United States Patent 7,250,496 (BIOINFORMATICALLY DETECTABLE GROUP OF NOVEL REGULATORY GENES AND USES THEREOF) - sequence listing, part 11

SEQ ID NO: 423084 - RNA, 19 nt, Human
ugggauuacaggcgugagc

SEQ ID NO: 423085 - RNA, 21 nt, Human
ugggauuacaggcgugagcca

SEQ ID NO: 423086 - RNA, 22 nt, Human
ugggauuacaggcgugagccac

SEQ ID NO: 423087 - RNA, 23 nt, Human
ugggauuacaggcgugagccacc

SEQ ID NO: 423088 - RNA, 24 nt, Human
ugggauuacaggcgugagccaccg

SEQ ID NO: 423089 - RNA, 24 nt, Human
ugggguuucacuguguuagccagg

SEQ ID NO: 423090 - RNA, 18 nt, Human
ugguuaagcccugggaaa

SEQ ID NO: 423091 - RNA, 18 nt, Human
ugguuaagcccugggaaa

SEQ ID NO: 423092 - RNA, 21 nt, Human
uguauuaacauuaagcagagg

SEQ ID NO: 423093 - RNA, 21 nt, Human
uguauuuuuaguagagauggg

SEQ ID NO: 423094 - RNA, 21 nt, Human
uguuagacaagcugauucaac

SEQ ID NO: 423095 - RNA, 24 nt, Human
uguuuuguauuuuuaguagagaug

SEQ ID NO: 423096 - RNA, 18 nt, Human
uuaguagagaugggguuu

SEQ ID NO: 423097 - RNA, 21 nt, Human
uuaguagagaugggguuucac

SEQ ID NO: 423098 - RNA, 21 nt, Human
uuaguagagaugggguuucac

SEQ ID NO: 423099 - RNA, 24 nt, Human
uuaguagagaugggguuucacugu

SEQ ID NO: 423100 - RNA, 21 nt, Human
uucaagaaaauuugcgcuuca

SEQ ID NO: 423101 - RNA, 22 nt, Human
uucacuguguuagccaggauga

SEQ ID NO: 423102 - RNA, 19 nt, Human
uucggccucccaaagugcu

SEQ ID NO: 423103 - RNA, 23 nt, Human
uucuccgccggccgccgccgagc

SEQ ID NO: 423104 - RNA, 23 nt, Human
uuguauuuuuaguagagaugggg

SEQ ID NO: 423105 - RNA, 19 nt, Human
uuucacuguguuagccagg

SEQ ID NO: 423106 - RNA, 19 nt, Human
uuugacaucucaugguacc

SEQ ID NO: 423107 - RNA, 20 nt, Human
uuuuguauuuuuaguagaga

SEQ ID NO: 423108 - RNA, 24 nt, Human
uuuuuaguagagaugggguuucac

SEQ ID NO: 423109 - RNA, 21 nt, Human
aaccccaagcaggacaaggga

SEQ ID NO: 423110 - RNA, 19 nt, Human
aaccgguaaaccuccaucu

SEQ ID NO: 423111 - RNA, 20 nt, Human
aacugcccaaagcccugcca

SEQ ID NO: 423112 - RNA, 22 nt, Human
aaggcccuaaauaaaagaauuc

SEQ ID NO: 423113 - RNA, 19 nt, Human
acaggccaguccagaggcc

SEQ ID NO: 423114 - RNA, 22 nt, Human
acauuuggaagcucuaaaaaca

SEQ ID NO: 423115 - RNA, 18 nt, Human
accaacugggugacucug

SEQ ID NO: 423116 - RNA, 21 nt, Human
accaauuccuaugaaccccaa

SEQ ID NO: 423117 - RNA, 20 nt, Human
accagaaaacuggccauuug

SEQ ID NO: 423118 - RNA, 21 nt, Human
acugggugacucugguugagu

SEQ ID NO: 423119 - RNA, 26 nt, Human
agaaauaauaaugggaacuucucaac

SEQ ID NO: 423120 - RNA, 19 nt, Human
agacagaaauggaggccaa

SEQ ID NO: 423121 - RNA, 21 nt, Human
agacagaaauggaggccaagg

SEQ ID NO: 423122 - RNA, 26 nt, Human
agacagaaauggaggccaagggucca

SEQ ID NO: 423123 - RNA, 22 nt, Human
agagcaaugucuggcacagaaa

SEQ ID NO: 423124 - RNA, 21 nt, Human
agaggucaccccaggcugcua

SEQ ID NO: 423125 - RNA, 19 nt, Human
agccuggccaacugcccaa

SEQ ID NO: 423126 - RNA, 24 nt, Human
agccuggccaacugcccaaagccc

SEQ ID NO: 423127 - RNA, 19 nt, Human
agcuucaaccucuucagcu

SEQ ID NO: 423128 - RNA, 18 nt, Human
aguguaggggugaagaga

SEQ ID NO: 423129 - RNA, 21 nt, Human
augggccugagcagcaccauc

SEQ ID NO: 423130 - RNA, 20 nt, Human
caaaccuaaucuguacccuu

SEQ ID NO: 423131 - RNA, 23 nt, Human
caaagcacugagagcaaugucug

SEQ ID NO: 423132 - RNA, 18 nt, Human
caaagcccugccagucag

SEQ ID NO: 423133 - RNA, 19 nt, Human
caaagcccugccagucagc

SEQ ID NO: 423134 - RNA, 24 nt, Human
caaccgguaaaccuccaucuuccu

SEQ ID NO: 423135 - RNA, 18 nt, Human
caaccuuuuccuuuuagc

SEQ ID NO: 423136 - RNA, 27 nt, Human
caauuccuaugaaccccaagcaggaca

SEQ ID NO: 423137 - RNA, 22 nt, Human
cagaaauaauaaugggaacuuc

SEQ ID NO: 423138 - RNA, 19 nt, Human
cagcucuagaggucacccc

SEQ ID NO: 423139 - RNA, 18 nt, Human
caggggccagacaggcca

SEQ ID NO: 423140 - RNA, 23 nt, Human
cauuuggaagcucuaaaaacagg

SEQ ID NO: 423141 - RNA, 22 nt, Human
ccaaagcccugccagucagcag

SEQ ID NO: 423142 - RNA, 21 nt, Human
ccaacugcccaaagcccugcc

SEQ ID NO: 423143 - RNA, 21 nt, Human
ccacaccccuaccugaaccug

SEQ ID NO: 423144 - RNA, 19 nt, Human
ccaguccagaggccuuacc

SEQ ID NO: 423145 - RNA, 18 nt, Human
ccauuacaguaccucuug

SEQ ID NO: 423146 - RNA, 22 nt, Human
cccaagacccaagauuugugcc

SEQ ID NO: 423147 - RNA, 18 nt, Human
cccacaccccuaccugaa

SEQ ID NO: 423148 - RNA, 19 nt, Human
cccacaccccuaccugaac

SEQ ID NO: 423149 - RNA, 22 nt, Human
cccauuacaguaccucuuggca

SEQ ID NO: 423150 - RNA, 23 nt, Human
ccccaagacccaagauuugugcc

SEQ ID NO: 423151 - RNA, 21 nt, Human
ccccuggagucccacagccuc

SEQ ID NO: 423152 - RNA, 22 nt, Human
ccuauucugacacauuuggaag

SEQ ID NO: 423153 - RNA, 22 nt, Human
ccuggccaacugcccaaagccc

SEQ ID NO: 423154 - RNA, 23 nt, Human
ccuggccaacugcccaaagcccu

SEQ ID NO: 423155 - RNA, 23 nt, Human
cuaccugaaccugucuuggucau

SEQ ID NO: 423156 - RNA, 19 nt, Human
cuggcauggucugcagcug

SEQ ID NO: 423157 - RNA, 21 nt, Human
gaaauggaggccaagggucca

SEQ ID NO: 423158 - RNA, 24 nt, Human
gagaaacuuaaccucaacaaugcc

SEQ ID NO: 423159 - RNA, 20 nt, Human
gagccuggccaacugcccaa

SEQ ID NO: 423160 - RNA, 21 nt, Human
gcagcccagaggauccgacca

SEQ ID NO: 423161 - RNA, 20 nt, Human
gcagcugggucucucaaggc

SEQ ID NO: 423162 - RNA, 22 nt, Human
gcaggacaagggagaagauuca

SEQ ID NO: 423163 - RNA, 22 nt, Human
ggaagagccuggccaacugccc

SEQ ID NO: 423164 - RNA, 21 nt, Human
ggaggccaaggguccagauca

SEQ ID NO: 423165 - RNA, 19 nt, Human
uaaaaacagggggaaaaua

SEQ ID NO: 423166 - RNA, 21 nt, Human
uaaacaaccgguaaaccucca

SEQ ID NO: 423167 - RNA, 24 nt, Human
uaccagaaaacuggccauuugguc

SEQ ID NO: 423168 - RNA, 18 nt, Human
uagagacaggcauuuuuc

SEQ ID NO: 423169 - RNA, 18 nt, Human
uagcuucaaccucuucag

SEQ ID NO: 423170 - RNA, 23 nt, Human
uaguccagaacagcuagagacag

SEQ ID NO: 423171 - RNA, 20 nt, Human
uaguuuuggugcgcugacgu

SEQ ID NO: 423172 - RNA, 22 nt, Human
uaugaaccccaagcaggacaag

SEQ ID NO: 423173 - RNA, 22 nt, Human
ucaaccucuucagcuuuaaacc

SEQ ID NO: 423174 - RNA, 22 nt, Human
uccagaucaggguaacuaaggc

SEQ ID NO: 423175 - RNA, 18 nt, Human
ucccacagccuccagcuc

SEQ ID NO: 423176 - RNA, 18 nt, Human
uccugaacacgggggccc

SEQ ID NO: 423177 - RNA, 18 nt, Human
uccugaacacgggggccc

SEQ ID NO: 423178 - RNA, 21 nt, Human
uccugaacacgggggccccug

SEQ ID NO: 423179 - RNA, 18 nt, Human
ucucaggggccagacagg

SEQ ID NO: 423180 - RNA, 22 nt, Human
ucucaggggccagacaggccag

SEQ ID NO: 423181 - RNA, 18 nt, Human
ucugcagcugggucucuc

SEQ ID NO: 423182 - RNA, 23 nt, Human
ucugcagcugggucucucaaggc

SEQ ID NO: 423183 - RNA, 21 nt, Human
ucuguuucuaaacaaccggua

SEQ ID NO: 423184 - RNA, 23 nt, Human
ugaaaaguuauuggccauaaggg

SEQ ID NO: 423185 - RNA, 18 nt, Human
ugaccuuucccugucucu

SEQ ID NO: 423186 - RNA, 22 nt, Human
ugcaauagauguguccugaaca

SEQ ID NO: 423187 - RNA, 21 nt, Human
uggcaaauguuugaugaccuu

SEQ ID NO: 423188 - RNA, 18 nt, Human
uggcauggucugcagcug

SEQ ID NO: 423189 - RNA, 22 nt, Human
uggcauggucugcagcuggguc

SEQ ID NO: 423190 - RNA, 18 nt, Human
uggugaaaaguuauuggc

SEQ ID NO: 423191 - RNA, 18 nt, Human
uguccugaacacgggggc

SEQ ID NO: 423192 - RNA, 19 nt, Human
ugucuggcacagaaaaggc

SEQ ID NO: 423193 - RNA, 20 nt, Human
ugugguuuggcaucuaaaga

SEQ ID NO: 423194 - RNA, 19 nt, Human
uguuugaugaccuugaggu

SEQ ID NO: 423195 - RNA, 23 nt, Human
uuaaccucaacaaugcccagguu

SEQ ID NO: 423196 - RNA, 21 nt, Human
uucagugagcuaauacaugca

SEQ ID NO: 423197 - RNA, 20 nt, Human
uucuugguuugacccacacc

SEQ ID NO: 423198 - RNA, 18 nt, Human
uuggucauuucagugggu

SEQ ID NO: 423199 - RNA, 20 nt, Human
uugguccuucugaaacgggc

SEQ ID NO: 423200 - RNA, 21 nt, Human
uuuccuaauacaauaaauaau

SEQ ID NO: 423201 - RNA, 22 nt, Human
uuuuuuuuuuuuuuuuucaggg

SEQ ID NO: 423202 - RNA, 23 nt, Human
aaaaggcagcaggagauccagaa

SEQ ID NO: 423203 - RNA, 21 nt, Human
aaggcagcaggagauccagaa

SEQ ID NO: 423204 - RNA, 25 nt, Human
acaaacuccagaaaagggggaacgc

SEQ ID NO: 423205 - RNA, 24 nt, Human
acacacaggcacacgcacgaguac

SEQ ID NO: 423206 - RNA, 31 nt, Human
acacgcacgaguacacacgcgcgcgcgcggu

SEQ ID NO: 423207 - RNA, 24 nt, Human
acccuggacaccuuggccagccuc

SEQ ID NO: 423208 - RNA, 22 nt, Human
accguguccccauucccagccc

SEQ ID NO: 423209 - RNA, 23 nt, Human
acuccagaaaaggcagcaggaga

SEQ ID NO: 423210 - RNA, 20 nt, Human
agagccagcuuugagccugg

SEQ ID NO: 423211 - RNA, 18 nt, Human
agaggaaaggggacuagg

SEQ ID NO: 423212 - RNA, 21 nt, Human
agcccagcaccugcugcagcc

SEQ ID NO: 423213 - RNA, 18 nt, Human
aggcacagggccaccagc

SEQ ID NO: 423214 - RNA, 22 nt, Human
aggcagggagugggcuagagga

SEQ ID NO: 423215 - RNA, 24 nt, Human
aguacacacgcgcgcgcgcgcgcg

SEQ ID NO: 423216 - RNA, 18 nt, Human
cacacacacacacacaca

SEQ ID NO: 423217 - RNA, 20 nt, Human
cagcccagcaccugcugcag

SEQ ID NO: 423218 - RNA, 33 nt, Human
caggcacacgcacgaguacacacgcgcgcggug

SEQ ID NO: 423219 - RNA, 20 nt, Human
cagggcccaggcacagggcc

SEQ ID NO: 423220 - RNA, 25 nt, Human
ccagcccagcaccugcugcagccuc

SEQ ID NO: 423221 - RNA, 24 nt, Human
ccagcuuugagccugggaggcgga

SEQ ID NO: 423222 - RNA, 18 nt, Human
ccccauucccagcccggc

SEQ ID NO: 423223 - RNA, 22 nt, Human
ccggcagcugugaggucacucc

SEQ ID NO: 423224 - RNA, 22 nt, Human
ccugcagagccagcuuugagcc

SEQ ID NO: 423225 - RNA, 19 nt, Human
ccugcagccaagggccugg

SEQ ID NO: 423226 - RNA, 21 nt, Human
ccugcagccaagggccugggc

SEQ ID NO: 423227 - RNA, 18 nt, Human
cgaguacacacgcgcgcg

SEQ ID NO: 423228 - RNA, 24 nt, Human
cucuugcccaggggaagucggaga

SEQ ID NO: 423229 - RNA, 18 nt, Human
gaccugugagucuuuaug

SEQ ID NO: 423230 - RNA, 18 nt, Human
gagccagcuuugagccug

SEQ ID NO: 423231 - RNA, 21 nt, Human
gagccugggaggcggaccugu

SEQ ID NO: 423232 - RNA, 22 nt, Human
gcauaggcuuguauucaggaac

SEQ ID NO: 423233 - RNA, 21 nt, Human
gcuuugagccugggaggcgga

SEQ ID NO: 423234 - RNA, 22 nt, Human
uacacacgcgcgcgcgcgcgcg

SEQ ID NO: 423235 - RNA, 21 nt, Human
uagaggaaaggggacuagguc

SEQ ID NO: 423236 - RNA, 18 nt, Human
ucccaucucuugcccagg

SEQ ID NO: 423237 - RNA, 21 nt, Human
ugagccugggaggcggaccug

SEQ ID NO: 423238 - RNA, 19 nt, Human
ugcaccucugccauaccuc

SEQ ID NO: 423239 - RNA, 20 nt, Human
ugcagccaagggccugggca

SEQ ID NO: 423240 - RNA, 22 nt, Human
ugccugcagccaagggccuggg

SEQ ID NO: 423241 - RNA, 21 nt, Human
uucacgcauaggcuuguauuc

SEQ ID NO: 423242 - RNA, 23 nt, Human
uugagccugggaggcggaccugu

SEQ ID NO: 423243 - RNA, 21 nt, Human
uuuacaaacuccagaaaaggc

SEQ ID NO: 423244 - RNA, 20 nt, Human
uuuuuuuuuuuuuuuuucac

SEQ ID NO: 423245 - RNA, 24 nt, Human
uuuuuuuuuuuuuuuuucacgcau

SEQ ID NO: 423246 - RNA, 24 nt, Human
cacaggucaggaaugggcgagcac

SEQ ID NO: 423247 - RNA, 18 nt, Human
gccaccuuucaugggacu

SEQ ID NO: 423248 - RNA, 18 nt, Human
gucaggaaugggcgagca

SEQ ID NO: 423249 - RNA, 18 nt, Human
ucuuuuuuuuuuuuuuuu

SEQ ID NO: 423250 - RNA, 18 nt, Human
ucuuuuuuuuuuuuuuuu

SEQ ID NO: 423251 - RNA, 20 nt, Human
ugacaggauugacuaacuuu

SEQ ID NO: 423252 - RNA, 24 nt, Human
ugacuaacuuuucccccauuugcu

SEQ ID NO: 423253 - RNA, 31 nt, Human; identical to SEQ ID NO: 289987

SEQ ID NO: 423254 - RNA, 32 nt, Human
uuuuuuuuucuuuuuuuuuuuuuuuuuuuuuu

SEQ ID NO: 423255 - RNA, 24 nt, Human
uuuuuuuuuuuuuuuuuucuuuuu

SEQ ID NO: 423256 - RNA, 24 nt, Human
uuuuuuuuuuuuuuuuuuucuuuu

SEQ ID NO: 423257 - RNA, 25 nt, Human
uuuuuuuuuuuuuuuuuuucuuuuu

SEQ ID NO: 423258 - RNA, 24 nt, Human
uuuuuuuuuuuuuuuuuuuucuuu

SEQ ID NO: 423259 - RNA, 18 nt, Human
aaaaggcugcagggagaa

SEQ ID NO: 423260 - RNA, 23 nt, Human
aacugaggagagaagagggacca

SEQ ID NO: 423261 - RNA, 23 nt, Human
aaggggaagaagagaggcagaga

SEQ ID NO: 423262 - RNA, 22 nt, Human
aauacugauuccaggaggcaaa

SEQ ID NO: 423263 - RNA, 21 nt, Human
acccagcacaauaaauaguuu

SEQ ID NO: 423264 - RNA, 18 nt, Human
acgcggcgguggcggcag

SEQ ID NO: 423265 - RNA, 24 nt, Human
agaaaggagagaagaguggagagg

SEQ ID NO: 423266 - RNA, 25 nt, Human
agaaaggagagaagaguggagaggg

SEQ ID NO: 423267 - RNA, 22 nt, Human
agaggaagaugcuacacuggug

SEQ ID NO: 423268 - RNA, 19 nt, Human
agaggcagagaggucgcug

SEQ ID NO: 423269 - RNA, 23 nt, Human
agcugcccuuuugcccuguaacc

SEQ ID NO: 423270 - RNA, 18 nt, Human
aggcauggcucacagcug

SEQ ID NO: 423271 - RNA, 18 nt, Human
agggagggagguaggucc

SEQ ID NO: 423272 - RNA, 26 nt, Human
agggagggagguagguccggggcagg

SEQ ID NO: 423273 - RNA, 23 nt, Human
aggggaagaagagaggcagagag

SEQ ID NO: 423274 - RNA, 18 nt, Human
caaggaaaagccaccaag

SEQ ID NO: 423275 - RNA, 21 nt, Human
caaggaaaagccaccaaguca

SEQ ID NO: 423276 - RNA, 23 nt, Human
cagcugcccuuuugcccuguaac

SEQ ID NO: 423277 - RNA, 19 nt, Human
caggacaaaggggaagaag

SEQ ID NO: 423278 - RNA, 20 nt, Human
caggacaaaggggaagaaga

SEQ ID NO: 423279 - RNA, 23 nt, Human
caggagccgaccccauggcggag

SEQ ID NO: 423280 - RNA, 20 nt, Human
cagggagaaaggagagaaga

SEQ ID NO: 423281 - RNA, 18 nt, Human
cagguaggaggaaguggg

SEQ ID NO: 423282 - RNA, 20 nt, Human
caucacagcugcccuuuugc

SEQ ID NO: 423283 - RNA, 18 nt, Human
ccagggaggcauggcuca

SEQ ID NO: 423284 - RNA, 20 nt, Human
ccaucaggagccgaccccau

SEQ ID NO: 423285 - RNA, 19 nt, Human
cccaggcaagugguuugag

SEQ ID NO: 423286 - RNA, 18 nt, Human
cccccaaccucauuucca

SEQ ID NO: 423287 - RNA, 22 nt, Human
ccgcggggagugugacuggagg

SEQ ID NO: 423288 - RNA, 18 nt, Human
ccggggcagguccaucag

SEQ ID NO: 423289 - RNA, 22 nt, Human
ccggggcagguccaucaggaug

SEQ ID NO: 423290 - RNA, 21 nt, Human
ccuggcuuugcccgcucugug

SEQ ID NO: 423291 - RNA, 22 nt, Human
ccuggcuuugcccgcucugugc

SEQ ID NO: 423292 - RNA, 23 nt, Human
cgauggagcaggcagaaugacac

SEQ ID NO: 423293 - RNA, 20 nt, Human
cucugugcugcaguugcggc

SEQ ID NO: 423294 - RNA, 20 nt, Human
cuuaggaggacccggagaaa

SEQ ID NO: 423295 - RNA, 20 nt, Human
cuuugcccgcucugugcugc

SEQ ID NO: 423296 - RNA, 20 nt, Human
gaagaagagaggcagagagg

SEQ ID NO: 423297 - RNA, 20 nt, Human
gaagaugcuacacugguggg

SEQ ID NO: 423298 - RNA, 20 nt, Human
gagaagaguggagagggauu

SEQ ID NO: 423299 - RNA, 24 nt, Human
gagagaagaguggagagggauugg

SEQ ID NO: 423300 - RNA, 24 nt, Human
gaggaguccccagguaggaggaag

SEQ ID NO: 423301 - RNA, 18 nt, Human
gaggcagagaggucgcug

SEQ ID NO: 423302 - RNA, 21 nt, Human
gaggcggccacggcgggcggc

SEQ ID NO: 423303 - RNA, 22 nt, Human
gagguggucuuugcaaaccagg

SEQ ID NO: 423304 - RNA, 21 nt, Human
gaugaggaggcaggacaggaa

SEQ ID NO: 423305 - RNA, 21 nt, Human
gcaggacaaaggggaagaaga

SEQ ID NO: 423306 - RNA, 21 nt, Human
gcaggacaaaggggaagaaga

SEQ ID NO: 423307 - RNA, 20 nt, Human
gcaguugcggcgacuuuggu

SEQ ID NO: 423308 - RNA, 19 nt, Human
gcccuguaaccuccugcuu

SEQ ID NO: 423309 - RNA, 18 nt, Human
ggaccagaaaaggcugca

SEQ ID NO: 423310 - RNA, 24 nt, Human
ggagagaagagggaccagaaaagg

SEQ ID NO: 423311 - RNA, 18 nt, Human
ggcuggugggcugaggcg

SEQ ID NO: 423312 - RNA, 21 nt, Human
ggcuggugggcugaggcggcc

SEQ ID NO: 423313 - RNA, 18 nt, Human
gggacgcggcgguggcgg

SEQ ID NO: 423314 - RNA, 21 nt, Human
gggacgcggcgguggcggcag

SEQ ID NO: 423315 - RNA, 19 nt, Human
gggagugguaaaaggggag

SEQ ID NO: 423316 - RNA, 23 nt, Human
gggcgaauaaccgggucuugagu

SEQ ID NO: 423317 - RNA, 22 nt, Human
gggguaggagguggcccaggga

SEQ ID NO: 423318 - RNA, 18 nt, Human
ggguaggagguggcccag

SEQ ID NO: 423319 - RNA, 24 nt, Human
ggguaggagguggcccagggaggc

SEQ ID NO: 423320 - RNA, 25 nt, Human
guacucgggugggcgaauaaccggg

SEQ ID NO: 423321 - RNA, 20 nt, Human
uacaacauccaaacucgugg

SEQ ID NO: 423322 - RNA, 19 nt, Human
uccaggaggcaaacgcauc

SEQ ID NO: 423323 - RNA, 22 nt, Human
uccccagguaggaggaaguggg

SEQ ID NO: 423324 - RNA, 23 nt, Human
ucgcggucccggcuggugggcca

SEQ ID NO: 423325 - RNA, 24 nt, Human
ucucccgcggagagggagggaggu

SEQ ID NO: 423326 - RNA, 21 nt, Human
ucugugcugcaguugcggcga

SEQ ID NO: 423327 - RNA, 19 nt, Human
ugacuggagguacucgggu

SEQ ID NO: 423328 - RNA, 21 nt, Human
ugaggagagaagagggaccag

SEQ ID NO: 423329 - RNA, 19 nt, Human
ugcaguugcggcgacuuug

SEQ ID NO: 423330 - RNA, 21 nt, Human
ugcccuguaaccuccugcuuc

SEQ ID NO: 423331 - RNA, 18 nt, Human
uggaaggaaauacugauu

SEQ ID NO: 423332 - RNA, 21 nt, Human
uggcaggagaauaggaaggga

SEQ ID NO: 423333 - RNA, 25 nt, Human
uggcggcaguggcgagaguucgcag

SEQ ID NO: 423334 - RNA, 21 nt, Human
uggggaggagaaaggcccuga

SEQ ID NO: 423335 - RNA, 20 nt, Human
uggguuggguuggagguggu

SEQ ID NO: 423336 - RNA, 18 nt, Human
uugcccgcucugugcugc

SEQ ID NO: 423337 - RNA, 21 nt, Human
uuugagaaacugaggagagaa

SEQ ID NO: 423338 - RNA, 25 nt, Human
uuugggggagggcucgaggagagcg

SEQ ID NO: 423339 - RNA, 25 nt, Human
aaacaggaaccaagaacaagucuca

SEQ ID NO: 423340 - RNA, 22 nt, Human
aaccguggggagacugcgcugg

SEQ ID NO: 423341 - RNA, 23 nt, Human
aaccguggggagacugcgcuggg

SEQ ID NO: 423342 - RNA, 22 nt, Human
aagaaggaaaaagaggcuccaa

SEQ ID NO: 423343 - RNA, 19 nt, Human
aaggaaaaagaggcuccaa

SEQ ID NO: 423344 - RNA, 19 nt, Human
acacaucccagaguccacc

SEQ ID NO: 423345 - RNA, 21 nt, Human
acccuuccugcugaagaagga

SEQ ID NO: 423346 - RNA, 19 nt, Human
accgcuuccccagcgccgc

SEQ ID NO: 423347 - RNA, 22 nt, Human
acuagugcugcuuaaaccgugg

SEQ ID NO: 423348 - RNA, 20 nt, Human
agaaaaaccucucuaccacu

SEQ ID NO: 423349 - RNA, 29 nt, Human
agcaaagggcugaaaaggcgccccucuca

SEQ ID NO: 423350 - RNA, 18 nt, Human
aggaaaaagaggcuccaa

SEQ ID NO: 423351 - RNA, 18 nt, Human
aggaaccaagaacaaguc

SEQ ID NO: 423352 - RNA, 21 nt, Human
aggaaccaagaacaagucuca

SEQ ID NO: 423353 - RNA, 22 nt, Human
aggcuacacaucccagagucca

SEQ ID NO: 423354 - RNA, 18 nt, Human
agggaccaagagugaccu

SEQ ID NO: 423355 - RNA, 19 nt, Human
agggaccaagagugaccuu

SEQ ID NO: 423356 - RNA, 18 nt, Human
aguccucuuccccagccc

SEQ ID NO: 423357 - RNA, 23 nt, Human
aucccuucccacccuuccugcug

SEQ ID NO: 423358 - RNA, 24 nt, Human
caagagggagcccaggcugcagua

SEQ ID NO: 423359 - RNA, 20 nt, Human
caccccuaaagcuguuucca

SEQ ID NO: 423360 - RNA, 20 nt, Human
cagagccgcauucuuccagg

SEQ ID NO: 423361 - RNA, 19 nt, Human
cagaguccaccugaccccc

SEQ ID NO: 423362 - RNA, 21 nt, Human
caucugaauggaaggagacaa

SEQ ID NO: 423363 - RNA, 25 nt, Human
ccaccugacccccaccaccccuaaa

SEQ ID NO: 423364 - RNA, 18 nt, Human
cccaagaaaaaccucucu

SEQ ID NO: 423365 - RNA, 21 nt, Human
cccaagaaaaaccucucuacc

SEQ ID NO: 423366 - RNA, 19 nt, Human
ccccaagguaaggcugacc

SEQ ID NO: 423367 - RNA, 23 nt, Human
ccccucagcacucugucucuuuc

SEQ ID NO: 423368 - RNA, 20 nt, Human
ccgcggccgccgggaggaag

SEQ ID NO: 423369 - RNA, 26 nt, Human
ccgggaggaagggagggaggaaggga

SEQ ID NO: 423370 - RNA, 19 nt, Human
ccggugggcagaucgauca

SEQ ID NO: 423371 - RNA, 23 nt, Human
ccuggacagacaacucucugagg

SEQ ID NO: 423372 - RNA, 21 nt, Human
cgagagagauagcaagccggc

SEQ ID NO: 423373 - RNA, 23 nt, Human
cgagcucaggguggcucugccgg

SEQ ID NO: 423374 - RNA, 26 nt, Human
cgggaggaagggagggaggaagggag

SEQ ID NO: 423375 - RNA, 22 nt, Human
cucaagggagaggaguggugaa

SEQ ID NO: 423376 - RNA, 23 nt, Human
gaaggaaaaagaggcuccaagag

SEQ ID NO: 423377 - RNA, 23 nt, Human
gaagggagggaggaagggaggga

SEQ ID NO: 423378 - RNA, 19 nt, Human
gagcucaggguggcucugc

SEQ ID NO: 423379 - RNA, 18 nt, Human
gaggaagggagggaggaa

SEQ ID NO: 423380 - RNA, 23 nt, Human
gaguccaccugacccccaccacc

SEQ ID NO: 423381 - RNA, 22 nt, Human
gcagaucgaucaggaccuccag

SEQ ID NO: 423382 - RNA, 19 nt, Human
gccaaaaggaguaugaauc

SEQ ID NO: 423383 - RNA, 20 nt, Human
gcucuggcuuugcucucacc

SEQ ID NO: 423384 - RNA, 19 nt, Human
ggaggaagggagggaggaa

SEQ ID NO: 423385 - RNA, 19 nt, Human
ggagggaggaagggaggga

SEQ ID NO: 423386 - RNA, 20 nt, Human
ggagggaggaagggagggag

SEQ ID NO: 423387 - RNA, 21 nt, Human
ggcgagcaaaggacugggggc

SEQ ID NO: 423388 - RNA, 20 nt, Human
gugggaggagcaauacagug

SEQ ID NO: 423389 - RNA, 25 nt, Human
uaacaucugaauggaaggagacaac

SEQ ID NO: 423390 - RNA, 18 nt, Human
uaaggagcagaagagggg

SEQ ID NO: 423391 - RNA, 20 nt, Human
ucaaacaggaaccaagaaca

SEQ ID NO: 423392 - RNA, 20 nt, Human
ucagagcaaagggcugaaaa

SEQ ID NO: 423393 - RNA, 22 nt, Human
uccaccugacccccaccacccc

SEQ ID NO: 423394 - RNA, 21 nt, Human
uccagggccgggccacuccuc

SEQ ID NO: 423395 - RNA, 21 nt, Human
uccagggccgggccacuccuc

SEQ ID NO: 423396 - RNA, 21 nt, Human
ucccacaagagggagcccagg

SEQ ID NO: 423397 - RNA, 18 nt, Human
ucccacccuuccugcuga

SEQ ID NO: 423398 - RNA, 18 nt, Human
ucccagaguccaccugac

SEQ ID NO: 423399 - RNA, 21 nt, Human
ucccagaguccaccugacccc

SEQ ID NO: 423400 - RNA, 25 nt, Human
ucccagaguccaccugacccccacc

SEQ ID NO: 423401 - RNA, 21 nt, Human
uccccagcgccgccgcggccg

SEQ ID NO: 423402 - RNA, 22 nt, Human
uccccagcgccgccgcggccgc

SEQ ID NO: 423403 - RNA, 20 nt, Human
ucgaagcccggaggcuccgg

SEQ ID NO: 423404 - RNA, 21 nt, Human
ucucccauuaucccacaagag

SEQ ID NO: 423405 - RNA, 19 nt, Human
ucugaggauucaggggaga

SEQ ID NO: 423406 - RNA, 23 nt, Human
ucugucucuuucccaagaaaaac

SEQ ID NO: 423407 - RNA, 22 nt, Human
ucuuccagggccgggccacucc

SEQ ID NO: 423408 - RNA, 21 nt, Human
ugaaacuauagggacucccca

SEQ ID NO: 423409 - RNA, 18 nt, Human
ugagaagugggaggagca

SEQ ID NO: 423410 - RNA, 22 nt, Human
ugagaagugggaggagcaauac

SEQ ID NO: 423411 - RNA, 25 nt, Human
ugccccucagcacucugucucuuuc

SEQ ID NO: 423412 - RNA, 20 nt, Human
ugcgcuggguucuguccccu

SEQ ID NO: 423413 - RNA, 19 nt, Human
uggaaggaaaucagagcaa

SEQ ID NO: 423414 - RNA, 19 nt, Human
ugguuugggugcggggucc

SEQ ID NO: 423415 - RNA, 19 nt, Human
ugucuaaggagcagaagag

SEQ ID NO: 423416 - RNA, 21 nt, Human
uucaucuuaguccauucaggu

SEQ ID NO: 423417 - RNA, 22 nt, Human
uuuuuuuuuuuuuuuuuuccag

SEQ ID NO: 423418 - RNA, 23 nt, Human
aaaaagcaaaaaacaaaagaaaa

SEQ ID NO: 423419 - RNA, 22 nt, Human
aaacaaaagaaaacauuuacaa

SEQ ID NO: 423420 - RNA, 21 nt, Human
aaaggaagaaaaagcaaaaaa

SEQ ID NO: 423421 - RNA, 24 nt, Human
aagaaaacauuuacaacccaagcu

SEQ ID NO: 423422 - RNA, 22 nt, Human
aagcaaaaaacaaaagaaaaca

SEQ ID NO: 423423 - RNA, 18 nt, Human
aagcuagugauuccaugu

SEQ ID NO: 423424 - RNA, 20 nt, Human
aagcuagugauuccaugugg

SEQ ID NO: 423425 - RNA, 18 nt, Human
acaccagccugugggcac

SEQ ID NO: 423426 - RNA, 23 nt, Human
agaaaaagcaaaaaacaaaagaa

SEQ ID NO: 423427 - RNA, 24 nt, Human
agaaaaagcaaaaaacaaaagaaa

SEQ ID NO: 423428 - RNA, 19 nt, Human
agcaggcucagaccccagg

SEQ ID NO: 423429 - RNA, 19 nt, Human
aggaagaaaaagcaaaaaa

SEQ ID NO: 423430 - RNA, 24 nt, Human
aggaagaaaaagcaaaaaacaaaa

SEQ ID NO: 423431 - RNA, 26 nt, Human
aggaagaaaaagcaaaaaacaaaaga

SEQ ID NO: 423432 - RNA, 21 nt, Human
aggcucagaccccaggguggg

SEQ ID NO: 423433 - RNA, 19 nt, Human
agggugggccagggggucc

SEQ ID NO: 423434 - RNA, 22 nt, Human
auuucuguagcuuccacauccc

SEQ ID NO: 423435 - RNA, 18 nt, Human
caaagcacaagccgccuc

SEQ ID NO: 423436 - RNA, 21 nt, Human
caaaggaagaaaaagcaaaaa

SEQ ID NO: 423437 - RNA, 26 nt, Human
caaaggaagaaaaagcaaaaaacaaa

SEQ ID NO: 423438 - RNA, 20 nt, Human
caccagccugugggcacucc

SEQ ID NO: 423439 - RNA, 25 nt, Human
caccagccugugggcacuccagagc

SEQ ID NO: 423440 - RNA, 21 nt, Human
cacgccgccugcagccgggga

SEQ ID NO: 423441 - RNA, 20 nt, Human
cacuccagagccucaggcug

SEQ ID NO: 423442 - RNA, 23 nt, Human
cagaccccagggugggccagggg

SEQ ID NO: 423443 - RNA, 18 nt, Human
cagcaggcucagacccca

SEQ ID NO: 423444 - RNA, 22 nt, Human
ccaaaggaagaaaaagcaaaaa

SEQ ID NO: 423445 - RNA, 18 nt, Human
cccaaaggaagaaaaagc

SEQ ID NO: 423446 - RNA, 24 nt, Human
cccaugccuggcaucuggaauuca

SEQ ID NO: 423447 - RNA, 19 nt, Human
ccccaaagaaaaagcuaug

SEQ ID NO: 423448 - RNA, 20 nt, Human
ccccagggugggccaggggg

SEQ ID NO: 423449 - RNA, 18 nt, Human
cccggggucacacccagg

SEQ ID NO: 423450 - RNA, 19 nt, Human
ccgccugcacggccgccgc

SEQ ID NO: 423451 - RNA, 21 nt, Human
ccgcugguccugcacgccgcc

SEQ ID NO: 423452 - RNA, 22 nt, Human
ccgcugguccugcacgccgccu

SEQ ID NO: 423453 - RNA, 24 nt, Human
ccugcagccggggagagcggaggc

SEQ ID NO: 423454 - RNA, 19 nt, Human
ccugcguggggcggagggc

SEQ ID NO: 423455 - RNA, 25 nt, Human
ccuuacaccagccugugggcacucc

SEQ ID NO: 423456 - RNA, 20 nt, Human
ccuuugauguccugcccucc

SEQ ID NO: 423457 - RNA, 20 nt, Human
cgaucccaagccccgcuccu

SEQ ID NO: 423458 - RNA, 21 nt, Human
cgccugcacggccgccgcugg

SEQ ID NO: 423459 - RNA, 18 nt, Human
cggcgggcgcgcccgggg

SEQ ID NO: 423460 - RNA, 22 nt, Human
cggggagagcggaggcggcggg

SEQ ID NO: 423461 - RNA, 24 nt, Human
cggggagagcggaggcggcggguu

SEQ ID NO: 423462 - RNA, 21 nt, Human
cgucgcgcggcgggcgcgccc

SEQ ID NO: 423463 - RNA, 23 nt, Human
cucagaccccagggugggccagg

SEQ ID NO: 423464 - RNA, 21 nt, Human
cuccagagccucaggcugcca

SEQ ID NO: 423465 - RNA, 20 nt, Human
gaaguccuccgccugcacgg

SEQ ID NO: 423466 - RNA, 18 nt, Human
gaggcuggucucuguggc

SEQ ID NO: 423467 - RNA, 23 nt, Human
gcaaagcacaagccgccucccau

SEQ ID NO: 423468 - RNA, 22 nt, Human
gcccagcaggcucagaccccag

SEQ ID NO: 423469 - RNA, 23 nt, Human
gccccgcuccuuacaccagccug

SEQ ID NO: 423470 - RNA, 22 nt, Human
gcgccgaaguccuccgccugca

SEQ ID NO: 423471 - RNA, 25 nt, Human
gcuaguuuuaaaauagagaucauua

SEQ ID NO: 423472 - RNA, 22 nt, Human
ggcccagcaggcucagacccca

SEQ ID NO: 423473 - RNA, 18 nt, Human
uaaagaggaauugagaag

SEQ ID NO: 423474 - RNA, 23 nt, Human
uacaacccaagcuagugauucca

SEQ ID NO: 423475 - RNA, 20 nt, Human
uauacauauauauuuauaua

SEQ ID NO: 423476 - RNA, 22 nt, Human
uauauaaagaggaauugagaag

SEQ ID NO: 423477 - RNA, 22 nt, Human
uauauacauauauauuuauaua

SEQ ID NO: 423478 - RNA, 24 nt, Human
uauauacauauauauuuauauaua

SEQ ID NO: 423479 - RNA, 19 nt, Human
uauauauauacauauauau

SEQ ID NO: 423480 - RNA, 28 nt, Human
uauauauauacauauauauuuauauaua

SEQ ID NO: 423481 - RNA, 22 nt, Human
ucacacccaggaggagccgcgc

SEQ ID NO: 423482 - RNA, 19 nt, Human
uccaagugaaggcaaagca

SEQ ID NO: 423483 - RNA, 22 nt, Human
uccacaucccaaaggaagaaaa

SEQ ID NO: 423484 - RNA, 21 nt, Human
ucccucugccagccccagggu

SEQ ID NO: 423485 - RNA, 18 nt, Human
uccugcacgccgccugca

SEQ ID NO: 423486 - RNA, 22 nt, Human
uccugcacgccgccugcagccg

SEQ ID NO: 423487 - RNA, 22 nt, Human
uccuuacaccagccugugggca

SEQ ID NO: 423488 - RNA, 22 nt, Human
ucuguagcuuccacaucccaaa

SEQ ID NO: 423489 - RNA, 21 nt, Human
ugagaagugccaccccaaaga

SEQ ID NO: 423490 - RNA, 20 nt, Human
ugagcagaguccucgcuccu

SEQ ID NO: 423491 - RNA, 19 nt, Human
ugcaggggcgggcuggggc

SEQ ID NO: 423492 - RNA, 21 nt, Human
ugccuggaaacuggagagcuc

SEQ ID NO: 423493 - RNA, 19 nt, Human
ugcguggggcggagggcag

SEQ ID NO: 423494 - RNA, 19 nt, Human
uggaauucacaagcagagc

SEQ ID NO: 423495 - RNA, 20 nt, Human
uggagagcucccucugccag

SEQ ID NO: 423496 - RNA, 23 nt, Human
uggcccugaaaggucaagucugu

SEQ ID NO: 423497 - RNA, 21 nt, Human
uuccaggguggccagaccuuc

SEQ ID NO: 423498 - RNA, 20 nt, Human
uucccggaggcuggucucug

SEQ ID NO: 423499 - RNA, 21 nt, Human
aaugccugcacucugagcagc

SEQ ID NO: 423500 - RNA, 19 nt, Human
accccacgcagcugggcug

SEQ ID NO: 423501 - RNA, 21 nt, Human
acgcugcuaggucugagccca

SEQ ID NO: 423502 - RNA, 23 nt, Human
agccugugcagguguagacccuu

SEQ ID NO: 423503 - RNA, 19 nt, Human
agguguagaccccucauac

SEQ ID NO: 423504 - RNA, 20 nt, Human
agguguagacccuucacacc

SEQ ID NO: 423505 - RNA, 22 nt, Human
cacagcaggguuggccaggccc

SEQ ID NO: 423506 - RNA, 18 nt, Human
cacccugcacagcagggu

SEQ ID NO: 423507 - RNA, 18 nt, Human
cacccugugcagcagggc

SEQ ID NO: 423508 - RNA, 23 nt, Human
cacgcugcuaggucugagcccag

SEQ ID NO: 423509 - RNA, 18 nt, Human
cacucugagcagcagggc

SEQ ID NO: 423510 - RNA, 18 nt, Human
cacugugugcaaugccug

SEQ ID NO: 423511 - RNA, 26 nt, Human
cagcugggcuggucgagcccaggaac

SEQ ID NO: 423512 - RNA, 18 nt, Human
cagggcugacugggccca

SEQ ID NO: 423513 - RNA, 21 nt, Human
caugugcaaugccugcacucu

SEQ ID NO: 423514 - RNA, 28 nt, Human
cccacgcugcuaggucugagcccaggga

SEQ ID NO: 423515 - RNA, 23 nt, Human
ccucacaccgugugcaaugccug

SEQ ID NO: 423516 - RNA, 20 nt, Human
ccucucaguccuugcaggag

SEQ ID NO: 423517 - RNA, 18 nt, Human
ccugcaccccaugcagcu

SEQ ID NO: 423518 - RNA, 18 nt, Human
ccugcacucugagcagca

SEQ ID NO: 423519 - RNA, 22 nt, Human
ccugugccaugugcagcagggc

SEQ ID NO: 423520 - RNA, 21 nt, Human
cgugugcaaugccugcacccu

SEQ ID NO: 423521 - RNA, 22 nt, Human
cucacaccgugugcaaugccug

SEQ ID NO: 423522 - RNA, 20 nt, Human
cuggcugggcccagggauuc

SEQ ID NO: 423523 - RNA, 19 nt, Human
cugugcaaugccugcaccc

SEQ ID NO: 423524 - RNA, 22 nt, Human
cugugugcaaugccuguacccc

SEQ ID NO: 423525 - RNA, 21 nt, Human
gacucagcccaugcaggugua

SEQ ID NO: 423526 - RNA, 18 nt, Human
gagcagcagggcugacug

SEQ ID NO: 423527 - RNA, 19 nt, Human
gagcagcagggcugacugg

SEQ ID NO: 423528 - RNA, 19 nt, Human
gcaaugccugcaccccaug

SEQ ID NO: 423529 - RNA, 19 nt, Human
gcaaugccuguaccccacg

SEQ ID NO: 423530 - RNA, 19 nt, Human
gcccggggacucgucccuu

SEQ ID NO: 423531 - RNA, 21 nt, Human
gccuguaccccacgcagcugg

SEQ ID NO: 423532 - RNA, 20 nt, Human
gugugcaaugccugugccau

SEQ ID NO: 423533 - RNA, 21 nt, Human
ucacaccaugugcaaugccug

SEQ ID NO: 423534 - RNA, 25 nt, Human
ucagcccaugcagguguagaccccg

SEQ ID NO: 423535 - RNA, 23 nt, Human
ucccuugcagguguagaccuucu

SEQ ID NO: 423536 - RNA, 22 nt, Human
uccuugcagguguagaccccuc

SEQ ID NO: 423537 - RNA, 23 nt, Human
ucucacaccaugugcaaugccug

SEQ ID NO: 423538 - RNA, 25 nt, Human
ugagcccagggacucaggaccaaag

SEQ ID NO: 423539 - RNA, 21 nt, Human
ugcaaugccugcacccugugc

SEQ ID NO: 423540 - RNA, 18 nt, Human
ugccugugccaugugcag

SEQ ID NO: 423541 - RNA, 19 nt, Human
uggcagguguaggcccauu

SEQ ID NO: 423542 - RNA, 19 nt, Human
uggccaggcccggggacuc

SEQ ID NO: 423543 - RNA, 20 nt, Human
uguacacuccucacaccgug

SEQ ID NO: 423544 - RNA, 20 nt, Human
uguagacccuucacaccgug

SEQ ID NO: 423545 - RNA, 23 nt, Human
uguagacccuucacaccgugugc

SEQ ID NO: 423546 - RNA, 21 nt, Human
uguagaccuucucacaccaug

SEQ ID NO: 423547 - RNA, 18 nt, Human
aaaaggcuggccaaggaa

SEQ ID NO: 423548 - RNA, 28 nt, Human
aggcaaaaggcuggccaaggaauggugg

SEQ ID NO: 423549 - RNA, 22 nt, Human
agggugccacaggagguccugg

SEQ ID NO: 423550 - RNA, 22 nt, Human
auagccccucucucccguccaa

SEQ ID NO: 423551 - RNA, 19 nt, Human
cacucugcccuccucucca

SEQ ID NO: 423552 - RNA, 19 nt, Human
ccccucucucccguccaaa

SEQ ID NO: 423553 - RNA, 20 nt, Human
cccuuauuucccuccauguc

SEQ ID NO: 423554 - RNA, 20 nt, Human
cgugugcauuggcacacaug

SEQ ID NO: 423555 - RNA, 21 nt, Human
cucacucugcccuccucucca

SEQ ID NO: 423556 - RNA, 21 nt, Human
cucccguccaaaauuucaguc

SEQ ID NO: 423557 - RNA, 25 nt, Human
cucugcccuccucuccaaguccuca

SEQ ID NO: 423558 - RNA, 21 nt, Human
cucuuuguugaguaucgaggg

SEQ ID NO: 423559 - RNA, 20 nt, Human
cuggcggcgcugcgcccucu

SEQ ID NO: 423560 - RNA, 20 nt, Human
cuugaagggugccacaggag

SEQ ID NO: 423561 - RNA, 27 nt, Human
cuugaagggugccacaggagguccugg

SEQ ID NO: 423562 - RNA, 21 nt, Human
gaagcaagauggaauagcccc

SEQ ID NO: 423563 - RNA, 19 nt, Human
uagccccucucucccgucc

SEQ ID NO: 423564 - RNA, 23 nt, Human
ucccuccaugucuuucucacucu

SEQ ID NO: 423565 - RNA, 22 nt, Human
uccucuccaaguccucaacaag

SEQ ID NO: 423566 - RNA, 19 nt, Human
ucucacucugcccuccucu

SEQ ID NO: 423567 - RNA, 19 nt, Human
ucucccuuauuucccucca

SEQ ID NO: 423568 - RNA, 25 nt, Human
ucucccuuauuucccuccaugucuu

SEQ ID NO: 423569 - RNA, 24 nt, Human
ugccacaggagguccuggcagugc

SEQ ID NO: 423570 - RNA, 18 nt, Human
uggaauagccccucucuc

SEQ ID NO: 423571 - RNA, 23 nt, Human
uggcacacaugccgguuuaugca

SEQ ID NO: 423572 - RNA, 19 nt, Human
aaagcucugcgcgccuccc

SEQ ID NO: 423573 - RNA, 23 nt, Human
aaaguuaagucaggggcaguuga

SEQ ID NO: 423574 - RNA, 23 nt, Human
aaauauccccccagaaagaaccc

SEQ ID NO: 423575 - RNA, 23 nt, Human
aacaccaggagauggauagaaua

SEQ ID NO: 423576 - RNA, 18 nt, Human
aaccacuuguacagacaa

SEQ ID NO: 423577 - RNA, 21 nt, Human
aaggacacacguccccaccuu

SEQ ID NO: 423578 - RNA, 20 nt, Human
aauugggaccauuuguggga

SEQ ID NO: 423579 - RNA, 20 nt, Human
acuuaaaaggguauugaaag

SEQ ID NO: 423580 - RNA, 19 nt, Human
agaaagaacccaaaggucc

SEQ ID NO: 423581 - RNA, 19 nt, Human
agcgagcgccugcagcccg

SEQ ID NO: 423582 - RNA, 21 nt, Human
agcgauaaaggccagcccgga

SEQ ID NO: 423583 - RNA, 23 nt, Human
agcggcagcgagcgccugcagcc

SEQ ID NO: 423584 - RNA, 21 nt, Human
agggaggaagagggggcuucc

SEQ ID NO: 423585 - RNA, 22 nt, Human
auacaacacaccauaguaccaa

SEQ ID NO: 423586 - RNA, 22 nt, Human
auccccccagaaagaacccaaa

SEQ ID NO: 423587 - RNA, 19 nt, Human
aucugagagaaguauggaa

SEQ ID NO: 423588 - RNA, 24 nt, Human
caaagcaaucccuuucugaggcuu

SEQ ID NO: 423589 - RNA, 22 nt, Human
cacaccauaguaccaaaggaca

SEQ ID NO: 423590 - RNA, 23 nt, Human
cacacguccccaccuuguuacau

SEQ ID NO: 423591 - RNA, 21 nt, Human
cagaaagaacccaaaggucca

SEQ ID NO: 423592 - RNA, 18 nt, Human
cagaacaccaggagaugg

SEQ ID NO: 423593 - RNA, 20 nt, Human
cagauuuuaauauggcaaua

SEQ ID NO: 423594 - RNA, 22 nt, Human
cagcccaauuccccagcggcag

SEQ ID NO: 423595 - RNA, 21 nt, Human
ccacuuguacagacaaaaguu

SEQ ID NO: 423596 - RNA, 20 nt, Human
ccauauucacccaauaguua

SEQ ID NO: 423597 - RNA, 22 nt, Human
cccagaaagaacccaaaggucc

SEQ ID NO: 423598 - RNA, 20 nt, Human
ccccagggaggaagaggggg

SEQ ID NO: 423599 - RNA, 18 nt, Human
cccccagggaggaagagg

SEQ ID NO: 423600 - RNA, 23 nt, Human
ccccccgcucgguccugcgacga

SEQ ID NO: 423601 - RNA, 21 nt, Human
cccccgccccccgcucggucc

SEQ ID NO: 423602 - RNA, 20 nt, Human
cccgcucgguccugcgacga

SEQ ID NO: 423603 - RNA, 20 nt, Human
ccgccccccgcucgguccug

SEQ ID NO: 423604 - RNA, 18 nt, Human
ccuggggcccccagggag

SEQ ID NO: 423605 - RNA, 23 nt, Human
cgcccccgccccccgcucggucc

SEQ ID NO: 423606 - RNA, 19 nt, Human
cgccgcgcccccgcccccc

SEQ ID NO: 423607 - RNA, 21 nt, Human
cgccgcgcccccgccccccgc

SEQ ID NO: 423608 - RNA, 19 nt, Human
cucgccgcgcccccgcccc

SEQ ID NO: 423609 - RNA, 23 nt, Human
gaacagccugucaugcuauuucc

SEQ ID NO: 423610 - RNA, 18 nt, Human
gagaacucgccaggaggg

SEQ ID NO: 423611 - RNA, 18 nt, Human
gagacaguggucugggcc

SEQ ID NO: 423612 - RNA, 19 nt, Human
gagcgccugcagcccgaaa

SEQ ID NO: 423613 - RNA, 18 nt, Human
gccgcgcccccgcccccc

SEQ ID NO: 423614 - RNA, 21 nt, Human
ggcaauaaaugccuugaaaaa

SEQ ID NO: 423615 - RNA, 20 nt, Human
gggaagacauugagaaagcu

SEQ ID NO: 423616 - RNA, 19 nt, Human
gggaagguggauggugacg

SEQ ID NO: 423617 - RNA, 25 nt, Human
ggggcccccagggaggaagaggggg

SEQ ID NO: 423618 - RNA, 22 nt, Human
guaaaaccacuuguacagacaa

SEQ ID NO: 423619 - RNA, 20 nt, Human
guaggcuuuaggugcagcgu

SEQ ID NO: 423620 - RNA, 18 nt, Human
gucaggggcaguugauuc

SEQ ID NO: 423621 - RNA, 19 nt, Human
guggucugggcccaccacc

SEQ ID NO: 423622 - RNA, 19 nt, Human
uacaacacaccauaguacc

SEQ ID NO: 423623 - RNA, 23 nt, Human
uacaacacaccauaguaccaaag

SEQ ID NO: 423624 - RNA, 25 nt, Human
uaggaaauauccccccagaaagaac

SEQ ID NO: 423625 - RNA, 23 nt, Human
ucagauuuuaauauggcaauaaa

SEQ ID NO: 423626 - RNA, 22 nt, Human
uccccagcggcagcgagcgccu

SEQ ID NO: 423627 - RNA, 19 nt, Human
uccuuguagaagggaaggu

SEQ ID NO: 423628 - RNA, 24 nt, Human
ucgccgcgcccccgccccccgcuc

SEQ ID NO: 423629 - RNA, 18 nt, Human
ugaaagccauucuucucc

SEQ ID NO: 423630 - RNA, 21 nt, Human
ugaaagccauucuucuccagg

SEQ ID NO: 423631 - RNA, 23 nt, Human
ugacugcagaacaccaggagaug

SEQ ID NO: 423632 - RNA, 22 nt, Human
ugagacacuuuuuuuucugcuu

SEQ ID NO: 423633 - RNA, 22 nt, Human
ugagauaaaggccacaugccuu

SEQ ID NO: 423634 - RNA, 25 nt, Human
aaagcccccuucuuuaaaaaccaca

SEQ ID NO: 423635 - RNA, 20 nt, Human
aaccacacaccauccagagu

SEQ ID NO: 423636 - RNA, 25 nt, Human
aagaaagcccccuucuuuaaaaacc

SEQ ID NO: 423637 - RNA, 21 nt, Human
acaggcgaguugggucugggu

SEQ ID NO: 423638 - RNA, 21 nt, Human
acaggcgaguugggucugggu

SEQ ID NO: 423639 - RNA, 21 nt, Human
accaugaagagggggagcgac

SEQ ID NO: 423640 - RNA, 20 nt, Human
acccuagagaacuaaaaaga

SEQ ID NO: 423641 - RNA, 22 nt, Human
aggaggaaguuugcccgcgacc

SEQ ID NO: 423642 - RNA, 18 nt, Human
aggcgaguugggucuggg

SEQ ID NO: 423643 - RNA, 22 nt, Human
caauaguuggaacaaaguccac

SEQ ID NO: 423644 - RNA, 18 nt, Human
caccauccagaguagggu

SEQ ID NO: 423645 - RNA, 22 nt, Human
cacuugagauuggaaaugacuu

SEQ ID NO: 423646 - RNA, 25 nt, Human
cagacccuagagaacuaaaaagaaa

SEQ ID NO: 423647 - RNA, 26 nt, Human
cccccaauaguuggaacaaaguccac

SEQ ID NO: 423648 - RNA, 21 nt, Human
cggcucuagguccugcuuccc

SEQ ID NO: 423649 - RNA, 22 nt, Human
cugaauccgcccagccacacac

SEQ ID NO: 423650 - RNA, 18 nt, Human
cuucaccccuucccagcg

SEQ ID NO: 423651 - RNA, 19 nt, Human
cuucccagcgcccuggugc

SEQ ID NO: 423652 - RNA, 21 nt, Human
gcugaauccgcccagccacac

SEQ ID NO: 423653 - RNA, 21 nt, Human
gcugugcccggcucuaggucc

SEQ ID NO: 423654 - RNA, 20 nt, Human
ggagagccuccccguccaca

SEQ ID NO: 423655 - RNA, 19 nt, Human
uaaaaaccacacaccaucc

SEQ ID NO: 423656 - RNA, 19 nt, Human
uaaaaagaaagcccccuuc

SEQ ID NO: 423657 - RNA, 22 nt, Human
uagagaacuaaaaagaaagccc

SEQ ID NO: 423658 - RNA, 20 nt, Human
uaucagacccuagagaaccg

SEQ ID NO: 423659 - RNA, 22 nt, Human
ucagacccuagagaacuaaaaa

SEQ ID NO: 423660 - RNA, 18 nt, Human
uccacuugagauuggaaa

SEQ ID NO: 423661 - RNA, 26 nt, Human
uccagaguagggugagaaauguaaga

SEQ ID NO: 423662 - RNA, 24 nt, Human
uccgcccagccacacacuucaccc

SEQ ID NO: 423663 - RNA, 23 nt, Human
ucgcugaauccgcccagccacac

SEQ ID NO: 423664 - RNA, 19 nt, Human
ucuuuaaaaaccacacacc

SEQ ID NO: 423665 - RNA, 18 nt, Human
ugaagagggggagcgacg

SEQ ID NO: 423666 - RNA, 23 nt, Human
ugcccggcucuagguccugcuuc

SEQ ID NO: 423667 - RNA, 21 nt, Human
uuuuuuuuuuuuucuuuaaca

SEQ ID NO: 423668 - RNA, 30 nt, Human
aaaaccccacuccuaaggaggcgcuccgcc

SEQ ID NO: 423669 - RNA, 20 nt, Human
aaaccucccgaacgccccca

SEQ ID NO: 423670 - RNA, 22 nt, Human
aaccaaaaacgcagaauuugag

SEQ ID NO: 423671 - RNA, 23 nt, Human
aaccaaaaacgcagaauuugagg

SEQ ID NO: 423672 - RNA, 18 nt, Human
aacgcagagccccucccc

SEQ ID NO: 423673 - RNA, 23 nt, Human
aacgcccccaaaugagaccagca

SEQ ID NO: 423674 - RNA, 25 nt, Human
aagaagccucauccaccauaaaacc

SEQ ID NO: 423675 - RNA, 18 nt, Human
aagcccugucccacccaa

SEQ ID NO: 423676 - RNA, 23 nt, Human
aagccucauccaccauaaaaccc

SEQ ID NO: 423677 - RNA, 18 nt, Human
aaggagccuaugcaggcc

SEQ ID NO: 423678 - RNA, 19 nt, Human
aaggaggcgcuccgcccuc

SEQ ID NO: 423679 - RNA, 23 nt, Human
acaggcgucggcgcgccuggagc

SEQ ID NO: 423680 - RNA, 18 nt, Human
acaguggcagaggcugag

SEQ ID NO: 423681 - RNA, 21 nt, Human
accauuucuccagucccgcca

SEQ ID NO: 423682 - RNA, 19 nt, Human
acccagagccacagccccc

SEQ ID NO: 423683 - RNA, 19 nt, Human
accccacuccuaaggaggc

SEQ ID NO: 423684 - RNA, 20 nt, Human
agaagccuaccuagugcccc

SEQ ID NO: 423685 - RNA, 21 nt, Human
agaauuugaggcagaggaugg

SEQ ID NO: 423686 - RNA, 18 nt, Human
agagaagccccacccaca

SEQ ID NO: 423687 - RNA, 19 nt, Human
agagacgggcggggccugg

SEQ ID NO: 423688 - RNA, 31 nt, Human
agagccccuccccauccuggagcuccgccuu

SEQ ID NO: 423689 - RNA, 23 nt, Human
agaggcuucuaucucuccuguag

SEQ ID NO: 423690 - RNA, 20 nt, Human
agcuggauggagugcaggug

SEQ ID NO: 423691 - RNA, 24 nt, Human
aggaggagccccgccugcagguag

SEQ ID NO: 423692 - RNA, 19 nt, Human
aggcagggcccgccccguc

SEQ ID NO: 423693 - RNA, 22 nt, Human
aggccacgcccacccagagcca

SEQ ID NO: 423694 - RNA, 21 nt, Human
aggcgucggcgcgccuggagc

SEQ ID NO: 423695 - RNA, 18 nt, Human
aggggccuugcccugguc

SEQ ID NO: 423696 - RNA, 23 nt, Human
aggggcuguggacaggcggagga

SEQ ID NO: 423697 - RNA, 20 nt, Human
agggggccggcccaucucag

SEQ ID NO: 423698 - RNA, 23 nt, Human
agguggguggucaaaccccaggc

SEQ ID NO: 423699 - RNA, 21 nt, Human
caaaccccaggcugaggaagg

SEQ ID NO: 423700 - RNA, 22 nt, Human
caacgcagagccccuccccauc

SEQ ID NO: 423701 - RNA, 20 nt, Human
cacaggaaggagccuaugca

SEQ ID NO: 423702 - RNA, 22 nt, Human
cacaggaaggagccuaugcagg

SEQ ID NO: 423703 - RNA, 21 nt, Human
cacagucgggggguugaugcc

SEQ ID NO: 423704 - RNA, 21 nt, Human
cacuccuaaggaggcgcuccg

SEQ ID NO: 423705 - RNA, 21 nt, Human
caggaagaagccucauccacc

SEQ ID NO: 423706 - RNA, 24 nt, Human
caggccacgcccacccagagccac

SEQ ID NO: 423707 - RNA, 22 nt, Human
cagggagcagccuaccccagag

SEQ ID NO: 423708 - RNA, 21 nt, Human
ccacccagagccacagccccc

SEQ ID NO: 423709 - RNA, 18 nt, Human
ccacccagggaaaagccc

SEQ ID NO: 423710 - RNA, 25 nt, Human
ccacccgcggagagaagccccgccc

SEQ ID NO: 423711 - RNA, 20 nt, Human
ccagccaccagagaggagac

SEQ ID NO: 423712 - RNA, 20 nt, Human
ccaggaagggggccggccca

SEQ ID NO: 423713 - RNA, 21 nt, Human
cccacccagagccacagcccc

SEQ ID NO: 423714 - RNA, 19 nt, Human
cccacccagagccacgccc

SEQ ID NO: 423715 - RNA, 19 nt, Human
cccagcucgacgcaggggu

SEQ ID NO: 423716 - RNA, 19 nt, Human
ccccaaaccucccgaacgc

SEQ ID NO: 423717 - RNA, 22 nt, Human
ccccaggcugaggaaggggugg

SEQ ID NO: 423718 - RNA, 19 nt, Human
ccccgcccacccagagcca

SEQ ID NO: 423719 - RNA, 19 nt, Human
ccccuccccauccuggagc

SEQ ID NO: 423720 - RNA, 22 nt, Human
cccgcccaaucuguagccccgc

SEQ ID NO: 423721 - RNA, 19 nt, Human
cccgccccguccaggggga

SEQ ID NO: 423722 - RNA, 18 nt, Human
ccucaggcagggcccgcc

SEQ ID NO: 423723 - RNA, 19 nt, Human
ccugccuucagguaggagu

SEQ ID NO: 423724 - RNA, 18 nt, Human
cgagggcagggaggaggg

SEQ ID NO: 423725 - RNA, 23 nt, Human
cgcccccagggaggaguacugcc

SEQ ID NO: 423726 - RNA, 21 nt, Human
cucauccaccauaaaacccca

SEQ ID NO: 423727 - RNA, 28 nt, Human
cugcccccagguaggagccccacccccu

SEQ ID NO: 423728 - RNA, 19 nt, Human
cugggcagcugcaaagaag

SEQ ID NO: 423729 - RNA, 19 nt, Human
gacccgacucgcuucaugg

SEQ ID NO: 423730 - RNA, 26 nt, Human
gagaagccccgcccaaucuguagccc

SEQ ID NO: 423731 - RNA, 18 nt, Human
gagaagcucugccccauc

SEQ ID NO: 423732 - RNA, 20 nt, Human
gagcagagcagagacgggcg

SEQ ID NO: 423733 - RNA, 20 nt, Human
gagccccgccuccuucagga

SEQ ID NO: 423734 - RNA, 26 nt, Human
gagccccuccccauccuggggcacuc

SEQ ID NO: 423735 - RNA, 18 nt, Human
gagcgugagcgccggggg

SEQ ID NO: 423736 - RNA, 18 nt, Human
gaggaaagggagggacgg

SEQ ID NO: 423737 - RNA, 21 nt, Human
gcagagccccuccccauccug

SEQ ID NO: 423738 - RNA, 19 nt, Human
gcagaggauggcggugugc

SEQ ID NO: 423739 - RNA, 21 nt, Human
gccaggaagggggccggccca

SEQ ID NO: 423740 - RNA, 25 nt, Human
gccccgagagcgugagcgccggggg

SEQ ID NO: 423741 - RNA, 21 nt, Human
gccgcgcgagagggcgcggag

SEQ ID NO: 423742 - RNA, 21 nt, Human
gcggagagaagccccgcccca

SEQ ID NO: 423743 - RNA, 22 nt, Human
gcggaugagucaggaggggccg

SEQ ID NO: 423744 - RNA, 20 nt, Human
ggaaaagcccacccucaggg

SEQ ID NO: 423745 - RNA, 26 nt, Human
ggagaagccaacgcagagccccuccc

SEQ ID NO: 423746 - RNA, 21 nt, Human
ggaggagccccgccugcaggu

SEQ ID NO: 423747 - RNA, 23 nt, Human
ggauggaaccuuacaggggguug

SEQ ID NO: 423748 - RNA, 19 nt, Human
ggcagaggauggcggugug

SEQ ID NO: 423749 - RNA, 20 nt, Human
ggcagggaggaggggcuggg

SEQ ID NO: 423750 - RNA, 19 nt, Human
gggcagggcgggccucuuu

SEQ ID NO: 423751 - RNA, 24 nt, Human
gggccggguggguucagcggccuc

SEQ ID NO: 423752 - RNA, 23 nt, Human
gggcgggccucuuugggagggcc

SEQ ID NO: 423753 - RNA, 20 nt, Human
gggcggggccuggggcgcag

SEQ ID NO: 423754 - RNA, 19 nt, Human
ggggaugagguggcuggug

SEQ ID NO: 423755 - RNA, 20 nt, Human
ggggccggcccaucucaggg

SEQ ID NO: 423756 - RNA, 18 nt, Human
gggguugggggcugggag

SEQ ID NO: 423757 - RNA, 19 nt, Human
ggguggucaaaccccaggc

SEQ ID NO: 423758 - RNA, 18 nt, Human
ggguugggggcugggagg

SEQ ID NO: 423759 - RNA, 18 nt, Human
gguugggggcugggaggc

SEQ ID NO: 423760 - RNA, 18 nt, Human
gucccuguccucucccag

SEQ ID NO: 423761 - RNA, 19 nt, Human
uaaaaccccacuccuaagg

SEQ ID NO: 423762 - RNA, 18 nt, Human
uagagccccgccuccuuc

SEQ ID NO: 423763 - RNA, 21 nt, Human
uagcuggauggagugcaggug

SEQ ID NO: 423764 - RNA, 19 nt, Human
uaggaguucugcccccagg

SEQ ID NO: 423765 - RNA, 23 nt, Human
uauaacauuaaaaccaaaaacgc

SEQ ID NO: 423766 - RNA, 24 nt, Human
ucagcggccuccccauucauuccc

SEQ ID NO: 423767 - RNA, 21 nt, Human
ucaggcagggcccgccccguc

SEQ ID NO: 423768 - RNA, 24 nt, Human
ucauccaccauaaaaccccacucc

SEQ ID NO: 423769 - RNA, 20 nt, Human
ucauucaggagcagcccagc

SEQ ID NO: 423770 - RNA, 23 nt, Human
uccaggaagaagccucauccacc

SEQ ID NO: 423771 - RNA, 21 nt, Human
ucccagagaagccccacccac

SEQ ID NO: 423772 - RNA, 21 nt, Human
ucccaggacuaagcuuggucu

SEQ ID NO: 423773 - RNA, 26 nt, Human
ucccaggggcacggguuggggacccc

SEQ ID NO: 423774 - RNA, 24 nt, Human
uccuagagccccgccuccuucagg

SEQ ID NO: 423775 - RNA, 21 nt, Human
ucucagggcugugggaccuuc

SEQ ID NO: 423776 - RNA, 19 nt, Human
ugagcgccggggggggccg

SEQ ID NO: 423777 - RNA, 18 nt, Human
ugaggaagggguggcaca

SEQ ID NO: 423778 - RNA, 22 nt, Human
ugaggaagggguggcacaggcg

SEQ ID NO: 423779 - RNA, 25 nt, Human
ugaggcagaggauggcggugugccc

SEQ ID NO: 423780 - RNA, 22 nt, Human
ugagguggcuggugggcugaau

SEQ ID NO: 423781 - RNA, 23 nt, Human
ugcaaagaagggggcgcagcuga

SEQ ID NO: 423782 - RNA, 19 nt, Human
ugccccgcccacccagagc

SEQ ID NO: 423783 - RNA, 20 nt, Human
ugccccgcccacccagagcc

SEQ ID NO: 423784 - RNA, 21 nt, Human
ugccccgcccacccagagcca

SEQ ID NO: 423785 - RNA, 24 nt, Human
ugcccuggucaggagaagcucugc

SEQ ID NO: 423786 - RNA, 20 nt, Human
uggacaggcggaggaaaggg

SEQ ID NO: 423787 - RNA, 19 nt, Human
uggcagaggcugaggggcg

SEQ ID NO: 423788 - RNA, 19 nt, Human
uggcaggaguaccugacgg

SEQ ID NO: 423789 - RNA, 20 nt, Human
ugggcagccuggggggcugg

SEQ ID NO: 423790 - RNA, 26 nt, Human
ugggcagcugcaaagaagggggcgca

SEQ ID NO: 423791 - RNA, 20 nt, Human
uggggggcuggaccucucuu

SEQ ID NO: 423792 - RNA, 20 nt, Human
uggugggcugaauuuccugc

SEQ ID NO: 423793 - RNA, 21 nt, Human
uugaggcagaggauggcggga

SEQ ID NO: 423794 - RNA, 20 nt, Human
uuggagaggggcccucggau

SEQ ID NO: 423795 - RNA, 23 nt, Human
uugggggcugggaggcccuucag

SEQ ID NO: 423796 - RNA, 24 nt, Human
uugggggcugggaggcccuucagg

SEQ ID NO: 423797 - RNA, 19 nt, Human
aggugguugccggcgcagg

SEQ ID NO: 423798 - RNA, 20 nt, Human
cgcccggcccggggcagcgg

SEQ ID NO: 423799 - RNA, 25 nt, Human
cgccgcgggcgcccggcccggggca

SEQ ID NO: 423800 - RNA, 21 nt, Human
cuucccugggccacuaggugg

SEQ ID NO: 423801 - RNA, 18 nt, Human
gcgcagggcuaggcaggc

SEQ ID NO: 423802 - RNA, 18 nt, Human
ggcagcggcugcggccgc

SEQ ID NO: 423803 - RNA, 19 nt, Human
gggcagcggcugcggccgc

SEQ ID NO: 423804 - RNA, 20 nt, Human
gggcgcccggcccggggcag

SEQ ID NO: 423805 - RNA, 26 nt, Human
ggugguugccggcgcagggcuaggca

SEQ ID NO: 423806 - RNA, 18 nt, Human
ucucuugggguagguggu

SEQ ID NO: 423807 - RNA, 19 nt, Human
uucccugggccacuaggug

SEQ ID NO: 423808 - RNA, 20 nt, Human
aaaaaaaaaaaaaaaagcua

SEQ ID NO: 423809 - RNA, 19 nt, Human
aaaaaaaaaagcuaucuau

SEQ ID NO: 423810 - RNA, 20 nt, Human
aaaacauagaaaacuacugc

SEQ ID NO: 423811 - RNA, 18 nt, Human
aaacaaaaaaucuagugu

SEQ ID NO: 423812 - RNA, 18 nt, Human
aaacauagaaaacuacug

SEQ ID NO: 423813 - RNA, 22 nt, Human
aaagaagucuuguauuaccuuu

SEQ ID NO: 423814 - RNA, 18 nt, Human
aaagauguguaucuuucc

SEQ ID NO: 423815 - RNA, 23 nt, Human
aaaggggacccaguggagcugcc

SEQ ID NO: 423816 - RNA, 18 nt, Human
aaaggggugaggcagaaa

SEQ ID NO: 423817 - RNA, 22 nt, Human
aacaaaaaaucuaguguccaga

SEQ ID NO: 423818 - RNA, 23 nt, Human
aacaggaaaaaaaaugguuccgg

SEQ ID NO: 423819 - RNA, 20 nt, Human
aacuggaaccuacccauccc

SEQ ID NO: 423820 - RNA, 22 nt, Human
aagaaaaaaagauaucuucaac

SEQ ID NO: 423821 - RNA, 19 nt, Human
aagcucaagacucaaaaaa

SEQ ID NO: 423822 - RNA, 26 nt, Human
agaaaaaaagauaucuucaacccaac

SEQ ID NO: 423823 - RNA, 24 nt, Human
agaaaagagaaacauugcugaugc

SEQ ID NO: 423824 - RNA, 20 nt, Human
agaaagcaagcuagcagccc

SEQ ID NO: 423825 - RNA, 25 nt, Human
agaaagcaagcuagcagcccugcug

SEQ ID NO: 423826 - RNA, 18 nt, Human
agaauaugacggucuguc

SEQ ID NO: 423827 - RNA, 22 nt, Human
agagccacaguuggcugaggug

SEQ ID NO: 423828 - RNA, 26 nt, Human
aggaugggggcaggacgcgggaggga

SEQ ID NO: 423829 - RNA, 26 nt, Human
aggcagaaaagaaaaaaaggggaccc

SEQ ID NO: 423830 - RNA, 22 nt, Human
aggcgggguggccagcgcgggg

SEQ ID NO: 423831 - RNA, 25 nt, Human
aggcgggguggccagcgcggggggu

SEQ ID NO: 423832 - RNA, 19 nt, Human
auauguauauauauauaua

SEQ ID NO: 423833 - RNA, 20 nt, Human
auauguauauauauauauau

SEQ ID NO: 423834 - RNA, 20 nt, Human
aucacaucacaacacggagg

SEQ ID NO: 423835 - RNA, 23 nt, Human
auggccuguuuggaaagaggugu

SEQ ID NO: 423836 - RNA, 18 nt, Human
auguauauauauauauau

SEQ ID NO: 423837 - RNA, 18 nt, Human
auguauauauauauauau

SEQ ID NO: 423838 - RNA, 20 nt, Human
auguauauauauauauauga

SEQ ID NO: 423839 - RNA, 20 nt, Human
caaaaaccagaaucacugua

SEQ ID NO: 423840 - RNA, 24 nt, Human
caaaggggacccaguggagcugcc

SEQ ID NO: 423841 - RNA, 22 nt, Human
caaccucaccaggaaaucugau

SEQ ID NO: 423842 - RNA, 20 nt, Human
caaccugggccgagcaacaa

SEQ ID NO: 423843 - RNA, 18 nt, Human
caacuggacugcagugaa

SEQ ID NO: 423844 - RNA, 21 nt, Human
caagccaaccuccccaaacaa

SEQ ID NO: 423845 - RNA, 21 nt, Human
caaguaaugcccucuccacaa

SEQ ID NO: 423846 - RNA, 21 nt, Human
cacagcccaagcucaagacuc

SEQ ID NO: 423847 - RNA, 18 nt, Human
cagaauaaaggcuagaag

SEQ ID NO: 423848 - RNA, 19 nt, Human
cagcugggaaaugcagcuc

SEQ ID NO: 423849 - RNA, 19 nt, Human
caucacaucacaacacgga

SEQ ID NO: 423850 - RNA, 23 nt, Human
ccaaccuccccaaacaaaaaauc

SEQ ID NO: 423851 - RNA, 23 nt, Human
ccacccuccguccucuccccaac

SEQ ID NO: 423852 - RNA, 25 nt, Human
ccacccuccguccucuccccaaccu

SEQ ID NO: 423853 - RNA, 21 nt, Human
ccagcaucacaucacaacacg

SEQ ID NO: 423854 - RNA, 18 nt, Human
cccacgcaaccucaccag

SEQ ID NO: 423855 - RNA, 26 nt, Human
cccccuucauucuauacuauccaaaa

SEQ ID NO: 423856 - RNA, 20 nt, Human
cccgcacccccugaccccuc

SEQ ID NO: 423857 - RNA, 22 nt, Human
cccugcugcccaaauuucauga

SEQ ID NO: 423858 - RNA, 21 nt, Human
ccugaccccucucuaguuggu

SEQ ID NO: 423859 - RNA, 22 nt, Human
ccuggugccaggcgcugccucc

SEQ ID NO: 423860 - RNA, 18 nt, Human
cgaacaaguaaugcccuc

SEQ ID NO: 423861 - RNA, 22 nt, Human
cgagaggagcacgggaggcgag

SEQ ID NO: 423862 - RNA, 23 nt, Human
cgggggguggaggaugggggcag

SEQ ID NO: 423863 - RNA, 19 nt, Human
cguuuggaaacguggccag

SEQ ID NO: 423864 - RNA, 20 nt, Human
cuaaaaaccaaaaaccagaa

SEQ ID NO: 423865 - RNA, 23 nt, Human
cuaaaaaccaaaaaccagaauca

SEQ ID NO: 423866 - RNA, 21 nt, Human
cucuagacagagagauaaccc

SEQ ID NO: 423867 - RNA, 22 nt, Human
cugcaacaccucugugaauucc

SEQ ID NO: 423868 - RNA, 21 nt, Human
cugccgccagaggcugccaag

SEQ ID NO: 423869 - RNA, 29 nt, Human
cugucugcaaauggaauauuugaggggaa

SEQ ID NO: 423870 - RNA, 22 nt, Human
cuucaacccaacacgcauuuca

SEQ ID NO: 423871 - RNA, 19 nt, Human
cuugggcugagaaaccugu

SEQ ID NO: 423872 - RNA, 18 nt, Human
gaaaugcagcuccgaauu

SEQ ID NO: 423873 - RNA, 20 nt, Human
gaauaucauuaugcaauaaa

SEQ ID NO: 423874 - RNA, 21 nt, Human
gaauugugaauagauuucuac

SEQ ID NO: 423875 - RNA, 24 nt, Human
gacaaaggggugaggcagaaaaga

SEQ ID NO: 423876 - RNA, 18 nt, Human
gagguguccuuauuaaaa

SEQ ID NO: 423877 - RNA, 20 nt, Human
gauguguaucuuuccaaacu

SEQ ID NO: 423878 - RNA, 19 nt, Human
gcagugcugaauggcacgc

SEQ ID NO: 423879 - RNA, 20 nt, Human
gcagugcugaauggcacgcc

SEQ ID NO: 423880 - RNA, 22 nt, Human
gccaggcgcugccuccuuccug

SEQ ID NO: 423881 - RNA, 22 nt, Human
gcgcgcugccgccagaggcugc

SEQ ID NO: 423882 - RNA, 20 nt, Human
gcgggagggaagggcagggg

SEQ ID NO: 423883 - RNA, 23 nt, Human
gcugccaaggaggcgggguggcc

SEQ ID NO: 423884 - RNA, 23 nt, Human
ggacaacaaugcucuagacagag

SEQ ID NO: 423885 - RNA, 19 nt, Human
ggagcacgggaggcgagug

SEQ ID NO: 423886 - RNA, 18 nt, Human
ggagcggggcugagugcu

SEQ ID NO: 423887 - RNA, 20 nt, Human
ggauaucauuaugcaauaaa

SEQ ID NO: 423888 - RNA, 18 nt, Human
ggcaggggguggggggcg

SEQ ID NO: 423889 - RNA, 21 nt, Human
ggccgagcaacaaguggagcc

SEQ ID NO: 423890 - RNA, 27 nt, Human
gggagggaagggcaggggguggggggc

SEQ ID NO: 423891 - RNA, 19 nt, Human
ggggaagagcagcccggau

SEQ ID NO: 423892 - RNA, 20 nt, Human
ggggaagagcagcccggauu

SEQ ID NO: 423893 - RNA, 21 nt, Human
ggggguggaggaugggggcag

SEQ ID NO: 423894 - RNA, 20 nt, Human
gggguggccagcgcgggggg

SEQ ID NO: 423895 - RNA, 27 nt, Human
gguaacaggaaaaaaaaagggagggcc

SEQ ID NO: 423896 - RNA, 23 nt, Human
ggugauaugaaagcccaaccucc

SEQ ID NO: 423897 - RNA, 20 nt, Human
guauauauauauauauguua

SEQ ID NO: 423898 - RNA, 21 nt, Human
guauuaccuuuucaaagaucc

SEQ ID NO: 423899 - RNA, 23 nt, Human
gugaaggacaacaaugcucuaga

SEQ ID NO: 423900 - RNA, 23 nt, Human
guggagcgcgcugccgccagagg

SEQ ID NO: 423901 - RNA, 22 nt, Human
guggggaaagccacuuccagau

SEQ ID NO: 423902 - RNA, 30 nt, Human
guguccuuauuaaaaaaaaaaaaaaaaaaa

SEQ ID NO: 423903 - RNA, 21 nt, Human
uaaaaaauauuucuaaaaacc

SEQ ID NO: 423904 - RNA, 22 nt, Human
uaaaaguacagaauaaaggcua

SEQ ID NO: 423905 - RNA, 21 nt, Human
uaaacaugagucacuaaaaag

SEQ ID NO: 423906 - RNA, 22 nt, Human
uaacaggaaaaaaaaugguucc

SEQ ID NO: 423907 - RNA, 19 nt, Human
uaaguuaggguauguguua

SEQ ID NO: 423908 - RNA, 21 nt, Human
uaauuucuggggacuuuccuc

SEQ ID NO: 423909 - RNA, 19 nt, Human
uacaaaucacgcaagacag

SEQ ID NO: 423910 - RNA, 20 nt, Human
uacaaguuaaaccaggggag

SEQ ID NO: 423911 - RNA, 23 nt, Human
uagaaaacuacugcuccucaaaa

SEQ ID NO: 423912 - RNA, 20 nt, Human
uauauauauguauauauaua

SEQ ID NO: 423913 - RNA, 23 nt, Human
uauauauauguauauauauauau

SEQ ID NO: 423914 - RNA, 18 nt, Human
uauauauguauauauaua

SEQ ID NO: 423915 - RNA, 18 nt, Human
uauauguauauauauaua

SEQ ID NO: 423916 - RNA, 18 nt, Human
uauguauauauauauaua

SEQ ID NO: 423917 - RNA, 19 nt, Human
uauguauauauauauauau

SEQ ID NO: 423918 - RNA, 27 nt, Human
uauguauauauauauauauguuaugua

SEQ ID NO: 423919 - RNA, 20 nt, Human
ucacaauucacugcaacuga

SEQ ID NO: 423920 - RNA, 22 nt, Human
ucaggguaugaucacagcgggg

SEQ ID NO: 423921 - RNA, 23 nt, Human
uccaaaagaagucuuguauuacc

SEQ ID NO: 423922 - RNA, 24 nt, Human
uccaugggcgagaggagcacggga

SEQ ID NO: 423923 - RNA, 19 nt, Human
ucccacccccauuauugcc

SEQ ID NO: 423924 - RNA, 18 nt, Human
ucccgcacccccugaccc

SEQ ID NO: 423925 - RNA, 19 nt, Human
ucccuaagaaaauacagga

SEQ ID NO: 423926 - RNA, 18 nt, Human
uccugggagcggggcuga

SEQ ID NO: 423927 - RNA, 20 nt, Human
ucgcucgagucccgcacccc

SEQ ID NO: 423928 - RNA, 20 nt, Human
ucgugguucccacccccauu

SEQ ID NO: 423929 - RNA, 21 nt, Human
ucuaccacccucuuucaacug

SEQ ID NO: 423930 - RNA, 20 nt, Human
ucucuuaaguuuacuguuga

SEQ ID NO: 423931 - RNA, 22 nt, Human
ucuucaacccaacacgcauuuc

SEQ ID NO: 423932 - RNA, 19 nt, Human
ugaaagcccaaccuccuaa

SEQ ID NO: 423933 - RNA, 24 nt, Human
ugacggucugucugcaaauggaau

SEQ ID NO: 423934 - RNA, 24 nt, Human
ugaguggauaaucuaaacacagga

SEQ ID NO: 423935 - RNA, 20 nt, Human
ugauacgcugcaacaccucu

SEQ ID NO: 423936 - RNA, 24 nt, Human
ugauggcaagauauaggcaguuuc

SEQ ID NO: 423937 - RNA, 22 nt, Human
ugauggccuguuuggaaagagg

SEQ ID NO: 423938 - RNA, 19 nt, Human
ugauugacugcgcuucucc

SEQ ID NO: 423939 - RNA, 21 nt, Human
ugcaacaccucugugaauucc

SEQ ID NO: 423940 - RNA, 22 nt, Human
ugcaauucuuggggaaaaauaa

SEQ ID NO: 423941 - RNA, 22 nt, Human
uggcaagauauaggcaguuucu

SEQ ID NO: 423942 - RNA, 22 nt, Human
uggcugaggugauaugaaagcc

SEQ ID NO: 423943 - RNA, 22 nt, Human
ugggaaaugcagcuccgaauua

SEQ ID NO: 423944 - RNA, 18 nt, Human
ugggagcggggcugagug

SEQ ID NO: 423945 - RNA, 18 nt, Human
uggggaaaaauaaaaaau

SEQ ID NO: 423946 - RNA, 24 nt, Human
uguaaaucuaaaucacuggcugca

SEQ ID NO: 423947 - RNA, 24 nt, Human
uguagugggcugaauauuccuuag

SEQ ID NO: 423948 - RNA, 18 nt, Human
uguauauauauauauaug

SEQ ID NO: 423949 - RNA, 23 nt, Human
ugucuauaacgaacaaguaaugc

SEQ ID NO: 423950 - RNA, 20 nt, Human
uuaaaaaaaaaaaaaaaaaa

SEQ ID NO: 423951 - RNA, 19 nt, Human
uuaauccacccacgcaacc

SEQ ID NO: 423952 - RNA, 21 nt, Human
uuaccuuguugcuugggcuga

SEQ ID NO: 423953 - RNA, 25 nt, Human
uuagcaaauaaaaaaaguacuucau

SEQ ID NO: 423954 - RNA, 19 nt, Human
uucaagccaaccuccccaa

SEQ ID NO: 423955 - RNA, 21 nt, Human
uucauaaacaugagucacuaa

SEQ ID NO: 423956 - RNA, 25 nt, Human
uucgcugggauccugugcgcggggc

SEQ ID NO: 423957 - RNA, 23 nt, Human
uugacugcgcuucuccuccguga

SEQ ID NO: 423958 - RNA, 19 nt, Human
uugcuucgucgugcucagg

SEQ ID NO: 423959 - RNA, 21 nt, Human
uuucaacuggaaccuacccau

SEQ ID NO: 423960 - RNA, 23 nt, Human
uuuccaaauuaauccacccacgc

SEQ ID NO: 423961 - RNA, 23 nt, Human
uuucuggggacuuuccucccugc

SEQ ID NO: 423962 - RNA, 25 nt, Human
uuuguuuuguuuucccaagaccuuu

SEQ ID NO: 423963 - RNA, 18 nt, Human
uuuguuuuguuuuguuuu

SEQ ID NO: 423964 - RNA, 24 nt, Human
uuuugcuuucaagaucuuuugcuc

SEQ ID NO: 423965 - RNA, 18 nt, Human
uuuuggucauagaagcug

SEQ ID NO: 423966 - RNA, 19 nt, Human
uuuuuuuuuuacaaguaac

SEQ ID NO: 423967 - RNA, 23 nt, Human
aaaaagcccugucucccacccac

SEQ ID NO: 423968 - RNA, 26 nt, Human
aaaaagcccugucucccacccaccaa

SEQ ID NO: 423969 - RNA, 20 nt, Human
aagaggagagaaccagcaaa

SEQ ID NO: 423970 - RNA, 24 nt, Human
acaaagacucuagacuuccagaca

SEQ ID NO: 423971 - RNA, 20 nt, Human
acgccgggcccgccagccug

SEQ ID NO: 423972 - RNA, 21 nt, Human
acgccgggcccgccagccuga

SEQ ID NO: 423973 - RNA, 21 nt, Human
agacaucgagguugaagcuga

SEQ ID NO: 423974 - RNA, 23 nt, Human
agagaaaaagcccugucucccac

SEQ ID NO: 423975 - RNA, 19 nt, Human
agagaaaccguacaccugg

SEQ ID NO: 423976 - RNA, 21 nt, Human
agcccaggcgcaaacauucag

SEQ ID NO: 423977 - RNA, 21 nt, Human
agccuggucaugcacccuggc

SEQ ID NO: 423978 - RNA, 21 nt, Human
agcgucucuuaaauaagcucu

SEQ ID NO: 423979 - RNA, 25 nt, Human
aggaucacaggcaguccucuaacca

SEQ ID NO: 423980 - RNA, 18 nt, Human
aggcagagugcagggggg

SEQ ID NO: 423981 - RNA, 19 nt, Human
aggcagagugcaggggggc

SEQ ID NO: 423982 - RNA, 20 nt, Human
aggcagagugcaggggggcc

SEQ ID NO: 423983 - RNA, 21 nt, Human
agggaaggagccguuccuggu

SEQ ID NO: 423984 - RNA, 26 nt, Human
auccaaccacaaccucccuccuccag

SEQ ID NO: 423985 - RNA, 23 nt, Human
caacaaagacucuagacuuccag

SEQ ID NO: 423986 - RNA, 18 nt, Human
caagaggagagaaccagc

SEQ ID NO: 423987 - RNA, 21 nt, Human
caagaggagagaaccagcaaa

SEQ ID NO: 423988 - RNA, 19 nt, Human
cagagaucuccagcgucuc

SEQ ID NO: 423989 - RNA, 21 nt, Human
cagaguaggguucccucuguc

SEQ ID NO: 423990 - RNA, 22 nt, Human
cagcccaggcgcaaacauucag

SEQ ID NO: 423991 - RNA, 19 nt, Human
caguuccuagguucaaacu

SEQ ID NO: 423992 - RNA, 19 nt, Human
ccagccugacccguugcag

SEQ ID NO: 423993 - RNA, 23 nt, Human
ccagcgucucuuaaauaagcucu

SEQ ID NO: 423994 - RNA, 18 nt, Human
cccaucuacauucuggac

SEQ ID NO: 423995 - RNA, 25 nt, Human
ccccagugcccugggacugacaguu

SEQ ID NO: 423996 - RNA, 25 nt, Human
ccccagugcccugggacugacaguu

SEQ ID NO: 423997 - RNA, 24 nt, Human
ccccuuuccucuucagguaggagc

SEQ ID NO: 423998 - RNA, 23 nt, Human
ccgccagccugacccguugcagc

SEQ ID NO: 423999 - RNA, 23 nt, Human
ccuucugcuucaaaaauuagcag

SEQ ID NO: 424000 - RNA, 20 nt, Human
cucucugguccugcaguucc

SEQ ID NO: 424001 - RNA, 21 nt, Human
cugaagcugucaaccuucugc

SEQ ID NO: 424002 - RNA, 23 nt, Human
cugaagcugucaaccuucugcuu

SEQ ID NO: 424003 - RNA, 20 nt, Human
cuguaaacugcagaugccgc

SEQ ID NO: 424004 - RNA, 23 nt, Human
cuucucgcucucuugagaucuua

SEQ ID NO: 424005 - RNA, 23 nt, Human
gacaguaaauauuuccaaguccc

SEQ ID NO: 424006 - RNA, 22 nt, Human
gagaaaaagcccugucucccac

SEQ ID NO: 424007 - RNA, 22 nt, Human
gagaaccagcaaaguccacucc

SEQ ID NO: 424008 - RNA, 21 nt, Human
gcccugggacugacaguuucc

SEQ ID NO: 424009 - RNA, 21 nt, Human
gcccugggacugacaguuucc

SEQ ID NO: 424010 - RNA, 20 nt, Human
gccgggagcaggcccuccgg

SEQ ID NO: 424011 - RNA, 20 nt, Human
ggagcuagugaaccguggag

SEQ ID NO: 424012 - RNA, 18 nt, Human
gggaaggagccguuccug

SEQ ID NO: 424013 - RNA, 21 nt, Human
gggcagagaugaugagcacgc

SEQ ID NO: 424014 - RNA, 19 nt, Human
gggcauuuaaugucagaga

SEQ ID NO: 424015 - RNA, 21 nt, Human
gggccagagaugaccuuggac

SEQ ID NO: 424016 - RNA, 25 nt, Human
gggggccgggagcaggcccuccggg

SEQ ID NO: 424017 - RNA, 19 nt, Human
guggaggaugaagaauucu

SEQ ID NO: 424018 - RNA, 24 nt, Human
guugcagcguccugugguuuguga

SEQ ID NO: 424019 - RNA, 22 nt, Human
uaaacugcagaugccgcacaaa

SEQ ID NO: 424020 - RNA, 19 nt, Human
uaagagagcaccaggccuc

SEQ ID NO: 424021 - RNA, 20 nt, Human
uaagagagcaccaggccucu

SEQ ID NO: 424022 - RNA, 21 nt, Human
uacauccugagaguccucgcc

SEQ ID NO: 424023 - RNA, 23 nt, Human
uaggagcuagugaaccguggagg

SEQ ID NO: 424024 - RNA, 24 nt, Human
uaguggccaggaucacaggcaguc

SEQ ID NO: 424025 - RNA, 23 nt, Human
uauauagauuuauauaauauaga

SEQ ID NO: 424026 - RNA, 19 nt, Human
uccauuuucaucuuuccau

SEQ ID NO: 424027 - RNA, 20 nt, Human
uccccagugcccugggacug

SEQ ID NO: 424028 - RNA, 20 nt, Human
uccccagugcccugggacug

SEQ ID NO: 424029 - RNA, 25 nt, Human
ucgagguugaagcugaguucccgcc

SEQ ID NO: 424030 - RNA, 21 nt, Human
ucuggacaagacccugaagac

SEQ ID NO: 424031 - RNA, 23 nt, Human
ugaagacaucgagguugaagcug

SEQ ID NO: 424032 - RNA, 24 nt, Human
ugaagacaucgagguugaagcuga

SEQ ID NO: 424033 - RNA, 18 nt, Human
ugacagcagcagcucaag

SEQ ID NO: 424034 - RNA, 18 nt, Human
ugaggcagagugcagggg

SEQ ID NO: 424035 - RNA, 19 nt, Human
ugaggcagagugcaggggg

SEQ ID NO: 424036 - RNA, 21 nt, Human
ugaggcagagugcaggggggc

SEQ ID NO: 424037 - RNA, 23 nt, Human
ugaugagcacgccgggcccgcca

SEQ ID NO: 424038 - RNA, 20 nt, Human
ugcacccuggcuucugcagc

SEQ ID NO: 424039 - RNA, 22 nt, Human
ugcagcguccugugguuuguga

SEQ ID NO: 424040 - RNA, 18 nt, Human
ugccgcacaagugcacgu

SEQ ID NO: 424041 - RNA, 18 nt, Human
uggacaagacccugaaga

SEQ ID NO: 424042 - RNA, 18 nt, Human
uggcccccuuuccucuuc

SEQ ID NO: 424043 - RNA, 19 nt, Human
uggcuucugcagcccaggc

SEQ ID NO: 424044 - RNA, 18 nt, Human
uggggcagagaugaugag

SEQ ID NO: 424045 - RNA, 19 nt, Human
ugggggccaccguuuccga

SEQ ID NO: 424046 - RNA, 20 nt, Human
ugguuugugaggccucccuc

SEQ ID NO: 424047 - RNA, 19 nt, Human
uguaaacugcagaugccgc

SEQ ID NO: 424048 - RNA, 22 nt, Human
ugugguuugugaggccucccuc

SEQ ID NO: 424049 - RNA, 24 nt, Human
ugugguuugugaggccucccucgg

SEQ ID NO: 424050 - RNA, 24 nt, Human
uucaaaaauuagcaguuuccauuu

SEQ ID NO: 424051 - RNA, 23 nt, Human
uucucgcucucuugagaucuuac

SEQ ID NO: 424052 - RNA, 23 nt, Human
uuuuuuuuuuuuuccaugaaggg

SEQ ID NO: 424053 - RNA, 20 nt, Human
uuuuuuuuuuuuuuuuccau

SEQ ID NO: 424054 - RNA, 24 nt, Human
uuuuuuuuuuuuuuuuuuuccaug

SEQ ID NO: 424055 - RNA, 18 nt, Human
aagucagucuagcggccg

SEQ ID NO: 424056 - RNA, 24 nt, Human
accauccuguggccagcaguucug

SEQ ID NO: 424057 - RNA, 21 nt, Human
agagcggacggggcagccagc

SEQ ID NO: 424058 - RNA, 25 nt, Human
agccagcgccugugucgguccucga

SEQ ID NO: 424059 - RNA, 24 nt, Human
agcgccuuuucggggccgucuggc

SEQ ID NO: 424060 - RNA, 18 nt, Human
aggcggagagcggacggg

SEQ ID NO: 424061 - RNA, 19 nt, Human
agggagggccuguacagug

SEQ ID NO: 424062 - RNA, 23 nt, Human
aguugggcuuuggcagggagagg

SEQ ID NO: 424063 - RNA, 19 nt, Human
caacggcggcggccgggag

SEQ ID NO: 424064 - RNA, 22 nt, Human
caguguccuuuaaacgcucccc

SEQ ID NO: 424065 - RNA, 19 nt, Human
cauccuguggccagcaguu

SEQ ID NO: 424066 - RNA, 20 nt, Human
ccacaggugcgagccaccgc

SEQ ID NO: 424067 - RNA, 19 nt, Human
ccagagcccugggaguugg

SEQ ID NO: 424068 - RNA, 23 nt, Human
cccugggccuucgugggugggcg

SEQ ID NO: 424069 - RNA, 18 nt, Human
ccuagaggccaaggggag

SEQ ID NO: 424070 - RNA, 19 nt, Human
ccugaggucccacaggugc

SEQ ID NO: 424071 - RNA, 18 nt, Human
ccugggaguugggcuuug

SEQ ID NO: 424072 - RNA, 23 nt, Human
ccuguggccagcaguucugggga

SEQ ID NO: 424073 - RNA, 18 nt, Human
cggcgcgcgagggcccgg

SEQ ID NO: 424074 - RNA, 18 nt, Human
cuaaccucacccaccauc

SEQ ID NO: 424075 - RNA, 20 nt, Human
gccaaggggagggagggccu

SEQ ID NO: 424076 - RNA, 18 nt, Human
gcggccgggaggcgaggg

SEQ ID NO: 424077 - RNA, 20 nt, Human
ggccaaggggagggagggcc

SEQ ID NO: 424078 - RNA, 20 nt, Human
ggcuuuggcagggagaggcu

SEQ ID NO: 424079 - RNA, 21 nt, Human
gggcuuuggcagggagaggcu

SEQ ID NO: 424080 - RNA, 22 nt, Human
gggugggcagggggcgaggcug

SEQ ID NO: 424081 - RNA, 23 nt, Human
ggucccacaggugcgagccaccg

SEQ ID NO: 424082 - RNA, 22 nt, Human
gucccacaggugcgagccaccg

SEQ ID NO: 424083 - RNA, 19 nt, Human
gugggcagggggcgaggcu

SEQ ID NO: 424084 - RNA, 24 nt, Human
guugggcuuuggcagggagaggcu

SEQ ID NO: 424085 - RNA, 19 nt, Human
ugaccgcccuacggccgcc

SEQ ID NO: 424086 - RNA, 22 nt, Human
ugcccugaggucccacaggugc

SEQ ID NO: 424087 - RNA, 19 nt, Human
ugccggugcccugaggucc

SEQ ID NO: 424088 - RNA, 19 nt, Human
uggcagggagaggcugggc

SEQ ID NO: 424089 - RNA, 21 nt, Human
uggcgcccugggccuucgugg

SEQ ID NO: 424090 - RNA, 20 nt, Human
ugggcuuuggcagggagagg

SEQ ID NO: 424091 - RNA, 24 nt, Human
ugggcuuuggcagggagaggcugg

SEQ ID NO: 424092 - RNA, 21 nt, Human
uuccagagcccugggaguugg

SEQ ID NO: 424093 - RNA, 22 nt, Human
uuccagagcccugggaguuggg

SEQ ID NO: 424094 - RNA, 25 nt, Human
uuuagacuggcuuuuuuccagucuc

SEQ ID NO: 424095 - RNA, 24 nt, Human
uuuccagagcccugggaguugggc

SEQ ID NO: 424096 - RNA, 19 nt, Human
uuuuuuuuuuuuuuuuuug

SEQ ID NO: 424097 - RNA, 25 nt, Human
uuuuuuuuuuuuuuuuuuuuugggg

SEQ ID NO: 424098 - RNA, 18 nt, Human
agccacggagcgggagga

SEQ ID NO: 424099 - RNA, 23 nt, Human
agcccgcagcuuggaaacggucc

SEQ ID NO: 424100 - RNA, 24 nt, Human
agcgggaggguggugugcacacgg

SEQ ID NO: 424101 - RNA, 19 nt, Human
aggagggagggaggagcga

SEQ ID NO: 424102 - RNA, 21 nt, Human
aggagggagggaggagcgagc

SEQ ID NO: 424103 - RNA, 20 nt, Human
agggaggagcgagcgcggcg

SEQ ID NO: 424104 - RNA, 22 nt, Human
agggagggaggagcgagcgcgg

SEQ ID NO: 424105 - RNA, 19 nt, Human
agggguccagaguuccugc

SEQ ID NO: 424106 - RNA, 20 nt, Human
cagaaaagacaagcucagca

SEQ ID NO: 424107 - RNA, 20 nt, Human
cagaaggcuucgcuccagcc

SEQ ID NO: 424108 - RNA, 23 nt, Human
cagcagaaaagacaagcucagca

SEQ ID NO: 424109 - RNA, 21 nt, Human
cagccgcggagggaccugggc

SEQ ID NO: 424110 - RNA, 20 nt, Human
caggaaaaguacccuccuca

SEQ ID NO: 424111 - RNA, 19 nt, Human
cauagcccgcccgggaggc

SEQ ID NO: 424112 - RNA, 23 nt, Human
cccagggguccagaguuccugcu

SEQ ID NO: 424113 - RNA, 19 nt, Human
ccccacggaugccugcagg

SEQ ID NO: 424114 - RNA, 21 nt, Human
ccgcagcuuggaaacggucca

SEQ ID NO: 424115 - RNA, 19 nt, Human
ccuccagcccccgccccuc

SEQ ID NO: 424116 - RNA, 23 nt, Human
ccuccagcccccgccccucccuc

SEQ ID NO: 424117 - RNA, 21 nt, Human
ccugcaggaaacccaggaaaa

SEQ ID NO: 424118 - RNA, 22 nt, Human
cgcccguccgcgcgcuccgcgc

SEQ ID NO: 424119 - RNA, 21 nt, Human
cggcguggggcgacgccgggc

SEQ ID NO: 424120 - RNA, 19 nt, Human
cguccgcgcgcuccgcgcc

SEQ ID NO: 424121 - RNA, 18 nt, Human
cuccagcccccgccccuc

SEQ ID NO: 424122 - RNA, 20 nt, Human
cuccgcgccugagccucgcc

SEQ ID NO: 424123 - RNA, 18 nt, Human
cugcugccuccagccccc

SEQ ID NO: 424124 - RNA, 18 nt, Human
gaaaagacaagcucagca

SEQ ID NO: 424125 - RNA, 22 nt, Human
gaaaaguacccuccucagcaga

SEQ ID NO: 424126 - RNA, 21 nt, Human
gagauuuuuuuucccccacgg

SEQ ID NO: 424127 - RNA, 19 nt, Human
gaggagcgagcgcggcgug

SEQ ID NO: 424128 - RNA, 20 nt, Human
gccuccagcccccgccccuc

SEQ ID NO: 424129 - RNA, 22 nt, Human
gcgccugagccucgccaggagc

SEQ ID NO: 424130 - RNA, 23 nt, Human
gcgggaggguggugugcacacgg

SEQ ID NO: 424131 - RNA, 19 nt, Human
gcugugaugaggcccaggg

SEQ ID NO: 424132 - RNA, 22 nt, Human
ggaagaauucuuuuuaauuaaa

SEQ ID NO: 424133 - RNA, 19 nt, Human
ggaggagggagggaggagc

SEQ ID NO: 424134 - RNA, 21 nt, Human
ggcccagggguccagaguucc

SEQ ID NO: 424135 - RNA, 18 nt, Human
gggaggagggagggagga

SEQ ID NO: 424136 - RNA, 20 nt, Human
gggaggagggagggaggagc

SEQ ID NO: 424137 - RNA, 23 nt, Human
ggggagugcgggggcgcugcugc

SEQ ID NO: 424138 - RNA, 19 nt, Human
gggguccagaguuccugcu

SEQ ID NO: 424139 - RNA, 22 nt, Human
uccagaguuccugcugcagaag

SEQ ID NO: 424140 - RNA, 20 nt, Human
uccccggggccgucugucgg

SEQ ID NO: 424141 - RNA, 22 nt, Human
ucgccaggagcacgggagccac

SEQ ID NO: 424142 - RNA, 20 nt, Human
ugaggcccagggguccagaa

SEQ ID NO: 424143 - RNA, 24 nt, Human
ugccagggagcccgcagcuuggaa

SEQ ID NO: 424144 - RNA, 19 nt, Human
ugggcugugucugggggag

SEQ ID NO: 424145 - RNA, 22 nt, Human
ugggcugugucugggggagggu

SEQ ID NO: 424146 - RNA, 22 nt, Human
ugggggaggguggagcagcauu

SEQ ID NO: 424147 - RNA, 20 nt, Human
ugugaugaggcccagggguc

SEQ ID NO: 424148 - RNA, 19 nt, Human
uuuuuuuuuuuuuuuuugu

SEQ ID NO: 424149 - RNA, 22 nt, Human
uuuuuuuuuuuuuuuuuugugg

SEQ ID NO: 424150 - RNA, 23 nt, Human
aaacaggcuggaaaguggcaagc

SEQ ID NO: 424151 - RNA, 20 nt, Human
aaccagugggaaaaggaggg

SEQ ID NO: 424152 - RNA, 21 nt, Human
aaccagugggaaaaggagggg

SEQ ID NO: 424153 - RNA, 23 nt, Human
aagaagagguaaaguugguugcu

SEQ ID NO: 424154 - RNA, 21 nt, Human
aagccaagaaccagugggaaa

SEQ ID NO: 424155 - RNA, 21 nt, Human
aagcuuuggagaaauugcagu

SEQ ID NO: 424156 - RNA, 25 nt, Human
accccaaagacaugcuuuuccgggg

SEQ ID NO: 424157 - RNA, 19 nt, Human
agagcucccucuuccaucu

SEQ ID NO: 424158 - RNA, 21 nt, Human
aggagaagggagaaguuaccu

SEQ ID NO: 424159 - RNA, 18 nt, Human
aggaggaaguaggucagg

SEQ ID NO: 424160 - RNA, 22 nt, Human
aggaggaaguaggucaggagaa

SEQ ID NO: 424161 - RNA, 19 nt, Human
aguaggucaggagaaggga

SEQ ID NO: 424162 - RNA, 18 nt, Human
agucauugccccacuagu

SEQ ID NO: 424163 - RNA, 20 nt, Human
aucuggagucccucggguua

SEQ ID NO: 424164 - RNA, 20 nt, Human
caagauuccuggggaaucug

SEQ ID NO: 424165 - RNA, 22 nt, Human
cagagcucccucuuccaucuuc

SEQ ID NO: 424166 - RNA, 19 nt, Human
cagcuagagaaaauuccaa

SEQ ID NO: 424167 - RNA, 18 nt, Human
cggggccaguuuccucag

SEQ ID NO: 424168 - RNA, 21 nt, Human
cucccucuuccaucuucaacc

SEQ ID NO: 424169 - RNA, 18 nt, Human
cucuaggaaccaacccca

SEQ ID NO: 424170 - RNA, 21 nt, Human
cugugcagaagagaggugcag

SEQ ID NO: 424171 - RNA, 21 nt, Human
gaaaggaaagggagaagagga

SEQ ID NO: 424172 - RNA, 18 nt, Human
gaaccaaccccaaagaca

SEQ ID NO: 424173 - RNA, 21 nt, Human
gaggggaggaggaacaccugu

SEQ ID NO: 424174 - RNA, 22 nt, Human
ggaaaggaaagggagaagagga

SEQ ID NO: 424175 - RNA, 19 nt, Human
ggaggaacaccuguucucc

SEQ ID NO: 424176 - RNA, 26 nt, Human
ggaggaacaccuguucuccuaaucca

SEQ ID NO: 424177 - RNA, 22 nt, Human
uaaaggaagccaagaaccagug

SEQ ID NO: 424178 - RNA, 22 nt, Human
uaacagcuagagaaaauuccaa

SEQ ID NO: 424179 - RNA, 21 nt, Human
uaggaaccaaccccaaagaca

SEQ ID NO: 424180 - RNA, 20 nt, Human
ucucucccucucaggauccc

SEQ ID NO: 424181 - RNA, 21 nt, Human
uggaaaguggcaagcuuugga

SEQ ID NO: 424182 - RNA, 27 nt, Human
uggaaaguggcaagcuuugguuccaua

SEQ ID NO: 424183 - RNA, 18 nt, Human
uggaguaacagcuagaga

SEQ ID NO: 424184 - RNA, 18 nt, Human
uggcucagaggaacaaag

SEQ ID NO: 424185 - RNA, 19 nt, Human
uggcugcgaggauucagac

SEQ ID NO: 424186 - RNA, 21 nt, Human
uggggaaucuggcucagcagg

SEQ ID NO: 424187 - RNA, 22 nt, Human
uuccccauucccuagguuccac

SEQ ID NO: 424188 - RNA, 22 nt, Human
aaaaaaaaaaucuaaacuaugc

SEQ ID NO: 424189 - RNA, 21 nt, Human
aaaaaaaucuaaacuaugcac

SEQ ID NO: 424190 - RNA, 18 nt, Human
aaacaguguaaaucagau

SEQ ID NO: 424191 - RNA, 21 nt, Human
aaacaguguaaaucagauuuu

SEQ ID NO: 424192 - RNA, 20 nt, Human
aacaaagggagaaaaagccc

SEQ ID NO: 424193 - RNA, 18 nt, Human
aaugaaaaauuaacagcc

SEQ ID NO: 424194 - RNA, 23 nt, Human
acagccucaaguaaguagauaau

SEQ ID NO: 424195 - RNA, 23 nt, Human
aggaagaggaaauccguuuuuua

SEQ ID NO: 424196 - RNA, 23 nt, Human
agggagaaaaagcccacgcaaug

SEQ ID NO: 424197 - RNA, 23 nt, Human
aguaaguagauaauacuauacaa

SEQ ID NO: 424198 - RNA, 24 nt, Human
auugaaugugauuaaagaagaaau

SEQ ID NO: 424199 - RNA, 25 nt, Human
caaguaaguagauaauacuauacaa

SEQ ID NO: 424200 - RNA, 26 nt, Human
caaguugagcacaaaacaaugcaucc

SEQ ID NO: 424201 - RNA, 19 nt, Human
cauucaaaaugcuuuaaau

SEQ ID NO: 424202 - RNA, 25 nt, Human
ccaagaacaaacauauucaacaaaa

SEQ ID NO: 424203 - RNA, 23 nt, Human
cuccuggcugugcuggguccgcu

SEQ ID NO: 424204 - RNA, 21 nt, Human
uaaaaaacaaaacaguguaaa

SEQ ID NO: 424205 - RNA, 26 nt, Human
uaaaaacagcacuaagucuucaaaga

SEQ ID NO: 424206 - RNA, 21 nt, Human
uaaacuggacuuucuuggcuc

SEQ ID NO: 424207 - RNA, 23 nt, Human
uaagagggcaaaucacaagugac

SEQ ID NO: 424208 - RNA, 24 nt, Human
uaagcuaggaagaggaaauccguu

SEQ ID NO: 424209 - RNA, 20 nt, Human
uaagguuuguuuucuguguu

SEQ ID NO: 424210 - RNA, 22 nt, Human
uaagguuuguuuucuguguucc

SEQ ID NO: 424211 - RNA, 22 nt, Human
uacaaaacacaaguugagcaca

SEQ ID NO: 424212 - RNA, 23 nt, Human
uacaaaacacuguaaugaaaaau

SEQ ID NO: 424213 - RNA, 19 nt, Human
uacgugucauaaacuggac

SEQ ID NO: 424214 - RNA, 20 nt, Human
uacgugucauaaacuggacu

SEQ ID NO: 424215 - RNA, 18 nt, Human
ucaaugacagguguagaa

SEQ ID NO: 424216 - RNA, 20 nt, Human
uccaagaacaaacauauuca

SEQ ID NO: 424217 - RNA, 18 nt, Human
ugacagguguagaaaauc

SEQ ID NO: 424218 - RNA, 22 nt, Human
ugacauuuuaaacaaagggaga

SEQ ID NO: 424219 - RNA, 22 nt, Human
uuaaaaaacaaaacaguguaaa

SEQ ID NO: 424220 - RNA, 18 nt, Human
uucguacagaucgaggac

SEQ ID NO: 424221 - RNA, 19 nt, Human
uucuguguuccauucuaaa

SEQ ID NO: 424222 - RNA, 24 nt, Human
uugaaugugauuaaagaagaaauu

SEQ ID NO: 424223 - RNA, 26 nt, Human
uuuuuagccucgcggcuguauccauc

SEQ ID NO: 424224 - RNA, 24 nt, Human
uuuuuaguagcgguauuaaaauua

SEQ ID NO: 424225 - RNA, 18 nt, Human
uuuuuuuuuuuuuuuuug

SEQ ID NO: 424226 - RNA, 18 nt, Human
uuuuuuuuuuuuuuuuug

SEQ ID NO: 424227 - RNA, 19 nt, Human
aaaacccgagaagauccag

SEQ ID NO: 424228 - RNA, 20 nt, Human
aagaaacauaauuguucugg

SEQ ID NO: 424229 - RNA, 19 nt, Human
aagacccagaaacuacaug

SEQ ID NO: 424230 - RNA, 23 nt, Human
acaaaacaauaucugaaagaaaa

SEQ ID NO: 424231 - RNA, 21 nt, Human
acccccucuuccccucagcag

SEQ ID NO: 424232 - RNA, 20 nt, Human
accuacccgacccgccccuc

SEQ ID NO: 424233 - RNA, 21 nt, Human
accuacccgacccgccccucc

SEQ ID NO: 424234 - RNA, 18 nt, Human
acgcgccgggcuucaguc

SEQ ID NO: 424235 - RNA, 18 nt, Human
agaagacccagaaacuac

SEQ ID NO: 424236 - RNA, 23 nt, Human
agaagacccagaaacuacaugaa

SEQ ID NO: 424237 - RNA, 21 nt, Human
agcccauccagccccgcccag

SEQ ID NO: 424238 - RNA, 21 nt, Human
agccggcgccuccccggcgca

SEQ ID NO: 424239 - RNA, 22 nt, Human
aggcugugccgggggaggcggg

SEQ ID NO: 424240 - RNA, 22 nt, Human
aguguagucucuucgcaggugc

SEQ ID NO: 424241 - RNA, 22 nt, Human
auuuuuuacauguuuuuucccu

SEQ ID NO: 424242 - RNA, 20 nt, Human
caacccucccaccacagccc

SEQ ID NO: 424243 - RNA, 23 nt, Human
caagcagggccugcaacccaggc

SEQ ID NO: 424244 - RNA, 18 nt, Human
cacagcccauccagcccc

SEQ ID NO: 424245 - RNA, 25 nt, Human
caccacaagcagggccugcaaccca

SEQ ID NO: 424246 - RNA, 26 nt, Human
cacccaaaaugcgguuucauuuucac

SEQ ID NO: 424247 - RNA, 24 nt, Human
caccccacgcgccgggcuucaguc

SEQ ID NO: 424248 - RNA, 19 nt, Human
caccccuuuccccgccccc

SEQ ID NO: 424249 - RNA, 19 nt, Human
cagcccauccagccccgcc

SEQ ID NO: 424250 - RNA, 25 nt, Human
cagcgcgccgcggugcgcaugcgug

SEQ ID NO: 424251 - RNA, 23 nt, Human
cauccaggcuagacaccaaauca

SEQ ID NO: 424252 - RNA, 18 nt, Human
ccaccgcccgccccccgc

SEQ ID NO: 424253 - RNA, 19 nt, Human
ccaguccaacaggucuucu

SEQ ID NO: 424254 - RNA, 19 nt, Human
cccagcgcgccgcggugcg

SEQ ID NO: 424255 - RNA, 21 nt, Human
cccagcgcgccgcggugcgca

SEQ ID NO: 424256 - RNA, 20 nt, Human
cccauccagccccgcccagc

SEQ ID NO: 424257 - RNA, 20 nt, Human
cccaucuucccaccugucca

SEQ ID NO: 424258 - RNA, 19 nt, Human
ccccccgccgucgcucucc

SEQ ID NO: 424259 - RNA, 23 nt, Human
ccccccgccgucgcucuccccgc

SEQ ID NO: 424260 - RNA, 22 nt, Human
cccccgccgucgcucuccccgc

SEQ ID NO: 424261 - RNA, 20 nt, Human
cccccggcccggcucgccuu

SEQ ID NO: 424262 - RNA, 20 nt, Human
ccccgccgucgcucuccccg

SEQ ID NO: 424263 - RNA, 18 nt, Human
ccccgccuccccuucccu

SEQ ID NO: 424264 - RNA, 24 nt, Human
ccccggcccggcucgccuuucucg

SEQ ID NO: 424265 - RNA, 22 nt, Human
cccgccgucgcucuccccgccu

SEQ ID NO: 424266 - RNA, 23 nt, Human
cccggcccggcucgccuuucucg

SEQ ID NO: 424267 - RNA, 22 nt, Human
ccgcagcggccgcaggaggggc

SEQ ID NO: 424268 - RNA, 19 nt, Human
ccgccccccgccgucgcuc

SEQ ID NO: 424269 - RNA, 20 nt, Human
ccgccccccgccgucgcucc

SEQ ID NO: 424270 - RNA, 21 nt, Human
ccgcccgccccccgccgucgc

SEQ ID NO: 424271 - RNA, 24 nt, Human
ccgcccgccccccgccgucgcucu

SEQ ID NO: 424272 - RNA, 19 nt, Human
ccgccgucgcucuccccgc

SEQ ID NO: 424273 - RNA, 20 nt, Human
ccgccgucgcucuccccgcc

SEQ ID NO: 424274 - RNA, 23 nt, Human
ccgccgucgcucuccccgccucc

SEQ ID NO: 424275 - RNA, 21 nt, Human
ccggcgcacacaguacacagu

SEQ ID NO: 424276 - RNA, 21 nt, Human
ccuacccgacccgccccucca

SEQ ID NO: 424277 - RNA, 21 nt, Human
ccuccagcgccguccccgccc

SEQ ID NO: 424278 - RNA, 18 nt, Human
ccucccaccacagcccau

SEQ ID NO: 424279 - RNA, 23 nt, Human
ccucccaccacagcccauccagc

SEQ ID NO: 424280 - RNA, 25 nt, Human
ccucuuauaauacagcaagaaacug

SEQ ID NO: 424281 - RNA, 19 nt, Human
ccugcaacccaggcaucca

SEQ ID NO: 424282 - RNA, 22 nt, Human
ccugcaacccaggcauccaggc

SEQ ID NO: 424283 - RNA, 23 nt, Human
ccugcaacccaggcauccaggcu

SEQ ID NO: 424284 - RNA, 21 nt, Human
cgcaggugcggcugggcagcu

SEQ ID NO: 424285 - RNA, 24 nt, Human
cgcugccgaguacaagccggcgcc

SEQ ID NO: 424286 - RNA, 25 nt, Human
cggcccggcucgccuuucucgcggg

SEQ ID NO: 424287 - RNA, 20 nt, Human
cuacccgacccgccccucca

SEQ ID NO: 424288 - RNA, 21 nt, Human
cuagacaccaaaucagcaaac

SEQ ID NO: 424289 - RNA, 22 nt, Human
cucccgcugcaccccacgcgcc

SEQ ID NO: 424290 - RNA, 20 nt, Human
cugagcaccucgggaagugu

SEQ ID NO: 424291 - RNA, 19 nt, Human
cugcaccccacgcgccggg

SEQ ID NO: 424292 - RNA, 19 nt, Human
cuuuccccgcccccggccc

SEQ ID NO: 424293 - RNA, 20 nt, Human
gaaauguccuauuugcagag

SEQ ID NO: 424294 - RNA, 18 nt, Human
gacaccaaaucagcaaac

SEQ ID NO: 424295 - RNA, 21 nt, Human
gcaacccucccaccacagccc

SEQ ID NO: 424296 - RNA, 21 nt, Human
gcccucgcugccgcugagcac

SEQ ID NO: 424297 - RNA, 21 nt, Human
gccgguguccgaagucaggcg

SEQ ID NO: 424298 - RNA, 22 nt, Human
gcugcaacccucccaccacagc

SEQ ID NO: 424299 - RNA, 20 nt, Human
ggaagagcggagacccccuc

SEQ ID NO: 424300 - RNA, 22 nt, Human
ggaauccggagaagugagaaca

SEQ ID NO: 424301 - RNA, 23 nt, Human
ggaggcgggguccaccgcccgcc

SEQ ID NO: 424302 - RNA, 26 nt, Human
ggccgguguccgaagucaggcggcgg

SEQ ID NO: 424303 - RNA, 21 nt, Human
ggugcgcaugcguggaggccc

SEQ ID NO: 424304 - RNA, 22 nt, Human
uaaaauaacuaugcuuucuuac

SEQ ID NO: 424305 - RNA, 23 nt, Human
uaaacagugaacuuuguaauuag

SEQ ID NO: 424306 - RNA, 23 nt, Human
uacaaaacaauaucugaaagaaa

SEQ ID NO: 424307 - RNA, 19 nt, Human
uagugcaauuggucuccau

SEQ ID NO: 424308 - RNA, 22 nt, Human
uaucugaaagaaaacccgagaa

SEQ ID NO: 424309 - RNA, 19 nt, Human
ucagcaggcugugccgggg

SEQ ID NO: 424310 - RNA, 19 nt, Human
uccaguccccucgcacucc

SEQ ID NO: 424311 - RNA, 21 nt, Human
uccccgcccccggcccggcuc

SEQ ID NO: 424312 - RNA, 19 nt, Human
uccccgcccccguuccugc

SEQ ID NO: 424313 - RNA, 23 nt, Human
uccccgccuccccuucccucccc

SEQ ID NO: 424314 - RNA, 21 nt, Human
uccccucgcacucccgcugca

SEQ ID NO: 424315 - RNA, 24 nt, Human
ucuauaucaaaucagagccggggc

SEQ ID NO: 424316 - RNA, 23 nt, Human
ucuucaaaagacaguaaaaacaa

SEQ ID NO: 424317 - RNA, 19 nt, Human
ucuucaauaaacagugaac

SEQ ID NO: 424318 - RNA, 20 nt, Human
ugagaacauucccgccgccc

SEQ ID NO: 424319 - RNA, 23 nt, Human
ugcaacccucccaccacagccca

SEQ ID NO: 424320 - RNA, 21 nt, Human
uguccaguccccucgcacucc

SEQ ID NO: 424321 - RNA, 19 nt, Human
uugcggaaggcugauuuaa

SEQ ID NO: 424322 - RNA, 23 nt, Human
uuuaagaacuucuucaaaagaca

SEQ ID NO: 424323 - RNA, 19 nt, Human
uuugaaauguccuauuugc

SEQ ID NO: 424324 - RNA, 24 nt, Human
aaagugcugggauuacaggcguga

SEQ ID NO: 424325 - RNA, 20 nt, Human
aaccugcaugagcaucccuc

SEQ ID NO: 424326 - RNA, 19 nt, Human
aagugcugggauuacaggc

SEQ ID NO: 424327 - RNA, 19 nt, Human
aagugcugggauuacaggc

SEQ ID NO: 424328 - RNA, 26 nt, Human
aagugcugggauuacaggcgugagcc

SEQ ID NO: 424329 - RNA, 24 nt, Human
aaguggcucggacuacaggugugu

SEQ ID NO: 424330 - RNA, 19 nt, Human
accauacacacacacacac

SEQ ID NO: 424331 - RNA, 24 nt, Human
accucagccucccaaguggcucgg

SEQ ID NO: 424332 - RNA, 24 nt, Human
accuuccauccgugucuuccccau

SEQ ID NO: 424333 - RNA, 18 nt, Human
acuacaggugugugccau

SEQ ID NO: 424334 - RNA, 19 nt, Human
agaacucaguccaugcugc

SEQ ID NO: 424335 - RNA, 21 nt, Human
agaacucaguccaugcugcac

SEQ ID NO: 424336 - RNA, 20 nt, Human
agccccgaguccggcccagc

SEQ ID NO: 424337 - RNA, 20 nt, Human
aggcaaggaaaggauguggg

SEQ ID NO: 424338 - RNA, 24 nt, Human
agggggaguggggaggcggccugg

SEQ ID NO: 424339 - RNA, 23 nt, Human
aggggggccaccugccaccuucu

SEQ ID NO: 424340 - RNA, 24 nt, Human
aggggucuugcuauauugcccagg

SEQ ID NO: 424341 - RNA, 22 nt, Human
agguuccuuuucauuucuugcu

SEQ ID NO: 424342 - RNA, 19 nt, Human
agugcaguggugcaaucag

SEQ ID NO: 424343 - RNA, 24 nt, Human
agugcaguggugcaaucagagguc

SEQ ID NO: 424344 - RNA, 18 nt, Human
agugcugggauuacaggc

SEQ ID NO: 424345 - RNA, 22 nt, Human
auccccgaaaccuguccuacgc

SEQ ID NO: 424346 - RNA, 22 nt, Human
auggugcccaaaugcaguguuu

SEQ ID NO: 424347 - RNA, 24 nt, Human
caaagugcugggauuacaggcgug

SEQ ID NO: 424348 - RNA, 19 nt, Human
caagggagcugagauggug

SEQ ID NO: 424349 - RNA, 19 nt, Human
caccugccaccuucucugg

SEQ ID NO: 424350 - RNA, 21 nt, Human
cagagcucuccuaggggggcc

SEQ ID NO: 424351 - RNA, 23 nt, Human
cagcuucgaacuccugggcucaa

SEQ ID NO: 424352 - RNA, 23 nt, Human
cauccgugucuuccccauggggg

SEQ ID NO: 424353 - RNA, 20 nt, Human
cauguauuuuccuuugcucc

SEQ ID NO: 424354 - RNA, 18 nt, Human
cauucuguuacccagccu

SEQ ID NO: 424355 - RNA, 20 nt, Human
ccaaagugcugggauuacag

SEQ ID NO: 424356 - RNA, 22 nt, Human
ccaaagugcugggauuacaggc

SEQ ID NO: 424357 - RNA, 22 nt, Human
ccaaagugcugggauuacaggc

SEQ ID NO: 424358 - RNA, 22 nt, Human
ccaaagugcugggauuacaggc

SEQ ID NO: 424359 - RNA, 24 nt, Human
ccaaagugcugggauuacaggcgu

SEQ ID NO: 424360 - RNA, 25 nt, Human
ccaccuuccauccgugucuucccca

SEQ ID NO: 424361 - RNA, 23 nt, Human
cccaacaaccauacacacacaca

SEQ ID NO: 424362 - RNA, 24 nt, Human
cccaaguggcucggacuacaggug

SEQ ID NO: 424363 - RNA, 20 nt, Human
cccaccucagccucccaagu

SEQ ID NO: 424364 - RNA, 23 nt, Human
cccaccucagccucccaaguggc

SEQ ID NO: 424365 - RNA, 20 nt, Human
ccccgaguccggcccagccu

SEQ ID NO: 424366 - RNA, 21 nt, Human
ccccggcuggggcugcuugag

SEQ ID NO: 424367 - RNA, 23 nt, Human
ccgauccucccaccucagccucc

SEQ ID NO: 424368 - RNA, 24 nt, Human
ccgcaccuuucgcucagggucccc

SEQ ID NO: 424369 - RNA, 22 nt, Human
ccgcgcggccgcgcugcuccuc

SEQ ID NO: 424370 - RNA, 23 nt, Human
ccucagguaagugacucagccuu

SEQ ID NO: 424371 - RNA, 22 nt, Human
ccugccaccuucucuggggucc

SEQ ID NO: 424372 - RNA, 23 nt, Human
ccugggcucaaccgauccuccca

SEQ ID NO: 424373 - RNA, 25 nt, Human
cgaacuccugggcucaaccgauccu

SEQ ID NO: 424374 - RNA, 22 nt, Human
cgcccaacaaccauacacacac

SEQ ID NO: 424375 - RNA, 19 nt, Human
cggacuacaggugugugcc

SEQ ID NO: 424376 - RNA, 20 nt, Human
cggcaggccgccuccgcacc

SEQ ID NO: 424377 - RNA, 19 nt, Human
cggcuggggcugcuugagg

SEQ ID NO: 424378 - RNA, 18 nt, Human
cgugagccacugugcugg

SEQ ID NO: 424379 - RNA, 24 nt, Human
cucaaccgauccucccaccucagc

SEQ ID NO: 424380 - RNA, 19 nt, Human
cucaggguccccgccccuu

SEQ ID NO: 424381 - RNA, 23 nt, Human
cugcaugagcaucccucuagccu

SEQ ID NO: 424382 - RNA, 18 nt, Human
cugggggugggggccucc

SEQ ID NO: 424383 - RNA, 25 nt, Human
cugggggugggggccuccgaggggu

SEQ ID NO: 424384 - RNA, 19 nt, Human
cuucgaacuccugggcuca

SEQ ID NO: 424385 - RNA, 18 nt, Human
cuuuuuuuuuuuuuuuug

SEQ ID NO: 424386 - RNA, 24 nt, Human
gacuacaggugugugccaucaugc

SEQ ID NO: 424387 - RNA, 18 nt, Human
gauuacaggcgugagcca

SEQ ID NO: 424388 - RNA, 21 nt, Human
gauuacaggcgugagccacug

SEQ ID NO: 424389 - RNA, 24 nt, Human
gauuacaggcgugagccacugugc

SEQ ID NO: 424390 - RNA, 18 nt, Human
gcccaacaaccauacaca

SEQ ID NO: 424391 - RNA, 20 nt, Human
gccccgaguccggcccagcc

SEQ ID NO: 424392 - RNA, 24 nt, Human
gccgccuccgcaccuuucgcuccu

SEQ ID NO: 424393 - RNA, 19 nt, Human
ggacuacaggugugugcca

SEQ ID NO: 424394 - RNA, 24 nt, Human
ggacuacaggugugugccaucaug

SEQ ID NO: 424395 - RNA, 23 nt, Human
ggcaaggaaaggaugugggggag

SEQ ID NO: 424396 - RNA, 21 nt, Human
ggccugggcgucugggggugg

SEQ ID NO: 424397 - RNA, 21 nt, Human
ggcgucugggggugggggccu

SEQ ID NO: 424398 - RNA, 18 nt, Human
ggggaggcggccugggcg

SEQ ID NO: 424399 - RNA, 20 nt, Human
gggggugggggccuccgagg

SEQ ID NO: 424400 - RNA, 22 nt, Human
gggucuugcuauauugcccagg

SEQ ID NO: 424401 - RNA, 24 nt, Human
gucccucgggagccccgaguccgg

SEQ ID NO: 424402 - RNA, 24 nt, Human
gucuugcuauauugcccaggcugg

SEQ ID NO: 424403 - RNA, 23 nt, Human
guggugcaaucagaggucccugc

SEQ ID NO: 424404 - RNA, 21 nt, Human
gugugugccaucaugcccagc

SEQ ID NO: 424405 - RNA, 23 nt, Human
guuggcauaugucacuucugacc

SEQ ID NO: 424406 - RNA, 19 nt, Human
uaagugauccuuccaccuu

SEQ ID NO: 424407 - RNA, 22 nt, Human
uacaggcgugagccacugugcu

SEQ ID NO: 424408 - RNA, 21 nt, Human
uacccagccuggagugcagug

SEQ ID NO: 424409 - RNA, 24 nt, Human
uacccagccuggagugcaguggug

SEQ ID NO: 424410 - RNA, 26 nt, Human
uaggcaaggaaaggaugugggggagg

SEQ ID NO: 424411 - RNA, 18 nt, Human
uaggggggccaccugcca

SEQ ID NO: 424412 - RNA, 18 nt, Human
uagggguccuucaauccu

SEQ ID NO: 424413 - RNA, 23 nt, Human
uauauugcccaggcuggucucaa

SEQ ID NO: 424414 - RNA, 24 nt, Human
uauauugcccaggcuggucucaaa

SEQ ID NO: 424415 - RNA, 25 nt, Human
ucaaccgauccucccaccucagccu

SEQ ID NO: 424416 - RNA, 20 nt, Human
ucaagaacucaguccaugcu

SEQ ID NO: 424417 - RNA, 19 nt, Human
ucagccucccaaguggcuc

SEQ ID NO: 424418 - RNA, 21 nt, Human
ucagccucccaaguggcucgg

SEQ ID NO: 424419 - RNA, 18 nt, Human
ucagccucucugaguccu

SEQ ID NO: 424420 - RNA, 24 nt, Human
ucccaaguggcucggacuacaggu

SEQ ID NO: 424421 - RNA, 22 nt, Human
uccccgcgacggaaaguccccg

SEQ ID NO: 424422 - RNA, 23 nt, Human
ucccucuagccuggcuggcagcc

SEQ ID NO: 424423 - RNA, 22 nt, Human
ucccugcagcuucgaacuccug

SEQ ID NO: 424424 - RNA, 24 nt, Human
ucccugcagcuucgaacuccuggg

SEQ ID NO: 424425 - RNA, 20 nt, Human
uccgugucuuccccaugggg

SEQ ID NO: 424426 - RNA, 23 nt, Human
uccgugucuuccccaugggggcc

SEQ ID NO: 424427 - RNA, 19 nt, Human
uccuacgcccaacaaccau

SEQ ID NO: 424428 - RNA, 27 nt, Human
uccucccaccucagccucccaaguggc

SEQ ID NO: 424429 - RNA, 22 nt, Human
uccugggcucaaccgauccucc

SEQ ID NO: 424430 - RNA, 28 nt, Human
ucuaagugauccuuccaccuuggccugc

SEQ ID NO: 424431 - RNA, 24 nt, Human
ucucauucuguuacccagccugga

SEQ ID NO: 424432 - RNA, 20 nt, Human
ucugccuggcuggguguccu

SEQ ID NO: 424433 - RNA, 24 nt, Human
ucuguuacccagccuggagugcag

SEQ ID NO: 424434 - RNA, 23 nt, Human
ucuugcuauauugcccaggcugg

SEQ ID NO: 424435 - RNA, 24 nt, Human
ucuugcuauauugcccaggcuggu

SEQ ID NO: 424436 - RNA, 22 nt, Human
ucuugcuccaccuuccccuugg

SEQ ID NO: 424437 - RNA, 18 nt, Human
ucuuuuuuuuuuuuuuuu

SEQ ID NO: 424438 - RNA, 22 nt, Human
ugagauaaggucucauucuguu

SEQ ID NO: 424439 - RNA, 21 nt, Human
ugagauggugcccaaaugcag

SEQ ID NO: 424440 - RNA, 23 nt, Human
ugagauggugcccaaaugcagug

SEQ ID NO: 424441 - RNA, 25 nt, Human
ugagauggugcccaaaugcaguguu

SEQ ID NO: 424442 - RNA, 23 nt, Human
ugcagcuucgaacuccugggcuc

SEQ ID NO: 424443 - RNA, 20 nt, Human
ugcccagagcucuccuaggg

SEQ ID NO: 424444 - RNA, 24 nt, Human
ugcccaggcuggucucaaacuccu

SEQ ID NO: 424445 - RNA, 21 nt, Human
ugccuggcuggguguccucag

SEQ ID NO: 424446 - RNA, 24 nt, Human
ugcuauauugcccaggcuggucuc

SEQ ID NO: 424447 - RNA, 27 nt, Human
ugcuauauugcccaggcuggucucaaa

SEQ ID NO: 424448 - RNA, 24 nt, Human
ugcugggauuacaggcgugagcca

SEQ ID NO: 424449 - RNA, 18 nt, Human
uggagugcaguggugcaa

SEQ ID NO: 424450 - RNA, 21 nt, Human
uggagugcaguggugcaauca

SEQ ID NO: 424451 - RNA, 25 nt, Human
uggagugcaguggugcaaucagagg

SEQ ID NO: 424452 - RNA, 19 nt, Human
uggcagcccccagccagac

SEQ ID NO: 424453 - RNA, 18 nt, Human
uggcucggacuacaggug

SEQ ID NO: 424454 - RNA, 18 nt, Human
ugggauuacaggcgugag

SEQ ID NO: 424455 - RNA, 21 nt, Human
ugggauuacaggcgugagcca

SEQ ID NO: 424456 - RNA, 22 nt, Human
ugggauuacaggcgugagccac

SEQ ID NO: 424457 - RNA, 22 nt, Human
ugggauuacaggcgugagccac

SEQ ID NO: 424458 - RNA, 22 nt, Human
ugggauuacaggcgugagccac

SEQ ID NO: 424459 - RNA, 23 nt, Human
ugggauuacaggcgugagccacu

SEQ ID NO: 424460 - RNA, 24 nt, Human
ugggauuacaggcgugagccacug

SEQ ID NO: 424461 - RNA, 20 nt, Human
uggggcugcuugagggggag

SEQ ID NO: 424462 - RNA, 18 nt, Human
ugggggccuccgaggggu

SEQ ID NO: 424463 - RNA, 23 nt, Human
uggguacagcgcccgaggcggca

SEQ ID NO: 424464 - RNA, 18 nt, Human
uggguaugaccaaagcug

SEQ ID NO: 424465 - RNA, 24 nt, Human
uguuuuauuuuuguagugaggggu

SEQ ID NO: 424466 - RNA, 26 nt, Human
uucuuuuuuuuuuuuuuuugcuuuuu

SEQ ID NO: 424467 - RNA, 24 nt, Human
uuuuauuuuuguagugaggggucu

SEQ ID NO: 424468 - RNA, 19 nt, Human
uuuuucuuagugguucuau

SEQ ID NO: 424469 - RNA, 24 nt, Human
uuuuuuuuuuuuuuuugcuuuuua

SEQ ID NO: 424470 - RNA, 23 nt, Human
aaaaguaggcagggcagagacca

SEQ ID NO: 424471 - RNA, 23 nt, Human
aaaauccacaccaaauggcaaug

SEQ ID NO: 424472 - RNA, 18 nt, Human
aaacaaaacacaacacaa

SEQ ID NO: 424473 - RNA, 22 nt, Human
aaaguaggcagggcagagacca

SEQ ID NO: 424474 - RNA, 23 nt, Human
aauaucuuguaagaucaacaccc

SEQ ID NO: 424475 - RNA, 22 nt, Human
acaaaacacaacacaacacaca

SEQ ID NO: 424476 - RNA, 33 nt, Human
acaacacaacacacacacacacacacacacagu

SEQ ID NO: 424477 - RNA, 33 nt, Human
acacaacacaacacacacacacacacacacagu

SEQ ID NO: 424478 - RNA, 31 nt, Human; identical to SEQ ID NO: 314502

SEQ ID NO: 424479 - RNA, 23 nt, Human
acacacacacacacacacacaca

SEQ ID NO: 424480 - RNA, 23 nt, Human
acacacacacacacacacacaca

SEQ ID NO: 424481 - RNA, 23 nt, Human
acacacacacacacacacacaca

SEQ ID NO: 424482 - RNA, 24 nt, Human
acacacacacacacacacacacag

SEQ ID NO: 424483 - RNA, 25 nt, Human
acacacacacacacacacacacagu

SEQ ID NO: 424484 - RNA, 23 nt, Human
acacacacacacacacacacacg

SEQ ID NO: 424485 - RNA, 24 nt, Human
acacacacacacacacacacacga

SEQ ID NO: 424486 - RNA, 23 nt, Human
acacacacacacacacacacagu

SEQ ID NO: 424487 - RNA, 25 nt, Human
acacacacacacacacacgaccauc

SEQ ID NO: 424488 - RNA, 22 nt, Human
acaguagaaaauccacaccaaa

SEQ ID NO: 424489 - RNA, 22 nt, Human
acaguagaaaauccagaccaaa

SEQ ID NO: 424490 - RNA, 18 nt, Human
accugguaguuuccagaa

SEQ ID NO: 424491 - RNA, 26 nt, Human
acugugcugccugggacacugaacgg

SEQ ID NO: 424492 - RNA, 23 nt, Human
aggaggaguggagagucagacuu

SEQ ID NO: 424493 - RNA, 18 nt, Human
aggaguggagagucagac

SEQ ID NO: 424494 - RNA, 28 nt, Human
aggcacaccugguaguuuccagaagcac

SEQ ID NO: 424495 - RNA, 18 nt, Human
aggcacccaggcccggag

SEQ ID NO: 424496 - RNA, 18 nt, Human
aguagaaaauccacacca

SEQ ID NO: 424497 - RNA, 18 nt, Human
aguaggugggagggaggg

SEQ ID NO: 424498 - RNA, 19 nt, Human
agugaugaaaaugaauucc

SEQ ID NO: 424499 - RNA, 19 nt, Human
augaguaggugggagggag

SEQ ID NO: 424500 - RNA, 20 nt, Human
caaaacacaacacaacacac

SEQ ID NO: 424501 - RNA, 19 nt, Human
caagaggaaguccaggauc

SEQ ID NO: 424502 - RNA, 20 nt, Human
caauaucuuguaagaucaac

SEQ ID NO: 424503 - RNA, 24 nt, Human
caauaucuuguaagaucaacaccc

SEQ ID NO: 424504 - RNA, 20 nt, Human
cacacacacacacacacaca

SEQ ID NO: 424505 - RNA, 20 nt, Human
cacacacacacacacacaca

SEQ ID NO: 424506 - RNA, 20 nt, Human
cacacacacacacacacaca

SEQ ID NO: 424507 - RNA, 20 nt, Human
cacacacacacacacacaca

SEQ ID NO: 424508 - RNA, 22 nt, Human
cacacacacacacacacacaca

SEQ ID NO: 424509 - RNA, 22 nt, Human
cacacacacacacacacacaca

SEQ ID NO: 424510 - RNA, 26 nt, Human
cacacacacacacacacacacacaca

SEQ ID NO: 424511 - RNA, 26 nt, Human
cacacacacacacacacacacacacg

SEQ ID NO: 424512 - RNA, 26 nt, Human
cacacacacacacacacacacacgac

SEQ ID NO: 424513 - RNA, 27 nt, Human
cacacacacacacacacacgaccaucu

SEQ ID NO: 424514 - RNA, 22 nt, Human
cacacacacacacacacgacca

SEQ ID NO: 424515 - RNA, 18 nt, Human
cacacguggaagccgggu

SEQ ID NO: 424516 - RNA, 19 nt, Human
cacacguggaagccggguc

SEQ ID NO: 424517 - RNA, 27 nt, Human
cacccagugaugcaucuaguacuuaua

SEQ ID NO: 424518 - RNA, 19 nt, Human
cagcaagaggaaguccagg

SEQ ID NO: 424519 - RNA, 20 nt, Human
caguagaaaauccagaccaa

SEQ ID NO: 424520 - RNA, 23 nt, Human
caucaauaucuuguaagaucaac

SEQ ID NO: 424521 - RNA, 19 nt, Human
caugguuuuuauacacuaa

SEQ ID NO: 424522 - RNA, 26 nt, Human
ccagaccaaauggcaaugggcuuuua

SEQ ID NO: 424523 - RNA, 22 nt, Human
ccagggccugugagucaacuaa

SEQ ID NO: 424524 - RNA, 18 nt, Human
ccccgaugccuugcucuc

SEQ ID NO: 424525 - RNA, 23 nt, Human
cccgggucccggacucccugcug

SEQ ID NO: 424526 - RNA, 19 nt, Human
cccucccuuaaaaaacaaa

SEQ ID NO: 424527 - RNA, 20 nt, Human
cccugcugcucuggcugcug

SEQ ID NO: 424528 - RNA, 21 nt, Human
cccuggagacguucagcgcug

SEQ ID NO: 424529 - RNA, 20 nt, Human
cccuuaaaaaacaaaacaca

SEQ ID NO: 424530 - RNA, 18 nt, Human
ccggagcggagcgugugc

SEQ ID NO: 424531 - RNA, 20 nt, Human
ccgggucccggacucccugc

SEQ ID NO: 424532 - RNA, 25 nt, Human
ccugggacacugaacgguccccgag

SEQ ID NO: 424533 - RNA, 27 nt, Human
cgccugggcugccgucccggcucuggg

SEQ ID NO: 424534 - RNA, 22 nt, Human
cgcugccuugaacuccuuaccc

SEQ ID NO: 424535 - RNA, 23 nt, Human
cgcuggccucggcggcgccuaac

SEQ ID NO: 424536 - RNA, 19 nt, Human
cggcggcgccuaacuuggc

SEQ ID NO: 424537 - RNA, 19 nt, Human
cggguugcggagagccccc

SEQ ID NO: 424538 - RNA, 24 nt, Human
cucccuuaaaaaacaaaacacaac

SEQ ID NO: 424539 - RNA, 21 nt, Human
cuccggcccuggagacguuca

SEQ ID NO: 424540 - RNA, 23 nt, Human
cuccuccggcccuggagacguuc

SEQ ID NO: 424541 - RNA, 19 nt, Human
cucugauuuauuucuugcu

SEQ ID NO: 424542 - RNA, 20 nt, Human
cugccuugaacuccuuaccc

SEQ ID NO: 424543 - RNA, 21 nt, Human
cuggccucggcggcgccuaac

SEQ ID NO: 424544 - RNA, 21 nt, Human
cuuaaaaacagucuuaucagu

SEQ ID NO: 424545 - RNA, 18 nt, Human
gaaugaguaggugggagg

SEQ ID NO: 424546 - RNA, 19 nt, Human
gacgccggcuccgggacac

SEQ ID NO: 424547 - RNA, 19 nt, Human
gagcauaaaaaaagaaggg

SEQ ID NO: 424548 - RNA, 18 nt, Human
gcgaaaacgagcauaaaa

SEQ ID NO: 424549 - RNA, 21 nt, Human
gcugccugggacacugaacgg

SEQ ID NO: 424550 - RNA, 22 nt, Human
gcuguaggcacccaggcccgga

SEQ ID NO: 424551 - RNA, 19 nt, Human
ggcccggagcggagcgugu

SEQ ID NO: 424552 - RNA, 21 nt, Human
ggcgggaagugggggagcgga

SEQ ID NO: 424553 - RNA, 28 nt, Human
ggcgggaagugggggagcgggggacccc

SEQ ID NO: 424554 - RNA, 19 nt, Human
gggaagugggggagcggac

SEQ ID NO: 424555 - RNA, 21 nt, Human
gggcagagaccaacucuucca

SEQ ID NO: 424556 - RNA, 22 nt, Human
gggcgggaagugggggagcgga

SEQ ID NO: 424557 - RNA, 22 nt, Human
guacaucuauaaagacacauau

SEQ ID NO: 424558 - RNA, 19 nt, Human
guaggugggagggagggcg

SEQ ID NO: 424559 - RNA, 19 nt, Human
guucagcgcuggccucggc

SEQ ID NO: 424560 - RNA, 18 nt, Human
uaaaaaaagaagggaagg

SEQ ID NO: 424561 - RNA, 19 nt, Human
uaaaaaacaaaacacaaca

SEQ ID NO: 424562 - RNA, 26 nt, Human
uaaagucacuuucauuuuuacaacuu

SEQ ID NO: 424563 - RNA, 22 nt, Human
uaaauucccucccuuaaaaaac

SEQ ID NO: 424564 - RNA, 25 nt, Human
uaaauucccucccuuaaaaaacaaa

SEQ ID NO: 424565 - RNA, 23 nt, Human
uacaguagaaaauccacaccaaa

SEQ ID NO: 424566 - RNA, 24 nt, Human
uagaaaaugguacaauaauuccau

SEQ ID NO: 424567 - RNA, 18 nt, Human
uauacuuguagacccaaa

SEQ ID NO: 424568 - RNA, 22 nt, Human
uauacuuguagacccaaagguc

SEQ ID NO: 424569 - RNA, 18 nt, Human
uaucaguggagauccugg

SEQ ID NO: 424570 - RNA, 24 nt, Human
ucaacacccagugaugcaucuagu

SEQ ID NO: 424571 - RNA, 18 nt, Human
ucagcuauggcucuucuu

SEQ ID NO: 424572 - RNA, 22 nt, Human
uccaggaucgcggcgaggagac

SEQ ID NO: 424573 - RNA, 20 nt, Human
ucccggacucccugcugcuc

SEQ ID NO: 424574 - RNA, 22 nt, Human
ucccugcugcucuggcugcugu

SEQ ID NO: 424575 - RNA, 23 nt, Human
ucccuuaaaaaacaaaacacaac

SEQ ID NO: 424576 - RNA, 18 nt, Human
uccgggacacacguggaa

SEQ ID NO: 424577 - RNA, 18 nt, Human
ugaaaaugaauuccccuc

SEQ ID NO: 424578 - RNA, 20 nt, Human
ugaaagcaguucacacacug

SEQ ID NO: 424579 - RNA, 21 nt, Human
ugagagcaaagugaaaaaugc

SEQ ID NO: 424580 - RNA, 22 nt, Human
ugcccuggccuauaaauauucc

SEQ ID NO: 424581 - RNA, 19 nt, Human
ugccuugcucucugauuua

SEQ ID NO: 424582 - RNA, 23 nt, Human
ugcucucugauuuauuucuugcu

SEQ ID NO: 424583 - RNA, 18 nt, Human
ugcugaggcucagacccg

SEQ ID NO: 424584 - RNA, 21 nt, Human
uggaagccggguccugcagca

SEQ ID NO: 424585 - RNA, 25 nt, Human
uggaagccggguccugcagcaagag

SEQ ID NO: 424586 - RNA, 19 nt, Human
uggagagucagacuugaaa

SEQ ID NO: 424587 - RNA, 19 nt, Human
uggcccagaugccgcccgg

SEQ ID NO: 424588 - RNA, 20 nt, Human
uggcccagaugccgcccggg

SEQ ID NO: 424589 - RNA, 27 nt, Human
uuaaagucacuuucauuuuuacaacuu

SEQ ID NO: 424590 - RNA, 18 nt, Human
uuagugaggaggagugga

SEQ ID NO: 424591 - RNA, 18 nt, Human
uuagugaggaggagugga

SEQ ID NO: 424592 - RNA, 20 nt, Human
uugcucucugauuuauuucu

SEQ ID NO: 424593 - RNA, 19 nt, Human
uuggaaguuggaugaagaa

SEQ ID NO: 424594 - RNA, 20 nt, Human
uuuuuuuuuuuuuuccuuuu

SEQ ID NO: 424595 - RNA, 21 nt, Human
uuuuuuuuuuuuuuuuccuuu

SEQ ID NO: 424596 - RNA, 22 nt, Human
uuuuuuuuuuuuuuuuccuuuu

SEQ ID NO: 424597 - RNA, 24 nt, Human
uuuuuuuuuuuuuuuuccuuuuga

SEQ ID NO: 424598 - RNA, 23 nt, Human
aaaaaaaaaagaaaagaaaagaa

SEQ ID NO: 424599 - RNA, 27 nt, Human
aaaaaaaccaaaacguacacccacaaa

SEQ ID NO: 424600 - RNA, 20 nt, Human
aaaaaacaacaaaaaaaaac

SEQ ID NO: 424601 - RNA, 25 nt, Human
aaaaaacaacaaaaaaaaaccaaaa

SEQ ID NO: 424602 - RNA, 21 nt, Human
aaaaaaccaaaacguacaccc

SEQ ID NO: 424603 - RNA, 24 nt, Human
aaaaaaccaaaacguacacccaca

SEQ ID NO: 424604 - RNA, 31 nt, Human
aaaaacaaagaaaaaaaacaacaaaaaaaaa

SEQ ID NO: 424605 - RNA, 27 nt, Human
aaaaacaacaaaaaaaaaccaaaacgu

SEQ ID NO: 424606 - RNA, 22 nt, Human
aaaaaggcaaauugugacaaaa

SEQ ID NO: 424607 - RNA, 23 nt, Human
aaaagaaaagaaaaacaaagaaa

SEQ ID NO: 424608 - RNA, 19 nt, Human
aaacaacaaaaaaaaacca

SEQ ID NO: 424609 - RNA, 22 nt, Human
aaaccaaaacguacacccacaa

SEQ ID NO: 424610 - RNA, 22 nt, Human
aaacuguaucuaacacugaaac

SEQ ID NO: 424611 - RNA, 22 nt, Human
aaagaaaaaaaacaacaaaaaa

SEQ ID NO: 424612 - RNA, 22 nt, Human
aaagagaaagugcacagaugua

SEQ ID NO: 424613 - RNA, 20 nt, Human
aacccacaucuacucuaaca

SEQ ID NO: 424614 - RNA, 24 nt, Human
aagaaaaaaaacaacaaaaaaaaa

SEQ ID NO: 424615 - RNA, 24 nt, Human
aagaaaaacaaagaaaaaaaacaa

SEQ ID NO: 424616 - RNA, 30 nt, Human
aagaaaaacaaagaaaaaaaacaacaaaag

SEQ ID NO: 424617 - RNA, 21 nt, Human
aagaaaagaaaagaaaaacaa

SEQ ID NO: 424618 - RNA, 27 nt, Human
aagaaaagaaaagaaaaacaaagaaaa

SEQ ID NO: 424619 - RNA, 18 nt, Human
aagcaaaaaaaaaaaaag

SEQ ID NO: 424620 - RNA, 25 nt, Human
acaaaaaaaaaccaaaacguacacc

SEQ ID NO: 424621 - RNA, 23 nt, Human
acaaagaaaaaaaacaacaaaaa

SEQ ID NO: 424622 - RNA, 21 nt, Human
acacugaaacuacuacaggac

SEQ ID NO: 424623 - RNA, 22 nt, Human
acagcacagauucuaaacagac

SEQ ID NO: 424624 - RNA, 19 nt, Human
acaguaacagcaugaguac

SEQ ID NO: 424625 - RNA, 21 nt, Human
agaaaagaaaaacaaagaaaa

SEQ ID NO: 424626 - RNA, 21 nt, Human
agaaaagaaaaacaaagaaaa

SEQ ID NO: 424627 - RNA, 24 nt, Human
agaaaagaaaaacaaagaaaaaaa

SEQ ID NO: 424628 - RNA, 19 nt, Human
agaaaagaaaagaaaaaca

SEQ ID NO: 424629 - RNA, 26 nt, Human
agaaaagaaaagaaaaacaaagaaaa

SEQ ID NO: 424630 - RNA, 25 nt, Human
agaaaagaaaagaaaaacaaagaag

SEQ ID NO: 424631 - RNA, 19 nt, Human
agcaaaaaaaaaaaaagaa

SEQ ID NO: 424632 - RNA, 25 nt, Human
aguauccucucccaaauuaaaugac

SEQ ID NO: 424633 - RNA, 23 nt, Human
auaaacccacaucuacucuaaca

SEQ ID NO: 424634 - RNA, 20 nt, Human
caaaaaggcaaauugugaca

SEQ ID NO: 424635 - RNA, 26 nt, Human
caaaaaggcaaauugugacaaaagua

SEQ ID NO: 424636 - RNA, 24 nt, Human
caaaacguacacccacaaaaaggc

SEQ ID NO: 424637 - RNA, 24 nt, Human
caaagcggcagaaguauugaagca

SEQ ID NO: 424638 - RNA, 19 nt, Human
caauaugcauuaacaggau

SEQ ID NO: 424639 - RNA, 21 nt, Human
cacagauucuaaacagacaga

SEQ ID NO: 424640 - RNA, 21 nt, Human
caggagaggaaaggugaaggg

SEQ ID NO: 424641 - RNA, 21 nt, Human
caguaacagcaugaguacgaa

SEQ ID NO: 424642 - RNA, 21 nt, Human
cauaaaaacugagcaacuaug

SEQ ID NO: 424643 - RNA, 20 nt, Human
cccacaaaaaggcaaauugu

SEQ ID NO: 424644 - RNA, 24 nt, Human
ccccgccaggagaggaaaggugaa

SEQ ID NO: 424645 - RNA, 19 nt, Human
ccccggagcucagcaagcu

SEQ ID NO: 424646 - RNA, 22 nt, Human
cggcagaaguauugaagcaaaa

SEQ ID NO: 424647 - RNA, 31 nt, Human
cggcagaaguauugaagcaaaaaaaaaaaaa

SEQ ID NO: 424648 - RNA, 23 nt, Human
cuaaagagaaagugcacagaugu

SEQ ID NO: 424649 - RNA, 20 nt, Human
cuaacacugaaacuacuaca

SEQ ID NO: 424650 - RNA, 20 nt, Human
cucgcccgccgccgaacccc

SEQ ID NO: 424651 - RNA, 22 nt, Human
gcgagcuccgcgggccccggag

SEQ ID NO: 424652 - RNA, 24 nt, Human
uaaacccacaucuacucuaacaag

SEQ ID NO: 424653 - RNA, 25 nt, Human
uaacucauauaaaaauaacuugacc

SEQ ID NO: 424654 - RNA, 18 nt, Human
uaacuugacccuacacaa

SEQ ID NO: 424655 - RNA, 22 nt, Human
uagugauaaaaaacuacuguac

SEQ ID NO: 424656 - RNA, 23 nt, Human
ucacucgcccgccgccgaacccc

SEQ ID NO: 424657 - RNA, 23 nt, Human
uccaaagcggcagaaguauugaa

SEQ ID NO: 424658 - RNA, 18 nt, Human
uccccgguaacacucccc

SEQ ID NO: 424659 - RNA, 25 nt, Human
ucuaacacugaaacuacuacaggac

SEQ ID NO: 424660 - RNA, 21 nt, Human
uggaaaaaacuguaucuaaca

SEQ ID NO: 424661 - RNA, 22 nt, Human
uggaaaaaacuguaucuaacac

SEQ ID NO: 424662 - RNA, 19 nt, Human
uggacaguauccucuccca

SEQ ID NO: 424663 - RNA, 19 nt, Human
uggagcagcugcuccccgg

SEQ ID NO: 424664 - RNA, 19 nt, Human
ugggcaaacuuggcaguca

SEQ ID NO: 424665 - RNA, 22 nt, Human
uguacugggcaaacuuggcagu

SEQ ID NO: 424666 - RNA, 22 nt, Human
uguaugguggaaaaaacuguau

SEQ ID NO: 424667 - RNA, 19 nt, Human
uuguauuuuaaggaaaaau

SEQ ID NO: 424668 - RNA, 20 nt, Human
uuuuuuuuuuuuuaaggagu

SEQ ID NO: 424669 - RNA, 23 nt, Human
uuuuuuuuuuuuuuuuuuuaagg

SEQ ID NO: 424670 - RNA, 19 nt, Human
aaaaugcugggauuacagg

SEQ ID NO: 424671 - RNA, 19 nt, Human
aaaaugcugggauuacagg

SEQ ID NO: 424672 - RNA, 24 nt, Human
aaaaugcugggauuacaggaguga

SEQ ID NO: 424673 - RNA, 26 nt, Human
aaacacuuaacauugucaacauuucu

SEQ ID NO: 424674 - RNA, 26 nt, Human
aaaugcugggauuacaggagugagcc

SEQ ID NO: 424675 - RNA, 20 nt, Human
aaccucugccucuugggcuc

SEQ ID NO: 424676 - RNA, 19 nt, Human
aacugccucccuagggcuc

SEQ ID NO: 424677 - RNA, 22 nt, Human
aagaauaccaaaacaguuuccu

SEQ ID NO: 424678 - RNA, 27 nt, Human
aagcagcauuuauuaaccagaguacuu

SEQ ID NO: 424679 - RNA, 18 nt, Human
aagcucuuacaaaacuua

SEQ ID NO: 424680 - RNA, 20 nt, Human
aaguagcugggacuagaggc

SEQ ID NO: 424681 - RNA, 24 nt, Human
aaguagcugggacuagaggcacac

SEQ ID NO: 424682 - RNA, 19 nt, Human
acaauaagguuccaaaucc

SEQ ID NO: 424683 - RNA, 25 nt, Human
accauguugcccaggcuggucuuaa

SEQ ID NO: 424684 - RNA, 24 nt, Human
acccggcuaauuuuuuuguauuuu

SEQ ID NO: 424685 - RNA, 23 nt, Human
acccugcaaccucugccucuugg

SEQ ID NO: 424686 - RNA, 24 nt, Human
acccugcaaccucugccucuuggg

SEQ ID NO: 424687 - RNA, 23 nt, Human
accucagccucccaaguagcugg

SEQ ID NO: 424688 - RNA, 22 nt, Human
accucugccucuugggcucaag

SEQ ID NO: 424689 - RNA, 19 nt, Human
agcgguccacccaccucgg

SEQ ID NO: 424690 - RNA, 22 nt, Human
aggaacucuccacugccucguc

SEQ ID NO: 424691 - RNA, 19 nt, Human
aggcacacaccaucauacc

SEQ ID NO: 424692 - RNA, 18 nt, Human
aucaagaauaccaaaaca

SEQ ID NO: 424693 - RNA, 18 nt, Human
aucacaauaagguuccaa

SEQ ID NO: 424694 - RNA, 18 nt, Human
auggggcuucaccauguu

SEQ ID NO: 424695 - RNA, 19 nt, Human
auggggcuucaccauguug

SEQ ID NO: 424696 - RNA, 24 nt, Human
auggggcuucaccauguugcccag

SEQ ID NO: 424697 - RNA, 24 nt, Human
caaaaugcugggauuacaggagug

SEQ ID NO: 424698 - RNA, 18 nt, Human
caacaugcuuuaaaagga

SEQ ID NO: 424699 - RNA, 18 nt, Human
caacauuucuucaguuau

SEQ ID NO: 424700 - RNA, 23 nt, Human
caaccucugccucuugggcucaa

SEQ ID NO: 424701 - RNA, 23 nt, Human
caagaauaccaaaacaguuuccu

SEQ ID NO: 424702 - RNA, 23 nt, Human
caaguagcugggacuagaggcac

SEQ ID NO: 424703 - RNA, 23 nt, Human
cacacaccaucauacccggcuaa

SEQ ID NO: 424704 - RNA, 24 nt, Human
cacauguaaauauaacugaagaac

SEQ ID NO: 424705 - RNA, 23 nt, Human
caccauguugcccaggcuggucu

SEQ ID NO: 424706 - RNA, 24 nt, Human
caccauguugcccaggcuggucuu

SEQ ID NO: 424707 - RNA, 27 nt, Human
caccauguugcccaggcuggucuuaaa

SEQ ID NO: 424708 - RNA, 22 nt, Human
cacccaccucggccucccaaaa

SEQ ID NO: 424709 - RNA, 23 nt, Human
cacccaccucggccucccaaaau

SEQ ID NO: 424710 - RNA, 24 nt, Human
caccucggccucccaaaaugcugg

SEQ ID NO: 424711 - RNA, 21 nt, Human
cacuggcugaaaauaaggaag

SEQ ID NO: 424712 - RNA, 19 nt, Human
cagcgacgccgggccaggg

SEQ ID NO: 424713 - RNA, 22 nt, Human
cagggccagggccaugguccgc

SEQ ID NO: 424714 - RNA, 19 nt, Human
cauguugcccaggcugguc

SEQ ID NO: 424715 - RNA, 23 nt, Human
cauguugcccaggcuggucuuaa

SEQ ID NO: 424716 - RNA, 24 nt, Human
cauguugcccaggcuggucuuaaa

SEQ ID NO: 424717 - RNA, 22 nt, Human
ccaaaaauuuuuuuugaauccc

SEQ ID NO: 424718 - RNA, 23 nt, Human
ccaaaaggggagaaaaacuggga

SEQ ID NO: 424719 - RNA, 24 nt, Human
ccaaaaugcugggauuacaggagu

SEQ ID NO: 424720 - RNA, 22 nt, Human
ccaaguagcugggacuagaggc

SEQ ID NO: 424721 - RNA, 20 nt, Human
ccaccuccgccggcgccgcc

SEQ ID NO: 424722 - RNA, 23 nt, Human
ccagcgacgccgggccagggcca

SEQ ID NO: 424723 - RNA, 19 nt, Human
cccaaguagcugggacuag

SEQ ID NO: 424724 - RNA, 24 nt, Human
cccgcucugcgacgcugcucgggg

SEQ ID NO: 424725 - RNA, 22 nt, Human
cccugcaaccucugccucuugg

SEQ ID NO: 424726 - RNA, 25 nt, Human
ccgagccgccgccuccgccgccgcc

SEQ ID NO: 424727 - RNA, 18 nt, Human
ccgcagggacugccgcau

SEQ ID NO: 424728 - RNA, 24 nt, Human
ccgccgccaccuccgccggcgccg

SEQ ID NO: 424729 - RNA, 20 nt, Human
ccgccgccaccuccgccggg

SEQ ID NO: 424730 - RNA, 27 nt, Human
ccgccgccuccgccgccgccuguccgg

SEQ ID NO: 424731 - RNA, 22 nt, Human
ccgccgccuguccggagcccgg

SEQ ID NO: 424732 - RNA, 19 nt, Human
ccggcgccgccgccuccuu

SEQ ID NO: 424733 - RNA, 21 nt, Human
ccgucuccgccgccaccuccg

SEQ ID NO: 424734 - RNA, 20 nt, Human
ccuccgccggcgccgccgcc

SEQ ID NO: 424735 - RNA, 19 nt, Human
ccuccuucccucccgagcc

SEQ ID NO: 424736 - RNA, 24 nt, Human
ccucuugggcucaagccauccucu

SEQ ID NO: 424737 - RNA, 22 nt, Human
cgccgccaccuccgccggcgcc

SEQ ID NO: 424738 - RNA, 18 nt, Human
cgcgccgggcgccggccg

SEQ ID NO: 424739 - RNA, 24 nt, Human
cgguccacccaccucggccuccca

SEQ ID NO: 424740 - RNA, 24 nt, Human
cucaagccauccucugaccucagc

SEQ ID NO: 424741 - RNA, 24 nt, Human
cucagccucccaaguagcugggac

SEQ ID NO: 424742 - RNA, 26 nt, Human
cuccgcgccgggcgccggccgucucc

SEQ ID NO: 424743 - RNA, 23 nt, Human
cugaccucagccucccaaguagc

SEQ ID NO: 424744 - RNA, 19 nt, Human
cugcaaccucugccucuug

SEQ ID NO: 424745 - RNA, 20 nt, Human
cugcaaccucugccucuugg

SEQ ID NO: 424746 - RNA, 21 nt, Human
cugcaaccucugccucuuggg

SEQ ID NO: 424747 - RNA, 24 nt, Human
cugcaaccucugccucuugggcuc

SEQ ID NO: 424748 - RNA, 18 nt, Human
cuuugaguuucacgcacc

SEQ ID NO: 424749 - RNA, 23 nt, Human
cuuuuuuuuuuuuaaagaaggua

SEQ ID NO: 424750 - RNA, 24 nt, Human
gaaaauaaggaagaugauguuagc

SEQ ID NO: 424751 - RNA, 18 nt, Human
gauuacaggagugagcca

SEQ ID NO: 424752 - RNA, 20 nt, Human
gcccgucacccauucauacc

SEQ ID NO: 424753 - RNA, 21 nt, Human
gccgccaccuccgccggcgcc

SEQ ID NO: 424754 - RNA, 24 nt, Human
gccuccuucccucccgagccgccg

SEQ ID NO: 424755 - RNA, 20 nt, Human
gcgcugaacugccucccuag

SEQ ID NO: 424756 - RNA, 26 nt, Human
gcgcugaacugccucccuagggcucc

SEQ ID NO: 424757 - RNA, 24 nt, Human
gcgguccacccaccucggccuccc

SEQ ID NO: 424758 - RNA, 22 nt, Human
ggacgccgugaggaaagcccag

SEQ ID NO: 424759 - RNA, 24 nt, Human
ggacucaagcgguccacccaccuc

SEQ ID NO: 424760 - RNA, 22 nt, Human
gggcuucaccauguugcccagg

SEQ ID NO: 424761 - RNA, 22 nt, Human
ggggcuucaccauguugcccag

SEQ ID NO: 424762 - RNA, 23 nt, Human
ggggcuucaccauguugcccagg

SEQ ID NO: 424763 - RNA, 21 nt, Human
ggucuggcucucucucucuca

SEQ ID NO: 424764 - RNA, 22 nt, Human
guagagauggggcuucaccaug

SEQ ID NO: 424765 - RNA, 19 nt, Human
guauuuuuuguagagaugg

SEQ ID NO: 424766 - RNA, 20 nt, Human
gucuggcucucucucucuca

SEQ ID NO: 424767 - RNA, 21 nt, Human
guggugcgaucuugacccugc

SEQ ID NO: 424768 - RNA, 18 nt, Human
uaacuauuaaaccaaaag

SEQ ID NO: 424769 - RNA, 24 nt, Human
uaacugaagaacuacuucaaauaa

SEQ ID NO: 424770 - RNA, 19 nt, Human
uacagcacuaauuaugaaa

SEQ ID NO: 424771 - RNA, 24 nt, Human
uacaggagugagccaccacgccca

SEQ ID NO: 424772 - RNA, 22 nt, Human
uagagauggggcuucaccaugu

SEQ ID NO: 424773 - RNA, 18 nt, Human
uauuucaacuacaucaug

SEQ ID NO: 424774 - RNA, 24 nt, Human
ucacacuacagcgguagugggaac

SEQ ID NO: 424775 - RNA, 21 nt, Human
ucagagccaugcuaaaugcag

SEQ ID NO: 424776 - RNA, 18 nt, Human
ucagccucccaaguagcu

SEQ ID NO: 424777 - RNA, 20 nt, Human
ucagccucccaaguagcugg

SEQ ID NO: 424778 - RNA, 23 nt, Human
ucagucgcuggucaguuccuucc

SEQ ID NO: 424779 - RNA, 23 nt, Human
ucccaaaaugcugggauuacagg

SEQ ID NO: 424780 - RNA, 24 nt, Human
ucccaaguagcugggacuagaggc

SEQ ID NO: 424781 - RNA, 25 nt, Human
ucccgagccgccgccuccucgggag

SEQ ID NO: 424782 - RNA, 20 nt, Human
ucccugguugucauuuuugg

SEQ ID NO: 424783 - RNA, 19 nt, Human
uccucugaccucagccucc

SEQ ID NO: 424784 - RNA, 21 nt, Human
uccugaaagauuaaaaggccc

SEQ ID NO: 424785 - RNA, 18 nt, Human
ucggccucccaaaaugcu

SEQ ID NO: 424786 - RNA, 21 nt, Human
ucuggaagacuuccuaagcua

SEQ ID NO: 424787 - RNA, 20 nt, Human
ugaagaacuacuucaaauaa

SEQ ID NO: 424788 - RNA, 21 nt, Human
ugagacaaggucuggcucucu

SEQ ID NO: 424789 - RNA, 21 nt, Human
ugaggaaagcccagcgacgcc

SEQ ID NO: 424790 - RNA, 21 nt, Human
ugcccaggcuggucuuaaacu

SEQ ID NO: 424791 - RNA, 22 nt, Human
uggacucaagcgguccacccac

SEQ ID NO: 424792 - RNA, 21 nt, Human
ugggacuagaggcacacacca

SEQ ID NO: 424793 - RNA, 18 nt, Human
ugggagggaaauauaugg

SEQ ID NO: 424794 - RNA, 20 nt, Human
ugggagggaaauauauggug

SEQ ID NO: 424795 - RNA, 18 nt, Human
ugggauuacaggagugag

SEQ ID NO: 424796 - RNA, 19 nt, Human
ugggauuacaggagugagc

SEQ ID NO: 424797 - RNA, 22 nt, Human
ugggauuacaggagugagccac

SEQ ID NO: 424798 - RNA, 23 nt, Human
ugggauuacaggagugagccacc

SEQ ID NO: 424799 - RNA, 24 nt, Human
ugggauuacaggagugagccacca

SEQ ID NO: 424800 - RNA, 24 nt, Human
uggggcuucaccauguugcccagg

SEQ ID NO: 424801 - RNA, 24 nt, Human
uguagagauggggcuucaccaugu

SEQ ID NO: 424802 - RNA, 18 nt, Human
ugucaacauuucuucagu

SEQ ID NO: 424803 - RNA, 23 nt, Human
uuaacauugucaacauuucuuca

SEQ ID NO: 424804 - RNA, 21 nt, Human
uuauauuucaacuacaucaug

SEQ ID NO: 424805 - RNA, 18 nt, Human
uucccaauacaggcuaag

SEQ ID NO: 424806 - RNA, 20 nt, Human
uucccggaagucggcccgcu

SEQ ID NO: 424807 - RNA, 24 nt, Human
uuguagagauggggcuucaccaug

SEQ ID NO: 424808 - RNA, 25 nt, Human
uuuccacaaaggaagcagcauuuau

SEQ ID NO: 424809 - RNA, 21 nt, Human
uuugaaucccugguugucauu

SEQ ID NO: 424810 - RNA, 24 nt, Human
uuuguagagauggggcuucaccau

SEQ ID NO: 424811 - RNA, 25 nt, Human
uuuuauuuuuugagacaaggucugg

SEQ ID NO: 424812 - RNA, 20 nt, Human
uuuuugguagcuuaacccag

SEQ ID NO: 424813 - RNA, 19 nt, Human
uuuuuugaaucccugguug

SEQ ID NO: 424814 - RNA, 24 nt, Human
uuuuuuguagagauggggcuucac

SEQ ID NO: 424815 - RNA, 21 nt, Human
uuuuuuguauuuuuuguagag

SEQ ID NO: 424816 - RNA, 24 nt, Human
uuuuuuguauuuuuuguagagaug

SEQ ID NO: 424817 - RNA, 18 nt, Human
aaacaggccaccaccaga

SEQ ID NO: 424818 - RNA, 18 nt, Human
aagagaacugagacugug

SEQ ID NO: 424819 - RNA, 21 nt, Human
acaaugugaaagcaagagaac

SEQ ID NO: 424820 - RNA, 21 nt, Human
acaaugugaaagcaagagaac

SEQ ID NO: 424821 - RNA, 19 nt, Human
accagaaagcaaagagacc

SEQ ID NO: 424822 - RNA, 28 nt, Human
acccuggacccuuuucccugaagcuccu

SEQ ID NO: 424823 - RNA, 22 nt, Human
accuaugccuagcccagcccca

SEQ ID NO: 424824 - RNA, 26 nt, Human
acuggcugggacaagguucugagauu

SEQ ID NO: 424825 - RNA, 26 nt, Human
acuggcugggacaagguucugagauu

SEQ ID NO: 424826 - RNA, 24 nt, Human
agaaagcaaagagaccuaugccua

SEQ ID NO: 424827 - RNA, 21 nt, Human
agcagguuuuuacuuucaaac

SEQ ID NO: 424828 - RNA, 20 nt, Human
aggccaccaccagaaagcaa

SEQ ID NO: 424829 - RNA, 24 nt, Human
agugaacacuugcuuuuucuuccc

SEQ ID NO: 424830 - RNA, 19 nt, Human
caagagaacugagacugug

SEQ ID NO: 424831 - RNA, 23 nt, Human
caagguucugagauuugucuccc

SEQ ID NO: 424832 - RNA, 23 nt, Human
caagguucugagauuugucuccc

SEQ ID NO: 424833 - RNA, 18 nt, Human
caaugcagcaaggagcag

SEQ ID NO: 424834 - RNA, 18 nt, Human
caaugcagcaaggagcag

SEQ ID NO: 424835 - RNA, 19 nt, Human
cacacagggcgggugugug

SEQ ID NO: 424836 - RNA, 23 nt, Human
caccaccagaaagcaaagagacc

SEQ ID NO: 424837 - RNA, 18 nt, Human
cacuggcugggacaaggu

SEQ ID NO: 424838 - RNA, 18 nt, Human
cacuggcugggacaaggu

SEQ ID NO: 424839 - RNA, 20 nt, Human
cacugucauccucacuggcu

SEQ ID NO: 424840 - RNA, 20 nt, Human
cacugucauccucacuggcu

SEQ ID NO: 424841 - RNA, 22 nt, Human
cagacaaagggauuaacuaacg

SEQ ID NO: 424842 - RNA, 22 nt, Human
cagacaaagggauuaacuaacg

SEQ ID NO: 424843 - RNA, 20 nt, Human
cagcucaaagucacugacaa

SEQ ID NO: 424844 - RNA, 22 nt, Human
caucuuuauuuuuuggcgggga

SEQ ID NO: 424845 - RNA, 23 nt, Human
ccccagaaaagugauacuuuacc

SEQ ID NO: 424846 - RNA, 20 nt, Human
ccccaggaauucccugcuuc

SEQ ID NO: 424847 - RNA, 20 nt, Human
cccccaaaauauccugugua

SEQ ID NO: 424848 - RNA, 21 nt, Human
ccccccaaaauauccugugua

SEQ ID NO: 424849 - RNA, 20 nt, Human
ccccgcuggacccgaggccc

SEQ ID NO: 424850 - RNA, 23 nt, Human
ccccgcuggacccgaggcccacc

SEQ ID NO: 424851 - RNA, 24 nt, Human
cccgcgcgcgucggggcccgaccg

SEQ ID NO: 424852 - RNA, 20 nt, Human
cccgcuggacccgaggccca

SEQ ID NO: 424853 - RNA, 19 nt, Human
ccgcgccgcgcagugcugc

SEQ ID NO: 424854 - RNA, 21 nt, Human
ccuggaucaaugcagcaagga

SEQ ID NO: 424855 - RNA, 21 nt, Human
ccuggaucaaugcagcaagga

SEQ ID NO: 424856 - RNA, 25 nt, Human
ccuggcacuugcgugaggggacaca

SEQ ID NO: 424857 - RNA, 23 nt, Human
cguccgcggccccacugcggccc

SEQ ID NO: 424858 - RNA, 19 nt, Human
cuacugggaacccuggacc

SEQ ID NO: 424859 - RNA, 27 nt, Human
cuauucuauaacaguaaaagaaagaga

SEQ ID NO: 424860 - RNA, 28 nt, Human
cuccccagcaguugcuaagcuggccgac

SEQ ID NO: 424861 - RNA, 28 nt, Human
cuccccagcaguugcuaagcuggccgac

SEQ ID NO: 424862 - RNA, 19 nt, Human
cugggaacccuggacccuu

SEQ ID NO: 424863 - RNA, 18 nt, Human
gaaagcaagagaacugag

SEQ ID NO: 424864 - RNA, 18 nt, Human
gaaagcaagagaacugag

SEQ ID NO: 424865 - RNA, 24 nt, Human
gacacacacagggcgggugugugu

SEQ ID NO: 424866 - RNA, 19 nt, Human
gagaccuaugccuagccca

SEQ ID NO: 424867 - RNA, 23 nt, Human
gccaccaccagaaagcaaagaga

SEQ ID NO: 424868 - RNA, 19 nt, Human
gcccuggcacuugcgugag

SEQ ID NO: 424869 - RNA, 20 nt, Human
ggccaccaccagaaagcaaa

SEQ ID NO: 424870 - RNA, 24 nt, Human
ggugucacugucauccucacuggc

SEQ ID NO: 424871 - RNA, 23 nt, Human
gugaacacuugcuuuuucuuccc

SEQ ID NO: 424872 - RNA, 24 nt, Human
guuggagggacauuuggaaggggc

SEQ ID NO: 424873 - RNA, 19 nt, Human
guuuuauucucugcccccc

SEQ ID NO: 424874 - RNA, 19 nt, Human
guuuuauucucugcccccc

SEQ ID NO: 424875 - RNA, 20 nt, Human
uaagauuuuucacucuguug

SEQ ID NO: 424876 - RNA, 19 nt, Human
uaaguauauacgcuucccu

SEQ ID NO: 424877 - RNA, 19 nt, Human
uaaguauauacgcuucccu

SEQ ID NO: 424878 - RNA, 19 nt, Human
uacaaugugaaagcaagag

SEQ ID NO: 424879 - RNA, 19 nt, Human
uacaaugugaaagcaagag

SEQ ID NO: 424880 - RNA, 21 nt, Human
uacaaugugaaagcaagagaa

SEQ ID NO: 424881 - RNA, 21 nt, Human
uacaaugugaaagcaagagaa

SEQ ID NO: 424882 - RNA, 20 nt, Human
uacuuucacuuugcaccgca

SEQ ID NO: 424883 - RNA, 18 nt, Human
uaugacaaguacuuugcc

SEQ ID NO: 424884 - RNA, 18 nt, Human
uaugacaaguacuuugcc

SEQ ID NO: 424885 - RNA, 19 nt, Human
uaugacaaguacuuugcca

SEQ ID NO: 424886 - RNA, 19 nt, Human
uaugacaaguacuuugcca

SEQ ID NO: 424887 - RNA, 20 nt, Human
uaugacaaguacuuugccac

SEQ ID NO: 424888 - RNA, 20 nt, Human
uaugacaaguacuuugccac

SEQ ID NO: 424889 - RNA, 23 nt, Human
uauucuacucccucuggguguca

SEQ ID NO: 424890 - RNA, 23 nt, Human
uauucuacucccucuggguguca

SEQ ID NO: 424891 - RNA, 18 nt, Human
uauuucagcacucagcuc

SEQ ID NO: 424892 - RNA, 22 nt, Human
ucaaacaggccaccaccagaaa

SEQ ID NO: 424893 - RNA, 21 nt, Human
ucuaaggaaugauuugaaaaa

SEQ ID NO: 424894 - RNA, 21 nt, Human
ucuaaggaaugauuugaaaaa

SEQ ID NO: 424895 - RNA, 20 nt, Human
ugaaagcaagagaacugaga

SEQ ID NO: 424896 - RNA, 21 nt, Human
ugaaagcaagagaacugagac

SEQ ID NO: 424897 - RNA, 21 nt, Human
ugaacacuugcuuuuucuucc

SEQ ID NO: 424898 - RNA, 21 nt, Human
ugaacacuugcuuuuucuucc

SEQ ID NO: 424899 - RNA, 21 nt, Human
ugagacuauucaagaucuuuu

SEQ ID NO: 424900 - RNA, 23 nt, Human
ugaggggacacacacagggcggg

SEQ ID NO: 424901 - RNA, 21 nt, Human
uggaaggggcccagcccuggc

SEQ ID NO: 424902 - RNA, 22 nt, Human
uggaaggggcccagcccuggca

SEQ ID NO: 424903 - RNA, 22 nt, Human
uggacccuuuucccugaagcuc

SEQ ID NO: 424904 - RNA, 20 nt, Human
ugucacugucauccucacug

SEQ ID NO: 424905 - RNA, 18 nt, Human
uugcaccgcacgcgcugc

SEQ ID NO: 424906 - RNA, 20 nt, Human
uugccaccugguaguucugc

SEQ ID NO: 424907 - RNA, 18 nt, Human
uugcggaucuguguugga

SEQ ID NO: 424908 - RNA, 23 nt, Human
uuuaaguacaaugugaaagcaag

SEQ ID NO: 424909 - RNA, 23 nt, Human
uuuaaguacaaugugaaagcaag

SEQ ID NO: 424910 - RNA, 19 nt, Human
uuuauuuuuuccuucuuuu

SEQ ID NO: 424911 - RNA, 21 nt, Human
uuugccaccugguaguucugc

SEQ ID NO: 424912 - RNA, 22 nt, Human
uuuuuggcggggaugaggccgc

SEQ ID NO: 424913 - RNA, 21 nt, Human
uuuuuuggcggggaugaggcc

SEQ ID NO: 424914 - RNA, 18 nt, Human
uuuuuuuuuuuuuuuuug

SEQ ID NO: 424915 - RNA, 27 nt, Human
uuuuuuuuuuuuuuuuuuuuuuugggg

SEQ ID NO: 424916 - RNA, 24 nt, Human
aacagccacccccaguggccaguc

SEQ ID NO: 424917 - RNA, 18 nt, Human
aaccacuucaaguuuaua

SEQ ID NO: 424918 - RNA, 26 nt, Human
aacuaguccaggaggucuccggccuc

SEQ ID NO: 424919 - RNA, 22 nt, Human
acaggggagaguuuugcagaga

SEQ ID NO: 424920 - RNA, 24 nt, Human
acccaggcagcuuagacaaaccuu

SEQ ID NO: 424921 - RNA, 18 nt, Human
accuucacuucaucucca

SEQ ID NO: 424922 - RNA, 18 nt, Human
acugcagggccuccuggg

SEQ ID NO: 424923 - RNA, 19 nt, Human
agagaaguccccugacucc

SEQ ID NO: 424924 - RNA, 21 nt, Human
agagggucagcccucuggaac

SEQ ID NO: 424925 - RNA, 25 nt, Human
aggcagagauggccucgccccaggg

SEQ ID NO: 424926 - RNA, 24 nt, Human
aggcagggaggacucaggacuaca

SEQ ID NO: 424927 - RNA, 18 nt, Human
aucagagaggcucaauua

SEQ ID NO: 424928 - RNA, 23 nt, Human
caagggcugcggggccaguggcc

SEQ ID NO: 424929 - RNA, 24 nt, Human
cagcccucuuuagccuuucuguuu

SEQ ID NO: 424930 - RNA, 21 nt, Human
cagcguaacaaaaaaccugca

SEQ ID NO: 424931 - RNA, 21 nt, Human
cagucccgaacagccaccccc

SEQ ID NO: 424932 - RNA, 21 nt, Human
caguguggucccacacagggc

SEQ ID NO: 424933 - RNA, 20 nt, Human
ccacgggggccucccaaggg

SEQ ID NO: 424934 - RNA, 20 nt, Human
ccaggguggggucuagagga

SEQ ID NO: 424935 - RNA, 23 nt, Human
cccacacagggccacauccacgg

SEQ ID NO: 424936 - RNA, 22 nt, Human
ccccagggcccgcucccucaga

SEQ ID NO: 424937 - RNA, 23 nt, Human
cccccaguggccagucuccucgc

SEQ ID NO: 424938 - RNA, 21 nt, Human
ccccuggggaugcaacaccuu

SEQ ID NO: 424939 - RNA, 24 nt, Human
ccguggauacccaggcagcuuaga

SEQ ID NO: 424940 - RNA, 23 nt, Human
ccucugcggcagccccuggggau

SEQ ID NO: 424941 - RNA, 24 nt, Human
ccucuggaacuuugcaaagguggg

SEQ ID NO: 424942 - RNA, 22 nt, Human
ccugacuccagcccucuuuagc

SEQ ID NO: 424943 - RNA, 18 nt, Human
ccugcaacccuacaacac

SEQ ID NO: 424944 - RNA, 19 nt, Human
ccugcaacccuacaacaca

SEQ ID NO: 424945 - RNA, 21 nt, Human
cgacucagccuccaccgcugg

SEQ ID NO: 424946 - RNA, 20 nt, Human
cggccucugcggcagccccu

SEQ ID NO: 424947 - RNA, 20 nt, Human
cucagccuccaccgcuggcc

SEQ ID NO: 424948 - RNA, 22 nt, Human
cucagccuccaccgcuggcgcc

SEQ ID NO: 424949 - RNA, 19 nt, Human
cuccucgccgaacuagucc

SEQ ID NO: 424950 - RNA, 19 nt, Human
gacagaaagugacagcagc

SEQ ID NO: 424951 - RNA, 20 nt, Human
gacagcagcguaacaaaaaa

SEQ ID NO: 424952 - RNA, 19 nt, Human
gacuccagcccucuuuagc

SEQ ID NO: 424953 - RNA, 24 nt, Human
gcagaaccuccuuugcuggcaaag

SEQ ID NO: 424954 - RNA, 23 nt, Human
gcagagauggccucgccccaggg

SEQ ID NO: 424955 - RNA, 20 nt, Human
gcggcagccccuggggaugc

SEQ ID NO: 424956 - RNA, 24 nt, Human
gcguaacaaaaaaccugcaacccu

SEQ ID NO: 424957 - RNA, 24 nt, Human
gcucucagucccgaacagccaccu

SEQ ID NO: 424958 - RNA, 28 nt, Human
ggacucaggacuacaugugcgcuggggg

SEQ ID NO: 424959 - RNA, 24 nt, Human
ggaucaggcuuuucugccagcagc

SEQ ID NO: 424960 - RNA, 18 nt, Human
ggaugcaacaccuucccu

SEQ ID NO: 424961 - RNA, 20 nt, Human
ggggccaguggccucucagg

SEQ ID NO: 424962 - RNA, 19 nt, Human
gggucgggggaacugcagg

SEQ ID NO: 424963 - RNA, 19 nt, Human
gugacagcagcguaacaaa

SEQ ID NO: 424964 - RNA, 23 nt, Human
uacaacacaaccacuucaaguuu

SEQ ID NO: 424965 - RNA, 22 nt, Human
uagaggacaggggagaguuuug

SEQ ID NO: 424966 - RNA, 20 nt, Human
uauuccagacugccauccgc

SEQ ID NO: 424967 - RNA, 21 nt, Human
ucccaagggcugcggggccag

SEQ ID NO: 424968 - RNA, 25 nt, Human
ucccgaacagccacccccaguggcc

SEQ ID NO: 424969 - RNA, 19 nt, Human
ucucaggcagggaggacuc

SEQ ID NO: 424970 - RNA, 22 nt, Human
ugacuccagcccucuuuagccu

SEQ ID NO: 424971 - RNA, 18 nt, Human
ugagaaugaauuaacugg

SEQ ID NO: 424972 - RNA, 20 nt, Human
ugcacacucacauacaccca

SEQ ID NO: 424973 - RNA, 19 nt, Human
ugcgcuggggggcguggga

SEQ ID NO: 424974 - RNA, 23 nt, Human
ugcggggccaguggccucucagg

SEQ ID NO: 424975 - RNA, 18 nt, Human
ugggaggggcggccucgg

SEQ ID NO: 424976 - RNA, 22 nt, Human
ugggaucaggcuuuucugccag

SEQ ID NO: 424977 - RNA, 23 nt, Human
uucaucuccaucaucagagaggc

SEQ ID NO: 424978 - RNA, 21 nt, Human
uugcuguuuuugucccgugga

SEQ ID NO: 424979 - RNA, 21 nt, Human
uuucugccagcagcgagauga

SEQ ID NO: 424980 - RNA, 19 nt, Human
aaacuggaggcaagccagg

SEQ ID NO: 424981 - RNA, 22 nt, Human
aaagagcccccucagcaggugu

SEQ ID NO: 424982 - RNA, 23 nt, Human
aagcaaacuaaaggaccuaaaac

SEQ ID NO: 424983 - RNA, 24 nt, Human
aagggggaagagaaaugauaaaga

SEQ ID NO: 424984 - RNA, 20 nt, Human
acagguucuuccuucacuga

SEQ ID NO: 424985 - RNA, 21 nt, Human
agaaagcaccuuucagaagcu

SEQ ID NO: 424986 - RNA, 24 nt, Human
agaaaugauaaagaaccauucaua

SEQ ID NO: 424987 - RNA, 21 nt, Human
agcuguaguucucaauuauag

SEQ ID NO: 424988 - RNA, 18 nt, Human
aggcaggaagauggcuuu

SEQ ID NO: 424989 - RNA, 21 nt, Human
aggggcugagaggugcuuccu

SEQ ID NO: 424990 - RNA, 22 nt, Human
agggggaagagaaaugauaaag

SEQ ID NO: 424991 - RNA, 18 nt, Human
caaggaaaagggcaacag

SEQ ID NO: 424992 - RNA, 23 nt, Human
caccgcgcaccgcgcgccgcagc

SEQ ID NO: 424993 - RNA, 22 nt, Human
cagacaggcuucucugcuaucc

SEQ ID NO: 424994 - RNA, 21 nt, Human
cagcagguguucccguugcuu

SEQ ID NO: 424995 - RNA, 18 nt, Human
caggaagauggcuuuggg

SEQ ID NO: 424996 - RNA, 22 nt, Human
caguggcuggaugaaagcagau

SEQ ID NO: 424997 - RNA, 24 nt, Human
cccaagaaugguuuacaccaagca

SEQ ID NO: 424998 - RNA, 20 nt, Human
ccccucagcagguguucccg

SEQ ID NO: 424999 - RNA, 23 nt, Human
ccgcgcaccgcgcgccgcagccg

SEQ ID NO: 425000 - RNA, 18 nt, Human
ccgcgcgccgcagccgcc

SEQ ID NO: 425001 - RNA, 24 nt, Human
ccucagcagguguucccguugcuu

SEQ ID NO: 425002 - RNA, 20 nt, Human
ccuccaggcaguguaauagu

SEQ ID NO: 425003 - RNA, 19 nt, Human
cuccagacuacgcaccgcg

SEQ ID NO: 425004 - RNA, 21 nt, Human
cucugaggggcugagaggugc

SEQ ID NO: 425005 - RNA, 18 nt, Human
cugcuauccuccaggcag

SEQ ID NO: 425006 - RNA, 24 nt, Human
cuuugggcaguggcuggaugaaag

SEQ ID NO: 425007 - RNA, 22 nt, Human
gaagcaaacuaaaggaccuaaa

SEQ ID NO: 425008 - RNA, 18 nt, Human
gcuuggcucucugucuca

SEQ ID NO: 425009 - RNA, 21 nt, Human
gggaacccccguauccacagu

SEQ ID NO: 425010 - RNA, 19 nt, Human
guaguuuuaaauaaaugga

SEQ ID NO: 425011 - RNA, 26 nt, Human
uaaaacuggaggcaagccaggaugcc

SEQ ID NO: 425012 - RNA, 23 nt, Human
uaaaaguacaaucuuaaaagcug

SEQ ID NO: 425013 - RNA, 24 nt, Human
uaagacuaggggcuugguauauau

SEQ ID NO: 425014 - RNA, 19 nt, Human
uaauaugucucaauaccuu

SEQ ID NO: 425015 - RNA, 18 nt, Human
uaccacauuagcuuggcu

SEQ ID NO: 425016 - RNA, 18 nt, Human
uaccugggggucaucuau

SEQ ID NO: 425017 - RNA, 22 nt, Human
uaccugggggucaucuaugaga

SEQ ID NO: 425018 - RNA, 19 nt, Human
uagcaggaaaaaauuccau

SEQ ID NO: 425019 - RNA, 18 nt, Human
ucaaaagacaauaccugg

SEQ ID NO: 425020 - RNA, 21 nt, Human
ucacuguaagcauccaguagg

SEQ ID NO: 425021 - RNA, 24 nt, Human
ucacuguaagcauccaguaggcag

SEQ ID NO: 425022 - RNA, 18 nt, Human
ucaucuucuacagguucu

SEQ ID NO: 425023 - RNA, 20 nt, Human
ucccaagaaugguuuacacc

SEQ ID NO: 425024 - RNA, 20 nt, Human
uccggaacgaggucaucuuc

SEQ ID NO: 425025 - RNA, 26 nt, Human
ugaaguacagacaggcuucucugcua

SEQ ID NO: 425026 - RNA, 22 nt, Human
ugagacaaugaauucaggguga

SEQ ID NO: 425027 - RNA, 18 nt, Human
ugagauacccagcuccgg

SEQ ID NO: 425028 - RNA, 19 nt, Human
ugaggggcugagaggugcu

SEQ ID NO: 425029 - RNA, 22 nt, Human
uggagaaagcaccuuucagaag

SEQ ID NO: 425030 - RNA, 18 nt, Human
uggcaaaaguguccuccc

SEQ ID NO: 425031 - RNA, 24 nt, Human
uucaagacauuugucuaaugaccc

SEQ ID NO: 425032 - RNA, 23 nt, Human
uucauaaauuccaugucuacuuc

SEQ ID NO: 425033 - RNA, 22 nt, Human
uucucugcuauccuccaggcag

SEQ ID NO: 425034 - RNA, 23 nt, Human
uugcauuguaccuuuuaauugca

SEQ ID NO: 425035 - RNA, 25 nt, Human
uugcauuguaccuuuuaauugcaug

SEQ ID NO: 425036 - RNA, 20 nt, Human
uuucuauaauuucacaaaag

SEQ ID NO: 425037 - RNA, 25 nt, Human
uuuugaaugaaguacagacaggcuu

SEQ ID NO: 425038 - RNA, 19 nt, Human
uuuuuuuuuuuuuuuugca

SEQ ID NO: 425039 - RNA, 18 nt, Human
uuuuuuuuuuuuuuuuug

SEQ ID NO: 425040 - RNA, 19 nt, Human
uuuuuuuuuuuuuuuuugc

SEQ ID NO: 425041 - RNA, 21 nt, Human
aagcuggacucuaagagagau

SEQ ID NO: 425042 - RNA, 19 nt, Human
aaggguauugauuuuuacu

SEQ ID NO: 425043 - RNA, 19 nt, Human
aauaaaguuucuuuauacc

SEQ ID NO: 425044 - RNA, 22 nt, Human
aauaggacaccaaaauaaaaca

SEQ ID NO: 425045 - RNA, 22 nt, Human
acucuaagagagauugauauag

SEQ ID NO: 425046 - RNA, 21 nt, Human
agcguguaaagugaaaugagc

SEQ ID NO: 425047 - RNA, 19 nt, Human
agugaauacagaagacauu

SEQ ID NO: 425048 - RNA, 18 nt, Human
auaaaguuucuuuauacc

SEQ ID NO: 425049 - RNA, 26 nt, Human
auaggacaccaaaauaaaacacaaag

SEQ ID NO: 425050 - RNA, 26 nt, Human
augauaacuagcguaauggcaaauac

SEQ ID NO: 425051 - RNA, 19 nt, Human
augguuaccaucaaagaga

SEQ ID NO: 425052 - RNA, 23 nt, Human
caaggucagaaaucaaacaacaa

SEQ ID NO: 425053 - RNA, 24 nt, Human
cagaaugggaacccagugaagacu

SEQ ID NO: 425054 - RNA, 25 nt, Human
cauuuuauuccuuuaauaggacacc

SEQ ID NO: 425055 - RNA, 19 nt, Human
cccucagaaugggaaccca

SEQ ID NO: 425056 - RNA, 24 nt, Human
cucagaaugggaacccagugaaga

SEQ ID NO: 425057 - RNA, 21 nt, Human
ggacaccaaaauaaaacacaa

SEQ ID NO: 425058 - RNA, 20 nt, Human
uauugcaugggucagcauuu

SEQ ID NO: 425059 - RNA, 24 nt, Human
ucagaaaucaaacaacaaugauac

SEQ ID NO: 425060 - RNA, 24 nt, Human
ugaaaugagcuggcuggcuggaga

SEQ ID NO: 425061 - RNA, 23 nt, Human
ugagcauuuaauuaaaaguuuac

SEQ ID NO: 425062 - RNA, 20 nt, Human
ugagcuggcuggcuggagac

SEQ ID NO: 425063 - RNA, 23 nt, Human
ugaggaaauauugcaugggucaa

SEQ ID NO: 425064 - RNA, 18 nt, Human
ugaguauaaacucagucc

SEQ ID NO: 425065 - RNA, 19 nt, Human
ugcaaauugugaucacauu

SEQ ID NO: 425066 - RNA, 19 nt, Human
ugcaugggucagcauuugg

SEQ ID NO: 425067 - RNA, 19 nt, Human
uggcuggagacggacaggg

SEQ ID NO: 425068 - RNA, 18 nt, Human
uguaaagugaaaugagcu

SEQ ID NO: 425069 - RNA, 21 nt, Human
uguguaaagaaccauuacaag

SEQ ID NO: 425070 - RNA, 22 nt, Human
uugcuaaugggacaaaaaaggg

SEQ ID NO: 425071 - RNA, 21 nt, Human
aagcccaaaggcagcacaaga

SEQ ID NO: 425072 - RNA, 21 nt, Human
acaggucugucauucugugac

SEQ ID NO: 425073 - RNA, 19 nt, Human
agacagaaaaugauccuaa

SEQ ID NO: 425074 - RNA, 18 nt, Human
agguugggguccccgaac

SEQ ID NO: 425075 - RNA, 21 nt, Human
aguaaguggggaauagcacaa

SEQ ID NO: 425076 - RNA, 21 nt, Human
augauuaaaacagaccggggc

SEQ ID NO: 425077 - RNA, 19 nt, Human
cagcacaagaagacucugc

SEQ ID NO: 425078 - RNA, 19 nt, Human
ccccgaacuccagguaccu

SEQ ID NO: 425079 - RNA, 24 nt, Human
ccccgaacuccagguaccucacuc

SEQ ID NO: 425080 - RNA, 19 nt, Human
ccuccugcuccauggaagc

SEQ ID NO: 425081 - RNA, 23 nt, Human
cgaacuccagguaccucacuccu

SEQ ID NO: 425082 - RNA, 21 nt, Human
cugugguauguuccuccugcu

SEQ ID NO: 425083 - RNA, 23 nt, Human
guuuugaauuugcuuaucauugu

SEQ ID NO: 425084 - RNA, 22 nt, Human
uaaaacagacagaaaaugaucc

SEQ ID NO: 425085 - RNA, 24 nt, Human
uaagagacacuggcagguaguuau

SEQ ID NO: 425086 - RNA, 22 nt, Human
uaggcauaacaguuuugaauuu

SEQ ID NO: 425087 - RNA, 19 nt, Human
uauuccagauacaugauua

SEQ ID NO: 425088 - RNA, 25 nt, Human
uggaagcccaaaggcagcacaagaa

SEQ ID NO: 425089 - RNA, 20 nt, Human
ugucauucugugacuuuaau

SEQ ID NO: 425090 - RNA, 19 nt, Human
ugucuuccaaaucccaucu

SEQ ID NO: 425091 - RNA, 23 nt, Human
ugugacuuuaauagauccauguu

SEQ ID NO: 425092 - RNA, 20 nt, Human
uguucugugguauguuccuc

SEQ ID NO: 425093 - RNA, 25 nt, Human
uuccaaaucccaucuugacaaauca

SEQ ID NO: 425094 - RNA, 21 nt, Human
uuuuuuuuuuuuuuuuugagg

SEQ ID NO: 425095 - RNA, 20 nt, Human
aaaaaauaaaaauaaccugc

SEQ ID NO: 425096 - RNA, 24 nt, Human
aaaaugaucuacugccuggacacc

SEQ ID NO: 425097 - RNA, 21 nt, Human
aaaauuccagggcuuucaugg

SEQ ID NO: 425098 - RNA, 26 nt, Human
aaacucacauccaaauaaugccuuga

SEQ ID NO: 425099 - RNA, 20 nt, Human
aacaugccuagucaguggga

SEQ ID NO: 425100 - RNA, 23 nt, Human
aaccaaacuugaacagcccuccc

SEQ ID NO: 425101 - RNA, 25 nt, Human
aaccuaaugaaucuaaccaguacaa

SEQ ID NO: 425102 - RNA, 19 nt, Human
aacuugucagugaaaaggc

SEQ ID NO: 425103 - RNA, 19 nt, Human
aagaaaugcuguauuugac

SEQ ID NO: 425104 - RNA, 28 nt, Human
aagaauauauacugcuuucuugaccucc

SEQ ID NO: 425105 - RNA, 20 nt, Human
aagcagucaacgaaagcuca

SEQ ID NO: 425106 - RNA, 18 nt, Human
aaggcuggaaaaaaccag

SEQ ID NO: 425107 - RNA, 20 nt, Human
aaugacacuacuuauuucuu

SEQ ID NO: 425108 - RNA, 21 nt, Human
acaaaaaagcccuaaugagau

SEQ ID NO: 425109 - RNA, 21 nt, Human
acacauuuuaacuccaaacac

SEQ ID NO: 425110 - RNA, 22 nt, Human
acacccccacaaaguuaaacca

SEQ ID NO: 425111 - RNA, 20 nt, Human
acccuaguaaucuuuuuugg

SEQ ID NO: 425112 - RNA, 22 nt, Human
acucccaaggccugagcugaag

SEQ ID NO: 425113 - RNA, 18 nt, Human
acucuauuccuugaaaua

SEQ ID NO: 425114 - RNA, 21 nt, Human
agaaagaaaguacugacaccc

SEQ ID NO: 425115 - RNA, 20 nt, Human
agaagaacacaacaugguua

SEQ ID NO: 425116 - RNA, 21 nt, Human
agagguuuuccuggcuucuuc

SEQ ID NO: 425117 - RNA, 20 nt, Human
agcccuaaugagaugaaaau

SEQ ID NO: 425118 - RNA, 26 nt, Human
aggaagaaacaaaaaaugagggaccc

SEQ ID NO: 425119 - RNA, 20 nt, Human
aggaagucuaaacauguuug

SEQ ID NO: 425120 - RNA, 21 nt, Human
agggugucagaggauacaacu

SEQ ID NO: 425121 - RNA, 24 nt, Human
auaaaugugugaagugggcuuugg

SEQ ID NO: 425122 - RNA, 20 nt, Human
auagugcaagugguaaguga

SEQ ID NO: 425123 - RNA, 21 nt, Human
auuugaucuuucugauaaccu

SEQ ID NO: 425124 - RNA, 18 nt, Human
caaaaaccaaacuugaac

SEQ ID NO: 425125 - RNA, 23 nt, Human
caaagcaccaagaaauuuaaaaa

SEQ ID NO: 425126 - RNA, 22 nt, Human
caaagucuccaaaucuaggccc

SEQ ID NO: 425127 - RNA, 27 nt, Human
caaauuaacucacaauuaugccaaguc

SEQ ID NO: 425128 - RNA, 20 nt, Human
caaggcuggaaaaaaccagu

SEQ ID NO: 425129 - RNA, 19 nt, Human
caauaggacaaccuagcuc

SEQ ID NO: 425130 - RNA, 25 nt, Human
cacacagaaagaaaguacugacacc

SEQ ID NO: 425131 - RNA, 19 nt, Human
cacauccaaauaaugccuu

SEQ ID NO: 425132 - RNA, 19 nt, Human
caccccuccugauccagaa

SEQ ID NO: 425133 - RNA, 19 nt, Human
caccccuccugauccagaa

SEQ ID NO: 425134 - RNA, 18 nt, Human
caccugaacugggugaga

SEQ ID NO: 425135 - RNA, 20 nt, Human
cagaaagaaaguacugacac

SEQ ID NO: 425136 - RNA, 19 nt, Human
caggacagcucuuggguga

SEQ ID NO: 425137 - RNA, 22 nt, Human
cauacacucauaaccauagcac

SEQ ID NO: 425138 - RNA, 22 nt, Human
caucaacgacugcagagaagca

SEQ ID NO: 425139 - RNA, 22 nt, Human
cauggcuuauguuuucaccccg

SEQ ID NO: 425140 - RNA, 22 nt, Human
ccacacagaaagaaaguacuga

SEQ ID NO: 425141 - RNA, 22 nt, Human
ccauuugccacugcagagccuc

SEQ ID NO: 425142 - RNA, 18 nt, Human
cccacaaaguuaaaccac

SEQ ID NO: 425143 - RNA, 21 nt, Human
cccacaaaguuaaaccacaaa

SEQ ID NO: 425144 - RNA, 21 nt, Human
cccacaccucacucccaaggc

SEQ ID NO: 425145 - RNA, 22 nt, Human
cccccacaaaguuaaaccacaa

SEQ ID NO: 425146 - RNA, 18 nt, Human
cuaaggaacaaagucucc

SEQ ID NO: 425147 - RNA, 24 nt, Human
cuacugccuggacacccccacaaa

SEQ ID NO: 425148 - RNA, 23 nt, Human
cucauaaccauagcacuaauguu

SEQ ID NO: 425149 - RNA, 20 nt, Human
cucuacacugggcugucucc

SEQ ID NO: 425150 - RNA, 23 nt, Human
cugaaaaacacauuuuaacucca

SEQ ID NO: 425151 - RNA, 21 nt, Human
cugccuggacacccccacaaa

SEQ ID NO: 425152 - RNA, 21 nt, Human
cugugcucugagaccuugggu

SEQ ID NO: 425153 - RNA, 23 nt, Human
cuguggcggcggcggccguugcc

SEQ ID NO: 425154 - RNA, 21 nt, Human
cuucagguuacccaaaccagc

SEQ ID NO: 425155 - RNA, 21 nt, Human
cuugaaucaauuagagacagc

SEQ ID NO: 425156 - RNA, 21 nt, Human
gaacagguaagccccucuccu

SEQ ID NO: 425157 - RNA, 26 nt, Human
gaacauuaaagggugucagaggauac

SEQ ID NO: 425158 - RNA, 18 nt, Human
gaagacauacuucacccc

SEQ ID NO: 425159 - RNA, 21 nt, Human
gaagugccaaucucuacacug

SEQ ID NO: 425160 - RNA, 21 nt, Human
gcucaccggggacggacgcag

SEQ ID NO: 425161 - RNA, 18 nt, Human
ggaauggggaggcaggag

SEQ ID NO: 425162 - RNA, 24 nt, Human
ggcuuugggugucggacaaaccag

SEQ ID NO: 425163 - RNA, 21 nt, Human
guggaucccuauuccauaugg

SEQ ID NO: 425164 - RNA, 28 nt, Human
guggcggcggcggccguugacgacggcg

SEQ ID NO: 425165 - RNA, 32 nt, Human
guggcggcggcuguguggcuguggcggcgacg

SEQ ID NO: 425166 - RNA, 20 nt, Human
guggcuguggcggcggcggc

SEQ ID NO: 425167 - RNA, 21 nt, Human
guguggcuguggcggcggcga

SEQ ID NO: 425168 - RNA, 24 nt, Human
guuacccaaaccagcagucuggaa

SEQ ID NO: 425169 - RNA, 24 nt, Human
uaaaacugacaaaauacccaaaug

SEQ ID NO: 425170 - RNA, 19 nt, Human
uaaaaugguccugacaggc

SEQ ID NO: 425171 - RNA, 19 nt, Human
uaacaugccuagucagugg

SEQ ID NO: 425172 - RNA, 22 nt, Human
uaaccaagguaacucuucuaaa

SEQ ID NO: 425173 - RNA, 18 nt, Human
uaacgaguaucaaaccca

SEQ ID NO: 425174 - RNA, 23 nt, Human
uaacuugucagugaaaaggccag

SEQ ID NO: 425175 - RNA, 25 nt, Human
uaacuugucagugaaaaggccagua

SEQ ID NO: 425176 - RNA, 20 nt, Human
uacaaggagaaauugaaaaa

SEQ ID NO: 425177 - RNA, 22 nt, Human
uacacucauaaccauagcacua

SEQ ID NO: 425178 - RNA, 20 nt, Human
uacaugaagagugcauggaa

SEQ ID NO: 425179 - RNA, 21 nt, Human
uacucccacaccucacuccca

SEQ ID NO: 425180 - RNA, 23 nt, Human
uacuucacccccauccagccaaa

SEQ ID NO: 425181 - RNA, 23 nt, Human
uagugcaagugguaagugaugug

SEQ ID NO: 425182 - RNA, 21 nt, Human
uaucaaagaaucacaacuuuc

SEQ ID NO: 425183 - RNA, 22 nt, Human
uaugcacauaugugauuacaug

SEQ ID NO: 425184 - RNA, 23 nt, Human
uaugcacauaugugauuacauga

SEQ ID NO: 425185 - RNA, 19 nt, Human
ucaaaugagaaaaaccaaa

SEQ ID NO: 425186 - RNA, 23 nt, Human
ucaaguugcucaccuaucuucua

SEQ ID NO: 425187 - RNA, 20 nt, Human
ucaguuggagcaacuauccu

SEQ ID NO: 425188 - RNA, 22 nt, Human
ucauucaaccuaaugaaucuaa

SEQ ID NO: 425189 - RNA, 21 nt, Human
ucccaaggccugagcugaagg

SEQ ID NO: 425190 - RNA, 20 nt, Human
ucccacaccucacucccaag

SEQ ID NO: 425191 - RNA, 23 nt, Human
ucgcauauccacucaggaacuca

SEQ ID NO: 425192 - RNA, 22 nt, Human
ucuuuaucaaauuaacucacaa

SEQ ID NO: 425193 - RNA, 24 nt, Human
ugaaaaacacauuuuaacuccaaa

SEQ ID NO: 425194 - RNA, 23 nt, Human
ugaaaagauuaaacucacaucca

SEQ ID NO: 425195 - RNA, 20 nt, Human
ugaaaagggagcgcuauugc

SEQ ID NO: 425196 - RNA, 19 nt, Human
ugaaacaaauagggucucc

SEQ ID NO: 425197 - RNA, 19 nt, Human
ugaaacaaauagggucucc

SEQ ID NO: 425198 - RNA, 25 nt, Human
ugacaaaauacccaaaugaguuacc

SEQ ID NO: 425199 - RNA, 18 nt, Human
ugacuaaagaauggccuu

SEQ ID NO: 425200 - RNA, 22 nt, Human
ugacuaaagaauggccuuacag

SEQ ID NO: 425201 - RNA, 22 nt, Human
ugagaggaagucuaaacauguu

SEQ ID NO: 425202 - RNA, 20 nt, Human
ugcagugugaacuguaauuu

SEQ ID NO: 425203 - RNA, 23 nt, Human
ugcauuccaugaaagacaaaaau

SEQ ID NO: 425204 - RNA, 19 nt, Human
uggcaaaacccuaguaauu

SEQ ID NO: 425205 - RNA, 22 nt, Human
uggcacuagaucuacgcauuuu

SEQ ID NO: 425206 - RNA, 22 nt, Human
uggcggcggcuguguggcugug

SEQ ID NO: 425207 - RNA, 23 nt, Human
uggcggcggcuguguggcugugg

SEQ ID NO: 425208 - RNA, 22 nt, Human
uggcuauguacaaaaaagcccu

SEQ ID NO: 425209 - RNA, 22 nt, Human
uggcuguggcggcggcggccgu

SEQ ID NO: 425210 - RNA, 21 nt, Human
ugggaucacucaaguugcuca

SEQ ID NO: 425211 - RNA, 21 nt, Human
ugggauguaauuaauuagaca

SEQ ID NO: 425212 - RNA, 23 nt, Human
ugggugagagauuucuguggggu

SEQ ID NO: 425213 - RNA, 18 nt, Human
ugguagugaggaaaacuc

SEQ ID NO: 425214 - RNA, 23 nt, Human
ugguuuguuuuaugccaauagga

SEQ ID NO: 425215 - RNA, 19 nt, Human
ugugaagugggcuuugggu

SEQ ID NO: 425216 - RNA, 18 nt, Human
ugugcucugagaccuugg

SEQ ID NO: 425217 - RNA, 21 nt, Human
uguguaucuaugcacauaugu

SEQ ID NO: 425218 - RNA, 22 nt, Human
uguguaucuaugcacauaugug

SEQ ID NO: 425219 - RNA, 20 nt, Human
uuaaaaacauuuucaaagca

SEQ ID NO: 425220 - RNA, 25 nt, Human
uuaucaaauuaacucacaauuaugc

SEQ ID NO: 425221 - RNA, 22 nt, Human
uucacccccauccagccaaaug

SEQ ID NO: 425222 - RNA, 18 nt, Human
uuccaaagaaaugcugua

SEQ ID NO: 425223 - RNA, 18 nt, Human
uugaacagcccucccuga

SEQ ID NO: 425224 - RNA, 19 nt, Human
uugccacugcagagccuca

SEQ ID NO: 425225 - RNA, 25 nt, Human
uuggucaccaggacagcucuugggu

SEQ ID NO: 425226 - RNA, 18 nt, Human
uuguagguuaacagagaa

SEQ ID NO: 425227 - RNA, 23 nt, Human
uuuaauauauauuuucccauuua

SEQ ID NO: 425228 - RNA, 22 nt, Human
uuuaaugguagaaauaauggca

SEQ ID NO: 425229 - RNA, 18 nt, Human
uuuccuggcuucuuccca

SEQ ID NO: 425230 - RNA, 18 nt, Human
uuuguaaauuucucagac

SEQ ID NO: 425231 - RNA, 23 nt, Human
uuuuauucaaagucauauauuuu

SEQ ID NO: 425232 - RNA, 19 nt, Human
aacuguguuuuagacucug

SEQ ID NO: 425233 - RNA, 22 nt, Human
aacuguguuuuagacucuggug

SEQ ID NO: 425234 - RNA, 18 nt, Human
aauggccacuuucucuuu

SEQ ID NO: 425235 - RNA, 21 nt, Human
acagugcuucuggaugauuuu

SEQ ID NO: 425236 - RNA, 20 nt, Human
acuguguuuuagacucuggu

SEQ ID NO: 425237 - RNA, 20 nt, Human
agaaaaaaaaagauuuguua

SEQ ID NO: 425238 - RNA, 19 nt, Human
agaaacuaaauaucaauau

SEQ ID NO: 425239 - RNA, 19 nt, Human
agaaacuaaauaucaauau

SEQ ID NO: 425240 - RNA, 22 nt, Human
agaacaaauaaaauugcgugaa

SEQ ID NO: 425241 - RNA, 21 nt, Human
aggaaauuacgguguaaaaua

SEQ ID NO: 425242 - RNA, 19 nt, Human
auacugacagaagcggagc

SEQ ID NO: 425243 - RNA, 19 nt, Human
auacugacagaagcggagc

SEQ ID NO: 425244 - RNA, 19 nt, Human
auaggaggugaaugcaaua

SEQ ID NO: 425245 - RNA, 24 nt, Human
auguauauacacauucccuuaaaa

SEQ ID NO: 425246 - RNA, 20 nt, Human
auuauuaucacauuuucuaa

SEQ ID NO: 425247 - RNA, 18 nt, Human
cacaauaucacagugcuu

SEQ ID NO: 425248 - RNA, 18 nt, Human
cacaauaucacagugcuu

SEQ ID NO: 425249 - RNA, 23 nt, Human
cacaauaucacagugcuucugga

SEQ ID NO: 425250 - RNA, 23 nt, Human
cacaauaucacagugcuucugga

SEQ ID NO: 425251 - RNA, 21 nt, Human
cacacucagccucuuuacucu

SEQ ID NO: 425252 - RNA, 21 nt, Human
cacacucagccucuuuacucu

SEQ ID NO: 425253 - RNA, 19 nt, Human
caccuagaaagaagucuca

SEQ ID NO: 425254 - RNA, 22 nt, Human
caccuccuucggaaaauaauuu

SEQ ID NO: 425255 - RNA, 23 nt, Human
caccuccuucggaaaauaauuua

SEQ ID NO: 425256 - RNA, 24 nt, Human
cacuucgguaaaacguucccucca

SEQ ID NO: 425257 - RNA, 24 nt, Human
cacuucgguaaaacguucccucca

SEQ ID NO: 425258 - RNA, 22 nt, Human
cccaacccaccuccuucggaaa

SEQ ID NO: 425259 - RNA, 26 nt, Human
ccuucggaaaauaauuuacauacaaa

SEQ ID NO: 425260 - RNA, 23 nt, Human
cuagagaagcagaaaaauuaaaa

SEQ ID NO: 425261 - RNA, 22 nt, Human
cuccuggcaauacuuugcccga

SEQ ID NO: 425262 - RNA, 22 nt, Human
cuccuggcaauacuuugcccga

SEQ ID NO: 425263 - RNA, 24 nt, Human
cuuaaaauaaaauaacuggaacuc

SEQ ID NO: 425264 - RNA, 25 nt, Human
ggagcuuaaagccaaaggcuaauag

SEQ ID NO: 425265 - RNA, 25 nt, Human
ggagcuuaaagccaaaggcuaauag

SEQ ID NO: 425266 - RNA, 21 nt, Human
gguacuagagaagcagaaaaa

SEQ ID NO: 425267 - RNA, 23 nt, Human
uaagugauuugugugggcauguu

SEQ ID NO: 425268 - RNA, 21 nt, Human
uagaaacuacuuccaagguuu

SEQ ID NO: 425269 - RNA, 21 nt, Human
uagaaacuacuuccaagguuu

SEQ ID NO: 425270 - RNA, 18 nt, Human
uaggaggugaaugcaaua

SEQ ID NO: 425271 - RNA, 25 nt, Human
uauaaaauaaagaauaagugaauac

SEQ ID NO: 425272 - RNA, 18 nt, Human
uauaaauguauauacaca

SEQ ID NO: 425273 - RNA, 21 nt, Human
uauaugcaugcaaaacauaua

SEQ ID NO: 425274 - RNA, 22 nt, Human
ucaaguaaauucuggaagugga

SEQ ID NO: 425275 - RNA, 27 nt, Human
ucaauuaagaacaaauaaaauugcgug

SEQ ID NO: 425276 - RNA, 18 nt, Human
ucacaacacuucgguaaa

SEQ ID NO: 425277 - RNA, 18 nt, Human
ucacaacacuucgguaaa

SEQ ID NO: 425278 - RNA, 18 nt, Human
ucucccaacccaccuccu

SEQ ID NO: 425279 - RNA, 23 nt, Human
ucuccuggcaauacuuugcccga

SEQ ID NO: 425280 - RNA, 23 nt, Human
ucuccuggcaauacuuugcccga

SEQ ID NO: 425281 - RNA, 23 nt, Human
ucuccuggcaauacuuugcccga

SEQ ID NO: 425282 - RNA, 23 nt, Human
ucuccuggcaauacuuugcccga

SEQ ID NO: 425283 - RNA, 28 nt, Human
ugaacuacacggcaauuauugagucaca

SEQ ID NO: 425284 - RNA, 28 nt, Human
ugaacuacacggcaauuauugagucaca

SEQ ID NO: 425285 - RNA, 25 nt, Human
ugaauacacacauacacaaauuuau

SEQ ID NO: 425286 - RNA, 18 nt, Human
ugacagcaccuagaaaga

SEQ ID NO: 425287 - RNA, 19 nt, Human
ugagugauaguaauuccuc

SEQ ID NO: 425288 - RNA, 19 nt, Human
ugagugauaguaauuccuc

SEQ ID NO: 425289 - RNA, 29 nt, Human
uggcaauacuuugcccgaccaccuugguu

SEQ ID NO: 425290 - RNA, 29 nt, Human
uggcaauacuuugcccgaccaccuugguu

SEQ ID NO: 425291 - RNA, 19 nt, Human
ugugugauggaauacaagg

SEQ ID NO: 425292 - RNA, 22 nt, Human
ugugugauggaauacaagguac

SEQ ID NO: 425293 - RNA, 25 nt, Human
uuaaaauaaaauaacuggaacucau

SEQ ID NO: 425294 - RNA, 21 nt, Human
uucgguaaaacguucccucca

SEQ ID NO: 425295 - RNA, 21 nt, Human
uucgguaaaacguucccucca

SEQ ID NO: 425296 - RNA, 22 nt, Human
uugaaaauauccuacccuucuc

SEQ ID NO: 425297 - RNA, 22 nt, Human
uugaaaauauccuacccuucuc

SEQ ID NO: 425298 - RNA, 23 nt, Human
uugaaaauauccuacccuucucc

SEQ ID NO: 425299 - RNA, 23 nt, Human
uugaaaauauccuacccuucucc

SEQ ID NO: 425300 - RNA, 21 nt, Human
uugcccgaccaccuugguugc

SEQ ID NO: 425301 - RNA, 21 nt, Human
uugcccgaccaccuugguugc

SEQ ID NO: 425302 - RNA, 26 nt, Human
uuuagacucuggugauaacaggaaau

SEQ ID NO: 425303 - RNA, 23 nt, Human
uuugcccgaccaccuugguugca

SEQ ID NO: 425304 - RNA, 23 nt, Human
uuugcccgaccaccuugguugca

SEQ ID NO: 425305 - RNA, 21 nt, Human
uuuuuguuuguguguacuuag

SEQ ID NO: 425306 - RNA, 24 nt, Human
aaaaacacaugacuagaaccuggg

SEQ ID NO: 425307 - RNA, 21 nt, Human
acacaaccaggccaggugacc

SEQ ID NO: 425308 - RNA, 24 nt, Human
acccuuuucccucuaccccaaucu

SEQ ID NO: 425309 - RNA, 23 nt, Human
auuacuuauacaaggguuucauu

SEQ ID NO: 425310 - RNA, 22 nt, Human
cacagacaugacauugugcaca

SEQ ID NO: 425311 - RNA, 22 nt, Human
cagaaaucguccuaaaaaacac

SEQ ID NO: 425312 - RNA, 21 nt, Human
cagcaguaguuccccacuguu

SEQ ID NO: 425313 - RNA, 19 nt, Human
caucucuguuguaagaagg

SEQ ID NO: 425314 - RNA, 19 nt, Human
ccaccaucguggagacaga

SEQ ID NO: 425315 - RNA, 23 nt, Human
ccaguucagccuuuguugaaccc

SEQ ID NO: 425316 - RNA, 20 nt, Human
gaacccuuuucccucuaccc

SEQ ID NO: 425317 - RNA, 25 nt, Human
gaccuaccacuucugcaccuacucu

SEQ ID NO: 425318 - RNA, 18 nt, Human
uaaaacaggucacugaac

SEQ ID NO: 425319 - RNA, 23 nt, Human
uagcugaccuaccacuucugcac

SEQ ID NO: 425320 - RNA, 21 nt, Human
ucugcaccuacucuagcacuc

SEQ ID NO: 425321 - RNA, 24 nt, Human
ucuggcccacuccgaggaccuagc

SEQ ID NO: 425322 - RNA, 19 nt, Human
ugacauugugcacacaacc

SEQ ID NO: 425323 - RNA, 20 nt, Human
ugccuugguaucuuguccuc

SEQ ID NO: 425324 - RNA, 22 nt, Human
ugccuugguaucuuguccucaa

SEQ ID NO: 425325 - RNA, 22 nt, Human
uguugcuuuuuuuuuugaauuu

SEQ ID NO: 425326 - RNA, 21 nt, Human
aaagaacaggucuaggaggca

SEQ ID NO: 425327 - RNA, 24 nt, Human
aacuagaucccagcagaugaccug

SEQ ID NO: 425328 - RNA, 21 nt, Human
acugauguuucuaaagaugga

SEQ ID NO: 425329 - RNA, 19 nt, Human
agcagaugaccuguacuuc

SEQ ID NO: 425330 - RNA, 26 nt, Human
agcuuggccucgucuccccugacccc

SEQ ID NO: 425331 - RNA, 19 nt, Human
agggugagugggcuuuggu

SEQ ID NO: 425332 - RNA, 19 nt, Human
agguguggggccuguagug

SEQ ID NO: 425333 - RNA, 21 nt, Human
agugaacuugucggacagaug

SEQ ID NO: 425334 - RNA, 18 nt, Human
caaagaggcagugagggc

SEQ ID NO: 425335 - RNA, 24 nt, Human
caccaccauccagaaaucucccgg

SEQ ID NO: 425336 - RNA, 19 nt, Human
caccauccagaaaucuccc

SEQ ID NO: 425337 - RNA, 19 nt, Human
cagcagagaagcccccacc

SEQ ID NO: 425338 - RNA, 18 nt, Human
cagcuuggccucgucucc

SEQ ID NO: 425339 - RNA, 23 nt, Human
ccaccaggggcugggcaugccca

SEQ ID NO: 425340 - RNA, 19 nt, Human
ccagcagaugaccuguacu

SEQ ID NO: 425341 - RNA, 26 nt, Human
ccagcagaugaccuguacuguaauga

SEQ ID NO: 425342 - RNA, 20 nt, Human
ccagcagaugaccuguacuu

SEQ ID NO: 425343 - RNA, 26 nt, Human
ccauccagaaaucucccgguggcuuc

SEQ ID NO: 425344 - RNA, 22 nt, Human
ccccaccaccaggggcugggca

SEQ ID NO: 425345 - RNA, 25 nt, Human
ccuacugcaaagaggcagugagggc

SEQ ID NO: 425346 - RNA, 23 nt, Human
ccugaccccgccuccgugcaugc

SEQ ID NO: 425347 - RNA, 19 nt, Human
ccugcagcaccuccucagc

SEQ ID NO: 425348 - RNA, 22 nt, Human
ccuguaguggggcagcagcaac

SEQ ID NO: 425349 - RNA, 18 nt, Human
cgggaccugcagcaccuc

SEQ ID NO: 425350 - RNA, 24 nt, Human
cgugcaugcugccucaguuugccu

SEQ ID NO: 425351 - RNA, 18 nt, Human
cucagcagagaagccccc

SEQ ID NO: 425352 - RNA, 26 nt, Human
cucagcuuggccucgucuccccugac

SEQ ID NO: 425353 - RNA, 22 nt, Human
cugaccccgccuccgugcaugc

SEQ ID NO: 425354 - RNA, 19 nt, Human
cuuggccucgucuccccug

SEQ ID NO: 425355 - RNA, 23 nt, Human
gcaaaguguucuguagcucaaag

SEQ ID NO: 425356 - RNA, 21 nt, Human
gcagagaagcccccaccacca

SEQ ID NO: 425357 - RNA, 19 nt, Human
gcagcaacuggugggugcc

SEQ ID NO: 425358 - RNA, 19 nt, Human
gcccagggcaggugugggg

SEQ ID NO: 425359 - RNA, 21 nt, Human
ggcaugcccagggcaggugug

SEQ ID NO: 425360 - RNA, 22 nt, Human
gggaagguaaguggccugcaga

SEQ ID NO: 425361 - RNA, 18 nt, Human
gggcagcagcaacuggug

SEQ ID NO: 425362 - RNA, 22 nt, Human
gggcagcagcaacuggugggug

SEQ ID NO: 425363 - RNA, 18 nt, Human
guggggcagcagcaacug

SEQ ID NO: 425364 - RNA, 23 nt, Human
uaucuaguaaugaauacaaucua

SEQ ID NO: 425365 - RNA, 22 nt, Human
uccgcaaccgaggcgagugaac

SEQ ID NO: 425366 - RNA, 18 nt, Human
ugaaucugacaagggcug

SEQ ID NO: 425367 - RNA, 19 nt, Human
ugcaccaccauccagaaau

SEQ ID NO: 425368 - RNA, 19 nt, Human
ugcaccaccauccagaaau

SEQ ID NO: 425369 - RNA, 21 nt, Human
ugcaccaccauccagaaaucu

SEQ ID NO: 425370 - RNA, 18 nt, Human
ugcccagggcaggugugg

SEQ ID NO: 425371 - RNA, 24 nt, Human
uggaaagaacaggucuaggaggca

SEQ ID NO: 425372 - RNA, 28 nt, Human
uggccugcagagaaaugguccuaggucc

SEQ ID NO: 425373 - RNA, 22 nt, Human
uggggcagcagcaacugguggg

SEQ ID NO: 425374 - RNA, 23 nt, Human
uggggcagcagcaacuggugggu

SEQ ID NO: 425375 - RNA, 19 nt, Human
ugguccuagguccgcaacc

SEQ ID NO: 425376 - RNA, 19 nt, Human
uucacccugggugaaucug

SEQ ID NO: 425377 - RNA, 19 nt, Human
uucuaaagauggaaagaac

SEQ ID NO: 425378 - RNA, 20 nt, Human
acccuuacucgcgguggcuu

SEQ ID NO: 425379 - RNA, 18 nt, Human
accuggaacaugaccauc

SEQ ID NO: 425380 - RNA, 22 nt, Human
agaaggaaaggaaaggggaaag

SEQ ID NO: 425381 - RNA, 21 nt, Human
agggaagaaggaaaggaaagg

SEQ ID NO: 425382 - RNA, 19 nt, Human
agguagggaagaaggaaag

SEQ ID NO: 425383 - RNA, 24 nt, Human
aucacuggccaaagaagucggggc

SEQ ID NO: 425384 - RNA, 22 nt, Human
aucuuccuuucaccaaguguuc

SEQ ID NO: 425385 - RNA, 20 nt, Human
caaaaacaaaaccggggagg

SEQ ID NO: 425386 - RNA, 19 nt, Human
caauaaaauaucaaagagg

SEQ ID NO: 425387 - RNA, 19 nt, Human
caccaaguguucaacuuug

SEQ ID NO: 425388 - RNA, 19 nt, Human
caccucguuagguucaauu

SEQ ID NO: 425389 - RNA, 19 nt, Human
ccacguuucuuccuuccuc

SEQ ID NO: 425390 - RNA, 22 nt, Human
ccacguuucuuccuuccuccag

SEQ ID NO: 425391 - RNA, 21 nt, Human
gaacaugaccaucauggagcc

SEQ ID NO: 425392 - RNA, 22 nt, Human
gagggacccuccuucuggugca

SEQ ID NO: 425393 - RNA, 21 nt, Human
gaucugccacguuucuuccuu

SEQ ID NO: 425394 - RNA, 20 nt, Human
gcaccuggaacaugaccauc

SEQ ID NO: 425395 - RNA, 19 nt, Human
uaaaagacugaguguuugc

SEQ ID NO: 425396 - RNA, 20 nt, Human
uaagaagauuuucuguucuu

SEQ ID NO: 425397 - RNA, 19 nt, Human
ucaaagaggauaagaagau

SEQ ID NO: 425398 - RNA, 21 nt, Human
ucacugaucauaaauauaguc

SEQ ID NO: 425399 - RNA, 20 nt, Human
ucaguugaaaauccugguga

SEQ ID NO: 425400 - RNA, 18 nt, Human
ucuuaaauuucucaguug

SEQ ID NO: 425401 - RNA, 27 nt, Human
uucacaguucugacauuuuuauucacu

SEQ ID NO: 425402 - RNA, 21 nt, Human
uuucucaguugaaaauccugg

SEQ ID NO: 425403 - RNA, 24 nt, Human
uuuuuuuuuuuuuuuuucacaguu

SEQ ID NO: 425404 - RNA, 23 nt, Human
uuuuuuuuuuuuuuuuuucacag

SEQ ID NO: 425405 - RNA, 25 nt, Human
aaacgucuuagcaggauguggaccc

SEQ ID NO: 425406 - RNA, 18 nt, Human
aagcaagggagcccccca

SEQ ID NO: 425407 - RNA, 19 nt, Human
agaggagcuuugggcugcc

SEQ ID NO: 425408 - RNA, 19 nt, Human
agcaaauucuucucaccac

SEQ ID NO: 425409 - RNA, 23 nt, Human
agccagggugggcagaggagcuu

SEQ ID NO: 425410 - RNA, 23 nt, Human
agcuguagcagucuguguuaggu

SEQ ID NO: 425411 - RNA, 20 nt, Human
agggacucugcauguugcug

SEQ ID NO: 425412 - RNA, 20 nt, Human
aggggcauuguuuucuuggg

SEQ ID NO: 425413 - RNA, 19 nt, Human
aggguuuugggagccaggg

SEQ ID NO: 425414 - RNA, 20 nt, Human
aggucuuggagaaggaggau

SEQ ID NO: 425415 - RNA, 19 nt, Human
agugucuuuguuaggcugu

SEQ ID NO: 425416 - RNA, 22 nt, Human
caaggugaaggggcauccaaga

SEQ ID NO: 425417 - RNA, 18 nt, Human
cacccuugggugguaggg

SEQ ID NO: 425418 - RNA, 23 nt, Human
caccgcauucccucuuacuccac

SEQ ID NO: 425419 - RNA, 19 nt, Human
cagagggugggggcuggcg

SEQ ID NO: 425420 - RNA, 22 nt, Human
cagcauuguagcuguggcugca

SEQ ID NO: 425421 - RNA, 23 nt, Human
cauggcacccuugggugguaggg

SEQ ID NO: 425422 - RNA, 22 nt, Human
cauucccucuuacuccacagcc

SEQ ID NO: 425423 - RNA, 19 nt, Human
ccauggcacccuugggugg

SEQ ID NO: 425424 - RNA, 20 nt, Human
cccuguguuuccuggggccu

SEQ ID NO: 425425 - RNA, 22 nt, Human
cccuguguuuccuggggccugg

SEQ ID NO: 425426 - RNA, 19 nt, Human
ccucaccgcauucccucuu

SEQ ID NO: 425427 - RNA, 23 nt, Human
ccuguguuuccuggggccuggga

SEQ ID NO: 425428 - RNA, 22 nt, Human
cgaacagcucuggcuaugccca

SEQ ID NO: 425429 - RNA, 24 nt, Human
cggcgcuggguggauggagggaca

SEQ ID NO: 425430 - RNA, 22 nt, Human
cgggaggggagcagcuguagca

SEQ ID NO: 425431 - RNA, 18 nt, Human
cuagcuggcuuuccuauu

SEQ ID NO: 425432 - RNA, 23 nt, Human
cucgagcagacagaggguggggg

SEQ ID NO: 425433 - RNA, 23 nt, Human
cuggaaugcuggcucaucuggcc

SEQ ID NO: 425434 - RNA, 19 nt, Human
gaagcccuguguuuccugg

SEQ ID NO: 425435 - RNA, 22 nt, Human
gaagcucaguuuuccugucucc

SEQ ID NO: 425436 - RNA, 20 nt, Human
gagccagggugggcagagga

SEQ ID NO: 425437 - RNA, 21 nt, Human
gaggcggacugugcaaguucc

SEQ ID NO: 425438 - RNA, 22 nt, Human
gcaaauucuucucaccacagug

SEQ ID NO: 425439 - RNA, 21 nt, Human
gccagcaggggcucuuggggu

SEQ ID NO: 425440 - RNA, 18 nt, Human
gccaucuggggccaagaa

SEQ ID NO: 425441 - RNA, 23 nt, Human
gcccaaguuuguucuccaaccuc

SEQ ID NO: 425442 - RNA, 22 nt, Human
gcccagggugugguauacaacc

SEQ ID NO: 425443 - RNA, 22 nt, Human
gcccuguguuuccuggggccug

SEQ ID NO: 425444 - RNA, 20 nt, Human
gcuggguucgaacagcucug

SEQ ID NO: 425445 - RNA, 20 nt, Human
ggagcagcuguagcagucug

SEQ ID NO: 425446 - RNA, 19 nt, Human
ggagccagggugggcagag

SEQ ID NO: 425447 - RNA, 22 nt, Human
ggaggugggcucagggacucug

SEQ ID NO: 425448 - RNA, 18 nt, Human
ggccugggauuaggggcc

SEQ ID NO: 425449 - RNA, 21 nt, Human
ggcugggaggugggcucaggg

SEQ ID NO: 425450 - RNA, 18 nt, Human
gggacaagggagagaggg

SEQ ID NO: 425451 - RNA, 23 nt, Human
gggugcagggaggugccaucugg

SEQ ID NO: 425452 - RNA, 23 nt, Human
gguaggggcauuguuuucuuggg

SEQ ID NO: 425453 - RNA, 21 nt, Human
ggugaaggggcauccaagaaa

SEQ ID NO: 425454 - RNA, 19 nt, Human
ggugggcucagggacucug

SEQ ID NO: 425455 - RNA, 26 nt, Human
gugaaggggcauccaagaaauguggg

SEQ ID NO: 425456 - RNA, 20 nt, Human
guguuuccuggggccuggga

SEQ ID NO: 425457 - RNA, 20 nt, Human
uaaaaagugggggcgauuuu

SEQ ID NO: 425458 - RNA, 19 nt, Human
uacaaccccggggugcagg

SEQ ID NO: 425459 - RNA, 24 nt, Human
uaggggcauuguuuucuuggggcu

SEQ ID NO: 425460 - RNA, 19 nt, Human
ucauauuccacacugccuc

SEQ ID NO: 425461 - RNA, 18 nt, Human
uccacacaaggugaaggg

SEQ ID NO: 425462 - RNA, 20 nt, Human
uccacacaaggugaaggggc

SEQ ID NO: 425463 - RNA, 21 nt, Human
ucggggccugggauuaggggc

SEQ ID NO: 425464 - RNA, 23 nt, Human
ucucaccacaguggguucagaga

SEQ ID NO: 425465 - RNA, 19 nt, Human
ucuccagaugccggcgcug

SEQ ID NO: 425466 - RNA, 19 nt, Human
ucugcauguugcugaaggg

SEQ ID NO: 425467 - RNA, 28 nt, Human
ucugcuguuacuuggcauggaaccuacc

SEQ ID NO: 425468 - RNA, 23 nt, Human
ucuuuuguuuuggaggguuuugg

SEQ ID NO: 425469 - RNA, 18 nt, Human
ugaggagagggcugggag

SEQ ID NO: 425470 - RNA, 19 nt, Human
ugaggagagggcugggagg

SEQ ID NO: 425471 - RNA, 21 nt, Human
ugcagggaggugccaucuggg

SEQ ID NO: 425472 - RNA, 19 nt, Human
ugcuggguggagagugcug

SEQ ID NO: 425473 - RNA, 21 nt, Human
ugcuggguggagagugcuuuu

SEQ ID NO: 425474 - RNA, 22 nt, Human
uggagagugcuuuucugguccu

SEQ ID NO: 425475 - RNA, 20 nt, Human
uggcgggaggggagcagcug

SEQ ID NO: 425476 - RNA, 23 nt, Human
uggcgggaggggagcagcuguag

SEQ ID NO: 425477 - RNA, 19 nt, Human
uggcuggguucgaacagcu

SEQ ID NO: 425478 - RNA, 21 nt, Human
ugggagccagggugggcagag

SEQ ID NO: 425479 - RNA, 20 nt, Human
ugggcagaggagcuuugggc

SEQ ID NO: 425480 - RNA, 22 nt, Human
ugggcagaggagcuuugggcug

SEQ ID NO: 425481 - RNA, 23 nt, Human
uguaaaauggggaaaccagacac

SEQ ID NO: 425482 - RNA, 24 nt, Human
uguuuggcgggaggggagcagcug

SEQ ID NO: 425483 - RNA, 23 nt, Human
uuaggcaaagcccacccccuguc

SEQ ID NO: 425484 - RNA, 23 nt, Human
uuccuggggccugggaccuucuc

SEQ ID NO: 425485 - RNA, 24 nt, Human
uuccuggggccugggaccuucucc

SEQ ID NO: 425486 - RNA, 22 nt, Human
uugcugaagggugaaacagcug

SEQ ID NO: 425487 - RNA, 22 nt, Human
uuguucuccaaccucugguagg

SEQ ID NO: 425488 - RNA, 22 nt, Human
uuucccgggaccauggcacccu

SEQ ID NO: 425489 - RNA, 21 nt, Human
uuuccugucuguaaaaugggg

SEQ ID NO: 425490 - RNA, 21 nt, Human
uuucggggccugggauuaggg

SEQ ID NO: 425491 - RNA, 18 nt, Human
uuugggagccaggguggg

SEQ ID NO: 425492 - RNA, 24 nt, Human
uuuguucuccaaccucugguaggg

SEQ ID NO: 425493 - RNA, 21 nt, Human
aaaaaaacagcaugaauuugg

SEQ ID NO: 425494 - RNA, 22 nt, Human
aaaaaacagcaugaauuuggau

SEQ ID NO: 425495 - RNA, 24 nt, Human
aaaaacacauaagaaaaagggcca

SEQ ID NO: 425496 - RNA, 23 nt, Human
aaaaagaacuguguaaaaauaac

SEQ ID NO: 425497 - RNA, 23 nt, Human
aaacuaaauaaagaugaccaaaa

SEQ ID NO: 425498 - RNA, 23 nt, Human
aaauaacuaacuguguucccaua

SEQ ID NO: 425499 - RNA, 19 nt, Human
acaagcgacagcacacaca

SEQ ID NO: 425500 - RNA, 20 nt, Human
acacaaaaacaaaaagaacu

SEQ ID NO: 425501 - RNA, 22 nt, Human
acacacacaaaaacaaaaagaa

SEQ ID NO: 425502 - RNA, 22 nt, Human
acacauaagaaaaagggccacu

SEQ ID NO: 425503 - RNA, 20 nt, Human
acggaguugcagagaaaaaa

SEQ ID NO: 425504 - RNA, 21 nt, Human
agacaaacgauucaguccaag

SEQ ID NO: 425505 - RNA, 23 nt, Human
agacuagaaggaaaaugcucccu

SEQ ID NO: 425506 - RNA, 22 nt, Human
agcccagccacaaaaaugggca

SEQ ID NO: 425507 - RNA, 21 nt, Human
aggcucacaaaugagcaacac

SEQ ID NO: 425508 - RNA, 20 nt, Human
aucuugcugcaaucuugcca

SEQ ID NO: 425509 - RNA, 21 nt, Human
augaaguaaaauuuuuaaaaa

SEQ ID NO: 425510 - RNA, 22 nt, Human
augcuguuuuccucugcuaacg

SEQ ID NO: 425511 - RNA, 18 nt, Human
auuugccuccucccccca

SEQ ID NO: 425512 - RNA, 26 nt, Human
caaacuaaauaaagaugaccaaaaca

SEQ ID NO: 425513 - RNA, 18 nt, Human
caaauugaauuugccucc

SEQ ID NO: 425514 - RNA, 30 nt, Human
caacuucaugcaaacuaaauaaagaugacu

SEQ ID NO: 425515 - RNA, 26 nt, Human
cacacaaaaacaaaaagaacugugua

SEQ ID NO: 425516 - RNA, 22 nt, Human
cacacacaaaaacaaaaagaac

SEQ ID NO: 425517 - RNA, 21 nt, Human
cacacacacacaaaaacaaaa

SEQ ID NO: 425518 - RNA, 24 nt, Human
cacacacacacaaaaacaaaaaga

SEQ ID NO: 425519 - RNA, 25 nt, Human
cauuagaauuacaaguauauguuca

SEQ ID NO: 425520 - RNA, 21 nt, Human
ccaaaacaaaagcuuaaacaa

SEQ ID NO: 425521 - RNA, 19 nt, Human
ccaaagagacuuuguaaua

SEQ ID NO: 425522 - RNA, 22 nt, Human
ccacuaggugacauuuuaauuu

SEQ ID NO: 425523 - RNA, 21 nt, Human
cccccagcccagccacaaaaa

SEQ ID NO: 425524 - RNA, 19 nt, Human
ccuuuaaacaacgcaauuu

SEQ ID NO: 425525 - RNA, 18 nt, Human
cucacaaaugagcaacac

SEQ ID NO: 425526 - RNA, 21 nt, Human
cucacaaaugagcaacacucc

SEQ ID NO: 425527 - RNA, 20 nt, Human
gaaaaagggccacuagguga

SEQ ID NO: 425528 - RNA, 18 nt, Human
gcacuauaauccuuuaaa

SEQ ID NO: 425529 - RNA, 23 nt, Human
gcagagaaaaaaaacagcaugaa

SEQ ID NO: 425530 - RNA, 19 nt, Human
gccacaaaaaugggcauga

SEQ ID NO: 425531 - RNA, 22 nt, Human
gcgacagcacacacacacaaaa

SEQ ID NO: 425532 - RNA, 23 nt, Human
gcuaacggaguugcagagaaaaa

SEQ ID NO: 425533 - RNA, 21 nt, Human
gcuguugucgacaagcgacag

SEQ ID NO: 425534 - RNA, 19 nt, Human
gcuguuuuccucugcuaac

SEQ ID NO: 425535 - RNA, 22 nt, Human
ucaucucaaaagccagaguugu

SEQ ID NO: 425536 - RNA, 22 nt, Human
uccaagaggugcuaacuucaga

SEQ ID NO: 425537 - RNA, 24 nt, Human
ucgacaagcgacagcacacacaca

SEQ ID NO: 425538 - RNA, 25 nt, Human
ucuagacaaacgauucaguccaaga

SEQ ID NO: 425539 - RNA, 23 nt, Human
ucuugcugcaaucuugccaaaga

SEQ ID NO: 425540 - RNA, 18 nt, Human
ucuuuucuucuaggcuga

SEQ ID NO: 425541 - RNA, 19 nt, Human
ugaccaaaacaaaagcuua

SEQ ID NO: 425542 - RNA, 24 nt, Human
ugaccaaaacaaaagcuuaaacaa

SEQ ID NO: 425543 - RNA, 23 nt, Human
ugcaaacuaaauaaagaugacca

SEQ ID NO: 425544 - RNA, 18 nt, Human
ugcacaugaucuugcugc

SEQ ID NO: 425545 - RNA, 18 nt, Human
ugcagagaaaaaaaacag

SEQ ID NO: 425546 - RNA, 19 nt, Human
ugccuccuccccccagccc

SEQ ID NO: 425547 - RNA, 23 nt, Human
uucacagaaaauuucuuauacaa

SEQ ID NO: 425548 - RNA, 18 nt, Human
uuguuuacaggaaaaauu

SEQ ID NO: 425549 - RNA, 23 nt, Human
uuguuuuguuuuuuaaugaguug

SEQ ID NO: 425550 - RNA, 22 nt, Human
uuugaagucgcuuuacaauggg

SEQ ID NO: 425551 - RNA, 21 nt, Human
uuugccuccuccccccagccc

SEQ ID NO: 425552 - RNA, 24 nt, Human
aaaaaauucuccacauaaacugac

SEQ ID NO: 425553 - RNA, 22 nt, Human
aaaaaccucgauucaaaaaggg

SEQ ID NO: 425554 - RNA, 24 nt, Human
aaaacaaaacaaaacaaaaaaacc

SEQ ID NO: 425555 - RNA, 19 nt, Human
aaacaaaacaaaacaaaaa

SEQ ID NO: 425556 - RNA, 24 nt, Human
aaacaaagaaaagaaaaggucaaa

SEQ ID NO: 425557 - RNA, 21 nt, Human
aaaccgggcugagcggaagcc

SEQ ID NO: 425558 - RNA, 25 nt, Human
aaacuaaaaagcauuaauuaaacau

SEQ ID NO: 425559 - RNA, 26 nt, Human
aacaaaacaaaaaaaccucgauucaa

SEQ ID NO: 425560 - RNA, 20 nt, Human
aagaaaagaaaagaaacaca

SEQ ID NO: 425561 - RNA, 19 nt, Human
aagaaaagaaacacaguga

SEQ ID NO: 425562 - RNA, 20 nt, Human
aagaaaagaaacacagugaa

SEQ ID NO: 425563 - RNA, 22 nt, Human
aaguagcuucaugaaugaagau

SEQ ID NO: 425564 - RNA, 20 nt, Human
aaugaaacuuuggcuuaaaa

SEQ ID NO: 425565 - RNA, 24 nt, Human
acaaaaaagcaauagaagcacaaa

SEQ ID NO: 425566 - RNA, 23 nt, Human
acaaaacaaaacaaaaaaaccuc

SEQ ID NO: 425567 - RNA, 25 nt, Human
acaaaacaaaacaaaaaaaccucga

SEQ ID NO: 425568 - RNA, 18 nt, Human
acaaaacacaaaaaagca

SEQ ID NO: 425569 - RNA, 26 nt, Human
acaaaacacaaaaaagcaauagaagc

SEQ ID NO: 425570 - RNA, 22 nt, Human
acaaagaaaagaaaaggucaaa

SEQ ID NO: 425571 - RNA, 22 nt, Human
acaaagaagugacaaugggcac

SEQ ID NO: 425572 - RNA, 19 nt, Human
acagagccucugaaauagc

SEQ ID NO: 425573 - RNA, 22 nt, Human
acaugcuuaacaaaacacaaaa

SEQ ID NO: 425574 - RNA, 21 nt, Human
accauacauguggaugcauaa

SEQ ID NO: 425575 - RNA, 22 nt, Human
acccacccagcaacccuuccca

SEQ ID NO: 425576 - RNA, 22 nt, Human
acuccuccccacaugggccccg

SEQ ID NO: 425577 - RNA, 18 nt, Human
agaaaagaaaagaaacac

SEQ ID NO: 425578 - RNA, 19 nt, Human
agaaaagaaaagaaacaca

SEQ ID NO: 425579 - RNA, 24 nt, Human
agaaaagaaaagaaacacagugag

SEQ ID NO: 425580 - RNA, 20 nt, Human
agaaaagaaacacagugagc

SEQ ID NO: 425581 - RNA, 23 nt, Human
agagguaugugggacugacccuc

SEQ ID NO: 425582 - RNA, 19 nt, Human
agcaacccuucccaaaaua

SEQ ID NO: 425583 - RNA, 27 nt, Human
agcaauagaagcacaaaagggagggcc

SEQ ID NO: 425584 - RNA, 21 nt, Human
agcgaaugguaauagcugccc

SEQ ID NO: 425585 - RNA, 21 nt, Human
aggcggcggcggcaacagcga

SEQ ID NO: 425586 - RNA, 27 nt, Human
agggaagaaaugagacaaaggggaccc

SEQ ID NO: 425587 - RNA, 24 nt, Human
agucaaaaaacagaauaguuaggg

SEQ ID NO: 425588 - RNA, 20 nt, Human
aucaccuucauugcacagga

SEQ ID NO: 425589 - RNA, 20 nt, Human
aucauauuucccacccaccc

SEQ ID NO: 425590 - RNA, 25 nt, Human
augcuaaauuuaaugccaaccauau

SEQ ID NO: 425591 - RNA, 19 nt, Human
augguggaagugcugauga

SEQ ID NO: 425592 - RNA, 21 nt, Human
caaaacaaaaaaaccucgauu

SEQ ID NO: 425593 - RNA, 23 nt, Human
caaaacaaaaaaaccucgauuca

SEQ ID NO: 425594 - RNA, 24 nt, Human
caaaacaaaaaaaccucgauucaa

SEQ ID NO: 425595 - RNA, 22 nt, Human
caaaacaaaacaaaaaaaccuc

SEQ ID NO: 425596 - RNA, 19 nt, Human
cacccagcaacccuuccca

SEQ ID NO: 425597 - RNA, 25 nt, Human
cacgcuacagggaccauacaugugg

SEQ ID NO: 425598 - RNA, 20 nt, Human
cagaaaacaaaacaaaacaa

SEQ ID NO: 425599 - RNA, 20 nt, Human
cagaagaaaaacuaucuagu

SEQ ID NO: 425600 - RNA, 23 nt, Human
cagcagcaacuuaagaaguuagc

SEQ ID NO: 425601 - RNA, 25 nt, Human
cagcagcaacuuaagaaguuagcaa

SEQ ID NO: 425602 - RNA, 19 nt, Human
caguaaccgaauguuuuga

SEQ ID NO: 425603 - RNA, 24 nt, Human
caucauauuucccacccacccagc

SEQ ID NO: 425604 - RNA, 22 nt, Human
caucauauuucccacccacccc

SEQ ID NO: 425605 - RNA, 21 nt, Human
cauguaugaccaaguaaagau

SEQ ID NO: 425606 - RNA, 24 nt, Human
cauguggaugcauaauaaggcaua

SEQ ID NO: 425607 - RNA, 24 nt, Human
cauuuccucuucauuugggccaag

SEQ ID NO: 425608 - RNA, 19 nt, Human
cccagcaacccuucccaaa

SEQ ID NO: 425609 - RNA, 23 nt, Human
cggcgcugcgcuucucuccuccu

SEQ ID NO: 425610 - RNA, 20 nt, Human
cggcggcaacagcgacuccg

SEQ ID NO: 425611 - RNA, 23 nt, Human
cucgauucaaaaagggaacacau

SEQ ID NO: 425612 - RNA, 21 nt, Human
cugcugguauugacuuugaaa

SEQ ID NO: 425613 - RNA, 23 nt, Human
cuuaaaacauccucugauuggca

SEQ ID NO: 425614 - RNA, 21 nt, Human
gaaaaggucaaacuggugcaa

SEQ ID NO: 425615 - RNA, 22 nt, Human
gacaaaaaauuuaaaaaccaau

SEQ ID NO: 425616 - RNA, 22 nt, Human
gaggaaguauaauuuguuccau

SEQ ID NO: 425617 - RNA, 22 nt, Human
ggacaugcuuaacaaaacacaa

SEQ ID NO: 425618 - RNA, 23 nt, Human
ggcgcggcgcggcgcugcgcuuc

SEQ ID NO: 425619 - RNA, 20 nt, Human
ggcggcaacagcgacuccga

SEQ ID NO: 425620 - RNA, 25 nt, Human
ggcuuaaaauaaaaacaaagaaaag

SEQ ID NO: 425621 - RNA, 19 nt, Human
gggaacacauuuuggaagc

SEQ ID NO: 425622 - RNA, 22 nt, Human
ggggucucuucagagcagcccg

SEQ ID NO: 425623 - RNA, 26 nt, Human
uaaaccagaagaaaagaaaagaaaca

SEQ ID NO: 425624 - RNA, 25 nt, Human
uaaacuaaaaagcauuaauuaaaca

SEQ ID NO: 425625 - RNA, 24 nt, Human
uaaaugucauccaacguaaguuuc

SEQ ID NO: 425626 - RNA, 21 nt, Human
uaacaaaacacaaaaaagcaa

SEQ ID NO: 425627 - RNA, 25 nt, Human
uaacaaaacacaaaaaagcaauaga

SEQ ID NO: 425628 - RNA, 21 nt, Human
uaacaaauacaucauauuucc

SEQ ID NO: 425629 - RNA, 22 nt, Human
uaaccuaccaagggucacuagu

SEQ ID NO: 425630 - RNA, 23 nt, Human
uaagaaaaguuacaucaaauuaa

SEQ ID NO: 425631 - RNA, 19 nt, Human
uaagaaaugccugguccac

SEQ ID NO: 425632 - RNA, 18 nt, Human
uaaguuuccccugccuuc

SEQ ID NO: 425633 - RNA, 20 nt, Human
uagcaaugaaacuuuggcuu

SEQ ID NO: 425634 - RNA, 22 nt, Human
uauuccacaucuguuccuuaaa

SEQ ID NO: 425635 - RNA, 23 nt, Human
ucaaccagucaaaaccgggcuga

SEQ ID NO: 425636 - RNA, 23 nt, Human
ucaggacucuaaagcagcagcaa

SEQ ID NO: 425637 - RNA, 26 nt, Human
ucaggcuuauuuggaugacuaaggaa

SEQ ID NO: 425638 - RNA, 19 nt, Human
ucaguaccgucccaucaga

SEQ ID NO: 425639 - RNA, 22 nt, Human
ucauucuguaugguuaaguuuc

SEQ ID NO: 425640 - RNA, 21 nt, Human
uccaugaaauucagccggugg

SEQ ID NO: 425641 - RNA, 20 nt, Human
uccucugauuggcaaaugaa

SEQ ID NO: 425642 - RNA, 27 nt, Human
uccuugcaaugccuguucuucauccug

SEQ ID NO: 425643 - RNA, 20 nt, Human
ugaaaauagaaaauuaaaau

SEQ ID NO: 425644 - RNA, 23 nt, Human
ugaacccagaagaaaaacuaucu

SEQ ID NO: 425645 - RNA, 21 nt, Human
ugaagugugggauuccuuguu

SEQ ID NO: 425646 - RNA, 22 nt, Human
ugacaaaaaauuuaaaaaccaa

SEQ ID NO: 425647 - RNA, 23 nt, Human
ugacaaaaaauuuaaaaaccaau

SEQ ID NO: 425648 - RNA, 22 nt, Human
ugacagaccagugauauuuccc

SEQ ID NO: 425649 - RNA, 23 nt, Human
ugcucaggacucuaaagcagcag

SEQ ID NO: 425650 - RNA, 21 nt, Human
ugcugggagaaauggcugcca

SEQ ID NO: 425651 - RNA, 24 nt, Human
ugggcacuguggacagaucauaau

SEQ ID NO: 425652 - RNA, 21 nt, Human
ugguugaacccagaagaaaaa

SEQ ID NO: 425653 - RNA, 19 nt, Human
uuaaaacugcugggagaaa

SEQ ID NO: 425654 - RNA, 20 nt, Human
uucccaaaauaagaaaaguu

SEQ ID NO: 425655 - RNA, 23 nt, Human
uucccacccacccagcaaccccu

SEQ ID NO: 425656 - RNA, 23 nt, Human
uugaacccagaagaaaaacuauc

SEQ ID NO: 425657 - RNA, 22 nt, Human
uuuaaugccaaccauauucaau

SEQ ID NO: 425658 - RNA, 19 nt, Human
uuucagaaaacaaaacaaa

SEQ ID NO: 425659 - RNA, 26 nt, Human
uuucagaaaacaaaacaaaacaaaaa

SEQ ID NO: 425660 - RNA, 22 nt, Human
uuuugaaaauagaaaauuaaaa

SEQ ID NO: 425661 - RNA, 21 nt, Human
cgugugugugugugugugugu

SEQ ID NO: 425662 - RNA, 21 nt, Human
gaggggcagggagagugggag

SEQ ID NO: 425663 - RNA, 23 nt, Human
ggagggagcggggugcgcccugc

SEQ ID NO: 425664 - RNA, 18 nt, Human
ggcuucgccuggccagaa

SEQ ID NO: 425665 - RNA, 24 nt, Human
gggagggagcggggugcgcccugc

SEQ ID NO: 425666 - RNA, 21 nt, Human
gggcagggagagugggaggga

SEQ ID NO: 425667 - RNA, 21 nt, Human
gugugugugugugugugugug

SEQ ID NO: 425668 - RNA, 22 nt, Human
ugcaucgugugugugugugugu

SEQ ID NO: 425669 - RNA, 27 nt, Human
ugcaucgugugugugugugugugugug

SEQ ID NO: 425670 - RNA, 20 nt, Human
uguguguguguauagcacau

SEQ ID NO: 425671 - RNA, 18 nt, Human
uguguguguguguguaua

SEQ ID NO: 425672 - RNA, 21 nt, Human
uguguguguguguguguauag

SEQ ID NO: 425673 - RNA, 18 nt, Human
ugugugugugugugugug

SEQ ID NO: 425674 - RNA, 18 nt, Human
ugugugugugugugugug

SEQ ID NO: 425675 - RNA, 18 nt, Human
ugugugugugugugugug

SEQ ID NO: 425676 - RNA, 18 nt, Human
ugugugugugugugugug

SEQ ID NO: 425677 - RNA, 18 nt, Human
ugugugugugugugugug

SEQ ID NO: 425678 - RNA, 18 nt, Human
ugugugugugugugugug

SEQ ID NO: 425679 - RNA, 18 nt, Human
ugugugugugugugugug

SEQ ID NO: 425680 - RNA, 18 nt, Human
ugugugugugugugugug

SEQ ID NO: 425681 - RNA, 22 nt, Human
uguguguguguguguguguaua

SEQ ID NO: 425682 - RNA, 21 nt, Human
ugugugugugugugugugugu

SEQ ID NO: 425683 - RNA, 21 nt, Human
ugugugugugugugugugugu

SEQ ID NO: 425684 - RNA, 21 nt, Human
ugugugugugugugugugugu

SEQ ID NO: 425685 - RNA, 21 nt, Human
ugugugugugugugugugugu

SEQ ID NO: 425686 - RNA, 21 nt, Human
ugugugugugugugugugugu

SEQ ID NO: 425687 - RNA, 21 nt, Human
ugugugugugugugugugugu

SEQ ID NO: 425688 - RNA, 21 nt, Human
ugugugugugugugugugugu

SEQ ID NO: 425689 - RNA, 21 nt, Human
ugugugugugugugugugugu

SEQ ID NO: 425690 - RNA, 21 nt, Human
ugugugugugugugugugugu

SEQ ID NO: 425691 - RNA, 21 nt, Human
ugugugugugugugugugugu

SEQ ID NO: 425692 - RNA, 21 nt, Human
ugugugugugugugugugugu

SEQ ID NO: 425693 - RNA, 21 nt, Human
ugugugugugugugugugugu

SEQ ID NO: 425694 - RNA, 21 nt, Human
ugugugugugugugugugugu

SEQ ID NO: 425695 - RNA, 22 nt, Human
ugugugugugugugugugugua

SEQ ID NO: 425696 - RNA, 22 nt, Human
ugugugugugugugugugugug

SEQ ID NO: 425697 - RNA, 22 nt, Human
ugugugugugugugugugugug

SEQ ID NO: 425698 - RNA, 22 nt, Human
ugugugugugugugugugugug

SEQ ID NO: 425699 - RNA, 22 nt, Human
ugugugugugugugugugugug

SEQ ID NO: 425700 - RNA, 22 nt, Human
ugugugugugugugugugugug

SEQ ID NO: 425701 - RNA, 23 nt, Human
aaaagaaaaaaaaaaaaaaagaa

SEQ ID NO: 425702 - RNA, 19 nt, Human
aaagugcuaggaucacagg

SEQ ID NO: 425703 - RNA, 24 nt, Human
aaagugcuaggaucacaggcauga

SEQ ID NO: 425704 - RNA, 19 nt, Human
aacauggugaaaccccguc

SEQ ID NO: 425705 - RNA, 20 nt, Human
aacauggugaaaccccgucu

SEQ ID NO: 425706 - RNA, 21 nt, Human
aacauggugaaaccccgucuc

SEQ ID NO: 425707 - RNA, 25 nt, Human
aacgaacauacgcgugcaugugucu

SEQ ID NO: 425708 - RNA, 23 nt, Human
aagaaaacuuuuggccacgagca

SEQ ID NO: 425709 - RNA, 22 nt, Human
aagaggcagaggcugcagcggg

SEQ ID NO: 425710 - RNA, 26 nt, Human
aagugcuaggaucacaggcaugagcc

SEQ ID NO: 425711 - RNA, 24 nt, Human
aaucacuugaacccaagaggcaga

SEQ ID NO: 425712 - RNA, 24 nt, Human
acagagcaagacucugucuuaaga

SEQ ID NO: 425713 - RNA, 21 nt, Human
acagaguaagacuguuucaaa

SEQ ID NO: 425714 - RNA, 19 nt, Human
accacauuuuuuuaaucca

SEQ ID NO: 425715 - RNA, 24 nt, Human
accccgucucuauuaaaaauacaa

SEQ ID NO: 425716 - RNA, 24 nt, Human
accguguugcccaggcuggucuug

SEQ ID NO: 425717 - RNA, 25 nt, Human
accguguugcccaggcuggucuuga

SEQ ID NO: 425718 - RNA, 18 nt, Human
acguguguuuuugugcca

SEQ ID NO: 425719 - RNA, 23 nt, Human
acuccagccugggagacagagca

SEQ ID NO: 425720 - RNA, 21 nt, Human
acugcacuccagcagccuggg

SEQ ID NO: 425721 - RNA, 18 nt, Human
acugcacuccagccuggg

SEQ ID NO: 425722 - RNA, 24 nt, Human
acugcacuccagccugggagacag

SEQ ID NO: 425723 - RNA, 24 nt, Human
acuugaggucaggaguucgagacc

SEQ ID NO: 425724 - RNA, 19 nt, Human
agagaugggguuucaccgu

SEQ ID NO: 425725 - RNA, 24 nt, Human
agaggcugcagcgggccgagauug

SEQ ID NO: 425726 - RNA, 20 nt, Human
agcaauucuccugccucggc

SEQ ID NO: 425727 - RNA, 20 nt, Human
agcacuuugggaggccgagg

SEQ ID NO: 425728 - RNA, 24 nt, Human
agcacuuugggaggccgagguggg

SEQ ID NO: 425729 - RNA, 23 nt, Human
agccaggcgugguggugggugcc

SEQ ID NO: 425730 - RNA, 22 nt, Human
agccuggccaacauggugaaac

SEQ ID NO: 425731 - RNA, 24 nt, Human
agccuggccaacauggugaaaccc

SEQ ID NO: 425732 - RNA, 24 nt, Human
agccugggagacagagcaagacuc

SEQ ID NO: 425733 - RNA, 24 nt, Human
aggaucccuugaggccaggaguuc

SEQ ID NO: 425734 - RNA, 20 nt, Human
aggcacgcaccaccaugccc

SEQ ID NO: 425735 - RNA, 21 nt, Human
aggcagaggcugcagcgggcc

SEQ ID NO: 425736 - RNA, 21 nt, Human
aggccgagguggguggaucac

SEQ ID NO: 425737 - RNA, 25 nt, Human
aggcgggagugcaauggcgcgaucu

SEQ ID NO: 425738 - RNA, 24 nt, Human
aggcgugguggugggugccuguaa

SEQ ID NO: 425739 - RNA, 24 nt, Human
aggcugagguggaagaaucacuug

SEQ ID NO: 425740 - RNA, 18 nt, Human
agguggaagaaucacuug

SEQ ID NO: 425741 - RNA, 23 nt, Human
agguggaagaaucacuugaaccc

SEQ ID NO: 425742 - RNA, 23 nt, Human
agguggguggaucacuugagguc

SEQ ID NO: 425743 - RNA, 21 nt, Human
agugcaauggcgcgaucucag

SEQ ID NO: 425744 - RNA, 24 nt, Human
aguggcucacgccuguaaucccug

SEQ ID NO: 425745 - RNA, 18 nt, Human
augggguuucaccguguu

SEQ ID NO: 425746 - RNA, 19 nt, Human
augggguuucaccguguug

SEQ ID NO: 425747 - RNA, 24 nt, Human
augggguuucaccguguugcccag

SEQ ID NO: 425748 - RNA, 27 nt, Human
auugugccacugcacuccagcagccug

SEQ ID NO: 425749 - RNA, 24 nt, Human
auugugccacugcacuccagccug

SEQ ID NO: 425750 - RNA, 21 nt, Human
auuugugaauuuuugcuucug

SEQ ID NO: 425751 - RNA, 24 nt, Human
caaagugcuaggaucacaggcaug

SEQ ID NO: 425752 - RNA, 22 nt, Human
caacagccuagaaacagaauag

SEQ ID NO: 425753 - RNA, 24 nt, Human
caacauggugaaaccccgucucua

SEQ ID NO: 425754 - RNA, 23 nt, Human
caaccuccaccuccuggguucca

SEQ ID NO: 425755 - RNA, 24 nt, Human
cacaggcaugagccaccacgccca

SEQ ID NO: 425756 - RNA, 22 nt, Human
caccaccaugcccagcuaauuu

SEQ ID NO: 425757 - RNA, 21 nt, Human
caccguguugcccaggcuggu

SEQ ID NO: 425758 - RNA, 22 nt, Human
caccguguugcccaggcugguc

SEQ ID NO: 425759 - RNA, 23 nt, Human
caccguguugcccaggcuggucu

SEQ ID NO: 425760 - RNA, 24 nt, Human
caccguguugcccaggcuggucuu

SEQ ID NO: 425761 - RNA, 28 nt, Human
caccuccuggguuccagcaauucuccuu

SEQ ID NO: 425762 - RNA, 27 nt, Human
cacgagcaguggcucacgccuguaauc

SEQ ID NO: 425763 - RNA, 19 nt, Human
cacgccuguaaucccugca

SEQ ID NO: 425764 - RNA, 24 nt, Human
cacgggccuguaauccuagcacuu

SEQ ID NO: 425765 - RNA, 21 nt, Human
cacugcaaccuccaccuccug

SEQ ID NO: 425766 - RNA, 23 nt, Human
cacugcaaccuccaccuccuggg

SEQ ID NO: 425767 - RNA, 22 nt, Human
cacugcacuccagcagccuggg

SEQ ID NO: 425768 - RNA, 22 nt, Human
cacugcacuccagcagccuggg

SEQ ID NO: 425769 - RNA, 18 nt, Human
cacugcacuccagccugg

SEQ ID NO: 425770 - RNA, 19 nt, Human
cacugcacuccagccuggg

SEQ ID NO: 425771 - RNA, 22 nt, Human
cacugcacuccagccugggaga

SEQ ID NO: 425772 - RNA, 24 nt, Human
cacugcacuccagccugggagaca

SEQ ID NO: 425773 - RNA, 24 nt, Human
cacugcacuccagccugggagaca

SEQ ID NO: 425774 - RNA, 23 nt, Human
cacuugaggucaggaguucgaga

SEQ ID NO: 425775 - RNA, 24 nt, Human
cagcuaccugggaggcugaggugg

SEQ ID NO: 425776 - RNA, 22 nt, Human
caggagagacucaacuuucccg

SEQ ID NO: 425777 - RNA, 19 nt, Human
caguggcucacgccuguaa

SEQ ID NO: 425778 - RNA, 24 nt, Human
caugauugugccacugcacuccag

SEQ ID NO: 425779 - RNA, 19 nt, Human
ccacaaccucaccagcauc

SEQ ID NO: 425780 - RNA, 18 nt, Human
ccacugcacuccagcagc

SEQ ID NO: 425781 - RNA, 23 nt, Human
ccacugcacuccagcagccuggg

SEQ ID NO: 425782 - RNA, 25 nt, Human
ccacugcacuccagcagccugggag

SEQ ID NO: 425783 - RNA, 27 nt, Human
ccacugcacuccagcagccugggagac

SEQ ID NO: 425784 - RNA, 19 nt, Human
ccacugcacuccagccugg

SEQ ID NO: 425785 - RNA, 20 nt, Human
ccacugcacuccagccuggg

SEQ ID NO: 425786 - RNA, 22 nt, Human
ccacugcacuccagccugggag

SEQ ID NO: 425787 - RNA, 24 nt, Human
ccacugcacuccagccugggagac

SEQ ID NO: 425788 - RNA, 23 nt, Human
ccgccaccaacgccauucaccaa

SEQ ID NO: 425789 - RNA, 23 nt, Human
ccuccaccuccuggguuccagca

SEQ ID NO: 425790 - RNA, 24 nt, Human
ccuccuggguuccagcaauucucc

SEQ ID NO: 425791 - RNA, 24 nt, Human
ccugagcgcgggcaauccacccac

SEQ ID NO: 425792 - RNA, 23 nt, Human
ccugccucggccuccugaguagc

SEQ ID NO: 425793 - RNA, 23 nt, Human
ccuggccaacauggugaaacccc

SEQ ID NO: 425794 - RNA, 24 nt, Human
ccuggccaacauggugaaaccccg

SEQ ID NO: 425795 - RNA, 22 nt, Human
ccugggagacagagcaagacuc

SEQ ID NO: 425796 - RNA, 19 nt, Human
ccuguaaucccagcuaccu

SEQ ID NO: 425797 - RNA, 21 nt, Human
ccuguaaucccagcuaccugg

SEQ ID NO: 425798 - RNA, 20 nt, Human
ccuguaauccuagcacuuug

SEQ ID NO: 425799 - RNA, 22 nt, Human
ccuguaauccuagcacuuuggg

SEQ ID NO: 425800 - RNA, 24 nt, Human
cgagaccagccuggccaacauggu

SEQ ID NO: 425801 - RNA, 24 nt, Human
cgagguggguggaucacuugaggu

SEQ ID NO: 425802 - RNA, 26 nt, Human
cgagguggguggaucacuugagguca

SEQ ID NO: 425803 - RNA, 19 nt, Human
cggccuccugaguagcugg

SEQ ID NO: 425804 - RNA, 22 nt, Human
cgggccgagauugugccacugc

SEQ ID NO: 425805 - RNA, 22 nt, Human
cucacgccuguaaucccugcac

SEQ ID NO: 425806 - RNA, 24 nt, Human
cucacugcaaccuccaccuccugg

SEQ ID NO: 425807 - RNA, 21 nt, Human
cuccuggguuccagcaauucu

SEQ ID NO: 425808 - RNA, 23 nt, Human
cuccuggguuccagcaauucucc

SEQ ID NO: 425809 - RNA, 23 nt, Human
cugcaaccuccaccuccuggguu

SEQ ID NO: 425810 - RNA, 22 nt, Human
cugcagugagccaugauugugc

SEQ ID NO: 425811 - RNA, 23 nt, Human
cugccucggccuccugaguagcu

SEQ ID NO: 425812 - RNA, 23 nt, Human
cuggauuucagaccuuucucaga

SEQ ID NO: 425813 - RNA, 25 nt, Human
cugggaggcugagguggaagaauca

SEQ ID NO: 425814 - RNA, 23 nt, Human
cuggucuugaccuccugagcgcg

SEQ ID NO: 425815 - RNA, 23 nt, Human
cuuacuaucaauauuucuuuaga

SEQ ID NO: 425816 - RNA, 24 nt, Human
cuuccacaauggcugaacuaauuu

SEQ ID NO: 425817 - RNA, 27 nt, Human
cuuucccgccaccaacgccauucacca

SEQ ID NO: 425818 - RNA, 23 nt, Human
gaaaagugucuguucauguccuu

SEQ ID NO: 425819 - RNA, 19 nt, Human
gaagaaucacuugaaccca

SEQ ID NO: 425820 - RNA, 19 nt, Human
gaaucacuugaacccaaga

SEQ ID NO: 425821 - RNA, 24 nt, Human
gacagagcaagacucugucuuaag

SEQ ID NO: 425822 - RNA, 23 nt, Human
gagaugggguuucaccguguugc

SEQ ID NO: 425823 - RNA, 23 nt, Human
gagauugugccacugcacuccag

SEQ ID NO: 425824 - RNA, 24 nt, Human
gaguagcuggcacuacaggcacgc

SEQ ID NO: 425825 - RNA, 18 nt, Human
gaucacaggcaugagcca

SEQ ID NO: 425826 - RNA, 24 nt, Human
gaucacuugaggucaggaguucga

SEQ ID NO: 425827 - RNA, 24 nt, Human
gaucccuugaggccaggaguucaa

SEQ ID NO: 425828 - RNA, 22 nt, Human
gaugggguuucaccguguugcc

SEQ ID NO: 425829 - RNA, 22 nt, Human
gcaaccuccaccuccuggguuc

SEQ ID NO: 425830 - RNA, 20 nt, Human
gcaccaccaugcccagcuaa

SEQ ID NO: 425831 - RNA, 19 nt, Human
gcacgcaccaccaugccca

SEQ ID NO: 425832 - RNA, 24 nt, Human
gcacuccagccugggagacagagc

SEQ ID NO: 425833 - RNA, 19 nt, Human
gcauaucuuuuucuccaca

SEQ ID NO: 425834 - RNA, 24 nt, Human
gccaacauggugaaaccccgucuc

SEQ ID NO: 425835 - RNA, 24 nt, Human
gcccacuuuuuaauggggugguuu

SEQ ID NO: 425836 - RNA, 23 nt, Human
gcccagcuaauuuuuuguauuuu

SEQ ID NO: 425837 - RNA, 21 nt, Human
gccucggccuccugaguagcu

SEQ ID NO: 425838 - RNA, 20 nt, Human
gccuguaaucccugcacucu

SEQ ID NO: 425839 - RNA, 20 nt, Human
gcugaacuaauuuaauuuac

SEQ ID NO: 425840 - RNA, 19 nt, Human
ggaucacaggcaugagcca

SEQ ID NO: 425841 - RNA, 22 nt, Human
ggaucacaggcaugagccacca

SEQ ID NO: 425842 - RNA, 22 nt, Human
ggaucacuugaggucaggaguu

SEQ ID NO: 425843 - RNA, 23 nt, Human
ggcaauccacccaccucggccuc

SEQ ID NO: 425844 - RNA, 24 nt, Human
ggccaggaguucaaggcugcagug

SEQ ID NO: 425845 - RNA, 23 nt, Human
ggccuguaauccuagcacuuugg

SEQ ID NO: 425846 - RNA, 24 nt, Human
gggcacgggccuguaauccuagca

SEQ ID NO: 425847 - RNA, 22 nt, Human
gggguuucaccguguugcccag

SEQ ID NO: 425848 - RNA, 23 nt, Human
gggguuucaccguguugcccagg

SEQ ID NO: 425849 - RNA, 21 nt, Human
gguggaucacuugaggucagg

SEQ ID NO: 425850 - RNA, 21 nt, Human
ggugggugccuguaaucccag

SEQ ID NO: 425851 - RNA, 24 nt, Human
gguggugggugccuguaaucccag

SEQ ID NO: 425852 - RNA, 18 nt, Human
gguuacuguagccuugua

SEQ ID NO: 425853 - RNA, 23 nt, Human
guaguauaguuugaagcugggua

SEQ ID NO: 425854 - RNA, 24 nt, Human
gugcaugugucuuuauaacaauga

SEQ ID NO: 425855 - RNA, 22 nt, Human
guuucaaaaagaaaaaaaaaaa

SEQ ID NO: 425856 - RNA, 21 nt, Human
uaaaaauacaaaaauuagcca

SEQ ID NO: 425857 - RNA, 21 nt, Human
uaaaacuuuagggcugggcac

SEQ ID NO: 425858 - RNA, 21 nt, Human
uaaaacuuuagggcugggcac

SEQ ID NO: 425859 - RNA, 20 nt, Human
uaaaaguuccuuugugaaga

SEQ ID NO: 425860 - RNA, 21 nt, Human
uaauagagaugggguuucacc

SEQ ID NO: 425861 - RNA, 24 nt, Human
uaauagagaugggguuucaccgug

SEQ ID NO: 425862 - RNA, 26 nt, Human
uaauagagaugggguuucaccguguu

SEQ ID NO: 425863 - RNA, 23 nt, Human
uaauuuuuuguauuuuaauagag

SEQ ID NO: 425864 - RNA, 24 nt, Human
uaauuuuuuguauuuuaauagaga

SEQ ID NO: 425865 - RNA, 18 nt, Human
uacaaaguuuaauugcua

SEQ ID NO: 425866 - RNA, 26 nt, Human
uacccaguaaugagauugcuggguug

SEQ ID NO: 425867 - RNA, 26 nt, Human
uagaguuuaaaacuuuagggcugggc

SEQ ID NO: 425868 - RNA, 24 nt, Human
uagcacuuugggaggccgaggugg

SEQ ID NO: 425869 - RNA, 18 nt, Human
uagcuggcacuacaggca

SEQ ID NO: 425870 - RNA, 24 nt, Human
uaggaucacaggcaugagccacca

SEQ ID NO: 425871 - RNA, 24 nt, Human
uaggaucacaggcaugagccacca

SEQ ID NO: 425872 - RNA, 23 nt, Human
uauauggcauaaggaaggcgucc

SEQ ID NO: 425873 - RNA, 20 nt, Human
uauccccacacugucuucca

SEQ ID NO: 425874 - RNA, 26 nt, Human
ucaaaaagaaaaaaaaaaaaaaagaa

SEQ ID NO: 425875 - RNA, 23 nt, Human
ucacugcaaccuccaccuccugg

SEQ ID NO: 425876 - RNA, 24 nt, Human
ucacugcaaccuccaccuccuggg

SEQ ID NO: 425877 - RNA, 25 nt, Human
ucacugcaaccuccaccuccugggu

SEQ ID NO: 425878 - RNA, 20 nt, Human
ucacuugaggucaggaguuc

SEQ ID NO: 425879 - RNA, 20 nt, Human
uccacaauggcugaacuaau

SEQ ID NO: 425880 - RNA, 22 nt, Human
uccacccaccucggccucgcaa

SEQ ID NO: 425881 - RNA, 26 nt, Human
uccauugcccauugcuuguuuuuguc

SEQ ID NO: 425882 - RNA, 27 nt, Human
uccccacacugucuuccacaauggcug

SEQ ID NO: 425883 - RNA, 19 nt, Human
ucccuugaggccaggaguu

SEQ ID NO: 425884 - RNA, 24 nt, Human
uccugaguagcuggcacuacaggc

SEQ ID NO: 425885 - RNA, 21 nt, Human
uccuggguuccagcaauucuc

SEQ ID NO: 425886 - RNA, 24 nt, Human
uccuggguuccagcaauucuccug

SEQ ID NO: 425887 - RNA, 18 nt, Human
ucgcccaggcgggagugc

SEQ ID NO: 425888 - RNA, 21 nt, Human
ucggccuccugaguagcuggc

SEQ ID NO: 425889 - RNA, 24 nt, Human
ucucuaaugaucagugaugcuggg

SEQ ID NO: 425890 - RNA, 21 nt, Human
ucucuauuaaaaauacaaaaa

SEQ ID NO: 425891 - RNA, 24 nt, Human
ugagaugguaucucguuguuguuu

SEQ ID NO: 425892 - RNA, 18 nt, Human
ugagcgcgggcaauccac

SEQ ID NO: 425893 - RNA, 19 nt, Human
ugagguggaagaaucacuu

SEQ ID NO: 425894 - RNA, 20 nt, Human
ugagguggaagaaucacuug

SEQ ID NO: 425895 - RNA, 21 nt, Human
ugagguggaagaaucacuuga

SEQ ID NO: 425896 - RNA, 24 nt, Human
ugagguggaagaaucacuugaacc

SEQ ID NO: 425897 - RNA, 22 nt, Human
ugauaguuucuuuugcugugca

SEQ ID NO: 425898 - RNA, 22 nt, Human
ugcagugagccaugauugugcc

SEQ ID NO: 425899 - RNA, 20 nt, Human
ugccacugcacuccagcagc

SEQ ID NO: 425900 - RNA, 24 nt, Human
ugcccaggcuggucuugaccuccu

SEQ ID NO: 425901 - RNA, 24 nt, Human
ugccucggccuccugaguagcugg

SEQ ID NO: 425902 - RNA, 19 nt, Human
ugccuggguugucuuccag

SEQ ID NO: 425903 - RNA, 23 nt, Human
ugccuguaaucccagcuaccugg

SEQ ID NO: 425904 - RNA, 24 nt, Human
ugccuguaaucccagcuaccuggg

SEQ ID NO: 425905 - RNA, 19 nt, Human
ugcuaggaucacaggcaug

SEQ ID NO: 425906 - RNA, 26 nt, Human
ugcugcaacgaacauacgcgugcaug

SEQ ID NO: 425907 - RNA, 23 nt, Human
ugcugugcagcucuuuaguuuaa

SEQ ID NO: 425908 - RNA, 24 nt, Human
uggaucacuugaggucaggaguuc

SEQ ID NO: 425909 - RNA, 27 nt, Human
uggaucacuugaggucaggaguucgag

SEQ ID NO: 425910 - RNA, 24 nt, Human
uggcacuacaggcacgcaccacca

SEQ ID NO: 425911 - RNA, 24 nt, Human
uggccaacauggugaaaccccguc

SEQ ID NO: 425912 - RNA, 24 nt, Human
uggccacgagcaguggcucacgcc

SEQ ID NO: 425913 - RNA, 24 nt, Human
uggcgcgaucucagcucacugcaa

SEQ ID NO: 425914 - RNA, 24 nt, Human
uggcucacgccuguaaucccugca

SEQ ID NO: 425915 - RNA, 23 nt, Human
ugggaggccgagguggguggauc

SEQ ID NO: 425916 - RNA, 24 nt, Human
ugggaggccgagguggguggauca

SEQ ID NO: 425917 - RNA, 24 nt, Human
ugggaggcugagguggaagaauca

SEQ ID NO: 425918 - RNA, 24 nt, Human
ugggguuucaccguguugcccagg

SEQ ID NO: 425919 - RNA, 24 nt, Human
uggguggaucacuugaggucagga

SEQ ID NO: 425920 - RNA, 20 nt, Human
uggguuccagcaauucuccu

SEQ ID NO: 425921 - RNA, 24 nt, Human
uggugggugccuguaaucccagcu

SEQ ID NO: 425922 - RNA, 24 nt, Human
ugguggugggugccuguaauccca

SEQ ID NO: 425923 - RNA, 22 nt, Human
ugguguguauguaccacauuuu

SEQ ID NO: 425924 - RNA, 22 nt, Human
ugguuuuuucuucuaaauuugu

SEQ ID NO: 425925 - RNA, 18 nt, Human
ugugccaguacuaugcug

SEQ ID NO: 425926 - RNA, 21 nt, Human
uguugcccaggcuggucuuga

SEQ ID NO: 425927 - RNA, 24 nt, Human
uuaaaacuuuagggcugggcacgg

SEQ ID NO: 425928 - RNA, 18 nt, Human
uuaauagagaugggguuu

SEQ ID NO: 425929 - RNA, 22 nt, Human
uuaauagagaugggguuucacc

SEQ ID NO: 425930 - RNA, 24 nt, Human
uuaauagagaugggguuucaccgu

SEQ ID NO: 425931 - RNA, 24 nt, Human
uuagccaggcgugguggugggugc

SEQ ID NO: 425932 - RNA, 18 nt, Human
uucuccacaaccucacca

SEQ ID NO: 425933 - RNA, 21 nt, Human
uugaggccaggaguucaaggc

SEQ ID NO: 425934 - RNA, 24 nt, Human
uugcccaggcuggucuugaccucc

SEQ ID NO: 425935 - RNA, 25 nt, Human
uugggaggccgagguggguggauca

SEQ ID NO: 425936 - RNA, 23 nt, Human
uuguaguauaguuugaagcuggg

SEQ ID NO: 425937 - RNA, 26 nt, Human
uugugccacugcacuccagcagccug

SEQ ID NO: 425938 - RNA, 23 nt, Human
uugugccacugcacuccagccug

SEQ ID NO: 425939 - RNA, 23 nt, Human
uuuacauuuccaccaacagugua

SEQ ID NO: 425940 - RNA, 22 nt, Human
uuucaccguguugcccaggcug

SEQ ID NO: 425941 - RNA, 23 nt, Human
uuucaccguguugcccaggcugg

SEQ ID NO: 425942 - RNA, 19 nt, Human
uuuguauuuuaauagagaa

SEQ ID NO: 425943 - RNA, 23 nt, Human
uuuuaauagagaugggguuucac

SEQ ID NO: 425944 - RNA, 22 nt, Human
uuuuauggcuguauaguauucc

SEQ ID NO: 425945 - RNA, 20 nt, Human
uuuuuguauuuuaauagaga

SEQ ID NO: 425946 - RNA, 23 nt, Human
uuuuuuguauuuuaauagagaug

SEQ ID NO: 425947 - RNA, 22 nt, Human
aagaagcaggcggcucccaggg

SEQ ID NO: 425948 - RNA, 22 nt, Human
aagacagaacaauggaugcaaa

SEQ ID NO: 425949 - RNA, 18 nt, Human
aagcaggcggcucccagg

SEQ ID NO: 425950 - RNA, 18 nt, Human
aaggacccagaggugggu

SEQ ID NO: 425951 - RNA, 18 nt, Human
aaggcaguccccccaccc

SEQ ID NO: 425952 - RNA, 19 nt, Human
acacuacuagagacaaggc

SEQ ID NO: 425953 - RNA, 22 nt, Human
acacugaaguuuuguggggcac

SEQ ID NO: 425954 - RNA, 21 nt, Human
acccucgugggcacgguccca

SEQ ID NO: 425955 - RNA, 22 nt, Human
acgccacucugccugcugggug

SEQ ID NO: 425956 - RNA, 24 nt, Human
acugugcccauggggaggccacgc

SEQ ID NO: 425957 - RNA, 19 nt, Human
agaagcaggcggcucccag

SEQ ID NO: 425958 - RNA, 18 nt, Human
agacccagggagaggcag

SEQ ID NO: 425959 - RNA, 18 nt, Human
agcuggacgcccagaccc

SEQ ID NO: 425960 - RNA, 19 nt, Human
agcugugucugaaccaggc

SEQ ID NO: 425961 - RNA, 20 nt, Human
aggccagggcugagcuggaa

SEQ ID NO: 425962 - RNA, 19 nt, Human
agggggucaccacugugcc

SEQ ID NO: 425963 - RNA, 18 nt, Human
aguggugggggaguaagg

SEQ ID NO: 425964 - RNA, 21 nt, Human
aguuuuguggggcacagugug

SEQ ID NO: 425965 - RNA, 22 nt, Human
aucaccucuccccaagggccag

SEQ ID NO: 425966 - RNA, 19 nt, Human
auuuauuugucaaaggccu

SEQ ID NO: 425967 - RNA, 21 nt, Human
caacggcaguccggcuccuga

SEQ ID NO: 425968 - RNA, 21 nt, Human
cacagugugugccgagguggg

SEQ ID NO: 425969 - RNA, 25 nt, Human
cacccccaggcucuccuggacccuu

SEQ ID NO: 425970 - RNA, 20 nt, Human
caccgggacccuccuuccuc

SEQ ID NO: 425971 - RNA, 19 nt, Human
cacgccacucugccugcug

SEQ ID NO: 425972 - RNA, 18 nt, Human
cacuacuagagacaaggc

SEQ ID NO: 425973 - RNA, 21 nt, Human
cacucgccuucaauucaaagc

SEQ ID NO: 425974 - RNA, 21 nt, Human
cacugagugggggguggaggg

SEQ ID NO: 425975 - RNA, 22 nt, Human
cagcaagcgggccuguccccuc

SEQ ID NO: 425976 - RNA, 24 nt, Human
cagcaguggggaccagguacccag

SEQ ID NO: 425977 - RNA, 19 nt, Human
cagcccagggggcaggccu

SEQ ID NO: 425978 - RNA, 20 nt, Human
cagccugugcagccagaugu

SEQ ID NO: 425979 - RNA, 18 nt, Human
cagcucagauggggguca

SEQ ID NO: 425980 - RNA, 23 nt, Human
caggaaagacagaacaauggaug

SEQ ID NO: 425981 - RNA, 20 nt, Human
caggcuccagcccugagaaa

SEQ ID NO: 425982 - RNA, 21 nt, Human
cagguacccagcaagcgggcc

SEQ ID NO: 425983 - RNA, 23 nt, Human
cagugugugccgagguggggccc

SEQ ID NO: 425984 - RNA, 22 nt, Human
ccacacuacuagagacaaggca

SEQ ID NO: 425985 - RNA, 20 nt, Human
ccagacccagggagaggcag

SEQ ID NO: 425986 - RNA, 21 nt, Human
ccaggaaagacagaacaaugg

SEQ ID NO: 425987 - RNA, 24 nt, Human
cccaaggcugagggggucugaggc

SEQ ID NO: 425988 - RNA, 22 nt, Human
cccaggcagacgcguuuuaaag

SEQ ID NO: 425989 - RNA, 24 nt, Human
cccagggccaggauacaccgggac

SEQ ID NO: 425990 - RNA, 19 nt, Human
ccccacccccaggcucucc

SEQ ID NO: 425991 - RNA, 25 nt, Human
ccccacccccaggcucuccuggacc

SEQ ID NO: 425992 - RNA, 21 nt, Human
ccccaggcucuccuggacccu

SEQ ID NO: 425993 - RNA, 26 nt, Human
ccccccacccccaggcucuccuggac

SEQ ID NO: 425994 - RNA, 20 nt, Human
cccccgggagccaaggaccc

SEQ ID NO: 425995 - RNA, 22 nt, Human
cccccgggagccaaggacccag

SEQ ID NO: 425996 - RNA, 21 nt, Human
ccccgugugucggggcuucuc

SEQ ID NO: 425997 - RNA, 22 nt, Human
cccgcggguuccgcacuccucu

SEQ ID NO: 425998 - RNA, 22 nt, Human
cccugugugcaggagggaagac

SEQ ID NO: 425999 - RNA, 18 nt, Human
ccgaaccagggaagugac

SEQ ID NO: 426000 - RNA, 18 nt, Human
ccugcagguggcccugcc

SEQ ID NO: 426001 - RNA, 22 nt, Human
ccuggacccugacacuggaggu

SEQ ID NO: 426002 - RNA, 20 nt, Human
cgaaccagggaagugacagc

SEQ ID NO: 426003 - RNA, 21 nt, Human
cgcccagacccccagggccag

SEQ ID NO: 426004 - RNA, 21 nt, Human
cgcugccugcgcuccucugac

SEQ ID NO: 426005 - RNA, 20 nt, Human
cgggagccaaggacccagag

SEQ ID NO: 426006 - RNA, 22 nt, Human
cgggagccaaggacccagaggu

SEQ ID NO: 426007 - RNA, 22 nt, Human
cgugggcacggucccaaggcug

SEQ ID NO: 426008 - RNA, 18 nt, Human
cgugucaucggggcucug

SEQ ID NO: 426009 - RNA, 20 nt, Human
cuccagcccugagaaucacc

SEQ ID NO: 426010 - RNA, 21 nt, Human
cuccugaggcuccuccugggc

SEQ ID NO: 426011 - RNA, 22 nt, Human
cuccugaggcuccuccugggcc

SEQ ID NO: 426012 - RNA, 19 nt, Human
cuccugggcccucugugca

SEQ ID NO: 426013 - RNA, 27 nt, Human
cuccugggcccucugugcacauccucc

SEQ ID NO: 426014 - RNA, 18 nt, Human
cucuuugcccagaacugu

SEQ ID NO: 426015 - RNA, 23 nt, Human
cucuuugcccagaacuguguucc

SEQ ID NO: 426016 - RNA, 20 nt, Human
cugcagguggcccugccagg

SEQ ID NO: 426017 - RNA, 21 nt, Human
cugugccaggcagcaugugga

SEQ ID NO: 426018 - RNA, 21 nt, Human
cugugcccauggggaggccac

SEQ ID NO: 426019 - RNA, 23 nt, Human
cugugucugaaccaggcucccag

SEQ ID NO: 426020 - RNA, 23 nt, Human
gaugaauaacuucccaggaaaga

SEQ ID NO: 426021 - RNA, 19 nt, Human
gcaaauucugaggcacucg

SEQ ID NO: 426022 - RNA, 21 nt, Human
gcagaacauccccccagcuca

SEQ ID NO: 426023 - RNA, 19 nt, Human
gcccagggggcaggccuca

SEQ ID NO: 426024 - RNA, 18 nt, Human
gcccugcgcugccugcgc

SEQ ID NO: 426025 - RNA, 22 nt, Human
gcccugcgcugccugcgcuccu

SEQ ID NO: 426026 - RNA, 19 nt, Human
gccuggccacaguguggga

SEQ ID NO: 426027 - RNA, 19 nt, Human
gcuccuccugggcccucug

SEQ ID NO: 426028 - RNA, 25 nt, Human
ggaaagacagaacaauggaugcaaa

SEQ ID NO: 426029 - RNA, 19 nt, Human
ggaccagguacccagcaag

SEQ ID NO: 426030 - RNA, 21 nt, Human
ggagguuggugggauaugcuu

SEQ ID NO: 426031 - RNA, 19 nt, Human
ggcccucugugcacauccu

SEQ ID NO: 426032 - RNA, 19 nt, Human
gggauaugcuuucuccacc

SEQ ID NO: 426033 - RNA, 22 nt, Human
gggcaggccucagacgcaaccc

SEQ ID NO: 426034 - RNA, 24 nt, Human
gggggcaggccucagacgcaaccc

SEQ ID NO: 426035 - RNA, 23 nt, Human
gggggucaccacugugcccaugg

SEQ ID NO: 426036 - RNA, 18 nt, Human
gggggucugaggccccag

SEQ ID NO: 426037 - RNA, 23 nt, Human
gucugaaccaggcucccagcugu

SEQ ID NO: 426038 - RNA, 18 nt, Human
uaaaggcccgagccccgu

SEQ ID NO: 426039 - RNA, 18 nt, Human
uauuugucaaaggccugg

SEQ ID NO: 426040 - RNA, 20 nt, Human
ucaaagccugugggaggccc

SEQ ID NO: 426041 - RNA, 20 nt, Human
ucccaggaaagacagaacaa

SEQ ID NO: 426042 - RNA, 25 nt, Human
ucccagggagucacuguaggacacc

SEQ ID NO: 426043 - RNA, 22 nt, Human
uccccccagcucagaugggggu

SEQ ID NO: 426044 - RNA, 24 nt, Human
uccuggacccugacacuggagguu

SEQ ID NO: 426045 - RNA, 20 nt, Human
ucggugggcuggccaccagg

SEQ ID NO: 426046 - RNA, 22 nt, Human
ucucaaccucggauccucuuug

SEQ ID NO: 426047 - RNA, 21 nt, Human
ucugucacucucuggggcuug

SEQ ID NO: 426048 - RNA, 20 nt, Human
ucugugccaggcagcauguc

SEQ ID NO: 426049 - RNA, 24 nt, Human
ugacugaggcaucucuugcacucu

SEQ ID NO: 426050 - RNA, 21 nt, Human
ugagaaaguggagccgcugcc

SEQ ID NO: 426051 - RNA, 19 nt, Human
ugagcuggacgcccagacc

SEQ ID NO: 426052 - RNA, 23 nt, Human
ugagcuggacgcccagaccccca

SEQ ID NO: 426053 - RNA, 18 nt, Human
ugaggaggagccgccugc

SEQ ID NO: 426054 - RNA, 21 nt, Human
ugaggccccagcccagggggc

SEQ ID NO: 426055 - RNA, 20 nt, Human
ugcacucugcaguuuaauuu

SEQ ID NO: 426056 - RNA, 21 nt, Human
ugcaggacaggguccugcagg

SEQ ID NO: 426057 - RNA, 23 nt, Human
ugccagcccugcgcugccugcgc

SEQ ID NO: 426058 - RNA, 19 nt, Human
ugccaggcagcauguggag

SEQ ID NO: 426059 - RNA, 23 nt, Human
ugccugcagccccacuguggccu

SEQ ID NO: 426060 - RNA, 21 nt, Human
ugcgcugccugcgcuccucug

SEQ ID NO: 426061 - RNA, 19 nt, Human
ugggcuggccaccaggaug

SEQ ID NO: 426062 - RNA, 20 nt, Human
ugucaaaggccuggucugug

SEQ ID NO: 426063 - RNA, 24 nt, Human
ugucggggcuucucaggcagggcu

SEQ ID NO: 426064 - RNA, 18 nt, Human
ugugcagccagauguguu

SEQ ID NO: 426065 - RNA, 19 nt, Human
uguggaggcacugaguggg

SEQ ID NO: 426066 - RNA, 24 nt, Human
uuggccaacggcaguccggcuccu

SEQ ID NO: 426067 - RNA, 20 nt, Human
uuuccagccagauguaaggc

SEQ ID NO: 426068 - RNA, 20 nt, Human
uuuguggggcacagugugug

SEQ ID NO: 426069 - RNA, 19 nt, Human
uuuuaaaggcccgagcccc

SEQ ID NO: 426070 - RNA, 19 nt, Human
uuuuuuuuuuuuuuuugca

SEQ ID NO: 426071 - RNA, 18 nt, Human
uuuuuuuuuuuuuuuuug

SEQ ID NO: 426072 - RNA, 19 nt, Human
uuuuuuuuuuuuuuuuugc

SEQ ID NO: 426073 - RNA, 19 nt, Human
aaaacgcccgcuuucacag

SEQ ID NO: 426074 - RNA, 18 nt, Human
aaacauagucuagugaac

SEQ ID NO: 426075 - RNA, 21 nt, Human
aaacgcccgcuuucacagauc

SEQ ID NO: 426076 - RNA, 23 nt, Human
aaacgcccgcuuucacagaucaa

SEQ ID NO: 426077 - RNA, 22 nt, Human
aauacucuccgugacucuacuu

SEQ ID NO: 426078 - RNA, 21 nt, Human
acaggauguuggacagcuauc

SEQ ID NO: 426079 - RNA, 24 nt, Human
acucuacuuccgguaucuuccaaa

SEQ ID NO: 426080 - RNA, 18 nt, Human
agaaaugaauagaaaaca

SEQ ID NO: 426081 - RNA, 21 nt, Human
aucuucccagacaggauguug

SEQ ID NO: 426082 - RNA, 26 nt, Human
caaaaaaagcugaagacauuuuaaaa

SEQ ID NO: 426083 - RNA, 18 nt, Human
ccggauccuaccucuccg

SEQ ID NO: 426084 - RNA, 23 nt, Human
cucuacuuccgguaucuuccaaa

SEQ ID NO: 426085 - RNA, 18 nt, Human
cugaaugaauaguuuaga

SEQ ID NO: 426086 - RNA, 19 nt, Human
gcugaaugaauaguuuaga

SEQ ID NO: 426087 - RNA, 18 nt, Human
guccuguuuucaaaaucu

SEQ ID NO: 426088 - RNA, 21 nt, Human
uaaaauguucaaacaucaaug

SEQ ID NO: 426089 - RNA, 22 nt, Human
uaaaauguucaaacaucaaugu

SEQ ID NO: 426090 - RNA, 23 nt, Human
uaaaauguucaaacaucaauguu

SEQ ID NO: 426091 - RNA, 19 nt, Human
uacaucaucacacaaauua

SEQ ID NO: 426092 - RNA, 24 nt, Human
uacaucaucacacaaauuaaaaug

SEQ ID NO: 426093 - RNA, 23 nt, Human
uagaacucaaugugccaguguca

SEQ ID NO: 426094 - RNA, 19 nt, Human
ucaaaaaaagcugaagaca

SEQ ID NO: 426095 - RNA, 20 nt, Human
ucaauguaucaaaaauuuua

SEQ ID NO: 426096 - RNA, 23 nt, Human
uccaaaacgcccgcuuucacaga

SEQ ID NO: 426097 - RNA, 18 nt, Human
ugacuugaaauucuccuu

SEQ ID NO: 426098 - RNA, 19 nt, Human
ugauguuuucuuuguccug

SEQ ID NO: 426099 - RNA, 22 nt, Human
ugauguuuucuuuguccuguuu

SEQ ID NO: 426100 - RNA, 26 nt, Human
ugugugaaugaauaugauaaaugugu

SEQ ID NO: 426101 - RNA, 18 nt, Human
uuauauuuucuacaucau

SEQ ID NO: 426102 - RNA, 23 nt, Human
uucacaauguuuauguacaaacu

SEQ ID NO: 426103 - RNA, 20 nt, Human
aaacuuucucucuuugaggc

SEQ ID NO: 426104 - RNA, 21 nt, Human
aaagaucaguaagaccacaga

SEQ ID NO: 426105 - RNA, 23 nt, Human
aaccaccuauauacagaggcaga

SEQ ID NO: 426106 - RNA, 19 nt, Human
aaccagaaaauaacaauga

SEQ ID NO: 426107 - RNA, 20 nt, Human
aaccagaaaauaacaaugac

SEQ ID NO: 426108 - RNA, 24 nt, Human
aagaaugaggacaagaaaaaaaga

SEQ ID NO: 426109 - RNA, 21 nt, Human
aagaucuacuuuccagaaacu

SEQ ID NO: 426110 - RNA, 23 nt, Human
accacagaaaaaauaauacacca

SEQ ID NO: 426111 - RNA, 20 nt, Human
acucaaggcaagaaugagga

SEQ ID NO: 426112 - RNA, 19 nt, Human
agagaacagugaagugaua

SEQ ID NO: 426113 - RNA, 19 nt, Human
agaggaacuggaacucaag

SEQ ID NO: 426114 - RNA, 19 nt, Human
aggacaagaaaaaaagaga

SEQ ID NO: 426115 - RNA, 27 nt, Human
aggcaagaaugaggacaagagggaccc

SEQ ID NO: 426116 - RNA, 21 nt, Human
auugugcuccccuucccaccc

SEQ ID NO: 426117 - RNA, 20 nt, Human
caaagaggaacuggaacuca

SEQ ID NO: 426118 - RNA, 24 nt, Human
caaagaugaaagcugacuuaggua

SEQ ID NO: 426119 - RNA, 21 nt, Human
caaccagaaaauaacaaugac

SEQ ID NO: 426120 - RNA, 22 nt, Human
caccuauauacagaggcagagu

SEQ ID NO: 426121 - RNA, 20 nt, Human
cacugcuuaaaaggaguaug

SEQ ID NO: 426122 - RNA, 18 nt, Human
caucacagcgauggcagc

SEQ ID NO: 426123 - RNA, 20 nt, Human
caugagaccaccaccauaac

SEQ ID NO: 426124 - RNA, 24 nt, Human
ccacagagaauuagaugauccgcc

SEQ ID NO: 426125 - RNA, 24 nt, Human
ccaccccacuuaaagaaaaccacc

SEQ ID NO: 426126 - RNA, 19 nt, Human
ccaugguuuuccuaaccca

SEQ ID NO: 426127 - RNA, 19 nt, Human
cccaccccacuuaaagaaa

SEQ ID NO: 426128 - RNA, 25 nt, Human
cccuucccaccccacuuaaagaaaa

SEQ ID NO: 426129 - RNA, 21 nt, Human
ccgguccucaggcgcuuuggu

SEQ ID NO: 426130 - RNA, 24 nt, Human
ccuccagguaaccugcugggaauu

SEQ ID NO: 426131 - RNA, 19 nt, Human
ccuuacccaugguuuuccu

SEQ ID NO: 426132 - RNA, 30 nt, Human
ccuuacccaugguuuuccuaacccagcugg

SEQ ID NO: 426133 - RNA, 19 nt, Human
cuauauacagaggcagagu

SEQ ID NO: 426134 - RNA, 19 nt, Human
cucaaggcaagaaugagga

SEQ ID NO: 426135 - RNA, 23 nt, Human
cuuguugggaggaagcaaaugcu

SEQ ID NO: 426136 - RNA, 23 nt, Human
gaacucccagcaucacagcgaug

SEQ ID NO: 426137 - RNA, 18 nt, Human
gaauuucuugagauuuug

SEQ ID NO: 426138 - RNA, 18 nt, Human
gacuuaugagggugcuga

SEQ ID NO: 426139 - RNA, 21 nt, Human
gagaccaccaccauaacucac

SEQ ID NO: 426140 - RNA, 19 nt, Human
gaggacaagaaaaaaagag

SEQ ID NO: 426141 - RNA, 22 nt, Human
gaguaugaagggaaauugugcu

SEQ ID NO: 426142 - RNA, 19 nt, Human
gcuccccuucccaccccac

SEQ ID NO: 426143 - RNA, 23 nt, Human
gcuguuggaggaucaggcaaagg

SEQ ID NO: 426144 - RNA, 21 nt, Human
guaaaggagacaccauccaca

SEQ ID NO: 426145 - RNA, 18 nt, Human
guccucaggcgcuuuggu

SEQ ID NO: 426146 - RNA, 18 nt, Human
uaacgaaacuuucucucu

SEQ ID NO: 426147 - RNA, 27 nt, Human
uaacgaaacuuucucucuuugaggcuu

SEQ ID NO: 426148 - RNA, 22 nt, Human
uaagaaacucaucaauaaccau

SEQ ID NO: 426149 - RNA, 23 nt, Human
uacaaagaucaguaagaccacag

SEQ ID NO: 426150 - RNA, 18 nt, Human
uagaacucccagcaucac

SEQ ID NO: 426151 - RNA, 19 nt, Human
ucaaggcaagaaugaggac

SEQ ID NO: 426152 - RNA, 25 nt, Human
ucaguuuuugaguuucuaaagguuc

SEQ ID NO: 426153 - RNA, 25 nt, Human
ugagaccaccaccauaacucacugc

SEQ ID NO: 426154 - RNA, 23 nt, Human
ugccgguccucaggcgcuuuggu

SEQ ID NO: 426155 - RNA, 20 nt, Human
ugcugaagacagaggugacu

SEQ ID NO: 426156 - RNA, 24 nt, Human
uggcagagauugggccaaaagguc

SEQ ID NO: 426157 - RNA, 20 nt, Human
ugggaaagaccgaaaaguua

SEQ ID NO: 426158 - RNA, 19 nt, Human
ugggaggaagcaaaugcua

SEQ ID NO: 426159 - RNA, 21 nt, Human
uguacaccaaagaggaacugg

SEQ ID NO: 426160 - RNA, 24 nt, Human
ugugguaacuagaaggccucaacu

SEQ ID NO: 426161 - RNA, 22 nt, Human
uguuggaggaucaggcaaagga

SEQ ID NO: 426162 - RNA, 21 nt, Human
uuggcuccccuugaauggccg

SEQ ID NO: 426163 - RNA, 20 nt, Human
aaacuauuccguagaaguaa

SEQ ID NO: 426164 - RNA, 19 nt, Human
aaagaggccucccuccuuc

SEQ ID NO: 426165 - RNA, 26 nt, Human
aaaugauucuugugccucagcagcca

SEQ ID NO: 426166 - RNA, 21 nt, Human
aagaaggucagcagggaaaca

SEQ ID NO: 426167 - RNA, 20 nt, Human
aagagaauuuuacagcacaa

SEQ ID NO: 426168 - RNA, 19 nt, Human
aagcaggagacagaagccu

SEQ ID NO: 426169 - RNA, 23 nt, Human
aagcauacagccugcaaacauau

SEQ ID NO: 426170 - RNA, 24 nt, Human
aaggugcuaggauuacaggcguga

SEQ ID NO: 426171 - RNA, 23 nt, Human
aaucugaucuuucuuuuccccac

SEQ ID NO: 426172 - RNA, 22 nt, Human
acaaaaauaaaaagacaucucc

SEQ ID NO: 426173 - RNA, 24 nt, Human
acacagacacaguaacaaucugau

SEQ ID NO: 426174 - RNA, 19 nt, Human
acaucggaucaccuaggga

SEQ ID NO: 426175 - RNA, 19 nt, Human
acauuauucuguaacagug

SEQ ID NO: 426176 - RNA, 19 nt, Human
accuagggaguuuuugggg

SEQ ID NO: 426177 - RNA, 21 nt, Human
acuacaacucaaaaaagaaga

SEQ ID NO: 426178 - RNA, 21 nt, Human
agacacucaggaaguugaugg

SEQ ID NO: 426179 - RNA, 19 nt, Human
agacaggauugauuacugg

SEQ ID NO: 426180 - RNA, 23 nt, Human
agccaaaaacaaaaauugcuuaa

SEQ ID NO: 426181 - RNA, 25 nt, Human
aggaaauggcaaagaacauuuuuug

SEQ ID NO: 426182 - RNA, 23 nt, Human
aggaggcaggugacagggaggaa

SEQ ID NO: 426183 - RNA, 22 nt, Human
agggauggaaugucccuuuguc

SEQ ID NO: 426184 - RNA, 19 nt, Human
aguagcuggaauuacaggc

SEQ ID NO: 426185 - RNA, 19 nt, Human
agugauccacccaccuuga

SEQ ID NO: 426186 - RNA, 24 nt, Human
aguggaguggcaugaucuuggcuc

SEQ ID NO: 426187 - RNA, 22 nt, Human
auagagaaagaacagugggccc

SEQ ID NO: 426188 - RNA, 25 nt, Human
auggcuaccacuaaggguacaggga

SEQ ID NO: 426189 - RNA, 18 nt, Human
augggguuucgccauguu

SEQ ID NO: 426190 - RNA, 23 nt, Human
augggguuucgccauguuggcca

SEQ ID NO: 426191 - RNA, 24 nt, Human
augggguuucgccauguuggccag

SEQ ID NO: 426192 - RNA, 19 nt, Human
auggugugucuucaguuac

SEQ ID NO: 426193 - RNA, 24 nt, Human
caaggugcuaggauuacaggcgug

SEQ ID NO: 426194 - RNA, 23 nt, Human
caagugauccacccaccuugacc

SEQ ID NO: 426195 - RNA, 23 nt, Human
cacagaaauugcauauucacuac

SEQ ID NO: 426196 - RNA, 20 nt, Human
caccaagacacacaccacgg

SEQ ID NO: 426197 - RNA, 22 nt, Human
caccgagacauuccauuaccag

SEQ ID NO: 426198 - RNA, 20 nt, Human
caccuugacccccaaggugc

SEQ ID NO: 426199 - RNA, 21 nt, Human
cagaggucccugcagcuuucu

SEQ ID NO: 426200 - RNA, 18 nt, Human
cagcagccagaguagcug

SEQ ID NO: 426201 - RNA, 19 nt, Human
cagcagccagaguagcugg

SEQ ID NO: 426202 - RNA, 20 nt, Human
cagcauaucucaccuccagc

SEQ ID NO: 426203 - RNA, 21 nt, Human
cagccgaggaguuuccgccug

SEQ ID NO: 426204 - RNA, 19 nt, Human
caggagacagaagccuucc

SEQ ID NO: 426205 - RNA, 25 nt, Human
cauaaaagaaccuucugauaagaag

SEQ ID NO: 426206 - RNA, 19 nt, Human
cauagcccacccccuucca

SEQ ID NO: 426207 - RNA, 20 nt, Human
caugaaauucacagaaacga

SEQ ID NO: 426208 - RNA, 22 nt, Human
cauguuggccaggcuggccuca

SEQ ID NO: 426209 - RNA, 22 nt, Human
ccaaggugcuaggauuacaggc

SEQ ID NO: 426210 - RNA, 24 nt, Human
ccaaggugcuaggauuacaggcgu

SEQ ID NO: 426211 - RNA, 18 nt, Human
ccacagaaacucuccaga

SEQ ID NO: 426212 - RNA, 18 nt, Human
ccacuuuugugcaguauc

SEQ ID NO: 426213 - RNA, 19 nt, Human
ccaggcuuucuugggcaga

SEQ ID NO: 426214 - RNA, 22 nt, Human
ccauguuggccaggcuggccuc

SEQ ID NO: 426215 - RNA, 18 nt, Human
cccagacuggaguggagu

SEQ ID NO: 426216 - RNA, 24 nt, Human
ccccaaggugcuaggauuacaggc

SEQ ID NO: 426217 - RNA, 20 nt, Human
cccccaaggugcuaggauua

SEQ ID NO: 426218 - RNA, 21 nt, Human
cccggccucggcgcgcucggc

SEQ ID NO: 426219 - RNA, 19 nt, Human
ccucccuccuucacuauuc

SEQ ID NO: 426220 - RNA, 24 nt, Human
ccugaccucaagugauccacccac

SEQ ID NO: 426221 - RNA, 21 nt, Human
ccugcacagcccuaaauccau

SEQ ID NO: 426222 - RNA, 23 nt, Human
ccugcagcuuucugcugugcauu

SEQ ID NO: 426223 - RNA, 24 nt, Human
cgccauguuggccaggcuggccuc

SEQ ID NO: 426224 - RNA, 27 nt, Human
cgccauguuggccaggcuggccucaaa

SEQ ID NO: 426225 - RNA, 26 nt, Human
cgcgcucggcuccggcucgggggucc

SEQ ID NO: 426226 - RNA, 24 nt, Human
cggcucggggguccggcacggcag

SEQ ID NO: 426227 - RNA, 21 nt, Human
cggcuuucauagcccaccccc

SEQ ID NO: 426228 - RNA, 21 nt, Human
cuaaaaauauuuguccucuaa

SEQ ID NO: 426229 - RNA, 18 nt, Human
cuaaaguuauaggcuaac

SEQ ID NO: 426230 - RNA, 24 nt, Human
cucaaaaaugccuucaaauuuuua

SEQ ID NO: 426231 - RNA, 23 nt, Human
cucaagugauccacccaccuuga

SEQ ID NO: 426232 - RNA, 26 nt, Human
cucacagcaaccgccaccuccuaggu

SEQ ID NO: 426233 - RNA, 20 nt, Human
cucugucgcccagacuggag

SEQ ID NO: 426234 - RNA, 23 nt, Human
cucugucgcccagacuggagugg

SEQ ID NO: 426235 - RNA, 24 nt, Human
cuggaguggaguggcaugaucuug

SEQ ID NO: 426236 - RNA, 23 nt, Human
cuuuuuuuuuuuuuugagucaga

SEQ ID NO: 426237 - RNA, 24 nt, Human
gaagaugagaugguugcugaagac

SEQ ID NO: 426238 - RNA, 20 nt, Human
gagggccagauccuccagga

SEQ ID NO: 426239 - RNA, 26 nt, Human
gaguagcuggaauuacaggccuaugc

SEQ ID NO: 426240 - RNA, 18 nt, Human
gauuacaggcgugagcca

SEQ ID NO: 426241 - RNA, 21 nt, Human
gauuacaggcgugagccaccg

SEQ ID NO: 426242 - RNA, 24 nt, Human
gauuacaggcgugagccaccgugc

SEQ ID NO: 426243 - RNA, 21 nt, Human
gauucuugugccucagcagcc

SEQ ID NO: 426244 - RNA, 22 nt, Human
gcaaccgccaccuccuagguuc

SEQ ID NO: 426245 - RNA, 23 nt, Human
gcccagacuggaguggaguggca

SEQ ID NO: 426246 - RNA, 23 nt, Human
gcuggccucaaacuccugaccuc

SEQ ID NO: 426247 - RNA, 22 nt, Human
ggauuacaggcgugagccaccg

SEQ ID NO: 426248 - RNA, 20 nt, Human
gggcagaggucccugcagcu

SEQ ID NO: 426249 - RNA, 23 nt, Human
gggcaucuggaguuuuaaaugcu

SEQ ID NO: 426250 - RNA, 22 nt, Human
gggguuucgccauguuggccag

SEQ ID NO: 426251 - RNA, 22 nt, Human
ggguuucgccauguuggccagg

SEQ ID NO: 426252 - RNA, 21 nt, Human
gugauccacccaccuugaccc

SEQ ID NO: 426253 - RNA, 21 nt, Human
gugcuaggauuacaggcguga

SEQ ID NO: 426254 - RNA, 20 nt, Human
guucaaggaaagguacugug

SEQ ID NO: 426255 - RNA, 21 nt, Human
uaaaagaaccuucugauaaga

SEQ ID NO: 426256 - RNA, 22 nt, Human
uaacaaggcacauccugcacag

SEQ ID NO: 426257 - RNA, 23 nt, Human
uaagauuuaaaggguggaagggg

SEQ ID NO: 426258 - RNA, 24 nt, Human
uacaggcgugagccaccgugccca

SEQ ID NO: 426259 - RNA, 19 nt, Human
uacuaugacaauugcuaaa

SEQ ID NO: 426260 - RNA, 22 nt, Human
uagaaaugggguuucgccaugu

SEQ ID NO: 426261 - RNA, 18 nt, Human
uaggauuacaggcgugag

SEQ ID NO: 426262 - RNA, 21 nt, Human
uaggauuacaggcgugagcca

SEQ ID NO: 426263 - RNA, 22 nt, Human
uaggauuacaggcgugagccac

SEQ ID NO: 426264 - RNA, 23 nt, Human
uaggauuacaggcgugagccacc

SEQ ID NO: 426265 - RNA, 23 nt, Human
uaggauuacaggcgugagccacc

SEQ ID NO: 426266 - RNA, 24 nt, Human
uaggauuacaggcgugagccaccg

SEQ ID NO: 426267 - RNA, 23 nt, Human
uaggcuaacaacaucucaaagca

SEQ ID NO: 426268 - RNA, 24 nt, Human
uaguagaaaugggguuucgccaug

SEQ ID NO: 426269 - RNA, 21 nt, Human
uauaaaauguaaauacuccuc

SEQ ID NO: 426270 - RNA, 21 nt, Human
uaucucaggcugucucagugg

SEQ ID NO: 426271 - RNA, 26 nt, Human
uaucucaggcugucucaguggggggg

SEQ ID NO: 426272 - RNA, 22 nt, Human
uaugacaauugcuaaaaaacaa

SEQ ID NO: 426273 - RNA, 20 nt, Human
uauucuguaacaguggugcu

SEQ ID NO: 426274 - RNA, 19 nt, Human
uauugcugccagcauaucu

SEQ ID NO: 426275 - RNA, 24 nt, Human
ucacagcaaccgccaccuccuagg

SEQ ID NO: 426276 - RNA, 18 nt, Human
ucagagccacuuuuuuuu

SEQ ID NO: 426277 - RNA, 27 nt, Human
ucagcaccgacccuuuaaccuccggag

SEQ ID NO: 426278 - RNA, 25 nt, Human
ucagccaaaaacaaaaauugcuuaa

SEQ ID NO: 426279 - RNA, 25 nt, Human
ucaggugaagcuggaagaugagaug

SEQ ID NO: 426280 - RNA, 24 nt, Human
ucagugggggggaaaccuuggaca

SEQ ID NO: 426281 - RNA, 18 nt, Human
ucauagcccacccccuuc

SEQ ID NO: 426282 - RNA, 24 nt, Human
uccacagaaacucuccagaauucc

SEQ ID NO: 426283 - RNA, 21 nt, Human
uccagaauuccaugaucucaa

SEQ ID NO: 426284 - RNA, 22 nt, Human
uccaugggguacaugcugguuc

SEQ ID NO: 426285 - RNA, 19 nt, Human
uccauuaccagggacaagc

SEQ ID NO: 426286 - RNA, 24 nt, Human
ucccagcuaauuuuuuuguauuuu

SEQ ID NO: 426287 - RNA, 21 nt, Human
uccuagguucaaaugauucuu

SEQ ID NO: 426288 - RNA, 22 nt, Human
uccuagguucaaaugauucuug

SEQ ID NO: 426289 - RNA, 21 nt, Human
uccucagcaccgacccuuuac

SEQ ID NO: 426290 - RNA, 22 nt, Human
uccucuaauauuuuggugucuc

SEQ ID NO: 426291 - RNA, 25 nt, Human
uccuggacccacugucagagaccuu

SEQ ID NO: 426292 - RNA, 24 nt, Human
ucgccauguuggccaggcuggccu

SEQ ID NO: 426293 - RNA, 21 nt, Human
ucgcccagacuggaguggagu

SEQ ID NO: 426294 - RNA, 23 nt, Human
ucuagggcuuuccuggaaugaag

SEQ ID NO: 426295 - RNA, 24 nt, Human
ucuggccaucgugucauggcuacc

SEQ ID NO: 426296 - RNA, 24 nt, Human
ucuugcucugucgcccagacugga

SEQ ID NO: 426297 - RNA, 20 nt, Human
ugacagcagguuuuuugaca

SEQ ID NO: 426298 - RNA, 20 nt, Human
ugacccccaaggugcuagga

SEQ ID NO: 426299 - RNA, 25 nt, Human
ugaccucaagugauccacccaccuu

SEQ ID NO: 426300 - RNA, 18 nt, Human
ugagcacagaguuggggc

SEQ ID NO: 426301 - RNA, 21 nt, Human
ugagcacagaguuggggcuaa

SEQ ID NO: 426302 - RNA, 18 nt, Human
ugaggaggcaggugacag

SEQ ID NO: 426303 - RNA, 23 nt, Human
ugaggaggcaggugacagggagg

SEQ ID NO: 426304 - RNA, 20 nt, Human
ugaucuaggacauuuaucuu

SEQ ID NO: 426305 - RNA, 18 nt, Human
ugauggguggccccaggg

SEQ ID NO: 426306 - RNA, 21 nt, Human
ugauggguggccccagggugu

SEQ ID NO: 426307 - RNA, 18 nt, Human
ugcaccacugacaaauag

SEQ ID NO: 426308 - RNA, 19 nt, Human
ugcauauucacuacaacuc

SEQ ID NO: 426309 - RNA, 24 nt, Human
ugcuaggauuacaggcgugagcca

SEQ ID NO: 426310 - RNA, 21 nt, Human
uggaaaugcucaaaaaugccu

SEQ ID NO: 426311 - RNA, 23 nt, Human
uggaaaugcucaaaaaugccuuc

SEQ ID NO: 426312 - RNA, 21 nt, Human
uggaagaugagaugguugcug

SEQ ID NO: 426313 - RNA, 24 nt, Human
uggaauuacaggccuaugccacca

SEQ ID NO: 426314 - RNA, 24 nt, Human
uggaguggaguggcaugaucuugg

SEQ ID NO: 426315 - RNA, 24 nt, Human
uggccaggcuggccucaaacuccu

SEQ ID NO: 426316 - RNA, 20 nt, Human
uggccucaaacuccugaccu

SEQ ID NO: 426317 - RNA, 20 nt, Human
uggccucugaguucccucag

SEQ ID NO: 426318 - RNA, 23 nt, Human
uggcuaccacuaaggguacaggg

SEQ ID NO: 426319 - RNA, 20 nt, Human
uggcuccugacuccuuuucc

SEQ ID NO: 426320 - RNA, 27 nt, Human
ugggaaagucagagccacuuuuuuuuu

SEQ ID NO: 426321 - RNA, 19 nt, Human
ugggcugagcacuccuggc

SEQ ID NO: 426322 - RNA, 21 nt, Human
uggggcaauuuuuuguagaga

SEQ ID NO: 426323 - RNA, 20 nt, Human
uggggguugagaggagggcc

SEQ ID NO: 426324 - RNA, 24 nt, Human
ugggguuucgccauguuggccagg

SEQ ID NO: 426325 - RNA, 20 nt, Human
uggguggccccagggugugg

SEQ ID NO: 426326 - RNA, 18 nt, Human
uggugugggcaucuggag

SEQ ID NO: 426327 - RNA, 21 nt, Human
uguauuuuuaguagaaauggg

SEQ ID NO: 426328 - RNA, 23 nt, Human
ugucccuuugucgcuccagcuua

SEQ ID NO: 426329 - RNA, 18 nt, Human
uguggaggacccgcaccg

SEQ ID NO: 426330 - RNA, 18 nt, Human
uuacgcacccugacugau

SEQ ID NO: 426331 - RNA, 18 nt, Human
uuaguagaaaugggguuu

SEQ ID NO: 426332 - RNA, 22 nt, Human
uuaguagaaaugggguuucgcc

SEQ ID NO: 426333 - RNA, 24 nt, Human
uuaguagaaaugggguuucgccau

SEQ ID NO: 426334 - RNA, 23 nt, Human
uucaaaacuccuuaaauggaucu

SEQ ID NO: 426335 - RNA, 23 nt, Human
uucaaaugauucuugugccucag

SEQ ID NO: 426336 - RNA, 22 nt, Human
uucauucucaccucacaguggc

SEQ ID NO: 426337 - RNA, 19 nt, Human
uuccagaaggucugauggg

SEQ ID NO: 426338 - RNA, 21 nt, Human
uucugugagcacagaguuggg

SEQ ID NO: 426339 - RNA, 19 nt, Human
uuggaggguggguggacaa

SEQ ID NO: 426340 - RNA, 23 nt, Human
uuggaggguggguggacaaaugg

SEQ ID NO: 426341 - RNA, 21 nt, Human
uuggucccauaagaauuauag

SEQ ID NO: 426342 - RNA, 23 nt, Human
uuguauuuuuaguagaaaugggg

SEQ ID NO: 426343 - RNA, 22 nt, Human
uugugcaguaucuaggaaaugg

SEQ ID NO: 426344 - RNA, 21 nt, Human
uuucgccauguuggccaggcu

SEQ ID NO: 426345 - RNA, 18 nt, Human
uuugaaaaagcagccgag

SEQ ID NO: 426346 - RNA, 22 nt, Human
uuuguggucuugauagaguugg

SEQ ID NO: 426347 - RNA, 24 nt, Human
uuuuuaguagaaaugggguuucgc

SEQ ID NO: 426348 - RNA, 18 nt, Human
uuuuuuguauuuuuagua

SEQ ID NO: 426349 - RNA, 19 nt, Human
uuuuuuuuuugagucagag

SEQ ID NO: 426350 - RNA, 22 nt, Human
aaaaagaaauccagaauuuugg

SEQ ID NO: 426351 - RNA, 22 nt, Human
aaaacaggagggauaaagagga

SEQ ID NO: 426352 - RNA, 22 nt, Human
aaaauaaaaaagaaauccagaa

SEQ ID NO: 426353 - RNA, 18 nt, Human
aaagacaggaaaagagag

SEQ ID NO: 426354 - RNA, 27 nt, Human
aacaaggagggcagggugugggagaga

SEQ ID NO: 426355 - RNA, 18 nt, Human
aagagagagggaaugagg

SEQ ID NO: 426356 - RNA, 19 nt, Human
aauccagaauuuuggaaau

SEQ ID NO: 426357 - RNA, 21 nt, Human
acacaacuucuucagcaagug

SEQ ID NO: 426358 - RNA, 28 nt, Human
accgggcuuugucucccccauucugcug

SEQ ID NO: 426359 - RNA, 19 nt, Human
agagaagagacuguggggu

SEQ ID NO: 426360 - RNA, 24 nt, Human
agagaagagacugugggguuugga

SEQ ID NO: 426361 - RNA, 20 nt, Human
agauaggaugagguuagggg

SEQ ID NO: 426362 - RNA, 22 nt, Human
agauaggaugagguuagggggu

SEQ ID NO: 426363 - RNA, 21 nt, Human
agauggugaaaggagagaaug

SEQ ID NO: 426364 - RNA, 25 nt, Human
aggaaaaaggaacucacuauacaaa

SEQ ID NO: 426365 - RNA, 25 nt, Human
aggaaaaaggaacucacuauacaaa

SEQ ID NO: 426366 - RNA, 23 nt, Human
aggaagaaaacucaaagugagaa

SEQ ID NO: 426367 - RNA, 21 nt, Human
aggaaggaaaaaggaacucac

SEQ ID NO: 426368 - RNA, 18 nt, Human
aggcaggggcaacaggga

SEQ ID NO: 426369 - RNA, 21 nt, Human
aggcaggggcaacagggaugc

SEQ ID NO: 426370 - RNA, 18 nt, Human
agggggagaggagagaug

SEQ ID NO: 426371 - RNA, 20 nt, Human
agguauggggugggggcggc

SEQ ID NO: 426372 - RNA, 20 nt, Human
aggugguacuagggggaguu

SEQ ID NO: 426373 - RNA, 23 nt, Human
agguugugaauuaugccaaguga

SEQ ID NO: 426374 - RNA, 21 nt, Human
agugccuaucuaucuucaugc

SEQ ID NO: 426375 - RNA, 21 nt, Human
aguguuguccugccuccuggg

SEQ ID NO: 426376 - RNA, 18 nt, Human
aucccagucucaguguug

SEQ ID NO: 426377 - RNA, 18 nt, Human
augguagaucaagguaug

SEQ ID NO: 426378 - RNA, 22 nt, Human
caacuucuucagcaaguggacu

SEQ ID NO: 426379 - RNA, 19 nt, Human
caccacuugggagaugguc

SEQ ID NO: 426380 - RNA, 21 nt, Human
caccucagacagcugaaacaa

SEQ ID NO: 426381 - RNA, 19 nt, Human
cacuauacaaauauaggaa

SEQ ID NO: 426382 - RNA, 25 nt, Human
cacuauacaaauauaggaagaaaac

SEQ ID NO: 426383 - RNA, 19 nt, Human
cagcgcccagagacgcagg

SEQ ID NO: 426384 - RNA, 21 nt, Human
cagcgcccagagacgcagggg

SEQ ID NO: 426385 - RNA, 21 nt, Human
cagcugaaacaaggagggcag

SEQ ID NO: 426386 - RNA, 19 nt, Human
caggauuuugucacucugg

SEQ ID NO: 426387 - RNA, 19 nt, Human
cagggugugggagagaaga

SEQ ID NO: 426388 - RNA, 20 nt, Human
caguaaaucugggcaggcag

SEQ ID NO: 426389 - RNA, 20 nt, Human
caugccuccaaaggacacca

SEQ ID NO: 426390 - RNA, 21 nt, Human
ccccuuccuuuuaacuuccca

SEQ ID NO: 426391 - RNA, 21 nt, Human
ccgcgcuccagcgcccagaga

SEQ ID NO: 426392 - RNA, 25 nt, Human
ccgggcuuugucucccccauucugc

SEQ ID NO: 426393 - RNA, 21 nt, Human
ccuccaaaggacaccacucac

SEQ ID NO: 426394 - RNA, 22 nt, Human
ccuccaaaggacaccacucacu

SEQ ID NO: 426395 - RNA, 19 nt, Human
cgccgcgcuccagcgccca

SEQ ID NO: 426396 - RNA, 23 nt, Human
cucaguguuguccugccuccugg

SEQ ID NO: 426397 - RNA, 18 nt, Human
cuucggaaucuugggcuu

SEQ ID NO: 426398 - RNA, 26 nt, Human
gaaauucuuccagagaaaugacacua

SEQ ID NO: 426399 - RNA, 21 nt, Human
gaauuucugaucucugguguu

SEQ ID NO: 426400 - RNA, 22 nt, Human
gaccgggcuuugucucccccau

SEQ ID NO: 426401 - RNA, 21 nt, Human
gagaauggggacagcauggaa

SEQ ID NO: 426402 - RNA, 24 nt, Human
gagagaauggggacagcauggaaa

SEQ ID NO: 426403 - RNA, 22 nt, Human
gagaugaaggagggggagagga

SEQ ID NO: 426404 - RNA, 22 nt, Human
gaggcaccucagacagcugaaa

SEQ ID NO: 426405 - RNA, 24 nt, Human
gagggaaugagggagaaaaaggga

SEQ ID NO: 426406 - RNA, 23 nt, Human
gauaggaugagguuaggggguga

SEQ ID NO: 426407 - RNA, 18 nt, Human
gcuuccuuugcgccuuuc

SEQ ID NO: 426408 - RNA, 19 nt, Human
ggaguugucugucuucuuc

SEQ ID NO: 426409 - RNA, 21 nt, Human
ggaugguagaucaagguaugg

SEQ ID NO: 426410 - RNA, 22 nt, Human
gggaaugagggagaaaaaggga

SEQ ID NO: 426411 - RNA, 21 nt, Human
gggauaaaagacaggaaaaga

SEQ ID NO: 426412 - RNA, 21 nt, Human
ggggugagaccgggcuuuguc

SEQ ID NO: 426413 - RNA, 18 nt, Human
gggguuuggauuggggaa

SEQ ID NO: 426414 - RNA, 23 nt, Human
guagaucaagguauggggugggg

SEQ ID NO: 426415 - RNA, 20 nt, Human
gucgccgcgcuccagcgccc

SEQ ID NO: 426416 - RNA, 26 nt, Human
uaaaaaagaaauccagaauuuuggaa

SEQ ID NO: 426417 - RNA, 23 nt, Human
uaagagaggcccugcgaggcacc

SEQ ID NO: 426418 - RNA, 21 nt, Human
uaagaugguccuggacacucc

SEQ ID NO: 426419 - RNA, 23 nt, Human
uaagaugguccuggacacuccaa

SEQ ID NO: 426420 - RNA, 18 nt, Human
uagcuuuucuuacuccua

SEQ ID NO: 426421 - RNA, 23 nt, Human
uagggggugagaccgggcuuugu

SEQ ID NO: 426422 - RNA, 21 nt, Human
uauaggaagaaaacucaaagu

SEQ ID NO: 426423 - RNA, 23 nt, Human
ucagacagcugaaacaaggaggg

SEQ ID NO: 426424 - RNA, 18 nt, Human
ucaguccguccguccgcc

SEQ ID NO: 426425 - RNA, 23 nt, Human
ucaguguuguccugccuccuggg

SEQ ID NO: 426426 - RNA, 22 nt, Human
uccaccaugccuccaaaggaca

SEQ ID NO: 426427 - RNA, 21 nt, Human
ucccaaguucagucaguucuc

SEQ ID NO: 426428 - RNA, 24 nt, Human
ucccaguagcuacugcucugagcu

SEQ ID NO: 426429 - RNA, 20 nt, Human
uccuuugcgccuuucaucca

SEQ ID NO: 426430 - RNA, 24 nt, Human
ucgacaaauggggucaguaaaucu

SEQ ID NO: 426431 - RNA, 18 nt, Human
ucgccgcgcuccagcgcc

SEQ ID NO: 426432 - RNA, 18 nt, Human
ucuucggaaucuugggcu

SEQ ID NO: 426433 - RNA, 18 nt, Human
ugaaaggagagaaugggg

SEQ ID NO: 426434 - RNA, 21 nt, Human
ugaaaggagagaauggggaca

SEQ ID NO: 426435 - RNA, 23 nt, Human
ugaaaggagagaauggggacagc

SEQ ID NO: 426436 - RNA, 24 nt, Human
ugaaauacuccaaaauaaaaaaga

SEQ ID NO: 426437 - RNA, 22 nt, Human
ugagaacaugcguauuuugauu

SEQ ID NO: 426438 - RNA, 20 nt, Human
ugagcucaguaaaggccuug

SEQ ID NO: 426439 - RNA, 22 nt, Human
ugagcucaguaaaggccuuggg

SEQ ID NO: 426440 - RNA, 21 nt, Human
ugaguuuggggagggaggaga

SEQ ID NO: 426441 - RNA, 21 nt, Human
ugcccuggggcacacgggcac

SEQ ID NO: 426442 - RNA, 20 nt, Human
ugcuggacaauaauguaaaa

SEQ ID NO: 426443 - RNA, 21 nt, Human
uggaagagucugcaggaguca

SEQ ID NO: 426444 - RNA, 25 nt, Human
ugggauaaaagacaggaaaagagag

SEQ ID NO: 426445 - RNA, 24 nt, Human
ugggcaggcaggggcaacagggau

SEQ ID NO: 426446 - RNA, 19 nt, Human
uggggaagaggauggaugg

SEQ ID NO: 426447 - RNA, 25 nt, Human
uggggagggaggagagaugaaggag

SEQ ID NO: 426448 - RNA, 28 nt, Human
uggggagggaggagagaugaaggagggg

SEQ ID NO: 426449 - RNA, 22 nt, Human
uggggcacacgggcacagggac

SEQ ID NO: 426450 - RNA, 25 nt, Human
uggggcacacgggcacagggacagg

SEQ ID NO: 426451 - RNA, 21 nt, Human
uggggccaugucgacaaaugg

SEQ ID NO: 426452 - RNA, 23 nt, Human
ugggugagaacaugcguauuuug

SEQ ID NO: 426453 - RNA, 19 nt, Human
ugucauuuuauuucugggu

SEQ ID NO: 426454 - RNA, 19 nt, Human
uuaacucuaugccacuguc

SEQ ID NO: 426455 - RNA, 19 nt, Human
uuuacuguuucauggucca

SEQ ID NO: 426456 - RNA, 24 nt, Human
uuucccaaguucagucaguucucu

SEQ ID NO: 426457 - RNA, 20 nt, Human
uuugaauuuuaaauauuaac

SEQ ID NO: 426458 - RNA, 22 nt, Human
aaaacauauacaccagaccuuc

SEQ ID NO: 426459 - RNA, 20 nt, Human
aaacagaaaaaacaaccaca

SEQ ID NO: 426460 - RNA, 20 nt, Human
aaaggacugaagugaaaaag

SEQ ID NO: 426461 - RNA, 21 nt, Human
aaaugcaagaaacuuuaaaaa

SEQ ID NO: 426462 - RNA, 20 nt, Human
aacacggugaaacugcgucu

SEQ ID NO: 426463 - RNA, 21 nt, Human
aacacggugaaacugcgucuc

SEQ ID NO: 426464 - RNA, 24 nt, Human
aacuuuaaaaaacuggaauggaau

SEQ ID NO: 426465 - RNA, 25 nt, Human
aagaaaacaaaaaaaagugaaugua

SEQ ID NO: 426466 - RNA, 18 nt, Human
aagaaacuuuaaaaaacu

SEQ ID NO: 426467 - RNA, 23 nt, Human
aagaaaggaaaugauuuauaaau

SEQ ID NO: 426468 - RNA, 18 nt, Human
aaugacagcacucuucuu

SEQ ID NO: 426469 - RNA, 19 nt, Human
acacggugaaacugcgucu

SEQ ID NO: 426470 - RNA, 23 nt, Human
accaugagcaaaagugcauucaa

SEQ ID NO: 426471 - RNA, 23 nt, Human
accuguagucccagcuacucggg

SEQ ID NO: 426472 - RNA, 24 nt, Human
acugcacuccagccugggcggcag

SEQ ID NO: 426473 - RNA, 26 nt, Human
acugcacuccagccugggcggcagag

SEQ ID NO: 426474 - RNA, 24 nt, Human
acugcgucucuacuaaaaauacaa

SEQ ID NO: 426475 - RNA, 20 nt, Human
agaaaaucuacacaaguucu

SEQ ID NO: 426476 - RNA, 18 nt, Human
agacacucaaaccacuaa

SEQ ID NO: 426477 - RNA, 21 nt, Human
agacacugaagacgaaaagcu

SEQ ID NO: 426478 - RNA, 24 nt, Human
agagcuugcagugagccgagaucg

SEQ ID NO: 426479 - RNA, 24 nt, Human
agcacuuugggaggccgaggcggg

SEQ ID NO: 426480 - RNA, 20 nt, Human
agccaggcgugguggugggc

SEQ ID NO: 426481 - RNA, 24 nt, Human
agccugggcggcagagcgagacuc

SEQ ID NO: 426482 - RNA, 18 nt, Human
aggacugaagugaaaaag

SEQ ID NO: 426483 - RNA, 21 nt, Human
aggcagagcuugcagugagcc

SEQ ID NO: 426484 - RNA, 24 nt, Human
aggcagagcuugcagugagccgag

SEQ ID NO: 426485 - RNA, 18 nt, Human
aggcaggagaauggugug

SEQ ID NO: 426486 - RNA, 22 nt, Human
aggcaggagaauggugugaacc

SEQ ID NO: 426487 - RNA, 24 nt, Human
aggcaggagaauggugugaaccug

SEQ ID NO: 426488 - RNA, 23 nt, Human
aggccgaggcgggcagaucacaa

SEQ ID NO: 426489 - RNA, 24 nt, Human
aggcgggcagaucacaaggucagg

SEQ ID NO: 426490 - RNA, 24 nt, Human
aggcgugguggugggcaccuguag

SEQ ID NO: 426491 - RNA, 19 nt, Human
aggcugaggcaggagaaug

SEQ ID NO: 426492 - RNA, 23 nt, Human
aguaaagaagauuuucuucuuuu

SEQ ID NO: 426493 - RNA, 20 nt, Human
auaaagcccuuaaaaaaucu

SEQ ID NO: 426494 - RNA, 24 nt, Human
aucgcgccacugcacuccagccug

SEQ ID NO: 426495 - RNA, 22 nt, Human
caaaagaaagcauauauuaaga

SEQ ID NO: 426496 - RNA, 18 nt, Human
caaauuccacuucugugg

SEQ ID NO: 426497 - RNA, 18 nt, Human
caagucccugaucugguc

SEQ ID NO: 426498 - RNA, 21 nt, Human
caagucccugaucuggucaua

SEQ ID NO: 426499 - RNA, 18 nt, Human
caaugcaaccucauacaa

SEQ ID NO: 426500 - RNA, 23 nt, Human
caccuguagucccagcuacucgg

SEQ ID NO: 426501 - RNA, 24 nt, Human
caccuguagucccagcuacucggg

SEQ ID NO: 426502 - RNA, 24 nt, Human
cacgccuguaaucccagcacuuug

SEQ ID NO: 426503 - RNA, 23 nt, Human
cacuccagccugggcggcagagc

SEQ ID NO: 426504 - RNA, 24 nt, Human
cacuccagccugggcggcagagcg

SEQ ID NO: 426505 - RNA, 19 nt, Human
cacugcacuccagccuggg

SEQ ID NO: 426506 - RNA, 22 nt, Human
cacugcacuccagccugggcgg

SEQ ID NO: 426507 - RNA, 23 nt, Human
cacugcacuccagccugggcggc

SEQ ID NO: 426508 - RNA, 24 nt, Human
cacugcacuccagccugggcggca

SEQ ID NO: 426509 - RNA, 24 nt, Human
cagaaccacugccaacuugcauga

SEQ ID NO: 426510 - RNA, 19 nt, Human
cagagcgagacuccgucuc

SEQ ID NO: 426511 - RNA, 23 nt, Human
cagagcgagacuccgucucaaaa

SEQ ID NO: 426512 - RNA, 22 nt, Human
cagcacuuugggaggccgaggc

SEQ ID NO: 426513 - RNA, 24 nt, Human
cagcacuuugggaggccgaggcgg

SEQ ID NO: 426514 - RNA, 24 nt, Human
cagcuacucgggaggcugaggcag

SEQ ID NO: 426515 - RNA, 22 nt, Human
cauaaaaaccauaucccacugc

SEQ ID NO: 426516 - RNA, 20 nt, Human
ccacugcacuccagccuggg

SEQ ID NO: 426517 - RNA, 21 nt, Human
ccacugcacuccagccugggc

SEQ ID NO: 426518 - RNA, 22 nt, Human
ccacugcacuccagccugggcg

SEQ ID NO: 426519 - RNA, 23 nt, Human
ccacugcacuccagccugggcgg

SEQ ID NO: 426520 - RNA, 24 nt, Human
ccacugcacuccagccugggcggc

SEQ ID NO: 426521 - RNA, 21 nt, Human
ccaugacaucaacauuaaaca

SEQ ID NO: 426522 - RNA, 25 nt, Human
cccuuaaaaaaucucaugucacaag

SEQ ID NO: 426523 - RNA, 23 nt, Human
ccgucucaaaaaagaaaacaaaa

SEQ ID NO: 426524 - RNA, 20 nt, Human
ccuggcuaacacggugaaac

SEQ ID NO: 426525 - RNA, 22 nt, Human
ccuggcuaacacggugaaacug

SEQ ID NO: 426526 - RNA, 22 nt, Human
ccugggcggcagagcgagacuc

SEQ ID NO: 426527 - RNA, 21 nt, Human
ccuguagucccagcuacucgg

SEQ ID NO: 426528 - RNA, 24 nt, Human
cgagaccauccuggcuaacacggu

SEQ ID NO: 426529 - RNA, 24 nt, Human
cgagaucgcgccacugcacuccag

SEQ ID NO: 426530 - RNA, 26 nt, Human
cgccacugcacuccagccugggcggc

SEQ ID NO: 426531 - RNA, 24 nt, Human
cgccuguaaucccagcacuuuggg

SEQ ID NO: 426532 - RNA, 22 nt, Human
cgggcagaucacaaggucagga

SEQ ID NO: 426533 - RNA, 22 nt, Human
cuaaugaauaccaucaacuuuu

SEQ ID NO: 426534 - RNA, 24 nt, Human
cuagccaggcgugguggugggcac

SEQ ID NO: 426535 - RNA, 22 nt, Human
cucacgccuguaaucccagcac

SEQ ID NO: 426536 - RNA, 24 nt, Human
cucacgccuguaaucccagcacuu

SEQ ID NO: 426537 - RNA, 19 nt, Human
cucugagugccagcaaagc

SEQ ID NO: 426538 - RNA, 19 nt, Human
cucuguucaucuauauuca

SEQ ID NO: 426539 - RNA, 18 nt, Human
cuggcuaacacggugaaa

SEQ ID NO: 426540 - RNA, 22 nt, Human
cuuccacauuaagacacugaag

SEQ ID NO: 426541 - RNA, 21 nt, Human
cuugcagugagccgagaucgc

SEQ ID NO: 426542 - RNA, 22 nt, Human
cuugcaugaaguccaucuucac

SEQ ID NO: 426543 - RNA, 18 nt, Human
gaaaaaccuggcccaugu

SEQ ID NO: 426544 - RNA, 24 nt, Human
gaaaauaucuccaaauuuacaaag

SEQ ID NO: 426545 - RNA, 20 nt, Human
gaaccugggaggcagagcuu

SEQ ID NO: 426546 - RNA, 24 nt, Human
gaggcgggcagaucacaaggucag

SEQ ID NO: 426547 - RNA, 18 nt, Human
gaucaaaacauuuccccu

SEQ ID NO: 426548 - RNA, 24 nt, Human
gcacuccagccugggcggcagagc

SEQ ID NO: 426549 - RNA, 22 nt, Human
gccacugcacuccagccugggc

SEQ ID NO: 426550 - RNA, 24 nt, Human
gccacugcacuccagccugggcgg

SEQ ID NO: 426551 - RNA, 22 nt, Human
gccagcaaagccauucugucac

SEQ ID NO: 426552 - RNA, 20 nt, Human
gccgagaucgcgccacugca

SEQ ID NO: 426553 - RNA, 24 nt, Human
gcuaacacggugaaacugcgucuc

SEQ ID NO: 426554 - RNA, 20 nt, Human
gcuguuuuugccaacuuccu

SEQ ID NO: 426555 - RNA, 19 nt, Human
ggcaccuguagucccagcu

SEQ ID NO: 426556 - RNA, 24 nt, Human
ggcagagcgagacuccgucucaaa

SEQ ID NO: 426557 - RNA, 21 nt, Human
gggaaaaaaagaaaggaaaga

SEQ ID NO: 426558 - RNA, 20 nt, Human
gggcaccuguagucccagcu

SEQ ID NO: 426559 - RNA, 24 nt, Human
gggcagaucacaaggucaggagau

SEQ ID NO: 426560 - RNA, 24 nt, Human
gggcgcgguggcucacgccuguaa

SEQ ID NO: 426561 - RNA, 23 nt, Human
gguggcucacgccuguaauccca

SEQ ID NO: 426562 - RNA, 24 nt, Human
gguggcucacgccuguaaucccag

SEQ ID NO: 426563 - RNA, 24 nt, Human
gguggugggcaccuguagucccag

SEQ ID NO: 426564 - RNA, 22 nt, Human
guaaacagaaaaaacaaccaca

SEQ ID NO: 426565 - RNA, 23 nt, Human
gucaucaguaucuuagcucuauu

SEQ ID NO: 426566 - RNA, 18 nt, Human
gugaaaaaguucuuauuc

SEQ ID NO: 426567 - RNA, 21 nt, Human
gugcauucaagucccugaucu

SEQ ID NO: 426568 - RNA, 26 nt, Human
uaaaaaaucaaugcaaccucauacaa

SEQ ID NO: 426569 - RNA, 19 nt, Human
uaaaaaccauaucccacug

SEQ ID NO: 426570 - RNA, 22 nt, Human
uaaaaaccauaucccacugcaa

SEQ ID NO: 426571 - RNA, 22 nt, Human
uaacacggugaaacugcgucuc

SEQ ID NO: 426572 - RNA, 24 nt, Human
uaacacggugaaacugcgucucua

SEQ ID NO: 426573 - RNA, 20 nt, Human
uaacuuguaaaacuuucaca

SEQ ID NO: 426574 - RNA, 22 nt, Human
uaccagaaccacugccaacuug

SEQ ID NO: 426575 - RNA, 21 nt, Human
uacguaaacagaaaaaacaac

SEQ ID NO: 426576 - RNA, 23 nt, Human
uaggcugggcgcgguggcucacg

SEQ ID NO: 426577 - RNA, 18 nt, Human
uaguaccagaaccacugc

SEQ ID NO: 426578 - RNA, 19 nt, Human
uauacgccauggcacagaa

SEQ ID NO: 426579 - RNA, 20 nt, Human
uauuuuguauguuucacuuu

SEQ ID NO: 426580 - RNA, 22 nt, Human
ucaaaaaagaaaacaaaaaaaa

SEQ ID NO: 426581 - RNA, 18 nt, Human
ucacaaggucaggagauc

SEQ ID NO: 426582 - RNA, 24 nt, Human
ucacaaggucaggagaucgagacc

SEQ ID NO: 426583 - RNA, 20 nt, Human
uccacauuaagacacugaag

SEQ ID NO: 426584 - RNA, 23 nt, Human
uccagccugggcggcagagcgag

SEQ ID NO: 426585 - RNA, 24 nt, Human
uccagccugggcggcagagcgaga

SEQ ID NO: 426586 - RNA, 22 nt, Human
uccaugaacaugaauauuaaug

SEQ ID NO: 426587 - RNA, 22 nt, Human
ucccacugcaaugaaugugaag

SEQ ID NO: 426588 - RNA, 23 nt, Human
ucgcgccacugcacuccagccug

SEQ ID NO: 426589 - RNA, 20 nt, Human
ucuauuuuguuuggacccug

SEQ ID NO: 426590 - RNA, 24 nt, Human
ucucuacuaaaaauacaaaaaacu

SEQ ID NO: 426591 - RNA, 19 nt, Human
ucucucaaguuuuaucugu

SEQ ID NO: 426592 - RNA, 18 nt, Human
ucuucagaaaaggacuga

SEQ ID NO: 426593 - RNA, 19 nt, Human
ucuuugagcaauucugacu

SEQ ID NO: 426594 - RNA, 22 nt, Human
ugagccgagaucgcgccacugc

SEQ ID NO: 426595 - RNA, 23 nt, Human
ugaggcaggagaauggugugaac

SEQ ID NO: 426596 - RNA, 24 nt, Human
ugaggcaggagaauggugugaacc

SEQ ID NO: 426597 - RNA, 25 nt, Human
ugaggcaggagaauggugugaaccu

SEQ ID NO: 426598 - RNA, 19 nt, Human
ugcuagacacucaaaccac

SEQ ID NO: 426599 - RNA, 24 nt, Human
uggcucacgccuguaaucccagca

SEQ ID NO: 426600 - RNA, 20 nt, Human
ugggaggccgaggcgggcag

SEQ ID NO: 426601 - RNA, 24 nt, Human
ugggaggccgaggcgggcagauca

SEQ ID NO: 426602 - RNA, 22 nt, Human
ugguauagcuuuuuaucucuca

SEQ ID NO: 426603 - RNA, 24 nt, Human
ugguggugggcaccuguaguccca

SEQ ID NO: 426604 - RNA, 18 nt, Human
uguuuauauuccuuuuga

SEQ ID NO: 426605 - RNA, 19 nt, Human
uguuuggacccugaaauac

SEQ ID NO: 426606 - RNA, 22 nt, Human
uguuuuacauaaaaaccauauc

SEQ ID NO: 426607 - RNA, 25 nt, Human
uuaagacacugaagacgaaaagcug

SEQ ID NO: 426608 - RNA, 21 nt, Human
uuacguaaacagaaaaaacaa

SEQ ID NO: 426609 - RNA, 22 nt, Human
uucagaaaaggacugaagugaa

SEQ ID NO: 426610 - RNA, 22 nt, Human
uucaucauugguacauuagagu

SEQ ID NO: 426611 - RNA, 23 nt, Human
uucauuuuauucaucaauuuuuc

SEQ ID NO: 426612 - RNA, 22 nt, Human
uugcagugagccgagaucgcgc

SEQ ID NO: 426613 - RNA, 21 nt, Human
uuggacccugaaauacgcuga

SEQ ID NO: 426614 - RNA, 25 nt, Human
uugggaggccgaggcgggcagauca

SEQ ID NO: 426615 - RNA, 21 nt, Human
uuuaaaaugcugggucuuacu

SEQ ID NO: 426616 - RNA, 19 nt, Human
uuuaggguaaaaacugucc

SEQ ID NO: 426617 - RNA, 22 nt, Human
uuuuuaguaccagaaccacugc

SEQ ID NO: 426618 - RNA, 22 nt, Human
aacaaagacccuuccgagcgaa

SEQ ID NO: 426619 - RNA, 18 nt, Human
acaaagcacgagaaacac

SEQ ID NO: 426620 - RNA, 30 nt, Human
aguggcugcagcggcggcggcggcggcgac

SEQ ID NO: 426621 - RNA, 27 nt, Human
aucggcggcggcgguggcgguagcucc

SEQ ID NO: 426622 - RNA, 20 nt, Human
cagugcucuuccugcuucuc

SEQ ID NO: 426623 - RNA, 21 nt, Human
ccgagcgagaugaccucuucc

SEQ ID NO: 426624 - RNA, 19 nt, Human
ccggaaucggcggcggcgg

SEQ ID NO: 426625 - RNA, 20 nt, Human
ccucuuccuuccuaagccca

SEQ ID NO: 426626 - RNA, 18 nt, Human
cggcggcggcgguggcgg

SEQ ID NO: 426627 - RNA, 18 nt, Human
cggcggcggcgguggcgg

SEQ ID NO: 426628 - RNA, 24 nt, Human
cuauccacagccgaaugggcaaaa

SEQ ID NO: 426629 - RNA, 19 nt, Human
cuccggaaucggcggcggc

SEQ ID NO: 426630 - RNA, 21 nt, Human
cugcagcggcggcggcggcuu

SEQ ID NO: 426631 - RNA, 23 nt, Human
gaccucuuccuuccuaagcccac

SEQ ID NO: 426632 - RNA, 20 nt, Human
gcagcggcggcggcggcggc

SEQ ID NO: 426633 - RNA, 22 nt, Human
gcggcggcgacuaccccggcuc

SEQ ID NO: 426634 - RNA, 25 nt, Human
gcggcggcggcggcggcgacuaccc

SEQ ID NO: 426635 - RNA, 22 nt, Human
gcggcgguggcgguagcuccac

SEQ ID NO: 426636 - RNA, 19 nt, Human
ggaacaaagacccuuccga

SEQ ID NO: 426637 - RNA, 23 nt, Human
ggaaucggcggcggcgguggcgg

SEQ ID NO: 426638 - RNA, 20 nt, Human
ggcggcgacuaccccggcuc

SEQ ID NO: 426639 - RNA, 20 nt, Human
ggcggcggcagcggugccug

SEQ ID NO: 426640 - RNA, 18 nt, Human
ggcgguggcgguagcucc

SEQ ID NO: 426641 - RNA, 23 nt, Human
ggcugcagcggcggcggcggcgg

SEQ ID NO: 426642 - RNA, 18 nt, Human
uaccccggcuccggaauc

SEQ ID NO: 426643 - RNA, 23 nt, Human
uagcggcccaaaucucuggagac

SEQ ID NO: 426644 - RNA, 24 nt, Human
uauguugaggguacagagugacac

SEQ ID NO: 426645 - RNA, 19 nt, Human
ucggcggcggcgguggcgg

SEQ ID NO: 426646 - RNA, 22 nt, Human
ucucuggagacucugccguggg

SEQ ID NO: 426647 - RNA, 22 nt, Human
ugaacagaucacaaagcacgag

SEQ ID NO: 426648 - RNA, 20 nt, Human
ugaacagaucacaaagcacu

SEQ ID NO: 426649 - RNA, 26 nt, Human
ugcagcggcggcggcggcggcgacuu

SEQ ID NO: 426650 - RNA, 19 nt, Human
ugccgugggagggcugcag

SEQ ID NO: 426651 - RNA, 21 nt, Human
ugccugcaguggcugcagcgg

SEQ ID NO: 426652 - RNA, 24 nt, Human
uggagacucugccgugggagggcu

SEQ ID NO: 426653 - RNA, 18 nt, Human
uggcugcagcggcggcgg

SEQ ID NO: 426654 - RNA, 18 nt, Human
uuccuaagcccacuacuc

SEQ ID NO: 426655 - RNA, 25 nt, Human
uuuuuuuuuuuuuuaucgcacaagg

SEQ ID NO: 426656 - RNA, 27 nt, Human
uuuuuuuuuuuuuuuaucgcacaaggg

SEQ ID NO: 426657 - RNA, 21 nt, Human
aaaaaaaaaaaaaaaaccaac

SEQ ID NO: 426658 - RNA, 30 nt, Human
aaaaaaaaaaaaaaccaacagggcaggaag

SEQ ID NO: 426659 - RNA, 22 nt, Human
aaaaaaaaaaaaccaacagggc

SEQ ID NO: 426660 - RNA, 23 nt, Human
aaaaaaaccaacagggcaggaac

SEQ ID NO: 426661 - RNA, 22 nt, Human
aaaaccaacagggcaggaaccu

SEQ ID NO: 426662 - RNA, 22 nt, Human
aaagucagauuuggugguucuc

SEQ ID NO: 426663 - RNA, 21 nt, Human
aaauccacagaaauucacucu

SEQ ID NO: 426664 - RNA, 21 nt, Human
aacauuuuuuacagcaaaacc

SEQ ID NO: 426665 - RNA, 21 nt, Human
aaccaacagggcaggaaccua

SEQ ID NO: 426666 - RNA, 20 nt, Human
aaccaccuuuaaccaucuca

SEQ ID NO: 426667 - RNA, 23 nt, Human
aaccaucucaagcuaacacccaa

SEQ ID NO: 426668 - RNA, 22 nt, Human
aagaauugaacaggcaugcagg

SEQ ID NO: 426669 - RNA, 22 nt, Human
aagggugggauggggaggaggg

SEQ ID NO: 426670 - RNA, 19 nt, Human
acaacgaagucccucccca

SEQ ID NO: 426671 - RNA, 24 nt, Human
acaacgaagucccuccccaaacca

SEQ ID NO: 426672 - RNA, 24 nt, Human
acugguauaaaacacaguuuaaac

SEQ ID NO: 426673 - RNA, 25 nt, Human
acuuuugaaaacuguuuaaaaaaaa

SEQ ID NO: 426674 - RNA, 21 nt, Human
agaccaaauguaaaagucaga

SEQ ID NO: 426675 - RNA, 19 nt, Human
aggagaagaaacaaaagaa

SEQ ID NO: 426676 - RNA, 22 nt, Human
aggaggggaggagugaggggaa

SEQ ID NO: 426677 - RNA, 20 nt, Human
agguagggggagggggaagg

SEQ ID NO: 426678 - RNA, 18 nt, Human
auggggaggagggggugg

SEQ ID NO: 426679 - RNA, 20 nt, Human
auggggaggagggggugguc

SEQ ID NO: 426680 - RNA, 20 nt, Human
caaaagagguugagcgagcg

SEQ ID NO: 426681 - RNA, 21 nt, Human
caaguuacacauacugaacaa

SEQ ID NO: 426682 - RNA, 22 nt, Human
caccuucaacgcuaaccugcuu

SEQ ID NO: 426683 - RNA, 28 nt, Human
cacucuugccuuuaagaacuuuugaaaa

SEQ ID NO: 426684 - RNA, 22 nt, Human
cagcaaaaccauuacaacgaag

SEQ ID NO: 426685 - RNA, 24 nt, Human
cauaccaccuucaacggggaagcc

SEQ ID NO: 426686 - RNA, 22 nt, Human
caugcaggcuuuuccauaccac

SEQ ID NO: 426687 - RNA, 18 nt, Human
cauuucagcggaguugga

SEQ ID NO: 426688 - RNA, 21 nt, Human
ccaaaccaccuuuaaccaucu

SEQ ID NO: 426689 - RNA, 24 nt, Human
gaacaggcaugcaggcuuuuccau

SEQ ID NO: 426690 - RNA, 22 nt, Human
gaagucccuccccaaaccaccu

SEQ ID NO: 426691 - RNA, 22 nt, Human
gagaagaaacaaaagaauugaa

SEQ ID NO: 426692 - RNA, 19 nt, Human
gagcgaaggaggggaggaa

SEQ ID NO: 426693 - RNA, 21 nt, Human
gaggggaaggagguaggggga

SEQ ID NO: 426694 - RNA, 24 nt, Human
gaggggaggagugaggggaaggag

SEQ ID NO: 426695 - RNA, 18 nt, Human
gagguagggggaggggga

SEQ ID NO: 426696 - RNA, 22 nt, Human
ggaaccuaaauucugagaccaa

SEQ ID NO: 426697 - RNA, 18 nt, Human
ggaaggagguagggggag

SEQ ID NO: 426698 - RNA, 19 nt, Human
ggaaggagguagggggagg

SEQ ID NO: 426699 - RNA, 24 nt, Human
ggagaguaaaguaggcaagaauga

SEQ ID NO: 426700 - RNA, 18 nt, Human
ggauggggaggagggggu

SEQ ID NO: 426701 - RNA, 18 nt, Human
ggcagggucugcgcgacg

SEQ ID NO: 426702 - RNA, 22 nt, Human
gggaaggagaagaaacaaaaga

SEQ ID NO: 426703 - RNA, 20 nt, Human
gggaaggagguagggggagg

SEQ ID NO: 426704 - RNA, 18 nt, Human
gggaguuuccaaagggug

SEQ ID NO: 426705 - RNA, 18 nt, Human
gggauggggaggaggggg

SEQ ID NO: 426706 - RNA, 22 nt, Human
gggcaggaaccuaaauucugag

SEQ ID NO: 426707 - RNA, 23 nt, Human
ggggaaggagguagggggagggg

SEQ ID NO: 426708 - RNA, 19 nt, Human
gguggucagagaugguuuc

SEQ ID NO: 426709 - RNA, 27 nt, Human
gugaggggaaggagguagggggagggg

SEQ ID NO: 426710 - RNA, 28 nt, Human
guuuaaaaaaaaaaaaaaaaaaaaccaa

SEQ ID NO: 426711 - RNA, 18 nt, Human
uaaagaaccuaaaagcug

SEQ ID NO: 426712 - RNA, 25 nt, Human
uaaaguaggcaagaaugagcagcca

SEQ ID NO: 426713 - RNA, 20 nt, Human
uaaccaucucaagcuaacac

SEQ ID NO: 426714 - RNA, 24 nt, Human
uaaguuuaauguuaauuccaugcu

SEQ ID NO: 426715 - RNA, 22 nt, Human
uacacauacugaacaaaagagg

SEQ ID NO: 426716 - RNA, 18 nt, Human
uagggggagggggaagga

SEQ ID NO: 426717 - RNA, 21 nt, Human
ucacucuugccuuuaagaagg

SEQ ID NO: 426718 - RNA, 25 nt, Human
ucagugacaauggggaguuuccaaa

SEQ ID NO: 426719 - RNA, 20 nt, Human
uccaaagggugggaugggga

SEQ ID NO: 426720 - RNA, 18 nt, Human
uccccaaaccaccuuuaa

SEQ ID NO: 426721 - RNA, 19 nt, Human
ucuaauggcuuucaaaugu

SEQ ID NO: 426722 - RNA, 19 nt, Human
ucucucagccucucgcucc

SEQ ID NO: 426723 - RNA, 19 nt, Human
ucuggcacggagacgacac

SEQ ID NO: 426724 - RNA, 25 nt, Human
ugaaaacuguuuaaaaaaaaaaaaa

SEQ ID NO: 426725 - RNA, 31 nt, Human
ugaaaacuguuuaaaaaaaaaaaaaaaaaaa

SEQ ID NO: 426726 - RNA, 23 nt, Human
ugagcgagcgaaggaggggagga

SEQ ID NO: 426727 - RNA, 19 nt, Human
ugggauggggaggaggggg

SEQ ID NO: 426728 - RNA, 20 nt, Human
ugggauggggaggagggggu

SEQ ID NO: 426729 - RNA, 25 nt, Human
ugggauggggaggagggggugguca

SEQ ID NO: 426730 - RNA, 20 nt, Human
uggggaggagggggugguca

SEQ ID NO: 426731 - RNA, 24 nt, Human
uguuaccagcaccaugcuuuucag

SEQ ID NO: 426732 - RNA, 20 nt, Human
uuaaaaaaaaaaaaaaaaaa

SEQ ID NO: 426733 - RNA, 18 nt, Human
uuagaugcuugcaucacc

SEQ ID NO: 426734 - RNA, 18 nt, Human
uuccaaagggugggaugg

SEQ ID NO: 426735 - RNA, 24 nt, Human
aaaaaucccacagccaccugccga

SEQ ID NO: 426736 - RNA, 20 nt, Human
aaaaccaaccuggauaaggc

SEQ ID NO: 426737 - RNA, 23 nt, Human
aaaagcacaaaggcucauucaga

SEQ ID NO: 426738 - RNA, 21 nt, Human
aaaagcagccagagccaaagc

SEQ ID NO: 426739 - RNA, 19 nt, Human
aaacaaagaaaacaagugu

SEQ ID NO: 426740 - RNA, 22 nt, Human
aaacaaagaaacaaagaaaaca

SEQ ID NO: 426741 - RNA, 25 nt, Human
aaacaccagacauuaagauuaagcu

SEQ ID NO: 426742 - RNA, 20 nt, Human
aaacgccccagugcagagug

SEQ ID NO: 426743 - RNA, 26 nt, Human
aaagccccaccuacccugcccccccc

SEQ ID NO: 426744 - RNA, 22 nt, Human
aaaguacccaaaacgagagacg

SEQ ID NO: 426745 - RNA, 22 nt, Human
aaauggguggaaauagcaacgu

SEQ ID NO: 426746 - RNA, 22 nt, Human
aacaaauggguggaaauagcaa

SEQ ID NO: 426747 - RNA, 22 nt, Human
aaccauaaggaugaaugagacc

SEQ ID NO: 426748 - RNA, 18 nt, Human
aaccauucaagcugcuua

SEQ ID NO: 426749 - RNA, 21 nt, Human
aacugugcgauguuacagagc

SEQ ID NO: 426750 - RNA, 23 nt, Human
aagaaaaaacuaucucgagagga

SEQ ID NO: 426751 - RNA, 18 nt, Human
aagaaggaccaaaaaaaa

SEQ ID NO: 426752 - RNA, 18 nt, Human
aagaggaaagaaggacca

SEQ ID NO: 426753 - RNA, 23 nt, Human
aagcccaaacaacuagcaaagga

SEQ ID NO: 426754 - RNA, 22 nt, Human
aagugcauuucuuuaaaaauaa

SEQ ID NO: 426755 - RNA, 19 nt, Human
aauaaaacaaagaaacaaa

SEQ ID NO: 426756 - RNA, 24 nt, Human
aauuccuuagagaaacacggagcu

SEQ ID NO: 426757 - RNA, 23 nt, Human
acaaaauauauaacugcauguca

SEQ ID NO: 426758 - RNA, 18 nt, Human
acagaacuuacugaauga

SEQ ID NO: 426759 - RNA, 18 nt, Human
acagaccuucuccaaacg

SEQ ID NO: 426760 - RNA, 18 nt, Human
acaguuuuuuuaucuucc

SEQ ID NO: 426761 - RNA, 18 nt, Human
acccacagagcgagcagc

SEQ ID NO: 426762 - RNA, 21 nt, Human
acccgaaaugagaaugagggc

SEQ ID NO: 426763 - RNA, 24 nt, Human
acccugcccccccccucccccccc

SEQ ID NO: 426764 - RNA, 25 nt, Human
acccugcccccccccucccccccca

SEQ ID NO: 426765 - RNA, 21 nt, Human
acccuggaaaacaugcagagc

SEQ ID NO: 426766 - RNA, 25 nt, Human
accuacccugcccccccccuccccc

SEQ ID NO: 426767 - RNA, 23 nt, Human
accugaauuuucacacacugcac

SEQ ID NO: 426768 - RNA, 25 nt, Human
acuguuccaugucuguaggcuacac

SEQ ID NO: 426769 - RNA, 25 nt, Human
agaaaaaccauucaagcugcuuaaa

SEQ ID NO: 426770 - RNA, 21 nt, Human
agaaaagaaaaaccauucaag

SEQ ID NO: 426771 - RNA, 22 nt, Human
agaaggaggaggacacuggggc

SEQ ID NO: 426772 - RNA, 22 nt, Human
agaccuucuccaaacgccucuc

SEQ ID NO: 426773 - RNA, 21 nt, Human
agacgagagcguauguacaua

SEQ ID NO: 426774 - RNA, 19 nt, Human
agagacaguaucauaggcc

SEQ ID NO: 426775 - RNA, 20 nt, Human
agaggcgaucaaagacagga

SEQ ID NO: 426776 - RNA, 27 nt, Human
agcaaaaccaaccuggauaaggcugaa

SEQ ID NO: 426777 - RNA, 20 nt, Human
agccagagccaaagcugaaa

SEQ ID NO: 426778 - RNA, 20 nt, Human
agcucuuccuuuuggguuuu

SEQ ID NO: 426779 - RNA, 19 nt, Human
agcugcagcagcuucagaa

SEQ ID NO: 426780 - RNA, 19 nt, Human
aggcggcggcugcgcggag

SEQ ID NO: 426781 - RNA, 21 nt, Human
agggagcugcagcagcuucag

SEQ ID NO: 426782 - RNA, 24 nt, Human
agggcuuggagggcgcgacuggag

SEQ ID NO: 426783 - RNA, 24 nt, Human
aucccucccuuucccucccccacc

SEQ ID NO: 426784 - RNA, 20 nt, Human
aucuacagaacaguccagac

SEQ ID NO: 426785 - RNA, 23 nt, Human
caaaaaaaaaaaaaaucccacag

SEQ ID NO: 426786 - RNA, 20 nt, Human
caaaaagcacaaaggcucau

SEQ ID NO: 426787 - RNA, 19 nt, Human
caaaacgagagacgagagc

SEQ ID NO: 426788 - RNA, 19 nt, Human
caacuaaucagagacuucg

SEQ ID NO: 426789 - RNA, 21 nt, Human
cacacacugcaccacagaccu

SEQ ID NO: 426790 - RNA, 24 nt, Human
cacaccucuucuugccuaaauaaa

SEQ ID NO: 426791 - RNA, 19 nt, Human
cacacugcaccacagaccu

SEQ ID NO: 426792 - RNA, 23 nt, Human
caccuaugaaccaaaaaccugaa

SEQ ID NO: 426793 - RNA, 25 nt, Human
cacugcaccacagaccuucuccaaa

SEQ ID NO: 426794 - RNA, 23 nt, Human
cacugcauaacaugacaaaaagc

SEQ ID NO: 426795 - RNA, 23 nt, Human
caucccucccuuucccuccccca

SEQ ID NO: 426796 - RNA, 18 nt, Human
caugacaaacaccagaca

SEQ ID NO: 426797 - RNA, 18 nt, Human
caugacaaacaccagaca

SEQ ID NO: 426798 - RNA, 22 nt, Human
caugggaaaaaaauaaagacug

SEQ ID NO: 426799 - RNA, 23 nt, Human
cauuaaaaagaaaaaacuaucuc

SEQ ID NO: 426800 - RNA, 21 nt, Human
cauuaagauuaagcuaacacu

SEQ ID NO: 426801 - RNA, 23 nt, Human
cauucagagaacauauuuguugu

SEQ ID NO: 426802 - RNA, 18 nt, Human
cauuucacuggagagaca

SEQ ID NO: 426803 - RNA, 22 nt, Human
ccaaaaaaaaaaaaaaucccac

SEQ ID NO: 426804 - RNA, 23 nt, Human
ccaaaaaaaaaaaaaaucccaca

SEQ ID NO: 426805 - RNA, 18 nt, Human
ccaaccuggauaaggcug

SEQ ID NO: 426806 - RNA, 18 nt, Human
ccacagaccuucuccaaa

SEQ ID NO: 426807 - RNA, 24 nt, Human
ccagcugcguccgccagcacgagg

SEQ ID NO: 426808 - RNA, 20 nt, Human
cccacagccaccugccgagc

SEQ ID NO: 426809 - RNA, 22 nt, Human
cccacagcuucugcacccagcu

SEQ ID NO: 426810 - RNA, 21 nt, Human
ccccaccuacccugccccccc

SEQ ID NO: 426811 - RNA, 21 nt, Human
cccccccaaaucgucuuccuc

SEQ ID NO: 426812 - RNA, 21 nt, Human
cccccccccuccccccccaaa

SEQ ID NO: 426813 - RNA, 19 nt, Human
cccccccuccccccccaaa

SEQ ID NO: 426814 - RNA, 21 nt, Human
cccccccuccccccccaaauc

SEQ ID NO: 426815 - RNA, 22 nt, Human
cccccccuccccccccaaaucg

SEQ ID NO: 426816 - RNA, 21 nt, Human
cccgacccccaacucauggga

SEQ ID NO: 426817 - RNA, 21 nt, Human
cccucccccacccgaccccca

SEQ ID NO: 426818 - RNA, 22 nt, Human
ccugccgagcaccuaugaacca

SEQ ID NO: 426819 - RNA, 24 nt, Human
ccugccgagcaccuaugaaccaaa

SEQ ID NO: 426820 - RNA, 22 nt, Human
ccugggaaggucaucccucccu

SEQ ID NO: 426821 - RNA, 21 nt, Human
ccuguuacacauacucaguuc

SEQ ID NO: 426822 - RNA, 23 nt, Human
cgacagcuacauaaugacucaca

SEQ ID NO: 426823 - RNA, 20 nt, Human
cgagcagcugaggcggcggc

SEQ ID NO: 426824 - RNA, 22 nt, Human
cgauggcuugauguuacauaug

SEQ ID NO: 426825 - RNA, 21 nt, Human
cuaaaaagcagccagagccaa

SEQ ID NO: 426826 - RNA, 26 nt, Human
cucaagaggauuaauaauuuuggugg

SEQ ID NO: 426827 - RNA, 23 nt, Human
cuccaaacgccucuccgacccca

SEQ ID NO: 426828 - RNA, 18 nt, Human
cugcacccagcugcgucc

SEQ ID NO: 426829 - RNA, 18 nt, Human
cugcccccccccuccccc

SEQ ID NO: 426830 - RNA, 24 nt, Human
gaaaacccuauuaucuagcaauaa

SEQ ID NO: 426831 - RNA, 19 nt, Human
gaaauacuguaaacugcaa

SEQ ID NO: 426832 - RNA, 23 nt, Human
gaaggaggaggacacuggggcgg

SEQ ID NO: 426833 - RNA, 28 nt, Human
gaaggaggaggacacuggggcggccuga

SEQ ID NO: 426834 - RNA, 21 nt, Human
gacaaggcucccgaaauugga

SEQ ID NO: 426835 - RNA, 20 nt, Human
gacccacagagcgagcagcu

SEQ ID NO: 426836 - RNA, 20 nt, Human
gacggcagugugaucccuga

SEQ ID NO: 426837 - RNA, 21 nt, Human
gagaaggaggaggacacuggg

SEQ ID NO: 426838 - RNA, 24 nt, Human
gagccaaagcugaaauuuaaagga

SEQ ID NO: 426839 - RNA, 18 nt, Human
gaggcggcggcugcgcgg

SEQ ID NO: 426840 - RNA, 22 nt, Human
gaucaacagcaaaaccaaccug

SEQ ID NO: 426841 - RNA, 21 nt, Human
gcagcagcuucagaagcggga

SEQ ID NO: 426842 - RNA, 18 nt, Human
gcaguaggaaacgcccca

SEQ ID NO: 426843 - RNA, 21 nt, Human
gccccaccuacccugcccccc

SEQ ID NO: 426844 - RNA, 20 nt, Human
gcgcggaggaggcggcugga

SEQ ID NO: 426845 - RNA, 22 nt, Human
gcuucagaagcgggauguucuc

SEQ ID NO: 426846 - RNA, 23 nt, Human
ggaaaaacugacacacugacaag

SEQ ID NO: 426847 - RNA, 23 nt, Human
ggaaggagugucuucggggagga

SEQ ID NO: 426848 - RNA, 24 nt, Human
ggagaccgaucaacagcaaaacca

SEQ ID NO: 426849 - RNA, 24 nt, Human
gggaaggagugucuucggggagga

SEQ ID NO: 426850 - RNA, 19 nt, Human
guagagcaaacuuuacccc

SEQ ID NO: 426851 - RNA, 24 nt, Human
guagagcaaacuuuacccccaaaa

SEQ ID NO: 426852 - RNA, 19 nt, Human
guaggcuucacuuaacugg

SEQ ID NO: 426853 - RNA, 22 nt, Human
gucaccuguauccuguuacaca

SEQ ID NO: 426854 - RNA, 20 nt, Human
gucugggauuuacacuguuc

SEQ ID NO: 426855 - RNA, 19 nt, Human
guuacacauacucaguucc

SEQ ID NO: 426856 - RNA, 19 nt, Human
uaaaaagcagccagagcca

SEQ ID NO: 426857 - RNA, 25 nt, Human
uaaaaagcagccagagccaaagcug

SEQ ID NO: 426858 - RNA, 26 nt, Human
uaaaaagcagccagagccaaagcuga

SEQ ID NO: 426859 - RNA, 21 nt, Human
uaaaaauccuuacuggaacca

SEQ ID NO: 426860 - RNA, 21 nt, Human
uaaaacaaagaaacaaagaaa

SEQ ID NO: 426861 - RNA, 21 nt, Human
uaaauaaaacaaagaaacaaa

SEQ ID NO: 426862 - RNA, 26 nt, Human
uaaauaaaacaaagaaacaaagaaaa

SEQ ID NO: 426863 - RNA, 20 nt, Human
uaacaugacaaaaagcacaa

SEQ ID NO: 426864 - RNA, 18 nt, Human
uaagucugucagucuggg

SEQ ID NO: 426865 - RNA, 22 nt, Human
uaauaguuauaauuucaccaug

SEQ ID NO: 426866 - RNA, 21 nt, Human
uacaaggaaaaacgcaacacu

SEQ ID NO: 426867 - RNA, 18 nt, Human
uacagaacaguccagacg

SEQ ID NO: 426868 - RNA, 19 nt, Human
uacccaaaacgagagacga

SEQ ID NO: 426869 - RNA, 23 nt, Human
uacccaaaacgagagacgagagc

SEQ ID NO: 426870 - RNA, 20 nt, Human
uacccugcccccccccuccc

SEQ ID NO: 426871 - RNA, 26 nt, Human
uacccugcccccccccucccccccca

SEQ ID NO: 426872 - RNA, 19 nt, Human
uauauaaaaaaaagaaugc

SEQ ID NO: 426873 - RNA, 23 nt, Human
uaucaagucucccauucccucuc

SEQ ID NO: 426874 - RNA, 23 nt, Human
uccaaacgccucuccgaccccac

SEQ ID NO: 426875 - RNA, 26 nt, Human
uccaauaccagcacagcuagccugac

SEQ ID NO: 426876 - RNA, 21 nt, Human
uccaugacauacagaccugaa

SEQ ID NO: 426877 - RNA, 20 nt, Human
ucccacagccaccugccgag

SEQ ID NO: 426878 - RNA, 21 nt, Human
ucccacagccaccugccgagc

SEQ ID NO: 426879 - RNA, 19 nt, Human
ucccccacccgacccccaa

SEQ ID NO: 426880 - RNA, 21 nt, Human
ucccccccuuuuaaaaacaaa

SEQ ID NO: 426881 - RNA, 18 nt, Human
ucccugaggagggagcug

SEQ ID NO: 426882 - RNA, 21 nt, Human
uccguuuucagcccucaggug

SEQ ID NO: 426883 - RNA, 23 nt, Human
uccucccauggcaaugacuuuag

SEQ ID NO: 426884 - RNA, 19 nt, Human
ucugaaaacccuauuaucu

SEQ ID NO: 426885 - RNA, 23 nt, Human
ucugguaggcuucacuuaacugg

SEQ ID NO: 426886 - RNA, 18 nt, Human
ugaaaacccuauuaucua

SEQ ID NO: 426887 - RNA, 21 nt, Human
ugaaaauaccaacacgaucca

SEQ ID NO: 426888 - RNA, 23 nt, Human
ugaaaauaccaacacgauccagu

SEQ ID NO: 426889 - RNA, 22 nt, Human
ugaaaauaccaacacgauccau

SEQ ID NO: 426890 - RNA, 19 nt, Human
ugaauuuucacacacugca

SEQ ID NO: 426891 - RNA, 21 nt, Human
ugacaaaaagcacaaaggcuc

SEQ ID NO: 426892 - RNA, 18 nt, Human
ugacaaggcucccgaaau

SEQ ID NO: 426893 - RNA, 22 nt, Human
ugacacacugacaaggcucccc

SEQ ID NO: 426894 - RNA, 18 nt, Human
ugagacaagccaaucucc

SEQ ID NO: 426895 - RNA, 21 nt, Human
ugagacaagccaaucuccaau

SEQ ID NO: 426896 - RNA, 24 nt, Human
ugaggaaacugcuaaagauggucc

SEQ ID NO: 426897 - RNA, 22 nt, Human
ugaggcugcuauuccaauacca

SEQ ID NO: 426898 - RNA, 20 nt, Human
ugcagagugggugacggcag

SEQ ID NO: 426899 - RNA, 20 nt, Human
ugcccccccccucccccccc

SEQ ID NO: 426900 - RNA, 22 nt, Human
ugccuaaauaaaacaaagaaac

SEQ ID NO: 426901 - RNA, 19 nt, Human
uggaaaacaugcagagccg

SEQ ID NO: 426902 - RNA, 23 nt, Human
uggaaaacaugcagagccgagac

SEQ ID NO: 426903 - RNA, 19 nt, Human
uggcuugauguuacauaug

SEQ ID NO: 426904 - RNA, 22 nt, Human
ugggugacggcagugugauccc

SEQ ID NO: 426905 - RNA, 21 nt, Human
ugguaggcuucacuuaacugg

SEQ ID NO: 426906 - RNA, 19 nt, Human
uuacccccaaaaggaaaaa

SEQ ID NO: 426907 - RNA, 19 nt, Human
uucaagcugcuuaaauauc

SEQ ID NO: 426908 - RNA, 21 nt, Human
uucacagauagacagauucac

SEQ ID NO: 426909 - RNA, 25 nt, Human
uucacagauagacagauucacccga

SEQ ID NO: 426910 - RNA, 19 nt, Human
uucaguguuuguuaucugg

SEQ ID NO: 426911 - RNA, 22 nt, Human
uuguaucaauagaguaauggag

SEQ ID NO: 426912 - RNA, 19 nt, Human
uuucaccaugacaaacacc

SEQ ID NO: 426913 - RNA, 19 nt, Human
aaaaugccucaucagaaca

SEQ ID NO: 426914 - RNA, 19 nt, Human
aaagcugauggaaaggagc

SEQ ID NO: 426915 - RNA, 21 nt, Human
aacaauugcaaccaaaaaaaa

SEQ ID NO: 426916 - RNA, 24 nt, Human
aacugcuucccaagagacaggagu

SEQ ID NO: 426917 - RNA, 18 nt, Human
aagauguacugcuuaacg

SEQ ID NO: 426918 - RNA, 18 nt, Human
aaggaagaaucggugaug

SEQ ID NO: 426919 - RNA, 24 nt, Human
acaaggacaauagccaaagaguua

SEQ ID NO: 426920 - RNA, 25 nt, Human
acacaauucaaaaaggggggaacgc

SEQ ID NO: 426921 - RNA, 20 nt, Human
acauggcgcugucaggauac

SEQ ID NO: 426922 - RNA, 21 nt, Human
agcaaccaucaguccagcaau

SEQ ID NO: 426923 - RNA, 21 nt, Human
aggcagcgccgccgcucgcgc

SEQ ID NO: 426924 - RNA, 20 nt, Human
aggcauaguaaaaugccuca

SEQ ID NO: 426925 - RNA, 21 nt, Human
agggagcuccugugggcucaa

SEQ ID NO: 426926 - RNA, 23 nt, Human
caaaaccaaggagcuacugaaac

SEQ ID NO: 426927 - RNA, 26 nt, Human
caaaaccaaggagcuacugaaaccuc

SEQ ID NO: 426928 - RNA, 21 nt, Human
caaagcaaccaucaguccagc

SEQ ID NO: 426929 - RNA, 27 nt, Human
caauacagauagguuuagcacuagaua

SEQ ID NO: 426930 - RNA, 20 nt, Human
caauagccaaagaguuacaa

SEQ ID NO: 426931 - RNA, 19 nt, Human
caguuuauuauaaagcuga

SEQ ID NO: 426932 - RNA, 23 nt, Human
ccccaaagcagcauuuauuuacc

SEQ ID NO: 426933 - RNA, 18 nt, Human
ccccauuacuuucgccua

SEQ ID NO: 426934 - RNA, 21 nt, Human
ccucucgcuggcucgccccgg

SEQ ID NO: 426935 - RNA, 25 nt, Human
cgcacgcgcacuggcucgccggccg

SEQ ID NO: 426936 - RNA, 18 nt, Human
cggucgcugcggaggccg

SEQ ID NO: 426937 - RNA, 24 nt, Human
cucaaagcaaccaucaguccagca

SEQ ID NO: 426938 - RNA, 21 nt, Human
cucgccucgcgccucacaccg

SEQ ID NO: 426939 - RNA, 23 nt, Human
cucggccucgccucgcgccgguu

SEQ ID NO: 426940 - RNA, 19 nt, Human
gaguagcugugcugccaau

SEQ ID NO: 426941 - RNA, 20 nt, Human
gggcucaaagcaaccaucag

SEQ ID NO: 426942 - RNA, 22 nt, Human
gucuggcauuucauaaucaccc

SEQ ID NO: 426943 - RNA, 27 nt, Human
uaaaaugccucaucagaacacacuucu

SEQ ID NO: 426944 - RNA, 19 nt, Human
uaauuuaaagaggcaaaac

SEQ ID NO: 426945 - RNA, 22 nt, Human
uacugaaaccucacguuaaaca

SEQ ID NO: 426946 - RNA, 19 nt, Human
uauaaagcugauggaaagg

SEQ ID NO: 426947 - RNA, 22 nt, Human
ucacaccgcuggcucgcuagcc

SEQ ID NO: 426948 - RNA, 19 nt, Human
ucaguccgcuccccggucg

SEQ ID NO: 426949 - RNA, 21 nt, Human
ucgcugcggaggccgccgccg

SEQ ID NO: 426950 - RNA, 21 nt, Human
ucgcuggcucgccccggccgc

SEQ ID NO: 426951 - RNA, 24 nt, Human
ugacaugggcugacacacauggcg

SEQ ID NO: 426952 - RNA, 19 nt, Human
ugauugacaugggcugaca

SEQ ID NO: 426953 - RNA, 19 nt, Human
ugauuguggcaaggaagaa

SEQ ID NO: 426954 - RNA, 22 nt, Human
ugcaaccaaaaaaaaaaaaaag

SEQ ID NO: 426955 - RNA, 27 nt, Human
ugcaaccaaaaaaaaaaaaaaguuaca

SEQ ID NO: 426956 - RNA, 22 nt, Human
uggugggugaaggaagggccag

SEQ ID NO: 426957 - RNA, 24 nt, Human
uggugggugaaggaagggccaggg

SEQ ID NO: 426958 - RNA, 18 nt, Human
uuaaauaucaacuguagc

SEQ ID NO: 426959 - RNA, 26 nt, Human
uugcaaccaaaaaaaaaaaaaaguua

SEQ ID NO: 426960 - RNA, 27 nt, Human
aaaaaaaaaaaaaaaaaaucacaaaag

SEQ ID NO: 426961 - RNA, 26 nt, Human
aaaaaaaaaaaaaaucacaaaagcaa

SEQ ID NO: 426962 - RNA, 24 nt, Human
aaacuuacaguuaaugcuacccaa

SEQ ID NO: 426963 - RNA, 28 nt, Human
aaagcaaaaauccuaaaaaaaaguuaaa

SEQ ID NO: 426964 - RNA, 20 nt, Human
aacaauuaugcuuggauugu

SEQ ID NO: 426965 - RNA, 22 nt, Human
aacucauuuuuuucaggguggg

SEQ ID NO: 426966 - RNA, 21 nt, Human
aagaaaaaauacaccuuuuuu

SEQ ID NO: 426967 - RNA, 23 nt, Human
aauaaauuucaaaaaauguacaa

SEQ ID NO: 426968 - RNA, 23 nt, Human
accaaugaucccuuuuauucccc

SEQ ID NO: 426969 - RNA, 20 nt, Human
accacagccuuguaagugcu

SEQ ID NO: 426970 - RNA, 23 nt, Human
acgucguaguccccaggguucca

SEQ ID NO: 426971 - RNA, 18 nt, Human
agaaaaugccauaugcca

SEQ ID NO: 426972 - RNA, 18 nt, Human
agaaagaggaaggauuuu

SEQ ID NO: 426973 - RNA, 20 nt, Human
agaaggcuaaaacaggaagg

SEQ ID NO: 426974 - RNA, 21 nt, Human
agacagaaggcuaaaacagga

SEQ ID NO: 426975 - RNA, 20 nt, Human
agcaaaggaagcagggugcc

SEQ ID NO: 426976 - RNA, 23 nt, Human
agccacaauguaccaaaaguacu

SEQ ID NO: 426977 - RNA, 20 nt, Human
aggaggaagaaagaggaagg

SEQ ID NO: 426978 - RNA, 20 nt, Human
aggguggggaggaagagagg

SEQ ID NO: 426979 - RNA, 24 nt, Human
auagaacauacagaaaacauuguc

SEQ ID NO: 426980 - RNA, 22 nt, Human
augaggcagacaaaaguuggaa

SEQ ID NO: 426981 - RNA, 19 nt, Human
caagacagaaggcuaaaac

SEQ ID NO: 426982 - RNA, 22 nt, Human
caagacagaaggcuaaaacagg

SEQ ID NO: 426983 - RNA, 21 nt, Human
cacaugggaaauauagaaauu

SEQ ID NO: 426984 - RNA, 19 nt, Human
cagggugccuuagacacug

SEQ ID NO: 426985 - RNA, 20 nt, Human
caggguggggaggaagagag

SEQ ID NO: 426986 - RNA, 23 nt, Human
ccaaaaguacuaugccaaacacu

SEQ ID NO: 426987 - RNA, 19 nt, Human
cuacaccugugacuggaac

SEQ ID NO: 426988 - RNA, 19 nt, Human
cuacaccugugacuggaac

SEQ ID NO: 426989 - RNA, 18 nt, Human
cuagccaucaucucaagu

SEQ ID NO: 426990 - RNA, 23 nt, Human
cucaagaugaaaacagauaacuc

SEQ ID NO: 426991 - RNA, 23 nt, Human
cucacccuuaucaucaagacuca

SEQ ID NO: 426992 - RNA, 19 nt, Human
cucccagaaaaaauaggaa

SEQ ID NO: 426993 - RNA, 24 nt, Human
cuuaaaguacccacaauuacuaca

SEQ ID NO: 426994 - RNA, 20 nt, Human
gaggcagacaaaaguuggaa

SEQ ID NO: 426995 - RNA, 27 nt, Human
gcaaguaucaaaaaaaaaaaaaaaaaa

SEQ ID NO: 426996 - RNA, 20 nt, Human
ggguggggaggaagagaggg

SEQ ID NO: 426997 - RNA, 25 nt, Human
guaaauuuuagaaugaggcagacaa

SEQ ID NO: 426998 - RNA, 21 nt, Human
guacaauuuccuuuagagaag

SEQ ID NO: 426999 - RNA, 21 nt, Human
uaaaucguaaacaaaaaacua

SEQ ID NO: 427000 - RNA, 25 nt, Human
uaacuuguauaaaaauuccacaucc

SEQ ID NO: 427001 - RNA, 18 nt, Human
uacauggccaccaaguaa

SEQ ID NO: 427002 - RNA, 21 nt, Human
uaccaagcaauucauuuuucc

SEQ ID NO: 427003 - RNA, 20 nt, Human
uagaaaaugccauaugccaa

SEQ ID NO: 427004 - RNA, 22 nt, Human
uagaacauacagaaaacauugu

SEQ ID NO: 427005 - RNA, 22 nt, Human
uagaagcaagguuugagggacg

SEQ ID NO: 427006 - RNA, 23 nt, Human
uagacacugaguggagccagaaa

SEQ ID NO: 427007 - RNA, 19 nt, Human
uagcaaaaauaaugaaagc

SEQ ID NO: 427008 - RNA, 22 nt, Human
uagcaaaaauaaugaaagcuaa

SEQ ID NO: 427009 - RNA, 22 nt, Human
uagucugugggaugcaagcaaa

SEQ ID NO: 427010 - RNA, 22 nt, Human
uauacaugguuuaauauguggu

SEQ ID NO: 427011 - RNA, 22 nt, Human
ucaaaaaaaaaaaaaaaaaauc

SEQ ID NO: 427012 - RNA, 22 nt, Human
ucaaucccccccucucccagaa

SEQ ID NO: 427013 - RNA, 19 nt, Human
ucauuauuuagagaauaga

SEQ ID NO: 427014 - RNA, 21 nt, Human
ucccuaaauguuaacuggcuc

SEQ ID NO: 427015 - RNA, 22 nt, Human
ucguaguccccaggguuccagc

SEQ ID NO: 427016 - RNA, 20 nt, Human
ucucaucaacuaaggagaga

SEQ ID NO: 427017 - RNA, 26 nt, Human
ucuccuagaagcaagguuugagggac

SEQ ID NO: 427018 - RNA, 21 nt, Human
ugaaaacagauaacucccuaa

SEQ ID NO: 427019 - RNA, 19 nt, Human
ugacaaauggucuacugug

SEQ ID NO: 427020 - RNA, 23 nt, Human
ugaguggagccagaaagaucaug

SEQ ID NO: 427021 - RNA, 19 nt, Human
ugaugggccaagaacauug

SEQ ID NO: 427022 - RNA, 22 nt, Human
ugcaccugacaaauagaaagaa

SEQ ID NO: 427023 - RNA, 22 nt, Human
uggaaugugaaccguuucugcc

SEQ ID NO: 427024 - RNA, 23 nt, Human
uggcauuuuuguuugguguuuuc

SEQ ID NO: 427025 - RNA, 22 nt, Human
ugggacagcauggaugacaaau

SEQ ID NO: 427026 - RNA, 23 nt, Human
uggguauaacuuagccccaucau

SEQ ID NO: 427027 - RNA, 21 nt, Human
uguacuaggcacaauagaaca

SEQ ID NO: 427028 - RNA, 19 nt, Human
uguaggcaguuuucuuugc

SEQ ID NO: 427029 - RNA, 19 nt, Human
ugucaugaugggccaagaa

SEQ ID NO: 427030 - RNA, 20 nt, Human
uuuuacagcacaugcauguu

SEQ ID NO: 427031 - RNA, 19 nt, Human
aaagaaaaucuacugcaag

SEQ ID NO: 427032 - RNA, 24 nt, Human
aaccgcccgcccuggccgcgccuc

SEQ ID NO: 427033 - RNA, 27 nt, Human
aaggggcgggcgccgcggcggcggcgg

SEQ ID NO: 427034 - RNA, 23 nt, Human
aauacaaaauuaaaaaaauugua

SEQ ID NO: 427035 - RNA, 22 nt, Human
aaucacacguagcauuacuaag

SEQ ID NO: 427036 - RNA, 23 nt, Human
acaauuauacaaaauguguuaac

SEQ ID NO: 427037 - RNA, 23 nt, Human
acacuucuggaagaugcuucccg

SEQ ID NO: 427038 - RNA, 21 nt, Human
acuaagcauauccccaaaaaa

SEQ ID NO: 427039 - RNA, 22 nt, Human
acuacaugauucaauacagcua

SEQ ID NO: 427040 - RNA, 18 nt, Human
aggcggcgagcgggcggg

SEQ ID NO: 427041 - RNA, 22 nt, Human
agggaggaaggcggcgagcggg

SEQ ID NO: 427042 - RNA, 19 nt, Human
agguguuaaaagguacaau

SEQ ID NO: 427043 - RNA, 20 nt, Human
caacuccucaacccgagccc

SEQ ID NO: 427044 - RNA, 21 nt, Human
caacuccucaacccgagccca

SEQ ID NO: 427045 - RNA, 19 nt, Human
cacacaaauaccaacuccu

SEQ ID NO: 427046 - RNA, 21 nt, Human
cagagcaagauagagcaucuu

SEQ ID NO: 427047 - RNA, 20 nt, Human
cauauccccaaaaaagugua

SEQ ID NO: 427048 - RNA, 18 nt, Human
cccccuuccuccugcgcc

SEQ ID NO: 427049 - RNA, 28 nt, Human
ccccgccucccucgccucggugcgcccg

SEQ ID NO: 427050 - RNA, 20 nt, Human
ccccuuccuccugcgccucc

SEQ ID NO: 427051 - RNA, 20 nt, Human
cccgagcccagaucucgccg

SEQ ID NO: 427052 - RNA, 19 nt, Human
cccuccgggccggcgcucc

SEQ ID NO: 427053 - RNA, 18 nt, Human
cccuggccgcgccuccuc

SEQ ID NO: 427054 - RNA, 21 nt, Human
ccgcccuggccgcgccuccuc

SEQ ID NO: 427055 - RNA, 27 nt, Human
ccgccgccacggccgcggcggccucgg

SEQ ID NO: 427056 - RNA, 18 nt, Human
ccgcgccuccucccgccc

SEQ ID NO: 427057 - RNA, 21 nt, Human
ccgcgcucgcucggccgcugc

SEQ ID NO: 427058 - RNA, 19 nt, Human
ccucccgcccuccgggccg

SEQ ID NO: 427059 - RNA, 22 nt, Human
ccuccgccuccuuccacacaaa

SEQ ID NO: 427060 - RNA, 23 nt, Human
ccucgccgcaaccgcccgcccug

SEQ ID NO: 427061 - RNA, 24 nt, Human
cgcaaccgcccgcccuggccgcgc

SEQ ID NO: 427062 - RNA, 21 nt, Human
cgccucgccucgccgcaaccg

SEQ ID NO: 427063 - RNA, 20 nt, Human
cgcgccuccucccgcccucc

SEQ ID NO: 427064 - RNA, 21 nt, Human
cggccgcggcggccucggcuu

SEQ ID NO: 427065 - RNA, 21 nt, Human
cggcggccucggcuccucggc

SEQ ID NO: 427066 - RNA, 22 nt, Human
cggcggggcuuccccgccuccc

SEQ ID NO: 427067 - RNA, 28 nt, Human
gaauacaaccaaaauuaagauagcaaac

SEQ ID NO: 427068 - RNA, 22 nt, Human
gagcgggcggggggagaggggg

SEQ ID NO: 427069 - RNA, 21 nt, Human
gcccuggccgcgccuccuccc

SEQ ID NO: 427070 - RNA, 22 nt, Human
gcccuggccgcgccuccucccg

SEQ ID NO: 427071 - RNA, 19 nt, Human
gccgcgccuccucccgccc

SEQ ID NO: 427072 - RNA, 20 nt, Human
gccgcgccuccucccgcccu

SEQ ID NO: 427073 - RNA, 21 nt, Human
gccgcgccuccucccgcccuc

SEQ ID NO: 427074 - RNA, 19 nt, Human
gcuccgccgccacggccgc

SEQ ID NO: 427075 - RNA, 19 nt, Human
ggagagggggcgggcggcg

SEQ ID NO: 427076 - RNA, 21 nt, Human
ggccgcgccuccucccgcccu

SEQ ID NO: 427077 - RNA, 23 nt, Human
gggaaggggcgggcgccgcggcg

SEQ ID NO: 427078 - RNA, 28 nt, Human
gggcgggcggcgggggaaggggcgggcg

SEQ ID NO: 427079 - RNA, 18 nt, Human
gggcgggcgggcgaggag

SEQ ID NO: 427080 - RNA, 18 nt, Human
gggcggggggagaggggg

SEQ ID NO: 427081 - RNA, 24 nt, Human
ggggcgggcgccgcggcggcggcg

SEQ ID NO: 427082 - RNA, 20 nt, Human
uaaaagguacaauacauucu

SEQ ID NO: 427083 - RNA, 21 nt, Human
uaacaucaaagaauacaacca

SEQ ID NO: 427084 - RNA, 23 nt, Human
uaacugaacaggcaaagaaauua

SEQ ID NO: 427085 - RNA, 26 nt, Human
uagcaaugucaucuuaguaaaguuuu

SEQ ID NO: 427086 - RNA, 23 nt, Human
uagcauuacuaagcauaucccca

SEQ ID NO: 427087 - RNA, 24 nt, Human
uccacacaaauaccaacuccucaa

SEQ ID NO: 427088 - RNA, 19 nt, Human
uccgccgccacggccgcgg

SEQ ID NO: 427089 - RNA, 24 nt, Human
uccgggccggcgcuccgcuucccc

SEQ ID NO: 427090 - RNA, 20 nt, Human
ucucgccgccgccgccacac

SEQ ID NO: 427091 - RNA, 23 nt, Human
ucuguaacugaacaggccggggc

SEQ ID NO: 427092 - RNA, 20 nt, Human
ugaacaggcaaagaaauuac

SEQ ID NO: 427093 - RNA, 23 nt, Human
ugagggcuccgccgccacggccg

SEQ ID NO: 427094 - RNA, 18 nt, Human
ugcacacuuggaaaauac

SEQ ID NO: 427095 - RNA, 21 nt, Human
uggccgcgccuccucccgccc

SEQ ID NO: 427096 - RNA, 22 nt, Human
ugggaccacacuuuacaaaaac

SEQ ID NO: 427097 - RNA, 23 nt, Human
ugggaccacacuuuacaaaaaca

SEQ ID NO: 427098 - RNA, 19 nt, Human
uggggaaggaaggcagagg

SEQ ID NO: 427099 - RNA, 22 nt, Human
uguaagcaacaggugagcuuca

SEQ ID NO: 427100 - RNA, 19 nt, Human
ugugaaaagaagucccauu

SEQ ID NO: 427101 - RNA, 25 nt, Human
uuaacacuauuaaaucacaucuaau

SEQ ID NO: 427102 - RNA, 20 nt, Human
uuccacacaaauaccaacuc

SEQ ID NO: 427103 - RNA, 21 nt, Human
uuccacacaaauaccaacucc

SEQ ID NO: 427104 - RNA, 18 nt, Human
uucccaaucacacuucug

SEQ ID NO: 427105 - RNA, 19 nt, Human
uuuacaggaaaauacuuuu

SEQ ID NO: 427106 - RNA, 19 nt, Human
uuuuuuuuuuuuacaggaa

SEQ ID NO: 427107 - RNA, 22 nt, Human
agagauacuagaagggcccaga

SEQ ID NO: 427108 - RNA, 24 nt, Human
agagauacuagaagggcccagagc

SEQ ID NO: 427109 - RNA, 22 nt, Human
agauacuagaagggcccagagc

SEQ ID NO: 427110 - RNA, 20 nt, Human
agccagagcuacuucugucc

SEQ ID NO: 427111 - RNA, 20 nt, Human
aggaagagagguagcaggga

SEQ ID NO: 427112 - RNA, 20 nt, Human
aguggaggagcagaacugaa

SEQ ID NO: 427113 - RNA, 18 nt, Human
cagaagcccccggcagag

SEQ ID NO: 427114 - RNA, 26 nt, Human
ccagaagcccccggcagagauacuag

SEQ ID NO: 427115 - RNA, 18 nt, Human
cccagagccaaauccagc

SEQ ID NO: 427116 - RNA, 19 nt, Human
cugaagaaagagaaaugau

SEQ ID NO: 427117 - RNA, 22 nt, Human
cuggcagagcugagccucccuc

SEQ ID NO: 427118 - RNA, 23 nt, Human
gaagaaagagaaaugauccugga

SEQ ID NO: 427119 - RNA, 19 nt, Human
gagccaaauccagcagcug

SEQ ID NO: 427120 - RNA, 23 nt, Human
gggcccagagccaaauccagcag

SEQ ID NO: 427121 - RNA, 20 nt, Human
guccuuucuuccagccuccu

SEQ ID NO: 427122 - RNA, 20 nt, Human
uagagaggaguaccagaagc

SEQ ID NO: 427123 - RNA, 22 nt, Human
uaggcaugaugaccaaguccua

SEQ ID NO: 427124 - RNA, 25 nt, Human
uaugauuagauauuuauugagcacc

SEQ ID NO: 427125 - RNA, 19 nt, Human
ucccucgggucuucuggug

SEQ ID NO: 427126 - RNA, 22 nt, Human
ucuguccuuucuuccagccucc

SEQ ID NO: 427127 - RNA, 20 nt, Human
ugaaauaacaauuucaauua

SEQ ID NO: 427128 - RNA, 18 nt, Human
ugaccaaguccuagugcu

SEQ ID NO: 427129 - RNA, 21 nt, Human
ugagcaccaggagagagucag

SEQ ID NO: 427130 - RNA, 23 nt, Human
ugggcaucuucccucugguauuu

SEQ ID NO: 427131 - RNA, 18 nt, Human
uuaaaagcugucuggccc

SEQ ID NO: 427132 - RNA, 19 nt, Human
uuagacuuauaguggagga

SEQ ID NO: 427133 - RNA, 22 nt, Human
uuuuuugcuguuaugauuagau

SEQ ID NO: 427134 - RNA, 21 nt, Human
uuuuuuuuuuuuuuuugcugu

SEQ ID NO: 427135 - RNA, 18 nt, Human
uuuuuuuuuuuuuuuuug

SEQ ID NO: 427136 - RNA, 20 nt, Human
uuuuuuuuuuuuuuuuugcu

SEQ ID NO: 427137 - RNA, 20 nt, Human
aagaaugaacagagaagcac

SEQ ID NO: 427138 - RNA, 18 nt, Human
aagacagcucaaaacuga

SEQ ID NO: 427139 - RNA, 18 nt, Human
agaggggaagggcacagu

SEQ ID NO: 427140 - RNA, 27 nt, Human
cagaaaagcucaaggaucagaaaucaa

SEQ ID NO: 427141 - RNA, 24 nt, Human
cagagaagcacagaaaagcucaag

SEQ ID NO: 427142 - RNA, 19 nt, Human
cagcucaaaacugagcaac

SEQ ID NO: 427143 - RNA, 21 nt, Human
ccccccuggccuccuuagcuu

SEQ ID NO: 427144 - RNA, 18 nt, Human
gaacagagaagcacagaa

SEQ ID NO: 427145 - RNA, 19 nt, Human
gggagaggggaagggcaca

SEQ ID NO: 427146 - RNA, 18 nt, Human
ugaagacagcucaaaacu

SEQ ID NO: 427147 - RNA, 19 nt, Human
ugaagacagcucaaaacug

SEQ ID NO: 427148 - RNA, 21 nt, Human
agaggacagggggccaggcag

SEQ ID NO: 427149 - RNA, 20 nt, Human
agccagagaggacagggggc

SEQ ID NO: 427150 - RNA, 19 nt, Human
agcccaggacaggcugcac

SEQ ID NO: 427151 - RNA, 18 nt, Human
agccgguucugaaugccc

SEQ ID NO: 427152 - RNA, 21 nt, Human
agcucagggcccuccgggagc

SEQ ID NO: 427153 - RNA, 23 nt, Human
aggcaaugcaaggccgguguggc

SEQ ID NO: 427154 - RNA, 22 nt, Human
cagcccaggacaggcugcacag

SEQ ID NO: 427155 - RNA, 22 nt, Human
ccccagcagcagcucugaggcc

SEQ ID NO: 427156 - RNA, 24 nt, Human
ccccugggccucccgaaaccuggg

SEQ ID NO: 427157 - RNA, 25 nt, Human
cccggaccucccugcuccccagcca

SEQ ID NO: 427158 - RNA, 23 nt, Human
ccucccggaccucccugcucccc

SEQ ID NO: 427159 - RNA, 20 nt, Human
ccuccgggagccaccagccc

SEQ ID NO: 427160 - RNA, 22 nt, Human
ccuccgggagccaccagcccag

SEQ ID NO: 427161 - RNA, 22 nt, Human
ccugagacacccccuaccacag

SEQ ID NO: 427162 - RNA, 23 nt, Human
cgccccugggccucccgaaaccu

SEQ ID NO: 427163 - RNA, 19 nt, Human
cuccgggagccaccagccc

SEQ ID NO: 427164 - RNA, 21 nt, Human
cucuggucccaaugccaaugg

SEQ ID NO: 427165 - RNA, 22 nt, Human
gagacacccccuaccacagccc

SEQ ID NO: 427166 - RNA, 24 nt, Human
gccccagcagcagcucugaggccc

SEQ ID NO: 427167 - RNA, 20 nt, Human
gcccuccgggagccaccagg

SEQ ID NO: 427168 - RNA, 21 nt, Human
gcucagggcccuccgggagcc

SEQ ID NO: 427169 - RNA, 25 nt, Human
ggacaggcugcacagccgcacccuc

SEQ ID NO: 427170 - RNA, 25 nt, Human
ggaccugggguggggcugagggugg

SEQ ID NO: 427171 - RNA, 20 nt, Human
ggcccaggggaaggcauccg

SEQ ID NO: 427172 - RNA, 24 nt, Human
ggcccuccgggagccaccagccca

SEQ ID NO: 427173 - RNA, 18 nt, Human
ggggcugaggguggggaa

SEQ ID NO: 427174 - RNA, 20 nt, Human
ggguggggcugagggugggg

SEQ ID NO: 427175 - RNA, 20 nt, Human
ucccggaccucccugcuccc

SEQ ID NO: 427176 - RNA, 21 nt, Human
ucccugcuccccagccagaga

SEQ ID NO: 427177 - RNA, 19 nt, Human
ucugaaugccccagcagca

SEQ ID NO: 427178 - RNA, 19 nt, Human
ugaaugccccagcagcagc

SEQ ID NO: 427179 - RNA, 23 nt, Human
ugagacacccccuaccacagccc

SEQ ID NO: 427180 - RNA, 19 nt, Human
ugaggguggggaagagccg

SEQ ID NO: 427181 - RNA, 25 nt, Human
ugggguggggcugaggguggggaag

SEQ ID NO: 427182 - RNA, 21 nt, Human
aaauaagaagcaaacccaggg

SEQ ID NO: 427183 - RNA, 24 nt, Human
augccugcaacugaauaggaucga

SEQ ID NO: 427184 - RNA, 18 nt, Human
guggccucuaauuccucc

SEQ ID NO: 427185 - RNA, 18 nt, Human
ucaccuacaacuuugccc

SEQ ID NO: 427186 - RNA, 20 nt, Human
ugagauuuuuuccucuuuuu

SEQ ID NO: 427187 - RNA, 22 nt, Human
ugggguguuuuucggguuuggu

SEQ ID NO: 427188 - RNA, 21 nt, Human
ugguggccucuaauuccuccu

SEQ ID NO: 427189 - RNA, 24 nt, Human
uuuuuuuuuuuauuuuuuauuuuu

SEQ ID NO: 427190 - RNA, 25 nt, Human
uuuuuuuuuuuuuuuuuuuauuuuu

SEQ ID NO: 427191 - RNA, 23 nt, Human
aaaaaaaaaaauugaggccuaaa

SEQ ID NO: 427192 - RNA, 25 nt, Human
aaaaaacaagaugaagaaaguggaa

SEQ ID NO: 427193 - RNA, 28 nt, Human
aaaacaaaaauaaaauaauaaaauugaa

SEQ ID NO: 427194 - RNA, 20 nt, Human
aacagcucccggagcaaacu

SEQ ID NO: 427195 - RNA, 23 nt, Human
aagcuggugcaaagguaacccau

SEQ ID NO: 427196 - RNA, 19 nt, Human
aaggaaaguacagaggaau

SEQ ID NO: 427197 - RNA, 20 nt, Human
acaggaauuagucucugaac

SEQ ID NO: 427198 - RNA, 19 nt, Human
acugaagcuggugcaaagg

SEQ ID NO: 427199 - RNA, 19 nt, Human
agaaaaagcaugaagaagc

SEQ ID NO: 427200 - RNA, 22 nt, Human
agaaauggugagaagaaaaagc

SEQ ID NO: 427201 - RNA, 18 nt, Human
agaagaaaaagcaugaag

SEQ ID NO: 427202 - RNA, 19 nt, Human
agaagaaaaagcaugaaga

SEQ ID NO: 427203 - RNA, 20 nt, Human
agaagaaaaagcaugaagaa

SEQ ID NO: 427204 - RNA, 20 nt, Human
agacauaguuuuuuaaaguu

SEQ ID NO: 427205 - RNA, 23 nt, Human
agcgaaaggaaaguacagaggaa

SEQ ID NO: 427206 - RNA, 21 nt, Human
agcgaagaaacagcucccgga

SEQ ID NO: 427207 - RNA, 21 nt, Human
agucucugaaccacacaguuu

SEQ ID NO: 427208 - RNA, 22 nt, Human
aguuuuuaacaauacccagcuc

SEQ ID NO: 427209 - RNA, 22 nt, Human
auaggaagcuuaaaaugcagua

SEQ ID NO: 427210 - RNA, 18 nt, Human
augacauuuuuuucuuuu

SEQ ID NO: 427211 - RNA, 25 nt, Human
auuuccaguaauuggaaaaaaacaa

SEQ ID NO: 427212 - RNA, 25 nt, Human
caaaacacaauaaaugcucuucucu

SEQ ID NO: 427213 - RNA, 18 nt, Human
cacacaguuuuuaggccu

SEQ ID NO: 427214 - RNA, 24 nt, Human
cacuccaggaaacacaaaccuggg

SEQ ID NO: 427215 - RNA, 18 nt, Human
cagucgaaaauacagugu

SEQ ID NO: 427216 - RNA, 20 nt, Human
cauggacucggcgcccugcu

SEQ ID NO: 427217 - RNA, 21 nt, Human
ccacuccaggaaacacaaacc

SEQ ID NO: 427218 - RNA, 21 nt, Human
ccaggaaacacaaaccugggg

SEQ ID NO: 427219 - RNA, 26 nt, Human
cccuucugucccucucuacagcuucc

SEQ ID NO: 427220 - RNA, 24 nt, Human
ccucuuuuuagcuaaaaaacaaga

SEQ ID NO: 427221 - RNA, 21 nt, Human
cggagcaaacuguacaaaaac

SEQ ID NO: 427222 - RNA, 22 nt, Human
cggagcaaacuguacaaaaacc

SEQ ID NO: 427223 - RNA, 24 nt, Human
cucccggagcaaacuguacaaaaa

SEQ ID NO: 427224 - RNA, 19 nt, Human
cuguacaaaaaccucgcca

SEQ ID NO: 427225 - RNA, 19 nt, Human
cugucccucucuacagcuu

SEQ ID NO: 427226 - RNA, 23 nt, Human
cuucaaguuccuucacagaaaaa

SEQ ID NO: 427227 - RNA, 19 nt, Human
gaaaaaaaaaaaugggaaa

SEQ ID NO: 427228 - RNA, 18 nt, Human
gaagaaacagcucccgga

SEQ ID NO: 427229 - RNA, 19 nt, Human
gaagccgcgaagugugggg

SEQ ID NO: 427230 - RNA, 21 nt, Human
ggaaacacaaaccuggggacg

SEQ ID NO: 427231 - RNA, 19 nt, Human
ggcagcacgcaggcucgau

SEQ ID NO: 427232 - RNA, 19 nt, Human
guaugguagugcgggcacc

SEQ ID NO: 427233 - RNA, 18 nt, Human
uaaaaccaccuuacaaag

SEQ ID NO: 427234 - RNA, 25 nt, Human
uaaaauaauaaaauugaaaaauccc

SEQ ID NO: 427235 - RNA, 22 nt, Human
uaaaauguuauuugaccuaaaa

SEQ ID NO: 427236 - RNA, 24 nt, Human
uaaaauuaggaaauauaaaaugag

SEQ ID NO: 427237 - RNA, 23 nt, Human
uaaaugaaugcaaaaaaaauuuu

SEQ ID NO: 427238 - RNA, 25 nt, Human
uaagcugaaaaaaaaaaaugggaaa

SEQ ID NO: 427239 - RNA, 22 nt, Human
uacaaauugaaaauucaauaau

SEQ ID NO: 427240 - RNA, 24 nt, Human
uacaauuuucuaguugugcuuaaa

SEQ ID NO: 427241 - RNA, 19 nt, Human
uauaaaaugagccacauaa

SEQ ID NO: 427242 - RNA, 24 nt, Human
uaucaaaaguucccaaauuuggaa

SEQ ID NO: 427243 - RNA, 22 nt, Human
ucacaauuaauguuccaaaaca

SEQ ID NO: 427244 - RNA, 26 nt, Human
ucacacaugcaucacuucaaguuccu

SEQ ID NO: 427245 - RNA, 24 nt, Human
uccaguaauuggaaaaaaacaaaa

SEQ ID NO: 427246 - RNA, 23 nt, Human
uccuucacagaaaaaaaaaaaaa

SEQ ID NO: 427247 - RNA, 24 nt, Human
ucuuaaauucacacaugcaucacu

SEQ ID NO: 427248 - RNA, 20 nt, Human
ugacaaaauuaaugaacaag

SEQ ID NO: 427249 - RNA, 19 nt, Human
ugaugaauagcgaaaggaa

SEQ ID NO: 427250 - RNA, 21 nt, Human
ugcagagcagguuagaacuga

SEQ ID NO: 427251 - RNA, 23 nt, Human
ugccuauucuucuaauacugaca

SEQ ID NO: 427252 - RNA, 20 nt, Human
uggaauuuucagucgaaaau

SEQ ID NO: 427253 - RNA, 18 nt, Human
ugggaaauugaugaauag

SEQ ID NO: 427254 - RNA, 22 nt, Human
uggugagaagaaaaagcaugaa

SEQ ID NO: 427255 - RNA, 24 nt, Human
uguaugguagugcgggcaccuuuu

SEQ ID NO: 427256 - RNA, 24 nt, Human
uuagaacugaucucuuucggccac

SEQ ID NO: 427257 - RNA, 18 nt, Human
uucacagaaaaaaaaaaa

SEQ ID NO: 427258 - RNA, 21 nt, Human
uucugucccucucuacagcuu

SEQ ID NO: 427259 - RNA, 23 nt, Human
uucuuuuucuuuucuguaggaga

SEQ ID NO: 427260 - RNA, 19 nt, Human
uugaaaaaucccaucucac

SEQ ID NO: 427261 - RNA, 20 nt, Human
uugaugaauagcgaaaggaa

SEQ ID NO: 427262 - RNA, 29 nt, Human
uuuguaguuuuggccagaaauggugagaa

SEQ ID NO: 427263 - RNA, 23 nt, Human
uuuucaagcagguaacaauacua

SEQ ID NO: 427264 - RNA, 24 nt, Human
uuuucuguaggagagagacgagag

SEQ ID NO: 427265 - RNA, 23 nt, Human
aaaaccccauccauuaagcacag

SEQ ID NO: 427266 - RNA, 26 nt, Human
aaaaccccauccauuaagcacagaaa

SEQ ID NO: 427267 - RNA, 19 nt, Human
aaccaagaggugcuggaca

SEQ ID NO: 427268 - RNA, 23 nt, Human
aagauacucaaagcuuauaaagg

SEQ ID NO: 427269 - RNA, 24 nt, Human
aagggaggaaacauuuaggauaag

SEQ ID NO: 427270 - RNA, 20 nt, Human
acaauuagguaugcauucaa

SEQ ID NO: 427271 - RNA, 23 nt, Human
acccguccccaacacccccgcca

SEQ ID NO: 427272 - RNA, 19 nt, Human
acuaaacuucaaaccacaa

SEQ ID NO: 427273 - RNA, 20 nt, Human
aggccccgagacugcuccuc

SEQ ID NO: 427274 - RNA, 20 nt, Human
aggccccgccgaccgcccag

SEQ ID NO: 427275 - RNA, 24 nt, Human
aggcgggcggcacugcggcccggc

SEQ ID NO: 427276 - RNA, 26 nt, Human
agggaaaaaaccaauaauaggccccg

SEQ ID NO: 427277 - RNA, 20 nt, Human
aggggccgugggggccggac

SEQ ID NO: 427278 - RNA, 18 nt, Human
auccgcgcgggcgcgagg

SEQ ID NO: 427279 - RNA, 21 nt, Human
caaaaaaacauuaacuucuga

SEQ ID NO: 427280 - RNA, 21 nt, Human
caaaaaauaacucagauccgc

SEQ ID NO: 427281 - RNA, 25 nt, Human
caaaccacaaaaacauugugacuaa

SEQ ID NO: 427282 - RNA, 19 nt, Human
cacugcacuaacauuaaac

SEQ ID NO: 427283 - RNA, 19 nt, Human
cagcgcccgucccgcucgg

SEQ ID NO: 427284 - RNA, 20 nt, Human
cagcgcccgucccgcucgga

SEQ ID NO: 427285 - RNA, 21 nt, Human
caggccggggcccgaggggcc

SEQ ID NO: 427286 - RNA, 21 nt, Human
ccacaaaaacauugugacuaa

SEQ ID NO: 427287 - RNA, 20 nt, Human
ccagagagcucggaauacgg

SEQ ID NO: 427288 - RNA, 23 nt, Human
ccaggccccaggccccgccgacc

SEQ ID NO: 427289 - RNA, 22 nt, Human
cccaggccccaggccccgccga

SEQ ID NO: 427290 - RNA, 22 nt, Human
ccccaacacccccgccaccucc

SEQ ID NO: 427291 - RNA, 18 nt, Human
ccccgccgaccgcccagg

SEQ ID NO: 427292 - RNA, 21 nt, Human
ccccguguccacgcgcgggcc

SEQ ID NO: 427293 - RNA, 22 nt, Human
cccgaagcccaggccccaggcc

SEQ ID NO: 427294 - RNA, 18 nt, Human
ccgcggcucgguggcagc

SEQ ID NO: 427295 - RNA, 21 nt, Human
ccggugccgcgaucucaaggg

SEQ ID NO: 427296 - RNA, 19 nt, Human
ccuccggagaccgcggccg

SEQ ID NO: 427297 - RNA, 22 nt, Human
ccucgcgccgggccucccaguc

SEQ ID NO: 427298 - RNA, 23 nt, Human
cgacaaaaauaaaggggaaaaga

SEQ ID NO: 427299 - RNA, 23 nt, Human
cgagaagagcggcgggcacggcg

SEQ ID NO: 427300 - RNA, 23 nt, Human
cgccgaccgcccaggcuccgcga

SEQ ID NO: 427301 - RNA, 18 nt, Human
cggcccggcccaggaugg

SEQ ID NO: 427302 - RNA, 19 nt, Human
cggcucgguggcagcuugg

SEQ ID NO: 427303 - RNA, 23 nt, Human
cggcucgguggcagcuugggcga

SEQ ID NO: 427304 - RNA, 22 nt, Human
cucaaaaccccauccauuaagc

SEQ ID NO: 427305 - RNA, 24 nt, Human
cucaaaaccccauccauuaagcaa

SEQ ID NO: 427306 - RNA, 19 nt, Human
cucagauccgcccaggagg

SEQ ID NO: 427307 - RNA, 25 nt, Human
cuccaggcggcuacccggcuccucc

SEQ ID NO: 427308 - RNA, 26 nt, Human
cugacccagguggcggggucggcccu

SEQ ID NO: 427309 - RNA, 24 nt, Human
gaacaaaacgagggacgcuucccc

SEQ ID NO: 427310 - RNA, 22 nt, Human
gagacugcuccuccaggcggcu

SEQ ID NO: 427311 - RNA, 21 nt, Human
gagaggggcgcgcgggagagc

SEQ ID NO: 427312 - RNA, 19 nt, Human
gcacuaacauuaaacuaaa

SEQ ID NO: 427313 - RNA, 23 nt, Human
gcaggccggggcccgaggggccg

SEQ ID NO: 427314 - RNA, 23 nt, Human
gccccaggccccgccgaccgccc

SEQ ID NO: 427315 - RNA, 20 nt, Human
gcccgaagcccaggccccag

SEQ ID NO: 427316 - RNA, 20 nt, Human
gcccggggcccagcguguuc

SEQ ID NO: 427317 - RNA, 19 nt, Human
gccgcgcccgaagcccagg

SEQ ID NO: 427318 - RNA, 19 nt, Human
gcggcaggccggggcccga

SEQ ID NO: 427319 - RNA, 19 nt, Human
ggaagaacaaaacgagggg

SEQ ID NO: 427320 - RNA, 20 nt, Human
ggaagcaggugacgggaucc

SEQ ID NO: 427321 - RNA, 20 nt, Human
ggcgacgagggacgcagaga

SEQ ID NO: 427322 - RNA, 21 nt, Human
ggcggcaggccggggcccgag

SEQ ID NO: 427323 - RNA, 19 nt, Human
ggcgggggccgcggcucgg

SEQ ID NO: 427324 - RNA, 21 nt, Human
gggaaaaacucaaaaccccau

SEQ ID NO: 427325 - RNA, 20 nt, Human
gggcgggggccgcggcucgg

SEQ ID NO: 427326 - RNA, 18 nt, Human
gggggaggagcggccgcc

SEQ ID NO: 427327 - RNA, 22 nt, Human
uaaaaaggcaagcuguaagaua

SEQ ID NO: 427328 - RNA, 18 nt, Human
uaacacacaaggcaacca

SEQ ID NO: 427329 - RNA, 19 nt, Human
uaacuucugaauuuccaau

SEQ ID NO: 427330 - RNA, 24 nt, Human
ucacugcacuaacauuaaacuaaa

SEQ ID NO: 427331 - RNA, 28 nt, Human
uccagagagcucggaauacggcggaccg

SEQ ID NO: 427332 - RNA, 21 nt, Human
uccccaacacccccgccaccu

SEQ ID NO: 427333 - RNA, 19 nt, Human
uccccggcgggaagcaggu

SEQ ID NO: 427334 - RNA, 22 nt, Human
uccccggggcgggcacugaccc

SEQ ID NO: 427335 - RNA, 23 nt, Human
ucccuggagucuccucucuuucc

SEQ ID NO: 427336 - RNA, 24 nt, Human
uccgcggccgcgggucaggagggc

SEQ ID NO: 427337 - RNA, 19 nt, Human
ucggagggaaaaaaccaau

SEQ ID NO: 427338 - RNA, 21 nt, Human
ugacccagguggcggggucgg

SEQ ID NO: 427339 - RNA, 23 nt, Human
ugacgggauccgcgcgggcgcga

SEQ ID NO: 427340 - RNA, 24 nt, Human
uggcgggcggcgccucucaggcgg

SEQ ID NO: 427341 - RNA, 21 nt, Human
uggcggggucggcccuccggu

SEQ ID NO: 427342 - RNA, 20 nt, Human
ugggcagugccggucgcagc

SEQ ID NO: 427343 - RNA, 20 nt, Human
ugugacuaacauuaaaaagg

SEQ ID NO: 427344 - RNA, 24 nt, Human
uuacaauuagguaugcauucaauu

SEQ ID NO: 427345 - RNA, 21 nt, Human
uuuaaccaagaggugcuggac

SEQ ID NO: 427346 - RNA, 22 nt, Human
uuuaaccaagaggugcuggaca

SEQ ID NO: 427347 - RNA, 25 nt, Human
uuuuacaauuagguaugcauucaau

SEQ ID NO: 427348 - RNA, 21 nt, Human
acucugaucaggagcacgcca

SEQ ID NO: 427349 - RNA, 21 nt, Human
cacgccagaccggaagaacuc

SEQ ID NO: 427350 - RNA, 20 nt, Human
cagcagcaucucccaugggg

SEQ ID NO: 427351 - RNA, 19 nt, Human
cauccugggugucagcagc

SEQ ID NO: 427352 - RNA, 25 nt, Human
cauccugggugucagcagcaucucc

SEQ ID NO: 427353 - RNA, 19 nt, Human
ccuugaacgccaaaaucuu

SEQ ID NO: 427354 - RNA, 19 nt, Human
cgccagaccggaagaacuc

SEQ ID NO: 427355 - RNA, 22 nt, Human
gaguaacucugaucaggagcac

SEQ ID NO: 427356 - RNA, 18 nt, Human
gccagaccggaagaacuc

SEQ ID NO: 427357 - RNA, 21 nt, Human
ggaagaacuccauccugcaga

SEQ ID NO: 427358 - RNA, 23 nt, Human
ucugaucaggagcacgccagacc

SEQ ID NO: 427359 - RNA, 23 nt, Human
uugaacgccaaaaucuucagauc

SEQ ID NO: 427360 - RNA, 24 nt, Human
aaaaauacaagggaagcagacgac

SEQ ID NO: 427361 - RNA, 21 nt, Human
aaaaauagacuuuuaagguaa

SEQ ID NO: 427362 - RNA, 21 nt, Human
acaaaaauagacuuuuaaggu

SEQ ID NO: 427363 - RNA, 21 nt, Human
acaagggaagcagacgaccca

SEQ ID NO: 427364 - RNA, 20 nt, Human
acacuccaucccccaccauc

SEQ ID NO: 427365 - RNA, 20 nt, Human
agcccugggguccaugcaga

SEQ ID NO: 427366 - RNA, 22 nt, Human
aggucaggggaguggguuaaug

SEQ ID NO: 427367 - RNA, 18 nt, Human
caagggaagcagacgacc

SEQ ID NO: 427368 - RNA, 24 nt, Human
caaguccccacagcccuggggucc

SEQ ID NO: 427369 - RNA, 21 nt, Human
cacagcacauaagauucuagg

SEQ ID NO: 427370 - RNA, 23 nt, Human
cacagcccugggguccaugcaga

SEQ ID NO: 427371 - RNA, 24 nt, Human
ccagcugaucugaccgggcaguca

SEQ ID NO: 427372 - RNA, 21 nt, Human
cccaagaaccucggaagacac

SEQ ID NO: 427373 - RNA, 24 nt, Human
cccccaaguccccacagcccuggg

SEQ ID NO: 427374 - RNA, 20 nt, Human
cggaagacacuccauccccc

SEQ ID NO: 427375 - RNA, 19 nt, Human
gaaaaauacaagggaagca

SEQ ID NO: 427376 - RNA, 28 nt, Human
gaagcagacgacccaauauuguaaugac

SEQ ID NO: 427377 - RNA, 22 nt, Human
gacgacccaauauauauaaaua

SEQ ID NO: 427378 - RNA, 19 nt, Human
gagagguuccaguuaccag

SEQ ID NO: 427379 - RNA, 19 nt, Human
gccccagcgugaggucagg

SEQ ID NO: 427380 - RNA, 22 nt, Human
gcugagauccagcugaucugac

SEQ ID NO: 427381 - RNA, 22 nt, Human
ggaaccucaggucuauaaaaac

SEQ ID NO: 427382 - RNA, 19 nt, Human
ggaagacacuccauccccc

SEQ ID NO: 427383 - RNA, 19 nt, Human
ggaagaggugggggagagg

SEQ ID NO: 427384 - RNA, 22 nt, Human
gucccccaaguccccacagccc

SEQ ID NO: 427385 - RNA, 20 nt, Human
gucggccgagagugggagcg

SEQ ID NO: 427386 - RNA, 23 nt, Human
uaagauucuaggagacagauuug

SEQ ID NO: 427387 - RNA, 24 nt, Human
uacugagcuugcacacuuggggac

SEQ ID NO: 427388 - RNA, 21 nt, Human
uccaucccccaccaucaugaa

SEQ ID NO: 427389 - RNA, 23 nt, Human
ugagcaccaggauucccccucag

SEQ ID NO: 427390 - RNA, 18 nt, Human
ugaggucaggggaguggg

SEQ ID NO: 427391 - RNA, 22 nt, Human
ugauuacugucccccaaguccc

SEQ ID NO: 427392 - RNA, 18 nt, Human
ugcccaaaacacaaaaau

SEQ ID NO: 427393 - RNA, 27 nt, Human
ugggcagggaagaggugggggagaggg

SEQ ID NO: 427394 - RNA, 18 nt, Human
ugggggagaggguucauu

SEQ ID NO: 427395 - RNA, 21 nt, Human
ugggggagaggguucauugcc

SEQ ID NO: 427396 - RNA, 24 nt, Human
ugucccccaaguccccacagcccu

SEQ ID NO: 427397 - RNA, 24 nt, Human
uuaaaaaugcccaaaacacaaaaa

SEQ ID NO: 427398 - RNA, 22 nt, Human
uucaauauuacaaaaaaaggaa

SEQ ID NO: 427399 - RNA, 18 nt, Human
uucccccucaggagaggu

SEQ ID NO: 427400 - RNA, 19 nt, Human
uuggggaccugccccagcg

SEQ ID NO: 427401 - RNA, 25 nt, Human
aaaaaaaagcauaguuuggcaauaa

SEQ ID NO: 427402 - RNA, 25 nt, Human
aaaaaaaaggcaucuacugacaaaa

SEQ ID NO: 427403 - RNA, 24 nt, Human
aaaaaggaaaaagacacgucacaa

SEQ ID NO: 427404 - RNA, 24 nt, Human
aaaagaaaaaauuaaaucacaaag

SEQ ID NO: 427405 - RNA, 18 nt, Human
aaaauaaaauaaccaaaa

SEQ ID NO: 427406 - RNA, 24 nt, Human
aaaauuaacaaaaaaaagcauagu

SEQ ID NO: 427407 - RNA, 24 nt, Human
aaagaaagagaaauagaaagcgac

SEQ ID NO: 427408 - RNA, 21 nt, Human
aagaaacucaauuugcagucc

SEQ ID NO: 427409 - RNA, 25 nt, Human
aagagaaagaaacucaauuugcaaa

SEQ ID NO: 427410 - RNA, 23 nt, Human
aagcauaguuuggcaauaaauac

SEQ ID NO: 427411 - RNA, 19 nt, Human
aaugaauaccauuaacugc

SEQ ID NO: 427412 - RNA, 21 nt, Human
acaaagaaagagaaauagaaa

SEQ ID NO: 427413 - RNA, 20 nt, Human
acaaagucccacuuaaguca

SEQ ID NO: 427414 - RNA, 20 nt, Human
accgggaagaggggaggagg

SEQ ID NO: 427415 - RNA, 22 nt, Human
aggaaaaagacacgucacaaaa

SEQ ID NO: 427416 - RNA, 23 nt, Human
aggcaagauuagucaacaggggu

SEQ ID NO: 427417 - RNA, 19 nt, Human
aggcgcagccucuccuguc

SEQ ID NO: 427418 - RNA, 19 nt, Human
agggccuguggggaauggg

SEQ ID NO: 427419 - RNA, 20 nt, Human
aggggugggggggguggggg

SEQ ID NO: 427420 - RNA, 21 nt, Human
aggugcugggggaaagggguu

SEQ ID NO: 427421 - RNA, 21 nt, Human
agguggagaggugccaccggg

SEQ ID NO: 427422 - RNA, 19 nt, Human
augagggggagagggaggg

SEQ ID NO: 427423 - RNA, 23 nt, Human
auuuuaagauuaauaugaagauc

SEQ ID NO: 427424 - RNA, 19 nt, Human
caaaaucaagucucuccua

SEQ ID NO: 427425 - RNA, 22 nt, Human
caaagucccacuuaagucaaaa

SEQ ID NO: 427426 - RNA, 24 nt, Human
caaagucccacuuaagucaaaauc

SEQ ID NO: 427427 - RNA, 21 nt, Human
caaaguuagauuacaaggcac

SEQ ID NO: 427428 - RNA, 18 nt, Human
cagccuuccuuccugcag

SEQ ID NO: 427429 - RNA, 20 nt, Human
caggguaggggcuggaguag

SEQ ID NO: 427430 - RNA, 26 nt, Human
caucuagcuuccccuuccuccccacu

SEQ ID NO: 427431 - RNA, 24 nt, Human
ccagaaccucaaaucugugagugg

SEQ ID NO: 427432 - RNA, 18 nt, Human
ccaguggagggggcugcu

SEQ ID NO: 427433 - RNA, 20 nt, Human
cccacacgccaguucccggc

SEQ ID NO: 427434 - RNA, 20 nt, Human
ccccucgccuuucugacucc

SEQ ID NO: 427435 - RNA, 21 nt, Human
ccuaguugugaaaggccuaaa

SEQ ID NO: 427436 - RNA, 26 nt, Human
ccuccccacuuaaaaaaaagaaaaaa

SEQ ID NO: 427437 - RNA, 19 nt, Human
ccugcagaccuacacaaac

SEQ ID NO: 427438 - RNA, 20 nt, Human
ccuuccuccccacuuaaaaa

SEQ ID NO: 427439 - RNA, 24 nt, Human
ccuuccuccccacuuaaaaaaaag

SEQ ID NO: 427440 - RNA, 21 nt, Human
cucuccugucuggagucccac

SEQ ID NO: 427441 - RNA, 19 nt, Human
cuguuacugcuuuuucucu

SEQ ID NO: 427442 - RNA, 22 nt, Human
gacagguuucccccaaaacccu

SEQ ID NO: 427443 - RNA, 22 nt, Human
gaggcccacgggugcccucugg

SEQ ID NO: 427444 - RNA, 23 nt, Human
ggaaaacuccagaccuggaaucc

SEQ ID NO: 427445 - RNA, 19 nt, Human
ggagggggcugcugguucc

SEQ ID NO: 427446 - RNA, 21 nt, Human
ggauggguagggagaagaggg

SEQ ID NO: 427447 - RNA, 19 nt, Human
gggaauuucuaaaauaaau

SEQ ID NO: 427448 - RNA, 22 nt, Human
gggaggggguuucaagccagaa

SEQ ID NO: 427449 - RNA, 18 nt, Human
gggcaggggugggggggg

SEQ ID NO: 427450 - RNA, 19 nt, Human
gggcagggguggggggggu

SEQ ID NO: 427451 - RNA, 19 nt, Human
ggggcaggggugggggggg

SEQ ID NO: 427452 - RNA, 20 nt, Human
gggguggggggggugggggg

SEQ ID NO: 427453 - RNA, 22 nt, Human
gggguggggggggugggggggc

SEQ ID NO: 427454 - RNA, 21 nt, Human
ggguggggggggugggggggc

SEQ ID NO: 427455 - RNA, 18 nt, Human
gguggggggggugggggg

SEQ ID NO: 427456 - RNA, 19 nt, Human
gguuaugagggggagaggg

SEQ ID NO: 427457 - RNA, 24 nt, Human
gucuggagucccacacgccaguuc

SEQ ID NO: 427458 - RNA, 20 nt, Human
guuucaagccagaagaagcu

SEQ ID NO: 427459 - RNA, 22 nt, Human
uaaaacuguggaaaaaaaggaa

SEQ ID NO: 427460 - RNA, 21 nt, Human
uaagccggaaaaaaaaaggca

SEQ ID NO: 427461 - RNA, 25 nt, Human
uaagccggaaaaaaaaaggcaucua

SEQ ID NO: 427462 - RNA, 18 nt, Human
uaagugugcgggagacug

SEQ ID NO: 427463 - RNA, 19 nt, Human
uacacaaacccaggcaaga

SEQ ID NO: 427464 - RNA, 26 nt, Human
uacacaaacccaggcaagauuaguca

SEQ ID NO: 427465 - RNA, 22 nt, Human
uacauucaucuuaaugugugug

SEQ ID NO: 427466 - RNA, 24 nt, Human
uagaagcuauacauaaaaaguugu

SEQ ID NO: 427467 - RNA, 22 nt, Human
ucaagacagguuucccccaaaa

SEQ ID NO: 427468 - RNA, 18 nt, Human
ucacauaugaacugggga

SEQ ID NO: 427469 - RNA, 18 nt, Human
ucagaucgggaagaaaaa

SEQ ID NO: 427470 - RNA, 20 nt, Human
ucccacacgccaguucccgg

SEQ ID NO: 427471 - RNA, 23 nt, Human
uccccuuccuccccacuuaaaaa

SEQ ID NO: 427472 - RNA, 21 nt, Human
ucgccaguggagggggcugcu

SEQ ID NO: 427473 - RNA, 23 nt, Human
ucuaaaauaaauaauccaacagu

SEQ ID NO: 427474 - RNA, 21 nt, Human
ucucuuuuuuuuuuuuucccc

SEQ ID NO: 427475 - RNA, 25 nt, Human
ucuuuuuuuuuuuuuccccuuuuag

SEQ ID NO: 427476 - RNA, 20 nt, Human
ugaaaggccuaaagagaaag

SEQ ID NO: 427477 - RNA, 24 nt, Human
ugaaaggccuaaagagaaagaaac

SEQ ID NO: 427478 - RNA, 21 nt, Human
ugagggaaggugcaguugugu

SEQ ID NO: 427479 - RNA, 18 nt, Human
ugaggugcugggggaaag

SEQ ID NO: 427480 - RNA, 18 nt, Human
uggaguaggcaggagguc

SEQ ID NO: 427481 - RNA, 24 nt, Human
uggcacuuaaggcuuaagccggaa

SEQ ID NO: 427482 - RNA, 23 nt, Human
ugggauggguagggagaagaggg

SEQ ID NO: 427483 - RNA, 21 nt, Human
ugggcacguggaagucaaagg

SEQ ID NO: 427484 - RNA, 26 nt, Human
ugggcacguggaagucaaaggguuuc

SEQ ID NO: 427485 - RNA, 21 nt, Human
ugggggaaagggguugagcuu

SEQ ID NO: 427486 - RNA, 22 nt, Human
ugggguuaugagggggagaggg

SEQ ID NO: 427487 - RNA, 20 nt, Human
ugguuccgggucuccacccc

SEQ ID NO: 427488 - RNA, 24 nt, Human
ugucaagacagguuucccccaaaa

SEQ ID NO: 427489 - RNA, 25 nt, Human
ugucacagaacuuuuacauacauuc

SEQ ID NO: 427490 - RNA, 23 nt, Human
ugucuggagucccacacgccagg

SEQ ID NO: 427491 - RNA, 24 nt, Human
uuaacugcucaccccuuacuuuuu

SEQ ID NO: 427492 - RNA, 18 nt, Human
uuccugcagaccuacaca

SEQ ID NO: 427493 - RNA, 19 nt, Human
uugaugugcagugacaagc

SEQ ID NO: 427494 - RNA, 23 nt, Human
uugcucuccaauuucugaaaguu

SEQ ID NO: 427495 - RNA, 22 nt, Human
uuuucagccuuccuuccugcag

SEQ ID NO: 427496 - RNA, 22 nt, Human
aaaacaagaagaaacacaggaa

SEQ ID NO: 427497 - RNA, 19 nt, Human
aaacaagaagaaacacagg

SEQ ID NO: 427498 - RNA, 18 nt, Human
aacauuuuuuacauauau

SEQ ID NO: 427499 - RNA, 22 nt, Human
aagaagaaacacaggaacuguc

SEQ ID NO: 427500 - RNA, 23 nt, Human
aagaagaaacacaggaacuguca

SEQ ID NO: 427501 - RNA, 24 nt, Human
acacauacagagauaagagacaga

SEQ ID NO: 427502 - RNA, 19 nt, Human
agagauaagagacagaggu

SEQ ID NO: 427503 - RNA, 18 nt, Human
caaaacaagaagaaacac

SEQ ID NO: 427504 - RNA, 19 nt, Human
caaaacaagaagaaacaca

SEQ ID NO: 427505 - RNA, 24 nt, Human
cauacagauacauguauauaugca

SEQ ID NO: 427506 - RNA, 20 nt, Human
cccaauggcaaccaccauga

SEQ ID NO: 427507 - RNA, 25 nt, Human
cuaaaggcuuucuaacacucuuuaa

SEQ ID NO: 427508 - RNA, 18 nt, Human
cucccuaccagcacauuu

SEQ ID NO: 427509 - RNA, 26 nt, Human
cuucacaauauaucuugaauaucgcu

SEQ ID NO: 427510 - RNA, 18 nt, Human
gcggcuacccggagggcg

SEQ ID NO: 427511 - RNA, 21 nt, Human
uaaaagguuuuguaucaaguu

SEQ ID NO: 427512 - RNA, 24 nt, Human
uaacaacccuuuuaaaaagauuuc

SEQ ID NO: 427513 - RNA, 26 nt, Human
uaagaaagagcugggugaaaauguca

SEQ ID NO: 427514 - RNA, 21 nt, Human
uacaaaacaagaagaaacaca

SEQ ID NO: 427515 - RNA, 22 nt, Human
uacaaaacaagaagaaacacag

SEQ ID NO: 427516 - RNA, 24 nt, Human
uacaaaacaagaagaaacacagga

SEQ ID NO: 427517 - RNA, 22 nt, Human
uauaugaagauccauuuucaaa

SEQ ID NO: 427518 - RNA, 29 nt, Human
uauaugcauacaaagauacauacacauag

SEQ ID NO: 427519 - RNA, 26 nt, Human
uauucacauacagauacauguauaua

SEQ ID NO: 427520 - RNA, 23 nt, Human
uauucuguauuuuuucaaagucu

SEQ ID NO: 427521 - RNA, 25 nt, Human
uauuuuuuauaaaagguuuuguauc

SEQ ID NO: 427522 - RNA, 21 nt, Human
ucaaagaggcuuauacagaug

SEQ ID NO: 427523 - RNA, 23 nt, Human
uccuagaccccaguccuauacuc

SEQ ID NO: 427524 - RNA, 23 nt, Human
uccucugcccaauggcaaccacc

SEQ ID NO: 427525 - RNA, 19 nt, Human
ugaacauguagaucauuua

SEQ ID NO: 427526 - RNA, 23 nt, Human
ugaagauccauuuucaaaguuuc

SEQ ID NO: 427527 - RNA, 23 nt, Human
ugaugcagaagccaacacagaca

SEQ ID NO: 427528 - RNA, 19 nt, Human
ugcuccuauccuagacccc

SEQ ID NO: 427529 - RNA, 28 nt, Human
uguauauaugcauacaaagauacauaca

SEQ ID NO: 427530 - RNA, 22 nt, Human
ugucaaagaggcuuauacagau

SEQ ID NO: 427531 - RNA, 26 nt, Human
uucucauguacaacaaggugugacau

SEQ ID NO: 427532 - RNA, 18 nt, Human
uugcuuugaauauucaaa

SEQ ID NO: 427533 - RNA, 18 nt, Human
uuguuucuccauugcuuu

SEQ ID NO: 427534 - RNA, 19 nt, Human
uuuuccuguuaacauuuuu

SEQ ID NO: 427535 - RNA, 22 nt, Human
aagaacuaaggcugaaggaugg

SEQ ID NO: 427536 - RNA, 24 nt, Human
aagaacuaaggcugaaggauggga

SEQ ID NO: 427537 - RNA, 19 nt, Human
aagaauucauguccuaacc

SEQ ID NO: 427538 - RNA, 21 nt, Human
aggcagaguuccggggaagug

SEQ ID NO: 427539 - RNA, 21 nt, Human
aggcuacuugcaggauuccuu

SEQ ID NO: 427540 - RNA, 19 nt, Human
aguagaaaacagacuagaa

SEQ ID NO: 427541 - RNA, 21 nt, Human
auguaaauugcagggucacau

SEQ ID NO: 427542 - RNA, 22 nt, Human
caacugaugauacacuguacaa

SEQ ID NO: 427543 - RNA, 20 nt, Human
cagauccgaccucgccuucc

SEQ ID NO: 427544 - RNA, 21 nt, Human
ccuccuucugggaaaaggcag

SEQ ID NO: 427545 - RNA, 19 nt, Human
cuccugugcagacuccgac

SEQ ID NO: 427546 - RNA, 21 nt, Human
gaaauaugacguuuguaaaga

SEQ ID NO: 427547 - RNA, 21 nt, Human
gccucucuccugugcagacuc

SEQ ID NO: 427548 - RNA, 23 nt, Human
ggacuucccaacggagacaaaga

SEQ ID NO: 427549 - RNA, 18 nt, Human
ggugaaaaacaccuccuu

SEQ ID NO: 427550 - RNA, 20 nt, Human
gugaaaaacaccuccuuaca

SEQ ID NO: 427551 - RNA, 18 nt, Human
uaaaacacagcauuugag

SEQ ID NO: 427552 - RNA, 18 nt, Human
uacaaagaacuaaggcug

SEQ ID NO: 427553 - RNA, 22 nt, Human
uacaaagaacuaaggcugaagg

SEQ ID NO: 427554 - RNA, 23 nt, Human
uacaucuugagaaccgggacacc

SEQ ID NO: 427555 - RNA, 23 nt, Human
uagaaaacagacuagaauuuuca

SEQ ID NO: 427556 - RNA, 19 nt, Human
ucacauuagauaaaaacag

SEQ ID NO: 427557 - RNA, 19 nt, Human
ucccaacggagacaaagau

SEQ ID NO: 427558 - RNA, 19 nt, Human
ucccugggagauaucucag

SEQ ID NO: 427559 - RNA, 23 nt, Human
uccuaaccaagucuaaaacacag

SEQ ID NO: 427560 - RNA, 24 nt, Human
ucuucaguaauugcugggcccuau

SEQ ID NO: 427561 - RNA, 23 nt, Human
ugaaaaacaccuccuuacauaga

SEQ ID NO: 427562 - RNA, 22 nt, Human
ugagagacuucuuuccugucaa

SEQ ID NO: 427563 - RNA, 21 nt, Human
ugagcucuaacugaaggcuga

SEQ ID NO: 427564 - RNA, 22 nt, Human
ugaugauacacuguacaaagaa

SEQ ID NO: 427565 - RNA, 22 nt, Human
uggcaguauuauauacuuuuca

SEQ ID NO: 427566 - RNA, 19 nt, Human
ugguagagauagaguggug

SEQ ID NO: 427567 - RNA, 21 nt, Human
uguaaagaauucauguccuaa

SEQ ID NO: 427568 - RNA, 22 nt, Human
ugucaagauucuuugaagcucu

SEQ ID NO: 427569 - RNA, 18 nt, Human
uguuaguauggauggcag

SEQ ID NO: 427570 - RNA, 21 nt, Human
uugcaggauuccuuuugaaua

SEQ ID NO: 427571 - RNA, 28 nt, Human
uuugagagacuucuuuccugucaagauu

SEQ ID NO: 427572 - RNA, 20 nt, Human
uuuuccccuccuccuucugg

SEQ ID NO: 427573 - RNA, 24 nt, Human
aggaguucgagaccagccuggggc

SEQ ID NO: 427574 - RNA, 22 nt, Human
aucuuaaucuugaacauccacu

SEQ ID NO: 427575 - RNA, 24 nt, Human
caaacugaauagaauucagaacac

SEQ ID NO: 427576 - RNA, 19 nt, Human
cagcaaaacaauucuaucu

SEQ ID NO: 427577 - RNA, 23 nt, Human
cagcauaaaucaauauacaguau

SEQ ID NO: 427578 - RNA, 22 nt, Human
cagcucagggaacagacggcag

SEQ ID NO: 427579 - RNA, 20 nt, Human
ccaggaguucgagaccagcc

SEQ ID NO: 427580 - RNA, 23 nt, Human
cuagcauguugccaguuuucccu

SEQ ID NO: 427581 - RNA, 21 nt, Human
gaacacacuacugagcaaaau

SEQ ID NO: 427582 - RNA, 22 nt, Human
gcccaggaguucgagaccagcc

SEQ ID NO: 427583 - RNA, 18 nt, Human
ggcagugacaggcgggca

SEQ ID NO: 427584 - RNA, 24 nt, Human
ggccaauaucucuacaaacguucu

SEQ ID NO: 427585 - RNA, 21 nt, Human
uaaaauucuaagauauaaaac

SEQ ID NO: 427586 - RNA, 23 nt, Human
uaaagcacagcucagggaacaga

SEQ ID NO: 427587 - RNA, 23 nt, Human
uaacuagcauguugccaguuuuc

SEQ ID NO: 427588 - RNA, 20 nt, Human
uauagcaagaaccggacgga

SEQ ID NO: 427589 - RNA, 22 nt, Human
ucacacaacuugacucuaaucu

SEQ ID NO: 427590 - RNA, 18 nt, Human
ucagaacacacuacugag

SEQ ID NO: 427591 - RNA, 24 nt, Human
ucagucacagcuccugucuuaauc

SEQ ID NO: 427592 - RNA, 25 nt, Human
ucccagcguaaagcacaggguaccc

SEQ ID NO: 427593 - RNA, 23 nt, Human
ucuaucuucuuaauaguucuucu

SEQ ID NO: 427594 - RNA, 24 nt, Human
ucucuacaaacguucuguagaagu

SEQ ID NO: 427595 - RNA, 22 nt, Human
ugaauagaauucagaacacacu

SEQ ID NO: 427596 - RNA, 23 nt, Human
ugagcccaggaguucgagaccag

SEQ ID NO: 427597 - RNA, 24 nt, Human
uguacacagcauaaaucaauauac

SEQ ID NO: 427598 - RNA, 25 nt, Human
ugugaaugagacugauuggcuuuaa

SEQ ID NO: 427599 - RNA, 18 nt, Human
uguugccaguuuucccua

SEQ ID NO: 427600 - RNA, 23 nt, Human
uuaauaguucuucuaugucuuuc

SEQ ID NO: 427601 - RNA, 22 nt, Human
uugagcccaggaguucgagacc

SEQ ID NO: 427602 - RNA, 22 nt, Human
gaugugaacaagacuggcuuua

SEQ ID NO: 427603 - RNA, 23 nt, Human
guaaagaaaaguggacuagaagc

SEQ ID NO: 427604 - RNA, 24 nt, Human
guauaguaauggaugugaacaaga

SEQ ID NO: 427605 - RNA, 21 nt, Human
uguaaagaaaaguggacuaga

SEQ ID NO: 427606 - RNA, 24 nt, Human
uguaaagaaaaguggacuagaagc

SEQ ID NO: 427607 - RNA, 21 nt, Human
ugugaacaagacuggcuuuaa

SEQ ID NO: 427608 - RNA, 22 nt, Human
uuaaagaaacugaauaggauuc

SEQ ID NO: 427609 - RNA, 21 nt, Human
aaaaaagccacccacaaagcc

SEQ ID NO: 427610 - RNA, 19 nt, Human
aaaaagccacccacaaagc

SEQ ID NO: 427611 - RNA, 18 nt, Human
aaaagaaaaaaaaaaagc

SEQ ID NO: 427612 - RNA, 19 nt, Human
aaaagccacccacaaagcc

SEQ ID NO: 427613 - RNA, 29 nt, Human
aaagggagcaauuuaaucauuucagaggg

SEQ ID NO: 427614 - RNA, 20 nt, Human
aacacucccaugauucauaa

SEQ ID NO: 427615 - RNA, 21 nt, Human
aagaaguuuuuaaacguguaa

SEQ ID NO: 427616 - RNA, 23 nt, Human
aagggccagugaaaccauaaaau

SEQ ID NO: 427617 - RNA, 19 nt, Human
aaucagcuucuaauggaac

SEQ ID NO: 427618 - RNA, 20 nt, Human
agaaagucuaagauucagaa

SEQ ID NO: 427619 - RNA, 19 nt, Human
agacauaguaauaaaucag

SEQ ID NO: 427620 - RNA, 21 nt, Human
agcuauaguuaaaaaauaaaa

SEQ ID NO: 427621 - RNA, 22 nt, Human
aucacaucucaaagaauagagg

SEQ ID NO: 427622 - RNA, 19 nt, Human
augaaaaaagccacccaca

SEQ ID NO: 427623 - RNA, 19 nt, Human
auggaacaaguaacaguag

SEQ ID NO: 427624 - RNA, 19 nt, Human
caauaugaaugaacagcac

SEQ ID NO: 427625 - RNA, 21 nt, Human
cagaaaaacauguuaaaaucc

SEQ ID NO: 427626 - RNA, 23 nt, Human
cagagugcuuuaagaaguuuuua

SEQ ID NO: 427627 - RNA, 23 nt, Human
caguagaaacagugguauucaug

SEQ ID NO: 427628 - RNA, 22 nt, Human
caguaguaugaaaaaagccacc

SEQ ID NO: 427629 - RNA, 21 nt, Human
cauuacggucuuuacauugcu

SEQ ID NO: 427630 - RNA, 25 nt, Human
cauucagaaaaacauguuaaaaucc

SEQ ID NO: 427631 - RNA, 22 nt, Human
ccucagaaagucuaagauucag

SEQ ID NO: 427632 - RNA, 21 nt, Human
cuaguggucauuaaacccccu

SEQ ID NO: 427633 - RNA, 21 nt, Human
cugcaguaguuuaacuuuggc

SEQ ID NO: 427634 - RNA, 23 nt, Human
cuguauaaacauuucugauuucc

SEQ ID NO: 427635 - RNA, 22 nt, Human
gccccaaaacguuuucaauguc

SEQ ID NO: 427636 - RNA, 19 nt, Human
ggccagugaaaccauaaaa

SEQ ID NO: 427637 - RNA, 23 nt, Human
gugaaaagcuaacuuuuaacuca

SEQ ID NO: 427638 - RNA, 24 nt, Human
uaaaaaauaaaaaguuuauaaaaa

SEQ ID NO: 427639 - RNA, 24 nt, Human
uaaacguguaaaagaaaaaaaaaa

SEQ ID NO: 427640 - RNA, 18 nt, Human
uaaguuccauuucuuuug

SEQ ID NO: 427641 - RNA, 22 nt, Human
uacuacgugauucuuuuucaca

SEQ ID NO: 427642 - RNA, 22 nt, Human
ucccaauaugaaugaacagcac

SEQ ID NO: 427643 - RNA, 26 nt, Human
ucccaauaugaaugaacaggguaccc

SEQ ID NO: 427644 - RNA, 18 nt, Human
ucuuuuucacauuuuugg

SEQ ID NO: 427645 - RNA, 24 nt, Human
ugaaaaaagccacccacaaagcca

SEQ ID NO: 427646 - RNA, 21 nt, Human
ugaggacaagcucuagugguc

SEQ ID NO: 427647 - RNA, 21 nt, Human
uggaauuacuaauaaagcuau

SEQ ID NO: 427648 - RNA, 23 nt, Human
uggcugaaaaacauuuaaccaag

SEQ ID NO: 427649 - RNA, 24 nt, Human
ugggcaaauucacaguaaaucaga

SEQ ID NO: 427650 - RNA, 20 nt, Human
uguuauaaaauuucacugaa

SEQ ID NO: 427651 - RNA, 27 nt, Human
uguucuauuuacauugcagaacuucca

SEQ ID NO: 427652 - RNA, 25 nt, Human
uuaaaaaaguuaacaguaguaugaa

SEQ ID NO: 427653 - RNA, 22 nt, Human
uucacauuuuuggugcaguauu

SEQ ID NO: 427654 - RNA, 21 nt, Human
uucauggauguguuuaaugaa

SEQ ID NO: 427655 - RNA, 23 nt, Human
uuucaacauauauaaauaggcug

SEQ ID NO: 427656 - RNA, 24 nt, Human
uuuucauaacauuuucaauggcug

SEQ ID NO: 427657 - RNA, 24 nt, Human
uuuuuuuuuuuguuuauaaaaggg

SEQ ID NO: 427658 - RNA, 18 nt, Human
uuuuuuuuuuuuuuuuug

SEQ ID NO: 427659 - RNA, 25 nt, Human
aaaaaaaaaaaaaaagugggugggg

SEQ ID NO: 427660 - RNA, 28 nt, Human
aaaaaaaaaagugggugggggggugaag

SEQ ID NO: 427661 - RNA, 30 nt, Human
aaaaaagaaaaauaaugaaagcgaaaggaa

SEQ ID NO: 427662 - RNA, 20 nt, Human
aaaaagaagccgaagcccca

SEQ ID NO: 427663 - RNA, 19 nt, Human
aaaaagccaaagaaaaggc

SEQ ID NO: 427664 - RNA, 21 nt, Human
aaaacaaagaaaaaaagaagc

SEQ ID NO: 427665 - RNA, 18 nt, Human
aaagaaaaggcgcaaauc

SEQ ID NO: 427666 - RNA, 22 nt, Human
aaagaaagaaaaagccaaagaa

SEQ ID NO: 427667 - RNA, 19 nt, Human
aaagaggauugcggggucu

SEQ ID NO: 427668 - RNA, 20 nt, Human
aaaguguacauacgaguucu

SEQ ID NO: 427669 - RNA, 21 nt, Human
aaauaaugaaagcgaaaggaa

SEQ ID NO: 427670 - RNA, 23 nt, Human
aagaaaaagccaaagaaaaggcg

SEQ ID NO: 427671 - RNA, 23 nt, Human
aagaaagaaagaaaaagccaaag

SEQ ID NO: 427672 - RNA, 27 nt, Human
aagaaagaaagaaaaagccaaagaaaa

SEQ ID NO: 427673 - RNA, 22 nt, Human
aauaggguuuuguucgauguuu

SEQ ID NO: 427674 - RNA, 18 nt, Human
acaaagaaaaaaagaagc

SEQ ID NO: 427675 - RNA, 21 nt, Human
acaaagaaaaaaagaagccga

SEQ ID NO: 427676 - RNA, 20 nt, Human
acccucgccagccgaggagg

SEQ ID NO: 427677 - RNA, 21 nt, Human
acgaguucuucuagccauaaa

SEQ ID NO: 427678 - RNA, 25 nt, Human
acuaaaguguacauacgaguucuuc

SEQ ID NO: 427679 - RNA, 18 nt, Human
acuagccccucgcccuuu

SEQ ID NO: 427680 - RNA, 23 nt, Human
acugcuucgcccucucuccgccu

SEQ ID NO: 427681 - RNA, 26 nt, Human
agaaagaaagaaaaagccaaagaaaa

SEQ ID NO: 427682 - RNA, 19 nt, Human
agaagaggaggagggaggg

SEQ ID NO: 427683 - RNA, 20 nt, Human
agaggaggagggagggugaa

SEQ ID NO: 427684 - RNA, 18 nt, Human
agcccccuaaaaaaaaac

SEQ ID NO: 427685 - RNA, 18 nt, Human
agcccguaccaauucgac

SEQ ID NO: 427686 - RNA, 22 nt, Human
agccgaagccccagagagcccg

SEQ ID NO: 427687 - RNA, 18 nt, Human
aggaagaagaggaggagg

SEQ ID NO: 427688 - RNA, 18 nt, Human
aggaagaagaggaggagg

SEQ ID NO: 427689 - RNA, 22 nt, Human
aggaagaggaggaagaagagga

SEQ ID NO: 427690 - RNA, 19 nt, Human
aggaggaacaagaggagga

SEQ ID NO: 427691 - RNA, 22 nt, Human
aggaggaagaggaggaagaaga

SEQ ID NO: 427692 - RNA, 18 nt, Human
aggaggagggagggugag

SEQ ID NO: 427693 - RNA, 19 nt, Human
auagccaggaacugagagc

SEQ ID NO: 427694 - RNA, 19 nt, Human
aucccacccacccgcucca

SEQ ID NO: 427695 - RNA, 18 nt, Human
auccggucccuccccccu

SEQ ID NO: 427696 - RNA, 24 nt, Human
auccggucccuccccccuccccca

SEQ ID NO: 427697 - RNA, 24 nt, Human
auccggucccuccccccuccccca

SEQ ID NO: 427698 - RNA, 18 nt, Human
auggagcaucucagcccc

SEQ ID NO: 427699 - RNA, 24 nt, Human
caaaguagccggacggcugcgggc

SEQ ID NO: 427700 - RNA, 23 nt, Human
caagaaaacaaagaaaaaaagaa

SEQ ID NO: 427701 - RNA, 23 nt, Human
cacccacccgcuccaaccgagau

SEQ ID NO: 427702 - RNA, 19 nt, Human
caccucgcgaaguccuagc

SEQ ID NO: 427703 - RNA, 19 nt, Human
ccaaacgcaaaguagccgg

SEQ ID NO: 427704 - RNA, 22 nt, Human
ccaccccucccccucccccucc

SEQ ID NO: 427705 - RNA, 27 nt, Human
cccaaugcaaagaccacaagguacccc

SEQ ID NO: 427706 - RNA, 20 nt, Human
cccauccggucccucccccc

SEQ ID NO: 427707 - RNA, 21 nt, Human
cccccaaugcaaagaccacaa

SEQ ID NO: 427708 - RNA, 21 nt, Human
cccccccacccucgccagccg

SEQ ID NO: 427709 - RNA, 23 nt, Human
ccccccccacccucgccagccga

SEQ ID NO: 427710 - RNA, 21 nt, Human
cccccgccccccccacccucg

SEQ ID NO: 427711 - RNA, 28 nt, Human
cccccuaccgcaccuuggguaccaagcc

SEQ ID NO: 427712 - RNA, 19 nt, Human
ccccggccucccccgcccc

SEQ ID NO: 427713 - RNA, 21 nt, Human
ccccggccucccccgcccccc

SEQ ID NO: 427714 - RNA, 26 nt, Human
ccccggccucccccgccccccccacc

SEQ ID NO: 427715 - RNA, 19 nt, Human
ccccuaaaaaaaaacuucc

SEQ ID NO: 427716 - RNA, 23 nt, Human
cccggccucccccgcccccccca

SEQ ID NO: 427717 - RNA, 18 nt, Human
ccggucccuccccccucc

SEQ ID NO: 427718 - RNA, 24 nt, Human
ccuaaaaaaaaacuuccuccugga

SEQ ID NO: 427719 - RNA, 19 nt, Human
ccuaccgcaccuuggguac

SEQ ID NO: 427720 - RNA, 20 nt, Human
ccucccccaaugcaaagacu

SEQ ID NO: 427721 - RNA, 23 nt, Human
ccuccccccucccccaaugcaaa

SEQ ID NO: 427722 - RNA, 22 nt, Human
ccucccccucccccuccccccg

SEQ ID NO: 427723 - RNA, 30 nt, Human
ccucucugcuuuuugaaaaaaaaaaaaaaa

SEQ ID NO: 427724 - RNA, 20 nt, Human
ccuuucuuuucucucucucc

SEQ ID NO: 427725 - RNA, 20 nt, Human
cgccccuccuuccuuccucc

SEQ ID NO: 427726 - RNA, 27 nt, Human
cgcuccaaccgagauauaacuauuuac

SEQ ID NO: 427727 - RNA, 24 nt, Human
cggccgcccaccccucccccuccc

SEQ ID NO: 427728 - RNA, 22 nt, Human
cggccucccccgccccccccac

SEQ ID NO: 427729 - RNA, 24 nt, Human
cggccucccccgccccccccaccc

SEQ ID NO: 427730 - RNA, 23 nt, Human
cggcugcgggccgcgaguaacgc

SEQ ID NO: 427731 - RNA, 20 nt, Human
cggucccuccccccuccccc

SEQ ID NO: 427732 - RNA, 22 nt, Human
cucccccuccccccgcccaucc

SEQ ID NO: 427733 - RNA, 23 nt, Human
cucccccucgacccccuaccgca

SEQ ID NO: 427734 - RNA, 18 nt, Human
cuccucccccucgacccc

SEQ ID NO: 427735 - RNA, 24 nt, Human
cuccucccccucgacccccuaccg

SEQ ID NO: 427736 - RNA, 21 nt, Human
cuccucgcuccuucacucucc

SEQ ID NO: 427737 - RNA, 26 nt, Human
cugcuucgcccucucuccgccucgcg

SEQ ID NO: 427738 - RNA, 18 nt, Human
cuucgcccucucuccgcc

SEQ ID NO: 427739 - RNA, 22 nt, Human
cuuucaccuccucagccgggcg

SEQ ID NO: 427740 - RNA, 20 nt, Human
cuuucggccgcccaccccuc

SEQ ID NO: 427741 - RNA, 21 nt, Human
gaagaggaggagggaggguga

SEQ ID NO: 427742 - RNA, 21 nt, Human
gacacgcagauccaggcucgu

SEQ ID NO: 427743 - RNA, 21 nt, Human
gagccccggccucccccgccc

SEQ ID NO: 427744 - RNA, 18 nt, Human
gauugcggggucugugug

SEQ ID NO: 427745 - RNA, 18 nt, Human
gcauuuggucagguggcc

SEQ ID NO: 427746 - RNA, 27 nt, Human
gcccaccccucccccucccccuccccc

SEQ ID NO: 427747 - RNA, 21 nt, Human
gccccccccacccucgccagc

SEQ ID NO: 427748 - RNA, 22 nt, Human
gccccucgcccuuucuuuucuc

SEQ ID NO: 427749 - RNA, 19 nt, Human
gccucccccgcccccccca

SEQ ID NO: 427750 - RNA, 18 nt, Human
gcucggggcgagccccgg

SEQ ID NO: 427751 - RNA, 20 nt, Human
ggacaguuauaguuuauauc

SEQ ID NO: 427752 - RNA, 18 nt, Human
ggaggaagaagaggagga

SEQ ID NO: 427753 - RNA, 18 nt, Human
ggaggaggaagaggagga

SEQ ID NO: 427754 - RNA, 22 nt, Human
ggagggaaaaucgggaggagga

SEQ ID NO: 427755 - RNA, 28 nt, Human
ggggagaaacuuucaccuccucaggacc

SEQ ID NO: 427756 - RNA, 23 nt, Human
guaacgcaggcuccagcgcccgc

SEQ ID NO: 427757 - RNA, 22 nt, Human
uaaaaaaaaacuuccuccugga

SEQ ID NO: 427758 - RNA, 22 nt, Human
uaacauggauaaaccggcccuu

SEQ ID NO: 427759 - RNA, 19 nt, Human
uaauguuguguauacgugu

SEQ ID NO: 427760 - RNA, 24 nt, Human
uacuauacgaauucuugacaggac

SEQ ID NO: 427761 - RNA, 18 nt, Human
ucacgcucgccuccucgc

SEQ ID NO: 427762 - RNA, 23 nt, Human
ucacucuccguuuuucccucucu

SEQ ID NO: 427763 - RNA, 25 nt, Human
ucccccgccccccccacccucgcca

SEQ ID NO: 427764 - RNA, 19 nt, Human
ucccccucccccucccccc

SEQ ID NO: 427765 - RNA, 24 nt, Human
ucccuccccccucccccaaugcaa

SEQ ID NO: 427766 - RNA, 23 nt, Human
ucgcuccuucacucuccguuuuu

SEQ ID NO: 427767 - RNA, 22 nt, Human
ucgggaggaggaggaggaacaa

SEQ ID NO: 427768 - RNA, 18 nt, Human
ucuguauuuacaagaaaa

SEQ ID NO: 427769 - RNA, 21 nt, Human
ucuucuagccauaaauauuga

SEQ ID NO: 427770 - RNA, 20 nt, Human
ucuuuucucucucucuccuu

SEQ ID NO: 427771 - RNA, 25 nt, Human
ugaaacaacauuuuacugcacuaaa

SEQ ID NO: 427772 - RNA, 23 nt, Human
ugaagaaagaaagaaaaagccaa

SEQ ID NO: 427773 - RNA, 18 nt, Human
ugacaggacaugaaacaa

SEQ ID NO: 427774 - RNA, 19 nt, Human
ugagcgcgagacugauagu

SEQ ID NO: 427775 - RNA, 22 nt, Human
ugcaggcaauggcgcgcgcgcg

SEQ ID NO: 427776 - RNA, 23 nt, Human
uggccuccucccccucgaccccc

SEQ ID NO: 427777 - RNA, 24 nt, Human
uggcggcauuuggucagguggccu

SEQ ID NO: 427778 - RNA, 23 nt, Human
ugggggggugaagaaagaaagaa

SEQ ID NO: 427779 - RNA, 24 nt, Human
ugggugggggggugaagaaagaaa

SEQ ID NO: 427780 - RNA, 20 nt, Human
uguuguguauacguguguga

SEQ ID NO: 427781 - RNA, 22 nt, Human
uuacugcacuaaaguacuuaga

SEQ ID NO: 427782 - RNA, 20 nt, Human
uucuguauuuacaagaaaac

SEQ ID NO: 427783 - RNA, 18 nt, Human
uugaugcuuccucucuuu

SEQ ID NO: 427784 - RNA, 23 nt, Human
uuggcagauuuuuuaaaagagga

SEQ ID NO: 427785 - RNA, 21 nt, Human
uuuacuagaacauucuugcca

SEQ ID NO: 427786 - RNA, 28 nt, Human
uuucuuuucucucucucuccuuucucuc

SEQ ID NO: 427787 - RNA, 24 nt, Human
aaaaaaaaaguuuauuacaaaagg

SEQ ID NO: 427788 - RNA, 20 nt, Human
aaaauaguaaguggagggcg

SEQ ID NO: 427789 - RNA, 20 nt, Human
aaacgucacaauguguagag

SEQ ID NO: 427790 - RNA, 19 nt, Human
aaacugacacuguaaggaa

SEQ ID NO: 427791 - RNA, 18 nt, Human
aaagaaaaauaagcaaaa

SEQ ID NO: 427792 - RNA, 19 nt, Human
aacaucaccaccaccaaca

SEQ ID NO: 427793 - RNA, 23 nt, Human
aacucgcaguuaaacaaccaucu

SEQ ID NO: 427794 - RNA, 21 nt, Human
aagaggaaggggaagaaaaag

SEQ ID NO: 427795 - RNA, 26 nt, Human
aaggggaagaaaaaguaguguaaaga

SEQ ID NO: 427796 - RNA, 19 nt, Human
aagggguggcggcgguugg

SEQ ID NO: 427797 - RNA, 18 nt, Human
acaaaacaagagaaagga

SEQ ID NO: 427798 - RNA, 19 nt, Human
acaaaacaagagaaaggag

SEQ ID NO: 427799 - RNA, 20 nt, Human
acaaaacaagagaaaggagu

SEQ ID NO: 427800 - RNA, 23 nt, Human
acaucaccaccaccaacaagccu

SEQ ID NO: 427801 - RNA, 22 nt, Human
acucgccgccucgugccgaauu

SEQ ID NO: 427802 - RNA, 20 nt, Human
acugaauugaucaguaauau

SEQ ID NO: 427803 - RNA, 26 nt, Human
agaaagagcagggaggggguguuggc

SEQ ID NO: 427804 - RNA, 19 nt, Human
agaagaaggcuguuacaaa

SEQ ID NO: 427805 - RNA, 20 nt, Human
agacugugagaguuuaaaca

SEQ ID NO: 427806 - RNA, 20 nt, Human
agagagcaagaggaagggga

SEQ ID NO: 427807 - RNA, 18 nt, Human
aggagggaggagaaggga

SEQ ID NO: 427808 - RNA, 25 nt, Human
aggagggaggaggggaagaaagagc

SEQ ID NO: 427809 - RNA, 21 nt, Human
agggaggggguguuggcgggg

SEQ ID NO: 427810 - RNA, 21 nt, Human
aggggaagaaagagcagggag

SEQ ID NO: 427811 - RNA, 18 nt, Human
agugcacagaaccgcggg

SEQ ID NO: 427812 - RNA, 24 nt, Human
auagauugauaggcagauuagaua

SEQ ID NO: 427813 - RNA, 22 nt, Human
auguagcccuauauauggccuc

SEQ ID NO: 427814 - RNA, 20 nt, Human
caaaauaguaaguggagggc

SEQ ID NO: 427815 - RNA, 26 nt, Human
caaggcgcuaccaggggcugcaacuu

SEQ ID NO: 427816 - RNA, 24 nt, Human
cacaggcgauccggccgaagugag

SEQ ID NO: 427817 - RNA, 20 nt, Human
caccacuaaggcgaaaaaga

SEQ ID NO: 427818 - RNA, 22 nt, Human
cagauuagauaagucauagaua

SEQ ID NO: 427819 - RNA, 23 nt, Human
cagccugaaaaaauacugaacaa

SEQ ID NO: 427820 - RNA, 22 nt, Human
caguuucgacccuauuagacaa

SEQ ID NO: 427821 - RNA, 22 nt, Human
cauagauacaaacauauauagg

SEQ ID NO: 427822 - RNA, 19 nt, Human
ccggcuagcggccgggcag

SEQ ID NO: 427823 - RNA, 21 nt, Human
ccuggguaccggccuccgggc

SEQ ID NO: 427824 - RNA, 22 nt, Human
ccuuaaaacuccauuuccaucu

SEQ ID NO: 427825 - RNA, 23 nt, Human
ccuuauguuuauauauguagggc

SEQ ID NO: 427826 - RNA, 20 nt, Human
cgaaggaggagaucuccgaa

SEQ ID NO: 427827 - RNA, 18 nt, Human
cggaaagggguggcggcg

SEQ ID NO: 427828 - RNA, 23 nt, Human
cggggccaggaggcucccugggu

SEQ ID NO: 427829 - RNA, 19 nt, Human
cguuacucgccgccucgug

SEQ ID NO: 427830 - RNA, 19 nt, Human
cuauauauggccucuugcc

SEQ ID NO: 427831 - RNA, 21 nt, Human
cugucccgggcaccccuccuc

SEQ ID NO: 427832 - RNA, 21 nt, Human
cuuuccgucacugcaagaguc

SEQ ID NO: 427833 - RNA, 21 nt, Human
gagauagagauaaagaaagga

SEQ ID NO: 427834 - RNA, 24 nt, Human
gaggggaagaaagagcagggaggg

SEQ ID NO: 427835 - RNA, 18 nt, Human
gagucagugguuccaaaa

SEQ ID NO: 427836 - RNA, 18 nt, Human
gagugcacagaaccgcgg

SEQ ID NO: 427837 - RNA, 20 nt, Human
gcaccccuccucuccccgag

SEQ ID NO: 427838 - RNA, 24 nt, Human
gccgaagugagagaggguaccggu

SEQ ID NO: 427839 - RNA, 21 nt, Human
ggaagaaaaaguaguguaaag

SEQ ID NO: 427840 - RNA, 20 nt, Human
ggaggcucccuggguaccgg

SEQ ID NO: 427841 - RNA, 19 nt, Human
ggaggggguguuggcgggg

SEQ ID NO: 427842 - RNA, 18 nt, Human
gggcacaggcgauccggc

SEQ ID NO: 427843 - RNA, 18 nt, Human
ggggaggaggagggagga

SEQ ID NO: 427844 - RNA, 25 nt, Human
gggggaggaggagggaggagaaggg

SEQ ID NO: 427845 - RNA, 19 nt, Human
gguaauaaagaacuaaggg

SEQ ID NO: 427846 - RNA, 21 nt, Human
ggugugcagagagcaagagga

SEQ ID NO: 427847 - RNA, 20 nt, Human
gucuucccagauggaaacug

SEQ ID NO: 427848 - RNA, 22 nt, Human
uaaaaaaugcuucaaaugccaa

SEQ ID NO: 427849 - RNA, 23 nt, Human
uaaacaaucaccacuaaggcgaa

SEQ ID NO: 427850 - RNA, 22 nt, Human
uaaagcaguuauaaucaaaagc

SEQ ID NO: 427851 - RNA, 21 nt, Human
uaaauauggcaucaauggaua

SEQ ID NO: 427852 - RNA, 20 nt, Human
uaaauggacuaugguuucuu

SEQ ID NO: 427853 - RNA, 25 nt, Human
uaacaucaccaccaccaacaagccu

SEQ ID NO: 427854 - RNA, 25 nt, Human
uaacuuccucucaagaaacaggaca

SEQ ID NO: 427855 - RNA, 20 nt, Human
uaauuugcucacaucuccuc

SEQ ID NO: 427856 - RNA, 20 nt, Human
uacaaacgauaaauauggca

SEQ ID NO: 427857 - RNA, 25 nt, Human
uaccggccuccgggcugggcugcgc

SEQ ID NO: 427858 - RNA, 18 nt, Human
uagauacaaacauauaua

SEQ ID NO: 427859 - RNA, 21 nt, Human
uauccugagaaaagggcaugg

SEQ ID NO: 427860 - RNA, 25 nt, Human
uauggauuggaacuauauacagcaa

SEQ ID NO: 427861 - RNA, 20 nt, Human
uauguuuauauauguagggc

SEQ ID NO: 427862 - RNA, 18 nt, Human
uccaggacaaacacauuu

SEQ ID NO: 427863 - RNA, 20 nt, Human
ucccgggcaccccuccucuc

SEQ ID NO: 427864 - RNA, 20 nt, Human
ucccuggguaccggccuccg

SEQ ID NO: 427865 - RNA, 18 nt, Human
uccugucccgggcacccc

SEQ ID NO: 427866 - RNA, 19 nt, Human
ucuagauagaacagacaga

SEQ ID NO: 427867 - RNA, 20 nt, Human
ucuccucuuuguagaagaag

SEQ ID NO: 427868 - RNA, 21 nt, Human
ugacacuguaaggaauuuaua

SEQ ID NO: 427869 - RNA, 20 nt, Human
ugcggggagacccccaaggc

SEQ ID NO: 427870 - RNA, 22 nt, Human
ugugagaguuuaaacaaucacc

SEQ ID NO: 427871 - RNA, 21 nt, Human
uuaaccauaaguaagcaaugc

SEQ ID NO: 427872 - RNA, 22 nt, Human
uucccggcacuuguugcaauaa

SEQ ID NO: 427873 - RNA, 23 nt, Human
uugcaugccgaaaauccaggaca

SEQ ID NO: 427874 - RNA, 20 nt, Human
uuggcggggggaggaggagg

SEQ ID NO: 427875 - RNA, 22 nt, Human
uuguucaguucccggcacuugu

SEQ ID NO: 427876 - RNA, 20 nt, Human
aacaauacaauagaacaacu

SEQ ID NO: 427877 - RNA, 22 nt, Human
aauacauagacucuuuuccuua

SEQ ID NO: 427878 - RNA, 22 nt, Human
aaugcuuucccacauuccauac

SEQ ID NO: 427879 - RNA, 19 nt, Human
accaagugcuuacauucac

SEQ ID NO: 427880 - RNA, 21 nt, Human
aggcugccucagaacuuccag

SEQ ID NO: 427881 - RNA, 18 nt, Human
aucaagggaugacuguac

SEQ ID NO: 427882 - RNA, 23 nt, Human
cagccagacaaaggcugccucag

SEQ ID NO: 427883 - RNA, 18 nt, Human
cauggcucacggagugcu

SEQ ID NO: 427884 - RNA, 22 nt, Human
ccaauacccagcagguaucaag

SEQ ID NO: 427885 - RNA, 21 nt, Human
ccaaugcguguuccagccaga

SEQ ID NO: 427886 - RNA, 19 nt, Human
gggaguugaaacaaagaaa

SEQ ID NO: 427887 - RNA, 22 nt, Human
uaaaagggacuggacauggcuc

SEQ ID NO: 427888 - RNA, 21 nt, Human
uaaaauuaauaaaugcuuucc

SEQ ID NO: 427889 - RNA, 23 nt, Human
uaaacaauacaauagaacaacua

SEQ ID NO: 427890 - RNA, 30 nt, Human
uacauagacucuuuuccuuaucaugauucu

SEQ ID NO: 427891 - RNA, 22 nt, Human
ucccagguccuaccgacagcuc

SEQ ID NO: 427892 - RNA, 25 nt, Human
ugaaacaaagaaacuuuaagggagc

SEQ ID NO: 427893 - RNA, 22 nt, Human
ugaaacaaagaaacuuuaaugu

SEQ ID NO: 427894 - RNA, 24 nt, Human
ugccaaugcguguuccagccagac

SEQ ID NO: 427895 - RNA, 21 nt, Human
uggaaagaaacugaaacuacu

SEQ ID NO: 427896 - RNA, 23 nt, Human
uggaaagaaacugaaacuacuua

SEQ ID NO: 427897 - RNA, 24 nt, Human
ugggaguugaaacaaagaaacuuu

SEQ ID NO: 427898 - RNA, 20 nt, Human
uucacagggucuaucuccaa

SEQ ID NO: 427899 - RNA, 24 nt, Human
uugauaggcugacaauuacugcau

SEQ ID NO: 427900 - RNA, 23 nt, Human
aaacauaccaaacacuacuaaau

SEQ ID NO: 427901 - RNA, 18 nt, Human
aaagcgaucccgucacaa

SEQ ID NO: 427902 - RNA, 20 nt, Human
aacagagaacgcgacuccau

SEQ ID NO: 427903 - RNA, 21 nt, Human
aaccaaaauaugguuucuacc

SEQ ID NO: 427904 - RNA, 24 nt, Human
aagcaacuagaagguucgauggga

SEQ ID NO: 427905 - RNA, 21 nt, Human
aagcgaucccgucacaaaggc

SEQ ID NO: 427906 - RNA, 21 nt, Human
aauaagaguggaaaaagugga

SEQ ID NO: 427907 - RNA, 20 nt, Human
aaucugugguuucuuucccu

SEQ ID NO: 427908 - RNA, 22 nt, Human
acaagacugaaagcauuuccac

SEQ ID NO: 427909 - RNA, 25 nt, Human
acuccauucaccagcggagcgcgaa

SEQ ID NO: 427910 - RNA, 23 nt, Human
acucccuuaaugaaaaccauuuc

SEQ ID NO: 427911 - RNA, 23 nt, Human
acucugugacccaaaacaauuua

SEQ ID NO: 427912 - RNA, 30 nt, Human
acucugugacccaaaacaauuuagaauagg

SEQ ID NO: 427913 - RNA, 24 nt, Human
agaagagagacauagucaagaaaa

SEQ ID NO: 427914 - RNA, 21 nt, Human
agaaugcucucaggccaauua

SEQ ID NO: 427915 - RNA, 23 nt, Human
agacauagucaagaaaacaauga

SEQ ID NO: 427916 - RNA, 24 nt, Human
agagagaucaagaucucugguugg

SEQ ID NO: 427917 - RNA, 19 nt, Human
agagcagcaggaaacauga

SEQ ID NO: 427918 - RNA, 19 nt, Human
agcuuaucuccaggaguuc

SEQ ID NO: 427919 - RNA, 21 nt, Human
aggaaacaugaaacccaggac

SEQ ID NO: 427920 - RNA, 18 nt, Human
aggaaauugagccacagg

SEQ ID NO: 427921 - RNA, 18 nt, Human
aggaccaauucucuaaug

SEQ ID NO: 427922 - RNA, 25 nt, Human
aggcaaaagggaaaaaccauguaug

SEQ ID NO: 427923 - RNA, 21 nt, Human
aggcagcagcaacagcaaaac

SEQ ID NO: 427924 - RNA, 25 nt, Human
aggcagcagcaacagcaaaacagag

SEQ ID NO: 427925 - RNA, 19 nt, Human
augaaaagaagaaaaucug

SEQ ID NO: 427926 - RNA, 24 nt, Human
caaaggcagcagcaacagcaaaac

SEQ ID NO: 427927 - RNA, 25 nt, Human
caacauuaaacagacuauaaaacuc

SEQ ID NO: 427928 - RNA, 24 nt, Human
caagcagauuucaauuaaauaaca

SEQ ID NO: 427929 - RNA, 18 nt, Human
caaguaugagcuagaggc

SEQ ID NO: 427930 - RNA, 21 nt, Human
cacagccaguaacuacagaga

SEQ ID NO: 427931 - RNA, 18 nt, Human
cacauaaaacauaccaaa

SEQ ID NO: 427932 - RNA, 21 nt, Human
cacuacuaaaugucccagaag

SEQ ID NO: 427933 - RNA, 19 nt, Human
cacuugaucucaauuguac

SEQ ID NO: 427934 - RNA, 22 nt, Human
cagcagcaacagcaaaacagag

SEQ ID NO: 427935 - RNA, 24 nt, Human
cagcagcaacagcaaaacagagaa

SEQ ID NO: 427936 - RNA, 20 nt, Human
caggagcuuuugcagugcua

SEQ ID NO: 427937 - RNA, 21 nt, Human
cauuacaagcuguuuauugau

SEQ ID NO: 427938 - RNA, 26 nt, Human
cauugcucuuugugaaaaauucccau

SEQ ID NO: 427939 - RNA, 20 nt, Human
ccacaugacaacgcuuugag

SEQ ID NO: 427940 - RNA, 19 nt, Human
ccagagaaucugaagacug

SEQ ID NO: 427941 - RNA, 23 nt, Human
cccgucacaaaggcagcagcaac

SEQ ID NO: 427942 - RNA, 19 nt, Human
cccuauaguagcauacuca

SEQ ID NO: 427943 - RNA, 24 nt, Human
cuccugauucuaaccaucauuucu

SEQ ID NO: 427944 - RNA, 22 nt, Human
cuguuuauugauccucagaaau

SEQ ID NO: 427945 - RNA, 19 nt, Human
cuuaauucucagcaacaac

SEQ ID NO: 427946 - RNA, 18 nt, Human
gaagagcggcgucagagg

SEQ ID NO: 427947 - RNA, 20 nt, Human
gaauucaugaaaagaagaaa

SEQ ID NO: 427948 - RNA, 23 nt, Human
gacacauaaaacauaccaaacac

SEQ ID NO: 427949 - RNA, 18 nt, Human
gacuccauucaccagcgg

SEQ ID NO: 427950 - RNA, 23 nt, Human
gcagcagcaacagcaaaacagag

SEQ ID NO: 427951 - RNA, 24 nt, Human
gcaugguguguacacagugagaag

SEQ ID NO: 427952 - RNA, 23 nt, Human
gcauuuccacauagauucaauuu

SEQ ID NO: 427953 - RNA, 18 nt, Human
gcccaauguuccccuagg

SEQ ID NO: 427954 - RNA, 19 nt, Human
ggcagcagcaacagcaaaa

SEQ ID NO: 427955 - RNA, 19 nt, Human
gggcaugguguguacacag

SEQ ID NO: 427956 - RNA, 19 nt, Human
gggguuucaaccuggguag

SEQ ID NO: 427957 - RNA, 23 nt, Human
uaaaacauaccaaacacuacuaa

SEQ ID NO: 427958 - RNA, 24 nt, Human
uaaaacauaccaaacacuacuaaa

SEQ ID NO: 427959 - RNA, 21 nt, Human
uaaaacucagucaaaaucucc

SEQ ID NO: 427960 - RNA, 19 nt, Human
uaagaguggaaaaagugga

SEQ ID NO: 427961 - RNA, 22 nt, Human
uaagugacuauucuacucccuu

SEQ ID NO: 427962 - RNA, 25 nt, Human
uacaaacagaauaaauguguauaca

SEQ ID NO: 427963 - RNA, 24 nt, Human
uacaacgacaaguaugagcuagag

SEQ ID NO: 427964 - RNA, 19 nt, Human
uacaagcuguuuauugauc

SEQ ID NO: 427965 - RNA, 23 nt, Human
uaccaaacacuacuaaauguccc

SEQ ID NO: 427966 - RNA, 23 nt, Human
uacuaugugccaggcacucuuuu

SEQ ID NO: 427967 - RNA, 24 nt, Human
uacuucuguaggaauucaugaaaa

SEQ ID NO: 427968 - RNA, 20 nt, Human
uagaauagagaaacuagagg

SEQ ID NO: 427969 - RNA, 21 nt, Human
uaguaauauuauuaauggcac

SEQ ID NO: 427970 - RNA, 24 nt, Human
uaguguacauuuuuuauuuugcaa

SEQ ID NO: 427971 - RNA, 18 nt, Human
uauguuguaugugggcau

SEQ ID NO: 427972 - RNA, 23 nt, Human
uauuaugcuaguguacauuuuuu

SEQ ID NO: 427973 - RNA, 20 nt, Human
ucaaaugcccaauguucccc

SEQ ID NO: 427974 - RNA, 20 nt, Human
ucacaugaggacacuugcuc

SEQ ID NO: 427975 - RNA, 20 nt, Human
ucaccauaauccuaccaggu

SEQ ID NO: 427976 - RNA, 27 nt, Human
ucagugaucauccucauacauauuucu

SEQ ID NO: 427977 - RNA, 21 nt, Human
ucagugauuuucccaggcugu

SEQ ID NO: 427978 - RNA, 18 nt, Human
uccaaugcaaaauaaagu

SEQ ID NO: 427979 - RNA, 18 nt, Human
uccacaugacaacgcuuu

SEQ ID NO: 427980 - RNA, 23 nt, Human
uccacaugacaacgcuuugaggu

SEQ ID NO: 427981 - RNA, 22 nt, Human
uccauagaauggaaaaccuuug

SEQ ID NO: 427982 - RNA, 23 nt, Human
uccauagaauggaaaaccuuugu

SEQ ID NO: 427983 - RNA, 19 nt, Human
ucccuauaguagcauacuc

SEQ ID NO: 427984 - RNA, 21 nt, Human
ucuccauagaauggaaaaccu

SEQ ID NO: 427985 - RNA, 20 nt, Human
ucugacuucacugaaaaugu

SEQ ID NO: 427986 - RNA, 19 nt, Human
ucugugguuucuuucccuu

SEQ ID NO: 427987 - RNA, 25 nt, Human
ugaaauaaaaucugugguuucuuuc

SEQ ID NO: 427988 - RNA, 18 nt, Human
ugagaagagcagcaggaa

SEQ ID NO: 427989 - RNA, 20 nt, Human
ugagaagagcagcaggaaac

SEQ ID NO: 427990 - RNA, 21 nt, Human
ugagugacagcagagugcugg

SEQ ID NO: 427991 - RNA, 18 nt, Human
uggcacagagaagcuaag

SEQ ID NO: 427992 - RNA, 22 nt, Human
ugggcaugguguguacacagug

SEQ ID NO: 427993 - RNA, 20 nt, Human
uguucaagaucacccagcua

SEQ ID NO: 427994 - RNA, 19 nt, Human
uuaaauucucaggagcuuu

SEQ ID NO: 427995 - RNA, 22 nt, Human
uuaauacucaccauaauccuac

SEQ ID NO: 427996 - RNA, 18 nt, Human
uuccuugagugacagcag

SEQ ID NO: 427997 - RNA, 22 nt, Human
uuguguacauauuuuaaugccu

SEQ ID NO: 427998 - RNA, 23 nt, Human
uuuauagaaugaaagagaaaauu

SEQ ID NO: 427999 - RNA, 21 nt, Human
uuuguacaaacagaauaaaug

SEQ ID NO: 428000 - RNA, 21 nt, Human
aaaaugacaaccccaucauua

SEQ ID NO: 428001 - RNA, 26 nt, Human
aaggucaaucuggaguauguguuacc

SEQ ID NO: 428002 - RNA, 23 nt, Human
acauggcucccuccccuauagcu

SEQ ID NO: 428003 - RNA, 22 nt, Human
agaagugaaaaucuauauucua

SEQ ID NO: 428004 - RNA, 23 nt, Human
auaaaguuuuucucuagaaugag

SEQ ID NO: 428005 - RNA, 25 nt, Human
auuccacauaaguggcacuguugug

SEQ ID NO: 428006 - RNA, 20 nt, Human
auuuauaaggucaaucugga

SEQ ID NO: 428007 - RNA, 18 nt, Human
caacauggcucccucccc

SEQ ID NO: 428008 - RNA, 19 nt, Human
caacauggcucccuccccu

SEQ ID NO: 428009 - RNA, 21 nt, Human
cacugcuaccaauaucagaga

SEQ ID NO: 428010 - RNA, 20 nt, Human
cagugaguccuuucaaguuu

SEQ ID NO: 428011 - RNA, 21 nt, Human
cauaaguggcacuguuguggu

SEQ ID NO: 428012 - RNA, 25 nt, Human
cauauggauuuucuucagugagucc

SEQ ID NO: 428013 - RNA, 19 nt, Human
cauguuuuugacaaaaacu

SEQ ID NO: 428014 - RNA, 20 nt, Human
ccuggugugaggugcuuggg

SEQ ID NO: 428015 - RNA, 21 nt, Human
cuggagguuuuucuacacuga

SEQ ID NO: 428016 - RNA, 24 nt, Human
gaaggcauucucacauucgauacc

SEQ ID NO: 428017 - RNA, 19 nt, Human
gaccuggugugaggugcuu

SEQ ID NO: 428018 - RNA, 18 nt, Human
gcaaaaaaugacaacccc

SEQ ID NO: 428019 - RNA, 18 nt, Human
guucauguuuuugacaaa

SEQ ID NO: 428020 - RNA, 19 nt, Human
uaaaauuuggcaucuggag

SEQ ID NO: 428021 - RNA, 23 nt, Human
uacaggauuuauuuccaguggga

SEQ ID NO: 428022 - RNA, 21 nt, Human
uauugcuuauagucauagggu

SEQ ID NO: 428023 - RNA, 22 nt, Human
ucacauucgauaccuucauaaa

SEQ ID NO: 428024 - RNA, 22 nt, Human
ucagaauuuucuguauuucuag

SEQ ID NO: 428025 - RNA, 25 nt, Human
uccgauuguuaaaaaaaaaaaaaaa

SEQ ID NO: 428026 - RNA, 26 nt, Human
uccgauuguuaaaaaaaaaaaaaaaa

SEQ ID NO: 428027 - RNA, 22 nt, Human
ucucgcucuauuaguuccugaa

SEQ ID NO: 428028 - RNA, 21 nt, Human
ucuucaaaaaugagcaaccaa

SEQ ID NO: 428029 - RNA, 19 nt, Human
ugaguccuuucaaguuuuc

SEQ ID NO: 428030 - RNA, 23 nt, Human
ugcagguuuucuaacauaaacaa

SEQ ID NO: 428031 - RNA, 18 nt, Human
uggugugaggugcuuggg

SEQ ID NO: 428032 - RNA, 24 nt, Human
uuacuaagucugaacuuacacugc

SEQ ID NO: 428033 - RNA, 23 nt, Human
uucacaguuucucucaaguaugu

SEQ ID NO: 428034 - RNA, 24 nt, Human
uugacaaaaacuguagugauuaaa

SEQ ID NO: 428035 - RNA, 22 nt, Human
uugugguaaugagugacuucuc

SEQ ID NO: 428036 - RNA, 20 nt, Human
uuuauagcuccuaaaacauc

SEQ ID NO: 428037 - RNA, 18 nt, Human
uuuuuuuuucaaaagaag

SEQ ID NO: 428038 - RNA, 24 nt, Human
aacugcacaguaacaaugcacuuu

SEQ ID NO: 428039 - RNA, 23 nt, Human
aagaacguuuguucaaacuaaag

SEQ ID NO: 428040 - RNA, 23 nt, Human
aaggaagaacuuuuaccacaaug

SEQ ID NO: 428041 - RNA, 22 nt, Human
aauuuucuaacaugcauuagaa

SEQ ID NO: 428042 - RNA, 21 nt, Human
acuuugguccacuugucuguu

SEQ ID NO: 428043 - RNA, 27 nt, Human
auccauuuaaguuuccagaaauauacu

SEQ ID NO: 428044 - RNA, 19 nt, Human
augaaaauagauacauucg

SEQ ID NO: 428045 - RNA, 26 nt, Human
caaacuaaagaaagccagaagccaaa

SEQ ID NO: 428046 - RNA, 21 nt, Human
cagcacaacaggaaacagcuu

SEQ ID NO: 428047 - RNA, 23 nt, Human
cauucuagaaauuuugccaccac

SEQ ID NO: 428048 - RNA, 18 nt, Human
cuccucuguggcaauaag

SEQ ID NO: 428049 - RNA, 19 nt, Human
gaacuuuuaccacaaugaa

SEQ ID NO: 428050 - RNA, 21 nt, Human
ggaagaacaugaccugggaaa

SEQ ID NO: 428051 - RNA, 18 nt, Human
uaaguuuccagaaauaua

SEQ ID NO: 428052 - RNA, 24 nt, Human
ucaacggacaacaguucagcacaa

SEQ ID NO: 428053 - RNA, 23 nt, Human
ucuaaugauuuaaguuugauuuu

SEQ ID NO: 428054 - RNA, 18 nt, Human
ucucaaaacuccccuuca

SEQ ID NO: 428055 - RNA, 19 nt, Human
ugaggaagaacaugaccug

SEQ ID NO: 428056 - RNA, 21 nt, Human
ugccaccaccacucuuucugg

SEQ ID NO: 428057 - RNA, 20 nt, Human
uggaaaagaucccuccucug

SEQ ID NO: 428058 - RNA, 25 nt, Human
uggaaaagaucccuccucuguggca

SEQ ID NO: 428059 - RNA, 20 nt, Human
aaaccaaaaccauaaugaga

SEQ ID NO: 428060 - RNA, 21 nt, Human
aagcaacagaauaagggagac

SEQ ID NO: 428061 - RNA, 21 nt, Human
aagcauggagguaauuuuucu

SEQ ID NO: 428062 - RNA, 22 nt, Human
acuccauugccaagaaccugag

SEQ ID NO: 428063 - RNA, 20 nt, Human
acuuggugggaaugguugac

SEQ ID NO: 428064 - RNA, 20 nt, Human
agcauggagguaauuuuucu

SEQ ID NO: 428065 - RNA, 19 nt, Human
augguugacuucauuagaa

SEQ ID NO: 428066 - RNA, 26 nt, Human
cacacccaagaagaggucccagggau

SEQ ID NO: 428067 - RNA, 22 nt, Human
cacccucuacuccauugccaag

SEQ ID NO: 428068 - RNA, 19 nt, Human
cagaauaagggagaccuca

SEQ ID NO: 428069 - RNA, 20 nt, Human
cagaauaagggagaccucac

SEQ ID NO: 428070 - RNA, 23 nt, Human
cagcauccuuaaacaugaggagu

SEQ ID NO: 428071 - RNA, 18 nt, Human
caucagggugaagaaggg

SEQ ID NO: 428072 - RNA, 19 nt, Human
ccccucacccucuacucca

SEQ ID NO: 428073 - RNA, 24 nt, Human
cccucuacuccauugccaagaacc

SEQ ID NO: 428074 - RNA, 20 nt, Human
ccucuacuccauugccaaga

SEQ ID NO: 428075 - RNA, 22 nt, Human
ccugaaaguagagaaaugccag

SEQ ID NO: 428076 - RNA, 19 nt, Human
cuaaagcauggagguaauu

SEQ ID NO: 428077 - RNA, 21 nt, Human
cucacccucuacuccauugcc

SEQ ID NO: 428078 - RNA, 21 nt, Human
cucuacuccauugccaagaac

SEQ ID NO: 428079 - RNA, 19 nt, Human
cugguauggggauucugcu

SEQ ID NO: 428080 - RNA, 22 nt, Human
gaccacuuccauaaggcuccac

SEQ ID NO: 428081 - RNA, 19 nt, Human
gcaggauagggaccagcca

SEQ ID NO: 428082 - RNA, 22 nt, Human
gccaagcaacagaauaagggag

SEQ ID NO: 428083 - RNA, 24 nt, Human
gcugaagauuuucucacaaagacc

SEQ ID NO: 428084 - RNA, 24 nt, Human
uaaaagaagauauauacacaaaug

SEQ ID NO: 428085 - RNA, 27 nt, Human
uaacacuucuacagaaacauucugcuu

SEQ ID NO: 428086 - RNA, 19 nt, Human
uacuauuggcaggauaggg

SEQ ID NO: 428087 - RNA, 23 nt, Human
uagggaccagccaagcaacagaa

SEQ ID NO: 428088 - RNA, 22 nt, Human
ucaucagggugaagaagggccc

SEQ ID NO: 428089 - RNA, 20 nt, Human
ucccagggauugcugacagg

SEQ ID NO: 428090 - RNA, 24 nt, Human
ucccagggauugcugacaggccaa

SEQ ID NO: 428091 - RNA, 22 nt, Human
ugaagaagggcccauuacuauu

SEQ ID NO: 428092 - RNA, 23 nt, Human
ugggcccccucacccucuacucc

SEQ ID NO: 428093 - RNA, 22 nt, Human
uucauuagaaauguuacccagg

SEQ ID NO: 428094 - RNA, 20 nt, Human
uucuugguggaaggaucugc

SEQ ID NO: 428095 - RNA, 24 nt, Human
aacagagcaagacucugucucagg

SEQ ID NO: 428096 - RNA, 22 nt, Human
aacagucaaauguccuuugacc

SEQ ID NO: 428097 - RNA, 22 nt, Human
aagccaaguuuauuacaaccga

SEQ ID NO: 428098 - RNA, 18 nt, Human
aauuagccaggcauggug

SEQ ID NO: 428099 - RNA, 24 nt, Human
aauugcucgaacucagggggugga

SEQ ID NO: 428100 - RNA, 23 nt, Human
acaaaacauuccccuggcucucc

SEQ ID NO: 428101 - RNA, 24 nt, Human
acaaaacauuccccuggcucuccg

SEQ ID NO: 428102 - RNA, 19 nt, Human
acaaccgaagccacaaaac

SEQ ID NO: 428103 - RNA, 21 nt, Human
acagagcaagacucugucuca

SEQ ID NO: 428104 - RNA, 24 nt, Human
acuccgucucuacuaaaaauacaa

SEQ ID NO: 428105 - RNA, 24 nt, Human
agaagguagaucagcggaaucaag

SEQ ID NO: 428106 - RNA, 18 nt, Human
agacuuaguguggagaaa

SEQ ID NO: 428107 - RNA, 18 nt, Human
agagcaagacucugucuc

SEQ ID NO: 428108 - RNA, 22 nt, Human
agcauuuugggaggcugaggca

SEQ ID NO: 428109 - RNA, 24 nt, Human
agcauuuugggaggcugaggcagg

SEQ ID NO: 428110 - RNA, 21 nt, Human
agccaggcauggugaggcgcc

SEQ ID NO: 428111 - RNA, 24 nt, Human
agccugggcaacagagcaagacuc

SEQ ID NO: 428112 - RNA, 18 nt, Human
aggcaggagaauugcucg

SEQ ID NO: 428113 - RNA, 18 nt, Human
aggcagguggaucaccug

SEQ ID NO: 428114 - RNA, 22 nt, Human
aggcagguggaucaccugaggg

SEQ ID NO: 428115 - RNA, 22 nt, Human
aggcagguggaucaccugaggu

SEQ ID NO: 428116 - RNA, 22 nt, Human
aggcauggugaggcgccuguaa

SEQ ID NO: 428117 - RNA, 21 nt, Human
aggcugaggcagguggaucac

SEQ ID NO: 428118 - RNA, 24 nt, Human
aggcugaggcagguggaucaccug

SEQ ID NO: 428119 - RNA, 23 nt, Human
aguggcucaugccuguaauccca

SEQ ID NO: 428120 - RNA, 24 nt, Human
aguggcucaugccuguaaucccag

SEQ ID NO: 428121 - RNA, 20 nt, Human
aucccagcuacucgggagcc

SEQ ID NO: 428122 - RNA, 24 nt, Human
auggugaggcgccuguaaucccag

SEQ ID NO: 428123 - RNA, 23 nt, Human
auugcacuccagccugggcaaca

SEQ ID NO: 428124 - RNA, 24 nt, Human
auugcacuccagccugggcaacag

SEQ ID NO: 428125 - RNA, 24 nt, Human
auugugccauugcacuccagccug

SEQ ID NO: 428126 - RNA, 23 nt, Human
caaaugcugaaacuccgucucua

SEQ ID NO: 428127 - RNA, 23 nt, Human
cacuccagccugggcaacagagc

SEQ ID NO: 428128 - RNA, 27 nt, Human
cagcaguucaaaaucaccugcaaaugc

SEQ ID NO: 428129 - RNA, 24 nt, Human
cagcauuuugggaggcugaggcag

SEQ ID NO: 428130 - RNA, 26 nt, Human
cagcauuuugggaggcugaggcaggu

SEQ ID NO: 428131 - RNA, 19 nt, Human
caggggguggagguugcag

SEQ ID NO: 428132 - RNA, 24 nt, Human
caggggguggagguugcagugagu

SEQ ID NO: 428133 - RNA, 27 nt, Human
cagguggaucaccugaggucagcaguu

SEQ ID NO: 428134 - RNA, 24 nt, Human
caugccuguaaucccagcauuuug

SEQ ID NO: 428135 - RNA, 19 nt, Human
cauugcacuccagccuggg

SEQ ID NO: 428136 - RNA, 21 nt, Human
cauugcacuccagccugggca

SEQ ID NO: 428137 - RNA, 22 nt, Human
cauugcacuccagccugggcaa

SEQ ID NO: 428138 - RNA, 24 nt, Human
cauugcacuccagccugggcaaca

SEQ ID NO: 428139 - RNA, 27 nt, Human
cauugcacuccagccugggcaacagag

SEQ ID NO: 428140 - RNA, 20 nt, Human
ccauugcacuccagccuggg

SEQ ID NO: 428141 - RNA, 21 nt, Human
ccauugcacuccagccugggc

SEQ ID NO: 428142 - RNA, 23 nt, Human
ccauugcacuccagccugggcaa

SEQ ID NO: 428143 - RNA, 24 nt, Human
ccauugcacuccagccugggcaac

SEQ ID NO: 428144 - RNA, 21 nt, Human
ccgaagccacaaaacauggag

SEQ ID NO: 428145 - RNA, 22 nt, Human
ccgggacccuguggcuuuuuuu

SEQ ID NO: 428146 - RNA, 22 nt, Human
ccugggcaacagagcaagacuc

SEQ ID NO: 428147 - RNA, 19 nt, Human
ccuguaaucccagcuacuc

SEQ ID NO: 428148 - RNA, 21 nt, Human
ccuguaaucccagcuacucgg

SEQ ID NO: 428149 - RNA, 23 nt, Human
ccuuaucucccugaagaaggaug

SEQ ID NO: 428150 - RNA, 24 nt, Human
cgccuguaaucccagcuacucggg

SEQ ID NO: 428151 - RNA, 19 nt, Human
cggaaucaaggccaggcua

SEQ ID NO: 428152 - RNA, 20 nt, Human
cuacucgggagccaaggcag

SEQ ID NO: 428153 - RNA, 23 nt, Human
cucaugccuguaaucccagcauu

SEQ ID NO: 428154 - RNA, 24 nt, Human
cucaugccuguaaucccagcauuu

SEQ ID NO: 428155 - RNA, 20 nt, Human
cucuacuccauuucaucaaa

SEQ ID NO: 428156 - RNA, 27 nt, Human
gaaucaaggccaggcuagguuaggaaa

SEQ ID NO: 428157 - RNA, 23 nt, Human
gagauugugccauugcacuccag

SEQ ID NO: 428158 - RNA, 23 nt, Human
gagguugcagugaguugagauug

SEQ ID NO: 428159 - RNA, 24 nt, Human
gaucaccugaggucagcaguucaa

SEQ ID NO: 428160 - RNA, 24 nt, Human
gcacuccagccugggcaacagagc

SEQ ID NO: 428161 - RNA, 22 nt, Human
gcauuucucuacuccauuucau

SEQ ID NO: 428162 - RNA, 22 nt, Human
gccauugcacuccagccugggc

SEQ ID NO: 428163 - RNA, 24 nt, Human
gccauugcacuccagccugggcaa

SEQ ID NO: 428164 - RNA, 19 nt, Human
gcucuccgggacccugugg

SEQ ID NO: 428165 - RNA, 22 nt, Human
ggagguugcagugaguugagau

SEQ ID NO: 428166 - RNA, 24 nt, Human
ggagguugcagugaguugagauug

SEQ ID NO: 428167 - RNA, 23 nt, Human
ggcgcaguggcucaugccuguaa

SEQ ID NO: 428168 - RNA, 21 nt, Human
ggcugggcgcaguggcucaug

SEQ ID NO: 428169 - RNA, 23 nt, Human
ggcugggcgcaguggcucaugcc

SEQ ID NO: 428170 - RNA, 18 nt, Human
gguggagguugcagugag

SEQ ID NO: 428171 - RNA, 23 nt, Human
gguggagguugcagugaguugag

SEQ ID NO: 428172 - RNA, 24 nt, Human
guugcagugaguugagauugugcc

SEQ ID NO: 428173 - RNA, 21 nt, Human
uaaaaauacaaaaauuagcca

SEQ ID NO: 428174 - RNA, 19 nt, Human
uaaaguuuuuuuuuuuuuu

SEQ ID NO: 428175 - RNA, 24 nt, Human
uaacacaaaacauuccccuggcuc

SEQ ID NO: 428176 - RNA, 24 nt, Human
ucgaacucaggggguggagguugc

SEQ ID NO: 428177 - RNA, 21 nt, Human
ucucuacuaaaaauacaaaaa

SEQ ID NO: 428178 - RNA, 19 nt, Human
ugacucuuaguccuugucc

SEQ ID NO: 428179 - RNA, 20 nt, Human
ugaggcagguggaucaccug

SEQ ID NO: 428180 - RNA, 24 nt, Human
ugaggcagguggaucaccugaggu

SEQ ID NO: 428181 - RNA, 26 nt, Human
ugaggcagguggaucaccugagguca

SEQ ID NO: 428182 - RNA, 22 nt, Human
ugaggucagcaguucaaaauca

SEQ ID NO: 428183 - RNA, 22 nt, Human
ugcacuccagccugggcaacag

SEQ ID NO: 428184 - RNA, 22 nt, Human
ugcacuccagccugggcaacag

SEQ ID NO: 428185 - RNA, 24 nt, Human
ugccauugcacuccagccugggca

SEQ ID NO: 428186 - RNA, 24 nt, Human
ugccuguaaucccagcauuuuggg

SEQ ID NO: 428187 - RNA, 24 nt, Human
uggaucaccugaggucagcaguuc

SEQ ID NO: 428188 - RNA, 24 nt, Human
uggcucaugccuguaaucccagca

SEQ ID NO: 428189 - RNA, 24 nt, Human
ugggaggcugaggcagguggauca

SEQ ID NO: 428190 - RNA, 22 nt, Human
uggugaggcgccuguaauccca

SEQ ID NO: 428191 - RNA, 18 nt, Human
uuacaaccgaagccacaa

SEQ ID NO: 428192 - RNA, 23 nt, Human
uuagccaggcauggugaggcgcc

SEQ ID NO: 428193 - RNA, 22 nt, Human
uuccccuggcucuccgggaccc

SEQ ID NO: 428194 - RNA, 20 nt, Human
uucuuuaaaacucucggcug

SEQ ID NO: 428195 - RNA, 28 nt, Human
uugaccacuuacagaaugcauuucucua

SEQ ID NO: 428196 - RNA, 19 nt, Human
uugcagugaguugagauug

SEQ ID NO: 428197 - RNA, 22 nt, Human
uugcagugaguugagauugugc

SEQ ID NO: 428198 - RNA, 24 nt, Human
uugcucgaacucaggggguggagg

SEQ ID NO: 428199 - RNA, 25 nt, Human
uugggaggcugaggcagguggauca

SEQ ID NO: 428200 - RNA, 23 nt, Human
uugugccauugcacuccagccug

SEQ ID NO: 428201 - RNA, 21 nt, Human
uuuuuuuuuuauaaagaagcc

SEQ ID NO: 428202 - RNA, 24 nt, Human
aaaaaaccugagcaagucagaaag

SEQ ID NO: 428203 - RNA, 22 nt, Human
aaacuuuuuguauaagccacca

SEQ ID NO: 428204 - RNA, 22 nt, Human
aaauaucuuucaagauggggcc

SEQ ID NO: 428205 - RNA, 23 nt, Human
aaccacagaggaucugcgccggg

SEQ ID NO: 428206 - RNA, 19 nt, Human
aacucaggcauuucaugau

SEQ ID NO: 428207 - RNA, 25 nt, Human
aaguacuuucccaggccaggugacc

SEQ ID NO: 428208 - RNA, 21 nt, Human
accagggccuguccaagcccc

SEQ ID NO: 428209 - RNA, 21 nt, Human
acccucuuggcuaaaaauggg

SEQ ID NO: 428210 - RNA, 23 nt, Human
accuggcaccauaagguaucucc

SEQ ID NO: 428211 - RNA, 20 nt, Human
acucgcagagcgaacagcga

SEQ ID NO: 428212 - RNA, 19 nt, Human
agaaagugcaacauauccc

SEQ ID NO: 428213 - RNA, 18 nt, Human
agcaaccccgagcuucug

SEQ ID NO: 428214 - RNA, 25 nt, Human
agcagauacagcucagacccucuuc

SEQ ID NO: 428215 - RNA, 23 nt, Human
aggcagccagaguucucucucuu

SEQ ID NO: 428216 - RNA, 26 nt, Human
auccauaccuauaccugucauacaga

SEQ ID NO: 428217 - RNA, 22 nt, Human
caaaaaaccugagcaagucaga

SEQ ID NO: 428218 - RNA, 23 nt, Human
caaaaaaccugagcaagucagaa

SEQ ID NO: 428219 - RNA, 23 nt, Human
caaaccagagcaacaugaggcaa

SEQ ID NO: 428220 - RNA, 21 nt, Human
caaccacagaggaucugcgcc

SEQ ID NO: 428221 - RNA, 19 nt, Human
cacauggauugacagugac

SEQ ID NO: 428222 - RNA, 22 nt, Human
caccucggaaccgcccagcaac

SEQ ID NO: 428223 - RNA, 23 nt, Human
cagagcgaacagcgacuucuccc

SEQ ID NO: 428224 - RNA, 21 nt, Human
cagcucagacccucuuggcua

SEQ ID NO: 428225 - RNA, 24 nt, Human
cagcucagacccucuuggcuaaaa

SEQ ID NO: 428226 - RNA, 18 nt, Human
cauaugucacaagggaga

SEQ ID NO: 428227 - RNA, 21 nt, Human
ccaagaauauccaugaagaaa

SEQ ID NO: 428228 - RNA, 20 nt, Human
ccacagaggaucugcgccgg

SEQ ID NO: 428229 - RNA, 22 nt, Human
ccauaccuauaccugucauaca

SEQ ID NO: 428230 - RNA, 23 nt, Human
ccccgggggcgcaggcggggucu

SEQ ID NO: 428231 - RNA, 18 nt, Human
cccugguguucauccagg

SEQ ID NO: 428232 - RNA, 18 nt, Human
ccgcacccucccgcuucc

SEQ ID NO: 428233 - RNA, 18 nt, Human
ccgcccagcaaccccgag

SEQ ID NO: 428234 - RNA, 19 nt, Human
ccgccgccaucacaguucg

SEQ ID NO: 428235 - RNA, 21 nt, Human
ccgggcccaucaccgcggccg

SEQ ID NO: 428236 - RNA, 22 nt, Human
ccuguggcuuaaacuguaaagc

SEQ ID NO: 428237 - RNA, 19 nt, Human
cgacuucucccgcacccuc

SEQ ID NO: 428238 - RNA, 23 nt, Human
cucccgcuuccgucaccucggaa

SEQ ID NO: 428239 - RNA, 21 nt, Human
cugcugugacuagagucaugc

SEQ ID NO: 428240 - RNA, 19 nt, Human
cuguccaagccccuccugc

SEQ ID NO: 428241 - RNA, 19 nt, Human
gacacugcuauagaaaugc

SEQ ID NO: 428242 - RNA, 18 nt, Human
gcaaaauaucuuucaaga

SEQ ID NO: 428243 - RNA, 24 nt, Human
gcagagcgaacagcgacuucuccc

SEQ ID NO: 428244 - RNA, 23 nt, Human
gccuguccaagccccuccugcug

SEQ ID NO: 428245 - RNA, 21 nt, Human
ggccgccgccaucacaguucg

SEQ ID NO: 428246 - RNA, 19 nt, Human
uaaaguuuuuuuuuuuuuu

SEQ ID NO: 428247 - RNA, 23 nt, Human
uaagccaccagcagauacagcuc

SEQ ID NO: 428248 - RNA, 19 nt, Human
uacagcucagacccucuuu

SEQ ID NO: 428249 - RNA, 19 nt, Human
uaccuggcaccauaaggua

SEQ ID NO: 428250 - RNA, 25 nt, Human
uaucacaaaccagagcaacaugagg

SEQ ID NO: 428251 - RNA, 19 nt, Human
ucagaagaugacucuucau

SEQ ID NO: 428252 - RNA, 23 nt, Human
ucagauacaugaaauucaacauc

SEQ ID NO: 428253 - RNA, 24 nt, Human
uccccgggggcgcaggcggggucu

SEQ ID NO: 428254 - RNA, 23 nt, Human
ucccuagaagguucccacguacc

SEQ ID NO: 428255 - RNA, 18 nt, Human
ucucaggcagccagaguu

SEQ ID NO: 428256 - RNA, 21 nt, Human
ugacagugacauaacucuggc

SEQ ID NO: 428257 - RNA, 24 nt, Human
ugagcaagucagaaagugcaacau

SEQ ID NO: 428258 - RNA, 22 nt, Human
ugcucuguucagaagaugacuc

SEQ ID NO: 428259 - RNA, 23 nt, Human
uggggccacauaugucacaaggg

SEQ ID NO: 428260 - RNA, 23 nt, Human
uguucagauacaugaaauucaac

SEQ ID NO: 428261 - RNA, 19 nt, Human
uucacuucaugccaacaac

SEQ ID NO: 428262 - RNA, 18 nt, Human
uucccaggccaggugacu

SEQ ID NO: 428263 - RNA, 25 nt, Human
uucccaggccaggugacuuggaggc

SEQ ID NO: 428264 - RNA, 18 nt, Human
uuuuuuuuucuuucccug

SEQ ID NO: 428265 - RNA, 28 nt, Human
aaaaauaaugcagggauaaccgguaccc

SEQ ID NO: 428266 - RNA, 20 nt, Human
aaagaugccacucucauuuc

SEQ ID NO: 428267 - RNA, 20 nt, Human
aaagcguucccuggauccac

SEQ ID NO: 428268 - RNA, 26 nt, Human
aagaugccacucucauuucuggaaca

SEQ ID NO: 428269 - RNA, 21 nt, Human
acaaaggaaaaaucucccuuu

SEQ ID NO: 428270 - RNA, 25 nt, Human
acaagacagcuguuuacugagacag

SEQ ID NO: 428271 - RNA, 30 nt, Human
acacacagacaagacagcuguuuacugagg

SEQ ID NO: 428272 - RNA, 26 nt, Human
acagagcagcaaaagccaucucagaa

SEQ ID NO: 428273 - RNA, 21 nt, Human
accuguuuauaguacacugau

SEQ ID NO: 428274 - RNA, 26 nt, Human
acucucugagggugucugaggggagu

SEQ ID NO: 428275 - RNA, 25 nt, Human
agccaucucagaaucagugagacuc

SEQ ID NO: 428276 - RNA, 22 nt, Human
aucagugagacucuauggaagc

SEQ ID NO: 428277 - RNA, 22 nt, Human
auccacagugauuccauaaaga

SEQ ID NO: 428278 - RNA, 21 nt, Human
augaccuagagcuuggugguc

SEQ ID NO: 428279 - RNA, 18 nt, Human
caagacagcuguuuacug

SEQ ID NO: 428280 - RNA, 22 nt, Human
caagacagcuguuuacugagac

SEQ ID NO: 428281 - RNA, 19 nt, Human
cagagucaacugaccauuc

SEQ ID NO: 428282 - RNA, 22 nt, Human
cagggauaacuaaaaaccuguu

SEQ ID NO: 428283 - RNA, 23 nt, Human
caucucagaaucagugagacucu

SEQ ID NO: 428284 - RNA, 18 nt, Human
cccauacaaagcuuuuca

SEQ ID NO: 428285 - RNA, 21 nt, Human
ccuaugucccagcacaugugg

SEQ ID NO: 428286 - RNA, 19 nt, Human
cgaugguuuaacaaaggaa

SEQ ID NO: 428287 - RNA, 24 nt, Human
cggugaauccuuggacaaaagcgu

SEQ ID NO: 428288 - RNA, 20 nt, Human
cuacuauuuggaugcagaga

SEQ ID NO: 428289 - RNA, 18 nt, Human
cugaggggagugcugugu

SEQ ID NO: 428290 - RNA, 23 nt, Human
gacaaaagcguucccuggaucca

SEQ ID NO: 428291 - RNA, 18 nt, Human
gacuuauguuuucccuuu

SEQ ID NO: 428292 - RNA, 21 nt, Human
gagcagcaaaagccaucucag

SEQ ID NO: 428293 - RNA, 24 nt, Human
gccauguacccugaucaaacaaua

SEQ ID NO: 428294 - RNA, 18 nt, Human
guagagggagaacagagc

SEQ ID NO: 428295 - RNA, 24 nt, Human
gucauuucccaucagugugaacuc

SEQ ID NO: 428296 - RNA, 21 nt, Human
uaaaacaaauaucuguguuuc

SEQ ID NO: 428297 - RNA, 27 nt, Human
uaaaacaaauaucuguguuucuaacgc

SEQ ID NO: 428298 - RNA, 19 nt, Human
uagaaagggaugagcuaug

SEQ ID NO: 428299 - RNA, 21 nt, Human
uagaaagggaugagcuauggc

SEQ ID NO: 428300 - RNA, 21 nt, Human
ucaggguucagacuuauguuu

SEQ ID NO: 428301 - RNA, 24 nt, Human
ucucauguguaugauugggucaaa

SEQ ID NO: 428302 - RNA, 22 nt, Human
ugagacucuauggaagcagcuu

SEQ ID NO: 428303 - RNA, 21 nt, Human
uggaugcagagauggaugacc

SEQ ID NO: 428304 - RNA, 23 nt, Human
uggcuuaaggucuuccuaugucc

SEQ ID NO: 428305 - RNA, 19 nt, Human
ugucccagcacauguggag

SEQ ID NO: 428306 - RNA, 27 nt, Human
uguuccauuucuuuuuuguagguucua

SEQ ID NO: 428307 - RNA, 21 nt, Human
uucauuuggucucguauauau

SEQ ID NO: 428308 - RNA, 25 nt, Human
uucccuggauccacuacauuuguuc

SEQ ID NO: 428309 - RNA, 24 nt, Human
uugguggucccauggucauuuccc

SEQ ID NO: 428310 - RNA, 22 nt, Human
uuuguuggguuucucaccaauu

SEQ ID NO: 428311 - RNA, 18 nt, Human
aaaaaaggcacugacaga

SEQ ID NO: 428312 - RNA, 24 nt, Human
aaagugcugggauuacagguguga

SEQ ID NO: 428313 - RNA, 24 nt, Human
aagcaugugggcuggcuaaaaacg

SEQ ID NO: 428314 - RNA, 18 nt, Human
aagugcugggauuacagg

SEQ ID NO: 428315 - RNA, 19 nt, Human
aagugcugggauuacaggu

SEQ ID NO: 428316 - RNA, 26 nt, Human
aagugcugggauuacaggugugagcc

SEQ ID NO: 428317 - RNA, 18 nt, Human
acacccagccagagccaa

SEQ ID NO: 428318 - RNA, 19 nt, Human
acacccagccagagccaaa

SEQ ID NO: 428319 - RNA, 23 nt, Human
acuggucucaaacuccugaccuc

SEQ ID NO: 428320 - RNA, 22 nt, Human
agagccagagcccucaaaugac

SEQ ID NO: 428321 - RNA, 19 nt, Human
agccaccacacccagccag

SEQ ID NO: 428322 - RNA, 25 nt, Human
agccagagccaaaacaucuguucaa

SEQ ID NO: 428323 - RNA, 21 nt, Human
augacuaaaggcucucccaca

SEQ ID NO: 428324 - RNA, 24 nt, Human
caaagugcugggauuacaggugug

SEQ ID NO: 428325 - RNA, 22 nt, Human
caagugauccuccugccucagc

SEQ ID NO: 428326 - RNA, 27 nt, Human
caagugauccuccugccucagccuccc

SEQ ID NO: 428327 - RNA, 27 nt, Human
caagugauccuccugccucagccuccc

SEQ ID NO: 428328 - RNA, 20 nt, Human
cacacuggucucaaacuccu

SEQ ID NO: 428329 - RNA, 19 nt, Human
caccacacccagccagagc

SEQ ID NO: 428330 - RNA, 23 nt, Human
caccacacccagccagagccaaa

SEQ ID NO: 428331 - RNA, 19 nt, Human
cacuacacauucaugugug

SEQ ID NO: 428332 - RNA, 23 nt, Human
cagcuuccucccuccggaucccc

SEQ ID NO: 428333 - RNA, 22 nt, Human
caggguuucucucaaauauggg

SEQ ID NO: 428334 - RNA, 19 nt, Human
cauucaugugugacagggu

SEQ ID NO: 428335 - RNA, 20 nt, Human
ccaaagugcugggauuacag

SEQ ID NO: 428336 - RNA, 21 nt, Human
ccaaagugcugggauuacagg

SEQ ID NO: 428337 - RNA, 21 nt, Human
ccaaagugcugggauuacagg

SEQ ID NO: 428338 - RNA, 24 nt, Human
ccaaagugcugggauuacaggugu

SEQ ID NO: 428339 - RNA, 23 nt, Human
ccacaaagccacagagccagagc

SEQ ID NO: 428340 - RNA, 21 nt, Human
ccagacaaguacuuuaaccca

SEQ ID NO: 428341 - RNA, 23 nt, Human
ccagacaaguacuuuaacccaca

SEQ ID NO: 428342 - RNA, 24 nt, Human
ccagacaaguacuuuaacccacaa

SEQ ID NO: 428343 - RNA, 25 nt, Human
ccagccagagccaaaacaucuguuc

SEQ ID NO: 428344 - RNA, 23 nt, Human
cccauguuacuuacauguauaug

SEQ ID NO: 428345 - RNA, 23 nt, Human
ccgcgccacagagacuccaggcg

SEQ ID NO: 428346 - RNA, 21 nt, Human
ccuccggaucccaaggcaggu

SEQ ID NO: 428347 - RNA, 18 nt, Human
ccugaccucaagugaucc

SEQ ID NO: 428348 - RNA, 23 nt, Human
ccugaccucaagugauccuccug

SEQ ID NO: 428349 - RNA, 22 nt, Human
cgccacagagacuccaggcgag

SEQ ID NO: 428350 - RNA, 24 nt, Human
cggaucccaaggcagguacaggaa

SEQ ID NO: 428351 - RNA, 24 nt, Human
cucaagugauccuccugccucagc

SEQ ID NO: 428352 - RNA, 18 nt, Human
cucuuuacauuuaccaag

SEQ ID NO: 428353 - RNA, 23 nt, Human
cugccucagccucccaaagugcu

SEQ ID NO: 428354 - RNA, 24 nt, Human
cugccucagccucccaaagugcug

SEQ ID NO: 428355 - RNA, 22 nt, Human
gaccucaagugauccuccugcc

SEQ ID NO: 428356 - RNA, 24 nt, Human
gaccucaagugauccuccugccuc

SEQ ID NO: 428357 - RNA, 20 nt, Human
gagaugaggucuugcuaugu

SEQ ID NO: 428358 - RNA, 22 nt, Human
gagccaaaacaucuguucaaau

SEQ ID NO: 428359 - RNA, 18 nt, Human
gauuacaggugugagcca

SEQ ID NO: 428360 - RNA, 21 nt, Human
gauuacaggugugagccacca

SEQ ID NO: 428361 - RNA, 22 nt, Human
gauuacaggugugagccaccac

SEQ ID NO: 428362 - RNA, 21 nt, Human
gggauugaaauccagcaucuc

SEQ ID NO: 428363 - RNA, 19 nt, Human
gguuccuuuccaaaaagca

SEQ ID NO: 428364 - RNA, 24 nt, Human
gugauccuccugccucagccuccc

SEQ ID NO: 428365 - RNA, 24 nt, Human
uacaggugugagccaccacaccca

SEQ ID NO: 428366 - RNA, 20 nt, Human
uacccaggguuucucucaaa

SEQ ID NO: 428367 - RNA, 24 nt, Human
uaccucaacuagugaggcccugcu

SEQ ID NO: 428368 - RNA, 23 nt, Human
ucccaaagugcugggauuacagg

SEQ ID NO: 428369 - RNA, 18 nt, Human
ucccgggugucccagcuu

SEQ ID NO: 428370 - RNA, 27 nt, Human
uccuccugccucagccucccaaagugc

SEQ ID NO: 428371 - RNA, 21 nt, Human
uccuuuccaaaaagcauuugu

SEQ ID NO: 428372 - RNA, 23 nt, Human
ucuugcuauguuuugcacacugg

SEQ ID NO: 428373 - RNA, 20 nt, Human
ugaaaggaacuaaaaugauu

SEQ ID NO: 428374 - RNA, 21 nt, Human
ugacaaaaccuuuccuacacc

SEQ ID NO: 428375 - RNA, 18 nt, Human
ugaccucaagugauccuc

SEQ ID NO: 428376 - RNA, 20 nt, Human
ugaccucaagugauccuccu

SEQ ID NO: 428377 - RNA, 21 nt, Human
ugaccucaagugauccuccug

SEQ ID NO: 428378 - RNA, 24 nt, Human
ugaccucaagugauccuccugccu

SEQ ID NO: 428379 - RNA, 24 nt, Human
ugacuaaaggcucucccacacucu

SEQ ID NO: 428380 - RNA, 25 nt, Human
ugacucccgggugucccagcuuccu

SEQ ID NO: 428381 - RNA, 20 nt, Human
ugaggucuugcuauguuuug

SEQ ID NO: 428382 - RNA, 19 nt, Human
ugaugacaaaaccuuuccu

SEQ ID NO: 428383 - RNA, 24 nt, Human
ugccucagccucccaaagugcugg

SEQ ID NO: 428384 - RNA, 24 nt, Human
ugcugggauuacaggugugagcca

SEQ ID NO: 428385 - RNA, 18 nt, Human
ugggauuacaggugugag

SEQ ID NO: 428386 - RNA, 19 nt, Human
ugggauuacaggugugagc

SEQ ID NO: 428387 - RNA, 22 nt, Human
ugggauuacaggugugagccac

SEQ ID NO: 428388 - RNA, 23 nt, Human
ugggauuacaggugugagccacc

SEQ ID NO: 428389 - RNA, 24 nt, Human
ugggauuacaggugugagccacca

SEQ ID NO: 428390 - RNA, 26 nt, Human
ugggauugaaauccagcaucuccugu

SEQ ID NO: 428391 - RNA, 20 nt, Human
uguauauggcuucucucuag

SEQ ID NO: 428392 - RNA, 22 nt, Human
ugucccagcuuccucccuccgg

SEQ ID NO: 428393 - RNA, 19 nt, Human
uuuaccaagguucucucca

SEQ ID NO: 428394 - RNA, 23 nt, Human
uuuauaguguuuugauccagggu

SEQ ID NO: 428395 - RNA, 24 nt, Human
aaaaaggcgcuuugcauuaaaacc

SEQ ID NO: 428396 - RNA, 22 nt, Human
aaacccuaacccacaacuuuug

SEQ ID NO: 428397 - RNA, 24 nt, Human
aaagugcugggauuacagguguga

SEQ ID NO: 428398 - RNA, 19 nt, Human
aaauaagccuuagaccaga

SEQ ID NO: 428399 - RNA, 24 nt, Human
aaauaagccuuagaccagaaugug

SEQ ID NO: 428400 - RNA, 24 nt, Human
aaauacaccccugggucauuaagc

SEQ ID NO: 428401 - RNA, 22 nt, Human
aaauguguaagguucucuccag

SEQ ID NO: 428402 - RNA, 25 nt, Human
aagcgauccucccuccuuggccucu

SEQ ID NO: 428403 - RNA, 26 nt, Human
aagcugaaaaaagguuuaauuucuaa

SEQ ID NO: 428404 - RNA, 22 nt, Human
aaggcgcuuugcauuaaaacca

SEQ ID NO: 428405 - RNA, 18 nt, Human
aagugcugggauuacagg

SEQ ID NO: 428406 - RNA, 19 nt, Human
aagugcugggauuacaggu

SEQ ID NO: 428407 - RNA, 26 nt, Human
aagugcugggauuacaggugugagcc

SEQ ID NO: 428408 - RNA, 20 nt, Human
acauguguaagguuucuuuc

SEQ ID NO: 428409 - RNA, 20 nt, Human
accuguaaucccagcuacuc

SEQ ID NO: 428410 - RNA, 18 nt, Human
agaggaaaagagcuaaga

SEQ ID NO: 428411 - RNA, 22 nt, Human
aggucuuacuauguugccuagg

SEQ ID NO: 428412 - RNA, 19 nt, Human
agguguggacuaacacacc

SEQ ID NO: 428413 - RNA, 22 nt, Human
agucaacucaaucucaagucaa

SEQ ID NO: 428414 - RNA, 24 nt, Human
agugguucauaccuguaaucccag

SEQ ID NO: 428415 - RNA, 19 nt, Human
caaagagagcucccaaguc

SEQ ID NO: 428416 - RNA, 20 nt, Human
caaagugcugggauuacagg

SEQ ID NO: 428417 - RNA, 23 nt, Human
caaagugcugggauuacaggugu

SEQ ID NO: 428418 - RNA, 24 nt, Human
caaagugcugggauuacaggugug

SEQ ID NO: 428419 - RNA, 24 nt, Human
caacauggcgacaggggcccucuc

SEQ ID NO: 428420 - RNA, 22 nt, Human
caagauaaacacuaaucagucc

SEQ ID NO: 428421 - RNA, 25 nt, Human
caagauaaacacuaaucaguccuca

SEQ ID NO: 428422 - RNA, 19 nt, Human
caccuggcuguuuuuuuuu

SEQ ID NO: 428423 - RNA, 21 nt, Human
cacuggacucagguugccuga

SEQ ID NO: 428424 - RNA, 21 nt, Human
cagcgcgccacuccaccccuu

SEQ ID NO: 428425 - RNA, 24 nt, Human
caguaugaacucucugauguugug

SEQ ID NO: 428426 - RNA, 19 nt, Human
cauaccuguaaucccagcu

SEQ ID NO: 428427 - RNA, 28 nt, Human
cauuccucucaaggcucagaauuaucuc

SEQ ID NO: 428428 - RNA, 23 nt, Human
cauuuucaacuuaagaggaaaaa

SEQ ID NO: 428429 - RNA, 21 nt, Human
cccagacagaggggagcucgc

SEQ ID NO: 428430 - RNA, 24 nt, Human
cccgcggcaaccagcgcgccacuc

SEQ ID NO: 428431 - RNA, 21 nt, Human
ccuacaauccgacagaaacug

SEQ ID NO: 428432 - RNA, 19 nt, Human
ccucccuccuuggccucuc

SEQ ID NO: 428433 - RNA, 23 nt, Human
ccugccccucucccccacccugc

SEQ ID NO: 428434 - RNA, 20 nt, Human
ccugggcuuaagcgauccuc

SEQ ID NO: 428435 - RNA, 21 nt, Human
ccuguaaucccagcuacucgg

SEQ ID NO: 428436 - RNA, 22 nt, Human
cgccuguaaucccaccuggccc

SEQ ID NO: 428437 - RNA, 24 nt, Human
cgggcgcggugcucgcgccuguaa

SEQ ID NO: 428438 - RNA, 21 nt, Human
cucccccacccugccccagac

SEQ ID NO: 428439 - RNA, 21 nt, Human
cucgcgccuguaaucccaccu

SEQ ID NO: 428440 - RNA, 23 nt, Human
cucuggugaggcuccuacaaucc

SEQ ID NO: 428441 - RNA, 21 nt, Human
cugaauuuugagcaaaggucu

SEQ ID NO: 428442 - RNA, 24 nt, Human
cugccccucucccccacccugccc

SEQ ID NO: 428443 - RNA, 24 nt, Human
cuuaaacucaagguuaagucaacu

SEQ ID NO: 428444 - RNA, 24 nt, Human
cuuggccucucaaagugcugggau

SEQ ID NO: 428445 - RNA, 23 nt, Human
cuuuaugaucuucuauagucacu

SEQ ID NO: 428446 - RNA, 22 nt, Human
cuuucaguuuccauuauccacu

SEQ ID NO: 428447 - RNA, 24 nt, Human
gaaauaugaaauuauccuccacuc

SEQ ID NO: 428448 - RNA, 18 nt, Human
gagaaacccuaacccaca

SEQ ID NO: 428449 - RNA, 20 nt, Human
gagggagggggagaaacccu

SEQ ID NO: 428450 - RNA, 18 nt, Human
gauuacaggugugagcca

SEQ ID NO: 428451 - RNA, 21 nt, Human
gauuacaggugugagccaccg

SEQ ID NO: 428452 - RNA, 22 nt, Human
gauuacaggugugagccaccgc

SEQ ID NO: 428453 - RNA, 25 nt, Human
gcccaacacaauauguuguuuuacc

SEQ ID NO: 428454 - RNA, 18 nt, Human
gccccgccugccggaugc

SEQ ID NO: 428455 - RNA, 20 nt, Human
gccgggcgcggugcucgcgc

SEQ ID NO: 428456 - RNA, 18 nt, Human
gcucgccccgccugccgg

SEQ ID NO: 428457 - RNA, 19 nt, Human
gcucgcgccuguaauccca

SEQ ID NO: 428458 - RNA, 21 nt, Human
ggaaauagaggaaaagagccg

SEQ ID NO: 428459 - RNA, 23 nt, Human
ggagggggagaaacccuaaccca

SEQ ID NO: 428460 - RNA, 23 nt, Human
ggcauagugguucauaccuguaa

SEQ ID NO: 428461 - RNA, 20 nt, Human
gggaagaggacacauaguug

SEQ ID NO: 428462 - RNA, 22 nt, Human
guaagguucucuccaguaugaa

SEQ ID NO: 428463 - RNA, 20 nt, Human
gucccugccccucuccccca

SEQ ID NO: 428464 - RNA, 19 nt, Human
gugugaguuuuacaacaug

SEQ ID NO: 428465 - RNA, 20 nt, Human
uaagcugaaaaaagguuuaa

SEQ ID NO: 428466 - RNA, 27 nt, Human
uaauugccagugcccgcggcaaccagc

SEQ ID NO: 428467 - RNA, 20 nt, Human
uacaggugugagccaccgcu

SEQ ID NO: 428468 - RNA, 22 nt, Human
uacaggugugagccaccgcucc

SEQ ID NO: 428469 - RNA, 20 nt, Human
uaccgaggucccugccccuc

SEQ ID NO: 428470 - RNA, 19 nt, Human
uaccugcucaaaaaaaggc

SEQ ID NO: 428471 - RNA, 24 nt, Human
uaccuguaaucccagcuacucggg

SEQ ID NO: 428472 - RNA, 24 nt, Human
uacuauguugccuaggcugauuuc

SEQ ID NO: 428473 - RNA, 21 nt, Human
uacuuuaucacuacauaagaa

SEQ ID NO: 428474 - RNA, 22 nt, Human
uagagaugaggucuuacuaugu

SEQ ID NO: 428475 - RNA, 25 nt, Human
uagaggaaaagagcuaagaguuuga

SEQ ID NO: 428476 - RNA, 24 nt, Human
uaguagagaugaggucuuacuaug

SEQ ID NO: 428477 - RNA, 24 nt, Human
uagugguucauaccuguaauccca

SEQ ID NO: 428478 - RNA, 18 nt, Human
uauguugccuaggcugau

SEQ ID NO: 428479 - RNA, 24 nt, Human
uauguugccuaggcugauuucgaa

SEQ ID NO: 428480 - RNA, 21 nt, Human
uauuaauaaauaagccuuaga

SEQ ID NO: 428481 - RNA, 22 nt, Human
ucaaaaauacaccccuggguca

SEQ ID NO: 428482 - RNA, 20 nt, Human
ucaaagugcugggauuacag

SEQ ID NO: 428483 - RNA, 21 nt, Human
ucaaagugcugggauuacagg

SEQ ID NO: 428484 - RNA, 24 nt, Human
ucaaagugcugggauuacaggugu

SEQ ID NO: 428485 - RNA, 21 nt, Human
ucaaucucaagucaaugccua

SEQ ID NO: 428486 - RNA, 19 nt, Human
ucagcaguaaauaauaaaa

SEQ ID NO: 428487 - RNA, 19 nt, Human
ucauaccuguaaucccagc

SEQ ID NO: 428488 - RNA, 21 nt, Human
uccacucaaacaacccaggac

SEQ ID NO: 428489 - RNA, 22 nt, Human
ucccccacccugccccagacag

SEQ ID NO: 428490 - RNA, 23 nt, Human
ucccugccccucucccccacccu

SEQ ID NO: 428491 - RNA, 20 nt, Human
uccuacaauccgacagaaac

SEQ ID NO: 428492 - RNA, 21 nt, Human
uccugggcuuaagcgauccuc

SEQ ID NO: 428493 - RNA, 21 nt, Human
ucuaaaaaaaaaaaacaaagu

SEQ ID NO: 428494 - RNA, 23 nt, Human
ucucaaagugcugggauuacagg

SEQ ID NO: 428495 - RNA, 24 nt, Human
ucucaaagugcugggauuacaggu

SEQ ID NO: 428496 - RNA, 20 nt, Human
ucucuggggcuacuuagucu

SEQ ID NO: 428497 - RNA, 19 nt, Human
ucuuacuauguugccuagg

SEQ ID NO: 428498 - RNA, 22 nt, Human
ucuuacuauguugccuaggcug

SEQ ID NO: 428499 - RNA, 23 nt, Human
ucuuacuauguugccuaggcuga

SEQ ID NO: 428500 - RNA, 21 nt, Human
ugacucuacuugguaauggag

SEQ ID NO: 428501 - RNA, 19 nt, Human
ugagggagggggagaaacc

SEQ ID NO: 428502 - RNA, 24 nt, Human
ugaggucuuacuauguugccuagg

SEQ ID NO: 428503 - RNA, 21 nt, Human
ugccagugcccgcggcaacca

SEQ ID NO: 428504 - RNA, 24 nt, Human
ugccuaggcugauuucgaauuccu

SEQ ID NO: 428505 - RNA, 23 nt, Human
ugcucgcgccuguaaucccaccu

SEQ ID NO: 428506 - RNA, 24 nt, Human
ugcugggauuacaggugugagcca

SEQ ID NO: 428507 - RNA, 19 nt, Human
ugggaccacagguguggac

SEQ ID NO: 428508 - RNA, 21 nt, Human
ugggaccacagguguggacua

SEQ ID NO: 428509 - RNA, 18 nt, Human
ugggauuacaggugugag

SEQ ID NO: 428510 - RNA, 19 nt, Human
ugggauuacaggugugagc

SEQ ID NO: 428511 - RNA, 21 nt, Human
ugggauuacaggugugagcca

SEQ ID NO: 428512 - RNA, 22 nt, Human
ugggauuacaggugugagccac

SEQ ID NO: 428513 - RNA, 23 nt, Human
ugggauuacaggugugagccacc

SEQ ID NO: 428514 - RNA, 24 nt, Human
ugggauuacaggugugagccaccg

SEQ ID NO: 428515 - RNA, 21 nt, Human
ugguucauaccuguaauccca

SEQ ID NO: 428516 - RNA, 18 nt, Human
uguaagguucucuccagu

SEQ ID NO: 428517 - RNA, 19 nt, Human
uguaagguuucuuuccagu

SEQ ID NO: 428518 - RNA, 24 nt, Human
ugugaugggaaauagaggaaaaga

SEQ ID NO: 428519 - RNA, 21 nt, Human
uguuuuaccuucgauuguuuc

SEQ ID NO: 428520 - RNA, 21 nt, Human
uuaacuuaggggccgggcgcg

SEQ ID NO: 428521 - RNA, 21 nt, Human
uuacaagggcugaauuuugag

SEQ ID NO: 428522 - RNA, 18 nt, Human
uuagaccagaaugugaug

SEQ ID NO: 428523 - RNA, 18 nt, Human
uuaguagagaugaggucu

SEQ ID NO: 428524 - RNA, 24 nt, Human
uuaguagagaugaggucuuacuau

SEQ ID NO: 428525 - RNA, 26 nt, Human
uucaagauaaacacuaaucaguccuc

SEQ ID NO: 428526 - RNA, 20 nt, Human
uucaaggaagguuacuuuau

SEQ ID NO: 428527 - RNA, 21 nt, Human
uuccaguaugaauugccuuau

SEQ ID NO: 428528 - RNA, 20 nt, Human
uuccaugaaauaugaaauua

SEQ ID NO: 428529 - RNA, 23 nt, Human
uuccugggcuuaagcgauccucc

SEQ ID NO: 428530 - RNA, 24 nt, Human
uucuaaaaaaaaaaaacaaaguua

SEQ ID NO: 428531 - RNA, 19 nt, Human
uugagcaaaggucuuucca

SEQ ID NO: 428532 - RNA, 23 nt, Human
uugcauuaaaaccauuuucaacu

SEQ ID NO: 428533 - RNA, 19 nt, Human
uuuuuaguagagaugaggu

SEQ ID NO: 428534 - RNA, 24 nt, Human
uuuuuguuuaaagaaauaaaaauc

SEQ ID NO: 428535 - RNA, 21 nt, Human
uuuuuuuuauuuuuaguagag

SEQ ID NO: 428536 - RNA, 24 nt, Human
uuuuuuuuauuuuuaguagagaug

SEQ ID NO: 428537 - RNA, 19 nt, Human
aaagcucugccacauucuu

SEQ ID NO: 428538 - RNA, 20 nt, Human
acaaagaccccgccgccucc

SEQ ID NO: 428539 - RNA, 22 nt, Human
acucuauggccacauccauaaa

SEQ ID NO: 428540 - RNA, 18 nt, Human
agacagguaaucaggucu

SEQ ID NO: 428541 - RNA, 25 nt, Human
agacagguaaucaggucuggccaag

SEQ ID NO: 428542 - RNA, 19 nt, Human
agagaacucuauggccaca

SEQ ID NO: 428543 - RNA, 19 nt, Human
auuugugggguuucucccc

SEQ ID NO: 428544 - RNA, 19 nt, Human
caaagaccccgccgccucc

SEQ ID NO: 428545 - RNA, 20 nt, Human
caauaaccagaucacagcgc

SEQ ID NO: 428546 - RNA, 24 nt, Human
cacagcgccacagaggcugggccu

SEQ ID NO: 428547 - RNA, 21 nt, Human
cacauucuucacauuuguaga

SEQ ID NO: 428548 - RNA, 20 nt, Human
caguaugaauuuucuuaugu

SEQ ID NO: 428549 - RNA, 21 nt, Human
cccgcugcagcgagacaaaga

SEQ ID NO: 428550 - RNA, 22 nt, Human
ccgcugcagcgagacaaagacc

SEQ ID NO: 428551 - RNA, 19 nt, Human
ccgggggauccuggcgucu

SEQ ID NO: 428552 - RNA, 23 nt, Human
ccugcagcacccgcugcagcgag

SEQ ID NO: 428553 - RNA, 19 nt, Human
cgccacagaggcugggccu

SEQ ID NO: 428554 - RNA, 19 nt, Human
cuaggcuuccgggggaucc

SEQ ID NO: 428555 - RNA, 18 nt, Human
cucccggaagacgucaug

SEQ ID NO: 428556 - RNA, 22 nt, Human
cucuauggccacauccauaaau

SEQ ID NO: 428557 - RNA, 20 nt, Human
gcagaaaggguugaagacuu

SEQ ID NO: 428558 - RNA, 21 nt, Human
gcugcagcgagacaaagaccc

SEQ ID NO: 428559 - RNA, 20 nt, Human
gcugggccucuaggaguaag

SEQ ID NO: 428560 - RNA, 23 nt, Human
guagaguuucucuccaguuugaa

SEQ ID NO: 428561 - RNA, 25 nt, Human
uaagaggacgcagaaaagugaaggc

SEQ ID NO: 428562 - RNA, 21 nt, Human
uacuaaggauugaguaucggu

SEQ ID NO: 428563 - RNA, 19 nt, Human
uaggaguaagaggacgcag

SEQ ID NO: 428564 - RNA, 21 nt, Human
uaucuuauguguaauaagagu

SEQ ID NO: 428565 - RNA, 21 nt, Human
uaucuuauguguaauaagggu

SEQ ID NO: 428566 - RNA, 25 nt, Human
ucaguggucccauuucuaggcuucc

SEQ ID NO: 428567 - RNA, 20 nt, Human
ucccaauaaccagaucacag

SEQ ID NO: 428568 - RNA, 21 nt, Human
ugaauuuucuuaugucucaua

SEQ ID NO: 428569 - RNA, 20 nt, Human
ugcagaaaggguugaagacu

SEQ ID NO: 428570 - RNA, 22 nt, Human
ugccacauuccucacauuugua

SEQ ID NO: 428571 - RNA, 22 nt, Human
ugccacauucuucacauuugua

SEQ ID NO: 428572 - RNA, 22 nt, Human
ugccacauucuucacauuugua

SEQ ID NO: 428573 - RNA, 22 nt, Human
ugccacauucuucacauuugua

SEQ ID NO: 428574 - RNA, 22 nt, Human
ugccacauucuucacauuugua

SEQ ID NO: 428575 - RNA, 21 nt, Human
uggccaagaaaaccagguuuc

SEQ ID NO: 428576 - RNA, 22 nt, Human
uggccaagaaaaccagguuucu

SEQ ID NO: 428577 - RNA, 20 nt, Human
uggcuaaaaccuuugccaca

SEQ ID NO: 428578 - RNA, 23 nt, Human
uguagaguuucucuccaguuuga

SEQ ID NO: 428579 - RNA, 19 nt, Human
uguaggcuuucucucuagu

SEQ ID NO: 428580 - RNA, 23 nt, Human
uguaggguuucucucuaguauga

SEQ ID NO: 428581 - RNA, 23 nt, Human
uguaggguuucucuuuacuauga

SEQ ID NO: 428582 - RNA, 23 nt, Human
uguaggguuuuucuccacuguga

SEQ ID NO: 428583 - RNA, 23 nt, Human
uguaggguuuuucuccaguauga

SEQ ID NO: 428584 - RNA, 19 nt, Human
ugucucauaaggugugagg

SEQ ID NO: 428585 - RNA, 23 nt, Human
ugugggguuucucuccaguauga

SEQ ID NO: 428586 - RNA, 23 nt, Human
ugugggguuucucuccgcuauga

SEQ ID NO: 428587 - RNA, 22 nt, Human
uuaugugcagaaaggguugaag

SEQ ID NO: 428588 - RNA, 20 nt, Human
uucacauuugugguguuucc

SEQ ID NO: 428589 - RNA, 30 nt, Human
uucacauuugugguguuucucuccugcauu

SEQ ID NO: 428590 - RNA, 18 nt, Human
uucauauuugugggguuu

SEQ ID NO: 428591 - RNA, 20 nt, Human
uuccagggcucuuuuccuug

SEQ ID NO: 428592 - RNA, 23 nt, Human
uuccagggcucuuuuccuuguuc

SEQ ID NO: 428593 - RNA, 19 nt, Human
uugaaaacugguuaaaggc

SEQ ID NO: 428594 - RNA, 26 nt, Human
uuguaggcuuucucucuaguguaaau

SEQ ID NO: 428595 - RNA, 19 nt, Human
uuuguaagguuucucucca

SEQ ID NO: 428596 - RNA, 19 nt, Human
uuuguagaguuucucucca

SEQ ID NO: 428597 - RNA, 19 nt, Human
uuugugggguuucucccca

SEQ ID NO: 428598 - RNA, 19 nt, Human
uuugugggguuucucucca

SEQ ID NO: 428599 - RNA, 24 nt, Human
aaagugcugggacuauaggcauga

SEQ ID NO: 428600 - RNA, 18 nt, Human
aaggcugugugaaggcuu

SEQ ID NO: 428601 - RNA, 19 nt, Human
aagugcugggacuauaggc

SEQ ID NO: 428602 - RNA, 19 nt, Human
aaugcaguggcgugaucuc

SEQ ID NO: 428603 - RNA, 21 nt, Human
aaugcaguggcgugaucucag

SEQ ID NO: 428604 - RNA, 18 nt, Human
accaugccugguucauuu

SEQ ID NO: 428605 - RNA, 24 nt, Human
accauguugaccacgcuggucucg

SEQ ID NO: 428606 - RNA, 24 nt, Human
acugcaaccucugucuccagguuc

SEQ ID NO: 428607 - RNA, 18 nt, Human
agagccaccuucggccuu

SEQ ID NO: 428608 - RNA, 21 nt, Human
agagccaccuucggccuucag

SEQ ID NO: 428609 - RNA, 18 nt, Human
agccuccugaguagcugg

SEQ ID NO: 428610 - RNA, 21 nt, Human
agguucaagugauucuccugc

SEQ ID NO: 428611 - RNA, 22 nt, Human
agguucaagugauucuccugcc

SEQ ID NO: 428612 - RNA, 23 nt, Human
agguucaagugauucuccugccu

SEQ ID NO: 428613 - RNA, 22 nt, Human
aguagagaugggguuacaccau

SEQ ID NO: 428614 - RNA, 21 nt, Human
aguagcugggauuagaggcau

SEQ ID NO: 428615 - RNA, 23 nt, Human
aguagcugggauuagaggcaugc

SEQ ID NO: 428616 - RNA, 24 nt, Human
aguggcgugaucucagcucacugc

SEQ ID NO: 428617 - RNA, 18 nt, Human
augggguuacaccauguu

SEQ ID NO: 428618 - RNA, 19 nt, Human
augggguuacaccauguug

SEQ ID NO: 428619 - RNA, 24 nt, Human
auuuuuugguaauuuuuaguagag

SEQ ID NO: 428620 - RNA, 22 nt, Human
caaaaaacaaaaaacaaaacag

SEQ ID NO: 428621 - RNA, 23 nt, Human
caaaaaacaaaaaacaaaacaga

SEQ ID NO: 428622 - RNA, 24 nt, Human
caaaagaaacuggaacaaucaagg

SEQ ID NO: 428623 - RNA, 24 nt, Human
caaagugcugggacuauaggcaug

SEQ ID NO: 428624 - RNA, 25 nt, Human
caaaugucuuacauuuauagacuuu

SEQ ID NO: 428625 - RNA, 21 nt, Human
caacaaaagaacuaggaugaa

SEQ ID NO: 428626 - RNA, 24 nt, Human
caacaacaaaagaacuaggaugaa

SEQ ID NO: 428627 - RNA, 20 nt, Human
caagugauucuccugccuua

SEQ ID NO: 428628 - RNA, 22 nt, Human
caagugauucuccugccuuagc

SEQ ID NO: 428629 - RNA, 25 nt, Human
cacacucuagaggacaguuggaaga

SEQ ID NO: 428630 - RNA, 21 nt, Human
cacauucuuaauauuuauagg

SEQ ID NO: 428631 - RNA, 21 nt, Human
caccauguugaccacgcuggu

SEQ ID NO: 428632 - RNA, 24 nt, Human
caccauguugaccacgcuggucuc

SEQ ID NO: 428633 - RNA, 18 nt, Human
cacugcaaccucugucuc

SEQ ID NO: 428634 - RNA, 21 nt, Human
caucaacaacaacaaaagaac

SEQ ID NO: 428635 - RNA, 24 nt, Human
cauucugucgcacaggcuggaaug

SEQ ID NO: 428636 - RNA, 24 nt, Human
ccaaagugcugggacuauaggcau

SEQ ID NO: 428637 - RNA, 19 nt, Human
ccagguucaagugauucuc

SEQ ID NO: 428638 - RNA, 22 nt, Human
ccagguucaagugauucuccug

SEQ ID NO: 428639 - RNA, 24 nt, Human
cccaaagugcugggacuauaggca

SEQ ID NO: 428640 - RNA, 19 nt, Human
ccugaguagcugggauuag

SEQ ID NO: 428641 - RNA, 23 nt, Human
ccugccuuagccuccugaguagc

SEQ ID NO: 428642 - RNA, 24 nt, Human
cgccuugcaccuuggccucccaaa

SEQ ID NO: 428643 - RNA, 18 nt, Human
cucaaaugaucugcccgc

SEQ ID NO: 428644 - RNA, 24 nt, Human
cucacugcaaccucugucuccagg

SEQ ID NO: 428645 - RNA, 18 nt, Human
cuccagguucaagugauu

SEQ ID NO: 428646 - RNA, 22 nt, Human
cuccagguucaagugauucucc

SEQ ID NO: 428647 - RNA, 24 nt, Human
cuccagguucaagugauucuccug

SEQ ID NO: 428648 - RNA, 21 nt, Human
cugaccucaaaugaucugccc

SEQ ID NO: 428649 - RNA, 23 nt, Human
cugcaaccucugucuccagguuc

SEQ ID NO: 428650 - RNA, 18 nt, Human
cugcagcacgaguccugu

SEQ ID NO: 428651 - RNA, 23 nt, Human
cugccuuagccuccugaguagcu

SEQ ID NO: 428652 - RNA, 24 nt, Human
cuggaaugcaguggcgugaucuca

SEQ ID NO: 428653 - RNA, 24 nt, Human
cuuagccuccugaguagcugggau

SEQ ID NO: 428654 - RNA, 20 nt, Human
gacaguuggaagauuuuccc

SEQ ID NO: 428655 - RNA, 23 nt, Human
gaccucaaaugaucugcccgccu

SEQ ID NO: 428656 - RNA, 18 nt, Human
gacuauaggcaugagcca

SEQ ID NO: 428657 - RNA, 19 nt, Human
gcuggaaugcaguggcgug

SEQ ID NO: 428658 - RNA, 22 nt, Human
ggcuggaaugcaguggcgugau

SEQ ID NO: 428659 - RNA, 19 nt, Human
ggucucgaauuucugaccu

SEQ ID NO: 428660 - RNA, 23 nt, Human
guagagaugggguuacaccaugu

SEQ ID NO: 428661 - RNA, 20 nt, Human
guguauucagaaggagcugg

SEQ ID NO: 428662 - RNA, 24 nt, Human
uacauuuauagacuuucaccccac

SEQ ID NO: 428663 - RNA, 22 nt, Human
uagagaugggguuacaccaugu

SEQ ID NO: 428664 - RNA, 20 nt, Human
uagccuccugaguagcuggg

SEQ ID NO: 428665 - RNA, 24 nt, Human
uaguagagaugggguuacaccaug

SEQ ID NO: 428666 - RNA, 19 nt, Human
ucaagugauucuccugccu

SEQ ID NO: 428667 - RNA, 19 nt, Human
ucacugcaaccucugucuc

SEQ ID NO: 428668 - RNA, 23 nt, Human
ucacugcaaccucugucuccagg

SEQ ID NO: 428669 - RNA, 24 nt, Human
ucagaaggagcuggaacaaccgaa

SEQ ID NO: 428670 - RNA, 19 nt, Human
ucauauauucacacucuag

SEQ ID NO: 428671 - RNA, 23 nt, Human
uccagguucaagugauucuccuc

SEQ ID NO: 428672 - RNA, 24 nt, Human
ucccaaagugcugggacuauaggc

SEQ ID NO: 428673 - RNA, 24 nt, Human
uccugaguagcugggauuagaggc

SEQ ID NO: 428674 - RNA, 24 nt, Human
ucucauucugucgcacaggcugga

SEQ ID NO: 428675 - RNA, 22 nt, Human
ucuccagguucaagugauucuc

SEQ ID NO: 428676 - RNA, 24 nt, Human
ucuccugccuuagccuccugagua

SEQ ID NO: 428677 - RNA, 22 nt, Human
ugaaaugaauuaggucaacuga

SEQ ID NO: 428678 - RNA, 24 nt, Human
ugaccacgcuggucucgaauuucu

SEQ ID NO: 428679 - RNA, 18 nt, Human
ugaccucaaaugaucugc

SEQ ID NO: 428680 - RNA, 20 nt, Human
ugauucuccugccuuagccu

SEQ ID NO: 428681 - RNA, 22 nt, Human
ugcaguggcgugaucucagcuc

SEQ ID NO: 428682 - RNA, 21 nt, Human
ugccugguucauuuuuuggua

SEQ ID NO: 428683 - RNA, 20 nt, Human
ugccuuagccuccugaguaa

SEQ ID NO: 428684 - RNA, 24 nt, Human
ugccuuagccuccugaguagcugg

SEQ ID NO: 428685 - RNA, 19 nt, Human
uggaagauuuucccacuuu

SEQ ID NO: 428686 - RNA, 19 nt, Human
uggaaugcaguggcgugau

SEQ ID NO: 428687 - RNA, 19 nt, Human
uggaaugcaguggcgugau

SEQ ID NO: 428688 - RNA, 24 nt, Human
uggaaugcaguggcgugaucucag

SEQ ID NO: 428689 - RNA, 24 nt, Human
uggcgugaucucagcucacugcaa

SEQ ID NO: 428690 - RNA, 18 nt, Human
ugggacuauaggcaugag

SEQ ID NO: 428691 - RNA, 21 nt, Human
ugggacuauaggcaugagcca

SEQ ID NO: 428692 - RNA, 23 nt, Human
ugggacuauaggcaugagccaac

SEQ ID NO: 428693 - RNA, 24 nt, Human
ugggacuauaggcaugagccaaca

SEQ ID NO: 428694 - RNA, 24 nt, Human
ugggauuagaggcaugcacuacca

SEQ ID NO: 428695 - RNA, 18 nt, Human
ugggguuacaccauguug

SEQ ID NO: 428696 - RNA, 21 nt, Human
uggucucgaauuucugaccuc

SEQ ID NO: 428697 - RNA, 27 nt, Human
ugugaaggcuuucccaaaugucuuaca

SEQ ID NO: 428698 - RNA, 22 nt, Human
uguuuguauucacacagcuucu

SEQ ID NO: 428699 - RNA, 22 nt, Human
uuaguagagaugggguuacacc

SEQ ID NO: 428700 - RNA, 24 nt, Human
uuaguagagaugggguuacaccau

SEQ ID NO: 428701 - RNA, 23 nt, Human
uucaagugauucuccugccuuag

SEQ ID NO: 428702 - RNA, 24 nt, Human
uucaagugauucuccugccuuagc

SEQ ID NO: 428703 - RNA, 25 nt, Human
uugagacagugucucauucugucgc

SEQ ID NO: 428704 - RNA, 18 nt, Human
uuggccucccaaagugcu

SEQ ID NO: 428705 - RNA, 19 nt, Human
uugguaauuuuuaguagag

SEQ ID NO: 428706 - RNA, 19 nt, Human
uuuauaggguuucucucca

SEQ ID NO: 428707 - RNA, 26 nt, Human
uuucugaccucaaaugaucugcccgc

SEQ ID NO: 428708 - RNA, 24 nt, Human
uuuugguaauuuuuaguagagaug

SEQ ID NO: 428709 - RNA, 22 nt, Human
uuuuuaguagagaugggguuac

SEQ ID NO: 428710 - RNA, 30 nt, Human
aaaaaacaaaaaggaaucccccuucccucc

SEQ ID NO: 428711 - RNA, 23 nt, Human
aaaacaaaaaggaaucccccuuc

SEQ ID NO: 428712 - RNA, 21 nt, Human
aaugguaguuuucccacagug

SEQ ID NO: 428713 - RNA, 24 nt, Human
agguugcaaauauugcagaaaguc

SEQ ID NO: 428714 - RNA, 21 nt, Human
aucacuguguuuguaucacuu

SEQ ID NO: 428715 - RNA, 25 nt, Human
caaagugcaucaucuuuguaaagcu

SEQ ID NO: 428716 - RNA, 19 nt, Human
cacacguaaaguaagggac

SEQ ID NO: 428717 - RNA, 24 nt, Human
cacaggccagacgcucgcgccgcc

SEQ ID NO: 428718 - RNA, 23 nt, Human
cagaaggaugcguuuccguggug

SEQ ID NO: 428719 - RNA, 20 nt, Human
ccccagggccccuccgcggg

SEQ ID NO: 428720 - RNA, 24 nt, Human
ccccuccgcgggcgucgcaggaau

SEQ ID NO: 428721 - RNA, 21 nt, Human
ccguggugcuuuccgccaggu

SEQ ID NO: 428722 - RNA, 23 nt, Human
ccuacagccaacacaggccagac

SEQ ID NO: 428723 - RNA, 19 nt, Human
cuccggaccgagucaccgc

SEQ ID NO: 428724 - RNA, 18 nt, Human
gaaggaugcguuuccgug

SEQ ID NO: 428725 - RNA, 22 nt, Human
gaagggaaggaggagaucagaa

SEQ ID NO: 428726 - RNA, 24 nt, Human
gaaguaaggcauuauacuucuuuu

SEQ ID NO: 428727 - RNA, 21 nt, Human
gccgccccccagggccccucc

SEQ ID NO: 428728 - RNA, 20 nt, Human
gcggggcuaaucucuggcuu

SEQ ID NO: 428729 - RNA, 20 nt, Human
ggccagacgcucgcgccgcc

SEQ ID NO: 428730 - RNA, 22 nt, Human
ggccagacgcucgcgccgcccc

SEQ ID NO: 428731 - RNA, 21 nt, Human
gucaucacuuucacauaaggc

SEQ ID NO: 428732 - RNA, 24 nt, Human
gucuucagaagccucgccgaccuu

SEQ ID NO: 428733 - RNA, 19 nt, Human
uaaagcucaucccuugucc

SEQ ID NO: 428734 - RNA, 21 nt, Human
uauugcaaaaaaauaaaagag

SEQ ID NO: 428735 - RNA, 21 nt, Human
ucacuuaaaaaacaaaaagga

SEQ ID NO: 428736 - RNA, 18 nt, Human
uccaggguggugaauaaa

SEQ ID NO: 428737 - RNA, 20 nt, Human
ucccccuucccucaaaauag

SEQ ID NO: 428738 - RNA, 24 nt, Human
ucccccuucccucaaaauagaacc

SEQ ID NO: 428739 - RNA, 18 nt, Human
ucccucaaaauagaaccg

SEQ ID NO: 428740 - RNA, 22 nt, Human
uccuaccaaaugaagucuucuc

SEQ ID NO: 428741 - RNA, 19 nt, Human
ucuccuacaagaguauuaa

SEQ ID NO: 428742 - RNA, 23 nt, Human
uuaauggcuuuuccacauauucc

SEQ ID NO: 428743 - RNA, 23 nt, Human
uuccguggugcuuuccgccaggu

SEQ ID NO: 428744 - RNA, 18 nt, Human
uugcaaaaaaauaaaaga

SEQ ID NO: 428745 - RNA, 19 nt, Human
uugcagaaagucacucuac

SEQ ID NO: 428746 - RNA, 20 nt, Human
uuggauauguauucuuuccu

SEQ ID NO: 428747 - RNA, 24 nt, Human
uuuucugaauucacuuaaaaaaca

SEQ ID NO: 428748 - RNA, 23 nt, Human
aaagacugaggaagauuuaaaga

SEQ ID NO: 428749 - RNA, 19 nt, Human
aagcauuuuugcuccagca

SEQ ID NO: 428750 - RNA, 21 nt, Human
aagccccuaacccgcggucug

SEQ ID NO: 428751 - RNA, 22 nt, Human
aagccccuaacccgcggucugc

SEQ ID NO: 428752 - RNA, 19 nt, Human
aaggcuuugcacacgguuc

SEQ ID NO: 428753 - RNA, 19 nt, Human
aaggcuuugcacauuuuuc

SEQ ID NO: 428754 - RNA, 22 nt, Human
aauagauugagugugguugcaa

SEQ ID NO: 428755 - RNA, 24 nt, Human
agaauacucuucuucacuuuaaag

SEQ ID NO: 428756 - RNA, 18 nt, Human
agccccuaacccgcgguc

SEQ ID NO: 428757 - RNA, 21 nt, Human
aggaagauuuaaagacugcca

SEQ ID NO: 428758 - RNA, 21 nt, Human
agguuugagaaugagguaaag

SEQ ID NO: 428759 - RNA, 22 nt, Human
auggcuuaaagguuuugucaca

SEQ ID NO: 428760 - RNA, 18 nt, Human
auuuguaagacuuuccuc

SEQ ID NO: 428761 - RNA, 21 nt, Human
auuuguagcauuuuuuucccc

SEQ ID NO: 428762 - RNA, 20 nt, Human
cacaacugagaacgcagaga

SEQ ID NO: 428763 - RNA, 20 nt, Human
cacaggcuuugcauauucuu

SEQ ID NO: 428764 - RNA, 24 nt, Human
cacaguaaggguugagaaccuauu

SEQ ID NO: 428765 - RNA, 21 nt, Human
caccaaggccucccacaacug

SEQ ID NO: 428766 - RNA, 21 nt, Human
cacuucuccacguuugcaguu

SEQ ID NO: 428767 - RNA, 19 nt, Human
cagagagaugaagccccua

SEQ ID NO: 428768 - RNA, 18 nt, Human
caggucacagagcgacgg

SEQ ID NO: 428769 - RNA, 24 nt, Human
cagugugaauuaucuucaugauuu

SEQ ID NO: 428770 - RNA, 25 nt, Human
cauuuuuugcauuuccaggggauuu

SEQ ID NO: 428771 - RNA, 21 nt, Human
ccaauacccgcaggucacaga

SEQ ID NO: 428772 - RNA, 22 nt, Human
cccacaacugagaacgcagaga

SEQ ID NO: 428773 - RNA, 24 nt, Human
cucugccacguuuuucacauuugu

SEQ ID NO: 428774 - RNA, 23 nt, Human
cugaggcuguggccgaaucacca

SEQ ID NO: 428775 - RNA, 23 nt, Human
cuggaguauggcuuaaagguuuu

SEQ ID NO: 428776 - RNA, 21 nt, Human
cuguggccgaaucaccaaggc

SEQ ID NO: 428777 - RNA, 22 nt, Human
cuucaugauuuagaaaagacug

SEQ ID NO: 428778 - RNA, 24 nt, Human
uaaaaauccugccacauuuuuugc

SEQ ID NO: 428779 - RNA, 24 nt, Human
uaaagguuuguggauggucugaag

SEQ ID NO: 428780 - RNA, 21 nt, Human
uacacucuuuacauuugcagg

SEQ ID NO: 428781 - RNA, 21 nt, Human
uacauguguaggguuucucuc

SEQ ID NO: 428782 - RNA, 21 nt, Human
uaucuaggaugaauucuuaua

SEQ ID NO: 428783 - RNA, 23 nt, Human
uauucgggagucuuagcuaccaa

SEQ ID NO: 428784 - RNA, 20 nt, Human
ucauaaagguuuguggaugg

SEQ ID NO: 428785 - RNA, 19 nt, Human
ucauaucuucucaauguaa

SEQ ID NO: 428786 - RNA, 19 nt, Human
ucgaauauaaaggauauca

SEQ ID NO: 428787 - RNA, 19 nt, Human
ucuugugcacaguaagggu

SEQ ID NO: 428788 - RNA, 19 nt, Human
ugagguaaagaacuuugcc

SEQ ID NO: 428789 - RNA, 25 nt, Human
ugcaaaaagaugagcauugguaaaa

SEQ ID NO: 428790 - RNA, 22 nt, Human
ugcacacuucuuuacaugugua

SEQ ID NO: 428791 - RNA, 26 nt, Human
ugcacauuuuucaauauuuuuggugg

SEQ ID NO: 428792 - RNA, 20 nt, Human
ugccacguucuucacauuuc

SEQ ID NO: 428793 - RNA, 22 nt, Human
ugccacguucuucacauuucca

SEQ ID NO: 428794 - RNA, 22 nt, Human
ugccacguuuuucacauuugua

SEQ ID NO: 428795 - RNA, 24 nt, Human
uggccgaaucaccaaggccuccca

SEQ ID NO: 428796 - RNA, 21 nt, Human
uggcuuaaagguuuugucaca

SEQ ID NO: 428797 - RNA, 20 nt, Human
ugguaaagacugugccacau

SEQ ID NO: 428798 - RNA, 18 nt, Human
uggucugaaggcucugcc

SEQ ID NO: 428799 - RNA, 21 nt, Human
uguacaguuucucuccgguau

SEQ ID NO: 428800 - RNA, 18 nt, Human
uguaggguuucucucugg

SEQ ID NO: 428801 - RNA, 22 nt, Human
ugugccacauucuucgcaugug

SEQ ID NO: 428802 - RNA, 26 nt, Human
uguuuaagaagccuggaguauggcuu

SEQ ID NO: 428803 - RNA, 24 nt, Human
uguuuauucaccggugagggcugu

SEQ ID NO: 428804 - RNA, 20 nt, Human
uuccaggggauuucuucagu

SEQ ID NO: 428805 - RNA, 18 nt, Human
uucuaugguuuuauaucu

SEQ ID NO: 428806 - RNA, 22 nt, Human
uucucauuauguuuaagaagcc

SEQ ID NO: 428807 - RNA, 23 nt, Human
uucucauuauguuuaagaagccu

SEQ ID NO: 428808 - RNA, 19 nt, Human
uuugcacauuuuucaauau

SEQ ID NO: 428809 - RNA, 24 nt, Human
uuuuucaauauuuuugguggcuuc

SEQ ID NO: 428810 - RNA, 21 nt, Human
aaaauccagaucuuauagcca

SEQ ID NO: 428811 - RNA, 18 nt, Human
agaaacugagaacuugca

SEQ ID NO: 428812 - RNA, 18 nt, Human
agacaggugggcaccaga

SEQ ID NO: 428813 - RNA, 18 nt, Human
aggagacaggugggcacc

SEQ ID NO: 428814 - RNA, 21 nt, Human
agggacuuugauggagugaug

SEQ ID NO: 428815 - RNA, 23 nt, Human
caacuguuuuuagaagauucuga

SEQ ID NO: 428816 - RNA, 22 nt, Human
cacaucucagaccauacccucu

SEQ ID NO: 428817 - RNA, 21 nt, Human
cacccuuguaccccaaaagcc

SEQ ID NO: 428818 - RNA, 26 nt, Human
cacccuuguaccccaaaagccagucu

SEQ ID NO: 428819 - RNA, 20 nt, Human
cacucucucuuccucuugcc

SEQ ID NO: 428820 - RNA, 25 nt, Human
cagguuaaaaacgcaauguacagca

SEQ ID NO: 428821 - RNA, 19 nt, Human
ccacucucucuuccucuug

SEQ ID NO: 428822 - RNA, 21 nt, Human
ccagacccagagccggcggga

SEQ ID NO: 428823 - RNA, 22 nt, Human
ccagacccagagccggcgggag

SEQ ID NO: 428824 - RNA, 27 nt, Human
ccagacccagagccggcgggagcccuc

SEQ ID NO: 428825 - RNA, 25 nt, Human
ccgcggcuggaacggcccccggggc

SEQ ID NO: 428826 - RNA, 20 nt, Human
ccuaucuccagacccagagc

SEQ ID NO: 428827 - RNA, 20 nt, Human
ccucaggcuagcgcuggucc

SEQ ID NO: 428828 - RNA, 18 nt, Human
ccuccggcucagccgccu

SEQ ID NO: 428829 - RNA, 23 nt, Human
ccucuugccggcugccgggguac

SEQ ID NO: 428830 - RNA, 19 nt, Human
cgaccgccuccggcucagc

SEQ ID NO: 428831 - RNA, 18 nt, Human
cgcuggucccagucugca

SEQ ID NO: 428832 - RNA, 23 nt, Human
cugggccucagcuuuccuaucuc

SEQ ID NO: 428833 - RNA, 23 nt, Human
gaagauggaguggguaaaaucca

SEQ ID NO: 428834 - RNA, 21 nt, Human
gagccgcaucucuauggucgg

SEQ ID NO: 428835 - RNA, 18 nt, Human
gcacaucucagaccauac

SEQ ID NO: 428836 - RNA, 19 nt, Human
gccagggacuuugauggag

SEQ ID NO: 428837 - RNA, 20 nt, Human
gcgcguggucuuggacagac

SEQ ID NO: 428838 - RNA, 20 nt, Human
gcuucgcuucucugggccuc

SEQ ID NO: 428839 - RNA, 21 nt, Human
gcuucgcuucucugggccuca

SEQ ID NO: 428840 - RNA, 21 nt, Human
uagccagggacuuugauggag

SEQ ID NO: 428841 - RNA, 25 nt, Human
ucuagucacccuuguaccccaaaag

SEQ ID NO: 428842 - RNA, 24 nt, Human
ucugcacaucucagaccauacccu

SEQ ID NO: 428843 - RNA, 22 nt, Human
ugaagaaacugagaacuugcag

SEQ ID NO: 428844 - RNA, 20 nt, Human
ugagguaggagacagguggg

SEQ ID NO: 428845 - RNA, 21 nt, Human
uuaaaaacgcaauguacagca

SEQ ID NO: 428846 - RNA, 22 nt, Human
uuaaaugugaauauuagcguug

SEQ ID NO: 428847 - RNA, 23 nt, Human
uuaaaugugaauauuagcguugu

SEQ ID NO: 428848 - RNA, 22 nt, Human
uuagcguuguucuggggaaucu

SEQ ID NO: 428849 - RNA, 23 nt, Human
uucucugggccucagcuuuccua

SEQ ID NO: 428850 - RNA, 22 nt, Human
aaaaaaaaaaaaagaggcagaa

SEQ ID NO: 428851 - RNA, 25 nt, Human
aaaaacagcaaauuacacaagaccc

SEQ ID NO: 428852 - RNA, 23 nt, Human
aaaacagcaaauuacacaagacc

SEQ ID NO: 428853 - RNA, 21 nt, Human
aaaaugaacaccauuuuccac

SEQ ID NO: 428854 - RNA, 19 nt, Human
aacccgccccccaccccca

SEQ ID NO: 428855 - RNA, 20 nt, Human
aacccgccccccacccccaa

SEQ ID NO: 428856 - RNA, 18 nt, Human
aaggccacacacacagga

SEQ ID NO: 428857 - RNA, 20 nt, Human
acaagaccccccccaaaaaa

SEQ ID NO: 428858 - RNA, 24 nt, Human
acaagauaaaugaugcaaaggcca

SEQ ID NO: 428859 - RNA, 19 nt, Human
acagcagccaagaugggga

SEQ ID NO: 428860 - RNA, 24 nt, Human
acauacacacacacauaaaguuug

SEQ ID NO: 428861 - RNA, 22 nt, Human
acuccaguggcccauccaguuu

SEQ ID NO: 428862 - RNA, 22 nt, Human
agaaagaaacaauucuaacuga

SEQ ID NO: 428863 - RNA, 22 nt, Human
agcugagaccucucagggccug

SEQ ID NO: 428864 - RNA, 19 nt, Human
aggcaggacagcagccaag

SEQ ID NO: 428865 - RNA, 19 nt, Human
agguuaacccacccccacu

SEQ ID NO: 428866 - RNA, 20 nt, Human
aguggagaggcuuggcugga

SEQ ID NO: 428867 - RNA, 26 nt, Human
auccaguucaucuccaggcaccccca

SEQ ID NO: 428868 - RNA, 24 nt, Human
augcaggugccaccuccacccugc

SEQ ID NO: 428869 - RNA, 21 nt, Human
auguacauauauauauauauu

SEQ ID NO: 428870 - RNA, 20 nt, Human
auuuauaaaacccgcccccc

SEQ ID NO: 428871 - RNA, 26 nt, Human
caaaaacagcaaauuacacaagaccc

SEQ ID NO: 428872 - RNA, 25 nt, Human
caacacaccaccugccuugggaaac

SEQ ID NO: 428873 - RNA, 20 nt, Human
cacacacauaaaguuuguuu

SEQ ID NO: 428874 - RNA, 22 nt, Human
cacuuccacucuaggccccagg

SEQ ID NO: 428875 - RNA, 21 nt, Human
cacuugcuccucagaaccagg

SEQ ID NO: 428876 - RNA, 27 nt, Human
cagcaacaaaagcaguucagcuuccaa

SEQ ID NO: 428877 - RNA, 19 nt, Human
cagccaguuggaaucaugc

SEQ ID NO: 428878 - RNA, 19 nt, Human
caggaaaaaaaaaaaaaag

SEQ ID NO: 428879 - RNA, 25 nt, Human
caugugaccugcacaaagcuguacc

SEQ ID NO: 428880 - RNA, 20 nt, Human
ccaaaaacagcaaauuacac

SEQ ID NO: 428881 - RNA, 24 nt, Human
ccaaaaacagcaaauuacacaaga

SEQ ID NO: 428882 - RNA, 22 nt, Human
ccaaggugggaagagcugggga

SEQ ID NO: 428883 - RNA, 21 nt, Human
ccacacauacacacacacaua

SEQ ID NO: 428884 - RNA, 23 nt, Human
ccacacauacacacacacauaaa

SEQ ID NO: 428885 - RNA, 18 nt, Human
ccaggcacccccaaaaac

SEQ ID NO: 428886 - RNA, 23 nt, Human
ccaggcacccccaaaaacagcaa

SEQ ID NO: 428887 - RNA, 25 nt, Human
ccaguggcccauccaguucaucucc

SEQ ID NO: 428888 - RNA, 21 nt, Human
ccaguucaucuccaggcaccc

SEQ ID NO: 428889 - RNA, 23 nt, Human
cccaaaaacagcaaauuacacaa

SEQ ID NO: 428890 - RNA, 22 nt, Human
cccacuuccacucuaggcccca

SEQ ID NO: 428891 - RNA, 19 nt, Human
cccauccaguucaucucca

SEQ ID NO: 428892 - RNA, 22 nt, Human
ccccaaaaacagcaaauuacac

SEQ ID NO: 428893 - RNA, 19 nt, Human
ccccaacacaccaccugcc

SEQ ID NO: 428894 - RNA, 24 nt, Human
cccccaaaaaaaaugaacaccauu

SEQ ID NO: 428895 - RNA, 18 nt, Human
ccccccaaaaaaaaugaa

SEQ ID NO: 428896 - RNA, 24 nt, Human
ccccggugaggguaagguuggugg

SEQ ID NO: 428897 - RNA, 19 nt, Human
ccucagaaccagggauaaa

SEQ ID NO: 428898 - RNA, 22 nt, Human
cuccacccugcacuugcuccuc

SEQ ID NO: 428899 - RNA, 18 nt, Human
cuccuauaugcagccagu

SEQ ID NO: 428900 - RNA, 22 nt, Human
cucuaggccccaggugagacuc

SEQ ID NO: 428901 - RNA, 20 nt, Human
cuguacccucuuccuguucg

SEQ ID NO: 428902 - RNA, 19 nt, Human
cuuugggucugaaggggcc

SEQ ID NO: 428903 - RNA, 21 nt, Human
gaaggggcccccaacacacca

SEQ ID NO: 428904 - RNA, 21 nt, Human
gagcuuuauugagacuccagu

SEQ ID NO: 428905 - RNA, 18 nt, Human
gcaagaggaggaggugau

SEQ ID NO: 428906 - RNA, 19 nt, Human
gcacaaaguuuccacugca

SEQ ID NO: 428907 - RNA, 18 nt, Human
gccucuggcaaagucugg

SEQ ID NO: 428908 - RNA, 21 nt, Human
gcugcagugggcaugugaccu

SEQ ID NO: 428909 - RNA, 25 nt, Human
ggaaacagcgaggauggugcagagc

SEQ ID NO: 428910 - RNA, 20 nt, Human
ggccccaggugagacuccac

SEQ ID NO: 428911 - RNA, 19 nt, Human
ggcuggaagaagggagagg

SEQ ID NO: 428912 - RNA, 20 nt, Human
gggagagaaagaaacaauuc

SEQ ID NO: 428913 - RNA, 21 nt, Human
gggaguggggggacuggggag

SEQ ID NO: 428914 - RNA, 22 nt, Human
gggaguggggggacuggggagc

SEQ ID NO: 428915 - RNA, 18 nt, Human
ggggagagaaacggggag

SEQ ID NO: 428916 - RNA, 21 nt, Human
ggggagagaaagaaacaauuc

SEQ ID NO: 428917 - RNA, 24 nt, Human
uaaaacccgccccccacccccaag

SEQ ID NO: 428918 - RNA, 23 nt, Human
uaaagccuuagcccuccuccaag

SEQ ID NO: 428919 - RNA, 22 nt, Human
uaacugacuccuauaugcagcc

SEQ ID NO: 428920 - RNA, 27 nt, Human
uaagucuuccagcaacaaaagcaguuc

SEQ ID NO: 428921 - RNA, 21 nt, Human
uacacaagaccccccccaaaa

SEQ ID NO: 428922 - RNA, 23 nt, Human
uacacaagaccccccccaaaaaa

SEQ ID NO: 428923 - RNA, 18 nt, Human
uauguacauauauauaua

SEQ ID NO: 428924 - RNA, 18 nt, Human
uauguacauauauauaua

SEQ ID NO: 428925 - RNA, 20 nt, Human
uauguacauauauauauaua

SEQ ID NO: 428926 - RNA, 21 nt, Human
uauguacauauauauauauau

SEQ ID NO: 428927 - RNA, 21 nt, Human
ucagaggcaggacagcagcca

SEQ ID NO: 428928 - RNA, 22 nt, Human
ucaucuccaggcacccccaaaa

SEQ ID NO: 428929 - RNA, 20 nt, Human
uccacacauacacacacaca

SEQ ID NO: 428930 - RNA, 22 nt, Human
uccacacauacacacacacagu

SEQ ID NO: 428931 - RNA, 21 nt, Human
uccacacauacacacacacau

SEQ ID NO: 428932 - RNA, 22 nt, Human
uccacacauacacacacacaua

SEQ ID NO: 428933 - RNA, 20 nt, Human
uccggggucgggaguggggg

SEQ ID NO: 428934 - RNA, 23 nt, Human
ucucagggccugaaucuucuuuu

SEQ ID NO: 428935 - RNA, 26 nt, Human
ucucagggccugaaucuucuuuucca

SEQ ID NO: 428936 - RNA, 23 nt, Human
ucuccaggcacccccaaaaacag

SEQ ID NO: 428937 - RNA, 24 nt, Human
ucuggacauucaacaacgcggggg

SEQ ID NO: 428938 - RNA, 22 nt, Human
ugaccugcacaaagcuguaccc

SEQ ID NO: 428939 - RNA, 27 nt, Human
ugaggguaagguuggugggggugcagg

SEQ ID NO: 428940 - RNA, 18 nt, Human
ugagguuaacccaccccc

SEQ ID NO: 428941 - RNA, 23 nt, Human
ugcacaaaguuuccacugcaaga

SEQ ID NO: 428942 - RNA, 19 nt, Human
ugccuaaagcuuugggucu

SEQ ID NO: 428943 - RNA, 21 nt, Human
ugggaaacagcgaggauggug

SEQ ID NO: 428944 - RNA, 21 nt, Human
ugggaagagcuggggaaagua

SEQ ID NO: 428945 - RNA, 24 nt, Human
ugggaagagcuggggaaaguagaa

SEQ ID NO: 428946 - RNA, 18 nt, Human
ugggaucugugcuugugu

SEQ ID NO: 428947 - RNA, 19 nt, Human
uggggagagaaacggggag

SEQ ID NO: 428948 - RNA, 21 nt, Human
uggggagcguugcccuuuugu

SEQ ID NO: 428949 - RNA, 19 nt, Human
uguacauauauauauauau

SEQ ID NO: 428950 - RNA, 21 nt, Human
uuccuguggcauuuaaauuaa

SEQ ID NO: 428951 - RNA, 20 nt, Human
uuuauaaaacccgcccccca

SEQ ID NO: 428952 - RNA, 25 nt, Human
uuuccacacauacacacacacauaa

SEQ ID NO: 428953 - RNA, 19 nt, Human
aaacguuuuaaaccaaaga

SEQ ID NO: 428954 - RNA, 27 nt, Human
aacaaacuaccuccacuuaaaaaaaau

SEQ ID NO: 428955 - RNA, 27 nt, Human
aacacucugguaacagaugagguacaa

SEQ ID NO: 428956 - RNA, 28 nt, Human
aacauguacauguacauacauauaugca

SEQ ID NO: 428957 - RNA, 19 nt, Human
aauuuuaaaaauacagaaa

SEQ ID NO: 428958 - RNA, 21 nt, Human
acaggguuuuaaucauaugca

SEQ ID NO: 428959 - RNA, 21 nt, Human
acauauaugcauccauuacca

SEQ ID NO: 428960 - RNA, 19 nt, Human
acuacaaaucaagccacag

SEQ ID NO: 428961 - RNA, 20 nt, Human
agcaauaaaaaacaggccuc

SEQ ID NO: 428962 - RNA, 21 nt, Human
agggauaagguuugagaggaa

SEQ ID NO: 428963 - RNA, 22 nt, Human
auagagagcaaguccauccauu

SEQ ID NO: 428964 - RNA, 25 nt, Human
augcauaggucuuuuuuugaaaucu

SEQ ID NO: 428965 - RNA, 24 nt, Human
auguacauacauauaugcauccau

SEQ ID NO: 428966 - RNA, 26 nt, Human
auuauuuucccuucuccaaccuucag

SEQ ID NO: 428967 - RNA, 18 nt, Human
auucccauccucacuccc

SEQ ID NO: 428968 - RNA, 21 nt, Human
caagccacaguaaauauccua

SEQ ID NO: 428969 - RNA, 25 nt, Human
cagguuucucuguuggacacagggu

SEQ ID NO: 428970 - RNA, 18 nt, Human
cauauuacauagagagca

SEQ ID NO: 428971 - RNA, 20 nt, Human
cauggucuauuuuucccccu

SEQ ID NO: 428972 - RNA, 19 nt, Human
ccaaagacauuuacacuua

SEQ ID NO: 428973 - RNA, 24 nt, Human
ccaauacccaucccaccucccaca

SEQ ID NO: 428974 - RNA, 18 nt, Human
ccacaucucuuacauuua

SEQ ID NO: 428975 - RNA, 22 nt, Human
ccacuuaaaaaaaauaguucca

SEQ ID NO: 428976 - RNA, 21 nt, Human
ccauaaggaguaagcuguggu

SEQ ID NO: 428977 - RNA, 24 nt, Human
ccauuaccaauagauaguacugag

SEQ ID NO: 428978 - RNA, 19 nt, Human
cccaucccaccucccacac

SEQ ID NO: 428979 - RNA, 19 nt, Human
cccuuuaaccaauacccau

SEQ ID NO: 428980 - RNA, 19 nt, Human
ccuauaccacaauccagaa

SEQ ID NO: 428981 - RNA, 20 nt, Human
ccuauaccacaauccagaau

SEQ ID NO: 428982 - RNA, 18 nt, Human
ccucaugauuucagucca

SEQ ID NO: 428983 - RNA, 22 nt, Human
ccucccaaguccuggugccucu

SEQ ID NO: 428984 - RNA, 26 nt, Human
cuaccuccacuuaaaaaaaauaguuc

SEQ ID NO: 428985 - RNA, 21 nt, Human
cuacuacaaaucaagccacag

SEQ ID NO: 428986 - RNA, 21 nt, Human
cucagucuuuccuggagaugg

SEQ ID NO: 428987 - RNA, 22 nt, Human
cucagucuuuccuggagaugga

SEQ ID NO: 428988 - RNA, 23 nt, Human
cucauuauuuucccuucuccacu

SEQ ID NO: 428989 - RNA, 24 nt, Human
cucauuauuuucccuucuccacuc

SEQ ID NO: 428990 - RNA, 19 nt, Human
cucccaaaugcagaguaag

SEQ ID NO: 428991 - RNA, 21 nt, Human
cucuccagcaugaauuuucug

SEQ ID NO: 428992 - RNA, 22 nt, Human
cucuccaguaugaacacucugg

SEQ ID NO: 428993 - RNA, 18 nt, Human
cuggugucccuuaaguuu

SEQ ID NO: 428994 - RNA, 22 nt, Human
cuguauccuuccaauccguuuc

SEQ ID NO: 428995 - RNA, 18 nt, Human
cugugcaucaucuucuca

SEQ ID NO: 428996 - RNA, 18 nt, Human
cuguguaugaucucccaa

SEQ ID NO: 428997 - RNA, 19 nt, Human
cuucacuaguuucucucca

SEQ ID NO: 428998 - RNA, 21 nt, Human
cuucccacuucuuucuccacc

SEQ ID NO: 428999 - RNA, 19 nt, Human
cuucuugcuucaacagagg

SEQ ID NO: 429000 - RNA, 23 nt, Human
cuuucaccauuaucucugcugca

SEQ ID NO: 429001 - RNA, 18 nt, Human
gaccaugucaucuauuuu

SEQ ID NO: 429002 - RNA, 21 nt, Human
gagaagcucccaacuaagucc

SEQ ID NO: 429003 - RNA, 24 nt, Human
gaggauuuacuuuuggcugaagau

SEQ ID NO: 429004 - RNA, 19 nt, Human
ggcugaagauauuuccaca

SEQ ID NO: 429005 - RNA, 21 nt, Human
gggcaugaugaggugcaaauu

SEQ ID NO: 429006 - RNA, 21 nt, Human
ggggcaugaugaggugcaaau

SEQ ID NO: 429007 - RNA, 19 nt, Human
guggauguuuauauaaaaa

SEQ ID NO: 429008 - RNA, 24 nt, Human
uaaaugcauaggucuuuuuuugaa

SEQ ID NO: 429009 - RNA, 18 nt, Human
uaaccaauacccauccca

SEQ ID NO: 429010 - RNA, 24 nt, Human
uaaccaauacccaucccaccuccc

SEQ ID NO: 429011 - RNA, 20 nt, Human
uaagacaagauaucccuaua

SEQ ID NO: 429012 - RNA, 21 nt, Human
uaagacaagauaucccuauac

SEQ ID NO: 429013 - RNA, 20 nt, Human
uaaggcuucucuguguauga

SEQ ID NO: 429014 - RNA, 24 nt, Human
uacaaaaaauaagacaagauaucc

SEQ ID NO: 429015 - RNA, 24 nt, Human
uacaaacguuuuaaaccaaagaca

SEQ ID NO: 429016 - RNA, 24 nt, Human
uacagaaaaguacaaaaaauaaga

SEQ ID NO: 429017 - RNA, 19 nt, Human
uacauguacauacauauau

SEQ ID NO: 429018 - RNA, 23 nt, Human
uaccacaauccagaaucaaucag

SEQ ID NO: 429019 - RNA, 22 nt, Human
uacuccuuagaagcacaggguu

SEQ ID NO: 429020 - RNA, 21 nt, Human
uauuuacaacuuaauuuuucu

SEQ ID NO: 429021 - RNA, 24 nt, Human
ucacucccauuccuauuuugagaa

SEQ ID NO: 429022 - RNA, 21 nt, Human
ucaguauauucaaugcuuucu

SEQ ID NO: 429023 - RNA, 22 nt, Human
uccacagauacagcauucccau

SEQ ID NO: 429024 - RNA, 22 nt, Human
uccauccauucauccgugauaa

SEQ ID NO: 429025 - RNA, 21 nt, Human
ucccacuuuuagugaaaaugu

SEQ ID NO: 429026 - RNA, 21 nt, Human
ucccauccucacucccauucc

SEQ ID NO: 429027 - RNA, 26 nt, Human
ucccuauaccacaauccagaaucaau

SEQ ID NO: 429028 - RNA, 22 nt, Human
uccuggagauggaucaacaugc

SEQ ID NO: 429029 - RNA, 19 nt, Human
ucuaucugugcaucaucuu

SEQ ID NO: 429030 - RNA, 25 nt, Human
ucucuguguaugaucucccaaaugc

SEQ ID NO: 429031 - RNA, 20 nt, Human
ucuucuugcuucaacagagg

SEQ ID NO: 429032 - RNA, 20 nt, Human
ugaaagagaaguggauguuu

SEQ ID NO: 429033 - RNA, 19 nt, Human
ugaagucuuuugaaagaga

SEQ ID NO: 429034 - RNA, 24 nt, Human
ugaauggaagcuuucccacauuca

SEQ ID NO: 429035 - RNA, 25 nt, Human
ugccuaaacuuucaccauuaucucu

SEQ ID NO: 429036 - RNA, 24 nt, Human
uguacauacauauaugcauccauu

SEQ ID NO: 429037 - RNA, 18 nt, Human
uguacauguacauacaua

SEQ ID NO: 429038 - RNA, 25 nt, Human
uguacauguacauacauauaugcau

SEQ ID NO: 429039 - RNA, 24 nt, Human
uuaaaccaaagacauuuacacuua

SEQ ID NO: 429040 - RNA, 19 nt, Human
uucacaagguuucucucca

SEQ ID NO: 429041 - RNA, 20 nt, Human
uucagaaggauuauuucugg

SEQ ID NO: 429042 - RNA, 23 nt, Human
uucccacuucuuucuccaccaua

SEQ ID NO: 429043 - RNA, 21 nt, Human
uucccuucuccacucuucaca

SEQ ID NO: 429044 - RNA, 23 nt, Human
uugaugagugaggauuuacuuuu

SEQ ID NO: 429045 - RNA, 18 nt, Human
uuggcuacuacaaaucaa

SEQ ID NO: 429046 - RNA, 19 nt, Human
uuggcuacuacaaaucaag

SEQ ID NO: 429047 - RNA, 21 nt, Human
uuggcuacuacaaaucaagcc

SEQ ID NO: 429048 - RNA, 19 nt, Human
uuucaaggcuuucaugggg

SEQ ID NO: 429049 - RNA, 23 nt, Human
uuucucuguuggacacaggguuu

SEQ ID NO: 429050 - RNA, 22 nt, Human
uuuuguguauaguucauggucu

SEQ ID NO: 429051 - RNA, 23 nt, Human
aaaacaccaagaucugaaggcua

SEQ ID NO: 429052 - RNA, 18 nt, Human
aacacaaucacucucacc

SEQ ID NO: 429053 - RNA, 19 nt, Human
aacacaaucacucucaccc

SEQ ID NO: 429054 - RNA, 20 nt, Human
aacacaaucacucucacccc

SEQ ID NO: 429055 - RNA, 24 nt, Human
acaauggggaguaggucacccugc

SEQ ID NO: 429056 - RNA, 19 nt, Human
acccucccgccagcucccc

SEQ ID NO: 429057 - RNA, 22 nt, Human
acucaugacuucacuucccaga

SEQ ID NO: 429058 - RNA, 24 nt, Human
acuucccagagcucugcccagcug

SEQ ID NO: 429059 - RNA, 19 nt, Human
agagcucugcccagcugcc

SEQ ID NO: 429060 - RNA, 21 nt, Human
aggcaccaggggguggaaacg

SEQ ID NO: 429061 - RNA, 24 nt, Human
aucccaccucccacccucccgcca

SEQ ID NO: 429062 - RNA, 25 nt, Human
aucccaccucccacccucccgccag

SEQ ID NO: 429063 - RNA, 21 nt, Human
caaaacaccaagaucugaagg

SEQ ID NO: 429064 - RNA, 22 nt, Human
cacaacacaaucacucucaccc

SEQ ID NO: 429065 - RNA, 18 nt, Human
caccucccacccucccgc

SEQ ID NO: 429066 - RNA, 18 nt, Human
cagagcucugcccagcug

SEQ ID NO: 429067 - RNA, 20 nt, Human
cagcuccccucccaugcucc

SEQ ID NO: 429068 - RNA, 22 nt, Human
ccagcuccccucccaugcuccc

SEQ ID NO: 429069 - RNA, 21 nt, Human
ccccucccaugcucccaaucc

SEQ ID NO: 429070 - RNA, 22 nt, Human
ccucccgccagcuccccuccca

SEQ ID NO: 429071 - RNA, 25 nt, Human
ccuggcuaaaucccaccucccaccc

SEQ ID NO: 429072 - RNA, 19 nt, Human
ccuuggggaccucuugggg

SEQ ID NO: 429073 - RNA, 22 nt, Human
cgccuccucgcccacaacacaa

SEQ ID NO: 429074 - RNA, 24 nt, Human
cgccuccucgcccacaacacaauc

SEQ ID NO: 429075 - RNA, 21 nt, Human
cucccacccucccgccagcuc

SEQ ID NO: 429076 - RNA, 22 nt, Human
cugaaggcuauggauuuucucu

SEQ ID NO: 429077 - RNA, 20 nt, Human
gacuucacuucccagagcuc

SEQ ID NO: 429078 - RNA, 21 nt, Human
gagcucugcccagcugcccag

SEQ ID NO: 429079 - RNA, 24 nt, Human
gauuuccagaacaauggggaguag

SEQ ID NO: 429080 - RNA, 23 nt, Human
ggaaacgccuccucgcccacaac

SEQ ID NO: 429081 - RNA, 23 nt, Human
ggacacaacugcugcacccgcgc

SEQ ID NO: 429082 - RNA, 19 nt, Human
ggagauuuccagaacaaug

SEQ ID NO: 429083 - RNA, 20 nt, Human
ucaccccuuuccuggcuaaa

SEQ ID NO: 429084 - RNA, 23 nt, Human
ucacuagggucuugggacuucug

SEQ ID NO: 429085 - RNA, 20 nt, Human
ucacuucccagagcucugcc

SEQ ID NO: 429086 - RNA, 18 nt, Human
ucccagagcucugcccag

SEQ ID NO: 429087 - RNA, 18 nt, Human
ucccgccagcuccccucc

SEQ ID NO: 429088 - RNA, 22 nt, Human
ucucaccccuuuccuggcuaaa

SEQ ID NO: 429089 - RNA, 21 nt, Human
ucugaaggcuauggauuuucu

SEQ ID NO: 429090 - RNA, 24 nt, Human
ugaaggcuauggauuuucucuaag

SEQ ID NO: 429091 - RNA, 19 nt, Human
ugcaggcagucagcccaag

SEQ ID NO: 429092 - RNA, 25 nt, Human
ugcugcacccgcgcuccgaggccgc

SEQ ID NO: 429093 - RNA, 22 nt, Human
uggaaacgccuccucgcccaca

SEQ ID NO: 429094 - RNA, 21 nt, Human
uucacuucccagagcucugcc

SEQ ID NO: 429095 - RNA, 30 nt, Human
uucacuucccagagcucugcccagcugccu

SEQ ID NO: 429096 - RNA, 25 nt, Human
aaaaacgaagacuucaaggaaagga

SEQ ID NO: 429097 - RNA, 20 nt, Human
aaagaaugcugacuaaccaa

SEQ ID NO: 429098 - RNA, 22 nt, Human
acuccauuuacacauaguaacc

SEQ ID NO: 429099 - RNA, 22 nt, Human
agaggaggggaaggggggaggg

SEQ ID NO: 429100 - RNA, 23 nt, Human
agaggaggggaaggggggagggg

SEQ ID NO: 429101 - RNA, 22 nt, Human
cagaucacgugcuugaauuucc

SEQ ID NO: 429102 - RNA, 23 nt, Human
cauugcuucuauaaaggugacaa

SEQ ID NO: 429103 - RNA, 18 nt, Human
ccaguauuauuucacuuu

SEQ ID NO: 429104 - RNA, 23 nt, Human
cccgccagaucacgugcuugaau

SEQ ID NO: 429105 - RNA, 22 nt, Human
cuaagguaaaaacgaagacuuc

SEQ ID NO: 429106 - RNA, 22 nt, Human
cucaauaccaccuuaaucacuu

SEQ ID NO: 429107 - RNA, 19 nt, Human
ggaaggggggaggggggag

SEQ ID NO: 429108 - RNA, 21 nt, Human
ggaggggggagaacuuuugcu

SEQ ID NO: 429109 - RNA, 22 nt, Human
uaaauacguuaggcaaacgccc

SEQ ID NO: 429110 - RNA, 18 nt, Human
uaagguaaaaacgaagac

SEQ ID NO: 429111 - RNA, 18 nt, Human
uaggcaaacgcccauccc

SEQ ID NO: 429112 - RNA, 25 nt, Human
ucaauaccaccuuaaucacuuaugc

SEQ ID NO: 429113 - RNA, 19 nt, Human
ugaucuaaaacaaguaaug

SEQ ID NO: 429114 - RNA, 28 nt, Human
ugcccgagacuaagguaaaaacgaagac

SEQ ID NO: 429115 - RNA, 21 nt, Human
ugcuguagaguugaaaaagaa

SEQ ID NO: 429116 - RNA, 20 nt, Human
uggguggaauagcaaguuuc

SEQ ID NO: 429117 - RNA, 22 nt, Human
uucaaagaaugcugacuaacca

SEQ ID NO: 429118 - RNA, 23 nt, Human
uucggcaacagcucccaccccug

SEQ ID NO: 429119 - RNA, 23 nt, Human
aaacagucagaagggccgccagc

SEQ ID NO: 429120 - RNA, 19 nt, Human
cacccuucccgguuccagg

SEQ ID NO: 429121 - RNA, 22 nt, Human
cggaccccaccgcagagggagg

SEQ ID NO: 429122 - RNA, 21 nt, Human
gggugccauccauccuuaaau

SEQ ID NO: 429123 - RNA, 25 nt, Human
uaaacuccagcuuggcuccccucgu

SEQ ID NO: 429124 - RNA, 19 nt, Human
uagaaaauaauccaauuua

SEQ ID NO: 429125 - RNA, 23 nt, Human
uccccucguccggcucauuaccu

SEQ ID NO: 429126 - RNA, 21 nt, Human
ucccggaccccaccgcagagg

SEQ ID NO: 429127 - RNA, 18 nt, Human
ucccgguuccagggugcc

SEQ ID NO: 429128 - RNA, 20 nt, Human
ugccaugucccggaccccac

SEQ ID NO: 429129 - RNA, 18 nt, Human
ugccuguguaaacuccag

SEQ ID NO: 429130 - RNA, 18 nt, Human
ugucccggaccccaccgc

SEQ ID NO: 429131 - RNA, 23 nt, Human
uuaccugccaugucccggacccc

SEQ ID NO: 429132 - RNA, 26 nt, Human
uucccgguuccagggugccauccauc

SEQ ID NO: 429133 - RNA, 24 nt, Human
acccgcaagacacauacuuggcuc

SEQ ID NO: 429134 - RNA, 22 nt, Human
agacuccugggugaugcaguuu

SEQ ID NO: 429135 - RNA, 23 nt, Human
caagacacauacuuggcucaaac

SEQ ID NO: 429136 - RNA, 25 nt, Human
ccacaguccccuuaguugacccccc

SEQ ID NO: 429137 - RNA, 22 nt, Human
ccgcaagacacauacuuggcuc

SEQ ID NO: 429138 - RNA, 22 nt, Human
cgcaagacacauacuuggcuca

SEQ ID NO: 429139 - RNA, 21 nt, Human
cugaaacgugccacagucccc

SEQ ID NO: 429140 - RNA, 23 nt, Human
uagcacguuguaccccauaaaua

SEQ ID NO: 429141 - RNA, 20 nt, Human
ugaaacgugccacagucccc

SEQ ID NO: 429142 - RNA, 27 nt, Human
ugaaacgugccacaguccccuuaguug

SEQ ID NO: 429143 - RNA, 25 nt, Human
uguaugcacacauuaaaauagcacg

SEQ ID NO: 429144 - RNA, 30 nt, Human
aaaaaacccaaauagccaaucaacagauag

SEQ ID NO: 429145 - RNA, 21 nt, Human
aaaaacccaaauagccaauca

SEQ ID NO: 429146 - RNA, 24 nt, Human
aaaaagcaagagaugaacagccca

SEQ ID NO: 429147 - RNA, 23 nt, Human
aaaacaacaugugaaccaaaaag

SEQ ID NO: 429148 - RNA, 19 nt, Human
aaacaacaugugaaccaaa

SEQ ID NO: 429149 - RNA, 19 nt, Human
aacauggugaaacccgucu

SEQ ID NO: 429150 - RNA, 20 nt, Human
aacauggugaaacccgucuu

SEQ ID NO: 429151 - RNA, 21 nt, Human
aagcaagagaugaacagccca

SEQ ID NO: 429152 - RNA, 23 nt, Human
aaucgcuugaacccgggaggcga

SEQ ID NO: 429153 - RNA, 24 nt, Human
acagagugagacuccaucucaaaa

SEQ ID NO: 429154 - RNA, 24 nt, Human
acuccagccugggugacagaguga

SEQ ID NO: 429155 - RNA, 22 nt, Human
agaaucgcuugaacccgggagg

SEQ ID NO: 429156 - RNA, 24 nt, Human
agacugaggcaggagaaucgcuug

SEQ ID NO: 429157 - RNA, 18 nt, Human
agccaggcaugguggugc

SEQ ID NO: 429158 - RNA, 22 nt, Human
agccuggccaacauggugaaac

SEQ ID NO: 429159 - RNA, 24 nt, Human
agccuggccaacauggugaaaccc

SEQ ID NO: 429160 - RNA, 24 nt, Human
agccugggugacagagugagacuc

SEQ ID NO: 429161 - RNA, 24 nt, Human
aggcaggagaaucgcuugaacccg

SEQ ID NO: 429162 - RNA, 18 nt, Human
aggcagguggaucaccug

SEQ ID NO: 429163 - RNA, 22 nt, Human
aggcagguggaucaccugaggu

SEQ ID NO: 429164 - RNA, 26 nt, Human
aggcagguggaucaccugaggucagg

SEQ ID NO: 429165 - RNA, 24 nt, Human
aggcaugguggugcacaccuguaa

SEQ ID NO: 429166 - RNA, 21 nt, Human
aggccgaggcagguggaucac

SEQ ID NO: 429167 - RNA, 24 nt, Human
aggcgaagguugaaaugagcugag

SEQ ID NO: 429168 - RNA, 22 nt, Human
agggaaaucugaauaaaaacaa

SEQ ID NO: 429169 - RNA, 21 nt, Human
auugcacuccagccuggguga

SEQ ID NO: 429170 - RNA, 24 nt, Human
auugcacuccagccugggugacag

SEQ ID NO: 429171 - RNA, 24 nt, Human
caacacuuuuggaggccgaggcag

SEQ ID NO: 429172 - RNA, 20 nt, Human
caacauggugaaacccgucu

SEQ ID NO: 429173 - RNA, 23 nt, Human
caacauggugaaacccgucuuua

SEQ ID NO: 429174 - RNA, 20 nt, Human
caaugcacagaagaaaaaac

SEQ ID NO: 429175 - RNA, 24 nt, Human
cacacaccacuaauuagggaaauc

SEQ ID NO: 429176 - RNA, 25 nt, Human
cacaccuguaaucccaacacuuuug

SEQ ID NO: 429177 - RNA, 24 nt, Human
cacaccuguaaucccagcuacuug

SEQ ID NO: 429178 - RNA, 19 nt, Human
caccuguaaucccaacacu

SEQ ID NO: 429179 - RNA, 23 nt, Human
caccuguaaucccagcuacuugg

SEQ ID NO: 429180 - RNA, 24 nt, Human
caccuguaaucccagcuacuuggg

SEQ ID NO: 429181 - RNA, 22 nt, Human
cacuccagccugggugacagag

SEQ ID NO: 429182 - RNA, 24 nt, Human
cacuccagccugggugacagagug

SEQ ID NO: 429183 - RNA, 24 nt, Human
cagaagaaaaaacccaaauagcca

SEQ ID NO: 429184 - RNA, 24 nt, Human
cagguggaucaccugaggucagga

SEQ ID NO: 429185 - RNA, 19 nt, Human
cauugcacuccagccuggg

SEQ ID NO: 429186 - RNA, 19 nt, Human
cauugcacuccagccuggg

SEQ ID NO: 429187 - RNA, 21 nt, Human
cauugcacuccagccugggug

SEQ ID NO: 429188 - RNA, 22 nt, Human
cauugcacuccagccuggguga

SEQ ID NO: 429189 - RNA, 24 nt, Human
cauugcacuccagccugggugaca

SEQ ID NO: 429190 - RNA, 25 nt, Human
cauugcacuccagccugggugacag

SEQ ID NO: 429191 - RNA, 19 nt, Human
ccaaauuuucacagcacac

SEQ ID NO: 429192 - RNA, 20 nt, Human
ccauugcacuccagccuggg

SEQ ID NO: 429193 - RNA, 21 nt, Human
ccauugcacuccagccugggu

SEQ ID NO: 429194 - RNA, 21 nt, Human
ccauugcacuccagccugggu

SEQ ID NO: 429195 - RNA, 22 nt, Human
ccauugcacuccagccugggug

SEQ ID NO: 429196 - RNA, 24 nt, Human
ccauugcacuccagccugggugac

SEQ ID NO: 429197 - RNA, 22 nt, Human
cccgucuuuacuaaaaauacaa

SEQ ID NO: 429198 - RNA, 22 nt, Human
ccugaggucaggaguuagagac

SEQ ID NO: 429199 - RNA, 22 nt, Human
ccuggccaacauggugaaaccc

SEQ ID NO: 429200 - RNA, 23 nt, Human
ccuggccaacauggugaaacccg

SEQ ID NO: 429201 - RNA, 21 nt, Human
ccuggccucagcccaccuucc

SEQ ID NO: 429202 - RNA, 22 nt, Human
ccugggugacagagugagacuc

SEQ ID NO: 429203 - RNA, 21 nt, Human
ccuguaaucccagcuacuugg

SEQ ID NO: 429204 - RNA, 20 nt, Human
cgaggcagguggaucaccug

SEQ ID NO: 429205 - RNA, 24 nt, Human
cgaggcagguggaucaccugaggu

SEQ ID NO: 429206 - RNA, 26 nt, Human
cgaggcagguggaucaccugagguca

SEQ ID NO: 429207 - RNA, 22 nt, Human
cucacaccuguaaucccaacac

SEQ ID NO: 429208 - RNA, 24 nt, Human
cucacaccuguaaucccaacacuu

SEQ ID NO: 429209 - RNA, 21 nt, Human
cuguaaucccagcuacuuggg

SEQ ID NO: 429210 - RNA, 28 nt, Human
gaaaacaaugagcagaggaccgguaccc

SEQ ID NO: 429211 - RNA, 24 nt, Human
gaagguugaaaugagcugagguca

SEQ ID NO: 429212 - RNA, 24 nt, Human
gacagagugagacuccaucucaaa

SEQ ID NO: 429213 - RNA, 23 nt, Human
gagaccagccuggccaacauggu

SEQ ID NO: 429214 - RNA, 24 nt, Human
gaucaccugaggucaggaguuaga

SEQ ID NO: 429215 - RNA, 24 nt, Human
gcacuccagccugggugacagagu

SEQ ID NO: 429216 - RNA, 22 nt, Human
gccaacauggugaaacccgucu

SEQ ID NO: 429217 - RNA, 19 nt, Human
gccauugcacuccagccug

SEQ ID NO: 429218 - RNA, 24 nt, Human
gccauugcacuccagccuggguga

SEQ ID NO: 429219 - RNA, 22 nt, Human
ggacagcugucuguguguagag

SEQ ID NO: 429220 - RNA, 22 nt, Human
ggaggccgaggcagguggauca

SEQ ID NO: 429221 - RNA, 22 nt, Human
ggaucaccugaggucaggaguu

SEQ ID NO: 429222 - RNA, 24 nt, Human
ggccucagcccaccuuccgugcug

SEQ ID NO: 429223 - RNA, 23 nt, Human
gguggcucacaccuguaauccca

SEQ ID NO: 429224 - RNA, 24 nt, Human
gguggugcacaccuguaaucccag

SEQ ID NO: 429225 - RNA, 22 nt, Human
guagaggguccugcagccucca

SEQ ID NO: 429226 - RNA, 24 nt, Human
gucaugccauugcacuccagccug

SEQ ID NO: 429227 - RNA, 24 nt, Human
uaaaaaacaacaugugaaccaaaa

SEQ ID NO: 429228 - RNA, 28 nt, Human
uaaaaaacaacaugugaaccaaaaagca

SEQ ID NO: 429229 - RNA, 25 nt, Human
uaaaaaaccaacgacaguuggagac

SEQ ID NO: 429230 - RNA, 21 nt, Human
uaaaaauacaaaaauuagcca

SEQ ID NO: 429231 - RNA, 25 nt, Human
ucacagcacacuguggugcccuggu

SEQ ID NO: 429232 - RNA, 23 nt, Human
ucaugccauugcacuccagccug

SEQ ID NO: 429233 - RNA, 23 nt, Human
uccagccugggugacagagugag

SEQ ID NO: 429234 - RNA, 24 nt, Human
uccagccugggugacagagugaga

SEQ ID NO: 429235 - RNA, 20 nt, Human
uccugcagccuccaguaagg

SEQ ID NO: 429236 - RNA, 18 nt, Human
ucgcuugaacccgggagg

SEQ ID NO: 429237 - RNA, 19 nt, Human
ucucaaaaaauaaaaaaua

SEQ ID NO: 429238 - RNA, 21 nt, Human
ucugaauaaaaacaaugagcu

SEQ ID NO: 429239 - RNA, 22 nt, Human
ugaaaacaaugagcagaggaca

SEQ ID NO: 429240 - RNA, 18 nt, Human
ugaaccaaaaagcaagag

SEQ ID NO: 429241 - RNA, 20 nt, Human
ugaggcaggagaaucgcuug

SEQ ID NO: 429242 - RNA, 24 nt, Human
ugaggcaggagaaucgcuugaacc

SEQ ID NO: 429243 - RNA, 25 nt, Human
ugaggcaggagaaucgcuugaaccc

SEQ ID NO: 429244 - RNA, 24 nt, Human
ugaggucaugccauugcacuccag

SEQ ID NO: 429245 - RNA, 24 nt, Human
ugcacuccagccugggugacagag

SEQ ID NO: 429246 - RNA, 20 nt, Human
ugccaaauuuucacagcacu

SEQ ID NO: 429247 - RNA, 23 nt, Human
uggaucaccugaggucaggaguu

SEQ ID NO: 429248 - RNA, 27 nt, Human
uggaucaccugaggucaggaguuagag

SEQ ID NO: 429249 - RNA, 20 nt, Human
uggcaaaauuuaaaaaacca

SEQ ID NO: 429250 - RNA, 23 nt, Human
uggccaacauggugaaacccguc

SEQ ID NO: 429251 - RNA, 21 nt, Human
uggcucacaccuguaauccca

SEQ ID NO: 429252 - RNA, 21 nt, Human
ugggagaagauauuugcaaca

SEQ ID NO: 429253 - RNA, 24 nt, Human
ugguggugcacaccuguaauccca

SEQ ID NO: 429254 - RNA, 23 nt, Human
uguagaggguccugcagccucca

SEQ ID NO: 429255 - RNA, 19 nt, Human
ugugaaccaaaaagcaaga

SEQ ID NO: 429256 - RNA, 23 nt, Human
uuaaaaaacaacaugugaaccaa

SEQ ID NO: 429257 - RNA, 23 nt, Human
uuagagaccagccuggccaacau

SEQ ID NO: 429258 - RNA, 24 nt, Human
uugggagacugaggcaggagaauc

SEQ ID NO: 429259 - RNA, 22 nt, Human
uuucacagcacacuguggugcc

SEQ ID NO: 429260 - RNA, 21 nt, Human
aaacaagcccaaacccaagac

SEQ ID NO: 429261 - RNA, 27 nt, Human
aagaggcaagagcaguggcagugggca

SEQ ID NO: 429262 - RNA, 20 nt, Human
aaucuucucccuuguaacaa

SEQ ID NO: 429263 - RNA, 20 nt, Human
acuggauguaggcagugagc

SEQ ID NO: 429264 - RNA, 19 nt, Human
agaagggagccuguaaagg

SEQ ID NO: 429265 - RNA, 19 nt, Human
caaacccaagacaucacaa

SEQ ID NO: 429266 - RNA, 22 nt, Human
caaacccaagacaucacaagag

SEQ ID NO: 429267 - RNA, 21 nt, Human
caagagcaguggcagugagaa

SEQ ID NO: 429268 - RNA, 24 nt, Human
caagcccaaacccaagacaucaca

SEQ ID NO: 429269 - RNA, 22 nt, Human
cacaagcuguaaaaacaagccc

SEQ ID NO: 429270 - RNA, 21 nt, Human
cagccuccauaaucuucuccc

SEQ ID NO: 429271 - RNA, 22 nt, Human
ccaagacaucacaagaggcaag

SEQ ID NO: 429272 - RNA, 26 nt, Human
cccaaacccaagacaucacaagaggc

SEQ ID NO: 429273 - RNA, 19 nt, Human
ccguucacaagcuguaaaa

SEQ ID NO: 429274 - RNA, 19 nt, Human
cuuuacuuuuuugguaacu

SEQ ID NO: 429275 - RNA, 19 nt, Human
gagcaguggcagugagaag

SEQ ID NO: 429276 - RNA, 23 nt, Human
gagcugaguccaggcuuucgguc

SEQ ID NO: 429277 - RNA, 22 nt, Human
gaguuggagaggaaacuaugcu

SEQ ID NO: 429278 - RNA, 19 nt, Human
ggcagugagcugaguccag

SEQ ID NO: 429279 - RNA, 18 nt, Human
uaaaaacaagcccaaacc

SEQ ID NO: 429280 - RNA, 19 nt, Human
uaaaaacaagcccaaaccc

SEQ ID NO: 429281 - RNA, 23 nt, Human
uaaaaacaagcccaaacccaaga

SEQ ID NO: 429282 - RNA, 19 nt, Human
uaggcagugagcugagucc

SEQ ID NO: 429283 - RNA, 19 nt, Human
ucccaggcuauguggccac

SEQ ID NO: 429284 - RNA, 20 nt, Human
uggagaggaaacuaugcucg

SEQ ID NO: 429285 - RNA, 18 nt, Human
uggcagaggcugagacaa

SEQ ID NO: 429286 - RNA, 20 nt, Human
uggcagaggcugagacaaug

SEQ ID NO: 429287 - RNA, 18 nt, Human
uggccaaagaggaguugg

SEQ ID NO: 429288 - RNA, 20 nt, Human
aaaaggaauuucugauuaaa

SEQ ID NO: 429289 - RNA, 23 nt, Human
aauucuggcauuucaucuugcca

SEQ ID NO: 429290 - RNA, 22 nt, Human
agaaaaaugcuaccacacucuu

SEQ ID NO: 429291 - RNA, 20 nt, Human
ccaucgggauuaauaugcug

SEQ ID NO: 429292 - RNA, 19 nt, Human
ccccccuccuccccacucc

SEQ ID NO: 429293 - RNA, 20 nt, Human
cccccuccuccccacucccc

SEQ ID NO: 429294 - RNA, 20 nt, Human
ccccuccuccccacuccccc

SEQ ID NO: 429295 - RNA, 22 nt, Human
cccuccuccccacuccccccgc

SEQ ID NO: 429296 - RNA, 23 nt, Human
cgaccccccuccuccccacuccc

SEQ ID NO: 429297 - RNA, 25 nt, Human
cggcggccgaccccccuccucccca

SEQ ID NO: 429298 - RNA, 21 nt, Human
cugcggcggccgaccccccuc

SEQ ID NO: 429299 - RNA, 25 nt, Human
gaccccccuccuccccacucccccc

SEQ ID NO: 429300 - RNA, 20 nt, Human
gccgaccccccuccucccca

SEQ ID NO: 429301 - RNA, 23 nt, Human
gccgaccccccuccuccccacuc

SEQ ID NO: 429302 - RNA, 21 nt, Human
ggcugcggcggccgacccccc

SEQ ID NO: 429303 - RNA, 20 nt, Human
guaaaaugcauauucucuga

SEQ ID NO: 429304 - RNA, 19 nt, Human
uaaaaugcauauucucuga

SEQ ID NO: 429305 - RNA, 24 nt, Human
uaaaaugcauauucucugaaaugc

SEQ ID NO: 429306 - RNA, 22 nt, Human
uacucauaaaaacaauaaacac

SEQ ID NO: 429307 - RNA, 22 nt, Human
uauucccaaagguaaaaugcau

SEQ ID NO: 429308 - RNA, 18 nt, Human
ucagguuaaaaucagcca

SEQ ID NO: 429309 - RNA, 25 nt, Human
ucaugguuuacuuuuugcuuuaauc

SEQ ID NO: 429310 - RNA, 18 nt, Human
uccuccccacuccccccg

SEQ ID NO: 429311 - RNA, 22 nt, Human
uuagaaauaguaaugcuguuuu

SEQ ID NO: 429312 - RNA, 21 nt, Human
uuucaugguuuacuuuuugcu

SEQ ID NO: 429313 - RNA, 18 nt, Human
uuugaaguggguucuacu

SEQ ID NO: 429314 - RNA, 21 nt, Human
uuuuaauucuggcauuucauc

SEQ ID NO: 429315 - RNA, 22 nt, Human
uccucagcauuuacuuacaaau

SEQ ID NO: 429316 - RNA, 24 nt, Human
uuuuuuuuuuuuuuuuuuuuucag

SEQ ID NO: 429317 - RNA, 19 nt, Human
aaagcggcugcucgcugcc

SEQ ID NO: 429318 - RNA, 18 nt, Human
aagcaagggggaggagaa

SEQ ID NO: 429319 - RNA, 26 nt, Human
acaacucucuccuuguaaacggguua

SEQ ID NO: 429320 - RNA, 19 nt, Human
agcuugccccaacucuccc

SEQ ID NO: 429321 - RNA, 21 nt, Human
aguagcaagcacacaggucuc

SEQ ID NO: 429322 - RNA, 19 nt, Human
aguggcuccggccuccagg

SEQ ID NO: 429323 - RNA, 19 nt, Human
augcauaacuauauauaua

SEQ ID NO: 429324 - RNA, 19 nt, Human
caaagccucacuugcuagc

SEQ ID NO: 429325 - RNA, 23 nt, Human
cagaaugugcaucaucauuccuc

SEQ ID NO: 429326 - RNA, 19 nt, Human
cagccuccugcacgcgagc

SEQ ID NO: 429327 - RNA, 20 nt, Human
caggagacaacucucuccuu

SEQ ID NO: 429328 - RNA, 21 nt, Human
cagugcccagaccugccuucu

SEQ ID NO: 429329 - RNA, 18 nt, Human
ccagugcccagaccugcc

SEQ ID NO: 429330 - RNA, 19 nt, Human
cccaacucucccgcauccu

SEQ ID NO: 429331 - RNA, 19 nt, Human
ccccagugcccagaccugc

SEQ ID NO: 429332 - RNA, 19 nt, Human
cccugguuggccuuuucug

SEQ ID NO: 429333 - RNA, 19 nt, Human
ccugauucucucucaguag

SEQ ID NO: 429334 - RNA, 19 nt, Human
cgccgggugcuaaacggua

SEQ ID NO: 429335 - RNA, 23 nt, Human
cucaagacaacgcggucccuggg

SEQ ID NO: 429336 - RNA, 21 nt, Human
cucuuugccccagugcccaga

SEQ ID NO: 429337 - RNA, 21 nt, Human
cugggagugggaagaguuuug

SEQ ID NO: 429338 - RNA, 25 nt, Human
gaacgggaugcagagacaaagccuc

SEQ ID NO: 429339 - RNA, 21 nt, Human
gaccugccuucucugcacccu

SEQ ID NO: 429340 - RNA, 20 nt, Human
guaaacggguuaagccuuug

SEQ ID NO: 429341 - RNA, 18 nt, Human
uaagccuuugggaucaug

SEQ ID NO: 429342 - RNA, 21 nt, Human
uagccaaacucaagacaacgc

SEQ ID NO: 429343 - RNA, 18 nt, Human
ucaagggccucgugcuuu

SEQ ID NO: 429344 - RNA, 19 nt, Human
ucaagggccucgugcuuuc

SEQ ID NO: 429345 - RNA, 19 nt, Human
ucaguagcaagcacacagg

SEQ ID NO: 429346 - RNA, 22 nt, Human
ucucccgcauccuggcggaaac

SEQ ID NO: 429347 - RNA, 19 nt, Human
ugacagcaaaugcauaacu

SEQ ID NO: 429348 - RNA, 22 nt, Human
ugcagagacaaagccucacuug

SEQ ID NO: 429349 - RNA, 27 nt, Human
ugcccagaccugccuucucugcacccu

SEQ ID NO: 429350 - RNA, 24 nt, Human
ugccccaacucucccgcauccugg

SEQ ID NO: 429351 - RNA, 22 nt, Human
ugccuucucugcacccugucau

SEQ ID NO: 429352 - RNA, 22 nt, Human
uuaacauauuuuagaggauaaa

SEQ ID NO: 429353 - RNA, 23 nt, Human
uucucuuugccccagugcccaga

SEQ ID NO: 429354 - RNA, 20 nt, Human
uuucugguagaucacucauc

SEQ ID NO: 429355 - RNA, 27 nt, Human
aaaaacaguugggaggccauauuuggc

SEQ ID NO: 429356 - RNA, 23 nt, Human
aaaauaacucaucugcuuacauc

SEQ ID NO: 429357 - RNA, 22 nt, Human
aaaaugcuucugaucccaggca

SEQ ID NO: 429358 - RNA, 23 nt, Human
aaagaucaguaaacauuauagaa

SEQ ID NO: 429359 - RNA, 18 nt, Human
aaagggggggcaagcuga

SEQ ID NO: 429360 - RNA, 23 nt, Human
aacucaucugcuuacaucuccug

SEQ ID NO: 429361 - RNA, 21 nt, Human
aagccccucaucacuccccca

SEQ ID NO: 429362 - RNA, 20 nt, Human
aauaugcugaugcacuagga

SEQ ID NO: 429363 - RNA, 19 nt, Human
aaugcacauucauguguau

SEQ ID NO: 429364 - RNA, 22 nt, Human
aauucugcagcaaaccccacug

SEQ ID NO: 429365 - RNA, 18 nt, Human
acccccaacaagccccuc

SEQ ID NO: 429366 - RNA, 24 nt, Human
acccccacugcuaauauucccaau

SEQ ID NO: 429367 - RNA, 24 nt, Human
acgcacccccacccccaacaagcc

SEQ ID NO: 429368 - RNA, 23 nt, Human
acuccacuuuucccaggagccag

SEQ ID NO: 429369 - RNA, 31 nt, Human
acugagggcauacauacauacauacauacgg

SEQ ID NO: 429370 - RNA, 20 nt, Human
agaagagaaaaucuguaaua

SEQ ID NO: 429371 - RNA, 23 nt, Human
auacgcauacauacacauaugcu

SEQ ID NO: 429372 - RNA, 21 nt, Human
aucacgcacccccacccccaa

SEQ ID NO: 429373 - RNA, 23 nt, Human
augaagagagauccugcagccuc

SEQ ID NO: 429374 - RNA, 21 nt, Human
augcacauucauguguaugua

SEQ ID NO: 429375 - RNA, 23 nt, Human
auuagaccugauucugagaagau

SEQ ID NO: 429376 - RNA, 19 nt, Human
cacauucauguguauguau

SEQ ID NO: 429377 - RNA, 24 nt, Human
cacgcacccccacccccaacaagc

SEQ ID NO: 429378 - RNA, 27 nt, Human
cacgcacccccacccccaacaagcccc

SEQ ID NO: 429379 - RNA, 22 nt, Human
cacuuuucccaggagccagaag

SEQ ID NO: 429380 - RNA, 20 nt, Human
cagcaaaccccacugcacug

SEQ ID NO: 429381 - RNA, 22 nt, Human
cagccucgucuucagccgagaa

SEQ ID NO: 429382 - RNA, 18 nt, Human
caguuuguugacuccugg

SEQ ID NO: 429383 - RNA, 19 nt, Human
cauacacauaugcugacca

SEQ ID NO: 429384 - RNA, 23 nt, Human
cauacauacacauaugcugacca

SEQ ID NO: 429385 - RNA, 24 nt, Human
cauacauacauacgcauacauaca

SEQ ID NO: 429386 - RNA, 24 nt, Human
cauaugcauauauauacauacaua

SEQ ID NO: 429387 - RNA, 22 nt, Human
ccaauaaaacuuuauuuuaaaa

SEQ ID NO: 429388 - RNA, 23 nt, Human
ccacugcuaauauucccaaucac

SEQ ID NO: 429389 - RNA, 21 nt, Human
ccauauacauaugucugcaua

SEQ ID NO: 429390 - RNA, 27 nt, Human
ccauauacauaugucugcauaugcaua

SEQ ID NO: 429391 - RNA, 19 nt, Human
cccaacaagccccucauca

SEQ ID NO: 429392 - RNA, 23 nt, Human
ccccaacaagccccucaucacuc

SEQ ID NO: 429393 - RNA, 19 nt, Human
cccccacccccaacaagcc

SEQ ID NO: 429394 - RNA, 23 nt, Human
cccccacugcuaauauucccaau

SEQ ID NO: 429395 - RNA, 19 nt, Human
ccccucaucacucccccaa

SEQ ID NO: 429396 - RNA, 25 nt, Human
ccccucaucacucccccaaagccag

SEQ ID NO: 429397 - RNA, 22 nt, Human
ccuacagaacccccacugcuaa

SEQ ID NO: 429398 - RNA, 22 nt, Human
cgcacccccacccccaacaagc

SEQ ID NO: 429399 - RNA, 22 nt, Human
cucacagccucgucuucagccg

SEQ ID NO: 429400 - RNA, 20 nt, Human
cuuggauuuucagauuaggg

SEQ ID NO: 429401 - RNA, 28 nt, Human
gaaaucccuuuaucacgcacccccaccc

SEQ ID NO: 429402 - RNA, 18 nt, Human
gacgcucaaaggaaaugc

SEQ ID NO: 429403 - RNA, 23 nt, Human
ggcgcacacacacacauaaaaua

SEQ ID NO: 429404 - RNA, 24 nt, Human
gggagaaaauuuauaauccuuaau

SEQ ID NO: 429405 - RNA, 22 nt, Human
gguggagauggaaagggggggc

SEQ ID NO: 429406 - RNA, 22 nt, Human
uaaaaaauaacucaucugcuua

SEQ ID NO: 429407 - RNA, 21 nt, Human
uaacucaucugcuuacaucuc

SEQ ID NO: 429408 - RNA, 28 nt, Human
uacagaacccccacugcuaauauuccca

SEQ ID NO: 429409 - RNA, 25 nt, Human
uacauacauacauacauacgcauag

SEQ ID NO: 429410 - RNA, 24 nt, Human
uacauacauacauacgcauacaua

SEQ ID NO: 429411 - RNA, 25 nt, Human
uacauacauacauacgcauacauac

SEQ ID NO: 429412 - RNA, 28 nt, Human
uacauacauagauacagaaauauacgua

SEQ ID NO: 429413 - RNA, 26 nt, Human
uauauacauacauagauacagaaaua

SEQ ID NO: 429414 - RNA, 18 nt, Human
uauauauacauacauaga

SEQ ID NO: 429415 - RNA, 20 nt, Human
uauauauaugcuuauauaca

SEQ ID NO: 429416 - RNA, 21 nt, Human
uaucaugacuguguuggcacu

SEQ ID NO: 429417 - RNA, 21 nt, Human
uaucugaaauccaaaaugcuu

SEQ ID NO: 429418 - RNA, 19 nt, Human
uccaaaaugcuucugaucc

SEQ ID NO: 429419 - RNA, 18 nt, Human
ucccaggagccagaagcu

SEQ ID NO: 429420 - RNA, 21 nt, Human
ucccccaaagccagccgcccc

SEQ ID NO: 429421 - RNA, 19 nt, Human
uccuaucaugacuguguug

SEQ ID NO: 429422 - RNA, 18 nt, Human
uccugacccuacagaacc

SEQ ID NO: 429423 - RNA, 24 nt, Human
ucuccugcuaugcagugaauucug

SEQ ID NO: 429424 - RNA, 24 nt, Human
ucugaaaacccaaaaucugaaacu

SEQ ID NO: 429425 - RNA, 20 nt, Human
ucugcagaagccucacagcc

SEQ ID NO: 429426 - RNA, 18 nt, Human
ugaaaacccaaaaucuga

SEQ ID NO: 429427 - RNA, 22 nt, Human
ugaacgagacuaaugguuggca

SEQ ID NO: 429428 - RNA, 21 nt, Human
ugaagagagauccugcagccu

SEQ ID NO: 429429 - RNA, 21 nt, Human
ugaagcaugaauucaauaaca

SEQ ID NO: 429430 - RNA, 20 nt, Human
ugacaacuccacuuuuccca

SEQ ID NO: 429431 - RNA, 19 nt, Human
ugagaagauguucucuucu

SEQ ID NO: 429432 - RNA, 26 nt, Human
ugagaagauguucucuucuucaagaa

SEQ ID NO: 429433 - RNA, 18 nt, Human
ugauguggccugaccugg

SEQ ID NO: 429434 - RNA, 19 nt, Human
ugauguggccugaccuggg

SEQ ID NO: 429435 - RNA, 21 nt, Human
ugcacauucauguguauguau

SEQ ID NO: 429436 - RNA, 29 nt, Human
ugcacugagggcauacauacauacauaca

SEQ ID NO: 429437 - RNA, 25 nt, Human
ugcauauauauacauacauagauac

SEQ ID NO: 429438 - RNA, 21 nt, Human
ugcauaugcauauauauacau

SEQ ID NO: 429439 - RNA, 18 nt, Human
ugcuucugaucccaggca

SEQ ID NO: 429440 - RNA, 21 nt, Human
uggagauggaaagggggggca

SEQ ID NO: 429441 - RNA, 23 nt, Human
uggggguucugcagaagccucac

SEQ ID NO: 429442 - RNA, 23 nt, Human
uguaauugcccucacuaaaauaa

SEQ ID NO: 429443 - RNA, 18 nt, Human
ugucugcauaugcauaua

SEQ ID NO: 429444 - RNA, 20 nt, Human
ugucugcauaugcauauaua

SEQ ID NO: 429445 - RNA, 24 nt, Human
uuccaauaaaacuuuauuuuaaaa

SEQ ID NO: 429446 - RNA, 23 nt, Human
uuccugacccuacagaaccccca

SEQ ID NO: 429447 - RNA, 21 nt, Human
uuuaucacgcacccccacccc

SEQ ID NO: 429448 - RNA, 19 nt, Human
uuucccacauauuuuacua

SEQ ID NO: 429449 - RNA, 18 nt, Human
uuucugcuuacucuuuuc

SEQ ID NO: 429450 - RNA, 19 nt, Human
aaaggacacagacccaaga

SEQ ID NO: 429451 - RNA, 22 nt, Human
aagcugcaucuucuuacaagcc

SEQ ID NO: 429452 - RNA, 18 nt, Human
aagguguuauucuuucgc

SEQ ID NO: 429453 - RNA, 19 nt, Human
aagucaguuucauagccua

SEQ ID NO: 429454 - RNA, 19 nt, Human
acacagacccaagagaggc

SEQ ID NO: 429455 - RNA, 26 nt, Human
acacagacccaagagagggggaacgc

SEQ ID NO: 429456 - RNA, 22 nt, Human
acccagacaccgagcauucgac

SEQ ID NO: 429457 - RNA, 21 nt, Human
acccuguaaguuucauagccu

SEQ ID NO: 429458 - RNA, 20 nt, Human
accuugagucccagcucagc

SEQ ID NO: 429459 - RNA, 21 nt, Human
agcaccucaucagugcucccc

SEQ ID NO: 429460 - RNA, 23 nt, Human
agccagaaacccugggauguagc

SEQ ID NO: 429461 - RNA, 21 nt, Human
agccuagaagucuuccuagua

SEQ ID NO: 429462 - RNA, 20 nt, Human
agggcaugggcacuccccca

SEQ ID NO: 429463 - RNA, 22 nt, Human
auaaaauaaaggauaaugugcc

SEQ ID NO: 429464 - RNA, 26 nt, Human
aucacccucccccgaccugccccucu

SEQ ID NO: 429465 - RNA, 18 nt, Human
aucuaaacaggcuugaaa

SEQ ID NO: 429466 - RNA, 22 nt, Human
auguagccuaucugugacaagg

SEQ ID NO: 429467 - RNA, 24 nt, Human
auuuuauuuuucauaaaauaaagg

SEQ ID NO: 429468 - RNA, 22 nt, Human
cacagacccaagagaggcccuu

SEQ ID NO: 429469 - RNA, 20 nt, Human
cagagggagaacucccgcac

SEQ ID NO: 429470 - RNA, 23 nt, Human
cagagggggaggccccgagaccu

SEQ ID NO: 429471 - RNA, 22 nt, Human
caucagugcuccccgcuccuga

SEQ ID NO: 429472 - RNA, 23 nt, Human
cauccuggggcuucucacaucug

SEQ ID NO: 429473 - RNA, 21 nt, Human
ccaccuagggguagacuucca

SEQ ID NO: 429474 - RNA, 23 nt, Human
ccagagguaaggaugccuuuucu

SEQ ID NO: 429475 - RNA, 19 nt, Human
ccagaugcugccucccagg

SEQ ID NO: 429476 - RNA, 18 nt, Human
ccagcaaagagugguuca

SEQ ID NO: 429477 - RNA, 22 nt, Human
ccauggucaaucauccuggggc

SEQ ID NO: 429478 - RNA, 20 nt, Human
cccacccauacccuguaagu

SEQ ID NO: 429479 - RNA, 21 nt, Human
ccccagaugcugccucccagg

SEQ ID NO: 429480 - RNA, 22 nt, Human
ccccagcaccucaucagugcuc

SEQ ID NO: 429481 - RNA, 18 nt, Human
cccccagagggagaacuc

SEQ ID NO: 429482 - RNA, 19 nt, Human
ccccucuucuucaucccca

SEQ ID NO: 429483 - RNA, 22 nt, Human
cccgaccugccccucuucuuca

SEQ ID NO: 429484 - RNA, 20 nt, Human
ccgcacccccaguucccagg

SEQ ID NO: 429485 - RNA, 20 nt, Human
ccucccccgaccugccccuc

SEQ ID NO: 429486 - RNA, 19 nt, Human
cucagaaugcaagaaaagg

SEQ ID NO: 429487 - RNA, 19 nt, Human
cucccgcacccccaguucc

SEQ ID NO: 429488 - RNA, 22 nt, Human
cucucgaccaccuagggguaga

SEQ ID NO: 429489 - RNA, 18 nt, Human
cuggagcagauuugggaa

SEQ ID NO: 429490 - RNA, 20 nt, Human
cuggagcagauuugggaagg

SEQ ID NO: 429491 - RNA, 23 nt, Human
cuucuuacaagcccaggggagaa

SEQ ID NO: 429492 - RNA, 24 nt, Human
gaccugccccucuucuucaucccc

SEQ ID NO: 429493 - RNA, 20 nt, Human
gagaggguccggaugcagag

SEQ ID NO: 429494 - RNA, 21 nt, Human
gaggagcugcaucaagcugca

SEQ ID NO: 429495 - RNA, 26 nt, Human
gaggccccgagaccuucaaccagagg

SEQ ID NO: 429496 - RNA, 18 nt, Human
gaggcugggauggggaga

SEQ ID NO: 429497 - RNA, 27 nt, Human
gagucccagcucagcuggucauccgug

SEQ ID NO: 429498 - RNA, 22 nt, Human
gcccaguguuccuuccuuccug

SEQ ID NO: 429499 - RNA, 28 nt, Human
gccccgagaccuucaaccagagguaagg

SEQ ID NO: 429500 - RNA, 21 nt, Human
gccucccagguuccaagagcc

SEQ ID NO: 429501 - RNA, 21 nt, Human
gcugccucccagguuccaaga

SEQ ID NO: 429502 - RNA, 20 nt, Human
ggagucucacuugcagccag

SEQ ID NO: 429503 - RNA, 22 nt, Human
ggcacuucacagagggcauggg

SEQ ID NO: 429504 - RNA, 22 nt, Human
ggcugugggccaggagugggaa

SEQ ID NO: 429505 - RNA, 20 nt, Human
gggcagugcaguacauggcg

SEQ ID NO: 429506 - RNA, 23 nt, Human
uaaguuucauagccuagaaguca

SEQ ID NO: 429507 - RNA, 18 nt, Human
uagaaguuguucauuuug

SEQ ID NO: 429508 - RNA, 21 nt, Human
ucccagguuccaagagccacc

SEQ ID NO: 429509 - RNA, 21 nt, Human
ucccgcacccccaguucccag

SEQ ID NO: 429510 - RNA, 21 nt, Human
ucccuggcaucacccuccccc

SEQ ID NO: 429511 - RNA, 21 nt, Human
ucuauccacugcccccagaug

SEQ ID NO: 429512 - RNA, 26 nt, Human
ucucugcucuggggucugggccacag

SEQ ID NO: 429513 - RNA, 18 nt, Human
ucucuggggcugugggcc

SEQ ID NO: 429514 - RNA, 19 nt, Human
ucugcaaccagaaacaggc

SEQ ID NO: 429515 - RNA, 20 nt, Human
ucugcaaccagaaacaggcc

SEQ ID NO: 429516 - RNA, 21 nt, Human
ucugcccaguguuccuuccuu

SEQ ID NO: 429517 - RNA, 21 nt, Human
ucugugacaagggcagaucgg

SEQ ID NO: 429518 - RNA, 23 nt, Human
ucuucauccccaccugacaucuc

SEQ ID NO: 429519 - RNA, 25 nt, Human
ugacaagggcagaucggcaaccauc

SEQ ID NO: 429520 - RNA, 22 nt, Human
ugcacagacaggcucucugggg

SEQ ID NO: 429521 - RNA, 19 nt, Human
ugcaguacauggcggugcc

SEQ ID NO: 429522 - RNA, 22 nt, Human
ugccucccagguuccaagagcc

SEQ ID NO: 429523 - RNA, 18 nt, Human
ugccuuggaaucccuggc

SEQ ID NO: 429524 - RNA, 23 nt, Human
ugccuuggaaucccuggcaucac

SEQ ID NO: 429525 - RNA, 18 nt, Human
uggaaucccuggcaucac

SEQ ID NO: 429526 - RNA, 19 nt, Human
uggaaucccuggcaucacc

SEQ ID NO: 429527 - RNA, 21 nt, Human
ugggaagggucaugggaacaa

SEQ ID NO: 429528 - RNA, 22 nt, Human
ugggaagggucaugggaacaag

SEQ ID NO: 429529 - RNA, 21 nt, Human
ugggauggggagaggguccgg

SEQ ID NO: 429530 - RNA, 23 nt, Human
ugggauggggagaggguccggau

SEQ ID NO: 429531 - RNA, 23 nt, Human
ugggauguagccuaucugugaca

SEQ ID NO: 429532 - RNA, 20 nt, Human
ugggccaggagugggaaagc

SEQ ID NO: 429533 - RNA, 18 nt, Human
uggggcugugggccagga

SEQ ID NO: 429534 - RNA, 19 nt, Human
uguucauuuuguuuuccuu

SEQ ID NO: 429535 - RNA, 19 nt, Human
uguucuauccacugccccc

SEQ ID NO: 429536 - RNA, 19 nt, Human
uguuugaggagcugcauca

SEQ ID NO: 429537 - RNA, 20 nt, Human
uucacagagggcaugggcac

SEQ ID NO: 429538 - RNA, 18 nt, Human
aaaacuggaucuccaauu

SEQ ID NO: 429539 - RNA, 23 nt, Human
aaacaaauaagauagaaagugac

SEQ ID NO: 429540 - RNA, 24 nt, Human
aacaaacaaauaagauagaaagug

SEQ ID NO: 429541 - RNA, 18 nt, Human
aacuaggucuucaccagg

SEQ ID NO: 429542 - RNA, 23 nt, Human
aagcagugacuacagcuaauccc

SEQ ID NO: 429543 - RNA, 18 nt, Human
agaaagcacuucuaaaac

SEQ ID NO: 429544 - RNA, 22 nt, Human
agauauccuccaaguccaaagc

SEQ ID NO: 429545 - RNA, 19 nt, Human
aggggcugacuuuggaguu

SEQ ID NO: 429546 - RNA, 26 nt, Human
caaagaacacacgugagcucacaggc

SEQ ID NO: 429547 - RNA, 22 nt, Human
cacagugaacaaacaaauaaga

SEQ ID NO: 429548 - RNA, 26 nt, Human
cagaggauucacagcugaguaggcac

SEQ ID NO: 429549 - RNA, 19 nt, Human
caggcccucuaugcuucuc

SEQ ID NO: 429550 - RNA, 23 nt, Human
ccaagaaaaaaggagauuaacaa

SEQ ID NO: 429551 - RNA, 19 nt, Human
ccagaaagcacuucuaaaa

SEQ ID NO: 429552 - RNA, 25 nt, Human
cccucuaugcuucuccccuucugga

SEQ ID NO: 429553 - RNA, 24 nt, Human
ccuccaaguccaaagccaugucca

SEQ ID NO: 429554 - RNA, 19 nt, Human
cucuccucuccaauccaag

SEQ ID NO: 429555 - RNA, 24 nt, Human
cugaggcagaaucaagaauuuaag

SEQ ID NO: 429556 - RNA, 24 nt, Human
cuucuaaaacuggaucuccaauuu

SEQ ID NO: 429557 - RNA, 22 nt, Human
gaacaaacaaauaagauagaaa

SEQ ID NO: 429558 - RNA, 20 nt, Human
gagauagaaauggggaaaga

SEQ ID NO: 429559 - RNA, 20 nt, Human
gauaugaaaaaaugaacuuc

SEQ ID NO: 429560 - RNA, 22 nt, Human
gcuacauuaugaacuugagguu

SEQ ID NO: 429561 - RNA, 18 nt, Human
ggagauagaaauggggaa

SEQ ID NO: 429562 - RNA, 21 nt, Human
ggagauagaaauggggaaaga

SEQ ID NO: 429563 - RNA, 20 nt, Human
gucugaacauuagccuagga

SEQ ID NO: 429564 - RNA, 21 nt, Human
uaaggggcugaucugagguuc

SEQ ID NO: 429565 - RNA, 18 nt, Human
ucaccaggacacucggcc

SEQ ID NO: 429566 - RNA, 21 nt, Human
ucaccccuaugacaaagaaca

SEQ ID NO: 429567 - RNA, 20 nt, Human
uccaagaaaaaaggagauua

SEQ ID NO: 429568 - RNA, 23 nt, Human
uccagauucucuccucuccaauc

SEQ ID NO: 429569 - RNA, 23 nt, Human
ucuccugaggcagaaucaagaau

SEQ ID NO: 429570 - RNA, 20 nt, Human
ucugcaguggaauugucucc

SEQ ID NO: 429571 - RNA, 22 nt, Human
ucugcuacauuaugaacuugag

SEQ ID NO: 429572 - RNA, 18 nt, Human
ugacaaagaacacacgug

SEQ ID NO: 429573 - RNA, 25 nt, Human
ugacaaagaacacacgugagcucaa

SEQ ID NO: 429574 - RNA, 18 nt, Human
ugacugggcugggagaua

SEQ ID NO: 429575 - RNA, 22 nt, Human
ugacugggcugggagauagaaa

SEQ ID NO: 429576 - RNA, 23 nt, Human
ugagauaaagguguugccaggac

SEQ ID NO: 429577 - RNA, 25 nt, Human
ugaggcagaaucaagaauuuaagcc

SEQ ID NO: 429578 - RNA, 24 nt, Human
ugcuucccagaaagcacuucuaaa

SEQ ID NO: 429579 - RNA, 19 nt, Human
ugugacugggcugggagau

SEQ ID NO: 429580 - RNA, 24 nt, Human
uugagguuuauaggggcugacuuu

SEQ ID NO: 429581 - RNA, 20 nt, Human
aaaagaaugaauaaaaagga

SEQ ID NO: 429582 - RNA, 23 nt, Human
aaacugagaaauugaauagauac

SEQ ID NO: 429583 - RNA, 19 nt, Human
aagcgcugccccacgcccc

SEQ ID NO: 429584 - RNA, 23 nt, Human
aaucccuuucuauucuaauccau

SEQ ID NO: 429585 - RNA, 21 nt, Human
acagcaaccuuuaaauuuucu

SEQ ID NO: 429586 - RNA, 22 nt, Human
accaagcgcugccccacgcccc

SEQ ID NO: 429587 - RNA, 18 nt, Human
aggcaacccccugccccg

SEQ ID NO: 429588 - RNA, 21 nt, Human
auagacacuuuccuaaaauuu

SEQ ID NO: 429589 - RNA, 21 nt, Human
cacacuuuucacuauauauca

SEQ ID NO: 429590 - RNA, 19 nt, Human
cagaacaaauuugagacac

SEQ ID NO: 429591 - RNA, 21 nt, Human
cauaacagcguacauuccaaa

SEQ ID NO: 429592 - RNA, 22 nt, Human
cauccauaaucccuuucuauuc

SEQ ID NO: 429593 - RNA, 18 nt, Human
cauuccauuuacucuuua

SEQ ID NO: 429594 - RNA, 24 nt, Human
cauuuacucuuuauggaaaaagag

SEQ ID NO: 429595 - RNA, 18 nt, Human
cccgcagcccgggcuggg

SEQ ID NO: 429596 - RNA, 22 nt, Human
ccugccccgauucugcaacacc

SEQ ID NO: 429597 - RNA, 21 nt, Human
cgccccuaccaaccugggcgu

SEQ ID NO: 429598 - RNA, 19 nt, Human
cgccucagugccuagcacg

SEQ ID NO: 429599 - RNA, 21 nt, Human
cggcccgacagcaagcguccg

SEQ ID NO: 429600 - RNA, 24 nt, Human
cuaaaauaugguuuuccagccuaa

SEQ ID NO: 429601 - RNA, 18 nt, Human
cuccccuagucagcaucc

SEQ ID NO: 429602 - RNA, 18 nt, Human
cuggcccgcagcccgggc

SEQ ID NO: 429603 - RNA, 18 nt, Human
cuuucccccuuucuuuuc

SEQ ID NO: 429604 - RNA, 19 nt, Human
cuuucccccuuucuuuucc

SEQ ID NO: 429605 - RNA, 18 nt, Human
gaagaucauguaguaaaa

SEQ ID NO: 429606 - RNA, 18 nt, Human
gccagguugaaaagucgu

SEQ ID NO: 429607 - RNA, 18 nt, Human
gcccgcagcccgggcugg

SEQ ID NO: 429608 - RNA, 23 nt, Human
gcccgcagcccgggcugggccug

SEQ ID NO: 429609 - RNA, 19 nt, Human
gcuggcccgcagcccgggc

SEQ ID NO: 429610 - RNA, 18 nt, Human
gggcugggccugucaccg

SEQ ID NO: 429611 - RNA, 21 nt, Human
uaaaagaaugaauaaaaagga

SEQ ID NO: 429612 - RNA, 18 nt, Human
uaaaaugaugcacuaaaa

SEQ ID NO: 429613 - RNA, 21 nt, Human
uaacagcguacauuccaaaaa

SEQ ID NO: 429614 - RNA, 25 nt, Human
uaaguucuaaacacuacagcaaccu

SEQ ID NO: 429615 - RNA, 22 nt, Human
uagacuuucccccuuucuuuuc

SEQ ID NO: 429616 - RNA, 29 nt, Human
ucauuuaucauagcauaacagcguacauu

SEQ ID NO: 429617 - RNA, 25 nt, Human
uccauaaucccuuucuauucuaauc

SEQ ID NO: 429618 - RNA, 26 nt, Human
uccauaaucccuuucuauucuaaucc

SEQ ID NO: 429619 - RNA, 18 nt, Human
ucggcccgacagcaagcg

SEQ ID NO: 429620 - RNA, 20 nt, Human
ucuagcacuggcaguuggcu

SEQ ID NO: 429621 - RNA, 18 nt, Human
ugagugcuuucugcaagg

SEQ ID NO: 429622 - RNA, 18 nt, Human
ugauucaggucugagugc

SEQ ID NO: 429623 - RNA, 19 nt, Human
ugccccacgccccuaccaa

SEQ ID NO: 429624 - RNA, 18 nt, Human
ugcucggcccgacagcaa

SEQ ID NO: 429625 - RNA, 20 nt, Human
uuccaaaaaggaaggcccaa

SEQ ID NO: 429626 - RNA, 24 nt, Human
uucuuccaacuacauguacuaccu

SEQ ID NO: 429627 - RNA, 23 nt, Human
uucuuuuccagaacaaauuugag

SEQ ID NO: 429628 - RNA, 21 nt, Human
uuuauaaaaucuucacaugua

SEQ ID NO: 429629 - RNA, 19 nt, Human
uuucccacacuuuucacua

SEQ ID NO: 429630 - RNA, 21 nt, Human
aaaaggacaaacuaaaguaaa

SEQ ID NO: 429631 - RNA, 24 nt, Human
aacaaaaggacaaacuaaaguaaa

SEQ ID NO: 429632 - RNA, 20 nt, Human
aacaugcauaaacauacaca

SEQ ID NO: 429633 - RNA, 18 nt, Human
aacuaaagcuuaaaacag

SEQ ID NO: 429634 - RNA, 22 nt, Human
aacugauuauaaaacuccaaac

SEQ ID NO: 429635 - RNA, 20 nt, Human
aacuggacuuccagcgcgcc

SEQ ID NO: 429636 - RNA, 24 nt, Human
aagcacaaauucuauuggcaaaac

SEQ ID NO: 429637 - RNA, 20 nt, Human
aaggcaguuucuaaauccac

SEQ ID NO: 429638 - RNA, 21 nt, Human
accagaccuaacgcagggagc

SEQ ID NO: 429639 - RNA, 21 nt, Human
acccugagcuccccucccccu

SEQ ID NO: 429640 - RNA, 19 nt, Human
aggagcauacuagaucccc

SEQ ID NO: 429641 - RNA, 22 nt, Human
auaugcaauugaauuguuaauu

SEQ ID NO: 429642 - RNA, 25 nt, Human
caaacuaaaguaaauaucuccccua

SEQ ID NO: 429643 - RNA, 21 nt, Human
caacacagcaaaaugcugaug

SEQ ID NO: 429644 - RNA, 24 nt, Human
caauguaaaugcauuagaccagga

SEQ ID NO: 429645 - RNA, 22 nt, Human
cagaccuaacgcagggagccga

SEQ ID NO: 429646 - RNA, 27 nt, Human
caucccguuccucuggaacuugaacac

SEQ ID NO: 429647 - RNA, 24 nt, Human
ccagaccuaacgcagggagccgaa

SEQ ID NO: 429648 - RNA, 22 nt, Human
ccccucccccuauagcgaucca

SEQ ID NO: 429649 - RNA, 19 nt, Human
cccugagcuccccuccccc

SEQ ID NO: 429650 - RNA, 23 nt, Human
ccuuugaaauaaucuacuccaaa

SEQ ID NO: 429651 - RNA, 18 nt, Human
cuaaagcuuaaaacagua

SEQ ID NO: 429652 - RNA, 20 nt, Human
cugcaacacgcugagguugu

SEQ ID NO: 429653 - RNA, 22 nt, Human
gccaccagaccuaacgcaggga

SEQ ID NO: 429654 - RNA, 19 nt, Human
uaaacaauguaaaugcauu

SEQ ID NO: 429655 - RNA, 19 nt, Human
uaaacccauucaagaaaau

SEQ ID NO: 429656 - RNA, 20 nt, Human
uaaaugcauuagaccaggag

SEQ ID NO: 429657 - RNA, 28 nt, Human
uacccugagcuccccucccccuauagcc

SEQ ID NO: 429658 - RNA, 23 nt, Human
ucaguacuuaacaaaaggacaaa

SEQ ID NO: 429659 - RNA, 23 nt, Human
uccaaacuaccuuugaaauaauc

SEQ ID NO: 429660 - RNA, 18 nt, Human
uccacacacucugauccc

SEQ ID NO: 429661 - RNA, 22 nt, Human
ucugcaacacgcugagguuguc

SEQ ID NO: 429662 - RNA, 22 nt, Human
ugaaauaaucuacuccaaaucc

SEQ ID NO: 429663 - RNA, 22 nt, Human
ugaccgccaccagaccuaacgc

SEQ ID NO: 429664 - RNA, 19 nt, Human
ugagcuccccucccccuau

SEQ ID NO: 429665 - RNA, 27 nt, Human
ugcaacacagcaaaaugcugauguaua

SEQ ID NO: 429666 - RNA, 22 nt, Human
uuacugaguuaggcuauuauau

SEQ ID NO: 429667 - RNA, 18 nt, Human
aaaaacauuugggcuuug

SEQ ID NO: 429668 - RNA, 20 nt, Human
aaaaaggcacucccaaaggu

SEQ ID NO: 429669 - RNA, 19 nt, Human
aaaacaaaaaaggcacucc

SEQ ID NO: 429670 - RNA, 18 nt, Human
aaaaccaaugcaauacca

SEQ ID NO: 429671 - RNA, 18 nt, Human
aaaaggcacucccaaagg

SEQ ID NO: 429672 - RNA, 20 nt, Human
aaacaaaaaaggcacuccca

SEQ ID NO: 429673 - RNA, 23 nt, Human
aaacaaaaaaggcacucccaaag

SEQ ID NO: 429674 - RNA, 21 nt, Human
aaaccaaugcaauaccaaaau

SEQ ID NO: 429675 - RNA, 21 nt, Human
aacaauaucuuccuccacuuu

SEQ ID NO: 429676 - RNA, 24 nt, Human
aaccaaugcaauaccaaaauaucu

SEQ ID NO: 429677 - RNA, 19 nt, Human
aagaacaauaucuuccucc

SEQ ID NO: 429678 - RNA, 19 nt, Human
aagcgaaaaacaaaacagg

SEQ ID NO: 429679 - RNA, 20 nt, Human
acaaaaaaggcacucccaaa

SEQ ID NO: 429680 - RNA, 20 nt, Human
acauggugacagaagacucu

SEQ ID NO: 429681 - RNA, 24 nt, Human
accaaugcaauaccaaaauaucuc

SEQ ID NO: 429682 - RNA, 18 nt, Human
agccaaacauaucaugga

SEQ ID NO: 429683 - RNA, 23 nt, Human
aggcauuggaacugccuuuaacu

SEQ ID NO: 429684 - RNA, 21 nt, Human
agggauaagcucauucacaua

SEQ ID NO: 429685 - RNA, 23 nt, Human
auaggggcaggaauugggggcgg

SEQ ID NO: 429686 - RNA, 21 nt, Human
caaaaaaggcacucccaaagg

SEQ ID NO: 429687 - RNA, 21 nt, Human
caaagcgaaaaacaaaacagg

SEQ ID NO: 429688 - RNA, 18 nt, Human
cacaauaugacaugguga

SEQ ID NO: 429689 - RNA, 22 nt, Human
cacaauaugacauggugacaga

SEQ ID NO: 429690 - RNA, 23 nt, Human
cagcuuccuagcauagacuccuu

SEQ ID NO: 429691 - RNA, 24 nt, Human
cauaggacuacaaauaucucucac

SEQ ID NO: 429692 - RNA, 22 nt, Human
ccuccacuuuuuuuggguccau

SEQ ID NO: 429693 - RNA, 21 nt, Human
cucacagguaggagggcacaa

SEQ ID NO: 429694 - RNA, 18 nt, Human
cucagcuuccuagcauag

SEQ ID NO: 429695 - RNA, 22 nt, Human
cugaaagacccacaauaugaca

SEQ ID NO: 429696 - RNA, 20 nt, Human
cuuccuagcauagacuccag

SEQ ID NO: 429697 - RNA, 19 nt, Human
cuuucauaugcaccugguu

SEQ ID NO: 429698 - RNA, 20 nt, Human
cuuucauaugcaccugguug

SEQ ID NO: 429699 - RNA, 24 nt, Human
gaaacuauuugccugaggcccaag

SEQ ID NO: 429700 - RNA, 18 nt, Human
gaggaucccuggcugggu

SEQ ID NO: 429701 - RNA, 21 nt, Human
gcauuggaacugccuuuaacu

SEQ ID NO: 429702 - RNA, 22 nt, Human
gccaaacauaucauggaacugg

SEQ ID NO: 429703 - RNA, 18 nt, Human
ggggcggccucacggaaa

SEQ ID NO: 429704 - RNA, 21 nt, Human
uaauagguuuauaauaaccau

SEQ ID NO: 429705 - RNA, 23 nt, Human
uaauauguacacuuucauaugca

SEQ ID NO: 429706 - RNA, 23 nt, Human
uaaucacugggacuuuggcaugc

SEQ ID NO: 429707 - RNA, 19 nt, Human
uaauugcaugcaaaaccua

SEQ ID NO: 429708 - RNA, 20 nt, Human
uaggggcaggaauugggggc

SEQ ID NO: 429709 - RNA, 21 nt, Human
uaucauggaacugaaagaccc

SEQ ID NO: 429710 - RNA, 28 nt, Human
ucacuaaaucugauccauguugagccau

SEQ ID NO: 429711 - RNA, 20 nt, Human
ucacugggacuuuggcaugc

SEQ ID NO: 429712 - RNA, 21 nt, Human
ucauagaucuggggaaccauc

SEQ ID NO: 429713 - RNA, 19 nt, Human
ucauggaacugaaagaccc

SEQ ID NO: 429714 - RNA, 20 nt, Human
ucucucacagguaggagggc

SEQ ID NO: 429715 - RNA, 21 nt, Human
ugaaaaacaaaaaaggcacuc

SEQ ID NO: 429716 - RNA, 24 nt, Human
ugaaaaacaaaaaaggcacuccca

SEQ ID NO: 429717 - RNA, 22 nt, Human
ugcuccagcucccuuauacuaa

SEQ ID NO: 429718 - RNA, 20 nt, Human
uggugaggccuacccggcug

SEQ ID NO: 429719 - RNA, 23 nt, Human
uuaaucacugggacuuuggcauu

SEQ ID NO: 429720 - RNA, 20 nt, Human
uuaaugguccacccauuuca

SEQ ID NO: 429721 - RNA, 22 nt, Human
uucaaagcgaaaaacaaaacag

SEQ ID NO: 429722 - RNA, 20 nt, Human
uuuagaaacuauuugccuga

SEQ ID NO: 429723 - RNA, 22 nt, Human
uuuccacuaucagcugcuccag

SEQ ID NO: 429724 - RNA, 22 nt, Human
uuuuccacuaucagcugcucca

SEQ ID NO: 429725 - RNA, 24 nt, Human
uuuuccacuaucagcugcuccagc

SEQ ID NO: 429726 - RNA, 25 nt, Human
uuuuuuggguccaucuugaaaaaca

SEQ ID NO: 429727 - RNA, 24 nt, Human
uuuuuuuucaaagcgaaaaacaaa

SEQ ID NO: 429728 - RNA, 23 nt, Human
uuuuuuuuuuuuuuuuuucaaag

SEQ ID NO: 429729 - RNA, 18 nt, Human
agagccugaaaagcucag

SEQ ID NO: 429730 - RNA, 21 nt, Human
agccugaaaagcucaggaagu

SEQ ID NO: 429731 - RNA, 25 nt, Human
uaccuucuuuaucuucuuaagagaa

SEQ ID NO: 429732 - RNA, 19 nt, Human
uacuuugugaguugcagag

SEQ ID NO: 429733 - RNA, 21 nt, Human
uuuaucuucuuaagagaagac

SEQ ID NO: 429734 - RNA, 23 nt, Human
aaagagaaaacaguagcuucaaa

SEQ ID NO: 429735 - RNA, 24 nt, Human
aaggaagaaagaggcauuuucuag

SEQ ID NO: 429736 - RNA, 21 nt, Human
acagcuuaaaagguacccucc

SEQ ID NO: 429737 - RNA, 20 nt, Human
accuugaacagcuuaaaagg

SEQ ID NO: 429738 - RNA, 21 nt, Human
accuuggaggcgcuugcgaga

SEQ ID NO: 429739 - RNA, 23 nt, Human
agaaagagguaaaaugaacaaaa

SEQ ID NO: 429740 - RNA, 22 nt, Human
aggcgcuugcgagacccggaac

SEQ ID NO: 429741 - RNA, 20 nt, Human
cacacaacuuggguggugau

SEQ ID NO: 429742 - RNA, 20 nt, Human
cauuuucuagucucaaccug

SEQ ID NO: 429743 - RNA, 20 nt, Human
ccggcccggcguugcuagaa

SEQ ID NO: 429744 - RNA, 21 nt, Human
gagacccggaacgcgcaagga

SEQ ID NO: 429745 - RNA, 18 nt, Human
gcaaggagggagaggggg

SEQ ID NO: 429746 - RNA, 19 nt, Human
gcggcacgaacaaugcccc

SEQ ID NO: 429747 - RNA, 18 nt, Human
ggcauguuggcuguggca

SEQ ID NO: 429748 - RNA, 20 nt, Human
gggcauguuggcuguggcag

SEQ ID NO: 429749 - RNA, 19 nt, Human
guggugaucuggaaaacuu

SEQ ID NO: 429750 - RNA, 24 nt, Human
uaaaagguacccuccagcuggagc

SEQ ID NO: 429751 - RNA, 23 nt, Human
uaagaaagagguaaaaugaacaa

SEQ ID NO: 429752 - RNA, 20 nt, Human
uaagagggacacagcuagua

SEQ ID NO: 429753 - RNA, 18 nt, Human
uagaagcgcggcacgaac

SEQ ID NO: 429754 - RNA, 20 nt, Human
uagaagcgcggcacgaacaa

SEQ ID NO: 429755 - RNA, 24 nt, Human
uagcagccaucucaaaaaaauaaa

SEQ ID NO: 429756 - RNA, 21 nt, Human
uagcuucaaacacccaacuuu

SEQ ID NO: 429757 - RNA, 21 nt, Human
uucaagacaaaccuuggaggc

SEQ ID NO: 429758 - RNA, 21 nt, Human
uugaccuugaacagcuuaaaa

SEQ ID NO: 429759 - RNA, 23 nt, Human
uuuuuuuuuuuuuuuuugggcau

SEQ ID NO: 429760 - RNA, 24 nt, Human
uuuuuuuuuuuuuuuuuuuuuggg

SEQ ID NO: 429761 - RNA, 21 nt, Human
aucuuuuaguaugaacucuag

SEQ ID NO: 429762 - RNA, 22 nt, Human
auuccuuucuccuucaaauccu

SEQ ID NO: 429763 - RNA, 19 nt, Human
cugaaaguuuaagcaacug

SEQ ID NO: 429764 - RNA, 23 nt, Human
cugaugcaagucuuccaucuagu

SEQ ID NO: 429765 - RNA, 20 nt, Human
cuggccuccagagagccugg

SEQ ID NO: 429766 - RNA, 20 nt, Human
gucugaacucugauguaaag

SEQ ID NO: 429767 - RNA, 21 nt, Human
gugcucuauuccuuucuccuu

SEQ ID NO: 429768 - RNA, 21 nt, Human
ucuccuucaaauccuccauug

SEQ ID NO: 429769 - RNA, 24 nt, Human
ucucuguagacucaacacagggau

SEQ ID NO: 429770 - RNA, 20 nt, Human
ugaacaaauguuauuccaca

SEQ ID NO: 429771 - RNA, 21 nt, Human
ugaacucuaguguuuucuaag

SEQ ID NO: 429772 - RNA, 21 nt, Human
ugcucuggagacuuauauuuc

SEQ ID NO: 429773 - RNA, 25 nt, Human
uguaaagugggaugcgagcagauac

SEQ ID NO: 429774 - RNA, 20 nt, Human
uguagacucaacacagggau

SEQ ID NO: 429775 - RNA, 20 nt, Human
ugucucuguagacucaacac

SEQ ID NO: 429776 - RNA, 22 nt, Human
uucuccuucaaauccuccauug

SEQ ID NO: 429777 - RNA, 22 nt, Human
uucucuacaaauuuucugaaag

SEQ ID NO: 429778 - RNA, 24 nt, Human
aaacaaaaaccccagccuauuagu

SEQ ID NO: 429779 - RNA, 24 nt, Human
aaacaaaacaaaaaccccagccua

SEQ ID NO: 429780 - RNA, 20 nt, Human
aaacaaaacaaaaccccaaa

SEQ ID NO: 429781 - RNA, 21 nt, Human
aaacaaaacaaaaccccaaaa

SEQ ID NO: 429782 - RNA, 24 nt, Human
aaaccaaacaaaacaaaaccccaa

SEQ ID NO: 429783 - RNA, 25 nt, Human
aaaccaaacaaaacaaaaccccaaa

SEQ ID NO: 429784 - RNA, 22 nt, Human
aaaccccaaaacaaaacaaaaa

SEQ ID NO: 429785 - RNA, 21 nt, Human
aacaaaacaaaaccccaaaac

SEQ ID NO: 429786 - RNA, 23 nt, Human
aacaaaacaaaaccccaaaacaa

SEQ ID NO: 429787 - RNA, 19 nt, Human
aaccccaaaacaaaacaaa

SEQ ID NO: 429788 - RNA, 22 nt, Human
aaccuccccucccccggcccac

SEQ ID NO: 429789 - RNA, 22 nt, Human
aaccuuguaaggcuucaguaac

SEQ ID NO: 429790 - RNA, 21 nt, Human
aagagcccccuuccaaggaag

SEQ ID NO: 429791 - RNA, 23 nt, Human
aaggaugcaccagacagggcuga

SEQ ID NO: 429792 - RNA, 20 nt, Human
acaaaaccccaaaacaaaac

SEQ ID NO: 429793 - RNA, 24 nt, Human
acaaaaccccaaaacaaaacaaaa

SEQ ID NO: 429794 - RNA, 22 nt, Human
acaaccaucugguuaagaaccc

SEQ ID NO: 429795 - RNA, 21 nt, Human
accccaaaacaaaacaaaaac

SEQ ID NO: 429796 - RNA, 25 nt, Human
accccaaaacaaaacaaaaacccca

SEQ ID NO: 429797 - RNA, 23 nt, Human
accccagccuauuaguuuacagu

SEQ ID NO: 429798 - RNA, 24 nt, Human
acuaaaauguaaaaccaaacaaaa

SEQ ID NO: 429799 - RNA, 19 nt, Human
agaaggaguaaacuugaaa

SEQ ID NO: 429800 - RNA, 21 nt, Human
agacacugcaaguucuaaacu

SEQ ID NO: 429801 - RNA, 19 nt, Human
agccacaaaugagaaaagg

SEQ ID NO: 429802 - RNA, 18 nt, Human
auuccgaaagacacugca

SEQ ID NO: 429803 - RNA, 19 nt, Human
caaaacaaaacaaaaaccc

SEQ ID NO: 429804 - RNA, 21 nt, Human
caaaacaaaacaaaaacccca

SEQ ID NO: 429805 - RNA, 24 nt, Human
caaaacaaaaccccaaaacaaaac

SEQ ID NO: 429806 - RNA, 20 nt, Human
caaaacaaaaccccaaaacc

SEQ ID NO: 429807 - RNA, 21 nt, Human
caaaaccccaaaacaaaacaa

SEQ ID NO: 429808 - RNA, 20 nt, Human
caaaacucaaaacagaagga

SEQ ID NO: 429809 - RNA, 25 nt, Human
caaaacucaaaacagaaggaguaaa

SEQ ID NO: 429810 - RNA, 25 nt, Human
caaaacucaaaacagaaggaguaaa

SEQ ID NO: 429811 - RNA, 33 nt, Human
caaacaaaacaaaaccccaaaacaaaacaaagg

SEQ ID NO: 429812 - RNA, 19 nt, Human
cacugcaaguucuaaacuu

SEQ ID NO: 429813 - RNA, 26 nt, Human
cacugcuacaaaacucaaaacagaag

SEQ ID NO: 429814 - RNA, 19 nt, Human
cagcaugacuaucuaaugc

SEQ ID NO: 429815 - RNA, 24 nt, Human
caguaacuaaaauguaaaaccaaa

SEQ ID NO: 429816 - RNA, 19 nt, Human
ccaaaacaaaacaaaaacc

SEQ ID NO: 429817 - RNA, 22 nt, Human
ccaaaacaaaacaaaaacccca

SEQ ID NO: 429818 - RNA, 22 nt, Human
cccuuccaaggaagcuuugcaa

SEQ ID NO: 429819 - RNA, 20 nt, Human
ccucccccggcccacccccc

SEQ ID NO: 429820 - RNA, 21 nt, Human
cgugacuucaaauguuccaug

SEQ ID NO: 429821 - RNA, 23 nt, Human
cuacaaaacucaaaacagaagga

SEQ ID NO: 429822 - RNA, 23 nt, Human
cucacuuucugccaaggaugcac

SEQ ID NO: 429823 - RNA, 25 nt, Human
cuuucacucacagauuauuuacaug

SEQ ID NO: 429824 - RNA, 26 nt, Human
gaaccuccccucccccggcccacccc

SEQ ID NO: 429825 - RNA, 21 nt, Human
gaacgaaccuccccucccccg

SEQ ID NO: 429826 - RNA, 25 nt, Human
gaacgaaccuccccucccccggccc

SEQ ID NO: 429827 - RNA, 18 nt, Human
gcggaacgaaccuccccu

SEQ ID NO: 429828 - RNA, 18 nt, Human
guaaaaccaaacaaaaca

SEQ ID NO: 429829 - RNA, 20 nt, Human
guauuuguuaaguauccuaa

SEQ ID NO: 429830 - RNA, 21 nt, Human
gucccgguucuggcugcgcuc

SEQ ID NO: 429831 - RNA, 24 nt, Human
gugcuacccauacacaaccaucug

SEQ ID NO: 429832 - RNA, 22 nt, Human
uaaaaauuccgaaagacacugc

SEQ ID NO: 429833 - RNA, 23 nt, Human
uaaaaccaaacaaaacaaaaccc

SEQ ID NO: 429834 - RNA, 18 nt, Human
ucccccggcccacccccc

SEQ ID NO: 429835 - RNA, 22 nt, Human
ucccccggcccaccccccuucg

SEQ ID NO: 429836 - RNA, 21 nt, Human
uccccucccccggcccacccc

SEQ ID NO: 429837 - RNA, 18 nt, Human
uccgaaagacacugcaag

SEQ ID NO: 429838 - RNA, 21 nt, Human
uccgcggaacgaaccuccccu

SEQ ID NO: 429839 - RNA, 22 nt, Human
ucuaacaauggggguguuuucc

SEQ ID NO: 429840 - RNA, 24 nt, Human
ucuaacaauggggguguuuuccuc

SEQ ID NO: 429841 - RNA, 20 nt, Human
ucuacauaaccuuguaaggc

SEQ ID NO: 429842 - RNA, 19 nt, Human
ucugccaaggaugcaccag

SEQ ID NO: 429843 - RNA, 25 nt, Human
ugacuaucuaaugcuguuuuauccc

SEQ ID NO: 429844 - RNA, 21 nt, Human
ugaugcagaaagccacaaaug

SEQ ID NO: 429845 - RNA, 23 nt, Human
ugcuacccauacacaaccaucug

SEQ ID NO: 429846 - RNA, 18 nt, Human
uggcugcgcuccgcggaa

SEQ ID NO: 429847 - RNA, 22 nt, Human
aaaacaaacaaaccaucgagca

SEQ ID NO: 429848 - RNA, 21 nt, Human
aaaagcugggacacaagagaa

SEQ ID NO: 429849 - RNA, 21 nt, Human
aaacaaacaaaccaucgagca

SEQ ID NO: 429850 - RNA, 24 nt, Human
aaacaaacaaaccaucgagcauaa

SEQ ID NO: 429851 - RNA, 18 nt, Human
aaacaaaccaucgagcau

SEQ ID NO: 429852 - RNA, 23 nt, Human
aaauuauaaaacaaacaaaccau

SEQ ID NO: 429853 - RNA, 22 nt, Human
aacaaaccaucgagcauaaugg

SEQ ID NO: 429854 - RNA, 21 nt, Human
acaggacaacggcagccagag

SEQ ID NO: 429855 - RNA, 18 nt, Human
acugcugugauaucauuc

SEQ ID NO: 429856 - RNA, 26 nt, Human
agugccuacuucauaugguuggugac

SEQ ID NO: 429857 - RNA, 20 nt, Human
aguucuccagcaucaccucc

SEQ ID NO: 429858 - RNA, 22 nt, Human
auaaugguaaagagaauagauu

SEQ ID NO: 429859 - RNA, 22 nt, Human
auccuauugucugacaaaccuc

SEQ ID NO: 429860 - RNA, 19 nt, Human
auggugccucguguccagc

SEQ ID NO: 429861 - RNA, 19 nt, Human
auucugccuuucccuccug

SEQ ID NO: 429862 - RNA, 21 nt, Human
caaucuaguugagaggauaau

SEQ ID NO: 429863 - RNA, 18 nt, Human
cacaggguccuggcgacu

SEQ ID NO: 429864 - RNA, 20 nt, Human
cacugugugagauacaaaga

SEQ ID NO: 429865 - RNA, 21 nt, Human
cacugugugagauacaaagac

SEQ ID NO: 429866 - RNA, 23 nt, Human
cacugugugagauacaaagaccu

SEQ ID NO: 429867 - RNA, 26 nt, Human
cagaguccuccggcacagagugcucc

SEQ ID NO: 429868 - RNA, 18 nt, Human
cagcgcugucgccuuagc

SEQ ID NO: 429869 - RNA, 20 nt, Human
caggacaggacaacggcagc

SEQ ID NO: 429870 - RNA, 27 nt, Human
cagucuagagagacacucucuggccau

SEQ ID NO: 429871 - RNA, 31 nt, Human
caucaaaacaaauguucugaaaaaaaaaaaa

SEQ ID NO: 429872 - RNA, 19 nt, Human
cauggugccucguguccag

SEQ ID NO: 429873 - RNA, 20 nt, Human
ccaagagagggggacuaaca

SEQ ID NO: 429874 - RNA, 18 nt, Human
ccccuacaguucuguaac

SEQ ID NO: 429875 - RNA, 19 nt, Human
cccguggcugaacaggauc

SEQ ID NO: 429876 - RNA, 21 nt, Human
ccuccaguauccgaugggagc

SEQ ID NO: 429877 - RNA, 24 nt, Human
ccuccccuacaguucuguaacacc

SEQ ID NO: 429878 - RNA, 19 nt, Human
ccuuguggacaagggcaga

SEQ ID NO: 429879 - RNA, 21 nt, Human
cuccuuguagaggucccucug

SEQ ID NO: 429880 - RNA, 18 nt, Human
cucugaucauggugccuc

SEQ ID NO: 429881 - RNA, 25 nt, Human
cuuauggucacccugaaguacugcc

SEQ ID NO: 429882 - RNA, 18 nt, Human
cuuccuguaaaacccuua

SEQ ID NO: 429883 - RNA, 24 nt, Human
cuuccuguaaaacccuuagcugag

SEQ ID NO: 429884 - RNA, 22 nt, Human
gacccaugaagaucuaccaucc

SEQ ID NO: 429885 - RNA, 24 nt, Human
gacccaugaagaucuaccauccac

SEQ ID NO: 429886 - RNA, 20 nt, Human
gaccugucuucaagaccugg

SEQ ID NO: 429887 - RNA, 20 nt, Human
gagaacaagauuagugcccc

SEQ ID NO: 429888 - RNA, 21 nt, Human
gcaaauggcagcuuuaagaca

SEQ ID NO: 429889 - RNA, 19 nt, Human
gcagccauucucuccugug

SEQ ID NO: 429890 - RNA, 23 nt, Human
gcaguggaaguaagaggucuaaa

SEQ ID NO: 429891 - RNA, 20 nt, Human
gcugaacaggauccaaaaug

SEQ ID NO: 429892 - RNA, 19 nt, Human
ggaacuggaaggcccaaug

SEQ ID NO: 429893 - RNA, 20 nt, Human
ggcgcagaagcaggacagga

SEQ ID NO: 429894 - RNA, 22 nt, Human
gggaagacggcgccucuucagg

SEQ ID NO: 429895 - RNA, 20 nt, Human
gggccuucgcaaggacuuca

SEQ ID NO: 429896 - RNA, 19 nt, Human
guaacacagcaggaaggga

SEQ ID NO: 429897 - RNA, 23 nt, Human
uaaaacaaacaaaccaucgagcc

SEQ ID NO: 429898 - RNA, 18 nt, Human
uagcaguggaaguaagag

SEQ ID NO: 429899 - RNA, 19 nt, Human
uaguucuccagcaucaccu

SEQ ID NO: 429900 - RNA, 20 nt, Human
uaucauucugccuuucccuc

SEQ ID NO: 429901 - RNA, 19 nt, Human
ucauuuccauggccucccc

SEQ ID NO: 429902 - RNA, 23 nt, Human
uccauggccuccccuacaguucu

SEQ ID NO: 429903 - RNA, 25 nt, Human
ucccucaaugauccuucugauuuuu

SEQ ID NO: 429904 - RNA, 24 nt, Human
uccgaaaaugugugcaaacgccgg

SEQ ID NO: 429905 - RNA, 24 nt, Human
ucgcaaggacuucaucucccagaa

SEQ ID NO: 429906 - RNA, 18 nt, Human
ucuagugucgcgucccuc

SEQ ID NO: 429907 - RNA, 21 nt, Human
ucuagugucgcgucccuccag

SEQ ID NO: 429908 - RNA, 22 nt, Human
ucuagugucgcgucccuccagu

SEQ ID NO: 429909 - RNA, 21 nt, Human
ucuccucagacccaugaagau

SEQ ID NO: 429910 - RNA, 24 nt, Human
ucuccuuguggacaagggcagagu

SEQ ID NO: 429911 - RNA, 22 nt, Human
ucucuccugugugcucuccuug

SEQ ID NO: 429912 - RNA, 25 nt, Human
ucugaagcaucgugaaucucaggcu

SEQ ID NO: 429913 - RNA, 21 nt, Human
uggcugaacaggauccaaaau

SEQ ID NO: 429914 - RNA, 23 nt, Human
uggguagaaugagcaaauggcag

SEQ ID NO: 429915 - RNA, 18 nt, Human
ugucgcgucccuccagua

SEQ ID NO: 429916 - RNA, 24 nt, Human
ugugcaaacgccggcuucccgugg

SEQ ID NO: 429917 - RNA, 18 nt, Human
uuuuuuuuuuuuuuuuug

SEQ ID NO: 429918 - RNA, 24 nt, Human
uuuuuuuuuuuuuuuuuugucauu

SEQ ID NO: 429919 - RNA, 26 nt, Human
aaacauuuuaacauuucugaagaaac

SEQ ID NO: 429920 - RNA, 21 nt, Human
aaaccaacucaaucuauagaa

SEQ ID NO: 429921 - RNA, 20 nt, Human
aagaguugggcaucagugag

SEQ ID NO: 429922 - RNA, 22 nt, Human
acagcaaagugggcauguaucu

SEQ ID NO: 429923 - RNA, 24 nt, Human
acagcaaagugggcauguaucuuu

SEQ ID NO: 429924 - RNA, 19 nt, Human
agaaacagcaaagugggcc

SEQ ID NO: 429925 - RNA, 19 nt, Human
aggugaauuguauuacgaa

SEQ ID NO: 429926 - RNA, 19 nt, Human
auaucuggagaccuacaac

SEQ ID NO: 429927 - RNA, 20 nt, Human
auguaucuuuaauguggagc

SEQ ID NO: 429928 - RNA, 18 nt, Human
caaaaagcaguuauccag

SEQ ID NO: 429929 - RNA, 18 nt, Human
caagccaaagaaucagga

SEQ ID NO: 429930 - RNA, 18 nt, Human
caaugcuugcaauacaaa

SEQ ID NO: 429931 - RNA, 20 nt, Human
cacggugcaggcggcagagc

SEQ ID NO: 429932 - RNA, 18 nt, Human
cagcaaagugggcaugua

SEQ ID NO: 429933 - RNA, 20 nt, Human
cauaucuggagaccuacaac

SEQ ID NO: 429934 - RNA, 21 nt, Human
ccucuuaaaccaacucaaucu

SEQ ID NO: 429935 - RNA, 25 nt, Human
cggcuucugggugucccgguguccu

SEQ ID NO: 429936 - RNA, 23 nt, Human
cucaauucaaaaagcaguuaucc

SEQ ID NO: 429937 - RNA, 20 nt, Human
cuuguguuucaaaggaagug

SEQ ID NO: 429938 - RNA, 20 nt, Human
gagggacccggggccucucg

SEQ ID NO: 429939 - RNA, 21 nt, Human
gcaagucucucuucucaauuc

SEQ ID NO: 429940 - RNA, 25 nt, Human
gugggacaacagaaagcuucucccg

SEQ ID NO: 429941 - RNA, 21 nt, Human
uacaaaguagaccucuuaaac

SEQ ID NO: 429942 - RNA, 25 nt, Human
uacaacucugaggaacagagacaag

SEQ ID NO: 429943 - RNA, 19 nt, Human
uagccacacaccucucucc

SEQ ID NO: 429944 - RNA, 21 nt, Human
ucaaaaagcaguuauccagag

SEQ ID NO: 429945 - RNA, 19 nt, Human
ucaccacucucuuuucuug

SEQ ID NO: 429946 - RNA, 21 nt, Human
ucucuagggcucccgugaaua

SEQ ID NO: 429947 - RNA, 23 nt, Human
ugaauagugcgggucacggugca

SEQ ID NO: 429948 - RNA, 23 nt, Human
ugcgggucacggugcaggcggca

SEQ ID NO: 429949 - RNA, 24 nt, Human
uggagaccuacaacucugaggaac

SEQ ID NO: 429950 - RNA, 18 nt, Human
uggcagagggacccgggg

SEQ ID NO: 429951 - RNA, 19 nt, Human
uggcagagggacccggggc

SEQ ID NO: 429952 - RNA, 25 nt, Human
ugugacugaugccuuccuuuucugu

SEQ ID NO: 429953 - RNA, 21 nt, Human
uguuucaaaggaagugggaca

SEQ ID NO: 429954 - RNA, 18 nt, Human
uuaacauuucugaagaaa

SEQ ID NO: 429955 - RNA, 24 nt, Human
uuauccagagguucuuucaccacu

SEQ ID NO: 429956 - RNA, 20 nt, Human
uuuccagccauaacaacauu

SEQ ID NO: 429957 - RNA, 22 nt, Human
aaaaagccuagaugcugaggua

SEQ ID NO: 429958 - RNA, 21 nt, Human
agagccaagcucucggggccu

SEQ ID NO: 429959 - RNA, 19 nt, Human
agcagacuccagauucauc

SEQ ID NO: 429960 - RNA, 19 nt, Human
aggcagcaccaucagaccc

SEQ ID NO: 429961 - RNA, 19 nt, Human
auacuuucaauagacacaa

SEQ ID NO: 429962 - RNA, 19 nt, Human
caccagaacacaguuccag

SEQ ID NO: 429963 - RNA, 19 nt, Human
cagaacuacuuaugaaagc

SEQ ID NO: 429964 - RNA, 18 nt, Human
cagcaccaucagacccag

SEQ ID NO: 429965 - RNA, 24 nt, Human
ccacacaccacacucguuucgcgg

SEQ ID NO: 429966 - RNA, 19 nt, Human
ccagaacacaguuccagau

SEQ ID NO: 429967 - RNA, 22 nt, Human
ccagagccaccucuuacuagag

SEQ ID NO: 429968 - RNA, 25 nt, Human
ccccucgcccuuccgagugcccuca

SEQ ID NO: 429969 - RNA, 19 nt, Human
ccccugagcguuugcuggg

SEQ ID NO: 429970 - RNA, 20 nt, Human
ccuuccaaguaagcagacuc

SEQ ID NO: 429971 - RNA, 24 nt, Human
cgagcccuccccucgcccuuccga

SEQ ID NO: 429972 - RNA, 23 nt, Human
cgggagagauagaaaaacuaggc

SEQ ID NO: 429973 - RNA, 20 nt, Human
cucgcccuuccgagugcccu

SEQ ID NO: 429974 - RNA, 18 nt, Human
cuuaugaaagcucucagg

SEQ ID NO: 429975 - RNA, 20 nt, Human
gagcccuccccucgcccuuc

SEQ ID NO: 429976 - RNA, 20 nt, Human
gcucucagguugaggcagca

SEQ ID NO: 429977 - RNA, 24 nt, Human
gcucucggggccucugcagccccu

SEQ ID NO: 429978 - RNA, 20 nt, Human
ggcucagagacucaggcucc

SEQ ID NO: 429979 - RNA, 20 nt, Human
uaacuucaaaaaggaaagcu

SEQ ID NO: 429980 - RNA, 20 nt, Human
ucaacuguuuuccuauauuc

SEQ ID NO: 429981 - RNA, 18 nt, Human
ucagaacuacuuaugaaa

SEQ ID NO: 429982 - RNA, 23 nt, Human
ucagacccagaaaggguucccag

SEQ ID NO: 429983 - RNA, 25 nt, Human
uccaaaguaaacaauuccuuucaac

SEQ ID NO: 429984 - RNA, 22 nt, Human
ucugcagccccugagcguuugc

SEQ ID NO: 429985 - RNA, 26 nt, Human
ugaccuguacauuaucauauaacuuc

SEQ ID NO: 429986 - RNA, 21 nt, Human
ugaggcagcaccaucagaccc

SEQ ID NO: 429987 - RNA, 19 nt, Human
ugagguauagcccuugaaa

SEQ ID NO: 429988 - RNA, 26 nt, Human
ugccuuccaaguaagcagacuccuuu

SEQ ID NO: 429989 - RNA, 20 nt, Human
uucgcggggccuccagagcc

SEQ ID NO: 429990 - RNA, 21 nt, Human
uucucaaguaugaauccccau

SEQ ID NO: 429991 - RNA, 19 nt, Human
uugcuggggacggcucaga

SEQ ID NO: 429992 - RNA, 23 nt, Human
agaaggcauuuccugaugaggau

SEQ ID NO: 429993 - RNA, 19 nt, Human
agccccucucuccucccuc

SEQ ID NO: 429994 - RNA, 24 nt, Human
agcuuagaaggcauuuccugaugg

SEQ ID NO: 429995 - RNA, 18 nt, Human
agcuucuggccaggagcc

SEQ ID NO: 429996 - RNA, 19 nt, Human
aggagccgggguggaggca

SEQ ID NO: 429997 - RNA, 19 nt, Human
cagcucccuucccgagccc

SEQ ID NO: 429998 - RNA, 23 nt, Human
caggagccgggguggaggcagag

SEQ ID NO: 429999 - RNA, 18 nt, Human
ccaucgccaugccucacc

SEQ ID NO: 430000 - RNA, 23 nt, Human
ccccaucgccaugccucacccca

SEQ ID NO: 430001 - RNA, 19 nt, Human
ccccaugcccucaccgccc

SEQ ID NO: 430002 - RNA, 20 nt, Human
ccccaugcccucaccgcccc

SEQ ID NO: 430003 - RNA, 21 nt, Human
cccccgggaagggagucucca

SEQ ID NO: 430004 - RNA, 18 nt, Human
ccccgcucccccuuuccu

SEQ ID NO: 430005 - RNA, 18 nt, Human
ccccugaagguaccgccu

SEQ ID NO: 430006 - RNA, 23 nt, Human
cccugaagguaccgccuccccca

SEQ ID NO: 430007 - RNA, 25 nt, Human
cccugggcgccccgcuccucgggag

SEQ ID NO: 430008 - RNA, 19 nt, Human
ccgggaagggagucuccac

SEQ ID NO: 430009 - RNA, 23 nt, Human
ccgggguggaggcagagggggca

SEQ ID NO: 430010 - RNA, 21 nt, Human
ccgucugcagacauuuucuau

SEQ ID NO: 430011 - RNA, 21 nt, Human
ccucccucggagccuugacuc

SEQ ID NO: 430012 - RNA, 19 nt, Human
ccugcggcagugggggccc

SEQ ID NO: 430013 - RNA, 24 nt, Human
ccugcggcagugggggcccccucc

SEQ ID NO: 430014 - RNA, 22 nt, Human
cgagccccucucuccucccucc

SEQ ID NO: 430015 - RNA, 22 nt, Human
cgccccagcucccuucccgagc

SEQ ID NO: 430016 - RNA, 19 nt, Human
cgccccgcucccccuuucc

SEQ ID NO: 430017 - RNA, 25 nt, Human
cggcagugggggcccccucccccgg

SEQ ID NO: 430018 - RNA, 21 nt, Human
cucaccccaugcccucaccgc

SEQ ID NO: 430019 - RNA, 22 nt, Human
cucccccaucgccaugccucac

SEQ ID NO: 430020 - RNA, 20 nt, Human
cugcccuuucucgcccucgc

SEQ ID NO: 430021 - RNA, 18 nt, Human
cugggcgccccgcucccc

SEQ ID NO: 430022 - RNA, 24 nt, Human
cuucuggccaggagccggggugga

SEQ ID NO: 430023 - RNA, 21 nt, Human
gaaccuccgggggugucuccu

SEQ ID NO: 430024 - RNA, 23 nt, Human
gagccuugacuccaguggggcug

SEQ ID NO: 430025 - RNA, 22 nt, Human
gagcuagaaagaacagcugagu

SEQ ID NO: 430026 - RNA, 23 nt, Human
gcagagggggcaccugcggcagu

SEQ ID NO: 430027 - RNA, 18 nt, Human
gcccugggcgccccgcuc

SEQ ID NO: 430028 - RNA, 18 nt, Human
ggggugucuccuuguccu

SEQ ID NO: 430029 - RNA, 20 nt, Human
guggcccugggcgccccgcu

SEQ ID NO: 430030 - RNA, 23 nt, Human
uaauucgcagagugccugcccuu

SEQ ID NO: 430031 - RNA, 24 nt, Human
uccagcuucuggccaggagccggg

SEQ ID NO: 430032 - RNA, 22 nt, Human
ucccccgggaagggagucucca

SEQ ID NO: 430033 - RNA, 19 nt, Human
ucucgcccucgcccucccc

SEQ ID NO: 430034 - RNA, 21 nt, Human
ucucgcccucgcccuccccca

SEQ ID NO: 430035 - RNA, 20 nt, Human
ugaagguaccgccuccccca

SEQ ID NO: 430036 - RNA, 19 nt, Human
ugacuccugaguguccccu

SEQ ID NO: 430037 - RNA, 19 nt, Human
uggaggcagagggggcacc

SEQ ID NO: 430038 - RNA, 24 nt, Human
uggaggcagagggggcaccugcgg

SEQ ID NO: 430039 - RNA, 24 nt, Human
uucagagcuagaaagaacagcuga

SEQ ID NO: 430040 - RNA, 23 nt, Human
uucccgagccccucucuccuccc

SEQ ID NO: 430041 - RNA, 23 nt, Human
uucgcagagugccugcccuuucu

SEQ ID NO: 430042 - RNA, 20 nt, Human
uuggccaagcccccuccagc

SEQ ID NO: 430043 - RNA, 21 nt, Human
uuucuauuucagagcuagaaa

SEQ ID NO: 430044 - RNA, 24 nt, Human
uuuuuuuuuuuuuuuuuuuucaag

SEQ ID NO: 430045 - RNA, 22 nt, Human
aaaagaagcaggagaaacgagg

SEQ ID NO: 430046 - RNA, 25 nt, Human
aaaagggaggagaaaagaagcagga

SEQ ID NO: 430047 - RNA, 23 nt, Human
aaaaucccucacuuucccaaccc

SEQ ID NO: 430048 - RNA, 20 nt, Human
aaacaugaaaaagaagccau

SEQ ID NO: 430049 - RNA, 19 nt, Human
aaacgaggccaaaaauccc

SEQ ID NO: 430050 - RNA, 22 nt, Human
aaaugcugugaaggcaaacuuu

SEQ ID NO: 430051 - RNA, 20 nt, Human
aagaagcaggagaaacgagg

SEQ ID NO: 430052 - RNA, 21 nt, Human
aagcagacacaaagaugcgac

SEQ ID NO: 430053 - RNA, 23 nt, Human
aagcaggagaaacgaggccaaaa

SEQ ID NO: 430054 - RNA, 18 nt, Human
aggaagcagacacaaaga

SEQ ID NO: 430055 - RNA, 21 nt, Human
aggagaaaagaagcaggagaa

SEQ ID NO: 430056 - RNA, 18 nt, Human
aggagaaacgaggccaaa

SEQ ID NO: 430057 - RNA, 18 nt, Human
aucugaaaugcugugaag

SEQ ID NO: 430058 - RNA, 20 nt, Human
augaaacaugaaaaagaagc

SEQ ID NO: 430059 - RNA, 21 nt, Human
caacaugaggaacucuaaaua

SEQ ID NO: 430060 - RNA, 18 nt, Human
caccaagcuagguugggg

SEQ ID NO: 430061 - RNA, 23 nt, Human
cagaaaagucacaugaccuuggu

SEQ ID NO: 430062 - RNA, 18 nt, Human
cagcccucaccaagcuag

SEQ ID NO: 430063 - RNA, 24 nt, Human
caggagaaacgaggccaaaaaucc

SEQ ID NO: 430064 - RNA, 21 nt, Human
caggcagugguccacagcugg

SEQ ID NO: 430065 - RNA, 21 nt, Human
caguacagaaaagucacauga

SEQ ID NO: 430066 - RNA, 24 nt, Human
caucugaaaugcugugaaggcaaa

SEQ ID NO: 430067 - RNA, 23 nt, Human
caugaaaaagaagccauacagua

SEQ ID NO: 430068 - RNA, 18 nt, Human
ccaaauaauuuuucccau

SEQ ID NO: 430069 - RNA, 24 nt, Human
ccauacaguauaaauugcaacuuc

SEQ ID NO: 430070 - RNA, 23 nt, Human
cccacaggaagcagacacaaaga

SEQ ID NO: 430071 - RNA, 19 nt, Human
cccucacuuucccaaccca

SEQ ID NO: 430072 - RNA, 22 nt, Human
cuaccaccacgucccacaggaa

SEQ ID NO: 430073 - RNA, 18 nt, Human
cucucucucucucucucu

SEQ ID NO: 430074 - RNA, 18 nt, Human
cucucucucucucucucu

SEQ ID NO: 430075 - RNA, 18 nt, Human
cucucucucucucucucu

SEQ ID NO: 430076 - RNA, 18 nt, Human
cucucucucucucucucu

SEQ ID NO: 430077 - RNA, 18 nt, Human
cucucucucucucucucu

SEQ ID NO: 430078 - RNA, 18 nt, Human
cucucucucucucucucu

SEQ ID NO: 430079 - RNA, 18 nt, Human
cucucucucucucucucu

SEQ ID NO: 430080 - RNA, 18 nt, Human
cucucucucucucucucu

SEQ ID NO: 430081 - RNA, 18 nt, Human
cucucucucucucucucu

SEQ ID NO: 430082 - RNA, 18 nt, Human
cucucucucucucucucu

SEQ ID NO: 430083 - RNA, 18 nt, Human
cucucucucucucucucu

SEQ ID NO: 430084 - RNA, 18 nt, Human
cucucucucucucucucu

SEQ ID NO: 430085 - RNA, 18 nt, Human
cucucucucucucucucu

SEQ ID NO: 430086 - RNA, 18 nt, Human
cucucucucucucucucu

SEQ ID NO: 430087 - RNA, 18 nt, Human
cucucucucucucucucu

SEQ ID NO: 430088 - RNA, 18 nt, Human
cucucucucucucucucu

SEQ ID NO: 430089 - RNA, 18 nt, Human
cucucucucucucucucu

SEQ ID NO: 430090 - RNA, 18 nt, Human
cucucucucucucucucu

SEQ ID NO: 430091 - RNA, 18 nt, Human
cucucucucucucucucu

SEQ ID NO: 430092 - RNA, 18 nt, Human
cucucucucucucucucu

SEQ ID NO: 430093 - RNA, 18 nt, Human
cucucucucucucucucu

SEQ ID NO: 430094 - RNA, 18 nt, Human
cucucucucucucucucu

SEQ ID NO: 430095 - RNA, 18 nt, Human
cucucucucucucucucu

SEQ ID NO: 430096 - RNA, 24 nt, Human
gaaacaugaaaaagaagccauaca

SEQ ID NO: 430097 - RNA, 22 nt, Human
gaaccaaauuuacuauacuuca

SEQ ID NO: 430098 - RNA, 23 nt, Human
gaagcaggagaaacgaggccaaa

SEQ ID NO: 430099 - RNA, 18 nt, Human
ggaaacaguuacagcccu

SEQ ID NO: 430100 - RNA, 18 nt, Human
gggugguauguucaugua

SEQ ID NO: 430101 - RNA, 25 nt, Human
uaaacccugcaacaugaggaacucu

SEQ ID NO: 430102 - RNA, 20 nt, Human
uauuccaaauaauuuuuccc

SEQ ID NO: 430103 - RNA, 21 nt, Human
ucaggcagugguccacagcug

SEQ ID NO: 430104 - RNA, 21 nt, Human
ucuaccggcaaaguaaaaggg

SEQ ID NO: 430105 - RNA, 18 nt, Human
ugaaaaagaagccauaca

SEQ ID NO: 430106 - RNA, 21 nt, Human
ugagaaaagguuuaaucucca

SEQ ID NO: 430107 - RNA, 24 nt, Human
ugcaacaugaggaacucuaaauac

SEQ ID NO: 430108 - RNA, 22 nt, Human
aaccaguuucaauucaaaccaa

SEQ ID NO: 430109 - RNA, 22 nt, Human
aagacuagaaugaaauagaaug

SEQ ID NO: 430110 - RNA, 18 nt, Human
acauuaaaaugcacagaa

SEQ ID NO: 430111 - RNA, 22 nt, Human
acggagccugugagaguggacc

SEQ ID NO: 430112 - RNA, 20 nt, Human
agaguggaccgggauggcca

SEQ ID NO: 430113 - RNA, 23 nt, Human
agaguggaccgggauggccaaaa

SEQ ID NO: 430114 - RNA, 23 nt, Human
agaucuccuuuugaagcaaauaa

SEQ ID NO: 430115 - RNA, 24 nt, Human
agcuguuaacuaaaugaacaauau

SEQ ID NO: 430116 - RNA, 21 nt, Human
auaguagguaaagaaaaauac

SEQ ID NO: 430117 - RNA, 22 nt, Human
aucuacacgggugucucugggg

SEQ ID NO: 430118 - RNA, 22 nt, Human
caugucacuuaacggagccugu

SEQ ID NO: 430119 - RNA, 21 nt, Human
ggaguuuuuaggggaguuaag

SEQ ID NO: 430120 - RNA, 22 nt, Human
gguaaagaaaaauacacuauaa

SEQ ID NO: 430121 - RNA, 24 nt, Human
guccuccugagaguucaugucacu

SEQ ID NO: 430122 - RNA, 21 nt, Human
uaaaaugcacagaaaaaaaga

SEQ ID NO: 430123 - RNA, 25 nt, Human
uaaaaugcacagaaaaaaagacuag

SEQ ID NO: 430124 - RNA, 19 nt, Human
uacaaaauugaacacacaa

SEQ ID NO: 430125 - RNA, 22 nt, Human
uagcuucucagucccugacccu

SEQ ID NO: 430126 - RNA, 21 nt, Human
uagggauuuuucuaaagaucu

SEQ ID NO: 430127 - RNA, 25 nt, Human
ugaaaauacaaaauugaacacacaa

SEQ ID NO: 430128 - RNA, 22 nt, Human
ugcccuguccgcuucuggcuca

SEQ ID NO: 430129 - RNA, 19 nt, Human
ugggagagaagccgugaug

SEQ ID NO: 430130 - RNA, 18 nt, Human
uuccuaucuuuuauuagg

SEQ ID NO: 430131 - RNA, 23 nt, Human
uucuaaagaucuccuuuugaagc

SEQ ID NO: 430132 - RNA, 21 nt, Human
uuuaauauauuuaugacugua

SEQ ID NO: 430133 - RNA, 19 nt, Human
aaacagauaagauaauuau

SEQ ID NO: 430134 - RNA, 18 nt, Human
aaacuucuaaagacccca

SEQ ID NO: 430135 - RNA, 18 nt, Human
aaagaccccaaacgcuuc

SEQ ID NO: 430136 - RNA, 22 nt, Human
aacauuuuucaaggaccugcua

SEQ ID NO: 430137 - RNA, 23 nt, Human
aacccucaacucacugccggcuc

SEQ ID NO: 430138 - RNA, 19 nt, Human
aagaguauuguuuggcuuu

SEQ ID NO: 430139 - RNA, 20 nt, Human
aauagguucuuaggaacugc

SEQ ID NO: 430140 - RNA, 23 nt, Human
acagauuuucuauccaaugauuu

SEQ ID NO: 430141 - RNA, 22 nt, Human
acagcaauacauacuucuccca

SEQ ID NO: 430142 - RNA, 18 nt, Human
accuucuuaaaagggcug

SEQ ID NO: 430143 - RNA, 23 nt, Human
agacauuaaaauaaaucugagcu

SEQ ID NO: 430144 - RNA, 18 nt, Human
aggaaucccugaccucgc

SEQ ID NO: 430145 - RNA, 21 nt, Human
aggaaucccugaccucgccga

SEQ ID NO: 430146 - RNA, 24 nt, Human
aggaaucccugaccucgccgaacc

SEQ ID NO: 430147 - RNA, 23 nt, Human
aucagacauuaaaauaaaucuga

SEQ ID NO: 430148 - RNA, 20 nt, Human
cacacagugucccuggcugg

SEQ ID NO: 430149 - RNA, 23 nt, Human
cacugaacaucaucaauagguuc

SEQ ID NO: 430150 - RNA, 22 nt, Human
cagacugagauaauuuagauau

SEQ ID NO: 430151 - RNA, 18 nt, Human
cagagcuaggacagggag

SEQ ID NO: 430152 - RNA, 18 nt, Human
cagcaagacaacaaaggg

SEQ ID NO: 430153 - RNA, 22 nt, Human
cagcucagggcaauggugggaa

SEQ ID NO: 430154 - RNA, 25 nt, Human
caguaagucugcacugaacaucauc

SEQ ID NO: 430155 - RNA, 23 nt, Human
ccgccuuacuagauugcaguaau

SEQ ID NO: 430156 - RNA, 23 nt, Human
ccugaccucgccgaacccucaac

SEQ ID NO: 430157 - RNA, 22 nt, Human
ccugcuauaaacaaaugcagau

SEQ ID NO: 430158 - RNA, 23 nt, Human
cgacgcacuccugcgcacgcgca

SEQ ID NO: 430159 - RNA, 22 nt, Human
cggaacaaccucgacgcacucc

SEQ ID NO: 430160 - RNA, 20 nt, Human
cucgccgaacccucaacuca

SEQ ID NO: 430161 - RNA, 21 nt, Human
gaccccaaacgcuuccaauau

SEQ ID NO: 430162 - RNA, 19 nt, Human
gaccuucuuaaaagggcug

SEQ ID NO: 430163 - RNA, 21 nt, Human
gauauaccuaaggcuauggac

SEQ ID NO: 430164 - RNA, 22 nt, Human
gccgaacccucaacucacugcc

SEQ ID NO: 430165 - RNA, 23 nt, Human
gcugcaacuaggaaucccugacc

SEQ ID NO: 430166 - RNA, 18 nt, Human
ggagcacccggagacaua

SEQ ID NO: 430167 - RNA, 30 nt, Human
ggagcacccggagacauagggagagugugg

SEQ ID NO: 430168 - RNA, 23 nt, Human
uaaagaccccaaacgcuuccaau

SEQ ID NO: 430169 - RNA, 24 nt, Human
uaacagcaauacauacuucuccca

SEQ ID NO: 430170 - RNA, 21 nt, Human
uaacuucauaaugucugguau

SEQ ID NO: 430171 - RNA, 20 nt, Human
uacagagcuaggacagggag

SEQ ID NO: 430172 - RNA, 22 nt, Human
uaccauagacuaauggauacaa

SEQ ID NO: 430173 - RNA, 20 nt, Human
uagaacucccacaguaguuc

SEQ ID NO: 430174 - RNA, 23 nt, Human
uagguucuuaggaacugcaacuu

SEQ ID NO: 430175 - RNA, 24 nt, Human
uauaacaaaacaaaaacauuuuuc

SEQ ID NO: 430176 - RNA, 19 nt, Human
uaucaaaauaaugauaaac

SEQ ID NO: 430177 - RNA, 24 nt, Human
uauccagcauaaauucaugauguu

SEQ ID NO: 430178 - RNA, 23 nt, Human
uauuaguaugcuauagaccuauu

SEQ ID NO: 430179 - RNA, 19 nt, Human
ucaacagcaagacaacaaa

SEQ ID NO: 430180 - RNA, 21 nt, Human
ucaacagcaagacaacaaagg

SEQ ID NO: 430181 - RNA, 20 nt, Human
ucaaggaccugcuauaaaca

SEQ ID NO: 430182 - RNA, 22 nt, Human
uccaagaguauuguuuggcuuu

SEQ ID NO: 430183 - RNA, 21 nt, Human
uccugcgcacgcgcaccagcu

SEQ ID NO: 430184 - RNA, 24 nt, Human
ucggugagguagaccaggccuuug

SEQ ID NO: 430185 - RNA, 21 nt, Human
ucuaaagaccccaaacgcuuc

SEQ ID NO: 430186 - RNA, 24 nt, Human
ucuaaagaccccaaacgcuuccaa

SEQ ID NO: 430187 - RNA, 26 nt, Human
ugaaacuggagcacccggagacauag

SEQ ID NO: 430188 - RNA, 23 nt, Human
ugaaaugauguauaacaaaacca

SEQ ID NO: 430189 - RNA, 25 nt, Human
uggacgucucuccagccuaaauucc

SEQ ID NO: 430190 - RNA, 18 nt, Human
ugugauaucauuuaagag

SEQ ID NO: 430191 - RNA, 28 nt, Human
uguggaaggaacccccuaggagcccccg

SEQ ID NO: 430192 - RNA, 19 nt, Human
uguguacuauaugcagugu

SEQ ID NO: 430193 - RNA, 19 nt, Human
uguuacuguugucuuagcc

SEQ ID NO: 430194 - RNA, 20 nt, Human
uucuuaggaacugcaacuuu

SEQ ID NO: 430195 - RNA, 21 nt, Human
uugaugauagagauccaaggu

SEQ ID NO: 430196 - RNA, 24 nt, Human
uugcaguaauucucaggcuugagg

SEQ ID NO: 430197 - RNA, 27 nt, Human
uuuaagagggauaucugacaaauguuu

SEQ ID NO: 430198 - RNA, 23 nt, Human
uuuagauaugucaauuaaccuaa

SEQ ID NO: 430199 - RNA, 19 nt, Human
aaaaauacaggcacauaac

SEQ ID NO: 430200 - RNA, 22 nt, Human
aaaacucuggagaacaucaaag

SEQ ID NO: 430201 - RNA, 21 nt, Human
aaacacccaaacauccuaaaa

SEQ ID NO: 430202 - RNA, 28 nt, Human
aaacugaaugcuuuaagaauaaaaguaa

SEQ ID NO: 430203 - RNA, 20 nt, Human
aaauaaaaacaaaguuucag

SEQ ID NO: 430204 - RNA, 19 nt, Human
aaguacaauaugauaaagc

SEQ ID NO: 430205 - RNA, 21 nt, Human
aaguuucauacaucacaaaaa

SEQ ID NO: 430206 - RNA, 18 nt, Human
acacuagaguccuacacc

SEQ ID NO: 430207 - RNA, 23 nt, Human
acaggcauuaccacaacacuaac

SEQ ID NO: 430208 - RNA, 24 nt, Human
acugaagucuuuuaaaaagcuuua

SEQ ID NO: 430209 - RNA, 18 nt, Human
agaagugauuauuaccag

SEQ ID NO: 430210 - RNA, 26 nt, Human
aggaggagguggagggagggggaccc

SEQ ID NO: 430211 - RNA, 24 nt, Human
aggccgggccgaggccuccgggaa

SEQ ID NO: 430212 - RNA, 22 nt, Human
auccaauuuuuuucaggggagg

SEQ ID NO: 430213 - RNA, 21 nt, Human
augucuuauuugacagcuuua

SEQ ID NO: 430214 - RNA, 21 nt, Human
caagcaucagugaaguauacu

SEQ ID NO: 430215 - RNA, 23 nt, Human
caauacacccaagaacacuagag

SEQ ID NO: 430216 - RNA, 19 nt, Human
cagcagcgucgagcguggc

SEQ ID NO: 430217 - RNA, 21 nt, Human
cagcccaugcaauacacccaa

SEQ ID NO: 430218 - RNA, 24 nt, Human
caggccaguacaauaagcuucaaa

SEQ ID NO: 430219 - RNA, 22 nt, Human
caucugcucuuuaauguuuucc

SEQ ID NO: 430220 - RNA, 19 nt, Human
caugcagagauuucauuua

SEQ ID NO: 430221 - RNA, 20 nt, Human
caugcagagauuucauuuau

SEQ ID NO: 430222 - RNA, 23 nt, Human
ccaauucugccuguaacaaacac

SEQ ID NO: 430223 - RNA, 20 nt, Human
cccaaaugcgaaagccgggu

SEQ ID NO: 430224 - RNA, 19 nt, Human
cccaugcaauacacccaag

SEQ ID NO: 430225 - RNA, 21 nt, Human
ccgccgcgggccgggagcggg

SEQ ID NO: 430226 - RNA, 18 nt, Human
ccgccgcggggucuuccu

SEQ ID NO: 430227 - RNA, 18 nt, Human
ccugcagcagcgucgagc

SEQ ID NO: 430228 - RNA, 21 nt, Human
ccugcagcagcgucgagcgug

SEQ ID NO: 430229 - RNA, 21 nt, Human
ccugcagcagcgucgagcgug

SEQ ID NO: 430230 - RNA, 21 nt, Human
ccuugauuacauucccaaaag

SEQ ID NO: 430231 - RNA, 18 nt, Human
cgacaaaagaugcacaug

SEQ ID NO: 430232 - RNA, 20 nt, Human
cgagggggggccgaggagga

SEQ ID NO: 430233 - RNA, 25 nt, Human
cgccgccgccgccgcggggucuucc

SEQ ID NO: 430234 - RNA, 20 nt, Human
cgggaaggcugagccgggcg

SEQ ID NO: 430235 - RNA, 20 nt, Human
cgggucggagcagcaggcgg

SEQ ID NO: 430236 - RNA, 20 nt, Human
cucaagacccuguuguuggc

SEQ ID NO: 430237 - RNA, 25 nt, Human
cucauuuauauauaaaaaacacaag

SEQ ID NO: 430238 - RNA, 22 nt, Human
cugcucuuuaauguuuuccuac

SEQ ID NO: 430239 - RNA, 22 nt, Human
cuucuggugcaggccaguacaa

SEQ ID NO: 430240 - RNA, 21 nt, Human
cuugaaccaaaacauucgacc

SEQ ID NO: 430241 - RNA, 22 nt, Human
gagaacaucaaagaaaaauggc

SEQ ID NO: 430242 - RNA, 18 nt, Human
gaggagggaagcgagggg

SEQ ID NO: 430243 - RNA, 24 nt, Human
gaggagguggagggaggaccggcg

SEQ ID NO: 430244 - RNA, 19 nt, Human
gagggaagcgagggggggc

SEQ ID NO: 430245 - RNA, 28 nt, Human
gcaauacacccaagaacacuagaguccc

SEQ ID NO: 430246 - RNA, 22 nt, Human
gcccaugcaauacacccaagaa

SEQ ID NO: 430247 - RNA, 24 nt, Human
gcguggccgggacgacgccggagc

SEQ ID NO: 430248 - RNA, 22 nt, Human
ggagguggagggaggaccggcg

SEQ ID NO: 430249 - RNA, 18 nt, Human
uaaaacucuggagaacau

SEQ ID NO: 430250 - RNA, 18 nt, Human
uaaaauugaaagcaaaac

SEQ ID NO: 430251 - RNA, 23 nt, Human
uaacucagaacuaagguacauaa

SEQ ID NO: 430252 - RNA, 27 nt, Human
uacacaucugcaggucuaacucagaac

SEQ ID NO: 430253 - RNA, 22 nt, Human
uacauacuuaacuauuuacaga

SEQ ID NO: 430254 - RNA, 22 nt, Human
uauacugccuuuucuaguuguu

SEQ ID NO: 430255 - RNA, 21 nt, Human
uaugugcaauacauaaauaug

SEQ ID NO: 430256 - RNA, 23 nt, Human
uauguugugaaauuaaagagggu

SEQ ID NO: 430257 - RNA, 24 nt, Human
uauucaauagagcugcuguaugug

SEQ ID NO: 430258 - RNA, 19 nt, Human
ucaaagguuaucucaagac

SEQ ID NO: 430259 - RNA, 23 nt, Human
ucaaugcugaauagcaugauuau

SEQ ID NO: 430260 - RNA, 20 nt, Human
ucagaugcauguuauucaau

SEQ ID NO: 430261 - RNA, 20 nt, Human
uccauuauaacacagaaguu

SEQ ID NO: 430262 - RNA, 19 nt, Human
ucccaaaaggcagauaugc

SEQ ID NO: 430263 - RNA, 19 nt, Human
ucggagcagcaggcggagg

SEQ ID NO: 430264 - RNA, 21 nt, Human
ucugcucuuuaauguuuuccu

SEQ ID NO: 430265 - RNA, 23 nt, Human
ucugguguaccauuuuaaaaaaa

SEQ ID NO: 430266 - RNA, 18 nt, Human
ucuugaaccaaaacauuc

SEQ ID NO: 430267 - RNA, 20 nt, Human
ugaaccaaaacauucgacaa

SEQ ID NO: 430268 - RNA, 24 nt, Human
ugaaccaaaacauucgacaaaaga

SEQ ID NO: 430269 - RNA, 21 nt, Human
ugagccgggcgcccuggugcc

SEQ ID NO: 430270 - RNA, 23 nt, Human
ugcaauaaaucagaaguagugcc

SEQ ID NO: 430271 - RNA, 21 nt, Human
ugcagcagcgucgagcguggc

SEQ ID NO: 430272 - RNA, 18 nt, Human
ugcagcccaugcaauaca

SEQ ID NO: 430273 - RNA, 24 nt, Human
ugcaucugcucuuuaauguuuucc

SEQ ID NO: 430274 - RNA, 19 nt, Human
uggagaacaucaaagaaaa

SEQ ID NO: 430275 - RNA, 20 nt, Human
uggagggaggaccggcggcc

SEQ ID NO: 430276 - RNA, 21 nt, Human
uggcgccaaauacugguuuca

SEQ ID NO: 430277 - RNA, 19 nt, Human
uggcgcuggauaccacuaa

SEQ ID NO: 430278 - RNA, 20 nt, Human
uggcuuuuauuauuuacaua

SEQ ID NO: 430279 - RNA, 22 nt, Human
uggcuuuuauuauuuacauaau

SEQ ID NO: 430280 - RNA, 21 nt, Human
uguaacaaacacccaaacauc

SEQ ID NO: 430281 - RNA, 21 nt, Human
uucagucucuucacaagaagu

SEQ ID NO: 430282 - RNA, 23 nt, Human
uucauacaucacaaaaaaccuuc

SEQ ID NO: 430283 - RNA, 19 nt, Human
uuccaaagaauauguugug

SEQ ID NO: 430284 - RNA, 20 nt, Human
uugcugugcagauuuucauc

SEQ ID NO: 430285 - RNA, 21 nt, Human
uuuacagaugaaaacaggcau

SEQ ID NO: 430286 - RNA, 26 nt, Human
aaaauaaaucaaacuggaaugaaaua

SEQ ID NO: 430287 - RNA, 22 nt, Human
aaacaaggcauacaggguuccc

SEQ ID NO: 430288 - RNA, 20 nt, Human
aaagagaaaucugaaagccc

SEQ ID NO: 430289 - RNA, 19 nt, Human
aaagcccaaaaaauuccag

SEQ ID NO: 430290 - RNA, 19 nt, Human
aaggugccuuccccaucug

SEQ ID NO: 430291 - RNA, 19 nt, Human
aagugcaaaacuaugaaaa

SEQ ID NO: 430292 - RNA, 21 nt, Human
aauagcagaaacugcuccaag

SEQ ID NO: 430293 - RNA, 24 nt, Human
acacuuccacauauaauaacauaa

SEQ ID NO: 430294 - RNA, 22 nt, Human
acagugcaaauuuauuuuugaa

SEQ ID NO: 430295 - RNA, 20 nt, Human
acaguuuaaaaaaaaaaaaa

SEQ ID NO: 430296 - RNA, 18 nt, Human
acugaggucuagaaacag

SEQ ID NO: 430297 - RNA, 21 nt, Human
agagaaaucugaaagcccaaa

SEQ ID NO: 430298 - RNA, 22 nt, Human
agcacaauagcagaaacugcuc

SEQ ID NO: 430299 - RNA, 20 nt, Human
agcugcauuagagaaaagga

SEQ ID NO: 430300 - RNA, 18 nt, Human
aguucacccaaaugccag

SEQ ID NO: 430301 - RNA, 18 nt, Human
aguuuaaaaaaaaaaaaa

SEQ ID NO: 430302 - RNA, 21 nt, Human
aucaacucuaguauguccaca

SEQ ID NO: 430303 - RNA, 22 nt, Human
caaaacccccccgccacugaau

SEQ ID NO: 430304 - RNA, 21 nt, Human
caagcagguuuacaacuuaga

SEQ ID NO: 430305 - RNA, 19 nt, Human
caauagcagaaacugcucc

SEQ ID NO: 430306 - RNA, 21 nt, Human
caauagcagaaacugcuccaa

SEQ ID NO: 430307 - RNA, 24 nt, Human
caaugccaacagacugaucucaaa

SEQ ID NO: 430308 - RNA, 24 nt, Human
cacaacuguaguguuccuugcaga

SEQ ID NO: 430309 - RNA, 21 nt, Human
cacaguauuugaacaagcagg

SEQ ID NO: 430310 - RNA, 20 nt, Human
caccaagaccuuuuuucccc

SEQ ID NO: 430311 - RNA, 23 nt, Human
caccaagaccuuuuuucccccua

SEQ ID NO: 430312 - RNA, 23 nt, Human
cacucaccccucuaacagcccug

SEQ ID NO: 430313 - RNA, 19 nt, Human
cagcauauuaaagaacaaa

SEQ ID NO: 430314 - RNA, 21 nt, Human
cagcccuggguuccaaaaacc

SEQ ID NO: 430315 - RNA, 23 nt, Human
cagcgggcucggccagcaguucc

SEQ ID NO: 430316 - RNA, 21 nt, Human
ccaaaaaauuccagcauaaua

SEQ ID NO: 430317 - RNA, 21 nt, Human
ccagagcaaauauuuauuaua

SEQ ID NO: 430318 - RNA, 22 nt, Human
ccagauacauuaagacuaccaa

SEQ ID NO: 430319 - RNA, 22 nt, Human
ccagcuuccgaauggcugaccu

SEQ ID NO: 430320 - RNA, 21 nt, Human
cccaaaaaauuccagcauaau

SEQ ID NO: 430321 - RNA, 19 nt, Human
cccaaaauuucccuuaaaa

SEQ ID NO: 430322 - RNA, 20 nt, Human
cccaucccgccccacccaac

SEQ ID NO: 430323 - RNA, 23 nt, Human
cccaucccgccccacccaaccca

SEQ ID NO: 430324 - RNA, 21 nt, Human
cccaucugagaugcucaaagu

SEQ ID NO: 430325 - RNA, 18 nt, Human
cccauguauguaaguucc

SEQ ID NO: 430326 - RNA, 18 nt, Human
ccccaauaccugcaauuc

SEQ ID NO: 430327 - RNA, 24 nt, Human
ccccaucugagaugcucaaaguug

SEQ ID NO: 430328 - RNA, 18 nt, Human
cccuggguuccaaaaacc

SEQ ID NO: 430329 - RNA, 24 nt, Human
ccuaaaauguuccccccaaaauuu

SEQ ID NO: 430330 - RNA, 21 nt, Human
ccugauacaaagcacuucauu

SEQ ID NO: 430331 - RNA, 23 nt, Human
cgccacugaaucguccaacaaaa

SEQ ID NO: 430332 - RNA, 22 nt, Human
cuaaaacccaaauugcaugugc

SEQ ID NO: 430333 - RNA, 22 nt, Human
cucaaaugaguucucccuugua

SEQ ID NO: 430334 - RNA, 28 nt, Human
cucagugauggugucacugguucuuucc

SEQ ID NO: 430335 - RNA, 19 nt, Human
cuccaagugaugagcugca

SEQ ID NO: 430336 - RNA, 24 nt, Human
cucuauuaucacauacccccuuua

SEQ ID NO: 430337 - RNA, 22 nt, Human
cugaccucgauaucugcagcac

SEQ ID NO: 430338 - RNA, 23 nt, Human
cugaccucgauaucugcagcaca

SEQ ID NO: 430339 - RNA, 26 nt, Human
cuucaaaacaaccaaaaaugggaaaa

SEQ ID NO: 430340 - RNA, 23 nt, Human
gaaaauaacugaggucuagaaac

SEQ ID NO: 430341 - RNA, 21 nt, Human
gagcugcauuagagaaaagga

SEQ ID NO: 430342 - RNA, 19 nt, Human
gcccuggguuccaaaaacc

SEQ ID NO: 430343 - RNA, 24 nt, Human
guccacaguucacccaaaugccag

SEQ ID NO: 430344 - RNA, 21 nt, Human
guuuaaaaaaaaaaaaacaua

SEQ ID NO: 430345 - RNA, 24 nt, Human
uaaaagugcaaaacuaugaaaaca

SEQ ID NO: 430346 - RNA, 19 nt, Human
uaaaucaaacuggaaugaa

SEQ ID NO: 430347 - RNA, 20 nt, Human
uaacugaggucuagaaacag

SEQ ID NO: 430348 - RNA, 24 nt, Human
uaagcacugacauccaccaagacc

SEQ ID NO: 430349 - RNA, 23 nt, Human
uaauacugauggacacaaaaaca

SEQ ID NO: 430350 - RNA, 25 nt, Human
uacaaaccuaaaauguuccccccaa

SEQ ID NO: 430351 - RNA, 21 nt, Human
uacaguuuauguuuauacaac

SEQ ID NO: 430352 - RNA, 18 nt, Human
uaccugcaauucacagau

SEQ ID NO: 430353 - RNA, 18 nt, Human
uagaaacagauuuucucu

SEQ ID NO: 430354 - RNA, 21 nt, Human
uaguauguccacaguucaccc

SEQ ID NO: 430355 - RNA, 19 nt, Human
uaguuaauacugauggaca

SEQ ID NO: 430356 - RNA, 22 nt, Human
uauaaaaccaguaguauaccaa

SEQ ID NO: 430357 - RNA, 23 nt, Human
uauacuuuucccccaucccgccc

SEQ ID NO: 430358 - RNA, 20 nt, Human
uauggagaacagcgaggcca

SEQ ID NO: 430359 - RNA, 19 nt, Human
ucagugauggugucacugg

SEQ ID NO: 430360 - RNA, 21 nt, Human
ucagugauggugucacugguc

SEQ ID NO: 430361 - RNA, 23 nt, Human
uccaccaagaccuuuuuuccccc

SEQ ID NO: 430362 - RNA, 22 nt, Human
uccauuaacaauuuuaagacaa

SEQ ID NO: 430363 - RNA, 23 nt, Human
uccauuaacaauuuuaagacaac

SEQ ID NO: 430364 - RNA, 23 nt, Human
uccccccaaaauuucccuuaaaa

SEQ ID NO: 430365 - RNA, 21 nt, Human
ucccgccccacccaacccaaa

SEQ ID NO: 430366 - RNA, 23 nt, Human
ucucuuaaaaauccuacaagccc

SEQ ID NO: 430367 - RNA, 20 nt, Human
ucuuuuuuuuaaauacaggg

SEQ ID NO: 430368 - RNA, 18 nt, Human
ugaaagagcacaauagca

SEQ ID NO: 430369 - RNA, 25 nt, Human
ugaaauaaauacauaaacaaaaauc

SEQ ID NO: 430370 - RNA, 23 nt, Human
ugaacaagcagguuuacaacuua

SEQ ID NO: 430371 - RNA, 18 nt, Human
ugaaguacaaagggcugu

SEQ ID NO: 430372 - RNA, 25 nt, Human
ugacagaaacaaauuuaaauaacug

SEQ ID NO: 430373 - RNA, 20 nt, Human
ugagaugcucaaaguugcga

SEQ ID NO: 430374 - RNA, 20 nt, Human
ugaggucuagaaacagauuu

SEQ ID NO: 430375 - RNA, 19 nt, Human
ugcacauacaguuuauguu

SEQ ID NO: 430376 - RNA, 20 nt, Human
ugcacugagaaaaauguuac

SEQ ID NO: 430377 - RNA, 24 nt, Human
uggaaugaaauaaauacauaaaca

SEQ ID NO: 430378 - RNA, 20 nt, Human
uggcugaccucgauaucugc

SEQ ID NO: 430379 - RNA, 25 nt, Human
uggcugaccucgauaucugcagcac

SEQ ID NO: 430380 - RNA, 18 nt, Human
ugguauuuuuauacauuc

SEQ ID NO: 430381 - RNA, 21 nt, Human
uguacuaauaaacucagccau

SEQ ID NO: 430382 - RNA, 22 nt, Human
uguacuaauaaacucagccaug

SEQ ID NO: 430383 - RNA, 19 nt, Human
ugugaacaggaaaaaaggu

SEQ ID NO: 430384 - RNA, 21 nt, Human
uuaaguaucaacaauuaaaau

SEQ ID NO: 430385 - RNA, 22 nt, Human
uuacaacuuagauauuuacaga

SEQ ID NO: 430386 - RNA, 23 nt, Human
uuccccccaaaauuucccuuaaa

SEQ ID NO: 430387 - RNA, 21 nt, Human
uuuaagacaacaauagauuug

SEQ ID NO: 430388 - RNA, 20 nt, Human
uuugaaguacaaagggcugu

SEQ ID NO: 430389 - RNA, 24 nt, Human
aaaauaaacucucacgccuaugga

SEQ ID NO: 430390 - RNA, 22 nt, Human
aacuaccucuagcgcucccccg

SEQ ID NO: 430391 - RNA, 21 nt, Human
aagacaccuguuuauugggga

SEQ ID NO: 430392 - RNA, 24 nt, Human
aagacaccuguuuauuggggacac

SEQ ID NO: 430393 - RNA, 18 nt, Human
aagugcagggaagaggag

SEQ ID NO: 430394 - RNA, 20 nt, Human
acaaaaauaaacucucacgc

SEQ ID NO: 430395 - RNA, 23 nt, Human
acacaaaccuucucugccagccc

SEQ ID NO: 430396 - RNA, 21 nt, Human
acagggccccugauggggcua

SEQ ID NO: 430397 - RNA, 24 nt, Human
acgccuauggaccagcaaagacug

SEQ ID NO: 430398 - RNA, 21 nt, Human
acuaccucuagcgcucccccg

SEQ ID NO: 430399 - RNA, 18 nt, Human
agaaggguacagugcccc

SEQ ID NO: 430400 - RNA, 26 nt, Human
agcgggcggcggcggcggcggcgggg

SEQ ID NO: 430401 - RNA, 19 nt, Human
aggaaaagcugcuaaugaa

SEQ ID NO: 430402 - RNA, 22 nt, Human
agggacacaaaccuucucugcc

SEQ ID NO: 430403 - RNA, 22 nt, Human
aggugcuguggaggagccccgg

SEQ ID NO: 430404 - RNA, 25 nt, Human
cacuaagcuaaucgccccugagggc

SEQ ID NO: 430405 - RNA, 24 nt, Human
ccaaaaauagcgacgucuacaggg

SEQ ID NO: 430406 - RNA, 21 nt, Human
ccacgcugcccccugcuggcu

SEQ ID NO: 430407 - RNA, 21 nt, Human
ccagcccacccuccuacgccc

SEQ ID NO: 430408 - RNA, 22 nt, Human
ccccccacccucaccccuugua

SEQ ID NO: 430409 - RNA, 19 nt, Human
cccccccgcccccggcccg

SEQ ID NO: 430410 - RNA, 21 nt, Human
cccccgcccccggcccggccc

SEQ ID NO: 430411 - RNA, 22 nt, Human
cccccgcccccggcccuggccc

SEQ ID NO: 430412 - RNA, 22 nt, Human
cccccgcccccuccccgguccc

SEQ ID NO: 430413 - RNA, 19 nt, Human
cccccggcccggcccccgc

SEQ ID NO: 430414 - RNA, 18 nt, Human
ccccgcccccggcccugg

SEQ ID NO: 430415 - RNA, 20 nt, Human
ccccugcuggcuucucuacc

SEQ ID NO: 430416 - RNA, 22 nt, Human
cccgcccccggcccggcccccg

SEQ ID NO: 430417 - RNA, 18 nt, Human
cccgcccccggcccuggc

SEQ ID NO: 430418 - RNA, 22 nt, Human
cccgcccccggcccuggcccgc

SEQ ID NO: 430419 - RNA, 19 nt, Human
cccgcccccuccccggucc

SEQ ID NO: 430420 - RNA, 19 nt, Human
cccggcccccgcccccucc

SEQ ID NO: 430421 - RNA, 24 nt, Human
ccgcccccggcccuggcccgcauu

SEQ ID NO: 430422 - RNA, 21 nt, Human
ccgcgccuuccaccucugguc

SEQ ID NO: 430423 - RNA, 27 nt, Human
ccgggccccggcccccccgcccccggc

SEQ ID NO: 430424 - RNA, 18 nt, Human
ccucugguccgccugggg

SEQ ID NO: 430425 - RNA, 24 nt, Human
ccuggcccgcauugugugcggcgg

SEQ ID NO: 430426 - RNA, 19 nt, Human
cgcauugugugcggcggga

SEQ ID NO: 430427 - RNA, 21 nt, Human
cgccagcccacccuccuacgc

SEQ ID NO: 430428 - RNA, 22 nt, Human
cgcgccuuccaccucugguccg

SEQ ID NO: 430429 - RNA, 21 nt, Human
cggcccccccgcccccggccc

SEQ ID NO: 430430 - RNA, 22 nt, Human
cggcccccgcccccuccccccu

SEQ ID NO: 430431 - RNA, 19 nt, Human
cggcgggaggcggcccggc

SEQ ID NO: 430432 - RNA, 23 nt, Human
cggggcugggagccgcgcgggag

SEQ ID NO: 430433 - RNA, 19 nt, Human
cgggggagaugcgccgggc

SEQ ID NO: 430434 - RNA, 21 nt, Human
cuagaaggguacagugccccc

SEQ ID NO: 430435 - RNA, 18 nt, Human
cuggcagaguggcuccuc

SEQ ID NO: 430436 - RNA, 20 nt, Human
cuggcuccggggacagggag

SEQ ID NO: 430437 - RNA, 19 nt, Human
gaagaggaggaaaagcugc

SEQ ID NO: 430438 - RNA, 18 nt, Human
gacagggagcuggggacc

SEQ ID NO: 430439 - RNA, 23 nt, Human
gagcuggggaccccgggagccgc

SEQ ID NO: 430440 - RNA, 18 nt, Human
gaggagccccgggcgggc

SEQ ID NO: 430441 - RNA, 24 nt, Human
gcaugcggggggcggcgcggcggg

SEQ ID NO: 430442 - RNA, 20 nt, Human
gcccccccgcccccggcccg

SEQ ID NO: 430443 - RNA, 18 nt, Human
gccgggccccggcccccc

SEQ ID NO: 430444 - RNA, 18 nt, Human
gcgcggcggggcugggag

SEQ ID NO: 430445 - RNA, 26 nt, Human
gcggcggcggagcgggcggcggcggc

SEQ ID NO: 430446 - RNA, 30 nt, Human
gcggcggcggagcgggcggcggcggcggcg

SEQ ID NO: 430447 - RNA, 20 nt, Human
gcggcggcggcggcggcggc

SEQ ID NO: 430448 - RNA, 20 nt, Human
gcggcggcggcggcggcggc

SEQ ID NO: 430449 - RNA, 23 nt, Human
gcggcggcggcggcggcggcggc

SEQ ID NO: 430450 - RNA, 21 nt, Human
gcggcggcggcggcggcgggc

SEQ ID NO: 430451 - RNA, 22 nt, Human
gcggcggcggcggcgggcggcg

SEQ ID NO: 430452 - RNA, 18 nt, Human
gcggcggcggcgggcggc

SEQ ID NO: 430453 - RNA, 20 nt, Human
gcucuggcuccggggacagg

SEQ ID NO: 430454 - RNA, 21 nt, Human
ggaagugcagggaagaggagg

SEQ ID NO: 430455 - RNA, 19 nt, Human
ggacagggagcuggggacc

SEQ ID NO: 430456 - RNA, 19 nt, Human
ggaccagcaaagacuggca

SEQ ID NO: 430457 - RNA, 19 nt, Human
ggacccccuucacauucuu

SEQ ID NO: 430458 - RNA, 25 nt, Human
ggagaugcgccgggccccggccccc

SEQ ID NO: 430459 - RNA, 30 nt, Human
ggagcgggcggcggcggcggcggcggcgac

SEQ ID NO: 430460 - RNA, 23 nt, Human
ggcggcgcggcggggcugggagc

SEQ ID NO: 430461 - RNA, 23 nt, Human
ggcggcggcggcggcggcggcgg

SEQ ID NO: 430462 - RNA, 32 nt, Human
ggcgggcggcggcggagcgggcggcggcgggg

SEQ ID NO: 430463 - RNA, 20 nt, Human
ggcgggcggcgggccggcgg

SEQ ID NO: 430464 - RNA, 22 nt, Human
ggcugggauaugggucccacgg

SEQ ID NO: 430465 - RNA, 20 nt, Human
gggaagugcagggaagagga

SEQ ID NO: 430466 - RNA, 31 nt, Human
gggcggcggcggagcgggcggcggcggcggg

SEQ ID NO: 430467 - RNA, 24 nt, Human
gggcggcggcggcggcggcggcgg

SEQ ID NO: 430468 - RNA, 20 nt, Human
gggcggcgggccggcggcga

SEQ ID NO: 430469 - RNA, 25 nt, Human
gggcgggcggcggcggagcgggcga

SEQ ID NO: 430470 - RNA, 21 nt, Human
gggggcggcgcggcggggcug

SEQ ID NO: 430471 - RNA, 21 nt, Human
gggucccacgcugcccccugc

SEQ ID NO: 430472 - RNA, 21 nt, Human
gucccccgcccccggcccugg

SEQ ID NO: 430473 - RNA, 22 nt, Human
gugcggcgggaggcggcccggc

SEQ ID NO: 430474 - RNA, 18 nt, Human
uacccaacuaccucuagc

SEQ ID NO: 430475 - RNA, 25 nt, Human
ucaccccuuguacaaaaauaaacuc

SEQ ID NO: 430476 - RNA, 20 nt, Human
ugccccccacccucaccccu

SEQ ID NO: 430477 - RNA, 23 nt, Human
ugcuguggaggagccccgggcgg

SEQ ID NO: 430478 - RNA, 23 nt, Human
uggaccagcaaagacuggcagag

SEQ ID NO: 430479 - RNA, 21 nt, Human
uggcagaguggcuccucaaca

SEQ ID NO: 430480 - RNA, 24 nt, Human
uggguaccgccagcccacccuccu

SEQ ID NO: 430481 - RNA, 24 nt, Human
ugggucccacgcugcccccugcug

SEQ ID NO: 430482 - RNA, 20 nt, Human
ugguucugggaagugcaggg

SEQ ID NO: 430483 - RNA, 19 nt, Human
ugugugcggcgggaggcgg

SEQ ID NO: 430484 - RNA, 19 nt, Human
uucuuugguucugggaagu

SEQ ID NO: 430485 - RNA, 25 nt, Human
aaaaaaacaaaacaaacaaaacaaa

SEQ ID NO: 430486 - RNA, 20 nt, Human
aaaaaaagggaaauccuuac

SEQ ID NO: 430487 - RNA, 24 nt, Human
aaaaaagauuccuuucauuuuuua

SEQ ID NO: 430488 - RNA, 22 nt, Human
aaaacaaacaaaacaaaaaaag

SEQ ID NO: 430489 - RNA, 23 nt, Human
aaaacaaacaaaacaaaaaaagg

SEQ ID NO: 430490 - RNA, 31 nt, Human
aaacaaaacaaacaaaacaaaaaaagggaaa

SEQ ID NO: 430491 - RNA, 24 nt, Human
aaacaaaaucucaucuguugcaga

SEQ ID NO: 430492 - RNA, 22 nt, Human
aaacaaacgacacagcaguuac

SEQ ID NO: 430493 - RNA, 18 nt, Human
aaacaauucauguaacac

SEQ ID NO: 430494 - RNA, 23 nt, Human
aaaccgauaugauuauaaaagau

SEQ ID NO: 430495 - RNA, 24 nt, Human
aaagggaaauccuuacuccuuuca

SEQ ID NO: 430496 - RNA, 23 nt, Human
aacaaacaaaacaaaaaaaggga

SEQ ID NO: 430497 - RNA, 21 nt, Human
aagaaauaaaagacaacuaau

SEQ ID NO: 430498 - RNA, 18 nt, Human
aagauaccaaaaaaucag

SEQ ID NO: 430499 - RNA, 22 nt, Human
aagcaagcugagauuuuucuug

SEQ ID NO: 430500 - RNA, 27 nt, Human
aagcaucucuauuucuaaaaaagauuc

SEQ ID NO: 430501 - RNA, 18 nt, Human
aaggagaagaaauaaaag

SEQ ID NO: 430502 - RNA, 21 nt, Human
acaaaacaaacaaaacaaaaa

SEQ ID NO: 430503 - RNA, 24 nt, Human
acaaaacaaacaaaacaaaaaaag

SEQ ID NO: 430504 - RNA, 25 nt, Human
acaaggagaagaaauaaaagacaac

SEQ ID NO: 430505 - RNA, 24 nt, Human
accauucucauggaagugaagaaa

SEQ ID NO: 430506 - RNA, 20 nt, Human
acucuauuaguaggaauaga

SEQ ID NO: 430507 - RNA, 19 nt, Human
agaaaguccuaaaacugag

SEQ ID NO: 430508 - RNA, 19 nt, Human
agaucuaaaaggcuggcuc

SEQ ID NO: 430509 - RNA, 22 nt, Human
agauuccuuucauuuuuuacuu

SEQ ID NO: 430510 - RNA, 20 nt, Human
agguguguaaauuguagguu

SEQ ID NO: 430511 - RNA, 19 nt, Human
aguggaauugauuucuucu

SEQ ID NO: 430512 - RNA, 21 nt, Human
auacuacaaaacuuuacaaac

SEQ ID NO: 430513 - RNA, 21 nt, Human
auaugauuauaaaagauacca

SEQ ID NO: 430514 - RNA, 23 nt, Human
augucaugcucccucaaaacaua

SEQ ID NO: 430515 - RNA, 23 nt, Human
augucauuaaauucccaauguuu

SEQ ID NO: 430516 - RNA, 24 nt, Human
caaaacaaacaaaacaaaaaaagg

SEQ ID NO: 430517 - RNA, 19 nt, Human
caacuuguggaaaacaaac

SEQ ID NO: 430518 - RNA, 19 nt, Human
cacagaaagaguuaaauuu

SEQ ID NO: 430519 - RNA, 21 nt, Human
cacagaaaguccuaaaacuga

SEQ ID NO: 430520 - RNA, 19 nt, Human
ccacucuggcucgcugggc

SEQ ID NO: 430521 - RNA, 19 nt, Human
ccagaagaggucaagggca

SEQ ID NO: 430522 - RNA, 21 nt, Human
ccuagagguguacagcucaga

SEQ ID NO: 430523 - RNA, 22 nt, Human
cgcgcgggaccagccaccacuc

SEQ ID NO: 430524 - RNA, 24 nt, Human
cgggaccagccaccacucuggcuc

SEQ ID NO: 430525 - RNA, 22 nt, Human
gagguguacagcucagaauuuu

SEQ ID NO: 430526 - RNA, 21 nt, Human
ggaugucaugcucccucaaaa

SEQ ID NO: 430527 - RNA, 18 nt, Human
ggucaagggcauggggau

SEQ ID NO: 430528 - RNA, 23 nt, Human
uaaaaaaaacaaaacaaacaaaa

SEQ ID NO: 430529 - RNA, 18 nt, Human
uaaaaaagaaaugagggu

SEQ ID NO: 430530 - RNA, 19 nt, Human
uaaaaaagaaaugagggua

SEQ ID NO: 430531 - RNA, 25 nt, Human
uaaaagauaccaaaaaaucagaaga

SEQ ID NO: 430532 - RNA, 24 nt, Human
uaacacagaaagaguuaaauuuca

SEQ ID NO: 430533 - RNA, 21 nt, Human
uacaaaacuuuacaaacaaaa

SEQ ID NO: 430534 - RNA, 21 nt, Human
uaccaaaaaaucagaagaaug

SEQ ID NO: 430535 - RNA, 21 nt, Human
uaguaggaauagaagacuuga

SEQ ID NO: 430536 - RNA, 23 nt, Human
uauaaaagauaccaaaaaaucag

SEQ ID NO: 430537 - RNA, 18 nt, Human
ucaagggcauggggaugu

SEQ ID NO: 430538 - RNA, 21 nt, Human
ucaauagaaauuaaaaccuga

SEQ ID NO: 430539 - RNA, 27 nt, Human
ucauuuuuuacuuuuuauuuuuucuua

SEQ ID NO: 430540 - RNA, 25 nt, Human
uccacaaggagaagaaauaaaagac

SEQ ID NO: 430541 - RNA, 24 nt, Human
ucccuuuuuucuuccacagaaagu

SEQ ID NO: 430542 - RNA, 20 nt, Human
ucucccuuuuuucuuccaca

SEQ ID NO: 430543 - RNA, 18 nt, Human
uggaauugauuucuucuc

SEQ ID NO: 430544 - RNA, 20 nt, Human
uucaguucuuugugcuccau

SEQ ID NO: 430545 - RNA, 19 nt, Human
uucuuccacagaaaguccu

SEQ ID NO: 430546 - RNA, 24 nt, Human
uugguuaaaaaaaacaaaacaaac

SEQ ID NO: 430547 - RNA, 18 nt, Human
aaaagugaacaacaacaa

SEQ ID NO: 430548 - RNA, 22 nt, Human
aaaauauacaauacacaaagca

SEQ ID NO: 430549 - RNA, 30 nt, Human
aaaaugcacagagaaaagaguggaaaaaaa

SEQ ID NO: 430550 - RNA, 20 nt, Human
aaaaugucuauuucuuuagg

SEQ ID NO: 430551 - RNA, 22 nt, Human
aaacaugaaggaaaaucugaca

SEQ ID NO: 430552 - RNA, 23 nt, Human
aaagacaaugauucuuuagauaa

SEQ ID NO: 430553 - RNA, 18 nt, Human
aaauaacccagcaagaac

SEQ ID NO: 430554 - RNA, 24 nt, Human
aaauaacccagcaagaacaaaagu

SEQ ID NO: 430555 - RNA, 21 nt, Human
aacaacaaaaaaaucaaaaga

SEQ ID NO: 430556 - RNA, 23 nt, Human
aacacuugaagcuuuaaaacaga

SEQ ID NO: 430557 - RNA, 22 nt, Human
aagaaguccaguaucacaagca

SEQ ID NO: 430558 - RNA, 20 nt, Human
aagcaguuuggaaaagaagu

SEQ ID NO: 430559 - RNA, 22 nt, Human
aauacaauucaccaaacuagcu

SEQ ID NO: 430560 - RNA, 20 nt, Human
acaaaauauacuguucagcc

SEQ ID NO: 430561 - RNA, 21 nt, Human
acccagcaagaacaaaaguuu

SEQ ID NO: 430562 - RNA, 23 nt, Human
acuaauuuucaaaaugcacagag

SEQ ID NO: 430563 - RNA, 20 nt, Human
acuuguagggccgcuccccc

SEQ ID NO: 430564 - RNA, 20 nt, Human
agaaaucucuuuucuagaau

SEQ ID NO: 430565 - RNA, 22 nt, Human
agaaggcgcggucacacuccag

SEQ ID NO: 430566 - RNA, 21 nt, Human
agacgcugacuguggcgugug

SEQ ID NO: 430567 - RNA, 24 nt, Human
aggaaaaucugacauacuuuuucc

SEQ ID NO: 430568 - RNA, 20 nt, Human
aggaauggcgugcacgcacu

SEQ ID NO: 430569 - RNA, 20 nt, Human
aguaucacaagcauaaguca

SEQ ID NO: 430570 - RNA, 24 nt, Human
agucucugaaagacaaugauucuu

SEQ ID NO: 430571 - RNA, 21 nt, Human
auaaagaucaaccuguacccc

SEQ ID NO: 430572 - RNA, 19 nt, Human
aucugacauacuuuuucca

SEQ ID NO: 430573 - RNA, 25 nt, Human
caaaagugaacaacaacaacaaaaa

SEQ ID NO: 430574 - RNA, 22 nt, Human
cacuagcgucaccucccacgcc

SEQ ID NO: 430575 - RNA, 21 nt, Human
cacuaguaugacuugcggcug

SEQ ID NO: 430576 - RNA, 18 nt, Human
cacucugcccagcacggg

SEQ ID NO: 430577 - RNA, 23 nt, Human
cagaaccuuuaaaacucuagcac

SEQ ID NO: 430578 - RNA, 23 nt, Human
cagcaagaacaaaaguuuaaaau

SEQ ID NO: 430579 - RNA, 25 nt, Human
cagcgugacacuagcgucaccuccc

SEQ ID NO: 430580 - RNA, 18 nt, Human
cagcuccuccccauccug

SEQ ID NO: 430581 - RNA, 18 nt, Human
caguaucacaagcauaag

SEQ ID NO: 430582 - RNA, 21 nt, Human
caguaucacaagcauaaguca

SEQ ID NO: 430583 - RNA, 18 nt, Human
cauaugcggcuacagcca

SEQ ID NO: 430584 - RNA, 27 nt, Human
ccacgcccgacgaggacaguggaccuc

SEQ ID NO: 430585 - RNA, 26 nt, Human
ccacgcccgacgaggacaugaccagg

SEQ ID NO: 430586 - RNA, 28 nt, Human
ccagcaagaacaaaaguuuaaaauucca

SEQ ID NO: 430587 - RNA, 21 nt, Human
ccagcuuuauaugacaaugaa

SEQ ID NO: 430588 - RNA, 22 nt, Human
ccccauguugacgccccagaua

SEQ ID NO: 430589 - RNA, 21 nt, Human
ccggcagccuccugcaccacc

SEQ ID NO: 430590 - RNA, 19 nt, Human
ccggccuggugugucugca

SEQ ID NO: 430591 - RNA, 22 nt, Human
ccuacccauuaccucuuucuuc

SEQ ID NO: 430592 - RNA, 26 nt, Human
ccuccagauagcauacccugaguauc

SEQ ID NO: 430593 - RNA, 23 nt, Human
ccuccagguggaggguccggcuc

SEQ ID NO: 430594 - RNA, 19 nt, Human
ccuccugcaccaccuccuc

SEQ ID NO: 430595 - RNA, 22 nt, Human
ccucuuucuuccuaaacacaaa

SEQ ID NO: 430596 - RNA, 20 nt, Human
ccugcagcgcacucuucugg

SEQ ID NO: 430597 - RNA, 23 nt, Human
ccugcagcgcacucuucugguug

SEQ ID NO: 430598 - RNA, 23 nt, Human
ccugcuccacccuggcccgagag

SEQ ID NO: 430599 - RNA, 18 nt, Human
cgauguauggcuugugcu

SEQ ID NO: 430600 - RNA, 20 nt, Human
cgccagcccguguggacagc

SEQ ID NO: 430601 - RNA, 24 nt, Human
cgcucccggccaugcaccuccuug

SEQ ID NO: 430602 - RNA, 24 nt, Human
cuaaagaauucccugaaaucaaaa

SEQ ID NO: 430603 - RNA, 23 nt, Human
cuauguacauauguauuuauaua

SEQ ID NO: 430604 - RNA, 25 nt, Human
cuccaggcacuggugcgcccggccc

SEQ ID NO: 430605 - RNA, 18 nt, Human
cucccggccaugcaccuc

SEQ ID NO: 430606 - RNA, 23 nt, Human
cucccggccaugcaccuccuugc

SEQ ID NO: 430607 - RNA, 24 nt, Human
cucccggccaugcaccuccuugcu

SEQ ID NO: 430608 - RNA, 21 nt, Human
cuccgggugaccugcagacuc

SEQ ID NO: 430609 - RNA, 19 nt, Human
cugaaaccaaggaggcaac

SEQ ID NO: 430610 - RNA, 19 nt, Human
cugacauucaaggaaggaa

SEQ ID NO: 430611 - RNA, 19 nt, Human
cugcaauuaggacuaguac

SEQ ID NO: 430612 - RNA, 19 nt, Human
cugcaccaccuccuccagg

SEQ ID NO: 430613 - RNA, 23 nt, Human
cugcugacccugagaggugaugu

SEQ ID NO: 430614 - RNA, 20 nt, Human
cuuuggggauauuuuuucac

SEQ ID NO: 430615 - RNA, 24 nt, Human
cuuuucuuuuucuuaaaaaaauau

SEQ ID NO: 430616 - RNA, 18 nt, Human
gaaaccaaggaggcaacg

SEQ ID NO: 430617 - RNA, 23 nt, Human
gagaaggcgcggucacacuccag

SEQ ID NO: 430618 - RNA, 20 nt, Human
gagccugcuccacccuggcc

SEQ ID NO: 430619 - RNA, 18 nt, Human
gcacgggugggauuuggu

SEQ ID NO: 430620 - RNA, 18 nt, Human
gcagacgcugacuguggc

SEQ ID NO: 430621 - RNA, 24 nt, Human
gccagcccguguggacagcugaau

SEQ ID NO: 430622 - RNA, 24 nt, Human
gcgcccggcccuccuucucuggcu

SEQ ID NO: 430623 - RNA, 20 nt, Human
gcggcgagccugcuccaccc

SEQ ID NO: 430624 - RNA, 25 nt, Human
gcggcgagccugcuccacccuggcc

SEQ ID NO: 430625 - RNA, 20 nt, Human
gcugggaacugcugacccug

SEQ ID NO: 430626 - RNA, 18 nt, Human
gcuucuuauaaccagaaa

SEQ ID NO: 430627 - RNA, 21 nt, Human
ggaccugaacacagauugaug

SEQ ID NO: 430628 - RNA, 18 nt, Human
ggaggagacugaggagga

SEQ ID NO: 430629 - RNA, 23 nt, Human
ggcagccguggaugcgcucccgg

SEQ ID NO: 430630 - RNA, 18 nt, Human
gguuuuuacggauucgug

SEQ ID NO: 430631 - RNA, 23 nt, Human
guuuuugucuuugcuaauacaaa

SEQ ID NO: 430632 - RNA, 19 nt, Human
uaaaacagagauuccaagu

SEQ ID NO: 430633 - RNA, 19 nt, Human
uaaaaugaauacaauacug

SEQ ID NO: 430634 - RNA, 21 nt, Human
uaaacagucaauuaaccaaua

SEQ ID NO: 430635 - RNA, 23 nt, Human
uaaagaauucccugaaaucaaaa

SEQ ID NO: 430636 - RNA, 27 nt, Human
uaaauaucuucacauaacaaaaguuuu

SEQ ID NO: 430637 - RNA, 18 nt, Human
uaacuucagaaacauucu

SEQ ID NO: 430638 - RNA, 19 nt, Human
uaccaagugcaaucacgac

SEQ ID NO: 430639 - RNA, 21 nt, Human
uagcauacccugaguaucggc

SEQ ID NO: 430640 - RNA, 18 nt, Human
uaggcucuagauucaccu

SEQ ID NO: 430641 - RNA, 18 nt, Human
uauaaaauaaaaagugca

SEQ ID NO: 430642 - RNA, 22 nt, Human
uaugaugagauaguucuaaaaa

SEQ ID NO: 430643 - RNA, 23 nt, Human
uaugcuucuuauuugcuggggug

SEQ ID NO: 430644 - RNA, 22 nt, Human
uauguacauauguauuuauaua

SEQ ID NO: 430645 - RNA, 22 nt, Human
ucaaggaauguucugcaaaaaa

SEQ ID NO: 430646 - RNA, 24 nt, Human
ucaauauuacuuauauacauaugc

SEQ ID NO: 430647 - RNA, 22 nt, Human
uccaguaucacaagcauaaguc

SEQ ID NO: 430648 - RNA, 20 nt, Human
ucccagagacgccagcuacc

SEQ ID NO: 430649 - RNA, 23 nt, Human
ucccagagacgccagcuaccugg

SEQ ID NO: 430650 - RNA, 20 nt, Human
uccggcucagcuccucccca

SEQ ID NO: 430651 - RNA, 22 nt, Human
uccugcacacggggcagccgug

SEQ ID NO: 430652 - RNA, 19 nt, Human
ucucugaaagacaaugauu

SEQ ID NO: 430653 - RNA, 22 nt, Human
ucucuggcugguugcccggggc

SEQ ID NO: 430654 - RNA, 28 nt, Human
ucugcaauuaggacuaguaccggggucc

SEQ ID NO: 430655 - RNA, 24 nt, Human
ucugcaauuauguaacccuggacc

SEQ ID NO: 430656 - RNA, 20 nt, Human
ucuggcugguugcccggggc

SEQ ID NO: 430657 - RNA, 20 nt, Human
ugaaaaagauauccauuuau

SEQ ID NO: 430658 - RNA, 23 nt, Human
ugaaaaagauauccauuuaugaa

SEQ ID NO: 430659 - RNA, 26 nt, Human
ugaaaaagauauccauuuaugaauaa

SEQ ID NO: 430660 - RNA, 23 nt, Human
ugaacaacaacaacaaaaaaauc

SEQ ID NO: 430661 - RNA, 27 nt, Human
ugaacaacaacaacaaaaaaaucaaaa

SEQ ID NO: 430662 - RNA, 23 nt, Human
ugagaugacauuuaaugcuaaaa

SEQ ID NO: 430663 - RNA, 19 nt, Human
ugauauuuucuuuuucuuu

SEQ ID NO: 430664 - RNA, 21 nt, Human
ugauuaaacaugucauggaga

SEQ ID NO: 430665 - RNA, 20 nt, Human
ugauuccuacccauuaccuc

SEQ ID NO: 430666 - RNA, 18 nt, Human
ugcaugugcuccuugagg

SEQ ID NO: 430667 - RNA, 25 nt, Human
ugcccggggccagguucccagagac

SEQ ID NO: 430668 - RNA, 18 nt, Human
ugccucaaucuuacgcuu

SEQ ID NO: 430669 - RNA, 20 nt, Human
ugccucaaucuuacgcuugc

SEQ ID NO: 430670 - RNA, 26 nt, Human
ugcuaaaaucaaaauaaauaaccuua

SEQ ID NO: 430671 - RNA, 19 nt, Human
ugcugggguggacagggcc

SEQ ID NO: 430672 - RNA, 23 nt, Human
ugcuuugcucuucacaaaacgua

SEQ ID NO: 430673 - RNA, 25 nt, Human
uggccgauggagacgucgguguugu

SEQ ID NO: 430674 - RNA, 21 nt, Human
uggcuugguuuggcaaaugcc

SEQ ID NO: 430675 - RNA, 21 nt, Human
ugggagcucaaagaggggccg

SEQ ID NO: 430676 - RNA, 18 nt, Human
uggugggucagguuuacu

SEQ ID NO: 430677 - RNA, 20 nt, Human
uggugugucugcaugugcuc

SEQ ID NO: 430678 - RNA, 23 nt, Human
ugucacauuuaaacacucuuggc

SEQ ID NO: 430679 - RNA, 18 nt, Human
ugucuuguguuugcuaau

SEQ ID NO: 430680 - RNA, 21 nt, Human
uuaaaagcagaaccuuuaaaa

SEQ ID NO: 430681 - RNA, 22 nt, Human
uuauugauauuuucuuuuucuu

SEQ ID NO: 430682 - RNA, 21 nt, Human
uucacaagcagcagacgcuga

SEQ ID NO: 430683 - RNA, 20 nt, Human
uucauaucaccgucaauauu

SEQ ID NO: 430684 - RNA, 26 nt, Human
uucccaguuuuuuuuuccuaugaguc

SEQ ID NO: 430685 - RNA, 22 nt, Human
uuccuaaacacaaaauuaacac

SEQ ID NO: 430686 - RNA, 20 nt, Human
uugaagcuuuaaaacagaga

SEQ ID NO: 430687 - RNA, 21 nt, Human
uugaagcuuuaaaacagagau

SEQ ID NO: 430688 - RNA, 19 nt, Human
uugcagacgguucuguggu

SEQ ID NO: 430689 - RNA, 20 nt, Human
uuuuauguggcaccauugac

SEQ ID NO: 430690 - RNA, 18 nt, Human
uuuuccuaacuucaucuu

SEQ ID NO: 430691 - RNA, 19 nt, Human
aacaugcccugcuugagaa

SEQ ID NO: 430692 - RNA, 19 nt, Human
acaaagugcuugauacuua

SEQ ID NO: 430693 - RNA, 22 nt, Human
acaaccaucugcacaaaugccc

SEQ ID NO: 430694 - RNA, 18 nt, Human
acaagaacaauccauuca

SEQ ID NO: 430695 - RNA, 21 nt, Human
acccaacacucugaccucaca

SEQ ID NO: 430696 - RNA, 22 nt, Human
acucuacccaucugagaaacaa

SEQ ID NO: 430697 - RNA, 19 nt, Human
agaccugaaugggcuaaug

SEQ ID NO: 430698 - RNA, 19 nt, Human
agcacauuccuccucaaca

SEQ ID NO: 430699 - RNA, 24 nt, Human
agguauagaagaaguuugcagcuc

SEQ ID NO: 430700 - RNA, 22 nt, Human
auccugacaaccuuaacacucg

SEQ ID NO: 430701 - RNA, 24 nt, Human
caaugaucucagccacauuucauc

SEQ ID NO: 430702 - RNA, 24 nt, Human
cacauuccuccucaacaaacaacc

SEQ ID NO: 430703 - RNA, 22 nt, Human
cagcagcacuggaaaagguaag

SEQ ID NO: 430704 - RNA, 24 nt, Human
cagcauaacaaagugcuugauacu

SEQ ID NO: 430705 - RNA, 19 nt, Human
cagcuuccugggagcagag

SEQ ID NO: 430706 - RNA, 22 nt, Human
caggaggaaagcucauguaaca

SEQ ID NO: 430707 - RNA, 25 nt, Human
cagugccaaugaucucagccacauu

SEQ ID NO: 430708 - RNA, 22 nt, Human
cauuccuccucaacaaacaacc

SEQ ID NO: 430709 - RNA, 21 nt, Human
cauuguacagcauaacaaagu

SEQ ID NO: 430710 - RNA, 22 nt, Human
ccaaaucauuucccuccugccc

SEQ ID NO: 430711 - RNA, 24 nt, Human
ccaaguuucuguaguugcccagca

SEQ ID NO: 430712 - RNA, 18 nt, Human
ccacagaauuuucauuca

SEQ ID NO: 430713 - RNA, 24 nt, Human
cucaaguucucagcuacugaaucu

SEQ ID NO: 430714 - RNA, 22 nt, Human
cugaagauucuccacagaauuu

SEQ ID NO: 430715 - RNA, 18 nt, Human
cuuccaaaacuagccagg

SEQ ID NO: 430716 - RNA, 21 nt, Human
cuucuugugucauugcugagu

SEQ ID NO: 430717 - RNA, 22 nt, Human
cuugccguuaaaugcuggguag

SEQ ID NO: 430718 - RNA, 21 nt, Human
gaaguguuuucugcugaagau

SEQ ID NO: 430719 - RNA, 24 nt, Human
gaccucacauuucuuaaucuccac

SEQ ID NO: 430720 - RNA, 26 nt, Human
gggagcagaguccaggugaccucacu

SEQ ID NO: 430721 - RNA, 18 nt, Human
uaagcacauuccuccuca

SEQ ID NO: 430722 - RNA, 26 nt, Human
uaagcacauuccuccucaacaaacaa

SEQ ID NO: 430723 - RNA, 20 nt, Human
uauccugacaaccuuaacac

SEQ ID NO: 430724 - RNA, 21 nt, Human
uccaaaucauuucccuccugc

SEQ ID NO: 430725 - RNA, 22 nt, Human
uccucggugaaggccacagagg

SEQ ID NO: 430726 - RNA, 27 nt, Human
uccuuuguaggaauauaaaguaagagu

SEQ ID NO: 430727 - RNA, 22 nt, Human
ucuacccaucugagaaacaaga

SEQ ID NO: 430728 - RNA, 20 nt, Human
ucuccacagugccaaugauc

SEQ ID NO: 430729 - RNA, 18 nt, Human
ucugcugaagauucucca

SEQ ID NO: 430730 - RNA, 20 nt, Human
ucugcugaagauucuccaca

SEQ ID NO: 430731 - RNA, 21 nt, Human
ugaagaccugaaugggcuaau

SEQ ID NO: 430732 - RNA, 19 nt, Human
ugagugagcuaagccaagu

SEQ ID NO: 430733 - RNA, 20 nt, Human
ugcacaaaugcccugcaagu

SEQ ID NO: 430734 - RNA, 21 nt, Human
ugcacaaaugcccugcaagug

SEQ ID NO: 430735 - RNA, 21 nt, Human
ugcugaguugucaucuucacc

SEQ ID NO: 430736 - RNA, 20 nt, Human
uggaaaagguaagaaaggua

SEQ ID NO: 430737 - RNA, 27 nt, Human
ugugucacucucuucuugugucauugc

SEQ ID NO: 430738 - RNA, 23 nt, Human
uuguacagcauaacaaagugcuu

SEQ ID NO: 430739 - RNA, 23 nt, Human
uuucugcugaagauucuccacag

SEQ ID NO: 430740 - RNA, 18 nt, Human
uuuguuggaaagucuuuc

SEQ ID NO: 430741 - RNA, 23 nt, Human
aaaaagaccugagugcugauucu

SEQ ID NO: 430742 - RNA, 19 nt, Human
aaaagacaacugaggcaga

SEQ ID NO: 430743 - RNA, 23 nt, Human
aaaaugguuuucagacuuuguaa

SEQ ID NO: 430744 - RNA, 22 nt, Human
aaacuuucaagaaagggacaau

SEQ ID NO: 430745 - RNA, 18 nt, Human
aaaggaauaaaaaauagg

SEQ ID NO: 430746 - RNA, 27 nt, Human
aaauagguaaccugauacuguaaugac

SEQ ID NO: 430747 - RNA, 22 nt, Human
aaaugguuuucagacuuuguaa

SEQ ID NO: 430748 - RNA, 18 nt, Human
aacacccugguaaaaaaa

SEQ ID NO: 430749 - RNA, 24 nt, Human
aaccugauacuugcccaccuguca

SEQ ID NO: 430750 - RNA, 23 nt, Human
aagaaaagacaacugaggcagaa

SEQ ID NO: 430751 - RNA, 21 nt, Human
acguucaacccuuuuguacca

SEQ ID NO: 430752 - RNA, 22 nt, Human
aggcagaauauaagccucaggg

SEQ ID NO: 430753 - RNA, 18 nt, Human
aguucugggaaccucaca

SEQ ID NO: 430754 - RNA, 21 nt, Human
augcucagacaaggggaagag

SEQ ID NO: 430755 - RNA, 19 nt, Human
auuugccuucaacacugcc

SEQ ID NO: 430756 - RNA, 20 nt, Human
caacacccugguaaaaaaaa

SEQ ID NO: 430757 - RNA, 21 nt, Human
caagaaaagacaacugaggca

SEQ ID NO: 430758 - RNA, 20 nt, Human
cacuccggcgcaaacuccgg

SEQ ID NO: 430759 - RNA, 22 nt, Human
caggcaaaauauaaauucuuga

SEQ ID NO: 430760 - RNA, 23 nt, Human
cauaaaacagcaaaccccuauga

SEQ ID NO: 430761 - RNA, 25 nt, Human
caucuuuuucuaaaagccaugacag

SEQ ID NO: 430762 - RNA, 23 nt, Human
ccaaaggaauaaaaaauagguaa

SEQ ID NO: 430763 - RNA, 25 nt, Human
ccccguuuucuucacaggcacuccg

SEQ ID NO: 430764 - RNA, 19 nt, Human
ccgcagacuucgcugucca

SEQ ID NO: 430765 - RNA, 21 nt, Human
cuccuccaaauacaacacccu

SEQ ID NO: 430766 - RNA, 25 nt, Human
cugagugcugauucuuuuuuuuuuu

SEQ ID NO: 430767 - RNA, 18 nt, Human
cuuaacaaagaugaaggc

SEQ ID NO: 430768 - RNA, 20 nt, Human
gcugauucuuuuuuuuuuuu

SEQ ID NO: 430769 - RNA, 18 nt, Human
uaaauaucauaaugguga

SEQ ID NO: 430770 - RNA, 24 nt, Human
uaaauucuugauacauuucaauuc

SEQ ID NO: 430771 - RNA, 20 nt, Human
uaacucacauaaaacagcaa

SEQ ID NO: 430772 - RNA, 26 nt, Human
uagaaaaugcuuaauaauaaaugcau

SEQ ID NO: 430773 - RNA, 22 nt, Human
ucacauaaaacagcaaaccccu

SEQ ID NO: 430774 - RNA, 23 nt, Human
ucacuuuuugauguuuaucacca

SEQ ID NO: 430775 - RNA, 24 nt, Human
ucagggcaauaccccguuuucuuc

SEQ ID NO: 430776 - RNA, 19 nt, Human
ucauuauuuggagaaguaa

SEQ ID NO: 430777 - RNA, 18 nt, Human
uccacggcagacgcagaa

SEQ ID NO: 430778 - RNA, 24 nt, Human
ucuguccuuaacaaagaugaaggc

SEQ ID NO: 430779 - RNA, 19 nt, Human
ugaggaaugcucagacaag

SEQ ID NO: 430780 - RNA, 24 nt, Human
ugaggaaugcucagacaaggggaa

SEQ ID NO: 430781 - RNA, 24 nt, Human
ugccuuuuaauauauaagggaaug

SEQ ID NO: 430782 - RNA, 26 nt, Human
uucaacacugccauccgcuacaaauu

SEQ ID NO: 430783 - RNA, 23 nt, Human
uucaagauaaauaucauaauggu

SEQ ID NO: 430784 - RNA, 23 nt, Human
uucacaggcacuccggcgcaaac

SEQ ID NO: 430785 - RNA, 22 nt, Human
uucacuuuuugauguuuaucac

SEQ ID NO: 430786 - RNA, 22 nt, Human
uucgcuguccacggcagacgca

SEQ ID NO: 430787 - RNA, 26 nt, Human
uuguaccaaaggaauaaaaaauaggu

SEQ ID NO: 430788 - RNA, 25 nt, Human
uuucuucacaggcacuccggcgcaa

SEQ ID NO: 430789 - RNA, 19 nt, Human
uuugucuucauuucugaag

SEQ ID NO: 430790 - RNA, 24 nt, Human
aauggcuuaaacccaggaggcaga

SEQ ID NO: 430791 - RNA, 19 nt, Human
acaagagugaaacuccauc

SEQ ID NO: 430792 - RNA, 20 nt, Human
acaagagugaaacuccaucu

SEQ ID NO: 430793 - RNA, 21 nt, Human
acaagagugaaacuccaucuc

SEQ ID NO: 430794 - RNA, 24 nt, Human
aggcagaagaauggcuuaaaccca

SEQ ID NO: 430795 - RNA, 27 nt, Human
aggcagaagaauggcuuaaacccagga

SEQ ID NO: 430796 - RNA, 20 nt, Human
aggcagagauugcagugaac

SEQ ID NO: 430797 - RNA, 18 nt, Human
agggcugguuaaaggcuu

SEQ ID NO: 430798 - RNA, 23 nt, Human
aucaugucauugcacuccagccu

SEQ ID NO: 430799 - RNA, 18 nt, Human
auugcacuccagccucgg

SEQ ID NO: 430800 - RNA, 21 nt, Human
auugcacuccagccucgguga

SEQ ID NO: 430801 - RNA, 21 nt, Human
caccuguaaucccagcuacuu

SEQ ID NO: 430802 - RNA, 23 nt, Human
caccuguaaucccagcuacuugg

SEQ ID NO: 430803 - RNA, 24 nt, Human
caccuguaaucccagcuacuuggg

SEQ ID NO: 430804 - RNA, 24 nt, Human
cacuccagccucggugacaagagu

SEQ ID NO: 430805 - RNA, 24 nt, Human
cagcuacuugggaggcugaggcag

SEQ ID NO: 430806 - RNA, 19 nt, Human
cauugcacuccagccucgg

SEQ ID NO: 430807 - RNA, 19 nt, Human
cauugcacuccagccucgg

SEQ ID NO: 430808 - RNA, 20 nt, Human
cauugcacuccagccucggu

SEQ ID NO: 430809 - RNA, 20 nt, Human
cauugcacuccagccucggu

SEQ ID NO: 430810 - RNA, 21 nt, Human
cauugcacuccagccucggug

SEQ ID NO: 430811 - RNA, 23 nt, Human
cauugcacuccagccucggugac

SEQ ID NO: 430812 - RNA, 24 nt, Human
cauugcacuccagccucggugaca

SEQ ID NO: 430813 - RNA, 25 nt, Human
cauugcacuccagccucggugacaa

SEQ ID NO: 430814 - RNA, 21 nt, Human
ccauauaaacucucaaauuua

SEQ ID NO: 430815 - RNA, 19 nt, Human
ccucggugacaagagugaa

SEQ ID NO: 430816 - RNA, 21 nt, Human
ccuguaaucccagcuacuugg

SEQ ID NO: 430817 - RNA, 23 nt, Human
cucaaaaaaaaaggaauugagaa

SEQ ID NO: 430818 - RNA, 21 nt, Human
cuguaaucccagcuacuuggg

SEQ ID NO: 430819 - RNA, 22 nt, Human
gcagaagaauggcuuaaaccca

SEQ ID NO: 430820 - RNA, 24 nt, Human
ggagaucaugucauugcacuccag

SEQ ID NO: 430821 - RNA, 21 nt, Human
guugggcaccuguaaucccag

SEQ ID NO: 430822 - RNA, 20 nt, Human
ucauugcacuccagccucgg

SEQ ID NO: 430823 - RNA, 21 nt, Human
ucauugcacuccagccucggu

SEQ ID NO: 430824 - RNA, 24 nt, Human
ucauugcacuccagccucggugac

SEQ ID NO: 430825 - RNA, 22 nt, Human
ucggugacaagagugaaacucc

SEQ ID NO: 430826 - RNA, 24 nt, Human
ugaggcagaagaauggcuuaaacc

SEQ ID NO: 430827 - RNA, 20 nt, Human
ugaggcagaagaauggcuuc

SEQ ID NO: 430828 - RNA, 25 nt, Human
ugcacuccagccucggugacaagag

SEQ ID NO: 430829 - RNA, 24 nt, Human
ugggaggcugaggcagaagaaugg

SEQ ID NO: 430830 - RNA, 25 nt, Human
ugggaggcugaggcagaagaauggc

SEQ ID NO: 430831 - RNA, 24 nt, Human
ugguuaaaggcuuucccacauuca

SEQ ID NO: 430832 - RNA, 21 nt, Human
uguugggcaccuguaauccca

SEQ ID NO: 430833 - RNA, 22 nt, Human
uguugggcaccuguaaucccag

SEQ ID NO: 430834 - RNA, 18 nt, Human
uugggaggcugaggcaga

SEQ ID NO: 430835 - RNA, 23 nt, Human
aaaccaauuuuaaacaaaaguaa

SEQ ID NO: 430836 - RNA, 26 nt, Human
aaaccaauuuuaaacaaaaguaauau

SEQ ID NO: 430837 - RNA, 18 nt, Human
aacauuauaccugcuacu

SEQ ID NO: 430838 - RNA, 21 nt, Human
aauaaaauaugaaucaaaacc

SEQ ID NO: 430839 - RNA, 18 nt, Human
acaucaaaaggacaccug

SEQ ID NO: 430840 - RNA, 23 nt, Human
accaaccuaagugcccaucaacc

SEQ ID NO: 430841 - RNA, 21 nt, Human
acugagugaagacuuuauugc

SEQ ID NO: 430842 - RNA, 23 nt, Human
aggaauggaaaaccaaauaccgu

SEQ ID NO: 430843 - RNA, 19 nt, Human
auggguguggugaaaagaa

SEQ ID NO: 430844 - RNA, 19 nt, Human
caccauggaauacuauuca

SEQ ID NO: 430845 - RNA, 21 nt, Human
caccauggaauacuauucagc

SEQ ID NO: 430846 - RNA, 18 nt, Human
cagacuccaaauggggag

SEQ ID NO: 430847 - RNA, 26 nt, Human
cagcacaauucacaauuucaaagaca

SEQ ID NO: 430848 - RNA, 20 nt, Human
cauuauaccugcuacucuuc

SEQ ID NO: 430849 - RNA, 21 nt, Human
ccauguaaccaaaaaccagua

SEQ ID NO: 430850 - RNA, 23 nt, Human
cucagacuucaccauuagacaau

SEQ ID NO: 430851 - RNA, 21 nt, Human
cucaggaauggaaaaccaaau

SEQ ID NO: 430852 - RNA, 22 nt, Human
cucaggaauggaaaaccaaaua

SEQ ID NO: 430853 - RNA, 18 nt, Human
gaaaaacaauagauguug

SEQ ID NO: 430854 - RNA, 24 nt, Human
ggaaaagaaguccuuacaucaaaa

SEQ ID NO: 430855 - RNA, 18 nt, Human
ggccauggcaggaaacuc

SEQ ID NO: 430856 - RNA, 18 nt, Human
guggaucuaccauuugau

SEQ ID NO: 430857 - RNA, 23 nt, Human
guggaucuaccauuugauccagc

SEQ ID NO: 430858 - RNA, 18 nt, Human
uaaaaucucagacuucac

SEQ ID NO: 430859 - RNA, 21 nt, Human
uaaccaaaaaccaguauauac

SEQ ID NO: 430860 - RNA, 18 nt, Human
uacagcacaauucacaau

SEQ ID NO: 430861 - RNA, 30 nt, Human
uagugaauuuccuaaucagucuaaaaucuu

SEQ ID NO: 430862 - RNA, 21 nt, Human
uaugauacaaacauuauaccu

SEQ ID NO: 430863 - RNA, 27 nt, Human
uauuacagcacaauucacaauuucaaa

SEQ ID NO: 430864 - RNA, 22 nt, Human
ucacaauuucaaagacauggaa

SEQ ID NO: 430865 - RNA, 23 nt, Human
ucacaauuucaaagacauggaac

SEQ ID NO: 430866 - RNA, 20 nt, Human
uccauguaaccaaaaaccaa

SEQ ID NO: 430867 - RNA, 23 nt, Human
ucccacuacuaucuacccaaagg

SEQ ID NO: 430868 - RNA, 19 nt, Human
ucuaaagaacuaaaagugg

SEQ ID NO: 430869 - RNA, 22 nt, Human
ucucuaaagaacuaaaagugga

SEQ ID NO: 430870 - RNA, 21 nt, Human
ugaaaagaaacgccuauacac

SEQ ID NO: 430871 - RNA, 21 nt, Human
ugaggacaagugaagccuuug

SEQ ID NO: 430872 - RNA, 21 nt, Human
ugauagaaauaaaagacgaaa

SEQ ID NO: 430873 - RNA, 20 nt, Human
ugcagcaacuuggauggagc

SEQ ID NO: 430874 - RNA, 20 nt, Human
ugcagcaacuuggauggagc

SEQ ID NO: 430875 - RNA, 19 nt, Human
uggaaccaaccuaagugcc

SEQ ID NO: 430876 - RNA, 19 nt, Human
uggaauacuauucagccau

SEQ ID NO: 430877 - RNA, 22 nt, Human
uggagauucucuaaagaacuaa

SEQ ID NO: 430878 - RNA, 20 nt, Human
uggauaaagaaaauauggua

SEQ ID NO: 430879 - RNA, 21 nt, Human
uggggaggguggaagguaggg

SEQ ID NO: 430880 - RNA, 25 nt, Human
uguaaccaaaaaccaguauauacuu

SEQ ID NO: 430881 - RNA, 24 nt, Human
uguggugaaaagaaacgccuauac

SEQ ID NO: 430882 - RNA, 21 nt, Human
uucaaagacauggaaccaacc

SEQ ID NO: 430883 - RNA, 24 nt, Human
uucaaagacauggaaccaaccuaa

SEQ ID NO: 430884 - RNA, 24 nt, Human
uuccuaaucagucuaaaaucuugc

SEQ ID NO: 430885 - RNA, 23 nt, Human
uucuaagugaaguaacucaggaa

SEQ ID NO: 430886 - RNA, 24 nt, Human
uugcagcaacuuggauggagcugg

SEQ ID NO: 430887 - RNA, 21 nt, Human
aaacaugguuauugaaaauac

SEQ ID NO: 430888 - RNA, 20 nt, Human
aguauguacacauauaaacu

SEQ ID NO: 430889 - RNA, 23 nt, Human
ccugcuccagaaccacccaggga

SEQ ID NO: 430890 - RNA, 20 nt, Human
cugaccaugguguguuccuu

SEQ ID NO: 430891 - RNA, 18 nt, Human
cugauaaggugccuccuc

SEQ ID NO: 430892 - RNA, 19 nt, Human
uaagugucaaguucuccag

SEQ ID NO: 430893 - RNA, 21 nt, Human
uaagugucaaguucuccagca

SEQ ID NO: 430894 - RNA, 23 nt, Human
ucaucaagaagaccccauuccuu

SEQ ID NO: 430895 - RNA, 18 nt, Human
uccucauccccugcucca

SEQ ID NO: 430896 - RNA, 21 nt, Human
uccuugguguucaaccaagug

SEQ ID NO: 430897 - RNA, 22 nt, Human
ugcagggacacuucucaguccg

SEQ ID NO: 430898 - RNA, 26 nt, Human
uguacacauauaaacuuauuuguaua

SEQ ID NO: 430899 - RNA, 25 nt, Human
aaauguugaggauuuguuaaaagcc

SEQ ID NO: 430900 - RNA, 18 nt, Human
aagcacugugacaucauu

SEQ ID NO: 430901 - RNA, 22 nt, Human
aggaacaguuaaaagcuuugac

SEQ ID NO: 430902 - RNA, 19 nt, Human
aggcuaugccacauucauc

SEQ ID NO: 430903 - RNA, 24 nt, Human
aguuucgcuccaguaugaaacauc

SEQ ID NO: 430904 - RNA, 24 nt, Human
auauuuguaggcuuuaucuuccac

SEQ ID NO: 430905 - RNA, 19 nt, Human
cacugugacaucauucagg

SEQ ID NO: 430906 - RNA, 27 nt, Human
caucuuauaucuguuaagaauugagga

SEQ ID NO: 430907 - RNA, 21 nt, Human
ccaauaccugcaggucacagg

SEQ ID NO: 430908 - RNA, 18 nt, Human
ccacagaggcugggcccc

SEQ ID NO: 430909 - RNA, 21 nt, Human
cugcaggucacagggccacag

SEQ ID NO: 430910 - RNA, 22 nt, Human
ggccacguucuucacauuugua

SEQ ID NO: 430911 - RNA, 20 nt, Human
uaccugcaggucacagggcc

SEQ ID NO: 430912 - RNA, 22 nt, Human
uaguaaggauugaggaacaguu

SEQ ID NO: 430913 - RNA, 18 nt, Human
ucccaauaccugcagguc

SEQ ID NO: 430914 - RNA, 21 nt, Human
ucccuuauguuuaguaaggau

SEQ ID NO: 430915 - RNA, 21 nt, Human
ugccacauucaucacauuuca

SEQ ID NO: 430916 - RNA, 20 nt, Human
ugggaagaggcuaugccaca

SEQ ID NO: 430917 - RNA, 22 nt, Human
ugucacauucuucauauuugua

SEQ ID NO: 430918 - RNA, 25 nt, Human
uguccaguauaaauuauguguaaua

SEQ ID NO: 430919 - RNA, 20 nt, Human
uguuuaguaagaguugagaa

SEQ ID NO: 430920 - RNA, 22 nt, Human
uguuuaguaaggauugaggaac

SEQ ID NO: 430921 - RNA, 21 nt, Human
uucauauuuguaggcuuuauc

SEQ ID NO: 430922 - RNA, 20 nt, Human
uuccaggaggaccuggcguc

SEQ ID NO: 430923 - RNA, 23 nt, Human
uucuucauauuuguaggcuuuau

SEQ ID NO: 430924 - RNA, 21 nt, Human
uugacacauucuucacauuug

SEQ ID NO: 430925 - RNA, 24 nt, Human
uuguaggcuuuaucuuccacagug

SEQ ID NO: 430926 - RNA, 22 nt, Human
uuuguaggguuuucuauuauga

SEQ ID NO: 430927 - RNA, 20 nt, Human
aaaaaacaacuuuauacucc

SEQ ID NO: 430928 - RNA, 21 nt, Human
aaaaacaacuuuauacuccac

SEQ ID NO: 430929 - RNA, 20 nt, Human
aaauaugguucuucauaacc

SEQ ID NO: 430930 - RNA, 20 nt, Human
aacacacagaucagagaagc

SEQ ID NO: 430931 - RNA, 21 nt, Human
aacugcaaaauauaauaaacg

SEQ ID NO: 430932 - RNA, 19 nt, Human
aagaccuucucgcacucac

SEQ ID NO: 430933 - RNA, 21 nt, Human
aagacucuguucccugcguuu

SEQ ID NO: 430934 - RNA, 22 nt, Human
aauccccagcacgaagcugucc

SEQ ID NO: 430935 - RNA, 19 nt, Human
acucucaagcucaucuuga

SEQ ID NO: 430936 - RNA, 24 nt, Human
agacaaccucccggucuggguacc

SEQ ID NO: 430937 - RNA, 24 nt, Human
agacacuaccacaggaagcacccc

SEQ ID NO: 430938 - RNA, 18 nt, Human
agagaaaacaggggugcu

SEQ ID NO: 430939 - RNA, 22 nt, Human
agagaagcagguucuaaaggga

SEQ ID NO: 430940 - RNA, 19 nt, Human
agauuuguaacuuauuucu

SEQ ID NO: 430941 - RNA, 18 nt, Human
agcaggaggcugaucugg

SEQ ID NO: 430942 - RNA, 22 nt, Human
aggagauaggacuuacuccuaa

SEQ ID NO: 430943 - RNA, 22 nt, Human
agguauuucuccagagaaaaca

SEQ ID NO: 430944 - RNA, 24 nt, Human
auagaacaaguuacauuaaaaaau

SEQ ID NO: 430945 - RNA, 19 nt, Human
auccauggaucuucuccuu

SEQ ID NO: 430946 - RNA, 19 nt, Human
auccgaagucuccugaaca

SEQ ID NO: 430947 - RNA, 18 nt, Human
augaauuacagacucaaa

SEQ ID NO: 430948 - RNA, 22 nt, Human
auggaacugcaaaauauaauaa

SEQ ID NO: 430949 - RNA, 19 nt, Human
caaaugaauuacagacuca

SEQ ID NO: 430950 - RNA, 19 nt, Human
caagucucuggucugccca

SEQ ID NO: 430951 - RNA, 18 nt, Human
cacagaucagagaagcag

SEQ ID NO: 430952 - RNA, 22 nt, Human
cacuaccacaggaagcacccca

SEQ ID NO: 430953 - RNA, 19 nt, Human
caggugcgggaccagggcc

SEQ ID NO: 430954 - RNA, 18 nt, Human
cauacgguuucacuccug

SEQ ID NO: 430955 - RNA, 20 nt, Human
ccacgcccacguucgcgcgc

SEQ ID NO: 430956 - RNA, 19 nt, Human
ccauuauuuucaucuacaa

SEQ ID NO: 430957 - RNA, 19 nt, Human
cccaacacacuacaagcau

SEQ ID NO: 430958 - RNA, 19 nt, Human
ccggcuccucagcucucgc

SEQ ID NO: 430959 - RNA, 21 nt, Human
ccucagcucucgcccaacaca

SEQ ID NO: 430960 - RNA, 23 nt, Human
ccuccugcuuguaaauccugucu

SEQ ID NO: 430961 - RNA, 19 nt, Human
cgugacuagacaaccuccc

SEQ ID NO: 430962 - RNA, 21 nt, Human
cugcggagagaccgugaggga

SEQ ID NO: 430963 - RNA, 20 nt, Human
cugggacaagaaugaaugag

SEQ ID NO: 430964 - RNA, 22 nt, Human
cuguccggaaacugguggccau

SEQ ID NO: 430965 - RNA, 24 nt, Human
cuuggcacugaaggcucuuucaca

SEQ ID NO: 430966 - RNA, 21 nt, Human
cuuguaaucaauuagccagaa

SEQ ID NO: 430967 - RNA, 23 nt, Human
gaaacacacagaucagagaagca

SEQ ID NO: 430968 - RNA, 19 nt, Human
gaacggauaccugaaagac

SEQ ID NO: 430969 - RNA, 28 nt, Human
gacucuguucccugcguuuugguugacc

SEQ ID NO: 430970 - RNA, 18 nt, Human
gagaagcagguucuaaag

SEQ ID NO: 430971 - RNA, 21 nt, Human
gagaggggagguauuucucca

SEQ ID NO: 430972 - RNA, 21 nt, Human
gccagaaugaauggauguucu

SEQ ID NO: 430973 - RNA, 20 nt, Human
gcccgaagacaggugcggga

SEQ ID NO: 430974 - RNA, 20 nt, Human
gccugcgggggcaggacccg

SEQ ID NO: 430975 - RNA, 22 nt, Human
gcugcggagagaccgugaggga

SEQ ID NO: 430976 - RNA, 19 nt, Human
ggcuccucagcucucgccc

SEQ ID NO: 430977 - RNA, 21 nt, Human
ggucuggguaccaggagucgc

SEQ ID NO: 430978 - RNA, 20 nt, Human
guaauuuuagggccuccugc

SEQ ID NO: 430979 - RNA, 21 nt, Human
gucucucuccuguaugaauuc

SEQ ID NO: 430980 - RNA, 18 nt, Human
uaaaaugcucaccuguag

SEQ ID NO: 430981 - RNA, 21 nt, Human
uaaaaugcucaccuguagcua

SEQ ID NO: 430982 - RNA, 19 nt, Human
uaaagggaucguauccaca

SEQ ID NO: 430983 - RNA, 18 nt, Human
uaagucuucccaacacac

SEQ ID NO: 430984 - RNA, 24 nt, Human
uaccaagauuuuauuuuacaaaaa

SEQ ID NO: 430985 - RNA, 18 nt, Human
uaccacaggaagcacccc

SEQ ID NO: 430986 - RNA, 19 nt, Human
uaccacaggaagcacccca

SEQ ID NO: 430987 - RNA, 21 nt, Human
uaccccacugauaucagguua

SEQ ID NO: 430988 - RNA, 22 nt, Human
uauauagauagauagaacaagu

SEQ ID NO: 430989 - RNA, 21 nt, Human
ucacugcauuuaugggguuuc

SEQ ID NO: 430990 - RNA, 21 nt, Human
ucagauuaagucuucccaaca

SEQ ID NO: 430991 - RNA, 24 nt, Human
uccagagaaaacaggggugcucau

SEQ ID NO: 430992 - RNA, 20 nt, Human
ucccacauucacugcagcca

SEQ ID NO: 430993 - RNA, 22 nt, Human
ucccacauucacugcagccaua

SEQ ID NO: 430994 - RNA, 20 nt, Human
uccuuguuccaacuugaaga

SEQ ID NO: 430995 - RNA, 18 nt, Human
ucgcacggauggauuugu

SEQ ID NO: 430996 - RNA, 21 nt, Human
ucgcugcauucauacgguuuc

SEQ ID NO: 430997 - RNA, 26 nt, Human
ucuccagagaaaacaggggugcucau

SEQ ID NO: 430998 - RNA, 21 nt, Human
ucuccagagaaaacagggguu

SEQ ID NO: 430999 - RNA, 19 nt, Human
ucuccuguaugaauucuga

SEQ ID NO: 431000 - RNA, 19 nt, Human
ucucugaugagcauuaagg

SEQ ID NO: 431001 - RNA, 21 nt, Human
ucugaaaaagagauuaccauu

SEQ ID NO: 431002 - RNA, 19 nt, Human
ucugagauguacaaugagc

SEQ ID NO: 431003 - RNA, 24 nt, Human
ucuuucacauuuacugcauucaua

SEQ ID NO: 431004 - RNA, 21 nt, Human
ugaaaaagaaaucaaaagaua

SEQ ID NO: 431005 - RNA, 25 nt, Human
ugaaagacacuaccacaggaagcac

SEQ ID NO: 431006 - RNA, 18 nt, Human
ugaaugacaauaaucccc

SEQ ID NO: 431007 - RNA, 19 nt, Human
ugaaugacaauaaucccca

SEQ ID NO: 431008 - RNA, 22 nt, Human
ugaaugacaauaauccccagca

SEQ ID NO: 431009 - RNA, 21 nt, Human
ugacuuggcacugaaggcucu

SEQ ID NO: 431010 - RNA, 20 nt, Human
uggaacugcaaaauauaaua

SEQ ID NO: 431011 - RNA, 21 nt, Human
uggaaugugacuuuccaugga

SEQ ID NO: 431012 - RNA, 18 nt, Human
uggacaacaggcauggaa

SEQ ID NO: 431013 - RNA, 24 nt, Human
uggacagcucugccuggaaauuuu

SEQ ID NO: 431014 - RNA, 18 nt, Human
ugggacaagaaugaauga

SEQ ID NO: 431015 - RNA, 23 nt, Human
ugggacaagaaugaaugaguucc

SEQ ID NO: 431016 - RNA, 21 nt, Human
uggguaaaaugcucaccugua

SEQ ID NO: 431017 - RNA, 19 nt, Human
ugguaccauucuucccagc

SEQ ID NO: 431018 - RNA, 23 nt, Human
uggucaagucucuggucugccca

SEQ ID NO: 431019 - RNA, 20 nt, Human
uguagcuaguggaacggaua

SEQ ID NO: 431020 - RNA, 24 nt, Human
uguuauagagucucugucuugaag

SEQ ID NO: 431021 - RNA, 20 nt, Human
uguucucaacagaauucugg

SEQ ID NO: 431022 - RNA, 23 nt, Human
uguucucaacagaauucugggac

SEQ ID NO: 431023 - RNA, 24 nt, Human
uucauaaccaugaaacuuaucagg

SEQ ID NO: 431024 - RNA, 21 nt, Human
uugaugcuuaagaaaauaugg

SEQ ID NO: 431025 - RNA, 24 nt, Human
uuucccacauucacugcagccaua

SEQ ID NO: 431026 - RNA, 26 nt, Human
aaaaacacaaaaaggagccugggaaa

SEQ ID NO: 431027 - RNA, 26 nt, Human
aaagggaggcaguuacagagggggcu

SEQ ID NO: 431028 - RNA, 21 nt, Human
aacacagaaaccaaggggaca

SEQ ID NO: 431029 - RNA, 19 nt, Human
aacccaaagccaacaggau

SEQ ID NO: 431030 - RNA, 25 nt, Human
aacccagccucaacccaagucagaa

SEQ ID NO: 431031 - RNA, 24 nt, Human
aagcauaaagaaaacgggcaaggu

SEQ ID NO: 431032 - RNA, 23 nt, Human
aagccaggguuccuagagaaggc

SEQ ID NO: 431033 - RNA, 19 nt, Human
aaggagccugggaaacagc

SEQ ID NO: 431034 - RNA, 22 nt, Human
aauuguuuucugggaccuccaa

SEQ ID NO: 431035 - RNA, 24 nt, Human
acaaaaaggagccugggaaacagc

SEQ ID NO: 431036 - RNA, 21 nt, Human
acaacaggagucugcuccccg

SEQ ID NO: 431037 - RNA, 23 nt, Human
accacagaucccauccugcauga

SEQ ID NO: 431038 - RNA, 20 nt, Human
accagagcuauuaacacucc

SEQ ID NO: 431039 - RNA, 23 nt, Human
accagagcuauuaacacuccacc

SEQ ID NO: 431040 - RNA, 19 nt, Human
acccagccucaacccaagu

SEQ ID NO: 431041 - RNA, 19 nt, Human
acucugaagcauaaagaaa

SEQ ID NO: 431042 - RNA, 18 nt, Human
agaagggagugggcacag

SEQ ID NO: 431043 - RNA, 18 nt, Human
agagacaaacacagaaac

SEQ ID NO: 431044 - RNA, 23 nt, Human
agagagacaaacacagaaaccaa

SEQ ID NO: 431045 - RNA, 24 nt, Human
agagagacaaacacagaaaccaag

SEQ ID NO: 431046 - RNA, 18 nt, Human
aggagccugggaaacagc

SEQ ID NO: 431047 - RNA, 20 nt, Human
aggcagggaaugggugagcg

SEQ ID NO: 431048 - RNA, 25 nt, Human
aggcauuuggaagauuuuaaaaacg

SEQ ID NO: 431049 - RNA, 22 nt, Human
aggcuacaagccuagaacugca

SEQ ID NO: 431050 - RNA, 23 nt, Human
agggagugggcacagggcagaga

SEQ ID NO: 431051 - RNA, 19 nt, Human
agggcagagaaggcagcug

SEQ ID NO: 431052 - RNA, 18 nt, Human
caaccuaagauggcagag

SEQ ID NO: 431053 - RNA, 24 nt, Human
caagccuagaacugcagacagcga

SEQ ID NO: 431054 - RNA, 24 nt, Human
cacaaaaaggagccugggaaacag

SEQ ID NO: 431055 - RNA, 22 nt, Human
cacagcuccucgccuguccuuu

SEQ ID NO: 431056 - RNA, 28 nt, Human
cagacagcgacggccccgcgcuccuucu

SEQ ID NO: 431057 - RNA, 26 nt, Human
cagagucuggacccagaaggaggggu

SEQ ID NO: 431058 - RNA, 25 nt, Human
cagcaaagucaacagggaaagaaag

SEQ ID NO: 431059 - RNA, 18 nt, Human
cagccucaacccaaguca

SEQ ID NO: 431060 - RNA, 18 nt, Human
caggaaacccaaagccaa

SEQ ID NO: 431061 - RNA, 21 nt, Human
caguggcggcaggcccugcgc

SEQ ID NO: 431062 - RNA, 24 nt, Human
ccaaagccaacaggaucaccagag

SEQ ID NO: 431063 - RNA, 25 nt, Human
ccaaagccaacaggaucaccagagc

SEQ ID NO: 431064 - RNA, 23 nt, Human
ccaaugcaagauggggaagagag

SEQ ID NO: 431065 - RNA, 22 nt, Human
ccagccucaacccaagucagaa

SEQ ID NO: 431066 - RNA, 21 nt, Human
ccucaacccaagucagaaggu

SEQ ID NO: 431067 - RNA, 18 nt, Human
ccuuuuggcauggugcug

SEQ ID NO: 431068 - RNA, 19 nt, Human
ccuuuuggcauggugcugg

SEQ ID NO: 431069 - RNA, 22 nt, Human
cgccucagaacaauauauacaa

SEQ ID NO: 431070 - RNA, 18 nt, Human
cuagagaaggcagggaau

SEQ ID NO: 431071 - RNA, 20 nt, Human
gaagaguagagaagggagug

SEQ ID NO: 431072 - RNA, 23 nt, Human
gaagguaguuuuugccuugggag

SEQ ID NO: 431073 - RNA, 18 nt, Human
gacaggagucugcacaac

SEQ ID NO: 431074 - RNA, 18 nt, Human
gcacagggcagagaaggc

SEQ ID NO: 431075 - RNA, 21 nt, Human
gcaguggcggcaggcccugcg

SEQ ID NO: 431076 - RNA, 22 nt, Human
gcauggcucacugaagggacag

SEQ ID NO: 431077 - RNA, 21 nt, Human
gcggcaggcccugcgcccaca

SEQ ID NO: 431078 - RNA, 19 nt, Human
gcuucucacuacaacacaa

SEQ ID NO: 431079 - RNA, 25 nt, Human
ggaaacagcaaagucaaccgguacc

SEQ ID NO: 431080 - RNA, 21 nt, Human
ggaaacccaaagccaacagga

SEQ ID NO: 431081 - RNA, 20 nt, Human
ggcagagaaggcagcugggu

SEQ ID NO: 431082 - RNA, 25 nt, Human
gggaagaguagagaagggagugggc

SEQ ID NO: 431083 - RNA, 20 nt, Human
gggcagagaaggcagcuggg

SEQ ID NO: 431084 - RNA, 25 nt, Human
ggggaacaauagaggggaacccagc

SEQ ID NO: 431085 - RNA, 20 nt, Human
ggggaacccagccucaaccc

SEQ ID NO: 431086 - RNA, 20 nt, Human
gguggugagauggugccaac

SEQ ID NO: 431087 - RNA, 22 nt, Human
uaaacaguggcuaacuggugac

SEQ ID NO: 431088 - RNA, 18 nt, Human
uaaagaaaacgggcaagc

SEQ ID NO: 431089 - RNA, 18 nt, Human
uaacuggugacaguuaua

SEQ ID NO: 431090 - RNA, 22 nt, Human
uaagauggcagagagacaaaca

SEQ ID NO: 431091 - RNA, 18 nt, Human
uagucauucucugccucu

SEQ ID NO: 431092 - RNA, 22 nt, Human
ucccauaggcuuggccuagcuc

SEQ ID NO: 431093 - RNA, 21 nt, Human
uccccguacuuagucauucuc

SEQ ID NO: 431094 - RNA, 20 nt, Human
uccucgccuguccuuugacc

SEQ ID NO: 431095 - RNA, 23 nt, Human
uccugcaugacucaaggucccau

SEQ ID NO: 431096 - RNA, 19 nt, Human
ucucacuacaacacaaggg

SEQ ID NO: 431097 - RNA, 21 nt, Human
ucucacuacaacacaaggguu

SEQ ID NO: 431098 - RNA, 22 nt, Human
ucugcacaacaggagucugcuc

SEQ ID NO: 431099 - RNA, 22 nt, Human
ugaaacaaacaauuucagagac

SEQ ID NO: 431100 - RNA, 18 nt, Human
ugaagcauaaagaaaacg

SEQ ID NO: 431101 - RNA, 23 nt, Human
ugaagcauaaagaaaacgggcaa

SEQ ID NO: 431102 - RNA, 20 nt, Human
ugaccacagaucccauccug

SEQ ID NO: 431103 - RNA, 22 nt, Human
ugagggacauggccacaggaca

SEQ ID NO: 431104 - RNA, 20 nt, Human
ugcuggggaagaguagagaa

SEQ ID NO: 431105 - RNA, 19 nt, Human
uggcauggugcuggggaag

SEQ ID NO: 431106 - RNA, 25 nt, Human
uggccacaggacagacauugauggu

SEQ ID NO: 431107 - RNA, 21 nt, Human
uggcuaacuggugacaguuau

SEQ ID NO: 431108 - RNA, 19 nt, Human
uggggaagaguagagaagg

SEQ ID NO: 431109 - RNA, 26 nt, Human
uggguacccccuuugccagaagcuaa

SEQ ID NO: 431110 - RNA, 22 nt, Human
ugggucaggaaacccaaagcca

SEQ ID NO: 431111 - RNA, 20 nt, Human
ugggugagcggaaaggagca

SEQ ID NO: 431112 - RNA, 22 nt, Human
ugguuccugggccugucacccu

SEQ ID NO: 431113 - RNA, 23 nt, Human
ugucaagugguacggaagaagau

SEQ ID NO: 431114 - RNA, 21 nt, Human
uuuaaacaguggcuaacuggu

SEQ ID NO: 431115 - RNA, 25 nt, Human
uuucagagacagaagguuagucguu

SEQ ID NO: 431116 - RNA, 24 nt, Human
aaaaaaaaaaaaaaaggucaagag

SEQ ID NO: 431117 - RNA, 21 nt, Human
aaaaaagacaagacugggggg

SEQ ID NO: 431118 - RNA, 20 nt, Human
aaaaauaauuccugagauaa

SEQ ID NO: 431119 - RNA, 20 nt, Human
aaacaaaaagugauagaagg

SEQ ID NO: 431120 - RNA, 24 nt, Human
aaacaacugccaacucugaaucuu

SEQ ID NO: 431121 - RNA, 21 nt, Human
aaacucacugcacaaacucaa

SEQ ID NO: 431122 - RNA, 22 nt, Human
aaagaaacugacuucauaagua

SEQ ID NO: 431123 - RNA, 21 nt, Human
aaagagcaacacacuuccaca

SEQ ID NO: 431124 - RNA, 19 nt, Human
aaagugcuaggauuacagg

SEQ ID NO: 431125 - RNA, 19 nt, Human
aacauggugaaaccccguc

SEQ ID NO: 431126 - RNA, 20 nt, Human
aacauggugaaaccccgucu

SEQ ID NO: 431127 - RNA, 21 nt, Human
aacauggugaaaccccgucuc

SEQ ID NO: 431128 - RNA, 20 nt, Human
aaccaccagagaaccaugac

SEQ ID NO: 431129 - RNA, 21 nt, Human
aacugacuucauaaguaauga

SEQ ID NO: 431130 - RNA, 23 nt, Human
aagaaugaacaauggaaugggua

SEQ ID NO: 431131 - RNA, 23 nt, Human
aagacaaaagccugaauguuaac

SEQ ID NO: 431132 - RNA, 25 nt, Human
aagacuaguaaacaaccccaaauaa

SEQ ID NO: 431133 - RNA, 23 nt, Human
aagaucgugccacugcacuccag

SEQ ID NO: 431134 - RNA, 20 nt, Human
aagauggugaaaccccgucu

SEQ ID NO: 431135 - RNA, 21 nt, Human
aagcauggccugaguauaugc

SEQ ID NO: 431136 - RNA, 23 nt, Human
aagcugaggcaguuaauugcuug

SEQ ID NO: 431137 - RNA, 20 nt, Human
aaggaaacauaaagacaucu

SEQ ID NO: 431138 - RNA, 18 nt, Human
aagggcgggggaggagag

SEQ ID NO: 431139 - RNA, 23 nt, Human
aagguuggcggaucacaagguca

SEQ ID NO: 431140 - RNA, 20 nt, Human
aaucagugaggaccauggaa

SEQ ID NO: 431141 - RNA, 22 nt, Human
aaucauuuaagggcacacuuaa

SEQ ID NO: 431142 - RNA, 24 nt, Human
aaucgcuugaacccaggaggcgga

SEQ ID NO: 431143 - RNA, 24 nt, Human
aauugcuugaacccgggaggcaga

SEQ ID NO: 431144 - RNA, 27 nt, Human
acaaacaaaaaagcacccuaggaugca

SEQ ID NO: 431145 - RNA, 22 nt, Human
acaaguaauauucagcaacaga

SEQ ID NO: 431146 - RNA, 20 nt, Human
acacaaacaaaaaagcaccc

SEQ ID NO: 431147 - RNA, 24 nt, Human
acacacacacaaacaaaaaagcac

SEQ ID NO: 431148 - RNA, 23 nt, Human
acagaacagagagauacaucucu

SEQ ID NO: 431149 - RNA, 20 nt, Human
acagagugagacucugucuc

SEQ ID NO: 431150 - RNA, 24 nt, Human
acagagugagacuuggucucaaaa

SEQ ID NO: 431151 - RNA, 24 nt, Human
acagcacuccagcgugggugacag

SEQ ID NO: 431152 - RNA, 18 nt, Human
acaggguuuugccauguu

SEQ ID NO: 431153 - RNA, 21 nt, Human
acaggguuuugccauguuggc

SEQ ID NO: 431154 - RNA, 24 nt, Human
acaggguuuugccauguuggccag

SEQ ID NO: 431155 - RNA, 21 nt, Human
accauauggcuacaaugauga

SEQ ID NO: 431156 - RNA, 25 nt, Human
acccaaaaacuuccaugccacgcac

SEQ ID NO: 431157 - RNA, 22 nt, Human
acccacccaauggaaauuaaac

SEQ ID NO: 431158 - RNA, 24 nt, Human
accccgucucuacuaaaaauacaa

SEQ ID NO: 431159 - RNA, 24 nt, Human
accccgucucuacuaaaaauacaa

SEQ ID NO: 431160 - RNA, 19 nt, Human
acuaagaaauccaugacaa

SEQ ID NO: 431161 - RNA, 24 nt, Human
acucacugcacaaacucaacagau

SEQ ID NO: 431162 - RNA, 24 nt, Human
acuccagccugggugacagaguga

SEQ ID NO: 431163 - RNA, 24 nt, Human
acugcacuccagccugggugacag

SEQ ID NO: 431164 - RNA, 26 nt, Human
acugcacuccagccugggugacagag

SEQ ID NO: 431165 - RNA, 21 nt, Human
agaagguguacaaaagaaccc

SEQ ID NO: 431166 - RNA, 23 nt, Human
agacaaaagccugaauguuaaca

SEQ ID NO: 431167 - RNA, 21 nt, Human
agacagaaaauagacuggaaa

SEQ ID NO: 431168 - RNA, 18 nt, Human
agacaggguuuugccaug

SEQ ID NO: 431169 - RNA, 24 nt, Human
agagcugggacagaggagccccgg

SEQ ID NO: 431170 - RNA, 19 nt, Human
agaggagccccgggcggcc

SEQ ID NO: 431171 - RNA, 22 nt, Human
agaggucgacaggccaagguug

SEQ ID NO: 431172 - RNA, 24 nt, Human
agagguugcagagagccgagaucg

SEQ ID NO: 431173 - RNA, 24 nt, Human
agaguaaguacuauuguggaauac

SEQ ID NO: 431174 - RNA, 20 nt, Human
agagucaauucaccacaaag

SEQ ID NO: 431175 - RNA, 24 nt, Human
agcacuuuggggggccgaggcggg

SEQ ID NO: 431176 - RNA, 22 nt, Human
agccugagcaacauggugaaac

SEQ ID NO: 431177 - RNA, 24 nt, Human
agccugagcaacauggugaaaccc

SEQ ID NO: 431178 - RNA, 24 nt, Human
agccugggugacagagugagacuc

SEQ ID NO: 431179 - RNA, 24 nt, Human
agcgugggugacagagugagacuu

SEQ ID NO: 431180 - RNA, 18 nt, Human
agcuugacagaacugaug

SEQ ID NO: 431181 - RNA, 20 nt, Human
aggaguuugagaccagccug

SEQ ID NO: 431182 - RNA, 21 nt, Human
aggcagagguugcagagagcc

SEQ ID NO: 431183 - RNA, 24 nt, Human
aggcagagguugcagagagccgag

SEQ ID NO: 431184 - RNA, 23 nt, Human
aggcaggagaaucgcuugaaccc

SEQ ID NO: 431185 - RNA, 23 nt, Human
aggcaguuaauugcuugaacccg

SEQ ID NO: 431186 - RNA, 24 nt, Human
aggcggagguugcagugagccaag

SEQ ID NO: 431187 - RNA, 24 nt, Human
aggcggguggaucaugaggucaag

SEQ ID NO: 431188 - RNA, 24 nt, Human
aggcgugguggcgggcgccuguaa

SEQ ID NO: 431189 - RNA, 20 nt, Human
aggcugaggcaggagaaucg

SEQ ID NO: 431190 - RNA, 24 nt, Human
aggcugaggcaggagaaucgcuug

SEQ ID NO: 431191 - RNA, 25 nt, Human
aggcuggagugcaguggcacgaucu

SEQ ID NO: 431192 - RNA, 25 nt, Human
aggcuggagugcaguggugagaucu

SEQ ID NO: 431193 - RNA, 21 nt, Human
aggggucaggcucguacaaag

SEQ ID NO: 431194 - RNA, 23 nt, Human
aggggucaggcucguacaaaggu

SEQ ID NO: 431195 - RNA, 18 nt, Human
aggugauccacccgccuu

SEQ ID NO: 431196 - RNA, 24 nt, Human
agguuggcggaucacaaggucagg

SEQ ID NO: 431197 - RNA, 19 nt, Human
agugcagagagcuagggaa

SEQ ID NO: 431198 - RNA, 21 nt, Human
agugcaguggcacgaucucag

SEQ ID NO: 431199 - RNA, 23 nt, Human
agugcaguggcacgaucucagcu

SEQ ID NO: 431200 - RNA, 24 nt, Human
agugcaguggcacgaucucagcuc

SEQ ID NO: 431201 - RNA, 21 nt, Human
agugcaguggugagaucucag

SEQ ID NO: 431202 - RNA, 23 nt, Human
agugcaguggugagaucucagcu

SEQ ID NO: 431203 - RNA, 24 nt, Human
agugcaguggugagaucucagcuc

SEQ ID NO: 431204 - RNA, 24 nt, Human
aguggugagaucucagcucacugc

SEQ ID NO: 431205 - RNA, 18 nt, Human
aguucaaacaucaaugcc

SEQ ID NO: 431206 - RNA, 24 nt, Human
auaauguacagaacagagagauac

SEQ ID NO: 431207 - RNA, 20 nt, Human
aucacaaggucaggaguuuc

SEQ ID NO: 431208 - RNA, 21 nt, Human
aucacaaggucaggaguuuga

SEQ ID NO: 431209 - RNA, 24 nt, Human
aucgugccacugcacuccagccug

SEQ ID NO: 431210 - RNA, 20 nt, Human
auuacuauuacuuaagauag

SEQ ID NO: 431211 - RNA, 18 nt, Human
auuuuacaaacauuccau

SEQ ID NO: 431212 - RNA, 21 nt, Human
caaaaagcugggcaagcacca

SEQ ID NO: 431213 - RNA, 23 nt, Human
caaaagacgggcaucaagacaaa

SEQ ID NO: 431214 - RNA, 21 nt, Human
caaaagccugaauguuaacau

SEQ ID NO: 431215 - RNA, 18 nt, Human
caaaccaccagagaacca

SEQ ID NO: 431216 - RNA, 23 nt, Human
caaagaaacagaagguguacaaa

SEQ ID NO: 431217 - RNA, 24 nt, Human
caaagcgccauaggcuuggcagag

SEQ ID NO: 431218 - RNA, 18 nt, Human
caacacacuuccacaauc

SEQ ID NO: 431219 - RNA, 22 nt, Human
caacauggugaaaccccgucuc

SEQ ID NO: 431220 - RNA, 24 nt, Human
caacauggugaaaccccgucucua

SEQ ID NO: 431221 - RNA, 18 nt, Human
caacucagaagacugugg

SEQ ID NO: 431222 - RNA, 19 nt, Human
caagacaaaccaccagaga

SEQ ID NO: 431223 - RNA, 23 nt, Human
caagacaaaccaccagagaacca

SEQ ID NO: 431224 - RNA, 24 nt, Human
caagauggugaaaccccgucucua

SEQ ID NO: 431225 - RNA, 24 nt, Human
caauaaaaaagaacacaaaaauca

SEQ ID NO: 431226 - RNA, 23 nt, Human
cacaaaaaucauuuaagggcaca

SEQ ID NO: 431227 - RNA, 24 nt, Human
cacaaggucaggaguuugagacca

SEQ ID NO: 431228 - RNA, 24 nt, Human
cacaccuguaaccccagcacuuug

SEQ ID NO: 431229 - RNA, 19 nt, Human
cacaccuguaaucccagcu

SEQ ID NO: 431230 - RNA, 19 nt, Human
cacagcacuccagcguggg

SEQ ID NO: 431231 - RNA, 19 nt, Human
cacagcacuccagcguggg

SEQ ID NO: 431232 - RNA, 23 nt, Human
cacagcacuccagcgugggugac

SEQ ID NO: 431233 - RNA, 23 nt, Human
cacaggcacacgccaccaugccc

SEQ ID NO: 431234 - RNA, 24 nt, Human
caccacaaagacuuggcaaacccc

SEQ ID NO: 431235 - RNA, 24 nt, Human
caccaugcccggcuaauuuuugua

SEQ ID NO: 431236 - RNA, 24 nt, Human
cacccgccuuaguggucucaaagu

SEQ ID NO: 431237 - RNA, 19 nt, Human
caccuguaaccccagcacu

SEQ ID NO: 431238 - RNA, 24 nt, Human
caccuguaaccccagcacuuuggg

SEQ ID NO: 431239 - RNA, 21 nt, Human
caccuguaaucccagcuacuc

SEQ ID NO: 431240 - RNA, 24 nt, Human
caccuguaaucccagcuacucagg

SEQ ID NO: 431241 - RNA, 22 nt, Human
cacuccagccugggugacagag

SEQ ID NO: 431242 - RNA, 22 nt, Human
cacuccagccugggugacagag

SEQ ID NO: 431243 - RNA, 24 nt, Human
cacuccagccugggugacagagug

SEQ ID NO: 431244 - RNA, 22 nt, Human
cacuccagcgugggugacagag

SEQ ID NO: 431245 - RNA, 22 nt, Human
cacuccagcgugggugacagag

SEQ ID NO: 431246 - RNA, 24 nt, Human
cacuccagcgugggugacagagug

SEQ ID NO: 431247 - RNA, 21 nt, Human
cacugcaaccuccgccuccca

SEQ ID NO: 431248 - RNA, 19 nt, Human
cacugcacuccagccuggg

SEQ ID NO: 431249 - RNA, 19 nt, Human
cacugcacuccagccuggg

SEQ ID NO: 431250 - RNA, 21 nt, Human
cacugcacuccagccugggug

SEQ ID NO: 431251 - RNA, 22 nt, Human
cacugcacuccagccuggguga

SEQ ID NO: 431252 - RNA, 24 nt, Human
cacugcacuccagccugggugaca

SEQ ID NO: 431253 - RNA, 24 nt, Human
cacugcacuccagccugggugaca

SEQ ID NO: 431254 - RNA, 19 nt, Human
cacuguaaacuaaggagaa

SEQ ID NO: 431255 - RNA, 18 nt, Human
cagacccagggcgccgcc

SEQ ID NO: 431256 - RNA, 23 nt, Human
cagacgcagggccgccgccuccu

SEQ ID NO: 431257 - RNA, 21 nt, Human
cagagcugggacagaggagcc

SEQ ID NO: 431258 - RNA, 24 nt, Human
cagcacuuuggggggccgaggcgg

SEQ ID NO: 431259 - RNA, 25 nt, Human
cagcagcugggaccacaggcacacg

SEQ ID NO: 431260 - RNA, 24 nt, Human
cagcuacucaggaggcugaggcag

SEQ ID NO: 431261 - RNA, 24 nt, Human
caggguuuugccauguuggccagg

SEQ ID NO: 431262 - RNA, 18 nt, Human
caucuugcaacauagcgc

SEQ ID NO: 431263 - RNA, 24 nt, Human
cauguuggccaggcuggucucgaa

SEQ ID NO: 431264 - RNA, 23 nt, Human
cauucaguagaaaccacacuuga

SEQ ID NO: 431265 - RNA, 23 nt, Human
ccacaaagacuuggcaaaccuac

SEQ ID NO: 431266 - RNA, 33 nt, Human
ccacgcacaucacagccaaacuucugaacaccg

SEQ ID NO: 431267 - RNA, 18 nt, Human
ccacugcacuccagccug

SEQ ID NO: 431268 - RNA, 20 nt, Human
ccacugcacuccagccuggg

SEQ ID NO: 431269 - RNA, 20 nt, Human
ccacugcacuccagccuggg

SEQ ID NO: 431270 - RNA, 20 nt, Human
ccacugcacuccagccuggg

SEQ ID NO: 431271 - RNA, 21 nt, Human
ccacugcacuccagccugggu

SEQ ID NO: 431272 - RNA, 21 nt, Human
ccacugcacuccagccugggu

SEQ ID NO: 431273 - RNA, 23 nt, Human
ccacugcacuccagccuggguga

SEQ ID NO: 431274 - RNA, 24 nt, Human
ccacugcacuccagccugggugac

SEQ ID NO: 431275 - RNA, 22 nt, Human
ccaggaggcggagguugcagug

SEQ ID NO: 431276 - RNA, 19 nt, Human
ccauguuggccaggcuggu

SEQ ID NO: 431277 - RNA, 22 nt, Human
ccauguuggccaggcuggucuc

SEQ ID NO: 431278 - RNA, 23 nt, Human
ccauguuggccaggcuggucucg

SEQ ID NO: 431279 - RNA, 22 nt, Human
cccaaaaacuuccaugccacgc

SEQ ID NO: 431280 - RNA, 19 nt, Human
cccaggcuggagugcagug

SEQ ID NO: 431281 - RNA, 19 nt, Human
ccccaaauaacagaggaac

SEQ ID NO: 431282 - RNA, 23 nt, Human
ccccaccugugcccgacccuggc

SEQ ID NO: 431283 - RNA, 20 nt, Human
ccccagcacuuuggggggcc

SEQ ID NO: 431284 - RNA, 25 nt, Human
cccccaaauacacuaagaaauccau

SEQ ID NO: 431285 - RNA, 24 nt, Human
ccccccagcagcugggaccacagg

SEQ ID NO: 431286 - RNA, 23 nt, Human
ccccgggcggccugacggacccc

SEQ ID NO: 431287 - RNA, 18 nt, Human
cccuaaaaaagacaagac

SEQ ID NO: 431288 - RNA, 21 nt, Human
cccuggccgguugcccggggc

SEQ ID NO: 431289 - RNA, 21 nt, Human
ccucaggugauccacccgccu

SEQ ID NO: 431290 - RNA, 24 nt, Human
ccugagcaacauggugaaaccccg

SEQ ID NO: 431291 - RNA, 23 nt, Human
ccuggccaagauggugaaacccc

SEQ ID NO: 431292 - RNA, 24 nt, Human
ccuggccaagauggugaaaccccg

SEQ ID NO: 431293 - RNA, 18 nt, Human
ccuggccucaggugaucc

SEQ ID NO: 431294 - RNA, 22 nt, Human
ccuggccucaggugauccaccc

SEQ ID NO: 431295 - RNA, 23 nt, Human
ccuggccucaggugauccacccg

SEQ ID NO: 431296 - RNA, 22 nt, Human
ccugggugacagagugagacuc

SEQ ID NO: 431297 - RNA, 21 nt, Human
ccuguaaucccagcuacucag

SEQ ID NO: 431298 - RNA, 22 nt, Human
ccuugaaacauuucccuucccc

SEQ ID NO: 431299 - RNA, 22 nt, Human
cgacccaggaacaaacccacgg

SEQ ID NO: 431300 - RNA, 19 nt, Human
cgacuuacuacuugacuuu

SEQ ID NO: 431301 - RNA, 22 nt, Human
cgaggcggguggaucaugaggu

SEQ ID NO: 431302 - RNA, 24 nt, Human
cgaggcggguggaucaugagguca

SEQ ID NO: 431303 - RNA, 25 nt, Human
cgccuguaauccauuacuagggaag

SEQ ID NO: 431304 - RNA, 24 nt, Human
cgcucugcugcccaggcuggagug

SEQ ID NO: 431305 - RNA, 24 nt, Human
cgcucuguugcccaggcuggagug

SEQ ID NO: 431306 - RNA, 21 nt, Human
cggaucacaaggucaggaguu

SEQ ID NO: 431307 - RNA, 18 nt, Human
cuaaaaaagacaagacug

SEQ ID NO: 431308 - RNA, 19 nt, Human
cuauacgcugaaaauuuuu

SEQ ID NO: 431309 - RNA, 22 nt, Human
cucacaccuguaaccccagcac

SEQ ID NO: 431310 - RNA, 24 nt, Human
cucacaccuguaaccccagcacuu

SEQ ID NO: 431311 - RNA, 18 nt, Human
cuccccugcucgguccug

SEQ ID NO: 431312 - RNA, 25 nt, Human
cuccugccucagccccccagcagcu

SEQ ID NO: 431313 - RNA, 21 nt, Human
cucgcucuguugcccaggcug

SEQ ID NO: 431314 - RNA, 24 nt, Human
cucgcucuguugcccaggcuggag

SEQ ID NO: 431315 - RNA, 24 nt, Human
cugacggaccccaccugugcccga

SEQ ID NO: 431316 - RNA, 24 nt, Human
cugcaaccuccgccucccacguuc

SEQ ID NO: 431317 - RNA, 24 nt, Human
cugcccaggcuggagugcaguggu

SEQ ID NO: 431318 - RNA, 18 nt, Human
cuggaaaauacaaaacca

SEQ ID NO: 431319 - RNA, 21 nt, Human
cuguaaucccagcuacucagg

SEQ ID NO: 431320 - RNA, 19 nt, Human
cuguugcccaggcuggagu

SEQ ID NO: 431321 - RNA, 23 nt, Human
cuuaagcccuaaaauaucaauaa

SEQ ID NO: 431322 - RNA, 24 nt, Human
cuuuacucaauuuaaaaauuuacc

SEQ ID NO: 431323 - RNA, 19 nt, Human
gaaaaacacuuugaaugaa

SEQ ID NO: 431324 - RNA, 22 nt, Human
gaacauuuguuacucuagaaga

SEQ ID NO: 431325 - RNA, 26 nt, Human
gacagagugagacucugucucuuuaa

SEQ ID NO: 431326 - RNA, 24 nt, Human
gacagagugagacuuggucucaaa

SEQ ID NO: 431327 - RNA, 19 nt, Human
gacaggguuuugccauguu

SEQ ID NO: 431328 - RNA, 19 nt, Human
gaccgcagcuugacggcga

SEQ ID NO: 431329 - RNA, 23 nt, Human
gagaaucgcuugaacccaggagg

SEQ ID NO: 431330 - RNA, 23 nt, Human
gagguugcagugagccaagaucg

SEQ ID NO: 431331 - RNA, 21 nt, Human
gaucacaaggucaggaguuug

SEQ ID NO: 431332 - RNA, 22 nt, Human
gaucacaaggucaggaguuuga

SEQ ID NO: 431333 - RNA, 24 nt, Human
gaucacaaggucaggaguuugaga

SEQ ID NO: 431334 - RNA, 24 nt, Human
gaucaugaggucaagaguucaaga

SEQ ID NO: 431335 - RNA, 25 nt, Human
gcaaagaaacagaagguguacaaaa

SEQ ID NO: 431336 - RNA, 22 nt, Human
gcaaccuccgccucccacguuc

SEQ ID NO: 431337 - RNA, 19 nt, Human
gcaagcaccagggagcgcc

SEQ ID NO: 431338 - RNA, 21 nt, Human
gcacaacucagaagacugugg

SEQ ID NO: 431339 - RNA, 18 nt, Human
gcacaucacagccaaacu

SEQ ID NO: 431340 - RNA, 23 nt, Human
gcacuccagccugggugacagag

SEQ ID NO: 431341 - RNA, 24 nt, Human
gcacuccagcgugggugacagagu

SEQ ID NO: 431342 - RNA, 22 nt, Human
gcaggagaaucgcuugaaccca

SEQ ID NO: 431343 - RNA, 24 nt, Human
gcauacuuuuccuaaacuaacugu

SEQ ID NO: 431344 - RNA, 20 nt, Human
gccaagaucgugccacugca

SEQ ID NO: 431345 - RNA, 24 nt, Human
gccaagauggugaaaccccgucuc

SEQ ID NO: 431346 - RNA, 19 nt, Human
gccacugcacuccagccug

SEQ ID NO: 431347 - RNA, 24 nt, Human
gccacugcacuccagccuggguga

SEQ ID NO: 431348 - RNA, 20 nt, Human
gccauguuggccaggcuggu

SEQ ID NO: 431349 - RNA, 19 nt, Human
gcccaggcuggagugcagu

SEQ ID NO: 431350 - RNA, 19 nt, Human
gcccaggcuggagugcagu

SEQ ID NO: 431351 - RNA, 22 nt, Human
gcccggcuaauuuuuguauuuu

SEQ ID NO: 431352 - RNA, 18 nt, Human
gccugaaaagaugugugc

SEQ ID NO: 431353 - RNA, 23 nt, Human
gcggcgcacaccuguaaucccag

SEQ ID NO: 431354 - RNA, 25 nt, Human
gcucugcugcccaggcuggagugca

SEQ ID NO: 431355 - RNA, 25 nt, Human
gcucuguugcccaggcuggagugca

SEQ ID NO: 431356 - RNA, 19 nt, Human
gcuggagugcaguggcacg

SEQ ID NO: 431357 - RNA, 23 nt, Human
gcuggucucgaacuccuggccuc

SEQ ID NO: 431358 - RNA, 22 nt, Human
ggaaaaagaaaaaagaugagag

SEQ ID NO: 431359 - RNA, 24 nt, Human
ggaaugucaaaggaacuagaaaug

SEQ ID NO: 431360 - RNA, 22 nt, Human
ggaggcggagguugcagugagc

SEQ ID NO: 431361 - RNA, 20 nt, Human
ggagguugcagugagccaag

SEQ ID NO: 431362 - RNA, 24 nt, Human
ggagguugcagugagccaagaucg

SEQ ID NO: 431363 - RNA, 23 nt, Human
ggagucucgcucuguugcccagg

SEQ ID NO: 431364 - RNA, 20 nt, Human
ggaucacaaggucaggaguu

SEQ ID NO: 431365 - RNA, 23 nt, Human
ggaucacaaggucaggaguuuga

SEQ ID NO: 431366 - RNA, 18 nt, Human
ggccaagauggugaaacc

SEQ ID NO: 431367 - RNA, 19 nt, Human
ggccgggugcaguggcuca

SEQ ID NO: 431368 - RNA, 23 nt, Human
ggcggaucacaaggucaggaguu

SEQ ID NO: 431369 - RNA, 24 nt, Human
ggcggcgcacaccuguaaucccag

SEQ ID NO: 431370 - RNA, 22 nt, Human
ggcuacaaugaugacguaaacc

SEQ ID NO: 431371 - RNA, 24 nt, Human
ggcuggucucgaacuccuggccuc

SEQ ID NO: 431372 - RNA, 20 nt, Human
gggccgaggcggguggauca

SEQ ID NO: 431373 - RNA, 24 nt, Human
ggguguggcggcgcacaccuguaa

SEQ ID NO: 431374 - RNA, 22 nt, Human
ggguuuugccauguuggccagg

SEQ ID NO: 431375 - RNA, 22 nt, Human
gguaagcuuuaaaauaaaauga

SEQ ID NO: 431376 - RNA, 23 nt, Human
ggugcaguggcucacaccuguaa

SEQ ID NO: 431377 - RNA, 23 nt, Human
gguggaucaugaggucaagaguu

SEQ ID NO: 431378 - RNA, 18 nt, Human
gguugcccggggcuucca

SEQ ID NO: 431379 - RNA, 24 nt, Human
guaaaacaagaucugccacucaug

SEQ ID NO: 431380 - RNA, 19 nt, Human
guacaaaagaacccaccca

SEQ ID NO: 431381 - RNA, 24 nt, Human
gucucgcucugcugcccaggcugg

SEQ ID NO: 431382 - RNA, 21 nt, Human
gucucuuuaaaaaaaaaaaaa

SEQ ID NO: 431383 - RNA, 25 nt, Human
gugauccacccgccuuaguggucuc

SEQ ID NO: 431384 - RNA, 18 nt, Human
gugcaguggcucacaccu

SEQ ID NO: 431385 - RNA, 19 nt, Human
gugggugacagagugagac

SEQ ID NO: 431386 - RNA, 21 nt, Human
uaaaaaauaagcaaagaaaca

SEQ ID NO: 431387 - RNA, 21 nt, Human
uaaaaauacaaaaauuagcca

SEQ ID NO: 431388 - RNA, 18 nt, Human
uaaaaauacaaaauuagc

SEQ ID NO: 431389 - RNA, 19 nt, Human
uaaaaauacaaaauuagcu

SEQ ID NO: 431390 - RNA, 21 nt, Human
uaaaacaagaucugccacuca

SEQ ID NO: 431391 - RNA, 21 nt, Human
uaaacaaccccaaauaacaga

SEQ ID NO: 431392 - RNA, 21 nt, Human
uaaacuaaggagaaagaugca

SEQ ID NO: 431393 - RNA, 21 nt, Human
uaaaggaaccuaauggaagua

SEQ ID NO: 431394 - RNA, 24 nt, Human
uaaaguuugcauacuuuuccuaaa

SEQ ID NO: 431395 - RNA, 18 nt, Human
uaaauguacauacaagca

SEQ ID NO: 431396 - RNA, 18 nt, Human
uaagaggccuacuccugc

SEQ ID NO: 431397 - RNA, 19 nt, Human
uaagggcacacuuaagccc

SEQ ID NO: 431398 - RNA, 22 nt, Human
uaaucaauauuaacaagacaga

SEQ ID NO: 431399 - RNA, 18 nt, Human
uaauggaaguaaagugcu

SEQ ID NO: 431400 - RNA, 20 nt, Human
uaauggaaguaaagugcuaa

SEQ ID NO: 431401 - RNA, 22 nt, Human
uaauuuuuguauuuuuaguaga

SEQ ID NO: 431402 - RNA, 21 nt, Human
uacacacacacacaaacaaaa

SEQ ID NO: 431403 - RNA, 23 nt, Human
uacagaucaaaaagcugggcaag

SEQ ID NO: 431404 - RNA, 24 nt, Human
uaccauauggcuacaaugaugacg

SEQ ID NO: 431405 - RNA, 24 nt, Human
uacuauuguggaauacagaagaug

SEQ ID NO: 431406 - RNA, 22 nt, Human
uagaacaaucacuaaaaaaugc

SEQ ID NO: 431407 - RNA, 19 nt, Human
uagaauacacccaaaaacu

SEQ ID NO: 431408 - RNA, 23 nt, Human
uagaauacacccaaaaacuucca

SEQ ID NO: 431409 - RNA, 24 nt, Human
uagggaccugcaaagcggccccga

SEQ ID NO: 431410 - RNA, 22 nt, Human
uaguagacaggguuuugccaug

SEQ ID NO: 431411 - RNA, 23 nt, Human
uaguagacaggguuuugccaugu

SEQ ID NO: 431412 - RNA, 23 nt, Human
uaguggucucaaagugcuaggau

SEQ ID NO: 431413 - RNA, 21 nt, Human
uauuguggaauacagaagaug

SEQ ID NO: 431414 - RNA, 21 nt, Human
ucaaaaagcugggcaagcacc

SEQ ID NO: 431415 - RNA, 18 nt, Human
ucaaaggaacuagaaaug

SEQ ID NO: 431416 - RNA, 20 nt, Human
ucaaagugcuaggauuacag

SEQ ID NO: 431417 - RNA, 22 nt, Human
ucaaagugcuaggauuacaggu

SEQ ID NO: 431418 - RNA, 25 nt, Human
ucaacugauccuccugccucagccc

SEQ ID NO: 431419 - RNA, 18 nt, Human
ucaagacaaaccaccaga

SEQ ID NO: 431420 - RNA, 18 nt, Human
ucaagaguucaagaccaa

SEQ ID NO: 431421 - RNA, 21 nt, Human
ucaauauuaacaagacagaaa

SEQ ID NO: 431422 - RNA, 24 nt, Human
ucacaaggucaggaguuugagacc

SEQ ID NO: 431423 - RNA, 21 nt, Human
ucacagcacuccagcgugggu

SEQ ID NO: 431424 - RNA, 24 nt, Human
ucacagcacuccagcgugggugac

SEQ ID NO: 431425 - RNA, 18 nt, Human
ucacugcaaccuccgccu

SEQ ID NO: 431426 - RNA, 19 nt, Human
ucacugcaaccuccgccuc

SEQ ID NO: 431427 - RNA, 22 nt, Human
ucacugcaaccuccgccuccca

SEQ ID NO: 431428 - RNA, 24 nt, Human
ucacugcaaccuccgccucccacg

SEQ ID NO: 431429 - RNA, 26 nt, Human
ucacugcaaccuccgccucccacguu

SEQ ID NO: 431430 - RNA, 21 nt, Human
ucagugaggaccauggaaggu

SEQ ID NO: 431431 - RNA, 24 nt, Human
ucaugaggucaagaguucaagacc

SEQ ID NO: 431432 - RNA, 23 nt, Human
uccagccugggugacagagugag

SEQ ID NO: 431433 - RNA, 24 nt, Human
uccagccugggugacagagugaga

SEQ ID NO: 431434 - RNA, 24 nt, Human
uccagcgugggugacagagugaga

SEQ ID NO: 431435 - RNA, 25 nt, Human
uccaugccacgcacaucacagccaa

SEQ ID NO: 431436 - RNA, 18 nt, Human
ucccuaaaaaagacaaga

SEQ ID NO: 431437 - RNA, 19 nt, Human
ucccuaaaaaagacaagac

SEQ ID NO: 431438 - RNA, 24 nt, Human
uccuccugccucagccccccagca

SEQ ID NO: 431439 - RNA, 26 nt, Human
uccuccugccucagccccccagcagc

SEQ ID NO: 431440 - RNA, 23 nt, Human
uccugacuagggaccugcaaagc

SEQ ID NO: 431441 - RNA, 24 nt, Human
ucgcaucacagcacuccagcgugg

SEQ ID NO: 431442 - RNA, 24 nt, Human
ucgcucugcugcccaggcuggagu

SEQ ID NO: 431443 - RNA, 24 nt, Human
ucgcuugaacccaggaggcggagg

SEQ ID NO: 431444 - RNA, 20 nt, Human
ucgguccugacuagggaccu

SEQ ID NO: 431445 - RNA, 24 nt, Human
ucucaaagugcuaggauuacaggu

SEQ ID NO: 431446 - RNA, 20 nt, Human
ucucgaacuccuggccucag

SEQ ID NO: 431447 - RNA, 23 nt, Human
ucucgcucugcugcccaggcugg

SEQ ID NO: 431448 - RNA, 24 nt, Human
ucucgcucugcugcccaggcugga

SEQ ID NO: 431449 - RNA, 26 nt, Human
ucucgcucugcugcccaggcuggagu

SEQ ID NO: 431450 - RNA, 27 nt, Human
ucucgcucugcugcccaggcuggagug

SEQ ID NO: 431451 - RNA, 19 nt, Human
ucucgcucuguugcccagg

SEQ ID NO: 431452 - RNA, 23 nt, Human
ucucgcucuguugcccaggcugg

SEQ ID NO: 431453 - RNA, 24 nt, Human
ucucgcucuguugcccaggcugga

SEQ ID NO: 431454 - RNA, 26 nt, Human
ucucgcucuguugcccaggcuggagu

SEQ ID NO: 431455 - RNA, 27 nt, Human
ucucgcucuguugcccaggcuggagug

SEQ ID NO: 431456 - RNA, 21 nt, Human
ucucuacuaaaaauacaaaaa

SEQ ID NO: 431457 - RNA, 22 nt, Human
ucucuacuaaaaauacaaaauu

SEQ ID NO: 431458 - RNA, 22 nt, Human
ucucuuuaaaaaaaaaaaaaaa

SEQ ID NO: 431459 - RNA, 23 nt, Human
ucugacacuggauagcaauaaau

SEQ ID NO: 431460 - RNA, 18 nt, Human
ucuguugcccaggcugga

SEQ ID NO: 431461 - RNA, 24 nt, Human
ucuguugcccaggcuggagugcag

SEQ ID NO: 431462 - RNA, 20 nt, Human
ucuuuaaaaaaaaaaaaaaa

SEQ ID NO: 431463 - RNA, 19 nt, Human
ugaaagagcaacacacuuc

SEQ ID NO: 431464 - RNA, 24 nt, Human
ugaaagauaaaaaauggucuguau

SEQ ID NO: 431465 - RNA, 25 nt, Human
ugacaaguaauauucagcaacagaa

SEQ ID NO: 431466 - RNA, 26 nt, Human
ugagaacaucagguaaaguauugaca

SEQ ID NO: 431467 - RNA, 18 nt, Human
ugagagucuuucuuuggc

SEQ ID NO: 431468 - RNA, 19 nt, Human
ugagagucuuucuuuggcg

SEQ ID NO: 431469 - RNA, 22 nt, Human
ugagccaagaucgugccacugc

SEQ ID NO: 431470 - RNA, 20 nt, Human
ugaggcaggagaaucgcuug

SEQ ID NO: 431471 - RNA, 24 nt, Human
ugaggcaggagaaucgcuugaacc

SEQ ID NO: 431472 - RNA, 25 nt, Human
ugaggcaggagaaucgcuugaaccc

SEQ ID NO: 431473 - RNA, 24 nt, Human
ugaggcaguuaauugcuugaaccc

SEQ ID NO: 431474 - RNA, 18 nt, Human
ugcaguggugagaucuca

SEQ ID NO: 431475 - RNA, 22 nt, Human
ugcaguggugagaucucagcuc

SEQ ID NO: 431476 - RNA, 24 nt, Human
ugccauguuggccaggcuggucuc

SEQ ID NO: 431477 - RNA, 27 nt, Human
ugccauguuggccaggcuggucucgaa

SEQ ID NO: 431478 - RNA, 18 nt, Human
ugcccaggcuggagugca

SEQ ID NO: 431479 - RNA, 18 nt, Human
ugcccaggcuggagugca

SEQ ID NO: 431480 - RNA, 21 nt, Human
ugcccaggcuggagugcagug

SEQ ID NO: 431481 - RNA, 21 nt, Human
ugcccaggcuggagugcagug

SEQ ID NO: 431482 - RNA, 22 nt, Human
ugcccaggcuggagugcagugg

SEQ ID NO: 431483 - RNA, 24 nt, Human
ugcccaggcuggagugcaguggca

SEQ ID NO: 431484 - RNA, 24 nt, Human
ugcccaggcuggagugcaguggug

SEQ ID NO: 431485 - RNA, 24 nt, Human
ugcccggcuaauuuuuguauuuuu

SEQ ID NO: 431486 - RNA, 18 nt, Human
ugcccggggcuuccaggc

SEQ ID NO: 431487 - RNA, 23 nt, Human
ugcccggggcuuccaggcgcgcu

SEQ ID NO: 431488 - RNA, 20 nt, Human
ugccucagccccccagcagc

SEQ ID NO: 431489 - RNA, 23 nt, Human
ugccucagccccccagcagcugg

SEQ ID NO: 431490 - RNA, 18 nt, Human
ugcuaggauuacagguaa

SEQ ID NO: 431491 - RNA, 21 nt, Human
ugcugcccaggcuggagugca

SEQ ID NO: 431492 - RNA, 22 nt, Human
ugcuugcauuucauuuuuucua

SEQ ID NO: 431493 - RNA, 18 nt, Human
uggaaugucaaaggaacu

SEQ ID NO: 431494 - RNA, 23 nt, Human
uggagaauaaggcucuagacuga

SEQ ID NO: 431495 - RNA, 24 nt, Human
uggagucucgcucuguugcccagg

SEQ ID NO: 431496 - RNA, 23 nt, Human
uggagugcaguggcacgaucuca

SEQ ID NO: 431497 - RNA, 24 nt, Human
uggagugcaguggcacgaucucag

SEQ ID NO: 431498 - RNA, 20 nt, Human
uggagugcaguggugagauc

SEQ ID NO: 431499 - RNA, 23 nt, Human
uggagugcaguggugagaucuca

SEQ ID NO: 431500 - RNA, 24 nt, Human
uggagugcaguggugagaucucag

SEQ ID NO: 431501 - RNA, 18 nt, Human
uggcacgaucucagcuca

SEQ ID NO: 431502 - RNA, 18 nt, Human
uggcagagaagccugaaa

SEQ ID NO: 431503 - RNA, 24 nt, Human
uggccaggcuggucucgaacuccu

SEQ ID NO: 431504 - RNA, 24 nt, Human
uggccucaggugauccacccgccu

SEQ ID NO: 431505 - RNA, 24 nt, Human
uggcggcgcacaccuguaauccca

SEQ ID NO: 431506 - RNA, 21 nt, Human
uggcucacaccuguaacccca

SEQ ID NO: 431507 - RNA, 22 nt, Human
uggcucacaccuguaaccccag

SEQ ID NO: 431508 - RNA, 23 nt, Human
uggcucacaccuguaaccccagc

SEQ ID NO: 431509 - RNA, 24 nt, Human
uggcucacaccuguaaccccagca

SEQ ID NO: 431510 - RNA, 21 nt, Human
ugggaccacaggcacacgcca

SEQ ID NO: 431511 - RNA, 24 nt, Human
ugggaccacaggcacacgccacca

SEQ ID NO: 431512 - RNA, 23 nt, Human
uggggggccgaggcggguggauc

SEQ ID NO: 431513 - RNA, 24 nt, Human
uggggggccgaggcggguggauca

SEQ ID NO: 431514 - RNA, 19 nt, Human
ugggugacagagugagacu

SEQ ID NO: 431515 - RNA, 21 nt, Human
ugggugacagagugagacucu

SEQ ID NO: 431516 - RNA, 21 nt, Human
ugguaguagguuucuuauauu

SEQ ID NO: 431517 - RNA, 24 nt, Human
uggugagaucucagcucacugcaa

SEQ ID NO: 431518 - RNA, 24 nt, Human
ugguucgacuuacuacuugacuuu

SEQ ID NO: 431519 - RNA, 21 nt, Human
uguauuugcagaugacauuuc

SEQ ID NO: 431520 - RNA, 24 nt, Human
uguggccgggugcaguggcucaca

SEQ ID NO: 431521 - RNA, 20 nt, Human
uguuacucuagaagaaaggc

SEQ ID NO: 431522 - RNA, 25 nt, Human
uguuagaugauuuugcccaacugcc

SEQ ID NO: 431523 - RNA, 22 nt, Human
uguucaaagaaacugacuucau

SEQ ID NO: 431524 - RNA, 20 nt, Human
uguuguuguugagacagagu

SEQ ID NO: 431525 - RNA, 23 nt, Human
uguuguuguuguugagacagagu

SEQ ID NO: 431526 - RNA, 20 nt, Human
uuaacucaauuucuguaaaa

SEQ ID NO: 431527 - RNA, 18 nt, Human
uuagcuggguguggcggc

SEQ ID NO: 431528 - RNA, 20 nt, Human
uuagcuggguguggcggcgc

SEQ ID NO: 431529 - RNA, 22 nt, Human
uuaguagacaggguuuugccau

SEQ ID NO: 431530 - RNA, 23 nt, Human
uuaguagacaggguuuugccaug

SEQ ID NO: 431531 - RNA, 23 nt, Human
uucaacauaccaauuaagagaga

SEQ ID NO: 431532 - RNA, 25 nt, Human
uucaacauaccaauuaagagagaca

SEQ ID NO: 431533 - RNA, 18 nt, Human
uugaaacauuucccuucc

SEQ ID NO: 431534 - RNA, 25 nt, Human
uugaaagagcaacacacuuccacaa

SEQ ID NO: 431535 - RNA, 24 nt, Human
uugaacccaggaggcggagguugc

SEQ ID NO: 431536 - RNA, 24 nt, Human
uugaaugaagcuugacagaacuga

SEQ ID NO: 431537 - RNA, 20 nt, Human
uugcagagagccgagaucgc

SEQ ID NO: 431538 - RNA, 21 nt, Human
uugcagagagccgagaucgca

SEQ ID NO: 431539 - RNA, 22 nt, Human
uugcagugagccaagaucgugc

SEQ ID NO: 431540 - RNA, 24 nt, Human
uugccauguuggccaggcuggucu

SEQ ID NO: 431541 - RNA, 24 nt, Human
uugcccaggcuggagugcaguggc

SEQ ID NO: 431542 - RNA, 18 nt, Human
uugcuugaacccgggagg

SEQ ID NO: 431543 - RNA, 24 nt, Human
uugcuugaacccgggaggcagagg

SEQ ID NO: 431544 - RNA, 25 nt, Human
uuggggggccgaggcggguggauca

SEQ ID NO: 431545 - RNA, 20 nt, Human
uuuacaaucacucaaauuac

SEQ ID NO: 431546 - RNA, 23 nt, Human
uuuaguagacaggguuuugccau

SEQ ID NO: 431547 - RNA, 19 nt, Human
uuugcaaacaaaaagugau

SEQ ID NO: 431548 - RNA, 24 nt, Human
uuuuaguagacaggguuuugccau

SEQ ID NO: 431549 - RNA, 23 nt, Human
uuuugccauguuggccaggcugg

SEQ ID NO: 431550 - RNA, 19 nt, Human
uuuuuaguagacaggguuu

SEQ ID NO: 431551 - RNA, 19 nt, Human
uuuuuaguagacaggguuu

SEQ ID NO: 431552 - RNA, 18 nt, Human
uuuuuguauuuuuaguag

SEQ ID NO: 431553 - RNA, 21 nt, Human
uuuuuguauuuuuaguagaca

SEQ ID NO: 431554 - RNA, 18 nt, Human
aaaaaaaacaagaaauca

SEQ ID NO: 431555 - RNA, 24 nt, Human
aaaaaaguaaagcuggauaaaaga

SEQ ID NO: 431556 - RNA, 20 nt, Human
aaaaacaugggaaagcucac

SEQ ID NO: 431557 - RNA, 21 nt, Human
aaagaaacuuaagacauaaaa

SEQ ID NO: 431558 - RNA, 22 nt, Human
aaagcaaugaaaggcaugcacc

SEQ ID NO: 431559 - RNA, 18 nt, Human
aacaaaaagcccccaagc

SEQ ID NO: 431560 - RNA, 18 nt, Human
aacauugguaaacauuuu

SEQ ID NO: 431561 - RNA, 20 nt, Human
aaccagaaaacaaacuaaag

SEQ ID NO: 431562 - RNA, 21 nt, Human
aaccagaaaacaaacuaaagc

SEQ ID NO: 431563 - RNA, 23 nt, Human
aaccuacauaaacgcagcaaaga

SEQ ID NO: 431564 - RNA, 24 nt, Human
aacuaguuuccagucuuucuucca

SEQ ID NO: 431565 - RNA, 18 nt, Human
aagaauaucacacaaagc

SEQ ID NO: 431566 - RNA, 21 nt, Human
aaucauaaucaucagaauugu

SEQ ID NO: 431567 - RNA, 23 nt, Human
acaggauguauuuggaaaugaca

SEQ ID NO: 431568 - RNA, 23 nt, Human
accaaaagagaaauauacuuuaa

SEQ ID NO: 431569 - RNA, 20 nt, Human
accaaguaagacaccaacuu

SEQ ID NO: 431570 - RNA, 21 nt, Human
acuuuguuauagcugaaaugg

SEQ ID NO: 431571 - RNA, 18 nt, Human
agaaaacaaacuaaagcu

SEQ ID NO: 431572 - RNA, 21 nt, Human
agaaaggaaaauauaucccac

SEQ ID NO: 431573 - RNA, 23 nt, Human
agacaccaacuucuuuaaaaaua

SEQ ID NO: 431574 - RNA, 18 nt, Human
agcaaaaaaguaaagcug

SEQ ID NO: 431575 - RNA, 20 nt, Human
aggcaugcaccucuacuagc

SEQ ID NO: 431576 - RNA, 23 nt, Human
agggguuggcccugggcucaggg

SEQ ID NO: 431577 - RNA, 24 nt, Human
auaaaagagacacaaugauucuaa

SEQ ID NO: 431578 - RNA, 26 nt, Human
augcuauuuacuuuuaacuucacaaa

SEQ ID NO: 431579 - RNA, 24 nt, Human
caaaugaaaucauaaucaucagaa

SEQ ID NO: 431580 - RNA, 22 nt, Human
caaccguaucagcagagaaaag

SEQ ID NO: 431581 - RNA, 24 nt, Human
caaccuacauaaacgcagcaaaga

SEQ ID NO: 431582 - RNA, 22 nt, Human
caagaaaucaauaucccauaac

SEQ ID NO: 431583 - RNA, 19 nt, Human
caaguaagacaccaacuuc

SEQ ID NO: 431584 - RNA, 20 nt, Human
cacaagaauaaaccaauggu

SEQ ID NO: 431585 - RNA, 18 nt, Human
cccauaacaaaaagcccc

SEQ ID NO: 431586 - RNA, 22 nt, Human
cccauaacaaaaagcccccaag

SEQ ID NO: 431587 - RNA, 23 nt, Human
cccccaagcacaacuguugauuu

SEQ ID NO: 431588 - RNA, 24 nt, Human
cccccaagcacaacuguugauuuc

SEQ ID NO: 431589 - RNA, 19 nt, Human
cggaaaaaaaacaagaaau

SEQ ID NO: 431590 - RNA, 20 nt, Human
cuuaaaaugcuauuuacuuu

SEQ ID NO: 431591 - RNA, 20 nt, Human
gaacgggaaccagaauggga

SEQ ID NO: 431592 - RNA, 20 nt, Human
gagaaauauacuuuaaaagc

SEQ ID NO: 431593 - RNA, 19 nt, Human
gaugucuuuaucaagcaac

SEQ ID NO: 431594 - RNA, 25 nt, Human
gcagcaaagaaacuuaagacauaaa

SEQ ID NO: 431595 - RNA, 21 nt, Human
ggaaagcucacuguaaaaaua

SEQ ID NO: 431596 - RNA, 18 nt, Human
gggguuggcccugggcuc

SEQ ID NO: 431597 - RNA, 19 nt, Human
guggagcaaaaaaguaaag

SEQ ID NO: 431598 - RNA, 24 nt, Human
gugucagaaaggaaaauauauccc

SEQ ID NO: 431599 - RNA, 23 nt, Human
uaaaaauaugcuucaugcacugu

SEQ ID NO: 431600 - RNA, 21 nt, Human
uaaaaguucuugugcaaccua

SEQ ID NO: 431601 - RNA, 26 nt, Human
uaaaccagaaaacaaacuaaagcuca

SEQ ID NO: 431602 - RNA, 24 nt, Human
uaagagaaaccuuuuuauuuuuua

SEQ ID NO: 431603 - RNA, 23 nt, Human
uacaguaucauuuccuuaugaaa

SEQ ID NO: 431604 - RNA, 27 nt, Human
uacaguaucauuuccuuaugaaaugaa

SEQ ID NO: 431605 - RNA, 24 nt, Human
uacggaaaaaaaacaagaaaucaa

SEQ ID NO: 431606 - RNA, 18 nt, Human
uagcagauuuagcacuuc

SEQ ID NO: 431607 - RNA, 22 nt, Human
uagugguguuccguagggguug

SEQ ID NO: 431608 - RNA, 20 nt, Human
ucaaaaagucugaggcacaa

SEQ ID NO: 431609 - RNA, 19 nt, Human
ucaaaauagacauuuacag

SEQ ID NO: 431610 - RNA, 18 nt, Human
ucacaaugucuccauugg

SEQ ID NO: 431611 - RNA, 20 nt, Human
ucagcagagaaaagauaaac

SEQ ID NO: 431612 - RNA, 19 nt, Human
ugaaaagcaaugaaaggca

SEQ ID NO: 431613 - RNA, 21 nt, Human
ugagaaauaaacuccaaaagc

SEQ ID NO: 431614 - RNA, 24 nt, Human
ugaggcaaauguucacuuaaauuc

SEQ ID NO: 431615 - RNA, 20 nt, Human
ugaggcacaauuacaaguga

SEQ ID NO: 431616 - RNA, 21 nt, Human
ugcagcagacaauguuacgga

SEQ ID NO: 431617 - RNA, 20 nt, Human
uggaagaauaucacacaaag

SEQ ID NO: 431618 - RNA, 20 nt, Human
ugggacauuauggcuuaaaa

SEQ ID NO: 431619 - RNA, 20 nt, Human
uguggagcaaaaaaguaaag

SEQ ID NO: 431620 - RNA, 22 nt, Human
uguggagcaaaaaaguaaagcu

SEQ ID NO: 431621 - RNA, 24 nt, Human
uuaacuucacaaauaaacacagcu

SEQ ID NO: 431622 - RNA, 22 nt, Human
uuaauuuugagaaauaaacucc

SEQ ID NO: 431623 - RNA, 25 nt, Human
uucaaaauagacauuuacaguuggc

SEQ ID NO: 431624 - RNA, 22 nt, Human
uucuuccaugcccaaaguucag

SEQ ID NO: 431625 - RNA, 21 nt, Human
uugaacuugaacgggaaccag

SEQ ID NO: 431626 - RNA, 23 nt, Human
uuucaaaaagucugaggcacaau

SEQ ID NO: 431627 - RNA, 24 nt, Human
uuugccccaaauuaugugucagaa

SEQ ID NO: 431628 - RNA, 21 nt, Human
uuuuaaaccagaaaacaaacu

SEQ ID NO: 431629 - RNA, 19 nt, Human
uuuuuugcuugacucacag

SEQ ID NO: 431630 - RNA, 18 nt, Human
uuuuuuuuuuuuuuuuug

SEQ ID NO: 431631 - RNA, 23 nt, Human
uuuuuuuuuuuuuuuuugcuuga

SEQ ID NO: 431632 - RNA, 25 nt, Human
aagcaucuguuccaggucucugucc

SEQ ID NO: 431633 - RNA, 24 nt, Human
aagcuuuucccaaguuccucacag

SEQ ID NO: 431634 - RNA, 18 nt, Human
aaggaacuaggacuuagg

SEQ ID NO: 431635 - RNA, 22 nt, Human
aaguuccucacaguauuaguuu

SEQ ID NO: 431636 - RNA, 19 nt, Human
aaugauuuaaccaagagaa

SEQ ID NO: 431637 - RNA, 25 nt, Human
acaaccagacugggaggucaucuga

SEQ ID NO: 431638 - RNA, 19 nt, Human
acagagucugagggcucac

SEQ ID NO: 431639 - RNA, 19 nt, Human
accaagagaaauuuauugc

SEQ ID NO: 431640 - RNA, 24 nt, Human
agauucucuacauucauacaguuu

SEQ ID NO: 431641 - RNA, 18 nt, Human
aggguugguuuccucugg

SEQ ID NO: 431642 - RNA, 19 nt, Human
agguccucucuauccacac

SEQ ID NO: 431643 - RNA, 18 nt, Human
caaaaugcaauaccuaca

SEQ ID NO: 431644 - RNA, 28 nt, Human
caaugugaguucacauacacacagugug

SEQ ID NO: 431645 - RNA, 21 nt, Human
cacaaccagacugggagguca

SEQ ID NO: 431646 - RNA, 18 nt, Human
cacauugcccaccccagg

SEQ ID NO: 431647 - RNA, 18 nt, Human
cagagucugagggcucac

SEQ ID NO: 431648 - RNA, 25 nt, Human
cagaucaucaaaagucacugaaucc

SEQ ID NO: 431649 - RNA, 23 nt, Human
cagugacacggcuugaauggcac

SEQ ID NO: 431650 - RNA, 19 nt, Human
cagugaguuuucaugucuu

SEQ ID NO: 431651 - RNA, 20 nt, Human
cauugcccaccccaggaggu

SEQ ID NO: 431652 - RNA, 22 nt, Human
ccaacaaccucauuugaaguua

SEQ ID NO: 431653 - RNA, 18 nt, Human
ccacacucacucacuguc

SEQ ID NO: 431654 - RNA, 18 nt, Human
ccccaggagguccucucu

SEQ ID NO: 431655 - RNA, 24 nt, Human
ccuccacugcagcacacucuugag

SEQ ID NO: 431656 - RNA, 24 nt, Human
cucacucacugucaguccccucca

SEQ ID NO: 431657 - RNA, 19 nt, Human
cuccauguguauccuuccu

SEQ ID NO: 431658 - RNA, 23 nt, Human
cucucuauccacacucacucacu

SEQ ID NO: 431659 - RNA, 25 nt, Human
cucuugagcagaugcuagauaaaca

SEQ ID NO: 431660 - RNA, 23 nt, Human
cugagauacaaaguugcuuccac

SEQ ID NO: 431661 - RNA, 24 nt, Human
cugggaggucaucugauuucccuc

SEQ ID NO: 431662 - RNA, 22 nt, Human
cuguuugaaaacccuaugucca

SEQ ID NO: 431663 - RNA, 20 nt, Human
gacugggaggucaucugauu

SEQ ID NO: 431664 - RNA, 18 nt, Human
gagaauucagcaaaguca

SEQ ID NO: 431665 - RNA, 18 nt, Human
gagccacaaaacaugucu

SEQ ID NO: 431666 - RNA, 18 nt, Human
gccaucuucugguggauc

SEQ ID NO: 431667 - RNA, 20 nt, Human
ggacaagcuugaucuaaagc

SEQ ID NO: 431668 - RNA, 20 nt, Human
ggagguccucucuauccaca

SEQ ID NO: 431669 - RNA, 26 nt, Human
ggcacuucuuacacaugauuguaugu

SEQ ID NO: 431670 - RNA, 22 nt, Human
guccacagccagaucaucaaaa

SEQ ID NO: 431671 - RNA, 19 nt, Human
guccccuccagugacacgg

SEQ ID NO: 431672 - RNA, 24 nt, Human
uaagaccugagauacaaaguugcu

SEQ ID NO: 431673 - RNA, 23 nt, Human
uaccaguguucacugcaaaaugc

SEQ ID NO: 431674 - RNA, 20 nt, Human
uagagguuucucugaguugg

SEQ ID NO: 431675 - RNA, 18 nt, Human
uaucaagguggagacagg

SEQ ID NO: 431676 - RNA, 20 nt, Human
uaucaagguggagacagggu

SEQ ID NO: 431677 - RNA, 25 nt, Human
uauguaacacaaccagacugggagg

SEQ ID NO: 431678 - RNA, 22 nt, Human
ucagaaagguauucccagauuc

SEQ ID NO: 431679 - RNA, 20 nt, Human
uccacagccagaucaucaaa

SEQ ID NO: 431680 - RNA, 21 nt, Human
ucuauccacacucacucacug

SEQ ID NO: 431681 - RNA, 20 nt, Human
ucuguuccaggucucugucc

SEQ ID NO: 431682 - RNA, 22 nt, Human
ucuucagagagaacagggacac

SEQ ID NO: 431683 - RNA, 20 nt, Human
ugaguuggguccaguaaagu

SEQ ID NO: 431684 - RNA, 21 nt, Human
ugcaauaccuacagagucuga

SEQ ID NO: 431685 - RNA, 24 nt, Human
ugcaauaccuacagagucugaggg

SEQ ID NO: 431686 - RNA, 23 nt, Human
ugcaggguuucucuccaauguga

SEQ ID NO: 431687 - RNA, 20 nt, Human
uggagacaggguugguuucc

SEQ ID NO: 431688 - RNA, 25 nt, Human
uugagccacaaaacaugucuaccag

SEQ ID NO: 431689 - RNA, 18 nt, Human
agacucggagcuguggcg

SEQ ID NO: 431690 - RNA, 19 nt, Human
agacucggagcuguggcga

SEQ ID NO: 431691 - RNA, 18 nt, Human
caagucgcagagcaacag

SEQ ID NO: 431692 - RNA, 22 nt, Human
cagaacgcgaagccgccugggc

SEQ ID NO: 431693 - RNA, 18 nt, Human
cagagcaacagagguucu

SEQ ID NO: 431694 - RNA, 19 nt, Human
cagagguucuguuuauucu

SEQ ID NO: 431695 - RNA, 21 nt, Human
ccagugccugcaagucgcaga

SEQ ID NO: 431696 - RNA, 23 nt, Human
cgaagccgccugggccucccaga

SEQ ID NO: 431697 - RNA, 19 nt, Human
ggcgaggagacccgagcuc

SEQ ID NO: 431698 - RNA, 18 nt, Human
uaaaaaaucugcuccaug

SEQ ID NO: 431699 - RNA, 21 nt, Human
uaguauggauuaucuugagua

SEQ ID NO: 431700 - RNA, 21 nt, Human
uucucugcuauuguguaaggc

SEQ ID NO: 431701 - RNA, 21 nt, Human
uugagcacaguuuaaaauaau

SEQ ID NO: 431702 - RNA, 21 nt, Human
aagacuuucccacauucacag

SEQ ID NO: 431703 - RNA, 21 nt, Human
acaacagcugcauccaaaggg

SEQ ID NO: 431704 - RNA, 20 nt, Human
acccugaaggggcagcagaa

SEQ ID NO: 431705 - RNA, 18 nt, Human
acugccuccaccuccaga

SEQ ID NO: 431706 - RNA, 18 nt, Human
agugacaggacgcgaggg

SEQ ID NO: 431707 - RNA, 23 nt, Human
agugacaggacgcgagggaugcu

SEQ ID NO: 431708 - RNA, 18 nt, Human
caaacccugaaggggcag

SEQ ID NO: 431709 - RNA, 20 nt, Human
caaaggcaaaaaaacuacaa

SEQ ID NO: 431710 - RNA, 21 nt, Human
caaaggcaaaaaaacuacaac

SEQ ID NO: 431711 - RNA, 24 nt, Human
caaauguagugcauucaaagcuuu

SEQ ID NO: 431712 - RNA, 24 nt, Human
cagaauagaguccaggguacugcc

SEQ ID NO: 431713 - RNA, 18 nt, Human
cagcagaauagaguccag

SEQ ID NO: 431714 - RNA, 22 nt, Human
cagcagaauagaguccagggua

SEQ ID NO: 431715 - RNA, 25 nt, Human
cauggagaggcaaaggcaaaaaaac

SEQ ID NO: 431716 - RNA, 19 nt, Human
cauucaaagcuuuuugccg

SEQ ID NO: 431717 - RNA, 24 nt, Human
cccacauucauuacacacauaugg

SEQ ID NO: 431718 - RNA, 25 nt, Human
ccuccaaacccugaaggggcagcag

SEQ ID NO: 431719 - RNA, 19 nt, Human
cggcgcggaacaauggcgg

SEQ ID NO: 431720 - RNA, 26 nt, Human
cuacugaagucuuucccaaccggagg

SEQ ID NO: 431721 - RNA, 22 nt, Human
cucuucggcaugaguuugcuga

SEQ ID NO: 431722 - RNA, 19 nt, Human
cugaaggcuuucucacaac

SEQ ID NO: 431723 - RNA, 24 nt, Human
gaauagaguccaggguacugccuc

SEQ ID NO: 431724 - RNA, 19 nt, Human
gauguauaacaagcuguga

SEQ ID NO: 431725 - RNA, 25 nt, Human
gcagaauagaguccaggguacugcc

SEQ ID NO: 431726 - RNA, 20 nt, Human
gcagcagaauagaguccagg

SEQ ID NO: 431727 - RNA, 23 nt, Human
ggcgaugaacgcuaucugaggaa

SEQ ID NO: 431728 - RNA, 22 nt, Human
gucaguuuugugugccucgcug

SEQ ID NO: 431729 - RNA, 21 nt, Human
ucacugcauucauguaguuuc

SEQ ID NO: 431730 - RNA, 22 nt, Human
uccaaacccugaaggggcagca

SEQ ID NO: 431731 - RNA, 19 nt, Human
uccauguaccugaaaccca

SEQ ID NO: 431732 - RNA, 21 nt, Human
uccggcuccuccaaacccuga

SEQ ID NO: 431733 - RNA, 19 nt, Human
uccuccaaacccugaaggg

SEQ ID NO: 431734 - RNA, 22 nt, Human
ugagguaugauuuacuacugaa

SEQ ID NO: 431735 - RNA, 21 nt, Human
ugcuccggcuccuccaaaccc

SEQ ID NO: 431736 - RNA, 27 nt, Human
uggaagaaugauuuuccauguaccuga

SEQ ID NO: 431737 - RNA, 26 nt, Human
uggaagugacaggacgcgagggaugc

SEQ ID NO: 431738 - RNA, 22 nt, Human
uucacagcacucauagggauuc

SEQ ID NO: 431739 - RNA, 18 nt, Human
uucgcaaccacuccagac

SEQ ID NO: 431740 - RNA, 20 nt, Human
uucgcaaccacuccagacuc

SEQ ID NO: 431741 - RNA, 23 nt, Human
uuugcucauguuuagaauggaag

SEQ ID NO: 431742 - RNA, 21 nt, Human
aagccggggacagcaggagga

SEQ ID NO: 431743 - RNA, 22 nt, Human
aaugggugaugcuugguugggu

SEQ ID NO: 431744 - RNA, 21 nt, Human
aggcgaccacucuuggggcag

SEQ ID NO: 431745 - RNA, 23 nt, Human
aggggcggcaggcgaagccgggg

SEQ ID NO: 431746 - RNA, 24 nt, Human
aggggcggcaggcgaagccgggga

SEQ ID NO: 431747 - RNA, 18 nt, Human
auacacauaaauacugug

SEQ ID NO: 431748 - RNA, 21 nt, Human
augacuaaaugagugaacaaa

SEQ ID NO: 431749 - RNA, 20 nt, Human
caaggggaggccucugguga

SEQ ID NO: 431750 - RNA, 19 nt, Human
cagagcagaagcuggagaa

SEQ ID NO: 431751 - RNA, 19 nt, Human
cauacacauaaauacugug

SEQ ID NO: 431752 - RNA, 24 nt, Human
caucuugacuggccgguuaggggc

SEQ ID NO: 431753 - RNA, 24 nt, Human
cccccgcggcgcgccagcuugccu

SEQ ID NO: 431754 - RNA, 27 nt, Human
ccgaacuacaacucccagacgcccccg

SEQ ID NO: 431755 - RNA, 18 nt, Human
ccggcggcgaagugcguc

SEQ ID NO: 431756 - RNA, 22 nt, Human
ccucacucaauacuucccuuuc

SEQ ID NO: 431757 - RNA, 23 nt, Human
ccucacucaauacuucccuuuca

SEQ ID NO: 431758 - RNA, 22 nt, Human
ccuccuucucaaugugucucug

SEQ ID NO: 431759 - RNA, 20 nt, Human
ccuuugguuuugggaauguc

SEQ ID NO: 431760 - RNA, 18 nt, Human
cgcuaggccgcagggccc

SEQ ID NO: 431761 - RNA, 18 nt, Human
cucaauacuucccuuuca

SEQ ID NO: 431762 - RNA, 20 nt, Human
cuccucaguuguccuuuggu

SEQ ID NO: 431763 - RNA, 19 nt, Human
cuugguuggguggcggugg

SEQ ID NO: 431764 - RNA, 24 nt, Human
gaugcuugguuggguggcgguggg

SEQ ID NO: 431765 - RNA, 21 nt, Human
gcuggagcucaggauacuccg

SEQ ID NO: 431766 - RNA, 20 nt, Human
gguuggguggcggugggggc

SEQ ID NO: 431767 - RNA, 20 nt, Human
guccagcuggagcucaggau

SEQ ID NO: 431768 - RNA, 23 nt, Human
gugucucugguggaagugggcag

SEQ ID NO: 431769 - RNA, 20 nt, Human
uaacuccucacucauuuucu

SEQ ID NO: 431770 - RNA, 26 nt, Human
ucccagacgcccccgcggcgcgccag

SEQ ID NO: 431771 - RNA, 23 nt, Human
uccuccuucucaaugugucucug

SEQ ID NO: 431772 - RNA, 19 nt, Human
ugagugaacaaacaauauc

SEQ ID NO: 431773 - RNA, 18 nt, Human
uggaagugggcagagucc

SEQ ID NO: 431774 - RNA, 19 nt, Human
uggaagugggcagaguccc

SEQ ID NO: 431775 - RNA, 23 nt, Human
ugggaaaucuuuuuuccaaauga

SEQ ID NO: 431776 - RNA, 22 nt, Human
ugggcggcgacccgagcuggga

SEQ ID NO: 431777 - RNA, 21 nt, Human
uggggcagagcagaagcugga

SEQ ID NO: 431778 - RNA, 24 nt, Human
uuaauaacuccucacucauuuucu

SEQ ID NO: 431779 - RNA, 22 nt, Human
uugguuggguggcggugggggc

SEQ ID NO: 431780 - RNA, 21 nt, Human
uuuauuuauccacauuaucuu

SEQ ID NO: 431781 - RNA, 18 nt, Human
uuucacauucaguccuga

SEQ ID NO: 431782 - RNA, 18 nt, Human
uuuuaaugacuaaaugag

SEQ ID NO: 431783 - RNA, 23 nt, Human
uuuuauuaaucucacuuuuaaug

SEQ ID NO: 431784 - RNA, 20 nt, Human
agggcgggucggaggcgggg

SEQ ID NO: 431785 - RNA, 24 nt, Human
auuacccggcagaaaagaaaaggg

SEQ ID NO: 431786 - RNA, 24 nt, Human
cacacaauaaaacuuuacagccaa

SEQ ID NO: 431787 - RNA, 18 nt, Human
cagcccccugggucuugg

SEQ ID NO: 431788 - RNA, 22 nt, Human
cccccugggucuuggaagcagc

SEQ ID NO: 431789 - RNA, 18 nt, Human
cggcagaaaagaaaaggg

SEQ ID NO: 431790 - RNA, 23 nt, Human
cuuuauuuuuugaaaagaacauu

SEQ ID NO: 431791 - RNA, 20 nt, Human
gccaaaauacaaagucuuca

SEQ ID NO: 431792 - RNA, 21 nt, Human
gcuucugugguaguuucuucu

SEQ ID NO: 431793 - RNA, 20 nt, Human
ggcagaaaagaaaagggagg

SEQ ID NO: 431794 - RNA, 22 nt, Human
gguaguuucuucuagguuuuca

SEQ ID NO: 431795 - RNA, 19 nt, Human
guuucuucuagguuuucaa

SEQ ID NO: 431796 - RNA, 26 nt, Human
uacaaagucuucaucuuauuuuccua

SEQ ID NO: 431797 - RNA, 19 nt, Human
ucauaggagaaaaacauga

SEQ ID NO: 431798 - RNA, 20 nt, Human
ucauguucuuaguaagugca

SEQ ID NO: 431799 - RNA, 25 nt, Human
ugaaaagaacauucauuuuugaaaa

SEQ ID NO: 431800 - RNA, 19 nt, Human
uucauuuuuuuucauguuc

SEQ ID NO: 431801 - RNA, 20 nt, Human
aaacaaaaggcgaaggcgaa

SEQ ID NO: 431802 - RNA, 24 nt, Human
aagcaggaucuagaucugaggaac

SEQ ID NO: 431803 - RNA, 20 nt, Human
aagcagggcucagaaagguc

SEQ ID NO: 431804 - RNA, 20 nt, Human
aagcagggcucagaaagguc

SEQ ID NO: 431805 - RNA, 21 nt, Human
aagcaggggucucaggccaaa

SEQ ID NO: 431806 - RNA, 26 nt, Human
aaggcaccaaccuccaaaaucaccua

SEQ ID NO: 431807 - RNA, 22 nt, Human
aaggcgaaggcggcggcggcgg

SEQ ID NO: 431808 - RNA, 18 nt, Human
aagucuacuucacuagcc

SEQ ID NO: 431809 - RNA, 21 nt, Human
aauuagagaauuaaaacccaa

SEQ ID NO: 431810 - RNA, 21 nt, Human
aauuagagaauuaaaacccaa

SEQ ID NO: 431811 - RNA, 18 nt, Human
acauagccaacccccgcu

SEQ ID NO: 431812 - RNA, 26 nt, Human
accaccccccacauagccaacccccg

SEQ ID NO: 431813 - RNA, 21 nt, Human
accuuccugguucccaacagc

SEQ ID NO: 431814 - RNA, 24 nt, Human
acuagagaagugggaggggaccaa

SEQ ID NO: 431815 - RNA, 24 nt, Human
acuagagaagugggaggggaccaa

SEQ ID NO: 431816 - RNA, 19 nt, Human
agaaggaguuggagugggg

SEQ ID NO: 431817 - RNA, 19 nt, Human
agaaggaguuggagugggg

SEQ ID NO: 431818 - RNA, 24 nt, Human
agccagaaaugaaagcaggaucua

SEQ ID NO: 431819 - RNA, 21 nt, Human
agcccagaaagaaacuuggau

SEQ ID NO: 431820 - RNA, 22 nt, Human
agcgggcgggcggcggcggcgg

SEQ ID NO: 431821 - RNA, 18 nt, Human
agcuacagaacccaaaca

SEQ ID NO: 431822 - RNA, 18 nt, Human
agcuacagaacccaaaca

SEQ ID NO: 431823 - RNA, 20 nt, Human
agcugguggcuaguucccag

SEQ ID NO: 431824 - RNA, 21 nt, Human
aggagagaaaggugagccaag

SEQ ID NO: 431825 - RNA, 23 nt, Human
aggccccagucuagaaaccccag

SEQ ID NO: 431826 - RNA, 19 nt, Human
aggcgaaggcgaaggcggc

SEQ ID NO: 431827 - RNA, 21 nt, Human
aggcgaaggcgaaggcggcgg

SEQ ID NO: 431828 - RNA, 19 nt, Human
aggcgaaggcggcggcggc

SEQ ID NO: 431829 - RNA, 21 nt, Human
aguuggagugggguugggggg

SEQ ID NO: 431830 - RNA, 20 nt, Human
auuagagaauuaaaacccaa

SEQ ID NO: 431831 - RNA, 22 nt, Human
caacagcauguugaaugguuaa

SEQ ID NO: 431832 - RNA, 22 nt, Human
caacagcauguugaaugguuaa

SEQ ID NO: 431833 - RNA, 22 nt, Human
caacagcauugaaacccccuac

SEQ ID NO: 431834 - RNA, 22 nt, Human
caacagcauugaaacccccuac

SEQ ID NO: 431835 - RNA, 19 nt, Human
caacccucuccagggaggc

SEQ ID NO: 431836 - RNA, 20 nt, Human
caagagagcccagaaagaaa

SEQ ID NO: 431837 - RNA, 21 nt, Human
caauucacaucacaaggucaa

SEQ ID NO: 431838 - RNA, 21 nt, Human
caauucacaucacaaggucaa

SEQ ID NO: 431839 - RNA, 19 nt, Human
cacacuccccacacgugcc

SEQ ID NO: 431840 - RNA, 23 nt, Human
cacagcauuucccagcagucccc

SEQ ID NO: 431841 - RNA, 23 nt, Human
cacagcauuucccagcagucccc

SEQ ID NO: 431842 - RNA, 21 nt, Human
cacaugugacacaacugaggu

SEQ ID NO: 431843 - RNA, 26 nt, Human
caccccccacauagccaacccccgcc

SEQ ID NO: 431844 - RNA, 20 nt, Human
cacccugcuagccucuccca

SEQ ID NO: 431845 - RNA, 22 nt, Human
cacccugcuagccucucccaaa

SEQ ID NO: 431846 - RNA, 23 nt, Human
cacccugcuagccucucccaaaa

SEQ ID NO: 431847 - RNA, 23 nt, Human
cacucugcuucucuggcgucuuc

SEQ ID NO: 431848 - RNA, 19 nt, Human
cagcagcgagaagcggggc

SEQ ID NO: 431849 - RNA, 19 nt, Human
caggaaggcaccaaccucc

SEQ ID NO: 431850 - RNA, 23 nt, Human
caggaaggcaccaaccuccaaaa

SEQ ID NO: 431851 - RNA, 25 nt, Human
cagucugaucagaucaauucacauc

SEQ ID NO: 431852 - RNA, 25 nt, Human
cagucugaucagaucaauucacauc

SEQ ID NO: 431853 - RNA, 20 nt, Human
cauagccaacccccgcccuc

SEQ ID NO: 431854 - RNA, 21 nt, Human
ccacacgugccggcccgaggc

SEQ ID NO: 431855 - RNA, 19 nt, Human
ccacauagccaacccccgc

SEQ ID NO: 431856 - RNA, 22 nt, Human
ccaccccccacauagccaaccc

SEQ ID NO: 431857 - RNA, 22 nt, Human
ccaugggcugcuggucaaccuc

SEQ ID NO: 431858 - RNA, 20 nt, Human
cccacauagccaacccccgc

SEQ ID NO: 431859 - RNA, 23 nt, Human
cccacauagccaacccccgcccu

SEQ ID NO: 431860 - RNA, 24 nt, Human
cccaccuuccugguucccaacagc

SEQ ID NO: 431861 - RNA, 24 nt, Human
cccaccuuccugguucccaacagc

SEQ ID NO: 431862 - RNA, 18 nt, Human
cccacuagcccggccgcu

SEQ ID NO: 431863 - RNA, 19 nt, Human
cccacuagcccggccgcug

SEQ ID NO: 431864 - RNA, 20 nt, Human
cccaugguccaugggaugcu

SEQ ID NO: 431865 - RNA, 22 nt, Human
ccccacauagccaacccccgcc

SEQ ID NO: 431866 - RNA, 21 nt, Human
ccccaugguccaugggaugcu

SEQ ID NO: 431867 - RNA, 22 nt, Human
cccccagggggcccccgagagc

SEQ ID NO: 431868 - RNA, 27 nt, Human
cccccucccuuccccucagcagcgaga

SEQ ID NO: 431869 - RNA, 22 nt, Human
ccccucagcagcgagaagcggg

SEQ ID NO: 431870 - RNA, 19 nt, Human
ccccucccgcccgccaggc

SEQ ID NO: 431871 - RNA, 18 nt, Human
ccccuccuguucccuucc

SEQ ID NO: 431872 - RNA, 20 nt, Human
ccccuccuguucccuuccac

SEQ ID NO: 431873 - RNA, 19 nt, Human
cccgagagcccggacaugc

SEQ ID NO: 431874 - RNA, 18 nt, Human
cccggagccuggagggcg

SEQ ID NO: 431875 - RNA, 19 nt, Human
cccggagccuggagggcgg

SEQ ID NO: 431876 - RNA, 20 nt, Human
cccggucuaccuuccggggg

SEQ ID NO: 431877 - RNA, 22 nt, Human
cccucccacuagcccggccgcu

SEQ ID NO: 431878 - RNA, 25 nt, Human
cccucccuuccccucagcagcgaga

SEQ ID NO: 431879 - RNA, 24 nt, Human
ccgagucacccagggaggagcugg

SEQ ID NO: 431880 - RNA, 26 nt, Human
ccgcccccucccuuccccucagcagc

SEQ ID NO: 431881 - RNA, 22 nt, Human
ccuccaaaaucaccuaggcaag

SEQ ID NO: 431882 - RNA, 25 nt, Human
ccuccaaaaucaccuaggcaaggac

SEQ ID NO: 431883 - RNA, 18 nt, Human
ccugccaccuccccuccc

SEQ ID NO: 431884 - RNA, 24 nt, Human
cgacugaacaaucugaaacccaaa

SEQ ID NO: 431885 - RNA, 19 nt, Human
cgcccccucccacuagccc

SEQ ID NO: 431886 - RNA, 20 nt, Human
cgcccccucccacuagcccg

SEQ ID NO: 431887 - RNA, 25 nt, Human
cgcccccucccuuccccucagcagc

SEQ ID NO: 431888 - RNA, 22 nt, Human
cgccgcccccucccacuagccc

SEQ ID NO: 431889 - RNA, 23 nt, Human
cgccgcgcaggcgcgcgcgcgcg

SEQ ID NO: 431890 - RNA, 20 nt, Human
cgcgagccggggcgggggcg

SEQ ID NO: 431891 - RNA, 19 nt, Human
cgcgcagccaagaagggca

SEQ ID NO: 431892 - RNA, 20 nt, Human
cgcgcaggcgcgcgcgcgcg

SEQ ID NO: 431893 - RNA, 20 nt, Human
cggagccuggagggcggugg

SEQ ID NO: 431894 - RNA, 23 nt, Human
cggaggaaacaaaaggcgaaggc

SEQ ID NO: 431895 - RNA, 18 nt, Human
cggcgccggcgcgcagcc

SEQ ID NO: 431896 - RNA, 22 nt, Human
cggggaggagaaggaggggucc

SEQ ID NO: 431897 - RNA, 20 nt, Human
cgggggcgccggagcggagg

SEQ ID NO: 431898 - RNA, 18 nt, Human
cggggugcaccacccccc

SEQ ID NO: 431899 - RNA, 23 nt, Human
cguguccacacuccccacacgug

SEQ ID NO: 431900 - RNA, 23 nt, Human
cucacaugugacacaacugaggu

SEQ ID NO: 431901 - RNA, 20 nt, Human
cuccgcauucacagcauuuc

SEQ ID NO: 431902 - RNA, 20 nt, Human
cuccucuccgcccgcccgcc

SEQ ID NO: 431903 - RNA, 22 nt, Human
cucuccucuccgcccgcccgcc

SEQ ID NO: 431904 - RNA, 21 nt, Human
cugaaauuuggggugggggug

SEQ ID NO: 431905 - RNA, 21 nt, Human
cugaaauuuggggugggggug

SEQ ID NO: 431906 - RNA, 18 nt, Human
cugaggagagaaagguga

SEQ ID NO: 431907 - RNA, 19 nt, Human
cugcaaacgcgccugccac

SEQ ID NO: 431908 - RNA, 19 nt, Human
cugcgcgccacucucuccu

SEQ ID NO: 431909 - RNA, 23 nt, Human
cuggcgucuucaggucgcuggca

SEQ ID NO: 431910 - RNA, 20 nt, Human
cugguccuaaaaaauaauaa

SEQ ID NO: 431911 - RNA, 20 nt, Human
cugguccuaaaaaauaauaa

SEQ ID NO: 431912 - RNA, 23 nt, Human
cuuccacugucaacccucuccag

SEQ ID NO: 431913 - RNA, 20 nt, Human
cuucccggucuaccuuccgg

SEQ ID NO: 431914 - RNA, 19 nt, Human
gaaacaaaaggcgaaggcg

SEQ ID NO: 431915 - RNA, 23 nt, Human
gaaacaaaaggcgaaggcgaagg

SEQ ID NO: 431916 - RNA, 18 nt, Human
gaagcagauaagcuggug

SEQ ID NO: 431917 - RNA, 24 nt, Human
gaccugcuaauaaaccucaaaaac

SEQ ID NO: 431918 - RNA, 18 nt, Human
gacucacucguggagugg

SEQ ID NO: 431919 - RNA, 18 nt, Human
gagaaagagccauuggca

SEQ ID NO: 431920 - RNA, 18 nt, Human
gagccuggagggcggugg

SEQ ID NO: 431921 - RNA, 22 nt, Human
gagucacccagggaggagcugg

SEQ ID NO: 431922 - RNA, 20 nt, Human
gagugggguuggggggcagu

SEQ ID NO: 431923 - RNA, 20 nt, Human
gagugggguuggggggcagu

SEQ ID NO: 431924 - RNA, 18 nt, Human
gcaccugcccgcccccuc

SEQ ID NO: 431925 - RNA, 22 nt, Human
gcagcagacguguccacacucc

SEQ ID NO: 431926 - RNA, 21 nt, Human
gccaacccccgcccucgcugg

SEQ ID NO: 431927 - RNA, 21 nt, Human
gcccaggucccccagggggcc

SEQ ID NO: 431928 - RNA, 22 nt, Human
gcccaggucccccagggggccc

SEQ ID NO: 431929 - RNA, 18 nt, Human
gccgaguguacacgcccc

SEQ ID NO: 431930 - RNA, 18 nt, Human
gccggcccgaggcucugu

SEQ ID NO: 431931 - RNA, 19 nt, Human
gccggcugucccaccuucc

SEQ ID NO: 431932 - RNA, 19 nt, Human
gccggcugucccaccuucc

SEQ ID NO: 431933 - RNA, 24 nt, Human
gccuaugggaagugaugccagggg

SEQ ID NO: 431934 - RNA, 18 nt, Human
gcgcagccaagaagggca

SEQ ID NO: 431935 - RNA, 18 nt, Human
gcggcggcggcggcagag

SEQ ID NO: 431936 - RNA, 24 nt, Human
gcggcggcggcggcagaguaggcc

SEQ ID NO: 431937 - RNA, 23 nt, Human
gcggcggcggcggcggcuggagc

SEQ ID NO: 431938 - RNA, 24 nt, Human
gcggcggcggcggcggcuggagcg

SEQ ID NO: 431939 - RNA, 21 nt, Human
gcggggugcaccaccccccac

SEQ ID NO: 431940 - RNA, 20 nt, Human
gcgguggcggcggcggcggc

SEQ ID NO: 431941 - RNA, 23 nt, Human
gcgguggcggcggcggcggcggc

SEQ ID NO: 431942 - RNA, 22 nt, Human
gcuuccuuaaaaacaguuggga

SEQ ID NO: 431943 - RNA, 22 nt, Human
gcuuccuuaaaaacaguuggga

SEQ ID NO: 431944 - RNA, 22 nt, Human
ggaaaaggcaagagagcccaga

SEQ ID NO: 431945 - RNA, 22 nt, Human
ggacacucaccccaugguccau

SEQ ID NO: 431946 - RNA, 22 nt, Human
ggacacucaccccaugguccau

SEQ ID NO: 431947 - RNA, 22 nt, Human
ggaggaaacaaaaggcgaaggc

SEQ ID NO: 431948 - RNA, 25 nt, Human
ggagggcgguggcggcggcggcggg

SEQ ID NO: 431949 - RNA, 20 nt, Human
ggauccgagggagggggucu

SEQ ID NO: 431950 - RNA, 22 nt, Human
ggccaaaugccccuccuguucc

SEQ ID NO: 431951 - RNA, 20 nt, Human
gggcacaccaauaaggaucc

SEQ ID NO: 431952 - RNA, 23 nt, Human
gggcagcauggguugacucuagu

SEQ ID NO: 431953 - RNA, 23 nt, Human
gggcccaggucccccagggggcc

SEQ ID NO: 431954 - RNA, 26 nt, Human
gggcggcggcggcggcagaguaggcc

SEQ ID NO: 431955 - RNA, 21 nt, Human
gggcgggcggcggcggcggca

SEQ ID NO: 431956 - RNA, 24 nt, Human
gggcgguggcggcggcggcggcgg

SEQ ID NO: 431957 - RNA, 26 nt, Human
gggcgguggcggcggcggcggcggcu

SEQ ID NO: 431958 - RNA, 18 nt, Human
ggggaggagaaggagggg

SEQ ID NO: 431959 - RNA, 18 nt, Human
ggggcgccggagcggagg

SEQ ID NO: 431960 - RNA, 18 nt, Human
ggggugccaucugugaaa

SEQ ID NO: 431961 - RNA, 21 nt, Human
gggguggccaggccccagucu

SEQ ID NO: 431962 - RNA, 19 nt, Human
gguggagaaggaguuggag

SEQ ID NO: 431963 - RNA, 19 nt, Human
gguggagaaggaguuggag

SEQ ID NO: 431964 - RNA, 23 nt, Human
guggaguggggaaagggguggcc

SEQ ID NO: 431965 - RNA, 20 nt, Human
guggcggcggcggcggcggc

SEQ ID NO: 431966 - RNA, 22 nt, Human
guggcggcggcggcggcggcug

SEQ ID NO: 431967 - RNA, 21 nt, Human
uaaaacccaacagcauguugg

SEQ ID NO: 431968 - RNA, 21 nt, Human
uaaaacccaacagcauguugg

SEQ ID NO: 431969 - RNA, 24 nt, Human
uaaaccucaaaaacacaaaagucu

SEQ ID NO: 431970 - RNA, 19 nt, Human
uaauaauaauaauuagaga

SEQ ID NO: 431971 - RNA, 19 nt, Human
uaauaauaauaauuagaga

SEQ ID NO: 431972 - RNA, 19 nt, Human
uacagaacccaaacaucac

SEQ ID NO: 431973 - RNA, 20 nt, Human
uacagaacccaaacaucacu

SEQ ID NO: 431974 - RNA, 24 nt, Human
uauaaagcuacucauuaguuuggu

SEQ ID NO: 431975 - RNA, 20 nt, Human
ucaaguaggacuuagagcgg

SEQ ID NO: 431976 - RNA, 19 nt, Human
ucacagcauuucccagcag

SEQ ID NO: 431977 - RNA, 24 nt, Human
ucacagcauuucccagcagucccc

SEQ ID NO: 431978 - RNA, 24 nt, Human
ucaccugggauagcuuucaguagc

SEQ ID NO: 431979 - RNA, 24 nt, Human
ucaccugggauagcuuucaguagc

SEQ ID NO: 431980 - RNA, 20 nt, Human
ucacuacaacugguccuaaa

SEQ ID NO: 431981 - RNA, 20 nt, Human
ucacuacaacugguccuaaa

SEQ ID NO: 431982 - RNA, 19 nt, Human
ucagaucaauucacaucac

SEQ ID NO: 431983 - RNA, 19 nt, Human
ucagaucaauucacaucac

SEQ ID NO: 431984 - RNA, 20 nt, Human
ucagcagcgagaagcggggc

SEQ ID NO: 431985 - RNA, 24 nt, Human
ucccaacagcauugaaacccccua

SEQ ID NO: 431986 - RNA, 24 nt, Human
ucccaacagcauugaaacccccua

SEQ ID NO: 431987 - RNA, 20 nt, Human
ucccaccuuccugguuccca

SEQ ID NO: 431988 - RNA, 20 nt, Human
ucccaccuuccugguuccca

SEQ ID NO: 431989 - RNA, 20 nt, Human
ucccaccuuccugguuccca

SEQ ID NO: 431990 - RNA, 20 nt, Human
ucccaccuuccugguuccca

SEQ ID NO: 431991 - RNA, 21 nt, Human
ucccaccuuccugguucccaa

SEQ ID NO: 431992 - RNA, 21 nt, Human
ucccaccuuccugguucccaa

SEQ ID NO: 431993 - RNA, 20 nt, Human
uccccagaugguuguuuccg

SEQ ID NO: 431994 - RNA, 20 nt, Human
uccccagaugguuguuuccg

SEQ ID NO: 431995 - RNA, 24 nt, Human
uccccagaugguuguuuccguggg

SEQ ID NO: 431996 - RNA, 24 nt, Human
uccccagaugguuguuuccguggg

SEQ ID NO: 431997 - RNA, 27 nt, Human
uccccagaugguuguuuccgugggagg

SEQ ID NO: 431998 - RNA, 21 nt, Human
ucccggagccuggagggcggu

SEQ ID NO: 431999 - RNA, 22 nt, Human
ucccggucuaccuuccgggggg

SEQ ID NO: 432000 - RNA, 23 nt, Human
uccugcaaacgcgccugccaccu

SEQ ID NO: 432001 - RNA, 18 nt, Human
ucucccaaaagcaggggu

SEQ ID NO: 432002 - RNA, 25 nt, Human
ucucccaaaagcaggggucucaggc

SEQ ID NO: 432003 - RNA, 19 nt, Human
ucugaaacccaaaggacuu

SEQ ID NO: 432004 - RNA, 23 nt, Human
ucugcugaggagagaaaggugag

SEQ ID NO: 432005 - RNA, 19 nt, Human
ugaaaggggggaaaaggca

SEQ ID NO: 432006 - RNA, 28 nt, Human
ugaauaaaaaucucucagcuacagaacc

SEQ ID NO: 432007 - RNA, 28 nt, Human
ugaauaaaaaucucucagcuacagaacc

SEQ ID NO: 432008 - RNA, 24 nt, Human
ugaugccaggggaagggaagcaga

SEQ ID NO: 432009 - RNA, 21 nt, Human
ugcaccuucuggauguguuug

SEQ ID NO: 432010 - RNA, 21 nt, Human
ugcccaggggugccaucugug

SEQ ID NO: 432011 - RNA, 21 nt, Human
ugccccuccuguucccuucca

SEQ ID NO: 432012 - RNA, 24 nt, Human
ugccucauuucccuucaggcccca

SEQ ID NO: 432013 - RNA, 23 nt, Human
ugccuuggaggccuauguagugu

SEQ ID NO: 432014 - RNA, 23 nt, Human
ugccuuggaggccuauguagugu

SEQ ID NO: 432015 - RNA, 18 nt, Human
ugcgccgaguguacacgc

SEQ ID NO: 432016 - RNA, 18 nt, Human
ugcggagugcuaaagggc

SEQ ID NO: 432017 - RNA, 20 nt, Human
ugcuagccucucccaaaagc

SEQ ID NO: 432018 - RNA, 21 nt, Human
ugcucacaugugacacaacug

SEQ ID NO: 432019 - RNA, 21 nt, Human
ugcucacaugugacacaacug

SEQ ID NO: 432020 - RNA, 20 nt, Human
ugcugggcaggaaccacccu

SEQ ID NO: 432021 - RNA, 22 nt, Human
uggagcccuccaggcagagggc

SEQ ID NO: 432022 - RNA, 22 nt, Human
uggagcccuccaggcagagggc

SEQ ID NO: 432023 - RNA, 18 nt, Human
uggaggccuauguagugu

SEQ ID NO: 432024 - RNA, 18 nt, Human
uggaggccuauguagugu

SEQ ID NO: 432025 - RNA, 29 nt, Human
uggagggcgguggcggcggcggcggcgac

SEQ ID NO: 432026 - RNA, 21 nt, Human
uggagugggguuggggggcag

SEQ ID NO: 432027 - RNA, 21 nt, Human
uggagugggguuggggggcag

SEQ ID NO: 432028 - RNA, 24 nt, Human
uggccaggccccagucuagaaacc

SEQ ID NO: 432029 - RNA, 19 nt, Human
uggcggcggcggcggcggc

SEQ ID NO: 432030 - RNA, 19 nt, Human
ugggaagggcagagggcag

SEQ ID NO: 432031 - RNA, 21 nt, Human
ugggaagggcagagggcagca

SEQ ID NO: 432032 - RNA, 18 nt, Human
ugggagaauggguggugg

SEQ ID NO: 432033 - RNA, 18 nt, Human
ugggagaauggguggugg

SEQ ID NO: 432034 - RNA, 20 nt, Human
ugggcuugcucacaugugac

SEQ ID NO: 432035 - RNA, 20 nt, Human
ugggcuugcucacaugugac

SEQ ID NO: 432036 - RNA, 20 nt, Human
uggggguguccucaacagcc

SEQ ID NO: 432037 - RNA, 20 nt, Human
uggggguguccucaacagcc

SEQ ID NO: 432038 - RNA, 21 nt, Human
uggggucacuaagaauugagc

SEQ ID NO: 432039 - RNA, 21 nt, Human
uggggucacuaagaauugagc

SEQ ID NO: 432040 - RNA, 24 nt, Human
ugggugguggagaaggaguuggag

SEQ ID NO: 432041 - RNA, 24 nt, Human
ugggugguggagaaggaguuggag

SEQ ID NO: 432042 - RNA, 23 nt, Human
ugugaaaggggggaaaaggcaag

SEQ ID NO: 432043 - RNA, 21 nt, Human
ugugccagucuucucuggagg

SEQ ID NO: 432044 - RNA, 20 nt, Human
uuaaaaacaguugggcaucc

SEQ ID NO: 432045 - RNA, 20 nt, Human
uuaaaaacaguugggcaucc

SEQ ID NO: 432046 - RNA, 22 nt, Human
uucacagcauuucccagcaguc

SEQ ID NO: 432047 - RNA, 21 nt, Human
uuccacugucaacccucucca

SEQ ID NO: 432048 - RNA, 21 nt, Human
uucccaacagcauugaaaccc

SEQ ID NO: 432049 - RNA, 21 nt, Human
uucccaacagcauugaaaccc

SEQ ID NO: 432050 - RNA, 19 nt, Human
uucccgggcccgcuggggg

SEQ ID NO: 432051 - RNA, 21 nt, Human
uuccugguucccaacagcauu

SEQ ID NO: 432052 - RNA, 21 nt, Human
uuccugguucccaacagcauu

SEQ ID NO: 432053 - RNA, 22 nt, Human
uuggguauaggauuggggucac

SEQ ID NO: 432054 - RNA, 22 nt, Human
uuggguauaggauuggggucac

SEQ ID NO: 432055 - RNA, 20 nt, Human
uugugccagucuucucugga

SEQ ID NO: 432056 - RNA, 25 nt, Human
uuuaauacuaacccuaaugugugac

SEQ ID NO: 432057 - RNA, 25 nt, Human
uuuaauacuaacccuaaugugugac

SEQ ID NO: 432058 - RNA, 18 nt, Human
uuucccgggcccgcuggg

SEQ ID NO: 432059 - RNA, 23 nt, Human
uuucuuccauagacuucaaacaa

SEQ ID NO: 432060 - RNA, 23 nt, Human
uuucuuccauagacuucaaacaa

SEQ ID NO: 432061 - RNA, 21 nt, Human
uuugaaggauaugggaaggga

SEQ ID NO: 432062 - RNA, 21 nt, Human
uuugaaggauaugggaaggga

SEQ ID NO: 432063 - RNA, 19 nt, Human
aaaaaagccuucuaccuuc

SEQ ID NO: 432064 - RNA, 19 nt, Human
aaaaagccuucuaccuucc

SEQ ID NO: 432065 - RNA, 18 nt, Human
aaauccuccccagcuucc

SEQ ID NO: 432066 - RNA, 21 nt, Human
aacccuagagccagcaaaaaa

SEQ ID NO: 432067 - RNA, 22 nt, Human
aacuccuuccaggccucccccu

SEQ ID NO: 432068 - RNA, 22 nt, Human
aaggagcucagccccaggagcc

SEQ ID NO: 432069 - RNA, 23 nt, Human
aaggccucgaacuagaagaaccc

SEQ ID NO: 432070 - RNA, 20 nt, Human
aagugagcagcagcuguggg

SEQ ID NO: 432071 - RNA, 22 nt, Human
aauacaaacaguccagaaagaa

SEQ ID NO: 432072 - RNA, 19 nt, Human
acaaagguccuuccccucu

SEQ ID NO: 432073 - RNA, 19 nt, Human
acacacaccacacauacga

SEQ ID NO: 432074 - RNA, 21 nt, Human
acagcagacaagacccuccau

SEQ ID NO: 432075 - RNA, 19 nt, Human
accacacauacgaaguaac

SEQ ID NO: 432076 - RNA, 20 nt, Human
accacacauacgaaguaaca

SEQ ID NO: 432077 - RNA, 20 nt, Human
acccaaaggugggggcuggg

SEQ ID NO: 432078 - RNA, 23 nt, Human
accccacacacacaccacacaua

SEQ ID NO: 432079 - RNA, 24 nt, Human
accccacacacacaccacacauac

SEQ ID NO: 432080 - RNA, 21 nt, Human
acuccuuccaggccucccccu

SEQ ID NO: 432081 - RNA, 22 nt, Human
acuccuuccaggccucccccug

SEQ ID NO: 432082 - RNA, 18 nt, Human
agaacccuagagccagca

SEQ ID NO: 432083 - RNA, 21 nt, Human
agaagaacccuagagccagca

SEQ ID NO: 432084 - RNA, 19 nt, Human
agacgggagaacccaaggg

SEQ ID NO: 432085 - RNA, 22 nt, Human
agaggaaggagcucagccccag

SEQ ID NO: 432086 - RNA, 20 nt, Human
agaggauggggacccaaggc

SEQ ID NO: 432087 - RNA, 19 nt, Human
agcagacaagacccuccau

SEQ ID NO: 432088 - RNA, 24 nt, Human
agcagcagcagcaaguccgcagcc

SEQ ID NO: 432089 - RNA, 23 nt, Human
agcaucaagcucacagcauccag

SEQ ID NO: 432090 - RNA, 19 nt, Human
aggcagaggacaagggcug

SEQ ID NO: 432091 - RNA, 27 nt, Human
aggccaagcccagaaugaugcagagga

SEQ ID NO: 432092 - RNA, 19 nt, Human
auaaagggcucaguccaca

SEQ ID NO: 432093 - RNA, 18 nt, Human
aucguaagccugagucac

SEQ ID NO: 432094 - RNA, 20 nt, Human
aucguaagccugagucacag

SEQ ID NO: 432095 - RNA, 18 nt, Human
augaaaccuuuagguacc

SEQ ID NO: 432096 - RNA, 19 nt, Human
caacagggagccaggcccu

SEQ ID NO: 432097 - RNA, 24 nt, Human
caagacccuccauggccaccaacc

SEQ ID NO: 432098 - RNA, 19 nt, Human
cacagcauccagagucgaa

SEQ ID NO: 432099 - RNA, 21 nt, Human
caccacuuuguuucaauacaa

SEQ ID NO: 432100 - RNA, 21 nt, Human
caccccacacacacaccacac

SEQ ID NO: 432101 - RNA, 19 nt, Human
cacucagaccaacagggag

SEQ ID NO: 432102 - RNA, 21 nt, Human
cagaagaggccacuggcagca

SEQ ID NO: 432103 - RNA, 23 nt, Human
cagaggauggggacccaaggccu

SEQ ID NO: 432104 - RNA, 18 nt, Human
cagaggguccugcauucc

SEQ ID NO: 432105 - RNA, 19 nt, Human
cagcaaaaaaagccuucua

SEQ ID NO: 432106 - RNA, 22 nt, Human
cagcagcagcagcaaguccgca

SEQ ID NO: 432107 - RNA, 21 nt, Human
caggcagaggacaagggcugg

SEQ ID NO: 432108 - RNA, 21 nt, Human
ccacacauacgaaguaacaaa

SEQ ID NO: 432109 - RNA, 26 nt, Human
ccaccccacacacacaccacacauac

SEQ ID NO: 432110 - RNA, 21 nt, Human
cccacacacacaccacacaua

SEQ ID NO: 432111 - RNA, 22 nt, Human
cccacacacacaccacacauac

SEQ ID NO: 432112 - RNA, 19 nt, Human
ccccacacacacaccacac

SEQ ID NO: 432113 - RNA, 23 nt, Human
ccccagccugggaacuguggagu

SEQ ID NO: 432114 - RNA, 19 nt, Human
ccccagcuuccacaaggca

SEQ ID NO: 432115 - RNA, 18 nt, Human
ccccaggagccugccucu

SEQ ID NO: 432116 - RNA, 21 nt, Human
ccccaggagccugccucugcc

SEQ ID NO: 432117 - RNA, 24 nt, Human
ccccaggagccugccucugccucu

SEQ ID NO: 432118 - RNA, 24 nt, Human
ccccugguuccagaggauggggac

SEQ ID NO: 432119 - RNA, 20 nt, Human
cccuagagccagcaaaaaaa

SEQ ID NO: 432120 - RNA, 18 nt, Human
cccucugggggaggggca

SEQ ID NO: 432121 - RNA, 23 nt, Human
ccuacaacccaaaggugggggcu

SEQ ID NO: 432122 - RNA, 24 nt, Human
ccuacaacccaaaggugggggcug

SEQ ID NO: 432123 - RNA, 18 nt, Human
ccucaaaggccaccccac

SEQ ID NO: 432124 - RNA, 21 nt, Human
ccucccccugguuccagagga

SEQ ID NO: 432125 - RNA, 22 nt, Human
ccucccccugguuccagaggau

SEQ ID NO: 432126 - RNA, 19 nt, Human
ccucgaacuagaagaaccc

SEQ ID NO: 432127 - RNA, 19 nt, Human
ccucuccuggcacccagaa

SEQ ID NO: 432128 - RNA, 19 nt, Human
ccuggccagcaucaagcuc

SEQ ID NO: 432129 - RNA, 23 nt, Human
ccuucuaccuuccgcuuucccua

SEQ ID NO: 432130 - RNA, 18 nt, Human
cuacagugaacuccuucc

SEQ ID NO: 432131 - RNA, 25 nt, Human
cucaaaggccaccccacacacacac

SEQ ID NO: 432132 - RNA, 19 nt, Human
cucagaccaacagggagcc

SEQ ID NO: 432133 - RNA, 24 nt, Human
cugaccauuccccucacaggagug

SEQ ID NO: 432134 - RNA, 26 nt, Human
cugaucccaaaugaaaccuuuaggua

SEQ ID NO: 432135 - RNA, 19 nt, Human
cugccucugccucucacau

SEQ ID NO: 432136 - RNA, 22 nt, Human
cuuccacaaggcaaagcauccc

SEQ ID NO: 432137 - RNA, 20 nt, Human
cuuccaggccucccccuggu

SEQ ID NO: 432138 - RNA, 23 nt, Human
cuuccgcuuucccuaccugggga

SEQ ID NO: 432139 - RNA, 19 nt, Human
gacaagagucuaacacacg

SEQ ID NO: 432140 - RNA, 21 nt, Human
gagcagcagcugugggggcag

SEQ ID NO: 432141 - RNA, 21 nt, Human
gaggggcaaggggaagagugg

SEQ ID NO: 432142 - RNA, 20 nt, Human
gaggguccugcauuccacag

SEQ ID NO: 432143 - RNA, 19 nt, Human
gcaggacagaaggacaaga

SEQ ID NO: 432144 - RNA, 24 nt, Human
gccaccccacacacacaccacaca

SEQ ID NO: 432145 - RNA, 19 nt, Human
gccccaggagccugccucu

SEQ ID NO: 432146 - RNA, 24 nt, Human
gccucucacauccucugcuucccu

SEQ ID NO: 432147 - RNA, 18 nt, Human
gccugagucacagagcuc

SEQ ID NO: 432148 - RNA, 19 nt, Human
gcucagccccaggagccug

SEQ ID NO: 432149 - RNA, 18 nt, Human
gcugagacugccggugcg

SEQ ID NO: 432150 - RNA, 19 nt, Human
gcugggcugagacugccgg

SEQ ID NO: 432151 - RNA, 21 nt, Human
ggaagaagggauaaagaaugu

SEQ ID NO: 432152 - RNA, 20 nt, Human
ggcugggcugagacugccgg

SEQ ID NO: 432153 - RNA, 24 nt, Human
gggugcuguccaggccaagcccag

SEQ ID NO: 432154 - RNA, 19 nt, Human
ggucuguguugcuugggag

SEQ ID NO: 432155 - RNA, 23 nt, Human
ggugcuguccaggccaagcccag

SEQ ID NO: 432156 - RNA, 23 nt, Human
uacaacccaaaggugggggcugg

SEQ ID NO: 432157 - RNA, 23 nt, Human
uaccuggggaaagucuggaccca

SEQ ID NO: 432158 - RNA, 22 nt, Human
uagagccagcaaaaaaagccuu

SEQ ID NO: 432159 - RNA, 23 nt, Human
uagagccagcaaaaaaagccuuc

SEQ ID NO: 432160 - RNA, 20 nt, Human
uagguaccagguaaaguuuc

SEQ ID NO: 432161 - RNA, 22 nt, Human
uccacagcagaugguacagagg

SEQ ID NO: 432162 - RNA, 22 nt, Human
uccagaaagaaagucaaguccc

SEQ ID NO: 432163 - RNA, 25 nt, Human
uccaggccucccccugguuccagag

SEQ ID NO: 432164 - RNA, 20 nt, Human
ucccuggccagcaucaagcu

SEQ ID NO: 432165 - RNA, 19 nt, Human
uccuuccaggccucccccu

SEQ ID NO: 432166 - RNA, 20 nt, Human
ucgaaucacagcagacaaga

SEQ ID NO: 432167 - RNA, 23 nt, Human
ucugggggaggggcaaggggaag

SEQ ID NO: 432168 - RNA, 19 nt, Human
ugagagggaauaaagggcu

SEQ ID NO: 432169 - RNA, 22 nt, Human
ugagcagcagcugugggggcag

SEQ ID NO: 432170 - RNA, 18 nt, Human
ugcuuggcucagcugcca

SEQ ID NO: 432171 - RNA, 25 nt, Human
uggcagcagcagcagcagcaagucc

SEQ ID NO: 432172 - RNA, 24 nt, Human
uggcgggugcuguccaggccaagc

SEQ ID NO: 432173 - RNA, 21 nt, Human
ugggggaacccccuuucccag

SEQ ID NO: 432174 - RNA, 18 nt, Human
ugggggaggggcaagggg

SEQ ID NO: 432175 - RNA, 24 nt, Human
ugguaacgcccagacaaagguccu

SEQ ID NO: 432176 - RNA, 22 nt, Human
uggugugagagggaauaaaggg

SEQ ID NO: 432177 - RNA, 22 nt, Human
uggugugagagggaauaaaggg

SEQ ID NO: 432178 - RNA, 23 nt, Human
uggugugagagggaauaaagggc

SEQ ID NO: 432179 - RNA, 18 nt, Human
ugucacagaggguccugc

SEQ ID NO: 432180 - RNA, 23 nt, Human
ugucacagaggguccugcauucc

SEQ ID NO: 432181 - RNA, 20 nt, Human
ugugggggcaggacagaagg

SEQ ID NO: 432182 - RNA, 23 nt, Human
uguugccgucaccaucguaagcc

SEQ ID NO: 432183 - RNA, 18 nt, Human
aagcuuucagccacagcu

SEQ ID NO: 432184 - RNA, 19 nt, Human
acagaacacacuuggugga

SEQ ID NO: 432185 - RNA, 22 nt, Human
accuugaaaaugaaaaaggaac

SEQ ID NO: 432186 - RNA, 27 nt, Human
caaagccuuuaguaauagcucaaaucc

SEQ ID NO: 432187 - RNA, 21 nt, Human
cacagcucaaaccucacccuc

SEQ ID NO: 432188 - RNA, 22 nt, Human
cacagcucaaaccucacccucc

SEQ ID NO: 432189 - RNA, 22 nt, Human
cacccuccauuacagaacacac

SEQ ID NO: 432190 - RNA, 22 nt, Human
cagacucagcgggaagcggguu

SEQ ID NO: 432191 - RNA, 22 nt, Human
ccuaugacuguaaguguggaaa

SEQ ID NO: 432192 - RNA, 22 nt, Human
ccuccauuacagaacacacuug

SEQ ID NO: 432193 - RNA, 23 nt, Human
cucacccuccauuacagaacaca

SEQ ID NO: 432194 - RNA, 18 nt, Human
cuucaagaggcaggcucc

SEQ ID NO: 432195 - RNA, 26 nt, Human
cuucaagaggcaggcuccaagaaagg

SEQ ID NO: 432196 - RNA, 20 nt, Human
gaacacacuugguggaccgg

SEQ ID NO: 432197 - RNA, 20 nt, Human
gcucaaaucucaccaaacac

SEQ ID NO: 432198 - RNA, 21 nt, Human
ggaaaagcuuuugggcagagc

SEQ ID NO: 432199 - RNA, 19 nt, Human
gugugcaccaaguguggga

SEQ ID NO: 432200 - RNA, 19 nt, Human
uccugggugcagacucagc

SEQ ID NO: 432201 - RNA, 21 nt, Human
ugaaaaaggaacaaaaccccc

SEQ ID NO: 432202 - RNA, 19 nt, Human
uggaaaagcuuuugggcag

SEQ ID NO: 432203 - RNA, 20 nt, Human
uuuuuuuuuuuugaggggcu

SEQ ID NO: 432204 - RNA, 23 nt, Human
uuuuuuuuuuuuugaggggcuca

SEQ ID NO: 432205 - RNA, 23 nt, Human
uuuuuuuuuuuuuuuuuugaggg

SEQ ID NO: 432206 - RNA, 18 nt, Human
acuccugcuuacgaccuc

SEQ ID NO: 432207 - RNA, 21 nt, Human
agacaaaggccggcgccgagc

SEQ ID NO: 432208 - RNA, 21 nt, Human
agagaacuucucuucaggaaa

SEQ ID NO: 432209 - RNA, 24 nt, Human
cagucaccaccucuucauaugauu

SEQ ID NO: 432210 - RNA, 18 nt, Human
ccaccucuucauaugauu

SEQ ID NO: 432211 - RNA, 25 nt, Human
cccgcagacaaaggccggcgccgag

SEQ ID NO: 432212 - RNA, 21 nt, Human
ccgagcccgcagcagcgccag

SEQ ID NO: 432213 - RNA, 20 nt, Human
cggcgccgagcccgcagcag

SEQ ID NO: 432214 - RNA, 22 nt, Human
cgugcccgcagacaaaggccgg

SEQ ID NO: 432215 - RNA, 21 nt, Human
gaacuggauagguugcuucau

SEQ ID NO: 432216 - RNA, 18 nt, Human
gaccucagucaccaccuc

SEQ ID NO: 432217 - RNA, 21 nt, Human
gcuguuccugagcaccgcagc

SEQ ID NO: 432218 - RNA, 20 nt, Human
ggggaaaggaaaaaaaucag

SEQ ID NO: 432219 - RNA, 24 nt, Human
uuuauuuuucauacucuuuugggg

SEQ ID NO: 432220 - RNA, 22 nt, Human
aaaaaacaaaauuaagcaaaaa

SEQ ID NO: 432221 - RNA, 23 nt, Human
aaaaaacaaaauuaagcaaaaaa

SEQ ID NO: 432222 - RNA, 25 nt, Human
aaaaaacaaaauuaagcaaaaaaga

SEQ ID NO: 432223 - RNA, 24 nt, Human
aaaaacaaaauuaagcaaaaaaga

SEQ ID NO: 432224 - RNA, 20 nt, Human
aaaacaaaauuaagcaaaaa

SEQ ID NO: 432225 - RNA, 18 nt, Human
aaccagaaauauuagaau

SEQ ID NO: 432226 - RNA, 23 nt, Human
aagcuucuucuugaguuucuucc

SEQ ID NO: 432227 - RNA, 19 nt, Human
acagacccagaggucccca

SEQ ID NO: 432228 - RNA, 20 nt, Human
accaggcagauaaccugccu

SEQ ID NO: 432229 - RNA, 24 nt, Human
agaaaacagcaaagaggugucuca

SEQ ID NO: 432230 - RNA, 24 nt, Human
agaggaggaagaaaacagcaaaga

SEQ ID NO: 432231 - RNA, 19 nt, Human
aggaagaaaacagcaaaga

SEQ ID NO: 432232 - RNA, 20 nt, Human
aggaagaaaacagcaaagag

SEQ ID NO: 432233 - RNA, 18 nt, Human
agggccaagaugaguacu

SEQ ID NO: 432234 - RNA, 18 nt, Human
agugaauuguugaacugc

SEQ ID NO: 432235 - RNA, 18 nt, Human
auggagacuagggaaugg

SEQ ID NO: 432236 - RNA, 24 nt, Human
cauuccuaggaaagccacauucca

SEQ ID NO: 432237 - RNA, 18 nt, Human
ccacuucagagaacauga

SEQ ID NO: 432238 - RNA, 21 nt, Human
cccaaauagcaucauuaccac

SEQ ID NO: 432239 - RNA, 19 nt, Human
cccaaauggaaugcgaugg

SEQ ID NO: 432240 - RNA, 21 nt, Human
ccccaaauagcaucauuacca

SEQ ID NO: 432241 - RNA, 20 nt, Human
cucucaauucugcagucauc

SEQ ID NO: 432242 - RNA, 19 nt, Human
cugcagucaucuucucugc

SEQ ID NO: 432243 - RNA, 20 nt, Human
cuggaggucuuccucuuccu

SEQ ID NO: 432244 - RNA, 18 nt, Human
gaauggucagaacagacc

SEQ ID NO: 432245 - RNA, 24 nt, Human
gaggaggaagaaaacagcaaagag

SEQ ID NO: 432246 - RNA, 23 nt, Human
gccuaugugcgcagcugagaagc

SEQ ID NO: 432247 - RNA, 20 nt, Human
gcuggaggucuuccucuucc

SEQ ID NO: 432248 - RNA, 22 nt, Human
ggagaaggagcuguugaucuug

SEQ ID NO: 432249 - RNA, 20 nt, Human
uaaaaaacaaaauuaagcaa

SEQ ID NO: 432250 - RNA, 18 nt, Human
uaaauuagccucugaaau

SEQ ID NO: 432251 - RNA, 24 nt, Human
uaacuuuuaaggacacagcccuca

SEQ ID NO: 432252 - RNA, 19 nt, Human
uaagcaaaaaagaccuuuc

SEQ ID NO: 432253 - RNA, 19 nt, Human
uacaauaccaagguucagg

SEQ ID NO: 432254 - RNA, 22 nt, Human
uaggcaagcuuuauucuuugac

SEQ ID NO: 432255 - RNA, 23 nt, Human
uccccaaauagcaucauuaccac

SEQ ID NO: 432256 - RNA, 20 nt, Human
uccccagaucuuuacaauac

SEQ ID NO: 432257 - RNA, 20 nt, Human
uccuauagcugggcgcugcc

SEQ ID NO: 432258 - RNA, 21 nt, Human
uccuauagcugggcgcugccc

SEQ ID NO: 432259 - RNA, 24 nt, Human
uccuucauccaggaaggggcuguu

SEQ ID NO: 432260 - RNA, 21 nt, Human
uccuugagugcuuggccaugg

SEQ ID NO: 432261 - RNA, 24 nt, Human
ucucaauucugcagucaucuucuc

SEQ ID NO: 432262 - RNA, 25 nt, Human
ucugcagucaucuucucuucccuug

SEQ ID NO: 432263 - RNA, 18 nt, Human
ugaaaugcuuuucuugug

SEQ ID NO: 432264 - RNA, 20 nt, Human
ugcgaugggaauugggggcu

SEQ ID NO: 432265 - RNA, 22 nt, Human
ugugugguguccaucaauccuu

SEQ ID NO: 432266 - RNA, 23 nt, Human
uuacccagucaccacuuaaccag

SEQ ID NO: 432267 - RNA, 22 nt, Human
uuagccucugaaaugcuuuucu

SEQ ID NO: 432268 - RNA, 21 nt, Human
uuuuuuuuuuuuuuuuugccu

SEQ ID NO: 432269 - RNA, 25 nt, Human
uuuuuuuuuuuuuuuuugccucuag

SEQ ID NO: 432270 - RNA, 27 nt, Human
uuuuuuuuuuuuuuuuuuuuuuugggg

SEQ ID NO: 432271 - RNA, 18 nt, Human
aaaacauuuucugccucc

SEQ ID NO: 432272 - RNA, 24 nt, Human
aaaagcacaggaguuuucuacaaa

SEQ ID NO: 432273 - RNA, 19 nt, Human
aaacaaaagggggaaaugg

SEQ ID NO: 432274 - RNA, 24 nt, Human
aaagugcugggauuacaggcguga

SEQ ID NO: 432275 - RNA, 21 nt, Human
aacaaaagggggaaauggcuu

SEQ ID NO: 432276 - RNA, 21 nt, Human
aagaugacgaugauaaaguca

SEQ ID NO: 432277 - RNA, 28 nt, Human
aagcaacaaaaaucacaucuucugaacu

SEQ ID NO: 432278 - RNA, 19 nt, Human
aaguagcugggauuacagg

SEQ ID NO: 432279 - RNA, 25 nt, Human
aagugauucuccugccucagccucc

SEQ ID NO: 432280 - RNA, 19 nt, Human
aagugcugggauuacaggc

SEQ ID NO: 432281 - RNA, 19 nt, Human
aagugcugggauuacaggc

SEQ ID NO: 432282 - RNA, 26 nt, Human
aagugcugggauuacaggcgugagcc

SEQ ID NO: 432283 - RNA, 18 nt, Human
accacguuccuuuuucug

SEQ ID NO: 432284 - RNA, 18 nt, Human
accauguuggccaggcug

SEQ ID NO: 432285 - RNA, 20 nt, Human
accauguuggccaggcuggu

SEQ ID NO: 432286 - RNA, 23 nt, Human
accauguuggccaggcuggucuc

SEQ ID NO: 432287 - RNA, 21 nt, Human
acccaggcuggagugcagugu

SEQ ID NO: 432288 - RNA, 22 nt, Human
accgcaccuggccucaguugcu

SEQ ID NO: 432289 - RNA, 18 nt, Human
acgggauuuuaccauguu

SEQ ID NO: 432290 - RNA, 20 nt, Human
acgggauuuuaccauguugg

SEQ ID NO: 432291 - RNA, 24 nt, Human
acgggauuuuaccauguuggccag

SEQ ID NO: 432292 - RNA, 20 nt, Human
acuugcaacacguuuuccca

SEQ ID NO: 432293 - RNA, 26 nt, Human
agaagucagucugaaugagugccucu

SEQ ID NO: 432294 - RNA, 19 nt, Human
agacuggugcacauacccu

SEQ ID NO: 432295 - RNA, 20 nt, Human
agccaccgcaccuggccuca

SEQ ID NO: 432296 - RNA, 18 nt, Human
agccuuucccugcagggg

SEQ ID NO: 432297 - RNA, 22 nt, Human
agcuauagggaaguuguaguug

SEQ ID NO: 432298 - RNA, 21 nt, Human
aggcagaacacugcugaugug

SEQ ID NO: 432299 - RNA, 24 nt, Human
aggcuggagugcagugugcaaucu

SEQ ID NO: 432300 - RNA, 24 nt, Human
aggugauccgcucaccucggccuc

SEQ ID NO: 432301 - RNA, 22 nt, Human
aguagagacgggauuuuaccau

SEQ ID NO: 432302 - RNA, 24 nt, Human
agugauucuccugccucagccucc

SEQ ID NO: 432303 - RNA, 22 nt, Human
agugcagugugcaaucuuggcu

SEQ ID NO: 432304 - RNA, 23 nt, Human
agugcagugugcaaucuuggcuc

SEQ ID NO: 432305 - RNA, 18 nt, Human
agugcugggauuacaggc

SEQ ID NO: 432306 - RNA, 21 nt, Human
aucacaucuucugaacuccag

SEQ ID NO: 432307 - RNA, 21 nt, Human
aucagacccuagagguuuagc

SEQ ID NO: 432308 - RNA, 18 nt, Human
auucuccugccucagccu

SEQ ID NO: 432309 - RNA, 22 nt, Human
caaaaaaaaaaaaugaccuuca

SEQ ID NO: 432310 - RNA, 23 nt, Human
caaaagcacaggaguuuucuaca

SEQ ID NO: 432311 - RNA, 24 nt, Human
caaagugcugggauuacaggcgug

SEQ ID NO: 432312 - RNA, 18 nt, Human
caaaugauucagaaaauc

SEQ ID NO: 432313 - RNA, 20 nt, Human
caaccucugccuccuggguu

SEQ ID NO: 432314 - RNA, 23 nt, Human
caacuacuacauaaaggcagaac

SEQ ID NO: 432315 - RNA, 22 nt, Human
caagugauucuccugccucagc

SEQ ID NO: 432316 - RNA, 18 nt, Human
cacaacgaugggaccaau

SEQ ID NO: 432317 - RNA, 24 nt, Human
cacccugcgcacaacgaugggacu

SEQ ID NO: 432318 - RNA, 24 nt, Human
caccucggccucccaaagugcugg

SEQ ID NO: 432319 - RNA, 19 nt, Human
caccuggccucaguugcuu

SEQ ID NO: 432320 - RNA, 21 nt, Human
cacugcaaccucugccuccug

SEQ ID NO: 432321 - RNA, 23 nt, Human
cacugcaaccucugccuccuggg

SEQ ID NO: 432322 - RNA, 19 nt, Human
caggugcccaccaucaugc

SEQ ID NO: 432323 - RNA, 21 nt, Human
caggugcccaccaucaugccc

SEQ ID NO: 432324 - RNA, 18 nt, Human
cagugaaugacugaugag

SEQ ID NO: 432325 - RNA, 18 nt, Human
cauaaagccaaggagagg

SEQ ID NO: 432326 - RNA, 24 nt, Human
cauguuggccaggcuggucucaaa

SEQ ID NO: 432327 - RNA, 20 nt, Human
ccaaagugcugggauuacag

SEQ ID NO: 432328 - RNA, 22 nt, Human
ccaaagugcugggauuacaggc

SEQ ID NO: 432329 - RNA, 22 nt, Human
ccaaagugcugggauuacaggc

SEQ ID NO: 432330 - RNA, 24 nt, Human
ccaaagugcugggauuacaggcgu

SEQ ID NO: 432331 - RNA, 21 nt, Human
ccaaguagcugggauuacagg

SEQ ID NO: 432332 - RNA, 20 nt, Human
ccauuucaguagaacugauc

SEQ ID NO: 432333 - RNA, 22 nt, Human
cccaaguagcugggauuacagg

SEQ ID NO: 432334 - RNA, 23 nt, Human
cccaaguagcugggauuacaggu

SEQ ID NO: 432335 - RNA, 24 nt, Human
cccaaguagcugggauuacaggug

SEQ ID NO: 432336 - RNA, 19 nt, Human
ccccgggagcggccugggg

SEQ ID NO: 432337 - RNA, 21 nt, Human
ccgugagccccgggagcggcc

SEQ ID NO: 432338 - RNA, 24 nt, Human
ccuccuggguucaagugauucucc

SEQ ID NO: 432339 - RNA, 22 nt, Human
ccucugccuccuggguucaagu

SEQ ID NO: 432340 - RNA, 24 nt, Human
ccugaccucaggugauccgcucac

SEQ ID NO: 432341 - RNA, 23 nt, Human
ccugccucagccucccaaguagc

SEQ ID NO: 432342 - RNA, 23 nt, Human
ccuggguucaagugauucuccuc

SEQ ID NO: 432343 - RNA, 23 nt, Human
ccuggguucaagugauucuccug

SEQ ID NO: 432344 - RNA, 18 nt, Human
ccuuguggcuacgaaggu

SEQ ID NO: 432345 - RNA, 24 nt, Human
cgggagcggccugggggcgcuggg

SEQ ID NO: 432346 - RNA, 18 nt, Human
cuacuacauaaaggcaga

SEQ ID NO: 432347 - RNA, 24 nt, Human
cuagucacccaggcuggagugcag

SEQ ID NO: 432348 - RNA, 25 nt, Human
cucaaaacuccugaccucaggugau

SEQ ID NO: 432349 - RNA, 28 nt, Human
cucacaaucuccugugugugaaacaguc

SEQ ID NO: 432350 - RNA, 24 nt, Human
cucacugcaaccucugccuccugg

SEQ ID NO: 432351 - RNA, 24 nt, Human
cucagccucccaaguagcugggau

SEQ ID NO: 432352 - RNA, 23 nt, Human
cuccaggaacugacuugauccaa

SEQ ID NO: 432353 - RNA, 19 nt, Human
cuccaggagcacacaucuc

SEQ ID NO: 432354 - RNA, 20 nt, Human
cuccuggguucaagugauuc

SEQ ID NO: 432355 - RNA, 21 nt, Human
cuccuggguucaagugauucu

SEQ ID NO: 432356 - RNA, 19 nt, Human
cugcaaccucugccuccug

SEQ ID NO: 432357 - RNA, 24 nt, Human
cugcaaccucugccuccuggguuc

SEQ ID NO: 432358 - RNA, 23 nt, Human
cugccucagccucccaaguagcu

SEQ ID NO: 432359 - RNA, 23 nt, Human
cugccuccuggguucaagugauu

SEQ ID NO: 432360 - RNA, 21 nt, Human
cuggaguaauggguuuuucuu

SEQ ID NO: 432361 - RNA, 25 nt, Human
cugggccaggcuaccauauuucagg

SEQ ID NO: 432362 - RNA, 19 nt, Human
cuuguccuacuugaguggc

SEQ ID NO: 432363 - RNA, 24 nt, Human
gaccucaggugauccgcucaccuc

SEQ ID NO: 432364 - RNA, 19 nt, Human
gaggacagaaccaucuaca

SEQ ID NO: 432365 - RNA, 18 nt, Human
gauuacaggcgugagcca

SEQ ID NO: 432366 - RNA, 20 nt, Human
gauuacaggcgugagccacc

SEQ ID NO: 432367 - RNA, 23 nt, Human
gauuacaggcgugagccaccgca

SEQ ID NO: 432368 - RNA, 21 nt, Human
gauuacaggugcccaccauca

SEQ ID NO: 432369 - RNA, 20 nt, Human
gccccgggagcggccugggg

SEQ ID NO: 432370 - RNA, 19 nt, Human
gcuagucacccaggcugga

SEQ ID NO: 432371 - RNA, 21 nt, Human
gcucacugcaaccucugccuc

SEQ ID NO: 432372 - RNA, 24 nt, Human
gcuggucucaaaacuccugaccuc

SEQ ID NO: 432373 - RNA, 20 nt, Human
ggaacaaaaacagcaucaga

SEQ ID NO: 432374 - RNA, 22 nt, Human
ggaguuuugcuagucacccagg

SEQ ID NO: 432375 - RNA, 24 nt, Human
ggauuacaggugcccaccaucaug

SEQ ID NO: 432376 - RNA, 22 nt, Human
ggauuuuaccauguuggccagg

SEQ ID NO: 432377 - RNA, 24 nt, Human
ggccaggcuaccauauuucaggga

SEQ ID NO: 432378 - RNA, 19 nt, Human
gggagagauguauuuggag

SEQ ID NO: 432379 - RNA, 23 nt, Human
gggauuuuaccauguuggccagg

SEQ ID NO: 432380 - RNA, 25 nt, Human
gggccaggcuaccauauuucaggga

SEQ ID NO: 432381 - RNA, 18 nt, Human
guagcugggauuacaggu

SEQ ID NO: 432382 - RNA, 24 nt, Human
gugauucuccugccucagccuccc

SEQ ID NO: 432383 - RNA, 24 nt, Human
guuuugcuagucacccaggcugga

SEQ ID NO: 432384 - RNA, 25 nt, Human
guuuuuguuuucacugucccucuuu

SEQ ID NO: 432385 - RNA, 20 nt, Human
uaacuuguggagaaaugcau

SEQ ID NO: 432386 - RNA, 18 nt, Human
uaaugcugaugaaacugc

SEQ ID NO: 432387 - RNA, 24 nt, Human
uaauuuuuauaauuuuaguagaga

SEQ ID NO: 432388 - RNA, 19 nt, Human
uacaaucaagugcuaacuu

SEQ ID NO: 432389 - RNA, 22 nt, Human
uacaggcgugagccaccgcacc

SEQ ID NO: 432390 - RNA, 23 nt, Human
uacaggcgugagccaccgcaccu

SEQ ID NO: 432391 - RNA, 21 nt, Human
uaccauguuggccaggcuggu

SEQ ID NO: 432392 - RNA, 24 nt, Human
uaccauguuggccaggcuggucuc

SEQ ID NO: 432393 - RNA, 22 nt, Human
uagagacgggauuuuaccaugu

SEQ ID NO: 432394 - RNA, 19 nt, Human
uaggcuaccagugaucaua

SEQ ID NO: 432395 - RNA, 24 nt, Human
uaguagagacgggauuuuaccaug

SEQ ID NO: 432396 - RNA, 24 nt, Human
uauauacaacuuaucguauauaua

SEQ ID NO: 432397 - RNA, 21 nt, Human
uauuucuuuuucccuccagga

SEQ ID NO: 432398 - RNA, 19 nt, Human
ucaagugauucuccugccu

SEQ ID NO: 432399 - RNA, 23 nt, Human
ucacccaggcuggagugcagugu

SEQ ID NO: 432400 - RNA, 24 nt, Human
ucacugcaaccucugccuccuggg

SEQ ID NO: 432401 - RNA, 25 nt, Human
ucacugcaaccucugccuccugggu

SEQ ID NO: 432402 - RNA, 27 nt, Human
ucacugcaaccucugccuccuggguuc

SEQ ID NO: 432403 - RNA, 20 nt, Human
ucagccucccaaguagcugg

SEQ ID NO: 432404 - RNA, 19 nt, Human
ucauacuguucagcagcua

SEQ ID NO: 432405 - RNA, 24 nt, Human
ucccaaagugcugggauuacaggc

SEQ ID NO: 432406 - RNA, 23 nt, Human
ucccaaguagcugggauuacagg

SEQ ID NO: 432407 - RNA, 24 nt, Human
ucccaaguagcugggauuacaggu

SEQ ID NO: 432408 - RNA, 24 nt, Human
ucccuugacaaccgaaucuuuuuu

SEQ ID NO: 432409 - RNA, 23 nt, Human
uccucuuuagaagcugggccagg

SEQ ID NO: 432410 - RNA, 21 nt, Human
uccuggguucaagugauucuc

SEQ ID NO: 432411 - RNA, 24 nt, Human
uccuggguucaagugauucuccug

SEQ ID NO: 432412 - RNA, 18 nt, Human
ucggccucccaaagugcu

SEQ ID NO: 432413 - RNA, 20 nt, Human
ucgggaagagauagaaaucu

SEQ ID NO: 432414 - RNA, 27 nt, Human
ucucagagcaacaaaauacauuuagua

SEQ ID NO: 432415 - RNA, 26 nt, Human
ucuccugccucagccucccaaguagc

SEQ ID NO: 432416 - RNA, 22 nt, Human
ucugaaaagcaacaaaaaucac

SEQ ID NO: 432417 - RNA, 19 nt, Human
ugaaaagcaacaaaaauca

SEQ ID NO: 432418 - RNA, 24 nt, Human
ugaaaagcaacaaaaaucacaucu

SEQ ID NO: 432419 - RNA, 20 nt, Human
ugaaaguuucauaaccucac

SEQ ID NO: 432420 - RNA, 19 nt, Human
ugaccucaggugauccgcu

SEQ ID NO: 432421 - RNA, 25 nt, Human
ugaccucaggugauccgcucaccuc

SEQ ID NO: 432422 - RNA, 23 nt, Human
ugacuugcaacacguuuucccaa

SEQ ID NO: 432423 - RNA, 19 nt, Human
ugauagucuugagguuugu

SEQ ID NO: 432424 - RNA, 22 nt, Human
ugauccaaacagggucugugcu

SEQ ID NO: 432425 - RNA, 24 nt, Human
ugauccgcucaccucggccuccca

SEQ ID NO: 432426 - RNA, 18 nt, Human
ugauguguuucuuuacua

SEQ ID NO: 432427 - RNA, 21 nt, Human
ugcaggcggcugacuagugcc

SEQ ID NO: 432428 - RNA, 21 nt, Human
ugcagugugcaaucuuggcuc

SEQ ID NO: 432429 - RNA, 24 nt, Human
ugcagugugcaaucuuggcucacu

SEQ ID NO: 432430 - RNA, 19 nt, Human
ugccacagaaagaugucaa

SEQ ID NO: 432431 - RNA, 24 nt, Human
ugcccggcuaauuuuuauaauuuu

SEQ ID NO: 432432 - RNA, 25 nt, Human
ugccgagaguccaagagugccuuaa

SEQ ID NO: 432433 - RNA, 24 nt, Human
ugccucagccucccaaguagcugg

SEQ ID NO: 432434 - RNA, 24 nt, Human
ugcugggauuacaggcgugagcca

SEQ ID NO: 432435 - RNA, 21 nt, Human
uggagugcagugugcaaucuu

SEQ ID NO: 432436 - RNA, 23 nt, Human
uggagugcagugugcaaucuugg

SEQ ID NO: 432437 - RNA, 23 nt, Human
uggaguuuugcuagucacccagg

SEQ ID NO: 432438 - RNA, 25 nt, Human
uggccaggcuggucucaaaacuccu

SEQ ID NO: 432439 - RNA, 18 nt, Human
ugggauuacaggcgugag

SEQ ID NO: 432440 - RNA, 19 nt, Human
ugggauuacaggcgugagc

SEQ ID NO: 432441 - RNA, 21 nt, Human
ugggauuacaggcgugagcca

SEQ ID NO: 432442 - RNA, 22 nt, Human
ugggauuacaggcgugagccac

SEQ ID NO: 432443 - RNA, 23 nt, Human
ugggauuacaggcgugagccacc

SEQ ID NO: 432444 - RNA, 24 nt, Human
ugggauuacaggcgugagccaccg

SEQ ID NO: 432445 - RNA, 21 nt, Human
ugggauuacaggugcccacca

SEQ ID NO: 432446 - RNA, 22 nt, Human
ugggauuacaggugcccaccau

SEQ ID NO: 432447 - RNA, 23 nt, Human
uggguucaagugauucuccugcc

SEQ ID NO: 432448 - RNA, 24 nt, Human
uggguucaagugauucuccugccu

SEQ ID NO: 432449 - RNA, 24 nt, Human
uggucucaaaacuccugaccucag

SEQ ID NO: 432450 - RNA, 24 nt, Human
ugucaaaaaaaaaaaaugaccuuc

SEQ ID NO: 432451 - RNA, 21 nt, Human
uguccugggagguuuuaugau

SEQ ID NO: 432452 - RNA, 22 nt, Human
ugugcucaccuuuauguccugg

SEQ ID NO: 432453 - RNA, 22 nt, Human
ugugcucaccuuuauguccugg

SEQ ID NO: 432454 - RNA, 23 nt, Human
ugugcucaccuuuauguccuggg

SEQ ID NO: 432455 - RNA, 26 nt, Human
uguggagaaaugcauuuaggagugcg

SEQ ID NO: 432456 - RNA, 21 nt, Human
uuaaaacauuuucugccucca

SEQ ID NO: 432457 - RNA, 18 nt, Human
uuaguagagacgggauuu

SEQ ID NO: 432458 - RNA, 18 nt, Human
uuaguagagacgggauuu

SEQ ID NO: 432459 - RNA, 24 nt, Human
uuaguagagacgggauuuuaccau

SEQ ID NO: 432460 - RNA, 20 nt, Human
uuaugauguguuucuuuacu

SEQ ID NO: 432461 - RNA, 21 nt, Human
uucaagugauucuccugccuc

SEQ ID NO: 432462 - RNA, 23 nt, Human
uucaagugauucuccugccucag

SEQ ID NO: 432463 - RNA, 24 nt, Human
uucaagugauucuccugccucagc

SEQ ID NO: 432464 - RNA, 22 nt, Human
uucucuuguguggaaaucucac

SEQ ID NO: 432465 - RNA, 19 nt, Human
uugauccaaacagggucug

SEQ ID NO: 432466 - RNA, 21 nt, Human
uugcuagucacccaggcugga

SEQ ID NO: 432467 - RNA, 24 nt, Human
uugcuagucacccaggcuggagug

SEQ ID NO: 432468 - RNA, 22 nt, Human
uuugcuagucacccaggcugga

SEQ ID NO: 432469 - RNA, 24 nt, Human
uuugcuagucacccaggcuggagu

SEQ ID NO: 432470 - RNA, 21 nt, Human
uuuuauaauuuuaguagagac

SEQ ID NO: 432471 - RNA, 22 nt, Human
uuuuaugauguguuucuuuacu

SEQ ID NO: 432472 - RNA, 21 nt, Human
uuuugcuagucacccaggcug

SEQ ID NO: 432473 - RNA, 23 nt, Human
uuuugcuagucacccaggcugga

SEQ ID NO: 432474 - RNA, 20 nt, Human
uuuuuauaauuuuaguagag

SEQ ID NO: 432475 - RNA, 19 nt, Human
agcuccuggggcaggaugg

SEQ ID NO: 432476 - RNA, 23 nt, Human
agguacuugccuuucucuucuuu

SEQ ID NO: 432477 - RNA, 21 nt, Human
cacccggaguuggcucagggc

SEQ ID NO: 432478 - RNA, 18 nt, Human
caggccuggagcuccugg

SEQ ID NO: 432479 - RNA, 19 nt, Human
cccaggccuggagcuccug

SEQ ID NO: 432480 - RNA, 21 nt, Human
ccucagccacucacagcagag

SEQ ID NO: 432481 - RNA, 19 nt, Human
ccugcacccaggccuggag

SEQ ID NO: 432482 - RNA, 20 nt, Human
ccuguggaggccuagggccc

SEQ ID NO: 432483 - RNA, 23 nt, Human
cgaggagagugacagccucuuca

SEQ ID NO: 432484 - RNA, 25 nt, Human
cugaagcgcuggcggaacaucucca

SEQ ID NO: 432485 - RNA, 23 nt, Human
cugcuccagcaccaguagcucca

SEQ ID NO: 432486 - RNA, 23 nt, Human
cugcuccuguggaggccuagggc

SEQ ID NO: 432487 - RNA, 23 nt, Human
cuugccuuucucuucuuucuccu

SEQ ID NO: 432488 - RNA, 21 nt, Human
cuuucucuucuuucuccucga

SEQ ID NO: 432489 - RNA, 23 nt, Human
gccuggagcuccuggggcaggau

SEQ ID NO: 432490 - RNA, 18 nt, Human
gccuuucucuucuuucuc

SEQ ID NO: 432491 - RNA, 22 nt, Human
gcuccuugguguggaucucggg

SEQ ID NO: 432492 - RNA, 21 nt, Human
uacccaaacugccugaagcgc

SEQ ID NO: 432493 - RNA, 18 nt, Human
uagggcccagaacugggg

SEQ ID NO: 432494 - RNA, 21 nt, Human
uagggcccagaacuggggcca

SEQ ID NO: 432495 - RNA, 21 nt, Human
uaucaugguacccaaacugcc

SEQ ID NO: 432496 - RNA, 18 nt, Human
ucuccgggcaaugcuccu

SEQ ID NO: 432497 - RNA, 21 nt, Human
ucuccgggcaaugcuccugca

SEQ ID NO: 432498 - RNA, 20 nt, Human
ugccugaagcgcuggcggaa

SEQ ID NO: 432499 - RNA, 20 nt, Human
uggagcuccuggggcaggau

SEQ ID NO: 432500 - RNA, 22 nt, Human
uggagcuccuggggcaggaugg

SEQ ID NO: 432501 - RNA, 23 nt, Human
uggggccaugccuaguaccuugg

SEQ ID NO: 432502 - RNA, 18 nt, Human
uguggaggccuagggccc

SEQ ID NO: 432503 - RNA, 20 nt, Human
aaccccacucuuccccaagc

SEQ ID NO: 432504 - RNA, 18 nt, Human
caacaggccuuccuccuc

SEQ ID NO: 432505 - RNA, 22 nt, Human
ccccacucuuccccaagcugga

SEQ ID NO: 432506 - RNA, 24 nt, Human
cccucaggcucuccugcugacaac

SEQ ID NO: 432507 - RNA, 26 nt, Human
ccugcugacaaccccacucuucccca

SEQ ID NO: 432508 - RNA, 26 nt, Human
cuccucccugcuauuagauaccugau

SEQ ID NO: 432509 - RNA, 21 nt, Human
cugggccucagcccucaggcc

SEQ ID NO: 432510 - RNA, 21 nt, Human
gcaacaggccuuccuccuccc

SEQ ID NO: 432511 - RNA, 18 nt, Human
ucaggcucuccugcugac

SEQ ID NO: 432512 - RNA, 22 nt, Human
ugacaaccccacucuuccccaa

SEQ ID NO: 432513 - RNA, 22 nt, Human
uucacgcugggccucagcccuc

SEQ ID NO: 432514 - RNA, 22 nt, Human
aaaucaguaagaagaucaauaa

SEQ ID NO: 432515 - RNA, 21 nt, Human
aaaugcaccuuagggcugaac

SEQ ID NO: 432516 - RNA, 20 nt, Human
aaccaaaaaacucuccacag

SEQ ID NO: 432517 - RNA, 24 nt, Human
aacccagcacaaggaggaagacug

SEQ ID NO: 432518 - RNA, 20 nt, Human
aagagcuacaauaaaucagu

SEQ ID NO: 432519 - RNA, 22 nt, Human
aagagggugcaggcuccuggau

SEQ ID NO: 432520 - RNA, 22 nt, Human
aaggacaaauggcaaaccaaaa

SEQ ID NO: 432521 - RNA, 18 nt, Human
aauggccaaaaaacaaaa

SEQ ID NO: 432522 - RNA, 19 nt, Human
acagaaugcccaccgugcc

SEQ ID NO: 432523 - RNA, 18 nt, Human
acuucaucccuggggaca

SEQ ID NO: 432524 - RNA, 20 nt, Human
agaaucagggccuggagaag

SEQ ID NO: 432525 - RNA, 18 nt, Human
agagggugcaggcuccug

SEQ ID NO: 432526 - RNA, 18 nt, Human
aggagagaaguggguccc

SEQ ID NO: 432527 - RNA, 20 nt, Human
aggaggaggcaccagcaacu

SEQ ID NO: 432528 - RNA, 20 nt, Human
aggcuccuggauaguggucu

SEQ ID NO: 432529 - RNA, 24 nt, Human
aggcuggagguggagccaacagaa

SEQ ID NO: 432530 - RNA, 20 nt, Human
agggaagugggugggucucg

SEQ ID NO: 432531 - RNA, 21 nt, Human
aguagccaagcccugggcgac

SEQ ID NO: 432532 - RNA, 20 nt, Human
caaaaaacucuccacaggca

SEQ ID NO: 432533 - RNA, 21 nt, Human
caaaaaccacaucggagucaa

SEQ ID NO: 432534 - RNA, 23 nt, Human
caaaagacaaauggccaaaaaac

SEQ ID NO: 432535 - RNA, 23 nt, Human
caaaugcagggaagugggugggu

SEQ ID NO: 432536 - RNA, 22 nt, Human
caacagaaagagggugcaggcu

SEQ ID NO: 432537 - RNA, 24 nt, Human
caacagaaagagggugcaggcucc

SEQ ID NO: 432538 - RNA, 22 nt, Human
caagaagacugagagagcagug

SEQ ID NO: 432539 - RNA, 19 nt, Human
cacagaacccgggccugca

SEQ ID NO: 432540 - RNA, 21 nt, Human
cacagaacccgggccugcaag

SEQ ID NO: 432541 - RNA, 21 nt, Human
cacagacuucaugaaggcugu

SEQ ID NO: 432542 - RNA, 23 nt, Human
cagaaugcccaccgugccgggac

SEQ ID NO: 432543 - RNA, 18 nt, Human
cagcaaaaaccacaucgg

SEQ ID NO: 432544 - RNA, 22 nt, Human
cagcaacuccaacugagaauca

SEQ ID NO: 432545 - RNA, 23 nt, Human
caggggaggaccauggcggacac

SEQ ID NO: 432546 - RNA, 24 nt, Human
cagugagggcuuuuaguggugaga

SEQ ID NO: 432547 - RNA, 20 nt, Human
caucggagucaaaagacaaa

SEQ ID NO: 432548 - RNA, 19 nt, Human
caucugaggaacacagacu

SEQ ID NO: 432549 - RNA, 19 nt, Human
caucugccauuuccacacc

SEQ ID NO: 432550 - RNA, 21 nt, Human
caucugccauuuccacacccu

SEQ ID NO: 432551 - RNA, 23 nt, Human
caugacagaaugcccaccgugcc

SEQ ID NO: 432552 - RNA, 26 nt, Human
ccaaaaaacaaaaaaaauuaaaaaag

SEQ ID NO: 432553 - RNA, 22 nt, Human
ccaacagaaagagggugcaggc

SEQ ID NO: 432554 - RNA, 21 nt, Human
ccacaggcaaaaggcuaauua

SEQ ID NO: 432555 - RNA, 18 nt, Human
ccuugcuugugaugucug

SEQ ID NO: 432556 - RNA, 23 nt, Human
cuggaggagguuaaaucaagaag

SEQ ID NO: 432557 - RNA, 22 nt, Human
gaaaucagcaaaaaccacaucg

SEQ ID NO: 432558 - RNA, 24 nt, Human
gcaaaugcagggaagugggugggu

SEQ ID NO: 432559 - RNA, 25 nt, Human
gccaaaaaacaaaaaaaauuaaaaa

SEQ ID NO: 432560 - RNA, 22 nt, Human
gcuggagguggagccaacagaa

SEQ ID NO: 432561 - RNA, 27 nt, Human
gcuguggggaaacgugagcaagggcuc

SEQ ID NO: 432562 - RNA, 19 nt, Human
ggagaaggcggaagccugg

SEQ ID NO: 432563 - RNA, 24 nt, Human
ggccaaaaaacaaaaaaaauuaaa

SEQ ID NO: 432564 - RNA, 23 nt, Human
ggcgacaaaugcagggguaggga

SEQ ID NO: 432565 - RNA, 18 nt, Human
gucucagcaaaugcaggg

SEQ ID NO: 432566 - RNA, 19 nt, Human
uaaaaaaggacaaauggca

SEQ ID NO: 432567 - RNA, 21 nt, Human
uaaaaaaggacaaauggcaaa

SEQ ID NO: 432568 - RNA, 20 nt, Human
uaagaaaaaugcaccuuagg

SEQ ID NO: 432569 - RNA, 21 nt, Human
uaagaagaucaauaaccucau

SEQ ID NO: 432570 - RNA, 23 nt, Human
uagccaagcccugggcgaccugc

SEQ ID NO: 432571 - RNA, 18 nt, Human
uagggcaagcgugggggc

SEQ ID NO: 432572 - RNA, 19 nt, Human
uaguaagaaaaaugcaccu

SEQ ID NO: 432573 - RNA, 24 nt, Human
ucccuggggacacagugugaacua

SEQ ID NO: 432574 - RNA, 18 nt, Human
ucuccacaggcaaaaggc

SEQ ID NO: 432575 - RNA, 21 nt, Human
ucucggaggcuggagguggag

SEQ ID NO: 432576 - RNA, 26 nt, Human
ucuguacagacuucccugaugaggug

SEQ ID NO: 432577 - RNA, 18 nt, Human
ugaaaaagcuuucuaguc

SEQ ID NO: 432578 - RNA, 20 nt, Human
ugaacuacagggaccugaaa

SEQ ID NO: 432579 - RNA, 20 nt, Human
ugaaggcuguggggaaacgu

SEQ ID NO: 432580 - RNA, 23 nt, Human
ugaccaaagaggcagacggaggc

SEQ ID NO: 432581 - RNA, 18 nt, Human
ugagagagcagugagggc

SEQ ID NO: 432582 - RNA, 20 nt, Human
ugagcaagggcucuagggca

SEQ ID NO: 432583 - RNA, 18 nt, Human
ugaucaacacaggggugg

SEQ ID NO: 432584 - RNA, 25 nt, Human
uggagguggagccaacagaaagagg

SEQ ID NO: 432585 - RNA, 18 nt, Human
uguagggcaagcgugggg

SEQ ID NO: 432586 - RNA, 19 nt, Human
uuggaugugccuugcuugu

SEQ ID NO: 432587 - RNA, 25 nt, Human
augucacaaugcccucugcgacagc

SEQ ID NO: 432588 - RNA, 23 nt, Human
ccacauucuucacacuuguagaa

SEQ ID NO: 432589 - RNA, 21 nt, Human
ccagcuuccaggauguccggg

SEQ ID NO: 432590 - RNA, 25 nt, Human
ccagugauacaucacaauccucuuu

SEQ ID NO: 432591 - RNA, 25 nt, Human
ccagugauaugucacaaugcccucu

SEQ ID NO: 432592 - RNA, 21 nt, Human
ccucugcgacagcaccaaggc

SEQ ID NO: 432593 - RNA, 19 nt, Human
cgacagcaccaaggcaaga

SEQ ID NO: 432594 - RNA, 22 nt, Human
cucacauucugagcagagguug

SEQ ID NO: 432595 - RNA, 20 nt, Human
cuguguacugggcccaggcc

SEQ ID NO: 432596 - RNA, 21 nt, Human
ggucacaugaucuacaugcug

SEQ ID NO: 432597 - RNA, 23 nt, Human
gucaaaucgcucacauucugagc

SEQ ID NO: 432598 - RNA, 23 nt, Human
uaugucacaaucccaucugugua

SEQ ID NO: 432599 - RNA, 22 nt, Human
ucccugggugcagggaccagug

SEQ ID NO: 432600 - RNA, 23 nt, Human
ucuagaauuucucaccaguauaa

SEQ ID NO: 432601 - RNA, 24 nt, Human
ucuaggugcuggguccagggccga

SEQ ID NO: 432602 - RNA, 20 nt, Human
ugauaugucacaaugcccuc

SEQ ID NO: 432603 - RNA, 22 nt, Human
ugccacauucuucacacuugua

SEQ ID NO: 432604 - RNA, 19 nt, Human
uguccgggcaucuuagcug

SEQ ID NO: 432605 - RNA, 21 nt, Human
uuaauggcuuuuccacauucu

SEQ ID NO: 432606 - RNA, 20 nt, Human
uuguguauauaccuuuuucc

SEQ ID NO: 432607 - RNA, 19 nt, Human
aaggagaaaaaagccauga

SEQ ID NO: 432608 - RNA, 21 nt, Human
caagucuuaagagggaaggag

SEQ ID NO: 432609 - RNA, 18 nt, Human
cacuggcugaacuacuga

SEQ ID NO: 432610 - RNA, 23 nt, Human
gaaggagaaaaaagccaugagag

SEQ ID NO: 432611 - RNA, 18 nt, Human
gaaggagaaaacaugagg

SEQ ID NO: 432612 - RNA, 24 nt, Human
ggaaggagaaaaaagccaugagag

SEQ ID NO: 432613 - RNA, 22 nt, Human
uacuccagaucagacucauccu

SEQ ID NO: 432614 - RNA, 25 nt, Human
uauaaaacaaauguuuugucuauga

SEQ ID NO: 432615 - RNA, 19 nt, Human
ucuggagaagugccaaguc

SEQ ID NO: 432616 - RNA, 21 nt, Human
ucuggagaagugccaagucuu

SEQ ID NO: 432617 - RNA, 24 nt, Human
ugaggcuucucugcuguguggucu

SEQ ID NO: 432618 - RNA, 22 nt, Human
ugagggaaggagaaaaaagcca

SEQ ID NO: 432619 - RNA, 20 nt, Human
ugugaggcuucucugcugug

SEQ ID NO: 432620 - RNA, 18 nt, Human
uuaaaauauuucagcacc

SEQ ID NO: 432621 - RNA, 23 nt, Human
uucucugcuguguggucucccaa

SEQ ID NO: 432622 - RNA, 24 nt, Human
uucugauuuacuccagaucagacu

SEQ ID NO: 432623 - RNA, 19 nt, Human
uuggccaaaacaaaaaaac

SEQ ID NO: 432624 - RNA, 22 nt, Human
aacccggugagacaguuaguga

SEQ ID NO: 432625 - RNA, 19 nt, Human
acuuccaccgccugaaucc

SEQ ID NO: 432626 - RNA, 21 nt, Human
auccauuucuuccagacccag

SEQ ID NO: 432627 - RNA, 21 nt, Human
caccucuggcucccaggguuc

SEQ ID NO: 432628 - RNA, 24 nt, Human
ccaccgccugaauccauacuuagc

SEQ ID NO: 432629 - RNA, 23 nt, Human
ccgccgccgccgccgccgccgcc

SEQ ID NO: 432630 - RNA, 24 nt, Human
ccgccgccgccgccgccgccgccu

SEQ ID NO: 432631 - RNA, 18 nt, Human
ccgccgccgccgccuccg

SEQ ID NO: 432632 - RNA, 23 nt, Human
ccgccgccgccgccuccgugccg

SEQ ID NO: 432633 - RNA, 18 nt, Human
ccgccgccgccuccgugc

SEQ ID NO: 432634 - RNA, 19 nt, Human
ccgccgccgccuccgugcc

SEQ ID NO: 432635 - RNA, 18 nt, Human
ccgccgccgcugccgccg

SEQ ID NO: 432636 - RNA, 21 nt, Human
ccgccgccgcugccgccgccg

SEQ ID NO: 432637 - RNA, 22 nt, Human
ccgccgccgcugccgccgccgc

SEQ ID NO: 432638 - RNA, 24 nt, Human
ccgccgccgcugccgccgccgccg

SEQ ID NO: 432639 - RNA, 22 nt, Human
ccgccgccuccgugccgccagu

SEQ ID NO: 432640 - RNA, 18 nt, Human
ccgccgcugccgccgccg

SEQ ID NO: 432641 - RNA, 24 nt, Human
ccgccgcugccgccgccgccgccg

SEQ ID NO: 432642 - RNA, 24 nt, Human
ccgccgcugccgccgccgcugccg

SEQ ID NO: 432643 - RNA, 18 nt, Human
ccgcugccgccgccgccg

SEQ ID NO: 432644 - RNA, 24 nt, Human
ccgcugccgccgccgccgccgccg

SEQ ID NO: 432645 - RNA, 24 nt, Human
ccgcugccgccgccgcugccgccg

SEQ ID NO: 432646 - RNA, 19 nt, Human
ccugcugcugcagcuacag

SEQ ID NO: 432647 - RNA, 23 nt, Human
cgccagucggacugugaccgcgc

SEQ ID NO: 432648 - RNA, 23 nt, Human
cgccgccgccgccgccgccuccg

SEQ ID NO: 432649 - RNA, 20 nt, Human
cuacagcugccgccgccgcu

SEQ ID NO: 432650 - RNA, 27 nt, Human
cugccgccgccgccgccgccgccgccu

SEQ ID NO: 432651 - RNA, 18 nt, Human
gagcucugcagauaaacu

SEQ ID NO: 432652 - RNA, 22 nt, Human
gccgccgccgccgccgccgccg

SEQ ID NO: 432653 - RNA, 22 nt, Human
gccgccgccgcugccgccgccg

SEQ ID NO: 432654 - RNA, 22 nt, Human
gccgccgccgcugccgccgccg

SEQ ID NO: 432655 - RNA, 22 nt, Human
gcugccgccgccgcugccgccg

SEQ ID NO: 432656 - RNA, 22 nt, Human
uagcaaaguucauucaccaaua

SEQ ID NO: 432657 - RNA, 23 nt, Human
uagugaauuucauccacuggcuc

SEQ ID NO: 432658 - RNA, 23 nt, Human
uauuagaggacucagaugucuag

SEQ ID NO: 432659 - RNA, 25 nt, Human
uccaagacuuccaccgccugaaucc

SEQ ID NO: 432660 - RNA, 19 nt, Human
ucucuugucucaguuuuga

SEQ ID NO: 432661 - RNA, 19 nt, Human
uggcucccaggguucuacu

SEQ ID NO: 432662 - RNA, 23 nt, Human
uguauucaccucuggcucccagg

SEQ ID NO: 432663 - RNA, 24 nt, Human
uguauucaccucuggcucccaggg

SEQ ID NO: 432664 - RNA, 19 nt, Human
aaagcccccgcgcuuuccc

SEQ ID NO: 432665 - RNA, 19 nt, Human
aaggcgggagggcuaagga

SEQ ID NO: 432666 - RNA, 18 nt, Human
aaguuaaggcuauagguu

SEQ ID NO: 432667 - RNA, 20 nt, Human
accccaaugccgaaggcggg

SEQ ID NO: 432668 - RNA, 24 nt, Human
cacauauauacacauuuauaugua

SEQ ID NO: 432669 - RNA, 20 nt, Human
cauauauacacauuuauaug

SEQ ID NO: 432670 - RNA, 22 nt, Human
ccaccucccacaccaggcgcuc

SEQ ID NO: 432671 - RNA, 18 nt, Human
ccacguguucuggccgag

SEQ ID NO: 432672 - RNA, 22 nt, Human
ccacguguucuggccgagagac

SEQ ID NO: 432673 - RNA, 20 nt, Human
cccacaccaggcgcucaagg

SEQ ID NO: 432674 - RNA, 22 nt, Human
cgcucaaggccccgcaaagccc

SEQ ID NO: 432675 - RNA, 19 nt, Human
cgggagggcuaaggaagcg

SEQ ID NO: 432676 - RNA, 21 nt, Human
cggggaccccaaugccgaagg

SEQ ID NO: 432677 - RNA, 26 nt, Human
gaccaccucccacaccaggcgcucaa

SEQ ID NO: 432678 - RNA, 22 nt, Human
ucgaccaccucccacaccaggc

SEQ ID NO: 432679 - RNA, 23 nt, Human
uucacauauauacacauuuauau

SEQ ID NO: 432680 - RNA, 24 nt, Human
aaacauggcaaaaccccgucucua

SEQ ID NO: 432681 - RNA, 18 nt, Human
aaagaugcuggaugcuuc

SEQ ID NO: 432682 - RNA, 18 nt, Human
aaagccaugucaggagcc

SEQ ID NO: 432683 - RNA, 20 nt, Human
aacauggcaaaaccccgucu

SEQ ID NO: 432684 - RNA, 21 nt, Human
aacauggcaaaaccccgucuc

SEQ ID NO: 432685 - RNA, 20 nt, Human
aacccgauauauccucgaga

SEQ ID NO: 432686 - RNA, 21 nt, Human
aagagugaagcuguaccuguc

SEQ ID NO: 432687 - RNA, 19 nt, Human
aagcagagguugcagugag

SEQ ID NO: 432688 - RNA, 22 nt, Human
aaguccacagccacauccuuga

SEQ ID NO: 432689 - RNA, 24 nt, Human
aagugauccccuugccuuggccuc

SEQ ID NO: 432690 - RNA, 25 nt, Human
aagugauccccuugccuuggccucc

SEQ ID NO: 432691 - RNA, 19 nt, Human
aaucauggcucacugcagc

SEQ ID NO: 432692 - RNA, 25 nt, Human
aaugauccucccaccucagccuccu

SEQ ID NO: 432693 - RNA, 22 nt, Human
aaugauugggcgcggggaagaa

SEQ ID NO: 432694 - RNA, 19 nt, Human
acaguguuaagauuacagg

SEQ ID NO: 432695 - RNA, 24 nt, Human
acaguguuaagauuacagguguga

SEQ ID NO: 432696 - RNA, 24 nt, Human
accaacagaaacagcaucgaggaa

SEQ ID NO: 432697 - RNA, 20 nt, Human
acccacuccccacaccaggc

SEQ ID NO: 432698 - RNA, 26 nt, Human
acccacuccccacaccaggcucagcc

SEQ ID NO: 432699 - RNA, 24 nt, Human
accccgucucuacuaaaaauacaa

SEQ ID NO: 432700 - RNA, 20 nt, Human
accuggcuucgggaagaccc

SEQ ID NO: 432701 - RNA, 24 nt, Human
acuaaaaauacaaacauuagccgg

SEQ ID NO: 432702 - RNA, 19 nt, Human
acugcagccuugaccuccu

SEQ ID NO: 432703 - RNA, 20 nt, Human
agacauacugacuacaagag

SEQ ID NO: 432704 - RNA, 25 nt, Human
agagguugcagugagcggaagauca

SEQ ID NO: 432705 - RNA, 25 nt, Human
agaugcuggaugcuucugggaaacu

SEQ ID NO: 432706 - RNA, 20 nt, Human
agauuacaggugugagccau

SEQ ID NO: 432707 - RNA, 24 nt, Human
agauuacaggugugagccauggca

SEQ ID NO: 432708 - RNA, 24 nt, Human
agcacuuugggaggccgaggcggg

SEQ ID NO: 432709 - RNA, 22 nt, Human
agcccguccgaggauacaacag

SEQ ID NO: 432710 - RNA, 23 nt, Human
agccgaucggcucacgccuguaa

SEQ ID NO: 432711 - RNA, 23 nt, Human
agccgggcgugguggcgcgugcc

SEQ ID NO: 432712 - RNA, 21 nt, Human
agcuguguagccuccaggauc

SEQ ID NO: 432713 - RNA, 18 nt, Human
aggaagguggucuggauc

SEQ ID NO: 432714 - RNA, 19 nt, Human
aggccgaggcgggcggauc

SEQ ID NO: 432715 - RNA, 24 nt, Human
aggccgaggcgggcggaucgcuug

SEQ ID NO: 432716 - RNA, 24 nt, Human
aggcgggagaauaguuugaacccg

SEQ ID NO: 432717 - RNA, 22 nt, Human
aggucucaccauguuguccagg

SEQ ID NO: 432718 - RNA, 25 nt, Human
aguagcugggaccacagggacaugc

SEQ ID NO: 432719 - RNA, 24 nt, Human
agugcagugcugugaaucauggcu

SEQ ID NO: 432720 - RNA, 25 nt, Human
agugcagugcugugaaucauggcuc

SEQ ID NO: 432721 - RNA, 22 nt, Human
aguguuaagauuacagguguga

SEQ ID NO: 432722 - RNA, 26 nt, Human
auacccacuccccacaccaggcucag

SEQ ID NO: 432723 - RNA, 24 nt, Human
aucggcucacgccuguaaucccag

SEQ ID NO: 432724 - RNA, 24 nt, Human
auggcucacugcagccuugaccuc

SEQ ID NO: 432725 - RNA, 24 nt, Human
caaaugacucucaacacuccuccu

SEQ ID NO: 432726 - RNA, 20 nt, Human
caaaugauccucccaccuca

SEQ ID NO: 432727 - RNA, 21 nt, Human
caacagaaacagcaucgagga

SEQ ID NO: 432728 - RNA, 22 nt, Human
caacagaaacagcaucgaggaa

SEQ ID NO: 432729 - RNA, 21 nt, Human
caacccgauauauccucgaga

SEQ ID NO: 432730 - RNA, 22 nt, Human
caacuacuugggagguugaggc

SEQ ID NO: 432731 - RNA, 24 nt, Human
caacuacuugggagguugaggcgg

SEQ ID NO: 432732 - RNA, 22 nt, Human
caagugauccccuugccuuggc

SEQ ID NO: 432733 - RNA, 27 nt, Human
caagugauccccuugccuuggccuccc

SEQ ID NO: 432734 - RNA, 22 nt, Human
cacagccacauccuugaaacuc

SEQ ID NO: 432735 - RNA, 22 nt, Human
caccauguuguccaggcugguc

SEQ ID NO: 432736 - RNA, 27 nt, Human
caccauguuguccaggcugguccuaga

SEQ ID NO: 432737 - RNA, 24 nt, Human
caccucagccuccugaguagcugg

SEQ ID NO: 432738 - RNA, 24 nt, Human
cacgccuguaaucccagcacuuug

SEQ ID NO: 432739 - RNA, 22 nt, Human
cacucccgccugggugacagag

SEQ ID NO: 432740 - RNA, 23 nt, Human
cacucccgccugggugacagagu

SEQ ID NO: 432741 - RNA, 24 nt, Human
cacucccgccugggugacagagug

SEQ ID NO: 432742 - RNA, 19 nt, Human
cacugcagccuugaccucc

SEQ ID NO: 432743 - RNA, 22 nt, Human
cagagaggaggcagaaccugcc

SEQ ID NO: 432744 - RNA, 24 nt, Human
cagcacuuugggaggccgaggcgg

SEQ ID NO: 432745 - RNA, 20 nt, Human
cagccuccugaguagcuggg

SEQ ID NO: 432746 - RNA, 21 nt, Human
cagccuugaccuccuaggcuc

SEQ ID NO: 432747 - RNA, 23 nt, Human
cagccuugaccuccuaggcucaa

SEQ ID NO: 432748 - RNA, 24 nt, Human
cagccuugaccuccuaggcucaaa

SEQ ID NO: 432749 - RNA, 25 nt, Human
cagcuacugacaccaaagcacauca

SEQ ID NO: 432750 - RNA, 20 nt, Human
cagcuguguagccuccagga

SEQ ID NO: 432751 - RNA, 21 nt, Human
caggagccaucggacgcggag

SEQ ID NO: 432752 - RNA, 21 nt, Human
caggagccgaucggcucacgc

SEQ ID NO: 432753 - RNA, 24 nt, Human
cagggucuugcuuugucacccagg

SEQ ID NO: 432754 - RNA, 19 nt, Human
cagugagcggaagaucaag

SEQ ID NO: 432755 - RNA, 24 nt, Human
caguguuaagauuacaggugugag

SEQ ID NO: 432756 - RNA, 22 nt, Human
cauggcacccaacgauaucccu

SEQ ID NO: 432757 - RNA, 23 nt, Human
cauggcacccaacgauaucccuu

SEQ ID NO: 432758 - RNA, 20 nt, Human
cauggcucacugcagccuug

SEQ ID NO: 432759 - RNA, 20 nt, Human
cauguuguccaggcuggucc

SEQ ID NO: 432760 - RNA, 23 nt, Human
cauguuguccaggcugguccuag

SEQ ID NO: 432761 - RNA, 24 nt, Human
cauguuguccaggcugguccuaga

SEQ ID NO: 432762 - RNA, 26 nt, Human
cauugcaccacucccgccugggugac

SEQ ID NO: 432763 - RNA, 24 nt, Human
ccacaguguuaagauuacaggugu

SEQ ID NO: 432764 - RNA, 20 nt, Human
ccacgcgcucacagcugcac

SEQ ID NO: 432765 - RNA, 22 nt, Human
ccauuuaaaaaaaaaaaaaaaa

SEQ ID NO: 432766 - RNA, 24 nt, Human
ccauuuaaaaaaaaaaaaaaaaga

SEQ ID NO: 432767 - RNA, 23 nt, Human
cccaccucagccuccugaguagc

SEQ ID NO: 432768 - RNA, 24 nt, Human
cccaccucagccuccugaguagcu

SEQ ID NO: 432769 - RNA, 19 nt, Human
cccaugcucggcgcacuca

SEQ ID NO: 432770 - RNA, 21 nt, Human
ccccaacccgauauauccucg

SEQ ID NO: 432771 - RNA, 18 nt, Human
ccccaguagcuagcacca

SEQ ID NO: 432772 - RNA, 19 nt, Human
ccccaugcucggcgcacuc

SEQ ID NO: 432773 - RNA, 18 nt, Human
ccccgccacacgcuccuc

SEQ ID NO: 432774 - RNA, 21 nt, Human
ccccgccacacgcuccucccg

SEQ ID NO: 432775 - RNA, 23 nt, Human
ccccuugucaacaacuuccaggc

SEQ ID NO: 432776 - RNA, 21 nt, Human
cccgaagcggacagagaccgc

SEQ ID NO: 432777 - RNA, 22 nt, Human
cccgguacaaggcccucugagg

SEQ ID NO: 432778 - RNA, 20 nt, Human
ccgaagcggacagagaccgc

SEQ ID NO: 432779 - RNA, 19 nt, Human
ccgcagauacccacucccc

SEQ ID NO: 432780 - RNA, 19 nt, Human
ccuccacggcagccucccc

SEQ ID NO: 432781 - RNA, 20 nt, Human
ccuccaggauccagggcagg

SEQ ID NO: 432782 - RNA, 20 nt, Human
ccucgagauucucuuucagg

SEQ ID NO: 432783 - RNA, 18 nt, Human
ccugcaaucccaacuacu

SEQ ID NO: 432784 - RNA, 23 nt, Human
ccugcagcggagccccgcggggc

SEQ ID NO: 432785 - RNA, 20 nt, Human
ccuggaguguggcccuucug

SEQ ID NO: 432786 - RNA, 23 nt, Human
ccuggcuucgggaagaccccaac

SEQ ID NO: 432787 - RNA, 21 nt, Human
ccugggcucaagugauccccu

SEQ ID NO: 432788 - RNA, 22 nt, Human
ccugggcucaagugauccccuu

SEQ ID NO: 432789 - RNA, 22 nt, Human
ccugggcucaagugauccccuu

SEQ ID NO: 432790 - RNA, 22 nt, Human
ccugggugacagagugagauuc

SEQ ID NO: 432791 - RNA, 22 nt, Human
ccuguaaucccagcacuuuggg

SEQ ID NO: 432792 - RNA, 23 nt, Human
ccugucguggcacaagugagaau

SEQ ID NO: 432793 - RNA, 22 nt, Human
ccuugaccuccuaggcucaaau

SEQ ID NO: 432794 - RNA, 22 nt, Human
cgaggcgggcggaucgcuugag

SEQ ID NO: 432795 - RNA, 24 nt, Human
cgaggucucaccauguuguccagg

SEQ ID NO: 432796 - RNA, 24 nt, Human
cgccgacggucugagggaccggca

SEQ ID NO: 432797 - RNA, 22 nt, Human
cgcucacagcugcacgaucaca

SEQ ID NO: 432798 - RNA, 23 nt, Human
cggcagccuccccaggaggagug

SEQ ID NO: 432799 - RNA, 22 nt, Human
cggcucacgccuguaaucccag

SEQ ID NO: 432800 - RNA, 24 nt, Human
cggcucacgccuguaaucccagca

SEQ ID NO: 432801 - RNA, 24 nt, Human
cgggaagcagagguugcagugagc

SEQ ID NO: 432802 - RNA, 24 nt, Human
cgugccugcaaucccaacuacuug

SEQ ID NO: 432803 - RNA, 24 nt, Human
cucaaaugauccucccaccucagc

SEQ ID NO: 432804 - RNA, 22 nt, Human
cucacgccuguaaucccagcac

SEQ ID NO: 432805 - RNA, 24 nt, Human
cucacgccuguaaucccagcacuu

SEQ ID NO: 432806 - RNA, 21 nt, Human
cucacugcagccuugaccucc

SEQ ID NO: 432807 - RNA, 24 nt, Human
cucagccuccugaguagcugggac

SEQ ID NO: 432808 - RNA, 21 nt, Human
cuccgcagauacccacucccc

SEQ ID NO: 432809 - RNA, 25 nt, Human
cuccuaggcucaaaugauccuccca

SEQ ID NO: 432810 - RNA, 24 nt, Human
cuccugaguagcugggaccacagg

SEQ ID NO: 432811 - RNA, 18 nt, Human
cucgggcuccggggcagg

SEQ ID NO: 432812 - RNA, 21 nt, Human
cugaaaauaauaguuuaugga

SEQ ID NO: 432813 - RNA, 22 nt, Human
cugcagccuugaccuccuaggc

SEQ ID NO: 432814 - RNA, 23 nt, Human
cugcagccuugaccuccuaggcu

SEQ ID NO: 432815 - RNA, 25 nt, Human
cugcuaccgccaaucaagcacgucu

SEQ ID NO: 432816 - RNA, 21 nt, Human
cugcuccuggggcugaggggc

SEQ ID NO: 432817 - RNA, 24 nt, Human
cugucuucucgggcuccggggcag

SEQ ID NO: 432818 - RNA, 20 nt, Human
cuucucgggcuccggggcag

SEQ ID NO: 432819 - RNA, 20 nt, Human
cuuugucacccaggcugcag

SEQ ID NO: 432820 - RNA, 23 nt, Human
gacagagugagauuccauuuaaa

SEQ ID NO: 432821 - RNA, 28 nt, Human
gaccccacuccuccugggugaaguccac

SEQ ID NO: 432822 - RNA, 19 nt, Human
gagccaucggacgcggagc

SEQ ID NO: 432823 - RNA, 21 nt, Human
gagcccccuccccgcgcccgg

SEQ ID NO: 432824 - RNA, 18 nt, Human
gauuacaggugugagcca

SEQ ID NO: 432825 - RNA, 20 nt, Human
gcaaggcucccacaccugga

SEQ ID NO: 432826 - RNA, 22 nt, Human
gcagauacccacuccccacacc

SEQ ID NO: 432827 - RNA, 23 nt, Human
gcgaacccgcgcucggagaccag

SEQ ID NO: 432828 - RNA, 22 nt, Human
gcucaaaugauccucccaccuc

SEQ ID NO: 432829 - RNA, 21 nt, Human
gcucacugcagccuugaccuc

SEQ ID NO: 432830 - RNA, 19 nt, Human
gcuccuggggcugaggggc

SEQ ID NO: 432831 - RNA, 18 nt, Human
ggaaacauggcaaaaccc

SEQ ID NO: 432832 - RNA, 24 nt, Human
ggaagaccccaacccgauauaucc

SEQ ID NO: 432833 - RNA, 20 nt, Human
ggaagcagagguugcaguga

SEQ ID NO: 432834 - RNA, 19 nt, Human
ggagcccccuccccgcgcc

SEQ ID NO: 432835 - RNA, 20 nt, Human
ggaggaagguggucuggauc

SEQ ID NO: 432836 - RNA, 21 nt, Human
ggcagggaucuccauggccuc

SEQ ID NO: 432837 - RNA, 23 nt, Human
ggcgugguggcgcgugccugcaa

SEQ ID NO: 432838 - RNA, 20 nt, Human
ggcucacgccuguaauccca

SEQ ID NO: 432839 - RNA, 18 nt, Human
gggcucaagugauccccu

SEQ ID NO: 432840 - RNA, 20 nt, Human
gggugcuuuccuuguugagu

SEQ ID NO: 432841 - RNA, 24 nt, Human
ggucucaccauguuguccaggcug

SEQ ID NO: 432842 - RNA, 22 nt, Human
guagagacgaggucucaccaug

SEQ ID NO: 432843 - RNA, 20 nt, Human
uaaaaauacaaacauuagcc

SEQ ID NO: 432844 - RNA, 19 nt, Human
uaaagccaugucaggagcc

SEQ ID NO: 432845 - RNA, 21 nt, Human
uaacuagaggaggcacccugg

SEQ ID NO: 432846 - RNA, 21 nt, Human
uaagauuacaggugugagcca

SEQ ID NO: 432847 - RNA, 22 nt, Human
uaagauuacaggugugagccau

SEQ ID NO: 432848 - RNA, 24 nt, Human
uaauuuuugcauuuuuuguagaga

SEQ ID NO: 432849 - RNA, 21 nt, Human
uacaagagugaagcuguaccu

SEQ ID NO: 432850 - RNA, 19 nt, Human
uacccacuccccacaccuc

SEQ ID NO: 432851 - RNA, 20 nt, Human
uacuaaaaauacaaacauua

SEQ ID NO: 432852 - RNA, 25 nt, Human
uagacuccugggcucaagugauccc

SEQ ID NO: 432853 - RNA, 22 nt, Human
uagagacgaggucucaccaugu

SEQ ID NO: 432854 - RNA, 19 nt, Human
uagccuccaggauccaggg

SEQ ID NO: 432855 - RNA, 24 nt, Human
uaguuugaacccgggaagcagagg

SEQ ID NO: 432856 - RNA, 19 nt, Human
ucacugcagccuugaccuc

SEQ ID NO: 432857 - RNA, 23 nt, Human
ucacugcagccuugaccuccuag

SEQ ID NO: 432858 - RNA, 24 nt, Human
ucacugcagccuugaccuccuagg

SEQ ID NO: 432859 - RNA, 21 nt, Human
ucagacacuccaauucaugac

SEQ ID NO: 432860 - RNA, 23 nt, Human
ucagccuccugaguagcugggac

SEQ ID NO: 432861 - RNA, 22 nt, Human
uccacagccacauccuugaaac

SEQ ID NO: 432862 - RNA, 23 nt, Human
uccaggcugguccuagacuccug

SEQ ID NO: 432863 - RNA, 20 nt, Human
uccagggcaggcccugaaga

SEQ ID NO: 432864 - RNA, 25 nt, Human
uccauggccuccacggcagccuccc

SEQ ID NO: 432865 - RNA, 23 nt, Human
ucccacaguguuaagauuacagg

SEQ ID NO: 432866 - RNA, 19 nt, Human
uccccacaccaggcucagc

SEQ ID NO: 432867 - RNA, 21 nt, Human
uccccacaccaggcucagccc

SEQ ID NO: 432868 - RNA, 22 nt, Human
uccccaggaggagugggcagcu

SEQ ID NO: 432869 - RNA, 24 nt, Human
ucccgccugggugacagagugaga

SEQ ID NO: 432870 - RNA, 24 nt, Human
ucccggcgaacccgcgcucggaga

SEQ ID NO: 432871 - RNA, 20 nt, Human
ucccgguacaaggcccucug

SEQ ID NO: 432872 - RNA, 27 nt, Human
uccgcagauacccacuccccacaccag

SEQ ID NO: 432873 - RNA, 23 nt, Human
uccgcggccaggagccaucggac

SEQ ID NO: 432874 - RNA, 18 nt, Human
uccuagacuccugggcuc

SEQ ID NO: 432875 - RNA, 26 nt, Human
uccucccaccucagccuccugaguag

SEQ ID NO: 432876 - RNA, 18 nt, Human
uccugaguagcugggacc

SEQ ID NO: 432877 - RNA, 18 nt, Human
uccugggcucaagugauc

SEQ ID NO: 432878 - RNA, 23 nt, Human
uccugggcucaagugauccccuu

SEQ ID NO: 432879 - RNA, 19 nt, Human
uccuuggaccuggcuucgg

SEQ ID NO: 432880 - RNA, 23 nt, Human
ucucaccauguuguccaggcugg

SEQ ID NO: 432881 - RNA, 23 nt, Human
ucucuacuaaaaauacaaacauu

SEQ ID NO: 432882 - RNA, 19 nt, Human
ucuugcuuugucacccagg

SEQ ID NO: 432883 - RNA, 22 nt, Human
ucuugcuuugucacccaggcug

SEQ ID NO: 432884 - RNA, 22 nt, Human
ugaaaauaauaguuuauggagg

SEQ ID NO: 432885 - RNA, 25 nt, Human
ugaccuccuaggcucaaaugauccu

SEQ ID NO: 432886 - RNA, 21 nt, Human
ugacucucaacacuccuccug

SEQ ID NO: 432887 - RNA, 25 nt, Human
ugacugacuuuaacuagaggaggcc

SEQ ID NO: 432888 - RNA, 25 nt, Human
ugagaggaaagagcuggcgaaggag

SEQ ID NO: 432889 - RNA, 26 nt, Human
ugagauuccauuuaaaaaaaaaaaaa

SEQ ID NO: 432890 - RNA, 22 nt, Human
ugagcuuaagaccagccuggga

SEQ ID NO: 432891 - RNA, 24 nt, Human
ugagggaccggcaaguggacagac

SEQ ID NO: 432892 - RNA, 19 nt, Human
ugaggggccugcagcggag

SEQ ID NO: 432893 - RNA, 22 nt, Human
ugaggugggguucaggccggcu

SEQ ID NO: 432894 - RNA, 20 nt, Human
ugauugggcgcggggaagaa

SEQ ID NO: 432895 - RNA, 18 nt, Human
ugcaaauccacagacaua

SEQ ID NO: 432896 - RNA, 24 nt, Human
ugccugcaaucccaacuacuuggg

SEQ ID NO: 432897 - RNA, 19 nt, Human
ugccuuggccucccacagu

SEQ ID NO: 432898 - RNA, 21 nt, Human
ugccuuggccucccacagugu

SEQ ID NO: 432899 - RNA, 22 nt, Human
ugcuggaugcuucugggaaacu

SEQ ID NO: 432900 - RNA, 22 nt, Human
uggaguguggcccuucugggga

SEQ ID NO: 432901 - RNA, 19 nt, Human
uggaugcuucugggaaacu

SEQ ID NO: 432902 - RNA, 19 nt, Human
uggcaagaaagaucuuucc

SEQ ID NO: 432903 - RNA, 21 nt, Human
uggccuccacggcagccuccc

SEQ ID NO: 432904 - RNA, 21 nt, Human
uggcgaaggagaaaugaguca

SEQ ID NO: 432905 - RNA, 24 nt, Human
uggcucacugcagccuugaccucc

SEQ ID NO: 432906 - RNA, 22 nt, Human
uggcuucgggaagaccccaacc

SEQ ID NO: 432907 - RNA, 20 nt, Human
ugggaccacagggacaugcc

SEQ ID NO: 432908 - RNA, 24 nt, Human
ugggaccacagggacaugccgcca

SEQ ID NO: 432909 - RNA, 19 nt, Human
ugggaggccgaggcgggcg

SEQ ID NO: 432910 - RNA, 23 nt, Human
ugggaggccgaggcgggcggauc

SEQ ID NO: 432911 - RNA, 24 nt, Human
ugggaggccgaggcgggcggaucg

SEQ ID NO: 432912 - RNA, 20 nt, Human
ugggcucaagugauccccuu

SEQ ID NO: 432913 - RNA, 24 nt, Human
ugguggcgcgugccugcaauccca

SEQ ID NO: 432914 - RNA, 24 nt, Human
uguagagacgaggucucaccaugu

SEQ ID NO: 432915 - RNA, 21 nt, Human
ugucacccaggcugcagugca

SEQ ID NO: 432916 - RNA, 22 nt, Human
uguccaggcugguccuagacuc

SEQ ID NO: 432917 - RNA, 24 nt, Human
uguccaggcugguccuagacuccu

SEQ ID NO: 432918 - RNA, 21 nt, Human
uuaaaaaaaaaaaaaaaagau

SEQ ID NO: 432919 - RNA, 20 nt, Human
uuagccgggcgugguggcgc

SEQ ID NO: 432920 - RNA, 20 nt, Human
uuagccgggcgugguggcgc

SEQ ID NO: 432921 - RNA, 24 nt, Human
uuagccgggcgugguggcgcgugc

SEQ ID NO: 432922 - RNA, 22 nt, Human
uugcaccacucccgccugggug

SEQ ID NO: 432923 - RNA, 18 nt, Human
aaacagacagcuuagauu

SEQ ID NO: 432924 - RNA, 23 nt, Human
aagaugcaaugcugaauaaaaca

SEQ ID NO: 432925 - RNA, 19 nt, Human
cagaaagggcuaacaucug

SEQ ID NO: 432926 - RNA, 18 nt, Human
gauagcuaaaggaaucuc

SEQ ID NO: 432927 - RNA, 20 nt, Human
gugaaguguaacauguaccc

SEQ ID NO: 432928 - RNA, 22 nt, Human
uaaaacagacagcuuagauucc

SEQ ID NO: 432929 - RNA, 24 nt, Human
uaauuuuguauucuuucaccacuu

SEQ ID NO: 432930 - RNA, 19 nt, Human
ucuuuucugcucagaaagg

SEQ ID NO: 432931 - RNA, 21 nt, Human
ugccucauaauuuuguauucu

SEQ ID NO: 432932 - RNA, 18 nt, Human
uguggguagaaaauagcc

SEQ ID NO: 432933 - RNA, 21 nt, Human
uuauguaucaacucuugugcu

SEQ ID NO: 432934 - RNA, 24 nt, Human
aaaaaaacaaaacaaaucaaaccc

SEQ ID NO: 432935 - RNA, 26 nt, Human
aaacaaaucaaacccaauccccagca

SEQ ID NO: 432936 - RNA, 22 nt, Human
aacugcugcucgugcacucaga

SEQ ID NO: 432937 - RNA, 19 nt, Human
acaaaacaaaucaaaccca

SEQ ID NO: 432938 - RNA, 20 nt, Human
acccaauccccagcagucua

SEQ ID NO: 432939 - RNA, 20 nt, Human
agagugggcgcccagcugau

SEQ ID NO: 432940 - RNA, 18 nt, Human
agccugggcccuuggggc

SEQ ID NO: 432941 - RNA, 19 nt, Human
agccugggcccuugggggc

SEQ ID NO: 432942 - RNA, 20 nt, Human
agcgccggccccacaacccg

SEQ ID NO: 432943 - RNA, 23 nt, Human
agcugauuuugagaggcgggugc

SEQ ID NO: 432944 - RNA, 22 nt, Human
aggaggagagugggcgcccagc

SEQ ID NO: 432945 - RNA, 21 nt, Human
aggcaucucagcuggccucca

SEQ ID NO: 432946 - RNA, 23 nt, Human
aggcgggugcccugguguagccu

SEQ ID NO: 432947 - RNA, 23 nt, Human
agggaggugguuauugcugggag

SEQ ID NO: 432948 - RNA, 19 nt, Human
agggccacucccugccucu

SEQ ID NO: 432949 - RNA, 24 nt, Human
aguagccaggcaucucagcuggcc

SEQ ID NO: 432950 - RNA, 22 nt, Human
augugccaccaccacccagagc

SEQ ID NO: 432951 - RNA, 23 nt, Human
caccacccagagcaggaaaaaaa

SEQ ID NO: 432952 - RNA, 21 nt, Human
cagcagucuauguacagggcc

SEQ ID NO: 432953 - RNA, 24 nt, Human
cagccccaaucucuaccugagaag

SEQ ID NO: 432954 - RNA, 25 nt, Human
cagcucccgaggaugaugcacuccc

SEQ ID NO: 432955 - RNA, 27 nt, Human
caggaaaaaaauuaucaaaauggaauu

SEQ ID NO: 432956 - RNA, 20 nt, Human
caggaagucccuggugccaa

SEQ ID NO: 432957 - RNA, 22 nt, Human
caguuuucuugcugucuucuca

SEQ ID NO: 432958 - RNA, 22 nt, Human
cauccaugugccaccaccaccc

SEQ ID NO: 432959 - RNA, 23 nt, Human
caugugccaccaccacccagagc

SEQ ID NO: 432960 - RNA, 22 nt, Human
ccaagagccacagcugagguca

SEQ ID NO: 432961 - RNA, 19 nt, Human
ccaugcaccgggccccgcc

SEQ ID NO: 432962 - RNA, 23 nt, Human
ccccagagaccuauguggccacc

SEQ ID NO: 432963 - RNA, 24 nt, Human
ccccugauuccagcugccuggccc

SEQ ID NO: 432964 - RNA, 21 nt, Human
cccuacagggccaguccccau

SEQ ID NO: 432965 - RNA, 20 nt, Human
cccuugggggcaagaguggc

SEQ ID NO: 432966 - RNA, 18 nt, Human
ccggccccacaacccgcc

SEQ ID NO: 432967 - RNA, 22 nt, Human
ccgggccccgccaccagcgccg

SEQ ID NO: 432968 - RNA, 23 nt, Human
ccgggccccgccaccagcgccgg

SEQ ID NO: 432969 - RNA, 25 nt, Human
ccugcuccacugcuacugggcugaa

SEQ ID NO: 432970 - RNA, 24 nt, Human
ccuggcccccuucuugcaccacug

SEQ ID NO: 432971 - RNA, 23 nt, Human
cuacugggcugaagagcugucug

SEQ ID NO: 432972 - RNA, 26 nt, Human
cugaggucagagauuuccuucugggu

SEQ ID NO: 432973 - RNA, 23 nt, Human
cuggccagcaccaagagccacag

SEQ ID NO: 432974 - RNA, 19 nt, Human
cuucuaugugucagccaca

SEQ ID NO: 432975 - RNA, 21 nt, Human
gccccacaacccgccugcgcc

SEQ ID NO: 432976 - RNA, 22 nt, Human
gccccugaggaauuaauugacu

SEQ ID NO: 432977 - RNA, 21 nt, Human
gcccgcccgcccgcgcgcagc

SEQ ID NO: 432978 - RNA, 22 nt, Human
gcuccacugcuacugggcugaa

SEQ ID NO: 432979 - RNA, 23 nt, Human
guagccaggcaucucagcuggcc

SEQ ID NO: 432980 - RNA, 19 nt, Human
ucagagauuuccuucuggg

SEQ ID NO: 432981 - RNA, 27 nt, Human
ucagagauuuccuucugggucacaagg

SEQ ID NO: 432982 - RNA, 18 nt, Human
uccccauagcagccccaa

SEQ ID NO: 432983 - RNA, 21 nt, Human
uccccauagcagccccaaucu

SEQ ID NO: 432984 - RNA, 27 nt, Human
uccccauagcagccccaaucucuaccu

SEQ ID NO: 432985 - RNA, 22 nt, Human
ucccgaggaugaugcacucccc

SEQ ID NO: 432986 - RNA, 20 nt, Human
ucuccagccacaggccccug

SEQ ID NO: 432987 - RNA, 23 nt, Human
ucuguggcucaacccuacagggc

SEQ ID NO: 432988 - RNA, 18 nt, Human
ugagaggcgggugcccug

SEQ ID NO: 432989 - RNA, 24 nt, Human
ugagcagggcccccauucccuuca

SEQ ID NO: 432990 - RNA, 19 nt, Human
ugcccugguguagccuggc

SEQ ID NO: 432991 - RNA, 20 nt, Human
uggcucaacccuacagggcc

SEQ ID NO: 432992 - RNA, 18 nt, Human
uggcuucuggccagcacc

SEQ ID NO: 432993 - RNA, 20 nt, Human
ugggggcaagaguggccaug

SEQ ID NO: 432994 - RNA, 21 nt, Human
uugcugggagggcaggacagg

SEQ ID NO: 432995 - RNA, 21 nt, Human
uuuaggaggagagugggcgcc

SEQ ID NO: 432996 - RNA, 24 nt, Human
uuuuuuuuuuuuuugaaauuugga

SEQ ID NO: 432997 - RNA, 20 nt, Human
uuuuuuuuuuuuuuuuuugg

SEQ ID NO: 432998 - RNA, 18 nt, Human
aacccggugaaaaagccg

SEQ ID NO: 432999 - RNA, 23 nt, Human
aagaaccgcuguccaaguaccgc

SEQ ID NO: 433000 - RNA, 19 nt, Human
aagccgcugccagcuuucc

SEQ ID NO: 433001 - RNA, 23 nt, Human
aagccuuuagcauuucucagauc

SEQ ID NO: 433002 - RNA, 18 nt, Human
accccguucugcagggcu

SEQ ID NO: 433003 - RNA, 20 nt, Human
agcuguccgggccugcccag

SEQ ID NO: 433004 - RNA, 18 nt, Human
agggucuaucuacagcag

SEQ ID NO: 433005 - RNA, 23 nt, Human
caacgccagguccuggcuccagc

SEQ ID NO: 433006 - RNA, 20 nt, Human
cagccucccagcaguucucu

SEQ ID NO: 433007 - RNA, 23 nt, Human
cagcuuuccgaaaaacgacuggc

SEQ ID NO: 433008 - RNA, 18 nt, Human
cauuucucagauccucac

SEQ ID NO: 433009 - RNA, 23 nt, Human
ccacagccucccagcaguucucu

SEQ ID NO: 433010 - RNA, 19 nt, Human
ccucgcgccacagccuccc

SEQ ID NO: 433011 - RNA, 18 nt, Human
ccucuccagccucucccc

SEQ ID NO: 433012 - RNA, 21 nt, Human
cgaaaaacgacuggcaacugg

SEQ ID NO: 433013 - RNA, 18 nt, Human
cgccacagccucccagca

SEQ ID NO: 433014 - RNA, 19 nt, Human
cucaagcagaacccgguga

SEQ ID NO: 433015 - RNA, 19 nt, Human
cugauccugcggugcuggg

SEQ ID NO: 433016 - RNA, 23 nt, Human
cuguccgggccugcccagccggg

SEQ ID NO: 433017 - RNA, 19 nt, Human
gagucacagccacucuuug

SEQ ID NO: 433018 - RNA, 22 nt, Human
gcagaacccggugaaaaagccg

SEQ ID NO: 433019 - RNA, 23 nt, Human
gccucgcgccacagccucccagc

SEQ ID NO: 433020 - RNA, 24 nt, Human
guggcucugggcugcagacucccc

SEQ ID NO: 433021 - RNA, 20 nt, Human
uccaaguaccgcccaacgcc

SEQ ID NO: 433022 - RNA, 19 nt, Human
ucccgagucacagccacuc

SEQ ID NO: 433023 - RNA, 23 nt, Human
ucggcauguccgggacucucucc

SEQ ID NO: 433024 - RNA, 24 nt, Human
ucggccucaagcagaacccgguga

SEQ ID NO: 433025 - RNA, 25 nt, Human
ucggccucaagcagaacccggugaa

SEQ ID NO: 433026 - RNA, 22 nt, Human
ugacggcucccaggccggacuc

SEQ ID NO: 433027 - RNA, 19 nt, Human
uguccgggccugcccagcc

SEQ ID NO: 433028 - RNA, 21 nt, Human
uguccgggccugcccagccgg

SEQ ID NO: 433029 - RNA, 19 nt, Human
uguuccacuccgucucccg

SEQ ID NO: 433030 - RNA, 20 nt, Human
acuugugguuaaaagucauc

SEQ ID NO: 433031 - RNA, 23 nt, Human
agaaaacaggcaggccuguguca

SEQ ID NO: 433032 - RNA, 19 nt, Human
agaggaagaauggaaaagg

SEQ ID NO: 433033 - RNA, 22 nt, Human
cacccaugacauuucuaccccc

SEQ ID NO: 433034 - RNA, 23 nt, Human
cagugcuuucuggcagaggaaga

SEQ ID NO: 433035 - RNA, 22 nt, Human
caucagugcuuucuggcagagg

SEQ ID NO: 433036 - RNA, 21 nt, Human
ccaugacauuucuacccccuc

SEQ ID NO: 433037 - RNA, 21 nt, Human
cccaugacauuucuaccccca

SEQ ID NO: 433038 - RNA, 21 nt, Human
gaagucacccaugacauuucu

SEQ ID NO: 433039 - RNA, 19 nt, Human
gguguaauggaaggaaugu

SEQ ID NO: 433040 - RNA, 23 nt, Human
uacaaaauggggccgcauauuga

SEQ ID NO: 433041 - RNA, 24 nt, Human
uaccacauuuuuuacuugugguua

SEQ ID NO: 433042 - RNA, 21 nt, Human
uagaaagucagaagucaccca

SEQ ID NO: 433043 - RNA, 23 nt, Human
uauguggacuuaccacauuuuuu

SEQ ID NO: 433044 - RNA, 20 nt, Human
ucacccaugacauuucuacc

SEQ ID NO: 433045 - RNA, 19 nt, Human
uggaaaaggagaaaacagg

SEQ ID NO: 433046 - RNA, 19 nt, Human
uggaaaaggagaaaacagg

SEQ ID NO: 433047 - RNA, 23 nt, Human
uggcagaggaagaauggaaaagg

SEQ ID NO: 433048 - RNA, 26 nt, Human
uggcagaggaagaauggaaaaggaga

SEQ ID NO: 433049 - RNA, 23 nt, Human
uguaauggaaggaaugucacaaa

SEQ ID NO: 433050 - RNA, 24 nt, Human
aaaaaaaaaaagaaaacccacaaa

SEQ ID NO: 433051 - RNA, 23 nt, Human
aaaaaaaaaagaaaacccacaaa

SEQ ID NO: 433052 - RNA, 22 nt, Human
aaacauuuagauugucucaacg

SEQ ID NO: 433053 - RNA, 18 nt, Human
aagcugcagaccuucgug

SEQ ID NO: 433054 - RNA, 19 nt, Human
aagugcacaauaaccaaca

SEQ ID NO: 433055 - RNA, 20 nt, Human
aagugcccuucugcauuucc

SEQ ID NO: 433056 - RNA, 25 nt, Human
aagugcccuucugcauuuccaacug

SEQ ID NO: 433057 - RNA, 18 nt, Human
acuguaucuuagagaucu

SEQ ID NO: 433058 - RNA, 22 nt, Human
acuugcaaaaggccuucccaca

SEQ ID NO: 433059 - RNA, 22 nt, Human
agaaggccaaagaagcugagaa

SEQ ID NO: 433060 - RNA, 20 nt, Human
agcaagauuuauugcaaaga

SEQ ID NO: 433061 - RNA, 22 nt, Human
caaaaacaauaaaugcuuuuua

SEQ ID NO: 433062 - RNA, 23 nt, Human
cacagcuucaccaucauucucuc

SEQ ID NO: 433063 - RNA, 20 nt, Human
cacaguauuucauagacagu

SEQ ID NO: 433064 - RNA, 18 nt, Human
cacgcacaucucugcaua

SEQ ID NO: 433065 - RNA, 23 nt, Human
cauugcauauaacccugguccaa

SEQ ID NO: 433066 - RNA, 21 nt, Human
ccacuauuaacaguuuuaugc

SEQ ID NO: 433067 - RNA, 23 nt, Human
ccaucugcaaaaugaagaacuga

SEQ ID NO: 433068 - RNA, 19 nt, Human
cccacauaucucauagagu

SEQ ID NO: 433069 - RNA, 24 nt, Human
ccucuuacagaaggccaaagaagc

SEQ ID NO: 433070 - RNA, 20 nt, Human
cguggugaguguuacagcuc

SEQ ID NO: 433071 - RNA, 23 nt, Human
cguuugcggugaguguuacagcu

SEQ ID NO: 433072 - RNA, 26 nt, Human
cuccagaagguguccgugugggagac

SEQ ID NO: 433073 - RNA, 21 nt, Human
cucucgucccuuucagccauc

SEQ ID NO: 433074 - RNA, 19 nt, Human
cugccacugaauucagagu

SEQ ID NO: 433075 - RNA, 20 nt, Human
cugcuggcuccggcccgaau

SEQ ID NO: 433076 - RNA, 24 nt, Human
cuguaucuuagagaucuuuugaua

SEQ ID NO: 433077 - RNA, 21 nt, Human
cuucugcauuuccaacugugu

SEQ ID NO: 433078 - RNA, 22 nt, Human
cuuguggugaguguuacagcuc

SEQ ID NO: 433079 - RNA, 18 nt, Human
gaaacucaagugcccuuc

SEQ ID NO: 433080 - RNA, 20 nt, Human
gaaagaacaaagcuuccaca

SEQ ID NO: 433081 - RNA, 22 nt, Human
gaaagcaacacagcuucaccau

SEQ ID NO: 433082 - RNA, 18 nt, Human
gaaugaagccgcggaccc

SEQ ID NO: 433083 - RNA, 18 nt, Human
gaauucagagugcuucuc

SEQ ID NO: 433084 - RNA, 21 nt, Human
gaauucgguuuuuuuuuuuuu

SEQ ID NO: 433085 - RNA, 20 nt, Human
gaggaugagcugcaggucac

SEQ ID NO: 433086 - RNA, 20 nt, Human
gaguuguucguuccucccgg

SEQ ID NO: 433087 - RNA, 20 nt, Human
gcggacccuuguggugagug

SEQ ID NO: 433088 - RNA, 22 nt, Human
ggccaaagaagcugagaaagca

SEQ ID NO: 433089 - RNA, 23 nt, Human
gugggugguucuuuuaagugcac

SEQ ID NO: 433090 - RNA, 18 nt, Human
uaaaugcuuuuuauuuuu

SEQ ID NO: 433091 - RNA, 23 nt, Human
uaacuucuagaaaacuagugaca

SEQ ID NO: 433092 - RNA, 21 nt, Human
uagcaagauuuauugcaaaga

SEQ ID NO: 433093 - RNA, 22 nt, Human
ucaaagaaaaaaaaaaaaagaa

SEQ ID NO: 433094 - RNA, 23 nt, Human
ucaaagaaaaaaaaaaaaagaaa

SEQ ID NO: 433095 - RNA, 23 nt, Human
ucacaguauuucauagacagugu

SEQ ID NO: 433096 - RNA, 23 nt, Human
ucauuagauuagauaagcugugu

SEQ ID NO: 433097 - RNA, 21 nt, Human
uccagcgauuauucuuugcac

SEQ ID NO: 433098 - RNA, 24 nt, Human
uccuguggccaaaagauuuucuuc

SEQ ID NO: 433099 - RNA, 18 nt, Human
ucgucccuuucagccauc

SEQ ID NO: 433100 - RNA, 25 nt, Human
ucuagaguuuguuccuucugauguu

SEQ ID NO: 433101 - RNA, 25 nt, Human
ucuauguaucaaagaaaaaaaaaaa

SEQ ID NO: 433102 - RNA, 23 nt, Human
ucucauagaguuuaucucuggaa

SEQ ID NO: 433103 - RNA, 27 nt, Human
ucucuauguaucaaagaaaaaaaaaaa

SEQ ID NO: 433104 - RNA, 21 nt, Human
ucuuacuuaaaaaaaaaaaaa

SEQ ID NO: 433105 - RNA, 18 nt, Human
ucuuuuacaguucccuuc

SEQ ID NO: 433106 - RNA, 20 nt, Human
ugaacauugcauauaacccu

SEQ ID NO: 433107 - RNA, 21 nt, Human
ugagaaagcacagaggaaaua

SEQ ID NO: 433108 - RNA, 25 nt, Human
ugagaaguagcaagauuuauugcaa

SEQ ID NO: 433109 - RNA, 22 nt, Human
uggaguuguucguuccucccgg

SEQ ID NO: 433110 - RNA, 18 nt, Human
uguccggaauuggugggu

SEQ ID NO: 433111 - RNA, 20 nt, Human
uguggugaguguuacagcuc

SEQ ID NO: 433112 - RNA, 20 nt, Human
uuaaguucucugacgucgac

SEQ ID NO: 433113 - RNA, 21 nt, Human
uucacaguauuucauagacag

SEQ ID NO: 433114 - RNA, 19 nt, Human
uucggaguuucuuccuucu

SEQ ID NO: 433115 - RNA, 22 nt, Human
uucguggugaguguuacagcuc

SEQ ID NO: 433116 - RNA, 28 nt, Human
uucucugacgucgacugaugagggccca

SEQ ID NO: 433117 - RNA, 27 nt, Human
uuguucguuccucccggugggcucgug

SEQ ID NO: 433118 - RNA, 21 nt, Human
uuuccugaaacuuucucuuuu

SEQ ID NO: 433119 - RNA, 24 nt, Human
uuuuuuuuuuuuuuuucuaacaug

SEQ ID NO: 433120 - RNA, 24 nt, Human
aaugguuucccacucucaguguuu

SEQ ID NO: 433121 - RNA, 23 nt, Human
aauugugccagaagaccuugcca

SEQ ID NO: 433122 - RNA, 20 nt, Human
acauuuuucuggguuucucu

SEQ ID NO: 433123 - RNA, 23 nt, Human
agaauucuuugaaaaauccuggu

SEQ ID NO: 433124 - RNA, 18 nt, Human
agccuugaacaaaaacua

SEQ ID NO: 433125 - RNA, 19 nt, Human
auucuuugaaaaauccugg

SEQ ID NO: 433126 - RNA, 18 nt, Human
cacagacacugagaguca

SEQ ID NO: 433127 - RNA, 21 nt, Human
caugcacguuacauuuguaug

SEQ ID NO: 433128 - RNA, 21 nt, Human
cauuuagaaaaaauaccugag

SEQ ID NO: 433129 - RNA, 18 nt, Human
ccagaagaccuugccaca

SEQ ID NO: 433130 - RNA, 18 nt, Human
ccucuuccccuuccgggu

SEQ ID NO: 433131 - RNA, 24 nt, Human
ccuuauaggucacacgcacucgcu

SEQ ID NO: 433132 - RNA, 26 nt, Human
cgacaaaaucaugaauauuacacuga

SEQ ID NO: 433133 - RNA, 24 nt, Human
cucagaaucaauacaccccauucc

SEQ ID NO: 433134 - RNA, 24 nt, Human
cuguauuacucuccuuuuuuggug

SEQ ID NO: 433135 - RNA, 21 nt, Human
cuuuccaacauuacugucugg

SEQ ID NO: 433136 - RNA, 19 nt, Human
cuuuguguaguuacucucc

SEQ ID NO: 433137 - RNA, 23 nt, Human
gcaaaguuuuucuccaguauaaa

SEQ ID NO: 433138 - RNA, 23 nt, Human
gccuguggaaaaucucuaucaca

SEQ ID NO: 433139 - RNA, 19 nt, Human
uaaaugcucuuuaguaugg

SEQ ID NO: 433140 - RNA, 19 nt, Human
uaccugaggaagaaccauu

SEQ ID NO: 433141 - RNA, 24 nt, Human
uacuugcaaaguuuuucuccagua

SEQ ID NO: 433142 - RNA, 18 nt, Human
uagaaaaaauaccugagg

SEQ ID NO: 433143 - RNA, 23 nt, Human
ucaaaaaaguuuuugaugccuag

SEQ ID NO: 433144 - RNA, 23 nt, Human
uccuuuuuuggugguaauuccuu

SEQ ID NO: 433145 - RNA, 23 nt, Human
ucucuaucacauauaauuauuau

SEQ ID NO: 433146 - RNA, 23 nt, Human
ucucucacgacaaaaucaugaau

SEQ ID NO: 433147 - RNA, 24 nt, Human
ugaauauuacacugaaaggcuuuu

SEQ ID NO: 433148 - RNA, 21 nt, Human
ugccagaagaccuugccacau

SEQ ID NO: 433149 - RNA, 22 nt, Human
ugccagaagaccuugccacauu

SEQ ID NO: 433150 - RNA, 22 nt, Human
uuaagccuugaacaaaaacuaa

SEQ ID NO: 433151 - RNA, 22 nt, Human
uuccacagacacugagagucau

SEQ ID NO: 433152 - RNA, 24 nt, Human
uugaacaaaaacuaaaggcucugc

SEQ ID NO: 433153 - RNA, 21 nt, Human
aaaacacaaagcagggaaaac

SEQ ID NO: 433154 - RNA, 21 nt, Human
cacgagcagaaaacacaaagc

SEQ ID NO: 433155 - RNA, 21 nt, Human
ccaauaccugcaggccacagg

SEQ ID NO: 433156 - RNA, 26 nt, Human
ccaauaugaauuaucuuaccuaaagu

SEQ ID NO: 433157 - RNA, 19 nt, Human
cuaggcuuccagggggucc

SEQ ID NO: 433158 - RNA, 23 nt, Human
cucccaauaccugcaggccacag

SEQ ID NO: 433159 - RNA, 21 nt, Human
cugcaggccacagggccacag

SEQ ID NO: 433160 - RNA, 25 nt, Human
gagcagauauuaacggcuuuuccac

SEQ ID NO: 433161 - RNA, 26 nt, Human
uaguaguuucucuccaguauaaauuu

SEQ ID NO: 433162 - RNA, 20 nt, Human
uccacgagcagaaaacacaa

SEQ ID NO: 433163 - RNA, 24 nt, Human
uccacgagcagaaaacacaaagca

SEQ ID NO: 433164 - RNA, 18 nt, Human
ucccaauaccugcaggcc

SEQ ID NO: 433165 - RNA, 19 nt, Human
ugucaaaauuauugucaca

SEQ ID NO: 433166 - RNA, 21 nt, Human
uucagguuaguaguuucucuc

SEQ ID NO: 433167 - RNA, 18 nt, Human
uuguuugcacuuguaguu

SEQ ID NO: 433168 - RNA, 22 nt, Human
uuuuuuuuuuuuuuuuccauuu

SEQ ID NO: 433169 - RNA, 24 nt, Human
aagucgguuuuuuuccaccccuuu

SEQ ID NO: 433170 - RNA, 21 nt, Human
aguugccucuaucugccaacc

SEQ ID NO: 433171 - RNA, 22 nt, Human
aucauuauacuaaaauuaaagu

SEQ ID NO: 433172 - RNA, 24 nt, Human
cagcuuuauuggaauaguuuaaaa

SEQ ID NO: 433173 - RNA, 23 nt, Human
ccuccuacaugggaacauguuca

SEQ ID NO: 433174 - RNA, 18 nt, Human
cuacaugggaacauguuc

SEQ ID NO: 433175 - RNA, 23 nt, Human
cucuuuccaucugacuuuuaaaa

SEQ ID NO: 433176 - RNA, 23 nt, Human
gaaaaugcauuucucugcaauuc

SEQ ID NO: 433177 - RNA, 22 nt, Human
gaauagcuccaaauuaugcuaa

SEQ ID NO: 433178 - RNA, 18 nt, Human
gcagucagaucuuccgcg

SEQ ID NO: 433179 - RNA, 19 nt, Human
ggccuggggaagacggcuc

SEQ ID NO: 433180 - RNA, 18 nt, Human
ggcugcagucagaucuuc

SEQ ID NO: 433181 - RNA, 24 nt, Human
gucgguuuuuuuccaccccuuucc

SEQ ID NO: 433182 - RNA, 19 nt, Human
uaaagcucacuggccuggg

SEQ ID NO: 433183 - RNA, 23 nt, Human
uaacaccucuaccaaacuaaaca

SEQ ID NO: 433184 - RNA, 18 nt, Human
ucaaucagaaaaaggagg

SEQ ID NO: 433185 - RNA, 20 nt, Human
uccaacaucaacacugugau

SEQ ID NO: 433186 - RNA, 22 nt, Human
ugacucaacucuucccauucau

SEQ ID NO: 433187 - RNA, 23 nt, Human
ugaggucagacaauccaagacca

SEQ ID NO: 433188 - RNA, 24 nt, Human
ugccaucaccaucuauguguccaa

SEQ ID NO: 433189 - RNA, 19 nt, Human
uggaaguucauagacacuu

SEQ ID NO: 433190 - RNA, 25 nt, Human
uuaaaguuauuuauggaaguucauu

SEQ ID NO: 433191 - RNA, 23 nt, Human
acaggcgcccgccaccacgcccg

SEQ ID NO: 433192 - RNA, 18 nt, Human
acugcaagcuccgccucc

SEQ ID NO: 433193 - RNA, 19 nt, Human
agugcaguggcgugaucuc

SEQ ID NO: 433194 - RNA, 20 nt, Human
agugcaguggcgugaucucg

SEQ ID NO: 433195 - RNA, 23 nt, Human
agugcaguggcgugaucucggcu

SEQ ID NO: 433196 - RNA, 24 nt, Human
agugcaguggcgugaucucggcuc

SEQ ID NO: 433197 - RNA, 18 nt, Human
auagcugggacuacaggc

SEQ ID NO: 433198 - RNA, 22 nt, Human
auagcugggacuacaggcgccc

SEQ ID NO: 433199 - RNA, 21 nt, Human
cacagagcagugaagucgaga

SEQ ID NO: 433200 - RNA, 22 nt, Human
cacgccauucuccugccucagc

SEQ ID NO: 433201 - RNA, 21 nt, Human
caggcgcccgccaccacgccc

SEQ ID NO: 433202 - RNA, 21 nt, Human
ccaauaccugcaggucacagg

SEQ ID NO: 433203 - RNA, 25 nt, Human
ccuccuggagcagaggacacagagc

SEQ ID NO: 433204 - RNA, 23 nt, Human
ccugccucagccucucgcauagc

SEQ ID NO: 433205 - RNA, 19 nt, Human
cgccucccggguucacgcc

SEQ ID NO: 433206 - RNA, 21 nt, Human
cucccggguucacgccauucu

SEQ ID NO: 433207 - RNA, 20 nt, Human
cucugucgcccaggcuugag

SEQ ID NO: 433208 - RNA, 23 nt, Human
cugccucagccucucgcauagcu

SEQ ID NO: 433209 - RNA, 22 nt, Human
gagugcaguggcgugaucucgg

SEQ ID NO: 433210 - RNA, 24 nt, Human
gcccaggcuugagugcaguggcgu

SEQ ID NO: 433211 - RNA, 25 nt, Human
gccucccggguucacgccauucucc

SEQ ID NO: 433212 - RNA, 20 nt, Human
gcucugucgcccaggcuuga

SEQ ID NO: 433213 - RNA, 22 nt, Human
ggcuugagugcaguggcgugau

SEQ ID NO: 433214 - RNA, 21 nt, Human
gugaucucggcucacugcaag

SEQ ID NO: 433215 - RNA, 23 nt, Human
uacaggcgcccgccaccacgccc

SEQ ID NO: 433216 - RNA, 20 nt, Human
uaccugcaggucacagggcc

SEQ ID NO: 433217 - RNA, 18 nt, Human
ucacugcaagcuccgccu

SEQ ID NO: 433218 - RNA, 19 nt, Human
ucacugcaagcuccgccuc

SEQ ID NO: 433219 - RNA, 24 nt, Human
ucacugcaagcuccgccucccggg

SEQ ID NO: 433220 - RNA, 21 nt, Human
ucccggguucacgccauucuc

SEQ ID NO: 433221 - RNA, 24 nt, Human
ucccggguucacgccauucuccug

SEQ ID NO: 433222 - RNA, 23 nt, Human
ucgcauagcugggacuacaggcg

SEQ ID NO: 433223 - RNA, 18 nt, Human
ucgcccaggcuugagugc

SEQ ID NO: 433224 - RNA, 26 nt, Human
ucuccugccucagccucucgcauagc

SEQ ID NO: 433225 - RNA, 24 nt, Human
ucucgcauagcugggacuacaggc

SEQ ID NO: 433226 - RNA, 19 nt, Human
ucucgcucugucgcccagg

SEQ ID NO: 433227 - RNA, 24 nt, Human
ucucgcucugucgcccaggcuuga

SEQ ID NO: 433228 - RNA, 25 nt, Human
ucucgcucugucgcccaggcuugag

SEQ ID NO: 433229 - RNA, 24 nt, Human
ucugucgcccaggcuugagugcag

SEQ ID NO: 433230 - RNA, 22 nt, Human
ugagacggagucucgcucuguc

SEQ ID NO: 433231 - RNA, 18 nt, Human
ugagugcaguggcgugau

SEQ ID NO: 433232 - RNA, 24 nt, Human
ugccucagccucucgcauagcugg

SEQ ID NO: 433233 - RNA, 20 nt, Human
uggcgugaucucggcucacu

SEQ ID NO: 433234 - RNA, 21 nt, Human
ugggacuacaggcgcccgcca

SEQ ID NO: 433235 - RNA, 22 nt, Human
ugggacuacaggcgcccgccac

SEQ ID NO: 433236 - RNA, 24 nt, Human
ugggacuacaggcgcccgccacca

SEQ ID NO: 433237 - RNA, 23 nt, Human
uugagugcaguggcgugaucucg

SEQ ID NO: 433238 - RNA, 24 nt, Human
uugagugcaguggcgugaucucgg

SEQ ID NO: 433239 - RNA, 21 nt, Human
aacgaugcugaauacauagga

SEQ ID NO: 433240 - RNA, 24 nt, Human
accccugugaacacagcuaaaaau

SEQ ID NO: 433241 - RNA, 21 nt, Human
agccugugaagggcagaaggg

SEQ ID NO: 433242 - RNA, 21 nt, Human
aggaagacaguguuucucugg

SEQ ID NO: 433243 - RNA, 23 nt, Human
aggaagacaguguuucucuggga

SEQ ID NO: 433244 - RNA, 19 nt, Human
caaagguuucacaaaagua

SEQ ID NO: 433245 - RNA, 20 nt, Human
caaggucagcuggucagcuc

SEQ ID NO: 433246 - RNA, 20 nt, Human
cagcuggucagcucuuccuc

SEQ ID NO: 433247 - RNA, 18 nt, Human
cauguaugacugaaaggc

SEQ ID NO: 433248 - RNA, 23 nt, Human
ccugugaagggcagaagggugag

SEQ ID NO: 433249 - RNA, 21 nt, Human
gagcugccgcuguggcuacuc

SEQ ID NO: 433250 - RNA, 22 nt, Human
gcuaaaaaugguaugaaaagaa

SEQ ID NO: 433251 - RNA, 23 nt, Human
gggaaaacaaagguuucacaaaa

SEQ ID NO: 433252 - RNA, 20 nt, Human
ucccagcaaggucagcuggu

SEQ ID NO: 433253 - RNA, 22 nt, Human
ucccugaugggaaaacaaaggu

SEQ ID NO: 433254 - RNA, 21 nt, Human
ugaaaagaaguuuggaacuga

SEQ ID NO: 433255 - RNA, 25 nt, Human
ugaaaggcuuuuccacgugugguug

SEQ ID NO: 433256 - RNA, 21 nt, Human
ugacugaaaggcuuuuccacg

SEQ ID NO: 433257 - RNA, 24 nt, Human
ugcauguaugacugaaaggcuuuu

SEQ ID NO: 433258 - RNA, 19 nt, Human
ugguuuuuagaaacgaugc

SEQ ID NO: 433259 - RNA, 19 nt, Human
uucagccugugaagggcag

SEQ ID NO: 433260 - RNA, 22 nt, Human
uugguuuuuagaaacgaugcug

SEQ ID NO: 433261 - RNA, 25 nt, Human
aaauaagcaaugaaaauccuagugc

SEQ ID NO: 433262 - RNA, 24 nt, Human
aacacacccaccauauaauaguca

SEQ ID NO: 433263 - RNA, 19 nt, Human
aagacacuuuaaaauaagc

SEQ ID NO: 433264 - RNA, 19 nt, Human
aagcaucgggacaggaagc

SEQ ID NO: 433265 - RNA, 25 nt, Human
aagucuucacagccagcagcagccu

SEQ ID NO: 433266 - RNA, 20 nt, Human
accauauaauagucacugag

SEQ ID NO: 433267 - RNA, 20 nt, Human
acccugagaaccuaaggaau

SEQ ID NO: 433268 - RNA, 22 nt, Human
accuagggagaauucccuucag

SEQ ID NO: 433269 - RNA, 23 nt, Human
accucgcaagacuguuucuaacc

SEQ ID NO: 433270 - RNA, 21 nt, Human
accucugacccuccacccacu

SEQ ID NO: 433271 - RNA, 21 nt, Human
acuccagggcucaugucacac

SEQ ID NO: 433272 - RNA, 20 nt, Human
agaagcagauggugggcuug

SEQ ID NO: 433273 - RNA, 18 nt, Human
agacgaagauuugagucu

SEQ ID NO: 433274 - RNA, 23 nt, Human
agaggaaggggccagccacgugg

SEQ ID NO: 433275 - RNA, 22 nt, Human
agccaaggacaggagaggcuuc

SEQ ID NO: 433276 - RNA, 24 nt, Human
agcuacaaaguuuugguaaugaaa

SEQ ID NO: 433277 - RNA, 21 nt, Human
aggagaggcuuccaaggcucc

SEQ ID NO: 433278 - RNA, 18 nt, Human
aggcaggaggagcagggc

SEQ ID NO: 433279 - RNA, 22 nt, Human
aggcauggagggaagagccaag

SEQ ID NO: 433280 - RNA, 18 nt, Human
aggcuccaagagcagcag

SEQ ID NO: 433281 - RNA, 22 nt, Human
agggacgacacacuccagggcu

SEQ ID NO: 433282 - RNA, 23 nt, Human
auagucacugagcuugccccggg

SEQ ID NO: 433283 - RNA, 20 nt, Human
aucuccgccacccuccuccu

SEQ ID NO: 433284 - RNA, 22 nt, Human
cacacccaccauauaauaguca

SEQ ID NO: 433285 - RNA, 18 nt, Human
cacccacuccggugaccu

SEQ ID NO: 433286 - RNA, 21 nt, Human
cacccacuccggugaccugca

SEQ ID NO: 433287 - RNA, 20 nt, Human
cacugagcuugccccggggg

SEQ ID NO: 433288 - RNA, 21 nt, Human
cacuuuaaaauaagcaaugaa

SEQ ID NO: 433289 - RNA, 18 nt, Human
cagaagcagauggugggc

SEQ ID NO: 433290 - RNA, 22 nt, Human
cagaagcagauggugggcuuga

SEQ ID NO: 433291 - RNA, 20 nt, Human
cagcaaggcggcgucggggg

SEQ ID NO: 433292 - RNA, 22 nt, Human
caggagaggcuuccaaggcucc

SEQ ID NO: 433293 - RNA, 21 nt, Human
caggcuguuucaggcaggaag

SEQ ID NO: 433294 - RNA, 19 nt, Human
cauaaagugcaagcaaaga

SEQ ID NO: 433295 - RNA, 19 nt, Human
cauccugugcucaguuucc

SEQ ID NO: 433296 - RNA, 25 nt, Human
cauuucuacuucucagggccgaaga

SEQ ID NO: 433297 - RNA, 20 nt, Human
ccacaccuucgggccugccc

SEQ ID NO: 433298 - RNA, 22 nt, Human
ccauauacuucccuaaagcuca

SEQ ID NO: 433299 - RNA, 20 nt, Human
ccccugcauuucuacuucuc

SEQ ID NO: 433300 - RNA, 19 nt, Human
cccgggcuuccuccucucc

SEQ ID NO: 433301 - RNA, 18 nt, Human
cccugcuggagaaggcuc

SEQ ID NO: 433302 - RNA, 20 nt, Human
cccuuugcgauaaguugcaa

SEQ ID NO: 433303 - RNA, 26 nt, Human
ccuccauaaagugcaagcaaagauug

SEQ ID NO: 433304 - RNA, 21 nt, Human
ccucuaagacucuuguauuag

SEQ ID NO: 433305 - RNA, 22 nt, Human
cgaagacccgaccucugacccu

SEQ ID NO: 433306 - RNA, 20 nt, Human
cgacacucagaagcagaugg

SEQ ID NO: 433307 - RNA, 20 nt, Human
cgaccucugacccuccaccc

SEQ ID NO: 433308 - RNA, 18 nt, Human
cgcaccaggaaugaccgc

SEQ ID NO: 433309 - RNA, 21 nt, Human
cgggacaggaagcccugcugg

SEQ ID NO: 433310 - RNA, 18 nt, Human
cuaaagcucaacccaccc

SEQ ID NO: 433311 - RNA, 19 nt, Human
cuaaagcucaacccaccca

SEQ ID NO: 433312 - RNA, 20 nt, Human
cuaaagcucaacccacccac

SEQ ID NO: 433313 - RNA, 22 nt, Human
cuaaagcucaacccacccaccg

SEQ ID NO: 433314 - RNA, 19 nt, Human
cucaguuucccuggaaggu

SEQ ID NO: 433315 - RNA, 20 nt, Human
cuccaucuccgccacccucc

SEQ ID NO: 433316 - RNA, 24 nt, Human
cugaacacuuuaaaaaagaacacc

SEQ ID NO: 433317 - RNA, 22 nt, Human
cugaagaucaaauccaccauga

SEQ ID NO: 433318 - RNA, 24 nt, Human
cuggaagguuucucaugaucgccc

SEQ ID NO: 433319 - RNA, 21 nt, Human
cuguugucaguugggaucagc

SEQ ID NO: 433320 - RNA, 22 nt, Human
gaagacccgaccucugacccuc

SEQ ID NO: 433321 - RNA, 19 nt, Human
gaccucugacccuccaccc

SEQ ID NO: 433322 - RNA, 19 nt, Human
gaccuggcucggcucauga

SEQ ID NO: 433323 - RNA, 24 nt, Human
gacuaaaacaggcuuaagccaaga

SEQ ID NO: 433324 - RNA, 20 nt, Human
gagaggagaggacacacacc

SEQ ID NO: 433325 - RNA, 21 nt, Human
gagagggacgacacacuccag

SEQ ID NO: 433326 - RNA, 19 nt, Human
gagauguccaggcucuuga

SEQ ID NO: 433327 - RNA, 22 nt, Human
gagauguccaggcucuugagga

SEQ ID NO: 433328 - RNA, 18 nt, Human
gaggcaggaggagcaggg

SEQ ID NO: 433329 - RNA, 21 nt, Human
gauacgccccgagugccuuuc

SEQ ID NO: 433330 - RNA, 20 nt, Human
gauucagguucauuccccuu

SEQ ID NO: 433331 - RNA, 22 nt, Human
gcaagguccccugcccugaggg

SEQ ID NO: 433332 - RNA, 20 nt, Human
gcauggagggaagagccaag

SEQ ID NO: 433333 - RNA, 20 nt, Human
gccacugccaccucacccug

SEQ ID NO: 433334 - RNA, 20 nt, Human
gccagccacgugguggccau

SEQ ID NO: 433335 - RNA, 22 nt, Human
gcucuugaggagaaacaaaagu

SEQ ID NO: 433336 - RNA, 22 nt, Human
ggaaggggccagccacguggug

SEQ ID NO: 433337 - RNA, 25 nt, Human
ggagaauucccuucaggcuguuuca

SEQ ID NO: 433338 - RNA, 22 nt, Human
ggccacugaagaucaaauccaa

SEQ ID NO: 433339 - RNA, 18 nt, Human
gggacaggaagcccugcu

SEQ ID NO: 433340 - RNA, 22 nt, Human
gggcagaggcuauuccucagga

SEQ ID NO: 433341 - RNA, 18 nt, Human
ggguucacgguggugggu

SEQ ID NO: 433342 - RNA, 19 nt, Human
gucacugagcuugccccgg

SEQ ID NO: 433343 - RNA, 19 nt, Human
gugccgccuuuugggaaag

SEQ ID NO: 433344 - RNA, 21 nt, Human
gugccgccuuuugggaaagcc

SEQ ID NO: 433345 - RNA, 21 nt, Human
guugugugucugggaacaaag

SEQ ID NO: 433346 - RNA, 21 nt, Human
uaaaauaagcaaugaaaaucc

SEQ ID NO: 433347 - RNA, 19 nt, Human
uaccacugagaagcucggc

SEQ ID NO: 433348 - RNA, 27 nt, Human
uagacuuuuaaaaacaacuaacaguuc

SEQ ID NO: 433349 - RNA, 21 nt, Human
uagaguagggucccagucacu

SEQ ID NO: 433350 - RNA, 20 nt, Human
uagcagcaacguugauuugg

SEQ ID NO: 433351 - RNA, 20 nt, Human
uagugcgacacucagaagca

SEQ ID NO: 433352 - RNA, 22 nt, Human
uauagacuuuuaaaaacaacua

SEQ ID NO: 433353 - RNA, 19 nt, Human
ucacccccacugagggaaa

SEQ ID NO: 433354 - RNA, 19 nt, Human
ucacuggaccccaggaggc

SEQ ID NO: 433355 - RNA, 21 nt, Human
ucaguuccuuccuugcuguuc

SEQ ID NO: 433356 - RNA, 18 nt, Human
uccauccucaucuccauc

SEQ ID NO: 433357 - RNA, 23 nt, Human
ucccagucacuggaccccaggag

SEQ ID NO: 433358 - RNA, 19 nt, Human
ucccgggcuuccuccucuc

SEQ ID NO: 433359 - RNA, 21 nt, Human
ucccuggaagguuucucauga

SEQ ID NO: 433360 - RNA, 20 nt, Human
uccuccuucguugccucccg

SEQ ID NO: 433361 - RNA, 22 nt, Human
ucuccaucuccgccacccuccu

SEQ ID NO: 433362 - RNA, 21 nt, Human
ucuccuguugucaguugggau

SEQ ID NO: 433363 - RNA, 24 nt, Human
ucucugacuaaaacaggcuuaagc

SEQ ID NO: 433364 - RNA, 23 nt, Human
ucucuugcaaggaccaaagagau

SEQ ID NO: 433365 - RNA, 23 nt, Human
ugagagaggucugauggguucac

SEQ ID NO: 433366 - RNA, 18 nt, Human
ugagggggccgaggggug

SEQ ID NO: 433367 - RNA, 18 nt, Human
ugagggggccgaggggug

SEQ ID NO: 433368 - RNA, 20 nt, Human
ugcaaggaccaaagagauaa

SEQ ID NO: 433369 - RNA, 20 nt, Human
ugccucccgggcuuccuccu

SEQ ID NO: 433370 - RNA, 18 nt, Human
ugggaaagccgaguggag

SEQ ID NO: 433371 - RNA, 21 nt, Human
ugggaacaaaggauuaagaca

SEQ ID NO: 433372 - RNA, 27 nt, Human
ugggaucagcugaucggagugaacuuc

SEQ ID NO: 433373 - RNA, 18 nt, Human
ugguaaggaaacacaccc

SEQ ID NO: 433374 - RNA, 19 nt, Human
uggugggcuugagggggcc

SEQ ID NO: 433375 - RNA, 21 nt, Human
uguuauaguucuucacaaaca

SEQ ID NO: 433376 - RNA, 19 nt, Human
uugcugccucuaagacucu

SEQ ID NO: 433377 - RNA, 23 nt, Human
agcagcaccacugaggugucaga

SEQ ID NO: 433378 - RNA, 21 nt, Human
aggcagugcgacaccuccugg

SEQ ID NO: 433379 - RNA, 26 nt, Human
auaacagcagucagagucagggacac

SEQ ID NO: 433380 - RNA, 21 nt, Human
caccacagccaggccuacgcc

SEQ ID NO: 433381 - RNA, 22 nt, Human
cagcagucagagucagggacac

SEQ ID NO: 433382 - RNA, 21 nt, Human
ccacagccaggccuacgccca

SEQ ID NO: 433383 - RNA, 23 nt, Human
ccacugaggugucagaaggcaaa

SEQ ID NO: 433384 - RNA, 21 nt, Human
ccaggccuacgcccagcagca

SEQ ID NO: 433385 - RNA, 21 nt, Human
ccugcagagcagcaggcagcc

SEQ ID NO: 433386 - RNA, 26 nt, Human
cuacgcccagcagcaccacugaggug

SEQ ID NO: 433387 - RNA, 20 nt, Human
gaagcagacacaggguggga

SEQ ID NO: 433388 - RNA, 19 nt, Human
gaaggcaaagcccacugcu

SEQ ID NO: 433389 - RNA, 20 nt, Human
gcagagcagcaggcagccgg

SEQ ID NO: 433390 - RNA, 25 nt, Human
uauucggaagcagacacaggguggg

SEQ ID NO: 433391 - RNA, 21 nt, Human
ucagaaggcaaagcccacugc

SEQ ID NO: 433392 - RNA, 24 nt, Human
ugggaggcagugcgacaccuccug

SEQ ID NO: 433393 - RNA, 18 nt, Human
uggugagaaccaggauaa

SEQ ID NO: 433394 - RNA, 21 nt, Human
augcacacacaacaaagauug

SEQ ID NO: 433395 - RNA, 21 nt, Human
auggagacgaccaguaagcac

SEQ ID NO: 433396 - RNA, 21 nt, Human
caguaagcacuuccgggaugg

SEQ ID NO: 433397 - RNA, 20 nt, Human
ccgagccucgcgccuuggcc

SEQ ID NO: 433398 - RNA, 21 nt, Human
cgccuuggcucuaagacgccc

SEQ ID NO: 433399 - RNA, 22 nt, Human
cgcuuaggguccccuccagcuc

SEQ ID NO: 433400 - RNA, 22 nt, Human
cuccagcucuaccucucacucc

SEQ ID NO: 433401 - RNA, 21 nt, Human
gaccaguaagcacuuccggga

SEQ ID NO: 433402 - RNA, 24 nt, Human
gcccggugggcgcagcggcucacg

SEQ ID NO: 433403 - RNA, 20 nt, Human
gcgcauggagacgaccagua

SEQ ID NO: 433404 - RNA, 18 nt, Human
ggaaccggcgcauggaga

SEQ ID NO: 433405 - RNA, 21 nt, Human
ggcgcagcggcucacgucccg

SEQ ID NO: 433406 - RNA, 18 nt, Human
ggcgccgggucuagcccg

SEQ ID NO: 433407 - RNA, 21 nt, Human
ggguccccuccagcucuaccu

SEQ ID NO: 433408 - RNA, 18 nt, Human
guccccuccagcucuacc

SEQ ID NO: 433409 - RNA, 23 nt, Human
uauaaaaaugcacacacaacaaa

SEQ ID NO: 433410 - RNA, 21 nt, Human
ucuaagacgcccaggaaccgg

SEQ ID NO: 433411 - RNA, 18 nt, Human
ucucacuccgagccucgc

SEQ ID NO: 433412 - RNA, 18 nt, Human
ucuuucgugguguggagg

SEQ ID NO: 433413 - RNA, 20 nt, Human
uuaggguccccuccagcucu

SEQ ID NO: 433414 - RNA, 20 nt, Human
uuccgggauggaucuuucgu

SEQ ID NO: 433415 - RNA, 23 nt, Human
acacgguggugaagcucuugcca

SEQ ID NO: 433416 - RNA, 19 nt, Human
agagguggugaagguccag

SEQ ID NO: 433417 - RNA, 21 nt, Human
agguggugaagguccagccuc

SEQ ID NO: 433418 - RNA, 22 nt, Human
caaaaagaaaugacugcacuua

SEQ ID NO: 433419 - RNA, 19 nt, Human
ccaaaaagaaaugacugca

SEQ ID NO: 433420 - RNA, 19 nt, Human
gaagcucuugccacagccc

SEQ ID NO: 433421 - RNA, 22 nt, Human
ggugaagcucuugccacagccc

SEQ ID NO: 433422 - RNA, 22 nt, Human
uccagccgcagccacccagggg

SEQ ID NO: 433423 - RNA, 18 nt, Human
uggcaaggaaugaauaga

SEQ ID NO: 433424 - RNA, 19 nt, Human
uggcaaggaaugaauagag

SEQ ID NO: 433425 - RNA, 22 nt, Human
uggcaaggaaugaauagaguug

SEQ ID NO: 433426 - RNA, 23 nt, Human
uuuagaucuccaaacucauaguc

SEQ ID NO: 433427 - RNA, 19 nt, Human
aagcagcagcacuaaaccu

SEQ ID NO: 433428 - RNA, 22 nt, Human
agcagaguacaaaggcugcucg

SEQ ID NO: 433429 - RNA, 23 nt, Human
agcagugaaagcagcagcacuaa

SEQ ID NO: 433430 - RNA, 22 nt, Human
agggugggaauguccuggaggg

SEQ ID NO: 433431 - RNA, 19 nt, Human
cacuaaaccuggugccccc

SEQ ID NO: 433432 - RNA, 24 nt, Human
cacuaaaccuggugccccccucag

SEQ ID NO: 433433 - RNA, 23 nt, Human
cagcacuaaaccuggugcccccc

SEQ ID NO: 433434 - RNA, 23 nt, Human
caggaugggcgaggaccagaccc

SEQ ID NO: 433435 - RNA, 19 nt, Human
ccacaauggggcauggacu

SEQ ID NO: 433436 - RNA, 18 nt, Human
ccagaccccagggcgggg

SEQ ID NO: 433437 - RNA, 20 nt, Human
cccgguccggagcagccucc

SEQ ID NO: 433438 - RNA, 23 nt, Human
cccuagaccauguuggguccugg

SEQ ID NO: 433439 - RNA, 25 nt, Human
cccuccgcaagcagaguacaaaggc

SEQ ID NO: 433440 - RNA, 19 nt, Human
cccugcaggaugggcgagg

SEQ ID NO: 433441 - RNA, 21 nt, Human
ccgcagacucugcgucccggu

SEQ ID NO: 433442 - RNA, 18 nt, Human
cuggagggucucccagcc

SEQ ID NO: 433443 - RNA, 23 nt, Human
cuggugccccccucagguggggu

SEQ ID NO: 433444 - RNA, 22 nt, Human
gcagcagugaaagcagcagcac

SEQ ID NO: 433445 - RNA, 23 nt, Human
gcagugaaagcagcagcacuaaa

SEQ ID NO: 433446 - RNA, 21 nt, Human
ggcgaggaccagaccccaggg

SEQ ID NO: 433447 - RNA, 22 nt, Human
gggcgaggaccagaccccaggg

SEQ ID NO: 433448 - RNA, 20 nt, Human
gggguuggaaaugggagggg

SEQ ID NO: 433449 - RNA, 20 nt, Human
gggugcagcagugaaagcag

SEQ ID NO: 433450 - RNA, 22 nt, Human
gggugguccacaauggggcaug

SEQ ID NO: 433451 - RNA, 21 nt, Human
ggugguccacaauggggcaug

SEQ ID NO: 433452 - RNA, 23 nt, Human
guccuggagggucucccagcccu

SEQ ID NO: 433453 - RNA, 20 nt, Human
uaacugaggugggggcaggu

SEQ ID NO: 433454 - RNA, 18 nt, Human
uccacaauggggcaugga

SEQ ID NO: 433455 - RNA, 19 nt, Human
uccacaauggggcauggac

SEQ ID NO: 433456 - RNA, 18 nt, Human
ucggcgccggguccgcag

SEQ ID NO: 433457 - RNA, 21 nt, Human
ucggcgccggguccgcagacu

SEQ ID NO: 433458 - RNA, 19 nt, Human
uggcagcaugggggagggu

SEQ ID NO: 433459 - RNA, 24 nt, Human
ugggaggggcuagacaucaaaaca

SEQ ID NO: 433460 - RNA, 22 nt, Human
ugggaugcuagggagggguugg

SEQ ID NO: 433461 - RNA, 19 nt, Human
ugggggagggugggaaugu

SEQ ID NO: 433462 - RNA, 22 nt, Human
uggguccugggucagggcaccu

SEQ ID NO: 433463 - RNA, 18 nt, Human
ugggugguccacaauggg

SEQ ID NO: 433464 - RNA, 21 nt, Human
ugguccacaauggggcaugga

SEQ ID NO: 433465 - RNA, 22 nt, Human
uggugccccccucagguggggu

SEQ ID NO: 433466 - RNA, 18 nt, Human
uuuuuuuuuuuuuuucug

SEQ ID NO: 433467 - RNA, 21 nt, Human
aaaaaagaaaaaagaaaagaa

SEQ ID NO: 433468 - RNA, 18 nt, Human
aaaaagaaaaaagaaaaa

SEQ ID NO: 433469 - RNA, 25 nt, Human
aaaaagaaaaaagaaaagaaaaugg

SEQ ID NO: 433470 - RNA, 23 nt, Human
aaaagaaaagaaaauggaacaag

SEQ ID NO: 433471 - RNA, 25 nt, Human
aaaagcaaccuucuaguaaaaagca

SEQ ID NO: 433472 - RNA, 19 nt, Human
aaaggaagguacuguucag

SEQ ID NO: 433473 - RNA, 19 nt, Human
aacccaguggggacaggag

SEQ ID NO: 433474 - RNA, 20 nt, Human
aaccgaggaagaccccaccu

SEQ ID NO: 433475 - RNA, 23 nt, Human
aagaaacaaaguaacaacucaua

SEQ ID NO: 433476 - RNA, 22 nt, Human
aagaaaggaaaaagaaaaaaga

SEQ ID NO: 433477 - RNA, 19 nt, Human
aagaggcugggaggacggg

SEQ ID NO: 433478 - RNA, 22 nt, Human
aagcaaccuucuaguaaaaagc

SEQ ID NO: 433479 - RNA, 23 nt, Human
acugggaucggcuuucuucuggg

SEQ ID NO: 433480 - RNA, 28 nt, Human
acuguucaguguagucggcuuugguaug

SEQ ID NO: 433481 - RNA, 19 nt, Human
agaaaaaagaaaaaagaaa

SEQ ID NO: 433482 - RNA, 21 nt, Human
agaaaggaaaaagaaaaaaga

SEQ ID NO: 433483 - RNA, 19 nt, Human
agaauaucaauuaagcuua

SEQ ID NO: 433484 - RNA, 25 nt, Human
agacagggaaagaauauacauguuu

SEQ ID NO: 433485 - RNA, 22 nt, Human
agagucuaucuggaccauuuuu

SEQ ID NO: 433486 - RNA, 19 nt, Human
agcaguauaaauaugcuca

SEQ ID NO: 433487 - RNA, 19 nt, Human
aggaaaaagaaaaaagaaa

SEQ ID NO: 433488 - RNA, 20 nt, Human
aggcgcccagaggcagcucu

SEQ ID NO: 433489 - RNA, 18 nt, Human
aggcggcggccgcgcugc

SEQ ID NO: 433490 - RNA, 23 nt, Human
agucuaaagaaaguucugaacag

SEQ ID NO: 433491 - RNA, 22 nt, Human
auuaaaauaugcaugccugaca

SEQ ID NO: 433492 - RNA, 20 nt, Human
auuuugccugccccuuucuc

SEQ ID NO: 433493 - RNA, 20 nt, Human
caaccgaggaagaccccacc

SEQ ID NO: 433494 - RNA, 22 nt, Human
caccagaaacgccggcugccgg

SEQ ID NO: 433495 - RNA, 22 nt, Human
caccuccggcuccggccgggag

SEQ ID NO: 433496 - RNA, 21 nt, Human
cacugaaugacguugccccag

SEQ ID NO: 433497 - RNA, 22 nt, Human
cacuugacagcauuaaguuuaa

SEQ ID NO: 433498 - RNA, 24 nt, Human
cagagugaauaaguuacauagaua

SEQ ID NO: 433499 - RNA, 21 nt, Human
cagccuccggcccacacggcc

SEQ ID NO: 433500 - RNA, 23 nt, Human
caggugaaaagacuuggaauuua

SEQ ID NO: 433501 - RNA, 25 nt, Human
caucgaagaaacaaaguaacaacuu

SEQ ID NO: 433502 - RNA, 19 nt, Human
ccagaggcagcucugcgga

SEQ ID NO: 433503 - RNA, 19 nt, Human
ccaggacuugcuucuuauu

SEQ ID NO: 433504 - RNA, 25 nt, Human
ccaggacuugcuucuuauuugcugg

SEQ ID NO: 433505 - RNA, 19 nt, Human
cccacacggccgccgcggg

SEQ ID NO: 433506 - RNA, 21 nt, Human
cccacacggccgccgcggggc

SEQ ID NO: 433507 - RNA, 23 nt, Human
cccacacggccgccgcggggcua

SEQ ID NO: 433508 - RNA, 22 nt, Human
ccgcccaccagcucggcuccag

SEQ ID NO: 433509 - RNA, 19 nt, Human
ccugccccuuucucagccc

SEQ ID NO: 433510 - RNA, 19 nt, Human
ccugucacagguugugaug

SEQ ID NO: 433511 - RNA, 20 nt, Human
cgagaagacacugaaugacg

SEQ ID NO: 433512 - RNA, 22 nt, Human
cgcuccuccuccuccgggucca

SEQ ID NO: 433513 - RNA, 19 nt, Human
cuaaaggacacggcggagc

SEQ ID NO: 433514 - RNA, 19 nt, Human
cucccugcagcccucggag

SEQ ID NO: 433515 - RNA, 23 nt, Human
cuugugaauaguuuucucuacaa

SEQ ID NO: 433516 - RNA, 21 nt, Human
cuuucagaaacaguagccuag

SEQ ID NO: 433517 - RNA, 21 nt, Human
gcagcggccgggagcagguac

SEQ ID NO: 433518 - RNA, 20 nt, Human
gcgcccagaggcagcucugc

SEQ ID NO: 433519 - RNA, 20 nt, Human
ggaacccaguggggacagga

SEQ ID NO: 433520 - RNA, 21 nt, Human
ggagucuguccaggacguucu

SEQ ID NO: 433521 - RNA, 20 nt, Human
ggccggccucccugacgcgg

SEQ ID NO: 433522 - RNA, 21 nt, Human
gggcugucaucaccagaaacg

SEQ ID NO: 433523 - RNA, 18 nt, Human
uaaaaagcagccaagauc

SEQ ID NO: 433524 - RNA, 20 nt, Human
uaaaaagcagccaagauccu

SEQ ID NO: 433525 - RNA, 21 nt, Human
uaaagaaaguucugaacagaa

SEQ ID NO: 433526 - RNA, 18 nt, Human
uaaaggacacggcggagc

SEQ ID NO: 433527 - RNA, 23 nt, Human
uaacacauuugugccacacagca

SEQ ID NO: 433528 - RNA, 19 nt, Human
uacacaggcugucagcuuu

SEQ ID NO: 433529 - RNA, 28 nt, Human
uacacguuggaaguucugccauccucuu

SEQ ID NO: 433530 - RNA, 21 nt, Human
uacagguaacaagagggagaa

SEQ ID NO: 433531 - RNA, 20 nt, Human
uagaaaaagcccuacaggua

SEQ ID NO: 433532 - RNA, 20 nt, Human
uaguaaaaagcagccaagau

SEQ ID NO: 433533 - RNA, 26 nt, Human
uaucuggaccauuuuuggugcaaagg

SEQ ID NO: 433534 - RNA, 19 nt, Human
ucaccagaaacgccggcug

SEQ ID NO: 433535 - RNA, 21 nt, Human
ucagcccacgaaagaaaggaa

SEQ ID NO: 433536 - RNA, 19 nt, Human
ucuaaaggacacggcggag

SEQ ID NO: 433537 - RNA, 18 nt, Human
ucuuuuuuuuuuuuuuuu

SEQ ID NO: 433538 - RNA, 21 nt, Human
ucuuuuuuuuuuuuuuuuagu

SEQ ID NO: 433539 - RNA, 24 nt, Human
ugaaaagacuuggaauuuaucuug

SEQ ID NO: 433540 - RNA, 22 nt, Human
ugacaggugaaaagacuuggaa

SEQ ID NO: 433541 - RNA, 19 nt, Human
ugagugaagaaaacauugc

SEQ ID NO: 433542 - RNA, 22 nt, Human
ugccauccucuuuagaaaaagc

SEQ ID NO: 433543 - RNA, 23 nt, Human
uggaacaagacagggaaagaaua

SEQ ID NO: 433544 - RNA, 19 nt, Human
uggcagcacugcaguuugg

SEQ ID NO: 433545 - RNA, 25 nt, Human
uggcagcacugcaguuuggaaccca

SEQ ID NO: 433546 - RNA, 18 nt, Human
ugucacagguugugaugu

SEQ ID NO: 433547 - RNA, 20 nt, Human
uuacauauauauuacacaua

SEQ ID NO: 433548 - RNA, 25 nt, Human
uugccugccccuuucucagcccacg

SEQ ID NO: 433549 - RNA, 23 nt, Human
uuggaaguucugccauccucuuu

SEQ ID NO: 433550 - RNA, 22 nt, Human
uuuacagagugaauaaguuaca

SEQ ID NO: 433551 - RNA, 20 nt, Human
agcaaauggggaugggguug

SEQ ID NO: 433552 - RNA, 18 nt, Human
agcaggaaauggguaaug

SEQ ID NO: 433553 - RNA, 19 nt, Human
auaaaagacauauuuacag

SEQ ID NO: 433554 - RNA, 22 nt, Human
cauaguugaauucuaaaaaguu

SEQ ID NO: 433555 - RNA, 25 nt, Human
uacuaaaaaaagaauguguuacagc

SEQ ID NO: 433556 - RNA, 18 nt, Human
ucuggacagcaaaugggg

SEQ ID NO: 433557 - RNA, 21 nt, Human
uggaacauccauacauugaaa

SEQ ID NO: 433558 - RNA, 29 nt, Human
aaaaaaaaaaaacacccuucucagagggg

SEQ ID NO: 433559 - RNA, 23 nt, Human
aaaaaaaacacccuucucagagg

SEQ ID NO: 433560 - RNA, 20 nt, Human
aaaaaaaugccagaucccac

SEQ ID NO: 433561 - RNA, 20 nt, Human
aaaaaacagagagaacaaac

SEQ ID NO: 433562 - RNA, 25 nt, Human
aaaaaagaaaacaaaaaacagagag

SEQ ID NO: 433563 - RNA, 21 nt, Human
aaaaaagaaagaaaacacgag

SEQ ID NO: 433564 - RNA, 24 nt, Human
aaaaagaaaacaaaaaacagagag

SEQ ID NO: 433565 - RNA, 25 nt, Human
aaaaagaaaacaaaaaacagagaga

SEQ ID NO: 433566 - RNA, 21 nt, Human
aaaauaccccagaccaaaaug

SEQ ID NO: 433567 - RNA, 18 nt, Human
aaacaaaaaacagagaga

SEQ ID NO: 433568 - RNA, 24 nt, Human
aaacaaaaauaccccagaccaaaa

SEQ ID NO: 433569 - RNA, 24 nt, Human
aaacacccuucucagagggucccc

SEQ ID NO: 433570 - RNA, 19 nt, Human
aaacaguauuuccccccca

SEQ ID NO: 433571 - RNA, 19 nt, Human
aaagaaagaaaacacgagg

SEQ ID NO: 433572 - RNA, 24 nt, Human
aacaaaaaacagagagaacaaaca

SEQ ID NO: 433573 - RNA, 18 nt, Human
aacaaacaaaaauacccc

SEQ ID NO: 433574 - RNA, 20 nt, Human
aacagagagaacaaacaaaa

SEQ ID NO: 433575 - RNA, 22 nt, Human
aacagcuccagcgagaaagaau

SEQ ID NO: 433576 - RNA, 18 nt, Human
aagaaaaaaaagaaaaca

SEQ ID NO: 433577 - RNA, 25 nt, Human
aagaaaacaaaaaacagagagaaca

SEQ ID NO: 433578 - RNA, 20 nt, Human
aagaggagagacugguagcu

SEQ ID NO: 433579 - RNA, 23 nt, Human
acacgcuagaagcuuccagaacc

SEQ ID NO: 433580 - RNA, 21 nt, Human
acaugccaccuguagucccag

SEQ ID NO: 433581 - RNA, 19 nt, Human
accacugcacuccagccug

SEQ ID NO: 433582 - RNA, 24 nt, Human
accccagaguggaaggaaaaacaa

SEQ ID NO: 433583 - RNA, 23 nt, Human
accuugggcgaugcggcuucuug

SEQ ID NO: 433584 - RNA, 18 nt, Human
acugcacuccagccuggg

SEQ ID NO: 433585 - RNA, 22 nt, Human
acugcacuccagccugggugac

SEQ ID NO: 433586 - RNA, 26 nt, Human
acugcacuccagccugggugacugag

SEQ ID NO: 433587 - RNA, 18 nt, Human
agaaaacaaaaaacagag

SEQ ID NO: 433588 - RNA, 20 nt, Human
agaaaacaaaaaacagagag

SEQ ID NO: 433589 - RNA, 22 nt, Human
agaaaacaguauuuccccccca

SEQ ID NO: 433590 - RNA, 26 nt, Human
agaaagugagaugcugauaaaaaaaa

SEQ ID NO: 433591 - RNA, 19 nt, Human
agagggcuuuccuggguca

SEQ ID NO: 433592 - RNA, 24 nt, Human
agcuaguugggaggcugagguggg

SEQ ID NO: 433593 - RNA, 21 nt, Human
agcugccgucugcucccugcu

SEQ ID NO: 433594 - RNA, 24 nt, Human
aggcugaggugggaguaucgcuug

SEQ ID NO: 433595 - RNA, 18 nt, Human
agggagaggaugggggcc

SEQ ID NO: 433596 - RNA, 20 nt, Human
agggaggggguuggggcuga

SEQ ID NO: 433597 - RNA, 19 nt, Human
aggugccaaccuugggcga

SEQ ID NO: 433598 - RNA, 19 nt, Human
agguggaggcugcagugag

SEQ ID NO: 433599 - RNA, 20 nt, Human
agguggaggcugcagugagc

SEQ ID NO: 433600 - RNA, 18 nt, Human
aggugggaguaucgcuug

SEQ ID NO: 433601 - RNA, 23 nt, Human
aguggaaggaaaaacaacccaga

SEQ ID NO: 433602 - RNA, 27 nt, Human
auaaaaaaaaaaaaaacacccuucuca

SEQ ID NO: 433603 - RNA, 24 nt, Human
aucauaccacugcacuccagccug

SEQ ID NO: 433604 - RNA, 22 nt, Human
auggcagggaggggguuggggc

SEQ ID NO: 433605 - RNA, 23 nt, Human
auggcagggaggggguuggggcu

SEQ ID NO: 433606 - RNA, 19 nt, Human
augggggugggguugaugg

SEQ ID NO: 433607 - RNA, 23 nt, Human
caaaaaacagagagaacaaacaa

SEQ ID NO: 433608 - RNA, 22 nt, Human
caaacaaaaauaccccagacca

SEQ ID NO: 433609 - RNA, 22 nt, Human
caacaggaucaagcagagggcu

SEQ ID NO: 433610 - RNA, 18 nt, Human
caaccuugggcgaugcgg

SEQ ID NO: 433611 - RNA, 23 nt, Human
caccuguagucccagcuaguugg

SEQ ID NO: 433612 - RNA, 24 nt, Human
caccuguagucccagcuaguuggg

SEQ ID NO: 433613 - RNA, 20 nt, Human
cacgcugucaaaagcgaggc

SEQ ID NO: 433614 - RNA, 18 nt, Human
cacuccagccugggugac

SEQ ID NO: 433615 - RNA, 18 nt, Human
cacuccagccugggugac

SEQ ID NO: 433616 - RNA, 20 nt, Human
cacuccagccugggugacug

SEQ ID NO: 433617 - RNA, 19 nt, Human
cacugcacuccagccuggg

SEQ ID NO: 433618 - RNA, 19 nt, Human
cacugcacuccagccuggg

SEQ ID NO: 433619 - RNA, 22 nt, Human
cacugcacuccagccuggguga

SEQ ID NO: 433620 - RNA, 23 nt, Human
cacugcacuccagccugggugac

SEQ ID NO: 433621 - RNA, 23 nt, Human
cacugcacuccagccugggugac

SEQ ID NO: 433622 - RNA, 20 nt, Human
cagagggcuuuccuggguca

SEQ ID NO: 433623 - RNA, 24 nt, Human
cagcuaguugggaggcugaggugg

SEQ ID NO: 433624 - RNA, 20 nt, Human
cagcuccagcgagaaagaau

SEQ ID NO: 433625 - RNA, 20 nt, Human
caggagguggaggcugcagu

SEQ ID NO: 433626 - RNA, 24 nt, Human
ccaaugccugaacgagaccccaga

SEQ ID NO: 433627 - RNA, 23 nt, Human
ccaccuguagucccagcuaguug

SEQ ID NO: 433628 - RNA, 20 nt, Human
ccacugcacuccagccuggg

SEQ ID NO: 433629 - RNA, 20 nt, Human
ccacugcacuccagccuggg

SEQ ID NO: 433630 - RNA, 21 nt, Human
ccacugcacuccagccugggu

SEQ ID NO: 433631 - RNA, 21 nt, Human
ccacugcacuccagccugggu

SEQ ID NO: 433632 - RNA, 23 nt, Human
ccacugcacuccagccuggguga

SEQ ID NO: 433633 - RNA, 24 nt, Human
ccacugcacuccagccugggugac

SEQ ID NO: 433634 - RNA, 21 nt, Human
ccagaauggggggacccuuaa

SEQ ID NO: 433635 - RNA, 22 nt, Human
ccaggagguggaggcugcagug

SEQ ID NO: 433636 - RNA, 18 nt, Human
ccaucuagaaauggacug

SEQ ID NO: 433637 - RNA, 18 nt, Human
cccagaguggaaggaaaa

SEQ ID NO: 433638 - RNA, 21 nt, Human
ccccacuucuuuaauaggcaa

SEQ ID NO: 433639 - RNA, 24 nt, Human
ccccccacuucuuuaauaggcaaa

SEQ ID NO: 433640 - RNA, 20 nt, Human
ccccugcugaaccccagcuc

SEQ ID NO: 433641 - RNA, 19 nt, Human
cccggggggagaggggagg

SEQ ID NO: 433642 - RNA, 23 nt, Human
cccggggggagaggggaggggug

SEQ ID NO: 433643 - RNA, 21 nt, Human
cccugcccacggggccccccc

SEQ ID NO: 433644 - RNA, 22 nt, Human
cccugcccacggggccccccca

SEQ ID NO: 433645 - RNA, 19 nt, Human
ccugcugaaccccagcuca

SEQ ID NO: 433646 - RNA, 23 nt, Human
ccugcugaaccccagcucaguuc

SEQ ID NO: 433647 - RNA, 21 nt, Human
ccuguagucccagcuaguugg

SEQ ID NO: 433648 - RNA, 23 nt, Human
cgagaccccagaguggaaggaaa

SEQ ID NO: 433649 - RNA, 22 nt, Human
cucaggaccuaggugguggugg

SEQ ID NO: 433650 - RNA, 20 nt, Human
cucuuccucuacgcggaaga

SEQ ID NO: 433651 - RNA, 21 nt, Human
cugcucccugcuggugggucc

SEQ ID NO: 433652 - RNA, 22 nt, Human
cugcucccugcugguggguccu

SEQ ID NO: 433653 - RNA, 23 nt, Human
cugcugguggguccuuggggugg

SEQ ID NO: 433654 - RNA, 25 nt, Human
cugggggaugauggcagacaggcuu

SEQ ID NO: 433655 - RNA, 22 nt, Human
cuugggaaaaaaaaagaaagaa

SEQ ID NO: 433656 - RNA, 27 nt, Human
cuuuaugggggugggguugauggcagu

SEQ ID NO: 433657 - RNA, 22 nt, Human
gaaaaaaaaagaaagaaaacac

SEQ ID NO: 433658 - RNA, 19 nt, Human
gaaaaacaacccagaaaug

SEQ ID NO: 433659 - RNA, 22 nt, Human
gaaggaaaaacaacccagaaau

SEQ ID NO: 433660 - RNA, 19 nt, Human
gagaggaugggggccagaa

SEQ ID NO: 433661 - RNA, 21 nt, Human
gagaggaugggggccagaaug

SEQ ID NO: 433662 - RNA, 18 nt, Human
gagcugucguguggcagg

SEQ ID NO: 433663 - RNA, 19 nt, Human
gagggagaggaugggggcc

SEQ ID NO: 433664 - RNA, 19 nt, Human
gaggggguuggggcugaau

SEQ ID NO: 433665 - RNA, 19 nt, Human
gaggugagagcugucgugu

SEQ ID NO: 433666 - RNA, 19 nt, Human
gcucuccccuccccucccc

SEQ ID NO: 433667 - RNA, 20 nt, Human
gcugugaucauaccacugca

SEQ ID NO: 433668 - RNA, 19 nt, Human
ggaaugggcaggcggccca

SEQ ID NO: 433669 - RNA, 18 nt, Human
ggaggcugcagugagcug

SEQ ID NO: 433670 - RNA, 20 nt, Human
ggaggcugcagugagcuggc

SEQ ID NO: 433671 - RNA, 23 nt, Human
ggcuucuugggaaauaacagcuc

SEQ ID NO: 433672 - RNA, 20 nt, Human
gggaaaaaaaaagaaagaaa

SEQ ID NO: 433673 - RNA, 19 nt, Human
gggaggggguuggggcuga

SEQ ID NO: 433674 - RNA, 23 nt, Human
gggcccccccacgcugucaaaag

SEQ ID NO: 433675 - RNA, 21 nt, Human
ggggaaugggcaggcggccca

SEQ ID NO: 433676 - RNA, 20 nt, Human
ggggaggggugggcguggug

SEQ ID NO: 433677 - RNA, 19 nt, Human
ggggcugaauggagaagaa

SEQ ID NO: 433678 - RNA, 21 nt, Human
ggugagggagaggaugggggc

SEQ ID NO: 433679 - RNA, 18 nt, Human
guccuugggguggaaagc

SEQ ID NO: 433680 - RNA, 20 nt, Human
guggaggcugcagugagcug

SEQ ID NO: 433681 - RNA, 21 nt, Human
gugggcucuccccuccccucc

SEQ ID NO: 433682 - RNA, 21 nt, Human
uaaaaaaaugccagaucccac

SEQ ID NO: 433683 - RNA, 22 nt, Human
uaaaaaaaugccagaucccacc

SEQ ID NO: 433684 - RNA, 23 nt, Human
uaacgggaggaggaggguuuuua

SEQ ID NO: 433685 - RNA, 22 nt, Human
uaccacugcacuccagccuggg

SEQ ID NO: 433686 - RNA, 19 nt, Human
uaccccagaccaaaaugcc

SEQ ID NO: 433687 - RNA, 22 nt, Human
uacgcggaagaggagagacugg

SEQ ID NO: 433688 - RNA, 22 nt, Human
uacuucagcuuuuuuuuugucu

SEQ ID NO: 433689 - RNA, 22 nt, Human
uagaaaaucaacaggaucaagc

SEQ ID NO: 433690 - RNA, 20 nt, Human
ucaggaccuaggugguggug

SEQ ID NO: 433691 - RNA, 21 nt, Human
ucaggaccuaggugguggugg

SEQ ID NO: 433692 - RNA, 23 nt, Human
ucauaccacugcacuccagccug

SEQ ID NO: 433693 - RNA, 19 nt, Human
uccagccugggugacugag

SEQ ID NO: 433694 - RNA, 20 nt, Human
uccagccugggugacugaga

SEQ ID NO: 433695 - RNA, 26 nt, Human
ucccggggggagaggggagggguggg

SEQ ID NO: 433696 - RNA, 24 nt, Human
uccugggucaccccugcugaaccc

SEQ ID NO: 433697 - RNA, 22 nt, Human
uccuugggguggaaagcauggc

SEQ ID NO: 433698 - RNA, 22 nt, Human
uccuugggguggaaagcauggc

SEQ ID NO: 433699 - RNA, 22 nt, Human
ucgcuugagcccaggaggugga

SEQ ID NO: 433700 - RNA, 24 nt, Human
ucgcuugagcccaggagguggagg

SEQ ID NO: 433701 - RNA, 25 nt, Human
ucucagaggguccacggcccugguu

SEQ ID NO: 433702 - RNA, 25 nt, Human
ucuugggaaaaaaaaagaaagaaaa

SEQ ID NO: 433703 - RNA, 19 nt, Human
ugaaaaaucaagguccugg

SEQ ID NO: 433704 - RNA, 22 nt, Human
ugaccugacagcccccaauucc

SEQ ID NO: 433705 - RNA, 18 nt, Human
ugagagagaacccaucuu

SEQ ID NO: 433706 - RNA, 25 nt, Human
ugagaugcugauaaaaaaaaaaaaa

SEQ ID NO: 433707 - RNA, 21 nt, Human
ugaggagaccccaaugccuga

SEQ ID NO: 433708 - RNA, 19 nt, Human
ugagggagaggaugggggc

SEQ ID NO: 433709 - RNA, 24 nt, Human
ugaggugggaguaucgcuugagcc

SEQ ID NO: 433710 - RNA, 25 nt, Human
ugaggugggaguaucgcuugagccc

SEQ ID NO: 433711 - RNA, 20 nt, Human
ugcccacggggcccccccac

SEQ ID NO: 433712 - RNA, 20 nt, Human
ugccgucugcucccugcugg

SEQ ID NO: 433713 - RNA, 23 nt, Human
ugccugaacgagaccccagagug

SEQ ID NO: 433714 - RNA, 20 nt, Human
ugccuggaguaggggaaugg

SEQ ID NO: 433715 - RNA, 23 nt, Human
uggaaggaaaaacaacccagaaa

SEQ ID NO: 433716 - RNA, 24 nt, Human
uggacugucauaaaaaaaugccag

SEQ ID NO: 433717 - RNA, 26 nt, Human
uggcagggaggggguugaccggaacg

SEQ ID NO: 433718 - RNA, 18 nt, Human
uggcagggaggggguugg

SEQ ID NO: 433719 - RNA, 19 nt, Human
ugggaggcugaggugggag

SEQ ID NO: 433720 - RNA, 23 nt, Human
ugggaggcugaggugggaguauc

SEQ ID NO: 433721 - RNA, 24 nt, Human
ugggaggcugaggugggaguaucg

SEQ ID NO: 433722 - RNA, 20 nt, Human
ugggcgaugcggcuucuugg

SEQ ID NO: 433723 - RNA, 23 nt, Human
ugggcucuccccuccccuccccc

SEQ ID NO: 433724 - RNA, 21 nt, Human
ugggggugggguugauggcag

SEQ ID NO: 433725 - RNA, 21 nt, Human
uggggugagggagaggauggg

SEQ ID NO: 433726 - RNA, 20 nt, Human
ugggguggaaagcauggcag

SEQ ID NO: 433727 - RNA, 27 nt, Human
uggugggcucuccccuccccucccccg

SEQ ID NO: 433728 - RNA, 24 nt, Human
ugucauaaaaaaaugccagauccc

SEQ ID NO: 433729 - RNA, 19 nt, Human
ugucguguggcagguuagg

SEQ ID NO: 433730 - RNA, 21 nt, Human
ugucguguggcagguuaggag

SEQ ID NO: 433731 - RNA, 20 nt, Human
uuaaauaauaacgggaggag

SEQ ID NO: 433732 - RNA, 21 nt, Human
uuaggagaggugccaaccuug

SEQ ID NO: 433733 - RNA, 21 nt, Human
uucagcgcaucucaggaccua

SEQ ID NO: 433734 - RNA, 19 nt, Human
aggaagcagaguguggagc

SEQ ID NO: 433735 - RNA, 18 nt, Human
agggccggaggcugaggc

SEQ ID NO: 433736 - RNA, 25 nt, Human
cagcgcuaaauaaaugguacuuccu

SEQ ID NO: 433737 - RNA, 19 nt, Human
ccgcaugagauuauuuuau

SEQ ID NO: 433738 - RNA, 22 nt, Human
cuaaauaaaugguacuuccuuc

SEQ ID NO: 433739 - RNA, 22 nt, Human
cucaucuacacagugcacgguc

SEQ ID NO: 433740 - RNA, 22 nt, Human
cuuccuucgcccuccccucgga

SEQ ID NO: 433741 - RNA, 18 nt, Human
gagcgaguugacucgaaa

SEQ ID NO: 433742 - RNA, 18 nt, Human
ggaacagaacaagggcug

SEQ ID NO: 433743 - RNA, 20 nt, Human
ggccggaggcugaggccgag

SEQ ID NO: 433744 - RNA, 18 nt, Human
guggagcgguaucugucc

SEQ ID NO: 433745 - RNA, 19 nt, Human
uccagggccggaggcugag

SEQ ID NO: 433746 - RNA, 22 nt, Human
ugacucgaaaccauuucagcac

SEQ ID NO: 433747 - RNA, 22 nt, Human
uuauuaaaaaacucaaaggaag

SEQ ID NO: 433748 - RNA, 25 nt, Human
acaaauccagggaucagcuguccca

SEQ ID NO: 433749 - RNA, 23 nt, Human
acgcagaggcggcggcucgggcu

SEQ ID NO: 433750 - RNA, 24 nt, Human
cacaaauccagggaucagcugucc

SEQ ID NO: 433751 - RNA, 25 nt, Human
cacaaauccagggaucagcuguccc

SEQ ID NO: 433752 - RNA, 18 nt, Human
cacaaucacucaacaaac

SEQ ID NO: 433753 - RNA, 21 nt, Human
cagcuggggcagcagcggcgg

SEQ ID NO: 433754 - RNA, 24 nt, Human
ccagcacuagcggcuggggcuccu

SEQ ID NO: 433755 - RNA, 22 nt, Human
cccauccccaaggccgcgaccg

SEQ ID NO: 433756 - RNA, 24 nt, Human
cccauccccaaggccgcgaccgcc

SEQ ID NO: 433757 - RNA, 24 nt, Human
ccucuuucacaaucacucaacaaa

SEQ ID NO: 433758 - RNA, 20 nt, Human
cgcccauccccaaggccgcg

SEQ ID NO: 433759 - RNA, 19 nt, Human
cuccagcuggggcagcagc

SEQ ID NO: 433760 - RNA, 22 nt, Human
gcagcagcggcggccaccagca

SEQ ID NO: 433761 - RNA, 23 nt, Human
gcggcucgggcuccagcuggggc

SEQ ID NO: 433762 - RNA, 18 nt, Human
gcggcuggggcuccgccc

SEQ ID NO: 433763 - RNA, 19 nt, Human
ggccaccagcacuagcggc

SEQ ID NO: 433764 - RNA, 23 nt, Human
uagcgugacacaaauccagggau

SEQ ID NO: 433765 - RNA, 19 nt, Human
uccccaaggccgcgaccgc

SEQ ID NO: 433766 - RNA, 20 nt, Human
uucacaaucacucaacaaac

SEQ ID NO: 433767 - RNA, 27 nt, Human
uuuuuuuuuuuuuucccgaaggccccc

SEQ ID NO: 433768 - RNA, 21 nt, Human
uuuuuuuuuuuuuuuucccga

SEQ ID NO: 433769 - RNA, 18 nt, Human
aggcagcugcuccgcgcc

SEQ ID NO: 433770 - RNA, 22 nt, Human
cacccggccgcgcgacacgucc

SEQ ID NO: 433771 - RNA, 24 nt, Human
ccacccggccgcgcgacacguccc

SEQ ID NO: 433772 - RNA, 21 nt, Human
ccaggguaccgaccgaggcca

SEQ ID NO: 433773 - RNA, 27 nt, Human
ccccgccggucucggccaccauguccg

SEQ ID NO: 433774 - RNA, 24 nt, Human
cgcgacgcucgcuguccccgaggg

SEQ ID NO: 433775 - RNA, 24 nt, Human
cgcucgcuguccccgagggcccgc

SEQ ID NO: 433776 - RNA, 25 nt, Human
cggccgcgcgacacgucccccaccc

SEQ ID NO: 433777 - RNA, 26 nt, Human
uaccgaccgaggccacccggccgcgc

SEQ ID NO: 433778 - RNA, 26 nt, Human
uccgcgcccaggguaccgaccgaggc

SEQ ID NO: 433779 - RNA, 18 nt, Human
uguccccgagggcccgcu

SEQ ID NO: 433780 - RNA, 23 nt, Human
uucaaugaaugaaaaacucagug

SEQ ID NO: 433781 - RNA, 24 nt, Human
uucaaugaaugaaaaacucagugc

SEQ ID NO: 433782 - RNA, 18 nt, Human
aaacugcaaucaaaaaag

SEQ ID NO: 433783 - RNA, 19 nt, Human
aagaagcccauguucaugc

SEQ ID NO: 433784 - RNA, 26 nt, Human
aagaagcccauguucaugcugaaacc

SEQ ID NO: 433785 - RNA, 22 nt, Human
acaaggaagcaaauccccuuca

SEQ ID NO: 433786 - RNA, 20 nt, Human
agacagcaagaagcccaugu

SEQ ID NO: 433787 - RNA, 22 nt, Human
agagacagacagcaagaagccc

SEQ ID NO: 433788 - RNA, 19 nt, Human
aguggaggaugaaagugga

SEQ ID NO: 433789 - RNA, 21 nt, Human
augcugaaaccugaaaaaucc

SEQ ID NO: 433790 - RNA, 25 nt, Human
caagaaaaagaagaggguaaaacac

SEQ ID NO: 433791 - RNA, 20 nt, Human
cacaccgagaaacuuuacau

SEQ ID NO: 433792 - RNA, 21 nt, Human
caccauggaguuauuuugaag

SEQ ID NO: 433793 - RNA, 22 nt, Human
caugcugaaaccugaaaaaucc

SEQ ID NO: 433794 - RNA, 20 nt, Human
cccauguucaugcugaaacc

SEQ ID NO: 433795 - RNA, 21 nt, Human
cgggaggcugggcccggaggg

SEQ ID NO: 433796 - RNA, 21 nt, Human
cugaaaccugaaaaaucccuc

SEQ ID NO: 433797 - RNA, 20 nt, Human
gcucuuggaugcaggugcuc

SEQ ID NO: 433798 - RNA, 24 nt, Human
ggacggcgcccgcuccggcuucca

SEQ ID NO: 433799 - RNA, 27 nt, Human
uacacaacuguucaucgucuuacauua

SEQ ID NO: 433800 - RNA, 19 nt, Human
uacacuugcuacaccuuga

SEQ ID NO: 433801 - RNA, 23 nt, Human
uacauaacaaggaagcaaauccc

SEQ ID NO: 433802 - RNA, 24 nt, Human
uacguguugaggaguuccaagaaa

SEQ ID NO: 433803 - RNA, 18 nt, Human
uaggaugcaauuauuuuc

SEQ ID NO: 433804 - RNA, 28 nt, Human
uaggaugcaauuauuuucuccacaacuu

SEQ ID NO: 433805 - RNA, 25 nt, Human
uaguagggauaaagcuuaagucuac

SEQ ID NO: 433806 - RNA, 23 nt, Human
uauaaacugcaaucaaaaaagua

SEQ ID NO: 433807 - RNA, 20 nt, Human
uccccggagcugggcugggg

SEQ ID NO: 433808 - RNA, 21 nt, Human
ugaaguugcaaguuauuuuuu

SEQ ID NO: 433809 - RNA, 19 nt, Human
ugcuaucuguguggguaca

SEQ ID NO: 433810 - RNA, 26 nt, Human
ugcugaaaccugaaaaaucccuccaa

SEQ ID NO: 433811 - RNA, 18 nt, Human
ugggcccggagggcgcga

SEQ ID NO: 433812 - RNA, 19 nt, Human
ugucaaagaaguuaugaag

SEQ ID NO: 433813 - RNA, 26 nt, Human
uucuccacaacuuagguacaugagaa

SEQ ID NO: 433814 - RNA, 19 nt, Human
aagaacucaaaucucuggc

SEQ ID NO: 433815 - RNA, 18 nt, Human
caaaucucuggccugccu

SEQ ID NO: 433816 - RNA, 22 nt, Human
ccccaggcuugucacuuaaucu

SEQ ID NO: 433817 - RNA, 20 nt, Human
ccuucuaugugcuaccccag

SEQ ID NO: 433818 - RNA, 24 nt, Human
ccuucuaugugcuaccccaggcuu

SEQ ID NO: 433819 - RNA, 22 nt, Human
cucugcaccguuccacagucuc

SEQ ID NO: 433820 - RNA, 19 nt, Human
cuucuggcucugcaccguu

SEQ ID NO: 433821 - RNA, 20 nt, Human
ucauuggcuggucuugcaag

SEQ ID NO: 433822 - RNA, 19 nt, Human
ugaaaggugaguuccuggc

SEQ ID NO: 433823 - RNA, 20 nt, Human
ugaguuccuggcccaguggc

SEQ ID NO: 433824 - RNA, 24 nt, Human
ugcaccguuccacagucucuuccu

SEQ ID NO: 433825 - RNA, 21 nt, Human
aaaagaagagggagacaggag

SEQ ID NO: 433826 - RNA, 22 nt, Human
aaagauggaggugcggaaaaga

SEQ ID NO: 433827 - RNA, 19 nt, Human
aaggggaggcaagagaggc

SEQ ID NO: 433828 - RNA, 20 nt, Human
acaguaacugguguugcccc

SEQ ID NO: 433829 - RNA, 23 nt, Human
accgcuggucccuaaaaucccca

SEQ ID NO: 433830 - RNA, 21 nt, Human
acuagaggccaaucguggggu

SEQ ID NO: 433831 - RNA, 21 nt, Human
acucucccacuggaacucugg

SEQ ID NO: 433832 - RNA, 21 nt, Human
aggcaagagaggccagccuag

SEQ ID NO: 433833 - RNA, 18 nt, Human
agggagggagaaacagug

SEQ ID NO: 433834 - RNA, 23 nt, Human
aggggcugggugaugaguggggu

SEQ ID NO: 433835 - RNA, 18 nt, Human
aggugacucaccacacca

SEQ ID NO: 433836 - RNA, 18 nt, Human
auuggaaaggccagacuc

SEQ ID NO: 433837 - RNA, 21 nt, Human
auuucaggguggcugggcacu

SEQ ID NO: 433838 - RNA, 23 nt, Human
auuugguuggcagcagcaagagg

SEQ ID NO: 433839 - RNA, 24 nt, Human
auuugguuggcagcagcaagaggg

SEQ ID NO: 433840 - RNA, 18 nt, Human
caacucucgaagauaauc

SEQ ID NO: 433841 - RNA, 20 nt, Human
caagagaggccagccuagca

SEQ ID NO: 433842 - RNA, 21 nt, Human
caagagggccgacuagaggug

SEQ ID NO: 433843 - RNA, 21 nt, Human
caccagggcaccgccuuagcc

SEQ ID NO: 433844 - RNA, 18 nt, Human
caccagggugaugcucac

SEQ ID NO: 433845 - RNA, 24 nt, Human
cacugaggcaccauuauuggggau

SEQ ID NO: 433846 - RNA, 21 nt, Human
cacuggaacucuggggcccac

SEQ ID NO: 433847 - RNA, 26 nt, Human
cagacacauacacacaugcauggagg

SEQ ID NO: 433848 - RNA, 23 nt, Human
caggagggaaccguacucuccca

SEQ ID NO: 433849 - RNA, 19 nt, Human
caggauaggggcugccccc

SEQ ID NO: 433850 - RNA, 18 nt, Human
caggguggcugggcacug

SEQ ID NO: 433851 - RNA, 21 nt, Human
caguaccaccuuauacagggg

SEQ ID NO: 433852 - RNA, 18 nt, Human
ccacaaagauggaggugc

SEQ ID NO: 433853 - RNA, 22 nt, Human
ccacugaggcaccauuauuggg

SEQ ID NO: 433854 - RNA, 23 nt, Human
ccacugaggcaccauuauugggg

SEQ ID NO: 433855 - RNA, 21 nt, Human
cccacacgccugcuucagacg

SEQ ID NO: 433856 - RNA, 24 nt, Human
cccccacaaacagugccucaugcu

SEQ ID NO: 433857 - RNA, 19 nt, Human
ccccuccaaaagggagggg

SEQ ID NO: 433858 - RNA, 20 nt, Human
cccuggaaacugggaaugag

SEQ ID NO: 433859 - RNA, 22 nt, Human
cccuguguccaugcuggaaccc

SEQ ID NO: 433860 - RNA, 25 nt, Human
ccuaaaauccccaggccccagacuu

SEQ ID NO: 433861 - RNA, 18 nt, Human
cuaaaauccccaggcccc

SEQ ID NO: 433862 - RNA, 20 nt, Human
cuccucuguggucccugaaa

SEQ ID NO: 433863 - RNA, 21 nt, Human
cugggugaugagugggguggg

SEQ ID NO: 433864 - RNA, 20 nt, Human
cuuggcaacuaguguccaaa

SEQ ID NO: 433865 - RNA, 18 nt, Human
cuuuuuggcaacaaaagg

SEQ ID NO: 433866 - RNA, 20 nt, Human
gagcucggccugagcaacag

SEQ ID NO: 433867 - RNA, 21 nt, Human
gauggucacaaccgcuggucc

SEQ ID NO: 433868 - RNA, 21 nt, Human
gcacaccaguccucacagaca

SEQ ID NO: 433869 - RNA, 18 nt, Human
gccccaggcuaccccugu

SEQ ID NO: 433870 - RNA, 24 nt, Human
ggaaaagaagagggagacaggagg

SEQ ID NO: 433871 - RNA, 21 nt, Human
ggauuucaggguggcugggca

SEQ ID NO: 433872 - RNA, 24 nt, Human
ggccaaggggaggcaagagaggcc

SEQ ID NO: 433873 - RNA, 20 nt, Human
gggaggcaagagaggccagc

SEQ ID NO: 433874 - RNA, 20 nt, Human
gggauuucaggguggcuggg

SEQ ID NO: 433875 - RNA, 21 nt, Human
gggcaaggagauggggauugg

SEQ ID NO: 433876 - RNA, 19 nt, Human
gggcugggugaugaguggg

SEQ ID NO: 433877 - RNA, 19 nt, Human
ggugcggaaaagaagaggg

SEQ ID NO: 433878 - RNA, 19 nt, Human
guaccagacugcccccagc

SEQ ID NO: 433879 - RNA, 24 nt, Human
gucccuaaaauccccaggccccag

SEQ ID NO: 433880 - RNA, 18 nt, Human
guuggcagcagcaagagg

SEQ ID NO: 433881 - RNA, 19 nt, Human
uaagccccaggcuaccccu

SEQ ID NO: 433882 - RNA, 19 nt, Human
uacacacaugcauggaggc

SEQ ID NO: 433883 - RNA, 23 nt, Human
uccacaaagauggaggugcggaa

SEQ ID NO: 433884 - RNA, 19 nt, Human
uccacgcacaccaguccuc

SEQ ID NO: 433885 - RNA, 22 nt, Human
ucccuaaaauccccaggcccca

SEQ ID NO: 433886 - RNA, 19 nt, Human
uccguaccagacugccccc

SEQ ID NO: 433887 - RNA, 18 nt, Human
uccuugaggaugccagug

SEQ ID NO: 433888 - RNA, 27 nt, Human
ucgcuggcaaccaggagcucggccuga

SEQ ID NO: 433889 - RNA, 19 nt, Human
ucuauaagccccaggcuac

SEQ ID NO: 433890 - RNA, 18 nt, Human
ucuguuaucuccauuugc

SEQ ID NO: 433891 - RNA, 19 nt, Human
ugcccccagccugacgcuu

SEQ ID NO: 433892 - RNA, 19 nt, Human
ugccccggccaaggggagg

SEQ ID NO: 433893 - RNA, 18 nt, Human
uggaacccaggauagggg

SEQ ID NO: 433894 - RNA, 25 nt, Human
uggaacccaggauaggggcugcccc

SEQ ID NO: 433895 - RNA, 18 nt, Human
uggaacucuggggcccac

SEQ ID NO: 433896 - RNA, 21 nt, Human
uggcagcagcaagagggccga

SEQ ID NO: 433897 - RNA, 23 nt, Human
uggcagcagcaagagggccgacu

SEQ ID NO: 433898 - RNA, 18 nt, Human
uucucuauaagccccagg

SEQ ID NO: 433899 - RNA, 24 nt, Human
uuuuuuuuuuuuuuuucagucuca

SEQ ID NO: 433900 - RNA, 24 nt, Human
uuuuuuuuuuuuuuuuuuuuucag

SEQ ID NO: 433901 - RNA, 19 nt, Human
aaacacucccaugaucccc

SEQ ID NO: 433902 - RNA, 24 nt, Human
aagcaucccugcaauugauggggc

SEQ ID NO: 433903 - RNA, 21 nt, Human
acaaacacucccaugaucccc

SEQ ID NO: 433904 - RNA, 21 nt, Human
acauauugcuaggggugaugg

SEQ ID NO: 433905 - RNA, 19 nt, Human
acccaggagccccacucac

SEQ ID NO: 433906 - RNA, 23 nt, Human
agagggcaggggaggagacugag

SEQ ID NO: 433907 - RNA, 19 nt, Human
agccccacucacaaacacu

SEQ ID NO: 433908 - RNA, 24 nt, Human
aggcugcccccaggcucaccccag

SEQ ID NO: 433909 - RNA, 23 nt, Human
auggcaacacuucagacuuuaau

SEQ ID NO: 433910 - RNA, 23 nt, Human
caaacacucccaugauccccaca

SEQ ID NO: 433911 - RNA, 21 nt, Human
cacucaggcuuucuccucuga

SEQ ID NO: 433912 - RNA, 24 nt, Human
cacucaggcuuucuccucugaguu

SEQ ID NO: 433913 - RNA, 19 nt, Human
cagaggcaauccucagcuu

SEQ ID NO: 433914 - RNA, 21 nt, Human
cagcaggcaggcugcccccag

SEQ ID NO: 433915 - RNA, 20 nt, Human
cagcugcccuacucucggcc

SEQ ID NO: 433916 - RNA, 19 nt, Human
caggcaggcugcccccagg

SEQ ID NO: 433917 - RNA, 18 nt, Human
cagggccuucugagcccc

SEQ ID NO: 433918 - RNA, 24 nt, Human
ccaggucucuuuugccucugguuc

SEQ ID NO: 433919 - RNA, 24 nt, Human
cccaggagccccacucacaaacac

SEQ ID NO: 433920 - RNA, 21 nt, Human
cccagugcucagcauugcaug

SEQ ID NO: 433921 - RNA, 24 nt, Human
ccccagagucuggaggcagcugcc

SEQ ID NO: 433922 - RNA, 21 nt, Human
cccccaggcucaccccagugc

SEQ ID NO: 433923 - RNA, 28 nt, Human
cccccuugagcucugugggggugggggc

SEQ ID NO: 433924 - RNA, 18 nt, Human
ccccuggacaggcucucu

SEQ ID NO: 433925 - RNA, 21 nt, Human
cucccaugauccccacaaucc

SEQ ID NO: 433926 - RNA, 20 nt, Human
cucgcccgcccuccucccuc

SEQ ID NO: 433927 - RNA, 25 nt, Human
cucuccggcugcgcccagcacugcc

SEQ ID NO: 433928 - RNA, 18 nt, Human
cucucuccggcugcgccc

SEQ ID NO: 433929 - RNA, 19 nt, Human
cugcccccaggcucacccc

SEQ ID NO: 433930 - RNA, 24 nt, Human
cuucagacuuuaauacauauugcu

SEQ ID NO: 433931 - RNA, 23 nt, Human
cuuccaggucucuuuugccucug

SEQ ID NO: 433932 - RNA, 23 nt, Human
gacuuccaggucucuuuugccuc

SEQ ID NO: 433933 - RNA, 21 nt, Human
gagcagggccuucugagcccc

SEQ ID NO: 433934 - RNA, 22 nt, Human
gaugccccagggauuugggggu

SEQ ID NO: 433935 - RNA, 18 nt, Human
gcuaggucucacccagga

SEQ ID NO: 433936 - RNA, 21 nt, Human
gcuccagcucgcccgcccucc

SEQ ID NO: 433937 - RNA, 23 nt, Human
ggagacugagggucagcagaggc

SEQ ID NO: 433938 - RNA, 23 nt, Human
ggagccccacucacaaacacucu

SEQ ID NO: 433939 - RNA, 22 nt, Human
ggaugccccagggauuuggggg

SEQ ID NO: 433940 - RNA, 21 nt, Human
ggcaggggaggagacugaggg

SEQ ID NO: 433941 - RNA, 21 nt, Human
ggcaggggaggagacugaggg

SEQ ID NO: 433942 - RNA, 24 nt, Human
gggcaggcaagcuggcuacuuucc

SEQ ID NO: 433943 - RNA, 23 nt, Human
gggcaggggaggagacugagggu

SEQ ID NO: 433944 - RNA, 20 nt, Human
gguucugguccccaugcugg

SEQ ID NO: 433945 - RNA, 21 nt, Human
gugggggugggggcuaggucu

SEQ ID NO: 433946 - RNA, 19 nt, Human
guucugguccccaugcugg

SEQ ID NO: 433947 - RNA, 21 nt, Human
uauccucagccccccaccccc

SEQ ID NO: 433948 - RNA, 24 nt, Human
ucacaaacacucccaugaucccca

SEQ ID NO: 433949 - RNA, 19 nt, Human
ucagcccccuggacaggcu

SEQ ID NO: 433950 - RNA, 19 nt, Human
uccccacaauccucgcccu

SEQ ID NO: 433951 - RNA, 20 nt, Human
uccccaugcugggacuucca

SEQ ID NO: 433952 - RNA, 19 nt, Human
uccucugaguucagcaggc

SEQ ID NO: 433953 - RNA, 24 nt, Human
ucggccagaaugagguguuacuca

SEQ ID NO: 433954 - RNA, 22 nt, Human
ucgggcucccgcugccugccgg

SEQ ID NO: 433955 - RNA, 19 nt, Human
ucuagcgcccgucucccca

SEQ ID NO: 433956 - RNA, 21 nt, Human
ucucucgggcucccgcugccu

SEQ ID NO: 433957 - RNA, 22 nt, Human
ucucucgggcucccgcugccug

SEQ ID NO: 433958 - RNA, 22 nt, Human
ucugugggggugggggcuaggu

SEQ ID NO: 433959 - RNA, 22 nt, Human
ucuuuugccucugguucuugac

SEQ ID NO: 433960 - RNA, 19 nt, Human
ugagcucuguggggguggg

SEQ ID NO: 433961 - RNA, 19 nt, Human
ugauggggcaggcaagcug

SEQ ID NO: 433962 - RNA, 18 nt, Human
ugccccagggauuugggg

SEQ ID NO: 433963 - RNA, 23 nt, Human
ugcuaggggugauggaagcugag

SEQ ID NO: 433964 - RNA, 24 nt, Human
ugcuaggggugauggaagcugagu

SEQ ID NO: 433965 - RNA, 20 nt, Human
uggaagcugaguagggcauc

SEQ ID NO: 433966 - RNA, 19 nt, Human
uggacaggcucucuccggc

SEQ ID NO: 433967 - RNA, 23 nt, Human
uggaugccccagggauuuggggg

SEQ ID NO: 433968 - RNA, 22 nt, Human
uggcaacacuucagacuuuaau

SEQ ID NO: 433969 - RNA, 24 nt, Human
ugguucuugaccagucaggaaucu

SEQ ID NO: 433970 - RNA, 24 nt, Human
ugucagcaggcaggcugcccccag

SEQ ID NO: 433971 - RNA, 19 nt, Human
ugugggggugggggcuagg

SEQ ID NO: 433972 - RNA, 21 nt, Human
uucagacuuuaauacauauug

SEQ ID NO: 433973 - RNA, 24 nt, Human
uucugagccccaaaucuagcgccc

SEQ ID NO: 433974 - RNA, 19 nt, Human
uucuggaugccccagggau

SEQ ID NO: 433975 - RNA, 22 nt, Human
uuucauacugggcggggccuuc

SEQ ID NO: 433976 - RNA, 20 nt, Human
uuucccaacuaugaggcugg

SEQ ID NO: 433977 - RNA, 20 nt, Human
aaauaaacaaaggagagccg

SEQ ID NO: 433978 - RNA, 21 nt, Human
aagagcgcuuguaggagggcg

SEQ ID NO: 433979 - RNA, 19 nt, Human
accccgcgcucgggagacc

SEQ ID NO: 433980 - RNA, 22 nt, Human
agcuggaggcggcggaaggggg

SEQ ID NO: 433981 - RNA, 22 nt, Human
aggcggcggaagggggugcugg

SEQ ID NO: 433982 - RNA, 20 nt, Human
augaguucuuugaccaguuu

SEQ ID NO: 433983 - RNA, 18 nt, Human
caaaccccgcgcucggga

SEQ ID NO: 433984 - RNA, 24 nt, Human
caaaccccgcgcucgggagaccag

SEQ ID NO: 433985 - RNA, 24 nt, Human
caagaagcucggaauucuccugcu

SEQ ID NO: 433986 - RNA, 22 nt, Human
cacacucaccauaagcuggagg

SEQ ID NO: 433987 - RNA, 22 nt, Human
cacccagacggccagcaagagc

SEQ ID NO: 433988 - RNA, 24 nt, Human
cagguauugcagucugcuuugaua

SEQ ID NO: 433989 - RNA, 18 nt, Human
cagugccgccgccucugc

SEQ ID NO: 433990 - RNA, 25 nt, Human
ccccacccgacgcggccccugggcu

SEQ ID NO: 433991 - RNA, 23 nt, Human
ccccagccacacucaccauaagc

SEQ ID NO: 433992 - RNA, 20 nt, Human
ccccgaauucccgugcgcuc

SEQ ID NO: 433993 - RNA, 18 nt, Human
ccccgcccuggcgcgccu

SEQ ID NO: 433994 - RNA, 21 nt, Human
ccccuuagcugcucucuuuca

SEQ ID NO: 433995 - RNA, 22 nt, Human
cccgcgcucgggagaccaggaa

SEQ ID NO: 433996 - RNA, 23 nt, Human
cccgugcgcucucugcaccccca

SEQ ID NO: 433997 - RNA, 25 nt, Human
ccuccagauguggggugcucggcuc

SEQ ID NO: 433998 - RNA, 21 nt, Human
ccuccgcgcugcuuggagaac

SEQ ID NO: 433999 - RNA, 21 nt, Human
ccugccugggcgcggcgaggg

SEQ ID NO: 434000 - RNA, 21 nt, Human
ccugggcuccguccgccgucc

SEQ ID NO: 434001 - RNA, 26 nt, Human
cgcacggggacuggaaaggaggugac

SEQ ID NO: 434002 - RNA, 19 nt, Human
cggccccugggcuccgucc

SEQ ID NO: 434003 - RNA, 20 nt, Human
cgggagagaauaaagaggaa

SEQ ID NO: 434004 - RNA, 26 nt, Human
cggggcggggcccacggcuggcuguc

SEQ ID NO: 434005 - RNA, 21 nt, Human
cgggugcugcuggggggcugg

SEQ ID NO: 434006 - RNA, 22 nt, Human
cgggugcugcuggggggcuggg

SEQ ID NO: 434007 - RNA, 19 nt, Human
cuccuuccuucuucagccc

SEQ ID NO: 434008 - RNA, 19 nt, Human
cugcacccccagccacacu

SEQ ID NO: 434009 - RNA, 23 nt, Human
cugcuggggggcuggggcgaagg

SEQ ID NO: 434010 - RNA, 19 nt, Human
cugcuuggagaaccacuuc

SEQ ID NO: 434011 - RNA, 19 nt, Human
cuguucccggggcuggcag

SEQ ID NO: 434012 - RNA, 19 nt, Human
cuucaaaccccgcgcucgg

SEQ ID NO: 434013 - RNA, 20 nt, Human
gacucuggcuggaggaggcg

SEQ ID NO: 434014 - RNA, 23 nt, Human
gagcgcccccgccccaccgcggg

SEQ ID NO: 434015 - RNA, 18 nt, Human
gcagagcgcccccgcccc

SEQ ID NO: 434016 - RNA, 22 nt, Human
gcccacggcuggcuguccccuc

SEQ ID NO: 434017 - RNA, 22 nt, Human
gccccagacccccgaauucccg

SEQ ID NO: 434018 - RNA, 22 nt, Human
ggaaagcuuccuuucuccccac

SEQ ID NO: 434019 - RNA, 18 nt, Human
ggacaggcgggaccuggc

SEQ ID NO: 434020 - RNA, 18 nt, Human
ggcggggcccacggcugg

SEQ ID NO: 434021 - RNA, 26 nt, Human
gggaccuggcggccacuggguggggg

SEQ ID NO: 434022 - RNA, 23 nt, Human
gggagaccaggaagggggcuggg

SEQ ID NO: 434023 - RNA, 25 nt, Human
gggcagcgcagccagucccgggccc

SEQ ID NO: 434024 - RNA, 27 nt, Human
gggcccacggcuggcuguccccuccag

SEQ ID NO: 434025 - RNA, 22 nt, Human
gggcuggggugaucgagggagc

SEQ ID NO: 434026 - RNA, 23 nt, Human
ggggcuggcagagcgcccccgcc

SEQ ID NO: 434027 - RNA, 21 nt, Human
gggggcuggggcgaaggggga

SEQ ID NO: 434028 - RNA, 24 nt, Human
gggugcugcuggggggcuggggcg

SEQ ID NO: 434029 - RNA, 19 nt, Human
guccccuccagaugugggg

SEQ ID NO: 434030 - RNA, 22 nt, Human
uagaaaauaaacaaaggagagc

SEQ ID NO: 434031 - RNA, 20 nt, Human
uccugcuccggacgccgggg

SEQ ID NO: 434032 - RNA, 20 nt, Human
ucugcuguucccggggcugg

SEQ ID NO: 434033 - RNA, 27 nt, Human
ucuggagcgcaaggacucucaaucccg

SEQ ID NO: 434034 - RNA, 22 nt, Human
ucuuugaccaguuuccuagaac

SEQ ID NO: 434035 - RNA, 20 nt, Human
ugcuguucccggggcuggca

SEQ ID NO: 434036 - RNA, 27 nt, Human
uggaaaggaggugaccuucaaaccccg

SEQ ID NO: 434037 - RNA, 22 nt, Human
uggagaaccacuucagggcagc

SEQ ID NO: 434038 - RNA, 21 nt, Human
uggaggaggcggcggcagcgc

SEQ ID NO: 434039 - RNA, 23 nt, Human
uggcuguccccuccagauguggg

SEQ ID NO: 434040 - RNA, 20 nt, Human
ugggcaagaagcucggaauu

SEQ ID NO: 434041 - RNA, 24 nt, Human
ugucaggggcagcggcugcuuccu

SEQ ID NO: 434042 - RNA, 24 nt, Human
ugucuugaaaccuuucugucuucu

SEQ ID NO: 434043 - RNA, 23 nt, Human
uucaaaccccgcgcucgggagac

SEQ ID NO: 434044 - RNA, 22 nt, Human
uucccggggcuggcagagcgcc

SEQ ID NO: 434045 - RNA, 25 nt, Human
uugcuaaaaugauguacuacugcau

SEQ ID NO: 434046 - RNA, 18 nt, Human
uuuccacgcagguauugc

SEQ ID NO: 434047 - RNA, 19 nt, Human
aaagaacaaagcauccucc

SEQ ID NO: 434048 - RNA, 20 nt, Human
aaagagccuccccacccagc

SEQ ID NO: 434049 - RNA, 24 nt, Human
aaagcauccuccgccccggacccu

SEQ ID NO: 434050 - RNA, 26 nt, Human
aaagcauccuccgccccggacccuug

SEQ ID NO: 434051 - RNA, 23 nt, Human
aagagccuccccacccagggcac

SEQ ID NO: 434052 - RNA, 20 nt, Human
aagaggaaccaaaaccagaa

SEQ ID NO: 434053 - RNA, 20 nt, Human
aagcauccuccgccccggag

SEQ ID NO: 434054 - RNA, 19 nt, Human
acaaagcauccuccgcccc

SEQ ID NO: 434055 - RNA, 18 nt, Human
accggcuggucagccugg

SEQ ID NO: 434056 - RNA, 23 nt, Human
agaaggcccggggcacucacuga

SEQ ID NO: 434057 - RNA, 18 nt, Human
agcggcggcgggcgggcg

SEQ ID NO: 434058 - RNA, 19 nt, Human
aggaagaaggauggggugg

SEQ ID NO: 434059 - RNA, 19 nt, Human
aggauggggugggcagaag

SEQ ID NO: 434060 - RNA, 18 nt, Human
caaaaccagaaaagaaca

SEQ ID NO: 434061 - RNA, 21 nt, Human
caacacgaacacggcccuucc

SEQ ID NO: 434062 - RNA, 20 nt, Human
caccaugugucagcccugcc

SEQ ID NO: 434063 - RNA, 25 nt, Human
caccggccucugcccucgugggcac

SEQ ID NO: 434064 - RNA, 18 nt, Human
caccucugucccaacugc

SEQ ID NO: 434065 - RNA, 21 nt, Human
cacucagucccuguugaccuc

SEQ ID NO: 434066 - RNA, 20 nt, Human
cacuucugggccucugcccc

SEQ ID NO: 434067 - RNA, 23 nt, Human
cacuugcagcggcugcaaaucca

SEQ ID NO: 434068 - RNA, 19 nt, Human
cagcccugccucgagacag

SEQ ID NO: 434069 - RNA, 18 nt, Human
cagccuccucuccucucu

SEQ ID NO: 434070 - RNA, 22 nt, Human
caucaggagcagguuggggagg

SEQ ID NO: 434071 - RNA, 23 nt, Human
ccaaaaccagaaaagaacaaagc

SEQ ID NO: 434072 - RNA, 18 nt, Human
ccacugggccugcuccca

SEQ ID NO: 434073 - RNA, 19 nt, Human
ccacugggccugcucccac

SEQ ID NO: 434074 - RNA, 18 nt, Human
ccagaaaagaacaaagca

SEQ ID NO: 434075 - RNA, 19 nt, Human
ccagaucagaccaggagcu

SEQ ID NO: 434076 - RNA, 21 nt, Human
ccaggcuggcacuucugggcc

SEQ ID NO: 434077 - RNA, 23 nt, Human
cccacagcuccucaacagccugc

SEQ ID NO: 434078 - RNA, 22 nt, Human
cccauugcagagagguggggau

SEQ ID NO: 434079 - RNA, 25 nt, Human
ccccaggcuggcacuucugggccuc

SEQ ID NO: 434080 - RNA, 24 nt, Human
ccccccgcgaaagaggaaccaaaa

SEQ ID NO: 434081 - RNA, 22 nt, Human
cccccuggcaucucuggagagg

SEQ ID NO: 434082 - RNA, 22 nt, Human
ccccgggaagggcggcccagug

SEQ ID NO: 434083 - RNA, 20 nt, Human
ccccuuagcaccggccucug

SEQ ID NO: 434084 - RNA, 23 nt, Human
cccgguggcagcucgggccuccc

SEQ ID NO: 434085 - RNA, 18 nt, Human
cccuucuuccccaucccc

SEQ ID NO: 434086 - RNA, 25 nt, Human
ccgcgaaagaggaaccaaaaccaga

SEQ ID NO: 434087 - RNA, 21 nt, Human
ccggacccuuggggcuggguc

SEQ ID NO: 434088 - RNA, 23 nt, Human
ccuaaagagccuccccacccagc

SEQ ID NO: 434089 - RNA, 25 nt, Human
ccucccacugggccugcucccacag

SEQ ID NO: 434090 - RNA, 24 nt, Human
ccuccgggagacacgcccuggcuc

SEQ ID NO: 434091 - RNA, 20 nt, Human
ccucgagacaggacacuguc

SEQ ID NO: 434092 - RNA, 19 nt, Human
ccucugccccacucagucc

SEQ ID NO: 434093 - RNA, 23 nt, Human
ccuuccugccuguugucuagaag

SEQ ID NO: 434094 - RNA, 26 nt, Human
cgaaagaggaaccaaaaccagaaaag

SEQ ID NO: 434095 - RNA, 22 nt, Human
cgcgaaagaggaaccaaaacca

SEQ ID NO: 434096 - RNA, 25 nt, Human
cggccucugcccucgugggcaccuc

SEQ ID NO: 434097 - RNA, 21 nt, Human
cgggagacacgcccuggcuca

SEQ ID NO: 434098 - RNA, 22 nt, Human
cuaaagagccuccccacccagc

SEQ ID NO: 434099 - RNA, 21 nt, Human
cucccacugggccugcuccca

SEQ ID NO: 434100 - RNA, 19 nt, Human
cuccccaggcuggcacuuc

SEQ ID NO: 434101 - RNA, 29 nt, Human
cucccccaccccccgcgaaagaggaaccc

SEQ ID NO: 434102 - RNA, 18 nt, Human
cugagguucauccuuccu

SEQ ID NO: 434103 - RNA, 21 nt, Human
cugcucccacagcuccucaac

SEQ ID NO: 434104 - RNA, 25 nt, Human
cuggcagcccacaggccuccgggag

SEQ ID NO: 434105 - RNA, 19 nt, Human
cugggccucugccccacuc

SEQ ID NO: 434106 - RNA, 23 nt, Human
cuuccacacacuugcagcggcug

SEQ ID NO: 434107 - RNA, 26 nt, Human
cuucugggccucugccccacucaguc

SEQ ID NO: 434108 - RNA, 22 nt, Human
gaaagaggaaccaaaaccagaa

SEQ ID NO: 434109 - RNA, 18 nt, Human
gagaggaagaaggauggg

SEQ ID NO: 434110 - RNA, 22 nt, Human
gcaccaccugggggugcccuga

SEQ ID NO: 434111 - RNA, 19 nt, Human
gcggcccagugccccauca

SEQ ID NO: 434112 - RNA, 20 nt, Human
ggacccuuggggcugggucu

SEQ ID NO: 434113 - RNA, 19 nt, Human
ggggcugggucucccccag

SEQ ID NO: 434114 - RNA, 18 nt, Human
ggugggcagaaggggcug

SEQ ID NO: 434115 - RNA, 18 nt, Human
guagagcauacacgcccc

SEQ ID NO: 434116 - RNA, 25 nt, Human
uaccaacagccuccucuccucucug

SEQ ID NO: 434117 - RNA, 18 nt, Human
uagcuccagcggcggcgg

SEQ ID NO: 434118 - RNA, 23 nt, Human
uauggcaccaugugucagcccug

SEQ ID NO: 434119 - RNA, 21 nt, Human
ucagcccugccucgagacagg

SEQ ID NO: 434120 - RNA, 26 nt, Human
uccccagaucagaccaggagcuucca

SEQ ID NO: 434121 - RNA, 20 nt, Human
uccccaggcuggcacuucug

SEQ ID NO: 434122 - RNA, 22 nt, Human
uccccaggcuggcacuucuggg

SEQ ID NO: 434123 - RNA, 18 nt, Human
ucccccagcccugccacu

SEQ ID NO: 434124 - RNA, 20 nt, Human
ucccgggcccucaaucuugc

SEQ ID NO: 434125 - RNA, 23 nt, Human
ucccgggcccucaaucuugccuc

SEQ ID NO: 434126 - RNA, 23 nt, Human
uccgcaccaccugggggugcccu

SEQ ID NO: 434127 - RNA, 23 nt, Human
uccuggcagcccacaggccuccg

SEQ ID NO: 434128 - RNA, 18 nt, Human
ucuagaaggcccggggca

SEQ ID NO: 434129 - RNA, 18 nt, Human
ucucugggaaucuugucc

SEQ ID NO: 434130 - RNA, 33 nt, Human
ugccccacucagucccuguugaccucccccaac

SEQ ID NO: 434131 - RNA, 20 nt, Human
ugccuaagcccgguggcagc

SEQ ID NO: 434132 - RNA, 22 nt, Human
ugggaaucuugucccuucuucc

SEQ ID NO: 434133 - RNA, 20 nt, Human
ugggccucugccccacucag

SEQ ID NO: 434134 - RNA, 23 nt, Human
ugggccucugccccacucagucc

SEQ ID NO: 434135 - RNA, 18 nt, Human
uggggugggcagaagggg

SEQ ID NO: 434136 - RNA, 21 nt, Human
uucugggccucugccccacuc

SEQ ID NO: 434137 - RNA, 18 nt, Human
aaaaaaagaagaaucugc

SEQ ID NO: 434138 - RNA, 28 nt, Human
aaacaaaaaaaaaaaaaagaagaaucug

SEQ ID NO: 434139 - RNA, 24 nt, Human
aaacucugucucaaacaaaaaaaa

SEQ ID NO: 434140 - RNA, 20 nt, Human
aaacuugagacggcucggcg

SEQ ID NO: 434141 - RNA, 19 nt, Human
aaagagcugguagcacagg

SEQ ID NO: 434142 - RNA, 19 nt, Human
aacauggagaaaccccauc

SEQ ID NO: 434143 - RNA, 20 nt, Human
aacauggagaaaccccaucu

SEQ ID NO: 434144 - RNA, 21 nt, Human
aacauggagaaaccccaucuc

SEQ ID NO: 434145 - RNA, 19 nt, Human
aagcuggagggcaguggca

SEQ ID NO: 434146 - RNA, 18 nt, Human
aauuagccaggcauggug

SEQ ID NO: 434147 - RNA, 18 nt, Human
aauugccugaacccggga

SEQ ID NO: 434148 - RNA, 21 nt, Human
acaaaaaaaaaaaaaagaaga

SEQ ID NO: 434149 - RNA, 20 nt, Human
acaagagugaaacucugucu

SEQ ID NO: 434150 - RNA, 21 nt, Human
acaagagugaaacucugucuc

SEQ ID NO: 434151 - RNA, 18 nt, Human
accccaucucuacuaaaa

SEQ ID NO: 434152 - RNA, 24 nt, Human
acccgggagauggaggcugcagug

SEQ ID NO: 434153 - RNA, 24 nt, Human
accugaggucaggaguucgagacc

SEQ ID NO: 434154 - RNA, 20 nt, Human
acucuagaaaucuccagaua

SEQ ID NO: 434155 - RNA, 27 nt, Human
acugcacuccagcccaggcaacaagag

SEQ ID NO: 434156 - RNA, 18 nt, Human
agagugaaacucugucuc

SEQ ID NO: 434157 - RNA, 21 nt, Human
agauggaggcugcagugagcc

SEQ ID NO: 434158 - RNA, 24 nt, Human
agauggaggcugcagugagccgag

SEQ ID NO: 434159 - RNA, 20 nt, Human
agauuuuuuuuuuuuuuuuu

SEQ ID NO: 434160 - RNA, 23 nt, Human
agccaggcaugguggugcacgcc

SEQ ID NO: 434161 - RNA, 24 nt, Human
agcgaucuaucccaccuuggccuc

SEQ ID NO: 434162 - RNA, 19 nt, Human
aggaagcagaccaagcccc

SEQ ID NO: 434163 - RNA, 18 nt, Human
aggcaggagaauugccug

SEQ ID NO: 434164 - RNA, 24 nt, Human
aggcaggagaauugccugaacccg

SEQ ID NO: 434165 - RNA, 18 nt, Human
aggcaggcggaucaccug

SEQ ID NO: 434166 - RNA, 26 nt, Human
aggcaggcggaucaccugaggucagg

SEQ ID NO: 434167 - RNA, 24 nt, Human
aggcaugguggugcacgccuguaa

SEQ ID NO: 434168 - RNA, 26 nt, Human
aggcaugguggugcacgccuguaacc

SEQ ID NO: 434169 - RNA, 20 nt, Human
aggcugaggcaggagaauug

SEQ ID NO: 434170 - RNA, 21 nt, Human
aggcugaggcaggagaauugc

SEQ ID NO: 434171 - RNA, 21 nt, Human
aggucucuaaaaugccagucu

SEQ ID NO: 434172 - RNA, 21 nt, Human
aucaccugaggucaggaguuc

SEQ ID NO: 434173 - RNA, 24 nt, Human
aucaccugaggucaggaguucgag

SEQ ID NO: 434174 - RNA, 20 nt, Human
aucuugccacugcacuccag

SEQ ID NO: 434175 - RNA, 22 nt, Human
augaucagggcucacugcagcc

SEQ ID NO: 434176 - RNA, 23 nt, Human
caacaagagugaaacucugucuc

SEQ ID NO: 434177 - RNA, 18 nt, Human
caagaaaggcaaaaaaua

SEQ ID NO: 434178 - RNA, 22 nt, Human
caagccccugcccuggauucua

SEQ ID NO: 434179 - RNA, 24 nt, Human
caaggcaggcggaucaccugaggu

SEQ ID NO: 434180 - RNA, 26 nt, Human
caaggcaggcggaucaccugagguca

SEQ ID NO: 434181 - RNA, 21 nt, Human
caaggucauggcacuucugag

SEQ ID NO: 434182 - RNA, 24 nt, Human
caccccugcaaucccagcacuuug

SEQ ID NO: 434183 - RNA, 21 nt, Human
cacccgaauccggccgugggg

SEQ ID NO: 434184 - RNA, 24 nt, Human
caccucggagaggagccacccgaa

SEQ ID NO: 434185 - RNA, 24 nt, Human
caccuggccaauuaacaacacuuu

SEQ ID NO: 434186 - RNA, 19 nt, Human
cacgccuguaaccccagcu

SEQ ID NO: 434187 - RNA, 19 nt, Human
cacugcacuccagcccagg

SEQ ID NO: 434188 - RNA, 21 nt, Human
cacugcacuccagcccaggca

SEQ ID NO: 434189 - RNA, 22 nt, Human
cacugcacuccagcccaggcaa

SEQ ID NO: 434190 - RNA, 23 nt, Human
cacugcacuccagcccaggcaac

SEQ ID NO: 434191 - RNA, 24 nt, Human
cacugcacuccagcccaggcaaca

SEQ ID NO: 434192 - RNA, 18 nt, Human
cacuucauuuggagugau

SEQ ID NO: 434193 - RNA, 24 nt, Human
cagcacuuugggaggccaaggcag

SEQ ID NO: 434194 - RNA, 25 nt, Human
cagcacuuugggaggccaaggcagg

SEQ ID NO: 434195 - RNA, 25 nt, Human
cagccucaaacccccuggcucaaag

SEQ ID NO: 434196 - RNA, 24 nt, Human
cagccugaccaacauggagaaacc

SEQ ID NO: 434197 - RNA, 18 nt, Human
cagcggguccccuccucc

SEQ ID NO: 434198 - RNA, 19 nt, Human
cagcggguccccuccuccu

SEQ ID NO: 434199 - RNA, 24 nt, Human
cagcuacucgggaggcugaggcag

SEQ ID NO: 434200 - RNA, 23 nt, Human
caugaucagggcucacugcagcc

SEQ ID NO: 434201 - RNA, 24 nt, Human
ccaaagagcugguagcacaggcgu

SEQ ID NO: 434202 - RNA, 22 nt, Human
ccacgugacaccccucagcugc

SEQ ID NO: 434203 - RNA, 21 nt, Human
ccacugcacccagccauguga

SEQ ID NO: 434204 - RNA, 19 nt, Human
ccacugcacuccagcccag

SEQ ID NO: 434205 - RNA, 20 nt, Human
ccacugcacuccagcccagg

SEQ ID NO: 434206 - RNA, 20 nt, Human
ccacugcacuccagcccagg

SEQ ID NO: 434207 - RNA, 21 nt, Human
ccacugcacuccagcccaggc

SEQ ID NO: 434208 - RNA, 22 nt, Human
ccacugcacuccagcccaggca

SEQ ID NO: 434209 - RNA, 24 nt, Human
ccacugcacuccagcccaggcaac

SEQ ID NO: 434210 - RNA, 21 nt, Human
ccagugggcaaaauguuuucu

SEQ ID NO: 434211 - RNA, 20 nt, Human
ccaucucaaaccccauccca

SEQ ID NO: 434212 - RNA, 19 nt, Human
ccccugcaaucccagcacu

SEQ ID NO: 434213 - RNA, 21 nt, Human
cccgcgacauugucacggccg

SEQ ID NO: 434214 - RNA, 23 nt, Human
ccgaugguuucuagauuuuuuuu

SEQ ID NO: 434215 - RNA, 18 nt, Human
ccgggccggccugcgacg

SEQ ID NO: 434216 - RNA, 19 nt, Human
ccgggccggccugcgacgc

SEQ ID NO: 434217 - RNA, 19 nt, Human
ccuccuggaguacaggggc

SEQ ID NO: 434218 - RNA, 24 nt, Human
ccugaccaacauggagaaacccca

SEQ ID NO: 434219 - RNA, 22 nt, Human
ccugaggucaggaguucgagac

SEQ ID NO: 434220 - RNA, 21 nt, Human
ccugcgacgcagagaagaggc

SEQ ID NO: 434221 - RNA, 20 nt, Human
ccuggaguacaggggccuug

SEQ ID NO: 434222 - RNA, 19 nt, Human
ccuguaaccccagcuacuc

SEQ ID NO: 434223 - RNA, 22 nt, Human
ccuguaaccccagcuacucggg

SEQ ID NO: 434224 - RNA, 23 nt, Human
cgaaaagcaaggaaaacacuuca

SEQ ID NO: 434225 - RNA, 20 nt, Human
cgcagcggguccccuccucc

SEQ ID NO: 434226 - RNA, 21 nt, Human
cgccgggccggccugcgacgc

SEQ ID NO: 434227 - RNA, 24 nt, Human
cgccuguaaccccagcuacucggg

SEQ ID NO: 434228 - RNA, 24 nt, Human
cggaucaccugaggucaggaguuc

SEQ ID NO: 434229 - RNA, 24 nt, Human
cgucucagccucccaaagagcugg

SEQ ID NO: 434230 - RNA, 30 nt, Human
cucaaacaaaaaaaaaaaaaagaagaaucc

SEQ ID NO: 434231 - RNA, 25 nt, Human
cucaagcgaucuaucccaccuuggc

SEQ ID NO: 434232 - RNA, 24 nt, Human
cucaccccugcaaucccagcacuu

SEQ ID NO: 434233 - RNA, 22 nt, Human
cucacugcagccucaaaccccc

SEQ ID NO: 434234 - RNA, 21 nt, Human
cucggcucccgcccgcccgcc

SEQ ID NO: 434235 - RNA, 22 nt, Human
cugcagccucaaacccccuggc

SEQ ID NO: 434236 - RNA, 22 nt, Human
cugcagccucaaacccccuggc

SEQ ID NO: 434237 - RNA, 22 nt, Human
cugcagugagccgagaucuugc

SEQ ID NO: 434238 - RNA, 23 nt, Human
cugggcaugguggcucaccccug

SEQ ID NO: 434239 - RNA, 20 nt, Human
gaaaagcaaggaaaacacuu

SEQ ID NO: 434240 - RNA, 19 nt, Human
gaaaaugugagagaggaag

SEQ ID NO: 434241 - RNA, 23 nt, Human
gaacauaagccgcucagcaaacc

SEQ ID NO: 434242 - RNA, 23 nt, Human
gagaccagccugaccaacaugga

SEQ ID NO: 434243 - RNA, 23 nt, Human
gagaucuugccacugcacuccag

SEQ ID NO: 434244 - RNA, 22 nt, Human
gaggagccacccgaauccggcc

SEQ ID NO: 434245 - RNA, 24 nt, Human
gaucaccugaggucaggaguucga

SEQ ID NO: 434246 - RNA, 22 nt, Human
gcaaagcaaaauaccgaugguu

SEQ ID NO: 434247 - RNA, 21 nt, Human
gcaccacgugacaccccucag

SEQ ID NO: 434248 - RNA, 19 nt, Human
gcagcggguccccuccucc

SEQ ID NO: 434249 - RNA, 21 nt, Human
gcagcuggauguacaugggcc

SEQ ID NO: 434250 - RNA, 18 nt, Human
gccaugugaagacuuucu

SEQ ID NO: 434251 - RNA, 20 nt, Human
gccucccaaaguccuguggu

SEQ ID NO: 434252 - RNA, 21 nt, Human
gcggaucaccugaggucagga

SEQ ID NO: 434253 - RNA, 19 nt, Human
ggaggccuuuugcaccacg

SEQ ID NO: 434254 - RNA, 18 nt, Human
ggaggcugcagugagccg

SEQ ID NO: 434255 - RNA, 20 nt, Human
ggaggcugcagugagccgag

SEQ ID NO: 434256 - RNA, 23 nt, Human
ggaggcugcagugagccgagauc

SEQ ID NO: 434257 - RNA, 19 nt, Human
ggaguacaggggccuugga

SEQ ID NO: 434258 - RNA, 22 nt, Human
ggaucaccugaggucaggaguu

SEQ ID NO: 434259 - RNA, 23 nt, Human
ggaucaccugaggucaggaguuc

SEQ ID NO: 434260 - RNA, 25 nt, Human
ggaucaccugaggucaggaguucga

SEQ ID NO: 434261 - RNA, 21 nt, Human
ggcaguggcaugaucagggcu

SEQ ID NO: 434262 - RNA, 23 nt, Human
ggcaugguggcucaccccugcaa

SEQ ID NO: 434263 - RNA, 22 nt, Human
ggcucggcggccggcgcccugc

SEQ ID NO: 434264 - RNA, 24 nt, Human
ggggugggggcugagggaggaugc

SEQ ID NO: 434265 - RNA, 24 nt, Human
gguggugcacgccuguaaccccag

SEQ ID NO: 434266 - RNA, 19 nt, Human
gguuacaagugugagccac

SEQ ID NO: 434267 - RNA, 21 nt, Human
gguuacaagugugagccacug

SEQ ID NO: 434268 - RNA, 22 nt, Human
gguuacaagugugagccacugc

SEQ ID NO: 434269 - RNA, 18 nt, Human
guacccccgaaaagcaag

SEQ ID NO: 434270 - RNA, 22 nt, Human
guagggauggggucuucccaug

SEQ ID NO: 434271 - RNA, 23 nt, Human
gugaucuuccgucucagccuccc

SEQ ID NO: 434272 - RNA, 22 nt, Human
uaagaaaagagauccaaggauu

SEQ ID NO: 434273 - RNA, 21 nt, Human
uaaguuacuuuauuucugcug

SEQ ID NO: 434274 - RNA, 24 nt, Human
uacaagugugagccacugcaccca

SEQ ID NO: 434275 - RNA, 18 nt, Human
uagcugggaggccuuuug

SEQ ID NO: 434276 - RNA, 22 nt, Human
uaucccaccuuggccucccaaa

SEQ ID NO: 434277 - RNA, 23 nt, Human
uaucccaccuuggccucccaaag

SEQ ID NO: 434278 - RNA, 24 nt, Human
ucaaacaaaaaaaaaaaaaagaaa

SEQ ID NO: 434279 - RNA, 26 nt, Human
ucaaacaaaaaaaaaaaaaagaagaa

SEQ ID NO: 434280 - RNA, 24 nt, Human
ucaaucgcgcagcggguccccucc

SEQ ID NO: 434281 - RNA, 20 nt, Human
ucacugagcaugcaugugca

SEQ ID NO: 434282 - RNA, 20 nt, Human
ucagccucccaaagagcugg

SEQ ID NO: 434283 - RNA, 24 nt, Human
ucccaaagagcugguagcacaggc

SEQ ID NO: 434284 - RNA, 24 nt, Human
uccgucucagccucccaaagagcu

SEQ ID NO: 434285 - RNA, 23 nt, Human
ucgggaggcugaggcaggagaau

SEQ ID NO: 434286 - RNA, 22 nt, Human
ucucaaacaaaaaaaaaaaaaa

SEQ ID NO: 434287 - RNA, 23 nt, Human
ucucaaacaaaaaaaaaaaaaag

SEQ ID NO: 434288 - RNA, 19 nt, Human
ucucaggcaagguggaaag

SEQ ID NO: 434289 - RNA, 23 nt, Human
ucucuacuaaaaauauaaaaauu

SEQ ID NO: 434290 - RNA, 19 nt, Human
ugaaacuuuccacauuccu

SEQ ID NO: 434291 - RNA, 19 nt, Human
ugagauggugucuugcucc

SEQ ID NO: 434292 - RNA, 22 nt, Human
ugagccgagaucuugccacugc

SEQ ID NO: 434293 - RNA, 20 nt, Human
ugaggcaggagaauugccug

SEQ ID NO: 434294 - RNA, 24 nt, Human
ugaggcaggagaauugccugaacc

SEQ ID NO: 434295 - RNA, 25 nt, Human
ugaggcaggagaauugccugaaccc

SEQ ID NO: 434296 - RNA, 21 nt, Human
ugccugccuugcuguuggaac

SEQ ID NO: 434297 - RNA, 19 nt, Human
uggagggcaguggcaugau

SEQ ID NO: 434298 - RNA, 23 nt, Human
uggagggcaguggcaugaucagg

SEQ ID NO: 434299 - RNA, 22 nt, Human
uggcucaccccugcaaucccag

SEQ ID NO: 434300 - RNA, 24 nt, Human
uggcucaccccugcaaucccagca

SEQ ID NO: 434301 - RNA, 24 nt, Human
ugggaggccaaggcaggcggauca

SEQ ID NO: 434302 - RNA, 18 nt, Human
ugggcugggcaugguggc

SEQ ID NO: 434303 - RNA, 21 nt, Human
ugggggugggggcugagggag

SEQ ID NO: 434304 - RNA, 21 nt, Human
uggugcacgccuguaacccca

SEQ ID NO: 434305 - RNA, 22 nt, Human
uggugcacgccuguaaccccag

SEQ ID NO: 434306 - RNA, 23 nt, Human
uggugcacgccuguaaccccagc

SEQ ID NO: 434307 - RNA, 20 nt, Human
ugguuacaagugugagccac

SEQ ID NO: 434308 - RNA, 22 nt, Human
ugguuacaagugugagccacug

SEQ ID NO: 434309 - RNA, 28 nt, Human
ugguuucuagauuuuuuuuuuuuuuuuu

SEQ ID NO: 434310 - RNA, 21 nt, Human
uguagggauggggucuuccca

SEQ ID NO: 434311 - RNA, 22 nt, Human
ugugguuacaagugugagccac

SEQ ID NO: 434312 - RNA, 21 nt, Human
uuacaagugugagccacugca

SEQ ID NO: 434313 - RNA, 18 nt, Human
uucacuuuuauuaaggga

SEQ ID NO: 434314 - RNA, 19 nt, Human
uuccaaagaagaaucuggg

SEQ ID NO: 434315 - RNA, 20 nt, Human
uucccaugcuucccaggcuc

SEQ ID NO: 434316 - RNA, 22 nt, Human
uucucauaaacaaauucagaac

SEQ ID NO: 434317 - RNA, 24 nt, Human
uugccugaacccgggagauggagg

SEQ ID NO: 434318 - RNA, 24 nt, Human
uuguagggauggggucuucccaug

SEQ ID NO: 434319 - RNA, 20 nt, Human
uuucugguaauuucacuuuu

SEQ ID NO: 434320 - RNA, 20 nt, Human
uuugcaccacgugacacccc

SEQ ID NO: 434321 - RNA, 18 nt, Human
uuuguagggauggggucu

SEQ ID NO: 434322 - RNA, 24 nt, Human
uuuguagggauggggucuucccau

SEQ ID NO: 434323 - RNA, 24 nt, Human
uuuugcaccacgugacaccccucc

SEQ ID NO: 434324 - RNA, 19 nt, Human
uuuuuuguagggauggggu

SEQ ID NO: 434325 - RNA, 25 nt, Human
uuuuuuuuuuuuuuuuuuuuuaagg

SEQ ID NO: 434326 - RNA, 18 nt, Human
aaacaccuacuccccaca

SEQ ID NO: 434327 - RNA, 22 nt, Human
aaagaacgggaaccucaaacac

SEQ ID NO: 434328 - RNA, 22 nt, Human
aaagugaaagagaaacaggucc

SEQ ID NO: 434329 - RNA, 23 nt, Human
aaauacacaccccauggcucaca

SEQ ID NO: 434330 - RNA, 21 nt, Human
aagaacgggaaccucaaacac

SEQ ID NO: 434331 - RNA, 22 nt, Human
acaaauacacaccccauggcuc

SEQ ID NO: 434332 - RNA, 24 nt, Human
acaaauacacaccccauggcucac

SEQ ID NO: 434333 - RNA, 22 nt, Human
acaccuacuccccacauacaaa

SEQ ID NO: 434334 - RNA, 23 nt, Human
accccauggcucacaccagcaaa

SEQ ID NO: 434335 - RNA, 27 nt, Human
accuacuccccacauacaaauacacac

SEQ ID NO: 434336 - RNA, 20 nt, Human
accucaaacaccuacucccc

SEQ ID NO: 434337 - RNA, 18 nt, Human
agagaagaaaaggagagg

SEQ ID NO: 434338 - RNA, 24 nt, Human
agggcccaccaggucugggcaagg

SEQ ID NO: 434339 - RNA, 25 nt, Human
aucucuuccuccuuuccacccccag

SEQ ID NO: 434340 - RNA, 21 nt, Human
caaacaccuacuccccacaua

SEQ ID NO: 434341 - RNA, 22 nt, Human
caaauacacaccccauggcuca

SEQ ID NO: 434342 - RNA, 21 nt, Human
caagucaguugaagaggcugg

SEQ ID NO: 434343 - RNA, 22 nt, Human
cacaccagcaaaugaaagugaa

SEQ ID NO: 434344 - RNA, 23 nt, Human
caccccucccucugaagggccca

SEQ ID NO: 434345 - RNA, 18 nt, Human
cagggccccacccuccuc

SEQ ID NO: 434346 - RNA, 18 nt, Human
caggggucccuucguccu

SEQ ID NO: 434347 - RNA, 20 nt, Human
cauggcucacaccagcaaau

SEQ ID NO: 434348 - RNA, 19 nt, Human
ccaccccucccucugaagg

SEQ ID NO: 434349 - RNA, 21 nt, Human
ccccauggcucacaccagcaa

SEQ ID NO: 434350 - RNA, 18 nt, Human
ccucuucccucugugccc

SEQ ID NO: 434351 - RNA, 20 nt, Human
cuacuccccacauacaaaua

SEQ ID NO: 434352 - RNA, 18 nt, Human
cuacugccucugcuggca

SEQ ID NO: 434353 - RNA, 22 nt, Human
cuaguaucucuuccuccuuucc

SEQ ID NO: 434354 - RNA, 26 nt, Human
cuaguaucucuuccuccuuuccaccc

SEQ ID NO: 434355 - RNA, 20 nt, Human
cucuaaagagaagaaaagga

SEQ ID NO: 434356 - RNA, 19 nt, Human
cugcuggcagacaggggca

SEQ ID NO: 434357 - RNA, 19 nt, Human
gaaagaacgggaaccucaa

SEQ ID NO: 434358 - RNA, 19 nt, Human
gaaagagaaacagguccac

SEQ ID NO: 434359 - RNA, 20 nt, Human
gggaaagaacgggaaccuca

SEQ ID NO: 434360 - RNA, 25 nt, Human
gggaaguauauuuuauuuacauuuu

SEQ ID NO: 434361 - RNA, 19 nt, Human
gugggagggcccugggcug

SEQ ID NO: 434362 - RNA, 22 nt, Human
uaucucuuccuccuuuccaccc

SEQ ID NO: 434363 - RNA, 30 nt, Human
uaucucuuccuccuuuccacccccagagaa

SEQ ID NO: 434364 - RNA, 21 nt, Human
ucacaccagcaaaugaaagug

SEQ ID NO: 434365 - RNA, 27 nt, Human
ucacaccagcaaaugaaagugaaagag

SEQ ID NO: 434366 - RNA, 24 nt, Human
ucauccagggccccacccuccucu

SEQ ID NO: 434367 - RNA, 19 nt, Human
ucucuuccuccuuuccacc

SEQ ID NO: 434368 - RNA, 26 nt, Human
ucugaagggcccaccaggucugggca

SEQ ID NO: 434369 - RNA, 26 nt, Human
ucugcuggcagacaggggcagggguu

SEQ ID NO: 434370 - RNA, 21 nt, Human
ugaagggcccaccaggucugg

SEQ ID NO: 434371 - RNA, 22 nt, Human
aaaaaaaucaaauaugucaaua

SEQ ID NO: 434372 - RNA, 23 nt, Human
aaaaaucuuccucauggauaaaa

SEQ ID NO: 434373 - RNA, 22 nt, Human
aaaagugaguaaauuaugguag

SEQ ID NO: 434374 - RNA, 22 nt, Human
aaaaucuuccucauggauaaaa

SEQ ID NO: 434375 - RNA, 22 nt, Human
aaacaaaccaacugaggucaag

SEQ ID NO: 434376 - RNA, 22 nt, Human
aaacgaaaacagguaaaaacaa

SEQ ID NO: 434377 - RNA, 27 nt, Human
aaacguggccccacccccuucuucccg

SEQ ID NO: 434378 - RNA, 18 nt, Human
aaaguuuuucauaucacc

SEQ ID NO: 434379 - RNA, 18 nt, Human
aaaugucagacauugccu

SEQ ID NO: 434380 - RNA, 18 nt, Human
aacacagaaaaaagugag

SEQ ID NO: 434381 - RNA, 20 nt, Human
aaccaacugaggucaaggca

SEQ ID NO: 434382 - RNA, 19 nt, Human
aacugaggggaaaucuucu

SEQ ID NO: 434383 - RNA, 18 nt, Human
aagaggaauacgaaaagc

SEQ ID NO: 434384 - RNA, 20 nt, Human
aauaccuacaauugaccaag

SEQ ID NO: 434385 - RNA, 18 nt, Human
aaugacaccccugaaccc

SEQ ID NO: 434386 - RNA, 22 nt, Human
acuaugcuuggcauaacugggc

SEQ ID NO: 434387 - RNA, 20 nt, Human
acugcagauaaucaaaaugu

SEQ ID NO: 434388 - RNA, 18 nt, Human
aggaaagaaagagguaaa

SEQ ID NO: 434389 - RNA, 22 nt, Human
aggaauacgaaaagccaauaac

SEQ ID NO: 434390 - RNA, 24 nt, Human
auggaaacugaggggaaaucuucu

SEQ ID NO: 434391 - RNA, 22 nt, Human
auuccagugagcuaucuugaac

SEQ ID NO: 434392 - RNA, 21 nt, Human
caaaccaacugaggucaaggc

SEQ ID NO: 434393 - RNA, 21 nt, Human
caagacaugcacuacaaccac

SEQ ID NO: 434394 - RNA, 23 nt, Human
caagacaugcacuacaaccacau

SEQ ID NO: 434395 - RNA, 25 nt, Human
cacaaaaaguuauguuacagaggua

SEQ ID NO: 434396 - RNA, 22 nt, Human
cacccccuucuucccggcgucc

SEQ ID NO: 434397 - RNA, 26 nt, Human
cagagaccaaaaaugucagacauugc

SEQ ID NO: 434398 - RNA, 24 nt, Human
cagcagcucuugugaucgagaggu

SEQ ID NO: 434399 - RNA, 20 nt, Human
caucaauaugaugguccugg

SEQ ID NO: 434400 - RNA, 23 nt, Human
ccagaagucugcuuuuuuuuuuu

SEQ ID NO: 434401 - RNA, 19 nt, Human
cccaccgacagcccuccca

SEQ ID NO: 434402 - RNA, 18 nt, Human
ccccacccccuucuuccc

SEQ ID NO: 434403 - RNA, 25 nt, Human
ccgacagcccucccagcccgccccc

SEQ ID NO: 434404 - RNA, 27 nt, Human
cugcagauaaucaaaaugucuaacaca

SEQ ID NO: 434405 - RNA, 25 nt, Human
cuuccaauuccauucuucacaccua

SEQ ID NO: 434406 - RNA, 21 nt, Human
gaaaacagguaaaaacaauga

SEQ ID NO: 434407 - RNA, 20 nt, Human
gcaaacguggccccaccccc

SEQ ID NO: 434408 - RNA, 21 nt, Human
gcaaacguggccccacccccu

SEQ ID NO: 434409 - RNA, 21 nt, Human
ggacgggccgucgcuacgcag

SEQ ID NO: 434410 - RNA, 23 nt, Human
ggcaaaaauuaaaccaaaaagaa

SEQ ID NO: 434411 - RNA, 19 nt, Human
guacauuagaaccacaaaa

SEQ ID NO: 434412 - RNA, 21 nt, Human
uaaaaagaauuuacaaaacag

SEQ ID NO: 434413 - RNA, 22 nt, Human
uaaauguuuccuuuugcuuaug

SEQ ID NO: 434414 - RNA, 21 nt, Human
uaaccugaucuaagucaaugg

SEQ ID NO: 434415 - RNA, 23 nt, Human
uaacucaaaauguacaaggacau

SEQ ID NO: 434416 - RNA, 19 nt, Human
uaaggcaaaacaaaccaac

SEQ ID NO: 434417 - RNA, 21 nt, Human
uaaggcaaaacaaaccaacug

SEQ ID NO: 434418 - RNA, 27 nt, Human
uaaggcaaaacaaaccaacugagguca

SEQ ID NO: 434419 - RNA, 23 nt, Human
uaaguacuacuugcuaaaacgaa

SEQ ID NO: 434420 - RNA, 19 nt, Human
uacauuggcaaaaauuaaa

SEQ ID NO: 434421 - RNA, 21 nt, Human
uauaauuaaagcccuaugaac

SEQ ID NO: 434422 - RNA, 22 nt, Human
uauacaauuugcacacuuuuaa

SEQ ID NO: 434423 - RNA, 18 nt, Human
uaugucaaacaauuuccu

SEQ ID NO: 434424 - RNA, 21 nt, Human
uauucuggcagggggagggaa

SEQ ID NO: 434425 - RNA, 22 nt, Human
uccaagacaugcacuacaacca

SEQ ID NO: 434426 - RNA, 24 nt, Human
uccaagacaugcacuacaaccaca

SEQ ID NO: 434427 - RNA, 21 nt, Human
uccauucuucacaccuagcuu

SEQ ID NO: 434428 - RNA, 22 nt, Human
ugaauacggaagaucacaaaca

SEQ ID NO: 434429 - RNA, 20 nt, Human
ugacaagacaaaguuuuuca

SEQ ID NO: 434430 - RNA, 21 nt, Human
ugcuuuuuuuuuuuaauugga

SEQ ID NO: 434431 - RNA, 19 nt, Human
uggcaaaaauuaaaccaaa

SEQ ID NO: 434432 - RNA, 23 nt, Human
uggcagggggagggaagucacau

SEQ ID NO: 434433 - RNA, 26 nt, Human
uggccaaaagcauccuaacuuguauu

SEQ ID NO: 434434 - RNA, 19 nt, Human
uggcccaccgacagcccuc

SEQ ID NO: 434435 - RNA, 22 nt, Human
uguuaaaaaucuuccucaugga

SEQ ID NO: 434436 - RNA, 24 nt, Human
uucaaauuuuuuucuuuuacuaau

SEQ ID NO: 434437 - RNA, 25 nt, Human
uucaaauuuuuuucuuuuacuaauc

SEQ ID NO: 434438 - RNA, 27 nt, Human
uuccuagguuacuuaggccaauuauau

SEQ ID NO: 434439 - RNA, 23 nt, Human
uucuacaguuagcauguaucacu

SEQ ID NO: 434440 - RNA, 24 nt, Human
uugaaagauagcauuuaaauguuu

SEQ ID NO: 434441 - RNA, 22 nt, Human
uuucuuaugggaaggcaguggg

SEQ ID NO: 434442 - RNA, 18 nt, Human
uuugcacacuuuuaaugu

SEQ ID NO: 434443 - RNA, 19 nt, Human
uuuugcuuaugugcauuuu

SEQ ID NO: 434444 - RNA, 20 nt, Human
aaaaauaaauauucuucugc

SEQ ID NO: 434445 - RNA, 18 nt, Human
aaaacaacaaaaaaccau

SEQ ID NO: 434446 - RNA, 19 nt, Human
aaaaguacccuucaccaca

SEQ ID NO: 434447 - RNA, 23 nt, Human
aaaccaugauaaauuaaaaccaa

SEQ ID NO: 434448 - RNA, 21 nt, Human
acuuucuucucugcagcagcc

SEQ ID NO: 434449 - RNA, 22 nt, Human
caaagcuccaaggucaaagcuc

SEQ ID NO: 434450 - RNA, 18 nt, Human
caaagcuccccagaauac

SEQ ID NO: 434451 - RNA, 21 nt, Human
caccaugaaaaguacccuuca

SEQ ID NO: 434452 - RNA, 24 nt, Human
cacuccucucugccuccuccucca

SEQ ID NO: 434453 - RNA, 19 nt, Human
ccccagaauacagaggaau

SEQ ID NO: 434454 - RNA, 21 nt, Human
cgaaaacaacaaaaaaccaug

SEQ ID NO: 434455 - RNA, 21 nt, Human
cgcccuccacuccucucugcc

SEQ ID NO: 434456 - RNA, 20 nt, Human
cuacuccgcccuccacuccu

SEQ ID NO: 434457 - RNA, 24 nt, Human
cuacuccgcccuccacuccucucu

SEQ ID NO: 434458 - RNA, 20 nt, Human
cuccgucuacuccgcccucc

SEQ ID NO: 434459 - RNA, 22 nt, Human
cuccucucugccuccuccucca

SEQ ID NO: 434460 - RNA, 18 nt, Human
gacacuuucuucucugca

SEQ ID NO: 434461 - RNA, 18 nt, Human
gccuccuccuccaccgcc

SEQ ID NO: 434462 - RNA, 24 nt, Human
ggcaaauaauaaaauuuguucuaa

SEQ ID NO: 434463 - RNA, 27 nt, Human
uauugugcaucuugcaggugaaguacu

SEQ ID NO: 434464 - RNA, 21 nt, Human
ucaaagcuccccagaauacag

SEQ ID NO: 434465 - RNA, 24 nt, Human
ucuaauguuuucucaagcuguaca

SEQ ID NO: 434466 - RNA, 28 nt, Human
ucucugcagcagccuccuccgucuacuc

SEQ ID NO: 434467 - RNA, 18 nt, Human
ucugcagcagccuccucc

SEQ ID NO: 434468 - RNA, 19 nt, Human
ucugccuccuccuccaccc

SEQ ID NO: 434469 - RNA, 18 nt, Human
ugauaaauuaaaaccaaa

SEQ ID NO: 434470 - RNA, 23 nt, Human
ugcacagaguugaaaauuauugu

SEQ ID NO: 434471 - RNA, 22 nt, Human
uguacaaagcuccaaggucaaa

SEQ ID NO: 434472 - RNA, 23 nt, Human
uucaaaacgaaaacaacaaaaaa

SEQ ID NO: 434473 - RNA, 25 nt, Human
uucaaaacgaaaacaacaaaaaacc

SEQ ID NO: 434474 - RNA, 20 nt, Human
uuucuucucugcagcagccu

SEQ ID NO: 434475 - RNA, 19 nt, Human
uuuuuuuuuuuuuuuuugu

SEQ ID NO: 434476 - RNA, 22 nt, Human
uuuuuuuuuuuuuuuuuguggg

SEQ ID NO: 434477 - RNA, 27 nt, Human
uuuuuuuuuuuuuuuuuuuuuuugggg

SEQ ID NO: 434478 - RNA, 18 nt, Human
aaaaaugaaaacuguaau

SEQ ID NO: 434479 - RNA, 19 nt, Human
aaacugauccacgcuuccc

SEQ ID NO: 434480 - RNA, 24 nt, Human
aacaauaaaaacaauaauaacaac

SEQ ID NO: 434481 - RNA, 19 nt, Human
aaccgaaaaccaaccuaau

SEQ ID NO: 434482 - RNA, 20 nt, Human
aagagccugaauuuguugac

SEQ ID NO: 434483 - RNA, 23 nt, Human
aagcacaaaauagacccauguug

SEQ ID NO: 434484 - RNA, 26 nt, Human
aagcacuuggauccacuggucucuuu

SEQ ID NO: 434485 - RNA, 19 nt, Human
aaguucaggcuaaaaaacu

SEQ ID NO: 434486 - RNA, 22 nt, Human
acaaugaagaauccuucaagga

SEQ ID NO: 434487 - RNA, 19 nt, Human
acuaacagaacaacaauaa

SEQ ID NO: 434488 - RNA, 24 nt, Human
agaaaacaaugaagaauccuucaa

SEQ ID NO: 434489 - RNA, 20 nt, Human
agaaugucauuauaauuaaa

SEQ ID NO: 434490 - RNA, 18 nt, Human
aggaaauaagcuauuuca

SEQ ID NO: 434491 - RNA, 22 nt, Human
auacuaccuuugaaaaaggauc

SEQ ID NO: 434492 - RNA, 25 nt, Human
caagaaaacaaugaagaauccuuca

SEQ ID NO: 434493 - RNA, 22 nt, Human
cacaaaaauacaguaugguauu

SEQ ID NO: 434494 - RNA, 22 nt, Human
cagaagagccugaauuuguuga

SEQ ID NO: 434495 - RNA, 19 nt, Human
cagagaguguaaugaauug

SEQ ID NO: 434496 - RNA, 23 nt, Human
caggaaagaaaauaaaaaaucaa

SEQ ID NO: 434497 - RNA, 22 nt, Human
caggccagagucauuaaacuga

SEQ ID NO: 434498 - RNA, 25 nt, Human
cagggcacaauuagaaugaaguuuu

SEQ ID NO: 434499 - RNA, 21 nt, Human
ccuacugauacuaccuuugaa

SEQ ID NO: 434500 - RNA, 19 nt, Human
ccuuguccaguuacucuuc

SEQ ID NO: 434501 - RNA, 23 nt, Human
cuucugaaaagccauggucugug

SEQ ID NO: 434502 - RNA, 27 nt, Human
gaaaacaaugaagaauccuucaaggac

SEQ ID NO: 434503 - RNA, 24 nt, Human
gaaaagaugcacaaauauagcccu

SEQ ID NO: 434504 - RNA, 23 nt, Human
gaaagaaaauaaaaaaucaaugu

SEQ ID NO: 434505 - RNA, 20 nt, Human
gagaaguauuugaagcacuu

SEQ ID NO: 434506 - RNA, 21 nt, Human
gauuauggcuaucuucuucca

SEQ ID NO: 434507 - RNA, 24 nt, Human
ggaaauaagcuauuucaggaaaga

SEQ ID NO: 434508 - RNA, 21 nt, Human
ggguagcucugaaguguuccg

SEQ ID NO: 434509 - RNA, 20 nt, Human
gucuguguguagaacaugcc

SEQ ID NO: 434510 - RNA, 24 nt, Human
gugaaaagauacagaaaaugacua

SEQ ID NO: 434511 - RNA, 21 nt, Human
uaaaauguucucaguguuagc

SEQ ID NO: 434512 - RNA, 20 nt, Human
uaaaguaaauauugcagagc

SEQ ID NO: 434513 - RNA, 22 nt, Human
uaacaaacucagggcacaauua

SEQ ID NO: 434514 - RNA, 23 nt, Human
uaacagaacaacaauaaaaacaa

SEQ ID NO: 434515 - RNA, 22 nt, Human
uaagcuauuucaggaaagaaaa

SEQ ID NO: 434516 - RNA, 24 nt, Human
uauaugccacuaccaggccagagu

SEQ ID NO: 434517 - RNA, 22 nt, Human
ucaggcuaaaaaacucauauuu

SEQ ID NO: 434518 - RNA, 21 nt, Human
ucaguuuaucagaccuucuua

SEQ ID NO: 434519 - RNA, 21 nt, Human
ucauuaaacugauccacgcuu

SEQ ID NO: 434520 - RNA, 22 nt, Human
uccuuuguguuauguuacugac

SEQ ID NO: 434521 - RNA, 24 nt, Human
ucucuuuuuuaaccauuuuguccu

SEQ ID NO: 434522 - RNA, 19 nt, Human
ucuuguagaauuauggaac

SEQ ID NO: 434523 - RNA, 19 nt, Human
ugaaaaaggauccauaaaa

SEQ ID NO: 434524 - RNA, 18 nt, Human
ugagaauaaauucuuucc

SEQ ID NO: 434525 - RNA, 18 nt, Human
ugaggugaaaagauacag

SEQ ID NO: 434526 - RNA, 23 nt, Human
ugcacaaauauagcccuagaaac

SEQ ID NO: 434527 - RNA, 20 nt, Human
uggggaugaauaacaugucu

SEQ ID NO: 434528 - RNA, 20 nt, Human
uguuggggaugaauaacaug

SEQ ID NO: 434529 - RNA, 24 nt, Human
uuacugacugguguauaugccacu

SEQ ID NO: 434530 - RNA, 22 nt, Human
uuagaauccgaguaaauaaugu

SEQ ID NO: 434531 - RNA, 26 nt, Human
uucauccuaaauuuuuaaaaaugaaa

SEQ ID NO: 434532 - RNA, 18 nt, Human
uucucaguguuagcuuua

SEQ ID NO: 434533 - RNA, 25 nt, Human
uugcagagcaauagaguuaagaaaa

SEQ ID NO: 434534 - RNA, 28 nt, Human
agacaucuaugcucuuuuguuggaaaua

SEQ ID NO: 434535 - RNA, 19 nt, Human
aggagaaaaugcagaaauc

SEQ ID NO: 434536 - RNA, 23 nt, Human
caucuaugcucuuuuguuggaaa

SEQ ID NO: 434537 - RNA, 19 nt, Human
cuuaaagauuuuuuuccuc

SEQ ID NO: 434538 - RNA, 23 nt, Human
ugcagaaaucugcagaaucauuc

SEQ ID NO: 434539 - RNA, 21 nt, Human
uuccucagugaaaaccauccc

SEQ ID NO: 434540 - RNA, 18 nt, Human
uuuguuggaaauauuugu

SEQ ID NO: 434541 - RNA, 18 nt, Human
aaacaaacaaacaaaccc

SEQ ID NO: 434542 - RNA, 23 nt, Human
aaacaaacaaacaaacccggagc

SEQ ID NO: 434543 - RNA, 19 nt, Human
aaacaaacaaacccggagc

SEQ ID NO: 434544 - RNA, 22 nt, Human
aaacaaacaaacccggagccaa

SEQ ID NO: 434545 - RNA, 25 nt, Human
aaacaaacaaacccggagccacgca

SEQ ID NO: 434546 - RNA, 25 nt, Human
aaagaggaaaaacaaacaaacaaac

SEQ ID NO: 434547 - RNA, 18 nt, Human
aaagcaaaacacacaacc

SEQ ID NO: 434548 - RNA, 19 nt, Human
aacaaaagccuagugcagc

SEQ ID NO: 434549 - RNA, 20 nt, Human
aacaaacaaacccggagcca

SEQ ID NO: 434550 - RNA, 22 nt, Human
aacagacagaccacuguccaaa

SEQ ID NO: 434551 - RNA, 22 nt, Human
aacccggagccacgcaguaaac

SEQ ID NO: 434552 - RNA, 18 nt, Human
aagcaaaacacacaacca

SEQ ID NO: 434553 - RNA, 19 nt, Human
aagcagcuguuucaguccc

SEQ ID NO: 434554 - RNA, 20 nt, Human
aaggagcuuagaaaaauuuc

SEQ ID NO: 434555 - RNA, 18 nt, Human
aagugaaaaagaaagaag

SEQ ID NO: 434556 - RNA, 27 nt, Human
aaguggcuuuuuuagaaauuaaaaagg

SEQ ID NO: 434557 - RNA, 22 nt, Human
aaucacaaauucagaagcacug

SEQ ID NO: 434558 - RNA, 21 nt, Human
aaucccuuuugcuuuucuucu

SEQ ID NO: 434559 - RNA, 21 nt, Human
aauccuauuagugugacaaag

SEQ ID NO: 434560 - RNA, 21 nt, Human
acaaacaaacaaacccggagc

SEQ ID NO: 434561 - RNA, 20 nt, Human
acaauggagaaaauaaacac

SEQ ID NO: 434562 - RNA, 21 nt, Human
acagaccaaaaagguacugca

SEQ ID NO: 434563 - RNA, 24 nt, Human
accacuguccaaauccagacuguu

SEQ ID NO: 434564 - RNA, 18 nt, Human
acgcaguaaacugcaugu

SEQ ID NO: 434565 - RNA, 18 nt, Human
acggaugacaacuuccau

SEQ ID NO: 434566 - RNA, 23 nt, Human
agaaagaagucccaguaagcaga

SEQ ID NO: 434567 - RNA, 18 nt, Human
agaagccuuagcuuugaa

SEQ ID NO: 434568 - RNA, 18 nt, Human
aggaaaaacaaacaaaca

SEQ ID NO: 434569 - RNA, 21 nt, Human
aggagaagcaagaaacuuuca

SEQ ID NO: 434570 - RNA, 25 nt, Human
aggauagaaacagcagccacaggga

SEQ ID NO: 434571 - RNA, 26 nt, Human
aggcagcuccagaagaaggggaacgc

SEQ ID NO: 434572 - RNA, 23 nt, Human
agugguacuuuuucuccuuugga

SEQ ID NO: 434573 - RNA, 19 nt, Human
aguuguuuuuaauuccugu

SEQ ID NO: 434574 - RNA, 21 nt, Human
aucacaaauucagaagcacug

SEQ ID NO: 434575 - RNA, 20 nt, Human
auuaagugaaaaagaaagaa

SEQ ID NO: 434576 - RNA, 24 nt, Human
caaaauaagcagcuguuucagucc

SEQ ID NO: 434577 - RNA, 20 nt, Human
caaacaaacaaacccggagc

SEQ ID NO: 434578 - RNA, 25 nt, Human
caaacaaacaaacccggagccacgc

SEQ ID NO: 434579 - RNA, 19 nt, Human
caaacccggagccacgcag

SEQ ID NO: 434580 - RNA, 24 nt, Human
caaauucagaagcacuguuucuga

SEQ ID NO: 434581 - RNA, 21 nt, Human
caacacucugaggcaggaaaa

SEQ ID NO: 434582 - RNA, 24 nt, Human
caauauacuucaauacaaacaugc

SEQ ID NO: 434583 - RNA, 20 nt, Human
cacaaauucagaagcacugu

SEQ ID NO: 434584 - RNA, 22 nt, Human
cacaagacagaccaaaaaggua

SEQ ID NO: 434585 - RNA, 20 nt, Human
cacacacaagacagaccaaa

SEQ ID NO: 434586 - RNA, 19 nt, Human
cacuguccaaauccagacu

SEQ ID NO: 434587 - RNA, 22 nt, Human
cagaccacuguccaaauccaga

SEQ ID NO: 434588 - RNA, 22 nt, Human
cagcagccacagggaagcaaaa

SEQ ID NO: 434589 - RNA, 28 nt, Human
cagugguacuuuuucuccuuugguaucu

SEQ ID NO: 434590 - RNA, 20 nt, Human
caugcaagcaaucccauggu

SEQ ID NO: 434591 - RNA, 23 nt, Human
ccaguaagcagaccgaacaauac

SEQ ID NO: 434592 - RNA, 21 nt, Human
cguucuugguucuccaguuac

SEQ ID NO: 434593 - RNA, 21 nt, Human
cuaccuccuaccauugggccc

SEQ ID NO: 434594 - RNA, 22 nt, Human
cucccgaaccgcccacagaggc

SEQ ID NO: 434595 - RNA, 25 nt, Human
cugaaaaguaaacaaggcaugugaa

SEQ ID NO: 434596 - RNA, 24 nt, Human
cuggacauacauaaauccaauccu

SEQ ID NO: 434597 - RNA, 22 nt, Human
cuuagcuuugaauugaggaaug

SEQ ID NO: 434598 - RNA, 19 nt, Human
cuugagaaacugaacuaac

SEQ ID NO: 434599 - RNA, 22 nt, Human
gaaaaacaaacaaacaaacccg

SEQ ID NO: 434600 - RNA, 21 nt, Human
gaaaauaaacacuagcucucu

SEQ ID NO: 434601 - RNA, 21 nt, Human
gaaagcacucuaaaaaguugu

SEQ ID NO: 434602 - RNA, 23 nt, Human
gaaauaccaccauaucaacagug

SEQ ID NO: 434603 - RNA, 30 nt, Human
gacuacaguaacaaaagccuagugcagccc

SEQ ID NO: 434604 - RNA, 25 nt, Human
gccagacuacaguaacaaaagccua

SEQ ID NO: 434605 - RNA, 25 nt, Human
ggaaaaacaaacaaacaaacccgga

SEQ ID NO: 434606 - RNA, 18 nt, Human
ggagcagcaaucugucag

SEQ ID NO: 434607 - RNA, 21 nt, Human
ggaggauagaaacagcagcca

SEQ ID NO: 434608 - RNA, 23 nt, Human
ggaugacaacuuccauucaaagu

SEQ ID NO: 434609 - RNA, 24 nt, Human
ggcagcuccagaagaagccuuagc

SEQ ID NO: 434610 - RNA, 18 nt, Human
gggaagcaaaaaguagaa

SEQ ID NO: 434611 - RNA, 23 nt, Human
ggguagaccagaauuugaaauac

SEQ ID NO: 434612 - RNA, 23 nt, Human
guauccccacaugcaagcaaucc

SEQ ID NO: 434613 - RNA, 24 nt, Human
guggguagaaacuuaugaccugaa

SEQ ID NO: 434614 - RNA, 26 nt, Human
uaaaccuauuaaagaggaaaaacaaa

SEQ ID NO: 434615 - RNA, 20 nt, Human
uaaacuaaaaugacaacuac

SEQ ID NO: 434616 - RNA, 22 nt, Human
uaagcagaccgaacaauacaaa

SEQ ID NO: 434617 - RNA, 19 nt, Human
uaagcagcuguuucagucc

SEQ ID NO: 434618 - RNA, 25 nt, Human
uacaaacuauauaguucaauauacu

SEQ ID NO: 434619 - RNA, 30 nt, Human
uagcaaaucuuuuuuucuuuucugaauucu

SEQ ID NO: 434620 - RNA, 18 nt, Human
ucaauacaaacaugcagc

SEQ ID NO: 434621 - RNA, 27 nt, Human
ucacugcaaggcacacacaagacagac

SEQ ID NO: 434622 - RNA, 22 nt, Human
ucuccuguauccccacaugcaa

SEQ ID NO: 434623 - RNA, 22 nt, Human
ucucuggcuggaggauagaaac

SEQ ID NO: 434624 - RNA, 21 nt, Human
ucucuggcuggaggauagaac

SEQ ID NO: 434625 - RNA, 23 nt, Human
ugaaaaauaaacuaaaaugacaa

SEQ ID NO: 434626 - RNA, 19 nt, Human
ugaaaaguaaacaaggcau

SEQ ID NO: 434627 - RNA, 19 nt, Human
ugaaauaccaccauaucaa

SEQ ID NO: 434628 - RNA, 24 nt, Human
ugaauggugaaaaagaugacauac

SEQ ID NO: 434629 - RNA, 21 nt, Human
ugaggcaggaaaaccuuucuc

SEQ ID NO: 434630 - RNA, 21 nt, Human
ugcaaggcacacacaagacag

SEQ ID NO: 434631 - RNA, 22 nt, Human
ugcagcugcacaaguguguaac

SEQ ID NO: 434632 - RNA, 21 nt, Human
uggagcagcaaucugucagcu

SEQ ID NO: 434633 - RNA, 19 nt, Human
uggguagaaacuuaugacc

SEQ ID NO: 434634 - RNA, 23 nt, Human
uguauccccacaugcaagcaauc

SEQ ID NO: 434635 - RNA, 22 nt, Human
uguccaaauccagacuguucac

SEQ ID NO: 434636 - RNA, 23 nt, Human
uuaaagaaaagcaaaacacacaa

SEQ ID NO: 434637 - RNA, 18 nt, Human
uuacacuucagcuuuuac

SEQ ID NO: 434638 - RNA, 21 nt, Human
uucaaagaauguggguagaaa

SEQ ID NO: 434639 - RNA, 19 nt, Human
uucaauggaacuaucguug

SEQ ID NO: 434640 - RNA, 22 nt, Human
uuccauucaaaguggcuuuuuu

SEQ ID NO: 434641 - RNA, 18 nt, Human
uugcuuuucuucucuacc

SEQ ID NO: 434642 - RNA, 23 nt, Human
uuugaaauaccaccauaucaaca

SEQ ID NO: 434643 - RNA, 21 nt, Human
acucuagaaacacugucaaaa

SEQ ID NO: 434644 - RNA, 22 nt, Human
agugccugacucuuugggugac

SEQ ID NO: 434645 - RNA, 21 nt, Human
auaaaaagcacucuagaaaca

SEQ ID NO: 434646 - RNA, 25 nt, Human
caggaaaauaauaaaaagcacucua

SEQ ID NO: 434647 - RNA, 23 nt, Human
cuuuacuaauauuuuguauugcc

SEQ ID NO: 434648 - RNA, 19 nt, Human
ggagaaaguaaucauggug

SEQ ID NO: 434649 - RNA, 21 nt, Human
uaaaaagcacucuagaaacac

SEQ ID NO: 434650 - RNA, 24 nt, Human
uaaaaagcacucuagaaacacugu

SEQ ID NO: 434651 - RNA, 25 nt, Human
uacccagugccugacucuuugggug

SEQ ID NO: 434652 - RNA, 18 nt, Human
uaucaccccuauguuuga

SEQ ID NO: 434653 - RNA, 22 nt, Human
uucuuuauugcugcuucuucau

SEQ ID NO: 434654 - RNA, 19 nt, Human
aaacaggaacacagaauuu

SEQ ID NO: 434655 - RNA, 22 nt, Human
aaacaggaacacagaauuuggg

SEQ ID NO: 434656 - RNA, 18 nt, Human
aaaguccagugaaaaugc

SEQ ID NO: 434657 - RNA, 20 nt, Human
aaaugccucuguccacacug

SEQ ID NO: 434658 - RNA, 20 nt, Human
aaauucuuaggaaaguauca

SEQ ID NO: 434659 - RNA, 25 nt, Human
aaccaagugacaaauauccacaaaa

SEQ ID NO: 434660 - RNA, 21 nt, Human
aaccuccuccucccaccacac

SEQ ID NO: 434661 - RNA, 22 nt, Human
acauggcacuuacccagcaccc

SEQ ID NO: 434662 - RNA, 22 nt, Human
accaagugacaaauauccacaa

SEQ ID NO: 434663 - RNA, 22 nt, Human
acccagcacccgaaccuccucc

SEQ ID NO: 434664 - RNA, 23 nt, Human
acccaugacauuuaguauuuuua

SEQ ID NO: 434665 - RNA, 18 nt, Human
accuccuccucccaccac

SEQ ID NO: 434666 - RNA, 19 nt, Human
agacaucacuaaagucuag

SEQ ID NO: 434667 - RNA, 18 nt, Human
aggaaucuagagguaugg

SEQ ID NO: 434668 - RNA, 23 nt, Human
auaguuucuaaaaauagaacauu

SEQ ID NO: 434669 - RNA, 22 nt, Human
caaaguaucauacaccuagaaa

SEQ ID NO: 434670 - RNA, 21 nt, Human
cacccgaaccuccuccuccca

SEQ ID NO: 434671 - RNA, 23 nt, Human
cagaacaauggaaccaguauggc

SEQ ID NO: 434672 - RNA, 23 nt, Human
cagugaaaauggcacacaguugg

SEQ ID NO: 434673 - RNA, 21 nt, Human
ccacacggagaaccauuucug

SEQ ID NO: 434674 - RNA, 18 nt, Human
ccagugaaaauggcacac

SEQ ID NO: 434675 - RNA, 19 nt, Human
cccgaaccuccuccuccca

SEQ ID NO: 434676 - RNA, 21 nt, Human
cccgaaccuccuccucccacc

SEQ ID NO: 434677 - RNA, 23 nt, Human
cgaaccuccuccucccaccacac

SEQ ID NO: 434678 - RNA, 20 nt, Human
cucccaccacacggagaacc

SEQ ID NO: 434679 - RNA, 30 nt, Human
cugaaaccaagugacaaauauccacaaaaa

SEQ ID NO: 434680 - RNA, 20 nt, Human
cuuucugaaaccaagugaca

SEQ ID NO: 434681 - RNA, 20 nt, Human
gacauggcacuuacccagca

SEQ ID NO: 434682 - RNA, 25 nt, Human
gcacccgaaccuccuccucccacca

SEQ ID NO: 434683 - RNA, 20 nt, Human
gucaaaugccucuguccaca

SEQ ID NO: 434684 - RNA, 27 nt, Human
gugaacuuucugaaaccaagugacaaa

SEQ ID NO: 434685 - RNA, 18 nt, Human
uaaaaaaauuuaaacaga

SEQ ID NO: 434686 - RNA, 25 nt, Human
uagcaauaagaagcacacuuaaauc

SEQ ID NO: 434687 - RNA, 20 nt, Human
uaugacauguuaaauucuua

SEQ ID NO: 434688 - RNA, 23 nt, Human
uauuuucuccuggucucuaccau

SEQ ID NO: 434689 - RNA, 25 nt, Human
ucaaaugccucuguccacacugaca

SEQ ID NO: 434690 - RNA, 21 nt, Human
ucacauuuucuaccuacucag

SEQ ID NO: 434691 - RNA, 18 nt, Human
ucuccuggucucuaccau

SEQ ID NO: 434692 - RNA, 20 nt, Human
ugcugcuauaaaaauaaaug

SEQ ID NO: 434693 - RNA, 20 nt, Human
uuaguauuuuuagcaauaag

SEQ ID NO: 434694 - RNA, 22 nt, Human
aacucugaaaaaugacagaaaa

SEQ ID NO: 434695 - RNA, 22 nt, Human
aauaaaugcauuuuuaaacuua

SEQ ID NO: 434696 - RNA, 18 nt, Human
acaacagacaaaacaugg

SEQ ID NO: 434697 - RNA, 23 nt, Human
agacaaaacauggacucacaauc

SEQ ID NO: 434698 - RNA, 21 nt, Human
agucacaggauuaaagaaaga

SEQ ID NO: 434699 - RNA, 21 nt, Human
auggcugcauaguauuccaug

SEQ ID NO: 434700 - RNA, 26 nt, Human
caaaacauggacucacaaucuaaacc

SEQ ID NO: 434701 - RNA, 19 nt, Human
cagagaaagaaaauuaagc

SEQ ID NO: 434702 - RNA, 18 nt, Human
caucaacccaucaucuac

SEQ ID NO: 434703 - RNA, 22 nt, Human
caucaacccaucaucuacauca

SEQ ID NO: 434704 - RNA, 20 nt, Human
cccaucaucuacaucaggua

SEQ ID NO: 434705 - RNA, 23 nt, Human
cccccauccccccaacaggcccc

SEQ ID NO: 434706 - RNA, 25 nt, Human
cccccauccccccaacaggccccag

SEQ ID NO: 434707 - RNA, 23 nt, Human
ccccuagcccccauccccccaac

SEQ ID NO: 434708 - RNA, 27 nt, Human
ccuacgaucgcccucacugacauugcc

SEQ ID NO: 434709 - RNA, 21 nt, Human
ccuagcccccauccccccaac

SEQ ID NO: 434710 - RNA, 22 nt, Human
ccuccccuagcccccauccccc

SEQ ID NO: 434711 - RNA, 23 nt, Human
cuccuaaugcuaucccuccccua

SEQ ID NO: 434712 - RNA, 20 nt, Human
gaauaugaacucauccuuuu

SEQ ID NO: 434713 - RNA, 18 nt, Human
gauuugguugcuggcaca

SEQ ID NO: 434714 - RNA, 20 nt, Human
gcauucuccaugacauccuc

SEQ ID NO: 434715 - RNA, 25 nt, Human
ggguauuuugguugguuccaagucu

SEQ ID NO: 434716 - RNA, 26 nt, Human
gucacuacuacaucaugcuuuuaauu

SEQ ID NO: 434717 - RNA, 18 nt, Human
gugugcaugugucuuuau

SEQ ID NO: 434718 - RNA, 20 nt, Human
gugugcaugugucuuuauag

SEQ ID NO: 434719 - RNA, 25 nt, Human
uaagaacaaguauuuaaaaagggaa

SEQ ID NO: 434720 - RNA, 23 nt, Human
uaaggcauauuaaggcuauaaaa

SEQ ID NO: 434721 - RNA, 26 nt, Human
uagcccccauccccccaacaggcccc

SEQ ID NO: 434722 - RNA, 22 nt, Human
uaggcacaacagacaaaacaug

SEQ ID NO: 434723 - RNA, 21 nt, Human
uauuccaugguguauaugugu

SEQ ID NO: 434724 - RNA, 18 nt, Human
ucccuccccuagccccca

SEQ ID NO: 434725 - RNA, 18 nt, Human
uccuguguuaguuugcug

SEQ ID NO: 434726 - RNA, 27 nt, Human
ugaaaaaugacagaaaaggaaaaccag

SEQ ID NO: 434727 - RNA, 20 nt, Human
ugaaguucagagaaagaaaa

SEQ ID NO: 434728 - RNA, 21 nt, Human
ugacagaaaaggaaaaccagu

SEQ ID NO: 434729 - RNA, 22 nt, Human
ugacagaaaaggaaaaccaguc

SEQ ID NO: 434730 - RNA, 24 nt, Human
ugaggaugaugguuuccagcuuca

SEQ ID NO: 434731 - RNA, 19 nt, Human
ugagugagaacaugcggug

SEQ ID NO: 434732 - RNA, 24 nt, Human
ugagugagaacaugcgguguuugg

SEQ ID NO: 434733 - RNA, 26 nt, Human
ugcugcaauaaacauacgugugcaug

SEQ ID NO: 434734 - RNA, 19 nt, Human
ugcuggguaaucaauugac

SEQ ID NO: 434735 - RNA, 22 nt, Human
uggcacaaaggcugcaugguau

SEQ ID NO: 434736 - RNA, 23 nt, Human
ugggucucugcauguucuggagg

SEQ ID NO: 434737 - RNA, 22 nt, Human
ugguguuccccucccugugucc

SEQ ID NO: 434738 - RNA, 21 nt, Human
uguaaacagugcugcaauaaa

SEQ ID NO: 434739 - RNA, 25 nt, Human
ugugaagaauaugaacucauccuuu

SEQ ID NO: 434740 - RNA, 24 nt, Human
uguuugguuuucuguuccuguguu

SEQ ID NO: 434741 - RNA, 24 nt, Human
uuaugagugagaacaugcgguguu

SEQ ID NO: 434742 - RNA, 19 nt, Human
uucagagaaagaaaauuaa

SEQ ID NO: 434743 - RNA, 25 nt, Human
uuccaugguguauaugugucacguu

SEQ ID NO: 434744 - RNA, 22 nt, Human
uucuauggcugcauaguauucc

SEQ ID NO: 434745 - RNA, 22 nt, Human
uugacuccccuuacccggaagu

SEQ ID NO: 434746 - RNA, 23 nt, Human
uugacuccccuuacccggaaguc

SEQ ID NO: 434747 - RNA, 24 nt, Human
uuuaaacuuaacacaguaggaaac

SEQ ID NO: 434748 - RNA, 23 nt, Human
uuuaauauuuugaaguucagaga

SEQ ID NO: 434749 - RNA, 19 nt, Human
uuuccagcuucauccaugu

SEQ ID NO: 434750 - RNA, 22 nt, Human
uuucucucaggaaagcuggagg

SEQ ID NO: 434751 - RNA, 24 nt, Human
aaaaggccacaacuaaguaucgua

SEQ ID NO: 434752 - RNA, 18 nt, Human
aacacaaggacugccacc

SEQ ID NO: 434753 - RNA, 20 nt, Human
aagaaccuucucuacucuuu

SEQ ID NO: 434754 - RNA, 21 nt, Human
aaggagauauacggccauuag

SEQ ID NO: 434755 - RNA, 27 nt, Human
aauauccaccuucuccugcccguggac

SEQ ID NO: 434756 - RNA, 21 nt, Human
acaacaagaagugccacugca

SEQ ID NO: 434757 - RNA, 19 nt, Human
acacacacacucuuaccug

SEQ ID NO: 434758 - RNA, 24 nt, Human
acagggaaacaugacaaccagaac

SEQ ID NO: 434759 - RNA, 20 nt, Human
acauuugauaaaaguaaggc

SEQ ID NO: 434760 - RNA, 18 nt, Human
acccuugcuuaauaaaau

SEQ ID NO: 434761 - RNA, 23 nt, Human
acccuuucugucuguuucugcca

SEQ ID NO: 434762 - RNA, 22 nt, Human
accucacuuugccuccuugcag

SEQ ID NO: 434763 - RNA, 21 nt, Human
accugaugaucuaaacaaaaa

SEQ ID NO: 434764 - RNA, 19 nt, Human
acuucuaacuccucagacu

SEQ ID NO: 434765 - RNA, 19 nt, Human
agaaaaacaguggggaugg

SEQ ID NO: 434766 - RNA, 21 nt, Human
agaacucaagguuaccuggcc

SEQ ID NO: 434767 - RNA, 19 nt, Human
agacugugggacuucuugg

SEQ ID NO: 434768 - RNA, 19 nt, Human
agagcccggcugcggcugu

SEQ ID NO: 434769 - RNA, 21 nt, Human
agcagaaaaacaguggggaug

SEQ ID NO: 434770 - RNA, 21 nt, Human
agccaaaaucugagcuguguu

SEQ ID NO: 434771 - RNA, 19 nt, Human
auaaaacgguaacuucuaa

SEQ ID NO: 434772 - RNA, 25 nt, Human
auauauccuauugguucuguuucuu

SEQ ID NO: 434773 - RNA, 19 nt, Human
auugguucuguuucucugg

SEQ ID NO: 434774 - RNA, 22 nt, Human
auuguagauaacccuaauagca

SEQ ID NO: 434775 - RNA, 20 nt, Human
caaaugucaccuuaucacca

SEQ ID NO: 434776 - RNA, 18 nt, Human
caccuuucugaccucagu

SEQ ID NO: 434777 - RNA, 18 nt, Human
cacugcauagccauagcu

SEQ ID NO: 434778 - RNA, 19 nt, Human
cagcucucugcuccaaccu

SEQ ID NO: 434779 - RNA, 25 nt, Human
ccaaaaucugagcuguguucacaga

SEQ ID NO: 434780 - RNA, 20 nt, Human
cccggccgcuggcugagagc

SEQ ID NO: 434781 - RNA, 20 nt, Human
ccugcccguggacgucagaa

SEQ ID NO: 434782 - RNA, 22 nt, Human
cgcccggccgcuggcugagagc

SEQ ID NO: 434783 - RNA, 23 nt, Human
cggcugcggcugucacuucccuu

SEQ ID NO: 434784 - RNA, 19 nt, Human
cucaaaaggccacaacuaa

SEQ ID NO: 434785 - RNA, 20 nt, Human
cucaaaaucuuccaaauucu

SEQ ID NO: 434786 - RNA, 20 nt, Human
cuucaugacuuuugcccuuc

SEQ ID NO: 434787 - RNA, 19 nt, Human
cuuggcuuccucccuaacu

SEQ ID NO: 434788 - RNA, 23 nt, Human
cuuucaguccuacccagugcgcc

SEQ ID NO: 434789 - RNA, 21 nt, Human
cuuuuuucucuccuuuuccuu

SEQ ID NO: 434790 - RNA, 18 nt, Human
gaagagauuagcauuuga

SEQ ID NO: 434791 - RNA, 20 nt, Human
gacaaauuacuccacccuuu

SEQ ID NO: 434792 - RNA, 20 nt, Human
gaccuagaacaguuuuggca

SEQ ID NO: 434793 - RNA, 18 nt, Human
gagaaaggggcagaaaug

SEQ ID NO: 434794 - RNA, 20 nt, Human
gagcccggcugcggcuguca

SEQ ID NO: 434795 - RNA, 20 nt, Human
gcacuccgccccggcagagu

SEQ ID NO: 434796 - RNA, 19 nt, Human
gccuuucaguccuacccag

SEQ ID NO: 434797 - RNA, 19 nt, Human
gcucaacucucaaaaggcc

SEQ ID NO: 434798 - RNA, 19 nt, Human
ggaaucccuuccacuggcu

SEQ ID NO: 434799 - RNA, 19 nt, Human
ggcauucccuuacccuacu

SEQ ID NO: 434800 - RNA, 18 nt, Human
gggagcagaaaaacagug

SEQ ID NO: 434801 - RNA, 18 nt, Human
gucaacuugacuggugaa

SEQ ID NO: 434802 - RNA, 22 nt, Human
gucaccuuaucaccaaugucuu

SEQ ID NO: 434803 - RNA, 22 nt, Human
gucagcuuucaccuuaguccuu

SEQ ID NO: 434804 - RNA, 22 nt, Human
gugaggagggaaaaaaaaccca

SEQ ID NO: 434805 - RNA, 18 nt, Human
gugcucaauaaauauuga

SEQ ID NO: 434806 - RNA, 20 nt, Human
guguauguuugugugugugu

SEQ ID NO: 434807 - RNA, 19 nt, Human
uaaaacacaaccagagucu

SEQ ID NO: 434808 - RNA, 24 nt, Human
uaaaacacaaccagagucugacca

SEQ ID NO: 434809 - RNA, 19 nt, Human
uaaaacuuuauuuuucuca

SEQ ID NO: 434810 - RNA, 21 nt, Human
uaacaaacacaaggacugcca

SEQ ID NO: 434811 - RNA, 23 nt, Human
uaacuccucagacuggcauuccc

SEQ ID NO: 434812 - RNA, 21 nt, Human
uaacugguguuucuucuucca

SEQ ID NO: 434813 - RNA, 21 nt, Human
uaaguuugugacagcaugauc

SEQ ID NO: 434814 - RNA, 23 nt, Human
uacaacaagaagugccacugcau

SEQ ID NO: 434815 - RNA, 24 nt, Human
uacauucaagcgagacuuccuaga

SEQ ID NO: 434816 - RNA, 22 nt, Human
uacuacaaggauaugcugacuc

SEQ ID NO: 434817 - RNA, 21 nt, Human
uacuccacccuuucugucugu

SEQ ID NO: 434818 - RNA, 22 nt, Human
uacuccacccuuucugucuguu

SEQ ID NO: 434819 - RNA, 19 nt, Human
uagaaauguuucaagucau

SEQ ID NO: 434820 - RNA, 20 nt, Human
uauuuucaugaauuaaaugg

SEQ ID NO: 434821 - RNA, 29 nt, Human
ucagcuuucaccuuaguccuugccuucca

SEQ ID NO: 434822 - RNA, 23 nt, Human
ucagucuuaccuuuccagcucuc

SEQ ID NO: 434823 - RNA, 21 nt, Human
uccgcugggcgcccggccgcu

SEQ ID NO: 434824 - RNA, 20 nt, Human
uccuaauucccauuuauauu

SEQ ID NO: 434825 - RNA, 21 nt, Human
uccuugaaaaagguggcacag

SEQ ID NO: 434826 - RNA, 19 nt, Human
ucugcaccuuucugaccuc

SEQ ID NO: 434827 - RNA, 25 nt, Human
ucuguuucucuggcgaacccuugcu

SEQ ID NO: 434828 - RNA, 20 nt, Human
ucuuuuuucucuccuuuucc

SEQ ID NO: 434829 - RNA, 22 nt, Human
ugacuauauuauccuaauuccc

SEQ ID NO: 434830 - RNA, 18 nt, Human
ugacuggugaagagaugg

SEQ ID NO: 434831 - RNA, 20 nt, Human
ugaggugagcauguuaaaac

SEQ ID NO: 434832 - RNA, 24 nt, Human
ugaggugagcauguuaaaacguug

SEQ ID NO: 434833 - RNA, 21 nt, Human
ugagguuugcugucaagucca

SEQ ID NO: 434834 - RNA, 19 nt, Human
ugaguguauguuugugugu

SEQ ID NO: 434835 - RNA, 24 nt, Human
ugaguguauguuugugugugugug

SEQ ID NO: 434836 - RNA, 18 nt, Human
ugauaaaaguaaggccuu

SEQ ID NO: 434837 - RNA, 20 nt, Human
ugauuagggccaaugcuggg

SEQ ID NO: 434838 - RNA, 19 nt, Human
ugccaaaggagauauacgg

SEQ ID NO: 434839 - RNA, 23 nt, Human
ugccauuguaauacugaauguaa

SEQ ID NO: 434840 - RNA, 21 nt, Human
ugcccguggacgucagaacuc

SEQ ID NO: 434841 - RNA, 19 nt, Human
ugcucaaaaucuuccaaau

SEQ ID NO: 434842 - RNA, 19 nt, Human
ugcuccaaccucacuuugc

SEQ ID NO: 434843 - RNA, 19 nt, Human
uggcaggcccaucaaauaa

SEQ ID NO: 434844 - RNA, 23 nt, Human
uggcuugugaguacgagguuauu

SEQ ID NO: 434845 - RNA, 22 nt, Human
ugguguuucuucuuccacucuu

SEQ ID NO: 434846 - RNA, 23 nt, Human
uguauguuuguguguguguguaa

SEQ ID NO: 434847 - RNA, 18 nt, Human
ugucugggugugucugug

SEQ ID NO: 434848 - RNA, 24 nt, Human
ugucugggugugucugugaggcug

SEQ ID NO: 434849 - RNA, 25 nt, Human
ugugaccaaaugucaccuuaucacc

SEQ ID NO: 434850 - RNA, 22 nt, Human
ugugugaguguauguuugugug

SEQ ID NO: 434851 - RNA, 19 nt, Human
ugugugugugaguguaugu

SEQ ID NO: 434852 - RNA, 19 nt, Human
ugugugugugaguguaugu

SEQ ID NO: 434853 - RNA, 20 nt, Human
uguuaaacaucugaaguguu

SEQ ID NO: 434854 - RNA, 19 nt, Human
uguuccuaagcacugaugg

SEQ ID NO: 434855 - RNA, 26 nt, Human
uuaaagcucaacucucaaaaggccac

SEQ ID NO: 434856 - RNA, 21 nt, Human
uuaacucuaccuuuaaaacac

SEQ ID NO: 434857 - RNA, 23 nt, Human
uuaccugaugaucuaaacaaaaa

SEQ ID NO: 434858 - RNA, 19 nt, Human
uucauugucugccuguaaa

SEQ ID NO: 434859 - RNA, 21 nt, Human
uucauugucugccuguaaacc

SEQ ID NO: 434860 - RNA, 19 nt, Human
uuccuggagcugaaauauc

SEQ ID NO: 434861 - RNA, 23 nt, Human
uugaaugaauauauuccugaaua

SEQ ID NO: 434862 - RNA, 20 nt, Human
uugcaaaugcaagacugugg

SEQ ID NO: 434863 - RNA, 24 nt, Human
uuggaaauuuuucaauacuaaaaa

SEQ ID NO: 434864 - RNA, 23 nt, Human
uuggauuaucgcaaacaaacuuc

SEQ ID NO: 434865 - RNA, 20 nt, Human
uuggcagcggacagucaguu

SEQ ID NO: 434866 - RNA, 20 nt, Human
uuucuuugcauuuccuucau

SEQ ID NO: 434867 - RNA, 23 nt, Human
acgccagcugcucaaacacgucg

SEQ ID NO: 434868 - RNA, 24 nt, Human
agcugguguacuuggugacagccu

SEQ ID NO: 434869 - RNA, 19 nt, Human
agggugguccggcccgagu

SEQ ID NO: 434870 - RNA, 20 nt, Human
gacacagcgugcuuggccag

SEQ ID NO: 434871 - RNA, 21 nt, Human
gccagccgggcagccucacac

SEQ ID NO: 434872 - RNA, 23 nt, Human
ggagcugguguacuuggugacag

SEQ ID NO: 434873 - RNA, 20 nt, Human
uggccagcuccccaggcagc

SEQ ID NO: 434874 - RNA, 20 nt, Human
ugaacugagaccccaaaugg

SEQ ID NO: 434875 - RNA, 21 nt, Human
aaacaaccuaaaagccaucca

SEQ ID NO: 434876 - RNA, 24 nt, Human
aaacuagauguacuuggcuuaaaa

SEQ ID NO: 434877 - RNA, 27 nt, Human
aagaacucugucacuugucaccaugcc

SEQ ID NO: 434878 - RNA, 19 nt, Human
aagcaaccagaugcugaaa

SEQ ID NO: 434879 - RNA, 24 nt, Human
accagaugcugaaacuggacagag

SEQ ID NO: 434880 - RNA, 18 nt, Human
acccugugccagguacug

SEQ ID NO: 434881 - RNA, 19 nt, Human
agaccugaaacagggggug

SEQ ID NO: 434882 - RNA, 19 nt, Human
agauguacuuggcuuaaaa

SEQ ID NO: 434883 - RNA, 22 nt, Human
agcaaccagaugcugaaacugg

SEQ ID NO: 434884 - RNA, 25 nt, Human
agccuggagcucccaggaagagcug

SEQ ID NO: 434885 - RNA, 20 nt, Human
aguaacuccaugcacuucuc

SEQ ID NO: 434886 - RNA, 18 nt, Human
augaagaggacagaaccc

SEQ ID NO: 434887 - RNA, 20 nt, Human
augcacuucucaaaacaauc

SEQ ID NO: 434888 - RNA, 18 nt, Human
auggauuccucugugacc

SEQ ID NO: 434889 - RNA, 23 nt, Human
caaaaauagccuggagcucccag

SEQ ID NO: 434890 - RNA, 24 nt, Human
caaccuaaaagccauccaucucuu

SEQ ID NO: 434891 - RNA, 27 nt, Human
cacauggauuccucugugaccaagucu

SEQ ID NO: 434892 - RNA, 19 nt, Human
cagccggaaccccuggcca

SEQ ID NO: 434893 - RNA, 18 nt, Human
cauggugggugcccccug

SEQ ID NO: 434894 - RNA, 21 nt, Human
ccagguacuguucuaaaugcu

SEQ ID NO: 434895 - RNA, 20 nt, Human
cccagcccccgcucucgacc

SEQ ID NO: 434896 - RNA, 22 nt, Human
ccccuggccagugcagcucccg

SEQ ID NO: 434897 - RNA, 21 nt, Human
ccggcccagcccccgcucucg

SEQ ID NO: 434898 - RNA, 19 nt, Human
ccuaaaagccauccaucuc

SEQ ID NO: 434899 - RNA, 21 nt, Human
ccucagggcucggccaccaga

SEQ ID NO: 434900 - RNA, 20 nt, Human
ccuggccagugcagcucccg

SEQ ID NO: 434901 - RNA, 26 nt, Human
cgcccccagucugguuccugcagcuc

SEQ ID NO: 434902 - RNA, 22 nt, Human
cgccgcuaccggcccagccccc

SEQ ID NO: 434903 - RNA, 22 nt, Human
cggacgcugugaguagaaacag

SEQ ID NO: 434904 - RNA, 23 nt, Human
cuaaaagccauccaucucuuuca

SEQ ID NO: 434905 - RNA, 24 nt, Human
cuuucagcuguguggcucucugau

SEQ ID NO: 434906 - RNA, 22 nt, Human
gaaccccuggccagugcagcuc

SEQ ID NO: 434907 - RNA, 21 nt, Human
gacgcagcuuccagaggaggg

SEQ ID NO: 434908 - RNA, 18 nt, Human
gagaugggagaccugaaa

SEQ ID NO: 434909 - RNA, 21 nt, Human
gaguagaaacaggaucuccug

SEQ ID NO: 434910 - RNA, 20 nt, Human
gcauaaguagggagcacccu

SEQ ID NO: 434911 - RNA, 22 nt, Human
gccauccaucucuuucagcugu

SEQ ID NO: 434912 - RNA, 20 nt, Human
gucacugagggagaugggag

SEQ ID NO: 434913 - RNA, 21 nt, Human
gugcauggugggugcccccug

SEQ ID NO: 434914 - RNA, 19 nt, Human
uaacaaugcaauggagaaa

SEQ ID NO: 434915 - RNA, 23 nt, Human
uaacaaugcaauggagaaaacca

SEQ ID NO: 434916 - RNA, 20 nt, Human
uacagccggaaccccuggcc

SEQ ID NO: 434917 - RNA, 21 nt, Human
uacaggugcucagcucgcccc

SEQ ID NO: 434918 - RNA, 18 nt, Human
uaccggcccagcccccgc

SEQ ID NO: 434919 - RNA, 21 nt, Human
uagaaacaggaucuccugcca

SEQ ID NO: 434920 - RNA, 22 nt, Human
uaugaaggauucaucugugcca

SEQ ID NO: 434921 - RNA, 20 nt, Human
ucacauggauuccucuguga

SEQ ID NO: 434922 - RNA, 24 nt, Human
uccagauaaauaugaaggauucau

SEQ ID NO: 434923 - RNA, 23 nt, Human
uccugcagcuccccggcugccag

SEQ ID NO: 434924 - RNA, 20 nt, Human
ugaaacagggggugagggga

SEQ ID NO: 434925 - RNA, 19 nt, Human
ugaagaguuguacaguugg

SEQ ID NO: 434926 - RNA, 23 nt, Human
ugagggagaugggagaccugaaa

SEQ ID NO: 434927 - RNA, 21 nt, Human
ugaggucagauccaggucacu

SEQ ID NO: 434928 - RNA, 22 nt, Human
ugcaauggagaaaaccaguaac

SEQ ID NO: 434929 - RNA, 21 nt, Human
uggacagagggcaagaacucu

SEQ ID NO: 434930 - RNA, 19 nt, Human
uggagcucccaggaagagc

SEQ ID NO: 434931 - RNA, 23 nt, Human
uggagcucccaggaagaggggag

SEQ ID NO: 434932 - RNA, 21 nt, Human
uggauuccucugugaccaagu

SEQ ID NO: 434933 - RNA, 25 nt, Human
uuccagaggagggcugcuggagcgu

SEQ ID NO: 434934 - RNA, 22 nt, Human
uuccugcagcuccccggcugcc

SEQ ID NO: 434935 - RNA, 27 nt, Human
uuccugcagcuccccggcugccagcgg

SEQ ID NO: 434936 - RNA, 22 nt, Human
uuccuugaagaguuguacaguu

SEQ ID NO: 434937 - RNA, 18 nt, Human
uuuuuuuuuuuuuuuucg

SEQ ID NO: 434938 - RNA, 20 nt, Human
uuuuuuuuuuuuuuuucgcu

SEQ ID NO: 434939 - RNA, 20 nt, Human
aaaaugcacccaaagaacua

SEQ ID NO: 434940 - RNA, 18 nt, Human
agacaaaaugcacccaaa

SEQ ID NO: 434941 - RNA, 21 nt, Human
agacaaaaugcacccaaagaa

SEQ ID NO: 434942 - RNA, 20 nt, Human
aguaaaagagcacauauaga

SEQ ID NO: 434943 - RNA, 24 nt, Human
aguuaaaauuugugcacuaagcug

SEQ ID NO: 434944 - RNA, 22 nt, Human
cacaauugugguucagacaaaa

SEQ ID NO: 434945 - RNA, 20 nt, Human
caucugcuggcuuauuugcu

SEQ ID NO: 434946 - RNA, 19 nt, Human
cauguuaucaucaacuaua

SEQ ID NO: 434947 - RNA, 18 nt, Human
ccugcggcgggaggagag

SEQ ID NO: 434948 - RNA, 19 nt, Human
cggacgcggcgccgcugcc

SEQ ID NO: 434949 - RNA, 19 nt, Human
cggcgggaggagagccggc

SEQ ID NO: 434950 - RNA, 21 nt, Human
cgggcgagagcggacgcggcg

SEQ ID NO: 434951 - RNA, 21 nt, Human
cuggaccucuucacccaucug

SEQ ID NO: 434952 - RNA, 18 nt, Human
cuucacccaucugcuggc

SEQ ID NO: 434953 - RNA, 24 nt, Human
gcggcgcgcggguccugcggcggg

SEQ ID NO: 434954 - RNA, 25 nt, Human
uaaaguaccauuaaaucaccuaaaa

SEQ ID NO: 434955 - RNA, 21 nt, Human
uaaaucaccuaaaacaaauaa

SEQ ID NO: 434956 - RNA, 24 nt, Human
uaaaucaccuaaaacaaauaaucu

SEQ ID NO: 434957 - RNA, 22 nt, Human
uaguaaaaauaaaaucuacgua

SEQ ID NO: 434958 - RNA, 26 nt, Human
uauauacaacaguuaaaauuugugca

SEQ ID NO: 434959 - RNA, 19 nt, Human
uaucagaguaaaagagcac

SEQ ID NO: 434960 - RNA, 22 nt, Human
ucagacaaaaugcacccaaaga

SEQ ID NO: 434961 - RNA, 23 nt, Human
uggcuuauuugcuuuauauacaa

SEQ ID NO: 434962 - RNA, 22 nt, Human
uguuuuguuucucuaaaaagua

SEQ ID NO: 434963 - RNA, 20 nt, Human
uucauguacauacuacuuug

SEQ ID NO: 434964 - RNA, 21 nt, Human
uuuuuuuuuuuuuuaaaaugg

SEQ ID NO: 434965 - RNA, 22 nt, Human
aucugggaagaccugacuauuc

SEQ ID NO: 434966 - RNA, 21 nt, Human
ccagggccuucagauaaucug

SEQ ID NO: 434967 - RNA, 19 nt, Human
ccuccuccuccuccucccc

SEQ ID NO: 434968 - RNA, 18 nt, Human
gggaauaaaccaaaaaaa

SEQ ID NO: 434969 - RNA, 18 nt, Human
gugaggcaagcacagccc

SEQ ID NO: 434970 - RNA, 21 nt, Human
gugaggcaagcacagcccugc

SEQ ID NO: 434971 - RNA, 21 nt, Human
ugacauacauaaaaaugguca

SEQ ID NO: 434972 - RNA, 19 nt, Human
ugaggcaagcacagcccug

SEQ ID NO: 434973 - RNA, 25 nt, Human
uguacaaaugauggcagaaagaucc

SEQ ID NO: 434974 - RNA, 20 nt, Human
uuccugugaggcaagcacag

SEQ ID NO: 434975 - RNA, 27 nt, Human
uugcuuuguuuuuaauacuggggaaua

SEQ ID NO: 434976 - RNA, 21 nt, Human
uuuacuggaguggaaucccca

SEQ ID NO: 434977 - RNA, 21 nt, Human
uuuguauccuucauucuacuu

SEQ ID NO: 434978 - RNA, 18 nt, Human
uuuuuuuuuuuuuuuuug

SEQ ID NO: 434979 - RNA, 26 nt, Human
aauggcggggguggccacccuagugu

SEQ ID NO: 434980 - RNA, 18 nt, Human
accccaucuccaccucca

SEQ ID NO: 434981 - RNA, 26 nt, Human
accccaucuccaccuccagccuccag

SEQ ID NO: 434982 - RNA, 21 nt, Human
agccgcaauacuccauuugac

SEQ ID NO: 434983 - RNA, 21 nt, Human
aggcaggcugggggaggggcu

SEQ ID NO: 434984 - RNA, 22 nt, Human
aggcccgcccgggaggccgcgc

SEQ ID NO: 434985 - RNA, 20 nt, Human
aggcgagcgaugagggcggc

SEQ ID NO: 434986 - RNA, 27 nt, Human
aucuccaccuccagccuccagccucac

SEQ ID NO: 434987 - RNA, 25 nt, Human
caccccuuucuaggcaggcuggggg

SEQ ID NO: 434988 - RNA, 18 nt, Human
caccgggccaggaggccg

SEQ ID NO: 434989 - RNA, 19 nt, Human
cagccgcuguccggccucg

SEQ ID NO: 434990 - RNA, 19 nt, Human
cagccucacuggcaguucc

SEQ ID NO: 434991 - RNA, 26 nt, Human
cagccucacuggcaguucccugugac

SEQ ID NO: 434992 - RNA, 23 nt, Human
ccauggcaucugagagcacccac

SEQ ID NO: 434993 - RNA, 18 nt, Human
ccccaucuccaccuccag

SEQ ID NO: 434994 - RNA, 21 nt, Human
ccccgggucccgggacauggc

SEQ ID NO: 434995 - RNA, 19 nt, Human
cccgaccccgggucccggg

SEQ ID NO: 434996 - RNA, 21 nt, Human
cccgcaacuauucuaggggcc

SEQ ID NO: 434997 - RNA, 18 nt, Human
cccucugccagauguucc

SEQ ID NO: 434998 - RNA, 22 nt, Human
ccuccagcgcggccaggcgggc

SEQ ID NO: 434999 - RNA, 19 nt, Human
ccucccagccgcccgaccc

SEQ ID NO: 435000 - RNA, 22 nt, Human
ccucccagccgcccgaccccgg

SEQ ID NO: 435001 - RNA, 22 nt, Human
ccuccucccagccgcccgaccc

SEQ ID NO: 435002 - RNA, 20 nt, Human
ccucggcggcgccgcccucc

SEQ ID NO: 435003 - RNA, 20 nt, Human
ccugccuucgcagcugcucc

SEQ ID NO: 435004 - RNA, 21 nt, Human
cgcggccaggcgggcgcggag

SEQ ID NO: 435005 - RNA, 18 nt, Human
cgggaggccgcgcggccg

SEQ ID NO: 435006 - RNA, 23 nt, Human
cgggaggccgcgcggccgccggc

SEQ ID NO: 435007 - RNA, 24 nt, Human
cucacuggcaguucccugugaccc

SEQ ID NO: 435008 - RNA, 25 nt, Human
cucacuggcaguucccugugaccca

SEQ ID NO: 435009 - RNA, 23 nt, Human
cucccggaagcgcgcaaccugcu

SEQ ID NO: 435010 - RNA, 24 nt, Human
cucccucucuuuuucuucuagucg

SEQ ID NO: 435011 - RNA, 24 nt, Human
cucccucugccagauguuccugac

SEQ ID NO: 435012 - RNA, 23 nt, Human
cugaccccaucuccaccuccagc

SEQ ID NO: 435013 - RNA, 20 nt, Human
cugcgcgcggggccuccucc

SEQ ID NO: 435014 - RNA, 21 nt, Human
cuggcaguucccugugaccca

SEQ ID NO: 435015 - RNA, 20 nt, Human
gaggccgcgcggccgccggc

SEQ ID NO: 435016 - RNA, 25 nt, Human
gcccuccugccuucgcagcugcucc

SEQ ID NO: 435017 - RNA, 21 nt, Human
gccucggcggcgccgcccucc

SEQ ID NO: 435018 - RNA, 23 nt, Human
gccuuggcucucaguagagcuca

SEQ ID NO: 435019 - RNA, 21 nt, Human
gcgcggcagcugcgcgcgggg

SEQ ID NO: 435020 - RNA, 22 nt, Human
gcggccgccggcaacuuccccu

SEQ ID NO: 435021 - RNA, 18 nt, Human
gcgggcgcggaggcgagc

SEQ ID NO: 435022 - RNA, 20 nt, Human
gcgucgcgggcagcgagcug

SEQ ID NO: 435023 - RNA, 22 nt, Human
ggagacacagacugggaccucc

SEQ ID NO: 435024 - RNA, 18 nt, Human
ucacagcagcaagaacgu

SEQ ID NO: 435025 - RNA, 22 nt, Human
ucagucagccucucaauuuccu

SEQ ID NO: 435026 - RNA, 21 nt, Human
uccauagccaaagggaccaaa

SEQ ID NO: 435027 - RNA, 23 nt, Human
uccauagccaaagggaccggggc

SEQ ID NO: 435028 - RNA, 23 nt, Human
ucccagccgcccgaccccggguc

SEQ ID NO: 435029 - RNA, 19 nt, Human
ucccucaggcagccacccc

SEQ ID NO: 435030 - RNA, 19 nt, Human
ucggcggcgccgcccuccu

SEQ ID NO: 435031 - RNA, 20 nt, Human
ugaaaugcaguuucucagug

SEQ ID NO: 435032 - RNA, 24 nt, Human
ugacccagccuguuccauagccaa

SEQ ID NO: 435033 - RNA, 20 nt, Human
ugacucccucaggcagccac

SEQ ID NO: 435034 - RNA, 20 nt, Human
ugagagcacccacccugucc

SEQ ID NO: 435035 - RNA, 19 nt, Human
ugcagagcgcggcagcugc

SEQ ID NO: 435036 - RNA, 21 nt, Human
ugcagagcgcggcagcugcgc

SEQ ID NO: 435037 - RNA, 22 nt, Human
uggaugacaaaugcuacugaaa

SEQ ID NO: 435038 - RNA, 22 nt, Human
uggcaguucccugugacccagc

SEQ ID NO: 435039 - RNA, 24 nt, Human
uuccauagaacaggauggggcucc

SEQ ID NO: 435040 - RNA, 21 nt, Human
uugcagucacagcagcaagaa

SEQ ID NO: 435041 - RNA, 20 nt, Human
uuucucagugcagacaugug

SEQ ID NO: 435042 - RNA, 18 nt, Human
uuuuuuuuuuuuuuuuug

SEQ ID NO: 435043 - RNA, 21 nt, Human
uuuuuuuuuuuuuuuuugcag

SEQ ID NO: 435044 - RNA, 22 nt, Human
uuuuuuuuuuuuuuuuugcagu

SEQ ID NO: 435045 - RNA, 21 nt, Human
aaaaggaauucuucuaaacau

SEQ ID NO: 435046 - RNA, 21 nt, Human
aaacagugauuaaaaaaaaug

SEQ ID NO: 435047 - RNA, 23 nt, Human
aacagugacuguucauuccaccc

SEQ ID NO: 435048 - RNA, 20 nt, Human
aagaaaccuuaaaaaccaac

SEQ ID NO: 435049 - RNA, 22 nt, Human
aagaaaccuuaaaaaccaacaa

SEQ ID NO: 435050 - RNA, 22 nt, Human
aagaacauuucauaacuaaccc

SEQ ID NO: 435051 - RNA, 18 nt, Human
aagaagaaagcugaaaag

SEQ ID NO: 435052 - RNA, 20 nt, Human
aagaagaaagcugaaaaggc

SEQ ID NO: 435053 - RNA, 19 nt, Human
aagaggcuuuguagaugcc

SEQ ID NO: 435054 - RNA, 19 nt, Human
aagcaaggaugaggacacc

SEQ ID NO: 435055 - RNA, 19 nt, Human
aagcagaaagaguuaaggg

SEQ ID NO: 435056 - RNA, 21 nt, Human
aagcauaucugccaccaccuc

SEQ ID NO: 435057 - RNA, 19 nt, Human
aagcaugcugagcccaguu

SEQ ID NO: 435058 - RNA, 25 nt, Human
aagcugaaaaggccaaauuaaauac

SEQ ID NO: 435059 - RNA, 19 nt, Human
aagguuuccuuucauuccu

SEQ ID NO: 435060 - RNA, 23 nt, Human
aaguucagaacacggccaagagg

SEQ ID NO: 435061 - RNA, 25 nt, Human
aaucaaagaacucagagagcuucaa

SEQ ID NO: 435062 - RNA, 26 nt, Human
acaacccaucccuccagcuggagccu

SEQ ID NO: 435063 - RNA, 20 nt, Human
acaaggaaagcaggguuuca

SEQ ID NO: 435064 - RNA, 23 nt, Human
acacacacacacacacacacaca

SEQ ID NO: 435065 - RNA, 23 nt, Human
acacacacacacacacacacaca

SEQ ID NO: 435066 - RNA, 23 nt, Human
acacacacacacacacacacaca

SEQ ID NO: 435067 - RNA, 23 nt, Human
acacacacacacacacacacaca

SEQ ID NO: 435068 - RNA, 23 nt, Human
acacacacacacacacacacaca

SEQ ID NO: 435069 - RNA, 23 nt, Human
acacacacacacacacacacaca

SEQ ID NO: 435070 - RNA, 23 nt, Human
acacacacacacacacacacaca

SEQ ID NO: 435071 - RNA, 23 nt, Human
acacacacacacacacacacaca

SEQ ID NO: 435072 - RNA, 18 nt, Human
acacacucggugacaaug

SEQ ID NO: 435073 - RNA, 20 nt, Human
acacagcaggacaaacauuc

SEQ ID NO: 435074 - RNA, 23 nt, Human
acaccuuuccaugaaggaaguga

SEQ ID NO: 435075 - RNA, 21 nt, Human
acagggaacacgacacagcuu

SEQ ID NO: 435076 - RNA, 18 nt, Human
acauaaaaccccaaaaga

SEQ ID NO: 435077 - RNA, 21 nt, Human
acauaaaaccccaaaagaaca

SEQ ID NO: 435078 - RNA, 20 nt, Human
acccagguggccaccauugu

SEQ ID NO: 435079 - RNA, 20 nt, Human
accccauggacagaccccuc

SEQ ID NO: 435080 - RNA, 18 nt, Human
acuaugugauagccugga

SEQ ID NO: 435081 - RNA, 23 nt, Human
acugaguuuaaaagauacaagga

SEQ ID NO: 435082 - RNA, 18 nt, Human
acugcaaacugcagugug

SEQ ID NO: 435083 - RNA, 21 nt, Human
acuggaaaugcaccauccucu

SEQ ID NO: 435084 - RNA, 19 nt, Human
acuggauugggauggagag

SEQ ID NO: 435085 - RNA, 23 nt, Human
agaaaaagaagaaaacaacgcag

SEQ ID NO: 435086 - RNA, 19 nt, Human
agagccauuugcuaaacau

SEQ ID NO: 435087 - RNA, 24 nt, Human
agcugaaaaggccaaauuaaauac

SEQ ID NO: 435088 - RNA, 21 nt, Human
agcugcccuguucccugaugg

SEQ ID NO: 435089 - RNA, 23 nt, Human
aggaagaaccacacgccuuccaa

SEQ ID NO: 435090 - RNA, 19 nt, Human
aggaugagaacugaaaaag

SEQ ID NO: 435091 - RNA, 21 nt, Human
aggcugccauugcaggagggc

SEQ ID NO: 435092 - RNA, 22 nt, Human
agggagcacaaaagagcaagcu

SEQ ID NO: 435093 - RNA, 27 nt, Human
agggagcacaaaagagcaagcuuuggg

SEQ ID NO: 435094 - RNA, 22 nt, Human
agguuuuggagaacaggaaguu

SEQ ID NO: 435095 - RNA, 26 nt, Human
auaacaauccauaugcaaagcauauc

SEQ ID NO: 435096 - RNA, 21 nt, Human
aucagcgccaacaccuuucca

SEQ ID NO: 435097 - RNA, 19 nt, Human
augauauggccccuacgca

SEQ ID NO: 435098 - RNA, 24 nt, Human
augggacuuguuuuuguuuuuugc

SEQ ID NO: 435099 - RNA, 26 nt, Human
auguagcccuuuacaucggcaccagg

SEQ ID NO: 435100 - RNA, 18 nt, Human
auugacagguaaggaagc

SEQ ID NO: 435101 - RNA, 25 nt, Human
caacccaucccuccagcuggagccu

SEQ ID NO: 435102 - RNA, 18 nt, Human
caaggaaagcaggguuuc

SEQ ID NO: 435103 - RNA, 23 nt, Human
cacaacccaucccuccagcugga

SEQ ID NO: 435104 - RNA, 20 nt, Human
cacacacacacacacacaca

SEQ ID NO: 435105 - RNA, 20 nt, Human
cacacacacacacacacaca

SEQ ID NO: 435106 - RNA, 20 nt, Human
cacacacacacacacacaca

SEQ ID NO: 435107 - RNA, 20 nt, Human
cacacacacacacacacaca

SEQ ID NO: 435108 - RNA, 20 nt, Human
cacacacacacacacacaca

SEQ ID NO: 435109 - RNA, 20 nt, Human
cacacacacacacacacaca

SEQ ID NO: 435110 - RNA, 20 nt, Human
cacacacacacacacacaca

SEQ ID NO: 435111 - RNA, 20 nt, Human
cacacacacacacacacaca

SEQ ID NO: 435112 - RNA, 20 nt, Human
cacacacacacacacacaca

SEQ ID NO: 435113 - RNA, 20 nt, Human
cacacacacacacacacaca

SEQ ID NO: 435114 - RNA, 20 nt, Human
cacacacacacacacacaca

SEQ ID NO: 435115 - RNA, 20 nt, Human
cacacacacacacacacaca

SEQ ID NO: 435116 - RNA, 20 nt, Human
cacacacacacacacacaca

SEQ ID NO: 435117 - RNA, 20 nt, Human
cacacacacacacacacaca

SEQ ID NO: 435118 - RNA, 22 nt, Human
cacacacacacacacacacaca

SEQ ID NO: 435119 - RNA, 22 nt, Human
cacacacacacacacacacaca

SEQ ID NO: 435120 - RNA, 22 nt, Human
cacacacacacacacacacaca

SEQ ID NO: 435121 - RNA, 22 nt, Human
cacacacacacacacacacaca

SEQ ID NO: 435122 - RNA, 22 nt, Human
cacacacacacacacacacaca

SEQ ID NO: 435123 - RNA, 22 nt, Human
cacacacacacacacacacaca

SEQ ID NO: 435124 - RNA, 22 nt, Human
cacacacacacacacacacaca

SEQ ID NO: 435125 - RNA, 22 nt, Human
cacacacacacacacacacaca

SEQ ID NO: 435126 - RNA, 22 nt, Human
cacacacacacacacacacaca

SEQ ID NO: 435127 - RNA, 22 nt, Human
cacacacacacacacacacaca

SEQ ID NO: 435128 - RNA, 22 nt, Human
cacacacacacacacacacaca

SEQ ID NO: 435129 - RNA, 22 nt, Human
cacacacacacacacacacaca

SEQ ID NO: 435130 - RNA, 20 nt, Human
cacacacccaugaauucgac

SEQ ID NO: 435131 - RNA, 20 nt, Human
caccaaaggcuaaacugcaa

SEQ ID NO: 435132 - RNA, 22 nt, Human
caccauccucuccauccccaca

SEQ ID NO: 435133 - RNA, 20 nt, Human
caccuccuccucuacacaca

SEQ ID NO: 435134 - RNA, 22 nt, Human
caccuccuccucuacacacaag

SEQ ID NO: 435135 - RNA, 20 nt, Human
cacgacacagcuuuucaaaa

SEQ ID NO: 435136 - RNA, 21 nt, Human
cacugcaaaucucaaguccca

SEQ ID NO: 435137 - RNA, 20 nt, Human
cagauagaaaacuaccccca

SEQ ID NO: 435138 - RNA, 21 nt, Human
cagauagaaaacuacccccau

SEQ ID NO: 435139 - RNA, 23 nt, Human
cagcgccaacaccuuuccaugaa

SEQ ID NO: 435140 - RNA, 27 nt, Human
caggaaccacacacaugauuggacaac

SEQ ID NO: 435141 - RNA, 23 nt, Human
caggaaccagguugccccacaag

SEQ ID NO: 435142 - RNA, 21 nt, Human
caggguuucauuagugggagc

SEQ ID NO: 435143 - RNA, 22 nt, Human
cauaacuaaccccaaaccaaaa

SEQ ID NO: 435144 - RNA, 20 nt, Human
cauaugcacgcacguguugg

SEQ ID NO: 435145 - RNA, 21 nt, Human
caucugcacaugucuggguga

SEQ ID NO: 435146 - RNA, 20 nt, Human
ccaaaggcuaaacugcaaac

SEQ ID NO: 435147 - RNA, 26 nt, Human
ccaacacacacacacacacacacaca

SEQ ID NO: 435148 - RNA, 18 nt, Human
ccacugcuuccugggccg

SEQ ID NO: 435149 - RNA, 20 nt, Human
ccagacagcuccuguccuag

SEQ ID NO: 435150 - RNA, 24 nt, Human
ccaggcuucaaguucagaacacgg

SEQ ID NO: 435151 - RNA, 19 nt, Human
cccaaccuggagcggucac

SEQ ID NO: 435152 - RNA, 19 nt, Human
cccacaacccaucccucca

SEQ ID NO: 435153 - RNA, 20 nt, Human
cccauggacagaccccucac

SEQ ID NO: 435154 - RNA, 21 nt, Human
ccgcaaacagaaaaauaaaca

SEQ ID NO: 435155 - RNA, 25 nt, Human
ccuccagcuggagccuuuugcuggg

SEQ ID NO: 435156 - RNA, 21 nt, Human
ccucccacugcuuccugggcc

SEQ ID NO: 435157 - RNA, 23 nt, Human
ccuuccaccaucuuccaugagag

SEQ ID NO: 435158 - RNA, 25 nt, Human
ccuuccaccaucuuccaugagaguc

SEQ ID NO: 435159 - RNA, 19 nt, Human
cggcaccagggaagccugc

SEQ ID NO: 435160 - RNA, 21 nt, Human
cucagcccgacagacugaggc

SEQ ID NO: 435161 - RNA, 25 nt, Human
cucauggccacccugucagagccau

SEQ ID NO: 435162 - RNA, 23 nt, Human
cucucuguuccccuggcuccuua

SEQ ID NO: 435163 - RNA, 23 nt, Human
cucugaccuccacaucccaccuc

SEQ ID NO: 435164 - RNA, 21 nt, Human
cugcuccagccucugccucag

SEQ ID NO: 435165 - RNA, 24 nt, Human
cugcugcaucgugcacagcugggg

SEQ ID NO: 435166 - RNA, 27 nt, Human
cugcugcaucgugcacagcuggggugg

SEQ ID NO: 435167 - RNA, 19 nt, Human
cuuaaaaaccaacaacagc

SEQ ID NO: 435168 - RNA, 19 nt, Human
cuuaguggcauaugaaggu

SEQ ID NO: 435169 - RNA, 19 nt, Human
cuucagagcuuuuguucuu

SEQ ID NO: 435170 - RNA, 22 nt, Human
cuuccaccaucuuccaugagag

SEQ ID NO: 435171 - RNA, 21 nt, Human
cuugcagauaggaggcuacug

SEQ ID NO: 435172 - RNA, 20 nt, Human
cuuuugcuuuugaacaguuu

SEQ ID NO: 435173 - RNA, 19 nt, Human
gaagaaccacacgccuucc

SEQ ID NO: 435174 - RNA, 19 nt, Human
gaccuccacaucccaccuc

SEQ ID NO: 435175 - RNA, 19 nt, Human
gacuuguuuuuguuuuuug

SEQ ID NO: 435176 - RNA, 23 nt, Human
gagaugcucugaccuccacaucc

SEQ ID NO: 435177 - RNA, 24 nt, Human
gcaaaucucaagucccaaauaauc

SEQ ID NO: 435178 - RNA, 24 nt, Human
gcaacucgcaggaaccacacacau

SEQ ID NO: 435179 - RNA, 28 nt, Human
gcacagccccaaagcaugagggaacgcc

SEQ ID NO: 435180 - RNA, 18 nt, Human
gcagagccugagggacuc

SEQ ID NO: 435181 - RNA, 19 nt, Human
gcagggccaccuccuccuc

SEQ ID NO: 435182 - RNA, 23 nt, Human
gcaggguuucauuagugggagcu

SEQ ID NO: 435183 - RNA, 18 nt, Human
gcggggagcaggaaccag

SEQ ID NO: 435184 - RNA, 21 nt, Human
gcuaaacugcaaacugcagug

SEQ ID NO: 435185 - RNA, 22 nt, Human
gcuugcagauaggaggcuacug

SEQ ID NO: 435186 - RNA, 21 nt, Human
ggaaauggaguagggggccca

SEQ ID NO: 435187 - RNA, 20 nt, Human
ggacauuuugaggacaagca

SEQ ID NO: 435188 - RNA, 23 nt, Human
ggacuuguuuuuguuuuuugcuu

SEQ ID NO: 435189 - RNA, 23 nt, Human
ggagaggaugagaacugaaaaag

SEQ ID NO: 435190 - RNA, 19 nt, Human
ggaguuccauuccugccag

SEQ ID NO: 435191 - RNA, 25 nt, Human
gggaagcagaaagaguuaagggaag

SEQ ID NO: 435192 - RNA, 21 nt, Human
gggaguggggacccaaggagc

SEQ ID NO: 435193 - RNA, 20 nt, Human
ggggaguggggacccaagga

SEQ ID NO: 435194 - RNA, 18 nt, Human
gggugugaaaucacugcc

SEQ ID NO: 435195 - RNA, 20 nt, Human
ggugauaauucauuaaucaa

SEQ ID NO: 435196 - RNA, 21 nt, Human
gguugucccaguuuucagucu

SEQ ID NO: 435197 - RNA, 25 nt, Human
gugcugccccacaauucucucuguu

SEQ ID NO: 435198 - RNA, 19 nt, Human
uaaaaaaaaugccaaagug

SEQ ID NO: 435199 - RNA, 18 nt, Human
uaaagaaauccagugaaa

SEQ ID NO: 435200 - RNA, 31 nt, Human
uaacuaaccccaaaccaaaauguagaugcug

SEQ ID NO: 435201 - RNA, 21 nt, Human
uaacucuaucucuuugagguu

SEQ ID NO: 435202 - RNA, 19 nt, Human
uaaggaaggggguuguccc

SEQ ID NO: 435203 - RNA, 20 nt, Human
uaauccuaauauuuggugcc

SEQ ID NO: 435204 - RNA, 21 nt, Human
uaauguuugucaccugccuca

SEQ ID NO: 435205 - RNA, 18 nt, Human
uacaaggaaagcaggguu

SEQ ID NO: 435206 - RNA, 21 nt, Human
uacauaaaaccccaaaagaac

SEQ ID NO: 435207 - RNA, 23 nt, Human
uaccacuggugucagagagacag

SEQ ID NO: 435208 - RNA, 21 nt, Human
uaccagaaacacagaagaggu

SEQ ID NO: 435209 - RNA, 24 nt, Human
uagaaaguuauucaaaagggagca

SEQ ID NO: 435210 - RNA, 18 nt, Human
uagccucacucuugaucu

SEQ ID NO: 435211 - RNA, 25 nt, Human
uagggugaacaagcuccaccaguuu

SEQ ID NO: 435212 - RNA, 21 nt, Human
uauacuggauugggauggaga

SEQ ID NO: 435213 - RNA, 20 nt, Human
uaugugaaguuauugaacac

SEQ ID NO: 435214 - RNA, 21 nt, Human
uaugugaaguuauugaacacg

SEQ ID NO: 435215 - RNA, 20 nt, Human
ucaaaagugguuaauuugaa

SEQ ID NO: 435216 - RNA, 23 nt, Human
ucacacacacucggugacaaugu

SEQ ID NO: 435217 - RNA, 18 nt, Human
ucacaggcacagcagcgc

SEQ ID NO: 435218 - RNA, 26 nt, Human
ucacugcaaucuuaggcaggccccuu

SEQ ID NO: 435219 - RNA, 21 nt, Human
ucagaaauuguuggauuuguu

SEQ ID NO: 435220 - RNA, 23 nt, Human
ucagaaauuguuggauuuguuua

SEQ ID NO: 435221 - RNA, 22 nt, Human
ucagcgccaacaccuuuccaug

SEQ ID NO: 435222 - RNA, 23 nt, Human
ucaucugcacaugucugggugau

SEQ ID NO: 435223 - RNA, 21 nt, Human
uccaacacacacacacacaca

SEQ ID NO: 435224 - RNA, 22 nt, Human
uccaccagccaagugcugggac

SEQ ID NO: 435225 - RNA, 19 nt, Human
uccccccuucuuuuugagu

SEQ ID NO: 435226 - RNA, 23 nt, Human
ucccuccagcuggagccuuuugc

SEQ ID NO: 435227 - RNA, 19 nt, Human
uccuccaggcuucaaguuc

SEQ ID NO: 435228 - RNA, 21 nt, Human
uccuccaggcuucaaguucag

SEQ ID NO: 435229 - RNA, 25 nt, Human
uccuccaggcuucaaguucagaaca

SEQ ID NO: 435230 - RNA, 23 nt, Human
ucuaguguugcagagccugagga

SEQ ID NO: 435231 - RNA, 21 nt, Human
ucucaagucccaaauaaucuc

SEQ ID NO: 435232 - RNA, 18 nt, Human
ucuuaagcacagccccaa

SEQ ID NO: 435233 - RNA, 25 nt, Human
ucuucuaauucuguuccuuggcugu

SEQ ID NO: 435234 - RNA, 26 nt, Human
ugaaaaggucacauguggacacuacu

SEQ ID NO: 435235 - RNA, 19 nt, Human
ugacucaugguguuuuaac

SEQ ID NO: 435236 - RNA, 24 nt, Human
ugacuguucauuccaccccccaaa

SEQ ID NO: 435237 - RNA, 26 nt, Human
ugagacaccaaaggcuaaacugcaag

SEQ ID NO: 435238 - RNA, 18 nt, Human
ugaggacaagcaugcuga

SEQ ID NO: 435239 - RNA, 31 nt, Human
ugaggacacccaggcauugugccaaggcugg

SEQ ID NO: 435240 - RNA, 24 nt, Human
ugauaucaucaucugagaagcaau

SEQ ID NO: 435241 - RNA, 23 nt, Human
ugauauggaaagaagcuuuuuuu

SEQ ID NO: 435242 - RNA, 19 nt, Human
ugaugcagaguauaugaca

SEQ ID NO: 435243 - RNA, 19 nt, Human
ugcaaaucucaagucccaa

SEQ ID NO: 435244 - RNA, 21 nt, Human
ugccauugcaggagggcacag

SEQ ID NO: 435245 - RNA, 22 nt, Human
ugccucagaagaggaaacucag

SEQ ID NO: 435246 - RNA, 23 nt, Human
ugccucagaagaggaaacucagc

SEQ ID NO: 435247 - RNA, 21 nt, Human
ugcugggacccagguggccac

SEQ ID NO: 435248 - RNA, 18 nt, Human
uggaaaugcaccaucccu

SEQ ID NO: 435249 - RNA, 19 nt, Human
uggaaaugcaccauccucu

SEQ ID NO: 435250 - RNA, 23 nt, Human
uggacaagucuguacauaaaacc

SEQ ID NO: 435251 - RNA, 21 nt, Human
ugggaaauggaguagggggcc

SEQ ID NO: 435252 - RNA, 19 nt, Human
ugggacccagguggccacc

SEQ ID NO: 435253 - RNA, 18 nt, Human
uggggacccaaggagcgg

SEQ ID NO: 435254 - RNA, 22 nt, Human
uggggaguggggacccaaggag

SEQ ID NO: 435255 - RNA, 23 nt, Human
uggggcauacugacaaacacuuc

SEQ ID NO: 435256 - RNA, 22 nt, Human
uggggugguaauguuugucacc

SEQ ID NO: 435257 - RNA, 21 nt, Human
ugucaaggucuacaggauugu

SEQ ID NO: 435258 - RNA, 25 nt, Human
ugugccaaggcugccauugcaggag

SEQ ID NO: 435259 - RNA, 19 nt, Human
uuaaaagauacaaggaaag

SEQ ID NO: 435260 - RNA, 19 nt, Human
uuaaauagcuaccagaaac

SEQ ID NO: 435261 - RNA, 18 nt, Human
uuaaccagacuuucucuu

SEQ ID NO: 435262 - RNA, 20 nt, Human
uuaauaaaaacugagauugc

SEQ ID NO: 435263 - RNA, 18 nt, Human
uuagauuccuuagguaag

SEQ ID NO: 435264 - RNA, 23 nt, Human
uuagugggagcugauuuaggguu

SEQ ID NO: 435265 - RNA, 22 nt, Human
uucauaacuaaccccaaaccaa

SEQ ID NO: 435266 - RNA, 20 nt, Human
uuccaugauuaaacuugccc

SEQ ID NO: 435267 - RNA, 18 nt, Human
uuccuagggugaacaagc

SEQ ID NO: 435268 - RNA, 19 nt, Human
uucuguuccuuggcugugc

SEQ ID NO: 435269 - RNA, 22 nt, Human
uucuucuaucacaacauaguug

SEQ ID NO: 435270 - RNA, 22 nt, Human
uugaaagaaaccuuaaaaaccu

SEQ ID NO: 435271 - RNA, 20 nt, Human
uugaauaacaaccaccacuc

SEQ ID NO: 435272 - RNA, 20 nt, Human
uugcagagccugagggacuc

SEQ ID NO: 435273 - RNA, 18 nt, Human
uugcaucugcugcaucgu

SEQ ID NO: 435274 - RNA, 23 nt, Human
uugcuguguaccuauacauuguu

SEQ ID NO: 435275 - RNA, 19 nt, Human
uugugccaaggcugccauu

SEQ ID NO: 435276 - RNA, 19 nt, Human
uuuaaaaaaaaacaacaac

SEQ ID NO: 435277 - RNA, 21 nt, Human
uuuccaagcaaugagaaaugg

SEQ ID NO: 435278 - RNA, 18 nt, Human
uuucuucuaauucuguuc

SEQ ID NO: 435279 - RNA, 19 nt, Human
uuugguuuuuuuuggccau

SEQ ID NO: 435280 - RNA, 24 nt, Human
uuuucuucuucggcuuuaaaacag

SEQ ID NO: 435281 - RNA, 24 nt, Human
uuuuuagaaagacuuaccuaguca

SEQ ID NO: 435282 - RNA, 18 nt, Human
aaaaggaaacaaaaacag

SEQ ID NO: 435283 - RNA, 25 nt, Human
aaggaaacaaaaacaguaauucuga

SEQ ID NO: 435284 - RNA, 21 nt, Human
aggaaacaaaaacaguaauuc

SEQ ID NO: 435285 - RNA, 18 nt, Human
agggggcugcuguaugug

SEQ ID NO: 435286 - RNA, 24 nt, Human
caaaaacaguaauucugaagagca

SEQ ID NO: 435287 - RNA, 23 nt, Human
ccuggcccauuccaggccagcug

SEQ ID NO: 435288 - RNA, 19 nt, Human
cugaaaugcugauucuguc

SEQ ID NO: 435289 - RNA, 23 nt, Human
gggaacaggcagccaggaccagc

SEQ ID NO: 435290 - RNA, 20 nt, Human
ugggguaaaaggaaacaaaa

SEQ ID NO: 435291 - RNA, 18 nt, Human
uguccagggggcugcugu

SEQ ID NO: 435292 - RNA, 20 nt, Human
uuggagagaagggaagacug

SEQ ID NO: 435293 - RNA, 22 nt, Human
uuuuuuuuuuuuuugggcuaga

SEQ ID NO: 435294 - RNA, 19 nt, Human
aaaaagaugcuaauaccac

SEQ ID NO: 435295 - RNA, 25 nt, Human
aaacaaaaacaaacagcacaagcaa

SEQ ID NO: 435296 - RNA, 24 nt, Human
aaauaaaaaggcacauaaaaauau

SEQ ID NO: 435297 - RNA, 21 nt, Human
aacaaaaacaaacagcacaag

SEQ ID NO: 435298 - RNA, 24 nt, Human
aacaaaaauaaaaaggcacauaaa

SEQ ID NO: 435299 - RNA, 22 nt, Human
aacagcacaagcaaacagaaau

SEQ ID NO: 435300 - RNA, 21 nt, Human
acaaaaacaaacagcacaagc

SEQ ID NO: 435301 - RNA, 23 nt, Human
acaaaacaagcauaugcaauagu

SEQ ID NO: 435302 - RNA, 20 nt, Human
acagagaaagauugccugga

SEQ ID NO: 435303 - RNA, 21 nt, Human
agacacuuggucugagaaaca

SEQ ID NO: 435304 - RNA, 24 nt, Human
agacaggaagcagagcagggccag

SEQ ID NO: 435305 - RNA, 26 nt, Human
agacaggaagcagagcagggccagga

SEQ ID NO: 435306 - RNA, 22 nt, Human
agccaagagucaaacaaaacaa

SEQ ID NO: 435307 - RNA, 21 nt, Human
aggaagcagagcagggccagg

SEQ ID NO: 435308 - RNA, 18 nt, Human
aggauaugaaggugaagg

SEQ ID NO: 435309 - RNA, 23 nt, Human
aggcagccaagagucaaacaaaa

SEQ ID NO: 435310 - RNA, 21 nt, Human
aggcccuuucugggggcagga

SEQ ID NO: 435311 - RNA, 21 nt, Human
agggggaggggggcucuaaga

SEQ ID NO: 435312 - RNA, 20 nt, Human
agguggguggcagggggagg

SEQ ID NO: 435313 - RNA, 26 nt, Human
agguggguggcagggggaggggggcu

SEQ ID NO: 435314 - RNA, 18 nt, Human
auggcucccauuccaccc

SEQ ID NO: 435315 - RNA, 22 nt, Human
caaacaauggcuuagaaaaugc

SEQ ID NO: 435316 - RNA, 19 nt, Human
caacaaaaauaaaaaggca

SEQ ID NO: 435317 - RNA, 21 nt, Human
caagaugaaaguuggaacuug

SEQ ID NO: 435318 - RNA, 22 nt, Human
caagcaaacagaaauuauaauc

SEQ ID NO: 435319 - RNA, 25 nt, Human
cacaagcaaacagaaauuauaauca

SEQ ID NO: 435320 - RNA, 20 nt, Human
cacauugacagaugaaaaac

SEQ ID NO: 435321 - RNA, 20 nt, Human
caccaacaaaaauaaaaagg

SEQ ID NO: 435322 - RNA, 22 nt, Human
caguuuacuuuguaggaaugau

SEQ ID NO: 435323 - RNA, 22 nt, Human
cauuaacucaauuuuuucuaca

SEQ ID NO: 435324 - RNA, 19 nt, Human
ccaacaaaaauaaaaaggc

SEQ ID NO: 435325 - RNA, 21 nt, Human
ccaagagucaaacaaaacaag

SEQ ID NO: 435326 - RNA, 24 nt, Human
ccaccuuuacaaugguuccaacuc

SEQ ID NO: 435327 - RNA, 22 nt, Human
cccacaaaacuccauguuuggg

SEQ ID NO: 435328 - RNA, 19 nt, Human
ccuccuaguuggaaauaaa

SEQ ID NO: 435329 - RNA, 22 nt, Human
ccuccuaguuggaaauaaaggc

SEQ ID NO: 435330 - RNA, 19 nt, Human
ccugaggugcacugguucu

SEQ ID NO: 435331 - RNA, 22 nt, Human
cuacauaaaaaagaugcuaaua

SEQ ID NO: 435332 - RNA, 27 nt, Human
cucuaagaucaggauaugaaggugaag

SEQ ID NO: 435333 - RNA, 20 nt, Human
cucuaucacuucaugcaaca

SEQ ID NO: 435334 - RNA, 20 nt, Human
cuuguccaaugaccucccca

SEQ ID NO: 435335 - RNA, 25 nt, Human
gaaaaacaaaaacaaacagcacaag

SEQ ID NO: 435336 - RNA, 21 nt, Human
gacaccuagguuuucaguucc

SEQ ID NO: 435337 - RNA, 26 nt, Human
gacuuauuauucucccaguuuacuuu

SEQ ID NO: 435338 - RNA, 20 nt, Human
gccaagagucaaacaaaaca

SEQ ID NO: 435339 - RNA, 22 nt, Human
gcccggguagucacgaucauuc

SEQ ID NO: 435340 - RNA, 18 nt, Human
gcuuagaaaaugcugacu

SEQ ID NO: 435341 - RNA, 23 nt, Human
ggaaauguauuucuucccaaccc

SEQ ID NO: 435342 - RNA, 19 nt, Human
ggacugacucaccacugaa

SEQ ID NO: 435343 - RNA, 19 nt, Human
ggauaugaaggugaaggga

SEQ ID NO: 435344 - RNA, 23 nt, Human
ggcaggaagugggauuuucaggg

SEQ ID NO: 435345 - RNA, 21 nt, Human
gggccaggaaauggaaggggc

SEQ ID NO: 435346 - RNA, 20 nt, Human
ggggacccuacagacguagg

SEQ ID NO: 435347 - RNA, 22 nt, Human
ggguggcagggggaggggggcu

SEQ ID NO: 435348 - RNA, 18 nt, Human
guggcagggggagggggg

SEQ ID NO: 435349 - RNA, 22 nt, Human
guucccauugagaggacucuau

SEQ ID NO: 435350 - RNA, 19 nt, Human
guuuauugugacaccuagg

SEQ ID NO: 435351 - RNA, 22 nt, Human
uaaagugcaccugucaagauca

SEQ ID NO: 435352 - RNA, 23 nt, Human
uaaagugcaccugucaagaucau

SEQ ID NO: 435353 - RNA, 22 nt, Human
uacagggcugcuuugccucagc

SEQ ID NO: 435354 - RNA, 19 nt, Human
uacccuauaaaacacagau

SEQ ID NO: 435355 - RNA, 19 nt, Human
uagaaaaaaaaauccaggu

SEQ ID NO: 435356 - RNA, 23 nt, Human
uagacaaaaauuaaauagaaaaa

SEQ ID NO: 435357 - RNA, 21 nt, Human
uaguuggaaauaaaggcccuu

SEQ ID NO: 435358 - RNA, 24 nt, Human
ucagccccaccauauguaagugca

SEQ ID NO: 435359 - RNA, 19 nt, Human
ucaguuccuuuuaguggcu

SEQ ID NO: 435360 - RNA, 19 nt, Human
uccaacucaacacuccacc

SEQ ID NO: 435361 - RNA, 18 nt, Human
uccaaugaccuccccacc

SEQ ID NO: 435362 - RNA, 24 nt, Human
uccaaugaccuccccaccaacaaa

SEQ ID NO: 435363 - RNA, 23 nt, Human
uccacucuacccuauaaaacaca

SEQ ID NO: 435364 - RNA, 25 nt, Human
uccacucuacccuauaaaacacaga

SEQ ID NO: 435365 - RNA, 18 nt, Human
ucccaacccaguccaccc

SEQ ID NO: 435366 - RNA, 25 nt, Human
ucccaacccaguccaccccauuaac

SEQ ID NO: 435367 - RNA, 22 nt, Human
uccccaccaacaaaaauaaaaa

SEQ ID NO: 435368 - RNA, 19 nt, Human
uccuaguuggaaauaaagg

SEQ ID NO: 435369 - RNA, 18 nt, Human
ucuacuaggcuuugccca

SEQ ID NO: 435370 - RNA, 21 nt, Human
ucuccccaguaaagugcaccu

SEQ ID NO: 435371 - RNA, 21 nt, Human
ucuucccaacccaguccaccc

SEQ ID NO: 435372 - RNA, 18 nt, Human
ucuuuguaauugugggag

SEQ ID NO: 435373 - RNA, 23 nt, Human
ugacaccuagguuuucaguuccu

SEQ ID NO: 435374 - RNA, 23 nt, Human
ugaccugccauggcucccauucc

SEQ ID NO: 435375 - RNA, 18 nt, Human
ugagaggacucuaugacc

SEQ ID NO: 435376 - RNA, 19 nt, Human
ugagguagacaggaagcag

SEQ ID NO: 435377 - RNA, 23 nt, Human
ugccucagccccaccauauguaa

SEQ ID NO: 435378 - RNA, 18 nt, Human
ugcuaguaugacaguaug

SEQ ID NO: 435379 - RNA, 18 nt, Human
uggaagcccacaaaacuc

SEQ ID NO: 435380 - RNA, 21 nt, Human
uggguggcagggggagggggg

SEQ ID NO: 435381 - RNA, 24 nt, Human
uguccaaugaccuccccaccaaca

SEQ ID NO: 435382 - RNA, 19 nt, Human
ugugacaccuagguuuuca

SEQ ID NO: 435383 - RNA, 28 nt, Human
uuccaacucaacacuccacccaggaagc

SEQ ID NO: 435384 - RNA, 18 nt, Human
uugaagccuacagggcug

SEQ ID NO: 435385 - RNA, 18 nt, Human
uuucaggggacccuacag

SEQ ID NO: 435386 - RNA, 25 nt, Human
uuucugggggcaggaagugggauuu

SEQ ID NO: 435387 - RNA, 23 nt, Human
aaaguaggcacuacgugcacccc

SEQ ID NO: 435388 - RNA, 18 nt, Human
aagcaauucagggcuagg

SEQ ID NO: 435389 - RNA, 18 nt, Human
aagugcuaagaccaaagc

SEQ ID NO: 435390 - RNA, 22 nt, Human
aauggauccuccccuggggucu

SEQ ID NO: 435391 - RNA, 21 nt, Human
acacaaacgcauacacaugcu

SEQ ID NO: 435392 - RNA, 19 nt, Human
acacacacucccccagccc

SEQ ID NO: 435393 - RNA, 21 nt, Human
accaaagcccacccccacccc

SEQ ID NO: 435394 - RNA, 20 nt, Human
acucggcccacaucccccuu

SEQ ID NO: 435395 - RNA, 22 nt, Human
agaaggaaagugcuaagaccaa

SEQ ID NO: 435396 - RNA, 23 nt, Human
agaccaaagcccacccccacccc

SEQ ID NO: 435397 - RNA, 22 nt, Human
agagaagccccacugagccccu

SEQ ID NO: 435398 - RNA, 24 nt, Human
agcgaugcacccggaauggcuucc

SEQ ID NO: 435399 - RNA, 18 nt, Human
agcgcucaccaucgaagg

SEQ ID NO: 435400 - RNA, 20 nt, Human
aggaaggaggucagagccug

SEQ ID NO: 435401 - RNA, 22 nt, Human
aggaaggaggucagagccuggg

SEQ ID NO: 435402 - RNA, 18 nt, Human
aggggggaucuggagaag

SEQ ID NO: 435403 - RNA, 21 nt, Human
aggucagagccugggucagga

SEQ ID NO: 435404 - RNA, 20 nt, Human
caaacgcauacacaugcuug

SEQ ID NO: 435405 - RNA, 22 nt, Human
caaagcccacccccaccccagg

SEQ ID NO: 435406 - RNA, 20 nt, Human
cacaucccccuuccugcagc

SEQ ID NO: 435407 - RNA, 19 nt, Human
cacuacgugcacccaggac

SEQ ID NO: 435408 - RNA, 20 nt, Human
cacugagccccucgcacccc

SEQ ID NO: 435409 - RNA, 21 nt, Human
cacugagccccucgcaccccc

SEQ ID NO: 435410 - RNA, 19 nt, Human
cagcuuagagaagcaauuc

SEQ ID NO: 435411 - RNA, 25 nt, Human
caggacgcagcgaugcacccggaau

SEQ ID NO: 435412 - RNA, 19 nt, Human
cagggcuaggcaagggcca

SEQ ID NO: 435413 - RNA, 18 nt, Human
ccacacaagcaggcauag

SEQ ID NO: 435414 - RNA, 25 nt, Human
ccacaucccccuuccugcagcuggc

SEQ ID NO: 435415 - RNA, 20 nt, Human
ccacugagccccucgcaccc

SEQ ID NO: 435416 - RNA, 21 nt, Human
ccacugagccccucgcacccc

SEQ ID NO: 435417 - RNA, 18 nt, Human
cccacacaagcaggcaua

SEQ ID NO: 435418 - RNA, 25 nt, Human
cccacugagccccucgcacccccca

SEQ ID NO: 435419 - RNA, 21 nt, Human
cccagggucuugggggcuggc

SEQ ID NO: 435420 - RNA, 22 nt, Human
ccccagcccuuccugaauggcc

SEQ ID NO: 435421 - RNA, 26 nt, Human
ccccaugaagcccucaaugugcaggg

SEQ ID NO: 435422 - RNA, 18 nt, Human
cccccagggucuuggggg

SEQ ID NO: 435423 - RNA, 21 nt, Human
cccccagggucuugggggcug

SEQ ID NO: 435424 - RNA, 22 nt, Human
cccuggggcugcccagccaggg

SEQ ID NO: 435425 - RNA, 19 nt, Human
cccuggggucuccaggcuc

SEQ ID NO: 435426 - RNA, 21 nt, Human
cccugugcaugggaacaccag

SEQ ID NO: 435427 - RNA, 20 nt, Human
ccuccugcaggaagccguga

SEQ ID NO: 435428 - RNA, 22 nt, Human
cgucucgcugcuccagcaggua

SEQ ID NO: 435429 - RNA, 18 nt, Human
cuaagaccaaagcccacc

SEQ ID NO: 435430 - RNA, 24 nt, Human
cuaagaccaaagcccacccccacc

SEQ ID NO: 435431 - RNA, 26 nt, Human
cucccccagcccuuccugaauggccc

SEQ ID NO: 435432 - RNA, 21 nt, Human
cuccccuggggucuccaggcu

SEQ ID NO: 435433 - RNA, 21 nt, Human
cucgcaccccccaugaagccc

SEQ ID NO: 435434 - RNA, 23 nt, Human
cucuagaagccgcugcaagaagu

SEQ ID NO: 435435 - RNA, 24 nt, Human
cuggccccuggggcugcccagcca

SEQ ID NO: 435436 - RNA, 22 nt, Human
gaacaccagcuuagagaagcaa

SEQ ID NO: 435437 - RNA, 21 nt, Human
gaaccgcgcacccggcggaug

SEQ ID NO: 435438 - RNA, 22 nt, Human
gaagaagagcugcacacaaacg

SEQ ID NO: 435439 - RNA, 23 nt, Human
gagugguguccacccccaggguc

SEQ ID NO: 435440 - RNA, 23 nt, Human
gccacacacacucccccagcccu

SEQ ID NO: 435441 - RNA, 25 nt, Human
gcucaucccaaauggauccuccccu

SEQ ID NO: 435442 - RNA, 22 nt, Human
ggacuggauuugggacuggggu

SEQ ID NO: 435443 - RNA, 23 nt, Human
ggacuggauuugggacuggggug

SEQ ID NO: 435444 - RNA, 24 nt, Human
ggacuggauuugggacuggggugg

SEQ ID NO: 435445 - RNA, 18 nt, Human
ggacugggguggguaggg

SEQ ID NO: 435446 - RNA, 20 nt, Human
ggcaggaaggaggucagagc

SEQ ID NO: 435447 - RNA, 24 nt, Human
ggcaggaaggaggucagagccugg

SEQ ID NO: 435448 - RNA, 19 nt, Human
ggccccuggggcugcccag

SEQ ID NO: 435449 - RNA, 19 nt, Human
ggggaucuggagaaggaaa

SEQ ID NO: 435450 - RNA, 23 nt, Human
ggguggguaggggggaucuggag

SEQ ID NO: 435451 - RNA, 20 nt, Human
uaagaccaaagcccaccccc

SEQ ID NO: 435452 - RNA, 26 nt, Human
uacccgagccgaacgaccggggguuc

SEQ ID NO: 435453 - RNA, 20 nt, Human
uagaagccgcugcaagaagu

SEQ ID NO: 435454 - RNA, 21 nt, Human
uccaagagagcuccuggcccc

SEQ ID NO: 435455 - RNA, 24 nt, Human
ucccacggugccuucaagcuuuau

SEQ ID NO: 435456 - RNA, 18 nt, Human
ucccccagcccuuccuga

SEQ ID NO: 435457 - RNA, 23 nt, Human
uccccuggggucuccaggcucau

SEQ ID NO: 435458 - RNA, 21 nt, Human
ucccugagugguguccacccc

SEQ ID NO: 435459 - RNA, 22 nt, Human
ucuccaagagagcuccuggccc

SEQ ID NO: 435460 - RNA, 19 nt, Human
ucucgcugcuccagcaggu

SEQ ID NO: 435461 - RNA, 26 nt, Human
ugagugguguccacccccagggucuu

SEQ ID NO: 435462 - RNA, 22 nt, Human
ugcacacaaacgcauacacaug

SEQ ID NO: 435463 - RNA, 23 nt, Human
ugccacacacacucccccagccc

SEQ ID NO: 435464 - RNA, 18 nt, Human
ugcuaagaccaaagccca

SEQ ID NO: 435465 - RNA, 21 nt, Human
ugcuugucuccaagagagcuc

SEQ ID NO: 435466 - RNA, 19 nt, Human
uggccccuggggcugcccu

SEQ ID NO: 435467 - RNA, 23 nt, Human
ugggaacaccagcuuagagaagc

SEQ ID NO: 435468 - RNA, 20 nt, Human
ugggacugggguggguaggg

SEQ ID NO: 435469 - RNA, 22 nt, Human
ugggacugggguggguaggggg

SEQ ID NO: 435470 - RNA, 18 nt, Human
ugggggcuggcuugugca

SEQ ID NO: 435471 - RNA, 21 nt, Human
uggggucacucagugccccau

SEQ ID NO: 435472 - RNA, 18 nt, Human
ugggguggguagggggga

SEQ ID NO: 435473 - RNA, 21 nt, Human
uuuuuuuuuucccacggugcc

SEQ ID NO: 435474 - RNA, 25 nt, Human
uuuuuuuuuuuuuuuuuucccacgg

SEQ ID NO: 435475 - RNA, 21 nt, Human
aaacaaaacaggaaacaugug

SEQ ID NO: 435476 - RNA, 26 nt, Human
aaacaaaacaggaaacaugugcuugg

SEQ ID NO: 435477 - RNA, 18 nt, Human
aagccacuccucaagcug

SEQ ID NO: 435478 - RNA, 18 nt, Human
aaggcaacauuuauuuga

SEQ ID NO: 435479 - RNA, 22 nt, Human
acaaaacaggaaacaugugcuu

SEQ ID NO: 435480 - RNA, 21 nt, Human
accauggcuugaucaaacuua

SEQ ID NO: 435481 - RNA, 24 nt, Human
agcaaauucagacaagucaguagc

SEQ ID NO: 435482 - RNA, 24 nt, Human
auagccucugcguccuccuggguu

SEQ ID NO: 435483 - RNA, 22 nt, Human
caccauggcuugaucaaacuua

SEQ ID NO: 435484 - RNA, 23 nt, Human
cagugaagucuuucagaaggccu

SEQ ID NO: 435485 - RNA, 26 nt, Human
caugaucaaugcauuuuugugucacc

SEQ ID NO: 435486 - RNA, 24 nt, Human
ccagcagacaaggcagccuuggca

SEQ ID NO: 435487 - RNA, 21 nt, Human
ccuccguaagcuccaaagggc

SEQ ID NO: 435488 - RNA, 21 nt, Human
cgauuucuuuuaaugucuucu

SEQ ID NO: 435489 - RNA, 20 nt, Human
cuaaggcagaaguggugguu

SEQ ID NO: 435490 - RNA, 18 nt, Human
cuccaagagcagacgucc

SEQ ID NO: 435491 - RNA, 21 nt, Human
gaaggccuccguaagcuccaa

SEQ ID NO: 435492 - RNA, 21 nt, Human
gcagaaguggugguuacuugg

SEQ ID NO: 435493 - RNA, 27 nt, Human
gcagugaagucuuucagaaggccuccg

SEQ ID NO: 435494 - RNA, 18 nt, Human
gccaguuguggcagcugc

SEQ ID NO: 435495 - RNA, 21 nt, Human
gcuugaucaaacuuaaucacu

SEQ ID NO: 435496 - RNA, 23 nt, Human
ggaaacaugcaucuucagacuuc

SEQ ID NO: 435497 - RNA, 22 nt, Human
gggcauggccaguuguggcagc

SEQ ID NO: 435498 - RNA, 25 nt, Human
ggggaguauaaagguuuaaaauuuu

SEQ ID NO: 435499 - RNA, 22 nt, Human
ggucauuccgcucuuguaguug

SEQ ID NO: 435500 - RNA, 21 nt, Human
gguucaaaucugagagaaugu

SEQ ID NO: 435501 - RNA, 23 nt, Human
guuucaggugagacuuugccagc

SEQ ID NO: 435502 - RNA, 18 nt, Human
uacccguucuucaaauuc

SEQ ID NO: 435503 - RNA, 25 nt, Human
uacuuggcaagaauacgauuucuuu

SEQ ID NO: 435504 - RNA, 19 nt, Human
uagcagcaacuacaaacac

SEQ ID NO: 435505 - RNA, 20 nt, Human
uagcagcaacuacaaacaca

SEQ ID NO: 435506 - RNA, 18 nt, Human
uagccucugcguccuccu

SEQ ID NO: 435507 - RNA, 24 nt, Human
ucacacugucaacuguuucaggug

SEQ ID NO: 435508 - RNA, 23 nt, Human
ucugaacugcuccacucugguga

SEQ ID NO: 435509 - RNA, 22 nt, Human
ucugcguccuccuggguuuucu

SEQ ID NO: 435510 - RNA, 23 nt, Human
ucugcugggugcugagggaggua

SEQ ID NO: 435511 - RNA, 22 nt, Human
ugccuggauuguucguauaaag

SEQ ID NO: 435512 - RNA, 24 nt, Human
ugccuggauuguucguauaaaggc

SEQ ID NO: 435513 - RNA, 20 nt, Human
ugccugugcuccaagagcag

SEQ ID NO: 435514 - RNA, 21 nt, Human
ugcugagggagguacacaggg

SEQ ID NO: 435515 - RNA, 19 nt, Human
uggaaacaaaacaggaaac

SEQ ID NO: 435516 - RNA, 18 nt, Human
uggaucagagguuccaug

SEQ ID NO: 435517 - RNA, 19 nt, Human
uggcagcugcucugaaggu

SEQ ID NO: 435518 - RNA, 20 nt, Human
uggccaguuguggcagcugc

SEQ ID NO: 435519 - RNA, 24 nt, Human
ugggaaucaaacuaaugcuggaaa

SEQ ID NO: 435520 - RNA, 20 nt, Human
uguacuucuagcaugggcuc

SEQ ID NO: 435521 - RNA, 24 nt, Human
uguggcagcugcucugaaggucaa

SEQ ID NO: 435522 - RNA, 25 nt, Human
uguggcagcugcucugaaggucacu

SEQ ID NO: 435523 - RNA, 22 nt, Human
uguuacccguucuucaaauuca

SEQ ID NO: 435524 - RNA, 19 nt, Human
uucaggggaguauaaaggu

SEQ ID NO: 435525 - RNA, 19 nt, Human
uucaugaucaaugcauuuu

SEQ ID NO: 435526 - RNA, 18 nt, Human
uuccauggucugaacugc

SEQ ID NO: 435527 - RNA, 19 nt, Human
uuccauggucugaacugcu

SEQ ID NO: 435528 - RNA, 23 nt, Human
uuggcaagaauacgauuucuuuu

SEQ ID NO: 435529 - RNA, 19 nt, Human
aaaauuccuuggcaauguc

SEQ ID NO: 435530 - RNA, 22 nt, Human
aaagggaauucagacccagaac

SEQ ID NO: 435531 - RNA, 19 nt, Human
aacaaaacacauuuacucc

SEQ ID NO: 435532 - RNA, 21 nt, Human
acuccugagggggcaaagagg

SEQ ID NO: 435533 - RNA, 22 nt, Human
acuggcugucaaggcaggaagg

SEQ ID NO: 435534 - RNA, 23 nt, Human
agacaguacuggcaucuggcaca

SEQ ID NO: 435535 - RNA, 21 nt, Human
agacccagaacagaagcagca

SEQ ID NO: 435536 - RNA, 22 nt, Human
agacccagaacagaagcagcaa

SEQ ID NO: 435537 - RNA, 23 nt, Human
agccuuuucgucucuguucuggg

SEQ ID NO: 435538 - RNA, 21 nt, Human
agggaggguagugugggucaa

SEQ ID NO: 435539 - RNA, 23 nt, Human
auuccuuggcaaugucuccccag

SEQ ID NO: 435540 - RNA, 18 nt, Human
caagaaaacagaguuuca

SEQ ID NO: 435541 - RNA, 24 nt, Human
caccacaaagaagugcccaccuca

SEQ ID NO: 435542 - RNA, 18 nt, Human
cagaacagaagcagcaaa

SEQ ID NO: 435543 - RNA, 18 nt, Human
cagaacagaagcagcaaa

SEQ ID NO: 435544 - RNA, 25 nt, Human
cagcacuccugagggggcaaagagg

SEQ ID NO: 435545 - RNA, 21 nt, Human
cccaccucaccaucauuucac

SEQ ID NO: 435546 - RNA, 21 nt, Human
cccauacagccccuggagcca

SEQ ID NO: 435547 - RNA, 22 nt, Human
ccggucccagacagcuggucaa

SEQ ID NO: 435548 - RNA, 22 nt, Human
ccuaggaacaaaacacauuuac

SEQ ID NO: 435549 - RNA, 21 nt, Human
ccucccugcuucaguggaggc

SEQ ID NO: 435550 - RNA, 20 nt, Human
ccucuggcccuaggaacaaa

SEQ ID NO: 435551 - RNA, 20 nt, Human
ccuucaaagaagcagaugau

SEQ ID NO: 435552 - RNA, 21 nt, Human
cggucccagacagcuggucaa

SEQ ID NO: 435553 - RNA, 24 nt, Human
cgucucuguucuggguucugagag

SEQ ID NO: 435554 - RNA, 27 nt, Human
cucacauccccuuugaacacuuaacuu

SEQ ID NO: 435555 - RNA, 23 nt, Human
cugacuggggcaagaaaacagag

SEQ ID NO: 435556 - RNA, 18 nt, Human
cugagggggcaaagagga

SEQ ID NO: 435557 - RNA, 22 nt, Human
gaccugggcccuguccuuucug

SEQ ID NO: 435558 - RNA, 22 nt, Human
gcugucaaggcaggaaggauuc

SEQ ID NO: 435559 - RNA, 23 nt, Human
ggcugucaaggcaggaaggauuc

SEQ ID NO: 435560 - RNA, 21 nt, Human
gggccagggcauggagucuuc

SEQ ID NO: 435561 - RNA, 23 nt, Human
gggucaacacuggcccucagcac

SEQ ID NO: 435562 - RNA, 24 nt, Human
ggguucuguucaggggaggguggg

SEQ ID NO: 435563 - RNA, 22 nt, Human
ggucaacacuggcccucagcac

SEQ ID NO: 435564 - RNA, 23 nt, Human
gguucuguucaggggaggguggg

SEQ ID NO: 435565 - RNA, 20 nt, Human
guggaggcccucacaucccc

SEQ ID NO: 435566 - RNA, 18 nt, Human
uaagggcaagugcaugcc

SEQ ID NO: 435567 - RNA, 27 nt, Human
uagccuuuucgucucuguucuggguuc

SEQ ID NO: 435568 - RNA, 23 nt, Human
uaggaacaaaacacauuuacucc

SEQ ID NO: 435569 - RNA, 19 nt, Human
ucacagacuggcugucaag

SEQ ID NO: 435570 - RNA, 20 nt, Human
ucagacccagaacagaagca

SEQ ID NO: 435571 - RNA, 23 nt, Human
ucaguggaggcccucacaucccc

SEQ ID NO: 435572 - RNA, 20 nt, Human
ucccagacagcuggucaagg

SEQ ID NO: 435573 - RNA, 28 nt, Human
uccccagaauucugcacucuucccuggg

SEQ ID NO: 435574 - RNA, 22 nt, Human
ucucuguucuggguucugagag

SEQ ID NO: 435575 - RNA, 22 nt, Human
ucucuuaugggcuggguucugu

SEQ ID NO: 435576 - RNA, 21 nt, Human
ucugagagcucugcagucugg

SEQ ID NO: 435577 - RNA, 18 nt, Human
ucuggaggcacagcagac

SEQ ID NO: 435578 - RNA, 21 nt, Human
ugaauacccucuggagacuga

SEQ ID NO: 435579 - RNA, 20 nt, Human
ugacuggggcaagaaaacag

SEQ ID NO: 435580 - RNA, 27 nt, Human
ugccgggacugagaaaaccggggguuc

SEQ ID NO: 435581 - RNA, 18 nt, Human
ugccuggcagucacagga

SEQ ID NO: 435582 - RNA, 20 nt, Human
ugccuggcagucacaggaug

SEQ ID NO: 435583 - RNA, 22 nt, Human
uggagucuuccaguaaaauucc

SEQ ID NO: 435584 - RNA, 19 nt, Human
ugucaaggcaggaaggauu

SEQ ID NO: 435585 - RNA, 19 nt, Human
uugaacacuuaacuugggu

SEQ ID NO: 435586 - RNA, 23 nt, Human
uuuggagcaggaggaauccuagg

SEQ ID NO: 435587 - RNA, 25 nt, Human
aaaaaaggagauuuucauaacuaca

SEQ ID NO: 435588 - RNA, 22 nt, Human
aaacaaagagagacuggaucca

SEQ ID NO: 435589 - RNA, 26 nt, Human
aaaccaaacucagauggcagaaccag

SEQ ID NO: 435590 - RNA, 22 nt, Human
aaagaacauguucaaguaaauc

SEQ ID NO: 435591 - RNA, 19 nt, Human
aaagaugccggaggcuugg

SEQ ID NO: 435592 - RNA, 19 nt, Human
aaagggcucucagcccagc

SEQ ID NO: 435593 - RNA, 22 nt, Human
aacaaaauaaagcuuuauuuga

SEQ ID NO: 435594 - RNA, 19 nt, Human
aaccgccagccccugcaug

SEQ ID NO: 435595 - RNA, 26 nt, Human
aagaggccagcacaaccacgaccgag

SEQ ID NO: 435596 - RNA, 21 nt, Human
aagcacccacuggcgucguga

SEQ ID NO: 435597 - RNA, 21 nt, Human
aagggacccggcucacugggc

SEQ ID NO: 435598 - RNA, 22 nt, Human
aagggacccggcucacugggcc

SEQ ID NO: 435599 - RNA, 25 nt, Human
aaguaaauccacacacuacauguga

SEQ ID NO: 435600 - RNA, 22 nt, Human
acaaagagagacuggauccaga

SEQ ID NO: 435601 - RNA, 20 nt, Human
acacuacagccccccaugcc

SEQ ID NO: 435602 - RNA, 23 nt, Human
acacuacagccccccaugcccag

SEQ ID NO: 435603 - RNA, 22 nt, Human
agaugccggaggcuuggaaguu

SEQ ID NO: 435604 - RNA, 22 nt, Human
agcacaggagaaacacucacca

SEQ ID NO: 435605 - RNA, 22 nt, Human
aggcaaaaaaggagauuuucau

SEQ ID NO: 435606 - RNA, 20 nt, Human
agggcacagcuuuguugcua

SEQ ID NO: 435607 - RNA, 22 nt, Human
auacacaaccaagcacaggaga

SEQ ID NO: 435608 - RNA, 27 nt, Human
caaaaaaggagauuuucauaacuacau

SEQ ID NO: 435609 - RNA, 22 nt, Human
caaacucagauggcagaaccag

SEQ ID NO: 435610 - RNA, 21 nt, Human
caaagagagacuggauccaga

SEQ ID NO: 435611 - RNA, 26 nt, Human
caaccgccagccccugcaugccuagc

SEQ ID NO: 435612 - RNA, 20 nt, Human
caagaggccagcacaaccac

SEQ ID NO: 435613 - RNA, 21 nt, Human
cacaaaaaucuuucuggauca

SEQ ID NO: 435614 - RNA, 19 nt, Human
cacauuaaaacaaagagag

SEQ ID NO: 435615 - RNA, 22 nt, Human
caccaccuccugggcuucacag

SEQ ID NO: 435616 - RNA, 18 nt, Human
caccacgcgcccaccccg

SEQ ID NO: 435617 - RNA, 19 nt, Human
caccaggaaaagaugccgg

SEQ ID NO: 435618 - RNA, 21 nt, Human
caccaguagaggcaaaaaagg

SEQ ID NO: 435619 - RNA, 20 nt, Human
caccccggaguccuugguug

SEQ ID NO: 435620 - RNA, 22 nt, Human
caccgcuuaggaguuagcucca

SEQ ID NO: 435621 - RNA, 23 nt, Human
caccuugcacuuggcuccucacc

SEQ ID NO: 435622 - RNA, 18 nt, Human
cagcaacauggaaagcua

SEQ ID NO: 435623 - RNA, 18 nt, Human
cagcuugaagaaacagaa

SEQ ID NO: 435624 - RNA, 21 nt, Human
cagcuugaagaaacagaacau

SEQ ID NO: 435625 - RNA, 18 nt, Human
cccagggccucaccuucc

SEQ ID NO: 435626 - RNA, 27 nt, Human
cccaugcccagggcacagccggggucc

SEQ ID NO: 435627 - RNA, 21 nt, Human
ccccccaugcccagggcacag

SEQ ID NO: 435628 - RNA, 21 nt, Human
ccccggaguccuugguugaag

SEQ ID NO: 435629 - RNA, 20 nt, Human
cccugcagccaacaccaccu

SEQ ID NO: 435630 - RNA, 20 nt, Human
cccugccaaccgccagcccc

SEQ ID NO: 435631 - RNA, 21 nt, Human
ccucagggguaccuucuggga

SEQ ID NO: 435632 - RNA, 23 nt, Human
ccucagggguaccuucugggaag

SEQ ID NO: 435633 - RNA, 21 nt, Human
ccucagugguucucaccgccc

SEQ ID NO: 435634 - RNA, 19 nt, Human
ccugaaggguagacugugg

SEQ ID NO: 435635 - RNA, 20 nt, Human
cgcgcccaccccggaguccu

SEQ ID NO: 435636 - RNA, 24 nt, Human
cuaagccuguaacaaaagaccacc

SEQ ID NO: 435637 - RNA, 23 nt, Human
cuacagccccccaugcccagggc

SEQ ID NO: 435638 - RNA, 18 nt, Human
cucaccgccccaaccaca

SEQ ID NO: 435639 - RNA, 24 nt, Human
cuccaagucucaucauuggaccuc

SEQ ID NO: 435640 - RNA, 20 nt, Human
cuccaccacgcgcccacccc

SEQ ID NO: 435641 - RNA, 19 nt, Human
cuccugggcuucacagguu

SEQ ID NO: 435642 - RNA, 18 nt, Human
cugaagccagcaaagaug

SEQ ID NO: 435643 - RNA, 18 nt, Human
cuuuguugcuaagccugu

SEQ ID NO: 435644 - RNA, 20 nt, Human
cuuuucauuccaggaaacca

SEQ ID NO: 435645 - RNA, 24 nt, Human
gaacauguucaaguaaauccacac

SEQ ID NO: 435646 - RNA, 23 nt, Human
gagcaggcgcgcuaucccagggc

SEQ ID NO: 435647 - RNA, 28 nt, Human
gcccagcuucacgugaggggggaacgcc

SEQ ID NO: 435648 - RNA, 22 nt, Human
gcccaucccaagagccccacaa

SEQ ID NO: 435649 - RNA, 19 nt, Human
gcccgcccaucccaagagc

SEQ ID NO: 435650 - RNA, 21 nt, Human
gcucacugggccuccuucccc

SEQ ID NO: 435651 - RNA, 19 nt, Human
gcucuguguuaucugagca

SEQ ID NO: 435652 - RNA, 21 nt, Human
gugguucucaccgccccaacc

SEQ ID NO: 435653 - RNA, 19 nt, Human
uaacaaaagaccaccacuc

SEQ ID NO: 435654 - RNA, 23 nt, Human
uaagggacccggcucacugggcc

SEQ ID NO: 435655 - RNA, 23 nt, Human
uacaaacaucuccaauucagacu

SEQ ID NO: 435656 - RNA, 19 nt, Human
uacagaucauucagaugcc

SEQ ID NO: 435657 - RNA, 18 nt, Human
uacccugcagccaacacc

SEQ ID NO: 435658 - RNA, 19 nt, Human
uagccaugucgcauagccu

SEQ ID NO: 435659 - RNA, 24 nt, Human
uagccaugucgcauagccucucca

SEQ ID NO: 435660 - RNA, 22 nt, Human
uagcuucccugaagaacccaac

SEQ ID NO: 435661 - RNA, 19 nt, Human
uauaaaaauaagauuucug

SEQ ID NO: 435662 - RNA, 19 nt, Human
uaucuagacagaucuggag

SEQ ID NO: 435663 - RNA, 19 nt, Human
ucacagguucacucaccca

SEQ ID NO: 435664 - RNA, 18 nt, Human
ucacucacccaagaggcc

SEQ ID NO: 435665 - RNA, 20 nt, Human
ucagcccagcuucacgugag

SEQ ID NO: 435666 - RNA, 21 nt, Human
ucaguggcccagacacccccc

SEQ ID NO: 435667 - RNA, 19 nt, Human
ucagugguucucaccgccc

SEQ ID NO: 435668 - RNA, 23 nt, Human
uccaugggugacacuccugggac

SEQ ID NO: 435669 - RNA, 18 nt, Human
ucccagggccucaccuuc

SEQ ID NO: 435670 - RNA, 19 nt, Human
ucccagggccucaccuucc

SEQ ID NO: 435671 - RNA, 22 nt, Human
ucccagggccucaccuuccugu

SEQ ID NO: 435672 - RNA, 24 nt, Human
uccucaccaguagaggcaaaaaag

SEQ ID NO: 435673 - RNA, 26 nt, Human
uccuugguugaaggugauaaccaccu

SEQ ID NO: 435674 - RNA, 19 nt, Human
ucuaacaagucaccugagu

SEQ ID NO: 435675 - RNA, 22 nt, Human
ucugcacugaagccagcaaaga

SEQ ID NO: 435676 - RNA, 24 nt, Human
ucuucagcuccaccacgcgcccac

SEQ ID NO: 435677 - RNA, 19 nt, Human
ugcccagggcacagcuuug

SEQ ID NO: 435678 - RNA, 19 nt, Human
ugcccgcccaucccaagag

SEQ ID NO: 435679 - RNA, 20 nt, Human
ugcccgggaccauguccagg

SEQ ID NO: 435680 - RNA, 22 nt, Human
ugccggaggcuuggaaguucuc

SEQ ID NO: 435681 - RNA, 18 nt, Human
uggaugggagaaagggcu

SEQ ID NO: 435682 - RNA, 24 nt, Human
uggcccagacaccccccgaacacu

SEQ ID NO: 435683 - RNA, 19 nt, Human
uggggugggggcugcuucu

SEQ ID NO: 435684 - RNA, 20 nt, Human
uggggugggggcugcuucug

SEQ ID NO: 435685 - RNA, 27 nt, Human
ugggugcccgcccaucccaagagcccc

SEQ ID NO: 435686 - RNA, 21 nt, Human
uguaacaaaagaccaccacuc

SEQ ID NO: 435687 - RNA, 18 nt, Human
uguggggugggggcugcu

SEQ ID NO: 435688 - RNA, 24 nt, Human
uucacagccucauccacuauuuuc

SEQ ID NO: 435689 - RNA, 21 nt, Human
uucucaccgccccaaccacag

SEQ ID NO: 435690 - RNA, 24 nt, Human
aggcauguccaggaugucagggcg

SEQ ID NO: 435691 - RNA, 19 nt, Human
gaagacggaaaagcuacgu

SEQ ID NO: 435692 - RNA, 19 nt, Human
gaagacggaaaagcuacgu

SEQ ID NO: 435693 - RNA, 20 nt, Human
ucagggcggggcuccgagga

SEQ ID NO: 435694 - RNA, 24 nt, Human
ugaagacggaaaagcuacgugcag

SEQ ID NO: 435695 - RNA, 24 nt, Human
ugaagacggaaaagcuacgugcag

SEQ ID NO: 435696 - RNA, 24 nt, Human
ugaugcauuaggacuuuauuuggg

SEQ ID NO: 435697 - RNA, 24 nt, Human
ugaugcauuaggacuuuauuuggg

SEQ ID NO: 435698 - RNA, 19 nt, Human
ugcauuaggacuuuauuug

SEQ ID NO: 435699 - RNA, 19 nt, Human
ugcauuaggacuuuauuug

SEQ ID NO: 435700 - RNA, 21 nt, Human
uguccaggaugucagggcggg

SEQ ID NO: 435701 - RNA, 18 nt, Human
uuuuuuuuuuuuuuuuug

SEQ ID NO: 435702 - RNA, 26 nt, Human
uuuuuuuuuuuuuuuuuuuuuugggg

SEQ ID NO: 435703 - RNA, 20 nt, Human
aaucagguuaauuaggguug

SEQ ID NO: 435704 - RNA, 18 nt, Human
agcuauauccugugcgcu

SEQ ID NO: 435705 - RNA, 22 nt, Human
agguuuuuggcacagcacuguu

SEQ ID NO: 435706 - RNA, 19 nt, Human
cagguuaauuaggguugcu

SEQ ID NO: 435707 - RNA, 19 nt, Human
cagguuaauuaggguugcu

SEQ ID NO: 435708 - RNA, 21 nt, Human
cauuggggaccgaguuagagg

SEQ ID NO: 435709 - RNA, 27 nt, Human
ccacccggaaaagguuuccuugauuau

SEQ ID NO: 435710 - RNA, 21 nt, Human
ccucuaaauuccuggaccaag

SEQ ID NO: 435711 - RNA, 28 nt, Human
cgaguuagagguuuauuucuuuuuuuuu

SEQ ID NO: 435712 - RNA, 21 nt, Human
gaaccucuaaauuccuggacc

SEQ ID NO: 435713 - RNA, 21 nt, Human
gaccagugcgcggagggcugc

SEQ ID NO: 435714 - RNA, 23 nt, Human
gaguuagagguuuauuucuuuuu

SEQ ID NO: 435715 - RNA, 22 nt, Human
uaaauuccuggaccaagcuaua

SEQ ID NO: 435716 - RNA, 23 nt, Human
uagagaaaauccacagguuuuug

SEQ ID NO: 435717 - RNA, 22 nt, Human
uagaguuuugugugucuuauuc

SEQ ID NO: 435718 - RNA, 19 nt, Human
ucugagugccgcucaaucc

SEQ ID NO: 435719 - RNA, 25 nt, Human
ugaucauuggggaccgaguuagagg

SEQ ID NO: 435720 - RNA, 21 nt, Human
ugauuugauuccauugagagu

SEQ ID NO: 435721 - RNA, 19 nt, Human
ugcgcggagggcugcuucc

SEQ ID NO: 435722 - RNA, 20 nt, Human
uucuauaauugguauaagcu

SEQ ID NO: 435723 - RNA, 24 nt, Human
uuggggaccgaguuagagguuuau

SEQ ID NO: 435724 - RNA, 21 nt, Human
uuuugugugucuuauucuuaa

SEQ ID NO: 435725 - RNA, 20 nt, Human
uuuuuuuuuuuuaauagagu

SEQ ID NO: 435726 - RNA, 22 nt, Human
aaaccucuuucacuggcugccc

SEQ ID NO: 435727 - RNA, 25 nt, Human
aucaccuccaaagcaaacccguacc

SEQ ID NO: 435728 - RNA, 22 nt, Human
caaaaaugagauauccuuuuga

SEQ ID NO: 435729 - RNA, 18 nt, Human
cacccagccuccguagcc

SEQ ID NO: 435730 - RNA, 20 nt, Human
cacccagccuccguagccaa

SEQ ID NO: 435731 - RNA, 18 nt, Human
caugcaaggaaagaaguu

SEQ ID NO: 435732 - RNA, 18 nt, Human
cguagccaaaccucuuuc

SEQ ID NO: 435733 - RNA, 19 nt, Human
cucacucuacugguguuuc

SEQ ID NO: 435734 - RNA, 19 nt, Human
cucccuugcugugguguug

SEQ ID NO: 435735 - RNA, 24 nt, Human
cugcccuguuuucccugucucacu

SEQ ID NO: 435736 - RNA, 21 nt, Human
gcccuguuuucccugucucac

SEQ ID NO: 435737 - RNA, 22 nt, Human
guagaauaugacuauggauguc

SEQ ID NO: 435738 - RNA, 21 nt, Human
uccugggaucaccuccaaagc

SEQ ID NO: 435739 - RNA, 20 nt, Human
ugcccuguuuucccugucuc

SEQ ID NO: 435740 - RNA, 24 nt, Human
uguugauaccuguugauacauauu

SEQ ID NO: 435741 - RNA, 22 nt, Human
uuuagaucuggccauucuuuug

SEQ ID NO: 435742 - RNA, 19 nt, Human
uuucaacaacuuugcuucu

SEQ ID NO: 435743 - RNA, 19 nt, Human
uuuccugggaucaccucca

SEQ ID NO: 435744 - RNA, 20 nt, Human
uuuugguagaauaugacuau

SEQ ID NO: 435745 - RNA, 24 nt, Human
uuuuuuuuuuuuuuuuuuuuucag

SEQ ID NO: 435746 - RNA, 19 nt, Human
aaaaggccggcugacgggu

SEQ ID NO: 435747 - RNA, 19 nt, Human
aaaccaccacaaaguccca

SEQ ID NO: 435748 - RNA, 23 nt, Human
aaagaaagaagaauggaaaagaa

SEQ ID NO: 435749 - RNA, 18 nt, Human
aaccaccacaaaguccca

SEQ ID NO: 435750 - RNA, 26 nt, Human
aagaaaaaaaccaccacaaaguccca

SEQ ID NO: 435751 - RNA, 18 nt, Human
aagaaaaccaaagaggga

SEQ ID NO: 435752 - RNA, 26 nt, Human
aagaaagaaagaagaauggaaaagaa

SEQ ID NO: 435753 - RNA, 21 nt, Human
aagaagaaaaaaaccaccaca

SEQ ID NO: 435754 - RNA, 18 nt, Human
aagcauaaaauaaccaau

SEQ ID NO: 435755 - RNA, 22 nt, Human
accacaaagucccaaaccucag

SEQ ID NO: 435756 - RNA, 21 nt, Human
agaaagaagaauggaaaagaa

SEQ ID NO: 435757 - RNA, 19 nt, Human
agcaaacaacauaaaaaga

SEQ ID NO: 435758 - RNA, 27 nt, Human
caaaagcuaagaaaaccaaagagggaa

SEQ ID NO: 435759 - RNA, 21 nt, Human
caaagucccaaaccucagaaa

SEQ ID NO: 435760 - RNA, 19 nt, Human
caaauucaaaagcuaagaa

SEQ ID NO: 435761 - RNA, 26 nt, Human
cagcaaacaacauaaaaagaaagaaa

SEQ ID NO: 435762 - RNA, 20 nt, Human
ccaagaaagcauaaaauaac

SEQ ID NO: 435763 - RNA, 22 nt, Human
ccacaaagucccaaaccucaga

SEQ ID NO: 435764 - RNA, 22 nt, Human
cccaaaccucagaaauuaacau

SEQ ID NO: 435765 - RNA, 25 nt, Human
cccgggucggggcgggcggcggagc

SEQ ID NO: 435766 - RNA, 22 nt, Human
ccgggucaacucaucauugaca

SEQ ID NO: 435767 - RNA, 18 nt, Human
ccguggccgcccccacgu

SEQ ID NO: 435768 - RNA, 21 nt, Human
cgggcacagcaggcugcgcgg

SEQ ID NO: 435769 - RNA, 20 nt, Human
cgggucggggcgggcggcgg

SEQ ID NO: 435770 - RNA, 19 nt, Human
cuccaguacgagcgcgggg

SEQ ID NO: 435771 - RNA, 24 nt, Human
cucgggacccacgggcacagcagg

SEQ ID NO: 435772 - RNA, 22 nt, Human
gaaaaaaaccaccacaaagucc

SEQ ID NO: 435773 - RNA, 21 nt, Human
gaaccugaaggaaaaggccgg

SEQ ID NO: 435774 - RNA, 24 nt, Human
gagagcaaacagugggguaguggc

SEQ ID NO: 435775 - RNA, 19 nt, Human
gcaguagcuaacacucaaa

SEQ ID NO: 435776 - RNA, 24 nt, Human
gcugggcccgggucggggcgggcg

SEQ ID NO: 435777 - RNA, 18 nt, Human
ggaaaaggccggcugacg

SEQ ID NO: 435778 - RNA, 20 nt, Human
ggcugggcccgggucggggc

SEQ ID NO: 435779 - RNA, 25 nt, Human
gggccguggaggcggcugggcccgg

SEQ ID NO: 435780 - RNA, 20 nt, Human
ggguaguggccauggcacuc

SEQ ID NO: 435781 - RNA, 25 nt, Human
uaaauuaaaagcaguugauuugcaa

SEQ ID NO: 435782 - RNA, 26 nt, Human
uaacacucaaaacaauuuguuuaagu

SEQ ID NO: 435783 - RNA, 20 nt, Human
uaagaaaaccaaagagggaa

SEQ ID NO: 435784 - RNA, 24 nt, Human
uacagcaaacaacauaaaaagaaa

SEQ ID NO: 435785 - RNA, 21 nt, Human
uagcuaacacucaaaacaauu

SEQ ID NO: 435786 - RNA, 23 nt, Human
uaguggagaugccgccugucaug

SEQ ID NO: 435787 - RNA, 21 nt, Human
ucaaaacaauuuguuuaagug

SEQ ID NO: 435788 - RNA, 21 nt, Human
uccuucaggaggccgcucuuc

SEQ ID NO: 435789 - RNA, 18 nt, Human
ugagccugacgaaccuga

SEQ ID NO: 435790 - RNA, 18 nt, Human
ugccguggccgcccccac

SEQ ID NO: 435791 - RNA, 24 nt, Human
uucaaaagcuaagaaaaccaaaga

SEQ ID NO: 435792 - RNA, 21 nt, Human
uucaaauucaaaagcuaagaa

SEQ ID NO: 435793 - RNA, 20 nt, Human
uuuuuuuuuucagugaaauu

SEQ ID NO: 435794 - RNA, 21 nt, Human
uuuuuuuuuuuuuuuuuucag

SEQ ID NO: 435795 - RNA, 21 nt, Human
acaauagagaacgugggcagg

SEQ ID NO: 435796 - RNA, 21 nt, Human
acgugggcagguugggcuggg

SEQ ID NO: 435797 - RNA, 23 nt, Human
caaaacaauagagaacgugggca

SEQ ID NO: 435798 - RNA, 25 nt, Human
caaaacaauagagaacgugggccgg

SEQ ID NO: 435799 - RNA, 24 nt, Human
cccaaggaaaugugaguaggggcc

SEQ ID NO: 435800 - RNA, 20 nt, Human
cccguggacacaagccgccu

SEQ ID NO: 435801 - RNA, 21 nt, Human
cccguggacacaagccgccuc

SEQ ID NO: 435802 - RNA, 23 nt, Human
cgucccguggacacaagccgccu

SEQ ID NO: 435803 - RNA, 22 nt, Human
cguggacacaagccgccucuaa

SEQ ID NO: 435804 - RNA, 18 nt, Human
cucaaaacaauagagaac

SEQ ID NO: 435805 - RNA, 18 nt, Human
gcagccugaaagcaaugg

SEQ ID NO: 435806 - RNA, 18 nt, Human
gcagccugaaagcaaugg

SEQ ID NO: 435807 - RNA, 22 nt, Human
gcagccugaaagcaaugggguc

SEQ ID NO: 435808 - RNA, 22 nt, Human
ggccgaguaacagacccagaaa

SEQ ID NO: 435809 - RNA, 22 nt, Human
ggcuggggugugggcagaauag

SEQ ID NO: 435810 - RNA, 22 nt, Human
gggcagccugaaagcaaugggg

SEQ ID NO: 435811 - RNA, 21 nt, Human
gggcagguugggcuggggugu

SEQ ID NO: 435812 - RNA, 20 nt, Human
gguugggcuggggugugggc

SEQ ID NO: 435813 - RNA, 22 nt, Human
uagagaacgugggcagguuggg

SEQ ID NO: 435814 - RNA, 18 nt, Human
ucccaccguggcccucuc

SEQ ID NO: 435815 - RNA, 22 nt, Human
ugggacuguugcuccaacccaa

SEQ ID NO: 435816 - RNA, 18 nt, Human
agagggaaaggaggaggg

SEQ ID NO: 435817 - RNA, 21 nt, Human
agagggaaaggaggagggggg

SEQ ID NO: 435818 - RNA, 19 nt, Human
agcagguguguggggagga

SEQ ID NO: 435819 - RNA, 21 nt, Human
agcagguguguggggaggagu

SEQ ID NO: 435820 - RNA, 23 nt, Human
aggacaagagggaaaggaggagg

SEQ ID NO: 435821 - RNA, 20 nt, Human
aggaggggggcaauguggca

SEQ ID NO: 435822 - RNA, 20 nt, Human
caacccagaaacaucaccau

SEQ ID NO: 435823 - RNA, 23 nt, Human
caacccagaaacaucaccauuua

SEQ ID NO: 435824 - RNA, 18 nt, Human
cagcaccgaggcggccgg

SEQ ID NO: 435825 - RNA, 21 nt, Human
ccaucugagcuugggagcagg

SEQ ID NO: 435826 - RNA, 21 nt, Human
cgcugcuagcggcccgugggc

SEQ ID NO: 435827 - RNA, 19 nt, Human
cggcccgugggcgguggcg

SEQ ID NO: 435828 - RNA, 22 nt, Human
gaaacaucaccauuuaugagga

SEQ ID NO: 435829 - RNA, 18 nt, Human
gcgguggcgggaucagca

SEQ ID NO: 435830 - RNA, 19 nt, Human
ggacaagagggaaaggagg

SEQ ID NO: 435831 - RNA, 20 nt, Human
gggggcaauguggcaugggg

SEQ ID NO: 435832 - RNA, 21 nt, Human
uagcggcccgugggcgguggc

SEQ ID NO: 435833 - RNA, 19 nt, Human
ucaacccagaaacaucacc

SEQ ID NO: 435834 - RNA, 19 nt, Human
ucagcaccgaggcggccgg

SEQ ID NO: 435835 - RNA, 20 nt, Human
ugaggacaagagggaaagga

SEQ ID NO: 435836 - RNA, 23 nt, Human
ugcuagcggcccgugggcggugg

SEQ ID NO: 435837 - RNA, 20 nt, Human
uuaagggacuuccaucugag

SEQ ID NO: 435838 - RNA, 18 nt, Human
cccccuguguguaggagu

SEQ ID NO: 435839 - RNA, 21 nt, Human
uaagcgccggcuccacccccu

SEQ ID NO: 435840 - RNA, 25 nt, Human
uccacccccuguguguaggagugcg

SEQ ID NO: 435841 - RNA, 20 nt, Human
cugugccaucugugcuggag

SEQ ID NO: 435842 - RNA, 20 nt, Human
ugcuggaggccuugucugug

SEQ ID NO: 435843 - RNA, 20 nt, Human
aaacucucccaaggcccccg

SEQ ID NO: 435844 - RNA, 22 nt, Human
aacacuccgacucaagaaagcg

SEQ ID NO: 435845 - RNA, 18 nt, Human
aaccagacagaacucaac

SEQ ID NO: 435846 - RNA, 23 nt, Human
aaccagacagaacucaaccccag

SEQ ID NO: 435847 - RNA, 20 nt, Human
aagcucccucucuccagccc

SEQ ID NO: 435848 - RNA, 22 nt, Human
aaggaacugcccagccgggucc

SEQ ID NO: 435849 - RNA, 18 nt, Human
aagucugggauuggggug

SEQ ID NO: 435850 - RNA, 24 nt, Human
aagucugggauuggggugggucuu

SEQ ID NO: 435851 - RNA, 21 nt, Human
aaguggaguuaacuucagaga

SEQ ID NO: 435852 - RNA, 23 nt, Human
aauggcaacaaaaccagacagaa

SEQ ID NO: 435853 - RNA, 19 nt, Human
acacacgcacucacacaca

SEQ ID NO: 435854 - RNA, 23 nt, Human
acacacucauauccacacacgca

SEQ ID NO: 435855 - RNA, 19 nt, Human
acacggcacucgcaugugc

SEQ ID NO: 435856 - RNA, 19 nt, Human
acacugggccccaccaggc

SEQ ID NO: 435857 - RNA, 23 nt, Human
accaaaauggcaacaaaaccaga

SEQ ID NO: 435858 - RNA, 21 nt, Human
acugggcugggaacauuaacu

SEQ ID NO: 435859 - RNA, 19 nt, Human
agagagaggugaagaugau

SEQ ID NO: 435860 - RNA, 19 nt, Human
agaggaaaagggagaaaga

SEQ ID NO: 435861 - RNA, 21 nt, Human
agagugaggacugcuccugcc

SEQ ID NO: 435862 - RNA, 24 nt, Human
agccagccagaggccaccugagga

SEQ ID NO: 435863 - RNA, 24 nt, Human
agccaguuaguggucaacccccuc

SEQ ID NO: 435864 - RNA, 22 nt, Human
agccuaggauggucagcagcaa

SEQ ID NO: 435865 - RNA, 20 nt, Human
agcuccuggcacucuggucu

SEQ ID NO: 435866 - RNA, 27 nt, Human
aggcagcagcugccuggggccucaggg

SEQ ID NO: 435867 - RNA, 18 nt, Human
agggggccuucccaccuc

SEQ ID NO: 435868 - RNA, 18 nt, Human
agguggggcccuggaggc

SEQ ID NO: 435869 - RNA, 21 nt, Human
agucaggaggcaucgauagug

SEQ ID NO: 435870 - RNA, 22 nt, Human
aucagcccagagggggccuucc

SEQ ID NO: 435871 - RNA, 23 nt, Human
caaaaccagacagaacucaaccc

SEQ ID NO: 435872 - RNA, 19 nt, Human
caacaaaaccagacagaac

SEQ ID NO: 435873 - RNA, 23 nt, Human
caacaagaacagauggaaagcga

SEQ ID NO: 435874 - RNA, 23 nt, Human
caagaauggcacaagaucagccc

SEQ ID NO: 435875 - RNA, 22 nt, Human
cacagccagccagaggccaccu

SEQ ID NO: 435876 - RNA, 20 nt, Human
caccuggcaggggccuuugg

SEQ ID NO: 435877 - RNA, 19 nt, Human
cagaacucaaccccagucc

SEQ ID NO: 435878 - RNA, 21 nt, Human
cagccuaggauggucagcagc

SEQ ID NO: 435879 - RNA, 18 nt, Human
caggagccaguuaguggu

SEQ ID NO: 435880 - RNA, 21 nt, Human
caggaggcagcaagcucccuc

SEQ ID NO: 435881 - RNA, 19 nt, Human
cagguccaaggucaagaau

SEQ ID NO: 435882 - RNA, 25 nt, Human
cauauccacacacgcacucacacac

SEQ ID NO: 435883 - RNA, 18 nt, Human
caucguccuuucugggcc

SEQ ID NO: 435884 - RNA, 26 nt, Human
caugugcacacacacucauauccaca

SEQ ID NO: 435885 - RNA, 21 nt, Human
cauucagagugaggacugcuc

SEQ ID NO: 435886 - RNA, 23 nt, Human
ccaaaccaaaauggcaacaaaac

SEQ ID NO: 435887 - RNA, 22 nt, Human
ccaagcagguccaaggucaaga

SEQ ID NO: 435888 - RNA, 22 nt, Human
ccagccccuaacugaacaaaca

SEQ ID NO: 435889 - RNA, 18 nt, Human
ccagccucccaaaccaaa

SEQ ID NO: 435890 - RNA, 24 nt, Human
cccacagccagccagaggccaccu

SEQ ID NO: 435891 - RNA, 26 nt, Human
cccccacagccagccagaggccaccu

SEQ ID NO: 435892 - RNA, 18 nt, Human
ccuccuguuucagaaaau

SEQ ID NO: 435893 - RNA, 23 nt, Human
ccuggcacucuggucuggcccac

SEQ ID NO: 435894 - RNA, 22 nt, Human
ccuuaaacucucccaaggcccc

SEQ ID NO: 435895 - RNA, 24 nt, Human
ccuugcuuaggggccucugccaaa

SEQ ID NO: 435896 - RNA, 26 nt, Human
cgcaaacacuccgacucaagaaagcg

SEQ ID NO: 435897 - RNA, 20 nt, Human
cuccaacaccccucccuugc

SEQ ID NO: 435898 - RNA, 21 nt, Human
cuccugcccuccuccaguggc

SEQ ID NO: 435899 - RNA, 21 nt, Human
cugaacaaacacuucaauaaa

SEQ ID NO: 435900 - RNA, 23 nt, Human
gaaaggggacugggcugggaaca

SEQ ID NO: 435901 - RNA, 19 nt, Human
gaagucugggauuggggug

SEQ ID NO: 435902 - RNA, 19 nt, Human
gagcacagccucugccagc

SEQ ID NO: 435903 - RNA, 22 nt, Human
gaggcagcagcugccuggggcc

SEQ ID NO: 435904 - RNA, 24 nt, Human
gagugucuuugaguguagcuucca

SEQ ID NO: 435905 - RNA, 21 nt, Human
gcacugcaguccgcggggcgc

SEQ ID NO: 435906 - RNA, 19 nt, Human
gcccagagggggccuuccc

SEQ ID NO: 435907 - RNA, 19 nt, Human
gccuuuggucauaggacgg

SEQ ID NO: 435908 - RNA, 23 nt, Human
gcucuuggggugcuuuuccagcc

SEQ ID NO: 435909 - RNA, 18 nt, Human
gcugaaggccuuuggacc

SEQ ID NO: 435910 - RNA, 22 nt, Human
ggcagugagcaagaggaaaagg

SEQ ID NO: 435911 - RNA, 19 nt, Human
ggcucuccaacaccccucc

SEQ ID NO: 435912 - RNA, 20 nt, Human
gggcacccuggggguggggg

SEQ ID NO: 435913 - RNA, 22 nt, Human
ggggugggggugaggguggggc

SEQ ID NO: 435914 - RNA, 18 nt, Human
ggggugggucuugguguc

SEQ ID NO: 435915 - RNA, 22 nt, Human
gucauaggacggcgugggggag

SEQ ID NO: 435916 - RNA, 27 nt, Human
gugguccuguucccuggucggccguac

SEQ ID NO: 435917 - RNA, 19 nt, Human
uaagagaagggaggugagu

SEQ ID NO: 435918 - RNA, 20 nt, Human
uacaaccuaguccccugguc

SEQ ID NO: 435919 - RNA, 24 nt, Human
uagcuuccaaucucaaaugguccu

SEQ ID NO: 435920 - RNA, 21 nt, Human
uaguccccuggucagcuacag

SEQ ID NO: 435921 - RNA, 18 nt, Human
ucagaaaaucuaaccagc

SEQ ID NO: 435922 - RNA, 19 nt, Human
ucagagugaggacugcucc

SEQ ID NO: 435923 - RNA, 18 nt, Human
ucagcccagagggggccu

SEQ ID NO: 435924 - RNA, 19 nt, Human
ucagcugggagaggugggg

SEQ ID NO: 435925 - RNA, 19 nt, Human
ucaggccaucaccacugca

SEQ ID NO: 435926 - RNA, 20 nt, Human
ucagggcacccugggggugg

SEQ ID NO: 435927 - RNA, 25 nt, Human
ucauauccacacacgcacucacaca

SEQ ID NO: 435928 - RNA, 18 nt, Human
uccacacacgcacucaca

SEQ ID NO: 435929 - RNA, 20 nt, Human
uccagggcagugagcaagag

SEQ ID NO: 435930 - RNA, 22 nt, Human
ucccucugucucccugugguag

SEQ ID NO: 435931 - RNA, 18 nt, Human
ucgcaaacacuccgacuc

SEQ ID NO: 435932 - RNA, 20 nt, Human
ucuaggcugaaggccuuugg

SEQ ID NO: 435933 - RNA, 23 nt, Human
ucuccagccccuaacugaacaaa

SEQ ID NO: 435934 - RNA, 25 nt, Human
ucuccagccccuaacugaacaaaca

SEQ ID NO: 435935 - RNA, 19 nt, Human
ucuggggaaggaacugccc

SEQ ID NO: 435936 - RNA, 20 nt, Human
ugaaggccuuuggaccacuc

SEQ ID NO: 435937 - RNA, 18 nt, Human
ugaggagggagcacagcc

SEQ ID NO: 435938 - RNA, 20 nt, Human
ugccuggggccucagggcac

SEQ ID NO: 435939 - RNA, 19 nt, Human
ugcgagggacaggcuuggg

SEQ ID NO: 435940 - RNA, 23 nt, Human
uggaaagcgagguccuggaacca

SEQ ID NO: 435941 - RNA, 23 nt, Human
uggaaccagcaggugccuuaaac

SEQ ID NO: 435942 - RNA, 19 nt, Human
uggaggcagcagcugccug

SEQ ID NO: 435943 - RNA, 21 nt, Human
uggcaacaaaaccagacagaa

SEQ ID NO: 435944 - RNA, 25 nt, Human
uggcacucuggucuggcccacuccc

SEQ ID NO: 435945 - RNA, 23 nt, Human
ugggagagguggggcccuggagg

SEQ ID NO: 435946 - RNA, 21 nt, Human
ugguccuggaaccuguggaca

SEQ ID NO: 435947 - RNA, 25 nt, Human
uggugggagugucuuugaguguagc

SEQ ID NO: 435948 - RNA, 20 nt, Human
ugucacaggugagggugccg

SEQ ID NO: 435949 - RNA, 19 nt, Human
ugucuuugaguguagcuuc

SEQ ID NO: 435950 - RNA, 21 nt, Human
ugugcacacacacucauaucc

SEQ ID NO: 435951 - RNA, 27 nt, Human
ugugcacacacacucauauccacacac

SEQ ID NO: 435952 - RNA, 22 nt, Human
uguuucagaaaaucuaaccagc

SEQ ID NO: 435953 - RNA, 18 nt, Human
uugauuccagggcaguga

SEQ ID NO: 435954 - RNA, 23 nt, Human
uuucacacauaccugcugcugug

SEQ ID NO: 435955 - RNA, 19 nt, Human
aaaaaagaaagcauuacgg

SEQ ID NO: 435956 - RNA, 21 nt, Human
aaaacaaauaaaucccuaagc

SEQ ID NO: 435957 - RNA, 23 nt, Human
aaaacaaauaaaucccuaagcca

SEQ ID NO: 435958 - RNA, 21 nt, Human
aaacaaauaaaucccuaagcc

SEQ ID NO: 435959 - RNA, 20 nt, Human
aaacaaauaaaucccuaagg

SEQ ID NO: 435960 - RNA, 24 nt, Human
aaacagaagcauuaacaaaacacc

SEQ ID NO: 435961 - RNA, 20 nt, Human
aaacuuagaaauaacucaug

SEQ ID NO: 435962 - RNA, 18 nt, Human
aaagcuuccccaagacac

SEQ ID NO: 435963 - RNA, 20 nt, Human
aaaggaaaaaagaaagcauu

SEQ ID NO: 435964 - RNA, 19 nt, Human
aaaguuccucuacguacuc

SEQ ID NO: 435965 - RNA, 18 nt, Human
aacagcuccaggcagagc

SEQ ID NO: 435966 - RNA, 24 nt, Human
aagcgccacauuacagaggaaaug

SEQ ID NO: 435967 - RNA, 26 nt, Human
acaaaacaacuaaugaaaauuaccca

SEQ ID NO: 435968 - RNA, 23 nt, Human
acaaagcuuccccaagacaccag

SEQ ID NO: 435969 - RNA, 18 nt, Human
accaaggaauaccgacag

SEQ ID NO: 435970 - RNA, 21 nt, Human
acccauuguuacccucccccc

SEQ ID NO: 435971 - RNA, 18 nt, Human
accuacagccaccgccgc

SEQ ID NO: 435972 - RNA, 25 nt, Human
agaagaccacccauuguuacccucc

SEQ ID NO: 435973 - RNA, 18 nt, Human
agcagacagaauccuuag

SEQ ID NO: 435974 - RNA, 18 nt, Human
agccgcacaaccuacagc

SEQ ID NO: 435975 - RNA, 21 nt, Human
agccgcugcagccgcacaacc

SEQ ID NO: 435976 - RNA, 22 nt, Human
aggaaaaaagaaagcauuacgg

SEQ ID NO: 435977 - RNA, 24 nt, Human
aggcagagcacaaguagaagaaaa

SEQ ID NO: 435978 - RNA, 23 nt, Human
augccuacuuagaagaaacaaag

SEQ ID NO: 435979 - RNA, 20 nt, Human
auggaaacagcuccaggcag

SEQ ID NO: 435980 - RNA, 19 nt, Human
caaaacaccagaucuuaag

SEQ ID NO: 435981 - RNA, 23 nt, Human
caaaacacuuuaguucugaaccu

SEQ ID NO: 435982 - RNA, 20 nt, Human
caacaaaacccacccaaaac

SEQ ID NO: 435983 - RNA, 19 nt, Human
cacaaccuacagccaccgc

SEQ ID NO: 435984 - RNA, 24 nt, Human
cacaaccuacagccaccgccgccc

SEQ ID NO: 435985 - RNA, 21 nt, Human
cagaagaccacccauuguuac

SEQ ID NO: 435986 - RNA, 27 nt, Human
cagaagaccacccauuguuacccuccc

SEQ ID NO: 435987 - RNA, 27 nt, Human
cagagcacaaguagaagaaaaccugcc

SEQ ID NO: 435988 - RNA, 19 nt, Human
cagcagacagaauccuuag

SEQ ID NO: 435989 - RNA, 18 nt, Human
ccaaaucaaaguacugua

SEQ ID NO: 435990 - RNA, 22 nt, Human
ccaucccgaaccaccccccauc

SEQ ID NO: 435991 - RNA, 22 nt, Human
cccccccgcaacaaaacccacc

SEQ ID NO: 435992 - RNA, 26 nt, Human
cccccgcaacaaaacccacccaaaac

SEQ ID NO: 435993 - RNA, 22 nt, Human
cccgaaccaccccccaucccag

SEQ ID NO: 435994 - RNA, 25 nt, Human
cccgaaccaccccccaucccaguaa

SEQ ID NO: 435995 - RNA, 22 nt, Human
cccgcaacaaaacccacccaaa

SEQ ID NO: 435996 - RNA, 24 nt, Human
cccgcaacaaaacccacccaaaac

SEQ ID NO: 435997 - RNA, 18 nt, Human
ccgcaacaaaacccaccc

SEQ ID NO: 435998 - RNA, 24 nt, Human
ccuacagccaccgccgcccggccg

SEQ ID NO: 435999 - RNA, 26 nt, Human
ccuacagccaccgccgcccggccguu

SEQ ID NO: 436000 - RNA, 18 nt, Human
ccuggaguugaaugaguu

SEQ ID NO: 436001 - RNA, 22 nt, Human
cgcaacaaaacccacccaaaac

SEQ ID NO: 436002 - RNA, 25 nt, Human
cuacagccaccgccgcccggccguu

SEQ ID NO: 436003 - RNA, 24 nt, Human
cucaaaaauaaaaaucagaagacc

SEQ ID NO: 436004 - RNA, 21 nt, Human
cuggaauaaacagaagcauua

SEQ ID NO: 436005 - RNA, 19 nt, Human
gcaacaaaacccacccaaa

SEQ ID NO: 436006 - RNA, 22 nt, Human
gcagacagaauccuuagcccuc

SEQ ID NO: 436007 - RNA, 20 nt, Human
gcagagcacaaguagaagaa

SEQ ID NO: 436008 - RNA, 18 nt, Human
gccacauaguaauggaau

SEQ ID NO: 436009 - RNA, 18 nt, Human
gcccagggaagagccgcu

SEQ ID NO: 436010 - RNA, 18 nt, Human
gcugcagccgcacaaccu

SEQ ID NO: 436011 - RNA, 19 nt, Human
gcugcccacccaucccgaa

SEQ ID NO: 436012 - RNA, 19 nt, Human
gcuuguuuuauuaagcacu

SEQ ID NO: 436013 - RNA, 21 nt, Human
ggcaauaaaggaaaaaagaaa

SEQ ID NO: 436014 - RNA, 19 nt, Human
guccuggaguugaaugagu

SEQ ID NO: 436015 - RNA, 21 nt, Human
uaaaugccuacuuagaagaaa

SEQ ID NO: 436016 - RNA, 23 nt, Human
uaagcacuggucaguuauauaaa

SEQ ID NO: 436017 - RNA, 26 nt, Human
uacagccaccgccgcccggccguuuu

SEQ ID NO: 436018 - RNA, 21 nt, Human
uacaggaaugaucuaaaugcc

SEQ ID NO: 436019 - RNA, 20 nt, Human
uagaagaaaaccugccaaau

SEQ ID NO: 436020 - RNA, 19 nt, Human
uagaagaaacaaagcagca

SEQ ID NO: 436021 - RNA, 26 nt, Human
uagaagaaacaaagcagcagacagaa

SEQ ID NO: 436022 - RNA, 20 nt, Human
uauaaaagaauaauuugcaa

SEQ ID NO: 436023 - RNA, 18 nt, Human
ucagcagcugcccaccca

SEQ ID NO: 436024 - RNA, 22 nt, Human
uccaguugacaaaaccucaaaa

SEQ ID NO: 436025 - RNA, 18 nt, Human
ucccaguaauauguaaaa

SEQ ID NO: 436026 - RNA, 20 nt, Human
ucccuaagaaguucacagga

SEQ ID NO: 436027 - RNA, 18 nt, Human
ucccuaagccacauagua

SEQ ID NO: 436028 - RNA, 18 nt, Human
ucuacguacuccaguuga

SEQ ID NO: 436029 - RNA, 21 nt, Human
ugaaccuaacauuucccuaag

SEQ ID NO: 436030 - RNA, 18 nt, Human
ugcccacccaucccgaac

SEQ ID NO: 436031 - RNA, 20 nt, Human
ugccuacuuagaagaaacaa

SEQ ID NO: 436032 - RNA, 20 nt, Human
uggaauacuacacuugcuuu

SEQ ID NO: 436033 - RNA, 22 nt, Human
uggcaauaaaggaaaaaagaaa

SEQ ID NO: 436034 - RNA, 24 nt, Human
uguaaauaaaguuccucuacguac

SEQ ID NO: 436035 - RNA, 24 nt, Human
uuacggguaugaugggaacaagcu

SEQ ID NO: 436036 - RNA, 21 nt, Human
uucaaaucaaaacaaacaaaa

SEQ ID NO: 436037 - RNA, 24 nt, Human
uuccucuacguacuccaguugaca

SEQ ID NO: 436038 - RNA, 25 nt, Human
uuccucuacguacuccaguugacaa

SEQ ID NO: 436039 - RNA, 20 nt, Human
uuuuaaauguuacuuuucca

SEQ ID NO: 436040 - RNA, 21 nt, Human
uuuuucagauaccaaggaaua

SEQ ID NO: 436041 - RNA, 23 nt, Human
uuuuuuuuuuuuuuuuuuauuuu

SEQ ID NO: 436042 - RNA, 20 nt, Human
aaaaccagccauccagacaa

SEQ ID NO: 436043 - RNA, 22 nt, Human
aaaaccucaaaaccagccaucc

SEQ ID NO: 436044 - RNA, 19 nt, Human
aaacagaaugcgaguaauc

SEQ ID NO: 436045 - RNA, 23 nt, Human
aaacagaaugcgaguaaucagaa

SEQ ID NO: 436046 - RNA, 19 nt, Human
aaagaaaaccuuuuggggg

SEQ ID NO: 436047 - RNA, 21 nt, Human
aaagcaagaaacagaaugcga

SEQ ID NO: 436048 - RNA, 19 nt, Human
aagcaagaaacagaaugcg

SEQ ID NO: 436049 - RNA, 29 nt, Human
aagcaagaaacagaaugcgaggggacccc

SEQ ID NO: 436050 - RNA, 21 nt, Human
aagcucuugcacugcacacuu

SEQ ID NO: 436051 - RNA, 27 nt, Human
aagucagguuuaaaaccucaaaaccag

SEQ ID NO: 436052 - RNA, 20 nt, Human
accucccuaaccccaauaac

SEQ ID NO: 436053 - RNA, 22 nt, Human
agaaagauuaucucuuccccac

SEQ ID NO: 436054 - RNA, 19 nt, Human
agaaagcagcaggcucggu

SEQ ID NO: 436055 - RNA, 21 nt, Human
agagauuggcggcgggagaca

SEQ ID NO: 436056 - RNA, 22 nt, Human
agagauuggcggcgggagacaa

SEQ ID NO: 436057 - RNA, 20 nt, Human
agcaagaaagcagcaggcuc

SEQ ID NO: 436058 - RNA, 19 nt, Human
aggcaggcaggcagucgcc

SEQ ID NO: 436059 - RNA, 23 nt, Human
aucuaaagaaaaacacaaucacu

SEQ ID NO: 436060 - RNA, 18 nt, Human
aucugcauggugauacac

SEQ ID NO: 436061 - RNA, 23 nt, Human
cacuagcaggcaucaguuaaucc

SEQ ID NO: 436062 - RNA, 24 nt, Human
cacuucuuuuuguuacacauaaga

SEQ ID NO: 436063 - RNA, 21 nt, Human
cagaaagaacuaaaacccacu

SEQ ID NO: 436064 - RNA, 20 nt, Human
cagggcacagaaagaacuaa

SEQ ID NO: 436065 - RNA, 23 nt, Human
ccagacaaaacagguaaucagaa

SEQ ID NO: 436066 - RNA, 21 nt, Human
ccauccagacaaaacagguaa

SEQ ID NO: 436067 - RNA, 18 nt, Human
ccccaauaacuaugaagc

SEQ ID NO: 436068 - RNA, 21 nt, Human
ccccaauaacuaugaagccaa

SEQ ID NO: 436069 - RNA, 18 nt, Human
ccgucugcuccgugcugc

SEQ ID NO: 436070 - RNA, 19 nt, Human
ccugcugcugcugcugccg

SEQ ID NO: 436071 - RNA, 19 nt, Human
cgaagcaguagcaagaaag

SEQ ID NO: 436072 - RNA, 21 nt, Human
cgaagcaguagcaagaaagca

SEQ ID NO: 436073 - RNA, 21 nt, Human
cggcuaucacuuccgcaaccc

SEQ ID NO: 436074 - RNA, 26 nt, Human
cuaaaacccacuucuuuuuguuacac

SEQ ID NO: 436075 - RNA, 18 nt, Human
cucaaaguauaaaaagua

SEQ ID NO: 436076 - RNA, 21 nt, Human
cuccucgccugcugcugcugc

SEQ ID NO: 436077 - RNA, 21 nt, Human
cucgccugcugcugcugcugc

SEQ ID NO: 436078 - RNA, 18 nt, Human
cucuugucuuuacucuuc

SEQ ID NO: 436079 - RNA, 22 nt, Human
cugcuaggggccagagauuggc

SEQ ID NO: 436080 - RNA, 25 nt, Human
cuguauaaucauguuugguguuacu

SEQ ID NO: 436081 - RNA, 22 nt, Human
cuugcacugcacacuuagaagu

SEQ ID NO: 436082 - RNA, 23 nt, Human
gaagccgaagcaguagcaagaaa

SEQ ID NO: 436083 - RNA, 19 nt, Human
gccgccgucugcuccgugc

SEQ ID NO: 436084 - RNA, 24 nt, Human
gggccagagauuggcggcgggaga

SEQ ID NO: 436085 - RNA, 19 nt, Human
ggggaagggguggagaggg

SEQ ID NO: 436086 - RNA, 22 nt, Human
gggggaagggguggagagggau

SEQ ID NO: 436087 - RNA, 27 nt, Human
uacaauucaagcauuauagagcuaucu

SEQ ID NO: 436088 - RNA, 23 nt, Human
uagccgggaagccgaagcaguag

SEQ ID NO: 436089 - RNA, 23 nt, Human
uauaaacaagcucuugcacugca

SEQ ID NO: 436090 - RNA, 23 nt, Human
ucaaucuaaagaaaaacacaauc

SEQ ID NO: 436091 - RNA, 26 nt, Human
ucagaaagauuaucucuuccccaccu

SEQ ID NO: 436092 - RNA, 18 nt, Human
ucagaaagcacuagcagg

SEQ ID NO: 436093 - RNA, 24 nt, Human
ucccacgaguguguaugccaaguc

SEQ ID NO: 436094 - RNA, 18 nt, Human
uccccaccucccuaaccc

SEQ ID NO: 436095 - RNA, 21 nt, Human
uccccaccucccuaaccccaa

SEQ ID NO: 436096 - RNA, 22 nt, Human
uccgcaacccaggcaggcaggc

SEQ ID NO: 436097 - RNA, 23 nt, Human
uccgugcugcuaggggccagaga

SEQ ID NO: 436098 - RNA, 24 nt, Human
uccucgccugcugcugcugcugcc

SEQ ID NO: 436099 - RNA, 20 nt, Human
ucuaaagaaaaacacaauca

SEQ ID NO: 436100 - RNA, 18 nt, Human
ucuuccccaccucccuaa

SEQ ID NO: 436101 - RNA, 24 nt, Human
ucuucuuuuaaagcaagaaacaga

SEQ ID NO: 436102 - RNA, 21 nt, Human
ucuuugacuuuuuuuccucaa

SEQ ID NO: 436103 - RNA, 19 nt, Human
ugcacacuuagaaguguac

SEQ ID NO: 436104 - RNA, 21 nt, Human
uggaagcacuccauaauaacu

SEQ ID NO: 436105 - RNA, 21 nt, Human
uggggggaagggguggagagg

SEQ ID NO: 436106 - RNA, 24 nt, Human
uuaucucuuccccaccucccuaac

SEQ ID NO: 436107 - RNA, 21 nt, Human
uucaccguccgggggguagcc

SEQ ID NO: 436108 - RNA, 22 nt, Human
uuggucaugguuuuuucccuca

SEQ ID NO: 436109 - RNA, 25 nt, Human
uuuaaaaccucaaaaccagccaucc

SEQ ID NO: 436110 - RNA, 21 nt, Human
uuuuuuuuuuuuuuuuacugg

SEQ ID NO: 436111 - RNA, 23 nt, Human
uuuuuuuuuuuuuuuuuuacugg

SEQ ID NO: 436112 - RNA, 27 nt, Human
aaaaaaaaaaaaaaaaaacgcucagaa

SEQ ID NO: 436113 - RNA, 21 nt, Human
aaaaaaaaaaaacgcucagaa

SEQ ID NO: 436114 - RNA, 27 nt, Human
aaacaacagcaaaugcaauaaaaacaa

SEQ ID NO: 436115 - RNA, 24 nt, Human
aaagauccuugauuuggagagggc

SEQ ID NO: 436116 - RNA, 20 nt, Human
aaaguuucuuuauagaguuu

SEQ ID NO: 436117 - RNA, 20 nt, Human
acagaacagcagcacacuaa

SEQ ID NO: 436118 - RNA, 19 nt, Human
accaaaaaaaaaaaaaaaa

SEQ ID NO: 436119 - RNA, 23 nt, Human
accaaaaaaaaaaaaaaaaaaaa

SEQ ID NO: 436120 - RNA, 20 nt, Human
acuccauuagccagguccaa

SEQ ID NO: 436121 - RNA, 21 nt, Human
agaacagcagcacacuaaaca

SEQ ID NO: 436122 - RNA, 21 nt, Human
auguacacagaacagcagcac

SEQ ID NO: 436123 - RNA, 25 nt, Human
caaagggucuucuuucuuaacauuu

SEQ ID NO: 436124 - RNA, 18 nt, Human
cacagaacagcagcacac

SEQ ID NO: 436125 - RNA, 23 nt, Human
cagagcaacauuuuucaacaaag

SEQ ID NO: 436126 - RNA, 21 nt, Human
cagcaaaugcaauaaaaacaa

SEQ ID NO: 436127 - RNA, 23 nt, Human
ccaaaaaaaaaaaaaaaaaaaaa

SEQ ID NO: 436128 - RNA, 25 nt, Human
ccagaccaaaaaaaaaaaaaaaaaa

SEQ ID NO: 436129 - RNA, 22 nt, Human
ccagagcaacauuuuucaacaa

SEQ ID NO: 436130 - RNA, 24 nt, Human
ccagagcaacauuuuucaacaaag

SEQ ID NO: 436131 - RNA, 23 nt, Human
cccagaccaaaaaaaaaaaaaaa

SEQ ID NO: 436132 - RNA, 26 nt, Human
cccagagcaacauuuuucuccuacgg

SEQ ID NO: 436133 - RNA, 18 nt, Human
cggcaaugcaguaagucu

SEQ ID NO: 436134 - RNA, 23 nt, Human
cuaaacauucacaagcugugucc

SEQ ID NO: 436135 - RNA, 22 nt, Human
cuccaguucagagucccauuuc

SEQ ID NO: 436136 - RNA, 19 nt, Human
cuuuauagaguuugcaagg

SEQ ID NO: 436137 - RNA, 19 nt, Human
uaaaguaaugcuuggaagc

SEQ ID NO: 436138 - RNA, 21 nt, Human
uagaaacaacagcaaaugcaa

SEQ ID NO: 436139 - RNA, 18 nt, Human
uagcuuagcagcuccagu

SEQ ID NO: 436140 - RNA, 24 nt, Human
uauguacacagaacagcagcacag

SEQ ID NO: 436141 - RNA, 25 nt, Human
ucauaaaacauauucggaagcccag

SEQ ID NO: 436142 - RNA, 23 nt, Human
ucccagagcaacauuuuucaaca

SEQ ID NO: 436143 - RNA, 22 nt, Human
ucccugggucuuccucggagac

SEQ ID NO: 436144 - RNA, 18 nt, Human
uccuugauuuggagaggg

SEQ ID NO: 436145 - RNA, 24 nt, Human
ugauuuaaaaaaaauagcaguagu

SEQ ID NO: 436146 - RNA, 22 nt, Human
uguaaaaucaaccgucauaaaa

SEQ ID NO: 436147 - RNA, 22 nt, Human
uuaaaaaaaauagcaguaguuc

SEQ ID NO: 436148 - RNA, 20 nt, Human
agggaccucugugcucagag

SEQ ID NO: 436149 - RNA, 18 nt, Human
cacguggccccagagggu

SEQ ID NO: 436150 - RNA, 25 nt, Human
cagaugggaagacugagguugggga

SEQ ID NO: 436151 - RNA, 20 nt, Human
cauuuuauagaaagggaaau

SEQ ID NO: 436152 - RNA, 21 nt, Human
cauuuuauagaaagggaaauu

SEQ ID NO: 436153 - RNA, 19 nt, Human
ccacguggccccagagggu

SEQ ID NO: 436154 - RNA, 19 nt, Human
cugguguggggugcagaac

SEQ ID NO: 436155 - RNA, 23 nt, Human
gaacauggugcaugguagguggc

SEQ ID NO: 436156 - RNA, 18 nt, Human
gaggccagggguugggga

SEQ ID NO: 436157 - RNA, 18 nt, Human
ggaagacugagguugggg

SEQ ID NO: 436158 - RNA, 21 nt, Human
gggaagacugagguuggggag

SEQ ID NO: 436159 - RNA, 24 nt, Human
ucccgggccaccaggacuggcguc

SEQ ID NO: 436160 - RNA, 23 nt, Human
ucuuccauuuuauagaaagggaa

SEQ ID NO: 436161 - RNA, 23 nt, Human
ugccucaggacccaucguucaga

SEQ ID NO: 436162 - RNA, 19 nt, Human
uggcaaggaacauggugca

SEQ ID NO: 436163 - RNA, 21 nt, Human
uggggugcagaaccgcugaug

SEQ ID NO: 436164 - RNA, 20 nt, Human
ugguagguggcagaagggac

SEQ ID NO: 436165 - RNA, 19 nt, Human
uucccgggccaccaggacu

SEQ ID NO: 436166 - RNA, 23 nt, Human
uuuuuuuuuuuuuuucuggacau

SEQ ID NO: 436167 - RNA, 23 nt, Human
uuuuuuuuuuuuuuuuuucuggg

SEQ ID NO: 436168 - RNA, 22 nt, Human
aaaguuccuuuucacccuacuc

SEQ ID NO: 436169 - RNA, 25 nt, Human
aaaugagacugcggggccugggagc

SEQ ID NO: 436170 - RNA, 19 nt, Human
acaguaucuauuguucagu

SEQ ID NO: 436171 - RNA, 18 nt, Human
agggaggggacacauggg

SEQ ID NO: 436172 - RNA, 22 nt, Human
agggaggggacacaugggacug

SEQ ID NO: 436173 - RNA, 21 nt, Human
auacauagucuuaagaacaua

SEQ ID NO: 436174 - RNA, 22 nt, Human
augcuguaauguucauugaaau

SEQ ID NO: 436175 - RNA, 22 nt, Human
caaaaaaagaguggcuuccccc

SEQ ID NO: 436176 - RNA, 19 nt, Human
cagcuuuauuaaaguguaa

SEQ ID NO: 436177 - RNA, 22 nt, Human
ccaaaaaaagaguggcuucccc

SEQ ID NO: 436178 - RNA, 23 nt, Human
ccaaaaaaagaguggcuuccccc

SEQ ID NO: 436179 - RNA, 24 nt, Human
cccaaaaaaagaguggcuuccccc

SEQ ID NO: 436180 - RNA, 25 nt, Human
ccccgcgccugucaccggucccgga

SEQ ID NO: 436181 - RNA, 22 nt, Human
cccucuguugaggagccggaga

SEQ ID NO: 436182 - RNA, 23 nt, Human
ccggagaggggcucggggcgcag

SEQ ID NO: 436183 - RNA, 22 nt, Human
cgcuagcgcgccggggucacgc

SEQ ID NO: 436184 - RNA, 24 nt, Human
cggagaggggcucggggcgcagcg

SEQ ID NO: 436185 - RNA, 21 nt, Human
cggcgagcccucuguugagga

SEQ ID NO: 436186 - RNA, 26 nt, Human
cuacucugcuacuauuauucuaguau

SEQ ID NO: 436187 - RNA, 22 nt, Human
cuuagcuuucagaacagaaagu

SEQ ID NO: 436188 - RNA, 24 nt, Human
gaggagccggagaggggcucgggg

SEQ ID NO: 436189 - RNA, 20 nt, Human
gcaaaugagacugcggggcc

SEQ ID NO: 436190 - RNA, 19 nt, Human
gcgcagcgacugcggcggc

SEQ ID NO: 436191 - RNA, 24 nt, Human
gcggcaaaugagacugcggggccu

SEQ ID NO: 436192 - RNA, 18 nt, Human
ggcagccggggacgccag

SEQ ID NO: 436193 - RNA, 19 nt, Human
ggccgcugggccccaggca

SEQ ID NO: 436194 - RNA, 18 nt, Human
ggggacgccaggagggaa

SEQ ID NO: 436195 - RNA, 21 nt, Human
ucccggacgcuagcgcgccgg

SEQ ID NO: 436196 - RNA, 20 nt, Human
ucuccacagcgcucccuacc

SEQ ID NO: 436197 - RNA, 21 nt, Human
ucuccacagcgcucccuacca

SEQ ID NO: 436198 - RNA, 21 nt, Human
ugcccaaaaaaagaguggcuu

SEQ ID NO: 436199 - RNA, 22 nt, Human
ugcccaaaaaaagaguggcuuc

SEQ ID NO: 436200 - RNA, 26 nt, Human
ugggacugcuuggcgcaccccgcgcc

SEQ ID NO: 436201 - RNA, 23 nt, Human
uguugaggagccggagaggggcu

SEQ ID NO: 436202 - RNA, 21 nt, Human
uuaaagauuccaugagacaag

SEQ ID NO: 436203 - RNA, 24 nt, Human
uucacacuaaauauuuuguaauga

SEQ ID NO: 436204 - RNA, 23 nt, Human
uucaguguguuacaauuuuucuc

SEQ ID NO: 436205 - RNA, 23 nt, Human
acacugaagucuucaagucccca

SEQ ID NO: 436206 - RNA, 18 nt, Human
agaagaagauggggaaga

SEQ ID NO: 436207 - RNA, 21 nt, Human
agaagaagauggggaagagga

SEQ ID NO: 436208 - RNA, 23 nt, Human
agagaagaagauggggaagagga

SEQ ID NO: 436209 - RNA, 18 nt, Human
agaggaagggagggcggc

SEQ ID NO: 436210 - RNA, 28 nt, Human
agcccuggagccccuuccacccaauccc

SEQ ID NO: 436211 - RNA, 25 nt, Human
cagcagcacccuccccgccgggucc

SEQ ID NO: 436212 - RNA, 18 nt, Human
caggcagccaggcccaug

SEQ ID NO: 436213 - RNA, 25 nt, Human
cagggcagcacccaugggcuccacc

SEQ ID NO: 436214 - RNA, 26 nt, Human
ccaccuugcuuuuuuuuuuuuuuuuu

SEQ ID NO: 436215 - RNA, 23 nt, Human
cccacauggggagcaccaggagc

SEQ ID NO: 436216 - RNA, 21 nt, Human
cccagcugccagcucccccca

SEQ ID NO: 436217 - RNA, 18 nt, Human
cccaugggcuccaccagc

SEQ ID NO: 436218 - RNA, 19 nt, Human
ccccuuccacccaauccca

SEQ ID NO: 436219 - RNA, 20 nt, Human
cccgccgggucccaccuugc

SEQ ID NO: 436220 - RNA, 18 nt, Human
ccuccccuagguaaagau

SEQ ID NO: 436221 - RNA, 19 nt, Human
ccuugcuuuuuuuuuuuuu

SEQ ID NO: 436222 - RNA, 24 nt, Human
cgcacuggaucuugcccagcugcc

SEQ ID NO: 436223 - RNA, 20 nt, Human
cgcggagacgccacaagcca

SEQ ID NO: 436224 - RNA, 26 nt, Human
cgggucccaccuugcuuuuuuuuuuu

SEQ ID NO: 436225 - RNA, 24 nt, Human
cugaagucuucaaguccccagcaa

SEQ ID NO: 436226 - RNA, 18 nt, Human
cuggagccccuuccaccc

SEQ ID NO: 436227 - RNA, 20 nt, Human
cugggcuccugccucaccgc

SEQ ID NO: 436228 - RNA, 22 nt, Human
cugugguuccucaguuucuccu

SEQ ID NO: 436229 - RNA, 18 nt, Human
gaagauggggaagaggaa

SEQ ID NO: 436230 - RNA, 22 nt, Human
gaagauggggaagaggaaggga

SEQ ID NO: 436231 - RNA, 18 nt, Human
gagaagaagauggggaag

SEQ ID NO: 436232 - RNA, 24 nt, Human
gagaagaagauggggaagaggaag

SEQ ID NO: 436233 - RNA, 23 nt, Human
gagagaagaagauggggaagagg

SEQ ID NO: 436234 - RNA, 18 nt, Human
gagcaccaggagcccugg

SEQ ID NO: 436235 - RNA, 20 nt, Human
gagcaccaggagcccuggag

SEQ ID NO: 436236 - RNA, 22 nt, Human
gagccccuuccacccaaggcac

SEQ ID NO: 436237 - RNA, 18 nt, Human
gcacuggaucuugcccag

SEQ ID NO: 436238 - RNA, 18 nt, Human
gcccauggcuggaaggcc

SEQ ID NO: 436239 - RNA, 26 nt, Human
gcccuggagccccuuccaaccggagg

SEQ ID NO: 436240 - RNA, 19 nt, Human
gcccuggagccccuuccac

SEQ ID NO: 436241 - RNA, 21 nt, Human
ggagccccuuccacccaaucc

SEQ ID NO: 436242 - RNA, 21 nt, Human
ggcccauggcuggaaggccgg

SEQ ID NO: 436243 - RNA, 21 nt, Human
ggcucuacucaagcaccacga

SEQ ID NO: 436244 - RNA, 21 nt, Human
gggcagcacccaugggcucca

SEQ ID NO: 436245 - RNA, 24 nt, Human
gggcuccaccagcccagcucuguc

SEQ ID NO: 436246 - RNA, 18 nt, Human
gggguguuuccuuccucu

SEQ ID NO: 436247 - RNA, 20 nt, Human
ucccacauggggagcaccag

SEQ ID NO: 436248 - RNA, 19 nt, Human
uccccagcaaccaaguugg

SEQ ID NO: 436249 - RNA, 21 nt, Human
uccucaguuucuccugccagc

SEQ ID NO: 436250 - RNA, 20 nt, Human
ucuccgggcgggggcucccg

SEQ ID NO: 436251 - RNA, 24 nt, Human
ucugggcuccugccucaccgcugg

SEQ ID NO: 436252 - RNA, 22 nt, Human
ucuucaggcagccaggcccaug

SEQ ID NO: 436253 - RNA, 24 nt, Human
ucuucaggcagccaggcccauggc

SEQ ID NO: 436254 - RNA, 22 nt, Human
ucuugcccagcugccagcuccc

SEQ ID NO: 436255 - RNA, 18 nt, Human
ugccagcuccccccacca

SEQ ID NO: 436256 - RNA, 20 nt, Human
ugccagcuccccccaccagg

SEQ ID NO: 436257 - RNA, 19 nt, Human
ugccucaccgcugguucag

SEQ ID NO: 436258 - RNA, 19 nt, Human
uggggaagaggaagggagg

SEQ ID NO: 436259 - RNA, 22 nt, Human
uggggaagaggaagggagggcg

SEQ ID NO: 436260 - RNA, 18 nt, Human
uuccucaguuucuccugc

SEQ ID NO: 436261 - RNA, 22 nt, Human
uuuccuuccucuucaggcagcc

SEQ ID NO: 436262 - RNA, 19 nt, Human
uuuuuuuuuuugaguggac

SEQ ID NO: 436263 - RNA, 21 nt, Human
uuuuuuuuuuuuuugagugga

SEQ ID NO: 436264 - RNA, 22 nt, Human
uuuuuuuuuuuuuuuugagugg

SEQ ID NO: 436265 - RNA, 18 nt, Human
uuuuuuuuuuuuuuuuug

SEQ ID NO: 436266 - RNA, 23 nt, Human
acagguuacaaaauuaaaaccaa

SEQ ID NO: 436267 - RNA, 21 nt, Human
aggcauugaagccuagcaacu

SEQ ID NO: 436268 - RNA, 28 nt, Human
agucauucagcauuguaguaagaaaaca

SEQ ID NO: 436269 - RNA, 22 nt, Human
cagcauuguaguaagaaaacac

SEQ ID NO: 436270 - RNA, 20 nt, Human
cccacgcaugcuaucuucca

SEQ ID NO: 436271 - RNA, 21 nt, Human
cggaaagugaugugacgcucc

SEQ ID NO: 436272 - RNA, 21 nt, Human
cuagccauaucaguucuucuu

SEQ ID NO: 436273 - RNA, 22 nt, Human
gguuacaaaauuaaaaccaaca

SEQ ID NO: 436274 - RNA, 19 nt, Human
uacaaaauuaaaaccaaca

SEQ ID NO: 436275 - RNA, 23 nt, Human
ucccaccaggcucagagauaccc

SEQ ID NO: 436276 - RNA, 22 nt, Human
ugcuaccgauaggcauugaagc

SEQ ID NO: 436277 - RNA, 24 nt, Human
aaaauaacaagugcaaacaugcug

SEQ ID NO: 436278 - RNA, 24 nt, Human
aaaauaugaagcagcucuaaacac

SEQ ID NO: 436279 - RNA, 21 nt, Human
aaacaggaugacagguuuuua

SEQ ID NO: 436280 - RNA, 24 nt, Human
aaagauaaauuucuaaagccaaag

SEQ ID NO: 436281 - RNA, 21 nt, Human
aaaguacuucaguaucaauug

SEQ ID NO: 436282 - RNA, 19 nt, Human
aaauaauguucgugaccau

SEQ ID NO: 436283 - RNA, 18 nt, Human
aacacagcuacuucaucu

SEQ ID NO: 436284 - RNA, 20 nt, Human
aacacagcuacuucaucugu

SEQ ID NO: 436285 - RNA, 20 nt, Human
aacuaaagagcaaugcaaua

SEQ ID NO: 436286 - RNA, 18 nt, Human
aagaagucugaacacagc

SEQ ID NO: 436287 - RNA, 21 nt, Human
aagaagucugaacacagccua

SEQ ID NO: 436288 - RNA, 18 nt, Human
aagcagcucuaaacacca

SEQ ID NO: 436289 - RNA, 19 nt, Human
aagcagcucuaaacaccaa

SEQ ID NO: 436290 - RNA, 23 nt, Human
aagcauaaauaauguucgugacc

SEQ ID NO: 436291 - RNA, 20 nt, Human
aagugcaaacaugcugaacc

SEQ ID NO: 436292 - RNA, 18 nt, Human
aauugccauaacacucag

SEQ ID NO: 436293 - RNA, 18 nt, Human
acaaaguaaugaguuaaa

SEQ ID NO: 436294 - RNA, 23 nt, Human
acagaagacaauuuacugccaca

SEQ ID NO: 436295 - RNA, 19 nt, Human
acagguuuuuaugaaggag

SEQ ID NO: 436296 - RNA, 19 nt, Human
accuguaaaagauuccccc

SEQ ID NO: 436297 - RNA, 23 nt, Human
acuucaucuguucucuuuuugca

SEQ ID NO: 436298 - RNA, 26 nt, Human
agucaagaaaugaaacaaagggaccc

SEQ ID NO: 436299 - RNA, 21 nt, Human
augaagcagcucuaaacacca

SEQ ID NO: 436300 - RNA, 24 nt, Human
auggaacuaguuuaaaauaugaag

SEQ ID NO: 436301 - RNA, 25 nt, Human
caaaacucucaagauaccagcacau

SEQ ID NO: 436302 - RNA, 19 nt, Human
caaaauaacaagugcaaac

SEQ ID NO: 436303 - RNA, 18 nt, Human
caaagcauuaaacugccu

SEQ ID NO: 436304 - RNA, 22 nt, Human
caacuaaagagcaaugcaauau

SEQ ID NO: 436305 - RNA, 21 nt, Human
cacaacucugagaugauuaga

SEQ ID NO: 436306 - RNA, 22 nt, Human
cacacaggaaucaaccacagcu

SEQ ID NO: 436307 - RNA, 21 nt, Human
ccaaacucacacccacaaggu

SEQ ID NO: 436308 - RNA, 19 nt, Human
ccacacaggaaucaaccac

SEQ ID NO: 436309 - RNA, 18 nt, Human
ccacugcuuucuggucuc

SEQ ID NO: 436310 - RNA, 19 nt, Human
ccagcacauaacacagcua

SEQ ID NO: 436311 - RNA, 19 nt, Human
cccaaacucacacccacaa

SEQ ID NO: 436312 - RNA, 22 nt, Human
cccaaacucacacccacaaggu

SEQ ID NO: 436313 - RNA, 18 nt, Human
cccacauauagcaggggc

SEQ ID NO: 436314 - RNA, 22 nt, Human
cccacccagcauccccucccca

SEQ ID NO: 436315 - RNA, 24 nt, Human
ccggauggguacaugaaagauaaa

SEQ ID NO: 436316 - RNA, 23 nt, Human
cggauggguacaugaaagauaaa

SEQ ID NO: 436317 - RNA, 22 nt, Human
cugaagaacaaaacaggaugaa

SEQ ID NO: 436318 - RNA, 24 nt, Human
cugaugaggagcugaagaacaaaa

SEQ ID NO: 436319 - RNA, 20 nt, Human
cugguuugaacuagaacugu

SEQ ID NO: 436320 - RNA, 24 nt, Human
cuuagggaaagucaagaaaugaaa

SEQ ID NO: 436321 - RNA, 18 nt, Human
cuuuuugguacauucugg

SEQ ID NO: 436322 - RNA, 21 nt, Human
gagugacauucccuucugcca

SEQ ID NO: 436323 - RNA, 19 nt, Human
gcaaaacucucaagauacc

SEQ ID NO: 436324 - RNA, 21 nt, Human
gcacuuuuugguacauucugg

SEQ ID NO: 436325 - RNA, 24 nt, Human
gcuuaucugcuuagggaaagucaa

SEQ ID NO: 436326 - RNA, 18 nt, Human
ggagcugaagaacaaaac

SEQ ID NO: 436327 - RNA, 18 nt, Human
gggguccggguucagugg

SEQ ID NO: 436328 - RNA, 18 nt, Human
gggguccggguucagugg

SEQ ID NO: 436329 - RNA, 19 nt, Human
ggguuuauggugaugccag

SEQ ID NO: 436330 - RNA, 21 nt, Human
guaaaagauucccccagagga

SEQ ID NO: 436331 - RNA, 19 nt, Human
guaagacacaucaaacaaa

SEQ ID NO: 436332 - RNA, 22 nt, Human
uaaaaaggagcugacuucauuc

SEQ ID NO: 436333 - RNA, 20 nt, Human
uaaauaauguucgugaccau

SEQ ID NO: 436334 - RNA, 24 nt, Human
uaacaagugcaaacaugcugaacc

SEQ ID NO: 436335 - RNA, 21 nt, Human
uaacacagcuacuucaucugu

SEQ ID NO: 436336 - RNA, 27 nt, Human
uaacuccauggcaaaguacuucaguau

SEQ ID NO: 436337 - RNA, 28 nt, Human
uaacuuuuagucaaaaauauguaagaca

SEQ ID NO: 436338 - RNA, 18 nt, Human
uaagacacaucaaacaaa

SEQ ID NO: 436339 - RNA, 21 nt, Human
uaagaugacaaaacuucaauc

SEQ ID NO: 436340 - RNA, 22 nt, Human
uaagaugacaaaacuucaaucu

SEQ ID NO: 436341 - RNA, 21 nt, Human
uacaaaauaacaagugcaaac

SEQ ID NO: 436342 - RNA, 21 nt, Human
uaccagcacauaacacagcua

SEQ ID NO: 436343 - RNA, 20 nt, Human
uaccuugugcacuuuuuggu

SEQ ID NO: 436344 - RNA, 24 nt, Human
uacuucaucuguucucuuuuugca

SEQ ID NO: 436345 - RNA, 19 nt, Human
uagaauuuccagagacaac

SEQ ID NO: 436346 - RNA, 20 nt, Human
uagaauuuccagagacaacu

SEQ ID NO: 436347 - RNA, 20 nt, Human
ucaacuggaagacccauguc

SEQ ID NO: 436348 - RNA, 18 nt, Human
ucccacccagcauccccu

SEQ ID NO: 436349 - RNA, 21 nt, Human
ucccacccagcauccccuccc

SEQ ID NO: 436350 - RNA, 23 nt, Human
ucccacccagcauccccucccca

SEQ ID NO: 436351 - RNA, 24 nt, Human
ucccacccagcauccccuccccaa

SEQ ID NO: 436352 - RNA, 19 nt, Human
ucccuaaugagccucaguu

SEQ ID NO: 436353 - RNA, 21 nt, Human
uccuucccuaaugagccucag

SEQ ID NO: 436354 - RNA, 19 nt, Human
ucucucauuugaauuucuc

SEQ ID NO: 436355 - RNA, 19 nt, Human
ucucucucuucaaaagaag

SEQ ID NO: 436356 - RNA, 24 nt, Human
ugaaagauaaauuucuaaagccaa

SEQ ID NO: 436357 - RNA, 23 nt, Human
ugaagcagcucuaaacaccaagc

SEQ ID NO: 436358 - RNA, 18 nt, Human
ugaccaugaguuuucccc

SEQ ID NO: 436359 - RNA, 21 nt, Human
ugccaaaugcugagccaucua

SEQ ID NO: 436360 - RNA, 18 nt, Human
uggaguaagcagacagaa

SEQ ID NO: 436361 - RNA, 19 nt, Human
uggcaguugaugacuuggg

SEQ ID NO: 436362 - RNA, 18 nt, Human
uggccuacaggguuuaug

SEQ ID NO: 436363 - RNA, 21 nt, Human
ugggggagcgcccgcuugaca

SEQ ID NO: 436364 - RNA, 21 nt, Human
ugggggagcgcccgcuugaca

SEQ ID NO: 436365 - RNA, 22 nt, Human
ugguaugaaaaccucucaaaau

SEQ ID NO: 436366 - RNA, 18 nt, Human
uguaaauuaccuuuaccu

SEQ ID NO: 436367 - RNA, 22 nt, Human
uguaacaacacaagaguuuggg

SEQ ID NO: 436368 - RNA, 21 nt, Human
uguggaauggaacuaguuuaa

SEQ ID NO: 436369 - RNA, 20 nt, Human
uguuucccacccagcauccc

SEQ ID NO: 436370 - RNA, 20 nt, Human
uucaacuauaaaaaggagcu

SEQ ID NO: 436371 - RNA, 24 nt, Human
uucagugguaauagcggcggagau

SEQ ID NO: 436372 - RNA, 25 nt, Human
uucccacccagcauccccuccccaa

SEQ ID NO: 436373 - RNA, 24 nt, Human
uuuccuguuccacuagauuuccuu

SEQ ID NO: 436374 - RNA, 25 nt, Human
uuuccuguuccacuagauuuccuuu

SEQ ID NO: 436375 - RNA, 20 nt, Human
uuucuagaaacccucaaagc

SEQ ID NO: 436376 - RNA, 19 nt, Human
uuucuuggcaaaacucuca

SEQ ID NO: 436377 - RNA, 23 nt, Human
uuucuuggcauuucauaacuguu

SEQ ID NO: 436378 - RNA, 19 nt, Human
uuugugcagacaaugguga

SEQ ID NO: 436379 - RNA, 23 nt, Human
uuuuuuuuuuuuuuuuuuuaggg

SEQ ID NO: 436380 - RNA, 20 nt, Human
aaauggccucacauccugaa

SEQ ID NO: 436381 - RNA, 21 nt, Human
accguugaaaacucugacagg

SEQ ID NO: 436382 - RNA, 25 nt, Human
acuacaaacaugaaucaaaaaggag

SEQ ID NO: 436383 - RNA, 21 nt, Human
agcugacaaaaaucaagucug

SEQ ID NO: 436384 - RNA, 21 nt, Human
cacaauuagcaaaacuaaaag

SEQ ID NO: 436385 - RNA, 21 nt, Human
cacagcaaaccuaccuuucca

SEQ ID NO: 436386 - RNA, 24 nt, Human
cauuuccauuucacaauuagcaaa

SEQ ID NO: 436387 - RNA, 23 nt, Human
cccaagaacucaauaaucucuua

SEQ ID NO: 436388 - RNA, 18 nt, Human
gacuacaaacaugaauca

SEQ ID NO: 436389 - RNA, 19 nt, Human
uagcucagagacaaugugg

SEQ ID NO: 436390 - RNA, 26 nt, Human
ucaaaaaggaguuaaggaauuuuaag

SEQ ID NO: 436391 - RNA, 24 nt, Human
ucaaauauuaacuauuucggugcc

SEQ ID NO: 436392 - RNA, 21 nt, Human
ucacaauuagcaaaacuaaaa

SEQ ID NO: 436393 - RNA, 27 nt, Human
uccacagcaaaccuaccuuuccagaag

SEQ ID NO: 436394 - RNA, 19 nt, Human
ucuuauguuuucuuuugaa

SEQ ID NO: 436395 - RNA, 20 nt, Human
ucuuuaauguugaauucuga

SEQ ID NO: 436396 - RNA, 21 nt, Human
ugaaaacacaaccauaaauca

SEQ ID NO: 436397 - RNA, 23 nt, Human
ugaaaacucugacaggcuuugug

SEQ ID NO: 436398 - RNA, 19 nt, Human
ugaaauaaaggauccaguc

SEQ ID NO: 436399 - RNA, 23 nt, Human
ugugguaccuguuuggaauccag

SEQ ID NO: 436400 - RNA, 21 nt, Human
uuaaauggccucacauccuga

SEQ ID NO: 436401 - RNA, 21 nt, Human
uugcaacaaucagggcaaaac

SEQ ID NO: 436402 - RNA, 23 nt, Human
uuucaauuauagcuuaccaauua

SEQ ID NO: 436403 - RNA, 26 nt, Human
aaaaaaaagagauauguaauagagaa

SEQ ID NO: 436404 - RNA, 19 nt, Human
aaaaaaagagauauguaau

SEQ ID NO: 436405 - RNA, 18 nt, Human
aaaaaaccaaacaccaca

SEQ ID NO: 436406 - RNA, 24 nt, Human
aaaaaagagauauguaauagagaa

SEQ ID NO: 436407 - RNA, 22 nt, Human
aaaccaaacaccacauauucuc

SEQ ID NO: 436408 - RNA, 22 nt, Human
aaaccaucauucucagcaaacu

SEQ ID NO: 436409 - RNA, 19 nt, Human
aaccaaacaccacauauuc

SEQ ID NO: 436410 - RNA, 19 nt, Human
aaccugcacauugugcaca

SEQ ID NO: 436411 - RNA, 26 nt, Human
aaggacaaaaaaccaaacaccacaua

SEQ ID NO: 436412 - RNA, 21 nt, Human
agaaaaaaaagagauauguaa

SEQ ID NO: 436413 - RNA, 26 nt, Human
agaaaaaaaagagauauguaauagag

SEQ ID NO: 436414 - RNA, 29 nt, Human
agaaaaaaaagagauauguaauagagaag

SEQ ID NO: 436415 - RNA, 21 nt, Human
agccggacucuaggcucagcu

SEQ ID NO: 436416 - RNA, 18 nt, Human
agcucccgcagccccgcc

SEQ ID NO: 436417 - RNA, 18 nt, Human
aggaacauggaugaagcu

SEQ ID NO: 436418 - RNA, 24 nt, Human
auauacaccauggaauacuaugca

SEQ ID NO: 436419 - RNA, 22 nt, Human
caauagcaaagacuuggaacca

SEQ ID NO: 436420 - RNA, 18 nt, Human
cacauguauacauaugua

SEQ ID NO: 436421 - RNA, 26 nt, Human
caccacauauucucacuccuaggugg

SEQ ID NO: 436422 - RNA, 18 nt, Human
caccagauccgcgcccac

SEQ ID NO: 436423 - RNA, 21 nt, Human
caccagauccgcgcccacucu

SEQ ID NO: 436424 - RNA, 18 nt, Human
caggcaggccugaguccc

SEQ ID NO: 436425 - RNA, 22 nt, Human
ccaaacaccacauauucucacu

SEQ ID NO: 436426 - RNA, 21 nt, Human
ccacauauucucacuccuagg

SEQ ID NO: 436427 - RNA, 20 nt, Human
ccccacaccagauccgcgcc

SEQ ID NO: 436428 - RNA, 21 nt, Human
ccccacaccagauccgcgccc

SEQ ID NO: 436429 - RNA, 22 nt, Human
cccgcagccccgccaacuuucc

SEQ ID NO: 436430 - RNA, 21 nt, Human
cccgccgccuuccccacacca

SEQ ID NO: 436431 - RNA, 21 nt, Human
cggacucuaggcucagcuccc

SEQ ID NO: 436432 - RNA, 21 nt, Human
gcaaacuaucgaaaggacaaa

SEQ ID NO: 436433 - RNA, 22 nt, Human
gcaaacuaucgaaaggacaaaa

SEQ ID NO: 436434 - RNA, 19 nt, Human
ggggagggauagcauuagg

SEQ ID NO: 436435 - RNA, 19 nt, Human
guaauagagaagaaaaaua

SEQ ID NO: 436436 - RNA, 23 nt, Human
guauaguaauaauaaaaacaaga

SEQ ID NO: 436437 - RNA, 25 nt, Human
uaauaaaaacaagaaaaaaaagaga

SEQ ID NO: 436438 - RNA, 21 nt, Human
uauaguaauaauaaaaacaag

SEQ ID NO: 436439 - RNA, 18 nt, Human
uauauacacuauuuguau

SEQ ID NO: 436440 - RNA, 24 nt, Human
ucagcaaacuaucgaaaggacaaa

SEQ ID NO: 436441 - RNA, 19 nt, Human
ucgaaaggacaaaaaacca

SEQ ID NO: 436442 - RNA, 20 nt, Human
ugaaaugacgaguuaauggg

SEQ ID NO: 436443 - RNA, 24 nt, Human
ugaacaaugagaacacauggacac

SEQ ID NO: 436444 - RNA, 20 nt, Human
ugagucccgccgccuucccc

SEQ ID NO: 436445 - RNA, 20 nt, Human
uggaauacuaugcagccaua

SEQ ID NO: 436446 - RNA, 20 nt, Human
uggauuaagaaaauguggcc

SEQ ID NO: 436447 - RNA, 19 nt, Human
uggcacauguauacauaug

SEQ ID NO: 436448 - RNA, 27 nt, Human
uguauacauauguaacaaaccugcaca

SEQ ID NO: 436449 - RNA, 18 nt, Human
uugggggaggggggaggg

SEQ ID NO: 436450 - RNA, 23 nt, Human
uugugcacauguacccuaaaacu

SEQ ID NO: 436451 - RNA, 23 nt, Human
uuuauuucggcacuauucacaau

SEQ ID NO: 436452 - RNA, 27 nt, Human
uuuuggagacacaugcacacguauggu

SEQ ID NO: 436453 - RNA, 28 nt, Human
uuuuuuuuuuuuuuuuuuuuuuuggggg

SEQ ID NO: 436454 - RNA, 19 nt, Human
aaauccucugucaacacca

SEQ ID NO: 436455 - RNA, 30 nt, Human
aagagaaaaaaauauaaaaauaaaaauguu

SEQ ID NO: 436456 - RNA, 20 nt, Human
acagacagugccacgaugac

SEQ ID NO: 436457 - RNA, 22 nt, Human
acuccaaaaagaacauuaaaga

SEQ ID NO: 436458 - RNA, 22 nt, Human
agaaagcaaaaccaauuuuccc

SEQ ID NO: 436459 - RNA, 22 nt, Human
agagcuuuuuacauaguuacau

SEQ ID NO: 436460 - RNA, 21 nt, Human
agcugaacugugggugaaauu

SEQ ID NO: 436461 - RNA, 18 nt, Human
aggcagaguugcagugaa

SEQ ID NO: 436462 - RNA, 19 nt, Human
aggcgagaaaaggaacuga

SEQ ID NO: 436463 - RNA, 21 nt, Human
aggcgagaaaaggaacugagg

SEQ ID NO: 436464 - RNA, 20 nt, Human
auaaaaauaaaaauguacaa

SEQ ID NO: 436465 - RNA, 28 nt, Human
auaaauccucugucaacaccagacagag

SEQ ID NO: 436466 - RNA, 23 nt, Human
caaaaagaacauuaaagacgaag

SEQ ID NO: 436467 - RNA, 25 nt, Human
caaagaaagcaaaaccaauuuuccc

SEQ ID NO: 436468 - RNA, 25 nt, Human
caauaagccaucuuccagaugcagc

SEQ ID NO: 436469 - RNA, 19 nt, Human
cacacaaaggcagaguugc

SEQ ID NO: 436470 - RNA, 18 nt, Human
cacgugcgacgggaaaac

SEQ ID NO: 436471 - RNA, 18 nt, Human
cagccagcugaacugugg

SEQ ID NO: 436472 - RNA, 21 nt, Human
ccuugcaaaccauucagaagc

SEQ ID NO: 436473 - RNA, 22 nt, Human
cgccgccggaggccgccgcucu

SEQ ID NO: 436474 - RNA, 20 nt, Human
cgggaccgacagauccacca

SEQ ID NO: 436475 - RNA, 28 nt, Human
cugguuaaaaccaauaagccaucuucca

SEQ ID NO: 436476 - RNA, 21 nt, Human
gagcauuacaaaugaucgcca

SEQ ID NO: 436477 - RNA, 22 nt, Human
gagcuuagagcuuuuuacauag

SEQ ID NO: 436478 - RNA, 19 nt, Human
guacaaagaaagcaaaacc

SEQ ID NO: 436479 - RNA, 23 nt, Human
guccaugacuggagagcgccgcc

SEQ ID NO: 436480 - RNA, 23 nt, Human
uaaaaccaauaagccaucuucca

SEQ ID NO: 436481 - RNA, 19 nt, Human
uaagagcauuacaaaugau

SEQ ID NO: 436482 - RNA, 21 nt, Human
uaagagcauuacaaaugaucg

SEQ ID NO: 436483 - RNA, 21 nt, Human
uacacacaaaggcagaguugc

SEQ ID NO: 436484 - RNA, 22 nt, Human
uacccacggccgauccaaaggc

SEQ ID NO: 436485 - RNA, 19 nt, Human
ucagaagccaacaguggcc

SEQ ID NO: 436486 - RNA, 19 nt, Human
ucuggacacucauguaaga

SEQ ID NO: 436487 - RNA, 19 nt, Human
ugagugccucuggacacuc

SEQ ID NO: 436488 - RNA, 18 nt, Human
uggaaaggaacggcucag

SEQ ID NO: 436489 - RNA, 23 nt, Human
uuaaaaccaauaagccaucuucc

SEQ ID NO: 436490 - RNA, 22 nt, Human
uucacagacagugccacgauga

SEQ ID NO: 436491 - RNA, 25 nt, Human
uucaggcgagaaaaggaacugagga

SEQ ID NO: 436492 - RNA, 27 nt, Human
uucaggcgagaaaaggaacugaggaaa

SEQ ID NO: 436493 - RNA, 23 nt, Human
uuuuuuuuuuuuuuuuuuuuggg

SEQ ID NO: 436494 - RNA, 19 nt, Human
agagugucgacuggagaag

SEQ ID NO: 436495 - RNA, 22 nt, Human
aggugcuagggagcggcgagcu

SEQ ID NO: 436496 - RNA, 18 nt, Human
cagcggcugccagggaca

SEQ ID NO: 436497 - RNA, 24 nt, Human
cgagagugucgacuggagaaggug

SEQ ID NO: 436498 - RNA, 19 nt, Human
ucgcccgcgggucgcugcu

SEQ ID NO: 436499 - RNA, 18 nt, Human
ucgggcucagcggcugcc

SEQ ID NO: 436500 - RNA, 24 nt, Human
ucuccgggcgcgagagugucgacu

SEQ ID NO: 436501 - RNA, 19 nt, Human
uccacugacuucauuccuc

SEQ ID NO: 436502 - RNA, 24 nt, Human
aacauagcaagaccccccauugcu

SEQ ID NO: 436503 - RNA, 26 nt, Human
agcaagaccccccauugcuacauauu

SEQ ID NO: 436504 - RNA, 24 nt, Human
agcacuuuggaaggcugaggcagg

SEQ ID NO: 436505 - RNA, 24 nt, Human
agccugggcaacauagcaagaccc

SEQ ID NO: 436506 - RNA, 24 nt, Human
aggauugcaugaagccagaaguuu

SEQ ID NO: 436507 - RNA, 24 nt, Human
cacgccuguaaucccagcacuuug

SEQ ID NO: 436508 - RNA, 24 nt, Human
cagcacuuuggaaggcugaggcag

SEQ ID NO: 436509 - RNA, 26 nt, Human
cagcacuuuggaaggcugaggcaggu

SEQ ID NO: 436510 - RNA, 18 nt, Human
cgccuguaaucccagcac

SEQ ID NO: 436511 - RNA, 23 nt, Human
cgccuguaaucccagcacuuugg

SEQ ID NO: 436512 - RNA, 22 nt, Human
cucacgccuguaaucccagcac

SEQ ID NO: 436513 - RNA, 24 nt, Human
cucacgccuguaaucccagcacuu

SEQ ID NO: 436514 - RNA, 18 nt, Human
gcucauuuggaaggauug

SEQ ID NO: 436515 - RNA, 24 nt, Human
gggugagguggcucacgccuguaa

SEQ ID NO: 436516 - RNA, 23 nt, Human
gguggcucacgccuguaauccca

SEQ ID NO: 436517 - RNA, 24 nt, Human
gguggcucacgccuguaaucccag

SEQ ID NO: 436518 - RNA, 19 nt, Human
uaucuaaauuagccggcug

SEQ ID NO: 436519 - RNA, 21 nt, Human
uauuacuuucuaguauacuaa

SEQ ID NO: 436520 - RNA, 23 nt, Human
ucuaaagcuuuguuuaaaaguua

SEQ ID NO: 436521 - RNA, 18 nt, Human
uggaaggcugaggcaggu

SEQ ID NO: 436522 - RNA, 18 nt, Human
uggaaggcugaggcaggu

SEQ ID NO: 436523 - RNA, 22 nt, Human
uggcucacgccuguaaucccag

SEQ ID NO: 436524 - RNA, 24 nt, Human
uggcucacgccuguaaucccagca

SEQ ID NO: 436525 - RNA, 24 nt, Human
uugcaugaagccagaaguuugaga

SEQ ID NO: 436526 - RNA, 19 nt, Human
uauggaaguucugugcaau

SEQ ID NO: 436527 - RNA, 20 nt, Human
accaaaaaugugaguagcag

SEQ ID NO: 436528 - RNA, 24 nt, Human
acguuugaaacacuaccaaaaaug

SEQ ID NO: 436529 - RNA, 21 nt, Human
agaacguuugaaacacuacca

SEQ ID NO: 436530 - RNA, 22 nt, Human
auccagaauccccagccuaagc

SEQ ID NO: 436531 - RNA, 20 nt, Human
caccuuucuuccuccucacu

SEQ ID NO: 436532 - RNA, 19 nt, Human
cucacuuccacugcaggga

SEQ ID NO: 436533 - RNA, 18 nt, Human
uaacagaaauaaguuguu

SEQ ID NO: 436534 - RNA, 25 nt, Human
ucaccuuucuuccuccucacuucca

SEQ ID NO: 436535 - RNA, 22 nt, Human
ugcacggccauuuuggauaucc

SEQ ID NO: 436536 - RNA, 19 nt, Human
uuucuuccuccucacuucc

SEQ ID NO: 436537 - RNA, 23 nt, Human
aaaaacuaaugaaauucaguuaa

SEQ ID NO: 436538 - RNA, 22 nt, Human
aagaaaacaucaagaaaaaaaa

SEQ ID NO: 436539 - RNA, 21 nt, Human
aauaacauguucaaaaaaucc

SEQ ID NO: 436540 - RNA, 22 nt, Human
acacacacacucuuuuaguaua

SEQ ID NO: 436541 - RNA, 20 nt, Human
agaaaaaaaaaaaguauuag

SEQ ID NO: 436542 - RNA, 20 nt, Human
agaaaaccauuucuuccuuc

SEQ ID NO: 436543 - RNA, 23 nt, Human
aguaacuuuuuuguagguauuua

SEQ ID NO: 436544 - RNA, 18 nt, Human
agugagugacagacaaga

SEQ ID NO: 436545 - RNA, 21 nt, Human
auauacacaaaccaaaaacac

SEQ ID NO: 436546 - RNA, 25 nt, Human
caucaagaaaaaaaaaaaguauuag

SEQ ID NO: 436547 - RNA, 25 nt, Human
ccauaucugccauaguaaaaauuca

SEQ ID NO: 436548 - RNA, 19 nt, Human
cuaagaugauaacucauag

SEQ ID NO: 436549 - RNA, 20 nt, Human
cucaugaaauucucaagugg

SEQ ID NO: 436550 - RNA, 21 nt, Human
cugaagacauuugcaaaaaga

SEQ ID NO: 436551 - RNA, 23 nt, Human
cuugugcauucuuuugaagacaa

SEQ ID NO: 436552 - RNA, 20 nt, Human
gacccagcacaccuuaguaa

SEQ ID NO: 436553 - RNA, 19 nt, Human
gcaacagaaaggcuuuuca

SEQ ID NO: 436554 - RNA, 22 nt, Human
gccuccaccuccgccucuucca

SEQ ID NO: 436555 - RNA, 23 nt, Human
gccuccaccuccgccucuuccau

SEQ ID NO: 436556 - RNA, 23 nt, Human
uaaacacuuaaugacaaaaaucu

SEQ ID NO: 436557 - RNA, 21 nt, Human
uaaccucaccgaugacugaau

SEQ ID NO: 436558 - RNA, 22 nt, Human
uaaccucaccgaugacugaaua

SEQ ID NO: 436559 - RNA, 26 nt, Human
uaagaaaaccauuucuuccuucuuuc

SEQ ID NO: 436560 - RNA, 23 nt, Human
uacacacacacucuuuuaguaua

SEQ ID NO: 436561 - RNA, 24 nt, Human
uacauuaaugauaacuaagguaga

SEQ ID NO: 436562 - RNA, 22 nt, Human
uagugagugacagacaagauuc

SEQ ID NO: 436563 - RNA, 18 nt, Human
uauauguauauauacaca

SEQ ID NO: 436564 - RNA, 21 nt, Human
ucagaauaacacuuaaacacu

SEQ ID NO: 436565 - RNA, 24 nt, Human
ucagaauaacacuuaaacacuuaa

SEQ ID NO: 436566 - RNA, 28 nt, Human
uccaugauuagugcauuaaccggggucc

SEQ ID NO: 436567 - RNA, 21 nt, Human
ugagaaucacugcaauaacau

SEQ ID NO: 436568 - RNA, 25 nt, Human
ugcgugaauacacacacacucuuuu

SEQ ID NO: 436569 - RNA, 19 nt, Human
uguaaaaguucaauugauu

SEQ ID NO: 436570 - RNA, 22 nt, Human
uguauauguauauauacacaaa

SEQ ID NO: 436571 - RNA, 22 nt, Human
ugugguucuugugcauucuuuu

SEQ ID NO: 436572 - RNA, 20 nt, Human
uuacugcauuuccuuguauu

SEQ ID NO: 436573 - RNA, 21 nt, Human
uuagugcuuaaaauuuuacga

SEQ ID NO: 436574 - RNA, 23 nt, Human
uucauuuuuaacacagcuaagau

SEQ ID NO: 436575 - RNA, 24 nt, Human
uugaagauuuuauaauugcuccug

SEQ ID NO: 436576 - RNA, 21 nt, Human
uuggcagcugauuagucaguu

SEQ ID NO: 436577 - RNA, 24 nt, Human
uuuguagguauuuaagaaaaccau

SEQ ID NO: 436578 - RNA, 19 nt, Human
uuuuauaauugcuccugcu

SEQ ID NO: 436579 - RNA, 27 nt, Human
uuuuuuuuuuuuuuuuuuuuuuugggg

SEQ ID NO: 436580 - RNA, 25 nt, Human
aaaaaagaaaaaaaaaaguaaaaag

SEQ ID NO: 436581 - RNA, 18 nt, Human
aaaaagaaaaaagaaaaa

SEQ ID NO: 436582 - RNA, 27 nt, Human
aaaaguaaaaagaaagauuaggccuag

SEQ ID NO: 436583 - RNA, 24 nt, Human
aaacaaagagccaaugucucuaau

SEQ ID NO: 436584 - RNA, 22 nt, Human
aaagaaagauuaggccuaaaca

SEQ ID NO: 436585 - RNA, 24 nt, Human
aagaaaaaaaaaaguaaaaagaaa

SEQ ID NO: 436586 - RNA, 20 nt, Human
acugcacuuucaagagcaag

SEQ ID NO: 436587 - RNA, 20 nt, Human
agaaaaaaaaaaguaaaaag

SEQ ID NO: 436588 - RNA, 21 nt, Human
agaaaaaagaaaaaaaaaagu

SEQ ID NO: 436589 - RNA, 30 nt, Human
agaaaaaagaaaaaaaaaaguaaaaagaaa

SEQ ID NO: 436590 - RNA, 21 nt, Human
aguaaaaagaaagauuaggcc

SEQ ID NO: 436591 - RNA, 21 nt, Human
auacugcacuuucaagagcaa

SEQ ID NO: 436592 - RNA, 22 nt, Human
augauguagaaaaauacugcac

SEQ ID NO: 436593 - RNA, 23 nt, Human
auguagaaaaauacugcacuuuc

SEQ ID NO: 436594 - RNA, 23 nt, Human
cauuaagccuucuuugcuggcuc

SEQ ID NO: 436595 - RNA, 20 nt, Human
ccuucacccaucaaguggua

SEQ ID NO: 436596 - RNA, 20 nt, Human
cuuguccuggcaagguagca

SEQ ID NO: 436597 - RNA, 19 nt, Human
ggcgaagugaacacagagg

SEQ ID NO: 436598 - RNA, 22 nt, Human
gugauuugauggaagacugcuu

SEQ ID NO: 436599 - RNA, 20 nt, Human
uaagaugaaagaagcauuaa

SEQ ID NO: 436600 - RNA, 18 nt, Human
uaauuuaacaauucugga

SEQ ID NO: 436601 - RNA, 21 nt, Human
uaggccuaaacaaagagccaa

SEQ ID NO: 436602 - RNA, 18 nt, Human
uauaugaugaugaaggag

SEQ ID NO: 436603 - RNA, 19 nt, Human
uaugaugaugaaggagaug

SEQ ID NO: 436604 - RNA, 24 nt, Human
ucuucuuucuauugccaaagccuu

SEQ ID NO: 436605 - RNA, 18 nt, Human
ucuugguucuuguccugg

SEQ ID NO: 436606 - RNA, 22 nt, Human
ucuuuaaaaaaaaagaaaaaag

SEQ ID NO: 436607 - RNA, 24 nt, Human
ugaaagaagcauuaaagcauagua

SEQ ID NO: 436608 - RNA, 25 nt, Human
ugacaagugaaagaccauuauggga

SEQ ID NO: 436609 - RNA, 24 nt, Human
uguagaaaaauacugcacuuucaa

SEQ ID NO: 436610 - RNA, 24 nt, Human
uguagacuucucaaaauaaacuuc

SEQ ID NO: 436611 - RNA, 20 nt, Human
uuguggucuccccagugucc

SEQ ID NO: 436612 - RNA, 20 nt, Human
uuugauggaagacugcuuuc

SEQ ID NO: 436613 - RNA, 18 nt, Human
accugggccucccucucu

SEQ ID NO: 436614 - RNA, 21 nt, Human
cacaugucucuccccagcccc

SEQ ID NO: 436615 - RNA, 21 nt, Human
cacccuucccucccaguuccc

SEQ ID NO: 436616 - RNA, 21 nt, Human
caccgggcuccuuuugggggc

SEQ ID NO: 436617 - RNA, 23 nt, Human
caccgggcuccuuuugggggcuu

SEQ ID NO: 436618 - RNA, 23 nt, Human
cagcccccacagugccgccuccc

SEQ ID NO: 436619 - RNA, 21 nt, Human
cagccuucgcagcaucaccgg

SEQ ID NO: 436620 - RNA, 18 nt, Human
cccagccccggcugccgg

SEQ ID NO: 436621 - RNA, 19 nt, Human
ccccacagugccgccuccc

SEQ ID NO: 436622 - RNA, 18 nt, Human
ccccggggcccccucugg

SEQ ID NO: 436623 - RNA, 22 nt, Human
ccccuguacggauccuucccuc

SEQ ID NO: 436624 - RNA, 23 nt, Human
ccgccagcuguggcuccgggugc

SEQ ID NO: 436625 - RNA, 22 nt, Human
ccgggcuccuuuugggggcuuc

SEQ ID NO: 436626 - RNA, 20 nt, Human
ccucccaguucccgcccccc

SEQ ID NO: 436627 - RNA, 18 nt, Human
ccugcgccgcgcccgggg

SEQ ID NO: 436628 - RNA, 19 nt, Human
cggggccuccgcgccgucg

SEQ ID NO: 436629 - RNA, 18 nt, Human
cgguugguggaguagugu

SEQ ID NO: 436630 - RNA, 21 nt, Human
cgguugguggaguaguguugg

SEQ ID NO: 436631 - RNA, 19 nt, Human
cucccugcaccugggccuc

SEQ ID NO: 436632 - RNA, 24 nt, Human
cuccuuuugggggcuucgguuggu

SEQ ID NO: 436633 - RNA, 22 nt, Human
cugggccuugguuucuucuucu

SEQ ID NO: 436634 - RNA, 19 nt, Human
cuuccggcuccgucucacc

SEQ ID NO: 436635 - RNA, 19 nt, Human
gagccugcgccgcgcccgg

SEQ ID NO: 436636 - RNA, 26 nt, Human
gccacguguccacaugucucucccca

SEQ ID NO: 436637 - RNA, 19 nt, Human
gccuccccuguucacagcc

SEQ ID NO: 436638 - RNA, 24 nt, Human
gcuccgucucacccuucccuccca

SEQ ID NO: 436639 - RNA, 18 nt, Human
gcugcagggcuggcggcg

SEQ ID NO: 436640 - RNA, 20 nt, Human
gggcccccucuggccggccc

SEQ ID NO: 436641 - RNA, 22 nt, Human
gguuucuucuucuuuggagccu

SEQ ID NO: 436642 - RNA, 20 nt, Human
guggaguaguguugggcccc

SEQ ID NO: 436643 - RNA, 24 nt, Human
uaacuuccggcuccgucucacccu

SEQ ID NO: 436644 - RNA, 21 nt, Human
ucacccuucccucccaguucc

SEQ ID NO: 436645 - RNA, 18 nt, Human
uccccagccccggcugcc

SEQ ID NO: 436646 - RNA, 23 nt, Human
uccccccagccagggcccugcag

SEQ ID NO: 436647 - RNA, 23 nt, Human
ucccugcaccugggccucccucu

SEQ ID NO: 436648 - RNA, 22 nt, Human
uguccacaugucucuccccagc

SEQ ID NO: 436649 - RNA, 18 nt, Human
uuggagccugcgccgcgc

SEQ ID NO: 436650 - RNA, 19 nt, Human
gugggauggcagggcacag

SEQ ID NO: 436651 - RNA, 18 nt, Human
ugggauggcagggcacag

SEQ ID NO: 436652 - RNA, 23 nt, Human
ucuuguggcagccgggugggggc

SEQ ID NO: 436653 - RNA, 23 nt, Human
ucuuguggcagccgggugggggc

SEQ ID NO: 436654 - RNA, 18 nt, Human
uggcagccgggugggggc

SEQ ID NO: 436655 - RNA, 18 nt, Human
uggcagccgggugggggc

SEQ ID NO: 436656 - RNA, 19 nt, Human
ugguaggcuugcggguggg

SEQ ID NO: 436657 - RNA, 21 nt, Human
ugguaggcuugcgggugggug

SEQ ID NO: 436658 - RNA, 19 nt, Human
uuguggcagccgggugggg

SEQ ID NO: 436659 - RNA, 24 nt, Human
uuuuuuuuuuuuuuuuuuuccaag

SEQ ID NO: 436660 - RNA, 23 nt, Human
uuuuuuuuuuuuuuuuuuuucca

SEQ ID NO: 436661 - RNA, 24 nt, Human
uuuuuuuuuuuuuuuuuuuuuccu

SEQ ID NO: 436662 - RNA, 19 nt, Human
cagacuacaggcgccugcc

SEQ ID NO: 436663 - RNA, 20 nt, Human
ccuugccuggcuaauuuuuu

SEQ ID NO: 436664 - RNA, 21 nt, Human
cgggcggcgcgcauucuuucc

SEQ ID NO: 436665 - RNA, 19 nt, Human
cggguggccagacgcggca

SEQ ID NO: 436666 - RNA, 23 nt, Human
gccuggcuaauuuuuuguauuuu

SEQ ID NO: 436667 - RNA, 23 nt, Human
ggcggagcgcacgggcggcgcgc

SEQ ID NO: 436668 - RNA, 24 nt, Human
uaauuuuuuguauuuuuaguagag

SEQ ID NO: 436669 - RNA, 25 nt, Human
ugccuggcuaauuuuuuguauuuuu

SEQ ID NO: 436670 - RNA, 18 nt, Human
uggccagacgcggcaggc

SEQ ID NO: 436671 - RNA, 22 nt, Human
uggccagacgcggcaggcggag

SEQ ID NO: 436672 - RNA, 18 nt, Human
uuaguagagacaggguuu

SEQ ID NO: 436673 - RNA, 22 nt, Human
uugccuggcuaauuuuuuguau

SEQ ID NO: 436674 - RNA, 24 nt, Human
uuuuguauuuuuaguagagacaac

SEQ ID NO: 436675 - RNA, 21 nt, Human
uuuuuguauuuuuaguagaga

SEQ ID NO: 436676 - RNA, 18 nt, Human
aaaaacaugcuagugugu

SEQ ID NO: 436677 - RNA, 20 nt, Human
auuuggucugaaaaacaugc

SEQ ID NO: 436678 - RNA, 23 nt, Human
caaaacaagcaccacauuggaug

SEQ ID NO: 436679 - RNA, 22 nt, Human
guaauugccaagagcugugauc

SEQ ID NO: 436680 - RNA, 22 nt, Human
guuuggcaggcaaaaaaauaaa

SEQ ID NO: 436681 - RNA, 22 nt, Human
uguguguguuuauaaauaaugu

SEQ ID NO: 436682 - RNA, 20 nt, Human
aaaaauaugggaaauacccc

SEQ ID NO: 436683 - RNA, 21 nt, Human
aaaacaguuucaaauauagaa

SEQ ID NO: 436684 - RNA, 23 nt, Human
aaacauaaagggcagacaccucg

SEQ ID NO: 436685 - RNA, 21 nt, Human
aacagauugaaugaccagaug

SEQ ID NO: 436686 - RNA, 20 nt, Human
aaccaguucacuuugcagau

SEQ ID NO: 436687 - RNA, 19 nt, Human
aagcugcuaagugcuccuc

SEQ ID NO: 436688 - RNA, 20 nt, Human
acaaagcauaauacauacaa

SEQ ID NO: 436689 - RNA, 23 nt, Human
acaaagcauaauacauacaaaau

SEQ ID NO: 436690 - RNA, 21 nt, Human
acaucauuuacuuuuggucau

SEQ ID NO: 436691 - RNA, 21 nt, Human
acuuaguuacuuugcuaauga

SEQ ID NO: 436692 - RNA, 23 nt, Human
agaaacuugaagaaagacacuuu

SEQ ID NO: 436693 - RNA, 20 nt, Human
agagccaaaaagcuuuggug

SEQ ID NO: 436694 - RNA, 18 nt, Human
agaguguggagcugcuca

SEQ ID NO: 436695 - RNA, 24 nt, Human
agguuuccuaacaucuauaaguuu

SEQ ID NO: 436696 - RNA, 19 nt, Human
aucaaagcagcuuuuacag

SEQ ID NO: 436697 - RNA, 23 nt, Human
augaccgcuacuuccaaaaauau

SEQ ID NO: 436698 - RNA, 21 nt, Human
caaagcauaauacauacaaaa

SEQ ID NO: 436699 - RNA, 18 nt, Human
cacagcagcaggaguagc

SEQ ID NO: 436700 - RNA, 25 nt, Human
cagaacccaugaaagcuacaaccag

SEQ ID NO: 436701 - RNA, 21 nt, Human
cagaucaucagguacaaccag

SEQ ID NO: 436702 - RNA, 21 nt, Human
cagcagcaggaguagcuguuu

SEQ ID NO: 436703 - RNA, 19 nt, Human
cagcagguuuccuaacauc

SEQ ID NO: 436704 - RNA, 25 nt, Human
caguugcuucccugugcuauuugag

SEQ ID NO: 436705 - RNA, 27 nt, Human
cauuccuacuccaggagcuaagcuggu

SEQ ID NO: 436706 - RNA, 24 nt, Human
ccaaaaauaugggaaauaccccua

SEQ ID NO: 436707 - RNA, 25 nt, Human
ccagaugcccaauguagauugcacc

SEQ ID NO: 436708 - RNA, 22 nt, Human
ccagugagacacugcuuucuuu

SEQ ID NO: 436709 - RNA, 19 nt, Human
cccaugaaagcuacaacca

SEQ ID NO: 436710 - RNA, 23 nt, Human
ccccaugucugguagcaugucua

SEQ ID NO: 436711 - RNA, 18 nt, Human
cccuugaaaggcaguugc

SEQ ID NO: 436712 - RNA, 22 nt, Human
cggaaucagaaucggacacuga

SEQ ID NO: 436713 - RNA, 20 nt, Human
cucagaucaucagguacaac

SEQ ID NO: 436714 - RNA, 22 nt, Human
cuccaaugauuaauauacauag

SEQ ID NO: 436715 - RNA, 25 nt, Human
cugccuacaaaauaaagaaucaugg

SEQ ID NO: 436716 - RNA, 21 nt, Human
cuucuagacaccucaagaaga

SEQ ID NO: 436717 - RNA, 25 nt, Human
gaacaauagaggcuucuugaagaaa

SEQ ID NO: 436718 - RNA, 20 nt, Human
gagcugcucaggguacccgg

SEQ ID NO: 436719 - RNA, 23 nt, Human
gcuaaugaccgcuacuuccaaaa

SEQ ID NO: 436720 - RNA, 20 nt, Human
gggcagacaccucgcccuag

SEQ ID NO: 436721 - RNA, 21 nt, Human
guucacuuugcagauguggaa

SEQ ID NO: 436722 - RNA, 22 nt, Human
uaaacaaaacaguuucaaauau

SEQ ID NO: 436723 - RNA, 23 nt, Human
uaaacaaaacaguuucaaauaua

SEQ ID NO: 436724 - RNA, 21 nt, Human
uaguuggugacagcaggauga

SEQ ID NO: 436725 - RNA, 21 nt, Human
uaugggaaauaccccuacaug

SEQ ID NO: 436726 - RNA, 23 nt, Human
ucaaauauagaacagucugugcu

SEQ ID NO: 436727 - RNA, 22 nt, Human
ucagugaagagucuuuugucau

SEQ ID NO: 436728 - RNA, 21 nt, Human
ucaucuuucuguuuccuuuac

SEQ ID NO: 436729 - RNA, 21 nt, Human
ucaugcuggauuuggggcauu

SEQ ID NO: 436730 - RNA, 20 nt, Human
uccucuucccccuucuccaa

SEQ ID NO: 436731 - RNA, 21 nt, Human
ucugcugccaugaagccacag

SEQ ID NO: 436732 - RNA, 20 nt, Human
ugaaacuaaucaaucuuuaa

SEQ ID NO: 436733 - RNA, 19 nt, Human
ugaaugacauuuuauguuu

SEQ ID NO: 436734 - RNA, 20 nt, Human
ugaccgcuacuuccaaaaau

SEQ ID NO: 436735 - RNA, 21 nt, Human
ugccggaaucagaaucggaca

SEQ ID NO: 436736 - RNA, 22 nt, Human
ugucacagcucugaucugcugc

SEQ ID NO: 436737 - RNA, 21 nt, Human
uugauuacauugaaaggcaaa

SEQ ID NO: 436738 - RNA, 20 nt, Human
uuuaaacaaaacaguuucaa

SEQ ID NO: 436739 - RNA, 19 nt, Human
uuuaaacuacgauuauagc

SEQ ID NO: 436740 - RNA, 24 nt, Human
uuuuacagauucgggaucauucau

SEQ ID NO: 436741 - RNA, 24 nt, Human
uuuuuaauuuugacuaccagcacu

SEQ ID NO: 436742 - RNA, 24 nt, Human
uuuuuuuuuuuuuuuuuuaauuuu

SEQ ID NO: 436743 - RNA, 23 nt, Human
uuuuuuuuuuuuuuuuuuuuggg

SEQ ID NO: 436744 - RNA, 24 nt, Human
accccuuugccugaauggagcccc

SEQ ID NO: 436745 - RNA, 24 nt, Human
acccucacacaacccagaccucag

SEQ ID NO: 436746 - RNA, 24 nt, Human
acgcagggguggggugcagggacg

SEQ ID NO: 436747 - RNA, 20 nt, Human
acuugcucccacugggcugg

SEQ ID NO: 436748 - RNA, 21 nt, Human
agcgagcugcucccuggucag

SEQ ID NO: 436749 - RNA, 20 nt, Human
agcuucccgcgggcucugcc

SEQ ID NO: 436750 - RNA, 19 nt, Human
aggcgcggagcccagagcc

SEQ ID NO: 436751 - RNA, 20 nt, Human
aggcugcagcuaaaaccccu

SEQ ID NO: 436752 - RNA, 23 nt, Human
agguggaguauaaaaaccuaaac

SEQ ID NO: 436753 - RNA, 21 nt, Human
caagcuagugagaccccagca

SEQ ID NO: 436754 - RNA, 24 nt, Human
cacaacccagaccucaguggcucu

SEQ ID NO: 436755 - RNA, 18 nt, Human
caccauaaaccaaacgcc

SEQ ID NO: 436756 - RNA, 21 nt, Human
caccugcaccugccuccuucc

SEQ ID NO: 436757 - RNA, 19 nt, Human
cacuccugccuggugucgu

SEQ ID NO: 436758 - RNA, 20 nt, Human
cacugggcugggggccucgg

SEQ ID NO: 436759 - RNA, 23 nt, Human
caggcgcggagcccagagccgcc

SEQ ID NO: 436760 - RNA, 19 nt, Human
ccaaaguaaaacgaaugca

SEQ ID NO: 436761 - RNA, 18 nt, Human
ccaucccuccagcguccc

SEQ ID NO: 436762 - RNA, 22 nt, Human
cccacugggcugggggccucgg

SEQ ID NO: 436763 - RNA, 26 nt, Human
cccaggcgcggagcccagagccgccu

SEQ ID NO: 436764 - RNA, 23 nt, Human
cccccucaagcuagugagacccc

SEQ ID NO: 436765 - RNA, 21 nt, Human
ccccucccucagacuccacag

SEQ ID NO: 436766 - RNA, 21 nt, Human
ccccugggugugggggacagg

SEQ ID NO: 436767 - RNA, 22 nt, Human
ccccugggugugggggacaggg

SEQ ID NO: 436768 - RNA, 19 nt, Human
cccgccacgucgcccccca

SEQ ID NO: 436769 - RNA, 22 nt, Human
cccgccacgucgccccccagac

SEQ ID NO: 436770 - RNA, 23 nt, Human
cccgccacgucgccccccagaca

SEQ ID NO: 436771 - RNA, 21 nt, Human
ccgacccgccacgucgccccc

SEQ ID NO: 436772 - RNA, 19 nt, Human
ccgccacgucgccccccag

SEQ ID NO: 436773 - RNA, 18 nt, Human
ccgccgccgcugcugcga

SEQ ID NO: 436774 - RNA, 18 nt, Human
ccgcgggcucugccuccu

SEQ ID NO: 436775 - RNA, 19 nt, Human
ccucaagcuagugagaccc

SEQ ID NO: 436776 - RNA, 19 nt, Human
ccucagacuccacaggaag

SEQ ID NO: 436777 - RNA, 22 nt, Human
ccuccagcgucccgcucagcuc

SEQ ID NO: 436778 - RNA, 21 nt, Human
ccugaauggagccccucccuc

SEQ ID NO: 436779 - RNA, 20 nt, Human
cgccccccagacacgguccc

SEQ ID NO: 436780 - RNA, 18 nt, Human
cgccuggagcgagcugcu

SEQ ID NO: 436781 - RNA, 23 nt, Human
cgcggagcccagagccgccuccc

SEQ ID NO: 436782 - RNA, 22 nt, Human
cggacugaacaggcaugggcca

SEQ ID NO: 436783 - RNA, 21 nt, Human
cggcguccugagugcuccgag

SEQ ID NO: 436784 - RNA, 21 nt, Human
cuaaacgaauagugaaaauaa

SEQ ID NO: 436785 - RNA, 20 nt, Human
cuccagcgucccgcucagcu

SEQ ID NO: 436786 - RNA, 29 nt, Human
cugaggcucacuccugccuggugucgugu

SEQ ID NO: 436787 - RNA, 19 nt, Human
cugcugcgaagcuugaggu

SEQ ID NO: 436788 - RNA, 21 nt, Human
cugggcugggggccucggcug

SEQ ID NO: 436789 - RNA, 23 nt, Human
cuggggcuggggugggcauggcu

SEQ ID NO: 436790 - RNA, 24 nt, Human
cuuccaaggcugcagcuaaaaccc

SEQ ID NO: 436791 - RNA, 19 nt, Human
cuugcucccacugggcugg

SEQ ID NO: 436792 - RNA, 21 nt, Human
gaaugcagggaaccggccgac

SEQ ID NO: 436793 - RNA, 19 nt, Human
gacccgccacgucgccccc

SEQ ID NO: 436794 - RNA, 21 nt, Human
gaccucaguggcucuuaguau

SEQ ID NO: 436795 - RNA, 19 nt, Human
gagcccagagccgccuccc

SEQ ID NO: 436796 - RNA, 18 nt, Human
gcaccugcaccugccucc

SEQ ID NO: 436797 - RNA, 23 nt, Human
gcagccgccgccgccgcugcugc

SEQ ID NO: 436798 - RNA, 18 nt, Human
gccaugacggacugaaca

SEQ ID NO: 436799 - RNA, 22 nt, Human
gccuccuucccggcagccgccg

SEQ ID NO: 436800 - RNA, 20 nt, Human
gcuugcuuucuaaugaaaau

SEQ ID NO: 436801 - RNA, 18 nt, Human
ggagggcggggaagggcg

SEQ ID NO: 436802 - RNA, 19 nt, Human
ggccgacccgccacgucgc

SEQ ID NO: 436803 - RNA, 22 nt, Human
ggcuggggugggcauggcuuuu

SEQ ID NO: 436804 - RNA, 19 nt, Human
gggaauggcuuucguuucu

SEQ ID NO: 436805 - RNA, 23 nt, Human
gggccucggcugggcgccuggag

SEQ ID NO: 436806 - RNA, 22 nt, Human
gggcuggggugggcauggcuuu

SEQ ID NO: 436807 - RNA, 18 nt, Human
ggggaagggcgcgcggcg

SEQ ID NO: 436808 - RNA, 25 nt, Human
ggucccaucccuccagcgucccgcu

SEQ ID NO: 436809 - RNA, 21 nt, Human
uaaaacgaaugcagggaaccg

SEQ ID NO: 436810 - RNA, 19 nt, Human
uaccugguagggagguuau

SEQ ID NO: 436811 - RNA, 24 nt, Human
uauuuugugcuugcuuucuaauga

SEQ ID NO: 436812 - RNA, 19 nt, Human
ucaggacugagcaggaaag

SEQ ID NO: 436813 - RNA, 20 nt, Human
ucaggacugagcaggaaagg

SEQ ID NO: 436814 - RNA, 22 nt, Human
ucccggcagccgccgccgccgc

SEQ ID NO: 436815 - RNA, 27 nt, Human
ucccuccagcgucccgcucagcuccag

SEQ ID NO: 436816 - RNA, 24 nt, Human
uccuucacuuugugggaauggcuu

SEQ ID NO: 436817 - RNA, 19 nt, Human
ucgguaaugucguacaucu

SEQ ID NO: 436818 - RNA, 21 nt, Human
ucggugccuccuuccaaggcu

SEQ ID NO: 436819 - RNA, 23 nt, Human
ucugccuccugcucugggcuccc

SEQ ID NO: 436820 - RNA, 20 nt, Human
ugagaccccagcaucaccaa

SEQ ID NO: 436821 - RNA, 23 nt, Human
ugcagggacggggccugaggcuc

SEQ ID NO: 436822 - RNA, 24 nt, Human
ugggcauggcuuuucucuucauuu

SEQ ID NO: 436823 - RNA, 19 nt, Human
ugggcugggggccucggcu

SEQ ID NO: 436824 - RNA, 18 nt, Human
ugggggacaggguucugg

SEQ ID NO: 436825 - RNA, 21 nt, Human
ugggugugggggacaggguuc

SEQ ID NO: 436826 - RNA, 21 nt, Human
ugugggggacaggguucuggg

SEQ ID NO: 436827 - RNA, 25 nt, Human
uguguuguugcucguccaaacauug

SEQ ID NO: 436828 - RNA, 26 nt, Human
aaaugucccaugugggggugcuggag

SEQ ID NO: 436829 - RNA, 22 nt, Human
aacucacagcagaaagaaacaa

SEQ ID NO: 436830 - RNA, 18 nt, Human
aagaaaacccgacacacg

SEQ ID NO: 436831 - RNA, 22 nt, Human
aagacacuacugcaaagaccua

SEQ ID NO: 436832 - RNA, 23 nt, Human
accauugauacugcagcacauua

SEQ ID NO: 436833 - RNA, 23 nt, Human
acguggcauuuuuuuuuccccag

SEQ ID NO: 436834 - RNA, 25 nt, Human
agacaaaugcagcauuguggucccc

SEQ ID NO: 436835 - RNA, 20 nt, Human
aggcuguggcuggaggcccg

SEQ ID NO: 436836 - RNA, 20 nt, Human
agggcgccaccgcugcugaa

SEQ ID NO: 436837 - RNA, 22 nt, Human
auggagaugcuaaauguccaca

SEQ ID NO: 436838 - RNA, 21 nt, Human
caaaugucccaugugggggug

SEQ ID NO: 436839 - RNA, 19 nt, Human
caagcaaacuuaaguugaa

SEQ ID NO: 436840 - RNA, 22 nt, Human
cagaaagaaacaaacgacccua

SEQ ID NO: 436841 - RNA, 18 nt, Human
cagcagaaagaaacaaac

SEQ ID NO: 436842 - RNA, 22 nt, Human
cagcagaaagaaacaaacgacc

SEQ ID NO: 436843 - RNA, 22 nt, Human
cagccgaugguaacaucugcaa

SEQ ID NO: 436844 - RNA, 21 nt, Human
cagcuaaaucucaguuccaca

SEQ ID NO: 436845 - RNA, 25 nt, Human
caugcaguccccaggcuauugucuc

SEQ ID NO: 436846 - RNA, 19 nt, Human
cauuauacuggaaaacaca

SEQ ID NO: 436847 - RNA, 18 nt, Human
ccccugggacucuccaag

SEQ ID NO: 436848 - RNA, 22 nt, Human
cccgcugcauucaggcaagaau

SEQ ID NO: 436849 - RNA, 24 nt, Human
ccuguccccugggacucuccaaga

SEQ ID NO: 436850 - RNA, 22 nt, Human
cuaagacacuacugcaaagacc

SEQ ID NO: 436851 - RNA, 24 nt, Human
cuacaguuaucuuacuaccaagaa

SEQ ID NO: 436852 - RNA, 20 nt, Human
cucacagcagaaagaaacaa

SEQ ID NO: 436853 - RNA, 24 nt, Human
cugauuccacuuguucuuagccau

SEQ ID NO: 436854 - RNA, 18 nt, Human
cugcugauuuucuuccuc

SEQ ID NO: 436855 - RNA, 20 nt, Human
cuggaggcccgcugcauuca

SEQ ID NO: 436856 - RNA, 24 nt, Human
cugucugcugauuuucuuccucug

SEQ ID NO: 436857 - RNA, 19 nt, Human
gagcagcaucguggggggu

SEQ ID NO: 436858 - RNA, 21 nt, Human
gaugguaacaucugcaaucuc

SEQ ID NO: 436859 - RNA, 24 nt, Human
gcaagaaugugcagcuaaaucuca

SEQ ID NO: 436860 - RNA, 18 nt, Human
gccagcaggcuguggcug

SEQ ID NO: 436861 - RNA, 18 nt, Human
uaacucacagcagaaaga

SEQ ID NO: 436862 - RNA, 23 nt, Human
uaagggcuugaaaccuguccccu

SEQ ID NO: 436863 - RNA, 19 nt, Human
uaccaagaaagaaaagccc

SEQ ID NO: 436864 - RNA, 23 nt, Human
uaccaagaaagaaaagcccuuuu

SEQ ID NO: 436865 - RNA, 26 nt, Human
uacugcaaagaccuacaguuaucuua

SEQ ID NO: 436866 - RNA, 27 nt, Human
uacugcagcacauuauacuggaaaaca

SEQ ID NO: 436867 - RNA, 23 nt, Human
uaucgcacccaagaaaacccgac

SEQ ID NO: 436868 - RNA, 25 nt, Human
ucaauaaaaaugauauggccuuugu

SEQ ID NO: 436869 - RNA, 19 nt, Human
ucaggcaagaaugugcagc

SEQ ID NO: 436870 - RNA, 21 nt, Human
ucagucaccauuuccccguuu

SEQ ID NO: 436871 - RNA, 25 nt, Human
uccccaggcuauugucuccucaguu

SEQ ID NO: 436872 - RNA, 22 nt, Human
uccccaguauuuuucugucugc

SEQ ID NO: 436873 - RNA, 19 nt, Human
ucugcugauuuucuuccuc

SEQ ID NO: 436874 - RNA, 19 nt, Human
ucuuccucugauguccugg

SEQ ID NO: 436875 - RNA, 28 nt, Human
ugaaaccuguccccugggacucuccaag

SEQ ID NO: 436876 - RNA, 19 nt, Human
ugaacagaaccacguggca

SEQ ID NO: 436877 - RNA, 19 nt, Human
ugaugcaaguuccaguuca

SEQ ID NO: 436878 - RNA, 19 nt, Human
ugcagcuaaaucucaguuc

SEQ ID NO: 436879 - RNA, 21 nt, Human
ugcuaaauguccacauuggag

SEQ ID NO: 436880 - RNA, 21 nt, Human
uggagggagcagaagcucagc

SEQ ID NO: 436881 - RNA, 18 nt, Human
uggaugugaacggcugug

SEQ ID NO: 436882 - RNA, 20 nt, Human
ugucacagaaucaaugacac

SEQ ID NO: 436883 - RNA, 20 nt, Human
uuucucacuuguaagaugga

SEQ ID NO: 436884 - RNA, 20 nt, Human
aagcagcuuggcuuuccucu

SEQ ID NO: 436885 - RNA, 21 nt, Human
accuggcccacuuucuucaac

SEQ ID NO: 436886 - RNA, 21 nt, Human
acuucguucuccccggcucug

SEQ ID NO: 436887 - RNA, 22 nt, Human
agaugcuaaggagaccaucugg

SEQ ID NO: 436888 - RNA, 21 nt, Human
agccucugaggccuaacaccc

SEQ ID NO: 436889 - RNA, 21 nt, Human
aggcaguuccaggaagucuuc

SEQ ID NO: 436890 - RNA, 19 nt, Human
agguccccccucccccgcc

SEQ ID NO: 436891 - RNA, 25 nt, Human
caacagaagcagcuuggcuuuccuc

SEQ ID NO: 436892 - RNA, 25 nt, Human
caaccaccuggcccacuuucuucaa

SEQ ID NO: 436893 - RNA, 22 nt, Human
cacauggcuuucuucaaccacc

SEQ ID NO: 436894 - RNA, 26 nt, Human
cacccucaaacaccucacagucccaa

SEQ ID NO: 436895 - RNA, 21 nt, Human
cagcaauccaaguuccuaucu

SEQ ID NO: 436896 - RNA, 18 nt, Human
cagcccgcaaaccuagag

SEQ ID NO: 436897 - RNA, 22 nt, Human
cagcuuggcuuuccucuggaag

SEQ ID NO: 436898 - RNA, 25 nt, Human
caggcucuuggcugauucgcucaca

SEQ ID NO: 436899 - RNA, 19 nt, Human
cccaccagcccgcaaaccu

SEQ ID NO: 436900 - RNA, 18 nt, Human
ccccccucccccgccaaa

SEQ ID NO: 436901 - RNA, 21 nt, Human
cccucaaacaccucacagucc

SEQ ID NO: 436902 - RNA, 21 nt, Human
ccuacagccucugaggccuaa

SEQ ID NO: 436903 - RNA, 24 nt, Human
ccucaaacaccucacagucccaaa

SEQ ID NO: 436904 - RNA, 20 nt, Human
cucacagucccaaacggggu

SEQ ID NO: 436905 - RNA, 20 nt, Human
cuccaaaaaaaagaaaaagg

SEQ ID NO: 436906 - RNA, 22 nt, Human
cucuguaacccaaggacccuac

SEQ ID NO: 436907 - RNA, 21 nt, Human
cucuuggcugauucgcucaca

SEQ ID NO: 436908 - RNA, 26 nt, Human
cuuuacauacaacaaacaugucaaga

SEQ ID NO: 436909 - RNA, 23 nt, Human
gaaguaccaauuugaaagcccac

SEQ ID NO: 436910 - RNA, 22 nt, Human
gagaugcuaaggagaccaucug

SEQ ID NO: 436911 - RNA, 24 nt, Human
gagcugagaugcuaaggagaccau

SEQ ID NO: 436912 - RNA, 20 nt, Human
ggaaguaccaauuugaaagc

SEQ ID NO: 436913 - RNA, 19 nt, Human
guccacacccucaaacacc

SEQ ID NO: 436914 - RNA, 19 nt, Human
uaacacccaagcucuuccu

SEQ ID NO: 436915 - RNA, 25 nt, Human
uaagcccuugggauuugcugagcuc

SEQ ID NO: 436916 - RNA, 21 nt, Human
uacaacaaacaugucaagacc

SEQ ID NO: 436917 - RNA, 20 nt, Human
uagaguguauucuccacccc

SEQ ID NO: 436918 - RNA, 24 nt, Human
uccaaguuccuaucuaucucggug

SEQ ID NO: 436919 - RNA, 23 nt, Human
uccacacccucaaacaccucaca

SEQ ID NO: 436920 - RNA, 20 nt, Human
ucccaaacggggugcuccua

SEQ ID NO: 436921 - RNA, 21 nt, Human
uccccccucccccgccaaaau

SEQ ID NO: 436922 - RNA, 23 nt, Human
ucuguaacccaaggacccuacag

SEQ ID NO: 436923 - RNA, 22 nt, Human
ucuuaagaaugggcucuguuuu

SEQ ID NO: 436924 - RNA, 23 nt, Human
ugccaguccacacccucaaacac

SEQ ID NO: 436925 - RNA, 22 nt, Human
uggaagaaaggcaguuccagga

SEQ ID NO: 436926 - RNA, 20 nt, Human
uggcuucuaauguaaggccu

SEQ ID NO: 436927 - RNA, 22 nt, Human
ugggaccuccaaaaaaaagaaa

SEQ ID NO: 436928 - RNA, 23 nt, Human
ugggaccuccaaaaaaaagaaaa

SEQ ID NO: 436929 - RNA, 21 nt, Human
ugggauuugcugagcucccac

SEQ ID NO: 436930 - RNA, 22 nt, Human
ugguuuguaaaauaucuuccuc

SEQ ID NO: 436931 - RNA, 25 nt, Human
uguaacccaaggacccuacagccuc

SEQ ID NO: 436932 - RNA, 22 nt, Human
uuagaaaaaucaaaaauuuuaa

SEQ ID NO: 436933 - RNA, 22 nt, Human
uugaaaagguccccccuccccc

SEQ ID NO: 436934 - RNA, 21 nt, Human
uugcugagcucccacauggcu

SEQ ID NO: 436935 - RNA, 22 nt, Human
uuugaaagcccaccagcccgca

SEQ ID NO: 436936 - RNA, 19 nt, Human
aaacaauucaugaacucug

SEQ ID NO: 436937 - RNA, 22 nt, Human
aacauauaaauaugcaaugcca

SEQ ID NO: 436938 - RNA, 23 nt, Human
aagcaaaacugcaaaacguaguc

SEQ ID NO: 436939 - RNA, 26 nt, Human
aagcauuuaaaacaauucaugaacuc

SEQ ID NO: 436940 - RNA, 24 nt, Human
aaguccaggucugguucuucagcc

SEQ ID NO: 436941 - RNA, 19 nt, Human
accacaaauacaauaacug

SEQ ID NO: 436942 - RNA, 22 nt, Human
agagacauguauuucaaacucc

SEQ ID NO: 436943 - RNA, 18 nt, Human
agcacuuuaagcaugauu

SEQ ID NO: 436944 - RNA, 20 nt, Human
aguuggguguaucucccugc

SEQ ID NO: 436945 - RNA, 23 nt, Human
aguuggguguaucucccugcggc

SEQ ID NO: 436946 - RNA, 23 nt, Human
auaauacuuacuugguuaucuaa

SEQ ID NO: 436947 - RNA, 21 nt, Human
auacuuacuugguuaucuaaa

SEQ ID NO: 436948 - RNA, 21 nt, Human
augcagcccaacgacuucuac

SEQ ID NO: 436949 - RNA, 18 nt, Human
augccaaacaucuuucuc

SEQ ID NO: 436950 - RNA, 25 nt, Human
caaacaucuuucucucuagcucgcc

SEQ ID NO: 436951 - RNA, 19 nt, Human
caacaaauacauguucaga

SEQ ID NO: 436952 - RNA, 25 nt, Human
caacaccacaaauacaauaacugaa

SEQ ID NO: 436953 - RNA, 24 nt, Human
caagcugcaguaaguuuguccuaa

SEQ ID NO: 436954 - RNA, 18 nt, Human
caaggcaaggcaacacca

SEQ ID NO: 436955 - RNA, 18 nt, Human
cacaaacaagggugcaaa

SEQ ID NO: 436956 - RNA, 21 nt, Human
caccuccggcugcugcagucc

SEQ ID NO: 436957 - RNA, 19 nt, Human
cagaagagaaugccugcug

SEQ ID NO: 436958 - RNA, 23 nt, Human
caguaaguuuguccuaagaaagu

SEQ ID NO: 436959 - RNA, 21 nt, Human
caguucuccagggaccagccu

SEQ ID NO: 436960 - RNA, 21 nt, Human
cccagcaucaugcaaggcaag

SEQ ID NO: 436961 - RNA, 20 nt, Human
ccccagcaucaugcaaggca

SEQ ID NO: 436962 - RNA, 26 nt, Human
cccccccuugcugcuauggucccaac

SEQ ID NO: 436963 - RNA, 27 nt, Human
ccuccagcuuauucuuuuggggccgcc

SEQ ID NO: 436964 - RNA, 26 nt, Human
ccugcggcuugggugagcgccgaggc

SEQ ID NO: 436965 - RNA, 22 nt, Human
ccugcugguagaauauuacuuc

SEQ ID NO: 436966 - RNA, 21 nt, Human
cgcaaacuuguguccaaccgc

SEQ ID NO: 436967 - RNA, 23 nt, Human
cgcaaacuuguguccaaccgcac

SEQ ID NO: 436968 - RNA, 18 nt, Human
cggccccgcccucaggac

SEQ ID NO: 436969 - RNA, 18 nt, Human
cgguggcccaauacaugc

SEQ ID NO: 436970 - RNA, 26 nt, Human
cguaaacaaggauaggauacuucuga

SEQ ID NO: 436971 - RNA, 19 nt, Human
cuaccuggcuaauuccggu

SEQ ID NO: 436972 - RNA, 19 nt, Human
cucaaauucuaccuggcua

SEQ ID NO: 436973 - RNA, 18 nt, Human
cuccaggcagaaaggcag

SEQ ID NO: 436974 - RNA, 18 nt, Human
cucccagcgacuccuucc

SEQ ID NO: 436975 - RNA, 21 nt, Human
cucgagagggggcgcuuuccc

SEQ ID NO: 436976 - RNA, 24 nt, Human
cucguucgcaguucuccagggacc

SEQ ID NO: 436977 - RNA, 20 nt, Human
cucugcaaaggagccacuau

SEQ ID NO: 436978 - RNA, 19 nt, Human
cugcagcucguucgcaguu

SEQ ID NO: 436979 - RNA, 25 nt, Human
cuucucauacgcugccacucuuagu

SEQ ID NO: 436980 - RNA, 23 nt, Human
cuugcuaaaacucaaauucuacc

SEQ ID NO: 436981 - RNA, 21 nt, Human
gaaaacacuccuacgcaaacu

SEQ ID NO: 436982 - RNA, 23 nt, Human
gcgucgcugucaccuccggcugc

SEQ ID NO: 436983 - RNA, 19 nt, Human
gcuuuggcuccuccccagc

SEQ ID NO: 436984 - RNA, 21 nt, Human
ggagcuguugaguuccugcug

SEQ ID NO: 436985 - RNA, 20 nt, Human
ggcgucgcugucaccuccgg

SEQ ID NO: 436986 - RNA, 18 nt, Human
gggcuccgagagcaacag

SEQ ID NO: 436987 - RNA, 19 nt, Human
guauuauaauacuuacuug

SEQ ID NO: 436988 - RNA, 25 nt, Human
uaaaacaauucaugaacucuguaug

SEQ ID NO: 436989 - RNA, 28 nt, Human
uaaagcacaauguagcaugugcaaagaa

SEQ ID NO: 436990 - RNA, 18 nt, Human
uaacacaaacaagggugc

SEQ ID NO: 436991 - RNA, 18 nt, Human
uaagacuuagggggucca

SEQ ID NO: 436992 - RNA, 22 nt, Human
uaaguuuguccuaagaaagucc

SEQ ID NO: 436993 - RNA, 22 nt, Human
uagaaaauaagacuuagggggu

SEQ ID NO: 436994 - RNA, 20 nt, Human
uagagaagagagugcuuuuc

SEQ ID NO: 436995 - RNA, 18 nt, Human
uaggucuguuaggagucu

SEQ ID NO: 436996 - RNA, 23 nt, Human
uauaaagccagacuuuaagaagc

SEQ ID NO: 436997 - RNA, 23 nt, Human
ucauaacacaaacaagggugcaa

SEQ ID NO: 436998 - RNA, 21 nt, Human
uccccagcugcugcgagcuuc

SEQ ID NO: 436999 - RNA, 22 nt, Human
ucccucuacacugaaugaaagu

SEQ ID NO: 437000 - RNA, 24 nt, Human
ugaaaguacaaaaagaaaccaguc

SEQ ID NO: 437001 - RNA, 25 nt, Human
ugaacucuguaugaaaggaaauaau

SEQ ID NO: 437002 - RNA, 20 nt, Human
ugacaguagccuauaaagau

SEQ ID NO: 437003 - RNA, 21 nt, Human
ugauuugugagguaaagucac

SEQ ID NO: 437004 - RNA, 24 nt, Human
ugcaaggcaaggcaacaccacaaa

SEQ ID NO: 437005 - RNA, 21 nt, Human
ugcgccgggcgccugggagcc

SEQ ID NO: 437006 - RNA, 20 nt, Human
ugcuccuucgcgaaaugauc

SEQ ID NO: 437007 - RNA, 22 nt, Human
ugcuguuuccucaucucccagu

SEQ ID NO: 437008 - RNA, 18 nt, Human
uggguguaucucccugcg

SEQ ID NO: 437009 - RNA, 22 nt, Human
ugguucuucagccuugcuccuu

SEQ ID NO: 437010 - RNA, 23 nt, Human
uguggguuaguucuccucucugg

SEQ ID NO: 437011 - RNA, 26 nt, Human
uguguugacagaauaugauuugugag

SEQ ID NO: 437012 - RNA, 22 nt, Human
uucaaacuccaggcagaaaggc

SEQ ID NO: 437013 - RNA, 19 nt, Human
uuccaguaucaucaguuua

SEQ ID NO: 437014 - RNA, 24 nt, Human
uuccgguggcccaauacaugcuuu

SEQ ID NO: 437015 - RNA, 19 nt, Human
uuccucaucucccaguugg

SEQ ID NO: 437016 - RNA, 21 nt, Human
uucuuuucucuuuuuccccca

SEQ ID NO: 437017 - RNA, 24 nt, Human
uuuacuagaaaauaagacuuaggg

SEQ ID NO: 437018 - RNA, 24 nt, Human
uuuccagaaaaauuuuguaggaaa

SEQ ID NO: 437019 - RNA, 26 nt, Human
uuuguccuaagaaaguccaggucugg

SEQ ID NO: 437020 - RNA, 23 nt, Human
uuuucauaacacaaacaagggug

SEQ ID NO: 437021 - RNA, 19 nt, Human
uuuucccucuacacugaau

SEQ ID NO: 437022 - RNA, 23 nt, Human
acgccugaguuucccuugggagc

SEQ ID NO: 437023 - RNA, 22 nt, Human
auggggagcugugaggaggcug

SEQ ID NO: 437024 - RNA, 21 nt, Human
ggagccccucgguccuggagg

SEQ ID NO: 437025 - RNA, 23 nt, Human
aaaaagaaaucuaugaugggcac

SEQ ID NO: 437026 - RNA, 22 nt, Human
aaacuaaauauccaaaaugcag

SEQ ID NO: 437027 - RNA, 19 nt, Human
aaccaguacucacaaggca

SEQ ID NO: 437028 - RNA, 19 nt, Human
aagaaauguugaaaaggca

SEQ ID NO: 437029 - RNA, 21 nt, Human
acagcggcggcggcggcgggc

SEQ ID NO: 437030 - RNA, 23 nt, Human
acaguaacaggaucaugagcauc

SEQ ID NO: 437031 - RNA, 18 nt, Human
accagugagaagacagcu

SEQ ID NO: 437032 - RNA, 22 nt, Human
agaagacagcuuugcagucaca

SEQ ID NO: 437033 - RNA, 20 nt, Human
agcggcggcggcggcgggcg

SEQ ID NO: 437034 - RNA, 18 nt, Human
aggcaggaaacggagucc

SEQ ID NO: 437035 - RNA, 22 nt, Human
aggcaguaccagugagaagaca

SEQ ID NO: 437036 - RNA, 24 nt, Human
aguaccagugagaagacagcuuug

SEQ ID NO: 437037 - RNA, 19 nt, Human
auaaaugaauccaccauga

SEQ ID NO: 437038 - RNA, 18 nt, Human
auucagaacaagaaaaau

SEQ ID NO: 437039 - RNA, 23 nt, Human
caaaauuaguagcugcaaaguca

SEQ ID NO: 437040 - RNA, 26 nt, Human
caaggcaggaaacggaguccagaucc

SEQ ID NO: 437041 - RNA, 25 nt, Human
cacagcaagggcaacacuaaaaaaa

SEQ ID NO: 437042 - RNA, 21 nt, Human
cacaugccccacaguccaacc

SEQ ID NO: 437043 - RNA, 24 nt, Human
cagaacaagaaaaauccuauaaua

SEQ ID NO: 437044 - RNA, 27 nt, Human
cagcaagggcaacacuaaaaaaagaaa

SEQ ID NO: 437045 - RNA, 20 nt, Human
cagcggcggcggcggcgggc

SEQ ID NO: 437046 - RNA, 19 nt, Human
caugccccacaguccaacc

SEQ ID NO: 437047 - RNA, 27 nt, Human
ccaaccaguacucacaaggcaguacca

SEQ ID NO: 437048 - RNA, 24 nt, Human
ccggacagcggcggcggcggcuuu

SEQ ID NO: 437049 - RNA, 24 nt, Human
ccuguccugucauagacuuagaaa

SEQ ID NO: 437050 - RNA, 22 nt, Human
cgcccggggccucgucgcgcuc

SEQ ID NO: 437051 - RNA, 20 nt, Human
cggccucgaggcgcgcgcgg

SEQ ID NO: 437052 - RNA, 21 nt, Human
cggcggacuccggcucgcgcc

SEQ ID NO: 437053 - RNA, 18 nt, Human
cucgucgcgcuccggcuc

SEQ ID NO: 437054 - RNA, 21 nt, Human
cugaaauaccaguuuuuguuu

SEQ ID NO: 437055 - RNA, 19 nt, Human
cugcagcggccacaugccc

SEQ ID NO: 437056 - RNA, 18 nt, Human
gacagcggcggcggcggc

SEQ ID NO: 437057 - RNA, 18 nt, Human
gaucaugagcaucacuug

SEQ ID NO: 437058 - RNA, 27 nt, Human
gauggcggcggcacggcgguggcggca

SEQ ID NO: 437059 - RNA, 22 nt, Human
gcaaaaacuaagucuguccaaa

SEQ ID NO: 437060 - RNA, 18 nt, Human
gcggcagcggggagggcg

SEQ ID NO: 437061 - RNA, 26 nt, Human
gcggcggcacggcgguggcggcagcg

SEQ ID NO: 437062 - RNA, 30 nt, Human
gcggcggcggcgggcggauggcggcggcaa

SEQ ID NO: 437063 - RNA, 23 nt, Human
gcggggccggcgugcucgggggc

SEQ ID NO: 437064 - RNA, 23 nt, Human
gcugcagcaugucaccaaugcca

SEQ ID NO: 437065 - RNA, 21 nt, Human
ggauggcggcggcacggcggu

SEQ ID NO: 437066 - RNA, 19 nt, Human
ggcgggcggauggcggcgg

SEQ ID NO: 437067 - RNA, 25 nt, Human
ggggagggcgcgcccggggccucgu

SEQ ID NO: 437068 - RNA, 29 nt, Human
gggggccggacagcggcggcggcggcggg

SEQ ID NO: 437069 - RNA, 21 nt, Human
gucaauucuugcaugugauuu

SEQ ID NO: 437070 - RNA, 22 nt, Human
uaaaaugaauacaaagggaaaa

SEQ ID NO: 437071 - RNA, 18 nt, Human
uaacacuucucaaagaca

SEQ ID NO: 437072 - RNA, 21 nt, Human
uaagcacaauacagcaauuua

SEQ ID NO: 437073 - RNA, 22 nt, Human
uacauacuacaacaguguguca

SEQ ID NO: 437074 - RNA, 28 nt, Human
uauacacauuagacugguagcuuguaug

SEQ ID NO: 437075 - RNA, 21 nt, Human
uauuacacagcaagggcaaca

SEQ ID NO: 437076 - RNA, 23 nt, Human
ucaaaauuaguagcugcaaaguc

SEQ ID NO: 437077 - RNA, 25 nt, Human
ucacaaggcaguaccagugagaaga

SEQ ID NO: 437078 - RNA, 25 nt, Human
ucagaaaacagaucugaaauaccag

SEQ ID NO: 437079 - RNA, 21 nt, Human
uccaaagagcaaggcaggaaa

SEQ ID NO: 437080 - RNA, 22 nt, Human
uccaaccaguacucacaaggca

SEQ ID NO: 437081 - RNA, 23 nt, Human
uccaggcugcagcaugucaccaa

SEQ ID NO: 437082 - RNA, 20 nt, Human
uccggcucgcgccgcggccg

SEQ ID NO: 437083 - RNA, 23 nt, Human
ucucaaagacaucugaccaauca

SEQ ID NO: 437084 - RNA, 22 nt, Human
ugaaaaaaaaucgcuuuuccca

SEQ ID NO: 437085 - RNA, 18 nt, Human
ugaaaaggcagauaaaau

SEQ ID NO: 437086 - RNA, 19 nt, Human
ugaagcaagaacagccugu

SEQ ID NO: 437087 - RNA, 23 nt, Human
ugaagcaagaacagccugucccc

SEQ ID NO: 437088 - RNA, 21 nt, Human
ugaauacaaagggaaaauaaa

SEQ ID NO: 437089 - RNA, 23 nt, Human
ugaauacaaagggaaaauaaaga

SEQ ID NO: 437090 - RNA, 21 nt, Human
ugcucgggggccggacagcgg

SEQ ID NO: 437091 - RNA, 23 nt, Human
uggcggcagcggggagggcgcgc

SEQ ID NO: 437092 - RNA, 19 nt, Human
uggcggcggcacggcggug

SEQ ID NO: 437093 - RNA, 19 nt, Human
uggcggcggcacggcggug

SEQ ID NO: 437094 - RNA, 24 nt, Human
uggcggcggcacggcgguggcggc

SEQ ID NO: 437095 - RNA, 22 nt, Human
ugguagcuuguauguuggcccu

SEQ ID NO: 437096 - RNA, 22 nt, Human
ugucaaggauauucagaacaag

SEQ ID NO: 437097 - RNA, 22 nt, Human
ugucagagaagguucugaagca

SEQ ID NO: 437098 - RNA, 21 nt, Human
ugucauagacuuagaaauaac

SEQ ID NO: 437099 - RNA, 22 nt, Human
ugugcaucucacaccuugacuc

SEQ ID NO: 437100 - RNA, 19 nt, Human
uuaacacuucucaaagaca

SEQ ID NO: 437101 - RNA, 21 nt, Human
uuagaugcuuaaaaugaauac

SEQ ID NO: 437102 - RNA, 21 nt, Human
uucagaaugaauacaugaaaa

SEQ ID NO: 437103 - RNA, 28 nt, Human
uucagaaugaauacaugaaaaaaaaucc

SEQ ID NO: 437104 - RNA, 22 nt, Human
uuccaggcugcagcaugucacc

SEQ ID NO: 437105 - RNA, 23 nt, Human
uuucgcauugugcaucucacacc

SEQ ID NO: 437106 - RNA, 23 nt, Human
aaaaggaaauacacaaaagaaga

SEQ ID NO: 437107 - RNA, 25 nt, Human
aaaggaaauaggaugaggagcaaga

SEQ ID NO: 437108 - RNA, 28 nt, Human
aagaaauagcagaaaaggaaauacacaa

SEQ ID NO: 437109 - RNA, 24 nt, Human
aagacaaaggaaauaggaugagga

SEQ ID NO: 437110 - RNA, 22 nt, Human
acucuugacuuuggaaaaacug

SEQ ID NO: 437111 - RNA, 23 nt, Human
acuuuggaaaaacugaaaagaaa

SEQ ID NO: 437112 - RNA, 26 nt, Human
agaaaaggaaauacacaaaagaagaa

SEQ ID NO: 437113 - RNA, 22 nt, Human
agcagaaaaggaaauacacaaa

SEQ ID NO: 437114 - RNA, 20 nt, Human
agccugaaaaaacugagcuu

SEQ ID NO: 437115 - RNA, 22 nt, Human
agggugucuuuguggggaaauu

SEQ ID NO: 437116 - RNA, 18 nt, Human
auacacaaaagaagaauc

SEQ ID NO: 437117 - RNA, 18 nt, Human
augagccugaaaaaacug

SEQ ID NO: 437118 - RNA, 23 nt, Human
augaggagcaagaagaaucagaa

SEQ ID NO: 437119 - RNA, 22 nt, Human
caaaauucccugaguacaaggu

SEQ ID NO: 437120 - RNA, 20 nt, Human
cugggcucuggagagggugu

SEQ ID NO: 437121 - RNA, 22 nt, Human
gaaaagaaauagcagaaaagga

SEQ ID NO: 437122 - RNA, 19 nt, Human
gacuuuggaaaaacugaag

SEQ ID NO: 437123 - RNA, 24 nt, Human
gcaagaagaaucagaaaaaacaac

SEQ ID NO: 437124 - RNA, 20 nt, Human
gcugggcucuggagagggug

SEQ ID NO: 437125 - RNA, 20 nt, Human
gggcucuggagagggugucu

SEQ ID NO: 437126 - RNA, 18 nt, Human
uaagacaaaggaaauagg

SEQ ID NO: 437127 - RNA, 21 nt, Human
uagcagaaaaggaaauacaca

SEQ ID NO: 437128 - RNA, 23 nt, Human
uagcagaaaaggaaauacacaaa

SEQ ID NO: 437129 - RNA, 23 nt, Human
ugaaaagaaauagcagaaaagga

SEQ ID NO: 437130 - RNA, 21 nt, Human
uggggaaauuaagacaaagga

SEQ ID NO: 437131 - RNA, 25 nt, Human
uuggaaaaacugaaaagaaauagca

SEQ ID NO: 437132 - RNA, 22 nt, Human
aaaauucacaaguacaacacug

SEQ ID NO: 437133 - RNA, 23 nt, Human
accuguacaguuuuuauuacaua

SEQ ID NO: 437134 - RNA, 18 nt, Human
cccugccgccgccggugc

SEQ ID NO: 437135 - RNA, 23 nt, Human
cguguugccauuauuaacucuuu

SEQ ID NO: 437136 - RNA, 19 nt, Human
cugccgccgccggugcucc

SEQ ID NO: 437137 - RNA, 24 nt, Human
gaccuguacaguuuuuauuacaua

SEQ ID NO: 437138 - RNA, 19 nt, Human
gacuccugucucuggcauc

SEQ ID NO: 437139 - RNA, 28 nt, Human
gccgccgccggugcuccgucgccgccgg

SEQ ID NO: 437140 - RNA, 19 nt, Human
gcuccgucgccgccgcgcc

SEQ ID NO: 437141 - RNA, 19 nt, Human
gggaagagucuucuggagc

SEQ ID NO: 437142 - RNA, 18 nt, Human
uaacucuuuugcuuucau

SEQ ID NO: 437143 - RNA, 21 nt, Human
ucgcccugccgccgccggugc

SEQ ID NO: 437144 - RNA, 19 nt, Human
ucucgcccugccgccgccg

SEQ ID NO: 437145 - RNA, 19 nt, Human
ugcuccgucgccgccgcgc

SEQ ID NO: 437146 - RNA, 19 nt, Human
uggcaggggaagagucuuc

SEQ ID NO: 437147 - RNA, 20 nt, Human
uguugccauuauuaacucuu

SEQ ID NO: 437148 - RNA, 18 nt, Human
uuucuuggcaggggaaga

SEQ ID NO: 437149 - RNA, 21 nt, Human
aagaaaagcagggacauggga

SEQ ID NO: 437150 - RNA, 20 nt, Human
aagcagggacaugggagagg

SEQ ID NO: 437151 - RNA, 18 nt, Human
acagaaagacaaacacug

SEQ ID NO: 437152 - RNA, 19 nt, Human
agaaagacaaacacugcau

SEQ ID NO: 437153 - RNA, 27 nt, Human
caagaaaagcagggacaugggagaggu

SEQ ID NO: 437154 - RNA, 30 nt, Human
cagaaagacaaacacugcaugaucucacua

SEQ ID NO: 437155 - RNA, 20 nt, Human
caugggcugggaggagaggg

SEQ ID NO: 437156 - RNA, 18 nt, Human
ccccgggggacagggcgg

SEQ ID NO: 437157 - RNA, 25 nt, Human
cuagcaacucuccaugagccucagg

SEQ ID NO: 437158 - RNA, 19 nt, Human
cugccacccggccugguug

SEQ ID NO: 437159 - RNA, 19 nt, Human
cuggggcaggccgagucag

SEQ ID NO: 437160 - RNA, 20 nt, Human
ggcugggaggagagggacug

SEQ ID NO: 437161 - RNA, 23 nt, Human
ggcugggaggagagggacugggc

SEQ ID NO: 437162 - RNA, 22 nt, Human
ggggaugagcuuguguggggga

SEQ ID NO: 437163 - RNA, 21 nt, Human
guggaaccuauaaaagcugcc

SEQ ID NO: 437164 - RNA, 24 nt, Human
uacaaguaaagagucaaaugcugg

SEQ ID NO: 437165 - RNA, 21 nt, Human
uaccagagaugggcaggauga

SEQ ID NO: 437166 - RNA, 18 nt, Human
ucccagaggccggggaug

SEQ ID NO: 437167 - RNA, 22 nt, Human
ucccagaggccggggaugagcu

SEQ ID NO: 437168 - RNA, 20 nt, Human
ucccaggucuagcaacucuc

SEQ ID NO: 437169 - RNA, 26 nt, Human
ugaaaaaaaggagugauauaggggua

SEQ ID NO: 437170 - RNA, 19 nt, Human
ugggagagguccuggcugc

SEQ ID NO: 437171 - RNA, 19 nt, Human
ugggaggagagggacuggg

SEQ ID NO: 437172 - RNA, 19 nt, Human
ugugcgccucccagggcag

SEQ ID NO: 437173 - RNA, 20 nt, Human
ugugugcgccucccagggca

SEQ ID NO: 437174 - RNA, 19 nt, Human
agcgcccaguuccucggag

SEQ ID NO: 437175 - RNA, 20 nt, Human
aggaaaagacuuuauuaaua

SEQ ID NO: 437176 - RNA, 20 nt, Human
agugggugggaggugagggu

SEQ ID NO: 437177 - RNA, 19 nt, Human
cccacacucguucgagagg

SEQ ID NO: 437178 - RNA, 21 nt, Human
gugggaggugagggugugcaa

SEQ ID NO: 437179 - RNA, 19 nt, Human
agccucuggcucuuagguc

SEQ ID NO: 437180 - RNA, 21 nt, Human
aggggccuuccaugugcugau

SEQ ID NO: 437181 - RNA, 19 nt, Human
cagcaggcuugggaagugc

SEQ ID NO: 437182 - RNA, 21 nt, Human
cagcccuuccuuucagugucc

SEQ ID NO: 437183 - RNA, 19 nt, Human
cccucugccccuacuccaa

SEQ ID NO: 437184 - RNA, 19 nt, Human
ccggggagggcgcgggggg

SEQ ID NO: 437185 - RNA, 19 nt, Human
ccucuacacagccucuggc

SEQ ID NO: 437186 - RNA, 21 nt, Human
ccucuacacagccucuggcuc

SEQ ID NO: 437187 - RNA, 22 nt, Human
cucuuaggucccagucauguuu

SEQ ID NO: 437188 - RNA, 18 nt, Human
cugcagcaaccccaucuc

SEQ ID NO: 437189 - RNA, 19 nt, Human
cugcagcaaccccaucucu

SEQ ID NO: 437190 - RNA, 18 nt, Human
cugccccuacuccaacac

SEQ ID NO: 437191 - RNA, 19 nt, Human
gagacuggcagguggagca

SEQ ID NO: 437192 - RNA, 22 nt, Human
gagcuuguuuuauuggagugac

SEQ ID NO: 437193 - RNA, 19 nt, Human
gcaggaccagcccuuccuu

SEQ ID NO: 437194 - RNA, 22 nt, Human
gcagguggagcaggagccucua

SEQ ID NO: 437195 - RNA, 20 nt, Human
gcuccggggagggcgcgggg

SEQ ID NO: 437196 - RNA, 20 nt, Human
gggaucgagacgggugaggg

SEQ ID NO: 437197 - RNA, 20 nt, Human
gggcgcggggggucaggggc

SEQ ID NO: 437198 - RNA, 19 nt, Human
ggggccuuccaugugcuga

SEQ ID NO: 437199 - RNA, 24 nt, Human
ggucucugggaaagggcggagagg

SEQ ID NO: 437200 - RNA, 21 nt, Human
ucagcaggcuugggaagugcu

SEQ ID NO: 437201 - RNA, 20 nt, Human
ucaguguccauaccaggggc

SEQ ID NO: 437202 - RNA, 23 nt, Human
ucauguuugcacccccucaaagg

SEQ ID NO: 437203 - RNA, 18 nt, Human
uccggggagggcgcgggg

SEQ ID NO: 437204 - RNA, 19 nt, Human
ucugccccuacuccaacac

SEQ ID NO: 437205 - RNA, 19 nt, Human
ugaccuuggcucccucccu

SEQ ID NO: 437206 - RNA, 22 nt, Human
ugaguugggcuggggucuuggu

SEQ ID NO: 437207 - RNA, 26 nt, Human
uggcagguggagcaggagccucuucu

SEQ ID NO: 437208 - RNA, 19 nt, Human
uggcucccucccucugccc

SEQ ID NO: 437209 - RNA, 21 nt, Human
ugggaagugcugcuccggggc

SEQ ID NO: 437210 - RNA, 24 nt, Human
uuccaugugcugaugggugaugug

SEQ ID NO: 437211 - RNA, 23 nt, Human
uuggagugaccuuggcucccucc

SEQ ID NO: 437212 - RNA, 18 nt, Human
uuuuuuuuuuuuuuuuug

SEQ ID NO: 437213 - RNA, 22 nt, Human
uuuuuuuuuuuuuuuuugccau

SEQ ID NO: 437214 - RNA, 25 nt, Human
uuuuuuuuuuuuuuuuuugccauga

SEQ ID NO: 437215 - RNA, 24 nt, Human
aaagcuuucccacaaugacugcac

SEQ ID NO: 437216 - RNA, 20 nt, Human
aaggugcugggauuacaggu

SEQ ID NO: 437217 - RNA, 25 nt, Human
aaggugcugggauuacagguguugg

SEQ ID NO: 437218 - RNA, 24 nt, Human
aagugauccaccugccucggccuc

SEQ ID NO: 437219 - RNA, 25 nt, Human
aagugauccucccaccucagccucc

SEQ ID NO: 437220 - RNA, 18 nt, Human
aagugcugggauuacagg

SEQ ID NO: 437221 - RNA, 19 nt, Human
aagugcugggauuacaggu

SEQ ID NO: 437222 - RNA, 23 nt, Human
aagugcugggauuacagguguga

SEQ ID NO: 437223 - RNA, 20 nt, Human
acaggguuucaccauauuag

SEQ ID NO: 437224 - RNA, 20 nt, Human
acccaccuuggccuaccuaa

SEQ ID NO: 437225 - RNA, 23 nt, Human
accucagccuccugaguagcugg

SEQ ID NO: 437226 - RNA, 23 nt, Human
accucagccuuccagagugcugg

SEQ ID NO: 437227 - RNA, 24 nt, Human
accucgugauccacccaccuuggc

SEQ ID NO: 437228 - RNA, 21 nt, Human
acucugagagucauguuuugg

SEQ ID NO: 437229 - RNA, 18 nt, Human
agacaggauuuugccaug

SEQ ID NO: 437230 - RNA, 19 nt, Human
agacaggauuuugccaugu

SEQ ID NO: 437231 - RNA, 20 nt, Human
agagggcagagguccucaga

SEQ ID NO: 437232 - RNA, 24 nt, Human
agagugcugggauuacaggcauga

SEQ ID NO: 437233 - RNA, 20 nt, Human
agccccuggccuguauuuuu

SEQ ID NO: 437234 - RNA, 19 nt, Human
agccuccugaguagcuggg

SEQ ID NO: 437235 - RNA, 21 nt, Human
agcugggacuacaggagcccg

SEQ ID NO: 437236 - RNA, 25 nt, Human
aggaggcucuuggcugccaccugca

SEQ ID NO: 437237 - RNA, 18 nt, Human
aggcagcggugugauggc

SEQ ID NO: 437238 - RNA, 25 nt, Human
aggcuggagugcaguggugugaucu

SEQ ID NO: 437239 - RNA, 24 nt, Human
aggugauccacccaccucagccuu

SEQ ID NO: 437240 - RNA, 24 nt, Human
agguguuggcaacugcacccggcu

SEQ ID NO: 437241 - RNA, 18 nt, Human
aguagcugggacuacagg

SEQ ID NO: 437242 - RNA, 18 nt, Human
aguagcugggacuacagg

SEQ ID NO: 437243 - RNA, 19 nt, Human
agugcaguggugugaucuc

SEQ ID NO: 437244 - RNA, 21 nt, Human
agugcaguggugugaucucag

SEQ ID NO: 437245 - RNA, 23 nt, Human
agugcaguggugugaucucagcu

SEQ ID NO: 437246 - RNA, 24 nt, Human
agugcaguggugugaucucagcuc

SEQ ID NO: 437247 - RNA, 18 nt, Human
agugcugggauuacaggc

SEQ ID NO: 437248 - RNA, 20 nt, Human
agugcugggauuacaggcau

SEQ ID NO: 437249 - RNA, 22 nt, Human
agugcugggauuacaggcauga

SEQ ID NO: 437250 - RNA, 24 nt, Human
aguggugugaucucagcucacugc

SEQ ID NO: 437251 - RNA, 26 nt, Human
aucacagcucacugcaacaaccgccu

SEQ ID NO: 437252 - RNA, 21 nt, Human
augcuaggcuaauuuuuguau

SEQ ID NO: 437253 - RNA, 26 nt, Human
caaacuucugacuucaggugauccaa

SEQ ID NO: 437254 - RNA, 22 nt, Human
caaccgccucccaaguccaagu

SEQ ID NO: 437255 - RNA, 20 nt, Human
caaggugcugggauuacagg

SEQ ID NO: 437256 - RNA, 22 nt, Human
caaggugcugggauuacaggug

SEQ ID NO: 437257 - RNA, 22 nt, Human
caagugauccaccugccucggc

SEQ ID NO: 437258 - RNA, 20 nt, Human
caagugauccucccaccuca

SEQ ID NO: 437259 - RNA, 27 nt, Human
caagugauccucccaccucagccuccu

SEQ ID NO: 437260 - RNA, 18 nt, Human
caccauauuagccaggau

SEQ ID NO: 437261 - RNA, 22 nt, Human
caccauauuagccaggaugguc

SEQ ID NO: 437262 - RNA, 24 nt, Human
caccauauuagccaggauggucuc

SEQ ID NO: 437263 - RNA, 24 nt, Human
caccaugcuaggcuaauuuuugua

SEQ ID NO: 437264 - RNA, 23 nt, Human
cacccaccucagccuuccagagu

SEQ ID NO: 437265 - RNA, 26 nt, Human
caccugaagaggccgcuguguagagg

SEQ ID NO: 437266 - RNA, 21 nt, Human
caccuuggccuaccuaagugc

SEQ ID NO: 437267 - RNA, 19 nt, Human
cagacuccuggauuuuacu

SEQ ID NO: 437268 - RNA, 24 nt, Human
cagagugcugggauuacaggcaug

SEQ ID NO: 437269 - RNA, 20 nt, Human
cagccuccugaguagcuggg

SEQ ID NO: 437270 - RNA, 24 nt, Human
caggauuuugccauguuacccagg

SEQ ID NO: 437271 - RNA, 24 nt, Human
caggguuucaccauauuagccagg

SEQ ID NO: 437272 - RNA, 19 nt, Human
caugcccacucaccugugu

SEQ ID NO: 437273 - RNA, 23 nt, Human
cauguuacccaggcugguuucaa

SEQ ID NO: 437274 - RNA, 23 nt, Human
cauguuacccaggcugguuucaa

SEQ ID NO: 437275 - RNA, 25 nt, Human
ccacccaccucagccuuccagagug

SEQ ID NO: 437276 - RNA, 22 nt, Human
ccagagugcugggauuacaggc

SEQ ID NO: 437277 - RNA, 24 nt, Human
ccagagugcugggauuacaggcau

SEQ ID NO: 437278 - RNA, 18 nt, Human
ccagccccuggccuguau

SEQ ID NO: 437279 - RNA, 19 nt, Human
ccauguuacccaggcuggu

SEQ ID NO: 437280 - RNA, 19 nt, Human
ccauguuacccaggcuggu

SEQ ID NO: 437281 - RNA, 19 nt, Human
ccauguuugccaggcuggu

SEQ ID NO: 437282 - RNA, 22 nt, Human
ccauguuugccaggcuggucuc

SEQ ID NO: 437283 - RNA, 25 nt, Human
cccacaaucaaugcauucguagggc

SEQ ID NO: 437284 - RNA, 23 nt, Human
cccaccucagccuccugaguagc

SEQ ID NO: 437285 - RNA, 24 nt, Human
cccaccucagccuccugaguagcu

SEQ ID NO: 437286 - RNA, 24 nt, Human
ccgccucccaaguccaagugaucc

SEQ ID NO: 437287 - RNA, 21 nt, Human
ccuaagugcugggauuacagg

SEQ ID NO: 437288 - RNA, 22 nt, Human
ccuaagugcugggauuacaggu

SEQ ID NO: 437289 - RNA, 24 nt, Human
ccuaagugcugggauuacaggugu

SEQ ID NO: 437290 - RNA, 19 nt, Human
ccucagaagaccagucuac

SEQ ID NO: 437291 - RNA, 19 nt, Human
ccucauccguagacaucau

SEQ ID NO: 437292 - RNA, 22 nt, Human
ccugaccucgugauccacccac

SEQ ID NO: 437293 - RNA, 23 nt, Human
ccugaguagcugggacuacagga

SEQ ID NO: 437294 - RNA, 23 nt, Human
ccugaguagcugggacuacaggu

SEQ ID NO: 437295 - RNA, 24 nt, Human
ccugaguagcugggacuacaggua

SEQ ID NO: 437296 - RNA, 18 nt, Human
ccugggcucaagugaucc

SEQ ID NO: 437297 - RNA, 21 nt, Human
ccugggcucaagugauccacc

SEQ ID NO: 437298 - RNA, 22 nt, Human
ccugggcucaagugauccaccu

SEQ ID NO: 437299 - RNA, 23 nt, Human
ccugggcucaagugauccaccug

SEQ ID NO: 437300 - RNA, 21 nt, Human
ccuguauuuuuaauagagaaa

SEQ ID NO: 437301 - RNA, 24 nt, Human
cgccucccaaguccaagugauccu

SEQ ID NO: 437302 - RNA, 24 nt, Human
cgugcccagccccuggccuguauu

SEQ ID NO: 437303 - RNA, 21 nt, Human
cuaaaggcuuucucgcaaugg

SEQ ID NO: 437304 - RNA, 20 nt, Human
cuaagugcugggauuacagg

SEQ ID NO: 437305 - RNA, 24 nt, Human
cuaagugcugggauuacaggugug

SEQ ID NO: 437306 - RNA, 23 nt, Human
cuagccuccugaguagcugggac

SEQ ID NO: 437307 - RNA, 21 nt, Human
cucaagugauccaccugccuc

SEQ ID NO: 437308 - RNA, 23 nt, Human
cucaagugauccaccugccucgg

SEQ ID NO: 437309 - RNA, 24 nt, Human
cucagccuccugaguagcugggac

SEQ ID NO: 437310 - RNA, 18 nt, Human
cuccugaccucgugaucc

SEQ ID NO: 437311 - RNA, 21 nt, Human
cuccugggcucaagugaucca

SEQ ID NO: 437312 - RNA, 21 nt, Human
cucgcaaggugcugggauuac

SEQ ID NO: 437313 - RNA, 23 nt, Human
cucucguguuuacuaaggguuga

SEQ ID NO: 437314 - RNA, 23 nt, Human
cugacuucaggugauccacccac

SEQ ID NO: 437315 - RNA, 23 nt, Human
cugcaacaaccgccucccaaguc

SEQ ID NO: 437316 - RNA, 23 nt, Human
cugcucuagccuccugaguagcu

SEQ ID NO: 437317 - RNA, 19 nt, Human
cugcugccuaguaaguuga

SEQ ID NO: 437318 - RNA, 24 nt, Human
cuggagugcaguggugugaucuca

SEQ ID NO: 437319 - RNA, 20 nt, Human
cugugccaggaggcucuugg

SEQ ID NO: 437320 - RNA, 22 nt, Human
cuucccaccgacaugcguccuc

SEQ ID NO: 437321 - RNA, 21 nt, Human
cuugcucuguugcccaggcug

SEQ ID NO: 437322 - RNA, 21 nt, Human
gaccucgugauccacccaccu

SEQ ID NO: 437323 - RNA, 21 nt, Human
gaccucgugauccacccaccu

SEQ ID NO: 437324 - RNA, 24 nt, Human
gaccucgugauccacccaccuugg

SEQ ID NO: 437325 - RNA, 24 nt, Human
gaccucgugauccacccaccuugg

SEQ ID NO: 437326 - RNA, 24 nt, Human
gacuacagguaugcgccaccaugc

SEQ ID NO: 437327 - RNA, 24 nt, Human
gacuucaggugauccacccaccuc

SEQ ID NO: 437328 - RNA, 20 nt, Human
gagcccgccaccaugccuag

SEQ ID NO: 437329 - RNA, 23 nt, Human
gaguagcugggacuacaggagcc

SEQ ID NO: 437330 - RNA, 26 nt, Human
gaguagcugggacuacaggagcccgc

SEQ ID NO: 437331 - RNA, 24 nt, Human
gaguagcugggacuacagguaugc

SEQ ID NO: 437332 - RNA, 19 nt, Human
gagugcugggauuacaggc

SEQ ID NO: 437333 - RNA, 18 nt, Human
gauuacaggcaugagcca

SEQ ID NO: 437334 - RNA, 21 nt, Human
gauuacaggcaugagccacca

SEQ ID NO: 437335 - RNA, 24 nt, Human
gauuacaggcaugagccaccaugc

SEQ ID NO: 437336 - RNA, 24 nt, Human
gauuacaggugugagguaccgugc

SEQ ID NO: 437337 - RNA, 22 nt, Human
gauuacagguguuggcaacugc

SEQ ID NO: 437338 - RNA, 23 nt, Human
gauuacagguguuggcaacugca

SEQ ID NO: 437339 - RNA, 24 nt, Human
gcaaggugcugggauuacaggugu

SEQ ID NO: 437340 - RNA, 22 nt, Human
gccaggcuggucucaaacuucu

SEQ ID NO: 437341 - RNA, 20 nt, Human
gccauguuacccaggcuggu

SEQ ID NO: 437342 - RNA, 20 nt, Human
gccauguuugccaggcuggu

SEQ ID NO: 437343 - RNA, 19 nt, Human
gcccagccccuggccugua

SEQ ID NO: 437344 - RNA, 24 nt, Human
gcccaggcuggagugcaguggugu

SEQ ID NO: 437345 - RNA, 24 nt, Human
gccuagcuaauuuuuuuguauuuu

SEQ ID NO: 437346 - RNA, 24 nt, Human
gcucaagugauccaccugccucgg

SEQ ID NO: 437347 - RNA, 25 nt, Human
gcucuguugcccaggcuggagugca

SEQ ID NO: 437348 - RNA, 24 nt, Human
ggacuacagguaugcgccaccaug

SEQ ID NO: 437349 - RNA, 21 nt, Human
ggagcugggaugaccucuggg

SEQ ID NO: 437350 - RNA, 24 nt, Human
ggauggucucaaucuccugaccuc

SEQ ID NO: 437351 - RNA, 24 nt, Human
ggauuacaggcaugagccaccaug

SEQ ID NO: 437352 - RNA, 22 nt, Human
ggcuggagugcaguggugugau

SEQ ID NO: 437353 - RNA, 22 nt, Human
gggcucaagugauccaccugcc

SEQ ID NO: 437354 - RNA, 21 nt, Human
ggugcaugaugaggggagacc

SEQ ID NO: 437355 - RNA, 23 nt, Human
ggugugauggcaugaucacagcu

SEQ ID NO: 437356 - RNA, 22 nt, Human
gucaugaagccccacucugaga

SEQ ID NO: 437357 - RNA, 21 nt, Human
guccucugauguucaaugagu

SEQ ID NO: 437358 - RNA, 24 nt, Human
gucuugcucuguugcccaggcugg

SEQ ID NO: 437359 - RNA, 24 nt, Human
gugauccacccaccucagccuucc

SEQ ID NO: 437360 - RNA, 25 nt, Human
gugauccacccaccuuggccuaccu

SEQ ID NO: 437361 - RNA, 22 nt, Human
gugauccaccugccucggccuc

SEQ ID NO: 437362 - RNA, 24 nt, Human
gugauccucccaccucagccuccu

SEQ ID NO: 437363 - RNA, 20 nt, Human
uaacuggaagcuuuuccaca

SEQ ID NO: 437364 - RNA, 19 nt, Human
uaagugcugggauuacagg

SEQ ID NO: 437365 - RNA, 24 nt, Human
uaagugcugggauuacagguguga

SEQ ID NO: 437366 - RNA, 22 nt, Human
uaauagagacaguuuugccaug

SEQ ID NO: 437367 - RNA, 22 nt, Human
uaauuuuuguauuuuuuguaga

SEQ ID NO: 437368 - RNA, 24 nt, Human
uacaggcaugagccaccaugccca

SEQ ID NO: 437369 - RNA, 18 nt, Human
uacagguaugcgccacca

SEQ ID NO: 437370 - RNA, 22 nt, Human
uaccgugcccagccccuggccu

SEQ ID NO: 437371 - RNA, 20 nt, Human
uagagacaggguuucaccau

SEQ ID NO: 437372 - RNA, 19 nt, Human
uaguagagacaggguuuca

SEQ ID NO: 437373 - RNA, 25 nt, Human
uaguagagacaggguuucaccauau

SEQ ID NO: 437374 - RNA, 27 nt, Human
uauuuaguuggcuagagugagcuuggu

SEQ ID NO: 437375 - RNA, 19 nt, Human
ucaaacuccugggcucaag

SEQ ID NO: 437376 - RNA, 24 nt, Human
ucaccauauuagccaggauggucu

SEQ ID NO: 437377 - RNA, 24 nt, Human
ucacugcaacaaccgccucccaag

SEQ ID NO: 437378 - RNA, 23 nt, Human
ucagccuccugaguagcugggac

SEQ ID NO: 437379 - RNA, 26 nt, Human
ucagcucacugcaagcuacgccuccc

SEQ ID NO: 437380 - RNA, 20 nt, Human
ucaggugauccacccaccuc

SEQ ID NO: 437381 - RNA, 24 nt, Human
uccaagugauccucccaccucagc

SEQ ID NO: 437382 - RNA, 21 nt, Human
uccacccaccucagccuucca

SEQ ID NO: 437383 - RNA, 23 nt, Human
uccagagugcugggauuacaggc

SEQ ID NO: 437384 - RNA, 24 nt, Human
uccagagugcugggauuacaggca

SEQ ID NO: 437385 - RNA, 22 nt, Human
uccaucuugguuauucauagag

SEQ ID NO: 437386 - RNA, 21 nt, Human
ucccaaguccaagugauccuc

SEQ ID NO: 437387 - RNA, 24 nt, Human
ucccauguucgcgccauucuccug

SEQ ID NO: 437388 - RNA, 26 nt, Human
uccucccaccucagccuccugaguag

SEQ ID NO: 437389 - RNA, 18 nt, Human
uccugaguagcugggacu

SEQ ID NO: 437390 - RNA, 24 nt, Human
uccugaguagcugggacuacaggu

SEQ ID NO: 437391 - RNA, 18 nt, Human
uccugggcucaagugauc

SEQ ID NO: 437392 - RNA, 24 nt, Human
uccugggcucaagugauccaccug

SEQ ID NO: 437393 - RNA, 24 nt, Human
ucgcaaggugcugggauuacaggu

SEQ ID NO: 437394 - RNA, 24 nt, Human
ucuccaggccucaguuuccucauc

SEQ ID NO: 437395 - RNA, 26 nt, Human
ucuccugaccucgugauccacccacc

SEQ ID NO: 437396 - RNA, 18 nt, Human
ucuguugcccaggcugga

SEQ ID NO: 437397 - RNA, 24 nt, Human
ucuguugcccaggcuggagugcag

SEQ ID NO: 437398 - RNA, 26 nt, Human
ucuugcccaugagcuuucucauguug

SEQ ID NO: 437399 - RNA, 23 nt, Human
ucuugcucuguugcccaggcugg

SEQ ID NO: 437400 - RNA, 24 nt, Human
ucuugcucuguugcccaggcugga

SEQ ID NO: 437401 - RNA, 18 nt, Human
ugaccucugggguccaau

SEQ ID NO: 437402 - RNA, 21 nt, Human
ugacuucaggugauccaccca

SEQ ID NO: 437403 - RNA, 24 nt, Human
ugacuucaggugauccacccaccu

SEQ ID NO: 437404 - RNA, 24 nt, Human
ugauccacccaccucagccuucca

SEQ ID NO: 437405 - RNA, 20 nt, Human
ugaugaggggagaccucugg

SEQ ID NO: 437406 - RNA, 24 nt, Human
ugcacccggcuccaucuugguuau

SEQ ID NO: 437407 - RNA, 31 nt, Human
ugccauguuacccaggcugguuucaaacucc

SEQ ID NO: 437408 - RNA, 18 nt, Human
ugcccaggcuggagugca

SEQ ID NO: 437409 - RNA, 21 nt, Human
ugcccaggcuggagugcagug

SEQ ID NO: 437410 - RNA, 24 nt, Human
ugcccaggcuggagugcaguggug

SEQ ID NO: 437411 - RNA, 20 nt, Human
ugcucuagccuccugaguaa

SEQ ID NO: 437412 - RNA, 24 nt, Human
ugcucuguugcccaggcuggagug

SEQ ID NO: 437413 - RNA, 20 nt, Human
ugcugggauuacagguguga

SEQ ID NO: 437414 - RNA, 23 nt, Human
ugcugggauuacagguguuggca

SEQ ID NO: 437415 - RNA, 19 nt, Human
uggaagaaaauguguccac

SEQ ID NO: 437416 - RNA, 18 nt, Human
uggagcugggaugaccuc

SEQ ID NO: 437417 - RNA, 19 nt, Human
uggagugcaguggugugau

SEQ ID NO: 437418 - RNA, 24 nt, Human
uggagugcaguggugugaucucag

SEQ ID NO: 437419 - RNA, 20 nt, Human
uggcagggaaauuucccauc

SEQ ID NO: 437420 - RNA, 24 nt, Human
uggcaugaucacagcucacugcaa

SEQ ID NO: 437421 - RNA, 22 nt, Human
ugggacuacaggagcccgccac

SEQ ID NO: 437422 - RNA, 24 nt, Human
ugggacuacaggagcccgccacca

SEQ ID NO: 437423 - RNA, 21 nt, Human
ugggacuacagguaugcgcca

SEQ ID NO: 437424 - RNA, 22 nt, Human
ugggacuacagguaugcgccac

SEQ ID NO: 437425 - RNA, 24 nt, Human
ugggacuacagguaugcgccacca

SEQ ID NO: 437426 - RNA, 18 nt, Human
ugggauuacaggcaugag

SEQ ID NO: 437427 - RNA, 22 nt, Human
ugggauuacaggcaugagccac

SEQ ID NO: 437428 - RNA, 23 nt, Human
ugggauuacaggcaugagccacc

SEQ ID NO: 437429 - RNA, 24 nt, Human
ugggauuacaggcaugagccacca

SEQ ID NO: 437430 - RNA, 25 nt, Human
ugggauuacaggcaugagccaccau

SEQ ID NO: 437431 - RNA, 18 nt, Human
ugggauuacaggugugag

SEQ ID NO: 437432 - RNA, 18 nt, Human
ugggauuacaggugugag

SEQ ID NO: 437433 - RNA, 19 nt, Human
ugggauuacaggugugagg

SEQ ID NO: 437434 - RNA, 21 nt, Human
ugggauuacaggugugaggua

SEQ ID NO: 437435 - RNA, 22 nt, Human
ugggauuacaggugugagguac

SEQ ID NO: 437436 - RNA, 23 nt, Human
ugggauuacaggugugagguacc

SEQ ID NO: 437437 - RNA, 23 nt, Human
ugggauuacaggugugagguacc

SEQ ID NO: 437438 - RNA, 24 nt, Human
ugggauuacaggugugagguaccg

SEQ ID NO: 437439 - RNA, 19 nt, Human
ugggauuacagguguuggc

SEQ ID NO: 437440 - RNA, 20 nt, Human
ugggauuacagguguuggca

SEQ ID NO: 437441 - RNA, 22 nt, Human
ugggauuacagguguuggcaac

SEQ ID NO: 437442 - RNA, 24 nt, Human
ugggauuacagguguuggcaacug

SEQ ID NO: 437443 - RNA, 24 nt, Human
uggugugaucucagcucacugcaa

SEQ ID NO: 437444 - RNA, 22 nt, Human
uguagacaggauuuugccaugu

SEQ ID NO: 437445 - RNA, 22 nt, Human
uguaggacucugaacgggucuc

SEQ ID NO: 437446 - RNA, 22 nt, Human
uuaauagagacaguuuugccau

SEQ ID NO: 437447 - RNA, 24 nt, Human
uuaguagagacaggguuucaccau

SEQ ID NO: 437448 - RNA, 19 nt, Human
uucacagggcuucucucca

SEQ ID NO: 437449 - RNA, 23 nt, Human
uucaggugauccacccaccucag

SEQ ID NO: 437450 - RNA, 27 nt, Human
uucucauguugaauaaggaaaguauca

SEQ ID NO: 437451 - RNA, 23 nt, Human
uugagacagucuugcucuguugc

SEQ ID NO: 437452 - RNA, 24 nt, Human
uugagacagucuugcucuguugcc

SEQ ID NO: 437453 - RNA, 24 nt, Human
uugcccaggcuggagugcaguggu

SEQ ID NO: 437454 - RNA, 24 nt, Human
uugcucuguugcccaggcuggagu

SEQ ID NO: 437455 - RNA, 20 nt, Human
uuucaccauauuagccagga

SEQ ID NO: 437456 - RNA, 21 nt, Human
uuuguagacaggauuuugcca

SEQ ID NO: 437457 - RNA, 22 nt, Human
uuuguagacaggauuuugccau

SEQ ID NO: 437458 - RNA, 21 nt, Human
uuuugagacagucuugcucug

SEQ ID NO: 437459 - RNA, 23 nt, Human
uuuugccauguuugccaggcugg

SEQ ID NO: 437460 - RNA, 22 nt, Human
uuuuuaauagagacaguuuugc

SEQ ID NO: 437461 - RNA, 24 nt, Human
uuuuuaguagagacaggguuucac

SEQ ID NO: 437462 - RNA, 21 nt, Human
uuuuuguauuuuuaguagaga

SEQ ID NO: 437463 - RNA, 18 nt, Human
uuuuuguauuuuuuguag

SEQ ID NO: 437464 - RNA, 21 nt, Human
uuuuuguauuuuuuguagaca

SEQ ID NO: 437465 - RNA, 21 nt, Human
uuuuuuguauuuuuaguagag

SEQ ID NO: 437466 - RNA, 24 nt, Human
uuuuuuguauuuuuaguagagaca

SEQ ID NO: 437467 - RNA, 23 nt, Human
uuuuuuuuuuuuugagacagucu

SEQ ID NO: 437468 - RNA, 27 nt, Human
acaguggaaaaagcacuugaaucugaa

SEQ ID NO: 437469 - RNA, 21 nt, Human
acaucacagugcucuaaaagc

SEQ ID NO: 437470 - RNA, 19 nt, Human
accuguuuaugauguucug

SEQ ID NO: 437471 - RNA, 19 nt, Human
aucaugucaucuacagcac

SEQ ID NO: 437472 - RNA, 19 nt, Human
auguucugccaaaugaaua

SEQ ID NO: 437473 - RNA, 18 nt, Human
caaaugaauaucacucuc

SEQ ID NO: 437474 - RNA, 24 nt, Human
caagaggaggccauccugggcagc

SEQ ID NO: 437475 - RNA, 20 nt, Human
cagauucuggggugcagcug

SEQ ID NO: 437476 - RNA, 20 nt, Human
cauguugggaaugcacaaaa

SEQ ID NO: 437477 - RNA, 18 nt, Human
ccccuggcccccucaccc

SEQ ID NO: 437478 - RNA, 19 nt, Human
ccccuggcccccucacccc

SEQ ID NO: 437479 - RNA, 20 nt, Human
ccuggcccccucacccccug

SEQ ID NO: 437480 - RNA, 22 nt, Human
cugcugaguuuaaaagcuuccu

SEQ ID NO: 437481 - RNA, 19 nt, Human
cuguaaacaugcucccuau

SEQ ID NO: 437482 - RNA, 18 nt, Human
gaggaggccauccugggc

SEQ ID NO: 437483 - RNA, 19 nt, Human
gaugauuccaggcagaguu

SEQ ID NO: 437484 - RNA, 18 nt, Human
ggaaacaguggaaaaagc

SEQ ID NO: 437485 - RNA, 20 nt, Human
ggaaacaguggaaaaagcac

SEQ ID NO: 437486 - RNA, 21 nt, Human
uacucugcuaucaugucaucu

SEQ ID NO: 437487 - RNA, 21 nt, Human
uagaauggcuguaaacaugcu

SEQ ID NO: 437488 - RNA, 19 nt, Human
uaugaauaaauccuugggc

SEQ ID NO: 437489 - RNA, 23 nt, Human
uaugguagaaauuugaaauucuu

SEQ ID NO: 437490 - RNA, 21 nt, Human
uccuuuggagaugcccccugg

SEQ ID NO: 437491 - RNA, 20 nt, Human
ucuuuuggugaugauuccag

SEQ ID NO: 437492 - RNA, 22 nt, Human
uggaaaaagcacuugaaucuga

SEQ ID NO: 437493 - RNA, 23 nt, Human
uggaaaaagcacuugaaucugaa

SEQ ID NO: 437494 - RNA, 21 nt, Human
uggagaugcccccuggccccc

SEQ ID NO: 437495 - RNA, 21 nt, Human
uggcccccucacccccugucc

SEQ ID NO: 437496 - RNA, 21 nt, Human
uggggugcagcugcugaguuu

SEQ ID NO: 437497 - RNA, 22 nt, Human
uggugaugauuccaggcagagu

SEQ ID NO: 437498 - RNA, 21 nt, Human
uuccuuuggagaugcccccug

SEQ ID NO: 437499 - RNA, 22 nt, Human
uugcaaguuucccaucauacaa

SEQ ID NO: 437500 - RNA, 22 nt, Human
uuuggugaugauuccaggcaga

SEQ ID NO: 437501 - RNA, 22 nt, Human
uuuuuuuuuuuucaaaaaguca

SEQ ID NO: 437502 - RNA, 21 nt, Human
aacuuggaaaaugaguacaaa

SEQ ID NO: 437503 - RNA, 24 nt, Human
aagacccugcccagggaggguggg

SEQ ID NO: 437504 - RNA, 25 nt, Human
aagaccuuuccucuuccagggaguc

SEQ ID NO: 437505 - RNA, 19 nt, Human
aggcaggaaagagaagagg

SEQ ID NO: 437506 - RNA, 21 nt, Human
aggcaggaaagagaagagggu

SEQ ID NO: 437507 - RNA, 27 nt, Human
aggcaggaaagagaagaggguaggguc

SEQ ID NO: 437508 - RNA, 19 nt, Human
caacuuggaaaaugaguac

SEQ ID NO: 437509 - RNA, 22 nt, Human
cagacccaggcccagggccccc

SEQ ID NO: 437510 - RNA, 19 nt, Human
cagagcuggggggcgugag

SEQ ID NO: 437511 - RNA, 24 nt, Human
cagggccuggagucagagcugggg

SEQ ID NO: 437512 - RNA, 23 nt, Human
caguggcugccucaagacccugc

SEQ ID NO: 437513 - RNA, 18 nt, Human
ccaagaccuuuccucuuc

SEQ ID NO: 437514 - RNA, 24 nt, Human
ccaccucgacggccacgcccaccc

SEQ ID NO: 437515 - RNA, 20 nt, Human
ccagggaggguggggugggc

SEQ ID NO: 437516 - RNA, 21 nt, Human
cccagggaggguggggugggc

SEQ ID NO: 437517 - RNA, 20 nt, Human
ccccaagaccuuuccucuuc

SEQ ID NO: 437518 - RNA, 18 nt, Human
cccgcagacccaggccca

SEQ ID NO: 437519 - RNA, 22 nt, Human
cccgcagacccaggcccagggc

SEQ ID NO: 437520 - RNA, 23 nt, Human
cccgcagacccaggcccagggcc

SEQ ID NO: 437521 - RNA, 20 nt, Human
cccgcuagauggggcucccg

SEQ ID NO: 437522 - RNA, 18 nt, Human
ccgccgccgccuuggaac

SEQ ID NO: 437523 - RNA, 18 nt, Human
ccucaagacccugcccag

SEQ ID NO: 437524 - RNA, 19 nt, Human
ccucaagacccugcccagg

SEQ ID NO: 437525 - RNA, 20 nt, Human
ccucaagacccugcccaggg

SEQ ID NO: 437526 - RNA, 22 nt, Human
ccuggagucagagcuggggggc

SEQ ID NO: 437527 - RNA, 20 nt, Human
ccuuuccucuuccagcucug

SEQ ID NO: 437528 - RNA, 25 nt, Human
cgccuuggaaccccgcuagaugggg

SEQ ID NO: 437529 - RNA, 21 nt, Human
cucccgcagacccaggcccag

SEQ ID NO: 437530 - RNA, 19 nt, Human
cucuuccagcucugcccca

SEQ ID NO: 437531 - RNA, 20 nt, Human
gacccgccgagccccaccuc

SEQ ID NO: 437532 - RNA, 20 nt, Human
gaggaguggggaguaggcag

SEQ ID NO: 437533 - RNA, 28 nt, Human
ggacagggccuggagucagagcuggggg

SEQ ID NO: 437534 - RNA, 21 nt, Human
ggaguaggcaggaaagagaag

SEQ ID NO: 437535 - RNA, 22 nt, Human
gggcagagcucaggggacaggg

SEQ ID NO: 437536 - RNA, 19 nt, Human
guaggaggcaagguaaggu

SEQ ID NO: 437537 - RNA, 21 nt, Human
ucccgcagacccaggcccagg

SEQ ID NO: 437538 - RNA, 23 nt, Human
uccuucggacccgccgagcccca

SEQ ID NO: 437539 - RNA, 24 nt, Human
uggaaccccgcuagauggggcucc

SEQ ID NO: 437540 - RNA, 22 nt, Human
uggcugccucaagacccugccc

SEQ ID NO: 437541 - RNA, 19 nt, Human
uuccucuuccagcucugcc

SEQ ID NO: 437542 - RNA, 20 nt, Human
uuuuuuuuuuuuuuuuuauc

SEQ ID NO: 437543 - RNA, 21 nt, Human
aacggaaaccacagcaacuac

SEQ ID NO: 437544 - RNA, 23 nt, Human
aagcaacaccaaguauaaauaac

SEQ ID NO: 437545 - RNA, 22 nt, Human
accacagcaacuaccggcgccg

SEQ ID NO: 437546 - RNA, 19 nt, Human
agaauaaaccgcaggaaga

SEQ ID NO: 437547 - RNA, 23 nt, Human
agggugguugagcuccuggcucc

SEQ ID NO: 437548 - RNA, 24 nt, Human
augcagucacagaguuacggcaug

SEQ ID NO: 437549 - RNA, 21 nt, Human
cacagcaacuaccggcgccgc

SEQ ID NO: 437550 - RNA, 22 nt, Human
cacauccaggggucuaucccuc

SEQ ID NO: 437551 - RNA, 21 nt, Human
cacugauggccggacucggac

SEQ ID NO: 437552 - RNA, 20 nt, Human
cacugcacuuacaaugcagu

SEQ ID NO: 437553 - RNA, 19 nt, Human
caggcaccgagcgucgagg

SEQ ID NO: 437554 - RNA, 23 nt, Human
ccacacuggggcaggcggcggaa

SEQ ID NO: 437555 - RNA, 20 nt, Human
ccacugcacuuacaaugcag

SEQ ID NO: 437556 - RNA, 21 nt, Human
ccccggagccgaccuaggccc

SEQ ID NO: 437557 - RNA, 22 nt, Human
ccccggagccgaccuaggcccc

SEQ ID NO: 437558 - RNA, 22 nt, Human
ccggcgccgcgguauuuccccu

SEQ ID NO: 437559 - RNA, 18 nt, Human
ccuaagccgcccccggag

SEQ ID NO: 437560 - RNA, 18 nt, Human
cgucgagggcacagcagc

SEQ ID NO: 437561 - RNA, 21 nt, Human
cuaagccgcccccggagccga

SEQ ID NO: 437562 - RNA, 22 nt, Human
cucacaggacugcuuaccccca

SEQ ID NO: 437563 - RNA, 18 nt, Human
cucgccggcggccuucuc

SEQ ID NO: 437564 - RNA, 19 nt, Human
gcaacaccaaguauaaaua

SEQ ID NO: 437565 - RNA, 18 nt, Human
gcacagcagcaggccggc

SEQ ID NO: 437566 - RNA, 22 nt, Human
gcagucacagaguuacggcaug

SEQ ID NO: 437567 - RNA, 21 nt, Human
gcccuguuccgaagaagggug

SEQ ID NO: 437568 - RNA, 20 nt, Human
gggcacagcagcaggccggc

SEQ ID NO: 437569 - RNA, 18 nt, Human
gguugagcuccuggcucc

SEQ ID NO: 437570 - RNA, 18 nt, Human
uaacagaacuacagcaga

SEQ ID NO: 437571 - RNA, 24 nt, Human
uacagcagagcaaacuaagauaaa

SEQ ID NO: 437572 - RNA, 22 nt, Human
uaggccccggaguagauacagg

SEQ ID NO: 437573 - RNA, 24 nt, Human
uaguuuccuuuuaaaaagaagagu

SEQ ID NO: 437574 - RNA, 19 nt, Human
uaugacacagcauauacau

SEQ ID NO: 437575 - RNA, 20 nt, Human
uaugacacagcauauacaua

SEQ ID NO: 437576 - RNA, 21 nt, Human
uccaugacaagcaacaccaag

SEQ ID NO: 437577 - RNA, 19 nt, Human
uccuaagcugcgagcucag

SEQ ID NO: 437578 - RNA, 18 nt, Human
ugcgccacucacaggacu

SEQ ID NO: 437579 - RNA, 23 nt, Human
uucaugguaaagguaucuccccc

SEQ ID NO: 437580 - RNA, 18 nt, Human
uugcaucguccuccacau

SEQ ID NO: 437581 - RNA, 20 nt, Human
uuuuuuuuacaaaccaggaa

SEQ ID NO: 437582 - RNA, 21 nt, Human
aaacagacagccgccucuagc

SEQ ID NO: 437583 - RNA, 24 nt, Human
aaccucccuagagauucuuuauua

SEQ ID NO: 437584 - RNA, 18 nt, Human
aauuaauuucugaagguu

SEQ ID NO: 437585 - RNA, 19 nt, Human
agaggugacaguauacaua

SEQ ID NO: 437586 - RNA, 19 nt, Human
ccacacgcucugaguuucc

SEQ ID NO: 437587 - RNA, 20 nt, Human
cucacaacgcccggcucgcc

SEQ ID NO: 437588 - RNA, 22 nt, Human
uccccaaauauaacaacacuga

SEQ ID NO: 437589 - RNA, 22 nt, Human
uccgcucacaacgcccggcucg

SEQ ID NO: 437590 - RNA, 21 nt, Human
ugggguccacacgcucugagu

SEQ ID NO: 437591 - RNA, 27 nt, Human
uuuucugccgcggcaaaccuccucgac

SEQ ID NO: 437592 - RNA, 19 nt, Human
aaaaaaguacaacagagaa

SEQ ID NO: 437593 - RNA, 18 nt, Human
aaaaaauuaaaacaacuc

SEQ ID NO: 437594 - RNA, 20 nt, Human
aaaacaaaucuuugccaaau

SEQ ID NO: 437595 - RNA, 18 nt, Human
aaacaauguggcgauuac

SEQ ID NO: 437596 - RNA, 24 nt, Human
aacaaauaucacauucuuccaacu

SEQ ID NO: 437597 - RNA, 26 nt, Human
aacaaauaucacauucuuccaacuag

SEQ ID NO: 437598 - RNA, 25 nt, Human
cagaggaaacugaauaaugaaacaa

SEQ ID NO: 437599 - RNA, 25 nt, Human
cauguaacuugcaaaaugacaaacc

SEQ ID NO: 437600 - RNA, 23 nt, Human
cuagaaaaugagcucaacucuca

SEQ ID NO: 437601 - RNA, 21 nt, Human
gaggacaaagcccauuccacu

SEQ ID NO: 437602 - RNA, 18 nt, Human
gaugcagaaaaaaaaauu

SEQ ID NO: 437603 - RNA, 19 nt, Human
gcagauucagaugcagaaa

SEQ ID NO: 437604 - RNA, 22 nt, Human
uaaaacauguaacuugcaaaau

SEQ ID NO: 437605 - RNA, 20 nt, Human
uaaagaagggauuaaaccau

SEQ ID NO: 437606 - RNA, 21 nt, Human
uaacuugcaaaaugacaaacc

SEQ ID NO: 437607 - RNA, 24 nt, Human
uaccacauucccccaccuccugga

SEQ ID NO: 437608 - RNA, 21 nt, Human
uaccccugggcuccuugaagg

SEQ ID NO: 437609 - RNA, 19 nt, Human
uagguaaacuaccaacaca

SEQ ID NO: 437610 - RNA, 22 nt, Human
ucaaaaucuucuuaggguaaaa

SEQ ID NO: 437611 - RNA, 19 nt, Human
ucaggcacaagauaauuug

SEQ ID NO: 437612 - RNA, 19 nt, Human
ucuuaaagcuaucaggccu

SEQ ID NO: 437613 - RNA, 18 nt, Human
ugaaagccuucuaugacc

SEQ ID NO: 437614 - RNA, 21 nt, Human
ugaaagccuucuaugaccagu

SEQ ID NO: 437615 - RNA, 21 nt, Human
ugaaugcauuuagauugacca

SEQ ID NO: 437616 - RNA, 23 nt, Human
ugcaguaccauaaacauguuaau

SEQ ID NO: 437617 - RNA, 25 nt, Human
ugccaaauaguuuaaguacuuuuaa

SEQ ID NO: 437618 - RNA, 26 nt, Human
uucagaugcagaaaaaaaaauuaaaa

SEQ ID NO: 437619 - RNA, 24 nt, Human
uucccccaccuccuggaggacaaa

SEQ ID NO: 437620 - RNA, 19 nt, Human
uugaaagccuucuaugacg

SEQ ID NO: 437621 - RNA, 20 nt, Human
uuuacagaggaaacugaaua

SEQ ID NO: 437622 - RNA, 23 nt, Human
uuugugguuucuucuacuuuauc

SEQ ID NO: 437623 - RNA, 19 nt, Human
uuuuuuuuuuuuuuugugg

SEQ ID NO: 437624 - RNA, 18 nt, Human
uuuuuuuuuuuuuuuuug

SEQ ID NO: 437625 - RNA, 19 nt, Human
uuuuuuuuuuuuuuuuugu

SEQ ID NO: 437626 - RNA, 21 nt, Human
uuuuuuuuuuuuuuuuugugg

SEQ ID NO: 437627 - RNA, 21 nt, Human
aaaaaagucagucaggccucu

SEQ ID NO: 437628 - RNA, 24 nt, Human
aaaaaagucagucaggccucugug

SEQ ID NO: 437629 - RNA, 23 nt, Human
aaacaccaagaacauuuacaaaa

SEQ ID NO: 437630 - RNA, 19 nt, Human
aacauccuccagggccgcu

SEQ ID NO: 437631 - RNA, 20 nt, Human
aagauaaaaaucugugaaga

SEQ ID NO: 437632 - RNA, 18 nt, Human
aagcacuugcuuccugau

SEQ ID NO: 437633 - RNA, 18 nt, Human
aagccaacacacaaaugc

SEQ ID NO: 437634 - RNA, 21 nt, Human
aagccuuuuccuccugcccaa

SEQ ID NO: 437635 - RNA, 18 nt, Human
acagagucuuagaacacc

SEQ ID NO: 437636 - RNA, 22 nt, Human
acaggcagggaagacacccccc

SEQ ID NO: 437637 - RNA, 20 nt, Human
accagggggccccggggcug

SEQ ID NO: 437638 - RNA, 26 nt, Human
accggcaggaaaagcacuugcuuccu

SEQ ID NO: 437639 - RNA, 19 nt, Human
accggggcguguggagcug

SEQ ID NO: 437640 - RNA, 19 nt, Human
acucagguucucuguggcc

SEQ ID NO: 437641 - RNA, 18 nt, Human
agacaggaaggggugggg

SEQ ID NO: 437642 - RNA, 22 nt, Human
agacaggaaggggugggggcag

SEQ ID NO: 437643 - RNA, 24 nt, Human
agacaggaaggggugggggcaggg

SEQ ID NO: 437644 - RNA, 25 nt, Human
agacaggaaggggugggggcagggc

SEQ ID NO: 437645 - RNA, 20 nt, Human
agagacccaagcuccugcuc

SEQ ID NO: 437646 - RNA, 21 nt, Human
agaggcuguuucccuggacag

SEQ ID NO: 437647 - RNA, 18 nt, Human
agcagggagggcguggcu

SEQ ID NO: 437648 - RNA, 20 nt, Human
agccacacagagucuuagaa

SEQ ID NO: 437649 - RNA, 24 nt, Human
agcugcaaagccaacacacaaaug

SEQ ID NO: 437650 - RNA, 19 nt, Human
aggcacgaaggcgcauggg

SEQ ID NO: 437651 - RNA, 24 nt, Human
aggcagcggugggagggggcuggg

SEQ ID NO: 437652 - RNA, 23 nt, Human
aggcagggaagacaccccccgca

SEQ ID NO: 437653 - RNA, 22 nt, Human
aggcugagucucggugaccagg

SEQ ID NO: 437654 - RNA, 20 nt, Human
agggggccccggggcuguuc

SEQ ID NO: 437655 - RNA, 21 nt, Human
agggggcuggggagagaagag

SEQ ID NO: 437656 - RNA, 19 nt, Human
agguguaccuggggcagau

SEQ ID NO: 437657 - RNA, 21 nt, Human
aguggccacuacucagacagc

SEQ ID NO: 437658 - RNA, 24 nt, Human
auaaaucuuuaauauuucuaauug

SEQ ID NO: 437659 - RNA, 22 nt, Human
augggaggaugagacuggagcc

SEQ ID NO: 437660 - RNA, 19 nt, Human
caaggaugcugcugugcac

SEQ ID NO: 437661 - RNA, 24 nt, Human
caccaggaccaaaggauauguaca

SEQ ID NO: 437662 - RNA, 26 nt, Human
caccaggaccaaaggauauguacaac

SEQ ID NO: 437663 - RNA, 22 nt, Human
caccccuccagcacauccaccc

SEQ ID NO: 437664 - RNA, 23 nt, Human
cacugcuggggcugagcagggac

SEQ ID NO: 437665 - RNA, 23 nt, Human
cagcagcugcaaagccaacacac

SEQ ID NO: 437666 - RNA, 23 nt, Human
cagcccuggcugcaggcagggcc

SEQ ID NO: 437667 - RNA, 24 nt, Human
cagccuagagcugaggaaaaccgg

SEQ ID NO: 437668 - RNA, 23 nt, Human
cagcggugggagggggcugggga

SEQ ID NO: 437669 - RNA, 18 nt, Human
caggaaggggugggggca

SEQ ID NO: 437670 - RNA, 19 nt, Human
caggcagggaagacacccc

SEQ ID NO: 437671 - RNA, 18 nt, Human
caggcccugccugugugg

SEQ ID NO: 437672 - RNA, 23 nt, Human
caggccucugugcuagcagggag

SEQ ID NO: 437673 - RNA, 23 nt, Human
cagggccucuggcaaccccagcc

SEQ ID NO: 437674 - RNA, 26 nt, Human
caggggcagaggggugauuccugcag

SEQ ID NO: 437675 - RNA, 18 nt, Human
ccacugucaccugucccc

SEQ ID NO: 437676 - RNA, 21 nt, Human
ccagcccuggcugcaggcagg

SEQ ID NO: 437677 - RNA, 19 nt, Human
ccagcgccuccaccgcacu

SEQ ID NO: 437678 - RNA, 21 nt, Human
cccaauacuguucucuagauu

SEQ ID NO: 437679 - RNA, 19 nt, Human
cccacccuucuuacccagg

SEQ ID NO: 437680 - RNA, 23 nt, Human
cccacucccacccuucuuaccca

SEQ ID NO: 437681 - RNA, 19 nt, Human
ccccaguggccacuacucu

SEQ ID NO: 437682 - RNA, 25 nt, Human
ccccuguaugcagcgccuggguccu

SEQ ID NO: 437683 - RNA, 26 nt, Human
cccgcagacaccaagccuuuuccucc

SEQ ID NO: 437684 - RNA, 21 nt, Human
cccuccagcacauccacccuu

SEQ ID NO: 437685 - RNA, 19 nt, Human
cccugcccuggcucugcug

SEQ ID NO: 437686 - RNA, 24 nt, Human
ccggccccagcuguggggugcgcc

SEQ ID NO: 437687 - RNA, 18 nt, Human
ccgggaacucagguucuc

SEQ ID NO: 437688 - RNA, 20 nt, Human
ccugcagcucgcccugcccu

SEQ ID NO: 437689 - RNA, 19 nt, Human
ccuguaugcagcgccuggg

SEQ ID NO: 437690 - RNA, 19 nt, Human
ccuguguggccacccuggu

SEQ ID NO: 437691 - RNA, 23 nt, Human
cgagagagacccaagcuccugcu

SEQ ID NO: 437692 - RNA, 20 nt, Human
cgccuggguccuuggccggg

SEQ ID NO: 437693 - RNA, 23 nt, Human
cgccuggguccuuggccgggggc

SEQ ID NO: 437694 - RNA, 22 nt, Human
cgccuguccaggccccgggagc

SEQ ID NO: 437695 - RNA, 19 nt, Human
cggcggcggcggcggcgcu

SEQ ID NO: 437696 - RNA, 20 nt, Human
cucaucugucuugaaagugg

SEQ ID NO: 437697 - RNA, 24 nt, Human
cucauugucgcggcggcggcggcg

SEQ ID NO: 437698 - RNA, 20 nt, Human
cuccagcacauccacccuuc

SEQ ID NO: 437699 - RNA, 19 nt, Human
cuccagggccgcuauuucc

SEQ ID NO: 437700 - RNA, 21 nt, Human
cucccaucuuccuguggucug

SEQ ID NO: 437701 - RNA, 25 nt, Human
cucucggccugagagcucacccacc

SEQ ID NO: 437702 - RNA, 21 nt, Human
cucugcuggcaaaggccccac

SEQ ID NO: 437703 - RNA, 20 nt, Human
cucuguggccugggcaggag

SEQ ID NO: 437704 - RNA, 20 nt, Human
cuggcaaaggccccacuccc

SEQ ID NO: 437705 - RNA, 21 nt, Human
cuggcccagugaaggcacccc

SEQ ID NO: 437706 - RNA, 18 nt, Human
cugggggaccggggcgug

SEQ ID NO: 437707 - RNA, 21 nt, Human
cuguaugcagcgccugggucc

SEQ ID NO: 437708 - RNA, 22 nt, Human
cugugaucccugguggcccagc

SEQ ID NO: 437709 - RNA, 18 nt, Human
cuguguggccacccuggu

SEQ ID NO: 437710 - RNA, 20 nt, Human
gaagagucuguacacuuuua

SEQ ID NO: 437711 - RNA, 22 nt, Human
gaagcugugguugcgguccagc

SEQ ID NO: 437712 - RNA, 21 nt, Human
gaaggcgcauggguggggaca

SEQ ID NO: 437713 - RNA, 23 nt, Human
gacaagacagaagagugagacag

SEQ ID NO: 437714 - RNA, 18 nt, Human
gagauaguuacauuacag

SEQ ID NO: 437715 - RNA, 23 nt, Human
gagcagggcucacugggcaaugg

SEQ ID NO: 437716 - RNA, 20 nt, Human
gcaagggcagcuggcaccgg

SEQ ID NO: 437717 - RNA, 28 nt, Human
gcagcagucccggccagcccucggcagc

SEQ ID NO: 437718 - RNA, 24 nt, Human
gcagcgccuggguccuuggccggg

SEQ ID NO: 437719 - RNA, 19 nt, Human
gccaccccuccagcacauc

SEQ ID NO: 437720 - RNA, 21 nt, Human
gccccacucccacccuucuua

SEQ ID NO: 437721 - RNA, 18 nt, Human
gcccugcccuggcucugc

SEQ ID NO: 437722 - RNA, 23 nt, Human
gccucuggcaaccccagcccugg

SEQ ID NO: 437723 - RNA, 24 nt, Human
gccucuggcaaccccagcccuggc

SEQ ID NO: 437724 - RNA, 21 nt, Human
gcuccugcucaucugucuuga

SEQ ID NO: 437725 - RNA, 19 nt, Human
gcugcugugcacgggcuug

SEQ ID NO: 437726 - RNA, 23 nt, Human
ggaagacaccccccgcagacacc

SEQ ID NO: 437727 - RNA, 25 nt, Human
ggcagaggggugauuccugcagcuc

SEQ ID NO: 437728 - RNA, 19 nt, Human
ggcagcggugggagggggc

SEQ ID NO: 437729 - RNA, 18 nt, Human
ggcagggccucugcuucc

SEQ ID NO: 437730 - RNA, 21 nt, Human
gggagagaagagcagggcuca

SEQ ID NO: 437731 - RNA, 19 nt, Human
gggccucuggcaaccccag

SEQ ID NO: 437732 - RNA, 24 nt, Human
gggcugggaacagacaggggccga

SEQ ID NO: 437733 - RNA, 20 nt, Human
gggcuuuguggcugaguguu

SEQ ID NO: 437734 - RNA, 21 nt, Human
ggggcugggaacagacagggg

SEQ ID NO: 437735 - RNA, 23 nt, Human
ggggugggggcagggccucugcu

SEQ ID NO: 437736 - RNA, 18 nt, Human
gucacucuacgaggcagc

SEQ ID NO: 437737 - RNA, 20 nt, Human
gucgcggcggcggcggcggc

SEQ ID NO: 437738 - RNA, 19 nt, Human
guggggugcgccccucccc

SEQ ID NO: 437739 - RNA, 19 nt, Human
uaaaaggccccuguguucc

SEQ ID NO: 437740 - RNA, 21 nt, Human
uaaaaggccccuguguuccaa

SEQ ID NO: 437741 - RNA, 26 nt, Human
uaagcuacagaacagccuagagcuga

SEQ ID NO: 437742 - RNA, 24 nt, Human
uaaggcucucggccugagagcuca

SEQ ID NO: 437743 - RNA, 20 nt, Human
uacaaaagaggggagcuggg

SEQ ID NO: 437744 - RNA, 21 nt, Human
uacagaacagccuagagcuga

SEQ ID NO: 437745 - RNA, 18 nt, Human
uaccuggggcagaugcuc

SEQ ID NO: 437746 - RNA, 21 nt, Human
uaccuggggcagaugcucugg

SEQ ID NO: 437747 - RNA, 21 nt, Human
uagaacaccaacagcuuccuc

SEQ ID NO: 437748 - RNA, 18 nt, Human
uagccuccgagcccgccu

SEQ ID NO: 437749 - RNA, 21 nt, Human
uagccucgguccuccaccccc

SEQ ID NO: 437750 - RNA, 19 nt, Human
uagguuacaucuaaaagcc

SEQ ID NO: 437751 - RNA, 22 nt, Human
ucacccagaacauggaaguuaa

SEQ ID NO: 437752 - RNA, 19 nt, Human
uccaccgcacugcuggggc

SEQ ID NO: 437753 - RNA, 21 nt, Human
uccaccgcacugcuggggcug

SEQ ID NO: 437754 - RNA, 19 nt, Human
uccaggccccgggagccuc

SEQ ID NO: 437755 - RNA, 21 nt, Human
uccaugcugagguccagcgcc

SEQ ID NO: 437756 - RNA, 19 nt, Human
ucccagagcagccacuguc

SEQ ID NO: 437757 - RNA, 22 nt, Human
ucccagagcagccacugucacc

SEQ ID NO: 437758 - RNA, 25 nt, Human
ucccagagcagccacugucaccuuu

SEQ ID NO: 437759 - RNA, 18 nt, Human
ucccuggacagucuggcu

SEQ ID NO: 437760 - RNA, 18 nt, Human
ucccugguggcccagccc

SEQ ID NO: 437761 - RNA, 21 nt, Human
ucgcccugcccuggcucugcu

SEQ ID NO: 437762 - RNA, 24 nt, Human
ucgcggcggcggcggcggcgcucc

SEQ ID NO: 437763 - RNA, 24 nt, Human
ucggugaccagggggccccggggc

SEQ ID NO: 437764 - RNA, 21 nt, Human
ucuguacauuauuacauaguu

SEQ ID NO: 437765 - RNA, 19 nt, Human
ucuuuaauauuucuaauug

SEQ ID NO: 437766 - RNA, 18 nt, Human
ugaaggcaccccaguggc

SEQ ID NO: 437767 - RNA, 19 nt, Human
ugaauuguagguuacaucu

SEQ ID NO: 437768 - RNA, 23 nt, Human
ugagacuggagccaggcccugcc

SEQ ID NO: 437769 - RNA, 26 nt, Human
ugaguguguagaaaagagagaggcug

SEQ ID NO: 437770 - RNA, 26 nt, Human
ugcaaagccaacacacaaaugccaca

SEQ ID NO: 437771 - RNA, 19 nt, Human
ugcacagccacacagaguc

SEQ ID NO: 437772 - RNA, 23 nt, Human
ugcaggcugcugcugucuuggag

SEQ ID NO: 437773 - RNA, 19 nt, Human
ugcauuuuuuccuuuucac

SEQ ID NO: 437774 - RNA, 20 nt, Human
ugcuagcagggagggcgugg

SEQ ID NO: 437775 - RNA, 19 nt, Human
ugcucugggggaccggggc

SEQ ID NO: 437776 - RNA, 22 nt, Human
ugcugcugucuuggagagggag

SEQ ID NO: 437777 - RNA, 24 nt, Human
uggagcuguagccucgguccucca

SEQ ID NO: 437778 - RNA, 19 nt, Human
uggcaaaggccccacuccc

SEQ ID NO: 437779 - RNA, 18 nt, Human
uggcaaccccagcccugg

SEQ ID NO: 437780 - RNA, 21 nt, Human
uggccaaggaugcugcugugc

SEQ ID NO: 437781 - RNA, 19 nt, Human
uggcucugcuggcaaaggc

SEQ ID NO: 437782 - RNA, 22 nt, Human
ugggacgcggugugggagcugg

SEQ ID NO: 437783 - RNA, 18 nt, Human
ugggagcuggggggcuuu

SEQ ID NO: 437784 - RNA, 24 nt, Human
ugggcaaugggaggaugagacugg

SEQ ID NO: 437785 - RNA, 18 nt, Human
uggggagagaagagcagg

SEQ ID NO: 437786 - RNA, 19 nt, Human
uggggagagaagagcaggg

SEQ ID NO: 437787 - RNA, 21 nt, Human
uggggagagaagagcagggcu

SEQ ID NO: 437788 - RNA, 26 nt, Human
uggggccucuguggcacauuccagcu

SEQ ID NO: 437789 - RNA, 19 nt, Human
uggggcugagcagggacuc

SEQ ID NO: 437790 - RNA, 27 nt, Human
uggggcugagcagggacucgugggagc

SEQ ID NO: 437791 - RNA, 27 nt, Human
uguacagaaauugcacagccacacaga

SEQ ID NO: 437792 - RNA, 20 nt, Human
uguagaaaagagagaggcug

SEQ ID NO: 437793 - RNA, 25 nt, Human
uguagaaaagagagaggcuguuucc

SEQ ID NO: 437794 - RNA, 24 nt, Human
uguaugcagcgccuggguccuugg

SEQ ID NO: 437795 - RNA, 22 nt, Human
uguguagaaaagagagaggcug

SEQ ID NO: 437796 - RNA, 24 nt, Human
uuacaucuaaaagccccuucccag

SEQ ID NO: 437797 - RNA, 21 nt, Human
uucagaaauaaaauaaaaccc

SEQ ID NO: 437798 - RNA, 23 nt, Human
uucccuggacagucuggcucccg

SEQ ID NO: 437799 - RNA, 19 nt, Human
uuccuccaugcugaggucc

SEQ ID NO: 437800 - RNA, 18 nt, Human
uucucuguggccugggca

SEQ ID NO: 437801 - RNA, 22 nt, Human
uugcacagccacacagagucuu

SEQ ID NO: 437802 - RNA, 21 nt, Human
aaacaccuuuccaucacuuuu

SEQ ID NO: 437803 - RNA, 18 nt, Human
aaagaaaggcuggcugau

SEQ ID NO: 437804 - RNA, 21 nt, Human
aaauaccagcucaaacuauga

SEQ ID NO: 437805 - RNA, 21 nt, Human
aacaccuuuccaucacuuuuu

SEQ ID NO: 437806 - RNA, 24 nt, Human
aacacuugugcacggugaaguuga

SEQ ID NO: 437807 - RNA, 20 nt, Human
aagcagcuuccaauucgugu

SEQ ID NO: 437808 - RNA, 23 nt, Human
aagccgccgcccgccagccccaa

SEQ ID NO: 437809 - RNA, 19 nt, Human
aagcugcagggcacccugc

SEQ ID NO: 437810 - RNA, 19 nt, Human
acaaaauagagccaggagc

SEQ ID NO: 437811 - RNA, 20 nt, Human
acacagcaccucaccugggu

SEQ ID NO: 437812 - RNA, 19 nt, Human
acagcgcgauuuucucaug

SEQ ID NO: 437813 - RNA, 22 nt, Human
accacauuccucgcauugcggu

SEQ ID NO: 437814 - RNA, 19 nt, Human
acgcugcccuuugaguccc

SEQ ID NO: 437815 - RNA, 18 nt, Human
acuaaccaccaaaaccuc

SEQ ID NO: 437816 - RNA, 24 nt, Human
agaaagaagacagugacaaccagg

SEQ ID NO: 437817 - RNA, 25 nt, Human
agaaagaagacagugacaaccagga

SEQ ID NO: 437818 - RNA, 22 nt, Human
agaaagaugucacuucgccuga

SEQ ID NO: 437819 - RNA, 19 nt, Human
agcagccuccgggagacca

SEQ ID NO: 437820 - RNA, 20 nt, Human
agcagccuccgggagaccaa

SEQ ID NO: 437821 - RNA, 19 nt, Human
aggaacccaaaaccguucc

SEQ ID NO: 437822 - RNA, 18 nt, Human
aggaaggggaggggcagg

SEQ ID NO: 437823 - RNA, 18 nt, Human
aggcaagcaagaaagcug

SEQ ID NO: 437824 - RNA, 20 nt, Human
aggcaagcaagaaagcuggg

SEQ ID NO: 437825 - RNA, 24 nt, Human
aggcaaggggugcuuguuccuggg

SEQ ID NO: 437826 - RNA, 25 nt, Human
aggcaaggggugcuuguuccugggg

SEQ ID NO: 437827 - RNA, 18 nt, Human
aggccacucugggcagag

SEQ ID NO: 437828 - RNA, 24 nt, Human
aggcugccaaucagaguggcccaa

SEQ ID NO: 437829 - RNA, 20 nt, Human
auaaaauaaggaaccucuga

SEQ ID NO: 437830 - RNA, 27 nt, Human
auaauaauaaaagguaaaaaacguuuc

SEQ ID NO: 437831 - RNA, 20 nt, Human
augaacacagcaccucacug

SEQ ID NO: 437832 - RNA, 21 nt, Human
auggacuugaagugacuguuc

SEQ ID NO: 437833 - RNA, 22 nt, Human
auggugggaagucugccugcaa

SEQ ID NO: 437834 - RNA, 20 nt, Human
caaaggggcacgccaagggc

SEQ ID NO: 437835 - RNA, 27 nt, Human
caaauaauuaauuaauaaaauaaggaa

SEQ ID NO: 437836 - RNA, 18 nt, Human
caagcaccaaacuguggc

SEQ ID NO: 437837 - RNA, 20 nt, Human
caaggggugcuuguuccugg

SEQ ID NO: 437838 - RNA, 19 nt, Human
caaugaaccucaaacuccu

SEQ ID NO: 437839 - RNA, 19 nt, Human
cacacaguaaaaagacauu

SEQ ID NO: 437840 - RNA, 18 nt, Human
caccaaaaccucacacag

SEQ ID NO: 437841 - RNA, 18 nt, Human
caccaccuuaaacaugaa

SEQ ID NO: 437842 - RNA, 19 nt, Human
caccacuuccugggugcag

SEQ ID NO: 437843 - RNA, 24 nt, Human
cacgugaaacaguagaaaauucaa

SEQ ID NO: 437844 - RNA, 18 nt, Human
cacuuccugggugcaguu

SEQ ID NO: 437845 - RNA, 24 nt, Human
cagacgcccugcuauggcuugggg

SEQ ID NO: 437846 - RNA, 22 nt, Human
cagcagccuccgggagaccaag

SEQ ID NO: 437847 - RNA, 22 nt, Human
cagcugccacagaggcaagggg

SEQ ID NO: 437848 - RNA, 20 nt, Human
cagcuucgacgcugcccuuu

SEQ ID NO: 437849 - RNA, 19 nt, Human
cagggcacccauuuugaaa

SEQ ID NO: 437850 - RNA, 24 nt, Human
cagggcacccugccggccaacccu

SEQ ID NO: 437851 - RNA, 20 nt, Human
cagggggacaaagggagccc

SEQ ID NO: 437852 - RNA, 22 nt, Human
cagguggacucaagcagcuucc

SEQ ID NO: 437853 - RNA, 21 nt, Human
cauccaaauucuccaagaaau

SEQ ID NO: 437854 - RNA, 20 nt, Human
ccacagaggcaaggggugcu

SEQ ID NO: 437855 - RNA, 18 nt, Human
ccaccaaaaccucacaca

SEQ ID NO: 437856 - RNA, 22 nt, Human
ccagcuccaucgcguggccacc

SEQ ID NO: 437857 - RNA, 25 nt, Human
ccagugcccauggccagccacacuc

SEQ ID NO: 437858 - RNA, 24 nt, Human
cccauggccagccacacucaugcc

SEQ ID NO: 437859 - RNA, 18 nt, Human
ccccagaggcuccuggug

SEQ ID NO: 437860 - RNA, 22 nt, Human
ccccuggcccuccuggugggcg

SEQ ID NO: 437861 - RNA, 19 nt, Human
cccgugcaccacacagcua

SEQ ID NO: 437862 - RNA, 24 nt, Human
cccugagcccgcaggggucggccc

SEQ ID NO: 437863 - RNA, 19 nt, Human
cccuggcccuccugguggg

SEQ ID NO: 437864 - RNA, 19 nt, Human
ccgccgcccgccagcccca

SEQ ID NO: 437865 - RNA, 20 nt, Human
ccggccagcuccaucgcgug

SEQ ID NO: 437866 - RNA, 22 nt, Human
ccuacaccuaaccccagcuucg

SEQ ID NO: 437867 - RNA, 21 nt, Human
ccucgcauugcggucggcacc

SEQ ID NO: 437868 - RNA, 24 nt, Human
ccugcggaggcguucaggggugac

SEQ ID NO: 437869 - RNA, 25 nt, Human
ccuggcccuccuggugguccccugg

SEQ ID NO: 437870 - RNA, 21 nt, Human
ccuugccccaguuccccgcag

SEQ ID NO: 437871 - RNA, 19 nt, Human
cgggcucaagcgccaccac

SEQ ID NO: 437872 - RNA, 18 nt, Human
cuaaccaccaaaaccuca

SEQ ID NO: 437873 - RNA, 19 nt, Human
cuaaccccagcuucgacgc

SEQ ID NO: 437874 - RNA, 22 nt, Human
cucacaacccuacaccuaaccc

SEQ ID NO: 437875 - RNA, 21 nt, Human
cuccgcuuuaaaaggcuuagg

SEQ ID NO: 437876 - RNA, 24 nt, Human
cugacccagcugguaagccgccgc

SEQ ID NO: 437877 - RNA, 21 nt, Human
cuggccccaagcagcaguaaa

SEQ ID NO: 437878 - RNA, 21 nt, Human
cuguaaagucccgugcaccac

SEQ ID NO: 437879 - RNA, 22 nt, Human
cuuccuggggguggccuccaga

SEQ ID NO: 437880 - RNA, 18 nt, Human
cuugcgggcucaagcgcc

SEQ ID NO: 437881 - RNA, 21 nt, Human
gaagaggcuguuucaaggaug

SEQ ID NO: 437882 - RNA, 23 nt, Human
gaaggcagcaaaaaucuauggag

SEQ ID NO: 437883 - RNA, 24 nt, Human
gacacaaaguccacgucaggacug

SEQ ID NO: 437884 - RNA, 24 nt, Human
gaggaaggcaauaguuuaguuuaa

SEQ ID NO: 437885 - RNA, 21 nt, Human
gcaacgccagggcauaggcac

SEQ ID NO: 437886 - RNA, 19 nt, Human
gcaaucaauucaaguucag

SEQ ID NO: 437887 - RNA, 22 nt, Human
gccaacccugaugccuggagac

SEQ ID NO: 437888 - RNA, 21 nt, Human
gcccgcaggggucggcccccu

SEQ ID NO: 437889 - RNA, 19 nt, Human
gccuccagagcugaggcca

SEQ ID NO: 437890 - RNA, 21 nt, Human
gccuggugaggaagcuggugg

SEQ ID NO: 437891 - RNA, 22 nt, Human
gcgaaaggaugcgucugacgcc

SEQ ID NO: 437892 - RNA, 24 nt, Human
gcuaaggcuccggggccuccuugc

SEQ ID NO: 437893 - RNA, 22 nt, Human
gcuacacuaaaaagacccggua

SEQ ID NO: 437894 - RNA, 20 nt, Human
gcuacugggacuggucucca

SEQ ID NO: 437895 - RNA, 19 nt, Human
gcuuuuucugcagugcugu

SEQ ID NO: 437896 - RNA, 24 nt, Human
ggaaacccaaggagucagucagug

SEQ ID NO: 437897 - RNA, 18 nt, Human
ggaaagggaagguguggc

SEQ ID NO: 437898 - RNA, 18 nt, Human
ggaaggggaggggcagga

SEQ ID NO: 437899 - RNA, 19 nt, Human
ggacaguggcccaugcucc

SEQ ID NO: 437900 - RNA, 19 nt, Human
ggacccuggccugccuguc

SEQ ID NO: 437901 - RNA, 20 nt, Human
ggacuaggccgggaggaacg

SEQ ID NO: 437902 - RNA, 22 nt, Human
ggacuggucuccaugaaucugc

SEQ ID NO: 437903 - RNA, 18 nt, Human
ggauguccuagugggaag

SEQ ID NO: 437904 - RNA, 18 nt, Human
ggcaagauggcucgcgug

SEQ ID NO: 437905 - RNA, 25 nt, Human
ggcaagcaagaaagcuucgagggcg

SEQ ID NO: 437906 - RNA, 18 nt, Human
ggcagccggggauccaag

SEQ ID NO: 437907 - RNA, 19 nt, Human
ggccauaaugacaaugaac

SEQ ID NO: 437908 - RNA, 19 nt, Human
ggcccacgugacacuuugc

SEQ ID NO: 437909 - RNA, 18 nt, Human
ggcgucacggaugcuggu

SEQ ID NO: 437910 - RNA, 25 nt, Human
gggcaggaggcccuggaauuccugc

SEQ ID NO: 437911 - RNA, 22 nt, Human
gggguggccuccagagcugagg

SEQ ID NO: 437912 - RNA, 20 nt, Human
gguaagucuggugccugggg

SEQ ID NO: 437913 - RNA, 19 nt, Human
ggugacugcuuuuucugca

SEQ ID NO: 437914 - RNA, 18 nt, Human
ggugcaguuucccuucuu

SEQ ID NO: 437915 - RNA, 20 nt, Human
guccuccggccagcuccauc

SEQ ID NO: 437916 - RNA, 28 nt, Human
gucggcccccucaccugaccuguccucc

SEQ ID NO: 437917 - RNA, 19 nt, Human
gucuccaugaaucugccug

SEQ ID NO: 437918 - RNA, 21 nt, Human
gugaaacaguagaaaauucaa

SEQ ID NO: 437919 - RNA, 21 nt, Human
gugaauuacaaaccuggguuu

SEQ ID NO: 437920 - RNA, 24 nt, Human
gugacucagcagauccacacuggu

SEQ ID NO: 437921 - RNA, 24 nt, Human
gugcagcugaggccacucugggcc

SEQ ID NO: 437922 - RNA, 20 nt, Human
guucccggcagauggcuuug

SEQ ID NO: 437923 - RNA, 18 nt, Human
guuuucccgccaucucuu

SEQ ID NO: 437924 - RNA, 22 nt, Human
uaagauacaggggaagguuaaa

SEQ ID NO: 437925 - RNA, 19 nt, Human
uacaccuaaccccagcuuc

SEQ ID NO: 437926 - RNA, 24 nt, Human
uacacuaaaaagacccgguaacac

SEQ ID NO: 437927 - RNA, 24 nt, Human
uacaggggaagguuaagccuggca

SEQ ID NO: 437928 - RNA, 19 nt, Human
uacgccaagacacaaaguc

SEQ ID NO: 437929 - RNA, 20 nt, Human
uagaauggaaagagcccuga

SEQ ID NO: 437930 - RNA, 23 nt, Human
uaggcacagaggggcgagauggg

SEQ ID NO: 437931 - RNA, 26 nt, Human
uauggcaccucuguauucuaugcucc

SEQ ID NO: 437932 - RNA, 18 nt, Human
ucaaaggacugcccuggc

SEQ ID NO: 437933 - RNA, 19 nt, Human
ucacgaauagaggugacug

SEQ ID NO: 437934 - RNA, 21 nt, Human
ucagaauucuggcaagauggc

SEQ ID NO: 437935 - RNA, 19 nt, Human
ucaggagaggcagcacggg

SEQ ID NO: 437936 - RNA, 24 nt, Human
ucaugaacuacgggcgaaaggaug

SEQ ID NO: 437937 - RNA, 19 nt, Human
uccaugagggaacaaauuc

SEQ ID NO: 437938 - RNA, 20 nt, Human
uccaugagggaacaaauucc

SEQ ID NO: 437939 - RNA, 20 nt, Human
uccccgcccgaccugccugg

SEQ ID NO: 437940 - RNA, 19 nt, Human
ucccgugcacaagcaccaa

SEQ ID NO: 437941 - RNA, 24 nt, Human
uccgggagaccaagaaguuaaucu

SEQ ID NO: 437942 - RNA, 25 nt, Human
uccggggccuccuugccuggugagg

SEQ ID NO: 437943 - RNA, 23 nt, Human
uccuggggguggccuccagagcu

SEQ ID NO: 437944 - RNA, 20 nt, Human
uccugggugcaguuucccuu

SEQ ID NO: 437945 - RNA, 22 nt, Human
uccuuuaugccuuaggcaucca

SEQ ID NO: 437946 - RNA, 22 nt, Human
ucgagcaccaaucagcugugcc

SEQ ID NO: 437947 - RNA, 18 nt, Human
ucgcagcugccacagagg

SEQ ID NO: 437948 - RNA, 22 nt, Human
ucgcugcugcccaccugugcug

SEQ ID NO: 437949 - RNA, 20 nt, Human
ucuaugaaaaaguuggucag

SEQ ID NO: 437950 - RNA, 23 nt, Human
ucuccggggacccuggccugccc

SEQ ID NO: 437951 - RNA, 18 nt, Human
ucuggaagaccaaagccg

SEQ ID NO: 437952 - RNA, 18 nt, Human
ugaaacaguagaaaauuc

SEQ ID NO: 437953 - RNA, 18 nt, Human
ugaaacauugccacgacc

SEQ ID NO: 437954 - RNA, 20 nt, Human
ugaaaucagacacacucgca

SEQ ID NO: 437955 - RNA, 21 nt, Human
ugacaagcuggaggaagggga

SEQ ID NO: 437956 - RNA, 25 nt, Human
ugacaagcuggaggaaggggagggg

SEQ ID NO: 437957 - RNA, 19 nt, Human
ugacccgaaggcagcaaaa

SEQ ID NO: 437958 - RNA, 27 nt, Human
ugagcccgcaggggucgggaccaaagu

SEQ ID NO: 437959 - RNA, 24 nt, Human
ugauggcucaggaacccaaaaccg

SEQ ID NO: 437960 - RNA, 20 nt, Human
ugcacagaaggcaagcaaga

SEQ ID NO: 437961 - RNA, 20 nt, Human
ugcaucagaggggaaagaaa

SEQ ID NO: 437962 - RNA, 18 nt, Human
ugcccaggucagggggac

SEQ ID NO: 437963 - RNA, 25 nt, Human
ugccccaguuccccgcagauucugg

SEQ ID NO: 437964 - RNA, 19 nt, Human
ugcccuggccccaagcagc

SEQ ID NO: 437965 - RNA, 19 nt, Human
ugccuggugaggaagcugg

SEQ ID NO: 437966 - RNA, 22 nt, Human
ugccuggugaggaagcugguga

SEQ ID NO: 437967 - RNA, 21 nt, Human
ugccugugcccaggucagggg

SEQ ID NO: 437968 - RNA, 23 nt, Human
ugcgaagaaauccggcuucuccg

SEQ ID NO: 437969 - RNA, 18 nt, Human
ugcuguuucuuugccugu

SEQ ID NO: 437970 - RNA, 19 nt, Human
ugcuuggggaaggggcggu

SEQ ID NO: 437971 - RNA, 19 nt, Human
uggacaguggacagaagga

SEQ ID NO: 437972 - RNA, 18 nt, Human
uggaggaaggggaggggc

SEQ ID NO: 437973 - RNA, 20 nt, Human
uggaggaaggggaggggcag

SEQ ID NO: 437974 - RNA, 21 nt, Human
uggcagcuuuucaugucuugg

SEQ ID NO: 437975 - RNA, 19 nt, Human
uggcagugcagcggacggc

SEQ ID NO: 437976 - RNA, 23 nt, Human
uggccauaaugacaaugaaccuc

SEQ ID NO: 437977 - RNA, 22 nt, Human
uggcccaagagcgucaaccagg

SEQ ID NO: 437978 - RNA, 20 nt, Human
ugggaaagaggcccuacuuu

SEQ ID NO: 437979 - RNA, 20 nt, Human
ugggagaccgcuuuccgcuu

SEQ ID NO: 437980 - RNA, 19 nt, Human
ugggaugaguaagauacag

SEQ ID NO: 437981 - RNA, 19 nt, Human
ugggcagagcuuccugccg

SEQ ID NO: 437982 - RNA, 23 nt, Human
ugggccugggggacaggcacugg

SEQ ID NO: 437983 - RNA, 20 nt, Human
uggggguggccuccagagcu

SEQ ID NO: 437984 - RNA, 21 nt, Human
ugucagaauucuggcaagaug

SEQ ID NO: 437985 - RNA, 21 nt, Human
uguccuagugggaagcuggcg

SEQ ID NO: 437986 - RNA, 25 nt, Human
uguuauaguuccaugagggaacaaa

SEQ ID NO: 437987 - RNA, 24 nt, Human
uuagaaauggccaguaauaauucu

SEQ ID NO: 437988 - RNA, 24 nt, Human
uuagugaaguauuaaaacccucug

SEQ ID NO: 437989 - RNA, 19 nt, Human
uucaaacuaugucauggac

SEQ ID NO: 437990 - RNA, 20 nt, Human
uucaaggauggacauccacc

SEQ ID NO: 437991 - RNA, 20 nt, Human
uucccagaagaggcuguuuc

SEQ ID NO: 437992 - RNA, 19 nt, Human
uuccuggggguggccucca

SEQ ID NO: 437993 - RNA, 20 nt, Human
uuccugggugcaguuucccu

SEQ ID NO: 437994 - RNA, 21 nt, Human
uucgccugauagcauccuuuc

SEQ ID NO: 437995 - RNA, 23 nt, Human
uucuggacaguggacagaaggaa

SEQ ID NO: 437996 - RNA, 19 nt, Human
uugagauuuucuggaagac

SEQ ID NO: 437997 - RNA, 22 nt, Human
uugucuauuuagaaauggccag

SEQ ID NO: 437998 - RNA, 20 nt, Human
uuuuuuuuuuuuuuuggggg

SEQ ID NO: 437999 - RNA, 23 nt, Human
aaaaaaucaaagcaguacaagua

SEQ ID NO: 438000 - RNA, 27 nt, Human
aaacaguaccaacaacagagauuuuaa

SEQ ID NO: 438001 - RNA, 25 nt, Human
aaacaugcugaaagaaacugaugga

SEQ ID NO: 438002 - RNA, 21 nt, Human
aagcgauucuccugccucagc

SEQ ID NO: 438003 - RNA, 24 nt, Human
aaucaaagcaguacaaguacuccu

SEQ ID NO: 438004 - RNA, 24 nt, Human
accauguugggcaggcugaucuug

SEQ ID NO: 438005 - RNA, 18 nt, Human
acgagguuucaccauguu

SEQ ID NO: 438006 - RNA, 20 nt, Human
acgagguuucaccauguugg

SEQ ID NO: 438007 - RNA, 25 nt, Human
acugcacuccagccugggugacaag

SEQ ID NO: 438008 - RNA, 19 nt, Human
acugcagccuccgcuuccu

SEQ ID NO: 438009 - RNA, 19 nt, Human
acuguguugcccagggugg

SEQ ID NO: 438010 - RNA, 18 nt, Human
agaaaauccaacaaacgc

SEQ ID NO: 438011 - RNA, 26 nt, Human
agagaggacaggcaugggagugggga

SEQ ID NO: 438012 - RNA, 21 nt, Human
agaggacaggcaugggagugg

SEQ ID NO: 438013 - RNA, 22 nt, Human
agaucgggccacugcacuccag

SEQ ID NO: 438014 - RNA, 25 nt, Human
agccaaaaacaaacaguaccaacaa

SEQ ID NO: 438015 - RNA, 21 nt, Human
agccugggugacaagcaaaac

SEQ ID NO: 438016 - RNA, 23 nt, Human
agccugggugacaagcaaaacuc

SEQ ID NO: 438017 - RNA, 24 nt, Human
agcgauucuccugccucagccucc

SEQ ID NO: 438018 - RNA, 20 nt, Human
aggccugggauuacaggcgu

SEQ ID NO: 438019 - RNA, 22 nt, Human
aggccugggauuacaggcguga

SEQ ID NO: 438020 - RNA, 24 nt, Human
agugcagugacacgaucucggcuc

SEQ ID NO: 438021 - RNA, 24 nt, Human
aucgggccacugcacuccagccug

SEQ ID NO: 438022 - RNA, 22 nt, Human
auggaaacaugcugaaagaaac

SEQ ID NO: 438023 - RNA, 23 nt, Human
caaaaaaaaaaaauguuuaaaag

SEQ ID NO: 438024 - RNA, 18 nt, Human
caaaacucuaucucaaaa

SEQ ID NO: 438025 - RNA, 23 nt, Human
caaaacucuaucucaaaaaaaaa

SEQ ID NO: 438026 - RNA, 19 nt, Human
caccacaccacgucuggcu

SEQ ID NO: 438027 - RNA, 21 nt, Human
caccacgucuggcuaaucuuu

SEQ ID NO: 438028 - RNA, 23 nt, Human
caccauguugggcaggcugaucu

SEQ ID NO: 438029 - RNA, 24 nt, Human
caccauguugggcaggcugaucuu

SEQ ID NO: 438030 - RNA, 20 nt, Human
cacuccagccugggugacaa

SEQ ID NO: 438031 - RNA, 21 nt, Human
cacuccagccugggugacaag

SEQ ID NO: 438032 - RNA, 19 nt, Human
cacugcacuccagccuggg

SEQ ID NO: 438033 - RNA, 19 nt, Human
cacugcacuccagccuggg

SEQ ID NO: 438034 - RNA, 19 nt, Human
cacugcacuccagccuggg

SEQ ID NO: 438035 - RNA, 20 nt, Human
cacugcacuccagccugggg

SEQ ID NO: 438036 - RNA, 22 nt, Human
cacugcacuccagccuggguga

SEQ ID NO: 438037 - RNA, 24 nt, Human
cacugcacuccagccugggugaca

SEQ ID NO: 438038 - RNA, 25 nt, Human
cacugcacuccagccugggugacaa

SEQ ID NO: 438039 - RNA, 19 nt, Human
cagccuccgcuuccugggc

SEQ ID NO: 438040 - RNA, 23 nt, Human
cagccuccgcuuccugggcuuaa

SEQ ID NO: 438041 - RNA, 23 nt, Human
caguuggguuuucuuucucaacu

SEQ ID NO: 438042 - RNA, 22 nt, Human
ccaacagccaaaaacaaacagu

SEQ ID NO: 438043 - RNA, 18 nt, Human
ccacucacuccagccaag

SEQ ID NO: 438044 - RNA, 19 nt, Human
ccacucacuccagccaaga

SEQ ID NO: 438045 - RNA, 20 nt, Human
ccacucacuccagccaagau

SEQ ID NO: 438046 - RNA, 20 nt, Human
ccacugcacuccagccuggg

SEQ ID NO: 438047 - RNA, 20 nt, Human
ccacugcacuccagccuggg

SEQ ID NO: 438048 - RNA, 20 nt, Human
ccacugcacuccagccuggg

SEQ ID NO: 438049 - RNA, 21 nt, Human
ccacugcacuccagccugggu

SEQ ID NO: 438050 - RNA, 21 nt, Human
ccacugcacuccagccugggu

SEQ ID NO: 438051 - RNA, 23 nt, Human
ccacugcacuccagccuggguga

SEQ ID NO: 438052 - RNA, 24 nt, Human
ccacugcacuccagccugggugac

SEQ ID NO: 438053 - RNA, 24 nt, Human
cccaaguaguugggacaaugggug

SEQ ID NO: 438054 - RNA, 23 nt, Human
ccuaggccugggauuacaggcgu

SEQ ID NO: 438055 - RNA, 19 nt, Human
ccucacuuccccuuuaucc

SEQ ID NO: 438056 - RNA, 20 nt, Human
cuaggccugggauuacaggc

SEQ ID NO: 438057 - RNA, 24 nt, Human
cucaagugaucuucccgccuaggc

SEQ ID NO: 438058 - RNA, 24 nt, Human
cucacugcagccuccgcuuccugg

SEQ ID NO: 438059 - RNA, 24 nt, Human
cucagccucccaaguaguugggac

SEQ ID NO: 438060 - RNA, 19 nt, Human
cucuaucucaaaaaaaaaa

SEQ ID NO: 438061 - RNA, 20 nt, Human
cugaugcucacauucuuugc

SEQ ID NO: 438062 - RNA, 23 nt, Human
cugcagccuccgcuuccugggcu

SEQ ID NO: 438063 - RNA, 21 nt, Human
cugccucagccucccaaguag

SEQ ID NO: 438064 - RNA, 20 nt, Human
cugggauuacaggcgugagc

SEQ ID NO: 438065 - RNA, 24 nt, Human
cuuaagcgauucuccugccucagc

SEQ ID NO: 438066 - RNA, 24 nt, Human
cuucacagccagcaaugacacuuu

SEQ ID NO: 438067 - RNA, 24 nt, Human
cuuccugggcuuaagcgauucucc

SEQ ID NO: 438068 - RNA, 20 nt, Human
cuuggcauaaacucuuuagu

SEQ ID NO: 438069 - RNA, 18 nt, Human
gauuacaggcgugagcua

SEQ ID NO: 438070 - RNA, 22 nt, Human
gauuacaggcgugagcuaagau

SEQ ID NO: 438071 - RNA, 19 nt, Human
gccacugcacuccagccug

SEQ ID NO: 438072 - RNA, 24 nt, Human
gccacugcacuccagccuggguga

SEQ ID NO: 438073 - RNA, 24 nt, Human
gcgauucuccugccucagccuccc

SEQ ID NO: 438074 - RNA, 20 nt, Human
gcggaccccugugucagccu

SEQ ID NO: 438075 - RNA, 18 nt, Human
gcugaaagaaacugaugg

SEQ ID NO: 438076 - RNA, 21 nt, Human
ggaccccugugucaggacccu

SEQ ID NO: 438077 - RNA, 24 nt, Human
ggcugaucuugaacuccugaucuc

SEQ ID NO: 438078 - RNA, 24 nt, Human
gggaaucuuacuguguugcccagg

SEQ ID NO: 438079 - RNA, 22 nt, Human
gggaguggggaauaaccaaagg

SEQ ID NO: 438080 - RNA, 21 nt, Human
gggccugggucugcggacccc

SEQ ID NO: 438081 - RNA, 23 nt, Human
gguggagugcagugacacgaucu

SEQ ID NO: 438082 - RNA, 21 nt, Human
uaaaaggaagauauagaaaua

SEQ ID NO: 438083 - RNA, 27 nt, Human
uaagcgauucuccugccucagccuccc

SEQ ID NO: 438084 - RNA, 27 nt, Human
uaaucuuuuuuguauuuuuaguagaga

SEQ ID NO: 438085 - RNA, 20 nt, Human
uacuguguugcccagggugg

SEQ ID NO: 438086 - RNA, 22 nt, Human
uagagacgagguuucaccaugu

SEQ ID NO: 438087 - RNA, 23 nt, Human
uaggccugggauuacaggcguga

SEQ ID NO: 438088 - RNA, 24 nt, Human
uaguagagacgagguuucaccaug

SEQ ID NO: 438089 - RNA, 26 nt, Human
uaguagagacgagguuucaccauguu

SEQ ID NO: 438090 - RNA, 20 nt, Human
ucaaaggaaaaaaaaucaaa

SEQ ID NO: 438091 - RNA, 24 nt, Human
ucacugcagccuccgcuuccuggg

SEQ ID NO: 438092 - RNA, 22 nt, Human
ucauaaguucuucuugagaacu

SEQ ID NO: 438093 - RNA, 23 nt, Human
uccaaguuccuuagaaauguugc

SEQ ID NO: 438094 - RNA, 21 nt, Human
uccagagaaaauccaacaaac

SEQ ID NO: 438095 - RNA, 24 nt, Human
ucccaaguaguugggacaaugggu

SEQ ID NO: 438096 - RNA, 23 nt, Human
uccucacuuccccuuuauccucc

SEQ ID NO: 438097 - RNA, 20 nt, Human
uccugggcuuaagcgauucu

SEQ ID NO: 438098 - RNA, 21 nt, Human
uccugggcuuaagcgauucuc

SEQ ID NO: 438099 - RNA, 24 nt, Human
uccugggcuuaagcgauucuccug

SEQ ID NO: 438100 - RNA, 22 nt, Human
uccuuuuuuuuucccccaauua

SEQ ID NO: 438101 - RNA, 20 nt, Human
ucuaucucaaaaaaaaaaaa

SEQ ID NO: 438102 - RNA, 19 nt, Human
ucuccugccucagccuccc

SEQ ID NO: 438103 - RNA, 20 nt, Human
ucuuacuguguugcccaggg

SEQ ID NO: 438104 - RNA, 24 nt, Human
ucuuacuguguugcccagggugga

SEQ ID NO: 438105 - RNA, 21 nt, Human
ucuugaacuccugaucucaag

SEQ ID NO: 438106 - RNA, 25 nt, Human
ugacaagcaaaacucuaucucaaaa

SEQ ID NO: 438107 - RNA, 24 nt, Human
ugaucucaagugaucuucccgccu

SEQ ID NO: 438108 - RNA, 25 nt, Human
ugaugcucacauucuuugcaguggg

SEQ ID NO: 438109 - RNA, 20 nt, Human
ugauggaaugaggggccugg

SEQ ID NO: 438110 - RNA, 22 nt, Human
ugcagugacacgaucucggcuc

SEQ ID NO: 438111 - RNA, 24 nt, Human
ugccucagccucccaaguaguugg

SEQ ID NO: 438112 - RNA, 23 nt, Human
uggagugcagugacacgaucucg

SEQ ID NO: 438113 - RNA, 24 nt, Human
uggagugcagugacacgaucucgg

SEQ ID NO: 438114 - RNA, 19 nt, Human
ugggaguggggaauaacca

SEQ ID NO: 438115 - RNA, 18 nt, Human
ugggauuacaggcgugag

SEQ ID NO: 438116 - RNA, 19 nt, Human
ugggauuacaggcgugagc

SEQ ID NO: 438117 - RNA, 19 nt, Human
ugggauuacaggcgugagc

SEQ ID NO: 438118 - RNA, 19 nt, Human
ugggauuacaggcgugagc

SEQ ID NO: 438119 - RNA, 19 nt, Human
ugggauuacaggcgugagc

SEQ ID NO: 438120 - RNA, 21 nt, Human
ugggauuacaggcgugagcua

SEQ ID NO: 438121 - RNA, 25 nt, Human
ugggauuacaggcgugagcuaagau

SEQ ID NO: 438122 - RNA, 24 nt, Human
ugggcaggcugaucuugaacuccu

SEQ ID NO: 438123 - RNA, 19 nt, Human
ugucuugaagagcacaaga

SEQ ID NO: 438124 - RNA, 21 nt, Human
uguugcccaggguggagugca

SEQ ID NO: 438125 - RNA, 20 nt, Human
uguugggcaggcugaucuug

SEQ ID NO: 438126 - RNA, 24 nt, Human
uuaguagagacgagguuucaccau

SEQ ID NO: 438127 - RNA, 24 nt, Human
uucaaaauaugaaaacauggaaac

SEQ ID NO: 438128 - RNA, 20 nt, Human
uugaaagaaauucuccucac

SEQ ID NO: 438129 - RNA, 24 nt, Human
uugagagggaaucuuacuguguug

SEQ ID NO: 438130 - RNA, 18 nt, Human
uugcccaggguggagugc

SEQ ID NO: 438131 - RNA, 21 nt, Human
uuucaccauguugggcaggcu

SEQ ID NO: 438132 - RNA, 21 nt, Human
uuucuuggcauaaacucuuua

SEQ ID NO: 438133 - RNA, 24 nt, Human
uuuuuaguagagacgagguuucac

SEQ ID NO: 438134 - RNA, 19 nt, Human
uuuuucuucuuaauguggu

SEQ ID NO: 438135 - RNA, 21 nt, Human
uuuuuguauuuuuaguagaga

SEQ ID NO: 438136 - RNA, 21 nt, Human
uuuuuuguauuuuuaguagag

SEQ ID NO: 438137 - RNA, 24 nt, Human
uuuuuuguauuuuuaguagagacg

SEQ ID NO: 438138 - RNA, 23 nt, Human
uuuuuuuuucuugagagggaauc

SEQ ID NO: 438139 - RNA, 18 nt, Human
uuuuuuuuuuuuuucuug

SEQ ID NO: 438140 - RNA, 24 nt, Human
uuuuuuuuuuuuuucuugagaggg

SEQ ID NO: 438141 - RNA, 25 nt, Human
uuuuuuuuuuuuuuuucuugagagg

SEQ ID NO: 438142 - RNA, 21 nt, Human
aaagaaauaaauuaaaagccc

SEQ ID NO: 438143 - RNA, 21 nt, Human
aaagaaauaaauuaaaagccc

SEQ ID NO: 438144 - RNA, 19 nt, Human
aaagcccuccuauccccuc

SEQ ID NO: 438145 - RNA, 19 nt, Human
aaagcccuccuauccccuc

SEQ ID NO: 438146 - RNA, 21 nt, Human
aaagcccuccuauccccucca

SEQ ID NO: 438147 - RNA, 21 nt, Human
aaagcccuccuauccccucca

SEQ ID NO: 438148 - RNA, 25 nt, Human
aacagaaaaagaaauaaauuaaaag

SEQ ID NO: 438149 - RNA, 25 nt, Human
aacagaaaaagaaauaaauuaaaag

SEQ ID NO: 438150 - RNA, 22 nt, Human
aaccacgcaaaacuggguccca

SEQ ID NO: 438151 - RNA, 22 nt, Human
aaccacgcaaaacuggguccca

SEQ ID NO: 438152 - RNA, 26 nt, Human
aacuggcucagagagggggaagccuc

SEQ ID NO: 438153 - RNA, 26 nt, Human
aacuggcucagagagggggaagccuc

SEQ ID NO: 438154 - RNA, 24 nt, Human
aagcucccaggaugagccugggag

SEQ ID NO: 438155 - RNA, 21 nt, Human
aaggguccagcccccacugac

SEQ ID NO: 438156 - RNA, 21 nt, Human
aaggguccagcccccacugac

SEQ ID NO: 438157 - RNA, 22 nt, Human
acccugggcaucugggcaaggg

SEQ ID NO: 438158 - RNA, 22 nt, Human
acccugggcaucugggcaaggg

SEQ ID NO: 438159 - RNA, 19 nt, Human
agaaauguggagacugaac

SEQ ID NO: 438160 - RNA, 19 nt, Human
agaaauguggagacugaac

SEQ ID NO: 438161 - RNA, 18 nt, Human
agacaguaggaggugggg

SEQ ID NO: 438162 - RNA, 24 nt, Human
agaggagaauaaguggggagaggg

SEQ ID NO: 438163 - RNA, 18 nt, Human
agauggucagcagggcug

SEQ ID NO: 438164 - RNA, 22 nt, Human
agcucccaggaugagccuggga

SEQ ID NO: 438165 - RNA, 23 nt, Human
aggaagaaaugaaaacuggcuca

SEQ ID NO: 438166 - RNA, 23 nt, Human
aggaagaaaugaaaacuggcuca

SEQ ID NO: 438167 - RNA, 26 nt, Human
aggaagaaaugaaaacuggcucagag

SEQ ID NO: 438168 - RNA, 26 nt, Human
aggaagaaaugaaaacuggcucagag

SEQ ID NO: 438169 - RNA, 18 nt, Human
aggaagauggggacagau

SEQ ID NO: 438170 - RNA, 22 nt, Human
aggaggugggggucaagagugg

SEQ ID NO: 438171 - RNA, 23 nt, Human
aggcugcggcagcggugguggcg

SEQ ID NO: 438172 - RNA, 19 nt, Human
aggggagacaaggaagagg

SEQ ID NO: 438173 - RNA, 25 nt, Human
agggggcaggaguggcgcuguaucc

SEQ ID NO: 438174 - RNA, 20 nt, Human
aguaggaggugggggucaag

SEQ ID NO: 438175 - RNA, 21 nt, Human
aguggcuaaugccaccaggaa

SEQ ID NO: 438176 - RNA, 21 nt, Human
aguggcuaaugccaccaggaa

SEQ ID NO: 438177 - RNA, 18 nt, Human
aguggggagaggggagac

SEQ ID NO: 438178 - RNA, 22 nt, Human
auaaaaaccaaccacgcaaaac

SEQ ID NO: 438179 - RNA, 23 nt, Human
auaaaaaccaaccacgcaaaacu

SEQ ID NO: 438180 - RNA, 23 nt, Human
auagcgguaggaauggugggggg

SEQ ID NO: 438181 - RNA, 22 nt, Human
caaaacugggucccacccucuc

SEQ ID NO: 438182 - RNA, 22 nt, Human
caaaacugggucccacccucuc

SEQ ID NO: 438183 - RNA, 21 nt, Human
cacauaggaagagacuccacu

SEQ ID NO: 438184 - RNA, 24 nt, Human
cacauucacuucagaaguugaaga

SEQ ID NO: 438185 - RNA, 26 nt, Human
cacccucccucccucccuuucugcug

SEQ ID NO: 438186 - RNA, 21 nt, Human
cacccucuccuuuugcuccca

SEQ ID NO: 438187 - RNA, 21 nt, Human
cacccucuccuuuugcuccca

SEQ ID NO: 438188 - RNA, 20 nt, Human
cacgacccugggcaucuggg

SEQ ID NO: 438189 - RNA, 20 nt, Human
cacgacccugggcaucuggg

SEQ ID NO: 438190 - RNA, 24 nt, Human
cacgacccugggcaucugggcaag

SEQ ID NO: 438191 - RNA, 24 nt, Human
cacgacccugggcaucugggcaag

SEQ ID NO: 438192 - RNA, 18 nt, Human
cagcacccucccucccuc

SEQ ID NO: 438193 - RNA, 21 nt, Human
cagccagagggcgagaagucc

SEQ ID NO: 438194 - RNA, 21 nt, Human
cagccagagggcgagaagucc

SEQ ID NO: 438195 - RNA, 23 nt, Human
ccaggguucguuccuuuccccaa

SEQ ID NO: 438196 - RNA, 23 nt, Human
ccaggguucguuccuuuccccaa

SEQ ID NO: 438197 - RNA, 19 nt, Human
cccaacgccugcugacuuc

SEQ ID NO: 438198 - RNA, 22 nt, Human
cccacagacaagacaguaggag

SEQ ID NO: 438199 - RNA, 19 nt, Human
ccccaguugugggaacagg

SEQ ID NO: 438200 - RNA, 19 nt, Human
ccccaguugugggaacagg

SEQ ID NO: 438201 - RNA, 22 nt, Human
cccccagcacccucccucccuc

SEQ ID NO: 438202 - RNA, 18 nt, Human
cccccgccaccccucccc

SEQ ID NO: 438203 - RNA, 21 nt, Human
cccccgccaccccuccccaac

SEQ ID NO: 438204 - RNA, 25 nt, Human
ccccgccaccccuccccaacgccug

SEQ ID NO: 438205 - RNA, 23 nt, Human
ccccuccagccaggguucguucc

SEQ ID NO: 438206 - RNA, 20 nt, Human
cccgccaccccuccccaacg

SEQ ID NO: 438207 - RNA, 22 nt, Human
cccucccucccuuucugcuguc

SEQ ID NO: 438208 - RNA, 19 nt, Human
cccugcuucagggcccacu

SEQ ID NO: 438209 - RNA, 21 nt, Human
cccugggcaucugggcaaggg

SEQ ID NO: 438210 - RNA, 21 nt, Human
cccugggcaucugggcaaggg

SEQ ID NO: 438211 - RNA, 18 nt, Human
ccucagagggguaggggg

SEQ ID NO: 438212 - RNA, 21 nt, Human
ccucuccuuuugcucccagcc

SEQ ID NO: 438213 - RNA, 21 nt, Human
ccucuccuuuugcucccagcc

SEQ ID NO: 438214 - RNA, 19 nt, Human
cggcagcggugguggcgga

SEQ ID NO: 438215 - RNA, 21 nt, Human
cucacaaauggaugaguccau

SEQ ID NO: 438216 - RNA, 21 nt, Human
cucacaaauggaugaguccau

SEQ ID NO: 438217 - RNA, 19 nt, Human
cucccagccuaccucccca

SEQ ID NO: 438218 - RNA, 19 nt, Human
cucccagccuaccucccca

SEQ ID NO: 438219 - RNA, 20 nt, Human
cuccccagggggcagaaguu

SEQ ID NO: 438220 - RNA, 20 nt, Human
cuccccagggggcagaaguu

SEQ ID NO: 438221 - RNA, 19 nt, Human
cucucucucuuuauuuuca

SEQ ID NO: 438222 - RNA, 19 nt, Human
cucucucucuuuauuuuca

SEQ ID NO: 438223 - RNA, 22 nt, Human
cugcugucucucugagggcugg

SEQ ID NO: 438224 - RNA, 23 nt, Human
cugcugucucucugagggcuggg

SEQ ID NO: 438225 - RNA, 24 nt, Human
cuggccaccuaaccaccauuuucc

SEQ ID NO: 438226 - RNA, 21 nt, Human
cuggcccccuccccagccagg

SEQ ID NO: 438227 - RNA, 18 nt, Human
cuggcucagagaggggga

SEQ ID NO: 438228 - RNA, 18 nt, Human
cuggcucagagaggggga

SEQ ID NO: 438229 - RNA, 20 nt, Human
gaagauggggacagauggga

SEQ ID NO: 438230 - RNA, 22 nt, Human
gacaggaggcuacacugggagg

SEQ ID NO: 438231 - RNA, 22 nt, Human
gagaggggagacaaggaagagg

SEQ ID NO: 438232 - RNA, 23 nt, Human
gagauggucagcagggcugcagg

SEQ ID NO: 438233 - RNA, 24 nt, Human
gagauggugcagcagggcugcagg

SEQ ID NO: 438234 - RNA, 18 nt, Human
gaggaagauggggacaga

SEQ ID NO: 438235 - RNA, 19 nt, Human
gaggaagauggggacagau

SEQ ID NO: 438236 - RNA, 21 nt, Human
gaggagaauaaguggggagag

SEQ ID NO: 438237 - RNA, 23 nt, Human
gagggcuggggcugcugccgccg

SEQ ID NO: 438238 - RNA, 24 nt, Human
gagggggaggcaacugucccacag

SEQ ID NO: 438239 - RNA, 23 nt, Human
gaggguuuggcccugcuucaggg

SEQ ID NO: 438240 - RNA, 24 nt, Human
gagugcuucagguaucagcuucca

SEQ ID NO: 438241 - RNA, 24 nt, Human
gagugcuucagguaucagcuucca

SEQ ID NO: 438242 - RNA, 24 nt, Human
gaguggcuaaugccaccaggaaga

SEQ ID NO: 438243 - RNA, 24 nt, Human
gaguggcuaaugccaccaggaaga

SEQ ID NO: 438244 - RNA, 20 nt, Human
gauggggacagaugggagga

SEQ ID NO: 438245 - RNA, 23 nt, Human
gcagcagggcugcagggggcugg

SEQ ID NO: 438246 - RNA, 23 nt, Human
gcuacacugggagggaaggugaa

SEQ ID NO: 438247 - RNA, 23 nt, Human
gcuacacugggagggaaggugaa

SEQ ID NO: 438248 - RNA, 24 nt, Human
gcucagagagggggaagccucaac

SEQ ID NO: 438249 - RNA, 24 nt, Human
gcucagagagggggaagccucaac

SEQ ID NO: 438250 - RNA, 18 nt, Human
gcucccagccuaccuccc

SEQ ID NO: 438251 - RNA, 24 nt, Human
gcugagucacuggagaugaggggg

SEQ ID NO: 438252 - RNA, 18 nt, Human
ggagaggggagacaagga

SEQ ID NO: 438253 - RNA, 24 nt, Human
ggagugagaggcagggaguggcua

SEQ ID NO: 438254 - RNA, 24 nt, Human
ggagugagaggcagggaguggcua

SEQ ID NO: 438255 - RNA, 21 nt, Human
ggauggggccaagagggggca

SEQ ID NO: 438256 - RNA, 21 nt, Human
ggcuaaugccaccaggaagaa

SEQ ID NO: 438257 - RNA, 21 nt, Human
ggcuaaugccaccaggaagaa

SEQ ID NO: 438258 - RNA, 18 nt, Human
gggacagaugggaggaga

SEQ ID NO: 438259 - RNA, 18 nt, Human
gggagaggggagacaagg

SEQ ID NO: 438260 - RNA, 23 nt, Human
gggaggaagauggggacagaugg

SEQ ID NO: 438261 - RNA, 22 nt, Human
ggggacagaugggaggagagcu

SEQ ID NO: 438262 - RNA, 21 nt, Human
ggggagaggggagacaaggga

SEQ ID NO: 438263 - RNA, 20 nt, Human
gggguagggggccugggggg

SEQ ID NO: 438264 - RNA, 19 nt, Human
ggguagggggccugggggg

SEQ ID NO: 438265 - RNA, 19 nt, Human
ggucagcagggcugcaggg

SEQ ID NO: 438266 - RNA, 18 nt, Human
ggugagauggugcagcag

SEQ ID NO: 438267 - RNA, 21 nt, Human
ggugcagcagggcugcagggg

SEQ ID NO: 438268 - RNA, 19 nt, Human
guaucagcuuccagccaga

SEQ ID NO: 438269 - RNA, 19 nt, Human
guaucagcuuccagccaga

SEQ ID NO: 438270 - RNA, 22 nt, Human
gugcagcagggcugcagggggc

SEQ ID NO: 438271 - RNA, 19 nt, Human
uacacugggagggaaggug

SEQ ID NO: 438272 - RNA, 19 nt, Human
uacacugggagggaaggug

SEQ ID NO: 438273 - RNA, 19 nt, Human
uagcgguaggaaugguggg

SEQ ID NO: 438274 - RNA, 23 nt, Human
uagguguggggaggaagaugggg

SEQ ID NO: 438275 - RNA, 25 nt, Human
uaucccagagagugcacgacccugg

SEQ ID NO: 438276 - RNA, 25 nt, Human
uaucccagagagugcacgacccugg

SEQ ID NO: 438277 - RNA, 25 nt, Human
uaucccagagagugcacgacccugg

SEQ ID NO: 438278 - RNA, 25 nt, Human
uaucccagagagugcacgacccugg

SEQ ID NO: 438279 - RNA, 20 nt, Human
uccaaagaauggaugagucc

SEQ ID NO: 438280 - RNA, 20 nt, Human
uccaaagaauggaugagucc

SEQ ID NO: 438281 - RNA, 23 nt, Human
uccagcccccacugacaggaggc

SEQ ID NO: 438282 - RNA, 23 nt, Human
uccagcccccacugacaggaggc

SEQ ID NO: 438283 - RNA, 25 nt, Human
ucccacagacaagacaguaggaggu

SEQ ID NO: 438284 - RNA, 23 nt, Human
ucccacccucuccuuuugcuccc

SEQ ID NO: 438285 - RNA, 23 nt, Human
ucccacccucuccuuuugcuccc

SEQ ID NO: 438286 - RNA, 19 nt, Human
ucccaggaugagccugggg

SEQ ID NO: 438287 - RNA, 19 nt, Human
ucccaggaugagccugggg

SEQ ID NO: 438288 - RNA, 20 nt, Human
uccccaacuccccagggggc

SEQ ID NO: 438289 - RNA, 20 nt, Human
uccccaacuccccagggggc

SEQ ID NO: 438290 - RNA, 24 nt, Human
uccccuccagccaggguucguucc

SEQ ID NO: 438291 - RNA, 24 nt, Human
uccgucaaguuuuagccaaugagu

SEQ ID NO: 438292 - RNA, 25 nt, Human
ucugucggggugucggugccaaggg

SEQ ID NO: 438293 - RNA, 21 nt, Human
ugaaaacuggcucagagaggg

SEQ ID NO: 438294 - RNA, 21 nt, Human
ugaaaacuggcucagagaggg

SEQ ID NO: 438295 - RNA, 23 nt, Human
ugaagaacuguacuauggggaca

SEQ ID NO: 438296 - RNA, 23 nt, Human
ugaagaacuguacuauggggaca

SEQ ID NO: 438297 - RNA, 23 nt, Human
ugaauuagaaggguccagccccc

SEQ ID NO: 438298 - RNA, 23 nt, Human
ugaauuagaaggguccagccccc

SEQ ID NO: 438299 - RNA, 24 nt, Human
ugacaggaggcuacacugggaggg

SEQ ID NO: 438300 - RNA, 18 nt, Human
ugagaggcagggaguggc

SEQ ID NO: 438301 - RNA, 18 nt, Human
ugagaggcagggaguggc

SEQ ID NO: 438302 - RNA, 21 nt, Human
ugaguccauugaauccaugga

SEQ ID NO: 438303 - RNA, 21 nt, Human
ugaguccauugaauccaugga

SEQ ID NO: 438304 - RNA, 23 nt, Human
ugcacgacccugggcaucugggc

SEQ ID NO: 438305 - RNA, 23 nt, Human
ugcacgacccugggcaucugggc

SEQ ID NO: 438306 - RNA, 19 nt, Human
ugcagcagggcugcagggg

SEQ ID NO: 438307 - RNA, 24 nt, Human
ugcagcagggcugcagggggcugg

SEQ ID NO: 438308 - RNA, 20 nt, Human
ugcagggggcuggguggggu

SEQ ID NO: 438309 - RNA, 20 nt, Human
ugcagggggcuggguggggu

SEQ ID NO: 438310 - RNA, 25 nt, Human
uggaggggaggugggagugggaggu

SEQ ID NO: 438311 - RNA, 20 nt, Human
uggaguggggggggauuugu

SEQ ID NO: 438312 - RNA, 19 nt, Human
uggcuaaugccaccaggaa

SEQ ID NO: 438313 - RNA, 19 nt, Human
uggcuaaugccaccaggaa

SEQ ID NO: 438314 - RNA, 23 nt, Human
ugggagugcuucagguaucagcu

SEQ ID NO: 438315 - RNA, 23 nt, Human
ugggagugcuucagguaucagcu

SEQ ID NO: 438316 - RNA, 19 nt, Human
ugggagugggagguugggc

SEQ ID NO: 438317 - RNA, 26 nt, Human
uggggagaggggagacaaggaagagg

SEQ ID NO: 438318 - RNA, 21 nt, Human
uggggaggaagauggggacag

SEQ ID NO: 438319 - RNA, 27 nt, Human
ugucccacagacaagacaguaggaggu

SEQ ID NO: 438320 - RNA, 18 nt, Human
ugucucugucucugucgg

SEQ ID NO: 438321 - RNA, 25 nt, Human
uuaaaagcccuccuauccccuccag

SEQ ID NO: 438322 - RNA, 25 nt, Human
uuaaaagcccuccuauccccuccag

SEQ ID NO: 438323 - RNA, 19 nt, Human
uuagaaggguccagccccc

SEQ ID NO: 438324 - RNA, 22 nt, Human
uuccaaagaggagaauaagugg

SEQ ID NO: 438325 - RNA, 23 nt, Human
uuccaaagaggagaauaaguggg

SEQ ID NO: 438326 - RNA, 21 nt, Human
uucccccgccaccccucccca

SEQ ID NO: 438327 - RNA, 22 nt, Human
uucccccgccaccccuccccaa

SEQ ID NO: 438328 - RNA, 27 nt, Human
uucuuccccuugugucuggccaaccag

SEQ ID NO: 438329 - RNA, 27 nt, Human
uucuuccccuugugucuggccaaccag

SEQ ID NO: 438330 - RNA, 20 nt, Human
uugaagauuccaaagaggag

SEQ ID NO: 438331 - RNA, 28 nt, Human
uuuugcucccagccuaccuccccaguug

SEQ ID NO: 438332 - RNA, 28 nt, Human
uuuugcucccagccuaccuccccaguug

SEQ ID NO: 438333 - RNA, 21 nt, Human
uuuuuuuuuuuuuuuucucuc

SEQ ID NO: 438334 - RNA, 21 nt, Human
aaacagaaaaacaaauguacc

SEQ ID NO: 438335 - RNA, 22 nt, Human
acagacgugagcaauaaauacg

SEQ ID NO: 438336 - RNA, 19 nt, Human
acccgcugcucguccaugc

SEQ ID NO: 438337 - RNA, 21 nt, Human
agcccugggggcuguggggcc

SEQ ID NO: 438338 - RNA, 18 nt, Human
aggaaaaacagaaaaaca

SEQ ID NO: 438339 - RNA, 25 nt, Human
aggaaaaacagaaaaacaaauguac

SEQ ID NO: 438340 - RNA, 23 nt, Human
aggagugggggcagggugggccu

SEQ ID NO: 438341 - RNA, 20 nt, Human
agucgucccccggcuccugg

SEQ ID NO: 438342 - RNA, 25 nt, Human
auacgcacauacauucaaguaugcg

SEQ ID NO: 438343 - RNA, 19 nt, Human
auccuggaggacugguacu

SEQ ID NO: 438344 - RNA, 20 nt, Human
augaggucgaagaauuccuc

SEQ ID NO: 438345 - RNA, 22 nt, Human
caaagaagcacuccucguccga

SEQ ID NO: 438346 - RNA, 19 nt, Human
caccacacccugugucagc

SEQ ID NO: 438347 - RNA, 23 nt, Human
caccaggcccagaucugccucuc

SEQ ID NO: 438348 - RNA, 18 nt, Human
cagacaucccgggaagcc

SEQ ID NO: 438349 - RNA, 21 nt, Human
caggucaaagaagcacuccuc

SEQ ID NO: 438350 - RNA, 23 nt, Human
caguccaggccucuguccgucac

SEQ ID NO: 438351 - RNA, 20 nt, Human
ccagcccugggggcuguggg

SEQ ID NO: 438352 - RNA, 18 nt, Human
ccauccuagccugagagu

SEQ ID NO: 438353 - RNA, 21 nt, Human
ccauccuagccugagaguggg

SEQ ID NO: 438354 - RNA, 22 nt, Human
cccaccacacccugugucagcc

SEQ ID NO: 438355 - RNA, 26 nt, Human
cccagccuuggccuggaaccgguucc

SEQ ID NO: 438356 - RNA, 20 nt, Human
cccccugcuccgggcccccg

SEQ ID NO: 438357 - RNA, 20 nt, Human
cccgggaagccucccgugcc

SEQ ID NO: 438358 - RNA, 24 nt, Human
cccugggccagccuccccagccuu

SEQ ID NO: 438359 - RNA, 23 nt, Human
ccguggccucggcagccccggcc

SEQ ID NO: 438360 - RNA, 19 nt, Human
ccuagaggcacccuccuag

SEQ ID NO: 438361 - RNA, 18 nt, Human
ccuggccaucguccaggg

SEQ ID NO: 438362 - RNA, 19 nt, Human
ccuuggccuggaacacuuc

SEQ ID NO: 438363 - RNA, 24 nt, Human
cgaagaauuccucggucuggggcg

SEQ ID NO: 438364 - RNA, 22 nt, Human
cgaggccgucaucgagggcugg

SEQ ID NO: 438365 - RNA, 22 nt, Human
cgcacauacauucaaguaugcg

SEQ ID NO: 438366 - RNA, 24 nt, Human
cgcccucccaccacgggcagcuug

SEQ ID NO: 438367 - RNA, 22 nt, Human
cggcaggcugcccacgcuggcc

SEQ ID NO: 438368 - RNA, 22 nt, Human
cggcccugccccuccagaagca

SEQ ID NO: 438369 - RNA, 18 nt, Human
cggccuggccaucgucca

SEQ ID NO: 438370 - RNA, 18 nt, Human
cggcuccuggggcucgcc

SEQ ID NO: 438371 - RNA, 18 nt, Human
cgggcaccugucccugcu

SEQ ID NO: 438372 - RNA, 19 nt, Human
cggggaggccguggggcug

SEQ ID NO: 438373 - RNA, 20 nt, Human
cgucccccggcuccuggggc

SEQ ID NO: 438374 - RNA, 25 nt, Human
cgugagcaauaaauacgcacauaca

SEQ ID NO: 438375 - RNA, 24 nt, Human
cgugccuccugucccugugcccac

SEQ ID NO: 438376 - RNA, 19 nt, Human
cucaugggugcuaccccag

SEQ ID NO: 438377 - RNA, 19 nt, Human
cuccagggugggggcggcc

SEQ ID NO: 438378 - RNA, 19 nt, Human
cuccuggggcucgccgugg

SEQ ID NO: 438379 - RNA, 24 nt, Human
cucuguccgucaccugcccugggc

SEQ ID NO: 438380 - RNA, 19 nt, Human
cugcugcuggggcucgggc

SEQ ID NO: 438381 - RNA, 28 nt, Human
cugcugcuggggcucgggccggcucguc

SEQ ID NO: 438382 - RNA, 25 nt, Human
cugggccagccuccccagccuuggc

SEQ ID NO: 438383 - RNA, 20 nt, Human
gaagcacgcccucccaccac

SEQ ID NO: 438384 - RNA, 22 nt, Human
gaaugaggcugaagaaguccuc

SEQ ID NO: 438385 - RNA, 25 nt, Human
gagugggggcagggugggccuggcg

SEQ ID NO: 438386 - RNA, 19 nt, Human
gccucgggaggacguggcu

SEQ ID NO: 438387 - RNA, 21 nt, Human
gccuggaacacuucccagaca

SEQ ID NO: 438388 - RNA, 19 nt, Human
gcgagguccacccgcugcu

SEQ ID NO: 438389 - RNA, 18 nt, Human
gcgauccuguccuccagg

SEQ ID NO: 438390 - RNA, 22 nt, Human
gcuccuggggcucgccguggcc

SEQ ID NO: 438391 - RNA, 26 nt, Human
gcugcuggggcucgggccggcucguc

SEQ ID NO: 438392 - RNA, 22 nt, Human
ggagugggggcagggugggccu

SEQ ID NO: 438393 - RNA, 18 nt, Human
ggcagccccggccuggcc

SEQ ID NO: 438394 - RNA, 20 nt, Human
ggcccagaucugccucucca

SEQ ID NO: 438395 - RNA, 20 nt, Human
ggcccugccccuccagaagc

SEQ ID NO: 438396 - RNA, 18 nt, Human
ggccugagccugucgccc

SEQ ID NO: 438397 - RNA, 19 nt, Human
gggaggccguggggcugca

SEQ ID NO: 438398 - RNA, 22 nt, Human
ggggggcgcuacguccuggaga

SEQ ID NO: 438399 - RNA, 20 nt, Human
ggucaucgauccuggaggac

SEQ ID NO: 438400 - RNA, 18 nt, Human
ggucggggaggccguggg

SEQ ID NO: 438401 - RNA, 20 nt, Human
ggucggggaggccguggggc

SEQ ID NO: 438402 - RNA, 21 nt, Human
ggugcccugcauugcuguggg

SEQ ID NO: 438403 - RNA, 20 nt, Human
guccucggcaauggccucgg

SEQ ID NO: 438404 - RNA, 18 nt, Human
gugggggcagggugggcc

SEQ ID NO: 438405 - RNA, 19 nt, Human
uagggcccuuggcagucuu

SEQ ID NO: 438406 - RNA, 18 nt, Human
ucaucgagggcugggcga

SEQ ID NO: 438407 - RNA, 23 nt, Human
uccaggccucuguccgucaccug

SEQ ID NO: 438408 - RNA, 21 nt, Human
uccccagccuuggccuggaac

SEQ ID NO: 438409 - RNA, 22 nt, Human
uccuagauggaacugccagccc

SEQ ID NO: 438410 - RNA, 23 nt, Human
ucucaugggugcuaccccagucc

SEQ ID NO: 438411 - RNA, 20 nt, Human
ucuuggguuggaaaggaccc

SEQ ID NO: 438412 - RNA, 19 nt, Human
ugacaacauggcacagacg

SEQ ID NO: 438413 - RNA, 24 nt, Human
ugagcauguugaagaagucguccc

SEQ ID NO: 438414 - RNA, 24 nt, Human
ugcaugcccagugccuguccucgg

SEQ ID NO: 438415 - RNA, 26 nt, Human
ugcccugggccagccuccccagccuu

SEQ ID NO: 438416 - RNA, 20 nt, Human
ugccuccugucccugugccc

SEQ ID NO: 438417 - RNA, 18 nt, Human
ugcggcccugccccucca

SEQ ID NO: 438418 - RNA, 23 nt, Human
ugcugcuggggcucgggcgggcc

SEQ ID NO: 438419 - RNA, 20 nt, Human
ugcuggggcucgggcgggcc

SEQ ID NO: 438420 - RNA, 28 nt, Human
uggaaaggacccauugacaacauggcag

SEQ ID NO: 438421 - RNA, 23 nt, Human
uggccaucguccaggggacaacg

SEQ ID NO: 438422 - RNA, 22 nt, Human
uggccucggcagccccggccug

SEQ ID NO: 438423 - RNA, 24 nt, Human
uggcggugggcacagggccuuagc

SEQ ID NO: 438424 - RNA, 18 nt, Human
ugggagcuggcgaugagg

SEQ ID NO: 438425 - RNA, 18 nt, Human
ugggaggugccaaggcug

SEQ ID NO: 438426 - RNA, 18 nt, Human
ugggggcagggugggccu

SEQ ID NO: 438427 - RNA, 20 nt, Human
uguguucgggcaccuguccc

SEQ ID NO: 438428 - RNA, 22 nt, Human
uuggucaacaggucaaagaagc

SEQ ID NO: 438429 - RNA, 23 nt, Human
aaagaccaccauccucagaagcc

SEQ ID NO: 438430 - RNA, 20 nt, Human
aacagaaauggguuuccaga

SEQ ID NO: 438431 - RNA, 22 nt, Human
aaccccagcaauaaccaacaaa

SEQ ID NO: 438432 - RNA, 23 nt, Human
aagaaaccaccagcuuuauagug

SEQ ID NO: 438433 - RNA, 25 nt, Human
aaggaaaggggaaacccacaugugg

SEQ ID NO: 438434 - RNA, 24 nt, Human
aaggggaaacccacaugugacccc

SEQ ID NO: 438435 - RNA, 20 nt, Human
accccagcaauaaccaacaa

SEQ ID NO: 438436 - RNA, 24 nt, Human
agaggacuuaagucagauggacuc

SEQ ID NO: 438437 - RNA, 19 nt, Human
agccuggccaaaugccauu

SEQ ID NO: 438438 - RNA, 26 nt, Human
agcugacuugggacuccuggcucggc

SEQ ID NO: 438439 - RNA, 22 nt, Human
aggaaaggggaaacccacaugu

SEQ ID NO: 438440 - RNA, 20 nt, Human
aggaagaugagggaagcccu

SEQ ID NO: 438441 - RNA, 31 nt, Human
aggcaaccccugaugauuuguaaagccaggg

SEQ ID NO: 438442 - RNA, 19 nt, Human
aggcaaggaaaggggaaac

SEQ ID NO: 438443 - RNA, 19 nt, Human
aggcaggagagcugacuug

SEQ ID NO: 438444 - RNA, 20 nt, Human
aggcaggagagcugacuugg

SEQ ID NO: 438445 - RNA, 21 nt, Human
agggagagaggacuuaaguca

SEQ ID NO: 438446 - RNA, 22 nt, Human
agguccccacucacccucugcc

SEQ ID NO: 438447 - RNA, 21 nt, Human
aguaaagccagccuggccaaa

SEQ ID NO: 438448 - RNA, 21 nt, Human
aguuuguggaaacaaagaucu

SEQ ID NO: 438449 - RNA, 24 nt, Human
caaaagaccaccauccucagaagc

SEQ ID NO: 438450 - RNA, 26 nt, Human
caacagaaauggguuuccagaagaau

SEQ ID NO: 438451 - RNA, 24 nt, Human
caaccccugaugauuuguaaagcc

SEQ ID NO: 438452 - RNA, 28 nt, Human
caagcaggcaaccccugauuguaaugac

SEQ ID NO: 438453 - RNA, 19 nt, Human
caagcucaccaccucaucc

SEQ ID NO: 438454 - RNA, 19 nt, Human
cacaaugauauuguguggu

SEQ ID NO: 438455 - RNA, 19 nt, Human
cacaaugauauuguguggu

SEQ ID NO: 438456 - RNA, 18 nt, Human
caccagaguucaguguuu

SEQ ID NO: 438457 - RNA, 20 nt, Human
caccauccucagaagccaag

SEQ ID NO: 438458 - RNA, 19 nt, Human
cacccuccuccugccaccc

SEQ ID NO: 438459 - RNA, 23 nt, Human
cacccuuguggacuaggaccagg

SEQ ID NO: 438460 - RNA, 19 nt, Human
caccuucuggaaauccgca

SEQ ID NO: 438461 - RNA, 22 nt, Human
cagagaacaacuugaaugacuu

SEQ ID NO: 438462 - RNA, 23 nt, Human
cagguccugaccccagucagaaa

SEQ ID NO: 438463 - RNA, 18 nt, Human
caugcaaaagaccaccau

SEQ ID NO: 438464 - RNA, 25 nt, Human
ccaauaccuugauuugauuuucagu

SEQ ID NO: 438465 - RNA, 20 nt, Human
ccagaaccugccacaggaac

SEQ ID NO: 438466 - RNA, 22 nt, Human
ccccaaagcuggagggagaugg

SEQ ID NO: 438467 - RNA, 24 nt, Human
ccccaucucuucuccuuguaccug

SEQ ID NO: 438468 - RNA, 20 nt, Human
cccccuucccaccaucccuc

SEQ ID NO: 438469 - RNA, 22 nt, Human
ccccuucccaccaucccucggc

SEQ ID NO: 438470 - RNA, 19 nt, Human
cccuccuguggaaucgagg

SEQ ID NO: 438471 - RNA, 20 nt, Human
ccuggccaaaugccauuuga

SEQ ID NO: 438472 - RNA, 25 nt, Human
ccuggccaaaugccauuugauuuug

SEQ ID NO: 438473 - RNA, 24 nt, Human
ccuggcucggccccaacagggagc

SEQ ID NO: 438474 - RNA, 21 nt, Human
ccuugauuugauuuucaguuu

SEQ ID NO: 438475 - RNA, 19 nt, Human
cucacccucugccaggagc

SEQ ID NO: 438476 - RNA, 20 nt, Human
cucccagaaccugccacagg

SEQ ID NO: 438477 - RNA, 24 nt, Human
cucccagaaccugccacaggaaac

SEQ ID NO: 438478 - RNA, 19 nt, Human
cuugaggaagaugagggaa

SEQ ID NO: 438479 - RNA, 19 nt, Human
gaaacccacaugugacccu

SEQ ID NO: 438480 - RNA, 19 nt, Human
gagggaagcccuccccucu

SEQ ID NO: 438481 - RNA, 19 nt, Human
gagggagagaggacuuaag

SEQ ID NO: 438482 - RNA, 22 nt, Human
gauagaguucccugaaaacucc

SEQ ID NO: 438483 - RNA, 19 nt, Human
gcaaaagaccaccauccuc

SEQ ID NO: 438484 - RNA, 18 nt, Human
gccuucuaggcuucaucc

SEQ ID NO: 438485 - RNA, 19 nt, Human
ggagagcucagccaacaga

SEQ ID NO: 438486 - RNA, 18 nt, Human
gggccucucuccuacuuu

SEQ ID NO: 438487 - RNA, 18 nt, Human
guccccaucucuucuccu

SEQ ID NO: 438488 - RNA, 19 nt, Human
guggaacaguucuugcucu

SEQ ID NO: 438489 - RNA, 20 nt, Human
guggagggagagaggacuuu

SEQ ID NO: 438490 - RNA, 19 nt, Human
guguucuuagccuccaccc

SEQ ID NO: 438491 - RNA, 22 nt, Human
guguucuuagccuccacccucc

SEQ ID NO: 438492 - RNA, 18 nt, Human
uaccugucaacaccagag

SEQ ID NO: 438493 - RNA, 23 nt, Human
uaccugucaacaccagaguucag

SEQ ID NO: 438494 - RNA, 21 nt, Human
uaccuugauuugauuuucagu

SEQ ID NO: 438495 - RNA, 26 nt, Human
uaccuugauuugauuuucaguuucau

SEQ ID NO: 438496 - RNA, 20 nt, Human
uagaguucccugaaaacucc

SEQ ID NO: 438497 - RNA, 20 nt, Human
uaggaaaaugaaucauuugg

SEQ ID NO: 438498 - RNA, 19 nt, Human
uaggaagaaaccaccagcu

SEQ ID NO: 438499 - RNA, 22 nt, Human
uaguccccaucucuucuccuug

SEQ ID NO: 438500 - RNA, 20 nt, Human
ucaaugaaaugaguagccca

SEQ ID NO: 438501 - RNA, 19 nt, Human
uccacacugcuccuggcua

SEQ ID NO: 438502 - RNA, 19 nt, Human
ucccagaaccugccacagg

SEQ ID NO: 438503 - RNA, 22 nt, Human
ucccucggcaagcucaccaccu

SEQ ID NO: 438504 - RNA, 19 nt, Human
uccugggcacccacucaag

SEQ ID NO: 438505 - RNA, 19 nt, Human
ucuaggcuucaucccagaa

SEQ ID NO: 438506 - RNA, 21 nt, Human
ucuggagaccccaaagcugga

SEQ ID NO: 438507 - RNA, 20 nt, Human
ucugggcugugcucaguguu

SEQ ID NO: 438508 - RNA, 18 nt, Human
ugaagaggcaaggaaagg

SEQ ID NO: 438509 - RNA, 25 nt, Human
ugaguaggugguucauauuguaaua

SEQ ID NO: 438510 - RNA, 20 nt, Human
ugauauuguguggucuuccc

SEQ ID NO: 438511 - RNA, 21 nt, Human
ugauauuguguggucuucccu

SEQ ID NO: 438512 - RNA, 21 nt, Human
ugaugauauguacaguggcac

SEQ ID NO: 438513 - RNA, 19 nt, Human
ugcaggggccucuggagug

SEQ ID NO: 438514 - RNA, 18 nt, Human
ugcaguggccccaacuag

SEQ ID NO: 438515 - RNA, 18 nt, Human
ugccuucuaggcuucauc

SEQ ID NO: 438516 - RNA, 20 nt, Human
ugccuucuaggcuucauccc

SEQ ID NO: 438517 - RNA, 22 nt, Human
ugcucuuuuuaucaccuucugg

SEQ ID NO: 438518 - RNA, 18 nt, Human
uggcacaccuuaaccagu

SEQ ID NO: 438519 - RNA, 20 nt, Human
uggcuaaccccagcaauaac

SEQ ID NO: 438520 - RNA, 23 nt, Human
uggcuaaccccagcaauaaccaa

SEQ ID NO: 438521 - RNA, 22 nt, Human
ugggcacccacucaagagugcu

SEQ ID NO: 438522 - RNA, 18 nt, Human
ugguaggaagccccaucu

SEQ ID NO: 438523 - RNA, 25 nt, Human
ugucuuuggccucagagaacaacuu

SEQ ID NO: 438524 - RNA, 21 nt, Human
ugugcuaaaaccagggaagca

SEQ ID NO: 438525 - RNA, 23 nt, Human
uguggacuaggaccagguccuga

SEQ ID NO: 438526 - RNA, 21 nt, Human
uucauaguccccaucucuucu

SEQ ID NO: 438527 - RNA, 25 nt, Human
uuuccagaagaauaaugaaaaguuc

SEQ ID NO: 438528 - RNA, 24 nt, Human
uuuccuggcauaaauuauuccugg

SEQ ID NO: 438529 - RNA, 18 nt, Human
uuuuguguguuuucugug

SEQ ID NO: 438530 - RNA, 26 nt, Human
aacuuucccugaaggcaccuccacca

SEQ ID NO: 438531 - RNA, 19 nt, Human
aagccggcugacauggugc

SEQ ID NO: 438532 - RNA, 21 nt, Human
acagaacaaugaauuuauuac

SEQ ID NO: 438533 - RNA, 27 nt, Human
acaucacauauucaugcauaaaccaau

SEQ ID NO: 438534 - RNA, 24 nt, Human
accauaccuaacauaaacuaauua

SEQ ID NO: 438535 - RNA, 18 nt, Human
acuaagcacuuggcuucc

SEQ ID NO: 438536 - RNA, 18 nt, Human
aggcaccuccaccaaaag

SEQ ID NO: 438537 - RNA, 18 nt, Human
caaccucaccaaaaaggg

SEQ ID NO: 438538 - RNA, 23 nt, Human
caagauaagaggggcucugcuaa

SEQ ID NO: 438539 - RNA, 22 nt, Human
caagccggcugacauggugcca

SEQ ID NO: 438540 - RNA, 19 nt, Human
caccaaaagauuuuucuuc

SEQ ID NO: 438541 - RNA, 18 nt, Human
cagcgcaacaagaagaca

SEQ ID NO: 438542 - RNA, 19 nt, Human
ccugaaggcaccuccacca

SEQ ID NO: 438543 - RNA, 21 nt, Human
ccugaaggcaccuccaccaaa

SEQ ID NO: 438544 - RNA, 22 nt, Human
cugaagagugagggugaagaaa

SEQ ID NO: 438545 - RNA, 24 nt, Human
cuucuugaacugaagagugagggu

SEQ ID NO: 438546 - RNA, 22 nt, Human
cuucuuugacaucacuaagcac

SEQ ID NO: 438547 - RNA, 25 nt, Human
gaagaaaacuuucccugaaggcacc

SEQ ID NO: 438548 - RNA, 19 nt, Human
gaaggcaccuccaccaaaa

SEQ ID NO: 438549 - RNA, 20 nt, Human
gagguaggguggcuccagga

SEQ ID NO: 438550 - RNA, 22 nt, Human
uaccagugguucugaaauucuu

SEQ ID NO: 438551 - RNA, 18 nt, Human
uagggagauccuuucccu

SEQ ID NO: 438552 - RNA, 21 nt, Human
ucacuaagcacuuggcuucca

SEQ ID NO: 438553 - RNA, 21 nt, Human
ucaugcauaaaccaaucacug

SEQ ID NO: 438554 - RNA, 19 nt, Human
ucccugaaggcaccuccac

SEQ ID NO: 438555 - RNA, 25 nt, Human
uccuguggagagcugcaggcuuucu

SEQ ID NO: 438556 - RNA, 22 nt, Human
ucucugagcuagggagauccuu

SEQ ID NO: 438557 - RNA, 19 nt, Human
ucucuggauaccagugguu

SEQ ID NO: 438558 - RNA, 25 nt, Human
ucuucaagauucacuggacaaaaau

SEQ ID NO: 438559 - RNA, 19 nt, Human
ugagcuagggagauccuuu

SEQ ID NO: 438560 - RNA, 19 nt, Human
ugagguaggguggcuccag

SEQ ID NO: 438561 - RNA, 20 nt, Human
ugagguaggguggcuccagg

SEQ ID NO: 438562 - RNA, 21 nt, Human
ugcaaaggggaaucaaauuac

SEQ ID NO: 438563 - RNA, 23 nt, Human
uggaguucucaagauaagagggg

SEQ ID NO: 438564 - RNA, 25 nt, Human
uggcuuccauccaucuuccaaccuc

SEQ ID NO: 438565 - RNA, 22 nt, Human
ugguucugaaauucuucaaauu

SEQ ID NO: 438566 - RNA, 23 nt, Human
uuccaaccucaccaaaaaggguu

SEQ ID NO: 438567 - RNA, 22 nt, Human
uuccauccaucuuccaaccuca

SEQ ID NO: 438568 - RNA, 23 nt, Human
uucuucaaauucacccuugaaca

SEQ ID NO: 438569 - RNA, 22 nt, Human
acaucuacucauucucuguaac

SEQ ID NO: 438570 - RNA, 22 nt, Human
acaugguuugauuaucacuugg

SEQ ID NO: 438571 - RNA, 18 nt, Human
acugacaauuccaccuuu

SEQ ID NO: 438572 - RNA, 24 nt, Human
uaaaucagguagcuucagaaauca

SEQ ID NO: 438573 - RNA, 26 nt, Human
uauaauagagcuauuaaccgaugaga

SEQ ID NO: 438574 - RNA, 19 nt, Human
ucagguagcuucagaaauc

SEQ ID NO: 438575 - RNA, 23 nt, Human
ucagguagcuucagaaaucaacu

SEQ ID NO: 438576 - RNA, 22 nt, Human
aaacaagaaugaaauuauagga

SEQ ID NO: 438577 - RNA, 23 nt, Human
aaaguccccagaaaugguaaaga

SEQ ID NO: 438578 - RNA, 24 nt, Human
aaaguccccagaaaugguaaagag

SEQ ID NO: 438579 - RNA, 21 nt, Human
aaaugggcucuuuuaaggcga

SEQ ID NO: 438580 - RNA, 19 nt, Human
aaccagaagcagcagcucc

SEQ ID NO: 438581 - RNA, 24 nt, Human
aagaaugaaauuauaggaaaaaaa

SEQ ID NO: 438582 - RNA, 19 nt, Human
aagaggaaaggaguaagaa

SEQ ID NO: 438583 - RNA, 22 nt, Human
aagcagcagcuccgagcuccga

SEQ ID NO: 438584 - RNA, 25 nt, Human
acuagagugagggacccugaacuuc

SEQ ID NO: 438585 - RNA, 18 nt, Human
agaaccagaagcagcagc

SEQ ID NO: 438586 - RNA, 19 nt, Human
agagugugugguucaggug

SEQ ID NO: 438587 - RNA, 22 nt, Human
agcccaaggcagccggacagcg

SEQ ID NO: 438588 - RNA, 28 nt, Human
agcccaaggcagccggacagcgacgggg

SEQ ID NO: 438589 - RNA, 21 nt, Human
agcgacgguggccacaagaga

SEQ ID NO: 438590 - RNA, 18 nt, Human
aggaaaaaaaucaagagg

SEQ ID NO: 438591 - RNA, 19 nt, Human
aggaaaaaaaucaagagga

SEQ ID NO: 438592 - RNA, 18 nt, Human
aggaagggcuauacuaua

SEQ ID NO: 438593 - RNA, 20 nt, Human
aggcagccggacagcgacgg

SEQ ID NO: 438594 - RNA, 19 nt, Human
auaaauccuagaggacaaa

SEQ ID NO: 438595 - RNA, 20 nt, Human
aucaccuuucugggcugggg

SEQ ID NO: 438596 - RNA, 18 nt, Human
aucuaaagagccaugaag

SEQ ID NO: 438597 - RNA, 22 nt, Human
caagagaaccagaagcagcagc

SEQ ID NO: 438598 - RNA, 19 nt, Human
cacaagagaaccagaagca

SEQ ID NO: 438599 - RNA, 23 nt, Human
cacaagagaaccagaagcagcag

SEQ ID NO: 438600 - RNA, 19 nt, Human
cagcuccgagcuccgaccu

SEQ ID NO: 438601 - RNA, 26 nt, Human
caggaaacagggcuuggaacuucuaa

SEQ ID NO: 438602 - RNA, 18 nt, Human
cccgccucuuucccccuc

SEQ ID NO: 438603 - RNA, 20 nt, Human
ccgcgccgccaccuccgcug

SEQ ID NO: 438604 - RNA, 21 nt, Human
ccgcgccgccaccuccgcugu

SEQ ID NO: 438605 - RNA, 21 nt, Human
ccggacagcgacgguggccac

SEQ ID NO: 438606 - RNA, 22 nt, Human
ccggccccugcgucgagcugcg

SEQ ID NO: 438607 - RNA, 19 nt, Human
cgaggguagagggcgguga

SEQ ID NO: 438608 - RNA, 21 nt, Human
cgcaaacacgcacgcaaagcg

SEQ ID NO: 438609 - RNA, 23 nt, Human
cggacagcgacgguggccacaag

SEQ ID NO: 438610 - RNA, 18 nt, Human
cuccgaccugcccgcgcc

SEQ ID NO: 438611 - RNA, 28 nt, Human
cuccugaucuuaacaagccaugcucauu

SEQ ID NO: 438612 - RNA, 21 nt, Human
cugacccgccgcccccgccuc

SEQ ID NO: 438613 - RNA, 22 nt, Human
gacaacagaaauaaauccuaga

SEQ ID NO: 438614 - RNA, 20 nt, Human
gcaaacacgcacgcaaagcg

SEQ ID NO: 438615 - RNA, 22 nt, Human
gccacaagagaaccagaagcag

SEQ ID NO: 438616 - RNA, 24 nt, Human
gccacaagagaaccagaagcagca

SEQ ID NO: 438617 - RNA, 20 nt, Human
gcccacccuccugccggccc

SEQ ID NO: 438618 - RNA, 25 nt, Human
ggacaacagaaauaaauccuagagg

SEQ ID NO: 438619 - RNA, 19 nt, Human
gggcugggggaguaaaauc

SEQ ID NO: 438620 - RNA, 24 nt, Human
guaaaauccuucuuuagugacuag

SEQ ID NO: 438621 - RNA, 22 nt, Human
uaaaaguuaucuuaaaaaauau

SEQ ID NO: 438622 - RNA, 18 nt, Human
uaaagagaagaaucaccu

SEQ ID NO: 438623 - RNA, 20 nt, Human
uaacaugcaccacccacauc

SEQ ID NO: 438624 - RNA, 24 nt, Human
uaacaugcaccacccacaucuaac

SEQ ID NO: 438625 - RNA, 26 nt, Human
uaacaugcaccacccacaucuaaccu

SEQ ID NO: 438626 - RNA, 20 nt, Human
uaagaagaaaauaaaaguua

SEQ ID NO: 438627 - RNA, 27 nt, Human
uacacaucucugaacuggacauaccac

SEQ ID NO: 438628 - RNA, 19 nt, Human
uaccaccuuuacgcaggaa

SEQ ID NO: 438629 - RNA, 19 nt, Human
uacuauaaauccaaguggg

SEQ ID NO: 438630 - RNA, 19 nt, Human
uaggaaaaaaaucaagagg

SEQ ID NO: 438631 - RNA, 22 nt, Human
uaggaaaaaaaucaagaggaaa

SEQ ID NO: 438632 - RNA, 21 nt, Human
uccccagaaaugguaaagaga

SEQ ID NO: 438633 - RNA, 20 nt, Human
ucuaaccuaccugccgggua

SEQ ID NO: 438634 - RNA, 20 nt, Human
ucuguucggcagcccaaggc

SEQ ID NO: 438635 - RNA, 22 nt, Human
ugaaagagcacugauuucagca

SEQ ID NO: 438636 - RNA, 19 nt, Human
ugaagaagugaaagagcac

SEQ ID NO: 438637 - RNA, 21 nt, Human
ugaagcaaguuccuguguggu

SEQ ID NO: 438638 - RNA, 18 nt, Human
ugacuagagugagggacc

SEQ ID NO: 438639 - RNA, 21 nt, Human
ugagaugaaaaaacaagaaug

SEQ ID NO: 438640 - RNA, 21 nt, Human
ugagcaagucuggugggagug

SEQ ID NO: 438641 - RNA, 19 nt, Human
ugcaccacccacaucuaac

SEQ ID NO: 438642 - RNA, 21 nt, Human
ugcccgcgccgccaccuccgc

SEQ ID NO: 438643 - RNA, 25 nt, Human
uggaacuucuaagggaaauuaacau

SEQ ID NO: 438644 - RNA, 25 nt, Human
uggcccacgccuugucuguucggca

SEQ ID NO: 438645 - RNA, 24 nt, Human
ugguucagguggacugguccuugg

SEQ ID NO: 438646 - RNA, 20 nt, Human
uguacgcaaacacgcacgca

SEQ ID NO: 438647 - RNA, 22 nt, Human
uuauaggaaaaaaaucaagagg

SEQ ID NO: 438648 - RNA, 28 nt, Human
uuucugggcugggggaguaaaauccuuc

SEQ ID NO: 438649 - RNA, 30 nt, Human
uuuuuuggacaacagaaauaaauccuaggg

SEQ ID NO: 438650 - RNA, 18 nt, Human
uuuuuuuuuuuuuuuuug

SEQ ID NO: 438651 - RNA, 23 nt, Human
aaacuuauuuccccucaacccua

SEQ ID NO: 438652 - RNA, 21 nt, Human
aacuuauuuccccucaacccu

SEQ ID NO: 438653 - RNA, 21 nt, Human
aagagcccagcccugucaagc

SEQ ID NO: 438654 - RNA, 25 nt, Human
acauaacagaaguauuugagguacc

SEQ ID NO: 438655 - RNA, 23 nt, Human
acccuauacccaaagaagaaaua

SEQ ID NO: 438656 - RNA, 24 nt, Human
agcaaagccauaaggaagcccagg

SEQ ID NO: 438657 - RNA, 23 nt, Human
agcauagcccguugaccucccca

SEQ ID NO: 438658 - RNA, 18 nt, Human
aggcagagacuaaaggac

SEQ ID NO: 438659 - RNA, 22 nt, Human
caacccuauacccaaagaagaa

SEQ ID NO: 438660 - RNA, 21 nt, Human
cagacaccuaaguaggaaucc

SEQ ID NO: 438661 - RNA, 18 nt, Human
ccagugggaagcaaagcc

SEQ ID NO: 438662 - RNA, 26 nt, Human
cccaaagaagaaauaaaaucacagau

SEQ ID NO: 438663 - RNA, 19 nt, Human
ccccugagggcagacaccu

SEQ ID NO: 438664 - RNA, 20 nt, Human
cccucaacccuauacccaaa

SEQ ID NO: 438665 - RNA, 19 nt, Human
cucaggcagagacuaaagg

SEQ ID NO: 438666 - RNA, 23 nt, Human
cucaggcagagacuaaaggacau

SEQ ID NO: 438667 - RNA, 19 nt, Human
cuccccaaacacuacaccu

SEQ ID NO: 438668 - RNA, 27 nt, Human
cucucauauaugcaaacaaaugcagac

SEQ ID NO: 438669 - RNA, 23 nt, Human
gaccccugagggcagacaccuaa

SEQ ID NO: 438670 - RNA, 19 nt, Human
uaaaaucacagauacauaa

SEQ ID NO: 438671 - RNA, 26 nt, Human
uaaaaucacagauacauaacagaagu

SEQ ID NO: 438672 - RNA, 19 nt, Human
ucccagugggaagcaaagc

SEQ ID NO: 438673 - RNA, 21 nt, Human
uccugaagugauuuggacccc

SEQ ID NO: 438674 - RNA, 23 nt, Human
uccugaagugauuuggaccccug

SEQ ID NO: 438675 - RNA, 18 nt, Human
uccuugugaucaggaagu

SEQ ID NO: 438676 - RNA, 21 nt, Human
ugaccuccccaaacacuacac

SEQ ID NO: 438677 - RNA, 22 nt, Human
ugaccuccccaaacacuacacc

SEQ ID NO: 438678 - RNA, 23 nt, Human
ugcaaacaaaugcagacuaggcc

SEQ ID NO: 438679 - RNA, 21 nt, Human
uggaccccugagggcagacac

SEQ ID NO: 438680 - RNA, 21 nt, Human
uucagcuaaaacguuuauuuc

SEQ ID NO: 438681 - RNA, 19 nt, Human
uuccuugugaucaggaagu

SEQ ID NO: 438682 - RNA, 22 nt, Human
uugggguguccugaagugauuu

SEQ ID NO: 438683 - RNA, 21 nt, Human
aacacuccucucaagggaaua

SEQ ID NO: 438684 - RNA, 19 nt, Human
aauccuaacccuccuaccc

SEQ ID NO: 438685 - RNA, 19 nt, Human
acccccagcccugucucca

SEQ ID NO: 438686 - RNA, 21 nt, Human
acccccagcccugucuccacc

SEQ ID NO: 438687 - RNA, 21 nt, Human
agagguggggagacagaccaa

SEQ ID NO: 438688 - RNA, 18 nt, Human
aggaagugggguugggga

SEQ ID NO: 438689 - RNA, 18 nt, Human
aggaggaggaggggcagg

SEQ ID NO: 438690 - RNA, 18 nt, Human
aggaggaggaggggcagg

SEQ ID NO: 438691 - RNA, 18 nt, Human
aggcagaggaaguggggu

SEQ ID NO: 438692 - RNA, 20 nt, Human
aggcuagaaggggaugggga

SEQ ID NO: 438693 - RNA, 24 nt, Human
agggaccgcaguguggcaggaggg

SEQ ID NO: 438694 - RNA, 19 nt, Human
aggggauggggaugugagg

SEQ ID NO: 438695 - RNA, 25 nt, Human
aggggcaggcagaggaagugggguu

SEQ ID NO: 438696 - RNA, 18 nt, Human
agggggaagaggaagggc

SEQ ID NO: 438697 - RNA, 18 nt, Human
agggugcuaggaaaggcu

SEQ ID NO: 438698 - RNA, 30 nt, Human
auguugagccuguggacaaggguagggauu

SEQ ID NO: 438699 - RNA, 24 nt, Human
caacugcuagguggaggagacaac

SEQ ID NO: 438700 - RNA, 22 nt, Human
ccaaccaacugcuagguggagg

SEQ ID NO: 438701 - RNA, 24 nt, Human
cccaucaucccuuuucccuucaaa

SEQ ID NO: 438702 - RNA, 24 nt, Human
cccaucaucccuuuucccuucaaa

SEQ ID NO: 438703 - RNA, 23 nt, Human
ccccuucaaucccaucaucccuu

SEQ ID NO: 438704 - RNA, 23 nt, Human
ccccuucaaucccaucaucccuu

SEQ ID NO: 438705 - RNA, 22 nt, Human
cccuccuacccccagcccuguc

SEQ ID NO: 438706 - RNA, 24 nt, Human
cccuccuacccccagcccugucuc

SEQ ID NO: 438707 - RNA, 20 nt, Human
cccugucuccaccgccuaca

SEQ ID NO: 438708 - RNA, 21 nt, Human
ccuacaguuucccccucaccu

SEQ ID NO: 438709 - RNA, 21 nt, Human
ccuccuacccccagcccuguc

SEQ ID NO: 438710 - RNA, 19 nt, Human
ccuucaaucccaucauccc

SEQ ID NO: 438711 - RNA, 19 nt, Human
cgggaaagggaccgcagug

SEQ ID NO: 438712 - RNA, 20 nt, Human
cuaggaauugcuuguugauc

SEQ ID NO: 438713 - RNA, 18 nt, Human
cugcugggccuucagcag

SEQ ID NO: 438714 - RNA, 19 nt, Human
cuggaggccucugucugca

SEQ ID NO: 438715 - RNA, 19 nt, Human
cuuguggaaauccuaaccc

SEQ ID NO: 438716 - RNA, 23 nt, Human
cuuuuuaucucugcuguuccugc

SEQ ID NO: 438717 - RNA, 23 nt, Human
gaagccccuucaaucccaucauc

SEQ ID NO: 438718 - RNA, 24 nt, Human
gaagccccuucaaucccaucaucc

SEQ ID NO: 438719 - RNA, 19 nt, Human
gaaggaggaggaggggcag

SEQ ID NO: 438720 - RNA, 18 nt, Human
gaggaggggcaggcagag

SEQ ID NO: 438721 - RNA, 18 nt, Human
gaucuggaggagggggua

SEQ ID NO: 438722 - RNA, 18 nt, Human
gaucuggaggagggggua

SEQ ID NO: 438723 - RNA, 18 nt, Human
gccuacaguuucccccuc

SEQ ID NO: 438724 - RNA, 22 nt, Human
ggaaagggaccgcaguguggca

SEQ ID NO: 438725 - RNA, 18 nt, Human
ggaagugggguuggggag

SEQ ID NO: 438726 - RNA, 21 nt, Human
ggcaggcagaggaaguggggu

SEQ ID NO: 438727 - RNA, 25 nt, Human
ggcaggcagaggaagugggguuggg

SEQ ID NO: 438728 - RNA, 23 nt, Human
ggcagggguuggaguuucugggg

SEQ ID NO: 438729 - RNA, 24 nt, Human
gggaagaggaagggcagggguugg

SEQ ID NO: 438730 - RNA, 18 nt, Human
gggcagggguuggaguuu

SEQ ID NO: 438731 - RNA, 24 nt, Human
gggcagggguuggaguuucugggg

SEQ ID NO: 438732 - RNA, 19 nt, Human
ggggauggggaugugaggg

SEQ ID NO: 438733 - RNA, 24 nt, Human
ggugaggggagagagcagaaggga

SEQ ID NO: 438734 - RNA, 24 nt, Human
guggaaggaggaggaggggcaggc

SEQ ID NO: 438735 - RNA, 26 nt, Human
uaacccuccuacccccagcccugucu

SEQ ID NO: 438736 - RNA, 20 nt, Human
uacccccagcccugucucca

SEQ ID NO: 438737 - RNA, 21 nt, Human
uagaagccccuucaaucccau

SEQ ID NO: 438738 - RNA, 21 nt, Human
uagaagccccuucaaucccau

SEQ ID NO: 438739 - RNA, 22 nt, Human
uaggaaaggcuagaaggggaug

SEQ ID NO: 438740 - RNA, 21 nt, Human
uagguggaggagacaacgugg

SEQ ID NO: 438741 - RNA, 23 nt, Human
ucccuuuucccuucaaaucaggg

SEQ ID NO: 438742 - RNA, 24 nt, Human
ucccuuuucccuucaaaucagggc

SEQ ID NO: 438743 - RNA, 20 nt, Human
ucucgcuuuuuccucauaca

SEQ ID NO: 438744 - RNA, 18 nt, Human
ucucugcuguuccugccu

SEQ ID NO: 438745 - RNA, 26 nt, Human
ucucugggugaggggagagagcaacg

SEQ ID NO: 438746 - RNA, 22 nt, Human
ucuggggaccaggacuauggau

SEQ ID NO: 438747 - RNA, 18 nt, Human
ugagagaggcaggcccgg

SEQ ID NO: 438748 - RNA, 23 nt, Human
ugaggggagagagcagaagggau

SEQ ID NO: 438749 - RNA, 24 nt, Human
ugccuuguucuuguggaaauccua

SEQ ID NO: 438750 - RNA, 22 nt, Human
ugcugagagaggcaggcccggg

SEQ ID NO: 438751 - RNA, 19 nt, Human
uggaaauccuaacccuccu

SEQ ID NO: 438752 - RNA, 18 nt, Human
uggaaggaggaggagggg

SEQ ID NO: 438753 - RNA, 23 nt, Human
uggaaggaggaggaggggcaggc

SEQ ID NO: 438754 - RNA, 22 nt, Human
uggaagggggaagaggaagggc

SEQ ID NO: 438755 - RNA, 22 nt, Human
uggcuuacaauuuugucuucug

SEQ ID NO: 438756 - RNA, 22 nt, Human
uggcuuacaauuuugucuucug

SEQ ID NO: 438757 - RNA, 25 nt, Human
ugggccuucagcaguccgaaagcuu

SEQ ID NO: 438758 - RNA, 22 nt, Human
ugggggaggagaaaacagguaa

SEQ ID NO: 438759 - RNA, 18 nt, Human
ugucugcaggcucuccuu

SEQ ID NO: 438760 - RNA, 22 nt, Human
uguugagccuguggacaagggu

SEQ ID NO: 438761 - RNA, 20 nt, Human
uuagaagccccuucaauccc

SEQ ID NO: 438762 - RNA, 20 nt, Human
uuagaagccccuucaauccc

SEQ ID NO: 438763 - RNA, 21 nt, Human
uugagaugggaagaggcacag

SEQ ID NO: 438764 - RNA, 19 nt, Human
uuuccuuuucucucgcuuu

SEQ ID NO: 438765 - RNA, 28 nt, Human
uuuccuuuucucucgcuuuuuccucaua

SEQ ID NO: 438766 - RNA, 18 nt, Human
acaaaagccuuacucuau

SEQ ID NO: 438767 - RNA, 20 nt, Human
auuacaaauggugcucauuu

SEQ ID NO: 438768 - RNA, 18 nt, Human
caacugugacauuaugca

SEQ ID NO: 438769 - RNA, 24 nt, Human
caucuaggaaaaguuucacaugau

SEQ ID NO: 438770 - RNA, 21 nt, Human
ccaaaauaaaaauccaagguc

SEQ ID NO: 438771 - RNA, 25 nt, Human
ccaaaauaaaaauccaagguccaau

SEQ ID NO: 438772 - RNA, 20 nt, Human
ccccuucccucucagguccc

SEQ ID NO: 438773 - RNA, 20 nt, Human
ccccuucccucucagguccc

SEQ ID NO: 438774 - RNA, 22 nt, Human
ccuuugacuuuaacauauuucu

SEQ ID NO: 438775 - RNA, 18 nt, Human
cucccccacugccaaugc

SEQ ID NO: 438776 - RNA, 18 nt, Human
gggggugcugaugccacc

SEQ ID NO: 438777 - RNA, 27 nt, Human
uaggaaaaguuucacaugauuaaauca

SEQ ID NO: 438778 - RNA, 18 nt, Human
uaucaguaaugacuuugg

SEQ ID NO: 438779 - RNA, 23 nt, Human
uccccaugguggccuagguucau

SEQ ID NO: 438780 - RNA, 19 nt, Human
ucuguccccuucccucuca

SEQ ID NO: 438781 - RNA, 23 nt, Human
ugagaaacaucuguccccuuccc

SEQ ID NO: 438782 - RNA, 19 nt, Human
ugagggugaguucuuuugg

SEQ ID NO: 438783 - RNA, 23 nt, Human
ugcugaugccaccaaguuccuuu

SEQ ID NO: 438784 - RNA, 23 nt, Human
uguccccuucccucucagguccc

SEQ ID NO: 438785 - RNA, 25 nt, Human
uguccccuucccucucaggucccca

SEQ ID NO: 438786 - RNA, 27 nt, Human
uucaugaaauugacaucauuauuacaa

SEQ ID NO: 438787 - RNA, 26 nt, Human
uucaugauuacagccaccuuuaggau

SEQ ID NO: 438788 - RNA, 22 nt, Human
uuuaacauauuucucaaaaaga

SEQ ID NO: 438789 - RNA, 26 nt, Human
uuugucuuuauuagucagcauuugca

SEQ ID NO: 438790 - RNA, 30 nt, Human; identical to SEQ ID NO: 242631

SEQ ID NO: 438791 - RNA, 20 nt, Human
acgcagcacgggcagggggg

SEQ ID NO: 438792 - RNA, 20 nt, Human
agcaugacgcagcacgggca

SEQ ID NO: 438793 - RNA, 21 nt, Human
ccuuccccgcugcucccuuuc

SEQ ID NO: 438794 - RNA, 20 nt, Human
cgcugcucccuuucggcaac

SEQ ID NO: 438795 - RNA, 22 nt, Human
cggcaacuccuagcaccucggu

SEQ ID NO: 438796 - RNA, 20 nt, Human
cuggcagcugcagcaguggg

SEQ ID NO: 438797 - RNA, 20 nt, Human
gagcuagcgccauuuuccuc

SEQ ID NO: 438798 - RNA, 21 nt, Human
gcagcugcagcagugggcuug

SEQ ID NO: 438799 - RNA, 23 nt, Human
ggcuuggcagguaaggcagggcc

SEQ ID NO: 438800 - RNA, 21 nt, Human
uagcuuccgagcuagcgccuc

SEQ ID NO: 438801 - RNA, 18 nt, Human
uauauacacagaagcaug

SEQ ID NO: 438802 - RNA, 23 nt, Human
ugagagauaaauaaaggccuuua

SEQ ID NO: 438803 - RNA, 24 nt, Human
uggcagguaaggcagggccaagug

SEQ ID NO: 438804 - RNA, 20 nt, Human
uuccccgcugcucccuuucg

SEQ ID NO: 438805 - RNA, 18 nt, Human
uuuuuuuuuuuuuuuuug

SEQ ID NO: 438806 - RNA, 20 nt, Human
aaacaaaugccauacaaugu

SEQ ID NO: 438807 - RNA, 21 nt, Human
aaacaaaugccauacaaugug

SEQ ID NO: 438808 - RNA, 19 nt, Human
aacucgucuuuccaacucu

SEQ ID NO: 438809 - RNA, 22 nt, Human
aagccucacucuucugauugcc

SEQ ID NO: 438810 - RNA, 23 nt, Human
acaaaguuuugcauucaucacca

SEQ ID NO: 438811 - RNA, 20 nt, Human
acacauaaauuugugcugcc

SEQ ID NO: 438812 - RNA, 21 nt, Human
agccucacucuucugauugcc

SEQ ID NO: 438813 - RNA, 19 nt, Human
augcuagacuaauacugug

SEQ ID NO: 438814 - RNA, 23 nt, Human
cuaacggguuaacuccgucguac

SEQ ID NO: 438815 - RNA, 22 nt, Human
cugccuccaacagcaaugauuc

SEQ ID NO: 438816 - RNA, 20 nt, Human
gccucacucuucugauugcc

SEQ ID NO: 438817 - RNA, 21 nt, Human
uacaaaaguuugaaaaaagaa

SEQ ID NO: 438818 - RNA, 23 nt, Human
uaucaccaaguauauccucuaaa

SEQ ID NO: 438819 - RNA, 22 nt, Human
ucaacagagaucaucuaaugca

SEQ ID NO: 438820 - RNA, 28 nt, Human
ucuucugauugccauuauaauaagugau

SEQ ID NO: 438821 - RNA, 18 nt, Human
ugaaaaaagaagccucac

SEQ ID NO: 438822 - RNA, 18 nt, Human
ugaaaaaagaagccucac

SEQ ID NO: 438823 - RNA, 20 nt, Human
ugcauucaucaccacuaccc

SEQ ID NO: 438824 - RNA, 24 nt, Human
ugcauuuuucauucaauaaauguu

SEQ ID NO: 438825 - RNA, 20 nt, Human
ugccuccaacagcaaugauu

SEQ ID NO: 438826 - RNA, 23 nt, Human
uucacauuaucaccaaguauauc

SEQ ID NO: 438827 - RNA, 22 nt, Human
uucaucaccacuacccaguucc

SEQ ID NO: 438828 - RNA, 19 nt, Human
uugaauuuguaaaguuauc

SEQ ID NO: 438829 - RNA, 20 nt, Human
uuuaaacuacuguuguaaca

SEQ ID NO: 438830 - RNA, 22 nt, Human
aaaacagccagacaccaaagga

SEQ ID NO: 438831 - RNA, 22 nt, Human
aaagggcccauaugaaacaaac

SEQ ID NO: 438832 - RNA, 19 nt, Human
aacacaccacuuacugaca

SEQ ID NO: 438833 - RNA, 18 nt, Human
aacauuguguuaaggaau

SEQ ID NO: 438834 - RNA, 20 nt, Human
aagagaacccaaacuucacu

SEQ ID NO: 438835 - RNA, 22 nt, Human
aaugcaaggaaacacaguuuug

SEQ ID NO: 438836 - RNA, 22 nt, Human
acaaaacagccagacaccaaag

SEQ ID NO: 438837 - RNA, 18 nt, Human
acaaaagagaacccaaac

SEQ ID NO: 438838 - RNA, 26 nt, Human
agaaaaaaaaaaaaauucaugcaaag

SEQ ID NO: 438839 - RNA, 22 nt, Human
aggaaggugugacuggggguua

SEQ ID NO: 438840 - RNA, 25 nt, Human
agguggugguugguggggggcggug

SEQ ID NO: 438841 - RNA, 18 nt, Human
auguacaaggcauugugu

SEQ ID NO: 438842 - RNA, 26 nt, Human
auuuauaauugcugaaaugcaucacc

SEQ ID NO: 438843 - RNA, 19 nt, Human
caaaggaagaugcccaggg

SEQ ID NO: 438844 - RNA, 22 nt, Human
caacaaauacaugggugaccau

SEQ ID NO: 438845 - RNA, 19 nt, Human
caauucuaucccagaaaug

SEQ ID NO: 438846 - RNA, 18 nt, Human
cacacaggucuagcuggg

SEQ ID NO: 438847 - RNA, 19 nt, Human
caccaaaggaagaugccca

SEQ ID NO: 438848 - RNA, 22 nt, Human
cagacaccucucacacaggucu

SEQ ID NO: 438849 - RNA, 21 nt, Human
ccagacaccucucacacaggu

SEQ ID NO: 438850 - RNA, 21 nt, Human
ccauaaugacaguauuccaag

SEQ ID NO: 438851 - RNA, 21 nt, Human
ccaugcaugauuuccagacac

SEQ ID NO: 438852 - RNA, 23 nt, Human
ccaugcaugauuuccagacaccu

SEQ ID NO: 438853 - RNA, 21 nt, Human
ccccuaugccaggggccucca

SEQ ID NO: 438854 - RNA, 20 nt, Human
cccuaugccaggggccuccc

SEQ ID NO: 438855 - RNA, 23 nt, Human
ccucccacccacaucagguuugu

SEQ ID NO: 438856 - RNA, 21 nt, Human
cuuacugacaugccccuccca

SEQ ID NO: 438857 - RNA, 30 nt, Human
gaccauuuaaaaucaaaauuauaauuugaa

SEQ ID NO: 438858 - RNA, 25 nt, Human
gccccucccacccacaucagguuug

SEQ ID NO: 438859 - RNA, 18 nt, Human
gccuccauuggggaacag

SEQ ID NO: 438860 - RNA, 18 nt, Human
ggagaaccagaugaucag

SEQ ID NO: 438861 - RNA, 21 nt, Human
ggugguugguggggggcggug

SEQ ID NO: 438862 - RNA, 20 nt, Human
gguuacacaauuuaucagau

SEQ ID NO: 438863 - RNA, 24 nt, Human
uauccugucuuccauuuaauuuua

SEQ ID NO: 438864 - RNA, 24 nt, Human
uccuuaucugcacaaccauugaag

SEQ ID NO: 438865 - RNA, 24 nt, Human
ucucacacaggucuagcugggaag

SEQ ID NO: 438866 - RNA, 18 nt, Human
ucucuuagccauaaugac

SEQ ID NO: 438867 - RNA, 18 nt, Human
ucugcacaaccauugaag

SEQ ID NO: 438868 - RNA, 24 nt, Human
ugaaacaaacacauugaacacacc

SEQ ID NO: 438869 - RNA, 20 nt, Human
ugaaacaaacacauugaacc

SEQ ID NO: 438870 - RNA, 22 nt, Human
ugacaaaacagccagacaccaa

SEQ ID NO: 438871 - RNA, 27 nt, Human
ugacaaaacagccagacaccaaaggaa

SEQ ID NO: 438872 - RNA, 20 nt, Human
ugacugaguggaagaugcag

SEQ ID NO: 438873 - RNA, 23 nt, Human
ugaucagggucuagcaaggccug

SEQ ID NO: 438874 - RNA, 26 nt, Human
ugcaaacugaaacuaugcuuuuuugu

SEQ ID NO: 438875 - RNA, 22 nt, Human
ugcaugauacaaagugugcgug

SEQ ID NO: 438876 - RNA, 21 nt, Human
ugcugaaaugcaucaccaugu

SEQ ID NO: 438877 - RNA, 21 nt, Human
uggaaagggcccauaugaaac

SEQ ID NO: 438878 - RNA, 19 nt, Human
uggggaacaguauguaaga

SEQ ID NO: 438879 - RNA, 18 nt, Human
uguguuaaggaaugaacu

SEQ ID NO: 438880 - RNA, 20 nt, Human
uuaaugcaaggaaacacagu

SEQ ID NO: 438881 - RNA, 27 nt, Human
uucaagaaaaaaaaaugacuuaaaaaa

SEQ ID NO: 438882 - RNA, 22 nt, Human
uugcugaaaugcaucaccaugu

SEQ ID NO: 438883 - RNA, 24 nt, Human
uuuccauucuaacaaacaugcauu

SEQ ID NO: 438884 - RNA, 22 nt, Human
aaaagggacccuucuuccggga

SEQ ID NO: 438885 - RNA, 22 nt, Human
aaacaacagugacagaucagaa

SEQ ID NO: 438886 - RNA, 26 nt, Human
aagcagauuuccuuuaucucaaguuu

SEQ ID NO: 438887 - RNA, 24 nt, Human
aagcugccuggcucucgguggggc

SEQ ID NO: 438888 - RNA, 22 nt, Human
aagcugcuagcaccacgcugcc

SEQ ID NO: 438889 - RNA, 21 nt, Human
acccuguuccgcugaagcugc

SEQ ID NO: 438890 - RNA, 20 nt, Human
acccuucuuccgggaguggg

SEQ ID NO: 438891 - RNA, 25 nt, Human
acugcauuaugguggaagucuagga

SEQ ID NO: 438892 - RNA, 19 nt, Human
acuggagugcagaauucca

SEQ ID NO: 438893 - RNA, 18 nt, Human
aggaaggaggaagucacu

SEQ ID NO: 438894 - RNA, 20 nt, Human
auacugccaucagaggaagg

SEQ ID NO: 438895 - RNA, 24 nt, Human
caaagcaaaccaccucuggcaccu

SEQ ID NO: 438896 - RNA, 23 nt, Human
caacagugacagaucagaaauau

SEQ ID NO: 438897 - RNA, 21 nt, Human
caccacgcugccacucaaagc

SEQ ID NO: 438898 - RNA, 23 nt, Human
cacgcugccacucaaagcugccu

SEQ ID NO: 438899 - RNA, 21 nt, Human
cacugugugaacaucaugugc

SEQ ID NO: 438900 - RNA, 23 nt, Human
ccagaggggccgcugcacuagcg

SEQ ID NO: 438901 - RNA, 25 nt, Human
ccccaccgccuccucgggaugccca

SEQ ID NO: 438902 - RNA, 19 nt, Human
ccgccuccucgggaugccc

SEQ ID NO: 438903 - RNA, 22 nt, Human
cgcugcacuagcgcgaaaaggg

SEQ ID NO: 438904 - RNA, 20 nt, Human
cuucccagaggauguggucc

SEQ ID NO: 438905 - RNA, 25 nt, Human
cuugacccaugacuugucaguuucc

SEQ ID NO: 438906 - RNA, 21 nt, Human
gcagauuuccuuuaucucaag

SEQ ID NO: 438907 - RNA, 19 nt, Human
gggagugggccccaccgcc

SEQ ID NO: 438908 - RNA, 21 nt, Human
uaaaccagauucacacccuuc

SEQ ID NO: 438909 - RNA, 20 nt, Human
uaaauggguuauugccauug

SEQ ID NO: 438910 - RNA, 24 nt, Human
uaggcuaaaacacucucauaaaug

SEQ ID NO: 438911 - RNA, 20 nt, Human
ucaaguaucaguucuaugcu

SEQ ID NO: 438912 - RNA, 23 nt, Human
ucauuggcuguguugaagaaucc

SEQ ID NO: 438913 - RNA, 19 nt, Human
ucucacccuguuccgcuga

SEQ ID NO: 438914 - RNA, 21 nt, Human
ugacagaucagaaauauagug

SEQ ID NO: 438915 - RNA, 18 nt, Human
ugacuugucaguuuccuu

SEQ ID NO: 438916 - RNA, 19 nt, Human
ugugugaacaucaugugca

SEQ ID NO: 438917 - RNA, 24 nt, Human
uguugaagaauccaaccaagggaa

SEQ ID NO: 438918 - RNA, 19 nt, Human
uucauuggcuguguugaag

SEQ ID NO: 438919 - RNA, 22 nt, Human
uuccggguccagaggggccgcu

SEQ ID NO: 438920 - RNA, 22 nt, Human
uucucuuauuuuucacaagcag

SEQ ID NO: 438921 - RNA, 19 nt, Human
uuucacaagcagauuuccu

SEQ ID NO: 438922 - RNA, 20 nt, Human
aaaaagcuaccaauagcuga

SEQ ID NO: 438923 - RNA, 21 nt, Human
aaaacaaacaaacaaacaaac

SEQ ID NO: 438924 - RNA, 18 nt, Human
aaaacaccacauucuugg

SEQ ID NO: 438925 - RNA, 21 nt, Human
aaaaucaaaguccccaaaaaa

SEQ ID NO: 438926 - RNA, 19 nt, Human
aaaaugccaucaagccagg

SEQ ID NO: 438927 - RNA, 18 nt, Human
aaaauguacagcacagca

SEQ ID NO: 438928 - RNA, 19 nt, Human
aaacacaggucuuuuucug

SEQ ID NO: 438929 - RNA, 20 nt, Human
aaacaggaaaggccaaaagg

SEQ ID NO: 438930 - RNA, 18 nt, Human
aaaccuaaaauacuaaug

SEQ ID NO: 438931 - RNA, 21 nt, Human
aaaccuacgauguaaccucga

SEQ ID NO: 438932 - RNA, 19 nt, Human
aaaguuauagaaaagggcc

SEQ ID NO: 438933 - RNA, 24 nt, Human
aaauagaucuagaacaucuuugga

SEQ ID NO: 438934 - RNA, 25 nt, Human
aacaaacaaacaaacaaaaaaaaca

SEQ ID NO: 438935 - RNA, 20 nt, Human
aacaagaaaguggauuacuu

SEQ ID NO: 438936 - RNA, 22 nt, Human
aacaccuauucaaucucacugc

SEQ ID NO: 438937 - RNA, 24 nt, Human
aacaucuuuggaaaaaccacaaag

SEQ ID NO: 438938 - RNA, 22 nt, Human
aacccaaaauugucaaaaaaaa

SEQ ID NO: 438939 - RNA, 25 nt, Human
aacugacuacaaguccucuuaaugc

SEQ ID NO: 438940 - RNA, 23 nt, Human
aagcaaaugcugaacucagcacu

SEQ ID NO: 438941 - RNA, 19 nt, Human
aagggccaaaauguacagc

SEQ ID NO: 438942 - RNA, 22 nt, Human
aaguagcugggauuacaggugc

SEQ ID NO: 438943 - RNA, 21 nt, Human
aaguccucuuaaugcuuaaag

SEQ ID NO: 438944 - RNA, 18 nt, Human
aagugauccacccccacc

SEQ ID NO: 438945 - RNA, 21 nt, Human
aauaguauucaaacauuacaa

SEQ ID NO: 438946 - RNA, 24 nt, Human
aaucauuaauuuucugagccuaaa

SEQ ID NO: 438947 - RNA, 21 nt, Human
aauguacagcacagcaauauu

SEQ ID NO: 438948 - RNA, 22 nt, Human
acaaaauaagaacuucuagaac

SEQ ID NO: 438949 - RNA, 23 nt, Human
acaaacaaacaaacaaaaaaaac

SEQ ID NO: 438950 - RNA, 18 nt, Human
acaaacaaacaaacaaac

SEQ ID NO: 438951 - RNA, 22 nt, Human
acaagguucugaaaacccccua

SEQ ID NO: 438952 - RNA, 23 nt, Human
acaaguccucuuaaugcuuaaag

SEQ ID NO: 438953 - RNA, 23 nt, Human
acacacacacacacacacacaca

SEQ ID NO: 438954 - RNA, 23 nt, Human
acacacacacacacacacacaca

SEQ ID NO: 438955 - RNA, 23 nt, Human
acacacacacacacacacacaca

SEQ ID NO: 438956 - RNA, 23 nt, Human
acacacacacacacacacacaca

SEQ ID NO: 438957 - RNA, 23 nt, Human
acacacacacacacacacacaca

SEQ ID NO: 438958 - RNA, 23 nt, Human
acacacacacacacacacacaca

SEQ ID NO: 438959 - RNA, 23 nt, Human
acacacacacacacacacacaca

SEQ ID NO: 438960 - RNA, 22 nt, Human
acacacccacacauacacagga

SEQ ID NO: 438961 - RNA, 26 nt, Human
acacacccacacauacacaggacaca

SEQ ID NO: 438962 - RNA, 22 nt, Human
acaccaccaauccuggaugagc

SEQ ID NO: 438963 - RNA, 20 nt, Human
acaccuuucaugccagaaug

SEQ ID NO: 438964 - RNA, 24 nt, Human
acagaaauaaacauuuucaaacac

SEQ ID NO: 438965 - RNA, 19 nt, Human
acaggugccugccaccacg

SEQ ID NO: 438966 - RNA, 21 nt, Human
acaguggcacaaucucagcuc

SEQ ID NO: 438967 - RNA, 18 nt, Human
accacaauuacuaauuca

SEQ ID NO: 438968 - RNA, 22 nt, Human
accauguugcccaggcuggucu

SEQ ID NO: 438969 - RNA, 25 nt, Human
accauguugcccaggcuggucuuga

SEQ ID NO: 438970 - RNA, 18 nt, Human
acgggguuucaccauguu

SEQ ID NO: 438971 - RNA, 19 nt, Human
acgggguuucaccauguug

SEQ ID NO: 438972 - RNA, 24 nt, Human
acgggguuucaccauguugcccag

SEQ ID NO: 438973 - RNA, 28 nt, Human
agaaguaucuuaaaaaucaaccuuaacu

SEQ ID NO: 438974 - RNA, 18 nt, Human
agacaaaagcaagacaca

SEQ ID NO: 438975 - RNA, 20 nt, Human
agacaaaagcaagacacaaa

SEQ ID NO: 438976 - RNA, 20 nt, Human
agagagugggggguggggga

SEQ ID NO: 438977 - RNA, 21 nt, Human
agaguuaauccacaaaacacc

SEQ ID NO: 438978 - RNA, 22 nt, Human
agaguugcagggagggaagaga

SEQ ID NO: 438979 - RNA, 22 nt, Human
agaguuguucaacugacuacaa

SEQ ID NO: 438980 - RNA, 23 nt, Human
agaguuguucaacugacuacaag

SEQ ID NO: 438981 - RNA, 22 nt, Human
agcaaaugcugaacucagcaca

SEQ ID NO: 438982 - RNA, 22 nt, Human
aggacagaaccaaggacagaaa

SEQ ID NO: 438983 - RNA, 19 nt, Human
aggcgugaaucaccgcgcc

SEQ ID NO: 438984 - RNA, 22 nt, Human
aggggggagggggaagagagug

SEQ ID NO: 438985 - RNA, 18 nt, Human
aguggggggugggggagg

SEQ ID NO: 438986 - RNA, 22 nt, Human
aguucugggauuacaggcguga

SEQ ID NO: 438987 - RNA, 23 nt, Human
auacacacacacccacacauaca

SEQ ID NO: 438988 - RNA, 18 nt, Human
auaguuuggggaaaucaa

SEQ ID NO: 438989 - RNA, 18 nt, Human
aucaaaguccccaaaaaa

SEQ ID NO: 438990 - RNA, 20 nt, Human
auccacccccacccccauug

SEQ ID NO: 438991 - RNA, 19 nt, Human
auuacaggugccugccacc

SEQ ID NO: 438992 - RNA, 26 nt, Human
auuauuauuaccacacaugcuaauac

SEQ ID NO: 438993 - RNA, 20 nt, Human
auugagaaaaaucaaaaccu

SEQ ID NO: 438994 - RNA, 24 nt, Human
auuuuuguauuuuugguagagacg

SEQ ID NO: 438995 - RNA, 21 nt, Human
caaaaagcuaccaauagcuga

SEQ ID NO: 438996 - RNA, 20 nt, Human
caaacaaaaaaaacaccaca

SEQ ID NO: 438997 - RNA, 25 nt, Human
caaacaaacaaaaaaaacaccacau

SEQ ID NO: 438998 - RNA, 20 nt, Human
caaaguccccaaaaaaagug

SEQ ID NO: 438999 - RNA, 21 nt, Human
caacauaucuuguaaaucaau

SEQ ID NO: 439000 - RNA, 23 nt, Human
caacugacuuacgauguuaauau

SEQ ID NO: 439001 - RNA, 22 nt, Human
caagcaauucuccugccuuagc

SEQ ID NO: 439002 - RNA, 27 nt, Human
caagcaauucuccugccuuagccuccc

SEQ ID NO: 439003 - RNA, 18 nt, Human
cacacacacacacacaca

SEQ ID NO: 439004 - RNA, 20 nt, Human
cacacacacacacacacaca

SEQ ID NO: 439005 - RNA, 20 nt, Human
cacacacacacacacacaca

SEQ ID NO: 439006 - RNA, 20 nt, Human
cacacacacacacacacaca

SEQ ID NO: 439007 - RNA, 20 nt, Human
cacacacacacacacacaca

SEQ ID NO: 439008 - RNA, 20 nt, Human
cacacacacacacacacaca

SEQ ID NO: 439009 - RNA, 20 nt, Human
cacacacacacacacacaca

SEQ ID NO: 439010 - RNA, 20 nt, Human
cacacacacacacacacaca

SEQ ID NO: 439011 - RNA, 20 nt, Human
cacacacacacacacacaca

SEQ ID NO: 439012 - RNA, 20 nt, Human
cacacacacacacacacaca

SEQ ID NO: 439013 - RNA, 20 nt, Human
cacacacacacacacacaca

SEQ ID NO: 439014 - RNA, 20 nt, Human
cacacacacacacacacaca

SEQ ID NO: 439015 - RNA, 20 nt, Human
cacacacacacacacacaca

SEQ ID NO: 439016 - RNA, 22 nt, Human
cacacacacacacacacacaca

SEQ ID NO: 439017 - RNA, 22 nt, Human
cacacacacacacacacacaca

SEQ ID NO: 439018 - RNA, 22 nt, Human
cacacacacacacacacacaca

SEQ ID NO: 439019 - RNA, 22 nt, Human
cacacacacacacacacacaca

SEQ ID NO: 439020 - RNA, 30 nt, Human
cacacacacacacacacacacacacaccuu

SEQ ID NO: 439021 - RNA, 20 nt, Human
cacacacacccacacauaca

SEQ ID NO: 439022 - RNA, 24 nt, Human
caccacgccuggcuaauuuuugua

SEQ ID NO: 439023 - RNA, 20 nt, Human
caccauaaacagaaauaaac

SEQ ID NO: 439024 - RNA, 24 nt, Human
caccauguugcccaggcuggucuu

SEQ ID NO: 439025 - RNA, 27 nt, Human
caccauguugcccaggcuggucuugaa

SEQ ID NO: 439026 - RNA, 21 nt, Human
caccucaaucucccauuuuaa

SEQ ID NO: 439027 - RNA, 22 nt, Human
caccucagaaugauuacaccau

SEQ ID NO: 439028 - RNA, 18 nt, Human
cacugcaaucucugccuc

SEQ ID NO: 439029 - RNA, 21 nt, Human
cacugcccuuuuuuauugcag

SEQ ID NO: 439030 - RNA, 19 nt, Human
cacuguauaugcaacgagc

SEQ ID NO: 439031 - RNA, 20 nt, Human
cagaaccaaggacagaaacu

SEQ ID NO: 439032 - RNA, 18 nt, Human
caggacacagcgagagau

SEQ ID NO: 439033 - RNA, 22 nt, Human
caggacacagcgagagauggua

SEQ ID NO: 439034 - RNA, 19 nt, Human
caggugccugccaccacgc

SEQ ID NO: 439035 - RNA, 21 nt, Human
caggugccugccaccacgccu

SEQ ID NO: 439036 - RNA, 23 nt, Human
caggugccugccaccacgccugg

SEQ ID NO: 439037 - RNA, 23 nt, Human
cagugcaguuucuagcagcacua

SEQ ID NO: 439038 - RNA, 23 nt, Human
cagugcucagaaaaaaugaaaac

SEQ ID NO: 439039 - RNA, 23 nt, Human
cauacacucaaguuacuaaacac

SEQ ID NO: 439040 - RNA, 24 nt, Human
cauauuaacauuaauuuuuaaaau

SEQ ID NO: 439041 - RNA, 19 nt, Human
cauguugcccaggcugguc

SEQ ID NO: 439042 - RNA, 24 nt, Human
cauguugcccaggcuggucuugaa

SEQ ID NO: 439043 - RNA, 23 nt, Human
cauugcccccacuugcuucuacc

SEQ ID NO: 439044 - RNA, 24 nt, Human
cauuuuaacgccaggauuuccuag

SEQ ID NO: 439045 - RNA, 20 nt, Human
ccaaauacacacacacccac

SEQ ID NO: 439046 - RNA, 22 nt, Human
ccaaauacacacacacccacac

SEQ ID NO: 439047 - RNA, 21 nt, Human
ccaaguagcugggauuacagg

SEQ ID NO: 439048 - RNA, 20 nt, Human
ccaccacgccuggcuaauuu

SEQ ID NO: 439049 - RNA, 24 nt, Human
ccacugcugaaacaaaacuuuagu

SEQ ID NO: 439050 - RNA, 22 nt, Human
ccagaguucugggauuacaggc

SEQ ID NO: 439051 - RNA, 24 nt, Human
ccagaguucugggauuacaggcgu

SEQ ID NO: 439052 - RNA, 22 nt, Human
cccaaguagcugggauuacagg

SEQ ID NO: 439053 - RNA, 23 nt, Human
cccaaguagcugggauuacaggu

SEQ ID NO: 439054 - RNA, 24 nt, Human
cccaaguagcugggauuacaggug

SEQ ID NO: 439055 - RNA, 23 nt, Human
cccacaccucaaucucccauuuu

SEQ ID NO: 439056 - RNA, 23 nt, Human
cccagguucaagcaauucuccug

SEQ ID NO: 439057 - RNA, 18 nt, Human
ccgcgcccagcccaaauc

SEQ ID NO: 439058 - RNA, 24 nt, Human
ccucccagguucaagcaauucucc

SEQ ID NO: 439059 - RNA, 24 nt, Human
ccugaccucaagugauccaccccc

SEQ ID NO: 439060 - RNA, 24 nt, Human
ccugaccucaagugauccaccccc

SEQ ID NO: 439061 - RNA, 24 nt, Human
ccugccuuagccucccaaguagcu

SEQ ID NO: 439062 - RNA, 18 nt, Human
cgaacaaaacucuucgag

SEQ ID NO: 439063 - RNA, 24 nt, Human
cgggguuucaccauguugcccagg

SEQ ID NO: 439064 - RNA, 20 nt, Human
cuaaaacaaacaaacaaaca

SEQ ID NO: 439065 - RNA, 23 nt, Human
cuacaaguccucuuaaugcuuaa

SEQ ID NO: 439066 - RNA, 21 nt, Human
cuauaauuauuccaagcugcu

SEQ ID NO: 439067 - RNA, 21 nt, Human
cuaucagaggucucauucacu

SEQ ID NO: 439068 - RNA, 18 nt, Human
cucaagugauccaccccc

SEQ ID NO: 439069 - RNA, 19 nt, Human
cucaagugauccacccccc

SEQ ID NO: 439070 - RNA, 25 nt, Human
cucaaguuacuaaacacaauuugau

SEQ ID NO: 439071 - RNA, 24 nt, Human
cucacugcaaucucugccucccag

SEQ ID NO: 439072 - RNA, 21 nt, Human
cuccccaaacaaauacuaaaa

SEQ ID NO: 439073 - RNA, 18 nt, Human
cucuagcaaaaugcaaag

SEQ ID NO: 439074 - RNA, 18 nt, Human
cucugucgcccaggaugg

SEQ ID NO: 439075 - RNA, 23 nt, Human
cugaaaacccccugguuagaccu

SEQ ID NO: 439076 - RNA, 24 nt, Human
cugcaaucucugccucccagguuc

SEQ ID NO: 439077 - RNA, 23 nt, Human
cuggugacagguggacaggguuu

SEQ ID NO: 439078 - RNA, 23 nt, Human
cuuaaagccucuacccacaccuc

SEQ ID NO: 439079 - RNA, 23 nt, Human
cuuagccucccaaguagcuggga

SEQ ID NO: 439080 - RNA, 18 nt, Human
cuucagugcaguuucuag

SEQ ID NO: 439081 - RNA, 20 nt, Human
cuugguuuaggaaaacauga

SEQ ID NO: 439082 - RNA, 19 nt, Human
cuuguuccccuccccaaac

SEQ ID NO: 439083 - RNA, 18 nt, Human
cuuuuuuauugcaaagug

SEQ ID NO: 439084 - RNA, 18 nt, Human
gaaacugguaaaaacaga

SEQ ID NO: 439085 - RNA, 23 nt, Human
gaaccaacauuuacacacccaaa

SEQ ID NO: 439086 - RNA, 20 nt, Human
gaaccaaggacagaaaccgg

SEQ ID NO: 439087 - RNA, 24 nt, Human
gaagagagagacaaaagcaagaca

SEQ ID NO: 439088 - RNA, 21 nt, Human
gacaaaauauacuuuacaaaa

SEQ ID NO: 439089 - RNA, 27 nt, Human
gacaagagugacuaauucuguauccac

SEQ ID NO: 439090 - RNA, 18 nt, Human
gaccucaagugauccacc

SEQ ID NO: 439091 - RNA, 22 nt, Human
gacgggguuucaccauguugcc

SEQ ID NO: 439092 - RNA, 19 nt, Human
gagaaaaaaugcaucucac

SEQ ID NO: 439093 - RNA, 22 nt, Human
gagaagaaacuaaauguuagua

SEQ ID NO: 439094 - RNA, 21 nt, Human
gagacaaaagcaagacacaac

SEQ ID NO: 439095 - RNA, 25 nt, Human
gagacagugggaggaggggggaggg

SEQ ID NO: 439096 - RNA, 23 nt, Human
gagacgggguuucaccauguugc

SEQ ID NO: 439097 - RNA, 18 nt, Human
gagcacaccaccaauccu

SEQ ID NO: 439098 - RNA, 23 nt, Human
gagcacagccaaauaaacagcua

SEQ ID NO: 439099 - RNA, 18 nt, Human
gaggaggggggaggggga

SEQ ID NO: 439100 - RNA, 20 nt, Human
gaguuaauccacaaaacacc

SEQ ID NO: 439101 - RNA, 24 nt, Human
gauaaaagaacaauuaauugcaaa

SEQ ID NO: 439102 - RNA, 19 nt, Human
gauuacaggcgugaaucac

SEQ ID NO: 439103 - RNA, 22 nt, Human
gauuacaggcgugaaucaccgc

SEQ ID NO: 439104 - RNA, 18 nt, Human
gauuacaggugccugcca

SEQ ID NO: 439105 - RNA, 21 nt, Human
gcaaauccagcaauauuaaaa

SEQ ID NO: 439106 - RNA, 22 nt, Human
gcaaucucugccucccagguuc

SEQ ID NO: 439107 - RNA, 20 nt, Human
gccuuagccucccaaguagc

SEQ ID NO: 439108 - RNA, 22 nt, Human
gcuaaaggcaggaacaauucug

SEQ ID NO: 439109 - RNA, 23 nt, Human
gcuggucuugaacuccugaccuc

SEQ ID NO: 439110 - RNA, 21 nt, Human
gcuguuugacuauagagcaac

SEQ ID NO: 439111 - RNA, 19 nt, Human
ggaggaggggagagagagu

SEQ ID NO: 439112 - RNA, 22 nt, Human
ggaggggggagggggaagagag

SEQ ID NO: 439113 - RNA, 24 nt, Human
ggcuggucuugaacuccugaccuc

SEQ ID NO: 439114 - RNA, 19 nt, Human
gggaggaggggagagagag

SEQ ID NO: 439115 - RNA, 21 nt, Human
gggggagggggaagagagugg

SEQ ID NO: 439116 - RNA, 23 nt, Human
gggguuucaccauguugcccagg

SEQ ID NO: 439117 - RNA, 21 nt, Human
gguagagacgggguuucacca

SEQ ID NO: 439118 - RNA, 19 nt, Human
ggucuugaacuccugaccu

SEQ ID NO: 439119 - RNA, 20 nt, Human
guaagggccaaaauguacag

SEQ ID NO: 439120 - RNA, 19 nt, Human
guagagacgggguuucacc

SEQ ID NO: 439121 - RNA, 21 nt, Human
guagagacgggguuucaccau

SEQ ID NO: 439122 - RNA, 22 nt, Human
guagagacgggguuucaccaug

SEQ ID NO: 439123 - RNA, 23 nt, Human
guagagacgggguuucaccaugu

SEQ ID NO: 439124 - RNA, 21 nt, Human
guagauauaguuuaucugggu

SEQ ID NO: 439125 - RNA, 18 nt, Human
guagcugggauuacaggu

SEQ ID NO: 439126 - RNA, 22 nt, Human
gugaaucaccgcgcccagccca

SEQ ID NO: 439127 - RNA, 24 nt, Human
guuucaccauguugcccaggcugg

SEQ ID NO: 439128 - RNA, 19 nt, Human
guuugacuauagagcaacc

SEQ ID NO: 439129 - RNA, 27 nt, Human
uaaaaaaacccaguccagugcugccac

SEQ ID NO: 439130 - RNA, 30 nt, Human
uaaaugcaaaguauucucccuacacccugg

SEQ ID NO: 439131 - RNA, 27 nt, Human
uaaauugagaaaaaucaaaaccuacga

SEQ ID NO: 439132 - RNA, 19 nt, Human
uaacaccaaaauauacaug

SEQ ID NO: 439133 - RNA, 20 nt, Human
uaacuaaguagacauuuaaa

SEQ ID NO: 439134 - RNA, 24 nt, Human
uaauuuuuguauuuuugguagaga

SEQ ID NO: 439135 - RNA, 22 nt, Human
uacacacacacccacacauaca

SEQ ID NO: 439136 - RNA, 25 nt, Human
uacacacccaaauacacacacaccc

SEQ ID NO: 439137 - RNA, 21 nt, Human
uacaccauaaacagaaauaaa

SEQ ID NO: 439138 - RNA, 22 nt, Human
uacaggugccugccaccacgcc

SEQ ID NO: 439139 - RNA, 24 nt, Human
uaccaguuuuaaacacugucuuuu

SEQ ID NO: 439140 - RNA, 20 nt, Human
uagaaaccuaaaauacuaau

SEQ ID NO: 439141 - RNA, 22 nt, Human
uagagacgggguuucaccaugu

SEQ ID NO: 439142 - RNA, 18 nt, Human
uagcaaauccagcaauau

SEQ ID NO: 439143 - RNA, 22 nt, Human
uaggcaacacugucaaccccac

SEQ ID NO: 439144 - RNA, 18 nt, Human
uaguguuuauagaaaccu

SEQ ID NO: 439145 - RNA, 19 nt, Human
uauagaaaccuaaaauacu

SEQ ID NO: 439146 - RNA, 22 nt, Human
uauaguaacugagcacagccaa

SEQ ID NO: 439147 - RNA, 20 nt, Human
uauccuagauuacaaaaucc

SEQ ID NO: 439148 - RNA, 22 nt, Human
uauuaccacacaugcuaauacc

SEQ ID NO: 439149 - RNA, 22 nt, Human
uauugaagaacucuuagcuggg

SEQ ID NO: 439150 - RNA, 20 nt, Human
uauuuugcuguugaucaaac

SEQ ID NO: 439151 - RNA, 23 nt, Human
uauuuugcuguugaucaaacuug

SEQ ID NO: 439152 - RNA, 19 nt, Human
uauuuuugguagagacggg

SEQ ID NO: 439153 - RNA, 21 nt, Human
ucaccauguugcccaggcugg

SEQ ID NO: 439154 - RNA, 18 nt, Human
ucaccggccucaacgacc

SEQ ID NO: 439155 - RNA, 19 nt, Human
ucacugcaaucucugccuc

SEQ ID NO: 439156 - RNA, 24 nt, Human
ucacugcaaucucugccucccagg

SEQ ID NO: 439157 - RNA, 25 nt, Human
ucacugcaaucucugccucccaggg

SEQ ID NO: 439158 - RNA, 25 nt, Human
ucacugcaaucucugccucccaggu

SEQ ID NO: 439159 - RNA, 27 nt, Human
ucagcucacugcaaucucugccuccca

SEQ ID NO: 439160 - RNA, 27 nt, Human
uccacccccacccccauuggcuuccca

SEQ ID NO: 439161 - RNA, 28 nt, Human
uccagugcugccacaucucaaguucuga

SEQ ID NO: 439162 - RNA, 23 nt, Human
ucccaaguagcugggauuacagg

SEQ ID NO: 439163 - RNA, 24 nt, Human
ucccagaguucugggauuacaggc

SEQ ID NO: 439164 - RNA, 21 nt, Human
ucccagguucaagcaauucuc

SEQ ID NO: 439165 - RNA, 24 nt, Human
ucccagguucaagcaauucuccug

SEQ ID NO: 439166 - RNA, 22 nt, Human
ucgagaugaaguguucuaucag

SEQ ID NO: 439167 - RNA, 18 nt, Human
ucucaggacccuucacug

SEQ ID NO: 439168 - RNA, 26 nt, Human
ucuccugccuuagccucccaaguagc

SEQ ID NO: 439169 - RNA, 23 nt, Human
ucuguaucuuaaauugagaaaaa

SEQ ID NO: 439170 - RNA, 20 nt, Human
ucugucucugucgcccagga

SEQ ID NO: 439171 - RNA, 24 nt, Human
ucugucucugucgcccaggaugga

SEQ ID NO: 439172 - RNA, 21 nt, Human
ucuugaacuccugaccucaag

SEQ ID NO: 439173 - RNA, 20 nt, Human
ugaaaagcaaaaaagaguua

SEQ ID NO: 439174 - RNA, 24 nt, Human
ugaaguuccacuauuauuauuacc

SEQ ID NO: 439175 - RNA, 22 nt, Human
ugacaaaaugccaucaagccag

SEQ ID NO: 439176 - RNA, 24 nt, Human
ugacaaaaugccaucaagccaggu

SEQ ID NO: 439177 - RNA, 20 nt, Human
ugacagguggacaggguuuu

SEQ ID NO: 439178 - RNA, 22 nt, Human
ugacagguggacaggguuuuua

SEQ ID NO: 439179 - RNA, 22 nt, Human
ugaccucaagugauccaccccc

SEQ ID NO: 439180 - RNA, 20 nt, Human
ugacuauagagcaaccaaau

SEQ ID NO: 439181 - RNA, 18 nt, Human
ugacuggcagcauuggca

SEQ ID NO: 439182 - RNA, 19 nt, Human
ugagaaaaaucaaaaccua

SEQ ID NO: 439183 - RNA, 21 nt, Human
ugagccccgcuuuuucucugu

SEQ ID NO: 439184 - RNA, 20 nt, Human
ugaggucucugaaucaccug

SEQ ID NO: 439185 - RNA, 20 nt, Human
ugauauacugaugggaaauu

SEQ ID NO: 439186 - RNA, 18 nt, Human
ugauccacccccaccccc

SEQ ID NO: 439187 - RNA, 24 nt, Human
ugauuuauaaaggaaacauuccuu

SEQ ID NO: 439188 - RNA, 20 nt, Human
ugauuugugacauugccccc

SEQ ID NO: 439189 - RNA, 28 nt, Human
ugcacaaguaaccaaagguagcaaaucc

SEQ ID NO: 439190 - RNA, 25 nt, Human
ugccaucaagccagguuugcucccc

SEQ ID NO: 439191 - RNA, 24 nt, Human
ugcccaggcuggucuugaacuccu

SEQ ID NO: 439192 - RNA, 24 nt, Human
ugccuuagccucccaaguagcugg

SEQ ID NO: 439193 - RNA, 22 nt, Human
ugcuuaaagccucuacccacac

SEQ ID NO: 439194 - RNA, 19 nt, Human
uggaguacaguggcacaau

SEQ ID NO: 439195 - RNA, 24 nt, Human
uggcacaaucucagcucacugcaa

SEQ ID NO: 439196 - RNA, 19 nt, Human
uggcagcauuggcaaauaa

SEQ ID NO: 439197 - RNA, 21 nt, Human
uggcuucccagaguucuggga

SEQ ID NO: 439198 - RNA, 19 nt, Human
uggcuuguuccccucccca

SEQ ID NO: 439199 - RNA, 19 nt, Human
ugggaacccaaaauuguca

SEQ ID NO: 439200 - RNA, 23 nt, Human
ugggagaagaaagaucacaggaa

SEQ ID NO: 439201 - RNA, 18 nt, Human
ugggauuacaggcgugaa

SEQ ID NO: 439202 - RNA, 19 nt, Human
ugggauuacaggcgugaau

SEQ ID NO: 439203 - RNA, 21 nt, Human
ugggauuacaggcgugaauca

SEQ ID NO: 439204 - RNA, 22 nt, Human
ugggauuacaggcgugaaucac

SEQ ID NO: 439205 - RNA, 23 nt, Human
ugggauuacaggcgugaaucacc

SEQ ID NO: 439206 - RNA, 24 nt, Human
ugggauuacaggcgugaaucaccg

SEQ ID NO: 439207 - RNA, 21 nt, Human
ugggauuacaggugccugcca

SEQ ID NO: 439208 - RNA, 22 nt, Human
ugggauuacaggugccugccac

SEQ ID NO: 439209 - RNA, 24 nt, Human
ugggauuacaggugccugccacca

SEQ ID NO: 439210 - RNA, 21 nt, Human
ugggggaaacuaucacuuaua

SEQ ID NO: 439211 - RNA, 22 nt, Human
ugggggaaacuaucacuuauag

SEQ ID NO: 439212 - RNA, 21 nt, Human
ugggggaggugagagacagug

SEQ ID NO: 439213 - RNA, 24 nt, Human
ugguagagacgggguuucaccaug

SEQ ID NO: 439214 - RNA, 23 nt, Human
uguauccacaucuucagagcagg

SEQ ID NO: 439215 - RNA, 22 nt, Human
uguuacacaguacaagaucuua

SEQ ID NO: 439216 - RNA, 25 nt, Human
uguuccccuccccaaacaaauacua

SEQ ID NO: 439217 - RNA, 22 nt, Human
uuaaacacugucuuuuuggacc

SEQ ID NO: 439218 - RNA, 23 nt, Human
uuagaaaaacauaaaauuuaaag

SEQ ID NO: 439219 - RNA, 23 nt, Human
uuaguauaauuuuucuaaauucu

SEQ ID NO: 439220 - RNA, 24 nt, Human
uucaagcaauucuccugccuuagc

SEQ ID NO: 439221 - RNA, 22 nt, Human
uuccaagcugcuuuugcuaugu

SEQ ID NO: 439222 - RNA, 18 nt, Human
uuccagguuaauccaagc

SEQ ID NO: 439223 - RNA, 25 nt, Human
uuccuaggcaacacugucaacccca

SEQ ID NO: 439224 - RNA, 20 nt, Human
uucucuugugcuggugacag

SEQ ID NO: 439225 - RNA, 20 nt, Human
uugaagguuuugaaacuggu

SEQ ID NO: 439226 - RNA, 18 nt, Human
uugauguaagugugaagu

SEQ ID NO: 439227 - RNA, 20 nt, Human
uugcaaagugucaaagagaa

SEQ ID NO: 439228 - RNA, 19 nt, Human
uugcuccccacuuaaguuc

SEQ ID NO: 439229 - RNA, 20 nt, Human
uuggcuucccagaguucugg

SEQ ID NO: 439230 - RNA, 24 nt, Human
uugguagagacgggguuucaccau

SEQ ID NO: 439231 - RNA, 19 nt, Human
uugugcagcuuucagaaca

SEQ ID NO: 439232 - RNA, 24 nt, Human
uuucaccauguugcccaggcuggu

SEQ ID NO: 439233 - RNA, 21 nt, Human
uuucuugaaaagcaaauuuga

SEQ ID NO: 439234 - RNA, 25 nt, Human
uuugcuccccacuuaaguucaaaua

SEQ ID NO: 439235 - RNA, 20 nt, Human
uuugugcagcuuucagaaca

SEQ ID NO: 439236 - RNA, 26 nt, Human
uuuuaaacacugucuuuuuggaccua

SEQ ID NO: 439237 - RNA, 23 nt, Human
uuuuaacacugcacaaguaacca

SEQ ID NO: 439238 - RNA, 22 nt, Human
uuuuugguagagacgggguuuc

SEQ ID NO: 439239 - RNA, 24 nt, Human
uuuuugguagagacgggguuucac

SEQ ID NO: 439240 - RNA, 20 nt, Human
uuuuuguauuuuugguagag

SEQ ID NO: 439241 - RNA, 20 nt, Human
aaagcuccccaagccugcac

SEQ ID NO: 439242 - RNA, 21 nt, Human
aaaucagucgucaaaucacaa

SEQ ID NO: 439243 - RNA, 24 nt, Human
aacauuaagaaaaaaauauacaau

SEQ ID NO: 439244 - RNA, 24 nt, Human
aagaaccugacuuauuucaugcca

SEQ ID NO: 439245 - RNA, 24 nt, Human
aagagccaaaagacgcgcgcccgc

SEQ ID NO: 439246 - RNA, 24 nt, Human
aagugaccaauuucagaguaccac

SEQ ID NO: 439247 - RNA, 24 nt, Human
acaacuuauccaaaugaauguguu

SEQ ID NO: 439248 - RNA, 25 nt, Human
acaauccaguaucuaucaaaauacc

SEQ ID NO: 439249 - RNA, 22 nt, Human
acauuaagaaaaaaauauacaa

SEQ ID NO: 439250 - RNA, 20 nt, Human
acuccaguuucagaagcaga

SEQ ID NO: 439251 - RNA, 27 nt, Human
agaaaaaaauauacaauagauacagga

SEQ ID NO: 439252 - RNA, 18 nt, Human
agccgacugcgaacgcgc

SEQ ID NO: 439253 - RNA, 21 nt, Human
aggaugggggagaaccggagg

SEQ ID NO: 439254 - RNA, 24 nt, Human
auucuguauguuucaaaaugcuuu

SEQ ID NO: 439255 - RNA, 24 nt, Human
cacaaauauggcacaaacacaauc

SEQ ID NO: 439256 - RNA, 26 nt, Human
cacaauccaguaucuaucaaaauacc

SEQ ID NO: 439257 - RNA, 20 nt, Human
cagaagcagaacuagguauu

SEQ ID NO: 439258 - RNA, 22 nt, Human
cauauaagaguagaaucaaaaa

SEQ ID NO: 439259 - RNA, 18 nt, Human
ccaaugacaauagaacau

SEQ ID NO: 439260 - RNA, 21 nt, Human
ccaauuucagaguaccacuaa

SEQ ID NO: 439261 - RNA, 22 nt, Human
ccggaggaugggggagaaccgg

SEQ ID NO: 439262 - RNA, 18 nt, Human
ccggguuacgccuucccc

SEQ ID NO: 439263 - RNA, 19 nt, Human
ccugccaaccgcagguggu

SEQ ID NO: 439264 - RNA, 18 nt, Human
cgggaucagagcggacug

SEQ ID NO: 439265 - RNA, 20 nt, Human
cuagaaaugagaucaguuga

SEQ ID NO: 439266 - RNA, 19 nt, Human
cuccaguuucagaagcaga

SEQ ID NO: 439267 - RNA, 19 nt, Human
cuccccggcagacgccuag

SEQ ID NO: 439268 - RNA, 19 nt, Human
cuccguguaauaggaaagu

SEQ ID NO: 439269 - RNA, 19 nt, Human
cuccugccugccaaccgca

SEQ ID NO: 439270 - RNA, 21 nt, Human
cuuaaagcuccccaagccugc

SEQ ID NO: 439271 - RNA, 21 nt, Human
cuuagcgggucccugcccucc

SEQ ID NO: 439272 - RNA, 18 nt, Human
gaccucaaucauuaguga

SEQ ID NO: 439273 - RNA, 25 nt, Human
gcagcagcauucauuuucuucuacu

SEQ ID NO: 439274 - RNA, 21 nt, Human
gccaugugugaaugcagucca

SEQ ID NO: 439275 - RNA, 23 nt, Human
gccgcagggacaggggcaagagc

SEQ ID NO: 439276 - RNA, 19 nt, Human
gcgaacgcgcccagccugc

SEQ ID NO: 439277 - RNA, 24 nt, Human
gggacaggggcaagagccaaaaga

SEQ ID NO: 439278 - RNA, 19 nt, Human
ggucuuggaaagaggaaau

SEQ ID NO: 439279 - RNA, 22 nt, Human
gugaagcaaauauuuuauuuaa

SEQ ID NO: 439280 - RNA, 24 nt, Human
guuucagaagcagaacuagguauu

SEQ ID NO: 439281 - RNA, 24 nt, Human
uaaaagaauggcacaaauauggca

SEQ ID NO: 439282 - RNA, 19 nt, Human
uaaagcuccccaagccugc

SEQ ID NO: 439283 - RNA, 30 nt, Human
uaagaaaaaaauauacaauagauacaggaa

SEQ ID NO: 439284 - RNA, 20 nt, Human
uagcgggucccugcccuccc

SEQ ID NO: 439285 - RNA, 19 nt, Human
uauaacugaggcuuaaagc

SEQ ID NO: 439286 - RNA, 25 nt, Human
ucagcuuagcgggucccugcccucc

SEQ ID NO: 439287 - RNA, 21 nt, Human
uccagguuaagaauuuaggac

SEQ ID NO: 439288 - RNA, 24 nt, Human
uccccaagccgcagggacaggggc

SEQ ID NO: 439289 - RNA, 19 nt, Human
uccccaagccugcacuaug

SEQ ID NO: 439290 - RNA, 23 nt, Human
uccccaagccugcacuauggcac

SEQ ID NO: 439291 - RNA, 21 nt, Human
uccccggcagacgccuagucu

SEQ ID NO: 439292 - RNA, 24 nt, Human
uccuccgcacuucucccgcgccua

SEQ ID NO: 439293 - RNA, 18 nt, Human
ucuaggaggcucuguuuu

SEQ ID NO: 439294 - RNA, 23 nt, Human
ucuucacauucuggucuuccaaa

SEQ ID NO: 439295 - RNA, 27 nt, Human
ucuucagucucagcagcagcauucauu

SEQ ID NO: 439296 - RNA, 21 nt, Human
ugaagcaaauauuuuauuuaa

SEQ ID NO: 439297 - RNA, 21 nt, Human
ugaggcuuaaagcuccccaag

SEQ ID NO: 439298 - RNA, 22 nt, Human
ugccaugugugaaugcagucca

SEQ ID NO: 439299 - RNA, 19 nt, Human
uggucuuggaaagaggaaa

SEQ ID NO: 439300 - RNA, 24 nt, Human
uguaguauccugcacauuuccuuc

SEQ ID NO: 439301 - RNA, 25 nt, Human
ugugugaaugcaguccagcauauag

SEQ ID NO: 439302 - RNA, 21 nt, Human
uuaaauggcucuagcuccuga

SEQ ID NO: 439303 - RNA, 20 nt, Human
uuccuuaaacauuaagaaaa

SEQ ID NO: 439304 - RNA, 22 nt, Human
aaagucaaugaagaugcuggga

SEQ ID NO: 439305 - RNA, 26 nt, Human
aucuuguuucuuccuguggccuucca

SEQ ID NO: 439306 - RNA, 18 nt, Human
auggacaggaaaaucugc

SEQ ID NO: 439307 - RNA, 18 nt, Human
ccacggaagacuccagaa

SEQ ID NO: 439308 - RNA, 18 nt, Human
ccagaagaggggaaagca

SEQ ID NO: 439309 - RNA, 18 nt, Human
ccggccccacugccagaa

SEQ ID NO: 439310 - RNA, 19 nt, Human
gauauagagggggagaugu

SEQ ID NO: 439311 - RNA, 18 nt, Human
gauguggaagugagaaag

SEQ ID NO: 439312 - RNA, 23 nt, Human
gccagaagaggggaaagcagugg

SEQ ID NO: 439313 - RNA, 21 nt, Human
uagcacaagaugacaugucuu

SEQ ID NO: 439314 - RNA, 21 nt, Human
ucaguuuaccccccuccugcc

SEQ ID NO: 439315 - RNA, 21 nt, Human
ucccucaguuuaccccccucc

SEQ ID NO: 439316 - RNA, 21 nt, Human
ucugagauaugaggaaagcuc

SEQ ID NO: 439317 - RNA, 28 nt, Human
ucugcaaaauccaguggcuagcacaaga

SEQ ID NO: 439318 - RNA, 19 nt, Human
ugaagaugcugggauguuc

SEQ ID NO: 439319 - RNA, 18 nt, Human
ugaugagaguggugugaa

SEQ ID NO: 439320 - RNA, 19 nt, Human
ugcugggauguucuugcuc

SEQ ID NO: 439321 - RNA, 18 nt, Human
ugcuugcauggacaggaa

SEQ ID NO: 439322 - RNA, 19 nt, Human
uggaauagugaaccacgga

SEQ ID NO: 439323 - RNA, 21 nt, Human
ugggauguucuugcucagcuc

SEQ ID NO: 439324 - RNA, 21 nt, Human
uggugugaagauaauguuagg

SEQ ID NO: 439325 - RNA, 21 nt, Human
uuuuuggagcccuuuaauugu

SEQ ID NO: 439326 - RNA, 29 nt, Human
aaaaagaugagcaaaaaugucacacuagg

SEQ ID NO: 439327 - RNA, 18 nt, Human
aaacaacaagaaccaaaa

SEQ ID NO: 439328 - RNA, 19 nt, Human
aacaacaagaaccaaaaau

SEQ ID NO: 439329 - RNA, 18 nt, Human
accacaauauuacaaaga

SEQ ID NO: 439330 - RNA, 26 nt, Human
agcaaacaacaagaaccaaaaaugaa

SEQ ID NO: 439331 - RNA, 22 nt, Human
agccagaugacaaaacugaacu

SEQ ID NO: 439332 - RNA, 18 nt, Human
aguauagaaaugcccagu

SEQ ID NO: 439333 - RNA, 22 nt, Human
aguuguuuuaggugguuucucu

SEQ ID NO: 439334 - RNA, 26 nt, Human
augagccuauuauuuucugugguguc

SEQ ID NO: 439335 - RNA, 22 nt, Human
caaagauggugguaucaccacg

SEQ ID NO: 439336 - RNA, 26 nt, Human
caacaagaaccaaaaaugaagugcag

SEQ ID NO: 439337 - RNA, 21 nt, Human
cacauguuuccaccauaaucu

SEQ ID NO: 439338 - RNA, 25 nt, Human
ccagccagaugacaaaacugaacuc

SEQ ID NO: 439339 - RNA, 24 nt, Human
cuaaaaauguauguuccaucaagg

SEQ ID NO: 439340 - RNA, 21 nt, Human
cuauuauuuucuguggagacu

SEQ ID NO: 439341 - RNA, 18 nt, Human
cucagauuaacacaagau

SEQ ID NO: 439342 - RNA, 20 nt, Human
cugucauuucccacucuuaa

SEQ ID NO: 439343 - RNA, 23 nt, Human
cuuaaagcuuauguucugaaacu

SEQ ID NO: 439344 - RNA, 21 nt, Human
gaaaauuuagcauuacuguca

SEQ ID NO: 439345 - RNA, 26 nt, Human
gaagugcaggaugaaaagcaagcuga

SEQ ID NO: 439346 - RNA, 21 nt, Human
gagcucagauuaacacaagau

SEQ ID NO: 439347 - RNA, 26 nt, Human
gcaaacaacaagaaccaaaaaugaag

SEQ ID NO: 439348 - RNA, 20 nt, Human
gcaaguuaagcaaacaacaa

SEQ ID NO: 439349 - RNA, 25 nt, Human
gcccuauuaaagaguucagugugau

SEQ ID NO: 439350 - RNA, 19 nt, Human
gcuguaacagagcucagau

SEQ ID NO: 439351 - RNA, 21 nt, Human
ggcagagcuguaacagagcuc

SEQ ID NO: 439352 - RNA, 18 nt, Human
guaaaauuucuuccaggc

SEQ ID NO: 439353 - RNA, 19 nt, Human
guaaaauuucuuccaggca

SEQ ID NO: 439354 - RNA, 21 nt, Human
uaacacaagauugcuuguugc

SEQ ID NO: 439355 - RNA, 19 nt, Human
uaagcaaacaacaagaacc

SEQ ID NO: 439356 - RNA, 20 nt, Human
uaagcaaacaacaagaacca

SEQ ID NO: 439357 - RNA, 27 nt, Human
uaagcaaacaacaagaaccaaaaauga

SEQ ID NO: 439358 - RNA, 19 nt, Human
uaaggucauagccagaguu

SEQ ID NO: 439359 - RNA, 19 nt, Human
uacauacaucucuaauccu

SEQ ID NO: 439360 - RNA, 28 nt, Human
uaugacucuaaagugcaaguuaagcaaa

SEQ ID NO: 439361 - RNA, 19 nt, Human
uauuaaagaguucagugug

SEQ ID NO: 439362 - RNA, 18 nt, Human
uauugagcaauucuuggg

SEQ ID NO: 439363 - RNA, 19 nt, Human
uauuuuguuuuauccuccu

SEQ ID NO: 439364 - RNA, 23 nt, Human
ucacuaugagccuauuauuuucu

SEQ ID NO: 439365 - RNA, 20 nt, Human
uccagccagaugacaaaagg

SEQ ID NO: 439366 - RNA, 23 nt, Human
uccucaccacaauauuacaaaga

SEQ ID NO: 439367 - RNA, 19 nt, Human
ucugcacauaguuggaagu

SEQ ID NO: 439368 - RNA, 19 nt, Human
ugagagaaaagaaaguggu

SEQ ID NO: 439369 - RNA, 19 nt, Human
ugagauuacggcagagcug

SEQ ID NO: 439370 - RNA, 20 nt, Human
ugcaggaugaaaagcaagcu

SEQ ID NO: 439371 - RNA, 20 nt, Human
uggagaauaaacauuggggu

SEQ ID NO: 439372 - RNA, 27 nt, Human
uguaacagagcucagauuaacacaaga

SEQ ID NO: 439373 - RNA, 22 nt, Human
ugugaauugcuuaugacucuaa

SEQ ID NO: 439374 - RNA, 24 nt, Human
uuaguuguguugucugugugaauu

SEQ ID NO: 439375 - RNA, 24 nt, Human
uuccuuagcagccuuuugugacaa

SEQ ID NO: 439376 - RNA, 27 nt, Human
uuguuuuauccuccuuguugaaacuuc

SEQ ID NO: 439377 - RNA, 23 nt, Human
aaaaaaaaauccagauugauaca

SEQ ID NO: 439378 - RNA, 21 nt, Human
aaaacagcaucuccugauccc

SEQ ID NO: 439379 - RNA, 22 nt, Human
aaaacucuuucaauaaacacag

SEQ ID NO: 439380 - RNA, 22 nt, Human
aaaccucacuucuuuccaaaac

SEQ ID NO: 439381 - RNA, 21 nt, Human
aaauacagcaaggcacacuuu

SEQ ID NO: 439382 - RNA, 18 nt, Human
aacaguuugccuuaacag

SEQ ID NO: 439383 - RNA, 19 nt, Human
aaccagaggccagcccagg

SEQ ID NO: 439384 - RNA, 25 nt, Human
aacggcagugacaaacgugauggaa

SEQ ID NO: 439385 - RNA, 20 nt, Human
aacuuuccacucucugcaag

SEQ ID NO: 439386 - RNA, 18 nt, Human
aagauaaucugggcugcu

SEQ ID NO: 439387 - RNA, 24 nt, Human
aauaaaugguauaagaaauacagc

SEQ ID NO: 439388 - RNA, 23 nt, Human
aauucaguaaauuuuuauugaau

SEQ ID NO: 439389 - RNA, 22 nt, Human
acaauaauagaauaaacauauc

SEQ ID NO: 439390 - RNA, 24 nt, Human
acagccuucugagggcagggcuuu

SEQ ID NO: 439391 - RNA, 20 nt, Human
acauggggugggagauugag

SEQ ID NO: 439392 - RNA, 18 nt, Human
accaugucaccuaauuua

SEQ ID NO: 439393 - RNA, 22 nt, Human
accucacuucuuuccaaaacag

SEQ ID NO: 439394 - RNA, 22 nt, Human
acuaccuauuaagaagccuaga

SEQ ID NO: 439395 - RNA, 23 nt, Human
agaaagaacuuucuaacaaagag

SEQ ID NO: 439396 - RNA, 19 nt, Human
agacaggagaauuuaaugg

SEQ ID NO: 439397 - RNA, 21 nt, Human
agaugaugaguaacuggccuu

SEQ ID NO: 439398 - RNA, 22 nt, Human
agggaagggaggaggcaaagag

SEQ ID NO: 439399 - RNA, 18 nt, Human
agggauagaugucaccau

SEQ ID NO: 439400 - RNA, 18 nt, Human
auacauauauacagaaau

SEQ ID NO: 439401 - RNA, 21 nt, Human
auucaaauguuggcuuuuuag

SEQ ID NO: 439402 - RNA, 19 nt, Human
auuccacuaacuuuccacu

SEQ ID NO: 439403 - RNA, 22 nt, Human
auucuagacaggagaauuuaau

SEQ ID NO: 439404 - RNA, 22 nt, Human
caaaacagcaucuccugauccc

SEQ ID NO: 439405 - RNA, 20 nt, Human
caaccaauucaaauguuggc

SEQ ID NO: 439406 - RNA, 19 nt, Human
caacuagaugucuggcuaa

SEQ ID NO: 439407 - RNA, 21 nt, Human
cacaucuuaaccuugcuauuu

SEQ ID NO: 439408 - RNA, 24 nt, Human
caccaugucaccuaauuuaauccu

SEQ ID NO: 439409 - RNA, 21 nt, Human
cagaaagauuuugaaaacuga

SEQ ID NO: 439410 - RNA, 19 nt, Human
cagcccagggcgggaggau

SEQ ID NO: 439411 - RNA, 20 nt, Human
cagccuucugagggcagggc

SEQ ID NO: 439412 - RNA, 21 nt, Human
caugaacccacaacauucuuu

SEQ ID NO: 439413 - RNA, 18 nt, Human
cccacaacauucuuuacc

SEQ ID NO: 439414 - RNA, 19 nt, Human
cccagggcgggaggaugag

SEQ ID NO: 439415 - RNA, 21 nt, Human
cccagggcgggaggaugaggc

SEQ ID NO: 439416 - RNA, 19 nt, Human
ccccugaguugcagccagg

SEQ ID NO: 439417 - RNA, 20 nt, Human
ccccugaguugcagccaggc

SEQ ID NO: 439418 - RNA, 21 nt, Human
ccuuccauuaaguccucccaa

SEQ ID NO: 439419 - RNA, 19 nt, Human
ccuuguacccacugcugcu

SEQ ID NO: 439420 - RNA, 18 nt, Human
cggcagugacaaacguga

SEQ ID NO: 439421 - RNA, 23 nt, Human
cuaaaccucacuucuuuccaaag

SEQ ID NO: 439422 - RNA, 22 nt, Human
cuaacuuuccacucucugcaag

SEQ ID NO: 439423 - RNA, 24 nt, Human
cuagacaggagaauuuaauggacu

SEQ ID NO: 439424 - RNA, 22 nt, Human
cucaagaagcauaaaaaaugaa

SEQ ID NO: 439425 - RNA, 20 nt, Human
cucuaugcugcaaccaauuc

SEQ ID NO: 439426 - RNA, 25 nt, Human
cuggcuaaaaccgcuuuugaacaaa

SEQ ID NO: 439427 - RNA, 21 nt, Human
cuguacuuuucuacuagcuuu

SEQ ID NO: 439428 - RNA, 20 nt, Human
cuuccaaccugaaaaggcau

SEQ ID NO: 439429 - RNA, 26 nt, Human
cuuccaaccugaaaaggcauuguuca

SEQ ID NO: 439430 - RNA, 22 nt, Human
cuugcuauuuccuccuuucaaa

SEQ ID NO: 439431 - RNA, 21 nt, Human
gaacugacauuuaaucauuug

SEQ ID NO: 439432 - RNA, 18 nt, Human
gaaggaccaguguuucuu

SEQ ID NO: 439433 - RNA, 22 nt, Human
gaagggaagggaggaggcaaag

SEQ ID NO: 439434 - RNA, 24 nt, Human
gaagggaagggaggaggcaaagag

SEQ ID NO: 439435 - RNA, 19 nt, Human
gaagggaggaggcaaagag

SEQ ID NO: 439436 - RNA, 21 nt, Human
gacaucacaaacaugaaagca

SEQ ID NO: 439437 - RNA, 18 nt, Human
gagaaaacacauuuggaa

SEQ ID NO: 439438 - RNA, 22 nt, Human
gauuuucaugcuuggggagggg

SEQ ID NO: 439439 - RNA, 18 nt, Human
gcaaaacagccuguacaa

SEQ ID NO: 439440 - RNA, 21 nt, Human
gcacacuuuuuuaaaaaacuu

SEQ ID NO: 439441 - RNA, 25 nt, Human
ggaaaagaucagaaggggcauaaaa

SEQ ID NO: 439442 - RNA, 21 nt, Human
ggaaguguguaggcagaguug

SEQ ID NO: 439443 - RNA, 18 nt, Human
ggcauuguucaacaaacc

SEQ ID NO: 439444 - RNA, 19 nt, Human
gugcaaaacagccuguaca

SEQ ID NO: 439445 - RNA, 22 nt, Human
uaaaaaaugaaaauguuguaca

SEQ ID NO: 439446 - RNA, 20 nt, Human
uaaaagaccuuccauuaagu

SEQ ID NO: 439447 - RNA, 22 nt, Human
uaaaauaaauuaagacauacaa

SEQ ID NO: 439448 - RNA, 18 nt, Human
uaaaauaauaccauaucc

SEQ ID NO: 439449 - RNA, 23 nt, Human
uaaaauaauaccauaucccaaca

SEQ ID NO: 439450 - RNA, 19 nt, Human
uaaagugguagaauuacag

SEQ ID NO: 439451 - RNA, 24 nt, Human
uaaauaaaaucaggugcaaaacag

SEQ ID NO: 439452 - RNA, 22 nt, Human
uaacaaauacuuucaauacugc

SEQ ID NO: 439453 - RNA, 19 nt, Human
uaaggguaauuggggaggu

SEQ ID NO: 439454 - RNA, 24 nt, Human
uaaucucuuucccccauaauccuc

SEQ ID NO: 439455 - RNA, 23 nt, Human
uaauucaauaguagaaugucacc

SEQ ID NO: 439456 - RNA, 20 nt, Human
uaccugaaauccaacauuaa

SEQ ID NO: 439457 - RNA, 22 nt, Human
uagaauaaacauaucuugaaua

SEQ ID NO: 439458 - RNA, 18 nt, Human
uagacaauuaucucuaau

SEQ ID NO: 439459 - RNA, 23 nt, Human
uagacaucacaaacaugaaagca

SEQ ID NO: 439460 - RNA, 25 nt, Human
uagcgggguacuaggcagauuuuaa

SEQ ID NO: 439461 - RNA, 22 nt, Human
uaggagaugccuuguuugaccu

SEQ ID NO: 439462 - RNA, 18 nt, Human
uaguauaaauguuuauug

SEQ ID NO: 439463 - RNA, 21 nt, Human
ucacacaucuuaaccuugcua

SEQ ID NO: 439464 - RNA, 21 nt, Human
ucacuggaaguguguaggcag

SEQ ID NO: 439465 - RNA, 21 nt, Human
ucacuucuuuccaaaacagca

SEQ ID NO: 439466 - RNA, 24 nt, Human
ucagucagguuggaauggaucuga

SEQ ID NO: 439467 - RNA, 26 nt, Human
ucagucagguuggaauggaucugaaa

SEQ ID NO: 439468 - RNA, 22 nt, Human
uccacaucacuagacaucacaa

SEQ ID NO: 439469 - RNA, 20 nt, Human
ucccccauaauccucuugaa

SEQ ID NO: 439470 - RNA, 18 nt, Human
uccuccuuguacccacug

SEQ ID NO: 439471 - RNA, 24 nt, Human
ucgcacuuaaauguucagauucuu

SEQ ID NO: 439472 - RNA, 26 nt, Human
ucuaaaccucacuucuuuccaaaaca

SEQ ID NO: 439473 - RNA, 18 nt, Human
ucuaaucucuuuccccca

SEQ ID NO: 439474 - RNA, 18 nt, Human
ucuaugcugcaaccaauu

SEQ ID NO: 439475 - RNA, 22 nt, Human
ucuaugcugcaaccaauucaaa

SEQ ID NO: 439476 - RNA, 25 nt, Human
ucuccugaucccaccgucuucuuuu

SEQ ID NO: 439477 - RNA, 26 nt, Human
ucuccugaucccaccgucuucuuuug

SEQ ID NO: 439478 - RNA, 18 nt, Human
ugaaagucauucuacaaa

SEQ ID NO: 439479 - RNA, 25 nt, Human
ugaaagucauucuacaaauuuagug

SEQ ID NO: 439480 - RNA, 24 nt, Human
ugacauuaguuacuacccaaagaa

SEQ ID NO: 439481 - RNA, 19 nt, Human
ugcaagcccuuuuucuucc

SEQ ID NO: 439482 - RNA, 25 nt, Human
ugcuccauaagacagaacaggguag

SEQ ID NO: 439483 - RNA, 20 nt, Human
ugcugcaaccaauucaaaug

SEQ ID NO: 439484 - RNA, 23 nt, Human
ugggagaagucaauguaauaaac

SEQ ID NO: 439485 - RNA, 18 nt, Human
uggggugggagauugagg

SEQ ID NO: 439486 - RNA, 19 nt, Human
uggggugggagauugaggc

SEQ ID NO: 439487 - RNA, 23 nt, Human
uguaaaauaauaccauaucccaa

SEQ ID NO: 439488 - RNA, 18 nt, Human
ugugacuuuauauugcau

SEQ ID NO: 439489 - RNA, 22 nt, Human
uuacuaccuauuaagaagccua

SEQ ID NO: 439490 - RNA, 21 nt, Human
uuagaaauuucaaagacucua

SEQ ID NO: 439491 - RNA, 21 nt, Human
uucaaaauaaauauuuaaaau

SEQ ID NO: 439492 - RNA, 20 nt, Human
uucaacaaaccugaaaguca

SEQ ID NO: 439493 - RNA, 21 nt, Human
uuccauuaaguccucccaauu

SEQ ID NO: 439494 - RNA, 24 nt, Human
uucuggaucuagaauagugccuug

SEQ ID NO: 439495 - RNA, 25 nt, Human
uugcauuguaccucuuucuaguugu

SEQ ID NO: 439496 - RNA, 23 nt, Human
uuuaaucauuugcuguuccaaga

SEQ ID NO: 439497 - RNA, 24 nt, Human
uuuacagcacaucuguaggaugca

SEQ ID NO: 439498 - RNA, 23 nt, Human
uuucaugaauauuccacuaacuu

SEQ ID NO: 439499 - RNA, 25 nt, Human
uuugauauauauuaucuauugugac

SEQ ID NO: 439500 - RNA, 18 nt, Human
aaaacacaaguguagcuc

SEQ ID NO: 439501 - RNA, 23 nt, Human
acgcugcaagucagucccuagac

SEQ ID NO: 439502 - RNA, 24 nt, Human
acgcugcaagucagucccuagacc

SEQ ID NO: 439503 - RNA, 20 nt, Human
acuugggccauucuucuuuc

SEQ ID NO: 439504 - RNA, 21 nt, Human
agaaauaucucacaacagcua

SEQ ID NO: 439505 - RNA, 18 nt, Human
agagggaagcagggaggc

SEQ ID NO: 439506 - RNA, 20 nt, Human
agcuacuuaauaagcugaaa

SEQ ID NO: 439507 - RNA, 21 nt, Human
aggagaagggaacuugcugcc

SEQ ID NO: 439508 - RNA, 23 nt, Human
agggauacgauaagaccuggagc

SEQ ID NO: 439509 - RNA, 22 nt, Human
agugaaaaaauagcuaaaaucc

SEQ ID NO: 439510 - RNA, 21 nt, Human
auagaaaagguugcauuucac

SEQ ID NO: 439511 - RNA, 20 nt, Human
auagcacagucugcgagcac

SEQ ID NO: 439512 - RNA, 27 nt, Human
auagcacagucugcgagcacacccugc

SEQ ID NO: 439513 - RNA, 24 nt, Human
caaacagaagcagugcaaacaaag

SEQ ID NO: 439514 - RNA, 23 nt, Human
caaagagcuacuuaauaagcuga

SEQ ID NO: 439515 - RNA, 24 nt, Human
caaauucucauuaaaaguaacacu

SEQ ID NO: 439516 - RNA, 24 nt, Human
caagucagucccuagacucagcag

SEQ ID NO: 439517 - RNA, 25 nt, Human
caagucagucccuagacucagcaga

SEQ ID NO: 439518 - RNA, 23 nt, Human
cacaacagcuaauuaagaaauca

SEQ ID NO: 439519 - RNA, 23 nt, Human
cacccugccuuuuucacuccacg

SEQ ID NO: 439520 - RNA, 19 nt, Human
cacugcauagcaacagcac

SEQ ID NO: 439521 - RNA, 19 nt, Human
cagcacaggcagcuugaag

SEQ ID NO: 439522 - RNA, 23 nt, Human
cagcacaggcagcuugaagagcc

SEQ ID NO: 439523 - RNA, 23 nt, Human
cauguauuccuuaagaaaugaaa

SEQ ID NO: 439524 - RNA, 23 nt, Human
ccagugaaaaaauagcuaaaauc

SEQ ID NO: 439525 - RNA, 23 nt, Human
cccaaauagaaauugcaguuuau

SEQ ID NO: 439526 - RNA, 19 nt, Human
ccccaaauagaaauugcag

SEQ ID NO: 439527 - RNA, 19 nt, Human
ccgugagcaaaaaaggcuc

SEQ ID NO: 439528 - RNA, 22 nt, Human
ccuagacucagcagagggaagc

SEQ ID NO: 439529 - RNA, 21 nt, Human
ccucagauaaaguagucaaau

SEQ ID NO: 439530 - RNA, 21 nt, Human
cuagacucagcagagggaagc

SEQ ID NO: 439531 - RNA, 24 nt, Human
cuccauuuuucuucuguuguguuu

SEQ ID NO: 439532 - RNA, 20 nt, Human
cugccagucccagcacucca

SEQ ID NO: 439533 - RNA, 23 nt, Human
cugccgugagcaaaaaaggcucc

SEQ ID NO: 439534 - RNA, 19 nt, Human
cuguuguuggcucuguuuu

SEQ ID NO: 439535 - RNA, 19 nt, Human
gagagaaaggagaagggaa

SEQ ID NO: 439536 - RNA, 22 nt, Human
gcaccagagaaacuuaacuuaa

SEQ ID NO: 439537 - RNA, 20 nt, Human
gcagcacaggcagcuugaag

SEQ ID NO: 439538 - RNA, 22 nt, Human
gcguccaggaggcauaacccaa

SEQ ID NO: 439539 - RNA, 18 nt, Human
gggaggcuuugcacagag

SEQ ID NO: 439540 - RNA, 18 nt, Human
guaguauaauuuacccag

SEQ ID NO: 439541 - RNA, 20 nt, Human
guauuccuuaagaaaugaaa

SEQ ID NO: 439542 - RNA, 21 nt, Human
guggcugagggcgaaugaaac

SEQ ID NO: 439543 - RNA, 18 nt, Human
uaaaaaauaaaaauccca

SEQ ID NO: 439544 - RNA, 20 nt, Human
uaaaaaauaaaaaucccaaa

SEQ ID NO: 439545 - RNA, 20 nt, Human
uaaaacacaaguguagcuca

SEQ ID NO: 439546 - RNA, 18 nt, Human
uaacccaaaguucccuuu

SEQ ID NO: 439547 - RNA, 22 nt, Human
uaagcugaaaagauuucauaag

SEQ ID NO: 439548 - RNA, 23 nt, Human
uaagcugaaaagauuucauaagc

SEQ ID NO: 439549 - RNA, 22 nt, Human
uacccagugaaaaaauagcuaa

SEQ ID NO: 439550 - RNA, 24 nt, Human
uagcacagucugcgagcacacccu

SEQ ID NO: 439551 - RNA, 23 nt, Human
uagcucaaaaaauaauugggcag

SEQ ID NO: 439552 - RNA, 18 nt, Human
uauuacagaaacagauau

SEQ ID NO: 439553 - RNA, 18 nt, Human
ucaaaguugugcugaaau

SEQ ID NO: 439554 - RNA, 19 nt, Human
uccaugaguaaacuggauu

SEQ ID NO: 439555 - RNA, 23 nt, Human
uccauuuuucuucuguuguguuu

SEQ ID NO: 439556 - RNA, 21 nt, Human
ucuaaaacacaaguguagcuc

SEQ ID NO: 439557 - RNA, 25 nt, Human
ucuccagugauuuccccuucccaag

SEQ ID NO: 439558 - RNA, 26 nt, Human
ucuccgugaggaccccaaauagaaau

SEQ ID NO: 439559 - RNA, 20 nt, Human
ucugucuuuccugguguucu

SEQ ID NO: 439560 - RNA, 21 nt, Human
ugaaaaaauagcuaaaaucca

SEQ ID NO: 439561 - RNA, 22 nt, Human
ugaaaaaauagcuaaaauccau

SEQ ID NO: 439562 - RNA, 24 nt, Human
ugaaaaaauagcuaaaauccauga

SEQ ID NO: 439563 - RNA, 18 nt, Human
ugaaaaagcagaacaaca

SEQ ID NO: 439564 - RNA, 19 nt, Human
ugaaaaagcagaacaacau

SEQ ID NO: 439565 - RNA, 25 nt, Human
ugaaacauaauuuacuauaaauaaa

SEQ ID NO: 439566 - RNA, 25 nt, Human
ugaggaccccaaauagaaauugcag

SEQ ID NO: 439567 - RNA, 24 nt, Human
ugagggcgaaugaaacuugggcca

SEQ ID NO: 439568 - RNA, 19 nt, Human
ugaucuacuccaucaauga

SEQ ID NO: 439569 - RNA, 21 nt, Human
ugaucuccagugauuuccccu

SEQ ID NO: 439570 - RNA, 18 nt, Human
ugcaaacaaguucagaug

SEQ ID NO: 439571 - RNA, 18 nt, Human
ugcacagagacauggggg

SEQ ID NO: 439572 - RNA, 23 nt, Human
ugcguccaggaggcauaacccaa

SEQ ID NO: 439573 - RNA, 25 nt, Human
uggcaaggccucuuucucggccuuu

SEQ ID NO: 439574 - RNA, 22 nt, Human
uggcauacugacuuaucaaaau

SEQ ID NO: 439575 - RNA, 25 nt, Human
uguaguauaauuuacccagugaaaa

SEQ ID NO: 439576 - RNA, 24 nt, Human
ugucugucuuuccugguguucuuc

SEQ ID NO: 439577 - RNA, 21 nt, Human
uuaaaaaaacuuuaaaauguu

SEQ ID NO: 439578 - RNA, 19 nt, Human
uuacauauuugaucuccag

SEQ ID NO: 439579 - RNA, 22 nt, Human
uucccuugugcguggcugaggg

SEQ ID NO: 439580 - RNA, 23 nt, Human
uuccuucaaaaagcucccuccua

SEQ ID NO: 439581 - RNA, 20 nt, Human
uucucauuaaaaguaacacu

SEQ ID NO: 439582 - RNA, 19 nt, Human
uucucgaugcaaagcuuca

SEQ ID NO: 439583 - RNA, 22 nt, Human
uucuuuggcaagaaauugcuaa

SEQ ID NO: 439584 - RNA, 24 nt, Human
uucuuugguguuuaccaaagagcu

SEQ ID NO: 439585 - RNA, 22 nt, Human
uugcugccgugagcaaaaaagg

SEQ ID NO: 439586 - RNA, 18 nt, Human
uuugaucagugaaaaaua

SEQ ID NO: 439587 - RNA, 19 nt, Human
uuuuuuuuuuuucaaggga

SEQ ID NO: 439588 - RNA, 24 nt, Human
uuuuuuuuuuuuuuuuuuucaagg

SEQ ID NO: 439589 - RNA, 18 nt, Human
aaaggaaaaaaaccugaa

SEQ ID NO: 439590 - RNA, 18 nt, Human
aaggaaaaaaauaaaaaa

SEQ ID NO: 439591 - RNA, 18 nt, Human
aagugcugggauuauagg

SEQ ID NO: 439592 - RNA, 18 nt, Human
aagugcugggauuauagg

SEQ ID NO: 439593 - RNA, 21 nt, Human
accacggccuccccaagugcu

SEQ ID NO: 439594 - RNA, 23 nt, Human
acuucagcuuugaaaccugggca

SEQ ID NO: 439595 - RNA, 18 nt, Human
agaaugugcuuggugagu

SEQ ID NO: 439596 - RNA, 21 nt, Human
agagauggggucuugcuaugu

SEQ ID NO: 439597 - RNA, 22 nt, Human
agauaccuucuaucuauggcaa

SEQ ID NO: 439598 - RNA, 22 nt, Human
agcaaggacuaaagauugggac

SEQ ID NO: 439599 - RNA, 19 nt, Human
agcauuccaucaguggcug

SEQ ID NO: 439600 - RNA, 22 nt, Human
agccacacgacugcaugagaca

SEQ ID NO: 439601 - RNA, 20 nt, Human
agccgcuaaggacaauguac

SEQ ID NO: 439602 - RNA, 21 nt, Human
aguauucagcuguucccaacc

SEQ ID NO: 439603 - RNA, 20 nt, Human
auagagcaagauauauuccu

SEQ ID NO: 439604 - RNA, 23 nt, Human
aucaaguuuucuuuccuuuuuuu

SEQ ID NO: 439605 - RNA, 18 nt, Human
augcaucaccgugccugg

SEQ ID NO: 439606 - RNA, 18 nt, Human
augugcuuggugaguuag

SEQ ID NO: 439607 - RNA, 24 nt, Human
caaaaaaaaauccucuauagagca

SEQ ID NO: 439608 - RNA, 19 nt, Human
caagaagccacacgacugc

SEQ ID NO: 439609 - RNA, 19 nt, Human
caagugcugggauuauagg

SEQ ID NO: 439610 - RNA, 19 nt, Human
caccuauggcaaucacauc

SEQ ID NO: 439611 - RNA, 24 nt, Human
caccuggaaucuccacuaaggcuc

SEQ ID NO: 439612 - RNA, 20 nt, Human
cagcaaggacuaaagauugg

SEQ ID NO: 439613 - RNA, 24 nt, Human
cagcagggccauuucaaaagggga

SEQ ID NO: 439614 - RNA, 21 nt, Human
caucccaacgccuucccugga

SEQ ID NO: 439615 - RNA, 22 nt, Human
caugcuagccucccuuucucag

SEQ ID NO: 439616 - RNA, 18 nt, Human
ccaacgcauccaucaucc

SEQ ID NO: 439617 - RNA, 20 nt, Human
ccaagugcugggauuauagg

SEQ ID NO: 439618 - RNA, 20 nt, Human
ccaagugcugggauuauagg

SEQ ID NO: 439619 - RNA, 24 nt, Human
ccaagugcugggauuauagguaug

SEQ ID NO: 439620 - RNA, 18 nt, Human
ccacaugugaaccaggug

SEQ ID NO: 439621 - RNA, 20 nt, Human
ccacggccuccccaagugcu

SEQ ID NO: 439622 - RNA, 18 nt, Human
ccaguggccagcguuucc

SEQ ID NO: 439623 - RNA, 18 nt, Human
cccaagugcugggauuau

SEQ ID NO: 439624 - RNA, 24 nt, Human
cccaagugcugggauuauagguau

SEQ ID NO: 439625 - RNA, 22 nt, Human
ccccaagugcugggauuauagg

SEQ ID NO: 439626 - RNA, 21 nt, Human
ccccugguauacaguagaggc

SEQ ID NO: 439627 - RNA, 22 nt, Human
ccucaugagcagggcccaauuc

SEQ ID NO: 439628 - RNA, 18 nt, Human
ccugaaguaaucuagagg

SEQ ID NO: 439629 - RNA, 18 nt, Human
cgacugcaugagacaagc

SEQ ID NO: 439630 - RNA, 23 nt, Human
cgcuaaggacaauguacuucagc

SEQ ID NO: 439631 - RNA, 21 nt, Human
cuaaggacaauguacuucagc

SEQ ID NO: 439632 - RNA, 23 nt, Human
cuccugggcuuaagcuauccucu

SEQ ID NO: 439633 - RNA, 20 nt, Human
cugaagcuugaaacauacaa

SEQ ID NO: 439634 - RNA, 24 nt, Human
cugcuuacaaaccaagggagaaag

SEQ ID NO: 439635 - RNA, 21 nt, Human
cugggauuauagguaugcauc

SEQ ID NO: 439636 - RNA, 22 nt, Human
cuucugauuuuaggaaauucug

SEQ ID NO: 439637 - RNA, 24 nt, Human
gaaaaaaauaaaaaaggaagccgg

SEQ ID NO: 439638 - RNA, 18 nt, Human
gagcagggcccaauuccu

SEQ ID NO: 439639 - RNA, 20 nt, Human
gauauaaucacccaaccuuu

SEQ ID NO: 439640 - RNA, 22 nt, Human
gccauuucaaaaggggaggauc

SEQ ID NO: 439641 - RNA, 22 nt, Human
gggucuugcuauguuguccagg

SEQ ID NO: 439642 - RNA, 22 nt, Human
uacuucagcuuugaaaccuggg

SEQ ID NO: 439643 - RNA, 24 nt, Human
uaggaaauucuguugcgugcuaac

SEQ ID NO: 439644 - RNA, 19 nt, Human
uauauuacagauaccuucu

SEQ ID NO: 439645 - RNA, 24 nt, Human
uauguuguccagguuggucuugaa

SEQ ID NO: 439646 - RNA, 19 nt, Human
uauuagagaacugauucag

SEQ ID NO: 439647 - RNA, 23 nt, Human
uauuagagaacugauucaggauu

SEQ ID NO: 439648 - RNA, 20 nt, Human
uauuccaagugcacuacugu

SEQ ID NO: 439649 - RNA, 20 nt, Human
uauuucucuaaaaugaaaca

SEQ ID NO: 439650 - RNA, 21 nt, Human
uccaucaucccaacgccuucc

SEQ ID NO: 439651 - RNA, 23 nt, Human
uccccaagugcugggauuauagg

SEQ ID NO: 439652 - RNA, 20 nt, Human
ucggucagauacuucuggcc

SEQ ID NO: 439653 - RNA, 19 nt, Human
ucucaccacggccucccca

SEQ ID NO: 439654 - RNA, 21 nt, Human
ucugguucuugagguugcggu

SEQ ID NO: 439655 - RNA, 23 nt, Human
ucuugaacuccugggcuuaagcu

SEQ ID NO: 439656 - RNA, 19 nt, Human
ucuugcuauguuguccagg

SEQ ID NO: 439657 - RNA, 22 nt, Human
ucuugcuauguuguccagguug

SEQ ID NO: 439658 - RNA, 23 nt, Human
ucuugcuauguuguccagguugg

SEQ ID NO: 439659 - RNA, 24 nt, Human
ucuugcuauguuguccagguuggu

SEQ ID NO: 439660 - RNA, 25 nt, Human
ucuuuccuuuuuuuuuaagagaugg

SEQ ID NO: 439661 - RNA, 20 nt, Human
uggaaagaucuaaaguaaua

SEQ ID NO: 439662 - RNA, 20 nt, Human
uggccuuugggagugcgugg

SEQ ID NO: 439663 - RNA, 23 nt, Human
uggcuguauugaacaaguaaugu

SEQ ID NO: 439664 - RNA, 21 nt, Human
ugggagugcguggaugugacg

SEQ ID NO: 439665 - RNA, 18 nt, Human
ugggauuauagguaugca

SEQ ID NO: 439666 - RNA, 22 nt, Human
ugggauuauagguaugcaucaa

SEQ ID NO: 439667 - RNA, 24 nt, Human
uggggucuugcuauguuguccagg

SEQ ID NO: 439668 - RNA, 19 nt, Human
uggguguguuuccaguggc

SEQ ID NO: 439669 - RNA, 24 nt, Human
uguccagguuggucuugaacuccu

SEQ ID NO: 439670 - RNA, 22 nt, Human
uuacuaggcgaccacagcacgc

SEQ ID NO: 439671 - RNA, 20 nt, Human
uucaaaaggccacagggaaa

SEQ ID NO: 439672 - RNA, 25 nt, Human
uucauuuuauauauauauauauauu

SEQ ID NO: 439673 - RNA, 20 nt, Human
uucccaaccaaauaaaaaaa

SEQ ID NO: 439674 - RNA, 21 nt, Human
uuugaaaccugggcaagaagc

SEQ ID NO: 439675 - RNA, 20 nt, Human
uuuuuucuuuucaagcaguu

SEQ ID NO: 439676 - RNA, 24 nt, Human
uuuuuuuuuuuuuuucuuuucaag

SEQ ID NO: 439677 - RNA, 27 nt, Human
aauacaaaagcacaaaagaaccauuga

SEQ ID NO: 439678 - RNA, 23 nt, Human
acaaaaggaaaucuauuuaaaau

SEQ ID NO: 439679 - RNA, 18 nt, Human
acaauacaaaagcacaaa

SEQ ID NO: 439680 - RNA, 26 nt, Human
accccauaaaauucaaaacuucuacc

SEQ ID NO: 439681 - RNA, 20 nt, Human
aggcaggggaaaacaggggu

SEQ ID NO: 439682 - RNA, 20 nt, Human
aguagccuuauaagaaaagu

SEQ ID NO: 439683 - RNA, 22 nt, Human
auacauacacaaugcuuauaua

SEQ ID NO: 439684 - RNA, 20 nt, Human
caccgccgccgccgccgcca

SEQ ID NO: 439685 - RNA, 20 nt, Human
caccgccgccgccgccgcca

SEQ ID NO: 439686 - RNA, 18 nt, Human
cauguaacuucaguagcc

SEQ ID NO: 439687 - RNA, 21 nt, Human
cauguaacuucaguagccuua

SEQ ID NO: 439688 - RNA, 20 nt, Human
ccauuugauaaauacacaag

SEQ ID NO: 439689 - RNA, 18 nt, Human
ccgccgccgccgccgcca

SEQ ID NO: 439690 - RNA, 26 nt, Human
cgaaguggaagcagucuccgcgcuca

SEQ ID NO: 439691 - RNA, 24 nt, Human
cgccgucaccgccgccgccgccgg

SEQ ID NO: 439692 - RNA, 24 nt, Human
cuggcggaucguccucagccgcac

SEQ ID NO: 439693 - RNA, 24 nt, Human
cuuauaagaaaagugcaggacacc

SEQ ID NO: 439694 - RNA, 21 nt, Human
ggcaaaacauguaacuucagu

SEQ ID NO: 439695 - RNA, 20 nt, Human
guuggggauagaaaggaaag

SEQ ID NO: 439696 - RNA, 27 nt, Human
uacacaaugcuuauauauacaaauucc

SEQ ID NO: 439697 - RNA, 24 nt, Human
uagccuuauaagaaaagugcagga

SEQ ID NO: 439698 - RNA, 18 nt, Human
uauuaggcaaaacaugua

SEQ ID NO: 439699 - RNA, 18 nt, Human
ucacaauacaaaagcaca

SEQ ID NO: 439700 - RNA, 26 nt, Human
ucaguacuugacaaaauaccccauaa

SEQ ID NO: 439701 - RNA, 21 nt, Human
ucccccgcccgaaguggaagc

SEQ ID NO: 439702 - RNA, 29 nt, Human
ugaauacauacacaaugcuuauauauaca

SEQ ID NO: 439703 - RNA, 23 nt, Human
ugaauauucacaauacaaaagca

SEQ ID NO: 439704 - RNA, 20 nt, Human
ugaggggugguuggggauag

SEQ ID NO: 439705 - RNA, 19 nt, Human
ugcaaggaaggcaggggaa

SEQ ID NO: 439706 - RNA, 26 nt, Human
ugcaugaauacauacacaaugcuuau

SEQ ID NO: 439707 - RNA, 21 nt, Human
uggcaagggauuuguauacaa

SEQ ID NO: 439708 - RNA, 24 nt, Human
uggcaagggauuuguauacaauca

SEQ ID NO: 439709 - RNA, 21 nt, Human
uucaugugcuggcaagggauu

SEQ ID NO: 439710 - RNA, 25 nt, Human
aaacggaacagauuuuuaaaggcaa

SEQ ID NO: 439711 - RNA, 19 nt, Human
aagaacaaaguaauagcca

SEQ ID NO: 439712 - RNA, 23 nt, Human
acaucuuuauagcaaauugaaaa

SEQ ID NO: 439713 - RNA, 22 nt, Human
accauguuccacaaugcuggaa

SEQ ID NO: 439714 - RNA, 20 nt, Human
agaaaaaccagcaaguagau

SEQ ID NO: 439715 - RNA, 24 nt, Human
agaacuccuucaggaaacucacuu

SEQ ID NO: 439716 - RNA, 18 nt, Human
agaagaaaagggaaauaa

SEQ ID NO: 439717 - RNA, 18 nt, Human
agcgccacuagcaggcgg

SEQ ID NO: 439718 - RNA, 19 nt, Human
aguaccugggaaaaaaacg

SEQ ID NO: 439719 - RNA, 20 nt, Human
aguguaaaggcagcagugaa

SEQ ID NO: 439720 - RNA, 19 nt, Human
agugucucaccauguucca

SEQ ID NO: 439721 - RNA, 22 nt, Human
auagaguucuuucuccuuaaaa

SEQ ID NO: 439722 - RNA, 18 nt, Human
aucaaguuuuuccuccau

SEQ ID NO: 439723 - RNA, 22 nt, Human
auccuuaguauccaaaauaaaa

SEQ ID NO: 439724 - RNA, 22 nt, Human
caaacgaugcaucuuaguaucc

SEQ ID NO: 439725 - RNA, 25 nt, Human
caaaguaauagccacaguuaugaaa

SEQ ID NO: 439726 - RNA, 18 nt, Human
caagaacaaaguaauagc

SEQ ID NO: 439727 - RNA, 23 nt, Human
cacacaguacaucagcaaccauc

SEQ ID NO: 439728 - RNA, 20 nt, Human
caccgcgcggguaccagggc

SEQ ID NO: 439729 - RNA, 25 nt, Human
cacuuguauuuuaaguaccugggaa

SEQ ID NO: 439730 - RNA, 20 nt, Human
caggaacaaagaacuccuuc

SEQ ID NO: 439731 - RNA, 20 nt, Human
caggcaugccucaucuauuu

SEQ ID NO: 439732 - RNA, 23 nt, Human
caggcggcuacugcgguuccccg

SEQ ID NO: 439733 - RNA, 22 nt, Human
ccaagaacaaaguaauagccac

SEQ ID NO: 439734 - RNA, 20 nt, Human
ccagaccacacaguacauca

SEQ ID NO: 439735 - RNA, 18 nt, Human
cccacuucuaccagacca

SEQ ID NO: 439736 - RNA, 20 nt, Human
ccccaaaacacauaagaacc

SEQ ID NO: 439737 - RNA, 20 nt, Human
ccccaaaacacauaagaacc

SEQ ID NO: 439738 - RNA, 22 nt, Human
ccccccaaaacacauaagaacc

SEQ ID NO: 439739 - RNA, 20 nt, Human
ccgaaucauuuggcacaucc

SEQ ID NO: 439740 - RNA, 22 nt, Human
ccuaaaacacauuucuuaaccu

SEQ ID NO: 439741 - RNA, 24 nt, Human
ccuccaucucucauauuuccccac

SEQ ID NO: 439742 - RNA, 23 nt, Human
ccugggaaaaaaacggaacagau

SEQ ID NO: 439743 - RNA, 23 nt, Human
cggguuucucuuuuuucuucucu

SEQ ID NO: 439744 - RNA, 18 nt, Human
cuaaaacacauuucuuaa

SEQ ID NO: 439745 - RNA, 19 nt, Human
cucuuuuuucuucucuuuu

SEQ ID NO: 439746 - RNA, 21 nt, Human
gaacaaagaacuccuucagga

SEQ ID NO: 439747 - RNA, 18 nt, Human
gacaccaauagaguucuu

SEQ ID NO: 439748 - RNA, 21 nt, Human
gcaaguagauccuaaaacaca

SEQ ID NO: 439749 - RNA, 22 nt, Human
gcaaguagauccuaaaacacau

SEQ ID NO: 439750 - RNA, 19 nt, Human
gcgcggguaccagggcuuu

SEQ ID NO: 439751 - RNA, 20 nt, Human
gcugcucagacgacaccaau

SEQ ID NO: 439752 - RNA, 20 nt, Human
ggaacagauuuuuaaaggca

SEQ ID NO: 439753 - RNA, 19 nt, Human
ggcaauaacgacuuguaag

SEQ ID NO: 439754 - RNA, 19 nt, Human
ggcagaucacacauuugga

SEQ ID NO: 439755 - RNA, 24 nt, Human
gucaucuuaaaguaauauuuuucu

SEQ ID NO: 439756 - RNA, 19 nt, Human
gugaaggaccaagaacaaa

SEQ ID NO: 439757 - RNA, 20 nt, Human
guucagacaucgcugauguu

SEQ ID NO: 439758 - RNA, 20 nt, Human
uaaaaucaguagaaauaaaa

SEQ ID NO: 439759 - RNA, 23 nt, Human
uaaacugaaaguaugcuuaacga

SEQ ID NO: 439760 - RNA, 24 nt, Human
uaaccuagugauaauccauaaguu

SEQ ID NO: 439761 - RNA, 27 nt, Human
uaccaaaugcucuuuuaauuuugcucu

SEQ ID NO: 439762 - RNA, 22 nt, Human
uacugcgguuccccggcguucc

SEQ ID NO: 439763 - RNA, 19 nt, Human
ucagaagaaaagggaaaua

SEQ ID NO: 439764 - RNA, 23 nt, Human
uccuuaguauccaaaauaaaauc

SEQ ID NO: 439765 - RNA, 21 nt, Human
ucuccuuaaaauaugguggca

SEQ ID NO: 439766 - RNA, 23 nt, Human
ucucucauauuuccccacuucua

SEQ ID NO: 439767 - RNA, 22 nt, Human
ucuuucuggaauuuuauauagu

SEQ ID NO: 439768 - RNA, 22 nt, Human
ucuuugaucaggaacaaagaac

SEQ ID NO: 439769 - RNA, 18 nt, Human
ugacacaaaucauaaccc

SEQ ID NO: 439770 - RNA, 19 nt, Human
ugaggcccgcaccgcgcgg

SEQ ID NO: 439771 - RNA, 22 nt, Human
ugagucauaacugaaaacauag

SEQ ID NO: 439772 - RNA, 20 nt, Human
ugauguuuuugaggauaacu

SEQ ID NO: 439773 - RNA, 20 nt, Human
ugcauacaacacacuagaug

SEQ ID NO: 439774 - RNA, 23 nt, Human
ugggaaaaaaacggaacagauuu

SEQ ID NO: 439775 - RNA, 18 nt, Human
uguaaauccaguugcuuu

SEQ ID NO: 439776 - RNA, 18 nt, Human
ugucucacaauaaaucug

SEQ ID NO: 439777 - RNA, 22 nt, Human
uuaguguaaaggcagcagugaa

SEQ ID NO: 439778 - RNA, 24 nt, Human
uuaguguaaaggcagcagugaauu

SEQ ID NO: 439779 - RNA, 18 nt, Human
uucaaaggaaacaaguca

SEQ ID NO: 439780 - RNA, 19 nt, Human
uucaaaggaaacaagucau

SEQ ID NO: 439781 - RNA, 20 nt, Human
uucaaaggaaacaagucauc

SEQ ID NO: 439782 - RNA, 22 nt, Human
uuccccccaaaacacauaagaa

SEQ ID NO: 439783 - RNA, 19 nt, Human
uuucaaaggaaacaaguca

SEQ ID NO: 439784 - RNA, 19 nt, Human
uuucaaaggaaacaaguca

SEQ ID NO: 439785 - RNA, 24 nt, Human
uuuggcacauccuuaguauccaaa

SEQ ID NO: 439786 - RNA, 18 nt, Human
aagaaagagaaucuccug

SEQ ID NO: 439787 - RNA, 18 nt, Human
aguagcugggauuacagg

SEQ ID NO: 439788 - RNA, 22 nt, Human
agucuugcacuguugccaaggc

SEQ ID NO: 439789 - RNA, 21 nt, Human
agugcaguggugcgaucucag

SEQ ID NO: 439790 - RNA, 23 nt, Human
agugcaguggugcgaucucagcu

SEQ ID NO: 439791 - RNA, 24 nt, Human
agugcaguggugcgaucucagcuc

SEQ ID NO: 439792 - RNA, 21 nt, Human
auucuccugccucagccuccc

SEQ ID NO: 439793 - RNA, 21 nt, Human
caaacuccugagcucaggccu

SEQ ID NO: 439794 - RNA, 22 nt, Human
caagcaauucuccugccucagc

SEQ ID NO: 439795 - RNA, 23 nt, Human
cacuacaaccucugucuccuggg

SEQ ID NO: 439796 - RNA, 21 nt, Human
caggcgcccaccgugacuccc

SEQ ID NO: 439797 - RNA, 23 nt, Human
cccgaguagcugggauuacaggc

SEQ ID NO: 439798 - RNA, 24 nt, Human
cccgaguagcugggauuacaggcg

SEQ ID NO: 439799 - RNA, 22 nt, Human
ccgaguagcugggauuacaggc

SEQ ID NO: 439800 - RNA, 23 nt, Human
ccugccucagccucccgaguagc

SEQ ID NO: 439801 - RNA, 24 nt, Human
ccugccucagccucccgaguagcu

SEQ ID NO: 439802 - RNA, 23 nt, Human
ccuggguucaagcaauucuccug

SEQ ID NO: 439803 - RNA, 20 nt, Human
cgaagaaagagaaucuccug

SEQ ID NO: 439804 - RNA, 21 nt, Human
cuacaaccucugucuccuggg

SEQ ID NO: 439805 - RNA, 23 nt, Human
cuacaaccucugucuccuggguu

SEQ ID NO: 439806 - RNA, 24 nt, Human
cuacaaccucugucuccuggguuc

SEQ ID NO: 439807 - RNA, 24 nt, Human
cucacuacaaccucugucuccugg

SEQ ID NO: 439808 - RNA, 24 nt, Human
cucagccucccgaguagcugggau

SEQ ID NO: 439809 - RNA, 21 nt, Human
cuccuggguucaagcaauucu

SEQ ID NO: 439810 - RNA, 21 nt, Human
cucucuguugcuguuuuugag

SEQ ID NO: 439811 - RNA, 19 nt, Human
cuugcacuguugccaaggc

SEQ ID NO: 439812 - RNA, 22 nt, Human
gagacagucuugcacuguugcc

SEQ ID NO: 439813 - RNA, 25 nt, Human
gaguagcugggauuacaggcgccca

SEQ ID NO: 439814 - RNA, 21 nt, Human
gaucuuaaauaagcuuggcua

SEQ ID NO: 439815 - RNA, 28 nt, Human
ggacuaaguucacugugaucuuaaauaa

SEQ ID NO: 439816 - RNA, 18 nt, Human
guagcugggauuacaggc

SEQ ID NO: 439817 - RNA, 23 nt, Human
uaaaacagcaccucgauucucgu

SEQ ID NO: 439818 - RNA, 23 nt, Human
uaaauaagcuuggcuaaaauggg

SEQ ID NO: 439819 - RNA, 24 nt, Human
uaauuuuuauauuguuaguagaga

SEQ ID NO: 439820 - RNA, 23 nt, Human
uagagugcaguggugcgaucuca

SEQ ID NO: 439821 - RNA, 24 nt, Human
uagagugcaguggugcgaucucag

SEQ ID NO: 439822 - RNA, 25 nt, Human
uaguagagacaggcuggucucaaac

SEQ ID NO: 439823 - RNA, 18 nt, Human
uauauuguuaguagagac

SEQ ID NO: 439824 - RNA, 19 nt, Human
ucaagcaauucuccugccu

SEQ ID NO: 439825 - RNA, 19 nt, Human
ucaagccaugcuuuucugu

SEQ ID NO: 439826 - RNA, 24 nt, Human
ucacuacaaccucugucuccuggg

SEQ ID NO: 439827 - RNA, 25 nt, Human
ucacuacaaccucugucuccugggu

SEQ ID NO: 439828 - RNA, 20 nt, Human
ucagccucccgaguagcugg

SEQ ID NO: 439829 - RNA, 24 nt, Human
ucccgaguagcugggauuacaggc

SEQ ID NO: 439830 - RNA, 19 nt, Human
uccugcucucuguugcugu

SEQ ID NO: 439831 - RNA, 21 nt, Human
uccuggguucaagcaauucuc

SEQ ID NO: 439832 - RNA, 24 nt, Human
uccuggguucaagcaauucuccug

SEQ ID NO: 439833 - RNA, 23 nt, Human
ucuaaaacagcaccucgauucuc

SEQ ID NO: 439834 - RNA, 23 nt, Human
ucucaaacuccugagcucaggcc

SEQ ID NO: 439835 - RNA, 25 nt, Human
ucucaaacuccugagcucaggccuc

SEQ ID NO: 439836 - RNA, 24 nt, Human
ucuccugccucagccucccgagua

SEQ ID NO: 439837 - RNA, 24 nt, Human
ucuccuggguucaagcaauucucc

SEQ ID NO: 439838 - RNA, 24 nt, Human
ucugucuccuggguucaagcaauu

SEQ ID NO: 439839 - RNA, 18 nt, Human
ugagcucaggccucgugc

SEQ ID NO: 439840 - RNA, 23 nt, Human
ugaguggagguagucacacuuca

SEQ ID NO: 439841 - RNA, 24 nt, Human
ugcacuguugccaaggcuagagug

SEQ ID NO: 439842 - RNA, 22 nt, Human
ugcaguggugcgaucucagcuc

SEQ ID NO: 439843 - RNA, 24 nt, Human
ugccaaggcuagagugcaguggug

SEQ ID NO: 439844 - RNA, 24 nt, Human
ugccucagccucccgaguagcugg

SEQ ID NO: 439845 - RNA, 18 nt, Human
ugggacaugaguggaggu

SEQ ID NO: 439846 - RNA, 20 nt, Human
ugggauuacaggcgcccacc

SEQ ID NO: 439847 - RNA, 20 nt, Human
ugggauuacaggcgcccacc

SEQ ID NO: 439848 - RNA, 21 nt, Human
ugggauuacaggcgcccaccg

SEQ ID NO: 439849 - RNA, 21 nt, Human
uggguucaagcaauucuccug

SEQ ID NO: 439850 - RNA, 23 nt, Human
uggguucaagcaauucuccugcc

SEQ ID NO: 439851 - RNA, 24 nt, Human
uggguucaagcaauucuccugccu

SEQ ID NO: 439852 - RNA, 19 nt, Human
uggugcagaaaugauucug

SEQ ID NO: 439853 - RNA, 24 nt, Human
uggugcgaucucagcucacuacaa

SEQ ID NO: 439854 - RNA, 21 nt, Human
uucaagcaauucuccugccuc

SEQ ID NO: 439855 - RNA, 24 nt, Human
uucaagcaauucuccugccucagc

SEQ ID NO: 439856 - RNA, 20 nt, Human
uugagacagucuugcacugu

SEQ ID NO: 439857 - RNA, 24 nt, Human
uugagacagucuugcacuguugcc

SEQ ID NO: 439858 - RNA, 22 nt, Human
uuggugcagaaaugauucugag

SEQ ID NO: 439859 - RNA, 18 nt, Human
uuuugagacagucuugca

SEQ ID NO: 439860 - RNA, 23 nt, Human
uuuuugagacagucuugcacugu

SEQ ID NO: 439861 - RNA, 27 nt, Human
uuuuuuaugauuauuauuuuuuuuauu

SEQ ID NO: 439862 - RNA, 21 nt, Human
aaaauuaccagaguucuuuug

SEQ ID NO: 439863 - RNA, 24 nt, Human
aaagugcugggauuauaggcauga

SEQ ID NO: 439864 - RNA, 19 nt, Human
aagaacucagauuaccaac

SEQ ID NO: 439865 - RNA, 22 nt, Human
aagcaccuuguuucaauauauc

SEQ ID NO: 439866 - RNA, 23 nt, Human
aaggccacugccagcacacugcc

SEQ ID NO: 439867 - RNA, 23 nt, Human
aaguacaauaaucuuauaaagca

SEQ ID NO: 439868 - RNA, 19 nt, Human
aagugcugggauuauaggc

SEQ ID NO: 439869 - RNA, 21 nt, Human
aagugcugggauuauaggcau

SEQ ID NO: 439870 - RNA, 19 nt, Human
acaggcccccgccaccgcg

SEQ ID NO: 439871 - RNA, 24 nt, Human
accuccugaucugcccaccuuggc

SEQ ID NO: 439872 - RNA, 18 nt, Human
acgggguuucaccuuguu

SEQ ID NO: 439873 - RNA, 20 nt, Human
acgggguuucaccuuguuag

SEQ ID NO: 439874 - RNA, 24 nt, Human
acugcaguggcgcuaucucggcuc

SEQ ID NO: 439875 - RNA, 24 nt, Human
agauggucucgaucuccugaccuc

SEQ ID NO: 439876 - RNA, 20 nt, Human
aggcaugagccaccgcaccc

SEQ ID NO: 439877 - RNA, 18 nt, Human
aguagcugggauuacagg

SEQ ID NO: 439878 - RNA, 18 nt, Human
agugaaaaaucuguucag

SEQ ID NO: 439879 - RNA, 19 nt, Human
augacagugaccuaaugug

SEQ ID NO: 439880 - RNA, 24 nt, Human
caaagugcugggauuauaggcaug

SEQ ID NO: 439881 - RNA, 18 nt, Human
caacucaaggugcagcaa

SEQ ID NO: 439882 - RNA, 18 nt, Human
caaggccacugccagcac

SEQ ID NO: 439883 - RNA, 24 nt, Human
caaguaacacuauuaaagucuuaa

SEQ ID NO: 439884 - RNA, 20 nt, Human
cacccaggccggacugcagu

SEQ ID NO: 439885 - RNA, 24 nt, Human
caccuuguuagccaagauggucuc

SEQ ID NO: 439886 - RNA, 21 nt, Human
cacugcaagcuccuccucccg

SEQ ID NO: 439887 - RNA, 19 nt, Human
cacugcacaaacauuaaac

SEQ ID NO: 439888 - RNA, 22 nt, Human
cagcacacugccacaugcacuu

SEQ ID NO: 439889 - RNA, 23 nt, Human
cagcacacugccacaugcacuuc

SEQ ID NO: 439890 - RNA, 20 nt, Human
cagccuccugaguagcuggg

SEQ ID NO: 439891 - RNA, 25 nt, Human
caguauagaccaaauuuuuuaaaau

SEQ ID NO: 439892 - RNA, 18 nt, Human
caguggcgcuaucucggc

SEQ ID NO: 439893 - RNA, 22 nt, Human
caugccauucuucugccucagc

SEQ ID NO: 439894 - RNA, 24 nt, Human
ccaaagugcugggauuauaggcau

SEQ ID NO: 439895 - RNA, 24 nt, Human
ccaggccggacugcaguggcgcua

SEQ ID NO: 439896 - RNA, 19 nt, Human
ccauugcaccgucuuggca

SEQ ID NO: 439897 - RNA, 19 nt, Human
cccucucucuucauuuuca

SEQ ID NO: 439898 - RNA, 18 nt, Human
ccuccugaucugcccacc

SEQ ID NO: 439899 - RNA, 24 nt, Human
ccucucaacucaaggugcagcaaa

SEQ ID NO: 439900 - RNA, 23 nt, Human
ccugaguagcugggauuacaggc

SEQ ID NO: 439901 - RNA, 21 nt, Human
ccuuugaugucuuuucugaag

SEQ ID NO: 439902 - RNA, 23 nt, Human
cucacugcaagcuccuccucccg

SEQ ID NO: 439903 - RNA, 24 nt, Human
cucagccuccugaguagcugggau

SEQ ID NO: 439904 - RNA, 21 nt, Human
cucccggguucaugccauucu

SEQ ID NO: 439905 - RNA, 20 nt, Human
cuccugaccuccugaucugc

SEQ ID NO: 439906 - RNA, 20 nt, Human
cuuauucacucuuuaaauug

SEQ ID NO: 439907 - RNA, 20 nt, Human
gagacgggguuucaccuugu

SEQ ID NO: 439908 - RNA, 26 nt, Human
gaguagcugggauuacaggcccccgc

SEQ ID NO: 439909 - RNA, 20 nt, Human
gauuauaggcaugagccacc

SEQ ID NO: 439910 - RNA, 23 nt, Human
gauuauaggcaugagccaccgca

SEQ ID NO: 439911 - RNA, 23 nt, Human
gccuggcuaauuuuuuguauuuu

SEQ ID NO: 439912 - RNA, 20 nt, Human
gcucacugcaagcuccuccu

SEQ ID NO: 439913 - RNA, 22 nt, Human
gcucacugcaagcuccuccucc

SEQ ID NO: 439914 - RNA, 24 nt, Human
ggaucuuaucuuggcugugucugu

SEQ ID NO: 439915 - RNA, 23 nt, Human
ggcaggguuuuauuuguauaugu

SEQ ID NO: 439916 - RNA, 22 nt, Human
guccaaagccucaaggccacug

SEQ ID NO: 439917 - RNA, 19 nt, Human
guggaucuuaucuuggcug

SEQ ID NO: 439918 - RNA, 22 nt, Human
gugguguuuagcucuauuuuaa

SEQ ID NO: 439919 - RNA, 24 nt, Human
uaauuuuuuguauuuuuaguagag

SEQ ID NO: 439920 - RNA, 25 nt, Human
uaauuuuuuguauuuuuaguagaga

SEQ ID NO: 439921 - RNA, 19 nt, Human
uacaggcccccgccaccgc

SEQ ID NO: 439922 - RNA, 23 nt, Human
uacauuggagggaaacaaacacc

SEQ ID NO: 439923 - RNA, 24 nt, Human
uaguagagacgggguuucaccuug

SEQ ID NO: 439924 - RNA, 26 nt, Human
uaguagagacgggguuucaccuuguu

SEQ ID NO: 439925 - RNA, 23 nt, Human
uauuucuguaguugaauugaaaa

SEQ ID NO: 439926 - RNA, 22 nt, Human
ucaaugugacugagucaaaguc

SEQ ID NO: 439927 - RNA, 19 nt, Human
ucacccaggccggacugca

SEQ ID NO: 439928 - RNA, 24 nt, Human
ucacugcaagcuccuccucccggg

SEQ ID NO: 439929 - RNA, 20 nt, Human
ucagccuccugaguagcugg

SEQ ID NO: 439930 - RNA, 18 nt, Human
ucaugccauucuucugcc

SEQ ID NO: 439931 - RNA, 18 nt, Human
uccaucauuauuucuucu

SEQ ID NO: 439932 - RNA, 24 nt, Human
ucccaaagugcugggauuauaggc

SEQ ID NO: 439933 - RNA, 20 nt, Human
ucccggguucaugccauucu

SEQ ID NO: 439934 - RNA, 24 nt, Human
ucccggguucaugccauucuucug

SEQ ID NO: 439935 - RNA, 22 nt, Human
uccucagguuggauaaaaacua

SEQ ID NO: 439936 - RNA, 25 nt, Human
uccucccggguucaugccauucuuc

SEQ ID NO: 439937 - RNA, 24 nt, Human
uccugaguagcugggauuacaggc

SEQ ID NO: 439938 - RNA, 24 nt, Human
ucucgcucuuucacccaggccgga

SEQ ID NO: 439939 - RNA, 24 nt, Human
ucugccucagccuccugaguagcu

SEQ ID NO: 439940 - RNA, 21 nt, Human
ucuuauucacucuuuaaauug

SEQ ID NO: 439941 - RNA, 18 nt, Human
ugacaguaugacagugac

SEQ ID NO: 439942 - RNA, 18 nt, Human
ugaccuccugaucugccc

SEQ ID NO: 439943 - RNA, 24 nt, Human
ugaucugcccaccuuggccuccca

SEQ ID NO: 439944 - RNA, 18 nt, Human
ugauucugaacaccacag

SEQ ID NO: 439945 - RNA, 22 nt, Human
ugcaguggcgcuaucucggcuc

SEQ ID NO: 439946 - RNA, 24 nt, Human
ugccucagccuccugaguagcugg

SEQ ID NO: 439947 - RNA, 20 nt, Human
uggaaucagugaaaacaauc

SEQ ID NO: 439948 - RNA, 18 nt, Human
ugggagugaaaaaucugu

SEQ ID NO: 439949 - RNA, 21 nt, Human
ugggauuacaggcccccgcca

SEQ ID NO: 439950 - RNA, 22 nt, Human
ugggauuacaggcccccgccac

SEQ ID NO: 439951 - RNA, 23 nt, Human
ugggauuacaggcccccgccacc

SEQ ID NO: 439952 - RNA, 24 nt, Human
ugggauuacaggcccccgccaccg

SEQ ID NO: 439953 - RNA, 18 nt, Human
ugggauuauaggcaugag

SEQ ID NO: 439954 - RNA, 19 nt, Human
ugggauuauaggcaugagc

SEQ ID NO: 439955 - RNA, 21 nt, Human
ugggauuauaggcaugagcca

SEQ ID NO: 439956 - RNA, 22 nt, Human
ugggauuauaggcaugagccac

SEQ ID NO: 439957 - RNA, 23 nt, Human
ugggauuauaggcaugagccacc

SEQ ID NO: 439958 - RNA, 24 nt, Human
ugggauuauaggcaugagccaccg

SEQ ID NO: 439959 - RNA, 21 nt, Human
uguauuuuuaguagagacggg

SEQ ID NO: 439960 - RNA, 24 nt, Human
uuagcucuauuuuaagacuuuucu

SEQ ID NO: 439961 - RNA, 24 nt, Human
uuaguagagacgggguuucaccuu

SEQ ID NO: 439962 - RNA, 25 nt, Human
uuaguagagacgggguuucaccuug

SEQ ID NO: 439963 - RNA, 22 nt, Human
uuaguugauaauuuccuaagag

SEQ ID NO: 439964 - RNA, 24 nt, Human
uucaauauaucucccaaguuaaga

SEQ ID NO: 439965 - RNA, 19 nt, Human
uucaugccauucuucugcc

SEQ ID NO: 439966 - RNA, 22 nt, Human
uugcaccgucuuggcacucaug

SEQ ID NO: 439967 - RNA, 18 nt, Human
uuggccucccaaagugcu

SEQ ID NO: 439968 - RNA, 23 nt, Human
uuguauuuuuaguagagacgggg

SEQ ID NO: 439969 - RNA, 18 nt, Human
uuuaaggaugcaagagag

SEQ ID NO: 439970 - RNA, 23 nt, Human
uuuucacguaauagugguucuau

SEQ ID NO: 439971 - RNA, 18 nt, Human
uuuucuuuuuuuuuuuug

SEQ ID NO: 439972 - RNA, 24 nt, Human
uuuuuaguagagacgggguuucac

SEQ ID NO: 439973 - RNA, 21 nt, Human
uuuuuguauuuuuaguagaga

SEQ ID NO: 439974 - RNA, 24 nt, Human
uuuuuuguauuuuuaguagagacg

SEQ ID NO: 439975 - RNA, 24 nt, Human
uuuuuuguuuuugagacggagucu

SEQ ID NO: 439976 - RNA, 25 nt, Human
uuuuuuguuuuugagacggagucuc

SEQ ID NO: 439977 - RNA, 20 nt, Human
aaaaacccuucuaagucagc

SEQ ID NO: 439978 - RNA, 23 nt, Human
aaauaaugcauggaucuagacaa

SEQ ID NO: 439979 - RNA, 25 nt, Human
agagaacaaaagaggugacagaaaa

SEQ ID NO: 439980 - RNA, 21 nt, Human
agcgcgcgggccucgggcggc

SEQ ID NO: 439981 - RNA, 25 nt, Human
aggcaggaagcuagaaaaagggacc

SEQ ID NO: 439982 - RNA, 19 nt, Human
aguguaaagugaauaggga

SEQ ID NO: 439983 - RNA, 23 nt, Human
caggucaagugccugcuuuauuc

SEQ ID NO: 439984 - RNA, 19 nt, Human
cgcgcaguggacggcggcg

SEQ ID NO: 439985 - RNA, 24 nt, Human
cucaagaccuaggcuacagccagg

SEQ ID NO: 439986 - RNA, 21 nt, Human
gaacaaaagaggugacagaaa

SEQ ID NO: 439987 - RNA, 19 nt, Human
gagaacaaaagaggugacc

SEQ ID NO: 439988 - RNA, 22 nt, Human
gagcgcgcgggccucgggcggc

SEQ ID NO: 439989 - RNA, 19 nt, Human
gcagccugagccaugaugg

SEQ ID NO: 439990 - RNA, 26 nt, Human
gugagagaacaaaagaggugacagaa

SEQ ID NO: 439991 - RNA, 21 nt, Human
uaagucagcuuaaggccaaga

SEQ ID NO: 439992 - RNA, 23 nt, Human
ucaagaccuaggcuacagccagg

SEQ ID NO: 439993 - RNA, 24 nt, Human
uucacaguguaaagugaauagggg

SEQ ID NO: 439994 - RNA, 20 nt, Human
aggcucggagcgggcggcga

SEQ ID NO: 439995 - RNA, 19 nt, Human
caccaggcucggagcgggc

SEQ ID NO: 439996 - RNA, 24 nt, Human
cagcccaggagccgcgcgcagcgg

SEQ ID NO: 439997 - RNA, 21 nt, Human
gcgcgcagcggucggaagcac

SEQ ID NO: 439998 - RNA, 19 nt, Human
ugacagcccaggagccgcg

SEQ ID NO: 439999 - RNA, 23 nt, Human
aaaaaauuaaauaaggcaaacac

SEQ ID NO: 440000 - RNA, 19 nt, Human
aaauguaccuagaaucagu

SEQ ID NO: 440001 - RNA, 24 nt, Human
aaauguaccuagaaucaguguauc

SEQ ID NO: 440002 - RNA, 23 nt, Human
aagaaggaaaaaagguuuccaag

SEQ ID NO: 440003 - RNA, 21 nt, Human
aagagcuaggacuggugaugu

SEQ ID NO: 440004 - RNA, 22 nt, Human
aagcuaauucacguagaacuga

SEQ ID NO: 440005 - RNA, 18 nt, Human
agacaguagcagcaacag

SEQ ID NO: 440006 - RNA, 22 nt, Human
agggguuaaauggcagcaucuc

SEQ ID NO: 440007 - RNA, 19 nt, Human
aguguauuugcguguaugu

SEQ ID NO: 440008 - RNA, 21 nt, Human
auacuacugcaauauaaacaa

SEQ ID NO: 440009 - RNA, 20 nt, Human
augcaaaaacaaaaacugga

SEQ ID NO: 440010 - RNA, 18 nt, Human
auuaaauaaggcaaacac

SEQ ID NO: 440011 - RNA, 18 nt, Human
caauggugggcucaugac

SEQ ID NO: 440012 - RNA, 24 nt, Human
caccaggaauuuaaaaaaaaaaaa

SEQ ID NO: 440013 - RNA, 21 nt, Human
caggggaaagaugcucucugg

SEQ ID NO: 440014 - RNA, 23 nt, Human
caguaccaagggguuaaauggca

SEQ ID NO: 440015 - RNA, 20 nt, Human
caguagcagcaacagcauga

SEQ ID NO: 440016 - RNA, 22 nt, Human
caguagcagcaacagcaugaga

SEQ ID NO: 440017 - RNA, 19 nt, Human
caucugagaaaaagcuaau

SEQ ID NO: 440018 - RNA, 26 nt, Human
caugcaaaaacaaaaacuggagugua

SEQ ID NO: 440019 - RNA, 18 nt, Human
cuacaguauccaccagga

SEQ ID NO: 440020 - RNA, 19 nt, Human
cuacugcaauauaaacaaa

SEQ ID NO: 440021 - RNA, 20 nt, Human
cucaugauugcccgugaagu

SEQ ID NO: 440022 - RNA, 24 nt, Human
gacauucaaaguuucaacaucuga

SEQ ID NO: 440023 - RNA, 21 nt, Human
gcaaaaacaaaaacuggagug

SEQ ID NO: 440024 - RNA, 21 nt, Human
ggugauaaaugucaagaagga

SEQ ID NO: 440025 - RNA, 22 nt, Human
uaaaaaauaaauacuacugcaa

SEQ ID NO: 440026 - RNA, 20 nt, Human
uaaaaaauguaccuagaauc

SEQ ID NO: 440027 - RNA, 20 nt, Human
uaaaaaauuaaauaaggcaa

SEQ ID NO: 440028 - RNA, 25 nt, Human
uaacaugacauacaauucucaucac

SEQ ID NO: 440029 - RNA, 22 nt, Human
uaaccccuuggcaugcauaguu

SEQ ID NO: 440030 - RNA, 21 nt, Human
uacauaugcacgccaccaccc

SEQ ID NO: 440031 - RNA, 25 nt, Human
uaccaaaugcuuccuaaucaauucc

SEQ ID NO: 440032 - RNA, 21 nt, Human
uaccugucuacauucuucagc

SEQ ID NO: 440033 - RNA, 22 nt, Human
uagaacaguguucacuugcuca

SEQ ID NO: 440034 - RNA, 19 nt, Human
uauauauauauauauauau

SEQ ID NO: 440035 - RNA, 21 nt, Human
uauaugccuacuucacgcacg

SEQ ID NO: 440036 - RNA, 26 nt, Human
uauccaccaggaauuuaaaaaaaaaa

SEQ ID NO: 440037 - RNA, 23 nt, Human
ucaagaaggaaaaaagguuucca

SEQ ID NO: 440038 - RNA, 19 nt, Human
ucaguucuugguagaacag

SEQ ID NO: 440039 - RNA, 20 nt, Human
ucaguucuugguagaacagu

SEQ ID NO: 440040 - RNA, 20 nt, Human
uccaaagguuggaaaauuac

SEQ ID NO: 440041 - RNA, 20 nt, Human
ucccaaagccaaauucuaac

SEQ ID NO: 440042 - RNA, 18 nt, Human
ucuacaguauccaccagg

SEQ ID NO: 440043 - RNA, 19 nt, Human
ugaaguagcagaaugaaag

SEQ ID NO: 440044 - RNA, 23 nt, Human
ugaagucucgacauccacaugug

SEQ ID NO: 440045 - RNA, 25 nt, Human
ugagaaaaagcuaauucacguagga

SEQ ID NO: 440046 - RNA, 23 nt, Human
ugagauacaauuucaugcaaaaa

SEQ ID NO: 440047 - RNA, 22 nt, Human
ugaugugcuuuacauaugcacg

SEQ ID NO: 440048 - RNA, 22 nt, Human
ugauugcccgugaagucucgac

SEQ ID NO: 440049 - RNA, 19 nt, Human
ugcacgccaccacccuucc

SEQ ID NO: 440050 - RNA, 22 nt, Human
ugcacgccaccacccuuccaca

SEQ ID NO: 440051 - RNA, 18 nt, Human
uggcaugcauaguugggg

SEQ ID NO: 440052 - RNA, 23 nt, Human
ugucaagaaggaaaaaagguuuc

SEQ ID NO: 440053 - RNA, 18 nt, Human
uguucaguccuucuacca

SEQ ID NO: 440054 - RNA, 19 nt, Human
uuaacagaggagaaaaagu

SEQ ID NO: 440055 - RNA, 23 nt, Human
uuacauaugcacgccaccacccu

SEQ ID NO: 440056 - RNA, 18 nt, Human
uuauauauauauauauau

SEQ ID NO: 440057 - RNA, 23 nt, Human
uuauauauauauauauauauccc

SEQ ID NO: 440058 - RNA, 19 nt, Human
uucaugcaaaaacaaaaac

SEQ ID NO: 440059 - RNA, 21 nt, Human
uucaugcaaaaacaaaaacug

SEQ ID NO: 440060 - RNA, 22 nt, Human
uuccaaagguuggaaaauuacu

SEQ ID NO: 440061 - RNA, 28 nt, Human
uuugcguguauguguguuuucaugaggg

SEQ ID NO: 440062 - RNA, 20 nt, Human
uuuuuuuuuuuuuuguugcc

SEQ ID NO: 440063 - RNA, 23 nt, Human
uuuuuuuuuuuuuuguugccagg

SEQ ID NO: 440064 - RNA, 20 nt, Human
uuuuuuuuuuuuuuuuuguu

SEQ ID NO: 440065 - RNA, 20 nt, Human
uuuuuuuuuuuuuuuuuugg

SEQ ID NO: 440066 - RNA, 22 nt, Human
aaaauaauggauggcauguacc

SEQ ID NO: 440067 - RNA, 23 nt, Human
aaagaggguucacucaaaccucu

SEQ ID NO: 440068 - RNA, 20 nt, Human
aaccucugccgcaacaccuc

SEQ ID NO: 440069 - RNA, 24 nt, Human
aaggccacucagggaaggagccag

SEQ ID NO: 440070 - RNA, 21 nt, Human
acauuaagggcagggguagga

SEQ ID NO: 440071 - RNA, 20 nt, Human
accucugccgcaacaccucc

SEQ ID NO: 440072 - RNA, 22 nt, Human
agcugggcugugguggggagcc

SEQ ID NO: 440073 - RNA, 18 nt, Human
aggaauagggagaggugc

SEQ ID NO: 440074 - RNA, 23 nt, Human
caaacaggacagaaaugaaaaua

SEQ ID NO: 440075 - RNA, 21 nt, Human
caagggucuccuucaaggugc

SEQ ID NO: 440076 - RNA, 26 nt, Human
cacaguaucgcaaggagcuaaguaag

SEQ ID NO: 440077 - RNA, 23 nt, Human
cagggguaggauuugcaucuguu

SEQ ID NO: 440078 - RNA, 22 nt, Human
ccaggccaugccacugcgugcc

SEQ ID NO: 440079 - RNA, 25 nt, Human
ccaugccacugcgugccuuccaucc

SEQ ID NO: 440080 - RNA, 18 nt, Human
cccagugcugguucucug

SEQ ID NO: 440081 - RNA, 22 nt, Human
ccucugccgcaacaccuccaga

SEQ ID NO: 440082 - RNA, 23 nt, Human
ccuucaaggugcucugggcccau

SEQ ID NO: 440083 - RNA, 24 nt, Human
ccuugugcugugccugcucugagg

SEQ ID NO: 440084 - RNA, 21 nt, Human
cuaccaagcugcuucugcuau

SEQ ID NO: 440085 - RNA, 21 nt, Human
cucacagaagcacggacaauu

SEQ ID NO: 440086 - RNA, 21 nt, Human
cucacaguaucgcaaggagcu

SEQ ID NO: 440087 - RNA, 20 nt, Human
cucugccgcaacaccuccag

SEQ ID NO: 440088 - RNA, 20 nt, Human
cugaggcagcugggcugugg

SEQ ID NO: 440089 - RNA, 23 nt, Human
cugccugccagucacagucaagg

SEQ ID NO: 440090 - RNA, 19 nt, Human
cugcuucugcuauucuuug

SEQ ID NO: 440091 - RNA, 18 nt, Human
cugguucucugggagucu

SEQ ID NO: 440092 - RNA, 23 nt, Human
gaggcagcugggcuguggugggg

SEQ ID NO: 440093 - RNA, 23 nt, Human
gcaucaauuaaaauaugguucag

SEQ ID NO: 440094 - RNA, 21 nt, Human
gccucauucuguaaacccagu

SEQ ID NO: 440095 - RNA, 22 nt, Human
gcugcuucugcuauucuuugcu

SEQ ID NO: 440096 - RNA, 18 nt, Human
ggaggggugcugugcccc

SEQ ID NO: 440097 - RNA, 25 nt, Human
ggcaacaaggccacucagggaagga

SEQ ID NO: 440098 - RNA, 26 nt, Human
ggcagggguaggauuuggggaggucc

SEQ ID NO: 440099 - RNA, 19 nt, Human
gggaaggagccaggccaug

SEQ ID NO: 440100 - RNA, 19 nt, Human
gggaggggugcugugcccc

SEQ ID NO: 440101 - RNA, 19 nt, Human
gggcugugguggggagcca

SEQ ID NO: 440102 - RNA, 22 nt, Human
gugcugguucucugggagucug

SEQ ID NO: 440103 - RNA, 22 nt, Human
guucacucaaaccucugccgca

SEQ ID NO: 440104 - RNA, 19 nt, Human
uaagauuacaaggacugga

SEQ ID NO: 440105 - RNA, 23 nt, Human
uaccaagcugcuucugcuauucu

SEQ ID NO: 440106 - RNA, 23 nt, Human
ucaagccuuugugacggcccaug

SEQ ID NO: 440107 - RNA, 19 nt, Human
ucaagggucuccuucaagg

SEQ ID NO: 440108 - RNA, 22 nt, Human
ucugcagccacaggcacguggc

SEQ ID NO: 440109 - RNA, 22 nt, Human
ugaaagaggguucacucaaacc

SEQ ID NO: 440110 - RNA, 23 nt, Human
ugaacacacgcccaaggcaacaa

SEQ ID NO: 440111 - RNA, 25 nt, Human
ugaagugcuuuuacuuucucucugg

SEQ ID NO: 440112 - RNA, 20 nt, Human
ugcgugccuuccauccuacc

SEQ ID NO: 440113 - RNA, 22 nt, Human
ugcugguucucugggagucugc

SEQ ID NO: 440114 - RNA, 21 nt, Human
ugcugugccugcucugaggca

SEQ ID NO: 440115 - RNA, 18 nt, Human
ugggaggugcugaacaca

SEQ ID NO: 440116 - RNA, 20 nt, Human
ugggaggugcugaacacacg

SEQ ID NO: 440117 - RNA, 21 nt, Human
ugggaugggaggugcugaaca

SEQ ID NO: 440118 - RNA, 24 nt, Human
ugugccacugcccaggcagugauc

SEQ ID NO: 440119 - RNA, 18 nt, Human
ugugguggggagccaggg

SEQ ID NO: 440120 - RNA, 20 nt, Human
ugugguggggagccagggcc

SEQ ID NO: 440121 - RNA, 23 nt, Human
uugugaagugcuuuuacuuucuc

SEQ ID NO: 440122 - RNA, 26 nt, Human
uugugccacugcccaggcagugauca

SEQ ID NO: 440123 - RNA, 20 nt, Human
aaggaacaaagaaaucuaca

SEQ ID NO: 440124 - RNA, 18 nt, Human
aaggacccaagauaggga

SEQ ID NO: 440125 - RNA, 20 nt, Human
aaucacagcuuucuugauua

SEQ ID NO: 440126 - RNA, 22 nt, Human
acaagacaccacauucucucca

SEQ ID NO: 440127 - RNA, 24 nt, Human
acaccacauucucuccaccacgcc

SEQ ID NO: 440128 - RNA, 24 nt, Human
accacgggaggggcgggacccucg

SEQ ID NO: 440129 - RNA, 22 nt, Human
acgccgccauaccccacacagu

SEQ ID NO: 440130 - RNA, 28 nt, Human
acgccgccauaccccacaccgggugucc

SEQ ID NO: 440131 - RNA, 24 nt, Human
agaaggaacaaagaaaucuacaaa

SEQ ID NO: 440132 - RNA, 21 nt, Human
agagagaaagaguaacaugaa

SEQ ID NO: 440133 - RNA, 21 nt, Human
agcagugggaauggagaagga

SEQ ID NO: 440134 - RNA, 22 nt, Human
agugaggaagcugauggagaga

SEQ ID NO: 440135 - RNA, 23 nt, Human
aucuaauccccucccuaucccag

SEQ ID NO: 440136 - RNA, 21 nt, Human
caauagguuucacugcagguu

SEQ ID NO: 440137 - RNA, 22 nt, Human
caauagguuucacugcagguuu

SEQ ID NO: 440138 - RNA, 19 nt, Human
cacagaauuugaccccauc

SEQ ID NO: 440139 - RNA, 18 nt, Human
caccacauucucuccacc

SEQ ID NO: 440140 - RNA, 18 nt, Human
caccacgccgccauaccc

SEQ ID NO: 440141 - RNA, 21 nt, Human
cagcuuucucaauggaaugac

SEQ ID NO: 440142 - RNA, 23 nt, Human
caggaacaaguucuuugaaauac

SEQ ID NO: 440143 - RNA, 23 nt, Human
caggagagggccgaagacugcgg

SEQ ID NO: 440144 - RNA, 18 nt, Human
caggcccuccccucucca

SEQ ID NO: 440145 - RNA, 21 nt, Human
caggcccuccccucuccagga

SEQ ID NO: 440146 - RNA, 21 nt, Human
cagucuccaggcgggaagagg

SEQ ID NO: 440147 - RNA, 19 nt, Human
cagugaggaagcugaugga

SEQ ID NO: 440148 - RNA, 18 nt, Human
caucuauuaucuaauccc

SEQ ID NO: 440149 - RNA, 18 nt, Human
cauugcauguaagcaucc

SEQ ID NO: 440150 - RNA, 18 nt, Human
ccaccacgccgccauacc

SEQ ID NO: 440151 - RNA, 18 nt, Human
ccuauaaaggaacaaggu

SEQ ID NO: 440152 - RNA, 19 nt, Human
ccucuguaaacagggccaa

SEQ ID NO: 440153 - RNA, 23 nt, Human
cgcggcagaggcugacggaccac

SEQ ID NO: 440154 - RNA, 21 nt, Human
cgugaucaauauuuacguagc

SEQ ID NO: 440155 - RNA, 25 nt, Human
cuguucucuagaaguauguuacugg

SEQ ID NO: 440156 - RNA, 19 nt, Human
gaacaagacaccacauucu

SEQ ID NO: 440157 - RNA, 24 nt, Human
gaagaagcggggagagcgcggcca

SEQ ID NO: 440158 - RNA, 22 nt, Human
gaagauguauuauccuagucuc

SEQ ID NO: 440159 - RNA, 18 nt, Human
gaauggagaaggaacaaa

SEQ ID NO: 440160 - RNA, 20 nt, Human
gaauuccuuuuuuuuuuuuu

SEQ ID NO: 440161 - RNA, 18 nt, Human
gauggagagagaaagagu

SEQ ID NO: 440162 - RNA, 22 nt, Human
gccagagaauuaacauuaucag

SEQ ID NO: 440163 - RNA, 19 nt, Human
gccaggaacaaguucuuug

SEQ ID NO: 440164 - RNA, 20 nt, Human
gccaggcccuccccucucca

SEQ ID NO: 440165 - RNA, 20 nt, Human
ggcgacaggagagggccgaa

SEQ ID NO: 440166 - RNA, 19 nt, Human
gggccgaagacugcgaaga

SEQ ID NO: 440167 - RNA, 28 nt, Human
gguuuuuuuuguuuuuuguuuuuuuucu

SEQ ID NO: 440168 - RNA, 22 nt, Human
guuuuuuuuguuuuuuguuuuu

SEQ ID NO: 440169 - RNA, 18 nt, Human
uaacauuaucagugggcc

SEQ ID NO: 440170 - RNA, 18 nt, Human
uaccccacacagucucca

SEQ ID NO: 440171 - RNA, 24 nt, Human
uagaaguauguuacuggcucuuaa

SEQ ID NO: 440172 - RNA, 24 nt, Human
ucagcuuucucaauggaaugacaa

SEQ ID NO: 440173 - RNA, 19 nt, Human
uccaccacgccgccauacc

SEQ ID NO: 440174 - RNA, 21 nt, Human
uccaccacgccgccauacccc

SEQ ID NO: 440175 - RNA, 22 nt, Human
uccaccacgccgccauacccca

SEQ ID NO: 440176 - RNA, 22 nt, Human
uccacugguguaagacagcagg

SEQ ID NO: 440177 - RNA, 24 nt, Human
uccacugguguaagacagcaggcu

SEQ ID NO: 440178 - RNA, 24 nt, Human
ucccuaucccaguugucagcuuuc

SEQ ID NO: 440179 - RNA, 22 nt, Human
uccgcggcagaggcugacggac

SEQ ID NO: 440180 - RNA, 18 nt, Human
uccuuuuuuuuuuuuuuu

SEQ ID NO: 440181 - RNA, 24 nt, Human
ucuaucgcaguagugaacagagac

SEQ ID NO: 440182 - RNA, 23 nt, Human
ucuccaccacgccgccauacccc

SEQ ID NO: 440183 - RNA, 18 nt, Human
ucugcgguccaggccagg

SEQ ID NO: 440184 - RNA, 18 nt, Human
ugaacagagacaaagugc

SEQ ID NO: 440185 - RNA, 18 nt, Human
ugaggagaaucacagcuu

SEQ ID NO: 440186 - RNA, 21 nt, Human
ugaucaauauuuacguagcac

SEQ ID NO: 440187 - RNA, 24 nt, Human
ugauuaguaucuacaaggcacuua

SEQ ID NO: 440188 - RNA, 20 nt, Human
ugcucggagaaaaugagugg

SEQ ID NO: 440189 - RNA, 20 nt, Human
uggaacaagacaccacauuc

SEQ ID NO: 440190 - RNA, 24 nt, Human
uggaagauguauuauccuagucuc

SEQ ID NO: 440191 - RNA, 27 nt, Human
uggaagauguauuauccuagucucuuu

SEQ ID NO: 440192 - RNA, 21 nt, Human
uggaaugacaaggggauacag

SEQ ID NO: 440193 - RNA, 22 nt, Human
uucacauucacacagaauuuga

SEQ ID NO: 440194 - RNA, 18 nt, Human
uucaguuguacugccucu

SEQ ID NO: 440195 - RNA, 18 nt, Human
uuucagugaggaagcuga

SEQ ID NO: 440196 - RNA, 18 nt, Human
aggcaggcggagggccag

SEQ ID NO: 440197 - RNA, 20 nt, Human
aggcaggcggagggccaggc

SEQ ID NO: 440198 - RNA, 18 nt, Human
aggccuagguccagcagc

SEQ ID NO: 440199 - RNA, 21 nt, Human
ccagcagcagcuuggguggcc

SEQ ID NO: 440200 - RNA, 18 nt, Human
ccucuccaggcaggcgga

SEQ ID NO: 440201 - RNA, 22 nt, Human
ccucuccaggcaggcggagggc

SEQ ID NO: 440202 - RNA, 18 nt, Human
gcagcagcuuggguggca

SEQ ID NO: 440203 - RNA, 20 nt, Human
uuugcccagggccaggccuc

SEQ ID NO: 440204 - RNA, 21 nt, Human
aacuaaaaauuugaacagcuc

SEQ ID NO: 440205 - RNA, 19 nt, Human
caaaauagauguacugagc

SEQ ID NO: 440206 - RNA, 19 nt, Human
gauguucacaaaauagaug

SEQ ID NO: 440207 - RNA, 25 nt, Human
uaaauuccauacagugaacuaaaaa

SEQ ID NO: 440208 - RNA, 21 nt, Human
uugaacagcucugugcuggac

SEQ ID NO: 440209 - RNA, 22 nt, Human
aagaacacaacugaagacugca

SEQ ID NO: 440210 - RNA, 22 nt, Human
acaacugaagacugcaaacaac

SEQ ID NO: 440211 - RNA, 23 nt, Human
acugaagcauaagaacacaacug

SEQ ID NO: 440212 - RNA, 18 nt, Human
ccaugccguggcagcccu

SEQ ID NO: 440213 - RNA, 21 nt, Human
cuccaugccguggcagcccuc

SEQ ID NO: 440214 - RNA, 21 nt, Human
uaagaacacaacugaagacug

SEQ ID NO: 440215 - RNA, 21 nt, Human
ucuccaugccguggcagcccc

SEQ ID NO: 440216 - RNA, 23 nt, Human
ucuccaugccguggcagcccucg

SEQ ID NO: 440217 - RNA, 23 nt, Human
ugacaagaaguuuauuucagcuu

SEQ ID NO: 440218 - RNA, 20 nt, Human
ugacacugaagcauaagaac

SEQ ID NO: 440219 - RNA, 22 nt, Human
ugacacugaagcauaagaacac

SEQ ID NO: 440220 - RNA, 19 nt, Human
uuuuuuuuuuuuuuuucaa

SEQ ID NO: 440221 - RNA, 18 nt, Human
aacaaguuuagugguuca

SEQ ID NO: 440222 - RNA, 20 nt, Human
aacagauaugguucugagau

SEQ ID NO: 440223 - RNA, 18 nt, Human
aagcaaguaccaaagaac

SEQ ID NO: 440224 - RNA, 20 nt, Human
aagugcgcgguuggcucuag

SEQ ID NO: 440225 - RNA, 18 nt, Human
aaguguucagaaaacauu

SEQ ID NO: 440226 - RNA, 21 nt, Human
acaaaaaaaaaauggcaaaaa

SEQ ID NO: 440227 - RNA, 22 nt, Human
accaagcacaugggacacccac

SEQ ID NO: 440228 - RNA, 28 nt, Human
agaacaaaaaaaaaauggcaaaaacauu

SEQ ID NO: 440229 - RNA, 19 nt, Human
aggcagccggggcagcacg

SEQ ID NO: 440230 - RNA, 18 nt, Human
aguuaucuuuucaugcug

SEQ ID NO: 440231 - RNA, 21 nt, Human
augaagaacaggagaacagca

SEQ ID NO: 440232 - RNA, 22 nt, Human
caaaaaaaaaauggcaaaaaca

SEQ ID NO: 440233 - RNA, 25 nt, Human
cagaaaacauuaaugcucauuaaca

SEQ ID NO: 440234 - RNA, 24 nt, Human
cagcagaaggggagaccaagcaca

SEQ ID NO: 440235 - RNA, 21 nt, Human
caucccacgcccccugcggcu

SEQ ID NO: 440236 - RNA, 18 nt, Human
cauguacuaucacuuuau

SEQ ID NO: 440237 - RNA, 22 nt, Human
ccccaucccacgcccccugcgg

SEQ ID NO: 440238 - RNA, 24 nt, Human
ccccaucccacgcccccugcggcu

SEQ ID NO: 440239 - RNA, 18 nt, Human
cccgcuuugaaguucccg

SEQ ID NO: 440240 - RNA, 21 nt, Human
ccgucuguaggguuugguugu

SEQ ID NO: 440241 - RNA, 25 nt, Human
ccuuccucuuccuuuucugucuuuu

SEQ ID NO: 440242 - RNA, 19 nt, Human
cgcccccaucccacgcccc

SEQ ID NO: 440243 - RNA, 26 nt, Human
cgcuuugaaguucccgggccgcggga

SEQ ID NO: 440244 - RNA, 23 nt, Human
cggggcugcgaggccccagagca

SEQ ID NO: 440245 - RNA, 20 nt, Human
cggugcgcggcgcuccugcc

SEQ ID NO: 440246 - RNA, 23 nt, Human
cuaaccuuacgguguucauuauc

SEQ ID NO: 440247 - RNA, 22 nt, Human
cucaaaauauuuccuuccuucc

SEQ ID NO: 440248 - RNA, 24 nt, Human
cucaaaauauuuccuuccuuccuc

SEQ ID NO: 440249 - RNA, 20 nt, Human
cuccugcccaugcuuaacuu

SEQ ID NO: 440250 - RNA, 20 nt, Human
cuggcggugcgcggcgcucc

SEQ ID NO: 440251 - RNA, 21 nt, Human
cuggcggugcgcggcgcuccu

SEQ ID NO: 440252 - RNA, 21 nt, Human
cuguucauucaugugcucuug

SEQ ID NO: 440253 - RNA, 19 nt, Human
cuuccucuuccuuuucugu

SEQ ID NO: 440254 - RNA, 20 nt, Human
cuuccucuuccuuuucuguc

SEQ ID NO: 440255 - RNA, 22 nt, Human
cuucuguacucacucacucacu

SEQ ID NO: 440256 - RNA, 19 nt, Human
cuuuuggucuuggaucauc

SEQ ID NO: 440257 - RNA, 21 nt, Human
gaaaaaaugucaacagauaug

SEQ ID NO: 440258 - RNA, 20 nt, Human
gaacaaaaaaaaaauggcaa

SEQ ID NO: 440259 - RNA, 20 nt, Human
gaacagcagaaggggagacc

SEQ ID NO: 440260 - RNA, 20 nt, Human
gagaaaagcacuauucaagg

SEQ ID NO: 440261 - RNA, 20 nt, Human
gagaaaagcacuauucaagg

SEQ ID NO: 440262 - RNA, 22 nt, Human
gccccccuccccggccgccccc

SEQ ID NO: 440263 - RNA, 19 nt, Human
gcuguuucugauaccgucu

SEQ ID NO: 440264 - RNA, 21 nt, Human
ggaauggaguuugaaaaaaga

SEQ ID NO: 440265 - RNA, 19 nt, Human
ggagaacagcagaagggga

SEQ ID NO: 440266 - RNA, 25 nt, Human
ggagaacagcagaaggggagaccgg

SEQ ID NO: 440267 - RNA, 18 nt, Human
ggcggugcgcggcgcucc

SEQ ID NO: 440268 - RNA, 19 nt, Human
gggaaaauggaaaagaaag

SEQ ID NO: 440269 - RNA, 18 nt, Human
gggacacccaccucacuu

SEQ ID NO: 440270 - RNA, 22 nt, Human
gggccgcgggaggggagcgcgg

SEQ ID NO: 440271 - RNA, 30 nt, Human
uaaaauaaaaacuuaaugacuauaacauuu

SEQ ID NO: 440272 - RNA, 22 nt, Human
uaacauguacuaucacuuuaua

SEQ ID NO: 440273 - RNA, 23 nt, Human
uaagcaaguaccaaagaacacuu

SEQ ID NO: 440274 - RNA, 19 nt, Human
uacuguacugucuuaucuu

SEQ ID NO: 440275 - RNA, 27 nt, Human
uacuguacugucuuaucuuugagguag

SEQ ID NO: 440276 - RNA, 26 nt, Human
ucaaaauauuuccuuccuuccucuuc

SEQ ID NO: 440277 - RNA, 20 nt, Human
ucagugugggcgccccccuc

SEQ ID NO: 440278 - RNA, 22 nt, Human
ucccgggccgcgggaggggagc

SEQ ID NO: 440279 - RNA, 19 nt, Human
uccugccacuggccccgca

SEQ ID NO: 440280 - RNA, 22 nt, Human
uccugcccaugcuuaacuuuag

SEQ ID NO: 440281 - RNA, 18 nt, Human
uccuuccucuuccuuuuc

SEQ ID NO: 440282 - RNA, 20 nt, Human
ucucaaaauauuuccuuccu

SEQ ID NO: 440283 - RNA, 21 nt, Human
ugaaaggguagaggaauaucu

SEQ ID NO: 440284 - RNA, 18 nt, Human
ugaagucaacuccugccc

SEQ ID NO: 440285 - RNA, 20 nt, Human
ugcaaaauaacucaauaugc

SEQ ID NO: 440286 - RNA, 19 nt, Human
uggaaaagaaagcuaugag

SEQ ID NO: 440287 - RNA, 23 nt, Human
uggcaaaaacauucacauaaagg

SEQ ID NO: 440288 - RNA, 21 nt, Human
uguacaaaggaaauagggacc

SEQ ID NO: 440289 - RNA, 23 nt, Human
uguguauguacaaaggaaauagg

SEQ ID NO: 440290 - RNA, 18 nt, Human
uguucagaaaacauuaau

SEQ ID NO: 440291 - RNA, 22 nt, Human
uuaaaaaguccugcuaacuuaa

SEQ ID NO: 440292 - RNA, 24 nt, Human
uucaaaauacauuauaugcuaaca

SEQ ID NO: 440293 - RNA, 21 nt, Human
uucugccauuagcugugugac

SEQ ID NO: 440294 - RNA, 22 nt, Human
uucuucucaauauauucucaaa

SEQ ID NO: 440295 - RNA, 23 nt, Human
uuggaucaucucaguagaagaau

SEQ ID NO: 440296 - RNA, 18 nt, Human
uuguaauauauuucuucc

SEQ ID NO: 440297 - RNA, 21 nt, Human
uuuggaaguguucagaaaaca

SEQ ID NO: 440298 - RNA, 22 nt, Human
aaagauaauauucacaaaauca

SEQ ID NO: 440299 - RNA, 21 nt, Human
aaauccuacacagacaccccc

SEQ ID NO: 440300 - RNA, 22 nt, Human
aaguugucuccucccuccucca

SEQ ID NO: 440301 - RNA, 22 nt, Human
aaucaccagguguucaaaacau

SEQ ID NO: 440302 - RNA, 18 nt, Human
acacagacucagacaaga

SEQ ID NO: 440303 - RNA, 23 nt, Human
acagcagccugaaauuaggucug

SEQ ID NO: 440304 - RNA, 18 nt, Human
acagcaucugauucuagu

SEQ ID NO: 440305 - RNA, 22 nt, Human
acauuuuaucauaucucuuugu

SEQ ID NO: 440306 - RNA, 19 nt, Human
accagaacaacuuucccag

SEQ ID NO: 440307 - RNA, 20 nt, Human
acccuccugucuucuccagu

SEQ ID NO: 440308 - RNA, 21 nt, Human
acucccacacagacucagaca

SEQ ID NO: 440309 - RNA, 18 nt, Human
agacacccccaaaagcga

SEQ ID NO: 440310 - RNA, 22 nt, Human
agauaauauucacaaaaucaaa

SEQ ID NO: 440311 - RNA, 18 nt, Human
agcaaauagcuaccaaaa

SEQ ID NO: 440312 - RNA, 20 nt, Human
aguagaacgaauguuuuguu

SEQ ID NO: 440313 - RNA, 18 nt, Human
auucagaauacaaaagau

SEQ ID NO: 440314 - RNA, 24 nt, Human
caaaagauuacuuauguuccucac

SEQ ID NO: 440315 - RNA, 19 nt, Human
caaaaucaaauugcugcug

SEQ ID NO: 440316 - RNA, 21 nt, Human
caacaccacccugcuuagcaa

SEQ ID NO: 440317 - RNA, 22 nt, Human
caauuccaccaucugaaaagga

SEQ ID NO: 440318 - RNA, 19 nt, Human
cacacagacucagacaaga

SEQ ID NO: 440319 - RNA, 24 nt, Human
cacagacacccccaaaagcgaugg

SEQ ID NO: 440320 - RNA, 22 nt, Human
cacagcaucugauucuaguaga

SEQ ID NO: 440321 - RNA, 20 nt, Human
cagaacaacuuucccagcuc

SEQ ID NO: 440322 - RNA, 18 nt, Human
cagcagccugaaauuagg

SEQ ID NO: 440323 - RNA, 19 nt, Human
cagcagccugaaauuaggu

SEQ ID NO: 440324 - RNA, 23 nt, Human
cagcagccugaaauuaggucugc

SEQ ID NO: 440325 - RNA, 20 nt, Human
caucugaaaaggaaaggugc

SEQ ID NO: 440326 - RNA, 24 nt, Human
cauucgggaaauucaccauacaga

SEQ ID NO: 440327 - RNA, 24 nt, Human
cccacacagacucagacaagagaa

SEQ ID NO: 440328 - RNA, 22 nt, Human
ccugaaauuaggucugcagagc

SEQ ID NO: 440329 - RNA, 20 nt, Human
ccugcuaaaaucagucucca

SEQ ID NO: 440330 - RNA, 23 nt, Human
cuaccaaaaucaacucacagcau

SEQ ID NO: 440331 - RNA, 22 nt, Human
cucuaagucgugcaauuccacc

SEQ ID NO: 440332 - RNA, 20 nt, Human
cuucccucucaugcucugaa

SEQ ID NO: 440333 - RNA, 19 nt, Human
cuugauauuacccuguacc

SEQ ID NO: 440334 - RNA, 20 nt, Human
gaacaacuccaaggucaaac

SEQ ID NO: 440335 - RNA, 23 nt, Human
gacucagacaagagaaccuuaug

SEQ ID NO: 440336 - RNA, 21 nt, Human
gagaaccacagcagccugaaa

SEQ ID NO: 440337 - RNA, 25 nt, Human
gcagagcagcaaauagcuaccaaaa

SEQ ID NO: 440338 - RNA, 19 nt, Human
gcauuuuuaauauagaaaa

SEQ ID NO: 440339 - RNA, 24 nt, Human
gcccacugccccagggccuuugca

SEQ ID NO: 440340 - RNA, 23 nt, Human
ggucugggcacauaguaggcauu

SEQ ID NO: 440341 - RNA, 19 nt, Human
guucuuuggggucaguugc

SEQ ID NO: 440342 - RNA, 21 nt, Human
guuuguaaaaauggcugcuug

SEQ ID NO: 440343 - RNA, 25 nt, Human
uacaaaagauaauauucacaaaauc

SEQ ID NO: 440344 - RNA, 21 nt, Human
uacacagacacccccaaaagc

SEQ ID NO: 440345 - RNA, 23 nt, Human
uacacagacacccccaaaagcga

SEQ ID NO: 440346 - RNA, 24 nt, Human
uacuaaauccuacacagacacccc

SEQ ID NO: 440347 - RNA, 24 nt, Human
uagaagaggucugggcacauagua

SEQ ID NO: 440348 - RNA, 24 nt, Human
uaucauacacuacaggacccuccu

SEQ ID NO: 440349 - RNA, 19 nt, Human
ucaguugcaguccagucuu

SEQ ID NO: 440350 - RNA, 22 nt, Human
uccaauacccagaaugcgaaau

SEQ ID NO: 440351 - RNA, 22 nt, Human
uccuacacagacacccccaaaa

SEQ ID NO: 440352 - RNA, 30 nt, Human
ucugaaguugucuccucccuccuccauucu

SEQ ID NO: 440353 - RNA, 25 nt, Human
ugaaaagaagacuaugacugggaaa

SEQ ID NO: 440354 - RNA, 26 nt, Human
ugaaaagaagacuaugacugggaaau

SEQ ID NO: 440355 - RNA, 20 nt, Human
ugagaaccacagcagccuga

SEQ ID NO: 440356 - RNA, 19 nt, Human
ugccccagggccuuugcac

SEQ ID NO: 440357 - RNA, 23 nt, Human
ugcugagaaccacagcagccuga

SEQ ID NO: 440358 - RNA, 22 nt, Human
ugcugcugagaaccacagcagc

SEQ ID NO: 440359 - RNA, 21 nt, Human
ugcuguguguccgacaccggg

SEQ ID NO: 440360 - RNA, 18 nt, Human
uggccacacccaccugcu

SEQ ID NO: 440361 - RNA, 18 nt, Human
ugggcacauaguaggcau

SEQ ID NO: 440362 - RNA, 19 nt, Human
ugugagacgaccacuuuau

SEQ ID NO: 440363 - RNA, 20 nt, Human
uguguguccgacaccggggc

SEQ ID NO: 440364 - RNA, 22 nt, Human
uguuuuguuucuucgaauauua

SEQ ID NO: 440365 - RNA, 23 nt, Human
uuaaaugaacaacuccaagguca

SEQ ID NO: 440366 - RNA, 22 nt, Human
uuccaccaucugaaaaggaaag

SEQ ID NO: 440367 - RNA, 18 nt, Human
uugucuccucccuccucc

SEQ ID NO: 440368 - RNA, 22 nt, Human
uuguguaucauacacuacagga

SEQ ID NO: 440369 - RNA, 21 nt, Human
uuuuuuuuuugugagacgacc

SEQ ID NO: 440370 - RNA, 18 nt, Human
uuuuuuuuuuuuuuuuug

SEQ ID NO: 440371 - RNA, 19 nt, Human
uuuuuuuuuuuuuuuuugu

SEQ ID NO: 440372 - RNA, 22 nt, Human
aaacaaaaccaacuagcaaaac

SEQ ID NO: 440373 - RNA, 18 nt, Human
aaagacucagugguucug

SEQ ID NO: 440374 - RNA, 24 nt, Human
aaagugcugggauuaugggcauga

SEQ ID NO: 440375 - RNA, 19 nt, Human
aagugcugggauuaugggc

SEQ ID NO: 440376 - RNA, 21 nt, Human
aagugcugggauuaugggcau

SEQ ID NO: 440377 - RNA, 18 nt, Human
aggcuggccuugaacuuc

SEQ ID NO: 440378 - RNA, 22 nt, Human
aggugggcucugcgggcacuuu

SEQ ID NO: 440379 - RNA, 23 nt, Human
aucugggccuguguuccccuggg

SEQ ID NO: 440380 - RNA, 26 nt, Human
caaaacaaaaccaacuagcaaaaccc

SEQ ID NO: 440381 - RNA, 19 nt, Human
caaaacccucaaggugggc

SEQ ID NO: 440382 - RNA, 24 nt, Human
caaagugcugggauuaugggcaug

SEQ ID NO: 440383 - RNA, 22 nt, Human
cagugguucuguccugagacuc

SEQ ID NO: 440384 - RNA, 24 nt, Human
ccaaagugcugggauuaugggcau

SEQ ID NO: 440385 - RNA, 20 nt, Human
ccacuucuugguggcugucc

SEQ ID NO: 440386 - RNA, 23 nt, Human
ccccacggcuguaaacgcaaaac

SEQ ID NO: 440387 - RNA, 21 nt, Human
cccucaaggugggcucugcgg

SEQ ID NO: 440388 - RNA, 23 nt, Human
ccgccuccaucucccaaagugcu

SEQ ID NO: 440389 - RNA, 22 nt, Human
ccuagagcgauguggucaaagg

SEQ ID NO: 440390 - RNA, 22 nt, Human
ccuccaaaagacucagugguuc

SEQ ID NO: 440391 - RNA, 23 nt, Human
cgcaaaacaaaaccaacuagcaa

SEQ ID NO: 440392 - RNA, 20 nt, Human
cuacggcgcacagggcugcg

SEQ ID NO: 440393 - RNA, 24 nt, Human
cucaaaugauuuucccgccuccau

SEQ ID NO: 440394 - RNA, 22 nt, Human
cucuguucuugguagauuuucu

SEQ ID NO: 440395 - RNA, 21 nt, Human
cugggccuguguuccccuggg

SEQ ID NO: 440396 - RNA, 21 nt, Human
cuuuggcagccacuucuuggu

SEQ ID NO: 440397 - RNA, 18 nt, Human
gauuaugggcaugagcca

SEQ ID NO: 440398 - RNA, 22 nt, Human
gauuaugggcaugagccacugc

SEQ ID NO: 440399 - RNA, 22 nt, Human
gauuaugggcaugagccacugc

SEQ ID NO: 440400 - RNA, 21 nt, Human
gcugggauuaugggcaugagc

SEQ ID NO: 440401 - RNA, 22 nt, Human
ggagucucgcuaugucguccag

SEQ ID NO: 440402 - RNA, 23 nt, Human
ggagucucgcuaugucguccagg

SEQ ID NO: 440403 - RNA, 20 nt, Human
ggcaugagccacugcgccca

SEQ ID NO: 440404 - RNA, 19 nt, Human
ggccuugaacuucugaccu

SEQ ID NO: 440405 - RNA, 24 nt, Human
ggcuggccuugaacuucugaccuc

SEQ ID NO: 440406 - RNA, 22 nt, Human
gggcugcagagcggggcucccc

SEQ ID NO: 440407 - RNA, 24 nt, Human
gguccaaucaguggaugcuagugg

SEQ ID NO: 440408 - RNA, 23 nt, Human
gguggugggggugaguuacagag

SEQ ID NO: 440409 - RNA, 19 nt, Human
guccaaucaguggaugcua

SEQ ID NO: 440410 - RNA, 23 nt, Human
gucccaggagaggcacauggggg

SEQ ID NO: 440411 - RNA, 24 nt, Human
guggaugcuagugggcccuggggc

SEQ ID NO: 440412 - RNA, 22 nt, Human
uaauuuuuauuuuuugguagag

SEQ ID NO: 440413 - RNA, 22 nt, Human
uagagguggagucucgcuaugu

SEQ ID NO: 440414 - RNA, 22 nt, Human
uaugucguccaggcuggccuug

SEQ ID NO: 440415 - RNA, 24 nt, Human
uaugucguccaggcuggccuugaa

SEQ ID NO: 440416 - RNA, 19 nt, Human
ucaguggaugcuagugggc

SEQ ID NO: 440417 - RNA, 24 nt, Human
ucccaaagugcugggauuaugggc

SEQ ID NO: 440418 - RNA, 23 nt, Human
uccccccacggcuguaaacgcaa

SEQ ID NO: 440419 - RNA, 18 nt, Human
ucccccugggacacgccu

SEQ ID NO: 440420 - RNA, 19 nt, Human
ucucgcuaugucguccagg

SEQ ID NO: 440421 - RNA, 23 nt, Human
ucucgcuaugucguccaggcugg

SEQ ID NO: 440422 - RNA, 18 nt, Human
ucuguccugagacucugu

SEQ ID NO: 440423 - RNA, 20 nt, Human
ucuguccugagacucuguuc

SEQ ID NO: 440424 - RNA, 23 nt, Human
ucuguucuugguagauuuucuuc

SEQ ID NO: 440425 - RNA, 30 nt, Human
ucuguuuugauuuuguuucuguuuuugugg

SEQ ID NO: 440426 - RNA, 24 nt, Human
ugaccucaaaugauuuucccgccu

SEQ ID NO: 440427 - RNA, 21 nt, Human
ugaggaguccuuuucucuggg

SEQ ID NO: 440428 - RNA, 18 nt, Human
uggcuguccuugaguugg

SEQ ID NO: 440429 - RNA, 18 nt, Human
ugggauuaugggcaugag

SEQ ID NO: 440430 - RNA, 19 nt, Human
ugggauuaugggcaugagc

SEQ ID NO: 440431 - RNA, 22 nt, Human
ugggauuaugggcaugagccac

SEQ ID NO: 440432 - RNA, 22 nt, Human
ugggauuaugggcaugagccac

SEQ ID NO: 440433 - RNA, 24 nt, Human
ugggauuaugggcaugagccacug

SEQ ID NO: 440434 - RNA, 20 nt, Human
ugggcucugcgggcacuuug

SEQ ID NO: 440435 - RNA, 19 nt, Human
ugggugccaguuauccuag

SEQ ID NO: 440436 - RNA, 24 nt, Human
ugguagagguggagucucgcuaug

SEQ ID NO: 440437 - RNA, 25 nt, Human
uggucaaagggaugucaucugggcc

SEQ ID NO: 440438 - RNA, 19 nt, Human
uguuuuuguguguguguau

SEQ ID NO: 440439 - RNA, 24 nt, Human
uugguagagguggagucucgcuau

SEQ ID NO: 440440 - RNA, 22 nt, Human
uuucccgccuccaucucccaaa

SEQ ID NO: 440441 - RNA, 19 nt, Human
uuucuguuuuugugugugu

SEQ ID NO: 440442 - RNA, 23 nt, Human
uuuuauuuuuugguagaggugga

SEQ ID NO: 440443 - RNA, 27 nt, Human
uuuuauuuuuugguagagguggagucu

SEQ ID NO: 440444 - RNA, 23 nt, Human
uuuucugcuuucucuguuuugau

SEQ ID NO: 440445 - RNA, 22 nt, Human
uuuuugguagagguggagucuc

SEQ ID NO: 440446 - RNA, 24 nt, Human
uuuuuugguagagguggagucucg

SEQ ID NO: 440447 - RNA, 20 nt, Human
uuuuuuuuuuuuuuuuuugg

SEQ ID NO: 440448 - RNA, 24 nt, Human
uuuuuuuuuuuuuuuuuuguuuuu

SEQ ID NO: 440449 - RNA, 21 nt, Human
aaagacagaucuccacaaaca

SEQ ID NO: 440450 - RNA, 19 nt, Human
aaagggagugggaugaaag

SEQ ID NO: 440451 - RNA, 18 nt, Human
aagaagggaugccccggc

SEQ ID NO: 440452 - RNA, 21 nt, Human
acagaaagaaaaaaaugggau

SEQ ID NO: 440453 - RNA, 21 nt, Human
acccagauggauaucaggagc

SEQ ID NO: 440454 - RNA, 21 nt, Human
agaaaagcucagaaacccaag

SEQ ID NO: 440455 - RNA, 18 nt, Human
agaaagagaacguagaaa

SEQ ID NO: 440456 - RNA, 20 nt, Human
agaaggaguuuggggauugg

SEQ ID NO: 440457 - RNA, 19 nt, Human
aggcagagaugagcacagg

SEQ ID NO: 440458 - RNA, 19 nt, Human
agggaggauggaagggucu

SEQ ID NO: 440459 - RNA, 20 nt, Human
agggagugggaugaaagggg

SEQ ID NO: 440460 - RNA, 18 nt, Human
aucuccacaaacacccca

SEQ ID NO: 440461 - RNA, 19 nt, Human
augggaacgaagaagggau

SEQ ID NO: 440462 - RNA, 22 nt, Human
augggaacgaagaagggaugcc

SEQ ID NO: 440463 - RNA, 18 nt, Human
augugcagaagagaaggu

SEQ ID NO: 440464 - RNA, 23 nt, Human
cagccggucccucuggcuggcuc

SEQ ID NO: 440465 - RNA, 18 nt, Human
ccacauguuagacccagg

SEQ ID NO: 440466 - RNA, 19 nt, Human
ccacuccccaauguccccc

SEQ ID NO: 440467 - RNA, 24 nt, Human
ccaggcacacaguccuucugugcc

SEQ ID NO: 440468 - RNA, 19 nt, Human
ccaggcuuuuccagagaag

SEQ ID NO: 440469 - RNA, 24 nt, Human
cccaagaucuguuccuccccauuc

SEQ ID NO: 440470 - RNA, 21 nt, Human
ccccaagaucuguuccucccc

SEQ ID NO: 440471 - RNA, 20 nt, Human
ccccaggccugggaaccugu

SEQ ID NO: 440472 - RNA, 24 nt, Human
ccccuuaaaggugcuagggacaaa

SEQ ID NO: 440473 - RNA, 27 nt, Human
cccggcaacgcuggccgcaacagcagc

SEQ ID NO: 440474 - RNA, 18 nt, Human
ccggcaacgcuggccgca

SEQ ID NO: 440475 - RNA, 24 nt, Human
ccucaugcuuggaccuuucuuucu

SEQ ID NO: 440476 - RNA, 19 nt, Human
ccuccaauucuuccccucc

SEQ ID NO: 440477 - RNA, 22 nt, Human
ccuccaauucuuccccuccccu

SEQ ID NO: 440478 - RNA, 20 nt, Human
ccuccccuuaaaggugcuag

SEQ ID NO: 440479 - RNA, 24 nt, Human
ccugggaaccuguuccugggucgg

SEQ ID NO: 440480 - RNA, 18 nt, Human
cgccuguauaauugggac

SEQ ID NO: 440481 - RNA, 20 nt, Human
cuccacaaacaccccaggcc

SEQ ID NO: 440482 - RNA, 24 nt, Human
cugaggaugggcccagcucucucu

SEQ ID NO: 440483 - RNA, 24 nt, Human
cugcuggcggcucgggcuuccucu

SEQ ID NO: 440484 - RNA, 22 nt, Human
cuggaacaagaggcugccccaa

SEQ ID NO: 440485 - RNA, 21 nt, Human
cuggaggaccugaggaacugg

SEQ ID NO: 440486 - RNA, 20 nt, Human
cugggcugguggcucuaggc

SEQ ID NO: 440487 - RNA, 19 nt, Human
cuuguuugcuugccucuga

SEQ ID NO: 440488 - RNA, 18 nt, Human
gaaagacagaucuccaca

SEQ ID NO: 440489 - RNA, 23 nt, Human
gaagaaagagaacguagaaaggc

SEQ ID NO: 440490 - RNA, 20 nt, Human
gaccuuucuuucuucuuugg

SEQ ID NO: 440491 - RNA, 23 nt, Human
gaccuuucuuucuucuuuggagu

SEQ ID NO: 440492 - RNA, 22 nt, Human
gagaaagacagaucuccacaaa

SEQ ID NO: 440493 - RNA, 18 nt, Human
gagaaggaagcugggcug

SEQ ID NO: 440494 - RNA, 19 nt, Human
gagugggaugaaaggggag

SEQ ID NO: 440495 - RNA, 19 nt, Human
gaguuuggggauuggggag

SEQ ID NO: 440496 - RNA, 22 nt, Human
gaugcugagauggagaaaagga

SEQ ID NO: 440497 - RNA, 21 nt, Human
gcaacagcagccggccuggag

SEQ ID NO: 440498 - RNA, 24 nt, Human
gcccagcucucucugggauguucc

SEQ ID NO: 440499 - RNA, 21 nt, Human
gccgcaacagcagccggccug

SEQ ID NO: 440500 - RNA, 22 nt, Human
gcuggaacaagaggcugcccca

SEQ ID NO: 440501 - RNA, 19 nt, Human
gcuuguccgcccacucccc

SEQ ID NO: 440502 - RNA, 19 nt, Human
ggagccuggguuccacugc

SEQ ID NO: 440503 - RNA, 25 nt, Human
gggagugggaugaaaggggaguugg

SEQ ID NO: 440504 - RNA, 21 nt, Human
gggcggagggcuaggggcugc

SEQ ID NO: 440505 - RNA, 21 nt, Human
ggggaggaugagggagaaaag

SEQ ID NO: 440506 - RNA, 21 nt, Human
gggguccaggcaagcugcccu

SEQ ID NO: 440507 - RNA, 19 nt, Human
ggguagggcugaggauggg

SEQ ID NO: 440508 - RNA, 20 nt, Human
ggugcuagggacaaagggga

SEQ ID NO: 440509 - RNA, 19 nt, Human
gucccccaagaucuguucc

SEQ ID NO: 440510 - RNA, 20 nt, Human
ucaaggacagaaagaaaaaa

SEQ ID NO: 440511 - RNA, 19 nt, Human
uccacaaacaccccaggcc

SEQ ID NO: 440512 - RNA, 22 nt, Human
uccacaaacaccccaggccugg

SEQ ID NO: 440513 - RNA, 22 nt, Human
uccagagaaggaagcugggcug

SEQ ID NO: 440514 - RNA, 24 nt, Human
uccccaaugucccccaagaucugu

SEQ ID NO: 440515 - RNA, 23 nt, Human
uccccauucccaggcagagauug

SEQ ID NO: 440516 - RNA, 24 nt, Human
ucccccaagaucuguuccucccca

SEQ ID NO: 440517 - RNA, 24 nt, Human
uccgcccacuccccaauguccccc

SEQ ID NO: 440518 - RNA, 27 nt, Human
ucuaauacuuguuugcuugccucugac

SEQ ID NO: 440519 - RNA, 20 nt, Human
ucuaggcuuggaagaaagag

SEQ ID NO: 440520 - RNA, 25 nt, Human
ucuccacaaacaccccaggccuggg

SEQ ID NO: 440521 - RNA, 24 nt, Human
ucucucugggauguuccugggcuu

SEQ ID NO: 440522 - RNA, 22 nt, Human
ugaaagggagugggaugaaagg

SEQ ID NO: 440523 - RNA, 22 nt, Human
ugaaaucuuuggagaaagacag

SEQ ID NO: 440524 - RNA, 25 nt, Human
ugagagccaaauauuuugguuuuua

SEQ ID NO: 440525 - RNA, 20 nt, Human
ugcccuggagugcuuguccg

SEQ ID NO: 440526 - RNA, 21 nt, Human
ugccucugacacagccggucc

SEQ ID NO: 440527 - RNA, 22 nt, Human
uggagaaagacagaucuccaca

SEQ ID NO: 440528 - RNA, 19 nt, Human
uggcugcaaaagucuccau

SEQ ID NO: 440529 - RNA, 18 nt, Human
ugggauguuccugggcuu

SEQ ID NO: 440530 - RNA, 21 nt, Human
ugggcccagcucucucuggga

SEQ ID NO: 440531 - RNA, 21 nt, Human
ugggcggagggcuaggggcug

SEQ ID NO: 440532 - RNA, 22 nt, Human
ugggcucaaggacagaaagaaa

SEQ ID NO: 440533 - RNA, 21 nt, Human
ugggcugguggcucuaggcuu

SEQ ID NO: 440534 - RNA, 23 nt, Human
ugggcuuucucucuccgaagcuc

SEQ ID NO: 440535 - RNA, 18 nt, Human
uggguagggcugaggaug

SEQ ID NO: 440536 - RNA, 20 nt, Human
uuaaaggugcuagggacaaa

SEQ ID NO: 440537 - RNA, 18 nt, Human
uugaacucacugggcuca

SEQ ID NO: 440538 - RNA, 18 nt, Human
uuuggggauuggggagga

SEQ ID NO: 440539 - RNA, 22 nt, Human
aaaugccccaggggacaaaggu

SEQ ID NO: 440540 - RNA, 24 nt, Human
aagguagaagaaaaauaguacaaa

SEQ ID NO: 440541 - RNA, 18 nt, Human
acaaaacucagagaaagc

SEQ ID NO: 440542 - RNA, 23 nt, Human
agaaaaauaguacaaaacucaga

SEQ ID NO: 440543 - RNA, 23 nt, Human
agucagagcaacccaagaacuaa

SEQ ID NO: 440544 - RNA, 24 nt, Human
caagaaaacccucccaggaguuuc

SEQ ID NO: 440545 - RNA, 22 nt, Human
cacaucaucuuuuuuugcuacc

SEQ ID NO: 440546 - RNA, 19 nt, Human
cauucagagagucagagca

SEQ ID NO: 440547 - RNA, 20 nt, Human
ccaggggacaaagguacacc

SEQ ID NO: 440548 - RNA, 21 nt, Human
cccaggggacaaagguacacc

SEQ ID NO: 440549 - RNA, 24 nt, Human
cgaaauacgucaagguagaagaaa

SEQ ID NO: 440550 - RNA, 20 nt, Human
cuucaacaaugcagagcaac

SEQ ID NO: 440551 - RNA, 21 nt, Human
gaacuaaacucauuauaugca

SEQ ID NO: 440552 - RNA, 19 nt, Human
gcauuuucucaagaaaacc

SEQ ID NO: 440553 - RNA, 18 nt, Human
uaaaaucaacacaucauc

SEQ ID NO: 440554 - RNA, 24 nt, Human
uacaaaacucagagaaagcucagc

SEQ ID NO: 440555 - RNA, 23 nt, Human
uagaagaaaaauaguacaaaacu

SEQ ID NO: 440556 - RNA, 22 nt, Human
uaguacaaaacucagagaaagc

SEQ ID NO: 440557 - RNA, 23 nt, Human
uccgugauaagcugugaaauuca

SEQ ID NO: 440558 - RNA, 21 nt, Human
ucucaagaaaacccucccagg

SEQ ID NO: 440559 - RNA, 27 nt, Human
uuauaugcauuuucucaagaaaacccu

SEQ ID NO: 440560 - RNA, 23 nt, Human
uucagagagucagagcaacccaa

SEQ ID NO: 440561 - RNA, 22 nt, Human
uucagugaagaguccgugauaa

SEQ ID NO: 440562 - RNA, 18 nt, Human
uuugcuaccuaaaugccc

SEQ ID NO: 440563 - RNA, 20 nt, Human
acaucaucuggauccaggau

SEQ ID NO: 440564 - RNA, 19 nt, Human
acccggggcgccgcucccc

SEQ ID NO: 440565 - RNA, 26 nt, Human
acccugaggcccggaggcucgcggca

SEQ ID NO: 440566 - RNA, 19 nt, Human
caaaagcaucugggcucug

SEQ ID NO: 440567 - RNA, 21 nt, Human
cacagcaaucagcuugucuuu

SEQ ID NO: 440568 - RNA, 19 nt, Human
caccacgaugcccguccug

SEQ ID NO: 440569 - RNA, 25 nt, Human
cacuucugucucaaaagcaucuggg

SEQ ID NO: 440570 - RNA, 21 nt, Human
cagagacccggggcgccgcuc

SEQ ID NO: 440571 - RNA, 21 nt, Human
caggacccuucucccgggucu

SEQ ID NO: 440572 - RNA, 21 nt, Human
ccaguaaccaggacccuucuc

SEQ ID NO: 440573 - RNA, 22 nt, Human
cccccggcgaccacgccgggcc

SEQ ID NO: 440574 - RNA, 20 nt, Human
ccccgcgggcgcagccccca

SEQ ID NO: 440575 - RNA, 19 nt, Human
cccggaacacccugaggcc

SEQ ID NO: 440576 - RNA, 23 nt, Human
cccggaacacccugaggcccgga

SEQ ID NO: 440577 - RNA, 18 nt, Human
cccggggcgccgcucccc

SEQ ID NO: 440578 - RNA, 19 nt, Human
cccugaggcccggaggcuc

SEQ ID NO: 440579 - RNA, 23 nt, Human
ccgacgcgcagcuggcccuccuu

SEQ ID NO: 440580 - RNA, 19 nt, Human
ccuggcccccggcgaccac

SEQ ID NO: 440581 - RNA, 21 nt, Human
cggggcgggugggcccagaga

SEQ ID NO: 440582 - RNA, 21 nt, Human
cgggugggcccagagacccgg

SEQ ID NO: 440583 - RNA, 23 nt, Human
cuucagguaccgcugcagcgccu

SEQ ID NO: 440584 - RNA, 21 nt, Human
cuuucauccuggcccccggcg

SEQ ID NO: 440585 - RNA, 18 nt, Human
gaggacgcccggggcggg

SEQ ID NO: 440586 - RNA, 19 nt, Human
ggaacacccugaggcccgg

SEQ ID NO: 440587 - RNA, 21 nt, Human
ggcccagagacccggggcgcc

SEQ ID NO: 440588 - RNA, 19 nt, Human
ucaaacacagcaaucagcu

SEQ ID NO: 440589 - RNA, 25 nt, Human
ucacuuucauccuggcccccggcga

SEQ ID NO: 440590 - RNA, 20 nt, Human
ucagguaccgcugcagcgcc

SEQ ID NO: 440591 - RNA, 22 nt, Human
uccccggaacacccugaggccc

SEQ ID NO: 440592 - RNA, 22 nt, Human
uccccggaacacccugaggccc

SEQ ID NO: 440593 - RNA, 22 nt, Human
uccuggcccccggcgaccacgc

SEQ ID NO: 440594 - RNA, 22 nt, Human
ucgcggcagcgccccuuccacc

SEQ ID NO: 440595 - RNA, 18 nt, Human
ucucggaggacgcccggg

SEQ ID NO: 440596 - RNA, 19 nt, Human
ucucggaggacgcccgggg

SEQ ID NO: 440597 - RNA, 18 nt, Human
ucugcaggguuuccacug

SEQ ID NO: 440598 - RNA, 22 nt, Human
ugcccguccugccgaagcacac

SEQ ID NO: 440599 - RNA, 22 nt, Human
ugucugaccccgcgggcgcagc

SEQ ID NO: 440600 - RNA, 22 nt, Human
uucaaacacagcaaucagcuug

SEQ ID NO: 440601 - RNA, 18 nt, Human
aaaaagcagcaaggagaa

SEQ ID NO: 440602 - RNA, 19 nt, Human
aaacagagggacuacaaac

SEQ ID NO: 440603 - RNA, 18 nt, Human
aagaaaaagcagcaagga

SEQ ID NO: 440604 - RNA, 22 nt, Human
aagggacagcaaaauacugaaa

SEQ ID NO: 440605 - RNA, 22 nt, Human
accuagaaauacagaagaaaaa

SEQ ID NO: 440606 - RNA, 18 nt, Human
acugaaaaaaauuaacug

SEQ ID NO: 440607 - RNA, 24 nt, Human
agaaaaaaauuccagaauaaauga

SEQ ID NO: 440608 - RNA, 23 nt, Human
agaaaaagggaaagcacaaacau

SEQ ID NO: 440609 - RNA, 23 nt, Human
agaaagugacaaaaauccaucua

SEQ ID NO: 440610 - RNA, 21 nt, Human
agaagaaaaagcagcaaggag

SEQ ID NO: 440611 - RNA, 20 nt, Human
agagggacuacaaacuggug

SEQ ID NO: 440612 - RNA, 21 nt, Human
agcagcaaggagaaaguguug

SEQ ID NO: 440613 - RNA, 25 nt, Human
agggcggcgaggccgcgaccggggc

SEQ ID NO: 440614 - RNA, 19 nt, Human
auuaacagaagaaaaaggg

SEQ ID NO: 440615 - RNA, 21 nt, Human
cacuguccucugagggcccau

SEQ ID NO: 440616 - RNA, 23 nt, Human
cagaagaaaaagggaaagcacaa

SEQ ID NO: 440617 - RNA, 28 nt, Human
cagcaaaauacugaaaaaaauuaacugg

SEQ ID NO: 440618 - RNA, 20 nt, Human
cagugcaccaacuguauuuu

SEQ ID NO: 440619 - RNA, 20 nt, Human
cccaagggacagcaaaauac

SEQ ID NO: 440620 - RNA, 19 nt, Human
cccaggcuacccgcuggga

SEQ ID NO: 440621 - RNA, 22 nt, Human
ccccaggcuacccgcugggaac

SEQ ID NO: 440622 - RNA, 19 nt, Human
ccccuuugaacagaguggu

SEQ ID NO: 440623 - RNA, 19 nt, Human
cccggcgcggggcgcggga

SEQ ID NO: 440624 - RNA, 20 nt, Human
ccgcgaccggggccgugggc

SEQ ID NO: 440625 - RNA, 21 nt, Human
cgaggcgagcgcucuaggccc

SEQ ID NO: 440626 - RNA, 32 nt, Human
cuagcggcgaccacggccagcgacucucuuuu

SEQ ID NO: 440627 - RNA, 24 nt, Human
cucugcaccagccccaggcuaccc

SEQ ID NO: 440628 - RNA, 20 nt, Human
gaagcacuguccucugaggg

SEQ ID NO: 440629 - RNA, 21 nt, Human
gccgcgaccggggccgugggc

SEQ ID NO: 440630 - RNA, 28 nt, Human
gcggcgaccacggccagcgacucucuuc

SEQ ID NO: 440631 - RNA, 21 nt, Human
gcuuggaacucugcaccagcc

SEQ ID NO: 440632 - RNA, 20 nt, Human
ggcgggcgccagagcccugc

SEQ ID NO: 440633 - RNA, 22 nt, Human
gggcgccagagcccugcucgcg

SEQ ID NO: 440634 - RNA, 25 nt, Human
ggucgcggccccgccucccuccccg

SEQ ID NO: 440635 - RNA, 21 nt, Human
uaaugugagugaggcucaguu

SEQ ID NO: 440636 - RNA, 19 nt, Human
uaccagaaaagggucugau

SEQ ID NO: 440637 - RNA, 20 nt, Human
uaguaauucugauguuuccu

SEQ ID NO: 440638 - RNA, 19 nt, Human
uaguucacacagaaaguga

SEQ ID NO: 440639 - RNA, 19 nt, Human
uauuaacagaagaaaaagg

SEQ ID NO: 440640 - RNA, 21 nt, Human
ucccaagggacagcaaaauac

SEQ ID NO: 440641 - RNA, 18 nt, Human
ucccggcgcggggcgcgg

SEQ ID NO: 440642 - RNA, 28 nt, Human
ucuaccagaaaagggucuggucccguga

SEQ ID NO: 440643 - RNA, 23 nt, Human
ugacaaaaauccaucuauuccaa

SEQ ID NO: 440644 - RNA, 19 nt, Human
uggaacucugcaccagccc

SEQ ID NO: 440645 - RNA, 18 nt, Human
aaaaaacagcaaaaccca

SEQ ID NO: 440646 - RNA, 19 nt, Human
aaacagaaaggaaaauagg

SEQ ID NO: 440647 - RNA, 28 nt, Human
aaacagaaaggaaaauaggagucuccag

SEQ ID NO: 440648 - RNA, 24 nt, Human
aaacucuacacucuauugaccuca

SEQ ID NO: 440649 - RNA, 22 nt, Human
aaaucccucccacccucuaccc

SEQ ID NO: 440650 - RNA, 18 nt, Human
aacaaagauaggggcaca

SEQ ID NO: 440651 - RNA, 18 nt, Human
aacugcgugcugucuaga

SEQ ID NO: 440652 - RNA, 20 nt, Human
aagcaagcacccggguuuua

SEQ ID NO: 440653 - RNA, 25 nt, Human
aagcaagcacccggguuuuacuuca

SEQ ID NO: 440654 - RNA, 22 nt, Human
aagcagcagccgaagcugcugc

SEQ ID NO: 440655 - RNA, 23 nt, Human
aaggaauuuuuaaaaacaugcaa

SEQ ID NO: 440656 - RNA, 22 nt, Human
aaguaaaucccucccacccucu

SEQ ID NO: 440657 - RNA, 18 nt, Human
aauuugcccgacuuccuc

SEQ ID NO: 440658 - RNA, 21 nt, Human
accaaguacuaauucuguacu

SEQ ID NO: 440659 - RNA, 23 nt, Human
accccaccaaccccucagaacgg

SEQ ID NO: 440660 - RNA, 19 nt, Human
acccuugugcaacauuccu

SEQ ID NO: 440661 - RNA, 25 nt, Human
accugcuggaauccuuucugaaacu

SEQ ID NO: 440662 - RNA, 23 nt, Human
acuugugcccacucugaggggga

SEQ ID NO: 440663 - RNA, 19 nt, Human
agacauuacacaacaguau

SEQ ID NO: 440664 - RNA, 19 nt, Human
agagucacuuuaugaaaua

SEQ ID NO: 440665 - RNA, 22 nt, Human
agaguucuucagaaaacugccu

SEQ ID NO: 440666 - RNA, 22 nt, Human
aggaagaaaaaaccacaaucuc

SEQ ID NO: 440667 - RNA, 18 nt, Human
aguacaggucugcaugca

SEQ ID NO: 440668 - RNA, 24 nt, Human
agugcauaucuauccuucaugugc

SEQ ID NO: 440669 - RNA, 23 nt, Human
auuuucuuuuagacagauuuucu

SEQ ID NO: 440670 - RNA, 22 nt, Human
caaauuaagcaccaaaaagauc

SEQ ID NO: 440671 - RNA, 26 nt, Human
caacaucaucacucggcgaccucggu

SEQ ID NO: 440672 - RNA, 19 nt, Human
caagaaaacucaacugaag

SEQ ID NO: 440673 - RNA, 19 nt, Human
caagacaagaaaacucaac

SEQ ID NO: 440674 - RNA, 22 nt, Human
caagacaagaaaacucaacuga

SEQ ID NO: 440675 - RNA, 20 nt, Human
cacacugcacugcuguuggg

SEQ ID NO: 440676 - RNA, 21 nt, Human
cacauucacaacccuugugca

SEQ ID NO: 440677 - RNA, 19 nt, Human
caccaaguacuaauucugu

SEQ ID NO: 440678 - RNA, 21 nt, Human
caccacccugccuccaaagug

SEQ ID NO: 440679 - RNA, 20 nt, Human
cacccccaccacccugccuc

SEQ ID NO: 440680 - RNA, 21 nt, Human
cacccugccuccaaagugauc

SEQ ID NO: 440681 - RNA, 19 nt, Human
cacuaaacacuaagagccc

SEQ ID NO: 440682 - RNA, 19 nt, Human
cacuucuggcuuaaccccu

SEQ ID NO: 440683 - RNA, 19 nt, Human
caguuguuuuuuuuuuugg

SEQ ID NO: 440684 - RNA, 23 nt, Human
cauacagcacaacauuuucuaaa

SEQ ID NO: 440685 - RNA, 26 nt, Human
ccagaccacauguuucagugcauauc

SEQ ID NO: 440686 - RNA, 24 nt, Human
ccagccuccaaggaauuuuuaaaa

SEQ ID NO: 440687 - RNA, 23 nt, Human
ccagguaucgaacaauaguauuc

SEQ ID NO: 440688 - RNA, 19 nt, Human
cccacugccagcaaccgcc

SEQ ID NO: 440689 - RNA, 24 nt, Human
cccagagccucacuuugccauuuc

SEQ ID NO: 440690 - RNA, 18 nt, Human
ccccaccacccugccucc

SEQ ID NO: 440691 - RNA, 19 nt, Human
ccccaccacccugccucca

SEQ ID NO: 440692 - RNA, 19 nt, Human
ccccagagccucacuuugc

SEQ ID NO: 440693 - RNA, 22 nt, Human
cccccuuucacauucacaaccc

SEQ ID NO: 440694 - RNA, 24 nt, Human
ccgaagcugcugccgcugcuccca

SEQ ID NO: 440695 - RNA, 19 nt, Human
ccuccauuagggcucaucc

SEQ ID NO: 440696 - RNA, 23 nt, Human
ccuccauucccccuuucacauuc

SEQ ID NO: 440697 - RNA, 20 nt, Human
ccucccacccucuacccagu

SEQ ID NO: 440698 - RNA, 20 nt, Human
ccugcuggaauccuuucuga

SEQ ID NO: 440699 - RNA, 21 nt, Human
ccuuuucucuucccauccuuc

SEQ ID NO: 440700 - RNA, 19 nt, Human
cgcccgggcguggcaggga

SEQ ID NO: 440701 - RNA, 21 nt, Human
cgcucaguuaucacacugcac

SEQ ID NO: 440702 - RNA, 26 nt, Human
cuacacucuauugaccucagcacaac

SEQ ID NO: 440703 - RNA, 24 nt, Human
cuccuaauuuugcuaaugcugcga

SEQ ID NO: 440704 - RNA, 21 nt, Human
cucugcuuuaugcuuaccaga

SEQ ID NO: 440705 - RNA, 22 nt, Human
cugcugccgcugcucccacugc

SEQ ID NO: 440706 - RNA, 20 nt, Human
cuuaaccccuuccagccucc

SEQ ID NO: 440707 - RNA, 22 nt, Human
cuuaccccaccaaccccucaga

SEQ ID NO: 440708 - RNA, 23 nt, Human
cuucaaaaaacagcaaaacccag

SEQ ID NO: 440709 - RNA, 21 nt, Human
cuuucuugcuuugguugagaa

SEQ ID NO: 440710 - RNA, 20 nt, Human
gaaaaaaccacaaucucaaa

SEQ ID NO: 440711 - RNA, 23 nt, Human
gagcuuaccccaccaaccccuca

SEQ ID NO: 440712 - RNA, 19 nt, Human
gcagccugaaagcagcagc

SEQ ID NO: 440713 - RNA, 18 nt, Human
ggaagauauuucuccuau

SEQ ID NO: 440714 - RNA, 19 nt, Human
ggaauccuuucugaaacuc

SEQ ID NO: 440715 - RNA, 19 nt, Human
ggagaacuuuuaauucuga

SEQ ID NO: 440716 - RNA, 21 nt, Human
gggauucuucuauuuaaugcc

SEQ ID NO: 440717 - RNA, 25 nt, Human
gggcguggcagggacaggcgggcga

SEQ ID NO: 440718 - RNA, 19 nt, Human
ggggcucaaaggccugaaa

SEQ ID NO: 440719 - RNA, 20 nt, Human
ggguugcauguggaguacag

SEQ ID NO: 440720 - RNA, 22 nt, Human
guaauacacauaaaucggacaa

SEQ ID NO: 440721 - RNA, 20 nt, Human
gucaggacaaaggaacaaaa

SEQ ID NO: 440722 - RNA, 19 nt, Human
gugugccuaugggaaccau

SEQ ID NO: 440723 - RNA, 22 nt, Human
guuguuuuuuuuuuuggagguu

SEQ ID NO: 440724 - RNA, 24 nt, Human
uaacuuauuuccucccuugccaaa

SEQ ID NO: 440725 - RNA, 22 nt, Human
uaacuuguauaaaaggucaguu

SEQ ID NO: 440726 - RNA, 23 nt, Human
uaagcaauaaaacugcuccuuuu

SEQ ID NO: 440727 - RNA, 24 nt, Human
uaauacacccccaccacccugccu

SEQ ID NO: 440728 - RNA, 23 nt, Human
uacacauaaaucggacaauuuaa

SEQ ID NO: 440729 - RNA, 21 nt, Human
uacacccccaccacccugccu

SEQ ID NO: 440730 - RNA, 20 nt, Human
uaggcucuuguaagcugccu

SEQ ID NO: 440731 - RNA, 20 nt, Human
ucaaaaaacagcaaaaccca

SEQ ID NO: 440732 - RNA, 20 nt, Human
ucaaaucaagaacauacagc

SEQ ID NO: 440733 - RNA, 19 nt, Human
ucagagaaguggcccacua

SEQ ID NO: 440734 - RNA, 21 nt, Human
ucagugcauaucuauccuuca

SEQ ID NO: 440735 - RNA, 18 nt, Human
ucccacccucuacccagu

SEQ ID NO: 440736 - RNA, 20 nt, Human
ucccacccucuacccaguug

SEQ ID NO: 440737 - RNA, 20 nt, Human
ucccauccuucuaaccuggg

SEQ ID NO: 440738 - RNA, 21 nt, Human
uccguagcaacgagcacucuc

SEQ ID NO: 440739 - RNA, 20 nt, Human
ucuauaagcaauaaaacugc

SEQ ID NO: 440740 - RNA, 23 nt, Human
ucucucaucuuuucucuaucaug

SEQ ID NO: 440741 - RNA, 22 nt, Human
ucuguacuaaaauggucagaaa

SEQ ID NO: 440742 - RNA, 23 nt, Human
ucuuaaaaguaaaucccucccac

SEQ ID NO: 440743 - RNA, 18 nt, Human
ucuucacccuuuguuuuu

SEQ ID NO: 440744 - RNA, 18 nt, Human
ucuuuuguauaaagacau

SEQ ID NO: 440745 - RNA, 21 nt, Human
ugaaaacagaaaggaaaauag

SEQ ID NO: 440746 - RNA, 23 nt, Human
ugaaaucuaaccccagagccuca

SEQ ID NO: 440747 - RNA, 18 nt, Human
ugaauaaaaaaaagaacc

SEQ ID NO: 440748 - RNA, 21 nt, Human
ugaauuggaauaugcgggaaa

SEQ ID NO: 440749 - RNA, 22 nt, Human
ugacaaaacaaagauaggggca

SEQ ID NO: 440750 - RNA, 18 nt, Human
ugacauccguagcaacga

SEQ ID NO: 440751 - RNA, 20 nt, Human
ugagaaggacagcuuuggua

SEQ ID NO: 440752 - RNA, 21 nt, Human
ugagcacauagcucuaagugg

SEQ ID NO: 440753 - RNA, 18 nt, Human
ugcagcggcagccugaaa

SEQ ID NO: 440754 - RNA, 19 nt, Human
ugccagcaaguucaguauc

SEQ ID NO: 440755 - RNA, 21 nt, Human
ugccuaagguuauuuacauaa

SEQ ID NO: 440756 - RNA, 20 nt, Human
ugccuaugggaaccauagga

SEQ ID NO: 440757 - RNA, 25 nt, Human
uggaaaaaguugguuuaguugucaa

SEQ ID NO: 440758 - RNA, 18 nt, Human
uggaauaugcgggaaauu

SEQ ID NO: 440759 - RNA, 21 nt, Human
uggcagggacaggcgggcgac

SEQ ID NO: 440760 - RNA, 23 nt, Human
uguucaagacaagaaaacucaac

SEQ ID NO: 440761 - RNA, 23 nt, Human
uguuggguugcauguggaguaca

SEQ ID NO: 440762 - RNA, 20 nt, Human
uuacuucaguuuacaauaau

SEQ ID NO: 440763 - RNA, 22 nt, Human
uuaggcuccaauucuucuuacu

SEQ ID NO: 440764 - RNA, 24 nt, Human
uuaguugucaccaacuuuucuuac

SEQ ID NO: 440765 - RNA, 26 nt, Human
uuauuuccauuccuccauucccccuu

SEQ ID NO: 440766 - RNA, 23 nt, Human
uucacauauaaaccugcuggaau

SEQ ID NO: 440767 - RNA, 27 nt, Human
uucacccuuuguuuuugucacgacacg

SEQ ID NO: 440768 - RNA, 25 nt, Human
uuccauuccuccauucccccuuuca

SEQ ID NO: 440769 - RNA, 23 nt, Human
uucccccuuucacauucacaacc

SEQ ID NO: 440770 - RNA, 19 nt, Human
uugaccucagcacaacuga

SEQ ID NO: 440771 - RNA, 21 nt, Human
uugcaaauuaagcaccaaaaa

SEQ ID NO: 440772 - RNA, 23 nt, Human
uuuagaaaaauuuuauugagaga

SEQ ID NO: 440773 - RNA, 21 nt, Human
uuuccuauacuggcaugaaag

SEQ ID NO: 440774 - RNA, 23 nt, Human
uuuuuuuuuugaaaauucaagcu

SEQ ID NO: 440775 - RNA, 19 nt, Human
aacugcagaaauacagccc

SEQ ID NO: 440776 - RNA, 19 nt, Human
aagcaaaugaaaaccgaaa

SEQ ID NO: 440777 - RNA, 26 nt, Human
accgaaacugcagaaauacagcccug

SEQ ID NO: 440778 - RNA, 22 nt, Human
agaugauggcucugccuggagc

SEQ ID NO: 440779 - RNA, 24 nt, Human
augaaaaccgaaacugcagaaaua

SEQ ID NO: 440780 - RNA, 20 nt, Human
augcaaaugacaauagcaau

SEQ ID NO: 440781 - RNA, 25 nt, Human
caaaugacaauagcaauaaccuucc

SEQ ID NO: 440782 - RNA, 22 nt, Human
caccauauuuaaacuauuccag

SEQ ID NO: 440783 - RNA, 18 nt, Human
cagcccuggaagaaccuu

SEQ ID NO: 440784 - RNA, 19 nt, Human
cauaggugaggacauaaag

SEQ ID NO: 440785 - RNA, 18 nt, Human
ccuggaagaaccuuggug

SEQ ID NO: 440786 - RNA, 21 nt, Human
uagcaauaaccuuccacugaa

SEQ ID NO: 440787 - RNA, 23 nt, Human
uaggucuguuagaugauggcucu

SEQ ID NO: 440788 - RNA, 18 nt, Human
ugaaaaccgaaacugcag

SEQ ID NO: 440789 - RNA, 23 nt, Human
ugacaauagcaauaaccuuccac

SEQ ID NO: 440790 - RNA, 19 nt, Human
ugcaagaaacuccacauca

SEQ ID NO: 440791 - RNA, 23 nt, Human
uggagcagccucacaacuucagc

SEQ ID NO: 440792 - RNA, 18 nt, Human
uggaguuagauuugaagc

SEQ ID NO: 440793 - RNA, 23 nt, Human
uggcucugccuggagcagccuca

SEQ ID NO: 440794 - RNA, 23 nt, Human
aaaaagaacccuaaaaagcaagg

SEQ ID NO: 440795 - RNA, 18 nt, Human
aaagauauauuaaaccuu

SEQ ID NO: 440796 - RNA, 24 nt, Human
aaaucuaauacuucaucuuucuua

SEQ ID NO: 440797 - RNA, 25 nt, Human
aagcauucuacuacccccagaaaug

SEQ ID NO: 440798 - RNA, 19 nt, Human
aagcggaaaaagaacccua

SEQ ID NO: 440799 - RNA, 25 nt, Human
aagugacauugggaucaggauaguu

SEQ ID NO: 440800 - RNA, 19 nt, Human
aauuuugcaauccaguucu

SEQ ID NO: 440801 - RNA, 18 nt, Human
acacacauacaaacauau

SEQ ID NO: 440802 - RNA, 20 nt, Human
agaaaaucuuuguacccuug

SEQ ID NO: 440803 - RNA, 23 nt, Human
agaagaaaacacaggagaaaauc

SEQ ID NO: 440804 - RNA, 21 nt, Human
agauagcaaaucaacuugaaa

SEQ ID NO: 440805 - RNA, 26 nt, Human
aggagagaacaaguucuuuuucagaa

SEQ ID NO: 440806 - RNA, 19 nt, Human
aucuccauccauccucccu

SEQ ID NO: 440807 - RNA, 18 nt, Human
cacacaauguuuuuguug

SEQ ID NO: 440808 - RNA, 20 nt, Human
cagcagcauuuucucggucu

SEQ ID NO: 440809 - RNA, 21 nt, Human
cccaagggguccggcuccuuc

SEQ ID NO: 440810 - RNA, 27 nt, Human
cccccagaaauguccuuucuuguccac

SEQ ID NO: 440811 - RNA, 18 nt, Human
ccccuucuaaacguaagg

SEQ ID NO: 440812 - RNA, 19 nt, Human
cccucagaaaaacaacuau

SEQ ID NO: 440813 - RNA, 19 nt, Human
cggaaaaagaacccuaaaa

SEQ ID NO: 440814 - RNA, 23 nt, Human
cggaaaaagaacccuaaaaagca

SEQ ID NO: 440815 - RNA, 22 nt, Human
cucaagcauucuacuaccccca

SEQ ID NO: 440816 - RNA, 23 nt, Human
gaacaaguucuuuuucagaacuu

SEQ ID NO: 440817 - RNA, 22 nt, Human
gagaaaaucuuuguacccuugg

SEQ ID NO: 440818 - RNA, 19 nt, Human
gaucacagacuaucaaaug

SEQ ID NO: 440819 - RNA, 24 nt, Human
uaaaaaaaaaauucaugauauaca

SEQ ID NO: 440820 - RNA, 22 nt, Human
uaaaacuucuagaagaaaacac

SEQ ID NO: 440821 - RNA, 18 nt, Human
uaaauaaaagcuucucau

SEQ ID NO: 440822 - RNA, 21 nt, Human
uaagacaucagaagucaccag

SEQ ID NO: 440823 - RNA, 18 nt, Human
uaaguaaacuauuugugu

SEQ ID NO: 440824 - RNA, 22 nt, Human
uacaaaauaagaagaguaaaac

SEQ ID NO: 440825 - RNA, 23 nt, Human
uacaaacauauauucacacaaug

SEQ ID NO: 440826 - RNA, 26 nt, Human
uacacacauacaaacauauauucaca

SEQ ID NO: 440827 - RNA, 25 nt, Human
uacauacacacauacaaacauauag

SEQ ID NO: 440828 - RNA, 22 nt, Human
uacuucaucuuucuuaaugaga

SEQ ID NO: 440829 - RNA, 21 nt, Human
uaucaaaugauaaaacuucua

SEQ ID NO: 440830 - RNA, 24 nt, Human
uaucaguuuuaaauaaaagcuucu

SEQ ID NO: 440831 - RNA, 23 nt, Human
ucagaacuuaaaaaaaaaauuca

SEQ ID NO: 440832 - RNA, 27 nt, Human
ucagaagucaccagaguuguaaauucu

SEQ ID NO: 440833 - RNA, 18 nt, Human
uccaggccucaagcauuc

SEQ ID NO: 440834 - RNA, 18 nt, Human
uccauccauccucccuca

SEQ ID NO: 440835 - RNA, 18 nt, Human
ucccucagaaaaacaacu

SEQ ID NO: 440836 - RNA, 21 nt, Human
ucuaagacaucagaagucacc

SEQ ID NO: 440837 - RNA, 23 nt, Human
ucuagaagaaaacacaggagaaa

SEQ ID NO: 440838 - RNA, 21 nt, Human
ucucaaugccacgcuuugacu

SEQ ID NO: 440839 - RNA, 18 nt, Human
ucucaucaaacuggucuu

SEQ ID NO: 440840 - RNA, 21 nt, Human
ucucuuaaggaagguaaaaau

SEQ ID NO: 440841 - RNA, 19 nt, Human
ucuuaaggaagguaaaaau

SEQ ID NO: 440842 - RNA, 18 nt, Human
ucuucaguccaauuaucu

SEQ ID NO: 440843 - RNA, 20 nt, Human
ugacuauauucaccuuccuu

SEQ ID NO: 440844 - RNA, 22 nt, Human
ugacuauauucaccuuccuuuc

SEQ ID NO: 440845 - RNA, 20 nt, Human
ugauauacauacacacauac

SEQ ID NO: 440846 - RNA, 20 nt, Human
ugcaauccaguucugccuuc

SEQ ID NO: 440847 - RNA, 22 nt, Human
ugggaggaugauuuuccccuuc

SEQ ID NO: 440848 - RNA, 24 nt, Human
uguuuuuguugcuguuguucuuuu

SEQ ID NO: 440849 - RNA, 23 nt, Human
uucagaacuuaaaaaaaaaauuc

SEQ ID NO: 440850 - RNA, 19 nt, Human
uucaucuuucuuaaugaga

SEQ ID NO: 440851 - RNA, 27 nt, Human
uucaugauauacauacacacauacagu

SEQ ID NO: 440852 - RNA, 22 nt, Human
uucuaagacaucagaagucacc

SEQ ID NO: 440853 - RNA, 22 nt, Human
aaaaaugaagacagagccggga

SEQ ID NO: 440854 - RNA, 18 nt, Human
aaagcaaagguuacgugg

SEQ ID NO: 440855 - RNA, 19 nt, Human
aaagugcugcgauuauaga

SEQ ID NO: 440856 - RNA, 24 nt, Human
aaagugcugcgauuauagacagga

SEQ ID NO: 440857 - RNA, 23 nt, Human
aaauacaacacauuccacacuuu

SEQ ID NO: 440858 - RNA, 20 nt, Human
aaccuccaccuccugggcuc

SEQ ID NO: 440859 - RNA, 24 nt, Human
accaacuccgcaaagugaaauuuc

SEQ ID NO: 440860 - RNA, 28 nt, Human
accauguugguuggccaggcuggucucg

SEQ ID NO: 440861 - RNA, 27 nt, Human
accccaaagccugccccacuguguccc

SEQ ID NO: 440862 - RNA, 19 nt, Human
acccugggguggguagggg

SEQ ID NO: 440863 - RNA, 19 nt, Human
acccugggguggguagggg

SEQ ID NO: 440864 - RNA, 23 nt, Human
accucggccucccaaagugcugc

SEQ ID NO: 440865 - RNA, 18 nt, Human
accuuauguggaaaagcu

SEQ ID NO: 440866 - RNA, 22 nt, Human
acgagguuucaccauguugguu

SEQ ID NO: 440867 - RNA, 22 nt, Human
acgagguuucaccauguugguu

SEQ ID NO: 440868 - RNA, 24 nt, Human
acgagguuucaccauguugguugg

SEQ ID NO: 440869 - RNA, 19 nt, Human
acgcccggccaccgcccag

SEQ ID NO: 440870 - RNA, 18 nt, Human
acgggguuucgccauguu

SEQ ID NO: 440871 - RNA, 23 nt, Human
acgggguuucgccauguuggcca

SEQ ID NO: 440872 - RNA, 24 nt, Human
acgggguuucgccauguuggccag

SEQ ID NO: 440873 - RNA, 22 nt, Human
acugcaaccuccaccucccagg

SEQ ID NO: 440874 - RNA, 24 nt, Human
agcgauucucuggccucagccucc

SEQ ID NO: 440875 - RNA, 19 nt, Human
agcgugagccaccacgccc

SEQ ID NO: 440876 - RNA, 24 nt, Human
aggcagagaacccgcugcacguag

SEQ ID NO: 440877 - RNA, 18 nt, Human
aggcuggagugcaguggc

SEQ ID NO: 440878 - RNA, 18 nt, Human
agggcauuuuggcuaaaa

SEQ ID NO: 440879 - RNA, 22 nt, Human
aguagagacgggguuucgccau

SEQ ID NO: 440880 - RNA, 19 nt, Human
aguagcugggauuacaggc

SEQ ID NO: 440881 - RNA, 20 nt, Human
aguccuggcuaauuuuugua

SEQ ID NO: 440882 - RNA, 23 nt, Human
agugcaguggcguagucuuggcu

SEQ ID NO: 440883 - RNA, 24 nt, Human
agugcaguggcguagucuuggcuc

SEQ ID NO: 440884 - RNA, 24 nt, Human
auuuuuguauuuuuaguagagacg

SEQ ID NO: 440885 - RNA, 22 nt, Human
caaagugcugcgauuauagaca

SEQ ID NO: 440886 - RNA, 23 nt, Human
caaccuccaccucccagguucaa

SEQ ID NO: 440887 - RNA, 20 nt, Human
caaccuccaccuccugggcu

SEQ ID NO: 440888 - RNA, 23 nt, Human
caaccuccaccuccugggcucaa

SEQ ID NO: 440889 - RNA, 24 nt, Human
caaccuccaccuccugggcucaag

SEQ ID NO: 440890 - RNA, 18 nt, Human
caagcaauaugcuaagcc

SEQ ID NO: 440891 - RNA, 25 nt, Human
caauucccaagcagaagcguuggca

SEQ ID NO: 440892 - RNA, 22 nt, Human
cacagacuuaaaccggcucagg

SEQ ID NO: 440893 - RNA, 25 nt, Human
caccauguugguuggccaggcuggu

SEQ ID NO: 440894 - RNA, 28 nt, Human
caccauguugguuggccaggcuggucuc

SEQ ID NO: 440895 - RNA, 24 nt, Human
cacccacuuuuguuuuguuuugaa

SEQ ID NO: 440896 - RNA, 19 nt, Human
caccggagccugccugcug

SEQ ID NO: 440897 - RNA, 19 nt, Human
caccggagccugccugcug

SEQ ID NO: 440898 - RNA, 21 nt, Human
caccggagccugccugcugga

SEQ ID NO: 440899 - RNA, 21 nt, Human
caccggagccugccugcugga

SEQ ID NO: 440900 - RNA, 20 nt, Human
caccguccuccccagcccag

SEQ ID NO: 440901 - RNA, 21 nt, Human
cacugcaaccuccaccuccug

SEQ ID NO: 440902 - RNA, 23 nt, Human
cacugcaaccuccaccuccuggg

SEQ ID NO: 440903 - RNA, 22 nt, Human
cagaagcugggauuacaggcac

SEQ ID NO: 440904 - RNA, 25 nt, Human
cagaagcugggauuacaggcacaug

SEQ ID NO: 440905 - RNA, 21 nt, Human
cagaauggagcccacggaggc

SEQ ID NO: 440906 - RNA, 24 nt, Human
cagcaaccugucgaaaauacaaca

SEQ ID NO: 440907 - RNA, 19 nt, Human
cagcaggaagcaggcucuc

SEQ ID NO: 440908 - RNA, 19 nt, Human
cagcccugagaagucagca

SEQ ID NO: 440909 - RNA, 21 nt, Human
cagcccugagaagucagcagc

SEQ ID NO: 440910 - RNA, 18 nt, Human
cagcgccgcagcagcugc

SEQ ID NO: 440911 - RNA, 21 nt, Human
cagggagcaaccccaaagccu

SEQ ID NO: 440912 - RNA, 22 nt, Human
caguggauggucucugagguuc

SEQ ID NO: 440913 - RNA, 20 nt, Human
cauggcccggaggugucagg

SEQ ID NO: 440914 - RNA, 23 nt, Human
cauguuggccaggcuggucucga

SEQ ID NO: 440915 - RNA, 18 nt, Human
ccaaagugcugcgauuau

SEQ ID NO: 440916 - RNA, 18 nt, Human
ccaagcaauaugcuaagc

SEQ ID NO: 440917 - RNA, 19 nt, Human
ccacccagaauguuccugc

SEQ ID NO: 440918 - RNA, 24 nt, Human
ccaccucccagguucaagcgauuc

SEQ ID NO: 440919 - RNA, 21 nt, Human
ccacggaggcgugggcugccc

SEQ ID NO: 440920 - RNA, 19 nt, Human
ccacucaaagccaccucuc

SEQ ID NO: 440921 - RNA, 22 nt, Human
ccacugugucccuuccagcugc

SEQ ID NO: 440922 - RNA, 23 nt, Human
ccacugugucccuuccagcugcc

SEQ ID NO: 440923 - RNA, 21 nt, Human
ccagaagcugggauuacaggc

SEQ ID NO: 440924 - RNA, 22 nt, Human
ccagaagcugggauuacaggca

SEQ ID NO: 440925 - RNA, 19 nt, Human
ccauguuggccaggcuggu

SEQ ID NO: 440926 - RNA, 22 nt, Human
ccauguuggccaggcuggucuc

SEQ ID NO: 440927 - RNA, 23 nt, Human
ccauguuggccaggcuggucucg

SEQ ID NO: 440928 - RNA, 20 nt, Human
cccaggcuggagugcagcga

SEQ ID NO: 440929 - RNA, 20 nt, Human
cccagguucaagcgauucuc

SEQ ID NO: 440930 - RNA, 22 nt, Human
cccagguucaagcgauucucug

SEQ ID NO: 440931 - RNA, 18 nt, Human
ccccaaagccugccccac

SEQ ID NO: 440932 - RNA, 22 nt, Human
ccccagcccagcuugucuucac

SEQ ID NO: 440933 - RNA, 18 nt, Human
cccccgcggcagcgccgc

SEQ ID NO: 440934 - RNA, 23 nt, Human
cccccgcggcagcgccgcagcag

SEQ ID NO: 440935 - RNA, 23 nt, Human
ccccggguccccggccauggccc

SEQ ID NO: 440936 - RNA, 23 nt, Human
ccccuccggggccuggcgggggc

SEQ ID NO: 440937 - RNA, 23 nt, Human
cccgaguagcugggauuacaggc

SEQ ID NO: 440938 - RNA, 24 nt, Human
cccgaguagcugggauuacaggcg

SEQ ID NO: 440939 - RNA, 19 nt, Human
cccgcugcacguagaaucc

SEQ ID NO: 440940 - RNA, 19 nt, Human
cccugcguccccggccucg

SEQ ID NO: 440941 - RNA, 22 nt, Human
ccgaguagcugggauuacaggc

SEQ ID NO: 440942 - RNA, 18 nt, Human
ccgccgccgcuuccgcgc

SEQ ID NO: 440943 - RNA, 23 nt, Human
ccgccgccgcuuccgcgccgccc

SEQ ID NO: 440944 - RNA, 19 nt, Human
ccgccgcuuccgcgccgcc

SEQ ID NO: 440945 - RNA, 23 nt, Human
ccgccucagccucccgaguagcu

SEQ ID NO: 440946 - RNA, 21 nt, Human
ccgcgccgccgccgcuucccc

SEQ ID NO: 440947 - RNA, 24 nt, Human
ccgcuccuccccuccggggccugg

SEQ ID NO: 440948 - RNA, 23 nt, Human
ccguccuccccagcccagcuugu

SEQ ID NO: 440949 - RNA, 19 nt, Human
ccuccaccuccugggcuca

SEQ ID NO: 440950 - RNA, 24 nt, Human
ccuccagaagcugggauuacaggc

SEQ ID NO: 440951 - RNA, 24 nt, Human
ccucccagguucaagcgauucucu

SEQ ID NO: 440952 - RNA, 24 nt, Human
ccuccggggccuggcgggggcgcg

SEQ ID NO: 440953 - RNA, 24 nt, Human
ccuccuagacaccguccuccccag

SEQ ID NO: 440954 - RNA, 25 nt, Human
ccuccugggcucaagcgaaucuucc

SEQ ID NO: 440955 - RNA, 19 nt, Human
ccugaccucagcugaucug

SEQ ID NO: 440956 - RNA, 21 nt, Human
cgagcccccggguccccggcc

SEQ ID NO: 440957 - RNA, 28 nt, Human
cgagguuucaccauguugguuggccagg

SEQ ID NO: 440958 - RNA, 24 nt, Human
cgccauguuggccaggcuggucuc

SEQ ID NO: 440959 - RNA, 22 nt, Human
cgccgccgccgcuuccgcgccg

SEQ ID NO: 440960 - RNA, 24 nt, Human
cgccucagccucccgaguagcugg

SEQ ID NO: 440961 - RNA, 24 nt, Human
cgcucuugucgcccaggcuggagu

SEQ ID NO: 440962 - RNA, 18 nt, Human
cggaggcagagaacccgc

SEQ ID NO: 440963 - RNA, 19 nt, Human
cggcggaaccgcuucccuu

SEQ ID NO: 440964 - RNA, 21 nt, Human
cgggggggcggcugcacgggg

SEQ ID NO: 440965 - RNA, 24 nt, Human
cgggguuucgccauguuggccagg

SEQ ID NO: 440966 - RNA, 25 nt, Human
cguagacccgcagggccgcccgcgc

SEQ ID NO: 440967 - RNA, 23 nt, Human
cguuucuucuaaacccucccagg

SEQ ID NO: 440968 - RNA, 26 nt, Human
cucaaaucucuuuccuuuuuccaccu

SEQ ID NO: 440969 - RNA, 18 nt, Human
cucaagcgaaucuuccgc

SEQ ID NO: 440970 - RNA, 24 nt, Human
cucacugcaaccuccaccuccugg

SEQ ID NO: 440971 - RNA, 26 nt, Human
cucacugcaaccuccaccuccugggc

SEQ ID NO: 440972 - RNA, 23 nt, Human
cucacuucucaaaucucuuuccu

SEQ ID NO: 440973 - RNA, 24 nt, Human
cucagccucccgaguagcugggau

SEQ ID NO: 440974 - RNA, 23 nt, Human
cuccaggcuggagugcaguggcg

SEQ ID NO: 440975 - RNA, 24 nt, Human
cuccaggcuggagugcaguggcgu

SEQ ID NO: 440976 - RNA, 22 nt, Human
cuccggggccuggcgggggcgc

SEQ ID NO: 440977 - RNA, 22 nt, Human
cuccucuaggcucugcugcacg

SEQ ID NO: 440978 - RNA, 25 nt, Human
cuccugggcucaagcgaaucuuccg

SEQ ID NO: 440979 - RNA, 21 nt, Human
cucgaacuccugaccucagcc

SEQ ID NO: 440980 - RNA, 25 nt, Human
cucgaaucucuuuccuuuuuccacc

SEQ ID NO: 440981 - RNA, 19 nt, Human
cucgaucuccugaccucag

SEQ ID NO: 440982 - RNA, 24 nt, Human
cucgcucuugucgcccaggcugga

SEQ ID NO: 440983 - RNA, 19 nt, Human
cucucuggcagcaaccugu

SEQ ID NO: 440984 - RNA, 23 nt, Human
cucuggccucagccuccagaagc

SEQ ID NO: 440985 - RNA, 21 nt, Human
cucuugucgcccaggcuggag

SEQ ID NO: 440986 - RNA, 24 nt, Human
cugaucugcccaccucggccuccc

SEQ ID NO: 440987 - RNA, 23 nt, Human
cugcaaccuccaccucccagguu

SEQ ID NO: 440988 - RNA, 24 nt, Human
cugcaaccuccaccucccagguuc

SEQ ID NO: 440989 - RNA, 18 nt, Human
cugcaaccuccaccuccu

SEQ ID NO: 440990 - RNA, 20 nt, Human
cugccuggagcugagugggg

SEQ ID NO: 440991 - RNA, 22 nt, Human
cuggagugcagcgaucucagcu

SEQ ID NO: 440992 - RNA, 19 nt, Human
cuggccucagccuccagaa

SEQ ID NO: 440993 - RNA, 21 nt, Human
cuggccucagccuccagaagc

SEQ ID NO: 440994 - RNA, 18 nt, Human
cuggccuccaggcuggag

SEQ ID NO: 440995 - RNA, 23 nt, Human
cuggccuccaggcuggagugcag

SEQ ID NO: 440996 - RNA, 21 nt, Human
cugugucccuuccagcugccc

SEQ ID NO: 440997 - RNA, 19 nt, Human
cuguuugcuuuuuguuaag

SEQ ID NO: 440998 - RNA, 24 nt, Human
cuuacugcaaccuccaccucccag

SEQ ID NO: 440999 - RNA, 24 nt, Human
cuugucgcccaggcuggagugcag

SEQ ID NO: 441000 - RNA, 22 nt, Human
cuuuuuaagaagggcauuuugg

SEQ ID NO: 441001 - RNA, 19 nt, Human
gaaaauacaacacauucca

SEQ ID NO: 441002 - RNA, 20 nt, Human
gaccucagcgugagccacca

SEQ ID NO: 441003 - RNA, 24 nt, Human
gaccucagcugaucugcccaccuc

SEQ ID NO: 441004 - RNA, 20 nt, Human
gagaacacccggagcugagg

SEQ ID NO: 441005 - RNA, 18 nt, Human
gagaacgcuggcaaugcu

SEQ ID NO: 441006 - RNA, 24 nt, Human
gagacgggguuucgccauguuggc

SEQ ID NO: 441007 - RNA, 26 nt, Human
gaguagcugggauuacaggcgggugc

SEQ ID NO: 441008 - RNA, 21 nt, Human
gauucucuggccucagccucc

SEQ ID NO: 441009 - RNA, 18 nt, Human
gcaaccuccaccucccag

SEQ ID NO: 441010 - RNA, 22 nt, Human
gcaaccuccaccuccugggcuc

SEQ ID NO: 441011 - RNA, 23 nt, Human
gcagcgaucucagcuuacugcaa

SEQ ID NO: 441012 - RNA, 23 nt, Human
gccauguuggccaggcuggucuc

SEQ ID NO: 441013 - RNA, 22 nt, Human
gcccaggcuggagugcagcgau

SEQ ID NO: 441014 - RNA, 22 nt, Human
gcccggaggugucagggugcgc

SEQ ID NO: 441015 - RNA, 18 nt, Human
gccucagccuccagaagc

SEQ ID NO: 441016 - RNA, 24 nt, Human
gcgaaucuuccgccucagccuccc

SEQ ID NO: 441017 - RNA, 19 nt, Human
gcguccccggccucggggc

SEQ ID NO: 441018 - RNA, 24 nt, Human
gcucuugucgcccaggcuggagug

SEQ ID NO: 441019 - RNA, 21 nt, Human
gcugcacgggggcugcuuggu

SEQ ID NO: 441020 - RNA, 18 nt, Human
gcugcgauuauagacagg

SEQ ID NO: 441021 - RNA, 19 nt, Human
gcuggagugcaguggcgua

SEQ ID NO: 441022 - RNA, 23 nt, Human
gcuggucucgaacuccugaccuc

SEQ ID NO: 441023 - RNA, 23 nt, Human
gcuggucucgaucuccugaccuc

SEQ ID NO: 441024 - RNA, 22 nt, Human
ggagccaccgcccccgacccuc

SEQ ID NO: 441025 - RNA, 22 nt, Human
ggccucagccuccagaagcugg

SEQ ID NO: 441026 - RNA, 19 nt, Human
ggccuccaggcuggagugc

SEQ ID NO: 441027 - RNA, 24 nt, Human
ggcuggucucgaacuccugaccuc

SEQ ID NO: 441028 - RNA, 24 nt, Human
ggcuggucucgaucuccugaccuc

SEQ ID NO: 441029 - RNA, 19 nt, Human
gggaacuggacuuuuaggg

SEQ ID NO: 441030 - RNA, 19 nt, Human
gggaauaggggaggaaagg

SEQ ID NO: 441031 - RNA, 19 nt, Human
gggcaauauuuuaaaauuc

SEQ ID NO: 441032 - RNA, 19 nt, Human
gggcgugcgagcccccggg

SEQ ID NO: 441033 - RNA, 28 nt, Human
gggcgugcgagcccccggguccccggcc

SEQ ID NO: 441034 - RNA, 21 nt, Human
ggggaacgauggcuuaaaaau

SEQ ID NO: 441035 - RNA, 22 nt, Human
ggggcggcugcacgggggcugc

SEQ ID NO: 441036 - RNA, 23 nt, Human
gggguuucgccauguuggccagg

SEQ ID NO: 441037 - RNA, 21 nt, Human
gggucgaggucccugggacgc

SEQ ID NO: 441038 - RNA, 21 nt, Human
gggugccaccgcaucuggcua

SEQ ID NO: 441039 - RNA, 22 nt, Human
ggguuucgccauguuggccagg

SEQ ID NO: 441040 - RNA, 20 nt, Human
ggucgaggucccugggacgc

SEQ ID NO: 441041 - RNA, 19 nt, Human
ggucucgaacuccugaccu

SEQ ID NO: 441042 - RNA, 23 nt, Human
guagagacgggguuucgccaugu

SEQ ID NO: 441043 - RNA, 30 nt, Human
uaaaaagcaguucuacauguuggaaaacgg

SEQ ID NO: 441044 - RNA, 18 nt, Human
uaaaauucauuuccccua

SEQ ID NO: 441045 - RNA, 24 nt, Human
uaagaagggcauuuuggcuaaaag

SEQ ID NO: 441046 - RNA, 24 nt, Human
uaauuuuuguauuuuuaguagaga

SEQ ID NO: 441047 - RNA, 21 nt, Human
uaccgcguagacccgcagggc

SEQ ID NO: 441048 - RNA, 20 nt, Human
uacugcaaccuccaccuccc

SEQ ID NO: 441049 - RNA, 21 nt, Human
uacugcaaccuccaccuccca

SEQ ID NO: 441050 - RNA, 22 nt, Human
uagacaggagccaccgcccccg

SEQ ID NO: 441051 - RNA, 22 nt, Human
uagagacgggguuucgccaugu

SEQ ID NO: 441052 - RNA, 23 nt, Human
uaggggaggaaaggaaacccacu

SEQ ID NO: 441053 - RNA, 20 nt, Human
uaggggucgaggucccuggg

SEQ ID NO: 441054 - RNA, 24 nt, Human
uaguagacacgagguuucaccaug

SEQ ID NO: 441055 - RNA, 24 nt, Human
uaguagagacgggguuucgccaug

SEQ ID NO: 441056 - RNA, 23 nt, Human
uaguuucuuguauuuuuaguaga

SEQ ID NO: 441057 - RNA, 25 nt, Human
uauagacaggagccaccgcccccga

SEQ ID NO: 441058 - RNA, 22 nt, Human
ucaaagacaguggauggucucu

SEQ ID NO: 441059 - RNA, 21 nt, Human
ucaccgcggcgccuaccgcgu

SEQ ID NO: 441060 - RNA, 23 nt, Human
ucacugcaaccuccaccuccugg

SEQ ID NO: 441061 - RNA, 24 nt, Human
ucacugcaaccuccaccuccuggg

SEQ ID NO: 441062 - RNA, 25 nt, Human
ucacugcaaccuccaccuccugggc

SEQ ID NO: 441063 - RNA, 27 nt, Human
ucacugcaaccuccaccuccugggcuc

SEQ ID NO: 441064 - RNA, 20 nt, Human
ucagccucccgaguagcugg

SEQ ID NO: 441065 - RNA, 25 nt, Human
ucagcuuacugcaaccuccaccucc

SEQ ID NO: 441066 - RNA, 23 nt, Human
uccagaagcugggauuacaggca

SEQ ID NO: 441067 - RNA, 24 nt, Human
ucccaaagugcugcgauuauagac

SEQ ID NO: 441068 - RNA, 21 nt, Human
ucccagguucaagcgauucuc

SEQ ID NO: 441069 - RNA, 23 nt, Human
ucccagguucaagcgauucucug

SEQ ID NO: 441070 - RNA, 24 nt, Human
ucccgaguagcugggauuacaggc

SEQ ID NO: 441071 - RNA, 21 nt, Human
ucccugggacgcccgcuccuc

SEQ ID NO: 441072 - RNA, 26 nt, Human
ucccugggacgcccgcuccuccccuc

SEQ ID NO: 441073 - RNA, 19 nt, Human
ucccuuccagcugcccuuc

SEQ ID NO: 441074 - RNA, 21 nt, Human
uccuagacaccguccucccca

SEQ ID NO: 441075 - RNA, 21 nt, Human
uccugggcucaagcgaaucuu

SEQ ID NO: 441076 - RNA, 22 nt, Human
ucgccauguuggccaggcuggu

SEQ ID NO: 441077 - RNA, 24 nt, Human
ucgccauguuggccaggcuggucu

SEQ ID NO: 441078 - RNA, 18 nt, Human
ucgcccaggcuggagugc

SEQ ID NO: 441079 - RNA, 18 nt, Human
ucggccucccaaagugcu

SEQ ID NO: 441080 - RNA, 26 nt, Human
ucucaaaucucuuuccuuuuuccacc

SEQ ID NO: 441081 - RNA, 22 nt, Human
ucucacucuggccuccaggcug

SEQ ID NO: 441082 - RNA, 23 nt, Human
ucucacucuggccuccaggcugg

SEQ ID NO: 441083 - RNA, 24 nt, Human
ucucacucuggccuccaggcugga

SEQ ID NO: 441084 - RNA, 23 nt, Human
ucucgaacuccugaccucagcgu

SEQ ID NO: 441085 - RNA, 24 nt, Human
ucucgcucuugucgcccaggcugg

SEQ ID NO: 441086 - RNA, 25 nt, Human
ucucgcucuugucgcccaggcugga

SEQ ID NO: 441087 - RNA, 23 nt, Human
ucucuuuccuuuuuccaccuucu

SEQ ID NO: 441088 - RNA, 21 nt, Human
ugaaaggcagguaguuccuuu

SEQ ID NO: 441089 - RNA, 25 nt, Human
ugaaugacugaaagcaacucgcagg

SEQ ID NO: 441090 - RNA, 18 nt, Human
ugaccucagcugaucugc

SEQ ID NO: 441091 - RNA, 18 nt, Human
ugacugaaagcaacucgc

SEQ ID NO: 441092 - RNA, 25 nt, Human
ugacugaaagcaacucgcaggaauc

SEQ ID NO: 441093 - RNA, 27 nt, Human
ugacuuguaagacaacacgcuuccucu

SEQ ID NO: 441094 - RNA, 20 nt, Human
ugagaagucagcagccguga

SEQ ID NO: 441095 - RNA, 23 nt, Human
ugaucugcccaccucggccuccc

SEQ ID NO: 441096 - RNA, 24 nt, Human
ugaucugcccaccucggccuccca

SEQ ID NO: 441097 - RNA, 22 nt, Human
ugaucuggaccucgcagaaguc

SEQ ID NO: 441098 - RNA, 22 nt, Human
ugcaguggcguagucuuggcuc

SEQ ID NO: 441099 - RNA, 21 nt, Human
ugccccacugugucccuucca

SEQ ID NO: 441100 - RNA, 19 nt, Human
ugccuggagcugagugggg

SEQ ID NO: 441101 - RNA, 19 nt, Human
ugccuggagcugagugggg

SEQ ID NO: 441102 - RNA, 24 nt, Human
ugcgauuauagacaggagccaccg

SEQ ID NO: 441103 - RNA, 22 nt, Human
ugcggggaugacuuguaagaca

SEQ ID NO: 441104 - RNA, 22 nt, Human
ugcguuucuucuaaacccuccc

SEQ ID NO: 441105 - RNA, 24 nt, Human
ugcuacagaauggagcccacggag

SEQ ID NO: 441106 - RNA, 23 nt, Human
uggagugcaguggcguagucuug

SEQ ID NO: 441107 - RNA, 24 nt, Human
uggagugcaguggcguagucuugg

SEQ ID NO: 441108 - RNA, 24 nt, Human
uggccaggcuggucucgaacuccu

SEQ ID NO: 441109 - RNA, 24 nt, Human
uggccaggcuggucucgaucuccu

SEQ ID NO: 441110 - RNA, 20 nt, Human
uggccucagccuccagaagc

SEQ ID NO: 441111 - RNA, 22 nt, Human
uggcuccaggaagcccccgcgg

SEQ ID NO: 441112 - RNA, 19 nt, Human
ugggauuacaggcacaugc

SEQ ID NO: 441113 - RNA, 21 nt, Human
ugggauuacaggcacaugcca

SEQ ID NO: 441114 - RNA, 21 nt, Human
ugggauuacaggcacaugcca

SEQ ID NO: 441115 - RNA, 22 nt, Human
ugggauuacaggcacaugccau

SEQ ID NO: 441116 - RNA, 23 nt, Human
ugggauuacaggcacaugccauc

SEQ ID NO: 441117 - RNA, 24 nt, Human
ugggauuacaggcacaugccauca

SEQ ID NO: 441118 - RNA, 21 nt, Human
ugggauuacaggcgggugcca

SEQ ID NO: 441119 - RNA, 22 nt, Human
ugggauuacaggcgggugccac

SEQ ID NO: 441120 - RNA, 24 nt, Human
ugggauuacaggcgggugccaccg

SEQ ID NO: 441121 - RNA, 27 nt, Human
uggggacccugggguggguaggggucg

SEQ ID NO: 441122 - RNA, 22 nt, Human
ugggguggguaggggucgaggu

SEQ ID NO: 441123 - RNA, 19 nt, Human
ugguuggccaggcuggucu

SEQ ID NO: 441124 - RNA, 21 nt, Human
uguauuuuuaguagagacggg

SEQ ID NO: 441125 - RNA, 20 nt, Human
ugucagggugcgcggggggg

SEQ ID NO: 441126 - RNA, 18 nt, Human
ugucccuuccagcugccc

SEQ ID NO: 441127 - RNA, 18 nt, Human
ugucccuuccagcugccc

SEQ ID NO: 441128 - RNA, 23 nt, Human
ugucccuuccagcugcccuucug

SEQ ID NO: 441129 - RNA, 21 nt, Human
ugucgcccaggcuggagugca

SEQ ID NO: 441130 - RNA, 23 nt, Human
ugucuucacggaggcagagaacc

SEQ ID NO: 441131 - RNA, 23 nt, Human
uguugguuggccaggcuggucuc

SEQ ID NO: 441132 - RNA, 23 nt, Human
uguuuuguuuugagacggagucu

SEQ ID NO: 441133 - RNA, 24 nt, Human
uuacugcaaccuccaccucccagg

SEQ ID NO: 441134 - RNA, 25 nt, Human
uuacugcaaccuccaccucccaggu

SEQ ID NO: 441135 - RNA, 24 nt, Human
uuaguagacacgagguuucaccau

SEQ ID NO: 441136 - RNA, 18 nt, Human
uuaguagagacgggguuu

SEQ ID NO: 441137 - RNA, 22 nt, Human
uuaguagagacgggguuucgcc

SEQ ID NO: 441138 - RNA, 24 nt, Human
uuaguagagacgggguuucgccau

SEQ ID NO: 441139 - RNA, 23 nt, Human
uucaagcgauucucuggccucag

SEQ ID NO: 441140 - RNA, 18 nt, Human
uuccaaguucacggcgga

SEQ ID NO: 441141 - RNA, 22 nt, Human
uucccaagcagaagucguccgg

SEQ ID NO: 441142 - RNA, 24 nt, Human
uucucgaaucucuuuccuuuuucc

SEQ ID NO: 441143 - RNA, 21 nt, Human
uucucuggccucagccuccag

SEQ ID NO: 441144 - RNA, 19 nt, Human
uucuuguauuuuuaguaga

SEQ ID NO: 441145 - RNA, 23 nt, Human
uuguauuuuuaguagagacgggg

SEQ ID NO: 441146 - RNA, 19 nt, Human
uuucaccauguugguuggc

SEQ ID NO: 441147 - RNA, 24 nt, Human
uuucgccauguuggccaggcuggu

SEQ ID NO: 441148 - RNA, 23 nt, Human
uuucgccauguuggccaggcugu

SEQ ID NO: 441149 - RNA, 19 nt, Human
uuucuguuucccugaauga

SEQ ID NO: 441150 - RNA, 24 nt, Human
uuuuuaguagacacgagguuucac

SEQ ID NO: 441151 - RNA, 23 nt, Human
uuuuuaguagagacgggguuucg

SEQ ID NO: 441152 - RNA, 24 nt, Human
uuuuuaguagagacgggguuucgc

SEQ ID NO: 441153 - RNA, 25 nt, Human
uuuuuccuccaguuaaaaagcaguu

SEQ ID NO: 441154 - RNA, 20 nt, Human
uuuuuguauuuuuaguagag

SEQ ID NO: 441155 - RNA, 23 nt, Human
uuuuuucuuuuugagagagucuc

SEQ ID NO: 441156 - RNA, 19 nt, Human
aaaaaaaaaaagaaaaaaa

SEQ ID NO: 441157 - RNA, 19 nt, Human
aaaaaaaagaaaaaaaaaa

SEQ ID NO: 441158 - RNA, 23 nt, Human
aaaagaaaaaaaaaaaaccuuua

SEQ ID NO: 441159 - RNA, 18 nt, Human
aaaagaaacaaauccauc

SEQ ID NO: 441160 - RNA, 22 nt, Human
aaagaaacaaauccaucauugg

SEQ ID NO: 441161 - RNA, 23 nt, Human
aaagaaacaaauccaucauuggg

SEQ ID NO: 441162 - RNA, 18 nt, Human
aacagcaaccaguaaaau

SEQ ID NO: 441163 - RNA, 20 nt, Human
acauaaaagaaacaaaucca

SEQ ID NO: 441164 - RNA, 22 nt, Human
caaccaguaaaauuuaucccaa

SEQ ID NO: 441165 - RNA, 20 nt, Human
cacaacagcaaccaguaaaa

SEQ ID NO: 441166 - RNA, 19 nt, Human
cacagccccagccaccgcc

SEQ ID NO: 441167 - RNA, 23 nt, Human
cacagccccagccaccgcccccc

SEQ ID NO: 441168 - RNA, 26 nt, Human
cacagccccagccaccgccccccaac

SEQ ID NO: 441169 - RNA, 20 nt, Human
cagccaccgccccccaacca

SEQ ID NO: 441170 - RNA, 21 nt, Human
cauuucuauuuuauuauggaa

SEQ ID NO: 441171 - RNA, 22 nt, Human
ccaaaaauaacucgguacaaaa

SEQ ID NO: 441172 - RNA, 19 nt, Human
ccaguaaaauuuaucccaa

SEQ ID NO: 441173 - RNA, 24 nt, Human
ccaucauugggcgcacagccccag

SEQ ID NO: 441174 - RNA, 21 nt, Human
cccaaccagggagcaagagga

SEQ ID NO: 441175 - RNA, 20 nt, Human
cgcacagccccagccaccgc

SEQ ID NO: 441176 - RNA, 19 nt, Human
cgccaccuucuccacaaca

SEQ ID NO: 441177 - RNA, 22 nt, Human
cgcggaaucgggcucgugccga

SEQ ID NO: 441178 - RNA, 20 nt, Human
gagcaagaggagacgccugg

SEQ ID NO: 441179 - RNA, 21 nt, Human
gcacagccccagccaccgccc

SEQ ID NO: 441180 - RNA, 23 nt, Human
gccaccuucuccacaacagcaac

SEQ ID NO: 441181 - RNA, 20 nt, Human
ggagcaagaggagacgccug

SEQ ID NO: 441182 - RNA, 27 nt, Human
uaaaagaaacaaauccaucauugggcg

SEQ ID NO: 441183 - RNA, 18 nt, Human
uaacucgguacaaaacag

SEQ ID NO: 441184 - RNA, 23 nt, Human
ucagaauuaaaaaaaaaaaaaag

SEQ ID NO: 441185 - RNA, 29 nt, Human
ucagaauuaaaaaaaaaaaaaagaaaaaa

SEQ ID NO: 441186 - RNA, 23 nt, Human
uucagaauuaaaaaaaaaaaaaa

SEQ ID NO: 441187 - RNA, 25 nt, Human
uucagaauuaaaaaaaaaaaaaaga

SEQ ID NO: 441188 - RNA, 21 nt, Human
uuucagaauuaaaaaaaaaaa

SEQ ID NO: 441189 - RNA, 21 nt, Human
aucccugucccucccaacccc

SEQ ID NO: 441190 - RNA, 20 nt, Human
auuuaucccugucccuccca

SEQ ID NO: 441191 - RNA, 18 nt, Human
cccucccaacccccgggc

SEQ ID NO: 441192 - RNA, 19 nt, Human
cccucccaacccccgggcu

SEQ ID NO: 441193 - RNA, 20 nt, Human
ccucagagcuccagccauug

SEQ ID NO: 441194 - RNA, 24 nt, Human
ccuccuggcucagggagccugggc

SEQ ID NO: 441195 - RNA, 25 nt, Human
cucccaacccccgggcucccaaguu

SEQ ID NO: 441196 - RNA, 18 nt, Human
gccugggccccucagagc

SEQ ID NO: 441197 - RNA, 20 nt, Human
gccugggccccucagagcuc

SEQ ID NO: 441198 - RNA, 22 nt, Human
gggagccugggccccucagagc

SEQ ID NO: 441199 - RNA, 21 nt, Human
ucccaacccccgggcucccaa

SEQ ID NO: 441200 - RNA, 22 nt, Human
ucccucccaacccccgggcucc

SEQ ID NO: 441201 - RNA, 20 nt, Human
ugggccccucagagcuccag

SEQ ID NO: 441202 - RNA, 25 nt, Human
ugggguucuucccuggaacucuccu

SEQ ID NO: 441203 - RNA, 27 nt, Human
ugucuuuauuuaucccugucccuccca

SEQ ID NO: 441204 - RNA, 19 nt, Human
uuaucccugucccucccaa

SEQ ID NO: 441205 - RNA, 18 nt, Human
aaaaaacauccccucccc

SEQ ID NO: 441206 - RNA, 23 nt, Human
aaaaacuaguggagaucuucuga

SEQ ID NO: 441207 - RNA, 18 nt, Human
aaaaagagaacaugaugg

SEQ ID NO: 441208 - RNA, 19 nt, Human
aaaaagucacugaaccucu

SEQ ID NO: 441209 - RNA, 20 nt, Human
aaaagucacugaaccucucc

SEQ ID NO: 441210 - RNA, 22 nt, Human
aaacagcacacacucaauucuc

SEQ ID NO: 441211 - RNA, 26 nt, Human
aaaccagaagauaaaaagaugcaaag

SEQ ID NO: 441212 - RNA, 19 nt, Human
aaaccucuacccccaaccc

SEQ ID NO: 441213 - RNA, 24 nt, Human
aaacucccuaccuuuuuuccagcu

SEQ ID NO: 441214 - RNA, 19 nt, Human
aaagcucuuucacucugcu

SEQ ID NO: 441215 - RNA, 19 nt, Human
aaaugcagaucagaaaagg

SEQ ID NO: 441216 - RNA, 25 nt, Human
aacaaaaagagaacaugaugggucu

SEQ ID NO: 441217 - RNA, 27 nt, Human
aacaaagauccuuccucacuuugcaaa

SEQ ID NO: 441218 - RNA, 19 nt, Human
aacccuuguccucacccuc

SEQ ID NO: 441219 - RNA, 18 nt, Human
aaccucuacccccaaccc

SEQ ID NO: 441220 - RNA, 26 nt, Human
aaccugucaacaaagauccuuccucu

SEQ ID NO: 441221 - RNA, 20 nt, Human
aacucccggcugcuccccuc

SEQ ID NO: 441222 - RNA, 24 nt, Human
aagaauccauuuccaaagcaccac

SEQ ID NO: 441223 - RNA, 26 nt, Human
aagaggaggcgaaagagaggggaccc

SEQ ID NO: 441224 - RNA, 25 nt, Human
aagaugccuuuucauaaaauggaau

SEQ ID NO: 441225 - RNA, 25 nt, Human
aagcaaaugcaaauucugcugcacu

SEQ ID NO: 441226 - RNA, 26 nt, Human
aaggguacaaaaggaauaucaagggg

SEQ ID NO: 441227 - RNA, 20 nt, Human
acaacccuuguccucacccu

SEQ ID NO: 441228 - RNA, 22 nt, Human
acacacacaggcacacacacaa

SEQ ID NO: 441229 - RNA, 20 nt, Human
acacuuguccuacugaugau

SEQ ID NO: 441230 - RNA, 23 nt, Human
acccaacaguguaacaacaaaaa

SEQ ID NO: 441231 - RNA, 18 nt, Human
accccaugcaacucucca

SEQ ID NO: 441232 - RNA, 18 nt, Human
accccuuaaaacugaucu

SEQ ID NO: 441233 - RNA, 22 nt, Human
acccuuaccuaacaccccccac

SEQ ID NO: 441234 - RNA, 22 nt, Human
accuaacaccccccacuucccu

SEQ ID NO: 441235 - RNA, 21 nt, Human
accucuacccccaacccuuac

SEQ ID NO: 441236 - RNA, 23 nt, Human
accuuuuuuccagcuuacauagc

SEQ ID NO: 441237 - RNA, 20 nt, Human
acuuuauaacugaggacuag

SEQ ID NO: 441238 - RNA, 21 nt, Human
agaaauucaaagcauucaacc

SEQ ID NO: 441239 - RNA, 24 nt, Human
agaaccaauaaaagggggaaaaug

SEQ ID NO: 441240 - RNA, 23 nt, Human
agagaagaggaggcgaaagagag

SEQ ID NO: 441241 - RNA, 23 nt, Human
agauacauauucccuggaccaug

SEQ ID NO: 441242 - RNA, 18 nt, Human
agauauuuuagguuccug

SEQ ID NO: 441243 - RNA, 20 nt, Human
agcaccccaugcaacucucc

SEQ ID NO: 441244 - RNA, 21 nt, Human
aggaggcgaaagagagcggag

SEQ ID NO: 441245 - RNA, 23 nt, Human
aggcacacacacaaaauaauucc

SEQ ID NO: 441246 - RNA, 26 nt, Human
aggcagccagaaagcuccucggaagg

SEQ ID NO: 441247 - RNA, 18 nt, Human
aggcgagacugacuggag

SEQ ID NO: 441248 - RNA, 21 nt, Human
auacucacagaggaaccccaa

SEQ ID NO: 441249 - RNA, 20 nt, Human
auauaucaggccuacucuuc

SEQ ID NO: 441250 - RNA, 22 nt, Human
auccuucauuaaaucaacaauc

SEQ ID NO: 441251 - RNA, 23 nt, Human
augaagggcagacaggugacaca

SEQ ID NO: 441252 - RNA, 20 nt, Human
auggugcugcugcugcuguu

SEQ ID NO: 441253 - RNA, 21 nt, Human
caaaaagagaacaugaugggu

SEQ ID NO: 441254 - RNA, 21 nt, Human
caaaagcucuuucacucugcu

SEQ ID NO: 441255 - RNA, 23 nt, Human
caaaauaguacucagccaagaac

SEQ ID NO: 441256 - RNA, 18 nt, Human
caaacaauaagcuuuaga

SEQ ID NO: 441257 - RNA, 22 nt, Human
caacccuuaccuaacacccccc

SEQ ID NO: 441258 - RNA, 22 nt, Human
caagauacauauucccuggacc

SEQ ID NO: 441259 - RNA, 30 nt, Human
cacaaauaaagccucugucggguaaacacc

SEQ ID NO: 441260 - RNA, 23 nt, Human
cacacaaaauaauuccuuuggaa

SEQ ID NO: 441261 - RNA, 22 nt, Human
cacacacacaggcacacacaca

SEQ ID NO: 441262 - RNA, 18 nt, Human
caccccaugcaacucucc

SEQ ID NO: 441263 - RNA, 22 nt, Human
caccccccacuucccucacccu

SEQ ID NO: 441264 - RNA, 22 nt, Human
caccuuaaugaagggcagacag

SEQ ID NO: 441265 - RNA, 21 nt, Human
cagacaggugacacagggcag

SEQ ID NO: 441266 - RNA, 23 nt, Human
cagaggucagagaagaaguaggg

SEQ ID NO: 441267 - RNA, 24 nt, Human
caguguaacaacaaaaagagaaca

SEQ ID NO: 441268 - RNA, 20 nt, Human
caguugauuacagaaugggg

SEQ ID NO: 441269 - RNA, 23 nt, Human
caucccaaaaccucuacccccaa

SEQ ID NO: 441270 - RNA, 24 nt, Human
cauccccuccccacaacccuuguc

SEQ ID NO: 441271 - RNA, 18 nt, Human
cauggaagucugcauaua

SEQ ID NO: 441272 - RNA, 21 nt, Human
ccaaagcaccacugaaaugaa

SEQ ID NO: 441273 - RNA, 21 nt, Human
ccacacaacugugaaaaggug

SEQ ID NO: 441274 - RNA, 28 nt, Human
ccacuucccucacccucccuauaccccu

SEQ ID NO: 441275 - RNA, 21 nt, Human
ccagcggccagggaugggcag

SEQ ID NO: 441276 - RNA, 23 nt, Human
ccaguacccuucugcaccccaaa

SEQ ID NO: 441277 - RNA, 20 nt, Human
cccaaaaccucuacccccaa

SEQ ID NO: 441278 - RNA, 25 nt, Human
cccaaaacucccuaccuuuuuucca

SEQ ID NO: 441279 - RNA, 21 nt, Human
cccaacucccggcugcucccc

SEQ ID NO: 441280 - RNA, 27 nt, Human
cccacaacccuuguccucacccucaaa

SEQ ID NO: 441281 - RNA, 20 nt, Human
cccacuucccucacccuccc

SEQ ID NO: 441282 - RNA, 22 nt, Human
ccccccacuucccucacccucc

SEQ ID NO: 441283 - RNA, 22 nt, Human
ccccuccccacaacccuugucc

SEQ ID NO: 441284 - RNA, 20 nt, Human
cccggcugcuccccuccucg

SEQ ID NO: 441285 - RNA, 20 nt, Human
cccuaagcauaccaaaauag

SEQ ID NO: 441286 - RNA, 20 nt, Human
cccuugaaaggcaauuucac

SEQ ID NO: 441287 - RNA, 21 nt, Human
ccuaacaccccccacuucccu

SEQ ID NO: 441288 - RNA, 19 nt, Human
ccucacccucccuauaccc

SEQ ID NO: 441289 - RNA, 19 nt, Human
ccuuccaaaaugcuaacca

SEQ ID NO: 441290 - RNA, 19 nt, Human
ccuucuaaggagacaaaag

SEQ ID NO: 441291 - RNA, 19 nt, Human
ccuugguggcagcggacag

SEQ ID NO: 441292 - RNA, 23 nt, Human
cggagauggaggaguaauucaga

SEQ ID NO: 441293 - RNA, 22 nt, Human
cuacccccaacccuuaccuaac

SEQ ID NO: 441294 - RNA, 20 nt, Human
cuccaguacccuucugcacc

SEQ ID NO: 441295 - RNA, 24 nt, Human
cuccccacaacccuuguccucacc

SEQ ID NO: 441296 - RNA, 22 nt, Human
cucccugguuugggaccaaggg

SEQ ID NO: 441297 - RNA, 22 nt, Human
cuccucgcugcuccguccgggc

SEQ ID NO: 441298 - RNA, 19 nt, Human
cuccuggcugcugcugugg

SEQ ID NO: 441299 - RNA, 20 nt, Human
cugcuccguccgggcucucc

SEQ ID NO: 441300 - RNA, 19 nt, Human
cugcugcugcuguugcugc

SEQ ID NO: 441301 - RNA, 19 nt, Human
cugcugcuguggcugcugc

SEQ ID NO: 441302 - RNA, 19 nt, Human
cugcugcuguugcugcugc

SEQ ID NO: 441303 - RNA, 19 nt, Human
cugcuguugcugcugcugc

SEQ ID NO: 441304 - RNA, 24 nt, Human
cuguggcugcugcugcugcuguug

SEQ ID NO: 441305 - RNA, 19 nt, Human
cuuaccuaacaccccccac

SEQ ID NO: 441306 - RNA, 20 nt, Human
cuucuccuggcugcugcugu

SEQ ID NO: 441307 - RNA, 22 nt, Human
gaagacaaacacaauucccugg

SEQ ID NO: 441308 - RNA, 21 nt, Human
gaauuagaagguccucagaga

SEQ ID NO: 441309 - RNA, 21 nt, Human
gacacuuguccuacugaugau

SEQ ID NO: 441310 - RNA, 20 nt, Human
gauggugaugauggugcugc

SEQ ID NO: 441311 - RNA, 24 nt, Human
gauggugcugcugcugcuguugcu

SEQ ID NO: 441312 - RNA, 20 nt, Human
gccagaggguggagcagcgg

SEQ ID NO: 441313 - RNA, 20 nt, Human
gccagggaugggcagggggg

SEQ ID NO: 441314 - RNA, 20 nt, Human
gcucaaaagcagcauuaaaa

SEQ ID NO: 441315 - RNA, 20 nt, Human
gcugcgaguuccuggcugac

SEQ ID NO: 441316 - RNA, 20 nt, Human
gcugcugcuguggcugcugc

SEQ ID NO: 441317 - RNA, 20 nt, Human
ggaaacuggaagaaaaaauu

SEQ ID NO: 441318 - RNA, 25 nt, Human
ggaaauccuucauuaaaucaacaau

SEQ ID NO: 441319 - RNA, 21 nt, Human
ggaccccccagaggucagaga

SEQ ID NO: 441320 - RNA, 24 nt, Human
ggagagaacuaagagaagaggagg

SEQ ID NO: 441321 - RNA, 22 nt, Human
ggagauggaggaguaauucagg

SEQ ID NO: 441322 - RNA, 20 nt, Human
ggagcagcggauagccggag

SEQ ID NO: 441323 - RNA, 21 nt, Human
ggauaguaacuauacaaaaca

SEQ ID NO: 441324 - RNA, 18 nt, Human
gggggaaaaugauuaaaa

SEQ ID NO: 441325 - RNA, 18 nt, Human
ggggucuaccaguuuagg

SEQ ID NO: 441326 - RNA, 21 nt, Human
guacccuucugcaccccaaaa

SEQ ID NO: 441327 - RNA, 22 nt, Human
guggagcagcggauagccggag

SEQ ID NO: 441328 - RNA, 21 nt, Human
guggcugcugcugcugcuguu

SEQ ID NO: 441329 - RNA, 21 nt, Human
uaaaaaacauccccuccccac

SEQ ID NO: 441330 - RNA, 22 nt, Human
uaaaaaacauccccuccccaca

SEQ ID NO: 441331 - RNA, 24 nt, Human
uaaaaaagauaaagaguuucccaa

SEQ ID NO: 441332 - RNA, 18 nt, Human
uaaaagcauuuuugcuga

SEQ ID NO: 441333 - RNA, 22 nt, Human
uaaaaucauggcucccagagcc

SEQ ID NO: 441334 - RNA, 25 nt, Human
uaaacaccaaagcauuuuccacacg

SEQ ID NO: 441335 - RNA, 21 nt, Human
uaaagagauggcuaccacaca

SEQ ID NO: 441336 - RNA, 24 nt, Human
uaaagagauggcuaccacacaaug

SEQ ID NO: 441337 - RNA, 18 nt, Human
uaacagauaugagaauau

SEQ ID NO: 441338 - RNA, 23 nt, Human
uaacuaagacaucccaaaaccuc

SEQ ID NO: 441339 - RNA, 18 nt, Human
uaacuuuauugucaguga

SEQ ID NO: 441340 - RNA, 25 nt, Human
uaagacaaccuggucacccuccuuu

SEQ ID NO: 441341 - RNA, 20 nt, Human
uaagcaauugagauaauagg

SEQ ID NO: 441342 - RNA, 21 nt, Human
uaagcauaccaaaauagacug

SEQ ID NO: 441343 - RNA, 23 nt, Human
uaauguacucucccagcaucuga

SEQ ID NO: 441344 - RNA, 21 nt, Human
uacaaaacagcacacacucaa

SEQ ID NO: 441345 - RNA, 20 nt, Human
uacaacugaauuagaagguc

SEQ ID NO: 441346 - RNA, 23 nt, Human
uacaagauacauauucccuggac

SEQ ID NO: 441347 - RNA, 18 nt, Human
uacaugauuuuaaaagaa

SEQ ID NO: 441348 - RNA, 26 nt, Human
uaccacacaauguggaauguaugaca

SEQ ID NO: 441349 - RNA, 25 nt, Human
uacccccaacccuuaccuaacaccc

SEQ ID NO: 441350 - RNA, 19 nt, Human
uacccuucugcaccccaaa

SEQ ID NO: 441351 - RNA, 22 nt, Human
uaccuugaagcucaaaagcagc

SEQ ID NO: 441352 - RNA, 18 nt, Human
uacugcugcaauccaccu

SEQ ID NO: 441353 - RNA, 22 nt, Human
uagaaagaagugggauugguuu

SEQ ID NO: 441354 - RNA, 21 nt, Human
uagccaucugccaaccccagc

SEQ ID NO: 441355 - RNA, 27 nt, Human
uagcccacagcugauaccuuccuuuga

SEQ ID NO: 441356 - RNA, 22 nt, Human
uagcuccugaaacuauucccuc

SEQ ID NO: 441357 - RNA, 21 nt, Human
uaguggaugguggagauugua

SEQ ID NO: 441358 - RNA, 22 nt, Human
uaguggaugguggagauuguag

SEQ ID NO: 441359 - RNA, 22 nt, Human
uauacucacagaggaaccccaa

SEQ ID NO: 441360 - RNA, 18 nt, Human
uaucaaguaaaguuuguu

SEQ ID NO: 441361 - RNA, 18 nt, Human
uaucuaagauacccaauc

SEQ ID NO: 441362 - RNA, 23 nt, Human
uaucuuauuuguccuucuuagca

SEQ ID NO: 441363 - RNA, 19 nt, Human
ucaaaauaguacucagcca

SEQ ID NO: 441364 - RNA, 21 nt, Human
ucaaacaauaagcuuuagagc

SEQ ID NO: 441365 - RNA, 22 nt, Human
ucaacaaagauccuuccucacu

SEQ ID NO: 441366 - RNA, 23 nt, Human
ucaaguggcuucggucccgggcc

SEQ ID NO: 441367 - RNA, 24 nt, Human
ucacccucccuauaccccuuaaaa

SEQ ID NO: 441368 - RNA, 20 nt, Human
ucacugaaccucuccaguuc

SEQ ID NO: 441369 - RNA, 24 nt, Human
ucagaacaaggguacaaaaggaau

SEQ ID NO: 441370 - RNA, 20 nt, Human
uccauuuccaaagcaccacu

SEQ ID NO: 441371 - RNA, 19 nt, Human
ucccaaaaccucuaccccc

SEQ ID NO: 441372 - RNA, 21 nt, Human
ucccaaaaccucuacccccaa

SEQ ID NO: 441373 - RNA, 25 nt, Human
ucccaaagguauuccaagauggugu

SEQ ID NO: 441374 - RNA, 26 nt, Human
uccccacaacccuuguccucacccuc

SEQ ID NO: 441375 - RNA, 18 nt, Human
ucccuggggcaggguagc

SEQ ID NO: 441376 - RNA, 18 nt, Human
ucccuggggcaggguagc

SEQ ID NO: 441377 - RNA, 19 nt, Human
ucccuggggcaggguagcu

SEQ ID NO: 441378 - RNA, 18 nt, Human
uccugcugcuucccaaag

SEQ ID NO: 441379 - RNA, 22 nt, Human
uccugcugcuucccaaagguau

SEQ ID NO: 441380 - RNA, 19 nt, Human
uccuggcugcugcuguggc

SEQ ID NO: 441381 - RNA, 21 nt, Human
uccuggcugcugcuguggcug

SEQ ID NO: 441382 - RNA, 18 nt, Human
ucuccuggcugcugcugu

SEQ ID NO: 441383 - RNA, 24 nt, Human
ucugcaccccaaaacucccuaccu

SEQ ID NO: 441384 - RNA, 25 nt, Human
ugaaaacgucgauguauagccaccu

SEQ ID NO: 441385 - RNA, 21 nt, Human
ugaaaagauaggcacaaagug

SEQ ID NO: 441386 - RNA, 19 nt, Human
ugaaagagucuuaacacaa

SEQ ID NO: 441387 - RNA, 19 nt, Human
ugaaaugcagaucagaaaa

SEQ ID NO: 441388 - RNA, 18 nt, Human
ugaaggcaaagaagacaa

SEQ ID NO: 441389 - RNA, 23 nt, Human
ugacaaacaaaacaaguuauuuc

SEQ ID NO: 441390 - RNA, 21 nt, Human
ugagauguccugcgcuggccu

SEQ ID NO: 441391 - RNA, 20 nt, Human
ugaggcugcgaguuccuggc

SEQ ID NO: 441392 - RNA, 22 nt, Human
ugaggugccgguaaaaugcaca

SEQ ID NO: 441393 - RNA, 23 nt, Human
ugauacagcacaaauaaagccuc

SEQ ID NO: 441394 - RNA, 23 nt, Human
ugauggcagauauuuuagguucc

SEQ ID NO: 441395 - RNA, 24 nt, Human
ugauggugcugcugcugcuguugc

SEQ ID NO: 441396 - RNA, 21 nt, Human
ugcacagauagguaggagucc

SEQ ID NO: 441397 - RNA, 21 nt, Human
ugcagaaugugauuaaaauca

SEQ ID NO: 441398 - RNA, 21 nt, Human
ugcuccguccgggcucuccuu

SEQ ID NO: 441399 - RNA, 27 nt, Human
ugcugcuguggcugcugcugcugcugu

SEQ ID NO: 441400 - RNA, 19 nt, Human
uggaaaguucaaaauagua

SEQ ID NO: 441401 - RNA, 19 nt, Human
uggacaagcuacuccaacc

SEQ ID NO: 441402 - RNA, 24 nt, Human
uggagcagcggauagccggaggcg

SEQ ID NO: 441403 - RNA, 21 nt, Human
uggaugguggagauuguagca

SEQ ID NO: 441404 - RNA, 18 nt, Human
uggcauccuucugugucc

SEQ ID NO: 441405 - RNA, 21 nt, Human
uggcauccuucuguguccuuc

SEQ ID NO: 441406 - RNA, 25 nt, Human
uggcugcugcugcugcuguuguugg

SEQ ID NO: 441407 - RNA, 24 nt, Human
ugggcaggggggaagccccaacuc

SEQ ID NO: 441408 - RNA, 19 nt, Human
uguugcugcugcugcugac

SEQ ID NO: 441409 - RNA, 24 nt, Human
uuaaaaaacauccccuccccacaa

SEQ ID NO: 441410 - RNA, 24 nt, Human
uuagcuccaguacccuucugcacc

SEQ ID NO: 441411 - RNA, 19 nt, Human
uuauuuguccuucuuagca

SEQ ID NO: 441412 - RNA, 20 nt, Human
uuccaaaaugcuaaccaaag

SEQ ID NO: 441413 - RNA, 21 nt, Human
uuuuuucuccuuaugacuaaa

SEQ ID NO: 441414 - RNA, 18 nt, Human
aaacagcucccaucuccc

SEQ ID NO: 441415 - RNA, 19 nt, Human
aagaaaggaauuucauugc

SEQ ID NO: 441416 - RNA, 23 nt, Human
aagaagccaggcagacaggagca

SEQ ID NO: 441417 - RNA, 22 nt, Human
aagagaaaggucagagcucagg

SEQ ID NO: 441418 - RNA, 24 nt, Human
aagcaggacagacaagaagccagg

SEQ ID NO: 441419 - RNA, 19 nt, Human
aaggaacaacaaaaaauua

SEQ ID NO: 441420 - RNA, 20 nt, Human
aaugaaggaacaacaaaaaa

SEQ ID NO: 441421 - RNA, 18 nt, Human
aaugagguucgcagcugc

SEQ ID NO: 441422 - RNA, 23 nt, Human
aauucagaaaagcuaagaagccc

SEQ ID NO: 441423 - RNA, 21 nt, Human
acaaaaaauuaaagacuguaa

SEQ ID NO: 441424 - RNA, 18 nt, Human
acaggcccuccccaagag

SEQ ID NO: 441425 - RNA, 19 nt, Human
accccaagacacugacaaa

SEQ ID NO: 441426 - RNA, 24 nt, Human
acggaaucuccugccuccucaaag

SEQ ID NO: 441427 - RNA, 22 nt, Human
acuccuucccaccaaagucccg

SEQ ID NO: 441428 - RNA, 24 nt, Human
acucuguucugcuucagucucuga

SEQ ID NO: 441429 - RNA, 29 nt, Human
agaaaaaaaugaaggaacaacaaaaaaga

SEQ ID NO: 441430 - RNA, 24 nt, Human
agacaaaaaagcaagugccacgag

SEQ ID NO: 441431 - RNA, 25 nt, Human
agacaaaaaagcaagugccacgauc

SEQ ID NO: 441432 - RNA, 24 nt, Human
agacaagaagccaggcagacagga

SEQ ID NO: 441433 - RNA, 19 nt, Human
agacagagaugaacucaga

SEQ ID NO: 441434 - RNA, 22 nt, Human
agagagccauggcugacuccag

SEQ ID NO: 441435 - RNA, 23 nt, Human
agauacauuuucuguacaaugaa

SEQ ID NO: 441436 - RNA, 18 nt, Human
aggcaaggagaauggggg

SEQ ID NO: 441437 - RNA, 19 nt, Human
aggcaaggagaaugggggu

SEQ ID NO: 441438 - RNA, 22 nt, Human
aggcacacagucucccugcguu

SEQ ID NO: 441439 - RNA, 25 nt, Human
agggacccacggaaucuccugccuc

SEQ ID NO: 441440 - RNA, 20 nt, Human
agguaauuaggugaagacca

SEQ ID NO: 441441 - RNA, 21 nt, Human
agugaucccaggggaggggcc

SEQ ID NO: 441442 - RNA, 24 nt, Human
auccugacagguagagacuggggg

SEQ ID NO: 441443 - RNA, 20 nt, Human
auuucauugcuucugauuua

SEQ ID NO: 441444 - RNA, 19 nt, Human
caaacacaguaggaaugau

SEQ ID NO: 441445 - RNA, 20 nt, Human
caaagucccgcuuucuucuc

SEQ ID NO: 441446 - RNA, 21 nt, Human
caccaaagucccgcuuucuuc

SEQ ID NO: 441447 - RNA, 21 nt, Human
cagcccagaugucagaaugga

SEQ ID NO: 441448 - RNA, 19 nt, Human
caggacagacaagaagcca

SEQ ID NO: 441449 - RNA, 23 nt, Human
caggacagacaagaagccaggca

SEQ ID NO: 441450 - RNA, 24 nt, Human
caggcucucaagauuuccuggagg

SEQ ID NO: 441451 - RNA, 28 nt, Human
cagggacccacggaaucuccugccuccu

SEQ ID NO: 441452 - RNA, 22 nt, Human
caguucagguacuggucucaua

SEQ ID NO: 441453 - RNA, 23 nt, Human
cauccuucacacucccccagagc

SEQ ID NO: 441454 - RNA, 21 nt, Human
caugagccuccugccucccag

SEQ ID NO: 441455 - RNA, 21 nt, Human
cauuaugccaagacaggcucu

SEQ ID NO: 441456 - RNA, 25 nt, Human
ccacggaaucuccugccuccucaaa

SEQ ID NO: 441457 - RNA, 18 nt, Human
ccagcccagaugucagaa

SEQ ID NO: 441458 - RNA, 19 nt, Human
cccagcccagaugucagaa

SEQ ID NO: 441459 - RNA, 21 nt, Human
cccaugguuggcacaggugac

SEQ ID NO: 441460 - RNA, 25 nt, Human
ccccaugguuggcacaggugacacu

SEQ ID NO: 441461 - RNA, 18 nt, Human
cccccagagcucacauca

SEQ ID NO: 441462 - RNA, 20 nt, Human
ccucaaagcuugcuuaguuc

SEQ ID NO: 441463 - RNA, 22 nt, Human
ccucccagcauccacccaacuu

SEQ ID NO: 441464 - RNA, 18 nt, Human
ccugcguuuccuuucucc

SEQ ID NO: 441465 - RNA, 20 nt, Human
cucacugccacacucacacu

SEQ ID NO: 441466 - RNA, 24 nt, Human
cuccuggccuggauuucgcccauu

SEQ ID NO: 441467 - RNA, 18 nt, Human
cuccuucccaccaaaguc

SEQ ID NO: 441468 - RNA, 20 nt, Human
cugcaacagguagaccuggg

SEQ ID NO: 441469 - RNA, 22 nt, Human
cugccacacucacacucacggg

SEQ ID NO: 441470 - RNA, 25 nt, Human
cugccgcuuuccuuguuugucagug

SEQ ID NO: 441471 - RNA, 21 nt, Human
gaaucuccugccuccucaaag

SEQ ID NO: 441472 - RNA, 20 nt, Human
gacaacacagaacuuuaaga

SEQ ID NO: 441473 - RNA, 18 nt, Human
gagaugcauccuucacac

SEQ ID NO: 441474 - RNA, 22 nt, Human
gagcaugagccuccugccuccc

SEQ ID NO: 441475 - RNA, 26 nt, Human
gagcugcaagagugcaucuuuacgug

SEQ ID NO: 441476 - RNA, 24 nt, Human
gaggggccuucauguggagauucu

SEQ ID NO: 441477 - RNA, 21 nt, Human
gaucauaaucuauccuguuua

SEQ ID NO: 441478 - RNA, 19 nt, Human
gauguacacaugugggauc

SEQ ID NO: 441479 - RNA, 18 nt, Human
gcaugauguacacaugug

SEQ ID NO: 441480 - RNA, 23 nt, Human
gcccaggguuguuugaguuucag

SEQ ID NO: 441481 - RNA, 21 nt, Human
gcucccaucucccauuuccau

SEQ ID NO: 441482 - RNA, 21 nt, Human
ggaacaacaaaaaauuaaaga

SEQ ID NO: 441483 - RNA, 19 nt, Human
ggggguauuccaaggauga

SEQ ID NO: 441484 - RNA, 20 nt, Human
ggggugggugaggagacagg

SEQ ID NO: 441485 - RNA, 23 nt, Human
gguguacaaggggccaagagaaa

SEQ ID NO: 441486 - RNA, 24 nt, Human
guacuccagcugucuuccuggagu

SEQ ID NO: 441487 - RNA, 21 nt, Human
guagaagcaggacagacaaga

SEQ ID NO: 441488 - RNA, 19 nt, Human
gugguuccugaggccccag

SEQ ID NO: 441489 - RNA, 20 nt, Human
gugguuccugaggccccaga

SEQ ID NO: 441490 - RNA, 18 nt, Human
uaaaucaaacaugcuaag

SEQ ID NO: 441491 - RNA, 20 nt, Human
uaaaucaaacaugcuaagag

SEQ ID NO: 441492 - RNA, 20 nt, Human
uaccgugugacuccuuccca

SEQ ID NO: 441493 - RNA, 21 nt, Human
uacuccagcugucuuccugga

SEQ ID NO: 441494 - RNA, 22 nt, Human
uacuccagcugucuuccuggag

SEQ ID NO: 441495 - RNA, 23 nt, Human
uagaagcaggacagacaagaagc

SEQ ID NO: 441496 - RNA, 21 nt, Human
uaggucuuucuucuuucucug

SEQ ID NO: 441497 - RNA, 24 nt, Human
uauaaaucacacugaugauuacuc

SEQ ID NO: 441498 - RNA, 18 nt, Human
ucaaauccccacccugcc

SEQ ID NO: 441499 - RNA, 18 nt, Human
ucaaggaagcuuuuccua

SEQ ID NO: 441500 - RNA, 21 nt, Human
ucacugccacacucacacuca

SEQ ID NO: 441501 - RNA, 21 nt, Human
ucagaaugagguucgcagcug

SEQ ID NO: 441502 - RNA, 21 nt, Human
ucaggcucagagagccauggc

SEQ ID NO: 441503 - RNA, 23 nt, Human
ucaggcucagagagccauggcug

SEQ ID NO: 441504 - RNA, 20 nt, Human
ucauaaucuauccuguuuag

SEQ ID NO: 441505 - RNA, 20 nt, Human
uccaccauguguaauaaaau

SEQ ID NO: 441506 - RNA, 18 nt, Human
uccauccucaggcucaga

SEQ ID NO: 441507 - RNA, 20 nt, Human
ucgcugaaaaggcaugacca

SEQ ID NO: 441508 - RNA, 23 nt, Human
ucucccugcguuuccuuucuccu

SEQ ID NO: 441509 - RNA, 18 nt, Human
ucuccugccuccucaaaa

SEQ ID NO: 441510 - RNA, 23 nt, Human
ucuccuuauuugugaaagacaaa

SEQ ID NO: 441511 - RNA, 18 nt, Human
ucucugaggcuccuggcc

SEQ ID NO: 441512 - RNA, 23 nt, Human
ucuguacugaaauuccacaggga

SEQ ID NO: 441513 - RNA, 25 nt, Human
ucuucagucauguaguuuuuguguu

SEQ ID NO: 441514 - RNA, 25 nt, Human
ucuuucuucuuucucugccgcuuuc

SEQ ID NO: 441515 - RNA, 23 nt, Human
ugaaaaggcaugaccagagaaua

SEQ ID NO: 441516 - RNA, 18 nt, Human
ugaaagacaaaaaagcaa

SEQ ID NO: 441517 - RNA, 20 nt, Human
ugaagcagccaggaagucgg

SEQ ID NO: 441518 - RNA, 24 nt, Human
ugacaaaacagcucccaucuccca

SEQ ID NO: 441519 - RNA, 21 nt, Human
ugacaacacagaacuuuaaga

SEQ ID NO: 441520 - RNA, 26 nt, Human
ugacaacacagaacuuuaagaaagga

SEQ ID NO: 441521 - RNA, 19 nt, Human
ugacuccuucccaccaaag

SEQ ID NO: 441522 - RNA, 19 nt, Human
ugagccuccugccucccag

SEQ ID NO: 441523 - RNA, 19 nt, Human
ugaggccccagcccagaug

SEQ ID NO: 441524 - RNA, 18 nt, Human
ugaucauuugcaggcucu

SEQ ID NO: 441525 - RNA, 19 nt, Human
ugcaagagugcaucuuuac

SEQ ID NO: 441526 - RNA, 18 nt, Human
ugcacacgcacacagaug

SEQ ID NO: 441527 - RNA, 19 nt, Human
ugcacaugcaagucccuug

SEQ ID NO: 441528 - RNA, 18 nt, Human
ugcagaggaguccucggg

SEQ ID NO: 441529 - RNA, 21 nt, Human
ugccaagacaggcucucaaga

SEQ ID NO: 441530 - RNA, 25 nt, Human
ugccaagacaggcucucaagauuuc

SEQ ID NO: 441531 - RNA, 20 nt, Human
ugcuagggcugggggugggu

SEQ ID NO: 441532 - RNA, 23 nt, Human
ugcuuaguucacagucagaauga

SEQ ID NO: 441533 - RNA, 24 nt, Human
ugcuucagucucugaggcuccugg

SEQ ID NO: 441534 - RNA, 19 nt, Human
uggacacucacaugugauc

SEQ ID NO: 441535 - RNA, 18 nt, Human
uggcugacuccaggcugc

SEQ ID NO: 441536 - RNA, 20 nt, Human
ugggaucagcgugggaaggu

SEQ ID NO: 441537 - RNA, 20 nt, Human
ugggguguacaaggggcccc

SEQ ID NO: 441538 - RNA, 21 nt, Human
ugguuccugaggccccagccc

SEQ ID NO: 441539 - RNA, 18 nt, Human
ugguuggcacaggugaca

SEQ ID NO: 441540 - RNA, 21 nt, Human
uguacaaggggccaagagaaa

SEQ ID NO: 441541 - RNA, 19 nt, Human
ugugaaagacaaaaaagca

SEQ ID NO: 441542 - RNA, 23 nt, Human
ugugaccccaagacacugacaaa

SEQ ID NO: 441543 - RNA, 19 nt, Human
ugugaucaaaguggacacc

SEQ ID NO: 441544 - RNA, 20 nt, Human
ugugaucaaaguggacaccc

SEQ ID NO: 441545 - RNA, 18 nt, Human
ugugggaucagcguggga

SEQ ID NO: 441546 - RNA, 22 nt, Human
uuaaagacuguaaagcagagac

SEQ ID NO: 441547 - RNA, 19 nt, Human
uuccugaggccccagccca

SEQ ID NO: 441548 - RNA, 23 nt, Human
uugugguuccugaggccccagcc

SEQ ID NO: 441549 - RNA, 24 nt, Human
uugugguuccugaggccccagccc

SEQ ID NO: 441550 - RNA, 24 nt, Human
aaccacgcucggaggcccugcccc

SEQ ID NO: 441551 - RNA, 24 nt, Human
acagaugcccuuauugagcccaga

SEQ ID NO: 441552 - RNA, 22 nt, Human
agagguaaauauaaacaaauug

SEQ ID NO: 441553 - RNA, 21 nt, Human
agaugcccuuauugagcccag

SEQ ID NO: 441554 - RNA, 23 nt, Human
aguugcuuuugggugaccauguu

SEQ ID NO: 441555 - RNA, 24 nt, Human
caaaaacuuccaaagcuuucuaga

SEQ ID NO: 441556 - RNA, 18 nt, Human
caaaaucagcucuuucuc

SEQ ID NO: 441557 - RNA, 18 nt, Human
caccacguucccgggacc

SEQ ID NO: 441558 - RNA, 20 nt, Human
caccccaguaauaagcucca

SEQ ID NO: 441559 - RNA, 23 nt, Human
ccaaauuucugcacagaugcccu

SEQ ID NO: 441560 - RNA, 22 nt, Human
ccuuauugagcccagagguaaa

SEQ ID NO: 441561 - RNA, 22 nt, Human
ccuucaaaguccaaccacgcuc

SEQ ID NO: 441562 - RNA, 23 nt, Human
cuaucuacaaaaacuuccaaagc

SEQ ID NO: 441563 - RNA, 22 nt, Human
cugaaauauuuauuaaauaaca

SEQ ID NO: 441564 - RNA, 19 nt, Human
cugacuugccuaaaaaaua

SEQ ID NO: 441565 - RNA, 21 nt, Human
cuggucaaauggaguaagcug

SEQ ID NO: 441566 - RNA, 23 nt, Human
cuuauugagcccagagguaaaua

SEQ ID NO: 441567 - RNA, 22 nt, Human
gcuuuugggugaccauguucuc

SEQ ID NO: 441568 - RNA, 21 nt, Human
ggaaggguauauggggguuca

SEQ ID NO: 441569 - RNA, 19 nt, Human
uagaaagcuuaaauuaagg

SEQ ID NO: 441570 - RNA, 23 nt, Human
uccaaaaaggggaugcagcaugg

SEQ ID NO: 441571 - RNA, 18 nt, Human
ucucaggugaugcccccc

SEQ ID NO: 441572 - RNA, 21 nt, Human
ucucuugggagagguucuuga

SEQ ID NO: 441573 - RNA, 23 nt, Human
ucucuugggagagguucuugugg

SEQ ID NO: 441574 - RNA, 24 nt, Human
ugccauaaaccacaggaaaaucca

SEQ ID NO: 441575 - RNA, 23 nt, Human
uggguuaagaaaggaaccaccuc

SEQ ID NO: 441576 - RNA, 25 nt, Human
uugccuaaaaaauauguucaguuau

SEQ ID NO: 441577 - RNA, 22 nt, Human
uuucucaggugaugccccccuu

SEQ ID NO: 441578 - RNA, 21 nt, Human
uuucugagcuacuuaauuucu

SEQ ID NO: 441579 - RNA, 21 nt, Human
uuucugaguaacuuaauuucu

SEQ ID NO: 441580 - RNA, 20 nt, Human
uuuugggugaccauguucuc

SEQ ID NO: 441581 - RNA, 19 nt, Human
uuuuuuuuuuuuuuuuuaa

SEQ ID NO: 441582 - RNA, 22 nt, Human
aaaacaaacgcagcuccagccc

SEQ ID NO: 441583 - RNA, 23 nt, Human
aaacaaacgcagcuccagcccuu

SEQ ID NO: 441584 - RNA, 20 nt, Human
aacaugacgaaacuccgucu

SEQ ID NO: 441585 - RNA, 21 nt, Human
aacaugacgaaacuccgucuc

SEQ ID NO: 441586 - RNA, 19 nt, Human
acaugacgaaacuccgucu

SEQ ID NO: 441587 - RNA, 18 nt, Human
aucggcgccagcaugagg

SEQ ID NO: 441588 - RNA, 18 nt, Human
caugaggaaggagucuca

SEQ ID NO: 441589 - RNA, 23 nt, Human
ccccagcagccaucggcgccagc

SEQ ID NO: 441590 - RNA, 23 nt, Human
ccuggccaacaugacgaaacucc

SEQ ID NO: 441591 - RNA, 24 nt, Human
ccuggccaacaugacgaaacuccg

SEQ ID NO: 441592 - RNA, 24 nt, Human
cgcgggaagguauaaaaacgacca

SEQ ID NO: 441593 - RNA, 20 nt, Human
cgggaagguauaaaaacgac

SEQ ID NO: 441594 - RNA, 22 nt, Human
gaaacuccgucucgcccuaccc

SEQ ID NO: 441595 - RNA, 25 nt, Human
gcaaaacaaacgcagcuccagcccu

SEQ ID NO: 441596 - RNA, 21 nt, Human
gccuggccaacaugacgaaac

SEQ ID NO: 441597 - RNA, 22 nt, Human
ggcaaaacaaacgcagcuccag

SEQ ID NO: 441598 - RNA, 24 nt, Human
ggccuggccaacaugacgaaacuc

SEQ ID NO: 441599 - RNA, 20 nt, Human
ucucgcccuacccgcccuuc

SEQ ID NO: 441600 - RNA, 21 nt, Human
ugacgaaacuccgucucgccc

SEQ ID NO: 441601 - RNA, 19 nt, Human
ugauggcaaaacaaacgca

SEQ ID NO: 441602 - RNA, 24 nt, Human
ugauggcaaaacaaacgcagcucc

SEQ ID NO: 441603 - RNA, 22 nt, Human
uguccccagcagccaucggcgc

SEQ ID NO: 441604 - RNA, 18 nt, Human
uuuaagauuugaguaguu

SEQ ID NO: 441605 - RNA, 20 nt, Human
uuuuuuuuuuuuuuuuuaag

SEQ ID NO: 441606 - RNA, 22 nt, Human
aaaaaaauccaggcuauacaaa

SEQ ID NO: 441607 - RNA, 24 nt, Human
aaaagaaaaagucucaccuacaag

SEQ ID NO: 441608 - RNA, 20 nt, Human
aaaccaaaugaaccaaaccc

SEQ ID NO: 441609 - RNA, 18 nt, Human
aaagacgucauccccuag

SEQ ID NO: 441610 - RNA, 24 nt, Human
aaagaugaguaaaaaaaauccauu

SEQ ID NO: 441611 - RNA, 19 nt, Human
aaaggcccugcauuuggag

SEQ ID NO: 441612 - RNA, 18 nt, Human
aacacaaaagaaaaaguc

SEQ ID NO: 441613 - RNA, 23 nt, Human
aacagacaacugaaagccacaua

SEQ ID NO: 441614 - RNA, 20 nt, Human
aaccaaaccccuagaaggua

SEQ ID NO: 441615 - RNA, 21 nt, Human
aaugaguuucccaaagacucg

SEQ ID NO: 441616 - RNA, 24 nt, Human
acaaaagaaaaagucucaccuaca

SEQ ID NO: 441617 - RNA, 22 nt, Human
auaaugaguuucccaaagacuc

SEQ ID NO: 441618 - RNA, 22 nt, Human
caaacagacaacugaaagccac

SEQ ID NO: 441619 - RNA, 25 nt, Human
caaacagacaacugaaagccacaua

SEQ ID NO: 441620 - RNA, 24 nt, Human
cacaaugcaucucugaaaggcccu

SEQ ID NO: 441621 - RNA, 21 nt, Human
caguaauuacaaucacaaugc

SEQ ID NO: 441622 - RNA, 23 nt, Human
caugacaaaaaccaaaugaacca

SEQ ID NO: 441623 - RNA, 24 nt, Human
caugacaaaaaccaaaugaaccaa

SEQ ID NO: 441624 - RNA, 25 nt, Human
caugacaaaaaccaaaugaaccaaa

SEQ ID NO: 441625 - RNA, 22 nt, Human
ccgggugaccucgugccgaauu

SEQ ID NO: 441626 - RNA, 24 nt, Human
ccuuccuugcacaugacaaaaacc

SEQ ID NO: 441627 - RNA, 21 nt, Human
ccuugcacaugacaaaaacca

SEQ ID NO: 441628 - RNA, 21 nt, Human
cgaaacacaaaagaaaaaguc

SEQ ID NO: 441629 - RNA, 23 nt, Human
cgaaacacaaaagaaaaagucuc

SEQ ID NO: 441630 - RNA, 23 nt, Human
cucgaguuuuuuuuuuuuuuuuu

SEQ ID NO: 441631 - RNA, 24 nt, Human
cucgaguuuuuuuuuuuuuuuuuc

SEQ ID NO: 441632 - RNA, 19 nt, Human
cugcauuuggaggcagagu

SEQ ID NO: 441633 - RNA, 20 nt, Human
gaaacacaaaagaaaaaguc

SEQ ID NO: 441634 - RNA, 20 nt, Human
ggaaauuuccgaaacacaaa

SEQ ID NO: 441635 - RNA, 23 nt, Human
uaagaaacaaauucaaauugguu

SEQ ID NO: 441636 - RNA, 23 nt, Human
uacaaacagacaacugaaagcca

SEQ ID NO: 441637 - RNA, 25 nt, Human
uacaagauuauuuacauguuuaggg

SEQ ID NO: 441638 - RNA, 18 nt, Human
uaccuuggcuuuaaugau

SEQ ID NO: 441639 - RNA, 22 nt, Human
ucaaaaaaauccaggcuauaca

SEQ ID NO: 441640 - RNA, 20 nt, Human
uccaggcuauacaaacagac

SEQ ID NO: 441641 - RNA, 18 nt, Human
uccccuaggucuaguaga

SEQ ID NO: 441642 - RNA, 21 nt, Human
uccccuaggucuaguagaaac

SEQ ID NO: 441643 - RNA, 19 nt, Human
ucccuagggucacuuucuu

SEQ ID NO: 441644 - RNA, 20 nt, Human
uccuugcacaugacaaaaac

SEQ ID NO: 441645 - RNA, 25 nt, Human
ucucaccuacaagauuauuuacaug

SEQ ID NO: 441646 - RNA, 23 nt, Human
ugacaaaaaccaaaugaaccaaa

SEQ ID NO: 441647 - RNA, 25 nt, Human
ugacaaaaaccaaaugaaccaaacc

SEQ ID NO: 441648 - RNA, 21 nt, Human
ugauaguuuuuacauaugucc

SEQ ID NO: 441649 - RNA, 24 nt, Human
uggaggcagaguaaucugcaaaga

SEQ ID NO: 441650 - RNA, 24 nt, Human
uuacuucccuagggucacuuucuu

SEQ ID NO: 441651 - RNA, 22 nt, Human
uucaaauugguuggagcuucaa

SEQ ID NO: 441652 - RNA, 25 nt, Human
aacuucuuuuuccuuuuacaauacu

SEQ ID NO: 441653 - RNA, 20 nt, Human
aacuugcugcccuuauucuu

SEQ ID NO: 441654 - RNA, 19 nt, Human
cauuuuuaagagcugaaaa

SEQ ID NO: 441655 - RNA, 21 nt, Human
cuugcugcccuuauucuugau

SEQ ID NO: 441656 - RNA, 24 nt, Human
cuuugcucugucugccacauggaa

SEQ ID NO: 441657 - RNA, 21 nt, Human
gucugugggccgucuuuaauc

SEQ ID NO: 441658 - RNA, 23 nt, Human
uaagucuuuacuuaguuguuuuu

SEQ ID NO: 441659 - RNA, 26 nt, Human
uaauauacauguaacauuuacauuuu

SEQ ID NO: 441660 - RNA, 19 nt, Human
uaauggcagcugcauuuuu

SEQ ID NO: 441661 - RNA, 19 nt, Human
uaguagcuuuucucuucuu

SEQ ID NO: 441662 - RNA, 19 nt, Human
ugagguuguaaaaugaugu

SEQ ID NO: 441663 - RNA, 23 nt, Human
ugccaaguaauauacauguaaca

SEQ ID NO: 441664 - RNA, 22 nt, Human
uguaagaaggaacuucuuuuuc

SEQ ID NO: 441665 - RNA, 24 nt, Human
uuaauuuuauuaguagcuuuucuc

SEQ ID NO: 441666 - RNA, 20 nt, Human
uuguucaucugugacuuuaa

SEQ ID NO: 441667 - RNA, 20 nt, Human
uuugacaagccaccuaugua

SEQ ID NO: 441668 - RNA, 19 nt, Human
aagcccugguccccgucag

SEQ ID NO: 441669 - RNA, 21 nt, Human
aagccgcuggaaagaaucgga

SEQ ID NO: 441670 - RNA, 21 nt, Human
aaguggucccucugagucccc

SEQ ID NO: 441671 - RNA, 21 nt, Human
acacaacagcaccagcaccau

SEQ ID NO: 441672 - RNA, 20 nt, Human
accaugagggcgcucucgac

SEQ ID NO: 441673 - RNA, 19 nt, Human
acucucggggacguugggg

SEQ ID NO: 441674 - RNA, 21 nt, Human
agaacucugugagcuccgccc

SEQ ID NO: 441675 - RNA, 18 nt, Human
agagccaagagucaccgu

SEQ ID NO: 441676 - RNA, 18 nt, Human
aguccccaacucccuggc

SEQ ID NO: 441677 - RNA, 18 nt, Human
agugaagcuccaugcccc

SEQ ID NO: 441678 - RNA, 25 nt, Human
augcagccccccugcacucagaaag

SEQ ID NO: 441679 - RNA, 22 nt, Human
caaguggucccucugagucccc

SEQ ID NO: 441680 - RNA, 22 nt, Human
caaguggucccucugagucccc

SEQ ID NO: 441681 - RNA, 18 nt, Human
cacaacagcaccagcacc

SEQ ID NO: 441682 - RNA, 24 nt, Human
cacauccucgggcagagccaagag

SEQ ID NO: 441683 - RNA, 24 nt, Human
cacucagaaagggggcuucuccag

SEQ ID NO: 441684 - RNA, 18 nt, Human
cagccccccugcacucag

SEQ ID NO: 441685 - RNA, 23 nt, Human
cagccucgaucucaggaggcaac

SEQ ID NO: 441686 - RNA, 22 nt, Human
cauccucgggcagagccaagag

SEQ ID NO: 441687 - RNA, 22 nt, Human
ccacacaagcccugguccccgu

SEQ ID NO: 441688 - RNA, 20 nt, Human
ccgcccagauaccauuggcg

SEQ ID NO: 441689 - RNA, 20 nt, Human
ccugcuuguguccccagggg

SEQ ID NO: 441690 - RNA, 26 nt, Human
ccuggccagcaaggagugaagcucca

SEQ ID NO: 441691 - RNA, 22 nt, Human
cgaggacuggagacgcggagga

SEQ ID NO: 441692 - RNA, 20 nt, Human
cgccauugaggccagucugg

SEQ ID NO: 441693 - RNA, 21 nt, Human
cuggccagcaaggagugaagc

SEQ ID NO: 441694 - RNA, 20 nt, Human
cuggccccaaguggucccuc

SEQ ID NO: 441695 - RNA, 18 nt, Human
cuggcuggccccaagugg

SEQ ID NO: 441696 - RNA, 20 nt, Human
gaggcaacgcaugcagcccc

SEQ ID NO: 441697 - RNA, 22 nt, Human
gcaacgcaugcagccccccugc

SEQ ID NO: 441698 - RNA, 18 nt, Human
gccauugaggccagucug

SEQ ID NO: 441699 - RNA, 27 nt, Human
gguugcuuuuauuccaagaacucuguu

SEQ ID NO: 441700 - RNA, 24 nt, Human
gucugagcauauccugcagccucg

SEQ ID NO: 441701 - RNA, 23 nt, Human
ucaccgucuuucgugggccuggg

SEQ ID NO: 441702 - RNA, 19 nt, Human
uccccaacucccuggccag

SEQ ID NO: 441703 - RNA, 21 nt, Human
ucccucugaguccccaacucc

SEQ ID NO: 441704 - RNA, 18 nt, Human
ucugugagcuccgcccag

SEQ ID NO: 441705 - RNA, 25 nt, Human
ugaggauccgcucagcucggcuucu

SEQ ID NO: 441706 - RNA, 20 nt, Human
ugcgaggacuggagacgcgg

SEQ ID NO: 441707 - RNA, 19 nt, Human
uggccccaaguggucccuc

SEQ ID NO: 441708 - RNA, 23 nt, Human
ugggagcggggauucggggacuc

SEQ ID NO: 441709 - RNA, 23 nt, Human
ugggagcggggauucggggggag

SEQ ID NO: 441710 - RNA, 24 nt, Human
uugcuuuuauuccaagaacucugu

SEQ ID NO: 441711 - RNA, 20 nt, Human
uugguugcagaagccgcugg

SEQ ID NO: 441712 - RNA, 21 nt, Human
aggcugggcccucaguuagcu

SEQ ID NO: 441713 - RNA, 20 nt, Human
cagaaaaaaggcugggcccu

SEQ ID NO: 441714 - RNA, 18 nt, Human
caugcagaaaaaaggcug

SEQ ID NO: 441715 - RNA, 22 nt, Human
caugcagaaaaaaggcugggcc

SEQ ID NO: 441716 - RNA, 20 nt, Human
cuccuggaucaugcagaaaa

SEQ ID NO: 441717 - RNA, 24 nt, Human
cugggcccucaguuagcuccggga

SEQ ID NO: 441718 - RNA, 20 nt, Human
gaggggcuggguagcuggcu

SEQ ID NO: 441719 - RNA, 20 nt, Human
ggcuggguagcuggcugggc

SEQ ID NO: 441720 - RNA, 18 nt, Human
ggguagcuggcugggcug

SEQ ID NO: 441721 - RNA, 19 nt, Human
ugcacacagagaggggcug

SEQ ID NO: 441722 - RNA, 19 nt, Human
uggguagcuggcugggcug

SEQ ID NO: 441723 - RNA, 21 nt, Human
uggguagcuggcugggcuggg

SEQ ID NO: 441724 - RNA, 21 nt, Human
uggguagcuggcugggcuggg

SEQ ID NO: 441725 - RNA, 21 nt, Human
ugugguaguuugugguaugug

SEQ ID NO: 441726 - RNA, 21 nt, Human
aaaugcuuucuggaccaaaac

SEQ ID NO: 441727 - RNA, 21 nt, Human
accccaagaaauaacugcuau

SEQ ID NO: 441728 - RNA, 18 nt, Human
cagcuccuugaaaaugcu

SEQ ID NO: 441729 - RNA, 22 nt, Human
cccggagcccggcggaggcgcc

SEQ ID NO: 441730 - RNA, 19 nt, Human
ccugggccugcuggggcga

SEQ ID NO: 441731 - RNA, 22 nt, Human
cgaccuugggcucccggagccc

SEQ ID NO: 441732 - RNA, 19 nt, Human
cgcgggacagcagggcugg

SEQ ID NO: 441733 - RNA, 21 nt, Human
cuccuugaaaaugcuuucugg

SEQ ID NO: 441734 - RNA, 18 nt, Human
cuggcccagccgcgaccu

SEQ ID NO: 441735 - RNA, 18 nt, Human
gccccgggcccccccgcu

SEQ ID NO: 441736 - RNA, 18 nt, Human
ggccccgggcccccccgc

SEQ ID NO: 441737 - RNA, 22 nt, Human
ggguguguguguccaugggccc

SEQ ID NO: 441738 - RNA, 23 nt, Human
guguauggauugcuuuggcuuug

SEQ ID NO: 441739 - RNA, 22 nt, Human
uaccucaguuucugcaucugug

SEQ ID NO: 441740 - RNA, 20 nt, Human
ucccggagcccggcggaggc

SEQ ID NO: 441741 - RNA, 19 nt, Human
ucuggaccaaaacuaaagc

SEQ ID NO: 441742 - RNA, 19 nt, Human
ugccugggccugcuggggc

SEQ ID NO: 441743 - RNA, 21 nt, Human
uggaaauaucuacuuucucca

SEQ ID NO: 441744 - RNA, 18 nt, Human
ugggccccgggccccccc

SEQ ID NO: 441745 - RNA, 25 nt, Human
uggguguguguguccaugggccccg

SEQ ID NO: 441746 - RNA, 19 nt, Human
uggugagcuggcgcgcggg

SEQ ID NO: 441747 - RNA, 19 nt, Human
uguauggauugcuuuggcu

SEQ ID NO: 441748 - RNA, 24 nt, Human
uugauggaaauaucuacuuucucc

SEQ ID NO: 441749 - RNA, 22 nt, Human
aaaaaaacacuaauacuguaca

SEQ ID NO: 441750 - RNA, 23 nt, Human
aaaagaaaaaacccuaaaacuga

SEQ ID NO: 441751 - RNA, 21 nt, Human
aaacacaugaaaaucaacuug

SEQ ID NO: 441752 - RNA, 18 nt, Human
aaacccaaaacuaagcaa

SEQ ID NO: 441753 - RNA, 22 nt, Human
aaagaaaaaacccuaaaacuga

SEQ ID NO: 441754 - RNA, 23 nt, Human
aaagaaagguuuucagggaagcg

SEQ ID NO: 441755 - RNA, 24 nt, Human
aacugacuuuucaauaaauuuuau

SEQ ID NO: 441756 - RNA, 21 nt, Human
aacuuccugggcauaggaaac

SEQ ID NO: 441757 - RNA, 22 nt, Human
aagaagcuuguccaaaguuuca

SEQ ID NO: 441758 - RNA, 22 nt, Human
aagcaguagaaagcuuuugagg

SEQ ID NO: 441759 - RNA, 20 nt, Human
aaggcauaaccaugaaaaca

SEQ ID NO: 441760 - RNA, 23 nt, Human
aaggcugcagugaggugugauca

SEQ ID NO: 441761 - RNA, 20 nt, Human
acaaacaaggcauaaccaug

SEQ ID NO: 441762 - RNA, 21 nt, Human
acaagacaagcucccaaacac

SEQ ID NO: 441763 - RNA, 23 nt, Human
acaaggcauaaccaugaaaacaa

SEQ ID NO: 441764 - RNA, 20 nt, Human
acagagcaagacccugucuc

SEQ ID NO: 441765 - RNA, 26 nt, Human
acagagcaagacccugucucaacaaa

SEQ ID NO: 441766 - RNA, 20 nt, Human
acaucaugaaaauauuucuc

SEQ ID NO: 441767 - RNA, 19 nt, Human
accaugaaaacaacacucc

SEQ ID NO: 441768 - RNA, 18 nt, Human
acucaggauuuaauuucu

SEQ ID NO: 441769 - RNA, 29 nt, Human
acugauuuuuugacugaaaauacagaaaa

SEQ ID NO: 441770 - RNA, 24 nt, Human
acugcacuccagucugggugacag

SEQ ID NO: 441771 - RNA, 26 nt, Human
acugcacuccagucugggugacagag

SEQ ID NO: 441772 - RNA, 21 nt, Human
agaaaauaacaaacaauuuga

SEQ ID NO: 441773 - RNA, 21 nt, Human
agaacaagacaagcucccaaa

SEQ ID NO: 441774 - RNA, 20 nt, Human
agaauccuuucauauuuccu

SEQ ID NO: 441775 - RNA, 19 nt, Human
agacaagcucccaaacaca

SEQ ID NO: 441776 - RNA, 20 nt, Human
agauuuagaaaacugaaggu

SEQ ID NO: 441777 - RNA, 24 nt, Human
agccugggcaauaucaugagaccu

SEQ ID NO: 441778 - RNA, 19 nt, Human
agcuguugaaaauuucagc

SEQ ID NO: 441779 - RNA, 18 nt, Human
aggaucaaaaacagauga

SEQ ID NO: 441780 - RNA, 20 nt, Human
aggcaggaggaucacgagcc

SEQ ID NO: 441781 - RNA, 22 nt, Human
aggcaggaggaucacgagccug

SEQ ID NO: 441782 - RNA, 24 nt, Human
aggcaggaggaucacgagccugag

SEQ ID NO: 441783 - RNA, 23 nt, Human
aggcugcagugaggugugaucau

SEQ ID NO: 441784 - RNA, 18 nt, Human
agggaaaaauaaggaaaa

SEQ ID NO: 441785 - RNA, 22 nt, Human
agguugaggcaggaggaucacg

SEQ ID NO: 441786 - RNA, 21 nt, Human
auaaccaugaaaacaacacuc

SEQ ID NO: 441787 - RNA, 19 nt, Human
auacuuuguuuuucuuggu

SEQ ID NO: 441788 - RNA, 23 nt, Human
aucaaaauacucccaccaaagca

SEQ ID NO: 441789 - RNA, 24 nt, Human
aucaugccacugcacuccagucug

SEQ ID NO: 441790 - RNA, 22 nt, Human
caacaaaauaaaaaacaucaaa

SEQ ID NO: 441791 - RNA, 23 nt, Human
caacacuugacuccacaaacaag

SEQ ID NO: 441792 - RNA, 24 nt, Human
caagacaagcucccaaacacauga

SEQ ID NO: 441793 - RNA, 20 nt, Human
caaggcauaaccaugaaaac

SEQ ID NO: 441794 - RNA, 27 nt, Human
cacaaacaaggcauaaccaugaaaaca

SEQ ID NO: 441795 - RNA, 24 nt, Human
cacgccuguagucccaagcuacuu

SEQ ID NO: 441796 - RNA, 22 nt, Human
cacuaucaaaaaaagaaaaaac

SEQ ID NO: 441797 - RNA, 22 nt, Human
cacuccagucugggugacagag

SEQ ID NO: 441798 - RNA, 19 nt, Human
cacugcacuccagucuggg

SEQ ID NO: 441799 - RNA, 19 nt, Human
cacugcacuccagucuggg

SEQ ID NO: 441800 - RNA, 21 nt, Human
cacugcacuccagucugggug

SEQ ID NO: 441801 - RNA, 22 nt, Human
cacugcacuccagucuggguga

SEQ ID NO: 441802 - RNA, 24 nt, Human
cacugcacuccagucugggugaca

SEQ ID NO: 441803 - RNA, 24 nt, Human
cacugcacuccagucugggugaca

SEQ ID NO: 441804 - RNA, 22 nt, Human
cagcucaacacgaagucacugg

SEQ ID NO: 441805 - RNA, 19 nt, Human
caguucucaauaaauugau

SEQ ID NO: 441806 - RNA, 19 nt, Human
caguuuaauuguugaaguc

SEQ ID NO: 441807 - RNA, 23 nt, Human
caugaaaaucaacuugaaauaac

SEQ ID NO: 441808 - RNA, 18 nt, Human
ccaaaacuaagcaagcuu

SEQ ID NO: 441809 - RNA, 22 nt, Human
ccaccaaagcacucuauggucu

SEQ ID NO: 441810 - RNA, 20 nt, Human
ccacugcacuccagucuggg

SEQ ID NO: 441811 - RNA, 20 nt, Human
ccacugcacuccagucuggg

SEQ ID NO: 441812 - RNA, 20 nt, Human
ccacugcacuccagucuggg

SEQ ID NO: 441813 - RNA, 21 nt, Human
ccacugcacuccagucugggu

SEQ ID NO: 441814 - RNA, 21 nt, Human
ccacugcacuccagucugggu

SEQ ID NO: 441815 - RNA, 23 nt, Human
ccacugcacuccagucuggguga

SEQ ID NO: 441816 - RNA, 24 nt, Human
ccacugcacuccagucugggugac

SEQ ID NO: 441817 - RNA, 24 nt, Human
cccaccaaagcacucuauggucua

SEQ ID NO: 441818 - RNA, 19 nt, Human
cccggccuggcacccagag

SEQ ID NO: 441819 - RNA, 19 nt, Human
ccugcuucugauggguagg

SEQ ID NO: 441820 - RNA, 21 nt, Human
ccuguagucccaagcuacuug

SEQ ID NO: 441821 - RNA, 21 nt, Human
cuagguccuuuugacccuucu

SEQ ID NO: 441822 - RNA, 18 nt, Human
cuccuugggcauagcuau

SEQ ID NO: 441823 - RNA, 19 nt, Human
cugggugacagagcaagac

SEQ ID NO: 441824 - RNA, 20 nt, Human
gaccuuucucucccgcgccg

SEQ ID NO: 441825 - RNA, 21 nt, Human
gaucaugccacugcacuccag

SEQ ID NO: 441826 - RNA, 18 nt, Human
gauuaaaaugucaacagu

SEQ ID NO: 441827 - RNA, 24 nt, Human
gcacuccagucugggugacagagc

SEQ ID NO: 441828 - RNA, 19 nt, Human
gccacugcacuccagucug

SEQ ID NO: 441829 - RNA, 24 nt, Human
gccacugcacuccagucuggguga

SEQ ID NO: 441830 - RNA, 24 nt, Human
gcucaacacgaagucacuggcccg

SEQ ID NO: 441831 - RNA, 18 nt, Human
gggaaaaauaaggaaaaa

SEQ ID NO: 441832 - RNA, 26 nt, Human
uaaaaaaacacuaauacuguacagua

SEQ ID NO: 441833 - RNA, 19 nt, Human
uaaaucccauauuccaaag

SEQ ID NO: 441834 - RNA, 26 nt, Human
uaaaucccauauuccaaaggacaaga

SEQ ID NO: 441835 - RNA, 22 nt, Human
uaaccuggacugaggcuaagag

SEQ ID NO: 441836 - RNA, 21 nt, Human
uaaugaaacccaaaacuaagc

SEQ ID NO: 441837 - RNA, 20 nt, Human
uacagaaaauaacaaacaau

SEQ ID NO: 441838 - RNA, 23 nt, Human
uagaagacacauaacaugccuca

SEQ ID NO: 441839 - RNA, 25 nt, Human
uaguaagccacacuagguccuuuug

SEQ ID NO: 441840 - RNA, 18 nt, Human
uagucacuagguuccugu

SEQ ID NO: 441841 - RNA, 26 nt, Human
uaucaaaaaaagaaaaaacccuaaaa

SEQ ID NO: 441842 - RNA, 23 nt, Human
uaugaaugacuacuugaguucag

SEQ ID NO: 441843 - RNA, 21 nt, Human
ucaaaaaaagaaaaaacccua

SEQ ID NO: 441844 - RNA, 25 nt, Human
ucaauaaauugauguauacugagga

SEQ ID NO: 441845 - RNA, 23 nt, Human
ucaugccacugcacuccagucug

SEQ ID NO: 441846 - RNA, 18 nt, Human
uccacaaacaaggcauaa

SEQ ID NO: 441847 - RNA, 19 nt, Human
uccacaaacaaggcauaac

SEQ ID NO: 441848 - RNA, 24 nt, Human
uccagucugggugacagagcaaga

SEQ ID NO: 441849 - RNA, 23 nt, Human
uccauguaguaagccacacuagg

SEQ ID NO: 441850 - RNA, 20 nt, Human
uccccauguuaauaaaucau

SEQ ID NO: 441851 - RNA, 20 nt, Human
ucucugggggaagacugucu

SEQ ID NO: 441852 - RNA, 21 nt, Human
ucugggugaggaugcugacug

SEQ ID NO: 441853 - RNA, 19 nt, Human
ucuguguuuauauuucauu

SEQ ID NO: 441854 - RNA, 25 nt, Human
ucuuuuucuuuggaaaaguacaguu

SEQ ID NO: 441855 - RNA, 28 nt, Human
ugaaacaacauuugcugaaaggucaucc

SEQ ID NO: 441856 - RNA, 24 nt, Human
ugaaacccaaaacuaagcaagcuu

SEQ ID NO: 441857 - RNA, 28 nt, Human
ugaaacccaaaacuaagcaagcuucccc

SEQ ID NO: 441858 - RNA, 22 nt, Human
ugacagagcaagacccugucuc

SEQ ID NO: 441859 - RNA, 19 nt, Human
ugacuccacaaacaaggca

SEQ ID NO: 441860 - RNA, 22 nt, Human
ugagaacaagacaagcucccaa

SEQ ID NO: 441861 - RNA, 22 nt, Human
ugagaacaagacaagcucccaa

SEQ ID NO: 441862 - RNA, 25 nt, Human
ugagaacaagacaagcucccaaaca

SEQ ID NO: 441863 - RNA, 26 nt, Human
ugagaacaagacaagcucccaaacac

SEQ ID NO: 441864 - RNA, 18 nt, Human
ugaggcaggaggaucacg

SEQ ID NO: 441865 - RNA, 22 nt, Human
ugaggcaggaggaucacgagcc

SEQ ID NO: 441866 - RNA, 23 nt, Human
ugaggcaggaggaucacgagccu

SEQ ID NO: 441867 - RNA, 24 nt, Human
ugaggcaggaggaucacgagccug

SEQ ID NO: 441868 - RNA, 18 nt, Human
ugccaaggaucaaaaaca

SEQ ID NO: 441869 - RNA, 25 nt, Human
ugccaaggaucaaaaacagaugaaa

SEQ ID NO: 441870 - RNA, 24 nt, Human
ugccacugcacuccagucugggug

SEQ ID NO: 441871 - RNA, 20 nt, Human
ugccaucucugggugaggau

SEQ ID NO: 441872 - RNA, 24 nt, Human
ugcgagguugaggcaggaggauca

SEQ ID NO: 441873 - RNA, 18 nt, Human
uggaacacagccuacuga

SEQ ID NO: 441874 - RNA, 19 nt, Human
uggauugucacuaucaaaa

SEQ ID NO: 441875 - RNA, 21 nt, Human
uggcacacgccuguaguccca

SEQ ID NO: 441876 - RNA, 19 nt, Human
uggcauggcuugcuuaauc

SEQ ID NO: 441877 - RNA, 24 nt, Human
uggcccggccuggcacccagaggu

SEQ ID NO: 441878 - RNA, 24 nt, Human
ugggggaagacugucuaccugcgu

SEQ ID NO: 441879 - RNA, 24 nt, Human
uggucuagacuugauacuuaaaau

SEQ ID NO: 441880 - RNA, 24 nt, Human
ugguggcacacgccuguaguccca

SEQ ID NO: 441881 - RNA, 22 nt, Human
ugucacuaucaaaaaaagaaaa

SEQ ID NO: 441882 - RNA, 19 nt, Human
uguuuauauuucauuaugg

SEQ ID NO: 441883 - RNA, 19 nt, Human
uguuucuucuucuacgaca

SEQ ID NO: 441884 - RNA, 19 nt, Human
uuaaccuggacugaggcua

SEQ ID NO: 441885 - RNA, 22 nt, Human
uuaguuuuucccacagcuguug

SEQ ID NO: 441886 - RNA, 21 nt, Human
uuauaaugaaacccaaaacua

SEQ ID NO: 441887 - RNA, 19 nt, Human
uuauaucuacaaaaaauua

SEQ ID NO: 441888 - RNA, 20 nt, Human
uucaaauuuauaugaaugac

SEQ ID NO: 441889 - RNA, 21 nt, Human
uucuacgacagaccuccaaga

SEQ ID NO: 441890 - RNA, 21 nt, Human
uucuccucaaaaaucugauaa

SEQ ID NO: 441891 - RNA, 19 nt, Human
uucuucuacgacagaccuc

SEQ ID NO: 441892 - RNA, 24 nt, Human
uucuuggcauggcuugcuuaaucu

SEQ ID NO: 441893 - RNA, 18 nt, Human
uuucuuggcauggcuugc

SEQ ID NO: 441894 - RNA, 19 nt, Human
uuugacaaaaauacucagu

SEQ ID NO: 441895 - RNA, 22 nt, Human
uuuuucuugguguccccauguu

SEQ ID NO: 441896 - RNA, 18 nt, Human
aauacaugccuaacacag

SEQ ID NO: 441897 - RNA, 23 nt, Human
acaaacuuuucuucaacugggua

SEQ ID NO: 441898 - RNA, 21 nt, Human
caaacuuuucuucaacugggu

SEQ ID NO: 441899 - RNA, 23 nt, Human
caaauccccgacugaagcagcuc

SEQ ID NO: 441900 - RNA, 19 nt, Human
caauucaaggaagcggcaa

SEQ ID NO: 441901 - RNA, 19 nt, Human
gaaaaaaaaaaaaucccau

SEQ ID NO: 441902 - RNA, 20 nt, Human
gugaaaaaaaaaaaauccca

SEQ ID NO: 441903 - RNA, 23 nt, Human
uaacgugaaaaaaaaaaaauccc

SEQ ID NO: 441904 - RNA, 24 nt, Human
uagauguuuaucuuuuaaaauuuc

SEQ ID NO: 441905 - RNA, 18 nt, Human
ucauauuucuugaucuga

SEQ ID NO: 441906 - RNA, 23 nt, Human
ucuucaaauccccgacugaagca

SEQ ID NO: 441907 - RNA, 21 nt, Human
uucaaggaagcggcaaagaaa

SEQ ID NO: 441908 - RNA, 20 nt, Human
uucuucaaauccccgacuga

SEQ ID NO: 441909 - RNA, 20 nt, Human
uuguagaaauggguuccaua

SEQ ID NO: 441910 - RNA, 23 nt, Human
aaaaaaaaaaaaauuuacaaaag

SEQ ID NO: 441911 - RNA, 23 nt, Human
aaaaaguugagaauacaggaaua

SEQ ID NO: 441912 - RNA, 19 nt, Human
aaaaggaaaaaaguugaga

SEQ ID NO: 441913 - RNA, 24 nt, Human
aaauauugaugucauaaccaaacu

SEQ ID NO: 441914 - RNA, 20 nt, Human
aacacagugagacccugucu

SEQ ID NO: 441915 - RNA, 21 nt, Human
aacacagugagacccugucuc

SEQ ID NO: 441916 - RNA, 19 nt, Human
aagaaguacauuuggugga

SEQ ID NO: 441917 - RNA, 18 nt, Human
acagcaaaaaaaaaaaaa

SEQ ID NO: 441918 - RNA, 18 nt, Human
agaaccagcagggggaac

SEQ ID NO: 441919 - RNA, 25 nt, Human
agaaccagcagggggaaccgguacc

SEQ ID NO: 441920 - RNA, 21 nt, Human
agaaccagcagggggaacuug

SEQ ID NO: 441921 - RNA, 22 nt, Human
agaagcuccacugaggugaagg

SEQ ID NO: 441922 - RNA, 23 nt, Human
agcaaaaaaaaaaaaauuuacaa

SEQ ID NO: 441923 - RNA, 22 nt, Human
agccugggcaacacagugagac

SEQ ID NO: 441924 - RNA, 24 nt, Human
agccugggcaacacagugagaccc

SEQ ID NO: 441925 - RNA, 25 nt, Human
augaguuguagaguuuuauuuuugu

SEQ ID NO: 441926 - RNA, 21 nt, Human
auggccccguuucauaaaggu

SEQ ID NO: 441927 - RNA, 22 nt, Human
caacacagugagacccugucuc

SEQ ID NO: 441928 - RNA, 24 nt, Human
caacacagugagacccugucucua

SEQ ID NO: 441929 - RNA, 24 nt, Human
cacagugagacccugucucuaaaa

SEQ ID NO: 441930 - RNA, 21 nt, Human
cacaugaagaacccauggaca

SEQ ID NO: 441931 - RNA, 27 nt, Human
cacuacacagacuaugaacaguuagca

SEQ ID NO: 441932 - RNA, 24 nt, Human
cagcuuacccuauucuuguuauug

SEQ ID NO: 441933 - RNA, 22 nt, Human
ccugggcaacacagugagaccc

SEQ ID NO: 441934 - RNA, 30 nt, Human
gggaacuugacauuaaaaaucuagaaacag

SEQ ID NO: 441935 - RNA, 26 nt, Human
guggggaugacagcaaaaaaaaaaaa

SEQ ID NO: 441936 - RNA, 21 nt, Human
uaaaacucagaagcuccacug

SEQ ID NO: 441937 - RNA, 25 nt, Human
uacaaaaggaaaaaaguugagaaua

SEQ ID NO: 441938 - RNA, 24 nt, Human
uacauuugguggaguuugagacca

SEQ ID NO: 441939 - RNA, 20 nt, Human
uagcagaaaaagaucucgug

SEQ ID NO: 441940 - RNA, 21 nt, Human
uagcuuuuaaguaagcaaugu

SEQ ID NO: 441941 - RNA, 22 nt, Human
ucuagaaacagaauuuuaggau

SEQ ID NO: 441942 - RNA, 21 nt, Human
ucucgugacuaaaguggggau

SEQ ID NO: 441943 - RNA, 22 nt, Human
ucuuuucagagaucauagcaca

SEQ ID NO: 441944 - RNA, 22 nt, Human
ugaaggaaacauggacaugaua

SEQ ID NO: 441945 - RNA, 18 nt, Human
ugacgaucuugagcagua

SEQ ID NO: 441946 - RNA, 19 nt, Human
ugaggugaaggaaacaugg

SEQ ID NO: 441947 - RNA, 24 nt, Human
ugggcaacacagugagacccuguc

SEQ ID NO: 441948 - RNA, 26 nt, Human
uggggaugacagcaaaaaaaaaaaaa

SEQ ID NO: 441949 - RNA, 21 nt, Human
ugucucuaaaagcauuaaagc

SEQ ID NO: 441950 - RNA, 19 nt, Human
uguuaauauuagaaccagc

SEQ ID NO: 441951 - RNA, 22 nt, Human
uuacaaaaggaaaaaaguugaa

SEQ ID NO: 441952 - RNA, 23 nt, Human
uuagaaccagcagggggaacuug

SEQ ID NO: 441953 - RNA, 22 nt, Human
uucagagaucauagcacaugaa

SEQ ID NO: 441954 - RNA, 20 nt, Human
uugguggaguuugagaccag

SEQ ID NO: 441955 - RNA, 23 nt, Human
uuguucaaauucuccugaagcuu

SEQ ID NO: 441956 - RNA, 22 nt, Human
uuuuaaguaagcaauguuagaa

SEQ ID NO: 441957 - RNA, 22 nt, Human
aaaaaaccaggagucugaggcg

SEQ ID NO: 441958 - RNA, 19 nt, Human
aaaagauauaaauacugca

SEQ ID NO: 441959 - RNA, 23 nt, Human
aaaccaggagucugaggcggggg

SEQ ID NO: 441960 - RNA, 24 nt, Human
aauacguagugaauauuggcacaa

SEQ ID NO: 441961 - RNA, 22 nt, Human
aggaagagaaaagugagucuca

SEQ ID NO: 441962 - RNA, 23 nt, Human
auuacuaaaaauguuucuguaaa

SEQ ID NO: 441963 - RNA, 23 nt, Human
caagaccuacagcuccaagaaga

SEQ ID NO: 441964 - RNA, 20 nt, Human
cauacaaaagauauaaauac

SEQ ID NO: 441965 - RNA, 19 nt, Human
ccccugaaagacguugcug

SEQ ID NO: 441966 - RNA, 22 nt, Human
ccccugaaagacguugcugcuu

SEQ ID NO: 441967 - RNA, 22 nt, Human
ccucuagauagcauggaaauuu

SEQ ID NO: 441968 - RNA, 19 nt, Human
cgucggacuacgagacgau

SEQ ID NO: 441969 - RNA, 19 nt, Human
cuggaaaaaaccaggaguc

SEQ ID NO: 441970 - RNA, 22 nt, Human
gacgauggaaacggugguucaa

SEQ ID NO: 441971 - RNA, 26 nt, Human
ggaacucucccacaaccagcugucuu

SEQ ID NO: 441972 - RNA, 22 nt, Human
ucccacaaccagcugucuucuc

SEQ ID NO: 441973 - RNA, 25 nt, Human
ugaggcuuuuaaauuaagauuuagc

SEQ ID NO: 441974 - RNA, 23 nt, Human
ugaugcucuuaaguguguuucuu

SEQ ID NO: 441975 - RNA, 24 nt, Human
uggaaaaaaccaggagucugaggc

SEQ ID NO: 441976 - RNA, 18 nt, Human
uggcacaaacccuuucgu

SEQ ID NO: 441977 - RNA, 27 nt, Human
uggcacaaacccuuucguacuuaaagc

SEQ ID NO: 441978 - RNA, 22 nt, Human
ugucuucuccucucggcuucca

SEQ ID NO: 441979 - RNA, 19 nt, Human
uucaggaagagaaaaguga

SEQ ID NO: 441980 - RNA, 24 nt, Human
uucaggaagagaaaagugagucuc

SEQ ID NO: 441981 - RNA, 19 nt, Human
aaaaaccuaacaacgcuua

SEQ ID NO: 441982 - RNA, 19 nt, Human
aaacagcuacaaaauccau

SEQ ID NO: 441983 - RNA, 19 nt, Human
aagcaaagcaugaaaaaac

SEQ ID NO: 441984 - RNA, 22 nt, Human
aagcaugaaaaaacagacccaa

SEQ ID NO: 441985 - RNA, 22 nt, Human
aaguaaaaaugcuguuacaauc

SEQ ID NO: 441986 - RNA, 23 nt, Human
acagcuaccuuuuuuuuuuuuuu

SEQ ID NO: 441987 - RNA, 20 nt, Human
accuuuuuuuuuuuuuuaaa

SEQ ID NO: 441988 - RNA, 18 nt, Human
agccaaguuacucacggg

SEQ ID NO: 441989 - RNA, 21 nt, Human
aggccggcggcgcgguccugg

SEQ ID NO: 441990 - RNA, 22 nt, Human
aggcgagcggagcccccggagc

SEQ ID NO: 441991 - RNA, 23 nt, Human
auaauaauaauuaaaaagcaaag

SEQ ID NO: 441992 - RNA, 24 nt, Human
aucacagcuauccacgcuacagca

SEQ ID NO: 441993 - RNA, 22 nt, Human
caaagcaugaaaaaacagaccc

SEQ ID NO: 441994 - RNA, 20 nt, Human
cacagcuaccuuuuuuuuuu

SEQ ID NO: 441995 - RNA, 18 nt, Human
cagaaaguaaaaaugcug

SEQ ID NO: 441996 - RNA, 18 nt, Human
cgggcaggcgagcggagc

SEQ ID NO: 441997 - RNA, 19 nt, Human
cgggcaggcgagcggagcc

SEQ ID NO: 441998 - RNA, 19 nt, Human
cgguugacucaccaaucac

SEQ ID NO: 441999 - RNA, 22 nt, Human
cuaccuuuuuuuuuuuuuuaaa

SEQ ID NO: 442000 - RNA, 21 nt, Human
gaaaaaacagacccaaaaugu

SEQ ID NO: 442001 - RNA, 25 nt, Human
gaaaaaacagacccaaaauguuaag

SEQ ID NO: 442002 - RNA, 21 nt, Human
gcgggcaggcgagcggagccc

SEQ ID NO: 442003 - RNA, 23 nt, Human
ggaggccggcggcgcgguccugg

SEQ ID NO: 442004 - RNA, 25 nt, Human
ggaggccggcggcgcgguccugggu

SEQ ID NO: 442005 - RNA, 24 nt, Human
gggcggcgugcgggcaggcgagcg

SEQ ID NO: 442006 - RNA, 18 nt, Human
ggguggguguccuggggu

SEQ ID NO: 442007 - RNA, 22 nt, Human
ggugguagauuaccaagaggga

SEQ ID NO: 442008 - RNA, 25 nt, Human
guaaaaaugcuguuacaaucucagu

SEQ ID NO: 442009 - RNA, 22 nt, Human
uacagaaaguaaaaaugcuguu

SEQ ID NO: 442010 - RNA, 24 nt, Human
uacagcaagaaucuuacacaaaaa

SEQ ID NO: 442011 - RNA, 18 nt, Human
ucacagcuaccuuuuuuu

SEQ ID NO: 442012 - RNA, 24 nt, Human
uccacaagcuuggugguagauuac

SEQ ID NO: 442013 - RNA, 24 nt, Human
uccacgcuacagcaagaaucuuac

SEQ ID NO: 442014 - RNA, 18 nt, Human
uccaugagcaguccaacc

SEQ ID NO: 442015 - RNA, 22 nt, Human
uccuggguggcgggcggcgugc

SEQ ID NO: 442016 - RNA, 19 nt, Human
ucuuuggcucuuugggugg

SEQ ID NO: 442017 - RNA, 20 nt, Human
ucuuuggcucuuuggguggg

SEQ ID NO: 442018 - RNA, 25 nt, Human
ucuuuggguggguggguguccuggg

SEQ ID NO: 442019 - RNA, 20 nt, Human
uggggugaaguccacaagcu

SEQ ID NO: 442020 - RNA, 23 nt, Human
uggguggguggguguccuggggu

SEQ ID NO: 442021 - RNA, 24 nt, Human
uggguggguggguguccugggguu

SEQ ID NO: 442022 - RNA, 19 nt, Human
uggguggguguccuggggu

SEQ ID NO: 442023 - RNA, 18 nt, Human
ugucacaggaacuauucu

SEQ ID NO: 442024 - RNA, 24 nt, Human
uuccccucuuccccccucuucaaa

SEQ ID NO: 442025 - RNA, 22 nt, Human
uuggggugaaguccacaagcuu

SEQ ID NO: 442026 - RNA, 18 nt, Human
auagaagagaaaauauga

SEQ ID NO: 442027 - RNA, 22 nt, Human
auaguuuuguuaauagugccau

SEQ ID NO: 442028 - RNA, 19 nt, Human
gaucgauugcauaaacuug

SEQ ID NO: 442029 - RNA, 20 nt, Human
uaagguucacuguuaaauca

SEQ ID NO: 442030 - RNA, 21 nt, Human
uagugccaugaacaguacaaa

SEQ ID NO: 442031 - RNA, 20 nt, Human
uccacauuuaaaauaaaauc

SEQ ID NO: 442032 - RNA, 19 nt, Human
ucccaaugccaauuuuucc

SEQ ID NO: 442033 - RNA, 23 nt, Human
ugaacaguacaaauuugugagaa

SEQ ID NO: 442034 - RNA, 18 nt, Human
ugccaugaacaguacaaa

SEQ ID NO: 442035 - RNA, 20 nt, Human
ugccaugaacaguacaaauu

SEQ ID NO: 442036 - RNA, 20 nt, Human
uuccacauuuaaaauaaaau

SEQ ID NO: 442037 - RNA, 21 nt, Human
uugaugguaauuguuaaccuc

SEQ ID NO: 442038 - RNA, 19 nt, Human
uuucaaagauagaagagaa

SEQ ID NO: 442039 - RNA, 26 nt, Human
aaggugguuccacccuguguuccuag

SEQ ID NO: 442040 - RNA, 19 nt, Human
aauuuugucuuuccuguac

SEQ ID NO: 442041 - RNA, 23 nt, Human
aggcaaaguuuaccgacagcaac

SEQ ID NO: 442042 - RNA, 22 nt, Human
aggcauaauccacaacuuuaau

SEQ ID NO: 442043 - RNA, 19 nt, Human
agugaagaggcagccuaga

SEQ ID NO: 442044 - RNA, 18 nt, Human
auccgggacucuuaaggg

SEQ ID NO: 442045 - RNA, 19 nt, Human
caaguuugauuuggaaugu

SEQ ID NO: 442046 - RNA, 22 nt, Human
caucuuaacguuacugcccuua

SEQ ID NO: 442047 - RNA, 24 nt, Human
caucuuaacguuacugcccuuaac

SEQ ID NO: 442048 - RNA, 19 nt, Human
cccuguguuccuauugccc

SEQ ID NO: 442049 - RNA, 22 nt, Human
ccuguaccuuacuugugugaug

SEQ ID NO: 442050 - RNA, 21 nt, Human
gccagaguucaaggugcccug

SEQ ID NO: 442051 - RNA, 23 nt, Human
guguuccuauugcccuggcuugg

SEQ ID NO: 442052 - RNA, 23 nt, Human
uacacagcuuggccuggcugcgc

SEQ ID NO: 442053 - RNA, 21 nt, Human
uagaaaacauccaguuaccau

SEQ ID NO: 442054 - RNA, 22 nt, Human
ucauuugcaaguuugauuugga

SEQ ID NO: 442055 - RNA, 22 nt, Human
ugaacacacagaaggaaaauua

SEQ ID NO: 442056 - RNA, 20 nt, Human
ugacaaaggugguuccaccc

SEQ ID NO: 442057 - RNA, 21 nt, Human
ugcccuuaacuuacacagcuu

SEQ ID NO: 442058 - RNA, 19 nt, Human
aaaggucucuuucccugcu

SEQ ID NO: 442059 - RNA, 24 nt, Human
aacaaauaugacuucauuggucac

SEQ ID NO: 442060 - RNA, 22 nt, Human
aagggaagccuuuucugcaauc

SEQ ID NO: 442061 - RNA, 21 nt, Human
acagaaccagcagagugcuga

SEQ ID NO: 442062 - RNA, 23 nt, Human
accugcuacaccuccuugggagc

SEQ ID NO: 442063 - RNA, 24 nt, Human
acgugauaggacaguuaaaaaaaa

SEQ ID NO: 442064 - RNA, 22 nt, Human
aggaaaacacaauuggcagcug

SEQ ID NO: 442065 - RNA, 18 nt, Human
aggucucuuucccugcuc

SEQ ID NO: 442066 - RNA, 27 nt, Human
caacaagauuugaguuuuaaauacaga

SEQ ID NO: 442067 - RNA, 19 nt, Human
cacagcaccaacuucucca

SEQ ID NO: 442068 - RNA, 21 nt, Human
caccuccuugggagccaaggg

SEQ ID NO: 442069 - RNA, 22 nt, Human
caucuggguuauucuagaaguu

SEQ ID NO: 442070 - RNA, 22 nt, Human
caucuggguuauucuagaaguu

SEQ ID NO: 442071 - RNA, 22 nt, Human
ccugcagagauccaacaagauu

SEQ ID NO: 442072 - RNA, 18 nt, Human
cgcaucuggguuauucua

SEQ ID NO: 442073 - RNA, 21 nt, Human
cuucaaguucugccacucuuc

SEQ ID NO: 442074 - RNA, 21 nt, Human
gaaaauagcaacccacugcaa

SEQ ID NO: 442075 - RNA, 20 nt, Human
gaaccagcagagugcugaug

SEQ ID NO: 442076 - RNA, 20 nt, Human
gaaggcagagaguauaaaga

SEQ ID NO: 442077 - RNA, 18 nt, Human
gauagaaacuuaucacaa

SEQ ID NO: 442078 - RNA, 21 nt, Human
gcagcugacauccucuggcuc

SEQ ID NO: 442079 - RNA, 21 nt, Human
uaagccauugguauagcaacu

SEQ ID NO: 442080 - RNA, 21 nt, Human
uacacaucaucggaaaacaga

SEQ ID NO: 442081 - RNA, 25 nt, Human
uagaaaauagcaacccacugcaaga

SEQ ID NO: 442082 - RNA, 22 nt, Human
uagcaaaauauuuaaaggucuc

SEQ ID NO: 442083 - RNA, 21 nt, Human
uagcaaccuaaaaaccuuggc

SEQ ID NO: 442084 - RNA, 22 nt, Human
uauugcucacaccugcuacacc

SEQ ID NO: 442085 - RNA, 21 nt, Human
uauuuuguucccuaaaaagua

SEQ ID NO: 442086 - RNA, 24 nt, Human
ucaaacagaaccagcagagugcug

SEQ ID NO: 442087 - RNA, 28 nt, Human
ucaagaaacuuuuagugccauuuucauu

SEQ ID NO: 442088 - RNA, 18 nt, Human
ucuagaaaauagcaaccc

SEQ ID NO: 442089 - RNA, 30 nt, Human
ucucaagaaacuuuuagugccauuuucauu

SEQ ID NO: 442090 - RNA, 22 nt, Human
ugauaggacaguuaaaaaaaaa

SEQ ID NO: 442091 - RNA, 20 nt, Human
ugaugagggggcgccgcugg

SEQ ID NO: 442092 - RNA, 23 nt, Human
ugcaaacccugugugaaaggcac

SEQ ID NO: 442093 - RNA, 19 nt, Human
uggcagcugacauccucug

SEQ ID NO: 442094 - RNA, 21 nt, Human
ugggcuuuauacuuggauauu

SEQ ID NO: 442095 - RNA, 21 nt, Human
ugggugacaggagaggacgug

SEQ ID NO: 442096 - RNA, 25 nt, Human
uuaaaggucucuuucccugcucuuc

SEQ ID NO: 442097 - RNA, 24 nt, Human
uucaaaaugggugacaggagagga

SEQ ID NO: 442098 - RNA, 22 nt, Human
uuuaaaggucucuuucccugcu

SEQ ID NO: 442099 - RNA, 23 nt, Human
uuuacagaggaaguugaacuuca

SEQ ID NO: 442100 - RNA, 21 nt, Human
aacuccgcuccucugcccccc

SEQ ID NO: 442101 - RNA, 22 nt, Human
aacuccgcuccucugcccccca

SEQ ID NO: 442102 - RNA, 24 nt, Human
acauccuuaccacccggagagccu

SEQ ID NO: 442103 - RNA, 18 nt, Human
accccaccgcccgagaag

SEQ ID NO: 442104 - RNA, 27 nt, Human
acccuaaaauugcgcccgcauuuuacc

SEQ ID NO: 442105 - RNA, 22 nt, Human
agcggcagcggcagcgacagcc

SEQ ID NO: 442106 - RNA, 24 nt, Human
agcggcagcggcagcgacagcccc

SEQ ID NO: 442107 - RNA, 22 nt, Human
agcugcuggggcccccuggggu

SEQ ID NO: 442108 - RNA, 22 nt, Human
auugagcaugcgcgggagcccc

SEQ ID NO: 442109 - RNA, 24 nt, Human
caaagccagagcgccaccugcugg

SEQ ID NO: 442110 - RNA, 22 nt, Human
caagaggccuccucgcacaucc

SEQ ID NO: 442111 - RNA, 25 nt, Human
cacauccuuaccacccggagagccu

SEQ ID NO: 442112 - RNA, 21 nt, Human
caccacgggaccccgcccucc

SEQ ID NO: 442113 - RNA, 18 nt, Human
cacccggagagccucagu

SEQ ID NO: 442114 - RNA, 21 nt, Human
cacuacgcaugcguccgcacc

SEQ ID NO: 442115 - RNA, 21 nt, Human
cagcggcagcgacagccugcc

SEQ ID NO: 442116 - RNA, 19 nt, Human
cagcggcagcggcagcgac

SEQ ID NO: 442117 - RNA, 24 nt, Human
ccaaaggagaugacaauccccccc

SEQ ID NO: 442118 - RNA, 22 nt, Human
ccaccacgggaccccgcccucc

SEQ ID NO: 442119 - RNA, 25 nt, Human
ccaccccaccgcccgagaagcccac

SEQ ID NO: 442120 - RNA, 21 nt, Human
ccaccgcccgagaagcccacu

SEQ ID NO: 442121 - RNA, 19 nt, Human
cccaccccaccgcccgaga

SEQ ID NO: 442122 - RNA, 24 nt, Human
cccaccgcccgagaagcccacuac

SEQ ID NO: 442123 - RNA, 18 nt, Human
ccgagcagggguuggugc

SEQ ID NO: 442124 - RNA, 20 nt, Human
ccgcaccccacgggcgcccc

SEQ ID NO: 442125 - RNA, 22 nt, Human
ccucccccuaaccugguacccc

SEQ ID NO: 442126 - RNA, 21 nt, Human
ccucgcacauccuuaccaccc

SEQ ID NO: 442127 - RNA, 22 nt, Human
ccugugucaagacccuaagagc

SEQ ID NO: 442128 - RNA, 22 nt, Human
cgccuccaccacgggaccccgc

SEQ ID NO: 442129 - RNA, 18 nt, Human
cggagagacagcaugaua

SEQ ID NO: 442130 - RNA, 25 nt, Human
cguccugugucaagacccuaagagc

SEQ ID NO: 442131 - RNA, 28 nt, Human
cguuuccucccccuaaccugguacccca

SEQ ID NO: 442132 - RNA, 19 nt, Human
cuacgcaugcguccgcacc

SEQ ID NO: 442133 - RNA, 19 nt, Human
cuccgcuccucugcccccc

SEQ ID NO: 442134 - RNA, 18 nt, Human
cugggguuugggacacag

SEQ ID NO: 442135 - RNA, 20 nt, Human
gaacccuccgcuguuucuuc

SEQ ID NO: 442136 - RNA, 18 nt, Human
gaagggggcuggucccca

SEQ ID NO: 442137 - RNA, 20 nt, Human
gcccaccccaccgcccgaga

SEQ ID NO: 442138 - RNA, 21 nt, Human
gcccaccccaccgcccgagaa

SEQ ID NO: 442139 - RNA, 19 nt, Human
gcccacuacgcaugcgucc

SEQ ID NO: 442140 - RNA, 21 nt, Human
gccuccaccacgggaccccgc

SEQ ID NO: 442141 - RNA, 24 nt, Human
gccugccuaccccaggacuccagc

SEQ ID NO: 442142 - RNA, 21 nt, Human
gcgagcuuccucccccgauuu

SEQ ID NO: 442143 - RNA, 23 nt, Human
gcuggggcccccugggguuuggg

SEQ ID NO: 442144 - RNA, 25 nt, Human
gcugguccccaguuuuugcagugcc

SEQ ID NO: 442145 - RNA, 20 nt, Human
guacggggccgagcaggggu

SEQ ID NO: 442146 - RNA, 21 nt, Human
uaaccugguaccccaucccuu

SEQ ID NO: 442147 - RNA, 22 nt, Human
uaccccaggacuccagccucac

SEQ ID NO: 442148 - RNA, 21 nt, Human
uagcucagccauugcuuuuuu

SEQ ID NO: 442149 - RNA, 21 nt, Human
ucaagacccuaagagcccggg

SEQ ID NO: 442150 - RNA, 20 nt, Human
uccaaauuccgcgcccaccc

SEQ ID NO: 442151 - RNA, 21 nt, Human
uccaaauuccgcgcccacccc

SEQ ID NO: 442152 - RNA, 19 nt, Human
uccaccacgggaccccgcc

SEQ ID NO: 442153 - RNA, 20 nt, Human
uccaucucaggcagcggcag

SEQ ID NO: 442154 - RNA, 24 nt, Human
uccccgccuccaccacgggacccc

SEQ ID NO: 442155 - RNA, 22 nt, Human
ucccuuagcucagccauugcuu

SEQ ID NO: 442156 - RNA, 21 nt, Human
uccgcaccccacgggcgcccc

SEQ ID NO: 442157 - RNA, 21 nt, Human
uccgcgcccaccccaccgccc

SEQ ID NO: 442158 - RNA, 22 nt, Human
uccucccccuaaccugguaccc

SEQ ID NO: 442159 - RNA, 19 nt, Human
uccucgcacauccuuacca

SEQ ID NO: 442160 - RNA, 25 nt, Human
uccucugaccucgggccucaggcuu

SEQ ID NO: 442161 - RNA, 23 nt, Human
uccugggccgacugcagagccuu

SEQ ID NO: 442162 - RNA, 18 nt, Human
ucgaagcugcuggggccc

SEQ ID NO: 442163 - RNA, 18 nt, Human
ugacuggcuucugccuca

SEQ ID NO: 442164 - RNA, 20 nt, Human
ugcgguccuucccucucccc

SEQ ID NO: 442165 - RNA, 18 nt, Human
ugcuggggcccccugggg

SEQ ID NO: 442166 - RNA, 20 nt, Human
ugcuggggcccccugggguu

SEQ ID NO: 442167 - RNA, 22 nt, Human
ugggucuccaaauuccgcgccc

SEQ ID NO: 442168 - RNA, 18 nt, Human
ugucaagacccuaagagc

SEQ ID NO: 442169 - RNA, 18 nt, Human
uucccgaagugggucucc

SEQ ID NO: 442170 - RNA, 24 nt, Human
uucucaggcuuuauugggcuuuau

SEQ ID NO: 442171 - RNA, 24 nt, Human
uuggugcuccgugcgguccuuccc

SEQ ID NO: 442172 - RNA, 22 nt, Human
uuuccaucucaggcagcggcag

SEQ ID NO: 442173 - RNA, 22 nt, Human
aaaacaagcacuggcuccaagc

SEQ ID NO: 442174 - RNA, 22 nt, Human
aaaacaagcacuggcuccaagc

SEQ ID NO: 442175 - RNA, 25 nt, Human
aaaauucaguacuguuucuggacaa

SEQ ID NO: 442176 - RNA, 25 nt, Human
aaaauucaguacuguuucuggacaa

SEQ ID NO: 442177 - RNA, 23 nt, Human
aaaccacaauaguaaaaucuacc

SEQ ID NO: 442178 - RNA, 22 nt, Human
aaacuggcaagagcugggaagg

SEQ ID NO: 442179 - RNA, 22 nt, Human
aaacuggcaagagcugggaagg

SEQ ID NO: 442180 - RNA, 24 nt, Human
aaagcguugagauuacagguguga

SEQ ID NO: 442181 - RNA, 21 nt, Human
aaaggucaaagguugccagcu

SEQ ID NO: 442182 - RNA, 24 nt, Human
aaauacuggcaauuacuucguacu

SEQ ID NO: 442183 - RNA, 18 nt, Human
aaccacaauaguaaaauc

SEQ ID NO: 442184 - RNA, 20 nt, Human
aagaacaucuaacaucucag

SEQ ID NO: 442185 - RNA, 20 nt, Human
aagagcaucuucacuuacaa

SEQ ID NO: 442186 - RNA, 21 nt, Human
aagagcugggaagguggucuc

SEQ ID NO: 442187 - RNA, 21 nt, Human
aagagcugggaagguggucuc

SEQ ID NO: 442188 - RNA, 21 nt, Human
aagaggcacacuccacaggca

SEQ ID NO: 442189 - RNA, 24 nt, Human
aagcagaagaggcaaacucaaaug

SEQ ID NO: 442190 - RNA, 26 nt, Human
aagcguugagauuacaggugugagcc

SEQ ID NO: 442191 - RNA, 23 nt, Human
aagcuccugagcauuuuuaaucc

SEQ ID NO: 442192 - RNA, 20 nt, Human
aaggucaaagguugccagcu

SEQ ID NO: 442193 - RNA, 20 nt, Human
aauuugcugauuuugggcuu

SEQ ID NO: 442194 - RNA, 23 nt, Human
acacgguuucauuguguuggcca

SEQ ID NO: 442195 - RNA, 24 nt, Human
acacgguuucauuguguuggccag

SEQ ID NO: 442196 - RNA, 24 nt, Human
acacuaggccgagagcuccacauu

SEQ ID NO: 442197 - RNA, 24 nt, Human
acacuaggccgagagcuccacauu

SEQ ID NO: 442198 - RNA, 23 nt, Human
acagcuggcgugauacuggugcc

SEQ ID NO: 442199 - RNA, 23 nt, Human
acagcuggcgugauacuggugcc

SEQ ID NO: 442200 - RNA, 19 nt, Human
acaguugauccagaaguug

SEQ ID NO: 442201 - RNA, 19 nt, Human
acaguugauccagaaguug

SEQ ID NO: 442202 - RNA, 22 nt, Human
acaugacaugcuuaagaucucc

SEQ ID NO: 442203 - RNA, 23 nt, Human
accaaacgagcuaaugagcaaua

SEQ ID NO: 442204 - RNA, 19 nt, Human
accugccgcugccuucgcc

SEQ ID NO: 442205 - RNA, 18 nt, Human
acgaccccuccugucagg

SEQ ID NO: 442206 - RNA, 22 nt, Human
acgguuucauuguguuggccag

SEQ ID NO: 442207 - RNA, 23 nt, Human
acuggucugaggaaucgugucuu

SEQ ID NO: 442208 - RNA, 23 nt, Human
acuggucugaggaaucgugucuu

SEQ ID NO: 442209 - RNA, 18 nt, Human
acugguucaguugugaca

SEQ ID NO: 442210 - RNA, 18 nt, Human
acugguucaguugugaca

SEQ ID NO: 442211 - RNA, 23 nt, Human
agacaauucccuacuccaggaag

SEQ ID NO: 442212 - RNA, 23 nt, Human
agacaauucccuacuccaggaag

SEQ ID NO: 442213 - RNA, 18 nt, Human
agacaggaagcggugggg

SEQ ID NO: 442214 - RNA, 19 nt, Human
agacaggaagcggugggga

SEQ ID NO: 442215 - RNA, 19 nt, Human
agagaaugacccaccuaca

SEQ ID NO: 442216 - RNA, 26 nt, Human
agagaccaggcaaguaaagugaacaa

SEQ ID NO: 442217 - RNA, 18 nt, Human
agauccccggcccccacu

SEQ ID NO: 442218 - RNA, 23 nt, Human
agauuacaggugugagccaccgc

SEQ ID NO: 442219 - RNA, 19 nt, Human
agcauucuucacggcugca

SEQ ID NO: 442220 - RNA, 19 nt, Human
agcauucuucacggcugca

SEQ ID NO: 442221 - RNA, 27 nt, Human
agccguaggcagguccuguuuugugaa

SEQ ID NO: 442222 - RNA, 27 nt, Human
agccguaggcagguccuguuuugugaa

SEQ ID NO: 442223 - RNA, 19 nt, Human
agcuuguaagugugcucac

SEQ ID NO: 442224 - RNA, 24 nt, Human
aggcacacuccacaggcaagcucc

SEQ ID NO: 442225 - RNA, 18 nt, Human
aggcaggacgaggccagg

SEQ ID NO: 442226 - RNA, 18 nt, Human
aggcaggacgaggccagg

SEQ ID NO: 442227 - RNA, 21 nt, Human
aggcaggacgaggccaggagg

SEQ ID NO: 442228 - RNA, 21 nt, Human
aggcaggacgaggccaggagg

SEQ ID NO: 442229 - RNA, 22 nt, Human
aggcauucacaaacacauuccu

SEQ ID NO: 442230 - RNA, 19 nt, Human
agggaacaugagcggagcu

SEQ ID NO: 442231 - RNA, 23 nt, Human
aggucaggcaggacgaggccagg

SEQ ID NO: 442232 - RNA, 23 nt, Human
aggucaggcaggacgaggccagg

SEQ ID NO: 442233 - RNA, 20 nt, Human
aguacgguggugugaucucg

SEQ ID NO: 442234 - RNA, 24 nt, Human
aguacgguggugugaucucggcuc

SEQ ID NO: 442235 - RNA, 18 nt, Human
aguagcugggacuacagg

SEQ ID NO: 442236 - RNA, 24 nt, Human
aguucuuccuuagaucaagaaagc

SEQ ID NO: 442237 - RNA, 24 nt, Human
aguucuuccuuagaucaagaaagc

SEQ ID NO: 442238 - RNA, 23 nt, Human
auacuggugcccuccauaggcca

SEQ ID NO: 442239 - RNA, 23 nt, Human
auacuggugcccuccauaggcca

SEQ ID NO: 442240 - RNA, 21 nt, Human
aucaacgaccccuccugucag

SEQ ID NO: 442241 - RNA, 19 nt, Human
auccgaacauucguugggg

SEQ ID NO: 442242 - RNA, 18 nt, Human
aucuucagaguccuccuu

SEQ ID NO: 442243 - RNA, 20 nt, Human
augcuuuuuuaggauguucu

SEQ ID NO: 442244 - RNA, 24 nt, Human
auguaucuaucccauaaauauaca

SEQ ID NO: 442245 - RNA, 24 nt, Human
auguaucuaucccauaaauauaca

SEQ ID NO: 442246 - RNA, 19 nt, Human
auucacaaacacauuccuc

SEQ ID NO: 442247 - RNA, 19 nt, Human
caaagacaauucccuacuc

SEQ ID NO: 442248 - RNA, 19 nt, Human
caaagacaauucccuacuc

SEQ ID NO: 442249 - RNA, 24 nt, Human
caaagcguugagauuacaggugug

SEQ ID NO: 442250 - RNA, 20 nt, Human
caagaggcacacuccacagg

SEQ ID NO: 442251 - RNA, 22 nt, Human
caagcaauucuccugccucagc

SEQ ID NO: 442252 - RNA, 26 nt, Human
cacagaaaaaaaaaagucaaugcuuc

SEQ ID NO: 442253 - RNA, 22 nt, Human
cacagauacugcaaagucaggc

SEQ ID NO: 442254 - RNA, 24 nt, Human
cacagcuggcgugauacuggugcc

SEQ ID NO: 442255 - RNA, 18 nt, Human
cacaggauuugggccucu

SEQ ID NO: 442256 - RNA, 22 nt, Human
cacauucaagaggcacacucca

SEQ ID NO: 442257 - RNA, 19 nt, Human
caccaauggaagggagauc

SEQ ID NO: 442258 - RNA, 21 nt, Human
caccuaguccagacccuuccg

SEQ ID NO: 442259 - RNA, 24 nt, Human
cacgguuucauuguguuggccagg

SEQ ID NO: 442260 - RNA, 19 nt, Human
cacuuugcaaccuuuggau

SEQ ID NO: 442261 - RNA, 24 nt, Human
cagaaaaaaaaaagucaaugcuuc

SEQ ID NO: 442262 - RNA, 21 nt, Human
cagaagaggcaaacucaaaug

SEQ ID NO: 442263 - RNA, 27 nt, Human
cagaagaggcaaacucaaaugccuuca

SEQ ID NO: 442264 - RNA, 18 nt, Human
cagaccggaguacggugg

SEQ ID NO: 442265 - RNA, 18 nt, Human
cagaggaguuguucagag

SEQ ID NO: 442266 - RNA, 18 nt, Human
cagaggaguuguucagag

SEQ ID NO: 442267 - RNA, 20 nt, Human
cagcccacgacccucuucuu

SEQ ID NO: 442268 - RNA, 20 nt, Human
cagccuccugaguagcuggg

SEQ ID NO: 442269 - RNA, 18 nt, Human
cagcuggcgugauacugg

SEQ ID NO: 442270 - RNA, 20 nt, Human
cagcuggcgugauacuggug

SEQ ID NO: 442271 - RNA, 18 nt, Human
caggaggaugcuggccac

SEQ ID NO: 442272 - RNA, 19 nt, Human
cagggaacaugagcggagc

SEQ ID NO: 442273 - RNA, 21 nt, Human
caugccuggcuaauuuuugua

SEQ ID NO: 442274 - RNA, 19 nt, Human
cauuguguuggccaggcug

SEQ ID NO: 442275 - RNA, 24 nt, Human
cauuguguuggccaggcuggucuc

SEQ ID NO: 442276 - RNA, 23 nt, Human
ccaaagagcuaucagacaugaca

SEQ ID NO: 442277 - RNA, 23 nt, Human
ccaaagcguugagauuacaggug

SEQ ID NO: 442278 - RNA, 24 nt, Human
ccaaagcguugagauuacaggugu

SEQ ID NO: 442279 - RNA, 19 nt, Human
ccaaguggguaaaaucugc

SEQ ID NO: 442280 - RNA, 19 nt, Human
ccaggcaaguaaagugaac

SEQ ID NO: 442281 - RNA, 22 nt, Human
ccauaggccagcuugaaacugu

SEQ ID NO: 442282 - RNA, 22 nt, Human
ccauaggccagcuugaaacugu

SEQ ID NO: 442283 - RNA, 26 nt, Human
ccgccuccuggguucaagcaauucuu

SEQ ID NO: 442284 - RNA, 19 nt, Human
ccuccgccuccuggguuca

SEQ ID NO: 442285 - RNA, 24 nt, Human
ccuccuggguucaagcaauucucc

SEQ ID NO: 442286 - RNA, 23 nt, Human
ccugaguagcugggacuacaggu

SEQ ID NO: 442287 - RNA, 24 nt, Human
ccugaguagcugggacuacaggug

SEQ ID NO: 442288 - RNA, 21 nt, Human
ccugcagcaggaggaugcugg

SEQ ID NO: 442289 - RNA, 23 nt, Human
ccugccucagccuccugaguagc

SEQ ID NO: 442290 - RNA, 24 nt, Human
ccugccucagccuccugaguagcu

SEQ ID NO: 442291 - RNA, 22 nt, Human
ccugccugcuacuguccagggg

SEQ ID NO: 442292 - RNA, 22 nt, Human
ccugccugcuacuguccagggg

SEQ ID NO: 442293 - RNA, 23 nt, Human
ccuggguucaagcaauucuccug

SEQ ID NO: 442294 - RNA, 22 nt, Human
cgacacaguugauccagaaguu

SEQ ID NO: 442295 - RNA, 22 nt, Human
cgacacaguugauccagaaguu

SEQ ID NO: 442296 - RNA, 21 nt, Human
cgcugagacaggaagcggugg

SEQ ID NO: 442297 - RNA, 24 nt, Human
cggaguacgguggugugaucucgg

SEQ ID NO: 442298 - RNA, 24 nt, Human
cggcagaacagguuugcagcgaag

SEQ ID NO: 442299 - RNA, 24 nt, Human
cggcagaacagguuugcagcgaag

SEQ ID NO: 442300 - RNA, 22 nt, Human
cggcugcagagugcccaggcau

SEQ ID NO: 442301 - RNA, 22 nt, Human
cggcugcagagugcccaggcau

SEQ ID NO: 442302 - RNA, 26 nt, Human
cuaacaucucaguggaaaaaaaccac

SEQ ID NO: 442303 - RNA, 21 nt, Human
cucaaguuaucugccugccuc

SEQ ID NO: 442304 - RNA, 24 nt, Human
cucagccuccugaguagcugggac

SEQ ID NO: 442305 - RNA, 19 nt, Human
cuccaaagcuggagaagga

SEQ ID NO: 442306 - RNA, 21 nt, Human
cuccuggguucaagcaauucu

SEQ ID NO: 442307 - RNA, 19 nt, Human
cucuuuuuauucauuucag

SEQ ID NO: 442308 - RNA, 19 nt, Human
cucuuuuuauucauuucag

SEQ ID NO: 442309 - RNA, 23 nt, Human
cugaaguccugcagacuggccgu

SEQ ID NO: 442310 - RNA, 23 nt, Human
cugaaguccugcagacuggccgu

SEQ ID NO: 442311 - RNA, 20 nt, Human
cugcagcagcaaguucuucc

SEQ ID NO: 442312 - RNA, 20 nt, Human
cugcagcagcaaguucuucc

SEQ ID NO: 442313 - RNA, 23 nt, Human
cugcaguggcuuuuauccccagc

SEQ ID NO: 442314 - RNA, 20 nt, Human
cugccaccaauggaagggag

SEQ ID NO: 442315 - RNA, 20 nt, Human
cuggccuuuuaacacagcac

SEQ ID NO: 442316 - RNA, 21 nt, Human
cuggcuccaagcagucgccca

SEQ ID NO: 442317 - RNA, 21 nt, Human
cuggcuccaagcagucgccca

SEQ ID NO: 442318 - RNA, 24 nt, Human
cuuagaucaagaaagccgacagcg

SEQ ID NO: 442319 - RNA, 24 nt, Human
cuuagaucaagaaagccgacagcg

SEQ ID NO: 442320 - RNA, 23 nt, Human
cuucacaggacaguaaguguccu

SEQ ID NO: 442321 - RNA, 23 nt, Human
cuucacaggacaguaaguguccu

SEQ ID NO: 442322 - RNA, 23 nt, Human
cuuuacacuaggccgagagcucc

SEQ ID NO: 442323 - RNA, 23 nt, Human
cuuuacacuaggccgagagcucc

SEQ ID NO: 442324 - RNA, 18 nt, Human
gaaaaguuggaaauccag

SEQ ID NO: 442325 - RNA, 18 nt, Human
gaacaucuaacaucucag

SEQ ID NO: 442326 - RNA, 22 nt, Human
gaacuacuacugauuccauuua

SEQ ID NO: 442327 - RNA, 21 nt, Human
gaagagcaucuucacuuacaa

SEQ ID NO: 442328 - RNA, 25 nt, Human
gacagauucuugcucugucgcucag

SEQ ID NO: 442329 - RNA, 20 nt, Human
gaccugccgcugccuucgcc

SEQ ID NO: 442330 - RNA, 21 nt, Human
gacuacaggugcacaccauca

SEQ ID NO: 442331 - RNA, 19 nt, Human
gagagagagaaugacccac

SEQ ID NO: 442332 - RNA, 20 nt, Human
gagagugcaucuucagaguc

SEQ ID NO: 442333 - RNA, 21 nt, Human
gagaugucauggugauguuuu

SEQ ID NO: 442334 - RNA, 21 nt, Human
gagaugucauggugauguuuu

SEQ ID NO: 442335 - RNA, 26 nt, Human
gaguagcugggacuacaggugcacac

SEQ ID NO: 442336 - RNA, 19 nt, Human
gaguuguguggcuuuucca

SEQ ID NO: 442337 - RNA, 19 nt, Human
gaucuccucccacaucagc

SEQ ID NO: 442338 - RNA, 22 nt, Human
gaugaaauagagcuauuacuga

SEQ ID NO: 442339 - RNA, 18 nt, Human
gauuacaggugugagcca

SEQ ID NO: 442340 - RNA, 20 nt, Human
gauuacaggugugagccacc

SEQ ID NO: 442341 - RNA, 20 nt, Human
gauuuguaaccgaguuccuu

SEQ ID NO: 442342 - RNA, 22 nt, Human
gcaaccuccgccuccuggguuc

SEQ ID NO: 442343 - RNA, 22 nt, Human
gcagaaucuucuccauaaaaag

SEQ ID NO: 442344 - RNA, 22 nt, Human
gcagaaucuucuccauaaaaag

SEQ ID NO: 442345 - RNA, 18 nt, Human
gcagagucuucuuuggug

SEQ ID NO: 442346 - RNA, 19 nt, Human
gccgcugccuucgccgccg

SEQ ID NO: 442347 - RNA, 21 nt, Human
gcuuccaaaagcagcauauuu

SEQ ID NO: 442348 - RNA, 21 nt, Human
gcuucucuucuuuccggcucc

SEQ ID NO: 442349 - RNA, 24 nt, Human
ggacuacaggugcacaccaucaug

SEQ ID NO: 442350 - RNA, 23 nt, Human
ggagaugggcagaaucuucucca

SEQ ID NO: 442351 - RNA, 23 nt, Human
ggagaugggcagaaucuucucca

SEQ ID NO: 442352 - RNA, 21 nt, Human
ggcauucacaaacacauuccu

SEQ ID NO: 442353 - RNA, 26 nt, Human
ggccacuaacuguugguaaauccaaa

SEQ ID NO: 442354 - RNA, 24 nt, Human
ggcuggucucgaacuccugaucuc

SEQ ID NO: 442355 - RNA, 23 nt, Human
gggaaaucuuuauuauagcuauc

SEQ ID NO: 442356 - RNA, 22 nt, Human
ggucuuuguacuugucucggau

SEQ ID NO: 442357 - RNA, 19 nt, Human
ggugcucuucggcuccagc

SEQ ID NO: 442358 - RNA, 21 nt, Human
gguuucauuguguuggccagg

SEQ ID NO: 442359 - RNA, 24 nt, Human
gucccgcaacgguaaucuauuuuu

SEQ ID NO: 442360 - RNA, 24 nt, Human
gucccgcaacgguaaucuauuuuu

SEQ ID NO: 442361 - RNA, 21 nt, Human
gucucuguuuucauauuccuu

SEQ ID NO: 442362 - RNA, 21 nt, Human
gucucuguuuucauauuccuu

SEQ ID NO: 442363 - RNA, 22 nt, Human
gugagccaccgcgcccagccca

SEQ ID NO: 442364 - RNA, 19 nt, Human
gugcaaccuccgccuccug

SEQ ID NO: 442365 - RNA, 19 nt, Human
gugccacgugcaguuuggg

SEQ ID NO: 442366 - RNA, 19 nt, Human
guggacagaagugaaggga

SEQ ID NO: 442367 - RNA, 25 nt, Human
guggggugucacagaaaaaaaaaag

SEQ ID NO: 442368 - RNA, 25 nt, Human
uaaagugaacaacuuaaguaggucc

SEQ ID NO: 442369 - RNA, 19 nt, Human
uaacaucucaguggaaaaa

SEQ ID NO: 442370 - RNA, 22 nt, Human
uaauuuuuguauuuuuaguaga

SEQ ID NO: 442371 - RNA, 24 nt, Human
uacaggugugagccaccgcgccca

SEQ ID NO: 442372 - RNA, 21 nt, Human
uacccuguacacuucaacaac

SEQ ID NO: 442373 - RNA, 19 nt, Human
uacuguagcuuccaaaagc

SEQ ID NO: 442374 - RNA, 21 nt, Human
uacuucacaggacaguaagug

SEQ ID NO: 442375 - RNA, 21 nt, Human
uacuucacaggacaguaagug

SEQ ID NO: 442376 - RNA, 19 nt, Human
uacuuuggagagagauguc

SEQ ID NO: 442377 - RNA, 19 nt, Human
uacuuuggagagagauguc

SEQ ID NO: 442378 - RNA, 22 nt, Human
uagagaacugguucaguuguga

SEQ ID NO: 442379 - RNA, 22 nt, Human
uagagaacugguucaguuguga

SEQ ID NO: 442380 - RNA, 23 nt, Human
uagcuuccaaaagcagcauauuu

SEQ ID NO: 442381 - RNA, 19 nt, Human
uagcuuguaagugugcuca

SEQ ID NO: 442382 - RNA, 18 nt, Human
uauuacugaaagccauaa

SEQ ID NO: 442383 - RNA, 24 nt, Human
uauuggucccugucaccccguggg

SEQ ID NO: 442384 - RNA, 24 nt, Human
uauuggucccugucaccccguggg

SEQ ID NO: 442385 - RNA, 19 nt, Human
ucaacaccuaguccagacc

SEQ ID NO: 442386 - RNA, 19 nt, Human
ucaagcaauucuccugccu

SEQ ID NO: 442387 - RNA, 19 nt, Human
ucaauccaguugaaaucaa

SEQ ID NO: 442388 - RNA, 23 nt, Human
ucacaguuucaauacugcagcag

SEQ ID NO: 442389 - RNA, 23 nt, Human
ucacaguuucaauacugcagcag

SEQ ID NO: 442390 - RNA, 18 nt, Human
ucacugcacacugcagug

SEQ ID NO: 442391 - RNA, 22 nt, Human
ucacuggucugaggaaucgugu

SEQ ID NO: 442392 - RNA, 22 nt, Human
ucacuggucugaggaaucgugu

SEQ ID NO: 442393 - RNA, 21 nt, Human
ucagacauuaacaaacuaaau

SEQ ID NO: 442394 - RNA, 21 nt, Human
ucagacauuaacaaacuaaau

SEQ ID NO: 442395 - RNA, 21 nt, Human
ucagaccggaguacgguggug

SEQ ID NO: 442396 - RNA, 19 nt, Human
ucagagcaggucaggcagg

SEQ ID NO: 442397 - RNA, 19 nt, Human
ucagagcaggucaggcagg

SEQ ID NO: 442398 - RNA, 20 nt, Human
ucagaguccuccuugccaac

SEQ ID NO: 442399 - RNA, 21 nt, Human
ucagcaaaaucaucaucacuu

SEQ ID NO: 442400 - RNA, 23 nt, Human
ucagccuccugaguagcugggac

SEQ ID NO: 442401 - RNA, 21 nt, Human
ucagggaagcgaacugugcag

SEQ ID NO: 442402 - RNA, 21 nt, Human
ucagggaagcgaacugugcag

SEQ ID NO: 442403 - RNA, 18 nt, Human
ucaggucuuuguacuugu

SEQ ID NO: 442404 - RNA, 18 nt, Human
ucagugcaaccuccgccu

SEQ ID NO: 442405 - RNA, 24 nt, Human
ucagugcaaccuccgccuccuggg

SEQ ID NO: 442406 - RNA, 27 nt, Human
ucagugcaaccuccgccuccuggguuc

SEQ ID NO: 442407 - RNA, 21 nt, Human
ucaguugugacaaccaagugg

SEQ ID NO: 442408 - RNA, 21 nt, Human
ucaguugugacaaccaagugg

SEQ ID NO: 442409 - RNA, 25 nt, Human
ucauaugcauaucucucauuuuucu

SEQ ID NO: 442410 - RNA, 18 nt, Human
ucauuccacugccuuucc

SEQ ID NO: 442411 - RNA, 18 nt, Human
ucauuccacugccuuucc

SEQ ID NO: 442412 - RNA, 22 nt, Human
ucauuguguuggccaggcuggu

SEQ ID NO: 442413 - RNA, 21 nt, Human
uccaaaagcagcauauuuuaa

SEQ ID NO: 442414 - RNA, 24 nt, Human
uccaaagagcuaucagacaugaca

SEQ ID NO: 442415 - RNA, 19 nt, Human
uccacacgcuugguuaccc

SEQ ID NO: 442416 - RNA, 24 nt, Human
uccacacuuuaucgauguccuuca

SEQ ID NO: 442417 - RNA, 20 nt, Human
ucccaaagcguugagauuac

SEQ ID NO: 442418 - RNA, 23 nt, Human
ucccaaagcguugagauuacagg

SEQ ID NO: 442419 - RNA, 23 nt, Human
ucccugucaccccgugggguguc

SEQ ID NO: 442420 - RNA, 23 nt, Human
ucccugucaccccgugggguguc

SEQ ID NO: 442421 - RNA, 24 nt, Human
uccgccuccuggguucaagcaauu

SEQ ID NO: 442422 - RNA, 24 nt, Human
uccugaguagcugggacuacaggu

SEQ ID NO: 442423 - RNA, 21 nt, Human
uccuggguucaagcaauucuc

SEQ ID NO: 442424 - RNA, 24 nt, Human
uccuggguucaagcaauucuccug

SEQ ID NO: 442425 - RNA, 24 nt, Human
uccuugaacagaaaggucggugcc

SEQ ID NO: 442426 - RNA, 25 nt, Human
ucgaauccauuuaucuggccuuuua

SEQ ID NO: 442427 - RNA, 24 nt, Human
ucuccugccucagccuccugagua

SEQ ID NO: 442428 - RNA, 21 nt, Human
ucucgaacuccugaucucaag

SEQ ID NO: 442429 - RNA, 23 nt, Human
ucucugaucuaucacaagucuuc

SEQ ID NO: 442430 - RNA, 19 nt, Human
ucugaaaggcugcuccaaa

SEQ ID NO: 442431 - RNA, 18 nt, Human
ucugaccagucauagcuu

SEQ ID NO: 442432 - RNA, 18 nt, Human
ucugaccagucauagcuu

SEQ ID NO: 442433 - RNA, 21 nt, Human
ucugaguugaaugcccggcuc

SEQ ID NO: 442434 - RNA, 20 nt, Human
ucugccugccuccccuccca

SEQ ID NO: 442435 - RNA, 21 nt, Human
ucuggugugaguguggcgagu

SEQ ID NO: 442436 - RNA, 18 nt, Human
ucuucagaugcuuauguc

SEQ ID NO: 442437 - RNA, 24 nt, Human
ucuuccauaaugcccagugcagaa

SEQ ID NO: 442438 - RNA, 21 nt, Human
ucuugauacuuuacacuaggc

SEQ ID NO: 442439 - RNA, 21 nt, Human
ucuugauacuuuacacuaggc

SEQ ID NO: 442440 - RNA, 18 nt, Human
ucuugcucugucgcucag

SEQ ID NO: 442441 - RNA, 18 nt, Human
ucuugcucugucgcucag

SEQ ID NO: 442442 - RNA, 19 nt, Human
ucuugcucugucgcucaga

SEQ ID NO: 442443 - RNA, 20 nt, Human
ucuugcucugucgcucagac

SEQ ID NO: 442444 - RNA, 24 nt, Human
ucuugcucugucgcucagaccgga

SEQ ID NO: 442445 - RNA, 18 nt, Human
ucuugucugagaaaacuc

SEQ ID NO: 442446 - RNA, 18 nt, Human
ucuugucugagaaaacuc

SEQ ID NO: 442447 - RNA, 23 nt, Human
ucuuuggaaauuuggagagaggc

SEQ ID NO: 442448 - RNA, 23 nt, Human
ucuuuggaaauuuggagagaggc

SEQ ID NO: 442449 - RNA, 21 nt, Human
ucuuuggugugucugaaagcc

SEQ ID NO: 442450 - RNA, 21 nt, Human
ugaaagccauaaaaucugcaa

SEQ ID NO: 442451 - RNA, 23 nt, Human
ugaaauagagcuauuacugaaag

SEQ ID NO: 442452 - RNA, 18 nt, Human
ugaagggaaggaguagag

SEQ ID NO: 442453 - RNA, 18 nt, Human
ugaagggaaggaguagag

SEQ ID NO: 442454 - RNA, 18 nt, Human
ugaauuacuucugugcaa

SEQ ID NO: 442455 - RNA, 18 nt, Human
ugacccugauuucaaaga

SEQ ID NO: 442456 - RNA, 18 nt, Human
ugagacaggaagcggugg

SEQ ID NO: 442457 - RNA, 25 nt, Human
ugagauuaaagcagaagaggcaaac

SEQ ID NO: 442458 - RNA, 19 nt, Human
ugagauuacaggugugagc

SEQ ID NO: 442459 - RNA, 21 nt, Human
ugagauuacaggugugagcca

SEQ ID NO: 442460 - RNA, 22 nt, Human
ugagauuacaggugugagccac

SEQ ID NO: 442461 - RNA, 23 nt, Human
ugagauuacaggugugagccacc

SEQ ID NO: 442462 - RNA, 24 nt, Human
ugagauuacaggugugagccaccg

SEQ ID NO: 442463 - RNA, 22 nt, Human
ugagggggauccacuuccugcu

SEQ ID NO: 442464 - RNA, 21 nt, Human
ugaguguggcgagugacauga

SEQ ID NO: 442465 - RNA, 20 nt, Human
ugaguugaaugcccggcucc

SEQ ID NO: 442466 - RNA, 22 nt, Human
ugaguugaaugcccggcuccuc

SEQ ID NO: 442467 - RNA, 21 nt, Human
ugcaaacagaacuacuacuga

SEQ ID NO: 442468 - RNA, 20 nt, Human
ugcaaccuccgccuccuggg

SEQ ID NO: 442469 - RNA, 19 nt, Human
ugcagagucuucuuuggug

SEQ ID NO: 442470 - RNA, 21 nt, Human
ugcagagucuucuuuggugug

SEQ ID NO: 442471 - RNA, 26 nt, Human
ugcauaucucucauuuuucuccaccu

SEQ ID NO: 442472 - RNA, 18 nt, Human
ugcaugcggcagaacagg

SEQ ID NO: 442473 - RNA, 18 nt, Human
ugcaugcggcagaacagg

SEQ ID NO: 442474 - RNA, 19 nt, Human
ugccacgugcaguuugggu

SEQ ID NO: 442475 - RNA, 19 nt, Human
ugccacgugcaguuugggu

SEQ ID NO: 442476 - RNA, 24 nt, Human
ugccucagccuccugaguagcugg

SEQ ID NO: 442477 - RNA, 23 nt, Human
ugccuucgccgccgccaccuuau

SEQ ID NO: 442478 - RNA, 19 nt, Human
ugcucugucgcucagaccg

SEQ ID NO: 442479 - RNA, 22 nt, Human
ugcugccaccaauggaagggag

SEQ ID NO: 442480 - RNA, 21 nt, Human
ugcuucacagaggaguuguuc

SEQ ID NO: 442481 - RNA, 21 nt, Human
ugcuucacagaggaguuguuc

SEQ ID NO: 442482 - RNA, 24 nt, Human
ugcuucacagaggaguuguucaga

SEQ ID NO: 442483 - RNA, 24 nt, Human
ugcuucacagaggaguuguucaga

SEQ ID NO: 442484 - RNA, 22 nt, Human
uggcaagagcugggaagguggu

SEQ ID NO: 442485 - RNA, 22 nt, Human
uggcaagagcugggaagguggu

SEQ ID NO: 442486 - RNA, 24 nt, Human
uggccaggcuggucucgaacuccu

SEQ ID NO: 442487 - RNA, 20 nt, Human
ugggaagguggucucuggaa

SEQ ID NO: 442488 - RNA, 20 nt, Human
ugggaagguggucucuggaa

SEQ ID NO: 442489 - RNA, 21 nt, Human
ugggacuacaggugcacacca

SEQ ID NO: 442490 - RNA, 22 nt, Human
ugggacuacaggugcacaccau

SEQ ID NO: 442491 - RNA, 24 nt, Human
ugggacuacaggugcacaccauca

SEQ ID NO: 442492 - RNA, 18 nt, Human
uggggugucacagaaaaa

SEQ ID NO: 442493 - RNA, 23 nt, Human
uggggugucacagaaaaaaaaaa

SEQ ID NO: 442494 - RNA, 24 nt, Human
uggggugucacagaaaaaaaaaag

SEQ ID NO: 442495 - RNA, 24 nt, Human
uggggugucacagaaaaaaaaaag

SEQ ID NO: 442496 - RNA, 22 nt, Human
ugggucaaugugauaugcaggc

SEQ ID NO: 442497 - RNA, 21 nt, Human
uggguucaagcaauucuccug

SEQ ID NO: 442498 - RNA, 23 nt, Human
uggguucaagcaauucuccugcc

SEQ ID NO: 442499 - RNA, 18 nt, Human
ugguccauggagaagaug

SEQ ID NO: 442500 - RNA, 21 nt, Human
uggugccacgugcaguuuggg

SEQ ID NO: 442501 - RNA, 21 nt, Human
uguaagugugcucacugcaaa

SEQ ID NO: 442502 - RNA, 24 nt, Human
uguaagugugcucacugcaaaauu

SEQ ID NO: 442503 - RNA, 23 nt, Human
ugucaguucuucacaguuucaau

SEQ ID NO: 442504 - RNA, 24 nt, Human
ugucgcucagaccggaguacggug

SEQ ID NO: 442505 - RNA, 20 nt, Human
ugucucggaugacgggcagg

SEQ ID NO: 442506 - RNA, 23 nt, Human
ugucuuuaaaacuggcaagagcu

SEQ ID NO: 442507 - RNA, 23 nt, Human
ugucuuuaaaacuggcaagagcu

SEQ ID NO: 442508 - RNA, 24 nt, Human
uguguuggccaggcuggucucgaa

SEQ ID NO: 442509 - RNA, 19 nt, Human
uguuggccaggcuggucuc

SEQ ID NO: 442510 - RNA, 20 nt, Human
uguuggccaggcuggucucg

SEQ ID NO: 442511 - RNA, 24 nt, Human
uuaaaagacauuaucugugcucag

SEQ ID NO: 442512 - RNA, 26 nt, Human
uuaaauacuggcaauuacuucguacu

SEQ ID NO: 442513 - RNA, 22 nt, Human
uuaagaacaucuaacaucucag

SEQ ID NO: 442514 - RNA, 20 nt, Human
uuagaggaacaggacuggcu

SEQ ID NO: 442515 - RNA, 20 nt, Human
uuaguagauacacgguuuca

SEQ ID NO: 442516 - RNA, 24 nt, Human
uuaguagauacacgguuucauugu

SEQ ID NO: 442517 - RNA, 21 nt, Human
uucaagcaauucuccugccuc

SEQ ID NO: 442518 - RNA, 24 nt, Human
uucaagcaauucuccugccucagc

SEQ ID NO: 442519 - RNA, 21 nt, Human
uucacagaggaguuguucaga

SEQ ID NO: 442520 - RNA, 21 nt, Human
uucacagaggaguuguucaga

SEQ ID NO: 442521 - RNA, 19 nt, Human
uucacaggacaguaagugu

SEQ ID NO: 442522 - RNA, 19 nt, Human
uucacaggacaguaagugu

SEQ ID NO: 442523 - RNA, 21 nt, Human
uucauaugcauaucucucauu

SEQ ID NO: 442524 - RNA, 18 nt, Human
uuccagagaaaguugucu

SEQ ID NO: 442525 - RNA, 24 nt, Human
uuccggcuccucgaguccacauuc

SEQ ID NO: 442526 - RNA, 23 nt, Human
uuccuuuugcucacuggucugag

SEQ ID NO: 442527 - RNA, 23 nt, Human
uuccuuuugcucacuggucugag

SEQ ID NO: 442528 - RNA, 19 nt, Human
uucuucugcaggcuucucu

SEQ ID NO: 442529 - RNA, 18 nt, Human
uugaaugcccggcuccuc

SEQ ID NO: 442530 - RNA, 18 nt, Human
uugcucacuggucugagg

SEQ ID NO: 442531 - RNA, 18 nt, Human
uugcucacuggucugagg

SEQ ID NO: 442532 - RNA, 19 nt, Human
uugcucacuggucugaggg

SEQ ID NO: 442533 - RNA, 19 nt, Human
uugcucacuggucugaggg

SEQ ID NO: 442534 - RNA, 24 nt, Human
uuucauuguguuggccaggcuggu

SEQ ID NO: 442535 - RNA, 23 nt, Human
uuucauuuugcuuugugaagugg

SEQ ID NO: 442536 - RNA, 23 nt, Human
uuucauuuugcuuugugaagugg

SEQ ID NO: 442537 - RNA, 19 nt, Human
uuuccugcgaaaccagaga

SEQ ID NO: 442538 - RNA, 18 nt, Human
uuucugggaagcuacaug

SEQ ID NO: 442539 - RNA, 18 nt, Human
uuugcugauuuugggcuu

SEQ ID NO: 442540 - RNA, 22 nt, Human
uuuggagagaggccacugcaaa

SEQ ID NO: 442541 - RNA, 22 nt, Human
uuuggagagaggccacugcaaa

SEQ ID NO: 442542 - RNA, 23 nt, Human
uuugugaaaucuuuauagucucu

SEQ ID NO: 442543 - RNA, 23 nt, Human
uuugugaaaucuuuauagucucu

SEQ ID NO: 442544 - RNA, 21 nt, Human
uuuuaggauguucuucugcag

SEQ ID NO: 442545 - RNA, 23 nt, Human
uuuucagguuuuucucacagaua

SEQ ID NO: 442546 - RNA, 23 nt, Human
uuuucagguuuuucucacagaua

SEQ ID NO: 442547 - RNA, 18 nt, Human
uuuuguauuuuuaguaga

SEQ ID NO: 442548 - RNA, 24 nt, Human
uuuuuaguagauacacgguuucau

SEQ ID NO: 442549 - RNA, 18 nt, Human
uuuuuguauuuuuaguag

SEQ ID NO: 442550 - RNA, 18 nt, Human
uuuuuuuuuuuuuuuuug

SEQ ID NO: 442551 - RNA, 20 nt, Human
aaacugccaaguccaggacc

SEQ ID NO: 442552 - RNA, 24 nt, Human
aagaaggcacucgcgagggggacu

SEQ ID NO: 442553 - RNA, 20 nt, Human
aagcagagaguuucucuccc

SEQ ID NO: 442554 - RNA, 19 nt, Human
aagggcgagggaagcagag

SEQ ID NO: 442555 - RNA, 22 nt, Human
acacagcccgcaccugcccucc

SEQ ID NO: 442556 - RNA, 18 nt, Human
agaaggcacucgcgaggg

SEQ ID NO: 442557 - RNA, 21 nt, Human
agcaagaaacugccaagucca

SEQ ID NO: 442558 - RNA, 19 nt, Human
aggaagaggugaggaaggg

SEQ ID NO: 442559 - RNA, 28 nt, Human
aggaagccccguguucaaggugaccuca

SEQ ID NO: 442560 - RNA, 21 nt, Human
aggcacucgcgagggggacuu

SEQ ID NO: 442561 - RNA, 24 nt, Human
agggggauggggaaagcuccaagg

SEQ ID NO: 442562 - RNA, 25 nt, Human
agggggauggggaaagcuccaaggg

SEQ ID NO: 442563 - RNA, 18 nt, Human
cacacagacacacacagc

SEQ ID NO: 442564 - RNA, 25 nt, Human
cacacagacacacacagcccgcacc

SEQ ID NO: 442565 - RNA, 24 nt, Human
cacacagcccgcaccugcccuccc

SEQ ID NO: 442566 - RNA, 22 nt, Human
cacagcccgcaccugcccuccc

SEQ ID NO: 442567 - RNA, 26 nt, Human
cagcccgcaccugcccucccucuaaa

SEQ ID NO: 442568 - RNA, 23 nt, Human
cauauaaaaucagggggaugggg

SEQ ID NO: 442569 - RNA, 23 nt, Human
ccucuaaaaucugcauccggggg

SEQ ID NO: 442570 - RNA, 24 nt, Human
ccugcccucccucuaaaaucugca

SEQ ID NO: 442571 - RNA, 19 nt, Human
cgcaacacccgcuaaggca

SEQ ID NO: 442572 - RNA, 21 nt, Human
cgcaacacccgcuaaggcagg

SEQ ID NO: 442573 - RNA, 18 nt, Human
gaagaggugaggaagggg

SEQ ID NO: 442574 - RNA, 18 nt, Human
gaggaaggggcgggugcu

SEQ ID NO: 442575 - RNA, 21 nt, Human
gaggugaggaaggggcgggug

SEQ ID NO: 442576 - RNA, 24 nt, Human
gcaccugcccucccucuaaaaucu

SEQ ID NO: 442577 - RNA, 23 nt, Human
gcgauggcggcgccgcuuccuuc

SEQ ID NO: 442578 - RNA, 22 nt, Human
gcugggagcaagaaacugccaa

SEQ ID NO: 442579 - RNA, 23 nt, Human
uccaggaccugcccucacacaga

SEQ ID NO: 442580 - RNA, 18 nt, Human
uccuaaaauucagaggag

SEQ ID NO: 442581 - RNA, 24 nt, Human
ucgcgagggggacuucaagccccu

SEQ ID NO: 442582 - RNA, 31 nt, Human
ugggcucagcggcugugaaggagggaccccc

SEQ ID NO: 442583 - RNA, 28 nt, Human
aaaaaaaaaaaagguauguaauuuccaa

SEQ ID NO: 442584 - RNA, 23 nt, Human
aaaacaguaauacugacaagaca

SEQ ID NO: 442585 - RNA, 19 nt, Human
aaagcuuaauccagcccag

SEQ ID NO: 442586 - RNA, 21 nt, Human
aaauucuuccuucagcagcuc

SEQ ID NO: 442587 - RNA, 22 nt, Human
acaauccuguuucucaucccag

SEQ ID NO: 442588 - RNA, 20 nt, Human
accacaaaaaauucaucuca

SEQ ID NO: 442589 - RNA, 23 nt, Human
agaaauucuuccuucagcagcuc

SEQ ID NO: 442590 - RNA, 21 nt, Human
agcauuuauugauugaaaaua

SEQ ID NO: 442591 - RNA, 21 nt, Human
agcggcaccggaggcagcgcg

SEQ ID NO: 442592 - RNA, 23 nt, Human
agggaggagccggggcugcggcg

SEQ ID NO: 442593 - RNA, 20 nt, Human
aguaauacugacaagacauc

SEQ ID NO: 442594 - RNA, 25 nt, Human
aguuuccauucauuugauaugugac

SEQ ID NO: 442595 - RNA, 24 nt, Human
auaagacagugcucacguggccug

SEQ ID NO: 442596 - RNA, 19 nt, Human
augaagacauguuuagaua

SEQ ID NO: 442597 - RNA, 22 nt, Human
augaagggagugaccaucuaca

SEQ ID NO: 442598 - RNA, 23 nt, Human
cagaccccgccccgggggccgga

SEQ ID NO: 442599 - RNA, 18 nt, Human
cagauuaagagaaacuga

SEQ ID NO: 442600 - RNA, 23 nt, Human
cagcacuucuaaguggagggaag

SEQ ID NO: 442601 - RNA, 19 nt, Human
cagcauuuauugauugaaa

SEQ ID NO: 442602 - RNA, 22 nt, Human
caguguuuguacguugaacguu

SEQ ID NO: 442603 - RNA, 23 nt, Human
cauagcuuuaaaaaauauagagc

SEQ ID NO: 442604 - RNA, 19 nt, Human
cauucgugcuuuaaacaau

SEQ ID NO: 442605 - RNA, 21 nt, Human
cauucucacuuuauuuugggg

SEQ ID NO: 442606 - RNA, 20 nt, Human
ccccgggggccggacgaggg

SEQ ID NO: 442607 - RNA, 23 nt, Human
ccggcggcggcggcggcggcgaa

SEQ ID NO: 442608 - RNA, 19 nt, Human
ccuuaucacuuaauuaacu

SEQ ID NO: 442609 - RNA, 20 nt, Human
ccuuuaaaaaaaaaaaaaaa

SEQ ID NO: 442610 - RNA, 23 nt, Human
cggcggcggcggcggcggcgaag

SEQ ID NO: 442611 - RNA, 21 nt, Human
cggcucagcggucgccagcgg

SEQ ID NO: 442612 - RNA, 21 nt, Human
cggggcugcggcgagcugagg

SEQ ID NO: 442613 - RNA, 23 nt, Human
cggggcugcggcgagcugagggg

SEQ ID NO: 442614 - RNA, 19 nt, Human
cugcaccauucuaauucau

SEQ ID NO: 442615 - RNA, 24 nt, Human
cugcauaguuugacaaacuuuugg

SEQ ID NO: 442616 - RNA, 19 nt, Human
gaagagaagccguggugcu

SEQ ID NO: 442617 - RNA, 32 nt, Human
gagcuuggccggcggcggcggcggcggcgacg

SEQ ID NO: 442618 - RNA, 20 nt, Human
gaggaagagaagccguggug

SEQ ID NO: 442619 - RNA, 21 nt, Human
gcuguggggaggacacccggc

SEQ ID NO: 442620 - RNA, 19 nt, Human
ggagcuuggccggcggcgg

SEQ ID NO: 442621 - RNA, 24 nt, Human
ggcaggcuuaggcggagaggggag

SEQ ID NO: 442622 - RNA, 20 nt, Human
ggccgcgggcgcggcggagc

SEQ ID NO: 442623 - RNA, 21 nt, Human
ggccggcggcggcggcggcgg

SEQ ID NO: 442624 - RNA, 18 nt, Human
ggcgcggcggagcuuggc

SEQ ID NO: 442625 - RNA, 21 nt, Human
ggcggccgcgggccgcgggcg

SEQ ID NO: 442626 - RNA, 20 nt, Human
ggcggcggcggcgaagggga

SEQ ID NO: 442627 - RNA, 24 nt, Human
ggcggcggcggcgaaggggaagcc

SEQ ID NO: 442628 - RNA, 19 nt, Human
ggcuuaggcggagagggga

SEQ ID NO: 442629 - RNA, 19 nt, Human
gggccggacgagggaggag

SEQ ID NO: 442630 - RNA, 18 nt, Human
gggcgcggcggagcuugg

SEQ ID NO: 442631 - RNA, 19 nt, Human
gggcgcggcggagcuuggc

SEQ ID NO: 442632 - RNA, 26 nt, Human
guggugcuguggggaggacacccggc

SEQ ID NO: 442633 - RNA, 24 nt, Human
uaaaguucccuuuuaaaaaaaaau

SEQ ID NO: 442634 - RNA, 31 nt, Human
uaacuaggcagugccauggaaagaaaggaaa

SEQ ID NO: 442635 - RNA, 19 nt, Human
uaagagaaacugaccuuua

SEQ ID NO: 442636 - RNA, 22 nt, Human
uaagugaaaauauaaaccauga

SEQ ID NO: 442637 - RNA, 23 nt, Human
uaagugaaaauauaaaccaugaa

SEQ ID NO: 442638 - RNA, 25 nt, Human
uaagugaaaauauaaaccaugaaga

SEQ ID NO: 442639 - RNA, 25 nt, Human
uagcaaaacaguaauacugacaaga

SEQ ID NO: 442640 - RNA, 22 nt, Human
uccuuuaaaaaaaaaaaaaaaa

SEQ ID NO: 442641 - RNA, 18 nt, Human
ugaaaaaaaaaugagaaa

SEQ ID NO: 442642 - RNA, 19 nt, Human
ugaaaugccacaagaaguc

SEQ ID NO: 442643 - RNA, 21 nt, Human
ugaaaugccacaagaagucau

SEQ ID NO: 442644 - RNA, 18 nt, Human
ugaaaugcugcacuaguc

SEQ ID NO: 442645 - RNA, 19 nt, Human
ugacaugucaauucccuuu

SEQ ID NO: 442646 - RNA, 23 nt, Human
ugagcuaacauggacaugaaggg

SEQ ID NO: 442647 - RNA, 21 nt, Human
ugauuuuacauguauaugaug

SEQ ID NO: 442648 - RNA, 19 nt, Human
ugccacaagaagucaucaa

SEQ ID NO: 442649 - RNA, 22 nt, Human
ugccugauuuuacauguauaug

SEQ ID NO: 442650 - RNA, 25 nt, Human
ugccuuggccuuaaaaauuaugugc

SEQ ID NO: 442651 - RNA, 22 nt, Human
uggaaagagauaaaaacacacu

SEQ ID NO: 442652 - RNA, 19 nt, Human
uggccggcggcggcggcgg

SEQ ID NO: 442653 - RNA, 22 nt, Human
ugugaagagagcaacacguuuu

SEQ ID NO: 442654 - RNA, 21 nt, Human
ugugccauuuucauaugugca

SEQ ID NO: 442655 - RNA, 22 nt, Human
uguggggaggacacccggcugg

SEQ ID NO: 442656 - RNA, 24 nt, Human
uguggggaggacacccggcuggca

SEQ ID NO: 442657 - RNA, 22 nt, Human
ugugugugcuuauaacaaccac

SEQ ID NO: 442658 - RNA, 22 nt, Human
uuuaaaaaaaaaaaaaaaaggu

SEQ ID NO: 442659 - RNA, 25 nt, Human
uuuaaaaaaaaaaaaaaaagguaug

SEQ ID NO: 442660 - RNA, 25 nt, Human
aaaaaaaaaaagcacuagcagaaag

SEQ ID NO: 442661 - RNA, 21 nt, Human
aaaaaaaagcacuagcagaaa

SEQ ID NO: 442662 - RNA, 23 nt, Human
aaaaacagaaaaacauaauuaaa

SEQ ID NO: 442663 - RNA, 22 nt, Human
aaaaagcacuagcagaaagcaa

SEQ ID NO: 442664 - RNA, 24 nt, Human
aaaacagaaaaacauaauuaaacc

SEQ ID NO: 442665 - RNA, 21 nt, Human
aaaccaauucauuauagagga

SEQ ID NO: 442666 - RNA, 19 nt, Human
aagaugcccauuucuaaaa

SEQ ID NO: 442667 - RNA, 19 nt, Human
aagcgagggcgagaggcga

SEQ ID NO: 442668 - RNA, 24 nt, Human
aaguaugguggcacacaccuguag

SEQ ID NO: 442669 - RNA, 20 nt, Human
acagagugagaucccauccc

SEQ ID NO: 442670 - RNA, 23 nt, Human
acagagugagaucccaucccauu

SEQ ID NO: 442671 - RNA, 24 nt, Human
accaaguucuucauaauucuccuu

SEQ ID NO: 442672 - RNA, 26 nt, Human
accaaguucuucauaauucuccuuuu

SEQ ID NO: 442673 - RNA, 24 nt, Human
acuccagccugggugacagaguga

SEQ ID NO: 442674 - RNA, 18 nt, Human
acugcacuccagccuggg

SEQ ID NO: 442675 - RNA, 18 nt, Human
acugcacuccagccuggg

SEQ ID NO: 442676 - RNA, 19 nt, Human
acugcacuccagccugggu

SEQ ID NO: 442677 - RNA, 21 nt, Human
acugcacuccagccuggguga

SEQ ID NO: 442678 - RNA, 22 nt, Human
acugcacuccagccugggugac

SEQ ID NO: 442679 - RNA, 24 nt, Human
acugcacuccagccugggugacag

SEQ ID NO: 442680 - RNA, 26 nt, Human
acugcacuccagccugggugacagag

SEQ ID NO: 442681 - RNA, 26 nt, Human
agaaaaaaaaaaaagcacuagcagaa

SEQ ID NO: 442682 - RNA, 21 nt, Human
agaaaaacauaauuaaaccaa

SEQ ID NO: 442683 - RNA, 21 nt, Human
agaaagcaaagaggacuugaa

SEQ ID NO: 442684 - RNA, 24 nt, Human
agaaagcaaagaggacuugaauaa

SEQ ID NO: 442685 - RNA, 18 nt, Human
agaccauggcugcuuccc

SEQ ID NO: 442686 - RNA, 21 nt, Human
agcagaaagcaaagaggacuu

SEQ ID NO: 442687 - RNA, 23 nt, Human
agccugggugacagagugagauc

SEQ ID NO: 442688 - RNA, 24 nt, Human
aucgugcuacugcacuccagccug

SEQ ID NO: 442689 - RNA, 21 nt, Human
auucuccuuuuucuuuucuuu

SEQ ID NO: 442690 - RNA, 25 nt, Human
auucuccuuuuucuuuucuuuuuuu

SEQ ID NO: 442691 - RNA, 19 nt, Human
auugcuugagcccaggagg

SEQ ID NO: 442692 - RNA, 19 nt, Human
cacaccuguagccccagcu

SEQ ID NO: 442693 - RNA, 18 nt, Human
caccuguagccccagcua

SEQ ID NO: 442694 - RNA, 24 nt, Human
caccuguagccccagcuacucagg

SEQ ID NO: 442695 - RNA, 22 nt, Human
cacuccagccugggugacagag

SEQ ID NO: 442696 - RNA, 22 nt, Human
cacuccagccugggugacagag

SEQ ID NO: 442697 - RNA, 24 nt, Human
cacuccagccugggugacagagug

SEQ ID NO: 442698 - RNA, 23 nt, Human
cagcugguuuaauuuuauuaaua

SEQ ID NO: 442699 - RNA, 18 nt, Human
cauacuaaaaaaugcaaa

SEQ ID NO: 442700 - RNA, 19 nt, Human
cccacaaugcccuggcacu

SEQ ID NO: 442701 - RNA, 22 nt, Human
cccacaaugcccuggcacugaa

SEQ ID NO: 442702 - RNA, 19 nt, Human
cccccacaaaaaauaaaag

SEQ ID NO: 442703 - RNA, 22 nt, Human
cccguaauugauuucauucauu

SEQ ID NO: 442704 - RNA, 19 nt, Human
ccgccgccucccccgccuc

SEQ ID NO: 442705 - RNA, 20 nt, Human
ccgccuugcgagcaaggagc

SEQ ID NO: 442706 - RNA, 19 nt, Human
ccugggugacagagugaga

SEQ ID NO: 442707 - RNA, 21 nt, Human
ccuguagccccagcuacucag

SEQ ID NO: 442708 - RNA, 18 nt, Human
cgagaggcgagcgcugga

SEQ ID NO: 442709 - RNA, 21 nt, Human
cggugagaggauugcuugagc

SEQ ID NO: 442710 - RNA, 21 nt, Human
cuacugcacuccagccugggu

SEQ ID NO: 442711 - RNA, 24 nt, Human
cuacugcacuccagccugggugac

SEQ ID NO: 442712 - RNA, 22 nt, Human
cuggagaagcgagggcgagagg

SEQ ID NO: 442713 - RNA, 27 nt, Human
cuucccacaaugcccuggcacugaaag

SEQ ID NO: 442714 - RNA, 20 nt, Human
gaaguuuauuuuauuaaauu

SEQ ID NO: 442715 - RNA, 21 nt, Human
gagccggugcggcugacaggu

SEQ ID NO: 442716 - RNA, 21 nt, Human
gaggcugcggugagaggauug

SEQ ID NO: 442717 - RNA, 23 nt, Human
gcacuccagccugggugacagag

SEQ ID NO: 442718 - RNA, 24 nt, Human
gcccaggagguccagguugcagug

SEQ ID NO: 442719 - RNA, 19 nt, Human
gcuacugcacuccagccug

SEQ ID NO: 442720 - RNA, 24 nt, Human
gcuacugcacuccagccuggguga

SEQ ID NO: 442721 - RNA, 22 nt, Human
gcugcuaucgugcuacugcacu

SEQ ID NO: 442722 - RNA, 19 nt, Human
ggacagauuaucagaaaua

SEQ ID NO: 442723 - RNA, 22 nt, Human
ggagccggugcggcugacaggu

SEQ ID NO: 442724 - RNA, 19 nt, Human
ggaggcugcggugagagga

SEQ ID NO: 442725 - RNA, 22 nt, Human
ggaggcugcggugagaggauug

SEQ ID NO: 442726 - RNA, 23 nt, Human
ggaggcugcggugagaggauugc

SEQ ID NO: 442727 - RNA, 22 nt, Human
ggugagaggauugcuugagccc

SEQ ID NO: 442728 - RNA, 21 nt, Human
uaaaaaaugcaaaugaccuaa

SEQ ID NO: 442729 - RNA, 24 nt, Human
uaaaaagaugcccauuucuaaaaa

SEQ ID NO: 442730 - RNA, 21 nt, Human
uacugcacuccagccugggug

SEQ ID NO: 442731 - RNA, 23 nt, Human
uacugcacuccagccugggugac

SEQ ID NO: 442732 - RNA, 24 nt, Human
uacugcacuccagccugggugaca

SEQ ID NO: 442733 - RNA, 25 nt, Human
uacugcacuccagccugggugacag

SEQ ID NO: 442734 - RNA, 23 nt, Human
uagaccauggcugcuucccacaa

SEQ ID NO: 442735 - RNA, 24 nt, Human
uauguaaaagauuuaaauuuucuu

SEQ ID NO: 442736 - RNA, 21 nt, Human
uccagaaauaaaaagaugccc

SEQ ID NO: 442737 - RNA, 23 nt, Human
uccagccugggugacagagugag

SEQ ID NO: 442738 - RNA, 24 nt, Human
uccagccugggugacagagugaga

SEQ ID NO: 442739 - RNA, 19 nt, Human
ucccucaguucuuuauucu

SEQ ID NO: 442740 - RNA, 23 nt, Human
ucgugcuacugcacuccagccug

SEQ ID NO: 442741 - RNA, 19 nt, Human
ucuaaaaacagaaaaacau

SEQ ID NO: 442742 - RNA, 19 nt, Human
ucuccuuuuucuuuucuuu

SEQ ID NO: 442743 - RNA, 24 nt, Human
ugaauauuauaauuagucauaguc

SEQ ID NO: 442744 - RNA, 20 nt, Human
ugagcccaggagguccaggu

SEQ ID NO: 442745 - RNA, 18 nt, Human
ugcccauuucuaaaaaca

SEQ ID NO: 442746 - RNA, 21 nt, Human
ugcgagcaaggagcgcuggag

SEQ ID NO: 442747 - RNA, 24 nt, Human
ugcuaucgugcuacugcacuccag

SEQ ID NO: 442748 - RNA, 25 nt, Human
ugcuauuauaaugagauuagguguu

SEQ ID NO: 442749 - RNA, 22 nt, Human
uggcacacaccuguagccccag

SEQ ID NO: 442750 - RNA, 23 nt, Human
uggcugcuucccacaaugcccug

SEQ ID NO: 442751 - RNA, 23 nt, Human
uggcugggccgccgccucccccg

SEQ ID NO: 442752 - RNA, 23 nt, Human
ugguggcacacaccuguagcccc

SEQ ID NO: 442753 - RNA, 19 nt, Human
uguacaaauuguuuuauua

SEQ ID NO: 442754 - RNA, 19 nt, Human
uguagccccagcuacucag

SEQ ID NO: 442755 - RNA, 20 nt, Human
uguuuuauucauuuauuuau

SEQ ID NO: 442756 - RNA, 19 nt, Human
uucaagaaaaaaaaaaaag

SEQ ID NO: 442757 - RNA, 25 nt, Human
uucaagaaaaaaaaaaaagcacuag

SEQ ID NO: 442758 - RNA, 23 nt, Human
uucaauuuuacugcauucauuuc

SEQ ID NO: 442759 - RNA, 21 nt, Human
uuccagaaauaaaaagaugcc

SEQ ID NO: 442760 - RNA, 22 nt, Human
uucuuuuuuuuuuuuuuuagau

SEQ ID NO: 442761 - RNA, 22 nt, Human
uugcagugcgcugcuaucgugc

SEQ ID NO: 442762 - RNA, 24 nt, Human
uugcuugagcccaggagguccagg

SEQ ID NO: 442763 - RNA, 23 nt, Human
uuuucaauuuuacugcauucauu

SEQ ID NO: 442764 - RNA, 21 nt, Human
uuuuuuuuuuuuagauggagu

SEQ ID NO: 442765 - RNA, 21 nt, Human
uuuuuuuuuuuuuuagaugga

SEQ ID NO: 442766 - RNA, 22 nt, Human
aaaagcaggcgaccccagagga

SEQ ID NO: 442767 - RNA, 22 nt, Human
aacacagaacagcccagguccc

SEQ ID NO: 442768 - RNA, 18 nt, Human
aacccaccccguccacgg

SEQ ID NO: 442769 - RNA, 23 nt, Human
aacccaccccguccacgguucug

SEQ ID NO: 442770 - RNA, 23 nt, Human
aagugccccucacguggugccca

SEQ ID NO: 442771 - RNA, 19 nt, Human
acagcggcccuuccuuccc

SEQ ID NO: 442772 - RNA, 19 nt, Human
accaagugccccucacgug

SEQ ID NO: 442773 - RNA, 19 nt, Human
accaccccaaacccaagcc

SEQ ID NO: 442774 - RNA, 21 nt, Human
accaccccaaacccaagccga

SEQ ID NO: 442775 - RNA, 18 nt, Human
acugacaauggacaacgc

SEQ ID NO: 442776 - RNA, 19 nt, Human
acugcaaccucucuuuggc

SEQ ID NO: 442777 - RNA, 22 nt, Human
acugcaaccucucuuuggcguc

SEQ ID NO: 442778 - RNA, 18 nt, Human
acuguggguucugggaga

SEQ ID NO: 442779 - RNA, 18 nt, Human
acuguggguucugggaga

SEQ ID NO: 442780 - RNA, 18 nt, Human
agacccagucaccagccc

SEQ ID NO: 442781 - RNA, 20 nt, Human
agccuggcuggcgcguggcc

SEQ ID NO: 442782 - RNA, 23 nt, Human
agcggagucuccuugcccugccu

SEQ ID NO: 442783 - RNA, 24 nt, Human
aggaccuuugggucaaaagcaggc

SEQ ID NO: 442784 - RNA, 19 nt, Human
aggcccuggcccaggacag

SEQ ID NO: 442785 - RNA, 20 nt, Human
agggcacagacccagguggg

SEQ ID NO: 442786 - RNA, 20 nt, Human
agggcacagacccagguggg

SEQ ID NO: 442787 - RNA, 18 nt, Human
caacgcaacaaaugaccu

SEQ ID NO: 442788 - RNA, 18 nt, Human
caacgcaacaaaugaccu

SEQ ID NO: 442789 - RNA, 22 nt, Human
cacagacccaggugggggaguc

SEQ ID NO: 442790 - RNA, 22 nt, Human
cacauucaaggacucggccccc

SEQ ID NO: 442791 - RNA, 22 nt, Human
cacauucaaggacucggccccc

SEQ ID NO: 442792 - RNA, 19 nt, Human
cacggcggacaacauagag

SEQ ID NO: 442793 - RNA, 18 nt, Human
cacuucugcugaccagga

SEQ ID NO: 442794 - RNA, 20 nt, Human
ccaaacccaagccgagaugc

SEQ ID NO: 442795 - RNA, 18 nt, Human
ccaaagagaaugggaaga

SEQ ID NO: 442796 - RNA, 18 nt, Human
ccaaagagaaugggaaga

SEQ ID NO: 442797 - RNA, 19 nt, Human
cccaaacccaagccgagau

SEQ ID NO: 442798 - RNA, 23 nt, Human
cccacgagcacacugacaaugga

SEQ ID NO: 442799 - RNA, 19 nt, Human
cccacuguggguucuggga

SEQ ID NO: 442800 - RNA, 19 nt, Human
cccacuguggguucuggga

SEQ ID NO: 442801 - RNA, 19 nt, Human
cccaggacaggagccccug

SEQ ID NO: 442802 - RNA, 22 nt, Human
cccaggacaggagccccugaag

SEQ ID NO: 442803 - RNA, 19 nt, Human
ccccgcccuguccaccaag

SEQ ID NO: 442804 - RNA, 19 nt, Human
cccugcccacagccuggcu

SEQ ID NO: 442805 - RNA, 22 nt, Human
cccuguccaccaagugccccuc

SEQ ID NO: 442806 - RNA, 19 nt, Human
cccuuccuuccccuccccc

SEQ ID NO: 442807 - RNA, 19 nt, Human
cccuuccuuccccuccccc

SEQ ID NO: 442808 - RNA, 19 nt, Human
ccgcuuucccacugugggu

SEQ ID NO: 442809 - RNA, 19 nt, Human
ccguccacgguucugacug

SEQ ID NO: 442810 - RNA, 22 nt, Human
ccucaacccaccccguccacgg

SEQ ID NO: 442811 - RNA, 25 nt, Human
ccugccuggugggggcucugccugu

SEQ ID NO: 442812 - RNA, 19 nt, Human
ccuggccccgcccugccca

SEQ ID NO: 442813 - RNA, 23 nt, Human
ccuggccccgcccugcccacagc

SEQ ID NO: 442814 - RNA, 21 nt, Human
cgcaacaaaugaccucggaug

SEQ ID NO: 442815 - RNA, 21 nt, Human
cgcaacaaaugaccucggaug

SEQ ID NO: 442816 - RNA, 25 nt, Human
cgcccuguccaccaagugccccuca

SEQ ID NO: 442817 - RNA, 18 nt, Human
cggcccccagcgcggggc

SEQ ID NO: 442818 - RNA, 18 nt, Human
cggcccccagcgcggggc

SEQ ID NO: 442819 - RNA, 22 nt, Human
cggcccuuccuuccccuccccc

SEQ ID NO: 442820 - RNA, 22 nt, Human
cggcccuuccuuccccuccccc

SEQ ID NO: 442821 - RNA, 21 nt, Human
cuccuugcccugccugguggg

SEQ ID NO: 442822 - RNA, 20 nt, Human
cugaagccacauucaaggac

SEQ ID NO: 442823 - RNA, 20 nt, Human
cugaagccacauucaaggac

SEQ ID NO: 442824 - RNA, 18 nt, Human
cugcaugggauucuguaa

SEQ ID NO: 442825 - RNA, 20 nt, Human
cugcuuccaggcccugccug

SEQ ID NO: 442826 - RNA, 21 nt, Human
cuggcccaggacaggagcccc

SEQ ID NO: 442827 - RNA, 22 nt, Human
cuuggcgacagcggcccuuccu

SEQ ID NO: 442828 - RNA, 18 nt, Human
gaagaagggucaguccug

SEQ ID NO: 442829 - RNA, 18 nt, Human
gaccaggaagacgggugg

SEQ ID NO: 442830 - RNA, 21 nt, Human
gacugaggagaggcgagacac

SEQ ID NO: 442831 - RNA, 18 nt, Human
gaggaggccacgucagcc

SEQ ID NO: 442832 - RNA, 23 nt, Human
gcacagacccaggugggggaguc

SEQ ID NO: 442833 - RNA, 19 nt, Human
gcccuuccuuccccucccc

SEQ ID NO: 442834 - RNA, 19 nt, Human
gcccuuccuuccccucccc

SEQ ID NO: 442835 - RNA, 18 nt, Human
gccugggaucccaagacc

SEQ ID NO: 442836 - RNA, 25 nt, Human
ggaccaccccaaacccaagccgaga

SEQ ID NO: 442837 - RNA, 19 nt, Human
ggagucuccuugcccugcc

SEQ ID NO: 442838 - RNA, 18 nt, Human
ggccccgcccugcccaca

SEQ ID NO: 442839 - RNA, 19 nt, Human
ggcccuggcccaggacagg

SEQ ID NO: 442840 - RNA, 22 nt, Human
ggccucaacccaccccguccac

SEQ ID NO: 442841 - RNA, 19 nt, Human
gggcacagacccagguggg

SEQ ID NO: 442842 - RNA, 19 nt, Human
gggcacagacccagguggg

SEQ ID NO: 442843 - RNA, 23 nt, Human
gggguggugcggggcucgcaggc

SEQ ID NO: 442844 - RNA, 22 nt, Human
guccacgguucugacugcaacc

SEQ ID NO: 442845 - RNA, 19 nt, Human
gucuccuugcccugccugg

SEQ ID NO: 442846 - RNA, 20 nt, Human
gugccccucacguggugccc

SEQ ID NO: 442847 - RNA, 21 nt, Human
uaaaaugucauuaucucugaa

SEQ ID NO: 442848 - RNA, 24 nt, Human
uaauucaacgcaacaaaugaccuc

SEQ ID NO: 442849 - RNA, 24 nt, Human
uaauucaacgcaacaaaugaccuc

SEQ ID NO: 442850 - RNA, 21 nt, Human
uacacggcggacaacauagag

SEQ ID NO: 442851 - RNA, 23 nt, Human
uacgugcuccgcgggguggugcg

SEQ ID NO: 442852 - RNA, 18 nt, Human
ucacagguccugcccaag

SEQ ID NO: 442853 - RNA, 24 nt, Human
ucagccccgcccuguccaccaagu

SEQ ID NO: 442854 - RNA, 21 nt, Human
ucaggacaggagccccugaag

SEQ ID NO: 442855 - RNA, 24 nt, Human
uccaggcccugccugggccuuccu

SEQ ID NO: 442856 - RNA, 23 nt, Human
ucccaagacccagucaccagccc

SEQ ID NO: 442857 - RNA, 26 nt, Human
ucccuggguacgugcuccgcggggug

SEQ ID NO: 442858 - RNA, 19 nt, Human
ucccuugcugguuuggggg

SEQ ID NO: 442859 - RNA, 19 nt, Human
ucccuugcugguuuggggg

SEQ ID NO: 442860 - RNA, 21 nt, Human
ugacacaaaaucaugacagca

SEQ ID NO: 442861 - RNA, 19 nt, Human
ugaccaggaagacgggugg

SEQ ID NO: 442862 - RNA, 21 nt, Human
ugacugcaaccucucuuuggc

SEQ ID NO: 442863 - RNA, 19 nt, Human
ugccccucacguggugccc

SEQ ID NO: 442864 - RNA, 23 nt, Human
ugccugggccuuccuaagggugc

SEQ ID NO: 442865 - RNA, 21 nt, Human
ugcggaccaccccaaacccaa

SEQ ID NO: 442866 - RNA, 19 nt, Human
ugcugggaaggaugugggg

SEQ ID NO: 442867 - RNA, 20 nt, Human
uggcgacagcggcccuuccu

SEQ ID NO: 442868 - RNA, 19 nt, Human
uggcuggcgcguggccugg

SEQ ID NO: 442869 - RNA, 26 nt, Human
ugggaaggauguggggaaaccuuggu

SEQ ID NO: 442870 - RNA, 19 nt, Human
ugggaucccaagacccagu

SEQ ID NO: 442871 - RNA, 22 nt, Human
ugggcacacuccuucaacacag

SEQ ID NO: 442872 - RNA, 19 nt, Human
ugggucaaaagcaggcgac

SEQ ID NO: 442873 - RNA, 19 nt, Human
uuccaggcccugccugggc

SEQ ID NO: 442874 - RNA, 23 nt, Human
uuccaggcccugccugggccuuc

SEQ ID NO: 442875 - RNA, 22 nt, Human
uuggaucaucuugacacaaaau

SEQ ID NO: 442876 - RNA, 18 nt, Human
uuugggggcgagaagggg

SEQ ID NO: 442877 - RNA, 18 nt, Human
uuugggggcgagaagggg

SEQ ID NO: 442878 - RNA, 20 nt, Human
aaaaaucaccuccaaaaucu

SEQ ID NO: 442879 - RNA, 19 nt, Human
aaauauuuggcaacauuuu

SEQ ID NO: 442880 - RNA, 23 nt, Human
aacaagaaggaaacaugaagaac

SEQ ID NO: 442881 - RNA, 25 nt, Human
aacaagaaggaaacaugaagaacaa

SEQ ID NO: 442882 - RNA, 22 nt, Human
aagaagaauggagccacaaaga

SEQ ID NO: 442883 - RNA, 25 nt, Human
aagaagaauggagccacaaagagaa

SEQ ID NO: 442884 - RNA, 22 nt, Human
aagaauggagccacaaagagaa

SEQ ID NO: 442885 - RNA, 18 nt, Human
aagagaagauagcacagg

SEQ ID NO: 442886 - RNA, 21 nt, Human
aagcugaauaaggcaaacacu

SEQ ID NO: 442887 - RNA, 21 nt, Human
acaggaggagaacuggacagu

SEQ ID NO: 442888 - RNA, 25 nt, Human
accuaauagugauacaucguaauga

SEQ ID NO: 442889 - RNA, 18 nt, Human
accugugccagucaguga

SEQ ID NO: 442890 - RNA, 23 nt, Human
agaaagcaaagcaaauguucuca

SEQ ID NO: 442891 - RNA, 24 nt, Human
agaaagcaaagcaaauguucucau

SEQ ID NO: 442892 - RNA, 22 nt, Human
agaagaauggagccacaaagag

SEQ ID NO: 442893 - RNA, 19 nt, Human
agaauauguauucccacuc

SEQ ID NO: 442894 - RNA, 24 nt, Human
agaauauguauucccacucacuug

SEQ ID NO: 442895 - RNA, 19 nt, Human
agauuuaaaaagacugaug

SEQ ID NO: 442896 - RNA, 19 nt, Human
agcaccaaccagcagcccu

SEQ ID NO: 442897 - RNA, 19 nt, Human
aggcagggcaggcaaaggu

SEQ ID NO: 442898 - RNA, 21 nt, Human
aggcauuuagguuaaccaugg

SEQ ID NO: 442899 - RNA, 21 nt, Human
aguacguauauuuaagcacuc

SEQ ID NO: 442900 - RNA, 20 nt, Human
auagaagagaagauagcaca

SEQ ID NO: 442901 - RNA, 18 nt, Human
auggagcagcagugcucc

SEQ ID NO: 442902 - RNA, 20 nt, Human
caaaauaacugggcaaggac

SEQ ID NO: 442903 - RNA, 22 nt, Human
caaacacuugaagaggcaguuu

SEQ ID NO: 442904 - RNA, 18 nt, Human
caaacuuaggcaaaagga

SEQ ID NO: 442905 - RNA, 20 nt, Human
caaccagcagcccuugacag

SEQ ID NO: 442906 - RNA, 24 nt, Human
caagacauuaaaaauaaaaagcaa

SEQ ID NO: 442907 - RNA, 23 nt, Human
cagacaaauucaaacccuuaaga

SEQ ID NO: 442908 - RNA, 19 nt, Human
cagcaccaaccagcagccc

SEQ ID NO: 442909 - RNA, 18 nt, Human
caucaauguuaccgagga

SEQ ID NO: 442910 - RNA, 19 nt, Human
caugaagaacaagcacuua

SEQ ID NO: 442911 - RNA, 18 nt, Human
cauuauaacucacuucca

SEQ ID NO: 442912 - RNA, 21 nt, Human
ccagcaccaaccagcagcccu

SEQ ID NO: 442913 - RNA, 26 nt, Human
ccuaaagacaaggaaugcagacaaau

SEQ ID NO: 442914 - RNA, 20 nt, Human
ccuccaaaaucuuccuaagu

SEQ ID NO: 442915 - RNA, 25 nt, Human
ccucucuugggacagauacugguuu

SEQ ID NO: 442916 - RNA, 19 nt, Human
ccuuguaccagcaccaacc

SEQ ID NO: 442917 - RNA, 18 nt, Human
ccuuuugcugaacugggg

SEQ ID NO: 442918 - RNA, 18 nt, Human
cggcgccggauccucucc

SEQ ID NO: 442919 - RNA, 21 nt, Human
cucuccuaccgaagcuggaga

SEQ ID NO: 442920 - RNA, 26 nt, Human
cuuaagaacaacaacaaaaaagauuu

SEQ ID NO: 442921 - RNA, 21 nt, Human
gcacauuuuccuccuuuugcu

SEQ ID NO: 442922 - RNA, 19 nt, Human
gcauuuagguuaaccaugg

SEQ ID NO: 442923 - RNA, 24 nt, Human
gucaagacauuaaaaauaaaaagc

SEQ ID NO: 442924 - RNA, 18 nt, Human
guccagguauagauuguu

SEQ ID NO: 442925 - RNA, 20 nt, Human
gugcagccgccagaugguau

SEQ ID NO: 442926 - RNA, 18 nt, Human
uaaaaagacugaugacug

SEQ ID NO: 442927 - RNA, 20 nt, Human
uaaaacaugaagauggcaaa

SEQ ID NO: 442928 - RNA, 20 nt, Human
uaaaagguuuccuuagcuua

SEQ ID NO: 442929 - RNA, 22 nt, Human
uaacaagaaggaaacaugaaga

SEQ ID NO: 442930 - RNA, 21 nt, Human
uaacagcugaaccaguggcac

SEQ ID NO: 442931 - RNA, 22 nt, Human
uaacugccaaucugagauuagu

SEQ ID NO: 442932 - RNA, 22 nt, Human
uaagaacaacaacaaaaaagau

SEQ ID NO: 442933 - RNA, 21 nt, Human
uacaauaccaaguacagugag

SEQ ID NO: 442934 - RNA, 21 nt, Human
uagcacaggaggagaacugga

SEQ ID NO: 442935 - RNA, 20 nt, Human
uagcauaagggaaagacggu

SEQ ID NO: 442936 - RNA, 21 nt, Human
ucaaacccuuaagaacaacaa

SEQ ID NO: 442937 - RNA, 22 nt, Human
ucacaaugaaauugagugcaau

SEQ ID NO: 442938 - RNA, 18 nt, Human
uccagugacaauuaugac

SEQ ID NO: 442939 - RNA, 20 nt, Human
uccaugaaaggcagggcagg

SEQ ID NO: 442940 - RNA, 20 nt, Human
uccuauggaaaaaaaucacc

SEQ ID NO: 442941 - RNA, 19 nt, Human
uccuuuugcugaacugggg

SEQ ID NO: 442942 - RNA, 18 nt, Human
ucggcgccggauccucuc

SEQ ID NO: 442943 - RNA, 21 nt, Human
ucuaugacuauagcuuuggga

SEQ ID NO: 442944 - RNA, 22 nt, Human
ucuuuugagguacgaacucuga

SEQ ID NO: 442945 - RNA, 22 nt, Human
ugaaaagauacaaaauaagcua

SEQ ID NO: 442946 - RNA, 18 nt, Human
ugaaaagggaauuucccc

SEQ ID NO: 442947 - RNA, 20 nt, Human
ugaaagaagaauggagccac

SEQ ID NO: 442948 - RNA, 20 nt, Human
ugaagaacaagcacuuaaga

SEQ ID NO: 442949 - RNA, 21 nt, Human
ugaagagucaagacauuaaaa

SEQ ID NO: 442950 - RNA, 20 nt, Human
ugagaccaguuaacucuuuu

SEQ ID NO: 442951 - RNA, 23 nt, Human
ugagaccaguuaacucuuuuagg

SEQ ID NO: 442952 - RNA, 21 nt, Human
ugcaguaacuuccuaaaagca

SEQ ID NO: 442953 - RNA, 21 nt, Human
ugccagggccauguggaagug

SEQ ID NO: 442954 - RNA, 19 nt, Human
uggaaaacaaacugguccu

SEQ ID NO: 442955 - RNA, 23 nt, Human
uggagcagcagugcucccugcca

SEQ ID NO: 442956 - RNA, 18 nt, Human
uggagcauggagcagcag

SEQ ID NO: 442957 - RNA, 20 nt, Human
uucaucuuuuuauugauagc

SEQ ID NO: 442958 - RNA, 23 nt, Human
uuccaugaaaggcagggcaggca

SEQ ID NO: 442959 - RNA, 20 nt, Human
uuccuuagcuuaaagcuccu

SEQ ID NO: 442960 - RNA, 21 nt, Human
uugacagcauagaugggauga

SEQ ID NO: 442961 - RNA, 21 nt, Human
uugcuuaaaagcacaaaugcu

SEQ ID NO: 442962 - RNA, 22 nt, Human
uuggacauuuuaguagaaauug

SEQ ID NO: 442963 - RNA, 22 nt, Human
uuggcaacauuuugacuuuaac

SEQ ID NO: 442964 - RNA, 23 nt, Human
uugguaccuaauagugauacauc

SEQ ID NO: 442965 - RNA, 21 nt, Human
uuuuuacugugcuaacagcug

SEQ ID NO: 442966 - RNA, 21 nt, Human
uuuuuuuuuuuuuugcuuuca

SEQ ID NO: 442967 - RNA, 18 nt, Human
uuuuuuuuuuuuuuuuug

SEQ ID NO: 442968 - RNA, 24 nt, Human
aaaacuagcaaaaacuuugcacaa

SEQ ID NO: 442969 - RNA, 18 nt, Human
aaaaggaagugaguagaa

SEQ ID NO: 442970 - RNA, 20 nt, Human
aaaaucugauuccacugggg

SEQ ID NO: 442971 - RNA, 18 nt, Human
aaacaaauguuggucuuu

SEQ ID NO: 442972 - RNA, 19 nt, Human
aaacuagucccaaagucag

SEQ ID NO: 442973 - RNA, 19 nt, Human
aaagacugaggaaaugaua

SEQ ID NO: 442974 - RNA, 21 nt, Human
aaagcaacacaacucugcagc

SEQ ID NO: 442975 - RNA, 24 nt, Human
aacaaaaacccuuuuguauaaaua

SEQ ID NO: 442976 - RNA, 25 nt, Human
aacacaacucuuuccuucccauccc

SEQ ID NO: 442977 - RNA, 23 nt, Human
aagagaccaagugcugauggaca

SEQ ID NO: 442978 - RNA, 21 nt, Human
aagccugagguaucccuuuag

SEQ ID NO: 442979 - RNA, 20 nt, Human
aauauuuaaauaguaacaga

SEQ ID NO: 442980 - RNA, 23 nt, Human
acacauggaaccaaacagcucga

SEQ ID NO: 442981 - RNA, 18 nt, Human
acacuccauggccugcug

SEQ ID NO: 442982 - RNA, 19 nt, Human
acaggcagugucugaaaac

SEQ ID NO: 442983 - RNA, 23 nt, Human
acaugauaggaguacaaaagaaa

SEQ ID NO: 442984 - RNA, 19 nt, Human
acccaugaucaacacaguc

SEQ ID NO: 442985 - RNA, 24 nt, Human
acgggucuuccuuuuucuccaugc

SEQ ID NO: 442986 - RNA, 24 nt, Human
acucuuuccuucccaucccuccuu

SEQ ID NO: 442987 - RNA, 18 nt, Human
agaaaccaacacaacucu

SEQ ID NO: 442988 - RNA, 20 nt, Human
agaagcuacuucugcacaug

SEQ ID NO: 442989 - RNA, 27 nt, Human
agaugcuucccuuuccauggggagucc

SEQ ID NO: 442990 - RNA, 25 nt, Human
agcggguggguccaggaggggacug

SEQ ID NO: 442991 - RNA, 24 nt, Human
aggaguacaaaagaaaagacugag

SEQ ID NO: 442992 - RNA, 20 nt, Human
agggaccaagauuaguuguu

SEQ ID NO: 442993 - RNA, 23 nt, Human
agggagcggguggguccaggagg

SEQ ID NO: 442994 - RNA, 24 nt, Human
aguaagaaaugaaaaaaugugcaa

SEQ ID NO: 442995 - RNA, 20 nt, Human
aguacaaaagaaaagacuga

SEQ ID NO: 442996 - RNA, 24 nt, Human
agucagaagauaaaacuagcaaaa

SEQ ID NO: 442997 - RNA, 23 nt, Human
aguccgauaccaucauggucuuu

SEQ ID NO: 442998 - RNA, 21 nt, Human
aguucuguccaguucucccug

SEQ ID NO: 442999 - RNA, 22 nt, Human
caaacagcucgauggagacacc

SEQ ID NO: 443000 - RNA, 26 nt, Human
caaaccuagaaauauucagggaccaa

SEQ ID NO: 443001 - RNA, 21 nt, Human
caacacaacucugcagcaaaa

SEQ ID NO: 443002 - RNA, 25 nt, Human
caacacaguccaucuuccuacagca

SEQ ID NO: 443003 - RNA, 18 nt, Human
caacgggaagguuacgau

SEQ ID NO: 443004 - RNA, 22 nt, Human
caagcuuccuacccccaucaca

SEQ ID NO: 443005 - RNA, 21 nt, Human
caaguaagaaaugaaaaaaug

SEQ ID NO: 443006 - RNA, 18 nt, Human
cacaacucugcagcaaaa

SEQ ID NO: 443007 - RNA, 25 nt, Human
cacaacucuuuccuucccaucccuc

SEQ ID NO: 443008 - RNA, 23 nt, Human
cacaauauuuagagaaaagcucu

SEQ ID NO: 443009 - RNA, 19 nt, Human
cacccaugaucaacacagu

SEQ ID NO: 443010 - RNA, 23 nt, Human
cacccaugaucaacacaguccau

SEQ ID NO: 443011 - RNA, 24 nt, Human
cacuccauggccugcugcacaugu

SEQ ID NO: 443012 - RNA, 18 nt, Human
cacugaagauaagagacc

SEQ ID NO: 443013 - RNA, 21 nt, Human
cagaaagaaaccaacacaacu

SEQ ID NO: 443014 - RNA, 25 nt, Human
cagauggaaaaguuuccgaccaacg

SEQ ID NO: 443015 - RNA, 19 nt, Human
cagcaaaaacuagucccaa

SEQ ID NO: 443016 - RNA, 22 nt, Human
cagcacugacaaauggagauau

SEQ ID NO: 443017 - RNA, 23 nt, Human
cagcucgauggagacacccugca

SEQ ID NO: 443018 - RNA, 21 nt, Human
cagugucugaaaacuaguccg

SEQ ID NO: 443019 - RNA, 20 nt, Human
cauggaaccaaacagcucga

SEQ ID NO: 443020 - RNA, 20 nt, Human
ccaagcagagcacaguauca

SEQ ID NO: 443021 - RNA, 26 nt, Human
ccagcacugacaaauggagauaugag

SEQ ID NO: 443022 - RNA, 22 nt, Human
cccaugaucaacacaguccauc

SEQ ID NO: 443023 - RNA, 22 nt, Human
ccugcaggucccuuacccuaga

SEQ ID NO: 443024 - RNA, 24 nt, Human
ccuuaagcuauaaacaaaaacccu

SEQ ID NO: 443025 - RNA, 18 nt, Human
cgaucugguaccagucca

SEQ ID NO: 443026 - RNA, 21 nt, Human
cgggcccuggcugcacugggg

SEQ ID NO: 443027 - RNA, 23 nt, Human
cuacacuccauggccugcugcac

SEQ ID NO: 443028 - RNA, 20 nt, Human
cuccaugcaccaagcagagc

SEQ ID NO: 443029 - RNA, 18 nt, Human
cuccuuuacuucuuuuuc

SEQ ID NO: 443030 - RNA, 22 nt, Human
cugaacuaggacaaaaaugacc

SEQ ID NO: 443031 - RNA, 22 nt, Human
cuuauggugaugcugcaggaau

SEQ ID NO: 443032 - RNA, 20 nt, Human
gaaaccuuagaauccuguag

SEQ ID NO: 443033 - RNA, 20 nt, Human
gaauacaugauaggaguaca

SEQ ID NO: 443034 - RNA, 21 nt, Human
gacaaguaagaaaugaaaaaa

SEQ ID NO: 443035 - RNA, 24 nt, Human
gcugauauuuuuuuuuacuuuuag

SEQ ID NO: 443036 - RNA, 21 nt, Human
ggaaaauggccggugaauucu

SEQ ID NO: 443037 - RNA, 20 nt, Human
ggaaucagaaagaaaccaac

SEQ ID NO: 443038 - RNA, 19 nt, Human
ggaucaaccacacccucga

SEQ ID NO: 443039 - RNA, 22 nt, Human
ggcacugaaggcuaaggaaaaa

SEQ ID NO: 443040 - RNA, 20 nt, Human
gggagcggguggguccagga

SEQ ID NO: 443041 - RNA, 24 nt, Human
uaaaacuagcaaaaacuuugcaca

SEQ ID NO: 443042 - RNA, 22 nt, Human
uaaaacugcugcacuuacaaac

SEQ ID NO: 443043 - RNA, 22 nt, Human
uaaacuggguugcuuacaccca

SEQ ID NO: 443044 - RNA, 23 nt, Human
uaaggaaaaaagggagcgggugg

SEQ ID NO: 443045 - RNA, 21 nt, Human
uaaguuuucaacucuggccuu

SEQ ID NO: 443046 - RNA, 22 nt, Human
uacaaaagaaaagacugaggaa

SEQ ID NO: 443047 - RNA, 21 nt, Human
uacaccugcaggucccuuacc

SEQ ID NO: 443048 - RNA, 21 nt, Human
uacacuaucccagaggaaaau

SEQ ID NO: 443049 - RNA, 22 nt, Human
uagaaugaaaagggacugguag

SEQ ID NO: 443050 - RNA, 19 nt, Human
uagaguccgacugcuuuuc

SEQ ID NO: 443051 - RNA, 23 nt, Human
uagcaaaaacuuugcacaauauu

SEQ ID NO: 443052 - RNA, 18 nt, Human
uagguuccucaggagagg

SEQ ID NO: 443053 - RNA, 25 nt, Human
ucagugacagaagaaagccuuuuuc

SEQ ID NO: 443054 - RNA, 18 nt, Human
uccaggaggggacugacc

SEQ ID NO: 443055 - RNA, 20 nt, Human
uccaguccauuuccagaagu

SEQ ID NO: 443056 - RNA, 23 nt, Human
uccaguccauuuccagaaguaca

SEQ ID NO: 443057 - RNA, 18 nt, Human
uccaguucucccugguga

SEQ ID NO: 443058 - RNA, 18 nt, Human
uccaugcaccaagcagag

SEQ ID NO: 443059 - RNA, 19 nt, Human
uccaugcaccaagcagagc

SEQ ID NO: 443060 - RNA, 21 nt, Human
ucccuccuuaagguagagucc

SEQ ID NO: 443061 - RNA, 24 nt, Human
ucccuggugaccuuuuccucccuu

SEQ ID NO: 443062 - RNA, 21 nt, Human
ucuacuccaguacgaugacac

SEQ ID NO: 443063 - RNA, 22 nt, Human
ucuaggguguggagaguacggg

SEQ ID NO: 443064 - RNA, 19 nt, Human
ucucugaaacucucuuacu

SEQ ID NO: 443065 - RNA, 18 nt, Human
ucugaaacucucuuacuu

SEQ ID NO: 443066 - RNA, 23 nt, Human
ucuuucuuucuuuuuaaucuuuc

SEQ ID NO: 443067 - RNA, 21 nt, Human
ugacacacgggcccuggcugc

SEQ ID NO: 443068 - RNA, 21 nt, Human
ugacagaagaaagccuuuuuc

SEQ ID NO: 443069 - RNA, 21 nt, Human
ugagggaaaaucugauuccac

SEQ ID NO: 443070 - RNA, 25 nt, Human
ugcacuuacaaaccuagaaauauuc

SEQ ID NO: 443071 - RNA, 22 nt, Human
ugcagcaaaaacuagucccaaa

SEQ ID NO: 443072 - RNA, 20 nt, Human
ugccauguuucuuaaacugg

SEQ ID NO: 443073 - RNA, 22 nt, Human
uggcugcacuggggauuauggg

SEQ ID NO: 443074 - RNA, 19 nt, Human
uggguugcuuacacccaug

SEQ ID NO: 443075 - RNA, 18 nt, Human
uguuaaacacacauggaa

SEQ ID NO: 443076 - RNA, 18 nt, Human
uuaguugccauguuucuu

SEQ ID NO: 443077 - RNA, 19 nt, Human
uucaaggaucaaccacacc

SEQ ID NO: 443078 - RNA, 25 nt, Human
uuccaugguggauguguaugucacu

SEQ ID NO: 443079 - RNA, 22 nt, Human
uuccgaccaacgggaagguuac

SEQ ID NO: 443080 - RNA, 25 nt, Human
uuuaaaaagucuccaguccauuucc

SEQ ID NO: 443081 - RNA, 20 nt, Human
uuuagauaauuaaagccaag

SEQ ID NO: 443082 - RNA, 24 nt, Human
uuuaggagaaauguuuugucuuag

SEQ ID NO: 443083 - RNA, 20 nt, Human
uuucaguucuguccaguucu

SEQ ID NO: 443084 - RNA, 19 nt, Human
uuucuuuuuaaucuuucua

SEQ ID NO: 443085 - RNA, 20 nt, Human
uuuuccucuuucuucuccuu

SEQ ID NO: 443086 - RNA, 26 nt, Human
uuuuuccucuuucuucuccuucccuc

SEQ ID NO: 443087 - RNA, 22 nt, Human
aaaaaaaaccacaaaaaaacac

SEQ ID NO: 443088 - RNA, 27 nt, Human
aaaaaacacaaaaggauucugggugua

SEQ ID NO: 443089 - RNA, 18 nt, Human
aaacacaaaaggauucug

SEQ ID NO: 443090 - RNA, 19 nt, Human
aacaagguggcccugacac

SEQ ID NO: 443091 - RNA, 20 nt, Human
aacauggugaaacccugucu

SEQ ID NO: 443092 - RNA, 21 nt, Human
aacauggugaaacccugucuc

SEQ ID NO: 443093 - RNA, 21 nt, Human
aagcagagguugcagugagcc

SEQ ID NO: 443094 - RNA, 24 nt, Human
aagcagagguugcagugagccgag

SEQ ID NO: 443095 - RNA, 20 nt, Human
aagcagcccucaucuuaagg

SEQ ID NO: 443096 - RNA, 22 nt, Human
aagcauauucuucaugaggcgg

SEQ ID NO: 443097 - RNA, 23 nt, Human
aaggauucuggguguaacaaucu

SEQ ID NO: 443098 - RNA, 22 nt, Human
acaaaaaaacacaaaaggauuc

SEQ ID NO: 443099 - RNA, 24 nt, Human
acagagcaagacuccaccucaaaa

SEQ ID NO: 443100 - RNA, 24 nt, Human
acagcacuccagccugggugacag

SEQ ID NO: 443101 - RNA, 26 nt, Human
acagcacuccagccugggugacagag

SEQ ID NO: 443102 - RNA, 20 nt, Human
acaguauggaagcaggaggc

SEQ ID NO: 443103 - RNA, 20 nt, Human
accacaaaaaaacacaaaag

SEQ ID NO: 443104 - RNA, 23 nt, Human
acccugucucuacuaaacauaca

SEQ ID NO: 443105 - RNA, 24 nt, Human
acccugucucuacuaaacauacaa

SEQ ID NO: 443106 - RNA, 18 nt, Human
agaagucuguggugcuaa

SEQ ID NO: 443107 - RNA, 19 nt, Human
agacaggagaaaugcuuga

SEQ ID NO: 443108 - RNA, 24 nt, Human
agacaggagaaaugcuugaacccg

SEQ ID NO: 443109 - RNA, 25 nt, Human
agacaggagaaaugcuugaacccgg

SEQ ID NO: 443110 - RNA, 22 nt, Human
agagguugcagugagccgagau

SEQ ID NO: 443111 - RNA, 24 nt, Human
agagguugcagugagccgagauug

SEQ ID NO: 443112 - RNA, 18 nt, Human
agcagugucaauaggaau

SEQ ID NO: 443113 - RNA, 22 nt, Human
agccuggccaacauggugaaac

SEQ ID NO: 443114 - RNA, 24 nt, Human
agccugggugacagagcaagacuc

SEQ ID NO: 443115 - RNA, 23 nt, Human
agcugggcaugguggugggugcc

SEQ ID NO: 443116 - RNA, 25 nt, Human
aggaaucccuucccuauuccaugcc

SEQ ID NO: 443117 - RNA, 22 nt, Human
aggcagggccccucacaucugc

SEQ ID NO: 443118 - RNA, 21 nt, Human
aggccaaggcggguagaucac

SEQ ID NO: 443119 - RNA, 22 nt, Human
aggcggguagaucacuugaggg

SEQ ID NO: 443120 - RNA, 23 nt, Human
aggcggguagaucacuugagguc

SEQ ID NO: 443121 - RNA, 24 nt, Human
aggcugagacaggagaaaugcuug

SEQ ID NO: 443122 - RNA, 24 nt, Human
agggcacaggaccucagaagucug

SEQ ID NO: 443123 - RNA, 20 nt, Human
auacaacaauuagcugggca

SEQ ID NO: 443124 - RNA, 21 nt, Human
aucauggagcuuucaagagug

SEQ ID NO: 443125 - RNA, 24 nt, Human
augcuugaacccgggaagcagagg

SEQ ID NO: 443126 - RNA, 23 nt, Human
auggaggcagcucaucauucaca

SEQ ID NO: 443127 - RNA, 20 nt, Human
auuagcugggcauggugguc

SEQ ID NO: 443128 - RNA, 19 nt, Human
auucaccuacacuucccuc

SEQ ID NO: 443129 - RNA, 24 nt, Human
auugcaccacagcacuccagccug

SEQ ID NO: 443130 - RNA, 19 nt, Human
caaaaaaaaaaaccacaaa

SEQ ID NO: 443131 - RNA, 22 nt, Human
caaaaaaaaaaaccacaaaaaa

SEQ ID NO: 443132 - RNA, 19 nt, Human
caaaaaaacacaaaaggau

SEQ ID NO: 443133 - RNA, 18 nt, Human
caacacagcaacaaaccu

SEQ ID NO: 443134 - RNA, 27 nt, Human
caacacagcaacaaaccuucugcucuc

SEQ ID NO: 443135 - RNA, 24 nt, Human
caacauggugaaacccugucucua

SEQ ID NO: 443136 - RNA, 20 nt, Human
caagaggggcccaggcugga

SEQ ID NO: 443137 - RNA, 21 nt, Human
caaggcggguagaucacuuga

SEQ ID NO: 443138 - RNA, 19 nt, Human
cacaacacagcaacaaacc

SEQ ID NO: 443139 - RNA, 20 nt, Human
cacaacacagcaacaaaccu

SEQ ID NO: 443140 - RNA, 24 nt, Human
cacaccuguaaugccagcacuuug

SEQ ID NO: 443141 - RNA, 24 nt, Human
cacagcaacaaaccuucugcucuc

SEQ ID NO: 443142 - RNA, 24 nt, Human
cacagcacuccagccugggugaca

SEQ ID NO: 443143 - RNA, 19 nt, Human
caccacagaaagaacauuu

SEQ ID NO: 443144 - RNA, 19 nt, Human
caccacagcacuccagccu

SEQ ID NO: 443145 - RNA, 23 nt, Human
cacccccagaucugaagggccag

SEQ ID NO: 443146 - RNA, 20 nt, Human
cacccucucagaccugcccu

SEQ ID NO: 443147 - RNA, 22 nt, Human
caccucaaaaaaaaaaaccaca

SEQ ID NO: 443148 - RNA, 23 nt, Human
caccucaaaaaaaaaaaccacaa

SEQ ID NO: 443149 - RNA, 18 nt, Human
caccugagggaacagagc

SEQ ID NO: 443150 - RNA, 23 nt, Human
caccuguaaugccagcacuuugg

SEQ ID NO: 443151 - RNA, 24 nt, Human
caccuguaaugccagcacuuuggg

SEQ ID NO: 443152 - RNA, 22 nt, Human
cacuccagccugggugacagag

SEQ ID NO: 443153 - RNA, 19 nt, Human
cagaaagaacauuuauggg

SEQ ID NO: 443154 - RNA, 24 nt, Human
cagcacuuugggaggccaaggcgg

SEQ ID NO: 443155 - RNA, 20 nt, Human
cagcaucaggaggcugaggg

SEQ ID NO: 443156 - RNA, 28 nt, Human
cagccagaaggcccaagaggggcccagg

SEQ ID NO: 443157 - RNA, 25 nt, Human
cagccuggccaacauggugaaaccc

SEQ ID NO: 443158 - RNA, 19 nt, Human
cagcgugcgucauguccag

SEQ ID NO: 443159 - RNA, 21 nt, Human
caggaggcccuacuccaccac

SEQ ID NO: 443160 - RNA, 20 nt, Human
cagguggcaguggguucccu

SEQ ID NO: 443161 - RNA, 19 nt, Human
caucagagaacggcaugac

SEQ ID NO: 443162 - RNA, 21 nt, Human
caucaggaggcugaggguccc

SEQ ID NO: 443163 - RNA, 22 nt, Human
caugguggugggugccuguaau

SEQ ID NO: 443164 - RNA, 19 nt, Human
cauguugucagcuuuaacc

SEQ ID NO: 443165 - RNA, 24 nt, Human
ccacaaaaaaacacaaaaggauuc

SEQ ID NO: 443166 - RNA, 18 nt, Human
ccacaccugagaucuagc

SEQ ID NO: 443167 - RNA, 30 nt, Human
ccacacugcccaucucugugcuuaucaugg

SEQ ID NO: 443168 - RNA, 18 nt, Human
ccacagcacuccagccug

SEQ ID NO: 443169 - RNA, 20 nt, Human
ccacagcacuccagccuggg

SEQ ID NO: 443170 - RNA, 21 nt, Human
ccacagcacuccagccugggu

SEQ ID NO: 443171 - RNA, 21 nt, Human
ccacagcacuccagccugggu

SEQ ID NO: 443172 - RNA, 23 nt, Human
ccacagcacuccagccuggguga

SEQ ID NO: 443173 - RNA, 24 nt, Human
ccacagcacuccagccugggugac

SEQ ID NO: 443174 - RNA, 24 nt, Human
ccagaaaaaagaaaauccaacccc

SEQ ID NO: 443175 - RNA, 20 nt, Human
ccagacacaaaguuuccagg

SEQ ID NO: 443176 - RNA, 26 nt, Human
cccaugcgacaguauggaagcaggag

SEQ ID NO: 443177 - RNA, 21 nt, Human
cccucacaucugcaguggccg

SEQ ID NO: 443178 - RNA, 23 nt, Human
ccuacuccaccacagaaagaaca

SEQ ID NO: 443179 - RNA, 21 nt, Human
ccuagugaggagguucuggga

SEQ ID NO: 443180 - RNA, 18 nt, Human
ccucaaaaaaaaaaacca

SEQ ID NO: 443181 - RNA, 24 nt, Human
ccugcccugcaacagcaucaggag

SEQ ID NO: 443182 - RNA, 22 nt, Human
ccuggccaacauggugaaaccc

SEQ ID NO: 443183 - RNA, 24 nt, Human
ccuggccaacauggugaaacccug

SEQ ID NO: 443184 - RNA, 22 nt, Human
ccugggugacagagcaagacuc

SEQ ID NO: 443185 - RNA, 21 nt, Human
ccuguaaucccagcuacuggg

SEQ ID NO: 443186 - RNA, 22 nt, Human
ccuguaaucccagcuacugggg

SEQ ID NO: 443187 - RNA, 20 nt, Human
ccuucuacagacacaggccc

SEQ ID NO: 443188 - RNA, 24 nt, Human
cgggaagcagagguugcagugagc

SEQ ID NO: 443189 - RNA, 24 nt, Human
cgggcccagccuggccaacauggu

SEQ ID NO: 443190 - RNA, 18 nt, Human
cggguagaucacuugagg

SEQ ID NO: 443191 - RNA, 24 nt, Human
cucacaccuguaaugccagcacuu

SEQ ID NO: 443192 - RNA, 22 nt, Human
cuccaccucaaaaaaaaaaacc

SEQ ID NO: 443193 - RNA, 23 nt, Human
cugcugggcacccucucagaccu

SEQ ID NO: 443194 - RNA, 24 nt, Human
cuggccaacauggugaaacccugu

SEQ ID NO: 443195 - RNA, 24 nt, Human
cuucuacagacacaggcccucucc

SEQ ID NO: 443196 - RNA, 18 nt, Human
cuugagguccaggaguuc

SEQ ID NO: 443197 - RNA, 19 nt, Human
gaaacccugucucuacuaa

SEQ ID NO: 443198 - RNA, 21 nt, Human
gaauacaacugggacuaggac

SEQ ID NO: 443199 - RNA, 19 nt, Human
gagaauggcaccugaggga

SEQ ID NO: 443200 - RNA, 20 nt, Human
gagaauguauuuuaaacuug

SEQ ID NO: 443201 - RNA, 21 nt, Human
gagcagugucaauaggaaucc

SEQ ID NO: 443202 - RNA, 20 nt, Human
gaucacuugagguccaggaa

SEQ ID NO: 443203 - RNA, 25 nt, Human
gaucacuugagguccaggaguucgg

SEQ ID NO: 443204 - RNA, 24 nt, Human
gcacuccagccugggugacagagc

SEQ ID NO: 443205 - RNA, 24 nt, Human
gccaacauggugaaacccugucuc

SEQ ID NO: 443206 - RNA, 24 nt, Human
gcccaccuucugacccacacugcc

SEQ ID NO: 443207 - RNA, 19 nt, Human
gcccaucucugugcuuauc

SEQ ID NO: 443208 - RNA, 22 nt, Human
gccuugcuugucuuugcuuguc

SEQ ID NO: 443209 - RNA, 20 nt, Human
ggaagcagagguugcaguga

SEQ ID NO: 443210 - RNA, 20 nt, Human
ggagaagaggcagcccugcu

SEQ ID NO: 443211 - RNA, 21 nt, Human
ggcacccucucagaccugccc

SEQ ID NO: 443212 - RNA, 22 nt, Human
ggcauguugacucccuacugag

SEQ ID NO: 443213 - RNA, 22 nt, Human
ggccgggcacgguggcucacag

SEQ ID NO: 443214 - RNA, 24 nt, Human
gggcacgguggcucacaccuguaa

SEQ ID NO: 443215 - RNA, 24 nt, Human
gggcaugguggugggugccuguaa

SEQ ID NO: 443216 - RNA, 23 nt, Human
ggugccuguaaucccagcuacug

SEQ ID NO: 443217 - RNA, 24 nt, Human
gguggcucacaccuguaaugccag

SEQ ID NO: 443218 - RNA, 21 nt, Human
ggugggugccuguaaucccag

SEQ ID NO: 443219 - RNA, 24 nt, Human
gguggugggugccuguaaucccag

SEQ ID NO: 443220 - RNA, 21 nt, Human
guccaggaguucgggcccagc

SEQ ID NO: 443221 - RNA, 19 nt, Human
guugcagugagccgagauu

SEQ ID NO: 443222 - RNA, 21 nt, Human
guugcagugagccgagauugc

SEQ ID NO: 443223 - RNA, 21 nt, Human
uaaccuucuacagacacaggc

SEQ ID NO: 443224 - RNA, 19 nt, Human
uacaacaauuagcugggca

SEQ ID NO: 443225 - RNA, 23 nt, Human
uacaacugggacuaggacaaugc

SEQ ID NO: 443226 - RNA, 21 nt, Human
uacugaggaaggcagggcccc

SEQ ID NO: 443227 - RNA, 23 nt, Human
uagagccagcgggugacucuggu

SEQ ID NO: 443228 - RNA, 25 nt, Human
uagaucacuugagguccaggaguuc

SEQ ID NO: 443229 - RNA, 25 nt, Human
uaucauggagcuuucaagagugagg

SEQ ID NO: 443230 - RNA, 23 nt, Human
uaugggcgccuaagcccugggag

SEQ ID NO: 443231 - RNA, 24 nt, Human
ucaaugcagucccuaacccuuggg

SEQ ID NO: 443232 - RNA, 22 nt, Human
ucaccacacccccagaucugaa

SEQ ID NO: 443233 - RNA, 24 nt, Human
ucacuugagguccaggaguucggg

SEQ ID NO: 443234 - RNA, 23 nt, Human
ucagaccugcccugcaacagcau

SEQ ID NO: 443235 - RNA, 19 nt, Human
ucaguagagccagcgggug

SEQ ID NO: 443236 - RNA, 18 nt, Human
ucaugaggagaauguauu

SEQ ID NO: 443237 - RNA, 19 nt, Human
uccacaggaagcggcccac

SEQ ID NO: 443238 - RNA, 19 nt, Human
uccaccacagaaagaacau

SEQ ID NO: 443239 - RNA, 19 nt, Human
uccagaagcuggcccaggu

SEQ ID NO: 443240 - RNA, 24 nt, Human
uccagccugggugacagagcaaga

SEQ ID NO: 443241 - RNA, 20 nt, Human
uccaugccaaacagucuucc

SEQ ID NO: 443242 - RNA, 18 nt, Human
uccccagccagaaggccc

SEQ ID NO: 443243 - RNA, 28 nt, Human
ucuauucaccuacacuucccucuuccaa

SEQ ID NO: 443244 - RNA, 24 nt, Human
ucucuacuaaacauacaacaauua

SEQ ID NO: 443245 - RNA, 21 nt, Human
ucugacccacacugcccaucu

SEQ ID NO: 443246 - RNA, 20 nt, Human
ucugcccuuacuugccacuc

SEQ ID NO: 443247 - RNA, 21 nt, Human
ucuggguguaacaaucucagu

SEQ ID NO: 443248 - RNA, 25 nt, Human
ucuuaaggacucuauuucaggccaa

SEQ ID NO: 443249 - RNA, 19 nt, Human
ugaauguacugaaaugucu

SEQ ID NO: 443250 - RNA, 21 nt, Human
ugacaucagggguuuugauau

SEQ ID NO: 443251 - RNA, 24 nt, Human
ugagacaggagaaaugcuugaacc

SEQ ID NO: 443252 - RNA, 22 nt, Human
ugagccgagauugcaccacagc

SEQ ID NO: 443253 - RNA, 23 nt, Human
ugcaacagcaucaggaggcugag

SEQ ID NO: 443254 - RNA, 19 nt, Human
ugccagaaaaaagaaaauc

SEQ ID NO: 443255 - RNA, 22 nt, Human
ugccuguaaucccagcuacugg

SEQ ID NO: 443256 - RNA, 23 nt, Human
ugccuguaaucccagcuacuggg

SEQ ID NO: 443257 - RNA, 21 nt, Human
uggaaaacaagguggcccuga

SEQ ID NO: 443258 - RNA, 19 nt, Human
uggaggcagcucaucauuc

SEQ ID NO: 443259 - RNA, 22 nt, Human
uggcauguguggguguguggug

SEQ ID NO: 443260 - RNA, 24 nt, Human
uggccaacauggugaaacccuguc

SEQ ID NO: 443261 - RNA, 24 nt, Human
uggcucacaccuguaaugccagca

SEQ ID NO: 443262 - RNA, 18 nt, Human
ugggaagcaggugggccu

SEQ ID NO: 443263 - RNA, 24 nt, Human
ugggacuaggacaaugcgggaagc

SEQ ID NO: 443264 - RNA, 19 nt, Human
ugggagaauggcaccugag

SEQ ID NO: 443265 - RNA, 24 nt, Human
ugggaggccaaggcggguagauca

SEQ ID NO: 443266 - RNA, 19 nt, Human
ugggcacaaaccacaggga

SEQ ID NO: 443267 - RNA, 25 nt, Human
uggguucccuauggaggcagcucau

SEQ ID NO: 443268 - RNA, 22 nt, Human
uggugggugccuguaaucccag

SEQ ID NO: 443269 - RNA, 24 nt, Human
uggugggugccuguaaucccagcu

SEQ ID NO: 443270 - RNA, 24 nt, Human
ugguggugggugccuguaauccca

SEQ ID NO: 443271 - RNA, 20 nt, Human
ugucugccagaaaaaagaag

SEQ ID NO: 443272 - RNA, 19 nt, Human
ugugugggugugugguggg

SEQ ID NO: 443273 - RNA, 24 nt, Human
uuaaccuucuacagacacaggccc

SEQ ID NO: 443274 - RNA, 24 nt, Human
uuagcugggcaugguggugggugc

SEQ ID NO: 443275 - RNA, 18 nt, Human
uucagcaaaugugagaga

SEQ ID NO: 443276 - RNA, 22 nt, Human
uuccccagacacaaaguuucca

SEQ ID NO: 443277 - RNA, 18 nt, Human
uugcagugagccgagauu

SEQ ID NO: 443278 - RNA, 19 nt, Human
uugcagugagccgagauug

SEQ ID NO: 443279 - RNA, 22 nt, Human
uugcagugagccgagauugcac

SEQ ID NO: 443280 - RNA, 21 nt, Human
uugccagccacgguucucucc

SEQ ID NO: 443281 - RNA, 19 nt, Human
aacucgagggcuccuucuc

SEQ ID NO: 443282 - RNA, 20 nt, Human
accccucccucuccaguucc

SEQ ID NO: 443283 - RNA, 22 nt, Human
accccucccucuccaguuccag

SEQ ID NO: 443284 - RNA, 18 nt, Human
accgcagaccccucccuc

SEQ ID NO: 443285 - RNA, 20 nt, Human
cacagggcagcucccacagc

SEQ ID NO: 443286 - RNA, 21 nt, Human
cacgguaacucgagggcuccu

SEQ ID NO: 443287 - RNA, 22 nt, Human
cagggcagcucccacagcuccc

SEQ ID NO: 443288 - RNA, 26 nt, Human
cccacgguaacucgagggcuccuucu

SEQ ID NO: 443289 - RNA, 25 nt, Human
ccgcagaccccucccucuccaguuc

SEQ ID NO: 443290 - RNA, 18 nt, Human
cgccccgcccacagaucg

SEQ ID NO: 443291 - RNA, 20 nt, Human
gagccaucggccggcagggu

SEQ ID NO: 443292 - RNA, 21 nt, Human
gcaggguucgccccgcccaca

SEQ ID NO: 443293 - RNA, 20 nt, Human
ggauuuccagcgccgcgucc

SEQ ID NO: 443294 - RNA, 20 nt, Human
uagguccuccgccggauuuc

SEQ ID NO: 443295 - RNA, 23 nt, Human
ucccucuccaguuccagccuuaa

SEQ ID NO: 443296 - RNA, 24 nt, Human
ucgccccgcccacagaucgcuccc

SEQ ID NO: 443297 - RNA, 21 nt, Human
ucguccugaugugggagccau

SEQ ID NO: 443298 - RNA, 23 nt, Human
ucuccaguuccagccuuaauucc

SEQ ID NO: 443299 - RNA, 19 nt, Human
ugaccgcagaccccucccu

SEQ ID NO: 443300 - RNA, 25 nt, Human
aaaacagacaaauuuuacagccaaa

SEQ ID NO: 443301 - RNA, 23 nt, Human
aaacauauaaaccacacuuguaa

SEQ ID NO: 443302 - RNA, 24 nt, Human
aaaccauacacuacauuccaaagc

SEQ ID NO: 443303 - RNA, 20 nt, Human
aacuuaguucaacacugauc

SEQ ID NO: 443304 - RNA, 21 nt, Human
acauuccaaagccaaauauga

SEQ ID NO: 443305 - RNA, 24 nt, Human
cauacacuacauuccaaagccaaa

SEQ ID NO: 443306 - RNA, 20 nt, Human
ccaugaguucuuuuuacuuu

SEQ ID NO: 443307 - RNA, 19 nt, Human
ccgccgccgcccgcgaugc

SEQ ID NO: 443308 - RNA, 30 nt, Human
cgccgccgccgcccgcgaugccgccgccgg

SEQ ID NO: 443309 - RNA, 24 nt, Human
cuaccaaaaaccauacacuacauu

SEQ ID NO: 443310 - RNA, 20 nt, Human
cugaguuaaagguuagggau

SEQ ID NO: 443311 - RNA, 22 nt, Human
cugaguuuucaaaauaagaaua

SEQ ID NO: 443312 - RNA, 19 nt, Human
uaacaguuaucuauaauaa

SEQ ID NO: 443313 - RNA, 23 nt, Human
uaguucaacacugaucuaagcaa

SEQ ID NO: 443314 - RNA, 18 nt, Human
ucagucccucuacacacu

SEQ ID NO: 443315 - RNA, 23 nt, Human
uccuacaacuguuagugugugcu

SEQ ID NO: 443316 - RNA, 21 nt, Human
ugagauuaucaauuucauguc

SEQ ID NO: 443317 - RNA, 20 nt, Human
uggaaaacagacaaauuuua

SEQ ID NO: 443318 - RNA, 19 nt, Human
uuagcuagcacuagaguaa

SEQ ID NO: 443319 - RNA, 19 nt, Human
uucauuagaaguaccauga

SEQ ID NO: 443320 - RNA, 20 nt, Human
aagaagacggcgaaagucgg

SEQ ID NO: 443321 - RNA, 19 nt, Human
acugcaguccuuccugcau

SEQ ID NO: 443322 - RNA, 22 nt, Human
agcucggaccgcgggaaacccg

SEQ ID NO: 443323 - RNA, 21 nt, Human
aggcuggaaaagaaacgacug

SEQ ID NO: 443324 - RNA, 19 nt, Human
aguuugguuuguaaguucu

SEQ ID NO: 443325 - RNA, 18 nt, Human
caaacugccaccuuggcc

SEQ ID NO: 443326 - RNA, 23 nt, Human
cagauucagaguccgaaggccag

SEQ ID NO: 443327 - RNA, 26 nt, Human
cagccaguuucucagaauaaaaguuu

SEQ ID NO: 443328 - RNA, 19 nt, Human
ccccgcccugcggccccgg

SEQ ID NO: 443329 - RNA, 22 nt, Human
ccgcccugcggccccggaacaa

SEQ ID NO: 443330 - RNA, 22 nt, Human
ggaaggaaguuguagauugcuu

SEQ ID NO: 443331 - RNA, 22 nt, Human
uaccacagaaaggcugggccca

SEQ ID NO: 443332 - RNA, 25 nt, Human
uggaaaagaaacgacuguccucccg

SEQ ID NO: 443333 - RNA, 24 nt, Human
uugcuuccuucaugucacuuucuu

SEQ ID NO: 443334 - RNA, 22 nt, Human
uuuguaaguucugauccacugc

SEQ ID NO: 443335 - RNA, 23 nt, Human
aaaaguuaugacaagggauggcu

SEQ ID NO: 443336 - RNA, 23 nt, Human
aaacucccggccucaagcaaucc

SEQ ID NO: 443337 - RNA, 22 nt, Human
aaagacaaggucucgcucuguu

SEQ ID NO: 443338 - RNA, 21 nt, Human
aaaggcaccaaauacugaaaa

SEQ ID NO: 443339 - RNA, 23 nt, Human
aaaggcaccaaauacugaaaagg

SEQ ID NO: 443340 - RNA, 19 nt, Human
aaagugcugggauuacugg

SEQ ID NO: 443341 - RNA, 24 nt, Human
aaagugcugggauuacuggcguga

SEQ ID NO: 443342 - RNA, 18 nt, Human
aagcaauccuccugcuuc

SEQ ID NO: 443343 - RNA, 30 nt, Human
aagcuugcuccccaaccuucacuggcuacc

SEQ ID NO: 443344 - RNA, 25 nt, Human
aagugauccucccaccucagccucc

SEQ ID NO: 443345 - RNA, 26 nt, Human
aagugcugggauuacuggcgugagcc

SEQ ID NO: 443346 - RNA, 21 nt, Human
accacccagccuucuuaucau

SEQ ID NO: 443347 - RNA, 19 nt, Human
accucagccucccuaguag

SEQ ID NO: 443348 - RNA, 18 nt, Human
acuccagccugcucuugc

SEQ ID NO: 443349 - RNA, 22 nt, Human
agagcacagggcccgaggagcc

SEQ ID NO: 443350 - RNA, 20 nt, Human
aggcacacaccaccaaugcc

SEQ ID NO: 443351 - RNA, 21 nt, Human
aggcucaagugauccucccac

SEQ ID NO: 443352 - RNA, 19 nt, Human
agguggaggagaggcuugc

SEQ ID NO: 443353 - RNA, 23 nt, Human
agugcaguagcacaaucauggcu

SEQ ID NO: 443354 - RNA, 18 nt, Human
aucauggcucacugcagc

SEQ ID NO: 443355 - RNA, 24 nt, Human
caaagugcugggauuacuggcgug

SEQ ID NO: 443356 - RNA, 21 nt, Human
caacggcuuuuccuggagucc

SEQ ID NO: 443357 - RNA, 22 nt, Human
caagcaauccuccugcuucagc

SEQ ID NO: 443358 - RNA, 27 nt, Human
caagcaauccuccugcuucagcccucc

SEQ ID NO: 443359 - RNA, 18 nt, Human
caagcaguagauagugag

SEQ ID NO: 443360 - RNA, 20 nt, Human
caagugauccucccaccuca

SEQ ID NO: 443361 - RNA, 27 nt, Human
caagugauccucccaccucagccuccc

SEQ ID NO: 443362 - RNA, 23 nt, Human
caauccuccugcuucagcccucc

SEQ ID NO: 443363 - RNA, 20 nt, Human
cagccucagucccccaggcu

SEQ ID NO: 443364 - RNA, 24 nt, Human
cagccucagucccccaggcucaag

SEQ ID NO: 443365 - RNA, 22 nt, Human
cagccugcucuugcuucucucc

SEQ ID NO: 443366 - RNA, 24 nt, Human
caggaagucagaggauggucaagc

SEQ ID NO: 443367 - RNA, 23 nt, Human
cauguugcccaggcuggucucaa

SEQ ID NO: 443368 - RNA, 24 nt, Human
cauguugcccaggcuggucucaaa

SEQ ID NO: 443369 - RNA, 23 nt, Human
cauuccugccccuagucuugggg

SEQ ID NO: 443370 - RNA, 22 nt, Human
ccaaagugcugggauuacuggc

SEQ ID NO: 443371 - RNA, 22 nt, Human
ccaaagugcugggauuacuggc

SEQ ID NO: 443372 - RNA, 24 nt, Human
ccaaagugcugggauuacuggcgu

SEQ ID NO: 443373 - RNA, 20 nt, Human
ccaaccuucacuggcuacgc

SEQ ID NO: 443374 - RNA, 22 nt, Human
cccaggcucaagugauccuccc

SEQ ID NO: 443375 - RNA, 24 nt, Human
ccccauguugcccaggcuggucuc

SEQ ID NO: 443376 - RNA, 27 nt, Human
ccccauguugcccaggcuggucucaaa

SEQ ID NO: 443377 - RNA, 25 nt, Human
cccccaggcucaagugauccuccca

SEQ ID NO: 443378 - RNA, 18 nt, Human
cccggccucaagcaaucc

SEQ ID NO: 443379 - RNA, 20 nt, Human
cccggccucaagcaauccuc

SEQ ID NO: 443380 - RNA, 24 nt, Human
cccuaguaguugggacuauaggca

SEQ ID NO: 443381 - RNA, 18 nt, Human
cccuggcuguccaggccu

SEQ ID NO: 443382 - RNA, 22 nt, Human
ccucacaagaauacaaaguaga

SEQ ID NO: 443383 - RNA, 25 nt, Human
ccucacaagaauacaaaguagagac

SEQ ID NO: 443384 - RNA, 24 nt, Human
ccucccaccucagccucccuagua

SEQ ID NO: 443385 - RNA, 22 nt, Human
ccuccugcuucagcccuccaaa

SEQ ID NO: 443386 - RNA, 26 nt, Human
ccuccugcuucagcccuccaaagugc

SEQ ID NO: 443387 - RNA, 19 nt, Human
ccuggagucccccucccuc

SEQ ID NO: 443388 - RNA, 25 nt, Human
ccuggagucccccucccucuuuccc

SEQ ID NO: 443389 - RNA, 20 nt, Human
cggccucaagcaauccuccu

SEQ ID NO: 443390 - RNA, 24 nt, Human
cggccucaagcaauccuccugcuu

SEQ ID NO: 443391 - RNA, 24 nt, Human
cucaagcaauccuccugcuucagc

SEQ ID NO: 443392 - RNA, 24 nt, Human
cucaagugauccucccaccucagc

SEQ ID NO: 443393 - RNA, 19 nt, Human
cucacugcagccucagucc

SEQ ID NO: 443394 - RNA, 22 nt, Human
cucccaccucagccucccuaau

SEQ ID NO: 443395 - RNA, 26 nt, Human
cuggagucccccucccucuuucccgc

SEQ ID NO: 443396 - RNA, 24 nt, Human
cugggucuccccauguugcccagg

SEQ ID NO: 443397 - RNA, 24 nt, Human
cuucuuaucauuccugccccuagu

SEQ ID NO: 443398 - RNA, 23 nt, Human
gaagguggaggagaggcuugcag

SEQ ID NO: 443399 - RNA, 18 nt, Human
gagccccuggcuguccag

SEQ ID NO: 443400 - RNA, 20 nt, Human
gagucccccucccucuuucc

SEQ ID NO: 443401 - RNA, 18 nt, Human
gauuacuggcgugagcca

SEQ ID NO: 443402 - RNA, 21 nt, Human
gauuacuggcgugagccacug

SEQ ID NO: 443403 - RNA, 24 nt, Human
gauuacuggcgugagccacugugc

SEQ ID NO: 443404 - RNA, 19 nt, Human
gcccaggaagucagaggau

SEQ ID NO: 443405 - RNA, 25 nt, Human
gcgaagcagacauagaaugggccuu

SEQ ID NO: 443406 - RNA, 23 nt, Human
gcuggucucaaacucccggccuc

SEQ ID NO: 443407 - RNA, 22 nt, Human
gcuguccaggccugaaggcagu

SEQ ID NO: 443408 - RNA, 19 nt, Human
ggaggagaggcuugcagag

SEQ ID NO: 443409 - RNA, 24 nt, Human
gugauccucccaccucagccuccc

SEQ ID NO: 443410 - RNA, 28 nt, Human
gugaugguccucucaacggcuuuuccuu

SEQ ID NO: 443411 - RNA, 19 nt, Human
guucauuggugcccucccc

SEQ ID NO: 443412 - RNA, 25 nt, Human
uaaaggcaccaaauacugaaaaggc

SEQ ID NO: 443413 - RNA, 27 nt, Human
uaaaggcaccaaauacugaaaaggccg

SEQ ID NO: 443414 - RNA, 19 nt, Human
uacaaaguagagacuccag

SEQ ID NO: 443415 - RNA, 24 nt, Human
uacuggcgugagccacugugcccg

SEQ ID NO: 443416 - RNA, 19 nt, Human
uacugugcuguucauuggu

SEQ ID NO: 443417 - RNA, 23 nt, Human
uagcacaaucauggcucacugca

SEQ ID NO: 443418 - RNA, 18 nt, Human
uaggggcccaggaaguca

SEQ ID NO: 443419 - RNA, 22 nt, Human
uaggugggacaucccagcuacc

SEQ ID NO: 443420 - RNA, 24 nt, Human
uaguaguugggacuauaggcacac

SEQ ID NO: 443421 - RNA, 25 nt, Human
ucaaaaguuaugacaagggauggcu

SEQ ID NO: 443422 - RNA, 25 nt, Human
ucaacggcuuuuccuggaguccccc

SEQ ID NO: 443423 - RNA, 24 nt, Human
ucacugcagccucagucccccagg

SEQ ID NO: 443424 - RNA, 21 nt, Human
ucccaccucagccucccuagu

SEQ ID NO: 443425 - RNA, 21 nt, Human
ucccagcuaccacccagccuu

SEQ ID NO: 443426 - RNA, 21 nt, Human
ucccccucccucuuucccgca

SEQ ID NO: 443427 - RNA, 24 nt, Human
ucccuaguaguugggacuauaggc

SEQ ID NO: 443428 - RNA, 20 nt, Human
uccuggagucccccucccuc

SEQ ID NO: 443429 - RNA, 23 nt, Human
ucuccccauguugcccaggcugg

SEQ ID NO: 443430 - RNA, 18 nt, Human
ucucgcucuguugccaga

SEQ ID NO: 443431 - RNA, 23 nt, Human
ucucgcucuguugccagauugga

SEQ ID NO: 443432 - RNA, 23 nt, Human
ucuguugccagauuggagugcag

SEQ ID NO: 443433 - RNA, 21 nt, Human
ugcccaggcuggucucaaacu

SEQ ID NO: 443434 - RNA, 24 nt, Human
ugccccuagucuuggggugaaggu

SEQ ID NO: 443435 - RNA, 23 nt, Human
ugccuggcuuuuuaaauuuuuuu

SEQ ID NO: 443436 - RNA, 18 nt, Human
ugcucagguugugauggu

SEQ ID NO: 443437 - RNA, 18 nt, Human
ugcuucucuccccaggca

SEQ ID NO: 443438 - RNA, 24 nt, Human
uggagugcaguagcacaaucaugg

SEQ ID NO: 443439 - RNA, 23 nt, Human
uggcgugagccacugugcccggu

SEQ ID NO: 443440 - RNA, 21 nt, Human
ugggacuauaggcacacacca

SEQ ID NO: 443441 - RNA, 24 nt, Human
ugggacuauaggcacacaccacca

SEQ ID NO: 443442 - RNA, 22 nt, Human
ugggauuacuggcgugagccac

SEQ ID NO: 443443 - RNA, 22 nt, Human
ugggauuacuggcgugagccac

SEQ ID NO: 443444 - RNA, 22 nt, Human
ugggauuacuggcgugagccac

SEQ ID NO: 443445 - RNA, 24 nt, Human
ugggauuacuggcgugagccacug

SEQ ID NO: 443446 - RNA, 23 nt, Human
ugggucuccccauguugcccagg

SEQ ID NO: 443447 - RNA, 24 nt, Human
uguagagacugggucuccccaugu

SEQ ID NO: 443448 - RNA, 21 nt, Human
uucagcccuccaaagugcugg

SEQ ID NO: 443449 - RNA, 21 nt, Human
uuccuggagucccccucccuc

SEQ ID NO: 443450 - RNA, 23 nt, Human
uuguaaagauguuuuuauuuuua

SEQ ID NO: 443451 - RNA, 27 nt, Human
uuuccuggagucccccucccucuuucc

SEQ ID NO: 443452 - RNA, 20 nt, Human
uuuccuggccaguauuuuuc

SEQ ID NO: 443453 - RNA, 18 nt, Human
uuuuuuuuuuuuuuguug

SEQ ID NO: 443454 - RNA, 19 nt, Human
uuuuuuuuuuuuuuuuguu

SEQ ID NO: 443455 - RNA, 24 nt, Human
aaaaaaaagacaauuuacaaagaa

SEQ ID NO: 443456 - RNA, 20 nt, Human
aaaaauagagaauccagacc

SEQ ID NO: 443457 - RNA, 23 nt, Human
aaaucaaaauagcuuucugcugg

SEQ ID NO: 443458 - RNA, 20 nt, Human
aacaugauggccacacagaa

SEQ ID NO: 443459 - RNA, 18 nt, Human
aagcagaaaaaaaaagac

SEQ ID NO: 443460 - RNA, 19 nt, Human
aagcagaaaaaaaaagaca

SEQ ID NO: 443461 - RNA, 19 nt, Human
acccuuuaaauaaggcagu

SEQ ID NO: 443462 - RNA, 27 nt, Human
agaaaaaaaaagacaauuuacaaagaa

SEQ ID NO: 443463 - RNA, 26 nt, Human
agugaaagagcagcaguuucaaaaga

SEQ ID NO: 443464 - RNA, 18 nt, Human
caaaagacacguccacuc

SEQ ID NO: 443465 - RNA, 20 nt, Human
caaaauagcuuucugcuggc

SEQ ID NO: 443466 - RNA, 24 nt, Human
caacuguauaaaacucgagaauau

SEQ ID NO: 443467 - RNA, 24 nt, Human
cacacagaaaacaguaaagacacu

SEQ ID NO: 443468 - RNA, 18 nt, Human
cagaaaacaguaaagaca

SEQ ID NO: 443469 - RNA, 22 nt, Human
gaauuucuaacucuguagaucu

SEQ ID NO: 443470 - RNA, 22 nt, Human
guccagaaugaauaagcaguuc

SEQ ID NO: 443471 - RNA, 21 nt, Human
uaaaauacaagcaaucaggac

SEQ ID NO: 443472 - RNA, 20 nt, Human
ucaaaagacacguccacucc

SEQ ID NO: 443473 - RNA, 25 nt, Human
ucgagaauaugaguauuuagguggu

SEQ ID NO: 443474 - RNA, 18 nt, Human
ucggugacgccugagaag

SEQ ID NO: 443475 - RNA, 20 nt, Human
ucugaagcagaaaaaaaaag

SEQ ID NO: 443476 - RNA, 19 nt, Human
ucuguagaucuaaaacaca

SEQ ID NO: 443477 - RNA, 24 nt, Human
ugaaagagcagcaguuucaaaaga

SEQ ID NO: 443478 - RNA, 19 nt, Human
ugaagcagaaaaaaaaaga

SEQ ID NO: 443479 - RNA, 20 nt, Human
ugcaguagcugccggcggcc

SEQ ID NO: 443480 - RNA, 18 nt, Human
ugcugagcucucggugac

SEQ ID NO: 443481 - RNA, 23 nt, Human
uuccuuaugcuguuauuucaaaa

SEQ ID NO: 443482 - RNA, 22 nt, Human
uugcaguagcugccggcggcug

SEQ ID NO: 443483 - RNA, 24 nt, Human
uuuuuuuuuuuuuuuuuuuuccag

SEQ ID NO: 443484 - RNA, 22 nt, Human
aaggucccggggcccucggcgu

SEQ ID NO: 443485 - RNA, 21 nt, Human
aaguagcuuggaggcugaagu

SEQ ID NO: 443486 - RNA, 23 nt, Human
acccuggacccaaauuauugcua

SEQ ID NO: 443487 - RNA, 24 nt, Human
agaagccaaaguagcuugguggga

SEQ ID NO: 443488 - RNA, 19 nt, Human
agaagccuggucccaagac

SEQ ID NO: 443489 - RNA, 20 nt, Human
agagcccuuccaccaggccc

SEQ ID NO: 443490 - RNA, 22 nt, Human
agagcccuuccaccaggcccuu

SEQ ID NO: 443491 - RNA, 20 nt, Human
agagggaggcaggcaggguc

SEQ ID NO: 443492 - RNA, 22 nt, Human
agccagcaccggccgguagaca

SEQ ID NO: 443493 - RNA, 29 nt, Human
agcucccccaggcugagaaccccaucggu

SEQ ID NO: 443494 - RNA, 20 nt, Human
aggaggagacaagcccuggu

SEQ ID NO: 443495 - RNA, 19 nt, Human
aggcagaagccaaaguagc

SEQ ID NO: 443496 - RNA, 20 nt, Human
aggcaggcagggucccgggg

SEQ ID NO: 443497 - RNA, 21 nt, Human
aggcagggucccggggcccuc

SEQ ID NO: 443498 - RNA, 22 nt, Human
aggcggccagauggccugaagc

SEQ ID NO: 443499 - RNA, 18 nt, Human
agggaggcaggcaggguc

SEQ ID NO: 443500 - RNA, 22 nt, Human
agggucccggggcccucggcgu

SEQ ID NO: 443501 - RNA, 22 nt, Human
caaacaauaaaauacagggaua

SEQ ID NO: 443502 - RNA, 18 nt, Human
caacggggcacccagcuc

SEQ ID NO: 443503 - RNA, 20 nt, Human
caagacagcaggaagaaagc

SEQ ID NO: 443504 - RNA, 19 nt, Human
caccggccgguagacaccc

SEQ ID NO: 443505 - RNA, 18 nt, Human
cagcgagcacugcacggu

SEQ ID NO: 443506 - RNA, 22 nt, Human
caggaagaaagccggacccucg

SEQ ID NO: 443507 - RNA, 18 nt, Human
caggaggagacaagcccu

SEQ ID NO: 443508 - RNA, 21 nt, Human
caggcccagccucggaggcaa

SEQ ID NO: 443509 - RNA, 22 nt, Human
cagggaccagaauucagguuuc

SEQ ID NO: 443510 - RNA, 18 nt, Human
caucagcccugcuucugc

SEQ ID NO: 443511 - RNA, 19 nt, Human
ccacccagacagggacggg

SEQ ID NO: 443512 - RNA, 23 nt, Human
cccaucaaugccgcugaacaguu

SEQ ID NO: 443513 - RNA, 21 nt, Human
cccccaggcugagaaccccau

SEQ ID NO: 443514 - RNA, 23 nt, Human
cccugguuuuugcgcugggcugg

SEQ ID NO: 443515 - RNA, 18 nt, Human
ccgguagacacccaggug

SEQ ID NO: 443516 - RNA, 19 nt, Human
ccugaucccugggcugaga

SEQ ID NO: 443517 - RNA, 21 nt, Human
cucaggcccagccucggaggc

SEQ ID NO: 443518 - RNA, 18 nt, Human
cucugugcugggguccca

SEQ ID NO: 443519 - RNA, 22 nt, Human
cugagcaucagcccugcuucug

SEQ ID NO: 443520 - RNA, 21 nt, Human
cuggucccaagacagcaggaa

SEQ ID NO: 443521 - RNA, 24 nt, Human
cuggucccaagacagcaggaagaa

SEQ ID NO: 443522 - RNA, 25 nt, Human
cuucugccgcuggcugaggaggagc

SEQ ID NO: 443523 - RNA, 23 nt, Human
cuuugcgcugggcuggccagucc

SEQ ID NO: 443524 - RNA, 21 nt, Human
gacagcagggaccagaauuca

SEQ ID NO: 443525 - RNA, 18 nt, Human
gagaaguagucacacagu

SEQ ID NO: 443526 - RNA, 24 nt, Human
gaggcaggcagggucccggggccc

SEQ ID NO: 443527 - RNA, 20 nt, Human
gcaaaccaacccaaaagccu

SEQ ID NO: 443528 - RNA, 22 nt, Human
gcagaagccaaaguagcuugga

SEQ ID NO: 443529 - RNA, 19 nt, Human
gcccugagaauggguggga

SEQ ID NO: 443530 - RNA, 22 nt, Human
gcugaggaggagcagaagccug

SEQ ID NO: 443531 - RNA, 23 nt, Human
ggcagaagccaaaguagcuugga

SEQ ID NO: 443532 - RNA, 18 nt, Human
ggccaggucaccuugggg

SEQ ID NO: 443533 - RNA, 18 nt, Human
ggccugaagcccacccag

SEQ ID NO: 443534 - RNA, 19 nt, Human
gggcuggccaguccagaag

SEQ ID NO: 443535 - RNA, 23 nt, Human
gugcuggggucccacccuggggu

SEQ ID NO: 443536 - RNA, 22 nt, Human
uaaauagaaagcaagcagccca

SEQ ID NO: 443537 - RNA, 23 nt, Human
uagacacccaggugcucugagaa

SEQ ID NO: 443538 - RNA, 18 nt, Human
uauugccucugugcuggg

SEQ ID NO: 443539 - RNA, 20 nt, Human
uccaaugcagccagcaccgg

SEQ ID NO: 443540 - RNA, 20 nt, Human
ucccccaggcugagaacccc

SEQ ID NO: 443541 - RNA, 22 nt, Human
ucccugagcaucagcccugcuu

SEQ ID NO: 443542 - RNA, 25 nt, Human
ucccugagcaucagcccugcuucug

SEQ ID NO: 443543 - RNA, 23 nt, Human
ucccugaucccuggggugagagc

SEQ ID NO: 443544 - RNA, 22 nt, Human
ucccugggcugagagcccuucc

SEQ ID NO: 443545 - RNA, 18 nt, Human
ucccuggggugagagccc

SEQ ID NO: 443546 - RNA, 19 nt, Human
uccugagccaggcagaagc

SEQ ID NO: 443547 - RNA, 22 nt, Human
ucgcuaggcggccagauggccu

SEQ ID NO: 443548 - RNA, 23 nt, Human
ucguucagccaggcagggacagc

SEQ ID NO: 443549 - RNA, 24 nt, Human
ugaacaguuccugcagcuccccca

SEQ ID NO: 443550 - RNA, 18 nt, Human
ugaagcccacccagacag

SEQ ID NO: 443551 - RNA, 23 nt, Human
ugacaaacaauaaaauacaggga

SEQ ID NO: 443552 - RNA, 26 nt, Human
ugacaaacaauaaaauacagggauaa

SEQ ID NO: 443553 - RNA, 28 nt, Human
ugagaaugggugggaugagggcaugcaa

SEQ ID NO: 443554 - RNA, 21 nt, Human
ugagaugcccaucaaugccgc

SEQ ID NO: 443555 - RNA, 22 nt, Human
ugaucccugggcugagagcccu

SEQ ID NO: 443556 - RNA, 18 nt, Human
ugcccugggucguucagc

SEQ ID NO: 443557 - RNA, 23 nt, Human
ugcccugggucguucagccaggc

SEQ ID NO: 443558 - RNA, 25 nt, Human
ugccuuuauugccucugugcugggg

SEQ ID NO: 443559 - RNA, 23 nt, Human
ugcuggggucccacccugggguu

SEQ ID NO: 443560 - RNA, 20 nt, Human
uggacccaaauuauugcuac

SEQ ID NO: 443561 - RNA, 19 nt, Human
uggccaggucaccuugggg

SEQ ID NO: 443562 - RNA, 21 nt, Human
uggccugggagggcaacgggg

SEQ ID NO: 443563 - RNA, 21 nt, Human
uggggugagagcccuuccacc

SEQ ID NO: 443564 - RNA, 20 nt, Human
ugggguucagaggccucugg

SEQ ID NO: 443565 - RNA, 22 nt, Human
ugggugggaugagggcaugcaa

SEQ ID NO: 443566 - RNA, 21 nt, Human
uuuuuuuuuuuggaagggacc

SEQ ID NO: 443567 - RNA, 21 nt, Human
uuuuuuuuuuuuuuggaaggg

SEQ ID NO: 443568 - RNA, 18 nt, Human
uuuuuuuuuuuuuuuuug

SEQ ID NO: 443569 - RNA, 24 nt, Human
uuuuuuuuuuuuuuuuuggaaggg

SEQ ID NO: 443570 - RNA, 19 nt, Human
agaaggcgcagcucgggga

SEQ ID NO: 443571 - RNA, 18 nt, Human
aggaccccgcuccccacg

SEQ ID NO: 443572 - RNA, 26 nt, Human
aggcaguucccaaaucgaggccgccu

SEQ ID NO: 443573 - RNA, 21 nt, Human
agggcaggcccaggauggggc

SEQ ID NO: 443574 - RNA, 22 nt, Human
cagccagggcaggcccaggaug

SEQ ID NO: 443575 - RNA, 22 nt, Human
cagccuccaggaccccgcuccc

SEQ ID NO: 443576 - RNA, 18 nt, Human
caggaccaagaaccgcug

SEQ ID NO: 443577 - RNA, 19 nt, Human
caggcaguucccaaaucga

SEQ ID NO: 443578 - RNA, 20 nt, Human
ccccagaaggcgcagcucgg

SEQ ID NO: 443579 - RNA, 21 nt, Human
cccgggccgcguccccagaag

SEQ ID NO: 443580 - RNA, 20 nt, Human
ccggggccauggaggcgaag

SEQ ID NO: 443581 - RNA, 23 nt, Human
ccguagacccugauccgagacuu

SEQ ID NO: 443582 - RNA, 21 nt, Human
ccuccaggaccccgcucccca

SEQ ID NO: 443583 - RNA, 18 nt, Human
cgccucagccccgcgcag

SEQ ID NO: 443584 - RNA, 23 nt, Human
cucagccccgcgcagccuccagg

SEQ ID NO: 443585 - RNA, 23 nt, Human
cuccaggaccccgcuccccacgg

SEQ ID NO: 443586 - RNA, 19 nt, Human
cuggccagccagggcaggc

SEQ ID NO: 443587 - RNA, 26 nt, Human
cuuaggccggcaucuucaggcaguuc

SEQ ID NO: 443588 - RNA, 20 nt, Human
gccucagccccgcgcagccu

SEQ ID NO: 443589 - RNA, 20 nt, Human
gcgcagccuccaggaccccg

SEQ ID NO: 443590 - RNA, 19 nt, Human
ggacggccccgacguagcc

SEQ ID NO: 443591 - RNA, 19 nt, Human
uauauuaggaaaucauaca

SEQ ID NO: 443592 - RNA, 19 nt, Human
uccccagaaggcgcagcuc

SEQ ID NO: 443593 - RNA, 23 nt, Human
uccucggucccguagacccuggc

SEQ ID NO: 443594 - RNA, 21 nt, Human
ugccaaaugcauaagcuuuua

SEQ ID NO: 443595 - RNA, 20 nt, Human
uggaggcgaaggcacagugg

SEQ ID NO: 443596 - RNA, 22 nt, Human
uggcaggcaagggaugaggugg

SEQ ID NO: 443597 - RNA, 24 nt, Human
aaacauauacaaaauuagauauaa

SEQ ID NO: 443598 - RNA, 22 nt, Human
agcuggcuucgccaacggcccc

SEQ ID NO: 443599 - RNA, 19 nt, Human
aucuagggcgagacuauuc

SEQ ID NO: 443600 - RNA, 19 nt, Human
caaccaucauuacuaacug

SEQ ID NO: 443601 - RNA, 22 nt, Human
ccgaaacucagauucucggcac

SEQ ID NO: 443602 - RNA, 19 nt, Human
ccugcaaccaucauuacua

SEQ ID NO: 443603 - RNA, 18 nt, Human
uuuuuuuuuuuuuuuuug

SEQ ID NO: 443604 - RNA, 19 nt, Human
uuuuuuuuuuuuuuuuugu

SEQ ID NO: 443605 - RNA, 20 nt, Human
aaagagguugucggcucccu

SEQ ID NO: 443606 - RNA, 22 nt, Human
aagaugagcagcggugcggucc

SEQ ID NO: 443607 - RNA, 18 nt, Human
acccccacccgcacuccc

SEQ ID NO: 443608 - RNA, 19 nt, Human
acccccuuuucccccaaaa

SEQ ID NO: 443609 - RNA, 18 nt, Human
acccugguucguuccucc

SEQ ID NO: 443610 - RNA, 21 nt, Human
acccugguucguuccuccugg

SEQ ID NO: 443611 - RNA, 19 nt, Human
acccuuuugggcuccgccg

SEQ ID NO: 443612 - RNA, 25 nt, Human
accuuccugcauaacccuggcccug

SEQ ID NO: 443613 - RNA, 22 nt, Human
acuccagcgacccuuggggucg

SEQ ID NO: 443614 - RNA, 22 nt, Human
acugacuccagcgacccuuggg

SEQ ID NO: 443615 - RNA, 23 nt, Human
agaaaggcuggccuugcccaugc

SEQ ID NO: 443616 - RNA, 21 nt, Human
agaggcccuggggcgaccuau

SEQ ID NO: 443617 - RNA, 18 nt, Human
agcggcccugaguugagg

SEQ ID NO: 443618 - RNA, 21 nt, Human
aggacaccuccacccucccug

SEQ ID NO: 443619 - RNA, 19 nt, Human
aggcagggagcugggaggg

SEQ ID NO: 443620 - RNA, 19 nt, Human
aggcgaaagugagcucagg

SEQ ID NO: 443621 - RNA, 21 nt, Human
agggggcuccuggcaggcagg

SEQ ID NO: 443622 - RNA, 18 nt, Human
aggggugcgacaggcagg

SEQ ID NO: 443623 - RNA, 24 nt, Human
agguguggcuguggcccccacggc

SEQ ID NO: 443624 - RNA, 22 nt, Human
aguguuaacugggggugggggc

SEQ ID NO: 443625 - RNA, 20 nt, Human
aucagggcuggaccggggcc

SEQ ID NO: 443626 - RNA, 19 nt, Human
auuggccucgcccgccgcg

SEQ ID NO: 443627 - RNA, 20 nt, Human
caacccucaaacccugguuc

SEQ ID NO: 443628 - RNA, 21 nt, Human
cacccaacccucaaacccugg

SEQ ID NO: 443629 - RNA, 19 nt, Human
cacggcaggggauggagaa

SEQ ID NO: 443630 - RNA, 23 nt, Human
cacuauuuaccacuauuuacacg

SEQ ID NO: 443631 - RNA, 23 nt, Human
cagaaacccgguacagaaacgug

SEQ ID NO: 443632 - RNA, 22 nt, Human
cagaggcagggagcugggaggg

SEQ ID NO: 443633 - RNA, 22 nt, Human
cagaggcccuggggcgaccuau

SEQ ID NO: 443634 - RNA, 18 nt, Human
cagccgagccccucaggc

SEQ ID NO: 443635 - RNA, 18 nt, Human
cagccggcccggcgucug

SEQ ID NO: 443636 - RNA, 19 nt, Human
cagcgacccuuggggucgc

SEQ ID NO: 443637 - RNA, 23 nt, Human
cagcucccagccucccccgccag

SEQ ID NO: 443638 - RNA, 22 nt, Human
caggagccagccagacccaagu

SEQ ID NO: 443639 - RNA, 22 nt, Human
caggcagggggauccguuggcc

SEQ ID NO: 443640 - RNA, 19 nt, Human
caggcccauggggcagcca

SEQ ID NO: 443641 - RNA, 21 nt, Human
caggucccagggccucgggcu

SEQ ID NO: 443642 - RNA, 24 nt, Human
cauaacccuggcccugucaccagc

SEQ ID NO: 443643 - RNA, 29 nt, Human
caucagccucaggacaccuccacccuccu

SEQ ID NO: 443644 - RNA, 20 nt, Human
ccacacccccacccgcacuc

SEQ ID NO: 443645 - RNA, 25 nt, Human
ccacacccccacccgcacucccaca

SEQ ID NO: 443646 - RNA, 20 nt, Human
ccagagccucggguggaggg

SEQ ID NO: 443647 - RNA, 24 nt, Human
ccaugacccccuuuucccccaaaa

SEQ ID NO: 443648 - RNA, 24 nt, Human
cccaaaacaaccugacagccuugc

SEQ ID NO: 443649 - RNA, 22 nt, Human
cccacagcuggggcugagaaug

SEQ ID NO: 443650 - RNA, 21 nt, Human
cccacauggggaaacagaggc

SEQ ID NO: 443651 - RNA, 22 nt, Human
cccacccccacccuuuugggcu

SEQ ID NO: 443652 - RNA, 21 nt, Human
cccagacccagacccggaccc

SEQ ID NO: 443653 - RNA, 21 nt, Human
cccagacccggacccggaggc

SEQ ID NO: 443654 - RNA, 23 nt, Human
cccagccucgccccaccugcggc

SEQ ID NO: 443655 - RNA, 18 nt, Human
cccagggccucgggcuca

SEQ ID NO: 443656 - RNA, 22 nt, Human
ccccaaaacaaccugacagccu

SEQ ID NO: 443657 - RNA, 21 nt, Human
ccccaaguccaaaagcucaga

SEQ ID NO: 443658 - RNA, 25 nt, Human
ccccacccuuuugggcuccgccgga

SEQ ID NO: 443659 - RNA, 18 nt, Human
ccccagccucgccccacc

SEQ ID NO: 443660 - RNA, 18 nt, Human
ccccagcuggcaggcccg

SEQ ID NO: 443661 - RNA, 24 nt, Human
ccccagucacggagacccggcccc

SEQ ID NO: 443662 - RNA, 18 nt, Human
cccccagcuggcaggccc

SEQ ID NO: 443663 - RNA, 20 nt, Human
ccccgccccagcugugcugu

SEQ ID NO: 443664 - RNA, 24 nt, Human
cccggccccugcgagucccacccc

SEQ ID NO: 443665 - RNA, 21 nt, Human
cccucaggcccuucuauaagc

SEQ ID NO: 443666 - RNA, 19 nt, Human
cccuggggcgaccuauggg

SEQ ID NO: 443667 - RNA, 20 nt, Human
cccuggggcgaccuaugggg

SEQ ID NO: 443668 - RNA, 19 nt, Human
cccuuggggucgccccagc

SEQ ID NO: 443669 - RNA, 20 nt, Human
ccgcaaaggcccccagcugg

SEQ ID NO: 443670 - RNA, 21 nt, Human
ccgccccguuuccuccuggac

SEQ ID NO: 443671 - RNA, 19 nt, Human
ccgcccucccccagccucg

SEQ ID NO: 443672 - RNA, 20 nt, Human
ccgccgcggcgccgcccucc

SEQ ID NO: 443673 - RNA, 25 nt, Human
ccggaaggcccccgaaccucccgcc

SEQ ID NO: 443674 - RNA, 24 nt, Human
ccggggcucggccacacccccacc

SEQ ID NO: 443675 - RNA, 24 nt, Human
ccucccacccccacccuuuugggc

SEQ ID NO: 443676 - RNA, 19 nt, Human
ccuuaggacuggcccugga

SEQ ID NO: 443677 - RNA, 18 nt, Human
ccuugccagcgcuccacg

SEQ ID NO: 443678 - RNA, 21 nt, Human
cgaagcagcggacccagaccc

SEQ ID NO: 443679 - RNA, 22 nt, Human
cgcaaaggcccccagcuggcag

SEQ ID NO: 443680 - RNA, 24 nt, Human
cgccggagcgcuugggcuccgggu

SEQ ID NO: 443681 - RNA, 20 nt, Human
cgcgcgccaucagggcugga

SEQ ID NO: 443682 - RNA, 21 nt, Human
cggcgggcgccgucaccuccc

SEQ ID NO: 443683 - RNA, 22 nt, Human
cgggcuccaggucccagggccu

SEQ ID NO: 443684 - RNA, 18 nt, Human
cggggguucugagagugg

SEQ ID NO: 443685 - RNA, 19 nt, Human
cggggugggggugggaggc

SEQ ID NO: 443686 - RNA, 20 nt, Human
cggggugggggugggaggcg

SEQ ID NO: 443687 - RNA, 21 nt, Human
cggugaggcgcgaggucgccg

SEQ ID NO: 443688 - RNA, 20 nt, Human
cggugagguguggcuguggc

SEQ ID NO: 443689 - RNA, 21 nt, Human
cuagcggccgccccguuuccu

SEQ ID NO: 443690 - RNA, 30 nt, Human
cucacagcggcccugaguugaggacagcuu

SEQ ID NO: 443691 - RNA, 22 nt, Human
cucagggcugggccaggacgcc

SEQ ID NO: 443692 - RNA, 24 nt, Human
cuccagcaccugcuggguggcaca

SEQ ID NO: 443693 - RNA, 21 nt, Human
cuccaggucccagggccucgg

SEQ ID NO: 443694 - RNA, 21 nt, Human
cugagagugguggggcucggg

SEQ ID NO: 443695 - RNA, 22 nt, Human
cugcagggugugggcccggagc

SEQ ID NO: 443696 - RNA, 27 nt, Human
cugcuggguggcacaccucggugacuu

SEQ ID NO: 443697 - RNA, 19 nt, Human
cuggacugggcggugaggu

SEQ ID NO: 443698 - RNA, 20 nt, Human
cuggcccuggagcauugggg

SEQ ID NO: 443699 - RNA, 24 nt, Human
cuguccccuucuggagcacagcug

SEQ ID NO: 443700 - RNA, 20 nt, Human
gaaaacaaucccugcaaagc

SEQ ID NO: 443701 - RNA, 21 nt, Human
gaaccucccgccuugucccag

SEQ ID NO: 443702 - RNA, 23 nt, Human
gacccagacccggacccggaggc

SEQ ID NO: 443703 - RNA, 25 nt, Human
gagaagcagcaguguuaacuggggg

SEQ ID NO: 443704 - RNA, 28 nt, Human
gagaagcagcaguguuaacugggggugg

SEQ ID NO: 443705 - RNA, 22 nt, Human
gagcacagcuggacugggcggu

SEQ ID NO: 443706 - RNA, 20 nt, Human
gagcagcggugcgguccugg

SEQ ID NO: 443707 - RNA, 24 nt, Human
gagcagcggugcgguccugggcaa

SEQ ID NO: 443708 - RNA, 23 nt, Human
gagcgugugccuucagccugggc

SEQ ID NO: 443709 - RNA, 21 nt, Human
gaggcagccgagccccucagg

SEQ ID NO: 443710 - RNA, 18 nt, Human
gagggaugggucauccgu

SEQ ID NO: 443711 - RNA, 18 nt, Human
gccucgggcucacugccg

SEQ ID NO: 443712 - RNA, 20 nt, Human
gcucacugccgggacucccc

SEQ ID NO: 443713 - RNA, 20 nt, Human
gcuccauccacccaacccuc

SEQ ID NO: 443714 - RNA, 18 nt, Human
ggacaccuccacccuccc

SEQ ID NO: 443715 - RNA, 21 nt, Human
ggaguuccccacggcccacau

SEQ ID NO: 443716 - RNA, 23 nt, Human
ggcucggccacacccccacccgc

SEQ ID NO: 443717 - RNA, 19 nt, Human
gggcaggagccagccagac

SEQ ID NO: 443718 - RNA, 19 nt, Human
gggccgcggugggagggag

SEQ ID NO: 443719 - RNA, 18 nt, Human
ggggaugaggcagccgag

SEQ ID NO: 443720 - RNA, 25 nt, Human
ggggcaacagauggggccgggugag

SEQ ID NO: 443721 - RNA, 20 nt, Human
gggggugggaggcggggcug

SEQ ID NO: 443722 - RNA, 24 nt, Human
ggggugcagggugacaugcauuca

SEQ ID NO: 443723 - RNA, 23 nt, Human
ggggugggggugggaggcggggc

SEQ ID NO: 443724 - RNA, 18 nt, Human
gggugagcacguguuugg

SEQ ID NO: 443725 - RNA, 19 nt, Human
gguggagggcaaggcuggg

SEQ ID NO: 443726 - RNA, 23 nt, Human
gguggggcucgggugggcagagg

SEQ ID NO: 443727 - RNA, 23 nt, Human
ggugucguccuuacgccggacag

SEQ ID NO: 443728 - RNA, 22 nt, Human
guagcucugggaguuccccccg

SEQ ID NO: 443729 - RNA, 18 nt, Human
gucacggagacccggccc

SEQ ID NO: 443730 - RNA, 18 nt, Human
guggggcugggguuuccu

SEQ ID NO: 443731 - RNA, 21 nt, Human
guggucauguugggggccagu

SEQ ID NO: 443732 - RNA, 21 nt, Human
guguggucauguugggggcca

SEQ ID NO: 443733 - RNA, 18 nt, Human
ucacggagacccggcccc

SEQ ID NO: 443734 - RNA, 23 nt, Human
ucaggacucgggguggggguggg

SEQ ID NO: 443735 - RNA, 19 nt, Human
ucaggcccuucuauaagcu

SEQ ID NO: 443736 - RNA, 24 nt, Human
uccaaaagcucagaagagaccacc

SEQ ID NO: 443737 - RNA, 21 nt, Human
uccacggucgggacuugaggc

SEQ ID NO: 443738 - RNA, 24 nt, Human
uccaggucccagggccucgggcuc

SEQ ID NO: 443739 - RNA, 25 nt, Human
ucccccaaaacaaccugacagccuu

SEQ ID NO: 443740 - RNA, 21 nt, Human
ucccccagccucgccccaccu

SEQ ID NO: 443741 - RNA, 20 nt, Human
ucccugaacaccgucugggc

SEQ ID NO: 443742 - RNA, 23 nt, Human
uccgugguggggcugggguuucc

SEQ ID NO: 443743 - RNA, 18 nt, Human
uccuggagaaggcacgug

SEQ ID NO: 443744 - RNA, 21 nt, Human
ucgccccacucagccugcauu

SEQ ID NO: 443745 - RNA, 21 nt, Human
ucgcccggggucaagcaacgg

SEQ ID NO: 443746 - RNA, 23 nt, Human
ucgcugccaccacgcucccccaa

SEQ ID NO: 443747 - RNA, 23 nt, Human
ucuacagcgcaggcccauggggc

SEQ ID NO: 443748 - RNA, 23 nt, Human
ugaaaacaaucccugcaaagccc

SEQ ID NO: 443749 - RNA, 25 nt, Human
ugaaaacaaucccugcaaagcccuc

SEQ ID NO: 443750 - RNA, 21 nt, Human
ugaaaagggacaagaugagca

SEQ ID NO: 443751 - RNA, 21 nt, Human
ugaacaccgucugggcggggc

SEQ ID NO: 443752 - RNA, 23 nt, Human
ugacuuauggacguccugucugg

SEQ ID NO: 443753 - RNA, 23 nt, Human
ugagcagcggugcgguccugggc

SEQ ID NO: 443754 - RNA, 21 nt, Human
ugagcuccauccacccaaccc

SEQ ID NO: 443755 - RNA, 22 nt, Human
ugagcuccauccacccaacccu

SEQ ID NO: 443756 - RNA, 18 nt, Human
ugaguugaggacagcucc

SEQ ID NO: 443757 - RNA, 24 nt, Human
ugcagaaaagagguugucggcucc

SEQ ID NO: 443758 - RNA, 20 nt, Human
ugcagugggcguaccuugag

SEQ ID NO: 443759 - RNA, 24 nt, Human
ugccagcgcuccacggucgggacu

SEQ ID NO: 443760 - RNA, 18 nt, Human
ugccccucccacccccac

SEQ ID NO: 443761 - RNA, 22 nt, Human
ugccggaaggcccccgaaccuc

SEQ ID NO: 443762 - RNA, 20 nt, Human
ugcgcaccuugcugcugggc

SEQ ID NO: 443763 - RNA, 18 nt, Human
ugcggcgggcgccgucac

SEQ ID NO: 443764 - RNA, 24 nt, Human
ugcugggcaaggcgucacgggcag

SEQ ID NO: 443765 - RNA, 18 nt, Human
uggaccuccgcggcacag

SEQ ID NO: 443766 - RNA, 18 nt, Human
uggcaggcccgccgcggc

SEQ ID NO: 443767 - RNA, 22 nt, Human
uggccucugccccucccacccc

SEQ ID NO: 443768 - RNA, 23 nt, Human
uggccucugccccucccaccccc

SEQ ID NO: 443769 - RNA, 24 nt, Human
ugggagggaggccuugcagugggc

SEQ ID NO: 443770 - RNA, 20 nt, Human
ugggaugggguccaaauguc

SEQ ID NO: 443771 - RNA, 24 nt, Human
ugggcggugagguguggcuguggu

SEQ ID NO: 443772 - RNA, 21 nt, Human
ugggcuccggguucccugaac

SEQ ID NO: 443773 - RNA, 20 nt, Human
ugggggccaguggcggucac

SEQ ID NO: 443774 - RNA, 19 nt, Human
ugggggugggaggcggggc

SEQ ID NO: 443775 - RNA, 21 nt, Human
ugggggugggaggcggggcug

SEQ ID NO: 443776 - RNA, 18 nt, Human
ugggggugggggcugggg

SEQ ID NO: 443777 - RNA, 22 nt, Human
ugggggugggggcuggggucag

SEQ ID NO: 443778 - RNA, 19 nt, Human
ugguggggcucgggugggc

SEQ ID NO: 443779 - RNA, 19 nt, Human
ugucccugcgaagcagcgg

SEQ ID NO: 443780 - RNA, 18 nt, Human
ugucggcucccucugcag

SEQ ID NO: 443781 - RNA, 23 nt, Human
uguuuggcauccccaaguccaaa

SEQ ID NO: 443782 - RNA, 27 nt, Human
uugauuguccagagaccgcggacugcc

SEQ ID NO: 443783 - RNA, 23 nt, Human
uugcagugggcguaccuugaguu

SEQ ID NO: 443784 - RNA, 19 nt, Human
uuuggcauccccaagucca

SEQ ID NO: 443785 - RNA, 19 nt, Human
uuuggcauccccaagucca

SEQ ID NO: 443786 - RNA, 25 nt, Human
uuuugagcuccauccacccaacccu

SEQ ID NO: 443787 - RNA, 19 nt, Human
aacucccucauucccagac

SEQ ID NO: 443788 - RNA, 24 nt, Human
acagagaaggagggggccccaaaa

SEQ ID NO: 443789 - RNA, 19 nt, Human
acaguggcccccugccccu

SEQ ID NO: 443790 - RNA, 21 nt, Human
acuacaguggcccccugcccc

SEQ ID NO: 443791 - RNA, 18 nt, Human
acucgcccggugcucccc

SEQ ID NO: 443792 - RNA, 20 nt, Human
acucgcccggugcuccccuu

SEQ ID NO: 443793 - RNA, 18 nt, Human
agaaggagggggccccaa

SEQ ID NO: 443794 - RNA, 18 nt, Human
agacaaacagauagacag

SEQ ID NO: 443795 - RNA, 23 nt, Human
agacaaacagauagacaggccug

SEQ ID NO: 443796 - RNA, 21 nt, Human
aggaggcagugaaacacagcg

SEQ ID NO: 443797 - RNA, 19 nt, Human
aggcauccuucccugacug

SEQ ID NO: 443798 - RNA, 19 nt, Human
aggccuuugucaacagccc

SEQ ID NO: 443799 - RNA, 22 nt, Human
aggguccacaggggcccauggg

SEQ ID NO: 443800 - RNA, 20 nt, Human
auggggcugcugaaagggga

SEQ ID NO: 443801 - RNA, 21 nt, Human
cacucugucucaccccaccuc

SEQ ID NO: 443802 - RNA, 21 nt, Human
cagauagacaggccuguagca

SEQ ID NO: 443803 - RNA, 24 nt, Human
cagcacagagccuggggccucugg

SEQ ID NO: 443804 - RNA, 18 nt, Human
cagcacucaguccaucug

SEQ ID NO: 443805 - RNA, 25 nt, Human
cagccccugcuccuugggccccucc

SEQ ID NO: 443806 - RNA, 18 nt, Human
caggcucugggaacuccu

SEQ ID NO: 443807 - RNA, 25 nt, Human
caggcucugggaacuccucuggggg

SEQ ID NO: 443808 - RNA, 19 nt, Human
cagggagagacucgggggg

SEQ ID NO: 443809 - RNA, 18 nt, Human
cagggcucagccaggcug

SEQ ID NO: 443810 - RNA, 21 nt, Human
cauucccagacagagcacccc

SEQ ID NO: 443811 - RNA, 25 nt, Human
ccagacagagcaccccagcccugac

SEQ ID NO: 443812 - RNA, 18 nt, Human
ccagcccugacagagaag

SEQ ID NO: 443813 - RNA, 18 nt, Human
ccccugggggcugcaugg

SEQ ID NO: 443814 - RNA, 21 nt, Human
ccccuucccagcacucagucc

SEQ ID NO: 443815 - RNA, 20 nt, Human
cccugcuccuugggccccuc

SEQ ID NO: 443816 - RNA, 19 nt, Human
cccugggggcugcaugggg

SEQ ID NO: 443817 - RNA, 21 nt, Human
ccguaaucucucccacucugu

SEQ ID NO: 443818 - RNA, 21 nt, Human
ccugcaccaaacuugguuaac

SEQ ID NO: 443819 - RNA, 18 nt, Human
ccugggggcugcaugggg

SEQ ID NO: 443820 - RNA, 19 nt, Human
cgccccuucccagcacuca

SEQ ID NO: 443821 - RNA, 25 nt, Human
cuccaugccaugccguaaucucucc

SEQ ID NO: 443822 - RNA, 24 nt, Human
cuccuggccugcacagccaugugu

SEQ ID NO: 443823 - RNA, 20 nt, Human
cuccuugggccccuccaugc

SEQ ID NO: 443824 - RNA, 21 nt, Human
cucgcccggugcuccccuuca

SEQ ID NO: 443825 - RNA, 23 nt, Human
gaggguagcggggggagcacagg

SEQ ID NO: 443826 - RNA, 19 nt, Human
gccagggcucagccaggcu

SEQ ID NO: 443827 - RNA, 18 nt, Human
gcccaugggcuauccccc

SEQ ID NO: 443828 - RNA, 20 nt, Human
ggaggguccacaggggccca

SEQ ID NO: 443829 - RNA, 19 nt, Human
gggaggcugggacgggucc

SEQ ID NO: 443830 - RNA, 18 nt, Human
gggagggaggguccacag

SEQ ID NO: 443831 - RNA, 20 nt, Human
gggccccuccaugccaugcc

SEQ ID NO: 443832 - RNA, 21 nt, Human
gggccccuccaugccaugccg

SEQ ID NO: 443833 - RNA, 25 nt, Human
gggccggcaggccugggucuguggg

SEQ ID NO: 443834 - RNA, 18 nt, Human
ggugauggggcugcugaa

SEQ ID NO: 443835 - RNA, 22 nt, Human
guuuccaaauuucuccacgcuc

SEQ ID NO: 443836 - RNA, 19 nt, Human
ucaccccaccucagcuccg

SEQ ID NO: 443837 - RNA, 22 nt, Human
ucaucagcacagagccuggggc

SEQ ID NO: 443838 - RNA, 23 nt, Human
uccacgcucacuacaguggcccc

SEQ ID NO: 443839 - RNA, 19 nt, Human
ucccacucugucucacccc

SEQ ID NO: 443840 - RNA, 23 nt, Human
ucccagacagagcaccccagccc

SEQ ID NO: 443841 - RNA, 19 nt, Human
uccuugggccccuccaugc

SEQ ID NO: 443842 - RNA, 22 nt, Human
ucgcagccgccccuucccagca

SEQ ID NO: 443843 - RNA, 18 nt, Human
ucucaccccaccucagcu

SEQ ID NO: 443844 - RNA, 22 nt, Human
ucuuuugugaaauagaaagugu

SEQ ID NO: 443845 - RNA, 20 nt, Human
ugaaaggggauguagaccca

SEQ ID NO: 443846 - RNA, 24 nt, Human
ugaguuaagaaauagguguuucca

SEQ ID NO: 443847 - RNA, 23 nt, Human
ugcacagccauguguccacuugg

SEQ ID NO: 443848 - RNA, 22 nt, Human
ugccaugccguaaucucuccca

SEQ ID NO: 443849 - RNA, 21 nt, Human
ugggccuccuggccugcacag

SEQ ID NO: 443850 - RNA, 22 nt, Human
uggggagggaggguccacaggg

SEQ ID NO: 443851 - RNA, 26 nt, Human
uggggagggaggguccacaggggccc

SEQ ID NO: 443852 - RNA, 19 nt, Human
ugggguggggaggggaggc

SEQ ID NO: 443853 - RNA, 21 nt, Human
ugggguggggaggggaggcug

SEQ ID NO: 443854 - RNA, 19 nt, Human
ugggucugugggcaggagg

SEQ ID NO: 443855 - RNA, 18 nt, Human
uuccaaauuucuccacgc

SEQ ID NO: 443856 - RNA, 19 nt, Human
aaacaaccucuugcuuggc

SEQ ID NO: 443857 - RNA, 22 nt, Human
aaagacaucaucaagagggaag

SEQ ID NO: 443858 - RNA, 19 nt, Human
aaccacccuggcacuucca

SEQ ID NO: 443859 - RNA, 19 nt, Human
aagaaaggcgcgagccgcg

SEQ ID NO: 443860 - RNA, 18 nt, Human
aagaaggcccaaucccug

SEQ ID NO: 443861 - RNA, 18 nt, Human
aagcaaaaggggagaaag

SEQ ID NO: 443862 - RNA, 23 nt, Human
aagcaaaaggggagaaaggggac

SEQ ID NO: 443863 - RNA, 22 nt, Human
aagcagcagcagcagcagcagc

SEQ ID NO: 443864 - RNA, 27 nt, Human
aagcaugagccuuuaagcagcagcagc

SEQ ID NO: 443865 - RNA, 23 nt, Human
aagcggcaucagggacccuccac

SEQ ID NO: 443866 - RNA, 21 nt, Human
acacacacaaaguugggcauc

SEQ ID NO: 443867 - RNA, 23 nt, Human
acacaggggaagggaacaauuuc

SEQ ID NO: 443868 - RNA, 22 nt, Human
acagaacaaucuuuacaaacau

SEQ ID NO: 443869 - RNA, 18 nt, Human
acccccagccccagccuc

SEQ ID NO: 443870 - RNA, 18 nt, Human
acccuggcacuuccaugc

SEQ ID NO: 443871 - RNA, 21 nt, Human
acccugggucugggaaugcug

SEQ ID NO: 443872 - RNA, 21 nt, Human
accuggagcuugggcuagcug

SEQ ID NO: 443873 - RNA, 23 nt, Human
acuacccucuucuguucccuauc

SEQ ID NO: 443874 - RNA, 19 nt, Human
agaagagacuuucugggca

SEQ ID NO: 443875 - RNA, 22 nt, Human
agaguacccugggucugggaau

SEQ ID NO: 443876 - RNA, 23 nt, Human
agcagcagcauagguaaaggggc

SEQ ID NO: 443877 - RNA, 18 nt, Human
agccagcuugccucuccc

SEQ ID NO: 443878 - RNA, 24 nt, Human
agcuugggcuagcuggggaugggg

SEQ ID NO: 443879 - RNA, 19 nt, Human
aggaagaagggaguauugg

SEQ ID NO: 443880 - RNA, 22 nt, Human
aggaaggaaggcccaaaugaag

SEQ ID NO: 443881 - RNA, 20 nt, Human
aggaagguccggucaacacg

SEQ ID NO: 443882 - RNA, 25 nt, Human
aggcaagagaagugacaaaggacuu

SEQ ID NO: 443883 - RNA, 27 nt, Human
aggcaagagaagugacaaaggggaccc

SEQ ID NO: 443884 - RNA, 18 nt, Human
aggccgaugaggcaggag

SEQ ID NO: 443885 - RNA, 20 nt, Human
agggccucccggggagaggg

SEQ ID NO: 443886 - RNA, 19 nt, Human
augaggcaggagacacaga

SEQ ID NO: 443887 - RNA, 22 nt, Human
auugugggacuuggggggcccu

SEQ ID NO: 443888 - RNA, 23 nt, Human
caacaggacaguucacagccagc

SEQ ID NO: 443889 - RNA, 22 nt, Human
caagcaaaaggggagaaagccc

SEQ ID NO: 443890 - RNA, 22 nt, Human
cacaacaggacaguucacagcc

SEQ ID NO: 443891 - RNA, 24 nt, Human
cacccccagccccagccucgggaa

SEQ ID NO: 443892 - RNA, 22 nt, Human
cacccuccccuccugaccugga

SEQ ID NO: 443893 - RNA, 19 nt, Human
cagcagcagcagcagcagc

SEQ ID NO: 443894 - RNA, 25 nt, Human
cagcagcagcagcagcagcagcguu

SEQ ID NO: 443895 - RNA, 18 nt, Human
cagcagcagcguuagcag

SEQ ID NO: 443896 - RNA, 19 nt, Human
cagcagggguaggucaggg

SEQ ID NO: 443897 - RNA, 18 nt, Human
cagccacccccagcccca

SEQ ID NO: 443898 - RNA, 25 nt, Human
cagccagcaccucuuaacuagaguc

SEQ ID NO: 443899 - RNA, 28 nt, Human
cagcuccagccccacaacaggacaguuc

SEQ ID NO: 443900 - RNA, 23 nt, Human
cagcugggggaauggugcagcag

SEQ ID NO: 443901 - RNA, 24 nt, Human
caggagacacagaaaggaaggggg

SEQ ID NO: 443902 - RNA, 19 nt, Human
caggcagggacuagggcgg

SEQ ID NO: 443903 - RNA, 18 nt, Human
caucuuucuuuccuuccu

SEQ ID NO: 443904 - RNA, 20 nt, Human
ccacacacacaaaguugggc

SEQ ID NO: 443905 - RNA, 23 nt, Human
ccacccuggcacuuccaugcccc

SEQ ID NO: 443906 - RNA, 20 nt, Human
ccagccacccccagccccag

SEQ ID NO: 443907 - RNA, 23 nt, Human
cccacaacaggacaguucacagc

SEQ ID NO: 443908 - RNA, 22 nt, Human
cccacacacacaaaguugggca

SEQ ID NO: 443909 - RNA, 21 nt, Human
cccacuuucuccccuucccca

SEQ ID NO: 443910 - RNA, 22 nt, Human
cccagccacccccagccccagc

SEQ ID NO: 443911 - RNA, 25 nt, Human
cccagccccagccucgggaaaaggc

SEQ ID NO: 443912 - RNA, 19 nt, Human
ccccaaaggaaaagcccug

SEQ ID NO: 443913 - RNA, 22 nt, Human
ccccacuuucuccccuucccca

SEQ ID NO: 443914 - RNA, 27 nt, Human
cccccagccccagccucgggaaaaggc

SEQ ID NO: 443915 - RNA, 19 nt, Human
ccccccuagcccacccacu

SEQ ID NO: 443916 - RNA, 22 nt, Human
ccccccuagcccacccacuacc

SEQ ID NO: 443917 - RNA, 23 nt, Human
ccccccuagcccacccacuaccc

SEQ ID NO: 443918 - RNA, 22 nt, Human
cccccguccccacacacacaaa

SEQ ID NO: 443919 - RNA, 21 nt, Human
ccccgccgcucccgcuggccg

SEQ ID NO: 443920 - RNA, 18 nt, Human
ccccucucuaccucuccc

SEQ ID NO: 443921 - RNA, 24 nt, Human
cccgcgcucagggcagaccggggc

SEQ ID NO: 443922 - RNA, 26 nt, Human
cccucccagccacccccagccccagc

SEQ ID NO: 443923 - RNA, 18 nt, Human
cccuccuuccuucugccc

SEQ ID NO: 443924 - RNA, 18 nt, Human
cccuccuuccuucugccc

SEQ ID NO: 443925 - RNA, 25 nt, Human
cccucucuaccucucccuuaacuga

SEQ ID NO: 443926 - RNA, 18 nt, Human
cccuggaggccaggugag

SEQ ID NO: 443927 - RNA, 19 nt, Human
cccugggguugagcgguag

SEQ ID NO: 443928 - RNA, 19 nt, Human
cccuuccccucccagccac

SEQ ID NO: 443929 - RNA, 21 nt, Human
ccgccgcucccgcuggccgcc

SEQ ID NO: 443930 - RNA, 22 nt, Human
ccgccgcucccgcuggccgccu

SEQ ID NO: 443931 - RNA, 23 nt, Human
ccgcggucaaggagagccagagc

SEQ ID NO: 443932 - RNA, 24 nt, Human
ccgcucccgcuggccgccuccccc

SEQ ID NO: 443933 - RNA, 22 nt, Human
ccgcucccgcuggccgccuccg

SEQ ID NO: 443934 - RNA, 19 nt, Human
ccgggagcggcagcggcga

SEQ ID NO: 443935 - RNA, 28 nt, Human
ccgggagcggcagcggcgagcucuuucu

SEQ ID NO: 443936 - RNA, 22 nt, Human
ccuagcccacccacuacccucu

SEQ ID NO: 443937 - RNA, 24 nt, Human
ccucccagccacccccagccccag

SEQ ID NO: 443938 - RNA, 23 nt, Human
ccuccucucccgccgcggggcag

SEQ ID NO: 443939 - RNA, 19 nt, Human
ccucucccuucccuucccc

SEQ ID NO: 443940 - RNA, 24 nt, Human
ccucucccuucccuuccccuccca

SEQ ID NO: 443941 - RNA, 19 nt, Human
ccuggcacuuccaugcccc

SEQ ID NO: 443942 - RNA, 18 nt, Human
ccuucuucuccccucucc

SEQ ID NO: 443943 - RNA, 19 nt, Human
ccuugggccgccgcggccc

SEQ ID NO: 443944 - RNA, 22 nt, Human
ccuugggccgccgcggccccgg

SEQ ID NO: 443945 - RNA, 23 nt, Human
cgaccaguccccacuccaagcau

SEQ ID NO: 443946 - RNA, 22 nt, Human
cgccuccgcucuucugcagccu

SEQ ID NO: 443947 - RNA, 21 nt, Human
cgguagucucagugccugagc

SEQ ID NO: 443948 - RNA, 22 nt, Human
cuagagucucuccuugcuuuuc

SEQ ID NO: 443949 - RNA, 18 nt, Human
cucccagcuuucuuagcc

SEQ ID NO: 443950 - RNA, 21 nt, Human
cuccccucuccgccuccccca

SEQ ID NO: 443951 - RNA, 26 nt, Human
cuccugggaacccugcucaagcaaaa

SEQ ID NO: 443952 - RNA, 18 nt, Human
cucuccgccucccccaaa

SEQ ID NO: 443953 - RNA, 26 nt, Human
cucuccuugcuuuucucugcauucuu

SEQ ID NO: 443954 - RNA, 25 nt, Human
cugacucccccguccccacacacac

SEQ ID NO: 443955 - RNA, 23 nt, Human
cugcaggucauggcaggccgaug

SEQ ID NO: 443956 - RNA, 24 nt, Human
cuggagaagaagggaggcuuucug

SEQ ID NO: 443957 - RNA, 24 nt, Human
cuggagcccacagaagggagcacu

SEQ ID NO: 443958 - RNA, 19 nt, Human
cuggggauggggugugggg

SEQ ID NO: 443959 - RNA, 21 nt, Human
cuggggauggggugugggggc

SEQ ID NO: 443960 - RNA, 20 nt, Human
cuucuccccucuccgccucc

SEQ ID NO: 443961 - RNA, 22 nt, Human
cuugggccgccgcggccccggc

SEQ ID NO: 443962 - RNA, 19 nt, Human
cuugucuucucuuucuccc

SEQ ID NO: 443963 - RNA, 19 nt, Human
gaaaggcgcgagccgcggc

SEQ ID NO: 443964 - RNA, 21 nt, Human
gaccuggagaagaagggaggc

SEQ ID NO: 443965 - RNA, 19 nt, Human
gagaccugguccccauccc

SEQ ID NO: 443966 - RNA, 21 nt, Human
gagcaaacgcugaugcuccac

SEQ ID NO: 443967 - RNA, 22 nt, Human
gccagagcagcaggagcgccug

SEQ ID NO: 443968 - RNA, 23 nt, Human
gccauggaguccagugauugaag

SEQ ID NO: 443969 - RNA, 19 nt, Human
gccccccuagcccacccac

SEQ ID NO: 443970 - RNA, 26 nt, Human
gccccgccgcucccgcuggggccgcc

SEQ ID NO: 443971 - RNA, 22 nt, Human
gccgcggccccggcgagccggc

SEQ ID NO: 443972 - RNA, 18 nt, Human
gcgcgugcgggcgcagag

SEQ ID NO: 443973 - RNA, 24 nt, Human
gcgcucagggcagacaugaggaag

SEQ ID NO: 443974 - RNA, 20 nt, Human
gcggaggggaccuggagaag

SEQ ID NO: 443975 - RNA, 19 nt, Human
gcggcuccgggagcggcag

SEQ ID NO: 443976 - RNA, 20 nt, Human
gcucuugucuucucuuucuc

SEQ ID NO: 443977 - RNA, 24 nt, Human
gcuugccucucccuucccuucccc

SEQ ID NO: 443978 - RNA, 23 nt, Human
ggaagguccggucaacacgaagg

SEQ ID NO: 443979 - RNA, 18 nt, Human
ggccccggcgagccggcg

SEQ ID NO: 443980 - RNA, 19 nt, Human
ggcgcccggaggccaagaa

SEQ ID NO: 443981 - RNA, 21 nt, Human
ggcuugggggagguggauagg

SEQ ID NO: 443982 - RNA, 20 nt, Human
ggggaauggugcagcagggg

SEQ ID NO: 443983 - RNA, 21 nt, Human
ggggauggggugugggggcag

SEQ ID NO: 443984 - RNA, 21 nt, Human
gggggcagcuggccaguuaug

SEQ ID NO: 443985 - RNA, 23 nt, Human
ggggugugggggcaggaagaagg

SEQ ID NO: 443986 - RNA, 23 nt, Human
ggugugggggcaggaagaaggga

SEQ ID NO: 443987 - RNA, 24 nt, Human
gucacuccccucuccaggcuucug

SEQ ID NO: 443988 - RNA, 23 nt, Human
gugggagcagcuccagccccaca

SEQ ID NO: 443989 - RNA, 21 nt, Human
guuaugggggcagcuggccag

SEQ ID NO: 443990 - RNA, 21 nt, Human
uaaggcaagagaagugacaaa

SEQ ID NO: 443991 - RNA, 19 nt, Human
uaccucggacuccugaaaa

SEQ ID NO: 443992 - RNA, 21 nt, Human
uagagucucuccuugcuuuuc

SEQ ID NO: 443993 - RNA, 23 nt, Human
uagagucucuccuugcuuuucuc

SEQ ID NO: 443994 - RNA, 20 nt, Human
uagccaugucaggcccagca

SEQ ID NO: 443995 - RNA, 19 nt, Human
uaggagaugggagaccugg

SEQ ID NO: 443996 - RNA, 18 nt, Human
ucaaggagagccagagca

SEQ ID NO: 443997 - RNA, 20 nt, Human
ucacggaagcuagggccucc

SEQ ID NO: 443998 - RNA, 25 nt, Human
ucauaaacaaccacuuuaaauaagg

SEQ ID NO: 443999 - RNA, 23 nt, Human
ucccccaaaggaaaagcccugga

SEQ ID NO: 444000 - RNA, 23 nt, Human
ucccccguccccacacacacaaa

SEQ ID NO: 444001 - RNA, 18 nt, Human
ucuuucuuuccuuccuuc

SEQ ID NO: 444002 - RNA, 21 nt, Human
ugaaaagacaucaucaagagg

SEQ ID NO: 444003 - RNA, 22 nt, Human
ugacucugagcaggucacuccc

SEQ ID NO: 444004 - RNA, 26 nt, Human
ugccucucccuucccuuccccuccca

SEQ ID NO: 444005 - RNA, 21 nt, Human
ugcuuggcuuuuacuccuggg

SEQ ID NO: 444006 - RNA, 21 nt, Human
uggcagaagagacuuucuggg

SEQ ID NO: 444007 - RNA, 19 nt, Human
uggccccucacggaagcua

SEQ ID NO: 444008 - RNA, 24 nt, Human
ugggacuuggggggcccugacucc

SEQ ID NO: 444009 - RNA, 20 nt, Human
ugggagcagcuccagcccca

SEQ ID NO: 444010 - RNA, 18 nt, Human
uggggauggggugugggg

SEQ ID NO: 444011 - RNA, 19 nt, Human
uggggaugggguguggggg

SEQ ID NO: 444012 - RNA, 21 nt, Human
uggggauggggugugggggca

SEQ ID NO: 444013 - RNA, 19 nt, Human
ugggggcaggaagaaggga

SEQ ID NO: 444014 - RNA, 19 nt, Human
ugggggcaggaagaaggga

SEQ ID NO: 444015 - RNA, 21 nt, Human
ugggggcgucaguggcagaag

SEQ ID NO: 444016 - RNA, 19 nt, Human
ugugggacuuggggggccc

SEQ ID NO: 444017 - RNA, 23 nt, Human
uucugggcaccgaccagucccca

SEQ ID NO: 444018 - RNA, 21 nt, Human
uucuuagcggcuggcugcucg

SEQ ID NO: 444019 - RNA, 22 nt, Human
uucuucuccccucuccgccucc

SEQ ID NO: 444020 - RNA, 19 nt, Human
uugaacacaggggaaggga

SEQ ID NO: 444021 - RNA, 22 nt, Human
uugcuuggcuuuuacuccuggg

SEQ ID NO: 444022 - RNA, 23 nt, Human
uugggcuagcuggggauggggug

SEQ ID NO: 444023 - RNA, 23 nt, Human
uuggggcguuagaugagacaggc

SEQ ID NO: 444024 - RNA, 20 nt, Human
uuuccuuccuucuguuccuu

SEQ ID NO: 444025 - RNA, 24 nt, Human
uuucuccccuuccccacggggcug

SEQ ID NO: 444026 - RNA, 25 nt, Human
uuucuuuccuuccuucuguuccuuu

SEQ ID NO: 444027 - RNA, 22 nt, Human
uuuuuuuuuuuuuuuuuuucag

SEQ ID NO: 444028 - RNA, 30 nt, Human
uuuuuuuuuuuuuuuuuuucagcuuuuaaa

SEQ ID NO: 444029 - RNA, 19 nt, Human
aaacaaauacacagacuuu

SEQ ID NO: 444030 - RNA, 20 nt, Human
aagcaggaggcagcucaggg

SEQ ID NO: 444031 - RNA, 21 nt, Human
aagcaggaggcagcucaggga

SEQ ID NO: 444032 - RNA, 18 nt, Human
aagcucaccaacaaggag

SEQ ID NO: 444033 - RNA, 21 nt, Human
acuuugagggagaagcaggag

SEQ ID NO: 444034 - RNA, 23 nt, Human
agaagugauuuaaaaucacacaa

SEQ ID NO: 444035 - RNA, 20 nt, Human
agagaaggguaggagacuuu

SEQ ID NO: 444036 - RNA, 22 nt, Human
agagaaggguaggagacuuuga

SEQ ID NO: 444037 - RNA, 21 nt, Human
agaggaagagaaggguaggag

SEQ ID NO: 444038 - RNA, 23 nt, Human
agaggaagagaaggguaggagac

SEQ ID NO: 444039 - RNA, 21 nt, Human
agcccgcgccaaccuaggcgc

SEQ ID NO: 444040 - RNA, 22 nt, Human
agcccgcgccaaccuaggcgcg

SEQ ID NO: 444041 - RNA, 22 nt, Human
aggaaagcgaggaagagagggc

SEQ ID NO: 444042 - RNA, 23 nt, Human
aggaagagagggcuuaaaagagg

SEQ ID NO: 444043 - RNA, 26 nt, Human
aggauuaaggcacaagaagcucacca

SEQ ID NO: 444044 - RNA, 19 nt, Human
aggggcugggucacaggau

SEQ ID NO: 444045 - RNA, 24 nt, Human
cacacaacuuccuggggcagcuag

SEQ ID NO: 444046 - RNA, 22 nt, Human
caccucccagcccgcgccaacc

SEQ ID NO: 444047 - RNA, 22 nt, Human
ccucccagcccgcgccaaccua

SEQ ID NO: 444048 - RNA, 21 nt, Human
cuuuccagcaaagacagaagu

SEQ ID NO: 444049 - RNA, 23 nt, Human
cuuugagggagaagcaggaggca

SEQ ID NO: 444050 - RNA, 21 nt, Human
gaagcaggaggcagcucaggg

SEQ ID NO: 444051 - RNA, 24 nt, Human
gagaagcaggaggcagcucaggga

SEQ ID NO: 444052 - RNA, 21 nt, Human
gagggagaagcaggaggcagc

SEQ ID NO: 444053 - RNA, 19 nt, Human
gcacaagaagcucaccaac

SEQ ID NO: 444054 - RNA, 21 nt, Human
gcuggaacaccucccagcccg

SEQ ID NO: 444055 - RNA, 21 nt, Human
ggagaagcaggaggcagcuca

SEQ ID NO: 444056 - RNA, 23 nt, Human
ggagaagcaggaggcagcucagg

SEQ ID NO: 444057 - RNA, 21 nt, Human
ggagcuagguaggaaggaaag

SEQ ID NO: 444058 - RNA, 26 nt, Human
uccagcaaagacagaagugauuuaaa

SEQ ID NO: 444059 - RNA, 25 nt, Human
ugaccaugccagauguccccaggcc

SEQ ID NO: 444060 - RNA, 22 nt, Human
ugagggagaagcaggaggcagc

SEQ ID NO: 444061 - RNA, 25 nt, Human
ugcaacccugaaacaaauacacaga

SEQ ID NO: 444062 - RNA, 22 nt, Human
ugccagauguccccaggccucc

SEQ ID NO: 444063 - RNA, 20 nt, Human
uuaaggcacaagaagcucac

SEQ ID NO: 444064 - RNA, 19 nt, Human
uuuuuuuuuuuuuuugcaa

SEQ ID NO: 444065 - RNA, 18 nt, Human
aaaaaggucagugccucu

SEQ ID NO: 444066 - RNA, 22 nt, Human
aagugcacucaauauaaaacac

SEQ ID NO: 444067 - RNA, 25 nt, Human
auaaaguauccuuuccugaauaaag

SEQ ID NO: 444068 - RNA, 21 nt, Human
augcaauaaaguauccuuucc

SEQ ID NO: 444069 - RNA, 19 nt, Human
cagcaauggaaaugaacag

SEQ ID NO: 444070 - RNA, 18 nt, Human
cggaaagcuuagauuguc

SEQ ID NO: 444071 - RNA, 24 nt, Human
cugaauaaaggaauugagguuuau

SEQ ID NO: 444072 - RNA, 18 nt, Human
guacugaacccuucggua

SEQ ID NO: 444073 - RNA, 24 nt, Human
uaccagauguaaaagauggacccc

SEQ ID NO: 444074 - RNA, 19 nt, Human
uagaagcuuuaaauaaggu

SEQ ID NO: 444075 - RNA, 21 nt, Human
ucaaaacuacuccaaaaacaa

SEQ ID NO: 444076 - RNA, 22 nt, Human
ugaauuaaugugaagguaaaau

SEQ ID NO: 444077 - RNA, 23 nt, Human
ugacaaaagugguuaagaacaac

SEQ ID NO: 444078 - RNA, 18 nt, Human
aaguugauuuucuuugug

SEQ ID NO: 444079 - RNA, 18 nt, Human
uagcaaguugauuuucuu

SEQ ID NO: 444080 - RNA, 24 nt, Human
uguaguagcaaguugauuuucuuu

SEQ ID NO: 444081 - RNA, 18 nt, Human
agaaccaauaauuaggaa

SEQ ID NO: 444082 - RNA, 24 nt, Human
caauaauuaggauagauuuuaugc

SEQ ID NO: 444083 - RNA, 20 nt, Human
ccggaguagcggccggcccc

SEQ ID NO: 444084 - RNA, 21 nt, Human
cgggauggaaagugcagccgu

SEQ ID NO: 444085 - RNA, 21 nt, Human
cugguaguggaacauauuuuu

SEQ ID NO: 444086 - RNA, 20 nt, Human
gggauggaaagugcagccgu

SEQ ID NO: 444087 - RNA, 23 nt, Human
uaaugcauaaacauauaaguccc

SEQ ID NO: 444088 - RNA, 18 nt, Human
uguccucgcugccaccga

SEQ ID NO: 444089 - RNA, 22 nt, Human
uuucuuugcacugauuuuuauu

SEQ ID NO: 444090 - RNA, 18 nt, Human
uuuuuuuuuuuuucuuug

SEQ ID NO: 444091 - RNA, 19 nt, Human
uuuuuuuuuuuuucuuugc

SEQ ID NO: 444092 - RNA, 23 nt, Human
aaaacacacgagacaaagcuccc

SEQ ID NO: 444093 - RNA, 18 nt, Human
aaccacagaaccggcgcc

SEQ ID NO: 444094 - RNA, 22 nt, Human
aagcagcagcagcagcagcagc

SEQ ID NO: 444095 - RNA, 22 nt, Human
acaaagcuccccuuuggucaag

SEQ ID NO: 444096 - RNA, 22 nt, Human
accaggugggccggucagugcc

SEQ ID NO: 444097 - RNA, 21 nt, Human
accucgccuucguuccuccaa

SEQ ID NO: 444098 - RNA, 25 nt, Human
accucgccuucguuccuccaaccuc

SEQ ID NO: 444099 - RNA, 23 nt, Human
acgcuccccaagcccuccuguuu

SEQ ID NO: 444100 - RNA, 21 nt, Human
acuacuaagaaugaacaacau

SEQ ID NO: 444101 - RNA, 19 nt, Human
agaaaggugcccacgcucc

SEQ ID NO: 444102 - RNA, 18 nt, Human
agaaugccacagcacugg

SEQ ID NO: 444103 - RNA, 21 nt, Human
agaaugccacagcacuggaaa

SEQ ID NO: 444104 - RNA, 18 nt, Human
agagcagcggggcagagu

SEQ ID NO: 444105 - RNA, 21 nt, Human
agcaaggcaaggacaugggga

SEQ ID NO: 444106 - RNA, 24 nt, Human
agcagcagcagcgaguccugccaa

SEQ ID NO: 444107 - RNA, 23 nt, Human
agcggggcagagugcacucuggg

SEQ ID NO: 444108 - RNA, 22 nt, Human
agggagaaaggauacgaggaaa

SEQ ID NO: 444109 - RNA, 21 nt, Human
aggugccacccccgaccccag

SEQ ID NO: 444110 - RNA, 22 nt, Human
caaagcaaggaggaaccucgcc

SEQ ID NO: 444111 - RNA, 19 nt, Human
caaccucaucucccacuga

SEQ ID NO: 444112 - RNA, 21 nt, Human
caaggugucccacacauuccc

SEQ ID NO: 444113 - RNA, 23 nt, Human
caagugggacugaggcccaggug

SEQ ID NO: 444114 - RNA, 23 nt, Human
caauucucagcaaggcaaggaca

SEQ ID NO: 444115 - RNA, 20 nt, Human
cacacaccacaagacucaag

SEQ ID NO: 444116 - RNA, 21 nt, Human
cacacgagacaaagcuccccu

SEQ ID NO: 444117 - RNA, 19 nt, Human
cacaggcccugacgggcac

SEQ ID NO: 444118 - RNA, 22 nt, Human
cacaggugccacccccgacccc

SEQ ID NO: 444119 - RNA, 19 nt, Human
caccaagcaguaaggccuc

SEQ ID NO: 444120 - RNA, 25 nt, Human
caccaggagccccaggcucucacag

SEQ ID NO: 444121 - RNA, 20 nt, Human
cacccccgaccccaggauuu

SEQ ID NO: 444122 - RNA, 21 nt, Human
caccuaacaccucagcggcau

SEQ ID NO: 444123 - RNA, 20 nt, Human
cacgagacaaagcuccccuu

SEQ ID NO: 444124 - RNA, 21 nt, Human
cacgcuccccaagcccuccug

SEQ ID NO: 444125 - RNA, 21 nt, Human
cagcagagcagcggggcagag

SEQ ID NO: 444126 - RNA, 25 nt, Human
cagcagcagcagcagcagcgagucc

SEQ ID NO: 444127 - RNA, 20 nt, Human
cagcagcagcgaguccugcc

SEQ ID NO: 444128 - RNA, 20 nt, Human
cagcagcuccaggacagcca

SEQ ID NO: 444129 - RNA, 19 nt, Human
cagccuucccugcuucccc

SEQ ID NO: 444130 - RNA, 22 nt, Human
cagcggugggcgcgccccccuc

SEQ ID NO: 444131 - RNA, 22 nt, Human
caggcucucacaggugccaccc

SEQ ID NO: 444132 - RNA, 21 nt, Human
cagguggaggccccgcccccc

SEQ ID NO: 444133 - RNA, 19 nt, Human
ccaaccacagaaccggcgc

SEQ ID NO: 444134 - RNA, 21 nt, Human
ccaaggaauggagaucgcacc

SEQ ID NO: 444135 - RNA, 18 nt, Human
ccacugagguagcccuug

SEQ ID NO: 444136 - RNA, 19 nt, Human
ccacugcagcucccagcac

SEQ ID NO: 444137 - RNA, 22 nt, Human
cccaaggaauggagaucgcacc

SEQ ID NO: 444138 - RNA, 22 nt, Human
cccacacacccacuuccugaau

SEQ ID NO: 444139 - RNA, 22 nt, Human
cccacacauucccacugcagcu

SEQ ID NO: 444140 - RNA, 25 nt, Human
cccacacauucccacugcagcuccc

SEQ ID NO: 444141 - RNA, 20 nt, Human
ccccaaagcaaggaggaacc

SEQ ID NO: 444142 - RNA, 24 nt, Human
ccccaccccaacuacacccaaggg

SEQ ID NO: 444143 - RNA, 19 nt, Human
ccccccgucaccacaccug

SEQ ID NO: 444144 - RNA, 20 nt, Human
ccccccgucaccacaccugg

SEQ ID NO: 444145 - RNA, 21 nt, Human
ccccccucgagagcagcccaa

SEQ ID NO: 444146 - RNA, 26 nt, Human
ccccgccccccccgucaccacaccug

SEQ ID NO: 444147 - RNA, 21 nt, Human
cccuaaaccaccuaacaccuc

SEQ ID NO: 444148 - RNA, 20 nt, Human
cccucaagccugacugucac

SEQ ID NO: 444149 - RNA, 21 nt, Human
cccuccuguuuacauuuccua

SEQ ID NO: 444150 - RNA, 21 nt, Human
ccgggacagcagguuacacag

SEQ ID NO: 444151 - RNA, 23 nt, Human
ccuacacaagcagcagcagcagc

SEQ ID NO: 444152 - RNA, 23 nt, Human
ccucccgggcagcgcagccucag

SEQ ID NO: 444153 - RNA, 21 nt, Human
cgaccacgcuguguccugugc

SEQ ID NO: 444154 - RNA, 18 nt, Human
cgaccuacacaagcagca

SEQ ID NO: 444155 - RNA, 19 nt, Human
cgaccuacacaagcagcag

SEQ ID NO: 444156 - RNA, 21 nt, Human
cgccccccucgagagcagccc

SEQ ID NO: 444157 - RNA, 24 nt, Human
cgcgccccccucgagagcagccca

SEQ ID NO: 444158 - RNA, 18 nt, Human
cggcaggcgagcgggcgg

SEQ ID NO: 444159 - RNA, 21 nt, Human
cguggggccgcaguguggcug

SEQ ID NO: 444160 - RNA, 19 nt, Human
cuccaggacagccagccgc

SEQ ID NO: 444161 - RNA, 21 nt, Human
cuccccaagcccuccuguuua

SEQ ID NO: 444162 - RNA, 24 nt, Human
cugugcacgccaucuucagguuuc

SEQ ID NO: 444163 - RNA, 24 nt, Human
cuucagguuucccacacacccacu

SEQ ID NO: 444164 - RNA, 23 nt, Human
cuuuuggcccuaaaccaccuaac

SEQ ID NO: 444165 - RNA, 27 nt, Human
gagcagcggggcagagugcacucuggg

SEQ ID NO: 444166 - RNA, 18 nt, Human
gcacagcggcgcaccaug

SEQ ID NO: 444167 - RNA, 19 nt, Human
gcagcacggggcgcagccc

SEQ ID NO: 444168 - RNA, 22 nt, Human
gcaggcuccagcagcagcucca

SEQ ID NO: 444169 - RNA, 18 nt, Human
gccuucccugcuucccca

SEQ ID NO: 444170 - RNA, 24 nt, Human
gcgccccccucgagagcagcccaa

SEQ ID NO: 444171 - RNA, 19 nt, Human
gcugccgcuccucucacgc

SEQ ID NO: 444172 - RNA, 18 nt, Human
gcuuccccaccccaacua

SEQ ID NO: 444173 - RNA, 18 nt, Human
ggaauggagaucgcacca

SEQ ID NO: 444174 - RNA, 25 nt, Human
ggagcaagugggacugaggcccagg

SEQ ID NO: 444175 - RNA, 23 nt, Human
ggccccgccccccccgucaccac

SEQ ID NO: 444176 - RNA, 20 nt, Human
gggauggaugaaacgcagcg

SEQ ID NO: 444177 - RNA, 23 nt, Human
gggcacucugagcugggcagucu

SEQ ID NO: 444178 - RNA, 20 nt, Human
guggugucugcccaccacac

SEQ ID NO: 444179 - RNA, 18 nt, Human
uaaaccaccuaacaccuc

SEQ ID NO: 444180 - RNA, 19 nt, Human
uaacagacggcuccgcgug

SEQ ID NO: 444181 - RNA, 21 nt, Human
ucacaggugccacccccgacc

SEQ ID NO: 444182 - RNA, 24 nt, Human
ucacagguggaggccccgcccccc

SEQ ID NO: 444183 - RNA, 23 nt, Human
ucccacacacccacuuccugaau

SEQ ID NO: 444184 - RNA, 18 nt, Human
ucccgggcagcgcagccu

SEQ ID NO: 444185 - RNA, 24 nt, Human
ucccgggcagcgcagccucagucc

SEQ ID NO: 444186 - RNA, 18 nt, Human
ucccugcuuccccacccc

SEQ ID NO: 444187 - RNA, 20 nt, Human
uccuugggcguggggccgca

SEQ ID NO: 444188 - RNA, 21 nt, Human
ucggcaggcgagcgggcggga

SEQ ID NO: 444189 - RNA, 20 nt, Human
ucuccccaaagcaaggagga

SEQ ID NO: 444190 - RNA, 23 nt, Human
ucugagggcaggcuccagcagca

SEQ ID NO: 444191 - RNA, 18 nt, Human
ucuucugagacucugacu

SEQ ID NO: 444192 - RNA, 19 nt, Human
ugacaacuucaaacaggac

SEQ ID NO: 444193 - RNA, 25 nt, Human
ugacaacuucaaacaggacuuuaau

SEQ ID NO: 444194 - RNA, 19 nt, Human
ugagggcaggcuccagcag

SEQ ID NO: 444195 - RNA, 18 nt, Human
ugcuggaaucggggcuga

SEQ ID NO: 444196 - RNA, 21 nt, Human
ugcuggaaucggggcugaggu

SEQ ID NO: 444197 - RNA, 22 nt, Human
ugcuuccccaccccaacuacac

SEQ ID NO: 444198 - RNA, 18 nt, Human
uggaaagggacacucuga

SEQ ID NO: 444199 - RNA, 25 nt, Human
uggaaaugccaccaggugaugccac

SEQ ID NO: 444200 - RNA, 21 nt, Human
ugggacugaggcccaggugcu

SEQ ID NO: 444201 - RNA, 20 nt, Human
ugggagcaagugggacugag

SEQ ID NO: 444202 - RNA, 20 nt, Human
ugggcagagaggacacagcg

SEQ ID NO: 444203 - RNA, 18 nt, Human
uggggggaggcagcacgg

SEQ ID NO: 444204 - RNA, 20 nt, Human
uggggggaggcagcacgggg

SEQ ID NO: 444205 - RNA, 21 nt, Human
uggggggaggcagcacggggc

SEQ ID NO: 444206 - RNA, 22 nt, Human
uggggggaggcagcacggggcc

SEQ ID NO: 444207 - RNA, 19 nt, Human
uggugggugcuggaaucgg

SEQ ID NO: 444208 - RNA, 19 nt, Human
uguggugucugcccaccac

SEQ ID NO: 444209 - RNA, 19 nt, Human
uguuuacauuuccuagugg

SEQ ID NO: 444210 - RNA, 22 nt, Human
uucccacugcagcucccagcac

SEQ ID NO: 444211 - RNA, 24 nt, Human
uucccacugcagcucccagcacag

SEQ ID NO: 444212 - RNA, 19 nt, Human
uuccuccaaccucaucucc

SEQ ID NO: 444213 - RNA, 20 nt, Human
uuuuuuuuuuuuuuguuuuc

SEQ ID NO: 444214 - RNA, 24 nt, Human
uuuuuuuuuuuuuuuuuuuguuuu

SEQ ID NO: 444215 - RNA, 26 nt, Human
uuuuuuuuuuuuuuuuuuuuuugggg

SEQ ID NO: 444216 - RNA, 18 nt, Human
aaccgagccccguagccu

SEQ ID NO: 444217 - RNA, 19 nt, Human
agacagcaaguagaagagg

SEQ ID NO: 444218 - RNA, 23 nt, Human
agacagcaaguagaagaggggac

SEQ ID NO: 444219 - RNA, 21 nt, Human
cagccaaaccgagccccguag

SEQ ID NO: 444220 - RNA, 25 nt, Human
ccacauugugucuuucuucugcagu

SEQ ID NO: 444221 - RNA, 19 nt, Human
ccccggccgggcccggcuc

SEQ ID NO: 444222 - RNA, 23 nt, Human
ccccguagccucugccgccgcuc

SEQ ID NO: 444223 - RNA, 25 nt, Human
cccuuggaggcccuuccccgcgcgg

SEQ ID NO: 444224 - RNA, 24 nt, Human
ccgcucacugccacccccuccgac

SEQ ID NO: 444225 - RNA, 19 nt, Human
ccugaccccuagucugggg

SEQ ID NO: 444226 - RNA, 25 nt, Human
ccugaccccuagucugggguuggaa

SEQ ID NO: 444227 - RNA, 20 nt, Human
ccugcaugguacccuaaggc

SEQ ID NO: 444228 - RNA, 23 nt, Human
ccugccgacuccccagucagcca

SEQ ID NO: 444229 - RNA, 25 nt, Human
cugccgacuccccagucagccaaac

SEQ ID NO: 444230 - RNA, 21 nt, Human
cugccgccugccgacucccca

SEQ ID NO: 444231 - RNA, 24 nt, Human
gagaaguggcagugaccucagcag

SEQ ID NO: 444232 - RNA, 23 nt, Human
gcagcgccaggcagcccucgugc

SEQ ID NO: 444233 - RNA, 26 nt, Human
gccaacuccagugcuguauccuggag

SEQ ID NO: 444234 - RNA, 19 nt, Human
gccgggcccggcucaaucc

SEQ ID NO: 444235 - RNA, 21 nt, Human
ggagguccgggucagcacugg

SEQ ID NO: 444236 - RNA, 23 nt, Human
uagcuagcugccugaccccuagu

SEQ ID NO: 444237 - RNA, 21 nt, Human
ugaaauaacauagggagcaga

SEQ ID NO: 444238 - RNA, 23 nt, Human
ugaauuguccugcaugguacccu

SEQ ID NO: 444239 - RNA, 24 nt, Human
ugaccucagcagcaggccugguau

SEQ ID NO: 444240 - RNA, 20 nt, Human
ugagaaaagcugcccuugga

SEQ ID NO: 444241 - RNA, 22 nt, Human
ugagaaaagcugcccuuggagg

SEQ ID NO: 444242 - RNA, 22 nt, Human
ugagaagccaagaucucagcug

SEQ ID NO: 444243 - RNA, 21 nt, Human
ugaguaaagggaugucagucc

SEQ ID NO: 444244 - RNA, 22 nt, Human
ugcagugguaaaaaggcugguc

SEQ ID NO: 444245 - RNA, 19 nt, Human
uggccaacuccagugcugu

SEQ ID NO: 444246 - RNA, 24 nt, Human
ugguccuugaauuguccugcaugg

SEQ ID NO: 444247 - RNA, 23 nt, Human
uuuuuuuuuuuuuuuuuaucuuu

SEQ ID NO: 444248 - RNA, 21 nt, Human
aaacacuccacaaacccccca

SEQ ID NO: 444249 - RNA, 20 nt, Human
aaagggacauccccggcaau

SEQ ID NO: 444250 - RNA, 24 nt, Human
aaaucaguaaccuuucaaaacuga

SEQ ID NO: 444251 - RNA, 19 nt, Human
aaccuaaauaacaaguuaa

SEQ ID NO: 444252 - RNA, 21 nt, Human
aacuaacuuagaaucccuugc

SEQ ID NO: 444253 - RNA, 23 nt, Human
aagacaccugcauuggaaucaca

SEQ ID NO: 444254 - RNA, 19 nt, Human
aagaggaaaaucaguaacc

SEQ ID NO: 444255 - RNA, 24 nt, Human
aagaugauaaacaggugucgcgga

SEQ ID NO: 444256 - RNA, 24 nt, Human
aaguuuuucauucaaauucggaag

SEQ ID NO: 444257 - RNA, 18 nt, Human
aauaaccugagaaguuaa

SEQ ID NO: 444258 - RNA, 22 nt, Human
acaaagcauccaaaaauaucac

SEQ ID NO: 444259 - RNA, 19 nt, Human
acacacacacacacacaua

SEQ ID NO: 444260 - RNA, 21 nt, Human
acacacacacacacacauaua

SEQ ID NO: 444261 - RNA, 24 nt, Human
acacacauauaugcuuauguaugu

SEQ ID NO: 444262 - RNA, 18 nt, Human
acacuccacaaacccccc

SEQ ID NO: 444263 - RNA, 24 nt, Human
acacuccacaaaccccccaucugu

SEQ ID NO: 444264 - RNA, 18 nt, Human
acagcaugcauauauaua

SEQ ID NO: 444265 - RNA, 20 nt, Human
acaucagacuacuagaaaug

SEQ ID NO: 444266 - RNA, 23 nt, Human
acugggaguaaaaaccuaaauaa

SEQ ID NO: 444267 - RNA, 27 nt, Human
agacugaauuucauuacauuuuagaaa

SEQ ID NO: 444268 - RNA, 23 nt, Human
agauucacaauuugaagucugaa

SEQ ID NO: 444269 - RNA, 24 nt, Human
agcaaaaauaaccuaaguugugca

SEQ ID NO: 444270 - RNA, 19 nt, Human
aggaaagggaaggggaagg

SEQ ID NO: 444271 - RNA, 23 nt, Human
aguggcaaaagcaaaccgagaga

SEQ ID NO: 444272 - RNA, 19 nt, Human
auccaaaaauaucacugug

SEQ ID NO: 444273 - RNA, 21 nt, Human
aucuuugaaaaugcagccuuu

SEQ ID NO: 444274 - RNA, 21 nt, Human
augcauauauauauauauaca

SEQ ID NO: 444275 - RNA, 19 nt, Human
augcugcaccacugcccag

SEQ ID NO: 444276 - RNA, 19 nt, Human
auucaguagagucuucccc

SEQ ID NO: 444277 - RNA, 18 nt, Human
caaaaggauaaucaccgu

SEQ ID NO: 444278 - RNA, 20 nt, Human
caaaauguuaagauugacca

SEQ ID NO: 444279 - RNA, 20 nt, Human
caaagcauccaaaaauauca

SEQ ID NO: 444280 - RNA, 20 nt, Human
caacagcaauuccaauuuau

SEQ ID NO: 444281 - RNA, 26 nt, Human
caaguuucacagcaugcauauauaua

SEQ ID NO: 444282 - RNA, 19 nt, Human
cacacacacacacacauau

SEQ ID NO: 444283 - RNA, 27 nt, Human
cacacacacacacacauauaugcuuau

SEQ ID NO: 444284 - RNA, 25 nt, Human
cacacacacacacauauaugcuuau

SEQ ID NO: 444285 - RNA, 28 nt, Human
cacacacacacacauauaugcuuaugua

SEQ ID NO: 444286 - RNA, 21 nt, Human
caccaacagcaauuccaauuu

SEQ ID NO: 444287 - RNA, 20 nt, Human
cacuccacaaaccccccauc

SEQ ID NO: 444288 - RNA, 19 nt, Human
cacuuguaucauucuagcc

SEQ ID NO: 444289 - RNA, 27 nt, Human
cagaaaaauacaucagacuacuagaaa

SEQ ID NO: 444290 - RNA, 18 nt, Human
cagccuuuauucuuaguu

SEQ ID NO: 444291 - RNA, 18 nt, Human
caugcauauauauauaua

SEQ ID NO: 444292 - RNA, 22 nt, Human
ccacuacccgcacuauuacacc

SEQ ID NO: 444293 - RNA, 18 nt, Human
cccuugcuacugggagua

SEQ ID NO: 444294 - RNA, 24 nt, Human
ccgcacuauuacaccuccagcugc

SEQ ID NO: 444295 - RNA, 20 nt, Human
ccggcgccaccgccgccucg

SEQ ID NO: 444296 - RNA, 22 nt, Human
ccucgugugccccaaccucggc

SEQ ID NO: 444297 - RNA, 20 nt, Human
cgaaacauucaaaugcagaa

SEQ ID NO: 444298 - RNA, 22 nt, Human
cggaagcaaaaauaaccuaagu

SEQ ID NO: 444299 - RNA, 21 nt, Human
cggugcaaagcaacuuacuuu

SEQ ID NO: 444300 - RNA, 20 nt, Human
cuagaaaugucauucaggca

SEQ ID NO: 444301 - RNA, 24 nt, Human
cucaugacaaugcugaagaaugcu

SEQ ID NO: 444302 - RNA, 22 nt, Human
cucgugugccccaaccucggcc

SEQ ID NO: 444303 - RNA, 20 nt, Human
cugcaccacugcccagcagc

SEQ ID NO: 444304 - RNA, 19 nt, Human
gaaagggaaggggaagggu

SEQ ID NO: 444305 - RNA, 21 nt, Human
gaaaguaaagucacuucugcu

SEQ ID NO: 444306 - RNA, 21 nt, Human
gaauagcaaacuuggggaggg

SEQ ID NO: 444307 - RNA, 18 nt, Human
gacacaaccauggucugu

SEQ ID NO: 444308 - RNA, 23 nt, Human
gaguuuugcuucuucugcagugu

SEQ ID NO: 444309 - RNA, 19 nt, Human
gauuugaauagcaaacuug

SEQ ID NO: 444310 - RNA, 18 nt, Human
gcagacaaagcauccaaa

SEQ ID NO: 444311 - RNA, 20 nt, Human
gcauccaaaaauaucacugu

SEQ ID NO: 444312 - RNA, 21 nt, Human
gcccugguuauuaaaucucca

SEQ ID NO: 444313 - RNA, 28 nt, Human
ggaacuucuccaaacccacuacccgcac

SEQ ID NO: 444314 - RNA, 20 nt, Human
ggaagggugagggauaaggg

SEQ ID NO: 444315 - RNA, 22 nt, Human
ggggaagggugagggauaaggg

SEQ ID NO: 444316 - RNA, 24 nt, Human
ggggaagggugagggauaagggaa

SEQ ID NO: 444317 - RNA, 24 nt, Human
gguaaugaagacaccugcauugga

SEQ ID NO: 444318 - RNA, 20 nt, Human
guaaccuuucaaaacugaug

SEQ ID NO: 444319 - RNA, 18 nt, Human
guagagucuuccccgacu

SEQ ID NO: 444320 - RNA, 19 nt, Human
guagagucuuccccgacua

SEQ ID NO: 444321 - RNA, 25 nt, Human
gugaaacaaaaauauacgaaacauu

SEQ ID NO: 444322 - RNA, 19 nt, Human
uaaaaaacuaagagggaag

SEQ ID NO: 444323 - RNA, 20 nt, Human
uaaaagauucacaauuugaa

SEQ ID NO: 444324 - RNA, 21 nt, Human
uaaguuuuuagcugaaggcaa

SEQ ID NO: 444325 - RNA, 24 nt, Human
uacaaaaguaggucauacauacaa

SEQ ID NO: 444326 - RNA, 22 nt, Human
uacacacacacacacacauaua

SEQ ID NO: 444327 - RNA, 24 nt, Human
uacacacacacacacacauauaug

SEQ ID NO: 444328 - RNA, 28 nt, Human
uacacacacacacacacauauaugcuua

SEQ ID NO: 444329 - RNA, 21 nt, Human
uagaaugaacagcucucaaca

SEQ ID NO: 444330 - RNA, 20 nt, Human
uagagauuauugccaccacu

SEQ ID NO: 444331 - RNA, 24 nt, Human
uauacacacacacacacacauaua

SEQ ID NO: 444332 - RNA, 31 nt, Human; identical to SEQ ID NO: 251951

SEQ ID NO: 444333 - RNA, 20 nt, Human
uauaugcuuauguauguaug

SEQ ID NO: 444334 - RNA, 21 nt, Human
uauaugcuuauguauguaugu

SEQ ID NO: 444335 - RNA, 25 nt, Human
uauguauguauguauauuauacaua

SEQ ID NO: 444336 - RNA, 21 nt, Human
uauuaagcucaugacaaugcu

SEQ ID NO: 444337 - RNA, 23 nt, Human
ucacugugguuuuaccuuggaca

SEQ ID NO: 444338 - RNA, 19 nt, Human
ucagacuacuagaaauguc

SEQ ID NO: 444339 - RNA, 18 nt, Human
uccaaugaguaguagaau

SEQ ID NO: 444340 - RNA, 25 nt, Human
ucuccaaacccacuacccgcacuau

SEQ ID NO: 444341 - RNA, 26 nt, Human
ucuccaaacccacuacccgcacuauu

SEQ ID NO: 444342 - RNA, 21 nt, Human
ugaaacaaaaauauacgaaac

SEQ ID NO: 444343 - RNA, 24 nt, Human
ugaaacaaaaauauacgaaacauu

SEQ ID NO: 444344 - RNA, 23 nt, Human
ugaaauggcuuugggccacuggc

SEQ ID NO: 444345 - RNA, 21 nt, Human
ugauaaacaggugucuugcaa

SEQ ID NO: 444346 - RNA, 18 nt, Human
ugcaccacugcccagcag

SEQ ID NO: 444347 - RNA, 22 nt, Human
ugcauauauauauauauacaca

SEQ ID NO: 444348 - RNA, 19 nt, Human
uguagucaaguuucacagc

SEQ ID NO: 444349 - RNA, 19 nt, Human
uguauguauauuauacaua

SEQ ID NO: 444350 - RNA, 24 nt, Human
uguauguauauuauacauacacau

SEQ ID NO: 444351 - RNA, 26 nt, Human
ugugaaacaaaaauauacgaaacauu

SEQ ID NO: 444352 - RNA, 21 nt, Human
uuaagcucaugacaaugcuga

SEQ ID NO: 444353 - RNA, 23 nt, Human
uucaguauuuugguuguuauuuc

SEQ ID NO: 444354 - RNA, 19 nt, Human
uugcagacaaagcauccaa

SEQ ID NO: 444355 - RNA, 19 nt, Human
uuggaaucacaaacuauuc

SEQ ID NO: 444356 - RNA, 23 nt, Human
uuuaaaagauucacaauuugaag

SEQ ID NO: 444357 - RNA, 21 nt, Human
uuuagaaugaacagcucucaa

SEQ ID NO: 444358 - RNA, 23 nt, Human
uuucacagcaugcauauauauau

SEQ ID NO: 444359 - RNA, 18 nt, Human
uuugguuguuauuucacc

SEQ ID NO: 444360 - RNA, 21 nt, Human
aaugagggggcagaccgagga

SEQ ID NO: 444361 - RNA, 20 nt, Human
agggggcagaccgaggaggu

SEQ ID NO: 444362 - RNA, 20 nt, Human
aggugguggcugcccggaga

SEQ ID NO: 444363 - RNA, 23 nt, Human
cacccaagucucccugcuaucau

SEQ ID NO: 444364 - RNA, 18 nt, Human
cagggccaggcugugcua

SEQ ID NO: 444365 - RNA, 26 nt, Human
cagggccaggcugugcuagauggcgc

SEQ ID NO: 444366 - RNA, 22 nt, Human
gcccggagaucagggccaggcu

SEQ ID NO: 444367 - RNA, 18 nt, Human
gugaauuuuaaugagggg

SEQ ID NO: 444368 - RNA, 18 nt, Human
ugagggggcagaccgagg

SEQ ID NO: 444369 - RNA, 23 nt, Human
ugagggggcagaccgaggaggug

SEQ ID NO: 444370 - RNA, 20 nt, Human
uggaaggggggucacccaag

SEQ ID NO: 444371 - RNA, 19 nt, Human
uucagggugggaacgugaa

SEQ ID NO: 444372 - RNA, 22 nt, Human
aaaucagagaaauucgcaaagg

SEQ ID NO: 444373 - RNA, 20 nt, Human
aaccacaucuuguaccccuu

SEQ ID NO: 444374 - RNA, 24 nt, Human
aagaaaacuuuucaggugauggcc

SEQ ID NO: 444375 - RNA, 22 nt, Human
aagcagcacaugaagauggccc

SEQ ID NO: 444376 - RNA, 22 nt, Human
aaggguuugugacaagcuuuug

SEQ ID NO: 444377 - RNA, 22 nt, Human
acagaagauaagaaaacuuuuc

SEQ ID NO: 444378 - RNA, 25 nt, Human
accuaaaucuccacacacuucccag

SEQ ID NO: 444379 - RNA, 27 nt, Human
acugaacuuaaaaaaaaaaaaaaaaaa

SEQ ID NO: 444380 - RNA, 18 nt, Human
acuuuuuuuuuuucuugg

SEQ ID NO: 444381 - RNA, 24 nt, Human
agaaauucgcaaaggacuagacaa

SEQ ID NO: 444382 - RNA, 26 nt, Human
aguauaaccacuaagaacacacuaga

SEQ ID NO: 444383 - RNA, 22 nt, Human
caaaagcacagaagauaagaaa

SEQ ID NO: 444384 - RNA, 19 nt, Human
cacaaaucagagaaauucg

SEQ ID NO: 444385 - RNA, 23 nt, Human
cagcagagcagcaccuaaaucuc

SEQ ID NO: 444386 - RNA, 23 nt, Human
caguucuauuaucugggaaugac

SEQ ID NO: 444387 - RNA, 22 nt, Human
caugaagauggcccaggagccu

SEQ ID NO: 444388 - RNA, 25 nt, Human
cauuuccaguucuauuaucugggaa

SEQ ID NO: 444389 - RNA, 19 nt, Human
ccacagaccuuuuuccaaa

SEQ ID NO: 444390 - RNA, 20 nt, Human
cccuuccucaucaacuccag

SEQ ID NO: 444391 - RNA, 20 nt, Human
cgaguguggacaagucacug

SEQ ID NO: 444392 - RNA, 19 nt, Human
cgcaaaggacuagacaaug

SEQ ID NO: 444393 - RNA, 24 nt, Human
cugaacuuaaaaaaaaaaaaaaag

SEQ ID NO: 444394 - RNA, 18 nt, Human
cugguuucaacaguacuu

SEQ ID NO: 444395 - RNA, 24 nt, Human
gaacuucagaggcaacuggaaaua

SEQ ID NO: 444396 - RNA, 21 nt, Human
gacgaguguggacaagucacu

SEQ ID NO: 444397 - RNA, 21 nt, Human
gcagcaccuaaaucuccacac

SEQ ID NO: 444398 - RNA, 20 nt, Human
gcagcagagcagcaccuaaa

SEQ ID NO: 444399 - RNA, 21 nt, Human
gccuguugucacaaaaaccuu

SEQ ID NO: 444400 - RNA, 19 nt, Human
ggagcucuucaagcagcac

SEQ ID NO: 444401 - RNA, 20 nt, Human
ggcaacuuuuuuuuuuucuu

SEQ ID NO: 444402 - RNA, 22 nt, Human
uaagacgaguguggacaaguca

SEQ ID NO: 444403 - RNA, 19 nt, Human
uacaaaauaggagcucuuc

SEQ ID NO: 444404 - RNA, 18 nt, Human
uacaccuuaacaaaggga

SEQ ID NO: 444405 - RNA, 22 nt, Human
uacagagaacuuuuuucacuuu

SEQ ID NO: 444406 - RNA, 23 nt, Human
uagacccuuggcauuaggggauu

SEQ ID NO: 444407 - RNA, 23 nt, Human
uccaaggguuugugacaagcuuu

SEQ ID NO: 444408 - RNA, 21 nt, Human
uccagaacaaagaaauguuuc

SEQ ID NO: 444409 - RNA, 18 nt, Human
ucucaucauauccucucu

SEQ ID NO: 444410 - RNA, 27 nt, Human
ucugccuguugucacaaaaaccuugac

SEQ ID NO: 444411 - RNA, 23 nt, Human
ucuuguaccccuuccucaucaac

SEQ ID NO: 444412 - RNA, 18 nt, Human
ugaaaggcagccauaagg

SEQ ID NO: 444413 - RNA, 20 nt, Human
uggcaucaaugaauaugcac

SEQ ID NO: 444414 - RNA, 23 nt, Human
uggcaucaaugaauaugcacuuc

SEQ ID NO: 444415 - RNA, 18 nt, Human
uggccauauucucaucau

SEQ ID NO: 444416 - RNA, 21 nt, Human
uggcccaggagccuucagcca

SEQ ID NO: 444417 - RNA, 22 nt, Human
uggcccaggagccuucagccau

SEQ ID NO: 444418 - RNA, 19 nt, Human
uggggaaacuucauaacug

SEQ ID NO: 444419 - RNA, 20 nt, Human
uuaaaaaaaaaaaaaaaaaa

SEQ ID NO: 444420 - RNA, 23 nt, Human
uucaacaguacuuuguuuccaga

SEQ ID NO: 444421 - RNA, 22 nt, Human
uucacauguggggaaacuucau

SEQ ID NO: 444422 - RNA, 18 nt, Human
uucaggugauggccauau

SEQ ID NO: 444423 - RNA, 21 nt, Human
uucauacauaggcggauuugu

SEQ ID NO: 444424 - RNA, 18 nt, Human
agcaaccucuugcccuuu

SEQ ID NO: 444425 - RNA, 19 nt, Human
aggggcucuaagucuuuau

SEQ ID NO: 444426 - RNA, 25 nt, Human
ccccuagagagauggcacccaaucc

SEQ ID NO: 444427 - RNA, 23 nt, Human
cucucugacuuccaccauucacu

SEQ ID NO: 444428 - RNA, 21 nt, Human
gaggagcucccaggaauccac

SEQ ID NO: 444429 - RNA, 25 nt, Human
uccacaguucuggaagagaggggcu

SEQ ID NO: 444430 - RNA, 21 nt, Human
ucucugacuuccaccauucac

SEQ ID NO: 444431 - RNA, 23 nt, Human
uuuuuggcaucuaacaguccauu

SEQ ID NO: 444432 - RNA, 21 nt, Human
aaacuccaggauguaguggca

SEQ ID NO: 444433 - RNA, 22 nt, Human
aaccaugcuagaggcucagagc

SEQ ID NO: 444434 - RNA, 19 nt, Human
aaggagcugggaaugggcc

SEQ ID NO: 444435 - RNA, 18 nt, Human
aagugacuagagccaaac

SEQ ID NO: 444436 - RNA, 25 nt, Human
acagcagccccuuugguggccuccc

SEQ ID NO: 444437 - RNA, 24 nt, Human
agcagccccuuugguggccucccu

SEQ ID NO: 444438 - RNA, 22 nt, Human
agccagaagugacuagagccaa

SEQ ID NO: 444439 - RNA, 22 nt, Human
aggcagccagaagugacuagag

SEQ ID NO: 444440 - RNA, 23 nt, Human
aggcagccagaagugacuagagc

SEQ ID NO: 444441 - RNA, 24 nt, Human
aggcuuccagcaucacggcaaaca

SEQ ID NO: 444442 - RNA, 19 nt, Human
aucuauuucauuugagcca

SEQ ID NO: 444443 - RNA, 20 nt, Human
augcaggagacagcagcccc

SEQ ID NO: 444444 - RNA, 21 nt, Human
caaagccuggugaauguaaug

SEQ ID NO: 444445 - RNA, 18 nt, Human
caacuugggaacccagag

SEQ ID NO: 444446 - RNA, 22 nt, Human
cacccuccacccaacaggccac

SEQ ID NO: 444447 - RNA, 20 nt, Human
cagaggguuuaaggagcucc

SEQ ID NO: 444448 - RNA, 24 nt, Human
cagcaucagagccagcagggauau

SEQ ID NO: 444449 - RNA, 19 nt, Human
caggaccuuccacccucca

SEQ ID NO: 444450 - RNA, 18 nt, Human
caggagacagcagccccu

SEQ ID NO: 444451 - RNA, 23 nt, Human
caggcuugcagauaaucacccac

SEQ ID NO: 444452 - RNA, 23 nt, Human
caugauauucucuuucucccuuc

SEQ ID NO: 444453 - RNA, 19 nt, Human
ccacaccuuucguacccac

SEQ ID NO: 444454 - RNA, 24 nt, Human
ccacaccuuucguacccaccagca

SEQ ID NO: 444455 - RNA, 19 nt, Human
cccaacaggccacuuucaa

SEQ ID NO: 444456 - RNA, 23 nt, Human
ccccugauagcugccauggcagc

SEQ ID NO: 444457 - RNA, 19 nt, Human
ccucucccucccuacuccc

SEQ ID NO: 444458 - RNA, 22 nt, Human
ccucucccucccuacucccuca

SEQ ID NO: 444459 - RNA, 25 nt, Human
ccuucuauuccccugauagcugcca

SEQ ID NO: 444460 - RNA, 22 nt, Human
cugcccucuccuaucacagccc

SEQ ID NO: 444461 - RNA, 18 nt, Human
cuuucguacccaccagca

SEQ ID NO: 444462 - RNA, 20 nt, Human
gacugaaccaugcuagaggc

SEQ ID NO: 444463 - RNA, 20 nt, Human
gcuugcagauaaucacccac

SEQ ID NO: 444464 - RNA, 22 nt, Human
ggaacccagagggaggggcugg

SEQ ID NO: 444465 - RNA, 20 nt, Human
ggaccuuccacccuccaccc

SEQ ID NO: 444466 - RNA, 22 nt, Human
ggagcugggaaugggccugggc

SEQ ID NO: 444467 - RNA, 18 nt, Human
ggggcuggagauggggag

SEQ ID NO: 444468 - RNA, 19 nt, Human
gugccucucccucccuacu

SEQ ID NO: 444469 - RNA, 18 nt, Human
uacccaccagcaucagag

SEQ ID NO: 444470 - RNA, 22 nt, Human
uagaggcucagagccaaggcuc

SEQ ID NO: 444471 - RNA, 26 nt, Human
ucacacaccaucacauguucucccca

SEQ ID NO: 444472 - RNA, 21 nt, Human
uccagcaucacggcaaacagg

SEQ ID NO: 444473 - RNA, 18 nt, Human
ucccaaaugagcacuggg

SEQ ID NO: 444474 - RNA, 26 nt, Human
uggcagcccuggggagacaagugcuc

SEQ ID NO: 444475 - RNA, 21 nt, Human
uguaguggcacaggcuuccag

SEQ ID NO: 444476 - RNA, 20 nt, Human
acaggaucuggauuccugca

SEQ ID NO: 444477 - RNA, 23 nt, Human
acugauucuguuucugagcauug

SEQ ID NO: 444478 - RNA, 19 nt, Human
acuggaacaacagugggag

SEQ ID NO: 444479 - RNA, 24 nt, Human
agaguaaacgcauccacgguauac

SEQ ID NO: 444480 - RNA, 21 nt, Human
aggcuucugcaucaguguggu

SEQ ID NO: 444481 - RNA, 18 nt, Human
agggguuugcucaguugg

SEQ ID NO: 444482 - RNA, 18 nt, Human
caagauugacauguccuu

SEQ ID NO: 444483 - RNA, 25 nt, Human
caccaagggccuuccacaggaucug

SEQ ID NO: 444484 - RNA, 25 nt, Human
cacuaaaggcuucugcaucagugug

SEQ ID NO: 444485 - RNA, 25 nt, Human
cagcagugcccagaaaguguguccc

SEQ ID NO: 444486 - RNA, 20 nt, Human
caucguguaacaccaagggc

SEQ ID NO: 444487 - RNA, 24 nt, Human
cauggcagacccucaaccaacacu

SEQ ID NO: 444488 - RNA, 21 nt, Human
cauugugucagguugcaguac

SEQ ID NO: 444489 - RNA, 26 nt, Human
ccaacacucgagcucccgugcagcac

SEQ ID NO: 444490 - RNA, 20 nt, Human
ccagauagucaaauuaaguu

SEQ ID NO: 444491 - RNA, 19 nt, Human
cccgugcagcacuaaaggc

SEQ ID NO: 444492 - RNA, 18 nt, Human
cccguuguccaagcacau

SEQ ID NO: 444493 - RNA, 24 nt, Human
ccuccaugcuuggaacuggaacaa

SEQ ID NO: 444494 - RNA, 23 nt, Human
ccuucugugucugagcaucgugu

SEQ ID NO: 444495 - RNA, 18 nt, Human
cuaaaggcuucugcauca

SEQ ID NO: 444496 - RNA, 18 nt, Human
cugcucccaaggccuugg

SEQ ID NO: 444497 - RNA, 24 nt, Human
cuggagguuuugcgccaguccuaa

SEQ ID NO: 444498 - RNA, 19 nt, Human
cugggguccucugaugccg

SEQ ID NO: 444499 - RNA, 20 nt, Human
cugggguccucugaugccgg

SEQ ID NO: 444500 - RNA, 19 nt, Human
cuuccugugacaguggugg

SEQ ID NO: 444501 - RNA, 24 nt, Human
cuuggaaccuggauaacagucgga

SEQ ID NO: 444502 - RNA, 21 nt, Human
gaccaagauugacauguccuu

SEQ ID NO: 444503 - RNA, 22 nt, Human
gagccuccaugcuuggaacugg

SEQ ID NO: 444504 - RNA, 21 nt, Human
gagccucuaggcuuggaaccu

SEQ ID NO: 444505 - RNA, 21 nt, Human
gauuccugcaguaguuggaga

SEQ ID NO: 444506 - RNA, 18 nt, Human
gcacuaaaggcuucugca

SEQ ID NO: 444507 - RNA, 24 nt, Human
gcccagaaagugugucccaauccc

SEQ ID NO: 444508 - RNA, 21 nt, Human
gcuggggucugugguaaaaca

SEQ ID NO: 444509 - RNA, 18 nt, Human
gguagcacugccggacca

SEQ ID NO: 444510 - RNA, 20 nt, Human
guccucugaugccggugugg

SEQ ID NO: 444511 - RNA, 20 nt, Human
uaaaggcuucugcaucagug

SEQ ID NO: 444512 - RNA, 20 nt, Human
uaacagucagaggcacgacu

SEQ ID NO: 444513 - RNA, 21 nt, Human
uaacucuguccauuaccaugg

SEQ ID NO: 444514 - RNA, 21 nt, Human
uaacucuguccauuaccgugg

SEQ ID NO: 444515 - RNA, 23 nt, Human
uaccgugguagcacugcugcucc

SEQ ID NO: 444516 - RNA, 21 nt, Human
uccacaggaucuggauuccug

SEQ ID NO: 444517 - RNA, 22 nt, Human
ucugugguaaaacaccaagggc

SEQ ID NO: 444518 - RNA, 21 nt, Human
ugaggcuuccuuggucauggc

SEQ ID NO: 444519 - RNA, 18 nt, Human
ugcuuccugugacggugg

SEQ ID NO: 444520 - RNA, 19 nt, Human
uggaaagaaucacauaguu

SEQ ID NO: 444521 - RNA, 20 nt, Human
uggguaguuuucuggggucc

SEQ ID NO: 444522 - RNA, 27 nt, Human
ugguguggugucauagaugaccaagcu

SEQ ID NO: 444523 - RNA, 27 nt, Human
ugguuuggaaggauccucuaggcuugg

SEQ ID NO: 444524 - RNA, 24 nt, Human
uguuuggaaguauccucucgucuu

SEQ ID NO: 444525 - RNA, 21 nt, Human
uucaugucuuuucaucccguu

SEQ ID NO: 444526 - RNA, 21 nt, Human
uucccagaaucuggauuccug

SEQ ID NO: 444527 - RNA, 19 nt, Human
uuccuggucaggccaugug

SEQ ID NO: 444528 - RNA, 20 nt, Human
uucugugucugagcaucgug

SEQ ID NO: 444529 - RNA, 19 nt, Human
uucuguuucugagcauugu

SEQ ID NO: 444530 - RNA, 19 nt, Human
uugacuuacaugagaguaa

SEQ ID NO: 444531 - RNA, 25 nt, Human
uuggaaccuggauaacagucggagg

SEQ ID NO: 444532 - RNA, 18 nt, Human
uuggaacuggaacaacag

SEQ ID NO: 444533 - RNA, 21 nt, Human
uuggguacuuuucugaggucc

SEQ ID NO: 444534 - RNA, 18 nt, Human
uuuaagaaauuacuggaa

SEQ ID NO: 444535 - RNA, 24 nt, Human
agcuggagaugguggugaacagcc

SEQ ID NO: 444536 - RNA, 18 nt, Human
aggaggcccugggacgcu

SEQ ID NO: 444537 - RNA, 18 nt, Human
agucauggccccucccgc

SEQ ID NO: 444538 - RNA, 22 nt, Human
cgcuuuaucuuccucagucucu

SEQ ID NO: 444539 - RNA, 22 nt, Human
cuacaaaaccgauucaaauugu

SEQ ID NO: 444540 - RNA, 19 nt, Human
cucacccucuuucugguuu

SEQ ID NO: 444541 - RNA, 21 nt, Human
cucguagucauggccccuccc

SEQ ID NO: 444542 - RNA, 22 nt, Human
cucugccuuccuuagagacuga

SEQ ID NO: 444543 - RNA, 26 nt, Human
cugaggcucaacccaggucucugccu

SEQ ID NO: 444544 - RNA, 23 nt, Human
cuggagaugguggugaacagccu

SEQ ID NO: 444545 - RNA, 22 nt, Human
cuggugucugugaucagcugga

SEQ ID NO: 444546 - RNA, 23 nt, Human
cugguuuuaggacagcccucccu

SEQ ID NO: 444547 - RNA, 21 nt, Human
gaacagccuguuugcauuucu

SEQ ID NO: 444548 - RNA, 20 nt, Human
gccccucccgcuuccugcuc

SEQ ID NO: 444549 - RNA, 23 nt, Human
gcuuuaucuuccucagucucuca

SEQ ID NO: 444550 - RNA, 20 nt, Human
ucauggccccucccgcuucc

SEQ ID NO: 444551 - RNA, 21 nt, Human
uccucagucucucacccuccu

SEQ ID NO: 444552 - RNA, 21 nt, Human
uccucagucucucacccucuu

SEQ ID NO: 444553 - RNA, 21 nt, Human
ugauucaaaguaaugcacucu

SEQ ID NO: 444554 - RNA, 21 nt, Human
uggccccucccgcuuccugcu

SEQ ID NO: 444555 - RNA, 18 nt, Human
uggucaggagugcauugc

SEQ ID NO: 444556 - RNA, 23 nt, Human
ugucuggagcaccaggguuucac

SEQ ID NO: 444557 - RNA, 21 nt, Human
uuucucuggggcccucccccu

SEQ ID NO: 444558 - RNA, 23 nt, Human
uuuuaaaagaaucuacuugguca

SEQ ID NO: 444559 - RNA, 20 nt, Human
aaacugaucuuaguucaaga

SEQ ID NO: 444560 - RNA, 22 nt, Human
aaccaaacccugugacuucaac

SEQ ID NO: 444561 - RNA, 24 nt, Human
acagugcugggauuacaggcguga

SEQ ID NO: 444562 - RNA, 18 nt, Human
acgggguuucgccauguu

SEQ ID NO: 444563 - RNA, 19 nt, Human
acgggguuucgccauguug

SEQ ID NO: 444564 - RNA, 22 nt, Human
acgggguuucgccauguugcgc

SEQ ID NO: 444565 - RNA, 23 nt, Human
acgggguuucgccauguugcgca

SEQ ID NO: 444566 - RNA, 24 nt, Human
acgggguuucgccauguugcgcag

SEQ ID NO: 444567 - RNA, 18 nt, Human
agccucgaccucccaggc

SEQ ID NO: 444568 - RNA, 18 nt, Human
aggcugaucuugaacucc

SEQ ID NO: 444569 - RNA, 18 nt, Human
agugcugggauuacaggc

SEQ ID NO: 444570 - RNA, 21 nt, Human
agugcugggauuacaggcgug

SEQ ID NO: 444571 - RNA, 22 nt, Human
agugcugggauuacaggcguga

SEQ ID NO: 444572 - RNA, 18 nt, Human
auucucccgccucagccu

SEQ ID NO: 444573 - RNA, 24 nt, Human
auuguagagacgggguuucgccau

SEQ ID NO: 444574 - RNA, 19 nt, Human
cacagugcugggauuacag

SEQ ID NO: 444575 - RNA, 21 nt, Human
cacagugcugggauuacaggc

SEQ ID NO: 444576 - RNA, 21 nt, Human
cagccucgaccucccaggcuc

SEQ ID NO: 444577 - RNA, 23 nt, Human
cagccucgaccucccaggcucag

SEQ ID NO: 444578 - RNA, 24 nt, Human
caggcucaggugauucucccgccu

SEQ ID NO: 444579 - RNA, 24 nt, Human
caggcucaggugauucucccgccu

SEQ ID NO: 444580 - RNA, 22 nt, Human
caggugauucucccgccucagc

SEQ ID NO: 444581 - RNA, 22 nt, Human
caggugauucucccgccucagc

SEQ ID NO: 444582 - RNA, 25 nt, Human
cagugcugggauuacaggcgugagc

SEQ ID NO: 444583 - RNA, 21 nt, Human
caucccgccucagccucucac

SEQ ID NO: 444584 - RNA, 24 nt, Human
cauguugcgcaggcugaucuugaa

SEQ ID NO: 444585 - RNA, 19 nt, Human
cccagguaguugggacuac

SEQ ID NO: 444586 - RNA, 23 nt, Human
cccagguaguugggacuacaagc

SEQ ID NO: 444587 - RNA, 24 nt, Human
ccucccaggcucaggugauucucc

SEQ ID NO: 444588 - RNA, 24 nt, Human
ccucccaggcucaggugauucucc

SEQ ID NO: 444589 - RNA, 27 nt, Human
cgccauguugcgcaggcugaucuugaa

SEQ ID NO: 444590 - RNA, 20 nt, Human
cgccucagccucccaggcuc

SEQ ID NO: 444591 - RNA, 20 nt, Human
cgccucagccucccagguag

SEQ ID NO: 444592 - RNA, 24 nt, Human
cgccucagccucucacagugcugg

SEQ ID NO: 444593 - RNA, 24 nt, Human
cgcucugucacccaggcuggaaug

SEQ ID NO: 444594 - RNA, 24 nt, Human
cucagccucccagguaguugggac

SEQ ID NO: 444595 - RNA, 18 nt, Human
cucaggugauucucccgc

SEQ ID NO: 444596 - RNA, 18 nt, Human
cucaggugauucucccgc

SEQ ID NO: 444597 - RNA, 20 nt, Human
cucaggugauucucccgccu

SEQ ID NO: 444598 - RNA, 20 nt, Human
cucaggugauucucccgccu

SEQ ID NO: 444599 - RNA, 21 nt, Human
cucaggugauucucccgccuc

SEQ ID NO: 444600 - RNA, 23 nt, Human
cucaggugauucucccgccucag

SEQ ID NO: 444601 - RNA, 23 nt, Human
cucaggugauucucccgccucag

SEQ ID NO: 444602 - RNA, 19 nt, Human
cucccaggcucaggugauu

SEQ ID NO: 444603 - RNA, 19 nt, Human
cucccaggcucaggugauu

SEQ ID NO: 444604 - RNA, 25 nt, Human
cucccaggcucaggugauucucccg

SEQ ID NO: 444605 - RNA, 25 nt, Human
cucccaggcucaggugauucucccg

SEQ ID NO: 444606 - RNA, 23 nt, Human
cucccgccucagccucccaggcu

SEQ ID NO: 444607 - RNA, 20 nt, Human
cuccuggauaaaucagauua

SEQ ID NO: 444608 - RNA, 21 nt, Human
cucgcucugucacccaggcug

SEQ ID NO: 444609 - RNA, 22 nt, Human
cucggcucgcugcagccucgac

SEQ ID NO: 444610 - RNA, 20 nt, Human
cugcagccucgaccucccag

SEQ ID NO: 444611 - RNA, 23 nt, Human
cugcagccucgaccucccaggcu

SEQ ID NO: 444612 - RNA, 24 nt, Human
gaccucaggugaucaucccgccuc

SEQ ID NO: 444613 - RNA, 23 nt, Human
gagacgggguuucgccauguugc

SEQ ID NO: 444614 - RNA, 18 nt, Human
gauuacaggcgugagcca

SEQ ID NO: 444615 - RNA, 22 nt, Human
gauuacaggcgugagccaccgc

SEQ ID NO: 444616 - RNA, 23 nt, Human
gauuacaggcgugagccaccgca

SEQ ID NO: 444617 - RNA, 25 nt, Human
gcucugucacccaggcuggaaugca

SEQ ID NO: 444618 - RNA, 23 nt, Human
gcugaucuugaacuccugaccuc

SEQ ID NO: 444619 - RNA, 19 nt, Human
gcuggaaugcagcggcgcg

SEQ ID NO: 444620 - RNA, 23 nt, Human
ggcucaggugauucucccgccuc

SEQ ID NO: 444621 - RNA, 24 nt, Human
ggcugaucuugaacuccugaccuc

SEQ ID NO: 444622 - RNA, 23 nt, Human
gggguuucgccauguugcgcagg

SEQ ID NO: 444623 - RNA, 22 nt, Human
ggguuucgccauguugcgcagg

SEQ ID NO: 444624 - RNA, 24 nt, Human
ggugauucucccgccucagccucc

SEQ ID NO: 444625 - RNA, 24 nt, Human
ggugauucucccgccucagccucc

SEQ ID NO: 444626 - RNA, 21 nt, Human
guagagacgggguuucgccau

SEQ ID NO: 444627 - RNA, 22 nt, Human
guagagacgggguuucgccaug

SEQ ID NO: 444628 - RNA, 18 nt, Human
guaguugggacuacaagc

SEQ ID NO: 444629 - RNA, 24 nt, Human
gugaucaucccgccucagccucuc

SEQ ID NO: 444630 - RNA, 24 nt, Human
gugauucucccgccucagccuccc

SEQ ID NO: 444631 - RNA, 24 nt, Human
gugauucucccgccucagccuccc

SEQ ID NO: 444632 - RNA, 25 nt, Human
uaauuuuuugcuauuuauuguagag

SEQ ID NO: 444633 - RNA, 22 nt, Human
uacaggcgugagccaccgcacc

SEQ ID NO: 444634 - RNA, 23 nt, Human
uacaggcgugagccaccgcaccu

SEQ ID NO: 444635 - RNA, 21 nt, Human
uagagacgggguuucgccaug

SEQ ID NO: 444636 - RNA, 22 nt, Human
uagagacgggguuucgccaugu

SEQ ID NO: 444637 - RNA, 22 nt, Human
ucacagugcugggauuacaggc

SEQ ID NO: 444638 - RNA, 24 nt, Human
ucacagugcugggauuacaggcgu

SEQ ID NO: 444639 - RNA, 19 nt, Human
ucacccaggcuggaaugca

SEQ ID NO: 444640 - RNA, 21 nt, Human
ucccaggcucaggugauucuc

SEQ ID NO: 444641 - RNA, 21 nt, Human
ucccaggcucaggugauucuc

SEQ ID NO: 444642 - RNA, 24 nt, Human
ucccaggcucaggugauucucccg

SEQ ID NO: 444643 - RNA, 24 nt, Human
ucccaggcucaggugauucucccg

SEQ ID NO: 444644 - RNA, 18 nt, Human
ucccagguaguugggacu

SEQ ID NO: 444645 - RNA, 21 nt, Human
ucgaaaccaaacccugugacu

SEQ ID NO: 444646 - RNA, 19 nt, Human
ucgcugcagccucgaccuc

SEQ ID NO: 444647 - RNA, 21 nt, Human
ucgcugcagccucgaccuccc

SEQ ID NO: 444648 - RNA, 23 nt, Human
ucgcugcagccucgaccucccag

SEQ ID NO: 444649 - RNA, 24 nt, Human
ucgcugcagccucgaccucccagg

SEQ ID NO: 444650 - RNA, 24 nt, Human
ucucacagugcugggauuacaggc

SEQ ID NO: 444651 - RNA, 19 nt, Human
ucucccgccucagccuccc

SEQ ID NO: 444652 - RNA, 23 nt, Human
ucucccgccucagccucccaggc

SEQ ID NO: 444653 - RNA, 19 nt, Human
ucucgcucugucacccagg

SEQ ID NO: 444654 - RNA, 23 nt, Human
ucucgcucugucacccaggcugg

SEQ ID NO: 444655 - RNA, 24 nt, Human
ucucgcucugucacccaggcugga

SEQ ID NO: 444656 - RNA, 26 nt, Human
ucucgcucugucacccaggcuggaau

SEQ ID NO: 444657 - RNA, 27 nt, Human
ucucgcucugucacccaggcuggaaug

SEQ ID NO: 444658 - RNA, 24 nt, Human
ucugucacccaggcuggaaugcag

SEQ ID NO: 444659 - RNA, 23 nt, Human
ucuugaacuccugaccucaggug

SEQ ID NO: 444660 - RNA, 20 nt, Human
ugaccucaggugaucauccc

SEQ ID NO: 444661 - RNA, 24 nt, Human
ugaccucaggugaucaucccgccu

SEQ ID NO: 444662 - RNA, 20 nt, Human
ugauucucccgccucagccu

SEQ ID NO: 444663 - RNA, 22 nt, Human
ugcagcggcgcgaucucggcuc

SEQ ID NO: 444664 - RNA, 24 nt, Human
ugcugggauuacaggcgugagcca

SEQ ID NO: 444665 - RNA, 24 nt, Human
uggaaugcagcggcgcgaucucgg

SEQ ID NO: 444666 - RNA, 23 nt, Human
uggauaaaucagauuaaaauuuu

SEQ ID NO: 444667 - RNA, 18 nt, Human
ugggacuacaagcgugca

SEQ ID NO: 444668 - RNA, 18 nt, Human
ugggauuacaggcgugag

SEQ ID NO: 444669 - RNA, 19 nt, Human
ugggauuacaggcgugagc

SEQ ID NO: 444670 - RNA, 21 nt, Human
ugggauuacaggcgugagcca

SEQ ID NO: 444671 - RNA, 22 nt, Human
ugggauuacaggcgugagccac

SEQ ID NO: 444672 - RNA, 23 nt, Human
ugggauuacaggcgugagccacc

SEQ ID NO: 444673 - RNA, 24 nt, Human
ugggauuacaggcgugagccaccg

SEQ ID NO: 444674 - RNA, 24 nt, Human
uguagagacgggguuucgccaugu

SEQ ID NO: 444675 - RNA, 24 nt, Human
uuacuguacagccuuccuccugga

SEQ ID NO: 444676 - RNA, 18 nt, Human
uuagaaacuucaaaacug

SEQ ID NO: 444677 - RNA, 23 nt, Human
uuguagagacgggguuucgccau

SEQ ID NO: 444678 - RNA, 24 nt, Human
uuguagagacgggguuucgccaug

SEQ ID NO: 444679 - RNA, 25 nt, Human
uuuuuauuuuuugagacauggucuc

SEQ ID NO: 444680 - RNA, 24 nt, Human
uuuuuugcuauuuauuguagagac

SEQ ID NO: 444681 - RNA, 21 nt, Human
aaaaaaaaaaaaaaaaagucu

SEQ ID NO: 444682 - RNA, 20 nt, Human
aaaugccaaagucacuaaca

SEQ ID NO: 444683 - RNA, 22 nt, Human
aaaugccaaagucacuaacacu

SEQ ID NO: 444684 - RNA, 19 nt, Human
aacacagugaaaccccguc

SEQ ID NO: 444685 - RNA, 20 nt, Human
aacacagugaaaccccgucu

SEQ ID NO: 444686 - RNA, 21 nt, Human
aacacagugaaaccccgucuc

SEQ ID NO: 444687 - RNA, 23 nt, Human
aacuacuucuucccauuccccac

SEQ ID NO: 444688 - RNA, 21 nt, Human
acacagugaaaccccgucucc

SEQ ID NO: 444689 - RNA, 19 nt, Human
acccuggaauucgaaaggg

SEQ ID NO: 444690 - RNA, 20 nt, Human
acuaacacucaguuccauaa

SEQ ID NO: 444691 - RNA, 18 nt, Human
acugcacuccauccuggg

SEQ ID NO: 444692 - RNA, 19 nt, Human
acugcacuccauccugggc

SEQ ID NO: 444693 - RNA, 24 nt, Human
acugcacuccauccugggcgauag

SEQ ID NO: 444694 - RNA, 19 nt, Human
agacacguccuccggccuc

SEQ ID NO: 444695 - RNA, 22 nt, Human
agagcgagacuccaucucaaaa

SEQ ID NO: 444696 - RNA, 24 nt, Human
agcacuuugggaggccgagguggg

SEQ ID NO: 444697 - RNA, 23 nt, Human
agccgggcgugguggcaggugcc

SEQ ID NO: 444698 - RNA, 22 nt, Human
agcgacaggacagcucuagaga

SEQ ID NO: 444699 - RNA, 25 nt, Human
aggcaggguccucuugucccgucgc

SEQ ID NO: 444700 - RNA, 21 nt, Human
aggccgaggugggcagaucac

SEQ ID NO: 444701 - RNA, 21 nt, Human
aggccggagaauggugugaac

SEQ ID NO: 444702 - RNA, 24 nt, Human
aggccggagaauggugugaacccg

SEQ ID NO: 444703 - RNA, 24 nt, Human
aggcgcgguggcucacgccuguaa

SEQ ID NO: 444704 - RNA, 24 nt, Human
aggcggaguuugcagugagccgag

SEQ ID NO: 444705 - RNA, 24 nt, Human
aggugggcagaucacgaggucagg

SEQ ID NO: 444706 - RNA, 21 nt, Human
aguggagcugcuguuucuucu

SEQ ID NO: 444707 - RNA, 18 nt, Human
auacacccccagaaggac

SEQ ID NO: 444708 - RNA, 20 nt, Human
aucugcauuaaccccucccu

SEQ ID NO: 444709 - RNA, 24 nt, Human
auugagccacugcacuccauccug

SEQ ID NO: 444710 - RNA, 20 nt, Human
caagcacaguaaacacgcug

SEQ ID NO: 444711 - RNA, 19 nt, Human
cacacaggucaauccuggg

SEQ ID NO: 444712 - RNA, 22 nt, Human
caccugcuccucagcuggggau

SEQ ID NO: 444713 - RNA, 24 nt, Human
cacgccuguaaucccagcacuuug

SEQ ID NO: 444714 - RNA, 21 nt, Human
cacucucacaccaaggcaggg

SEQ ID NO: 444715 - RNA, 23 nt, Human
cacugcacuccauccugggcgau

SEQ ID NO: 444716 - RNA, 24 nt, Human
cacugcacuccauccugggcgaua

SEQ ID NO: 444717 - RNA, 24 nt, Human
cagcacuuugggaggccgaggugg

SEQ ID NO: 444718 - RNA, 22 nt, Human
cagcgacaggacagcucuagag

SEQ ID NO: 444719 - RNA, 20 nt, Human
caugacaaccaccccaacca

SEQ ID NO: 444720 - RNA, 23 nt, Human
caugacaaccaccccaaccacca

SEQ ID NO: 444721 - RNA, 18 nt, Human
ccacacucuccaguccuc

SEQ ID NO: 444722 - RNA, 20 nt, Human
ccacugcacuccauccuggg

SEQ ID NO: 444723 - RNA, 21 nt, Human
ccacugcacuccauccugggc

SEQ ID NO: 444724 - RNA, 21 nt, Human
ccacugcacuccauccugggc

SEQ ID NO: 444725 - RNA, 24 nt, Human
ccacugcacuccauccugggcgau

SEQ ID NO: 444726 - RNA, 25 nt, Human
ccaucucaaaaaaaaaaaaaaaaaa

SEQ ID NO: 444727 - RNA, 23 nt, Human
cccaauauauucuuuaguccaaa

SEQ ID NO: 444728 - RNA, 20 nt, Human
cccaaugcuaaacugcuuuc

SEQ ID NO: 444729 - RNA, 19 nt, Human
cccccagaaggacaaggga

SEQ ID NO: 444730 - RNA, 22 nt, Human
ccugggcgauagagcgagacuc

SEQ ID NO: 444731 - RNA, 21 nt, Human
ccuguagucccagcuacucgg

SEQ ID NO: 444732 - RNA, 23 nt, Human
cgagacuccaucucaaaaaaaaa

SEQ ID NO: 444733 - RNA, 24 nt, Human
cgaggugggcagaucacgagguca

SEQ ID NO: 444734 - RNA, 23 nt, Human
cgccuguaaucccagcacuuugg

SEQ ID NO: 444735 - RNA, 24 nt, Human
cgccuguaaucccagcacuuuggg

SEQ ID NO: 444736 - RNA, 24 nt, Human
cguggcuaacacagugaaaccccg

SEQ ID NO: 444737 - RNA, 18 nt, Human
cucaaaaaaaaaaaaaaa

SEQ ID NO: 444738 - RNA, 22 nt, Human
cucacgccuguaaucccagcac

SEQ ID NO: 444739 - RNA, 24 nt, Human
cucacgccuguaaucccagcacuu

SEQ ID NO: 444740 - RNA, 23 nt, Human
cuccagucacuguccagacugga

SEQ ID NO: 444741 - RNA, 19 nt, Human
cuccaucucaaaaaaaaaa

SEQ ID NO: 444742 - RNA, 19 nt, Human
cuccauuuucagcucuuuc

SEQ ID NO: 444743 - RNA, 21 nt, Human
cugaggccggagaauggugug

SEQ ID NO: 444744 - RNA, 21 nt, Human
cuggaagguuuuccuuaaccc

SEQ ID NO: 444745 - RNA, 21 nt, Human
cuuggugcacuugccaucugc

SEQ ID NO: 444746 - RNA, 23 nt, Human
cuuugggaggccgaggugggcag

SEQ ID NO: 444747 - RNA, 24 nt, Human
gacaagggagaguggaugcuggaa

SEQ ID NO: 444748 - RNA, 19 nt, Human
gagcugcuguuucuucucc

SEQ ID NO: 444749 - RNA, 23 nt, Human
gaguuugcagugagccgagauug

SEQ ID NO: 444750 - RNA, 24 nt, Human
gauacacccccagaaggacaaggg

SEQ ID NO: 444751 - RNA, 24 nt, Human
gccacugcacuccauccugggcga

SEQ ID NO: 444752 - RNA, 23 nt, Human
gccagcggcuggguuaccgaggg

SEQ ID NO: 444753 - RNA, 20 nt, Human
ggaaagacagagcgagagag

SEQ ID NO: 444754 - RNA, 24 nt, Human
ggaaggacaucaaaccuggggggg

SEQ ID NO: 444755 - RNA, 21 nt, Human
ggaagguuuuccuuaacccuc

SEQ ID NO: 444756 - RNA, 18 nt, Human
ggagauggagaccaucgu

SEQ ID NO: 444757 - RNA, 24 nt, Human
ggaguuugcagugagccgagauug

SEQ ID NO: 444758 - RNA, 21 nt, Human
ggcagaucacgaggucaggag

SEQ ID NO: 444759 - RNA, 21 nt, Human
ggcucacgccuguaaucccag

SEQ ID NO: 444760 - RNA, 21 nt, Human
gggaaguuuggguucucaggg

SEQ ID NO: 444761 - RNA, 23 nt, Human
gggacaugcacccuuuaguaacc

SEQ ID NO: 444762 - RNA, 23 nt, Human
gguggcucacgccuguaauccca

SEQ ID NO: 444763 - RNA, 24 nt, Human
gguggcucacgccuguaaucccag

SEQ ID NO: 444764 - RNA, 23 nt, Human
guaauaaccagacacguccuccg

SEQ ID NO: 444765 - RNA, 18 nt, Human
gugcuuccucccaaugcu

SEQ ID NO: 444766 - RNA, 23 nt, Human
uacacacaggucaauccugggca

SEQ ID NO: 444767 - RNA, 19 nt, Human
uacacccccagaaggacaa

SEQ ID NO: 444768 - RNA, 23 nt, Human
uaccaccugccucucaggguuca

SEQ ID NO: 444769 - RNA, 18 nt, Human
uaguaaccuggaggggac

SEQ ID NO: 444770 - RNA, 24 nt, Human
uauccaacaguucuaacucugguu

SEQ ID NO: 444771 - RNA, 22 nt, Human
ucaaaaaaaaaaaaaaaaaaaa

SEQ ID NO: 444772 - RNA, 23 nt, Human
ucaaaaaaaaaaaaaaaaaaaaa

SEQ ID NO: 444773 - RNA, 24 nt, Human
ucacgaggucaggagauggagacc

SEQ ID NO: 444774 - RNA, 28 nt, Human
ucagcucuuucuuuuccuggccuucuca

SEQ ID NO: 444775 - RNA, 20 nt, Human
ucaugaccaagcacaguaaa

SEQ ID NO: 444776 - RNA, 19 nt, Human
uccaagggaucuuccucug

SEQ ID NO: 444777 - RNA, 19 nt, Human
uccauaagcuuuaccuugc

SEQ ID NO: 444778 - RNA, 24 nt, Human
uccauccugggcgauagagcgaga

SEQ ID NO: 444779 - RNA, 23 nt, Human
uccaucucaaaaaaaaaaaaaaa

SEQ ID NO: 444780 - RNA, 22 nt, Human
ucccagcagcucaugaccaagc

SEQ ID NO: 444781 - RNA, 22 nt, Human
ucccauuccccacacucuccag

SEQ ID NO: 444782 - RNA, 19 nt, Human
uccccacacucuccagucc

SEQ ID NO: 444783 - RNA, 20 nt, Human
uccucucuccucccuuauug

SEQ ID NO: 444784 - RNA, 19 nt, Human
ucgguaguggagcugcugu

SEQ ID NO: 444785 - RNA, 22 nt, Human
ucucagauacucucugggaagu

SEQ ID NO: 444786 - RNA, 19 nt, Human
ucuccagucacuguccaga

SEQ ID NO: 444787 - RNA, 21 nt, Human
ucuccaguccucucuccuccc

SEQ ID NO: 444788 - RNA, 20 nt, Human
ucuuucuuuuccuggccuuc

SEQ ID NO: 444789 - RNA, 22 nt, Human
ugacaaccaccccaaccaccau

SEQ ID NO: 444790 - RNA, 22 nt, Human
ugagccgagauugagccacugc

SEQ ID NO: 444791 - RNA, 24 nt, Human
ugaggccggagaauggugugaacc

SEQ ID NO: 444792 - RNA, 20 nt, Human
ugaguaggugaguuuauugg

SEQ ID NO: 444793 - RNA, 26 nt, Human
ugccaaagucacuaacacucaguucc

SEQ ID NO: 444794 - RNA, 19 nt, Human
ugcccggcauuucugcccu

SEQ ID NO: 444795 - RNA, 18 nt, Human
ugcccuccuuaucccccu

SEQ ID NO: 444796 - RNA, 20 nt, Human
ugcccugguggcugcacugc

SEQ ID NO: 444797 - RNA, 23 nt, Human
ugccuguagucccagcuacucgg

SEQ ID NO: 444798 - RNA, 24 nt, Human
ugccuguagucccagcuacucggg

SEQ ID NO: 444799 - RNA, 20 nt, Human
ugcuguuucuucuccuguau

SEQ ID NO: 444800 - RNA, 24 nt, Human
uggccaggcgcgguggcucacgcc

SEQ ID NO: 444801 - RNA, 21 nt, Human
uggcuaacacagugaaacccc

SEQ ID NO: 444802 - RNA, 22 nt, Human
uggcucacgccuguaaucccag

SEQ ID NO: 444803 - RNA, 24 nt, Human
uggcucacgccuguaaucccagca

SEQ ID NO: 444804 - RNA, 20 nt, Human
ugggaggccgaggugggcag

SEQ ID NO: 444805 - RNA, 24 nt, Human
ugggaggccgaggugggcagauca

SEQ ID NO: 444806 - RNA, 22 nt, Human
ugggcagaucacgaggucagga

SEQ ID NO: 444807 - RNA, 24 nt, Human
ugguggcaggugccuguaguccca

SEQ ID NO: 444808 - RNA, 25 nt, Human
ugguuuucuccauuuucagcucuuu

SEQ ID NO: 444809 - RNA, 30 nt, Human
uguuucuucuccuguauccaacaguucuaa

SEQ ID NO: 444810 - RNA, 21 nt, Human
uuagccgggcgugguggcagg

SEQ ID NO: 444811 - RNA, 24 nt, Human
uuagccgggcgugguggcaggugc

SEQ ID NO: 444812 - RNA, 18 nt, Human
uuccuuggagcucuccag

SEQ ID NO: 444813 - RNA, 22 nt, Human
uucuuggaaggacaucaaaccu

SEQ ID NO: 444814 - RNA, 21 nt, Human
uugcaggcuccaguguuccug

SEQ ID NO: 444815 - RNA, 25 nt, Human
uugcagugagccgagauugagccac

SEQ ID NO: 444816 - RNA, 25 nt, Human
uugggaggccgaggugggcagauca

SEQ ID NO: 444817 - RNA, 19 nt, Human
uuuccuggccuucucauug

SEQ ID NO: 444818 - RNA, 19 nt, Human
uuugcagugagccgagauu

SEQ ID NO: 444819 - RNA, 24 nt, Human
uuuggccaggcgcgguggcucacg

SEQ ID NO: 444820 - RNA, 22 nt, Human
aaauaaccuaaaggggauccau

SEQ ID NO: 444821 - RNA, 22 nt, Human
aaaugccaaagucacuaacacu

SEQ ID NO: 444822 - RNA, 22 nt, Human
aaaugccaagaccaaccuagcc

SEQ ID NO: 444823 - RNA, 24 nt, Human
acaggaugcuucccagccccaccc

SEQ ID NO: 444824 - RNA, 19 nt, Human
acccuggaacccaaaaggg

SEQ ID NO: 444825 - RNA, 25 nt, Human
accuccccucuauuccuccccccaa

SEQ ID NO: 444826 - RNA, 19 nt, Human
accugacuggaaggguucg

SEQ ID NO: 444827 - RNA, 21 nt, Human
accugguccucagcuggggac

SEQ ID NO: 444828 - RNA, 20 nt, Human
acuaacacucagcuccauaa

SEQ ID NO: 444829 - RNA, 18 nt, Human
acuacaaccaccaccucc

SEQ ID NO: 444830 - RNA, 25 nt, Human
acucucacaccaaggcaggguccuu

SEQ ID NO: 444831 - RNA, 19 nt, Human
agagggagguuggaggggc

SEQ ID NO: 444832 - RNA, 21 nt, Human
agauauacccuggaacccaaa

SEQ ID NO: 444833 - RNA, 21 nt, Human
agccaccuguggacagaggga

SEQ ID NO: 444834 - RNA, 26 nt, Human
aggagaaagcaaauugugggacugaa

SEQ ID NO: 444835 - RNA, 21 nt, Human
aguggagccgcuguuucuucu

SEQ ID NO: 444836 - RNA, 19 nt, Human
auccggccucccccagucu

SEQ ID NO: 444837 - RNA, 21 nt, Human
aucugcauaauaaccagacac

SEQ ID NO: 444838 - RNA, 20 nt, Human
aucugcauuaaccccucccc

SEQ ID NO: 444839 - RNA, 22 nt, Human
caaaugccaagaccaaccuagc

SEQ ID NO: 444840 - RNA, 22 nt, Human
caagaagccacuggcugacuga

SEQ ID NO: 444841 - RNA, 23 nt, Human
caagacagaguggaugcuggaaa

SEQ ID NO: 444842 - RNA, 19 nt, Human
cacacuacaaccaccaccu

SEQ ID NO: 444843 - RNA, 21 nt, Human
caccgccaucaucaagaagcc

SEQ ID NO: 444844 - RNA, 21 nt, Human
cacucucacaccaaggcaggg

SEQ ID NO: 444845 - RNA, 25 nt, Human
cagccccacccuuggcccaguccca

SEQ ID NO: 444846 - RNA, 22 nt, Human
caggggacauauaccccuaaau

SEQ ID NO: 444847 - RNA, 21 nt, Human
caggguccuuuuguccaagga

SEQ ID NO: 444848 - RNA, 22 nt, Human
caucacacuacaaccaccaccu

SEQ ID NO: 444849 - RNA, 25 nt, Human
ccaauauauucguuagucuaaagga

SEQ ID NO: 444850 - RNA, 18 nt, Human
ccacacucuccagucccc

SEQ ID NO: 444851 - RNA, 22 nt, Human
ccaccuguggacagagggaggu

SEQ ID NO: 444852 - RNA, 24 nt, Human
cccagccccacccuuggcccaguc

SEQ ID NO: 444853 - RNA, 23 nt, Human
cccauccuugguccagcagcacc

SEQ ID NO: 444854 - RNA, 20 nt, Human
ccccucuccucccuuauucc

SEQ ID NO: 444855 - RNA, 22 nt, Human
ccccugcugugcucagcuacag

SEQ ID NO: 444856 - RNA, 19 nt, Human
cccuggaacccaaaaggga

SEQ ID NO: 444857 - RNA, 18 nt, Human
ccggccucccccagucuc

SEQ ID NO: 444858 - RNA, 23 nt, Human
ccuccccucuauuccucccccca

SEQ ID NO: 444859 - RNA, 18 nt, Human
ccugggccccagccagcu

SEQ ID NO: 444860 - RNA, 20 nt, Human
ccuugguccagcagcacccu

SEQ ID NO: 444861 - RNA, 18 nt, Human
cgguguuuuuuaaucucc

SEQ ID NO: 444862 - RNA, 22 nt, Human
cuccagcauuccugccuucucc

SEQ ID NO: 444863 - RNA, 19 nt, Human
cuccaguccccucuccucc

SEQ ID NO: 444864 - RNA, 22 nt, Human
cuccccucuauuccucccccca

SEQ ID NO: 444865 - RNA, 20 nt, Human
cuccugggccccagccagcu

SEQ ID NO: 444866 - RNA, 20 nt, Human
cucuuuaucccccuaauaaa

SEQ ID NO: 444867 - RNA, 19 nt, Human
cuguguauggcucaccucc

SEQ ID NO: 444868 - RNA, 21 nt, Human
cuuggugcacuugccaucugc

SEQ ID NO: 444869 - RNA, 27 nt, Human
gagacuguuuuucuugguagguucucg

SEQ ID NO: 444870 - RNA, 20 nt, Human
gagccgcuguuucuucugcu

SEQ ID NO: 444871 - RNA, 20 nt, Human
gaggagaaagcaaauugugg

SEQ ID NO: 444872 - RNA, 25 nt, Human
gcaaaacaggaugcuucccagcccc

SEQ ID NO: 444873 - RNA, 22 nt, Human
gcuccauaaacuuuaccuugcc

SEQ ID NO: 444874 - RNA, 18 nt, Human
gggcaggucgguagugga

SEQ ID NO: 444875 - RNA, 18 nt, Human
ggguuuuuagagacaccu

SEQ ID NO: 444876 - RNA, 27 nt, Human
gucacaacuuggcagcagcuccugauc

SEQ ID NO: 444877 - RNA, 19 nt, Human
guggaucccaccuccagcc

SEQ ID NO: 444878 - RNA, 22 nt, Human
gugucagcaaaugccaagacca

SEQ ID NO: 444879 - RNA, 20 nt, Human
uaaaggggauccaucacacu

SEQ ID NO: 444880 - RNA, 23 nt, Human
uacacacagggcacucagcagga

SEQ ID NO: 444881 - RNA, 23 nt, Human
uacacuuccaggaggacaagaca

SEQ ID NO: 444882 - RNA, 22 nt, Human
uaggacuuacacacagggcacu

SEQ ID NO: 444883 - RNA, 20 nt, Human
uagguucucgcauacucucc

SEQ ID NO: 444884 - RNA, 23 nt, Human
uccaccgccaucaucaagaagcc

SEQ ID NO: 444885 - RNA, 25 nt, Human
uccaccgccaucaucaagaagccac

SEQ ID NO: 444886 - RNA, 19 nt, Human
ucccagccccacccuuggc

SEQ ID NO: 444887 - RNA, 19 nt, Human
uccccacacucuccagucc

SEQ ID NO: 444888 - RNA, 22 nt, Human
uccccacacucuccaguccccu

SEQ ID NO: 444889 - RNA, 19 nt, Human
ucccucugcccucacucuc

SEQ ID NO: 444890 - RNA, 21 nt, Human
ucggcuuucugcauuuucagc

SEQ ID NO: 444891 - RNA, 24 nt, Human
ucuccagucacugaccugacugga

SEQ ID NO: 444892 - RNA, 23 nt, Human
ucuccugggccccagccagcugg

SEQ ID NO: 444893 - RNA, 21 nt, Human
ucugcccucacucucacacca

SEQ ID NO: 444894 - RNA, 20 nt, Human
ucuuucuuuuccuggccuuc

SEQ ID NO: 444895 - RNA, 18 nt, Human
ugagacuguuuuucuugg

SEQ ID NO: 444896 - RNA, 24 nt, Human
ugagauauacccuggaacccaaaa

SEQ ID NO: 444897 - RNA, 19 nt, Human
ugaguaaugagacuguuuu

SEQ ID NO: 444898 - RNA, 27 nt, Human
ugccaaagucacuaacacucagcucca

SEQ ID NO: 444899 - RNA, 18 nt, Human
ugcccucuuuaucccccu

SEQ ID NO: 444900 - RNA, 18 nt, Human
ugcuccagcucccucugc

SEQ ID NO: 444901 - RNA, 19 nt, Human
uggacagagggagguugga

SEQ ID NO: 444902 - RNA, 21 nt, Human
uggagccgcuguuucuucugc

SEQ ID NO: 444903 - RNA, 21 nt, Human
ugguuccugcacaccuccccu

SEQ ID NO: 444904 - RNA, 25 nt, Human
ugugagcaagauccagcuguucuga

SEQ ID NO: 444905 - RNA, 31 nt, Human
uguggacagagggagguuggaggggcuggaa

SEQ ID NO: 444906 - RNA, 23 nt, Human
uuaccuggccuucaggguucaag

SEQ ID NO: 444907 - RNA, 18 nt, Human
uuccauggagcucuccag

SEQ ID NO: 444908 - RNA, 22 nt, Human
uucccagccccacccuuggccc

SEQ ID NO: 444909 - RNA, 20 nt, Human
uucuuuuccuggccuucuca

SEQ ID NO: 444910 - RNA, 24 nt, Human
uugguagguucucgcauacucucc

SEQ ID NO: 444911 - RNA, 19 nt, Human
uuuccuggccuucucauug

SEQ ID NO: 444912 - RNA, 22 nt, Human
uuucuucuuccuauuccccaca

SEQ ID NO: 444913 - RNA, 22 nt, Human
uuuuuuuucuuaacccuugagg

SEQ ID NO: 444914 - RNA, 23 nt, Human
aacacgcugcuccccagcaccuc

SEQ ID NO: 444915 - RNA, 23 nt, Human
aacugcuucuuuccauuccccac

SEQ ID NO: 444916 - RNA, 21 nt, Human
aaguaaagacaggcauaagaa

SEQ ID NO: 444917 - RNA, 20 nt, Human
acaagccgcaaaaccagcaa

SEQ ID NO: 444918 - RNA, 26 nt, Human
accaccaccaccaucaucaagaagcc

SEQ ID NO: 444919 - RNA, 25 nt, Human
acccucaggggugcauucucuuucc

SEQ ID NO: 444920 - RNA, 22 nt, Human
acgagacuuuuacuugguuggu

SEQ ID NO: 444921 - RNA, 18 nt, Human
acuacaaccaccaccacc

SEQ ID NO: 444922 - RNA, 19 nt, Human
agacacguccuccagcccc

SEQ ID NO: 444923 - RNA, 20 nt, Human
agacacguccuccagccccc

SEQ ID NO: 444924 - RNA, 24 nt, Human
agacagcucgagagauccagccuc

SEQ ID NO: 444925 - RNA, 24 nt, Human
agagauccagccucccccaauguc

SEQ ID NO: 444926 - RNA, 21 nt, Human
agauuuucagcaaagcagcuc

SEQ ID NO: 444927 - RNA, 21 nt, Human
aggagacaggguuuugagagc

SEQ ID NO: 444928 - RNA, 19 nt, Human
aggugacauacauccuccu

SEQ ID NO: 444929 - RNA, 21 nt, Human
aguggagccgcuguuucuucu

SEQ ID NO: 444930 - RNA, 23 nt, Human
auaauaaccagacacguccucca

SEQ ID NO: 444931 - RNA, 18 nt, Human
auuuauagacccacccuc

SEQ ID NO: 444932 - RNA, 18 nt, Human
caaccaccaccaccauca

SEQ ID NO: 444933 - RNA, 24 nt, Human
caacuaggacacagugcguccccu

SEQ ID NO: 444934 - RNA, 20 nt, Human
caacuucccagcagcucaca

SEQ ID NO: 444935 - RNA, 20 nt, Human
caagcacagcaaacacgcug

SEQ ID NO: 444936 - RNA, 19 nt, Human
caagccgcaaaaccagcaa

SEQ ID NO: 444937 - RNA, 18 nt, Human
caaggcaaguggaggcag

SEQ ID NO: 444938 - RNA, 19 nt, Human
cacaaggcaaguggaggca

SEQ ID NO: 444939 - RNA, 20 nt, Human
cacaauccacguucuucugc

SEQ ID NO: 444940 - RNA, 18 nt, Human
cacacuacaaccaccacc

SEQ ID NO: 444941 - RNA, 24 nt, Human
cacagcaaacacgcugcuccccag

SEQ ID NO: 444942 - RNA, 24 nt, Human
caccaccaccaucaucaagaagcc

SEQ ID NO: 444943 - RNA, 21 nt, Human
caccaccaucaucaagaagcc

SEQ ID NO: 444944 - RNA, 18 nt, Human
caccagggaaggauucca

SEQ ID NO: 444945 - RNA, 21 nt, Human
cacuacaaccaccaccaccau

SEQ ID NO: 444946 - RNA, 18 nt, Human
cagcaaacacgcugcucc

SEQ ID NO: 444947 - RNA, 20 nt, Human
cagcaaagcagcucccucca

SEQ ID NO: 444948 - RNA, 22 nt, Human
cagcaaagcagcucccuccaug

SEQ ID NO: 444949 - RNA, 19 nt, Human
cagcagcucacaaucaagg

SEQ ID NO: 444950 - RNA, 24 nt, Human
cagcccccaagauauacccaggaa

SEQ ID NO: 444951 - RNA, 27 nt, Human
cagggcgagaucacaggaacacaggac

SEQ ID NO: 444952 - RNA, 22 nt, Human
cagugcguccccucuaggcgag

SEQ ID NO: 444953 - RNA, 18 nt, Human
ccaagauauacccaggaa

SEQ ID NO: 444954 - RNA, 27 nt, Human
ccaccaccaccaucaucaagaagcccc

SEQ ID NO: 444955 - RNA, 22 nt, Human
ccacuggcugacucagauacac

SEQ ID NO: 444956 - RNA, 18 nt, Human
ccccaagauauacccagg

SEQ ID NO: 444957 - RNA, 18 nt, Human
ccccacacucuccagucc

SEQ ID NO: 444958 - RNA, 21 nt, Human
ccccagcauuucugccuucuc

SEQ ID NO: 444959 - RNA, 22 nt, Human
ccccagcauuucugccuucucc

SEQ ID NO: 444960 - RNA, 20 nt, Human
ccccucuccucccuuauucc

SEQ ID NO: 444961 - RNA, 22 nt, Human
ccccugcugugcucagcuacag

SEQ ID NO: 444962 - RNA, 23 nt, Human
cccuacagucucgaccauagaag

SEQ ID NO: 444963 - RNA, 18 nt, Human
ccucaggggugcauucuc

SEQ ID NO: 444964 - RNA, 19 nt, Human
ccucccucucuuccucccc

SEQ ID NO: 444965 - RNA, 19 nt, Human
ccucgcccucuuuauuccc

SEQ ID NO: 444966 - RNA, 24 nt, Human
ccuuauuccaggccccagcauuuc

SEQ ID NO: 444967 - RNA, 22 nt, Human
ccuucaggguucaagcagggga

SEQ ID NO: 444968 - RNA, 18 nt, Human
cguuuggggucccugacu

SEQ ID NO: 444969 - RNA, 21 nt, Human
cuaacacugaguuccauaaac

SEQ ID NO: 444970 - RNA, 21 nt, Human
cucacaagccgcaaaaccagc

SEQ ID NO: 444971 - RNA, 19 nt, Human
cuccaguccccucuccucc

SEQ ID NO: 444972 - RNA, 19 nt, Human
cuccauuuucagcucuuuc

SEQ ID NO: 444973 - RNA, 19 nt, Human
cuccucagcugacaggauu

SEQ ID NO: 444974 - RNA, 20 nt, Human
gaaagaagagaaauaugacc

SEQ ID NO: 444975 - RNA, 23 nt, Human
gaaauaugacucuguuccaccag

SEQ ID NO: 444976 - RNA, 23 nt, Human
gagaucacaggaacacaggaccg

SEQ ID NO: 444977 - RNA, 19 nt, Human
gagccgcuguuucuucucc

SEQ ID NO: 444978 - RNA, 24 nt, Human
gauacacccccgggaggacaaggg

SEQ ID NO: 444979 - RNA, 20 nt, Human
gauacugacuguuagccuca

SEQ ID NO: 444980 - RNA, 19 nt, Human
gaugccucacaagccgcaa

SEQ ID NO: 444981 - RNA, 24 nt, Human
gccucacaagccgcaaaaccagca

SEQ ID NO: 444982 - RNA, 22 nt, Human
ggcaaguggaggcagggcgaga

SEQ ID NO: 444983 - RNA, 21 nt, Human
gggaagugauuuugguuccag

SEQ ID NO: 444984 - RNA, 21 nt, Human
gggagggaguguaugaauagg

SEQ ID NO: 444985 - RNA, 23 nt, Human
ggggagggaguguaugaauaggg

SEQ ID NO: 444986 - RNA, 21 nt, Human
gggugugggugugggucacaa

SEQ ID NO: 444987 - RNA, 18 nt, Human
guaaagacaggcauaaga

SEQ ID NO: 444988 - RNA, 27 nt, Human
guaaagacaggcauaagaaaucacaag

SEQ ID NO: 444989 - RNA, 18 nt, Human
guaaagacaggcauagga

SEQ ID NO: 444990 - RNA, 21 nt, Human
guaaccccuccccugcugugc

SEQ ID NO: 444991 - RNA, 20 nt, Human
guaugaauagggugugggug

SEQ ID NO: 444992 - RNA, 18 nt, Human
gucccggccugugucugg

SEQ ID NO: 444993 - RNA, 24 nt, Human
uaaagcuagguguccaggggagac

SEQ ID NO: 444994 - RNA, 24 nt, Human
uaauaaccagacacguccuccagc

SEQ ID NO: 444995 - RNA, 23 nt, Human
uacacacagggcacucagcaaga

SEQ ID NO: 444996 - RNA, 26 nt, Human
uaccucgcccucuuuauuccccuaaa

SEQ ID NO: 444997 - RNA, 23 nt, Human
uagaauaucacaaggcaagugga

SEQ ID NO: 444998 - RNA, 22 nt, Human
uaggacuuacacacagggcacu

SEQ ID NO: 444999 - RNA, 20 nt, Human
ucaagcacagcaaacacgcu

SEQ ID NO: 445000 - RNA, 25 nt, Human
ucacaaucaagcacagcaaacacgc

SEQ ID NO: 445001 - RNA, 24 nt, Human
ucagcgauauuucucccauuugcu

SEQ ID NO: 445002 - RNA, 21 nt, Human
ucaggggugcauucucuuucu

SEQ ID NO: 445003 - RNA, 19 nt, Human
uccaagggaucuuccucug

SEQ ID NO: 445004 - RNA, 18 nt, Human
uccaggauguuuggauuc

SEQ ID NO: 445005 - RNA, 22 nt, Human
ucccagcagcucacaaucaagc

SEQ ID NO: 445006 - RNA, 22 nt, Human
uccccacacucuccaguccccu

SEQ ID NO: 445007 - RNA, 21 nt, Human
ucccuaaguguuggccgguuu

SEQ ID NO: 445008 - RNA, 21 nt, Human
ucccuccguuuggggucccug

SEQ ID NO: 445009 - RNA, 20 nt, Human
ucccugguggcugcacugcc

SEQ ID NO: 445010 - RNA, 21 nt, Human
ucccugguggcugcacugcuc

SEQ ID NO: 445011 - RNA, 21 nt, Human
uccugaggugacauacauccu

SEQ ID NO: 445012 - RNA, 18 nt, Human
ucucagagacaccugguc

SEQ ID NO: 445013 - RNA, 23 nt, Human
ucucagagacaccugguccucag

SEQ ID NO: 445014 - RNA, 19 nt, Human
ucuccaggauguuuggauu

SEQ ID NO: 445015 - RNA, 19 nt, Human
ucugcguuuugucccggcc

SEQ ID NO: 445016 - RNA, 21 nt, Human
ucuuaucaggagacaggguuu

SEQ ID NO: 445017 - RNA, 20 nt, Human
ucuuucuuuuccuggucuuc

SEQ ID NO: 445018 - RNA, 21 nt, Human
ugacaggauuaggagauuaaa

SEQ ID NO: 445019 - RNA, 20 nt, Human
ugacucagauacacccccgg

SEQ ID NO: 445020 - RNA, 21 nt, Human
ugccaaaguuccuaacacuga

SEQ ID NO: 445021 - RNA, 19 nt, Human
ugccauggcuucagccagu

SEQ ID NO: 445022 - RNA, 23 nt, Human
ugccucccucucuuccuccccca

SEQ ID NO: 445023 - RNA, 19 nt, Human
ugcugguaagacaggguga

SEQ ID NO: 445024 - RNA, 23 nt, Human
uggaaauggcucauuacccggcc

SEQ ID NO: 445025 - RNA, 20 nt, Human
uggccgguuugagaaauaaa

SEQ ID NO: 445026 - RNA, 24 nt, Human
uggggaacuaauaaauguccauga

SEQ ID NO: 445027 - RNA, 23 nt, Human
ugguugguucucagauacucucc

SEQ ID NO: 445028 - RNA, 19 nt, Human
ugucccggccugugucugg

SEQ ID NO: 445029 - RNA, 22 nt, Human
ugucgcugcggggccuccucca

SEQ ID NO: 445030 - RNA, 18 nt, Human
ugucuggcucaccuuccc

SEQ ID NO: 445031 - RNA, 20 nt, Human
uguggaucucaccuccagcu

SEQ ID NO: 445032 - RNA, 21 nt, Human
uguuccuugcugagaaaaaga

SEQ ID NO: 445033 - RNA, 26 nt, Human
uuaaaguaaagacaggcauaagaaau

SEQ ID NO: 445034 - RNA, 21 nt, Human
uuagagauugcgguaaagaca

SEQ ID NO: 445035 - RNA, 24 nt, Human
uuauccuguucuuuuuucaaggug

SEQ ID NO: 445036 - RNA, 20 nt, Human
uuccaggccccagcauuucu

SEQ ID NO: 445037 - RNA, 21 nt, Human
uucccugguggcugcacugcu

SEQ ID NO: 445038 - RNA, 19 nt, Human
uucucagauacucuccagg

SEQ ID NO: 445039 - RNA, 23 nt, Human
uucuuuuccuggucuucucauug

SEQ ID NO: 445040 - RNA, 19 nt, Human
uugaggcuggauacugacu

SEQ ID NO: 445041 - RNA, 22 nt, Human
uuggauucucagagacaccugg

SEQ ID NO: 445042 - RNA, 19 nt, Human
uuuccuggucuucucauug

SEQ ID NO: 445043 - RNA, 18 nt, Human
agaaguuucccuaccccc

SEQ ID NO: 445044 - RNA, 23 nt, Human
caguauucuucagggaagacuug

SEQ ID NO: 445045 - RNA, 25 nt, Human
caguggugacagggugaccaacucu

SEQ ID NO: 445046 - RNA, 25 nt, Human
cauugccacuagaaguuucccuacc

SEQ ID NO: 445047 - RNA, 27 nt, Human
cccccaguauucuucagggaagacuug

SEQ ID NO: 445048 - RNA, 18 nt, Human
ccuucuauuaucauugcu

SEQ ID NO: 445049 - RNA, 27 nt, Human
ccuucuauuaucauugcugcugguuuu

SEQ ID NO: 445050 - RNA, 21 nt, Human
cuagaaguuucccuaccccca

SEQ ID NO: 445051 - RNA, 19 nt, Human
ucuucagggaagacuugca

SEQ ID NO: 445052 - RNA, 23 nt, Human
aaacaaacaaacagggaagaccc

SEQ ID NO: 445053 - RNA, 24 nt, Human
aaacaaacagggaagacccuuuuc

SEQ ID NO: 445054 - RNA, 24 nt, Human
aaacagaaggcaugccgaggucug

SEQ ID NO: 445055 - RNA, 21 nt, Human
aaacugguuucgguuaagugc

SEQ ID NO: 445056 - RNA, 23 nt, Human
aacaaacaaacaaacaaacaaac

SEQ ID NO: 445057 - RNA, 23 nt, Human
aacaaacaaacaaacaaacaaac

SEQ ID NO: 445058 - RNA, 19 nt, Human
aacacaguguuuagggcuc

SEQ ID NO: 445059 - RNA, 22 nt, Human
aaccaugguuugauaagauuua

SEQ ID NO: 445060 - RNA, 22 nt, Human
aacccagaaaauccgagacagg

SEQ ID NO: 445061 - RNA, 18 nt, Human
aaccucuguccuugccuc

SEQ ID NO: 445062 - RNA, 19 nt, Human
aagacagcacaccuagaua

SEQ ID NO: 445063 - RNA, 20 nt, Human
aagacauuaaucaauauaug

SEQ ID NO: 445064 - RNA, 21 nt, Human
aagugcccuguacaggagagc

SEQ ID NO: 445065 - RNA, 21 nt, Human
aauugauugcaaaacugguuu

SEQ ID NO: 445066 - RNA, 18 nt, Human
acaaacaaacaaacaaac

SEQ ID NO: 445067 - RNA, 18 nt, Human
acaaacaaacaaacaaac

SEQ ID NO: 445068 - RNA, 18 nt, Human
acaaacaaacaaacaaac

SEQ ID NO: 445069 - RNA, 18 nt, Human
acaaacaaacaaacaaac

SEQ ID NO: 445070 - RNA, 24 nt, Human
acacagacucaggaaguccugaug

SEQ ID NO: 445071 - RNA, 25 nt, Human
acacagacucaggaaguccugauga

SEQ ID NO: 445072 - RNA, 23 nt, Human
acacuacaaugcaauugccuaau

SEQ ID NO: 445073 - RNA, 21 nt, Human
acagggaagacccuuuuccca

SEQ ID NO: 445074 - RNA, 23 nt, Human
accaagcaccgauagauuuguca

SEQ ID NO: 445075 - RNA, 24 nt, Human
acccagacuggagucucaaaacaa

SEQ ID NO: 445076 - RNA, 18 nt, Human
agacagcacaccuagaua

SEQ ID NO: 445077 - RNA, 18 nt, Human
agccauaaaguuagcuca

SEQ ID NO: 445078 - RNA, 30 nt, Human
agcuugaguuuuccuuagugauucuggggg

SEQ ID NO: 445079 - RNA, 20 nt, Human
aggcacccucaucuccaaga

SEQ ID NO: 445080 - RNA, 23 nt, Human
aggcuaugccaucuaaguuuugu

SEQ ID NO: 445081 - RNA, 20 nt, Human
aggcucucccauauagccuu

SEQ ID NO: 445082 - RNA, 18 nt, Human
aguaguauacaguaaugc

SEQ ID NO: 445083 - RNA, 24 nt, Human
aguagucacaugcuguacaggugc

SEQ ID NO: 445084 - RNA, 21 nt, Human
augguuggggcauaccuuggu

SEQ ID NO: 445085 - RNA, 20 nt, Human
auguggccaagaugguuggg

SEQ ID NO: 445086 - RNA, 22 nt, Human
caaacaaacaaacagggaagac

SEQ ID NO: 445087 - RNA, 19 nt, Human
caaagcucuagggcucuuc

SEQ ID NO: 445088 - RNA, 21 nt, Human
caaagcucuagggcucuucca

SEQ ID NO: 445089 - RNA, 23 nt, Human
caaagcucuagggcucuuccagg

SEQ ID NO: 445090 - RNA, 23 nt, Human
caagacagcacaccuagauagac

SEQ ID NO: 445091 - RNA, 19 nt, Human
cacacugugacacagacuc

SEQ ID NO: 445092 - RNA, 24 nt, Human
caccuagauagacuuuuugcuuau

SEQ ID NO: 445093 - RNA, 20 nt, Human
caccucccuucccuuccaaa

SEQ ID NO: 445094 - RNA, 24 nt, Human
ccacccagaauccauucaugguuu

SEQ ID NO: 445095 - RNA, 22 nt, Human
ccaggacaggcacccucaucuc

SEQ ID NO: 445096 - RNA, 23 nt, Human
ccaggagucaaaugauuuucuuc

SEQ ID NO: 445097 - RNA, 21 nt, Human
cccaccucccuucccuuccaa

SEQ ID NO: 445098 - RNA, 24 nt, Human
cccagaaaauccgagacaggucuc

SEQ ID NO: 445099 - RNA, 19 nt, Human
ccuacaguaguauacagua

SEQ ID NO: 445100 - RNA, 23 nt, Human
cuagguaugcaguaggcuaugcc

SEQ ID NO: 445101 - RNA, 25 nt, Human
cucaagacagcacaccuagauagac

SEQ ID NO: 445102 - RNA, 22 nt, Human
cucucagcccugcaagcuccau

SEQ ID NO: 445103 - RNA, 23 nt, Human
cucucagcccugcaagcuccauu

SEQ ID NO: 445104 - RNA, 24 nt, Human
cuucacauucauucaccacucacu

SEQ ID NO: 445105 - RNA, 21 nt, Human
cuuuuuuuuuuuuuuuuuuuu

SEQ ID NO: 445106 - RNA, 19 nt, Human
gacccacugcugcccaccu

SEQ ID NO: 445107 - RNA, 23 nt, Human
gagcuuccaggucacagauaggu

SEQ ID NO: 445108 - RNA, 23 nt, Human
gauaggaagaguaggguggccuu

SEQ ID NO: 445109 - RNA, 25 nt, Human
gauuuucuucucuccacggagcucu

SEQ ID NO: 445110 - RNA, 19 nt, Human
gccucuccgagguccccug

SEQ ID NO: 445111 - RNA, 24 nt, Human
gccuuugaacaggaauugauugca

SEQ ID NO: 445112 - RNA, 21 nt, Human
ggacaggcacccucaucucca

SEQ ID NO: 445113 - RNA, 18 nt, Human
ggagaggaagauccugaa

SEQ ID NO: 445114 - RNA, 20 nt, Human
ggccuucacauucauucacc

SEQ ID NO: 445115 - RNA, 18 nt, Human
gggcaucuccacccagaa

SEQ ID NO: 445116 - RNA, 22 nt, Human
gggcaucuccacccagaaucca

SEQ ID NO: 445117 - RNA, 24 nt, Human
gucaaaugauuuucuucucuccac

SEQ ID NO: 445118 - RNA, 18 nt, Human
uaagaaguuucccuaagc

SEQ ID NO: 445119 - RNA, 18 nt, Human
uaaguacaaucugugaua

SEQ ID NO: 445120 - RNA, 21 nt, Human
uacaaucugugauaaucacac

SEQ ID NO: 445121 - RNA, 18 nt, Human
uacaggagagccaauucu

SEQ ID NO: 445122 - RNA, 23 nt, Human
uacccuaaaauagggugcuuugg

SEQ ID NO: 445123 - RNA, 21 nt, Human
uauuuggaccuccaaggccau

SEQ ID NO: 445124 - RNA, 23 nt, Human
ucacagauaggugagacacaaac

SEQ ID NO: 445125 - RNA, 19 nt, Human
ucacauucauucaccacuc

SEQ ID NO: 445126 - RNA, 22 nt, Human
ucaccaagagauacaugacugu

SEQ ID NO: 445127 - RNA, 19 nt, Human
ucacugacucaucuggagc

SEQ ID NO: 445128 - RNA, 20 nt, Human
ucagcccugcaagcuccauu

SEQ ID NO: 445129 - RNA, 22 nt, Human
uccagaaggaagguaauugucc

SEQ ID NO: 445130 - RNA, 20 nt, Human
uccaggucacagauagguga

SEQ ID NO: 445131 - RNA, 19 nt, Human
uccauucaugguuuccaaa

SEQ ID NO: 445132 - RNA, 23 nt, Human
ucccuucccuuccaaagcacagg

SEQ ID NO: 445133 - RNA, 21 nt, Human
uccuggacaccccuuccugga

SEQ ID NO: 445134 - RNA, 21 nt, Human
uccuuuguggccuuggguccc

SEQ ID NO: 445135 - RNA, 19 nt, Human
ucgguuaagugcugcagga

SEQ ID NO: 445136 - RNA, 20 nt, Human
ucucagcccugcaagcucca

SEQ ID NO: 445137 - RNA, 24 nt, Human
ucucauucugacacccagacugga

SEQ ID NO: 445138 - RNA, 19 nt, Human
ucuccgagguccccugguc

SEQ ID NO: 445139 - RNA, 18 nt, Human
ucugggcuggagaaagac

SEQ ID NO: 445140 - RNA, 25 nt, Human
ucugggcuggagaaagaccgggguc

SEQ ID NO: 445141 - RNA, 18 nt, Human
ucuuuuuuuuuuuuuuuu

SEQ ID NO: 445142 - RNA, 19 nt, Human
ugaauagagugggaggugg

SEQ ID NO: 445143 - RNA, 23 nt, Human
ugagauggggucucauucugaca

SEQ ID NO: 445144 - RNA, 19 nt, Human
ugcccuaagaaguuucccu

SEQ ID NO: 445145 - RNA, 18 nt, Human
ugccuaaugacacauuua

SEQ ID NO: 445146 - RNA, 25 nt, Human
ugcugcccaccucccuucccuucca

SEQ ID NO: 445147 - RNA, 22 nt, Human
uggggccccaagauauuuuccu

SEQ ID NO: 445148 - RNA, 26 nt, Human
uguauucuucuucuuuuuuuuuuuuu

SEQ ID NO: 445149 - RNA, 24 nt, Human
uguccaauaacaauguuucgguca

SEQ ID NO: 445150 - RNA, 22 nt, Human
uguccccaggagucaaaugauu

SEQ ID NO: 445151 - RNA, 23 nt, Human
uguccuggacaccccuuccugga

SEQ ID NO: 445152 - RNA, 20 nt, Human
ugucugggcuggagaaagac

SEQ ID NO: 445153 - RNA, 21 nt, Human
uguggccaagaugguuggggc

SEQ ID NO: 445154 - RNA, 20 nt, Human
uuaaaaguugcucaagacag

SEQ ID NO: 445155 - RNA, 20 nt, Human
uugccucuccgagguccccu

SEQ ID NO: 445156 - RNA, 21 nt, Human
uugguuugagccauaaaguua

SEQ ID NO: 445157 - RNA, 22 nt, Human
uuugagauggggucucauucug

SEQ ID NO: 445158 - RNA, 20 nt, Human
uuuucccagcacauaggccu

SEQ ID NO: 445159 - RNA, 20 nt, Human
uuuuuuuugagauggggucu

SEQ ID NO: 445160 - RNA, 26 nt, Human
uuuuuuuuuuuugagauggggucuca

SEQ ID NO: 445161 - RNA, 22 nt, Human
uuuuuuuuuuuuuugagauggg

SEQ ID NO: 445162 - RNA, 18 nt, Human
uuuuuuuuuuuuuuuuug

SEQ ID NO: 445163 - RNA, 25 nt, Human
uuuuuuuuuuuuuuuuugagauggg

SEQ ID NO: 445164 - RNA, 21 nt, Human
aaccacccaucaauaaacuuu

SEQ ID NO: 445165 - RNA, 23 nt, Human
accugcucuggucccuagauguc

SEQ ID NO: 445166 - RNA, 19 nt, Human
acucccauccugucuuccc

SEQ ID NO: 445167 - RNA, 25 nt, Human
aggcacugggaguccagaaagagcc

SEQ ID NO: 445168 - RNA, 19 nt, Human
aggcugcagucccugggcc

SEQ ID NO: 445169 - RNA, 24 nt, Human
auccugucuucccucuguguuccc

SEQ ID NO: 445170 - RNA, 18 nt, Human
augagacagcuggacacc

SEQ ID NO: 445171 - RNA, 23 nt, Human
augagacagcuggacaccuggag

SEQ ID NO: 445172 - RNA, 25 nt, Human
augucuggagaccuggggucgucca

SEQ ID NO: 445173 - RNA, 21 nt, Human
cacaggacagaguccucaccc

SEQ ID NO: 445174 - RNA, 24 nt, Human
cacccaucaauaaacuuucuuuuu

SEQ ID NO: 445175 - RNA, 23 nt, Human
cacucccauccugucuucccucu

SEQ ID NO: 445176 - RNA, 19 nt, Human
cagcccucgaguccacacc

SEQ ID NO: 445177 - RNA, 20 nt, Human
cagcuucuggagcugcccuc

SEQ ID NO: 445178 - RNA, 20 nt, Human
cagcuucuggagcugcccuc

SEQ ID NO: 445179 - RNA, 21 nt, Human
caguggagcuggcuuggggac

SEQ ID NO: 445180 - RNA, 23 nt, Human
ccaaaccugcucuggucccuaga

SEQ ID NO: 445181 - RNA, 18 nt, Human
ccaagaccuguggguguu

SEQ ID NO: 445182 - RNA, 20 nt, Human
ccacaugucugaucggcagg

SEQ ID NO: 445183 - RNA, 21 nt, Human
ccagaaagagccacuccccac

SEQ ID NO: 445184 - RNA, 23 nt, Human
cccacaugucugaucggcagggc

SEQ ID NO: 445185 - RNA, 23 nt, Human
cccaccgcugcaccugccaccau

SEQ ID NO: 445186 - RNA, 20 nt, Human
ccccgcgcccagcccucgag

SEQ ID NO: 445187 - RNA, 21 nt, Human
ccccgcgcccagcccucgagu

SEQ ID NO: 445188 - RNA, 20 nt, Human
cccugggccucggggagcuc

SEQ ID NO: 445189 - RNA, 19 nt, Human
ccggccccgcgcccagccc

SEQ ID NO: 445190 - RNA, 22 nt, Human
ccggccccgcgcccagcccucg

SEQ ID NO: 445191 - RNA, 19 nt, Human
ccucggggagcucaggcug

SEQ ID NO: 445192 - RNA, 20 nt, Human
ccucuugggggccugggcag

SEQ ID NO: 445193 - RNA, 21 nt, Human
ccugcagaguguaagguggcg

SEQ ID NO: 445194 - RNA, 22 nt, Human
ccugcagugaagccauaaggac

SEQ ID NO: 445195 - RNA, 19 nt, Human
cggcuucugcgccggcccc

SEQ ID NO: 445196 - RNA, 19 nt, Human
cugcccugggccucgggga

SEQ ID NO: 445197 - RNA, 20 nt, Human
cugccgcugcagccugcaga

SEQ ID NO: 445198 - RNA, 18 nt, Human
cuggagcugcccucuugg

SEQ ID NO: 445199 - RNA, 20 nt, Human
cuggagcugcccucuugggg

SEQ ID NO: 445200 - RNA, 19 nt, Human
cuggccaggcggugggcac

SEQ ID NO: 445201 - RNA, 21 nt, Human
cuggcggcuucugcgccggcc

SEQ ID NO: 445202 - RNA, 21 nt, Human
cugggcaguggagcuggcuug

SEQ ID NO: 445203 - RNA, 19 nt, Human
gaggccaucuggagcugcc

SEQ ID NO: 445204 - RNA, 22 nt, Human
gcaccagcguggugggugggca

SEQ ID NO: 445205 - RNA, 18 nt, Human
gcaguccugggcuuccag

SEQ ID NO: 445206 - RNA, 22 nt, Human
gcggcuucugcgccggccccgc

SEQ ID NO: 445207 - RNA, 22 nt, Human
gcugcccugggccucggggagc

SEQ ID NO: 445208 - RNA, 21 nt, Human
ggacucaggcucuucaguggg

SEQ ID NO: 445209 - RNA, 21 nt, Human
ggcacugggaguccagaaaga

SEQ ID NO: 445210 - RNA, 23 nt, Human
ggcagcuucuggagcugcccucu

SEQ ID NO: 445211 - RNA, 22 nt, Human
ggcaguggagcuggcuugggga

SEQ ID NO: 445212 - RNA, 21 nt, Human
ggcggcuucugcgccggcccc

SEQ ID NO: 445213 - RNA, 28 nt, Human
gggcaguccugggcuuccaggaggccuc

SEQ ID NO: 445214 - RNA, 25 nt, Human
gggcaguggagcuggcuucgggccc

SEQ ID NO: 445215 - RNA, 21 nt, Human
gucccugggccugguggcacc

SEQ ID NO: 445216 - RNA, 20 nt, Human
gugggugggcaguccugggc

SEQ ID NO: 445217 - RNA, 22 nt, Human
uccagaaagagccacuccccac

SEQ ID NO: 445218 - RNA, 23 nt, Human
uccagaaagagccacuccccacc

SEQ ID NO: 445219 - RNA, 29 nt, Human
ucccauccugucuucccucuguguucccu

SEQ ID NO: 445220 - RNA, 26 nt, Human
ucccggagcccugggcaacucagaga

SEQ ID NO: 445221 - RNA, 20 nt, Human
ucccugggccugguggcacc

SEQ ID NO: 445222 - RNA, 22 nt, Human
uccugggcuuccaggaggccuc

SEQ ID NO: 445223 - RNA, 20 nt, Human
ugaagccauaaggacacagu

SEQ ID NO: 445224 - RNA, 18 nt, Human
ugcagucccugggccugg

SEQ ID NO: 445225 - RNA, 20 nt, Human
ugcccugggccucggggagc

SEQ ID NO: 445226 - RNA, 22 nt, Human
ugcccugggccucggggagcuc

SEQ ID NO: 445227 - RNA, 20 nt, Human
ugcucuggucccuagauguc

SEQ ID NO: 445228 - RNA, 21 nt, Human
uggcuacacucccauccuguc

SEQ ID NO: 445229 - RNA, 20 nt, Human
ugggauggggucccggagcc

SEQ ID NO: 445230 - RNA, 24 nt, Human
ugggauggggucccggagcccugg

SEQ ID NO: 445231 - RNA, 21 nt, Human
ugggcaguccugggcuuccag

SEQ ID NO: 445232 - RNA, 18 nt, Human
ugggcaguggagcuggcu

SEQ ID NO: 445233 - RNA, 21 nt, Human
ugggcaguggagcuggcuugg

SEQ ID NO: 445234 - RNA, 22 nt, Human
ugggggccugggcaguggagcu

SEQ ID NO: 445235 - RNA, 21 nt, Human
uggggucccggagcccugggc

SEQ ID NO: 445236 - RNA, 24 nt, Human
uuuuuuguuuugcaaccacccauc

SEQ ID NO: 445237 - RNA, 18 nt, Human
uuuuuuuuuuuuuuuuug

SEQ ID NO: 445238 - RNA, 24 nt, Human
uuuuuuuuuuuuuuuuuuuguuuu

SEQ ID NO: 445239 - RNA, 22 nt, Human
aggagcgggugcacgcauugga

SEQ ID NO: 445240 - RNA, 19 nt, Human
aggcuccgaagaccgagac

SEQ ID NO: 445241 - RNA, 19 nt, Human
ccacuggcccuauagccua

SEQ ID NO: 445242 - RNA, 19 nt, Human
ccccacacuagcccuggac

SEQ ID NO: 445243 - RNA, 24 nt, Human
ccccacacuagcccuggacuucuc

SEQ ID NO: 445244 - RNA, 19 nt, Human
cgccggagcccccacacua

SEQ ID NO: 445245 - RNA, 22 nt, Human
cgggugcacgcauuggauuggu

SEQ ID NO: 445246 - RNA, 22 nt, Human
gacaugauagcucaauaagcuc

SEQ ID NO: 445247 - RNA, 23 nt, Human
guagggcugaggaauuggggccg

SEQ ID NO: 445248 - RNA, 19 nt, Human
uaacgcacuguuguaucag

SEQ ID NO: 445249 - RNA, 19 nt, Human
uccaugcggaugggggcca

SEQ ID NO: 445250 - RNA, 20 nt, Human
ucgggcucacggggcugaag

SEQ ID NO: 445251 - RNA, 22 nt, Human
ugaggagaccugcuuugggggu

SEQ ID NO: 445252 - RNA, 19 nt, Human
ugauagcucaauaagcucc

SEQ ID NO: 445253 - RNA, 24 nt, Human
ugcggaugggggccacagcccccg

SEQ ID NO: 445254 - RNA, 23 nt, Human
ugcuuuggggguugcacagucug

SEQ ID NO: 445255 - RNA, 20 nt, Human
uggcgccgccguguggacug

SEQ ID NO: 445256 - RNA, 31 nt, Human
uggcguugggaagagggucuggcgccgccgg

SEQ ID NO: 445257 - RNA, 24 nt, Human
uggggaggcuccaugcggaugggg

SEQ ID NO: 445258 - RNA, 21 nt, Human
ugggggccacagcccccgccg

SEQ ID NO: 445259 - RNA, 18 nt, Human
aacaacaccaaugggaac

SEQ ID NO: 445260 - RNA, 21 nt, Human
aaugggaacugguauuugucu

SEQ ID NO: 445261 - RNA, 22 nt, Human
acaauaaaaggccacuuuugac

SEQ ID NO: 445262 - RNA, 22 nt, Human
acaauaaaaggccacuuuugac

SEQ ID NO: 445263 - RNA, 23 nt, Human
agagcccuuuccacgcccagagc

SEQ ID NO: 445264 - RNA, 21 nt, Human
aggaagcagagcucccugacu

SEQ ID NO: 445265 - RNA, 21 nt, Human
aggagcagggcggcagcccag

SEQ ID NO: 445266 - RNA, 21 nt, Human
agggcggcagcccagggcacc

SEQ ID NO: 445267 - RNA, 20 nt, Human
auggcggccucaaccuugag

SEQ ID NO: 445268 - RNA, 19 nt, Human
caacaacaccaaugggaac

SEQ ID NO: 445269 - RNA, 24 nt, Human
caccaaugggaacugguauuuguc

SEQ ID NO: 445270 - RNA, 22 nt, Human
cacgcccagagcgaggagcagg

SEQ ID NO: 445271 - RNA, 22 nt, Human
cagggcggcagcccagggcacc

SEQ ID NO: 445272 - RNA, 18 nt, Human
ccacgcccagagcgagga

SEQ ID NO: 445273 - RNA, 21 nt, Human
ccagagcccuuuccacgccca

SEQ ID NO: 445274 - RNA, 23 nt, Human
ccagagcccuuuccacgcccaga

SEQ ID NO: 445275 - RNA, 27 nt, Human
ccagagcccuuuccacgcccagagaag

SEQ ID NO: 445276 - RNA, 21 nt, Human
cgaaaucagaaccgcaggccc

SEQ ID NO: 445277 - RNA, 26 nt, Human
cgaaaucagaaccgcaggcccgccga

SEQ ID NO: 445278 - RNA, 21 nt, Human
cgaggagaagggggagccgcu

SEQ ID NO: 445279 - RNA, 19 nt, Human
cgcccagagcgaggagcag

SEQ ID NO: 445280 - RNA, 22 nt, Human
cgcccagagcgaggagcagggc

SEQ ID NO: 445281 - RNA, 20 nt, Human
cggcagcccagggcaccagg

SEQ ID NO: 445282 - RNA, 20 nt, Human
cggccucaaccuugaggcga

SEQ ID NO: 445283 - RNA, 18 nt, Human
cugggcagggucgggaag

SEQ ID NO: 445284 - RNA, 18 nt, Human
gaagcgucagggacgaaa

SEQ ID NO: 445285 - RNA, 21 nt, Human
gagugcaauuuuucaucuucc

SEQ ID NO: 445286 - RNA, 22 nt, Human
gccagagcccuuuccacgccca

SEQ ID NO: 445287 - RNA, 18 nt, Human
gcccagagcgaggagcag

SEQ ID NO: 445288 - RNA, 20 nt, Human
gccgaggagaagggggagcc

SEQ ID NO: 445289 - RNA, 23 nt, Human
gcgccagagcccuuuccacgccc

SEQ ID NO: 445290 - RNA, 18 nt, Human
ggagaagggggagccgcu

SEQ ID NO: 445291 - RNA, 18 nt, Human
uaagauaguucagauuga

SEQ ID NO: 445292 - RNA, 23 nt, Human
uacaauaaaaggccacuuuugac

SEQ ID NO: 445293 - RNA, 23 nt, Human
uacaauaaaaggccacuuuugac

SEQ ID NO: 445294 - RNA, 24 nt, Human
uaguucagauugaucuuaggucaa

SEQ ID NO: 445295 - RNA, 26 nt, Human
uaguucagauugaucuuaggucaaug

SEQ ID NO: 445296 - RNA, 24 nt, Human
uccacuggcgaaagaugccuuucu

SEQ ID NO: 445297 - RNA, 24 nt, Human
ucggguagcgccagagcccuuucc

SEQ ID NO: 445298 - RNA, 20 nt, Human
ucuuccaauggcggccucaa

SEQ ID NO: 445299 - RNA, 22 nt, Human
uggcugggcagggucgggaagc

SEQ ID NO: 445300 - RNA, 19 nt, Human
ugggaacugguauuugucu

SEQ ID NO: 445301 - RNA, 24 nt, Human
uucagauugaucuuaggucaaugg

SEQ ID NO: 445302 - RNA, 24 nt, Human
uucaucuuccaauggcggccucaa

SEQ ID NO: 445303 - RNA, 19 nt, Human
uugggugcauaucuggcug

SEQ ID NO: 445304 - RNA, 18 nt, Human
uuugucuacaccaaggga

SEQ ID NO: 445305 - RNA, 24 nt, Human
aaagugcugggauuacaggcguga

SEQ ID NO: 445306 - RNA, 19 nt, Human
aaauaauacacaagaccug

SEQ ID NO: 445307 - RNA, 23 nt, Human
aagaaucgcuugaacccgggagg

SEQ ID NO: 445308 - RNA, 18 nt, Human
aagugcuccucugucuuc

SEQ ID NO: 445309 - RNA, 19 nt, Human
aagugcugggauuacaggc

SEQ ID NO: 445310 - RNA, 19 nt, Human
aagugcugggauuacaggc

SEQ ID NO: 445311 - RNA, 26 nt, Human
aagugcugggauuacaggcgugagcc

SEQ ID NO: 445312 - RNA, 24 nt, Human
aaucgcuugaacccgggaggcgga

SEQ ID NO: 445313 - RNA, 23 nt, Human
acaggcacccgccaccacgcccg

SEQ ID NO: 445314 - RNA, 23 nt, Human
acaggcacccgccaccacgcccg

SEQ ID NO: 445315 - RNA, 18 nt, Human
accaaauaauacacaaga

SEQ ID NO: 445316 - RNA, 24 nt, Human
acccugagaccuccuggaacgcug

SEQ ID NO: 445317 - RNA, 24 nt, Human
accuccaggcuccggccgcggccu

SEQ ID NO: 445318 - RNA, 25 nt, Human
accucccagguucacgccauucucc

SEQ ID NO: 445319 - RNA, 21 nt, Human
accugggugaggccacaugag

SEQ ID NO: 445320 - RNA, 24 nt, Human
accuugugauccgcccgccucggc

SEQ ID NO: 445321 - RNA, 18 nt, Human
acgggguuucaccguguu

SEQ ID NO: 445322 - RNA, 19 nt, Human
acgggguuucaccguguua

SEQ ID NO: 445323 - RNA, 20 nt, Human
acgggguuucaccguguuag

SEQ ID NO: 445324 - RNA, 24 nt, Human
acgggguuucaccguguuagccag

SEQ ID NO: 445325 - RNA, 21 nt, Human
acugcaagcuccaccucccag

SEQ ID NO: 445326 - RNA, 19 nt, Human
acugcacuccagccuggcg

SEQ ID NO: 445327 - RNA, 19 nt, Human
agagacgggguuucaccgu

SEQ ID NO: 445328 - RNA, 18 nt, Human
agccuggcgacaaaguga

SEQ ID NO: 445329 - RNA, 23 nt, Human
agcugggcgugguggcacacgcc

SEQ ID NO: 445330 - RNA, 20 nt, Human
aggcacccgccaccacgccc

SEQ ID NO: 445331 - RNA, 24 nt, Human
aggcagaagaaucgcuugaacccg

SEQ ID NO: 445332 - RNA, 23 nt, Human
aggccucuugccccaggccggag

SEQ ID NO: 445333 - RNA, 21 nt, Human
aggcggaaguuguagugagcc

SEQ ID NO: 445334 - RNA, 24 nt, Human
aggcggaaguuguagugagccgag

SEQ ID NO: 445335 - RNA, 24 nt, Human
aggcugaggcagaagaaucgcuug

SEQ ID NO: 445336 - RNA, 18 nt, Human
aggcuggagugcaguggc

SEQ ID NO: 445337 - RNA, 20 nt, Human
aggggcggugcaccccaccc

SEQ ID NO: 445338 - RNA, 20 nt, Human
aguagagacgggguuucacc

SEQ ID NO: 445339 - RNA, 24 nt, Human
agugcaguggcgcgauguccgcuc

SEQ ID NO: 445340 - RNA, 18 nt, Human
agugcugggauuacaggc

SEQ ID NO: 445341 - RNA, 24 nt, Human
aucgcgccacugcacuccagccug

SEQ ID NO: 445342 - RNA, 24 nt, Human
caaagugcugggauuacaggcgug

SEQ ID NO: 445343 - RNA, 20 nt, Human
caaccaaccccugccagccc

SEQ ID NO: 445344 - RNA, 22 nt, Human
caaccccugccagccccacacu

SEQ ID NO: 445345 - RNA, 25 nt, Human
cacacucucaucacaaaauggggga

SEQ ID NO: 445346 - RNA, 19 nt, Human
caccccacccucuccaccu

SEQ ID NO: 445347 - RNA, 18 nt, Human
caccguguuagccaggau

SEQ ID NO: 445348 - RNA, 24 nt, Human
caccguguuagccaggauggucuc

SEQ ID NO: 445349 - RNA, 22 nt, Human
cacgccauucuccugccucagc

SEQ ID NO: 445350 - RNA, 18 nt, Human
cacgccuguagucccagc

SEQ ID NO: 445351 - RNA, 21 nt, Human
cacuccagccuggcgacaaag

SEQ ID NO: 445352 - RNA, 22 nt, Human
cacuccagccuggcgacaaagu

SEQ ID NO: 445353 - RNA, 22 nt, Human
cacucucaucacaaaauggggg

SEQ ID NO: 445354 - RNA, 21 nt, Human
cacugcaagcuccaccuccca

SEQ ID NO: 445355 - RNA, 18 nt, Human
cacugcacuccagccugg

SEQ ID NO: 445356 - RNA, 18 nt, Human
cacugcacuccagccugg

SEQ ID NO: 445357 - RNA, 22 nt, Human
cacugcacuccagccuggcgac

SEQ ID NO: 445358 - RNA, 23 nt, Human
cacugcacuccagccuggcgaca

SEQ ID NO: 445359 - RNA, 24 nt, Human
cacugcacuccagccuggcgacaa

SEQ ID NO: 445360 - RNA, 20 nt, Human
cacuuccccucccuggucac

SEQ ID NO: 445361 - RNA, 24 nt, Human
cagcuacucgggaggcugaggcag

SEQ ID NO: 445362 - RNA, 19 nt, Human
caggggaaggaauugggac

SEQ ID NO: 445363 - RNA, 23 nt, Human
cauguuccuuuccuccccaaccc

SEQ ID NO: 445364 - RNA, 22 nt, Human
ccaaagugcugggauuacaggc

SEQ ID NO: 445365 - RNA, 22 nt, Human
ccaaagugcugggauuacaggc

SEQ ID NO: 445366 - RNA, 24 nt, Human
ccaaagugcugggauuacaggcgu

SEQ ID NO: 445367 - RNA, 19 nt, Human
ccaaccaaccccugccagc

SEQ ID NO: 445368 - RNA, 21 nt, Human
ccaaccccugccagccccaca

SEQ ID NO: 445369 - RNA, 24 nt, Human
ccaacccuguuccacccaggcugc

SEQ ID NO: 445370 - RNA, 24 nt, Human
ccacccaggcugcuuccuggccgu

SEQ ID NO: 445371 - RNA, 19 nt, Human
ccacugcacuccagccugg

SEQ ID NO: 445372 - RNA, 19 nt, Human
ccacugcacuccagccugg

SEQ ID NO: 445373 - RNA, 19 nt, Human
ccacugcacuccagccugg

SEQ ID NO: 445374 - RNA, 20 nt, Human
ccacugcacuccagccuggc

SEQ ID NO: 445375 - RNA, 22 nt, Human
ccacugcacuccagccuggcga

SEQ ID NO: 445376 - RNA, 23 nt, Human
ccacugcacuccagccuggcgac

SEQ ID NO: 445377 - RNA, 21 nt, Human
ccaggcugcuuccuggccguu

SEQ ID NO: 445378 - RNA, 25 nt, Human
ccauguuccuuuccuccccaacccu

SEQ ID NO: 445379 - RNA, 19 nt, Human
cccagggagcaccucugaa

SEQ ID NO: 445380 - RNA, 20 nt, Human
cccagguucacgccauucuc

SEQ ID NO: 445381 - RNA, 24 nt, Human
cccauguuccuuuccuccccaacc

SEQ ID NO: 445382 - RNA, 20 nt, Human
ccccacacucucaucacaaa

SEQ ID NO: 445383 - RNA, 18 nt, Human
ccccacccucuccaccua

SEQ ID NO: 445384 - RNA, 22 nt, Human
cccugccaggcuccccuugccc

SEQ ID NO: 445385 - RNA, 20 nt, Human
ccgcgcggugacaucagagc

SEQ ID NO: 445386 - RNA, 22 nt, Human
ccuccccaacccuguuccaccc

SEQ ID NO: 445387 - RNA, 18 nt, Human
ccucugaagguugagggc

SEQ ID NO: 445388 - RNA, 27 nt, Human
ccucugaagguugagggcccagcucuu

SEQ ID NO: 445389 - RNA, 22 nt, Human
ccugagcgagguggugggaggg

SEQ ID NO: 445390 - RNA, 24 nt, Human
ccugccagccccacacucucauca

SEQ ID NO: 445391 - RNA, 22 nt, Human
ccugccaggcuccccuugccca

SEQ ID NO: 445392 - RNA, 23 nt, Human
ccugccucagccuuccgaguagc

SEQ ID NO: 445393 - RNA, 21 nt, Human
ccuguagucccagcuacucgg

SEQ ID NO: 445394 - RNA, 22 nt, Human
ccuguagucccagcuacucggg

SEQ ID NO: 445395 - RNA, 20 nt, Human
ccuugggaucagagguggca

SEQ ID NO: 445396 - RNA, 23 nt, Human
ccuuuccuccccaacccuguucc

SEQ ID NO: 445397 - RNA, 25 nt, Human
cgaccgcccaccggccuccagcgcg

SEQ ID NO: 445398 - RNA, 24 nt, Human
cgcccaggcuggagugcaguggcg

SEQ ID NO: 445399 - RNA, 20 nt, Human
cgccggcccagucccagguc

SEQ ID NO: 445400 - RNA, 23 nt, Human
cgccuguagucccagcuacucgg

SEQ ID NO: 445401 - RNA, 24 nt, Human
cgccuguagucccagcuacucggg

SEQ ID NO: 445402 - RNA, 24 nt, Human
cggagucuugcucugucgcccagg

SEQ ID NO: 445403 - RNA, 18 nt, Human
cggcgaccgcccaccggc

SEQ ID NO: 445404 - RNA, 24 nt, Human
cgggguuucaccguguuagccagg

SEQ ID NO: 445405 - RNA, 20 nt, Human
cguccggccgcgggggcggg

SEQ ID NO: 445406 - RNA, 24 nt, Human
cucacugcaagcuccaccucccag

SEQ ID NO: 445407 - RNA, 19 nt, Human
cuccucccuccaaccaacc

SEQ ID NO: 445408 - RNA, 24 nt, Human
cuccugaccuugugauccgcccgc

SEQ ID NO: 445409 - RNA, 22 nt, Human
cuccugccucagccuuccgagu

SEQ ID NO: 445410 - RNA, 23 nt, Human
cuccugggccgucgcagccgcgc

SEQ ID NO: 445411 - RNA, 24 nt, Human
cucugucuucucuccucccuccaa

SEQ ID NO: 445412 - RNA, 24 nt, Human
cugcaagcuccaccucccagguuc

SEQ ID NO: 445413 - RNA, 23 nt, Human
cugccucagccuuccgaguagcu

SEQ ID NO: 445414 - RNA, 22 nt, Human
cuuugcaccuuaagugcuccuc

SEQ ID NO: 445415 - RNA, 22 nt, Human
gaccuugugauccgcccgccuc

SEQ ID NO: 445416 - RNA, 24 nt, Human
gaccuugugauccgcccgccucgg

SEQ ID NO: 445417 - RNA, 24 nt, Human
gagacgggguuucaccguguuagc

SEQ ID NO: 445418 - RNA, 23 nt, Human
gagaucgcgccacugcacuccag

SEQ ID NO: 445419 - RNA, 18 nt, Human
gauuacaggcgugagcca

SEQ ID NO: 445420 - RNA, 22 nt, Human
gauuacaggcgugagccaccgc

SEQ ID NO: 445421 - RNA, 22 nt, Human
gauuacaggcgugagccaccgc

SEQ ID NO: 445422 - RNA, 18 nt, Human
gcaagcuccaccucccag

SEQ ID NO: 445423 - RNA, 24 nt, Human
gccagccccacacucucaucacaa

SEQ ID NO: 445424 - RNA, 18 nt, Human
gcccacacaagcagccuu

SEQ ID NO: 445425 - RNA, 20 nt, Human
gcccaggcuggagugcagug

SEQ ID NO: 445426 - RNA, 23 nt, Human
gcccggcuaauuuuuuauauuuu

SEQ ID NO: 445427 - RNA, 20 nt, Human
gccgagaucgcgccacugca

SEQ ID NO: 445428 - RNA, 23 nt, Human
gccucggccucccaaagugcugg

SEQ ID NO: 445429 - RNA, 25 nt, Human
gcucugucgcccaggcuggagugca

SEQ ID NO: 445430 - RNA, 26 nt, Human
gcuggagugcaguggcgcgauguccg

SEQ ID NO: 445431 - RNA, 23 nt, Human
ggaaguuguagugagccgagauc

SEQ ID NO: 445432 - RNA, 24 nt, Human
ggaaguuguagugagccgagaucg

SEQ ID NO: 445433 - RNA, 23 nt, Human
ggagucuugcucugucgcccagg

SEQ ID NO: 445434 - RNA, 24 nt, Human
ggauggucucgaucuccugaccuu

SEQ ID NO: 445435 - RNA, 25 nt, Human
ggccgcgggggcgggagccgcagcc

SEQ ID NO: 445436 - RNA, 21 nt, Human
ggcggugcaccccacccucuc

SEQ ID NO: 445437 - RNA, 25 nt, Human
gggaggcugaggcagaagaaucgcu

SEQ ID NO: 445438 - RNA, 24 nt, Human
gggcgugguggcacacgccuguag

SEQ ID NO: 445439 - RNA, 23 nt, Human
gggguuucaccguguuagccagg

SEQ ID NO: 445440 - RNA, 19 nt, Human
ggucacuuccccucccugg

SEQ ID NO: 445441 - RNA, 20 nt, Human
ggucucgaucuccugaccuu

SEQ ID NO: 445442 - RNA, 24 nt, Human
gguggcacacgccuguagucccag

SEQ ID NO: 445443 - RNA, 23 nt, Human
guagagacgggguuucaccgugu

SEQ ID NO: 445444 - RNA, 24 nt, Human
gugauccgcccgccucggccuccc

SEQ ID NO: 445445 - RNA, 19 nt, Human
guuguagugagccgagauc

SEQ ID NO: 445446 - RNA, 21 nt, Human
guuguagugagccgagaucgc

SEQ ID NO: 445447 - RNA, 24 nt, Human
uaauuuuuuauauuuuuaguagag

SEQ ID NO: 445448 - RNA, 25 nt, Human
uaauuuuuuauauuuuuaguagaga

SEQ ID NO: 445449 - RNA, 23 nt, Human
uacaggcacccgccaccacgccc

SEQ ID NO: 445450 - RNA, 23 nt, Human
uacaggcgugagccaccgcgccc

SEQ ID NO: 445451 - RNA, 19 nt, Human
uaccaaauaauacacaaga

SEQ ID NO: 445452 - RNA, 18 nt, Human
uacccugagaccuccugg

SEQ ID NO: 445453 - RNA, 21 nt, Human
uacccugagaccuccuggaac

SEQ ID NO: 445454 - RNA, 22 nt, Human
uagcugggcgugguggcacacg

SEQ ID NO: 445455 - RNA, 21 nt, Human
uaguagagacgggguuucacc

SEQ ID NO: 445456 - RNA, 24 nt, Human
uaguagagacgggguuucaccgug

SEQ ID NO: 445457 - RNA, 25 nt, Human
uaguagagacgggguuucaccgugu

SEQ ID NO: 445458 - RNA, 26 nt, Human
uaguagagacgggguuucaccguugg

SEQ ID NO: 445459 - RNA, 22 nt, Human
uaucuuagaaaggccuggacuc

SEQ ID NO: 445460 - RNA, 24 nt, Human
ucaccguguuagccaggauggucu

SEQ ID NO: 445461 - RNA, 19 nt, Human
ucacugcaagcuccaccuc

SEQ ID NO: 445462 - RNA, 24 nt, Human
ucacugcaagcuccaccucccagg

SEQ ID NO: 445463 - RNA, 20 nt, Human
ucagagccccgggcucugac

SEQ ID NO: 445464 - RNA, 20 nt, Human
ucagccuuccgaguagcugg

SEQ ID NO: 445465 - RNA, 25 nt, Human
uccaaccaaccccugccagccccac

SEQ ID NO: 445466 - RNA, 18 nt, Human
uccacccaggcugcuucc

SEQ ID NO: 445467 - RNA, 24 nt, Human
ucccaaagugcugggauuacaggc

SEQ ID NO: 445468 - RNA, 19 nt, Human
ucccaggucugagggugga

SEQ ID NO: 445469 - RNA, 19 nt, Human
ucccagguucacgccauuc

SEQ ID NO: 445470 - RNA, 20 nt, Human
ucccagguucacgccauucu

SEQ ID NO: 445471 - RNA, 21 nt, Human
ucccagguucacgccauucuc

SEQ ID NO: 445472 - RNA, 24 nt, Human
ucccagguucacgccauucuccug

SEQ ID NO: 445473 - RNA, 24 nt, Human
uccccaaucccucaagggaaaagc

SEQ ID NO: 445474 - RNA, 23 nt, Human
ucccucaagggaaaagcagagac

SEQ ID NO: 445475 - RNA, 22 nt, Human
ucccugccaggcuccccuugcc

SEQ ID NO: 445476 - RNA, 23 nt, Human
uccgaguagcuggcaauacaggc

SEQ ID NO: 445477 - RNA, 24 nt, Human
uccgaguagcuggcaauacaggca

SEQ ID NO: 445478 - RNA, 19 nt, Human
uccggccgcggccucaggg

SEQ ID NO: 445479 - RNA, 21 nt, Human
uccucugucuucucuccuccc

SEQ ID NO: 445480 - RNA, 24 nt, Human
ucgcccaggcuggagugcaguggc

SEQ ID NO: 445481 - RNA, 23 nt, Human
ucgcgccacugcacuccagccug

SEQ ID NO: 445482 - RNA, 18 nt, Human
ucgcuugaacccgggagg

SEQ ID NO: 445483 - RNA, 18 nt, Human
ucggccucccaaagugcu

SEQ ID NO: 445484 - RNA, 24 nt, Human
ucgggaggcugaggcagaagaauc

SEQ ID NO: 445485 - RNA, 18 nt, Human
ucugucuucucuccuccc

SEQ ID NO: 445486 - RNA, 20 nt, Human
ucugucuucucuccuccccc

SEQ ID NO: 445487 - RNA, 22 nt, Human
ucugucuucucuccucccucca

SEQ ID NO: 445488 - RNA, 22 nt, Human
ucuugcucugucgcccaggcug

SEQ ID NO: 445489 - RNA, 23 nt, Human
ucuugcucugucgcccaggcugg

SEQ ID NO: 445490 - RNA, 24 nt, Human
ucuugcucugucgcccaggcugga

SEQ ID NO: 445491 - RNA, 25 nt, Human
ugacuccgaccccaccuccaggcuc

SEQ ID NO: 445492 - RNA, 22 nt, Human
ugagacggagucuugcucuguc

SEQ ID NO: 445493 - RNA, 22 nt, Human
ugagccgagaucgcgccacugc

SEQ ID NO: 445494 - RNA, 22 nt, Human
ugagcgagguggugggagggcg

SEQ ID NO: 445495 - RNA, 20 nt, Human
ugaggcagaagaaucgcuug

SEQ ID NO: 445496 - RNA, 24 nt, Human
ugaggcagaagaaucgcuugaacc

SEQ ID NO: 445497 - RNA, 25 nt, Human
ugaggcagaagaaucgcuugaaccc

SEQ ID NO: 445498 - RNA, 23 nt, Human
ugccagccccacacucucaucac

SEQ ID NO: 445499 - RNA, 24 nt, Human
ugccucagccuuccgaguagcugg

SEQ ID NO: 445500 - RNA, 24 nt, Human
ugcucugucgcccaggcuggagug

SEQ ID NO: 445501 - RNA, 24 nt, Human
ugcugggauuacaggcgugagcca

SEQ ID NO: 445502 - RNA, 29 nt, Human
uggagaaguaucuuuuuuuuuuuuuuuuu

SEQ ID NO: 445503 - RNA, 19 nt, Human
uggagugcaguggcgcgau

SEQ ID NO: 445504 - RNA, 20 nt, Human
uggagugcaguggcgcgaug

SEQ ID NO: 445505 - RNA, 21 nt, Human
uggcaauacaggcacccgcca

SEQ ID NO: 445506 - RNA, 24 nt, Human
uggcaauacaggcacccgccacca

SEQ ID NO: 445507 - RNA, 21 nt, Human
uggcacacgccuguaguccca

SEQ ID NO: 445508 - RNA, 21 nt, Human
uggcagagucaccuugggauc

SEQ ID NO: 445509 - RNA, 22 nt, Human
ugggaccagcucauucccugcc

SEQ ID NO: 445510 - RNA, 19 nt, Human
ugggagggcgacuacggcg

SEQ ID NO: 445511 - RNA, 19 nt, Human
ugggaucagagguggcaga

SEQ ID NO: 445512 - RNA, 20 nt, Human
ugggaucagagguggcagag

SEQ ID NO: 445513 - RNA, 18 nt, Human
ugggauuacaggcgugag

SEQ ID NO: 445514 - RNA, 19 nt, Human
ugggauuacaggcgugagc

SEQ ID NO: 445515 - RNA, 21 nt, Human
ugggauuacaggcgugagcca

SEQ ID NO: 445516 - RNA, 22 nt, Human
ugggauuacaggcgugagccac

SEQ ID NO: 445517 - RNA, 23 nt, Human
ugggauuacaggcgugagccacc

SEQ ID NO: 445518 - RNA, 24 nt, Human
ugggauuacaggcgugagccaccg

SEQ ID NO: 445519 - RNA, 24 nt, Human
ugguggcacacgccuguaguccca

SEQ ID NO: 445520 - RNA, 21 nt, Human
ugucgcccaggcuggagugca

SEQ ID NO: 445521 - RNA, 18 nt, Human
uuagcugggcgugguggc

SEQ ID NO: 445522 - RNA, 20 nt, Human
uuagcugggcgugguggcac

SEQ ID NO: 445523 - RNA, 24 nt, Human
uuagcugggcgugguggcacacgc

SEQ ID NO: 445524 - RNA, 18 nt, Human
uuaguagagacgggguuu

SEQ ID NO: 445525 - RNA, 22 nt, Human
uuaguagagacgggguuucacc

SEQ ID NO: 445526 - RNA, 24 nt, Human
uuaguagagacgggguuucaccgu

SEQ ID NO: 445527 - RNA, 24 nt, Human
uugcucugucgcccaggcuggagu

SEQ ID NO: 445528 - RNA, 18 nt, Human
uuguagugagccgagauc

SEQ ID NO: 445529 - RNA, 19 nt, Human
uuguagugagccgagaucg

SEQ ID NO: 445530 - RNA, 22 nt, Human
uuguagugagccgagaucgcgc

SEQ ID NO: 445531 - RNA, 21 nt, Human
uuuacccugagaccuccugga

SEQ ID NO: 445532 - RNA, 19 nt, Human
uuucaccguguuagccagg

SEQ ID NO: 445533 - RNA, 24 nt, Human
uuuuuaguagagacgggguuucac

SEQ ID NO: 445534 - RNA, 21 nt, Human
uuuuuauauuuuuaguagaga

SEQ ID NO: 445535 - RNA, 24 nt, Human
uuuuuuauauuuuuaguagagacg

SEQ ID NO: 445536 - RNA, 24 nt, Human
uuuuuuuuuuuugagacggagucu

SEQ ID NO: 445537 - RNA, 22 nt, Human
uuuuuuuuuuuuuugagacgga

SEQ ID NO: 445538 - RNA, 18 nt, Human
uuuuuuuuuuuuuuuuug

SEQ ID NO: 445539 - RNA, 25 nt, Human
aaaaccgcuuugcgggaggagggga

SEQ ID NO: 445540 - RNA, 25 nt, Human
aaacagauaaacagagaagccuccc

SEQ ID NO: 445541 - RNA, 24 nt, Human
aacuacccucuuggggaggcaucc

SEQ ID NO: 445542 - RNA, 23 nt, Human
aagaagccaagagagcuaguggg

SEQ ID NO: 445543 - RNA, 19 nt, Human
aagaggaagaaugacuguu

SEQ ID NO: 445544 - RNA, 22 nt, Human
aagcaagggagaaagggggaga

SEQ ID NO: 445545 - RNA, 18 nt, Human
accaggaagaggauugcc

SEQ ID NO: 445546 - RNA, 25 nt, Human
acucccuuagccuuccccucuccaa

SEQ ID NO: 445547 - RNA, 21 nt, Human
agaacacuguccuaagaagcc

SEQ ID NO: 445548 - RNA, 21 nt, Human
agagugcccuaaaguuguucc

SEQ ID NO: 445549 - RNA, 18 nt, Human
agcauccucugcagggag

SEQ ID NO: 445550 - RNA, 20 nt, Human
agcccgacucucgcuccucg

SEQ ID NO: 445551 - RNA, 22 nt, Human
aggagugacucccuuagccuuc

SEQ ID NO: 445552 - RNA, 22 nt, Human
aggaguuuccaacucugaggcu

SEQ ID NO: 445553 - RNA, 19 nt, Human
aggcauccccgagagggug

SEQ ID NO: 445554 - RNA, 22 nt, Human
aggcgccgaggcgaugagagcu

SEQ ID NO: 445555 - RNA, 18 nt, Human
agggaaccccaggagagc

SEQ ID NO: 445556 - RNA, 19 nt, Human
agggaagcaagggagaaag

SEQ ID NO: 445557 - RNA, 24 nt, Human
agggcaguccccaggguugugccc

SEQ ID NO: 445558 - RNA, 18 nt, Human
aguuucacagccuugcuc

SEQ ID NO: 445559 - RNA, 23 nt, Human
auccugagcuggcucugggcccu

SEQ ID NO: 445560 - RNA, 19 nt, Human
caaaacgagcauccucugc

SEQ ID NO: 445561 - RNA, 26 nt, Human
caaacagauaaacagagaagccuccc

SEQ ID NO: 445562 - RNA, 21 nt, Human
cacagcaccgagaugucuagg

SEQ ID NO: 445563 - RNA, 20 nt, Human
caccacaggcacccaccacc

SEQ ID NO: 445564 - RNA, 24 nt, Human
caccacaggcacccaccaccagcc

SEQ ID NO: 445565 - RNA, 24 nt, Human
caccaccagccauuaccagcacug

SEQ ID NO: 445566 - RNA, 24 nt, Human
caccccuaacuacccucuugggga

SEQ ID NO: 445567 - RNA, 21 nt, Human
cagaggggccaccacaggcac

SEQ ID NO: 445568 - RNA, 24 nt, Human
cagauaaacagagaagccucccag

SEQ ID NO: 445569 - RNA, 18 nt, Human
cagauccugagcuggcuc

SEQ ID NO: 445570 - RNA, 19 nt, Human
cagcaucugagcugaggca

SEQ ID NO: 445571 - RNA, 22 nt, Human
caggagagcuguagaaguggug

SEQ ID NO: 445572 - RNA, 21 nt, Human
caggauccuucuuaguuuagg

SEQ ID NO: 445573 - RNA, 22 nt, Human
cagucgggacaggcuauggagg

SEQ ID NO: 445574 - RNA, 19 nt, Human
cauccaggugcgcacccuc

SEQ ID NO: 445575 - RNA, 19 nt, Human
ccaccagaggggccaccac

SEQ ID NO: 445576 - RNA, 22 nt, Human
ccccaggguugugcccuacacu

SEQ ID NO: 445577 - RNA, 19 nt, Human
cccgcagccguccccaucc

SEQ ID NO: 445578 - RNA, 23 nt, Human
cccuacacuggaugguggccccc

SEQ ID NO: 445579 - RNA, 20 nt, Human
cccuccgcccccaccacgcc

SEQ ID NO: 445580 - RNA, 21 nt, Human
cccugcagaugcccgcagccg

SEQ ID NO: 445581 - RNA, 18 nt, Human
ccuccuucccuccgcccc

SEQ ID NO: 445582 - RNA, 21 nt, Human
ccucggagccgcccgcccucc

SEQ ID NO: 445583 - RNA, 20 nt, Human
ccuggcgccagguugcccuc

SEQ ID NO: 445584 - RNA, 24 nt, Human
ccuuccccucuccaaggacggggg

SEQ ID NO: 445585 - RNA, 18 nt, Human
cgcccuccuucccuccgc

SEQ ID NO: 445586 - RNA, 22 nt, Human
cucccagguucuggcacauuaa

SEQ ID NO: 445587 - RNA, 18 nt, Human
cucucugucucugugccc

SEQ ID NO: 445588 - RNA, 21 nt, Human
cucugugccccgccgcccucc

SEQ ID NO: 445589 - RNA, 21 nt, Human
cuggcacauuaacaaagagga

SEQ ID NO: 445590 - RNA, 19 nt, Human
cugugccaacaguggcccc

SEQ ID NO: 445591 - RNA, 18 nt, Human
cuuacuguuucagugaaa

SEQ ID NO: 445592 - RNA, 18 nt, Human
cuugcucucugucucugu

SEQ ID NO: 445593 - RNA, 18 nt, Human
gagaagccucccagguuc

SEQ ID NO: 445594 - RNA, 20 nt, Human
gaggggaugagaagccugag

SEQ ID NO: 445595 - RNA, 19 nt, Human
gccuugcucucugucucug

SEQ ID NO: 445596 - RNA, 20 nt, Human
ggaggaggggaugagaagcc

SEQ ID NO: 445597 - RNA, 18 nt, Human
gggaagcaagggagaaag

SEQ ID NO: 445598 - RNA, 18 nt, Human
ggggaugagaagccugag

SEQ ID NO: 445599 - RNA, 19 nt, Human
ggucaguggcuggcuccag

SEQ ID NO: 445600 - RNA, 23 nt, Human
uaaccagaauuuucccuggcgcc

SEQ ID NO: 445601 - RNA, 21 nt, Human
uaagaacacaaccucuaaauc

SEQ ID NO: 445602 - RNA, 24 nt, Human
uagaggaacacugccuucucugca

SEQ ID NO: 445603 - RNA, 23 nt, Human
ucagugaaaaguugggagggaag

SEQ ID NO: 445604 - RNA, 21 nt, Human
ucaguggcuggcuccaggguc

SEQ ID NO: 445605 - RNA, 20 nt, Human
uccagcauccaggugcgcac

SEQ ID NO: 445606 - RNA, 23 nt, Human
uccagcaucugagcugaggcagg

SEQ ID NO: 445607 - RNA, 20 nt, Human
uccaggguccaugagugaag

SEQ ID NO: 445608 - RNA, 18 nt, Human
ucccuggcgccagguugc

SEQ ID NO: 445609 - RNA, 18 nt, Human
ucccuguccaggauccuu

SEQ ID NO: 445610 - RNA, 19 nt, Human
uccugguaccuuauccucc

SEQ ID NO: 445611 - RNA, 21 nt, Human
uccugguaccuuauccuccuc

SEQ ID NO: 445612 - RNA, 25 nt, Human
ucggcagucgggacaggccgggguc

SEQ ID NO: 445613 - RNA, 20 nt, Human
ugaauaaccagaauuuuccc

SEQ ID NO: 445614 - RNA, 24 nt, Human
ugacuuggagaaagaacacugucc

SEQ ID NO: 445615 - RNA, 21 nt, Human
ugagcuggcucugggcccuca

SEQ ID NO: 445616 - RNA, 22 nt, Human
ugcaaaagaaggacagugggaa

SEQ ID NO: 445617 - RNA, 21 nt, Human
ugcagggagcggcaggagagc

SEQ ID NO: 445618 - RNA, 18 nt, Human
ugccccgccgcccuccuu

SEQ ID NO: 445619 - RNA, 18 nt, Human
ugcgggaggaggggauga

SEQ ID NO: 445620 - RNA, 19 nt, Human
uggaaacacccuauugcua

SEQ ID NO: 445621 - RNA, 20 nt, Human
uggagggcaguccccagggu

SEQ ID NO: 445622 - RNA, 20 nt, Human
uggcacauuaacaaagagga

SEQ ID NO: 445623 - RNA, 24 nt, Human
uggcaugccuaagaacacaaccuc

SEQ ID NO: 445624 - RNA, 20 nt, Human
uggcugugccaacaguggcc

SEQ ID NO: 445625 - RNA, 20 nt, Human
ugggaggcgccgaggcgaug

SEQ ID NO: 445626 - RNA, 22 nt, Human
ugggaggcgccgaggcgaugag

SEQ ID NO: 445627 - RNA, 18 nt, Human
ugguccagccucuugccu

SEQ ID NO: 445628 - RNA, 18 nt, Human
ugguggcccccuccaccc

SEQ ID NO: 445629 - RNA, 23 nt, Human
uguguugagcagacaccagaucc

SEQ ID NO: 445630 - RNA, 24 nt, Human
uuccccaccccuaacuacccucuu

SEQ ID NO: 445631 - RNA, 22 nt, Human
uucucugcaaaacgagcauccu

SEQ ID NO: 445632 - RNA, 21 nt, Human
uugcucucugucucugugccc

SEQ ID NO: 445633 - RNA, 24 nt, Human
uuuuuuuuuuuuuuuucgcucuga

SEQ ID NO: 445634 - RNA, 21 nt, Human
uuuuuuuuuuuuuuuuucgcu

SEQ ID NO: 445635 - RNA, 27 nt, Human
uuuuuuuuuuuuuuuuuuuuuucgggg

SEQ ID NO: 445636 - RNA, 19 nt, Human
aaaaagacagagugaugua

SEQ ID NO: 445637 - RNA, 19 nt, Human
aacauuuuguccagaggug

SEQ ID NO: 445638 - RNA, 18 nt, Human
aacccgaaauccccaaaa

SEQ ID NO: 445639 - RNA, 18 nt, Human
aagcaagaaaaaaaaauc

SEQ ID NO: 445640 - RNA, 19 nt, Human
aagcaagaaaaaaaaaucc

SEQ ID NO: 445641 - RNA, 22 nt, Human
aagcaagaucaagacuuagcaa

SEQ ID NO: 445642 - RNA, 21 nt, Human
aagcugccaauuccacuucug

SEQ ID NO: 445643 - RNA, 23 nt, Human
aagugccuugugaauuguuaagc

SEQ ID NO: 445644 - RNA, 21 nt, Human
aauaucuuuuuggagaccucc

SEQ ID NO: 445645 - RNA, 23 nt, Human
acucaacuuaucuucccuaagau

SEQ ID NO: 445646 - RNA, 20 nt, Human
agaaggcuguuucaggggac

SEQ ID NO: 445647 - RNA, 23 nt, Human
agaccaggauccaguggcuuuca

SEQ ID NO: 445648 - RNA, 20 nt, Human
agaucaagacuuagcaagac

SEQ ID NO: 445649 - RNA, 23 nt, Human
aggauccaguggcuuucaguuuu

SEQ ID NO: 445650 - RNA, 18 nt, Human
agguggcuuaggaaggga

SEQ ID NO: 445651 - RNA, 19 nt, Human
agguggcuuaggaagggag

SEQ ID NO: 445652 - RNA, 24 nt, Human
augggcaauguggcauuugccuca

SEQ ID NO: 445653 - RNA, 22 nt, Human
caaagcaagaaaaaaaaauccc

SEQ ID NO: 445654 - RNA, 23 nt, Human
caacucaacuuaucuucccuaag

SEQ ID NO: 445655 - RNA, 26 nt, Human
caagaacacagacacuuagaugccau

SEQ ID NO: 445656 - RNA, 21 nt, Human
caguuugacugaaggugcauc

SEQ ID NO: 445657 - RNA, 22 nt, Human
cauuuggcuucucaaauucauc

SEQ ID NO: 445658 - RNA, 21 nt, Human
ccaguggcuuucaguuuuggc

SEQ ID NO: 445659 - RNA, 22 nt, Human
ccaguggcuuucaguuuuggcu

SEQ ID NO: 445660 - RNA, 20 nt, Human
ccccuugugccuuccagcug

SEQ ID NO: 445661 - RNA, 18 nt, Human
cccuugugccuuccagcu

SEQ ID NO: 445662 - RNA, 20 nt, Human
ccuuugggaauucugggcuu

SEQ ID NO: 445663 - RNA, 20 nt, Human
cugaaugccacaauguccuc

SEQ ID NO: 445664 - RNA, 22 nt, Human
cugacugcaaauccagagcuga

SEQ ID NO: 445665 - RNA, 22 nt, Human
cuuagaacccgaaauccccaaa

SEQ ID NO: 445666 - RNA, 23 nt, Human
gacaacucaacuuaucuucccua

SEQ ID NO: 445667 - RNA, 21 nt, Human
gacccagacaaugagggucuu

SEQ ID NO: 445668 - RNA, 24 nt, Human
gagaacuucaaggggaaaagacug

SEQ ID NO: 445669 - RNA, 21 nt, Human
ggaaauccccugaauguaaug

SEQ ID NO: 445670 - RNA, 20 nt, Human
ggggguggggugggggacaa

SEQ ID NO: 445671 - RNA, 23 nt, Human
ggggguggggugggggacaaugg

SEQ ID NO: 445672 - RNA, 19 nt, Human
gggguggggugggggacaa

SEQ ID NO: 445673 - RNA, 20 nt, Human
guggggugggggacaauggu

SEQ ID NO: 445674 - RNA, 21 nt, Human
uaaauugcuaccacuuuccuu

SEQ ID NO: 445675 - RNA, 23 nt, Human
uacaagaacacagacacuuagau

SEQ ID NO: 445676 - RNA, 19 nt, Human
uaccacuuuccuucaucug

SEQ ID NO: 445677 - RNA, 25 nt, Human
uaggaaaauacauuugagcuaaaaa

SEQ ID NO: 445678 - RNA, 18 nt, Human
uaggaaauauccagguag

SEQ ID NO: 445679 - RNA, 22 nt, Human
uauacaaauccaguagcauagc

SEQ ID NO: 445680 - RNA, 21 nt, Human
uaucugaaaaaugggcaaugu

SEQ ID NO: 445681 - RNA, 21 nt, Human
uauguccauagauuguagaac

SEQ ID NO: 445682 - RNA, 18 nt, Human
uauucugggggguggggu

SEQ ID NO: 445683 - RNA, 19 nt, Human
ucaaaugucuguucucaag

SEQ ID NO: 445684 - RNA, 23 nt, Human
ucaaggggaaaagacugagccag

SEQ ID NO: 445685 - RNA, 20 nt, Human
ucaucagaaacauuucacau

SEQ ID NO: 445686 - RNA, 22 nt, Human
ucccaaacugacugcaaaucca

SEQ ID NO: 445687 - RNA, 20 nt, Human
uccuccccuugugccuucca

SEQ ID NO: 445688 - RNA, 23 nt, Human
uccucuaaaaugcaggagagcaa

SEQ ID NO: 445689 - RNA, 22 nt, Human
ucugaagauucagcuagaccag

SEQ ID NO: 445690 - RNA, 27 nt, Human
ucugaaugccacaauguccuccccuug

SEQ ID NO: 445691 - RNA, 19 nt, Human
ucugauaucagcacaaagc

SEQ ID NO: 445692 - RNA, 18 nt, Human
ucuuggacaacucaacuu

SEQ ID NO: 445693 - RNA, 21 nt, Human
ugaaaaaugggcaauguggca

SEQ ID NO: 445694 - RNA, 20 nt, Human
ugacugcaaauccagagcug

SEQ ID NO: 445695 - RNA, 28 nt, Human
ugcagaugcuuuuccaauuagauguccc

SEQ ID NO: 445696 - RNA, 22 nt, Human
uggacaacucaacuuaucuucc

SEQ ID NO: 445697 - RNA, 25 nt, Human
uggacaacucaacuuaucuucccua

SEQ ID NO: 445698 - RNA, 21 nt, Human
uggcaggaagcaagaucaaga

SEQ ID NO: 445699 - RNA, 18 nt, Human
uggggggugggguggggg

SEQ ID NO: 445700 - RNA, 19 nt, Human
uggggugggggacaauggu

SEQ ID NO: 445701 - RNA, 21 nt, Human
ugucgauacugaagaaaaggg

SEQ ID NO: 445702 - RNA, 24 nt, Human
ugugaauuguuaagcccaauaagg

SEQ ID NO: 445703 - RNA, 23 nt, Human
uguuucuaccaauaccuaccugu

SEQ ID NO: 445704 - RNA, 28 nt, Human
uucccuguucgcugcuauuuguuugaau

SEQ ID NO: 445705 - RNA, 21 nt, Human
uucucaaauucaucuugucuc

SEQ ID NO: 445706 - RNA, 20 nt, Human
uuuauacaaauccaguagca

SEQ ID NO: 445707 - RNA, 23 nt, Human
uuugacugaaggugcaucccuug

SEQ ID NO: 445708 - RNA, 21 nt, Human
uuuuaugcagaugcuuuucca

SEQ ID NO: 445709 - RNA, 18 nt, Human
aaagcaggagcugcccuu

SEQ ID NO: 445710 - RNA, 18 nt, Human
aacucgcucucccuacuc

SEQ ID NO: 445711 - RNA, 20 nt, Human
aacucgcucucccuacucca

SEQ ID NO: 445712 - RNA, 21 nt, Human
aaucucucauggaaccccuac

SEQ ID NO: 445713 - RNA, 19 nt, Human
agaacaacagcaauggcuc

SEQ ID NO: 445714 - RNA, 18 nt, Human
agaaucccccucucugcc

SEQ ID NO: 445715 - RNA, 24 nt, Human
agcagagccaucccagaacaacag

SEQ ID NO: 445716 - RNA, 20 nt, Human
agccuccaaucuuccuccaa

SEQ ID NO: 445717 - RNA, 28 nt, Human
aggagcugcccuuguucagggauaauau

SEQ ID NO: 445718 - RNA, 20 nt, Human
aggccauugcuggggggagg

SEQ ID NO: 445719 - RNA, 18 nt, Human
auaaagcaggagcugccc

SEQ ID NO: 445720 - RNA, 18 nt, Human
auucacugcucuccuuac

SEQ ID NO: 445721 - RNA, 28 nt, Human
auugacaauuacucaucuauuuuugacu

SEQ ID NO: 445722 - RNA, 24 nt, Human
caacagugccacgauaagaguuuc

SEQ ID NO: 445723 - RNA, 19 nt, Human
cacugcucuccuuacuuca

SEQ ID NO: 445724 - RNA, 22 nt, Human
cagagaggggccaugaccuguc

SEQ ID NO: 445725 - RNA, 23 nt, Human
cagcaccacacuggauucuggag

SEQ ID NO: 445726 - RNA, 24 nt, Human
caucacccaggccucugguuucca

SEQ ID NO: 445727 - RNA, 19 nt, Human
ccaaucuuccuccaaagaa

SEQ ID NO: 445728 - RNA, 25 nt, Human
ccagaauguaggaagugggacagga

SEQ ID NO: 445729 - RNA, 21 nt, Human
cccagagucugaggccuggac

SEQ ID NO: 445730 - RNA, 19 nt, Human
ccccagagucugaggccug

SEQ ID NO: 445731 - RNA, 23 nt, Human
ccccagagucugaggccuggaca

SEQ ID NO: 445732 - RNA, 24 nt, Human
ccccgagucccagcucccaaacuc

SEQ ID NO: 445733 - RNA, 19 nt, Human
ccugcccacccugggucug

SEQ ID NO: 445734 - RNA, 19 nt, Human
cuccaaagaaagaugcuga

SEQ ID NO: 445735 - RNA, 24 nt, Human
cuccccgagucccagcucccaaac

SEQ ID NO: 445736 - RNA, 18 nt, Human
cugcgaucuggaagcaga

SEQ ID NO: 445737 - RNA, 18 nt, Human
cugcuccugccugacuga

SEQ ID NO: 445738 - RNA, 18 nt, Human
cuggagucuuuccagcca

SEQ ID NO: 445739 - RNA, 21 nt, Human
cugggcccagagaggggccau

SEQ ID NO: 445740 - RNA, 23 nt, Human
cuucacgguagucccagaaugua

SEQ ID NO: 445741 - RNA, 22 nt, Human
gacuccccgagucccagcuccc

SEQ ID NO: 445742 - RNA, 18 nt, Human
gagaggggaaggggcuug

SEQ ID NO: 445743 - RNA, 29 nt, Human
gcuggggggaggggcagggugaagggagg

SEQ ID NO: 445744 - RNA, 20 nt, Human
ggaagggacuucauuugaag

SEQ ID NO: 445745 - RNA, 24 nt, Human
gggaggggcagggugaagggaggg

SEQ ID NO: 445746 - RNA, 20 nt, Human
uaagaaacacaguuugacau

SEQ ID NO: 445747 - RNA, 19 nt, Human
uaaggaaacugaggcccag

SEQ ID NO: 445748 - RNA, 22 nt, Human
uaaugcaguaaaaccauuccuu

SEQ ID NO: 445749 - RNA, 22 nt, Human
ucacccaggccucugguuucca

SEQ ID NO: 445750 - RNA, 19 nt, Human
ucccaaacucgcucucccu

SEQ ID NO: 445751 - RNA, 21 nt, Human
ucccagcucccaaacucgcuc

SEQ ID NO: 445752 - RNA, 20 nt, Human
uccccgagucccagcuccca

SEQ ID NO: 445753 - RNA, 23 nt, Human
uccugcccacccugggucugggu

SEQ ID NO: 445754 - RNA, 23 nt, Human
ucucccuacuccaggcuucacgg

SEQ ID NO: 445755 - RNA, 23 nt, Human
ugacuccccgagucccagcuccc

SEQ ID NO: 445756 - RNA, 18 nt, Human
ugcuggggggaggggcag

SEQ ID NO: 445757 - RNA, 18 nt, Human
uggccccucaguuccugc

SEQ ID NO: 445758 - RNA, 23 nt, Human
uggccccucaguuccugcccacc

SEQ ID NO: 445759 - RNA, 23 nt, Human
ugggacaggauagacuuuaacau

SEQ ID NO: 445760 - RNA, 23 nt, Human
uuaaaacccaaaaucucucaugg

SEQ ID NO: 445761 - RNA, 18 nt, Human
uucacgguagucccagaa

SEQ ID NO: 445762 - RNA, 22 nt, Human
aaaaaagacacaauauaaagga

SEQ ID NO: 445763 - RNA, 20 nt, Human
aaacaaaacaucagcagaaa

SEQ ID NO: 445764 - RNA, 20 nt, Human
aaaccagucccagauacugu

SEQ ID NO: 445765 - RNA, 18 nt, Human
aaauccaaaccccaccaa

SEQ ID NO: 445766 - RNA, 18 nt, Human
aagaaagagggaggcaga

SEQ ID NO: 445767 - RNA, 20 nt, Human
agcucccaggcaaacuaaac

SEQ ID NO: 445768 - RNA, 22 nt, Human
aggaagaaagagggaggcagaa

SEQ ID NO: 445769 - RNA, 20 nt, Human
aggaccugcuaggcgacugg

SEQ ID NO: 445770 - RNA, 24 nt, Human
auaaaaaagacacaauauaaagga

SEQ ID NO: 445771 - RNA, 19 nt, Human
caacauaaaaaagacacaa

SEQ ID NO: 445772 - RNA, 22 nt, Human
cagaagcagaagggguuugggg

SEQ ID NO: 445773 - RNA, 20 nt, Human
cagcacagaacuaauuggcu

SEQ ID NO: 445774 - RNA, 21 nt, Human
caugcaacauaaaaaagacac

SEQ ID NO: 445775 - RNA, 21 nt, Human
ccaaaccccaccaagguuaag

SEQ ID NO: 445776 - RNA, 20 nt, Human
ccaauaaacaaaacaucagc

SEQ ID NO: 445777 - RNA, 18 nt, Human
ccagucccagauacuguu

SEQ ID NO: 445778 - RNA, 22 nt, Human
cccaauaaacaaaacaucagca

SEQ ID NO: 445779 - RNA, 19 nt, Human
cccaggcaaacuaaacgag

SEQ ID NO: 445780 - RNA, 22 nt, Human
cccaggcaaacuaaacgagagg

SEQ ID NO: 445781 - RNA, 18 nt, Human
ccccugugccgaugaaga

SEQ ID NO: 445782 - RNA, 28 nt, Human
cgguaaacaauaauuggcaacaaaauaa

SEQ ID NO: 445783 - RNA, 20 nt, Human
cucccaggcaaacuaaacga

SEQ ID NO: 445784 - RNA, 21 nt, Human
cugguacaagcaguauuagaa

SEQ ID NO: 445785 - RNA, 21 nt, Human
cuuucaagcucccaggcaaac

SEQ ID NO: 445786 - RNA, 19 nt, Human
gaccccgugcuuucuccuu

SEQ ID NO: 445787 - RNA, 22 nt, Human
gcaacaugcaacauaaaaaaga

SEQ ID NO: 445788 - RNA, 21 nt, Human
ggggcgaccccgugcuuucuc

SEQ ID NO: 445789 - RNA, 23 nt, Human
guaguguuuuggaucuuucucug

SEQ ID NO: 445790 - RNA, 23 nt, Human
uaaaaccaagcacauugcuaaau

SEQ ID NO: 445791 - RNA, 24 nt, Human
uaacaagccuagaccaauuuuauc

SEQ ID NO: 445792 - RNA, 20 nt, Human
uaagccgguagaggaccugc

SEQ ID NO: 445793 - RNA, 19 nt, Human
uaauaaccaagauacaaac

SEQ ID NO: 445794 - RNA, 22 nt, Human
uacaagcaguauuagaaaaucu

SEQ ID NO: 445795 - RNA, 20 nt, Human
uacuuuuuucccaaggagaa

SEQ ID NO: 445796 - RNA, 19 nt, Human
uaucaaacauguccuuggu

SEQ ID NO: 445797 - RNA, 19 nt, Human
uauguccaggcauuuacgc

SEQ ID NO: 445798 - RNA, 18 nt, Human
uauuaggaauaauuccaa

SEQ ID NO: 445799 - RNA, 24 nt, Human
uauucugcccaaaccagucccaga

SEQ ID NO: 445800 - RNA, 18 nt, Human
ucaaauccaaaccccacc

SEQ ID NO: 445801 - RNA, 21 nt, Human
ucaaauccaaaccccaccaag

SEQ ID NO: 445802 - RNA, 22 nt, Human
ucaaauccaaaccccaccaagg

SEQ ID NO: 445803 - RNA, 21 nt, Human
ugaugaguuuuccaaaaacuc

SEQ ID NO: 445804 - RNA, 21 nt, Human
ugaugggcagaagcagaaggg

SEQ ID NO: 445805 - RNA, 22 nt, Human
ugcuuucuccuuucaagcuccc

SEQ ID NO: 445806 - RNA, 18 nt, Human
uggaucuuucucuggcug

SEQ ID NO: 445807 - RNA, 25 nt, Human
uggcaacaaaauaaguuuaauauuc

SEQ ID NO: 445808 - RNA, 19 nt, Human
ugggcagaagcagaagggg

SEQ ID NO: 445809 - RNA, 19 nt, Human
ugggcagaagcagaagggg

SEQ ID NO: 445810 - RNA, 25 nt, Human
ugggcagaagcagaagggguuuggg

SEQ ID NO: 445811 - RNA, 23 nt, Human
uggggcucaaaaaacacucaaaa

SEQ ID NO: 445812 - RNA, 21 nt, Human
ugucuggggcucaaaaaacac

SEQ ID NO: 445813 - RNA, 22 nt, Human
ugugccgaugaagauccggcac

SEQ ID NO: 445814 - RNA, 21 nt, Human
uguuuuggaucuuucucuggc

SEQ ID NO: 445815 - RNA, 24 nt, Human
uuggggcgaccccgugcuuucucc

SEQ ID NO: 445816 - RNA, 21 nt, Human
uugguuagauauccaauuuca

SEQ ID NO: 445817 - RNA, 27 nt, Human
aaaaaaaaaaaaaaaaaaaggaaaaag

SEQ ID NO: 445818 - RNA, 26 nt, Human
aaaagaaagggaaacaaacaaaagag

SEQ ID NO: 445819 - RNA, 20 nt, Human
aaacaaaagagaaaaccccc

SEQ ID NO: 445820 - RNA, 23 nt, Human
aaacaaaagagaaaacccccaag

SEQ ID NO: 445821 - RNA, 22 nt, Human
aaacaaacaaaagagaaaaccc

SEQ ID NO: 445822 - RNA, 25 nt, Human
aaacaaacaaaagagaaaaccccca

SEQ ID NO: 445823 - RNA, 20 nt, Human
aaacccccaagccccguccc

SEQ ID NO: 445824 - RNA, 18 nt, Human
aaagaagagaaaguggca

SEQ ID NO: 445825 - RNA, 24 nt, Human
aaaggaaaaaagcauacauaggaa

SEQ ID NO: 445826 - RNA, 20 nt, Human
aacaguaacuccagaguuca

SEQ ID NO: 445827 - RNA, 23 nt, Human
aacgcaaagccaacaaaaaaaaa

SEQ ID NO: 445828 - RNA, 19 nt, Human
aaggaaggggggggaaggc

SEQ ID NO: 445829 - RNA, 23 nt, Human
aagggacuuuuacccaagaacug

SEQ ID NO: 445830 - RNA, 18 nt, Human
acccccaagccccguccc

SEQ ID NO: 445831 - RNA, 30 nt, Human
acgccgccgccgccgcgaaaccgaaacgag

SEQ ID NO: 445832 - RNA, 18 nt, Human
acugcagcccuccggccc

SEQ ID NO: 445833 - RNA, 21 nt, Human
acugcagcccuccggcccgcc

SEQ ID NO: 445834 - RNA, 22 nt, Human
acugcagcccuccggcccgccc

SEQ ID NO: 445835 - RNA, 21 nt, Human
acugcccuuccccccgcaggc

SEQ ID NO: 445836 - RNA, 25 nt, Human
agaaagggaaacaaacaaaagagaa

SEQ ID NO: 445837 - RNA, 22 nt, Human
agaacaguaacuccagaguuca

SEQ ID NO: 445838 - RNA, 20 nt, Human
agaacucauaaggaaggggg

SEQ ID NO: 445839 - RNA, 19 nt, Human
agacugcagcccuccggcc

SEQ ID NO: 445840 - RNA, 21 nt, Human
agagaaaacccccaagccccg

SEQ ID NO: 445841 - RNA, 24 nt, Human
agaggcagcgcggcuccggggccc

SEQ ID NO: 445842 - RNA, 21 nt, Human
agaggcccaggccccccgcuc

SEQ ID NO: 445843 - RNA, 24 nt, Human
aggaaaaaagcauacauaggaaaa

SEQ ID NO: 445844 - RNA, 27 nt, Human
aggaaaaagaaagggaaacaaacaaaa

SEQ ID NO: 445845 - RNA, 18 nt, Human
aggaaaaugaaagauucu

SEQ ID NO: 445846 - RNA, 28 nt, Human
agugauaaggaaacugggcaaaaaagga

SEQ ID NO: 445847 - RNA, 21 nt, Human
augcaugauguguuucagaac

SEQ ID NO: 445848 - RNA, 18 nt, Human
caaaaaaggaaaaaagca

SEQ ID NO: 445849 - RNA, 22 nt, Human
caaacaaaagagaaaaccccca

SEQ ID NO: 445850 - RNA, 18 nt, Human
caaauucaaaagaagaga

SEQ ID NO: 445851 - RNA, 21 nt, Human
caacaacgccgccgccgccgc

SEQ ID NO: 445852 - RNA, 19 nt, Human
cacauuugaaauuacuaag

SEQ ID NO: 445853 - RNA, 18 nt, Human
caccgaccgcacaacuug

SEQ ID NO: 445854 - RNA, 21 nt, Human
cacugggcuccccaccgaccc

SEQ ID NO: 445855 - RNA, 21 nt, Human
cagucgccgccgccacccggg

SEQ ID NO: 445856 - RNA, 20 nt, Human
ccaacaaaaaaaaaaaaaaa

SEQ ID NO: 445857 - RNA, 18 nt, Human
ccaagaacugcuguguuu

SEQ ID NO: 445858 - RNA, 23 nt, Human
cccaagaacugcuguguuucccc

SEQ ID NO: 445859 - RNA, 23 nt, Human
ccccaagccccguccccgccaaa

SEQ ID NO: 445860 - RNA, 21 nt, Human
cccccaagccccguccccgcc

SEQ ID NO: 445861 - RNA, 18 nt, Human
ccccguccccgccaaacu

SEQ ID NO: 445862 - RNA, 20 nt, Human
cccgcuccuccgccuuccuc

SEQ ID NO: 445863 - RNA, 21 nt, Human
ccgacccaggacacccgagag

SEQ ID NO: 445864 - RNA, 19 nt, Human
ccgccgcgguucccgcucc

SEQ ID NO: 445865 - RNA, 21 nt, Human
ccgccgcgguucccgcuccuc

SEQ ID NO: 445866 - RNA, 22 nt, Human
ccgggcccugagacugcgcugg

SEQ ID NO: 445867 - RNA, 18 nt, Human
ccuccuaagggcagaggc

SEQ ID NO: 445868 - RNA, 24 nt, Human
ccuccuaagggcagaggcccaggc

SEQ ID NO: 445869 - RNA, 22 nt, Human
cgaaauaaaaaaaucccaaacc

SEQ ID NO: 445870 - RNA, 26 nt, Human
cgaaauaaaaaaaucccaaaccuauu

SEQ ID NO: 445871 - RNA, 32 nt, Human
cgcaaagccaacaaaaaaaaaaaaaaaaaaaa

SEQ ID NO: 445872 - RNA, 21 nt, Human
cgccaaacuguagaacaguaa

SEQ ID NO: 445873 - RNA, 23 nt, Human
cgccgccgccgccgcgaaacccc

SEQ ID NO: 445874 - RNA, 22 nt, Human
cgccgccgccgccgcgaaaccg

SEQ ID NO: 445875 - RNA, 23 nt, Human
cggaacugcccuuccccccgcag

SEQ ID NO: 445876 - RNA, 24 nt, Human
cuaacgcaaagccaacaaaaaaaa

SEQ ID NO: 445877 - RNA, 25 nt, Human
cuaacgcaaagccaacaaaaaaaaa

SEQ ID NO: 445878 - RNA, 18 nt, Human
cuccuuccaggggauggg

SEQ ID NO: 445879 - RNA, 19 nt, Human
cugcgugggaguugccucc

SEQ ID NO: 445880 - RNA, 21 nt, Human
cugggcaaaaaaggaaaaaag

SEQ ID NO: 445881 - RNA, 25 nt, Human
gaaaaagaaagggaaacaaacaaaa

SEQ ID NO: 445882 - RNA, 23 nt, Human
gagccauccuaacgcaaagccaa

SEQ ID NO: 445883 - RNA, 22 nt, Human
gagccggggccgggggcauuca

SEQ ID NO: 445884 - RNA, 22 nt, Human
gaggcgcggcccggcccggaac

SEQ ID NO: 445885 - RNA, 22 nt, Human
gccaacaacgccgccgccgccg

SEQ ID NO: 445886 - RNA, 19 nt, Human
gcgcggcuccggggccccg

SEQ ID NO: 445887 - RNA, 20 nt, Human
gcgcugggagccgccgcccu

SEQ ID NO: 445888 - RNA, 21 nt, Human
ggaaaaugaaagauucucucg

SEQ ID NO: 445889 - RNA, 21 nt, Human
ggaaacaaacaaaagagaaaa

SEQ ID NO: 445890 - RNA, 23 nt, Human
ggagccggggccgggggcauuca

SEQ ID NO: 445891 - RNA, 22 nt, Human
uaaaagacaaacggcaguuuga

SEQ ID NO: 445892 - RNA, 27 nt, Human
uaacgcaaagccaacaaaaaaaaaaaa

SEQ ID NO: 445893 - RNA, 22 nt, Human
uaagggcagaggcccaggcccc

SEQ ID NO: 445894 - RNA, 21 nt, Human
uaaguuuacuauacuggucuu

SEQ ID NO: 445895 - RNA, 21 nt, Human
uacauaggaaaaugaaagauu

SEQ ID NO: 445896 - RNA, 18 nt, Human
uagaacaguaacuccaga

SEQ ID NO: 445897 - RNA, 18 nt, Human
uagaacaguaacuccaga

SEQ ID NO: 445898 - RNA, 21 nt, Human
uagaugaaacagacuugcaac

SEQ ID NO: 445899 - RNA, 23 nt, Human
ucgaaauaaaaaaaucccaaacc

SEQ ID NO: 445900 - RNA, 20 nt, Human
ucggugcgcugccuccagcc

SEQ ID NO: 445901 - RNA, 18 nt, Human
ucuccagucgccgccgcc

SEQ ID NO: 445902 - RNA, 22 nt, Human
ucuccuuccaggggaugggugg

SEQ ID NO: 445903 - RNA, 20 nt, Human
ugaaagaggugaugguggcg

SEQ ID NO: 445904 - RNA, 18 nt, Human
ugccuccagccgccgccc

SEQ ID NO: 445905 - RNA, 19 nt, Human
ugcuggaagucaacaagga

SEQ ID NO: 445906 - RNA, 21 nt, Human
ugggcaaaaaaggaaaaaagc

SEQ ID NO: 445907 - RNA, 23 nt, Human
ugggcaaaaaaggaaaaaagcau

SEQ ID NO: 445908 - RNA, 23 nt, Human
ugucccggguccccucagccaac

SEQ ID NO: 445909 - RNA, 20 nt, Human
uucagaacuuacuugcugac

SEQ ID NO: 445910 - RNA, 18 nt, Human
uucccauucugcuggaag

SEQ ID NO: 445911 - RNA, 28 nt, Human
aaaaacaguaaagagcacaccgguaccc

SEQ ID NO: 445912 - RNA, 22 nt, Human
aaaaaugaaaaacaguaaagag

SEQ ID NO: 445913 - RNA, 21 nt, Human
aaaauuagugaaaagggaagc

SEQ ID NO: 445914 - RNA, 24 nt, Human
aaaauuagugaaaagggaagccgg

SEQ ID NO: 445915 - RNA, 24 nt, Human
aaaauuagugaaaagggaagccgg

SEQ ID NO: 445916 - RNA, 25 nt, Human
aacaccuaccauuauacauacauua

SEQ ID NO: 445917 - RNA, 25 nt, Human
aacaccuaccauuauacauacauua

SEQ ID NO: 445918 - RNA, 25 nt, Human
aacaccuaccauuauacauacauua

SEQ ID NO: 445919 - RNA, 21 nt, Human
aacagcaugaccuuuuacccu

SEQ ID NO: 445920 - RNA, 20 nt, Human
aauagaaggaccaauuuaga

SEQ ID NO: 445921 - RNA, 19 nt, Human
acuacuaaaugcugccaac

SEQ ID NO: 445922 - RNA, 23 nt, Human
agccuuaaguuuuauugucaaaa

SEQ ID NO: 445923 - RNA, 21 nt, Human
aggcuuuuuuuuuaaugcuuu

SEQ ID NO: 445924 - RNA, 23 nt, Human
agugaaaaggcagguuaaaagaa

SEQ ID NO: 445925 - RNA, 21 nt, Human
auaagcauuugccacuguacu

SEQ ID NO: 445926 - RNA, 19 nt, Human
auauauauauauauauaua

SEQ ID NO: 445927 - RNA, 21 nt, Human
aucacuguccuuacaacaauu

SEQ ID NO: 445928 - RNA, 27 nt, Human
auuauaaucaggcacaauuuuucaacu

SEQ ID NO: 445929 - RNA, 27 nt, Human
auuauaaucaggcacaauuuuucaacu

SEQ ID NO: 445930 - RNA, 27 nt, Human
auuauaaucaggcacaauuuuucaacu

SEQ ID NO: 445931 - RNA, 20 nt, Human
cagguuaaaagaagcagcua

SEQ ID NO: 445932 - RNA, 26 nt, Human
cauaauaauauucuuuaaaaaugaaa

SEQ ID NO: 445933 - RNA, 23 nt, Human
cauuaagcaacugucauuucuac

SEQ ID NO: 445934 - RNA, 21 nt, Human
ccacaacagugcuaccaaaaa

SEQ ID NO: 445935 - RNA, 19 nt, Human
ccucuuucccaguauauug

SEQ ID NO: 445936 - RNA, 24 nt, Human
ccuuaguguuacacuuuuucuuca

SEQ ID NO: 445937 - RNA, 24 nt, Human
ccuuaguguuacacuuuuucuuca

SEQ ID NO: 445938 - RNA, 24 nt, Human
ccuuaguguuacacuuuuucuuca

SEQ ID NO: 445939 - RNA, 22 nt, Human
cuaaaugcugccaacauucagu

SEQ ID NO: 445940 - RNA, 18 nt, Human
gaaaaacaguaaagagca

SEQ ID NO: 445941 - RNA, 24 nt, Human
ggagcuugagaaaaauauuucuuu

SEQ ID NO: 445942 - RNA, 24 nt, Human
ggagcuugagaaaaauauuucuuu

SEQ ID NO: 445943 - RNA, 24 nt, Human
ggagcuugagaaaaauauuucuuu

SEQ ID NO: 445944 - RNA, 22 nt, Human
uaaaaaaaaaagucucaaugua

SEQ ID NO: 445945 - RNA, 23 nt, Human
uaaaagaagcagcuauacuucac

SEQ ID NO: 445946 - RNA, 22 nt, Human
uaaaguauuaauuuucuguacc

SEQ ID NO: 445947 - RNA, 24 nt, Human
uaauaagcauuugccacuguacuu

SEQ ID NO: 445948 - RNA, 18 nt, Human
uacaccuguaacagcaug

SEQ ID NO: 445949 - RNA, 18 nt, Human
uacaccuguaacagcaug

SEQ ID NO: 445950 - RNA, 18 nt, Human
uacaccuguaacagcaug

SEQ ID NO: 445951 - RNA, 19 nt, Human
uacauauugcccauaauac

SEQ ID NO: 445952 - RNA, 19 nt, Human
uaccaaaaagucacaucuu

SEQ ID NO: 445953 - RNA, 19 nt, Human
uacuuuuuaaaagaaugua

SEQ ID NO: 445954 - RNA, 23 nt, Human
uagaguaacuuuucaaggccuuc

SEQ ID NO: 445955 - RNA, 24 nt, Human
uagcuuuuaaauaaagccaacccu

SEQ ID NO: 445956 - RNA, 19 nt, Human
uauauauauauauauauau

SEQ ID NO: 445957 - RNA, 19 nt, Human
uauauauauauauauauau

SEQ ID NO: 445958 - RNA, 21 nt, Human
uauauauauauauauaugcau

SEQ ID NO: 445959 - RNA, 22 nt, Human
uauauauauauauaugcauccu

SEQ ID NO: 445960 - RNA, 22 nt, Human
uaucagaacauuaaaaaaaaaa

SEQ ID NO: 445961 - RNA, 22 nt, Human
uaugcuaagaaugugcauuaca

SEQ ID NO: 445962 - RNA, 22 nt, Human
uaugcuaagaaugugcauuaca

SEQ ID NO: 445963 - RNA, 22 nt, Human
uaugcuaagaaugugcauuaca

SEQ ID NO: 445964 - RNA, 20 nt, Human
ucacacacaaacaccuacca

SEQ ID NO: 445965 - RNA, 20 nt, Human
ucacacacaaacaccuacca

SEQ ID NO: 445966 - RNA, 20 nt, Human
ucacacacaaacaccuacca

SEQ ID NO: 445967 - RNA, 28 nt, Human
ucacacacaaacaccuaccauuauacau

SEQ ID NO: 445968 - RNA, 28 nt, Human
ucacacacaaacaccuaccauuauacau

SEQ ID NO: 445969 - RNA, 28 nt, Human
ucacacacaaacaccuaccauuauacau

SEQ ID NO: 445970 - RNA, 21 nt, Human
ucagaacauuaaaaaaaaaag

SEQ ID NO: 445971 - RNA, 18 nt, Human
ugaaaaacaguaaagagc

SEQ ID NO: 445972 - RNA, 19 nt, Human
ugaaaaacaguaaagagca

SEQ ID NO: 445973 - RNA, 21 nt, Human
ugaaaagaaugaaccacaaca

SEQ ID NO: 445974 - RNA, 19 nt, Human
ugaaaaggcagguuaaaag

SEQ ID NO: 445975 - RNA, 22 nt, Human
ugaaaaggcagguuaaaagaaa

SEQ ID NO: 445976 - RNA, 24 nt, Human
ugaaaaggcagguuaaaagaagca

SEQ ID NO: 445977 - RNA, 19 nt, Human
ugaaucacacacaaacacc

SEQ ID NO: 445978 - RNA, 19 nt, Human
ugaaucacacacaaacacc

SEQ ID NO: 445979 - RNA, 19 nt, Human
ugaaucacacacaaacacc

SEQ ID NO: 445980 - RNA, 24 nt, Human
ugcaaaguuacuuuuaaccacaaa

SEQ ID NO: 445981 - RNA, 24 nt, Human
uuaaagguguucuguuaacucuga

SEQ ID NO: 445982 - RNA, 21 nt, Human
uuaacuucauccuaauguauc

SEQ ID NO: 445983 - RNA, 19 nt, Human
uucaacuaauaagauuuaa

SEQ ID NO: 445984 - RNA, 20 nt, Human
uucauccuaauguaucagaa

SEQ ID NO: 445985 - RNA, 23 nt, Human
uuccuuuauauauauauauauau

SEQ ID NO: 445986 - RNA, 21 nt, Human
uucucacaagcaauacaacac

SEQ ID NO: 445987 - RNA, 21 nt, Human
uucucacaagcaauacaacac

SEQ ID NO: 445988 - RNA, 21 nt, Human
uucucacaagcaauacaacac

SEQ ID NO: 445989 - RNA, 21 nt, Human
uugaauuuuuuuuuucuuuag

SEQ ID NO: 445990 - RNA, 24 nt, Human
uuguauuguuuuuaaacaaaaaua

SEQ ID NO: 445991 - RNA, 19 nt, Human
uuuauauauauauauauau

SEQ ID NO: 445992 - RNA, 19 nt, Human
uuuauauauauauauauau

SEQ ID NO: 445993 - RNA, 23 nt, Human
uuucuucaauuaacuaguaaaca

SEQ ID NO: 445994 - RNA, 23 nt, Human
uuucuucaauuaacuaguaaaca

SEQ ID NO: 445995 - RNA, 23 nt, Human
uuucuucaauuaacuaguaaaca

SEQ ID NO: 445996 - RNA, 18 nt, Human
uuuguugaaaaauagaag

SEQ ID NO: 445997 - RNA, 21 nt, Human
uuuucaaggccuucucaugaa

SEQ ID NO: 445998 - RNA, 23 nt, Human
uuuucaaggccuucucaugaaca

SEQ ID NO: 445999 - RNA, 18 nt, Human
uuuuuuuuuuuuuuuuug

SEQ ID NO: 446000 - RNA, 18 nt, Human
uuuuuuuuuuuuuuuuug

SEQ ID NO: 446001 - RNA, 18 nt, Human
uuuuuuuuuuuuuuuuug

SEQ ID NO: 446002 - RNA, 23 nt, Human
uuuuuuuuuuuuuuuuuggagcu

SEQ ID NO: 446003 - RNA, 25 nt, Human
uuuuuuuuuuuuuuuuuuuuugggg

SEQ ID NO: 446004 - RNA, 25 nt, Human
uuuuuuuuuuuuuuuuuuuuugggg

SEQ ID NO: 446005 - RNA, 22 nt, Human
aaaagggacucccuggggcaga

SEQ ID NO: 446006 - RNA, 20 nt, Human
aaacaggcacauguggaaca

SEQ ID NO: 446007 - RNA, 19 nt, Human
aaagacacucaaagacccc

SEQ ID NO: 446008 - RNA, 25 nt, Human
aacccggccccuccugccuggccac

SEQ ID NO: 446009 - RNA, 24 nt, Human
acacugcaguugcugauucuuggg

SEQ ID NO: 446010 - RNA, 22 nt, Human
accgacgcgggucugacagcac

SEQ ID NO: 446011 - RNA, 22 nt, Human
accggcccuccacaccagcuac

SEQ ID NO: 446012 - RNA, 22 nt, Human
accggugugcagggcagcccca

SEQ ID NO: 446013 - RNA, 22 nt, Human
agaaagacacucaaagaccccc

SEQ ID NO: 446014 - RNA, 22 nt, Human
agcaaggagaggccccagcacc

SEQ ID NO: 446015 - RNA, 18 nt, Human
aggaccgggcgccaggag

SEQ ID NO: 446016 - RNA, 19 nt, Human
aggcguggacucgggagcc

SEQ ID NO: 446017 - RNA, 19 nt, Human
agggcccacccugcgcucc

SEQ ID NO: 446018 - RNA, 26 nt, Human
auccuggggcuggagcuucgguaccc

SEQ ID NO: 446019 - RNA, 24 nt, Human
augcugccaagucaaggugcuggc

SEQ ID NO: 446020 - RNA, 21 nt, Human
caaaagggacucccuggggca

SEQ ID NO: 446021 - RNA, 20 nt, Human
caagagggcuggugcccaca

SEQ ID NO: 446022 - RNA, 19 nt, Human
caagguggaguccaccccu

SEQ ID NO: 446023 - RNA, 21 nt, Human
cacagcaaggagaggccccag

SEQ ID NO: 446024 - RNA, 22 nt, Human
caccugcagaagggaaaggcca

SEQ ID NO: 446025 - RNA, 23 nt, Human
cacucaaagacccccacgcucag

SEQ ID NO: 446026 - RNA, 22 nt, Human
cagagugggccgucccccuacc

SEQ ID NO: 446027 - RNA, 21 nt, Human
cagcuccugaacccggccccu

SEQ ID NO: 446028 - RNA, 23 nt, Human
cagucacucucuucaaaaagaaa

SEQ ID NO: 446029 - RNA, 18 nt, Human
ccaagacugagggucaca

SEQ ID NO: 446030 - RNA, 25 nt, Human
ccacauccaccuucugaagguggcc

SEQ ID NO: 446031 - RNA, 22 nt, Human
ccaccagccgccaccagcuucc

SEQ ID NO: 446032 - RNA, 23 nt, Human
ccaggcccaccugcccgcaccug

SEQ ID NO: 446033 - RNA, 18 nt, Human
ccaggguguuccaggaug

SEQ ID NO: 446034 - RNA, 24 nt, Human
cccacacaggcuggacagcaagcc

SEQ ID NO: 446035 - RNA, 28 nt, Human
cccacgcaccgaagacuccccacgcgca

SEQ ID NO: 446036 - RNA, 25 nt, Human
cccacgcgcaggcggcgcacacccg

SEQ ID NO: 446037 - RNA, 26 nt, Human
cccacuguccaagguggaguccaccu

SEQ ID NO: 446038 - RNA, 22 nt, Human
cccaggcccaccugcccgcacc

SEQ ID NO: 446039 - RNA, 19 nt, Human
ccccacgcaccgaagacuc

SEQ ID NO: 446040 - RNA, 22 nt, Human
ccccacgcaccgaagacucccc

SEQ ID NO: 446041 - RNA, 22 nt, Human
ccccagcaccggucccaggccc

SEQ ID NO: 446042 - RNA, 23 nt, Human
cccccacacaggcuggacagcaa

SEQ ID NO: 446043 - RNA, 19 nt, Human
cccuggggcagagugggcc

SEQ ID NO: 446044 - RNA, 22 nt, Human
cccuuugugcuggcugcuuucc

SEQ ID NO: 446045 - RNA, 18 nt, Human
ccgcacugcaaugaggau

SEQ ID NO: 446046 - RNA, 18 nt, Human
ccuagacccaggcaccac

SEQ ID NO: 446047 - RNA, 26 nt, Human
ccugaacccggccccuccugccuggc

SEQ ID NO: 446048 - RNA, 19 nt, Human
ccugcaucagggccgaggg

SEQ ID NO: 446049 - RNA, 22 nt, Human
ccugcgcuccuuuuucuuccag

SEQ ID NO: 446050 - RNA, 18 nt, Human
ccuuuuucuuccagggug

SEQ ID NO: 446051 - RNA, 22 nt, Human
cgagacgcuguccucacacugc

SEQ ID NO: 446052 - RNA, 21 nt, Human
cgagcacaggggcugaagggc

SEQ ID NO: 446053 - RNA, 22 nt, Human
cgucgcugacagcucggcacgu

SEQ ID NO: 446054 - RNA, 19 nt, Human
cuagacccaggcaccacgc

SEQ ID NO: 446055 - RNA, 25 nt, Human
cuccacaccagcuaccaagagggcu

SEQ ID NO: 446056 - RNA, 22 nt, Human
cuccugggcggggacagaccuu

SEQ ID NO: 446057 - RNA, 19 nt, Human
cucggggaggugaggguug

SEQ ID NO: 446058 - RNA, 22 nt, Human
cucugugcugcagcccaccucc

SEQ ID NO: 446059 - RNA, 18 nt, Human
cugccuggccacguccgc

SEQ ID NO: 446060 - RNA, 20 nt, Human
cuggagcuucccuagaccca

SEQ ID NO: 446061 - RNA, 24 nt, Human
cuggcugcuuucccgguggcuucu

SEQ ID NO: 446062 - RNA, 19 nt, Human
cuggucccaggccccagag

SEQ ID NO: 446063 - RNA, 24 nt, Human
cuucucagcaccuugagccucuga

SEQ ID NO: 446064 - RNA, 18 nt, Human
cuugggucaaauggaagg

SEQ ID NO: 446065 - RNA, 19 nt, Human
cuuugugcuggcugcuuuc

SEQ ID NO: 446066 - RNA, 24 nt, Human
gaaagaacuagagcaaaaccaaag

SEQ ID NO: 446067 - RNA, 21 nt, Human
gaaagacacucaaagaccccc

SEQ ID NO: 446068 - RNA, 18 nt, Human
gaacccggccccuccugc

SEQ ID NO: 446069 - RNA, 27 nt, Human
gaaggaggaggaacgacgagggcagag

SEQ ID NO: 446070 - RNA, 29 nt, Human
gaaggaggaggaacgacgagggcagagug

SEQ ID NO: 446071 - RNA, 21 nt, Human
gaaggcacccuccugggcggg

SEQ ID NO: 446072 - RNA, 20 nt, Human
gacagaccuuggcuccaugc

SEQ ID NO: 446073 - RNA, 24 nt, Human
gacccaggcaccacgcacaggcau

SEQ ID NO: 446074 - RNA, 21 nt, Human
gaccucagguccaacuacagc

SEQ ID NO: 446075 - RNA, 21 nt, Human
gagaggccccagcaccggucc

SEQ ID NO: 446076 - RNA, 18 nt, Human
gaggacagcucaggugug

SEQ ID NO: 446077 - RNA, 24 nt, Human
gaggguuacgaccgacgcgggucu

SEQ ID NO: 446078 - RNA, 20 nt, Human
gcaccgaagacuccccacgc

SEQ ID NO: 446079 - RNA, 22 nt, Human
gcagcccaccucccagcaagcc

SEQ ID NO: 446080 - RNA, 21 nt, Human
gcccccacacaggcuggacag

SEQ ID NO: 446081 - RNA, 21 nt, Human
gccucugaugccccgccucug

SEQ ID NO: 446082 - RNA, 18 nt, Human
gcgccaggagggcucgcu

SEQ ID NO: 446083 - RNA, 22 nt, Human
gcucgcugaaaucucgguccca

SEQ ID NO: 446084 - RNA, 18 nt, Human
gcugacagcucggcacgu

SEQ ID NO: 446085 - RNA, 25 nt, Human
gcuggcugcuuucccgguggcuucu

SEQ ID NO: 446086 - RNA, 23 nt, Human
gcuggcuuccugggcccuuugug

SEQ ID NO: 446087 - RNA, 22 nt, Human
ggaaguggggugaccagggagc

SEQ ID NO: 446088 - RNA, 20 nt, Human
ggacucgggagccgagggug

SEQ ID NO: 446089 - RNA, 22 nt, Human
ggagacgagucacacguggcag

SEQ ID NO: 446090 - RNA, 18 nt, Human
ggagggaggggcgggcag

SEQ ID NO: 446091 - RNA, 21 nt, Human
ggagggaggggcgggcagggc

SEQ ID NO: 446092 - RNA, 18 nt, Human
ggcagggaggagagcacc

SEQ ID NO: 446093 - RNA, 19 nt, Human
ggccagagugaugagcaug

SEQ ID NO: 446094 - RNA, 22 nt, Human
ggccagggccgagguagggccg

SEQ ID NO: 446095 - RNA, 19 nt, Human
ggcugaagggcccaggcug

SEQ ID NO: 446096 - RNA, 19 nt, Human
gggacgggggcgcaguggg

SEQ ID NO: 446097 - RNA, 20 nt, Human
gggcaccggugugcagggca

SEQ ID NO: 446098 - RNA, 23 nt, Human
gggcucgcugaaaucucgguccc

SEQ ID NO: 446099 - RNA, 20 nt, Human
gggcugaagggcccaggcug

SEQ ID NO: 446100 - RNA, 20 nt, Human
gggcuggcuuccugggcccu

SEQ ID NO: 446101 - RNA, 19 nt, Human
gggucaaauggaaggagga

SEQ ID NO: 446102 - RNA, 20 nt, Human
ggucucggccaccacaucca

SEQ ID NO: 446103 - RNA, 19 nt, Human
ggugcuggcguggaaacag

SEQ ID NO: 446104 - RNA, 22 nt, Human
ggugugcagggcagccccaucc

SEQ ID NO: 446105 - RNA, 20 nt, Human
gugcagggcagccccauccu

SEQ ID NO: 446106 - RNA, 20 nt, Human
guggguguggcuauugugga

SEQ ID NO: 446107 - RNA, 21 nt, Human
ucaggccagggccgagguagg

SEQ ID NO: 446108 - RNA, 21 nt, Human
ucaggccagggccgagguagg

SEQ ID NO: 446109 - RNA, 25 nt, Human
ucauuuccagcauuuccaucuuuaa

SEQ ID NO: 446110 - RNA, 19 nt, Human
uccacaccagcuaccaaga

SEQ ID NO: 446111 - RNA, 19 nt, Human
uccaggagugcugcagacg

SEQ ID NO: 446112 - RNA, 19 nt, Human
ucccaggcccaccugcccg

SEQ ID NO: 446113 - RNA, 19 nt, Human
ucccaggccccagagauac

SEQ ID NO: 446114 - RNA, 18 nt, Human
uccuggggcuggagcuuc

SEQ ID NO: 446115 - RNA, 24 nt, Human
ucggcacguggcuggucccaggcc

SEQ ID NO: 446116 - RNA, 24 nt, Human
ucugugcugcagcccaccucccag

SEQ ID NO: 446117 - RNA, 18 nt, Human
ugaagggcccaggcugcu

SEQ ID NO: 446118 - RNA, 18 nt, Human
ugagcaugguggcaggga

SEQ ID NO: 446119 - RNA, 22 nt, Human
ugagccucugaugccccgccuc

SEQ ID NO: 446120 - RNA, 19 nt, Human
ugaggguuggcauguggcg

SEQ ID NO: 446121 - RNA, 21 nt, Human
ugaggguuggcauguggcggg

SEQ ID NO: 446122 - RNA, 24 nt, Human
ugauucuugggucaaauggaagga

SEQ ID NO: 446123 - RNA, 20 nt, Human
ugcagcccaccucccagcaa

SEQ ID NO: 446124 - RNA, 19 nt, Human
ugcccaggggaguguggga

SEQ ID NO: 446125 - RNA, 27 nt, Human
ugcuggagggaggggcgggcagggccg

SEQ ID NO: 446126 - RNA, 19 nt, Human
uggaaacaggcacaugugg

SEQ ID NO: 446127 - RNA, 19 nt, Human
uggaacaccacaucccacu

SEQ ID NO: 446128 - RNA, 21 nt, Human
uggaacaccacaucccacugu

SEQ ID NO: 446129 - RNA, 19 nt, Human
uggaaggaggaggaacgac

SEQ ID NO: 446130 - RNA, 20 nt, Human
uggaaggaggaggaacgacg

SEQ ID NO: 446131 - RNA, 20 nt, Human
uggaaugcugucagguccgc

SEQ ID NO: 446132 - RNA, 18 nt, Human
uggcagcacaucauccag

SEQ ID NO: 446133 - RNA, 24 nt, Human
uggcccagacaccuccacgcugcu

SEQ ID NO: 446134 - RNA, 24 nt, Human
ugggacgagcacaggggcugaagg

SEQ ID NO: 446135 - RNA, 21 nt, Human
uggucggauggcagcgugagc

SEQ ID NO: 446136 - RNA, 21 nt, Human
uggugcccacagggaggaccg

SEQ ID NO: 446137 - RNA, 19 nt, Human
uuauuggaaugcugucagg

SEQ ID NO: 446138 - RNA, 21 nt, Human
aaaagcacucacugaaaaaca

SEQ ID NO: 446139 - RNA, 23 nt, Human
aaacagaaaucacaggaaagcuc

SEQ ID NO: 446140 - RNA, 22 nt, Human
aaagcaaggauauacacagaga

SEQ ID NO: 446141 - RNA, 18 nt, Human
aauuucugaaaagcaaga

SEQ ID NO: 446142 - RNA, 21 nt, Human
acaaaauauucauucaaaacc

SEQ ID NO: 446143 - RNA, 24 nt, Human
acaggaaagcuccuacaucagaac

SEQ ID NO: 446144 - RNA, 20 nt, Human
accucuccuccucccccaca

SEQ ID NO: 446145 - RNA, 21 nt, Human
aggaaggaacgugaaacagaa

SEQ ID NO: 446146 - RNA, 21 nt, Human
aggagggugugacaggaagga

SEQ ID NO: 446147 - RNA, 20 nt, Human
agggcagaagcuuaaguuug

SEQ ID NO: 446148 - RNA, 24 nt, Human
agucacuuuuggucuuuugaagga

SEQ ID NO: 446149 - RNA, 23 nt, Human
auaaagcaaggauauacacagag

SEQ ID NO: 446150 - RNA, 24 nt, Human
auaaagcaaggauauacacagaga

SEQ ID NO: 446151 - RNA, 28 nt, Human
auaaagcaaggauauacacagagacgcc

SEQ ID NO: 446152 - RNA, 24 nt, Human
caaaagaaauauuaaaaaucagaa

SEQ ID NO: 446153 - RNA, 20 nt, Human
caaguguuuauucuauuuag

SEQ ID NO: 446154 - RNA, 24 nt, Human
cacaugaagccuccugguucagga

SEQ ID NO: 446155 - RNA, 24 nt, Human
cagaauuucucaaaagaaauauua

SEQ ID NO: 446156 - RNA, 18 nt, Human
cagcauccgcugauucug

SEQ ID NO: 446157 - RNA, 22 nt, Human
ccaugugucacauggagaccuc

SEQ ID NO: 446158 - RNA, 25 nt, Human
cccauacacgcaacuauuuucugua

SEQ ID NO: 446159 - RNA, 24 nt, Human
cccccacaugaagccuccugguuc

SEQ ID NO: 446160 - RNA, 20 nt, Human
ccuccugguucaggagcagg

SEQ ID NO: 446161 - RNA, 19 nt, Human
ccugguucaggagcaggag

SEQ ID NO: 446162 - RNA, 23 nt, Human
cucuccuccucccccacaugaag

SEQ ID NO: 446163 - RNA, 19 nt, Human
cugucuaaaacacagcuaa

SEQ ID NO: 446164 - RNA, 25 nt, Human
gaagcaaucugucacacgagacacc

SEQ ID NO: 446165 - RNA, 24 nt, Human
gaugacuucaaauauuauuuggca

SEQ ID NO: 446166 - RNA, 21 nt, Human
ggaaauacacaucaugacuuc

SEQ ID NO: 446167 - RNA, 24 nt, Human
ggaauuucuccaggaaauacacau

SEQ ID NO: 446168 - RNA, 20 nt, Human
uaacaaaacuacccaauuac

SEQ ID NO: 446169 - RNA, 26 nt, Human
uaagaaagauucacaaaauauucauu

SEQ ID NO: 446170 - RNA, 24 nt, Human
uaauuuacaaagagacagaugacu

SEQ ID NO: 446171 - RNA, 19 nt, Human
uagcaaaacaaucugcaaa

SEQ ID NO: 446172 - RNA, 19 nt, Human
uauuaugagaacucuuagg

SEQ ID NO: 446173 - RNA, 21 nt, Human
ucaaauauauuuuacugugcu

SEQ ID NO: 446174 - RNA, 20 nt, Human
ucccuuggcagggcagaagc

SEQ ID NO: 446175 - RNA, 24 nt, Human
ugaaaaaguagcaaaacaaucugc

SEQ ID NO: 446176 - RNA, 18 nt, Human
ugagaugauuuauuauga

SEQ ID NO: 446177 - RNA, 21 nt, Human
ugguucaggagcaggaggagc

SEQ ID NO: 446178 - RNA, 20 nt, Human
ugucuaaaacacagcuaaau

SEQ ID NO: 446179 - RNA, 20 nt, Human
uuauuuggcagucaccuuac

SEQ ID NO: 446180 - RNA, 19 nt, Human
uucucccauacacgcaacu

SEQ ID NO: 446181 - RNA, 23 nt, Human
uucuguagcuguaucuucuuacc

SEQ ID NO: 446182 - RNA, 26 nt, Human
uuuuuuuuuuuuucugcugcaagugu

SEQ ID NO: 446183 - RNA, 18 nt, Human
uuuuuuuuuuuuuuucug

SEQ ID NO: 446184 - RNA, 20 nt, Human
uuuuuuuuuuuuuuucugcu

SEQ ID NO: 446185 - RNA, 24 nt, Human
aacuccuuguuucuaugaaacuuc

SEQ ID NO: 446186 - RNA, 19 nt, Human
acacucaaacaacagaaaa

SEQ ID NO: 446187 - RNA, 23 nt, Human
acucaaacaacagaaaacccagc

SEQ ID NO: 446188 - RNA, 23 nt, Human
agcugcagcacuggccugggcag

SEQ ID NO: 446189 - RNA, 18 nt, Human
agucagaaauggcaugcu

SEQ ID NO: 446190 - RNA, 21 nt, Human
caaacaacagaaaacccagca

SEQ ID NO: 446191 - RNA, 25 nt, Human
caacagaaaacccagcauauuuuag

SEQ ID NO: 446192 - RNA, 19 nt, Human
cagagcugcagcacuggcc

SEQ ID NO: 446193 - RNA, 19 nt, Human
cagcacuggccugggcagc

SEQ ID NO: 446194 - RNA, 25 nt, Human
cagcguagaggccauccguuuccag

SEQ ID NO: 446195 - RNA, 21 nt, Human
cauucugcagagcugcagcac

SEQ ID NO: 446196 - RNA, 21 nt, Human
cucaaacaacagaaaacccag

SEQ ID NO: 446197 - RNA, 22 nt, Human
cucaaacaacagaaaacccagc

SEQ ID NO: 446198 - RNA, 21 nt, Human
cugcagcacuggccugggcag

SEQ ID NO: 446199 - RNA, 24 nt, Human
gaaugauagaaaugaagcagacuu

SEQ ID NO: 446200 - RNA, 21 nt, Human
gacucguaacugacaaaaaca

SEQ ID NO: 446201 - RNA, 21 nt, Human
gcagcacuggccugggcagcc

SEQ ID NO: 446202 - RNA, 18 nt, Human
uaacacacucaaacaaca

SEQ ID NO: 446203 - RNA, 19 nt, Human
uaacacacucaaacaacag

SEQ ID NO: 446204 - RNA, 21 nt, Human
uaacacacucaaacaacagaa

SEQ ID NO: 446205 - RNA, 23 nt, Human
uaacacacucaaacaacagaaaa

SEQ ID NO: 446206 - RNA, 20 nt, Human
uaccauaagccuuaguugga

SEQ ID NO: 446207 - RNA, 23 nt, Human
uaccauaagccuuaguuggagac

SEQ ID NO: 446208 - RNA, 20 nt, Human
ucaaacaacagaaaaccccu

SEQ ID NO: 446209 - RNA, 20 nt, Human
ucaaggagagugacuucuuu

SEQ ID NO: 446210 - RNA, 24 nt, Human
ucuaacacacucaaacaacagaaa

SEQ ID NO: 446211 - RNA, 21 nt, Human
ugaaauaccauaagccuuagu

SEQ ID NO: 446212 - RNA, 25 nt, Human
ugacaguuuaaucagaaaaauggaa

SEQ ID NO: 446213 - RNA, 22 nt, Human
ugagauccaagaugccaacucc

SEQ ID NO: 446214 - RNA, 18 nt, Human
ugcagcacuggccugggc

SEQ ID NO: 446215 - RNA, 21 nt, Human
uggcaguuagccguuacaaga

SEQ ID NO: 446216 - RNA, 18 nt, Human
aaaguaaauagaagaacc

SEQ ID NO: 446217 - RNA, 21 nt, Human
aacauggccugggucuuccuc

SEQ ID NO: 446218 - RNA, 22 nt, Human
aagcaaagcaaacccacccccc

SEQ ID NO: 446219 - RNA, 23 nt, Human
aagcaaagcaaacccacccccca

SEQ ID NO: 446220 - RNA, 19 nt, Human
aagccagccugagcacugg

SEQ ID NO: 446221 - RNA, 22 nt, Human
accccaaagcaaagcaaaccca

SEQ ID NO: 446222 - RNA, 22 nt, Human
agaaaacaaaguaaauagaaga

SEQ ID NO: 446223 - RNA, 21 nt, Human
agcaaagcaaacccacccccc

SEQ ID NO: 446224 - RNA, 21 nt, Human
agcacuggagccccaauuccc

SEQ ID NO: 446225 - RNA, 19 nt, Human
aggcaagaucagccccaga

SEQ ID NO: 446226 - RNA, 18 nt, Human
aggccgcuccugcccaca

SEQ ID NO: 446227 - RNA, 20 nt, Human
aggccucagcccugucccga

SEQ ID NO: 446228 - RNA, 18 nt, Human
auaaaaacagccacuccc

SEQ ID NO: 446229 - RNA, 22 nt, Human
aucagccccagaccacuuccgg

SEQ ID NO: 446230 - RNA, 24 nt, Human
auuuugcacucacccugggugaca

SEQ ID NO: 446231 - RNA, 23 nt, Human
caaacccaccccccagaucagca

SEQ ID NO: 446232 - RNA, 21 nt, Human
caaagcaaacccaccccccaa

SEQ ID NO: 446233 - RNA, 18 nt, Human
caaagcaaagcaaaccca

SEQ ID NO: 446234 - RNA, 21 nt, Human
caaagcaaagcaaacccaccc

SEQ ID NO: 446235 - RNA, 19 nt, Human
caaaguaaauagaagaacc

SEQ ID NO: 446236 - RNA, 21 nt, Human
caaaguaaauagaagaacccc

SEQ ID NO: 446237 - RNA, 19 nt, Human
cacuccccaacuugcgggg

SEQ ID NO: 446238 - RNA, 23 nt, Human
cagagaaccccuccgggagguuc

SEQ ID NO: 446239 - RNA, 24 nt, Human
cagggcagaagccagauggcagcc

SEQ ID NO: 446240 - RNA, 19 nt, Human
cagggccugggccagccgg

SEQ ID NO: 446241 - RNA, 22 nt, Human
caugcagcccaagccagccuga

SEQ ID NO: 446242 - RNA, 24 nt, Human
ccaauucccaaccaggucucccuc

SEQ ID NO: 446243 - RNA, 24 nt, Human
ccacagggcuguccucaugcagcc

SEQ ID NO: 446244 - RNA, 22 nt, Human
ccacucccagcaggcccccuca

SEQ ID NO: 446245 - RNA, 22 nt, Human
ccagaccacuuccggggucacu

SEQ ID NO: 446246 - RNA, 22 nt, Human
ccaggcccaggcgugggguaua

SEQ ID NO: 446247 - RNA, 21 nt, Human
ccaggcgugggguauaggucu

SEQ ID NO: 446248 - RNA, 23 nt, Human
ccagugggguccgugcagggagg

SEQ ID NO: 446249 - RNA, 25 nt, Human
cccacaaacacuccccaacuugcgg

SEQ ID NO: 446250 - RNA, 19 nt, Human
ccccaaagcaaagcaaacc

SEQ ID NO: 446251 - RNA, 19 nt, Human
cccccacaaacacucccca

SEQ ID NO: 446252 - RNA, 19 nt, Human
ccccccagaaagggccucg

SEQ ID NO: 446253 - RNA, 21 nt, Human
ccccucagcuuuuugcaucag

SEQ ID NO: 446254 - RNA, 18 nt, Human
ccuccuccucgauggggc

SEQ ID NO: 446255 - RNA, 24 nt, Human
ccuccuccucgauggggcggagac

SEQ ID NO: 446256 - RNA, 23 nt, Human
ccucgaaaggccgccgcugcgcc

SEQ ID NO: 446257 - RNA, 25 nt, Human
ccucgaaaggccgccgcugcgcccu

SEQ ID NO: 446258 - RNA, 23 nt, Human
ccuuugggaacauggccuggguc

SEQ ID NO: 446259 - RNA, 20 nt, Human
cucccucagaccccccagaa

SEQ ID NO: 446260 - RNA, 21 nt, Human
cuccuggcugggggagggcuc

SEQ ID NO: 446261 - RNA, 23 nt, Human
cugccagacuccccuccaaagcc

SEQ ID NO: 446262 - RNA, 24 nt, Human
cugccagacuccccuccaaagccu

SEQ ID NO: 446263 - RNA, 23 nt, Human
cuggagccccaauucccaaccag

SEQ ID NO: 446264 - RNA, 23 nt, Human
gaacauggccugggucuuccuca

SEQ ID NO: 446265 - RNA, 21 nt, Human
gcaaacccaccccccagauca

SEQ ID NO: 446266 - RNA, 18 nt, Human
gcaaagcaaacccacccc

SEQ ID NO: 446267 - RNA, 20 nt, Human
gcagccauggcugacgggcc

SEQ ID NO: 446268 - RNA, 18 nt, Human
gcaggcccaguggggucc

SEQ ID NO: 446269 - RNA, 19 nt, Human
gcaggccucagcccugucc

SEQ ID NO: 446270 - RNA, 19 nt, Human
gccaggcccaggcgugggg

SEQ ID NO: 446271 - RNA, 18 nt, Human
gcccagugggguccgugc

SEQ ID NO: 446272 - RNA, 19 nt, Human
gcugcagggccugggccag

SEQ ID NO: 446273 - RNA, 19 nt, Human
gcugccagacuccccucca

SEQ ID NO: 446274 - RNA, 20 nt, Human
ggaagaacacagcacucggc

SEQ ID NO: 446275 - RNA, 23 nt, Human
ggaagaacacagcacucggcagg

SEQ ID NO: 446276 - RNA, 22 nt, Human
ggacacagggccccacagagaa

SEQ ID NO: 446277 - RNA, 18 nt, Human
ggcagaagccagauggca

SEQ ID NO: 446278 - RNA, 22 nt, Human
ggcauaaaaacagccacuccca

SEQ ID NO: 446279 - RNA, 21 nt, Human
ggccucgaaaggccgccgcug

SEQ ID NO: 446280 - RNA, 21 nt, Human
ggccugggccagccgggcugc

SEQ ID NO: 446281 - RNA, 18 nt, Human
ggucucccucagaccccc

SEQ ID NO: 446282 - RNA, 23 nt, Human
uauaggucuucccccgcaggccu

SEQ ID NO: 446283 - RNA, 23 nt, Human
uccccaacuugcggggcuggggc

SEQ ID NO: 446284 - RNA, 18 nt, Human
uccgugcagggaggaccc

SEQ ID NO: 446285 - RNA, 20 nt, Human
uccuggcugggggagggcuc

SEQ ID NO: 446286 - RNA, 23 nt, Human
ucuucgagaaaacaaaguaaaua

SEQ ID NO: 446287 - RNA, 21 nt, Human
ugaggugaagccaggcccagg

SEQ ID NO: 446288 - RNA, 19 nt, Human
ugcacucacccugggugac

SEQ ID NO: 446289 - RNA, 18 nt, Human
uggacccccacaaacacu

SEQ ID NO: 446290 - RNA, 21 nt, Human
uggacccccacaaacacuccc

SEQ ID NO: 446291 - RNA, 23 nt, Human
ugggaacauggccugggucuucc

SEQ ID NO: 446292 - RNA, 26 nt, Human
ugggguccgugcagggaggaccccag

SEQ ID NO: 446293 - RNA, 20 nt, Human
ugucccgaggcugcaucaca

SEQ ID NO: 446294 - RNA, 18 nt, Human
uuugcacucacccugggu

SEQ ID NO: 446295 - RNA, 23 nt, Human
uuuuuuuuuuuuuuuuucacacu

SEQ ID NO: 446296 - RNA, 22 nt, Human
aaaaaaugucuaaacagaauua

SEQ ID NO: 446297 - RNA, 18 nt, Human
aaaccaaacaaaaaucug

SEQ ID NO: 446298 - RNA, 18 nt, Human
aauuccaggagcuucccu

SEQ ID NO: 446299 - RNA, 18 nt, Human
agauaaagcucacuuagc

SEQ ID NO: 446300 - RNA, 24 nt, Human
agcacagagauauaucaagagaaa

SEQ ID NO: 446301 - RNA, 21 nt, Human
auccucuuuugaaauauuuca

SEQ ID NO: 446302 - RNA, 25 nt, Human
caauagcccuuuuuccccacauauu

SEQ ID NO: 446303 - RNA, 20 nt, Human
cacccugaacucggaaugag

SEQ ID NO: 446304 - RNA, 22 nt, Human
cacuuccauaaagaauuagggg

SEQ ID NO: 446305 - RNA, 24 nt, Human
cagaugucccaaaaugugucaccc

SEQ ID NO: 446306 - RNA, 19 nt, Human
cagcuccuugauuuccccc

SEQ ID NO: 446307 - RNA, 21 nt, Human
caggucucaaaagcacagaga

SEQ ID NO: 446308 - RNA, 18 nt, Human
ccaaaaugugucacccug

SEQ ID NO: 446309 - RNA, 18 nt, Human
ccaggcuggagugcagug

SEQ ID NO: 446310 - RNA, 21 nt, Human
ccaggcuggagugcaguggug

SEQ ID NO: 446311 - RNA, 21 nt, Human
ccaggcuggagugcaguggug

SEQ ID NO: 446312 - RNA, 24 nt, Human
cccaaaaugugucacccugaacuc

SEQ ID NO: 446313 - RNA, 20 nt, Human
cccacauauucuggaagguu

SEQ ID NO: 446314 - RNA, 21 nt, Human
cccuuguuugcuguuuucguc

SEQ ID NO: 446315 - RNA, 21 nt, Human
cggaaugagagaaaaucucau

SEQ ID NO: 446316 - RNA, 22 nt, Human
cucggaaugagagaaaaucuca

SEQ ID NO: 446317 - RNA, 22 nt, Human
cuuccaucacuccccuuucaga

SEQ ID NO: 446318 - RNA, 21 nt, Human
uaguugugccccugcugaugu

SEQ ID NO: 446319 - RNA, 22 nt, Human
uauuagauaaagcucacuuagc

SEQ ID NO: 446320 - RNA, 20 nt, Human
uauuagauacucauuccugg

SEQ ID NO: 446321 - RNA, 22 nt, Human
ucaucccauaaagaauagaagc

SEQ ID NO: 446322 - RNA, 26 nt, Human
uccccacauauucuggaagguucuac

SEQ ID NO: 446323 - RNA, 19 nt, Human
ucccccuagggauaaagau

SEQ ID NO: 446324 - RNA, 26 nt, Human
ucccuguaauuccucaaaaaagcacu

SEQ ID NO: 446325 - RNA, 22 nt, Human
ucuguauuucugggacaaaaaa

SEQ ID NO: 446326 - RNA, 22 nt, Human
ugaaaucuuagaguagaaccac

SEQ ID NO: 446327 - RNA, 21 nt, Human
ugucauucuccuucccucuca

SEQ ID NO: 446328 - RNA, 24 nt, Human
uucagcacugggcuaccagcagau

SEQ ID NO: 446329 - RNA, 18 nt, Human
uuccaaauggcuuaccac

SEQ ID NO: 446330 - RNA, 23 nt, Human
uuccaaauggcuuaccacagagg

SEQ ID NO: 446331 - RNA, 30 nt, Human
uuccaucacuccccuuucagaggcaccaca

SEQ ID NO: 446332 - RNA, 18 nt, Human
aagcagguaaacccgaga

SEQ ID NO: 446333 - RNA, 18 nt, Human
aaggcagcuugcaggccu

SEQ ID NO: 446334 - RNA, 20 nt, Human
acaaaaaccuuuggugcugc

SEQ ID NO: 446335 - RNA, 20 nt, Human
agcggcggcuacucugcugg

SEQ ID NO: 446336 - RNA, 22 nt, Human
aggcagcugaguucaacaguug

SEQ ID NO: 446337 - RNA, 22 nt, Human
aggcagcugaguucaacaguug

SEQ ID NO: 446338 - RNA, 23 nt, Human
aguccagugcccgucccagcaca

SEQ ID NO: 446339 - RNA, 20 nt, Human
aucccacauuuugacguguc

SEQ ID NO: 446340 - RNA, 20 nt, Human
aucccacauuuugacguguc

SEQ ID NO: 446341 - RNA, 26 nt, Human
augccacaggcacgcacaggaccagc

SEQ ID NO: 446342 - RNA, 28 nt, Human
caaagcuuagagcaggaaguaggaaucc

SEQ ID NO: 446343 - RNA, 23 nt, Human
caaauauuugaccauuuuuaaau

SEQ ID NO: 446344 - RNA, 19 nt, Human
cagaaugaguugcuugggc

SEQ ID NO: 446345 - RNA, 19 nt, Human
cagaggaaguaggagucag

SEQ ID NO: 446346 - RNA, 19 nt, Human
cagaggaaguaggagucag

SEQ ID NO: 446347 - RNA, 21 nt, Human
cagagugcaacacccuccguu

SEQ ID NO: 446348 - RNA, 24 nt, Human
cagcacacaccugcuuuuucagac

SEQ ID NO: 446349 - RNA, 23 nt, Human
cagcacaggaaaaucgcuaucuu

SEQ ID NO: 446350 - RNA, 27 nt, Human
caggaagccccuucuccgccucggccu

SEQ ID NO: 446351 - RNA, 23 nt, Human
caggcgcccucuacagaaggagg

SEQ ID NO: 446352 - RNA, 24 nt, Human
cauuguauucuaacaugcccauug

SEQ ID NO: 446353 - RNA, 18 nt, Human
ccacauucuccaaucagc

SEQ ID NO: 446354 - RNA, 24 nt, Human
cccugaagagauguauaaaagagg

SEQ ID NO: 446355 - RNA, 20 nt, Human
ccugggagcccacaaucugu

SEQ ID NO: 446356 - RNA, 24 nt, Human
cggcggcuacucugcuggugguuu

SEQ ID NO: 446357 - RNA, 18 nt, Human
cguucagugucuccugau

SEQ ID NO: 446358 - RNA, 25 nt, Human
cucacagcagcggcggcuacucucc

SEQ ID NO: 446359 - RNA, 23 nt, Human
cuccgccucggccucagcgugca

SEQ ID NO: 446360 - RNA, 19 nt, Human
cuucccaagacaaaaaccu

SEQ ID NO: 446361 - RNA, 18 nt, Human
gaaguaggagucaguggc

SEQ ID NO: 446362 - RNA, 18 nt, Human
gaaguaggagucaguggc

SEQ ID NO: 446363 - RNA, 18 nt, Human
gacgcguugacgcaggug

SEQ ID NO: 446364 - RNA, 21 nt, Human
gcaagagaggaauauguagca

SEQ ID NO: 446365 - RNA, 24 nt, Human
gcccucuacagaaggagggagccg

SEQ ID NO: 446366 - RNA, 19 nt, Human
gcggcuacucuccuggugg

SEQ ID NO: 446367 - RNA, 30 nt, Human
gcggcuacucugcuggugguuuggugggaa

SEQ ID NO: 446368 - RNA, 19 nt, Human
ggcgcccucuacagaagga

SEQ ID NO: 446369 - RNA, 18 nt, Human
gggagcugcugagauaau

SEQ ID NO: 446370 - RNA, 21 nt, Human
gugaucuuuuaucuuguaggu

SEQ ID NO: 446371 - RNA, 22 nt, Human
uaaaaccuuuugcugcaagaga

SEQ ID NO: 446372 - RNA, 25 nt, Human
uaagauuaaguccaauccaaguguc

SEQ ID NO: 446373 - RNA, 25 nt, Human
uaagauuaaguccaauccaaguguc

SEQ ID NO: 446374 - RNA, 20 nt, Human
uaucaugauuuuuuuccuuu

SEQ ID NO: 446375 - RNA, 19 nt, Human
uaucaugauuuuuuucuuu

SEQ ID NO: 446376 - RNA, 21 nt, Human
ucaggaagccccuucuccgcc

SEQ ID NO: 446377 - RNA, 18 nt, Human
ucaguuuuccuacaggca

SEQ ID NO: 446378 - RNA, 18 nt, Human
uccagugcccgucccagc

SEQ ID NO: 446379 - RNA, 20 nt, Human
uccccaggcucacagcagcg

SEQ ID NO: 446380 - RNA, 22 nt, Human
ugacgugucaaaccuuagagca

SEQ ID NO: 446381 - RNA, 22 nt, Human
ugacgugucaaagcuuagagca

SEQ ID NO: 446382 - RNA, 23 nt, Human
ugauugccaucauuguaagaucu

SEQ ID NO: 446383 - RNA, 21 nt, Human
ugcaagagaggaauauguagc

SEQ ID NO: 446384 - RNA, 19 nt, Human
ugccacaggcacgcacagg

SEQ ID NO: 446385 - RNA, 26 nt, Human
ugccacaggcacgcacaggaccagcg

SEQ ID NO: 446386 - RNA, 21 nt, Human
uggcagguggagauguugacg

SEQ ID NO: 446387 - RNA, 18 nt, Human
uggugcugccugauagca

SEQ ID NO: 446388 - RNA, 20 nt, Human
uggugggagguggagauggu

SEQ ID NO: 446389 - RNA, 23 nt, Human
uguacugggacgcucaggaagcc

SEQ ID NO: 446390 - RNA, 23 nt, Human
uguauucuaacaugcccauuggu

SEQ ID NO: 446391 - RNA, 24 nt, Human
uuagagcaggaaguaggaauccac

SEQ ID NO: 446392 - RNA, 24 nt, Human
uuagagcaggaaguaggaauccac

SEQ ID NO: 446393 - RNA, 24 nt, Human
uucacggagggggaccagccugcc

SEQ ID NO: 446394 - RNA, 19 nt, Human
uuccucuauucucagcucc

SEQ ID NO: 446395 - RNA, 19 nt, Human
uuccucuauucucagcucc

SEQ ID NO: 446396 - RNA, 22 nt, Human
uugcuugggcagguauuccucu

SEQ ID NO: 446397 - RNA, 18 nt, Human
agacacccucacccaggg

SEQ ID NO: 446398 - RNA, 20 nt, Human
aggauucugaaauuggaaac

SEQ ID NO: 446399 - RNA, 21 nt, Human
aggauucugaaauuggaaaca

SEQ ID NO: 446400 - RNA, 20 nt, Human
aggcagcuccucuuccccaa

SEQ ID NO: 446401 - RNA, 23 nt, Human
aggcagcuccucuuccccaacag

SEQ ID NO: 446402 - RNA, 19 nt, Human
aguuaggauucugaaauug

SEQ ID NO: 446403 - RNA, 23 nt, Human
caggcacagaccgcaguggagcc

SEQ ID NO: 446404 - RNA, 23 nt, Human
ccccgggguggaaucggcucucu

SEQ ID NO: 446405 - RNA, 19 nt, Human
ccuacgggccccggggugg

SEQ ID NO: 446406 - RNA, 22 nt, Human
ccuggccuuugucuccuccuca

SEQ ID NO: 446407 - RNA, 24 nt, Human
ccuggccuuugucuccuccucagg

SEQ ID NO: 446408 - RNA, 19 nt, Human
cucacagagacacccucac

SEQ ID NO: 446409 - RNA, 20 nt, Human
cugcggagcguccuggccuu

SEQ ID NO: 446410 - RNA, 24 nt, Human
guccuggccuuugucuccuccuca

SEQ ID NO: 446411 - RNA, 21 nt, Human
ucuagggggaaaguggcagaa

SEQ ID NO: 446412 - RNA, 24 nt, Human
aaaaaaaaaaaaacccaaaaaugc

SEQ ID NO: 446413 - RNA, 26 nt, Human
aaaaaaaaaaacccaaaaaugcaagc

SEQ ID NO: 446414 - RNA, 25 nt, Human
aaaaaaacccaaaaaugcaagcacc

SEQ ID NO: 446415 - RNA, 23 nt, Human
aaaacucuuccauguauucacuu

SEQ ID NO: 446416 - RNA, 22 nt, Human
aaagaugaguauccucucaaac

SEQ ID NO: 446417 - RNA, 28 nt, Human
aaagaugaguauccucucaaacgccucc

SEQ ID NO: 446418 - RNA, 21 nt, Human
aaaugcuaaggucacagugcc

SEQ ID NO: 446419 - RNA, 21 nt, Human
aacaaaaaaaaaaaaaaccca

SEQ ID NO: 446420 - RNA, 22 nt, Human
aacaacagagaccaaggggagc

SEQ ID NO: 446421 - RNA, 19 nt, Human
aacaagcgccaacaauaaa

SEQ ID NO: 446422 - RNA, 19 nt, Human
aacgaagcacuaucauggg

SEQ ID NO: 446423 - RNA, 23 nt, Human
aagcuuggguaaguggcaucuuc

SEQ ID NO: 446424 - RNA, 18 nt, Human
aaugaugagcuagaaaga

SEQ ID NO: 446425 - RNA, 22 nt, Human
aauuuccuuuuuaaugaugagc

SEQ ID NO: 446426 - RNA, 22 nt, Human
acaaaaaaaaaaaaaacccaaa

SEQ ID NO: 446427 - RNA, 24 nt, Human
acaaaaaaaaaaaaaacccaaaaa

SEQ ID NO: 446428 - RNA, 21 nt, Human
acaagcgccaacaauaaacag

SEQ ID NO: 446429 - RNA, 27 nt, Human
acacaacuucuaaacagcgcacaaaaa

SEQ ID NO: 446430 - RNA, 27 nt, Human
accauccuacucagcuaucuucaggaa

SEQ ID NO: 446431 - RNA, 21 nt, Human
aguauccucucaaacgccucc

SEQ ID NO: 446432 - RNA, 22 nt, Human
agugcuggucuacaaaucuugc

SEQ ID NO: 446433 - RNA, 26 nt, Human
caaaaaaaaaaaaaacccaaaaaugc

SEQ ID NO: 446434 - RNA, 22 nt, Human
caaaaagaugaguauccucuca

SEQ ID NO: 446435 - RNA, 20 nt, Human
caagauuucaaagccucaua

SEQ ID NO: 446436 - RNA, 21 nt, Human
caaguuuuaagccugacuccu

SEQ ID NO: 446437 - RNA, 23 nt, Human
cacacaacuucuaaacagcgcac

SEQ ID NO: 446438 - RNA, 19 nt, Human
caccgcgccucccaagucc

SEQ ID NO: 446439 - RNA, 23 nt, Human
caccuuuuuguuugcuguuguuu

SEQ ID NO: 446440 - RNA, 23 nt, Human
caggaauuuucucucugaaacgc

SEQ ID NO: 446441 - RNA, 25 nt, Human
caguuuaaaaaaugcaacaaaaguu

SEQ ID NO: 446442 - RNA, 23 nt, Human
ccauguauucacuucucaucacu

SEQ ID NO: 446443 - RNA, 20 nt, Human
cccuccaacaaguuuuaagc

SEQ ID NO: 446444 - RNA, 24 nt, Human
cgccaacaauaaacaggucagauc

SEQ ID NO: 446445 - RNA, 21 nt, Human
cucuaaagcuuggguaagugg

SEQ ID NO: 446446 - RNA, 19 nt, Human
cuucaggaaggcaagauuu

SEQ ID NO: 446447 - RNA, 20 nt, Human
cuuucugcuacuauucuuuc

SEQ ID NO: 446448 - RNA, 21 nt, Human
gcuuggguaaguggcaucuuc

SEQ ID NO: 446449 - RNA, 24 nt, Human
gguauacaugacuuuggcugugca

SEQ ID NO: 446450 - RNA, 24 nt, Human
uaacaaaaaaaaaaaaaacccaaa

SEQ ID NO: 446451 - RNA, 22 nt, Human
uaacuuaauuccagacagcuuu

SEQ ID NO: 446452 - RNA, 24 nt, Human
uaaggucacagugccaguuccccc

SEQ ID NO: 446453 - RNA, 24 nt, Human
uacaugccgaaccuaaggucagga

SEQ ID NO: 446454 - RNA, 23 nt, Human
uaccacuuuuuaaugacaaucac

SEQ ID NO: 446455 - RNA, 18 nt, Human
uacucagcuaucuucagg

SEQ ID NO: 446456 - RNA, 23 nt, Human
uauaacaaaaaaaaaaaaaaccc

SEQ ID NO: 446457 - RNA, 27 nt, Human
uaucaacgauggcaaaaaaucacacaa

SEQ ID NO: 446458 - RNA, 23 nt, Human
uaugacaucaaaccaagacaccu

SEQ ID NO: 446459 - RNA, 30 nt, Human
uauucacuucucaucacuuggucuacaugg

SEQ ID NO: 446460 - RNA, 22 nt, Human
ucaacccaaaauaauaguccuu

SEQ ID NO: 446461 - RNA, 20 nt, Human
ucaccgcgccucccaagucc

SEQ ID NO: 446462 - RNA, 18 nt, Human
ucaugggaaagaaagcuc

SEQ ID NO: 446463 - RNA, 22 nt, Human
uccucuagcucauuuguaucuc

SEQ ID NO: 446464 - RNA, 22 nt, Human
uccucuagcucauuuguaucuc

SEQ ID NO: 446465 - RNA, 18 nt, Human
ucuaaacagcgcacaaaa

SEQ ID NO: 446466 - RNA, 22 nt, Human
ucucaaacgccuccuaagccuc

SEQ ID NO: 446467 - RNA, 18 nt, Human
ucucuuggaacaggaauu

SEQ ID NO: 446468 - RNA, 18 nt, Human
ucuguauuuuaugggaaa

SEQ ID NO: 446469 - RNA, 27 nt, Human
ugaaauaaaccaacagauuaucagaug

SEQ ID NO: 446470 - RNA, 24 nt, Human
ugaagaacagaaccaucagacuga

SEQ ID NO: 446471 - RNA, 23 nt, Human
ugaauaaaaaucgacauuuuuuu

SEQ ID NO: 446472 - RNA, 19 nt, Human
ugacuccucaccgcgccuc

SEQ ID NO: 446473 - RNA, 22 nt, Human
ugaguauccucucaaacgccuc

SEQ ID NO: 446474 - RNA, 19 nt, Human
ugccgaaccuaaggucagg

SEQ ID NO: 446475 - RNA, 18 nt, Human
uggagcuucaacccaaaa

SEQ ID NO: 446476 - RNA, 23 nt, Human
uggcaaaaaaucacacaacuucu

SEQ ID NO: 446477 - RNA, 18 nt, Human
ugguauacaugacuuugg

SEQ ID NO: 446478 - RNA, 18 nt, Human
uuauguugguaaaauguc

SEQ ID NO: 446479 - RNA, 24 nt, Human
uucuucucugaaagaaucucuaaa

SEQ ID NO: 446480 - RNA, 28 nt, Human
uuguuuuuuacacuagauuccuuugucu

SEQ ID NO: 446481 - RNA, 22 nt, Human
uuuagcaaugacacucuagaaa

SEQ ID NO: 446482 - RNA, 21 nt, Human
uuucugcuacuauucuuuccu

SEQ ID NO: 446483 - RNA, 19 nt, Human
uuuguagugcuggucuaca

SEQ ID NO: 446484 - RNA, 20 nt, Human
aaaaaaauucccagacccuc

SEQ ID NO: 446485 - RNA, 19 nt, Human
aaauacaaaaauuagccgg

SEQ ID NO: 446486 - RNA, 20 nt, Human
aacauggugaaacccugucu

SEQ ID NO: 446487 - RNA, 21 nt, Human
aacauggugaaacccugucuc

SEQ ID NO: 446488 - RNA, 21 nt, Human
aagcagcuugcgacuucuggu

SEQ ID NO: 446489 - RNA, 24 nt, Human
aaucgcuugaacccaggaggugga

SEQ ID NO: 446490 - RNA, 24 nt, Human
acagaaugagacucugucccaaaa

SEQ ID NO: 446491 - RNA, 25 nt, Human
acccucggccccagaccuucccaaa

SEQ ID NO: 446492 - RNA, 24 nt, Human
acccugucucuacuaaaaauacaa

SEQ ID NO: 446493 - RNA, 23 nt, Human
accguagaccaucaugaggccug

SEQ ID NO: 446494 - RNA, 18 nt, Human
accugggcccccgggccc

SEQ ID NO: 446495 - RNA, 28 nt, Human
acucugucccaaaaaaaaaaaaaaaaaa

SEQ ID NO: 446496 - RNA, 18 nt, Human
acugcacucuagccugag

SEQ ID NO: 446497 - RNA, 24 nt, Human
acugcacucuagccugagugacag

SEQ ID NO: 446498 - RNA, 18 nt, Human
acuggcuccugcacccac

SEQ ID NO: 446499 - RNA, 22 nt, Human
agaaucgcuugaacccaggagg

SEQ ID NO: 446500 - RNA, 20 nt, Human
agacaccaugagcuggaggg

SEQ ID NO: 446501 - RNA, 20 nt, Human
agcacuuugggaggcuaagg

SEQ ID NO: 446502 - RNA, 24 nt, Human
agccaggaaaggagagaguuccag

SEQ ID NO: 446503 - RNA, 18 nt, Human
agccggacgugguggugu

SEQ ID NO: 446504 - RNA, 24 nt, Human
agccugagugacagaaugagacuc

SEQ ID NO: 446505 - RNA, 22 nt, Human
agccuggccaacauggugaaac

SEQ ID NO: 446506 - RNA, 24 nt, Human
agccuggccaacauggugaaaccc

SEQ ID NO: 446507 - RNA, 22 nt, Human
aggaaggaaggagcuggaggau

SEQ ID NO: 446508 - RNA, 19 nt, Human
aggaggcugaggcaagaga

SEQ ID NO: 446509 - RNA, 18 nt, Human
aggcaagagaaucgcuug

SEQ ID NO: 446510 - RNA, 24 nt, Human
aggcaagagaaucgcuugaaccca

SEQ ID NO: 446511 - RNA, 24 nt, Human
aggcggguggaucacgaggucagg

SEQ ID NO: 446512 - RNA, 21 nt, Human
aggcuaaggcggguggaucac

SEQ ID NO: 446513 - RNA, 24 nt, Human
aggcugaggcaagagaaucgcuug

SEQ ID NO: 446514 - RNA, 19 nt, Human
aggguacggcagggccuug

SEQ ID NO: 446515 - RNA, 24 nt, Human
agguggagcuugcagugagccaag

SEQ ID NO: 446516 - RNA, 24 nt, Human
aucaugccacugcacucuagccug

SEQ ID NO: 446517 - RNA, 23 nt, Human
auuuuuucugcccccugggcaca

SEQ ID NO: 446518 - RNA, 24 nt, Human
caacauggugaaacccugucucua

SEQ ID NO: 446519 - RNA, 21 nt, Human
caaccugacuucuuggaagcu

SEQ ID NO: 446520 - RNA, 24 nt, Human
caagaccagccuggccaacauggu

SEQ ID NO: 446521 - RNA, 24 nt, Human
caagaucaugccacugcacucuag

SEQ ID NO: 446522 - RNA, 23 nt, Human
cacagaaaacuugcucaugacca

SEQ ID NO: 446523 - RNA, 24 nt, Human
cacgccuguaaucccagcacuuug

SEQ ID NO: 446524 - RNA, 22 nt, Human
cacucuagccugagugacagaa

SEQ ID NO: 446525 - RNA, 19 nt, Human
cacugcacucuagccugag

SEQ ID NO: 446526 - RNA, 21 nt, Human
cacugcacucuagccugagug

SEQ ID NO: 446527 - RNA, 24 nt, Human
cacugcacucuagccugagugaca

SEQ ID NO: 446528 - RNA, 25 nt, Human
cacugcacucuagccugagugacag

SEQ ID NO: 446529 - RNA, 24 nt, Human
cagaaaacuugcucaugaccacac

SEQ ID NO: 446530 - RNA, 18 nt, Human
cagaaugagacucugucc

SEQ ID NO: 446531 - RNA, 23 nt, Human
cagacacuggcuccugcacccac

SEQ ID NO: 446532 - RNA, 18 nt, Human
cagagccccagccaggaa

SEQ ID NO: 446533 - RNA, 24 nt, Human
cagagccccagccaggaaaggaga

SEQ ID NO: 446534 - RNA, 24 nt, Human
cagcacuuugggaggcuaaggcgg

SEQ ID NO: 446535 - RNA, 29 nt, Human
caggagguggagcuugcagugacaacggu

SEQ ID NO: 446536 - RNA, 21 nt, Human
caggguacggcagggccuugg

SEQ ID NO: 446537 - RNA, 22 nt, Human
ccaaaaaaaaaaaaaaaaaaaa

SEQ ID NO: 446538 - RNA, 23 nt, Human
ccaaaaaaaaaaaaaaaaaaaaa

SEQ ID NO: 446539 - RNA, 23 nt, Human
ccaagagucuagccgcaggcccc

SEQ ID NO: 446540 - RNA, 22 nt, Human
ccacagaaaacuugcucaugac

SEQ ID NO: 446541 - RNA, 21 nt, Human
ccacaucaccaccauguccca

SEQ ID NO: 446542 - RNA, 22 nt, Human
ccacaucaccaccaugucccag

SEQ ID NO: 446543 - RNA, 20 nt, Human
ccacugcacucuagccugag

SEQ ID NO: 446544 - RNA, 20 nt, Human
ccacugcacucuagccugag

SEQ ID NO: 446545 - RNA, 21 nt, Human
ccacugcacucuagccugagu

SEQ ID NO: 446546 - RNA, 24 nt, Human
ccacugcacucuagccugagugac

SEQ ID NO: 446547 - RNA, 20 nt, Human
ccaggaaaggagagaguucc

SEQ ID NO: 446548 - RNA, 21 nt, Human
cccacaucaccaccauguccc

SEQ ID NO: 446549 - RNA, 18 nt, Human
ccccagacaccaugagcu

SEQ ID NO: 446550 - RNA, 21 nt, Human
ccccagcacugggccaggggg

SEQ ID NO: 446551 - RNA, 21 nt, Human
cccccugggcacaugugccca

SEQ ID NO: 446552 - RNA, 20 nt, Human
ccccugggcacaugugccca

SEQ ID NO: 446553 - RNA, 24 nt, Human
ccccugggcacaugugcccagcuc

SEQ ID NO: 446554 - RNA, 21 nt, Human
cccucggccccagaccuuccc

SEQ ID NO: 446555 - RNA, 24 nt, Human
cccucggccccagaccuucccaaa

SEQ ID NO: 446556 - RNA, 18 nt, Human
cccucgguggccuccgug

SEQ ID NO: 446557 - RNA, 20 nt, Human
ccuccugauaggcccagccc

SEQ ID NO: 446558 - RNA, 22 nt, Human
ccugcacccacaucaccaccau

SEQ ID NO: 446559 - RNA, 27 nt, Human
ccugcacccacaucaccaccauguccc

SEQ ID NO: 446560 - RNA, 22 nt, Human
ccuggccaacauggugaaaccc

SEQ ID NO: 446561 - RNA, 24 nt, Human
ccuggccaacauggugaaacccug

SEQ ID NO: 446562 - RNA, 23 nt, Human
ccugggcccccgggcccugucag

SEQ ID NO: 446563 - RNA, 22 nt, Human
ccugggguucuucgagaacaag

SEQ ID NO: 446564 - RNA, 22 nt, Human
ccuguaaucccagcacuuuggg

SEQ ID NO: 446565 - RNA, 24 nt, Human
ccuguccugccgcaguggggggaa

SEQ ID NO: 446566 - RNA, 19 nt, Human
cgacuccuaggcgcccucc

SEQ ID NO: 446567 - RNA, 24 nt, Human
cgcauguagucccagcuacucagg

SEQ ID NO: 446568 - RNA, 23 nt, Human
cgccuguaaucccagcacuuugg

SEQ ID NO: 446569 - RNA, 23 nt, Human
cggcaccugggcccccgggcccu

SEQ ID NO: 446570 - RNA, 19 nt, Human
cgggagcccagggaggcag

SEQ ID NO: 446571 - RNA, 21 nt, Human
cuagccgcaggccccagacac

SEQ ID NO: 446572 - RNA, 22 nt, Human
cucacgccuguaaucccagcac

SEQ ID NO: 446573 - RNA, 24 nt, Human
cucacgccuguaaucccagcacuu

SEQ ID NO: 446574 - RNA, 21 nt, Human
cuccagagccaagcagcuugc

SEQ ID NO: 446575 - RNA, 19 nt, Human
cucugucccaaaaaaaaaa

SEQ ID NO: 446576 - RNA, 24 nt, Human
cucugucccaaaaaaaaaaaaaaa

SEQ ID NO: 446577 - RNA, 24 nt, Human
cuggccaacauggugaaacccugu

SEQ ID NO: 446578 - RNA, 18 nt, Human
cuggcuccugcacccaca

SEQ ID NO: 446579 - RNA, 24 nt, Human
cugggccgggcacgguggcucacg

SEQ ID NO: 446580 - RNA, 23 nt, Human
cugucccaaaaaaaaaaaaaaaa

SEQ ID NO: 446581 - RNA, 21 nt, Human
cuugcgacuucuggugggcac

SEQ ID NO: 446582 - RNA, 22 nt, Human
cuugggaaccuggguggguugg

SEQ ID NO: 446583 - RNA, 19 nt, Human
gaaacccugucucuacuaa

SEQ ID NO: 446584 - RNA, 18 nt, Human
gaacuccacaggcuggua

SEQ ID NO: 446585 - RNA, 23 nt, Human
gacagaaugagacucugucccaa

SEQ ID NO: 446586 - RNA, 18 nt, Human
gagcuugcagugagccaa

SEQ ID NO: 446587 - RNA, 22 nt, Human
gagcuugcagugagccaagauc

SEQ ID NO: 446588 - RNA, 22 nt, Human
gaucacgaggucaggaguucaa

SEQ ID NO: 446589 - RNA, 24 nt, Human
gaucacgaggucaggaguucaaga

SEQ ID NO: 446590 - RNA, 22 nt, Human
gcaagagaaucgcuugaaccca

SEQ ID NO: 446591 - RNA, 24 nt, Human
gcaccggaauccccugggaugcuu

SEQ ID NO: 446592 - RNA, 24 nt, Human
gccaacauggugaaacccugucuc

SEQ ID NO: 446593 - RNA, 20 nt, Human
gccaagaucaugccacugca

SEQ ID NO: 446594 - RNA, 20 nt, Human
gccacugcacucuagccuga

SEQ ID NO: 446595 - RNA, 21 nt, Human
gccacugcacucuagccugag

SEQ ID NO: 446596 - RNA, 21 nt, Human
gccaggaaaggagagaguucc

SEQ ID NO: 446597 - RNA, 18 nt, Human
gcccagggaggcagggac

SEQ ID NO: 446598 - RNA, 18 nt, Human
ggaaaggagagaguucca

SEQ ID NO: 446599 - RNA, 23 nt, Human
ggaaggagcuggaggauacagug

SEQ ID NO: 446600 - RNA, 23 nt, Human
ggagcuugaggacuaagugggcc

SEQ ID NO: 446601 - RNA, 20 nt, Human
ggagcuugcagugagccaag

SEQ ID NO: 446602 - RNA, 24 nt, Human
ggagcuugcagugagccaagauca

SEQ ID NO: 446603 - RNA, 23 nt, Human
ggcacgguggcucacgccuguaa

SEQ ID NO: 446604 - RNA, 19 nt, Human
ggccccagaccuucccaag

SEQ ID NO: 446605 - RNA, 21 nt, Human
gggaaggaaggaaggagcugg

SEQ ID NO: 446606 - RNA, 22 nt, Human
gggcgcccgcguggaacagugc

SEQ ID NO: 446607 - RNA, 19 nt, Human
ggggcugaggcaggagaua

SEQ ID NO: 446608 - RNA, 21 nt, Human
ggggggcugaggcaggagaua

SEQ ID NO: 446609 - RNA, 19 nt, Human
gggguggagaugggagggg

SEQ ID NO: 446610 - RNA, 24 nt, Human
gggguggagaugggaggggugggu

SEQ ID NO: 446611 - RNA, 23 nt, Human
gguggaucacgaggucaggaguu

SEQ ID NO: 446612 - RNA, 23 nt, Human
gguggcucacgccuguaauccca

SEQ ID NO: 446613 - RNA, 24 nt, Human
gguggcucacgccuguaaucccag

SEQ ID NO: 446614 - RNA, 22 nt, Human
gguggggguggcugugaugagg

SEQ ID NO: 446615 - RNA, 19 nt, Human
guaucuggcuguuggugac

SEQ ID NO: 446616 - RNA, 23 nt, Human
gucucgccuccugaacuccacag

SEQ ID NO: 446617 - RNA, 23 nt, Human
guggaucacgaggucaggaguuc

SEQ ID NO: 446618 - RNA, 18 nt, Human
gugggguggagaugggag

SEQ ID NO: 446619 - RNA, 21 nt, Human
uaaggagauggucagaugggu

SEQ ID NO: 446620 - RNA, 24 nt, Human
uaaggcggguggaucacgagguca

SEQ ID NO: 446621 - RNA, 24 nt, Human
uaccguagaccaucaugaggccug

SEQ ID NO: 446622 - RNA, 19 nt, Human
uagccgcaggccccagaca

SEQ ID NO: 446623 - RNA, 20 nt, Human
uagccggacgugguggugug

SEQ ID NO: 446624 - RNA, 24 nt, Human
ucaagcauaacuugagucugcacu

SEQ ID NO: 446625 - RNA, 21 nt, Human
ucacgaggucaggaguucaag

SEQ ID NO: 446626 - RNA, 24 nt, Human
ucacgaggucaggaguucaagacc

SEQ ID NO: 446627 - RNA, 23 nt, Human
ucaggcuguggccagauguggcc

SEQ ID NO: 446628 - RNA, 22 nt, Human
uccacagaaaacuugcucauga

SEQ ID NO: 446629 - RNA, 20 nt, Human
ucccaaaaaaaaaaaaaaaa

SEQ ID NO: 446630 - RNA, 24 nt, Human
ucccagacccucggccccagaccu

SEQ ID NO: 446631 - RNA, 25 nt, Human
ucccagacccucggccccagaccuu

SEQ ID NO: 446632 - RNA, 26 nt, Human
ucccagacccucggccccagaccuug

SEQ ID NO: 446633 - RNA, 20 nt, Human
ucccaggggcagccuggagg

SEQ ID NO: 446634 - RNA, 27 nt, Human
uccguguuccugggggaaggaaggaag

SEQ ID NO: 446635 - RNA, 24 nt, Human
ucuagccugagugacagaaugaga

SEQ ID NO: 446636 - RNA, 20 nt, Human
ucucagaaggcuucuuccuu

SEQ ID NO: 446637 - RNA, 23 nt, Human
ucucagaaggcuucuuccuuugg

SEQ ID NO: 446638 - RNA, 21 nt, Human
ucucuacuaaaaauacaaaaa

SEQ ID NO: 446639 - RNA, 23 nt, Human
ucugucccaaaaaaaaaaaaaaa

SEQ ID NO: 446640 - RNA, 19 nt, Human
ucuuaggcgacaccgacuc

SEQ ID NO: 446641 - RNA, 21 nt, Human
ugaaccaguucugagaaacug

SEQ ID NO: 446642 - RNA, 23 nt, Human
ugaagacaagucuuccauguggg

SEQ ID NO: 446643 - RNA, 24 nt, Human
ugaagacaagucuuccaugugggg

SEQ ID NO: 446644 - RNA, 25 nt, Human
ugacagaaugagacucugucccaaa

SEQ ID NO: 446645 - RNA, 21 nt, Human
ugagaaacugucccgcgugga

SEQ ID NO: 446646 - RNA, 20 nt, Human
ugaggcaagagaaucgcuug

SEQ ID NO: 446647 - RNA, 24 nt, Human
ugaggcaagagaaucgcuugaacc

SEQ ID NO: 446648 - RNA, 25 nt, Human
ugaggcaagagaaucgcuugaaccc

SEQ ID NO: 446649 - RNA, 18 nt, Human
ugaggcaggagauauggg

SEQ ID NO: 446650 - RNA, 21 nt, Human
ugaggcaggagauauggggaa

SEQ ID NO: 446651 - RNA, 21 nt, Human
ugccaggcugcagccuguguc

SEQ ID NO: 446652 - RNA, 21 nt, Human
ugcccagcucugcaaagacag

SEQ ID NO: 446653 - RNA, 18 nt, Human
ugcccggagcccgcagca

SEQ ID NO: 446654 - RNA, 19 nt, Human
ugcccggagcccgcagcac

SEQ ID NO: 446655 - RNA, 22 nt, Human
uggaucacgaggucaggaguuc

SEQ ID NO: 446656 - RNA, 21 nt, Human
uggcaggcuuggggcgcccgc

SEQ ID NO: 446657 - RNA, 22 nt, Human
uggcaggcuuggggcgcccgcg

SEQ ID NO: 446658 - RNA, 24 nt, Human
uggccaacauggugaaacccuguc

SEQ ID NO: 446659 - RNA, 22 nt, Human
uggccagauguggcccacaggc

SEQ ID NO: 446660 - RNA, 24 nt, Human
uggccagauguggcccacaggcug

SEQ ID NO: 446661 - RNA, 24 nt, Human
uggcucacgccuguaaucccagca

SEQ ID NO: 446662 - RNA, 20 nt, Human
ugggaggcuaaggcgggugg

SEQ ID NO: 446663 - RNA, 24 nt, Human
ugggaggcuaaggcggguggauca

SEQ ID NO: 446664 - RNA, 19 nt, Human
ugggaggggugggugccag

SEQ ID NO: 446665 - RNA, 19 nt, Human
ugggaggggugggugccag

SEQ ID NO: 446666 - RNA, 21 nt, Human
ugggcccccgggcccugucag

SEQ ID NO: 446667 - RNA, 19 nt, Human
ugggggaaggaaggaagga

SEQ ID NO: 446668 - RNA, 21 nt, Human
ugggguucuucgagaacaaga

SEQ ID NO: 446669 - RNA, 19 nt, Human
uggguggguuggggagggu

SEQ ID NO: 446670 - RNA, 18 nt, Human
ugguagaagcggggcuug

SEQ ID NO: 446671 - RNA, 18 nt, Human
ugguggggguggcuguga

SEQ ID NO: 446672 - RNA, 24 nt, Human
ugguggugugcgcauguaguccca

SEQ ID NO: 446673 - RNA, 24 nt, Human
uggugugcgcauguagucccagcu

SEQ ID NO: 446674 - RNA, 20 nt, Human
uguagucccagcuacucagg

SEQ ID NO: 446675 - RNA, 20 nt, Human
ugucucgccuccugaacucc

SEQ ID NO: 446676 - RNA, 20 nt, Human
uguggucagagccccagccc

SEQ ID NO: 446677 - RNA, 24 nt, Human
uuagccggacgugguggugugcgc

SEQ ID NO: 446678 - RNA, 19 nt, Human
uucccaaaggaggcucagg

SEQ ID NO: 446679 - RNA, 27 nt, Human
uucccaaaggaggcucagggauuaggu

SEQ ID NO: 446680 - RNA, 20 nt, Human
uugcagugagccaagaucau

SEQ ID NO: 446681 - RNA, 25 nt, Human
uugggaggcuaaggcggguggauca

SEQ ID NO: 446682 - RNA, 19 nt, Human
uuguggucagagccccagc

SEQ ID NO: 446683 - RNA, 21 nt, Human
uuuuaaaaguccugggccggg

SEQ ID NO: 446684 - RNA, 18 nt, Human
uuuuuuuuuuuuuuuuug

SEQ ID NO: 446685 - RNA, 23 nt, Human
aaaaauucaagucacacaaaacu

SEQ ID NO: 446686 - RNA, 20 nt, Human
aaaagaacaaauuugcugca

SEQ ID NO: 446687 - RNA, 21 nt, Human
aaacucagauccaccuggaau

SEQ ID NO: 446688 - RNA, 22 nt, Human
aaagaagccaguuccauccagg

SEQ ID NO: 446689 - RNA, 18 nt, Human
aaagcgguccccuucuuc

SEQ ID NO: 446690 - RNA, 20 nt, Human
aaagguuuucaggaagcgcc

SEQ ID NO: 446691 - RNA, 22 nt, Human
aaauuugcugcacacugaugcc

SEQ ID NO: 446692 - RNA, 18 nt, Human
aacuguauuuuuaugaug

SEQ ID NO: 446693 - RNA, 20 nt, Human
aaugaugaaaccagcccaaa

SEQ ID NO: 446694 - RNA, 20 nt, Human
agaaaaaaaaaacuuuuggg

SEQ ID NO: 446695 - RNA, 19 nt, Human
agacuuaaaaacaaaggcg

SEQ ID NO: 446696 - RNA, 19 nt, Human
agacuuaaaaacaaaggcg

SEQ ID NO: 446697 - RNA, 20 nt, Human
agggaauaaagguuuucagg

SEQ ID NO: 446698 - RNA, 22 nt, Human
aguccacauuggacguggcggg

SEQ ID NO: 446699 - RNA, 23 nt, Human
auauauguucuucuggcuguagu

SEQ ID NO: 446700 - RNA, 19 nt, Human
augaaaccagcccaaauga

SEQ ID NO: 446701 - RNA, 28 nt, Human
caaaacucaaaaacuguauuaaaaguuu

SEQ ID NO: 446702 - RNA, 21 nt, Human
caaaaugaugaaaccagccca

SEQ ID NO: 446703 - RNA, 18 nt, Human
caaaugacaaagaaggga

SEQ ID NO: 446704 - RNA, 21 nt, Human
caagucacacaaaacucaaaa

SEQ ID NO: 446705 - RNA, 22 nt, Human
caccacacacccgaaggggaag

SEQ ID NO: 446706 - RNA, 20 nt, Human
cagacaacgugccagggaau

SEQ ID NO: 446707 - RNA, 20 nt, Human
caggaagcgccuucaaaugc

SEQ ID NO: 446708 - RNA, 21 nt, Human
ccaacuguauuuuuaugauga

SEQ ID NO: 446709 - RNA, 19 nt, Human
ccagcccaaaugaaggggg

SEQ ID NO: 446710 - RNA, 22 nt, Human
cccaaaugaagggggggggggg

SEQ ID NO: 446711 - RNA, 24 nt, Human
cccagugccacuccugaguccugg

SEQ ID NO: 446712 - RNA, 21 nt, Human
ccccuucuucccagugccacu

SEQ ID NO: 446713 - RNA, 23 nt, Human
ccccuucuucccagugccacucc

SEQ ID NO: 446714 - RNA, 20 nt, Human
ccuggaaugacuaaagaaaa

SEQ ID NO: 446715 - RNA, 20 nt, Human
cgaguggauccgcacggggc

SEQ ID NO: 446716 - RNA, 24 nt, Human
gaaaaaaaaaacuuuugggggaag

SEQ ID NO: 446717 - RNA, 18 nt, Human
gcaaaaugaugaaaccag

SEQ ID NO: 446718 - RNA, 23 nt, Human
gcacuuuuguuagugaugaaacc

SEQ ID NO: 446719 - RNA, 25 nt, Human
gcauaauaacaauucugauacaaga

SEQ ID NO: 446720 - RNA, 19 nt, Human
gcuagaguggacauacccc

SEQ ID NO: 446721 - RNA, 20 nt, Human
gcuccgaggaggggcagggc

SEQ ID NO: 446722 - RNA, 22 nt, Human
gcugauuucucgugacuucaac

SEQ ID NO: 446723 - RNA, 18 nt, Human
ggaaugacuaaagaaaaa

SEQ ID NO: 446724 - RNA, 24 nt, Human
gggcccccugcauaauaacaauuc

SEQ ID NO: 446725 - RNA, 21 nt, Human
guaguaaguugcaacaaauac

SEQ ID NO: 446726 - RNA, 20 nt, Human
uaaaacugguaaauguaaug

SEQ ID NO: 446727 - RNA, 19 nt, Human
uaaagaaaaaaaaaacuuu

SEQ ID NO: 446728 - RNA, 19 nt, Human
uaaagguuuucaggaagcg

SEQ ID NO: 446729 - RNA, 21 nt, Human
uaaauauauauauauauauau

SEQ ID NO: 446730 - RNA, 23 nt, Human
uaccuugcucauuuguauacaac

SEQ ID NO: 446731 - RNA, 26 nt, Human
uauauauauguucuucuggcuguagu

SEQ ID NO: 446732 - RNA, 27 nt, Human
uauauuuuuaaauauauauauauauau

SEQ ID NO: 446733 - RNA, 27 nt, Human
uauuuuuaaauauauauauauauauau

SEQ ID NO: 446734 - RNA, 21 nt, Human
ucagcuccuagagagauccag

SEQ ID NO: 446735 - RNA, 21 nt, Human
uccacaagcaggcuccgagga

SEQ ID NO: 446736 - RNA, 18 nt, Human
uccugaguccuggaaaaa

SEQ ID NO: 446737 - RNA, 20 nt, Human
uccugaguccuggaaaaauc

SEQ ID NO: 446738 - RNA, 20 nt, Human
ugaaacagacaacgugccag

SEQ ID NO: 446739 - RNA, 22 nt, Human
ugaaacagacaacgugccaggg

SEQ ID NO: 446740 - RNA, 24 nt, Human
ugaaacagacaacgugccagggaa

SEQ ID NO: 446741 - RNA, 20 nt, Human
ugaagguucgagugucagcu

SEQ ID NO: 446742 - RNA, 25 nt, Human
ugcagaauuauauucuucucgauaa

SEQ ID NO: 446743 - RNA, 21 nt, Human
ugcugcacacugaugccagcg

SEQ ID NO: 446744 - RNA, 20 nt, Human
uggaaaaauccgaauggguc

SEQ ID NO: 446745 - RNA, 23 nt, Human
uggaaugacuaaagaaaaaaaaa

SEQ ID NO: 446746 - RNA, 19 nt, Human
uggacguggcggggaaugc

SEQ ID NO: 446747 - RNA, 20 nt, Human
uuaaauauauauauauauau

SEQ ID NO: 446748 - RNA, 19 nt, Human
uucaggaagcgccuucaaa

SEQ ID NO: 446749 - RNA, 21 nt, Human
uugcagaaagcgguccccuuc

SEQ ID NO: 446750 - RNA, 24 nt, Human
uuguuagugaugaaaccaaaagaa

SEQ ID NO: 446751 - RNA, 21 nt, Human
uuucaaaugacaaagaaggga

SEQ ID NO: 446752 - RNA, 26 nt, Human
uuuuaaauauauauauauauauaugu

SEQ ID NO: 446753 - RNA, 23 nt, Human
aaacaaaguagaaccuagccaag

SEQ ID NO: 446754 - RNA, 19 nt, Human
aacacggugaaaccgucuc

SEQ ID NO: 446755 - RNA, 24 nt, Human
aacccuucucgcuccuccagcccc

SEQ ID NO: 446756 - RNA, 20 nt, Human
aaccuagagaauauguucua

SEQ ID NO: 446757 - RNA, 21 nt, Human
aaccuagagaauauguucuau

SEQ ID NO: 446758 - RNA, 19 nt, Human
aacuugcuccauucuuucu

SEQ ID NO: 446759 - RNA, 22 nt, Human
aauggcacuuugaauuucauga

SEQ ID NO: 446760 - RNA, 21 nt, Human
acagacacaaacguguuugug

SEQ ID NO: 446761 - RNA, 18 nt, Human
accccgucucacaggcug

SEQ ID NO: 446762 - RNA, 18 nt, Human
acccgcuucucuuagccc

SEQ ID NO: 446763 - RNA, 18 nt, Human
accucacucuuccuucac

SEQ ID NO: 446764 - RNA, 24 nt, Human
acugcacuccagccuggacgacag

SEQ ID NO: 446765 - RNA, 26 nt, Human
acugcacuccagccuggacgacagag

SEQ ID NO: 446766 - RNA, 20 nt, Human
agaaaagccaguucagguag

SEQ ID NO: 446767 - RNA, 21 nt, Human
agaaaccuuaucugacuugga

SEQ ID NO: 446768 - RNA, 24 nt, Human
agcacuuugggaggcugaggcggg

SEQ ID NO: 446769 - RNA, 25 nt, Human
agccguuagccucaucuuccgcccc

SEQ ID NO: 446770 - RNA, 21 nt, Human
aggaugcagguccugacccuc

SEQ ID NO: 446771 - RNA, 18 nt, Human
aggcacaacuugcuccau

SEQ ID NO: 446772 - RNA, 21 nt, Human
aggcaggaaaauggcaugaac

SEQ ID NO: 446773 - RNA, 24 nt, Human
aggcaggaaaauggcaugaaccca

SEQ ID NO: 446774 - RNA, 25 nt, Human
aggcaggaaaauggcaugaacccag

SEQ ID NO: 446775 - RNA, 27 nt, Human
aggcaggaaaauggcaugaacccagga

SEQ ID NO: 446776 - RNA, 24 nt, Human
aggcgggcggaucacaaggucagg

SEQ ID NO: 446777 - RNA, 19 nt, Human
aggcugaggcgggcggauc

SEQ ID NO: 446778 - RNA, 21 nt, Human
aggcugaggcgggcggaucac

SEQ ID NO: 446779 - RNA, 23 nt, Human
aucaauuauuuccacaucauaau

SEQ ID NO: 446780 - RNA, 22 nt, Human
aucccggugcguucacugaagc

SEQ ID NO: 446781 - RNA, 18 nt, Human
augaaauuacucugcccc

SEQ ID NO: 446782 - RNA, 22 nt, Human
augcauuuuuaaaauuuaaaaa

SEQ ID NO: 446783 - RNA, 19 nt, Human
augccuguaaucccagcac

SEQ ID NO: 446784 - RNA, 24 nt, Human
auugcgccacugcacuccagccug

SEQ ID NO: 446785 - RNA, 25 nt, Human
caaauaaaaauagaguuuuaggaug

SEQ ID NO: 446786 - RNA, 19 nt, Human
caagguacaccuacuggca

SEQ ID NO: 446787 - RNA, 21 nt, Human
caauuagaaaugccauaaaca

SEQ ID NO: 446788 - RNA, 18 nt, Human
caccacgggggggucaca

SEQ ID NO: 446789 - RNA, 22 nt, Human
caccacgggggggucacacccg

SEQ ID NO: 446790 - RNA, 18 nt, Human
cacccagagccaccacgg

SEQ ID NO: 446791 - RNA, 21 nt, Human
caccuguagucccagcuacuc

SEQ ID NO: 446792 - RNA, 24 nt, Human
caccuguagucccagcuacucggg

SEQ ID NO: 446793 - RNA, 18 nt, Human
cacugcacuccagccugg

SEQ ID NO: 446794 - RNA, 19 nt, Human
cacugcacuccagccugga

SEQ ID NO: 446795 - RNA, 20 nt, Human
cacugcacuccagccuggac

SEQ ID NO: 446796 - RNA, 22 nt, Human
cacugcacuccagccuggacga

SEQ ID NO: 446797 - RNA, 24 nt, Human
cacugcacuccagccuggacgaca

SEQ ID NO: 446798 - RNA, 22 nt, Human
cagcacuuugggaggcugaggc

SEQ ID NO: 446799 - RNA, 24 nt, Human
cagcacuuugggaggcugaggcgg

SEQ ID NO: 446800 - RNA, 24 nt, Human
cagccuggacgacagagucagaaa

SEQ ID NO: 446801 - RNA, 24 nt, Human
cagcuacucgggaggcugaggcag

SEQ ID NO: 446802 - RNA, 20 nt, Human
cauccugcaagucauaccaa

SEQ ID NO: 446803 - RNA, 24 nt, Human
caugccuguaaucccagcacuuug

SEQ ID NO: 446804 - RNA, 20 nt, Human
cauucuaacaaccaaucuga

SEQ ID NO: 446805 - RNA, 19 nt, Human
ccacugcacuccagccugg

SEQ ID NO: 446806 - RNA, 19 nt, Human
ccacugcacuccagccugg

SEQ ID NO: 446807 - RNA, 20 nt, Human
ccacugcacuccagccugga

SEQ ID NO: 446808 - RNA, 21 nt, Human
ccacugcacuccagccuggac

SEQ ID NO: 446809 - RNA, 24 nt, Human
ccacugcacuccagccuggacgac

SEQ ID NO: 446810 - RNA, 21 nt, Human
cccaucagccugccucuaccu

SEQ ID NO: 446811 - RNA, 19 nt, Human
ccccaaauaaaaauagagu

SEQ ID NO: 446812 - RNA, 22 nt, Human
ccccagcuccuccgcagacacc

SEQ ID NO: 446813 - RNA, 19 nt, Human
cccccagcuccuccgcaga

SEQ ID NO: 446814 - RNA, 24 nt, Human
ccccgcccuagccuggccgccgga

SEQ ID NO: 446815 - RNA, 21 nt, Human
cccggugcccgcccgggcugg

SEQ ID NO: 446816 - RNA, 21 nt, Human
cccuuugauccagccacaccu

SEQ ID NO: 446817 - RNA, 18 nt, Human
ccucaucuuccgccccca

SEQ ID NO: 446818 - RNA, 22 nt, Human
ccucccggccugcacaucccgg

SEQ ID NO: 446819 - RNA, 20 nt, Human
ccuccgcagacacccagagc

SEQ ID NO: 446820 - RNA, 21 nt, Human
ccuggcuaacacggugaaacc

SEQ ID NO: 446821 - RNA, 22 nt, Human
ccuggcuaacacggugaaaccg

SEQ ID NO: 446822 - RNA, 21 nt, Human
ccuguagucccagcuacucgg

SEQ ID NO: 446823 - RNA, 21 nt, Human
ccuuaaccauuguucuuaguu

SEQ ID NO: 446824 - RNA, 23 nt, Human
ccuucucgcuccuccagccccag

SEQ ID NO: 446825 - RNA, 24 nt, Human
cgagaccauccuggcuaacacggu

SEQ ID NO: 446826 - RNA, 26 nt, Human
cgccacugcacuccagccuggacgac

SEQ ID NO: 446827 - RNA, 21 nt, Human
cgggcaccuguagucccagcu

SEQ ID NO: 446828 - RNA, 21 nt, Human
cuaaucugcuccaacaucuaa

SEQ ID NO: 446829 - RNA, 23 nt, Human
cucaugccuguaaucccagcacu

SEQ ID NO: 446830 - RNA, 24 nt, Human
cucaugccuguaaucccagcacuu

SEQ ID NO: 446831 - RNA, 19 nt, Human
cucccggccugcacauccc

SEQ ID NO: 446832 - RNA, 23 nt, Human
cucguucgccaccaagucuucca

SEQ ID NO: 446833 - RNA, 21 nt, Human
cugcggccccgacccccggcc

SEQ ID NO: 446834 - RNA, 25 nt, Human
cuggccgccggaccagccggcugcu

SEQ ID NO: 446835 - RNA, 18 nt, Human
cuggcuaacacggugaaa

SEQ ID NO: 446836 - RNA, 19 nt, Human
cuuccgcccccagcuccuc

SEQ ID NO: 446837 - RNA, 21 nt, Human
cuuugaauuucaugagagccu

SEQ ID NO: 446838 - RNA, 21 nt, Human
cuuugaauuucaugagagccu

SEQ ID NO: 446839 - RNA, 18 nt, Human
gaaguggagcuugcagug

SEQ ID NO: 446840 - RNA, 25 nt, Human
gacaauaaacauuaauauaauucca

SEQ ID NO: 446841 - RNA, 23 nt, Human
gagauugcgccacugcacuccag

SEQ ID NO: 446842 - RNA, 21 nt, Human
gaguuuuaggaugcuauugaa

SEQ ID NO: 446843 - RNA, 24 nt, Human
gcacuccagccuggacgacagagu

SEQ ID NO: 446844 - RNA, 22 nt, Human
gcaggaaaauggcaugaaccca

SEQ ID NO: 446845 - RNA, 27 nt, Human
gcccccgcccuagccuggccgccggac

SEQ ID NO: 446846 - RNA, 18 nt, Human
gcuccuccgcagacaccc

SEQ ID NO: 446847 - RNA, 19 nt, Human
ggcaccuguagucccagcu

SEQ ID NO: 446848 - RNA, 21 nt, Human
ggcggaucacaaggucaggag

SEQ ID NO: 446849 - RNA, 21 nt, Human
ggcgggcaccuguagucccag

SEQ ID NO: 446850 - RNA, 22 nt, Human
ggcgugguggcgggcaccugua

SEQ ID NO: 446851 - RNA, 23 nt, Human
ggcgugguggcucaugccuguaa

SEQ ID NO: 446852 - RNA, 24 nt, Human
gguggcucaugccuguaaucccag

SEQ ID NO: 446853 - RNA, 24 nt, Human
uaaaaauuguuuaaagcagacaac

SEQ ID NO: 446854 - RNA, 24 nt, Human
uaaacaugacauucuaacaaccaa

SEQ ID NO: 446855 - RNA, 19 nt, Human
uaacacggugaaaccgucu

SEQ ID NO: 446856 - RNA, 22 nt, Human
uaacacggugaaaccgucucua

SEQ ID NO: 446857 - RNA, 19 nt, Human
uaacucucugaggcaggau

SEQ ID NO: 446858 - RNA, 26 nt, Human
uaauugccaaaucuauauuggacaga

SEQ ID NO: 446859 - RNA, 24 nt, Human
uacacacaggacaaaaucaucaua

SEQ ID NO: 446860 - RNA, 20 nt, Human
uacaguuaaaccccuaggac

SEQ ID NO: 446861 - RNA, 22 nt, Human
uagccgccgucaccccgucuca

SEQ ID NO: 446862 - RNA, 19 nt, Human
uagccgggcgugguggcuc

SEQ ID NO: 446863 - RNA, 24 nt, Human
uagccgggcgugguggcucaugcc

SEQ ID NO: 446864 - RNA, 21 nt, Human
uagccucaucuuccgccccca

SEQ ID NO: 446865 - RNA, 20 nt, Human
uaggaugcuauugaaggaaa

SEQ ID NO: 446866 - RNA, 21 nt, Human
uauaagaaaucaccuugguua

SEQ ID NO: 446867 - RNA, 23 nt, Human
uaucuuuaaugucuaugcuaaau

SEQ ID NO: 446868 - RNA, 19 nt, Human
ucaagucauuuuccagaga

SEQ ID NO: 446869 - RNA, 18 nt, Human
ucacaaggucaggagauc

SEQ ID NO: 446870 - RNA, 24 nt, Human
ucacaaggucaggagaucgagacc

SEQ ID NO: 446871 - RNA, 18 nt, Human
ucacacaaaaauauguca

SEQ ID NO: 446872 - RNA, 22 nt, Human
ucacauccacuuacacagaccc

SEQ ID NO: 446873 - RNA, 18 nt, Human
uccaaaccuuacuguccc

SEQ ID NO: 446874 - RNA, 23 nt, Human
uccaaaccuuacuguccccgucu

SEQ ID NO: 446875 - RNA, 23 nt, Human
uccaacgaucccccuuccuccaa

SEQ ID NO: 446876 - RNA, 27 nt, Human
uccaacgaucccccuuccuccaaaccu

SEQ ID NO: 446877 - RNA, 24 nt, Human
uccagccuggacgacagagucaga

SEQ ID NO: 446878 - RNA, 18 nt, Human
ucccggugcccgcccggg

SEQ ID NO: 446879 - RNA, 22 nt, Human
ucuaaucugcuccaacaucuaa

SEQ ID NO: 446880 - RNA, 24 nt, Human
ucuagccgggcgugguggcucaug

SEQ ID NO: 446881 - RNA, 21 nt, Human
ucuauugccagauucucucca

SEQ ID NO: 446882 - RNA, 19 nt, Human
ucuccacuucuugcuacuu

SEQ ID NO: 446883 - RNA, 24 nt, Human
ucucuacuaaaaauacaaaaaauu

SEQ ID NO: 446884 - RNA, 23 nt, Human
ucugaaaaacuaccuuuaguggg

SEQ ID NO: 446885 - RNA, 21 nt, Human
ucugacuuggaggaaauaggc

SEQ ID NO: 446886 - RNA, 22 nt, Human
ucuucaaauucaacauuucauc

SEQ ID NO: 446887 - RNA, 22 nt, Human
ugaagaaaacccuucucgcucc

SEQ ID NO: 446888 - RNA, 22 nt, Human
ugaagccaagccguuagccucc

SEQ ID NO: 446889 - RNA, 24 nt, Human
ugaaugcugcucuaaucugcucca

SEQ ID NO: 446890 - RNA, 24 nt, Human
ugaggcaggaaaauggcaugaacc

SEQ ID NO: 446891 - RNA, 19 nt, Human
ugaggcaggaugcaggucc

SEQ ID NO: 446892 - RNA, 23 nt, Human
ugaggcaggaugcagguccugac

SEQ ID NO: 446893 - RNA, 24 nt, Human
ugaggcgggcggaucacaagguca

SEQ ID NO: 446894 - RNA, 25 nt, Human
ugaggcgggcggaucacaaggucag

SEQ ID NO: 446895 - RNA, 23 nt, Human
ugccuguaaucccagcacuuugg

SEQ ID NO: 446896 - RNA, 24 nt, Human
ugccuguaaucccagcacuuuggg

SEQ ID NO: 446897 - RNA, 20 nt, Human
uggaggaaauaggcacaacu

SEQ ID NO: 446898 - RNA, 20 nt, Human
uggcacuauaaaugaaauua

SEQ ID NO: 446899 - RNA, 18 nt, Human
uggcacuucugcggcccc

SEQ ID NO: 446900 - RNA, 22 nt, Human
uggcgggcaccuguagucccag

SEQ ID NO: 446901 - RNA, 22 nt, Human
uggcucaugccuguaaucccag

SEQ ID NO: 446902 - RNA, 24 nt, Human
uggcucaugccuguaaucccagca

SEQ ID NO: 446903 - RNA, 19 nt, Human
ugggaggcugaggcgggcg

SEQ ID NO: 446904 - RNA, 20 nt, Human
ugggaggcugaggcgggcgg

SEQ ID NO: 446905 - RNA, 24 nt, Human
ugggaggcugaggcgggcggauca

SEQ ID NO: 446906 - RNA, 24 nt, Human
ugguggcgggcaccuguaguccca

SEQ ID NO: 446907 - RNA, 24 nt, Human
ugguggcucaugccuguaauccca

SEQ ID NO: 446908 - RNA, 22 nt, Human
uguacagugaaaaaaaugaaac

SEQ ID NO: 446909 - RNA, 21 nt, Human
uuaagaaaaacaaagaaguaa

SEQ ID NO: 446910 - RNA, 22 nt, Human
uuaaugcauuuuuaaaauuuaa

SEQ ID NO: 446911 - RNA, 18 nt, Human
uuagcugggcgugguggc

SEQ ID NO: 446912 - RNA, 24 nt, Human
uuagcugggcgugguggcgggcac

SEQ ID NO: 446913 - RNA, 18 nt, Human
uuccacggcuuuuccuug

SEQ ID NO: 446914 - RNA, 24 nt, Human
uucccuugauggauauaaaaagac

SEQ ID NO: 446915 - RNA, 26 nt, Human
uuccuugauccucacucacauccacu

SEQ ID NO: 446916 - RNA, 18 nt, Human
uucucuccacuucuugcu

SEQ ID NO: 446917 - RNA, 27 nt, Human
uucucuccacuucuugcuacuuccaac

SEQ ID NO: 446918 - RNA, 19 nt, Human
uucuuaguucgagugaaca

SEQ ID NO: 446919 - RNA, 23 nt, Human
uugcgccacugcacuccagccug

SEQ ID NO: 446920 - RNA, 22 nt, Human
uugcuccauucuuucuaucaca

SEQ ID NO: 446921 - RNA, 25 nt, Human
uugggaggcugaggcgggcggauca

SEQ ID NO: 446922 - RNA, 21 nt, Human
uuuggcaaggacaauaaacau

SEQ ID NO: 446923 - RNA, 21 nt, Human
acaaagcugcagaagagggcu

SEQ ID NO: 446924 - RNA, 20 nt, Human
acagggugaagugcaggcac

SEQ ID NO: 446925 - RNA, 18 nt, Human
aggcaggauguggagcgg

SEQ ID NO: 446926 - RNA, 19 nt, Human
cacccagcagccacugauc

SEQ ID NO: 446927 - RNA, 24 nt, Human
cagggcuggagagaagcaaggggg

SEQ ID NO: 446928 - RNA, 20 nt, Human
cagggugaagugcaggcacc

SEQ ID NO: 446929 - RNA, 18 nt, Human
caucuccagcagcggcac

SEQ ID NO: 446930 - RNA, 20 nt, Human
ccaaaaggggccugggccaa

SEQ ID NO: 446931 - RNA, 21 nt, Human
ccccagcauccuuccucagcu

SEQ ID NO: 446932 - RNA, 26 nt, Human
ccccagcauccuuccucagcugccuc

SEQ ID NO: 446933 - RNA, 21 nt, Human
ccugggccagggcugaggggc

SEQ ID NO: 446934 - RNA, 19 nt, Human
cugcacagggugaagugca

SEQ ID NO: 446935 - RNA, 20 nt, Human
cugggccagggcugaggggc

SEQ ID NO: 446936 - RNA, 21 nt, Human
cugugugcacggccccauccc

SEQ ID NO: 446937 - RNA, 21 nt, Human
cuugcuggacagggcuggaga

SEQ ID NO: 446938 - RNA, 19 nt, Human
gagaagcaagggggcuggg

SEQ ID NO: 446939 - RNA, 22 nt, Human
gagaagcaagggggcuggggag

SEQ ID NO: 446940 - RNA, 19 nt, Human
gcagaagagggcuuucccc

SEQ ID NO: 446941 - RNA, 26 nt, Human
gcauccuuccucagcugccuccaaaa

SEQ ID NO: 446942 - RNA, 21 nt, Human
gccccaucccaccucucugca

SEQ ID NO: 446943 - RNA, 19 nt, Human
gccuuccacaaagcugcag

SEQ ID NO: 446944 - RNA, 28 nt, Human
gggcaggcaggauguggagcgggcaucc

SEQ ID NO: 446945 - RNA, 21 nt, Human
gggcuggggagaguggccggu

SEQ ID NO: 446946 - RNA, 20 nt, Human
guggagcgggcaucccugug

SEQ ID NO: 446947 - RNA, 21 nt, Human
ucccugugugcacggccccau

SEQ ID NO: 446948 - RNA, 22 nt, Human
uccuuccucagcugccuccaaa

SEQ ID NO: 446949 - RNA, 20 nt, Human
ugaggggcaggcaggaugug

SEQ ID NO: 446950 - RNA, 24 nt, Human
uggacagggcuggagagaagcaag

SEQ ID NO: 446951 - RNA, 21 nt, Human
uggagagaagcaagggggcug

SEQ ID NO: 446952 - RNA, 23 nt, Human
uggagagaagcaagggggcuggg

SEQ ID NO: 446953 - RNA, 22 nt, Human
uuccccagcauccuuccucagc

SEQ ID NO: 446954 - RNA, 21 nt, Human
aaaaacaacaacaauaacaac

SEQ ID NO: 446955 - RNA, 23 nt, Human
aaaaucagccagaaagcaggcug

SEQ ID NO: 446956 - RNA, 21 nt, Human
aaaguuaugacagaaugaacu

SEQ ID NO: 446957 - RNA, 23 nt, Human
aaauaacaaaaucagccagaaag

SEQ ID NO: 446958 - RNA, 22 nt, Human
aacaaaaucagccagaaagcag

SEQ ID NO: 446959 - RNA, 23 nt, Human
aacaacaacaauaacaacaaaaa

SEQ ID NO: 446960 - RNA, 21 nt, Human
aacagcuuaaauaaacuggua

SEQ ID NO: 446961 - RNA, 19 nt, Human
aacauggagaaaccccauc

SEQ ID NO: 446962 - RNA, 20 nt, Human
aacauggagaaaccccaucu

SEQ ID NO: 446963 - RNA, 21 nt, Human
aacauggagaaaccccaucuc

SEQ ID NO: 446964 - RNA, 22 nt, Human
aagaauaugaauacaaauuugu

SEQ ID NO: 446965 - RNA, 26 nt, Human
aauaacaaaaucagccagaaagcagg

SEQ ID NO: 446966 - RNA, 20 nt, Human
aauauaaacacuccaaagag

SEQ ID NO: 446967 - RNA, 23 nt, Human
aaucgcuugaaccugggaggugg

SEQ ID NO: 446968 - RNA, 24 nt, Human
aauuuauaauauacauguacuuca

SEQ ID NO: 446969 - RNA, 22 nt, Human
aauuuguaauauaaacacucca

SEQ ID NO: 446970 - RNA, 25 nt, Human
acagagcaaaucaaacucuuaggaa

SEQ ID NO: 446971 - RNA, 24 nt, Human
accccaucucuacuaaaaauacaa

SEQ ID NO: 446972 - RNA, 21 nt, Human
acccugaaauuaugaaaggaa

SEQ ID NO: 446973 - RNA, 24 nt, Human
acccugaaauuaugaaaggaaaaa

SEQ ID NO: 446974 - RNA, 25 nt, Human
acuccagccugggcaacaagaguga

SEQ ID NO: 446975 - RNA, 19 nt, Human
acugguuaauugaaccaaa

SEQ ID NO: 446976 - RNA, 18 nt, Human
acugugagagaugaaaaa

SEQ ID NO: 446977 - RNA, 21 nt, Human
agaaagcaggcugaaaagcau

SEQ ID NO: 446978 - RNA, 22 nt, Human
agaaucgcuugaaccugggagg

SEQ ID NO: 446979 - RNA, 23 nt, Human
agaaugaacugaagacacgaaca

SEQ ID NO: 446980 - RNA, 24 nt, Human
agcacuuugggaggcugaggcagg

SEQ ID NO: 446981 - RNA, 22 nt, Human
agccaggcguagugacaaagcc

SEQ ID NO: 446982 - RNA, 23 nt, Human
agccuguaauuccagcuacuugg

SEQ ID NO: 446983 - RNA, 24 nt, Human
agccuguaauuccagcuacuuggg

SEQ ID NO: 446984 - RNA, 18 nt, Human
agcuuaaauaaacuggua

SEQ ID NO: 446985 - RNA, 20 nt, Human
aggaaaaaauuggcuuaaaa

SEQ ID NO: 446986 - RNA, 22 nt, Human
aggcaggagaaucgcuugaacc

SEQ ID NO: 446987 - RNA, 24 nt, Human
aggcaggagaaucgcuugaaccug

SEQ ID NO: 446988 - RNA, 18 nt, Human
aggcaggcggaucaccug

SEQ ID NO: 446989 - RNA, 21 nt, Human
aggcaggcggaucaccugagg

SEQ ID NO: 446990 - RNA, 22 nt, Human
aggcaggcggaucaccugaggu

SEQ ID NO: 446991 - RNA, 26 nt, Human
aggcaggcggaucaccugagguuggg

SEQ ID NO: 446992 - RNA, 18 nt, Human
aggcguagugacaaagcc

SEQ ID NO: 446993 - RNA, 23 nt, Human
aggcguagugacaaagccuguaa

SEQ ID NO: 446994 - RNA, 20 nt, Human
aggcugaggcaggagaaucg

SEQ ID NO: 446995 - RNA, 24 nt, Human
aggcugaggcaggagaaucgcuug

SEQ ID NO: 446996 - RNA, 21 nt, Human
aggcugaggcaggcggaucac

SEQ ID NO: 446997 - RNA, 24 nt, Human
aggcugaggcaggcggaucaccug

SEQ ID NO: 446998 - RNA, 21 nt, Human
aggugacagaaauugccacag

SEQ ID NO: 446999 - RNA, 24 nt, Human
aggugcaguggcucacgccuguaa

SEQ ID NO: 447000 - RNA, 24 nt, Human
agguggggguuguggugagccgag

SEQ ID NO: 447001 - RNA, 23 nt, Human
aguaauauagaacagguuaagaa

SEQ ID NO: 447002 - RNA, 24 nt, Human
aguggcucacgccuguaaucgcag

SEQ ID NO: 447003 - RNA, 21 nt, Human
aucaaauaacaaaaucagcca

SEQ ID NO: 447004 - RNA, 21 nt, Human
aucaccugagguugggaguuc

SEQ ID NO: 447005 - RNA, 24 nt, Human
aucgcgccauugcacuccagccug

SEQ ID NO: 447006 - RNA, 22 nt, Human
aucuugguucugaaguuaaaau

SEQ ID NO: 447007 - RNA, 19 nt, Human
augaaaaguuauauaaccu

SEQ ID NO: 447008 - RNA, 21 nt, Human
augaaguauacuacugaaccc

SEQ ID NO: 447009 - RNA, 21 nt, Human
auuccagagcuagaaaugauc

SEQ ID NO: 447010 - RNA, 24 nt, Human
auugcacuccagccugggcaacaa

SEQ ID NO: 447011 - RNA, 26 nt, Human
caaaaacaacaacaauaacaacaaaa

SEQ ID NO: 447012 - RNA, 31 nt, Human
caaaacucauuacaaucacagaauuccagag

SEQ ID NO: 447013 - RNA, 20 nt, Human
caaauccagccuguuugcaa

SEQ ID NO: 447014 - RNA, 18 nt, Human
caacaaauucuaauugua

SEQ ID NO: 447015 - RNA, 22 nt, Human
caacaacaauaacaacaaaaaa

SEQ ID NO: 447016 - RNA, 26 nt, Human
caacaacaauaacaacaaaaaaccuu

SEQ ID NO: 447017 - RNA, 19 nt, Human
caacaucccaagcauggcc

SEQ ID NO: 447018 - RNA, 23 nt, Human
caacauuaucaacucacuuuagc

SEQ ID NO: 447019 - RNA, 20 nt, Human
caaccuagaaacaguuuaua

SEQ ID NO: 447020 - RNA, 24 nt, Human
caacgucggucuccuccgucuccu

SEQ ID NO: 447021 - RNA, 18 nt, Human
caauagguauaaguaaua

SEQ ID NO: 447022 - RNA, 24 nt, Human
cacgccuguaaucgcagcacuuug

SEQ ID NO: 447023 - RNA, 23 nt, Human
cacuccagccugggcaacaagag

SEQ ID NO: 447024 - RNA, 24 nt, Human
cacuccagccugggcaacaagagu

SEQ ID NO: 447025 - RNA, 25 nt, Human
cacuccagccugggcaacaagagug

SEQ ID NO: 447026 - RNA, 22 nt, Human
cacucucgcucgccucucuucc

SEQ ID NO: 447027 - RNA, 21 nt, Human
cagaaagcaggcugaaaagca

SEQ ID NO: 447028 - RNA, 24 nt, Human
cagcacuuugggaggcugaggcag

SEQ ID NO: 447029 - RNA, 26 nt, Human
cagcacuuugggaggcugaggcaggc

SEQ ID NO: 447030 - RNA, 24 nt, Human
cagcaggaccaacauggagaaacc

SEQ ID NO: 447031 - RNA, 24 nt, Human
cagcuacuugggaggcugaggcag

SEQ ID NO: 447032 - RNA, 24 nt, Human
caggaccaacauggagaaaccccc

SEQ ID NO: 447033 - RNA, 20 nt, Human
caucauagaucuuuugaaca

SEQ ID NO: 447034 - RNA, 18 nt, Human
caucucaaaauacagauc

SEQ ID NO: 447035 - RNA, 18 nt, Human
cauugcacuccagccugg

SEQ ID NO: 447036 - RNA, 19 nt, Human
cauugcacuccagccuggg

SEQ ID NO: 447037 - RNA, 21 nt, Human
cauugcacuccagccugggca

SEQ ID NO: 447038 - RNA, 24 nt, Human
cauugcacuccagccugggcaaca

SEQ ID NO: 447039 - RNA, 22 nt, Human
ccagaaagcaggcugaaaagca

SEQ ID NO: 447040 - RNA, 20 nt, Human
ccauugcacuccagccuggg

SEQ ID NO: 447041 - RNA, 21 nt, Human
ccauugcacuccagccugggc

SEQ ID NO: 447042 - RNA, 23 nt, Human
ccauugcacuccagccugggcaa

SEQ ID NO: 447043 - RNA, 24 nt, Human
ccauugcacuccagccugggcaac

SEQ ID NO: 447044 - RNA, 19 nt, Human
ccccaaaagcagcagucac

SEQ ID NO: 447045 - RNA, 22 nt, Human
ccgcagccgccgccuccuccuc

SEQ ID NO: 447046 - RNA, 19 nt, Human
ccgucccgcagccgccgcc

SEQ ID NO: 447047 - RNA, 19 nt, Human
ccugaaauuauaaaauacu

SEQ ID NO: 447048 - RNA, 22 nt, Human
ccuguaaucgcagcacuuuggg

SEQ ID NO: 447049 - RNA, 24 nt, Human
ccuguaaucgcagcacuuugggag

SEQ ID NO: 447050 - RNA, 21 nt, Human
ccuguaauuccagcuacuugg

SEQ ID NO: 447051 - RNA, 24 nt, Human
cgccauugcacuccagccugggca

SEQ ID NO: 447052 - RNA, 23 nt, Human
cgccuguaaucgcagcacuuugg

SEQ ID NO: 447053 - RNA, 18 nt, Human
cgcucgccucucuuccuc

SEQ ID NO: 447054 - RNA, 20 nt, Human
cgcuugaaccugggaggugg

SEQ ID NO: 447055 - RNA, 24 nt, Human
cggaucaccugagguugggaguuc

SEQ ID NO: 447056 - RNA, 21 nt, Human
cggcagggggggggggggcag

SEQ ID NO: 447057 - RNA, 20 nt, Human
cgucggucuccuccgucucc

SEQ ID NO: 447058 - RNA, 24 nt, Human
cucacgccuguaaucgcagcacuu

SEQ ID NO: 447059 - RNA, 18 nt, Human
cuccuccgucuccuccuc

SEQ ID NO: 447060 - RNA, 22 nt, Human
cucuuuucagccuacuuccaaa

SEQ ID NO: 447061 - RNA, 21 nt, Human
cugguaccaacaucaaaggaa

SEQ ID NO: 447062 - RNA, 22 nt, Human
cugugugcuuugcaauaggaau

SEQ ID NO: 447063 - RNA, 21 nt, Human
gaaaaaacagagcaaaucaaa

SEQ ID NO: 447064 - RNA, 25 nt, Human
gaaaauucucuuuucagccuacuuc

SEQ ID NO: 447065 - RNA, 23 nt, Human
gagaucgcgccauugcacuccag

SEQ ID NO: 447066 - RNA, 24 nt, Human
gaucaccugagguugggaguucga

SEQ ID NO: 447067 - RNA, 19 nt, Human
gcagggggggggggggcag

SEQ ID NO: 447068 - RNA, 22 nt, Human
gccauugcacuccagccugggc

SEQ ID NO: 447069 - RNA, 24 nt, Human
gccauugcacuccagccugggcaa

SEQ ID NO: 447070 - RNA, 22 nt, Human
gccuccuccuccacucucgcuc

SEQ ID NO: 447071 - RNA, 21 nt, Human
gcggaucaccugagguuggga

SEQ ID NO: 447072 - RNA, 21 nt, Human
gcuucucauucugaaaauaaa

SEQ ID NO: 447073 - RNA, 22 nt, Human
ggaaaaaacagagcaaaucaaa

SEQ ID NO: 447074 - RNA, 18 nt, Human
ggagauaaguuuggggga

SEQ ID NO: 447075 - RNA, 23 nt, Human
ggaucaccugagguugggaguuc

SEQ ID NO: 447076 - RNA, 18 nt, Human
ggcagggggggggggggc

SEQ ID NO: 447077 - RNA, 18 nt, Human
ggccaggugcaguggcuc

SEQ ID NO: 447078 - RNA, 21 nt, Human
ggccaggugcaguggcucacg

SEQ ID NO: 447079 - RNA, 18 nt, Human
ggccucaguagccugaaa

SEQ ID NO: 447080 - RNA, 20 nt, Human
ggggaaggugcaaggugggu

SEQ ID NO: 447081 - RNA, 24 nt, Human
ggggguuguggugagccgagaucg

SEQ ID NO: 447082 - RNA, 21 nt, Human
gggguuguggugagccgagau

SEQ ID NO: 447083 - RNA, 22 nt, Human
gggguuguggugagccgagauc

SEQ ID NO: 447084 - RNA, 23 nt, Human
gggguuguggugagccgagaucg

SEQ ID NO: 447085 - RNA, 24 nt, Human
gguaccaacaucaaaggaaaaaau

SEQ ID NO: 447086 - RNA, 19 nt, Human
guacaacacaucacagaaa

SEQ ID NO: 447087 - RNA, 22 nt, Human
gugacaaauuguauugaguuuc

SEQ ID NO: 447088 - RNA, 19 nt, Human
guuugggggaaggugcaag

SEQ ID NO: 447089 - RNA, 20 nt, Human
uaaaaauacaaaauuagcca

SEQ ID NO: 447090 - RNA, 22 nt, Human
uaaaaauacaaaauuagccagg

SEQ ID NO: 447091 - RNA, 23 nt, Human
uaaaaauacaaaauuagccaggc

SEQ ID NO: 447092 - RNA, 18 nt, Human
uaaauuaaagcuauauag

SEQ ID NO: 447093 - RNA, 19 nt, Human
uaacaaaaucagccagaaa

SEQ ID NO: 447094 - RNA, 23 nt, Human
uaacacaaauaagauaauuuaua

SEQ ID NO: 447095 - RNA, 22 nt, Human
uaauuguauauguaacuucuuu

SEQ ID NO: 447096 - RNA, 21 nt, Human
uacaaucacagaauuccagag

SEQ ID NO: 447097 - RNA, 21 nt, Human
uacagaaaugugaaauauguc

SEQ ID NO: 447098 - RNA, 22 nt, Human
uacagaauuaacaguauacaaa

SEQ ID NO: 447099 - RNA, 18 nt, Human
uacccccaaaagcagcag

SEQ ID NO: 447100 - RNA, 19 nt, Human
uaccugugccaccuauucu

SEQ ID NO: 447101 - RNA, 20 nt, Human
uacuaaauguguuccccaag

SEQ ID NO: 447102 - RNA, 24 nt, Human
uagugacaaagccuguaauuccag

SEQ ID NO: 447103 - RNA, 18 nt, Human
uauacuaaauguguuccc

SEQ ID NO: 447104 - RNA, 18 nt, Human
uaugcuucucauucugaa

SEQ ID NO: 447105 - RNA, 22 nt, Human
uauguugcugacuaacccugaa

SEQ ID NO: 447106 - RNA, 24 nt, Human
uauuucauuauggaccauaaagaa

SEQ ID NO: 447107 - RNA, 22 nt, Human
uauuuuaggaaaaaacagagca

SEQ ID NO: 447108 - RNA, 22 nt, Human
uauuuucuacacuauacuaaau

SEQ ID NO: 447109 - RNA, 20 nt, Human
ucaaauaacaaaaucagcca

SEQ ID NO: 447110 - RNA, 24 nt, Human
ucaaauaacaaaaucagccagaaa

SEQ ID NO: 447111 - RNA, 22 nt, Human
ucaaaucauccacggguuuacu

SEQ ID NO: 447112 - RNA, 19 nt, Human
ucaacagcagccugguuca

SEQ ID NO: 447113 - RNA, 18 nt, Human
ucaccugagguugggagu

SEQ ID NO: 447114 - RNA, 23 nt, Human
ucaggcuuuuuuccuguacauag

SEQ ID NO: 447115 - RNA, 19 nt, Human
uccagagcuagaaaugauc

SEQ ID NO: 447116 - RNA, 23 nt, Human
ucccuaacaacgucggucuccuc

SEQ ID NO: 447117 - RNA, 23 nt, Human
ucccucauuucugugcagaaaca

SEQ ID NO: 447118 - RNA, 18 nt, Human
uccuacuucaaaccuggg

SEQ ID NO: 447119 - RNA, 23 nt, Human
ucgacaccagcaggaccaacaug

SEQ ID NO: 447120 - RNA, 23 nt, Human
ucgcgccauugcacuccagccug

SEQ ID NO: 447121 - RNA, 23 nt, Human
ucgcuugaaccugggaggugggg

SEQ ID NO: 447122 - RNA, 20 nt, Human
ucucuacuaaaaauacaaaa

SEQ ID NO: 447123 - RNA, 18 nt, Human
ugaaaaacgguaaaugcc

SEQ ID NO: 447124 - RNA, 19 nt, Human
ugaaaaacgguaaaugcca

SEQ ID NO: 447125 - RNA, 19 nt, Human
ugaaaauaaaaucaucucc

SEQ ID NO: 447126 - RNA, 18 nt, Human
ugaaaaucaucuauuuac

SEQ ID NO: 447127 - RNA, 19 nt, Human
ugaaccugggagguggggg

SEQ ID NO: 447128 - RNA, 27 nt, Human
ugaaccugggagguggggguugugacg

SEQ ID NO: 447129 - RNA, 25 nt, Human
ugaagacacgaacaguuuugaaaau

SEQ ID NO: 447130 - RNA, 19 nt, Human
ugaaguauacuacugaacc

SEQ ID NO: 447131 - RNA, 21 nt, Human
ugaaguauacuacugaacccu

SEQ ID NO: 447132 - RNA, 25 nt, Human
ugaaguauacuacugaacccugaaa

SEQ ID NO: 447133 - RNA, 22 nt, Human
ugaagugaaauuccgucucaaa

SEQ ID NO: 447134 - RNA, 21 nt, Human
ugacaaagccuguaauuccag

SEQ ID NO: 447135 - RNA, 23 nt, Human
ugacagaaugaacugaagacacg

SEQ ID NO: 447136 - RNA, 22 nt, Human
ugagccgagaucgcgccauugc

SEQ ID NO: 447137 - RNA, 20 nt, Human
ugaggcaggagaaucgcuug

SEQ ID NO: 447138 - RNA, 24 nt, Human
ugaggcaggagaaucgcuugaacc

SEQ ID NO: 447139 - RNA, 24 nt, Human
ugaggcaggagaaucgcuugaacc

SEQ ID NO: 447140 - RNA, 20 nt, Human
ugaggcaggcggaucaccug

SEQ ID NO: 447141 - RNA, 21 nt, Human
ugaggcaggcggaucaccuga

SEQ ID NO: 447142 - RNA, 26 nt, Human
ugaggcaggcggaucaccugagguug

SEQ ID NO: 447143 - RNA, 19 nt, Human
ugcacuccagccugggcaa

SEQ ID NO: 447144 - RNA, 22 nt, Human
ugcacuccagccugggcaacaa

SEQ ID NO: 447145 - RNA, 19 nt, Human
ugccagaauguaaauuaag

SEQ ID NO: 447146 - RNA, 24 nt, Human
uggagauaaguuugggggaaggug

SEQ ID NO: 447147 - RNA, 19 nt, Human
uggauuuuaguacaacaca

SEQ ID NO: 447148 - RNA, 18 nt, Human
uggcucacgccuguaauc

SEQ ID NO: 447149 - RNA, 22 nt, Human
uggcucacgccuguaaucgcag

SEQ ID NO: 447150 - RNA, 24 nt, Human
uggcucacgccuguaaucgcagca

SEQ ID NO: 447151 - RNA, 19 nt, Human
ugggaggcugaggcaggag

SEQ ID NO: 447152 - RNA, 23 nt, Human
ugggaggcugaggcaggagaauc

SEQ ID NO: 447153 - RNA, 20 nt, Human
ugggaggcugaggcaggcgg

SEQ ID NO: 447154 - RNA, 24 nt, Human
ugggaggcugaggcaggcggauca

SEQ ID NO: 447155 - RNA, 19 nt, Human
uguaaauuaaguugcccaa

SEQ ID NO: 447156 - RNA, 19 nt, Human
uguacuuucuuaauuccug

SEQ ID NO: 447157 - RNA, 18 nt, Human
uguguaaaagaaauaggu

SEQ ID NO: 447158 - RNA, 19 nt, Human
uguguaaaagaaauagguu

SEQ ID NO: 447159 - RNA, 20 nt, Human
uguguaaaagaaauagguuc

SEQ ID NO: 447160 - RNA, 21 nt, Human
uuagcaauggguuuuuuggau

SEQ ID NO: 447161 - RNA, 20 nt, Human
uuccaaauagaaauagucag

SEQ ID NO: 447162 - RNA, 21 nt, Human
uuccugaugugacaaauugua

SEQ ID NO: 447163 - RNA, 21 nt, Human
uuccugggccaggugcagugg

SEQ ID NO: 447164 - RNA, 24 nt, Human
uugaaccugggagguggggguugu

SEQ ID NO: 447165 - RNA, 19 nt, Human
uugcaugcagcagcagcuu

SEQ ID NO: 447166 - RNA, 23 nt, Human
uugcugacuaacccugaaauuau

SEQ ID NO: 447167 - RNA, 24 nt, Human
uugggaggcugaggcaggagaauc

SEQ ID NO: 447168 - RNA, 25 nt, Human
uugggaggcugaggcaggcggauca

SEQ ID NO: 447169 - RNA, 23 nt, Human
uugggggaaggugcaaggugggu

SEQ ID NO: 447170 - RNA, 19 nt, Human
uugguauguguguaaaaga

SEQ ID NO: 447171 - RNA, 18 nt, Human
uuguggugagccgagauc

SEQ ID NO: 447172 - RNA, 22 nt, Human
uuguggugagccgagaucgcgc

SEQ ID NO: 447173 - RNA, 22 nt, Human
uuuaggaaaaaacagagcaaau

SEQ ID NO: 447174 - RNA, 26 nt, Human
aaaaacucaaggccagcugugaggcc

SEQ ID NO: 447175 - RNA, 22 nt, Human
aagucucacucacacacacgcc

SEQ ID NO: 447176 - RNA, 22 nt, Human
acagaaauacaaagugaccaag

SEQ ID NO: 447177 - RNA, 21 nt, Human
accccaggcaggaggagacag

SEQ ID NO: 447178 - RNA, 19 nt, Human
acugcacccagcacagcag

SEQ ID NO: 447179 - RNA, 21 nt, Human
agacaggugugcuggagucug

SEQ ID NO: 447180 - RNA, 23 nt, Human
aggaggagacaggugugcuggaa

SEQ ID NO: 447181 - RNA, 25 nt, Human
aggcaggaggagacaggugugcugg

SEQ ID NO: 447182 - RNA, 26 nt, Human
aggcaggaggagacaggugugcugga

SEQ ID NO: 447183 - RNA, 18 nt, Human
aggccccuggcagcaccu

SEQ ID NO: 447184 - RNA, 24 nt, Human
aggccccuggcagcaccugcccaa

SEQ ID NO: 447185 - RNA, 23 nt, Human
aggccuuugucacauaccagacc

SEQ ID NO: 447186 - RNA, 18 nt, Human
aguaaaaacucaaggcca

SEQ ID NO: 447187 - RNA, 19 nt, Human
agucuggucacuuuggggc

SEQ ID NO: 447188 - RNA, 18 nt, Human
agugagagccacacaggu

SEQ ID NO: 447189 - RNA, 20 nt, Human
auacaagugcacagacaggu

SEQ ID NO: 447190 - RNA, 24 nt, Human
caaaacauacaagugcacagacag

SEQ ID NO: 447191 - RNA, 23 nt, Human
cacagguagguacacucggcaca

SEQ ID NO: 447192 - RNA, 21 nt, Human
caccaccgagggccucuuccu

SEQ ID NO: 447193 - RNA, 21 nt, Human
cacccccgcacacagggacgu

SEQ ID NO: 447194 - RNA, 24 nt, Human
cacccccuuccauccccauggcca

SEQ ID NO: 447195 - RNA, 22 nt, Human
caccuggccccuccccggacgu

SEQ ID NO: 447196 - RNA, 21 nt, Human
cacugcuuaaccucagucuuc

SEQ ID NO: 447197 - RNA, 22 nt, Human
cacuuuggggcccggcgugggc

SEQ ID NO: 447198 - RNA, 19 nt, Human
cagaugccuccacucaccc

SEQ ID NO: 447199 - RNA, 21 nt, Human
ccaaccaagacagaaauacaa

SEQ ID NO: 447200 - RNA, 19 nt, Human
ccacugggccugacuggcg

SEQ ID NO: 447201 - RNA, 20 nt, Human
ccacugggccugacuggcgc

SEQ ID NO: 447202 - RNA, 27 nt, Human
ccagacccacacaagugagagccacac

SEQ ID NO: 447203 - RNA, 18 nt, Human
ccccauggccaccccagg

SEQ ID NO: 447204 - RNA, 19 nt, Human
ccccgccggcccccaccug

SEQ ID NO: 447205 - RNA, 20 nt, Human
ccccgccggcccccaccugc

SEQ ID NO: 447206 - RNA, 21 nt, Human
ccccuggguaaacgcugacuc

SEQ ID NO: 447207 - RNA, 22 nt, Human
cccugggcccacugcuuaaccu

SEQ ID NO: 447208 - RNA, 23 nt, Human
cccugggcccacugcuuaaccuc

SEQ ID NO: 447209 - RNA, 18 nt, Human
ccgagcaaggaaggcuga

SEQ ID NO: 447210 - RNA, 21 nt, Human
ccggcccccaccugcgugccg

SEQ ID NO: 447211 - RNA, 26 nt, Human
ccggcccccgucucuggcccggcccc

SEQ ID NO: 447212 - RNA, 18 nt, Human
ccuggcagcaccugccca

SEQ ID NO: 447213 - RNA, 20 nt, Human
ccuugucucucugcagcucu

SEQ ID NO: 447214 - RNA, 21 nt, Human
ccuuugucacauaccagaccc

SEQ ID NO: 447215 - RNA, 23 nt, Human
cgccgccuugucucucugcagcu

SEQ ID NO: 447216 - RNA, 24 nt, Human
cgcgggcagaugccuccacucacc

SEQ ID NO: 447217 - RNA, 19 nt, Human
cgggaguggagggccuggg

SEQ ID NO: 447218 - RNA, 20 nt, Human
cgugggcagagcccacuggg

SEQ ID NO: 447219 - RNA, 27 nt, Human
cucacacacacgccacauggacacccc

SEQ ID NO: 447220 - RNA, 18 nt, Human
gacagggcuggcgggacg

SEQ ID NO: 447221 - RNA, 23 nt, Human
gaccugggccgagcaaggaaggc

SEQ ID NO: 447222 - RNA, 19 nt, Human
gagcaaggaaggcugaugg

SEQ ID NO: 447223 - RNA, 22 nt, Human
gagggccugggcucaggccccu

SEQ ID NO: 447224 - RNA, 23 nt, Human
gccaauucccaggccuuugucac

SEQ ID NO: 447225 - RNA, 22 nt, Human
gccuugucucucugcagcucug

SEQ ID NO: 447226 - RNA, 23 nt, Human
gcgggcagaugccuccacucacc

SEQ ID NO: 447227 - RNA, 21 nt, Human
ggcacagggaacuuggcucag

SEQ ID NO: 447228 - RNA, 19 nt, Human
ggccugggcucaggccccu

SEQ ID NO: 447229 - RNA, 19 nt, Human
ggcuggggcaggaggagcg

SEQ ID NO: 447230 - RNA, 19 nt, Human
ggcuggggcaggaggagcg

SEQ ID NO: 447231 - RNA, 18 nt, Human
gggaguggagggccuggg

SEQ ID NO: 447232 - RNA, 18 nt, Human
gggcuggggcaggaggag

SEQ ID NO: 447233 - RNA, 19 nt, Human
gugggcagagcccacuggg

SEQ ID NO: 447234 - RNA, 21 nt, Human
guuuuauuccacccccuucca

SEQ ID NO: 447235 - RNA, 18 nt, Human
uaagacccacacagguac

SEQ ID NO: 447236 - RNA, 21 nt, Human
uacaaaacauacaagugcaca

SEQ ID NO: 447237 - RNA, 19 nt, Human
uauuuuuacagaugccaag

SEQ ID NO: 447238 - RNA, 21 nt, Human
ucaacucacauccuagucuca

SEQ ID NO: 447239 - RNA, 24 nt, Human
ucaacucacauccuagucucauca

SEQ ID NO: 447240 - RNA, 23 nt, Human
uccaaccaagacagaaauacaaa

SEQ ID NO: 447241 - RNA, 26 nt, Human
uccaaccaagacagaaauacaaagug

SEQ ID NO: 447242 - RNA, 19 nt, Human
uccacccccuuccaucccc

SEQ ID NO: 447243 - RNA, 22 nt, Human
ucuaauggcugguuauuuuuac

SEQ ID NO: 447244 - RNA, 24 nt, Human
ucuauggcccugggcccacugcuu

SEQ ID NO: 447245 - RNA, 20 nt, Human
ucucugugggcaggugugga

SEQ ID NO: 447246 - RNA, 21 nt, Human
ugacacaggugagacccgcac

SEQ ID NO: 447247 - RNA, 23 nt, Human
ugacagguuuuauuccacccccu

SEQ ID NO: 447248 - RNA, 19 nt, Human
ugacgaggccgacagggcu

SEQ ID NO: 447249 - RNA, 21 nt, Human
ugacgaggccgacagggcugg

SEQ ID NO: 447250 - RNA, 21 nt, Human
ugacucagaugccugaaacag

SEQ ID NO: 447251 - RNA, 22 nt, Human
ugacucagaugccugaaacagg

SEQ ID NO: 447252 - RNA, 19 nt, Human
ugacuggcgcgggcagaug

SEQ ID NO: 447253 - RNA, 22 nt, Human
ugagaccccuacacguacgccu

SEQ ID NO: 447254 - RNA, 24 nt, Human
ugagacguucacaggugagacccc

SEQ ID NO: 447255 - RNA, 20 nt, Human
ugcacagacaggugugggag

SEQ ID NO: 447256 - RNA, 19 nt, Human
ugccugaaacagaccuggg

SEQ ID NO: 447257 - RNA, 18 nt, Human
ugccuggcacaagugaga

SEQ ID NO: 447258 - RNA, 20 nt, Human
uggcagcaccugcccaaggu

SEQ ID NO: 447259 - RNA, 20 nt, Human
uggcaguaaagggauuggcc

SEQ ID NO: 447260 - RNA, 21 nt, Human
uggcucagggucugcuccugg

SEQ ID NO: 447261 - RNA, 22 nt, Human
ugucacauaccagacccacaca

SEQ ID NO: 447262 - RNA, 26 nt, Human
ugugcuggagucuggucacuuugggg

SEQ ID NO: 447263 - RNA, 21 nt, Human
uguggcaguaaagggauuggc

SEQ ID NO: 447264 - RNA, 24 nt, Human
uucuauggcccugggcccacugcu

SEQ ID NO: 447265 - RNA, 23 nt, Human
uuuuuuuuuuuuuuuuuuucagg

SEQ ID NO: 447266 - RNA, 19 nt, Human
aaaacagaacaccagccuc

SEQ ID NO: 447267 - RNA, 21 nt, Human
aagcucccucacccaucccaa

SEQ ID NO: 447268 - RNA, 18 nt, Human
accaccuccucugcaguc

SEQ ID NO: 447269 - RNA, 23 nt, Human
agaacaccagccucucaccacca

SEQ ID NO: 447270 - RNA, 24 nt, Human
agcacuaucccaauaccaccaccu

SEQ ID NO: 447271 - RNA, 22 nt, Human
auaacagggaacaagaagagaa

SEQ ID NO: 447272 - RNA, 20 nt, Human
aucccaauaccaccaccucc

SEQ ID NO: 447273 - RNA, 21 nt, Human
aucccaguuacuuucagucgu

SEQ ID NO: 447274 - RNA, 22 nt, Human
caaaacagaacaccagccucuc

SEQ ID NO: 447275 - RNA, 24 nt, Human
caccaccagagaugaccggaaaua

SEQ ID NO: 447276 - RNA, 19 nt, Human
caccucaagucacacucau

SEQ ID NO: 447277 - RNA, 24 nt, Human
cacuccucuuuuccucuucucuca

SEQ ID NO: 447278 - RNA, 19 nt, Human
cagaacaccagccucucac

SEQ ID NO: 447279 - RNA, 24 nt, Human
cagccucucaccaccagagaugac

SEQ ID NO: 447280 - RNA, 27 nt, Human
cagcuacuguagucccagcuacuuggg

SEQ ID NO: 447281 - RNA, 18 nt, Human
ccacucacuuuccucuuu

SEQ ID NO: 447282 - RNA, 19 nt, Human
ccacuccucuuuuccucuu

SEQ ID NO: 447283 - RNA, 20 nt, Human
cccaauaccaccaccuccuc

SEQ ID NO: 447284 - RNA, 19 nt, Human
ccccaucuguugcuuccag

SEQ ID NO: 447285 - RNA, 25 nt, Human
ccggaaauauguuuucucuucuucc

SEQ ID NO: 447286 - RNA, 19 nt, Human
ccucacccaucccaacacc

SEQ ID NO: 447287 - RNA, 25 nt, Human
ccucugcaguccccaucuguugcuu

SEQ ID NO: 447288 - RNA, 24 nt, Human
cggaaauauguuuucucuucuucc

SEQ ID NO: 447289 - RNA, 19 nt, Human
cucucagcuucuccacugc

SEQ ID NO: 447290 - RNA, 22 nt, Human
cuggccacuccucuuuuccucu

SEQ ID NO: 447291 - RNA, 22 nt, Human
cuguagucccagcuacuugggg

SEQ ID NO: 447292 - RNA, 20 nt, Human
cuugaaccucuucucauucu

SEQ ID NO: 447293 - RNA, 20 nt, Human
gaagcucccucacccauccc

SEQ ID NO: 447294 - RNA, 19 nt, Human
gagcaggaguugguccugg

SEQ ID NO: 447295 - RNA, 22 nt, Human
gauaacagggaacaagaagaga

SEQ ID NO: 447296 - RNA, 26 nt, Human
ggaaauauguuuucucuucuuccuuc

SEQ ID NO: 447297 - RNA, 19 nt, Human
gggaacaagaagagaagcc

SEQ ID NO: 447298 - RNA, 19 nt, Human
gggaggaaugauaacaggg

SEQ ID NO: 447299 - RNA, 18 nt, Human
gggguuaauccacucacu

SEQ ID NO: 447300 - RNA, 21 nt, Human
guaguggugggagucuggcca

SEQ ID NO: 447301 - RNA, 21 nt, Human
guuuucucuucuuccuucccu

SEQ ID NO: 447302 - RNA, 21 nt, Human
uaacagggaacaagaagagaa

SEQ ID NO: 447303 - RNA, 22 nt, Human
uaaguucuuggcugcagcacua

SEQ ID NO: 447304 - RNA, 23 nt, Human
uaaguucuuggcugcagcacuau

SEQ ID NO: 447305 - RNA, 22 nt, Human
uacuguagucccagcuacuugg

SEQ ID NO: 447306 - RNA, 20 nt, Human
uagccagcacugucaccuug

SEQ ID NO: 447307 - RNA, 22 nt, Human
uaggagguucucuuguaagucu

SEQ ID NO: 447308 - RNA, 19 nt, Human
uaucccaauaccaccaccu

SEQ ID NO: 447309 - RNA, 19 nt, Human
ucacccaucccaacaccuc

SEQ ID NO: 447310 - RNA, 18 nt, Human
ucauuugggagauuuaaa

SEQ ID NO: 447311 - RNA, 23 nt, Human
ucccaauaccaccaccuccucug

SEQ ID NO: 447312 - RNA, 25 nt, Human
ucccagcuacuugggagccugaggc

SEQ ID NO: 447313 - RNA, 21 nt, Human
ucccaguuacuuucagucguu

SEQ ID NO: 447314 - RNA, 19 nt, Human
uccccaucuguugcuucca

SEQ ID NO: 447315 - RNA, 18 nt, Human
ucguuaaguucuuggcug

SEQ ID NO: 447316 - RNA, 24 nt, Human
ucugcaguccccaucuguugcuuc

SEQ ID NO: 447317 - RNA, 20 nt, Human
ucugggugugcuggcccagc

SEQ ID NO: 447318 - RNA, 20 nt, Human
ugaggcacaagaaucacuug

SEQ ID NO: 447319 - RNA, 24 nt, Human
ugaggcacaagaaucacuugaacc

SEQ ID NO: 447320 - RNA, 22 nt, Human
ugggagccugaggcacaagaau

SEQ ID NO: 447321 - RNA, 24 nt, Human
ugggagccugaggcacaagaauca

SEQ ID NO: 447322 - RNA, 18 nt, Human
uggugggagucuggccac

SEQ ID NO: 447323 - RNA, 18 nt, Human
uguagccagcacugucac

SEQ ID NO: 447324 - RNA, 22 nt, Human
uuucugggugugcuggcccagc

SEQ ID NO: 447325 - RNA, 24 nt, Human
aaagacaaggcccaugcggccgcc

SEQ ID NO: 447326 - RNA, 19 nt, Human
aaccagacccccaggcccc

SEQ ID NO: 447327 - RNA, 19 nt, Human
acugcuccugccugcccca

SEQ ID NO: 447328 - RNA, 21 nt, Human
agaaagagacgacacccaggg

SEQ ID NO: 447329 - RNA, 20 nt, Human
agacccccaggccccuccua

SEQ ID NO: 447330 - RNA, 22 nt, Human
agagacagggccauguuuaaug

SEQ ID NO: 447331 - RNA, 20 nt, Human
agcagcagcaguacaggcag

SEQ ID NO: 447332 - RNA, 18 nt, Human
agcagggaggcacaggug

SEQ ID NO: 447333 - RNA, 21 nt, Human
agcaggggcagcaggggaggg

SEQ ID NO: 447334 - RNA, 19 nt, Human
agcccugagcagcagcagc

SEQ ID NO: 447335 - RNA, 23 nt, Human
aggcagaaagagacgacacccag

SEQ ID NO: 447336 - RNA, 25 nt, Human
aggcagaaagagacgacacccaggg

SEQ ID NO: 447337 - RNA, 19 nt, Human
aggggaggggaggcagaaa

SEQ ID NO: 447338 - RNA, 21 nt, Human
aggggcagcaggggcagcagg

SEQ ID NO: 447339 - RNA, 22 nt, Human
aggguggggcccccaggugggc

SEQ ID NO: 447340 - RNA, 19 nt, Human
caccagcagggcagggugc

SEQ ID NO: 447341 - RNA, 22 nt, Human
caccagcagggcagggugcucc

SEQ ID NO: 447342 - RNA, 18 nt, Human
caccgagagagacagggc

SEQ ID NO: 447343 - RNA, 20 nt, Human
cagacccccaggccccuccu

SEQ ID NO: 447344 - RNA, 23 nt, Human
cagauaagggggccagaagccaa

SEQ ID NO: 447345 - RNA, 19 nt, Human
cagcaaagacaaggcccau

SEQ ID NO: 447346 - RNA, 19 nt, Human
cagcagcagcagcaguaca

SEQ ID NO: 447347 - RNA, 22 nt, Human
cagcagcaguacaggcagaagc

SEQ ID NO: 447348 - RNA, 21 nt, Human
cagcaggggcagcaggggagg

SEQ ID NO: 447349 - RNA, 18 nt, Human
caggcagaagcuggcggc

SEQ ID NO: 447350 - RNA, 18 nt, Human
caggcccagucccagcaa

SEQ ID NO: 447351 - RNA, 22 nt, Human
caggggcagcaggggcagcagg

SEQ ID NO: 447352 - RNA, 22 nt, Human
caggggcagcaggggcagcagg

SEQ ID NO: 447353 - RNA, 23 nt, Human
ccacacugcuccugccugcccca

SEQ ID NO: 447354 - RNA, 19 nt, Human
ccacuggccccagcacuca

SEQ ID NO: 447355 - RNA, 20 nt, Human
ccagacccccaggccccucc

SEQ ID NO: 447356 - RNA, 19 nt, Human
ccagcaaagacaaggccca

SEQ ID NO: 447357 - RNA, 23 nt, Human
ccaggccccuccuagagagcucc

SEQ ID NO: 447358 - RNA, 23 nt, Human
ccaggggaggggaggcagaaaga

SEQ ID NO: 447359 - RNA, 25 nt, Human
ccccaaccagacccccaggccccuc

SEQ ID NO: 447360 - RNA, 24 nt, Human
ccccagcacucacagaauuccacc

SEQ ID NO: 447361 - RNA, 22 nt, Human
ccccagccccacuggccccagc

SEQ ID NO: 447362 - RNA, 23 nt, Human
cccccaggccccuccuagagagc

SEQ ID NO: 447363 - RNA, 25 nt, Human
cccccaggccccuccuagagagcuc

SEQ ID NO: 447364 - RNA, 24 nt, Human
cccccaggugggcucugccggucc

SEQ ID NO: 447365 - RNA, 21 nt, Human
cccccggcccccaggggaggg

SEQ ID NO: 447366 - RNA, 19 nt, Human
ccccgccgguccccagccc

SEQ ID NO: 447367 - RNA, 18 nt, Human
cccggcccccaggggagg

SEQ ID NO: 447368 - RNA, 19 nt, Human
ccgagcagggaggcacagg

SEQ ID NO: 447369 - RNA, 22 nt, Human
ccggcaagguggugacucuggc

SEQ ID NO: 447370 - RNA, 19 nt, Human
ccguggccgcuggccgagc

SEQ ID NO: 447371 - RNA, 28 nt, Human
ccugccugccccaaccagacccccaggc

SEQ ID NO: 447372 - RNA, 18 nt, Human
ccugcggggaggccccuc

SEQ ID NO: 447373 - RNA, 20 nt, Human
cgagagagacagggccaugu

SEQ ID NO: 447374 - RNA, 24 nt, Human
cgagcagggaggcacagguguucu

SEQ ID NO: 447375 - RNA, 19 nt, Human
cgcguggggcgggggcaga

SEQ ID NO: 447376 - RNA, 21 nt, Human
cgcguggggcgggggcagaua

SEQ ID NO: 447377 - RNA, 21 nt, Human
cggcaagguggugacucuggc

SEQ ID NO: 447378 - RNA, 23 nt, Human
cucacagaauuccaccagcaggg

SEQ ID NO: 447379 - RNA, 21 nt, Human
cuggcaccguggccgcuggcc

SEQ ID NO: 447380 - RNA, 21 nt, Human
cuggccccagcacucacagaa

SEQ ID NO: 447381 - RNA, 23 nt, Human
cuggucacucacggggggugcug

SEQ ID NO: 447382 - RNA, 23 nt, Human
cuguuccugaccccaugggcacg

SEQ ID NO: 447383 - RNA, 23 nt, Human
cuuggggauuuccuccccuaagg

SEQ ID NO: 447384 - RNA, 21 nt, Human
gagcaggggcagcaggggcag

SEQ ID NO: 447385 - RNA, 21 nt, Human
gcaaaggguggggcccccagg

SEQ ID NO: 447386 - RNA, 27 nt, Human
gcagcagcagcagcaguacaggcagaa

SEQ ID NO: 447387 - RNA, 22 nt, Human
gcagcagcagcaguacaggcag

SEQ ID NO: 447388 - RNA, 18 nt, Human
gcagcaggggagggucug

SEQ ID NO: 447389 - RNA, 22 nt, Human
gcagcaggggcagcaggggcag

SEQ ID NO: 447390 - RNA, 22 nt, Human
gccccaaccagacccccaggcc

SEQ ID NO: 447391 - RNA, 20 nt, Human
gccgcccccggcccccaggg

SEQ ID NO: 447392 - RNA, 22 nt, Human
gcgcggcccgggcgccgcggag

SEQ ID NO: 447393 - RNA, 19 nt, Human
gcggagccgccgaggagcc

SEQ ID NO: 447394 - RNA, 21 nt, Human
gcuccuccgaggggcuccucg

SEQ ID NO: 447395 - RNA, 23 nt, Human
gcuccucgcucccuguuccugac

SEQ ID NO: 447396 - RNA, 20 nt, Human
gcuggcggcucauggugcug

SEQ ID NO: 447397 - RNA, 19 nt, Human
ggcaaaggguggggccccc

SEQ ID NO: 447398 - RNA, 21 nt, Human
ggcagcaggggcagcagggga

SEQ ID NO: 447399 - RNA, 23 nt, Human
ggcagcaggggcagcaggggagg

SEQ ID NO: 447400 - RNA, 20 nt, Human
ggcgggggcagauaaggggg

SEQ ID NO: 447401 - RNA, 23 nt, Human
ggcucugccggucccccgccggu

SEQ ID NO: 447402 - RNA, 21 nt, Human
gggacagcgccaggccagggg

SEQ ID NO: 447403 - RNA, 24 nt, Human
gggaggcagaaagagacgacaccc

SEQ ID NO: 447404 - RNA, 22 nt, Human
gggcagcaggggcagcagggga

SEQ ID NO: 447405 - RNA, 24 nt, Human
gggcagcaggggcagcaggggcag

SEQ ID NO: 447406 - RNA, 27 nt, Human
gggccagaagccaagcagcagcugcca

SEQ ID NO: 447407 - RNA, 18 nt, Human
gggcgcguggggcggggg

SEQ ID NO: 447408 - RNA, 22 nt, Human
ggggaggggaggcagaaagaga

SEQ ID NO: 447409 - RNA, 24 nt, Human
gugcugccagggcgcguggggcgg

SEQ ID NO: 447410 - RNA, 19 nt, Human
uaccacacugcuccugccu

SEQ ID NO: 447411 - RNA, 24 nt, Human
uaccacacugcuccugccugcccc

SEQ ID NO: 447412 - RNA, 24 nt, Human
uacuaccacacugcuccugccugc

SEQ ID NO: 447413 - RNA, 22 nt, Human
ucccagcaaagacaaggcccau

SEQ ID NO: 447414 - RNA, 19 nt, Human
ucccgcagggccaggccca

SEQ ID NO: 447415 - RNA, 20 nt, Human
ugagggagguaggggagaca

SEQ ID NO: 447416 - RNA, 24 nt, Human
ugagggagguaggggagacacgac

SEQ ID NO: 447417 - RNA, 22 nt, Human
ugccccaaccagacccccaggc

SEQ ID NO: 447418 - RNA, 19 nt, Human
ugccugccccaaccagacc

SEQ ID NO: 447419 - RNA, 20 nt, Human
ugcuccugccugccccaacc

SEQ ID NO: 447420 - RNA, 20 nt, Human
ugcuggggaugcuugggggu

SEQ ID NO: 447421 - RNA, 19 nt, Human
uggcacacaggcccagucc

SEQ ID NO: 447422 - RNA, 24 nt, Human
uggcacacaggcccagucccagca

SEQ ID NO: 447423 - RNA, 18 nt, Human
ugggcacgaagcccugag

SEQ ID NO: 447424 - RNA, 21 nt, Human
ugugcaacaacugagggaggu

SEQ ID NO: 447425 - RNA, 19 nt, Human
aagcagacacagcauucca

SEQ ID NO: 447426 - RNA, 20 nt, Human
aauugcaucagucuucugcc

SEQ ID NO: 447427 - RNA, 25 nt, Human
acuggacugguagguguuaccuggc

SEQ ID NO: 447428 - RNA, 27 nt, Human
acuggacugguagguguuaccuggcuu

SEQ ID NO: 447429 - RNA, 18 nt, Human
agacaggcuggcccgagg

SEQ ID NO: 447430 - RNA, 20 nt, Human
aguguagacacagcuuaacc

SEQ ID NO: 447431 - RNA, 25 nt, Human
aguuuaacauuuaguauucacauau

SEQ ID NO: 447432 - RNA, 23 nt, Human
auuuugguucaaagcaaacauua

SEQ ID NO: 447433 - RNA, 19 nt, Human
cagaaggcggccguccugc

SEQ ID NO: 447434 - RNA, 22 nt, Human
ccagcucacuucugaaagcaaa

SEQ ID NO: 447435 - RNA, 19 nt, Human
ccuugauggcaggggugaa

SEQ ID NO: 447436 - RNA, 18 nt, Human
cguccaguaagugaaaca

SEQ ID NO: 447437 - RNA, 28 nt, Human
cugacgcugaugaaguuuaacauuuagu

SEQ ID NO: 447438 - RNA, 18 nt, Human
gaaggaacuaagcaagac

SEQ ID NO: 447439 - RNA, 18 nt, Human
gagucauucggagcgugc

SEQ ID NO: 447440 - RNA, 22 nt, Human
gcuauugcacguuucuccccca

SEQ ID NO: 447441 - RNA, 21 nt, Human
gcugagaagucacccuugauu

SEQ ID NO: 447442 - RNA, 21 nt, Human
gucacccuugauugcaaauuc

SEQ ID NO: 447443 - RNA, 22 nt, Human
uaaaugccugcacuacugaaua

SEQ ID NO: 447444 - RNA, 23 nt, Human
uaacaguuugagaagcuugggaa

SEQ ID NO: 447445 - RNA, 20 nt, Human
uacauauauuuucucauaaa

SEQ ID NO: 447446 - RNA, 24 nt, Human
uauacaguacacacauuauaccac

SEQ ID NO: 447447 - RNA, 19 nt, Human
uauuuauacgagaagggag

SEQ ID NO: 447448 - RNA, 24 nt, Human
ucggagcgugcgugcuaaagcaga

SEQ ID NO: 447449 - RNA, 24 nt, Human
ugaauacauauauuuucucauaaa

SEQ ID NO: 447450 - RNA, 20 nt, Human
ugacagcagaaggcggccgu

SEQ ID NO: 447451 - RNA, 20 nt, Human
ugacaugauggugugcacuc

SEQ ID NO: 447452 - RNA, 23 nt, Human
ugacaugauggugugcacucauu

SEQ ID NO: 447453 - RNA, 21 nt, Human
ugauaggcacugagcauuuug

SEQ ID NO: 447454 - RNA, 18 nt, Human
ugcugagacauuuauuuc

SEQ ID NO: 447455 - RNA, 19 nt, Human
ugugcacucauuaugcacg

SEQ ID NO: 447456 - RNA, 24 nt, Human
uugcaucagucuucugccuucgug

SEQ ID NO: 447457 - RNA, 26 nt, Human
aaaaaaaaaaggauuaauaaauccga

SEQ ID NO: 447458 - RNA, 22 nt, Human
aaaaaaaaagaaaagaaaagaa

SEQ ID NO: 447459 - RNA, 21 nt, Human
aaaaaagaaaaaaaaaaagga

SEQ ID NO: 447460 - RNA, 23 nt, Human
aaaaagaaaagaaaagaaaaaag

SEQ ID NO: 447461 - RNA, 19 nt, Human
aaaagaaaaaaaaaaagga

SEQ ID NO: 447462 - RNA, 19 nt, Human
aaaagaaaaaaaaaaagga

SEQ ID NO: 447463 - RNA, 23 nt, Human
aaaagaaaaaaaaaaaggaaaag

SEQ ID NO: 447464 - RNA, 25 nt, Human
aaaagaaaaaaaaaaaggaaaagag

SEQ ID NO: 447465 - RNA, 22 nt, Human
aaaagacacugaaaccugacuc

SEQ ID NO: 447466 - RNA, 22 nt, Human
aaagaaaaaagaaaaaaaaaaa

SEQ ID NO: 447467 - RNA, 21 nt, Human
aaagcuuuuacauuaaauguu

SEQ ID NO: 447468 - RNA, 18 nt, Human
aacaugcgggucuccccc

SEQ ID NO: 447469 - RNA, 24 nt, Human
aacuacgaccuucucagaaaccaa

SEQ ID NO: 447470 - RNA, 25 nt, Human
aagaaaaaaaaaaaggaaaagagga

SEQ ID NO: 447471 - RNA, 18 nt, Human
aauccuuucuccuccagc

SEQ ID NO: 447472 - RNA, 20 nt, Human
accauacaauaguauguaca

SEQ ID NO: 447473 - RNA, 18 nt, Human
acccugugccccggucuc

SEQ ID NO: 447474 - RNA, 21 nt, Human
agaaaagaaaaaagaaaaaaa

SEQ ID NO: 447475 - RNA, 19 nt, Human
agaaaagaaaagaaaaaag

SEQ ID NO: 447476 - RNA, 19 nt, Human
agaaaccaaaaacccagcc

SEQ ID NO: 447477 - RNA, 18 nt, Human
agacacugaaaccugacu

SEQ ID NO: 447478 - RNA, 21 nt, Human
aggaaaggaaaaaaaaaagga

SEQ ID NO: 447479 - RNA, 27 nt, Human
aguaaaauaauaaauaaaaccauacaa

SEQ ID NO: 447480 - RNA, 21 nt, Human
aguauguacacaacagcacuc

SEQ ID NO: 447481 - RNA, 24 nt, Human
augaaucacagaaaaaugugccuu

SEQ ID NO: 447482 - RNA, 22 nt, Human
caacagcacuccuuccaagucc

SEQ ID NO: 447483 - RNA, 19 nt, Human
cacagaagccuccuccuuu

SEQ ID NO: 447484 - RNA, 21 nt, Human
cagccccucuuccccuccccc

SEQ ID NO: 447485 - RNA, 28 nt, Human
cagcgcacauacaggcgugcgcguguac

SEQ ID NO: 447486 - RNA, 23 nt, Human
caugcgggucuccccccgggccu

SEQ ID NO: 447487 - RNA, 22 nt, Human
ccagcuuucucagcuguccuuc

SEQ ID NO: 447488 - RNA, 21 nt, Human
ccagucccugaaggaggagug

SEQ ID NO: 447489 - RNA, 24 nt, Human
cccccgcuuuaaaaaaaaagaaaa

SEQ ID NO: 447490 - RNA, 18 nt, Human
ccccucuuccccuccccc

SEQ ID NO: 447491 - RNA, 22 nt, Human
cccgcuuuaaaaaaaaagaaaa

SEQ ID NO: 447492 - RNA, 20 nt, Human
cccugaaggaggagugggga

SEQ ID NO: 447493 - RNA, 18 nt, Human
ccucccaacuugaagaua

SEQ ID NO: 447494 - RNA, 20 nt, Human
ccucccaacuugaagauaga

SEQ ID NO: 447495 - RNA, 18 nt, Human
cgauacauacauauuuau

SEQ ID NO: 447496 - RNA, 23 nt, Human
cguguacacacauauguggggug

SEQ ID NO: 447497 - RNA, 18 nt, Human
cucagaaaccaaaaaccc

SEQ ID NO: 447498 - RNA, 20 nt, Human
cucagccccucuuccccucc

SEQ ID NO: 447499 - RNA, 19 nt, Human
cucagcuguccuucuguug

SEQ ID NO: 447500 - RNA, 21 nt, Human
cuccuuccaaguccagugcaa

SEQ ID NO: 447501 - RNA, 18 nt, Human
cuggauccuaguuucccu

SEQ ID NO: 447502 - RNA, 20 nt, Human
cuuugaggaaaggaaaaaaa

SEQ ID NO: 447503 - RNA, 19 nt, Human
gaaaggaaaaaaaaaagga

SEQ ID NO: 447504 - RNA, 25 nt, Human
gcagaccaagcaacaugcgggucuc

SEQ ID NO: 447505 - RNA, 19 nt, Human
gccucccaacuugaagaua

SEQ ID NO: 447506 - RNA, 21 nt, Human
gcuuuggugucuugaucagga

SEQ ID NO: 447507 - RNA, 18 nt, Human
ggaggaguggggacgcag

SEQ ID NO: 447508 - RNA, 18 nt, Human
ggccagucccugaaggag

SEQ ID NO: 447509 - RNA, 18 nt, Human
ggccuuggcuggauccua

SEQ ID NO: 447510 - RNA, 26 nt, Human
ggcgugcgcguguacacacauaugug

SEQ ID NO: 447511 - RNA, 20 nt, Human
gggacgcagaggauuuggug

SEQ ID NO: 447512 - RNA, 26 nt, Human
gugacaaagaggggaggggaggcacc

SEQ ID NO: 447513 - RNA, 24 nt, Human
uaaauccgaaauggcacuuggaaa

SEQ ID NO: 447514 - RNA, 19 nt, Human
uaacugcaaaguacagaua

SEQ ID NO: 447515 - RNA, 19 nt, Human
uaauaaauaaaaccauaca

SEQ ID NO: 447516 - RNA, 18 nt, Human
uacacacauauguggggu

SEQ ID NO: 447517 - RNA, 20 nt, Human
uacagauaaaaccauccuuu

SEQ ID NO: 447518 - RNA, 27 nt, Human
uauggacuuccuuaaaaaaaaaaaagc

SEQ ID NO: 447519 - RNA, 25 nt, Human
uauguacacaacagcacuccuucca

SEQ ID NO: 447520 - RNA, 22 nt, Human
ucaggacccugguaacugaugc

SEQ ID NO: 447521 - RNA, 18 nt, Human
uccaaugcuuaauaugac

SEQ ID NO: 447522 - RNA, 19 nt, Human
ucccugaaggaggaguggg

SEQ ID NO: 447523 - RNA, 21 nt, Human
ucccugaaggaggagugggga

SEQ ID NO: 447524 - RNA, 24 nt, Human
uccuuaaaaaaaaaaaagcuuuua

SEQ ID NO: 447525 - RNA, 18 nt, Human
uccuuucucagccccucu

SEQ ID NO: 447526 - RNA, 21 nt, Human
ucucagaaaccaaaaacccag

SEQ ID NO: 447527 - RNA, 23 nt, Human
ucuccccccgggccuuggcugga

SEQ ID NO: 447528 - RNA, 24 nt, Human
ugaagauagaauccuuucuccucc

SEQ ID NO: 447529 - RNA, 22 nt, Human
ugaaucacagaaaaaugugccu

SEQ ID NO: 447530 - RNA, 20 nt, Human
ugacaaagaggggaggggag

SEQ ID NO: 447531 - RNA, 21 nt, Human
ugacaaagaggggaggggagg

SEQ ID NO: 447532 - RNA, 18 nt, Human
ugagaggagggccuccca

SEQ ID NO: 447533 - RNA, 24 nt, Human
ugagaggagggccucccaacuuga

SEQ ID NO: 447534 - RNA, 19 nt, Human
ugagcaaggugagaggagg

SEQ ID NO: 447535 - RNA, 18 nt, Human
ugagcagaccaagcaaca

SEQ ID NO: 447536 - RNA, 24 nt, Human
ugagcagaccaagcaacaugcggg

SEQ ID NO: 447537 - RNA, 18 nt, Human
ugccuggggucuuaugga

SEQ ID NO: 447538 - RNA, 24 nt, Human
uggacuuccuuaaaaaaaaaaaag

SEQ ID NO: 447539 - RNA, 20 nt, Human
uggccaaaaaaaaaugaauc

SEQ ID NO: 447540 - RNA, 21 nt, Human
uggggugagggcagaccaugg

SEQ ID NO: 447541 - RNA, 24 nt, Human
uucaaaauaucacuguuaacugca

SEQ ID NO: 447542 - RNA, 23 nt, Human
aaaaaugggggguaaaggaagaa

SEQ ID NO: 447543 - RNA, 19 nt, Human
aaucaccacacacacacca

SEQ ID NO: 447544 - RNA, 33 nt, Human
acauauacacacauaucuacacaugcacauggu

SEQ ID NO: 447545 - RNA, 18 nt, Human
accacacacacaccacag

SEQ ID NO: 447546 - RNA, 24 nt, Human
acccgcucuccaaucucuccccac

SEQ ID NO: 447547 - RNA, 20 nt, Human
acuggccaucuucagucccu

SEQ ID NO: 447548 - RNA, 22 nt, Human
agagggcacaggaagcauccag

SEQ ID NO: 447549 - RNA, 18 nt, Human
agcucagacuuagcaucu

SEQ ID NO: 447550 - RNA, 19 nt, Human
augcacauguacacacaca

SEQ ID NO: 447551 - RNA, 19 nt, Human
auggagcacucagucauuu

SEQ ID NO: 447552 - RNA, 21 nt, Human
caacugccacagaacccuagc

SEQ ID NO: 447553 - RNA, 22 nt, Human
cacaaucaccacacacacacca

SEQ ID NO: 447554 - RNA, 19 nt, Human
cacacacaccacagucagc

SEQ ID NO: 447555 - RNA, 24 nt, Human
cacacacaccacagucagcagaau

SEQ ID NO: 447556 - RNA, 19 nt, Human
cacacaccacagucagcag

SEQ ID NO: 447557 - RNA, 21 nt, Human
cacaccacagucagcagaaug

SEQ ID NO: 447558 - RNA, 19 nt, Human
cacacccgcucuccaaucu

SEQ ID NO: 447559 - RNA, 21 nt, Human
cacagaacccuagccuccaag

SEQ ID NO: 447560 - RNA, 18 nt, Human
cacagauuuucugagaca

SEQ ID NO: 447561 - RNA, 24 nt, Human
cacagauuuucugagacacauacu

SEQ ID NO: 447562 - RNA, 22 nt, Human
cacagucagcagaaugccuuuc

SEQ ID NO: 447563 - RNA, 20 nt, Human
cacauaucuacacaugcaca

SEQ ID NO: 447564 - RNA, 22 nt, Human
cacaugcacauguacacacaca

SEQ ID NO: 447565 - RNA, 23 nt, Human
caccacacacacaccacagucag

SEQ ID NO: 447566 - RNA, 18 nt, Human
caccacacacacaccacg

SEQ ID NO: 447567 - RNA, 24 nt, Human
cacccagcacagucucuucuggag

SEQ ID NO: 447568 - RNA, 21 nt, Human
cacucagucauuuguggguca

SEQ ID NO: 447569 - RNA, 21 nt, Human
cagauuuucugagacacauac

SEQ ID NO: 447570 - RNA, 22 nt, Human
caggacaaaggcaagaaagccc

SEQ ID NO: 447571 - RNA, 19 nt, Human
cagggcucucauccccugg

SEQ ID NO: 447572 - RNA, 19 nt, Human
cauuggccacacauucaag

SEQ ID NO: 447573 - RNA, 20 nt, Human
ccaagccacacccagcacag

SEQ ID NO: 447574 - RNA, 18 nt, Human
ccccacacgucaggcacc

SEQ ID NO: 447575 - RNA, 20 nt, Human
cccccugccagccacugucc

SEQ ID NO: 447576 - RNA, 22 nt, Human
cccugccagccacugucugccu

SEQ ID NO: 447577 - RNA, 22 nt, Human
cccugggugccaagccacaccc

SEQ ID NO: 447578 - RNA, 20 nt, Human
ccuccugcagucagggugac

SEQ ID NO: 447579 - RNA, 24 nt, Human
ccucgucccgggccugggcccccc

SEQ ID NO: 447580 - RNA, 18 nt, Human
ccugagcugaaggggagg

SEQ ID NO: 447581 - RNA, 22 nt, Human
cgggccugggccccccugccag

SEQ ID NO: 447582 - RNA, 23 nt, Human
cucugcacuaagccucugucucc

SEQ ID NO: 447583 - RNA, 23 nt, Human
cuggagcucagacuuagcaucuu

SEQ ID NO: 447584 - RNA, 20 nt, Human
cugugccuccugcagucagg

SEQ ID NO: 447585 - RNA, 21 nt, Human
cuuggcccugagcauagcagg

SEQ ID NO: 447586 - RNA, 21 nt, Human
gagcacucagucauuuguggg

SEQ ID NO: 447587 - RNA, 18 nt, Human
gaggccucgucccgggcc

SEQ ID NO: 447588 - RNA, 23 nt, Human
gcaagaaagcccaggagguucac

SEQ ID NO: 447589 - RNA, 20 nt, Human
gcagccacacccgcucucca

SEQ ID NO: 447590 - RNA, 22 nt, Human
gccacacccgcucuccaaucuc

SEQ ID NO: 447591 - RNA, 21 nt, Human
gcccugcaacugccacagaac

SEQ ID NO: 447592 - RNA, 20 nt, Human
gccugagcugaaggggaggc

SEQ ID NO: 447593 - RNA, 21 nt, Human
gccugggccccccugccagcc

SEQ ID NO: 447594 - RNA, 18 nt, Human
gcugugccugagcugaag

SEQ ID NO: 447595 - RNA, 22 nt, Human
ggaucaggacaaaggcaagaaa

SEQ ID NO: 447596 - RNA, 22 nt, Human
ggccugggccccccugccagcc

SEQ ID NO: 447597 - RNA, 23 nt, Human
gggguugggcagccacacccgcu

SEQ ID NO: 447598 - RNA, 28 nt, Human
ggguuccccacacgucaggcacccugcu

SEQ ID NO: 447599 - RNA, 19 nt, Human
gguugccacgagagguagu

SEQ ID NO: 447600 - RNA, 26 nt, Human
gugguccacagcucccguuucuucac

SEQ ID NO: 447601 - RNA, 24 nt, Human
gugguuccaaagcucaaggcugag

SEQ ID NO: 447602 - RNA, 25 nt, Human
uaagccucugucuccauuggccaca

SEQ ID NO: 447603 - RNA, 24 nt, Human
uacauauacacacauaucuacaca

SEQ ID NO: 447604 - RNA, 31 nt, Human
uacauauacacacauaucuacacaugcacag

SEQ ID NO: 447605 - RNA, 24 nt, Human
uaggugucucccaacaugugcccc

SEQ ID NO: 447606 - RNA, 25 nt, Human
ucaccacacacacaccacagucaac

SEQ ID NO: 447607 - RNA, 21 nt, Human
ucacccagaugcaggaucuaa

SEQ ID NO: 447608 - RNA, 22 nt, Human
ucaggacccagcuacuggccau

SEQ ID NO: 447609 - RNA, 22 nt, Human
ucaggcggccguuuucauuggc

SEQ ID NO: 447610 - RNA, 18 nt, Human
ucauuugugggucaggag

SEQ ID NO: 447611 - RNA, 18 nt, Human
uccauaacauugcccugc

SEQ ID NO: 447612 - RNA, 20 nt, Human
ucccccuugaauccccucca

SEQ ID NO: 447613 - RNA, 22 nt, Human
ucuacacaugcacauguacaca

SEQ ID NO: 447614 - RNA, 19 nt, Human
ucugagacacauacucuga

SEQ ID NO: 447615 - RNA, 24 nt, Human
ucugcaggcaggaauuauggaggc

SEQ ID NO: 447616 - RNA, 18 nt, Human
ucugccuugcugucucug

SEQ ID NO: 447617 - RNA, 21 nt, Human
ucuggaagcagaugcucugga

SEQ ID NO: 447618 - RNA, 18 nt, Human
ugaauccccuccacucuc

SEQ ID NO: 447619 - RNA, 18 nt, Human
ugacagugaauccaaugg

SEQ ID NO: 447620 - RNA, 18 nt, Human
ugacagugucaguccugg

SEQ ID NO: 447621 - RNA, 21 nt, Human
ugaccuagauuugucuuccuu

SEQ ID NO: 447622 - RNA, 24 nt, Human
ugagacacauacucugaauucuuc

SEQ ID NO: 447623 - RNA, 21 nt, Human
ugagcugaaggggaggccucg

SEQ ID NO: 447624 - RNA, 25 nt, Human
ugauacauauacacacauaucuaca

SEQ ID NO: 447625 - RNA, 19 nt, Human
ugcaacugccacagaaccc

SEQ ID NO: 447626 - RNA, 23 nt, Human
ugcagaaacaagcagggugacua

SEQ ID NO: 447627 - RNA, 19 nt, Human
ugccaggccguuggcugcu

SEQ ID NO: 447628 - RNA, 18 nt, Human
ugccagugcucuucgccc

SEQ ID NO: 447629 - RNA, 21 nt, Human
ugccugagcugaaggggaggc

SEQ ID NO: 447630 - RNA, 25 nt, Human
ugcucuggaugggguugggcagcca

SEQ ID NO: 447631 - RNA, 21 nt, Human
uggaagagaagaacuggcuug

SEQ ID NO: 447632 - RNA, 20 nt, Human
uggcuuccugcucauuccug

SEQ ID NO: 447633 - RNA, 22 nt, Human
uggguucaggcggccguuuuca

SEQ ID NO: 447634 - RNA, 22 nt, Human
uguccugaagcucgaucucuau

SEQ ID NO: 447635 - RNA, 24 nt, Human
ugucuccauuggccacacauucaa

SEQ ID NO: 447636 - RNA, 19 nt, Human
ugucucugucccucgccuc

SEQ ID NO: 447637 - RNA, 20 nt, Human
ugucucugucccucgccucc

SEQ ID NO: 447638 - RNA, 22 nt, Human
ugucucugucccucgccuccuc

SEQ ID NO: 447639 - RNA, 25 nt, Human
ugugguuccaaagcucaaggcugag

SEQ ID NO: 447640 - RNA, 19 nt, Human
uucauuggcugcucugucc

SEQ ID NO: 447641 - RNA, 24 nt, Human
uuccuuggcccugagcauagcagg

SEQ ID NO: 447642 - RNA, 18 nt, Human
uugggcuccucugccagg

SEQ ID NO: 447643 - RNA, 18 nt, Human
uuuacugaggguucccca

SEQ ID NO: 447644 - RNA, 23 nt, Human
acuugcugauuggggacaggcug

SEQ ID NO: 447645 - RNA, 23 nt, Human
agccacaggcucuugggaagccc

SEQ ID NO: 447646 - RNA, 20 nt, Human
aggacucaucgaggaugucg

SEQ ID NO: 447647 - RNA, 28 nt, Human
aggcugugcugccgccggcuggccuccc

SEQ ID NO: 447648 - RNA, 19 nt, Human
agggguaggaagggcauag

SEQ ID NO: 447649 - RNA, 20 nt, Human
caaaaccgaaaucucccugc

SEQ ID NO: 447650 - RNA, 21 nt, Human
caaugguggcguccaccuucu

SEQ ID NO: 447651 - RNA, 18 nt, Human
caccuggcuuccccaggc

SEQ ID NO: 447652 - RNA, 19 nt, Human
caccuggcuuccccaggcc

SEQ ID NO: 447653 - RNA, 21 nt, Human
cacgguguggcccccucgagc

SEQ ID NO: 447654 - RNA, 20 nt, Human
cagagccuggagcuuagggc

SEQ ID NO: 447655 - RNA, 19 nt, Human
cagcagcugagaggggccc

SEQ ID NO: 447656 - RNA, 20 nt, Human
caguccagguggaguugucc

SEQ ID NO: 447657 - RNA, 26 nt, Human
ccaccaccuccgggagcuggcuccag

SEQ ID NO: 447658 - RNA, 20 nt, Human
cccucggggcuggaggacuc

SEQ ID NO: 447659 - RNA, 25 nt, Human
cccuugugcccacguuuccucccca

SEQ ID NO: 447660 - RNA, 18 nt, Human
ccgggagcuggcuccagg

SEQ ID NO: 447661 - RNA, 21 nt, Human
ccucaaaaccgaaaucucccu

SEQ ID NO: 447662 - RNA, 22 nt, Human
ccucaaaaccgaaaucucccug

SEQ ID NO: 447663 - RNA, 20 nt, Human
ccuccgggagcuggcuccag

SEQ ID NO: 447664 - RNA, 22 nt, Human
ccuccugccuuuuccgcuccuc

SEQ ID NO: 447665 - RNA, 19 nt, Human
ccugccggguccccucccu

SEQ ID NO: 447666 - RNA, 27 nt, Human
ccugggacacgguguggcccccucgag

SEQ ID NO: 447667 - RNA, 20 nt, Human
ccuugaaggaacccuugugc

SEQ ID NO: 447668 - RNA, 20 nt, Human
ccuugugcccacguuuccuc

SEQ ID NO: 447669 - RNA, 19 nt, Human
cguggggcacuccugggca

SEQ ID NO: 447670 - RNA, 19 nt, Human
cuccaggugaccugggcgg

SEQ ID NO: 447671 - RNA, 20 nt, Human
cugggcgggccgguagcucu

SEQ ID NO: 447672 - RNA, 22 nt, Human
cuggggacaugugaucuuccuu

SEQ ID NO: 447673 - RNA, 23 nt, Human
cuugucccacucagggguaggaa

SEQ ID NO: 447674 - RNA, 22 nt, Human
cuuguuuuuggccgggcuccga

SEQ ID NO: 447675 - RNA, 22 nt, Human
gaucuccugguagagcuggggg

SEQ ID NO: 447676 - RNA, 18 nt, Human
gccccagggaaccaugcu

SEQ ID NO: 447677 - RNA, 22 nt, Human
gcgucuucuuguuuuuggccgg

SEQ ID NO: 447678 - RNA, 18 nt, Human
gcucuugggaagccccag

SEQ ID NO: 447679 - RNA, 22 nt, Human
ggcacucaaggcccuucuuguc

SEQ ID NO: 447680 - RNA, 23 nt, Human
ggccgggcuccgaguaugaggcu

SEQ ID NO: 447681 - RNA, 20 nt, Human
gggcccagccagccaacggg

SEQ ID NO: 447682 - RNA, 25 nt, Human
gucuucuuguuuuuggccgggcucc

SEQ ID NO: 447683 - RNA, 18 nt, Human
gugaagugucuggagccc

SEQ ID NO: 447684 - RNA, 19 nt, Human
guguggcccccucgagcuu

SEQ ID NO: 447685 - RNA, 18 nt, Human
uccaggugaccugggcgg

SEQ ID NO: 447686 - RNA, 20 nt, Human
ucccugggacacgguguggc

SEQ ID NO: 447687 - RNA, 19 nt, Human
uccggccggccccuucuca

SEQ ID NO: 447688 - RNA, 21 nt, Human
uccgggagcuggcuccaggug

SEQ ID NO: 447689 - RNA, 21 nt, Human
uccucagccagagccuggagc

SEQ ID NO: 447690 - RNA, 22 nt, Human
uccuggcugguguucaggcccc

SEQ ID NO: 447691 - RNA, 19 nt, Human
uccugggcacucaaggccc

SEQ ID NO: 447692 - RNA, 19 nt, Human
uccugggcacucaaggccc

SEQ ID NO: 447693 - RNA, 19 nt, Human
ugccggguccccucccucc

SEQ ID NO: 447694 - RNA, 27 nt, Human
uggggacaugugaucuucccccccugg

SEQ ID NO: 447695 - RNA, 18 nt, Human
uggguccuugagaccagc

SEQ ID NO: 447696 - RNA, 23 nt, Human
uggguuccucagccagagccugg

SEQ ID NO: 447697 - RNA, 18 nt, Human
uuagaaaccucaaaaccg

SEQ ID NO: 447698 - RNA, 25 nt, Human
uucaggccccgcuccuggaucuccu

SEQ ID NO: 447699 - RNA, 19 nt, Human
uucuugucccacucagggg

SEQ ID NO: 447700 - RNA, 19 nt, Human
uugugcccacguuuccucc

SEQ ID NO: 447701 - RNA, 26 nt, Human
uuuccuccccagcgucuucuuguuuu

SEQ ID NO: 447702 - RNA, 23 nt, Human
uuuuccgcuccucaguggagagc

SEQ ID NO: 447703 - RNA, 23 nt, Human
uuuuuuuucuuaagaaauaacuu

SEQ ID NO: 447704 - RNA, 19 nt, Human
uuuuuuuuuuuuuucuuaa

SEQ ID NO: 447705 - RNA, 22 nt, Human
aaaagaaaacaaaagaacaaca

SEQ ID NO: 447706 - RNA, 23 nt, Human
aaaagaacaacaaaacauucugg

SEQ ID NO: 447707 - RNA, 24 nt, Human
aaauggccccagguauccaaggau

SEQ ID NO: 447708 - RNA, 19 nt, Human
aagaaaacaaaagaacaac

SEQ ID NO: 447709 - RNA, 23 nt, Human
aagaaaacaaaagaacaacaaaa

SEQ ID NO: 447710 - RNA, 19 nt, Human
aagaacccagcagcugcgu

SEQ ID NO: 447711 - RNA, 19 nt, Human
aagaaggcaugaaccacug

SEQ ID NO: 447712 - RNA, 20 nt, Human
aauggccccagguauccaag

SEQ ID NO: 447713 - RNA, 18 nt, Human
acaaaaaagaaaacaaaa

SEQ ID NO: 447714 - RNA, 20 nt, Human
accccaaccuuuauuccauc

SEQ ID NO: 447715 - RNA, 25 nt, Human
accuuuauuccaucaacuccaggaa

SEQ ID NO: 447716 - RNA, 21 nt, Human
agaaaacaaaagaacaacaaa

SEQ ID NO: 447717 - RNA, 18 nt, Human
agauguggagauaggagg

SEQ ID NO: 447718 - RNA, 24 nt, Human
agcccccucaguaauguucuucag

SEQ ID NO: 447719 - RNA, 22 nt, Human
aggcgaccaagcccagguccgc

SEQ ID NO: 447720 - RNA, 21 nt, Human
agggacauggcccugcccaca

SEQ ID NO: 447721 - RNA, 20 nt, Human
agggcaagaacccagcagcu

SEQ ID NO: 447722 - RNA, 19 nt, Human
agggugcuguggcugcagc

SEQ ID NO: 447723 - RNA, 21 nt, Human
augaaggacggagaaagggag

SEQ ID NO: 447724 - RNA, 24 nt, Human
augaaggacggagaaagggagaac

SEQ ID NO: 447725 - RNA, 23 nt, Human
augguugcugagguggaagauga

SEQ ID NO: 447726 - RNA, 19 nt, Human
caacaaaccauuauggcca

SEQ ID NO: 447727 - RNA, 18 nt, Human
caacuccaggaagccagg

SEQ ID NO: 447728 - RNA, 23 nt, Human
caagaacccagcagcugcgugga

SEQ ID NO: 447729 - RNA, 23 nt, Human
caggaagccagguuaucucccag

SEQ ID NO: 447730 - RNA, 24 nt, Human
caguaguguucaaggacaaggccc

SEQ ID NO: 447731 - RNA, 22 nt, Human
caguggggcacggggcaggggg

SEQ ID NO: 447732 - RNA, 24 nt, Human
ccaacaaaccauuauggccacccc

SEQ ID NO: 447733 - RNA, 23 nt, Human
cccaacaaaccauuauggccacc

SEQ ID NO: 447734 - RNA, 21 nt, Human
ccccauaacuaauaaacaaua

SEQ ID NO: 447735 - RNA, 21 nt, Human
cccccaacaaaccauuauggc

SEQ ID NO: 447736 - RNA, 18 nt, Human
cccccaccccucaacuuc

SEQ ID NO: 447737 - RNA, 21 nt, Human
cccccauaacuaauaaacaau

SEQ ID NO: 447738 - RNA, 24 nt, Human
ccccccguuacugcagaugaaggc

SEQ ID NO: 447739 - RNA, 20 nt, Human
cccgggucggagcaacuuuc

SEQ ID NO: 447740 - RNA, 22 nt, Human
ccgggucggagcaacuuucuuu

SEQ ID NO: 447741 - RNA, 24 nt, Human
ccucugaucccuauggcuugguuc

SEQ ID NO: 447742 - RNA, 18 nt, Human
cggauguugcaggggagg

SEQ ID NO: 447743 - RNA, 22 nt, Human
gaagucauucucucccccaccc

SEQ ID NO: 447744 - RNA, 21 nt, Human
gcaagaagaaaauucuucgac

SEQ ID NO: 447745 - RNA, 21 nt, Human
ggaagaaggcaugaaccacug

SEQ ID NO: 447746 - RNA, 19 nt, Human
ggcuggucgacauuugggg

SEQ ID NO: 447747 - RNA, 18 nt, Human
gggcaagaacccagcagc

SEQ ID NO: 447748 - RNA, 23 nt, Human
gggcaguagggugcuguggcugc

SEQ ID NO: 447749 - RNA, 22 nt, Human
ggggcuggucgacauuuggggg

SEQ ID NO: 447750 - RNA, 22 nt, Human
ggggguguuguggccuaauucc

SEQ ID NO: 447751 - RNA, 19 nt, Human
gguggaagaugaggucagg

SEQ ID NO: 447752 - RNA, 23 nt, Human
uaaagcacucggucccgccggcu

SEQ ID NO: 447753 - RNA, 23 nt, Human
uaagagguugaggggagaggaga

SEQ ID NO: 447754 - RNA, 25 nt, Human
uacaaaaaagaaaacaaaagaacaa

SEQ ID NO: 447755 - RNA, 26 nt, Human
uacaaaaaagaaaacaaaagaacaac

SEQ ID NO: 447756 - RNA, 18 nt, Human
uauuccaucaacuccagg

SEQ ID NO: 447757 - RNA, 23 nt, Human
ucccccaccccucaacuucuuca

SEQ ID NO: 447758 - RNA, 21 nt, Human
uccccuagcuucuuaaauggc

SEQ ID NO: 447759 - RNA, 20 nt, Human
ucccuauggcuugguuccca

SEQ ID NO: 447760 - RNA, 22 nt, Human
ucccucacccccaacaaaccau

SEQ ID NO: 447761 - RNA, 20 nt, Human
ucccuguggguuuuuucccu

SEQ ID NO: 447762 - RNA, 18 nt, Human
ugaaggacggagaaaggg

SEQ ID NO: 447763 - RNA, 21 nt, Human
ugaggggagaggagaaaggga

SEQ ID NO: 447764 - RNA, 22 nt, Human
ugaggggagaggagaaagggac

SEQ ID NO: 447765 - RNA, 19 nt, Human
ugagguggaagaugagguc

SEQ ID NO: 447766 - RNA, 21 nt, Human
ugcugagguggaagaugaggu

SEQ ID NO: 447767 - RNA, 21 nt, Human
uggaagaugaggucagggcuc

SEQ ID NO: 447768 - RNA, 21 nt, Human
uggcaagaagaaaauucuucg

SEQ ID NO: 447769 - RNA, 20 nt, Human
uggcaucugugguguagcuu

SEQ ID NO: 447770 - RNA, 21 nt, Human
uggcccugcccacagcccucc

SEQ ID NO: 447771 - RNA, 18 nt, Human
uggcuggggaagagguca

SEQ ID NO: 447772 - RNA, 18 nt, Human
uguugcaggggagggccg

SEQ ID NO: 447773 - RNA, 26 nt, Human
uuagcccccucaguaauguucuucag

SEQ ID NO: 447774 - RNA, 24 nt, Human
uuccccuagcuucuuaaauggccc

SEQ ID NO: 447775 - RNA, 25 nt, Human
uucccugaauuuuuuuuuuaaacaa

SEQ ID NO: 447776 - RNA, 26 nt, Human
uucuucagagauguggagauaggagg

SEQ ID NO: 447777 - RNA, 25 nt, Human
uuggagauuuuccaacccacccuag

SEQ ID NO: 447778 - RNA, 20 nt, Human
uuucaaauguucccucauca

SEQ ID NO: 447779 - RNA, 18 nt, Human
uuucccucacccccaaca

SEQ ID NO: 447780 - RNA, 21 nt, Human
uuuuuuuuuuuuggaguucca

SEQ ID NO: 447781 - RNA, 19 nt, Human
uuuuuuuuuuuuuuuuugg

SEQ ID NO: 447782 - RNA, 23 nt, Human
uuuuuuuuuuuuuuuuuggaguu

SEQ ID NO: 447783 - RNA, 24 nt, Human
aaacauucauugaccaccuuccca

SEQ ID NO: 447784 - RNA, 22 nt, Human
aaaguaugaaaaagugcuucuc

SEQ ID NO: 447785 - RNA, 18 nt, Human
aaagugcuucuccaaacc

SEQ ID NO: 447786 - RNA, 22 nt, Human
aaauaauaaaguauauaccuug

SEQ ID NO: 447787 - RNA, 23 nt, Human
aacauguauacuuucacaaaagu

SEQ ID NO: 447788 - RNA, 18 nt, Human
aagaaucauucauucuuu

SEQ ID NO: 447789 - RNA, 22 nt, Human
aagaccuauaaauacagaaaua

SEQ ID NO: 447790 - RNA, 24 nt, Human
aagcagagcaggaaagcccaaagc

SEQ ID NO: 447791 - RNA, 19 nt, Human
aagcucuggccuuucucag

SEQ ID NO: 447792 - RNA, 22 nt, Human
aagugcuucuccaaaccguucc

SEQ ID NO: 447793 - RNA, 24 nt, Human
aagugguacagaagcacaagagga

SEQ ID NO: 447794 - RNA, 24 nt, Human
acaaaaacauucauuucaucaaaa

SEQ ID NO: 447795 - RNA, 22 nt, Human
acaguacuagggacaaagguac

SEQ ID NO: 447796 - RNA, 25 nt, Human
acccuaggcgacuacaaaacuccca

SEQ ID NO: 447797 - RNA, 18 nt, Human
agauacgagagacugggc

SEQ ID NO: 447798 - RNA, 22 nt, Human
agcagagcaggaaagcccaaag

SEQ ID NO: 447799 - RNA, 21 nt, Human
agcuccacgaugccgggcggc

SEQ ID NO: 447800 - RNA, 27 nt, Human
aggcagaugaaacacaaugaauacagg

SEQ ID NO: 447801 - RNA, 19 nt, Human
aggcgacuacaaaacuccc

SEQ ID NO: 447802 - RNA, 22 nt, Human
agggggccccagcuccacgaug

SEQ ID NO: 447803 - RNA, 23 nt, Human
agugcuucuccaaaccguuccau

SEQ ID NO: 447804 - RNA, 19 nt, Human
auacaaaaacauucauuuc

SEQ ID NO: 447805 - RNA, 22 nt, Human
auauaucuugucacacagcuug

SEQ ID NO: 447806 - RNA, 20 nt, Human
augaaguugcaaaguucaga

SEQ ID NO: 447807 - RNA, 22 nt, Human
caaaccucuuuucccaacacac

SEQ ID NO: 447808 - RNA, 19 nt, Human
caacugaaaguaacuuguu

SEQ ID NO: 447809 - RNA, 18 nt, Human
cacacagcuugaaugcac

SEQ ID NO: 447810 - RNA, 22 nt, Human
cacuugggaaauacaacacagg

SEQ ID NO: 447811 - RNA, 22 nt, Human
cagaauccccagggauguuuuc

SEQ ID NO: 447812 - RNA, 18 nt, Human
caguacuagggacaaagg

SEQ ID NO: 447813 - RNA, 18 nt, Human
cauccauccagacacuug

SEQ ID NO: 447814 - RNA, 23 nt, Human
cauucauuucaucaaaacauuca

SEQ ID NO: 447815 - RNA, 21 nt, Human
ccagacacuugggaaauacaa

SEQ ID NO: 447816 - RNA, 22 nt, Human
ccagacacuugggaaauacaac

SEQ ID NO: 447817 - RNA, 24 nt, Human
cccaaaagcagagcaggaaagccc

SEQ ID NO: 447818 - RNA, 21 nt, Human
ccccagcuccacgaugccggg

SEQ ID NO: 447819 - RNA, 20 nt, Human
cccuuugggaugucaccgcu

SEQ ID NO: 447820 - RNA, 19 nt, Human
ccucuggagaacauaauua

SEQ ID NO: 447821 - RNA, 19 nt, Human
cgacccaaaagcagagcag

SEQ ID NO: 447822 - RNA, 23 nt, Human
cuaccacaucuaagagcugggaa

SEQ ID NO: 447823 - RNA, 20 nt, Human
cucuucuagguacuuagcug

SEQ ID NO: 447824 - RNA, 22 nt, Human
cugcagcagguucacuugcugu

SEQ ID NO: 447825 - RNA, 21 nt, Human
cugccgggccugcccuuuggg

SEQ ID NO: 447826 - RNA, 21 nt, Human
cuggcaggccuuccuaagccc

SEQ ID NO: 447827 - RNA, 21 nt, Human
cuuggcuuuccucugcuucug

SEQ ID NO: 447828 - RNA, 29 nt, Human
gagcaggaaagcccaaagcucuggccuuu

SEQ ID NO: 447829 - RNA, 21 nt, Human
gcagagcaggaaagcccaaag

SEQ ID NO: 447830 - RNA, 20 nt, Human
gcggcggcggcgacacggag

SEQ ID NO: 447831 - RNA, 19 nt, Human
ggaaagcccaaagcucugg

SEQ ID NO: 447832 - RNA, 21 nt, Human
guaaaucaaggcuggacaaag

SEQ ID NO: 447833 - RNA, 19 nt, Human
guacagaagcacaagagga

SEQ ID NO: 447834 - RNA, 24 nt, Human
guucugacgaagugcuuuucauuc

SEQ ID NO: 447835 - RNA, 23 nt, Human
uaaaacaguaguuuugagauucu

SEQ ID NO: 447836 - RNA, 24 nt, Human
uaaaaugacaucaaugcauuuacu

SEQ ID NO: 447837 - RNA, 20 nt, Human
uacaaaacucccaggcaaaa

SEQ ID NO: 447838 - RNA, 24 nt, Human
uaggccuaggcagaugaaacacaa

SEQ ID NO: 447839 - RNA, 27 nt, Human
ucaaaacauucauugaccaccuuccca

SEQ ID NO: 447840 - RNA, 21 nt, Human
ucaaaccaaguucacuucaug

SEQ ID NO: 447841 - RNA, 22 nt, Human
ucagagcuggcagccgcuucug

SEQ ID NO: 447842 - RNA, 23 nt, Human
uccaaauucuuccucuccugugu

SEQ ID NO: 447843 - RNA, 23 nt, Human
uccaaauucuuccucuccugugu

SEQ ID NO: 447844 - RNA, 19 nt, Human
uccagcuuacacagacaga

SEQ ID NO: 447845 - RNA, 19 nt, Human
uccauccagacacuuggga

SEQ ID NO: 447846 - RNA, 24 nt, Human
uccauccauccagacacuugggaa

SEQ ID NO: 447847 - RNA, 19 nt, Human
ucugauguuuuaggcuagc

SEQ ID NO: 447848 - RNA, 18 nt, Human
ucugcagcagguucacuu

SEQ ID NO: 447849 - RNA, 21 nt, Human
ugaguaccucuccauccaucc

SEQ ID NO: 447850 - RNA, 19 nt, Human
ugaguuggucuuuccugau

SEQ ID NO: 447851 - RNA, 20 nt, Human
ugcacaugauauauguacau

SEQ ID NO: 447852 - RNA, 24 nt, Human
ugggaugucaccgcugacccuagg

SEQ ID NO: 447853 - RNA, 21 nt, Human
ugguacagaagcacaagagga

SEQ ID NO: 447854 - RNA, 19 nt, Human
ugucacacagcuugaaugc

SEQ ID NO: 447855 - RNA, 20 nt, Human
uucacaaaaguaugaaaaag

SEQ ID NO: 447856 - RNA, 21 nt, Human
uucagagcuggcagccgcuuc

SEQ ID NO: 447857 - RNA, 25 nt, Human
uuuacacuugcagggagcucuucua

SEQ ID NO: 447858 - RNA, 20 nt, Human
uuuacugcuuucuuuucugu

SEQ ID NO: 447859 - RNA, 23 nt, Human
uuuucccaacacacuggcugaug

SEQ ID NO: 447860 - RNA, 22 nt, Human
aaaaagacaacaggaguacaga

SEQ ID NO: 447861 - RNA, 18 nt, Human
aaacaaaaccaggaacga

SEQ ID NO: 447862 - RNA, 18 nt, Human
aaacaagaugccaaaauc

SEQ ID NO: 447863 - RNA, 23 nt, Human
aaagcagcuccaucccuacacca

SEQ ID NO: 447864 - RNA, 21 nt, Human
aaauccaaacaaaaccaggaa

SEQ ID NO: 447865 - RNA, 20 nt, Human
aaauuaaaugugguuucugg

SEQ ID NO: 447866 - RNA, 27 nt, Human
aacaagaugccaaaauccaaacaaaaa

SEQ ID NO: 447867 - RNA, 22 nt, Human
aagaaaaacugggggccacugg

SEQ ID NO: 447868 - RNA, 20 nt, Human
aagaugccaaaauccaaaca

SEQ ID NO: 447869 - RNA, 21 nt, Human
aagaugccaaaauccaaacaa

SEQ ID NO: 447870 - RNA, 21 nt, Human
aagcaacuccccagcccaucc

SEQ ID NO: 447871 - RNA, 18 nt, Human
aagcugcagcggcggugu

SEQ ID NO: 447872 - RNA, 22 nt, Human
aaggaacccuggggaaacaagc

SEQ ID NO: 447873 - RNA, 24 nt, Human
acacacccgcugccugggcugugg

SEQ ID NO: 447874 - RNA, 18 nt, Human
acagcagagggucauggg

SEQ ID NO: 447875 - RNA, 18 nt, Human
accgcacagcagcaggca

SEQ ID NO: 447876 - RNA, 23 nt, Human
acucaauaaaguuugaaaagguc

SEQ ID NO: 447877 - RNA, 20 nt, Human
agacaacaggaguacagacc

SEQ ID NO: 447878 - RNA, 24 nt, Human
agaugccaaaauccaaacaaaacc

SEQ ID NO: 447879 - RNA, 21 nt, Human
agcccucuuuguccuccgccc

SEQ ID NO: 447880 - RNA, 21 nt, Human
agccgcgcggacccuggccuc

SEQ ID NO: 447881 - RNA, 21 nt, Human
agccugaagagggggguggcc

SEQ ID NO: 447882 - RNA, 21 nt, Human
agcgucgccuuccuggguggc

SEQ ID NO: 447883 - RNA, 22 nt, Human
aggaaggccaggccgagugggc

SEQ ID NO: 447884 - RNA, 25 nt, Human
aggauuagguuuccagagaagaggg

SEQ ID NO: 447885 - RNA, 21 nt, Human
aggccagagaguccugcccag

SEQ ID NO: 447886 - RNA, 19 nt, Human
agggagagacagcagaggg

SEQ ID NO: 447887 - RNA, 18 nt, Human
agggcaccaggagcaggg

SEQ ID NO: 447888 - RNA, 19 nt, Human
agggcagugggccccccuc

SEQ ID NO: 447889 - RNA, 21 nt, Human
aggggcacauggccuggcauu

SEQ ID NO: 447890 - RNA, 20 nt, Human
agggugccagccggcugaug

SEQ ID NO: 447891 - RNA, 25 nt, Human
aggugguucuggagcuaccgcacag

SEQ ID NO: 447892 - RNA, 18 nt, Human
auccaaacaaaaccagga

SEQ ID NO: 447893 - RNA, 21 nt, Human
augcugcugaauccugugggc

SEQ ID NO: 447894 - RNA, 20 nt, Human
caacaggaguacagaccugg

SEQ ID NO: 447895 - RNA, 19 nt, Human
caacuccccagcccauccc

SEQ ID NO: 447896 - RNA, 20 nt, Human
caagcaacuccccagcccau

SEQ ID NO: 447897 - RNA, 21 nt, Human
caagguguugagaguaagaau

SEQ ID NO: 447898 - RNA, 24 nt, Human
cacauccaagagcucaggcugccu

SEQ ID NO: 447899 - RNA, 24 nt, Human
cacgucuugguggcacaagcaacu

SEQ ID NO: 447900 - RNA, 18 nt, Human
cacugugcccaagccgcg

SEQ ID NO: 447901 - RNA, 25 nt, Human
cacuuuuccuccuguguucuggaga

SEQ ID NO: 447902 - RNA, 25 nt, Human
cagagugccaccccagcuguugggg

SEQ ID NO: 447903 - RNA, 18 nt, Human
cagcaccaggaccugcug

SEQ ID NO: 447904 - RNA, 20 nt, Human
cagcccaucccugcucacuu

SEQ ID NO: 447905 - RNA, 20 nt, Human
cagccgacugcaccgucuug

SEQ ID NO: 447906 - RNA, 23 nt, Human
caggaaggucccugagccagggc

SEQ ID NO: 447907 - RNA, 24 nt, Human
caggcagacugaccacacucccga

SEQ ID NO: 447908 - RNA, 26 nt, Human
cagggcagagugccaccccagcuguu

SEQ ID NO: 447909 - RNA, 18 nt, Human
caucuuugcuuuucagaa

SEQ ID NO: 447910 - RNA, 20 nt, Human
cauugcaggccacagaaggc

SEQ ID NO: 447911 - RNA, 22 nt, Human
ccaaaauccaaacaaaaccagg

SEQ ID NO: 447912 - RNA, 24 nt, Human
ccagccggcugaugcugugccaga

SEQ ID NO: 447913 - RNA, 18 nt, Human
ccaggagcagggaaaaag

SEQ ID NO: 447914 - RNA, 22 nt, Human
ccaggagcagggaaaaagacaa

SEQ ID NO: 447915 - RNA, 19 nt, Human
ccaggccgagugggccucg

SEQ ID NO: 447916 - RNA, 19 nt, Human
cccaagccgcgcggacccu

SEQ ID NO: 447917 - RNA, 18 nt, Human
cccagggcucugcuucag

SEQ ID NO: 447918 - RNA, 25 nt, Human
cccagugaucgcuaaaaacauagcc

SEQ ID NO: 447919 - RNA, 24 nt, Human
ccccagaugccugucaggaaggaa

SEQ ID NO: 447920 - RNA, 21 nt, Human
ccccagcccaucccugcucac

SEQ ID NO: 447921 - RNA, 23 nt, Human
cccguuccucacaguggcuguca

SEQ ID NO: 447922 - RNA, 21 nt, Human
cccuacacagguccagagggc

SEQ ID NO: 447923 - RNA, 22 nt, Human
cccugaucugggggagccaagg

SEQ ID NO: 447924 - RNA, 19 nt, Human
cccuugggagaacuugggg

SEQ ID NO: 447925 - RNA, 21 nt, Human
ccgacugcaccgucuuguccu

SEQ ID NO: 447926 - RNA, 23 nt, Human
ccgcgcggacccuggccuccuuc

SEQ ID NO: 447927 - RNA, 20 nt, Human
ccucacaguggcugucaguc

SEQ ID NO: 447928 - RNA, 18 nt, Human
ccugaagagggggguggc

SEQ ID NO: 447929 - RNA, 21 nt, Human
ccugcugcuggggccgguugc

SEQ ID NO: 447930 - RNA, 24 nt, Human
ccugcugcuggggccgguugcugg

SEQ ID NO: 447931 - RNA, 20 nt, Human
ccuggcgcagccugcucuuc

SEQ ID NO: 447932 - RNA, 19 nt, Human
ccuggcuucugcccuccca

SEQ ID NO: 447933 - RNA, 19 nt, Human
ccugggccuggccuccugc

SEQ ID NO: 447934 - RNA, 21 nt, Human
ccuucccugcucucuuccuuc

SEQ ID NO: 447935 - RNA, 24 nt, Human
cgccaggcccuggcucugcuccug

SEQ ID NO: 447936 - RNA, 19 nt, Human
cgcuacacacacacacaca

SEQ ID NO: 447937 - RNA, 24 nt, Human
cggaagggugccagccggcugaug

SEQ ID NO: 447938 - RNA, 21 nt, Human
cgggcuggggacuuggagaac

SEQ ID NO: 447939 - RNA, 24 nt, Human
cgucuuguccuuuuccgcuacaca

SEQ ID NO: 447940 - RNA, 24 nt, Human
cucccaggaaggucccugagccag

SEQ ID NO: 447941 - RNA, 19 nt, Human
cuccgccagcaccaggacc

SEQ ID NO: 447942 - RNA, 18 nt, Human
cucuuccccuucucgccc

SEQ ID NO: 447943 - RNA, 19 nt, Human
cucuuccuucugcucaucu

SEQ ID NO: 447944 - RNA, 19 nt, Human
cugaccacauccaagagcu

SEQ ID NO: 447945 - RNA, 18 nt, Human
cugagcugcgguuucccc

SEQ ID NO: 447946 - RNA, 25 nt, Human
cuggccugggccuggccuccugcag

SEQ ID NO: 447947 - RNA, 21 nt, Human
cuggcgcagccugcucuuccc

SEQ ID NO: 447948 - RNA, 18 nt, Human
cugugugcugagccacag

SEQ ID NO: 447949 - RNA, 22 nt, Human
cugugugcugagccacagaauu

SEQ ID NO: 447950 - RNA, 20 nt, Human
cuucagagccgccguaggag

SEQ ID NO: 447951 - RNA, 19 nt, Human
cuugauggucgguucacuu

SEQ ID NO: 447952 - RNA, 20 nt, Human
gaggguguccagcagccagc

SEQ ID NO: 447953 - RNA, 24 nt, Human
gcagcagccugaagaggggggugg

SEQ ID NO: 447954 - RNA, 20 nt, Human
gccaacagcugaacagggag

SEQ ID NO: 447955 - RNA, 21 nt, Human
gccaggcccuggcucugcucc

SEQ ID NO: 447956 - RNA, 24 nt, Human
gcccguuccucacaguggcuguca

SEQ ID NO: 447957 - RNA, 20 nt, Human
gcccuacacagguccagagg

SEQ ID NO: 447958 - RNA, 18 nt, Human
gcccuggcucugcuccug

SEQ ID NO: 447959 - RNA, 22 nt, Human
gccuccuucccugcucucuucc

SEQ ID NO: 447960 - RNA, 19 nt, Human
gcgaagggcgggcuccggg

SEQ ID NO: 447961 - RNA, 22 nt, Human
gcuacacacacacacacaagug

SEQ ID NO: 447962 - RNA, 19 nt, Human
gcugcugaauccugugggc

SEQ ID NO: 447963 - RNA, 20 nt, Human
gcugggugcuucuggcgcgu

SEQ ID NO: 447964 - RNA, 23 nt, Human
gcugucagucucugcuggggaga

SEQ ID NO: 447965 - RNA, 21 nt, Human
ggaagaaaaacugggggccac

SEQ ID NO: 447966 - RNA, 21 nt, Human
ggagaacuagagggcagaggg

SEQ ID NO: 447967 - RNA, 23 nt, Human
ggcaccaggagcagggaaaaaga

SEQ ID NO: 447968 - RNA, 19 nt, Human
ggcccagcaggugcuguca

SEQ ID NO: 447969 - RNA, 18 nt, Human
ggccgagugggccucggg

SEQ ID NO: 447970 - RNA, 19 nt, Human
ggccgagugggccucgggg

SEQ ID NO: 447971 - RNA, 20 nt, Human
ggccgguugcugggcagggc

SEQ ID NO: 447972 - RNA, 23 nt, Human
ggcgagugcggggucugcccccu

SEQ ID NO: 447973 - RNA, 18 nt, Human
gggaagaaaaacuggggg

SEQ ID NO: 447974 - RNA, 18 nt, Human
gggcagggcugggugcuu

SEQ ID NO: 447975 - RNA, 22 nt, Human
gggcagggcugggugcuucugg

SEQ ID NO: 447976 - RNA, 21 nt, Human
gggcccaagcugcagcggcgg

SEQ ID NO: 447977 - RNA, 21 nt, Human
gggcuuccggcaucuuugcuu

SEQ ID NO: 447978 - RNA, 19 nt, Human
ggggaaagcagcuccaucc

SEQ ID NO: 447979 - RNA, 25 nt, Human
ggggguggccugugcaaaggcaugu

SEQ ID NO: 447980 - RNA, 23 nt, Human
gucccagggcucugcuucagagc

SEQ ID NO: 447981 - RNA, 21 nt, Human
guguggcgagugcggggucug

SEQ ID NO: 447982 - RNA, 26 nt, Human
uaaaaacauagcccucuuuguccucc

SEQ ID NO: 447983 - RNA, 27 nt, Human
uacacacacacacacaagugaagaggg

SEQ ID NO: 447984 - RNA, 20 nt, Human
uagaaccauugacucaauaa

SEQ ID NO: 447985 - RNA, 22 nt, Human
uauuaccaaccuuugggaacaa

SEQ ID NO: 447986 - RNA, 23 nt, Human
ucacuagggugggcuuuuugggg

SEQ ID NO: 447987 - RNA, 19 nt, Human
uccagagaagaggguccca

SEQ ID NO: 447988 - RNA, 22 nt, Human
uccaucccuacaccaaccccag

SEQ ID NO: 447989 - RNA, 18 nt, Human
uccccagcccaucccugc

SEQ ID NO: 447990 - RNA, 20 nt, Human
uccccagcccaucccugcuc

SEQ ID NO: 447991 - RNA, 18 nt, Human
uccccagcugggccuggg

SEQ ID NO: 447992 - RNA, 19 nt, Human
ucccuacaccaaccccaga

SEQ ID NO: 447993 - RNA, 23 nt, Human
ucccugcucacuugcaggcagag

SEQ ID NO: 447994 - RNA, 21 nt, Human
uccgccagcaccaggaccugc

SEQ ID NO: 447995 - RNA, 22 nt, Human
ucuccccagcugggccugggcu

SEQ ID NO: 447996 - RNA, 21 nt, Human
ucucuggccugggccuggccu

SEQ ID NO: 447997 - RNA, 28 nt, Human
ucugcuccuggcgccccuuggcaggaca

SEQ ID NO: 447998 - RNA, 21 nt, Human
ugacccaggcuuccccagugg

SEQ ID NO: 447999 - RNA, 19 nt, Human
ugagcugcgguuuccccgc

SEQ ID NO: 448000 - RNA, 24 nt, Human
ugaggcccuacacagguccagagg

SEQ ID NO: 448001 - RNA, 20 nt, Human
ugaucugggggagccaaggu

SEQ ID NO: 448002 - RNA, 22 nt, Human
ugaucugggggagccaaggugu

SEQ ID NO: 448003 - RNA, 20 nt, Human
ugccugggcugugggucagu

SEQ ID NO: 448004 - RNA, 22 nt, Human
ugccugggcugugggucagucc

SEQ ID NO: 448005 - RNA, 21 nt, Human
ugccuggggucucuggccugg

SEQ ID NO: 448006 - RNA, 20 nt, Human
ugcucucuuccuucugcuca

SEQ ID NO: 448007 - RNA, 18 nt, Human
ugcuggucucuucagggc

SEQ ID NO: 448008 - RNA, 20 nt, Human
ugcugucaggcagggaccag

SEQ ID NO: 448009 - RNA, 20 nt, Human
ugcugucaggcagggaccag

SEQ ID NO: 448010 - RNA, 18 nt, Human
uggagaaacuaaacugga

SEQ ID NO: 448011 - RNA, 20 nt, Human
uggagcuaccgcacagcagc

SEQ ID NO: 448012 - RNA, 18 nt, Human
uggcaggaaggcccagca

SEQ ID NO: 448013 - RNA, 22 nt, Human
uggcaggacagggcgccaucuc

SEQ ID NO: 448014 - RNA, 25 nt, Human
uggcauugcaggccacagaaggcca

SEQ ID NO: 448015 - RNA, 19 nt, Human
uggccccuuauuaccaacc

SEQ ID NO: 448016 - RNA, 21 nt, Human
uggccccuuauuaccaaccuu

SEQ ID NO: 448017 - RNA, 22 nt, Human
uggccugggccuggccuccugc

SEQ ID NO: 448018 - RNA, 21 nt, Human
uggcggugcccagugaucgcu

SEQ ID NO: 448019 - RNA, 20 nt, Human
uggcuuggagaaggaauagu

SEQ ID NO: 448020 - RNA, 25 nt, Human
ugggaggcgaagggcgggcuccggg

SEQ ID NO: 448021 - RNA, 23 nt, Human
uggggaacguucauggguguucu

SEQ ID NO: 448022 - RNA, 19 nt, Human
ugggggccacuggcaggaa

SEQ ID NO: 448023 - RNA, 19 nt, Human
ugggugcccagggcagagu

SEQ ID NO: 448024 - RNA, 21 nt, Human
ugugauguuucaggggcaugg

SEQ ID NO: 448025 - RNA, 19 nt, Human
uguuggggacagcaugggg

SEQ ID NO: 448026 - RNA, 21 nt, Human
uguuggggacagcaugggguc

SEQ ID NO: 448027 - RNA, 22 nt, Human
uugaaaaggucuuaugagccaa

SEQ ID NO: 448028 - RNA, 18 nt, Human
uugauggucgguucacuu

SEQ ID NO: 448029 - RNA, 22 nt, Human
uugauggucgguucacuuuucc

SEQ ID NO: 448030 - RNA, 22 nt, Human
uuggagaacuagagggcagagg

SEQ ID NO: 448031 - RNA, 24 nt, Human
uuuccgcuacacacacacacacaa

SEQ ID NO: 448032 - RNA, 22 nt, Human
aaaaaacccugaaaccucccaa

SEQ ID NO: 448033 - RNA, 27 nt, Human
aaaacacuuuuguuccuuaucucucug

SEQ ID NO: 448034 - RNA, 18 nt, Human
aaaagaaacaaaagaaua

SEQ ID NO: 448035 - RNA, 21 nt, Human
aaaaugcagguacaauacugu

SEQ ID NO: 448036 - RNA, 23 nt, Human
aaacaacagaaaacacuuuuguu

SEQ ID NO: 448037 - RNA, 20 nt, Human
aaagagagagggaaagaaag

SEQ ID NO: 448038 - RNA, 18 nt, Human
aaauagcuuguaauuuga

SEQ ID NO: 448039 - RNA, 23 nt, Human
aacacggccuucuuugagugcca

SEQ ID NO: 448040 - RNA, 18 nt, Human
aacaugggaaaccccagu

SEQ ID NO: 448041 - RNA, 23 nt, Human
aaccccagugauagaagaaacag

SEQ ID NO: 448042 - RNA, 24 nt, Human
aacucacuugccccaaauguccug

SEQ ID NO: 448043 - RNA, 20 nt, Human
aacugcagggcugaaggaac

SEQ ID NO: 448044 - RNA, 18 nt, Human
aagaaaagauucccaggc

SEQ ID NO: 448045 - RNA, 23 nt, Human
aagaaacaaaagaauaaacuggc

SEQ ID NO: 448046 - RNA, 19 nt, Human
aagaaacagccugaaugca

SEQ ID NO: 448047 - RNA, 20 nt, Human
aagaaagagagagggaaagg

SEQ ID NO: 448048 - RNA, 28 nt, Human
aagaagaaagagagagggaaagaaagaa

SEQ ID NO: 448049 - RNA, 30 nt, Human
aagaagaaagagagagggaaagaaagaagc

SEQ ID NO: 448050 - RNA, 24 nt, Human
aagcaaaaagcuggccaaaagcga

SEQ ID NO: 448051 - RNA, 23 nt, Human
aaggaggagugagaaguuggaaa

SEQ ID NO: 448052 - RNA, 19 nt, Human
acaggguaaaaauggaaaa

SEQ ID NO: 448053 - RNA, 22 nt, Human
acagguacuccaacauccauag

SEQ ID NO: 448054 - RNA, 18 nt, Human
accaaaacacucugccag

SEQ ID NO: 448055 - RNA, 23 nt, Human
agaaagaagccagggaagauugu

SEQ ID NO: 448056 - RNA, 23 nt, Human
agaaaggagaggaggaaguaggg

SEQ ID NO: 448057 - RNA, 18 nt, Human
agaaaugucaacuucuga

SEQ ID NO: 448058 - RNA, 18 nt, Human
agaagcaugucaaggcca

SEQ ID NO: 448059 - RNA, 19 nt, Human
agaaguuggaaaaagaggu

SEQ ID NO: 448060 - RNA, 18 nt, Human
agaaucucaaccucugcu

SEQ ID NO: 448061 - RNA, 18 nt, Human
agagagggggggaaaaag

SEQ ID NO: 448062 - RNA, 22 nt, Human
agagagggggggaaaaagagag

SEQ ID NO: 448063 - RNA, 20 nt, Human
agagaucacugcccuaaacc

SEQ ID NO: 448064 - RNA, 20 nt, Human
agagcaaauccuggccucaa

SEQ ID NO: 448065 - RNA, 23 nt, Human
agagggaaagaaagaagccaggg

SEQ ID NO: 448066 - RNA, 19 nt, Human
agcucauucccuuccucaa

SEQ ID NO: 448067 - RNA, 22 nt, Human
aggaaaagggagcucagggcca

SEQ ID NO: 448068 - RNA, 20 nt, Human
aggagaagugcggguugaga

SEQ ID NO: 448069 - RNA, 19 nt, Human
aggagaggaggaaguaggg

SEQ ID NO: 448070 - RNA, 21 nt, Human
aggcagugaaucacucacagg

SEQ ID NO: 448071 - RNA, 20 nt, Human
aggcccagaaacuuguccaa

SEQ ID NO: 448072 - RNA, 23 nt, Human
agggagagacaggccuaggggga

SEQ ID NO: 448073 - RNA, 23 nt, Human
agggucucugugugugugugugu

SEQ ID NO: 448074 - RNA, 25 nt, Human
agggucucugugugugugugugugg

SEQ ID NO: 448075 - RNA, 23 nt, Human
agucaagaaauguaggcccagaa

SEQ ID NO: 448076 - RNA, 24 nt, Human
auacaaacacaucuaucguaauaa

SEQ ID NO: 448077 - RNA, 20 nt, Human
aucaaugcugcccaaacauc

SEQ ID NO: 448078 - RNA, 19 nt, Human
aucauagucugauacuccc

SEQ ID NO: 448079 - RNA, 24 nt, Human
aucaucagaaaaaaaacaauacaa

SEQ ID NO: 448080 - RNA, 19 nt, Human
augcugcccaaacaucugu

SEQ ID NO: 448081 - RNA, 20 nt, Human
caaaauguucccugaacaga

SEQ ID NO: 448082 - RNA, 19 nt, Human
caacagagcauguccagac

SEQ ID NO: 448083 - RNA, 24 nt, Human
caacaugggaaaccccagugauag

SEQ ID NO: 448084 - RNA, 22 nt, Human
caagaaaagcaaugaauagaaa

SEQ ID NO: 448085 - RNA, 23 nt, Human
cacaacuuugacacuuguuugac

SEQ ID NO: 448086 - RNA, 23 nt, Human
cacaguaccuaaaacacaguaaa

SEQ ID NO: 448087 - RNA, 18 nt, Human
caccccagcccaccccau

SEQ ID NO: 448088 - RNA, 24 nt, Human
caccccagcccaccccauccccaa

SEQ ID NO: 448089 - RNA, 21 nt, Human
cacggccuucuuugagugcca

SEQ ID NO: 448090 - RNA, 18 nt, Human
cacucugccagacaggau

SEQ ID NO: 448091 - RNA, 19 nt, Human
cacugaagggaggccugca

SEQ ID NO: 448092 - RNA, 21 nt, Human
cagaaaaaaaacaauacaaac

SEQ ID NO: 448093 - RNA, 24 nt, Human
cagaaaaaaaacaauacaaacaca

SEQ ID NO: 448094 - RNA, 19 nt, Human
cagaaaacacuuuuguucc

SEQ ID NO: 448095 - RNA, 24 nt, Human
cagaagugcugcaacaugggaaac

SEQ ID NO: 448096 - RNA, 20 nt, Human
cagacuguccauacagccac

SEQ ID NO: 448097 - RNA, 21 nt, Human
cagccugaaugcaaaauguuc

SEQ ID NO: 448098 - RNA, 20 nt, Human
cagcuauggcugcugcuugg

SEQ ID NO: 448099 - RNA, 21 nt, Human
caggacccuugccaaagaggc

SEQ ID NO: 448100 - RNA, 22 nt, Human
caggaggacuacaaucacggca

SEQ ID NO: 448101 - RNA, 25 nt, Human
cagucccgagccccggcccucuccc

SEQ ID NO: 448102 - RNA, 21 nt, Human
cauccaccccagcccacccca

SEQ ID NO: 448103 - RNA, 27 nt, Human
cauccccaaagcacuaaaagguccuuc

SEQ ID NO: 448104 - RNA, 22 nt, Human
caugaaaagggcuaugugugga

SEQ ID NO: 448105 - RNA, 21 nt, Human
ccaaaacacucugccagacag

SEQ ID NO: 448106 - RNA, 19 nt, Human
ccacaaagaaaagauuccc

SEQ ID NO: 448107 - RNA, 25 nt, Human
ccacagcaggucccauugaacacac

SEQ ID NO: 448108 - RNA, 23 nt, Human
ccaggaaaaacaugaguaugaca

SEQ ID NO: 448109 - RNA, 20 nt, Human
cccacaaagaaaagauuccc

SEQ ID NO: 448110 - RNA, 21 nt, Human
cccaccccauccccaaagcac

SEQ ID NO: 448111 - RNA, 20 nt, Human
cccagaucaggcucauccuu

SEQ ID NO: 448112 - RNA, 23 nt, Human
cccagaucaggcucauccuugac

SEQ ID NO: 448113 - RNA, 24 nt, Human
cccaggaaaaacaugaguaugacc

SEQ ID NO: 448114 - RNA, 21 nt, Human
ccccaaaacaacagaaaacac

SEQ ID NO: 448115 - RNA, 21 nt, Human
ccccggcccucuccccagauc

SEQ ID NO: 448116 - RNA, 23 nt, Human
cccgagccccggcccucucccca

SEQ ID NO: 448117 - RNA, 21 nt, Human
cccugggcagaagccccaagg

SEQ ID NO: 448118 - RNA, 18 nt, Human
ccuggagcccugggcaga

SEQ ID NO: 448119 - RNA, 27 nt, Human
ccuggagcccugggcagaagccccaag

SEQ ID NO: 448120 - RNA, 20 nt, Human
ccuggucuggaucaggaggc

SEQ ID NO: 448121 - RNA, 21 nt, Human
ccugugcuaggauggcaggag

SEQ ID NO: 448122 - RNA, 22 nt, Human
ccuuuuggagagcaaauccugg

SEQ ID NO: 448123 - RNA, 21 nt, Human
cgaagaagcaugucaaggcca

SEQ ID NO: 448124 - RNA, 19 nt, Human
cgacccagaagugcugcaa

SEQ ID NO: 448125 - RNA, 22 nt, Human
cgacuacaguuugcacauccag

SEQ ID NO: 448126 - RNA, 22 nt, Human
cggccuucuuugagugccagaa

SEQ ID NO: 448127 - RNA, 18 nt, Human
cgggaaaggcaaaauccu

SEQ ID NO: 448128 - RNA, 21 nt, Human
cgggaaaggcaaaauccuagc

SEQ ID NO: 448129 - RNA, 24 nt, Human
cgggaugaaaucaaagcgagaguu

SEQ ID NO: 448130 - RNA, 24 nt, Human
cgggcgccacgggaaaggcaaaau

SEQ ID NO: 448131 - RNA, 23 nt, Human
cguucccaggaaaaacaugagua

SEQ ID NO: 448132 - RNA, 20 nt, Human
cuacucccuuuacuucgcuc

SEQ ID NO: 448133 - RNA, 18 nt, Human
cuccacacagcuauggcu

SEQ ID NO: 448134 - RNA, 22 nt, Human
cuccauacuucuaucaaugcug

SEQ ID NO: 448135 - RNA, 19 nt, Human
cuccccuuggggcuguugg

SEQ ID NO: 448136 - RNA, 21 nt, Human
cuccgaaaaaagguccaucua

SEQ ID NO: 448137 - RNA, 20 nt, Human
cucuccugggaggcagaauc

SEQ ID NO: 448138 - RNA, 22 nt, Human
cugaaagcaaagggaaggggga

SEQ ID NO: 448139 - RNA, 21 nt, Human
cugauccuggagcccugggca

SEQ ID NO: 448140 - RNA, 22 nt, Human
cuggaucaggaggcauagagca

SEQ ID NO: 448141 - RNA, 21 nt, Human
cugggcaccaggacccuugcc

SEQ ID NO: 448142 - RNA, 20 nt, Human
cuguucugucagacugucca

SEQ ID NO: 448143 - RNA, 22 nt, Human
cuuccuaccaaccacauauuuc

SEQ ID NO: 448144 - RNA, 18 nt, Human
cuuucucucucuuucccu

SEQ ID NO: 448145 - RNA, 23 nt, Human
gaaaccucccaacucuaccacau

SEQ ID NO: 448146 - RNA, 20 nt, Human
gaaagaagaaagagagaggg

SEQ ID NO: 448147 - RNA, 22 nt, Human
gaagaaacagccugaaugcaaa

SEQ ID NO: 448148 - RNA, 18 nt, Human
gaagccccaaggagggag

SEQ ID NO: 448149 - RNA, 20 nt, Human
gagaagggcuggguuuggcg

SEQ ID NO: 448150 - RNA, 22 nt, Human
gagcauguccagacuggcauga

SEQ ID NO: 448151 - RNA, 21 nt, Human
gagccccggcccucuccccag

SEQ ID NO: 448152 - RNA, 18 nt, Human
gagggggauggggacggg

SEQ ID NO: 448153 - RNA, 22 nt, Human
gaguuuagucgggggaggggag

SEQ ID NO: 448154 - RNA, 21 nt, Human
gcagaacacuguaguguucca

SEQ ID NO: 448155 - RNA, 19 nt, Human
gcagaagccccaaggaggg

SEQ ID NO: 448156 - RNA, 24 nt, Human
gcagagcagcaaggguaaucaaag

SEQ ID NO: 448157 - RNA, 20 nt, Human
gcaggagaaagaagaaagag

SEQ ID NO: 448158 - RNA, 23 nt, Human
gccugaaugcaaaauguucccug

SEQ ID NO: 448159 - RNA, 23 nt, Human
gcgccacgggaaaggcaaaaucc

SEQ ID NO: 448160 - RNA, 21 nt, Human
gcuaggauggcaggagaaaga

SEQ ID NO: 448161 - RNA, 21 nt, Human
gcuaugcugaagccuccacac

SEQ ID NO: 448162 - RNA, 18 nt, Human
gcuauggcugcugcuugg

SEQ ID NO: 448163 - RNA, 21 nt, Human
gcucugucuugaaccccucca

SEQ ID NO: 448164 - RNA, 18 nt, Human
gcugcaacaugggaaacc

SEQ ID NO: 448165 - RNA, 19 nt, Human
ggacagacucccagucucc

SEQ ID NO: 448166 - RNA, 19 nt, Human
ggagaaagaagaaagagag

SEQ ID NO: 448167 - RNA, 18 nt, Human
ggaggaaaugagagggcc

SEQ ID NO: 448168 - RNA, 21 nt, Human
ggcacaacagagcauguccag

SEQ ID NO: 448169 - RNA, 21 nt, Human
ggccuucuuugagugccagaa

SEQ ID NO: 448170 - RNA, 20 nt, Human
gggacaaccaggacacugaa

SEQ ID NO: 448171 - RNA, 21 nt, Human
gggcagaagccccaaggaggg

SEQ ID NO: 448172 - RNA, 20 nt, Human
gggcuguuggccacuggucu

SEQ ID NO: 448173 - RNA, 21 nt, Human
ggggaggggagggggaugggg

SEQ ID NO: 448174 - RNA, 20 nt, Human
ggggauggggacggggugcu

SEQ ID NO: 448175 - RNA, 18 nt, Human
ggggggaaccugugagug

SEQ ID NO: 448176 - RNA, 22 nt, Human
guccacuccagcaucaucauag

SEQ ID NO: 448177 - RNA, 19 nt, Human
gucuccacauuccucacua

SEQ ID NO: 448178 - RNA, 18 nt, Human
gucugugugugugugugu

SEQ ID NO: 448179 - RNA, 18 nt, Human
gugauagaagaaacagcc

SEQ ID NO: 448180 - RNA, 19 nt, Human
gugauuuuuuuuuuuucuc

SEQ ID NO: 448181 - RNA, 23 nt, Human
guggccagucccgagccccggcc

SEQ ID NO: 448182 - RNA, 23 nt, Human
gugugucuguguguguguguguu

SEQ ID NO: 448183 - RNA, 21 nt, Human
guguguguguguguguaugug

SEQ ID NO: 448184 - RNA, 21 nt, Human
gugugugugugugugugugug

SEQ ID NO: 448185 - RNA, 18 nt, Human
uaaaacacaguaaaagca

SEQ ID NO: 448186 - RNA, 18 nt, Human
uaaaacacaguaaaagca

SEQ ID NO: 448187 - RNA, 24 nt, Human
uaaaacacaguaaaagcaauagga

SEQ ID NO: 448188 - RNA, 21 nt, Human
uaaacuggcaaaugcagagca

SEQ ID NO: 448189 - RNA, 21 nt, Human
uaaauuucaacagugcuucuc

SEQ ID NO: 448190 - RNA, 22 nt, Human
uaacaagaaaagcaaugaauag

SEQ ID NO: 448191 - RNA, 26 nt, Human
uaacuauaucaauaccaaaaauccuc

SEQ ID NO: 448192 - RNA, 21 nt, Human
uacaauacuguggaucaaggc

SEQ ID NO: 448193 - RNA, 19 nt, Human
uacaguuugcacauccagg

SEQ ID NO: 448194 - RNA, 24 nt, Human
uaccauugcugucaggacauaaca

SEQ ID NO: 448195 - RNA, 19 nt, Human
uagaagaaacagccugaau

SEQ ID NO: 448196 - RNA, 22 nt, Human
uagaugcaaaauugcaacgacc

SEQ ID NO: 448197 - RNA, 20 nt, Human
uaggcugagggaauacucca

SEQ ID NO: 448198 - RNA, 23 nt, Human
uaucugguacuagggggcaggua

SEQ ID NO: 448199 - RNA, 18 nt, Human
uauguguacucaaggguc

SEQ ID NO: 448200 - RNA, 20 nt, Human
uauuucacuuccccaaaaca

SEQ ID NO: 448201 - RNA, 22 nt, Human
uauuuggggcaacugcagggcu

SEQ ID NO: 448202 - RNA, 20 nt, Human
ucaacaucaguaucaucaga

SEQ ID NO: 448203 - RNA, 22 nt, Human
ucaaggccaagccuaguaagga

SEQ ID NO: 448204 - RNA, 19 nt, Human
ucaaugcugcccaaacauc

SEQ ID NO: 448205 - RNA, 21 nt, Human
ucaauggaaaguaaaagaggg

SEQ ID NO: 448206 - RNA, 20 nt, Human
ucacagcagaguucauccuu

SEQ ID NO: 448207 - RNA, 24 nt, Human
uccaagcauccccucccggugugc

SEQ ID NO: 448208 - RNA, 18 nt, Human
uccaccccagcccacccc

SEQ ID NO: 448209 - RNA, 22 nt, Human
uccauccaccccagcccacccc

SEQ ID NO: 448210 - RNA, 22 nt, Human
uccauccaccccagcccacccc

SEQ ID NO: 448211 - RNA, 18 nt, Human
ucccaggaaaaacaugag

SEQ ID NO: 448212 - RNA, 19 nt, Human
uccccaaaacaacagaaaa

SEQ ID NO: 448213 - RNA, 19 nt, Human
uccccuacucccuuuacuu

SEQ ID NO: 448214 - RNA, 23 nt, Human
ucccggcugccagacacucguuc

SEQ ID NO: 448215 - RNA, 24 nt, Human
ucccuagcugagaaaucuuagcuu

SEQ ID NO: 448216 - RNA, 26 nt, Human
uccuggagcccugggcaacucagaga

SEQ ID NO: 448217 - RNA, 18 nt, Human
ucgcugggcucccggcug

SEQ ID NO: 448218 - RNA, 18 nt, Human
ucuccgaaaaaaggucca

SEQ ID NO: 448219 - RNA, 21 nt, Human
ucuccggcgccugcucagucu

SEQ ID NO: 448220 - RNA, 26 nt, Human
ucucucugugugugugugugugugug

SEQ ID NO: 448221 - RNA, 19 nt, Human
ucucucuuucccugucucu

SEQ ID NO: 448222 - RNA, 22 nt, Human
ucuggaucaggaggcauagagc

SEQ ID NO: 448223 - RNA, 20 nt, Human
ucuuucuuguaaaagguuac

SEQ ID NO: 448224 - RNA, 25 nt, Human
ugaagccuccacacagcuauggcug

SEQ ID NO: 448225 - RNA, 19 nt, Human
ugaaggagaggagaaagga

SEQ ID NO: 448226 - RNA, 26 nt, Human
ugacaagcaggaggacuucgagggcg

SEQ ID NO: 448227 - RNA, 23 nt, Human
ugagaaguuggaaaaagagguac

SEQ ID NO: 448228 - RNA, 23 nt, Human
ugagggaauacuccaaccaaugg

SEQ ID NO: 448229 - RNA, 18 nt, Human
ugaucccuucacaguacc

SEQ ID NO: 448230 - RNA, 21 nt, Human
ugcaaaauugcaacgacccag

SEQ ID NO: 448231 - RNA, 23 nt, Human
ugcaacgacccagaagugcugca

SEQ ID NO: 448232 - RNA, 22 nt, Human
ugccagacacucguucgauccc

SEQ ID NO: 448233 - RNA, 22 nt, Human
ugccccugggccccuaacucac

SEQ ID NO: 448234 - RNA, 24 nt, Human
ugcuguagagaucacugcccuaaa

SEQ ID NO: 448235 - RNA, 23 nt, Human
uggaaaaagagguacacugaagg

SEQ ID NO: 448236 - RNA, 22 nt, Human
uggagcccugggcagaagcccc

SEQ ID NO: 448237 - RNA, 23 nt, Human
ugggaggcagaaucucaaccucu

SEQ ID NO: 448238 - RNA, 25 nt, Human
ugggccccuaacucacuugccccaa

SEQ ID NO: 448239 - RNA, 24 nt, Human
ugggcucccggcugccagacacuc

SEQ ID NO: 448240 - RNA, 22 nt, Human
uggggacggggugcuugguucc

SEQ ID NO: 448241 - RNA, 23 nt, Human
ugggguuuaggacagacucccag

SEQ ID NO: 448242 - RNA, 23 nt, Human
ugguaccucuuccuaccaaccac

SEQ ID NO: 448243 - RNA, 20 nt, Human
uguccaagcauccccucccg

SEQ ID NO: 448244 - RNA, 25 nt, Human
uguccagacuggcaugacugaggac

SEQ ID NO: 448245 - RNA, 23 nt, Human
ugucuguguguguguguguguaa

SEQ ID NO: 448246 - RNA, 18 nt, Human
ugugcuaggauggcagga

SEQ ID NO: 448247 - RNA, 24 nt, Human
uguguacucaagggucucugugug

SEQ ID NO: 448248 - RNA, 21 nt, Human
ugugucugugugugugugugu

SEQ ID NO: 448249 - RNA, 21 nt, Human
ugugugucugugugugugugu

SEQ ID NO: 448250 - RNA, 19 nt, Human
uguguguguauguguacuc

SEQ ID NO: 448251 - RNA, 21 nt, Human
ugugugugucugugugugugu

SEQ ID NO: 448252 - RNA, 21 nt, Human
ugugugugucugugugugugu

SEQ ID NO: 448253 - RNA, 21 nt, Human
ugugugugucugugugugugu

SEQ ID NO: 448254 - RNA, 21 nt, Human
ugugugugucugugugugugu

SEQ ID NO: 448255 - RNA, 24 nt, Human
ugugugugucugugugugugugug

SEQ ID NO: 448256 - RNA, 19 nt, Human
uguguguguguauguguac

SEQ ID NO: 448257 - RNA, 21 nt, Human
ugugugugugugucugugugu

SEQ ID NO: 448258 - RNA, 24 nt, Human
ugugugugugugucugugugugug

SEQ ID NO: 448259 - RNA, 18 nt, Human
uguguguguguguguaua

SEQ ID NO: 448260 - RNA, 20 nt, Human
uguguguguguguguaugug

SEQ ID NO: 448261 - RNA, 22 nt, Human
uguguguguguguguaugugua

SEQ ID NO: 448262 - RNA, 21 nt, Human
ugugugugugugugucugugu

SEQ ID NO: 448263 - RNA, 23 nt, Human
ugugugugugugugucugugugu

SEQ ID NO: 448264 - RNA, 30 nt, Human
ugugugugugugugucugugugugugugug

SEQ ID NO: 448265 - RNA, 18 nt, Human
ugugugugugugugugua

SEQ ID NO: 448266 - RNA, 20 nt, Human
uguguguguguguguguaua

SEQ ID NO: 448267 - RNA, 22 nt, Human
uguguguguguguguguauguu

SEQ ID NO: 448268 - RNA, 18 nt, Human
ugugugugugugugugug

SEQ ID NO: 448269 - RNA, 18 nt, Human
ugugugugugugugugug

SEQ ID NO: 448270 - RNA, 18 nt, Human
ugugugugugugugugug

SEQ ID NO: 448271 - RNA, 18 nt, Human
ugugugugugugugugug

SEQ ID NO: 448272 - RNA, 18 nt, Human
ugugugugugugugugug

SEQ ID NO: 448273 - RNA, 18 nt, Human
ugugugugugugugugug

SEQ ID NO: 448274 - RNA, 18 nt, Human
ugugugugugugugugug

SEQ ID NO: 448275 - RNA, 18 nt, Human
ugugugugugugugugug

SEQ ID NO: 448276 - RNA, 18 nt, Human
ugugugugugugugugug

SEQ ID NO: 448277 - RNA, 22 nt, Human
ugugugugugugugugugucug

SEQ ID NO: 448278 - RNA, 21 nt, Human
ugugugugugugugugugugu

SEQ ID NO: 448279 - RNA, 21 nt, Human
ugugugugugugugugugugu

SEQ ID NO: 448280 - RNA, 21 nt, Human
ugugugugugugugugugugu

SEQ ID NO: 448281 - RNA, 21 nt, Human
ugugugugugugugugugugu

SEQ ID NO: 448282 - RNA, 21 nt, Human
ugugugugugugugugugugu

SEQ ID NO: 448283 - RNA, 21 nt, Human
ugugugugugugugugugugu

SEQ ID NO: 448284 - RNA, 21 nt, Human
ugugugugugugugugugugu

SEQ ID NO: 448285 - RNA, 21 nt, Human
ugugugugugugugugugugu

SEQ ID NO: 448286 - RNA, 21 nt, Human
ugugugugugugugugugugu

SEQ ID NO: 448287 - RNA, 21 nt, Human
ugugugugugugugugugugu

SEQ ID NO: 448288 - RNA, 21 nt, Human
ugugugugugugugugugugu

SEQ ID NO: 448289 - RNA, 21 nt, Human
ugugugugugugugugugugu

SEQ ID NO: 448290 - RNA, 21 nt, Human
ugugugugugugugugugugu

SEQ ID NO: 448291 - RNA, 21 nt, Human
ugugugugugugugugugugu

SEQ ID NO: 448292 - RNA, 21 nt, Human
ugugugugugugugugugugu

SEQ ID NO: 448293 - RNA, 22 nt, Human
ugugugugugugugugugugug

SEQ ID NO: 448294 - RNA, 22 nt, Human
ugugugugugugugugugugug

SEQ ID NO: 448295 - RNA, 22 nt, Human
ugugugugugugugugugugug

SEQ ID NO: 448296 - RNA, 22 nt, Human
ugugugugugugugugugugug

SEQ ID NO: 448297 - RNA, 22 nt, Human
ugugugugugugugugugugug

SEQ ID NO: 448298 - RNA, 22 nt, Human
ugugugugugugugugugugug

SEQ ID NO: 448299 - RNA, 23 nt, Human
ugugugugugugugugugugugu

SEQ ID NO: 448300 - RNA, 19 nt, Human
uuacugggguuaccauugc

SEQ ID NO: 448301 - RNA, 23 nt, Human
uuacuuuauuuuaaaauuaucuu

SEQ ID NO: 448302 - RNA, 20 nt, Human
uuagaacucucuuguugcug

SEQ ID NO: 448303 - RNA, 20 nt, Human
uuagagaagggcuggguuug

SEQ ID NO: 448304 - RNA, 22 nt, Human
uucaaggucuauccaugaaaag

SEQ ID NO: 448305 - RNA, 21 nt, Human
uucccaagcaaaaagcuggcc

SEQ ID NO: 448306 - RNA, 22 nt, Human
uuccccccuucucaggauuggg

SEQ ID NO: 448307 - RNA, 21 nt, Human
uucccugucucugucugugau

SEQ ID NO: 448308 - RNA, 22 nt, Human
uucgcugggcucccggcugcca

SEQ ID NO: 448309 - RNA, 18 nt, Human
uugccccugggccccuaa

SEQ ID NO: 448310 - RNA, 22 nt, Human
uuguucaaggucuauccaugaa

SEQ ID NO: 448311 - RNA, 23 nt, Human
uuuagggugguagaaaaugcagg

SEQ ID NO: 448312 - RNA, 21 nt, Human
uuuccauucccaucccuguuc

SEQ ID NO: 448313 - RNA, 18 nt, Human
aaaaaaaggcaugguuug

SEQ ID NO: 448314 - RNA, 22 nt, Human
aaaaagacaacacaaaacccac

SEQ ID NO: 448315 - RNA, 24 nt, Human
aaaaagacaacacaaaacccacag

SEQ ID NO: 448316 - RNA, 27 nt, Human
aaaacagaaaagcacaacuugguaagg

SEQ ID NO: 448317 - RNA, 18 nt, Human
aaaacaugaaacuacuga

SEQ ID NO: 448318 - RNA, 22 nt, Human
aaaagacaacacaaaacccaca

SEQ ID NO: 448319 - RNA, 21 nt, Human
aaaagaggcgggucuggccga

SEQ ID NO: 448320 - RNA, 24 nt, Human
aaacaagaaaauuaaaggcagaaa

SEQ ID NO: 448321 - RNA, 23 nt, Human
aaacaugaaacuacugaccaaca

SEQ ID NO: 448322 - RNA, 24 nt, Human
aaagacaacacaaaacccacagaa

SEQ ID NO: 448323 - RNA, 23 nt, Human
aacacaaaacccacagaaaaaua

SEQ ID NO: 448324 - RNA, 18 nt, Human
aaccuaaaguauaaccug

SEQ ID NO: 448325 - RNA, 24 nt, Human
aacucaucuucccucccacaccuc

SEQ ID NO: 448326 - RNA, 21 nt, Human
aacuggcuuuacagauuuccc

SEQ ID NO: 448327 - RNA, 22 nt, Human
aagagauaacaaacaguuuuga

SEQ ID NO: 448328 - RNA, 20 nt, Human
aagcacaacuugguaaggcc

SEQ ID NO: 448329 - RNA, 20 nt, Human
aagcuuccuagcaucuguuu

SEQ ID NO: 448330 - RNA, 23 nt, Human
aagggucaacaagaagaggaagc

SEQ ID NO: 448331 - RNA, 25 nt, Human
aaguagcccuuaaucaagagagggu

SEQ ID NO: 448332 - RNA, 21 nt, Human
aauagaaccccuaaccuaaag

SEQ ID NO: 448333 - RNA, 24 nt, Human
aaucaacagcaaauacagccauac

SEQ ID NO: 448334 - RNA, 26 nt, Human
acaaacaagaaaauuaaaggcagaaa

SEQ ID NO: 448335 - RNA, 21 nt, Human
acaacacaaaacccacagaaa

SEQ ID NO: 448336 - RNA, 23 nt, Human
acaguaccgaaagcaaaugucac

SEQ ID NO: 448337 - RNA, 18 nt, Human
acccgguccgggaagcga

SEQ ID NO: 448338 - RNA, 25 nt, Human
acccugcaacugaguguucaggcug

SEQ ID NO: 448339 - RNA, 19 nt, Human
accgcaagcccgacccugc

SEQ ID NO: 448340 - RNA, 22 nt, Human
acucaucuucccucccacaccu

SEQ ID NO: 448341 - RNA, 19 nt, Human
acugcagccccauacacuu

SEQ ID NO: 448342 - RNA, 24 nt, Human
agacaggugcucccuguugcccuc

SEQ ID NO: 448343 - RNA, 23 nt, Human
agagcuccuccuauaauacauau

SEQ ID NO: 448344 - RNA, 19 nt, Human
agcccuaacagcugccacc

SEQ ID NO: 448345 - RNA, 18 nt, Human
agccuccuccccagcucc

SEQ ID NO: 448346 - RNA, 24 nt, Human
agcuaagaacuauuguuaccaugg

SEQ ID NO: 448347 - RNA, 26 nt, Human
aggaaacuaugaccgacaucaauucc

SEQ ID NO: 448348 - RNA, 20 nt, Human
aggaaccacucccuaaaacc

SEQ ID NO: 448349 - RNA, 21 nt, Human
aggaguuguuucagcuaauau

SEQ ID NO: 448350 - RNA, 19 nt, Human
aggcaccagguuacgauag

SEQ ID NO: 448351 - RNA, 24 nt, Human
aggcagaaagaauacauaaaauug

SEQ ID NO: 448352 - RNA, 22 nt, Human
aggcagaggucucucacuuuuu

SEQ ID NO: 448353 - RNA, 31 nt, Human
aggcaggagguguggaaguccccuccagggg

SEQ ID NO: 448354 - RNA, 23 nt, Human
aggcggccagggagggucguggc

SEQ ID NO: 448355 - RNA, 20 nt, Human
aggcgggcgggcuggcgggg

SEQ ID NO: 448356 - RNA, 19 nt, Human
aguaaaagcuauucuccug

SEQ ID NO: 448357 - RNA, 19 nt, Human
agugugcaugggugugcac

SEQ ID NO: 448358 - RNA, 22 nt, Human
auaaaaaagacaacacaaaacc

SEQ ID NO: 448359 - RNA, 19 nt, Human
auagaaccccuaaccuaaa

SEQ ID NO: 448360 - RNA, 20 nt, Human
auagaaccccuaaccuaaag

SEQ ID NO: 448361 - RNA, 22 nt, Human
auauacacacacucucgauaua

SEQ ID NO: 448362 - RNA, 27 nt, Human
caaacaaacaagaaaauuaaaggcugu

SEQ ID NO: 448363 - RNA, 25 nt, Human
caacaagaagaggaagccaagcuuc

SEQ ID NO: 448364 - RNA, 24 nt, Human
caacagcaaauacagccauacaga

SEQ ID NO: 448365 - RNA, 23 nt, Human
cacaggaaccacucccuaaaaca

SEQ ID NO: 448366 - RNA, 19 nt, Human
cacccaccgcaagcccgac

SEQ ID NO: 448367 - RNA, 20 nt, Human
caccgacagcugcgggcgcg

SEQ ID NO: 448368 - RNA, 24 nt, Human
caccgacagcugcgggcgcguccc

SEQ ID NO: 448369 - RNA, 23 nt, Human
caccgcgcgacuggcccgggagg

SEQ ID NO: 448370 - RNA, 22 nt, Human
cacuugaaaacagaaaagcaca

SEQ ID NO: 448371 - RNA, 24 nt, Human
cagaagauucagcccuaacagcug

SEQ ID NO: 448372 - RNA, 21 nt, Human
cagccuccgcagccuccuccc

SEQ ID NO: 448373 - RNA, 23 nt, Human
cagccuccuccccagcucccaag

SEQ ID NO: 448374 - RNA, 18 nt, Human
cagcucccaagaggguga

SEQ ID NO: 448375 - RNA, 23 nt, Human
cauaaaaaagacaacacaaaacc

SEQ ID NO: 448376 - RNA, 23 nt, Human
ccaagaccacagcgccccccgcc

SEQ ID NO: 448377 - RNA, 18 nt, Human
ccaagcgcucugucuccg

SEQ ID NO: 448378 - RNA, 23 nt, Human
cccacaccuccaggcaccagaca

SEQ ID NO: 448379 - RNA, 18 nt, Human
cccauacacugucacacg

SEQ ID NO: 448380 - RNA, 20 nt, Human
cccauacacugucacacgca

SEQ ID NO: 448381 - RNA, 21 nt, Human
cccauacacugucacacgcag

SEQ ID NO: 448382 - RNA, 22 nt, Human
cccauacacugucacacgcaua

SEQ ID NO: 448383 - RNA, 22 nt, Human
ccccagcucccaagagggugac

SEQ ID NO: 448384 - RNA, 24 nt, Human
ccccgccugcgcgccgcgcgccug

SEQ ID NO: 448385 - RNA, 28 nt, Human
ccccgcgccaagaccacagcgccccccc

SEQ ID NO: 448386 - RNA, 21 nt, Human
cccgaggcgccgccgcgacca

SEQ ID NO: 448387 - RNA, 19 nt, Human
cccgcgccaagaccacagc

SEQ ID NO: 448388 - RNA, 21 nt, Human
cccuguugcccucguuaccua

SEQ ID NO: 448389 - RNA, 24 nt, Human
ccgacagcugcgggcgcguccccg

SEQ ID NO: 448390 - RNA, 22 nt, Human
ccgcgcccgaggcgccgccgcg

SEQ ID NO: 448391 - RNA, 19 nt, Human
ccggcccgaccgccccucc

SEQ ID NO: 448392 - RNA, 19 nt, Human
ccguggaucccaagcgcuc

SEQ ID NO: 448393 - RNA, 22 nt, Human
ccuaaaggcaggagguguggaa

SEQ ID NO: 448394 - RNA, 21 nt, Human
ccucagaguccacuggccucu

SEQ ID NO: 448395 - RNA, 25 nt, Human
ccugcaacugaguguucaggcugcc

SEQ ID NO: 448396 - RNA, 19 nt, Human
ccugcacccgcgcccgagg

SEQ ID NO: 448397 - RNA, 19 nt, Human
ccuugcucccauuuuggcu

SEQ ID NO: 448398 - RNA, 24 nt, Human
cgcagccuccuccccagcucccaa

SEQ ID NO: 448399 - RNA, 20 nt, Human
cgcccgaggcgccgccgcga

SEQ ID NO: 448400 - RNA, 21 nt, Human
cggcaagaugagacuguauuc

SEQ ID NO: 448401 - RNA, 18 nt, Human
cgggcaggcgggcgggcu

SEQ ID NO: 448402 - RNA, 27 nt, Human
cguccccggcccuggagaguggcgguu

SEQ ID NO: 448403 - RNA, 22 nt, Human
cuaaaacaugaaacuacugacc

SEQ ID NO: 448404 - RNA, 24 nt, Human
cuaaaacaugaaacuacugaccaa

SEQ ID NO: 448405 - RNA, 18 nt, Human
cucaaacaaacaagaaaa

SEQ ID NO: 448406 - RNA, 20 nt, Human
cucccacaccuccaggcacc

SEQ ID NO: 448407 - RNA, 23 nt, Human
cucccacaccuccaggcaccaga

SEQ ID NO: 448408 - RNA, 21 nt, Human
cuccgccccggaggguugcgg

SEQ ID NO: 448409 - RNA, 18 nt, Human
cuccuccccagcucccaa

SEQ ID NO: 448410 - RNA, 18 nt, Human
cucucgauauagguucua

SEQ ID NO: 448411 - RNA, 25 nt, Human
cugaaaauagccuuucugggugucu

SEQ ID NO: 448412 - RNA, 22 nt, Human
cugagcacuuuccacccaugcc

SEQ ID NO: 448413 - RNA, 19 nt, Human
cugcgcgccgcgcgccugc

SEQ ID NO: 448414 - RNA, 22 nt, Human
cugcgggcgcguccccggcccu

SEQ ID NO: 448415 - RNA, 21 nt, Human
cugugugcaugagugugcaug

SEQ ID NO: 448416 - RNA, 21 nt, Human
cuugcauaaguaucucauccc

SEQ ID NO: 448417 - RNA, 22 nt, Human
gaggaccuggaacacacguucc

SEQ ID NO: 448418 - RNA, 18 nt, Human
gagguuccgcuuucuggc

SEQ ID NO: 448419 - RNA, 27 nt, Human
gccucugcugcuacugcccugaaagcc

SEQ ID NO: 448420 - RNA, 20 nt, Human
gcggggagggaaaagaggcg

SEQ ID NO: 448421 - RNA, 18 nt, Human
gcgguagggaggagcugu

SEQ ID NO: 448422 - RNA, 21 nt, Human
gcugccuuguggugucucgga

SEQ ID NO: 448423 - RNA, 24 nt, Human
ggaggaccuggaacacacguuccg

SEQ ID NO: 448424 - RNA, 23 nt, Human
ggauguauuucacugucacagga

SEQ ID NO: 448425 - RNA, 24 nt, Human
ggcaggagguguggaaguccccuc

SEQ ID NO: 448426 - RNA, 23 nt, Human
ggcaggcgggcgggcuggcgggg

SEQ ID NO: 448427 - RNA, 21 nt, Human
ggcauucucuaaagcaaaauu

SEQ ID NO: 448428 - RNA, 24 nt, Human
ggcccgggagguuccgcuuucugg

SEQ ID NO: 448429 - RNA, 20 nt, Human
ggcgcgggaggaccuggaac

SEQ ID NO: 448430 - RNA, 20 nt, Human
gggagggaaaagaggcgggu

SEQ ID NO: 448431 - RNA, 18 nt, Human
gggcgggcaggcgggcgg

SEQ ID NO: 448432 - RNA, 21 nt, Human
ggggcgggcaggcgggcgggc

SEQ ID NO: 448433 - RNA, 23 nt, Human
guccucagaguccacuggccucu

SEQ ID NO: 448434 - RNA, 21 nt, Human
gucuggagagaaggccuugcu

SEQ ID NO: 448435 - RNA, 18 nt, Human
guguucaggcugccuugu

SEQ ID NO: 448436 - RNA, 22 nt, Human
uaaaaaagacaacacaaaaccc

SEQ ID NO: 448437 - RNA, 25 nt, Human
uaaaaaagacaacacaaaacccaca

SEQ ID NO: 448438 - RNA, 24 nt, Human
uaaaaaagauguugguucaaaaaa

SEQ ID NO: 448439 - RNA, 18 nt, Human
uaacaagagauaacaaac

SEQ ID NO: 448440 - RNA, 23 nt, Human
uaacaggaauaaauagaaccccu

SEQ ID NO: 448441 - RNA, 20 nt, Human
uaacagguuucaagagaugu

SEQ ID NO: 448442 - RNA, 18 nt, Human
uaaccagaggucuagaac

SEQ ID NO: 448443 - RNA, 25 nt, Human
uaagcucaaacaaacaagaaaauua

SEQ ID NO: 448444 - RNA, 19 nt, Human
uaaguagcccuuaaucaag

SEQ ID NO: 448445 - RNA, 23 nt, Human
uacacgccccgccccucaggagu

SEQ ID NO: 448446 - RNA, 23 nt, Human
uacacuuaaaaacauacucugaa

SEQ ID NO: 448447 - RNA, 18 nt, Human
uacgcaguaaaaggaguu

SEQ ID NO: 448448 - RNA, 25 nt, Human
uauaaaaugcagcaauauauuuuaa

SEQ ID NO: 448449 - RNA, 22 nt, Human
uaugugucaacacaacuggacu

SEQ ID NO: 448450 - RNA, 22 nt, Human
uauuucacugucacaggaagca

SEQ ID NO: 448451 - RNA, 19 nt, Human
ucaaccccacuuaaaauuc

SEQ ID NO: 448452 - RNA, 19 nt, Human
ucaaguacaacauucugcu

SEQ ID NO: 448453 - RNA, 23 nt, Human
ucagccaaaguggcauucucuaa

SEQ ID NO: 448454 - RNA, 19 nt, Human
ucagcccuaacagcugcca

SEQ ID NO: 448455 - RNA, 20 nt, Human
ucagguuguaacuaaaugcu

SEQ ID NO: 448456 - RNA, 22 nt, Human
ucagugggauguuuucuguugg

SEQ ID NO: 448457 - RNA, 24 nt, Human
uccacagauagguaagccaggcgc

SEQ ID NO: 448458 - RNA, 22 nt, Human
uccacaggaaccacucccuaaa

SEQ ID NO: 448459 - RNA, 18 nt, Human
ucccacaaacacuugcug

SEQ ID NO: 448460 - RNA, 25 nt, Human
ucccuaaaacaugaaacuacugacc

SEQ ID NO: 448461 - RNA, 18 nt, Human
ucccucccacaccuccag

SEQ ID NO: 448462 - RNA, 21 nt, Human
uccgcagccuccuccccagcu

SEQ ID NO: 448463 - RNA, 21 nt, Human
uccucagaguccacuggccuc

SEQ ID NO: 448464 - RNA, 19 nt, Human
uccuuuuuugacuacagag

SEQ ID NO: 448465 - RNA, 18 nt, Human
ucucuugagucugucaag

SEQ ID NO: 448466 - RNA, 20 nt, Human
ucugcugcuacugcccugaa

SEQ ID NO: 448467 - RNA, 20 nt, Human
ucugggucacccaccgcaag

SEQ ID NO: 448468 - RNA, 20 nt, Human
ucugucuccgcccggcuucc

SEQ ID NO: 448469 - RNA, 19 nt, Human
ugaaaacagaaaagcacaa

SEQ ID NO: 448470 - RNA, 22 nt, Human
ugaccgacaucaauuccaaugu

SEQ ID NO: 448471 - RNA, 22 nt, Human
ugagcacuuuccacccaugccu

SEQ ID NO: 448472 - RNA, 23 nt, Human
ugcaacugaguguucaggcugcc

SEQ ID NO: 448473 - RNA, 21 nt, Human
ugcauuuaaaggucaacccac

SEQ ID NO: 448474 - RNA, 20 nt, Human
ugcccugaaagccaucuguc

SEQ ID NO: 448475 - RNA, 22 nt, Human
ugccuuguggugucucggaagc

SEQ ID NO: 448476 - RNA, 19 nt, Human
uggacuaagaaagaaaagu

SEQ ID NO: 448477 - RNA, 20 nt, Human
uggaggacagcgguccgagc

SEQ ID NO: 448478 - RNA, 19 nt, Human
uggcuuguguaauaccugg

SEQ ID NO: 448479 - RNA, 19 nt, Human
ugggggccauggucccggc

SEQ ID NO: 448480 - RNA, 22 nt, Human
uguacauaaugcacugugcauu

SEQ ID NO: 448481 - RNA, 18 nt, Human
uguauaaagcuuucagaa

SEQ ID NO: 448482 - RNA, 24 nt, Human
ugucaccgacagcugcgggcgcgu

SEQ ID NO: 448483 - RNA, 20 nt, Human
ugucccacaaacacuugcug

SEQ ID NO: 448484 - RNA, 19 nt, Human
ugucuccgcccggcuuccc

SEQ ID NO: 448485 - RNA, 20 nt, Human
ugugcacacagagaaguaca

SEQ ID NO: 448486 - RNA, 19 nt, Human
uguguacauaaugcacugu

SEQ ID NO: 448487 - RNA, 22 nt, Human
uguguacauaaugcacugugca

SEQ ID NO: 448488 - RNA, 19 nt, Human
ugugugcaugagugugcau

SEQ ID NO: 448489 - RNA, 19 nt, Human
uguucauuuuauuuuuugu

SEQ ID NO: 448490 - RNA, 28 nt, Human
uuaacauaaaaaagacaacacaaaaccc

SEQ ID NO: 448491 - RNA, 18 nt, Human
uuaacucaaacacauacu

SEQ ID NO: 448492 - RNA, 21 nt, Human
uucaagaguauucaccucccu

SEQ ID NO: 448493 - RNA, 21 nt, Human
uucagaacugggccacacagg

SEQ ID NO: 448494 - RNA, 23 nt, Human
uuccacagauagguaagccaggc

SEQ ID NO: 448495 - RNA, 23 nt, Human
uucccggcgacacgacgcguggg

SEQ ID NO: 448496 - RNA, 18 nt, Human
uuguggccacgcuuuucc

SEQ ID NO: 448497 - RNA, 21 nt, Human
uuguggccacgcuuuucccca

SEQ ID NO: 448498 - RNA, 24 nt, Human
uuguggugucucggaagcauuccu

SEQ ID NO: 448499 - RNA, 24 nt, Human
uuugcacuauacuccaugccauuu

SEQ ID NO: 448500 - RNA, 23 nt, Human
uuugguggcucugggucacccac

SEQ ID NO: 448501 - RNA, 26 nt, Human
uuuuucucagauuuuugcuccuuaaa

SEQ ID NO: 448502 - RNA, 22 nt, Human
uuuuuuuuauucauaagucaga

SEQ ID NO: 448503 - RNA, 20 nt, Human
aagaaacuggguucccaaac

SEQ ID NO: 448504 - RNA, 20 nt, Human
agaaacuggguucccaaacu

SEQ ID NO: 448505 - RNA, 23 nt, Human
agccaggcugaccugagggccca

SEQ ID NO: 448506 - RNA, 24 nt, Human
agcuuugacuggagaaauccaaau

SEQ ID NO: 448507 - RNA, 19 nt, Human
aguccuaugagguggccag

SEQ ID NO: 448508 - RNA, 21 nt, Human
aucagagugggcaguuagagg

SEQ ID NO: 448509 - RNA, 24 nt, Human
caaagugccagguuuuuuucugug

SEQ ID NO: 448510 - RNA, 22 nt, Human
cagagugggcaguuagaggccc

SEQ ID NO: 448511 - RNA, 19 nt, Human
cccaggacaagaaacuggg

SEQ ID NO: 448512 - RNA, 21 nt, Human
cccuccuaggcucacccaggc

SEQ ID NO: 448513 - RNA, 22 nt, Human
ccgcuccgggggcagcagaggg

SEQ ID NO: 448514 - RNA, 19 nt, Human
ccgcuggcugccucugacu

SEQ ID NO: 448515 - RNA, 22 nt, Human
cuccuaggcucacccaggcaua

SEQ ID NO: 448516 - RNA, 20 nt, Human
cuggagaaauccaaaucaga

SEQ ID NO: 448517 - RNA, 18 nt, Human
gagguggccaggcccugc

SEQ ID NO: 448518 - RNA, 22 nt, Human
gagugggcaguuagaggcccau

SEQ ID NO: 448519 - RNA, 22 nt, Human
gcagcagaggggccagcccggg

SEQ ID NO: 448520 - RNA, 19 nt, Human
ggacaagaaacuggguucc

SEQ ID NO: 448521 - RNA, 18 nt, Human
gggcagcagaggggccag

SEQ ID NO: 448522 - RNA, 19 nt, Human
gggcagcagaggggccagc

SEQ ID NO: 448523 - RNA, 22 nt, Human
uagcugccgcaaaggcccgggu

SEQ ID NO: 448524 - RNA, 21 nt, Human
ucagaagggaacugaguccua

SEQ ID NO: 448525 - RNA, 18 nt, Human
ucagccaggcugaccuga

SEQ ID NO: 448526 - RNA, 24 nt, Human
ucuuuggccuccugccuacuacuu

SEQ ID NO: 448527 - RNA, 23 nt, Human
ugaagcaggucccgcuggcugcc

SEQ ID NO: 448528 - RNA, 24 nt, Human
ugagcuuugacuggagaaauccaa

SEQ ID NO: 448529 - RNA, 24 nt, Human
ugagggcccaggacaagaaacugg

SEQ ID NO: 448530 - RNA, 19 nt, Human
ugagguggccaggcccugc

SEQ ID NO: 448531 - RNA, 19 nt, Human
uggccuccugccuacuacu

SEQ ID NO: 448532 - RNA, 18 nt, Human
uuagaggcccaugucccc

SEQ ID NO: 448533 - RNA, 21 nt, Human
uuuggccuccugccuacuacu

SEQ ID NO: 448534 - RNA, 22 nt, Human
uuuucugugagcuuugacugga

SEQ ID NO: 448535 - RNA, 22 nt, Human
aaagcaagaaaagaauauuuua

SEQ ID NO: 448536 - RNA, 22 nt, Human
aacacaagaaagcaagaaaaga

SEQ ID NO: 448537 - RNA, 21 nt, Human
acccccuguccucccucgccg

SEQ ID NO: 448538 - RNA, 24 nt, Human
aucaaauuaucccuccaacuaaau

SEQ ID NO: 448539 - RNA, 18 nt, Human
caagaaagcaagaaaaga

SEQ ID NO: 448540 - RNA, 20 nt, Human
cucgcaagcccagucagcca

SEQ ID NO: 448541 - RNA, 23 nt, Human
cuguauuugaauaagaauuccau

SEQ ID NO: 448542 - RNA, 21 nt, Human
cuuaacacaagaaagcaagaa

SEQ ID NO: 448543 - RNA, 23 nt, Human
guccucccucgccgaucuucagu

SEQ ID NO: 448544 - RNA, 21 nt, Human
uacuacaaauauugcagucag

SEQ ID NO: 448545 - RNA, 19 nt, Human
uccuuggccuucgcugcag

SEQ ID NO: 448546 - RNA, 22 nt, Human
uuaacacaagaaagcaagaaaa

SEQ ID NO: 448547 - RNA, 20 nt, Human
aagcagcaaauuaguguuuu

SEQ ID NO: 448548 - RNA, 23 nt, Human
aaucaugugcuuuagacauuuaa

SEQ ID NO: 448549 - RNA, 23 nt, Human
agacauuuaauacuauuucaauu

SEQ ID NO: 448550 - RNA, 20 nt, Human
agcuggaguguacacagaug

SEQ ID NO: 448551 - RNA, 19 nt, Human
cuggaauggggauucuuuc

SEQ ID NO: 448552 - RNA, 21 nt, Human
gaaaaaaaaagcccacuggaa

SEQ ID NO: 448553 - RNA, 21 nt, Human
gaaaaaugauacugaaccuca

SEQ ID NO: 448554 - RNA, 18 nt, Human
uaaaucuacugcuggaau

SEQ ID NO: 448555 - RNA, 24 nt, Human
uaugcagaggaaauaauauaauuc

SEQ ID NO: 448556 - RNA, 19 nt, Human
ucuacugcuggaaugggga

SEQ ID NO: 448557 - RNA, 18 nt, Human
ugaaaaacauuuggucag

SEQ ID NO: 448558 - RNA, 21 nt, Human
ugcuggaauggggauucuuuc

SEQ ID NO: 448559 - RNA, 20 nt, Human
uggaguguacacagaugaaa

SEQ ID NO: 448560 - RNA, 23 nt, Human
uggucagaaagcagcaaauuagu

SEQ ID NO: 448561 - RNA, 22 nt, Human
aaaaacuaaugagaaagcaaac

SEQ ID NO: 448562 - RNA, 21 nt, Human
aagcaaacuggaaggugagac

SEQ ID NO: 448563 - RNA, 20 nt, Human
aaugagaaagcaaacuggaa

SEQ ID NO: 448564 - RNA, 21 nt, Human
acacacaaccuuaagcaaaau

SEQ ID NO: 448565 - RNA, 18 nt, Human
caaaaugucuuccucucc

SEQ ID NO: 448566 - RNA, 22 nt, Human
cacacaaccuuaagcaaaauac

SEQ ID NO: 448567 - RNA, 21 nt, Human
cacacacaaccuuaagcaaaa

SEQ ID NO: 448568 - RNA, 22 nt, Human
cacacacaaccuuaagcaaaau

SEQ ID NO: 448569 - RNA, 19 nt, Human
cagcgauuugggagguugg

SEQ ID NO: 448570 - RNA, 24 nt, Human
cagcggaccccccccccuccagac

SEQ ID NO: 448571 - RNA, 26 nt, Human
cagcggaccccccccccuccagacac

SEQ ID NO: 448572 - RNA, 21 nt, Human
cauugugguuauaacgaagga

SEQ ID NO: 448573 - RNA, 20 nt, Human
ccagacacccgggccgccuu

SEQ ID NO: 448574 - RNA, 22 nt, Human
ccuccagacacccgggccgccu

SEQ ID NO: 448575 - RNA, 27 nt, Human
ccuccagacacccgggccgccuggcuu

SEQ ID NO: 448576 - RNA, 20 nt, Human
cucucccuuuguacuuacca

SEQ ID NO: 448577 - RNA, 20 nt, Human
cuuuguuuucaaauaagugg

SEQ ID NO: 448578 - RNA, 20 nt, Human
gaacauaaaucaaugccauu

SEQ ID NO: 448579 - RNA, 21 nt, Human
gaccccccccccuccagacac

SEQ ID NO: 448580 - RNA, 18 nt, Human
ggugagacuucaucuuug

SEQ ID NO: 448581 - RNA, 22 nt, Human
uaaaauucaaaaugucuuccuc

SEQ ID NO: 448582 - RNA, 20 nt, Human
uacacaauacacacacaacc

SEQ ID NO: 448583 - RNA, 18 nt, Human
uaccauaggcuacacaau

SEQ ID NO: 448584 - RNA, 20 nt, Human
uacuuaccauaggcuacaca

SEQ ID NO: 448585 - RNA, 20 nt, Human
uaggcuacacaauguccuga

SEQ ID NO: 448586 - RNA, 24 nt, Human
uauacacaauacacacacaaccuu

SEQ ID NO: 448587 - RNA, 19 nt, Human
uauauacacaauacacaca

SEQ ID NO: 448588 - RNA, 24 nt, Human
uauauacacaauacacacacaacc

SEQ ID NO: 448589 - RNA, 18 nt, Human
ugagaaagcaaacuggaa

SEQ ID NO: 448590 - RNA, 21 nt, Human
ugcagcuuucagguaaagucc

SEQ ID NO: 448591 - RNA, 20 nt, Human
ugcugauuuguauucugacu

SEQ ID NO: 448592 - RNA, 19 nt, Human
uggaaaaaacuaaugagaa

SEQ ID NO: 448593 - RNA, 20 nt, Human
uggaaaaaacuaaugagaaa

SEQ ID NO: 448594 - RNA, 21 nt, Human
uggaacaagaagaaaauaaca

SEQ ID NO: 448595 - RNA, 21 nt, Human
uggaacauaaaucaaugccag

SEQ ID NO: 448596 - RNA, 21 nt, Human
uggcacugaacacuaaugcca

SEQ ID NO: 448597 - RNA, 24 nt, Human
uuaaacaagcagcucagcgauuug

SEQ ID NO: 448598 - RNA, 20 nt, Human
uucaaaaugucuuccucucc

SEQ ID NO: 448599 - RNA, 20 nt, Human
uucaucuuuguuuucaaaua

SEQ ID NO: 448600 - RNA, 21 nt, Human
uuucagguaaaguccagcacu

SEQ ID NO: 448601 - RNA, 18 nt, Human
uuuuuuuuuuaaacaagc

SEQ ID NO: 448602 - RNA, 20 nt, Human
aaaaaguuaagaaaaaaucu

SEQ ID NO: 448603 - RNA, 23 nt, Human
aaacaacacaaccaagcagaaau

SEQ ID NO: 448604 - RNA, 26 nt, Human
aaacaacacaaccaagcagaaauuca

SEQ ID NO: 448605 - RNA, 24 nt, Human
aaagauugagugaaaaccuaaaaa

SEQ ID NO: 448606 - RNA, 23 nt, Human
aaauggcauuuucuuaauucccc

SEQ ID NO: 448607 - RNA, 21 nt, Human
aacauuucuuacaaggcaguc

SEQ ID NO: 448608 - RNA, 22 nt, Human
aagcacaccugaaaaaagagca

SEQ ID NO: 448609 - RNA, 19 nt, Human
aauccaaaacuaaccaaau

SEQ ID NO: 448610 - RNA, 19 nt, Human
acaacacaaccaagcagaa

SEQ ID NO: 448611 - RNA, 23 nt, Human
acaacacaaccaagcagaaauuc

SEQ ID NO: 448612 - RNA, 22 nt, Human
accaagcacaccugaaaaaaga

SEQ ID NO: 448613 - RNA, 23 nt, Human
acuaagaaaacggcuuaaaacaa

SEQ ID NO: 448614 - RNA, 18 nt, Human
acuacacuuauccucuac

SEQ ID NO: 448615 - RNA, 19 nt, Human
acuacucuaucaaaccagu

SEQ ID NO: 448616 - RNA, 24 nt, Human
agaaagcuuuccuuuggccacugu

SEQ ID NO: 448617 - RNA, 21 nt, Human
agaaccaaugcucuaguauua

SEQ ID NO: 448618 - RNA, 21 nt, Human
agaauugaaagcaauugguca

SEQ ID NO: 448619 - RNA, 24 nt, Human
aggaaagccauguaguuuuuuaag

SEQ ID NO: 448620 - RNA, 19 nt, Human
aggcagaagaguggacuug

SEQ ID NO: 448621 - RNA, 26 nt, Human
aggcagaagaguggacuugauuccuu

SEQ ID NO: 448622 - RNA, 20 nt, Human
aggcagaagaguggacuugg

SEQ ID NO: 448623 - RNA, 21 nt, Human
aggcagauagucauuucauaa

SEQ ID NO: 448624 - RNA, 23 nt, Human
auauauccucuaggcagauuucu

SEQ ID NO: 448625 - RNA, 21 nt, Human
aucacgcauaugacaaacauu

SEQ ID NO: 448626 - RNA, 18 nt, Human
aucccacacacaccacaa

SEQ ID NO: 448627 - RNA, 22 nt, Human
augucacagaauaaauagagca

SEQ ID NO: 448628 - RNA, 20 nt, Human
caaaauuaaaaaguacugca

SEQ ID NO: 448629 - RNA, 24 nt, Human
caaagcagcugugauauaucuugc

SEQ ID NO: 448630 - RNA, 21 nt, Human
caaauguacauuuuuuagaca

SEQ ID NO: 448631 - RNA, 18 nt, Human
caaccaagcagaaauuca

SEQ ID NO: 448632 - RNA, 20 nt, Human
caacuauuaaaaacacuuuu

SEQ ID NO: 448633 - RNA, 24 nt, Human
caagcacaccugaaaaaagagcaa

SEQ ID NO: 448634 - RNA, 21 nt, Human
cagaagaauuguugcugaaaa

SEQ ID NO: 448635 - RNA, 22 nt, Human
cauaagaacaaauacaggagua

SEQ ID NO: 448636 - RNA, 18 nt, Human
caucccacacacaccaca

SEQ ID NO: 448637 - RNA, 19 nt, Human
caugacuucuaaagaacag

SEQ ID NO: 448638 - RNA, 23 nt, Human
ccacucagaaggcgccgcgacga

SEQ ID NO: 448639 - RNA, 22 nt, Human
ccacugagcccaacgccgaccc

SEQ ID NO: 448640 - RNA, 20 nt, Human
ccagccaaucuuacuagaua

SEQ ID NO: 448641 - RNA, 23 nt, Human
cccaacgccgacccguagucccc

SEQ ID NO: 448642 - RNA, 21 nt, Human
cccaaggcauaacuacaaaga

SEQ ID NO: 448643 - RNA, 20 nt, Human
cccacacacaccacaaacca

SEQ ID NO: 448644 - RNA, 23 nt, Human
cccacacacaccacaaaccaucc

SEQ ID NO: 448645 - RNA, 23 nt, Human
cccacacacaccacaaaccaucc

SEQ ID NO: 448646 - RNA, 24 nt, Human
ccccacaucccacacacaccacaa

SEQ ID NO: 448647 - RNA, 26 nt, Human
ccccacaucccacacacaccacaaac

SEQ ID NO: 448648 - RNA, 26 nt, Human
cccccacaucccacacacaccacaaa

SEQ ID NO: 448649 - RNA, 22 nt, Human
ccgcggcgcgggcugcgcggag

SEQ ID NO: 448650 - RNA, 25 nt, Human
ccuauaacauuuuagaacccaaggc

SEQ ID NO: 448651 - RNA, 24 nt, Human
ccucgacccgaccacucagaaggc

SEQ ID NO: 448652 - RNA, 22 nt, Human
cgacuaaauuaacuugacuaaa

SEQ ID NO: 448653 - RNA, 24 nt, Human
cgcauaugacaaacauuucuuaca

SEQ ID NO: 448654 - RNA, 21 nt, Human
cgccugagaucgcgcagcgag

SEQ ID NO: 448655 - RNA, 21 nt, Human
cggagccgaggagaacccgcc

SEQ ID NO: 448656 - RNA, 19 nt, Human
cggcuucagcuacugccca

SEQ ID NO: 448657 - RNA, 21 nt, Human
cgggcugcgcggagccgagga

SEQ ID NO: 448658 - RNA, 18 nt, Human
cugagcccaacgccgacc

SEQ ID NO: 448659 - RNA, 22 nt, Human
cugaugcuaaaauauauuccaa

SEQ ID NO: 448660 - RNA, 22 nt, Human
cuucggcuucagcuacugccca

SEQ ID NO: 448661 - RNA, 21 nt, Human
gaauccccaccggacagcccu

SEQ ID NO: 448662 - RNA, 20 nt, Human
gagccgaggagaacccgccu

SEQ ID NO: 448663 - RNA, 19 nt, Human
gcaguaccugaugguuucc

SEQ ID NO: 448664 - RNA, 22 nt, Human
gcaguaccugaugguuuccaag

SEQ ID NO: 448665 - RNA, 20 nt, Human
gcccaacgccgacccguagg

SEQ ID NO: 448666 - RNA, 18 nt, Human
gcggcgcgggcugcgcgg

SEQ ID NO: 448667 - RNA, 22 nt, Human
gcuaggauucaauucagcaguu

SEQ ID NO: 448668 - RNA, 24 nt, Human
ggauuuacaaaauaaauuguauuu

SEQ ID NO: 448669 - RNA, 20 nt, Human
gggcgggccgcggggucccu

SEQ ID NO: 448670 - RNA, 24 nt, Human
guaucuuacaguucacugauuuac

SEQ ID NO: 448671 - RNA, 18 nt, Human
uaaaaaguacugcaaaaa

SEQ ID NO: 448672 - RNA, 21 nt, Human
uaaaaaugcuaugacagacac

SEQ ID NO: 448673 - RNA, 23 nt, Human
uaaaaaugcuaugacagacacga

SEQ ID NO: 448674 - RNA, 21 nt, Human
uaaaacaaaguuaaacaacua

SEQ ID NO: 448675 - RNA, 23 nt, Human
uaaacaacuacuuuccaaagccc

SEQ ID NO: 448676 - RNA, 28 nt, Human
uaaacaacuacuuuccaaagcccagaaa

SEQ ID NO: 448677 - RNA, 19 nt, Human
uaaauuguauuuuaaaaau

SEQ ID NO: 448678 - RNA, 26 nt, Human
uaauucccccacaucccacacacacc

SEQ ID NO: 448679 - RNA, 23 nt, Human
uacuuacgguaaacaacacaacc

SEQ ID NO: 448680 - RNA, 23 nt, Human
uagaacccaaggcauaacuacaa

SEQ ID NO: 448681 - RNA, 26 nt, Human
uagaacccaaggcauaacuacaaaga

SEQ ID NO: 448682 - RNA, 21 nt, Human
uagguaaauggcauuuucuua

SEQ ID NO: 448683 - RNA, 22 nt, Human
uagguaaauggcauuuucuuaa

SEQ ID NO: 448684 - RNA, 19 nt, Human
uauucauuuuaucccuuuc

SEQ ID NO: 448685 - RNA, 24 nt, Human
ucaugauguggaaucuuccuuaca

SEQ ID NO: 448686 - RNA, 20 nt, Human
ucccacacacaccacaaacc

SEQ ID NO: 448687 - RNA, 23 nt, Human
ucccacacacaccacaaaccauc

SEQ ID NO: 448688 - RNA, 23 nt, Human
ucccuugcuuuucacuuacuaua

SEQ ID NO: 448689 - RNA, 25 nt, Human
ucgagcccacugagcccaacgccga

SEQ ID NO: 448690 - RNA, 18 nt, Human
ucucaggacagacuuagg

SEQ ID NO: 448691 - RNA, 21 nt, Human
ucucugguugggagggagugc

SEQ ID NO: 448692 - RNA, 21 nt, Human
ugcaaagaaaagagcuaaaau

SEQ ID NO: 448693 - RNA, 24 nt, Human
ugcaaagaaaagagcuaaaauuuc

SEQ ID NO: 448694 - RNA, 21 nt, Human
ugggggaaaguuaaaaggcaa

SEQ ID NO: 448695 - RNA, 23 nt, Human
uggguuaaaacauucucuuggag

SEQ ID NO: 448696 - RNA, 18 nt, Human
uggucaagaauugaaagc

SEQ ID NO: 448697 - RNA, 23 nt, Human
ugugguaauauaaaaaauaacca

SEQ ID NO: 448698 - RNA, 18 nt, Human
uguucaguucaagggugu

SEQ ID NO: 448699 - RNA, 26 nt, Human
uuaaaaauuaaauagcaaauuugagu

SEQ ID NO: 448700 - RNA, 26 nt, Human
uuaauucccccacaucccacacacac

SEQ ID NO: 448701 - RNA, 21 nt, Human
uuacauucauccaacugaaga

SEQ ID NO: 448702 - RNA, 22 nt, Human
uucaaaauaugaauaaaggcac

SEQ ID NO: 448703 - RNA, 20 nt, Human
uugaauaaacaggaucgaaa

SEQ ID NO: 448704 - RNA, 25 nt, Human
uuuaaugccauccaauaaauaaacu

SEQ ID NO: 448705 - RNA, 23 nt, Human
aaaacaacucacaccagacaggc

SEQ ID NO: 448706 - RNA, 21 nt, Human
aaaagucucuauucuguacuu

SEQ ID NO: 448707 - RNA, 21 nt, Human
aaacaaagccaaaacaauaug

SEQ ID NO: 448708 - RNA, 21 nt, Human
aaagauacaaacaauaucaau

SEQ ID NO: 448709 - RNA, 22 nt, Human
aaagccaaaacaauauguaagu

SEQ ID NO: 448710 - RNA, 24 nt, Human
aaaguacugggauuacaggcguga

SEQ ID NO: 448711 - RNA, 24 nt, Human
aaagugcugggauuacaggcauga

SEQ ID NO: 448712 - RNA, 20 nt, Human
aaauaaugcuuuaaaauguu

SEQ ID NO: 448713 - RNA, 21 nt, Human
aaccuaaucuaucuauaauag

SEQ ID NO: 448714 - RNA, 25 nt, Human
aagcaauccucucgccucagccucc

SEQ ID NO: 448715 - RNA, 24 nt, Human
aagcaguugggauuacaggugugu

SEQ ID NO: 448716 - RNA, 23 nt, Human
aagcauuucucauaaaacaacuc

SEQ ID NO: 448717 - RNA, 18 nt, Human
aagcggggacuggcgggc

SEQ ID NO: 448718 - RNA, 18 nt, Human
aagcuacaacuaguuccu

SEQ ID NO: 448719 - RNA, 19 nt, Human
aaguacugggauuacaggc

SEQ ID NO: 448720 - RNA, 24 nt, Human
aagugaucugcccgucucagccuc

SEQ ID NO: 448721 - RNA, 19 nt, Human
aagugcugggauuacaggc

SEQ ID NO: 448722 - RNA, 21 nt, Human
aagugcugggauuacaggcau

SEQ ID NO: 448723 - RNA, 23 nt, Human
aauccccaagaucuagggcccaa

SEQ ID NO: 448724 - RNA, 22 nt, Human
acaaaccuuaggagagcuacgg

SEQ ID NO: 448725 - RNA, 21 nt, Human
acagcgcugcucuagaguacu

SEQ ID NO: 448726 - RNA, 21 nt, Human
acaggcgcccgccaccacacc

SEQ ID NO: 448727 - RNA, 18 nt, Human
acaggcgugagcaccacg

SEQ ID NO: 448728 - RNA, 21 nt, Human
accacaccuggcuaauuuugc

SEQ ID NO: 448729 - RNA, 24 nt, Human
accauauuggccaggcuggucuug

SEQ ID NO: 448730 - RNA, 24 nt, Human
accauguuggccaggauggucucg

SEQ ID NO: 448731 - RNA, 24 nt, Human
acgaaaauucaaaaaauugacucg

SEQ ID NO: 448732 - RNA, 18 nt, Human
acgggguuucaccauauu

SEQ ID NO: 448733 - RNA, 20 nt, Human
acgggguuucaccauauugg

SEQ ID NO: 448734 - RNA, 24 nt, Human
acgggguuucaccauauuggccag

SEQ ID NO: 448735 - RNA, 18 nt, Human
acgggguuucaccauguu

SEQ ID NO: 448736 - RNA, 23 nt, Human
acgggguuucaccauguuggcca

SEQ ID NO: 448737 - RNA, 24 nt, Human
acgggguuucaccauguuggccag

SEQ ID NO: 448738 - RNA, 20 nt, Human
acguauuuccccacaucccu

SEQ ID NO: 448739 - RNA, 21 nt, Human
acugagcacuugcaauguggc

SEQ ID NO: 448740 - RNA, 24 nt, Human
acuucaauaauaaccacuuaauau

SEQ ID NO: 448741 - RNA, 24 nt, Human
acuugguucucuugggaggaaaac

SEQ ID NO: 448742 - RNA, 22 nt, Human
agcaaaaauauggcaacuagug

SEQ ID NO: 448743 - RNA, 18 nt, Human
agccuccagagcagcugg

SEQ ID NO: 448744 - RNA, 19 nt, Human
agcguccucauuuuuaaaa

SEQ ID NO: 448745 - RNA, 23 nt, Human
agcuguaugaccucaugcaagcc

SEQ ID NO: 448746 - RNA, 25 nt, Human
aggaaacacaaaccuuaggagagcu

SEQ ID NO: 448747 - RNA, 25 nt, Human
aggcuggggugcaguggcgcgaucu

SEQ ID NO: 448748 - RNA, 20 nt, Human
agugcaguggugcgaucucg

SEQ ID NO: 448749 - RNA, 23 nt, Human
agugcaguggugcgaucucggcu

SEQ ID NO: 448750 - RNA, 24 nt, Human
agugcaguggugcgaucucggcuc

SEQ ID NO: 448751 - RNA, 23 nt, Human
aguugggauuacaggugugugcc

SEQ ID NO: 448752 - RNA, 23 nt, Human
auaaaacaacucacaccagacag

SEQ ID NO: 448753 - RNA, 18 nt, Human
auaaauaucccagcucug

SEQ ID NO: 448754 - RNA, 22 nt, Human
auaaauaucccagcucugugcu

SEQ ID NO: 448755 - RNA, 23 nt, Human
auauuggccaggcuggucuugaa

SEQ ID NO: 448756 - RNA, 21 nt, Human
auccucucgccucagccuccc

SEQ ID NO: 448757 - RNA, 22 nt, Human
augcagagguuaauccccaaga

SEQ ID NO: 448758 - RNA, 20 nt, Human
auuacaaaaacagaaaagug

SEQ ID NO: 448759 - RNA, 20 nt, Human
auuuaaacucugugccucag

SEQ ID NO: 448760 - RNA, 18 nt, Human
auuucuuguaccugugcc

SEQ ID NO: 448761 - RNA, 22 nt, Human
caaaaauaaaacaaagccaaaa

SEQ ID NO: 448762 - RNA, 21 nt, Human
caaaaaucauaaaugccucuc

SEQ ID NO: 448763 - RNA, 22 nt, Human
caaaaaucauaaaugccucuca

SEQ ID NO: 448764 - RNA, 23 nt, Human
caaagccaaaacaauauguaagu

SEQ ID NO: 448765 - RNA, 23 nt, Human
caaccuccaacauugcugggaca

SEQ ID NO: 448766 - RNA, 19 nt, Human
caacuaaaaaaaacugcau

SEQ ID NO: 448767 - RNA, 26 nt, Human
caagaggacagugugccaauacaucc

SEQ ID NO: 448768 - RNA, 22 nt, Human
caagaucuagggcccaagaucc

SEQ ID NO: 448769 - RNA, 19 nt, Human
caauaucaauacaguacuu

SEQ ID NO: 448770 - RNA, 22 nt, Human
cacaggcgcccgccaccacacc

SEQ ID NO: 448771 - RNA, 20 nt, Human
caccauauagaacaggaaac

SEQ ID NO: 448772 - RNA, 21 nt, Human
caccauauuggccaggcuggu

SEQ ID NO: 448773 - RNA, 23 nt, Human
caccauauuggccaggcuggucu

SEQ ID NO: 448774 - RNA, 27 nt, Human
caccauauuggccaggcuggucuugaa

SEQ ID NO: 448775 - RNA, 22 nt, Human
caccauguuggccaggaugguc

SEQ ID NO: 448776 - RNA, 24 nt, Human
caccauguuggccaggauggucuc

SEQ ID NO: 448777 - RNA, 18 nt, Human
cacgagagagaaaauaug

SEQ ID NO: 448778 - RNA, 22 nt, Human
cacucuguugcccagacuggag

SEQ ID NO: 448779 - RNA, 23 nt, Human
cacucuguugcccagacuggagu

SEQ ID NO: 448780 - RNA, 18 nt, Human
cacugcaaccucugccuc

SEQ ID NO: 448781 - RNA, 21 nt, Human
cacugcaaccucugccuccca

SEQ ID NO: 448782 - RNA, 23 nt, Human
cacugccaucucugccuccuggg

SEQ ID NO: 448783 - RNA, 25 nt, Human
cagaaaaguggcaccuaguggccac

SEQ ID NO: 448784 - RNA, 19 nt, Human
cagcauggaggagccccgg

SEQ ID NO: 448785 - RNA, 18 nt, Human
caggagccacuuggucgg

SEQ ID NO: 448786 - RNA, 24 nt, Human
caguagagacgggguuucaccaug

SEQ ID NO: 448787 - RNA, 19 nt, Human
caguggcgcgaucuuggcu

SEQ ID NO: 448788 - RNA, 24 nt, Human
cauauuggccaggcuggucuugaa

SEQ ID NO: 448789 - RNA, 28 nt, Human
caucaaaaauaaaacaaagccaaaacaa

SEQ ID NO: 448790 - RNA, 22 nt, Human
ccaaaguacugggauuacaggc

SEQ ID NO: 448791 - RNA, 24 nt, Human
ccaaaguacugggauuacaggcgu

SEQ ID NO: 448792 - RNA, 23 nt, Human
ccaaagugcugggauuacaggca

SEQ ID NO: 448793 - RNA, 24 nt, Human
ccaaagugcugggauuacaggcau

SEQ ID NO: 448794 - RNA, 24 nt, Human
ccaagcaguugggauuacaggugu

SEQ ID NO: 448795 - RNA, 22 nt, Human
ccagugcaguagccacuagcca

SEQ ID NO: 448796 - RNA, 24 nt, Human
cccaaagugcugggauuacaggca

SEQ ID NO: 448797 - RNA, 19 nt, Human
cccaagcaguugggauuac

SEQ ID NO: 448798 - RNA, 22 nt, Human
cccaagcaguugggauuacagg

SEQ ID NO: 448799 - RNA, 24 nt, Human
cccaagcaguugggauuacaggug

SEQ ID NO: 448800 - RNA, 18 nt, Human
cccagguucaagcaaucc

SEQ ID NO: 448801 - RNA, 20 nt, Human
cccagguucaagcaauccuc

SEQ ID NO: 448802 - RNA, 19 nt, Human
ccccgggcccgcccugccc

SEQ ID NO: 448803 - RNA, 21 nt, Human
ccucccagguucaagcaaucc

SEQ ID NO: 448804 - RNA, 19 nt, Human
ccugaccucaagugaucug

SEQ ID NO: 448805 - RNA, 22 nt, Human
ccugaccucaagugaucugccc

SEQ ID NO: 448806 - RNA, 20 nt, Human
ccugccccggcccaggcggc

SEQ ID NO: 448807 - RNA, 20 nt, Human
ccuugcccacgagccccugg

SEQ ID NO: 448808 - RNA, 20 nt, Human
cgccaccgcagcccguaggc

SEQ ID NO: 448809 - RNA, 24 nt, Human
cgcccaggcuggggugcaguggcg

SEQ ID NO: 448810 - RNA, 21 nt, Human
cgcucaugaauggacugucau

SEQ ID NO: 448811 - RNA, 24 nt, Human
cgcucugucgcccaggcuggggug

SEQ ID NO: 448812 - RNA, 21 nt, Human
cggcggccgccaccgcagccc

SEQ ID NO: 448813 - RNA, 21 nt, Human
cgggcccgcccugccccggcc

SEQ ID NO: 448814 - RNA, 24 nt, Human
cgggguuucaccauguuggccagg

SEQ ID NO: 448815 - RNA, 24 nt, Human
cgucucagccucccaaaguacugg

SEQ ID NO: 448816 - RNA, 24 nt, Human
cuacugagcacuugcaauguggcu

SEQ ID NO: 448817 - RNA, 21 nt, Human
cuaguuccugggucaguuagu

SEQ ID NO: 448818 - RNA, 24 nt, Human
cucacugcaaccucugccucccag

SEQ ID NO: 448819 - RNA, 24 nt, Human
cucacugcaaccucugccucccag

SEQ ID NO: 448820 - RNA, 18 nt, Human
cucacugccaucucugcc

SEQ ID NO: 448821 - RNA, 24 nt, Human
cucacugccaucucugccuccugg

SEQ ID NO: 448822 - RNA, 19 nt, Human
cuccaaagaucaaauacag

SEQ ID NO: 448823 - RNA, 26 nt, Human
cuccugaccucaagugaucugcccgu

SEQ ID NO: 448824 - RNA, 22 nt, Human
cuccugaccucgugauccgccc

SEQ ID NO: 448825 - RNA, 21 nt, Human
cuccuggguucacgccauucu

SEQ ID NO: 448826 - RNA, 24 nt, Human
cucgcucugucgcccaggcugggg

SEQ ID NO: 448827 - RNA, 23 nt, Human
cugcaaccucugccucccagguu

SEQ ID NO: 448828 - RNA, 24 nt, Human
cugcaaccucugccucccagguuc

SEQ ID NO: 448829 - RNA, 20 nt, Human
cugccaccccuggcuuaggc

SEQ ID NO: 448830 - RNA, 23 nt, Human
cugcugcacaccaauucucccca

SEQ ID NO: 448831 - RNA, 22 nt, Human
cuggcagcauggaggagccccg

SEQ ID NO: 448832 - RNA, 18 nt, Human
cuggcuaucugcccacug

SEQ ID NO: 448833 - RNA, 18 nt, Human
cugggcagguuuucuuuc

SEQ ID NO: 448834 - RNA, 24 nt, Human
gaccucaagugaucugcccgucuc

SEQ ID NO: 448835 - RNA, 22 nt, Human
gaccucgugauccgcccacuuc

SEQ ID NO: 448836 - RNA, 24 nt, Human
gaccucgugauccgcccacuucgg

SEQ ID NO: 448837 - RNA, 25 nt, Human
gaccucgugauccgcccacuucggc

SEQ ID NO: 448838 - RNA, 18 nt, Human
gacuuuucuuuucuuuuc

SEQ ID NO: 448839 - RNA, 24 nt, Human
gagacgggguuucaccauguuggc

SEQ ID NO: 448840 - RNA, 19 nt, Human
gagcacuuuuuggaggaag

SEQ ID NO: 448841 - RNA, 19 nt, Human
gagcacuuuuuggaggaag

SEQ ID NO: 448842 - RNA, 24 nt, Human
gagcauacuuggcaagcuaugaaa

SEQ ID NO: 448843 - RNA, 18 nt, Human
gaggagccccgggcccgc

SEQ ID NO: 448844 - RNA, 20 nt, Human
gaguaaaucuuauaugcaga

SEQ ID NO: 448845 - RNA, 23 nt, Human
gaucuagggcccaagauccuucc

SEQ ID NO: 448846 - RNA, 18 nt, Human
gauuacaggcaugagcca

SEQ ID NO: 448847 - RNA, 22 nt, Human
gauuacaggcaugagccacugc

SEQ ID NO: 448848 - RNA, 22 nt, Human
gauuacaggcaugagccacugc

SEQ ID NO: 448849 - RNA, 21 nt, Human
gauuacaggcgugagcaccac

SEQ ID NO: 448850 - RNA, 18 nt, Human
gauuacaggugugugcca

SEQ ID NO: 448851 - RNA, 21 nt, Human
gauuauaagccauuucacuga

SEQ ID NO: 448852 - RNA, 22 nt, Human
gcaaccucugccucccagguuc

SEQ ID NO: 448853 - RNA, 21 nt, Human
gcaauuuguagauauauucuu

SEQ ID NO: 448854 - RNA, 23 nt, Human
gccccgcagcccggccggcagca

SEQ ID NO: 448855 - RNA, 20 nt, Human
gcccugccgggugccgcggc

SEQ ID NO: 448856 - RNA, 23 nt, Human
gccucagccucccaagcaguugg

SEQ ID NO: 448857 - RNA, 21 nt, Human
gcucacugccaucucugccuc

SEQ ID NO: 448858 - RNA, 19 nt, Human
ggacuuggguguuagggug

SEQ ID NO: 448859 - RNA, 24 nt, Human
ggauggucucgaucuccugaccuc

SEQ ID NO: 448860 - RNA, 22 nt, Human
ggauuacaggcaugagccacug

SEQ ID NO: 448861 - RNA, 18 nt, Human
ggcccgcccugccccggc

SEQ ID NO: 448862 - RNA, 24 nt, Human
ggcuggucuugaacuccugaccuc

SEQ ID NO: 448863 - RNA, 20 nt, Human
gggaagcggggacuggcggg

SEQ ID NO: 448864 - RNA, 19 nt, Human
ggggacuggcgggcccugc

SEQ ID NO: 448865 - RNA, 24 nt, Human
ggggagauaccucuuggcagcaug

SEQ ID NO: 448866 - RNA, 23 nt, Human
gggguuucaccauauuggccagg

SEQ ID NO: 448867 - RNA, 23 nt, Human
gggguuucaccauguuggccagg

SEQ ID NO: 448868 - RNA, 22 nt, Human
ggguuucaccauauuggccagg

SEQ ID NO: 448869 - RNA, 19 nt, Human
ggucuugaacuccugaccu

SEQ ID NO: 448870 - RNA, 23 nt, Human
ggugcaguggcgcgaucuuggcu

SEQ ID NO: 448871 - RNA, 24 nt, Human
ggugcaguggcgcgaucuuggcuc

SEQ ID NO: 448872 - RNA, 25 nt, Human
guagaacauuaauaaaagauacaaa

SEQ ID NO: 448873 - RNA, 23 nt, Human
guagagacgggguuucaccaugu

SEQ ID NO: 448874 - RNA, 24 nt, Human
gugaucugcccgucucagccuccc

SEQ ID NO: 448875 - RNA, 22 nt, Human
gugcaguggcgcgaucuuggcu

SEQ ID NO: 448876 - RNA, 20 nt, Human
guuccgugcugggcagguuu

SEQ ID NO: 448877 - RNA, 24 nt, Human
uaaaacaacucacaccagacaggc

SEQ ID NO: 448878 - RNA, 23 nt, Human
uaaauuaaaaaaaaaaacuacaa

SEQ ID NO: 448879 - RNA, 24 nt, Human
uaaauuccauuuauuuacuaaaag

SEQ ID NO: 448880 - RNA, 19 nt, Human
uaacauggauagagacuug

SEQ ID NO: 448881 - RNA, 19 nt, Human
uaaccacuuaauauaaugu

SEQ ID NO: 448882 - RNA, 24 nt, Human
uaagaauuaccacuacaguaaugu

SEQ ID NO: 448883 - RNA, 21 nt, Human
uaagauacauaccagauuuug

SEQ ID NO: 448884 - RNA, 20 nt, Human
uacaaaaacagaaaaguggc

SEQ ID NO: 448885 - RNA, 19 nt, Human
uacagauucaaggaucaau

SEQ ID NO: 448886 - RNA, 23 nt, Human
uacaggcaugagccacugcgccc

SEQ ID NO: 448887 - RNA, 22 nt, Human
uaccauaaaaauaugucacuuc

SEQ ID NO: 448888 - RNA, 20 nt, Human
uaccucaacuaaaaaaaacu

SEQ ID NO: 448889 - RNA, 24 nt, Human
uacucacuguuuucuuaaagugug

SEQ ID NO: 448890 - RNA, 23 nt, Human
uacugggauuacaggcgugagca

SEQ ID NO: 448891 - RNA, 21 nt, Human
uagagacgggguuucaccaug

SEQ ID NO: 448892 - RNA, 22 nt, Human
uagagacgggguuucaccaugu

SEQ ID NO: 448893 - RNA, 20 nt, Human
uaggcugcugcacaccaauu

SEQ ID NO: 448894 - RNA, 23 nt, Human
uaguagaaacgggguuucaccau

SEQ ID NO: 448895 - RNA, 25 nt, Human
uauggaauugaacagccccuccucu

SEQ ID NO: 448896 - RNA, 24 nt, Human
ucaccauguuggccaggauggucu

SEQ ID NO: 448897 - RNA, 18 nt, Human
ucacgaaaauucaaaaaa

SEQ ID NO: 448898 - RNA, 19 nt, Human
ucacugcaaccucugccuc

SEQ ID NO: 448899 - RNA, 24 nt, Human
ucacugcaaccucugccucccagg

SEQ ID NO: 448900 - RNA, 25 nt, Human
ucacugcaaccucugccucccaggu

SEQ ID NO: 448901 - RNA, 23 nt, Human
ucacugccaucucugccuccugg

SEQ ID NO: 448902 - RNA, 24 nt, Human
ucacugccaucucugccuccuggg

SEQ ID NO: 448903 - RNA, 24 nt, Human
ucaguagagacgggguuucaccau

SEQ ID NO: 448904 - RNA, 23 nt, Human
uccaacauugcugggacacuauc

SEQ ID NO: 448905 - RNA, 22 nt, Human
uccaauuccagggcucagugau

SEQ ID NO: 448906 - RNA, 24 nt, Human
ucccaaaguacugggauuacaggc

SEQ ID NO: 448907 - RNA, 24 nt, Human
ucccaaagugcugggauuacaggc

SEQ ID NO: 448908 - RNA, 23 nt, Human
ucccaagcaguugggauuacagg

SEQ ID NO: 448909 - RNA, 24 nt, Human
ucccaagcaguugggauuacaggu

SEQ ID NO: 448910 - RNA, 18 nt, Human
ucccagguucaagcaauc

SEQ ID NO: 448911 - RNA, 18 nt, Human
ucccugugacaggaagau

SEQ ID NO: 448912 - RNA, 18 nt, Human
uccgcagcccggcggcug

SEQ ID NO: 448913 - RNA, 21 nt, Human
uccuggguucacgccauucug

SEQ ID NO: 448914 - RNA, 22 nt, Human
ucgcccaggcuggggugcagug

SEQ ID NO: 448915 - RNA, 24 nt, Human
ucgcucugucgcccaggcuggggu

SEQ ID NO: 448916 - RNA, 26 nt, Human
ucuaaacucaagaauauaugagaagu

SEQ ID NO: 448917 - RNA, 19 nt, Human
ucuacagaaaaauauuaga

SEQ ID NO: 448918 - RNA, 23 nt, Human
ucuacagaaaaauauuagagcga

SEQ ID NO: 448919 - RNA, 24 nt, Human
ucuauuggacagcgcugcucuaga

SEQ ID NO: 448920 - RNA, 24 nt, Human
ucucacucuguugcccagacugga

SEQ ID NO: 448921 - RNA, 26 nt, Human
ucucacucuguugcccagacuggagu

SEQ ID NO: 448922 - RNA, 27 nt, Human
ucucacucuguugcccagacuggagug

SEQ ID NO: 448923 - RNA, 19 nt, Human
ucucgcucugucgcccagg

SEQ ID NO: 448924 - RNA, 22 nt, Human
ucucgcucugucgcccaggcug

SEQ ID NO: 448925 - RNA, 23 nt, Human
ucucgcucugucgcccaggcugg

SEQ ID NO: 448926 - RNA, 23 nt, Human
ucucgcucugucgcccaggcugg

SEQ ID NO: 448927 - RNA, 24 nt, Human
ucucgcucugucgcccaggcuggg

SEQ ID NO: 448928 - RNA, 26 nt, Human
ucucgcucugucgcccaggcuggggu

SEQ ID NO: 448929 - RNA, 27 nt, Human
ucucgcucugucgcccaggcuggggug

SEQ ID NO: 448930 - RNA, 24 nt, Human
ucugucgcccaggcuggggugcag

SEQ ID NO: 448931 - RNA, 21 nt, Human
ucuugaacuccugaccucaag

SEQ ID NO: 448932 - RNA, 20 nt, Human
ugaaagcauuacaaaaacag

SEQ ID NO: 448933 - RNA, 18 nt, Human
ugaagucucacucuguug

SEQ ID NO: 448934 - RNA, 18 nt, Human
ugaccucaagugaucugc

SEQ ID NO: 448935 - RNA, 24 nt, Human
ugaccucaagugaucugcccgucu

SEQ ID NO: 448936 - RNA, 19 nt, Human
ugauuccaaguaucauccu

SEQ ID NO: 448937 - RNA, 21 nt, Human
ugcagagguuaauccccaaga

SEQ ID NO: 448938 - RNA, 22 nt, Human
ugcaguggugcgaucucggcuc

SEQ ID NO: 448939 - RNA, 21 nt, Human
ugcccagacuggagugcagug

SEQ ID NO: 448940 - RNA, 24 nt, Human
ugcccagacuggagugcaguggug

SEQ ID NO: 448941 - RNA, 20 nt, Human
ugccgcggcggccgccaccg

SEQ ID NO: 448942 - RNA, 25 nt, Human
ugccgcggcggccgccaccgcagcc

SEQ ID NO: 448943 - RNA, 24 nt, Human
ugccucagccuccagagcagcugg

SEQ ID NO: 448944 - RNA, 20 nt, Human
ugccuggaaucagaagaccc

SEQ ID NO: 448945 - RNA, 24 nt, Human
ugcuuuguauuuucaguagagacg

SEQ ID NO: 448946 - RNA, 21 nt, Human
uggaaagcauuucucauaaaa

SEQ ID NO: 448947 - RNA, 23 nt, Human
uggagcagggaagcggggacugg

SEQ ID NO: 448948 - RNA, 24 nt, Human
uggagucucgcucugucgcccagg

SEQ ID NO: 448949 - RNA, 23 nt, Human
uggagugcaguggugcgaucucg

SEQ ID NO: 448950 - RNA, 24 nt, Human
uggagugcaguggugcgaucucgg

SEQ ID NO: 448951 - RNA, 24 nt, Human
uggccaggauggucucgaucuccu

SEQ ID NO: 448952 - RNA, 24 nt, Human
uggccaggcuggucuugaacuccu

SEQ ID NO: 448953 - RNA, 21 nt, Human
uggcucacugccaucucugcc

SEQ ID NO: 448954 - RNA, 21 nt, Human
ugggaccacaggcgcccgcca

SEQ ID NO: 448955 - RNA, 24 nt, Human
ugggaccacaggcgcccgccacca

SEQ ID NO: 448956 - RNA, 24 nt, Human
ugggaggaaaacguauuuccccac

SEQ ID NO: 448957 - RNA, 19 nt, Human
ugggauuacaggcaugagc

SEQ ID NO: 448958 - RNA, 22 nt, Human
ugggauuacaggcaugagccac

SEQ ID NO: 448959 - RNA, 22 nt, Human
ugggauuacaggcaugagccac

SEQ ID NO: 448960 - RNA, 23 nt, Human
ugggauuacaggcaugagccacu

SEQ ID NO: 448961 - RNA, 24 nt, Human
ugggauuacaggcaugagccacug

SEQ ID NO: 448962 - RNA, 26 nt, Human
ugggauuacaggcaugagccacugcg

SEQ ID NO: 448963 - RNA, 18 nt, Human
ugggauuacaggcgugag

SEQ ID NO: 448964 - RNA, 19 nt, Human
ugggauuacaggcgugagc

SEQ ID NO: 448965 - RNA, 23 nt, Human
ugggauuacaggcgugagcacca

SEQ ID NO: 448966 - RNA, 24 nt, Human
ugggauuacaggcgugagcaccac

SEQ ID NO: 448967 - RNA, 19 nt, Human
ugggauuacaggugugugc

SEQ ID NO: 448968 - RNA, 21 nt, Human
ugggauuacaggugugugcca

SEQ ID NO: 448969 - RNA, 21 nt, Human
ugggauuacaggugugugcca

SEQ ID NO: 448970 - RNA, 21 nt, Human
ugggauuacaggugugugcca

SEQ ID NO: 448971 - RNA, 22 nt, Human
ugggauuacaggugugugccau

SEQ ID NO: 448972 - RNA, 24 nt, Human
ugggauuacaggugugugccauua

SEQ ID NO: 448973 - RNA, 22 nt, Human
ugggcaaguaugagucuccaau

SEQ ID NO: 448974 - RNA, 24 nt, Human
uggggugcaguggcgcgaucuugg

SEQ ID NO: 448975 - RNA, 25 nt, Human
ugguaggcaggccccucugcucaau

SEQ ID NO: 448976 - RNA, 19 nt, Human
ugguuagaaauauuuuagc

SEQ ID NO: 448977 - RNA, 22 nt, Human
uguaaggaaagcugaaacucuu

SEQ ID NO: 448978 - RNA, 23 nt, Human
ugucggaccaggaauggugccaa

SEQ ID NO: 448979 - RNA, 21 nt, Human
uguugcccagacuggagugca

SEQ ID NO: 448980 - RNA, 21 nt, Human
uuagcaaaaauauggcaacua

SEQ ID NO: 448981 - RNA, 24 nt, Human
uuaguagaaacgggguuucaccau

SEQ ID NO: 448982 - RNA, 23 nt, Human
uuagugaugaccauauaacucau

SEQ ID NO: 448983 - RNA, 28 nt, Human
uucaucuuaaagugcucaacugagcaua

SEQ ID NO: 448984 - RNA, 19 nt, Human
uucggccucccaaagugcu

SEQ ID NO: 448985 - RNA, 21 nt, Human
uucuuuggcucauucuaaacc

SEQ ID NO: 448986 - RNA, 24 nt, Human
uugcccagacuggagugcaguggu

SEQ ID NO: 448987 - RNA, 21 nt, Human
uugggauuacaggugugugcc

SEQ ID NO: 448988 - RNA, 23 nt, Human
uuguauuuuuaguagaaacgggg

SEQ ID NO: 448989 - RNA, 23 nt, Human
uuuaaacauguacuugucauuuu

SEQ ID NO: 448990 - RNA, 22 nt, Human
uuuacggagaucccucaaagac

SEQ ID NO: 448991 - RNA, 24 nt, Human
uuucaccauauuggccaggcuggu

SEQ ID NO: 448992 - RNA, 19 nt, Human
uuucaccauguuggccagg

SEQ ID NO: 448993 - RNA, 20 nt, Human
uuucaccauguuggccagga

SEQ ID NO: 448994 - RNA, 24 nt, Human
uuuucaguagagacgggguuucac

SEQ ID NO: 448995 - RNA, 24 nt, Human
uuuugaguccaggacaaaaggauc

SEQ ID NO: 448996 - RNA, 24 nt, Human
uuuuuaguagaaacgggguuucac

SEQ ID NO: 448997 - RNA, 18 nt, Human
uuuuuuguauuuuuagua

SEQ ID NO: 448998 - RNA, 21 nt, Human
aaaaaaaacuaaaagauacau

SEQ ID NO: 448999 - RNA, 19 nt, Human
aaacagcuccagaaaguuc

SEQ ID NO: 449000 - RNA, 18 nt, Human
aaauaccauaaaauacaa

SEQ ID NO: 449001 - RNA, 22 nt, Human
aaggaggaggcuggcagacagc

SEQ ID NO: 449002 - RNA, 18 nt, Human
acaaaaauaggcugggag

SEQ ID NO: 449003 - RNA, 21 nt, Human
agaaaguucaaacaaaaaaaa

SEQ ID NO: 449004 - RNA, 18 nt, Human
aggaggaggagggagagc

SEQ ID NO: 449005 - RNA, 20 nt, Human
auaucagaacaugccucaca

SEQ ID NO: 449006 - RNA, 25 nt, Human
aucgaacgacgcguucaggcagaca

SEQ ID NO: 449007 - RNA, 21 nt, Human
augauaggaaauauaaacauc

SEQ ID NO: 449008 - RNA, 25 nt, Human
auguaucuguaguaauucucauaca

SEQ ID NO: 449009 - RNA, 24 nt, Human
auguggcaaaaaaguuugcuguuu

SEQ ID NO: 449010 - RNA, 24 nt, Human
caacaccgacgucgcuauuuacag

SEQ ID NO: 449011 - RNA, 24 nt, Human
caacgugacaccaucgaacgacgc

SEQ ID NO: 449012 - RNA, 22 nt, Human
cucaccgacaacaaaccaucau

SEQ ID NO: 449013 - RNA, 19 nt, Human
cuccugggaccuaacgauu

SEQ ID NO: 449014 - RNA, 20 nt, Human
cucggccccgccucgugccg

SEQ ID NO: 449015 - RNA, 22 nt, Human
cuuaguaucagccagauguacc

SEQ ID NO: 449016 - RNA, 20 nt, Human
cuucucuggguucugaaggg

SEQ ID NO: 449017 - RNA, 19 nt, Human
gaggaggaggagggagagc

SEQ ID NO: 449018 - RNA, 19 nt, Human
gccuauaaacauaucagaa

SEQ ID NO: 449019 - RNA, 19 nt, Human
ggaggaggaggagggagag

SEQ ID NO: 449020 - RNA, 25 nt, Human
ggaggaggaggagggagagcgaggu

SEQ ID NO: 449021 - RNA, 24 nt, Human
ggaggaggagggagagcgagguga

SEQ ID NO: 449022 - RNA, 22 nt, Human
ggugaggagggcgggagaagga

SEQ ID NO: 449023 - RNA, 23 nt, Human
uaaaacagcuccagaaaguucaa

SEQ ID NO: 449024 - RNA, 22 nt, Human
ucagccagauguaccaaauacc

SEQ ID NO: 449025 - RNA, 23 nt, Human
uccaacacucaccgacaacaaac

SEQ ID NO: 449026 - RNA, 23 nt, Human
uccagaaaguucaaacaaaaaaa

SEQ ID NO: 449027 - RNA, 24 nt, Human
uccagaaaguucaaacaaaaaaaa

SEQ ID NO: 449028 - RNA, 21 nt, Human
ucuucuauaaaacagcuccag

SEQ ID NO: 449029 - RNA, 18 nt, Human
ugaggagggcgggagaag

SEQ ID NO: 449030 - RNA, 19 nt, Human
uuccccaacgugacaccau

SEQ ID NO: 449031 - RNA, 21 nt, Human
uugcuguuuuauuuguuugcc

SEQ ID NO: 449032 - RNA, 24 nt, Human
uuucuaauguuguuuucucuaaca

SEQ ID NO: 449033 - RNA, 20 nt, Human
uuuuauuacaauggugcaag

SEQ ID NO: 449034 - RNA, 24 nt, Human
uuuucuaauguuguuuucucuaac

SEQ ID NO: 449035 - RNA, 19 nt, Human
aaccacuccccagccccca

SEQ ID NO: 449036 - RNA, 25 nt, Human
acaaagaagguguggccagaacaac

SEQ ID NO: 449037 - RNA, 24 nt, Human
acaagaaguccaaggaagagccga

SEQ ID NO: 449038 - RNA, 24 nt, Human
acagaacacacaagaaguccaagg

SEQ ID NO: 449039 - RNA, 23 nt, Human
agaacacacaagaaguccaagga

SEQ ID NO: 449040 - RNA, 20 nt, Human
agcccccagagccugggagu

SEQ ID NO: 449041 - RNA, 22 nt, Human
aggaagagccgaggguccagug

SEQ ID NO: 449042 - RNA, 21 nt, Human
aggcuugguaaccacucccca

SEQ ID NO: 449043 - RNA, 18 nt, Human
ccagagccugggagugga

SEQ ID NO: 449044 - RNA, 24 nt, Human
ccagagccugggaguggagcuggg

SEQ ID NO: 449045 - RNA, 22 nt, Human
ccaucugaggccaagauauuga

SEQ ID NO: 449046 - RNA, 23 nt, Human
cccaaacuauaaauauuuagcau

SEQ ID NO: 449047 - RNA, 20 nt, Human
cccaagacccugaauccagc

SEQ ID NO: 449048 - RNA, 23 nt, Human
cccaagacccugaauccagcgaa

SEQ ID NO: 449049 - RNA, 21 nt, Human
cccagcccccagagccuggga

SEQ ID NO: 449050 - RNA, 20 nt, Human
ccccagagccugggagugga

SEQ ID NO: 449051 - RNA, 20 nt, Human
cccugaauccagcgaagcuc

SEQ ID NO: 449052 - RNA, 19 nt, Human
ccucugagcuagagacggg

SEQ ID NO: 449053 - RNA, 19 nt, Human
cgcccagggucacagaucc

SEQ ID NO: 449054 - RNA, 19 nt, Human
cgcggcggaccucugaugc

SEQ ID NO: 449055 - RNA, 21 nt, Human
cucacagaacacacaagaagu

SEQ ID NO: 449056 - RNA, 21 nt, Human
cuccccagcccccagagccug

SEQ ID NO: 449057 - RNA, 23 nt, Human
cugagccacaaagaagguguggc

SEQ ID NO: 449058 - RNA, 26 nt, Human
cugaugcccaagacccugaauccagc

SEQ ID NO: 449059 - RNA, 23 nt, Human
gaauccagcgaagcucacagaac

SEQ ID NO: 449060 - RNA, 23 nt, Human
gccaagauauugacgggggggau

SEQ ID NO: 449061 - RNA, 22 nt, Human
gcccccagagccugggagugga

SEQ ID NO: 449062 - RNA, 18 nt, Human
gcggcggaccucugaugc

SEQ ID NO: 449063 - RNA, 20 nt, Human
ggagccaucugaggccaaga

SEQ ID NO: 449064 - RNA, 22 nt, Human
ggcagugggacagaaggagaga

SEQ ID NO: 449065 - RNA, 20 nt, Human
gggacagaaggagagaggag

SEQ ID NO: 449066 - RNA, 25 nt, Human
gggcagugggacagaaggagagagg

SEQ ID NO: 449067 - RNA, 18 nt, Human
ggggagagggcaguggga

SEQ ID NO: 449068 - RNA, 20 nt, Human
gggggggauuccuggguccc

SEQ ID NO: 449069 - RNA, 21 nt, Human
gguaaccacuccccagccccc

SEQ ID NO: 449070 - RNA, 24 nt, Human
guccaaggaagagccgagggucca

SEQ ID NO: 449071 - RNA, 22 nt, Human
uacuuuguguuauuauaagaua

SEQ ID NO: 449072 - RNA, 19 nt, Human
ucaaaccgagauaugaaug

SEQ ID NO: 449073 - RNA, 25 nt, Human
uccacagugggaaguucugugggac

SEQ ID NO: 449074 - RNA, 18 nt, Human
ugaccuuggggagccauc

SEQ ID NO: 449075 - RNA, 23 nt, Human
ugcugaccaauguccucuagggc

SEQ ID NO: 449076 - RNA, 21 nt, Human
uggagcugggaugcugggccg

SEQ ID NO: 449077 - RNA, 23 nt, Human
uggccagaacaacuugggcuccu

SEQ ID NO: 449078 - RNA, 22 nt, Human
ugggaguggagcugggaugcug

SEQ ID NO: 449079 - RNA, 22 nt, Human
ugguaaccacuccccagccccc

SEQ ID NO: 449080 - RNA, 21 nt, Human
ugugggacacauuggcacuga

SEQ ID NO: 449081 - RNA, 22 nt, Human
aaagcuccccaucuguccccuc

SEQ ID NO: 449082 - RNA, 20 nt, Human
aaaggcacguauuccuugaa

SEQ ID NO: 449083 - RNA, 22 nt, Human
aaccauuagccucccugacccc

SEQ ID NO: 449084 - RNA, 22 nt, Human
accccucuccccgcuuccccag

SEQ ID NO: 449085 - RNA, 23 nt, Human
agaaacauucagcaaagcaacca

SEQ ID NO: 449086 - RNA, 22 nt, Human
cagcaaagcaaccauuagccuc

SEQ ID NO: 449087 - RNA, 21 nt, Human
cagccccuaugggaacucgua

SEQ ID NO: 449088 - RNA, 21 nt, Human
ccagaaacauucagcaaagca

SEQ ID NO: 449089 - RNA, 22 nt, Human
ccccagcaguuaggaugaaggc

SEQ ID NO: 449090 - RNA, 22 nt, Human
ccugaccccucuccccgcuucc

SEQ ID NO: 449091 - RNA, 22 nt, Human
gcaaagcaaccauuagccuccc

SEQ ID NO: 449092 - RNA, 18 nt, Human
gccucccugaccccucuc

SEQ ID NO: 449093 - RNA, 22 nt, Human
uaagaaaagcuccccaucuguc

SEQ ID NO: 449094 - RNA, 23 nt, Human
uccccagcaguuaggaugaaggc

SEQ ID NO: 449095 - RNA, 20 nt, Human
ucccugaccccucuccccgc

SEQ ID NO: 449096 - RNA, 21 nt, Human
ugaccccucuccccgcuuccc

SEQ ID NO: 449097 - RNA, 22 nt, Human
ugaccccucuccccgcuucccc

SEQ ID NO: 449098 - RNA, 21 nt, Human
uuccuugaauagguaagaaaa

SEQ ID NO: 449099 - RNA, 25 nt, Human
aaaucacccuugauaacccacuuuc

SEQ ID NO: 449100 - RNA, 18 nt, Human
acgaaauaaaggcaaaag

SEQ ID NO: 449101 - RNA, 21 nt, Human
agacaugcucuucucucuucu

SEQ ID NO: 449102 - RNA, 21 nt, Human
caaauucuugaucaagaguuu

SEQ ID NO: 449103 - RNA, 24 nt, Human
caaguaaagacaugcucuucucuc

SEQ ID NO: 449104 - RNA, 20 nt, Human
caugcucuucucucuucugu

SEQ ID NO: 449105 - RNA, 20 nt, Human
cggcgcccggguuucaaccc

SEQ ID NO: 449106 - RNA, 21 nt, Human
cuguauaaaacuuuacgaaau

SEQ ID NO: 449107 - RNA, 20 nt, Human
gagacgguggcugcccgggc

SEQ ID NO: 449108 - RNA, 22 nt, Human
gagacgguggcugcccgggcuc

SEQ ID NO: 449109 - RNA, 21 nt, Human
gcagaaaauuucaaaucaccc

SEQ ID NO: 449110 - RNA, 24 nt, Human
ugcucuucucucuucuguauaaaa

SEQ ID NO: 449111 - RNA, 18 nt, Human
ugcuggaaaaugcugccc

SEQ ID NO: 449112 - RNA, 22 nt, Human
uggaaaaugcugcccagggcuc

SEQ ID NO: 449113 - RNA, 22 nt, Human
uguguacaucuugcuggaaaau

SEQ ID NO: 449114 - RNA, 23 nt, Human
uucuuauuaagcgccagcuuuaa

SEQ ID NO: 449115 - RNA, 28 nt, Human
uucuuuauuauuacuuauucuuauuaag

SEQ ID NO: 449116 - RNA, 19 nt, Human
uugcuggaaaaugcugccc

SEQ ID NO: 449117 - RNA, 18 nt, Human
uuuuuuuuuuuuuuuuug

SEQ ID NO: 449118 - RNA, 20 nt, Human
uuuuuuuuuuuuuuuuuguu

SEQ ID NO: 449119 - RNA, 21 nt, Human
agacaugcucuucucucuucu

SEQ ID NO: 449120 - RNA, 24 nt, Human
caaguaaagacaugcucuucucuc

SEQ ID NO: 449121 - RNA, 20 nt, Human
cggcgcccggguuucaaccc

SEQ ID NO: 449122 - RNA, 18 nt, Human
cugcagaaaauuucacau

SEQ ID NO: 449123 - RNA, 20 nt, Human
uaagcgccagcuuaaugcug

SEQ ID NO: 449124 - RNA, 24 nt, Human
ugcucuucucucuucuauauaaaa

SEQ ID NO: 449125 - RNA, 19 nt, Human
aagcacaccacccaccucc

SEQ ID NO: 449126 - RNA, 18 nt, Human
agcacaccacccaccucc

SEQ ID NO: 449127 - RNA, 19 nt, Human
caaaugcccaccccaaccc

SEQ ID NO: 449128 - RNA, 18 nt, Human
caccacccaccucccgca

SEQ ID NO: 449129 - RNA, 18 nt, Human
cacguguggccuuggggc

SEQ ID NO: 449130 - RNA, 22 nt, Human
ccacccaccucccgcaucaaau

SEQ ID NO: 449131 - RNA, 25 nt, Human
ccaccucccgcaucaaaugcccacc

SEQ ID NO: 449132 - RNA, 19 nt, Human
cccaccccaacccaacucc

SEQ ID NO: 449133 - RNA, 23 nt, Human
cccaccccaacccaacucccugc

SEQ ID NO: 449134 - RNA, 22 nt, Human
ccccaacccaacucccugccgc

SEQ ID NO: 449135 - RNA, 20 nt, Human
cccugccgccgccgcgcugc

SEQ ID NO: 449136 - RNA, 19 nt, Human
ccugccgccgccgcgcugc

SEQ ID NO: 449137 - RNA, 23 nt, Human
cgcaucaaaugcccaccccaacc

SEQ ID NO: 449138 - RNA, 20 nt, Human
cuagcaagcacaccacccaa

SEQ ID NO: 449139 - RNA, 23 nt, Human
cucccgcaucaaaugcccacccc

SEQ ID NO: 449140 - RNA, 22 nt, Human
cucccugccgccgccgcgcugc

SEQ ID NO: 449141 - RNA, 18 nt, Human
gccuuggggcagguccac

SEQ ID NO: 449142 - RNA, 23 nt, Human
uaaaaaaaaucugucccggccca

SEQ ID NO: 449143 - RNA, 24 nt, Human
uagcaagcacaccacccaccuccc

SEQ ID NO: 449144 - RNA, 21 nt, Human
ucaaaugcccaccccaaccca

SEQ ID NO: 449145 - RNA, 19 nt, Human
ugaccaggcacguguggcc

SEQ ID NO: 449146 - RNA, 20 nt, Human
ugaccaggcacguguggccu

SEQ ID NO: 449147 - RNA, 19 nt, Human
uggggcagguccacugcug

SEQ ID NO: 449148 - RNA, 24 nt, Human
uggguagucugagggggaaggcca

SEQ ID NO: 449149 - RNA, 24 nt, Human
uguggccuuggggcagguccacug

SEQ ID NO: 449150 - RNA, 20 nt, Human
uuggggcagguccacugcug

SEQ ID NO: 449151 - RNA, 24 nt, Human
uuuuuuuuuuuuuuuuuuuacaag

SEQ ID NO: 449152 - RNA, 22 nt, Human
aaaaaaccagccaacagggguu

SEQ ID NO: 449153 - RNA, 20 nt, Human
aaaaagcaagaaggcaaagc

SEQ ID NO: 449154 - RNA, 22 nt, Human
aaaacaaaacagaacaaaaaac

SEQ ID NO: 449155 - RNA, 21 nt, Human
aaaacaaaaugaaacaaaaag

SEQ ID NO: 449156 - RNA, 21 nt, Human
aaaacagcaaagaguuuauag

SEQ ID NO: 449157 - RNA, 21 nt, Human
aaaauaauacaaaacaaaaca

SEQ ID NO: 449158 - RNA, 22 nt, Human
aaacaaaaagcagguaucaaaa

SEQ ID NO: 449159 - RNA, 23 nt, Human
aacaaaacagaacaaaaaaccag

SEQ ID NO: 449160 - RNA, 25 nt, Human
aacagaacaaaaaaccagccaacag

SEQ ID NO: 449161 - RNA, 20 nt, Human
aagcaagaaggcaaagcuga

SEQ ID NO: 449162 - RNA, 22 nt, Human
aagucagugauuacaaaacugg

SEQ ID NO: 449163 - RNA, 19 nt, Human
aaucauucuuucugauuug

SEQ ID NO: 449164 - RNA, 21 nt, Human
aauuuuuugcuguguggcagu

SEQ ID NO: 449165 - RNA, 25 nt, Human
acaaaaagcagguaucaaaaacagc

SEQ ID NO: 449166 - RNA, 27 nt, Human
acaaaacaaaacaaaaugaaacaaaaa

SEQ ID NO: 449167 - RNA, 22 nt, Human
acaaaacaaaacagaacaaaaa

SEQ ID NO: 449168 - RNA, 20 nt, Human
agaacaaaaaaccagccaac

SEQ ID NO: 449169 - RNA, 24 nt, Human
agagaaacagaugcuacccacagg

SEQ ID NO: 449170 - RNA, 19 nt, Human
agauaaucaggaggcaagc

SEQ ID NO: 449171 - RNA, 25 nt, Human
agcaagaaggcaaagcugagagaaa

SEQ ID NO: 449172 - RNA, 19 nt, Human
agcagguaucaaaaacagc

SEQ ID NO: 449173 - RNA, 20 nt, Human
aggcaaagcugagagaaaca

SEQ ID NO: 449174 - RNA, 19 nt, Human
aggcagauaauccacuucc

SEQ ID NO: 449175 - RNA, 26 nt, Human
aggcagauaauccacuuccugccaga

SEQ ID NO: 449176 - RNA, 18 nt, Human
agggcagcgguggcauug

SEQ ID NO: 449177 - RNA, 27 nt, Human
agggguuaaaaguugcacaauuaaacu

SEQ ID NO: 449178 - RNA, 18 nt, Human
agugauuacaaaacuggc

SEQ ID NO: 449179 - RNA, 22 nt, Human
augaaaaagcaagaaggcaaag

SEQ ID NO: 449180 - RNA, 19 nt, Human
augguccaguuuugcaaug

SEQ ID NO: 449181 - RNA, 22 nt, Human
caaaaagcagguaucaaaaaca

SEQ ID NO: 449182 - RNA, 25 nt, Human
caaaacaaaacaaaaugaaacaaaa

SEQ ID NO: 449183 - RNA, 24 nt, Human
caaaacaaaacagaacaaaaaacc

SEQ ID NO: 449184 - RNA, 20 nt, Human
caagacuucuugcucugaac

SEQ ID NO: 449185 - RNA, 20 nt, Human
cacuucccucuuggucaggu

SEQ ID NO: 449186 - RNA, 18 nt, Human
cagaacaaaaaaccagcc

SEQ ID NO: 449187 - RNA, 21 nt, Human
cagaacaaaaaaccagccaac

SEQ ID NO: 449188 - RNA, 22 nt, Human
ccacucccgaggcagauaaucc

SEQ ID NO: 449189 - RNA, 23 nt, Human
cccacaguacagauaaucaggag

SEQ ID NO: 449190 - RNA, 26 nt, Human
cgaggcagauaauccacuuccugcca

SEQ ID NO: 449191 - RNA, 19 nt, Human
cuucccucuuggucaggug

SEQ ID NO: 449192 - RNA, 20 nt, Human
cuucuugcucugaacccugg

SEQ ID NO: 449193 - RNA, 23 nt, Human
cuuucugcaaaucauucuuucug

SEQ ID NO: 449194 - RNA, 21 nt, Human
gaaaaagcaagaaggcaaagc

SEQ ID NO: 449195 - RNA, 24 nt, Human
gaaaaagcaagaaggcaaagcuga

SEQ ID NO: 449196 - RNA, 22 nt, Human
gaacccugggugaccacaaaua

SEQ ID NO: 449197 - RNA, 18 nt, Human
gagccauauuaguggaac

SEQ ID NO: 449198 - RNA, 24 nt, Human
gcauccaauguaaauacuaagcac

SEQ ID NO: 449199 - RNA, 18 nt, Human
ggcagcgguggcauuugg

SEQ ID NO: 449200 - RNA, 19 nt, Human
gggcagcgguggcauuugg

SEQ ID NO: 449201 - RNA, 20 nt, Human
gguaucaaaaacagcaaaga

SEQ ID NO: 449202 - RNA, 20 nt, Human
ggucuuuguaccagcaauuc

SEQ ID NO: 449203 - RNA, 21 nt, Human
guuaaaaauaauacaaaacaa

SEQ ID NO: 449204 - RNA, 19 nt, Human
uaaacccacaguacagaua

SEQ ID NO: 449205 - RNA, 25 nt, Human
uacaaaacaaaacaaaaugaaacaa

SEQ ID NO: 449206 - RNA, 28 nt, Human
uacaaaacaaaacaaaaugaaacaaaaa

SEQ ID NO: 449207 - RNA, 22 nt, Human
uacaaaacaaaacagaacaaaa

SEQ ID NO: 449208 - RNA, 23 nt, Human
uacaaaacaaaacagaacaaaaa

SEQ ID NO: 449209 - RNA, 24 nt, Human
uaccagcaauucccacucccgagg

SEQ ID NO: 449210 - RNA, 22 nt, Human
uacccugaagaacacugaagac

SEQ ID NO: 449211 - RNA, 23 nt, Human
uagaaaacacugagcuaaaacac

SEQ ID NO: 449212 - RNA, 18 nt, Human
uauagaauuucugcacca

SEQ ID NO: 449213 - RNA, 18 nt, Human
uaucaaaaacagcaaaga

SEQ ID NO: 449214 - RNA, 18 nt, Human
ucugaacccugggugacc

SEQ ID NO: 449215 - RNA, 24 nt, Human
ugaccaaaucucucaguauuaguu

SEQ ID NO: 449216 - RNA, 23 nt, Human
ugccagucucucauauuuuuuau

SEQ ID NO: 449217 - RNA, 21 nt, Human
ugcccagaguuuaaauuacac

SEQ ID NO: 449218 - RNA, 20 nt, Human
ugcucugaacccugggugac

SEQ ID NO: 449219 - RNA, 19 nt, Human
uguguggcaguuucuuuuu

SEQ ID NO: 449220 - RNA, 23 nt, Human
uguuuuggucuuuguaccagcaa

SEQ ID NO: 449221 - RNA, 23 nt, Human
uuaaaggacaacugauauguaaa

SEQ ID NO: 449222 - RNA, 23 nt, Human
uuaguggaacaaaaguuugaugu

SEQ ID NO: 449223 - RNA, 19 nt, Human
uucacccaccacuuauucc

SEQ ID NO: 449224 - RNA, 19 nt, Human
uucuuucugauuugcaguu

SEQ ID NO: 449225 - RNA, 20 nt, Human
uugaggggccaugauuauug

SEQ ID NO: 449226 - RNA, 22 nt, Human
uuugaaaggaugaaacacuucu

SEQ ID NO: 449227 - RNA, 18 nt, Human
uuugagaucccaacuacc

SEQ ID NO: 449228 - RNA, 24 nt, Human
ccgccgggccgccuccgcccgcgc

SEQ ID NO: 449229 - RNA, 20 nt, Human
ccggccgccgcccgucccag

SEQ ID NO: 449230 - RNA, 21 nt, Human
cgggaaaagaugcaauuagcg

SEQ ID NO: 449231 - RNA, 23 nt, Human
cucccagggcccgccgggccgcc

SEQ ID NO: 449232 - RNA, 19 nt, Human
cuccgcccgcgcucgugcc

SEQ ID NO: 449233 - RNA, 18 nt, Human
uggccgaggccacccggc

SEQ ID NO: 449234 - RNA, 23 nt, Human
aaaaccaaaccaaacaaaaauaa

SEQ ID NO: 449235 - RNA, 24 nt, Human
aaacaaaaauaaugauaucuuaau

SEQ ID NO: 449236 - RNA, 19 nt, Human
aaacauaagcccucuccca

SEQ ID NO: 449237 - RNA, 19 nt, Human
aaaccaaaccaaacaaaaa

SEQ ID NO: 449238 - RNA, 22 nt, Human
aagaggaaaaaagcaaaaccaa

SEQ ID NO: 449239 - RNA, 21 nt, Human
aagcaaaaccaaaccaaacaa

SEQ ID NO: 449240 - RNA, 24 nt, Human
aagcaaaaccaaaccaaacaaaaa

SEQ ID NO: 449241 - RNA, 18 nt, Human
aagucuuuggcaggcagc

SEQ ID NO: 449242 - RNA, 22 nt, Human
agaaagugcucucaaugcucuc

SEQ ID NO: 449243 - RNA, 20 nt, Human
aggaaaaaagcaaaaccaaa

SEQ ID NO: 449244 - RNA, 28 nt, Human
aggaaaaaagcaaaaccaaaccaaacaa

SEQ ID NO: 449245 - RNA, 25 nt, Human
aggagagaggauacuugggauuaua

SEQ ID NO: 449246 - RNA, 20 nt, Human
aggcaagugcauuuugggga

SEQ ID NO: 449247 - RNA, 25 nt, Human
caagcucccgagcucccaagcuccu

SEQ ID NO: 449248 - RNA, 22 nt, Human
cacaauagucuauagacacugg

SEQ ID NO: 449249 - RNA, 21 nt, Human
cagcagcaagaccauuuuuua

SEQ ID NO: 449250 - RNA, 22 nt, Human
cagccuuaucaaaagagagccu

SEQ ID NO: 449251 - RNA, 24 nt, Human
caguauugagaaaucuccaccaaa

SEQ ID NO: 449252 - RNA, 22 nt, Human
cagugauauauuaauaauauua

SEQ ID NO: 449253 - RNA, 21 nt, Human
cauaagcccucucccaagcuc

SEQ ID NO: 449254 - RNA, 25 nt, Human
cauaagcccucucccaagcucccga

SEQ ID NO: 449255 - RNA, 22 nt, Human
cccucucccaagcucccgagcu

SEQ ID NO: 449256 - RNA, 24 nt, Human
cuaaucuugcuguaaggagcaaaa

SEQ ID NO: 449257 - RNA, 25 nt, Human
cuccaggcucacaauagucuauaga

SEQ ID NO: 449258 - RNA, 22 nt, Human
cucccaagcuccugucaguugc

SEQ ID NO: 449259 - RNA, 22 nt, Human
cucccgagcucccaagcuccug

SEQ ID NO: 449260 - RNA, 18 nt, Human
cucucuguuuccaugagg

SEQ ID NO: 449261 - RNA, 23 nt, Human
cugauaaaauaaguacaauuuca

SEQ ID NO: 449262 - RNA, 20 nt, Human
gaaaauucagcacuacugug

SEQ ID NO: 449263 - RNA, 22 nt, Human
gacagcuacauuauuaaaaaca

SEQ ID NO: 449264 - RNA, 22 nt, Human
gguaagacaucuccaacaagga

SEQ ID NO: 449265 - RNA, 21 nt, Human
gucuuuggcaggcagcucuag

SEQ ID NO: 449266 - RNA, 24 nt, Human
gugcauuuuggggagcugagaggu

SEQ ID NO: 449267 - RNA, 21 nt, Human
uaaaaacauaagcccucuccc

SEQ ID NO: 449268 - RNA, 27 nt, Human
uaaaguaagaggaaaaaagcaaaacca

SEQ ID NO: 449269 - RNA, 20 nt, Human
uauuaacuuaaagucaccau

SEQ ID NO: 449270 - RNA, 19 nt, Human
ucccaagcucccgagcucc

SEQ ID NO: 449271 - RNA, 25 nt, Human
ucccaagcucccgagcucccaagcu

SEQ ID NO: 449272 - RNA, 27 nt, Human
ucccaagcucccgagcucccaagcucc

SEQ ID NO: 449273 - RNA, 20 nt, Human
ucccgagcucccaagcuccu

SEQ ID NO: 449274 - RNA, 22 nt, Human
ucucccaagcucccgagcuccc

SEQ ID NO: 449275 - RNA, 23 nt, Human
ucucccaagcucccgagcuccca

SEQ ID NO: 449276 - RNA, 25 nt, Human
ugaggaaaauucagcacuacugugc

SEQ ID NO: 449277 - RNA, 19 nt, Human
ugaugugaaguuucccauu

SEQ ID NO: 449278 - RNA, 20 nt, Human
ugccugaaaggcaaacaaaa

SEQ ID NO: 449279 - RNA, 25 nt, Human
ugcuguaaggagcaaaaauaagggu

SEQ ID NO: 449280 - RNA, 21 nt, Human
uggggagcugagagguaagac

SEQ ID NO: 449281 - RNA, 20 nt, Human
uguuucuuauaggcaagugc

SEQ ID NO: 449282 - RNA, 25 nt, Human
uucuccaggcucacaauagucuaua

SEQ ID NO: 449283 - RNA, 28 nt, Human
uugaggacaaaaucuauuaggaauuuau

SEQ ID NO: 449284 - RNA, 20 nt, Human
uugguucagccuuaucaaaa

SEQ ID NO: 449285 - RNA, 24 nt, Human
uuuuauaaccuacuaaucuugcug

SEQ ID NO: 449286 - RNA, 21 nt, Human
uuuuuuuuuuuugaggacaaa

SEQ ID NO: 449287 - RNA, 19 nt, Human
uuuuuuuuuuuuuugagga

SEQ ID NO: 449288 - RNA, 23 nt, Human
uuuuuuuuuuuuuuuuuuugagg

SEQ ID NO: 449289 - RNA, 27 nt, Human
uuuuuuuuuuuuuuuuuuuuuuugggg

SEQ ID NO: 449290 - RNA, 24 nt, Human
aagcagggggaggugaucacaggu

SEQ ID NO: 449291 - RNA, 19 nt, Human
aagcgugggguauggaagg

SEQ ID NO: 449292 - RNA, 20 nt, Human
agcaggaagcagggggaggu

SEQ ID NO: 449293 - RNA, 24 nt, Human
agcagggggaggugaucacaggug

SEQ ID NO: 449294 - RNA, 18 nt, Human
aggaagcagggggaggug

SEQ ID NO: 449295 - RNA, 18 nt, Human
aggugaucacagguggag

SEQ ID NO: 449296 - RNA, 23 nt, Human
auaagcgugggguauggaaggca

SEQ ID NO: 449297 - RNA, 19 nt, Human
cagagaggaggugccugag

SEQ ID NO: 449298 - RNA, 22 nt, Human
cagcagcaggaagcagggggag

SEQ ID NO: 449299 - RNA, 21 nt, Human
cagguggagccaggccccguc

SEQ ID NO: 449300 - RNA, 22 nt, Human
ccccucagaccccaugagugag

SEQ ID NO: 449301 - RNA, 23 nt, Human
cccucagaccccaugagugagcu

SEQ ID NO: 449302 - RNA, 21 nt, Human
gcugugccacagcagcaggaa

SEQ ID NO: 449303 - RNA, 22 nt, Human
ugggguauggaaggcagagggc

SEQ ID NO: 449304 - RNA, 18 nt, Human
acuucgaggagggcgaga

SEQ ID NO: 449305 - RNA, 18 nt, Human
caaaaaauucucagagcu

SEQ ID NO: 449306 - RNA, 19 nt, Human
cagcccgcgcugcgccugc

SEQ ID NO: 449307 - RNA, 22 nt, Human
caucucucucgcgggaacgguc

SEQ ID NO: 449308 - RNA, 20 nt, Human
cgaucguacucgucaucacu

SEQ ID NO: 449309 - RNA, 20 nt, Human
cgcucacggccacgguccca

SEQ ID NO: 449310 - RNA, 22 nt, Human
cgcucacggccacggucccacu

SEQ ID NO: 449311 - RNA, 30 nt, Human
cucucugucauuccaaucguccccucgacu

SEQ ID NO: 449312 - RNA, 20 nt, Human
cugcgccugcgucaccccuc

SEQ ID NO: 449313 - RNA, 22 nt, Human
gacuucgaggagggcgagacgg

SEQ ID NO: 449314 - RNA, 21 nt, Human
gggcgaccugggucgcgggcg

SEQ ID NO: 449315 - RNA, 21 nt, Human
uacucgucaucacugucaccc

SEQ ID NO: 449316 - RNA, 26 nt, Human
uccccucgacgucuuucaucucucuc

SEQ ID NO: 449317 - RNA, 21 nt, Human
uugucccugcgccuucgaucg

SEQ ID NO: 449318 - RNA, 18 nt, Human
uuuuuuuuuuuuucccug

SEQ ID NO: 449319 - RNA, 25 nt, Human
uuuuuuuuuuuuuuuucccugugga

SEQ ID NO: 449320 - RNA, 22 nt, Human
uuuuuuuuuuuuuuuuuucccu

SEQ ID NO: 449321 - RNA, 19 nt, Human
aaaacaagugcaauaaaag

SEQ ID NO: 449322 - RNA, 21 nt, Human
aacagaagcaaaguaaaucug

SEQ ID NO: 449323 - RNA, 21 nt, Human
aagaagcuaguucaaauuugc

SEQ ID NO: 449324 - RNA, 23 nt, Human
aaucaucccugcuauagcuuaga

SEQ ID NO: 449325 - RNA, 21 nt, Human
accaagcaggcaaggcuggaa

SEQ ID NO: 449326 - RNA, 24 nt, Human
accauguuggccaggcuggucuug

SEQ ID NO: 449327 - RNA, 24 nt, Human
acucuggcaguaacagaagcaaag

SEQ ID NO: 449328 - RNA, 20 nt, Human
acuucuucccugcuacccau

SEQ ID NO: 449329 - RNA, 22 nt, Human
agaagcaaaguaaaucuggaca

SEQ ID NO: 449330 - RNA, 24 nt, Human
agaaguacuguguagucugcugca

SEQ ID NO: 449331 - RNA, 22 nt, Human
agaauuuuuauuugucauugac

SEQ ID NO: 449332 - RNA, 24 nt, Human
agaggugggguuucaccauguugg

SEQ ID NO: 449333 - RNA, 18 nt, Human
agcuuagauucuccuagg

SEQ ID NO: 449334 - RNA, 22 nt, Human
aguaacagaagcaaaguaaauc

SEQ ID NO: 449335 - RNA, 21 nt, Human
aguagaggugggguuucacca

SEQ ID NO: 449336 - RNA, 22 nt, Human
aguagaggugggguuucaccau

SEQ ID NO: 449337 - RNA, 18 nt, Human
auaaacaggaagacacac

SEQ ID NO: 449338 - RNA, 26 nt, Human
aucaucccugcuauagcuuagauucu

SEQ ID NO: 449339 - RNA, 19 nt, Human
auuuugugcauuaucuucc

SEQ ID NO: 449340 - RNA, 18 nt, Human
caagacaauguaaggaaa

SEQ ID NO: 449341 - RNA, 20 nt, Human
caagugaugggaacacuacu

SEQ ID NO: 449342 - RNA, 21 nt, Human
cacacuccaaacaagugaugg

SEQ ID NO: 449343 - RNA, 21 nt, Human
caccauguuggccaggcuggu

SEQ ID NO: 449344 - RNA, 22 nt, Human
caccauguuggccaggcugguc

SEQ ID NO: 449345 - RNA, 23 nt, Human
caccauguuggccaggcuggucu

SEQ ID NO: 449346 - RNA, 24 nt, Human
caccauguuggccaggcuggucuu

SEQ ID NO: 449347 - RNA, 20 nt, Human
cauaaaucaucccugcuaua

SEQ ID NO: 449348 - RNA, 24 nt, Human
cauguuggccaggcuggucuugaa

SEQ ID NO: 449349 - RNA, 18 nt, Human
cauuccaggaaaucaaaa

SEQ ID NO: 449350 - RNA, 20 nt, Human
ccaagcaggcaaggcuggaa

SEQ ID NO: 449351 - RNA, 21 nt, Human
ccugggcaagcccugcuccug

SEQ ID NO: 449352 - RNA, 19 nt, Human
cggcugcagcggcaccaga

SEQ ID NO: 449353 - RNA, 23 nt, Human
cguaaaaugaccauuucuaaaca

SEQ ID NO: 449354 - RNA, 19 nt, Human
cugcuccugagccagucuu

SEQ ID NO: 449355 - RNA, 25 nt, Human
cugguugguugggaggaacugaauu

SEQ ID NO: 449356 - RNA, 20 nt, Human
gaccauaauuaccaauauca

SEQ ID NO: 449357 - RNA, 18 nt, Human
gaccuccggugauccacc

SEQ ID NO: 449358 - RNA, 20 nt, Human
gaggugggguuucaccaugu

SEQ ID NO: 449359 - RNA, 24 nt, Human
gaggugggguuucaccauguuggc

SEQ ID NO: 449360 - RNA, 24 nt, Human
ggcuggucuugaacuacugaccuc

SEQ ID NO: 449361 - RNA, 22 nt, Human
gggguuucaccauguuggccag

SEQ ID NO: 449362 - RNA, 18 nt, Human
ggguuucaccauguuggc

SEQ ID NO: 449363 - RNA, 19 nt, Human
ggucuugaacuacugaccu

SEQ ID NO: 449364 - RNA, 23 nt, Human
guagaggugggguuucaccaugu

SEQ ID NO: 449365 - RNA, 18 nt, Human
gugggguuucaccauguu

SEQ ID NO: 449366 - RNA, 20 nt, Human
uaacagaagcaaaguaaauc

SEQ ID NO: 449367 - RNA, 19 nt, Human
uagaauagcacacuccaaa

SEQ ID NO: 449368 - RNA, 24 nt, Human
uaggauuuuuuuuuuuuuuuuuuu

SEQ ID NO: 449369 - RNA, 24 nt, Human
uaguagaggugggguuucaccaug

SEQ ID NO: 449370 - RNA, 24 nt, Human
uauacacaauuuuuaguagaggug

SEQ ID NO: 449371 - RNA, 22 nt, Human
uaucagaagugaagacuguggu

SEQ ID NO: 449372 - RNA, 18 nt, Human
uccaaacaagugauggga

SEQ ID NO: 449373 - RNA, 21 nt, Human
ucccuuggcacacauaaacag

SEQ ID NO: 449374 - RNA, 19 nt, Human
uccuauaacucuuuccccc

SEQ ID NO: 449375 - RNA, 26 nt, Human
uccuuuggcagcauuacuuuugauaa

SEQ ID NO: 449376 - RNA, 18 nt, Human
ucucuuggguccaacugg

SEQ ID NO: 449377 - RNA, 19 nt, Human
ucugccggcugcagcggca

SEQ ID NO: 449378 - RNA, 18 nt, Human
ucuuaguuuuuauucugg

SEQ ID NO: 449379 - RNA, 19 nt, Human
ugaaaacaaaaaauaauca

SEQ ID NO: 449380 - RNA, 25 nt, Human
ugaccuccggugauccaccaugccu

SEQ ID NO: 449381 - RNA, 24 nt, Human
ugcauaaaucaucccugcuauagc

SEQ ID NO: 449382 - RNA, 23 nt, Human
ugccugggcaagcccugcuccug

SEQ ID NO: 449383 - RNA, 25 nt, Human
ugccugggcaagcccugcuccugag

SEQ ID NO: 449384 - RNA, 20 nt, Human
uggcagcauuacuuuugauu

SEQ ID NO: 449385 - RNA, 19 nt, Human
uggcaguaacagaagcaaa

SEQ ID NO: 449386 - RNA, 24 nt, Human
uggcaguacacugaguuuuaacug

SEQ ID NO: 449387 - RNA, 24 nt, Human
uggccaggcuggucuugaacuacu

SEQ ID NO: 449388 - RNA, 23 nt, Human
ugggaggaacugaauugugaaca

SEQ ID NO: 449389 - RNA, 21 nt, Human
ugggguuucaccauguuggcc

SEQ ID NO: 449390 - RNA, 24 nt, Human
ugggguuucaccauguuggccagg

SEQ ID NO: 449391 - RNA, 18 nt, Human
uggucaaaacaagugcaa

SEQ ID NO: 449392 - RNA, 18 nt, Human
ugguggguaguuaccaac

SEQ ID NO: 449393 - RNA, 20 nt, Human
ugguugggaggaacugaauu

SEQ ID NO: 449394 - RNA, 18 nt, Human
ugucaagacaauguaagg

SEQ ID NO: 449395 - RNA, 21 nt, Human
ugucaagacaauguaaggaaa

SEQ ID NO: 449396 - RNA, 18 nt, Human
uuagauucuccuagguag

SEQ ID NO: 449397 - RNA, 18 nt, Human
uuaguagaggugggguuu

SEQ ID NO: 449398 - RNA, 22 nt, Human
uuaguagaggugggguuucacc

SEQ ID NO: 449399 - RNA, 24 nt, Human
uuaguagaggugggguuucaccau

SEQ ID NO: 449400 - RNA, 20 nt, Human
uuaguagaggugggguuucg

SEQ ID NO: 449401 - RNA, 23 nt, Human
uuccaguauucuccuucucuuuu

SEQ ID NO: 449402 - RNA, 23 nt, Human
uucccugcuacccaugugcucuu

SEQ ID NO: 449403 - RNA, 24 nt, Human
uuggcacagacauuuuaaucuugu

SEQ ID NO: 449404 - RNA, 23 nt, Human
uugugcuaaagguuuugaaaacc

SEQ ID NO: 449405 - RNA, 30 nt, Human
uuguuuguuuguuuuuaggauuuuuuuuuu

SEQ ID NO: 449406 - RNA, 24 nt, Human
uuucaccauguuggccaggcuggu

SEQ ID NO: 449407 - RNA, 18 nt, Human
uuuuuaguagaggugggg

SEQ ID NO: 449408 - RNA, 24 nt, Human
uuuuuaguagaggugggguuucac

SEQ ID NO: 449409 - RNA, 19 nt, Human
uuuuuguuuguuuguuuuu

SEQ ID NO: 449410 - RNA, 26 nt, Human
uuuuuuuugccacacugguuuuuguu

SEQ ID NO: 449411 - RNA, 20 nt, Human
uuuuuuuuuuuuuuuugcca

SEQ ID NO: 449412 - RNA, 18 nt, Human
uuuuuuuuuuuuuuuuug

SEQ ID NO: 449413 - RNA, 18 nt, Human
uuuuuuuuuuuuuuuuug

SEQ ID NO: 449414 - RNA, 23 nt, Human
aaaaauauuauccuuuggaaauu

SEQ ID NO: 449415 - RNA, 18 nt, Human
aaccuuguauuuucuggc

SEQ ID NO: 449416 - RNA, 22 nt, Human
aaguaucagccuugagaugacc

SEQ ID NO: 449417 - RNA, 20 nt, Human
aggagguugcagccgcauuu

SEQ ID NO: 449418 - RNA, 20 nt, Human
cacagcucaaguaucagccu

SEQ ID NO: 449419 - RNA, 21 nt, Human
cucacaggccaugggacaguc

SEQ ID NO: 449420 - RNA, 19 nt, Human
gacaguccaguucccugca

SEQ ID NO: 449421 - RNA, 18 nt, Human
gaucucugggcacacagc

SEQ ID NO: 449422 - RNA, 18 nt, Human
ggcggccagacgcccauc

SEQ ID NO: 449423 - RNA, 23 nt, Human
uaaaugcacaggagguugcagcc

SEQ ID NO: 449424 - RNA, 18 nt, Human
ucccugcagacccagcgg

SEQ ID NO: 449425 - RNA, 18 nt, Human
ucucugggcacacagcuc

SEQ ID NO: 449426 - RNA, 22 nt, Human
ucuggcaaaaauauaaaucuaa

SEQ ID NO: 449427 - RNA, 18 nt, Human
ugaagauuggcuccaggg

SEQ ID NO: 449428 - RNA, 19 nt, Human
ugcacuuccuuggcaggca

SEQ ID NO: 449429 - RNA, 23 nt, Human
uggcaggcagccaggcgcuccgg

SEQ ID NO: 449430 - RNA, 30 nt, Human
uuaguuuuauuauaaccuuguauuuucugg

SEQ ID NO: 449431 - RNA, 18 nt, Human
uuccuuggcaggcagcca

SEQ ID NO: 449432 - RNA, 25 nt, Human
uuuucuggcaaaaauauaaaucuaa

SEQ ID NO: 449433 - RNA, 18 nt, Human
uuuuuuuuuuuuuuuuug

SEQ ID NO: 449434 - RNA, 22 nt, Human
uuuuuuuuuuuuuuuuugguag

SEQ ID NO: 449435 - RNA, 20 nt, Human
uuuuuuuuuuuuuuuuuugg

SEQ ID NO: 449436 - RNA, 18 nt, Human
aaggagccacaagauuuc

SEQ ID NO: 449437 - RNA, 20 nt, Human
aaguacuucuccuuugcccu

SEQ ID NO: 449438 - RNA, 25 nt, Human
caaguacuucuccuuugcccuuggu

SEQ ID NO: 449439 - RNA, 22 nt, Human
cacaaguacuucuccuuugccc

SEQ ID NO: 449440 - RNA, 23 nt, Human
cacaaguacuucuccuuugcccu

SEQ ID NO: 449441 - RNA, 18 nt, Human
cuuucagucucauccgua

SEQ ID NO: 449442 - RNA, 23 nt, Human
uauuuuuuuuaaauaaaaggagc

SEQ ID NO: 449443 - RNA, 21 nt, Human
ugugucacaaguacuucuccu

SEQ ID NO: 449444 - RNA, 22 nt, Human
uucucagaguucuccuuugagg

SEQ ID NO: 449445 - RNA, 21 nt, Human
agaguucccucagcccugcug

SEQ ID NO: 449446 - RNA, 25 nt, Human
agaguucccucagcccugcuguggc

SEQ ID NO: 449447 - RNA, 26 nt, Human
caguacuuuccuugcuugucccagga

SEQ ID NO: 449448 - RNA, 18 nt, Human
cccaucacauagcagagu

SEQ ID NO: 449449 - RNA, 23 nt, Human
ccucaauaaaacuccaugucucc

SEQ ID NO: 449450 - RNA, 18 nt, Human
ccugcuguggccucccca

SEQ ID NO: 449451 - RNA, 21 nt, Human
ccugcuguggccuccccaggc

SEQ ID NO: 449452 - RNA, 18 nt, Human
ccuggaggagacgugagg

SEQ ID NO: 449453 - RNA, 21 nt, Human
cugccucaguacuuuccuugc

SEQ ID NO: 449454 - RNA, 18 nt, Human
gagaaggcugcuagggcu

SEQ ID NO: 449455 - RNA, 20 nt, Human
gagggcgggaccagaggugc

SEQ ID NO: 449456 - RNA, 18 nt, Human
ggagaaggcugcuagggc

SEQ ID NO: 449457 - RNA, 22 nt, Human
ggaggagacgugagggccaggg

SEQ ID NO: 449458 - RNA, 22 nt, Human
gggagaaggcugcuagggcugg

SEQ ID NO: 449459 - RNA, 20 nt, Human
gugagggcgggaccagaggu

SEQ ID NO: 449460 - RNA, 23 nt, Human
guggccuccccaggccaacaucc

SEQ ID NO: 449461 - RNA, 22 nt, Human
uagcuaccucaauaaaacucca

SEQ ID NO: 449462 - RNA, 20 nt, Human
uccacacugcaauaccauuu

SEQ ID NO: 449463 - RNA, 18 nt, Human
uccccaggccaacauccu

SEQ ID NO: 449464 - RNA, 23 nt, Human
ucccggguccaggauuagggccc

SEQ ID NO: 449465 - RNA, 18 nt, Human
ucccucagcccugcugug

SEQ ID NO: 449466 - RNA, 27 nt, Human
ucuccacacugcaauaccauuuaauca

SEQ ID NO: 449467 - RNA, 24 nt, Human
ucuccacauugcaacaccguucaa

SEQ ID NO: 449468 - RNA, 18 nt, Human
ugagggccagggguccgg

SEQ ID NO: 449469 - RNA, 20 nt, Human
ugagggccagggguccgggu

SEQ ID NO: 449470 - RNA, 25 nt, Human
ugcaacaccguucaaucaaguggcu

SEQ ID NO: 449471 - RNA, 26 nt, Human
ugcaauaccauuuaaucacguagcua

SEQ ID NO: 449472 - RNA, 20 nt, Human
ugccucaguacuuuccuugc

SEQ ID NO: 449473 - RNA, 18 nt, Human
uucccucagcccugcugu

SEQ ID NO: 449474 - RNA, 23 nt, Human
uucccucagcccugcuguggccu

SEQ ID NO: 449475 - RNA, 19 nt, Human
uucgaggggcucgaggcag

SEQ ID NO: 449476 - RNA, 23 nt, Human
uucgaggggcucgaggcagaucu

SEQ ID NO: 449477 - RNA, 19 nt, Human
uuggggagaaggcugcuag

SEQ ID NO: 449478 - RNA, 19 nt, Human
uuuuuuuuuuuuuuuugca

SEQ ID NO: 449479 - RNA, 19 nt, Human
uuuuuuuuuuuuuuuuugc

SEQ ID NO: 449480 - RNA, 27 nt, Human
uuuuuuuuuuuuuuuuuuuuuuugggg

SEQ ID NO: 449481 - RNA, 21 nt, Human
aaacaaggcucagagaagcuc

SEQ ID NO: 449482 - RNA, 20 nt, Human
aaguagagagcugggaggcc

SEQ ID NO: 449483 - RNA, 21 nt, Human
acccgauucuucucucagcgg

SEQ ID NO: 449484 - RNA, 19 nt, Human
acugcaauauguguccuuc

SEQ ID NO: 449485 - RNA, 20 nt, Human
agaugcugggaggggccccu

SEQ ID NO: 449486 - RNA, 22 nt, Human
aggaacaaggggccuacacagc

SEQ ID NO: 449487 - RNA, 18 nt, Human
aggcccggguggcagcga

SEQ ID NO: 449488 - RNA, 18 nt, Human
agugagugagggcgggga

SEQ ID NO: 449489 - RNA, 25 nt, Human
agugcugggcucucccccgaagcuc

SEQ ID NO: 449490 - RNA, 20 nt, Human
agugggacucugcgggaggg

SEQ ID NO: 449491 - RNA, 25 nt, Human
auuccagccccagcgucaccagauc

SEQ ID NO: 449492 - RNA, 20 nt, Human
caaccaagcaacugcaauau

SEQ ID NO: 449493 - RNA, 20 nt, Human
caacuccaucccucagcagc

SEQ ID NO: 449494 - RNA, 18 nt, Human
cacaacuccaugagguaa

SEQ ID NO: 449495 - RNA, 20 nt, Human
caccuuguucuucuaggcaa

SEQ ID NO: 449496 - RNA, 24 nt, Human
cagaucccgggguggggcugggag

SEQ ID NO: 449497 - RNA, 21 nt, Human
ccaccccaguuucuccaggug

SEQ ID NO: 449498 - RNA, 21 nt, Human
ccacuguaguguucaucagag

SEQ ID NO: 449499 - RNA, 25 nt, Human
ccagcucccaugagugaguacaggc

SEQ ID NO: 449500 - RNA, 26 nt, Human
cccacccuccuguugaggcagcacca

SEQ ID NO: 449501 - RNA, 18 nt, Human
ccccagcgucaccagauc

SEQ ID NO: 449502 - RNA, 25 nt, Human
cccccgagguugggagggggguaga

SEQ ID NO: 449503 - RNA, 19 nt, Human
cccccgggccuugucuggg

SEQ ID NO: 449504 - RNA, 18 nt, Human
ccccgaagcucaaacagc

SEQ ID NO: 449505 - RNA, 18 nt, Human
ccccgaagcucaaacagc

SEQ ID NO: 449506 - RNA, 21 nt, Human
ccccuagcuuggcuagguccc

SEQ ID NO: 449507 - RNA, 20 nt, Human
cccgccccaccuuucggggc

SEQ ID NO: 449508 - RNA, 20 nt, Human
cccgggccuugucugggggc

SEQ ID NO: 449509 - RNA, 19 nt, Human
cccgggguggggcugggag

SEQ ID NO: 449510 - RNA, 23 nt, Human
ccgaagcucaaacagcgcaugcc

SEQ ID NO: 449511 - RNA, 21 nt, Human
ccuccugcccgccgccgcagc

SEQ ID NO: 449512 - RNA, 20 nt, Human
ccucggauauggagaguaga

SEQ ID NO: 449513 - RNA, 19 nt, Human
ccuuggcagccagucugca

SEQ ID NO: 449514 - RNA, 21 nt, Human
cgccccaccuuucggggcuca

SEQ ID NO: 449515 - RNA, 22 nt, Human
cgggagaaagugagugagggcg

SEQ ID NO: 449516 - RNA, 22 nt, Human
cgggccgagggcgggagaaagu

SEQ ID NO: 449517 - RNA, 22 nt, Human
cgguaaggguccagucugcaaa

SEQ ID NO: 449518 - RNA, 20 nt, Human
cuccaucccucagcagccuc

SEQ ID NO: 449519 - RNA, 19 nt, Human
cucccccgaagcucaaaca

SEQ ID NO: 449520 - RNA, 18 nt, Human
cugcagcagcugcucucu

SEQ ID NO: 449521 - RNA, 22 nt, Human
gagaaagugagugagggcgggg

SEQ ID NO: 449522 - RNA, 18 nt, Human
gagaggcacggaaaccgg

SEQ ID NO: 449523 - RNA, 20 nt, Human
gagggcggggagcgaggggu

SEQ ID NO: 449524 - RNA, 19 nt, Human
gcaggaagagccaccggua

SEQ ID NO: 449525 - RNA, 23 nt, Human
gcagggugagggcucuggggcug

SEQ ID NO: 449526 - RNA, 21 nt, Human
gcccgagggaccugcugcugg

SEQ ID NO: 449527 - RNA, 18 nt, Human
gcccugcagcagcugcuc

SEQ ID NO: 449528 - RNA, 24 nt, Human
ggagggggguagaugcugggaggg

SEQ ID NO: 449529 - RNA, 21 nt, Human
ggccugggcgggggcugaugc

SEQ ID NO: 449530 - RNA, 21 nt, Human
ggccuugucugggggccgggc

SEQ ID NO: 449531 - RNA, 18 nt, Human
ggcgggggcugaugccuc

SEQ ID NO: 449532 - RNA, 19 nt, Human
ggcucaccuggcugcucca

SEQ ID NO: 449533 - RNA, 20 nt, Human
guacaggccaguuccagcac

SEQ ID NO: 449534 - RNA, 19 nt, Human
guggccuuggcagccaguc

SEQ ID NO: 449535 - RNA, 25 nt, Human
uaggggccucucagcuuugaggccu

SEQ ID NO: 449536 - RNA, 21 nt, Human
ucagccacuguaguguucauc

SEQ ID NO: 449537 - RNA, 20 nt, Human
uccagaugagcaaacaaggc

SEQ ID NO: 449538 - RNA, 20 nt, Human
uccagcacaggcacuuucaa

SEQ ID NO: 449539 - RNA, 24 nt, Human
ucccuacagggccugggcgggggc

SEQ ID NO: 449540 - RNA, 21 nt, Human
uccgaagggcuccauagcuga

SEQ ID NO: 449541 - RNA, 24 nt, Human
uccugcaccuuguucuucuaggca

SEQ ID NO: 449542 - RNA, 21 nt, Human
uccugcccgccgccgcagccg

SEQ ID NO: 449543 - RNA, 18 nt, Human
ucggggcucaccuggcug

SEQ ID NO: 449544 - RNA, 23 nt, Human
ucugcaaagcccuggagcgagcc

SEQ ID NO: 449545 - RNA, 20 nt, Human
ucuucuaggcaccuuuccgg

SEQ ID NO: 449546 - RNA, 21 nt, Human
ucuuuugugggggaccggccu

SEQ ID NO: 449547 - RNA, 22 nt, Human
ugagcuguucccccacccuccu

SEQ ID NO: 449548 - RNA, 22 nt, Human
ugagcuguucccccacccuccu

SEQ ID NO: 449549 - RNA, 18 nt, Human
ugaggcagcacggggucc

SEQ ID NO: 449550 - RNA, 21 nt, Human
ugagggcucuggggcugcuag

SEQ ID NO: 449551 - RNA, 21 nt, Human
ugccagagucugugagaagug

SEQ ID NO: 449552 - RNA, 26 nt, Human
ugccccgccccaccuuucggggcuca

SEQ ID NO: 449553 - RNA, 23 nt, Human
ugcuccacccgauucuucucuca

SEQ ID NO: 449554 - RNA, 22 nt, Human
uggagaggcacggaaaccggga

SEQ ID NO: 449555 - RNA, 18 nt, Human
uggcagccagucugcacc

SEQ ID NO: 449556 - RNA, 18 nt, Human
uggcagcgagggcugggg

SEQ ID NO: 449557 - RNA, 18 nt, Human
uggcuagugggacucugc

SEQ ID NO: 449558 - RNA, 26 nt, Human
uggcuagugggacucugcgggagggu

SEQ ID NO: 449559 - RNA, 24 nt, Human
ugggacucugcgggagggucccag

SEQ ID NO: 449560 - RNA, 20 nt, Human
ugggaggccgggccgagggc

SEQ ID NO: 449561 - RNA, 23 nt, Human
ugggaggccgggccgagggcggg

SEQ ID NO: 449562 - RNA, 21 nt, Human
ugggagggggguagaugcugg

SEQ ID NO: 449563 - RNA, 23 nt, Human
ugggagggggguagaugcuggag

SEQ ID NO: 449564 - RNA, 21 nt, Human
uggggcccgagggaccugcug

SEQ ID NO: 449565 - RNA, 18 nt, Human
uggggcuccaggcccggg

SEQ ID NO: 449566 - RNA, 27 nt, Human
uggggcuccaggcccggguggcagcga

SEQ ID NO: 449567 - RNA, 19 nt, Human
uguggccuuggcagccagu

SEQ ID NO: 449568 - RNA, 21 nt, Human
uguggggcuccaggcccgggu

SEQ ID NO: 449569 - RNA, 24 nt, Human
uguggggcuccaggcccggguggc

SEQ ID NO: 449570 - RNA, 20 nt, Human
uguugaggcagcacgggguc

SEQ ID NO: 449571 - RNA, 20 nt, Human
uucgucccuggcugaggccg

SEQ ID NO: 449572 - RNA, 27 nt, Human
uugcagcuauucuuucacaacuccaug

SEQ ID NO: 449573 - RNA, 18 nt, Human
uugucccuucaccuguuc

SEQ ID NO: 449574 - RNA, 19 nt, Human
aaaaauugagaaauggaca

SEQ ID NO: 449575 - RNA, 22 nt, Human
aaaccccagcuucaacgaccca

SEQ ID NO: 449576 - RNA, 23 nt, Human
aaacuugcugcugccaucucuga

SEQ ID NO: 449577 - RNA, 19 nt, Human
aaagcaaaugaaaauaggc

SEQ ID NO: 449578 - RNA, 18 nt, Human
aaaguucuuuagcuuucc

SEQ ID NO: 449579 - RNA, 22 nt, Human
aacgacccaagcuggagcccca

SEQ ID NO: 449580 - RNA, 23 nt, Human
aacuugcugcugccaucucuuuu

SEQ ID NO: 449581 - RNA, 21 nt, Human
aagaaaauagggcgccuguuu

SEQ ID NO: 449582 - RNA, 22 nt, Human
aagaaccucagcaucaauauug

SEQ ID NO: 449583 - RNA, 20 nt, Human
aagagccgagacugaugauu

SEQ ID NO: 449584 - RNA, 22 nt, Human
aagauuaauccaacuaaacacu

SEQ ID NO: 449585 - RNA, 20 nt, Human
aagcaaacucaaagcauaga

SEQ ID NO: 449586 - RNA, 23 nt, Human
aagcaaacucaaagcauagauca

SEQ ID NO: 449587 - RNA, 19 nt, Human
aaggaaauagaaauagcaa

SEQ ID NO: 449588 - RNA, 23 nt, Human
aagugguuucccaaaccccagcu

SEQ ID NO: 449589 - RNA, 25 nt, Human
acaccguauaccacaauauacaagc

SEQ ID NO: 449590 - RNA, 19 nt, Human
acccugaaaccugacaccg

SEQ ID NO: 449591 - RNA, 22 nt, Human
accuaaauguacaacaggaaau

SEQ ID NO: 449592 - RNA, 19 nt, Human
agccagcaccauaacucaa

SEQ ID NO: 449593 - RNA, 22 nt, Human
agccgagacugaugauuuagcg

SEQ ID NO: 449594 - RNA, 23 nt, Human
caaaccccagcuucaacgaccca

SEQ ID NO: 449595 - RNA, 19 nt, Human
caccauaacucacucacua

SEQ ID NO: 449596 - RNA, 18 nt, Human
cagcacaucuuauuuggg

SEQ ID NO: 449597 - RNA, 18 nt, Human
cagcuaugcuuccauucc

SEQ ID NO: 449598 - RNA, 19 nt, Human
ccaaagaguucuggacuuu

SEQ ID NO: 449599 - RNA, 22 nt, Human
ccauuauuuaaccucaaguuua

SEQ ID NO: 449600 - RNA, 23 nt, Human
ccccagcuucaacgacccaagcu

SEQ ID NO: 449601 - RNA, 23 nt, Human
ccgccgccaccaccacugccgcc

SEQ ID NO: 449602 - RNA, 24 nt, Human
ccgccgccaccaccacugccgccg

SEQ ID NO: 449603 - RNA, 25 nt, Human
ccgccgccaccaccacugccgccgg

SEQ ID NO: 449604 - RNA, 19 nt, Human
ccuucuauuucagaagagc

SEQ ID NO: 449605 - RNA, 23 nt, Human
cugaaaccugacaccguauacca

SEQ ID NO: 449606 - RNA, 22 nt, Human
cuggagccccaccccgugauac

SEQ ID NO: 449607 - RNA, 21 nt, Human
cuugacuaaucaccugugcaa

SEQ ID NO: 449608 - RNA, 20 nt, Human
gaaaaaguacuaaaaagcau

SEQ ID NO: 449609 - RNA, 19 nt, Human
gagaaggaaauagaaauag

SEQ ID NO: 449610 - RNA, 24 nt, Human
gauugcccuaaaccagauccccau

SEQ ID NO: 449611 - RNA, 24 nt, Human
gcaguagaagaaccucagcaucaa

SEQ ID NO: 449612 - RNA, 19 nt, Human
gucauggaauagcauuguu

SEQ ID NO: 449613 - RNA, 25 nt, Human
uaauaaguggaaaauacaauaaugu

SEQ ID NO: 449614 - RNA, 20 nt, Human
uacaaauuuccagaccauag

SEQ ID NO: 449615 - RNA, 23 nt, Human
uacaacaggaaauguguaaacaa

SEQ ID NO: 449616 - RNA, 23 nt, Human
uacaagcaauaguaguauaucau

SEQ ID NO: 449617 - RNA, 20 nt, Human
uacaguaauaauaaguggaa

SEQ ID NO: 449618 - RNA, 24 nt, Human
uacauucuaaaacggcuuuacagg

SEQ ID NO: 449619 - RNA, 18 nt, Human
uaccaaggagaccacagc

SEQ ID NO: 449620 - RNA, 18 nt, Human
uaccacaauauacaagca

SEQ ID NO: 449621 - RNA, 24 nt, Human
uagcaaaauauagccagcaccaua

SEQ ID NO: 449622 - RNA, 21 nt, Human
uagcaguagaagaaccucagc

SEQ ID NO: 449623 - RNA, 24 nt, Human
uagcaguagaagaaccucagcauc

SEQ ID NO: 449624 - RNA, 18 nt, Human
uaguaguauaucauuuua

SEQ ID NO: 449625 - RNA, 18 nt, Human
uaugagaaggaaauagaa

SEQ ID NO: 449626 - RNA, 18 nt, Human
uauuugggagauaaaugu

SEQ ID NO: 449627 - RNA, 23 nt, Human
uauuuuuaaacagaaauuauuuc

SEQ ID NO: 449628 - RNA, 19 nt, Human
ucaccaaagaguucuggac

SEQ ID NO: 449629 - RNA, 26 nt, Human
ucauuugucauauaagcaaagauuuc

SEQ ID NO: 449630 - RNA, 25 nt, Human
ugaaaaaaaacccugaaaccugaca

SEQ ID NO: 449631 - RNA, 21 nt, Human
ugaaaaaucauuauuuuaugc

SEQ ID NO: 449632 - RNA, 20 nt, Human
ugaaaacuuugaauaaccua

SEQ ID NO: 449633 - RNA, 18 nt, Human
ugaagcaaauauucaaua

SEQ ID NO: 449634 - RNA, 21 nt, Human
ugacaccguauaccacaauau

SEQ ID NO: 449635 - RNA, 25 nt, Human
ugagaaagcaaacucaaagcauaga

SEQ ID NO: 449636 - RNA, 20 nt, Human
ugcccuaaaccagaucccca

SEQ ID NO: 449637 - RNA, 21 nt, Human
uggagaugaaguaacuuuagc

SEQ ID NO: 449638 - RNA, 23 nt, Human
uggagccccaccccgugauaccu

SEQ ID NO: 449639 - RNA, 24 nt, Human
uggauuaccuaaaauauuacauuc

SEQ ID NO: 449640 - RNA, 24 nt, Human
uggcagagauuaacuuugaaauga

SEQ ID NO: 449641 - RNA, 25 nt, Human
ugggaaaacaggcaugcuuauucau

SEQ ID NO: 449642 - RNA, 18 nt, Human
ugggguucuggggccgcc

SEQ ID NO: 449643 - RNA, 19 nt, Human
ugggguucuggggccgccc

SEQ ID NO: 449644 - RNA, 21 nt, Human
uguauaaaauaauacaauaga

SEQ ID NO: 449645 - RNA, 20 nt, Human
uguguaaacaaaccguggaa

SEQ ID NO: 449646 - RNA, 25 nt, Human
uguugguaucuuuuuaaugugcuuu

SEQ ID NO: 449647 - RNA, 21 nt, Human
uuaaagcaaaugaaaauaggc

SEQ ID NO: 449648 - RNA, 23 nt, Human
uuacuacccauuauuuaaccuca

SEQ ID NO: 449649 - RNA, 22 nt, Human
uuauaagaauugaaagugcaau

SEQ ID NO: 449650 - RNA, 20 nt, Human
uucccaaaccccagcuucaa

SEQ ID NO: 449651 - RNA, 22 nt, Human
uucgcaguaugaauuccuagca

SEQ ID NO: 449652 - RNA, 23 nt, Human
uuggucaagagaauaaacaguca

SEQ ID NO: 449653 - RNA, 21 nt, Human
uuuuccagacuuccuugacua

SEQ ID NO: 449654 - RNA, 20 nt, Human
aaaaagauauaaacauguca

SEQ ID NO: 449655 - RNA, 18 nt, Human
acagcuuuauucagaugu

SEQ ID NO: 449656 - RNA, 24 nt, Human
agauauaaacaugucaaaggaaug

SEQ ID NO: 449657 - RNA, 19 nt, Human
cagcuuuauucagauguaa

SEQ ID NO: 449658 - RNA, 18 nt, Human
cucaacagaaaugaggag

SEQ ID NO: 449659 - RNA, 21 nt, Human
gcagcaacauuccuugugucc

SEQ ID NO: 449660 - RNA, 23 nt, Human
guggguguuucuaugugugacug

SEQ ID NO: 449661 - RNA, 25 nt, Human
uaaauuaaaaagauauaaacauguc

SEQ ID NO: 449662 - RNA, 19 nt, Human
uaagccaguaacaacauuu

SEQ ID NO: 449663 - RNA, 21 nt, Human
uaauuacagcuuuauucagau

SEQ ID NO: 449664 - RNA, 22 nt, Human
uaccuggccuuguguauaacgu

SEQ ID NO: 449665 - RNA, 23 nt, Human
uauuucaugucuuuucucuuuca

SEQ ID NO: 449666 - RNA, 21 nt, Human
ucagauacagcuggucaugcc

SEQ ID NO: 449667 - RNA, 19 nt, Human
uccaccgcuauuaucauug

SEQ ID NO: 449668 - RNA, 21 nt, Human
ugccacagauagugaagaaga

SEQ ID NO: 449669 - RNA, 26 nt, Human
uggcuugucucuuggguuggaagacc

SEQ ID NO: 449670 - RNA, 19 nt, Human
uguugcaugucauucaguc

SEQ ID NO: 449671 - RNA, 22 nt, Human
uuccacucaacugcaguccaga

SEQ ID NO: 449672 - RNA, 21 nt, Human
uugggugcauuugugggggug

SEQ ID NO: 449673 - RNA, 24 nt, Human
uuuaagccaguaacaacauuuaaa

SEQ ID NO: 449674 - RNA, 24 nt, Human
uuuucucuuucagauacagcuggu

SEQ ID NO: 449675 - RNA, 27 nt, Human
aaaaaccuguuuauuacaucaaugcua

SEQ ID NO: 449676 - RNA, 23 nt, Human
aaaaaucaacugauagggggaaa

SEQ ID NO: 449677 - RNA, 22 nt, Human
aacacccacgcugaaucuccau

SEQ ID NO: 449678 - RNA, 24 nt, Human
aacagcaguuagaaccagaaggaa

SEQ ID NO: 449679 - RNA, 21 nt, Human
aaccagaaggaaaaggcuguu

SEQ ID NO: 449680 - RNA, 22 nt, Human
aaccagaaggaaaaggcuguuu

SEQ ID NO: 449681 - RNA, 20 nt, Human
aaguucuauuaguacuuuuc

SEQ ID NO: 449682 - RNA, 18 nt, Human
aaucuccauuuauuccac

SEQ ID NO: 449683 - RNA, 19 nt, Human
acgcugaaucuccauuuau

SEQ ID NO: 449684 - RNA, 25 nt, Human
agaaggaaaaggcuguuauacagaa

SEQ ID NO: 449685 - RNA, 20 nt, Human
agacagcugcaguguucggu

SEQ ID NO: 449686 - RNA, 19 nt, Human
agggggaaaaaaaaaaaga

SEQ ID NO: 449687 - RNA, 20 nt, Human
agguagaagugaaaaacugg

SEQ ID NO: 449688 - RNA, 19 nt, Human
aguguucggucacauggag

SEQ ID NO: 449689 - RNA, 23 nt, Human
auacugauuacuucuugaacccc

SEQ ID NO: 449690 - RNA, 22 nt, Human
aucaaugcuacuuaugagaauu

SEQ ID NO: 449691 - RNA, 21 nt, Human
augacuguuuuacuuccccua

SEQ ID NO: 449692 - RNA, 18 nt, Human
auuccacggagguggagu

SEQ ID NO: 449693 - RNA, 20 nt, Human
cagauccccaaaugucaaag

SEQ ID NO: 449694 - RNA, 20 nt, Human
cagcaaagauaaugauauag

SEQ ID NO: 449695 - RNA, 20 nt, Human
cagcaguuagaaccagaagg

SEQ ID NO: 449696 - RNA, 23 nt, Human
cccaaaugucaaagugaaacaaa

SEQ ID NO: 449697 - RNA, 21 nt, Human
cugaaaaauacaguaacauaa

SEQ ID NO: 449698 - RNA, 21 nt, Human
cugcccaccagauccccaaau

SEQ ID NO: 449699 - RNA, 20 nt, Human
gaagacaagcuauugacuca

SEQ ID NO: 449700 - RNA, 20 nt, Human
guaauuaugaaaaagggaac

SEQ ID NO: 449701 - RNA, 21 nt, Human
gucuuugacuuguuuauuuac

SEQ ID NO: 449702 - RNA, 19 nt, Human
guggaguguuuacuguccc

SEQ ID NO: 449703 - RNA, 19 nt, Human
gugggaugcaguuuuuuaa

SEQ ID NO: 449704 - RNA, 25 nt, Human
uagaaccagaaggaaaaggcuguua

SEQ ID NO: 449705 - RNA, 24 nt, Human
uaucgcugucaauaacagcaaaga

SEQ ID NO: 449706 - RNA, 20 nt, Human
uaugaaaaagggaacacuuc

SEQ ID NO: 449707 - RNA, 22 nt, Human
uauuaguacuuuucauaagcag

SEQ ID NO: 449708 - RNA, 23 nt, Human
uccacggagguggaguucaccau

SEQ ID NO: 449709 - RNA, 20 nt, Human
ucugaaaaauacaguaacau

SEQ ID NO: 449710 - RNA, 20 nt, Human
ucuugaaccccaaaaagugc

SEQ ID NO: 449711 - RNA, 23 nt, Human
ugaaaaacugaagaauguggagu

SEQ ID NO: 449712 - RNA, 22 nt, Human
ugaagaacaaacuaaaaaccug

SEQ ID NO: 449713 - RNA, 24 nt, Human
ugacucaaagagaaccugccgcga

SEQ ID NO: 449714 - RNA, 23 nt, Human
ugagugucaggaacacaacugug

SEQ ID NO: 449715 - RNA, 21 nt, Human
ugauagggggaaaaaaaaaaa

SEQ ID NO: 449716 - RNA, 25 nt, Human
ugauagggggaaaaaaaaaaagauc

SEQ ID NO: 449717 - RNA, 22 nt, Human
ugcauacugauuacuucuugaa

SEQ ID NO: 449718 - RNA, 20 nt, Human
ugggaugcaguuuuuuaagu

SEQ ID NO: 449719 - RNA, 24 nt, Human
ugucaaagugaaacaaaacucagu

SEQ ID NO: 449720 - RNA, 25 nt, Human
ugucucaucccucuaaugauaugua

SEQ ID NO: 449721 - RNA, 18 nt, Human
uuaaaauauggguucacu

SEQ ID NO: 449722 - RNA, 21 nt, Human
uuccacggagguggaguucac

SEQ ID NO: 449723 - RNA, 23 nt, Human
uuccuuaggguuacugggaagua

SEQ ID NO: 449724 - RNA, 21 nt, Human
uuuauuccacggagguggagu

SEQ ID NO: 449725 - RNA, 22 nt, Human
uuuccagugacuguuuauugag

SEQ ID NO: 449726 - RNA, 23 nt, Human
uuuccagugacuguuuauugagu

SEQ ID NO: 449727 - RNA, 23 nt, Human
uuuuuuuuuuuuuuuuuuaucag

SEQ ID NO: 449728 - RNA, 24 nt, Human
aaagggcugggauuacaggcguga

SEQ ID NO: 449729 - RNA, 24 nt, Human
aagugauccacccgccuuggccuc

SEQ ID NO: 449730 - RNA, 24 nt, Human
accauguuggccaggcuggucuug

SEQ ID NO: 449731 - RNA, 18 nt, Human
acgagguuucaccauguu

SEQ ID NO: 449732 - RNA, 20 nt, Human
acgagguuucaccauguugg

SEQ ID NO: 449733 - RNA, 24 nt, Human
acgagguuucaccauguuggccag

SEQ ID NO: 449734 - RNA, 19 nt, Human
agccaccgcaccuggccug

SEQ ID NO: 449735 - RNA, 24 nt, Human
agggcugggauuacaggcgugagc

SEQ ID NO: 449736 - RNA, 22 nt, Human
agguucaagcaauucuccagcc

SEQ ID NO: 449737 - RNA, 22 nt, Human
agguuucaccauguuggccagg

SEQ ID NO: 449738 - RNA, 23 nt, Human
aucucagcucacuugcagccucg

SEQ ID NO: 449739 - RNA, 22 nt, Human
auuuuuguauuuuuaguagaga

SEQ ID NO: 449740 - RNA, 24 nt, Human
auuuuuguauuuuuaguagagacg

SEQ ID NO: 449741 - RNA, 24 nt, Human
caaagggcugggauuacaggcgug

SEQ ID NO: 449742 - RNA, 21 nt, Human
caccauguuggccaggcuggu

SEQ ID NO: 449743 - RNA, 23 nt, Human
caccauguuggccaggcuggucu

SEQ ID NO: 449744 - RNA, 24 nt, Human
caccauguuggccaggcuggucuu

SEQ ID NO: 449745 - RNA, 27 nt, Human
caccauguuggccaggcuggucuugaa

SEQ ID NO: 449746 - RNA, 23 nt, Human
cacuugcagccucgacuucccag

SEQ ID NO: 449747 - RNA, 24 nt, Human
cagagucucgcucuguugcccagg

SEQ ID NO: 449748 - RNA, 20 nt, Human
cagccucgacuucccagguu

SEQ ID NO: 449749 - RNA, 21 nt, Human
cagccucgacuucccagguuc

SEQ ID NO: 449750 - RNA, 24 nt, Human
cauguuggccaggcuggucuugaa

SEQ ID NO: 449751 - RNA, 22 nt, Human
ccaaagggcugggauuacaggc

SEQ ID NO: 449752 - RNA, 23 nt, Human
ccaaagggcugggauuacaggcg

SEQ ID NO: 449753 - RNA, 24 nt, Human
ccaaagggcugggauuacaggcgu

SEQ ID NO: 449754 - RNA, 22 nt, Human
ccaaguagcugugauaacaggc

SEQ ID NO: 449755 - RNA, 23 nt, Human
cccgccuuggccucccaaagggc

SEQ ID NO: 449756 - RNA, 22 nt, Human
ccugaccucaagugauccaccc

SEQ ID NO: 449757 - RNA, 23 nt, Human
ccugaccucaagugauccacccg

SEQ ID NO: 449758 - RNA, 24 nt, Human
cgcucuguugcccaggcuagacug

SEQ ID NO: 449759 - RNA, 24 nt, Human
cucaagugauccacccgccuuggc

SEQ ID NO: 449760 - RNA, 25 nt, Human
cucuguugcccaggcuagacugcca

SEQ ID NO: 449761 - RNA, 24 nt, Human
cuucccagguucaagcaauucucc

SEQ ID NO: 449762 - RNA, 24 nt, Human
cuuggccucccaaagggcugggau

SEQ ID NO: 449763 - RNA, 23 nt, Human
gaccucaagugauccacccgccu

SEQ ID NO: 449764 - RNA, 23 nt, Human
gacuucccagguucaagcaauuc

SEQ ID NO: 449765 - RNA, 23 nt, Human
gagguuucaccauguuggccagg

SEQ ID NO: 449766 - RNA, 18 nt, Human
gauuacaggcgugagcca

SEQ ID NO: 449767 - RNA, 22 nt, Human
gauuacaggcgugagccaccgc

SEQ ID NO: 449768 - RNA, 23 nt, Human
gauuacaggcgugagccaccgca

SEQ ID NO: 449769 - RNA, 22 nt, Human
gcagccucgacuucccagguuc

SEQ ID NO: 449770 - RNA, 23 nt, Human
gcuggucuugaacuccugaccuc

SEQ ID NO: 449771 - RNA, 24 nt, Human
ggcuggucuugaacuccugaccuc

SEQ ID NO: 449772 - RNA, 19 nt, Human
gggcuccagcggccgcaac

SEQ ID NO: 449773 - RNA, 19 nt, Human
ggucuugaacuccugaccu

SEQ ID NO: 449774 - RNA, 24 nt, Human
gugauccacccgccuuggccuccc

SEQ ID NO: 449775 - RNA, 22 nt, Human
uacaggcgugagccaccgcacc

SEQ ID NO: 449776 - RNA, 23 nt, Human
uacaggcgugagccaccgcaccu

SEQ ID NO: 449777 - RNA, 23 nt, Human
uagacugccauggcaugaucuca

SEQ ID NO: 449778 - RNA, 22 nt, Human
uagagacgagguuucaccaugu

SEQ ID NO: 449779 - RNA, 24 nt, Human
uaguagagacgagguuucaccaug

SEQ ID NO: 449780 - RNA, 26 nt, Human
uaguagagacgagguuucaccauguu

SEQ ID NO: 449781 - RNA, 24 nt, Human
ucacuugcagccucgacuucccag

SEQ ID NO: 449782 - RNA, 19 nt, Human
ucccaaagggcugggauua

SEQ ID NO: 449783 - RNA, 23 nt, Human
ucccaaagggcugggauuacagg

SEQ ID NO: 449784 - RNA, 24 nt, Human
ucccaaagggcugggauuacaggc

SEQ ID NO: 449785 - RNA, 24 nt, Human
ucccaaguagcugugauaacaggc

SEQ ID NO: 449786 - RNA, 21 nt, Human
ucccagguucaagcaauucuc

SEQ ID NO: 449787 - RNA, 24 nt, Human
ucccagguucaagcaauucuccag

SEQ ID NO: 449788 - RNA, 18 nt, Human
ucucgcucuguugcccag

SEQ ID NO: 449789 - RNA, 19 nt, Human
ucucgcucuguugcccagg

SEQ ID NO: 449790 - RNA, 21 nt, Human
ucucgcucuguugcccaggcu

SEQ ID NO: 449791 - RNA, 23 nt, Human
ucucgcucuguugcccaggcuag

SEQ ID NO: 449792 - RNA, 24 nt, Human
ucucgcucuguugcccaggcuaga

SEQ ID NO: 449793 - RNA, 18 nt, Human
ucuguugcccaggcuaga

SEQ ID NO: 449794 - RNA, 21 nt, Human
ucuugaacuccugaccucaag

SEQ ID NO: 449795 - RNA, 24 nt, Human
ugaccucaagugauccacccgccu

SEQ ID NO: 449796 - RNA, 24 nt, Human
ugauuuuuguauuuuuaguagaga

SEQ ID NO: 449797 - RNA, 20 nt, Human
uggcaugaucucagcucacu

SEQ ID NO: 449798 - RNA, 24 nt, Human
uggccaggcuggucuugaacuccu

SEQ ID NO: 449799 - RNA, 18 nt, Human
ugggauuacaggcgugag

SEQ ID NO: 449800 - RNA, 19 nt, Human
ugggauuacaggcgugagc

SEQ ID NO: 449801 - RNA, 21 nt, Human
ugggauuacaggcgugagcca

SEQ ID NO: 449802 - RNA, 22 nt, Human
ugggauuacaggcgugagccac

SEQ ID NO: 449803 - RNA, 23 nt, Human
ugggauuacaggcgugagccacc

SEQ ID NO: 449804 - RNA, 24 nt, Human
ugggauuacaggcgugagccaccg

SEQ ID NO: 449805 - RNA, 24 nt, Human
uuaguagagacgagguuucaccau

SEQ ID NO: 449806 - RNA, 19 nt, Human
uucaagcaauucuccagcc

SEQ ID NO: 449807 - RNA, 24 nt, Human
uuucaccauguuggccaggcuggu

SEQ ID NO: 449808 - RNA, 24 nt, Human
uuuuuaguagagacgagguuucac

SEQ ID NO: 449809 - RNA, 20 nt, Human
uuuuuguauuuuuaguagag

SEQ ID NO: 449810 - RNA, 20 nt, Human
agcugggccuccugcugcca

SEQ ID NO: 449811 - RNA, 20 nt, Human
aggagggaaauacagacaga

SEQ ID NO: 449812 - RNA, 19 nt, Human
caggcuggggcaucugcuu

SEQ ID NO: 449813 - RNA, 19 nt, Human
ccccaguaggagugugucu

SEQ ID NO: 449814 - RNA, 22 nt, Human
cgaggcugaccuggccacgcau

SEQ ID NO: 449815 - RNA, 20 nt, Human
cggcugccgcugucgguccg

SEQ ID NO: 449816 - RNA, 23 nt, Human
cugccagggcuaccuggccugag

SEQ ID NO: 449817 - RNA, 20 nt, Human
cugggccuccugcugccagg

SEQ ID NO: 449818 - RNA, 21 nt, Human
gaaaggggaguggggaggagg

SEQ ID NO: 449819 - RNA, 20 nt, Human
gaggaggagagguauaugcc

SEQ ID NO: 449820 - RNA, 18 nt, Human
gccaaaggcagagagaga

SEQ ID NO: 449821 - RNA, 19 nt, Human
ggagaaacagccgggggcu

SEQ ID NO: 449822 - RNA, 20 nt, Human
ggaguggggaggaggagagg

SEQ ID NO: 449823 - RNA, 24 nt, Human
ggcagagagagagagagagagagc

SEQ ID NO: 449824 - RNA, 23 nt, Human
ggggagaaacagccgggggcuuc

SEQ ID NO: 449825 - RNA, 27 nt, Human
gucgguccgcuucucugcauugggaau

SEQ ID NO: 449826 - RNA, 24 nt, Human
uaaugcacauacaggguuugcaca

SEQ ID NO: 449827 - RNA, 21 nt, Human
ucacccggcugccgcugucgg

SEQ ID NO: 449828 - RNA, 18 nt, Human
ucagacaucacccggcug

SEQ ID NO: 449829 - RNA, 19 nt, Human
ugaccuggccacgcaucca

SEQ ID NO: 449830 - RNA, 23 nt, Human
ugaccuggccacgcauccagcag

SEQ ID NO: 449831 - RNA, 26 nt, Human
uggagauuuuuaaugcacauacaggg

SEQ ID NO: 449832 - RNA, 19 nt, Human
uucaucagacaucacccgg

SEQ ID NO: 449833 - RNA, 24 nt, Human
aaacagaugaaaaacaauucccac

SEQ ID NO: 449834 - RNA, 22 nt, Human
aacuuuuuacaagaguuggaga

SEQ ID NO: 449835 - RNA, 19 nt, Human
aaguccuccaguuuaacuc

SEQ ID NO: 449836 - RNA, 21 nt, Human
aauauacaccuugacacaccu

SEQ ID NO: 449837 - RNA, 21 nt, Human
acaaagacccauagaaagucc

SEQ ID NO: 449838 - RNA, 19 nt, Human
acaaagaugaaagggcaga

SEQ ID NO: 449839 - RNA, 20 nt, Human
acagcacaaagggcaucgcc

SEQ ID NO: 449840 - RNA, 20 nt, Human
accuugacacaccuucacac

SEQ ID NO: 449841 - RNA, 21 nt, Human
acgcugcuucagaggaacagg

SEQ ID NO: 449842 - RNA, 21 nt, Human
agaaucagcaacaaugcccuc

SEQ ID NO: 449843 - RNA, 23 nt, Human
agacaucacagguugucauugcu

SEQ ID NO: 449844 - RNA, 18 nt, Human
agagaugggguuucauca

SEQ ID NO: 449845 - RNA, 22 nt, Human
agagugccuuugaggauggucc

SEQ ID NO: 449846 - RNA, 21 nt, Human
agcagagcagcagucccaggc

SEQ ID NO: 449847 - RNA, 19 nt, Human
aggcagagcccucacccgg

SEQ ID NO: 449848 - RNA, 18 nt, Human
aggccuccagucauacag

SEQ ID NO: 449849 - RNA, 21 nt, Human
aggccuuugcacugagaauga

SEQ ID NO: 449850 - RNA, 19 nt, Human
augaaaaacaauucccaca

SEQ ID NO: 449851 - RNA, 20 nt, Human
augaaaaacaauucccacag

SEQ ID NO: 449852 - RNA, 21 nt, Human
augaaaaacaauucccacaga

SEQ ID NO: 449853 - RNA, 19 nt, Human
augggguuucaucaaguug

SEQ ID NO: 449854 - RNA, 24 nt, Human
augggguuucaucaaguuggccag

SEQ ID NO: 449855 - RNA, 20 nt, Human
auuccgccacuuuuauugag

SEQ ID NO: 449856 - RNA, 27 nt, Human
caaagcacugggacaaugcuggaugug

SEQ ID NO: 449857 - RNA, 20 nt, Human
caaagccagggccuuccccc

SEQ ID NO: 449858 - RNA, 23 nt, Human
caaaguccuccaguuuaacuccc

SEQ ID NO: 449859 - RNA, 26 nt, Human
caacacccuggaaacauuauccaggg

SEQ ID NO: 449860 - RNA, 21 nt, Human
caacucaaagcacugggacaa

SEQ ID NO: 449861 - RNA, 18 nt, Human
caaguuggccaggcuggu

SEQ ID NO: 449862 - RNA, 21 nt, Human
caaguuggccaggcugguuuc

SEQ ID NO: 449863 - RNA, 22 nt, Human
caaguuggccaggcugguuucg

SEQ ID NO: 449864 - RNA, 18 nt, Human
cacacagcagccagcaga

SEQ ID NO: 449865 - RNA, 23 nt, Human
cacccacaacugugaccugagac

SEQ ID NO: 449866 - RNA, 24 nt, Human
cacccacaacugugaccugagacg

SEQ ID NO: 449867 - RNA, 27 nt, Human
cagagcagcagucccaggccacauccc

SEQ ID NO: 449868 - RNA, 19 nt, Human
cagagucuccaaacaggcc

SEQ ID NO: 449869 - RNA, 18 nt, Human
cagccagcagagcagcag

SEQ ID NO: 449870 - RNA, 18 nt, Human
cagcucugccagccuccu

SEQ ID NO: 449871 - RNA, 20 nt, Human
caggaaaagcauccacacag

SEQ ID NO: 449872 - RNA, 22 nt, Human
caggaaaagcauccacacagca

SEQ ID NO: 449873 - RNA, 20 nt, Human
caggccuucccaacacccug

SEQ ID NO: 449874 - RNA, 24 nt, Human
caucaaguuggccaggcugguuuc

SEQ ID NO: 449875 - RNA, 18 nt, Human
caucccaggccgaccuuc

SEQ ID NO: 449876 - RNA, 22 nt, Human
caugcagucugaauacgcuacc

SEQ ID NO: 449877 - RNA, 18 nt, Human
cauugcuagaggcaagaa

SEQ ID NO: 449878 - RNA, 22 nt, Human
ccaaacaggccuuugcacugag

SEQ ID NO: 449879 - RNA, 24 nt, Human
ccacgcggagaggccuccagucau

SEQ ID NO: 449880 - RNA, 19 nt, Human
ccaggacaggcgugaccug

SEQ ID NO: 449881 - RNA, 22 nt, Human
ccauagaaagucccugagugac

SEQ ID NO: 449882 - RNA, 19 nt, Human
cccacaaagacccauagaa

SEQ ID NO: 449883 - RNA, 21 nt, Human
cccacaacugugaccugagac

SEQ ID NO: 449884 - RNA, 18 nt, Human
cccacccccaaguaccca

SEQ ID NO: 449885 - RNA, 18 nt, Human
ccccacccccaaguaccc

SEQ ID NO: 449886 - RNA, 20 nt, Human
ccccagaaaccacucauccc

SEQ ID NO: 449887 - RNA, 24 nt, Human
ccccagaaaccacucaucccugaa

SEQ ID NO: 449888 - RNA, 27 nt, Human
cccccaaguacccacgcggagaggccu

SEQ ID NO: 449889 - RNA, 20 nt, Human
cccccacaaagacccauaga

SEQ ID NO: 449890 - RNA, 18 nt, Human
cccggcacacugucucca

SEQ ID NO: 449891 - RNA, 24 nt, Human
ccuccaguuuaacucccuguugug

SEQ ID NO: 449892 - RNA, 19 nt, Human
cgcugcuucagaggaacag

SEQ ID NO: 449893 - RNA, 19 nt, Human
cgugcaggcuuggggcugg

SEQ ID NO: 449894 - RNA, 19 nt, Human
cucaguccccagcucugcc

SEQ ID NO: 449895 - RNA, 21 nt, Human
cugaccucagaugccccagaa

SEQ ID NO: 449896 - RNA, 23 nt, Human
cugucugcggugggaggcucggg

SEQ ID NO: 449897 - RNA, 24 nt, Human
gaacggguagagaugggguuucau

SEQ ID NO: 449898 - RNA, 25 nt, Human
gaagacaaauuuccuaagaaacuca

SEQ ID NO: 449899 - RNA, 24 nt, Human
gagacgcaggccuucccaacaccc

SEQ ID NO: 449900 - RNA, 23 nt, Human
gagagugccuuugaggauggucc

SEQ ID NO: 449901 - RNA, 21 nt, Human
gauagcuucaaggaguuagca

SEQ ID NO: 449902 - RNA, 30 nt, Human
gcagagucccauucccguccaacucaaagg

SEQ ID NO: 449903 - RNA, 21 nt, Human
gcaucgccuugggcagcucag

SEQ ID NO: 449904 - RNA, 18 nt, Human
gccacacccacaacugug

SEQ ID NO: 449905 - RNA, 21 nt, Human
gccccacccccaaguacccac

SEQ ID NO: 449906 - RNA, 21 nt, Human
gccccagaaaccacucauccc

SEQ ID NO: 449907 - RNA, 19 nt, Human
gccuccucugugcucccca

SEQ ID NO: 449908 - RNA, 20 nt, Human
gcugggcacaacgggggcag

SEQ ID NO: 449909 - RNA, 23 nt, Human
gcugguuucgaacuccugaccuc

SEQ ID NO: 449910 - RNA, 21 nt, Human
gcuuggggcugggggaugccu

SEQ ID NO: 449911 - RNA, 22 nt, Human
gcuuggggcugggggaugccuu

SEQ ID NO: 449912 - RNA, 21 nt, Human
ggacaggcgugaccuguucuc

SEQ ID NO: 449913 - RNA, 18 nt, Human
ggcacacugucuccagga

SEQ ID NO: 449914 - RNA, 21 nt, Human
ggcucgggccggccugggugc

SEQ ID NO: 449915 - RNA, 24 nt, Human
ggcugguuucgaacuccugaccuc

SEQ ID NO: 449916 - RNA, 18 nt, Human
gggaauacaaagccaggg

SEQ ID NO: 449917 - RNA, 18 nt, Human
gggaugccuuggaaagug

SEQ ID NO: 449918 - RNA, 18 nt, Human
gggcagccucucuuacua

SEQ ID NO: 449919 - RNA, 23 nt, Human
gggguucuuaaaauuuaugaagg

SEQ ID NO: 449920 - RNA, 18 nt, Human
gggguuucaucaaguugg

SEQ ID NO: 449921 - RNA, 22 nt, Human
gggguuucaucaaguuggccag

SEQ ID NO: 449922 - RNA, 19 nt, Human
ggguagagaugggguuuca

SEQ ID NO: 449923 - RNA, 22 nt, Human
ggugcgggcagccucucuuacu

SEQ ID NO: 449924 - RNA, 23 nt, Human
ggugguggccugcaccuggggcc

SEQ ID NO: 449925 - RNA, 19 nt, Human
gguuucgaacuccugaccu

SEQ ID NO: 449926 - RNA, 18 nt, Human
gucccaggccacauccca

SEQ ID NO: 449927 - RNA, 19 nt, Human
gugguggccugcaccuggg

SEQ ID NO: 449928 - RNA, 25 nt, Human
uaauaagugggcgauggugcccccu

SEQ ID NO: 449929 - RNA, 20 nt, Human
uagaaacagaugaaaaacaa

SEQ ID NO: 449930 - RNA, 20 nt, Human
uauccugccuuggcugcaga

SEQ ID NO: 449931 - RNA, 22 nt, Human
uccacacagcagccagcagagc

SEQ ID NO: 449932 - RNA, 18 nt, Human
ucccacagagucuccaaa

SEQ ID NO: 449933 - RNA, 21 nt, Human
ucccaggccacaucccaggcc

SEQ ID NO: 449934 - RNA, 21 nt, Human
uccgcaaaacuaaauaauaag

SEQ ID NO: 449935 - RNA, 25 nt, Human
uccucugugcuccccacgccgucug

SEQ ID NO: 449936 - RNA, 21 nt, Human
ucuacagcaaucacgcugcuu

SEQ ID NO: 449937 - RNA, 19 nt, Human
ugaaaaacaauucccacag

SEQ ID NO: 449938 - RNA, 20 nt, Human
ugaaaaacaauucccacaga

SEQ ID NO: 449939 - RNA, 23 nt, Human
ugaaagggcagaacccagugcuu

SEQ ID NO: 449940 - RNA, 23 nt, Human
ugacaauggcgggaacgcuggag

SEQ ID NO: 449941 - RNA, 20 nt, Human
ugaccugagacgcaggccuu

SEQ ID NO: 449942 - RNA, 19 nt, Human
ugagaaugccgagccacga

SEQ ID NO: 449943 - RNA, 21 nt, Human
ugagaggguagguucuguaga

SEQ ID NO: 449944 - RNA, 23 nt, Human
ugagugagaaucagcaacaaugc

SEQ ID NO: 449945 - RNA, 20 nt, Human
ugcaggacgggauugcaaga

SEQ ID NO: 449946 - RNA, 19 nt, Human
ugcagucugaauacgcuac

SEQ ID NO: 449947 - RNA, 18 nt, Human
ugccgagccacgagaaua

SEQ ID NO: 449948 - RNA, 19 nt, Human
ugcggcaggcugccccggu

SEQ ID NO: 449949 - RNA, 21 nt, Human
ugcugggcacaacgggggcag

SEQ ID NO: 449950 - RNA, 24 nt, Human
uggccaggcugguuucgaacuccu

SEQ ID NO: 449951 - RNA, 20 nt, Human
ugggacaaugcuggauguga

SEQ ID NO: 449952 - RNA, 24 nt, Human
uggggccugugcaucugcggcagg

SEQ ID NO: 449953 - RNA, 22 nt, Human
ugggggaugccuuggaaagugc

SEQ ID NO: 449954 - RNA, 24 nt, Human
ugggguuucaucaaguuggccagg

SEQ ID NO: 449955 - RNA, 19 nt, Human
ugggugcgggcagccucuc

SEQ ID NO: 449956 - RNA, 18 nt, Human
uucuguagaacagcgcag

SEQ ID NO: 449957 - RNA, 19 nt, Human
uugaauggcucauuaccaa

SEQ ID NO: 449958 - RNA, 21 nt, Human
uuggggcugggggaugccuug

SEQ ID NO: 449959 - RNA, 21 nt, Human
uuucaucaaguuggccaggcu

SEQ ID NO: 449960 - RNA, 22 nt, Human
aaaaaaaaaaaaaaggagacaa

SEQ ID NO: 449961 - RNA, 22 nt, Human
aaaaaaaaaaggagacaacuga

SEQ ID NO: 449962 - RNA, 21 nt, Human
aaacgucgcaccggcucugcc

SEQ ID NO: 449963 - RNA, 20 nt, Human
aacauggcgagaccccgucu

SEQ ID NO: 449964 - RNA, 21 nt, Human
aacauggcgagaccccgucuc

SEQ ID NO: 449965 - RNA, 21 nt, Human
aaccaggcgcaguggcucaug

SEQ ID NO: 449966 - RNA, 20 nt, Human
aagaaaagaaaagagggcca

SEQ ID NO: 449967 - RNA, 18 nt, Human
aagaaaagagggccagga

SEQ ID NO: 449968 - RNA, 19 nt, Human
aagaacaaagcuggaaagg

SEQ ID NO: 449969 - RNA, 21 nt, Human
aagagacugaaagccugcccu

SEQ ID NO: 449970 - RNA, 22 nt, Human
aagagacugaaagccugcccuc

SEQ ID NO: 449971 - RNA, 23 nt, Human
aagaggggcaggcaaccaggcgc

SEQ ID NO: 449972 - RNA, 19 nt, Human
aagaugcuucugguagcuc

SEQ ID NO: 449973 - RNA, 25 nt, Human
aaggcggguggaucaccugagguca

SEQ ID NO: 449974 - RNA, 24 nt, Human
aauugcuugaacccgggaggcgga

SEQ ID NO: 449975 - RNA, 24 nt, Human
acaccacugcacuucagccugggc

SEQ ID NO: 449976 - RNA, 24 nt, Human
acagagagagacccugucuccaaa

SEQ ID NO: 449977 - RNA, 19 nt, Human
acagagugagaccccgucu

SEQ ID NO: 449978 - RNA, 23 nt, Human
acagagugagaccccgucuggag

SEQ ID NO: 449979 - RNA, 23 nt, Human
acagagugagacuaggucucaaa

SEQ ID NO: 449980 - RNA, 24 nt, Human
acagagugagacuaggucucaaaa

SEQ ID NO: 449981 - RNA, 20 nt, Human
acaggccuauuccuucagga

SEQ ID NO: 449982 - RNA, 23 nt, Human
accaaaaauacaaaaucagccag

SEQ ID NO: 449983 - RNA, 25 nt, Human
acccucuuuugaccccuagaugcug

SEQ ID NO: 449984 - RNA, 30 nt, Human; identical to SEQ ID NO: 170933

SEQ ID NO: 449985 - RNA, 24 nt, Human
acuccagccugggcaacagaguga

SEQ ID NO: 449986 - RNA, 24 nt, Human
acuccagccugggcgacagaguga

SEQ ID NO: 449987 - RNA, 24 nt, Human
acugcacuccagccugggcaacag

SEQ ID NO: 449988 - RNA, 24 nt, Human
acugcacuccagccugggcaacag

SEQ ID NO: 449989 - RNA, 24 nt, Human
acugcacuccagccugggcgacag

SEQ ID NO: 449990 - RNA, 26 nt, Human
acugcacuccagccugggcgacagag

SEQ ID NO: 449991 - RNA, 18 nt, Human
acugcacuucagccuggg

SEQ ID NO: 449992 - RNA, 24 nt, Human
acugcacuucagccugggccacag

SEQ ID NO: 449993 - RNA, 20 nt, Human
acuugcuguguguccuuggc

SEQ ID NO: 449994 - RNA, 18 nt, Human
agacagcagggccggaag

SEQ ID NO: 449995 - RNA, 22 nt, Human
agacagcagggccggaagaaca

SEQ ID NO: 449996 - RNA, 22 nt, Human
agaccacgcuauugcauuccag

SEQ ID NO: 449997 - RNA, 20 nt, Human
agaccuggguggaggcggug

SEQ ID NO: 449998 - RNA, 22 nt, Human
agagacucagaccuuagccccc

SEQ ID NO: 449999 - RNA, 23 nt, Human
agagccccagaggaaaacugggg

SEQ ID NO: 450000 - RNA, 20 nt, Human
agaugcugaaacacugcgcc

SEQ ID NO: 450001 - RNA, 21 nt, Human
agcccagggguuugagaccag

SEQ ID NO: 450002 - RNA, 24 nt, Human
agccuggccaacauggcgagaccc

SEQ ID NO: 450003 - RNA, 22 nt, Human
agccugggcaacagagugagac

SEQ ID NO: 450004 - RNA, 22 nt, Human
agccugggcgacagagugagac

SEQ ID NO: 450005 - RNA, 24 nt, Human
aggaggcugaacagguauaagggu

SEQ ID NO: 450006 - RNA, 21 nt, Human
aggaggcugagguggugggag

SEQ ID NO: 450007 - RNA, 24 nt, Human
aggcaggagaauugcuugaacccg

SEQ ID NO: 450008 - RNA, 19 nt, Human
aggcaggaggauugcuuga

SEQ ID NO: 450009 - RNA, 24 nt, Human
aggcaggaggauugcuugagcuug

SEQ ID NO: 450010 - RNA, 23 nt, Human
aggcaggaggcuugcuugagccc

SEQ ID NO: 450011 - RNA, 24 nt, Human
aggcaggaggcuugcuugagccca

SEQ ID NO: 450012 - RNA, 21 nt, Human
aggccaaggcggguggaucac

SEQ ID NO: 450013 - RNA, 24 nt, Human
aggcgcaguggcucaugccugcaa

SEQ ID NO: 450014 - RNA, 24 nt, Human
aggcggagguugcagugagccaag

SEQ ID NO: 450015 - RNA, 22 nt, Human
aggcggguggaucaccugaggg

SEQ ID NO: 450016 - RNA, 22 nt, Human
aggcggguggaucaccugaggu

SEQ ID NO: 450017 - RNA, 21 nt, Human
aggcugaggcaggagaauugc

SEQ ID NO: 450018 - RNA, 24 nt, Human
aggcugaggcaggagaauugcuug

SEQ ID NO: 450019 - RNA, 27 nt, Human
aggcugagguggugggaggaucgcuug

SEQ ID NO: 450020 - RNA, 18 nt, Human
agggggagagaggauucu

SEQ ID NO: 450021 - RNA, 20 nt, Human
agggguuugagaccagcugg

SEQ ID NO: 450022 - RNA, 24 nt, Human
aggugguagaaguugcagugagcc

SEQ ID NO: 450023 - RNA, 24 nt, Human
agguguggugacucaugccuguag

SEQ ID NO: 450024 - RNA, 21 nt, Human
agucugcagcccuuccugcug

SEQ ID NO: 450025 - RNA, 23 nt, Human
aguggcucaugccugcaauccca

SEQ ID NO: 450026 - RNA, 24 nt, Human
aguuuggggcacaagaaucgcuug

SEQ ID NO: 450027 - RNA, 24 nt, Human
auagcgccacugcacuccagccug

SEQ ID NO: 450028 - RNA, 24 nt, Human
auaugaugguuccagcuacucagg

SEQ ID NO: 450029 - RNA, 24 nt, Human
aucacaccacugcacuucagccug

SEQ ID NO: 450030 - RNA, 22 nt, Human
aucccaacacuuugggaggcca

SEQ ID NO: 450031 - RNA, 22 nt, Human
aucccagcacuuugggaggcca

SEQ ID NO: 450032 - RNA, 19 nt, Human
augccugcaaucccaacac

SEQ ID NO: 450033 - RNA, 20 nt, Human
auugcuugagcuugggaggu

SEQ ID NO: 450034 - RNA, 24 nt, Human
auugugccacugcacuccagccug

SEQ ID NO: 450035 - RNA, 18 nt, Human
caaaaaagggaagagaga

SEQ ID NO: 450036 - RNA, 25 nt, Human
caaaaaagggaagagagacucagac

SEQ ID NO: 450037 - RNA, 20 nt, Human
caaaaauacaaaaucagcca

SEQ ID NO: 450038 - RNA, 23 nt, Human
caaaaauacaaaaucagccaggu

SEQ ID NO: 450039 - RNA, 21 nt, Human
caaaugguaagacccugucuc

SEQ ID NO: 450040 - RNA, 22 nt, Human
caacacuuugggaggccaaggc

SEQ ID NO: 450041 - RNA, 24 nt, Human
caacacuuugggaggccaaggcgg

SEQ ID NO: 450042 - RNA, 24 nt, Human
caaccaggcgcaguggcucaugcc

SEQ ID NO: 450043 - RNA, 24 nt, Human
caaggcggguggaucaccugaggu

SEQ ID NO: 450044 - RNA, 24 nt, Human
cacaccuguaaucccagcacuuug

SEQ ID NO: 450045 - RNA, 19 nt, Human
caccuguaaucccagcacu

SEQ ID NO: 450046 - RNA, 24 nt, Human
caccuguaaucccagcacuuuggg

SEQ ID NO: 450047 - RNA, 20 nt, Human
caccuguggucccagcuacu

SEQ ID NO: 450048 - RNA, 24 nt, Human
caccuguggucccagcuacuuggg

SEQ ID NO: 450049 - RNA, 22 nt, Human
cacuccagccugggcaacagag

SEQ ID NO: 450050 - RNA, 24 nt, Human
cacuccagccugggcaacagagug

SEQ ID NO: 450051 - RNA, 22 nt, Human
cacuccagccugggcgacagag

SEQ ID NO: 450052 - RNA, 22 nt, Human
cacuccagccugggcgacagag

SEQ ID NO: 450053 - RNA, 24 nt, Human
cacuccagccugggcgacagagug

SEQ ID NO: 450054 - RNA, 18 nt, Human
cacugcacuccagccugg

SEQ ID NO: 450055 - RNA, 19 nt, Human
cacugcacuccagccuggg

SEQ ID NO: 450056 - RNA, 19 nt, Human
cacugcacuccagccuggg

SEQ ID NO: 450057 - RNA, 20 nt, Human
cacugcacuccagccugggc

SEQ ID NO: 450058 - RNA, 21 nt, Human
cacugcacuccagccugggca

SEQ ID NO: 450059 - RNA, 23 nt, Human
cacugcacuccagccugggcaac

SEQ ID NO: 450060 - RNA, 24 nt, Human
cacugcacuccagccugggcaaca

SEQ ID NO: 450061 - RNA, 22 nt, Human
cacugcacuccagccugggcga

SEQ ID NO: 450062 - RNA, 23 nt, Human
cacugcacuccagccugggcgac

SEQ ID NO: 450063 - RNA, 24 nt, Human
cacugcacuccagccugggcgaca

SEQ ID NO: 450064 - RNA, 18 nt, Human
cacugcacuucagccugg

SEQ ID NO: 450065 - RNA, 19 nt, Human
cacugcacuucagccuggg

SEQ ID NO: 450066 - RNA, 22 nt, Human
cacugcacuucagccugggcca

SEQ ID NO: 450067 - RNA, 24 nt, Human
cacugcacuucagccugggccaca

SEQ ID NO: 450068 - RNA, 24 nt, Human
cacugcgccaacuucccucgggcc

SEQ ID NO: 450069 - RNA, 21 nt, Human
cagaacacaccaugggacagc

SEQ ID NO: 450070 - RNA, 21 nt, Human
cagagagagacccugucucca

SEQ ID NO: 450071 - RNA, 24 nt, Human
cagcacuuugggaggccaaggcag

SEQ ID NO: 450072 - RNA, 24 nt, Human
cagcacuuugggaggccaaggcag

SEQ ID NO: 450073 - RNA, 24 nt, Human
cagcaggagggccccuguaguccc

SEQ ID NO: 450074 - RNA, 22 nt, Human
cagcaggugucucaagaagccc

SEQ ID NO: 450075 - RNA, 24 nt, Human
cagcuacucaggaggcugaggugg

SEQ ID NO: 450076 - RNA, 24 nt, Human
cagcuacuuaggaggcugaggcag

SEQ ID NO: 450077 - RNA, 18 nt, Human
caggagagggagguggug

SEQ ID NO: 450078 - RNA, 21 nt, Human
caggaggagaagggaggugaa

SEQ ID NO: 450079 - RNA, 25 nt, Human
cauccugugagaccuggguggaggc

SEQ ID NO: 450080 - RNA, 20 nt, Human
caugccugcaaucccaacac

SEQ ID NO: 450081 - RNA, 20 nt, Human
ccaagacccucuuuugaccc

SEQ ID NO: 450082 - RNA, 20 nt, Human
ccacugcacuccagccuggg

SEQ ID NO: 450083 - RNA, 20 nt, Human
ccacugcacuccagccuggg

SEQ ID NO: 450084 - RNA, 20 nt, Human
ccacugcacuccagccuggg

SEQ ID NO: 450085 - RNA, 20 nt, Human
ccacugcacuccagccuggg

SEQ ID NO: 450086 - RNA, 21 nt, Human
ccacugcacuccagccugggc

SEQ ID NO: 450087 - RNA, 21 nt, Human
ccacugcacuccagccugggc

SEQ ID NO: 450088 - RNA, 21 nt, Human
ccacugcacuccagccugggc

SEQ ID NO: 450089 - RNA, 23 nt, Human
ccacugcacuccagccugggcaa

SEQ ID NO: 450090 - RNA, 24 nt, Human
ccacugcacuccagccugggcaac

SEQ ID NO: 450091 - RNA, 24 nt, Human
ccacugcacuccagccugggcgac

SEQ ID NO: 450092 - RNA, 20 nt, Human
ccacugcacuucagccuggg

SEQ ID NO: 450093 - RNA, 21 nt, Human
ccacugcacuucagccugggc

SEQ ID NO: 450094 - RNA, 24 nt, Human
ccacugcacuucagccugggccac

SEQ ID NO: 450095 - RNA, 23 nt, Human
ccaggacagcacguggaguacag

SEQ ID NO: 450096 - RNA, 18 nt, Human
cccagggguuugagacca

SEQ ID NO: 450097 - RNA, 19 nt, Human
ccccagaggaaaacugggg

SEQ ID NO: 450098 - RNA, 24 nt, Human
ccccuguagucccagcuacuuagg

SEQ ID NO: 450099 - RNA, 21 nt, Human
cccgcggcuggaacugcuccg

SEQ ID NO: 450100 - RNA, 21 nt, Human
ccggaagaacaaagcuggaaa

SEQ ID NO: 450101 - RNA, 19 nt, Human
ccggggaggcagacagcag

SEQ ID NO: 450102 - RNA, 19 nt, Human
ccuaggugguagaaguugc

SEQ ID NO: 450103 - RNA, 21 nt, Human
ccucaagcugagaggggugga

SEQ ID NO: 450104 - RNA, 20 nt, Human
ccuccgcaguuggaggcggg

SEQ ID NO: 450105 - RNA, 22 nt, Human
ccuccgcaguuggaggcgggga

SEQ ID NO: 450106 - RNA, 23 nt, Human
ccucgacccgacuaccucccuug

SEQ ID NO: 450107 - RNA, 20 nt, Human
ccugcaaucccaacacuuug

SEQ ID NO: 450108 - RNA, 23 nt, Human
ccuggccaacauggcgagacccc

SEQ ID NO: 450109 - RNA, 24 nt, Human
ccuggccaacauggcgagaccccg

SEQ ID NO: 450110 - RNA, 21 nt, Human
ccuguagucccagcuacucgg

SEQ ID NO: 450111 - RNA, 21 nt, Human
ccuguagucccagcuacuuag

SEQ ID NO: 450112 - RNA, 18 nt, Human
ccugugagaccugggugg

SEQ ID NO: 450113 - RNA, 21 nt, Human
ccuguggucccagcuacuugg

SEQ ID NO: 450114 - RNA, 24 nt, Human
cgccacugcacuccagccugggca

SEQ ID NO: 450115 - RNA, 24 nt, Human
cgggaggcggagguugcagugagc

SEQ ID NO: 450116 - RNA, 27 nt, Human
cggguggaucaccugaggucaguguga

SEQ ID NO: 450117 - RNA, 19 nt, Human
cuaugcuucauaacguaca

SEQ ID NO: 450118 - RNA, 20 nt, Human
cucaaaaagaaaagaaaaga

SEQ ID NO: 450119 - RNA, 22 nt, Human
cucacaccuguaaucccagcac

SEQ ID NO: 450120 - RNA, 24 nt, Human
cucacaccuguaaucccagcacuu

SEQ ID NO: 450121 - RNA, 22 nt, Human
cucagggccgagauggggagga

SEQ ID NO: 450122 - RNA, 24 nt, Human
cucaugccugcaaucccaacacuu

SEQ ID NO: 450123 - RNA, 24 nt, Human
cucaugccuguagucccagcuacu

SEQ ID NO: 450124 - RNA, 21 nt, Human
cugaaagccugcccucagugg

SEQ ID NO: 450125 - RNA, 23 nt, Human
cuggugcagccacuaacuugcug

SEQ ID NO: 450126 - RNA, 20 nt, Human
cuugcuguguguccuuggcu

SEQ ID NO: 450127 - RNA, 23 nt, Human
cuugcuguguguccuuggcugca

SEQ ID NO: 450128 - RNA, 22 nt, Human
cuugcuugagcccagggguuug

SEQ ID NO: 450129 - RNA, 20 nt, Human
gaagcccauggaggagugag

SEQ ID NO: 450130 - RNA, 18 nt, Human
gacagcacguggaguaca

SEQ ID NO: 450131 - RNA, 21 nt, Human
gaccccgucuccaccaaaaau

SEQ ID NO: 450132 - RNA, 21 nt, Human
gacucaugccuguagucccag

SEQ ID NO: 450133 - RNA, 23 nt, Human
gagaauugcuugaacccgggagg

SEQ ID NO: 450134 - RNA, 21 nt, Human
gagagacucagaccuuagccc

SEQ ID NO: 450135 - RNA, 23 nt, Human
gagauagcgccacugcacuccag

SEQ ID NO: 450136 - RNA, 23 nt, Human
gagauugugccacugcacuccag

SEQ ID NO: 450137 - RNA, 20 nt, Human
gaggcaggaggauugcuuga

SEQ ID NO: 450138 - RNA, 21 nt, Human
gagggacugucugaggcagug

SEQ ID NO: 450139 - RNA, 22 nt, Human
gaggggcagaacacaccauggg

SEQ ID NO: 450140 - RNA, 18 nt, Human
gagguugcagugagccaa

SEQ ID NO: 450141 - RNA, 19 nt, Human
gagguugcagugagccaag

SEQ ID NO: 450142 - RNA, 24 nt, Human
gauaaggccgggugugguggcuca

SEQ ID NO: 450143 - RNA, 19 nt, Human
gaucaccugaggucagugu

SEQ ID NO: 450144 - RNA, 21 nt, Human
gaucaccugaggucaguguga

SEQ ID NO: 450145 - RNA, 18 nt, Human
gcaccggcucugcccagc

SEQ ID NO: 450146 - RNA, 24 nt, Human
gcacuccagccugggcaacagagu

SEQ ID NO: 450147 - RNA, 23 nt, Human
gcacuccagccugggcgacagag

SEQ ID NO: 450148 - RNA, 24 nt, Human
gccaacauggcgagaccccgucuc

SEQ ID NO: 450149 - RNA, 23 nt, Human
gccacagagagagacccugucuc

SEQ ID NO: 450150 - RNA, 22 nt, Human
gccacugcacuccagccugggc

SEQ ID NO: 450151 - RNA, 22 nt, Human
gccacugcacuccagccugggc

SEQ ID NO: 450152 - RNA, 24 nt, Human
gccacugcacuccagccugggcaa

SEQ ID NO: 450153 - RNA, 24 nt, Human
gccacugcacuccagccugggcga

SEQ ID NO: 450154 - RNA, 20 nt, Human
gcuguaaucacaccacugca

SEQ ID NO: 450155 - RNA, 18 nt, Human
gcuuaaugccuauccuug

SEQ ID NO: 450156 - RNA, 23 nt, Human
ggaagaacaaagcuggaaaggga

SEQ ID NO: 450157 - RNA, 20 nt, Human
ggagaagggaggugaaggcc

SEQ ID NO: 450158 - RNA, 19 nt, Human
ggagauaaggccgggugug

SEQ ID NO: 450159 - RNA, 22 nt, Human
ggagauaaggccggguguggug

SEQ ID NO: 450160 - RNA, 20 nt, Human
ggaggcugaggcaggagaau

SEQ ID NO: 450161 - RNA, 22 nt, Human
ggagguccaggcuacaugagcu

SEQ ID NO: 450162 - RNA, 18 nt, Human
ggagguugcagugagcca

SEQ ID NO: 450163 - RNA, 20 nt, Human
ggagguugcagugagccaag

SEQ ID NO: 450164 - RNA, 20 nt, Human
ggcaggagagggagguggug

SEQ ID NO: 450165 - RNA, 22 nt, Human
ggcaguggcaccugggcagagc

SEQ ID NO: 450166 - RNA, 22 nt, Human
gggacaggugggaggggcagaa

SEQ ID NO: 450167 - RNA, 20 nt, Human
gggagcagcaggagggcccc

SEQ ID NO: 450168 - RNA, 19 nt, Human
gggaggcagaggcaggagg

SEQ ID NO: 450169 - RNA, 19 nt, Human
gggguggaaaggcaaggga

SEQ ID NO: 450170 - RNA, 20 nt, Human
gggguuugggcaguggcacc

SEQ ID NO: 450171 - RNA, 22 nt, Human
ggguggaggcggugcucccaga

SEQ ID NO: 450172 - RNA, 18 nt, Human
gguagaaguugcagugag

SEQ ID NO: 450173 - RNA, 20 nt, Human
gguagaaguugcagugagcc

SEQ ID NO: 450174 - RNA, 23 nt, Human
gguagaaguugcagugagccgag

SEQ ID NO: 450175 - RNA, 25 nt, Human
gguagacagaggcacaaaaaaggga

SEQ ID NO: 450176 - RNA, 24 nt, Human
ggugacucaugccuguagucccag

SEQ ID NO: 450177 - RNA, 24 nt, Human
gguggcucacaccuguaaucccag

SEQ ID NO: 450178 - RNA, 22 nt, Human
ggugggaggaucgcuugagucc

SEQ ID NO: 450179 - RNA, 23 nt, Human
ggugugguggcucacaccuguaa

SEQ ID NO: 450180 - RNA, 23 nt, Human
guggcucacaccuguaaucccag

SEQ ID NO: 450181 - RNA, 18 nt, Human
gugugguggcucacaccu

SEQ ID NO: 450182 - RNA, 24 nt, Human
guugcagugagccgagauagcgcc

SEQ ID NO: 450183 - RNA, 20 nt, Human
guuugagaccagcuggggca

SEQ ID NO: 450184 - RNA, 26 nt, Human
uaacguacacagaaguggguuuucaa

SEQ ID NO: 450185 - RNA, 22 nt, Human
uaaggccgggugugguggcuca

SEQ ID NO: 450186 - RNA, 24 nt, Human
uaaggccgggugugguggcucaca

SEQ ID NO: 450187 - RNA, 19 nt, Human
uacucggaaguuuggggca

SEQ ID NO: 450188 - RNA, 18 nt, Human
uacucggaaguuuggggg

SEQ ID NO: 450189 - RNA, 24 nt, Human
uagacagaggcacaaaaaagggaa

SEQ ID NO: 450190 - RNA, 24 nt, Human
uagcucucaggaccuuccaauucu

SEQ ID NO: 450191 - RNA, 18 nt, Human
uaggaccucaagcugaga

SEQ ID NO: 450192 - RNA, 22 nt, Human
uauuccuucaggaccagccuca

SEQ ID NO: 450193 - RNA, 25 nt, Human
uauugcauuccagcuuagccaggcg

SEQ ID NO: 450194 - RNA, 21 nt, Human
ucagggccgagauggggagga

SEQ ID NO: 450195 - RNA, 20 nt, Human
ucaguggccagggggcuguc

SEQ ID NO: 450196 - RNA, 20 nt, Human
uccaagagacugaaagccug

SEQ ID NO: 450197 - RNA, 21 nt, Human
uccaagagacugaaagccugc

SEQ ID NO: 450198 - RNA, 22 nt, Human
uccaagagacugaaagccugcc

SEQ ID NO: 450199 - RNA, 19 nt, Human
uccaagggagggaagagcc

SEQ ID NO: 450200 - RNA, 20 nt, Human
uccaagggagggaagagccc

SEQ ID NO: 450201 - RNA, 23 nt, Human
uccagccugggcaacagagugag

SEQ ID NO: 450202 - RNA, 24 nt, Human
uccagccugggcaacagagugaga

SEQ ID NO: 450203 - RNA, 23 nt, Human
uccagccugggcgacagagugag

SEQ ID NO: 450204 - RNA, 24 nt, Human
uccagccugggcgacagagugaga

SEQ ID NO: 450205 - RNA, 25 nt, Human
ucccagcuacucggaaguuuggggg

SEQ ID NO: 450206 - RNA, 23 nt, Human
ucccucgacccgacuaccucccu

SEQ ID NO: 450207 - RNA, 21 nt, Human
uccgcaguuggaggcggggac

SEQ ID NO: 450208 - RNA, 25 nt, Human
ucgcaccggcucugcccagcggcgc

SEQ ID NO: 450209 - RNA, 19 nt, Human
ucucaagaagcccauggag

SEQ ID NO: 450210 - RNA, 21 nt, Human
ucucaggaccuuccaauucug

SEQ ID NO: 450211 - RNA, 20 nt, Human
ucuccaaaaaaaaaaaaaaa

SEQ ID NO: 450212 - RNA, 24 nt, Human
ucugcagcccuuccugcuggagag

SEQ ID NO: 450213 - RNA, 21 nt, Human
ugagaccagccuggccaacau

SEQ ID NO: 450214 - RNA, 23 nt, Human
ugagaccagccuggccaacaugg

SEQ ID NO: 450215 - RNA, 24 nt, Human
ugagaccuggguggaggcggugcu

SEQ ID NO: 450216 - RNA, 19 nt, Human
ugagagggguggaaaggca

SEQ ID NO: 450217 - RNA, 23 nt, Human
ugagcccagggguuugagaccag

SEQ ID NO: 450218 - RNA, 22 nt, Human
ugagccgagauagcgccacugc

SEQ ID NO: 450219 - RNA, 24 nt, Human
ugaggcaggagaauugcuugaacc

SEQ ID NO: 450220 - RNA, 25 nt, Human
ugaggcaggagaauugcuugaaccc

SEQ ID NO: 450221 - RNA, 26 nt, Human
ugaggcagugaguacuauuucuggug

SEQ ID NO: 450222 - RNA, 23 nt, Human
ugagggugggguagacagaggca

SEQ ID NO: 450223 - RNA, 22 nt, Human
ugaggucagugugagaccagcc

SEQ ID NO: 450224 - RNA, 23 nt, Human
ugaguccagcaagcagaggucgg

SEQ ID NO: 450225 - RNA, 19 nt, Human
ugauucagaaccagaccuu

SEQ ID NO: 450226 - RNA, 19 nt, Human
ugauucucauggaggacac

SEQ ID NO: 450227 - RNA, 21 nt, Human
ugcccaagacccucuuuugac

SEQ ID NO: 450228 - RNA, 23 nt, Human
ugccugcaaucccaacacuuugg

SEQ ID NO: 450229 - RNA, 24 nt, Human
ugccugcaaucccaacacuuuggg

SEQ ID NO: 450230 - RNA, 23 nt, Human
ugccuguagucccagcuacucgg

SEQ ID NO: 450231 - RNA, 24 nt, Human
ugcugcccaccuguggucccagcu

SEQ ID NO: 450232 - RNA, 20 nt, Human
ugcuggagagagggucugaa

SEQ ID NO: 450233 - RNA, 22 nt, Human
ugcuggagagagggucugaagc

SEQ ID NO: 450234 - RNA, 24 nt, Human
uggagacagaguagacugugggag

SEQ ID NO: 450235 - RNA, 24 nt, Human
uggagagagggucugaagcucagg

SEQ ID NO: 450236 - RNA, 21 nt, Human
uggagggagcagcaggagggc

SEQ ID NO: 450237 - RNA, 18 nt, Human
uggaucaccugaggucag

SEQ ID NO: 450238 - RNA, 19 nt, Human
uggaucaccugaggucagu

SEQ ID NO: 450239 - RNA, 27 nt, Human
uggaucaccugaggucagugugagacc

SEQ ID NO: 450240 - RNA, 22 nt, Human
uggcaggagagggagguggugg

SEQ ID NO: 450241 - RNA, 26 nt, Human
uggcaggagagggagguggugggcca

SEQ ID NO: 450242 - RNA, 21 nt, Human
uggcucacaccuguaauccca

SEQ ID NO: 450243 - RNA, 22 nt, Human
uggcucacaccuguaaucccag

SEQ ID NO: 450244 - RNA, 24 nt, Human
uggcucacaccuguaaucccagca

SEQ ID NO: 450245 - RNA, 24 nt, Human
uggcucaugccugcaaucccaaca

SEQ ID NO: 450246 - RNA, 19 nt, Human
ugggaggcagaggcaggag

SEQ ID NO: 450247 - RNA, 22 nt, Human
ugggaggcagaggcaggaggau

SEQ ID NO: 450248 - RNA, 24 nt, Human
ugggaggcagaggcaggaggauug

SEQ ID NO: 450249 - RNA, 28 nt, Human
ugggaggcagaggcaggaggauugcuug

SEQ ID NO: 450250 - RNA, 24 nt, Human
ugggaggccaaggcggguggauca

SEQ ID NO: 450251 - RNA, 23 nt, Human
ugggagggacugucugaggcagu

SEQ ID NO: 450252 - RNA, 21 nt, Human
ugggaggggcagaacacacca

SEQ ID NO: 450253 - RNA, 21 nt, Human
ugggaggggcagaacacacca

SEQ ID NO: 450254 - RNA, 23 nt, Human
ugggaggggcagaacacaccaug

SEQ ID NO: 450255 - RNA, 21 nt, Human
ugggcaguggcaccugggcca

SEQ ID NO: 450256 - RNA, 18 nt, Human
uggggcccagggguuugg

SEQ ID NO: 450257 - RNA, 22 nt, Human
ugggggaggcaugugcccaaga

SEQ ID NO: 450258 - RNA, 21 nt, Human
ugggucugcccucgggugggg

SEQ ID NO: 450259 - RNA, 24 nt, Human
uggugacucaugccuguaguccca

SEQ ID NO: 450260 - RNA, 24 nt, Human
ugguggcucacaccuguaauccca

SEQ ID NO: 450261 - RNA, 21 nt, Human
uguaaucacaccacugcacuu

SEQ ID NO: 450262 - RNA, 23 nt, Human
uguagucccagcuacucggaagu

SEQ ID NO: 450263 - RNA, 20 nt, Human
ugucugaggcagugaguacu

SEQ ID NO: 450264 - RNA, 20 nt, Human
ugugggagggacugucugag

SEQ ID NO: 450265 - RNA, 23 nt, Human
uguggugcugcccaccugugguc

SEQ ID NO: 450266 - RNA, 20 nt, Human
uuagccccccagauuaggcu

SEQ ID NO: 450267 - RNA, 18 nt, Human
uucauaugaaaacugaag

SEQ ID NO: 450268 - RNA, 19 nt, Human
uucuuggcaugggaccugg

SEQ ID NO: 450269 - RNA, 24 nt, Human
uugaacccgggaggcggagguugc

SEQ ID NO: 450270 - RNA, 20 nt, Human
uugcagugagccaagaccac

SEQ ID NO: 450271 - RNA, 19 nt, Human
uugcagugagccgagauag

SEQ ID NO: 450272 - RNA, 22 nt, Human
uugcagugagccgagauagcgc

SEQ ID NO: 450273 - RNA, 24 nt, Human
uugcuugaacccgggaggcggagg

SEQ ID NO: 450274 - RNA, 24 nt, Human
uugcuugagcuugggagguccagg

SEQ ID NO: 450275 - RNA, 21 nt, Human
uugggaggcagaggcaggagg

SEQ ID NO: 450276 - RNA, 23 nt, Human
uugugccacugcacuccagccug

SEQ ID NO: 450277 - RNA, 18 nt, Human
uuuaauuuucuaugcuuc

SEQ ID NO: 450278 - RNA, 21 nt, Human
auacuguaauccuccaguuac

SEQ ID NO: 450279 - RNA, 20 nt, Human
cagcacuguagaaauaaaau

SEQ ID NO: 450280 - RNA, 24 nt, Human
cauacuguaauccuccaguuacau

SEQ ID NO: 450281 - RNA, 21 nt, Human
cuccacaaacagaagugcccu

SEQ ID NO: 450282 - RNA, 24 nt, Human
gcacuguagaaauaaaaucagagg

SEQ ID NO: 450283 - RNA, 21 nt, Human
uaaaaucagagguaagcauac

SEQ ID NO: 450284 - RNA, 18 nt, Human
ugacaauguggcaggcuu

SEQ ID NO: 450285 - RNA, 20 nt, Human
uguagaaauaaaaucagagg

SEQ ID NO: 450286 - RNA, 19 nt, Human
uuacuccacaaacagaagu

SEQ ID NO: 450287 - RNA, 25 nt, Human
uuauagcagcacuguagaaauaaaa

SEQ ID NO: 450288 - RNA, 20 nt, Human
uugacaauguggcaggcuuu

SEQ ID NO: 450289 - RNA, 22 nt, Human
uuuauuaacuucuaagccauac

SEQ ID NO: 450290 - RNA, 20 nt, Human
uuuuuauuaacuucuaagcc

SEQ ID NO: 450291 - RNA, 24 nt, Human
uccucuuuaaccugaguuuugucg

SEQ ID NO: 450292 - RNA, 24 nt, Human
ucgucaggaugcuguauuuugggg

SEQ ID NO: 450293 - RNA, 21 nt, Human
aaaaacuggggaaaauuucaa

SEQ ID NO: 450294 - RNA, 22 nt, Human
aaaccccaucucuacuaaaaaa

SEQ ID NO: 450295 - RNA, 23 nt, Human
aaagagacaggacggucgauugg

SEQ ID NO: 450296 - RNA, 21 nt, Human
aaaugucuucuggggaggccc

SEQ ID NO: 450297 - RNA, 24 nt, Human
aaccugggcgacagagcgagacuc

SEQ ID NO: 450298 - RNA, 19 nt, Human
aacguggugaaaccccauc

SEQ ID NO: 450299 - RNA, 20 nt, Human
aacguggugaaaccccaucu

SEQ ID NO: 450300 - RNA, 21 nt, Human
aacguggugaaaccccaucuc

SEQ ID NO: 450301 - RNA, 20 nt, Human
aacuuagccaggcgcagugg

SEQ ID NO: 450302 - RNA, 22 nt, Human
aagacaaacauugcauguucuu

SEQ ID NO: 450303 - RNA, 20 nt, Human
aaggcagguggaucacgagg

SEQ ID NO: 450304 - RNA, 21 nt, Human
aauauggugaaaccccugucu

SEQ ID NO: 450305 - RNA, 24 nt, Human
aaucguccucccaggccaggcucc

SEQ ID NO: 450306 - RNA, 22 nt, Human
acaaagaaagaaugaauaagac

SEQ ID NO: 450307 - RNA, 23 nt, Human
acacacacacacacacacacaca

SEQ ID NO: 450308 - RNA, 18 nt, Human
acaccacugcacuccagc

SEQ ID NO: 450309 - RNA, 20 nt, Human
acaccacugcacuccagccu

SEQ ID NO: 450310 - RNA, 18 nt, Human
acagaaagacaaacauug

SEQ ID NO: 450311 - RNA, 24 nt, Human
acagagcgagacuccaucucaaaa

SEQ ID NO: 450312 - RNA, 22 nt, Human
accacacacacacacacacaca

SEQ ID NO: 450313 - RNA, 24 nt, Human
accacacacacacacacacacaca

SEQ ID NO: 450314 - RNA, 19 nt, Human
accacugcacuccagccug

SEQ ID NO: 450315 - RNA, 18 nt, Human
accccaucucuacuaaaa

SEQ ID NO: 450316 - RNA, 22 nt, Human
acccugaugaccccagcugcca

SEQ ID NO: 450317 - RNA, 23 nt, Human
accugggcgacagagcgagacuc

SEQ ID NO: 450318 - RNA, 21 nt, Human
acgugugcagagcagaaaacc

SEQ ID NO: 450319 - RNA, 20 nt, Human
acucauggagauaagagugg

SEQ ID NO: 450320 - RNA, 18 nt, Human
acugcacuccaaccuggg

SEQ ID NO: 450321 - RNA, 24 nt, Human
acugcacuccaaccugggcgacag

SEQ ID NO: 450322 - RNA, 18 nt, Human
acugcacuccagccuggg

SEQ ID NO: 450323 - RNA, 23 nt, Human
acugcacuccagccugggugaca

SEQ ID NO: 450324 - RNA, 24 nt, Human
acuuugggaggucaaggcagguua

SEQ ID NO: 450325 - RNA, 20 nt, Human
agaaccaaaaccccacucua

SEQ ID NO: 450326 - RNA, 22 nt, Human
agaaucguuggaacccaggagg

SEQ ID NO: 450327 - RNA, 21 nt, Human
agacaaacauugcauguucuu

SEQ ID NO: 450328 - RNA, 19 nt, Human
agaugccucacaaguucag

SEQ ID NO: 450329 - RNA, 20 nt, Human
agcacuuugggaggucaagg

SEQ ID NO: 450330 - RNA, 20 nt, Human
agccggguauaguggugggc

SEQ ID NO: 450331 - RNA, 19 nt, Human
agccuggccaauaugguga

SEQ ID NO: 450332 - RNA, 22 nt, Human
agccuggccaauauggugaaac

SEQ ID NO: 450333 - RNA, 24 nt, Human
agccuggccaauauggugaaaccc

SEQ ID NO: 450334 - RNA, 26 nt, Human
aggaggucaggagaucgagaccaucc

SEQ ID NO: 450335 - RNA, 23 nt, Human
aggcaggagaaucguuggaaccc

SEQ ID NO: 450336 - RNA, 24 nt, Human
aggcaggagaauggcgugaacccg

SEQ ID NO: 450337 - RNA, 20 nt, Human
aggcaggcgcaucaggaggu

SEQ ID NO: 450338 - RNA, 24 nt, Human
aggcaggcgcaucaggaggucagg

SEQ ID NO: 450339 - RNA, 18 nt, Human
aggcagguggaucacgag

SEQ ID NO: 450340 - RNA, 24 nt, Human
aggcagguggaucacgaggucagg

SEQ ID NO: 450341 - RNA, 24 nt, Human
aggcgcaguggcucacaccuauaa

SEQ ID NO: 450342 - RNA, 22 nt, Human
aggcgcaucaggaggucggggc

SEQ ID NO: 450343 - RNA, 21 nt, Human
aggcggagcuugcagugagcc

SEQ ID NO: 450344 - RNA, 24 nt, Human
aggcggagcuugcagugagccgag

SEQ ID NO: 450345 - RNA, 24 nt, Human
aggcggagguugcagugagccaag

SEQ ID NO: 450346 - RNA, 20 nt, Human
aggcugaggcaggagaaucg

SEQ ID NO: 450347 - RNA, 23 nt, Human
aggcugaggcaggagaaucguug

SEQ ID NO: 450348 - RNA, 19 nt, Human
aggcugaggcaggagaaug

SEQ ID NO: 450349 - RNA, 23 nt, Human
agggagauggggaagguuaaugg

SEQ ID NO: 450350 - RNA, 24 nt, Human
agggguagggcaucauccgggagc

SEQ ID NO: 450351 - RNA, 18 nt, Human
agguggaucacgagguca

SEQ ID NO: 450352 - RNA, 24 nt, Human
agguggaucacgaggucaggaguu

SEQ ID NO: 450353 - RNA, 24 nt, Human
aguggcucacaccuauaaucccag

SEQ ID NO: 450354 - RNA, 24 nt, Human
aucacaccacugcacuccagccug

SEQ ID NO: 450355 - RNA, 20 nt, Human
aucacgaggucaggaguucc

SEQ ID NO: 450356 - RNA, 18 nt, Human
aucauccgggagcgccca

SEQ ID NO: 450357 - RNA, 19 nt, Human
augacugguuccucauuuu

SEQ ID NO: 450358 - RNA, 31 nt, Human
auggguaccacacacacacacacacacacag

SEQ ID NO: 450359 - RNA, 24 nt, Human
auugcgccacugcacuccaaccug

SEQ ID NO: 450360 - RNA, 23 nt, Human
auugcucgacucccgaucugcag

SEQ ID NO: 450361 - RNA, 24 nt, Human
auuguaacuggauuguuuguaacu

SEQ ID NO: 450362 - RNA, 22 nt, Human
caaggcagguggaucacgaggu

SEQ ID NO: 450363 - RNA, 24 nt, Human
caaggcagguggaucacgagguca

SEQ ID NO: 450364 - RNA, 25 nt, Human
caauauggugaaaccccugucucua

SEQ ID NO: 450365 - RNA, 23 nt, Human
cacacacacacacaaagaaagaa

SEQ ID NO: 450366 - RNA, 20 nt, Human
cacacacacacacacacaca

SEQ ID NO: 450367 - RNA, 20 nt, Human
cacacacacacacacacaca

SEQ ID NO: 450368 - RNA, 20 nt, Human
cacacacacacacacacaca

SEQ ID NO: 450369 - RNA, 20 nt, Human
cacacacacacacacacaca

SEQ ID NO: 450370 - RNA, 20 nt, Human
cacacacacacacacacaca

SEQ ID NO: 450371 - RNA, 20 nt, Human
cacacacacacacacacaca

SEQ ID NO: 450372 - RNA, 22 nt, Human
cacacacacacacacacacaaa

SEQ ID NO: 450373 - RNA, 22 nt, Human
cacacacacacacacacacaca

SEQ ID NO: 450374 - RNA, 22 nt, Human
cacacacacacacacacacaca

SEQ ID NO: 450375 - RNA, 22 nt, Human
cacacacacacacacacacaca

SEQ ID NO: 450376 - RNA, 22 nt, Human
cacacacacacacacacacaca

SEQ ID NO: 450377 - RNA, 23 nt, Human
cacacacacacacacacacacaa

SEQ ID NO: 450378 - RNA, 26 nt, Human
cacacacacacacacacacacacaca

SEQ ID NO: 450379 - RNA, 26 nt, Human
cacacacacacacacacacacacaca

SEQ ID NO: 450380 - RNA, 26 nt, Human
cacacacacacacacacacacacaca

SEQ ID NO: 450381 - RNA, 21 nt, Human
cacaccacugcacuccagccu

SEQ ID NO: 450382 - RNA, 22 nt, Human
cacaccuauaaucccagcacug

SEQ ID NO: 450383 - RNA, 24 nt, Human
cacaccuguuauccuagcacuuug

SEQ ID NO: 450384 - RNA, 23 nt, Human
cacacugcucuuccuaagccuua

SEQ ID NO: 450385 - RNA, 26 nt, Human
caccacugcacuccagccugggugac

SEQ ID NO: 450386 - RNA, 21 nt, Human
caccuauaaucccagcacugg

SEQ ID NO: 450387 - RNA, 22 nt, Human
caccuucagcuuucuuuaguuc

SEQ ID NO: 450388 - RNA, 23 nt, Human
cacuccaaccugggcgacagagc

SEQ ID NO: 450389 - RNA, 18 nt, Human
cacuccagccugggugac

SEQ ID NO: 450390 - RNA, 19 nt, Human
cacuccagccugggugaca

SEQ ID NO: 450391 - RNA, 23 nt, Human
cacuccagccugggugacaccag

SEQ ID NO: 450392 - RNA, 23 nt, Human
cacugcacuccaaccugggcgac

SEQ ID NO: 450393 - RNA, 24 nt, Human
cacugcacuccaaccugggcgaca

SEQ ID NO: 450394 - RNA, 19 nt, Human
cacugcacuccagccuggg

SEQ ID NO: 450395 - RNA, 19 nt, Human
cacugcacuccagccuggg

SEQ ID NO: 450396 - RNA, 22 nt, Human
cacugcacuccagccuggguga

SEQ ID NO: 450397 - RNA, 23 nt, Human
cacugcacuccagccugggugac

SEQ ID NO: 450398 - RNA, 24 nt, Human
cacugcacuccagccugggugaca

SEQ ID NO: 450399 - RNA, 22 nt, Human
cagcacugggaggcugaggcag

SEQ ID NO: 450400 - RNA, 24 nt, Human
cagcuacucaggaggcugaggcag

SEQ ID NO: 450401 - RNA, 24 nt, Human
cagcuacucgggaggcugaggcag

SEQ ID NO: 450402 - RNA, 23 nt, Human
cagcugccaaggaaacccccagu

SEQ ID NO: 450403 - RNA, 19 nt, Human
ccacacacacacacacaca

SEQ ID NO: 450404 - RNA, 21 nt, Human
ccacacacacacacacacaca

SEQ ID NO: 450405 - RNA, 24 nt, Human
ccacacugcucuuccuaagccuua

SEQ ID NO: 450406 - RNA, 18 nt, Human
ccacugcacuccaaccug

SEQ ID NO: 450407 - RNA, 21 nt, Human
ccacugcacuccaaccugggc

SEQ ID NO: 450408 - RNA, 24 nt, Human
ccacugcacuccaaccugggcgac

SEQ ID NO: 450409 - RNA, 20 nt, Human
ccacugcacuccagccuggg

SEQ ID NO: 450410 - RNA, 20 nt, Human
ccacugcacuccagccuggg

SEQ ID NO: 450411 - RNA, 20 nt, Human
ccacugcacuccagccuggg

SEQ ID NO: 450412 - RNA, 21 nt, Human
ccacugcacuccagccugggu

SEQ ID NO: 450413 - RNA, 21 nt, Human
ccacugcacuccagccugggu

SEQ ID NO: 450414 - RNA, 23 nt, Human
ccacugcacuccagccuggguga

SEQ ID NO: 450415 - RNA, 24 nt, Human
ccacugcacuccagccugggugac

SEQ ID NO: 450416 - RNA, 25 nt, Human
ccacugcacuccagccugggugaca

SEQ ID NO: 450417 - RNA, 24 nt, Human
ccagcacugggaggcugaggcagg

SEQ ID NO: 450418 - RNA, 22 nt, Human
ccaggaggcggagguugcagug

SEQ ID NO: 450419 - RNA, 22 nt, Human
ccaggccaggcuccugcuggcu

SEQ ID NO: 450420 - RNA, 23 nt, Human
ccaggcuccugcuggcugcgcug

SEQ ID NO: 450421 - RNA, 23 nt, Human
cccacucuagauuuacccaggaa

SEQ ID NO: 450422 - RNA, 22 nt, Human
ccccagcugccaaggaaacccc

SEQ ID NO: 450423 - RNA, 24 nt, Human
ccccugucucuacuaaaaauacaa

SEQ ID NO: 450424 - RNA, 21 nt, Human
ccucaggcaacccuguagccc

SEQ ID NO: 450425 - RNA, 22 nt, Human
ccucauuuuuuucucccuccca

SEQ ID NO: 450426 - RNA, 23 nt, Human
ccuggccaauauggugaaacccc

SEQ ID NO: 450427 - RNA, 25 nt, Human
ccuggccaauauggugaaaccccug

SEQ ID NO: 450428 - RNA, 22 nt, Human
ccuggcuaacguggugaaaccc

SEQ ID NO: 450429 - RNA, 23 nt, Human
ccuggcuaacguggugaaacccc

SEQ ID NO: 450430 - RNA, 24 nt, Human
ccuggcuaacguggugaaacccca

SEQ ID NO: 450431 - RNA, 19 nt, Human
ccugggacccacaccucag

SEQ ID NO: 450432 - RNA, 19 nt, Human
ccuguagucccagcuacuc

SEQ ID NO: 450433 - RNA, 21 nt, Human
ccuguagucccagcuacucag

SEQ ID NO: 450434 - RNA, 22 nt, Human
ccuguagucccagcuacucagg

SEQ ID NO: 450435 - RNA, 27 nt, Human
cgaaaaauguauucccgaaagccgcug

SEQ ID NO: 450436 - RNA, 24 nt, Human
cgagaccagccuggccaauauggu

SEQ ID NO: 450437 - RNA, 24 nt, Human
cgagaccauccuggcuaacguggu

SEQ ID NO: 450438 - RNA, 23 nt, Human
cgagacuccaucucaaaaaaaaa

SEQ ID NO: 450439 - RNA, 26 nt, Human
cgccacugcacuccaaccugggcgac

SEQ ID NO: 450440 - RNA, 18 nt, Human
cgggagcgcccaacuggu

SEQ ID NO: 450441 - RNA, 24 nt, Human
cuaaaaaaaaauacaaaaaauuag

SEQ ID NO: 450442 - RNA, 22 nt, Human
cuacuaaaaaaaaauacaaaaa

SEQ ID NO: 450443 - RNA, 22 nt, Human
cucacaccuauaaucccagcac

SEQ ID NO: 450444 - RNA, 24 nt, Human
cucacaccuguuauccuagcacuu

SEQ ID NO: 450445 - RNA, 24 nt, Human
cucauuuuuuucucccucccaucc

SEQ ID NO: 450446 - RNA, 19 nt, Human
cuccaucucaaaaaaaaaa

SEQ ID NO: 450447 - RNA, 19 nt, Human
cucuacuaaaaaaaaauac

SEQ ID NO: 450448 - RNA, 22 nt, Human
cucuagauuuacccaggaaaca

SEQ ID NO: 450449 - RNA, 24 nt, Human
cuuagccaggcgcaguggcucaca

SEQ ID NO: 450450 - RNA, 22 nt, Human
cuugaaaguacccugaugaccc

SEQ ID NO: 450451 - RNA, 19 nt, Human
cuugcagugagccgagauu

SEQ ID NO: 450452 - RNA, 21 nt, Human
cuugcagugagccgagauugc

SEQ ID NO: 450453 - RNA, 18 nt, Human
cuuggcagggugcggugg

SEQ ID NO: 450454 - RNA, 18 nt, Human
gaaaaauguauucccgaa

SEQ ID NO: 450455 - RNA, 25 nt, Human
gacauacuauuugauaacacaacca

SEQ ID NO: 450456 - RNA, 18 nt, Human
gagauugcgccacugcac

SEQ ID NO: 450457 - RNA, 18 nt, Human
gagcuugcagugagccga

SEQ ID NO: 450458 - RNA, 23 nt, Human
gagcuugcagugagccgagauug

SEQ ID NO: 450459 - RNA, 21 nt, Human
gaggcggagguugcagugagc

SEQ ID NO: 450460 - RNA, 18 nt, Human
gagguugcagugagccaa

SEQ ID NO: 450461 - RNA, 22 nt, Human
gagguugcagugagccaagauc

SEQ ID NO: 450462 - RNA, 21 nt, Human
gaucacgaggucaggaguucg

SEQ ID NO: 450463 - RNA, 22 nt, Human
gaucacgaggucaggaguucga

SEQ ID NO: 450464 - RNA, 24 nt, Human
gaucacgaggucaggaguucgaga

SEQ ID NO: 450465 - RNA, 21 nt, Human
gcagaaaaccgaggaagaagu

SEQ ID NO: 450466 - RNA, 21 nt, Human
gcagagcagaaaaccgaggaa

SEQ ID NO: 450467 - RNA, 22 nt, Human
gcaggagaaucguuggaaccca

SEQ ID NO: 450468 - RNA, 22 nt, Human
gcagggagauggggaagguuaa

SEQ ID NO: 450469 - RNA, 20 nt, Human
gccaagaucacaccacugca

SEQ ID NO: 450470 - RNA, 25 nt, Human
gccaauauggugaaaccccugucuc

SEQ ID NO: 450471 - RNA, 24 nt, Human
gccacugcacuccaaccugggcga

SEQ ID NO: 450472 - RNA, 18 nt, Human
gcccgggcugcucgcacc

SEQ ID NO: 450473 - RNA, 23 nt, Human
gccuguagucccagcuacucagg

SEQ ID NO: 450474 - RNA, 18 nt, Human
gcgcuggugcagucucug

SEQ ID NO: 450475 - RNA, 24 nt, Human
gcuaacguggugaaaccccaucuc

SEQ ID NO: 450476 - RNA, 22 nt, Human
gcugaggcaggagaauggcgug

SEQ ID NO: 450477 - RNA, 19 nt, Human
gcugccaaggaaaccccca

SEQ ID NO: 450478 - RNA, 21 nt, Human
gcuggagucagaggcccgucg

SEQ ID NO: 450479 - RNA, 21 nt, Human
ggagaaucguuggaacccagg

SEQ ID NO: 450480 - RNA, 22 nt, Human
ggagauggggaagguuaauggg

SEQ ID NO: 450481 - RNA, 18 nt, Human
ggagcgcggggguaggca

SEQ ID NO: 450482 - RNA, 24 nt, Human
ggagcuugcagugagccgagauug

SEQ ID NO: 450483 - RNA, 20 nt, Human
ggagguugcagugagccaag

SEQ ID NO: 450484 - RNA, 24 nt, Human
ggagguugcagugagccaagauca

SEQ ID NO: 450485 - RNA, 18 nt, Human
ggcagccacacugcucuu

SEQ ID NO: 450486 - RNA, 21 nt, Human
ggggagggauucugggggugu

SEQ ID NO: 450487 - RNA, 22 nt, Human
gggggugucaccuucugguggc

SEQ ID NO: 450488 - RNA, 31 nt, Human
ggguaccacacacacacacacacacacacag

SEQ ID NO: 450489 - RNA, 24 nt, Human
gggugcgguggcucacaccuguua

SEQ ID NO: 450490 - RNA, 24 nt, Human
gguggcucacaccuguuauccuag

SEQ ID NO: 450491 - RNA, 25 nt, Human
gucaauaauaaugguacauuuuaaa

SEQ ID NO: 450492 - RNA, 23 nt, Human
guggaucacgaggucaggaguuc

SEQ ID NO: 450493 - RNA, 19 nt, Human
uaaagaaccaaaaccccac

SEQ ID NO: 450494 - RNA, 23 nt, Human
uaaagaaccaaaaccccacucua

SEQ ID NO: 450495 - RNA, 22 nt, Human
uaacguggugaaaccccaucuc

SEQ ID NO: 450496 - RNA, 24 nt, Human
uaacguggugaaaccccaucucua

SEQ ID NO: 450497 - RNA, 20 nt, Human
uaagaauacuaguuaguagg

SEQ ID NO: 450498 - RNA, 25 nt, Human
uaagaauacuaguuaguagggcugu

SEQ ID NO: 450499 - RNA, 24 nt, Human
uacccaggaaacagcuccuuuaau

SEQ ID NO: 450500 - RNA, 21 nt, Human
uacccugaugaccccagcugc

SEQ ID NO: 450501 - RNA, 24 nt, Human
uacccugaugaccccagcugccaa

SEQ ID NO: 450502 - RNA, 24 nt, Human
uagcacuuugggaggucaaggcag

SEQ ID NO: 450503 - RNA, 25 nt, Human
uagcacuuugggaggucaaggcagg

SEQ ID NO: 450504 - RNA, 24 nt, Human
uagccaggcgcaguggcucacacc

SEQ ID NO: 450505 - RNA, 23 nt, Human
uaguuaguagggcugugcuuucu

SEQ ID NO: 450506 - RNA, 23 nt, Human
ucacaccacugcacuccagccug

SEQ ID NO: 450507 - RNA, 18 nt, Human
ucacgaggucaggaguuc

SEQ ID NO: 450508 - RNA, 24 nt, Human
ucacgaggucaggaguucgagacc

SEQ ID NO: 450509 - RNA, 22 nt, Human
ucagcuuucuuuaguuccucag

SEQ ID NO: 450510 - RNA, 24 nt, Human
ucaggaggucaggagaucgagacc

SEQ ID NO: 450511 - RNA, 25 nt, Human
ucaggaggucaggagaucgagaccc

SEQ ID NO: 450512 - RNA, 24 nt, Human
uccaaccugggcgacagagcgaga

SEQ ID NO: 450513 - RNA, 24 nt, Human
uccagccugggugacaccaggaga

SEQ ID NO: 450514 - RNA, 22 nt, Human
uccaucucaaaaaaaaaaaaaa

SEQ ID NO: 450515 - RNA, 18 nt, Human
ucccaggccaggcuccug

SEQ ID NO: 450516 - RNA, 18 nt, Human
ucccgaugggucgccccc

SEQ ID NO: 450517 - RNA, 22 nt, Human
uccucaguuucccgggggcaga

SEQ ID NO: 450518 - RNA, 24 nt, Human
uccucauuuuuuucucccucccaa

SEQ ID NO: 450519 - RNA, 26 nt, Human
uccucauuuuuuucucccucccaucc

SEQ ID NO: 450520 - RNA, 24 nt, Human
ucgggaggcugaggcaggagaauc

SEQ ID NO: 450521 - RNA, 18 nt, Human
ucucaaaaaaaaaaaaaa

SEQ ID NO: 450522 - RNA, 26 nt, Human
ucucuacuaaaaaaaaauacaaaaaa

SEQ ID NO: 450523 - RNA, 21 nt, Human
ucucuacuaaaaauacaaaaa

SEQ ID NO: 450524 - RNA, 25 nt, Human
ucugggggugucaccuucugguggc

SEQ ID NO: 450525 - RNA, 19 nt, Human
ugaaaccccaucucuacua

SEQ ID NO: 450526 - RNA, 21 nt, Human
ugaaaguacccugaugacccc

SEQ ID NO: 450527 - RNA, 24 nt, Human
ugaaaguacccugaugaccccagc

SEQ ID NO: 450528 - RNA, 22 nt, Human
ugagccgagauugcgccacugc

SEQ ID NO: 450529 - RNA, 19 nt, Human
ugaggcaggagaaucguug

SEQ ID NO: 450530 - RNA, 24 nt, Human
ugaggcaggagaaucguuggaacc

SEQ ID NO: 450531 - RNA, 23 nt, Human
ugaggcaggagaauggcgugaac

SEQ ID NO: 450532 - RNA, 24 nt, Human
ugaggcaggagaauggcgugaacc

SEQ ID NO: 450533 - RNA, 25 nt, Human
ugaggcaggagaauggcgugaaccc

SEQ ID NO: 450534 - RNA, 24 nt, Human
ugaggcaggcgcaucaggagguca

SEQ ID NO: 450535 - RNA, 21 nt, Human
ugauucgcuguauugcuggag

SEQ ID NO: 450536 - RNA, 28 nt, Human
ugcuuucuguguuaaaugucuucugggg

SEQ ID NO: 450537 - RNA, 24 nt, Human
uggaacccaggaggcggagguugc

SEQ ID NO: 450538 - RNA, 22 nt, Human
uggaucacgaggucaggaguuc

SEQ ID NO: 450539 - RNA, 25 nt, Human
uggccaauauggugaaaccccuguc

SEQ ID NO: 450540 - RNA, 22 nt, Human
uggcucacaccuauaaucccag

SEQ ID NO: 450541 - RNA, 24 nt, Human
uggcucacaccuauaaucccagca

SEQ ID NO: 450542 - RNA, 24 nt, Human
uggcucacaccuguuauccuagca

SEQ ID NO: 450543 - RNA, 19 nt, Human
ugggaggcugaggcaggcg

SEQ ID NO: 450544 - RNA, 24 nt, Human
ugggaggcugaggcaggcgcauca

SEQ ID NO: 450545 - RNA, 22 nt, Human
uggggaaaauuucaacgugugc

SEQ ID NO: 450546 - RNA, 23 nt, Human
uggggaggguaguuaggggcugg

SEQ ID NO: 450547 - RNA, 26 nt, Human
uggguaccacacacacacacacacac

SEQ ID NO: 450548 - RNA, 27 nt, Human
uggguaccacacacacacacacacaca

SEQ ID NO: 450549 - RNA, 19 nt, Human
uguagcccgggcugcucgc

SEQ ID NO: 450550 - RNA, 24 nt, Human
uuagccggguauaguggugggcac

SEQ ID NO: 450551 - RNA, 21 nt, Human
uuccuggaggcuggggagggu

SEQ ID NO: 450552 - RNA, 24 nt, Human
uugaaaguacccugaugaccccag

SEQ ID NO: 450553 - RNA, 19 nt, Human
uugaacucauggagauaag

SEQ ID NO: 450554 - RNA, 20 nt, Human
uugcagugagccaagaucac

SEQ ID NO: 450555 - RNA, 18 nt, Human
uugcagugagccgagauu

SEQ ID NO: 450556 - RNA, 19 nt, Human
uugcagugagccgagauug

SEQ ID NO: 450557 - RNA, 22 nt, Human
uugcagugagccgagauugcgc

SEQ ID NO: 450558 - RNA, 22 nt, Human
uuggcagggugcgguggcucac

SEQ ID NO: 450559 - RNA, 23 nt, Human
uuggcagggugcgguggcucaca

SEQ ID NO: 450560 - RNA, 19 nt, Human
uuugauguccugcacgagc

SEQ ID NO: 450561 - RNA, 21 nt, Human
aggcgcggaggaaauggugga

SEQ ID NO: 450562 - RNA, 22 nt, Human
ccggagcaggacuccuuguccu

SEQ ID NO: 450563 - RNA, 24 nt, Human
cggagcaggacuccuuguccuguu

SEQ ID NO: 450564 - RNA, 21 nt, Human
cuguggccacgugccggagca

SEQ ID NO: 450565 - RNA, 21 nt, Human
ggaaaugguggaaggcccagc

SEQ ID NO: 450566 - RNA, 19 nt, Human
uccugggcgcugcccccgu

SEQ ID NO: 450567 - RNA, 24 nt, Human
ucuccaggcacuguuguuguucuc

SEQ ID NO: 450568 - RNA, 21 nt, Human
ucuguggccacgugccggagc

SEQ ID NO: 450569 - RNA, 20 nt, Human
ugauccugggcgcugccccc

SEQ ID NO: 450570 - RNA, 20 nt, Human
ugggauucuccaggcacugu

SEQ ID NO: 450571 - RNA, 18 nt, Human
ugggugauccugggcgcu

SEQ ID NO: 450572 - RNA, 24 nt, Human
uuccccagagccgugggauucucc

SEQ ID NO: 450573 - RNA, 21 nt, Human
aacaacacccuagacccugca

SEQ ID NO: 450574 - RNA, 19 nt, Human
agaaauucggaccaacugc

SEQ ID NO: 450575 - RNA, 20 nt, Human
agcagcgcggggcuugcggc

SEQ ID NO: 450576 - RNA, 26 nt, Human
agcagcgcggggcuugcggccagggc

SEQ ID NO: 450577 - RNA, 20 nt, Human
caacaacacccuagacccug

SEQ ID NO: 450578 - RNA, 23 nt, Human
caacaacacccuagacccugcag

SEQ ID NO: 450579 - RNA, 26 nt, Human
cacuccaacaacacccuagacccugc

SEQ ID NO: 450580 - RNA, 20 nt, Human
cagaagggaccaggcuggug

SEQ ID NO: 450581 - RNA, 24 nt, Human
ccaacaacacccuagacccugcag

SEQ ID NO: 450582 - RNA, 26 nt, Human
ccaacaacacccuagacccugcaguu

SEQ ID NO: 450583 - RNA, 24 nt, Human
ccgacaacacccuagacccugcag

SEQ ID NO: 450584 - RNA, 22 nt, Human
ccgcgggcuucgggagaaauuc

SEQ ID NO: 450585 - RNA, 23 nt, Human
cgacaacacccuagacccugcag

SEQ ID NO: 450586 - RNA, 25 nt, Human
cgacaacacccuagacccugcaguu

SEQ ID NO: 450587 - RNA, 20 nt, Human
cuccgacaacacccuagacc

SEQ ID NO: 450588 - RNA, 22 nt, Human
cuucgggagaaauucggaccaa

SEQ ID NO: 450589 - RNA, 21 nt, Human
guaaguuguauuuggugccag

SEQ ID NO: 450590 - RNA, 24 nt, Human
uaaagagcacuauuuugacauuaa

SEQ ID NO: 450591 - RNA, 27 nt, Human
uagcagcgcggggcuugcggccagggc

SEQ ID NO: 450592 - RNA, 19 nt, Human
ucuuacccgcuccuccgcg

SEQ ID NO: 450593 - RNA, 18 nt, Human
ugcgaggaagaagggcgg

SEQ ID NO: 450594 - RNA, 18 nt, Human
ugcggccagggccgccuc

SEQ ID NO: 450595 - RNA, 20 nt, Human
uuggggccggauucgcgggg

SEQ ID NO: 450596 - RNA, 26 nt, Human
uuuuuuuuuuuuuuugugauucaggg

SEQ ID NO: 450597 - RNA, 21 nt, Human
uuuuuuuuuuuuuuuugugau

SEQ ID NO: 450598 - RNA, 24 nt, Human
aaaaaaaaaaagcauaugcuauag

SEQ ID NO: 450599 - RNA, 22 nt, Human
aaaacacccuucaacacagucc

SEQ ID NO: 450600 - RNA, 19 nt, Human
acacccuucaacacagucc

SEQ ID NO: 450601 - RNA, 19 nt, Human
agaaaaaaaacacccuuca

SEQ ID NO: 450602 - RNA, 18 nt, Human
agcaaaugaaagagcaca

SEQ ID NO: 450603 - RNA, 23 nt, Human
agguaauaauuaaaaaaaaaaaa

SEQ ID NO: 450604 - RNA, 20 nt, Human
caaaaagaaacugcaauaga

SEQ ID NO: 450605 - RNA, 23 nt, Human
caaaugaaagagcacaaauuuug

SEQ ID NO: 450606 - RNA, 27 nt, Human
cacccuucaacacaguccugguguggc

SEQ ID NO: 450607 - RNA, 20 nt, Human
ccagucuaggacugucagaa

SEQ ID NO: 450608 - RNA, 23 nt, Human
cuaaagaauaagaauaguguaaa

SEQ ID NO: 450609 - RNA, 18 nt, Human
cucaacccuuauguauca

SEQ ID NO: 450610 - RNA, 21 nt, Human
gcucugcuuauucaguuauac

SEQ ID NO: 450611 - RNA, 18 nt, Human
gucuuaguguagaagacc

SEQ ID NO: 450612 - RNA, 21 nt, Human
uaaaauaagucaguggacuua

SEQ ID NO: 450613 - RNA, 23 nt, Human
uaaugaacauuuacugaaggcuu

SEQ ID NO: 450614 - RNA, 20 nt, Human
uaauuaaaaaaaaaaaagca

SEQ ID NO: 450615 - RNA, 19 nt, Human
uacauaaagaacucugagc

SEQ ID NO: 450616 - RNA, 19 nt, Human
uagcggaucauuaaaaugc

SEQ ID NO: 450617 - RNA, 20 nt, Human
uauaauagcggaucauuaaa

SEQ ID NO: 450618 - RNA, 18 nt, Human
uauacuagauguguuucu

SEQ ID NO: 450619 - RNA, 21 nt, Human
ucagaagagaguaguccuccu

SEQ ID NO: 450620 - RNA, 23 nt, Human
ucaguggacuuaccacuugagaa

SEQ ID NO: 450621 - RNA, 23 nt, Human
ucccuguuuucugauuuuacaua

SEQ ID NO: 450622 - RNA, 22 nt, Human
ugaaagagcacaaauuuugcua

SEQ ID NO: 450623 - RNA, 20 nt, Human
ugcuuauucaguuauacuag

SEQ ID NO: 450624 - RNA, 19 nt, Human
ugcuugauaacaaaguguu

SEQ ID NO: 450625 - RNA, 18 nt, Human
uggcaaaauuccguugaa

SEQ ID NO: 450626 - RNA, 18 nt, Human
uggcugcacccuggguga

SEQ ID NO: 450627 - RNA, 20 nt, Human
uggcugcacccugggugaua

SEQ ID NO: 450628 - RNA, 21 nt, Human
uuaaauggacauuaccaauua

SEQ ID NO: 450629 - RNA, 25 nt, Human
uuuaaaagaaaaaaaacacccuuca

SEQ ID NO: 450630 - RNA, 18 nt, Human
uuuacaguacagcucuuu

SEQ ID NO: 450631 - RNA, 22 nt, Human
uuucucagaguuauccagucca

SEQ ID NO: 450632 - RNA, 28 nt, Human
uuucucagaguuauccagucggaaaucc

SEQ ID NO: 450633 - RNA, 21 nt, Human
uuugcuaagucaagcauucca

SEQ ID NO: 450634 - RNA, 18 nt, Human
aaaccugaugguggcgcu

SEQ ID NO: 450635 - RNA, 21 nt, Human
accagcgcccccuccucagca

SEQ ID NO: 450636 - RNA, 19 nt, Human
caaaccugaugguggcgcu

SEQ ID NO: 450637 - RNA, 23 nt, Human
ccucuugcuggccggcagcuuca

SEQ ID NO: 450638 - RNA, 20 nt, Human
ccuugcccaggcuccucuuc

SEQ ID NO: 450639 - RNA, 22 nt, Human
cguguacacgcagacuggggug

SEQ ID NO: 450640 - RNA, 20 nt, Human
cugaugguggcgcugccccc

SEQ ID NO: 450641 - RNA, 26 nt, Human
cuggcagcucucaccucuugcuggcc

SEQ ID NO: 450642 - RNA, 18 nt, Human
gaccagcgcccccuccuc

SEQ ID NO: 450643 - RNA, 19 nt, Human
gcgcccccuccucagcagc

SEQ ID NO: 450644 - RNA, 19 nt, Human
ggaccagcgcccccuccuc

SEQ ID NO: 450645 - RNA, 21 nt, Human
ggaccagcgcccccuccucag

SEQ ID NO: 450646 - RNA, 22 nt, Human
ggcagcuucagccacuugggca

SEQ ID NO: 450647 - RNA, 21 nt, Human
gugccccgcagggcagcuuca

SEQ ID NO: 450648 - RNA, 22 nt, Human
guggccccgccggggugcugca

SEQ ID NO: 450649 - RNA, 21 nt, Human
ucaggcccagcgacugcagcg

SEQ ID NO: 450650 - RNA, 20 nt, Human
ugcuggcagaggaggugguc

SEQ ID NO: 450651 - RNA, 21 nt, Human
uggcagaggaggugguccugu

SEQ ID NO: 450652 - RNA, 22 nt, Human
aaaaaagagagagaaguccuua

SEQ ID NO: 450653 - RNA, 27 nt, Human
aaacugucccuccauaggucuccucca

SEQ ID NO: 450654 - RNA, 19 nt, Human
agaaggaagaagagcaaag

SEQ ID NO: 450655 - RNA, 18 nt, Human
agaauacugcucccccuc

SEQ ID NO: 450656 - RNA, 19 nt, Human
agcaaaaaagagagagaag

SEQ ID NO: 450657 - RNA, 25 nt, Human
aggaagaaagcagaguguggcagga

SEQ ID NO: 450658 - RNA, 23 nt, Human
aggaagaggaggcagcugcggag

SEQ ID NO: 450659 - RNA, 23 nt, Human
aggaagaggcagggucccacaaa

SEQ ID NO: 450660 - RNA, 19 nt, Human
agguagcaggaagaggcag

SEQ ID NO: 450661 - RNA, 24 nt, Human
auggcaggaagaaagcagagugug

SEQ ID NO: 450662 - RNA, 19 nt, Human
caggccccaggauccagga

SEQ ID NO: 450663 - RNA, 19 nt, Human
caggccccaggauccagga

SEQ ID NO: 450664 - RNA, 18 nt, Human
caucugcuaggcccaucc

SEQ ID NO: 450665 - RNA, 23 nt, Human
ccauaggucuccuccaggggucc

SEQ ID NO: 450666 - RNA, 22 nt, Human
ccaugcuuccucacugcaacca

SEQ ID NO: 450667 - RNA, 22 nt, Human
cccaggccccaggauccaggag

SEQ ID NO: 450668 - RNA, 22 nt, Human
ccccagcccacccaggccccag

SEQ ID NO: 450669 - RNA, 19 nt, Human
ccucacugcaaccauccuc

SEQ ID NO: 450670 - RNA, 18 nt, Human
cggcggcggcgguggcgg

SEQ ID NO: 450671 - RNA, 22 nt, Human
cgggcggcggcggcgguggcuu

SEQ ID NO: 450672 - RNA, 19 nt, Human
cgguggcgaaggaggaaga

SEQ ID NO: 450673 - RNA, 18 nt, Human
cgguggcggcgguggcga

SEQ ID NO: 450674 - RNA, 18 nt, Human
cugaagaggucaaaacug

SEQ ID NO: 450675 - RNA, 23 nt, Human
cugcuaggcccauccucagcugu

SEQ ID NO: 450676 - RNA, 20 nt, Human
gaaaagguuuaaaaaggaga

SEQ ID NO: 450677 - RNA, 22 nt, Human
gagagacuuuugauagagucaa

SEQ ID NO: 450678 - RNA, 20 nt, Human
gcggcggcggcgguggcggc

SEQ ID NO: 450679 - RNA, 24 nt, Human
gcggcggcggcgguggcggcggug

SEQ ID NO: 450680 - RNA, 24 nt, Human
gcggcggcgguggcggcgguggcg

SEQ ID NO: 450681 - RNA, 20 nt, Human
gcggcgguggcggcgguggc

SEQ ID NO: 450682 - RNA, 26 nt, Human
gcgggcggcggcggcgguggcggcgc

SEQ ID NO: 450683 - RNA, 20 nt, Human
gcggugcugcgggcggcggc

SEQ ID NO: 450684 - RNA, 22 nt, Human
ggagaauacugcucccccuccc

SEQ ID NO: 450685 - RNA, 18 nt, Human
ggcagcugcggagacggc

SEQ ID NO: 450686 - RNA, 18 nt, Human
ggcggcggcggcgguggc

SEQ ID NO: 450687 - RNA, 20 nt, Human
ggcggcggcgguggcggcgg

SEQ ID NO: 450688 - RNA, 19 nt, Human
ggcggcgguggcggcggug

SEQ ID NO: 450689 - RNA, 19 nt, Human
gggcggcggcggcgguggc

SEQ ID NO: 450690 - RNA, 24 nt, Human
gggcggcggcggcgguggcggcgg

SEQ ID NO: 450691 - RNA, 21 nt, Human
guggcggcgguggcgaaggag

SEQ ID NO: 450692 - RNA, 20 nt, Human
guuugcuuuggccuugcugg

SEQ ID NO: 450693 - RNA, 22 nt, Human
uagcaggaagaggcaggguccc

SEQ ID NO: 450694 - RNA, 23 nt, Human
ucaauaauguccagcaaaaaaga

SEQ ID NO: 450695 - RNA, 25 nt, Human
uccacuauccacaggagaaaccguu

SEQ ID NO: 450696 - RNA, 19 nt, Human
uccauggcaggaagaaagc

SEQ ID NO: 450697 - RNA, 23 nt, Human
ucccccagcccacccaggccccc

SEQ ID NO: 450698 - RNA, 18 nt, Human
uccuggugcugaagaggu

SEQ ID NO: 450699 - RNA, 18 nt, Human
ucugggcagacccacagg

SEQ ID NO: 450700 - RNA, 22 nt, Human
ucuguccacuauccacaggaga

SEQ ID NO: 450701 - RNA, 19 nt, Human
ugaaaaaauaaaagauaga

SEQ ID NO: 450702 - RNA, 23 nt, Human
ugaaaaaauaaaagauagagaaa

SEQ ID NO: 450703 - RNA, 18 nt, Human
ugccucgggauugacagc

SEQ ID NO: 450704 - RNA, 18 nt, Human
ugcugaagaggucaaaac

SEQ ID NO: 450705 - RNA, 18 nt, Human
uggcaggaagaaagcaga

SEQ ID NO: 450706 - RNA, 19 nt, Human
uggcaggaagaaagcagag

SEQ ID NO: 450707 - RNA, 21 nt, Human
uggcaggaagaaggaagaaga

SEQ ID NO: 450708 - RNA, 23 nt, Human
uggcaggaagaaggaagaagagc

SEQ ID NO: 450709 - RNA, 21 nt, Human
uggcggcgguggcgaaggagg

SEQ ID NO: 450710 - RNA, 23 nt, Human
ugucccuccauaggucuccucca

SEQ ID NO: 450711 - RNA, 19 nt, Human
accaaaaaaaaugcacaac

SEQ ID NO: 450712 - RNA, 22 nt, Human
agaaagaauccuccaaaaugau

SEQ ID NO: 450713 - RNA, 21 nt, Human
agaaccaaaaaaaaugcacaa

SEQ ID NO: 450714 - RNA, 18 nt, Human
aggaaacagucuguuuua

SEQ ID NO: 450715 - RNA, 18 nt, Human
caaaaugauaaaucccaa

SEQ ID NO: 450716 - RNA, 22 nt, Human
caacacaggaacuucccggcag

SEQ ID NO: 450717 - RNA, 25 nt, Human
cacagguacugaauauguauccugg

SEQ ID NO: 450718 - RNA, 23 nt, Human
cagaaccaaaaaaaaugcacaac

SEQ ID NO: 450719 - RNA, 26 nt, Human
cauugccacaaaauauuuuuuaaaag

SEQ ID NO: 450720 - RNA, 23 nt, Human
ccccauacuuaagguuuccuagc

SEQ ID NO: 450721 - RNA, 18 nt, Human
ccccgcgaacgcucagcc

SEQ ID NO: 450722 - RNA, 21 nt, Human
cccgcgucgcuagcgcggccg

SEQ ID NO: 450723 - RNA, 22 nt, Human
ccgccgccaccccacaaugcag

SEQ ID NO: 450724 - RNA, 23 nt, Human
cgucgcuagcgcggccgccgccg

SEQ ID NO: 450725 - RNA, 19 nt, Human
cucacagauacauugccac

SEQ ID NO: 450726 - RNA, 24 nt, Human
cucggccccgcgaacgcucagccg

SEQ ID NO: 450727 - RNA, 21 nt, Human
gagcauaucuugcucuagaaa

SEQ ID NO: 450728 - RNA, 21 nt, Human
ggggcuaggucauaaugcagu

SEQ ID NO: 450729 - RNA, 22 nt, Human
gggggcuaggucauaaugcagu

SEQ ID NO: 450730 - RNA, 23 nt, Human
uaacuaugagauucucacagaua

SEQ ID NO: 450731 - RNA, 22 nt, Human
uacaaacaggagaauuugagca

SEQ ID NO: 450732 - RNA, 20 nt, Human
uagcgcggccgccgccgccu

SEQ ID NO: 450733 - RNA, 28 nt, Human
uaucuugcucuagaaagaauccuccaaa

SEQ ID NO: 450734 - RNA, 21 nt, Human
ugaauauguauccuggcacaa

SEQ ID NO: 450735 - RNA, 20 nt, Human
ugagaagacauauuuucuaa

SEQ ID NO: 450736 - RNA, 25 nt, Human
ugagaagacauauuuucuaagugau

SEQ ID NO: 450737 - RNA, 21 nt, Human
ugcucuagaaagaauccucca

SEQ ID NO: 450738 - RNA, 24 nt, Human
uucauuuuacaaaauacaaacagg

SEQ ID NO: 450739 - RNA, 18 nt, Human
uucccggcagaggugaac

SEQ ID NO: 450740 - RNA, 21 nt, Human
uuugagcauaucuugcucuag

SEQ ID NO: 450741 - RNA, 22 nt, Human
aagaugcacuugcccuggucca

SEQ ID NO: 450742 - RNA, 23 nt, Human
aagcacaacccuggccguugcac

SEQ ID NO: 450743 - RNA, 22 nt, Human
acacaggaagacagcucuccaa

SEQ ID NO: 450744 - RNA, 18 nt, Human
acagcuacaugacaaaaa

SEQ ID NO: 450745 - RNA, 24 nt, Human
agaggaagaugggagaugggagag

SEQ ID NO: 450746 - RNA, 19 nt, Human
agagguacacaggaagaca

SEQ ID NO: 450747 - RNA, 18 nt, Human
agaugggagaugggagag

SEQ ID NO: 450748 - RNA, 19 nt, Human
agcucugcaauguuccuuc

SEQ ID NO: 450749 - RNA, 24 nt, Human
aggaaaauggaauauuucuuuggc

SEQ ID NO: 450750 - RNA, 24 nt, Human
aggaagacagcucuccaauggcuu

SEQ ID NO: 450751 - RNA, 23 nt, Human
aggcgggcaggacaccagcuggg

SEQ ID NO: 450752 - RNA, 19 nt, Human
agguacagacacugcugcc

SEQ ID NO: 450753 - RNA, 24 nt, Human
aguagccagcguccuuguggccag

SEQ ID NO: 450754 - RNA, 18 nt, Human
auaccacgacugcuuagc

SEQ ID NO: 450755 - RNA, 18 nt, Human
cacaggaagacagcucuc

SEQ ID NO: 450756 - RNA, 18 nt, Human
caccggggcucaucaagc

SEQ ID NO: 450757 - RNA, 26 nt, Human
cacucuggggcagaaugggaagggcc

SEQ ID NO: 450758 - RNA, 21 nt, Human
cagcauauuugcuagaaagca

SEQ ID NO: 450759 - RNA, 21 nt, Human
caggcccucccgccuugaugg

SEQ ID NO: 450760 - RNA, 21 nt, Human
cauaacagcauauuugcuaga

SEQ ID NO: 450761 - RNA, 22 nt, Human
cauaacagcauauuugcuagaa

SEQ ID NO: 450762 - RNA, 27 nt, Human
caugacaaaaaaaaugcuuuugacauc

SEQ ID NO: 450763 - RNA, 22 nt, Human
ccaauaaugcuaaaccugguac

SEQ ID NO: 450764 - RNA, 22 nt, Human
ccacggugaaggagauggcccc

SEQ ID NO: 450765 - RNA, 23 nt, Human
cccccaaaacucuuagaaaccag

SEQ ID NO: 450766 - RNA, 19 nt, Human
cccccauaccacgacugcu

SEQ ID NO: 450767 - RNA, 21 nt, Human
cccccauaccacgacugcuua

SEQ ID NO: 450768 - RNA, 19 nt, Human
ccgccccccaaaacucuua

SEQ ID NO: 450769 - RNA, 18 nt, Human
cgacuccugggacacacc

SEQ ID NO: 450770 - RNA, 23 nt, Human
cgagagaagagagcugugcagug

SEQ ID NO: 450771 - RNA, 18 nt, Human
cggccagggucgggacgg

SEQ ID NO: 450772 - RNA, 26 nt, Human
cugcaauguuccuucuuuuaucuguu

SEQ ID NO: 450773 - RNA, 19 nt, Human
cuggaguccucccauucug

SEQ ID NO: 450774 - RNA, 18 nt, Human
cugguaccaccagcucca

SEQ ID NO: 450775 - RNA, 20 nt, Human
cugguaccaccagcuccacu

SEQ ID NO: 450776 - RNA, 21 nt, Human
cuucucacagcugcaaacacc

SEQ ID NO: 450777 - RNA, 23 nt, Human
cuucucacagcugcaaacacccu

SEQ ID NO: 450778 - RNA, 22 nt, Human
gaaaaugcagacccucuucuuc

SEQ ID NO: 450779 - RNA, 21 nt, Human
gagcagcacuggguuuaggaa

SEQ ID NO: 450780 - RNA, 20 nt, Human
gcaaacacccugggccagau

SEQ ID NO: 450781 - RNA, 18 nt, Human
gcuccucaaucugagccu

SEQ ID NO: 450782 - RNA, 22 nt, Human
gcugcaaacacccugggccaga

SEQ ID NO: 450783 - RNA, 19 nt, Human
gcuuucuuccugugacuuu

SEQ ID NO: 450784 - RNA, 25 nt, Human
ggaguccucccauucugagcccuuc

SEQ ID NO: 450785 - RNA, 22 nt, Human
ggcaggacaccagcugggggcc

SEQ ID NO: 450786 - RNA, 24 nt, Human
gggcggccagggucgggacggggu

SEQ ID NO: 450787 - RNA, 22 nt, Human
guauaaaaugaggauucaauga

SEQ ID NO: 450788 - RNA, 18 nt, Human
guggagaguccuaacccu

SEQ ID NO: 450789 - RNA, 21 nt, Human
guguugugugacacaaacauc

SEQ ID NO: 450790 - RNA, 21 nt, Human
uaccaccagcuccacugacug

SEQ ID NO: 450791 - RNA, 19 nt, Human
uagacacaacuccugaccu

SEQ ID NO: 450792 - RNA, 19 nt, Human
uauuucuuuggcucuucca

SEQ ID NO: 450793 - RNA, 20 nt, Human
uccaaacaucucuccacuga

SEQ ID NO: 450794 - RNA, 20 nt, Human
ucggggcggccagggucggg

SEQ ID NO: 450795 - RNA, 25 nt, Human
ucucacagcugcaaacacccugggc

SEQ ID NO: 450796 - RNA, 22 nt, Human
ucucacuccacauccccuacga

SEQ ID NO: 450797 - RNA, 21 nt, Human
ucucuuacagaaaauuguaau

SEQ ID NO: 450798 - RNA, 25 nt, Human
ucuugagcuccucaaucugagccuu

SEQ ID NO: 450799 - RNA, 18 nt, Human
ugaaggagauggccccau

SEQ ID NO: 450800 - RNA, 19 nt, Human
ugacagccccgccccccaa

SEQ ID NO: 450801 - RNA, 21 nt, Human
ugacagccccgccccccaaaa

SEQ ID NO: 450802 - RNA, 23 nt, Human
ugacuucucacagcugcaaacac

SEQ ID NO: 450803 - RNA, 24 nt, Human
ugacuucucacagcugcaaacacc

SEQ ID NO: 450804 - RNA, 18 nt, Human
ugagaaaaagcauauaaa

SEQ ID NO: 450805 - RNA, 19 nt, Human
ugagauacugcacguggug

SEQ ID NO: 450806 - RNA, 23 nt, Human
ugagcauguauaucaaaugcugc

SEQ ID NO: 450807 - RNA, 27 nt, Human
ugagcccggacaauacacgugggccga

SEQ ID NO: 450808 - RNA, 18 nt, Human
ugcacacacaauuucugg

SEQ ID NO: 450809 - RNA, 19 nt, Human
ugcgagaggaagaugggag

SEQ ID NO: 450810 - RNA, 18 nt, Human
ugcuagaaagcacaaccc

SEQ ID NO: 450811 - RNA, 20 nt, Human
uggaaguugaacuuucugcu

SEQ ID NO: 450812 - RNA, 19 nt, Human
ugggacacaccggggcuca

SEQ ID NO: 450813 - RNA, 20 nt, Human
ugggagaugggagagcagca

SEQ ID NO: 450814 - RNA, 23 nt, Human
ugggauucuagagguacacagga

SEQ ID NO: 450815 - RNA, 18 nt, Human
uggguuuaggaaaaugca

SEQ ID NO: 450816 - RNA, 23 nt, Human
ugugacacaaacaucggaagagu

SEQ ID NO: 450817 - RNA, 19 nt, Human
uguucucacuccacauccc

SEQ ID NO: 450818 - RNA, 22 nt, Human
uucaaccacaaggaaaggaaaa

SEQ ID NO: 450819 - RNA, 26 nt, Human
uucucacagcugcaaacacccugggc

SEQ ID NO: 450820 - RNA, 28 nt, Human
uucucacagcugcaaacacccugggcca

SEQ ID NO: 450821 - RNA, 21 nt, Human
uugaugguucucugcugcugg

SEQ ID NO: 450822 - RNA, 22 nt, Human
uuggaacugaguuugcaacaga

SEQ ID NO: 450823 - RNA, 23 nt, Human
uuuuaauagacaguagccagcgu

SEQ ID NO: 450824 - RNA, 21 nt, Human
acccacuuaucauuuuuuugu

SEQ ID NO: 450825 - RNA, 22 nt, Human
cagcagcggcaccacgugcgca

SEQ ID NO: 450826 - RNA, 21 nt, Human
caggcgugacuguucaccuac

SEQ ID NO: 450827 - RNA, 19 nt, Human
cauaagcaagccaaaaaac

SEQ ID NO: 450828 - RNA, 23 nt, Human
ccuacacauaagcaagccaaaaa

SEQ ID NO: 450829 - RNA, 24 nt, Human
gcaagccaaaaaacaguguguggu

SEQ ID NO: 450830 - RNA, 18 nt, Human
gcagguaggagggcugcc

SEQ ID NO: 450831 - RNA, 21 nt, Human
ggcgagcgggaggcagcagca

SEQ ID NO: 450832 - RNA, 20 nt, Human
uaacauaaccaucacuucac

SEQ ID NO: 450833 - RNA, 24 nt, Human
uacacauaagcaagccaaaaaaca

SEQ ID NO: 450834 - RNA, 20 nt, Human
ucagggcgagcgggaggcag

SEQ ID NO: 450835 - RNA, 21 nt, Human
ucauuuuuuugugguaagaaa

SEQ ID NO: 450836 - RNA, 19 nt, Human
uccucaaaguuucaggcgg

SEQ ID NO: 450837 - RNA, 24 nt, Human
aaaaacugccaagaaguuaccccc

SEQ ID NO: 450838 - RNA, 18 nt, Human
aaaaugagcgcuauccuc

SEQ ID NO: 450839 - RNA, 21 nt, Human
aaagcucuuccuguuauaccc

SEQ ID NO: 450840 - RNA, 19 nt, Human
aacaagaugcucucguucu

SEQ ID NO: 450841 - RNA, 19 nt, Human
aacacugaaaaacugccaa

SEQ ID NO: 450842 - RNA, 22 nt, Human
aacugccaagaaguuaccccca

SEQ ID NO: 450843 - RNA, 21 nt, Human
aagaagacagguuaaaucugc

SEQ ID NO: 450844 - RNA, 25 nt, Human
aagaauucucuauuuuguuucccau

SEQ ID NO: 450845 - RNA, 19 nt, Human
aagaugcucucguucuuua

SEQ ID NO: 450846 - RNA, 21 nt, Human
aaguauuggaaguuaaagacu

SEQ ID NO: 450847 - RNA, 20 nt, Human
aagugcuuugugcaacaacg

SEQ ID NO: 450848 - RNA, 18 nt, Human
aaugggagggaagaagac

SEQ ID NO: 450849 - RNA, 23 nt, Human
acacugaaaaacugccaagaagu

SEQ ID NO: 450850 - RNA, 23 nt, Human
acagcagaggaggcugcaucaga

SEQ ID NO: 450851 - RNA, 21 nt, Human
agaaaaaucuaguuucaacug

SEQ ID NO: 450852 - RNA, 20 nt, Human
agaagacagguuaaaucugc

SEQ ID NO: 450853 - RNA, 23 nt, Human
agaagacagguuaaaucugcaag

SEQ ID NO: 450854 - RNA, 20 nt, Human
agacagggacaagucaaagc

SEQ ID NO: 450855 - RNA, 18 nt, Human
agagaaaaguagguagga

SEQ ID NO: 450856 - RNA, 24 nt, Human
agggaacaacacaagauuuaccau

SEQ ID NO: 450857 - RNA, 18 nt, Human
agggagggggagauaaag

SEQ ID NO: 450858 - RNA, 22 nt, Human
auaaagcaacaguucuuccuuc

SEQ ID NO: 450859 - RNA, 20 nt, Human
aucaaagguaaaaauaaggu

SEQ ID NO: 450860 - RNA, 23 nt, Human
aucuucccuccuguucucuccca

SEQ ID NO: 450861 - RNA, 24 nt, Human
augaaacauuugguuuaaacaaaa

SEQ ID NO: 450862 - RNA, 23 nt, Human
augaaguauuggaaguuaaagac

SEQ ID NO: 450863 - RNA, 23 nt, Human
augaauggcaaacccaacuuugg

SEQ ID NO: 450864 - RNA, 25 nt, Human
auuucauucacaccccccaccccca

SEQ ID NO: 450865 - RNA, 24 nt, Human
caaacccaacuuuggcuaauguca

SEQ ID NO: 450866 - RNA, 19 nt, Human
caccccccacccccacagu

SEQ ID NO: 450867 - RNA, 21 nt, Human
caucacuacaaacugagcaca

SEQ ID NO: 450868 - RNA, 19 nt, Human
caucagacacaugacacuc

SEQ ID NO: 450869 - RNA, 22 nt, Human
cauucugcuacuuucccaaaga

SEQ ID NO: 450870 - RNA, 22 nt, Human
cauuucauucacaccccccacc

SEQ ID NO: 450871 - RNA, 20 nt, Human
ccacucaugggaaagaagcg

SEQ ID NO: 450872 - RNA, 20 nt, Human
ccagcauuauuuauuugauc

SEQ ID NO: 450873 - RNA, 21 nt, Human
cccacagucagacugaaaacu

SEQ ID NO: 450874 - RNA, 25 nt, Human
cccaucacuacaaacugagcacaac

SEQ ID NO: 450875 - RNA, 20 nt, Human
cccaucuucccuccuguucu

SEQ ID NO: 450876 - RNA, 20 nt, Human
ccccaaaagauacagagaau

SEQ ID NO: 450877 - RNA, 20 nt, Human
ccccacccccacagucagac

SEQ ID NO: 450878 - RNA, 24 nt, Human
ccccacccccacagucagacugaa

SEQ ID NO: 450879 - RNA, 22 nt, Human
cccccacccccacagucagacu

SEQ ID NO: 450880 - RNA, 18 nt, Human
ccccccacccccacaguc

SEQ ID NO: 450881 - RNA, 22 nt, Human
ccccccacccccacagucagac

SEQ ID NO: 450882 - RNA, 21 nt, Human
cccuccuguucucucccaucc

SEQ ID NO: 450883 - RNA, 23 nt, Human
cuacagcuguuauuuguacagcc

SEQ ID NO: 450884 - RNA, 21 nt, Human
cugaacacugaaaaacugcca

SEQ ID NO: 450885 - RNA, 19 nt, Human
cuucccuuuuucuuucuuu

SEQ ID NO: 450886 - RNA, 21 nt, Human
gaaaaucauauuccuuuaucc

SEQ ID NO: 450887 - RNA, 23 nt, Human
gaaaaugagaauaaugggaggga

SEQ ID NO: 450888 - RNA, 24 nt, Human
gagcacaacuacaguugucuacac

SEQ ID NO: 450889 - RNA, 24 nt, Human
gaugguggagaaagguaaaaggaa

SEQ ID NO: 450890 - RNA, 19 nt, Human
ggagguaauaaguuuugga

SEQ ID NO: 450891 - RNA, 22 nt, Human
ggggagguaauaaguuuuggaa

SEQ ID NO: 450892 - RNA, 19 nt, Human
ggggucaguccugcagacc

SEQ ID NO: 450893 - RNA, 18 nt, Human
gggucaguccugcagacc

SEQ ID NO: 450894 - RNA, 18 nt, Human
gguaaguaaaaaaucuac

SEQ ID NO: 450895 - RNA, 21 nt, Human
gguaauaaguuuuggaaagaa

SEQ ID NO: 450896 - RNA, 18 nt, Human
ggugaagaacauuacaaa

SEQ ID NO: 450897 - RNA, 25 nt, Human
gguggaaaaacccauugguacuucc

SEQ ID NO: 450898 - RNA, 22 nt, Human
guuuuuuuauagaaaaauuagg

SEQ ID NO: 450899 - RNA, 23 nt, Human
uaagguggaaaaacccauuggua

SEQ ID NO: 450900 - RNA, 22 nt, Human
uaagugcuuugugcaacaacgu

SEQ ID NO: 450901 - RNA, 21 nt, Human
uacccccaaaagauacagaga

SEQ ID NO: 450902 - RNA, 25 nt, Human
uaggggagguaauaaguuuuggaaa

SEQ ID NO: 450903 - RNA, 21 nt, Human
uaguuuauuuggaaagugguu

SEQ ID NO: 450904 - RNA, 24 nt, Human
uaguuuguuuuuuuauagaaaaau

SEQ ID NO: 450905 - RNA, 19 nt, Human
uaucagaagcaaacaugga

SEQ ID NO: 450906 - RNA, 19 nt, Human
uaucucaugaaguggcagu

SEQ ID NO: 450907 - RNA, 23 nt, Human
ucacaauguugacacaugcaggg

SEQ ID NO: 450908 - RNA, 23 nt, Human
ucagacacaugacacucugugac

SEQ ID NO: 450909 - RNA, 26 nt, Human
ucagacacaugacacucugugacauc

SEQ ID NO: 450910 - RNA, 22 nt, Human
uccaggcuuuaguuuauuugga

SEQ ID NO: 450911 - RNA, 21 nt, Human
uccauuuaucagaagcaaaca

SEQ ID NO: 450912 - RNA, 23 nt, Human
uccuguuauacccucucccuacc

SEQ ID NO: 450913 - RNA, 25 nt, Human
uccuuggggucaguccugcagaccu

SEQ ID NO: 450914 - RNA, 18 nt, Human
ucugcaaggguagaucaa

SEQ ID NO: 450915 - RNA, 23 nt, Human
ucugugacauccauuucauucac

SEQ ID NO: 450916 - RNA, 19 nt, Human
ugaaaaaggcaaugaacaa

SEQ ID NO: 450917 - RNA, 21 nt, Human
ugaagaacauuacaaagguua

SEQ ID NO: 450918 - RNA, 25 nt, Human
ugacccaaauauucaccucuagcau

SEQ ID NO: 450919 - RNA, 21 nt, Human
ugccuaggggaugaauggcaa

SEQ ID NO: 450920 - RNA, 23 nt, Human
uggaaagaaacugaaaugcaacc

SEQ ID NO: 450921 - RNA, 24 nt, Human
uggaagaugagcuggcucuggggc

SEQ ID NO: 450922 - RNA, 21 nt, Human
uggacggaggcaaaagucuuc

SEQ ID NO: 450923 - RNA, 24 nt, Human
uggaggagaguuggacaagccaca

SEQ ID NO: 450924 - RNA, 21 nt, Human
uggcagugaaccuacauuucc

SEQ ID NO: 450925 - RNA, 25 nt, Human
uggggucaguccugcagaccugcau

SEQ ID NO: 450926 - RNA, 20 nt, Human
uguagauuaguaaauacuga

SEQ ID NO: 450927 - RNA, 20 nt, Human
uguggugaagaacauuacaa

SEQ ID NO: 450928 - RNA, 23 nt, Human
uguuacagggcugagcagaguug

SEQ ID NO: 450929 - RNA, 21 nt, Human
uguucucucccauccuccaaa

SEQ ID NO: 450930 - RNA, 21 nt, Human
uuaaaagaacaugcaacauga

SEQ ID NO: 450931 - RNA, 19 nt, Human
uuccccuuaugcuuaggug

SEQ ID NO: 450932 - RNA, 21 nt, Human
uucccuuuuucuuucuuuaca

SEQ ID NO: 450933 - RNA, 22 nt, Human
uuccuccagacuuccagucuca

SEQ ID NO: 450934 - RNA, 23 nt, Human
uucuauggcuuuggcugaaaugu

SEQ ID NO: 450935 - RNA, 23 nt, Human
uuggaaagugguuucagcaccug

SEQ ID NO: 450936 - RNA, 18 nt, Human
uugugcccacguuccucc

SEQ ID NO: 450937 - RNA, 18 nt, Human
uuuuuuuuuuuuuuuuug

SEQ ID NO: 450938 - RNA, 21 nt, Human
uuuuuuuuuuuuuuuuugcaa

SEQ ID NO: 450939 - RNA, 18 nt, Human
aaaaagcagaaccaacuc

SEQ ID NO: 450940 - RNA, 19 nt, Human
aaacagccuccuucuccaa

SEQ ID NO: 450941 - RNA, 18 nt, Human
aaagucccaggcaaacug

SEQ ID NO: 450942 - RNA, 19 nt, Human
aaauagcuuuaaaaaaaga

SEQ ID NO: 450943 - RNA, 18 nt, Human
aaauggcccuuccagucc

SEQ ID NO: 450944 - RNA, 22 nt, Human
aagauggcacauuggaugguca

SEQ ID NO: 450945 - RNA, 21 nt, Human
aagcagaaccaacucgcugug

SEQ ID NO: 450946 - RNA, 20 nt, Human
aaggguuauguggaccagug

SEQ ID NO: 450947 - RNA, 25 nt, Human
acaaaaacagccuccuucuccaaac

SEQ ID NO: 450948 - RNA, 19 nt, Human
acccuaaaacacucagaag

SEQ ID NO: 450949 - RNA, 21 nt, Human
acgguugguccuacaagaaaa

SEQ ID NO: 450950 - RNA, 23 nt, Human
acucguaggcucaaagacucacc

SEQ ID NO: 450951 - RNA, 20 nt, Human
agaagaaggggucaaggguu

SEQ ID NO: 450952 - RNA, 18 nt, Human
aggcaaaaagcagaacca

SEQ ID NO: 450953 - RNA, 19 nt, Human
aggcaaaaagcagaaccaa

SEQ ID NO: 450954 - RNA, 21 nt, Human
aggcucaaagacucaccacac

SEQ ID NO: 450955 - RNA, 19 nt, Human
agggucagaagaauggcuu

SEQ ID NO: 450956 - RNA, 19 nt, Human
agguacuagcuuaaggugg

SEQ ID NO: 450957 - RNA, 19 nt, Human
aguagccagaaauuggggg

SEQ ID NO: 450958 - RNA, 22 nt, Human
agucugugacacugaguucaaa

SEQ ID NO: 450959 - RNA, 22 nt, Human
aguuuguacagauuucugcagc

SEQ ID NO: 450960 - RNA, 20 nt, Human
augaagaagaaggggucaag

SEQ ID NO: 450961 - RNA, 21 nt, Human
augaagaagaaggggucaagg

SEQ ID NO: 450962 - RNA, 20 nt, Human
auuccuccaaauacccacca

SEQ ID NO: 450963 - RNA, 22 nt, Human
caaguuuugacucaauccccuc

SEQ ID NO: 450964 - RNA, 23 nt, Human
cagaucuccugaggccacuguuc

SEQ ID NO: 450965 - RNA, 24 nt, Human
cagcuggcuagugcuggcaucauu

SEQ ID NO: 450966 - RNA, 23 nt, Human
ccaccuauuuucccuuuagcugu

SEQ ID NO: 450967 - RNA, 22 nt, Human
ccgacuggguuucccgucuuug

SEQ ID NO: 450968 - RNA, 23 nt, Human
ccuacaagaaaaagagcagcauc

SEQ ID NO: 450969 - RNA, 18 nt, Human
cgcugugccuggaaggga

SEQ ID NO: 450970 - RNA, 26 nt, Human
cucaccacacuuauugcaucuauuuc

SEQ ID NO: 450971 - RNA, 23 nt, Human
cuccaaauacccaccagcuggcu

SEQ ID NO: 450972 - RNA, 18 nt, Human
cuggcaucuuugcugagg

SEQ ID NO: 450973 - RNA, 22 nt, Human
cuggguugauacacuucuugaa

SEQ ID NO: 450974 - RNA, 20 nt, Human
cuuuucuuuggcuuacaggc

SEQ ID NO: 450975 - RNA, 18 nt, Human
gaagaagaaggggucaag

SEQ ID NO: 450976 - RNA, 21 nt, Human
gagagcagcagaaaacuagag

SEQ ID NO: 450977 - RNA, 21 nt, Human
gcacuggguuguaggcuacgc

SEQ ID NO: 450978 - RNA, 25 nt, Human
gcagaccuggcuucuuuggucccag

SEQ ID NO: 450979 - RNA, 21 nt, Human
gcaguucuaaucaacuugcag

SEQ ID NO: 450980 - RNA, 18 nt, Human
gcauucugcuucaagcca

SEQ ID NO: 450981 - RNA, 22 nt, Human
gcuccaguuuccuaggauuugg

SEQ ID NO: 450982 - RNA, 24 nt, Human
ggaagggauguuaaccccgauuca

SEQ ID NO: 450983 - RNA, 22 nt, Human
ggcaaaaagcagaaccaacucg

SEQ ID NO: 450984 - RNA, 24 nt, Human
ggcugguggcaugacucguaggcu

SEQ ID NO: 450985 - RNA, 24 nt, Human
ggguaaauaaacccagaaacuucc

SEQ ID NO: 450986 - RNA, 22 nt, Human
ggucaaggguuauguggaccag

SEQ ID NO: 450987 - RNA, 23 nt, Human
gucaagguuguugaagaaaagaa

SEQ ID NO: 450988 - RNA, 25 nt, Human
guggaccagugacuagguggccucu

SEQ ID NO: 450989 - RNA, 24 nt, Human
guggcucaguaacccuuucuggcu

SEQ ID NO: 450990 - RNA, 22 nt, Human
guuguaccaguugcuccaguuu

SEQ ID NO: 450991 - RNA, 23 nt, Human
uaaauaaacccagaaacuuccau

SEQ ID NO: 450992 - RNA, 19 nt, Human
uagcugugacccuaaaaca

SEQ ID NO: 450993 - RNA, 22 nt, Human
uagcuuaagguggcucaguaac

SEQ ID NO: 450994 - RNA, 24 nt, Human
uaguagcuuuuuagauguggcuuu

SEQ ID NO: 450995 - RNA, 22 nt, Human
ucaaggguuauguggaccagug

SEQ ID NO: 450996 - RNA, 22 nt, Human
ucaauccccucacuggaaacaa

SEQ ID NO: 450997 - RNA, 20 nt, Human
ucagaguguuggcuauaguu

SEQ ID NO: 450998 - RNA, 22 nt, Human
ucaguaaaauaucauaaaagua

SEQ ID NO: 450999 - RNA, 18 nt, Human
ucauaugggccuauucug

SEQ ID NO: 451000 - RNA, 21 nt, Human
ucccugugaagugacacuugc

SEQ ID NO: 451001 - RNA, 23 nt, Human
ucccugugaagugacacuugcuc

SEQ ID NO: 451002 - RNA, 21 nt, Human
ucuaaaccgauuugagaacuc

SEQ ID NO: 451003 - RNA, 18 nt, Human
ucugugacacugaguuca

SEQ ID NO: 451004 - RNA, 22 nt, Human
ucuucugaaacuuuaacucugg

SEQ ID NO: 451005 - RNA, 20 nt, Human
ugaagcccuuaugugcacaa

SEQ ID NO: 451006 - RNA, 23 nt, Human
ugacacugaguucaaauccacuu

SEQ ID NO: 451007 - RNA, 18 nt, Human
ugagagcagcagaaaacu

SEQ ID NO: 451008 - RNA, 19 nt, Human
ugaggagguucucaaguga

SEQ ID NO: 451009 - RNA, 22 nt, Human
ugaggguguuacagcuuucaga

SEQ ID NO: 451010 - RNA, 19 nt, Human
ugagguaccugagauccaa

SEQ ID NO: 451011 - RNA, 21 nt, Human
ugccaggaagauggucagagg

SEQ ID NO: 451012 - RNA, 25 nt, Human
ugccuggguugauacacuucuugaa

SEQ ID NO: 451013 - RNA, 21 nt, Human
ugcugaggagguucucaagug

SEQ ID NO: 451014 - RNA, 21 nt, Human
uggaaacuuacggcacugggu

SEQ ID NO: 451015 - RNA, 21 nt, Human
uggaaacuuacggcacugggu

SEQ ID NO: 451016 - RNA, 22 nt, Human
uggcaucauuauauggcagagg

SEQ ID NO: 451017 - RNA, 23 nt, Human
uggggccagcacuuccuccaugg

SEQ ID NO: 451018 - RNA, 18 nt, Human
uguacagauuucugcagc

SEQ ID NO: 451019 - RNA, 22 nt, Human
uguaccaguugcuccaguuucc

SEQ ID NO: 451020 - RNA, 18 nt, Human
ugugaaauaaaaaucccu

SEQ ID NO: 451021 - RNA, 21 nt, Human
ugugacccuaaaacacucaga

SEQ ID NO: 451022 - RNA, 21 nt, Human
ugugucagaccccuuggggcc

SEQ ID NO: 451023 - RNA, 22 nt, Human
ugugucagaccccuuggggcca

SEQ ID NO: 451024 - RNA, 21 nt, Human
uguuauaggggaauagugguu

SEQ ID NO: 451025 - RNA, 23 nt, Human
uucaagccaccugcauccuagag

SEQ ID NO: 451026 - RNA, 22 nt, Human
uuccauauccugagauauugcc

SEQ ID NO: 451027 - RNA, 20 nt, Human
uuuaacacuguuuugagcuu

SEQ ID NO: 451028 - RNA, 24 nt, Human
uuuggcuuacaggcaaaaagcaga

SEQ ID NO: 451029 - RNA, 24 nt, Human
aaaaccaaauuuuucuaagaaccu

SEQ ID NO: 451030 - RNA, 24 nt, Human
aaaaggcaaagcaauauucuggua

SEQ ID NO: 451031 - RNA, 25 nt, Human
aaacagucauaagaaagcagaaagc

SEQ ID NO: 451032 - RNA, 20 nt, Human
aaaugaucaugguccaaaac

SEQ ID NO: 451033 - RNA, 21 nt, Human
aaccucauagaaaccuccaga

SEQ ID NO: 451034 - RNA, 22 nt, Human
aaccuugaaagaauacuugcaa

SEQ ID NO: 451035 - RNA, 18 nt, Human
aagaaagcagaaagcaac

SEQ ID NO: 451036 - RNA, 20 nt, Human
aagaugauuugagggcuuau

SEQ ID NO: 451037 - RNA, 24 nt, Human
aaugggccacaggcugagcugaug

SEQ ID NO: 451038 - RNA, 19 nt, Human
aauggggcuacugaaagca

SEQ ID NO: 451039 - RNA, 21 nt, Human
acauauaaaauccugccaaca

SEQ ID NO: 451040 - RNA, 22 nt, Human
accaauguauuaaaaacuacuu

SEQ ID NO: 451041 - RNA, 22 nt, Human
acccuagaaucccucuuucccu

SEQ ID NO: 451042 - RNA, 20 nt, Human
accugaaaagucucagggua

SEQ ID NO: 451043 - RNA, 22 nt, Human
accugcucuggugucugguacc

SEQ ID NO: 451044 - RNA, 21 nt, Human
acucuagcccucuaucacaaa

SEQ ID NO: 451045 - RNA, 21 nt, Human
agaaagcagaaagcaacuucc

SEQ ID NO: 451046 - RNA, 18 nt, Human
agagguuuggagauuuug

SEQ ID NO: 451047 - RNA, 23 nt, Human
agauccucggcgauguucagggc

SEQ ID NO: 451048 - RNA, 21 nt, Human
agcauggagauucaggaagga

SEQ ID NO: 451049 - RNA, 18 nt, Human
aggaaugcauuccugguc

SEQ ID NO: 451050 - RNA, 28 nt, Human
aggcaugcuuugugacuuuccucagaag

SEQ ID NO: 451051 - RNA, 23 nt, Human
aggcuacaaaaaugucagaccaa

SEQ ID NO: 451052 - RNA, 21 nt, Human
aguuucuguuuauaucucaua

SEQ ID NO: 451053 - RNA, 20 nt, Human
auacaaacauacaauaaugc

SEQ ID NO: 451054 - RNA, 21 nt, Human
aucccucuuuccccuuuccaa

SEQ ID NO: 451055 - RNA, 19 nt, Human
auuacauuaagcaaaguac

SEQ ID NO: 451056 - RNA, 21 nt, Human
caaaauaguaggcagaaggua

SEQ ID NO: 451057 - RNA, 23 nt, Human
caaauccugccacacuacaucuu

SEQ ID NO: 451058 - RNA, 21 nt, Human
cacuacaucuucgaaaaacca

SEQ ID NO: 451059 - RNA, 24 nt, Human
cacuucacuggcuccuucuccacu

SEQ ID NO: 451060 - RNA, 18 nt, Human
cagagaacaacuuguauu

SEQ ID NO: 451061 - RNA, 19 nt, Human
cagcaagaugauuugaggg

SEQ ID NO: 451062 - RNA, 19 nt, Human
cagccagaagaccaaaagc

SEQ ID NO: 451063 - RNA, 18 nt, Human
cagcugcugugaggauaa

SEQ ID NO: 451064 - RNA, 18 nt, Human
caugcuuugugacuuucc

SEQ ID NO: 451065 - RNA, 23 nt, Human
caugucccuuauggaaaaacaag

SEQ ID NO: 451066 - RNA, 21 nt, Human
ccaaaaaguuuuacaaaagca

SEQ ID NO: 451067 - RNA, 22 nt, Human
ccaacaccugaaaagucucagg

SEQ ID NO: 451068 - RNA, 23 nt, Human
ccaaccuugaaagaauacuugca

SEQ ID NO: 451069 - RNA, 18 nt, Human
ccgacuggagccugacca

SEQ ID NO: 451070 - RNA, 22 nt, Human
ccucuucaaaaucccucuucca

SEQ ID NO: 451071 - RNA, 24 nt, Human
ccugccacacuacaucuucgaaaa

SEQ ID NO: 451072 - RNA, 20 nt, Human
ccuggucccugaugaaaccc

SEQ ID NO: 451073 - RNA, 23 nt, Human
cuagaaucccucuuuccccuuuc

SEQ ID NO: 451074 - RNA, 22 nt, Human
cucauagaaaccuccagagaac

SEQ ID NO: 451075 - RNA, 22 nt, Human
cucucgguuuugccauauugcu

SEQ ID NO: 451076 - RNA, 23 nt, Human
cuggccuuacuuagaauaaaauc

SEQ ID NO: 451077 - RNA, 23 nt, Human
cuguccugcagcugggggcucuc

SEQ ID NO: 451078 - RNA, 18 nt, Human
gacuccaaccuccuggca

SEQ ID NO: 451079 - RNA, 19 nt, Human
gagagaaauaggaaucaag

SEQ ID NO: 451080 - RNA, 21 nt, Human
gagcauggagauucaggaagg

SEQ ID NO: 451081 - RNA, 19 nt, Human
gaggcuccaacaccugaaa

SEQ ID NO: 451082 - RNA, 24 nt, Human
gcacuucacuggcuccuucuccac

SEQ ID NO: 451083 - RNA, 18 nt, Human
gcagcugggggcucucgg

SEQ ID NO: 451084 - RNA, 19 nt, Human
gcaguaaucaaauccugcc

SEQ ID NO: 451085 - RNA, 18 nt, Human
gcuucaguuuccuaacug

SEQ ID NO: 451086 - RNA, 26 nt, Human
ggaaaaacaagucauucuugcuugga

SEQ ID NO: 451087 - RNA, 23 nt, Human
ggaaaagagguacugaaucuguc

SEQ ID NO: 451088 - RNA, 20 nt, Human
ggcgauguucagggcucggc

SEQ ID NO: 451089 - RNA, 18 nt, Human
guaaaaggcaugcuuugu

SEQ ID NO: 451090 - RNA, 23 nt, Human
gucaaacucuagcccucuaucac

SEQ ID NO: 451091 - RNA, 18 nt, Human
gucucuggaagauuguuu

SEQ ID NO: 451092 - RNA, 22 nt, Human
guuuggagauuuuggaauugug

SEQ ID NO: 451093 - RNA, 19 nt, Human
uaaaaacagucauaagaaa

SEQ ID NO: 451094 - RNA, 21 nt, Human
uaaaaagcuauuaauaggcac

SEQ ID NO: 451095 - RNA, 21 nt, Human
uaaauagagauaggacuucaa

SEQ ID NO: 451096 - RNA, 21 nt, Human
uaacagaaggcuacaaaaaug

SEQ ID NO: 451097 - RNA, 18 nt, Human
uaagaaagcagaaagcaa

SEQ ID NO: 451098 - RNA, 22 nt, Human
uaagaaccucauagaaaccucc

SEQ ID NO: 451099 - RNA, 23 nt, Human
uaagaaccucauagaaaccucca

SEQ ID NO: 451100 - RNA, 21 nt, Human
uaagcaguauaauuauacccu

SEQ ID NO: 451101 - RNA, 25 nt, Human
uacaggaaaucacccaaugggccac

SEQ ID NO: 451102 - RNA, 21 nt, Human
uagaaaacuaaacccugagaa

SEQ ID NO: 451103 - RNA, 23 nt, Human
uaggcagaagguagaaaacuaaa

SEQ ID NO: 451104 - RNA, 21 nt, Human
uauaagaaaaggcaaagcaau

SEQ ID NO: 451105 - RNA, 22 nt, Human
uauaagaaaaggcaaagcaaua

SEQ ID NO: 451106 - RNA, 21 nt, Human
uauggcuucaguuuccuaacu

SEQ ID NO: 451107 - RNA, 19 nt, Human
ucaaaagaacuucaacagg

SEQ ID NO: 451108 - RNA, 23 nt, Human
ucaaaagaacuucaacaggaaua

SEQ ID NO: 451109 - RNA, 18 nt, Human
ucacuggcuccuucucca

SEQ ID NO: 451110 - RNA, 19 nt, Human
ucagaccaaaauaguaggc

SEQ ID NO: 451111 - RNA, 19 nt, Human
ucagggaaugaaugccagc

SEQ ID NO: 451112 - RNA, 24 nt, Human
uccccuuuccaaugaaggcuccac

SEQ ID NO: 451113 - RNA, 24 nt, Human
uccugccacacuacaucuucgaaa

SEQ ID NO: 451114 - RNA, 18 nt, Human
ucucaaaugacuccccuu

SEQ ID NO: 451115 - RNA, 21 nt, Human
ucuucaaaaucccucuuccaa

SEQ ID NO: 451116 - RNA, 20 nt, Human
ugaaaaauauuucaguuuuc

SEQ ID NO: 451117 - RNA, 26 nt, Human
ugaaaagucucaggguauuguaaaaa

SEQ ID NO: 451118 - RNA, 20 nt, Human
ugaaaaugcuuuuacaaaau

SEQ ID NO: 451119 - RNA, 21 nt, Human
ugacaacaucuauacagaggc

SEQ ID NO: 451120 - RNA, 20 nt, Human
ugagagguaugccuacaucu

SEQ ID NO: 451121 - RNA, 21 nt, Human
uggaauuguggauaugagauu

SEQ ID NO: 451122 - RNA, 20 nt, Human
uggcaguaaucaaauccugc

SEQ ID NO: 451123 - RNA, 21 nt, Human
uggcugacaacuuucaaauau

SEQ ID NO: 451124 - RNA, 25 nt, Human
uggugauaugauauguccaucaggc

SEQ ID NO: 451125 - RNA, 18 nt, Human
uuacaacuaaagccagca

SEQ ID NO: 451126 - RNA, 24 nt, Human
uucaaaaucccucuuccaaccuuu

SEQ ID NO: 451127 - RNA, 20 nt, Human
uuccuagaguaaaagagcuc

SEQ ID NO: 451128 - RNA, 18 nt, Human
uucuggaugacugguggc

SEQ ID NO: 451129 - RNA, 18 nt, Human
uuggaauuguggauauga

SEQ ID NO: 451130 - RNA, 23 nt, Human
uuucacuuccuuaaacucucucu

SEQ ID NO: 451131 - RNA, 18 nt, Human
uuucagggaaugaaugcc

SEQ ID NO: 451132 - RNA, 22 nt, Human
uuugugacuuuccuucuaaguu

SEQ ID NO: 451133 - RNA, 18 nt, Human
uuuuuuccguauuuccuc

SEQ ID NO: 451134 - RNA, 19 nt, Human
aaagaugaucggcugucuu

SEQ ID NO: 451135 - RNA, 20 nt, Human
aaagaugaucggcugucuua

SEQ ID NO: 451136 - RNA, 20 nt, Human
aacauggugaaacccugucu

SEQ ID NO: 451137 - RNA, 21 nt, Human
aacauggugaaacccugucuc

SEQ ID NO: 451138 - RNA, 20 nt, Human
aacccugucuccgccaaaaa

SEQ ID NO: 451139 - RNA, 27 nt, Human
aagaggaacagcaauucuuucugccac

SEQ ID NO: 451140 - RNA, 23 nt, Human
aaguaaaauaaaauaaaacacaa

SEQ ID NO: 451141 - RNA, 24 nt, Human
aaucacuugaauccgggaggugga

SEQ ID NO: 451142 - RNA, 19 nt, Human
acaacagcgaaacuccauc

SEQ ID NO: 451143 - RNA, 20 nt, Human
acaacagcgaaacuccaucu

SEQ ID NO: 451144 - RNA, 21 nt, Human
acaacagcgaaacuccaucuc

SEQ ID NO: 451145 - RNA, 18 nt, Human
acaccacugcacuccagc

SEQ ID NO: 451146 - RNA, 20 nt, Human
acaccacugcacuccagccu

SEQ ID NO: 451147 - RNA, 24 nt, Human
acaccagagagcaaggaaucaaac

SEQ ID NO: 451148 - RNA, 20 nt, Human
accacacccggcuuaggcag

SEQ ID NO: 451149 - RNA, 19 nt, Human
accacugcacuccagccug

SEQ ID NO: 451150 - RNA, 24 nt, Human
accacugcacuccagccuggguga

SEQ ID NO: 451151 - RNA, 19 nt, Human
accagcagcaagaacaggc

SEQ ID NO: 451152 - RNA, 24 nt, Human
acccagacacaccauggucucuuc

SEQ ID NO: 451153 - RNA, 20 nt, Human
accucuaaaaccaacagaau

SEQ ID NO: 451154 - RNA, 19 nt, Human
acuacagaugcaugccacc

SEQ ID NO: 451155 - RNA, 18 nt, Human
acucugucacccaggcug

SEQ ID NO: 451156 - RNA, 25 nt, Human
acucugucacccaggcuggaaugca

SEQ ID NO: 451157 - RNA, 18 nt, Human
acugcacuccagccuggg

SEQ ID NO: 451158 - RNA, 27 nt, Human
acugcacuccagccugggugacaacag

SEQ ID NO: 451159 - RNA, 19 nt, Human
acugcagccuugaccuccu

SEQ ID NO: 451160 - RNA, 24 nt, Human
acuugaggucaggaguucgagacc

SEQ ID NO: 451161 - RNA, 22 nt, Human
agaaaggaaacauuguagagga

SEQ ID NO: 451162 - RNA, 20 nt, Human
agaacaauauccuguuagca

SEQ ID NO: 451163 - RNA, 23 nt, Human
agaacaggcuuuaguuuuaagug

SEQ ID NO: 451164 - RNA, 25 nt, Human
agaagcaguugagugaucaggugac

SEQ ID NO: 451165 - RNA, 20 nt, Human
agcacugugggaggcugagg

SEQ ID NO: 451166 - RNA, 22 nt, Human
agccuggccaacauggugaaac

SEQ ID NO: 451167 - RNA, 24 nt, Human
agccuggccaacauggugaaaccc

SEQ ID NO: 451168 - RNA, 23 nt, Human
agcugggcaugguggugugugcc

SEQ ID NO: 451169 - RNA, 20 nt, Human
aggaaacauuguagaggaga

SEQ ID NO: 451170 - RNA, 19 nt, Human
aggaggcugaggcuggaga

SEQ ID NO: 451171 - RNA, 18 nt, Human
aggcaaucgggugagagu

SEQ ID NO: 451172 - RNA, 18 nt, Human
aggcaggcggaucacuug

SEQ ID NO: 451173 - RNA, 22 nt, Human
aggcaggcggaucacuugaggu

SEQ ID NO: 451174 - RNA, 26 nt, Human
aggcaggcggaucacuugaggucagg

SEQ ID NO: 451175 - RNA, 21 nt, Human
aggcugaggcaggcggaucac

SEQ ID NO: 451176 - RNA, 24 nt, Human
aggcugaggcaggcggaucacuug

SEQ ID NO: 451177 - RNA, 24 nt, Human
aggcugaggcuggagaaucacuug

SEQ ID NO: 451178 - RNA, 18 nt, Human
aggcuggagaaucacuug

SEQ ID NO: 451179 - RNA, 24 nt, Human
aggcuggagaaucacuugaauccg

SEQ ID NO: 451180 - RNA, 21 nt, Human
agguggagguugcagugagcc

SEQ ID NO: 451181 - RNA, 24 nt, Human
agguggagguugcagugagccgag

SEQ ID NO: 451182 - RNA, 22 nt, Human
agucuuguccuucuccaaucac

SEQ ID NO: 451183 - RNA, 24 nt, Human
aucacaccacugcacuccagccug

SEQ ID NO: 451184 - RNA, 19 nt, Human
aucacccuucacauagugg

SEQ ID NO: 451185 - RNA, 21 nt, Human
aucacuugaggucaggaguuc

SEQ ID NO: 451186 - RNA, 18 nt, Human
aucucacucugucaccca

SEQ ID NO: 451187 - RNA, 22 nt, Human
auggucucuucaugacuguggc

SEQ ID NO: 451188 - RNA, 23 nt, Human
caacauggugaaacccugucucc

SEQ ID NO: 451189 - RNA, 23 nt, Human
caagccgggugcgguggcucacg

SEQ ID NO: 451190 - RNA, 20 nt, Human
caagugauccuccugccuua

SEQ ID NO: 451191 - RNA, 27 nt, Human
caagugauccuccugccuuaaucuccu

SEQ ID NO: 451192 - RNA, 18 nt, Human
caauuuccagagcuguag

SEQ ID NO: 451193 - RNA, 21 nt, Human
cacaccacugcacuccagccu

SEQ ID NO: 451194 - RNA, 19 nt, Human
caccacacccggcuuaggc

SEQ ID NO: 451195 - RNA, 24 nt, Human
caccuauuggauaaaacucaaagu

SEQ ID NO: 451196 - RNA, 22 nt, Human
cacgccuguaaucccagcacug

SEQ ID NO: 451197 - RNA, 18 nt, Human
cacuccagccugggugac

SEQ ID NO: 451198 - RNA, 19 nt, Human
cacuccagccugggugaca

SEQ ID NO: 451199 - RNA, 25 nt, Human
cacuccagccugggugacaacagcg

SEQ ID NO: 451200 - RNA, 22 nt, Human
cacucugucacccaggcuggaa

SEQ ID NO: 451201 - RNA, 23 nt, Human
cacucugucacccaggcuggaau

SEQ ID NO: 451202 - RNA, 19 nt, Human
cacugcacuccagccuggg

SEQ ID NO: 451203 - RNA, 19 nt, Human
cacugcacuccagccuggg

SEQ ID NO: 451204 - RNA, 22 nt, Human
cacugcacuccagccuggguga

SEQ ID NO: 451205 - RNA, 23 nt, Human
cacugcacuccagccugggugac

SEQ ID NO: 451206 - RNA, 24 nt, Human
cacugcacuccagccugggugaca

SEQ ID NO: 451207 - RNA, 25 nt, Human
cacugcacuccagccugggugacaa

SEQ ID NO: 451208 - RNA, 19 nt, Human
cacugcagccuugaccucc

SEQ ID NO: 451209 - RNA, 23 nt, Human
cacuugaggucaggaguucgaga

SEQ ID NO: 451210 - RNA, 22 nt, Human
cagagacaggaucucacucugu

SEQ ID NO: 451211 - RNA, 24 nt, Human
cagcacugugggaggcugaggcag

SEQ ID NO: 451212 - RNA, 26 nt, Human
cagcacugugggaggcugaggcaggc

SEQ ID NO: 451213 - RNA, 22 nt, Human
cagcagcaagaacaggcuuuag

SEQ ID NO: 451214 - RNA, 23 nt, Human
cagccuugaccuccugggcucaa

SEQ ID NO: 451215 - RNA, 24 nt, Human
cagccuugaccuccugggcucaag

SEQ ID NO: 451216 - RNA, 24 nt, Human
cagcucacugcagccuugaccucc

SEQ ID NO: 451217 - RNA, 24 nt, Human
caggaggcugaggcuggagaauca

SEQ ID NO: 451218 - RNA, 27 nt, Human
caugccaccacacccggcuuaggcaga

SEQ ID NO: 451219 - RNA, 20 nt, Human
ccacugcacuccagccuggg

SEQ ID NO: 451220 - RNA, 20 nt, Human
ccacugcacuccagccuggg

SEQ ID NO: 451221 - RNA, 20 nt, Human
ccacugcacuccagccuggg

SEQ ID NO: 451222 - RNA, 21 nt, Human
ccacugcacuccagccugggu

SEQ ID NO: 451223 - RNA, 21 nt, Human
ccacugcacuccagccugggu

SEQ ID NO: 451224 - RNA, 23 nt, Human
ccacugcacuccagccuggguga

SEQ ID NO: 451225 - RNA, 24 nt, Human
ccacugcacuccagccugggugac

SEQ ID NO: 451226 - RNA, 27 nt, Human
ccacugcacuccagccugggugacaac

SEQ ID NO: 451227 - RNA, 18 nt, Human
ccagagcuguagcugcug

SEQ ID NO: 451228 - RNA, 22 nt, Human
ccauaugcuaaguguucucccc

SEQ ID NO: 451229 - RNA, 18 nt, Human
cccugagacacuauacua

SEQ ID NO: 451230 - RNA, 21 nt, Human
cccuuuucauuccaguuacau

SEQ ID NO: 451231 - RNA, 18 nt, Human
ccuccugccuuaaucucc

SEQ ID NO: 451232 - RNA, 24 nt, Human
ccuccugggcucaagugauccucc

SEQ ID NO: 451233 - RNA, 18 nt, Human
ccuccuuccuuauugccc

SEQ ID NO: 451234 - RNA, 22 nt, Human
ccuggccaacauggugaaaccc

SEQ ID NO: 451235 - RNA, 24 nt, Human
ccuggccaacauggugaaacccug

SEQ ID NO: 451236 - RNA, 22 nt, Human
ccugggcucaagugauccuccu

SEQ ID NO: 451237 - RNA, 23 nt, Human
ccugggcucaagugauccuccug

SEQ ID NO: 451238 - RNA, 21 nt, Human
ccuguaaucccagcacugugg

SEQ ID NO: 451239 - RNA, 21 nt, Human
ccuguaaucccagcuacucag

SEQ ID NO: 451240 - RNA, 22 nt, Human
ccuguaaucccagcuacucagg

SEQ ID NO: 451241 - RNA, 22 nt, Human
ccuuaaucuccugaauaggugg

SEQ ID NO: 451242 - RNA, 22 nt, Human
ccuugaccuccugggcucaagu

SEQ ID NO: 451243 - RNA, 19 nt, Human
ccuugugccagccuucccc

SEQ ID NO: 451244 - RNA, 24 nt, Human
cgagaccagccuggccaacauggu

SEQ ID NO: 451245 - RNA, 21 nt, Human
cgccaaaaauacaaaaguuag

SEQ ID NO: 451246 - RNA, 23 nt, Human
cgccuguaaucccagcacugugg

SEQ ID NO: 451247 - RNA, 24 nt, Human
cgccuguaaucccagcacuguggg

SEQ ID NO: 451248 - RNA, 24 nt, Human
cggaucacuugaggucaggaguuc

SEQ ID NO: 451249 - RNA, 27 nt, Human
cggaucacuugaggucaggaguucgag

SEQ ID NO: 451250 - RNA, 29 nt, Human
cgggagguggagguugcagugacaacggu

SEQ ID NO: 451251 - RNA, 24 nt, Human
cgggagguggagguugcagugagc

SEQ ID NO: 451252 - RNA, 22 nt, Human
cucaaaguccucuuuccauccc

SEQ ID NO: 451253 - RNA, 24 nt, Human
cucaagugauccuccugccuuaau

SEQ ID NO: 451254 - RNA, 22 nt, Human
cucacgccuguaaucccagcac

SEQ ID NO: 451255 - RNA, 23 nt, Human
cucacgccuguaaucccagcacu

SEQ ID NO: 451256 - RNA, 24 nt, Human
cucacugcagccuugaccuccugg

SEQ ID NO: 451257 - RNA, 21 nt, Human
cuccuagguggcauuuaaacu

SEQ ID NO: 451258 - RNA, 19 nt, Human
cugaagcugagaaaaaccu

SEQ ID NO: 451259 - RNA, 22 nt, Human
cugcagccuugaccuccugggc

SEQ ID NO: 451260 - RNA, 23 nt, Human
cugcagccuugaccuccugggcu

SEQ ID NO: 451261 - RNA, 20 nt, Human
cugccugaagcugagaaaaa

SEQ ID NO: 451262 - RNA, 24 nt, Human
cuggccaacauggugaaacccugu

SEQ ID NO: 451263 - RNA, 21 nt, Human
cuugaauccgggagguggagg

SEQ ID NO: 451264 - RNA, 18 nt, Human
cuugaucaacaaugucac

SEQ ID NO: 451265 - RNA, 24 nt, Human
cuuuucauuccaguuacauaaacu

SEQ ID NO: 451266 - RNA, 19 nt, Human
cuuuuguucucaucuuucc

SEQ ID NO: 451267 - RNA, 23 nt, Human
gagaaucacuugaauccgggagg

SEQ ID NO: 451268 - RNA, 23 nt, Human
gagaucacaccacugcacuccag

SEQ ID NO: 451269 - RNA, 18 nt, Human
gaggcugaggcuggagaa

SEQ ID NO: 451270 - RNA, 22 nt, Human
gagguugcagugagccgagauc

SEQ ID NO: 451271 - RNA, 24 nt, Human
gaucacuugaggucaggaguucga

SEQ ID NO: 451272 - RNA, 20 nt, Human
gccaaaaauacaaaaguuag

SEQ ID NO: 451273 - RNA, 24 nt, Human
gccaacauggugaaacccugucuc

SEQ ID NO: 451274 - RNA, 18 nt, Human
gccaccacacccggcuua

SEQ ID NO: 451275 - RNA, 21 nt, Human
gccaccacacccggcuuaggc

SEQ ID NO: 451276 - RNA, 20 nt, Human
gccgagaucacaccacugca

SEQ ID NO: 451277 - RNA, 21 nt, Human
gcggaucacuugaggucagga

SEQ ID NO: 451278 - RNA, 19 nt, Human
gcucaagugauccuccugc

SEQ ID NO: 451279 - RNA, 20 nt, Human
gcucaagugauccuccugcc

SEQ ID NO: 451280 - RNA, 21 nt, Human
ggaaggagauuccaaagagga

SEQ ID NO: 451281 - RNA, 20 nt, Human
ggaggcagaaguuucuuagg

SEQ ID NO: 451282 - RNA, 20 nt, Human
ggagguugcagugagccgag

SEQ ID NO: 451283 - RNA, 22 nt, Human
ggagguugcagugagccgagau

SEQ ID NO: 451284 - RNA, 23 nt, Human
ggagguugcagugagccgagauc

SEQ ID NO: 451285 - RNA, 24 nt, Human
ggagguugcagugagccgagauca

SEQ ID NO: 451286 - RNA, 22 nt, Human
ggaucacuugaggucaggaguu

SEQ ID NO: 451287 - RNA, 23 nt, Human
ggaucacuugaggucaggaguuc

SEQ ID NO: 451288 - RNA, 25 nt, Human
ggcagguuuuuuuuuucuucagaga

SEQ ID NO: 451289 - RNA, 21 nt, Human
ggcucacgccuguaaucccag

SEQ ID NO: 451290 - RNA, 21 nt, Human
gggaggcagaaguuucuuagg

SEQ ID NO: 451291 - RNA, 24 nt, Human
gggcaugguggugugugccuguaa

SEQ ID NO: 451292 - RNA, 22 nt, Human
gggcucaagugauccuccugcc

SEQ ID NO: 451293 - RNA, 24 nt, Human
gggugcgguggcucacgccuguaa

SEQ ID NO: 451294 - RNA, 23 nt, Human
gguggcucacgccuguaauccca

SEQ ID NO: 451295 - RNA, 24 nt, Human
gguggcucacgccuguaaucccag

SEQ ID NO: 451296 - RNA, 24 nt, Human
gguggugugugccuguaaucccag

SEQ ID NO: 451297 - RNA, 24 nt, Human
gguuuugggagaaaggaaacauug

SEQ ID NO: 451298 - RNA, 22 nt, Human
gucucuucaugacuguggcuuu

SEQ ID NO: 451299 - RNA, 24 nt, Human
guggugugugccuguaaucccagc

SEQ ID NO: 451300 - RNA, 18 nt, Human
gugguuggccucccuuua

SEQ ID NO: 451301 - RNA, 19 nt, Human
guugcagugagccgagauc

SEQ ID NO: 451302 - RNA, 20 nt, Human
guuuguuuuuguauuuucca

SEQ ID NO: 451303 - RNA, 22 nt, Human
uaaaacacaaaugugaucacag

SEQ ID NO: 451304 - RNA, 24 nt, Human
uaaaacacaaaugugaucacagag

SEQ ID NO: 451305 - RNA, 18 nt, Human
uaaaacagaaacagaacu

SEQ ID NO: 451306 - RNA, 18 nt, Human
uaaaacagaaacagaacu

SEQ ID NO: 451307 - RNA, 28 nt, Human
uaaaauaaaacacaaaugugaucacaga

SEQ ID NO: 451308 - RNA, 22 nt, Human
uaaaauguucaaaauugaucuc

SEQ ID NO: 451309 - RNA, 20 nt, Human
uaaacugcucacaguuaccc

SEQ ID NO: 451310 - RNA, 21 nt, Human
uaaacuggcuaaugggccuug

SEQ ID NO: 451311 - RNA, 21 nt, Human
uaaccaccccugauggucuca

SEQ ID NO: 451312 - RNA, 20 nt, Human
uaagaaaauggguugagagg

SEQ ID NO: 451313 - RNA, 21 nt, Human
uaagcgaguucccuuaaccca

SEQ ID NO: 451314 - RNA, 23 nt, Human
uaaucauaauagaaauucuccuu

SEQ ID NO: 451315 - RNA, 23 nt, Human
uacagaugcaugccaccacaccc

SEQ ID NO: 451316 - RNA, 26 nt, Human
uacaucuccacaucaaugucugacca

SEQ ID NO: 451317 - RNA, 21 nt, Human
uaccagcagcaagaacaggcu

SEQ ID NO: 451318 - RNA, 23 nt, Human
uaccaugagauaaaacagaaaca

SEQ ID NO: 451319 - RNA, 20 nt, Human
uaugcuaaguguucucccca

SEQ ID NO: 451320 - RNA, 20 nt, Human
uauguuuacaugacuggcuu

SEQ ID NO: 451321 - RNA, 23 nt, Human
ucacaccacugcacuccagccug

SEQ ID NO: 451322 - RNA, 19 nt, Human
ucacccaggcuggaaugca

SEQ ID NO: 451323 - RNA, 23 nt, Human
ucacugcagccuugaccuccugg

SEQ ID NO: 451324 - RNA, 24 nt, Human
ucacugcagccuugaccuccuggg

SEQ ID NO: 451325 - RNA, 24 nt, Human
ucacuugaauccgggagguggagg

SEQ ID NO: 451326 - RNA, 20 nt, Human
ucacuugaggucaggaguuc

SEQ ID NO: 451327 - RNA, 18 nt, Human
ucauuguauguuuguuug

SEQ ID NO: 451328 - RNA, 23 nt, Human
uccagccugggugacaacagcga

SEQ ID NO: 451329 - RNA, 21 nt, Human
uccauuaaccuacuauagaag

SEQ ID NO: 451330 - RNA, 24 nt, Human
ucccagaacaauauccuguuagca

SEQ ID NO: 451331 - RNA, 20 nt, Human
ucccagggaaggaccuugcc

SEQ ID NO: 451332 - RNA, 22 nt, Human
ucccugccauuccucugagccc

SEQ ID NO: 451333 - RNA, 21 nt, Human
ucccuuaacccaauguugcuu

SEQ ID NO: 451334 - RNA, 21 nt, Human
uccgggagguggagguugcag

SEQ ID NO: 451335 - RNA, 21 nt, Human
uccugggcucaagugauccuc

SEQ ID NO: 451336 - RNA, 22 nt, Human
uccugggcucaagugauccucc

SEQ ID NO: 451337 - RNA, 24 nt, Human
uccugggcucaagugauccuccug

SEQ ID NO: 451338 - RNA, 19 nt, Human
uccuugugccagccuuccc

SEQ ID NO: 451339 - RNA, 22 nt, Human
ucgaacagcucccacaauguca

SEQ ID NO: 451340 - RNA, 22 nt, Human
ucggcugucuuagauguccauc

SEQ ID NO: 451341 - RNA, 23 nt, Human
ucucacucugucacccaggcugg

SEQ ID NO: 451342 - RNA, 24 nt, Human
ucucacucugucacccaggcugga

SEQ ID NO: 451343 - RNA, 26 nt, Human
ucucacucugucacccaggcuggaau

SEQ ID NO: 451344 - RNA, 27 nt, Human
ucucacucugucacccaggcuggaaug

SEQ ID NO: 451345 - RNA, 19 nt, Human
ucucaucuuuccuucucac

SEQ ID NO: 451346 - RNA, 24 nt, Human
ucugucacccaggcuggaaugcag

SEQ ID NO: 451347 - RNA, 20 nt, Human
ugaagcugagaaaaaccugu

SEQ ID NO: 451348 - RNA, 21 nt, Human
ugaagcugagaaaaaccuguu

SEQ ID NO: 451349 - RNA, 25 nt, Human
ugaccuccugggcucaagugauccu

SEQ ID NO: 451350 - RNA, 22 nt, Human
ugagaggaggcaguuucauugu

SEQ ID NO: 451351 - RNA, 19 nt, Human
ugagauaaaacagaaacag

SEQ ID NO: 451352 - RNA, 24 nt, Human
ugaggcaggcggaucacuugaggu

SEQ ID NO: 451353 - RNA, 26 nt, Human
ugaggcaggcggaucacuugagguca

SEQ ID NO: 451354 - RNA, 20 nt, Human
ugaggcuggagaaucacuug

SEQ ID NO: 451355 - RNA, 25 nt, Human
ugaggcuggagaaucacuugaaucc

SEQ ID NO: 451356 - RNA, 18 nt, Human
ugaucacagagccucccu

SEQ ID NO: 451357 - RNA, 19 nt, Human
ugcagugcagcucacugca

SEQ ID NO: 451358 - RNA, 24 nt, Human
ugccacaagagaaaaaacacuguu

SEQ ID NO: 451359 - RNA, 22 nt, Human
ugccaucccugccauuccucug

SEQ ID NO: 451360 - RNA, 20 nt, Human
ugccugaagcugagaaaaac

SEQ ID NO: 451361 - RNA, 24 nt, Human
ugccuguaaucccagcuacucagg

SEQ ID NO: 451362 - RNA, 23 nt, Human
ugcuaaacuggcuaaugggccuu

SEQ ID NO: 451363 - RNA, 19 nt, Human
ugcuuuuuuuuucuccuug

SEQ ID NO: 451364 - RNA, 20 nt, Human
uggauaaaacucaaaguccu

SEQ ID NO: 451365 - RNA, 24 nt, Human
uggccaacauggugaaacccuguc

SEQ ID NO: 451366 - RNA, 23 nt, Human
uggccuggcaaggaacguucugu

SEQ ID NO: 451367 - RNA, 20 nt, Human
uggcuaaugggccuuggcuu

SEQ ID NO: 451368 - RNA, 24 nt, Human
uggcucacgccuguaaucccagca

SEQ ID NO: 451369 - RNA, 23 nt, Human
ugggaaggagauuccaaagagga

SEQ ID NO: 451370 - RNA, 21 nt, Human
ugggacuacagaugcaugcca

SEQ ID NO: 451371 - RNA, 24 nt, Human
ugggacuacagaugcaugccacca

SEQ ID NO: 451372 - RNA, 18 nt, Human
ugggaggcugaggcaggc

SEQ ID NO: 451373 - RNA, 20 nt, Human
ugggaggcugaggcaggcgg

SEQ ID NO: 451374 - RNA, 24 nt, Human
ugggaggcugaggcaggcggauca

SEQ ID NO: 451375 - RNA, 20 nt, Human
ugggcaaagacgcagcagag

SEQ ID NO: 451376 - RNA, 20 nt, Human
ugggcucaagugauccuccu

SEQ ID NO: 451377 - RNA, 24 nt, Human
ugggcucaagugauccuccugccu

SEQ ID NO: 451378 - RNA, 23 nt, Human
uggugauucccagggaaggaccu

SEQ ID NO: 451379 - RNA, 24 nt, Human
ugguggugugugccuguaauccca

SEQ ID NO: 451380 - RNA, 21 nt, Human
uggugugugccuguaauccca

SEQ ID NO: 451381 - RNA, 22 nt, Human
uggugugugccuguaaucccag

SEQ ID NO: 451382 - RNA, 24 nt, Human
uggugugugccuguaaucccagcu

SEQ ID NO: 451383 - RNA, 23 nt, Human
uguagaggagauucagacuuugg

SEQ ID NO: 451384 - RNA, 24 nt, Human
ugucugggaaggagauuccaaaga

SEQ ID NO: 451385 - RNA, 21 nt, Human
ugucuuagauguccaucuggc

SEQ ID NO: 451386 - RNA, 19 nt, Human
uguguccuaauugaagaaa

SEQ ID NO: 451387 - RNA, 21 nt, Human
uguucucaucuuuccuucuca

SEQ ID NO: 451388 - RNA, 20 nt, Human
uguuuguuuuuguauuuucc

SEQ ID NO: 451389 - RNA, 22 nt, Human
uuaaaguaaaugcuaaacuggc

SEQ ID NO: 451390 - RNA, 21 nt, Human
uuaccagcagcaagaacaggc

SEQ ID NO: 451391 - RNA, 24 nt, Human
uuagcugggcaugguggugugugc

SEQ ID NO: 451392 - RNA, 18 nt, Human
uucauugacagauuauga

SEQ ID NO: 451393 - RNA, 19 nt, Human
uuccagagcuguagcugcu

SEQ ID NO: 451394 - RNA, 19 nt, Human
uuccaucccugaauaccuc

SEQ ID NO: 451395 - RNA, 24 nt, Human
uugaauccgggagguggagguugc

SEQ ID NO: 451396 - RNA, 19 nt, Human
uugcagugagccgagauca

SEQ ID NO: 451397 - RNA, 20 nt, Human
uugcagugagccgagaucac

SEQ ID NO: 451398 - RNA, 20 nt, Human
uuguauguuuguuuguuuuu

SEQ ID NO: 451399 - RNA, 24 nt, Human
uuuggagucauucuccaaacuccu

SEQ ID NO: 451400 - RNA, 18 nt, Human
uuuuccauuaaccuacua

SEQ ID NO: 451401 - RNA, 20 nt, Human
agcuucccuggcccaguccc

SEQ ID NO: 451402 - RNA, 19 nt, Human
aggcagaagccugcacugc

SEQ ID NO: 451403 - RNA, 20 nt, Human
agguggccgggaccccagga

SEQ ID NO: 451404 - RNA, 23 nt, Human
auggggcgggggcugggggcagu

SEQ ID NO: 451405 - RNA, 19 nt, Human
ccacagcucaaagcugagg

SEQ ID NO: 451406 - RNA, 21 nt, Human
ccccaggagcuggcugggccc

SEQ ID NO: 451407 - RNA, 21 nt, Human
ccccuggccgggccucgggac

SEQ ID NO: 451408 - RNA, 22 nt, Human
cccugcccagccccuggccggg

SEQ ID NO: 451409 - RNA, 18 nt, Human
cggcaggaagcggguagc

SEQ ID NO: 451410 - RNA, 23 nt, Human
gacuccggcgcggcgcgggcggc

SEQ ID NO: 451411 - RNA, 22 nt, Human
gagcuuucaacacaggcagggc

SEQ ID NO: 451412 - RNA, 18 nt, Human
gcagccacagcucaaagc

SEQ ID NO: 451413 - RNA, 22 nt, Human
gcgcggcgcgggcggccuggag

SEQ ID NO: 451414 - RNA, 20 nt, Human
gcggguagcuggcggacagc

SEQ ID NO: 451415 - RNA, 19 nt, Human
ggcccaccuggcaucccug

SEQ ID NO: 451416 - RNA, 18 nt, Human
ggcgcggcgcgggcggcc

SEQ ID NO: 451417 - RNA, 22 nt, Human
ggcggcuggcucugcagggcag

SEQ ID NO: 451418 - RNA, 20 nt, Human
ggggaugguaagcggcccgu

SEQ ID NO: 451419 - RNA, 19 nt, Human
ggggcgggggcugggggca

SEQ ID NO: 451420 - RNA, 20 nt, Human
uccccagguggccgggaccc

SEQ ID NO: 451421 - RNA, 18 nt, Human
uggcaggcgcggcuuccc

SEQ ID NO: 451422 - RNA, 20 nt, Human
uggcugggcccaccuggcau

SEQ ID NO: 451423 - RNA, 25 nt, Human
uggguggcagccacagcucaaagcu

SEQ ID NO: 451424 - RNA, 18 nt, Human
uucccuggcccagucccc

SEQ ID NO: 451425 - RNA, 22 nt, Human
uuuuucaggcuuccgggucuuu

SEQ ID NO: 451426 - RNA, 21 nt, Human
uuuuuuuuuuuuuuuuucagg

SEQ ID NO: 451427 - RNA, 20 nt, Human
acaacucaaaggcagagcaa

SEQ ID NO: 451428 - RNA, 20 nt, Human
caacacagaaagacuuuguc

SEQ ID NO: 451429 - RNA, 24 nt, Human
cagggcaggaccaagauggccgcu

SEQ ID NO: 451430 - RNA, 19 nt, Human
gagaaucugucagggcagg

SEQ ID NO: 451431 - RNA, 18 nt, Human
gauuucguucucucacua

SEQ ID NO: 451432 - RNA, 19 nt, Human
gcagagcaagaaggaugag

SEQ ID NO: 451433 - RNA, 20 nt, Human
uaggagaaucugucagggca

SEQ ID NO: 451434 - RNA, 21 nt, Human
ugagaaacaucugacuggccg

SEQ ID NO: 451435 - RNA, 24 nt, Human
aauacaagggccagagcuuccucc

SEQ ID NO: 451436 - RNA, 20 nt, Human
acccuggcugcccacggucc

SEQ ID NO: 451437 - RNA, 21 nt, Human
ggccagagcuuccuccuggac

SEQ ID NO: 451438 - RNA, 26 nt, Human
uuuuuuguauaauuauuauuuuuaau

SEQ ID NO: 451439 - RNA, 18 nt, Human
uuuuuuuuuuuuuuuuug

SEQ ID NO: 451440 - RNA, 19 nt, Human
uuuuuuuuuuuuuuuuugu

SEQ ID NO: 451441 - RNA, 20 nt, Human
caccggaagcacaaccugca

SEQ ID NO: 451442 - RNA, 21 nt, Human
ccugcagacggagcaggaugc

SEQ ID NO: 451443 - RNA, 18 nt, Human
cugcagacggagcaggau

SEQ ID NO: 451444 - RNA, 23 nt, Human
gcaccggaagcacaaccugcaga

SEQ ID NO: 451445 - RNA, 18 nt, Human
gcuuuauucauccgcugc

SEQ ID NO: 451446 - RNA, 20 nt, Human
ggaagcacaaccugcagacg

SEQ ID NO: 451447 - RNA, 23 nt, Human
ugcagacggagcaggaugccgca

SEQ ID NO: 451448 - RNA, 24 nt, Human
aggauucagcaacgauugagauug

SEQ ID NO: 451449 - RNA, 21 nt, Human
aguccugguguccgcugugcc

SEQ ID NO: 451450 - RNA, 23 nt, Human
ggaguccugguguccgcugugcc

SEQ ID NO: 451451 - RNA, 22 nt, Human
gucguggggugggggggugcag

SEQ ID NO: 451452 - RNA, 20 nt, Human
uaugaaaggauucagcaacg

SEQ ID NO: 451453 - RNA, 21 nt, Human
ugaaaggauucagcaacgauu

SEQ ID NO: 451454 - RNA, 20 nt, Human
uggggugggggggugcagag

SEQ ID NO: 451455 - RNA, 20 nt, Human
ccgucgccccgaaccgccgg

SEQ ID NO: 451456 - RNA, 18 nt, Human
ucuuuuuuuuuuuuuuuu

SEQ ID NO: 451457 - RNA, 19 nt, Human
uucagauagcagucugauc

SEQ ID NO: 451458 - RNA, 18 nt, Human
uuuuuuuuuuuuuuuuug

SEQ ID NO: 451459 - RNA, 25 nt, Human
uuuuuuuuuuuuuuuuuuucuuuuu

SEQ ID NO: 451460 - RNA, 24 nt, Human
aaaaacaucacaggcacacacaaa

SEQ ID NO: 451461 - RNA, 22 nt, Human
aaacagccaauuuccaaccccc

SEQ ID NO: 451462 - RNA, 19 nt, Human
aaacaucacaggcacacac

SEQ ID NO: 451463 - RNA, 24 nt, Human
aaacaucacaggcacacacaaaau

SEQ ID NO: 451464 - RNA, 18 nt, Human
aacuuuauuugucacucu

SEQ ID NO: 451465 - RNA, 21 nt, Human
accacagugggauucacguca

SEQ ID NO: 451466 - RNA, 19 nt, Human
acuuuaaagcacacuaaaa

SEQ ID NO: 451467 - RNA, 21 nt, Human
acuuuauuugucacucuugau

SEQ ID NO: 451468 - RNA, 22 nt, Human
agacauugguccacuccaacau

SEQ ID NO: 451469 - RNA, 23 nt, Human
agcaucuauauacuccacaaggc

SEQ ID NO: 451470 - RNA, 23 nt, Human
aggugacgcgcucggacucgucc

SEQ ID NO: 451471 - RNA, 25 nt, Human
augaaaagcaucuauauacuccaca

SEQ ID NO: 451472 - RNA, 22 nt, Human
auucacucuagaaaaacaucac

SEQ ID NO: 451473 - RNA, 22 nt, Human
auucauuaaacagaaugaaauc

SEQ ID NO: 451474 - RNA, 19 nt, Human
caaauuguucauaguauac

SEQ ID NO: 451475 - RNA, 24 nt, Human
cacaaggcuaguuucuucuuagau

SEQ ID NO: 451476 - RNA, 22 nt, Human
cacucuagaaaaacaucacagg

SEQ ID NO: 451477 - RNA, 24 nt, Human
cagaagaggguuaaaaaacagcug

SEQ ID NO: 451478 - RNA, 18 nt, Human
cagccgcagcgugaggag

SEQ ID NO: 451479 - RNA, 23 nt, Human
cagccgcagcgugaggaggugac

SEQ ID NO: 451480 - RNA, 23 nt, Human
cagggauuuuuguguguauaaug

SEQ ID NO: 451481 - RNA, 19 nt, Human
cauaacacgagcuauucua

SEQ ID NO: 451482 - RNA, 24 nt, Human
ccaaauaugauuuucaccuaugcu

SEQ ID NO: 451483 - RNA, 22 nt, Human
ccaacccccuuuucuaauucug

SEQ ID NO: 451484 - RNA, 19 nt, Human
ccacagugggauucacguc

SEQ ID NO: 451485 - RNA, 21 nt, Human
cgacacggaacgggccggcgg

SEQ ID NO: 451486 - RNA, 21 nt, Human
cgacagccgcagcgugaggag

SEQ ID NO: 451487 - RNA, 18 nt, Human
cucuguuacucagauaca

SEQ ID NO: 451488 - RNA, 19 nt, Human
gccaauuuccaacccccuu

SEQ ID NO: 451489 - RNA, 18 nt, Human
uaaaaaguagaauucacc

SEQ ID NO: 451490 - RNA, 24 nt, Human
uaaauguaaaguauacuaucuacu

SEQ ID NO: 451491 - RNA, 22 nt, Human
uagaaaaacaucacaggcacac

SEQ ID NO: 451492 - RNA, 18 nt, Human
uagaauucacccacuucc

SEQ ID NO: 451493 - RNA, 20 nt, Human
ucaaaaugucccucagggau

SEQ ID NO: 451494 - RNA, 19 nt, Human
ucaaauuaagacauuuaca

SEQ ID NO: 451495 - RNA, 25 nt, Human
ucaagcauauuauggaaucuauacc

SEQ ID NO: 451496 - RNA, 20 nt, Human
uccaacauaaaaaguagaau

SEQ ID NO: 451497 - RNA, 20 nt, Human
uccaacccccuuuucuaauu

SEQ ID NO: 451498 - RNA, 18 nt, Human
uccacuccaacauaaaaa

SEQ ID NO: 451499 - RNA, 23 nt, Human
uccauaacacgagcuauucuaaa

SEQ ID NO: 451500 - RNA, 24 nt, Human
ugcagaagaggguuaaaaaacagc

SEQ ID NO: 451501 - RNA, 25 nt, Human
uuauauucaugccucaaaauguccc

SEQ ID NO: 451502 - RNA, 22 nt, Human
uuccaacccccuuuucuaauuc

SEQ ID NO: 451503 - RNA, 24 nt, Human
aaaagccaggguaggaggagggca

SEQ ID NO: 451504 - RNA, 22 nt, Human
aaaccaucagugacacugaccu

SEQ ID NO: 451505 - RNA, 24 nt, Human
aacagagcaaagaucaucacgaaa

SEQ ID NO: 451506 - RNA, 23 nt, Human
aacauacuuuauucaacauagga

SEQ ID NO: 451507 - RNA, 23 nt, Human
aacccgcacccuccgcggcucca

SEQ ID NO: 451508 - RNA, 25 nt, Human
aaccgccacagaaaccaccgcagcc

SEQ ID NO: 451509 - RNA, 22 nt, Human
aacucugcuucaaaccccacug

SEQ ID NO: 451510 - RNA, 24 nt, Human
aaggccucuguuccaagcaucccg

SEQ ID NO: 451511 - RNA, 23 nt, Human
acagagcaaagaucaucacgaaa

SEQ ID NO: 451512 - RNA, 21 nt, Human
acagggagaagccacucauga

SEQ ID NO: 451513 - RNA, 22 nt, Human
accuggauuucucuccaaccuc

SEQ ID NO: 451514 - RNA, 18 nt, Human
acgaaaacccaggacacc

SEQ ID NO: 451515 - RNA, 20 nt, Human
acuacacuacacacaaagcu

SEQ ID NO: 451516 - RNA, 27 nt, Human
acuacacuacacacaaagcuaggggug

SEQ ID NO: 451517 - RNA, 18 nt, Human
acuccccccacuacuccu

SEQ ID NO: 451518 - RNA, 22 nt, Human
acugaagacaucaugauugggg

SEQ ID NO: 451519 - RNA, 19 nt, Human
agagggaagcccugugcac

SEQ ID NO: 451520 - RNA, 21 nt, Human
agccacaugcacggcagcccu

SEQ ID NO: 451521 - RNA, 24 nt, Human
agccagggcugccacgccagcaca

SEQ ID NO: 451522 - RNA, 23 nt, Human
agcccucacagccacaugcacgg

SEQ ID NO: 451523 - RNA, 23 nt, Human
aggaagccccuuggcaggacugu

SEQ ID NO: 451524 - RNA, 21 nt, Human
aggagcagcgcuucgacgugc

SEQ ID NO: 451525 - RNA, 18 nt, Human
aggaggaccuugggcagg

SEQ ID NO: 451526 - RNA, 22 nt, Human
aggcagaaccaagaggacccca

SEQ ID NO: 451527 - RNA, 18 nt, Human
aggcagcucacucagaaa

SEQ ID NO: 451528 - RNA, 22 nt, Human
aggcggggaggguagcaugggg

SEQ ID NO: 451529 - RNA, 23 nt, Human
aggcggggaggguagcauggggc

SEQ ID NO: 451530 - RNA, 21 nt, Human
agggagaagccacucaugaug

SEQ ID NO: 451531 - RNA, 20 nt, Human
agggcugucuggauggaugg

SEQ ID NO: 451532 - RNA, 22 nt, Human
aggggggcugcacaaggucggg

SEQ ID NO: 451533 - RNA, 21 nt, Human
agggguggugggagacccaag

SEQ ID NO: 451534 - RNA, 21 nt, Human
aggguucccugaacucugcuu

SEQ ID NO: 451535 - RNA, 19 nt, Human
auggauggaggcuaagagg

SEQ ID NO: 451536 - RNA, 21 nt, Human
auggcuuccaaacagcaaacc

SEQ ID NO: 451537 - RNA, 18 nt, Human
caaaagacgcaaauauca

SEQ ID NO: 451538 - RNA, 19 nt, Human
caaaccccacuggaaacag

SEQ ID NO: 451539 - RNA, 19 nt, Human
caagcaucccggcugugcu

SEQ ID NO: 451540 - RNA, 20 nt, Human
caauggcuuccaaacagcaa

SEQ ID NO: 451541 - RNA, 20 nt, Human
caccagccuggcccacucag

SEQ ID NO: 451542 - RNA, 20 nt, Human
cacccucggccugagggugu

SEQ ID NO: 451543 - RNA, 21 nt, Human
caccgcagccaaacccgcacc

SEQ ID NO: 451544 - RNA, 18 nt, Human
cacgaaaacccaggacac

SEQ ID NO: 451545 - RNA, 21 nt, Human
cacuacacacaaagcuagggg

SEQ ID NO: 451546 - RNA, 20 nt, Human
cacuacacuacacacaaagc

SEQ ID NO: 451547 - RNA, 21 nt, Human
cagaaaaucacuacacuacac

SEQ ID NO: 451548 - RNA, 21 nt, Human
cagaaaccaccgcagccaaac

SEQ ID NO: 451549 - RNA, 23 nt, Human
cagagcaaagaucaucacgaaaa

SEQ ID NO: 451550 - RNA, 19 nt, Human
cagaugcagggaacucaaa

SEQ ID NO: 451551 - RNA, 20 nt, Human
cagcaaccgccacagaaacc

SEQ ID NO: 451552 - RNA, 24 nt, Human
cagccaaacccgcacccuccgcgg

SEQ ID NO: 451553 - RNA, 18 nt, Human
cagcucacucagaaaagc

SEQ ID NO: 451554 - RNA, 21 nt, Human
caggcagagaggcacagcuga

SEQ ID NO: 451555 - RNA, 20 nt, Human
caggcugcaggcagaaccaa

SEQ ID NO: 451556 - RNA, 23 nt, Human
caggcugcaggcagaaccaagag

SEQ ID NO: 451557 - RNA, 24 nt, Human
caggcugcaggcagaaccaagagg

SEQ ID NO: 451558 - RNA, 19 nt, Human
cagggugacacgaaugagc

SEQ ID NO: 451559 - RNA, 21 nt, Human
caggguggggucagaaaggcg

SEQ ID NO: 451560 - RNA, 22 nt, Human
ccacagaaaccaccgcagccaa

SEQ ID NO: 451561 - RNA, 23 nt, Human
ccacagaaaccaccgcagccaaa

SEQ ID NO: 451562 - RNA, 26 nt, Human
ccacagaaaccaccgcagccaaaccc

SEQ ID NO: 451563 - RNA, 21 nt, Human
ccaccccugcuaauccaagag

SEQ ID NO: 451564 - RNA, 21 nt, Human
ccagggcaggggggcugcaca

SEQ ID NO: 451565 - RNA, 22 nt, Human
ccagucccacacugaagacauc

SEQ ID NO: 451566 - RNA, 19 nt, Human
ccccccacuacuccugcua

SEQ ID NO: 451567 - RNA, 21 nt, Human
ccccuggggaugacagggaga

SEQ ID NO: 451568 - RNA, 23 nt, Human
cccugaacucugcuucaaacccc

SEQ ID NO: 451569 - RNA, 20 nt, Human
cccugcccaggacaccccuc

SEQ ID NO: 451570 - RNA, 23 nt, Human
cccugcccaggacaccccuccug

SEQ ID NO: 451571 - RNA, 20 nt, Human
ccgcacccuccgcggcucca

SEQ ID NO: 451572 - RNA, 21 nt, Human
ccgcacccuccgcggcuccag

SEQ ID NO: 451573 - RNA, 22 nt, Human
ccgcacccuccgcggcuccagg

SEQ ID NO: 451574 - RNA, 20 nt, Human
ccgcagccaaacccgcaccc

SEQ ID NO: 451575 - RNA, 24 nt, Human
ccgcagccaaacccgcacccuccg

SEQ ID NO: 451576 - RNA, 28 nt, Human
ccucacagccacaugcacggcagcccug

SEQ ID NO: 451577 - RNA, 24 nt, Human
ccugugcacugcggagcagccaag

SEQ ID NO: 451578 - RNA, 26 nt, Human
cgcagccaaacccgcacccuccgcgg

SEQ ID NO: 451579 - RNA, 23 nt, Human
cgccacagaaaccaccgcagcca

SEQ ID NO: 451580 - RNA, 23 nt, Human
cgccacagcaaccgccacagaaa

SEQ ID NO: 451581 - RNA, 20 nt, Human
cgcggcuccaggagcagcgc

SEQ ID NO: 451582 - RNA, 24 nt, Human
cuagugaguaccuggauuucucuc

SEQ ID NO: 451583 - RNA, 24 nt, Human
cucacagccacaugcacggcagcc

SEQ ID NO: 451584 - RNA, 23 nt, Human
cuccgccacagcaaccgccacag

SEQ ID NO: 451585 - RNA, 19 nt, Human
cucugcuucaaaccccacu

SEQ ID NO: 451586 - RNA, 21 nt, Human
cugaacaggaggaccuugggc

SEQ ID NO: 451587 - RNA, 19 nt, Human
cuggggaugacagggagaa

SEQ ID NO: 451588 - RNA, 26 nt, Human
cuguauuacuccccccacuacuccug

SEQ ID NO: 451589 - RNA, 20 nt, Human
cuucaaaccccacuggaaac

SEQ ID NO: 451590 - RNA, 18 nt, Human
cuuccuggacccaccccu

SEQ ID NO: 451591 - RNA, 19 nt, Human
gaaaggaugggagugcagg

SEQ ID NO: 451592 - RNA, 22 nt, Human
gaagaagccaaccccgagagag

SEQ ID NO: 451593 - RNA, 19 nt, Human
gaaugagcuggugcccaca

SEQ ID NO: 451594 - RNA, 21 nt, Human
gcacaaggucgggucaggucc

SEQ ID NO: 451595 - RNA, 20 nt, Human
gcagagaggcacagcugauc

SEQ ID NO: 451596 - RNA, 20 nt, Human
gcagaugcagggaacucaaa

SEQ ID NO: 451597 - RNA, 20 nt, Human
gcagcucacucagaaaagcc

SEQ ID NO: 451598 - RNA, 23 nt, Human
gcccagccugggagaggggauga

SEQ ID NO: 451599 - RNA, 20 nt, Human
gcccagggccagcccagccu

SEQ ID NO: 451600 - RNA, 19 nt, Human
gcggagcagccaaggccuc

SEQ ID NO: 451601 - RNA, 19 nt, Human
gcuuccaaacagcaaacca

SEQ ID NO: 451602 - RNA, 19 nt, Human
gcuuugggauggcguggga

SEQ ID NO: 451603 - RNA, 20 nt, Human
ggaagaagccaaccccgagg

SEQ ID NO: 451604 - RNA, 24 nt, Human
ggaagcccugugcacuggugaccc

SEQ ID NO: 451605 - RNA, 18 nt, Human
ggaauucuuucuaccacu

SEQ ID NO: 451606 - RNA, 20 nt, Human
ggcagagaggcacagcugau

SEQ ID NO: 451607 - RNA, 19 nt, Human
gggaagagcaucagucugc

SEQ ID NO: 451608 - RNA, 20 nt, Human
ggguggggaagaucucaggg

SEQ ID NO: 451609 - RNA, 18 nt, Human
ggguggugggagacccaa

SEQ ID NO: 451610 - RNA, 18 nt, Human
gguggggaagaucucagg

SEQ ID NO: 451611 - RNA, 20 nt, Human
gguguagauauccuaugacc

SEQ ID NO: 451612 - RNA, 21 nt, Human
guggccccgcccagggccagc

SEQ ID NO: 451613 - RNA, 23 nt, Human
uacaaugcacggggaagaugaaa

SEQ ID NO: 451614 - RNA, 20 nt, Human
uaccaguguccccuucuagg

SEQ ID NO: 451615 - RNA, 18 nt, Human
uagaugggugaauggcau

SEQ ID NO: 451616 - RNA, 19 nt, Human
ucacuacacuacacacaaa

SEQ ID NO: 451617 - RNA, 20 nt, Human
ucaugauuggggguggggaa

SEQ ID NO: 451618 - RNA, 19 nt, Human
uccaucuacaaugcacggg

SEQ ID NO: 451619 - RNA, 24 nt, Human
ucccugaacucugcuucaaacccc

SEQ ID NO: 451620 - RNA, 18 nt, Human
uccguaaagccccgcccc

SEQ ID NO: 451621 - RNA, 21 nt, Human
uccguaaagccccgccccugc

SEQ ID NO: 451622 - RNA, 21 nt, Human
ugaaagggcuuugggauggcg

SEQ ID NO: 451623 - RNA, 18 nt, Human
ugacaaggaggaagcccc

SEQ ID NO: 451624 - RNA, 19 nt, Human
ugacaaggaggaagccccu

SEQ ID NO: 451625 - RNA, 22 nt, Human
ugacucacagacagggugacac

SEQ ID NO: 451626 - RNA, 21 nt, Human
ugcacggggaagaugaaaggg

SEQ ID NO: 451627 - RNA, 19 nt, Human
ugcagacuggcucaccacc

SEQ ID NO: 451628 - RNA, 24 nt, Human
uggcaggacugugcagcccucaca

SEQ ID NO: 451629 - RNA, 18 nt, Human
uggccuaguuggguccag

SEQ ID NO: 451630 - RNA, 20 nt, Human
ugggaagggcugucuggaug

SEQ ID NO: 451631 - RNA, 22 nt, Human
ugggagugcaggguggggucag

SEQ ID NO: 451632 - RNA, 21 nt, Human
ugggauggcgugggaaugcag

SEQ ID NO: 451633 - RNA, 19 nt, Human
uggggucagaaaggcggug

SEQ ID NO: 451634 - RNA, 21 nt, Human
uggugggagacccaaggagga

SEQ ID NO: 451635 - RNA, 21 nt, Human
ugugcuugugggcagggccca

SEQ ID NO: 451636 - RNA, 23 nt, Human
ugugggcagggcccaugcaaggc

SEQ ID NO: 451637 - RNA, 21 nt, Human
uuccaaacagcaaaccaucag

SEQ ID NO: 451638 - RNA, 20 nt, Human
uuuuuuuuuuuuuuuuccgg

SEQ ID NO: 451639 - RNA, 21 nt, Human
cugacauaagugaaagucuau

SEQ ID NO: 451640 - RNA, 23 nt, Human
uaaugaagauggaauuuuuccua

SEQ ID NO: 451641 - RNA, 22 nt, Human
aaaaauacagaugcucccguca

SEQ ID NO: 451642 - RNA, 21 nt, Human
agccagcggagggcggagggc

SEQ ID NO: 451643 - RNA, 18 nt, Human
agggaggggagacccggg

SEQ ID NO: 451644 - RNA, 19 nt, Human
auggagcgugcggcgcccc

SEQ ID NO: 451645 - RNA, 21 nt, Human
cagaguaaggcaucgcaaccu

SEQ ID NO: 451646 - RNA, 20 nt, Human
cccccaccaccucggagccg

SEQ ID NO: 451647 - RNA, 18 nt, Human
ccgggagucgagggggag

SEQ ID NO: 451648 - RNA, 20 nt, Human
cugccgguguuggggugcca

SEQ ID NO: 451649 - RNA, 23 nt, Human
cugcugguggcagcucugagacu

SEQ ID NO: 451650 - RNA, 20 nt, Human
gcgcagaagccgcugguugg

SEQ ID NO: 451651 - RNA, 21 nt, Human
gcugguugggguggcgaggga

SEQ ID NO: 451652 - RNA, 25 nt, Human
ggagcaguccccagcugggagccca

SEQ ID NO: 451653 - RNA, 20 nt, Human
ggaggggagacccgggagcc

SEQ ID NO: 451654 - RNA, 22 nt, Human
ggcauggagcgcgggaaaagga

SEQ ID NO: 451655 - RNA, 23 nt, Human
gggauggagcgugcggcgccccc

SEQ ID NO: 451656 - RNA, 19 nt, Human
uaaaaauacagaugcuccc

SEQ ID NO: 451657 - RNA, 22 nt, Human
uaacauaaaaauacagaugcuc

SEQ ID NO: 451658 - RNA, 22 nt, Human
ucggagccagcggagggcggag

SEQ ID NO: 451659 - RNA, 19 nt, Human
ugccgguguuggggugcca

SEQ ID NO: 451660 - RNA, 23 nt, Human
ugccgguguuggggugccacggc

SEQ ID NO: 451661 - RNA, 19 nt, Human
uggagcgugcggcgccccc

SEQ ID NO: 451662 - RNA, 21 nt, Human
ugguugggguggcgagggagg

SEQ ID NO: 451663 - RNA, 20 nt, Human
ugucugagccugcugcuggu

SEQ ID NO: 451664 - RNA, 25 nt, Human
uuuauuuuuauuuugugggcuuuua

SEQ ID NO: 451665 - RNA, 21 nt, Human
aaaagguagagagaggucaaa

SEQ ID NO: 451666 - RNA, 23 nt, Human
aaaccgaaagcaaacacucagga

SEQ ID NO: 451667 - RNA, 25 nt, Human
aaaccgaaagcaaacacucaggaaa

SEQ ID NO: 451668 - RNA, 21 nt, Human
aaagcagaaccaaauugggga

SEQ ID NO: 451669 - RNA, 19 nt, Human
aaauuggggauuuucaaag

SEQ ID NO: 451670 - RNA, 18 nt, Human
aacacagagagaccaaca

SEQ ID NO: 451671 - RNA, 20 nt, Human
aagaacacagagagaccaac

SEQ ID NO: 451672 - RNA, 19 nt, Human
acaaaccgaaagcaaacac

SEQ ID NO: 451673 - RNA, 21 nt, Human
acacaaaggugggaaccgaga

SEQ ID NO: 451674 - RNA, 20 nt, Human
acacagagagaccaacagga

SEQ ID NO: 451675 - RNA, 21 nt, Human
acgccacuccaucccugcagc

SEQ ID NO: 451676 - RNA, 24 nt, Human
acgccacuccaucccugcagcacu

SEQ ID NO: 451677 - RNA, 19 nt, Human
acuccaacacaaagguggg

SEQ ID NO: 451678 - RNA, 22 nt, Human
acuccaacacaaaggugggaac

SEQ ID NO: 451679 - RNA, 20 nt, Human
acucuugagggaguugagag

SEQ ID NO: 451680 - RNA, 23 nt, Human
acuggcccagcagacgcgcgcac

SEQ ID NO: 451681 - RNA, 18 nt, Human
agaacacagagagaccaa

SEQ ID NO: 451682 - RNA, 23 nt, Human
agagaaaaagaaaacuccuuuca

SEQ ID NO: 451683 - RNA, 19 nt, Human
agcaaaaagacagucaaaa

SEQ ID NO: 451684 - RNA, 21 nt, Human
agcacugaggacccagguagg

SEQ ID NO: 451685 - RNA, 26 nt, Human
aggaaagagcaaaaagacagucaaaa

SEQ ID NO: 451686 - RNA, 23 nt, Human
aggauucuguguauuauuuggag

SEQ ID NO: 451687 - RNA, 18 nt, Human
aggcugcucucuaacaga

SEQ ID NO: 451688 - RNA, 21 nt, Human
aggucaaaaagcagaaccaaa

SEQ ID NO: 451689 - RNA, 22 nt, Human
agguccauuuaauuuaacauuu

SEQ ID NO: 451690 - RNA, 22 nt, Human
aggucuaagagacccaaauaac

SEQ ID NO: 451691 - RNA, 22 nt, Human
aguaacaaagaacacagagaga

SEQ ID NO: 451692 - RNA, 23 nt, Human
aucaugcugacucccccaacccc

SEQ ID NO: 451693 - RNA, 21 nt, Human
caaacacucaggaaagagccu

SEQ ID NO: 451694 - RNA, 21 nt, Human
caaagauuacccugaaaaggu

SEQ ID NO: 451695 - RNA, 21 nt, Human
caacaaaccgaaagcaaacac

SEQ ID NO: 451696 - RNA, 23 nt, Human
caacaaaccgaaagcaaacacuc

SEQ ID NO: 451697 - RNA, 19 nt, Human
caacaugaaagauggaaug

SEQ ID NO: 451698 - RNA, 24 nt, Human
caacccccagcccucagagaaaaa

SEQ ID NO: 451699 - RNA, 22 nt, Human
caacucuacuggcaauuguaau

SEQ ID NO: 451700 - RNA, 19 nt, Human
caagaggagcugaccagcg

SEQ ID NO: 451701 - RNA, 22 nt, Human
caagaggagcugaccagcgugc

SEQ ID NO: 451702 - RNA, 20 nt, Human
caaguaacaaagaacacaga

SEQ ID NO: 451703 - RNA, 21 nt, Human
cacagagagaccaacaggacg

SEQ ID NO: 451704 - RNA, 20 nt, Human
cacccaaguaacaaagaacc

SEQ ID NO: 451705 - RNA, 23 nt, Human
cagacagauaccagcugugcaaa

SEQ ID NO: 451706 - RNA, 23 nt, Human
cagcaauaagaaaacgccacucc

SEQ ID NO: 451707 - RNA, 19 nt, Human
cagcacuuuaaacauagca

SEQ ID NO: 451708 - RNA, 24 nt, Human
cagcccagcaauacaggcauacca

SEQ ID NO: 451709 - RNA, 19 nt, Human
ccccaaacaacaacucuac

SEQ ID NO: 451710 - RNA, 19 nt, Human
ccccgcccccuucgccgcc

SEQ ID NO: 451711 - RNA, 19 nt, Human
ccccuucgccgccggccgc

SEQ ID NO: 451712 - RNA, 25 nt, Human
cccuucgccgccggccgcccccagc

SEQ ID NO: 451713 - RNA, 23 nt, Human
ccgccggccgcccccagccucgg

SEQ ID NO: 451714 - RNA, 22 nt, Human
ccuaugcgcgcugcggcgcccg

SEQ ID NO: 451715 - RNA, 19 nt, Human
ccucagagaaaaaagugaa

SEQ ID NO: 451716 - RNA, 22 nt, Human
ccugcagcacuuuaaacauagc

SEQ ID NO: 451717 - RNA, 22 nt, Human
ccugcuugcgagcaagaggagc

SEQ ID NO: 451718 - RNA, 24 nt, Human
cgcggagcaaugcagaagcagcag

SEQ ID NO: 451719 - RNA, 18 nt, Human
cgcggccgaggcuccgcc

SEQ ID NO: 451720 - RNA, 24 nt, Human
cuaccagacagauaccagcugugc

SEQ ID NO: 451721 - RNA, 22 nt, Human
cuacuggcaauuguaaucaugu

SEQ ID NO: 451722 - RNA, 19 nt, Human
cucccccaacccccagccc

SEQ ID NO: 451723 - RNA, 26 nt, Human
gaaaaaagugaagaacuuuacacaac

SEQ ID NO: 451724 - RNA, 26 nt, Human
gaaaacucuaaagcuuggaaaugcua

SEQ ID NO: 451725 - RNA, 22 nt, Human
gacuucucucagacuggaucuu

SEQ ID NO: 451726 - RNA, 21 nt, Human
gagaccaacaggacgcauggc

SEQ ID NO: 451727 - RNA, 20 nt, Human
gagcgcggagcaaugcagaa

SEQ ID NO: 451728 - RNA, 25 nt, Human
gaggagcugaccagcgugcugggag

SEQ ID NO: 451729 - RNA, 21 nt, Human
gcagauauaccaaggcggccc

SEQ ID NO: 451730 - RNA, 22 nt, Human
gcaggaauucagaaaacucuaa

SEQ ID NO: 451731 - RNA, 18 nt, Human
gcaggauucuguguauua

SEQ ID NO: 451732 - RNA, 18 nt, Human
gccggccgcccccagccu

SEQ ID NO: 451733 - RNA, 19 nt, Human
gcucccuccccuugccuuc

SEQ ID NO: 451734 - RNA, 26 nt, Human
ggaaagagcaaaaagacagucaaaac

SEQ ID NO: 451735 - RNA, 19 nt, Human
ggcugcucucuaacagagu

SEQ ID NO: 451736 - RNA, 18 nt, Human
gggauauuuuaaggucug

SEQ ID NO: 451737 - RNA, 27 nt, Human
gguaacuaacuacuccacuauguacaa

SEQ ID NO: 451738 - RNA, 21 nt, Human
gguagagagaggucaaaaagc

SEQ ID NO: 451739 - RNA, 22 nt, Human
uaaagaaaacagaaccaguauu

SEQ ID NO: 451740 - RNA, 18 nt, Human
uaacuucagagacuggua

SEQ ID NO: 451741 - RNA, 26 nt, Human
uaagaaaacgccacuccaucccugca

SEQ ID NO: 451742 - RNA, 19 nt, Human
uaaucaugcugacuccccc

SEQ ID NO: 451743 - RNA, 24 nt, Human
uaaucaugcugacucccccaaccc

SEQ ID NO: 451744 - RNA, 20 nt, Human
uaccccaaacaacaacucua

SEQ ID NO: 451745 - RNA, 30 nt, Human
uagcacugaggacccagguagggggauauu

SEQ ID NO: 451746 - RNA, 20 nt, Human
uauguacaauacauacagca

SEQ ID NO: 451747 - RNA, 19 nt, Human
ucagaaaacucuaaagcuu

SEQ ID NO: 451748 - RNA, 18 nt, Human
ucgccccgcccccuucgc

SEQ ID NO: 451749 - RNA, 23 nt, Human
ucgccccgcccccuucgccgccg

SEQ ID NO: 451750 - RNA, 24 nt, Human
ucuaagagacccaaauaacaagac

SEQ ID NO: 451751 - RNA, 19 nt, Human
ugaagaacuuuacacaaca

SEQ ID NO: 451752 - RNA, 22 nt, Human
ugacuccucugcuuggaaaccc

SEQ ID NO: 451753 - RNA, 23 nt, Human
ugcaaaaaguugcaggauucuga

SEQ ID NO: 451754 - RNA, 22 nt, Human
ugcuucgagcagcagcacagcc

SEQ ID NO: 451755 - RNA, 20 nt, Human
uggaaaugcuaucguuugug

SEQ ID NO: 451756 - RNA, 24 nt, Human
uggaaaugcuaucguuugugccac

SEQ ID NO: 451757 - RNA, 20 nt, Human
uggcagaacugcauagaaga

SEQ ID NO: 451758 - RNA, 19 nt, Human
uggggauuuucaaaggcug

SEQ ID NO: 451759 - RNA, 18 nt, Human
ugguaaacuccaacacaa

SEQ ID NO: 451760 - RNA, 26 nt, Human
ugucacauuuucuacauuaaaauaua

SEQ ID NO: 451761 - RNA, 20 nt, Human
ugugcaaaaaguugcaggau

SEQ ID NO: 451762 - RNA, 22 nt, Human
ugugcaaaaaguugcaggauuc

SEQ ID NO: 451763 - RNA, 19 nt, Human
uuuuuuuuuuuuaaggucc

SEQ ID NO: 451764 - RNA, 23 nt, Human
uuuuuuuuuuuuuuuuuuuaagg

SEQ ID NO: 451765 - RNA, 25 nt, Human
aaaaaauaaauagccacacaaauca

SEQ ID NO: 451766 - RNA, 21 nt, Human
aagacaggaaccugucaugca

SEQ ID NO: 451767 - RNA, 20 nt, Human
aaguuccugggcagguuuua

SEQ ID NO: 451768 - RNA, 21 nt, Human
aauagcuacccacuuccuaca

SEQ ID NO: 451769 - RNA, 21 nt, Human
acaggaaccugucaugcaagg

SEQ ID NO: 451770 - RNA, 23 nt, Human
acauggagugggaaaaauagcua

SEQ ID NO: 451771 - RNA, 18 nt, Human
accccaaaaugcaacagu

SEQ ID NO: 451772 - RNA, 21 nt, Human
acgggagucagcugguugugu

SEQ ID NO: 451773 - RNA, 19 nt, Human
agaaagcucuggcugacac

SEQ ID NO: 451774 - RNA, 25 nt, Human
agaaagcucuggcugacacuacuga

SEQ ID NO: 451775 - RNA, 19 nt, Human
agacaggaaccugucaugc

SEQ ID NO: 451776 - RNA, 25 nt, Human
agacaggaaccugucaugcaaggaa

SEQ ID NO: 451777 - RNA, 24 nt, Human
aggaaaagugcagguuuucacaaa

SEQ ID NO: 451778 - RNA, 18 nt, Human
auaaauagacaucuaggu

SEQ ID NO: 451779 - RNA, 22 nt, Human
auggagugggaaaaauagcuac

SEQ ID NO: 451780 - RNA, 19 nt, Human
auuuauuaguaccccaaaa

SEQ ID NO: 451781 - RNA, 22 nt, Human
caaaaaauaaauagccacacaa

SEQ ID NO: 451782 - RNA, 24 nt, Human
caaaaaauaaauagccacacaaau

SEQ ID NO: 451783 - RNA, 18 nt, Human
caaaaguaaucccauaaa

SEQ ID NO: 451784 - RNA, 21 nt, Human
caaaaugcaacaguugucuca

SEQ ID NO: 451785 - RNA, 19 nt, Human
cacaguaauuggccugaga

SEQ ID NO: 451786 - RNA, 24 nt, Human
cagaauggcucccaugacagacaa

SEQ ID NO: 451787 - RNA, 18 nt, Human
cagaucucuuucauccau

SEQ ID NO: 451788 - RNA, 21 nt, Human
caugacagacaagacaggaac

SEQ ID NO: 451789 - RNA, 23 nt, Human
caugacagacaagacaggaaccu

SEQ ID NO: 451790 - RNA, 24 nt, Human
ccacacaaaucaaaccuacacacu

SEQ ID NO: 451791 - RNA, 25 nt, Human
ccagaacuggccuccacagugucuu

SEQ ID NO: 451792 - RNA, 18 nt, Human
cggccgggcaaccgaggc

SEQ ID NO: 451793 - RNA, 19 nt, Human
cggcucggguccccggccg

SEQ ID NO: 451794 - RNA, 25 nt, Human
cggcucggguccccggccgggcaac

SEQ ID NO: 451795 - RNA, 21 nt, Human
cuacccacuuccuacauguug

SEQ ID NO: 451796 - RNA, 19 nt, Human
cuccagaacuggccuccac

SEQ ID NO: 451797 - RNA, 25 nt, Human
cucccaugacagacaagacaggaac

SEQ ID NO: 451798 - RNA, 28 nt, Human
cuggccuccacagugucuuccucuacgg

SEQ ID NO: 451799 - RNA, 22 nt, Human
gcagagaaagcucuggcugaca

SEQ ID NO: 451800 - RNA, 18 nt, Human
gccaaaaaauaaauagcc

SEQ ID NO: 451801 - RNA, 24 nt, Human
ggccuccacagugucuuccucuac

SEQ ID NO: 451802 - RNA, 20 nt, Human
guaaguuccugggcagguuu

SEQ ID NO: 451803 - RNA, 20 nt, Human
uaaauagacaucuagguaaa

SEQ ID NO: 451804 - RNA, 19 nt, Human
uaagcagaucacguguaac

SEQ ID NO: 451805 - RNA, 21 nt, Human
uaagcagaucacguguaacac

SEQ ID NO: 451806 - RNA, 21 nt, Human
uaauaaaaacggaaugacuua

SEQ ID NO: 451807 - RNA, 21 nt, Human
uagccacacaaaucaaaccua

SEQ ID NO: 451808 - RNA, 20 nt, Human
uaggccaaaaaauaaauagc

SEQ ID NO: 451809 - RNA, 18 nt, Human
ucacuugaccccucuugu

SEQ ID NO: 451810 - RNA, 23 nt, Human
ucagacaacagcgccaagguuug

SEQ ID NO: 451811 - RNA, 22 nt, Human
uccacaguaauuggccugagac

SEQ ID NO: 451812 - RNA, 23 nt, Human
uccacaguaauuggccugagacc

SEQ ID NO: 451813 - RNA, 24 nt, Human
ucccaugacagacaagacaggaac

SEQ ID NO: 451814 - RNA, 20 nt, Human
ucugcagagaaagcucuggc

SEQ ID NO: 451815 - RNA, 25 nt, Human
ugagaacaugacuuaacaguaaauu

SEQ ID NO: 451816 - RNA, 25 nt, Human
ugcuaaauuaugauucugcaaaagu

SEQ ID NO: 451817 - RNA, 21 nt, Human
uggccuccacagugucuuccu

SEQ ID NO: 451818 - RNA, 19 nt, Human
uggcugacacuacugaucu

SEQ ID NO: 451819 - RNA, 23 nt, Human
uggcugacacuacugaucugagc

SEQ ID NO: 451820 - RNA, 22 nt, Human
uucggcucggguccccggccgg

SEQ ID NO: 451821 - RNA, 22 nt, Human
uucuuaggccaaaaaauaaaua

SEQ ID NO: 451822 - RNA, 18 nt, Human
uugcaaguggguaggaau

SEQ ID NO: 451823 - RNA, 19 nt, Human
uugcaaguggguaggaaug

SEQ ID NO: 451824 - RNA, 21 nt, Human
uuuaaauuggcagaauggcuc

SEQ ID NO: 451825 - RNA, 20 nt, Human
uuuacagaucucuuucaucc

SEQ ID NO: 451826 - RNA, 23 nt, Human
uuuucggcucggguccccggccg

SEQ ID NO: 451827 - RNA, 18 nt, Human
acuaguuuccuuucccca

SEQ ID NO: 451828 - RNA, 22 nt, Human
agaaaaacagaacaguaucaga

SEQ ID NO: 451829 - RNA, 22 nt, Human
agcaucaaagaggaggaaacac

SEQ ID NO: 451830 - RNA, 19 nt, Human
agugucucuggaguuccac

SEQ ID NO: 451831 - RNA, 19 nt, Human
auuucaggagugucucugg

SEQ ID NO: 451832 - RNA, 20 nt, Human
cguuuggcuccuuugacuua

SEQ ID NO: 451833 - RNA, 22 nt, Human
cuccuuugacuuaggacaauuu

SEQ ID NO: 451834 - RNA, 19 nt, Human
cuggcacuguugcuuccuu

SEQ ID NO: 451835 - RNA, 18 nt, Human
cuuggcacccggggccau

SEQ ID NO: 451836 - RNA, 23 nt, Human
gaacgcacgcuggaaccuggcac

SEQ ID NO: 451837 - RNA, 23 nt, Human
gagcaucaaagaggaggaaacac

SEQ ID NO: 451838 - RNA, 21 nt, Human
ggagucugcacacagaaugug

SEQ ID NO: 451839 - RNA, 19 nt, Human
ggggacggcagagagggag

SEQ ID NO: 451840 - RNA, 19 nt, Human
uaaaagggauuuccuuggc

SEQ ID NO: 451841 - RNA, 23 nt, Human
uauccaaaggguauuucgugaag

SEQ ID NO: 451842 - RNA, 23 nt, Human
uauccuugcacacucagaaucuc

SEQ ID NO: 451843 - RNA, 22 nt, Human
ucaacacuagcuucacuuccca

SEQ ID NO: 451844 - RNA, 24 nt, Human
uccaaaggguauuucgugaagaaa

SEQ ID NO: 451845 - RNA, 26 nt, Human
uccaaaggguauuucgugaagaaaaa

SEQ ID NO: 451846 - RNA, 18 nt, Human
uccccaaaaaacuuaaac

SEQ ID NO: 451847 - RNA, 20 nt, Human
ucgugaagaaaaacagaaca

SEQ ID NO: 451848 - RNA, 18 nt, Human
ugcacacagaauguggaa

SEQ ID NO: 451849 - RNA, 21 nt, Human
ugcucuggcguugggagucug

SEQ ID NO: 451850 - RNA, 24 nt, Human
uggcacccggggccaugacggggg

SEQ ID NO: 451851 - RNA, 19 nt, Human
uggcacuguugcuuccuuc

SEQ ID NO: 451852 - RNA, 23 nt, Human
ugucucuggaguuccacuuucuc

SEQ ID NO: 451853 - RNA, 23 nt, Human
uugaauccaaagagccaggcugu

SEQ ID NO: 451854 - RNA, 18 nt, Human
uuuuuuuuuuuuuuucug

SEQ ID NO: 451855 - RNA, 21 nt, Human
aagcaagaauaugacuuuaau

SEQ ID NO: 451856 - RNA, 19 nt, Human
agauggucaggcuuccugu

SEQ ID NO: 451857 - RNA, 19 nt, Human
agcaaccuagaagcgccuc

SEQ ID NO: 451858 - RNA, 21 nt, Human
agggaagggcugagggcuaug

SEQ ID NO: 451859 - RNA, 26 nt, Human
caaaaaguaaagaaggcugauggcaa

SEQ ID NO: 451860 - RNA, 20 nt, Human
caagccuggggagaggccug

SEQ ID NO: 451861 - RNA, 24 nt, Human
cacagggaagagguaguggaggga

SEQ ID NO: 451862 - RNA, 22 nt, Human
caccagaagccacugaaacccc

SEQ ID NO: 451863 - RNA, 18 nt, Human
cagggaauuggaaaucag

SEQ ID NO: 451864 - RNA, 20 nt, Human
ccagaagccacugaaacccc

SEQ ID NO: 451865 - RNA, 21 nt, Human
ccccagcaaccuagaagcgcc

SEQ ID NO: 451866 - RNA, 19 nt, Human
ccuagaagcgccucaccua

SEQ ID NO: 451867 - RNA, 23 nt, Human
gagcaccagaagccacugaaacc

SEQ ID NO: 451868 - RNA, 18 nt, Human
gagggaagggcugagggc

SEQ ID NO: 451869 - RNA, 24 nt, Human
gcagagcucacccuagagcaccag

SEQ ID NO: 451870 - RNA, 20 nt, Human
ggggagaggccuggaaacgg

SEQ ID NO: 451871 - RNA, 20 nt, Human
ucaaaaaguaaagaaggcug

SEQ ID NO: 451872 - RNA, 23 nt, Human
uuaacaucaacaaugacacugug

SEQ ID NO: 451873 - RNA, 25 nt, Human
aaaaaagacaacauauaaccauuaa

SEQ ID NO: 451874 - RNA, 20 nt, Human
aaaaaauuauuuaaucccuu

SEQ ID NO: 451875 - RNA, 18 nt, Human
acuagagcugugcuaagc

SEQ ID NO: 451876 - RNA, 22 nt, Human
agaaacuaaaagcagcccaaac

SEQ ID NO: 451877 - RNA, 20 nt, Human
agacaacauauaaccauuaa

SEQ ID NO: 451878 - RNA, 27 nt, Human
agagaaacuaaaagcagcccaaagggu

SEQ ID NO: 451879 - RNA, 20 nt, Human
agccgcccacaaucugcgcu

SEQ ID NO: 451880 - RNA, 22 nt, Human
auagauaaagccccugaccuuc

SEQ ID NO: 451881 - RNA, 22 nt, Human
caaaagacauaggaaaaaaaga

SEQ ID NO: 451882 - RNA, 26 nt, Human
caaaagacauaggaaaaaaagacaac

SEQ ID NO: 451883 - RNA, 21 nt, Human
cacagcacaggugcuucucuc

SEQ ID NO: 451884 - RNA, 18 nt, Human
cacugauauacauguugc

SEQ ID NO: 451885 - RNA, 19 nt, Human
cagcgauucugagagcaag

SEQ ID NO: 451886 - RNA, 25 nt, Human
cauagauaaagccccugaccuucaa

SEQ ID NO: 451887 - RNA, 20 nt, Human
ccugaccuucaagaaagugu

SEQ ID NO: 451888 - RNA, 22 nt, Human
cggccuaaggcaccucgaaggc

SEQ ID NO: 451889 - RNA, 23 nt, Human
cuaaccauuagcaagaauggacu

SEQ ID NO: 451890 - RNA, 18 nt, Human
cugaccuucaagaaagug

SEQ ID NO: 451891 - RNA, 23 nt, Human
cuucaagaaaguguuagggaaaa

SEQ ID NO: 451892 - RNA, 28 nt, Human
gaaacuaaaagcagcccaaacaauucca

SEQ ID NO: 451893 - RNA, 22 nt, Human
gacagagucuuuacuuuuaaau

SEQ ID NO: 451894 - RNA, 18 nt, Human
gaugaaaucuuuagauaa

SEQ ID NO: 451895 - RNA, 18 nt, Human
gggaaaaaaauuauuuaa

SEQ ID NO: 451896 - RNA, 23 nt, Human
guggaaggaccuauuauauaaua

SEQ ID NO: 451897 - RNA, 23 nt, Human
uaaacuagaucuaagaaagaaaa

SEQ ID NO: 451898 - RNA, 22 nt, Human
uaagagaaacuaaaagcagccc

SEQ ID NO: 451899 - RNA, 18 nt, Human
uaaggcaccucgaaggcc

SEQ ID NO: 451900 - RNA, 19 nt, Human
uaauacauguaacaaguuc

SEQ ID NO: 451901 - RNA, 22 nt, Human
uacaaaaaagcuagauuugcua

SEQ ID NO: 451902 - RNA, 20 nt, Human
uacauguaacaaguucuuga

SEQ ID NO: 451903 - RNA, 20 nt, Human
ucccuuccuuucuucaaagg

SEQ ID NO: 451904 - RNA, 22 nt, Human
ucuaaaaugccacuccacagca

SEQ ID NO: 451905 - RNA, 20 nt, Human
ucuaguaauuuugauuaaga

SEQ ID NO: 451906 - RNA, 22 nt, Human
ugagggcaucuaaaaugccagu

SEQ ID NO: 451907 - RNA, 24 nt, Human
uuuuaaaugauuaucgauacacca

SEQ ID NO: 451908 - RNA, 19 nt, Human
uuuuuuuuuuuuuuuuugc

SEQ ID NO: 451909 - RNA, 24 nt, Human
uuuuuuuuuuuuuuuuuugcauga

SEQ ID NO: 451910 - RNA, 27 nt, Human
uuuuuuuuuuuuuuuuuuuuuuugggg

SEQ ID NO: 451911 - RNA, 18 nt, Human
aaggagguauaaaugagg

SEQ ID NO: 451912 - RNA, 28 nt, Human
acacaccuuuuuuuuucuugaaaacugu

SEQ ID NO: 451913 - RNA, 28 nt, Human
acacaccuuuuuuuuucuugaaaacugu

SEQ ID NO: 451914 - RNA, 20 nt, Human
caacauaaaaauacgaagcc

SEQ ID NO: 451915 - RNA, 20 nt, Human
caacauaaaaauacgaagcc

SEQ ID NO: 451916 - RNA, 25 nt, Human
cugagagauuauucugagagcccau

SEQ ID NO: 451917 - RNA, 23 nt, Human
uaaaaauacgaagccauaagcaa

SEQ ID NO: 451918 - RNA, 24 nt, Human
uaaaaauacgaagccauaagcaac

SEQ ID NO: 451919 - RNA, 24 nt, Human
uaaggagguauaaaugagguguug

SEQ ID NO: 451920 - RNA, 18 nt, Human
uagucugcuccaagcaag

SEQ ID NO: 451921 - RNA, 21 nt, Human
uaucuuagauuguuuuagucg

SEQ ID NO: 451922 - RNA, 21 nt, Human
ucacauggauuucugguuuca

SEQ ID NO: 451923 - RNA, 18 nt, Human
ugagagcccauuaucuua

SEQ ID NO: 451924 - RNA, 22 nt, Human
uguaguucacauggauuucugg

SEQ ID NO: 451925 - RNA, 23 nt, Human
uuuuuucuugaaaacugugaugu

SEQ ID NO: 451926 - RNA, 23 nt, Human
uuuuuucuugaaaacugugaugu

SEQ ID NO: 451927 - RNA, 22 nt, Human
accccacaacgcacccaaagcc

SEQ ID NO: 451928 - RNA, 23 nt, Human
accccacaacgcacccaaagccg

SEQ ID NO: 451929 - RNA, 19 nt, Human
acguugagggccgcacagg

SEQ ID NO: 451930 - RNA, 21 nt, Human
acuccgggagccgaaagugaa

SEQ ID NO: 451931 - RNA, 19 nt, Human
acugguucugcauugaggc

SEQ ID NO: 451932 - RNA, 21 nt, Human
agagaacaauaaauacagaaa

SEQ ID NO: 451933 - RNA, 18 nt, Human
auuuauuugccauucacu

SEQ ID NO: 451934 - RNA, 20 nt, Human
caaauccucgggaccccaca

SEQ ID NO: 451935 - RNA, 25 nt, Human
caagcaguauauguaacaguaauau

SEQ ID NO: 451936 - RNA, 25 nt, Human
cacucuuaacucuaaacacagugcu

SEQ ID NO: 451937 - RNA, 22 nt, Human
cagccgggcuggggcgccgcgu

SEQ ID NO: 451938 - RNA, 21 nt, Human
caguggagggagacuccggga

SEQ ID NO: 451939 - RNA, 19 nt, Human
ccagagaacaauaaauaca

SEQ ID NO: 451940 - RNA, 21 nt, Human
ccauucacuacuuugcaacaa

SEQ ID NO: 451941 - RNA, 19 nt, Human
cccacaacgcacccaaagc

SEQ ID NO: 451942 - RNA, 18 nt, Human
ccccacaacgcacccaaa

SEQ ID NO: 451943 - RNA, 19 nt, Human
ccgggagccgaaagugaac

SEQ ID NO: 451944 - RNA, 23 nt, Human
ccugucagguccagaggucugag

SEQ ID NO: 451945 - RNA, 18 nt, Human
cguugagggccgcacagg

SEQ ID NO: 451946 - RNA, 23 nt, Human
cuccgggagccgaaagugaacgg

SEQ ID NO: 451947 - RNA, 27 nt, Human
cucgggaccccacaacgcacccaaagg

SEQ ID NO: 451948 - RNA, 23 nt, Human
gaccccacaacgcacccaaagcc

SEQ ID NO: 451949 - RNA, 24 nt, Human
ggacacagccgggcuggggcgccg

SEQ ID NO: 451950 - RNA, 22 nt, Human
ggucugagcaguggagggagac

SEQ ID NO: 451951 - RNA, 19 nt, Human
ggugguccggggcgccggg

SEQ ID NO: 451952 - RNA, 21 nt, Human
guccagaggucugagcagugg

SEQ ID NO: 451953 - RNA, 24 nt, Human
uacagaaucaccuacuuuuauaca

SEQ ID NO: 451954 - RNA, 21 nt, Human
uauuuuguuguuguuguuugg

SEQ ID NO: 451955 - RNA, 18 nt, Human
ucaaaguccaaguaaaga

SEQ ID NO: 451956 - RNA, 21 nt, Human
ucuccugucagguccagaggu

SEQ ID NO: 451957 - RNA, 22 nt, Human
ugaaugucuuucaacaaauccu

SEQ ID NO: 451958 - RNA, 19 nt, Human
ugaggcggaggggaaggcc

SEQ ID NO: 451959 - RNA, 23 nt, Human
ugccauucacuacuuugcaacaa

SEQ ID NO: 451960 - RNA, 23 nt, Human
ugggaaaagcuauauaacagagg

SEQ ID NO: 451961 - RNA, 23 nt, Human
uuaacucuaaacacagugcuccc

SEQ ID NO: 451962 - RNA, 26 nt, Human
uuauuuuguuguuguuguuuggaaau

SEQ ID NO: 451963 - RNA, 20 nt, Human
uuccaaguaaaaucaaacag

SEQ ID NO: 451964 - RNA, 20 nt, Human
uucguaaucuugaaugucuu

SEQ ID NO: 451965 - RNA, 21 nt, Human
uugaggcggaggggaaggcca

SEQ ID NO: 451966 - RNA, 25 nt, Human
acagagccugccuuucaggcucuuc

SEQ ID NO: 451967 - RNA, 23 nt, Human
accuuaaaaaaauccaaaagaga

SEQ ID NO: 451968 - RNA, 22 nt, Human
agcaaauaccuuaaaaaaaucc

SEQ ID NO: 451969 - RNA, 24 nt, Human
auaccaggucauuuucaauuuccg

SEQ ID NO: 451970 - RNA, 22 nt, Human
caaccugguagcucuccuuaga

SEQ ID NO: 451971 - RNA, 28 nt, Human
cugcggugacaaccugguagcucuccuu

SEQ ID NO: 451972 - RNA, 19 nt, Human
gagcucagaucuaccuuuc

SEQ ID NO: 451973 - RNA, 25 nt, Human
uaagaaagcccucuggcaagauacc

SEQ ID NO: 451974 - RNA, 24 nt, Human
uaccuuuccucuucauggaccaga

SEQ ID NO: 451975 - RNA, 18 nt, Human
uagcucuccuuagagagg

SEQ ID NO: 451976 - RNA, 23 nt, Human
ucauggaccagacuggaauuggu

SEQ ID NO: 451977 - RNA, 18 nt, Human
aaaaacacacacacacac

SEQ ID NO: 451978 - RNA, 18 nt, Human
aaaaacacacacacacac

SEQ ID NO: 451979 - RNA, 22 nt, Human
aaaaagagagacaaaaaggaag

SEQ ID NO: 451980 - RNA, 26 nt, Human
aaaaagagagacaaaaaggaaggggu

SEQ ID NO: 451981 - RNA, 25 nt, Human
aaaacacagaaacucacucaaugaa

SEQ ID NO: 451982 - RNA, 23 nt, Human
aacacaacagucacugacauggc

SEQ ID NO: 451983 - RNA, 22 nt, Human
aacgagccacgcuggcaaacaa

SEQ ID NO: 451984 - RNA, 21 nt, Human
aacucccuuccucugaaacaa

SEQ ID NO: 451985 - RNA, 21 nt, Human
aagaaaccaaauagauccugc

SEQ ID NO: 451986 - RNA, 24 nt, Human
aagaugccucugccuuuguggggu

SEQ ID NO: 451987 - RNA, 24 nt, Human
aagcugccaccaguguuguuccga

SEQ ID NO: 451988 - RNA, 22 nt, Human
aaguagcgccaggcagaggguu

SEQ ID NO: 451989 - RNA, 23 nt, Human
aaguagcgccaggcagaggguuu

SEQ ID NO: 451990 - RNA, 26 nt, Human
aaucuucaccacuggcugccuuucag

SEQ ID NO: 451991 - RNA, 22 nt, Human
acaacacaaaauacaaaagcuu

SEQ ID NO: 451992 - RNA, 21 nt, Human
acaaccuucagcuacacagaa

SEQ ID NO: 451993 - RNA, 20 nt, Human
acacaaaauacaaaagcuua

SEQ ID NO: 451994 - RNA, 23 nt, Human
acacacacacacacacacacaca

SEQ ID NO: 451995 - RNA, 23 nt, Human
acacacacacacacacacacaca

SEQ ID NO: 451996 - RNA, 23 nt, Human
acacacacacacacacacacaca

SEQ ID NO: 451997 - RNA, 23 nt, Human
acacacacacacacacacacaca

SEQ ID NO: 451998 - RNA, 23 nt, Human
acacacacacacacacacacaca

SEQ ID NO: 451999 - RNA, 23 nt, Human
acacacacacacacacacacaca

SEQ ID NO: 452000 - RNA, 24 nt, Human
acacacacacacaccccccacaca

SEQ ID NO: 452001 - RNA, 21 nt, Human
acacgcccugccugcaggagc

SEQ ID NO: 452002 - RNA, 20 nt, Human
accagggcccccuccagcga

SEQ ID NO: 452003 - RNA, 19 nt, Human
accccacaaacacaacagu

SEQ ID NO: 452004 - RNA, 20 nt, Human
accccaguaaaaacaagaca

SEQ ID NO: 452005 - RNA, 20 nt, Human
accccaguaaaaacaagaca

SEQ ID NO: 452006 - RNA, 23 nt, Human
accuuuccgcuuuggucuuggag

SEQ ID NO: 452007 - RNA, 18 nt, Human
acgaucccaggaauccag

SEQ ID NO: 452008 - RNA, 19 nt, Human
acgcaaauccaagaucuca

SEQ ID NO: 452009 - RNA, 23 nt, Human
acgcaaauccaagaucucaacca

SEQ ID NO: 452010 - RNA, 23 nt, Human
acugcaaaauccacagguggcgg

SEQ ID NO: 452011 - RNA, 19 nt, Human
agaaaaaaaaagagagaca

SEQ ID NO: 452012 - RNA, 24 nt, Human
agaaaaguacugcaaaacugcaga

SEQ ID NO: 452013 - RNA, 22 nt, Human
agaacacugacgaguaccuucc

SEQ ID NO: 452014 - RNA, 20 nt, Human
agaagaugcuucggagcucc

SEQ ID NO: 452015 - RNA, 24 nt, Human
agaagcaacuugaaaacccaagaa

SEQ ID NO: 452016 - RNA, 18 nt, Human
agaccaucuucauucugc

SEQ ID NO: 452017 - RNA, 26 nt, Human
agagaaaaaaaaagagagacaaaaag

SEQ ID NO: 452018 - RNA, 22 nt, Human
agagacaaaaaggaaggggugg

SEQ ID NO: 452019 - RNA, 20 nt, Human
agagagagaucaaccaauga

SEQ ID NO: 452020 - RNA, 22 nt, Human
agagucccagcccccugaccuu

SEQ ID NO: 452021 - RNA, 19 nt, Human
agcagccacagcuuuauaa

SEQ ID NO: 452022 - RNA, 23 nt, Human
aggaagggguggggggaggggaa

SEQ ID NO: 452023 - RNA, 20 nt, Human
aggcucccacacgcccugcc

SEQ ID NO: 452024 - RNA, 19 nt, Human
agggaagcgccaagaccag

SEQ ID NO: 452025 - RNA, 20 nt, Human
agggguggggggaggggaag

SEQ ID NO: 452026 - RNA, 19 nt, Human
auguggugucaacagccaa

SEQ ID NO: 452027 - RNA, 19 nt, Human
auuagcauaucaauuucca

SEQ ID NO: 452028 - RNA, 21 nt, Human
caacugaauccuuaugcuuaa

SEQ ID NO: 452029 - RNA, 22 nt, Human
caagaaguaaacgcaaauccaa

SEQ ID NO: 452030 - RNA, 24 nt, Human
caagaccagggcccccuccagcga

SEQ ID NO: 452031 - RNA, 24 nt, Human
caagagcaggaguuaguaggcauc

SEQ ID NO: 452032 - RNA, 18 nt, Human
caaggauaacagauugga

SEQ ID NO: 452033 - RNA, 18 nt, Human
cacaacagucacugacau

SEQ ID NO: 452034 - RNA, 20 nt, Human
cacacacacacacacacaca

SEQ ID NO: 452035 - RNA, 20 nt, Human
cacacacacacacacacaca

SEQ ID NO: 452036 - RNA, 20 nt, Human
cacacacacacacacacaca

SEQ ID NO: 452037 - RNA, 20 nt, Human
cacacacacacacacacaca

SEQ ID NO: 452038 - RNA, 20 nt, Human
cacacacacacacacacaca

SEQ ID NO: 452039 - RNA, 20 nt, Human
cacacacacacacacacaca

SEQ ID NO: 452040 - RNA, 20 nt, Human
cacacacacacacacacaca

SEQ ID NO: 452041 - RNA, 20 nt, Human
cacacacacacacacacaca

SEQ ID NO: 452042 - RNA, 20 nt, Human
cacacacacacacacacaca

SEQ ID NO: 452043 - RNA, 20 nt, Human
cacacacacacacacacaca

SEQ ID NO: 452044 - RNA, 22 nt, Human
cacacacacacacacacacaca

SEQ ID NO: 452045 - RNA, 22 nt, Human
cacacacacacacacacacaca

SEQ ID NO: 452046 - RNA, 22 nt, Human
cacacacacacacacacacaca

SEQ ID NO: 452047 - RNA, 27 nt, Human
cacacaccccccacacacuucaaacau

SEQ ID NO: 452048 - RNA, 22 nt, Human
cacacgcccugccugcaggagc

SEQ ID NO: 452049 - RNA, 20 nt, Human
caccccccacacacuucaaa

SEQ ID NO: 452050 - RNA, 19 nt, Human
caccggacugcauccuccu

SEQ ID NO: 452051 - RNA, 22 nt, Human
caccugaccccacaaacacaac

SEQ ID NO: 452052 - RNA, 23 nt, Human
cagaaaagguuaaagauaaaaau

SEQ ID NO: 452053 - RNA, 22 nt, Human
cagacugcgccucaaaccaugc

SEQ ID NO: 452054 - RNA, 22 nt, Human
cagagcuccccucuaaucaaaa

SEQ ID NO: 452055 - RNA, 21 nt, Human
cagcacaaauuucuccuccac

SEQ ID NO: 452056 - RNA, 18 nt, Human
cagucacugacauggccc

SEQ ID NO: 452057 - RNA, 19 nt, Human
caugaguuuacaguuaacc

SEQ ID NO: 452058 - RNA, 28 nt, Human
cauucugcuucugcuggaaaccucuaaa

SEQ ID NO: 452059 - RNA, 19 nt, Human
ccaaaccgacaccaagagc

SEQ ID NO: 452060 - RNA, 23 nt, Human
ccaaaccgacaccaagagcuuuc

SEQ ID NO: 452061 - RNA, 19 nt, Human
ccacaaacacaacagucac

SEQ ID NO: 452062 - RNA, 22 nt, Human
ccagagcuccccucuaaucaaa

SEQ ID NO: 452063 - RNA, 23 nt, Human
ccagagcuccccucuaaucaaaa

SEQ ID NO: 452064 - RNA, 21 nt, Human
ccauauaaaucucccagcuga

SEQ ID NO: 452065 - RNA, 21 nt, Human
cccacaaacacaacagucacu

SEQ ID NO: 452066 - RNA, 25 nt, Human
cccacaaacacaacagucacugaca

SEQ ID NO: 452067 - RNA, 20 nt, Human
cccacacgcccugccugcag

SEQ ID NO: 452068 - RNA, 26 nt, Human
cccacacgcccugccugcaggagcca

SEQ ID NO: 452069 - RNA, 21 nt, Human
cccaccacaacuaagaugacc

SEQ ID NO: 452070 - RNA, 25 nt, Human
cccaccacaacuaagaugacccuag

SEQ ID NO: 452071 - RNA, 20 nt, Human
ccccaggggcuggaaaaggg

SEQ ID NO: 452072 - RNA, 26 nt, Human
ccugaccccacaaacacaacagucac

SEQ ID NO: 452073 - RNA, 18 nt, Human
cgccaagaccagggcccc

SEQ ID NO: 452074 - RNA, 23 nt, Human
cgcucagaaacacgaaagaucau

SEQ ID NO: 452075 - RNA, 25 nt, Human
cggcaguggaacagaucccagaucc

SEQ ID NO: 452076 - RNA, 22 nt, Human
cuaccccaguaaaaacaagaca

SEQ ID NO: 452077 - RNA, 23 nt, Human
cucacacacuauggaugcugaau

SEQ ID NO: 452078 - RNA, 21 nt, Human
cucucaccggacugcauccuc

SEQ ID NO: 452079 - RNA, 20 nt, Human
cuucauucugcuucugcugg

SEQ ID NO: 452080 - RNA, 18 nt, Human
gaaaacacagaaacucac

SEQ ID NO: 452081 - RNA, 19 nt, Human
gacaacaaaauucaaguca

SEQ ID NO: 452082 - RNA, 19 nt, Human
gacaacacaaaauacaaaa

SEQ ID NO: 452083 - RNA, 21 nt, Human
gaccucaaauuaaauuggcug

SEQ ID NO: 452084 - RNA, 20 nt, Human
gaccuccgagaaguacccag

SEQ ID NO: 452085 - RNA, 20 nt, Human
gacugcaaacucccuuccuc

SEQ ID NO: 452086 - RNA, 20 nt, Human
gacuguguaccucaaggccc

SEQ ID NO: 452087 - RNA, 24 nt, Human
gagaaaucuucaccacuggcugcc

SEQ ID NO: 452088 - RNA, 19 nt, Human
gagagacaaaaaggaaggg

SEQ ID NO: 452089 - RNA, 25 nt, Human
gagcaggaguuaguaggcaucagaa

SEQ ID NO: 452090 - RNA, 21 nt, Human
gcaaauccaagaucucaacca

SEQ ID NO: 452091 - RNA, 23 nt, Human
gcaaauccaagaucucaaccaca

SEQ ID NO: 452092 - RNA, 22 nt, Human
ggaaaccucuaaaacuuucuga

SEQ ID NO: 452093 - RNA, 22 nt, Human
gggcuggaaaagggaggucugc

SEQ ID NO: 452094 - RNA, 19 nt, Human
ggggugggggaggcauuag

SEQ ID NO: 452095 - RNA, 20 nt, Human
gguuaaagauaaaaauagcu

SEQ ID NO: 452096 - RNA, 20 nt, Human
uaaaaugcugcccuaaaggc

SEQ ID NO: 452097 - RNA, 26 nt, Human
uaaagcauacugugccagagcucccc

SEQ ID NO: 452098 - RNA, 27 nt, Human
uaacagauuggacuuaggacacucucu

SEQ ID NO: 452099 - RNA, 22 nt, Human
uaacuuuuuaccaaaugucacu

SEQ ID NO: 452100 - RNA, 26 nt, Human
uaagaaacaugccggcauguagucca

SEQ ID NO: 452101 - RNA, 18 nt, Human
uacacaagcuuuauuggg

SEQ ID NO: 452102 - RNA, 24 nt, Human
uacagacugauuuccaagaaaacg

SEQ ID NO: 452103 - RNA, 21 nt, Human
uacagagccagguucagcauc

SEQ ID NO: 452104 - RNA, 21 nt, Human
uacauuaaaaaguagcauggc

SEQ ID NO: 452105 - RNA, 23 nt, Human
uacauuaaaaaguagcauggcca

SEQ ID NO: 452106 - RNA, 22 nt, Human
uaccaugccccccaccugaccc

SEQ ID NO: 452107 - RNA, 22 nt, Human
uaccccaguaaaaacaagacaa

SEQ ID NO: 452108 - RNA, 24 nt, Human
uaccucaaggcccucugaccucaa

SEQ ID NO: 452109 - RNA, 19 nt, Human
uaggcgcagagccacuucc

SEQ ID NO: 452110 - RNA, 20 nt, Human
uaguccauccugggagggga

SEQ ID NO: 452111 - RNA, 24 nt, Human
uauguauucaucaagaaguaaacg

SEQ ID NO: 452112 - RNA, 18 nt, Human
ucaacugaauccuuaugc

SEQ ID NO: 452113 - RNA, 19 nt, Human
ucacacacuauggaugcug

SEQ ID NO: 452114 - RNA, 22 nt, Human
ucacaucugccauguugccuaa

SEQ ID NO: 452115 - RNA, 20 nt, Human
ucaccggacugcauccuccu

SEQ ID NO: 452116 - RNA, 24 nt, Human
ucagccccuccugggagcauucuc

SEQ ID NO: 452117 - RNA, 22 nt, Human
ucaucaaaagacauaugaacaa

SEQ ID NO: 452118 - RNA, 18 nt, Human
ucccccugucacacaacc

SEQ ID NO: 452119 - RNA, 21 nt, Human
ucuaaucaaaaaacgcugucc

SEQ ID NO: 452120 - RNA, 22 nt, Human
ucuuucaggacccucccucccg

SEQ ID NO: 452121 - RNA, 19 nt, Human
ugaaaaugucugagguccu

SEQ ID NO: 452122 - RNA, 20 nt, Human
ugacaucauucucucgcucu

SEQ ID NO: 452123 - RNA, 22 nt, Human
ugaccccacaaacacaacaguc

SEQ ID NO: 452124 - RNA, 20 nt, Human
ugacgaggcucccacacgcc

SEQ ID NO: 452125 - RNA, 18 nt, Human
ugaggaaaucacagacuc

SEQ ID NO: 452126 - RNA, 21 nt, Human
ugcaaaacugcagaaucauaa

SEQ ID NO: 452127 - RNA, 22 nt, Human
ugcuguggcggagaagacagau

SEQ ID NO: 452128 - RNA, 19 nt, Human
ugcuucggagcuccaggug

SEQ ID NO: 452129 - RNA, 23 nt, Human
uggcacguuuccugcuaaaacaa

SEQ ID NO: 452130 - RNA, 22 nt, Human
uggcggggggugggggaggcau

SEQ ID NO: 452131 - RNA, 22 nt, Human
uggcgguuaauauaaauggaac

SEQ ID NO: 452132 - RNA, 21 nt, Human
ugggcuuacagucugauugug

SEQ ID NO: 452133 - RNA, 18 nt, Human
ugggguucucugcugggc

SEQ ID NO: 452134 - RNA, 23 nt, Human
ugggucucuuucaggacccuccc

SEQ ID NO: 452135 - RNA, 28 nt, Human
ugucacacaaccaucaucaaaagacagc

SEQ ID NO: 452136 - RNA, 22 nt, Human
uguccucucaccggacugcauc

SEQ ID NO: 452137 - RNA, 20 nt, Human
uuaaagauccaccaacuuaa

SEQ ID NO: 452138 - RNA, 28 nt, Human
uucacacacacacacaccccccacacac

SEQ ID NO: 452139 - RNA, 21 nt, Human
uuccgcuuuggucuuggagga

SEQ ID NO: 452140 - RNA, 23 nt, Human
uuuaaaaugcugcccuaaaggca

SEQ ID NO: 452141 - RNA, 19 nt, Human
uuucacacacacacacacc

SEQ ID NO: 452142 - RNA, 20 nt, Human
uuucaggacccucccucccg

SEQ ID NO: 452143 - RNA, 18 nt, Human
uuugcaaagucuaaacag

SEQ ID NO: 452144 - RNA, 23 nt, Human
uuuugcaaauaccaugcccccca

SEQ ID NO: 452145 - RNA, 20 nt, Human
aagggcagaaggugcugggg

SEQ ID NO: 452146 - RNA, 26 nt, Human
aaggugcuggggccagcccgcugggg

SEQ ID NO: 452147 - RNA, 21 nt, Human
aauacaaaaaaagaaagaaaa

SEQ ID NO: 452148 - RNA, 22 nt, Human
acaauacaaaaaaagaaagaaa

SEQ ID NO: 452149 - RNA, 21 nt, Human
acacuuaagaggaagaggcca

SEQ ID NO: 452150 - RNA, 22 nt, Human
agaaggugcuggggccagcccg

SEQ ID NO: 452151 - RNA, 23 nt, Human
agagaaacagggcauuauuugca

SEQ ID NO: 452152 - RNA, 19 nt, Human
agaggcugucucagcaucu

SEQ ID NO: 452153 - RNA, 20 nt, Human
agaggcugucucagcaucua

SEQ ID NO: 452154 - RNA, 24 nt, Human
aggaagaggccaucgcagcaucug

SEQ ID NO: 452155 - RNA, 19 nt, Human
aggagaggcugucucagca

SEQ ID NO: 452156 - RNA, 20 nt, Human
agggagaagccauccuggca

SEQ ID NO: 452157 - RNA, 20 nt, Human
agggagaggcugucucagca

SEQ ID NO: 452158 - RNA, 20 nt, Human
agggaggggccaucccggca

SEQ ID NO: 452159 - RNA, 18 nt, Human
aggugcuggggccagccu

SEQ ID NO: 452160 - RNA, 20 nt, Human
caauauggaaauacaauuuu

SEQ ID NO: 452161 - RNA, 24 nt, Human
cagcccgcuggggguggcgguccg

SEQ ID NO: 452162 - RNA, 22 nt, Human
ccauccuggcaucugugcccug

SEQ ID NO: 452163 - RNA, 18 nt, Human
ccugggcucgccuggcgu

SEQ ID NO: 452164 - RNA, 22 nt, Human
cgucccggccucugugcccugg

SEQ ID NO: 452165 - RNA, 23 nt, Human
cuggggccagcccgcugggggug

SEQ ID NO: 452166 - RNA, 27 nt, Human
gaaauacaauuuugacaauacaaaaaa

SEQ ID NO: 452167 - RNA, 27 nt, Human
gagaaaaagaaucccaaauuaaaaugu

SEQ ID NO: 452168 - RNA, 21 nt, Human
gagaaggagaggcugucucag

SEQ ID NO: 452169 - RNA, 23 nt, Human
gagaggcugucucagcaucugug

SEQ ID NO: 452170 - RNA, 20 nt, Human
gagagggagaagccauccug

SEQ ID NO: 452171 - RNA, 21 nt, Human
gaggaagaggccaucgcagca

SEQ ID NO: 452172 - RNA, 19 nt, Human
gcacugagagggagaagcc

SEQ ID NO: 452173 - RNA, 21 nt, Human
gcaggggugaggccccacacu

SEQ ID NO: 452174 - RNA, 19 nt, Human
gcccugggcucgccuggcg

SEQ ID NO: 452175 - RNA, 24 nt, Human
ggagaggcugucucagcaucuaug

SEQ ID NO: 452176 - RNA, 24 nt, Human
ggagaggcugucucagcaucugug

SEQ ID NO: 452177 - RNA, 19 nt, Human
gggaagggcagaaggugcu

SEQ ID NO: 452178 - RNA, 22 nt, Human
gucccggccucugugcccuggg

SEQ ID NO: 452179 - RNA, 23 nt, Human
ucccggccucugugcccugggcu

SEQ ID NO: 452180 - RNA, 24 nt, Human
ugacaauacaaaaaaagaaagaaa

SEQ ID NO: 452181 - RNA, 19 nt, Human
ugagagggaggggccaucc

SEQ ID NO: 452182 - RNA, 19 nt, Human
ugcccugggcucgccuggc

SEQ ID NO: 452183 - RNA, 20 nt, Human
ugcccugggcucgccuggcg

SEQ ID NO: 452184 - RNA, 20 nt, Human
ugcccugggcuugccuagca

SEQ ID NO: 452185 - RNA, 23 nt, Human
uggcaaacccugcguucacuggc

SEQ ID NO: 452186 - RNA, 18 nt, Human
ugggaagggcagaaggug

SEQ ID NO: 452187 - RNA, 21 nt, Human
ugguagcaauggcaaacccug

SEQ ID NO: 452188 - RNA, 20 nt, Human
ugucuaaguuacaggcacag

SEQ ID NO: 452189 - RNA, 25 nt, Human
uuacaggcacagagaaacagggcau

SEQ ID NO: 452190 - RNA, 24 nt, Human
uuguggugcuugcuugguagcaau

SEQ ID NO: 452191 - RNA, 23 nt, Human
aaaaaaggaaaccucaaguaugc

SEQ ID NO: 452192 - RNA, 25 nt, Human
aacaggauguuuggcuuaugcuuuu

SEQ ID NO: 452193 - RNA, 22 nt, Human
aacugcucauuauaaaugcuga

SEQ ID NO: 452194 - RNA, 25 nt, Human
aagcccauaucuaacuacagcaggu

SEQ ID NO: 452195 - RNA, 22 nt, Human
accucgaacacuuaaaaaagga

SEQ ID NO: 452196 - RNA, 18 nt, Human
accugaaauuugcugaua

SEQ ID NO: 452197 - RNA, 19 nt, Human
acuaaaggcaucucugggg

SEQ ID NO: 452198 - RNA, 21 nt, Human
aggaaaccucaaguaugcuga

SEQ ID NO: 452199 - RNA, 20 nt, Human
cccccgccuccuccuccucc

SEQ ID NO: 452200 - RNA, 18 nt, Human
ccccgccuccuccuccuc

SEQ ID NO: 452201 - RNA, 20 nt, Human
ccccgccuccuccuccuccu

SEQ ID NO: 452202 - RNA, 22 nt, Human
cgaacacuuaaaaaaggaaacc

SEQ ID NO: 452203 - RNA, 22 nt, Human
cugguuauucuacaguuuaaac

SEQ ID NO: 452204 - RNA, 24 nt, Human
gaagucuuuaaccugaugggaaua

SEQ ID NO: 452205 - RNA, 19 nt, Human
ggaauaucugguuauucua

SEQ ID NO: 452206 - RNA, 24 nt, Human
uaaacaggauguuuggcuuaugcu

SEQ ID NO: 452207 - RNA, 18 nt, Human
uaaagaugacaaacucau

SEQ ID NO: 452208 - RNA, 19 nt, Human
uaacagguggaguuagaaa

SEQ ID NO: 452209 - RNA, 22 nt, Human
uaauagggcucaucucugugac

SEQ ID NO: 452210 - RNA, 23 nt, Human
uagggcaacucauuaccaacugc

SEQ ID NO: 452211 - RNA, 23 nt, Human
uauaccugaaauuugcugauacc

SEQ ID NO: 452212 - RNA, 24 nt, Human
uaucuaacuauaccugaaauuugc

SEQ ID NO: 452213 - RNA, 23 nt, Human
uaugcuuuuguucagcugacugg

SEQ ID NO: 452214 - RNA, 20 nt, Human
ucaaaguggccagaaugcaa

SEQ ID NO: 452215 - RNA, 21 nt, Human
ugacaaacucaucauuuggga

SEQ ID NO: 452216 - RNA, 21 nt, Human
ugacaaacucaucauuuggga

SEQ ID NO: 452217 - RNA, 18 nt, Human
ugacugcuugcgacaagc

SEQ ID NO: 452218 - RNA, 22 nt, Human
ugagucaacuaggugaagggcc

SEQ ID NO: 452219 - RNA, 19 nt, Human
ugaguucauaaagaugaca

SEQ ID NO: 452220 - RNA, 22 nt, Human
ugaguucauaaagaugacaaac

SEQ ID NO: 452221 - RNA, 21 nt, Human
ugggaaggauuaaagcccaua

SEQ ID NO: 452222 - RNA, 20 nt, Human
ugugacugcuugcgacaagc

SEQ ID NO: 452223 - RNA, 21 nt, Human
ugugcaaaaucaagucaacug

SEQ ID NO: 452224 - RNA, 18 nt, Human
uucauaaagaugacaaac

SEQ ID NO: 452225 - RNA, 20 nt, Human
uuugcugauaccccaagcca

SEQ ID NO: 452226 - RNA, 22 nt, Human
aaggaccagcccccagggccuu

SEQ ID NO: 452227 - RNA, 24 nt, Human
agacgcgaaaccuggagcaggaaa

SEQ ID NO: 452228 - RNA, 19 nt, Human
aggcaaaggaccagccccc

SEQ ID NO: 452229 - RNA, 22 nt, Human
aggcaaaggaccagcccccagg

SEQ ID NO: 452230 - RNA, 23 nt, Human
aggcaaaggaccagcccccaggg

SEQ ID NO: 452231 - RNA, 21 nt, Human
caaaggaccagcccccagggc

SEQ ID NO: 452232 - RNA, 19 nt, Human
caggaaacacagagcgaug

SEQ ID NO: 452233 - RNA, 18 nt, Human
caugacaccuacggcgcg

SEQ ID NO: 452234 - RNA, 25 nt, Human
ccaaagccgcacggucgggcuguac

SEQ ID NO: 452235 - RNA, 22 nt, Human
ccucagagcccucaaccucccu

SEQ ID NO: 452236 - RNA, 25 nt, Human
ccuugucggaauuugguaaaggguc

SEQ ID NO: 452237 - RNA, 26 nt, Human
cgccgccaucuuccgcaugacaccua

SEQ ID NO: 452238 - RNA, 24 nt, Human
cgcgaaaccuggagcaggaaacac

SEQ ID NO: 452239 - RNA, 20 nt, Human
cucagagcccucaaccuccc

SEQ ID NO: 452240 - RNA, 19 nt, Human
cuuccgcaugacaccuacg

SEQ ID NO: 452241 - RNA, 28 nt, Human
gcgaaaccuggagcaggaaacacagagc

SEQ ID NO: 452242 - RNA, 18 nt, Human
ggcaaaggaccagccccc

SEQ ID NO: 452243 - RNA, 18 nt, Human
gggccagacaggcaaagg

SEQ ID NO: 452244 - RNA, 18 nt, Human
gggcuguacggaaaccuc

SEQ ID NO: 452245 - RNA, 18 nt, Human
gucugggaagaugcgaga

SEQ ID NO: 452246 - RNA, 22 nt, Human
uaaagggucuacccuacgaagc

SEQ ID NO: 452247 - RNA, 24 nt, Human
aaacaaacuugacuauaaugaaau

SEQ ID NO: 452248 - RNA, 24 nt, Human
aaacuugacuauaaugaaaugggc

SEQ ID NO: 452249 - RNA, 26 nt, Human
aaaggacauaccuaugaccggggccc

SEQ ID NO: 452250 - RNA, 21 nt, Human
aaaugguggcaaaaaccgagc

SEQ ID NO: 452251 - RNA, 22 nt, Human
aacacaaccaccacccuagucc

SEQ ID NO: 452252 - RNA, 23 nt, Human
aagccgcagggcccgcccaaaca

SEQ ID NO: 452253 - RNA, 23 nt, Human
aaggacacagacuuauaaauggu

SEQ ID NO: 452254 - RNA, 18 nt, Human
aagggccagguuuucagu

SEQ ID NO: 452255 - RNA, 20 nt, Human
aaugaaaugggcaaaaagga

SEQ ID NO: 452256 - RNA, 18 nt, Human
acauaccuaugacuauaa

SEQ ID NO: 452257 - RNA, 19 nt, Human
acccggcuggagcuggagc

SEQ ID NO: 452258 - RNA, 20 nt, Human
acgggcgagggcagaacaca

SEQ ID NO: 452259 - RNA, 23 nt, Human
acucaagaaaaggacacagacuu

SEQ ID NO: 452260 - RNA, 24 nt, Human
acuuauaaaugguggcaaaaaccg

SEQ ID NO: 452261 - RNA, 18 nt, Human
agccccauaaaagaaguc

SEQ ID NO: 452262 - RNA, 21 nt, Human
agcuggagcgggggcgggggc

SEQ ID NO: 452263 - RNA, 26 nt, Human
aggaagaaacaaacuugacuauaaug

SEQ ID NO: 452264 - RNA, 20 nt, Human
caaccaccacccuagucccg

SEQ ID NO: 452265 - RNA, 24 nt, Human
caagaaaaggacacagacuuauaa

SEQ ID NO: 452266 - RNA, 20 nt, Human
caagacgaaucaaugacuga

SEQ ID NO: 452267 - RNA, 22 nt, Human
cacaaccaccacccuagucccg

SEQ ID NO: 452268 - RNA, 20 nt, Human
cagcccagcguuggcgacgg

SEQ ID NO: 452269 - RNA, 22 nt, Human
caggaagaaacaaacuugacua

SEQ ID NO: 452270 - RNA, 28 nt, Human
caggaagaaacaaacuugacuauaaugg

SEQ ID NO: 452271 - RNA, 18 nt, Human
ccgcagggcccgcccaaa

SEQ ID NO: 452272 - RNA, 26 nt, Human
cgccaggagccccauaaaagaagucc

SEQ ID NO: 452273 - RNA, 18 nt, Human
cgggggcggggcgagggc

SEQ ID NO: 452274 - RNA, 20 nt, Human
cugaaugaauagcaccgcca

SEQ ID NO: 452275 - RNA, 23 nt, Human
gaaaauaaauaugaaacacagga

SEQ ID NO: 452276 - RNA, 22 nt, Human
gcccagaguuucucccacggcc

SEQ ID NO: 452277 - RNA, 21 nt, Human
gcgcgacccaaagggccaggu

SEQ ID NO: 452278 - RNA, 22 nt, Human
gcgcgacccaaagggccagguu

SEQ ID NO: 452279 - RNA, 19 nt, Human
gcggggcgagggcggggcc

SEQ ID NO: 452280 - RNA, 23 nt, Human
gcggggcgagggcgggugcuggg

SEQ ID NO: 452281 - RNA, 18 nt, Human
ggccgagcgaggacccgg

SEQ ID NO: 452282 - RNA, 23 nt, Human
ggccgagcgaggacccggcugga

SEQ ID NO: 452283 - RNA, 18 nt, Human
gggcccgcccaaacaaga

SEQ ID NO: 452284 - RNA, 22 nt, Human
gggccgagggcgagccggaaga

SEQ ID NO: 452285 - RNA, 20 nt, Human
gggcggggcgagggcggggc

SEQ ID NO: 452286 - RNA, 21 nt, Human
gggcggggcgagggcggggcc

SEQ ID NO: 452287 - RNA, 21 nt, Human
gggcuggggccgggauggaga

SEQ ID NO: 452288 - RNA, 22 nt, Human
gggggcggggcgagggcggggc

SEQ ID NO: 452289 - RNA, 19 nt, Human
gugagucaacugcaacaaa

SEQ ID NO: 452290 - RNA, 20 nt, Human
uaguggacgcucgacugggc

SEQ ID NO: 452291 - RNA, 24 nt, Human
uaugaaacacaggaagaaacaaac

SEQ ID NO: 452292 - RNA, 23 nt, Human
ucaagaaaaggacacagacuuau

SEQ ID NO: 452293 - RNA, 18 nt, Human
ucaguacucaagaaaagg

SEQ ID NO: 452294 - RNA, 18 nt, Human
ucagucuucgcugugaca

SEQ ID NO: 452295 - RNA, 22 nt, Human
uccgugaggagcgaggauuagg

SEQ ID NO: 452296 - RNA, 22 nt, Human
ugaaaauaaauaugaaacacag

SEQ ID NO: 452297 - RNA, 19 nt, Human
ugccgggucgaguacagag

SEQ ID NO: 452298 - RNA, 23 nt, Human
uggagcgggggcgggggcggggc

SEQ ID NO: 452299 - RNA, 22 nt, Human
ugucugguucuuccgguaccca

SEQ ID NO: 452300 - RNA, 19 nt, Human
uuuuuuuuuuuuuuugucu

SEQ ID NO: 452301 - RNA, 18 nt, Human
uuuuuuuuuuuuuuuuug

SEQ ID NO: 452302 - RNA, 19 nt, Human
uuuuuuuuuuuuuuuuugu

SEQ ID NO: 452303 - RNA, 21 nt, Human
aaauuauucacauuaaaaaau

SEQ ID NO: 452304 - RNA, 21 nt, Human
aagguuccaugugcugaggca

SEQ ID NO: 452305 - RNA, 19 nt, Human
aguaaauauuuaaaaaugu

SEQ ID NO: 452306 - RNA, 18 nt, Human
aucacuuagaaacuuuau

SEQ ID NO: 452307 - RNA, 23 nt, Human
cagcacaguagacauacaaucaa

SEQ ID NO: 452308 - RNA, 21 nt, Human
gaaagacacuuccaggaagua

SEQ ID NO: 452309 - RNA, 19 nt, Human
uaacuucacauuuuuggua

SEQ ID NO: 452310 - RNA, 18 nt, Human
uagaaacuuuauuuggua

SEQ ID NO: 452311 - RNA, 23 nt, Human
uauaaauuauucacauuaaaaaa

SEQ ID NO: 452312 - RNA, 24 nt, Human
uauguauauguagcuguucguaug

SEQ ID NO: 452313 - RNA, 18 nt, Human
ucauuuuucagguuuaga

SEQ ID NO: 452314 - RNA, 21 nt, Human
uccgaaagacacuuccaggaa

SEQ ID NO: 452315 - RNA, 21 nt, Human
uuuuugguauauagaaauuuu

SEQ ID NO: 452316 - RNA, 26 nt, Human
aaaaacaaaaaucacauagaagagaa

SEQ ID NO: 452317 - RNA, 25 nt, Human
acagcauuaaaguuuccuucucuga

SEQ ID NO: 452318 - RNA, 18 nt, Human
acauagaagagaaucuag

SEQ ID NO: 452319 - RNA, 19 nt, Human
accagcccgcacacacgca

SEQ ID NO: 452320 - RNA, 24 nt, Human
acucuuguacuuuuagaucacaaa

SEQ ID NO: 452321 - RNA, 24 nt, Human
agagaaggacuggagaacuguaaa

SEQ ID NO: 452322 - RNA, 18 nt, Human
agaucacaaauuugccuu

SEQ ID NO: 452323 - RNA, 19 nt, Human
aggaaacaaacacuacuac

SEQ ID NO: 452324 - RNA, 20 nt, Human
caaaacccccaugagaacaa

SEQ ID NO: 452325 - RNA, 23 nt, Human
caaaacccccaugagaacaaugg

SEQ ID NO: 452326 - RNA, 25 nt, Human
caaaacccccaugagaacaaugggc

SEQ ID NO: 452327 - RNA, 26 nt, Human
cacaaaaccagcccgcacacacgcag

SEQ ID NO: 452328 - RNA, 21 nt, Human
caccaacccggcaaaugcucc

SEQ ID NO: 452329 - RNA, 22 nt, Human
caccaacccggcaaaugcucca

SEQ ID NO: 452330 - RNA, 27 nt, Human
cacuacacugcuuuauauaaaaaacaa

SEQ ID NO: 452331 - RNA, 19 nt, Human
caggagccaccaacccggc

SEQ ID NO: 452332 - RNA, 22 nt, Human
cccccaugagaacaaugggcuc

SEQ ID NO: 452333 - RNA, 23 nt, Human
cccgcacacacgcagacguuccg

SEQ ID NO: 452334 - RNA, 18 nt, Human
cggcaaaugcuccagcuc

SEQ ID NO: 452335 - RNA, 18 nt, Human
cuagcucaaaaaucacuc

SEQ ID NO: 452336 - RNA, 22 nt, Human
cucagguggaagacuuugaaga

SEQ ID NO: 452337 - RNA, 22 nt, Human
cuuacagguggccucagcuucu

SEQ ID NO: 452338 - RNA, 26 nt, Human
gagccaccaacccggcaaaugcucca

SEQ ID NO: 452339 - RNA, 20 nt, Human
gccacaaaaccagcccgcac

SEQ ID NO: 452340 - RNA, 22 nt, Human
gccacaaaaccagcccgcacac

SEQ ID NO: 452341 - RNA, 21 nt, Human
gguggaagacuuugaagacua

SEQ ID NO: 452342 - RNA, 21 nt, Human
guagaauuaucacuaguagau

SEQ ID NO: 452343 - RNA, 21 nt, Human
guuaauaucacaaaaccccca

SEQ ID NO: 452344 - RNA, 23 nt, Human
uaaagaacauauaaaauuaagau

SEQ ID NO: 452345 - RNA, 21 nt, Human
uaaagcaagacaaacucuucc

SEQ ID NO: 452346 - RNA, 26 nt, Human
uaacaaauacuauuuaauuaucaaga

SEQ ID NO: 452347 - RNA, 18 nt, Human
uaaguaacacauaauaca

SEQ ID NO: 452348 - RNA, 24 nt, Human
uacaaacugagaauuuugaaacua

SEQ ID NO: 452349 - RNA, 24 nt, Human
uagaaagcaagauucauuaaauca

SEQ ID NO: 452350 - RNA, 20 nt, Human
uagcagcagccgccacaaaa

SEQ ID NO: 452351 - RNA, 24 nt, Human
uauaauccuagcucaaaaaucacu

SEQ ID NO: 452352 - RNA, 19 nt, Human
uaucaagacauaugcaaaa

SEQ ID NO: 452353 - RNA, 21 nt, Human
uaucacaaaacccccaugaga

SEQ ID NO: 452354 - RNA, 20 nt, Human
ucacaaaacccccaugagaa

SEQ ID NO: 452355 - RNA, 18 nt, Human
ucagcuucuaaacaccac

SEQ ID NO: 452356 - RNA, 24 nt, Human
ucauuuuuccccuuucaauggaau

SEQ ID NO: 452357 - RNA, 23 nt, Human
ucuagcagcagccgccacaaaaa

SEQ ID NO: 452358 - RNA, 23 nt, Human
ucuucauuuuuccccuuucaaug

SEQ ID NO: 452359 - RNA, 23 nt, Human
ugaaaauaaacauuucagauaua

SEQ ID NO: 452360 - RNA, 26 nt, Human
uguuucucuucauuuuuccccuuuca

SEQ ID NO: 452361 - RNA, 28 nt, Human
uuaauuaucaagacauaugcaaaaguau

SEQ ID NO: 452362 - RNA, 18 nt, Human
uuuauauucacuccucau

SEQ ID NO: 452363 - RNA, 18 nt, Human
aggcagaaauugguggau

SEQ ID NO: 452364 - RNA, 18 nt, Human
cuaaauuaaguagcugaa

SEQ ID NO: 452365 - RNA, 24 nt, Human
cuuuucuguggccuugcaauaggu

SEQ ID NO: 452366 - RNA, 21 nt, Human
uaacauuuuagguauauaaca

SEQ ID NO: 452367 - RNA, 19 nt, Human
uaucugcucuuuucugugg

SEQ ID NO: 452368 - RNA, 21 nt, Human
uaucugcucuuuucuguggcc

SEQ ID NO: 452369 - RNA, 21 nt, Human
ucugcucuuuucuguggccuu

SEQ ID NO: 452370 - RNA, 19 nt, Human
ugagaaaaaauggagaaca

SEQ ID NO: 452371 - RNA, 21 nt, Human
uuggcacuaucugcucuuuuc

SEQ ID NO: 452372 - RNA, 21 nt, Human
uugguggauaaauuauuuccu

SEQ ID NO: 452373 - RNA, 20 nt, Human
aaaagagaaaucgugcugca

SEQ ID NO: 452374 - RNA, 24 nt, Human
aaacaaaaccaaaacaaaaaucua

SEQ ID NO: 452375 - RNA, 26 nt, Human
aaaccaaaacaaaaaucuauucuucc

SEQ ID NO: 452376 - RNA, 19 nt, Human
aaagacuggugaauaaaca

SEQ ID NO: 452377 - RNA, 21 nt, Human
aaagagaaaucgugcugcaga

SEQ ID NO: 452378 - RNA, 19 nt, Human
aaauacagcacaauuacuu

SEQ ID NO: 452379 - RNA, 22 nt, Human
aaugaaaaaacagaagcagccc

SEQ ID NO: 452380 - RNA, 20 nt, Human
agcacaauuacuucagauca

SEQ ID NO: 452381 - RNA, 18 nt, Human
agcacacacucucuugug

SEQ ID NO: 452382 - RNA, 18 nt, Human
agcagacuucagauucau

SEQ ID NO: 452383 - RNA, 20 nt, Human
agggcauuaucaaaagagaa

SEQ ID NO: 452384 - RNA, 21 nt, Human
augacuaggaaaaaaaaaacc

SEQ ID NO: 452385 - RNA, 22 nt, Human
auugcaauggaaauaaauguuc

SEQ ID NO: 452386 - RNA, 23 nt, Human
caaaaaaaaguuuaaacacacaa

SEQ ID NO: 452387 - RNA, 22 nt, Human
caaaacaaaaccaaaacaaaaa

SEQ ID NO: 452388 - RNA, 28 nt, Human
caaaacaaaaccaaaacaaaaaucuauu

SEQ ID NO: 452389 - RNA, 23 nt, Human
cacugcucuacauucccaaugac

SEQ ID NO: 452390 - RNA, 18 nt, Human
cagaagcagccauaauga

SEQ ID NO: 452391 - RNA, 25 nt, Human
cagccacagaaauugcaauggaaau

SEQ ID NO: 452392 - RNA, 23 nt, Human
cauaagcagcuacuuaaaaguuu

SEQ ID NO: 452393 - RNA, 24 nt, Human
cauucccaaugacuaggaaaaaaa

SEQ ID NO: 452394 - RNA, 18 nt, Human
ccacagaaauugcaaugg

SEQ ID NO: 452395 - RNA, 25 nt, Human
cccuaaagggcauuaucaaaagaga

SEQ ID NO: 452396 - RNA, 18 nt, Human
ccgccggccccuccgucc

SEQ ID NO: 452397 - RNA, 23 nt, Human
ccucaagucaauuuuuaguuugc

SEQ ID NO: 452398 - RNA, 21 nt, Human
cgccgccgccgguagccgccg

SEQ ID NO: 452399 - RNA, 18 nt, Human
cgcugcgcgccgccgccg

SEQ ID NO: 452400 - RNA, 28 nt, Human
cucaucagcacacacucucuugugacaa

SEQ ID NO: 452401 - RNA, 19 nt, Human
cuccgccaccgccggcccc

SEQ ID NO: 452402 - RNA, 21 nt, Human
cugcagcagacuucagauuca

SEQ ID NO: 452403 - RNA, 24 nt, Human
cuucauauuguauacacacaaacc

SEQ ID NO: 452404 - RNA, 21 nt, Human
cuucccucgcucaaaaaaaag

SEQ ID NO: 452405 - RNA, 22 nt, Human
gaaaaaacagaagcagccauaa

SEQ ID NO: 452406 - RNA, 18 nt, Human
gagaaaagcgauauauac

SEQ ID NO: 452407 - RNA, 24 nt, Human
gagucauuuucaaaacaaaaccaa

SEQ ID NO: 452408 - RNA, 20 nt, Human
gcagcagacuucagauucau

SEQ ID NO: 452409 - RNA, 24 nt, Human
uaaaagcccucugcacucaacuaa

SEQ ID NO: 452410 - RNA, 21 nt, Human
uaacuaguugugcccuaaagg

SEQ ID NO: 452411 - RNA, 18 nt, Human
uacauacacaaugagaaa

SEQ ID NO: 452412 - RNA, 23 nt, Human
uauauacauacacaaugagaaaa

SEQ ID NO: 452413 - RNA, 24 nt, Human
ucucauaagcagcuacuuaaaagu

SEQ ID NO: 452414 - RNA, 18 nt, Human
ucucuugugacaaaugau

SEQ ID NO: 452415 - RNA, 23 nt, Human
ugagaaaauaaacugcaagauua

SEQ ID NO: 452416 - RNA, 22 nt, Human
ugcaauggaaauaaauguucag

SEQ ID NO: 452417 - RNA, 21 nt, Human
ugccgccgaaccccugcuugc

SEQ ID NO: 452418 - RNA, 20 nt, Human
uguauacacacaaacccaug

SEQ ID NO: 452419 - RNA, 24 nt, Human
uguauacacacaaacccaugaaca

SEQ ID NO: 452420 - RNA, 20 nt, Human
uuaaacacacaaacuuacaa

SEQ ID NO: 452421 - RNA, 19 nt, Human
uuacugauaacuaguugug

SEQ ID NO: 452422 - RNA, 19 nt, Human
uuagcuuucugccuucccu

SEQ ID NO: 452423 - RNA, 21 nt, Human
uucaaaacaaaaccaaaacaa

SEQ ID NO: 452424 - RNA, 21 nt, Human
uuuaauacuggaaaaaucaca

SEQ ID NO: 452425 - RNA, 22 nt, Human
uuuuuuuuuuuuuuuuucauuu

SEQ ID NO: 452426 - RNA, 24 nt, Human
aaauaugacuacaguaaucauaac

SEQ ID NO: 452427 - RNA, 19 nt, Human
aagcacaauggcgcccgcc

SEQ ID NO: 452428 - RNA, 22 nt, Human
agcacaauggcgcccgccccuc

SEQ ID NO: 452429 - RNA, 23 nt, Human
agcauuuuauuucaaaaguauau

SEQ ID NO: 452430 - RNA, 18 nt, Human
aggcauacauguguaugu

SEQ ID NO: 452431 - RNA, 18 nt, Human
caaaaaaggguugauagg

SEQ ID NO: 452432 - RNA, 20 nt, Human
caaaaugagacugcaacuua

SEQ ID NO: 452433 - RNA, 18 nt, Human
caagaguaaaacacaaac

SEQ ID NO: 452434 - RNA, 20 nt, Human
cacaauggcgcccgccccuc

SEQ ID NO: 452435 - RNA, 22 nt, Human
cacaauggcgcccgccccucuc

SEQ ID NO: 452436 - RNA, 23 nt, Human
cauucccccacaaaaguaauuua

SEQ ID NO: 452437 - RNA, 27 nt, Human
cccgugacugaggaaaugccggggucc

SEQ ID NO: 452438 - RNA, 19 nt, Human
gcgaagcacaauggcgccc

SEQ ID NO: 452439 - RNA, 25 nt, Human
uaaucauaacacaaaaaaggguuga

SEQ ID NO: 452440 - RNA, 20 nt, Human
uacaggcauacauguguaug

SEQ ID NO: 452441 - RNA, 20 nt, Human
uagcaagaguaaaacacaaa

SEQ ID NO: 452442 - RNA, 24 nt, Human
uaggugccauauagcauuuuauuu

SEQ ID NO: 452443 - RNA, 24 nt, Human
uauacaggcauacauguguaugua

SEQ ID NO: 452444 - RNA, 24 nt, Human
uauauacaggcauacauguguaug

SEQ ID NO: 452445 - RNA, 19 nt, Human
uauauauacaggcauacau

SEQ ID NO: 452446 - RNA, 23 nt, Human
uauguauauauucauuuuauaua

SEQ ID NO: 452447 - RNA, 18 nt, Human
uauguuaaaaaguccagc

SEQ ID NO: 452448 - RNA, 22 nt, Human
ucaaaaugagacugcaacuuaa

SEQ ID NO: 452449 - RNA, 18 nt, Human
ugacuacaguaaucauaa

SEQ ID NO: 452450 - RNA, 18 nt, Human
ugucccacuuuucucacu

SEQ ID NO: 452451 - RNA, 27 nt, Human
uguguauguauauauucauuuuauaua

SEQ ID NO: 452452 - RNA, 25 nt, Human
uguuaaaaaguccagcagaauuuua

SEQ ID NO: 452453 - RNA, 21 nt, Human
uuaggugccauauagcauuuu

SEQ ID NO: 452454 - RNA, 21 nt, Human
uuugcuauguuaaaaagucca

SEQ ID NO: 452455 - RNA, 18 nt, Human
aaaucaaucucacaacug

SEQ ID NO: 452456 - RNA, 24 nt, Human
acauuagccagacacaaacagccu

SEQ ID NO: 452457 - RNA, 19 nt, Human
agccagacacaaacagccu

SEQ ID NO: 452458 - RNA, 18 nt, Human
auccaagauauuauuuga

SEQ ID NO: 452459 - RNA, 19 nt, Human
caaccaaacaacucuacuu

SEQ ID NO: 452460 - RNA, 24 nt, Human
cucauaaaucccucuaauuauaaa

SEQ ID NO: 452461 - RNA, 18 nt, Human
gaaaacuucccuucuucc

SEQ ID NO: 452462 - RNA, 23 nt, Human
gcgccagcccuauaucugugcuu

SEQ ID NO: 452463 - RNA, 21 nt, Human
ggaagcaccugcgccagcccu

SEQ ID NO: 452464 - RNA, 24 nt, Human
uaagcuuugggaagcaccugcgcc

SEQ ID NO: 452465 - RNA, 24 nt, Human
uaauagaacaaaucacaugaaagu

SEQ ID NO: 452466 - RNA, 20 nt, Human
uacauuuacuauauaagaau

SEQ ID NO: 452467 - RNA, 20 nt, Human
uagaaaacuucccuucuucc

SEQ ID NO: 452468 - RNA, 23 nt, Human
uagagcaaucacucauaaauccc

SEQ ID NO: 452469 - RNA, 23 nt, Human
ucuaauuauaaauaaaauccaag

SEQ ID NO: 452470 - RNA, 21 nt, Human
ugaaguaaaaagucccaaccc

SEQ ID NO: 452471 - RNA, 21 nt, Human
uggcaaaacaagacaaguuuc

SEQ ID NO: 452472 - RNA, 23 nt, Human
uguuacaaguucuccuagugaag

SEQ ID NO: 452473 - RNA, 22 nt, Human
uuagccagacacaaacagccuu

SEQ ID NO: 452474 - RNA, 19 nt, Human
uucaauuccuuuccuuucc

SEQ ID NO: 452475 - RNA, 21 nt, Human
uucaauuccuuuccuuuccuu

SEQ ID NO: 452476 - RNA, 19 nt, Human
uucauacaauacuagaaaa

SEQ ID NO: 452477 - RNA, 23 nt, Human
uucauacaauacuagaaaacuuc

SEQ ID NO: 452478 - RNA, 19 nt, Human
uucgaacuugaaauuagca

SEQ ID NO: 452479 - RNA, 18 nt, Human
uuugacaaugagaugcuu

SEQ ID NO: 452480 - RNA, 19 nt, Human
aaaaaagaaaagaaacaua

SEQ ID NO: 452481 - RNA, 22 nt, Human
aaagaaaaaaaaagaaaaaaaa

SEQ ID NO: 452482 - RNA, 19 nt, Human
aaagagcaaaacaaaaaag

SEQ ID NO: 452483 - RNA, 19 nt, Human
aaauauugaagaauacgcc

SEQ ID NO: 452484 - RNA, 18 nt, Human
aagaaaaaaaaagaaaaa

SEQ ID NO: 452485 - RNA, 18 nt, Human
aagucacuuuuugagaua

SEQ ID NO: 452486 - RNA, 25 nt, Human
aauugcuuuugaaaaugguuucuau

SEQ ID NO: 452487 - RNA, 19 nt, Human
acacauuccaccugcugac

SEQ ID NO: 452488 - RNA, 19 nt, Human
agaaagaaaaaaaaagaaa

SEQ ID NO: 452489 - RNA, 19 nt, Human
agcaaaacaaaaaagaaag

SEQ ID NO: 452490 - RNA, 22 nt, Human
agcaaaacaaaaaagaaagaaa

SEQ ID NO: 452491 - RNA, 24 nt, Human
agcgugcuguguuuuccuucuucu

SEQ ID NO: 452492 - RNA, 19 nt, Human
caaaacaaaaaagaaagaa

SEQ ID NO: 452493 - RNA, 21 nt, Human
caaggugcccgugccaggagc

SEQ ID NO: 452494 - RNA, 23 nt, Human
caccuggaaaauaccaacaccuu

SEQ ID NO: 452495 - RNA, 19 nt, Human
caccuuaggucccauuucc

SEQ ID NO: 452496 - RNA, 24 nt, Human
cacgucuauuccaaauauugaaga

SEQ ID NO: 452497 - RNA, 21 nt, Human
caguggcugucugucaccucu

SEQ ID NO: 452498 - RNA, 22 nt, Human
caguucauuucccccgacaccu

SEQ ID NO: 452499 - RNA, 24 nt, Human
cauucuacuuucuuccaaaucuga

SEQ ID NO: 452500 - RNA, 24 nt, Human
ccaccugcugaccagauuuaaucc

SEQ ID NO: 452501 - RNA, 21 nt, Human
ccagcgugcuguguuuuccuu

SEQ ID NO: 452502 - RNA, 21 nt, Human
ccgacaccuggaaaauaccaa

SEQ ID NO: 452503 - RNA, 22 nt, Human
ccucaguggcugucugucaccu

SEQ ID NO: 452504 - RNA, 19 nt, Human
cucugggacugagaaugaa

SEQ ID NO: 452505 - RNA, 19 nt, Human
cuuggcacuaguuuguuuu

SEQ ID NO: 452506 - RNA, 21 nt, Human
gaaagagcaaaacaaaaaaga

SEQ ID NO: 452507 - RNA, 20 nt, Human
gagaagcgugagguggagau

SEQ ID NO: 452508 - RNA, 20 nt, Human
gagguggagauuguccaugg

SEQ ID NO: 452509 - RNA, 21 nt, Human
gauauuaauaaucacauccag

SEQ ID NO: 452510 - RNA, 19 nt, Human
gcaaaacaaaaaagaaaga

SEQ ID NO: 452511 - RNA, 24 nt, Human
gcaggaagcaaaaacuuuacaaaa

SEQ ID NO: 452512 - RNA, 21 nt, Human
ggaaaauaccaacaccuuagg

SEQ ID NO: 452513 - RNA, 19 nt, Human
uaaaaaaagaaaagaaaca

SEQ ID NO: 452514 - RNA, 18 nt, Human
uacgccuccuuggcacua

SEQ ID NO: 452515 - RNA, 22 nt, Human
uacugugaguuucaguuuccca

SEQ ID NO: 452516 - RNA, 24 nt, Human
uagcaggaagcaaaaacuuuacaa

SEQ ID NO: 452517 - RNA, 25 nt, Human
uagcaggaagcaaaaacuuuacaaa

SEQ ID NO: 452518 - RNA, 19 nt, Human
ucuuacuacaaguucagga

SEQ ID NO: 452519 - RNA, 19 nt, Human
ucuuuuguuuacuuuguua

SEQ ID NO: 452520 - RNA, 22 nt, Human
ugaaagagcaaaacaaaaaaga

SEQ ID NO: 452521 - RNA, 19 nt, Human
ugacucauaaaucuuccuc

SEQ ID NO: 452522 - RNA, 18 nt, Human
ugagaacacgucuauucc

SEQ ID NO: 452523 - RNA, 25 nt, Human
uggaaaauaccaacaccuuaggucc

SEQ ID NO: 452524 - RNA, 27 nt, Human
uguacacauuacaugggaauauaugua

SEQ ID NO: 452525 - RNA, 23 nt, Human
ugucuggaaggaagcaggugaga

SEQ ID NO: 452526 - RNA, 21 nt, Human
ugugaggaggagauucaaggu

SEQ ID NO: 452527 - RNA, 22 nt, Human
uuauacacauuccaccugcuga

SEQ ID NO: 452528 - RNA, 18 nt, Human
uuggcaaaguuuccuugg

SEQ ID NO: 452529 - RNA, 20 nt, Human
uuuacaaaaccccuucacca

SEQ ID NO: 452530 - RNA, 18 nt, Human
uuugauagagaagcguga

SEQ ID NO: 452531 - RNA, 18 nt, Human
aaagaaagacaagucagg

SEQ ID NO: 452532 - RNA, 27 nt, Human
aagcaaacacugaguuacauuuaccac

SEQ ID NO: 452533 - RNA, 18 nt, Human
aaggcgccgccgggugaa

SEQ ID NO: 452534 - RNA, 22 nt, Human
accgagacgugcgcacugccaa

SEQ ID NO: 452535 - RNA, 20 nt, Human
accgggacgcagcgaccaca

SEQ ID NO: 452536 - RNA, 19 nt, Human
agaggaagaggaaagaaag

SEQ ID NO: 452537 - RNA, 21 nt, Human
agucucuucagaaagaaacaa

SEQ ID NO: 452538 - RNA, 18 nt, Human
auaaagcagcaccggccc

SEQ ID NO: 452539 - RNA, 18 nt, Human
auaaagcagcaccggccc

SEQ ID NO: 452540 - RNA, 19 nt, Human
aucauguaaaaaaaccgag

SEQ ID NO: 452541 - RNA, 21 nt, Human
aucugagacgcagacgugaga

SEQ ID NO: 452542 - RNA, 24 nt, Human
cagaccgggacgcagcgaccacaa

SEQ ID NO: 452543 - RNA, 21 nt, Human
cagcgugcggccgggcccggc

SEQ ID NO: 452544 - RNA, 19 nt, Human
cauggcucucacccaggga

SEQ ID NO: 452545 - RNA, 25 nt, Human
cauggcucucacccagggacagguu

SEQ ID NO: 452546 - RNA, 26 nt, Human
ccaaaaucccaugaaagccggguguc

SEQ ID NO: 452547 - RNA, 22 nt, Human
ccaaacgcagaccgggacgcag

SEQ ID NO: 452548 - RNA, 19 nt, Human
ccuugaaaggaaagucucu

SEQ ID NO: 452549 - RNA, 19 nt, Human
cgagacgugcgcacugcca

SEQ ID NO: 452550 - RNA, 21 nt, Human
cgccgccgggugaagcaggug

SEQ ID NO: 452551 - RNA, 21 nt, Human
cgcggacccaugggaagccuu

SEQ ID NO: 452552 - RNA, 21 nt, Human
cgcugagguccaggaacgggc

SEQ ID NO: 452553 - RNA, 24 nt, Human
cggcucaggcucgcugagguccag

SEQ ID NO: 452554 - RNA, 21 nt, Human
cggucggggacagcacggggg

SEQ ID NO: 452555 - RNA, 21 nt, Human
gagcccagccccgugagccgg

SEQ ID NO: 452556 - RNA, 22 nt, Human
gcagaccgggacgcagcgacca

SEQ ID NO: 452557 - RNA, 19 nt, Human
gcguggcugcgggacgggg

SEQ ID NO: 452558 - RNA, 19 nt, Human
ggacacggcgcgcugcccc

SEQ ID NO: 452559 - RNA, 22 nt, Human
gggcaccuccaccuggacacgg

SEQ ID NO: 452560 - RNA, 18 nt, Human
gggcagcagcgggguuga

SEQ ID NO: 452561 - RNA, 23 nt, Human
gggcagcagcgggguugacggua

SEQ ID NO: 452562 - RNA, 24 nt, Human
gggccuggugccggcugguccugu

SEQ ID NO: 452563 - RNA, 23 nt, Human
gugaagcaggugucccggagggc

SEQ ID NO: 452564 - RNA, 23 nt, Human
gugcggccgggcccggcucaggc

SEQ ID NO: 452565 - RNA, 19 nt, Human
uaaaaaaaccgagacgugc

SEQ ID NO: 452566 - RNA, 25 nt, Human
uaaaaaaaccgagacgugcgcacug

SEQ ID NO: 452567 - RNA, 19 nt, Human
uaagucgcaagcaaacacu

SEQ ID NO: 452568 - RNA, 22 nt, Human
uacacucaucgacacaaacuua

SEQ ID NO: 452569 - RNA, 19 nt, Human
uaccacgaagucacuggac

SEQ ID NO: 452570 - RNA, 23 nt, Human
uaccacgaagucacuggacagag

SEQ ID NO: 452571 - RNA, 22 nt, Human
uccaggaacgggcaccuccacc

SEQ ID NO: 452572 - RNA, 21 nt, Human
uccuuaaaucauguaaaaaaa

SEQ ID NO: 452573 - RNA, 20 nt, Human
ucggauuccuggaaccuggg

SEQ ID NO: 452574 - RNA, 19 nt, Human
ugacauucagggauguggc

SEQ ID NO: 452575 - RNA, 22 nt, Human
ugagacgcagacgugagaaacg

SEQ ID NO: 452576 - RNA, 18 nt, Human
ugccccggcaacccccag

SEQ ID NO: 452577 - RNA, 19 nt, Human
uggacagagaccaaaaucc

SEQ ID NO: 452578 - RNA, 18 nt, Human
uuaaacacgggcagcagc

SEQ ID NO: 452579 - RNA, 19 nt, Human
uuaaggcggaaguugggga

SEQ ID NO: 452580 - RNA, 19 nt, Human
uucucauuaaacgaggggc

SEQ ID NO: 452581 - RNA, 23 nt, Human
aagcagcaggaccaugcccuggg

SEQ ID NO: 452582 - RNA, 21 nt, Human
aagggggucagcaugcucagg

SEQ ID NO: 452583 - RNA, 23 nt, Human
acccuagacagggccaaccugac

SEQ ID NO: 452584 - RNA, 21 nt, Human
agccccccagugcaugcccag

SEQ ID NO: 452585 - RNA, 18 nt, Human
agggccaaccugacucaa

SEQ ID NO: 452586 - RNA, 22 nt, Human
aggggccacuucuggcuccaag

SEQ ID NO: 452587 - RNA, 22 nt, Human
agugcaugcccagccccaauaa

SEQ ID NO: 452588 - RNA, 25 nt, Human
caacacaagggcugcuuguccccag

SEQ ID NO: 452589 - RNA, 24 nt, Human
cacuucuggcuccaagggucagga

SEQ ID NO: 452590 - RNA, 24 nt, Human
cagcccagcuccuccagcccccca

SEQ ID NO: 452591 - RNA, 20 nt, Human
cagccccccagugcaugccc

SEQ ID NO: 452592 - RNA, 23 nt, Human
cagcugcccucccuccugggucc

SEQ ID NO: 452593 - RNA, 23 nt, Human
caggccuggggcccagucccaca

SEQ ID NO: 452594 - RNA, 24 nt, Human
caucuguccuucuguuccacccua

SEQ ID NO: 452595 - RNA, 22 nt, Human
ccccccagugcaugcccagccc

SEQ ID NO: 452596 - RNA, 24 nt, Human
ccccccagugcaugcccagccccc

SEQ ID NO: 452597 - RNA, 24 nt, Human
cccuagacagggccaaccugacuc

SEQ ID NO: 452598 - RNA, 18 nt, Human
cccucccuccugggucca

SEQ ID NO: 452599 - RNA, 21 nt, Human
ccgcgccgccgcccgcgcccg

SEQ ID NO: 452600 - RNA, 25 nt, Human
ccuucuguuccacccuagacagggc

SEQ ID NO: 452601 - RNA, 22 nt, Human
cuccuggguccaucuguccuuc

SEQ ID NO: 452602 - RNA, 24 nt, Human
cuggcuccaagggucaggacuugg

SEQ ID NO: 452603 - RNA, 20 nt, Human
cugggccuggaggggcagag

SEQ ID NO: 452604 - RNA, 18 nt, Human
gaagggggucagcaugcu

SEQ ID NO: 452605 - RNA, 24 nt, Human
gaggggcagaggggccacuucugg

SEQ ID NO: 452606 - RNA, 19 nt, Human
gccugaaaagaggugguag

SEQ ID NO: 452607 - RNA, 25 nt, Human
ggaggggcagaggggccacuucugg

SEQ ID NO: 452608 - RNA, 18 nt, Human
gggcagaggggccacuuc

SEQ ID NO: 452609 - RNA, 22 nt, Human
gggccuggaggggcagaggggc

SEQ ID NO: 452610 - RNA, 19 nt, Human
gugaagcagcaggaccaug

SEQ ID NO: 452611 - RNA, 19 nt, Human
ucuggagguaggaaggggg

SEQ ID NO: 452612 - RNA, 19 nt, Human
ucuuuauucuggagguagg

SEQ ID NO: 452613 - RNA, 21 nt, Human
ugcaugcccagccccaauaag

SEQ ID NO: 452614 - RNA, 18 nt, Human
ugcccagccccaauaagu

SEQ ID NO: 452615 - RNA, 19 nt, Human
ugcccucccuccugggucc

SEQ ID NO: 452616 - RNA, 24 nt, Human
ugcccugggccuggaggggcagag

SEQ ID NO: 452617 - RNA, 20 nt, Human
ugggaaggguccagcccagc

SEQ ID NO: 452618 - RNA, 19 nt, Human
ugggcagugccacacggca

SEQ ID NO: 452619 - RNA, 19 nt, Human
ugggcagugccacacggcc

SEQ ID NO: 452620 - RNA, 19 nt, Human
ugguaguugggguggggcc

SEQ ID NO: 452621 - RNA, 19 nt, Human
ugugggcagugccacacgg

SEQ ID NO: 452622 - RNA, 24 nt, Human
ugugggcagugccacacggcaggc

SEQ ID NO: 452623 - RNA, 20 nt, Human
uuuuuuuuuuuuuuuccagg

SEQ ID NO: 452624 - RNA, 22 nt, Human
aaacacaggcacuucuacauag

SEQ ID NO: 452625 - RNA, 26 nt, Human
aaacucuaguaguucauacccccaaa

SEQ ID NO: 452626 - RNA, 26 nt, Human
aaacucuaguaguucauacccccaaa

SEQ ID NO: 452627 - RNA, 21 nt, Human
aaauacuaaaauuacacuaug

SEQ ID NO: 452628 - RNA, 18 nt, Human
aaauauuucaagaaagua

SEQ ID NO: 452629 - RNA, 24 nt, Human
aaaucacuuaaaauggccaaauuc

SEQ ID NO: 452630 - RNA, 20 nt, Human
aacaaaaucacuuaaaaugg

SEQ ID NO: 452631 - RNA, 23 nt, Human
aacaaagucuuuguagccaauag

SEQ ID NO: 452632 - RNA, 20 nt, Human
aacacaggcacuucuacaua

SEQ ID NO: 452633 - RNA, 23 nt, Human
acaacaugggaacuauucaaaau

SEQ ID NO: 452634 - RNA, 18 nt, Human
acaagaaaaauuaaaccc

SEQ ID NO: 452635 - RNA, 18 nt, Human
acaagaaaaauuaaaccc

SEQ ID NO: 452636 - RNA, 20 nt, Human
acaauaaauaaaaccacagg

SEQ ID NO: 452637 - RNA, 19 nt, Human
acagaaauuacucuaaugu

SEQ ID NO: 452638 - RNA, 24 nt, Human
acauaauuccauuucacgaaaacc

SEQ ID NO: 452639 - RNA, 22 nt, Human
accaaucauccugccauaucau

SEQ ID NO: 452640 - RNA, 21 nt, Human
agaaaaauuaaacccucuuuc

SEQ ID NO: 452641 - RNA, 21 nt, Human
agaaaaauuaaacccucuuuc

SEQ ID NO: 452642 - RNA, 19 nt, Human
agaaacaggauuucagaua

SEQ ID NO: 452643 - RNA, 18 nt, Human
auaacaucacaacaagau

SEQ ID NO: 452644 - RNA, 18 nt, Human
auaacaucacaacaagau

SEQ ID NO: 452645 - RNA, 19 nt, Human
auacuguugggguggcagg

SEQ ID NO: 452646 - RNA, 19 nt, Human
auacuguugggguggcagg

SEQ ID NO: 452647 - RNA, 19 nt, Human
auagaagagggcaaacaaa

SEQ ID NO: 452648 - RNA, 24 nt, Human
auaucuuguccgggagcagcucca

SEQ ID NO: 452649 - RNA, 24 nt, Human
auaucuuguccgggagcagcucca

SEQ ID NO: 452650 - RNA, 23 nt, Human
aucacuuaaaauggccaaauucc

SEQ ID NO: 452651 - RNA, 21 nt, Human
augauaccaccaggaaaccaa

SEQ ID NO: 452652 - RNA, 21 nt, Human
augauaccaccaggaaaccaa

SEQ ID NO: 452653 - RNA, 21 nt, Human
auucaaaauacaccuuucuau

SEQ ID NO: 452654 - RNA, 21 nt, Human
caaaaauaucucaagaaagua

SEQ ID NO: 452655 - RNA, 26 nt, Human
caaaauacaccuuucuaugcaaaauu

SEQ ID NO: 452656 - RNA, 26 nt, Human
caaaaucacuuaaaauggccaaauuc

SEQ ID NO: 452657 - RNA, 22 nt, Human
caaauacuaaaauuacacuaug

SEQ ID NO: 452658 - RNA, 23 nt, Human
caacaugggaacuauucaaaaua

SEQ ID NO: 452659 - RNA, 26 nt, Human
caacugacaacugaaauuucaguuuu

SEQ ID NO: 452660 - RNA, 26 nt, Human
caacugacaacugaaauuucaguuuu

SEQ ID NO: 452661 - RNA, 26 nt, Human
caauaaauaaaaccacaggcacuucu

SEQ ID NO: 452662 - RNA, 20 nt, Human
cagcccggcgaccgccgcag

SEQ ID NO: 452663 - RNA, 20 nt, Human
cagcccggcgaccgccgcag

SEQ ID NO: 452664 - RNA, 27 nt, Human
cauaacaucacaacaagauaaauuaga

SEQ ID NO: 452665 - RNA, 27 nt, Human
cauaacaucacaacaagauaaauuaga

SEQ ID NO: 452666 - RNA, 21 nt, Human
ccaaaucccauaaaaauaaac

SEQ ID NO: 452667 - RNA, 21 nt, Human
ccaaaucccauaaaaauaaac

SEQ ID NO: 452668 - RNA, 20 nt, Human
ccaaauuccagaaacaggau

SEQ ID NO: 452669 - RNA, 18 nt, Human
ccacgucccggcgcuccg

SEQ ID NO: 452670 - RNA, 23 nt, Human
ccccaguaucccaucugauaaga

SEQ ID NO: 452671 - RNA, 23 nt, Human
ccccaguaucccaucugauaaga

SEQ ID NO: 452672 - RNA, 20 nt, Human
ccgcagcucacgcuccaugc

SEQ ID NO: 452673 - RNA, 20 nt, Human
ccgcagcucacgcuccaugc

SEQ ID NO: 452674 - RNA, 24 nt, Human
ccggcggugucggcggcagggacu

SEQ ID NO: 452675 - RNA, 24 nt, Human
ccggcggugucggcggcagggacu

SEQ ID NO: 452676 - RNA, 19 nt, Human
ccuccgcgcggcucagccc

SEQ ID NO: 452677 - RNA, 20 nt, Human
cgcggccacauccacguccc

SEQ ID NO: 452678 - RNA, 20 nt, Human
cgcggccacauccacguccc

SEQ ID NO: 452679 - RNA, 23 nt, Human
cggcccggcggugucggcggcag

SEQ ID NO: 452680 - RNA, 23 nt, Human
cggcccggcggugucggcggcag

SEQ ID NO: 452681 - RNA, 24 nt, Human
cugccauaucauccauaaaaaaaa

SEQ ID NO: 452682 - RNA, 19 nt, Human
cuuguugccgcugcugccg

SEQ ID NO: 452683 - RNA, 19 nt, Human
gaacaauaaauaaaaacac

SEQ ID NO: 452684 - RNA, 21 nt, Human
gcaaaagucuguaacuucaac

SEQ ID NO: 452685 - RNA, 20 nt, Human
gcggcaauucaaucuucagu

SEQ ID NO: 452686 - RNA, 23 nt, Human
gggcaaacaaaaucacuuaaaau

SEQ ID NO: 452687 - RNA, 23 nt, Human
gggcggcccggcggugucggcgg

SEQ ID NO: 452688 - RNA, 23 nt, Human
gggcggcccggcggugucggcgg

SEQ ID NO: 452689 - RNA, 24 nt, Human
guccauauugaaaauucacuaaca

SEQ ID NO: 452690 - RNA, 24 nt, Human
guccauauugaaaauucacuaaca

SEQ ID NO: 452691 - RNA, 18 nt, Human
uaaaaacacaggcacuuc

SEQ ID NO: 452692 - RNA, 19 nt, Human
uaaaaauacaguggcuuua

SEQ ID NO: 452693 - RNA, 19 nt, Human
uaaauaaaaacacaggcac

SEQ ID NO: 452694 - RNA, 21 nt, Human
uaaauaaaaccacaggcacuu

SEQ ID NO: 452695 - RNA, 31 nt, Human
uaaauaaaaccacaggcacuucuacauagaa

SEQ ID NO: 452696 - RNA, 22 nt, Human
uaaauaccugaauuacaaauaa

SEQ ID NO: 452697 - RNA, 26 nt, Human
uaccaccaggaaaccaaauacaagaa

SEQ ID NO: 452698 - RNA, 26 nt, Human
uaccaccaggaaaccaaauacaagaa

SEQ ID NO: 452699 - RNA, 22 nt, Human
uaccugaauuacaaauaaauca

SEQ ID NO: 452700 - RNA, 21 nt, Human
uagaagagggcaaacaaaauc

SEQ ID NO: 452701 - RNA, 22 nt, Human
uagaagagggcaaacaaaauca

SEQ ID NO: 452702 - RNA, 21 nt, Human
uauagaagagggcaaacaaaa

SEQ ID NO: 452703 - RNA, 22 nt, Human
uauucaaaauacaccuuucuau

SEQ ID NO: 452704 - RNA, 19 nt, Human
uauuuaagaaaauguuuug

SEQ ID NO: 452705 - RNA, 19 nt, Human
uauuuaagaaaauguuuug

SEQ ID NO: 452706 - RNA, 23 nt, Human
ucaaaauacaccuuucuaugcaa

SEQ ID NO: 452707 - RNA, 21 nt, Human
ucagaaccaaucauccugcca

SEQ ID NO: 452708 - RNA, 22 nt, Human
ucagaaccaaucauccugccau

SEQ ID NO: 452709 - RNA, 18 nt, Human
uccagcucggcggggcgg

SEQ ID NO: 452710 - RNA, 18 nt, Human
uccagcucggcggggcgg

SEQ ID NO: 452711 - RNA, 18 nt, Human
uccaugcgcggcgccccg

SEQ ID NO: 452712 - RNA, 18 nt, Human
uccaugcgcggcgccccg

SEQ ID NO: 452713 - RNA, 19 nt, Human
uccaugcgcggcgccccgg

SEQ ID NO: 452714 - RNA, 19 nt, Human
uccaugcgcggcgccccgg

SEQ ID NO: 452715 - RNA, 22 nt, Human
uccaugcgcggcgccccggacg

SEQ ID NO: 452716 - RNA, 22 nt, Human
uccaugcgcggcgccccggacg

SEQ ID NO: 452717 - RNA, 19 nt, Human
ucccggcgcuccgcgcggc

SEQ ID NO: 452718 - RNA, 22 nt, Human
ucccgggcccuccgcgcggcuc

SEQ ID NO: 452719 - RNA, 21 nt, Human
uccguaaaaaaaaauuaccau

SEQ ID NO: 452720 - RNA, 23 nt, Human
uccugccauaucauccauaaaaa

SEQ ID NO: 452721 - RNA, 20 nt, Human
ucggcggcagggacugcucc

SEQ ID NO: 452722 - RNA, 20 nt, Human
ucggcggcagggacugcucc

SEQ ID NO: 452723 - RNA, 21 nt, Human
ucuaugcaaaagucuguaacu

SEQ ID NO: 452724 - RNA, 21 nt, Human
ucuaugcaaaagucuguaacu

SEQ ID NO: 452725 - RNA, 25 nt, Human
ucucaagaaaguauguuacacaaua

SEQ ID NO: 452726 - RNA, 18 nt, Human
ugaaaaacugaauuccac

SEQ ID NO: 452727 - RNA, 19 nt, Human
ugaaaaacugaauuccaca

SEQ ID NO: 452728 - RNA, 19 nt, Human
ugaaaaacugaauuccaca

SEQ ID NO: 452729 - RNA, 20 nt, Human
ugaaaaacugaauuccacaa

SEQ ID NO: 452730 - RNA, 24 nt, Human
ugaaaaacugaauuccacaacuga

SEQ ID NO: 452731 - RNA, 24 nt, Human
ugaaaaacugaauuccacaacuga

SEQ ID NO: 452732 - RNA, 25 nt, Human
ugaacaauaaauaaaaacacaggca

SEQ ID NO: 452733 - RNA, 21 nt, Human
ugaguaccaaauugaaggguu

SEQ ID NO: 452734 - RNA, 22 nt, Human
ugcaaaagucuguaacuucaac

SEQ ID NO: 452735 - RNA, 26 nt, Human
ugccauaucauccauaaaaaaaaauu

SEQ ID NO: 452736 - RNA, 22 nt, Human
uggcagaauuuuaaacucuagu

SEQ ID NO: 452737 - RNA, 22 nt, Human
uggcagaauuuuaaacucuagu

SEQ ID NO: 452738 - RNA, 26 nt, Human
uggguaucacucauaaaggcaauuuu

SEQ ID NO: 452739 - RNA, 21 nt, Human
uguuuuggucuuugaucugaa

SEQ ID NO: 452740 - RNA, 21 nt, Human
uguuuuggucuuugaucugaa

SEQ ID NO: 452741 - RNA, 22 nt, Human
uuaacaaagucuuuguagccaa

SEQ ID NO: 452742 - RNA, 23 nt, Human
uuacacuaugauaccaccaggaa

SEQ ID NO: 452743 - RNA, 23 nt, Human
uuacacuaugauaccaccaggaa

SEQ ID NO: 452744 - RNA, 23 nt, Human
uuagcggcaauucaaucuucagu

SEQ ID NO: 452745 - RNA, 23 nt, Human
uucaaaauacaccuuucuaugca

SEQ ID NO: 452746 - RNA, 19 nt, Human
uucauacccccaaaaaaca

SEQ ID NO: 452747 - RNA, 19 nt, Human
uucauacccccaaaaaaca

SEQ ID NO: 452748 - RNA, 23 nt, Human
uucaucaacaacacuguauacaa

SEQ ID NO: 452749 - RNA, 23 nt, Human
uucaucaacaacacuguauacaa

SEQ ID NO: 452750 - RNA, 25 nt, Human
uucaucaacaacacuguauacaaau

SEQ ID NO: 452751 - RNA, 25 nt, Human
uucaucaacaacacuguauacaaau

SEQ ID NO: 452752 - RNA, 26 nt, Human
uucaucaacaacacuguauacaaaua

SEQ ID NO: 452753 - RNA, 26 nt, Human
uucaucaacaacacuguauacaaaua

SEQ ID NO: 452754 - RNA, 22 nt, Human
uucuagacaauuuaaaauuuac

SEQ ID NO: 452755 - RNA, 22 nt, Human
uucuagacaauuuaaaauuuac

SEQ ID NO: 452756 - RNA, 27 nt, Human
uucuccuuauuaugaccauaacaucac

SEQ ID NO: 452757 - RNA, 27 nt, Human
uucuccuuauuaugaccauaacaucac

SEQ ID NO: 452758 - RNA, 22 nt, Human
uugaaaaacugaauuccacaac

SEQ ID NO: 452759 - RNA, 22 nt, Human
uugaaaaacugaauuccacaac

SEQ ID NO: 452760 - RNA, 24 nt, Human
uuguugccgcugcugacgcugccg

SEQ ID NO: 452761 - RNA, 20 nt, Human
uuuaaaauuuacccaaaucc

SEQ ID NO: 452762 - RNA, 20 nt, Human
uuuaaaauuuacccaaaucc

SEQ ID NO: 452763 - RNA, 25 nt, Human
uuucaagaaaguauguuacacaaua

SEQ ID NO: 452764 - RNA, 24 nt, Human
uuucaucaacaacacuguauacaa

SEQ ID NO: 452765 - RNA, 21 nt, Human
uuuuuaaaaauacaguggcuu

SEQ ID NO: 452766 - RNA, 24 nt, Human
aaaaaaauuuuaacaauaacacug

SEQ ID NO: 452767 - RNA, 24 nt, Human
aaaaaagaugcaaaccaaccaaaa

SEQ ID NO: 452768 - RNA, 22 nt, Human
aaaaugcuuuaaccccaaacug

SEQ ID NO: 452769 - RNA, 26 nt, Human
aaaauucuuccacacgggcauccuuu

SEQ ID NO: 452770 - RNA, 22 nt, Human
aaacauuaaaaagcuaccugcu

SEQ ID NO: 452771 - RNA, 21 nt, Human
aaacuuaaacacagaccaaua

SEQ ID NO: 452772 - RNA, 23 nt, Human
aaagaacauauuccuaauuccuu

SEQ ID NO: 452773 - RNA, 23 nt, Human
aaccaaaagguaaaaaaagggac

SEQ ID NO: 452774 - RNA, 21 nt, Human
aaccugccugucugcacaaaa

SEQ ID NO: 452775 - RNA, 22 nt, Human
aaccugccugucugcacaaaag

SEQ ID NO: 452776 - RNA, 21 nt, Human
aacuuguuccauucuauucua

SEQ ID NO: 452777 - RNA, 24 nt, Human
aagguuuuuuucauccagguuuga

SEQ ID NO: 452778 - RNA, 24 nt, Human
acacuuccaaguauagauacacag

SEQ ID NO: 452779 - RNA, 21 nt, Human
acauguuggucauuaaaaaug

SEQ ID NO: 452780 - RNA, 23 nt, Human
acauuguacacauuuuucuacau

SEQ ID NO: 452781 - RNA, 21 nt, Human
accaucuucuauucaagugac

SEQ ID NO: 452782 - RNA, 21 nt, Human
accuaguucuuucuguaguga

SEQ ID NO: 452783 - RNA, 22 nt, Human
acuuugaaaaaagaugcaaaaa

SEQ ID NO: 452784 - RNA, 22 nt, Human
agaaggacccuaugagcaacca

SEQ ID NO: 452785 - RNA, 18 nt, Human
agacaccaccuaguucuu

SEQ ID NO: 452786 - RNA, 19 nt, Human
agcuacauggaugugguaa

SEQ ID NO: 452787 - RNA, 28 nt, Human
auagaaaaaaauuaaaauuucuguaaac

SEQ ID NO: 452788 - RNA, 25 nt, Human
auagcccuacacuggagcaccaaaa

SEQ ID NO: 452789 - RNA, 23 nt, Human
caaggaacaugcagcuuuaaaaa

SEQ ID NO: 452790 - RNA, 21 nt, Human
cacucaagucuguuuuuaguu

SEQ ID NO: 452791 - RNA, 18 nt, Human
cacugcuguaaacaagau

SEQ ID NO: 452792 - RNA, 24 nt, Human
ccaguugaaaacgucauuaaaauc

SEQ ID NO: 452793 - RNA, 22 nt, Human
ccuaugagcaaccagcugcccu

SEQ ID NO: 452794 - RNA, 26 nt, Human
ccuugaaauguuguacuguacguuca

SEQ ID NO: 452795 - RNA, 23 nt, Human
cgaggacacuggcacgucaaaau

SEQ ID NO: 452796 - RNA, 19 nt, Human
cugaaaguaacuacaaccu

SEQ ID NO: 452797 - RNA, 24 nt, Human
gaaaacgucauuaaaaucagcuua

SEQ ID NO: 452798 - RNA, 25 nt, Human
gaaagaacauauuccuaauuccuua

SEQ ID NO: 452799 - RNA, 19 nt, Human
gaacuugaacuucccuuua

SEQ ID NO: 452800 - RNA, 21 nt, Human
gaagucauuauuuuggccuuc

SEQ ID NO: 452801 - RNA, 21 nt, Human
gaagugccuucauauuuccuu

SEQ ID NO: 452802 - RNA, 20 nt, Human
gacaccaccuaguucuuucu

SEQ ID NO: 452803 - RNA, 23 nt, Human
gacaucaccuuauuauaugagaa

SEQ ID NO: 452804 - RNA, 21 nt, Human
gagugaguucagucacucuug

SEQ ID NO: 452805 - RNA, 21 nt, Human
gauguuuaaugcucucaauuu

SEQ ID NO: 452806 - RNA, 21 nt, Human
gcaccaaaaaguuuuuuccuu

SEQ ID NO: 452807 - RNA, 23 nt, Human
ggaacacccuguagaacgaggac

SEQ ID NO: 452808 - RNA, 22 nt, Human
gguuuuuuucauccagguuuga

SEQ ID NO: 452809 - RNA, 21 nt, Human
guaauguucugucuuuccauu

SEQ ID NO: 452810 - RNA, 20 nt, Human
guaucuacucugaaaguaac

SEQ ID NO: 452811 - RNA, 24 nt, Human
guuuauuggaaacuauagauuuuu

SEQ ID NO: 452812 - RNA, 22 nt, Human
uaaaaagauagcccuacacugg

SEQ ID NO: 452813 - RNA, 28 nt, Human
uaaaaagauagcccuacacuguaaugac

SEQ ID NO: 452814 - RNA, 22 nt, Human
uaaaccaaauguaaccugccug

SEQ ID NO: 452815 - RNA, 23 nt, Human
uaacaaaaauaaacuugcuuacc

SEQ ID NO: 452816 - RNA, 19 nt, Human
uaacaccaguagcuacaug

SEQ ID NO: 452817 - RNA, 21 nt, Human
uaacacuguguauaaccaucu

SEQ ID NO: 452818 - RNA, 22 nt, Human
uaagaacaagagacuguuuuac

SEQ ID NO: 452819 - RNA, 21 nt, Human
uaauuauuuugccauacaaga

SEQ ID NO: 452820 - RNA, 22 nt, Human
uacaugagaacuugaacuuccc

SEQ ID NO: 452821 - RNA, 24 nt, Human
uagcccuacacuggagcaccaaaa

SEQ ID NO: 452822 - RNA, 21 nt, Human
uaguacuuagcagaggcauac

SEQ ID NO: 452823 - RNA, 21 nt, Human
uagugaagggagguagugugu

SEQ ID NO: 452824 - RNA, 20 nt, Human
uaucacagucaagaagagaa

SEQ ID NO: 452825 - RNA, 21 nt, Human
uauuccaugccaccuaucaca

SEQ ID NO: 452826 - RNA, 24 nt, Human
ucaaccaauggcaaccuuaaacac

SEQ ID NO: 452827 - RNA, 22 nt, Human
ucaagaagagaaaagaaucaca

SEQ ID NO: 452828 - RNA, 23 nt, Human
ucagugacagugaaaacauacaa

SEQ ID NO: 452829 - RNA, 22 nt, Human
uccagguuugacucagugacag

SEQ ID NO: 452830 - RNA, 19 nt, Human
ucccuaacaggugccucug

SEQ ID NO: 452831 - RNA, 20 nt, Human
uccuaauuccuuaaaccaaa

SEQ ID NO: 452832 - RNA, 18 nt, Human
uccuucuuuuuuaaaagg

SEQ ID NO: 452833 - RNA, 18 nt, Human
ucgcguggguuacuaagg

SEQ ID NO: 452834 - RNA, 23 nt, Human
ucuaagcaauguaaacaagccuc

SEQ ID NO: 452835 - RNA, 24 nt, Human
ucucccuagcaguagacaccaccu

SEQ ID NO: 452836 - RNA, 22 nt, Human
ucuguaaacauuaaaaagcuac

SEQ ID NO: 452837 - RNA, 22 nt, Human
ucuguaaacauuaaaaagcuac

SEQ ID NO: 452838 - RNA, 21 nt, Human
ucuguagugaagggagguagu

SEQ ID NO: 452839 - RNA, 20 nt, Human
ugaaaaaagaugcaaaaaaa

SEQ ID NO: 452840 - RNA, 23 nt, Human
ugaagucauuauuuuggccuuca

SEQ ID NO: 452841 - RNA, 25 nt, Human
ugcggaagaauggaacacccuguag

SEQ ID NO: 452842 - RNA, 24 nt, Human
uggcaacuuuucuaucacuuuuuu

SEQ ID NO: 452843 - RNA, 19 nt, Human
uggccagagacacuuaugu

SEQ ID NO: 452844 - RNA, 22 nt, Human
uguagaacgaggacacuggcac

SEQ ID NO: 452845 - RNA, 27 nt, Human
uuaaaaauucuaaauuaucuaagcaau

SEQ ID NO: 452846 - RNA, 19 nt, Human
uuaaaccaaauguaaccug

SEQ ID NO: 452847 - RNA, 22 nt, Human
uuaaucacuuuucuaaaaguuc

SEQ ID NO: 452848 - RNA, 20 nt, Human
uuagggcaacauuaaucacu

SEQ ID NO: 452849 - RNA, 18 nt, Human
uuaugugucauuuucuaa

SEQ ID NO: 452850 - RNA, 18 nt, Human
uucaaaauagaaaaaaau

SEQ ID NO: 452851 - RNA, 23 nt, Human
uugaacuucccuuuaguuuuguu

SEQ ID NO: 452852 - RNA, 25 nt, Human
uugaacuucccuuuaguuuuguuuu

SEQ ID NO: 452853 - RNA, 21 nt, Human
uugaauuaacaaugguuucuc

SEQ ID NO: 452854 - RNA, 20 nt, Human
uugacauuuuuuaaaaagau

SEQ ID NO: 452855 - RNA, 18 nt, Human
uuguacacauuuuucuac

SEQ ID NO: 452856 - RNA, 25 nt, Human
uuguacacauuuuucuacaucuccu

SEQ ID NO: 452857 - RNA, 24 nt, Human
uuuaaguaagugugaugaaggaau

SEQ ID NO: 452858 - RNA, 23 nt, Human
uuuagucccauuuuucugagauu

SEQ ID NO: 452859 - RNA, 22 nt, Human
uuucugagauugcggaagaaug

SEQ ID NO: 452860 - RNA, 20 nt, Human
uuucuguagugaagggaggu

SEQ ID NO: 452861 - RNA, 24 nt, Human
uuugucuuucguccucauuuuacu

SEQ ID NO: 452862 - RNA, 24 nt, Human
uuuucccuuuguugacauuuuuua

SEQ ID NO: 452863 - RNA, 19 nt, Human
aaccugcagacccuucccu

SEQ ID NO: 452864 - RNA, 24 nt, Human
aaguauucagacuucuuagcucca

SEQ ID NO: 452865 - RNA, 19 nt, Human
aaucgaucccagcacccca

SEQ ID NO: 452866 - RNA, 25 nt, Human
accugcagacccuucccuccuccag

SEQ ID NO: 452867 - RNA, 21 nt, Human
acgaagcuuacagaauguuuu

SEQ ID NO: 452868 - RNA, 19 nt, Human
agcccguugaagggacaga

SEQ ID NO: 452869 - RNA, 24 nt, Human
caacaccacagcuaccucuguaaa

SEQ ID NO: 452870 - RNA, 20 nt, Human
caacgaccacccggccacag

SEQ ID NO: 452871 - RNA, 23 nt, Human
cacagcuaccucuguaaagugga

SEQ ID NO: 452872 - RNA, 19 nt, Human
cagacccuucccuccucca

SEQ ID NO: 452873 - RNA, 20 nt, Human
cagcaccccauauccaaguc

SEQ ID NO: 452874 - RNA, 22 nt, Human
cagcuaguuagugguaaagcua

SEQ ID NO: 452875 - RNA, 19 nt, Human
cauggaaccugcagacccu

SEQ ID NO: 452876 - RNA, 26 nt, Human
ccagucaggccuaaaugguggccuga

SEQ ID NO: 452877 - RNA, 23 nt, Human
ccuccagaacccuugaaggcgaa

SEQ ID NO: 452878 - RNA, 23 nt, Human
ccuccuccagaacccuugaaggc

SEQ ID NO: 452879 - RNA, 19 nt, Human
ccugaggagccaagaggcu

SEQ ID NO: 452880 - RNA, 23 nt, Human
cgcgcagcaacgaccacccggcc

SEQ ID NO: 452881 - RNA, 22 nt, Human
cgguaggcacauacccagccca

SEQ ID NO: 452882 - RNA, 18 nt, Human
cucuccuacuacccaccc

SEQ ID NO: 452883 - RNA, 21 nt, Human
cucucggggcucggggcgcgc

SEQ ID NO: 452884 - RNA, 22 nt, Human
cuuuuugcucuccuacuaccca

SEQ ID NO: 452885 - RNA, 18 nt, Human
gaagcccugagagaacca

SEQ ID NO: 452886 - RNA, 22 nt, Human
gccgcaagcccggauuuaccgc

SEQ ID NO: 452887 - RNA, 22 nt, Human
gggcucggggcgcgcagcaacg

SEQ ID NO: 452888 - RNA, 20 nt, Human
gguagguauucucaccuccc

SEQ ID NO: 452889 - RNA, 22 nt, Human
guggagcgacauuucuuacccc

SEQ ID NO: 452890 - RNA, 19 nt, Human
uaauaauaacaacaauaau

SEQ ID NO: 452891 - RNA, 19 nt, Human
uacuuuuugcucuccuacu

SEQ ID NO: 452892 - RNA, 23 nt, Human
uaggcacauacccagcccagccc

SEQ ID NO: 452893 - RNA, 19 nt, Human
uagguauucucaccucccu

SEQ ID NO: 452894 - RNA, 21 nt, Human
ucaacaccacagcuaccucug

SEQ ID NO: 452895 - RNA, 20 nt, Human
uccaaaaaguccauuucauu

SEQ ID NO: 452896 - RNA, 20 nt, Human
ugagccucccaacaguuccg

SEQ ID NO: 452897 - RNA, 19 nt, Human
ugcagacccuucccuccuc

SEQ ID NO: 452898 - RNA, 24 nt, Human
ugugaacacgcauuuauuuacaca

SEQ ID NO: 452899 - RNA, 18 nt, Human
uuacucaaggccacacag

SEQ ID NO: 452900 - RNA, 21 nt, Human
aaaaaaaaaaaaaaaaagucc

SEQ ID NO: 452901 - RNA, 19 nt, Human
aaaaagaaauuccuagccc

SEQ ID NO: 452902 - RNA, 19 nt, Human
aaagaaauuccuagcccuu

SEQ ID NO: 452903 - RNA, 19 nt, Human
aaccuucugcacccacccc

SEQ ID NO: 452904 - RNA, 24 nt, Human
aagacgucaucgucgccuuugaaa

SEQ ID NO: 452905 - RNA, 24 nt, Human
aagccuggagccuucucccuccaa

SEQ ID NO: 452906 - RNA, 23 nt, Human
aagcugggaaggacaacaggaga

SEQ ID NO: 452907 - RNA, 18 nt, Human
aagucccauuuuauugag

SEQ ID NO: 452908 - RNA, 20 nt, Human
aaguggaucuccuugagggu

SEQ ID NO: 452909 - RNA, 23 nt, Human
accaaaaaaaaaaaaaaaaaaaa

SEQ ID NO: 452910 - RNA, 23 nt, Human
agaaaucucuggcaaccuuggcc

SEQ ID NO: 452911 - RNA, 21 nt, Human
agauguccagccacuugagga

SEQ ID NO: 452912 - RNA, 24 nt, Human
agcagggugcgguggggcagggcu

SEQ ID NO: 452913 - RNA, 18 nt, Human
agccaagaacaaggaaca

SEQ ID NO: 452914 - RNA, 20 nt, Human
agccuggagccuucucccuc

SEQ ID NO: 452915 - RNA, 27 nt, Human
agcuuuuugcuuucucccuuuucuccu

SEQ ID NO: 452916 - RNA, 22 nt, Human
aggaaggcacuggcucacgcua

SEQ ID NO: 452917 - RNA, 21 nt, Human
aggaaguggaucuccuugaga

SEQ ID NO: 452918 - RNA, 22 nt, Human
agggaaaaggggagguugggga

SEQ ID NO: 452919 - RNA, 19 nt, Human
agggagcccaccggccucu

SEQ ID NO: 452920 - RNA, 19 nt, Human
aggggagggaagggaggag

SEQ ID NO: 452921 - RNA, 19 nt, Human
agguaggagguggcaaccu

SEQ ID NO: 452922 - RNA, 23 nt, Human
aucucuggcaaccuuggccccag

SEQ ID NO: 452923 - RNA, 24 nt, Human
aucuuuccuaggugacucccgcug

SEQ ID NO: 452924 - RNA, 24 nt, Human
augcuggucugcuaggcccuggag

SEQ ID NO: 452925 - RNA, 21 nt, Human
caaccuucugcacccaccccc

SEQ ID NO: 452926 - RNA, 23 nt, Human
caaccuuggccccagacaggcuc

SEQ ID NO: 452927 - RNA, 21 nt, Human
caaggaacaagcugugucuuc

SEQ ID NO: 452928 - RNA, 19 nt, Human
cacagcugauccaucccuu

SEQ ID NO: 452929 - RNA, 21 nt, Human
caccagccaagaacaaggaac

SEQ ID NO: 452930 - RNA, 24 nt, Human
caccagccaagaacaaggaacaag

SEQ ID NO: 452931 - RNA, 21 nt, Human
cacccaccagccaagaacaag

SEQ ID NO: 452932 - RNA, 21 nt, Human
cagcagcuugggccaaggucc

SEQ ID NO: 452933 - RNA, 22 nt, Human
cagccagaaauucuagcagguu

SEQ ID NO: 452934 - RNA, 21 nt, Human
cagcugauccaucccuucacc

SEQ ID NO: 452935 - RNA, 19 nt, Human
caggcacggagcugcuggc

SEQ ID NO: 452936 - RNA, 20 nt, Human
cagggagcccaccggccucu

SEQ ID NO: 452937 - RNA, 19 nt, Human
cagggccaggugguggcgc

SEQ ID NO: 452938 - RNA, 24 nt, Human
cagggccauaagcuauuucagugc

SEQ ID NO: 452939 - RNA, 20 nt, Human
caucugaacccccugggauu

SEQ ID NO: 452940 - RNA, 23 nt, Human
ccaaaaaaaaaaaaaaaaaaaaa

SEQ ID NO: 452941 - RNA, 20 nt, Human
ccacccuggaggucagcagc

SEQ ID NO: 452942 - RNA, 22 nt, Human
ccagggcacagucaagggcugg

SEQ ID NO: 452943 - RNA, 22 nt, Human
cccaccagccaagaacaaggaa

SEQ ID NO: 452944 - RNA, 23 nt, Human
cccccacagcugauccaucccuu

SEQ ID NO: 452945 - RNA, 19 nt, Human
ccccugggauuccccugag

SEQ ID NO: 452946 - RNA, 25 nt, Human
cccuccccacccuggaggucagcag

SEQ ID NO: 452947 - RNA, 22 nt, Human
cccuccugaagccuggagccuu

SEQ ID NO: 452948 - RNA, 23 nt, Human
ccuccaaauucuucauaaauaaa

SEQ ID NO: 452949 - RNA, 18 nt, Human
ccucggggccaacucugg

SEQ ID NO: 452950 - RNA, 23 nt, Human
ccucuguacggccgaccuaaucu

SEQ ID NO: 452951 - RNA, 19 nt, Human
ccuggagccuucucccucc

SEQ ID NO: 452952 - RNA, 18 nt, Human
ccugggcaucugaacccc

SEQ ID NO: 452953 - RNA, 21 nt, Human
cgaccuaaucucacccacuga

SEQ ID NO: 452954 - RNA, 20 nt, Human
cgagcuccccgaaaaagaaa

SEQ ID NO: 452955 - RNA, 20 nt, Human
cucccuccccacccuggagg

SEQ ID NO: 452956 - RNA, 22 nt, Human
cucugaugcagcugggaacagg

SEQ ID NO: 452957 - RNA, 23 nt, Human
cucuggccucacccuuggcaggg

SEQ ID NO: 452958 - RNA, 20 nt, Human
cucuguacggccgaccuaau

SEQ ID NO: 452959 - RNA, 19 nt, Human
cugcugucugagugacucu

SEQ ID NO: 452960 - RNA, 21 nt, Human
cuggagaagcagggugcggug

SEQ ID NO: 452961 - RNA, 22 nt, Human
cuggagaagcagggugcggugg

SEQ ID NO: 452962 - RNA, 20 nt, Human
cuggccucacccuuggcagg

SEQ ID NO: 452963 - RNA, 19 nt, Human
cugggugcaggcacggagc

SEQ ID NO: 452964 - RNA, 19 nt, Human
cuuaagagccgagcucccc

SEQ ID NO: 452965 - RNA, 22 nt, Human
cuuaagagccgagcuccccgaa

SEQ ID NO: 452966 - RNA, 18 nt, Human
gaaugaggggagggaagg

SEQ ID NO: 452967 - RNA, 26 nt, Human
gagccgagcuccccgaaaaagaaauu

SEQ ID NO: 452968 - RNA, 19 nt, Human
gaggagggccagggaggac

SEQ ID NO: 452969 - RNA, 18 nt, Human
gagggaagggaggagggc

SEQ ID NO: 452970 - RNA, 21 nt, Human
gccccgucuaaaucccuucca

SEQ ID NO: 452971 - RNA, 21 nt, Human
gccuggagccuucucccucca

SEQ ID NO: 452972 - RNA, 21 nt, Human
ggaaugaggggagggaaggga

SEQ ID NO: 452973 - RNA, 18 nt, Human
ggcccuggagaagcaggg

SEQ ID NO: 452974 - RNA, 21 nt, Human
gggaaaaggggagguugggga

SEQ ID NO: 452975 - RNA, 24 nt, Human
gggaacaggaaguuucacaccaaa

SEQ ID NO: 452976 - RNA, 22 nt, Human
gggaagggaggagggccaggga

SEQ ID NO: 452977 - RNA, 19 nt, Human
gggagaagcugggaaggac

SEQ ID NO: 452978 - RNA, 18 nt, Human
gggagguuggggagaagc

SEQ ID NO: 452979 - RNA, 21 nt, Human
gggagguuggggagaagcugg

SEQ ID NO: 452980 - RNA, 19 nt, Human
gggcagggcucuggagggg

SEQ ID NO: 452981 - RNA, 21 nt, Human
gggcagggcucuggagggggc

SEQ ID NO: 452982 - RNA, 22 nt, Human
gggcagggcucuggagggggcu

SEQ ID NO: 452983 - RNA, 20 nt, Human
ggggagggaagggaggaggg

SEQ ID NO: 452984 - RNA, 19 nt, Human
gggugcgguggggcagggc

SEQ ID NO: 452985 - RNA, 23 nt, Human
gguagcucccuccccacccugga

SEQ ID NO: 452986 - RNA, 18 nt, Human
ggugcgguggggcagggc

SEQ ID NO: 452987 - RNA, 28 nt, Human
guuucacaccaaaaaaaaaaaaaaaaaa

SEQ ID NO: 452988 - RNA, 19 nt, Human
uaaaucccuuccagaaguc

SEQ ID NO: 452989 - RNA, 20 nt, Human
uacaacucuaagggguccac

SEQ ID NO: 452990 - RNA, 19 nt, Human
uagcucccagguuuuucug

SEQ ID NO: 452991 - RNA, 24 nt, Human
ucacaccaaaaaaaaaaaaaaaaa

SEQ ID NO: 452992 - RNA, 23 nt, Human
ucagcagcuugggccaagguccc

SEQ ID NO: 452993 - RNA, 21 nt, Human
ucagggagcccaccggccucu

SEQ ID NO: 452994 - RNA, 21 nt, Human
uccccgaaaaagaaauuccua

SEQ ID NO: 452995 - RNA, 26 nt, Human
uccccgaaaaagaaauuccuagcccu

SEQ ID NO: 452996 - RNA, 18 nt, Human
ucccuucaccggggcaga

SEQ ID NO: 452997 - RNA, 18 nt, Human
uccugggcaucugaaccc

SEQ ID NO: 452998 - RNA, 18 nt, Human
ucuaaaucccuuccagaa

SEQ ID NO: 452999 - RNA, 21 nt, Human
ucuccugucuuauaaacuagg

SEQ ID NO: 453000 - RNA, 18 nt, Human
ucucuggcaaccuuggcc

SEQ ID NO: 453001 - RNA, 21 nt, Human
ucucuggcaaccuuggcccca

SEQ ID NO: 453002 - RNA, 19 nt, Human
ugaaggggacgugggggca

SEQ ID NO: 453003 - RNA, 21 nt, Human
ugcaggcacggagcugcuggc

SEQ ID NO: 453004 - RNA, 20 nt, Human
ugccuggaagggaugucagg

SEQ ID NO: 453005 - RNA, 20 nt, Human
ugccuggaagggaugucagg

SEQ ID NO: 453006 - RNA, 23 nt, Human
ugccuggaagggaugucagggag

SEQ ID NO: 453007 - RNA, 23 nt, Human
ugcgguggggcagggcucuggag

SEQ ID NO: 453008 - RNA, 20 nt, Human
ugcugagggcaggcagcugg

SEQ ID NO: 453009 - RNA, 25 nt, Human
uggagaagcagggugcgguggggca

SEQ ID NO: 453010 - RNA, 19 nt, Human
uggccccagacaggcucuc

SEQ ID NO: 453011 - RNA, 24 nt, Human
ugggaacaggaaguuucacaccaa

SEQ ID NO: 453012 - RNA, 28 nt, Human
ugggaacaggaaguuucaccgggauccc

SEQ ID NO: 453013 - RNA, 18 nt, Human
uggugggguugacgaaga

SEQ ID NO: 453014 - RNA, 21 nt, Human
ugucaaucccuccaucuuucc

SEQ ID NO: 453015 - RNA, 20 nt, Human
uucagugcuuucagguugcc

SEQ ID NO: 453016 - RNA, 23 nt, Human
uuccccugagcugggugcaggca

SEQ ID NO: 453017 - RNA, 22 nt, Human
uugccuggaagggaugucaggg

SEQ ID NO: 453018 - RNA, 18 nt, Human
uugcuuucucccuuuucu

SEQ ID NO: 453019 - RNA, 20 nt, Human
uuggcagggacaggaaggca

SEQ ID NO: 453020 - RNA, 23 nt, Human
uuucuccugucuuauaaacuagg

SEQ ID NO: 453021 - RNA, 22 nt, Human
uuugcuuucucccuuuucuccu

SEQ ID NO: 453022 - RNA, 23 nt, Human
uuuugcuuucucccuuuucuccu

SEQ ID NO: 453023 - RNA, 18 nt, Human
aagaaacugaaggcugga

SEQ ID NO: 453024 - RNA, 19 nt, Human
aagaaacugaaggcuggau

SEQ ID NO: 453025 - RNA, 19 nt, Human
aauccuguauguauuuguu

SEQ ID NO: 453026 - RNA, 21 nt, Human
acgcugcugcgaccugggggc

SEQ ID NO: 453027 - RNA, 23 nt, Human
cacaagugcuuauuguagaacag

SEQ ID NO: 453028 - RNA, 23 nt, Human
ccccccggaggcgacacgcugcu

SEQ ID NO: 453029 - RNA, 21 nt, Human
ccccggccccgggcccugccc

SEQ ID NO: 453030 - RNA, 18 nt, Human
ccccgggcccugcccggg

SEQ ID NO: 453031 - RNA, 20 nt, Human
ccggccccgggcccugcccg

SEQ ID NO: 453032 - RNA, 19 nt, Human
ccgggaaagacugggaagg

SEQ ID NO: 453033 - RNA, 18 nt, Human
cggccccgggcccugccc

SEQ ID NO: 453034 - RNA, 24 nt, Human
cggcucuguggccgggcagaggcc

SEQ ID NO: 453035 - RNA, 19 nt, Human
cuucaaaccccggccccgg

SEQ ID NO: 453036 - RNA, 23 nt, Human
cuuuaucaugucauaaaacacaa

SEQ ID NO: 453037 - RNA, 21 nt, Human
gacagcaccuccagcuccggc

SEQ ID NO: 453038 - RNA, 19 nt, Human
gccccgggcccugcccggg

SEQ ID NO: 453039 - RNA, 18 nt, Human
gccgccagacgggacagc

SEQ ID NO: 453040 - RNA, 18 nt, Human
gcuuauuguagaacagug

SEQ ID NO: 453041 - RNA, 20 nt, Human
gggcagaggccaaccccccg

SEQ ID NO: 453042 - RNA, 19 nt, Human
uaaaaaacccuaagcaauc

SEQ ID NO: 453043 - RNA, 21 nt, Human
ugggggccgggaaagacuggg

SEQ ID NO: 453044 - RNA, 21 nt, Human
uucaaaccccggccccgggcc

SEQ ID NO: 453045 - RNA, 24 nt, Human
uucagcaucuucaaaccccggccc

SEQ ID NO: 453046 - RNA, 21 nt, Human
uuuuuuuuuuuuuugcaugga

SEQ ID NO: 453047 - RNA, 18 nt, Human
uuuuuuuuuuuuuuuugc

SEQ ID NO: 453048 - RNA, 22 nt, Human
uuuuuuuuuuuuuuuugcaugg

SEQ ID NO: 453049 - RNA, 21 nt, Human
accacuccuaccagcaccccg

SEQ ID NO: 453050 - RNA, 21 nt, Human
cacccacgccugcccgagggc

SEQ ID NO: 453051 - RNA, 18 nt, Human
caccccagccgccuucgc

SEQ ID NO: 453052 - RNA, 22 nt, Human
cacucuguuucuuuauuggaaa

SEQ ID NO: 453053 - RNA, 20 nt, Human
cuaccagcaccccgcggccc

SEQ ID NO: 453054 - RNA, 19 nt, Human
cuccaaccacuccuaccag

SEQ ID NO: 453055 - RNA, 26 nt, Human
cucuccaaccacuccuaccagcaccc

SEQ ID NO: 453056 - RNA, 21 nt, Human
cuuggcucucacccacgccug

SEQ ID NO: 453057 - RNA, 20 nt, Human
gaaauccgaacaccccagcc

SEQ ID NO: 453058 - RNA, 21 nt, Human
ggcccccggccuaggcuccag

SEQ ID NO: 453059 - RNA, 22 nt, Human
uccuaccagcaccccgcggggc

SEQ ID NO: 453060 - RNA, 21 nt, Human
uucgcaagucucuccaaccac

SEQ ID NO: 453061 - RNA, 19 nt, Human
aauaaauaggaaaaacuca

SEQ ID NO: 453062 - RNA, 21 nt, Human
agaaaacaaauugaggcauug

SEQ ID NO: 453063 - RNA, 21 nt, Human
agucaugcagaaaacaaauug

SEQ ID NO: 453064 - RNA, 22 nt, Human
augaaccccuaaaccacagguu

SEQ ID NO: 453065 - RNA, 18 nt, Human
augacaagaagaccucac

SEQ ID NO: 453066 - RNA, 22 nt, Human
caaaagaaaucauucacaacca

SEQ ID NO: 453067 - RNA, 24 nt, Human
caaaauaaauaggaaaaacucaua

SEQ ID NO: 453068 - RNA, 23 nt, Human
cacacucacaugacaagaagacc

SEQ ID NO: 453069 - RNA, 25 nt, Human
cacucacaugacaagaagaccucac

SEQ ID NO: 453070 - RNA, 24 nt, Human
cauuccuuccucuugucacgcuca

SEQ ID NO: 453071 - RNA, 21 nt, Human
cauugaguggaggcaaagggc

SEQ ID NO: 453072 - RNA, 19 nt, Human
ccaacacugagacucucag

SEQ ID NO: 453073 - RNA, 28 nt, Human
ccccuaaaccacagguugagaaucccug

SEQ ID NO: 453074 - RNA, 27 nt, Human
ccuccaggcucccuguuccggcucacc

SEQ ID NO: 453075 - RNA, 19 nt, Human
ccucuugucacgcucagcc

SEQ ID NO: 453076 - RNA, 18 nt, Human
cgaugagccccucaggca

SEQ ID NO: 453077 - RNA, 25 nt, Human
cucagccccgaugaaccccuaaacc

SEQ ID NO: 453078 - RNA, 21 nt, Human
cugcaggcggacagaagcgcg

SEQ ID NO: 453079 - RNA, 22 nt, Human
gccagguuccauuuucagugcu

SEQ ID NO: 453080 - RNA, 21 nt, Human
gcucagccccgaugaaccccu

SEQ ID NO: 453081 - RNA, 19 nt, Human
gcuugaagaucagaaguuc

SEQ ID NO: 453082 - RNA, 19 nt, Human
ggaugauuugcuuggaggc

SEQ ID NO: 453083 - RNA, 21 nt, Human
ucacaggcgucgaugagcccc

SEQ ID NO: 453084 - RNA, 18 nt, Human
ucagccccgaugaacccc

SEQ ID NO: 453085 - RNA, 20 nt, Human
uccaucuuucuucauucucc

SEQ ID NO: 453086 - RNA, 22 nt, Human
ucccuccaggcucccuguuuga

SEQ ID NO: 453087 - RNA, 18 nt, Human
ucuuucuucauucuccuc

SEQ ID NO: 453088 - RNA, 18 nt, Human
ugaaccccuaaaccacag

SEQ ID NO: 453089 - RNA, 24 nt, Human
ugacuccaucuuucuucauucucc

SEQ ID NO: 453090 - RNA, 20 nt, Human
ugagcaaaucauuaagcagc

SEQ ID NO: 453091 - RNA, 18 nt, Human
ugauuugcuuggaggcuc

SEQ ID NO: 453092 - RNA, 22 nt, Human
ugcccugcaggcggacagaagc

SEQ ID NO: 453093 - RNA, 18 nt, Human
ugucacaggcgucgauga

SEQ ID NO: 453094 - RNA, 18 nt, Human
uuaagucccacauugccu

SEQ ID NO: 453095 - RNA, 18 nt, Human
uuggaggcuccuuguuca

SEQ ID NO: 453096 - RNA, 27 nt, Human
uuuuaagucccacauugccugcauccc

SEQ ID NO: 453097 - RNA, 21 nt, Human
cgccggcguugcccuagaaac

SEQ ID NO: 453098 - RNA, 21 nt, Human
cgggaaggcagcccuucauua

SEQ ID NO: 453099 - RNA, 18 nt, Human
uagaaacagacggcguag

SEQ ID NO: 453100 - RNA, 22 nt, Human
uaucagagacugugcagccugu

SEQ ID NO: 453101 - RNA, 26 nt, Human
ugcccccagcucuggccaccaggcuu

SEQ ID NO: 453102 - RNA, 23 nt, Human
ugcuaagagacgccggcguugcc

SEQ ID NO: 453103 - RNA, 20 nt, Human
uggccaccaggcuugccccu

SEQ ID NO: 453104 - RNA, 19 nt, Human
ugugcagccuguggagccu

SEQ ID NO: 453105 - RNA, 22 nt, Human
uuggcagcgacaccuucgcgaa

SEQ ID NO: 453106 - RNA, 24 nt, Human
uuuuuuuuuuuuuuuuuacucuga

SEQ ID NO: 453107 - RNA, 19 nt, Human
aaaauagugaaacuccauu

SEQ ID NO: 453108 - RNA, 20 nt, Human
aacauggugaaacccccauc

SEQ ID NO: 453109 - RNA, 21 nt, Human
aacauggugaaacccccaucu

SEQ ID NO: 453110 - RNA, 22 nt, Human
aacauggugaaacccccaucuc

SEQ ID NO: 453111 - RNA, 21 nt, Human
aagcucucagaaccgccuucc

SEQ ID NO: 453112 - RNA, 22 nt, Human
aaggauucagcccgcuuugucc

SEQ ID NO: 453113 - RNA, 24 nt, Human
aaucacuugaacccaggaggcaga

SEQ ID NO: 453114 - RNA, 21 nt, Human
acccauuccauccccaagccc

SEQ ID NO: 453115 - RNA, 21 nt, Human
accgccuuccucucugccucc

SEQ ID NO: 453116 - RNA, 24 nt, Human
accugaggucaggaguucgagacu

SEQ ID NO: 453117 - RNA, 19 nt, Human
agaacauacuaggcuagca

SEQ ID NO: 453118 - RNA, 22 nt, Human
agaaccgccuuccucucugccu

SEQ ID NO: 453119 - RNA, 24 nt, Human
agagaggaggaggggaaauggagc

SEQ ID NO: 453120 - RNA, 23 nt, Human
agagguugcagugagccaagauc

SEQ ID NO: 453121 - RNA, 24 nt, Human
agagguugcagugagccaagaucg

SEQ ID NO: 453122 - RNA, 22 nt, Human
agccuggccaacauggugaaac

SEQ ID NO: 453123 - RNA, 24 nt, Human
agccuggccaacauggugaaaccc

SEQ ID NO: 453124 - RNA, 22 nt, Human
agccugggcaaaauagugaaac

SEQ ID NO: 453125 - RNA, 23 nt, Human
agccugggcaaaauagugaaacu

SEQ ID NO: 453126 - RNA, 24 nt, Human
agccugggcaaaauagugaaacuc

SEQ ID NO: 453127 - RNA, 23 nt, Human
aggaguucgagacuagccuggcc

SEQ ID NO: 453128 - RNA, 18 nt, Human
aggcaagagaaucacuug

SEQ ID NO: 453129 - RNA, 24 nt, Human
aggcaagagaaucacuugaaccca

SEQ ID NO: 453130 - RNA, 24 nt, Human
aggcagagguugcagugagccaag

SEQ ID NO: 453131 - RNA, 18 nt, Human
aggcagguggaucaccug

SEQ ID NO: 453132 - RNA, 22 nt, Human
aggcagguggaucaccugaggu

SEQ ID NO: 453133 - RNA, 26 nt, Human
aggcagguggaucaccugaggucagg

SEQ ID NO: 453134 - RNA, 20 nt, Human
agggggugggaggguggagg

SEQ ID NO: 453135 - RNA, 20 nt, Human
agguaucagaaaccugaagg

SEQ ID NO: 453136 - RNA, 22 nt, Human
agguggaucaccugaggucagg

SEQ ID NO: 453137 - RNA, 18 nt, Human
agucagcuuggggagcua

SEQ ID NO: 453138 - RNA, 23 nt, Human
aguggcucaugcuuguaauccca

SEQ ID NO: 453139 - RNA, 24 nt, Human
aguggcucaugcuuguaaucccag

SEQ ID NO: 453140 - RNA, 21 nt, Human
aucaccugaggucaggaguuc

SEQ ID NO: 453141 - RNA, 24 nt, Human
aucgcaccaucgcacuccagccug

SEQ ID NO: 453142 - RNA, 28 nt, Human
aucgcaccaucgcacuccagccugggca

SEQ ID NO: 453143 - RNA, 25 nt, Human
aucgcacuccagccugggcaaaaua

SEQ ID NO: 453144 - RNA, 19 nt, Human
auuccauccccaagcccau

SEQ ID NO: 453145 - RNA, 24 nt, Human
caacauggugaaacccccaucucu

SEQ ID NO: 453146 - RNA, 19 nt, Human
caacauguucuccucugcc

SEQ ID NO: 453147 - RNA, 19 nt, Human
caacccucaagaaagaaaa

SEQ ID NO: 453148 - RNA, 24 nt, Human
caaggcagguggaucaccugaggu

SEQ ID NO: 453149 - RNA, 26 nt, Human
caaggcagguggaucaccugagguca

SEQ ID NO: 453150 - RNA, 20 nt, Human
caauguacacauacacaugu

SEQ ID NO: 453151 - RNA, 24 nt, Human
caccacccauuccauccccaagcc

SEQ ID NO: 453152 - RNA, 23 nt, Human
caccugaggucaggaguucgaga

SEQ ID NO: 453153 - RNA, 23 nt, Human
caccuguaauuuccacuacucgg

SEQ ID NO: 453154 - RNA, 24 nt, Human
cacuacucgggagacugaggcaag

SEQ ID NO: 453155 - RNA, 20 nt, Human
cacuccagccugggcaaaau

SEQ ID NO: 453156 - RNA, 20 nt, Human
cacucugugaacuuaccacc

SEQ ID NO: 453157 - RNA, 26 nt, Human
cacucugugaacuuaccaccacccau

SEQ ID NO: 453158 - RNA, 18 nt, Human
cagaaaccugaaggauuc

SEQ ID NO: 453159 - RNA, 19 nt, Human
cagcagcccaaggaaguga

SEQ ID NO: 453160 - RNA, 22 nt, Human
cagcccagucagcuuggggagc

SEQ ID NO: 453161 - RNA, 23 nt, Human
caggcugggcacaguggcucaug

SEQ ID NO: 453162 - RNA, 24 nt, Human
cagguggaucaccugaggucagga

SEQ ID NO: 453163 - RNA, 22 nt, Human
caguacaggacacaggcacucc

SEQ ID NO: 453164 - RNA, 24 nt, Human
cagugcuuugggaggccaaggcag

SEQ ID NO: 453165 - RNA, 25 nt, Human
cagugcuuugggaggccaaggcagg

SEQ ID NO: 453166 - RNA, 19 nt, Human
caucgcacuccagccuggg

SEQ ID NO: 453167 - RNA, 22 nt, Human
caucgcacuccagccugggcaa

SEQ ID NO: 453168 - RNA, 22 nt, Human
caucugcccaccaaggccccug

SEQ ID NO: 453169 - RNA, 24 nt, Human
caugcuuguaaucccagugcuuug

SEQ ID NO: 453170 - RNA, 20 nt, Human
cauucggggccuagcugccc

SEQ ID NO: 453171 - RNA, 21 nt, Human
ccacccauuccauccccaagc

SEQ ID NO: 453172 - RNA, 22 nt, Human
ccagaggucaugggaguuggga

SEQ ID NO: 453173 - RNA, 22 nt, Human
ccaggaggcagagguugcagug

SEQ ID NO: 453174 - RNA, 23 nt, Human
ccagugcuaggcagauagccaag

SEQ ID NO: 453175 - RNA, 19 nt, Human
ccagugcuuugggaggcca

SEQ ID NO: 453176 - RNA, 20 nt, Human
ccaucgcacuccagccuggg

SEQ ID NO: 453177 - RNA, 21 nt, Human
ccaucgcacuccagccugggc

SEQ ID NO: 453178 - RNA, 24 nt, Human
ccaucgcacuccagccugggcaaa

SEQ ID NO: 453179 - RNA, 25 nt, Human
cccaauguacacauacacaugugua

SEQ ID NO: 453180 - RNA, 20 nt, Human
cccacgcugucaaguagggu

SEQ ID NO: 453181 - RNA, 19 nt, Human
cccagugcuuugggaggcc

SEQ ID NO: 453182 - RNA, 22 nt, Human
ccccacccaccacugaagccag

SEQ ID NO: 453183 - RNA, 23 nt, Human
ccccacccaccacugaagccaga

SEQ ID NO: 453184 - RNA, 19 nt, Human
cccucaauugccaucugcc

SEQ ID NO: 453185 - RNA, 19 nt, Human
cccucccccacccuaauag

SEQ ID NO: 453186 - RNA, 22 nt, Human
cccugccccacccaccacugaa

SEQ ID NO: 453187 - RNA, 24 nt, Human
cccuugaggauguccuaguuacac

SEQ ID NO: 453188 - RNA, 21 nt, Human
ccgcugugucccuugggaggg

SEQ ID NO: 453189 - RNA, 20 nt, Human
ccgggcccuuccucuuccag

SEQ ID NO: 453190 - RNA, 18 nt, Human
ccuaccgcugugucccuu

SEQ ID NO: 453191 - RNA, 21 nt, Human
ccucucugauaccuguggagu

SEQ ID NO: 453192 - RNA, 19 nt, Human
ccucuuccaggggguggga

SEQ ID NO: 453193 - RNA, 22 nt, Human
ccugaggucaggaguucgagac

SEQ ID NO: 453194 - RNA, 19 nt, Human
ccugccccacccaccacug

SEQ ID NO: 453195 - RNA, 22 nt, Human
ccugccccacccaccacugaag

SEQ ID NO: 453196 - RNA, 23 nt, Human
ccuggccaacauggugaaacccc

SEQ ID NO: 453197 - RNA, 23 nt, Human
ccuggccaacauggugaaacccc

SEQ ID NO: 453198 - RNA, 25 nt, Human
ccuggccaacauggugaaaccccca

SEQ ID NO: 453199 - RNA, 24 nt, Human
ccugggcaaaauagugaaacucca

SEQ ID NO: 453200 - RNA, 18 nt, Human
ccuuucaucugcccugcc

SEQ ID NO: 453201 - RNA, 24 nt, Human
cgagacuagccuggccaacauggu

SEQ ID NO: 453202 - RNA, 21 nt, Human
cgcaccaucgcacuccagccu

SEQ ID NO: 453203 - RNA, 20 nt, Human
cgcuuuguccuacuaguguc

SEQ ID NO: 453204 - RNA, 24 nt, Human
cgggagacugaggcaagagaauca

SEQ ID NO: 453205 - RNA, 22 nt, Human
cuagguaucagaaaccugaagg

SEQ ID NO: 453206 - RNA, 24 nt, Human
cucaugcuuguaaucccagugcuu

SEQ ID NO: 453207 - RNA, 18 nt, Human
cucucugccuccgcuguc

SEQ ID NO: 453208 - RNA, 18 nt, Human
cucugugaacuuaccacc

SEQ ID NO: 453209 - RNA, 19 nt, Human
cugccuccgcugucgccgc

SEQ ID NO: 453210 - RNA, 23 nt, Human
cugggcaaaauagugaaacucca

SEQ ID NO: 453211 - RNA, 20 nt, Human
cuuggcugguguaacaguuu

SEQ ID NO: 453212 - RNA, 27 nt, Human
cuuugucugguagagaggaggagggga

SEQ ID NO: 453213 - RNA, 24 nt, Human
gaagcccuuucaucugcccugccc

SEQ ID NO: 453214 - RNA, 21 nt, Human
gacagcgagggcaguacagga

SEQ ID NO: 453215 - RNA, 19 nt, Human
gacaugaggcugagaaggg

SEQ ID NO: 453216 - RNA, 23 nt, Human
gagaaucacuugaacccaggagg

SEQ ID NO: 453217 - RNA, 19 nt, Human
gaggaaaagccuuauggag

SEQ ID NO: 453218 - RNA, 18 nt, Human
gagggaggggacagaggc

SEQ ID NO: 453219 - RNA, 24 nt, Human
gaucaccugaggucaggaguucga

SEQ ID NO: 453220 - RNA, 22 nt, Human
gcaagagaaucacuugaaccca

SEQ ID NO: 453221 - RNA, 20 nt, Human
gcaccaucgcacuccagccu

SEQ ID NO: 453222 - RNA, 20 nt, Human
gcaguacaggacacaggcac

SEQ ID NO: 453223 - RNA, 19 nt, Human
gcauaaguccccugccucc

SEQ ID NO: 453224 - RNA, 25 nt, Human
gccaacauggugaaacccccaucuc

SEQ ID NO: 453225 - RNA, 19 nt, Human
gccuccgcugucgccgccg

SEQ ID NO: 453226 - RNA, 19 nt, Human
gccuccgcugucgccgccg

SEQ ID NO: 453227 - RNA, 22 nt, Human
gccuuccucucugccuccgcug

SEQ ID NO: 453228 - RNA, 21 nt, Human
gcuaggcagauagccaagugg

SEQ ID NO: 453229 - RNA, 19 nt, Human
gcucugccucuguggcuuu

SEQ ID NO: 453230 - RNA, 22 nt, Human
ggaagugagggaggggacagag

SEQ ID NO: 453231 - RNA, 22 nt, Human
ggaggcagagguugcagugagc

SEQ ID NO: 453232 - RNA, 23 nt, Human
ggagggggugcaguggaagcucu

SEQ ID NO: 453233 - RNA, 22 nt, Human
ggaggguggagguggggacagg

SEQ ID NO: 453234 - RNA, 18 nt, Human
ggaggucccucccccacc

SEQ ID NO: 453235 - RNA, 22 nt, Human
ggaucaccugaggucaggaguu

SEQ ID NO: 453236 - RNA, 23 nt, Human
ggcacaguggcucaugcuuguaa

SEQ ID NO: 453237 - RNA, 24 nt, Human
ggcucaugcuuguaaucccagugc

SEQ ID NO: 453238 - RNA, 22 nt, Human
ggcugggcacaguggcucaugc

SEQ ID NO: 453239 - RNA, 24 nt, Human
gggacaggaccaacccucaagaaa

SEQ ID NO: 453240 - RNA, 18 nt, Human
gggagacagcgagggcag

SEQ ID NO: 453241 - RNA, 19 nt, Human
gggagacugaggcaagaga

SEQ ID NO: 453242 - RNA, 18 nt, Human
gggcacaguggcucaugc

SEQ ID NO: 453243 - RNA, 21 nt, Human
gggugggaggguggagguggg

SEQ ID NO: 453244 - RNA, 28 nt, Human
gguagagaggaggaggggaaauggagcc

SEQ ID NO: 453245 - RNA, 20 nt, Human
ggucaugggaguugggaucu

SEQ ID NO: 453246 - RNA, 22 nt, Human
ggugcaguggaagcucuuaaag

SEQ ID NO: 453247 - RNA, 22 nt, Human
gguggugggggagacagcgagg

SEQ ID NO: 453248 - RNA, 22 nt, Human
uaaaaauacaaaacuagcaaga

SEQ ID NO: 453249 - RNA, 23 nt, Human
uaaaaauacaaaacuagcaagau

SEQ ID NO: 453250 - RNA, 18 nt, Human
uaacuuggcugguguaac

SEQ ID NO: 453251 - RNA, 20 nt, Human
uaacuuggcugguguaacag

SEQ ID NO: 453252 - RNA, 21 nt, Human
uaagaaaugucaguggaacag

SEQ ID NO: 453253 - RNA, 18 nt, Human
uaagucucuguccugaga

SEQ ID NO: 453254 - RNA, 19 nt, Human
uacaaaacuagcaagaugu

SEQ ID NO: 453255 - RNA, 22 nt, Human
uacacauacacauguguaucau

SEQ ID NO: 453256 - RNA, 19 nt, Human
uacaggacacaggcacucc

SEQ ID NO: 453257 - RNA, 24 nt, Human
uagccuggccaacauggugaaacc

SEQ ID NO: 453258 - RNA, 18 nt, Human
uaggguggugggggagac

SEQ ID NO: 453259 - RNA, 24 nt, Human
uauaugcauggacacucaagcaca

SEQ ID NO: 453260 - RNA, 21 nt, Human
uaucagaaaccugaaggauuc

SEQ ID NO: 453261 - RNA, 20 nt, Human
ucaccugaggucaggaguuc

SEQ ID NO: 453262 - RNA, 21 nt, Human
ucaugcuuguaaucccagugc

SEQ ID NO: 453263 - RNA, 21 nt, Human
uccagggggugggagggugga

SEQ ID NO: 453264 - RNA, 22 nt, Human
uccauuaaaaaaaaaaaaaaaa

SEQ ID NO: 453265 - RNA, 26 nt, Human
uccauuaaaaaaaaaaaaaaaaguca

SEQ ID NO: 453266 - RNA, 21 nt, Human
uccugagauccuggggcuccu

SEQ ID NO: 453267 - RNA, 19 nt, Human
ucucagaaccgccuuccuc

SEQ ID NO: 453268 - RNA, 20 nt, Human
ucucugcuaaaaauacaaaa

SEQ ID NO: 453269 - RNA, 23 nt, Human
ucugcccaccaaggccccugccc

SEQ ID NO: 453270 - RNA, 21 nt, Human
ugaagcccuuucaucugcccu

SEQ ID NO: 453271 - RNA, 20 nt, Human
ugacuccacuaaagcagcag

SEQ ID NO: 453272 - RNA, 20 nt, Human
ugagaagggaagccagaugu

SEQ ID NO: 453273 - RNA, 22 nt, Human
ugagaagggaagccagauguca

SEQ ID NO: 453274 - RNA, 23 nt, Human
ugagaagggaagccagaugucag

SEQ ID NO: 453275 - RNA, 18 nt, Human
ugaggcaagagaaucacu

SEQ ID NO: 453276 - RNA, 20 nt, Human
ugaggcaagagaaucacuug

SEQ ID NO: 453277 - RNA, 24 nt, Human
ugaggcaagagaaucacuugaacc

SEQ ID NO: 453278 - RNA, 25 nt, Human
ugaggcaagagaaucacuugaaccc

SEQ ID NO: 453279 - RNA, 19 nt, Human
ugagggaggggacagaggc

SEQ ID NO: 453280 - RNA, 21 nt, Human
ugcauaaguccccugccuccc

SEQ ID NO: 453281 - RNA, 23 nt, Human
ugccccacccaccacugaagcca

SEQ ID NO: 453282 - RNA, 23 nt, Human
ugccuccgcugucgccgccgggc

SEQ ID NO: 453283 - RNA, 23 nt, Human
ugcuuguaaucccagugcuuugg

SEQ ID NO: 453284 - RNA, 19 nt, Human
uggaacacaaaauucccug

SEQ ID NO: 453285 - RNA, 24 nt, Human
uggaucaccugaggucaggaguuc

SEQ ID NO: 453286 - RNA, 26 nt, Human
uggaucaccugaggucaggaguucga

SEQ ID NO: 453287 - RNA, 22 nt, Human
uggcacugagggaugcauaagu

SEQ ID NO: 453288 - RNA, 18 nt, Human
uggccaacauggugaaac

SEQ ID NO: 453289 - RNA, 22 nt, Human
uggcucaugcuuguaaucccag

SEQ ID NO: 453290 - RNA, 22 nt, Human
uggcucaugcuuguaaucccag

SEQ ID NO: 453291 - RNA, 24 nt, Human
ugggaggccaaggcagguggauca

SEQ ID NO: 453292 - RNA, 18 nt, Human
ugggagggggugcagugg

SEQ ID NO: 453293 - RNA, 21 nt, Human
uggggguuuugcugaaugucu

SEQ ID NO: 453294 - RNA, 21 nt, Human
ugguagagaggaggaggggaa

SEQ ID NO: 453295 - RNA, 23 nt, Human
ugguagcacacaccuguaauuuc

SEQ ID NO: 453296 - RNA, 20 nt, Human
uguaaucccagugcuuuggg

SEQ ID NO: 453297 - RNA, 25 nt, Human
uguacacauacacauguguaucaug

SEQ ID NO: 453298 - RNA, 27 nt, Human
uguacacauacacauguguaucaugua

SEQ ID NO: 453299 - RNA, 21 nt, Human
uguagccuggcuggcaggcag

SEQ ID NO: 453300 - RNA, 18 nt, Human
uguaucauguauguauau

SEQ ID NO: 453301 - RNA, 18 nt, Human
ugucagagcacaccagga

SEQ ID NO: 453302 - RNA, 19 nt, Human
uguccugagauccuggggc

SEQ ID NO: 453303 - RNA, 20 nt, Human
uguguaucauguauguauau

SEQ ID NO: 453304 - RNA, 21 nt, Human
uguguaucauguauguauaug

SEQ ID NO: 453305 - RNA, 22 nt, Human
uguuugggaaagggaguuggga

SEQ ID NO: 453306 - RNA, 24 nt, Human
uucccugucuuaacauuguacauu

SEQ ID NO: 453307 - RNA, 22 nt, Human
uugcagugagccaagaucgcac

SEQ ID NO: 453308 - RNA, 23 nt, Human
uugcuacccucaauugccaucug

SEQ ID NO: 453309 - RNA, 24 nt, Human
uuuuuuuuuuuuuuagacaaguuu

SEQ ID NO: 453310 - RNA, 24 nt, Human
aaaaaaaacaaaaacaaaaaacga

SEQ ID NO: 453311 - RNA, 22 nt, Human
aaaaaguaaacuccaagugaac

SEQ ID NO: 453312 - RNA, 21 nt, Human
aaaacagacauaccuugggua

SEQ ID NO: 453313 - RNA, 23 nt, Human
aaacaaaaacaaaaaacgauuaa

SEQ ID NO: 453314 - RNA, 20 nt, Human
aaacaaccuggaggucacag

SEQ ID NO: 453315 - RNA, 19 nt, Human
aaacaucuugugacaagcu

SEQ ID NO: 453316 - RNA, 18 nt, Human
aaccuggaggucacagga

SEQ ID NO: 453317 - RNA, 24 nt, Human
aagauacuuuuuaaaauucagaau

SEQ ID NO: 453318 - RNA, 18 nt, Human
aaggaaaaaaaacaaaaa

SEQ ID NO: 453319 - RNA, 21 nt, Human
aaggaaaaaaaacaaaaacaa

SEQ ID NO: 453320 - RNA, 19 nt, Human
agauacuuuuuaaaauuca

SEQ ID NO: 453321 - RNA, 23 nt, Human
agaugugaacuaaagcuauaacc

SEQ ID NO: 453322 - RNA, 24 nt, Human
aggaaaaaaaacaaaaacaaaaaa

SEQ ID NO: 453323 - RNA, 21 nt, Human
augaaaaucaauuuauaaaca

SEQ ID NO: 453324 - RNA, 22 nt, Human
caaugaaucauauaaacuguag

SEQ ID NO: 453325 - RNA, 24 nt, Human
cacagaaggaauguccuauuugcc

SEQ ID NO: 453326 - RNA, 19 nt, Human
cacccagaaugaaaugacu

SEQ ID NO: 453327 - RNA, 20 nt, Human
cacgagaaaaagaagauacu

SEQ ID NO: 453328 - RNA, 22 nt, Human
cagaaugaaaugacucugcuga

SEQ ID NO: 453329 - RNA, 19 nt, Human
cauauaaacuguagacugc

SEQ ID NO: 453330 - RNA, 18 nt, Human
cauuucuuugccuggugc

SEQ ID NO: 453331 - RNA, 22 nt, Human
ccaagugaacaucaaaucaaau

SEQ ID NO: 453332 - RNA, 24 nt, Human
ccaaugauaacaucacacaugcaa

SEQ ID NO: 453333 - RNA, 20 nt, Human
ccauagaagauucuuuuaac

SEQ ID NO: 453334 - RNA, 25 nt, Human
cuaaagcuauaaccccuguacccua

SEQ ID NO: 453335 - RNA, 23 nt, Human
cuaaauaucagccacuuugggcu

SEQ ID NO: 453336 - RNA, 19 nt, Human
cuauaaccccuguacccua

SEQ ID NO: 453337 - RNA, 18 nt, Human
cucaagugauuuaucuac

SEQ ID NO: 453338 - RNA, 20 nt, Human
cuuuucuaauuuucccggag

SEQ ID NO: 453339 - RNA, 22 nt, Human
gaaaaaaaacaaaaacaaaaaa

SEQ ID NO: 453340 - RNA, 20 nt, Human
gacauauaaggaaaaaaaac

SEQ ID NO: 453341 - RNA, 19 nt, Human
gauucugagauaaucccuc

SEQ ID NO: 453342 - RNA, 18 nt, Human
ggcggugauaauacugca

SEQ ID NO: 453343 - RNA, 23 nt, Human
gugaacuaaagcuauaaccccug

SEQ ID NO: 453344 - RNA, 22 nt, Human
guguguuaggaucacccagaau

SEQ ID NO: 453345 - RNA, 22 nt, Human
uaaagcuauaaccccuguaccc

SEQ ID NO: 453346 - RNA, 19 nt, Human
uaacacgagaaaaagaaga

SEQ ID NO: 453347 - RNA, 18 nt, Human
uaacugaggacagaaauc

SEQ ID NO: 453348 - RNA, 19 nt, Human
uacgcagacagaauauaug

SEQ ID NO: 453349 - RNA, 19 nt, Human
uagaaggaggcaacaguuu

SEQ ID NO: 453350 - RNA, 22 nt, Human
uagaaggaggcaacaguuucau

SEQ ID NO: 453351 - RNA, 22 nt, Human
ucaguuauuaaaagguuucuua

SEQ ID NO: 453352 - RNA, 23 nt, Human
ugaaucauauaaacuguagacug

SEQ ID NO: 453353 - RNA, 19 nt, Human
ugacacagaaggaaugucc

SEQ ID NO: 453354 - RNA, 18 nt, Human
ugacugguuguucuuuau

SEQ ID NO: 453355 - RNA, 22 nt, Human
ugaggaauguuaaauagagaaa

SEQ ID NO: 453356 - RNA, 27 nt, Human
ugauaacaucacacaugcaaagauuuu

SEQ ID NO: 453357 - RNA, 22 nt, Human
ugggaaagaugugaacuaaagc

SEQ ID NO: 453358 - RNA, 18 nt, Human
ugggccauugacauauaa

SEQ ID NO: 453359 - RNA, 18 nt, Human
ugugaacuaaagcuauaa

SEQ ID NO: 453360 - RNA, 24 nt, Human
uguucuggucaccaaaugucuugu

SEQ ID NO: 453361 - RNA, 21 nt, Human
uuaaaaaacaucugaacagca

SEQ ID NO: 453362 - RNA, 21 nt, Human
uugcgguaucauuucuaauau

SEQ ID NO: 453363 - RNA, 21 nt, Human
uuuuaaaccgcuaagcauccu

SEQ ID NO: 453364 - RNA, 24 nt, Human
aaacaaauagaggcucucucuagu

SEQ ID NO: 453365 - RNA, 22 nt, Human
aaagcuuuuccacauucaguac

SEQ ID NO: 453366 - RNA, 24 nt, Human
acugcauuuauaguaauuccccuc

SEQ ID NO: 453367 - RNA, 20 nt, Human
agaaaacaaauagaggcucu

SEQ ID NO: 453368 - RNA, 21 nt, Human
agcuugacaacaccaauauca

SEQ ID NO: 453369 - RNA, 19 nt, Human
auuuauaguaauuccccuc

SEQ ID NO: 453370 - RNA, 24 nt, Human
caacaccaauaucaaguaaccaaa

SEQ ID NO: 453371 - RNA, 23 nt, Human
caccaauaucaaguaaccaaaga

SEQ ID NO: 453372 - RNA, 19 nt, Human
caucugaacagaucugacu

SEQ ID NO: 453373 - RNA, 22 nt, Human
cauucauggcauucaugcugcu

SEQ ID NO: 453374 - RNA, 21 nt, Human
ccaucaagcugggacuucuga

SEQ ID NO: 453375 - RNA, 22 nt, Human
ccccauauguguaacuacacau

SEQ ID NO: 453376 - RNA, 21 nt, Human
cuccaguaugaauuuuuuuau

SEQ ID NO: 453377 - RNA, 22 nt, Human
cugaacagaucugacuucugga

SEQ ID NO: 453378 - RNA, 20 nt, Human
gacugccaucaagcugggac

SEQ ID NO: 453379 - RNA, 23 nt, Human
gugcauauuccugcauaaacccu

SEQ ID NO: 453380 - RNA, 24 nt, Human
guuugaauucugagggagguuuuu

SEQ ID NO: 453381 - RNA, 21 nt, Human
uaaggaguuuucugacgguuu

SEQ ID NO: 453382 - RNA, 18 nt, Human
ugagagcuugcuuaugau

SEQ ID NO: 453383 - RNA, 18 nt, Human
ugagugaagacugccuca

SEQ ID NO: 453384 - RNA, 27 nt, Human
ugcaggagcuugacaacaccaauauca

SEQ ID NO: 453385 - RNA, 20 nt, Human
ugcauaaacccucugacugc

SEQ ID NO: 453386 - RNA, 21 nt, Human
uggcauucaugcugcuuuucu

SEQ ID NO: 453387 - RNA, 28 nt, Human
uguguaacuacacaucagcuauaugauc

SEQ ID NO: 453388 - RNA, 24 nt, Human
uguugauuuccuugugaaagcuuu

SEQ ID NO: 453389 - RNA, 21 nt, Human
uuccuugugaaagcuuuucca

SEQ ID NO: 453390 - RNA, 21 nt, Human
uucuccagaaugaauucucug

SEQ ID NO: 453391 - RNA, 24 nt, Human
uuucucacauucacuguacucaua

SEQ ID NO: 453392 - RNA, 23 nt, Human
agcagcagcuuuauuaguggugc

SEQ ID NO: 453393 - RNA, 23 nt, Human
aggcaccaguggcaggaggaggg

SEQ ID NO: 453394 - RNA, 20 nt, Human
cagccaagcagcagcuuuau

SEQ ID NO: 453395 - RNA, 18 nt, Human
cggaugcggcgggcggcu

SEQ ID NO: 453396 - RNA, 22 nt, Human
cggcugcagaagggcgcaggug

SEQ ID NO: 453397 - RNA, 24 nt, Human
gaggcaccaguggcaggaggaggg

SEQ ID NO: 453398 - RNA, 21 nt, Human
gggaacuucuaagugacugga

SEQ ID NO: 453399 - RNA, 22 nt, Human
guuaacacugugauacgaaaac

SEQ ID NO: 453400 - RNA, 21 nt, Human
guucuucccauacccuacagc

SEQ ID NO: 453401 - RNA, 21 nt, Human
uaacacugugauacgaaaacu

SEQ ID NO: 453402 - RNA, 22 nt, Human
uacgaaaacuucagacaacacc

SEQ ID NO: 453403 - RNA, 18 nt, Human
ugaauuggguuuuuggcc

SEQ ID NO: 453404 - RNA, 24 nt, Human
uggaaugauauaaauaaagcuuug

SEQ ID NO: 453405 - RNA, 25 nt, Human
uggguucuucccauacccuacagcg

SEQ ID NO: 453406 - RNA, 25 nt, Human
uuauuaguggugcuggguucuuccc

SEQ ID NO: 453407 - RNA, 19 nt, Human
uuugcaggagagaguacag

SEQ ID NO: 453408 - RNA, 21 nt, Human
aagcccggagccugagggcgg

SEQ ID NO: 453409 - RNA, 20 nt, Human
aaucugggucagcccucccu

SEQ ID NO: 453410 - RNA, 21 nt, Human
agggagcugaggcugucggcu

SEQ ID NO: 453411 - RNA, 21 nt, Human
caaaggagacagcacggaucc

SEQ ID NO: 453412 - RNA, 26 nt, Human
cacggauccucuuuuugcauaggccu

SEQ ID NO: 453413 - RNA, 22 nt, Human
cagcacggauccucuuuuugca

SEQ ID NO: 453414 - RNA, 20 nt, Human
caggccccgccccgcccgug

SEQ ID NO: 453415 - RNA, 21 nt, Human
caggcgccugggggaaagccc

SEQ ID NO: 453416 - RNA, 19 nt, Human
cagggcagugggaacgggu

SEQ ID NO: 453417 - RNA, 23 nt, Human
ccagggcagugggaacgggugga

SEQ ID NO: 453418 - RNA, 19 nt, Human
cccccaggcccgccaggcc

SEQ ID NO: 453419 - RNA, 24 nt, Human
cccucagaaccccgguggacccag

SEQ ID NO: 453420 - RNA, 18 nt, Human
ccgccaggccuccugggc

SEQ ID NO: 453421 - RNA, 20 nt, Human
ccgccucccuccagcacccc

SEQ ID NO: 453422 - RNA, 18 nt, Human
ccgggccugccgccuccc

SEQ ID NO: 453423 - RNA, 18 nt, Human
ccguagcgcccccaggcc

SEQ ID NO: 453424 - RNA, 21 nt, Human
ccucccuccagcaccccgggc

SEQ ID NO: 453425 - RNA, 19 nt, Human
cgccaggccuccugggccc

SEQ ID NO: 453426 - RNA, 20 nt, Human
cgccaggccuccugggcccu

SEQ ID NO: 453427 - RNA, 22 nt, Human
cgcccccaggcccgccaggccu

SEQ ID NO: 453428 - RNA, 19 nt, Human
cgccugggggaaagcccgg

SEQ ID NO: 453429 - RNA, 24 nt, Human
cggauccucuuuuugcauaggccu

SEQ ID NO: 453430 - RNA, 23 nt, Human
cucagaaccccgguggacccagg

SEQ ID NO: 453431 - RNA, 25 nt, Human
cucaggaccucagucuccccucaga

SEQ ID NO: 453432 - RNA, 23 nt, Human
cucucccaccguagcgcccccag

SEQ ID NO: 453433 - RNA, 21 nt, Human
cucugggcccaagcccgaucu

SEQ ID NO: 453434 - RNA, 23 nt, Human
cugcccagggcagugggaacggg

SEQ ID NO: 453435 - RNA, 21 nt, Human
gaucucgaggcaccugacccg

SEQ ID NO: 453436 - RNA, 21 nt, Human
gcccccaggcccgccaggccu

SEQ ID NO: 453437 - RNA, 19 nt, Human
gcccccagggcaucgcggg

SEQ ID NO: 453438 - RNA, 24 nt, Human
gcccuggaaggcagaggcagguac

SEQ ID NO: 453439 - RNA, 20 nt, Human
gcgcccccaggcccgccagg

SEQ ID NO: 453440 - RNA, 20 nt, Human
gcugcccagggcagugggaa

SEQ ID NO: 453441 - RNA, 19 nt, Human
ggaaaacccaaaacuuccg

SEQ ID NO: 453442 - RNA, 24 nt, Human
ggaaaacccaaaacuuccgauggg

SEQ ID NO: 453443 - RNA, 18 nt, Human
ggcacagcuggggccaac

SEQ ID NO: 453444 - RNA, 20 nt, Human
ggcccuggaaggcagaggca

SEQ ID NO: 453445 - RNA, 26 nt, Human
ggccugccgccucccuccagcacccc

SEQ ID NO: 453446 - RNA, 18 nt, Human
ggcggaaaacccaaaacu

SEQ ID NO: 453447 - RNA, 20 nt, Human
gggcagugggaacgggugga

SEQ ID NO: 453448 - RNA, 21 nt, Human
gggccaacgguggcccuggaa

SEQ ID NO: 453449 - RNA, 21 nt, Human
ggggaaagcccggagccugag

SEQ ID NO: 453450 - RNA, 22 nt, Human
gggggaaagcccggagccugag

SEQ ID NO: 453451 - RNA, 22 nt, Human
guagucaaggcacagcuggggc

SEQ ID NO: 453452 - RNA, 21 nt, Human
uagcgcccccaggcccgccag

SEQ ID NO: 453453 - RNA, 22 nt, Human
uagcgcccccaggcccgccagg

SEQ ID NO: 453454 - RNA, 24 nt, Human
uccgcccauauucaagauggcugc

SEQ ID NO: 453455 - RNA, 19 nt, Human
ugacccgggccugccgccu

SEQ ID NO: 453456 - RNA, 23 nt, Human
ugaggacaagauguuacguaguc

SEQ ID NO: 453457 - RNA, 26 nt, Human
uggaaggcagaggcagguaccccugg

SEQ ID NO: 453458 - RNA, 22 nt, Human
uggcugcccagggcagugggaa

SEQ ID NO: 453459 - RNA, 21 nt, Human
uuacguagucaaggcacagcu

SEQ ID NO: 453460 - RNA, 19 nt, Human
aaagcuaugaaacguaagg

SEQ ID NO: 453461 - RNA, 18 nt, Human
aaggugacaaaaggaagg

SEQ ID NO: 453462 - RNA, 20 nt, Human
acugguaauuaauacacuaa

SEQ ID NO: 453463 - RNA, 23 nt, Human
agucaauaaaaagcaguucuacc

SEQ ID NO: 453464 - RNA, 18 nt, Human
auaaaaagcaguucuacc

SEQ ID NO: 453465 - RNA, 25 nt, Human
caauccacugguaauuaauacacua

SEQ ID NO: 453466 - RNA, 22 nt, Human
cacccaccucaggcaacaaagc

SEQ ID NO: 453467 - RNA, 24 nt, Human
caccgccacccaccucaggcaaca

SEQ ID NO: 453468 - RNA, 18 nt, Human
caccucaggcaacaaagc

SEQ ID NO: 453469 - RNA, 20 nt, Human
gagaaaauagacauuuauac

SEQ ID NO: 453470 - RNA, 18 nt, Human
gugcauuucaaggaaagc

SEQ ID NO: 453471 - RNA, 23 nt, Human
uaaaaagcaguucuaccaaucca

SEQ ID NO: 453472 - RNA, 23 nt, Human
uaacuuccaccgccacccaccuc

SEQ ID NO: 453473 - RNA, 24 nt, Human
uacccuaagggcuaacuggcgaag

SEQ ID NO: 453474 - RNA, 19 nt, Human
uagccccugacucccuuaa

SEQ ID NO: 453475 - RNA, 22 nt, Human
uauuuagagaaaauagacauuu

SEQ ID NO: 453476 - RNA, 26 nt, Human
ucccuuaacuuccaccgccacccacc

SEQ ID NO: 453477 - RNA, 20 nt, Human
ugaguauacuaaagcuauga

SEQ ID NO: 453478 - RNA, 18 nt, Human
ugcuuguaauaagaauaa

SEQ ID NO: 453479 - RNA, 21 nt, Human
uggaaagcauuuuacugaaag

SEQ ID NO: 453480 - RNA, 18 nt, Human
uuuccugaguauacuaaa

SEQ ID NO: 453481 - RNA, 23 nt, Human
aaaaaaaggcaaguuacaauaua

SEQ ID NO: 453482 - RNA, 25 nt, Human
aagugguuauaccuaacaaagaacu

SEQ ID NO: 453483 - RNA, 20 nt, Human
acguuuguuuuccccacaaa

SEQ ID NO: 453484 - RNA, 24 nt, Human
acuguguguguaguaaaugugugu

SEQ ID NO: 453485 - RNA, 18 nt, Human
agacaagaauucaaucua

SEQ ID NO: 453486 - RNA, 21 nt, Human
agauauauaauuguucacagu

SEQ ID NO: 453487 - RNA, 24 nt, Human
agccaagaggucaccggccccucc

SEQ ID NO: 453488 - RNA, 20 nt, Human
aggcaaguuacaauauagga

SEQ ID NO: 453489 - RNA, 21 nt, Human
caacccgggaggacucgccga

SEQ ID NO: 453490 - RNA, 19 nt, Human
caagaggucaccggccccu

SEQ ID NO: 453491 - RNA, 22 nt, Human
cacaggaaucuuuacauccaaa

SEQ ID NO: 453492 - RNA, 21 nt, Human
ccacgcgggcgcccgcccucc

SEQ ID NO: 453493 - RNA, 27 nt, Human
ccggcggcagcgaguggagcgcuccuu

SEQ ID NO: 453494 - RNA, 18 nt, Human
cggcggcagcgaguggag

SEQ ID NO: 453495 - RNA, 18 nt, Human
cuaaaaaaucucuagaua

SEQ ID NO: 453496 - RNA, 18 nt, Human
gugaaauaugcuagaucc

SEQ ID NO: 453497 - RNA, 19 nt, Human
uaaaugcucuuagguuuga

SEQ ID NO: 453498 - RNA, 19 nt, Human
uaacaaagaacuaguuauc

SEQ ID NO: 453499 - RNA, 25 nt, Human
uaacuuuuuuaaaaaaaggcaaguu

SEQ ID NO: 453500 - RNA, 20 nt, Human
uaagccuccgacgcggggua

SEQ ID NO: 453501 - RNA, 19 nt, Human
uaccuaacaaagaacuagu

SEQ ID NO: 453502 - RNA, 18 nt, Human
uaggaauuuuagagaauu

SEQ ID NO: 453503 - RNA, 18 nt, Human
uaggugguuuucucacau

SEQ ID NO: 453504 - RNA, 18 nt, Human
uccacagaauagugaaau

SEQ ID NO: 453505 - RNA, 22 nt, Human
ucccucugacgcccgcgggggc

SEQ ID NO: 453506 - RNA, 18 nt, Human
ucgccgucaccacgcggg

SEQ ID NO: 453507 - RNA, 24 nt, Human
ucuaacuuuuuuaaaaaaaggcaa

SEQ ID NO: 453508 - RNA, 19 nt, Human
ugaaacaacuaucaguguc

SEQ ID NO: 453509 - RNA, 20 nt, Human
ugagaaaagaugaagcagau

SEQ ID NO: 453510 - RNA, 22 nt, Human
ugccagacaggaaaaagcaguc

SEQ ID NO: 453511 - RNA, 22 nt, Human
ugcuagauccuaguacaagaca

SEQ ID NO: 453512 - RNA, 22 nt, Human
uguguguguaguaaaugugugu

SEQ ID NO: 453513 - RNA, 22 nt, Human
uguguguguaguaaaugugugu

SEQ ID NO: 453514 - RNA, 22 nt, Human
uuagagaauugaugcauuugag

SEQ ID NO: 453515 - RNA, 24 nt, Human
uucacagugguaaauuauaggugg

SEQ ID NO: 453516 - RNA, 20 nt, Human
uuguguauuguguaaaugcu

SEQ ID NO: 453517 - RNA, 26 nt, Human
aaaauucccuaaagcacacaucgguu

SEQ ID NO: 453518 - RNA, 23 nt, Human
agagaaguuggccgcggcccggg

SEQ ID NO: 453519 - RNA, 23 nt, Human
agagagggguggaagugucuggg

SEQ ID NO: 453520 - RNA, 19 nt, Human
agccuccucgcugccagag

SEQ ID NO: 453521 - RNA, 23 nt, Human
aggcgggggugacguggccagag

SEQ ID NO: 453522 - RNA, 20 nt, Human
agguggugggggugcccaag

SEQ ID NO: 453523 - RNA, 25 nt, Human
aucauuuuccuuuuuagcccuuuua

SEQ ID NO: 453524 - RNA, 21 nt, Human
caaaagacagugcacaaccac

SEQ ID NO: 453525 - RNA, 24 nt, Human
caaccacagcuaacaggugguggg

SEQ ID NO: 453526 - RNA, 26 nt, Human
caacugacuuaaagucucugaaaugc

SEQ ID NO: 453527 - RNA, 19 nt, Human
cagggcugcagaacaagca

SEQ ID NO: 453528 - RNA, 22 nt, Human
cagugcacaaccacagcuaaca

SEQ ID NO: 453529 - RNA, 21 nt, Human
cauccaacauacagauauucc

SEQ ID NO: 453530 - RNA, 19 nt, Human
cauuucugauaaauguuuc

SEQ ID NO: 453531 - RNA, 19 nt, Human
ccaagcagcuaauaaaaac

SEQ ID NO: 453532 - RNA, 20 nt, Human
ccaguccagagaaguuggcc

SEQ ID NO: 453533 - RNA, 25 nt, Human
cccaucuaccccuccaguccagagc

SEQ ID NO: 453534 - RNA, 22 nt, Human
ccccaucuaccccuccagucca

SEQ ID NO: 453535 - RNA, 22 nt, Human
ccccuccaguccagagcuacaa

SEQ ID NO: 453536 - RNA, 19 nt, Human
cccgggguuggaugcggag

SEQ ID NO: 453537 - RNA, 18 nt, Human
ccgccgccgugggccccu

SEQ ID NO: 453538 - RNA, 21 nt, Human
ccuauggcuccuggcacauuu

SEQ ID NO: 453539 - RNA, 23 nt, Human
ccuggcacauuuuacucucucua

SEQ ID NO: 453540 - RNA, 21 nt, Human
ccuuuaugaauuaaaggcggg

SEQ ID NO: 453541 - RNA, 24 nt, Human
ccuuuaugaauuaaaggcgggggu

SEQ ID NO: 453542 - RNA, 20 nt, Human
cgccgugggccccucuccgc

SEQ ID NO: 453543 - RNA, 25 nt, Human
cggcccgggguuggaugcggagcuc

SEQ ID NO: 453544 - RNA, 19 nt, Human
cgggaagccggcgccgggc

SEQ ID NO: 453545 - RNA, 21 nt, Human
cguguccgggaagccggcgcc

SEQ ID NO: 453546 - RNA, 19 nt, Human
cuccccaucuaccccucca

SEQ ID NO: 453547 - RNA, 19 nt, Human
cucuccgccgccgacgugu

SEQ ID NO: 453548 - RNA, 20 nt, Human
gacuccccaucuaccccucc

SEQ ID NO: 453549 - RNA, 22 nt, Human
gaggggaaggaggagauaaagg

SEQ ID NO: 453550 - RNA, 25 nt, Human
gaggggaaggaggagauaaagggag

SEQ ID NO: 453551 - RNA, 20 nt, Human
gcgcgggugcggggcgcugg

SEQ ID NO: 453552 - RNA, 23 nt, Human
gcgggggugacguggccagagag

SEQ ID NO: 453553 - RNA, 19 nt, Human
gcugcagaacaagcaacgg

SEQ ID NO: 453554 - RNA, 20 nt, Human
gcuggggcgcgggugcgggg

SEQ ID NO: 453555 - RNA, 23 nt, Human
ggcccgggguuggaugcggagcu

SEQ ID NO: 453556 - RNA, 24 nt, Human
ggcgcgggugcggggcgcuggcuc

SEQ ID NO: 453557 - RNA, 20 nt, Human
ggcugcagaacaagcaacgg

SEQ ID NO: 453558 - RNA, 19 nt, Human
guccagagaaguuggccgc

SEQ ID NO: 453559 - RNA, 22 nt, Human
gugggccccucuccgccgccga

SEQ ID NO: 453560 - RNA, 20 nt, Human
guguccgggaagccggcgcc

SEQ ID NO: 453561 - RNA, 20 nt, Human
uaaaauucccuaaagcacac

SEQ ID NO: 453562 - RNA, 23 nt, Human
uaacagguggugggggugcccaa

SEQ ID NO: 453563 - RNA, 24 nt, Human
uaacagguggugggggugcccaag

SEQ ID NO: 453564 - RNA, 18 nt, Human
uccccaucuaccccucca

SEQ ID NO: 453565 - RNA, 21 nt, Human
uccuuuuuagcccuuuuauua

SEQ ID NO: 453566 - RNA, 21 nt, Human
ucuaccccuccaguccagagc

SEQ ID NO: 453567 - RNA, 19 nt, Human
ucucaaacaacaagcaacu

SEQ ID NO: 453568 - RNA, 24 nt, Human
ucuuuauuuguacagaguaagaau

SEQ ID NO: 453569 - RNA, 21 nt, Human
ugaaaugcaugcaacuuaaaa

SEQ ID NO: 453570 - RNA, 18 nt, Human
ugaagaaaaucaucucau

SEQ ID NO: 453571 - RNA, 19 nt, Human
ugacuccccaucuaccccu

SEQ ID NO: 453572 - RNA, 21 nt, Human
ugacuccccaucuaccccucc

SEQ ID NO: 453573 - RNA, 19 nt, Human
uucucaaacaacaagcaac

SEQ ID NO: 453574 - RNA, 18 nt, Human
uuuuuuuuuuuuuuuuug

SEQ ID NO: 453575 - RNA, 20 nt, Human
aaacagaaguccaagaaggc

SEQ ID NO: 453576 - RNA, 18 nt, Human
acaaaacaaaacagaagu

SEQ ID NO: 453577 - RNA, 18 nt, Human
accccgaaagcugaggga

SEQ ID NO: 453578 - RNA, 22 nt, Human
accccgaaagcugagggacgga

SEQ ID NO: 453579 - RNA, 18 nt, Human
caaaacaaaacagaaguc

SEQ ID NO: 453580 - RNA, 22 nt, Human
caaaacaaaacagaaguccaag

SEQ ID NO: 453581 - RNA, 21 nt, Human
caagaaggcuaaagucuaagc

SEQ ID NO: 453582 - RNA, 21 nt, Human
caaguuaguaacaggcuucca

SEQ ID NO: 453583 - RNA, 22 nt, Human
cccaggcccgggcccgccccuu

SEQ ID NO: 453584 - RNA, 18 nt, Human
cccgcuccccacggccga

SEQ ID NO: 453585 - RNA, 22 nt, Human
cccgcuccccacggccgaccca

SEQ ID NO: 453586 - RNA, 21 nt, Human
ccuucugcugccgaaccccga

SEQ ID NO: 453587 - RNA, 21 nt, Human
cgccccgcuccccacggccga

SEQ ID NO: 453588 - RNA, 25 nt, Human
cgccccgcuccccacggccgaccca

SEQ ID NO: 453589 - RNA, 23 nt, Human
cuccccacggccgacccaucgcg

SEQ ID NO: 453590 - RNA, 21 nt, Human
gcauuucaaaaagaggguaau

SEQ ID NO: 453591 - RNA, 22 nt, Human
gcccugaagcgcuucccgcccc

SEQ ID NO: 453592 - RNA, 21 nt, Human
ggcccgggcccgccccuucug

SEQ ID NO: 453593 - RNA, 21 nt, Human
ggggucggacgacgccagcca

SEQ ID NO: 453594 - RNA, 21 nt, Human
uaaacugcaaauaacaaaaca

SEQ ID NO: 453595 - RNA, 22 nt, Human
uaaacugcaaauaacaaaacaa

SEQ ID NO: 453596 - RNA, 23 nt, Human
uacaaaaaugugacaagauaucc

SEQ ID NO: 453597 - RNA, 18 nt, Human
ucaaguauaaaaucaaag

SEQ ID NO: 453598 - RNA, 20 nt, Human
ucccaggcccgggcccgccc

SEQ ID NO: 453599 - RNA, 24 nt, Human
ucccgccccgcuccccacggccga

SEQ ID NO: 453600 - RNA, 22 nt, Human
ucucagauuauauccaguuuca

SEQ ID NO: 453601 - RNA, 21 nt, Human
ucugaaaacugaaaacaacuu

SEQ ID NO: 453602 - RNA, 25 nt, Human
ucuuccauuccuuugccaguuuuuc

SEQ ID NO: 453603 - RNA, 18 nt, Human
ugacaagauauccagaug

SEQ ID NO: 453604 - RNA, 19 nt, Human
ugcugccgaaccccgaaag

SEQ ID NO: 453605 - RNA, 24 nt, Human
ugguaagaagcagcuuguagauau

SEQ ID NO: 453606 - RNA, 21 nt, Human
ugguagguuucugauaagccu

SEQ ID NO: 453607 - RNA, 23 nt, Human
uuggcaauauugguaacuccaua

SEQ ID NO: 453608 - RNA, 22 nt, Human
aaaagaacagacugucugaaca

SEQ ID NO: 453609 - RNA, 19 nt, Human
aaacaaaccacaccacauc

SEQ ID NO: 453610 - RNA, 20 nt, Human
aaacaaagccaugccugaca

SEQ ID NO: 453611 - RNA, 27 nt, Human
aaacaagauuccucucuaaaacguaga

SEQ ID NO: 453612 - RNA, 19 nt, Human
aaacagcuccccacgaagg

SEQ ID NO: 453613 - RNA, 18 nt, Human
aacaaaaaaaccccaccc

SEQ ID NO: 453614 - RNA, 19 nt, Human
aacaaaaaaaccccacccc

SEQ ID NO: 453615 - RNA, 24 nt, Human
aacaaacaaaaaaaccccaccccg

SEQ ID NO: 453616 - RNA, 21 nt, Human
aacagcuccccacgaaggccg

SEQ ID NO: 453617 - RNA, 23 nt, Human
aaccacaccacaucauacagaua

SEQ ID NO: 453618 - RNA, 18 nt, Human
aagcagcagauacugaau

SEQ ID NO: 453619 - RNA, 23 nt, Human
aaggugacccgggggaggagucu

SEQ ID NO: 453620 - RNA, 24 nt, Human
aaucgcuugaaccugggaggugga

SEQ ID NO: 453621 - RNA, 23 nt, Human
aaucugaucauuuccaugaccaa

SEQ ID NO: 453622 - RNA, 19 nt, Human
aauggacacuuuuaaaggg

SEQ ID NO: 453623 - RNA, 18 nt, Human
aauuagccaggcauggug

SEQ ID NO: 453624 - RNA, 18 nt, Human
acacaaaaacaagauucc

SEQ ID NO: 453625 - RNA, 19 nt, Human
acagagacuccaucucaaa

SEQ ID NO: 453626 - RNA, 21 nt, Human
acagagcucuaauuuaaaaac

SEQ ID NO: 453627 - RNA, 21 nt, Human
acagccuuggacaacagaaga

SEQ ID NO: 453628 - RNA, 24 nt, Human
acagcguuuaaugcagacccaaag

SEQ ID NO: 453629 - RNA, 18 nt, Human
accccucccgacuagguc

SEQ ID NO: 453630 - RNA, 19 nt, Human
acccuguacucacacacga

SEQ ID NO: 453631 - RNA, 25 nt, Human
acuaucucccuacacagaguuacac

SEQ ID NO: 453632 - RNA, 19 nt, Human
acucacacacgaugcccac

SEQ ID NO: 453633 - RNA, 21 nt, Human
acucuauuaaaaauacaaaaa

SEQ ID NO: 453634 - RNA, 18 nt, Human
acugcacugcagccuggg

SEQ ID NO: 453635 - RNA, 24 nt, Human
acugcacugcagccugggcaacag

SEQ ID NO: 453636 - RNA, 24 nt, Human
acugcacugcagccugggcaacag

SEQ ID NO: 453637 - RNA, 22 nt, Human
agaaucgcuugaaccugggagg

SEQ ID NO: 453638 - RNA, 24 nt, Human
agauacugaauagaauuugcuuca

SEQ ID NO: 453639 - RNA, 24 nt, Human
agcacuuuggggggccgaggcggg

SEQ ID NO: 453640 - RNA, 23 nt, Human
agccaggcauggugccacaugcc

SEQ ID NO: 453641 - RNA, 21 nt, Human
agccugaccaucauggugaaa

SEQ ID NO: 453642 - RNA, 18 nt, Human
agccuuuaauuccgagca

SEQ ID NO: 453643 - RNA, 22 nt, Human
agcugacugccuagaaaaccua

SEQ ID NO: 453644 - RNA, 20 nt, Human
agcugcaugccucgcacccc

SEQ ID NO: 453645 - RNA, 26 nt, Human
aggaagccuuuaauuccgagcagguu

SEQ ID NO: 453646 - RNA, 22 nt, Human
aggcaggagaaucgcuugaacc

SEQ ID NO: 453647 - RNA, 24 nt, Human
aggcaggagaaucgcuugaaccug

SEQ ID NO: 453648 - RNA, 24 nt, Human
aggcgggcggaucacgaggucagg

SEQ ID NO: 453649 - RNA, 19 nt, Human
agguauuuaaggcuacucc

SEQ ID NO: 453650 - RNA, 20 nt, Human
agguggagguugcagugagc

SEQ ID NO: 453651 - RNA, 24 nt, Human
agguggagguugcagugagcugag

SEQ ID NO: 453652 - RNA, 20 nt, Human
aguucuagauucugaaagac

SEQ ID NO: 453653 - RNA, 23 nt, Human
auagaauuugcuucaaucauaaa

SEQ ID NO: 453654 - RNA, 23 nt, Human
augaaacagaacauguacugcuu

SEQ ID NO: 453655 - RNA, 24 nt, Human
auggcucuuucaggcaacagagaa

SEQ ID NO: 453656 - RNA, 19 nt, Human
auuuuguaccggauccuca

SEQ ID NO: 453657 - RNA, 24 nt, Human
caaaaaaaccccaccccguuaagc

SEQ ID NO: 453658 - RNA, 22 nt, Human
caaaagaagucugaauuggaug

SEQ ID NO: 453659 - RNA, 20 nt, Human
caaaagcagcagauacugaa

SEQ ID NO: 453660 - RNA, 26 nt, Human
caaaccaaacaaaccacaccacauca

SEQ ID NO: 453661 - RNA, 18 nt, Human
caacaucaaaagcagcag

SEQ ID NO: 453662 - RNA, 22 nt, Human
caacaucaaaagcagcagauac

SEQ ID NO: 453663 - RNA, 20 nt, Human
caauacaaugugacaagccc

SEQ ID NO: 453664 - RNA, 18 nt, Human
caaugugacaagcccagu

SEQ ID NO: 453665 - RNA, 25 nt, Human
cacacccguuaaucccagcacuuug

SEQ ID NO: 453666 - RNA, 23 nt, Human
caccacaugcccaugacaugagc

SEQ ID NO: 453667 - RNA, 21 nt, Human
caccccucccgacuaggucug

SEQ ID NO: 453668 - RNA, 23 nt, Human
cacggccuaaauaccgacugccc

SEQ ID NO: 453669 - RNA, 20 nt, Human
cacugcacugcagccugggc

SEQ ID NO: 453670 - RNA, 23 nt, Human
cacugcacugcagccugggcaac

SEQ ID NO: 453671 - RNA, 24 nt, Human
cacugcacugcagccugggcaaca

SEQ ID NO: 453672 - RNA, 22 nt, Human
cagacugucugaacaaacaaaa

SEQ ID NO: 453673 - RNA, 18 nt, Human
cagaucacaaaaauacaa

SEQ ID NO: 453674 - RNA, 23 nt, Human
cagaucacaaaaauacaauacaa

SEQ ID NO: 453675 - RNA, 22 nt, Human
cagcacuuuggggggccgaggc

SEQ ID NO: 453676 - RNA, 24 nt, Human
cagcacuuuggggggccgaggcgg

SEQ ID NO: 453677 - RNA, 23 nt, Human
cagcguuuaaugcagacccaaag

SEQ ID NO: 453678 - RNA, 25 nt, Human
caugaccaauuacccaugugaacaa

SEQ ID NO: 453679 - RNA, 19 nt, Human
ccaaacaaaccacaccaca

SEQ ID NO: 453680 - RNA, 21 nt, Human
ccacaccacaucauacagaua

SEQ ID NO: 453681 - RNA, 20 nt, Human
ccacugcacugcagccuggg

SEQ ID NO: 453682 - RNA, 20 nt, Human
ccacugcacugcagccuggg

SEQ ID NO: 453683 - RNA, 21 nt, Human
ccacugcacugcagccugggc

SEQ ID NO: 453684 - RNA, 22 nt, Human
ccacugcacugcagccugggca

SEQ ID NO: 453685 - RNA, 24 nt, Human
ccacugcacugcagccugggcaac

SEQ ID NO: 453686 - RNA, 22 nt, Human
ccagcugcaugccucgcacccc

SEQ ID NO: 453687 - RNA, 18 nt, Human
cccacauguucucaaggc

SEQ ID NO: 453688 - RNA, 25 nt, Human
cccccagcugcaugccucgcacccc

SEQ ID NO: 453689 - RNA, 22 nt, Human
ccccuuucucauaauuuuccua

SEQ ID NO: 453690 - RNA, 22 nt, Human
cccucugaccccaccguccagc

SEQ ID NO: 453691 - RNA, 22 nt, Human
ccuaaauaccgacugcccucug

SEQ ID NO: 453692 - RNA, 22 nt, Human
ccugacagucaaucaaggucaa

SEQ ID NO: 453693 - RNA, 19 nt, Human
ccugaccaucauggugaaa

SEQ ID NO: 453694 - RNA, 24 nt, Human
ccugaccaucauggugaaaucuca

SEQ ID NO: 453695 - RNA, 21 nt, Human
ccugggagguggagguugcag

SEQ ID NO: 453696 - RNA, 19 nt, Human
ccuguacucccagcuacuc

SEQ ID NO: 453697 - RNA, 22 nt, Human
ccuguacucccagcuacucagg

SEQ ID NO: 453698 - RNA, 25 nt, Human
ccuguacucccagcuacucaggugg

SEQ ID NO: 453699 - RNA, 22 nt, Human
ccuuuuuuuuuuuuaaaggccc

SEQ ID NO: 453700 - RNA, 23 nt, Human
cgcaccccucccgacuaggucug

SEQ ID NO: 453701 - RNA, 21 nt, Human
cgcuugaaccugggaggugga

SEQ ID NO: 453702 - RNA, 22 nt, Human
cggaucacgaggucaggaguuc

SEQ ID NO: 453703 - RNA, 24 nt, Human
cggaucacgaggucaggaguucga

SEQ ID NO: 453704 - RNA, 24 nt, Human
cggggugcggcaccggagcugggc

SEQ ID NO: 453705 - RNA, 25 nt, Human
cucacacccguuaaucccagcacuu

SEQ ID NO: 453706 - RNA, 21 nt, Human
cucauauuaacacaaacagcu

SEQ ID NO: 453707 - RNA, 25 nt, Human
cucgcaccccucccgacuaggucug

SEQ ID NO: 453708 - RNA, 25 nt, Human
cugaacaaacaaaaaaaccccaccc

SEQ ID NO: 453709 - RNA, 25 nt, Human
gaacauggacuacagcguuuaaugc

SEQ ID NO: 453710 - RNA, 19 nt, Human
gacaacagaagagaaccau

SEQ ID NO: 453711 - RNA, 18 nt, Human
gacugcccucugacccca

SEQ ID NO: 453712 - RNA, 23 nt, Human
gaggcgggcggaucacgagguca

SEQ ID NO: 453713 - RNA, 21 nt, Human
gagguugcagugagcugagau

SEQ ID NO: 453714 - RNA, 21 nt, Human
gaucacgaggucaggaguucg

SEQ ID NO: 453715 - RNA, 24 nt, Human
gaucacgaggucaggaguucgaga

SEQ ID NO: 453716 - RNA, 18 nt, Human
gcaacaucaaaagcagca

SEQ ID NO: 453717 - RNA, 23 nt, Human
gcaacaucaaaagcagcagauac

SEQ ID NO: 453718 - RNA, 21 nt, Human
gcaccggagcugggcccccag

SEQ ID NO: 453719 - RNA, 19 nt, Human
gccacaugccuguacuccc

SEQ ID NO: 453720 - RNA, 20 nt, Human
ggaaauacacauccuuuaga

SEQ ID NO: 453721 - RNA, 22 nt, Human
ggagguugcagugagcugagau

SEQ ID NO: 453722 - RNA, 23 nt, Human
ggagguugcagugagcugagaug

SEQ ID NO: 453723 - RNA, 24 nt, Human
ggagguugcagugagcugagaugg

SEQ ID NO: 453724 - RNA, 20 nt, Human
ggccgaggcgggcggaucac

SEQ ID NO: 453725 - RNA, 23 nt, Human
ggcggaucacgaggucaggaguu

SEQ ID NO: 453726 - RNA, 23 nt, Human
ggcugaggcaggagaaucgcuug

SEQ ID NO: 453727 - RNA, 23 nt, Human
gggccgaggcgggcggaucacga

SEQ ID NO: 453728 - RNA, 21 nt, Human
gggugcggcaccggagcuggg

SEQ ID NO: 453729 - RNA, 19 nt, Human
gguggagguugcagugagc

SEQ ID NO: 453730 - RNA, 19 nt, Human
gugcaaaacaguaucaaaa

SEQ ID NO: 453731 - RNA, 20 nt, Human
guggagguugcagugagcug

SEQ ID NO: 453732 - RNA, 18 nt, Human
guugcagugagcugagau

SEQ ID NO: 453733 - RNA, 26 nt, Human
uaaaaaauaaaaacucuuccucaaga

SEQ ID NO: 453734 - RNA, 22 nt, Human
uaaaaacgcaaaaaaaaggaca

SEQ ID NO: 453735 - RNA, 19 nt, Human
uaaaaacucuuccugggcu

SEQ ID NO: 453736 - RNA, 21 nt, Human
uaaaaacucuuccugggcugg

SEQ ID NO: 453737 - RNA, 21 nt, Human
uaaaaauacaaaaauuagcca

SEQ ID NO: 453738 - RNA, 19 nt, Human
uacaauacaaugugacaag

SEQ ID NO: 453739 - RNA, 19 nt, Human
uacccaugugaacaauuca

SEQ ID NO: 453740 - RNA, 23 nt, Human
uacccaugugaacaauucaaaau

SEQ ID NO: 453741 - RNA, 25 nt, Human
uagaaacaaagccaugccugacagu

SEQ ID NO: 453742 - RNA, 20 nt, Human
uauacauagaagcacauaug

SEQ ID NO: 453743 - RNA, 18 nt, Human
ucacgaggucaggaguuc

SEQ ID NO: 453744 - RNA, 24 nt, Human
ucacgaggucaggaguucgagacc

SEQ ID NO: 453745 - RNA, 23 nt, Human
ucacuaaggaaaacuauaagcuu

SEQ ID NO: 453746 - RNA, 19 nt, Human
ucagguggcugaggcagga

SEQ ID NO: 453747 - RNA, 18 nt, Human
ucccucuggguuacugac

SEQ ID NO: 453748 - RNA, 24 nt, Human
ucgcuugaaccugggagguggagg

SEQ ID NO: 453749 - RNA, 18 nt, Human
ugaaacagaacauguacu

SEQ ID NO: 453750 - RNA, 19 nt, Human
ugaaacuagaaacaaagcc

SEQ ID NO: 453751 - RNA, 19 nt, Human
ugaaacuagaaacaaagcc

SEQ ID NO: 453752 - RNA, 28 nt, Human
ugaaacuagaaacaaagccaugccugac

SEQ ID NO: 453753 - RNA, 21 nt, Human
ugaacaaacaaaaaaacccca

SEQ ID NO: 453754 - RNA, 22 nt, Human
ugaacaaacaaaaaaaccccac

SEQ ID NO: 453755 - RNA, 24 nt, Human
ugaaccugggagguggagguugca

SEQ ID NO: 453756 - RNA, 24 nt, Human
ugaggcaggagaaucgcuugaacc

SEQ ID NO: 453757 - RNA, 25 nt, Human
ugaggcaggagaaucgcuugaaccu

SEQ ID NO: 453758 - RNA, 20 nt, Human
ugcagccugggcaacagaga

SEQ ID NO: 453759 - RNA, 19 nt, Human
ugccaggaguuggaccugc

SEQ ID NO: 453760 - RNA, 20 nt, Human
ugccucgcaccccucccgac

SEQ ID NO: 453761 - RNA, 24 nt, Human
ugccuguacucccagcuacucagg

SEQ ID NO: 453762 - RNA, 23 nt, Human
uggcucacacccguuaaucccag

SEQ ID NO: 453763 - RNA, 25 nt, Human
uggcucacacccguuaaucccagca

SEQ ID NO: 453764 - RNA, 18 nt, Human
ugggagguggagguugca

SEQ ID NO: 453765 - RNA, 29 nt, Human
ugggagguggagguugcagugacaacggu

SEQ ID NO: 453766 - RNA, 24 nt, Human
ugggagguggagguugcagugagc

SEQ ID NO: 453767 - RNA, 19 nt, Human
ugggcccccagcugcaugc

SEQ ID NO: 453768 - RNA, 19 nt, Human
uggggggccgaggcgggcg

SEQ ID NO: 453769 - RNA, 24 nt, Human
uggggggccgaggcgggcggauca

SEQ ID NO: 453770 - RNA, 20 nt, Human
uguacucacacacgaugccc

SEQ ID NO: 453771 - RNA, 22 nt, Human
uguacucacacacgaugcccac

SEQ ID NO: 453772 - RNA, 23 nt, Human
uuaacacaaacagcuccccacga

SEQ ID NO: 453773 - RNA, 24 nt, Human
uuauaagugaaaaaaaagccuucu

SEQ ID NO: 453774 - RNA, 20 nt, Human
uucaaaaugacgguggaaga

SEQ ID NO: 453775 - RNA, 24 nt, Human
uugaaccugggagguggagguugc

SEQ ID NO: 453776 - RNA, 22 nt, Human
uugcagugagcugagauggcac

SEQ ID NO: 453777 - RNA, 21 nt, Human
uugccaggaguuggaccugca

SEQ ID NO: 453778 - RNA, 25 nt, Human
uuggggggccgaggcgggcggauca

SEQ ID NO: 453779 - RNA, 18 nt, Human
uugguccuggagcaggug

SEQ ID NO: 453780 - RNA, 18 nt, Human
uuuaaaggcccauuaacu

SEQ ID NO: 453781 - RNA, 21 nt, Human
uuuaagagcauucuaaaauua

SEQ ID NO: 453782 - RNA, 25 nt, Human
uuuaguuuuaguauaaccugacauu

SEQ ID NO: 453783 - RNA, 27 nt, Human
uuuauggaaauacacauccuuuagaag

SEQ ID NO: 453784 - RNA, 24 nt, Human
uuucacaagcaccaaaagaagucu

SEQ ID NO: 453785 - RNA, 20 nt, Human
uuugucuugcaacaucaaaa

SEQ ID NO: 453786 - RNA, 19 nt, Human
uuuguuuucugauuaaaaa

SEQ ID NO: 453787 - RNA, 26 nt, Human
uuuuuuuuuuaaaggcccauuaacuu

SEQ ID NO: 453788 - RNA, 19 nt, Human
aaaaugcacaucgcuguaa

SEQ ID NO: 453789 - RNA, 31 nt, Human
aagccgggaacagagcagcucagcgggagaa

SEQ ID NO: 453790 - RNA, 18 nt, Human
acacagugaaacuccauc

SEQ ID NO: 453791 - RNA, 19 nt, Human
acacagugaaacuccaucu

SEQ ID NO: 453792 - RNA, 20 nt, Human
acacagugaaacuccaucuc

SEQ ID NO: 453793 - RNA, 19 nt, Human
acagugaaacuccaucucc

SEQ ID NO: 453794 - RNA, 22 nt, Human
agauguugaauacugauugacu

SEQ ID NO: 453795 - RNA, 22 nt, Human
agccggcuccugcagcacaagg

SEQ ID NO: 453796 - RNA, 21 nt, Human
aggccaaggcgggcggaucac

SEQ ID NO: 453797 - RNA, 23 nt, Human
aggccaaggcgggcggaucacga

SEQ ID NO: 453798 - RNA, 24 nt, Human
aggcgggcggaucacgaggucagg

SEQ ID NO: 453799 - RNA, 20 nt, Human
aucacgaggucaggagaucc

SEQ ID NO: 453800 - RNA, 20 nt, Human
auguguucuggacaaagcag

SEQ ID NO: 453801 - RNA, 21 nt, Human
auuugauaguggcuccaaagu

SEQ ID NO: 453802 - RNA, 22 nt, Human
caaaaugcacaucgcuguaauc

SEQ ID NO: 453803 - RNA, 24 nt, Human
caaggcgggcggaucacgagguca

SEQ ID NO: 453804 - RNA, 20 nt, Human
caauguguucuggacaaagc

SEQ ID NO: 453805 - RNA, 24 nt, Human
cagccuccagcucccccuucuccu

SEQ ID NO: 453806 - RNA, 23 nt, Human
cccuccuaacacuccagcugcgc

SEQ ID NO: 453807 - RNA, 19 nt, Human
ccucuaagccgggaacaga

SEQ ID NO: 453808 - RNA, 24 nt, Human
ccuggcugacacagugaaacucca

SEQ ID NO: 453809 - RNA, 24 nt, Human
cgagaccauccuggcugacacagu

SEQ ID NO: 453810 - RNA, 19 nt, Human
cgcuguaaucucggcacuu

SEQ ID NO: 453811 - RNA, 24 nt, Human
cggcacuuuggaaggccaaggcgg

SEQ ID NO: 453812 - RNA, 28 nt, Human
cuccagccccacuccuaccgcucaggcc

SEQ ID NO: 453813 - RNA, 18 nt, Human
cuccccaacaaucucugg

SEQ ID NO: 453814 - RNA, 19 nt, Human
cucccccuucuccuggucc

SEQ ID NO: 453815 - RNA, 21 nt, Human
cuccuaacacuccagcugcgc

SEQ ID NO: 453816 - RNA, 22 nt, Human
cuccuaacacuccagcugcgcu

SEQ ID NO: 453817 - RNA, 23 nt, Human
cuggcugacacagugaaacucca

SEQ ID NO: 453818 - RNA, 19 nt, Human
cuguaaucucggcacuuug

SEQ ID NO: 453819 - RNA, 18 nt, Human
gcccuccuaacacuccag

SEQ ID NO: 453820 - RNA, 20 nt, Human
gcuccugcagcacaaggauu

SEQ ID NO: 453821 - RNA, 21 nt, Human
ggcggaucacgaggucaggag

SEQ ID NO: 453822 - RNA, 20 nt, Human
uaagaauaaaaaacaugcaa

SEQ ID NO: 453823 - RNA, 22 nt, Human
uaagccgggaacagagcagcuc

SEQ ID NO: 453824 - RNA, 19 nt, Human
uaauacaaguagaauaaca

SEQ ID NO: 453825 - RNA, 20 nt, Human
uaccgcucaggccgcccucc

SEQ ID NO: 453826 - RNA, 20 nt, Human
uacugcacagucccuauuua

SEQ ID NO: 453827 - RNA, 22 nt, Human
uagaauaacacucagggaauuu

SEQ ID NO: 453828 - RNA, 18 nt, Human
ucacgaggucaggagauc

SEQ ID NO: 453829 - RNA, 24 nt, Human
ucacgaggucaggagaucgagacc

SEQ ID NO: 453830 - RNA, 24 nt, Human
uccagcucccccuucuccuggucc

SEQ ID NO: 453831 - RNA, 21 nt, Human
uccccaacaaucucuggcaau

SEQ ID NO: 453832 - RNA, 18 nt, Human
ucccccuucuccuggucc

SEQ ID NO: 453833 - RNA, 24 nt, Human
uccuaccgcucaggccgcccuccu

SEQ ID NO: 453834 - RNA, 22 nt, Human
ugaaaccguugauaacauuucc

SEQ ID NO: 453835 - RNA, 24 nt, Human
ugaaaggagccggcuccugcagca

SEQ ID NO: 453836 - RNA, 22 nt, Human
ugacacagugaaacuccaucuc

SEQ ID NO: 453837 - RNA, 24 nt, Human
ugacacagugaaacuccaucuccu

SEQ ID NO: 453838 - RNA, 22 nt, Human
ugcagcacaaggauaaugauac

SEQ ID NO: 453839 - RNA, 20 nt, Human
ugcuccagccccacuccuac

SEQ ID NO: 453840 - RNA, 24 nt, Human
uggaaggccaaggcgggcggauca

SEQ ID NO: 453841 - RNA, 20 nt, Human
uggacaaagcaggaagaugu

SEQ ID NO: 453842 - RNA, 18 nt, Human
uggcaaugaucccucaga

SEQ ID NO: 453843 - RNA, 22 nt, Human
uguugccaccaccauccagagu

SEQ ID NO: 453844 - RNA, 19 nt, Human
uuucugaggaaauaacuuu

SEQ ID NO: 453845 - RNA, 21 nt, Human
aaacaggagagagaaacuugg

SEQ ID NO: 453846 - RNA, 21 nt, Human
aaacgagagacaggugccccc

SEQ ID NO: 453847 - RNA, 21 nt, Human
aaagacaccaaguaaccaaaa

SEQ ID NO: 453848 - RNA, 20 nt, Human
aacacaaaucucaaauaaau

SEQ ID NO: 453849 - RNA, 22 nt, Human
aacaccucuccccaaaucacaa

SEQ ID NO: 453850 - RNA, 18 nt, Human
aaccugcuuuccugcuuc

SEQ ID NO: 453851 - RNA, 25 nt, Human
aagcaaaaggaugaaauguguagag

SEQ ID NO: 453852 - RNA, 19 nt, Human
acaaaacaggagagagaaa

SEQ ID NO: 453853 - RNA, 18 nt, Human
acaauauuuugccaucag

SEQ ID NO: 453854 - RNA, 18 nt, Human
accaaguaaccaaaaagg

SEQ ID NO: 453855 - RNA, 24 nt, Human
agacacuggugaauaggggaaaca

SEQ ID NO: 453856 - RNA, 18 nt, Human
agcaaagcccccaaaucu

SEQ ID NO: 453857 - RNA, 25 nt, Human
agcaaagcccccaaaucucucaaaa

SEQ ID NO: 453858 - RNA, 18 nt, Human
aggcaaauaaucacaugg

SEQ ID NO: 453859 - RNA, 24 nt, Human
aucauauacaauauuuugccauca

SEQ ID NO: 453860 - RNA, 18 nt, Human
caaagcccccaaaucucu

SEQ ID NO: 453861 - RNA, 18 nt, Human
caagccuccgcuuguuca

SEQ ID NO: 453862 - RNA, 18 nt, Human
caccaaguaaccaaaaag

SEQ ID NO: 453863 - RNA, 18 nt, Human
caccccuccuccaaaaaa

SEQ ID NO: 453864 - RNA, 19 nt, Human
caccccuccuccaaaaaaa

SEQ ID NO: 453865 - RNA, 21 nt, Human
cagaacaagcgaggcaaauaa

SEQ ID NO: 453866 - RNA, 19 nt, Human
cagcacgagcccccaagcc

SEQ ID NO: 453867 - RNA, 24 nt, Human
caguacaaacaaacauuccuucgc

SEQ ID NO: 453868 - RNA, 23 nt, Human
ccaaaaaaauaaaacgagagaca

SEQ ID NO: 453869 - RNA, 21 nt, Human
ccaguccacguaagcaagcaa

SEQ ID NO: 453870 - RNA, 27 nt, Human
cccacagcacgagcccccaaggcccuc

SEQ ID NO: 453871 - RNA, 22 nt, Human
ccccccacagcacgagccccca

SEQ ID NO: 453872 - RNA, 20 nt, Human
cucugauuaucagaaagggg

SEQ ID NO: 453873 - RNA, 22 nt, Human
gacaccaaguaaccaaaaagga

SEQ ID NO: 453874 - RNA, 20 nt, Human
gagcccccaagccuccgcuu

SEQ ID NO: 453875 - RNA, 20 nt, Human
gaggaacaguuuggcacagu

SEQ ID NO: 453876 - RNA, 20 nt, Human
gaugagcacugggaauuuau

SEQ ID NO: 453877 - RNA, 24 nt, Human
gcaaagcccccaaaucucucaaaa

SEQ ID NO: 453878 - RNA, 27 nt, Human
gccucaacauaucacucaggaaaccug

SEQ ID NO: 453879 - RNA, 20 nt, Human
gcucagauggucugauuugg

SEQ ID NO: 453880 - RNA, 20 nt, Human
ggugaauaggggaaacaaaa

SEQ ID NO: 453881 - RNA, 24 nt, Human
ggugaauaggggaaacaaaaaaga

SEQ ID NO: 453882 - RNA, 21 nt, Human
uaaauaaagacaccaaguaac

SEQ ID NO: 453883 - RNA, 22 nt, Human
uaaccaaaaaggaaaaaauaau

SEQ ID NO: 453884 - RNA, 22 nt, Human
uacaauauuuugccaucagaac

SEQ ID NO: 453885 - RNA, 20 nt, Human
uaggaaagguauagucacau

SEQ ID NO: 453886 - RNA, 19 nt, Human
uauacaauauuuugccauc

SEQ ID NO: 453887 - RNA, 20 nt, Human
ucgcuccccugcacacgcuc

SEQ ID NO: 453888 - RNA, 23 nt, Human
ugacaaaggaacucuauguauaa

SEQ ID NO: 453889 - RNA, 21 nt, Human
ugccucuuaaauaaagacacc

SEQ ID NO: 453890 - RNA, 22 nt, Human
ugcuucuuaaaaggaguauaua

SEQ ID NO: 453891 - RNA, 25 nt, Human
uggcacaguacaaacaaacauuccu

SEQ ID NO: 453892 - RNA, 21 nt, Human
ugggagaaacaccucucccca

SEQ ID NO: 453893 - RNA, 18 nt, Human
uguaaagaucauugcugu

SEQ ID NO: 453894 - RNA, 22 nt, Human
uugggggauggagaaguguugu

SEQ ID NO: 453895 - RNA, 20 nt, Human
uuuccugcugccguucugga

SEQ ID NO: 453896 - RNA, 19 nt, Human
aaaggagauuaaagaacac

SEQ ID NO: 453897 - RNA, 22 nt, Human
aaccccaagacauaaagacaga

SEQ ID NO: 453898 - RNA, 20 nt, Human
aagaggaaggaagguccuga

SEQ ID NO: 453899 - RNA, 21 nt, Human
agcucuaaguccucgggcggc

SEQ ID NO: 453900 - RNA, 25 nt, Human
aggaaggaagguccugaaaguguuu

SEQ ID NO: 453901 - RNA, 20 nt, Human
caagacauaaagacagauaa

SEQ ID NO: 453902 - RNA, 24 nt, Human
cacccaagguaaggccauaccagc

SEQ ID NO: 453903 - RNA, 18 nt, Human
ccagagcucuaaguccuc

SEQ ID NO: 453904 - RNA, 21 nt, Human
cccaaccccaagacauaaaga

SEQ ID NO: 453905 - RNA, 20 nt, Human
ccccaagacauaaagacaga

SEQ ID NO: 453906 - RNA, 20 nt, Human
cccgcuccucgugcgggugu

SEQ ID NO: 453907 - RNA, 21 nt, Human
cgcccgccguccccgcuccuc

SEQ ID NO: 453908 - RNA, 19 nt, Human
cgggcggcggggagugcac

SEQ ID NO: 453909 - RNA, 22 nt, Human
cuaguauguggcuaguccuuuc

SEQ ID NO: 453910 - RNA, 18 nt, Human
gcggcggggagugcacgg

SEQ ID NO: 453911 - RNA, 19 nt, Human
ggaaggaagguccugaaag

SEQ ID NO: 453912 - RNA, 22 nt, Human
gggcggcggggagugcacgguc

SEQ ID NO: 453913 - RNA, 21 nt, Human
uaaagaacaacugcaagagga

SEQ ID NO: 453914 - RNA, 18 nt, Human
ucaagccacucuuugagc

SEQ ID NO: 453915 - RNA, 23 nt, Human
ucaguccauacagauaacccaug

SEQ ID NO: 453916 - RNA, 22 nt, Human
uccauacagauaacccauggga

SEQ ID NO: 453917 - RNA, 23 nt, Human
uggaaaaucuaaaaucauucugu

SEQ ID NO: 453918 - RNA, 19 nt, Human
ugggauauauucaagccac

SEQ ID NO: 453919 - RNA, 23 nt, Human
uguuuauucccuuuugcgcuuca

SEQ ID NO: 453920 - RNA, 19 nt, Human
uuaaagaacaacugcaaga

SEQ ID NO: 453921 - RNA, 23 nt, Human
aaacaugauguaacaauaaugac

SEQ ID NO: 453922 - RNA, 22 nt, Human
aaacauucaauuuauuuguggc

SEQ ID NO: 453923 - RNA, 23 nt, Human
aaauaagacaagguuucugcaaa

SEQ ID NO: 453924 - RNA, 18 nt, Human
aagcaaaaccagcaagca

SEQ ID NO: 453925 - RNA, 19 nt, Human
aagcaaaaccagcaagcaa

SEQ ID NO: 453926 - RNA, 21 nt, Human
aagguuucugcaaacaugaug

SEQ ID NO: 453927 - RNA, 24 nt, Human
acucaucagaugcaagcaaaacca

SEQ ID NO: 453928 - RNA, 19 nt, Human
aggaagaccacggaacuug

SEQ ID NO: 453929 - RNA, 21 nt, Human
auccauagacauuuucccauu

SEQ ID NO: 453930 - RNA, 23 nt, Human
auuuugccaauaacaaauucuga

SEQ ID NO: 453931 - RNA, 18 nt, Human
cacuaaauaagacaaggu

SEQ ID NO: 453932 - RNA, 22 nt, Human
cagaccccauaacuuugcuaca

SEQ ID NO: 453933 - RNA, 19 nt, Human
caggguuauaugcaaauag

SEQ ID NO: 453934 - RNA, 25 nt, Human
cauuuucuucuucuggccuuuuccc

SEQ ID NO: 453935 - RNA, 20 nt, Human
ccaaauucaggcuugcuuca

SEQ ID NO: 453936 - RNA, 20 nt, Human
ccagagcuucauccauagac

SEQ ID NO: 453937 - RNA, 20 nt, Human
ccagcuacuuaaaaagcaaa

SEQ ID NO: 453938 - RNA, 23 nt, Human
ccaucugccaguguuuaaauuuc

SEQ ID NO: 453939 - RNA, 22 nt, Human
cuacucaucagaugcaagcaaa

SEQ ID NO: 453940 - RNA, 23 nt, Human
cugcugaaucauuuccaggccac

SEQ ID NO: 453941 - RNA, 18 nt, Human
gaacuugucaucaucaga

SEQ ID NO: 453942 - RNA, 19 nt, Human
ggcaauccaaauucaggcu

SEQ ID NO: 453943 - RNA, 19 nt, Human
gugggucgggguguggggg

SEQ ID NO: 453944 - RNA, 23 nt, Human
ucaucagauugucuucuggcugu

SEQ ID NO: 453945 - RNA, 22 nt, Human
ucauccauagacauuuucccau

SEQ ID NO: 453946 - RNA, 23 nt, Human
uccaaaacaaagaauaggcugaa

SEQ ID NO: 453947 - RNA, 21 nt, Human
ucuccugcaggaggaugaagu

SEQ ID NO: 453948 - RNA, 23 nt, Human
ucuccugcugaaucauuuccagg

SEQ ID NO: 453949 - RNA, 19 nt, Human
ucugcaaacaugauguaac

SEQ ID NO: 453950 - RNA, 22 nt, Human
ugaaaucugaaguuuuguuucu

SEQ ID NO: 453951 - RNA, 22 nt, Human
ugcaagcaaaaccagcaagcaa

SEQ ID NO: 453952 - RNA, 22 nt, Human
uggauggugcacaauggugagu

SEQ ID NO: 453953 - RNA, 20 nt, Human
uguuucuaagaaauaauaga

SEQ ID NO: 453954 - RNA, 19 nt, Human
uucuaaggagaggaggaau

SEQ ID NO: 453955 - RNA, 24 nt, Human
uuucuuaggaagaccacggaacuu

SEQ ID NO: 453956 - RNA, 22 nt, Human
uuuguauuuucaugguuauucu

SEQ ID NO: 453957 - RNA, 22 nt, Human
uuuucaggguuauaugcaaaua

SEQ ID NO: 453958 - RNA, 19 nt, Human
aaaaaucuucccuaccucc

SEQ ID NO: 453959 - RNA, 24 nt, Human
aaaaugcugggauuacaggcauga

SEQ ID NO: 453960 - RNA, 23 nt, Human
aaacaaggugauguuugagucua

SEQ ID NO: 453961 - RNA, 19 nt, Human
aaaugcugggauuacaggc

SEQ ID NO: 453962 - RNA, 21 nt, Human
aacacuugucgaaucaaugca

SEQ ID NO: 453963 - RNA, 21 nt, Human
aagcaauucuccugucucagc

SEQ ID NO: 453964 - RNA, 21 nt, Human
acagaagauagugguuuucau

SEQ ID NO: 453965 - RNA, 19 nt, Human
acauuauuacacuuaaacc

SEQ ID NO: 453966 - RNA, 24 nt, Human
accaugccagcaaugauuccuuuu

SEQ ID NO: 453967 - RNA, 22 nt, Human
accaugcccagccuaaacuugg

SEQ ID NO: 453968 - RNA, 19 nt, Human
accuccaccuccugaaucu

SEQ ID NO: 453969 - RNA, 21 nt, Human
accuccuuuucugcccuccaa

SEQ ID NO: 453970 - RNA, 23 nt, Human
accuccuuuucugcccuccaaga

SEQ ID NO: 453971 - RNA, 25 nt, Human
acuaaaaccuccaccuccugaaucu

SEQ ID NO: 453972 - RNA, 20 nt, Human
agaugccagggcugggguga

SEQ ID NO: 453973 - RNA, 21 nt, Human
agcgcaaaaucucuuggaaac

SEQ ID NO: 453974 - RNA, 22 nt, Human
aggcuggucucaaaguccuggc

SEQ ID NO: 453975 - RNA, 19 nt, Human
agggcuggggugacccaug

SEQ ID NO: 453976 - RNA, 18 nt, Human
aggugauccaccagccuc

SEQ ID NO: 453977 - RNA, 19 nt, Human
aguagcugggacuacaggc

SEQ ID NO: 453978 - RNA, 19 nt, Human
aguagcugggacuacaggc

SEQ ID NO: 453979 - RNA, 22 nt, Human
aguagggaugagguuuugccau

SEQ ID NO: 453980 - RNA, 18 nt, Human
agucaccaugcccagccu

SEQ ID NO: 453981 - RNA, 22 nt, Human
agugcaauggugugauuucggc

SEQ ID NO: 453982 - RNA, 23 nt, Human
auccuauuucucauauguccgca

SEQ ID NO: 453983 - RNA, 21 nt, Human
augaagaccugacacacuaug

SEQ ID NO: 453984 - RNA, 24 nt, Human
augaggccacagugcaaccaggug

SEQ ID NO: 453985 - RNA, 20 nt, Human
augagguuuugccauauugg

SEQ ID NO: 453986 - RNA, 24 nt, Human
augagguuuugccauauuggucag

SEQ ID NO: 453987 - RNA, 23 nt, Human
auggucuuggggacacagcaggg

SEQ ID NO: 453988 - RNA, 25 nt, Human
auuuaaaaaucuucccuaccuccuu

SEQ ID NO: 453989 - RNA, 24 nt, Human
auuuuuguauuuuuaguagggaug

SEQ ID NO: 453990 - RNA, 24 nt, Human
caaaaugcugggauuacaggcaug

SEQ ID NO: 453991 - RNA, 24 nt, Human
cacaccaccaugcccggcuaauuu

SEQ ID NO: 453992 - RNA, 21 nt, Human
cacauuauuacacuuaaaccu

SEQ ID NO: 453993 - RNA, 19 nt, Human
caccaugcccagccuaaac

SEQ ID NO: 453994 - RNA, 24 nt, Human
caccaugcccggcuaauuuuugua

SEQ ID NO: 453995 - RNA, 22 nt, Human
cacuaugcuaaaaguccaaggc

SEQ ID NO: 453996 - RNA, 18 nt, Human
cagaagauagugguuuuc

SEQ ID NO: 453997 - RNA, 19 nt, Human
cagcagggaaugaacugac

SEQ ID NO: 453998 - RNA, 23 nt, Human
cagcagggaaugaacugacagga

SEQ ID NO: 453999 - RNA, 20 nt, Human
cagccuccugaguagcuggg

SEQ ID NO: 454000 - RNA, 20 nt, Human
cagcugggugaugccagggc

SEQ ID NO: 454001 - RNA, 19 nt, Human
caggugcucaauaaacacu

SEQ ID NO: 454002 - RNA, 23 nt, Human
caugagaucauaccuauaaaaca

SEQ ID NO: 454003 - RNA, 22 nt, Human
cauuucugucauaauuaguggg

SEQ ID NO: 454004 - RNA, 23 nt, Human
ccaaaaugcugggauuacaggca

SEQ ID NO: 454005 - RNA, 24 nt, Human
ccaaaaugcugggauuacaggcau

SEQ ID NO: 454006 - RNA, 18 nt, Human
ccacagugcaaccaggug

SEQ ID NO: 454007 - RNA, 27 nt, Human
ccaccuccugaaucuaagcaauucuuu

SEQ ID NO: 454008 - RNA, 24 nt, Human
ccacuaaaaccuccaccuccugaa

SEQ ID NO: 454009 - RNA, 21 nt, Human
ccagggcuggggugacccaug

SEQ ID NO: 454010 - RNA, 19 nt, Human
ccauauuggucaggcuggu

SEQ ID NO: 454011 - RNA, 22 nt, Human
ccauauuggucaggcuggucuc

SEQ ID NO: 454012 - RNA, 20 nt, Human
ccaugcccagccuaaacuug

SEQ ID NO: 454013 - RNA, 24 nt, Human
cccaaaaugcugggauuacaggca

SEQ ID NO: 454014 - RNA, 23 nt, Human
cccacacauuauuacacuuaaac

SEQ ID NO: 454015 - RNA, 24 nt, Human
cccacacauuauuacacuuaaacc

SEQ ID NO: 454016 - RNA, 24 nt, Human
cccacuaaaaccuccaccuccuga

SEQ ID NO: 454017 - RNA, 18 nt, Human
cccagcgcaaaaucucuu

SEQ ID NO: 454018 - RNA, 22 nt, Human
ccucaggugauccaccagccuc

SEQ ID NO: 454019 - RNA, 19 nt, Human
ccugaaaccuacaaaaaaa

SEQ ID NO: 454020 - RNA, 24 nt, Human
ccugaaaccuacaaaaaaagaaaa

SEQ ID NO: 454021 - RNA, 24 nt, Human
ccugaguagcugggacuacaggcu

SEQ ID NO: 454022 - RNA, 18 nt, Human
ccuggccucaggugaucc

SEQ ID NO: 454023 - RNA, 21 nt, Human
ccuggccucaggugauccacc

SEQ ID NO: 454024 - RNA, 23 nt, Human
ccuggccucaggugauccaccag

SEQ ID NO: 454025 - RNA, 23 nt, Human
cgccagcuaugcucuaucuccac

SEQ ID NO: 454026 - RNA, 24 nt, Human
cgcucugucgcacagucuggagug

SEQ ID NO: 454027 - RNA, 24 nt, Human
cucagccuccugaguagcugggac

SEQ ID NO: 454028 - RNA, 23 nt, Human
cugaaucuaagcaauucuccugu

SEQ ID NO: 454029 - RNA, 23 nt, Human
cugucucagccuccugaguagcu

SEQ ID NO: 454030 - RNA, 22 nt, Human
cuucaugccaugcaaaauuacu

SEQ ID NO: 454031 - RNA, 23 nt, Human
cuuccuucucgggcucugggcag

SEQ ID NO: 454032 - RNA, 23 nt, Human
cuugccucaccgcuucugcugag

SEQ ID NO: 454033 - RNA, 24 nt, Human
gacuacaggcucacaccaccaugc

SEQ ID NO: 454034 - RNA, 22 nt, Human
gagguuuugccauauuggucag

SEQ ID NO: 454035 - RNA, 25 nt, Human
gaguagcugggacuacaggcucaca

SEQ ID NO: 454036 - RNA, 18 nt, Human
gauuacaggcaugaguca

SEQ ID NO: 454037 - RNA, 21 nt, Human
gauuacaggcaugagucacca

SEQ ID NO: 454038 - RNA, 22 nt, Human
gauuacaggcaugagucaccau

SEQ ID NO: 454039 - RNA, 18 nt, Human
gcaaaauuacuuuacccc

SEQ ID NO: 454040 - RNA, 22 nt, Human
gcccggcuaauuuuuguauuuu

SEQ ID NO: 454041 - RNA, 23 nt, Human
gccucagccucccaaaaugcugg

SEQ ID NO: 454042 - RNA, 22 nt, Human
ggaaaaacaaggugauguuuga

SEQ ID NO: 454043 - RNA, 24 nt, Human
ggacacagcagggaaugaacugac

SEQ ID NO: 454044 - RNA, 24 nt, Human
ggauuacaggcaugagucaccaug

SEQ ID NO: 454045 - RNA, 24 nt, Human
gggaugagguuuugccauauuggu

SEQ ID NO: 454046 - RNA, 23 nt, Human
gggcagaugccagggcuggggug

SEQ ID NO: 454047 - RNA, 25 nt, Human
ggugauccaccagccucagccuccc

SEQ ID NO: 454048 - RNA, 19 nt, Human
guagcaagcagccucccca

SEQ ID NO: 454049 - RNA, 19 nt, Human
gucacggugcagucauucc

SEQ ID NO: 454050 - RNA, 18 nt, Human
gugggccacauuuucccu

SEQ ID NO: 454051 - RNA, 26 nt, Human
uaaaugccuacuacaugccagccaug

SEQ ID NO: 454052 - RNA, 24 nt, Human
uaauuuuuguauuuuuaguaggga

SEQ ID NO: 454053 - RNA, 18 nt, Human
uacagaagauagugguuu

SEQ ID NO: 454054 - RNA, 24 nt, Human
uacaggcaugagucaccaugccca

SEQ ID NO: 454055 - RNA, 23 nt, Human
uaguagggaugagguuuugccau

SEQ ID NO: 454056 - RNA, 24 nt, Human
uaguagggaugagguuuugccaua

SEQ ID NO: 454057 - RNA, 20 nt, Human
uaguucuggccuggagguuu

SEQ ID NO: 454058 - RNA, 22 nt, Human
uauacaguucugugccugaaac

SEQ ID NO: 454059 - RNA, 22 nt, Human
uaucagcugugugaucugggua

SEQ ID NO: 454060 - RNA, 23 nt, Human
ucaagggcuucagaaaaggacag

SEQ ID NO: 454061 - RNA, 22 nt, Human
ucaauaaacacuugucgaauca

SEQ ID NO: 454062 - RNA, 19 nt, Human
ucagaaaaggacagaacca

SEQ ID NO: 454063 - RNA, 18 nt, Human
ucagccucccaaaaugcu

SEQ ID NO: 454064 - RNA, 23 nt, Human
ucagccuccugaguagcugggac

SEQ ID NO: 454065 - RNA, 24 nt, Human
ucccaaaaugcugggauuacaggc

SEQ ID NO: 454066 - RNA, 19 nt, Human
ucccagagcuuugggagcu

SEQ ID NO: 454067 - RNA, 23 nt, Human
uccccagagcuucuugccucacc

SEQ ID NO: 454068 - RNA, 24 nt, Human
ucccuuggcaaagaggguaaaggu

SEQ ID NO: 454069 - RNA, 24 nt, Human
uccugaaucuaagcaauucuccug

SEQ ID NO: 454070 - RNA, 24 nt, Human
uccugaguagcugggacuacaggc

SEQ ID NO: 454071 - RNA, 21 nt, Human
uccuucucgggcucugggcag

SEQ ID NO: 454072 - RNA, 18 nt, Human
ucuauucugccuccacca

SEQ ID NO: 454073 - RNA, 24 nt, Human
ucuccugucucagccuccugagua

SEQ ID NO: 454074 - RNA, 24 nt, Human
ucucgcucugucgcacagucugga

SEQ ID NO: 454075 - RNA, 18 nt, Human
ucugcccuccaagacugc

SEQ ID NO: 454076 - RNA, 18 nt, Human
ucugcgcuucccucucca

SEQ ID NO: 454077 - RNA, 20 nt, Human
ucugucgcacagucuggagu

SEQ ID NO: 454078 - RNA, 23 nt, Human
ucuucugugugaaacaggaacug

SEQ ID NO: 454079 - RNA, 19 nt, Human
ugaaugaguggaaaaacaa

SEQ ID NO: 454080 - RNA, 23 nt, Human
ugacacacuaugcuaaaagucca

SEQ ID NO: 454081 - RNA, 18 nt, Human
ugagguagcuggaggauc

SEQ ID NO: 454082 - RNA, 24 nt, Human
ugagguuuugccauauuggucagg

SEQ ID NO: 454083 - RNA, 22 nt, Human
ugagucuauaguggucaagggc

SEQ ID NO: 454084 - RNA, 20 nt, Human
ugccaaauacuuguugaaca

SEQ ID NO: 454085 - RNA, 20 nt, Human
ugccagggcuggggugaccc

SEQ ID NO: 454086 - RNA, 24 nt, Human
ugccauauuggucaggcuggucuc

SEQ ID NO: 454087 - RNA, 24 nt, Human
ugcccggcuaauuuuuguauuuuu

SEQ ID NO: 454088 - RNA, 22 nt, Human
ugccugaaaccuacaaaaaaag

SEQ ID NO: 454089 - RNA, 23 nt, Human
ugccugaaaccuacaaaaaaaga

SEQ ID NO: 454090 - RNA, 23 nt, Human
ugcuaaaaguccaaggcugggug

SEQ ID NO: 454091 - RNA, 24 nt, Human
ugcugggauuacaggcaugaguca

SEQ ID NO: 454092 - RNA, 24 nt, Human
ugcuuuggugggccacauuuuccc

SEQ ID NO: 454093 - RNA, 22 nt, Human
uggaaaccucuaacugugucug

SEQ ID NO: 454094 - RNA, 23 nt, Human
uggagugcaauggugugauuucg

SEQ ID NO: 454095 - RNA, 24 nt, Human
uggagugcaauggugugauuucgg

SEQ ID NO: 454096 - RNA, 18 nt, Human
uggcaaagaggguaaagg

SEQ ID NO: 454097 - RNA, 22 nt, Human
uggcaagauaauaaauaaccuu

SEQ ID NO: 454098 - RNA, 25 nt, Human
uggcaagauaauaaauaaccuuuuu

SEQ ID NO: 454099 - RNA, 24 nt, Human
uggccucaggugauccaccagccu

SEQ ID NO: 454100 - RNA, 22 nt, Human
ugggacuacaggcucacaccac

SEQ ID NO: 454101 - RNA, 24 nt, Human
ugggacuacaggcucacaccacca

SEQ ID NO: 454102 - RNA, 18 nt, Human
ugggauuacaggcaugag

SEQ ID NO: 454103 - RNA, 22 nt, Human
ugggauuacaggcaugagucac

SEQ ID NO: 454104 - RNA, 23 nt, Human
ugggauuacaggcaugagucacc

SEQ ID NO: 454105 - RNA, 24 nt, Human
ugggauuacaggcaugagucacca

SEQ ID NO: 454106 - RNA, 25 nt, Human
ugggauuacaggcaugagucaccau

SEQ ID NO: 454107 - RNA, 23 nt, Human
ugggcagaugccagggcuggggu

SEQ ID NO: 454108 - RNA, 24 nt, Human
uggucaggcuggucucaaaguccu

SEQ ID NO: 454109 - RNA, 21 nt, Human
uggugaggggugaaugauuug

SEQ ID NO: 454110 - RNA, 22 nt, Human
uggugugauuucggcccacuaa

SEQ ID NO: 454111 - RNA, 22 nt, Human
ugucgcacagucuggagugcaa

SEQ ID NO: 454112 - RNA, 24 nt, Human
ugucucagccuccugaguagcugg

SEQ ID NO: 454113 - RNA, 18 nt, Human
uuaguagggaugagguuu

SEQ ID NO: 454114 - RNA, 18 nt, Human
uuaguagggaugagguuu

SEQ ID NO: 454115 - RNA, 24 nt, Human
uuaguagggaugagguuuugccau

SEQ ID NO: 454116 - RNA, 20 nt, Human
uuaugucugcgcuucccucu

SEQ ID NO: 454117 - RNA, 20 nt, Human
uuccuaaauaugcaagaaaa

SEQ ID NO: 454118 - RNA, 24 nt, Human
uucuggccuggagguuucugcugc

SEQ ID NO: 454119 - RNA, 18 nt, Human
uucuuuagguuaccaugc

SEQ ID NO: 454120 - RNA, 21 nt, Human
uuggauauacaguucugugcc

SEQ ID NO: 454121 - RNA, 25 nt, Human
uuguauuuuccuccucacaucccca

SEQ ID NO: 454122 - RNA, 27 nt, Human
uuuaaaaaucuucccuaccuccuuuuc

SEQ ID NO: 454123 - RNA, 18 nt, Human
uuucugcugcaucugccu

SEQ ID NO: 454124 - RNA, 18 nt, Human
uuuggcacucaggagggg

SEQ ID NO: 454125 - RNA, 21 nt, Human
uuuuuaguagggaugagguuu

SEQ ID NO: 454126 - RNA, 18 nt, Human
uuuuuguauuuuuaguag

SEQ ID NO: 454127 - RNA, 24 nt, Human
aacaugcuuauauuuuucuuaaga

SEQ ID NO: 454128 - RNA, 19 nt, Human
accauauaccaaugacauu

SEQ ID NO: 454129 - RNA, 25 nt, Human
caucaucaaauauuuugauaaugcc

SEQ ID NO: 454130 - RNA, 20 nt, Human
ccggcagcccgccuggcucc

SEQ ID NO: 454131 - RNA, 21 nt, Human
ccggucauagugcauuuuucu

SEQ ID NO: 454132 - RNA, 26 nt, Human
uaaacagccaccauauaccaaugaca

SEQ ID NO: 454133 - RNA, 22 nt, Human
uaaauuuucuagaggcuaacau

SEQ ID NO: 454134 - RNA, 20 nt, Human
uaacaugcuuauauuuuucu

SEQ ID NO: 454135 - RNA, 21 nt, Human
uacaaccuauguguggcauua

SEQ ID NO: 454136 - RNA, 21 nt, Human
uagugcauuuuucugaacuua

SEQ ID NO: 454137 - RNA, 25 nt, Human
ugauaaugccauuacaauacaaccu

SEQ ID NO: 454138 - RNA, 20 nt, Human
uuaaauuuucuagaggcuaa

SEQ ID NO: 454139 - RNA, 22 nt, Human
uucuagaggcuaacauaacaaa

SEQ ID NO: 454140 - RNA, 20 nt, Human
aaaaaaaaaaucaaagggac

SEQ ID NO: 454141 - RNA, 24 nt, Human
aaaaaaaaucaaagggacacacug

SEQ ID NO: 454142 - RNA, 21 nt, Human
aaacagccaguaaagcugugc

SEQ ID NO: 454143 - RNA, 20 nt, Human
aaagggacacacugggaauu

SEQ ID NO: 454144 - RNA, 20 nt, Human
aacaaacaccuaaaaagcaa

SEQ ID NO: 454145 - RNA, 23 nt, Human
aacaaacaccuaaaaagcacaca

SEQ ID NO: 454146 - RNA, 22 nt, Human
aacacacuaacaugcuauagga

SEQ ID NO: 454147 - RNA, 23 nt, Human
aacccagagaaccuuacaaacug

SEQ ID NO: 454148 - RNA, 20 nt, Human
aagcacacagcauauaauac

SEQ ID NO: 454149 - RNA, 20 nt, Human
aauaagugacacaucaguac

SEQ ID NO: 454150 - RNA, 22 nt, Human
acaguacuaacaaacaccuaaa

SEQ ID NO: 454151 - RNA, 18 nt, Human
acaugcaaacacacuaac

SEQ ID NO: 454152 - RNA, 20 nt, Human
acauucauaggugcccagua

SEQ ID NO: 454153 - RNA, 21 nt, Human
accugcuacucaugcugggcu

SEQ ID NO: 454154 - RNA, 25 nt, Human
acuaaaccaaagcauacaaacagcc

SEQ ID NO: 454155 - RNA, 23 nt, Human
agaaacacagagcuuguagcuug

SEQ ID NO: 454156 - RNA, 21 nt, Human
agacaagaugugaucacagga

SEQ ID NO: 454157 - RNA, 18 nt, Human
agagggugguggcggcgg

SEQ ID NO: 454158 - RNA, 20 nt, Human
agauguguucugucaucaug

SEQ ID NO: 454159 - RNA, 21 nt, Human
aggaagaaacugcagaguccc

SEQ ID NO: 454160 - RNA, 19 nt, Human
aggaccagaagacagugac

SEQ ID NO: 454161 - RNA, 20 nt, Human
aggagacuccaaaaucucaa

SEQ ID NO: 454162 - RNA, 23 nt, Human
aggccgcggccagcucacugcca

SEQ ID NO: 454163 - RNA, 20 nt, Human
aggcugaaguacugaaacug

SEQ ID NO: 454164 - RNA, 25 nt, Human
aguacagaaacacagagcuuguagc

SEQ ID NO: 454165 - RNA, 19 nt, Human
agucccuaccuaacccaga

SEQ ID NO: 454166 - RNA, 20 nt, Human
auccagaaugaucccauuca

SEQ ID NO: 454167 - RNA, 29 nt, Human
augcuggggaagggccccccagguggagu

SEQ ID NO: 454168 - RNA, 20 nt, Human
cacacagcauacauucauag

SEQ ID NO: 454169 - RNA, 19 nt, Human
cacaguacuaacaaacacc

SEQ ID NO: 454170 - RNA, 20 nt, Human
cacaguacuaacaaacaccu

SEQ ID NO: 454171 - RNA, 22 nt, Human
cacauggagcuuuuauguagag

SEQ ID NO: 454172 - RNA, 21 nt, Human
caccuaaaaagcacacagcau

SEQ ID NO: 454173 - RNA, 22 nt, Human
cacuaaaccaaagcauacaaac

SEQ ID NO: 454174 - RNA, 21 nt, Human
cagaagacagugacacaagga

SEQ ID NO: 454175 - RNA, 19 nt, Human
cagccaaggccgcggccag

SEQ ID NO: 454176 - RNA, 24 nt, Human
cagccgagacaagaugugaucaca

SEQ ID NO: 454177 - RNA, 23 nt, Human
caggaagaaacugcagagucccu

SEQ ID NO: 454178 - RNA, 22 nt, Human
cauccagaaugaucccauucau

SEQ ID NO: 454179 - RNA, 18 nt, Human
cauucauuggcuggaggu

SEQ ID NO: 454180 - RNA, 23 nt, Human
ccaaggccgcggccagcucacug

SEQ ID NO: 454181 - RNA, 21 nt, Human
ccacuagguuagccugaguau

SEQ ID NO: 454182 - RNA, 20 nt, Human
ccccgaguaggcuccaaccc

SEQ ID NO: 454183 - RNA, 23 nt, Human
cccuagauaaacaucaggaaccc

SEQ ID NO: 454184 - RNA, 22 nt, Human
ccuaacccagagaaccuuacaa

SEQ ID NO: 454185 - RNA, 19 nt, Human
ccugaaguuuuacucaugg

SEQ ID NO: 454186 - RNA, 19 nt, Human
cgcaugcagggcgcggccg

SEQ ID NO: 454187 - RNA, 18 nt, Human
cucagaagcuccugagag

SEQ ID NO: 454188 - RNA, 19 nt, Human
cuccaaccccgcccgcggc

SEQ ID NO: 454189 - RNA, 19 nt, Human
cugaaacuguggcccaugu

SEQ ID NO: 454190 - RNA, 23 nt, Human
cuguugauuccuacagccgagac

SEQ ID NO: 454191 - RNA, 19 nt, Human
cuugcgaaacaccugaagu

SEQ ID NO: 454192 - RNA, 18 nt, Human
gagggugguggcggcggg

SEQ ID NO: 454193 - RNA, 22 nt, Human
gccccgaguaggcuccaacccc

SEQ ID NO: 454194 - RNA, 21 nt, Human
gcccggcgggguuaaggccuc

SEQ ID NO: 454195 - RNA, 19 nt, Human
gcgcggccgcccggcgggg

SEQ ID NO: 454196 - RNA, 24 nt, Human
gcuccagaggcgucugacucagaa

SEQ ID NO: 454197 - RNA, 28 nt, Human
gcugaaguacugaaacuguggcccaguc

SEQ ID NO: 454198 - RNA, 19 nt, Human
guggcggcggguuagucca

SEQ ID NO: 454199 - RNA, 26 nt, Human
gugguggcggcggguuaacgacggcg

SEQ ID NO: 454200 - RNA, 24 nt, Human
uaaaagagacuucuagaaacagug

SEQ ID NO: 454201 - RNA, 23 nt, Human
uaaacaucaggaaccccacugag

SEQ ID NO: 454202 - RNA, 24 nt, Human
uaaaccaaagcauacaaacagcca

SEQ ID NO: 454203 - RNA, 19 nt, Human
uaacaaacaccuaaaaagc

SEQ ID NO: 454204 - RNA, 23 nt, Human
uacuaacaaacaccuaaaaagca

SEQ ID NO: 454205 - RNA, 19 nt, Human
uacuugagguggggaggag

SEQ ID NO: 454206 - RNA, 22 nt, Human
uagauaaacaucaggaacccca

SEQ ID NO: 454207 - RNA, 18 nt, Human
uaggcuccaaccccgccc

SEQ ID NO: 454208 - RNA, 25 nt, Human
ucacaggagacuccaaaaucucaaa

SEQ ID NO: 454209 - RNA, 22 nt, Human
ucacauggagcuuuuauguaga

SEQ ID NO: 454210 - RNA, 20 nt, Human
uccaaaaucucaaacugggc

SEQ ID NO: 454211 - RNA, 18 nt, Human
uccaggaggguuagguca

SEQ ID NO: 454212 - RNA, 18 nt, Human
uccuucuguugauuccua

SEQ ID NO: 454213 - RNA, 19 nt, Human
ugaaguacugaaacugugg

SEQ ID NO: 454214 - RNA, 19 nt, Human
ugacaggaagaaacugcag

SEQ ID NO: 454215 - RNA, 25 nt, Human
ugacaggaagaaacugcagaguccc

SEQ ID NO: 454216 - RNA, 24 nt, Human
ugagguggggaggaguacuauggu

SEQ ID NO: 454217 - RNA, 20 nt, Human
ugcagagucccuaccuaacc

SEQ ID NO: 454218 - RNA, 24 nt, Human
uggaacagagggugguggcggcgg

SEQ ID NO: 454219 - RNA, 19 nt, Human
uggaaguuccaagaucaca

SEQ ID NO: 454220 - RNA, 18 nt, Human
ugggcuggacaguggaac

SEQ ID NO: 454221 - RNA, 24 nt, Human
uguuucaggauaaauagguccagg

SEQ ID NO: 454222 - RNA, 18 nt, Human
uuaauacuuaacauaaau

SEQ ID NO: 454223 - RNA, 21 nt, Human
uuacacaccagcagguaugcu

SEQ ID NO: 454224 - RNA, 23 nt, Human
uuuaaguggauaaucauggaagu

SEQ ID NO: 454225 - RNA, 21 nt, Human
uuuuucaaaaauaaugcuuaa

SEQ ID NO: 454226 - RNA, 18 nt, Human
aacacgggggguggccag

SEQ ID NO: 454227 - RNA, 23 nt, Human
acuucaauucaucaaacuucaac

SEQ ID NO: 454228 - RNA, 21 nt, Human
agcagcugguggcagaggagg

SEQ ID NO: 454229 - RNA, 22 nt, Human
agggccuggcugggaucucugg

SEQ ID NO: 454230 - RNA, 19 nt, Human
caaaaggaaccaguuggca

SEQ ID NO: 454231 - RNA, 20 nt, Human
cgagcagcugguggcagagg

SEQ ID NO: 454232 - RNA, 18 nt, Human
cuccagggccuggcuggg

SEQ ID NO: 454233 - RNA, 20 nt, Human
cucccagggaggaaccagcu

SEQ ID NO: 454234 - RNA, 23 nt, Human
gagaacaaaaggaaccaguuggc

SEQ ID NO: 454235 - RNA, 18 nt, Human
gagcagcugguggcagag

SEQ ID NO: 454236 - RNA, 22 nt, Human
gagcagcugguggcagaggagg

SEQ ID NO: 454237 - RNA, 21 nt, Human
gaggauggggaacacgggggg

SEQ ID NO: 454238 - RNA, 24 nt, Human
ugaggauggggaacacggggggug

SEQ ID NO: 454239 - RNA, 22 nt, Human
ugcccucccagggaggaaccag

SEQ ID NO: 454240 - RNA, 24 nt, Human
uggccauccaugcuggggagagag

SEQ ID NO: 454241 - RNA, 21 nt, Human
uggcugggaucucuggucagg

SEQ ID NO: 454242 - RNA, 18 nt, Human
uggggagagaagauggca

SEQ ID NO: 454243 - RNA, 21 nt, Human
uggggagagaggguguggucc

SEQ ID NO: 454244 - RNA, 24 nt, Human
uggggagagagggugugguccguu

SEQ ID NO: 454245 - RNA, 20 nt, Human
ugguggcagaggaggcggcc

SEQ ID NO: 454246 - RNA, 18 nt, Human
acacucagccccaggcac

SEQ ID NO: 454247 - RNA, 20 nt, Human
acaguggugggguccagcac

SEQ ID NO: 454248 - RNA, 21 nt, Human
accagcccaccacccccuaca

SEQ ID NO: 454249 - RNA, 20 nt, Human
agaaaaauaaccguucccug

SEQ ID NO: 454250 - RNA, 20 nt, Human
auuuagaaaaauaaccguuc

SEQ ID NO: 454251 - RNA, 23 nt, Human
cacacucagccccaggcaccucu

SEQ ID NO: 454252 - RNA, 19 nt, Human
caccagcccaccacccccu

SEQ ID NO: 454253 - RNA, 20 nt, Human
caccagcccaccacccccua

SEQ ID NO: 454254 - RNA, 21 nt, Human
caccagcccaccacccccuac

SEQ ID NO: 454255 - RNA, 18 nt, Human
caccucucucucucucuu

SEQ ID NO: 454256 - RNA, 19 nt, Human
caccucucucucucucuug

SEQ ID NO: 454257 - RNA, 19 nt, Human
caccucugaccccugcguc

SEQ ID NO: 454258 - RNA, 19 nt, Human
cacuccuuguccaggccuc

SEQ ID NO: 454259 - RNA, 22 nt, Human
cacucuggggugcagagggacu

SEQ ID NO: 454260 - RNA, 25 nt, Human
cacucuggggugcagagggacugcu

SEQ ID NO: 454261 - RNA, 22 nt, Human
cagcugggcucccuuccugacu

SEQ ID NO: 454262 - RNA, 23 nt, Human
cagcugggcucccuuccugacuu

SEQ ID NO: 454263 - RNA, 24 nt, Human
cagcugggcucccuuccugacuuc

SEQ ID NO: 454264 - RNA, 23 nt, Human
ccacaguggugggguccagcaca

SEQ ID NO: 454265 - RNA, 24 nt, Human
ccucccgaggcucugcucuccccg

SEQ ID NO: 454266 - RNA, 24 nt, Human
ccugcccuguagccaccucugacc

SEQ ID NO: 454267 - RNA, 18 nt, Human
ccuugcucugugccaugg

SEQ ID NO: 454268 - RNA, 22 nt, Human
ccuuguccaggccucugucucc

SEQ ID NO: 454269 - RNA, 19 nt, Human
cgaaacgcugcggcacugc

SEQ ID NO: 454270 - RNA, 22 nt, Human
cugugugccccucccgaggcuc

SEQ ID NO: 454271 - RNA, 21 nt, Human
gacugcuccccaaagggacau

SEQ ID NO: 454272 - RNA, 19 nt, Human
gcaccucucucucucucuu

SEQ ID NO: 454273 - RNA, 22 nt, Human
gcacugcugggaggccucacgc

SEQ ID NO: 454274 - RNA, 18 nt, Human
ggcgcagcucugccacag

SEQ ID NO: 454275 - RNA, 20 nt, Human
uacaggugccuccucugccu

SEQ ID NO: 454276 - RNA, 22 nt, Human
ucacucuggggugcagagggac

SEQ ID NO: 454277 - RNA, 26 nt, Human
uccaggccucugucuccgggucucca

SEQ ID NO: 454278 - RNA, 22 nt, Human
uccgggcucucacacucagccc

SEQ ID NO: 454279 - RNA, 21 nt, Human
uccucugccugcccuguagcc

SEQ ID NO: 454280 - RNA, 31 nt, Human
uccucugccugcccuguagccaccucugacu

SEQ ID NO: 454281 - RNA, 19 nt, Human
uccugggccaccagcccac

SEQ ID NO: 454282 - RNA, 24 nt, Human
uccugggccaccagcccaccaccc

SEQ ID NO: 454283 - RNA, 19 nt, Human
ucuccagguggacaggggc

SEQ ID NO: 454284 - RNA, 22 nt, Human
ucuccagguggacaggggccuu

SEQ ID NO: 454285 - RNA, 23 nt, Human
ugaaaucuuccgggcucucacac

SEQ ID NO: 454286 - RNA, 18 nt, Human
ugaccccugcguccuccu

SEQ ID NO: 454287 - RNA, 19 nt, Human
ugaccccugcguccuccuc

SEQ ID NO: 454288 - RNA, 19 nt, Human
ugcagagggacugcucccc

SEQ ID NO: 454289 - RNA, 18 nt, Human
ugccaugggacuugagca

SEQ ID NO: 454290 - RNA, 18 nt, Human
ugccuccucugccugccc

SEQ ID NO: 454291 - RNA, 20 nt, Human
ugucaccagcugggcucccu

SEQ ID NO: 454292 - RNA, 20 nt, Human
uguccaggccucugucuccg

SEQ ID NO: 454293 - RNA, 21 nt, Human
ugucgcucgcuuuggggcuug

SEQ ID NO: 454294 - RNA, 19 nt, Human
ugugugccccucccgaggc

SEQ ID NO: 454295 - RNA, 20 nt, Human
ugugugccccucccgaggcu

SEQ ID NO: 454296 - RNA, 21 nt, Human
uucccguguucacuccuuguc

SEQ ID NO: 454297 - RNA, 24 nt, Human
aaacaaaaaccacaaaaaauuaua

SEQ ID NO: 454298 - RNA, 18 nt, Human
aacaaaaaccacaaaaaa

SEQ ID NO: 454299 - RNA, 22 nt, Human
aacaaaacaaaaaccacaaaaa

SEQ ID NO: 454300 - RNA, 24 nt, Human
aacagggcgagguucuuaaaggga

SEQ ID NO: 454301 - RNA, 18 nt, Human
aagggaccucgcauagga

SEQ ID NO: 454302 - RNA, 18 nt, Human
acaaaacaaaaaccacaa

SEQ ID NO: 454303 - RNA, 21 nt, Human
acaaaacaaaaaccacaaaaa

SEQ ID NO: 454304 - RNA, 26 nt, Human
acuuuaacucaacaaaacaaaaacca

SEQ ID NO: 454305 - RNA, 19 nt, Human
agacagaagcccgagaaac

SEQ ID NO: 454306 - RNA, 24 nt, Human
aggaggcucaaaucuguuucuuuu

SEQ ID NO: 454307 - RNA, 19 nt, Human
auaugcauguacccagucc

SEQ ID NO: 454308 - RNA, 21 nt, Human
caaaacaaaaaccacaaaaaa

SEQ ID NO: 454309 - RNA, 19 nt, Human
caaggaggcucaaaucugu

SEQ ID NO: 454310 - RNA, 19 nt, Human
caggagcgggagggagaag

SEQ ID NO: 454311 - RNA, 21 nt, Human
ccgccuccgcccaggagcggg

SEQ ID NO: 454312 - RNA, 23 nt, Human
cucacaauaauauacuuuaacuc

SEQ ID NO: 454313 - RNA, 23 nt, Human
cuuuaacucaacaaaacaaaaac

SEQ ID NO: 454314 - RNA, 20 nt, Human
gaacccuuggaaggagcuaa

SEQ ID NO: 454315 - RNA, 18 nt, Human
gcaaucaggugcuucacc

SEQ ID NO: 454316 - RNA, 20 nt, Human
ggcaaucaggugcuucaccc

SEQ ID NO: 454317 - RNA, 21 nt, Human
uaaaaucaaggaggcucaaau

SEQ ID NO: 454318 - RNA, 24 nt, Human
uaaagggaccucgcauaggauaga

SEQ ID NO: 454319 - RNA, 24 nt, Human
uaacucaacaaaacaaaaaccaca

SEQ ID NO: 454320 - RNA, 20 nt, Human
uagaggccaguuccgucucu

SEQ ID NO: 454321 - RNA, 19 nt, Human
uaggauagaggccaguucc

SEQ ID NO: 454322 - RNA, 22 nt, Human
uaggauagaggccaguuccguc

SEQ ID NO: 454323 - RNA, 19 nt, Human
ucgccacuuccgcuuccgc

SEQ ID NO: 454324 - RNA, 20 nt, Human
ucucucauagagacagaagc

SEQ ID NO: 454325 - RNA, 21 nt, Human
ugacaaguggcaacuugccuu

SEQ ID NO: 454326 - RNA, 22 nt, Human
ugagugcuggaggaaggaaacg

SEQ ID NO: 454327 - RNA, 20 nt, Human
ugcuggaggaaggaaacgag

SEQ ID NO: 454328 - RNA, 20 nt, Human
uuaaauaaaucucacaauaa

SEQ ID NO: 454329 - RNA, 23 nt, Human
uuucucgccacuuccgcuuccgc

SEQ ID NO: 454330 - RNA, 18 nt, Human
aaaggcagccuuuuacca

SEQ ID NO: 454331 - RNA, 20 nt, Human
aagacuuuccauugugauuu

SEQ ID NO: 454332 - RNA, 19 nt, Human
agacagauaaccuuacccu

SEQ ID NO: 454333 - RNA, 25 nt, Human
agcggccagucaggguuucucuaug

SEQ ID NO: 454334 - RNA, 21 nt, Human
agcuacaguaaaggcagccuu

SEQ ID NO: 454335 - RNA, 18 nt, Human
aguagguaaagcacaaug

SEQ ID NO: 454336 - RNA, 19 nt, Human
auaaccuuacccucaaaga

SEQ ID NO: 454337 - RNA, 25 nt, Human
caauagaaagcaaagcuccaggauc

SEQ ID NO: 454338 - RNA, 20 nt, Human
cacauacaguacaugcaacc

SEQ ID NO: 454339 - RNA, 25 nt, Human
cagacagauaaccuuacccucaaag

SEQ ID NO: 454340 - RNA, 22 nt, Human
ccaccuauuaccgucaaaagcc

SEQ ID NO: 454341 - RNA, 18 nt, Human
cccucagcggccagucag

SEQ ID NO: 454342 - RNA, 23 nt, Human
ccucaaagauucuggguucugag

SEQ ID NO: 454343 - RNA, 21 nt, Human
ccucgcgggcucgccgggcgu

SEQ ID NO: 454344 - RNA, 24 nt, Human
cugagagaacaaacuggcccagga

SEQ ID NO: 454345 - RNA, 22 nt, Human
cugccuccgcuucacuguacac

SEQ ID NO: 454346 - RNA, 23 nt, Human
gaagaugaacugcggcaaagccu

SEQ ID NO: 454347 - RNA, 24 nt, Human
gcaacccggagagacugaaaacac

SEQ ID NO: 454348 - RNA, 21 nt, Human
ggagccgcucugccuccgcuu

SEQ ID NO: 454349 - RNA, 20 nt, Human
ggcaaagccuuugucauaug

SEQ ID NO: 454350 - RNA, 25 nt, Human
gggaaaguggagagaagccgguacc

SEQ ID NO: 454351 - RNA, 23 nt, Human
gugaugcagcaggauuccaggaa

SEQ ID NO: 454352 - RNA, 24 nt, Human
uauaugaaacuaguuucacacucu

SEQ ID NO: 454353 - RNA, 22 nt, Human
ucaagacuuuccauugugauuu

SEQ ID NO: 454354 - RNA, 19 nt, Human
ugagagaacaaacuggccc

SEQ ID NO: 454355 - RNA, 19 nt, Human
ugggaaaguggagagaagc

SEQ ID NO: 454356 - RNA, 21 nt, Human
uuguuuuguuuugaaagaaua

SEQ ID NO: 454357 - RNA, 23 nt, Human
uuuuccaccacuuggacucacua

SEQ ID NO: 454358 - RNA, 23 nt, Human
ccguuuccgcuuccgggucacgc

SEQ ID NO: 454359 - RNA, 25 nt, Human
cuuucugggauccccgacuugccca

SEQ ID NO: 454360 - RNA, 18 nt, Human
ggacggacacccguuucc

SEQ ID NO: 454361 - RNA, 20 nt, Human
ggucacgcuucucuuucugg

SEQ ID NO: 454362 - RNA, 21 nt, Human
uaaaagauccugggcauccac

SEQ ID NO: 454363 - RNA, 21 nt, Human
ucgguccugucgccgccgccg

SEQ ID NO: 454364 - RNA, 18 nt, Human
uggcaggccggagcuggg

SEQ ID NO: 454365 - RNA, 23 nt, Human
ugggacggacacccguuuccgcu

SEQ ID NO: 454366 - RNA, 20 nt, Human
accuggcccucucaggacgu

SEQ ID NO: 454367 - RNA, 23 nt, Human
aggcaauagugggaguccugggg

SEQ ID NO: 454368 - RNA, 25 nt, Human
cacccugcaaaccccaggggcagcc

SEQ ID NO: 454369 - RNA, 22 nt, Human
cagagcacucccggcgaccugg

SEQ ID NO: 454370 - RNA, 18 nt, Human
cagcacccugcaaacccc

SEQ ID NO: 454371 - RNA, 21 nt, Human
cagcacccugcaaaccccagg

SEQ ID NO: 454372 - RNA, 21 nt, Human
cccccaaccugugccuggccc

SEQ ID NO: 454373 - RNA, 22 nt, Human
ccccccaaccugugccuggccc

SEQ ID NO: 454374 - RNA, 19 nt, Human
ccccucuggcacggggccu

SEQ ID NO: 454375 - RNA, 23 nt, Human
cccggcgaccuggcccucucagg

SEQ ID NO: 454376 - RNA, 21 nt, Human
ccucucaggacgugcagcugg

SEQ ID NO: 454377 - RNA, 18 nt, Human
ccugcaaaccccaggggc

SEQ ID NO: 454378 - RNA, 21 nt, Human
ccugcaaaccccaggggcagc

SEQ ID NO: 454379 - RNA, 18 nt, Human
cgugcagcugggagaaca

SEQ ID NO: 454380 - RNA, 22 nt, Human
cuccugggccaaucacagaggc

SEQ ID NO: 454381 - RNA, 22 nt, Human
cuggcguggggguggggccugg

SEQ ID NO: 454382 - RNA, 21 nt, Human
gagcacucccggcgaccuggc

SEQ ID NO: 454383 - RNA, 25 nt, Human
gcaaaccccaggggcaggggaacgc

SEQ ID NO: 454384 - RNA, 22 nt, Human
gcaauagugggaguccugggga

SEQ ID NO: 454385 - RNA, 22 nt, Human
gcacccugcaaaccccaggggc

SEQ ID NO: 454386 - RNA, 23 nt, Human
ggaggggcauggcuggcgugggg

SEQ ID NO: 454387 - RNA, 23 nt, Human
ggaguccuggggaggggcauggc

SEQ ID NO: 454388 - RNA, 18 nt, Human
ggccuaggguugggggcu

SEQ ID NO: 454389 - RNA, 22 nt, Human
gggcagccccccaaccugugcc

SEQ ID NO: 454390 - RNA, 19 nt, Human
gggcaggaugggcuggugu

SEQ ID NO: 454391 - RNA, 20 nt, Human
gggcauggcuggcguggggg

SEQ ID NO: 454392 - RNA, 23 nt, Human
guccugccggaggccagagcacu

SEQ ID NO: 454393 - RNA, 19 nt, Human
guccuggggaggggcaugg

SEQ ID NO: 454394 - RNA, 20 nt, Human
guccuggggaggggcauggc

SEQ ID NO: 454395 - RNA, 18 nt, Human
uccccugggagucagccu

SEQ ID NO: 454396 - RNA, 22 nt, Human
uccugggccaaucacagaggca

SEQ ID NO: 454397 - RNA, 26 nt, Human
ugcaaaccccaggggcagcccccccu

SEQ ID NO: 454398 - RNA, 21 nt, Human
ugcagcacccugcaaaccccu

SEQ ID NO: 454399 - RNA, 18 nt, Human
uggggguggggccuggag

SEQ ID NO: 454400 - RNA, 24 nt, Human
ugugaagaugacguggaagaugac

SEQ ID NO: 454401 - RNA, 19 nt, Human
uuccccugggagucagccu

SEQ ID NO: 454402 - RNA, 23 nt, Human
acacagcuggggagcaugccccu

SEQ ID NO: 454403 - RNA, 19 nt, Human
accccuucugccuuggaga

SEQ ID NO: 454404 - RNA, 19 nt, Human
agcucaaucuccucuggca

SEQ ID NO: 454405 - RNA, 18 nt, Human
agggaggaccuuuccugg

SEQ ID NO: 454406 - RNA, 20 nt, Human
augcugugaacgugguuucc

SEQ ID NO: 454407 - RNA, 25 nt, Human
augcuuuuuugagggaggaccuuuc

SEQ ID NO: 454408 - RNA, 21 nt, Human
auggcccagggcaccccaccg

SEQ ID NO: 454409 - RNA, 19 nt, Human
caaguucugcagcuccugc

SEQ ID NO: 454410 - RNA, 21 nt, Human
cacgugggggcuacaugaugu

SEQ ID NO: 454411 - RNA, 23 nt, Human
cacuccgccgucccauacauccc

SEQ ID NO: 454412 - RNA, 19 nt, Human
cacuggguggccccgcaac

SEQ ID NO: 454413 - RNA, 24 nt, Human
cagcaucuugaguuaugcuaacua

SEQ ID NO: 454414 - RNA, 27 nt, Human
caggaagucucucuucugcaccaguuu

SEQ ID NO: 454415 - RNA, 21 nt, Human
cagggcaccccacgugggggc

SEQ ID NO: 454416 - RNA, 20 nt, Human
cauggagaugauguccagcu

SEQ ID NO: 454417 - RNA, 27 nt, Human
ccaagacuucccggagacgcugaauuu

SEQ ID NO: 454418 - RNA, 19 nt, Human
ccccauggcccagggcacc

SEQ ID NO: 454419 - RNA, 24 nt, Human
cccggcggaccaagacuucccgga

SEQ ID NO: 454420 - RNA, 22 nt, Human
ccgugcccauggccucugguga

SEQ ID NO: 454421 - RNA, 22 nt, Human
cgcaucguccaccaggaagucu

SEQ ID NO: 454422 - RNA, 19 nt, Human
cuacacucuguacagggug

SEQ ID NO: 454423 - RNA, 20 nt, Human
cucccaguucauucacacgg

SEQ ID NO: 454424 - RNA, 18 nt, Human
cucuggggaggaccaugc

SEQ ID NO: 454425 - RNA, 19 nt, Human
gcaguuugguuuuuucuuu

SEQ ID NO: 454426 - RNA, 21 nt, Human
gcaucguccaccaggaagucu

SEQ ID NO: 454427 - RNA, 19 nt, Human
gcucuggggaggaccaugc

SEQ ID NO: 454428 - RNA, 18 nt, Human
ggcaucaugguugucucc

SEQ ID NO: 454429 - RNA, 20 nt, Human
ggggggggguccccauggcc

SEQ ID NO: 454430 - RNA, 24 nt, Human
ggguggggggggguccccauggcc

SEQ ID NO: 454431 - RNA, 21 nt, Human
guccagcugaucuuucuuugc

SEQ ID NO: 454432 - RNA, 18 nt, Human
uaaacagugagacagacu

SEQ ID NO: 454433 - RNA, 22 nt, Human
uaaagacaagaggguggggggg

SEQ ID NO: 454434 - RNA, 23 nt, Human
uacagcuagagagaaguggagau

SEQ ID NO: 454435 - RNA, 18 nt, Human
ucaaucuccucuggcauc

SEQ ID NO: 454436 - RNA, 18 nt, Human
ucagauccuggcuaugau

SEQ ID NO: 454437 - RNA, 19 nt, Human
uccaccaggaagucucucu

SEQ ID NO: 454438 - RNA, 26 nt, Human
uccauaaucaagaaaaaaaguaaaaa

SEQ ID NO: 454439 - RNA, 21 nt, Human
uccccauggcccagggcaccc

SEQ ID NO: 454440 - RNA, 24 nt, Human
ucccggagacgcugaauuuuugcc

SEQ ID NO: 454441 - RNA, 19 nt, Human
uccuggguucggcaugcuc

SEQ ID NO: 454442 - RNA, 18 nt, Human
uccuugucuucuucuugc

SEQ ID NO: 454443 - RNA, 23 nt, Human
ugaauuuuugccaucuccagcuc

SEQ ID NO: 454444 - RNA, 23 nt, Human
ugagacagacuccuggguucggc

SEQ ID NO: 454445 - RNA, 21 nt, Human
ugaggaaacugacaggcuuca

SEQ ID NO: 454446 - RNA, 23 nt, Human
ugauuguuauucuccaguggcac

SEQ ID NO: 454447 - RNA, 21 nt, Human
ugcaguuugguuuuuucuuuu

SEQ ID NO: 454448 - RNA, 19 nt, Human
ugccuucaaccccuucugc

SEQ ID NO: 454449 - RNA, 23 nt, Human
ugcuuucuucucugcccgggagc

SEQ ID NO: 454450 - RNA, 19 nt, Human
uggggaggaccaugcgacg

SEQ ID NO: 454451 - RNA, 25 nt, Human
ugggggcuauaaagacaagagggug

SEQ ID NO: 454452 - RNA, 18 nt, Human
ugugaacgugguuuccau

SEQ ID NO: 454453 - RNA, 22 nt, Human
uuaaccgcucgaccuccgcauc

SEQ ID NO: 454454 - RNA, 24 nt, Human
uuagauacagcuagagagaagugg

SEQ ID NO: 454455 - RNA, 19 nt, Human
uugguuacuuugucuagag

SEQ ID NO: 454456 - RNA, 20 nt, Human
uugguuuuuucuuuuucugg

SEQ ID NO: 454457 - RNA, 19 nt, Human
uuguggaucuucuggauua

SEQ ID NO: 454458 - RNA, 22 nt, Human
uuuccugguguuuggauaaaca

SEQ ID NO: 454459 - RNA, 23 nt, Human
uuuuaacuugauucucaggaaau

SEQ ID NO: 454460 - RNA, 22 nt, Human
uuuugagggaggaccuuuccug

SEQ ID NO: 454461 - RNA, 19 nt, Human
aaaugcaucaucugacaaa

SEQ ID NO: 454462 - RNA, 21 nt, Human
aaccuucuaaggucucaccaa

SEQ ID NO: 454463 - RNA, 18 nt, Human
aacuagugaaacaggucc

SEQ ID NO: 454464 - RNA, 21 nt, Human
aagcaguaggaaaguuuucag

SEQ ID NO: 454465 - RNA, 21 nt, Human
aaguaaacugccgaucaaggu

SEQ ID NO: 454466 - RNA, 26 nt, Human
aaucagauaaagucugauuuguauga

SEQ ID NO: 454467 - RNA, 18 nt, Human
aaucagucaucuucugau

SEQ ID NO: 454468 - RNA, 20 nt, Human
aaucagucaucuucugaugu

SEQ ID NO: 454469 - RNA, 21 nt, Human
aaucagucaucuucugaugug

SEQ ID NO: 454470 - RNA, 21 nt, Human
aaugugacuugaauuaucuug

SEQ ID NO: 454471 - RNA, 19 nt, Human
acccugaggaugugaugaa

SEQ ID NO: 454472 - RNA, 23 nt, Human
acuuugcaacugagucugagcca

SEQ ID NO: 454473 - RNA, 23 nt, Human
aggaagaagacccuccugaagga

SEQ ID NO: 454474 - RNA, 22 nt, Human
aggaauuacuuccaguaaaauc

SEQ ID NO: 454475 - RNA, 22 nt, Human
aggucaucaacuaauccaaaac

SEQ ID NO: 454476 - RNA, 22 nt, Human
caaaauccgccgcucgcugacu

SEQ ID NO: 454477 - RNA, 20 nt, Human
caaaccuucuaaggucucac

SEQ ID NO: 454478 - RNA, 20 nt, Human
cagacaugacccucaccugg

SEQ ID NO: 454479 - RNA, 26 nt, Human
cagggcucauuacucguggaauauug

SEQ ID NO: 454480 - RNA, 19 nt, Human
cauugaaauggcccauuug

SEQ ID NO: 454481 - RNA, 26 nt, Human
ccaaaaagauuggcaucaucaaaaaa

SEQ ID NO: 454482 - RNA, 20 nt, Human
ccaccuuuuuucucugcuuc

SEQ ID NO: 454483 - RNA, 20 nt, Human
cccccgcaucuccccaccaa

SEQ ID NO: 454484 - RNA, 21 nt, Human
cccccgccgccccccgccucg

SEQ ID NO: 454485 - RNA, 24 nt, Human
ccccgccgccccccgccucgacug

SEQ ID NO: 454486 - RNA, 18 nt, Human
ccgccgccccccgccucg

SEQ ID NO: 454487 - RNA, 20 nt, Human
ccgccgccccccgccucgac

SEQ ID NO: 454488 - RNA, 19 nt, Human
ccucaggcgaccacccguc

SEQ ID NO: 454489 - RNA, 18 nt, Human
ccugugaauggcucaguu

SEQ ID NO: 454490 - RNA, 20 nt, Human
ccuuuggcuuggauuucauc

SEQ ID NO: 454491 - RNA, 23 nt, Human
cgaaggucaucaacuaauccagc

SEQ ID NO: 454492 - RNA, 19 nt, Human
cucgcgcuucgccaugacu

SEQ ID NO: 454493 - RNA, 23 nt, Human
gaaaaggaauaaugugaagaaaa

SEQ ID NO: 454494 - RNA, 26 nt, Human
gaacaugguucagugaaucuaugugc

SEQ ID NO: 454495 - RNA, 24 nt, Human
gacacgacccgcccccgcaucucc

SEQ ID NO: 454496 - RNA, 18 nt, Human
gacccgcccccgcaucuc

SEQ ID NO: 454497 - RNA, 21 nt, Human
gacccgcccccgcaucucccc

SEQ ID NO: 454498 - RNA, 23 nt, Human
gacugacacucgcggcuggccgg

SEQ ID NO: 454499 - RNA, 18 nt, Human
gauaugcugaguagauuc

SEQ ID NO: 454500 - RNA, 18 nt, Human
gauuagccuuuucuugcu

SEQ ID NO: 454501 - RNA, 19 nt, Human
ggcaucaucaaaaaagucc

SEQ ID NO: 454502 - RNA, 23 nt, Human
ggcgcccccgccgccccccgccu

SEQ ID NO: 454503 - RNA, 19 nt, Human
guggaauauugcguucccc

SEQ ID NO: 454504 - RNA, 18 nt, Human
uaaaauuuccuucuugau

SEQ ID NO: 454505 - RNA, 26 nt, Human
uaaauucucuucuaaagaugaaaagc

SEQ ID NO: 454506 - RNA, 23 nt, Human
uaacuuagaacauguuuuuguuu

SEQ ID NO: 454507 - RNA, 23 nt, Human
uacaaaugcaucaucugacaaac

SEQ ID NO: 454508 - RNA, 18 nt, Human
uagaaaaugaugaaugcc

SEQ ID NO: 454509 - RNA, 26 nt, Human
uauaugauuacuggaaaaggaauaau

SEQ ID NO: 454510 - RNA, 21 nt, Human
uaugaggugaaaaggaauuac

SEQ ID NO: 454511 - RNA, 24 nt, Human
uauuauuggaucauuuccgaaggu

SEQ ID NO: 454512 - RNA, 23 nt, Human
ucaaaauccgccgcucgcugacu

SEQ ID NO: 454513 - RNA, 21 nt, Human
ucuguaacaauccgggcuguu

SEQ ID NO: 454514 - RNA, 21 nt, Human
ucuuuuccuucaacugaagca

SEQ ID NO: 454515 - RNA, 19 nt, Human
ugaaaagccauuaguuucu

SEQ ID NO: 454516 - RNA, 18 nt, Human
ugaagugucaaaauccgc

SEQ ID NO: 454517 - RNA, 21 nt, Human
ugaauucaaugauguauuggg

SEQ ID NO: 454518 - RNA, 19 nt, Human
ugagaaaauugcugcauug

SEQ ID NO: 454519 - RNA, 21 nt, Human
ugaggaagaagacccuccuga

SEQ ID NO: 454520 - RNA, 20 nt, Human
ugaggcgcccccgccgcccc

SEQ ID NO: 454521 - RNA, 18 nt, Human
ugcuugauuccucuauga

SEQ ID NO: 454522 - RNA, 23 nt, Human
uggaaauuauuugaauucaauga

SEQ ID NO: 454523 - RNA, 22 nt, Human
uggaagauggaggcugucgcug

SEQ ID NO: 454524 - RNA, 18 nt, Human
uggaauauugcguucccc

SEQ ID NO: 454525 - RNA, 19 nt, Human
uguacaaaugcaucaucug

SEQ ID NO: 454526 - RNA, 18 nt, Human
ugucaugaagugucaaaa

SEQ ID NO: 454527 - RNA, 21 nt, Human
ugugaugaaugcaauauuugg

SEQ ID NO: 454528 - RNA, 25 nt, Human
uguucaaaaucagucaucuucugau

SEQ ID NO: 454529 - RNA, 18 nt, Human
uguugacucaucaaagug

SEQ ID NO: 454530 - RNA, 22 nt, Human
uucaaauucugcacccaaauuc

SEQ ID NO: 454531 - RNA, 22 nt, Human
uucgccaugacugaggcgcccc

SEQ ID NO: 454532 - RNA, 20 nt, Human
uucuaaagaugaaaagccau

SEQ ID NO: 454533 - RNA, 19 nt, Human
uuggaucauuuccgaaggu

SEQ ID NO: 454534 - RNA, 20 nt, Human
uuuguuuuuuugcugucuuu

SEQ ID NO: 454535 - RNA, 18 nt, Human
uuuugcugucuuuguccu

SEQ ID NO: 454536 - RNA, 23 nt, Human
aaaaccagcaggcccgggggaga

SEQ ID NO: 454537 - RNA, 22 nt, Human
aacaaaauuaguuacuguaagc

SEQ ID NO: 454538 - RNA, 22 nt, Human
aacaaagaaaacaugccagccc

SEQ ID NO: 454539 - RNA, 27 nt, Human
aacagaacagagauuggaaucauacaa

SEQ ID NO: 454540 - RNA, 18 nt, Human
aacaugccagccccaucc

SEQ ID NO: 454541 - RNA, 19 nt, Human
aagacugaaaaugcuuuuc

SEQ ID NO: 454542 - RNA, 20 nt, Human
aaguccuuuuguuguagcuc

SEQ ID NO: 454543 - RNA, 23 nt, Human
aagugaaaacaauuuugcauuca

SEQ ID NO: 454544 - RNA, 20 nt, Human
aauacaguuuauuagccauu

SEQ ID NO: 454545 - RNA, 21 nt, Human
aauacauuacuuguuccugaa

SEQ ID NO: 454546 - RNA, 20 nt, Human
acagaacuacaauuaaaaca

SEQ ID NO: 454547 - RNA, 25 nt, Human
acccucugcagcucccuccgggcaa

SEQ ID NO: 454548 - RNA, 20 nt, Human
acggcggcgauggacccucu

SEQ ID NO: 454549 - RNA, 21 nt, Human
acugauuuauagaaaaauggc

SEQ ID NO: 454550 - RNA, 18 nt, Human
agaaaacaugccagcccc

SEQ ID NO: 454551 - RNA, 21 nt, Human
aggcagaggcuccggcuccuc

SEQ ID NO: 454552 - RNA, 21 nt, Human
aggcgguggccguggcggcgg

SEQ ID NO: 454553 - RNA, 22 nt, Human
aggcgguggccguggcggcggc

SEQ ID NO: 454554 - RNA, 19 nt, Human
auacaagugccaaacagaa

SEQ ID NO: 454555 - RNA, 23 nt, Human
auaucaaauguuccagcuuuaac

SEQ ID NO: 454556 - RNA, 18 nt, Human
caaaauacaagggaauac

SEQ ID NO: 454557 - RNA, 19 nt, Human
caaacagaacagagauugg

SEQ ID NO: 454558 - RNA, 20 nt, Human
caagaugaagcucaagaguc

SEQ ID NO: 454559 - RNA, 26 nt, Human
caauucccagacaaguuggaaacaac

SEQ ID NO: 454560 - RNA, 18 nt, Human
cacaauguauaucaaaau

SEQ ID NO: 454561 - RNA, 23 nt, Human
cacacaauguauaucaaaauuaa

SEQ ID NO: 454562 - RNA, 22 nt, Human
cacacuacaagacugaaaaugc

SEQ ID NO: 454563 - RNA, 22 nt, Human
cagaguccccucucuccuucuc

SEQ ID NO: 454564 - RNA, 20 nt, Human
cagcggcugcugaggcagag

SEQ ID NO: 454565 - RNA, 25 nt, Human
cagcuugucaagaaacaauuuuuaa

SEQ ID NO: 454566 - RNA, 19 nt, Human
cagcuuuaacaaaauacaa

SEQ ID NO: 454567 - RNA, 22 nt, Human
caggcccgggggagagaugggg

SEQ ID NO: 454568 - RNA, 21 nt, Human
cauuccaauuugaagggccau

SEQ ID NO: 454569 - RNA, 22 nt, Human
cauuuguacaauauauuacaua

SEQ ID NO: 454570 - RNA, 24 nt, Human
ccagccccauccaaaaaaaguaca

SEQ ID NO: 454571 - RNA, 22 nt, Human
ccauccaaaaaaaguacacaga

SEQ ID NO: 454572 - RNA, 19 nt, Human
ccccaaaaccagcaggccc

SEQ ID NO: 454573 - RNA, 22 nt, Human
ccccccaaaaccagcaggcccc

SEQ ID NO: 454574 - RNA, 27 nt, Human
cccccggacuggagguccgggccccca

SEQ ID NO: 454575 - RNA, 24 nt, Human
ccccggacuggagguccgggcccc

SEQ ID NO: 454576 - RNA, 23 nt, Human
ccccucucuccuucuccccccca

SEQ ID NO: 454577 - RNA, 24 nt, Human
cccgcggcggcgacugguaccuuu

SEQ ID NO: 454578 - RNA, 24 nt, Human
cccucucuccuucucccccccaaa

SEQ ID NO: 454579 - RNA, 25 nt, Human
cccucucuccuucucccccccaaaa

SEQ ID NO: 454580 - RNA, 23 nt, Human
ccgcucgggcucccugguugggg

SEQ ID NO: 454581 - RNA, 24 nt, Human
ccuccgggcaaagguccaggcggu

SEQ ID NO: 454582 - RNA, 21 nt, Human
ccucuaaaacaccagguucag

SEQ ID NO: 454583 - RNA, 24 nt, Human
cgaccgagcuccucacuccggacu

SEQ ID NO: 454584 - RNA, 19 nt, Human
cgauggacccucugcagcu

SEQ ID NO: 454585 - RNA, 22 nt, Human
cgcgcugcccuccagaggacgg

SEQ ID NO: 454586 - RNA, 26 nt, Human
cggcgauggacccucugcagcucccu

SEQ ID NO: 454587 - RNA, 26 nt, Human
cuccggacucgacugacgggcaaaca

SEQ ID NO: 454588 - RNA, 19 nt, Human
cucgggcucccugguuggg

SEQ ID NO: 454589 - RNA, 26 nt, Human
cugaggcagaggcuccggcuccuccu

SEQ ID NO: 454590 - RNA, 20 nt, Human
cuuuacaguccuguacaaau

SEQ ID NO: 454591 - RNA, 23 nt, Human
gaaaagaaacauuuacaagaaaa

SEQ ID NO: 454592 - RNA, 20 nt, Human
gaacagagauuggaaucaua

SEQ ID NO: 454593 - RNA, 22 nt, Human
gccauuuucuuuuuucacacaa

SEQ ID NO: 454594 - RNA, 19 nt, Human
gcccgggggagagaugggg

SEQ ID NO: 454595 - RNA, 21 nt, Human
gcgguggccguggcggcggca

SEQ ID NO: 454596 - RNA, 22 nt, Human
gcucauaauaaaauaagcaaua

SEQ ID NO: 454597 - RNA, 21 nt, Human
gcuccggcuccuccuccuccc

SEQ ID NO: 454598 - RNA, 20 nt, Human
gcuccuccuccucccgcggc

SEQ ID NO: 454599 - RNA, 24 nt, Human
ggaaaagaaacauuuacaagaaaa

SEQ ID NO: 454600 - RNA, 23 nt, Human
ggaaacaaagaaaacaugccagc

SEQ ID NO: 454601 - RNA, 26 nt, Human
gggaaaagaaacauuuacaagaaaac

SEQ ID NO: 454602 - RNA, 21 nt, Human
gggaagaagggcggcgggucc

SEQ ID NO: 454603 - RNA, 25 nt, Human
gggcccccaaucgcgcugcccucca

SEQ ID NO: 454604 - RNA, 22 nt, Human
ggggaagaagggcggcgggucc

SEQ ID NO: 454605 - RNA, 18 nt, Human
guaaaacagucuguacaa

SEQ ID NO: 454606 - RNA, 21 nt, Human
gucaauacaagugaaaacaau

SEQ ID NO: 454607 - RNA, 19 nt, Human
gugacuugcuuuaaaaaac

SEQ ID NO: 454608 - RNA, 25 nt, Human
uaaaacaguaaaacagucuguacaa

SEQ ID NO: 454609 - RNA, 24 nt, Human
uaaaauaaccaccauccuuuugag

SEQ ID NO: 454610 - RNA, 19 nt, Human
uaaaguacuguguauuaac

SEQ ID NO: 454611 - RNA, 23 nt, Human
uaaauacaagugccaaacagaac

SEQ ID NO: 454612 - RNA, 21 nt, Human
uaacauguucugacccacccc

SEQ ID NO: 454613 - RNA, 23 nt, Human
uaacauguucugacccaccccuu

SEQ ID NO: 454614 - RNA, 23 nt, Human
uacaaucuuuauacauuguuuaa

SEQ ID NO: 454615 - RNA, 23 nt, Human
uaccagacacacaauucccagac

SEQ ID NO: 454616 - RNA, 18 nt, Human
uauaaaaaaaaaguggcc

SEQ ID NO: 454617 - RNA, 21 nt, Human
uauaaaauagugcuugucuga

SEQ ID NO: 454618 - RNA, 20 nt, Human
uaucaaauguuccagcuuua

SEQ ID NO: 454619 - RNA, 23 nt, Human
uauggcauuuuauuucagagccu

SEQ ID NO: 454620 - RNA, 28 nt, Human
uauugccaggaaacaaagaaaacaugcc

SEQ ID NO: 454621 - RNA, 20 nt, Human
ucaaaauuaaaaaaaaauac

SEQ ID NO: 454622 - RNA, 26 nt, Human
uccaaaaaaaguacacagaacuacaa

SEQ ID NO: 454623 - RNA, 22 nt, Human
uccauuccaauuugaagggcca

SEQ ID NO: 454624 - RNA, 18 nt, Human
ucccccccaaaaccagca

SEQ ID NO: 454625 - RNA, 23 nt, Human
ucccuccgggcaaagguccaggc

SEQ ID NO: 454626 - RNA, 20 nt, Human
ucccugguuggggggagggg

SEQ ID NO: 454627 - RNA, 23 nt, Human
ucccugguuggggggagggggac

SEQ ID NO: 454628 - RNA, 18 nt, Human
ucgcgcugcccuccagag

SEQ ID NO: 454629 - RNA, 23 nt, Human
ucgcgcugcccuccagaggacgg

SEQ ID NO: 454630 - RNA, 23 nt, Human
ucucuacaggcagugaaaagccu

SEQ ID NO: 454631 - RNA, 23 nt, Human
ugaacacauccacaauauacaaa

SEQ ID NO: 454632 - RNA, 21 nt, Human
ugaauaaauauacacuuugaa

SEQ ID NO: 454633 - RNA, 24 nt, Human
ugacuuauacaauuaaagccaccc

SEQ ID NO: 454634 - RNA, 18 nt, Human
ugacuugcuuuaaaaaac

SEQ ID NO: 454635 - RNA, 20 nt, Human
ugaggcagaggcuccggcuc

SEQ ID NO: 454636 - RNA, 24 nt, Human
ugauuuauagaaaaauggcaaagu

SEQ ID NO: 454637 - RNA, 23 nt, Human
ugcaaagugcuuuagcaaguccu

SEQ ID NO: 454638 - RNA, 21 nt, Human
ugcaagaccuuuuagccuaau

SEQ ID NO: 454639 - RNA, 18 nt, Human
ugccaggaaacaaagaaa

SEQ ID NO: 454640 - RNA, 22 nt, Human
uggaaaaauaucaaauguuccc

SEQ ID NO: 454641 - RNA, 21 nt, Human
uggaaggccuuccaguuaccg

SEQ ID NO: 454642 - RNA, 21 nt, Human
uguaaacauguucagucuuuu

SEQ ID NO: 454643 - RNA, 18 nt, Human
uguaaaggauucugacac

SEQ ID NO: 454644 - RNA, 22 nt, Human
uguaagcacacacuacaagacu

SEQ ID NO: 454645 - RNA, 23 nt, Human
uguaagcacacacuacaagacug

SEQ ID NO: 454646 - RNA, 21 nt, Human
uguacaauaaaguacugugua

SEQ ID NO: 454647 - RNA, 18 nt, Human
uguacaauauauuacaua

SEQ ID NO: 454648 - RNA, 19 nt, Human
uuaaaacaguaaaacaguc

SEQ ID NO: 454649 - RNA, 18 nt, Human
uucaacaaaauuaguuac

SEQ ID NO: 454650 - RNA, 22 nt, Human
uucauaaauaaauggaaaaaua

SEQ ID NO: 454651 - RNA, 19 nt, Human
uucccagacaaguuggaaa

SEQ ID NO: 454652 - RNA, 21 nt, Human
uugaaugaacacauccacaaa

SEQ ID NO: 454653 - RNA, 30 nt, Human
uuuaagggaaaagaaacauuuacaagaaaa

SEQ ID NO: 454654 - RNA, 21 nt, Human
uuuaauacaguuuauuagcca

SEQ ID NO: 454655 - RNA, 22 nt, Human
uuuuauaggccuaccaccccca

SEQ ID NO: 454656 - RNA, 21 nt, Human
uuuuuuuuuuuuuaaggauuc

SEQ ID NO: 454657 - RNA, 23 nt, Human
uuuuuuuuuuuuuuuuuuuaagg

SEQ ID NO: 454658 - RNA, 18 nt, Human
aacccagaaagagugggc

SEQ ID NO: 454659 - RNA, 21 nt, Human
acggcucaguccugcagcugc

SEQ ID NO: 454660 - RNA, 18 nt, Human
acuccagcaccaccccuc

SEQ ID NO: 454661 - RNA, 24 nt, Human
agauggcugccagggagagggcag

SEQ ID NO: 454662 - RNA, 22 nt, Human
agcccauucccuuggaaaaccc

SEQ ID NO: 454663 - RNA, 23 nt, Human
aggaauagaggggacaagauggc

SEQ ID NO: 454664 - RNA, 19 nt, Human
agggggagagggccugggc

SEQ ID NO: 454665 - RNA, 24 nt, Human
auggcugccagggagagggcaguu

SEQ ID NO: 454666 - RNA, 22 nt, Human
caccuggacuccagcaccaccc

SEQ ID NO: 454667 - RNA, 20 nt, Human
cacggcucaguccugcagcu

SEQ ID NO: 454668 - RNA, 18 nt, Human
cagacacuccauccugca

SEQ ID NO: 454669 - RNA, 25 nt, Human
cagcugcagcugagacugcggcggg

SEQ ID NO: 454670 - RNA, 24 nt, Human
caggcuacccagggcugggguugg

SEQ ID NO: 454671 - RNA, 18 nt, Human
caggguagggggagaggg

SEQ ID NO: 454672 - RNA, 18 nt, Human
cccagggcugggguuggg

SEQ ID NO: 454673 - RNA, 21 nt, Human
ccccuucaggaacugucaccu

SEQ ID NO: 454674 - RNA, 23 nt, Human
ccuccgggugcacggcucagucc

SEQ ID NO: 454675 - RNA, 25 nt, Human
cgcagggugugagggaaaauuuggg

SEQ ID NO: 454676 - RNA, 19 nt, Human
cucauacacaguuuuauuu

SEQ ID NO: 454677 - RNA, 22 nt, Human
cuccggcccugauggaagaucu

SEQ ID NO: 454678 - RNA, 21 nt, Human
cugggcugggcuggagccucc

SEQ ID NO: 454679 - RNA, 25 nt, Human
cuucaggaacugucaccuggacucc

SEQ ID NO: 454680 - RNA, 26 nt, Human
gaagccccuucaggaacugucaccuu

SEQ ID NO: 454681 - RNA, 18 nt, Human
gcagugcuguggccggca

SEQ ID NO: 454682 - RNA, 21 nt, Human
ggcucaguccugcagcugcag

SEQ ID NO: 454683 - RNA, 19 nt, Human
ggcugggguugggucgcgg

SEQ ID NO: 454684 - RNA, 21 nt, Human
gggggagagggccugggcugg

SEQ ID NO: 454685 - RNA, 23 nt, Human
ggguagggggagagggccugggc

SEQ ID NO: 454686 - RNA, 20 nt, Human
uacagacacuccauccugca

SEQ ID NO: 454687 - RNA, 23 nt, Human
uacccagggcugggguugggucg

SEQ ID NO: 454688 - RNA, 18 nt, Human
uccugugguggcgggagc

SEQ ID NO: 454689 - RNA, 21 nt, Human
ugcaagcccauucccuuggaa

SEQ ID NO: 454690 - RNA, 19 nt, Human
ugccugggcucauacacag

SEQ ID NO: 454691 - RNA, 22 nt, Human
uggaaaacccagaaagaguggg

SEQ ID NO: 454692 - RNA, 20 nt, Human
uggacuccagcaccaccccu

SEQ ID NO: 454693 - RNA, 21 nt, Human
ugggguugggucgcggcacug

SEQ ID NO: 454694 - RNA, 18 nt, Human
ugguggcgggagcgcagg

SEQ ID NO: 454695 - RNA, 24 nt, Human
ugucacuuccugugguggcgggag

SEQ ID NO: 454696 - RNA, 21 nt, Human
ugugguggcgggagcgcaggg

SEQ ID NO: 454697 - RNA, 21 nt, Human
ugugguggcgggagcgcaggg

SEQ ID NO: 454698 - RNA, 22 nt, Human
ugugguggcgggagcgcagggu

SEQ ID NO: 454699 - RNA, 21 nt, Human
uugaggcacuuagggauuuac

SEQ ID NO: 454700 - RNA, 23 nt, Human
uuucccagaagccccuucaggaa

SEQ ID NO: 454701 - RNA, 26 nt, Human
uuugucgccuccuccgggggucuccu

SEQ ID NO: 454702 - RNA, 21 nt, Human
uuuuacagacacuccauccug

SEQ ID NO: 454703 - RNA, 20 nt, Human
uuuuuuuuuuuuuugccugg

SEQ ID NO: 454704 - RNA, 18 nt, Human
uuuuuuuuuuuuuuuuug

SEQ ID NO: 454705 - RNA, 21 nt, Human
uuuuuuuuuuuuuuuuugccu

SEQ ID NO: 454706 - RNA, 24 nt, Human
uuuuuuuuuuuuuuuuugccuggg

SEQ ID NO: 454707 - RNA, 24 nt, Human
uuuuuuuuuuuuuuuuuugccugg

SEQ ID NO: 454708 - RNA, 24 nt, Human
aaaaucaguaguaacuuuagacaa

SEQ ID NO: 454709 - RNA, 21 nt, Human
aaacaguaagcuuucccaaag

SEQ ID NO: 454710 - RNA, 22 nt, Human
aagaugaagcuggggaaacuug

SEQ ID NO: 454711 - RNA, 22 nt, Human
acuugaaaagauauucuaaagg

SEQ ID NO: 454712 - RNA, 23 nt, Human
augauaauagaaagcaaccagcc

SEQ ID NO: 454713 - RNA, 25 nt, Human
augauaauagaaagcaaccagccaa

SEQ ID NO: 454714 - RNA, 21 nt, Human
ccaaagaugaagcuggggaaa

SEQ ID NO: 454715 - RNA, 22 nt, Human
ccaacauagcuaggucuucucu

SEQ ID NO: 454716 - RNA, 22 nt, Human
ccggcgcggcgcugggcgcucg

SEQ ID NO: 454717 - RNA, 23 nt, Human
gauaauagaaagcaaccagccaa

SEQ ID NO: 454718 - RNA, 25 nt, Human
gcacauuauuacuuuaucaaaaaca

SEQ ID NO: 454719 - RNA, 21 nt, Human
gcgcggcgcugggcgcucggg

SEQ ID NO: 454720 - RNA, 20 nt, Human
ggcgcucgggcucucaggau

SEQ ID NO: 454721 - RNA, 22 nt, Human
uaccaugauaauagaaagcaac

SEQ ID NO: 454722 - RNA, 23 nt, Human
uaccaugauaauagaaagcaacc

SEQ ID NO: 454723 - RNA, 25 nt, Human
uaccaugauaauagaaagcaaccag

SEQ ID NO: 454724 - RNA, 18 nt, Human
uagcaguaguuaccuuaa

SEQ ID NO: 454725 - RNA, 23 nt, Human
uagcuaggucuucucuuaaauuu

SEQ ID NO: 454726 - RNA, 20 nt, Human
uauaacugauaccuucugaa

SEQ ID NO: 454727 - RNA, 24 nt, Human
ucaugaguauuuacauuuuucaua

SEQ ID NO: 454728 - RNA, 23 nt, Human
ucugaaauguuucaugcuuuuaa

SEQ ID NO: 454729 - RNA, 21 nt, Human
ugaagcuggggaaacuugaaa

SEQ ID NO: 454730 - RNA, 23 nt, Human
uguggauacuaaaagcuuguaua

SEQ ID NO: 454731 - RNA, 26 nt, Human
uuuuuuuuuuuuuuuuuuucacaaaa

SEQ ID NO: 454732 - RNA, 18 nt, Human
aaaacccccaagcugcag

SEQ ID NO: 454733 - RNA, 25 nt, Human
aaacagcaauacaaagaaaaaaacc

SEQ ID NO: 454734 - RNA, 19 nt, Human
aaagaaaaaaacccccaag

SEQ ID NO: 454735 - RNA, 24 nt, Human
acagcaauacaaagaaaaaaaccc

SEQ ID NO: 454736 - RNA, 18 nt, Human
acgggguccggcuggcgg

SEQ ID NO: 454737 - RNA, 21 nt, Human
auacaaagaaaaaaaccccca

SEQ ID NO: 454738 - RNA, 19 nt, Human
cagcaauacaaagaaaaaa

SEQ ID NO: 454739 - RNA, 22 nt, Human
cagcaauacaaagaaaaaaacc

SEQ ID NO: 454740 - RNA, 27 nt, Human
cagcaauacaaagaaaaaaacccccaa

SEQ ID NO: 454741 - RNA, 23 nt, Human
cccaagcugcaguguguacacaa

SEQ ID NO: 454742 - RNA, 23 nt, Human
gcaauacaaagaaaaaaaccccc

SEQ ID NO: 454743 - RNA, 24 nt, Human
ggaagaccacaaagcucacaaagg

SEQ ID NO: 454744 - RNA, 18 nt, Human
ggcaggugcggggguggu

SEQ ID NO: 454745 - RNA, 26 nt, Human
gguggugcugugcuuccccggcgucc

SEQ ID NO: 454746 - RNA, 24 nt, Human
uacaaagaaaaaaacccccaagcu

SEQ ID NO: 454747 - RNA, 20 nt, Human
uacacaaugucacuuuccag

SEQ ID NO: 454748 - RNA, 21 nt, Human
uuccugaugggaagaccacaa

SEQ ID NO: 454749 - RNA, 24 nt, Human
aaaaauuaucuuaagaaaacuaac

SEQ ID NO: 454750 - RNA, 19 nt, Human
aaaacaagguaucucaaac

SEQ ID NO: 454751 - RNA, 18 nt, Human
aaaauccuaacauuugag

SEQ ID NO: 454752 - RNA, 19 nt, Human
aaacgaaacuaacaaauau

SEQ ID NO: 454753 - RNA, 24 nt, Human
aagaaaacuaacucaaaguucagc

SEQ ID NO: 454754 - RNA, 21 nt, Human
aagguaucucaaacucugaaa

SEQ ID NO: 454755 - RNA, 21 nt, Human
acacugcagcugggacccucc

SEQ ID NO: 454756 - RNA, 24 nt, Human
accuuagucucccuggaucccugg

SEQ ID NO: 454757 - RNA, 19 nt, Human
acucugaaagacacugaga

SEQ ID NO: 454758 - RNA, 24 nt, Human
acucugaaagacacugagacuuca

SEQ ID NO: 454759 - RNA, 19 nt, Human
agacuuagauuaucuggca

SEQ ID NO: 454760 - RNA, 24 nt, Human
agcaaauuuuggcuuauaauugac

SEQ ID NO: 454761 - RNA, 22 nt, Human
agcugugucagguggcagugcc

SEQ ID NO: 454762 - RNA, 21 nt, Human
agggagcucccucuggccccc

SEQ ID NO: 454763 - RNA, 18 nt, Human
auacuagauuucuuuugc

SEQ ID NO: 454764 - RNA, 18 nt, Human
auccuuucagguccugcu

SEQ ID NO: 454765 - RNA, 21 nt, Human
augacuauuccuuuucuuuuu

SEQ ID NO: 454766 - RNA, 24 nt, Human
cacacaugcgcugaucaguagggc

SEQ ID NO: 454767 - RNA, 18 nt, Human
caccagaaaguuugaugc

SEQ ID NO: 454768 - RNA, 24 nt, Human
cacugagacuucagaaaauccuaa

SEQ ID NO: 454769 - RNA, 23 nt, Human
cacugaguuuucugguaauuuua

SEQ ID NO: 454770 - RNA, 24 nt, Human
cagaaaguuugaugcaggcauugg

SEQ ID NO: 454771 - RNA, 21 nt, Human
caguaaaucuccacugaguuu

SEQ ID NO: 454772 - RNA, 22 nt, Human
ccagugccccauaaaucaugag

SEQ ID NO: 454773 - RNA, 20 nt, Human
cccgcaugcacacugcagcu

SEQ ID NO: 454774 - RNA, 19 nt, Human
ccuaggaugcagugugauc

SEQ ID NO: 454775 - RNA, 18 nt, Human
cgaaacuaacaaauauug

SEQ ID NO: 454776 - RNA, 21 nt, Human
cuauuucuagcaucugagauc

SEQ ID NO: 454777 - RNA, 23 nt, Human
cucggagcaugagcuggacaauc

SEQ ID NO: 454778 - RNA, 25 nt, Human
cugcagcugggacccuccucggagc

SEQ ID NO: 454779 - RNA, 20 nt, Human
cuggaugcuagacauuguac

SEQ ID NO: 454780 - RNA, 21 nt, Human
gacuucagaaaauccuaacau

SEQ ID NO: 454781 - RNA, 20 nt, Human
gccaugguaacagguauccu

SEQ ID NO: 454782 - RNA, 24 nt, Human
gccuguuuuuuauuuccuauuggc

SEQ ID NO: 454783 - RNA, 19 nt, Human
ggaaaaguuuuuaaaucaa

SEQ ID NO: 454784 - RNA, 20 nt, Human
ggaacaggcccuacccuagg

SEQ ID NO: 454785 - RNA, 18 nt, Human
ggagcucccucuggcccu

SEQ ID NO: 454786 - RNA, 18 nt, Human
uaacucaaaguucagcaa

SEQ ID NO: 454787 - RNA, 24 nt, Human
uaagaaaacuaacucaaaguucag

SEQ ID NO: 454788 - RNA, 25 nt, Human
uaauaugaaaaauuaucuuaagaaa

SEQ ID NO: 454789 - RNA, 19 nt, Human
uaauguugugugccuguuu

SEQ ID NO: 454790 - RNA, 20 nt, Human
uacccagugccccauaaauc

SEQ ID NO: 454791 - RNA, 21 nt, Human
uacccuagguccugugucagc

SEQ ID NO: 454792 - RNA, 24 nt, Human
uacuuuuaaauuaaaaauuagaaa

SEQ ID NO: 454793 - RNA, 24 nt, Human
uaggguggugggaacaggcccuac

SEQ ID NO: 454794 - RNA, 22 nt, Human
uaggguuucucacuuguguuuu

SEQ ID NO: 454795 - RNA, 19 nt, Human
uauuuuuuuccuuuccuag

SEQ ID NO: 454796 - RNA, 18 nt, Human
ucaugccucucuacugga

SEQ ID NO: 454797 - RNA, 22 nt, Human
uccuuucagguccugcuguaua

SEQ ID NO: 454798 - RNA, 23 nt, Human
ugaccaaaauuuuaaaaaacugg

SEQ ID NO: 454799 - RNA, 22 nt, Human
ugaccgcgaguuccggccaccu

SEQ ID NO: 454800 - RNA, 21 nt, Human
ugagauccaggucaguuguga

SEQ ID NO: 454801 - RNA, 18 nt, Human
ugaggagcacagagcaga

SEQ ID NO: 454802 - RNA, 19 nt, Human
ugaugcaggcauuggaaga

SEQ ID NO: 454803 - RNA, 24 nt, Human
ugcaauguauuuuccugcuuuuca

SEQ ID NO: 454804 - RNA, 25 nt, Human
uggaaaaguuuuuaaaucaaccacu

SEQ ID NO: 454805 - RNA, 24 nt, Human
ugggacagaacccuacuuuuugua

SEQ ID NO: 454806 - RNA, 26 nt, Human
ugguauuugguggcuugcaaaccguu

SEQ ID NO: 454807 - RNA, 19 nt, Human
uguacauuuuaccuucuug

SEQ ID NO: 454808 - RNA, 18 nt, Human
ugucagagacacauggga

SEQ ID NO: 454809 - RNA, 20 nt, Human
ugugucacuagagguguuuu

SEQ ID NO: 454810 - RNA, 19 nt, Human
uguuucuccaucuuagcca

SEQ ID NO: 454811 - RNA, 23 nt, Human
uguuuuaucccuccaggagacua

SEQ ID NO: 454812 - RNA, 20 nt, Human
uguuuucuacccagugcccc

SEQ ID NO: 454813 - RNA, 24 nt, Human
uuaaaauaaaaaauagaaguuuuu

SEQ ID NO: 454814 - RNA, 21 nt, Human
uucauccuggcuuguauguuu

SEQ ID NO: 454815 - RNA, 20 nt, Human
uucugguaauuuuacaaaaa

SEQ ID NO: 454816 - RNA, 23 nt, Human
uucuucuuggaaaaguuuuuaaa

SEQ ID NO: 454817 - RNA, 23 nt, Human
uuucugaauuuggaaucaucaug

SEQ ID NO: 454818 - RNA, 19 nt, Human
uuuucaguaaaucuccacu

SEQ ID NO: 454819 - RNA, 23 nt, Human
uuuucaugccucucuacuggaug

SEQ ID NO: 454820 - RNA, 18 nt, Human
uuuuuuuuuuuuuuuuug

SEQ ID NO: 454821 - RNA, 18 nt, Human
uuuuuuuuuuuuuuuuug

SEQ ID NO: 454822 - RNA, 24 nt, Human
uuuuuuuuuuuuuuuuuuuccaag

SEQ ID NO: 454823 - RNA, 23 nt, Human
aaagagaaagagacagaggaagg

SEQ ID NO: 454824 - RNA, 19 nt, Human
aaagugagaacucccagau

SEQ ID NO: 454825 - RNA, 20 nt, Human
acaauuuaguccaccagaaa

SEQ ID NO: 454826 - RNA, 21 nt, Human
acagaggaaggcacaaugaua

SEQ ID NO: 454827 - RNA, 22 nt, Human
acuuucaaacaaaauuuuuaca

SEQ ID NO: 454828 - RNA, 27 nt, Human
caaagcacccacagaaagaagggaguc

SEQ ID NO: 454829 - RNA, 18 nt, Human
cacccacagaaagaauaa

SEQ ID NO: 454830 - RNA, 24 nt, Human
cagaaagaauaagugcaaaaggua

SEQ ID NO: 454831 - RNA, 20 nt, Human
cagccgagcuccccuccccu

SEQ ID NO: 454832 - RNA, 28 nt, Human
cagccgagcuccccuccccuacccaaac

SEQ ID NO: 454833 - RNA, 23 nt, Human
caggagaugcugcucccuccucc

SEQ ID NO: 454834 - RNA, 21 nt, Human
ccacagaaagaauaagugcaa

SEQ ID NO: 454835 - RNA, 18 nt, Human
cccuccauccaaagaaac

SEQ ID NO: 454836 - RNA, 19 nt, Human
ccuacccaaaccccaacac

SEQ ID NO: 454837 - RNA, 21 nt, Human
ccuacccaaaccccaacacca

SEQ ID NO: 454838 - RNA, 24 nt, Human
ccuccauccaaagaaacauaucca

SEQ ID NO: 454839 - RNA, 22 nt, Human
ccuccccuacccaaaccccaac

SEQ ID NO: 454840 - RNA, 21 nt, Human
ccugcguuuccuuccugcucu

SEQ ID NO: 454841 - RNA, 18 nt, Human
ccuuccugcucuccugcu

SEQ ID NO: 454842 - RNA, 21 nt, Human
cuccaagagcccuggaucucu

SEQ ID NO: 454843 - RNA, 18 nt, Human
cuccccuacccaaacccc

SEQ ID NO: 454844 - RNA, 22 nt, Human
cuuccugcucuccugcuccuuc

SEQ ID NO: 454845 - RNA, 21 nt, Human
ggagaugcugcucccuccucc

SEQ ID NO: 454846 - RNA, 22 nt, Human
gucauguaacuuaacucaucag

SEQ ID NO: 454847 - RNA, 19 nt, Human
guccaccagaaacauggga

SEQ ID NO: 454848 - RNA, 19 nt, Human
uaaauaauuaucugccucu

SEQ ID NO: 454849 - RNA, 22 nt, Human
uaaauaauuaucugccucuucu

SEQ ID NO: 454850 - RNA, 22 nt, Human
uaacuuaacucaucaggccugg

SEQ ID NO: 454851 - RNA, 19 nt, Human
uacccaaaccccaacacca

SEQ ID NO: 454852 - RNA, 22 nt, Human
uagaaggacuggaucuaaucaa

SEQ ID NO: 454853 - RNA, 21 nt, Human
uccugcuccuucccuccuuca

SEQ ID NO: 454854 - RNA, 20 nt, Human
ucucacuugucccucuccaa

SEQ ID NO: 454855 - RNA, 19 nt, Human
ucuccaagagcccuggauc

SEQ ID NO: 454856 - RNA, 27 nt, Human
ucucugucucuccugaugguagaaggu

SEQ ID NO: 454857 - RNA, 18 nt, Human
ucuguguucacaggagau

SEQ ID NO: 454858 - RNA, 20 nt, Human
ucuuagaaggacuggaucua

SEQ ID NO: 454859 - RNA, 22 nt, Human
ugaauacaaucucugauucaug

SEQ ID NO: 454860 - RNA, 18 nt, Human
ugacuuucaaacaaaauu

SEQ ID NO: 454861 - RNA, 18 nt, Human
ugauaaauaauuaucugc

SEQ ID NO: 454862 - RNA, 18 nt, Human
ugcguuuccuuccugcuc

SEQ ID NO: 454863 - RNA, 26 nt, Human
ugcguuuccuuccugcucuccugcuc

SEQ ID NO: 454864 - RNA, 22 nt, Human
uggaguucugacagccgagcuc

SEQ ID NO: 454865 - RNA, 19 nt, Human
uggcuggcucucacuuguc

SEQ ID NO: 454866 - RNA, 18 nt, Human
ugucauugaauacaaucu

SEQ ID NO: 454867 - RNA, 24 nt, Human
uuaacagcaaacaggugcuccucu

SEQ ID NO: 454868 - RNA, 21 nt, Human
uuggcuggcucucacuugucc

SEQ ID NO: 454869 - RNA, 26 nt, Human
uuuccuuccugcucuccugcuccuuc

SEQ ID NO: 454870 - RNA, 26 nt, Human
aacccaucacccaaauagggaacaua

SEQ ID NO: 454871 - RNA, 22 nt, Human
agcuuuuuaaccccugccccuc

SEQ ID NO: 454872 - RNA, 21 nt, Human
aguguuuauuucuccagucuu

SEQ ID NO: 454873 - RNA, 20 nt, Human
cacaggaaggaaauccacug

SEQ ID NO: 454874 - RNA, 19 nt, Human
caugugcaggcuuguuaca

SEQ ID NO: 454875 - RNA, 22 nt, Human
caugugcaggcuuguuacauga

SEQ ID NO: 454876 - RNA, 23 nt, Human
caugugcaggcuuguuacaugag

SEQ ID NO: 454877 - RNA, 19 nt, Human
cccaucacccaaauaggga

SEQ ID NO: 454878 - RNA, 19 nt, Human
ccccucuuccuccuugccc

SEQ ID NO: 454879 - RNA, 20 nt, Human
cccugccccucuuccuccuu

SEQ ID NO: 454880 - RNA, 21 nt, Human
ccuccuugccccccuuuugga

SEQ ID NO: 454881 - RNA, 18 nt, Human
cugggguacaugugcagg

SEQ ID NO: 454882 - RNA, 22 nt, Human
cuugccccccuuuuggaguccu

SEQ ID NO: 454883 - RNA, 20 nt, Human
cuuuuggaguccucaguguu

SEQ ID NO: 454884 - RNA, 20 nt, Human
cuuuuuaaccccugccccuc

SEQ ID NO: 454885 - RNA, 20 nt, Human
gccccucuuccuccuugccc

SEQ ID NO: 454886 - RNA, 21 nt, Human
uaaccccugccccucuuccuc

SEQ ID NO: 454887 - RNA, 22 nt, Human
uaaccccugccccucuuccucc

SEQ ID NO: 454888 - RNA, 20 nt, Human
uccuugccccccuuuuggag

SEQ ID NO: 454889 - RNA, 21 nt, Human
ugaguauauugugugcugcug

SEQ ID NO: 454890 - RNA, 19 nt, Human
ugcugcugagguuuggacu

SEQ ID NO: 454891 - RNA, 21 nt, Human
ugugugcugcugagguuugga

SEQ ID NO: 454892 - RNA, 19 nt, Human
uuuccagaccuugugguug

SEQ ID NO: 454893 - RNA, 24 nt, Human
uuuggaguccucaguguuuauuuc

SEQ ID NO: 454894 - RNA, 22 nt, Human
aaaaaaagggaacuaaaaacau

SEQ ID NO: 454895 - RNA, 27 nt, Human
aaaaacaaaaaaaccuaauaacaacac

SEQ ID NO: 454896 - RNA, 23 nt, Human
aaaacaaaaacaaaaaaaccuaa

SEQ ID NO: 454897 - RNA, 26 nt, Human
aaacaaaaacaaaaaaaccuaauaac

SEQ ID NO: 454898 - RNA, 20 nt, Human
aaagauauauauaucuccuu

SEQ ID NO: 454899 - RNA, 19 nt, Human
aacaaaaaaagggaacuaa

SEQ ID NO: 454900 - RNA, 22 nt, Human
aacugugcagcucccaaagagc

SEQ ID NO: 454901 - RNA, 18 nt, Human
aagcauucaaacaaaaaa

SEQ ID NO: 454902 - RNA, 20 nt, Human
acaaaaacaaaaaaaccuaa

SEQ ID NO: 454903 - RNA, 19 nt, Human
acagcaacauauugcuucc

SEQ ID NO: 454904 - RNA, 22 nt, Human
acauuaggaacgucaauggaca

SEQ ID NO: 454905 - RNA, 24 nt, Human
acuaaaaacauauuacaaagacac

SEQ ID NO: 454906 - RNA, 20 nt, Human
agaaaacaaaaacaaaaaaa

SEQ ID NO: 454907 - RNA, 19 nt, Human
agcauccauccauuucuag

SEQ ID NO: 454908 - RNA, 20 nt, Human
agcaugccacaaaauaaccc

SEQ ID NO: 454909 - RNA, 23 nt, Human
agucaaaaaaagaaaaaaagucc

SEQ ID NO: 454910 - RNA, 21 nt, Human
auagcagcaaaggcacuguac

SEQ ID NO: 454911 - RNA, 24 nt, Human
auagcagcaaaggcacuguacauc

SEQ ID NO: 454912 - RNA, 27 nt, Human
aucaaacacuaagcacuuaagacacca

SEQ ID NO: 454913 - RNA, 22 nt, Human
caaaaaaagaaaaaaaguccaa

SEQ ID NO: 454914 - RNA, 22 nt, Human
caaaaacaaaaaaaccuaauaa

SEQ ID NO: 454915 - RNA, 25 nt, Human
caaaaacaaaaaaaccuaauaacaa

SEQ ID NO: 454916 - RNA, 21 nt, Human
caacaaaacugacuaaagaua

SEQ ID NO: 454917 - RNA, 26 nt, Human
cauuucaacuugcagcauccauccau

SEQ ID NO: 454918 - RNA, 22 nt, Human
ccuaauaacaacacagcaacau

SEQ ID NO: 454919 - RNA, 23 nt, Human
cuaauuguucagccaaauuucca

SEQ ID NO: 454920 - RNA, 19 nt, Human
cucuauacagucaucaguc

SEQ ID NO: 454921 - RNA, 20 nt, Human
gagucaaaaaaagaaaaaaa

SEQ ID NO: 454922 - RNA, 26 nt, Human
gccuauaauacaacaaaaaaagggaa

SEQ ID NO: 454923 - RNA, 18 nt, Human
gcuuaaaagucugaauuc

SEQ ID NO: 454924 - RNA, 22 nt, Human
guuauuuauguuuaaugcuuaa

SEQ ID NO: 454925 - RNA, 18 nt, Human
uaaguucucucuuugagg

SEQ ID NO: 454926 - RNA, 22 nt, Human
uaaugacaucaaacacuaagca

SEQ ID NO: 454927 - RNA, 18 nt, Human
uaggaacgucaauggaca

SEQ ID NO: 454928 - RNA, 22 nt, Human
ucaaaaaaagaaaaaaagucca

SEQ ID NO: 454929 - RNA, 18 nt, Human
ucagccaaauuuccaaaa

SEQ ID NO: 454930 - RNA, 25 nt, Human
ucccaaagagcaugccaaccauugg

SEQ ID NO: 454931 - RNA, 25 nt, Human
ucucauaacaacaaaacugacuaaa

SEQ ID NO: 454932 - RNA, 21 nt, Human
ucuccuuuugcaaagaaaugu

SEQ ID NO: 454933 - RNA, 22 nt, Human
ugaauucacaaacaaucuacca

SEQ ID NO: 454934 - RNA, 19 nt, Human
ugauuugauccauagcagc

SEQ ID NO: 454935 - RNA, 23 nt, Human
uguagaaaacaaaaacaaaaaaa

SEQ ID NO: 454936 - RNA, 24 nt, Human
uguagaaaacaaaaacaaaaaaac

SEQ ID NO: 454937 - RNA, 18 nt, Human
ugugcagcucccaaagag

SEQ ID NO: 454938 - RNA, 20 nt, Human
uucaacuugcagcauccauc

SEQ ID NO: 454939 - RNA, 19 nt, Human
uucacaaacaaucuaccau

SEQ ID NO: 454940 - RNA, 19 nt, Human
aagaugcagcagugugugg

SEQ ID NO: 454941 - RNA, 22 nt, Human
aagaugcagcaguguguggagc

SEQ ID NO: 454942 - RNA, 24 nt, Human
aagaugcagcaguguguggagcag

SEQ ID NO: 454943 - RNA, 19 nt, Human
acccgguggccgcuaggac

SEQ ID NO: 454944 - RNA, 23 nt, Human
aggaggcaauggacccuguugag

SEQ ID NO: 454945 - RNA, 23 nt, Human
auggggcaagggggugugggugg

SEQ ID NO: 454946 - RNA, 23 nt, Human
caggcgcccagccgccugcgccc

SEQ ID NO: 454947 - RNA, 22 nt, Human
cagggugcccacuucccugcuc

SEQ ID NO: 454948 - RNA, 20 nt, Human
ccaggcgcccagccgccugc

SEQ ID NO: 454949 - RNA, 21 nt, Human
ccagggcccgggucccagcgg

SEQ ID NO: 454950 - RNA, 18 nt, Human
cccugagacccaagaugc

SEQ ID NO: 454951 - RNA, 19 nt, Human
ccgcuaggacugaggaccc

SEQ ID NO: 454952 - RNA, 18 nt, Human
ccggagccagggcccggg

SEQ ID NO: 454953 - RNA, 20 nt, Human
ccuuucagacccgguggccg

SEQ ID NO: 454954 - RNA, 20 nt, Human
cuccaaguucuggaggcgag

SEQ ID NO: 454955 - RNA, 20 nt, Human
cuggugcuggaggccucagg

SEQ ID NO: 454956 - RNA, 24 nt, Human
cuucccugcuccaaguucuggagg

SEQ ID NO: 454957 - RNA, 21 nt, Human
gaggacccaggcgacccaaaa

SEQ ID NO: 454958 - RNA, 18 nt, Human
gccaggcgcccagccgcc

SEQ ID NO: 454959 - RNA, 24 nt, Human
gcccgggucccagcggaagggcuc

SEQ ID NO: 454960 - RNA, 22 nt, Human
gccgcccugccugacccgggag

SEQ ID NO: 454961 - RNA, 19 nt, Human
gcggagagcagcucccauc

SEQ ID NO: 454962 - RNA, 20 nt, Human
gcggcccaggcuggucgggu

SEQ ID NO: 454963 - RNA, 18 nt, Human
ggacccuguugaggcagg

SEQ ID NO: 454964 - RNA, 20 nt, Human
gggguguggguggguagggg

SEQ ID NO: 454965 - RNA, 21 nt, Human
gggguguggguggguaggggc

SEQ ID NO: 454966 - RNA, 21 nt, Human
gggugcccacuucccugcucc

SEQ ID NO: 454967 - RNA, 22 nt, Human
ggucagaguggggguuccccag

SEQ ID NO: 454968 - RNA, 20 nt, Human
uaggggcucuucuccgacuu

SEQ ID NO: 454969 - RNA, 23 nt, Human
uccaaguucuggaggcgaggagg

SEQ ID NO: 454970 - RNA, 21 nt, Human
uccgcuaggacugaggaccca

SEQ ID NO: 454971 - RNA, 20 nt, Human
ucgccaggcgcccagccgcc

SEQ ID NO: 454972 - RNA, 18 nt, Human
ucugggucccugagaccc

SEQ ID NO: 454973 - RNA, 24 nt, Human
ugcagcaguguguggagcaggggg

SEQ ID NO: 454974 - RNA, 21 nt, Human
ugcagggaaugcggcccaggc

SEQ ID NO: 454975 - RNA, 19 nt, Human
ugcgucgaggaugcugaca

SEQ ID NO: 454976 - RNA, 20 nt, Human
uggacccuguugaggcaggg

SEQ ID NO: 454977 - RNA, 18 nt, Human
uggaggccucagggugcc

SEQ ID NO: 454978 - RNA, 20 nt, Human
uggguggguaggggcucuuc

SEQ ID NO: 454979 - RNA, 19 nt, Human
uggugcuggaggccucagg

SEQ ID NO: 454980 - RNA, 23 nt, Human
ugucugggucccugagacccaag

SEQ ID NO: 454981 - RNA, 23 nt, Human
uguguggagcagggggccgcccu

SEQ ID NO: 454982 - RNA, 22 nt, Human
aaaaaaaccagcuccggccgga

SEQ ID NO: 454983 - RNA, 21 nt, Human
aaaaacauuuucagggaggcu

SEQ ID NO: 454984 - RNA, 22 nt, Human
aaaacaccugcucacucacuga

SEQ ID NO: 454985 - RNA, 26 nt, Human
aacacaguuuauuacugaacugcacu

SEQ ID NO: 454986 - RNA, 19 nt, Human
aauucuagaaaacuagcug

SEQ ID NO: 454987 - RNA, 23 nt, Human
accagcucuccacgugcacgcgc

SEQ ID NO: 454988 - RNA, 19 nt, Human
acccuggggcucccauagc

SEQ ID NO: 454989 - RNA, 19 nt, Human
acugcacuuucaccuucac

SEQ ID NO: 454990 - RNA, 22 nt, Human
agaagggggugggaggguagag

SEQ ID NO: 454991 - RNA, 19 nt, Human
agaugccacaggcugcucu

SEQ ID NO: 454992 - RNA, 20 nt, Human
agcuccuggccaggccacuc

SEQ ID NO: 454993 - RNA, 19 nt, Human
aggaaccagcccccucgcu

SEQ ID NO: 454994 - RNA, 23 nt, Human
aggcaggcaggugcagcccccgg

SEQ ID NO: 454995 - RNA, 20 nt, Human
aggcaggugcagcccccgga

SEQ ID NO: 454996 - RNA, 22 nt, Human
aggccaaggguggagcagaaga

SEQ ID NO: 454997 - RNA, 21 nt, Human
agggaacugaggugugggggu

SEQ ID NO: 454998 - RNA, 23 nt, Human
agggaggcuaagggguaaggguu

SEQ ID NO: 454999 - RNA, 22 nt, Human
agggaggggaagggacuagggu

SEQ ID NO: 455000 - RNA, 22 nt, Human
agggaugggcucaaccagucca

SEQ ID NO: 455001 - RNA, 19 nt, Human
aggucgggagaggaggugg

SEQ ID NO: 455002 - RNA, 22 nt, Human
agguucugaaaacuuucaagcu

SEQ ID NO: 455003 - RNA, 23 nt, Human
aguaaacacaguuuauuacugaa

SEQ ID NO: 455004 - RNA, 22 nt, Human
auagcucccuuucaccucaggg

SEQ ID NO: 455005 - RNA, 19 nt, Human
augcagcaggcucuccuuc

SEQ ID NO: 455006 - RNA, 21 nt, Human
caaacaucaaaacaaaggcaa

SEQ ID NO: 455007 - RNA, 25 nt, Human
caaacccuuccauaccugccagccu

SEQ ID NO: 455008 - RNA, 21 nt, Human
caaagagcuggaacaagugug

SEQ ID NO: 455009 - RNA, 21 nt, Human
caagcagccugaaucccuagu

SEQ ID NO: 455010 - RNA, 22 nt, Human
cacagacuauuucaaagagcug

SEQ ID NO: 455011 - RNA, 18 nt, Human
cacaggcugcucuuguag

SEQ ID NO: 455012 - RNA, 19 nt, Human
caccaugaggagcagccca

SEQ ID NO: 455013 - RNA, 21 nt, Human
cacugcaagccagcagcuccu

SEQ ID NO: 455014 - RNA, 22 nt, Human
cagaaaaacauuuucagggagg

SEQ ID NO: 455015 - RNA, 24 nt, Human
cagcccaaggcaaagaugccacag

SEQ ID NO: 455016 - RNA, 22 nt, Human
cagcccccggaagaucuuuugu

SEQ ID NO: 455017 - RNA, 18 nt, Human
cagcccuaccccacccca

SEQ ID NO: 455018 - RNA, 22 nt, Human
caggcucuccuuccugcccuuc

SEQ ID NO: 455019 - RNA, 18 nt, Human
cagggaggcuaaggggua

SEQ ID NO: 455020 - RNA, 21 nt, Human
caucaaaacaaaggcaaucua

SEQ ID NO: 455021 - RNA, 19 nt, Human
caucaaaacaaaggcaauu

SEQ ID NO: 455022 - RNA, 24 nt, Human
caucuuuaucccaagcagccugaa

SEQ ID NO: 455023 - RNA, 24 nt, Human
ccaaaacaccugcucacucacuga

SEQ ID NO: 455024 - RNA, 23 nt, Human
ccacaaacaucaaaacaaaggca

SEQ ID NO: 455025 - RNA, 22 nt, Human
ccaccaugaggagcagcccaag

SEQ ID NO: 455026 - RNA, 21 nt, Human
ccacccuagcuuuggcauggg

SEQ ID NO: 455027 - RNA, 21 nt, Human
ccaggccacucuggccuuggc

SEQ ID NO: 455028 - RNA, 24 nt, Human
ccauaccugccagccuccuuugga

SEQ ID NO: 455029 - RNA, 21 nt, Human
ccaugaggagcagcccaaggc

SEQ ID NO: 455030 - RNA, 20 nt, Human
cccagccacaaacccuucca

SEQ ID NO: 455031 - RNA, 20 nt, Human
ccccaugcagcaggcucucc

SEQ ID NO: 455032 - RNA, 21 nt, Human
ccucagggcugaguccccuga

SEQ ID NO: 455033 - RNA, 27 nt, Human
ccuccuuuggacagauuuuguggaaau

SEQ ID NO: 455034 - RNA, 25 nt, Human
ccuggaccagggcaggggagggagc

SEQ ID NO: 455035 - RNA, 18 nt, Human
cgacccggcaggcuggga

SEQ ID NO: 455036 - RNA, 18 nt, Human
cggccucgcgguggcugg

SEQ ID NO: 455037 - RNA, 18 nt, Human
cgggagaggagguggcug

SEQ ID NO: 455038 - RNA, 22 nt, Human
cuccgggcaccagcucuccacg

SEQ ID NO: 455039 - RNA, 18 nt, Human
cuccugcccccagccaca

SEQ ID NO: 455040 - RNA, 18 nt, Human
cucgucucugguuaguga

SEQ ID NO: 455041 - RNA, 18 nt, Human
cucuccuuccugcccuuc

SEQ ID NO: 455042 - RNA, 23 nt, Human
cuggaacaagugugggguggggg

SEQ ID NO: 455043 - RNA, 19 nt, Human
cuggggaagagguucugaa

SEQ ID NO: 455044 - RNA, 20 nt, Human
cuuaacaaaaauaguauauc

SEQ ID NO: 455045 - RNA, 23 nt, Human
cuucuaagauccaaagccaagau

SEQ ID NO: 455046 - RNA, 18 nt, Human
gaacccagguuagugugg

SEQ ID NO: 455047 - RNA, 18 nt, Human
gaagggggugggagggua

SEQ ID NO: 455048 - RNA, 23 nt, Human
gaagggggugggaggguagagug

SEQ ID NO: 455049 - RNA, 27 nt, Human
gagccagggaggggaagggacuagggu

SEQ ID NO: 455050 - RNA, 26 nt, Human
gagcccgggguggcugggaccaaagu

SEQ ID NO: 455051 - RNA, 20 nt, Human
gagguggcugcggggaugcc

SEQ ID NO: 455052 - RNA, 20 nt, Human
gauccaaagccaagauaaga

SEQ ID NO: 455053 - RNA, 19 nt, Human
gaugagacaggccaagggu

SEQ ID NO: 455054 - RNA, 21 nt, Human
gaugagacaggccaagggugg

SEQ ID NO: 455055 - RNA, 24 nt, Human
gcaaaggcaggcaggugcagcccc

SEQ ID NO: 455056 - RNA, 21 nt, Human
gcaccagcucuccacgugcac

SEQ ID NO: 455057 - RNA, 19 nt, Human
gcacgcgcacugcaagcca

SEQ ID NO: 455058 - RNA, 24 nt, Human
gcagaagagagagggaggccugaa

SEQ ID NO: 455059 - RNA, 19 nt, Human
gcaggggagggagcaucag

SEQ ID NO: 455060 - RNA, 20 nt, Human
gcaucuuuaucccaagcagc

SEQ ID NO: 455061 - RNA, 25 nt, Human
gcauguagugguucuccugguggca

SEQ ID NO: 455062 - RNA, 21 nt, Human
gccaguccagaggugaggagg

SEQ ID NO: 455063 - RNA, 19 nt, Human
gccuggcugcccaggcugg

SEQ ID NO: 455064 - RNA, 21 nt, Human
gcgacccggcaggcugggagc

SEQ ID NO: 455065 - RNA, 22 nt, Human
gcuccuggccaggccacucugg

SEQ ID NO: 455066 - RNA, 23 nt, Human
gcugaacugcaagggccacccua

SEQ ID NO: 455067 - RNA, 18 nt, Human
gcuggaacaagugugggg

SEQ ID NO: 455068 - RNA, 19 nt, Human
gcuggcaaaaaaaccagcu

SEQ ID NO: 455069 - RNA, 19 nt, Human
ggaccagggcaggggaggg

SEQ ID NO: 455070 - RNA, 25 nt, Human
ggaggcuaagggguaaggguugcac

SEQ ID NO: 455071 - RNA, 23 nt, Human
gggaacccagguuagugugggga

SEQ ID NO: 455072 - RNA, 20 nt, Human
gggaagggacuaggguggug

SEQ ID NO: 455073 - RNA, 23 nt, Human
gggcaggggagggagcaucaggc

SEQ ID NO: 455074 - RNA, 21 nt, Human
gggggugggaggguagagugg

SEQ ID NO: 455075 - RNA, 19 nt, Human
gggguggggguugggggag

SEQ ID NO: 455076 - RNA, 21 nt, Human
gggguggggguugggggaggg

SEQ ID NO: 455077 - RNA, 22 nt, Human
gggguggggguugggggagggg

SEQ ID NO: 455078 - RNA, 20 nt, Human
gguggagcagagaagggggu

SEQ ID NO: 455079 - RNA, 22 nt, Human
gguggcugggaccccuggggau

SEQ ID NO: 455080 - RNA, 20 nt, Human
gguugggggaggggcagaug

SEQ ID NO: 455081 - RNA, 24 nt, Human
guggagcagagaagggggugggag

SEQ ID NO: 455082 - RNA, 21 nt, Human
guggcugggaccccuggggau

SEQ ID NO: 455083 - RNA, 23 nt, Human
uaacaaaaauaguauaucaucuu

SEQ ID NO: 455084 - RNA, 19 nt, Human
uagaaaacuagcugcaagg

SEQ ID NO: 455085 - RNA, 19 nt, Human
uagucuccuuucuggggaa

SEQ ID NO: 455086 - RNA, 20 nt, Human
uaucccaagcagccugaauc

SEQ ID NO: 455087 - RNA, 20 nt, Human
ucaaagagcuggaacaagug

SEQ ID NO: 455088 - RNA, 19 nt, Human
ucacaggucgggagaggag

SEQ ID NO: 455089 - RNA, 22 nt, Human
ucaccuucacacagacuauuuc

SEQ ID NO: 455090 - RNA, 19 nt, Human
ucagguagggcccuccugc

SEQ ID NO: 455091 - RNA, 22 nt, Human
uccauuguccaaaacaccugcu

SEQ ID NO: 455092 - RNA, 25 nt, Human
uccccugaacccaccaugaggagca

SEQ ID NO: 455093 - RNA, 18 nt, Human
ucccuagucaaaaguggc

SEQ ID NO: 455094 - RNA, 23 nt, Human
ucccuagucaaaaguggccccua

SEQ ID NO: 455095 - RNA, 18 nt, Human
ucccuggaccagggcagg

SEQ ID NO: 455096 - RNA, 23 nt, Human
uccuugcaucuuuaucccaagca

SEQ ID NO: 455097 - RNA, 19 nt, Human
ucugaaaacuuucaagcuc

SEQ ID NO: 455098 - RNA, 19 nt, Human
ucugguuagugauucucuu

SEQ ID NO: 455099 - RNA, 18 nt, Human
ugaacugcaagggccacc

SEQ ID NO: 455100 - RNA, 22 nt, Human
ugaggccaagggaacugagguu

SEQ ID NO: 455101 - RNA, 23 nt, Human
ugagucucgucucugguuaguga

SEQ ID NO: 455102 - RNA, 18 nt, Human
ugcauguagugguucucc

SEQ ID NO: 455103 - RNA, 25 nt, Human
ugcccaggcuggacaggcauggggc

SEQ ID NO: 455104 - RNA, 21 nt, Human
ugccugagguagggaagaccc

SEQ ID NO: 455105 - RNA, 21 nt, Human
uggaaauuuugugaauucuga

SEQ ID NO: 455106 - RNA, 18 nt, Human
uggaacaaguguggggug

SEQ ID NO: 455107 - RNA, 21 nt, Human
uggaaggaaagggaacccagg

SEQ ID NO: 455108 - RNA, 18 nt, Human
uggacggaggauguggug

SEQ ID NO: 455109 - RNA, 22 nt, Human
uggacggaggaugugguggagc

SEQ ID NO: 455110 - RNA, 19 nt, Human
uggagcagagaagggggug

SEQ ID NO: 455111 - RNA, 18 nt, Human
uggcagaaaaacauuuuc

SEQ ID NO: 455112 - RNA, 21 nt, Human
uggcagaaaaacauuuucagg

SEQ ID NO: 455113 - RNA, 23 nt, Human
uggcagaaaaacauuuucaggga

SEQ ID NO: 455114 - RNA, 18 nt, Human
uggcauggggugcuuccu

SEQ ID NO: 455115 - RNA, 20 nt, Human
uggccaggccacucuggccu

SEQ ID NO: 455116 - RNA, 23 nt, Human
uggcugcccaggcuggacaggca

SEQ ID NO: 455117 - RNA, 22 nt, Human
ugggagccagggaggggaaggg

SEQ ID NO: 455118 - RNA, 18 nt, Human
ugggcccaguuggucccu

SEQ ID NO: 455119 - RNA, 18 nt, Human
uggucccucaguaugguc

SEQ ID NO: 455120 - RNA, 25 nt, Human
ugguggcaauggcggcuggacggag

SEQ ID NO: 455121 - RNA, 19 nt, Human
ugugguggagcagagaagg

SEQ ID NO: 455122 - RNA, 21 nt, Human
ugugguggagcagagaagggg

SEQ ID NO: 455123 - RNA, 22 nt, Human
uguuccugauagcucccuuuca

SEQ ID NO: 455124 - RNA, 23 nt, Human
uucaccuucacacagacuauuuc

SEQ ID NO: 455125 - RNA, 21 nt, Human
uucuagucagcccuaccccac

SEQ ID NO: 455126 - RNA, 22 nt, Human
uuucuggggaagagguucugaa

SEQ ID NO: 455127 - RNA, 23 nt, Human
uuuuuuuuuucacugaguaaaca

SEQ ID NO: 455128 - RNA, 22 nt, Human
uuuuuuuuuuuuucacugagua

SEQ ID NO: 455129 - RNA, 23 nt, Human
uuuuuuuuuuuuuuuuuucacug

SEQ ID NO: 455130 - RNA, 24 nt, Human
uuuuuuuuuuuuuuuuuucacuga

SEQ ID NO: 455131 - RNA, 20 nt, Human
aaagaaagccccagcgcucu

SEQ ID NO: 455132 - RNA, 25 nt, Human
acacugaggggguucuagagaggga

SEQ ID NO: 455133 - RNA, 24 nt, Human
accccacagcccugaguggaauag

SEQ ID NO: 455134 - RNA, 22 nt, Human
acuuggaaaagcacacgaagag

SEQ ID NO: 455135 - RNA, 22 nt, Human
agaaaaacuagaaaaaguaggg

SEQ ID NO: 455136 - RNA, 18 nt, Human
aggaaagaggaaaagagg

SEQ ID NO: 455137 - RNA, 22 nt, Human
aggaaggagcuacaguggccga

SEQ ID NO: 455138 - RNA, 21 nt, Human
aggcaggcuguguacucuggg

SEQ ID NO: 455139 - RNA, 23 nt, Human
aggcaggcuguguacucugggga

SEQ ID NO: 455140 - RNA, 24 nt, Human
aguuuuaaacaauuuauuuuuggc

SEQ ID NO: 455141 - RNA, 18 nt, Human
caaaaagaaagccccagc

SEQ ID NO: 455142 - RNA, 22 nt, Human
caaccaccaccccacagcccug

SEQ ID NO: 455143 - RNA, 21 nt, Human
caccccacagcccugagugga

SEQ ID NO: 455144 - RNA, 21 nt, Human
cacugaggggguucuagagag

SEQ ID NO: 455145 - RNA, 19 nt, Human
cagcugacgggaaaggggg

SEQ ID NO: 455146 - RNA, 20 nt, Human
ccaccccacagcccugagug

SEQ ID NO: 455147 - RNA, 19 nt, Human
cccaaagaaugauaaaguu

SEQ ID NO: 455148 - RNA, 20 nt, Human
cccacagcccugaguggaau

SEQ ID NO: 455149 - RNA, 19 nt, Human
ccccacagcccugagugga

SEQ ID NO: 455150 - RNA, 23 nt, Human
ccccagcgcucuagagcucagcu

SEQ ID NO: 455151 - RNA, 23 nt, Human
cccgcacgccccgaccuuccauc

SEQ ID NO: 455152 - RNA, 24 nt, Human
cgcucuagagcucagcugacggga

SEQ ID NO: 455153 - RNA, 21 nt, Human
cguccgagagcgaggagcggg

SEQ ID NO: 455154 - RNA, 18 nt, Human
gaggaaagaggaaaagag

SEQ ID NO: 455155 - RNA, 21 nt, Human
gcaaccaccaccccacagccc

SEQ ID NO: 455156 - RNA, 21 nt, Human
gcccugaguggaauaggaaga

SEQ ID NO: 455157 - RNA, 19 nt, Human
gcuccaagacagggguggg

SEQ ID NO: 455158 - RNA, 20 nt, Human
ggaaaguggagcaaggaagg

SEQ ID NO: 455159 - RNA, 18 nt, Human
ggaggaaagaggaaaaga

SEQ ID NO: 455160 - RNA, 23 nt, Human
ggaggaaagaggaaaagaggagg

SEQ ID NO: 455161 - RNA, 23 nt, Human
gggcaaccaccaccccacagccc

SEQ ID NO: 455162 - RNA, 21 nt, Human
ggguggguuccagcugcccgc

SEQ ID NO: 455163 - RNA, 18 nt, Human
guacucuggggaaagugg

SEQ ID NO: 455164 - RNA, 20 nt, Human
gucaucuuguagcagcuucu

SEQ ID NO: 455165 - RNA, 22 nt, Human
uacacgugaaucgauucugcac

SEQ ID NO: 455166 - RNA, 22 nt, Human
uacccggagcuccaagacaggg

SEQ ID NO: 455167 - RNA, 23 nt, Human
uacccggagcuccaagacagggg

SEQ ID NO: 455168 - RNA, 23 nt, Human
ucagucucgaaaccuggggcgug

SEQ ID NO: 455169 - RNA, 22 nt, Human
uccaagacagggguggguucca

SEQ ID NO: 455170 - RNA, 21 nt, Human
ucuacauugggguaagugcag

SEQ ID NO: 455171 - RNA, 18 nt, Human
ucuagagagggaggggug

SEQ ID NO: 455172 - RNA, 19 nt, Human
ucucgaaaccuggggcgug

SEQ ID NO: 455173 - RNA, 22 nt, Human
ucugcacugaaauaacuaggga

SEQ ID NO: 455174 - RNA, 21 nt, Human
ucuguccuggaggagggaggc

SEQ ID NO: 455175 - RNA, 22 nt, Human
ucuucuguagggggacugugga

SEQ ID NO: 455176 - RNA, 21 nt, Human
ugaguggaauaggaagacuug

SEQ ID NO: 455177 - RNA, 22 nt, Human
ugcagaaaaacuagaaaaagua

SEQ ID NO: 455178 - RNA, 21 nt, Human
uggaaauguuuugggagaucu

SEQ ID NO: 455179 - RNA, 20 nt, Human
uggaggagggaggcgggcag

SEQ ID NO: 455180 - RNA, 20 nt, Human
uggcaaaaacagguagggca

SEQ ID NO: 455181 - RNA, 26 nt, Human
uggcaaaaacagguagggcaaccacc

SEQ ID NO: 455182 - RNA, 21 nt, Human
uggcguccgagagcgaggagc

SEQ ID NO: 455183 - RNA, 24 nt, Human
uucaagaagucgaucaaaaagaaa

SEQ ID NO: 455184 - RNA, 21 nt, Human
uugaauggaaguucuguguug

SEQ ID NO: 455185 - RNA, 22 nt, Human
uugggucuguuacccaaagaau

SEQ ID NO: 455186 - RNA, 21 nt, Human
uuguagcagcuucugagaaag

SEQ ID NO: 455187 - RNA, 22 nt, Human
uuuggcaaaaacagguagggca

SEQ ID NO: 455188 - RNA, 27 nt, Human
aaaaaaugaagacauuuaaaauacuug

SEQ ID NO: 455189 - RNA, 18 nt, Human
aaauaaccaacagccaau

SEQ ID NO: 455190 - RNA, 21 nt, Human
aacuacaaaaaucaugaaaug

SEQ ID NO: 455191 - RNA, 21 nt, Human
aacuguguuuugggagguaaa

SEQ ID NO: 455192 - RNA, 20 nt, Human
aagaaaaacgauaugaacau

SEQ ID NO: 455193 - RNA, 21 nt, Human
aagaacacaucuaacaaaccu

SEQ ID NO: 455194 - RNA, 18 nt, Human
aagaacuguguuuuggga

SEQ ID NO: 455195 - RNA, 18 nt, Human
aaguaauuuuucuaaugc

SEQ ID NO: 455196 - RNA, 21 nt, Human
aauuaacugcaagacacucug

SEQ ID NO: 455197 - RNA, 27 nt, Human
acagguuuucccccagaugacuuaaaa

SEQ ID NO: 455198 - RNA, 20 nt, Human
accacauaaugagaagcaca

SEQ ID NO: 455199 - RNA, 19 nt, Human
accucccauuaaaaagagu

SEQ ID NO: 455200 - RNA, 19 nt, Human
acgcacacuuguuugcugc

SEQ ID NO: 455201 - RNA, 23 nt, Human
acugcucuguacaaaaauacagu

SEQ ID NO: 455202 - RNA, 26 nt, Human
agccaaaaggcaaaaaagagggaccc

SEQ ID NO: 455203 - RNA, 23 nt, Human
aggugauaaccagaugaauucua

SEQ ID NO: 455204 - RNA, 27 nt, Human
agugaaacaguaaagaacauagagcaa

SEQ ID NO: 455205 - RNA, 22 nt, Human
augugugugaguauauauaugu

SEQ ID NO: 455206 - RNA, 20 nt, Human
auuguauuuuagaugagaag

SEQ ID NO: 455207 - RNA, 21 nt, Human
caaaagacucuauaauacuau

SEQ ID NO: 455208 - RNA, 25 nt, Human
caagcaaauaaccaacagccaaugu

SEQ ID NO: 455209 - RNA, 21 nt, Human
caagcaaauaaccaacagccu

SEQ ID NO: 455210 - RNA, 21 nt, Human
cacuggagugauaaacagguu

SEQ ID NO: 455211 - RNA, 28 nt, Human
cagaaacuaauagcauaaacagcaugaa

SEQ ID NO: 455212 - RNA, 21 nt, Human
caggaaaaacagagauccuca

SEQ ID NO: 455213 - RNA, 22 nt, Human
cagguacaugcuaauccauaua

SEQ ID NO: 455214 - RNA, 26 nt, Human
cagguuuucccccagaugacuuaaaa

SEQ ID NO: 455215 - RNA, 22 nt, Human
caguaaacugcaaauaugugug

SEQ ID NO: 455216 - RNA, 21 nt, Human
caucaguuaacuucagaggac

SEQ ID NO: 455217 - RNA, 19 nt, Human
cccaggaaaaacagagauc

SEQ ID NO: 455218 - RNA, 21 nt, Human
cccagggagacgcugauugcc

SEQ ID NO: 455219 - RNA, 24 nt, Human
cggaauaacuagcccugcugagua

SEQ ID NO: 455220 - RNA, 19 nt, Human
cucaagcaaauaaccaaca

SEQ ID NO: 455221 - RNA, 24 nt, Human
cucucuauauuuaugucuuuaaaa

SEQ ID NO: 455222 - RNA, 24 nt, Human
cugcuugaugcuccacaaguguuu

SEQ ID NO: 455223 - RNA, 20 nt, Human
cugucacuuugagcuuguca

SEQ ID NO: 455224 - RNA, 26 nt, Human
gaaaucggaauaacuagcccugcuga

SEQ ID NO: 455225 - RNA, 20 nt, Human
gauaugaacauauuggaagu

SEQ ID NO: 455226 - RNA, 19 nt, Human
gcaaaagcuuuaagguacc

SEQ ID NO: 455227 - RNA, 20 nt, Human
gcaguucauuuuucaagggc

SEQ ID NO: 455228 - RNA, 21 nt, Human
gcuaaaguaagacuaaaccug

SEQ ID NO: 455229 - RNA, 20 nt, Human
gcuuaugccaacugcucccc

SEQ ID NO: 455230 - RNA, 18 nt, Human
ggaauaacuagcccugcu

SEQ ID NO: 455231 - RNA, 19 nt, Human
guagaucuauauccauaga

SEQ ID NO: 455232 - RNA, 20 nt, Human
guugcugaaaucccuaucca

SEQ ID NO: 455233 - RNA, 19 nt, Human
uaaaauggauguaaaagcu

SEQ ID NO: 455234 - RNA, 23 nt, Human
uaaacagaauuaacacaaguuug

SEQ ID NO: 455235 - RNA, 18 nt, Human
uaaagguuucugucugug

SEQ ID NO: 455236 - RNA, 19 nt, Human
uaacaguggaauccuuguc

SEQ ID NO: 455237 - RNA, 21 nt, Human
uaacugcaagacacucugccc

SEQ ID NO: 455238 - RNA, 22 nt, Human
uaagaacacaucuaacaaaccu

SEQ ID NO: 455239 - RNA, 20 nt, Human
uaaguaugaauaccaaucua

SEQ ID NO: 455240 - RNA, 22 nt, Human
uacuuccuuccauugaacaguc

SEQ ID NO: 455241 - RNA, 21 nt, Human
uaggaccaagagaagugccuc

SEQ ID NO: 455242 - RNA, 18 nt, Human
uaggauaagcaggcggua

SEQ ID NO: 455243 - RNA, 18 nt, Human
uaggcacagcuuuaggca

SEQ ID NO: 455244 - RNA, 22 nt, Human
uagggaacaacuuauuaccauu

SEQ ID NO: 455245 - RNA, 18 nt, Human
uauauauauguguguaua

SEQ ID NO: 455246 - RNA, 20 nt, Human
uauaugugugugaguauaua

SEQ ID NO: 455247 - RNA, 24 nt, Human
uaucuaacaauggguuuguggcua

SEQ ID NO: 455248 - RNA, 22 nt, Human
uaugccaacugcuccccugcag

SEQ ID NO: 455249 - RNA, 23 nt, Human
ucacuggagugauaaacagguuu

SEQ ID NO: 455250 - RNA, 18 nt, Human
ucccuuaacauaaaucca

SEQ ID NO: 455251 - RNA, 21 nt, Human
ucuaguguagggcucuuugcu

SEQ ID NO: 455252 - RNA, 18 nt, Human
ucuguacaaaaauacagu

SEQ ID NO: 455253 - RNA, 22 nt, Human
ugaaagaagaacuguguuuugg

SEQ ID NO: 455254 - RNA, 25 nt, Human
ugaaagaagaacuguguuuugggag

SEQ ID NO: 455255 - RNA, 25 nt, Human
ugaaauuucuaggcacagcuuuagg

SEQ ID NO: 455256 - RNA, 21 nt, Human
ugaaguauauuuuacuuuuaa

SEQ ID NO: 455257 - RNA, 22 nt, Human
ugaguauauauauguguguaua

SEQ ID NO: 455258 - RNA, 22 nt, Human
ugauaaacagguuuucccccag

SEQ ID NO: 455259 - RNA, 23 nt, Human
ugcuccacaaguguuuuagaaaa

SEQ ID NO: 455260 - RNA, 23 nt, Human
uggguuuguggcuaaaaauuaug

SEQ ID NO: 455261 - RNA, 18 nt, Human
uguacaaaaauacagucu

SEQ ID NO: 455262 - RNA, 21 nt, Human
ugugaaacugcaaacucaaaa

SEQ ID NO: 455263 - RNA, 23 nt, Human
ugugauguauuuauucgcuuuug

SEQ ID NO: 455264 - RNA, 26 nt, Human
uguguauaucuauaucuauagaugua

SEQ ID NO: 455265 - RNA, 21 nt, Human
ugugugugaguauauauaugu

SEQ ID NO: 455266 - RNA, 22 nt, Human
uguguuuugggagguaaaacaa

SEQ ID NO: 455267 - RNA, 23 nt, Human
uuaacagauuuugcaauacagua

SEQ ID NO: 455268 - RNA, 20 nt, Human
uuagcccaucaguuaacuuc

SEQ ID NO: 455269 - RNA, 21 nt, Human
uucuaaauguugcuuaugcca

SEQ ID NO: 455270 - RNA, 18 nt, Human
uuguacugagauuguuag

SEQ ID NO: 455271 - RNA, 19 nt, Human
uuuauuuuuuuccacauag

SEQ ID NO: 455272 - RNA, 25 nt, Human
uuuguuggaugguggugguuguuuu

SEQ ID NO: 455273 - RNA, 18 nt, Human
uuuuuuggcuguuguuuu

SEQ ID NO: 455274 - RNA, 19 nt, Human
uuuuuuuuuuuuucacuuu

SEQ ID NO: 455275 - RNA, 25 nt, Human
uuuuuuuuuuuuuuuucacuuuuaa

SEQ ID NO: 455276 - RNA, 23 nt, Human
aaaaacauguuucuaaguccuuc

SEQ ID NO: 455277 - RNA, 24 nt, Human
aaaaggaaaaaaacauguuucuaa

SEQ ID NO: 455278 - RNA, 21 nt, Human
aaaguuuaaaaggaaaaaaac

SEQ ID NO: 455279 - RNA, 24 nt, Human
aagaaacauuauaacaacuucaua

SEQ ID NO: 455280 - RNA, 24 nt, Human
aagugccuuccccgaauucgcucc

SEQ ID NO: 455281 - RNA, 23 nt, Human
aauucgcucccucaaaccaacca

SEQ ID NO: 455282 - RNA, 19 nt, Human
acaugguggguccagcuug

SEQ ID NO: 455283 - RNA, 19 nt, Human
acgagcggagaaggagccg

SEQ ID NO: 455284 - RNA, 20 nt, Human
acuauaacacacuguacaug

SEQ ID NO: 455285 - RNA, 22 nt, Human
agaaaagaaacaaauguuccaa

SEQ ID NO: 455286 - RNA, 21 nt, Human
agaaggagccgggccggagaa

SEQ ID NO: 455287 - RNA, 21 nt, Human
aggaaaaaaacauguuucuaa

SEQ ID NO: 455288 - RNA, 22 nt, Human
aggcagggagccugcgauccgg

SEQ ID NO: 455289 - RNA, 25 nt, Human
caagugccuuccccgaauucgcucc

SEQ ID NO: 455290 - RNA, 18 nt, Human
cacacuguacaugguggg

SEQ ID NO: 455291 - RNA, 19 nt, Human
caggcagagaaaucaaagc

SEQ ID NO: 455292 - RNA, 27 nt, Human
cauccagacacgccucagugcuaccac

SEQ ID NO: 455293 - RNA, 18 nt, Human
ccacacaguucugaccac

SEQ ID NO: 455294 - RNA, 23 nt, Human
ccccaagcggacucgaggcggcg

SEQ ID NO: 455295 - RNA, 24 nt, Human
cccccaagcggacucgaggcggcg

SEQ ID NO: 455296 - RNA, 21 nt, Human
cccugcccuaccauacucccc

SEQ ID NO: 455297 - RNA, 25 nt, Human
ccuuccccgaauucgcucccucaaa

SEQ ID NO: 455298 - RNA, 19 nt, Human
cgaggcggcgagaaggagc

SEQ ID NO: 455299 - RNA, 18 nt, Human
cuacacaucucuaccagg

SEQ ID NO: 455300 - RNA, 24 nt, Human
cuacuggauuacauccaauagcau

SEQ ID NO: 455301 - RNA, 19 nt, Human
cucagugcuaccacucacg

SEQ ID NO: 455302 - RNA, 23 nt, Human
gagccugcgauccggcucuuuga

SEQ ID NO: 455303 - RNA, 19 nt, Human
gaguaggcagggagccugc

SEQ ID NO: 455304 - RNA, 19 nt, Human
gauaugagggguggggggg

SEQ ID NO: 455305 - RNA, 24 nt, Human
gcccuaccauacucccccaauccu

SEQ ID NO: 455306 - RNA, 19 nt, Human
ggcggcgagaaggagcggg

SEQ ID NO: 455307 - RNA, 24 nt, Human
ggcggcgagaaggagcggggggcg

SEQ ID NO: 455308 - RNA, 19 nt, Human
gggugggggggguuggcga

SEQ ID NO: 455309 - RNA, 22 nt, Human
gguggagagagauaugaggggu

SEQ ID NO: 455310 - RNA, 21 nt, Human
guacaugguggguccagcuug

SEQ ID NO: 455311 - RNA, 20 nt, Human
guuuaaaaggaaaaaaacaa

SEQ ID NO: 455312 - RNA, 23 nt, Human
uaaaaacaaacguaucccaaagc

SEQ ID NO: 455313 - RNA, 24 nt, Human
uaaaacaucgguuaucagcaauug

SEQ ID NO: 455314 - RNA, 21 nt, Human
uaacuuaaagcauccagacac

SEQ ID NO: 455315 - RNA, 18 nt, Human
uaccacaagcuucauuca

SEQ ID NO: 455316 - RNA, 19 nt, Human
uaguuguuguguguggaua

SEQ ID NO: 455317 - RNA, 18 nt, Human
uauaacacacuguacaug

SEQ ID NO: 455318 - RNA, 25 nt, Human
uauaucaccaagugccuuccccgaa

SEQ ID NO: 455319 - RNA, 21 nt, Human
ucaaagucuucuuuaaauaag

SEQ ID NO: 455320 - RNA, 20 nt, Human
uccuuuuacucauuuuuuuu

SEQ ID NO: 455321 - RNA, 25 nt, Human
ucuaaguccuucugacuggaguaau

SEQ ID NO: 455322 - RNA, 22 nt, Human
ucuguaaacaaaacaaaguuau

SEQ ID NO: 455323 - RNA, 24 nt, Human
ucuuacaggcagagaaaucaaagc

SEQ ID NO: 455324 - RNA, 23 nt, Human
ugacuuaaaaguuuaaaaggaaa

SEQ ID NO: 455325 - RNA, 21 nt, Human
ugaggggugggggggguuggc

SEQ ID NO: 455326 - RNA, 23 nt, Human
ugcauugaaaaguaaagaaacau

SEQ ID NO: 455327 - RNA, 24 nt, Human
ugcccugcccuaccauacuccccc

SEQ ID NO: 455328 - RNA, 25 nt, Human
ugcccugcccuaccauacuccccca

SEQ ID NO: 455329 - RNA, 24 nt, Human
uggugaaaaauuugcaugaauccc

SEQ ID NO: 455330 - RNA, 22 nt, Human
uucacaauaauuaaaacaucgg

SEQ ID NO: 455331 - RNA, 18 nt, Human
uugcaugaaucccacaga

SEQ ID NO: 455332 - RNA, 23 nt, Human
uuguauuaugacacauaugcaca

SEQ ID NO: 455333 - RNA, 25 nt, Human
uuuaaaaggaaaaaaacauguuucu

SEQ ID NO: 455334 - RNA, 21 nt, Human
uuugaaguuuucccccaagcg

SEQ ID NO: 455335 - RNA, 23 nt, Human
uuugaauuuauauuacacacuac

SEQ ID NO: 455336 - RNA, 25 nt, Human
uuuuauguacauuuccaagcaaccu

SEQ ID NO: 455337 - RNA, 20 nt, Human
uuuuuuuuuuuuuuuuucac

SEQ ID NO: 455338 - RNA, 24 nt, Human
uuuuuuuuuuuuuuuuucacgauu

SEQ ID NO: 455339 - RNA, 26 nt, Human
aaaaagauuaagcucaacagcaacua

SEQ ID NO: 455340 - RNA, 19 nt, Human
aaaacauaaaaaccccaaa

SEQ ID NO: 455341 - RNA, 18 nt, Human
aaacagaccacacuuuca

SEQ ID NO: 455342 - RNA, 21 nt, Human
aaacaucaaugaacacucuaa

SEQ ID NO: 455343 - RNA, 22 nt, Human
aaauguacaauuuguccuuuuu

SEQ ID NO: 455344 - RNA, 22 nt, Human
aacacuguaauacuguguacca

SEQ ID NO: 455345 - RNA, 18 nt, Human
aaggcauaaaauaaaaca

SEQ ID NO: 455346 - RNA, 20 nt, Human
acagguccagcaggccgcac

SEQ ID NO: 455347 - RNA, 18 nt, Human
acccauggcuuucagugc

SEQ ID NO: 455348 - RNA, 18 nt, Human
acccuuagaaauuaaguu

SEQ ID NO: 455349 - RNA, 19 nt, Human
acgugcagcauccucacag

SEQ ID NO: 455350 - RNA, 20 nt, Human
acugcaaaaucccaacugca

SEQ ID NO: 455351 - RNA, 23 nt, Human
agaauuuuccuucauuccuaaaa

SEQ ID NO: 455352 - RNA, 22 nt, Human
agcagcgccagcgacaccagca

SEQ ID NO: 455353 - RNA, 21 nt, Human
aggccuucgcugcugggaaca

SEQ ID NO: 455354 - RNA, 22 nt, Human
agguccagcaggccgcacagga

SEQ ID NO: 455355 - RNA, 21 nt, Human
agugcaauccuuaaaaauccc

SEQ ID NO: 455356 - RNA, 21 nt, Human
aguuguggaugauggagucga

SEQ ID NO: 455357 - RNA, 25 nt, Human
auaaaaacauucuaaaaauguacaa

SEQ ID NO: 455358 - RNA, 19 nt, Human
auacuaaaaccucuguugc

SEQ ID NO: 455359 - RNA, 20 nt, Human
aucaacguaacauuccccua

SEQ ID NO: 455360 - RNA, 22 nt, Human
auggccuucagaaauauuaaaa

SEQ ID NO: 455361 - RNA, 22 nt, Human
caacgcacgugaggccgcggcg

SEQ ID NO: 455362 - RNA, 19 nt, Human
caccagccacagagaugcc

SEQ ID NO: 455363 - RNA, 26 nt, Human
cagaaaaaaauuaaaaaccugaaacu

SEQ ID NO: 455364 - RNA, 19 nt, Human
cagaauacuugacauuuac

SEQ ID NO: 455365 - RNA, 18 nt, Human
cagaguccuaccacuucc

SEQ ID NO: 455366 - RNA, 22 nt, Human
cauaaaaaccccaaaaacagaa

SEQ ID NO: 455367 - RNA, 19 nt, Human
ccacugcccccuuccuugg

SEQ ID NO: 455368 - RNA, 23 nt, Human
ccagcgguacacgccgucccucu

SEQ ID NO: 455369 - RNA, 22 nt, Human
cccaaaaacagaauacuugaca

SEQ ID NO: 455370 - RNA, 18 nt, Human
cccauggcuuucagugcc

SEQ ID NO: 455371 - RNA, 19 nt, Human
cccccgcucaggucgcaca

SEQ ID NO: 455372 - RNA, 24 nt, Human
cccuaaauagcuguuguaauaagc

SEQ ID NO: 455373 - RNA, 19 nt, Human
ccgcagaggccuucgcugc

SEQ ID NO: 455374 - RNA, 19 nt, Human
ccgccgccucgcgcugcuc

SEQ ID NO: 455375 - RNA, 20 nt, Human
ccguaguuguggaugaugga

SEQ ID NO: 455376 - RNA, 22 nt, Human
cgcucacaucacaaggccucau

SEQ ID NO: 455377 - RNA, 20 nt, Human
cggcagcuccgagaaccagc

SEQ ID NO: 455378 - RNA, 26 nt, Human
cuaccacuucccacuguuuuccaagu

SEQ ID NO: 455379 - RNA, 23 nt, Human
cucacagccacucacagagccgc

SEQ ID NO: 455380 - RNA, 19 nt, Human
cuccgagucgcgcagcgag

SEQ ID NO: 455381 - RNA, 19 nt, Human
cucugcgcuguguagcucc

SEQ ID NO: 455382 - RNA, 20 nt, Human
cuggauuuaagguuaaccuc

SEQ ID NO: 455383 - RNA, 24 nt, Human
cuguuuuaauguuuugcuggauuu

SEQ ID NO: 455384 - RNA, 21 nt, Human
cuugcaaacucugcugaggac

SEQ ID NO: 455385 - RNA, 20 nt, Human
cuuggaggagggaaggaaau

SEQ ID NO: 455386 - RNA, 19 nt, Human
gacaccagcagcuugcugc

SEQ ID NO: 455387 - RNA, 19 nt, Human
gacuucggacggccucccu

SEQ ID NO: 455388 - RNA, 18 nt, Human
gaggaagucugaugaccg

SEQ ID NO: 455389 - RNA, 23 nt, Human
gagguucuuggggagcccguggg

SEQ ID NO: 455390 - RNA, 18 nt, Human
gcaaaacgcucuucagac

SEQ ID NO: 455391 - RNA, 19 nt, Human
gcaaaacgcucuucagacg

SEQ ID NO: 455392 - RNA, 21 nt, Human
gcagaaaaaaauuaaaaaccu

SEQ ID NO: 455393 - RNA, 20 nt, Human
gcagcuugcugcgcaccacc

SEQ ID NO: 455394 - RNA, 20 nt, Human
gcccaggucggccggguugu

SEQ ID NO: 455395 - RNA, 22 nt, Human
gcccguaguuguggaugaugga

SEQ ID NO: 455396 - RNA, 24 nt, Human
gccucgcgcugcuccgagcccagc

SEQ ID NO: 455397 - RNA, 20 nt, Human
gcugcuccgagcccagcagc

SEQ ID NO: 455398 - RNA, 25 nt, Human
ggagaauuuuccuucauuccuaaaa

SEQ ID NO: 455399 - RNA, 21 nt, Human
gggguuggagguucuugggga

SEQ ID NO: 455400 - RNA, 19 nt, Human
guagagcacgcccgccgcc

SEQ ID NO: 455401 - RNA, 23 nt, Human
guguagcugcccuggaauugacg

SEQ ID NO: 455402 - RNA, 20 nt, Human
guuaaccuuuggccucaacc

SEQ ID NO: 455403 - RNA, 24 nt, Human
uaaaaaaaccaaaaaauuuaaaag

SEQ ID NO: 455404 - RNA, 24 nt, Human
uaaaaaccccaaaaacagaauacu

SEQ ID NO: 455405 - RNA, 20 nt, Human
uaaaaaccugaaacugcuac

SEQ ID NO: 455406 - RNA, 26 nt, Human
uaaaaagauuaagcucaacagcaacu

SEQ ID NO: 455407 - RNA, 21 nt, Human
uaaaacacugguugccacagc

SEQ ID NO: 455408 - RNA, 21 nt, Human
uaaaacauaaaaaccccaaaa

SEQ ID NO: 455409 - RNA, 21 nt, Human
uaaagcaccuuuggauuaaaa

SEQ ID NO: 455410 - RNA, 24 nt, Human
uaaauuucagacaaaaggcuuuca

SEQ ID NO: 455411 - RNA, 22 nt, Human
uacagugaggacuuuuauuacu

SEQ ID NO: 455412 - RNA, 19 nt, Human
uaggaacagaacaaaacaa

SEQ ID NO: 455413 - RNA, 22 nt, Human
uaguuguggaugauggagucga

SEQ ID NO: 455414 - RNA, 21 nt, Human
uaugaaguuaggaacugcucu

SEQ ID NO: 455415 - RNA, 19 nt, Human
ucacacaugugaugagggc

SEQ ID NO: 455416 - RNA, 20 nt, Human
ucagaccacguguagcugcc

SEQ ID NO: 455417 - RNA, 18 nt, Human
ucagugccaccugacuca

SEQ ID NO: 455418 - RNA, 18 nt, Human
uccagaguccuaccacuu

SEQ ID NO: 455419 - RNA, 24 nt, Human
ucccagagauuagugcuaaucacu

SEQ ID NO: 455420 - RNA, 19 nt, Human
ucccuccggaaagaggccu

SEQ ID NO: 455421 - RNA, 22 nt, Human
uccgagcucgcugcuggcaaac

SEQ ID NO: 455422 - RNA, 23 nt, Human
uccgcagaggccuucgcugcugg

SEQ ID NO: 455423 - RNA, 21 nt, Human
ucgcugcugggaacacagccg

SEQ ID NO: 455424 - RNA, 18 nt, Human
ucucggguguguggccuc

SEQ ID NO: 455425 - RNA, 25 nt, Human
ucugcauugcauagaaauaaaauuc

SEQ ID NO: 455426 - RNA, 21 nt, Human
ugaaacagaccacacuuucag

SEQ ID NO: 455427 - RNA, 23 nt, Human
ugaaacagaccacacuuucagga

SEQ ID NO: 455428 - RNA, 24 nt, Human
ugaccgcaaaacgcucuucagacg

SEQ ID NO: 455429 - RNA, 25 nt, Human
ugagccuaggagggccagugauggc

SEQ ID NO: 455430 - RNA, 18 nt, Human
ugauguacaacgagcaag

SEQ ID NO: 455431 - RNA, 19 nt, Human
ugcacguaagacucacaca

SEQ ID NO: 455432 - RNA, 18 nt, Human
ugcagcauccucacagcc

SEQ ID NO: 455433 - RNA, 20 nt, Human
ugccacagcauucugaaaca

SEQ ID NO: 455434 - RNA, 21 nt, Human
ugccacagcauucugaaacag

SEQ ID NO: 455435 - RNA, 20 nt, Human
ugcccaggucggccggguug

SEQ ID NO: 455436 - RNA, 22 nt, Human
ugcuggcaaacucucaagucca

SEQ ID NO: 455437 - RNA, 19 nt, Human
uggagguggccgaucucac

SEQ ID NO: 455438 - RNA, 24 nt, Human
uggagguggccgaucucaccagcc

SEQ ID NO: 455439 - RNA, 19 nt, Human
uggccacugcccccuuccu

SEQ ID NO: 455440 - RNA, 20 nt, Human
uggccgaucucaccagccac

SEQ ID NO: 455441 - RNA, 22 nt, Human
uggccgaucucaccagccacag

SEQ ID NO: 455442 - RNA, 21 nt, Human
uggccuucagaaauauuaaaa

SEQ ID NO: 455443 - RNA, 18 nt, Human
ugguaguccuugcgggcc

SEQ ID NO: 455444 - RNA, 19 nt, Human
ugucaggaguccggcgggu

SEQ ID NO: 455445 - RNA, 23 nt, Human
ugucaggaguccggcggguggaa

SEQ ID NO: 455446 - RNA, 23 nt, Human
ugugaugagggcuuguuacaacg

SEQ ID NO: 455447 - RNA, 18 nt, Human
uuaaaaaccugaaacugc

SEQ ID NO: 455448 - RNA, 19 nt, Human
uuaggaacagaacaaaaca

SEQ ID NO: 455449 - RNA, 19 nt, Human
uucaacacuguaauacugu

SEQ ID NO: 455450 - RNA, 20 nt, Human
uucaguaccaaagccuucuc

SEQ ID NO: 455451 - RNA, 21 nt, Human
uucagugccaccugacucauu

SEQ ID NO: 455452 - RNA, 18 nt, Human
uucaugaggcugauuguc

SEQ ID NO: 455453 - RNA, 19 nt, Human
uucaugaggcugauugucc

SEQ ID NO: 455454 - RNA, 22 nt, Human
uuccuuggugaacaguggagca

SEQ ID NO: 455455 - RNA, 19 nt, Human
uucggacggccucccugga

SEQ ID NO: 455456 - RNA, 26 nt, Human
uugaagacuuuagcauuuucgauaag

SEQ ID NO: 455457 - RNA, 22 nt, Human
uuugagcagaaaauucccuuua

SEQ ID NO: 455458 - RNA, 18 nt, Human
agagggcucgccgaggcu

SEQ ID NO: 455459 - RNA, 19 nt, Human
agcaacggguguuagaaug

SEQ ID NO: 455460 - RNA, 22 nt, Human
agggucuuucuggaagccccuc

SEQ ID NO: 455461 - RNA, 18 nt, Human
cacuccacacccuguuug

SEQ ID NO: 455462 - RNA, 19 nt, Human
cagagggcucgccgaggcu

SEQ ID NO: 455463 - RNA, 24 nt, Human
cccuccaccagcacuccugcggcc

SEQ ID NO: 455464 - RNA, 24 nt, Human
cccuccccuccccuuccaccaggg

SEQ ID NO: 455465 - RNA, 21 nt, Human
ccgcgcaggugcccgcucucc

SEQ ID NO: 455466 - RNA, 24 nt, Human
ccucccuccccuccccuuccacca

SEQ ID NO: 455467 - RNA, 24 nt, Human
cucuccugcggggagagccgaggg

SEQ ID NO: 455468 - RNA, 22 nt, Human
cugagauuuagaggccucugcc

SEQ ID NO: 455469 - RNA, 23 nt, Human
cugcagagggcucgccgaggcuc

SEQ ID NO: 455470 - RNA, 19 nt, Human
cugccugccacuccacacc

SEQ ID NO: 455471 - RNA, 23 nt, Human
cuuucuggaagccccuccaccag

SEQ ID NO: 455472 - RNA, 21 nt, Human
gccgcagggucuuucuggaag

SEQ ID NO: 455473 - RNA, 22 nt, Human
gcgcaggugcccgcucuccugc

SEQ ID NO: 455474 - RNA, 18 nt, Human
gcgcugccgcagggucuu

SEQ ID NO: 455475 - RNA, 23 nt, Human
ggaagccccuccaccagcacucu

SEQ ID NO: 455476 - RNA, 21 nt, Human
ggcaugguggauaauccacac

SEQ ID NO: 455477 - RNA, 21 nt, Human
gggggcuccgcugcagagggc

SEQ ID NO: 455478 - RNA, 21 nt, Human
uauauggguuccucccuccuu

SEQ ID NO: 455479 - RNA, 23 nt, Human
uccacacguggauaaucaagagu

SEQ ID NO: 455480 - RNA, 18 nt, Human
uccccuccccuuccacca

SEQ ID NO: 455481 - RNA, 22 nt, Human
uccucccuccccuccccuucca

SEQ ID NO: 455482 - RNA, 21 nt, Human
ugacuauauggguuccucccu

SEQ ID NO: 455483 - RNA, 26 nt, Human
ugcaaagaagucauucccucuaguua

SEQ ID NO: 455484 - RNA, 18 nt, Human
ugcagagggcucgccgag

SEQ ID NO: 455485 - RNA, 23 nt, Human
ugggcagggggcuccgcugcaga

SEQ ID NO: 455486 - RNA, 22 nt, Human
uuagaauggcccaguuccuccc

SEQ ID NO: 455487 - RNA, 24 nt, Human
uuccaaaaccaaaugggcaggggg

SEQ ID NO: 455488 - RNA, 19 nt, Human
uuuuuuuuuuuuaaggauc

SEQ ID NO: 455489 - RNA, 24 nt, Human
uuuuuuuuuuuuuuuuuuuuaagg

SEQ ID NO: 455490 - RNA, 20 nt, Human
aaaaugccacaguauuugaa

SEQ ID NO: 455491 - RNA, 20 nt, Human
cacaguauuugaacacuagg

SEQ ID NO: 455492 - RNA, 24 nt, Human
cagaggagagagagaaaaggcggg

SEQ ID NO: 455493 - RNA, 22 nt, Human
cagcgaaacaccaacuucuucc

SEQ ID NO: 455494 - RNA, 22 nt, Human
ccagggcccagcgaaacaccaa

SEQ ID NO: 455495 - RNA, 20 nt, Human
cuucaguaccagggcccagc

SEQ ID NO: 455496 - RNA, 19 nt, Human
gaacaaauuccaaauucac

SEQ ID NO: 455497 - RNA, 20 nt, Human
gcccagcgaaacaccaacuu

SEQ ID NO: 455498 - RNA, 27 nt, Human
ggaaacagcuaggggcgaccgguaccc

SEQ ID NO: 455499 - RNA, 19 nt, Human
uaaguuggaacaaauucca

SEQ ID NO: 455500 - RNA, 21 nt, Human
uggaacaaauuccaaauucac

SEQ ID NO: 455501 - RNA, 22 nt, Human
uggaacaaauuccaaauucaca

SEQ ID NO: 455502 - RNA, 18 nt, Human
uucagcaauuuucaaugg

SEQ ID NO: 455503 - RNA, 22 nt, Human
uucagcaauuuucaauggaaaa

SEQ ID NO: 455504 - RNA, 19 nt, Human
aaacacuacaaugugucac

SEQ ID NO: 455505 - RNA, 21 nt, Human
aaauggcuuucuaaaggcccc

SEQ ID NO: 455506 - RNA, 22 nt, Human
aagagucacugaguucuggagg

SEQ ID NO: 455507 - RNA, 22 nt, Human
agaggagauguugccuccaaca

SEQ ID NO: 455508 - RNA, 21 nt, Human
agcccuuccucccuccacccc

SEQ ID NO: 455509 - RNA, 18 nt, Human
agggagcacagaggccug

SEQ ID NO: 455510 - RNA, 20 nt, Human
auagaugugccaggcuugcc

SEQ ID NO: 455511 - RNA, 19 nt, Human
caacagugcuccugauggc

SEQ ID NO: 455512 - RNA, 27 nt, Human
cacaacccuauagccauuugaggcaaa

SEQ ID NO: 455513 - RNA, 19 nt, Human
caccccacaacccuauagc

SEQ ID NO: 455514 - RNA, 21 nt, Human
caccccacaacccuauagcca

SEQ ID NO: 455515 - RNA, 21 nt, Human
caccccacaacccuauagcca

SEQ ID NO: 455516 - RNA, 18 nt, Human
cagcccuuccucccucca

SEQ ID NO: 455517 - RNA, 21 nt, Human
cagcccuuccucccuccaccc

SEQ ID NO: 455518 - RNA, 18 nt, Human
cccagcccuuccucccuc

SEQ ID NO: 455519 - RNA, 21 nt, Human
ccggcaugacuggcuccuuuc

SEQ ID NO: 455520 - RNA, 19 nt, Human
ccuccaacagcagggagga

SEQ ID NO: 455521 - RNA, 19 nt, Human
ccucccagcccuuccuccc

SEQ ID NO: 455522 - RNA, 26 nt, Human
ccucccagcccuuccucccuccaccc

SEQ ID NO: 455523 - RNA, 23 nt, Human
ccucccuccaccccacaacccua

SEQ ID NO: 455524 - RNA, 23 nt, Human
ccucucaagggaaugggggcaga

SEQ ID NO: 455525 - RNA, 26 nt, Human
ccucucaagggaaugggggcagagac

SEQ ID NO: 455526 - RNA, 18 nt, Human
ccucuguaaaaagaggag

SEQ ID NO: 455527 - RNA, 18 nt, Human
ccuuccucccuccacccc

SEQ ID NO: 455528 - RNA, 18 nt, Human
cuaguccaaccaaaggug

SEQ ID NO: 455529 - RNA, 20 nt, Human
cuccugaaugugcacacaug

SEQ ID NO: 455530 - RNA, 18 nt, Human
gacuauaucgcagucugc

SEQ ID NO: 455531 - RNA, 24 nt, Human
gagaauggaaacagguuauaagaa

SEQ ID NO: 455532 - RNA, 23 nt, Human
gccccgccccacucgccuagcca

SEQ ID NO: 455533 - RNA, 27 nt, Human
gcccuuccucccuccaccccacaaccc

SEQ ID NO: 455534 - RNA, 24 nt, Human
uaacauccauguucaagagucacu

SEQ ID NO: 455535 - RNA, 25 nt, Human
uaagaaaaaaggauguacccucugu

SEQ ID NO: 455536 - RNA, 24 nt, Human
uacaaugugucacacuacagcuag

SEQ ID NO: 455537 - RNA, 22 nt, Human
uagcaauuccuccccacucccu

SEQ ID NO: 455538 - RNA, 25 nt, Human
ucacacuacagcuagcagugggaac

SEQ ID NO: 455539 - RNA, 21 nt, Human
ucacugaguucuggagggcag

SEQ ID NO: 455540 - RNA, 22 nt, Human
ucccagcccuuccucccuccac

SEQ ID NO: 455541 - RNA, 21 nt, Human
uccccacucccucccagcccu

SEQ ID NO: 455542 - RNA, 22 nt, Human
uccugauggcuauccucgaguu

SEQ ID NO: 455543 - RNA, 23 nt, Human
ugagaccuggguggcuucccaga

SEQ ID NO: 455544 - RNA, 18 nt, Human
uggcuauccucgaguugu

SEQ ID NO: 455545 - RNA, 18 nt, Human
ugggggcagagacugucg

SEQ ID NO: 455546 - RNA, 24 nt, Human
uguaaaaagaggagauguugccuc

SEQ ID NO: 455547 - RNA, 22 nt, Human
uguaagaaaaaaggauguaccc

SEQ ID NO: 455548 - RNA, 21 nt, Human
ugugcacacaugggguaaaug

SEQ ID NO: 455549 - RNA, 18 nt, Human
uuccuccccacucccucc

SEQ ID NO: 455550 - RNA, 19 nt, Human
aacaaaaaucuuacagacu

SEQ ID NO: 455551 - RNA, 20 nt, Human
aacaagggcacaucaugaac

SEQ ID NO: 455552 - RNA, 18 nt, Human
aacacaauauucaauuag

SEQ ID NO: 455553 - RNA, 21 nt, Human
aacauguaaauucgaaagcaa

SEQ ID NO: 455554 - RNA, 24 nt, Human
aagugacagguaaagguuuacaac

SEQ ID NO: 455555 - RNA, 25 nt, Human
acaacaagggcacaucaugaacaug

SEQ ID NO: 455556 - RNA, 21 nt, Human
cccccgggccggaugccagcc

SEQ ID NO: 455557 - RNA, 22 nt, Human
cccccgggccggaugccagccc

SEQ ID NO: 455558 - RNA, 23 nt, Human
cccgccgagcgcagggcagcggg

SEQ ID NO: 455559 - RNA, 21 nt, Human
cgggccggaugccagcccgcc

SEQ ID NO: 455560 - RNA, 18 nt, Human
cugcagaagggcuggucc

SEQ ID NO: 455561 - RNA, 21 nt, Human
cuuguagucuccuccuucucc

SEQ ID NO: 455562 - RNA, 22 nt, Human
gaggugcgccgccgggacacuu

SEQ ID NO: 455563 - RNA, 18 nt, Human
uacuccugggccuauccu

SEQ ID NO: 455564 - RNA, 21 nt, Human
ucgccacgaggugcgccgccg

SEQ ID NO: 455565 - RNA, 22 nt, Human
ucuccuccuucucccgauucuc

SEQ ID NO: 455566 - RNA, 24 nt, Human
uucuucugcuaacaaaaaucuuac

SEQ ID NO: 455567 - RNA, 20 nt, Human
aaacaaaagcccagugacua

SEQ ID NO: 455568 - RNA, 19 nt, Human
aaagugcugggauuacagg

SEQ ID NO: 455569 - RNA, 20 nt, Human
aaagugcugggauuacaggg

SEQ ID NO: 455570 - RNA, 24 nt, Human
aaagugcugggauuacagggguga

SEQ ID NO: 455571 - RNA, 21 nt, Human
aagacagagucucccucuguc

SEQ ID NO: 455572 - RNA, 24 nt, Human
aaguagcugggauuacagguaugu

SEQ ID NO: 455573 - RNA, 25 nt, Human
aaguagcugggauuacagguaugug

SEQ ID NO: 455574 - RNA, 18 nt, Human
aagugcugggauuacagg

SEQ ID NO: 455575 - RNA, 21 nt, Human
aagugcugggauuacaggggu

SEQ ID NO: 455576 - RNA, 21 nt, Human
aagugcugggauuacaggggu

SEQ ID NO: 455577 - RNA, 22 nt, Human
accauguuggccaagcuggucu

SEQ ID NO: 455578 - RNA, 23 nt, Human
agaaaacugcugcaaaacaucau

SEQ ID NO: 455579 - RNA, 23 nt, Human
agaaagggauccagaccuucaau

SEQ ID NO: 455580 - RNA, 19 nt, Human
agacguagaaaacugcugc

SEQ ID NO: 455581 - RNA, 20 nt, Human
agaggaagagggagaggcuu

SEQ ID NO: 455582 - RNA, 20 nt, Human
agcaacucuucaauaagaca

SEQ ID NO: 455583 - RNA, 21 nt, Human
agccaaacagacaauccuccc

SEQ ID NO: 455584 - RNA, 22 nt, Human
aguagagaugagguuucaccau

SEQ ID NO: 455585 - RNA, 19 nt, Human
agugcaguggugcagucuc

SEQ ID NO: 455586 - RNA, 20 nt, Human
auaaagcaaaacaaaagccc

SEQ ID NO: 455587 - RNA, 18 nt, Human
augagguuucaccauguu

SEQ ID NO: 455588 - RNA, 20 nt, Human
augagguuucaccauguugg

SEQ ID NO: 455589 - RNA, 24 nt, Human
auuuuuguauuuuuaguagagaug

SEQ ID NO: 455590 - RNA, 19 nt, Human
caaaacaaaagcccaguga

SEQ ID NO: 455591 - RNA, 20 nt, Human
caaaacaaaagcccagugac

SEQ ID NO: 455592 - RNA, 24 nt, Human
caaagugcugggauuacaggggug

SEQ ID NO: 455593 - RNA, 21 nt, Human
caccauguuggccaagcuggu

SEQ ID NO: 455594 - RNA, 22 nt, Human
caccauguuggccaagcugguc

SEQ ID NO: 455595 - RNA, 23 nt, Human
caccauguuggccaagcuggucu

SEQ ID NO: 455596 - RNA, 24 nt, Human
caccauguuggccaagcuggucuu

SEQ ID NO: 455597 - RNA, 19 nt, Human
caccuuguuuuacugaggg

SEQ ID NO: 455598 - RNA, 27 nt, Human
cacuaaaucuaaugggaacugcccgac

SEQ ID NO: 455599 - RNA, 19 nt, Human
cacugagguuggggagggg

SEQ ID NO: 455600 - RNA, 23 nt, Human
cagcacagaccccgcgggagcag

SEQ ID NO: 455601 - RNA, 24 nt, Human
cauguuggccaagcuggucuugaa

SEQ ID NO: 455602 - RNA, 26 nt, Human
cauucuaggcucaaacugaauccuuu

SEQ ID NO: 455603 - RNA, 22 nt, Human
ccaaaacaauucugaauaacau

SEQ ID NO: 455604 - RNA, 19 nt, Human
ccaaagugcugggauuaca

SEQ ID NO: 455605 - RNA, 21 nt, Human
ccaaagugcugggauuacagg

SEQ ID NO: 455606 - RNA, 24 nt, Human
ccaaagugcugggauuacaggggu

SEQ ID NO: 455607 - RNA, 21 nt, Human
ccaaguagcugggauuacagg

SEQ ID NO: 455608 - RNA, 24 nt, Human
ccaaguagcugggauuacagguau

SEQ ID NO: 455609 - RNA, 22 nt, Human
cccaaagugcugggauuacagg

SEQ ID NO: 455610 - RNA, 20 nt, Human
cccaauaaaccuggucucag

SEQ ID NO: 455611 - RNA, 18 nt, Human
cccugccucaccccucuu

SEQ ID NO: 455612 - RNA, 24 nt, Human
ccgccuccuggguucaggcgauuu

SEQ ID NO: 455613 - RNA, 22 nt, Human
ccucacccacccaaagugcugg

SEQ ID NO: 455614 - RNA, 19 nt, Human
ccuccgccuccuggguuca

SEQ ID NO: 455615 - RNA, 25 nt, Human
ccucugucacccaggcugaagugca

SEQ ID NO: 455616 - RNA, 18 nt, Human
ccuggcuucaagugaucc

SEQ ID NO: 455617 - RNA, 21 nt, Human
ccuggcuucaagugauccgcc

SEQ ID NO: 455618 - RNA, 23 nt, Human
ccuggcuucaagugauccgccug

SEQ ID NO: 455619 - RNA, 21 nt, Human
ccuuguuuuacugaggguaga

SEQ ID NO: 455620 - RNA, 23 nt, Human
cgggagcagaggaagagggagag

SEQ ID NO: 455621 - RNA, 21 nt, Human
cuaaacuugacuuagaggaca

SEQ ID NO: 455622 - RNA, 23 nt, Human
cuaauuuuuguauuuuuaguaga

SEQ ID NO: 455623 - RNA, 21 nt, Human
cuagcaacucuucaauaagac

SEQ ID NO: 455624 - RNA, 21 nt, Human
cucaaucucuccauucagaga

SEQ ID NO: 455625 - RNA, 18 nt, Human
cucccugccucaccccuc

SEQ ID NO: 455626 - RNA, 18 nt, Human
cucgugccacccacaggc

SEQ ID NO: 455627 - RNA, 18 nt, Human
cucucaaucucuccauuc

SEQ ID NO: 455628 - RNA, 21 nt, Human
cugcaaccuccgccuccuggg

SEQ ID NO: 455629 - RNA, 23 nt, Human
cugcaaccuccgccuccuggguu

SEQ ID NO: 455630 - RNA, 24 nt, Human
cugcaaccuccgccuccuggguuc

SEQ ID NO: 455631 - RNA, 18 nt, Human
cuggucuugaaguccugg

SEQ ID NO: 455632 - RNA, 21 nt, Human
cugugaggaagguggcugggu

SEQ ID NO: 455633 - RNA, 18 nt, Human
gaagggcugcugcugugu

SEQ ID NO: 455634 - RNA, 18 nt, Human
gagguuucaccauguugg

SEQ ID NO: 455635 - RNA, 18 nt, Human
gauuacagguaugugcca

SEQ ID NO: 455636 - RNA, 22 nt, Human
gcaacucuucaauaagacagaa

SEQ ID NO: 455637 - RNA, 24 nt, Human
ggagaggacaugguuggagcuuuu

SEQ ID NO: 455638 - RNA, 19 nt, Human
ggauuacagguaugugcca

SEQ ID NO: 455639 - RNA, 23 nt, Human
gggacugauguggcacccuucug

SEQ ID NO: 455640 - RNA, 21 nt, Human
ggggaggggacugauguggca

SEQ ID NO: 455641 - RNA, 18 nt, Human
guagcugggauuacaggu

SEQ ID NO: 455642 - RNA, 24 nt, Human
guccgcucccugccucaccccucu

SEQ ID NO: 455643 - RNA, 21 nt, Human
guccuugcucgugccacccac

SEQ ID NO: 455644 - RNA, 19 nt, Human
uaaagcaaaacaaaagccc

SEQ ID NO: 455645 - RNA, 20 nt, Human
uaaagcaaaacaaaagccca

SEQ ID NO: 455646 - RNA, 24 nt, Human
uaauuuuuguauuuuuaguagaga

SEQ ID NO: 455647 - RNA, 21 nt, Human
uacagguaugugccaucacac

SEQ ID NO: 455648 - RNA, 19 nt, Human
uacucugaauccuagcaac

SEQ ID NO: 455649 - RNA, 21 nt, Human
uagaaaacugcugcaaaacau

SEQ ID NO: 455650 - RNA, 24 nt, Human
uagaaaauaggaaguccgcucccu

SEQ ID NO: 455651 - RNA, 22 nt, Human
uagagaugagguuucaccaugu

SEQ ID NO: 455652 - RNA, 24 nt, Human
uaguagagaugagguuucaccaug

SEQ ID NO: 455653 - RNA, 26 nt, Human
uaguagagaugagguuucaccauguu

SEQ ID NO: 455654 - RNA, 21 nt, Human
uaugacagaaucuuauccuug

SEQ ID NO: 455655 - RNA, 19 nt, Human
ucaagugauccgccugccu

SEQ ID NO: 455656 - RNA, 20 nt, Human
ucaagugauccgccugccuc

SEQ ID NO: 455657 - RNA, 18 nt, Human
ucacugagguuggggagg

SEQ ID NO: 455658 - RNA, 21 nt, Human
ucagcacagaccccgcgggag

SEQ ID NO: 455659 - RNA, 22 nt, Human
uccaaguagcugggauuacagg

SEQ ID NO: 455660 - RNA, 22 nt, Human
uccaaguagcugggauuacagg

SEQ ID NO: 455661 - RNA, 23 nt, Human
uccaaguagcugggauuacaggu

SEQ ID NO: 455662 - RNA, 24 nt, Human
uccaaguagcugggauuacaggua

SEQ ID NO: 455663 - RNA, 20 nt, Human
ucccucugucacccaggcug

SEQ ID NO: 455664 - RNA, 24 nt, Human
ucccugcaaccuccgccuccuggg

SEQ ID NO: 455665 - RNA, 25 nt, Human
ucccugcaaccuccgccuccugggu

SEQ ID NO: 455666 - RNA, 27 nt, Human
ucccugcaaccuccgccuccuggguuc

SEQ ID NO: 455667 - RNA, 20 nt, Human
ucccugcaaccuccgccucu

SEQ ID NO: 455668 - RNA, 21 nt, Human
ucccugugcggaugucagucc

SEQ ID NO: 455669 - RNA, 19 nt, Human
ucucagcacagaccccgcg

SEQ ID NO: 455670 - RNA, 24 nt, Human
ucucccucugucacccaggcugaa

SEQ ID NO: 455671 - RNA, 18 nt, Human
ucucuaugccuaugacag

SEQ ID NO: 455672 - RNA, 24 nt, Human
ucugucacccaggcugaagugcag

SEQ ID NO: 455673 - RNA, 27 nt, Human
ugaagugcaguggugcaguccuagcag

SEQ ID NO: 455674 - RNA, 24 nt, Human
ugagguuucaccauguuggccaag

SEQ ID NO: 455675 - RNA, 21 nt, Human
ugauuuccauaaagcaaaaca

SEQ ID NO: 455676 - RNA, 18 nt, Human
ugcaguggugcagucucc

SEQ ID NO: 455677 - RNA, 23 nt, Human
ugccucaccccucuuaagcauca

SEQ ID NO: 455678 - RNA, 24 nt, Human
uggccaagcuggucuugaaguccu

SEQ ID NO: 455679 - RNA, 24 nt, Human
uggcuucaagugauccgccugccu

SEQ ID NO: 455680 - RNA, 20 nt, Human
ugggaagggcugcugcugug

SEQ ID NO: 455681 - RNA, 18 nt, Human
ugggauuacaggggugag

SEQ ID NO: 455682 - RNA, 18 nt, Human
ugggauuacaggggugag

SEQ ID NO: 455683 - RNA, 18 nt, Human
ugggauuacaggggugag

SEQ ID NO: 455684 - RNA, 20 nt, Human
ugggauuacaggggugaggu

SEQ ID NO: 455685 - RNA, 23 nt, Human
ugggauuacaggggugagguauc

SEQ ID NO: 455686 - RNA, 18 nt, Human
ugggauuacagguaugug

SEQ ID NO: 455687 - RNA, 19 nt, Human
ugggauuacagguaugugc

SEQ ID NO: 455688 - RNA, 21 nt, Human
ugggauuacagguaugugcca

SEQ ID NO: 455689 - RNA, 21 nt, Human
ugggauuacagguaugugcca

SEQ ID NO: 455690 - RNA, 22 nt, Human
ugggauuacagguaugugccau

SEQ ID NO: 455691 - RNA, 24 nt, Human
ugggauuacagguaugugccauca

SEQ ID NO: 455692 - RNA, 18 nt, Human
uuaguagagaugagguuu

SEQ ID NO: 455693 - RNA, 22 nt, Human
uuaguagagaugagguuucacc

SEQ ID NO: 455694 - RNA, 24 nt, Human
uuaguagagaugagguuucaccau

SEQ ID NO: 455695 - RNA, 21 nt, Human
uucaagugauccgccugccuc

SEQ ID NO: 455696 - RNA, 26 nt, Human
uucaagugauccgccugccucaccca

SEQ ID NO: 455697 - RNA, 21 nt, Human
uuucaccauguuggccaagcu

SEQ ID NO: 455698 - RNA, 24 nt, Human
uuuuuaguagagaugagguuucac

SEQ ID NO: 455699 - RNA, 20 nt, Human
uuuuuguauuuuuaguagag

SEQ ID NO: 455700 - RNA, 21 nt, Human
aaaaagcaauacuuaaacuga

SEQ ID NO: 455701 - RNA, 19 nt, Human
aacugaauuaaaacuaccc

SEQ ID NO: 455702 - RNA, 18 nt, Human
aagaaccacuccggggag

SEQ ID NO: 455703 - RNA, 19 nt, Human
aagaggcucggaacgccug

SEQ ID NO: 455704 - RNA, 25 nt, Human
aagaggcucggaacgccugcccucu

SEQ ID NO: 455705 - RNA, 21 nt, Human
acugauugcuuuuccugcagc

SEQ ID NO: 455706 - RNA, 20 nt, Human
agaugccagugacgaugcca

SEQ ID NO: 455707 - RNA, 22 nt, Human
agcuuuuuaaucuaccuggaac

SEQ ID NO: 455708 - RNA, 23 nt, Human
agggacucuuuggagaguggcug

SEQ ID NO: 455709 - RNA, 21 nt, Human
aucauguccugccggcucucc

SEQ ID NO: 455710 - RNA, 21 nt, Human
augcacaguguagggaagcug

SEQ ID NO: 455711 - RNA, 22 nt, Human
caaaaagcaauacuuaaacuga

SEQ ID NO: 455712 - RNA, 22 nt, Human
cacagccuacugcuggcugucc

SEQ ID NO: 455713 - RNA, 24 nt, Human
cacagccuacugcuggcuguccug

SEQ ID NO: 455714 - RNA, 20 nt, Human
cacugugggccugcuucagg

SEQ ID NO: 455715 - RNA, 20 nt, Human
caggaagaggcucggaacgg

SEQ ID NO: 455716 - RNA, 24 nt, Human
cccacacgugaagcuucuuggaau

SEQ ID NO: 455717 - RNA, 22 nt, Human
cccacugccgagaagaaccacu

SEQ ID NO: 455718 - RNA, 23 nt, Human
cccagacugaagagaccuggggc

SEQ ID NO: 455719 - RNA, 22 nt, Human
ccgaggauggccacacuguggg

SEQ ID NO: 455720 - RNA, 19 nt, Human
ccucacaaucauguccugc

SEQ ID NO: 455721 - RNA, 21 nt, Human
ccuguggggucucucugcugu

SEQ ID NO: 455722 - RNA, 22 nt, Human
cgaugcccgccaagauuccaga

SEQ ID NO: 455723 - RNA, 24 nt, Human
cgccaagauuccagaguaagucag

SEQ ID NO: 455724 - RNA, 24 nt, Human
cgcuugaagcccaaagcgaugagg

SEQ ID NO: 455725 - RNA, 22 nt, Human
cggcgaugcccgccaagauucc

SEQ ID NO: 455726 - RNA, 24 nt, Human
cuccagaauugcguggcaucugcc

SEQ ID NO: 455727 - RNA, 21 nt, Human
cugcccucuauucuauagaaa

SEQ ID NO: 455728 - RNA, 21 nt, Human
cuggggagcuggugguguaga

SEQ ID NO: 455729 - RNA, 24 nt, Human
cugguaauggaauaauagggucuu

SEQ ID NO: 455730 - RNA, 25 nt, Human
cuuggcagaaaugccugugcccaga

SEQ ID NO: 455731 - RNA, 20 nt, Human
gaagagaccuggggcucagg

SEQ ID NO: 455732 - RNA, 21 nt, Human
gaagagaccuggggcucagga

SEQ ID NO: 455733 - RNA, 22 nt, Human
gaccuggggcucaggaagaggc

SEQ ID NO: 455734 - RNA, 20 nt, Human
gccugcuucaggccgagcuc

SEQ ID NO: 455735 - RNA, 24 nt, Human
gcgcagcagucauaagcgauguac

SEQ ID NO: 455736 - RNA, 21 nt, Human
ggaagcccuuggcggcucugc

SEQ ID NO: 455737 - RNA, 22 nt, Human
ggaagcugugggcagcuggggu

SEQ ID NO: 455738 - RNA, 22 nt, Human
ggagauguguucccacuugucc

SEQ ID NO: 455739 - RNA, 23 nt, Human
uaaaacuacccacacgugaagcu

SEQ ID NO: 455740 - RNA, 22 nt, Human
uaaacugaauuaaaacuaccca

SEQ ID NO: 455741 - RNA, 22 nt, Human
uaacagacuuggcagaaaugcc

SEQ ID NO: 455742 - RNA, 20 nt, Human
uaccuggaacuaaggccaaa

SEQ ID NO: 455743 - RNA, 22 nt, Human
uagaaucaaacaggcagcagca

SEQ ID NO: 455744 - RNA, 22 nt, Human
ucauguccugccggcucuccug

SEQ ID NO: 455745 - RNA, 18 nt, Human
uccacagcgccuccucug

SEQ ID NO: 455746 - RNA, 26 nt, Human
ucuggaaggagagcugaucccguccg

SEQ ID NO: 455747 - RNA, 18 nt, Human
ugacgaugccaccugcaa

SEQ ID NO: 455748 - RNA, 24 nt, Human
ugaguugugacugauugcuuuucc

SEQ ID NO: 455749 - RNA, 21 nt, Human
ugcaaauacugugcccacugc

SEQ ID NO: 455750 - RNA, 21 nt, Human
ugcccacugccgagaagaacc

SEQ ID NO: 455751 - RNA, 25 nt, Human
ugcccagacugaagagaccuggggg

SEQ ID NO: 455752 - RNA, 21 nt, Human
uggaaggagagcugaucucau

SEQ ID NO: 455753 - RNA, 18 nt, Human
uggcagaaaugccugugc

SEQ ID NO: 455754 - RNA, 21 nt, Human
uggcagaaaugccugugccca

SEQ ID NO: 455755 - RNA, 19 nt, Human
uggcaggccucuggggagc

SEQ ID NO: 455756 - RNA, 24 nt, Human
ugguguagaugccagugacgaugc

SEQ ID NO: 455757 - RNA, 23 nt, Human
uguagagccagugcugugcccug

SEQ ID NO: 455758 - RNA, 24 nt, Human
ugugacugauugcuuuuccugcag

SEQ ID NO: 455759 - RNA, 20 nt, Human
ugugcccacugccgagaaga

SEQ ID NO: 455760 - RNA, 22 nt, Human
uuaagcaucaagucaguuggca

SEQ ID NO: 455761 - RNA, 26 nt, Human
uuauacauuaaauagaaucaaacagg

SEQ ID NO: 455762 - RNA, 18 nt, Human
uucaggccgagcucagga

SEQ ID NO: 455763 - RNA, 22 nt, Human
uuggcagaaaugccugugccca

SEQ ID NO: 455764 - RNA, 19 nt, Human
uugggaguaggagaugugu

SEQ ID NO: 455765 - RNA, 21 nt, Human
uuuggagaguggcugccuguc

SEQ ID NO: 455766 - RNA, 22 nt, Human
aaaaaaagaacaaaaacaaaaa

SEQ ID NO: 455767 - RNA, 25 nt, Human
aaaaaagaacaaaaacaaaaauuaa

SEQ ID NO: 455768 - RNA, 20 nt, Human
aaaaacaaaaauuaaagaaa

SEQ ID NO: 455769 - RNA, 23 nt, Human
aaacaaacccaucguggcugugg

SEQ ID NO: 455770 - RNA, 24 nt, Human
aaacaggaaagcccacacacucuu

SEQ ID NO: 455771 - RNA, 25 nt, Human
aaacuggcucuccuucagcucucua

SEQ ID NO: 455772 - RNA, 20 nt, Human
aaagaaaaaaagaacaaaaa

SEQ ID NO: 455773 - RNA, 22 nt, Human
aaagaaaaaaagaacaaaaaca

SEQ ID NO: 455774 - RNA, 18 nt, Human
aaagaaagagaaaagaaa

SEQ ID NO: 455775 - RNA, 26 nt, Human
aaagaacaaaaacaaaaauuaaagaa

SEQ ID NO: 455776 - RNA, 19 nt, Human
aacaaaaacaaaaauuaaa

SEQ ID NO: 455777 - RNA, 21 nt, Human
aacaaaaauuaaagaaagaga

SEQ ID NO: 455778 - RNA, 19 nt, Human
aaccugcucuccucccucc

SEQ ID NO: 455779 - RNA, 19 nt, Human
aaccugcucuccucccucc

SEQ ID NO: 455780 - RNA, 24 nt, Human
aagaaaaaaagaacaaaaacaaaa

SEQ ID NO: 455781 - RNA, 27 nt, Human
aagaaaacagaaacaaacccaucgugg

SEQ ID NO: 455782 - RNA, 21 nt, Human
aagaaccaaaagaauucugca

SEQ ID NO: 455783 - RNA, 19 nt, Human
aagaaccuccagcuggcac

SEQ ID NO: 455784 - RNA, 21 nt, Human
aagaaccuccagcuggcacua

SEQ ID NO: 455785 - RNA, 22 nt, Human
aagcaggaggaggaggagacaa

SEQ ID NO: 455786 - RNA, 18 nt, Human
aagcccacacacucuuug

SEQ ID NO: 455787 - RNA, 23 nt, Human
aaguccaauuuuggggaaacugg

SEQ ID NO: 455788 - RNA, 23 nt, Human
aaucacuguuuuuaggaaacaaa

SEQ ID NO: 455789 - RNA, 21 nt, Human
acaagcaucuucucucucucu

SEQ ID NO: 455790 - RNA, 20 nt, Human
acccaagaaaacagaaacaa

SEQ ID NO: 455791 - RNA, 22 nt, Human
acccaagaaaacagaaacaaac

SEQ ID NO: 455792 - RNA, 22 nt, Human
accuucuccacuuucucugcua

SEQ ID NO: 455793 - RNA, 22 nt, Human
acugucccacccccugcucccu

SEQ ID NO: 455794 - RNA, 20 nt, Human
agaaccuccagcuggcacua

SEQ ID NO: 455795 - RNA, 23 nt, Human
agacaaacaagcccaacucuuca

SEQ ID NO: 455796 - RNA, 19 nt, Human
agaggugauuaaauacugc

SEQ ID NO: 455797 - RNA, 26 nt, Human
agcagagugcaggggagaagaaccua

SEQ ID NO: 455798 - RNA, 18 nt, Human
agcuggaggcaggaacuc

SEQ ID NO: 455799 - RNA, 25 nt, Human
aggagacaaacaagcccaacucuuc

SEQ ID NO: 455800 - RNA, 23 nt, Human
aggcaggaacucugagcagggga

SEQ ID NO: 455801 - RNA, 24 nt, Human
aggcugcugcaggcacacacuggu

SEQ ID NO: 455802 - RNA, 23 nt, Human
aguuuuuguuaccaagaaaguaa

SEQ ID NO: 455803 - RNA, 21 nt, Human
caagaucuucucuucuuauaa

SEQ ID NO: 455804 - RNA, 22 nt, Human
caagcccaacucuucauccucc

SEQ ID NO: 455805 - RNA, 21 nt, Human
caaguaaaaucacugauccac

SEQ ID NO: 455806 - RNA, 23 nt, Human
caaguaaggaucugaaaccugcu

SEQ ID NO: 455807 - RNA, 25 nt, Human
cacccaagaaaacagaaacaaaccu

SEQ ID NO: 455808 - RNA, 24 nt, Human
cacccccugcucccuccagccacu

SEQ ID NO: 455809 - RNA, 21 nt, Human
cacugauccaccuuuuuuucc

SEQ ID NO: 455810 - RNA, 18 nt, Human
cacugggguuggugaaau

SEQ ID NO: 455811 - RNA, 22 nt, Human
cacugggguuggugaaaucuca

SEQ ID NO: 455812 - RNA, 22 nt, Human
cagaaauccggcuuugcuuuuc

SEQ ID NO: 455813 - RNA, 26 nt, Human
cagagugcaggggagaagaaccuacu

SEQ ID NO: 455814 - RNA, 20 nt, Human
cagcagcagcgagcaccacc

SEQ ID NO: 455815 - RNA, 30 nt, Human
cagcuuuucuauuccuuauuuuaguuuuug

SEQ ID NO: 455816 - RNA, 22 nt, Human
caguaaaauaaaacuuuccuua

SEQ ID NO: 455817 - RNA, 20 nt, Human
caucguggcuguggaggcug

SEQ ID NO: 455818 - RNA, 22 nt, Human
caucguggcuguggaggcugcu

SEQ ID NO: 455819 - RNA, 22 nt, Human
cauucaauucacacacaccugg

SEQ ID NO: 455820 - RNA, 22 nt, Human
ccaaagaaccaaaagaauucug

SEQ ID NO: 455821 - RNA, 27 nt, Human
ccaacucuucauccuccuccuccucuc

SEQ ID NO: 455822 - RNA, 18 nt, Human
ccaagaaaacagaaacaa

SEQ ID NO: 455823 - RNA, 22 nt, Human
ccacccaagaaaacagaaacaa

SEQ ID NO: 455824 - RNA, 19 nt, Human
cccaucguggcuguggagg

SEQ ID NO: 455825 - RNA, 23 nt, Human
ccccacccaagaaaacagaaaca

SEQ ID NO: 455826 - RNA, 19 nt, Human
cccccucuuggagauucac

SEQ ID NO: 455827 - RNA, 22 nt, Human
cccccugcucccuccagccacu

SEQ ID NO: 455828 - RNA, 22 nt, Human
cccccuggcagcuggaggcagg

SEQ ID NO: 455829 - RNA, 23 nt, Human
ccccugcucccuccagccacucc

SEQ ID NO: 455830 - RNA, 24 nt, Human
ccccuggcagcuggaggcaggaac

SEQ ID NO: 455831 - RNA, 19 nt, Human
ccccuucccucuucugggc

SEQ ID NO: 455832 - RNA, 25 nt, Human
cccgucccugcuccccacccaagaa

SEQ ID NO: 455833 - RNA, 24 nt, Human
cccugcucccuccagccacucccc

SEQ ID NO: 455834 - RNA, 19 nt, Human
ccugcugcuggcuggcugu

SEQ ID NO: 455835 - RNA, 18 nt, Human
ccuuuuuuuccuuccugg

SEQ ID NO: 455836 - RNA, 22 nt, Human
cuaauucuauaguuucuucagc

SEQ ID NO: 455837 - RNA, 24 nt, Human
cuccauucaauucacacacaccug

SEQ ID NO: 455838 - RNA, 24 nt, Human
cuccccuucccucuucugggcacu

SEQ ID NO: 455839 - RNA, 21 nt, Human
cucccuccgcccgucccugcu

SEQ ID NO: 455840 - RNA, 21 nt, Human
cuccgcccgucccugcucccc

SEQ ID NO: 455841 - RNA, 19 nt, Human
cuccugcugcuggcuggcu

SEQ ID NO: 455842 - RNA, 21 nt, Human
cuccugcugcuggcuggcugu

SEQ ID NO: 455843 - RNA, 21 nt, Human
cugcauaucauaucccccucu

SEQ ID NO: 455844 - RNA, 23 nt, Human
cuuaaagaaaaaaagaacaaaaa

SEQ ID NO: 455845 - RNA, 27 nt, Human
cuuaaagaaaaaaagaacaaaaacaaa

SEQ ID NO: 455846 - RNA, 20 nt, Human
cuucugggcacugggguugg

SEQ ID NO: 455847 - RNA, 24 nt, Human
cuugccgccgggaucccguggcuu

SEQ ID NO: 455848 - RNA, 19 nt, Human
gaaacuggcucuccuucag

SEQ ID NO: 455849 - RNA, 21 nt, Human
gaaccuacuggcuguucuugg

SEQ ID NO: 455850 - RNA, 20 nt, Human
gacuugucuucucuaccuaa

SEQ ID NO: 455851 - RNA, 22 nt, Human
gaggagacagcgggauaaccac

SEQ ID NO: 455852 - RNA, 26 nt, Human
gaguggugggguuaccgcgcagggag

SEQ ID NO: 455853 - RNA, 19 nt, Human
gcuggaggcaggaacucug

SEQ ID NO: 455854 - RNA, 25 nt, Human
ggcucggcaaguaaggaucugaaac

SEQ ID NO: 455855 - RNA, 23 nt, Human
ggcucugcuuguucuuggagagg

SEQ ID NO: 455856 - RNA, 24 nt, Human
gggcacugggguuggugaaaucuc

SEQ ID NO: 455857 - RNA, 21 nt, Human
guaaaauaaaacuuuccuuaa

SEQ ID NO: 455858 - RNA, 19 nt, Human
uaagaaggaucaauuggca

SEQ ID NO: 455859 - RNA, 19 nt, Human
uacaauguuucuuaccuug

SEQ ID NO: 455860 - RNA, 18 nt, Human
uacacacagaauaagaag

SEQ ID NO: 455861 - RNA, 25 nt, Human
uaccaagaaaguaaaaugaacagua

SEQ ID NO: 455862 - RNA, 25 nt, Human
uaccaugcaaggucuuggcuacccu

SEQ ID NO: 455863 - RNA, 19 nt, Human
uagugggcucccugucauu

SEQ ID NO: 455864 - RNA, 21 nt, Human
uaucauaucccccucuuggag

SEQ ID NO: 455865 - RNA, 20 nt, Human
ucacugauccaccuuuuuuu

SEQ ID NO: 455866 - RNA, 18 nt, Human
ucacugcagcuuaugagg

SEQ ID NO: 455867 - RNA, 20 nt, Human
ucacugcagcuuaugaggua

SEQ ID NO: 455868 - RNA, 25 nt, Human
ucacugcagcuuaugagguaguggg

SEQ ID NO: 455869 - RNA, 26 nt, Human
ucagcagcagcagcgagcaccaccag

SEQ ID NO: 455870 - RNA, 23 nt, Human
ucagccucuguuuaaaguaacaa

SEQ ID NO: 455871 - RNA, 18 nt, Human
ucagcucucuagcccccc

SEQ ID NO: 455872 - RNA, 19 nt, Human
ucaggaguggugggguuac

SEQ ID NO: 455873 - RNA, 20 nt, Human
ucccacccccugcucccucc

SEQ ID NO: 455874 - RNA, 22 nt, Human
ucccacccccugcucccuccag

SEQ ID NO: 455875 - RNA, 22 nt, Human
ucccuccagccacuccccuucc

SEQ ID NO: 455876 - RNA, 21 nt, Human
ucccucuucugggcacugggg

SEQ ID NO: 455877 - RNA, 19 nt, Human
ucccugccuugggcaaggg

SEQ ID NO: 455878 - RNA, 23 nt, Human
uccuuaaagaaaaaaagaacaaa

SEQ ID NO: 455879 - RNA, 20 nt, Human
ucuaccuucuccacuuucuc

SEQ ID NO: 455880 - RNA, 22 nt, Human
ucucacugcagcuuaugaggua

SEQ ID NO: 455881 - RNA, 21 nt, Human
ugaaaccugcucuccucccuc

SEQ ID NO: 455882 - RNA, 24 nt, Human
ugauccaccuuuuuuuccuuccug

SEQ ID NO: 455883 - RNA, 20 nt, Human
ugcacgaggcccccgccaga

SEQ ID NO: 455884 - RNA, 22 nt, Human
ugcaggcacacacugguguaua

SEQ ID NO: 455885 - RNA, 21 nt, Human
ugcccgaacgaugacacaagg

SEQ ID NO: 455886 - RNA, 23 nt, Human
ugcccgaacgaugacacaaggac

SEQ ID NO: 455887 - RNA, 21 nt, Human
ugcccuugcauaaaaaaacag

SEQ ID NO: 455888 - RNA, 23 nt, Human
ugccuugggcaagggccaguggc

SEQ ID NO: 455889 - RNA, 21 nt, Human
ugcugcuggcuggcugucccc

SEQ ID NO: 455890 - RNA, 21 nt, Human
uggcagcuggaggcaggaacu

SEQ ID NO: 455891 - RNA, 24 nt, Human
uggcauggugcuggcaaagaaccu

SEQ ID NO: 455892 - RNA, 19 nt, Human
uggcccgggcucugcuugu

SEQ ID NO: 455893 - RNA, 21 nt, Human
ugucccacccccugcucccuc

SEQ ID NO: 455894 - RNA, 23 nt, Human
uguuaccaagaaaguaaaaugaa

SEQ ID NO: 455895 - RNA, 23 nt, Human
uucccugccuugggcaagggcug

SEQ ID NO: 455896 - RNA, 21 nt, Human
uuggggaaacuggcucuccuu

SEQ ID NO: 455897 - RNA, 24 nt, Human
uuggggaaacuggcucuccuucag

SEQ ID NO: 455898 - RNA, 23 nt, Human
uuguuaccaagaaaguaaaauga

SEQ ID NO: 455899 - RNA, 27 nt, Human
uuuguaauuuuuuuuuacaauguuucu

SEQ ID NO: 455900 - RNA, 23 nt, Human
aaaacaaguacucuggaccaaaa

SEQ ID NO: 455901 - RNA, 18 nt, Human
aaaauaaaaacaggaaaa

SEQ ID NO: 455902 - RNA, 19 nt, Human
aaacaggugccagaagccc

SEQ ID NO: 455903 - RNA, 19 nt, Human
aagaggaauuagccuacag

SEQ ID NO: 455904 - RNA, 22 nt, Human
aagcaaagcagcaggauccccu

SEQ ID NO: 455905 - RNA, 19 nt, Human
aagcugcugcggagcuggc

SEQ ID NO: 455906 - RNA, 24 nt, Human
aaggcaacgacuuaauaccaaaau

SEQ ID NO: 455907 - RNA, 24 nt, Human
aagucuccugaugucaagcaaucc

SEQ ID NO: 455908 - RNA, 19 nt, Human
aauaaaaacaggaaaagaa

SEQ ID NO: 455909 - RNA, 21 nt, Human
aaucugcucuccaugccucag

SEQ ID NO: 455910 - RNA, 23 nt, Human
acacacacacacacacacacaca

SEQ ID NO: 455911 - RNA, 23 nt, Human
acacacacacacacacacacaca

SEQ ID NO: 455912 - RNA, 23 nt, Human
acacacacacacacacacacaca

SEQ ID NO: 455913 - RNA, 23 nt, Human
acacacacacacacacacacaca

SEQ ID NO: 455914 - RNA, 23 nt, Human
acgcacacgcacauacacacaca

SEQ ID NO: 455915 - RNA, 23 nt, Human
acgcacauacacacacacacaca

SEQ ID NO: 455916 - RNA, 19 nt, Human
acuacauucucuuuauucu

SEQ ID NO: 455917 - RNA, 23 nt, Human
agaaaaaaaaauuauucuucucu

SEQ ID NO: 455918 - RNA, 21 nt, Human
agcaaagcagcaggauccccu

SEQ ID NO: 455919 - RNA, 22 nt, Human
agcuaaucacuacgaaagccug

SEQ ID NO: 455920 - RNA, 18 nt, Human
agcugagcccuggaaagc

SEQ ID NO: 455921 - RNA, 23 nt, Human
aggaaaagaaaaaguuaaaacac

SEQ ID NO: 455922 - RNA, 19 nt, Human
aggaaaagaauuauuuuau

SEQ ID NO: 455923 - RNA, 23 nt, Human
aggagcuuuaaaguccuauacca

SEQ ID NO: 455924 - RNA, 19 nt, Human
aggcacacaugugcacgca

SEQ ID NO: 455925 - RNA, 19 nt, Human
aggcagggguggggagcag

SEQ ID NO: 455926 - RNA, 24 nt, Human
aggcagggguggggagcagaccug

SEQ ID NO: 455927 - RNA, 23 nt, Human
aggugccagaagcccagggaacu

SEQ ID NO: 455928 - RNA, 19 nt, Human
auagugcaucuugaaaaga

SEQ ID NO: 455929 - RNA, 28 nt, Human
augcagcuucaguuggggggggaacgcc

SEQ ID NO: 455930 - RNA, 25 nt, Human
caacacgcaggcacacaugugcacg

SEQ ID NO: 455931 - RNA, 21 nt, Human
caacuacuuaacauuuacuca

SEQ ID NO: 455932 - RNA, 23 nt, Human
caagcaauccuucgugacuuccc

SEQ ID NO: 455933 - RNA, 24 nt, Human
caaguaauuauacaaauaaacauc

SEQ ID NO: 455934 - RNA, 20 nt, Human
cacacacacacacacacaca

SEQ ID NO: 455935 - RNA, 20 nt, Human
cacacacacacacacacaca

SEQ ID NO: 455936 - RNA, 20 nt, Human
cacacacacacacacacaca

SEQ ID NO: 455937 - RNA, 20 nt, Human
cacacacacacacacacaca

SEQ ID NO: 455938 - RNA, 20 nt, Human
cacacacacacacacacaca

SEQ ID NO: 455939 - RNA, 26 nt, Human
cacacacacacacacacacacacaca

SEQ ID NO: 455940 - RNA, 30 nt, Human; identical to SEQ ID NO: 326474

SEQ ID NO: 455941 - RNA, 29 nt, Human
cacacacacacacacacacacacacccug

SEQ ID NO: 455942 - RNA, 20 nt, Human
cacacacccugaaucugcuc

SEQ ID NO: 455943 - RNA, 21 nt, Human
cacagaccaagacuuugaagc

SEQ ID NO: 455944 - RNA, 26 nt, Human
cacauacacacacacacacacacaca

SEQ ID NO: 455945 - RNA, 31 nt, Human
cacgcacacgcacauacacacacacacacag

SEQ ID NO: 455946 - RNA, 22 nt, Human
cagaaaggaucuggcggugcca

SEQ ID NO: 455947 - RNA, 23 nt, Human
cagacccagcucccaaacugaag

SEQ ID NO: 455948 - RNA, 22 nt, Human
cagcuuuacaaauaaaggcaac

SEQ ID NO: 455949 - RNA, 25 nt, Human
cauacacacacacacacacacacac

SEQ ID NO: 455950 - RNA, 25 nt, Human
caugugcacgcacacgcacauacac

SEQ ID NO: 455951 - RNA, 21 nt, Human
ccaaaaauaaaacuucuuuga

SEQ ID NO: 455952 - RNA, 24 nt, Human
ccaaaaauaaaacuucuuugaagg

SEQ ID NO: 455953 - RNA, 23 nt, Human
ccaaaaggagcuuuaaaguccua

SEQ ID NO: 455954 - RNA, 22 nt, Human
ccaaacugaagagugacucaca

SEQ ID NO: 455955 - RNA, 21 nt, Human
ccacugcgcgcuccugucugc

SEQ ID NO: 455956 - RNA, 24 nt, Human
ccagaagcccagggaacuccuccc

SEQ ID NO: 455957 - RNA, 18 nt, Human
cccagggaacuccucccu

SEQ ID NO: 455958 - RNA, 19 nt, Human
ccccaaaccacuaccgugc

SEQ ID NO: 455959 - RNA, 21 nt, Human
ccccauguuagcagaaagcuc

SEQ ID NO: 455960 - RNA, 19 nt, Human
cccccaagucuccugaugu

SEQ ID NO: 455961 - RNA, 19 nt, Human
ccuccggggcagcucagcu

SEQ ID NO: 455962 - RNA, 19 nt, Human
ccugcggaaaccuccccaa

SEQ ID NO: 455963 - RNA, 21 nt, Human
ccugcggaaaccuccccaaac

SEQ ID NO: 455964 - RNA, 23 nt, Human
ccugcggaaaccuccccaaacca

SEQ ID NO: 455965 - RNA, 25 nt, Human
cgacuuaauaccaaaauaaaaacag

SEQ ID NO: 455966 - RNA, 23 nt, Human
cgcacauacacacacacacacac

SEQ ID NO: 455967 - RNA, 20 nt, Human
cgucuggaugaggacugccc

SEQ ID NO: 455968 - RNA, 23 nt, Human
cuacaaucccccccaagucuccu

SEQ ID NO: 455969 - RNA, 21 nt, Human
cuaugccagugccugcuaccu

SEQ ID NO: 455970 - RNA, 21 nt, Human
cuccaaaauauaaacacugua

SEQ ID NO: 455971 - RNA, 19 nt, Human
cugaaucugcucuccaugc

SEQ ID NO: 455972 - RNA, 20 nt, Human
cugacugcucucucuccccg

SEQ ID NO: 455973 - RNA, 22 nt, Human
cuugaaaagcugcugcggagcu

SEQ ID NO: 455974 - RNA, 19 nt, Human
cuugguuugguucccugca

SEQ ID NO: 455975 - RNA, 18 nt, Human
cuuuauucuuccgaggca

SEQ ID NO: 455976 - RNA, 18 nt, Human
gaacuccucccucccucc

SEQ ID NO: 455977 - RNA, 20 nt, Human
gacccagcucccaaacugag

SEQ ID NO: 455978 - RNA, 19 nt, Human
gaccugcggaaaccucccc

SEQ ID NO: 455979 - RNA, 22 nt, Human
gagggcuucgggggucucuccg

SEQ ID NO: 455980 - RNA, 24 nt, Human
gcaaagcagcaggauccccuagag

SEQ ID NO: 455981 - RNA, 26 nt, Human
gcagcuucaguuggggggggaacgcc

SEQ ID NO: 455982 - RNA, 24 nt, Human
gcggagcuggcuggacacaucggg

SEQ ID NO: 455983 - RNA, 22 nt, Human
ggaaguagcgaggaaggaaagc

SEQ ID NO: 455984 - RNA, 19 nt, Human
ggaauugaaaacugagucu

SEQ ID NO: 455985 - RNA, 21 nt, Human
ggcaacgacuuaauaccaaaa

SEQ ID NO: 455986 - RNA, 30 nt, Human
ggcacacaugugcacgcacacgcacauaca

SEQ ID NO: 455987 - RNA, 19 nt, Human
gggagcugagcccuggaaa

SEQ ID NO: 455988 - RNA, 20 nt, Human
ggugggguccuaacagcugg

SEQ ID NO: 455989 - RNA, 23 nt, Human
gugcacgcacacgcacauacaca

SEQ ID NO: 455990 - RNA, 21 nt, Human
guggggagcagaccugcggaa

SEQ ID NO: 455991 - RNA, 24 nt, Human
uaacagcugguugggagcugagcc

SEQ ID NO: 455992 - RNA, 28 nt, Human
uaauaccaaaauaaaaacaggaaaagaa

SEQ ID NO: 455993 - RNA, 20 nt, Human
uacacacacacacacacaca

SEQ ID NO: 455994 - RNA, 25 nt, Human
uacacacacacacacacacacacac

SEQ ID NO: 455995 - RNA, 18 nt, Human
uaccaaaauaaaaacagg

SEQ ID NO: 455996 - RNA, 20 nt, Human
uagaaacaggugccagaagc

SEQ ID NO: 455997 - RNA, 23 nt, Human
uaggccuuugagaagcuaagcuu

SEQ ID NO: 455998 - RNA, 23 nt, Human
ucaagcaauccuucgugacuucc

SEQ ID NO: 455999 - RNA, 23 nt, Human
ucagcuuugugcacuuuggggug

SEQ ID NO: 456000 - RNA, 18 nt, Human
uccacaggaaaagaauua

SEQ ID NO: 456001 - RNA, 18 nt, Human
ucccuagagaaaaaaaaa

SEQ ID NO: 456002 - RNA, 20 nt, Human
ucccuccggggcagcucagc

SEQ ID NO: 456003 - RNA, 22 nt, Human
ucccuccggggcagcucagcuu

SEQ ID NO: 456004 - RNA, 21 nt, Human
ucgacaauaaaggcaaaaggg

SEQ ID NO: 456005 - RNA, 20 nt, Human
ucucccuagagaaaaaaaaa

SEQ ID NO: 456006 - RNA, 21 nt, Human
ucucuggguggggaaaagccc

SEQ ID NO: 456007 - RNA, 21 nt, Human
ucucuucaaaaacaggaauug

SEQ ID NO: 456008 - RNA, 21 nt, Human
ucugaaacauuuuccuuuuua

SEQ ID NO: 456009 - RNA, 19 nt, Human
ucugcuacaauccccccca

SEQ ID NO: 456010 - RNA, 22 nt, Human
ucuggaugaggacugcccugga

SEQ ID NO: 456011 - RNA, 22 nt, Human
ucuucggcuuugagaugcagcu

SEQ ID NO: 456012 - RNA, 27 nt, Human
ucuuuauucuuccgaggcagggguugg

SEQ ID NO: 456013 - RNA, 21 nt, Human
ugaagagugacucacagacca

SEQ ID NO: 456014 - RNA, 21 nt, Human
ugaaggagacggaauccuuuu

SEQ ID NO: 456015 - RNA, 19 nt, Human
ugccaaggcuugguuaggc

SEQ ID NO: 456016 - RNA, 23 nt, Human
ugccaaggcuugguuaggccuuu

SEQ ID NO: 456017 - RNA, 21 nt, Human
ugccucagauuaucucaguau

SEQ ID NO: 456018 - RNA, 19 nt, Human
uggaaucuucggcuuugag

SEQ ID NO: 456019 - RNA, 21 nt, Human
uggaugaggacugcccuggag

SEQ ID NO: 456020 - RNA, 22 nt, Human
ugggagcugagcccuggaaagc

SEQ ID NO: 456021 - RNA, 19 nt, Human
uggggaaaagcccagacgu

SEQ ID NO: 456022 - RNA, 24 nt, Human
uggggaaaagcccagacgucugcu

SEQ ID NO: 456023 - RNA, 20 nt, Human
ugggguccuaacagcugguu

SEQ ID NO: 456024 - RNA, 19 nt, Human
uugcagcauucacaaaaac

SEQ ID NO: 456025 - RNA, 20 nt, Human
uuuacaaauaaaggcaacga

SEQ ID NO: 456026 - RNA, 18 nt, Human
uuugaagcuuuugaaaau

SEQ ID NO: 456027 - RNA, 26 nt, Human
aaacaccuagaaauucaucaaaaaua

SEQ ID NO: 456028 - RNA, 23 nt, Human
aacagcucaaacaauucaauaau

SEQ ID NO: 456029 - RNA, 22 nt, Human
aacccaguagugggucauaaaa

SEQ ID NO: 456030 - RNA, 18 nt, Human
aagaacucugagagcagg

SEQ ID NO: 456031 - RNA, 22 nt, Human
aagaacucugagagcaggacuc

SEQ ID NO: 456032 - RNA, 20 nt, Human
aauuguguuuguuacuaagg

SEQ ID NO: 456033 - RNA, 23 nt, Human
acgaaacagaagaacucugagag

SEQ ID NO: 456034 - RNA, 18 nt, Human
agcaggacucuggguauu

SEQ ID NO: 456035 - RNA, 18 nt, Human
aggcacuagguggaucca

SEQ ID NO: 456036 - RNA, 20 nt, Human
aucucuccuccccuccuccc

SEQ ID NO: 456037 - RNA, 25 nt, Human
aucucuccuccccuccuccccauug

SEQ ID NO: 456038 - RNA, 22 nt, Human
auuucuaaaacauacuuuaaaa

SEQ ID NO: 456039 - RNA, 21 nt, Human
caccuagaaauucaucaaaaa

SEQ ID NO: 456040 - RNA, 24 nt, Human
cagagaaaaauaucauaguucuca

SEQ ID NO: 456041 - RNA, 26 nt, Human
cagggugggugcuuagugaaccuguu

SEQ ID NO: 456042 - RNA, 25 nt, Human
caguagugggucauaaaaauccauu

SEQ ID NO: 456043 - RNA, 23 nt, Human
cccaaacaccuagaaauucauca

SEQ ID NO: 456044 - RNA, 24 nt, Human
ccugugcugcagugauuuccauaa

SEQ ID NO: 456045 - RNA, 18 nt, Human
cuccuccccuccucccca

SEQ ID NO: 456046 - RNA, 20 nt, Human
cuuuaucugucccuggcugg

SEQ ID NO: 456047 - RNA, 22 nt, Human
gagcaggacucuggguauugga

SEQ ID NO: 456048 - RNA, 24 nt, Human
gugggucacgaaacagaagaacuc

SEQ ID NO: 456049 - RNA, 22 nt, Human
uaacaucugaauuacuuuuccu

SEQ ID NO: 456050 - RNA, 19 nt, Human
uaauucuauuuuguucagg

SEQ ID NO: 456051 - RNA, 21 nt, Human
uaccaacuaauacaagcucac

SEQ ID NO: 456052 - RNA, 22 nt, Human
uaccaacuucuucaaguggcau

SEQ ID NO: 456053 - RNA, 21 nt, Human
uacuaggauggaucacacauu

SEQ ID NO: 456054 - RNA, 21 nt, Human
uauccaucucuccuccccucc

SEQ ID NO: 456055 - RNA, 20 nt, Human
uauggcccagaggcacuagg

SEQ ID NO: 456056 - RNA, 18 nt, Human
ucaaaacagcucaaacaa

SEQ ID NO: 456057 - RNA, 19 nt, Human
ucacgaaacagaagaacuc

SEQ ID NO: 456058 - RNA, 19 nt, Human
ucuaaaacauacuuuaaaa

SEQ ID NO: 456059 - RNA, 21 nt, Human
ucucuccuccccuccucccca

SEQ ID NO: 456060 - RNA, 20 nt, Human
ugaaauauccaucucuccuc

SEQ ID NO: 456061 - RNA, 22 nt, Human
ugaaauauccaucucuccuccc

SEQ ID NO: 456062 - RNA, 21 nt, Human
ugacccaaacaccuagaaauu

SEQ ID NO: 456063 - RNA, 19 nt, Human
ugaguccuuuaugacaguu

SEQ ID NO: 456064 - RNA, 18 nt, Human
ugcaugaccucuuuucua

SEQ ID NO: 456065 - RNA, 26 nt, Human
ugcucagccuuauggcccagaggcac

SEQ ID NO: 456066 - RNA, 20 nt, Human
uggaacagaaaauacuagga

SEQ ID NO: 456067 - RNA, 22 nt, Human
uggaacagaaaauacuaggaug

SEQ ID NO: 456068 - RNA, 18 nt, Human
ugguagaaaaguggguca

SEQ ID NO: 456069 - RNA, 24 nt, Human
ugucucauccucuuugcuagccua

SEQ ID NO: 456070 - RNA, 19 nt, Human
ugugacccaaacaccuaga

SEQ ID NO: 456071 - RNA, 22 nt, Human
uuaagugucuuguagcaauauu

SEQ ID NO: 456072 - RNA, 23 nt, Human
uucaggcuugagcuuuuguagga

SEQ ID NO: 456073 - RNA, 18 nt, Human
uucagguaauagcaauaa

SEQ ID NO: 456074 - RNA, 26 nt, Human
uugcugggucauuauauaaauugugu

SEQ ID NO: 456075 - RNA, 18 nt, Human
uuguacuuauuuugcucc

SEQ ID NO: 456076 - RNA, 18 nt, Human
uuuaauagcugaaaagaa

SEQ ID NO: 456077 - RNA, 21 nt, Human
uuugaaaagucucaacuagca

SEQ ID NO: 456078 - RNA, 22 nt, Human
uuuuuuaaaagcuaccaacuaa

SEQ ID NO: 456079 - RNA, 21 nt, Human
uuuuuuuuuuuuuuucucauu

SEQ ID NO: 456080 - RNA, 19 nt, Human
aaagaaaacggaaaaaguc

SEQ ID NO: 456081 - RNA, 24 nt, Human
aaagugcugggauuacaggcguga

SEQ ID NO: 456082 - RNA, 19 nt, Human
aagugcugggauuacaggc

SEQ ID NO: 456083 - RNA, 19 nt, Human
aagugcugggauuacaggc

SEQ ID NO: 456084 - RNA, 26 nt, Human
aagugcugggauuacaggcgugagcc

SEQ ID NO: 456085 - RNA, 18 nt, Human
aauaaggaacaagagaga

SEQ ID NO: 456086 - RNA, 20 nt, Human
aaugugaucuagaaauagag

SEQ ID NO: 456087 - RNA, 20 nt, Human
aauugccaugucuaauucuu

SEQ ID NO: 456088 - RNA, 18 nt, Human
acagcaacaacgaaucaa

SEQ ID NO: 456089 - RNA, 18 nt, Human
acaggguuucaccauguu

SEQ ID NO: 456090 - RNA, 21 nt, Human
acaggguuucaccauguuggc

SEQ ID NO: 456091 - RNA, 24 nt, Human
acaggguuucaccauguuggccag

SEQ ID NO: 456092 - RNA, 24 nt, Human
accauguuggccaggcuggucuug

SEQ ID NO: 456093 - RNA, 19 nt, Human
agagacagagcggggaagg

SEQ ID NO: 456094 - RNA, 25 nt, Human
aggaaaacgaggagaaaccgguacc

SEQ ID NO: 456095 - RNA, 23 nt, Human
aggaacaagagagagagagugac

SEQ ID NO: 456096 - RNA, 20 nt, Human
aggaagcaacagguuaaaca

SEQ ID NO: 456097 - RNA, 22 nt, Human
agguaagaaacaaaaaauaagg

SEQ ID NO: 456098 - RNA, 22 nt, Human
aguagagacaggguuucaccau

SEQ ID NO: 456099 - RNA, 18 nt, Human
agugcugggauuacaggc

SEQ ID NO: 456100 - RNA, 22 nt, Human
caaagaaaacggaaaaagucua

SEQ ID NO: 456101 - RNA, 24 nt, Human
caaagugcugggauuacaggcgug

SEQ ID NO: 456102 - RNA, 18 nt, Human
caagagagagagagugac

SEQ ID NO: 456103 - RNA, 21 nt, Human
caccauguuggccaggcuggu

SEQ ID NO: 456104 - RNA, 23 nt, Human
caccauguuggccaggcuggucu

SEQ ID NO: 456105 - RNA, 24 nt, Human
caccauguuggccaggcuggucuu

SEQ ID NO: 456106 - RNA, 27 nt, Human
caccauguuggccaggcuggucuugaa

SEQ ID NO: 456107 - RNA, 23 nt, Human
cacccgccucagccucccaaagu

SEQ ID NO: 456108 - RNA, 24 nt, Human
caggguuucaccauguuggccagg

SEQ ID NO: 456109 - RNA, 24 nt, Human
cauguuggccaggcuggucuugaa

SEQ ID NO: 456110 - RNA, 22 nt, Human
ccaaagugcugggauuacaggc

SEQ ID NO: 456111 - RNA, 22 nt, Human
ccaaagugcugggauuacaggc

SEQ ID NO: 456112 - RNA, 24 nt, Human
ccaaagugcugggauuacaggcgu

SEQ ID NO: 456113 - RNA, 26 nt, Human
ccacccgccucagccucccaaagugc

SEQ ID NO: 456114 - RNA, 21 nt, Human
ccacugcacccagccuuaagg

SEQ ID NO: 456115 - RNA, 22 nt, Human
ccacugcacccagccuuaaggu

SEQ ID NO: 456116 - RNA, 24 nt, Human
ccgccucagccucccaaagugcug

SEQ ID NO: 456117 - RNA, 20 nt, Human
ccugagcuugugauccaccc

SEQ ID NO: 456118 - RNA, 23 nt, Human
cgcuaggacugcaucuugggaac

SEQ ID NO: 456119 - RNA, 21 nt, Human
cggaaaaagucuaggaguuag

SEQ ID NO: 456120 - RNA, 23 nt, Human
cggaaaaagucuaggaguuagug

SEQ ID NO: 456121 - RNA, 24 nt, Human
cucagaauagaaaggauuuuaaaa

SEQ ID NO: 456122 - RNA, 24 nt, Human
cuccugagcuugugauccacccgc

SEQ ID NO: 456123 - RNA, 25 nt, Human
gaaauagagguugagauugcuccau

SEQ ID NO: 456124 - RNA, 22 nt, Human
gagcuugugauccacccgccuc

SEQ ID NO: 456125 - RNA, 24 nt, Human
gagcuugugauccacccgccucag

SEQ ID NO: 456126 - RNA, 19 nt, Human
gauauccuucaccccacuc

SEQ ID NO: 456127 - RNA, 18 nt, Human
gauuacaggcgugagcca

SEQ ID NO: 456128 - RNA, 19 nt, Human
gauuacaggcgugagccac

SEQ ID NO: 456129 - RNA, 23 nt, Human
gauuacaggcgugagccacugca

SEQ ID NO: 456130 - RNA, 23 nt, Human
gccucagccucccaaagugcugg

SEQ ID NO: 456131 - RNA, 20 nt, Human
ggacugcaucuugggaacag

SEQ ID NO: 456132 - RNA, 20 nt, Human
ggacugcaucuugggaacag

SEQ ID NO: 456133 - RNA, 23 nt, Human
ggcuggucuugaacuccugagcu

SEQ ID NO: 456134 - RNA, 22 nt, Human
ggguuucaccauguuggccagg

SEQ ID NO: 456135 - RNA, 24 nt, Human
gguaagaaacaaaaaauaaggaac

SEQ ID NO: 456136 - RNA, 22 nt, Human
guaagaaacaaaaaauaaggaa

SEQ ID NO: 456137 - RNA, 24 nt, Human
gugauccacccgccucagccuccc

SEQ ID NO: 456138 - RNA, 26 nt, Human
uaaacaguaagagguaagaaacaaaa

SEQ ID NO: 456139 - RNA, 22 nt, Human
uaaauaucugcauuaaagaacg

SEQ ID NO: 456140 - RNA, 23 nt, Human
uaagaaacaaaaaauaaggaaca

SEQ ID NO: 456141 - RNA, 25 nt, Human
uaagaaacaaaaaauaaggaacaag

SEQ ID NO: 456142 - RNA, 19 nt, Human
uacaggcgugagccacugc

SEQ ID NO: 456143 - RNA, 24 nt, Human
uacaggcgugagccacugcaccca

SEQ ID NO: 456144 - RNA, 22 nt, Human
uagagacaggguuucaccaugu

SEQ ID NO: 456145 - RNA, 24 nt, Human
uaguagagacaggguuucaccaug

SEQ ID NO: 456146 - RNA, 26 nt, Human
uaguagagacaggguuucaccauguu

SEQ ID NO: 456147 - RNA, 19 nt, Human
uauggaagauuugaaauac

SEQ ID NO: 456148 - RNA, 24 nt, Human
ucauauucccucuuuugucccaug

SEQ ID NO: 456149 - RNA, 21 nt, Human
uccacccgccucagccuccca

SEQ ID NO: 456150 - RNA, 18 nt, Human
uccagaaggaagcaacag

SEQ ID NO: 456151 - RNA, 24 nt, Human
ucccaaagugcugggauuacaggc

SEQ ID NO: 456152 - RNA, 24 nt, Human
uccuacuuaaaguguauccaaaga

SEQ ID NO: 456153 - RNA, 19 nt, Human
ucuugaacuccugagcuug

SEQ ID NO: 456154 - RNA, 22 nt, Human
ugaacuccugagcuugugaucc

SEQ ID NO: 456155 - RNA, 24 nt, Human
ugcugggauuacaggcgugagcca

SEQ ID NO: 456156 - RNA, 24 nt, Human
uggaagauuugaaauacaaggaua

SEQ ID NO: 456157 - RNA, 24 nt, Human
uggccaggcuggucuugaacuccu

SEQ ID NO: 456158 - RNA, 18 nt, Human
ugggauuacaggcgugag

SEQ ID NO: 456159 - RNA, 19 nt, Human
ugggauuacaggcgugagc

SEQ ID NO: 456160 - RNA, 21 nt, Human
ugggauuacaggcgugagcca

SEQ ID NO: 456161 - RNA, 22 nt, Human
ugggauuacaggcgugagccac

SEQ ID NO: 456162 - RNA, 22 nt, Human
ugggauuacaggcgugagccac

SEQ ID NO: 456163 - RNA, 24 nt, Human
ugggauuacaggcgugagccacug

SEQ ID NO: 456164 - RNA, 26 nt, Human
ugggauuacaggcgugagccacugca

SEQ ID NO: 456165 - RNA, 24 nt, Human
ugugauccacccgccucagccucc

SEQ ID NO: 456166 - RNA, 24 nt, Human
uuaguagagacaggguuucaccau

SEQ ID NO: 456167 - RNA, 25 nt, Human
uucaccccacuccaggaacguucgc

SEQ ID NO: 456168 - RNA, 22 nt, Human
uucccauaugcaaauauuucau

SEQ ID NO: 456169 - RNA, 24 nt, Human
uuucaccauguuggccaggcuggu

SEQ ID NO: 456170 - RNA, 22 nt, Human
aaagagaccuaaacaucuccua

SEQ ID NO: 456171 - RNA, 23 nt, Human
aaccagaguaacaaaacaauucc

SEQ ID NO: 456172 - RNA, 24 nt, Human
aacguccuaaaacccagaaaauuc

SEQ ID NO: 456173 - RNA, 21 nt, Human
aacuaugccaagugcaaagcc

SEQ ID NO: 456174 - RNA, 19 nt, Human
aagcagccugcaggagaga

SEQ ID NO: 456175 - RNA, 18 nt, Human
aagccccaugucuuuggg

SEQ ID NO: 456176 - RNA, 23 nt, Human
aaggaccaaggucuggccaggca

SEQ ID NO: 456177 - RNA, 22 nt, Human
aaggagcccccguggugggcgu

SEQ ID NO: 456178 - RNA, 21 nt, Human
aaggcagguguggauggagcc

SEQ ID NO: 456179 - RNA, 24 nt, Human
aauacaauaugaaaaaccccagaa

SEQ ID NO: 456180 - RNA, 20 nt, Human
aaugaagaugcccaggucug

SEQ ID NO: 456181 - RNA, 19 nt, Human
aaugugcagcucuaucccc

SEQ ID NO: 456182 - RNA, 20 nt, Human
aauuuugcacaaugacuguu

SEQ ID NO: 456183 - RNA, 21 nt, Human
acacuaagguaaugcacagaa

SEQ ID NO: 456184 - RNA, 18 nt, Human
acacuguaacggaaggua

SEQ ID NO: 456185 - RNA, 23 nt, Human
acagggugaucgggaaaaaagua

SEQ ID NO: 456186 - RNA, 20 nt, Human
accacaauuuggcacaacaa

SEQ ID NO: 456187 - RNA, 22 nt, Human
accagaguaacaaaacaauucc

SEQ ID NO: 456188 - RNA, 18 nt, Human
acucaucuccgagucuaa

SEQ ID NO: 456189 - RNA, 18 nt, Human
acucuuuacccaggccca

SEQ ID NO: 456190 - RNA, 29 nt, Human
acugcagccucagguccagcuggucccaa

SEQ ID NO: 456191 - RNA, 21 nt, Human
agaacccuacagcuaccuuuc

SEQ ID NO: 456192 - RNA, 22 nt, Human
agaagacugcagccucaggucc

SEQ ID NO: 456193 - RNA, 22 nt, Human
agaaucugaauacccuggauuu

SEQ ID NO: 456194 - RNA, 18 nt, Human
agagaagaccugcaugug

SEQ ID NO: 456195 - RNA, 19 nt, Human
agagggaaggggaaggggc

SEQ ID NO: 456196 - RNA, 20 nt, Human
agauacugcauaaacuacaa

SEQ ID NO: 456197 - RNA, 25 nt, Human
agcagaauacaggggcucagggcug

SEQ ID NO: 456198 - RNA, 19 nt, Human
agcaggggucccaguggcu

SEQ ID NO: 456199 - RNA, 18 nt, Human
agcccuugguggcucaga

SEQ ID NO: 456200 - RNA, 21 nt, Human
agcugcagcgugcggcgcccc

SEQ ID NO: 456201 - RNA, 20 nt, Human
aggaccacgagcauagacca

SEQ ID NO: 456202 - RNA, 28 nt, Human
aggcuggaaccuccuaaaacugcuuucu

SEQ ID NO: 456203 - RNA, 19 nt, Human
agggagcaggaccaggacu

SEQ ID NO: 456204 - RNA, 20 nt, Human
agguguggauggagccucug

SEQ ID NO: 456205 - RNA, 23 nt, Human
agugggcuccuggcgagccuggc

SEQ ID NO: 456206 - RNA, 19 nt, Human
auaaagaccaacauucuga

SEQ ID NO: 456207 - RNA, 19 nt, Human
aucugugcugggacaccuc

SEQ ID NO: 456208 - RNA, 19 nt, Human
augaaacuaugccaagugc

SEQ ID NO: 456209 - RNA, 22 nt, Human
augaaucaacacuguaacggaa

SEQ ID NO: 456210 - RNA, 19 nt, Human
auuuugcacaaugacuguu

SEQ ID NO: 456211 - RNA, 18 nt, Human
caaacacggugggagcug

SEQ ID NO: 456212 - RNA, 20 nt, Human
caaagcucucacaagugucc

SEQ ID NO: 456213 - RNA, 26 nt, Human
caaauaaauaccccauacuguaauga

SEQ ID NO: 456214 - RNA, 19 nt, Human
caacucagguucugccccu

SEQ ID NO: 456215 - RNA, 19 nt, Human
caacucagguucugccccu

SEQ ID NO: 456216 - RNA, 19 nt, Human
cacagcucugccucgugcu

SEQ ID NO: 456217 - RNA, 21 nt, Human
caccccaaguacaaaaggacu

SEQ ID NO: 456218 - RNA, 18 nt, Human
caccugcuguccacgcug

SEQ ID NO: 456219 - RNA, 22 nt, Human
cacggcaccugagaccgucucu

SEQ ID NO: 456220 - RNA, 24 nt, Human
cagaaaaaauacaguacucagaca

SEQ ID NO: 456221 - RNA, 19 nt, Human
cagagagcugugggagggg

SEQ ID NO: 456222 - RNA, 22 nt, Human
cagagagcugugggagggggca

SEQ ID NO: 456223 - RNA, 18 nt, Human
caguggcauauccaaaaa

SEQ ID NO: 456224 - RNA, 20 nt, Human
cauccccuacugcgcaugcc

SEQ ID NO: 456225 - RNA, 20 nt, Human
caucuccuaccugugaaucc

SEQ ID NO: 456226 - RNA, 22 nt, Human
ccacucccacuaaccucacuca

SEQ ID NO: 456227 - RNA, 23 nt, Human
ccagacaaacacggugggagcug

SEQ ID NO: 456228 - RNA, 18 nt, Human
ccagcagaauacaggggc

SEQ ID NO: 456229 - RNA, 18 nt, Human
ccagcagaauacaggggc

SEQ ID NO: 456230 - RNA, 22 nt, Human
ccauacagaugaaguuaucucc

SEQ ID NO: 456231 - RNA, 22 nt, Human
ccaugucuuugggacugaaccc

SEQ ID NO: 456232 - RNA, 18 nt, Human
ccccagaaucugaauacc

SEQ ID NO: 456233 - RNA, 18 nt, Human
ccuaugcugcaggcugga

SEQ ID NO: 456234 - RNA, 21 nt, Human
ccucacucagcaaacaaaaca

SEQ ID NO: 456235 - RNA, 20 nt, Human
ccuccugauacccucagcuc

SEQ ID NO: 456236 - RNA, 21 nt, Human
ccucuggaaaugggagaaccc

SEQ ID NO: 456237 - RNA, 19 nt, Human
ccuggguuauggucagcug

SEQ ID NO: 456238 - RNA, 25 nt, Human
cgaggaacaugcaagucucaacuca

SEQ ID NO: 456239 - RNA, 19 nt, Human
cgcaggccgggcccuccuc

SEQ ID NO: 456240 - RNA, 24 nt, Human
cgcagggcuuagaagauggcaggg

SEQ ID NO: 456241 - RNA, 26 nt, Human
cggcuagacuccuacccucugugcau

SEQ ID NO: 456242 - RNA, 19 nt, Human
cguccuaaaacccagaaaa

SEQ ID NO: 456243 - RNA, 24 nt, Human
cuaaagcuacacgcuauggagcac

SEQ ID NO: 456244 - RNA, 19 nt, Human
cuaugcugcaggcuggaac

SEQ ID NO: 456245 - RNA, 22 nt, Human
cucaacucagguucugccccuu

SEQ ID NO: 456246 - RNA, 20 nt, Human
cucacucagcaaacaaaaca

SEQ ID NO: 456247 - RNA, 19 nt, Human
cucagcuugucccagaagg

SEQ ID NO: 456248 - RNA, 24 nt, Human
cucccacuaaccucacucagcaaa

SEQ ID NO: 456249 - RNA, 21 nt, Human
cuccuuccuauuccuuuucca

SEQ ID NO: 456250 - RNA, 26 nt, Human
cugaugcaacgccccauggcgccucg

SEQ ID NO: 456251 - RNA, 22 nt, Human
cugcagugugacagggccgggu

SEQ ID NO: 456252 - RNA, 22 nt, Human
cuggcagccagggaagaagggu

SEQ ID NO: 456253 - RNA, 24 nt, Human
cugggcuuggggaagaaauucugg

SEQ ID NO: 456254 - RNA, 21 nt, Human
cuucacaacguccuaaaaccc

SEQ ID NO: 456255 - RNA, 19 nt, Human
gaaaaccuggggccuuggg

SEQ ID NO: 456256 - RNA, 26 nt, Human
gagaaaagagagcguuagaaagcggu

SEQ ID NO: 456257 - RNA, 19 nt, Human
gagcauagaccacggcacc

SEQ ID NO: 456258 - RNA, 18 nt, Human
gcaaagcuuucccagcac

SEQ ID NO: 456259 - RNA, 22 nt, Human
gcaggaccaggacuccucccuu

SEQ ID NO: 456260 - RNA, 24 nt, Human
gcaggggucccaguggcuugggug

SEQ ID NO: 456261 - RNA, 19 nt, Human
gccaucccccagauugcac

SEQ ID NO: 456262 - RNA, 23 nt, Human
gcgagucuugcuggggcaggggg

SEQ ID NO: 456263 - RNA, 18 nt, Human
gcugcagcgugcggcgcc

SEQ ID NO: 456264 - RNA, 21 nt, Human
gcuggaaccuccuaaaacugc

SEQ ID NO: 456265 - RNA, 19 nt, Human
ggaaggcagguguggaugg

SEQ ID NO: 456266 - RNA, 18 nt, Human
ggagcacacagcucugcc

SEQ ID NO: 456267 - RNA, 21 nt, Human
ggcagagagcugugggagggg

SEQ ID NO: 456268 - RNA, 20 nt, Human
ggcugcagugugacagggcc

SEQ ID NO: 456269 - RNA, 21 nt, Human
gggaagaacgcgcagggcaga

SEQ ID NO: 456270 - RNA, 22 nt, Human
gggaaggggaaggggcugcagu

SEQ ID NO: 456271 - RNA, 22 nt, Human
gggagggggcaacacggucucu

SEQ ID NO: 456272 - RNA, 20 nt, Human
gggcagagagcugugggaag

SEQ ID NO: 456273 - RNA, 22 nt, Human
ggugcuccugagggggcuuuga

SEQ ID NO: 456274 - RNA, 19 nt, Human
ggugugaggagcaccugcc

SEQ ID NO: 456275 - RNA, 24 nt, Human
guaaagaaucacugacuaacagaa

SEQ ID NO: 456276 - RNA, 20 nt, Human
guaacucgaaugccucuucc

SEQ ID NO: 456277 - RNA, 19 nt, Human
guaauacuacucauucaau

SEQ ID NO: 456278 - RNA, 22 nt, Human
gucaugcuucacaacguccuaa

SEQ ID NO: 456279 - RNA, 22 nt, Human
gucugggugugaggagcaccug

SEQ ID NO: 456280 - RNA, 18 nt, Human
gugggcaugccagcagcc

SEQ ID NO: 456281 - RNA, 20 nt, Human
uaaaaaaagaacauguguaa

SEQ ID NO: 456282 - RNA, 19 nt, Human
uaaccagagcaaaggucaa

SEQ ID NO: 456283 - RNA, 24 nt, Human
uaaccucacucagcaaacaaaaca

SEQ ID NO: 456284 - RNA, 21 nt, Human
uaauacuacucauucaauaau

SEQ ID NO: 456285 - RNA, 23 nt, Human
uaauaucaaaauaucaaaagugc

SEQ ID NO: 456286 - RNA, 21 nt, Human
uacaccuguggguguccaacc

SEQ ID NO: 456287 - RNA, 27 nt, Human
uacaggaccacgagcauagaggacauc

SEQ ID NO: 456288 - RNA, 22 nt, Human
uacuauggcuaacccucauccc

SEQ ID NO: 456289 - RNA, 19 nt, Human
uagcaggggucccaguggc

SEQ ID NO: 456290 - RNA, 24 nt, Human
uagguugcccuuccuuccuccuug

SEQ ID NO: 456291 - RNA, 21 nt, Human
uaugaaaaaccccagaaucug

SEQ ID NO: 456292 - RNA, 20 nt, Human
uccaacccagccaagcccuu

SEQ ID NO: 456293 - RNA, 20 nt, Human
uccaagaguaccaauuugac

SEQ ID NO: 456294 - RNA, 20 nt, Human
ucccaaagcacacucaaggu

SEQ ID NO: 456295 - RNA, 21 nt, Human
ucccuuggguuuccccacggg

SEQ ID NO: 456296 - RNA, 24 nt, Human
uccuaccaaugugacucuuuaccc

SEQ ID NO: 456297 - RNA, 22 nt, Human
uccugagggggcuuugaggagu

SEQ ID NO: 456298 - RNA, 19 nt, Human
ucggcccauacagaggccu

SEQ ID NO: 456299 - RNA, 22 nt, Human
ucuucggcccauacagaggccu

SEQ ID NO: 456300 - RNA, 24 nt, Human
ucuuugggacugaacccccuaugg

SEQ ID NO: 456301 - RNA, 20 nt, Human
ugaaaagaauugcaguggca

SEQ ID NO: 456302 - RNA, 21 nt, Human
ugaaaagaauugcaguggcau

SEQ ID NO: 456303 - RNA, 20 nt, Human
ugacaaguggcccuggcccu

SEQ ID NO: 456304 - RNA, 22 nt, Human
ugacuaacagaauuuugcacaa

SEQ ID NO: 456305 - RNA, 20 nt, Human
ugagaaugaucugugcuggg

SEQ ID NO: 456306 - RNA, 22 nt, Human
ugaggcggacagcuacaggacc

SEQ ID NO: 456307 - RNA, 23 nt, Human
ugaggcggacagcuacaggacca

SEQ ID NO: 456308 - RNA, 25 nt, Human
ugaucugugcugggacaccucccuu

SEQ ID NO: 456309 - RNA, 22 nt, Human
ugauuauuauuuuuuuguuugg

SEQ ID NO: 456310 - RNA, 25 nt, Human
ugcaaauaaauaccccauacagaug

SEQ ID NO: 456311 - RNA, 18 nt, Human
ugcacagaaaaaauacag

SEQ ID NO: 456312 - RNA, 23 nt, Human
ugcacagaaaaaauacaguacuc

SEQ ID NO: 456313 - RNA, 19 nt, Human
uggcagaagagaagaccug

SEQ ID NO: 456314 - RNA, 21 nt, Human
uggccaggcacuuggaaagcu

SEQ ID NO: 456315 - RNA, 22 nt, Human
uggcuaacccucauccccuacu

SEQ ID NO: 456316 - RNA, 24 nt, Human
uggcucagacuucaggcuaggguu

SEQ ID NO: 456317 - RNA, 20 nt, Human
ugggagcugaggcggacagc

SEQ ID NO: 456318 - RNA, 18 nt, Human
ugggagggggcaacacgg

SEQ ID NO: 456319 - RNA, 22 nt, Human
uggggcagggggaucugggccc

SEQ ID NO: 456320 - RNA, 21 nt, Human
uggggucaccccaaguacaaa

SEQ ID NO: 456321 - RNA, 18 nt, Human
ugggugcuccugaggggg

SEQ ID NO: 456322 - RNA, 21 nt, Human
ugggugugaggagcaccugcc

SEQ ID NO: 456323 - RNA, 24 nt, Human
uggguuauggucagcugugucugu

SEQ ID NO: 456324 - RNA, 21 nt, Human
ugguccuaccaaugugacucu

SEQ ID NO: 456325 - RNA, 19 nt, Human
uguaccacaauuuggcaca

SEQ ID NO: 456326 - RNA, 20 nt, Human
ugugacagggccggguggcc

SEQ ID NO: 456327 - RNA, 21 nt, Human
ugugggaaggcagguguggau

SEQ ID NO: 456328 - RNA, 23 nt, Human
uuagcaggggucccaguggcuug

SEQ ID NO: 456329 - RNA, 22 nt, Human
uucacaacguccuaaaacccag

SEQ ID NO: 456330 - RNA, 20 nt, Human
uucauacagcuugcucagcu

SEQ ID NO: 456331 - RNA, 21 nt, Human
uuccaugaaacuaugccaagu

SEQ ID NO: 456332 - RNA, 22 nt, Human
uuccuauuccuuuuccaugcuc

SEQ ID NO: 456333 - RNA, 23 nt, Human
uuccuggguuauggucagcugug

SEQ ID NO: 456334 - RNA, 24 nt, Human
uuccuggguuauggucagcugugu

SEQ ID NO: 456335 - RNA, 24 nt, Human
uugaagcucuccacgugcugggag

SEQ ID NO: 456336 - RNA, 21 nt, Human
uugcaguggcauauccaaaaa

SEQ ID NO: 456337 - RNA, 20 nt, Human
uugggugcugagggagcagg

SEQ ID NO: 456338 - RNA, 24 nt, Human
uuuaaaaucuguaauuucaaacau

SEQ ID NO: 456339 - RNA, 21 nt, Human
uuucuaagccccugaauuugc

SEQ ID NO: 456340 - RNA, 23 nt, Human
uuugaccacucccacuaaccuca

SEQ ID NO: 456341 - RNA, 25 nt, Human
uuugagaaugaucugugcugggaca

SEQ ID NO: 456342 - RNA, 19 nt, Human
uuuggagaaggaaggacag

SEQ ID NO: 456343 - RNA, 19 nt, Human
aaaaacaaaaaaccugagu

SEQ ID NO: 456344 - RNA, 24 nt, Human
aaacaaaaaaccugaguauaaaac

SEQ ID NO: 456345 - RNA, 31 nt, Human
aaacaaaaaaccugaguauaaaaccucagcu

SEQ ID NO: 456346 - RNA, 22 nt, Human
aaccucagcaguguuccagcac

SEQ ID NO: 456347 - RNA, 24 nt, Human
acagcagcaggccgccaccuccag

SEQ ID NO: 456348 - RNA, 22 nt, Human
accagcacucccccugcuaccu

SEQ ID NO: 456349 - RNA, 22 nt, Human
agaaaaaacgaaaacuggaaua

SEQ ID NO: 456350 - RNA, 20 nt, Human
cagggcaguggucauggggg

SEQ ID NO: 456351 - RNA, 26 nt, Human
ccugccgugugggcaggggcaggagu

SEQ ID NO: 456352 - RNA, 20 nt, Human
cuggcggcggcgaugcuggc

SEQ ID NO: 456353 - RNA, 24 nt, Human
cuggcggcggcgaugcuggcagcg

SEQ ID NO: 456354 - RNA, 24 nt, Human
gaaaacaguuaaaaagauaacagc

SEQ ID NO: 456355 - RNA, 25 nt, Human
ggcaggagugaauggcucuuccugg

SEQ ID NO: 456356 - RNA, 21 nt, Human
ggcaggggcaggagugaaugg

SEQ ID NO: 456357 - RNA, 20 nt, Human
uaaaaaggcaucaugagaaa

SEQ ID NO: 456358 - RNA, 24 nt, Human
uaacagcagcaggccgccaccucc

SEQ ID NO: 456359 - RNA, 19 nt, Human
uagaaaaaacgaaaacugg

SEQ ID NO: 456360 - RNA, 19 nt, Human
uauaaaaaggcaucaugag

SEQ ID NO: 456361 - RNA, 24 nt, Human
uaucacacaggggugugaccagca

SEQ ID NO: 456362 - RNA, 20 nt, Human
uccagggcaguggucauggg

SEQ ID NO: 456363 - RNA, 21 nt, Human
ucuguaagccacccgggaggc

SEQ ID NO: 456364 - RNA, 23 nt, Human
ugaccagcacucccccugcuacc

SEQ ID NO: 456365 - RNA, 20 nt, Human
ugagaaaacaguuaaaaaga

SEQ ID NO: 456366 - RNA, 20 nt, Human
ugagaaaacaguuaaaaaga

SEQ ID NO: 456367 - RNA, 18 nt, Human
ugccgugugggcaggggc

SEQ ID NO: 456368 - RNA, 23 nt, Human
uggcggcggcgaugcuggcagcg

SEQ ID NO: 456369 - RNA, 22 nt, Human
ugggcacaggccacaguuaacc

SEQ ID NO: 456370 - RNA, 19 nt, Human
uggggguggggccagcccc

SEQ ID NO: 456371 - RNA, 22 nt, Human
uggggguggggccagccccgcc

SEQ ID NO: 456372 - RNA, 19 nt, Human
uuuuuuuuuuuuuugcugg

SEQ ID NO: 456373 - RNA, 21 nt, Human
aacauaauguaguagcccaug

SEQ ID NO: 456374 - RNA, 19 nt, Human
aaccugagcuggaagugau

SEQ ID NO: 456375 - RNA, 18 nt, Human
aacuuugaauggucagca

SEQ ID NO: 456376 - RNA, 18 nt, Human
aagcagcccuuuuauguc

SEQ ID NO: 456377 - RNA, 22 nt, Human
aaguccccggcccggcgcgcag

SEQ ID NO: 456378 - RNA, 18 nt, Human
aaguguaggaaacuaagc

SEQ ID NO: 456379 - RNA, 21 nt, Human
acccaauaaaauuucagggcc

SEQ ID NO: 456380 - RNA, 20 nt, Human
aggauacugugaugcagaag

SEQ ID NO: 456381 - RNA, 19 nt, Human
augcugcuguggcggcugc

SEQ ID NO: 456382 - RNA, 21 nt, Human
caagggcaaguccccggcccg

SEQ ID NO: 456383 - RNA, 22 nt, Human
cacagccugggccccgccgccc

SEQ ID NO: 456384 - RNA, 25 nt, Human
cagggagcgugcaagggcaaguccc

SEQ ID NO: 456385 - RNA, 21 nt, Human
ccaagccucacauuccgcgcu

SEQ ID NO: 456386 - RNA, 18 nt, Human
ccaauaguuccucuucug

SEQ ID NO: 456387 - RNA, 21 nt, Human
ccauaucaggacaacaaagca

SEQ ID NO: 456388 - RNA, 19 nt, Human
ccauuuccaggucuuagug

SEQ ID NO: 456389 - RNA, 24 nt, Human
ccccaagcgcacagccugggcccc

SEQ ID NO: 456390 - RNA, 22 nt, Human
cccgccaagccucacauuccgc

SEQ ID NO: 456391 - RNA, 24 nt, Human
ccgccccuggcccguccgagcgug

SEQ ID NO: 456392 - RNA, 20 nt, Human
ccgcuccgcggcuccgcugc

SEQ ID NO: 456393 - RNA, 24 nt, Human
cgaggggucgccgccccuggcccg

SEQ ID NO: 456394 - RNA, 19 nt, Human
cgcacagccugggccccgc

SEQ ID NO: 456395 - RNA, 28 nt, Human
cgcagccgggcguccgcgaggggucgcc

SEQ ID NO: 456396 - RNA, 23 nt, Human
cgccccuggcccguccgagcgug

SEQ ID NO: 456397 - RNA, 24 nt, Human
cggcugcugaggaggucccugacc

SEQ ID NO: 456398 - RNA, 19 nt, Human
cucuguccaauaguuccuc

SEQ ID NO: 456399 - RNA, 21 nt, Human
cugauguugagcuagcaucug

SEQ ID NO: 456400 - RNA, 24 nt, Human
cugauuucuaaugcacacaacaua

SEQ ID NO: 456401 - RNA, 20 nt, Human
cugcggcccgccaagccuca

SEQ ID NO: 456402 - RNA, 19 nt, Human
cugcugcugcugcugcugc

SEQ ID NO: 456403 - RNA, 19 nt, Human
cugcugcugcugcugcugc

SEQ ID NO: 456404 - RNA, 18 nt, Human
cugcugcugcuguugcug

SEQ ID NO: 456405 - RNA, 19 nt, Human
cugcuguugcuguugcugc

SEQ ID NO: 456406 - RNA, 19 nt, Human
cuguugcuguugcugcugc

SEQ ID NO: 456407 - RNA, 19 nt, Human
cuguugcuguugcugcugc

SEQ ID NO: 456408 - RNA, 23 nt, Human
gcaaguccccggcccggcgcgca

SEQ ID NO: 456409 - RNA, 19 nt, Human
gccugcugauacugcggca

SEQ ID NO: 456410 - RNA, 18 nt, Human
gccugggccccgccgccc

SEQ ID NO: 456411 - RNA, 23 nt, Human
gcgcagccgggcguccgcgaggg

SEQ ID NO: 456412 - RNA, 23 nt, Human
gcgcagccgggcguccgcgaggg

SEQ ID NO: 456413 - RNA, 18 nt, Human
gcgcuccccaagcgcaca

SEQ ID NO: 456414 - RNA, 20 nt, Human
gcgcuccccaagcgcacagc

SEQ ID NO: 456415 - RNA, 21 nt, Human
gcgugcaagggcaaguccccg

SEQ ID NO: 456416 - RNA, 21 nt, Human
gcuacuaucaagcaacugauu

SEQ ID NO: 456417 - RNA, 23 nt, Human
gcugcugcugcugcugcugcugg

SEQ ID NO: 456418 - RNA, 23 nt, Human
gcugcuguggcggcugcugagga

SEQ ID NO: 456419 - RNA, 20 nt, Human
gcuggugaggaugacgaugc

SEQ ID NO: 456420 - RNA, 19 nt, Human
gcuuuuccuagcagcugcu

SEQ ID NO: 456421 - RNA, 19 nt, Human
gugcugcugcugcugcugc

SEQ ID NO: 456422 - RNA, 21 nt, Human
guggcaguaguagcagaguug

SEQ ID NO: 456423 - RNA, 23 nt, Human
guggugcugcugcugcugcugcu

SEQ ID NO: 456424 - RNA, 24 nt, Human
gugguggugcugcugcugcugcuc

SEQ ID NO: 456425 - RNA, 23 nt, Human
uaaaaauuguuguugaagcaucu

SEQ ID NO: 456426 - RNA, 23 nt, Human
uaaaaugucucccuuuuuauuga

SEQ ID NO: 456427 - RNA, 22 nt, Human
uaaagugaaaaagaauuuauuu

SEQ ID NO: 456428 - RNA, 20 nt, Human
uaagaagauggccugaauuu

SEQ ID NO: 456429 - RNA, 26 nt, Human
uaaggcaaaauaauaaaaugucuccc

SEQ ID NO: 456430 - RNA, 18 nt, Human
uaauguaguagcccaugu

SEQ ID NO: 456431 - RNA, 22 nt, Human
uagcauacuaucagcaauauug

SEQ ID NO: 456432 - RNA, 18 nt, Human
uaggaggaguccauuaug

SEQ ID NO: 456433 - RNA, 20 nt, Human
uaguagcagaguuggccuuu

SEQ ID NO: 456434 - RNA, 23 nt, Human
uaguagcagaguuggccuuuggu

SEQ ID NO: 456435 - RNA, 24 nt, Human
uauugagugugcagaaaaacagag

SEQ ID NO: 456436 - RNA, 22 nt, Human
ucaaagggcaucucagacccac

SEQ ID NO: 456437 - RNA, 26 nt, Human
uccccaagcgcacagccugggccccg

SEQ ID NO: 456438 - RNA, 20 nt, Human
uccgcgaggggucgccgccc

SEQ ID NO: 456439 - RNA, 21 nt, Human
uccucuccaaaaggauuccac

SEQ ID NO: 456440 - RNA, 22 nt, Human
ucuaugcugcuguggcggcugc

SEQ ID NO: 456441 - RNA, 19 nt, Human
ucuccaaucucccugcugu

SEQ ID NO: 456442 - RNA, 25 nt, Human
ugagguuucuguugguccaauggua

SEQ ID NO: 456443 - RNA, 22 nt, Human
ugcagaaaaacagagcugcaaa

SEQ ID NO: 456444 - RNA, 25 nt, Human
ugcauuaaaaauuguuguugaagca

SEQ ID NO: 456445 - RNA, 24 nt, Human
ugcugaggaggucccugacccaau

SEQ ID NO: 456446 - RNA, 18 nt, Human
ugcugcugcugcugcugc

SEQ ID NO: 456447 - RNA, 21 nt, Human
ugcugcugcugcugcugcugc

SEQ ID NO: 456448 - RNA, 21 nt, Human
ugcugcugcugcugcugcugc

SEQ ID NO: 456449 - RNA, 21 nt, Human
ugcugcugcugcugcugcugc

SEQ ID NO: 456450 - RNA, 21 nt, Human
ugcugcugcugcugcugcugu

SEQ ID NO: 456451 - RNA, 18 nt, Human
ugcugcugcugcugcugu

SEQ ID NO: 456452 - RNA, 18 nt, Human
ugcugcugcugcuguugc

SEQ ID NO: 456453 - RNA, 21 nt, Human
ugcugcugcugcuguugcugu

SEQ ID NO: 456454 - RNA, 18 nt, Human
ugcugcugcuguugcugu

SEQ ID NO: 456455 - RNA, 18 nt, Human
ugcugcugcuguugcugu

SEQ ID NO: 456456 - RNA, 21 nt, Human
ugcugcuguugcuguugcugc

SEQ ID NO: 456457 - RNA, 24 nt, Human
ugcuguggcggcugcugaggaggu

SEQ ID NO: 456458 - RNA, 21 nt, Human
ugcuguugcugcugcugcugc

SEQ ID NO: 456459 - RNA, 21 nt, Human
ugcuguugcugcugcugcugu

SEQ ID NO: 456460 - RNA, 21 nt, Human
ugcuguugcuguugcugcugc

SEQ ID NO: 456461 - RNA, 21 nt, Human
ugcuguugcuguugcugcugc

SEQ ID NO: 456462 - RNA, 18 nt, Human
uggugguggugguggugg

SEQ ID NO: 456463 - RNA, 20 nt, Human
uggugguggugguggugguc

SEQ ID NO: 456464 - RNA, 20 nt, Human
uggugguggugguggugguc

SEQ ID NO: 456465 - RNA, 20 nt, Human
ugguggugguggugguggug

SEQ ID NO: 456466 - RNA, 21 nt, Human
ugguggugguggugguggugc

SEQ ID NO: 456467 - RNA, 20 nt, Human
ugguugauauaccgaaugca

SEQ ID NO: 456468 - RNA, 18 nt, Human
ugucccuuacuugaucuu

SEQ ID NO: 456469 - RNA, 23 nt, Human
ugugaagcaaaauaagccuucaa

SEQ ID NO: 456470 - RNA, 21 nt, Human
uguugcugcugcugcugcugc

SEQ ID NO: 456471 - RNA, 21 nt, Human
uguugcuguugcugcugcugc

SEQ ID NO: 456472 - RNA, 21 nt, Human
uguugcuguugcugcugcugc

SEQ ID NO: 456473 - RNA, 22 nt, Human
uuagagauauucugaauuuaac

SEQ ID NO: 456474 - RNA, 25 nt, Human
uuagugccccuuuuggucuaugguu

SEQ ID NO: 456475 - RNA, 19 nt, Human
uuccaaccugagcuggaag

SEQ ID NO: 456476 - RNA, 22 nt, Human
uuuaauuuuugccauaucagga

SEQ ID NO: 456477 - RNA, 24 nt, Human
uuuccaggucuuagugccccuuuu

SEQ ID NO: 456478 - RNA, 19 nt, Human
uuuuuuuuuuuuuuuuuaa

SEQ ID NO: 456479 - RNA, 24 nt, Human
caaaaucacuccuaaaaagacuaa

SEQ ID NO: 456480 - RNA, 20 nt, Human
cuaaagaacagaaauguaaa

SEQ ID NO: 456481 - RNA, 23 nt, Human
uaaaaagacuaagacuauugcca

SEQ ID NO: 456482 - RNA, 20 nt, Human
uaagacuauugccacauugu

SEQ ID NO: 456483 - RNA, 19 nt, Human
uuccaaaaacaaaucugug

SEQ ID NO: 456484 - RNA, 21 nt, Human
uuuggagaagucaaacuagca

SEQ ID NO: 456485 - RNA, 18 nt, Human
aaacuuccagaaauuuuu

SEQ ID NO: 456486 - RNA, 24 nt, Human
aaagugcugggauuacagguguga

SEQ ID NO: 456487 - RNA, 25 nt, Human
aaauggaaaguaaguuaacucuacu

SEQ ID NO: 456488 - RNA, 24 nt, Human
aagcuaguucaauauagaaaacag

SEQ ID NO: 456489 - RNA, 24 nt, Human
aaguaagaauggcuuccaggccca

SEQ ID NO: 456490 - RNA, 18 nt, Human
aagugcugggauuacagg

SEQ ID NO: 456491 - RNA, 19 nt, Human
aagugcugggauuacaggu

SEQ ID NO: 456492 - RNA, 26 nt, Human
aagugcugggauuacaggugugagcc

SEQ ID NO: 456493 - RNA, 24 nt, Human
aaugauucgcccgccucagccucc

SEQ ID NO: 456494 - RNA, 24 nt, Human
aaugcaguggcgccaucuuggcuc

SEQ ID NO: 456495 - RNA, 19 nt, Human
acaagcaagcucaguaaca

SEQ ID NO: 456496 - RNA, 24 nt, Human
accaugcuggccaggcuggucucg

SEQ ID NO: 456497 - RNA, 19 nt, Human
acuugggcaaggggagggg

SEQ ID NO: 456498 - RNA, 18 nt, Human
agaaaacagguucuacaa

SEQ ID NO: 456499 - RNA, 18 nt, Human
agaccuguccccaacccc

SEQ ID NO: 456500 - RNA, 28 nt, Human
aggcacgaaaguaaaacaaaagggaccc

SEQ ID NO: 456501 - RNA, 22 nt, Human
aguagagaugggguuucaccau

SEQ ID NO: 456502 - RNA, 23 nt, Human
aguggcugggacuacaggcaugu

SEQ ID NO: 456503 - RNA, 19 nt, Human
auagaaaacagguucuaca

SEQ ID NO: 456504 - RNA, 22 nt, Human
augauauggaaauaauaugcaa

SEQ ID NO: 456505 - RNA, 24 nt, Human
augauucgcccgccucagccuccc

SEQ ID NO: 456506 - RNA, 20 nt, Human
augggguuucaccaugcugg

SEQ ID NO: 456507 - RNA, 20 nt, Human
auggucuucuggccguucag

SEQ ID NO: 456508 - RNA, 24 nt, Human
auuuuuguauuuuuaguagagaug

SEQ ID NO: 456509 - RNA, 24 nt, Human
caaagugcugggauuacaggugug

SEQ ID NO: 456510 - RNA, 22 nt, Human
caaauuauugauucagcaguuu

SEQ ID NO: 456511 - RNA, 24 nt, Human
caccacaccuggcuaauuuuugua

SEQ ID NO: 456512 - RNA, 21 nt, Human
caccaugcuggccaggcuggu

SEQ ID NO: 456513 - RNA, 24 nt, Human
caccaugcuggccaggcuggucuc

SEQ ID NO: 456514 - RNA, 24 nt, Human
caccucaaaugauucgcccgccuc

SEQ ID NO: 456515 - RNA, 21 nt, Human
cacugcaaccucugccucccg

SEQ ID NO: 456516 - RNA, 23 nt, Human
cacugcaaccucugccucccggg

SEQ ID NO: 456517 - RNA, 22 nt, Human
cagaagggucccaggugagcac

SEQ ID NO: 456518 - RNA, 24 nt, Human
cagggucuugcucuguugcccagg

SEQ ID NO: 456519 - RNA, 24 nt, Human
caugcuggccaggcuggucucgaa

SEQ ID NO: 456520 - RNA, 21 nt, Human
ccaaagugcugggauuacagg

SEQ ID NO: 456521 - RNA, 21 nt, Human
ccaaagugcugggauuacagg

SEQ ID NO: 456522 - RNA, 24 nt, Human
ccaaagugcugggauuacaggugu

SEQ ID NO: 456523 - RNA, 23 nt, Human
ccaaccccuucccuguugaccau

SEQ ID NO: 456524 - RNA, 23 nt, Human
ccaaguagaguggauucauaaga

SEQ ID NO: 456525 - RNA, 20 nt, Human
ccaccacaccuggcuaauuu

SEQ ID NO: 456526 - RNA, 19 nt, Human
cccggguucaagcaagucu

SEQ ID NO: 456527 - RNA, 22 nt, Human
cccggguucaagcaagucuugc

SEQ ID NO: 456528 - RNA, 23 nt, Human
cccuaguggcugggacuacaggc

SEQ ID NO: 456529 - RNA, 21 nt, Human
cccuguuuccucuuuauauug

SEQ ID NO: 456530 - RNA, 20 nt, Human
ccgccucagccucccaaagg

SEQ ID NO: 456531 - RNA, 24 nt, Human
ccgccucagccucccaaagugcug

SEQ ID NO: 456532 - RNA, 23 nt, Human
ccuaguggcugggacuacaggca

SEQ ID NO: 456533 - RNA, 20 nt, Human
ccuguuuccucuuuauauug

SEQ ID NO: 456534 - RNA, 29 nt, Human
ccuuuagcugggguggauuacucagggac

SEQ ID NO: 456535 - RNA, 22 nt, Human
cgucguagaugaacaggcaguc

SEQ ID NO: 456536 - RNA, 22 nt, Human
cgucucagccgcccuaguggcu

SEQ ID NO: 456537 - RNA, 23 nt, Human
cuaauuuuuguauuuuuaguaga

SEQ ID NO: 456538 - RNA, 20 nt, Human
cuacaaggauuaaggaacau

SEQ ID NO: 456539 - RNA, 18 nt, Human
cucaaaugauucgcccgc

SEQ ID NO: 456540 - RNA, 24 nt, Human
cucacugcaaccucugccucccgg

SEQ ID NO: 456541 - RNA, 24 nt, Human
cucagccgcccuaguggcugggac

SEQ ID NO: 456542 - RNA, 20 nt, Human
cucuguugcccaggcuggaa

SEQ ID NO: 456543 - RNA, 23 nt, Human
cucuguugcccaggcuggaaugc

SEQ ID NO: 456544 - RNA, 19 nt, Human
cugcaaccucugccucccg

SEQ ID NO: 456545 - RNA, 23 nt, Human
cugcaaccucugccucccggguu

SEQ ID NO: 456546 - RNA, 24 nt, Human
cugcaaccucugccucccggguuc

SEQ ID NO: 456547 - RNA, 22 nt, Human
cuuggaaucccagacgaagucc

SEQ ID NO: 456548 - RNA, 18 nt, Human
cuugggcaaggggagggg

SEQ ID NO: 456549 - RNA, 20 nt, Human
gaaaguaaguuaacucuacu

SEQ ID NO: 456550 - RNA, 18 nt, Human
gaaaguauguggcugaag

SEQ ID NO: 456551 - RNA, 23 nt, Human
gaacaaaugcucuguccguccuu

SEQ ID NO: 456552 - RNA, 24 nt, Human
gaacaucucuuggcccacagaaga

SEQ ID NO: 456553 - RNA, 19 nt, Human
gagaagccucuggaaugaa

SEQ ID NO: 456554 - RNA, 18 nt, Human
gagaugggguuucaccau

SEQ ID NO: 456555 - RNA, 24 nt, Human
gagaugggguuucaccaugcuggc

SEQ ID NO: 456556 - RNA, 18 nt, Human
gauuacaggugugagcca

SEQ ID NO: 456557 - RNA, 20 nt, Human
gauuacaggugugagccacc

SEQ ID NO: 456558 - RNA, 23 nt, Human
gauuacaggugugagccaccgca

SEQ ID NO: 456559 - RNA, 21 nt, Human
gcaggacuguguuuuguuuug

SEQ ID NO: 456560 - RNA, 23 nt, Human
gccucagccucccaaagugcugg

SEQ ID NO: 456561 - RNA, 18 nt, Human
gcgccaucuuggcucacu

SEQ ID NO: 456562 - RNA, 21 nt, Human
gcucacugcaaccucugccuc

SEQ ID NO: 456563 - RNA, 20 nt, Human
gcucuguccguccuuuagua

SEQ ID NO: 456564 - RNA, 20 nt, Human
gcuggaaugcaguggcgcca

SEQ ID NO: 456565 - RNA, 23 nt, Human
ggaccucaaagguauuggugaug

SEQ ID NO: 456566 - RNA, 19 nt, Human
ggacuacaggcaugugcca

SEQ ID NO: 456567 - RNA, 22 nt, Human
gggguuucaccaugcuggccag

SEQ ID NO: 456568 - RNA, 20 nt, Human
ggguuugccuuuagcugggg

SEQ ID NO: 456569 - RNA, 22 nt, Human
ggugaugauuuauuucuugagc

SEQ ID NO: 456570 - RNA, 19 nt, Human
gguuuuguuuuuuguuuug

SEQ ID NO: 456571 - RNA, 25 nt, Human
gguuuuuagcauuaaucaacaacuu

SEQ ID NO: 456572 - RNA, 23 nt, Human
guaaaacaaaaaacaguacagaa

SEQ ID NO: 456573 - RNA, 24 nt, Human
gucuugcucuguugcccaggcugg

SEQ ID NO: 456574 - RNA, 20 nt, Human
guggcugggacuacaggcau

SEQ ID NO: 456575 - RNA, 23 nt, Human
uaagugguuuuguuuuuuguuuu

SEQ ID NO: 456576 - RNA, 24 nt, Human
uaauuuuuguauuuuuaguagaga

SEQ ID NO: 456577 - RNA, 22 nt, Human
uacaggcaugugccaccacacc

SEQ ID NO: 456578 - RNA, 24 nt, Human
uacaggugugagccaccgcaccca

SEQ ID NO: 456579 - RNA, 22 nt, Human
uaccacaagcaagcucaguaac

SEQ ID NO: 456580 - RNA, 21 nt, Human
uacuugggcaaggggagggga

SEQ ID NO: 456581 - RNA, 19 nt, Human
uaggaacgaaauucuggac

SEQ ID NO: 456582 - RNA, 18 nt, Human
uagguauaauugacaaaa

SEQ ID NO: 456583 - RNA, 24 nt, Human
uaguagagaugggguuucaccaug

SEQ ID NO: 456584 - RNA, 26 nt, Human
uaguagagaugggguuucaccaugcu

SEQ ID NO: 456585 - RNA, 18 nt, Human
uaguaguaucaugaauuu

SEQ ID NO: 456586 - RNA, 25 nt, Human
uaguggcugggacuacaggcaugug

SEQ ID NO: 456587 - RNA, 23 nt, Human
uaguucaauauagaaaacagguu

SEQ ID NO: 456588 - RNA, 23 nt, Human
uauauaaauugaauacuucuucc

SEQ ID NO: 456589 - RNA, 22 nt, Human
uaugcaaucacuagagauaaaa

SEQ ID NO: 456590 - RNA, 21 nt, Human
uauuuuuguuuuaaauagaaa

SEQ ID NO: 456591 - RNA, 24 nt, Human
ucacugcaaccucugccucccggg

SEQ ID NO: 456592 - RNA, 25 nt, Human
ucacugcaaccucugccucccgggu

SEQ ID NO: 456593 - RNA, 23 nt, Human
ucccaaagugcugggauuacagg

SEQ ID NO: 456594 - RNA, 20 nt, Human
ucccggguucaagcaagucu

SEQ ID NO: 456595 - RNA, 20 nt, Human
ucccggguucaagcaagucu

SEQ ID NO: 456596 - RNA, 22 nt, Human
ucccggguucaagcaagucuug

SEQ ID NO: 456597 - RNA, 20 nt, Human
uccuuuaguaggaagcagug

SEQ ID NO: 456598 - RNA, 24 nt, Human
ucuguugcccaggcuggaaugcag

SEQ ID NO: 456599 - RNA, 23 nt, Human
ucuugcucuguugcccaggcugg

SEQ ID NO: 456600 - RNA, 24 nt, Human
ucuugcucuguugcccaggcugga

SEQ ID NO: 456601 - RNA, 23 nt, Human
ugaaauacuaugauauggaaaua

SEQ ID NO: 456602 - RNA, 23 nt, Human
ugaagucauuuuucccuaacccc

SEQ ID NO: 456603 - RNA, 20 nt, Human
ugagaccacaccauacauac

SEQ ID NO: 456604 - RNA, 18 nt, Human
ugaggauaaaaguauggu

SEQ ID NO: 456605 - RNA, 27 nt, Human
ugcaggcacgaaaguaaaacaaaaaac

SEQ ID NO: 456606 - RNA, 22 nt, Human
ugcaguggcgccaucuuggcuc

SEQ ID NO: 456607 - RNA, 21 nt, Human
ugcccaggcuggaaugcagug

SEQ ID NO: 456608 - RNA, 24 nt, Human
ugcccaggcuggaaugcaguggcg

SEQ ID NO: 456609 - RNA, 18 nt, Human
ugcuggccaggcuggucu

SEQ ID NO: 456610 - RNA, 24 nt, Human
ugcugggauuacaggugugagcca

SEQ ID NO: 456611 - RNA, 22 nt, Human
uggaaucccagacgaagucccc

SEQ ID NO: 456612 - RNA, 24 nt, Human
uggaaugcaguggcgccaucuugg

SEQ ID NO: 456613 - RNA, 24 nt, Human
uggccaggcuggucucgaauuccu

SEQ ID NO: 456614 - RNA, 21 nt, Human
uggcuuccaggcccacuuccu

SEQ ID NO: 456615 - RNA, 18 nt, Human
ugggacuacaggcaugug

SEQ ID NO: 456616 - RNA, 21 nt, Human
ugggacuacaggcaugugcca

SEQ ID NO: 456617 - RNA, 22 nt, Human
ugggacuacaggcaugugccac

SEQ ID NO: 456618 - RNA, 24 nt, Human
ugggacuacaggcaugugccacca

SEQ ID NO: 456619 - RNA, 19 nt, Human
ugggagagacugaaaagua

SEQ ID NO: 456620 - RNA, 18 nt, Human
ugggauuacaggugugag

SEQ ID NO: 456621 - RNA, 19 nt, Human
ugggauuacaggugugagc

SEQ ID NO: 456622 - RNA, 21 nt, Human
ugggauuacaggugugagcca

SEQ ID NO: 456623 - RNA, 22 nt, Human
ugggauuacaggugugagccac

SEQ ID NO: 456624 - RNA, 23 nt, Human
ugggauuacaggugugagccacc

SEQ ID NO: 456625 - RNA, 24 nt, Human
ugggauuacaggugugagccaccg

SEQ ID NO: 456626 - RNA, 24 nt, Human
ugggguuucaccaugcuggccagg

SEQ ID NO: 456627 - RNA, 20 nt, Human
ugguguacauauacuuucug

SEQ ID NO: 456628 - RNA, 21 nt, Human
ugucuggggucaauacccggg

SEQ ID NO: 456629 - RNA, 24 nt, Human
uguuuugguguacauauacuuucu

SEQ ID NO: 456630 - RNA, 26 nt, Human
uguuuuguuuuguuuuguuuuuuaau

SEQ ID NO: 456631 - RNA, 24 nt, Human
uguuuuguuuuuuagcaagccuua

SEQ ID NO: 456632 - RNA, 21 nt, Human
uuaacucuacuguaccaaagc

SEQ ID NO: 456633 - RNA, 23 nt, Human
uuagcaagccuuacacauuuucu

SEQ ID NO: 456634 - RNA, 18 nt, Human
uuaguagagaugggguuu

SEQ ID NO: 456635 - RNA, 22 nt, Human
uuaguagagaugggguuucacc

SEQ ID NO: 456636 - RNA, 24 nt, Human
uuaguagagaugggguuucaccau

SEQ ID NO: 456637 - RNA, 21 nt, Human
uucauguggauccuguguuaa

SEQ ID NO: 456638 - RNA, 21 nt, Human
uucgcccgccucagccuccca

SEQ ID NO: 456639 - RNA, 23 nt, Human
uugaaggguuugccuuuagcugg

SEQ ID NO: 456640 - RNA, 19 nt, Human
uugaccauggacaauggag

SEQ ID NO: 456641 - RNA, 24 nt, Human
uugcccaggcuggaaugcaguggc

SEQ ID NO: 456642 - RNA, 24 nt, Human
uuggugaugauuuauuucuugagc

SEQ ID NO: 456643 - RNA, 23 nt, Human
uuguauuuuuaguagagaugggg

SEQ ID NO: 456644 - RNA, 21 nt, Human
uuucaccaugcuggccaggcu

SEQ ID NO: 456645 - RNA, 21 nt, Human
uuucuaaacaaaugagaccac

SEQ ID NO: 456646 - RNA, 18 nt, Human
uuuguuuuguuuuguuuu

SEQ ID NO: 456647 - RNA, 24 nt, Human
uuuuuaguagagaugggguuucac

SEQ ID NO: 456648 - RNA, 20 nt, Human
uuuuuguauuuuuaguagag

SEQ ID NO: 456649 - RNA, 21 nt, Human
aaaaauauaauucauacacaa

SEQ ID NO: 456650 - RNA, 19 nt, Human
aacaaaauauuguacuacc

SEQ ID NO: 456651 - RNA, 18 nt, Human
aacucuuugggguuguag

SEQ ID NO: 456652 - RNA, 21 nt, Human
aagcacuuuaacaugacaacc

SEQ ID NO: 456653 - RNA, 18 nt, Human
acaaaaagaaaucaauga

SEQ ID NO: 456654 - RNA, 22 nt, Human
acacaagugaaaagcaccaaag

SEQ ID NO: 456655 - RNA, 26 nt, Human
acacuacucccuuagguacacauaca

SEQ ID NO: 456656 - RNA, 20 nt, Human
acacuauuuaaaagcuaagu

SEQ ID NO: 456657 - RNA, 19 nt, Human
agaaaucaaugauagacuc

SEQ ID NO: 456658 - RNA, 19 nt, Human
agccauaaaauuuccacag

SEQ ID NO: 456659 - RNA, 21 nt, Human
caaaaagaaaucaaugauaga

SEQ ID NO: 456660 - RNA, 21 nt, Human
caagugaaaagcaccaaagac

SEQ ID NO: 456661 - RNA, 24 nt, Human
caccaaagacaauucggcaccaua

SEQ ID NO: 456662 - RNA, 20 nt, Human
cacugcauuuaaaaacuaaa

SEQ ID NO: 456663 - RNA, 21 nt, Human
cagguaggaugaguaucucuc

SEQ ID NO: 456664 - RNA, 19 nt, Human
cagguuaaaauauagacua

SEQ ID NO: 456665 - RNA, 21 nt, Human
caguaacuccugaaaugaugc

SEQ ID NO: 456666 - RNA, 18 nt, Human
caguaaucaacucuacua

SEQ ID NO: 456667 - RNA, 23 nt, Human
ccaaagacaauucggcaccauaa

SEQ ID NO: 456668 - RNA, 23 nt, Human
ccaagauacuacuuagaacacaa

SEQ ID NO: 456669 - RNA, 19 nt, Human
ccacaagcuuuguugaacc

SEQ ID NO: 456670 - RNA, 19 nt, Human
ccugcagcaucauguugac

SEQ ID NO: 456671 - RNA, 19 nt, Human
ccugcagcaucauguugac

SEQ ID NO: 456672 - RNA, 18 nt, Human
gaaaagcaccaaagacaa

SEQ ID NO: 456673 - RNA, 20 nt, Human
gaguaucucucugaauuacc

SEQ ID NO: 456674 - RNA, 20 nt, Human
gcacacuuuuuacacugcau

SEQ ID NO: 456675 - RNA, 19 nt, Human
gccuuuuauuuauauuugg

SEQ ID NO: 456676 - RNA, 24 nt, Human
gcuuuguugaaccugugccugcua

SEQ ID NO: 456677 - RNA, 20 nt, Human
ggcaccauaacucugaugaa

SEQ ID NO: 456678 - RNA, 22 nt, Human
gguacacauacauacuaauaua

SEQ ID NO: 456679 - RNA, 18 nt, Human
uaaaacacaagugaaaag

SEQ ID NO: 456680 - RNA, 19 nt, Human
uaaaacacaagugaaaagc

SEQ ID NO: 456681 - RNA, 23 nt, Human
uaaaacacaagugaaaagcacca

SEQ ID NO: 456682 - RNA, 24 nt, Human
uaaaacacaagugaaaagcaccaa

SEQ ID NO: 456683 - RNA, 26 nt, Human
uaaaacacaagugaaaagcaccaaag

SEQ ID NO: 456684 - RNA, 19 nt, Human
uaaaagcuaaguucacaca

SEQ ID NO: 456685 - RNA, 29 nt, Human
uaaaauuuccacagcacacuuuuuacacu

SEQ ID NO: 456686 - RNA, 24 nt, Human
uaacaagcagugacacuacucccu

SEQ ID NO: 456687 - RNA, 23 nt, Human
uaagcacuuuaacaugacaaccc

SEQ ID NO: 456688 - RNA, 18 nt, Human
uaccacaaaaagaaauca

SEQ ID NO: 456689 - RNA, 19 nt, Human
uaccacaaaaagaaaucaa

SEQ ID NO: 456690 - RNA, 21 nt, Human
uaccaucuuuucagaaacaag

SEQ ID NO: 456691 - RNA, 22 nt, Human
uacuaccaaaaaaguacugcuu

SEQ ID NO: 456692 - RNA, 21 nt, Human
uacuggauuuaucucaguuua

SEQ ID NO: 456693 - RNA, 27 nt, Human
uaguaacucuuucagguaaccuaagug

SEQ ID NO: 456694 - RNA, 18 nt, Human
uaucagaaacgccuaaca

SEQ ID NO: 456695 - RNA, 18 nt, Human
uauuuguuuccauuuccu

SEQ ID NO: 456696 - RNA, 21 nt, Human
ucacacuauuuaaaagcuaag

SEQ ID NO: 456697 - RNA, 23 nt, Human
ucccuuguaaauaaacagauugg

SEQ ID NO: 456698 - RNA, 22 nt, Human
ucuacacuauaauuuaguauuc

SEQ ID NO: 456699 - RNA, 20 nt, Human
ugaaagaacaacaaauccag

SEQ ID NO: 456700 - RNA, 22 nt, Human
ugauagacucuuauguagaauu

SEQ ID NO: 456701 - RNA, 22 nt, Human
uuaacaaaauucuaagcaacua

SEQ ID NO: 456702 - RNA, 25 nt, Human
uuacuggauuuaucucaguuuauau

SEQ ID NO: 456703 - RNA, 18 nt, Human
uuagaacacaacucuuug

SEQ ID NO: 456704 - RNA, 22 nt, Human
uuaguaccaaagcagacuagaa

SEQ ID NO: 456705 - RNA, 21 nt, Human
uuauaugcaggcuucuuuccc

SEQ ID NO: 456706 - RNA, 21 nt, Human
uucccuuguaaauaaacagau

SEQ ID NO: 456707 - RNA, 23 nt, Human
uugacuuucuuccuaacuuugua

SEQ ID NO: 456708 - RNA, 20 nt, Human
aaaaaagacagagaaaugug

SEQ ID NO: 456709 - RNA, 25 nt, Human
aaaaaagcacaagaccuaacucaaa

SEQ ID NO: 456710 - RNA, 26 nt, Human
aaaaaagcacaagaccuaacucaaag

SEQ ID NO: 456711 - RNA, 21 nt, Human
aaaugaauggggaagaaaagg

SEQ ID NO: 456712 - RNA, 18 nt, Human
aacaauguuuuuugaguu

SEQ ID NO: 456713 - RNA, 19 nt, Human
aauacuaggcugaaaagcc

SEQ ID NO: 456714 - RNA, 23 nt, Human
aauauguuacacaaaacaauguu

SEQ ID NO: 456715 - RNA, 22 nt, Human
aauguaaacaugaugcuacaga

SEQ ID NO: 456716 - RNA, 20 nt, Human
accacaccuggcuucauguc

SEQ ID NO: 456717 - RNA, 20 nt, Human
agaauucuuuauaaaaacac

SEQ ID NO: 456718 - RNA, 21 nt, Human
agaguaagcuguguugaaaau

SEQ ID NO: 456719 - RNA, 23 nt, Human
agauggcuauuuuaaaacuucug

SEQ ID NO: 456720 - RNA, 24 nt, Human
aggaaaaaaaagcacaagaccuaa

SEQ ID NO: 456721 - RNA, 18 nt, Human
aggcagggucucaguaug

SEQ ID NO: 456722 - RNA, 23 nt, Human
aggcagggucucaguaugcugcc

SEQ ID NO: 456723 - RNA, 20 nt, Human
aggcaucuccacagguaggu

SEQ ID NO: 456724 - RNA, 18 nt, Human
auaaaaacaccauguccc

SEQ ID NO: 456725 - RNA, 24 nt, Human
augccaaaauauuuaaaauucuua

SEQ ID NO: 456726 - RNA, 19 nt, Human
caaaaaagacagagaaaug

SEQ ID NO: 456727 - RNA, 20 nt, Human
caaguaauucucuugccuca

SEQ ID NO: 456728 - RNA, 22 nt, Human
caaguaauucucuugccucagc

SEQ ID NO: 456729 - RNA, 23 nt, Human
cacagaauucuuuauaaaaacac

SEQ ID NO: 456730 - RNA, 23 nt, Human
cagaauucuuuauaaaaacacca

SEQ ID NO: 456731 - RNA, 21 nt, Human
cagaguaagcuguguugaaaa

SEQ ID NO: 456732 - RNA, 19 nt, Human
cagccugggacuacaggca

SEQ ID NO: 456733 - RNA, 22 nt, Human
caggaaaaaaaagcacaagacc

SEQ ID NO: 456734 - RNA, 18 nt, Human
cauaccaccacaccuggc

SEQ ID NO: 456735 - RNA, 21 nt, Human
ccaccacaccuggcuucaugu

SEQ ID NO: 456736 - RNA, 20 nt, Human
cccugguguuuuguuuuugu

SEQ ID NO: 456737 - RNA, 20 nt, Human
ccugggcucaaguaauucuc

SEQ ID NO: 456738 - RNA, 20 nt, Human
ccugggcucaaguaauucuc

SEQ ID NO: 456739 - RNA, 20 nt, Human
cucaaaggaggaaaauaaua

SEQ ID NO: 456740 - RNA, 23 nt, Human
cucacagaauucuuuauaaaaac

SEQ ID NO: 456741 - RNA, 21 nt, Human
cuccugggcucaaguaauucu

SEQ ID NO: 456742 - RNA, 23 nt, Human
cuccugggcucaaguaauucucu

SEQ ID NO: 456743 - RNA, 20 nt, Human
cugaaaagccaaaaugaaaa

SEQ ID NO: 456744 - RNA, 22 nt, Human
gggcucaaguaauucucuugcc

SEQ ID NO: 456745 - RNA, 21 nt, Human
uaaaauaaugguaagauuuac

SEQ ID NO: 456746 - RNA, 24 nt, Human
uaagaacaaaagccuaucauucuc

SEQ ID NO: 456747 - RNA, 22 nt, Human
uaauaaauuaauucuaaaguuu

SEQ ID NO: 456748 - RNA, 20 nt, Human
uaauucucuugccucagccu

SEQ ID NO: 456749 - RNA, 18 nt, Human
uacagaguaagcuguguu

SEQ ID NO: 456750 - RNA, 22 nt, Human
uaccucuuuuucguucauaaga

SEQ ID NO: 456751 - RNA, 23 nt, Human
uauaugcacaccuucgauguaua

SEQ ID NO: 456752 - RNA, 24 nt, Human
uaugcugcccaggauggauucaaa

SEQ ID NO: 456753 - RNA, 25 nt, Human
ucauucaacauauaugcacaccuuc

SEQ ID NO: 456754 - RNA, 21 nt, Human
uccugggcucaaguaauucuc

SEQ ID NO: 456755 - RNA, 21 nt, Human
uccugggcucaaguaauucuc

SEQ ID NO: 456756 - RNA, 18 nt, Human
ucucuugccucagccugg

SEQ ID NO: 456757 - RNA, 21 nt, Human
ugaauggggaagaaaagggac

SEQ ID NO: 456758 - RNA, 24 nt, Human
ugaauggggaagaaaagggacuag

SEQ ID NO: 456759 - RNA, 23 nt, Human
ugccaaaauauuuaaaauucuua

SEQ ID NO: 456760 - RNA, 28 nt, Human
ugcccaggauggauucaaacuccugggc

SEQ ID NO: 456761 - RNA, 22 nt, Human
uggaaagcucugcugucaagug

SEQ ID NO: 456762 - RNA, 26 nt, Human
uggccaggaaaaaaaagcacaagacc

SEQ ID NO: 456763 - RNA, 21 nt, Human
ugggacuacaggcacauacca

SEQ ID NO: 456764 - RNA, 24 nt, Human
ugggacuacaggcacauaccacca

SEQ ID NO: 456765 - RNA, 20 nt, Human
ugggcucaaguaauucucuu

SEQ ID NO: 456766 - RNA, 24 nt, Human
ugggcucaaguaauucucuugccu

SEQ ID NO: 456767 - RNA, 19 nt, Human
uguauaggacacugaucaa

SEQ ID NO: 456768 - RNA, 22 nt, Human
uuagaguuucaacauggagauu

SEQ ID NO: 456769 - RNA, 25 nt, Human
uuagaguuucaacauggagauucua

SEQ ID NO: 456770 - RNA, 23 nt, Human
uucuccaggcuacuagaauguuu

SEQ ID NO: 456771 - RNA, 21 nt, Human
uuuauaaaaacaccauguccc

SEQ ID NO: 456772 - RNA, 26 nt, Human
uuuauacauacaauguaaacaugguu

SEQ ID NO: 456773 - RNA, 25 nt, Human
uuucaguggcauucaaucaacccaa

SEQ ID NO: 456774 - RNA, 20 nt, Human
uuuguagugcuaccucuuuu

SEQ ID NO: 456775 - RNA, 18 nt, Human
uuuuguucuguuuguuuu

SEQ ID NO: 456776 - RNA, 25 nt, Human
uuuuuuauuauuuuuauuucuaugc

SEQ ID NO: 456777 - RNA, 22 nt, Human
uuuuuugaguuguaaauaaaua

SEQ ID NO: 456778 - RNA, 22 nt, Human
aaaauccgaacagaacaaaaug

SEQ ID NO: 456779 - RNA, 18 nt, Human
aaacacaacaaccaaccu

SEQ ID NO: 456780 - RNA, 18 nt, Human
aacaugccuacuauagag

SEQ ID NO: 456781 - RNA, 21 nt, Human
aagaaaauggacagaauccua

SEQ ID NO: 456782 - RNA, 23 nt, Human
aaucccccccuccccgaagagaa

SEQ ID NO: 456783 - RNA, 29 nt, Human
agaauccuaaaacacaacaaccaaccucc

SEQ ID NO: 456784 - RNA, 22 nt, Human
agagggaagggugguggguggg

SEQ ID NO: 456785 - RNA, 20 nt, Human
agugaaaaggccccucuaaa

SEQ ID NO: 456786 - RNA, 24 nt, Human
auaacaguaaaaaaaauggauaau

SEQ ID NO: 456787 - RNA, 23 nt, Human
auggcaaaucacuuuacaaacau

SEQ ID NO: 456788 - RNA, 23 nt, Human
caaccaaccucuaaaaacaaucu

SEQ ID NO: 456789 - RNA, 22 nt, Human
caaccucuaaaaacaaucucua

SEQ ID NO: 456790 - RNA, 22 nt, Human
cacacaaaacaaauuaugugau

SEQ ID NO: 456791 - RNA, 21 nt, Human
cacauuguguucaguuauagu

SEQ ID NO: 456792 - RNA, 18 nt, Human
caccagcauggaacaauu

SEQ ID NO: 456793 - RNA, 18 nt, Human
cacggggguuagguuacu

SEQ ID NO: 456794 - RNA, 24 nt, Human
cagaacaaaaugaaaaaagucgaa

SEQ ID NO: 456795 - RNA, 22 nt, Human
cagaauccuaaaacacaacaac

SEQ ID NO: 456796 - RNA, 22 nt, Human
cagcauggaacaauuuauuccu

SEQ ID NO: 456797 - RNA, 24 nt, Human
cagcucccuaggaagagcacagga

SEQ ID NO: 456798 - RNA, 21 nt, Human
ccaaccucuaaaaacaaucuu

SEQ ID NO: 456799 - RNA, 18 nt, Human
cccauaaaacccuucggg

SEQ ID NO: 456800 - RNA, 19 nt, Human
ccccaaucccccccucccc

SEQ ID NO: 456801 - RNA, 19 nt, Human
cccccaaucccccccuccc

SEQ ID NO: 456802 - RNA, 20 nt, Human
cccucuaaaaccccucuggg

SEQ ID NO: 456803 - RNA, 19 nt, Human
cccucuggggccccucccc

SEQ ID NO: 456804 - RNA, 23 nt, Human
cuuaaagucaguucacaucacac

SEQ ID NO: 456805 - RNA, 20 nt, Human
cuuuccaccagcauggaaca

SEQ ID NO: 456806 - RNA, 18 nt, Human
gaaaaggccccucuaaaa

SEQ ID NO: 456807 - RNA, 22 nt, Human
gccccucccccaaucccccccu

SEQ ID NO: 456808 - RNA, 22 nt, Human
ggaaacaacacagcucccuagg

SEQ ID NO: 456809 - RNA, 21 nt, Human
gggaaggguggugggugggaa

SEQ ID NO: 456810 - RNA, 22 nt, Human
gggccccucccccaaucccccc

SEQ ID NO: 456811 - RNA, 22 nt, Human
guuacugauguuaguucccaua

SEQ ID NO: 456812 - RNA, 21 nt, Human
uaagaacaacauaacaugccu

SEQ ID NO: 456813 - RNA, 18 nt, Human
uaauacagcuaauacccu

SEQ ID NO: 456814 - RNA, 22 nt, Human
uaauacccugaaaaaucaagaa

SEQ ID NO: 456815 - RNA, 19 nt, Human
ucaguuauaguaugaugcu

SEQ ID NO: 456816 - RNA, 24 nt, Human
ucccccaaucccccccuccccgaa

SEQ ID NO: 456817 - RNA, 25 nt, Human
ucccccaaucccccccuccccgaaa

SEQ ID NO: 456818 - RNA, 21 nt, Human
uccgaacagaacaaaaugaaa

SEQ ID NO: 456819 - RNA, 29 nt, Human
ucuaugcauauuaacaacauacauagugu

SEQ ID NO: 456820 - RNA, 24 nt, Human
ucugaaaagaauaaaaaauccaga

SEQ ID NO: 456821 - RNA, 21 nt, Human
ugaaaagaauaaaaaauccag

SEQ ID NO: 456822 - RNA, 22 nt, Human
uggacagaauccuaaaacacaa

SEQ ID NO: 456823 - RNA, 19 nt, Human
ugggaaacaacacagcucc

SEQ ID NO: 456824 - RNA, 31 nt, Human
ugggaaacaacacagcucccuaggaagagcc

SEQ ID NO: 456825 - RNA, 23 nt, Human
uggggagauuaacucuaaucucc

SEQ ID NO: 456826 - RNA, 21 nt, Human
uggggccccucccccaauccc

SEQ ID NO: 456827 - RNA, 22 nt, Human
uggggccccucccccaaucccc

SEQ ID NO: 456828 - RNA, 20 nt, Human
uuaaagucaguucacaucac

SEQ ID NO: 456829 - RNA, 19 nt, Human
uuaacucuaaucuccacau

SEQ ID NO: 456830 - RNA, 23 nt, Human
uucacacaaaacaaauuauguga

SEQ ID NO: 456831 - RNA, 25 nt, Human
uucacuuacacuuagaaauuaaauc

SEQ ID NO: 456832 - RNA, 21 nt, Human
aaaaaaaaaaaacaaaaaaaa

SEQ ID NO: 456833 - RNA, 27 nt, Human
aaaaaaaaacaaaaaaacacaacaaca

SEQ ID NO: 456834 - RNA, 21 nt, Human
aaaaaaaacaaaaaaacacaa

SEQ ID NO: 456835 - RNA, 19 nt, Human
aaaaaaacacaacaacaaa

SEQ ID NO: 456836 - RNA, 24 nt, Human
aaaaaaacacaacaacaaaaaaga

SEQ ID NO: 456837 - RNA, 20 nt, Human
aaaacagcaaaaaugagccc

SEQ ID NO: 456838 - RNA, 29 nt, Human
aaaacagcaaaaaugagcccccaaaaaag

SEQ ID NO: 456839 - RNA, 19 nt, Human
aaagaaagcggggaccugg

SEQ ID NO: 456840 - RNA, 22 nt, Human
aaagagagagagagagagaagc

SEQ ID NO: 456841 - RNA, 22 nt, Human
aaauccaucaucuuacgccaga

SEQ ID NO: 456842 - RNA, 19 nt, Human
aacacaacaacaaaaaaac

SEQ ID NO: 456843 - RNA, 23 nt, Human
aagcccgggaaucaaaacagcaa

SEQ ID NO: 456844 - RNA, 23 nt, Human
aagcuguaacaauccacccugca

SEQ ID NO: 456845 - RNA, 18 nt, Human
aaucacacagcaguggca

SEQ ID NO: 456846 - RNA, 19 nt, Human
acaaaacaggagcacaguu

SEQ ID NO: 456847 - RNA, 24 nt, Human
acaacaaaaaaacuguccucugag

SEQ ID NO: 456848 - RNA, 21 nt, Human
acacagcaguggcaaaaggag

SEQ ID NO: 456849 - RNA, 22 nt, Human
acagcaaaaaugagcccccaaa

SEQ ID NO: 456850 - RNA, 19 nt, Human
acaggcuuuuuauuucuca

SEQ ID NO: 456851 - RNA, 18 nt, Human
acaguagaggagccaggg

SEQ ID NO: 456852 - RNA, 26 nt, Human
acucuauucugucuccucauccaccu

SEQ ID NO: 456853 - RNA, 21 nt, Human
acugggccugucuaaucacac

SEQ ID NO: 456854 - RNA, 23 nt, Human
agacaaaacaggagcacaguuga

SEQ ID NO: 456855 - RNA, 21 nt, Human
agagaagcagccacuguuacc

SEQ ID NO: 456856 - RNA, 18 nt, Human
agaggagccagggacucu

SEQ ID NO: 456857 - RNA, 19 nt, Human
agaggagccagggacucug

SEQ ID NO: 456858 - RNA, 18 nt, Human
agaugugaagguugggcu

SEQ ID NO: 456859 - RNA, 20 nt, Human
agcaaaaaugagcccccaaa

SEQ ID NO: 456860 - RNA, 21 nt, Human
agcccagccagucccccacag

SEQ ID NO: 456861 - RNA, 19 nt, Human
aggaacagccgagaugacc

SEQ ID NO: 456862 - RNA, 21 nt, Human
aggagcggccagcaugugccc

SEQ ID NO: 456863 - RNA, 21 nt, Human
aggcagcuccggccagaggcc

SEQ ID NO: 456864 - RNA, 24 nt, Human
agggaggagggcgaaucaaaucca

SEQ ID NO: 456865 - RNA, 20 nt, Human
aggugugacagauaaggaac

SEQ ID NO: 456866 - RNA, 27 nt, Human
agguuuccagcgaagcuguaacaaucc

SEQ ID NO: 456867 - RNA, 25 nt, Human
aucuaccaaaaaaaaaaaacaaaaa

SEQ ID NO: 456868 - RNA, 22 nt, Human
caaaacagcaaaaaugagcccc

SEQ ID NO: 456869 - RNA, 23 nt, Human
caaaacaggagcacaguugaaac

SEQ ID NO: 456870 - RNA, 21 nt, Human
caacaaaaaaacuguccucug

SEQ ID NO: 456871 - RNA, 26 nt, Human
caacaacaaaaaaacuguccucugag

SEQ ID NO: 456872 - RNA, 20 nt, Human
cacaacaacaaaaaaacugg

SEQ ID NO: 456873 - RNA, 23 nt, Human
cacacacaagucaugcaucuacc

SEQ ID NO: 456874 - RNA, 20 nt, Human
cacacggccugcagcagccc

SEQ ID NO: 456875 - RNA, 19 nt, Human
cacagcaguggcaaaagga

SEQ ID NO: 456876 - RNA, 19 nt, Human
cacagcaguggcaaaagga

SEQ ID NO: 456877 - RNA, 23 nt, Human
caccccguuuccccaaugacuua

SEQ ID NO: 456878 - RNA, 21 nt, Human
caccugguaagcccgggaauc

SEQ ID NO: 456879 - RNA, 24 nt, Human
cacuuucaagacaaaacaggagca

SEQ ID NO: 456880 - RNA, 19 nt, Human
cagcaaaaaugagccccca

SEQ ID NO: 456881 - RNA, 19 nt, Human
caggaaggcugguggcacc

SEQ ID NO: 456882 - RNA, 27 nt, Human
ccaaaaaaaaaaaacaaaaaaacacaa

SEQ ID NO: 456883 - RNA, 18 nt, Human
ccacugccuuuuucugag

SEQ ID NO: 456884 - RNA, 18 nt, Human
ccagccagucccccacag

SEQ ID NO: 456885 - RNA, 22 nt, Human
cccccacagcaucgagccaagu

SEQ ID NO: 456886 - RNA, 19 nt, Human
cccgcugcacaggcagaag

SEQ ID NO: 456887 - RNA, 20 nt, Human
cccugcgggagcugcugccu

SEQ ID NO: 456888 - RNA, 20 nt, Human
ccgccgccgccaccucugcc

SEQ ID NO: 456889 - RNA, 22 nt, Human
ccgccgccgccaccucugccaa

SEQ ID NO: 456890 - RNA, 18 nt, Human
ccuccaaagaaagcgggg

SEQ ID NO: 456891 - RNA, 18 nt, Human
ccucugaggaggcacagg

SEQ ID NO: 456892 - RNA, 19 nt, Human
ccuucuuccucccucacuu

SEQ ID NO: 456893 - RNA, 21 nt, Human
ccuucuuccucccucacuucu

SEQ ID NO: 456894 - RNA, 23 nt, Human
ccuucuuccucccucacuucuca

SEQ ID NO: 456895 - RNA, 19 nt, Human
cggcucacugggccugucu

SEQ ID NO: 456896 - RNA, 23 nt, Human
cggggaccugggcggacugcguc

SEQ ID NO: 456897 - RNA, 20 nt, Human
cuaauuugaaaauguugauc

SEQ ID NO: 456898 - RNA, 20 nt, Human
cuaccaaaaaaaaaaaacaa

SEQ ID NO: 456899 - RNA, 26 nt, Human
cuaccaaaaaaaaaaaacaaaaaaac

SEQ ID NO: 456900 - RNA, 24 nt, Human
cucacugggccugucuaaucacac

SEQ ID NO: 456901 - RNA, 23 nt, Human
cucauccaccugaaguucacccc

SEQ ID NO: 456902 - RNA, 22 nt, Human
cuccaaagaaagcggggaccug

SEQ ID NO: 456903 - RNA, 20 nt, Human
cugcagcucagauucaacag

SEQ ID NO: 456904 - RNA, 22 nt, Human
cugucagcucuagcaaaaggga

SEQ ID NO: 456905 - RNA, 22 nt, Human
cuguccucugaggaggcacagg

SEQ ID NO: 456906 - RNA, 18 nt, Human
cuucagcccugcgggagc

SEQ ID NO: 456907 - RNA, 21 nt, Human
gacacauucacuguggaaggc

SEQ ID NO: 456908 - RNA, 19 nt, Human
gacugugacagccucaaca

SEQ ID NO: 456909 - RNA, 21 nt, Human
gagagagagagaagcagccac

SEQ ID NO: 456910 - RNA, 19 nt, Human
gagcugcugccuccaaaga

SEQ ID NO: 456911 - RNA, 18 nt, Human
gagggaggagcggccagc

SEQ ID NO: 456912 - RNA, 20 nt, Human
gcaucuaccaaaaaaaaaaa

SEQ ID NO: 456913 - RNA, 18 nt, Human
gccagacgcuuccuauca

SEQ ID NO: 456914 - RNA, 22 nt, Human
gcccugcgggagcugcugccuc

SEQ ID NO: 456915 - RNA, 24 nt, Human
ggacacugccuucuuccucccuca

SEQ ID NO: 456916 - RNA, 22 nt, Human
ggagccagggacucugucucca

SEQ ID NO: 456917 - RNA, 19 nt, Human
ggcccacaggaaggcuggu

SEQ ID NO: 456918 - RNA, 20 nt, Human
uaccaaaaaaaaaaaacaaa

SEQ ID NO: 456919 - RNA, 24 nt, Human
uaccaaaaaaaaaaaacaaaaaaa

SEQ ID NO: 456920 - RNA, 23 nt, Human
uaugacagggaggagggcgaauc

SEQ ID NO: 456921 - RNA, 22 nt, Human
ucaaaacagcaaaaaugagccc

SEQ ID NO: 456922 - RNA, 22 nt, Human
ucaagacaaaacaggagcacaa

SEQ ID NO: 456923 - RNA, 21 nt, Human
ucagcccugcgggagcugcug

SEQ ID NO: 456924 - RNA, 21 nt, Human
uccacacucaggacugugaca

SEQ ID NO: 456925 - RNA, 22 nt, Human
ucccucacuucucaccugguaa

SEQ ID NO: 456926 - RNA, 25 nt, Human
ucuaccaaaaaaaaaaaacaaaaaa

SEQ ID NO: 456927 - RNA, 19 nt, Human
ucuaugacagggaggaggg

SEQ ID NO: 456928 - RNA, 21 nt, Human
ugaaaauguugaucuccuuuc

SEQ ID NO: 456929 - RNA, 19 nt, Human
ugacagauaaggaaccugc

SEQ ID NO: 456930 - RNA, 20 nt, Human
ugacagccucaacaacauga

SEQ ID NO: 456931 - RNA, 19 nt, Human
ugacagggaggagggcgaa

SEQ ID NO: 456932 - RNA, 18 nt, Human
ugcagccacucugggacc

SEQ ID NO: 456933 - RNA, 19 nt, Human
ugcagcucuaugacaggga

SEQ ID NO: 456934 - RNA, 23 nt, Human
ugccagacgcuuccuaucacucu

SEQ ID NO: 456935 - RNA, 23 nt, Human
uggugccacuuucaagacaaaac

SEQ ID NO: 456936 - RNA, 25 nt, Human
ugguggcaccagggaauaaacccug

SEQ ID NO: 456937 - RNA, 19 nt, Human
uguaacaauccacccugca

SEQ ID NO: 456938 - RNA, 21 nt, Human
uguaacaauccacccugcagc

SEQ ID NO: 456939 - RNA, 20 nt, Human
ugugaagguugggcugacag

SEQ ID NO: 456940 - RNA, 23 nt, Human
uucagcccugcgggagcugcugc

SEQ ID NO: 456941 - RNA, 19 nt, Human
aaagccggucugcacgagu

SEQ ID NO: 456942 - RNA, 20 nt, Human
aacccugcccuaagccgggc

SEQ ID NO: 456943 - RNA, 26 nt, Human
aagccacaacgcucccagccuccagc

SEQ ID NO: 456944 - RNA, 25 nt, Human
aagggucagcaagaaaagaggaagc

SEQ ID NO: 456945 - RNA, 20 nt, Human
aauaaagaagcaauuaggaa

SEQ ID NO: 456946 - RNA, 25 nt, Human
acacacgcgcacacacacgugugua

SEQ ID NO: 456947 - RNA, 27 nt, Human
acacgcgcacacacacguguguaguug

SEQ ID NO: 456948 - RNA, 26 nt, Human
acccaggcugacgacccacgauuagc

SEQ ID NO: 456949 - RNA, 18 nt, Human
agcaagaaaagaggaagc

SEQ ID NO: 456950 - RNA, 19 nt, Human
agcacugcacuuggucauc

SEQ ID NO: 456951 - RNA, 21 nt, Human
agccacaacgcucccagccuc

SEQ ID NO: 456952 - RNA, 22 nt, Human
aggccccccagggcgucuccuc

SEQ ID NO: 456953 - RNA, 25 nt, Human
caaaauaaagaagcaauuaggaaaa

SEQ ID NO: 456954 - RNA, 26 nt, Human
caaggugcagccacuucccagagcuc

SEQ ID NO: 456955 - RNA, 18 nt, Human
cacuaugcauggcggggc

SEQ ID NO: 456956 - RNA, 19 nt, Human
cacuggccagcucucucgg

SEQ ID NO: 456957 - RNA, 22 nt, Human
cagcuggaaaccacgcggugga

SEQ ID NO: 456958 - RNA, 24 nt, Human
ccaaaauaaagaagcaauuaggaa

SEQ ID NO: 456959 - RNA, 24 nt, Human
ccaccuguccagcucucaaaagcc

SEQ ID NO: 456960 - RNA, 23 nt, Human
ccagagcuccgaagggucagcaa

SEQ ID NO: 456961 - RNA, 21 nt, Human
ccagggcgucuccuccaacgc

SEQ ID NO: 456962 - RNA, 18 nt, Human
cccaggcugacgacccac

SEQ ID NO: 456963 - RNA, 23 nt, Human
cccuaagccgggcccagccaccc

SEQ ID NO: 456964 - RNA, 20 nt, Human
cccugcccuaagccgggccc

SEQ ID NO: 456965 - RNA, 22 nt, Human
ccucgugccccacgcccguguc

SEQ ID NO: 456966 - RNA, 18 nt, Human
ccuguccagcucucaaaa

SEQ ID NO: 456967 - RNA, 20 nt, Human
ccuguguaguacagcccagc

SEQ ID NO: 456968 - RNA, 27 nt, Human
cgaucaccagguucccaguuuuucagu

SEQ ID NO: 456969 - RNA, 20 nt, Human
cgcgcacacacacguguggu

SEQ ID NO: 456970 - RNA, 19 nt, Human
cgggagggucccgcggagg

SEQ ID NO: 456971 - RNA, 24 nt, Human
cuaaggccccccagggcgucuccu

SEQ ID NO: 456972 - RNA, 22 nt, Human
cuccgaagggucagcaagaaaa

SEQ ID NO: 456973 - RNA, 22 nt, Human
gagcccccuaccauuggaaaug

SEQ ID NO: 456974 - RNA, 21 nt, Human
gagccgccaaggugcagccac

SEQ ID NO: 456975 - RNA, 18 nt, Human
gcacugcacuuggucauc

SEQ ID NO: 456976 - RNA, 18 nt, Human
gcccccuaccauuggaaa

SEQ ID NO: 456977 - RNA, 26 nt, Human
gcucccagccuccagcuggaaaccac

SEQ ID NO: 456978 - RNA, 19 nt, Human
gguaauaagaacauagcac

SEQ ID NO: 456979 - RNA, 19 nt, Human
gugcacuguguuuuauaca

SEQ ID NO: 456980 - RNA, 21 nt, Human
uaaaggcugaguauuagugca

SEQ ID NO: 456981 - RNA, 21 nt, Human
uacagcccagcacuggccagc

SEQ ID NO: 456982 - RNA, 18 nt, Human
uacggccugucuaaagca

SEQ ID NO: 456983 - RNA, 24 nt, Human
ucaaaauaaaagcugcggauaaac

SEQ ID NO: 456984 - RNA, 25 nt, Human
ucaacuccugagcccccacguugcc

SEQ ID NO: 456985 - RNA, 19 nt, Human
uccaacgcgccgaugccca

SEQ ID NO: 456986 - RNA, 19 nt, Human
ucccagccuccagcuggaa

SEQ ID NO: 456987 - RNA, 23 nt, Human
ucgcgccaggauagcggcuccaa

SEQ ID NO: 456988 - RNA, 24 nt, Human
ucuauccaccaccuguccagcucu

SEQ ID NO: 456989 - RNA, 23 nt, Human
ucugcagacacauacguuuuaga

SEQ ID NO: 456990 - RNA, 20 nt, Human
ugaguauuagugcacugugu

SEQ ID NO: 456991 - RNA, 22 nt, Human
ugaucuauccaccaccugucca

SEQ ID NO: 456992 - RNA, 23 nt, Human
ugaucuauccaccaccuguccag

SEQ ID NO: 456993 - RNA, 20 nt, Human
ugcccuaagccgggcccagc

SEQ ID NO: 456994 - RNA, 21 nt, Human
uggcccaaaauaaagaagcaa

SEQ ID NO: 456995 - RNA, 19 nt, Human
ugucccaacgggagggucc

SEQ ID NO: 456996 - RNA, 21 nt, Human
ugucuaccgcuucagggcagc

SEQ ID NO: 456997 - RNA, 26 nt, Human
uguguuuuauacacacgcgcacacag

SEQ ID NO: 456998 - RNA, 20 nt, Human
uguuaucuagcuucuucacu

SEQ ID NO: 456999 - RNA, 23 nt, Human
uugaugucugcagacacauacgu

SEQ ID NO: 457000 - RNA, 20 nt, Human
uugccaccugucuaccgcuu

SEQ ID NO: 457001 - RNA, 20 nt, Human
uuggaaaugccaaacccugc

SEQ ID NO: 457002 - RNA, 22 nt, Human
uuugucaacuccugagccccca

SEQ ID NO: 457003 - RNA, 23 nt, Human
aaaagaacaggaugagcaguggg

SEQ ID NO: 457004 - RNA, 19 nt, Human
aaacaaacaaacaaacaca

SEQ ID NO: 457005 - RNA, 21 nt, Human
aaacaaacaaacaaacacaac

SEQ ID NO: 457006 - RNA, 19 nt, Human
aaacaaacaaacacaacaa

SEQ ID NO: 457007 - RNA, 18 nt, Human
aaacaaacacaacaauga

SEQ ID NO: 457008 - RNA, 23 nt, Human
aacaaacaaacaaacacaacaau

SEQ ID NO: 457009 - RNA, 24 nt, Human
aacaaugcagaagaggaggagaga

SEQ ID NO: 457010 - RNA, 25 nt, Human
acaaaaaaaaaaaaaaaaaaaagaa

SEQ ID NO: 457011 - RNA, 21 nt, Human
acaaacaaacacaacaaugaa

SEQ ID NO: 457012 - RNA, 23 nt, Human
acaaugaaucuagcuacauauca

SEQ ID NO: 457013 - RNA, 21 nt, Human
agaagaggaggagagagaggc

SEQ ID NO: 457014 - RNA, 18 nt, Human
aggaggagagagaggcuu

SEQ ID NO: 457015 - RNA, 21 nt, Human
caaugaaucuagcuacauauc

SEQ ID NO: 457016 - RNA, 19 nt, Human
caccagcagccagccgggc

SEQ ID NO: 457017 - RNA, 22 nt, Human
cagguaaaacaaacaaacaaac

SEQ ID NO: 457018 - RNA, 23 nt, Human
ccaccagcagccagccgggccag

SEQ ID NO: 457019 - RNA, 23 nt, Human
cccccaagauaauaucagguaaa

SEQ ID NO: 457020 - RNA, 25 nt, Human
ccucuagaacaaaaaaaaaaaaaaa

SEQ ID NO: 457021 - RNA, 19 nt, Human
cucaugucugaaacuggau

SEQ ID NO: 457022 - RNA, 21 nt, Human
cucaugucugaaacuggaucu

SEQ ID NO: 457023 - RNA, 27 nt, Human
cucuagaacaaaaaaaaaaaaaaaaaa

SEQ ID NO: 457024 - RNA, 18 nt, Human
gaaaaacaaugcagaaga

SEQ ID NO: 457025 - RNA, 22 nt, Human
gcugggaucagcuacgucaggc

SEQ ID NO: 457026 - RNA, 21 nt, Human
uaucagguaaaacaaacaaac

SEQ ID NO: 457027 - RNA, 23 nt, Human
ucuagaacaaaaaaaaaaaaaaa

SEQ ID NO: 457028 - RNA, 24 nt, Human
ucuagaacaaaaaaaaaaaaaaaa

SEQ ID NO: 457029 - RNA, 19 nt, Human
ucucaugucugaaacugga

SEQ ID NO: 457030 - RNA, 20 nt, Human
ugagcagggaaaaacaaugc

SEQ ID NO: 457031 - RNA, 22 nt, Human
ugggaucagcuacgucaggccc

SEQ ID NO: 457032 - RNA, 22 nt, Human
uuuucuaguuuauaagaguuau

SEQ ID NO: 457033 - RNA, 22 nt, Human
aaacaaaugaggcaagcaagau

SEQ ID NO: 457034 - RNA, 20 nt, Human
aacaaaugaggcaagcaaga

SEQ ID NO: 457035 - RNA, 23 nt, Human
aacuccauggauaaugaccaucu

SEQ ID NO: 457036 - RNA, 22 nt, Human
aagggugcuccugaggcacuug

SEQ ID NO: 457037 - RNA, 23 nt, Human
acaggugcccaccacuacacccg

SEQ ID NO: 457038 - RNA, 18 nt, Human
acgggguuucaccauguu

SEQ ID NO: 457039 - RNA, 19 nt, Human
acgggguuucaccauguua

SEQ ID NO: 457040 - RNA, 20 nt, Human
acgggguuucaccauguuag

SEQ ID NO: 457041 - RNA, 24 nt, Human
acgggguuucaccauguuagccag

SEQ ID NO: 457042 - RNA, 24 nt, Human
agaaauuaaugaagagaugccaca

SEQ ID NO: 457043 - RNA, 28 nt, Human
agaaauuaaugaagagaugccgguaccc

SEQ ID NO: 457044 - RNA, 23 nt, Human
agccccaauuuuuuuuuuaaggg

SEQ ID NO: 457045 - RNA, 18 nt, Human
agccucucgaguagcuag

SEQ ID NO: 457046 - RNA, 25 nt, Human
aggcuggagugcaguggcgcgaucu

SEQ ID NO: 457047 - RNA, 19 nt, Human
agggaggcaaggagagcgg

SEQ ID NO: 457048 - RNA, 22 nt, Human
aguagagacgggguuucaccau

SEQ ID NO: 457049 - RNA, 20 nt, Human
aguccuguauauagcaguuu

SEQ ID NO: 457050 - RNA, 21 nt, Human
agugcaguggcgcgaucuccg

SEQ ID NO: 457051 - RNA, 24 nt, Human
agugcaguggcgcgaucuccgcuc

SEQ ID NO: 457052 - RNA, 24 nt, Human
auccuaagaacauaaccaggaaac

SEQ ID NO: 457053 - RNA, 26 nt, Human
caagaaauuaaugaagagaugccaca

SEQ ID NO: 457054 - RNA, 18 nt, Human
caccauguuagccaggau

SEQ ID NO: 457055 - RNA, 22 nt, Human
caccauguuagccaggaugguc

SEQ ID NO: 457056 - RNA, 24 nt, Human
caccauguuagccaggauggucuc

SEQ ID NO: 457057 - RNA, 18 nt, Human
caccccaucaaauucaga

SEQ ID NO: 457058 - RNA, 19 nt, Human
caccucccggguucacgcc

SEQ ID NO: 457059 - RNA, 24 nt, Human
cagagucuugcccuguugcccagg

SEQ ID NO: 457060 - RNA, 21 nt, Human
cagauggcauaaauuuuuucc

SEQ ID NO: 457061 - RNA, 23 nt, Human
caggaaacaaaugaggcaagcaa

SEQ ID NO: 457062 - RNA, 21 nt, Human
caggugcccaccacuacaccc

SEQ ID NO: 457063 - RNA, 24 nt, Human
caggugcccaccacuacacccggc

SEQ ID NO: 457064 - RNA, 23 nt, Human
caguccuguauauagcaguuuca

SEQ ID NO: 457065 - RNA, 21 nt, Human
ccaccauaaucauauacaagc

SEQ ID NO: 457066 - RNA, 23 nt, Human
ccuaagaacauaaccaggaaaca

SEQ ID NO: 457067 - RNA, 24 nt, Human
ccucccggguucacgccauucucc

SEQ ID NO: 457068 - RNA, 23 nt, Human
cuaccucagccucucgaguagcu

SEQ ID NO: 457069 - RNA, 24 nt, Human
cucacugcaagcuccaccucccgg

SEQ ID NO: 457070 - RNA, 21 nt, Human
cucccggguucacgccauucu

SEQ ID NO: 457071 - RNA, 24 nt, Human
cucgaguagcuaggacuacaggug

SEQ ID NO: 457072 - RNA, 24 nt, Human
cucucgaguagcuaggacuacagg

SEQ ID NO: 457073 - RNA, 24 nt, Human
cugcaagcuccaccucccggguuc

SEQ ID NO: 457074 - RNA, 24 nt, Human
cuuacuaaaaucuucuacugucuu

SEQ ID NO: 457075 - RNA, 19 nt, Human
cuuauauaucugaaaucac

SEQ ID NO: 457076 - RNA, 24 nt, Human
cuugcccuguugcccaggcuggag

SEQ ID NO: 457077 - RNA, 18 nt, Human
gaacauaaccaggaaaca

SEQ ID NO: 457078 - RNA, 24 nt, Human
gagacgggguuucaccauguuagc

SEQ ID NO: 457079 - RNA, 19 nt, Human
gcccaggcuggagugcagu

SEQ ID NO: 457080 - RNA, 20 nt, Human
gcccaggcuggagugcagug

SEQ ID NO: 457081 - RNA, 25 nt, Human
gcccuguugcccaggcuggagugca

SEQ ID NO: 457082 - RNA, 25 nt, Human
gcuggagugcaguggcgcgaucucc

SEQ ID NO: 457083 - RNA, 22 nt, Human
ggacuacaggugcccaccacua

SEQ ID NO: 457084 - RNA, 21 nt, Human
ggagagcgggauggauuugga

SEQ ID NO: 457085 - RNA, 23 nt, Human
gggguuucaccauguuagccagg

SEQ ID NO: 457086 - RNA, 22 nt, Human
ggguuucaccauguuagccagg

SEQ ID NO: 457087 - RNA, 24 nt, Human
gguuucaccauguuagccaggaug

SEQ ID NO: 457088 - RNA, 23 nt, Human
guagagacgggguuucaccaugu

SEQ ID NO: 457089 - RNA, 21 nt, Human
uaaccaggaaacaaaugaggc

SEQ ID NO: 457090 - RNA, 24 nt, Human
uaauuuuuuguauguuuaguagag

SEQ ID NO: 457091 - RNA, 23 nt, Human
uaccucagccucucgaguagcua

SEQ ID NO: 457092 - RNA, 24 nt, Human
uaccucagccucucgaguagcuag

SEQ ID NO: 457093 - RNA, 22 nt, Human
uagagacgggguuucaccaugu

SEQ ID NO: 457094 - RNA, 21 nt, Human
uaggacuacaggugcccacca

SEQ ID NO: 457095 - RNA, 24 nt, Human
uaguagagacgggguuucaccaug

SEQ ID NO: 457096 - RNA, 26 nt, Human
uaguagagacgggguuucaccauguu

SEQ ID NO: 457097 - RNA, 22 nt, Human
uauaaaagucacuucaugcuua

SEQ ID NO: 457098 - RNA, 19 nt, Human
uauacaguccuguauauag

SEQ ID NO: 457099 - RNA, 18 nt, Human
uauaucugaaaucaccca

SEQ ID NO: 457100 - RNA, 24 nt, Human
ucaccauguuagccaggauggucu

SEQ ID NO: 457101 - RNA, 24 nt, Human
ucacugcaagcuccaccucccggg

SEQ ID NO: 457102 - RNA, 19 nt, Human
ucagggaggcaaggagagc

SEQ ID NO: 457103 - RNA, 18 nt, Human
ucccaacaagaaauuaau

SEQ ID NO: 457104 - RNA, 21 nt, Human
ucccggguucacgccauucuc

SEQ ID NO: 457105 - RNA, 23 nt, Human
ucccggguucacgccauucuccu

SEQ ID NO: 457106 - RNA, 26 nt, Human
uccgaacagauggcauaaaggaguuc

SEQ ID NO: 457107 - RNA, 18 nt, Human
ucuccaggaucaguuucu

SEQ ID NO: 457108 - RNA, 24 nt, Human
ucuccuaccucagccucucgagua

SEQ ID NO: 457109 - RNA, 23 nt, Human
ucucgaguagcuaggacuacagg

SEQ ID NO: 457110 - RNA, 24 nt, Human
ucucgaguagcuaggacuacaggu

SEQ ID NO: 457111 - RNA, 24 nt, Human
ucugaaguuuuucucuuggaaacu

SEQ ID NO: 457112 - RNA, 20 nt, Human
ucuuagucagaauccuaaga

SEQ ID NO: 457113 - RNA, 23 nt, Human
ucuugcccuguugcccaggcugg

SEQ ID NO: 457114 - RNA, 24 nt, Human
ucuugcccuguugcccaggcugga

SEQ ID NO: 457115 - RNA, 18 nt, Human
ugagacagagucuugccc

SEQ ID NO: 457116 - RNA, 22 nt, Human
ugagacagagucuugcccuguu

SEQ ID NO: 457117 - RNA, 18 nt, Human
ugcccaggcuggagugca

SEQ ID NO: 457118 - RNA, 21 nt, Human
ugcccaggcuggagugcagug

SEQ ID NO: 457119 - RNA, 22 nt, Human
ugcccaggcuggagugcagugg

SEQ ID NO: 457120 - RNA, 24 nt, Human
ugcccaggcuggagugcaguggcg

SEQ ID NO: 457121 - RNA, 24 nt, Human
ugcccuguugcccaggcuggagug

SEQ ID NO: 457122 - RNA, 25 nt, Human
ugcccuguugcccaggcuggagugc

SEQ ID NO: 457123 - RNA, 23 nt, Human
ugcgagagguagcuugcccaggc

SEQ ID NO: 457124 - RNA, 22 nt, Human
uggagugcaguggcgcgaucuc

SEQ ID NO: 457125 - RNA, 24 nt, Human
uggagugcaguggcgcgaucuccg

SEQ ID NO: 457126 - RNA, 18 nt, Human
uguaggcuuacuaaaauc

SEQ ID NO: 457127 - RNA, 23 nt, Human
uguccagauuauauacucuuaac

SEQ ID NO: 457128 - RNA, 24 nt, Human
uguccagauuauauacucuuaacu

SEQ ID NO: 457129 - RNA, 24 nt, Human
uguggucaccccaucaaauucaga

SEQ ID NO: 457130 - RNA, 22 nt, Human
uguggucggcuuaugcaguacc

SEQ ID NO: 457131 - RNA, 21 nt, Human
uguugcccaggcuggagugca

SEQ ID NO: 457132 - RNA, 24 nt, Human
uguuuaguagagacgggguuucac

SEQ ID NO: 457133 - RNA, 18 nt, Human
uuaguagagacgggguuu

SEQ ID NO: 457134 - RNA, 22 nt, Human
uuaguagagacgggguuucacc

SEQ ID NO: 457135 - RNA, 24 nt, Human
uuaguagagacgggguuucaccau

SEQ ID NO: 457136 - RNA, 23 nt, Human
uuauuuuuuauaccacaagaucu

SEQ ID NO: 457137 - RNA, 22 nt, Human
uucaagaggagaaugcugagga

SEQ ID NO: 457138 - RNA, 25 nt, Human
uucuucauuguagauaauuuccgau

SEQ ID NO: 457139 - RNA, 23 nt, Human
uugcauugccugauuuguguuuc

SEQ ID NO: 457140 - RNA, 24 nt, Human
uugcccuguugcccaggcuggagu

SEQ ID NO: 457141 - RNA, 19 nt, Human
uuggaguuuuauagauuga

SEQ ID NO: 457142 - RNA, 19 nt, Human
uuucaccauguuagccagg

SEQ ID NO: 457143 - RNA, 20 nt, Human
uuucaccauguuagccagga

SEQ ID NO: 457144 - RNA, 20 nt, Human
uuuuaaaugcguguuaacca

SEQ ID NO: 457145 - RNA, 21 nt, Human
uuuuuguauguuuaguagaga

SEQ ID NO: 457146 - RNA, 24 nt, Human
uuuuuuguauguuuaguagagacg

SEQ ID NO: 457147 - RNA, 20 nt, Human
uuuuuuuuuuugagacagag

SEQ ID NO: 457148 - RNA, 24 nt, Human
uuuuuuuuuuuugagacagagucu

SEQ ID NO: 457149 - RNA, 18 nt, Human
uuuuuuuuuuuuuuuuug

SEQ ID NO: 457150 - RNA, 25 nt, Human
aaaaaaggaaaaggguagaagagaa

SEQ ID NO: 457151 - RNA, 24 nt, Human
aaaaaggaaaaggguagaagagaa

SEQ ID NO: 457152 - RNA, 25 nt, Human
aaaaauauccaaacaucuaucaagg

SEQ ID NO: 457153 - RNA, 22 nt, Human
aaaagcucuagaauagcagucc

SEQ ID NO: 457154 - RNA, 18 nt, Human
aaaaggaaaaggguagaa

SEQ ID NO: 457155 - RNA, 23 nt, Human
aaaaggaauauacacauguauuu

SEQ ID NO: 457156 - RNA, 19 nt, Human
aaaccagaagagggacuga

SEQ ID NO: 457157 - RNA, 21 nt, Human
aacacacacaaccacaagacc

SEQ ID NO: 457158 - RNA, 19 nt, Human
aacauuucaaacagcugug

SEQ ID NO: 457159 - RNA, 24 nt, Human
aacuacgugaacacaccauacuuc

SEQ ID NO: 457160 - RNA, 20 nt, Human
aagaccacccacgacuauag

SEQ ID NO: 457161 - RNA, 20 nt, Human
aagagcaacaucuaucuguu

SEQ ID NO: 457162 - RNA, 20 nt, Human
aagcucuagaauagcagucc

SEQ ID NO: 457163 - RNA, 24 nt, Human
aauaaagggaaaccagaagaggga

SEQ ID NO: 457164 - RNA, 18 nt, Human
acacaaugaggcccccuc

SEQ ID NO: 457165 - RNA, 23 nt, Human
acacauguauuuguacacacaca

SEQ ID NO: 457166 - RNA, 23 nt, Human
acucagcuggggacugcuagaac

SEQ ID NO: 457167 - RNA, 18 nt, Human
agacugaaaggacaggca

SEQ ID NO: 457168 - RNA, 23 nt, Human
agagaaauaaagggaaaccagaa

SEQ ID NO: 457169 - RNA, 19 nt, Human
agagagauggauggaucag

SEQ ID NO: 457170 - RNA, 21 nt, Human
aggcaagagagagauggaugg

SEQ ID NO: 457171 - RNA, 23 nt, Human
aggcagcagggauccugcaagcc

SEQ ID NO: 457172 - RNA, 27 nt, Human
aggcaggaggaagggcaaaggggaccc

SEQ ID NO: 457173 - RNA, 19 nt, Human
aggcaggggccaggagaaa

SEQ ID NO: 457174 - RNA, 23 nt, Human
aggcucucgggcgucagcaaucu

SEQ ID NO: 457175 - RNA, 20 nt, Human
agucacaaagucuuccuggg

SEQ ID NO: 457176 - RNA, 21 nt, Human
auaaaacaucacaggccaaaa

SEQ ID NO: 457177 - RNA, 25 nt, Human
caaaaaauauccaaacaucuaucaa

SEQ ID NO: 457178 - RNA, 28 nt, Human
caaaaaggcgccgucaggaaugugacag

SEQ ID NO: 457179 - RNA, 22 nt, Human
caaacagcugugcaacgaacac

SEQ ID NO: 457180 - RNA, 23 nt, Human
cacaaccacaagaccacccacga

SEQ ID NO: 457181 - RNA, 23 nt, Human
cacaagaccacccacgaccacgg

SEQ ID NO: 457182 - RNA, 21 nt, Human
cacacacaaccacaagaccac

SEQ ID NO: 457183 - RNA, 20 nt, Human
cacacacagggcacaccaaa

SEQ ID NO: 457184 - RNA, 23 nt, Human
cacaccaaaaaauauccaaacau

SEQ ID NO: 457185 - RNA, 19 nt, Human
cacaggccaaaaaggcgcc

SEQ ID NO: 457186 - RNA, 24 nt, Human
cacccacgacuauaggacuuuaca

SEQ ID NO: 457187 - RNA, 24 nt, Human
cacucugcaauccccaugcuaaau

SEQ ID NO: 457188 - RNA, 26 nt, Human
cagcccgggaucaccaaggcagcagg

SEQ ID NO: 457189 - RNA, 22 nt, Human
caggcaggggccaggagaaagu

SEQ ID NO: 457190 - RNA, 25 nt, Human
cagggcacaccaaaaaauauccaaa

SEQ ID NO: 457191 - RNA, 18 nt, Human
caucacaggccaaaaagg

SEQ ID NO: 457192 - RNA, 18 nt, Human
cauguuucugucuagccu

SEQ ID NO: 457193 - RNA, 25 nt, Human
ccaaaaaauauccaaacaucuauca

SEQ ID NO: 457194 - RNA, 21 nt, Human
ccacaagaccacccacgacua

SEQ ID NO: 457195 - RNA, 25 nt, Human
ccagacacccaggugaaagagcaac

SEQ ID NO: 457196 - RNA, 20 nt, Human
ccaggaccuagauggggaca

SEQ ID NO: 457197 - RNA, 18 nt, Human
cccucacucuccaggagc

SEQ ID NO: 457198 - RNA, 25 nt, Human
ccgccgccacugucgccgucugccg

SEQ ID NO: 457199 - RNA, 19 nt, Human
ccgcugugcucucuggcug

SEQ ID NO: 457200 - RNA, 22 nt, Human
ccuccaguucuguucucugccu

SEQ ID NO: 457201 - RNA, 21 nt, Human
ccucccgucuucugcuuccuu

SEQ ID NO: 457202 - RNA, 20 nt, Human
cgaggcugcgggauuugaaa

SEQ ID NO: 457203 - RNA, 22 nt, Human
cgcagaaaaagcagcaagugac

SEQ ID NO: 457204 - RNA, 20 nt, Human
cgccgccgccacugucgccg

SEQ ID NO: 457205 - RNA, 24 nt, Human
cgggaaagcuugagcccagacacc

SEQ ID NO: 457206 - RNA, 23 nt, Human
cuagaacuacgugaacacaccau

SEQ ID NO: 457207 - RNA, 25 nt, Human
cuagaacuacgugaacacaccauac

SEQ ID NO: 457208 - RNA, 24 nt, Human
cucucccacucacucagcugggga

SEQ ID NO: 457209 - RNA, 22 nt, Human
cugaagauuuguggacaacuaa

SEQ ID NO: 457210 - RNA, 21 nt, Human
cugacaaggaggggucacaga

SEQ ID NO: 457211 - RNA, 19 nt, Human
cugcaagcccugccauggc

SEQ ID NO: 457212 - RNA, 19 nt, Human
gaaaggacaggcaugcuga

SEQ ID NO: 457213 - RNA, 19 nt, Human
gaaaggcaggaggaagggc

SEQ ID NO: 457214 - RNA, 25 nt, Human
gaacacacacaaccacaagaccacc

SEQ ID NO: 457215 - RNA, 23 nt, Human
gaagagggacugaggagucagua

SEQ ID NO: 457216 - RNA, 18 nt, Human
gacaguugagaaaggcag

SEQ ID NO: 457217 - RNA, 24 nt, Human
gacauguuucugucuagccugcug

SEQ ID NO: 457218 - RNA, 20 nt, Human
gaccuaaugggagccagcgg

SEQ ID NO: 457219 - RNA, 23 nt, Human
gaccuagauggggacagaacaca

SEQ ID NO: 457220 - RNA, 18 nt, Human
gagaaaggcaggaggaag

SEQ ID NO: 457221 - RNA, 19 nt, Human
gaucaccaaggcagcaggg

SEQ ID NO: 457222 - RNA, 21 nt, Human
gcccuccgcuuucuucaaccc

SEQ ID NO: 457223 - RNA, 19 nt, Human
gccgccgccacugucgccg

SEQ ID NO: 457224 - RNA, 22 nt, Human
gccuccaguucuguucucugcc

SEQ ID NO: 457225 - RNA, 22 nt, Human
gccuccaguucuguucucugcc

SEQ ID NO: 457226 - RNA, 20 nt, Human
gcgccgccgccacugucgcc

SEQ ID NO: 457227 - RNA, 19 nt, Human
gcuaaaccucaaaaucaga

SEQ ID NO: 457228 - RNA, 19 nt, Human
ggagccagcgggcgcaggc

SEQ ID NO: 457229 - RNA, 21 nt, Human
ggccaaaaaggcgccgucagg

SEQ ID NO: 457230 - RNA, 22 nt, Human
gggcaaaggaagugaggcuggg

SEQ ID NO: 457231 - RNA, 25 nt, Human
gggcagggccuucaccaaggcugcc

SEQ ID NO: 457232 - RNA, 21 nt, Human
gucacauuggggcagcugacc

SEQ ID NO: 457233 - RNA, 18 nt, Human
gugcucucuggcugucag

SEQ ID NO: 457234 - RNA, 20 nt, Human
uaaaacaucacaggccaaaa

SEQ ID NO: 457235 - RNA, 26 nt, Human
uaaauaaaaacuguagcggcaccuac

SEQ ID NO: 457236 - RNA, 18 nt, Human
uacuucaaugcugcagag

SEQ ID NO: 457237 - RNA, 21 nt, Human
uagaauagcaguccagacguu

SEQ ID NO: 457238 - RNA, 22 nt, Human
uaggacuuuacaauaaaagcac

SEQ ID NO: 457239 - RNA, 18 nt, Human
uaucaaggggaucaaggc

SEQ ID NO: 457240 - RNA, 21 nt, Human
ucaaacagcugugcaacgaac

SEQ ID NO: 457241 - RNA, 24 nt, Human
ucaaugccuccccucccgucuucu

SEQ ID NO: 457242 - RNA, 25 nt, Human
ucacaaagucuuccuggguauucuc

SEQ ID NO: 457243 - RNA, 24 nt, Human
ucaccaaggcugccgggcaccgcu

SEQ ID NO: 457244 - RNA, 24 nt, Human
ucagcaaucucuucaaauucgaga

SEQ ID NO: 457245 - RNA, 27 nt, Human
ucaggaaugugacacccgcgaggccga

SEQ ID NO: 457246 - RNA, 23 nt, Human
uccccaugcuaaauaaaaacugu

SEQ ID NO: 457247 - RNA, 24 nt, Human
uccccaugcuaaauaaaaacugua

SEQ ID NO: 457248 - RNA, 21 nt, Human
ucccuagauggacugccucca

SEQ ID NO: 457249 - RNA, 25 nt, Human
ucccuagauggacugccuccaguuc

SEQ ID NO: 457250 - RNA, 18 nt, Human
uccucacaguaaugaggc

SEQ ID NO: 457251 - RNA, 20 nt, Human
uccuuucuuaaaaaugaagu

SEQ ID NO: 457252 - RNA, 22 nt, Human
ucuaucaaggggaucaaggccg

SEQ ID NO: 457253 - RNA, 27 nt, Human
ucuccagcaggcaggggccaggagaaa

SEQ ID NO: 457254 - RNA, 19 nt, Human
ucuccaggagcugagccgc

SEQ ID NO: 457255 - RNA, 21 nt, Human
ucucuggcugucagcccggga

SEQ ID NO: 457256 - RNA, 22 nt, Human
ucugccgcagccugccuccacc

SEQ ID NO: 457257 - RNA, 23 nt, Human
ucugccgcagccugccuccaccu

SEQ ID NO: 457258 - RNA, 23 nt, Human
ugaccuaugucaaugccuccccu

SEQ ID NO: 457259 - RNA, 24 nt, Human
ugagaaaggcaggaggaagggcaa

SEQ ID NO: 457260 - RNA, 25 nt, Human
ugagaaaggcaggaggaagggcaaa

SEQ ID NO: 457261 - RNA, 21 nt, Human
ugaggcgagagggguggucau

SEQ ID NO: 457262 - RNA, 21 nt, Human
ugcaaaaaugagcccugucuu

SEQ ID NO: 457263 - RNA, 21 nt, Human
ugcaagcccugccauggcgcc

SEQ ID NO: 457264 - RNA, 24 nt, Human
ugcacgggagacacaaugaggccc

SEQ ID NO: 457265 - RNA, 18 nt, Human
ugccgggcaccgcugcag

SEQ ID NO: 457266 - RNA, 23 nt, Human
ugccuccaguucuguucucugcc

SEQ ID NO: 457267 - RNA, 25 nt, Human
ugccuccaguucuguucucugccug

SEQ ID NO: 457268 - RNA, 27 nt, Human
ugccuggcccaucucucuuuccccuca

SEQ ID NO: 457269 - RNA, 24 nt, Human
ugcuaaaccucaaaaucagaccac

SEQ ID NO: 457270 - RNA, 22 nt, Human
uguucucugccuggcccaucuc

SEQ ID NO: 457271 - RNA, 24 nt, Human
uuaugaccuaugucaaugccuccc

SEQ ID NO: 457272 - RNA, 25 nt, Human
uuccuggguauucuucauaacguac

SEQ ID NO: 457273 - RNA, 19 nt, Human
uucgauaaagcuucuuuaa

SEQ ID NO: 457274 - RNA, 29 nt, Human
uuuguacacacacacacacacagggcaca

SEQ ID NO: 457275 - RNA, 22 nt, Human
uuuuuuuuuuuuuuuuuuaaag

SEQ ID NO: 457276 - RNA, 23 nt, Human
aaaaaagagacucuuaaaaaaaa

SEQ ID NO: 457277 - RNA, 22 nt, Human
aaaauaacaaaucucacacugg

SEQ ID NO: 457278 - RNA, 18 nt, Human
aaacuaaaauagaaacac

SEQ ID NO: 457279 - RNA, 24 nt, Human
aaagugcugggauuacaggcguga

SEQ ID NO: 457280 - RNA, 20 nt, Human
aaccuccgccucccaggcuc

SEQ ID NO: 457281 - RNA, 27 nt, Human
aagcgauucucaugucucagucuccca

SEQ ID NO: 457282 - RNA, 19 nt, Human
aaguagcugggauuacagg

SEQ ID NO: 457283 - RNA, 24 nt, Human
aaguagcugggauuacaggugugc

SEQ ID NO: 457284 - RNA, 24 nt, Human
aagugauccgcuggccuuggccuc

SEQ ID NO: 457285 - RNA, 19 nt, Human
aagugcugggauuacaggc

SEQ ID NO: 457286 - RNA, 19 nt, Human
aagugcugggauuacaggc

SEQ ID NO: 457287 - RNA, 26 nt, Human
aagugcugggauuacaggcgugagcc

SEQ ID NO: 457288 - RNA, 21 nt, Human
aaugguacgaucucggcucac

SEQ ID NO: 457289 - RNA, 22 nt, Human
acaaaucucacacugggaaacc

SEQ ID NO: 457290 - RNA, 22 nt, Human
acaaucauuuuuaaaaagaagc

SEQ ID NO: 457291 - RNA, 22 nt, Human
acacacacacacauauauauau

SEQ ID NO: 457292 - RNA, 24 nt, Human
acacuagauuuaaauucugauuug

SEQ ID NO: 457293 - RNA, 24 nt, Human
acaggguuucuccauguuggucag

SEQ ID NO: 457294 - RNA, 22 nt, Human
acuagauuuaaauucugauuug

SEQ ID NO: 457295 - RNA, 18 nt, Human
agacaggguuucuccaug

SEQ ID NO: 457296 - RNA, 23 nt, Human
aggcgugagccaccgugccuggc

SEQ ID NO: 457297 - RNA, 25 nt, Human
aggcuggagugcagugguacgaucu

SEQ ID NO: 457298 - RNA, 21 nt, Human
aguagcugggauuacaggcau

SEQ ID NO: 457299 - RNA, 24 nt, Human
agugauucuccugccucagccucc

SEQ ID NO: 457300 - RNA, 24 nt, Human
agugcaaugguacgaucucggcuc

SEQ ID NO: 457301 - RNA, 20 nt, Human
agugcagugguacgaucuug

SEQ ID NO: 457302 - RNA, 23 nt, Human
agugcagugguacgaucuuggcu

SEQ ID NO: 457303 - RNA, 24 nt, Human
agugcagugguacgaucuuggcuc

SEQ ID NO: 457304 - RNA, 18 nt, Human
agugcugggauuacaggc

SEQ ID NO: 457305 - RNA, 24 nt, Human
agugguacgaucuuggcucauugc

SEQ ID NO: 457306 - RNA, 22 nt, Human
aguugagacaggguuucuccau

SEQ ID NO: 457307 - RNA, 19 nt, Human
auauaaccauauccauaua

SEQ ID NO: 457308 - RNA, 19 nt, Human
auauauauauauauauaua

SEQ ID NO: 457309 - RNA, 32 nt, Human
auauauauauauauaucccacauauauauggc

SEQ ID NO: 457310 - RNA, 20 nt, Human
auauauauauauaucccaca

SEQ ID NO: 457311 - RNA, 22 nt, Human
auauccauauauauauauauau

SEQ ID NO: 457312 - RNA, 18 nt, Human
auguauauguaugugugu

SEQ ID NO: 457313 - RNA, 21 nt, Human
auguauguguguguguauaua

SEQ ID NO: 457314 - RNA, 22 nt, Human
augucucagucucccaaguagc

SEQ ID NO: 457315 - RNA, 23 nt, Human
augucucagucucccaaguagcu

SEQ ID NO: 457316 - RNA, 24 nt, Human
augucucagucucccaaguagcug

SEQ ID NO: 457317 - RNA, 18 nt, Human
auguguauauauguauac

SEQ ID NO: 457318 - RNA, 18 nt, Human
auucuccugccucagccu

SEQ ID NO: 457319 - RNA, 24 nt, Human
auuuuuuuuuuuugaaauggaguu

SEQ ID NO: 457320 - RNA, 24 nt, Human
caaagugcugggauuacaggcgug

SEQ ID NO: 457321 - RNA, 23 nt, Human
caaccuccgccucccaggcucaa

SEQ ID NO: 457322 - RNA, 20 nt, Human
caagugauucuccugccuca

SEQ ID NO: 457323 - RNA, 22 nt, Human
caagugauucuccugccucagc

SEQ ID NO: 457324 - RNA, 20 nt, Human
cacacacacacacacacaua

SEQ ID NO: 457325 - RNA, 22 nt, Human
cacacacacacacacacauaua

SEQ ID NO: 457326 - RNA, 26 nt, Human
cacacacacacacacacauauauaua

SEQ ID NO: 457327 - RNA, 19 nt, Human
cacacacacacacacauau

SEQ ID NO: 457328 - RNA, 25 nt, Human
cacacacacacacacauauauauau

SEQ ID NO: 457329 - RNA, 18 nt, Human
cacacacacauauauaua

SEQ ID NO: 457330 - RNA, 20 nt, Human
cacacacauauauauauaua

SEQ ID NO: 457331 - RNA, 24 nt, Human
cacacacauauauauauauauaca

SEQ ID NO: 457332 - RNA, 21 nt, Human
cacugcaaccgccgccucccg

SEQ ID NO: 457333 - RNA, 23 nt, Human
cacugcaaccgccgccucccggg

SEQ ID NO: 457334 - RNA, 24 nt, Human
caggguuucuccauguuggucagg

SEQ ID NO: 457335 - RNA, 19 nt, Human
cagugguacgaucuuggcu

SEQ ID NO: 457336 - RNA, 24 nt, Human
cagugucuugcucugucgcccagg

SEQ ID NO: 457337 - RNA, 18 nt, Human
cauauauauauauauaca

SEQ ID NO: 457338 - RNA, 20 nt, Human
cauauauauauauauauaua

SEQ ID NO: 457339 - RNA, 20 nt, Human
cauauccauauauauauaua

SEQ ID NO: 457340 - RNA, 22 nt, Human
cauauccauauauauauauaua

SEQ ID NO: 457341 - RNA, 26 nt, Human
caucccauauauauaaccauauccau

SEQ ID NO: 457342 - RNA, 21 nt, Human
cauugcaaccuccgccuccca

SEQ ID NO: 457343 - RNA, 22 nt, Human
ccaaagugcugggauuacaggc

SEQ ID NO: 457344 - RNA, 22 nt, Human
ccaaagugcugggauuacaggc

SEQ ID NO: 457345 - RNA, 24 nt, Human
ccaaagugcugggauuacaggcgu

SEQ ID NO: 457346 - RNA, 19 nt, Human
ccaaccaaaccaucccaua

SEQ ID NO: 457347 - RNA, 21 nt, Human
ccaaguagcugggauuacagg

SEQ ID NO: 457348 - RNA, 24 nt, Human
ccaaguagcugggauuacaggugu

SEQ ID NO: 457349 - RNA, 20 nt, Human
ccaccacgccuggcuaauuu

SEQ ID NO: 457350 - RNA, 19 nt, Human
ccauguuggucaggcuggu

SEQ ID NO: 457351 - RNA, 22 nt, Human
cccaaguagcugggauuacagg

SEQ ID NO: 457352 - RNA, 23 nt, Human
cccaaguagcugggauuacaggu

SEQ ID NO: 457353 - RNA, 24 nt, Human
cccaaguagcugggauuacaggug

SEQ ID NO: 457354 - RNA, 18 nt, Human
cccacauauauaugggau

SEQ ID NO: 457355 - RNA, 20 nt, Human
cccaggcucaagcgauucuc

SEQ ID NO: 457356 - RNA, 18 nt, Human
cccaggcuggagugcaau

SEQ ID NO: 457357 - RNA, 23 nt, Human
cccgaguagcugggauuacaggc

SEQ ID NO: 457358 - RNA, 24 nt, Human
cccgaguagcugggauuacaggca

SEQ ID NO: 457359 - RNA, 23 nt, Human
cccggguucaagugauucuccuc

SEQ ID NO: 457360 - RNA, 23 nt, Human
cccggguucaagugauucuccug

SEQ ID NO: 457361 - RNA, 23 nt, Human
ccgaguagcugggauuacaggca

SEQ ID NO: 457362 - RNA, 24 nt, Human
ccgaguagcugggauuacaggcau

SEQ ID NO: 457363 - RNA, 24 nt, Human
ccgccucccaggcucaagcgauuc

SEQ ID NO: 457364 - RNA, 24 nt, Human
ccgccucccggguucaagugauuc

SEQ ID NO: 457365 - RNA, 24 nt, Human
ccucccggguucaagugauucucc

SEQ ID NO: 457366 - RNA, 18 nt, Human
ccugaccucaagugaucc

SEQ ID NO: 457367 - RNA, 22 nt, Human
ccugaccucaagugauccgcug

SEQ ID NO: 457368 - RNA, 25 nt, Human
ccugaccucaagugauccgcuggcc

SEQ ID NO: 457369 - RNA, 23 nt, Human
ccugccucagccucccgaguagc

SEQ ID NO: 457370 - RNA, 24 nt, Human
cucacugcaaccgccgccucccgg

SEQ ID NO: 457371 - RNA, 24 nt, Human
cucagccucccgaguagcugggau

SEQ ID NO: 457372 - RNA, 22 nt, Human
cucagucucccaaguagcuggg

SEQ ID NO: 457373 - RNA, 24 nt, Human
cucagucucccaaguagcugggau

SEQ ID NO: 457374 - RNA, 19 nt, Human
cucauugcaaccuccgccu

SEQ ID NO: 457375 - RNA, 24 nt, Human
cuccauguuggucaggcuggucuc

SEQ ID NO: 457376 - RNA, 20 nt, Human
cucccggguucaagugauuc

SEQ ID NO: 457377 - RNA, 23 nt, Human
cucugucgcccaggcuggagugc

SEQ ID NO: 457378 - RNA, 22 nt, Human
cucuuguugcccaggcuggagu

SEQ ID NO: 457379 - RNA, 22 nt, Human
cugaucaaaauaacaaaucuca

SEQ ID NO: 457380 - RNA, 18 nt, Human
cugcaaccgccgccuccc

SEQ ID NO: 457381 - RNA, 23 nt, Human
cugcaaccgccgccucccggguu

SEQ ID NO: 457382 - RNA, 23 nt, Human
cugccucagccucccgaguagcu

SEQ ID NO: 457383 - RNA, 24 nt, Human
cuuguugcccaggcuggagugcaa

SEQ ID NO: 457384 - RNA, 24 nt, Human
gaccucaagugauccgcuggccuu

SEQ ID NO: 457385 - RNA, 20 nt, Human
gagacaggguuucuccaugu

SEQ ID NO: 457386 - RNA, 21 nt, Human
gagacaggguuucuccauguu

SEQ ID NO: 457387 - RNA, 24 nt, Human
gaguagcugggauuacaggcaugc

SEQ ID NO: 457388 - RNA, 25 nt, Human
gagucugucaccaauuuuuuuuuuu

SEQ ID NO: 457389 - RNA, 18 nt, Human
gauuacaggcaugcgcca

SEQ ID NO: 457390 - RNA, 18 nt, Human
gauuacaggcgugagcca

SEQ ID NO: 457391 - RNA, 21 nt, Human
gauuacaggcgugagccaccg

SEQ ID NO: 457392 - RNA, 24 nt, Human
gauuacaggcgugagccaccgugc

SEQ ID NO: 457393 - RNA, 21 nt, Human
gauucucaugucucagucucc

SEQ ID NO: 457394 - RNA, 19 nt, Human
gcccaggcuggagugcagu

SEQ ID NO: 457395 - RNA, 20 nt, Human
gcccaggcuggagugcagug

SEQ ID NO: 457396 - RNA, 22 nt, Human
gccuuggccucccaaagugcug

SEQ ID NO: 457397 - RNA, 24 nt, Human
gcucuuguugcccaggcuggagug

SEQ ID NO: 457398 - RNA, 23 nt, Human
gcuggucucgaacuccugaccuc

SEQ ID NO: 457399 - RNA, 21 nt, Human
ggagagagagagagagacagu

SEQ ID NO: 457400 - RNA, 19 nt, Human
ggauuacaggcaugcgcca

SEQ ID NO: 457401 - RNA, 24 nt, Human
ggcuggucucgaacuccugaccuc

SEQ ID NO: 457402 - RNA, 22 nt, Human
ggguucaagugauucuccugcc

SEQ ID NO: 457403 - RNA, 23 nt, Human
ggguucaagugauucuccugccu

SEQ ID NO: 457404 - RNA, 19 nt, Human
ggucucgaacuccugaccu

SEQ ID NO: 457405 - RNA, 18 nt, Human
guagcugggauuacaggc

SEQ ID NO: 457406 - RNA, 20 nt, Human
guagcugggauuacaggcau

SEQ ID NO: 457407 - RNA, 22 nt, Human
guauauauauacacauguauau

SEQ ID NO: 457408 - RNA, 24 nt, Human
gugauucuccugccucagccuccc

SEQ ID NO: 457409 - RNA, 18 nt, Human
guuuuuuuaaaaaagaga

SEQ ID NO: 457410 - RNA, 24 nt, Human
uaaaaaagagacucuuaaaaaaaa

SEQ ID NO: 457411 - RNA, 20 nt, Human
uacacacacacacacacaca

SEQ ID NO: 457412 - RNA, 26 nt, Human
uacacacacacacacacacauauaua

SEQ ID NO: 457413 - RNA, 22 nt, Human
uacacacacacacauauauaua

SEQ ID NO: 457414 - RNA, 22 nt, Human
uacaggcaugcgccaccacgcc

SEQ ID NO: 457415 - RNA, 22 nt, Human
uacaggcgugagccaccgugcc

SEQ ID NO: 457416 - RNA, 23 nt, Human
uacaggcgugagccaccgugccu

SEQ ID NO: 457417 - RNA, 23 nt, Human
uacuuuauaaaugagauuucauu

SEQ ID NO: 457418 - RNA, 24 nt, Human
uaguugagacaggguuucuccaug

SEQ ID NO: 457419 - RNA, 26 nt, Human
uauacacacacacacacacacauaua

SEQ ID NO: 457420 - RNA, 24 nt, Human
uauacacacacacacauauauaua

SEQ ID NO: 457421 - RNA, 25 nt, Human
uauacacacacacacauauauauau

SEQ ID NO: 457422 - RNA, 19 nt, Human
uauacacauguauauguau

SEQ ID NO: 457423 - RNA, 24 nt, Human
uauacacauguauauguaugugug

SEQ ID NO: 457424 - RNA, 25 nt, Human
uauauacacacacacacauauauag

SEQ ID NO: 457425 - RNA, 23 nt, Human
uauauacacauguauauguaugu

SEQ ID NO: 457426 - RNA, 18 nt, Human
uauauauacacauguaua

SEQ ID NO: 457427 - RNA, 19 nt, Human
uauauauacacauguauau

SEQ ID NO: 457428 - RNA, 24 nt, Human
uauauauacacauguauauguaug

SEQ ID NO: 457429 - RNA, 27 nt, Human
uauauauacacauguauauguaugugu

SEQ ID NO: 457430 - RNA, 24 nt, Human
uauauauauacacauguauaugua

SEQ ID NO: 457431 - RNA, 19 nt, Human
uauauauauauauauauau

SEQ ID NO: 457432 - RNA, 23 nt, Human
uauauauauauauauaucccaca

SEQ ID NO: 457433 - RNA, 25 nt, Human
uauauauauaucccacauauauaug

SEQ ID NO: 457434 - RNA, 24 nt, Human
uauaugggaugguauauauauaca

SEQ ID NO: 457435 - RNA, 26 nt, Human
uauaugggaugguauauauauacaca

SEQ ID NO: 457436 - RNA, 20 nt, Human
uauauguaugugugugugua

SEQ ID NO: 457437 - RNA, 25 nt, Human
uauauguauguguguguguauauaa

SEQ ID NO: 457438 - RNA, 18 nt, Human
uauauguguauauaugua

SEQ ID NO: 457439 - RNA, 19 nt, Human
uauauguguauauauguau

SEQ ID NO: 457440 - RNA, 21 nt, Human
uaucccacauauauaugggau

SEQ ID NO: 457441 - RNA, 20 nt, Human
uauguauguguguguguaua

SEQ ID NO: 457442 - RNA, 18 nt, Human
uauguguauauauguaua

SEQ ID NO: 457443 - RNA, 20 nt, Human
uauguguauauauguauaau

SEQ ID NO: 457444 - RNA, 24 nt, Human
uauguguguguguauauaugugua

SEQ ID NO: 457445 - RNA, 19 nt, Human
ucaagugauucuccugccu

SEQ ID NO: 457446 - RNA, 18 nt, Human
ucacugcaaccgccgccu

SEQ ID NO: 457447 - RNA, 24 nt, Human
ucacugcaaccgccgccucccggg

SEQ ID NO: 457448 - RNA, 20 nt, Human
ucagccucccgaguagcugg

SEQ ID NO: 457449 - RNA, 23 nt, Human
ucaggaagcuaaacuaaaauaga

SEQ ID NO: 457450 - RNA, 19 nt, Human
ucauugcaaccuccgccuc

SEQ ID NO: 457451 - RNA, 24 nt, Human
ucauugcaaccuccgccucccagg

SEQ ID NO: 457452 - RNA, 25 nt, Human
ucauugcaaccuccgccucccaggc

SEQ ID NO: 457453 - RNA, 19 nt, Human
uccauauauauauauauau

SEQ ID NO: 457454 - RNA, 24 nt, Human
uccauguuggucaggcuggucucg

SEQ ID NO: 457455 - RNA, 24 nt, Human
ucccaaagugcugggauuacaggc

SEQ ID NO: 457456 - RNA, 23 nt, Human
ucccaaguagcugggauuacagg

SEQ ID NO: 457457 - RNA, 24 nt, Human
ucccaaguagcugggauuacaggu

SEQ ID NO: 457458 - RNA, 21 nt, Human
ucccaggcucaagcgauucuc

SEQ ID NO: 457459 - RNA, 24 nt, Human
ucccaggcucaagcgauucucaug

SEQ ID NO: 457460 - RNA, 24 nt, Human
ucccgaguagcugggauuacaggc

SEQ ID NO: 457461 - RNA, 21 nt, Human
ucccggguucaagugauucuc

SEQ ID NO: 457462 - RNA, 24 nt, Human
ucccggguucaagugauucuccug

SEQ ID NO: 457463 - RNA, 22 nt, Human
ucgcccaggcuggagugcagug

SEQ ID NO: 457464 - RNA, 22 nt, Human
ucgcucuuguugcccaggcugg

SEQ ID NO: 457465 - RNA, 23 nt, Human
ucgcucuuguugcccaggcugga

SEQ ID NO: 457466 - RNA, 24 nt, Human
ucuccugccucagccucccgagua

SEQ ID NO: 457467 - RNA, 21 nt, Human
ucucgaacuccugaccucaag

SEQ ID NO: 457468 - RNA, 19 nt, Human
ucucggcucacugcaaccg

SEQ ID NO: 457469 - RNA, 21 nt, Human
ucugaucaaaauaacaaaucu

SEQ ID NO: 457470 - RNA, 24 nt, Human
ucugucgcccaggcuggagugcag

SEQ ID NO: 457471 - RNA, 18 nt, Human
ucuuacagucaucuuuau

SEQ ID NO: 457472 - RNA, 23 nt, Human
ucuugcucugucgcccaggcugg

SEQ ID NO: 457473 - RNA, 24 nt, Human
ucuugcucugucgcccaggcugga

SEQ ID NO: 457474 - RNA, 22 nt, Human
ucuuguugcccaggcuggagug

SEQ ID NO: 457475 - RNA, 18 nt, Human
ugaccucaagugauccgc

SEQ ID NO: 457476 - RNA, 19 nt, Human
ugaccucaagugauccgcu

SEQ ID NO: 457477 - RNA, 22 nt, Human
ugagacaggguuucuccauguu

SEQ ID NO: 457478 - RNA, 22 nt, Human
ugcaaccgccgccucccggguu

SEQ ID NO: 457479 - RNA, 18 nt, Human
ugcccaggcuggagugca

SEQ ID NO: 457480 - RNA, 21 nt, Human
ugcccaggcuggagugcaaug

SEQ ID NO: 457481 - RNA, 21 nt, Human
ugcccaggcuggagugcaaug

SEQ ID NO: 457482 - RNA, 24 nt, Human
ugccucagccucccgaguagcugg

SEQ ID NO: 457483 - RNA, 24 nt, Human
ugcucugucgcccaggcuggagug

SEQ ID NO: 457484 - RNA, 24 nt, Human
ugcugggauuacaggcgugagcca

SEQ ID NO: 457485 - RNA, 23 nt, Human
uggagugcaaugguacgaucucg

SEQ ID NO: 457486 - RNA, 24 nt, Human
uggagugcaaugguacgaucucgg

SEQ ID NO: 457487 - RNA, 23 nt, Human
uggagugcagugguacgaucuug

SEQ ID NO: 457488 - RNA, 24 nt, Human
uggagugcagugguacgaucuugg

SEQ ID NO: 457489 - RNA, 21 nt, Human
ugggaccaaccaaaccauccc

SEQ ID NO: 457490 - RNA, 18 nt, Human
ugggauuacaggcaugcg

SEQ ID NO: 457491 - RNA, 21 nt, Human
ugggauuacaggcaugcgcca

SEQ ID NO: 457492 - RNA, 22 nt, Human
ugggauuacaggcaugcgccac

SEQ ID NO: 457493 - RNA, 24 nt, Human
ugggauuacaggcaugcgccacca

SEQ ID NO: 457494 - RNA, 18 nt, Human
ugggauuacaggcgugag

SEQ ID NO: 457495 - RNA, 21 nt, Human
ugggauuacaggcgugagcca

SEQ ID NO: 457496 - RNA, 22 nt, Human
ugggauuacaggcgugagccac

SEQ ID NO: 457497 - RNA, 23 nt, Human
ugggauuacaggcgugagccacc

SEQ ID NO: 457498 - RNA, 23 nt, Human
ugggauuacaggcgugagccacc

SEQ ID NO: 457499 - RNA, 24 nt, Human
ugggauuacaggcgugagccaccg

SEQ ID NO: 457500 - RNA, 21 nt, Human
ugggauuacaggugugcacca

SEQ ID NO: 457501 - RNA, 22 nt, Human
ugggauuacaggugugcaccac

SEQ ID NO: 457502 - RNA, 24 nt, Human
ugggauuacaggugugcaccacca

SEQ ID NO: 457503 - RNA, 23 nt, Human
ugguauauauauacacauguaua

SEQ ID NO: 457504 - RNA, 27 nt, Human
ugguauauauauacacauguauaugua

SEQ ID NO: 457505 - RNA, 24 nt, Human
uggucaggcuggucucgaacuccu

SEQ ID NO: 457506 - RNA, 24 nt, Human
uguauacacacacacacacacaca

SEQ ID NO: 457507 - RNA, 25 nt, Human
uguauacacacacacacacacacag

SEQ ID NO: 457508 - RNA, 19 nt, Human
uguauauauguguauauau

SEQ ID NO: 457509 - RNA, 23 nt, Human
uguauauauguguauauauguau

SEQ ID NO: 457510 - RNA, 24 nt, Human
ugugcaccaccacaccaggcuaac

SEQ ID NO: 457511 - RNA, 18 nt, Human
uguguauauauguguaua

SEQ ID NO: 457512 - RNA, 18 nt, Human
uguguauauauguguaua

SEQ ID NO: 457513 - RNA, 20 nt, Human
uguguauauauguguauaua

SEQ ID NO: 457514 - RNA, 20 nt, Human
uguguauauauguguauaua

SEQ ID NO: 457515 - RNA, 21 nt, Human
uguguauauauguguauauau

SEQ ID NO: 457516 - RNA, 24 nt, Human
uguguauauauguguauauaugua

SEQ ID NO: 457517 - RNA, 19 nt, Human
uguguguauauauguguau

SEQ ID NO: 457518 - RNA, 24 nt, Human
uguguguguauauauguguauaua

SEQ ID NO: 457519 - RNA, 20 nt, Human
uguguguguguauauaugug

SEQ ID NO: 457520 - RNA, 25 nt, Human
uguguguguguauauauguguauca

SEQ ID NO: 457521 - RNA, 20 nt, Human
uguugcccaggcuggagugc

SEQ ID NO: 457522 - RNA, 21 nt, Human
uucaagugauucuccugccuc

SEQ ID NO: 457523 - RNA, 23 nt, Human
uucaagugauucuccugccucag

SEQ ID NO: 457524 - RNA, 24 nt, Human
uucaagugauucuccugccucagc

SEQ ID NO: 457525 - RNA, 24 nt, Human
uucgcucuuguugcccaggcugga

SEQ ID NO: 457526 - RNA, 18 nt, Human
uucugauuugaauacucu

SEQ ID NO: 457527 - RNA, 23 nt, Human
uugcaaccuccgccucccaggcu

SEQ ID NO: 457528 - RNA, 24 nt, Human
uugcaaccuccgccucccaggcuc

SEQ ID NO: 457529 - RNA, 18 nt, Human
uugcccaggcuggagugc

SEQ ID NO: 457530 - RNA, 24 nt, Human
uugcucugucgcccaggcuggagu

SEQ ID NO: 457531 - RNA, 18 nt, Human
uuggccucccaaagugcu

SEQ ID NO: 457532 - RNA, 27 nt, Human
uuuaucuucuugggacaacauucuuuu

SEQ ID NO: 457533 - RNA, 23 nt, Human
uuucgcucuuguugcccaggcug

SEQ ID NO: 457534 - RNA, 24 nt, Human
uuucgcucuuguugcccaggcugg

SEQ ID NO: 457535 - RNA, 21 nt, Human
uuucuccauguuggucaggcu

SEQ ID NO: 457536 - RNA, 24 nt, Human
uuuuuuuuuuugaaauggaguuuc

SEQ ID NO: 457537 - RNA, 23 nt, Human
aaaauaaggucaacaaaccacca

SEQ ID NO: 457538 - RNA, 20 nt, Human
aacaaaugcccuccaaaaga

SEQ ID NO: 457539 - RNA, 20 nt, Human
aacaaaugcccuccaaaaga

SEQ ID NO: 457540 - RNA, 21 nt, Human
aacagaaucgauccacaccaa

SEQ ID NO: 457541 - RNA, 18 nt, Human
aagaggaguuuugagccu

SEQ ID NO: 457542 - RNA, 18 nt, Human
aagaggaguuuugagccu

SEQ ID NO: 457543 - RNA, 23 nt, Human
aagccaauuaaacugaagcacag

SEQ ID NO: 457544 - RNA, 24 nt, Human
aaguccuccaagcgucaacagcuu

SEQ ID NO: 457545 - RNA, 23 nt, Human
aaguuccugggaugcaguugcau

SEQ ID NO: 457546 - RNA, 18 nt, Human
acaaaccaccaaauccca

SEQ ID NO: 457547 - RNA, 22 nt, Human
acaacaagauucugggggcaaa

SEQ ID NO: 457548 - RNA, 20 nt, Human
accacaaccccaggccagca

SEQ ID NO: 457549 - RNA, 18 nt, Human
accaccaaaucccaaguc

SEQ ID NO: 457550 - RNA, 20 nt, Human
acccggccucaaccacaacc

SEQ ID NO: 457551 - RNA, 19 nt, Human
agccaccaaaaugaaccuu

SEQ ID NO: 457552 - RNA, 20 nt, Human
aggucaaacggacagccacc

SEQ ID NO: 457553 - RNA, 18 nt, Human
aggucaacaaaccaccaa

SEQ ID NO: 457554 - RNA, 21 nt, Human
aggucugauaucaaagaggag

SEQ ID NO: 457555 - RNA, 22 nt, Human
auggcagcucuuuuuaguaaac

SEQ ID NO: 457556 - RNA, 18 nt, Human
auuaaacugaagcacagc

SEQ ID NO: 457557 - RNA, 23 nt, Human
caaaauaaggucaacaaaccacc

SEQ ID NO: 457558 - RNA, 22 nt, Human
caaaccaccaaaucccaagucc

SEQ ID NO: 457559 - RNA, 23 nt, Human
caacaaaccaccaaaucccaagu

SEQ ID NO: 457560 - RNA, 21 nt, Human
caagaggaacauggauccaaa

SEQ ID NO: 457561 - RNA, 21 nt, Human
caagaggaacauggauccaaa

SEQ ID NO: 457562 - RNA, 21 nt, Human
caagccaauuaaacugaagca

SEQ ID NO: 457563 - RNA, 28 nt, Human
caaguugguaaaauuuauucuacauuua

SEQ ID NO: 457564 - RNA, 28 nt, Human
caaguugguaaaauuuauucuacauuua

SEQ ID NO: 457565 - RNA, 22 nt, Human
caccaaaucccaaguccuccaa

SEQ ID NO: 457566 - RNA, 18 nt, Human
caccaguaagaucaugau

SEQ ID NO: 457567 - RNA, 19 nt, Human
cagaaucgauccacaccaa

SEQ ID NO: 457568 - RNA, 22 nt, Human
cagaaucgauccacaccaaaac

SEQ ID NO: 457569 - RNA, 25 nt, Human
cagcuucagaucuccuugcaugaag

SEQ ID NO: 457570 - RNA, 25 nt, Human
cagcuucagaucuccuugcaugaag

SEQ ID NO: 457571 - RNA, 18 nt, Human
caggaagaaggaguagag

SEQ ID NO: 457572 - RNA, 19 nt, Human
cagugugucccaaacagaa

SEQ ID NO: 457573 - RNA, 23 nt, Human
cauggcacuggacugaagugugu

SEQ ID NO: 457574 - RNA, 21 nt, Human
cauuucuauuucugcugaaga

SEQ ID NO: 457575 - RNA, 21 nt, Human
cauuucuauuucugcugaaga

SEQ ID NO: 457576 - RNA, 18 nt, Human
ccaaaacaucccaggaag

SEQ ID NO: 457577 - RNA, 19 nt, Human
ccaaaacaucccaggaaga

SEQ ID NO: 457578 - RNA, 21 nt, Human
ccaaacaaaugcccuccaaaa

SEQ ID NO: 457579 - RNA, 21 nt, Human
ccaaacaaaugcccuccaaaa

SEQ ID NO: 457580 - RNA, 23 nt, Human
cccggccucaaccacaaccccag

SEQ ID NO: 457581 - RNA, 28 nt, Human
cccggccucaaccacaaccccaggccag

SEQ ID NO: 457582 - RNA, 22 nt, Human
ccgucugcaagguaaaaucugg

SEQ ID NO: 457583 - RNA, 22 nt, Human
ccgucugcaagguaaaaucugg

SEQ ID NO: 457584 - RNA, 23 nt, Human
ccuaggacuggcacacucaauuc

SEQ ID NO: 457585 - RNA, 23 nt, Human
cgggcacaggagcggagacccgg

SEQ ID NO: 457586 - RNA, 23 nt, Human
cgggcacaggagcggagacccgg

SEQ ID NO: 457587 - RNA, 24 nt, Human
cucaaccacaaccccaggccagca

SEQ ID NO: 457588 - RNA, 23 nt, Human
cugaagauauagcaauguacaga

SEQ ID NO: 457589 - RNA, 23 nt, Human
cugaagauauagcaauguacaga

SEQ ID NO: 457590 - RNA, 20 nt, Human
cugaagauuuucauuguuca

SEQ ID NO: 457591 - RNA, 20 nt, Human
cugaagauuuucauuguuca

SEQ ID NO: 457592 - RNA, 28 nt, Human
cugaccgccgaacuugagaagguuuucc

SEQ ID NO: 457593 - RNA, 20 nt, Human
cuuaaccaaacaaaugcccu

SEQ ID NO: 457594 - RNA, 20 nt, Human
cuucaguaggcaaacaacaa

SEQ ID NO: 457595 - RNA, 24 nt, Human
cuucccgggcacaggagcggagac

SEQ ID NO: 457596 - RNA, 24 nt, Human
cuucccgggcacaggagcggagac

SEQ ID NO: 457597 - RNA, 19 nt, Human
cuuguaaacucgccacuau

SEQ ID NO: 457598 - RNA, 19 nt, Human
cuuguaaacucgccacuau

SEQ ID NO: 457599 - RNA, 19 nt, Human
gaacaaauuugauucccca

SEQ ID NO: 457600 - RNA, 19 nt, Human
gaacaaauuugauucccca

SEQ ID NO: 457601 - RNA, 22 nt, Human
gaagacggagcuuucacccgcc

SEQ ID NO: 457602 - RNA, 22 nt, Human
gaagacggagcuuucacccgcc

SEQ ID NO: 457603 - RNA, 20 nt, Human
gacagccaccaaaaugaacc

SEQ ID NO: 457604 - RNA, 21 nt, Human
gacccggccucaaccacaacc

SEQ ID NO: 457605 - RNA, 21 nt, Human
gacccggccucaaccacaacc

SEQ ID NO: 457606 - RNA, 19 nt, Human
gaucaugaucaucaucaua

SEQ ID NO: 457607 - RNA, 20 nt, Human
gcauggcacuggacugaagu

SEQ ID NO: 457608 - RNA, 19 nt, Human
gggcaaaagacauuucuuc

SEQ ID NO: 457609 - RNA, 18 nt, Human
gugugucccaaacagaau

SEQ ID NO: 457610 - RNA, 20 nt, Human
uaaacucgccacuauccuuu

SEQ ID NO: 457611 - RNA, 20 nt, Human
uaaacucgccacuauccuuu

SEQ ID NO: 457612 - RNA, 18 nt, Human
uaaccaaacaaaugcccu

SEQ ID NO: 457613 - RNA, 22 nt, Human
uaaccaaacaaaugcccuccaa

SEQ ID NO: 457614 - RNA, 22 nt, Human
uaaccaaacaaaugcccuccaa

SEQ ID NO: 457615 - RNA, 24 nt, Human
uaaccaaacaaaugcccuccaaaa

SEQ ID NO: 457616 - RNA, 24 nt, Human
uaaccaaacaaaugcccuccaaaa

SEQ ID NO: 457617 - RNA, 24 nt, Human
uaaggucaacaaaccaccaaaucc

SEQ ID NO: 457618 - RNA, 22 nt, Human
uagaaagguccuaggacuggca

SEQ ID NO: 457619 - RNA, 19 nt, Human
ucaaaacgggcaaaagaca

SEQ ID NO: 457620 - RNA, 19 nt, Human
ucaacaaaccaccaaaucc

SEQ ID NO: 457621 - RNA, 20 nt, Human
ucaacaaaccaccaaauccc

SEQ ID NO: 457622 - RNA, 20 nt, Human
uccaaaagaaggaaaauaac

SEQ ID NO: 457623 - RNA, 20 nt, Human
uccaaaagaaggaaaauaac

SEQ ID NO: 457624 - RNA, 21 nt, Human
uccaaagaagccuucuuaacc

SEQ ID NO: 457625 - RNA, 21 nt, Human
uccaaagaagccuucuuaacc

SEQ ID NO: 457626 - RNA, 23 nt, Human
uccacaccaaaacaucccaggaa

SEQ ID NO: 457627 - RNA, 21 nt, Human
uccccacaacacuuuuugcuu

SEQ ID NO: 457628 - RNA, 21 nt, Human
uccccacaacacuuuuugcuu

SEQ ID NO: 457629 - RNA, 21 nt, Human
ucccugggccaugauggcagc

SEQ ID NO: 457630 - RNA, 21 nt, Human
ucccugggccaugauggcagc

SEQ ID NO: 457631 - RNA, 23 nt, Human
uccuguuucuauaaggauucuac

SEQ ID NO: 457632 - RNA, 19 nt, Human
uguuuugugcaugaggaaa

SEQ ID NO: 457633 - RNA, 19 nt, Human
uguuuugugcaugaggaaa

SEQ ID NO: 457634 - RNA, 22 nt, Human
uucagaagacggagcuuucacc

SEQ ID NO: 457635 - RNA, 22 nt, Human
uucagaagacggagcuuucacc

SEQ ID NO: 457636 - RNA, 21 nt, Human
uucauuguucagcuucagauc

SEQ ID NO: 457637 - RNA, 22 nt, Human
uuccaaaguccaaagaagccuu

SEQ ID NO: 457638 - RNA, 22 nt, Human
uuccaaaguccaaagaagccuu

SEQ ID NO: 457639 - RNA, 18 nt, Human
uuccaagccaauuaaacc

SEQ ID NO: 457640 - RNA, 22 nt, Human
uucucaguccucuuugcauuuc

SEQ ID NO: 457641 - RNA, 23 nt, Human
uuugugcaugaggaaaggaacaa

SEQ ID NO: 457642 - RNA, 23 nt, Human
uuugugcaugaggaaaggaacaa

SEQ ID NO: 457643 - RNA, 24 nt, Human
uuuuuuuuuuuuuuuuuuuccaag

SEQ ID NO: 457644 - RNA, 20 nt, Human
aaacaaauuccagauuagca

SEQ ID NO: 457645 - RNA, 22 nt, Human
aaacaaauuccagauuagcaac

SEQ ID NO: 457646 - RNA, 23 nt, Human
aaacaaauuccagauuagcauag

SEQ ID NO: 457647 - RNA, 22 nt, Human
aagaaaauuuaaaccauaacua

SEQ ID NO: 457648 - RNA, 18 nt, Human
aaggcaaacaaaguacag

SEQ ID NO: 457649 - RNA, 23 nt, Human
acaccacaucaacuccuacggac

SEQ ID NO: 457650 - RNA, 24 nt, Human
acagaaaaaaauauauuucaggca

SEQ ID NO: 457651 - RNA, 21 nt, Human
acagaugcuguacauuaaaaa

SEQ ID NO: 457652 - RNA, 20 nt, Human
acuccuacggacaaaagggc

SEQ ID NO: 457653 - RNA, 19 nt, Human
auauaucacucacaccaca

SEQ ID NO: 457654 - RNA, 21 nt, Human
caaacaaaguacagaugcugu

SEQ ID NO: 457655 - RNA, 19 nt, Human
caacaacagaaacacuccc

SEQ ID NO: 457656 - RNA, 24 nt, Human
cacagcaauuagcuaacaauaaaa

SEQ ID NO: 457657 - RNA, 24 nt, Human
caccacaucaacuccuacggacaa

SEQ ID NO: 457658 - RNA, 24 nt, Human
cagacuacauuugggcugacaggg

SEQ ID NO: 457659 - RNA, 19 nt, Human
ccugcagucacagcugaaa

SEQ ID NO: 457660 - RNA, 23 nt, Human
cuuccugcagucacagcugaaag

SEQ ID NO: 457661 - RNA, 22 nt, Human
gauacaagugauguaguuugac

SEQ ID NO: 457662 - RNA, 24 nt, Human
guauuacacugcaaaacuuacaca

SEQ ID NO: 457663 - RNA, 24 nt, Human
guuucauuuaucuuaccuuuauca

SEQ ID NO: 457664 - RNA, 22 nt, Human
uaaaaacacucccacuuccugc

SEQ ID NO: 457665 - RNA, 25 nt, Human
uaagaaaauuuaaaccauaacuaga

SEQ ID NO: 457666 - RNA, 22 nt, Human
uacagaugcuguacauuaaaaa

SEQ ID NO: 457667 - RNA, 22 nt, Human
uacauuaaaaacauagaaauau

SEQ ID NO: 457668 - RNA, 21 nt, Human
uagccaacaacagaaacacuc

SEQ ID NO: 457669 - RNA, 26 nt, Human
uauauacagaccagacuacauaugua

SEQ ID NO: 457670 - RNA, 22 nt, Human
uauguauuacacugcaaaacuu

SEQ ID NO: 457671 - RNA, 22 nt, Human
ucaaggcaaacaaaguacagau

SEQ ID NO: 457672 - RNA, 25 nt, Human
uggauuuucaaucacuguauaauuc

SEQ ID NO: 457673 - RNA, 25 nt, Human
uuuaaaccauaacuagacauaaaca

SEQ ID NO: 457674 - RNA, 24 nt, Human
uuuuuuuuuuuuuuucuuaacuug

SEQ ID NO: 457675 - RNA, 23 nt, Human
aaaaagaaaauucaaaauccagc

SEQ ID NO: 457676 - RNA, 18 nt, Human
aaaauucaaaauccagcc

SEQ ID NO: 457677 - RNA, 25 nt, Human
aaacaagcacggagcagcuuccugc

SEQ ID NO: 457678 - RNA, 19 nt, Human
aaccucccauccccuggac

SEQ ID NO: 457679 - RNA, 19 nt, Human
aagcagcaauaaaagggga

SEQ ID NO: 457680 - RNA, 18 nt, Human
aagccagccuccuucccc

SEQ ID NO: 457681 - RNA, 18 nt, Human
aagcuguggaggucagca

SEQ ID NO: 457682 - RNA, 22 nt, Human
aaggaaaagcagcaauaaaagg

SEQ ID NO: 457683 - RNA, 19 nt, Human
aaggagcuuggcugcuugg

SEQ ID NO: 457684 - RNA, 20 nt, Human
aaggagcuuggcugcuuggc

SEQ ID NO: 457685 - RNA, 19 nt, Human
aagggcaccuagagucagc

SEQ ID NO: 457686 - RNA, 22 nt, Human
aaguagaaguuguuucuugagg

SEQ ID NO: 457687 - RNA, 18 nt, Human
acccuaggaguucuccac

SEQ ID NO: 457688 - RNA, 24 nt, Human
acgggccccuuccaguccaccuuu

SEQ ID NO: 457689 - RNA, 19 nt, Human
agagaaaaaagggacgucu

SEQ ID NO: 457690 - RNA, 18 nt, Human
agaggcuccccgccaggu

SEQ ID NO: 457691 - RNA, 22 nt, Human
agccuuaaccuccacucauccc

SEQ ID NO: 457692 - RNA, 22 nt, Human
agcuguggaggucagcagcccc

SEQ ID NO: 457693 - RNA, 22 nt, Human
agcuguuauuuccccagugggg

SEQ ID NO: 457694 - RNA, 25 nt, Human
aggagauacucagagaaaaaaggga

SEQ ID NO: 457695 - RNA, 18 nt, Human
aggaggagagaggggaag

SEQ ID NO: 457696 - RNA, 22 nt, Human
aggccacacucugcugccagcu

SEQ ID NO: 457697 - RNA, 23 nt, Human
aggugguagggagcacccagaac

SEQ ID NO: 457698 - RNA, 23 nt, Human
aguguguucugggaggggcaggc

SEQ ID NO: 457699 - RNA, 21 nt, Human
aucaaugcccacaaccuccca

SEQ ID NO: 457700 - RNA, 23 nt, Human
aucugcuucagacucccccaucg

SEQ ID NO: 457701 - RNA, 21 nt, Human
auggggguugguuccucuagc

SEQ ID NO: 457702 - RNA, 23 nt, Human
auuucaauuuugaacaaaucacu

SEQ ID NO: 457703 - RNA, 26 nt, Human
caaacaagcacggagcagcuuccugc

SEQ ID NO: 457704 - RNA, 21 nt, Human
caaccucccauccccuggacc

SEQ ID NO: 457705 - RNA, 19 nt, Human
caagaugacugcaggcuug

SEQ ID NO: 457706 - RNA, 18 nt, Human
caccccaccccaucucgc

SEQ ID NO: 457707 - RNA, 19 nt, Human
caccccaucucgccuggcg

SEQ ID NO: 457708 - RNA, 23 nt, Human
caccuagagucagcccugccugc

SEQ ID NO: 457709 - RNA, 21 nt, Human
cagcccaggggggugcagaug

SEQ ID NO: 457710 - RNA, 19 nt, Human
cagccuccuuccccaucaa

SEQ ID NO: 457711 - RNA, 21 nt, Human
caggauccggugacauggggu

SEQ ID NO: 457712 - RNA, 23 nt, Human
cauccccuggacccagccacccu

SEQ ID NO: 457713 - RNA, 23 nt, Human
caucugcuucagacucccccauc

SEQ ID NO: 457714 - RNA, 19 nt, Human
ccacaaccucccauccccu

SEQ ID NO: 457715 - RNA, 24 nt, Human
ccacaaccucccauccccuggacc

SEQ ID NO: 457716 - RNA, 18 nt, Human
ccaccccaccccaucucg

SEQ ID NO: 457717 - RNA, 22 nt, Human
ccaccuuucuccguuccgacuc

SEQ ID NO: 457718 - RNA, 22 nt, Human
ccauccccuggacccagccacc

SEQ ID NO: 457719 - RNA, 20 nt, Human
cccacaaccucccauccccu

SEQ ID NO: 457720 - RNA, 26 nt, Human
cccacaaccucccauccccuggaccc

SEQ ID NO: 457721 - RNA, 23 nt, Human
cccagaacugccggacgggccuc

SEQ ID NO: 457722 - RNA, 23 nt, Human
cccaguggggccucccaaggagc

SEQ ID NO: 457723 - RNA, 18 nt, Human
ccccaaaugaggauacuc

SEQ ID NO: 457724 - RNA, 20 nt, Human
ccccaaggaaaagcagcaau

SEQ ID NO: 457725 - RNA, 21 nt, Human
ccccaaggaaaagcagcaaua

SEQ ID NO: 457726 - RNA, 22 nt, Human
ccccuaagcugauggagugugu

SEQ ID NO: 457727 - RNA, 23 nt, Human
ccccucuguggcagggcagagau

SEQ ID NO: 457728 - RNA, 18 nt, Human
ccccuggacccagccacc

SEQ ID NO: 457729 - RNA, 20 nt, Human
ccccuggacccagccacccu

SEQ ID NO: 457730 - RNA, 20 nt, Human
ccccuggugcucagcuucug

SEQ ID NO: 457731 - RNA, 18 nt, Human
cccuggacccagccaccc

SEQ ID NO: 457732 - RNA, 18 nt, Human
cccugggcuccagccuag

SEQ ID NO: 457733 - RNA, 21 nt, Human
cccugggcuccagccuagccc

SEQ ID NO: 457734 - RNA, 22 nt, Human
cccugggcuccagccuagcccc

SEQ ID NO: 457735 - RNA, 22 nt, Human
cccuggugcucagcuucuggcu

SEQ ID NO: 457736 - RNA, 24 nt, Human
cccuggugcucagcuucuggcuuu

SEQ ID NO: 457737 - RNA, 18 nt, Human
ccgaaggccacacucugc

SEQ ID NO: 457738 - RNA, 19 nt, Human
ccuaggacacucuuagccc

SEQ ID NO: 457739 - RNA, 19 nt, Human
ccuggggacuucccugccu

SEQ ID NO: 457740 - RNA, 21 nt, Human
ccuggggacuucccugccuca

SEQ ID NO: 457741 - RNA, 20 nt, Human
ccuuaaccuccacucauccc

SEQ ID NO: 457742 - RNA, 19 nt, Human
ccuuaggaucccagcuccu

SEQ ID NO: 457743 - RNA, 21 nt, Human
cggguuucuuucuugcuucuc

SEQ ID NO: 457744 - RNA, 23 nt, Human
cuaggaguucuccaccccacccc

SEQ ID NO: 457745 - RNA, 24 nt, Human
cuaggaguucuccaccccacccca

SEQ ID NO: 457746 - RNA, 20 nt, Human
cucagccuuaaccuccacuc

SEQ ID NO: 457747 - RNA, 20 nt, Human
cuccaccccaccccaucucg

SEQ ID NO: 457748 - RNA, 20 nt, Human
cuccagccuagccccagggc

SEQ ID NO: 457749 - RNA, 21 nt, Human
cuccagccuagccccagggcc

SEQ ID NO: 457750 - RNA, 22 nt, Human
cucggccuucacgcuuccucag

SEQ ID NO: 457751 - RNA, 19 nt, Human
cugagcuuccugcuugguc

SEQ ID NO: 457752 - RNA, 18 nt, Human
cugugccuuugagcugcu

SEQ ID NO: 457753 - RNA, 21 nt, Human
cuuccucguuguccugccgug

SEQ ID NO: 457754 - RNA, 23 nt, Human
cuuuccgcucccugggcuccagc

SEQ ID NO: 457755 - RNA, 19 nt, Human
gaaaagcagcaauaaaagg

SEQ ID NO: 457756 - RNA, 21 nt, Human
gaagcuguggaggucagcaac

SEQ ID NO: 457757 - RNA, 20 nt, Human
gacacucuuagccacgguga

SEQ ID NO: 457758 - RNA, 21 nt, Human
gacacucuuagccacggugag

SEQ ID NO: 457759 - RNA, 18 nt, Human
gaccugucuuuccucucu

SEQ ID NO: 457760 - RNA, 20 nt, Human
gagcacccagaacugccgga

SEQ ID NO: 457761 - RNA, 24 nt, Human
gagccacagcuguuauuuccccag

SEQ ID NO: 457762 - RNA, 20 nt, Human
gaucaaaggcuggggaggug

SEQ ID NO: 457763 - RNA, 18 nt, Human
gccccaaggaaaagcagc

SEQ ID NO: 457764 - RNA, 23 nt, Human
gcuggccuuuccucagccuuaac

SEQ ID NO: 457765 - RNA, 23 nt, Human
ggacaagccagccuccuucccca

SEQ ID NO: 457766 - RNA, 23 nt, Human
ggagcacccagaacugccggacg

SEQ ID NO: 457767 - RNA, 22 nt, Human
ggaggagagaggggaagcugug

SEQ ID NO: 457768 - RNA, 19 nt, Human
ggaggugcgugagguucuc

SEQ ID NO: 457769 - RNA, 20 nt, Human
ggagugaggaggggacaagc

SEQ ID NO: 457770 - RNA, 19 nt, Human
ggaguucuccaccccaccc

SEQ ID NO: 457771 - RNA, 25 nt, Human
gggaagcuguggaggucagcagccc

SEQ ID NO: 457772 - RNA, 19 nt, Human
gggcacggcuuccuggggc

SEQ ID NO: 457773 - RNA, 20 nt, Human
gggccccuuccaguccaccu

SEQ ID NO: 457774 - RNA, 18 nt, Human
gggccucccacaccccag

SEQ ID NO: 457775 - RNA, 23 nt, Human
gggcuccagccuagccccagggc

SEQ ID NO: 457776 - RNA, 20 nt, Human
gggggugcagauggguaagg

SEQ ID NO: 457777 - RNA, 18 nt, Human
gggugcagauggguaagg

SEQ ID NO: 457778 - RNA, 18 nt, Human
gucagcccugccugcaga

SEQ ID NO: 457779 - RNA, 20 nt, Human
guguucugggaggggcaggc

SEQ ID NO: 457780 - RNA, 19 nt, Human
uaaggugaugccacggagg

SEQ ID NO: 457781 - RNA, 18 nt, Human
uaccugaacucaaccagu

SEQ ID NO: 457782 - RNA, 19 nt, Human
uaccugaacucaaccaguc

SEQ ID NO: 457783 - RNA, 20 nt, Human
uagcuaccccaaaugaggau

SEQ ID NO: 457784 - RNA, 21 nt, Human
uagcuaccccaaaugaggaua

SEQ ID NO: 457785 - RNA, 19 nt, Human
uccaccccaccccaucucg

SEQ ID NO: 457786 - RNA, 19 nt, Human
uccacucauccccuggugc

SEQ ID NO: 457787 - RNA, 21 nt, Human
uccagcaucacugccugcccc

SEQ ID NO: 457788 - RNA, 18 nt, Human
uccccgccaggugccucu

SEQ ID NO: 457789 - RNA, 21 nt, Human
ucccucugucgggucggacuc

SEQ ID NO: 457790 - RNA, 22 nt, Human
ucccugggcuccagccuagccc

SEQ ID NO: 457791 - RNA, 21 nt, Human
uccuaggacacucuuagccac

SEQ ID NO: 457792 - RNA, 20 nt, Human
uccuggggccuggggacuuc

SEQ ID NO: 457793 - RNA, 21 nt, Human
uccuguuggaaggagcaucca

SEQ ID NO: 457794 - RNA, 19 nt, Human
ucgccuggcggaggggacc

SEQ ID NO: 457795 - RNA, 21 nt, Human
ucggccuucacgcuuccucag

SEQ ID NO: 457796 - RNA, 19 nt, Human
ucucgccuggcggagggga

SEQ ID NO: 457797 - RNA, 24 nt, Human
ucucucagcccaggggggugcaga

SEQ ID NO: 457798 - RNA, 22 nt, Human
ucucugagaggaacccuagcuc

SEQ ID NO: 457799 - RNA, 19 nt, Human
ucuuagccacggugagccc

SEQ ID NO: 457800 - RNA, 19 nt, Human
ugacaugggguggacccag

SEQ ID NO: 457801 - RNA, 23 nt, Human
ugacugcaggcuugggggccugg

SEQ ID NO: 457802 - RNA, 24 nt, Human
ugagaggaacccuagcucucuugg

SEQ ID NO: 457803 - RNA, 22 nt, Human
ugagcccuuaggaucccagcuc

SEQ ID NO: 457804 - RNA, 24 nt, Human
ugagcugcuuuccgcucccugggc

SEQ ID NO: 457805 - RNA, 20 nt, Human
ugauggaguguguucuggga

SEQ ID NO: 457806 - RNA, 19 nt, Human
ugauugauccaucucccuc

SEQ ID NO: 457807 - RNA, 23 nt, Human
ugcaucugcuucagacuccccca

SEQ ID NO: 457808 - RNA, 27 nt, Human
ugccacggaggggaugguugagaugac

SEQ ID NO: 457809 - RNA, 22 nt, Human
ugcccacaaccucccauccccu

SEQ ID NO: 457810 - RNA, 20 nt, Human
ugccuuugagcugcuuuccg

SEQ ID NO: 457811 - RNA, 18 nt, Human
ugcucagcuucuggcuuu

SEQ ID NO: 457812 - RNA, 18 nt, Human
uggaaggagcauccagca

SEQ ID NO: 457813 - RNA, 22 nt, Human
uggaguguguucugggaggggc

SEQ ID NO: 457814 - RNA, 21 nt, Human
uggcggaggggaccgccgggu

SEQ ID NO: 457815 - RNA, 20 nt, Human
ugggaagggagugaggaggg

SEQ ID NO: 457816 - RNA, 18 nt, Human
uggggaggugguagggag

SEQ ID NO: 457817 - RNA, 23 nt, Human
uggggaggugguagggagcaccc

SEQ ID NO: 457818 - RNA, 21 nt, Human
ugggguggacccagcgcuguu

SEQ ID NO: 457819 - RNA, 18 nt, Human
uguccgaaggccacacuc

SEQ ID NO: 457820 - RNA, 24 nt, Human
uguucuagaaauggggguugguuc

SEQ ID NO: 457821 - RNA, 18 nt, Human
uuccucagccuuaaccuc

SEQ ID NO: 457822 - RNA, 26 nt, Human
uuccucagccuuaaccuccacucauc

SEQ ID NO: 457823 - RNA, 18 nt, Human
uuccucuagcuaccccaa

SEQ ID NO: 457824 - RNA, 23 nt, Human
uuccucucugagaggaacccuag

SEQ ID NO: 457825 - RNA, 18 nt, Human
uuccuggggccuggggac

SEQ ID NO: 457826 - RNA, 21 nt, Human
uucuccaccccaccccaucuc

SEQ ID NO: 457827 - RNA, 19 nt, Human
uugaagacaucuucuuggu

SEQ ID NO: 457828 - RNA, 26 nt, Human
uuuuuuuuuugaagacaucuucuugg

SEQ ID NO: 457829 - RNA, 18 nt, Human
uuuuuuuuuuuuuuuuug

SEQ ID NO: 457830 - RNA, 18 nt, Human
auccggcccuggcccucc

SEQ ID NO: 457831 - RNA, 27 nt, Human
cacauccggcccuggcccuccuggucc

SEQ ID NO: 457832 - RNA, 21 nt, Human
cacuuggggugaggaggaggg

SEQ ID NO: 457833 - RNA, 19 nt, Human
ccacugcggagacuggggc

SEQ ID NO: 457834 - RNA, 20 nt, Human
ccacuggguggggcaggaag

SEQ ID NO: 457835 - RNA, 22 nt, Human
ccugggcagcagccgggguggg

SEQ ID NO: 457836 - RNA, 22 nt, Human
cggcagaggcuggaccgugauc

SEQ ID NO: 457837 - RNA, 22 nt, Human
cgggguccggcggauccugggc

SEQ ID NO: 457838 - RNA, 22 nt, Human
cuccugguccgguuugcugaag

SEQ ID NO: 457839 - RNA, 23 nt, Human
cugaagcaacacacuuggccuac

SEQ ID NO: 457840 - RNA, 22 nt, Human
cuggaggccagcuuuacugugc

SEQ ID NO: 457841 - RNA, 20 nt, Human
cugugcuagaggaagagggu

SEQ ID NO: 457842 - RNA, 23 nt, Human
cuuuaccgcccgcucugcucucc

SEQ ID NO: 457843 - RNA, 20 nt, Human
gaccgugaucuugagguuca

SEQ ID NO: 457844 - RNA, 22 nt, Human
gcagcagccgggguggggaugc

SEQ ID NO: 457845 - RNA, 24 nt, Human
gccuacccacuggguggggcagga

SEQ ID NO: 457846 - RNA, 24 nt, Human
ggagacuggggcuccggcagaggc

SEQ ID NO: 457847 - RNA, 21 nt, Human
ggcccucagcaacugcagccc

SEQ ID NO: 457848 - RNA, 23 nt, Human
gggaugcugucacauucggggac

SEQ ID NO: 457849 - RNA, 23 nt, Human
ggggaugcugucacauucgggga

SEQ ID NO: 457850 - RNA, 18 nt, Human
ggggcaggaagucucgag

SEQ ID NO: 457851 - RNA, 19 nt, Human
gugaucuugagguucaggg

SEQ ID NO: 457852 - RNA, 20 nt, Human
guucaggggugcauucuggg

SEQ ID NO: 457853 - RNA, 18 nt, Human
ucacuuggggugaggagg

SEQ ID NO: 457854 - RNA, 19 nt, Human
ucggcccucagcaacugca

SEQ ID NO: 457855 - RNA, 23 nt, Human
uggggcaggaagucucgagcccc

SEQ ID NO: 457856 - RNA, 22 nt, Human
aaccacugaaaaugcacuccaa

SEQ ID NO: 457857 - RNA, 19 nt, Human
aagaaaguccuccagccuc

SEQ ID NO: 457858 - RNA, 21 nt, Human
aaugcacuccaagacuucugc

SEQ ID NO: 457859 - RNA, 20 nt, Human
agaaaacuuuucuguaaagg

SEQ ID NO: 457860 - RNA, 23 nt, Human
agaacacacacuguaaggccucc

SEQ ID NO: 457861 - RNA, 18 nt, Human
agaaugcccugcauaaaa

SEQ ID NO: 457862 - RNA, 22 nt, Human
agauuucucucacaggcacuuu

SEQ ID NO: 457863 - RNA, 23 nt, Human
agcucccaaauaauaaugacucu

SEQ ID NO: 457864 - RNA, 24 nt, Human
aggaagugauauuauuucuagcau

SEQ ID NO: 457865 - RNA, 22 nt, Human
agugcguauaaacucaaguaac

SEQ ID NO: 457866 - RNA, 23 nt, Human
auaaagggaaagaaaguccucca

SEQ ID NO: 457867 - RNA, 20 nt, Human
augacucuuggguaauaagg

SEQ ID NO: 457868 - RNA, 25 nt, Human
auuucuagcauuguaagaaccccag

SEQ ID NO: 457869 - RNA, 25 nt, Human
auuuugugauuauucuuaaaggcca

SEQ ID NO: 457870 - RNA, 19 nt, Human
caccagguuaacuucucac

SEQ ID NO: 457871 - RNA, 20 nt, Human
caccagguuaacuucucaca

SEQ ID NO: 457872 - RNA, 20 nt, Human
cauauaaaauauccagcaag

SEQ ID NO: 457873 - RNA, 21 nt, Human
cauucggaagccgacccgccc

SEQ ID NO: 457874 - RNA, 21 nt, Human
cauuuggaauacagaaugccc

SEQ ID NO: 457875 - RNA, 23 nt, Human
ccaaaagagcaggauaaacaaau

SEQ ID NO: 457876 - RNA, 23 nt, Human
ccauuucugcaaggccucuuuug

SEQ ID NO: 457877 - RNA, 19 nt, Human
ccggaauacguuuccaaaa

SEQ ID NO: 457878 - RNA, 21 nt, Human
ccuccguaagugaaaagcgga

SEQ ID NO: 457879 - RNA, 21 nt, Human
cucacaggcacuucugcaaca

SEQ ID NO: 457880 - RNA, 22 nt, Human
cucacaggcacuucugcaacaa

SEQ ID NO: 457881 - RNA, 24 nt, Human
cuccaagacuucugcugaacaacc

SEQ ID NO: 457882 - RNA, 21 nt, Human
gaaaaugcacuccaagacuuc

SEQ ID NO: 457883 - RNA, 23 nt, Human
gaagguagauaaauuuauugcca

SEQ ID NO: 457884 - RNA, 23 nt, Human
gacucuuggguaauaaggaagua

SEQ ID NO: 457885 - RNA, 20 nt, Human
gacuucugcugaacaaccuc

SEQ ID NO: 457886 - RNA, 21 nt, Human
gaguuacagaaucuuuuucuu

SEQ ID NO: 457887 - RNA, 21 nt, Human
gccgacccgcccagucccucc

SEQ ID NO: 457888 - RNA, 23 nt, Human
ggaaagaaaguccuccagccucc

SEQ ID NO: 457889 - RNA, 24 nt, Human
guaacacagaacacacacuguaag

SEQ ID NO: 457890 - RNA, 30 nt, Human
guaacacagaacacacacuguaaggccucu

SEQ ID NO: 457891 - RNA, 21 nt, Human
guaucaccagguuaacuucuc

SEQ ID NO: 457892 - RNA, 26 nt, Human
uaaacaaauucugcagugcguauaaa

SEQ ID NO: 457893 - RNA, 26 nt, Human
uaaauauaacucagaugagucagaca

SEQ ID NO: 457894 - RNA, 21 nt, Human
uaacucagaugagucagacaa

SEQ ID NO: 457895 - RNA, 19 nt, Human
uaagaaccccagcucccaa

SEQ ID NO: 457896 - RNA, 21 nt, Human
uaauaaggaaguaccuuagca

SEQ ID NO: 457897 - RNA, 24 nt, Human
uaauugacagguugcauuuuuucu

SEQ ID NO: 457898 - RNA, 19 nt, Human
uagacaauagcaaaugaau

SEQ ID NO: 457899 - RNA, 21 nt, Human
uagcauguuuuccugaaguac

SEQ ID NO: 457900 - RNA, 24 nt, Human
uagcauguuuuccugaaguacuug

SEQ ID NO: 457901 - RNA, 18 nt, Human
uagcauuguaagaacccc

SEQ ID NO: 457902 - RNA, 19 nt, Human
uauccauuuggaauacaga

SEQ ID NO: 457903 - RNA, 22 nt, Human
uaugauggcuaaucauaaauac

SEQ ID NO: 457904 - RNA, 19 nt, Human
ucagacaaaaaaaaucauu

SEQ ID NO: 457905 - RNA, 21 nt, Human
uccaagacuucugcugaacaa

SEQ ID NO: 457906 - RNA, 18 nt, Human
ucccuacuacaauuacuu

SEQ ID NO: 457907 - RNA, 23 nt, Human
ucucacuccuaaccacuuccgau

SEQ ID NO: 457908 - RNA, 21 nt, Human
ucucucacuccuaaccacuuc

SEQ ID NO: 457909 - RNA, 23 nt, Human
ucugcaguuguaguggccaaaac

SEQ ID NO: 457910 - RNA, 21 nt, Human
ugcccugcauaaaacuagcau

SEQ ID NO: 457911 - RNA, 20 nt, Human
uggccaaaaccaggcuuaga

SEQ ID NO: 457912 - RNA, 18 nt, Human
uggguaauaaggaaguac

SEQ ID NO: 457913 - RNA, 19 nt, Human
uuccugaaguacuuguuaa

SEQ ID NO: 457914 - RNA, 20 nt, Human
uuggaaaaagucuaccuuuu

SEQ ID NO: 457915 - RNA, 20 nt, Human
uuggauauucuugucuguug

SEQ ID NO: 457916 - RNA, 18 nt, Human
uuguaguggccaaaacca

SEQ ID NO: 457917 - RNA, 26 nt, Human
uuugaagauuucucucacaggcacuu

SEQ ID NO: 457918 - RNA, 24 nt, Human
uuuggugcuaaaagagaguuacag

SEQ ID NO: 457919 - RNA, 20 nt, Human
uuuguagcucaaaaaauuac

SEQ ID NO: 457920 - RNA, 22 nt, Human
aaaaaaaaaaaaaaacaaaaca

SEQ ID NO: 457921 - RNA, 21 nt, Human
aaaaaaaaaaaacaaaacaaa

SEQ ID NO: 457922 - RNA, 26 nt, Human
aaaaaaaaaaaacaaaacaaauaaau

SEQ ID NO: 457923 - RNA, 27 nt, Human
aaaaaaaaaacaaaacaaauaaauaaa

SEQ ID NO: 457924 - RNA, 18 nt, Human
aaaauuagcugggcgugg

SEQ ID NO: 457925 - RNA, 23 nt, Human
aaacaggauggagaaaaaucuaa

SEQ ID NO: 457926 - RNA, 22 nt, Human
aacaaaacaaauaaauaaaaau

SEQ ID NO: 457927 - RNA, 22 nt, Human
aacuuccucccugucucugcua

SEQ ID NO: 457928 - RNA, 19 nt, Human
accauucagaauacaggag

SEQ ID NO: 457929 - RNA, 18 nt, Human
acuuccuuaaaaguuggg

SEQ ID NO: 457930 - RNA, 24 nt, Human
acuuuguuuucucuaacugccuuc

SEQ ID NO: 457931 - RNA, 21 nt, Human
agaagauacugaaacaugcua

SEQ ID NO: 457932 - RNA, 24 nt, Human
agagauugauaaaggaauguauaa

SEQ ID NO: 457933 - RNA, 24 nt, Human
agaucacauuuuuuuaauaacaaa

SEQ ID NO: 457934 - RNA, 20 nt, Human
agcaggcaaauuuuugugcu

SEQ ID NO: 457935 - RNA, 19 nt, Human
agccuggcgacagagaguc

SEQ ID NO: 457936 - RNA, 19 nt, Human
agcucuaaaaagagccaga

SEQ ID NO: 457937 - RNA, 23 nt, Human
agcugggcgugguggugcaugcc

SEQ ID NO: 457938 - RNA, 19 nt, Human
aggaacuuacaauguucaa

SEQ ID NO: 457939 - RNA, 19 nt, Human
aggcaggagaagccuggcg

SEQ ID NO: 457940 - RNA, 18 nt, Human
agggacagaugagucacc

SEQ ID NO: 457941 - RNA, 22 nt, Human
agggcaaauaaaaucuucccuu

SEQ ID NO: 457942 - RNA, 19 nt, Human
aguaaaugauaaaaauuua

SEQ ID NO: 457943 - RNA, 23 nt, Human
auaaaaacuuccucaaacaucag

SEQ ID NO: 457944 - RNA, 22 nt, Human
auaaauauaacucaucagcacu

SEQ ID NO: 457945 - RNA, 22 nt, Human
auacgauucaguaaauuuuaau

SEQ ID NO: 457946 - RNA, 19 nt, Human
aucaaaagcuuccaguuaa

SEQ ID NO: 457947 - RNA, 23 nt, Human
augucuauucacuucaucauaac

SEQ ID NO: 457948 - RNA, 21 nt, Human
caaaaaaaaaaaaaaacaaaa

SEQ ID NO: 457949 - RNA, 19 nt, Human
caacaaaaagggacagaug

SEQ ID NO: 457950 - RNA, 26 nt, Human
caauaaauauaacucaucagcacuuc

SEQ ID NO: 457951 - RNA, 18 nt, Human
cacuuugcuacccccuuc

SEQ ID NO: 457952 - RNA, 22 nt, Human
cagcaaauacuuuuuccuuuga

SEQ ID NO: 457953 - RNA, 19 nt, Human
cagcacuuccgaucuguau

SEQ ID NO: 457954 - RNA, 19 nt, Human
cauccaggguccauaauuc

SEQ ID NO: 457955 - RNA, 22 nt, Human
cccuucuguuccccuucacugu

SEQ ID NO: 457956 - RNA, 25 nt, Human
cccuucuguuccccuucacuguuuc

SEQ ID NO: 457957 - RNA, 25 nt, Human
ccuaugauagagaagauacugaaac

SEQ ID NO: 457958 - RNA, 21 nt, Human
ccucaaaaaaaaaaaaaaaca

SEQ ID NO: 457959 - RNA, 27 nt, Human
ccucaaaaaaaaaaaaaaacaaaacaa

SEQ ID NO: 457960 - RNA, 20 nt, Human
ccuguagucccagcuacucg

SEQ ID NO: 457961 - RNA, 24 nt, Human
cuccccaacauacaccuucugcag

SEQ ID NO: 457962 - RNA, 18 nt, Human
cuccugguguuuucauag

SEQ ID NO: 457963 - RNA, 27 nt, Human
cugccucaaaaaaaaaaaaaaacaaaa

SEQ ID NO: 457964 - RNA, 23 nt, Human
cugcuuccagaguucaccauuca

SEQ ID NO: 457965 - RNA, 24 nt, Human
gaaaaaucuaaauuaaagcaaaaa

SEQ ID NO: 457966 - RNA, 24 nt, Human
gaguauggacaacaaaaagggaca

SEQ ID NO: 457967 - RNA, 24 nt, Human
gaugcuucuacuguaaauucccac

SEQ ID NO: 457968 - RNA, 23 nt, Human
ggucugaaucuuaaaaaaaguaa

SEQ ID NO: 457969 - RNA, 21 nt, Human
gguuucuugaagcuacuuguu

SEQ ID NO: 457970 - RNA, 28 nt, Human
gucaaguauuuuguuuucccuuucaguu

SEQ ID NO: 457971 - RNA, 25 nt, Human
gucaccuuucauuaaucauugacuc

SEQ ID NO: 457972 - RNA, 25 nt, Human
uaaaaauaaaaacuuccucaaacau

SEQ ID NO: 457973 - RNA, 20 nt, Human
uaaaaauaaaaacuuccucc

SEQ ID NO: 457974 - RNA, 25 nt, Human
uaaaaauaaaaacuuccucccuguc

SEQ ID NO: 457975 - RNA, 19 nt, Human
uaauucauacgcauucccu

SEQ ID NO: 457976 - RNA, 19 nt, Human
uaccaauauuuauucugaa

SEQ ID NO: 457977 - RNA, 22 nt, Human
uaugucaaguauuuuguuuucc

SEQ ID NO: 457978 - RNA, 24 nt, Human
uauuguaagaaacggggccucuga

SEQ ID NO: 457979 - RNA, 18 nt, Human
ucuccccaacauacaccu

SEQ ID NO: 457980 - RNA, 23 nt, Human
ucucugcuaaaaauacaaaaauu

SEQ ID NO: 457981 - RNA, 21 nt, Human
ucugccucaaaaaaaaaaaaa

SEQ ID NO: 457982 - RNA, 20 nt, Human
ucuguaacacuuugcuaccc

SEQ ID NO: 457983 - RNA, 19 nt, Human
ucugugacaguaguagccu

SEQ ID NO: 457984 - RNA, 22 nt, Human
ucugugacaguaguagccuuaa

SEQ ID NO: 457985 - RNA, 18 nt, Human
ucuguugcuuuccuccuu

SEQ ID NO: 457986 - RNA, 23 nt, Human
ucuuauuuuuuuucccccaauga

SEQ ID NO: 457987 - RNA, 18 nt, Human
ugaaagccacuacacuuc

SEQ ID NO: 457988 - RNA, 18 nt, Human
ugaggcaggagaagccug

SEQ ID NO: 457989 - RNA, 23 nt, Human
ugauaugucuauucacuucauca

SEQ ID NO: 457990 - RNA, 21 nt, Human
ugcacaaagaaauuacagauc

SEQ ID NO: 457991 - RNA, 22 nt, Human
ugccucaaaaaaaaaaaaaaac

SEQ ID NO: 457992 - RNA, 24 nt, Human
ugccucaaaaaaaaaaaaaaacaa

SEQ ID NO: 457993 - RNA, 21 nt, Human
ugccuguagucccagcuacuc

SEQ ID NO: 457994 - RNA, 25 nt, Human
ugccuguagucccagcuacucguga

SEQ ID NO: 457995 - RNA, 21 nt, Human
uggagaaaaaucuaaauuaaa

SEQ ID NO: 457996 - RNA, 18 nt, Human
uggugcaugccuguaguc

SEQ ID NO: 457997 - RNA, 24 nt, Human
ugguggugcaugccuguaguccca

SEQ ID NO: 457998 - RNA, 21 nt, Human
uuacaacaacaaaaaauacca

SEQ ID NO: 457999 - RNA, 23 nt, Human
uuagaaauacuauccucaaaaca

SEQ ID NO: 458000 - RNA, 19 nt, Human
uuagcugggcgugguggug

SEQ ID NO: 458001 - RNA, 24 nt, Human
uuagcugggcgugguggugcaugc

SEQ ID NO: 458002 - RNA, 22 nt, Human
uucaaaaccaaagaauaaaaau

SEQ ID NO: 458003 - RNA, 22 nt, Human
uucaauuuuacaacaacaaaaa

SEQ ID NO: 458004 - RNA, 19 nt, Human
uuguucuaaaaaaaaaaau

SEQ ID NO: 458005 - RNA, 22 nt, Human
acacacaacauacauccuuaca

SEQ ID NO: 458006 - RNA, 21 nt, Human
acagaggaaagaaauaaaagc

SEQ ID NO: 458007 - RNA, 20 nt, Human
acuuuacugauuuuggcaca

SEQ ID NO: 458008 - RNA, 18 nt, Human
agagggaagaggaacaga

SEQ ID NO: 458009 - RNA, 21 nt, Human
aggaaagaaauaaaagcaaga

SEQ ID NO: 458010 - RNA, 22 nt, Human
aggaaagaaauaaaagcaagaa

SEQ ID NO: 458011 - RNA, 21 nt, Human
caaaaaaagucaaaaugcaaa

SEQ ID NO: 458012 - RNA, 21 nt, Human
caguagaaaauaaagucauug

SEQ ID NO: 458013 - RNA, 26 nt, Human
caugaacaugcauacguaauauucua

SEQ ID NO: 458014 - RNA, 24 nt, Human
gucacagaauuuuucucaguagag

SEQ ID NO: 458015 - RNA, 23 nt, Human
guccuuguccuucuauccuuggg

SEQ ID NO: 458016 - RNA, 19 nt, Human
uaaaaaacugcauucucag

SEQ ID NO: 458017 - RNA, 22 nt, Human
uaaaaaacugcauucucaguca

SEQ ID NO: 458018 - RNA, 22 nt, Human
uaaaaaagagggaagaggaaca

SEQ ID NO: 458019 - RNA, 23 nt, Human
uaaaacuuuaaacaaaaguauua

SEQ ID NO: 458020 - RNA, 21 nt, Human
uaacuuuacugauuuuggcac

SEQ ID NO: 458021 - RNA, 19 nt, Human
uaagguaccuucagccagu

SEQ ID NO: 458022 - RNA, 18 nt, Human
uaauaaagguuaaacaca

SEQ ID NO: 458023 - RNA, 19 nt, Human
uagacaugaacaugcauac

SEQ ID NO: 458024 - RNA, 21 nt, Human
ucaacagccauucuuuagaca

SEQ ID NO: 458025 - RNA, 21 nt, Human
ucuguccuuguccuucuaucc

SEQ ID NO: 458026 - RNA, 18 nt, Human
ugauuaaaaaagagggaa

SEQ ID NO: 458027 - RNA, 21 nt, Human
uuacugauuuuggcacagaaa

SEQ ID NO: 458028 - RNA, 18 nt, Human
uuccuaguucacuuguuc

SEQ ID NO: 458029 - RNA, 20 nt, Human
uugguugcacaugaaaaagg

SEQ ID NO: 458030 - RNA, 23 nt, Human
uuuuggcacagaaaagaagucuu

SEQ ID NO: 458031 - RNA, 20 nt, Human
aaagaaaaaaaaaaggagag

SEQ ID NO: 458032 - RNA, 22 nt, Human
aaagaaaaaaaaaaggagaggg

SEQ ID NO: 458033 - RNA, 24 nt, Human
aggcaagaggaaaguaacugucca

SEQ ID NO: 458034 - RNA, 19 nt, Human
caaagaaaaaaaaaaggag

SEQ ID NO: 458035 - RNA, 19 nt, Human
caaguccagucccuaaagc

SEQ ID NO: 458036 - RNA, 18 nt, Human
cagucccuaaagcgcccc

SEQ ID NO: 458037 - RNA, 21 nt, Human
caucaauaagggggaaaauca

SEQ ID NO: 458038 - RNA, 19 nt, Human
cccgacaguuuccaaaugu

SEQ ID NO: 458039 - RNA, 21 nt, Human
gauaugaacaggcaagaggaa

SEQ ID NO: 458040 - RNA, 20 nt, Human
gggaaaaucaaagaaaaaaa

SEQ ID NO: 458041 - RNA, 23 nt, Human
ucaaaaacagaaugaauaucagu

SEQ ID NO: 458042 - RNA, 21 nt, Human
ucaaagaaaaaaaaaaggaga

SEQ ID NO: 458043 - RNA, 23 nt, Human
ucaauaagggggaaaaucaaaga

SEQ ID NO: 458044 - RNA, 26 nt, Human
ugaacaggcaagaggaaaguaacugu

SEQ ID NO: 458045 - RNA, 20 nt, Human
ugaagguugacaacuauucu

SEQ ID NO: 458046 - RNA, 22 nt, Human
ugacaacuauucuccuuuaaaa

SEQ ID NO: 458047 - RNA, 20 nt, Human
acgacggacggaaaugggcc

SEQ ID NO: 458048 - RNA, 22 nt, Human
acgcugccgugccccaguggac

SEQ ID NO: 458049 - RNA, 19 nt, Human
acucacugugccucccccc

SEQ ID NO: 458050 - RNA, 20 nt, Human
acucacugugccucccccca

SEQ ID NO: 458051 - RNA, 23 nt, Human
agcacaagcaucaggcugugucu

SEQ ID NO: 458052 - RNA, 21 nt, Human
aggcuccguuaggaccuggcu

SEQ ID NO: 458053 - RNA, 22 nt, Human
caguggacucacugugccuccc

SEQ ID NO: 458054 - RNA, 23 nt, Human
ccacaucuccugcagucucacuc

SEQ ID NO: 458055 - RNA, 22 nt, Human
cccacgccgcucuucuuagaag

SEQ ID NO: 458056 - RNA, 22 nt, Human
ccccacgacggacggaaauggg

SEQ ID NO: 458057 - RNA, 18 nt, Human
ccccaggagguggggacc

SEQ ID NO: 458058 - RNA, 21 nt, Human
cccgccgccuccaagcuccgc

SEQ ID NO: 458059 - RNA, 21 nt, Human
ccgcaggcccacagccgggcu

SEQ ID NO: 458060 - RNA, 22 nt, Human
ccgccgccuccaagcuccgccc

SEQ ID NO: 458061 - RNA, 25 nt, Human
ccgggagcacgguggagcgguggag

SEQ ID NO: 458062 - RNA, 18 nt, Human
ccugcagucucacuccuc

SEQ ID NO: 458063 - RNA, 20 nt, Human
cgacugaagcgaaggucgcc

SEQ ID NO: 458064 - RNA, 21 nt, Human
cgcccaccggagcacaagcau

SEQ ID NO: 458065 - RNA, 19 nt, Human
cggccccaggaggugggga

SEQ ID NO: 458066 - RNA, 18 nt, Human
cugcgcuggggaggcugc

SEQ ID NO: 458067 - RNA, 21 nt, Human
gagccccccacgccgcucuuc

SEQ ID NO: 458068 - RNA, 19 nt, Human
ggcggcgggggcggggagc

SEQ ID NO: 458069 - RNA, 21 nt, Human
gggcacaggggacugcacggg

SEQ ID NO: 458070 - RNA, 19 nt, Human
gggcggggagccgggagca

SEQ ID NO: 458071 - RNA, 24 nt, Human
ggucgggcgucuccgccggcuacu

SEQ ID NO: 458072 - RNA, 25 nt, Human
ucccgccgccuccaagcuccgccca

SEQ ID NO: 458073 - RNA, 22 nt, Human
ucccgcucgccgcgccuucaaa

SEQ ID NO: 458074 - RNA, 23 nt, Human
uccugcagucucacuccucaaga

SEQ ID NO: 458075 - RNA, 19 nt, Human
ucgccgagccccccacgcc

SEQ ID NO: 458076 - RNA, 18 nt, Human
ucucgggaguccaggccg

SEQ ID NO: 458077 - RNA, 21 nt, Human
uggcaagcgguucagcugucu

SEQ ID NO: 458078 - RNA, 19 nt, Human
uuagacgcugccgugcccc

SEQ ID NO: 458079 - RNA, 23 nt, Human
uuaggaccuggcuuaugugcucg

SEQ ID NO: 458080 - RNA, 21 nt, Human
uuggggcccgcgggcggcggg

SEQ ID NO: 458081 - RNA, 18 nt, Human
uuuuuuuuuuuuuuuuug

SEQ ID NO: 458082 - RNA, 23 nt, Human
aacuccgccaccagcgcucacua

SEQ ID NO: 458083 - RNA, 27 nt, Human
caaaauaaauuauacaugcuguauaaa

SEQ ID NO: 458084 - RNA, 19 nt, Human
caccagcgcucacuaucug

SEQ ID NO: 458085 - RNA, 23 nt, Human
uaacuccgccaccagcgcucacu

SEQ ID NO: 458086 - RNA, 21 nt, Human
ucugccaccucagccugaagc

SEQ ID NO: 458087 - RNA, 23 nt, Human
ucugccaccucagccugaagccu

SEQ ID NO: 458088 - RNA, 24 nt, Human
ugcuuugacuuuaacuccgccacc

SEQ ID NO: 458089 - RNA, 19 nt, Human
aaaaagccaggcagcaguu

SEQ ID NO: 458090 - RNA, 21 nt, Human
aaaauccaacccaugcagagg

SEQ ID NO: 458091 - RNA, 24 nt, Human
aaacagaaauauucauaaaaagga

SEQ ID NO: 458092 - RNA, 18 nt, Human
aaacauuaucacacaauc

SEQ ID NO: 458093 - RNA, 24 nt, Human
aaagaaaggugaaauagcuuaaac

SEQ ID NO: 458094 - RNA, 20 nt, Human
aaagcaaaaauaaaaauuca

SEQ ID NO: 458095 - RNA, 25 nt, Human
aaaggugaaauagcuuaaacagaaa

SEQ ID NO: 458096 - RNA, 23 nt, Human
aaagguuuaaagaaaaaagggag

SEQ ID NO: 458097 - RNA, 23 nt, Human
aaaugaacugugcuaaaaacccg

SEQ ID NO: 458098 - RNA, 23 nt, Human
aacccaugcagagggauaaaaaa

SEQ ID NO: 458099 - RNA, 21 nt, Human
aacccgacaggcaucuucccu

SEQ ID NO: 458100 - RNA, 21 nt, Human
aaccuuaauuaccuagauuug

SEQ ID NO: 458101 - RNA, 21 nt, Human
aagcaaaaauaaaaauucaca

SEQ ID NO: 458102 - RNA, 24 nt, Human
aagcaaaaauaaaaauucacaacc

SEQ ID NO: 458103 - RNA, 22 nt, Human
aagcaccgaagaccaugaugcu

SEQ ID NO: 458104 - RNA, 22 nt, Human
aagcaccgaagaccaugaugcu

SEQ ID NO: 458105 - RNA, 20 nt, Human
aagcucggaagaaaaaaagc

SEQ ID NO: 458106 - RNA, 18 nt, Human
aaucauguuuuguuuuug

SEQ ID NO: 458107 - RNA, 20 nt, Human
aauccucuaacccaguuucu

SEQ ID NO: 458108 - RNA, 25 nt, Human
acaaagcaaaaauaaaaauucacaa

SEQ ID NO: 458109 - RNA, 30 nt, Human
acaaagcaaaaauaaaaauucacaaccuuu

SEQ ID NO: 458110 - RNA, 18 nt, Human
acagaaaugcuucaaaau

SEQ ID NO: 458111 - RNA, 21 nt, Human
acaggcaucuucccugcccuc

SEQ ID NO: 458112 - RNA, 19 nt, Human
agaaaaaagggaggggcuu

SEQ ID NO: 458113 - RNA, 20 nt, Human
agaaauauucauaaaaagga

SEQ ID NO: 458114 - RNA, 21 nt, Human
agacccaccucggagggccag

SEQ ID NO: 458115 - RNA, 23 nt, Human
agggaggggcuuucuuacaagcu

SEQ ID NO: 458116 - RNA, 20 nt, Human
augaugcuggcuggagugaa

SEQ ID NO: 458117 - RNA, 20 nt, Human
augaugcuggcuggagugaa

SEQ ID NO: 458118 - RNA, 23 nt, Human
auucguaaaugcuggccuuccuu

SEQ ID NO: 458119 - RNA, 27 nt, Human
caacccaugcagagggauaaaaaacug

SEQ ID NO: 458120 - RNA, 22 nt, Human
caagagcuuucccacacgccaa

SEQ ID NO: 458121 - RNA, 24 nt, Human
cacaauccuauucugaaagacaaa

SEQ ID NO: 458122 - RNA, 18 nt, Human
cacacaauccuauucuga

SEQ ID NO: 458123 - RNA, 27 nt, Human
caccugagguuggagggccccaagggc

SEQ ID NO: 458124 - RNA, 19 nt, Human
caccugcaggccggcugcu

SEQ ID NO: 458125 - RNA, 20 nt, Human
caccugcaggccggcugcuu

SEQ ID NO: 458126 - RNA, 20 nt, Human
caccugcaggccggcugcuu

SEQ ID NO: 458127 - RNA, 25 nt, Human
caguuucugggcagcuucuauccug

SEQ ID NO: 458128 - RNA, 18 nt, Human
caucaccugagguugagc

SEQ ID NO: 458129 - RNA, 18 nt, Human
caucaccugagguuggag

SEQ ID NO: 458130 - RNA, 24 nt, Human
caucuucccugcccuccccccacu

SEQ ID NO: 458131 - RNA, 27 nt, Human
caugcagagggauaaaaaacugacauc

SEQ ID NO: 458132 - RNA, 18 nt, Human
ccaaagcugugagggggg

SEQ ID NO: 458133 - RNA, 18 nt, Human
ccaguguguuccgccagg

SEQ ID NO: 458134 - RNA, 18 nt, Human
ccccccgcccccaccccc

SEQ ID NO: 458135 - RNA, 27 nt, Human
cccccgcccccacccccaguguguucc

SEQ ID NO: 458136 - RNA, 19 nt, Human
ccccgggcccggaagcacc

SEQ ID NO: 458137 - RNA, 20 nt, Human
ccccgggcccgggaagcacc

SEQ ID NO: 458138 - RNA, 18 nt, Human
ccccucugucuggagucu

SEQ ID NO: 458139 - RNA, 18 nt, Human
ccccucugucuggagucu

SEQ ID NO: 458140 - RNA, 22 nt, Human
cccgacagaccccgggcccgga

SEQ ID NO: 458141 - RNA, 22 nt, Human
cccgacagaccccgggcccggg

SEQ ID NO: 458142 - RNA, 21 nt, Human
ccgcaucuuccccccgccccc

SEQ ID NO: 458143 - RNA, 18 nt, Human
ccugagguuggagggccc

SEQ ID NO: 458144 - RNA, 19 nt, Human
cgcaucuuccccccgcccc

SEQ ID NO: 458145 - RNA, 22 nt, Human
cgcccccacccccaguguguuc

SEQ ID NO: 458146 - RNA, 18 nt, Human
cggaagcaccgaagacca

SEQ ID NO: 458147 - RNA, 24 nt, Human
cggaagcaccgaagaccaugaugc

SEQ ID NO: 458148 - RNA, 19 nt, Human
cuauccuggggcgagagcc

SEQ ID NO: 458149 - RNA, 23 nt, Human
cuggacgcuuagacgugaacauc

SEQ ID NO: 458150 - RNA, 23 nt, Human
cuggacgcuuagacgugaacauc

SEQ ID NO: 458151 - RNA, 21 nt, Human
gaaaugaacugugcuaaaaac

SEQ ID NO: 458152 - RNA, 23 nt, Human
gagccugugugugugugugugug

SEQ ID NO: 458153 - RNA, 22 nt, Human
gauaagacaagcucggaagaaa

SEQ ID NO: 458154 - RNA, 25 nt, Human
gccugugugugugugugugugugug

SEQ ID NO: 458155 - RNA, 20 nt, Human
ggaauccagugggggauggg

SEQ ID NO: 458156 - RNA, 20 nt, Human
ggaauccagugggggauggg

SEQ ID NO: 458157 - RNA, 20 nt, Human
gggccucuaggaugucccag

SEQ ID NO: 458158 - RNA, 24 nt, Human
ggggaagcugugggaaggcuucca

SEQ ID NO: 458159 - RNA, 21 nt, Human
gggggaagcugugggaaggcu

SEQ ID NO: 458160 - RNA, 24 nt, Human
ggggggccagugcccagcucaaga

SEQ ID NO: 458161 - RNA, 21 nt, Human
guacuggcucaucguggccaa

SEQ ID NO: 458162 - RNA, 21 nt, Human
gugaacacacagccaccucgu

SEQ ID NO: 458163 - RNA, 21 nt, Human
gugugugugugugugugugug

SEQ ID NO: 458164 - RNA, 21 nt, Human
gugugugugugugugugugug

SEQ ID NO: 458165 - RNA, 21 nt, Human
gugugugugugugugugugug

SEQ ID NO: 458166 - RNA, 21 nt, Human
gugugugugugugugugugug

SEQ ID NO: 458167 - RNA, 18 nt, Human
uccccccgcccccacccc

SEQ ID NO: 458168 - RNA, 18 nt, Human
ucccucccgacagacccc

SEQ ID NO: 458169 - RNA, 19 nt, Human
ucccucccgacagaccccg

SEQ ID NO: 458170 - RNA, 20 nt, Human
ucccugcccuccccccacuc

SEQ ID NO: 458171 - RNA, 20 nt, Human
ucccuggaaagccagggccc

SEQ ID NO: 458172 - RNA, 20 nt, Human
ucccuggaaagccagggccc

SEQ ID NO: 458173 - RNA, 22 nt, Human
uccuuguagggaauccaguggg

SEQ ID NO: 458174 - RNA, 22 nt, Human
uccuuguagggaauccaguggg

SEQ ID NO: 458175 - RNA, 23 nt, Human
ucgggacucugccagucucuuuu

SEQ ID NO: 458176 - RNA, 23 nt, Human
ucgggacucugccagucucuuuu

SEQ ID NO: 458177 - RNA, 21 nt, Human
ucucgggacucugccagucuc

SEQ ID NO: 458178 - RNA, 21 nt, Human
ucucgggacucugccagucuc

SEQ ID NO: 458179 - RNA, 20 nt, Human
ucugcaauccucuaacccag

SEQ ID NO: 458180 - RNA, 20 nt, Human
ucuucccugcccucccccca

SEQ ID NO: 458181 - RNA, 18 nt, Human
ucuucugcaauccucuaa

SEQ ID NO: 458182 - RNA, 20 nt, Human
ugaaaggggccaaagcugug

SEQ ID NO: 458183 - RNA, 24 nt, Human
ugaaaugaacugugcuaaaaaccc

SEQ ID NO: 458184 - RNA, 25 nt, Human
ugaaaugaacugugcuaaaaacccg

SEQ ID NO: 458185 - RNA, 19 nt, Human
ugaacaucuuucucagcuc

SEQ ID NO: 458186 - RNA, 19 nt, Human
ugaacaucuuucucagcuc

SEQ ID NO: 458187 - RNA, 18 nt, Human
ugaggggggaaggacccc

SEQ ID NO: 458188 - RNA, 19 nt, Human
ugaggggggaaggaccccg

SEQ ID NO: 458189 - RNA, 22 nt, Human
ugagguugagcaagggccccuc

SEQ ID NO: 458190 - RNA, 20 nt, Human
ugcagagggauaaaaaacug

SEQ ID NO: 458191 - RNA, 24 nt, Human
ugggggaagcugugggaaggcuuc

SEQ ID NO: 458192 - RNA, 24 nt, Human
ugggggauggggacaugacuacag

SEQ ID NO: 458193 - RNA, 24 nt, Human
ugggggauggggacaugacuacag

SEQ ID NO: 458194 - RNA, 18 nt, Human
ugugcuaaaaacccgaca

SEQ ID NO: 458195 - RNA, 21 nt, Human
ugugugugaacacacagccac

SEQ ID NO: 458196 - RNA, 18 nt, Human
ugugugugugugugugug

SEQ ID NO: 458197 - RNA, 18 nt, Human
ugugugugugugugugug

SEQ ID NO: 458198 - RNA, 18 nt, Human
ugugugugugugugugug

SEQ ID NO: 458199 - RNA, 18 nt, Human
ugugugugugugugugug

SEQ ID NO: 458200 - RNA, 18 nt, Human
ugugugugugugugugug

SEQ ID NO: 458201 - RNA, 18 nt, Human
ugugugugugugugugug

SEQ ID NO: 458202 - RNA, 18 nt, Human
ugugugugugugugugug

SEQ ID NO: 458203 - RNA, 18 nt, Human
ugugugugugugugugug

SEQ ID NO: 458204 - RNA, 18 nt, Human
ugugugugugugugugug

SEQ ID NO: 458205 - RNA, 18 nt, Human
ugugugugugugugugug

SEQ ID NO: 458206 - RNA, 21 nt, Human
ugugugugugugugugugugu

SEQ ID NO: 458207 - RNA, 21 nt, Human
ugugugugugugugugugugu

SEQ ID NO: 458208 - RNA, 21 nt, Human
ugugugugugugugugugugu

SEQ ID NO: 458209 - RNA, 21 nt, Human
ugugugugugugugugugugu

SEQ ID NO: 458210 - RNA, 21 nt, Human
ugugugugugugugugugugu

SEQ ID NO: 458211 - RNA, 21 nt, Human
ugugugugugugugugugugu

SEQ ID NO: 458212 - RNA, 21 nt, Human
ugugugugugugugugugugu

SEQ ID NO: 458213 - RNA, 21 nt, Human
ugugugugugugugugugugu

SEQ ID NO: 458214 - RNA, 21 nt, Human
ugugugugugugugugugugu

SEQ ID NO: 458215 - RNA, 21 nt, Human
ugugugugugugugugugugu

SEQ ID NO: 458216 - RNA, 21 nt, Human
ugugugugugugugugugugu

SEQ ID NO: 458217 - RNA, 21 nt, Human
ugugugugugugugugugugu

SEQ ID NO: 458218 - RNA, 21 nt, Human
ugugugugugugugugugugu

SEQ ID NO: 458219 - RNA, 21 nt, Human
ugugugugugugugugugugu

SEQ ID NO: 458220 - RNA, 21 nt, Human
ugugugugugugugugugugu

SEQ ID NO: 458221 - RNA, 21 nt, Human
ugugugugugugugugugugu

SEQ ID NO: 458222 - RNA, 21 nt, Human
ugugugugugugugugugugu

SEQ ID NO: 458223 - RNA, 21 nt, Human
ugugugugugugugugugugu

SEQ ID NO: 458224 - RNA, 22 nt, Human
ugugugugugugugugugugug

SEQ ID NO: 458225 - RNA, 22 nt, Human
ugugugugugugugugugugug

SEQ ID NO: 458226 - RNA, 22 nt, Human
ugugugugugugugugugugug

SEQ ID NO: 458227 - RNA, 22 nt, Human
ugugugugugugugugugugug

SEQ ID NO: 458228 - RNA, 18 nt, Human
uuccccccgcccccaccc

SEQ ID NO: 458229 - RNA, 18 nt, Human
uuccccccgcccccaccc

SEQ ID NO: 458230 - RNA, 27 nt, Human
uucuccuuaaaagggaaggauuucaaa

SEQ ID NO: 458231 - RNA, 23 nt, Human
uugcaacauuccaagcccccccc

SEQ ID NO: 458232 - RNA, 20 nt, Human
uuuaaagguuuaaagaaaaa

SEQ ID NO: 458233 - RNA, 18 nt, Human
uuuugcaacauuccaagc

SEQ ID NO: 458234 - RNA, 21 nt, Human
aaguccuuuuucuugcagagu

SEQ ID NO: 458235 - RNA, 25 nt, Human
acaaaaugaggcaucugucgcuuga

SEQ ID NO: 458236 - RNA, 23 nt, Human
agaaacuguaagggaagagcggc

SEQ ID NO: 458237 - RNA, 20 nt, Human
agcggcucaggcagcucccg

SEQ ID NO: 458238 - RNA, 19 nt, Human
aggcaaaaaauauuucaga

SEQ ID NO: 458239 - RNA, 22 nt, Human
caaauacaauccccaagcuuug

SEQ ID NO: 458240 - RNA, 19 nt, Human
cagaugagagccaaaaauu

SEQ ID NO: 458241 - RNA, 26 nt, Human
caucauuaaguuuucacaaaaugagg

SEQ ID NO: 458242 - RNA, 26 nt, Human
cauccuagaccucuuuucucaacagc

SEQ ID NO: 458243 - RNA, 19 nt, Human
ccaaaaauuugaucuuuaa

SEQ ID NO: 458244 - RNA, 25 nt, Human
ccaaaauuccagccuuccuccuucc

SEQ ID NO: 458245 - RNA, 23 nt, Human
ccuaacucguuaaugacucuuuc

SEQ ID NO: 458246 - RNA, 26 nt, Human
ccucccacuggcugucgucccaaaau

SEQ ID NO: 458247 - RNA, 24 nt, Human
ccuguaauuguugcccagauugcc

SEQ ID NO: 458248 - RNA, 19 nt, Human
cggcucaggcagcucccgg

SEQ ID NO: 458249 - RNA, 23 nt, Human
cucaacagcuucaaugcauugcu

SEQ ID NO: 458250 - RNA, 23 nt, Human
cuuccuguaauuguugcccagau

SEQ ID NO: 458251 - RNA, 22 nt, Human
gcguggacaugagguucuugga

SEQ ID NO: 458252 - RNA, 27 nt, Human
uaauaaguccuuuuucuugcagaguuu

SEQ ID NO: 458253 - RNA, 21 nt, Human
uacaaaccacggaacugugga

SEQ ID NO: 458254 - RNA, 23 nt, Human
uagaccucuuuucucaacagcuu

SEQ ID NO: 458255 - RNA, 20 nt, Human
uauagugcuauccuuuucuc

SEQ ID NO: 458256 - RNA, 21 nt, Human
uccacaaacugcucaaagaaa

SEQ ID NO: 458257 - RNA, 25 nt, Human
ucccaaaauuccagccuuccuccuu

SEQ ID NO: 458258 - RNA, 19 nt, Human
uccccaagcuuugcgugga

SEQ ID NO: 458259 - RNA, 22 nt, Human
uccucugagccgaagaucuuac

SEQ ID NO: 458260 - RNA, 18 nt, Human
ucugguagaccaugugga

SEQ ID NO: 458261 - RNA, 20 nt, Human
ucugguagaccauguggauc

SEQ ID NO: 458262 - RNA, 19 nt, Human
ucugucagucuuccucuga

SEQ ID NO: 458263 - RNA, 27 nt, Human
ucuuguguuguugucuugcuuuuugau

SEQ ID NO: 458264 - RNA, 19 nt, Human
ugacaacguggauguccuc

SEQ ID NO: 458265 - RNA, 21 nt, Human
ugaggcaucugucgcuugaaa

SEQ ID NO: 458266 - RNA, 21 nt, Human
ugagguucuuggaggcuuugg

SEQ ID NO: 458267 - RNA, 21 nt, Human
uggcugucgucccaaaauucc

SEQ ID NO: 458268 - RNA, 18 nt, Human
ugucacgauuuggcggag

SEQ ID NO: 458269 - RNA, 23 nt, Human
ugucuugcuuuuugaucgcuucc

SEQ ID NO: 458270 - RNA, 21 nt, Human
uuacaaaccacggaacugugg

SEQ ID NO: 458271 - RNA, 23 nt, Human
uuauugacaaugccaucaacucc

SEQ ID NO: 458272 - RNA, 24 nt, Human
uuauugacaaugccaucaacuccu

SEQ ID NO: 458273 - RNA, 23 nt, Human
uucaaugcauugcuuuacaaacc

SEQ ID NO: 458274 - RNA, 19 nt, Human
uucacguucacacacuuug

SEQ ID NO: 458275 - RNA, 23 nt, Human
uugcguggacaugagguucuugg

SEQ ID NO: 458276 - RNA, 21 nt, Human
uuucucggcaaugaccuguua

SEQ ID NO: 458277 - RNA, 28 nt, Human
uuuuuuauugucaauuauuuuauucaaa

SEQ ID NO: 458278 - RNA, 20 nt, Human
aaaacaaccagccagaaaga

SEQ ID NO: 458279 - RNA, 19 nt, Human
aaacaaaggcuuacaugca

SEQ ID NO: 458280 - RNA, 24 nt, Human
aaacaggccaggcagaggccaggc

SEQ ID NO: 458281 - RNA, 20 nt, Human
aacacauaaagccaaaggcc

SEQ ID NO: 458282 - RNA, 21 nt, Human
aagaagagguaauauccagaa

SEQ ID NO: 458283 - RNA, 20 nt, Human
aagccacaaagccuccaccg

SEQ ID NO: 458284 - RNA, 19 nt, Human
aaguagccccacaccaggg

SEQ ID NO: 458285 - RNA, 23 nt, Human
aaugguauggagacccacaggga

SEQ ID NO: 458286 - RNA, 24 nt, Human
acaacaaaaaaacaauuucacaag

SEQ ID NO: 458287 - RNA, 21 nt, Human
acaaccagccagaaagaaccu

SEQ ID NO: 458288 - RNA, 24 nt, Human
acaauggucagugugucccagagc

SEQ ID NO: 458289 - RNA, 18 nt, Human
acacacauacacacauau

SEQ ID NO: 458290 - RNA, 20 nt, Human
acacccugagaauagaauuc

SEQ ID NO: 458291 - RNA, 22 nt, Human
acccccacccucagcaagccac

SEQ ID NO: 458292 - RNA, 24 nt, Human
accuugauccagagaggggagaac

SEQ ID NO: 458293 - RNA, 24 nt, Human
agaaacccaacccucccugagguc

SEQ ID NO: 458294 - RNA, 24 nt, Human
agaaauuaaaaaaaauuaaaacac

SEQ ID NO: 458295 - RNA, 20 nt, Human
agaaggccugcagagccaug

SEQ ID NO: 458296 - RNA, 23 nt, Human
agagaaacccaacccucccugag

SEQ ID NO: 458297 - RNA, 24 nt, Human
agaggcagagugcccagaccccag

SEQ ID NO: 458298 - RNA, 22 nt, Human
agagguauguuguuuccaagga

SEQ ID NO: 458299 - RNA, 19 nt, Human
agcaagagaaggcugccag

SEQ ID NO: 458300 - RNA, 19 nt, Human
agccagaaguuugguucau

SEQ ID NO: 458301 - RNA, 23 nt, Human
agccauggugaccaaagucuucc

SEQ ID NO: 458302 - RNA, 23 nt, Human
aggcagaggccaggcugaguccu

SEQ ID NO: 458303 - RNA, 24 nt, Human
aggcagagugcccagaccccaggg

SEQ ID NO: 458304 - RNA, 25 nt, Human
aggcagagugcccagaccccagggc

SEQ ID NO: 458305 - RNA, 19 nt, Human
aggcauuucuuucccgagg

SEQ ID NO: 458306 - RNA, 25 nt, Human
aggggccaguuuagaucacuaagcc

SEQ ID NO: 458307 - RNA, 20 nt, Human
aggggguggaggucgggggg

SEQ ID NO: 458308 - RNA, 24 nt, Human
aguggcugcuguaaauaaucccgg

SEQ ID NO: 458309 - RNA, 22 nt, Human
aguuccucuggaaaaaccacag

SEQ ID NO: 458310 - RNA, 23 nt, Human
auaaagccaaaggcucuguacag

SEQ ID NO: 458311 - RNA, 26 nt, Human
auaacaacaaaaaaacaauuucacaa

SEQ ID NO: 458312 - RNA, 21 nt, Human
caacaaaaaaacaauuucaca

SEQ ID NO: 458313 - RNA, 20 nt, Human
caacaguguuugacaaaggc

SEQ ID NO: 458314 - RNA, 18 nt, Human
caacuucuagaaaccccu

SEQ ID NO: 458315 - RNA, 23 nt, Human
caagacucaaaaguccccaccag

SEQ ID NO: 458316 - RNA, 18 nt, Human
caagccacaaagccucca

SEQ ID NO: 458317 - RNA, 18 nt, Human
caagcugguccccggcuc

SEQ ID NO: 458318 - RNA, 19 nt, Human
caagcugguccccggcucc

SEQ ID NO: 458319 - RNA, 18 nt, Human
caagggccugacagagaa

SEQ ID NO: 458320 - RNA, 19 nt, Human
caaggggucuggggucccc

SEQ ID NO: 458321 - RNA, 20 nt, Human
cacaaaguuugacucugagg

SEQ ID NO: 458322 - RNA, 24 nt, Human
cacacagcuuagugagcagaacac

SEQ ID NO: 458323 - RNA, 18 nt, Human
cacagggaaggcugaauu

SEQ ID NO: 458324 - RNA, 25 nt, Human
caccuccccaucaagucccucaaaa

SEQ ID NO: 458325 - RNA, 24 nt, Human
caccugcacagagagagggggcag

SEQ ID NO: 458326 - RNA, 21 nt, Human
cacuggccaccugcacagaga

SEQ ID NO: 458327 - RNA, 20 nt, Human
cagaaagaaccuuucuccuu

SEQ ID NO: 458328 - RNA, 24 nt, Human
cagaacacaagcugaauuccagcc

SEQ ID NO: 458329 - RNA, 20 nt, Human
cagagagaaauuaaaaaaaa

SEQ ID NO: 458330 - RNA, 21 nt, Human
cagagcagggaggggcacugg

SEQ ID NO: 458331 - RNA, 24 nt, Human
cagagccauggugaccaaagucuu

SEQ ID NO: 458332 - RNA, 20 nt, Human
cagcugggccccucuggguc

SEQ ID NO: 458333 - RNA, 24 nt, Human
caggagcagugagacaggucagcu

SEQ ID NO: 458334 - RNA, 22 nt, Human
cagggaugggguagaaggcuag

SEQ ID NO: 458335 - RNA, 18 nt, Human
cagucagaccaccuucca

SEQ ID NO: 458336 - RNA, 24 nt, Human
cagucccucucccaacccccaccc

SEQ ID NO: 458337 - RNA, 21 nt, Human
cagucuucaagcugguccccc

SEQ ID NO: 458338 - RNA, 19 nt, Human
cagugcagucagaccaccu

SEQ ID NO: 458339 - RNA, 23 nt, Human
ccaaggaaaccaaggggucuggg

SEQ ID NO: 458340 - RNA, 23 nt, Human
ccacagcacucuuccugggaggc

SEQ ID NO: 458341 - RNA, 20 nt, Human
ccagacgguguuccuggugc

SEQ ID NO: 458342 - RNA, 21 nt, Human
ccagcuggucccaggccgcca

SEQ ID NO: 458343 - RNA, 19 nt, Human
ccaggccgccagugguggc

SEQ ID NO: 458344 - RNA, 20 nt, Human
cccaacccccacccucagcc

SEQ ID NO: 458345 - RNA, 23 nt, Human
cccacaccagggcacgcacacag

SEQ ID NO: 458346 - RNA, 22 nt, Human
cccacugcaaacuugcccccga

SEQ ID NO: 458347 - RNA, 21 nt, Human
cccagacuuugaaacaggcca

SEQ ID NO: 458348 - RNA, 21 nt, Human
cccaggccagcacugauuugc

SEQ ID NO: 458349 - RNA, 24 nt, Human
ccccaccagcccucaggcugccua

SEQ ID NO: 458350 - RNA, 23 nt, Human
cccccacccucagcaagccacaa

SEQ ID NO: 458351 - RNA, 24 nt, Human
ccccuuucuucuuccucucuccca

SEQ ID NO: 458352 - RNA, 18 nt, Human
cccgcuucugccacgucc

SEQ ID NO: 458353 - RNA, 21 nt, Human
cccucaaaaagaagugcucac

SEQ ID NO: 458354 - RNA, 19 nt, Human
cccugaggucugcuggagg

SEQ ID NO: 458355 - RNA, 20 nt, Human
cccuuucuucuuccucucuc

SEQ ID NO: 458356 - RNA, 20 nt, Human
ccucccaggcauuucuuucc

SEQ ID NO: 458357 - RNA, 24 nt, Human
ccugcacaacuguacauccagaag

SEQ ID NO: 458358 - RNA, 24 nt, Human
ccugcccgauguccuuccuguucc

SEQ ID NO: 458359 - RNA, 22 nt, Human
ccugcuggguuccagagcaugc

SEQ ID NO: 458360 - RNA, 24 nt, Human
ccugucaccaccuugauccagaga

SEQ ID NO: 458361 - RNA, 18 nt, Human
ccuuccaccugccccagg

SEQ ID NO: 458362 - RNA, 19 nt, Human
cgauagccccuguggaucc

SEQ ID NO: 458363 - RNA, 21 nt, Human
cucccaacccccacccucagc

SEQ ID NO: 458364 - RNA, 19 nt, Human
cucucccaacccccacccu

SEQ ID NO: 458365 - RNA, 22 nt, Human
cugaagaccuccucuccucaga

SEQ ID NO: 458366 - RNA, 20 nt, Human
cugagcaccuuuagcuggga

SEQ ID NO: 458367 - RNA, 19 nt, Human
cugaggucugcuggaggug

SEQ ID NO: 458368 - RNA, 21 nt, Human
cugcacagagagagggggcag

SEQ ID NO: 458369 - RNA, 21 nt, Human
cugccagcuaccuccuggguu

SEQ ID NO: 458370 - RNA, 24 nt, Human
cuguccaggacagucaccguggcu

SEQ ID NO: 458371 - RNA, 27 nt, Human
cuugcccccgaugucccucagugccga

SEQ ID NO: 458372 - RNA, 24 nt, Human
gaaccuuucuccuuccugacagcu

SEQ ID NO: 458373 - RNA, 20 nt, Human
gaacuggaagacuugggcuu

SEQ ID NO: 458374 - RNA, 23 nt, Human
gaauaacccccaggcaggggcca

SEQ ID NO: 458375 - RNA, 18 nt, Human
gagaaggcugccaguggc

SEQ ID NO: 458376 - RNA, 25 nt, Human
gagcagaacacaagcugaauuccag

SEQ ID NO: 458377 - RNA, 18 nt, Human
gagcaugcccuucuggcc

SEQ ID NO: 458378 - RNA, 20 nt, Human
gagcugccacaccggcugcu

SEQ ID NO: 458379 - RNA, 23 nt, Human
gagggggcaguggggcucugagc

SEQ ID NO: 458380 - RNA, 20 nt, Human
gagugaguuccuggcuuugc

SEQ ID NO: 458381 - RNA, 18 nt, Human
gaucacggcccccaucca

SEQ ID NO: 458382 - RNA, 18 nt, Human
gauguggagcuggccggc

SEQ ID NO: 458383 - RNA, 21 nt, Human
gcagaggccaggcugaguccu

SEQ ID NO: 458384 - RNA, 19 nt, Human
gccaggcagaggccaggcu

SEQ ID NO: 458385 - RNA, 24 nt, Human
gccccacaccagggcacgcacaca

SEQ ID NO: 458386 - RNA, 26 nt, Human
gccccacugcaaacuugcccccgaug

SEQ ID NO: 458387 - RNA, 24 nt, Human
gcucauagguuugguggaacuggg

SEQ ID NO: 458388 - RNA, 23 nt, Human
gcucugagcaccuuuagcuggga

SEQ ID NO: 458389 - RNA, 20 nt, Human
gcuggagguggcaggagcug

SEQ ID NO: 458390 - RNA, 24 nt, Human
ggaaaccaaggggucugggguccc

SEQ ID NO: 458391 - RNA, 20 nt, Human
ggaagacgugcacaggcagc

SEQ ID NO: 458392 - RNA, 21 nt, Human
ggacuucccucaccagaucug

SEQ ID NO: 458393 - RNA, 20 nt, Human
ggaggcuggcugggcaccua

SEQ ID NO: 458394 - RNA, 18 nt, Human
ggcaggagcuggccagga

SEQ ID NO: 458395 - RNA, 19 nt, Human
ggcugccaguggcccagac

SEQ ID NO: 458396 - RNA, 23 nt, Human
gggaggcccuggcugaaccgucc

SEQ ID NO: 458397 - RNA, 23 nt, Human
ggggauggagucugagggggugg

SEQ ID NO: 458398 - RNA, 19 nt, Human
gggggugggggauggaguc

SEQ ID NO: 458399 - RNA, 22 nt, Human
gggugacaggugagccccuucc

SEQ ID NO: 458400 - RNA, 24 nt, Human
gguaugaaaaaggacuggggauaa

SEQ ID NO: 458401 - RNA, 23 nt, Human
ggucacaaaguuugacucugagg

SEQ ID NO: 458402 - RNA, 22 nt, Human
ggucgggggggaggggcagguc

SEQ ID NO: 458403 - RNA, 19 nt, Human
ggucuccucgauagccccu

SEQ ID NO: 458404 - RNA, 20 nt, Human
ggugggggauggagucugag

SEQ ID NO: 458405 - RNA, 22 nt, Human
guagaaggcuagcaaugcuccc

SEQ ID NO: 458406 - RNA, 23 nt, Human
guagcccugaggucuucuuuguc

SEQ ID NO: 458407 - RNA, 20 nt, Human
guaugaaaaaggacugggga

SEQ ID NO: 458408 - RNA, 23 nt, Human
guccacuucccagagaacaucac

SEQ ID NO: 458409 - RNA, 20 nt, Human
gucugaggggguggaggucg

SEQ ID NO: 458410 - RNA, 30 nt, Human
uaaaacacaaaauaacaacaaaaaaacaaa

SEQ ID NO: 458411 - RNA, 20 nt, Human
uaaaaugguauggagaccca

SEQ ID NO: 458412 - RNA, 23 nt, Human
uaaauaaucccgguuuuuuggug

SEQ ID NO: 458413 - RNA, 22 nt, Human
uaacugaguuccucuggaaaaa

SEQ ID NO: 458414 - RNA, 23 nt, Human
uacacaucauaaaaugguaugga

SEQ ID NO: 458415 - RNA, 19 nt, Human
uacaggucaggauccaggu

SEQ ID NO: 458416 - RNA, 31 nt, Human
uaccccaccuccccaucaagucccucaaaag

SEQ ID NO: 458417 - RNA, 22 nt, Human
uacucuaaaagucacuuagcug

SEQ ID NO: 458418 - RNA, 18 nt, Human
uacucuagacuccuccua

SEQ ID NO: 458419 - RNA, 18 nt, Human
uagcuggcaaagccacug

SEQ ID NO: 458420 - RNA, 23 nt, Human
ucacaaaguuugacucugagggu

SEQ ID NO: 458421 - RNA, 19 nt, Human
ucacuaacggaucaucuuc

SEQ ID NO: 458422 - RNA, 21 nt, Human
ucacugggguagcaugcuccu

SEQ ID NO: 458423 - RNA, 20 nt, Human
ucagugugucccagagccag

SEQ ID NO: 458424 - RNA, 18 nt, Human
uccacagcacucuuccug

SEQ ID NO: 458425 - RNA, 23 nt, Human
uccacccucauugcaggagucca

SEQ ID NO: 458426 - RNA, 19 nt, Human
uccaccgucuucagcuggu

SEQ ID NO: 458427 - RNA, 21 nt, Human
uccagaauaucugagcagaac

SEQ ID NO: 458428 - RNA, 21 nt, Human
uccaggucagacucucccucc

SEQ ID NO: 458429 - RNA, 20 nt, Human
ucccaacccccacccucagc

SEQ ID NO: 458430 - RNA, 23 nt, Human
ucccaacccccacccucagcaag

SEQ ID NO: 458431 - RNA, 25 nt, Human
ucccaacccccacccucagcaagcc

SEQ ID NO: 458432 - RNA, 18 nt, Human
ucccagagccagucuuca

SEQ ID NO: 458433 - RNA, 18 nt, Human
ucccagaggcagagugcc

SEQ ID NO: 458434 - RNA, 22 nt, Human
ucccagaggcagagugcccaga

SEQ ID NO: 458435 - RNA, 20 nt, Human
uccccggcuccuucucugca

SEQ ID NO: 458436 - RNA, 23 nt, Human
uccccggcuccuucucuggggcc

SEQ ID NO: 458437 - RNA, 23 nt, Human
ucccugaggucugcuggaggugg

SEQ ID NO: 458438 - RNA, 18 nt, Human
uccucgauagccccugug

SEQ ID NO: 458439 - RNA, 19 nt, Human
uccucgauagccccugugg

SEQ ID NO: 458440 - RNA, 19 nt, Human
uccuggggccuccaagugg

SEQ ID NO: 458441 - RNA, 24 nt, Human
uccuggguuuuguugguggggaag

SEQ ID NO: 458442 - RNA, 22 nt, Human
uccuuggguagcccugaggucu

SEQ ID NO: 458443 - RNA, 24 nt, Human
ucucccagaggcagagugcccaga

SEQ ID NO: 458444 - RNA, 23 nt, Human
ugaaacaggccaggcagaggcca

SEQ ID NO: 458445 - RNA, 23 nt, Human
ugaaagaagagcugacaaaggca

SEQ ID NO: 458446 - RNA, 23 nt, Human
ugaaagaagagcugacaaaggca

SEQ ID NO: 458447 - RNA, 26 nt, Human
ugaagaacauaaacacauaaagccaa

SEQ ID NO: 458448 - RNA, 25 nt, Human
ugaccaaagucuucccgcuucugcc

SEQ ID NO: 458449 - RNA, 19 nt, Human
ugaccaacuucuagaaacc

SEQ ID NO: 458450 - RNA, 19 nt, Human
ugagacaggucagcugggc

SEQ ID NO: 458451 - RNA, 21 nt, Human
ugagacaggucagcugggccc

SEQ ID NO: 458452 - RNA, 18 nt, Human
ugagggaggucacuggga

SEQ ID NO: 458453 - RNA, 20 nt, Human
ugaggggguggaggucgggg

SEQ ID NO: 458454 - RNA, 23 nt, Human
ugagggguccuuagagaaaccca

SEQ ID NO: 458455 - RNA, 18 nt, Human
ugcacagagagagggggc

SEQ ID NO: 458456 - RNA, 22 nt, Human
ugcagucagaccaccuuccacc

SEQ ID NO: 458457 - RNA, 20 nt, Human
ugcccagaccccagggcagc

SEQ ID NO: 458458 - RNA, 22 nt, Human
ugcccuggcucacuuaagacag

SEQ ID NO: 458459 - RNA, 21 nt, Human
ugccugucaccaccuugaucc

SEQ ID NO: 458460 - RNA, 21 nt, Human
ugcgacauguuugaggggucc

SEQ ID NO: 458461 - RNA, 21 nt, Human
ugcuggagguggcaggagcug

SEQ ID NO: 458462 - RNA, 21 nt, Human
uggcaaagccacuguccuggc

SEQ ID NO: 458463 - RNA, 23 nt, Human
uggcaaagccacuguccuggcuu

SEQ ID NO: 458464 - RNA, 18 nt, Human
uggcaaggucucugaagc

SEQ ID NO: 458465 - RNA, 20 nt, Human
uggcccagacuuugaaacag

SEQ ID NO: 458466 - RNA, 21 nt, Human
uggcccagacuuugaaacagg

SEQ ID NO: 458467 - RNA, 20 nt, Human
uggccgaagcccugcugggu

SEQ ID NO: 458468 - RNA, 18 nt, Human
uggccuagcuggaagcug

SEQ ID NO: 458469 - RNA, 19 nt, Human
uggccuggggacuucccuc

SEQ ID NO: 458470 - RNA, 22 nt, Human
ugggaggcuggcugggcaccua

SEQ ID NO: 458471 - RNA, 24 nt, Human
ugggaggcuggcugggcaccuaug

SEQ ID NO: 458472 - RNA, 25 nt, Human
uggggacuucccucaccagaucugu

SEQ ID NO: 458473 - RNA, 21 nt, Human
uggggauaagggggaagaggu

SEQ ID NO: 458474 - RNA, 24 nt, Human
ugggggcugagggaggucacuggg

SEQ ID NO: 458475 - RNA, 22 nt, Human
ugggggugggggauggagucug

SEQ ID NO: 458476 - RNA, 22 nt, Human
ugggucuccucgauagccccug

SEQ ID NO: 458477 - RNA, 18 nt, Human
uguacagauuuuuaaaaa

SEQ ID NO: 458478 - RNA, 23 nt, Human
uguggauccagggaugggguaga

SEQ ID NO: 458479 - RNA, 21 nt, Human
uguugguggggaagaagggag

SEQ ID NO: 458480 - RNA, 20 nt, Human
uuacaggucaggauccaggu

SEQ ID NO: 458481 - RNA, 21 nt, Human
uuacaggucaggauccagguc

SEQ ID NO: 458482 - RNA, 20 nt, Human
uucacuguuagcaccaaugu

SEQ ID NO: 458483 - RNA, 20 nt, Human
uuccucagucgaagaaucua

SEQ ID NO: 458484 - RNA, 19 nt, Human
uuccucuggaaaaaccaca

SEQ ID NO: 458485 - RNA, 22 nt, Human
uucggacacagaccuacucccc

SEQ ID NO: 458486 - RNA, 19 nt, Human
uucucacauaugcaaaagu

SEQ ID NO: 458487 - RNA, 22 nt, Human
uucuuuguccagggaagccguc

SEQ ID NO: 458488 - RNA, 23 nt, Human
uuuccagucccucucccaacccc

SEQ ID NO: 458489 - RNA, 18 nt, Human
uuucccgaggaggaaggu

SEQ ID NO: 458490 - RNA, 18 nt, Human
uuugugagucuacucuag

SEQ ID NO: 458491 - RNA, 18 nt, Human
aacucuuccucucucucu

SEQ ID NO: 458492 - RNA, 19 nt, Human
ccuacaacaaacugaccug

SEQ ID NO: 458493 - RNA, 23 nt, Human
ccucccccuaccacucuuccucu

SEQ ID NO: 458494 - RNA, 20 nt, Human
ccucuauuacuguacacccu

SEQ ID NO: 458495 - RNA, 18 nt, Human
ccucucucucucccuccc

SEQ ID NO: 458496 - RNA, 19 nt, Human
cgagcuccuaggccaagcc

SEQ ID NO: 458497 - RNA, 21 nt, Human
cuucccugggcucuaaguggc

SEQ ID NO: 458498 - RNA, 18 nt, Human
gcucuaaguggcaguuuu

SEQ ID NO: 458499 - RNA, 21 nt, Human
ucccugggcucuaaguggcag

SEQ ID NO: 458500 - RNA, 21 nt, Human
uccugaaggcagcaagccucu

SEQ ID NO: 458501 - RNA, 22 nt, Human
ucucucucucccucccccuacc

SEQ ID NO: 458502 - RNA, 20 nt, Human
ucuuguggaacguaaauguc

SEQ ID NO: 458503 - RNA, 21 nt, Human
ucuuguggaacguaaaugucu

SEQ ID NO: 458504 - RNA, 19 nt, Human
ugggcucuaaguggcaguu

SEQ ID NO: 458505 - RNA, 20 nt, Human
uuccuacaacaaacugaccu

SEQ ID NO: 458506 - RNA, 23 nt, Human
uuccugaaggcagcaagccucua

SEQ ID NO: 458507 - RNA, 20 nt, Human
aaaaaaacccagagcucugc

SEQ ID NO: 458508 - RNA, 21 nt, Human
aaaaaaacccagagcucugca

SEQ ID NO: 458509 - RNA, 18 nt, Human
aaaaaacaaaaaaaccca

SEQ ID NO: 458510 - RNA, 21 nt, Human
aaaaauacagguuuugaaagc

SEQ ID NO: 458511 - RNA, 25 nt, Human
aaacaaaaaaacccagagcucugca

SEQ ID NO: 458512 - RNA, 22 nt, Human
aaacaaaaaacaaaaaaaccca

SEQ ID NO: 458513 - RNA, 25 nt, Human
aaacaaaaaacaaaaaaacccagag

SEQ ID NO: 458514 - RNA, 19 nt, Human
aaagugcugggauuacaga

SEQ ID NO: 458515 - RNA, 24 nt, Human
aaagugcugggauuacagacguga

SEQ ID NO: 458516 - RNA, 20 nt, Human
aaauuaggacccaaaaagau

SEQ ID NO: 458517 - RNA, 18 nt, Human
aacaaaaaaacccagagc

SEQ ID NO: 458518 - RNA, 23 nt, Human
aacaaaaaacaaaaaaacccaga

SEQ ID NO: 458519 - RNA, 19 nt, Human
aacauggugaaaccccguc

SEQ ID NO: 458520 - RNA, 20 nt, Human
aacauggugaaaccccgucu

SEQ ID NO: 458521 - RNA, 21 nt, Human
aacauggugaaaccccgucuc

SEQ ID NO: 458522 - RNA, 21 nt, Human
aacugguucuaaggcccuuua

SEQ ID NO: 458523 - RNA, 22 nt, Human
aagccucuuccauccaaggcac

SEQ ID NO: 458524 - RNA, 21 nt, Human
aaggaaaaagggcauacagcg

SEQ ID NO: 458525 - RNA, 19 nt, Human
aaggcccuuuauccagucc

SEQ ID NO: 458526 - RNA, 22 nt, Human
aagguggaaggaucacaguccc

SEQ ID NO: 458527 - RNA, 22 nt, Human
aaguaggauuaaaacccagagc

SEQ ID NO: 458528 - RNA, 19 nt, Human
aagugcugggauuacagac

SEQ ID NO: 458529 - RNA, 26 nt, Human
aagugcugggauuacagacgugagcc

SEQ ID NO: 458530 - RNA, 19 nt, Human
acaccuguaaucucggcac

SEQ ID NO: 458531 - RNA, 18 nt, Human
acagacgugagccaccgc

SEQ ID NO: 458532 - RNA, 20 nt, Human
acagagcgagacuccgucuc

SEQ ID NO: 458533 - RNA, 24 nt, Human
acagagcgagacuccgucucaaaa

SEQ ID NO: 458534 - RNA, 24 nt, Human
accccgucucuacuaaaaauacaa

SEQ ID NO: 458535 - RNA, 24 nt, Human
acccuaagacagcccccaagaaga

SEQ ID NO: 458536 - RNA, 26 nt, Human
acccuaagacagcccccaagaagaaa

SEQ ID NO: 458537 - RNA, 20 nt, Human
acgugagccaccgcgcccga

SEQ ID NO: 458538 - RNA, 24 nt, Human
acuccuucccaggcucacaggcag

SEQ ID NO: 458539 - RNA, 23 nt, Human
acugcacuccagccuggcgacag

SEQ ID NO: 458540 - RNA, 25 nt, Human
acugcacuccagccuggcgacagag

SEQ ID NO: 458541 - RNA, 20 nt, Human
acuggaaugaaagucaccca

SEQ ID NO: 458542 - RNA, 22 nt, Human
agaaaagaucaagggaacugaa

SEQ ID NO: 458543 - RNA, 19 nt, Human
agacaggaggaaaauuagg

SEQ ID NO: 458544 - RNA, 22 nt, Human
agacaggaggaaaauuaggacc

SEQ ID NO: 458545 - RNA, 25 nt, Human
agacaggaggaaaauuaggacccaa

SEQ ID NO: 458546 - RNA, 23 nt, Human
agcagacaugacuuagaaggaaa

SEQ ID NO: 458547 - RNA, 22 nt, Human
agcagaucaguuucccagccuc

SEQ ID NO: 458548 - RNA, 19 nt, Human
agccaccgcgcccgaccac

SEQ ID NO: 458549 - RNA, 21 nt, Human
agccuggcgacagagcgagac

SEQ ID NO: 458550 - RNA, 23 nt, Human
agccuggcgacagagcgagacuc

SEQ ID NO: 458551 - RNA, 23 nt, Human
agcugggcgugguggcgugcgcc

SEQ ID NO: 458552 - RNA, 18 nt, Human
agcugguugucccagccc

SEQ ID NO: 458553 - RNA, 18 nt, Human
aggcagaagaauggcuug

SEQ ID NO: 458554 - RNA, 19 nt, Human
aggcaggcuggcugucagg

SEQ ID NO: 458555 - RNA, 23 nt, Human
aggccgaggcgggcagaucacga

SEQ ID NO: 458556 - RNA, 21 nt, Human
aggcggagguugcagugagcc

SEQ ID NO: 458557 - RNA, 24 nt, Human
aggcggagguugcagugagccgag

SEQ ID NO: 458558 - RNA, 24 nt, Human
aggcgggcagaucacgaggucaag

SEQ ID NO: 458559 - RNA, 24 nt, Human
aggcugaggcagaagaauggcuug

SEQ ID NO: 458560 - RNA, 24 nt, Human
agugcugggauuacagacgugagc

SEQ ID NO: 458561 - RNA, 21 nt, Human
aguugcuccacccaacaucug

SEQ ID NO: 458562 - RNA, 20 nt, Human
auccugccauuccuccuuca

SEQ ID NO: 458563 - RNA, 21 nt, Human
auccuggccaacauggugaaa

SEQ ID NO: 458564 - RNA, 24 nt, Human
aucgcaccacugcacuccagccug

SEQ ID NO: 458565 - RNA, 18 nt, Human
caaaaaaacccagagcuc

SEQ ID NO: 458566 - RNA, 22 nt, Human
caaaaaacaaaaaaacccagag

SEQ ID NO: 458567 - RNA, 24 nt, Human
caaagugcugggauuacagacgug

SEQ ID NO: 458568 - RNA, 22 nt, Human
caacaucugucuuuuuuccugc

SEQ ID NO: 458569 - RNA, 24 nt, Human
caacauggugaaaccccgucucua

SEQ ID NO: 458570 - RNA, 22 nt, Human
caagggaacugaauaguaggua

SEQ ID NO: 458571 - RNA, 24 nt, Human
cacaccuguaaucucggcacuuug

SEQ ID NO: 458572 - RNA, 19 nt, Human
caccacuugcuagaagcag

SEQ ID NO: 458573 - RNA, 23 nt, Human
caccuguaaucucggcacuuugg

SEQ ID NO: 458574 - RNA, 24 nt, Human
caccuguaaucucggcacuuuggg

SEQ ID NO: 458575 - RNA, 22 nt, Human
cacuccagccuggcgacagagc

SEQ ID NO: 458576 - RNA, 23 nt, Human
cacuccagccuggcgacagagcg

SEQ ID NO: 458577 - RNA, 18 nt, Human
cacugcacuccagccugg

SEQ ID NO: 458578 - RNA, 18 nt, Human
cacugcacuccagccugg

SEQ ID NO: 458579 - RNA, 22 nt, Human
cacugcacuccagccuggcgac

SEQ ID NO: 458580 - RNA, 23 nt, Human
cacugcacuccagccuggcgaca

SEQ ID NO: 458581 - RNA, 23 nt, Human
cacugcacuccagccuggcgaca

SEQ ID NO: 458582 - RNA, 21 nt, Human
cagagcagaggauaggccuuc

SEQ ID NO: 458583 - RNA, 18 nt, Human
cagagcucugcauauccc

SEQ ID NO: 458584 - RNA, 18 nt, Human
cagcccccaagaagaaaa

SEQ ID NO: 458585 - RNA, 20 nt, Human
cagccuccucaggaagcaau

SEQ ID NO: 458586 - RNA, 21 nt, Human
cagcgguucuucaagauuuaa

SEQ ID NO: 458587 - RNA, 19 nt, Human
cagcugccugugaaucucc

SEQ ID NO: 458588 - RNA, 20 nt, Human
caguaauugagauacagagc

SEQ ID NO: 458589 - RNA, 20 nt, Human
cauacagcgguucuucaaga

SEQ ID NO: 458590 - RNA, 27 nt, Human
cauccugccauuccuccuucagcucca

SEQ ID NO: 458591 - RNA, 26 nt, Human
caucugucuuuuuuccugccucuugu

SEQ ID NO: 458592 - RNA, 22 nt, Human
ccaaagugcugggauuacagac

SEQ ID NO: 458593 - RNA, 22 nt, Human
ccaaagugcugggauuacagac

SEQ ID NO: 458594 - RNA, 24 nt, Human
ccaaagugcugggauuacagacgu

SEQ ID NO: 458595 - RNA, 21 nt, Human
ccaacacuuccuuaccucuuu

SEQ ID NO: 458596 - RNA, 20 nt, Human
ccaagaagaaaagaucaagg

SEQ ID NO: 458597 - RNA, 19 nt, Human
ccacugcacuccagccugg

SEQ ID NO: 458598 - RNA, 19 nt, Human
ccacugcacuccagccugg

SEQ ID NO: 458599 - RNA, 20 nt, Human
ccacugcacuccagccuggc

SEQ ID NO: 458600 - RNA, 22 nt, Human
ccacugcacuccagccuggcga

SEQ ID NO: 458601 - RNA, 23 nt, Human
ccacugcacuccagccuggcgac

SEQ ID NO: 458602 - RNA, 22 nt, Human
cccagagcucuggccgagcgcg

SEQ ID NO: 458603 - RNA, 20 nt, Human
cccagccucaaagcccugcu

SEQ ID NO: 458604 - RNA, 19 nt, Human
cccccaacacuuccuuacc

SEQ ID NO: 458605 - RNA, 18 nt, Human
cccugcugaaaguagggu

SEQ ID NO: 458606 - RNA, 25 nt, Human
ccgucucaaaaaacaaaaaacaaaa

SEQ ID NO: 458607 - RNA, 18 nt, Human
ccuccuucagcuccaacu

SEQ ID NO: 458608 - RNA, 21 nt, Human
ccucuguagcaguugcuccac

SEQ ID NO: 458609 - RNA, 23 nt, Human
ccucuguagcaguugcuccaccc

SEQ ID NO: 458610 - RNA, 20 nt, Human
ccucuuuucugucucagcug

SEQ ID NO: 458611 - RNA, 25 nt, Human
ccugacccuaagacagcccccaaga

SEQ ID NO: 458612 - RNA, 22 nt, Human
ccuggccaacauggugaaaccc

SEQ ID NO: 458613 - RNA, 23 nt, Human
ccuggccaacauggugaaacccc

SEQ ID NO: 458614 - RNA, 24 nt, Human
ccuggccaacauggugaaaccccg

SEQ ID NO: 458615 - RNA, 21 nt, Human
ccuggcgacagagcgagacuc

SEQ ID NO: 458616 - RNA, 18 nt, Human
ccuuaccucuuuucuguc

SEQ ID NO: 458617 - RNA, 21 nt, Human
ccuucuuuaaacaccuaggag

SEQ ID NO: 458618 - RNA, 19 nt, Human
ccuuuugcaugcuucuaca

SEQ ID NO: 458619 - RNA, 24 nt, Human
cgagaccauccuggccaacauggu

SEQ ID NO: 458620 - RNA, 24 nt, Human
cgaggcgggcagaucacgagguca

SEQ ID NO: 458621 - RNA, 21 nt, Human
cgcaccacugcacuccagccu

SEQ ID NO: 458622 - RNA, 22 nt, Human
cgccgguagucucagcuacucg

SEQ ID NO: 458623 - RNA, 25 nt, Human
cgccgguagucucagcuacucgcug

SEQ ID NO: 458624 - RNA, 24 nt, Human
cggcacuuugggaggccgaggcgg

SEQ ID NO: 458625 - RNA, 24 nt, Human
cgggaggcggagguugcagugagc

SEQ ID NO: 458626 - RNA, 22 nt, Human
cgggcagaucacgaggucaaga

SEQ ID NO: 458627 - RNA, 24 nt, Human
cgguccagcugucugacagcuuca

SEQ ID NO: 458628 - RNA, 28 nt, Human
cgucucaaaaaacaaaaaacaaaaaaac

SEQ ID NO: 458629 - RNA, 23 nt, Human
cuauacagaugcuucucuuaccu

SEQ ID NO: 458630 - RNA, 27 nt, Human
cucaaaaaacaaaaaacaaaaaaaccc

SEQ ID NO: 458631 - RNA, 22 nt, Human
cucacaccuguaaucucggcac

SEQ ID NO: 458632 - RNA, 24 nt, Human
cucacaccuguaaucucggcacuu

SEQ ID NO: 458633 - RNA, 24 nt, Human
cuccagccuggcgacagagcgaga

SEQ ID NO: 458634 - RNA, 19 nt, Human
cuccuucagcuccaacucc

SEQ ID NO: 458635 - RNA, 18 nt, Human
cugacccuaagacagccc

SEQ ID NO: 458636 - RNA, 25 nt, Human
cugacccuaagacagcccccaagaa

SEQ ID NO: 458637 - RNA, 22 nt, Human
cugugaaucuccuuuagggucu

SEQ ID NO: 458638 - RNA, 23 nt, Human
cuucccaggcucacaggcagcag

SEQ ID NO: 458639 - RNA, 20 nt, Human
cuuccuuaccucuuuucugu

SEQ ID NO: 458640 - RNA, 23 nt, Human
cuuccuuaccucuuuucugucuc

SEQ ID NO: 458641 - RNA, 21 nt, Human
cuucuacaucgcuccaugaca

SEQ ID NO: 458642 - RNA, 21 nt, Human
cuuuuucugcuccauuuccau

SEQ ID NO: 458643 - RNA, 22 nt, Human
gaauaauugaaaugaagaacag

SEQ ID NO: 458644 - RNA, 24 nt, Human
gacagagcgagacuccgucucaaa

SEQ ID NO: 458645 - RNA, 19 nt, Human
gacuuagaaggaaaaaggg

SEQ ID NO: 458646 - RNA, 23 nt, Human
gagaucgcaccacugcacuccag

SEQ ID NO: 458647 - RNA, 24 nt, Human
gagcgcgguggcucacaccuguaa

SEQ ID NO: 458648 - RNA, 23 nt, Human
gagguugcagugagccgagaucg

SEQ ID NO: 458649 - RNA, 18 nt, Human
gauuacagacgugagcca

SEQ ID NO: 458650 - RNA, 22 nt, Human
gauuacagacgugagccaccgc

SEQ ID NO: 458651 - RNA, 20 nt, Human
gcaccacugcacuccagccu

SEQ ID NO: 458652 - RNA, 23 nt, Human
gcacuccagccuggcgacagagc

SEQ ID NO: 458653 - RNA, 23 nt, Human
gcacuuugggaggccgaggcggg

SEQ ID NO: 458654 - RNA, 20 nt, Human
gcaugcuucuacaucgcucc

SEQ ID NO: 458655 - RNA, 24 nt, Human
gccaacauggugaaaccccgucuc

SEQ ID NO: 458656 - RNA, 18 nt, Human
gccaccgcgcccgaccac

SEQ ID NO: 458657 - RNA, 20 nt, Human
gccgagaucgcaccacugca

SEQ ID NO: 458658 - RNA, 22 nt, Human
gcuaaagugcuggggguaccug

SEQ ID NO: 458659 - RNA, 21 nt, Human
gcuggggguaccugcagcugc

SEQ ID NO: 458660 - RNA, 21 nt, Human
gcuugaaccgggaggcggagg

SEQ ID NO: 458661 - RNA, 20 nt, Human
ggagguugcagugagccgag

SEQ ID NO: 458662 - RNA, 22 nt, Human
ggagguugcagugagccgagau

SEQ ID NO: 458663 - RNA, 24 nt, Human
ggagguugcagugagccgagaucg

SEQ ID NO: 458664 - RNA, 19 nt, Human
ggauuaaaacccagagcuc

SEQ ID NO: 458665 - RNA, 18 nt, Human
ggcagaucacgaggucaa

SEQ ID NO: 458666 - RNA, 21 nt, Human
ggccgagcgcgguggcucaca

SEQ ID NO: 458667 - RNA, 18 nt, Human
gggaauucuucauccugc

SEQ ID NO: 458668 - RNA, 21 nt, Human
gggccgaagcagugccagaaa

SEQ ID NO: 458669 - RNA, 25 nt, Human
gggcgugguggcgugcgccgguagu

SEQ ID NO: 458670 - RNA, 22 nt, Human
gggucuucaggaucuucagaag

SEQ ID NO: 458671 - RNA, 24 nt, Human
ggucuuuuucugcuccauuuccau

SEQ ID NO: 458672 - RNA, 20 nt, Human
gguggcucacaccuguaauc

SEQ ID NO: 458673 - RNA, 24 nt, Human
gguggcucacaccuguaaucucgg

SEQ ID NO: 458674 - RNA, 21 nt, Human
guaaguuccuuuugcaugcuu

SEQ ID NO: 458675 - RNA, 24 nt, Human
guucuggugcuucugcaaucuccc

SEQ ID NO: 458676 - RNA, 19 nt, Human
guugcagugagccgagauc

SEQ ID NO: 458677 - RNA, 23 nt, Human
uaaaaauacaaaacaauuagcug

SEQ ID NO: 458678 - RNA, 27 nt, Human
uaagacagcccccaagaagaaaagauc

SEQ ID NO: 458679 - RNA, 21 nt, Human
uaagacagcccccaagaaggg

SEQ ID NO: 458680 - RNA, 21 nt, Human
uaagccucuuccauccaaggu

SEQ ID NO: 458681 - RNA, 24 nt, Human
uaaugagcugacucuccuggcucc

SEQ ID NO: 458682 - RNA, 23 nt, Human
uacagacgugagccaccgcgccc

SEQ ID NO: 458683 - RNA, 18 nt, Human
uagaagcagauuaccugc

SEQ ID NO: 458684 - RNA, 19 nt, Human
uagggucaugcaaaggaca

SEQ ID NO: 458685 - RNA, 23 nt, Human
uaucccauacaaaaugacccuac

SEQ ID NO: 458686 - RNA, 24 nt, Human
ucacgaggucaagagaucgagacc

SEQ ID NO: 458687 - RNA, 21 nt, Human
ucaggaucuucagaagugcca

SEQ ID NO: 458688 - RNA, 21 nt, Human
uccacccaacaucugucuuuu

SEQ ID NO: 458689 - RNA, 22 nt, Human
uccagccuggcgacagagcgag

SEQ ID NO: 458690 - RNA, 19 nt, Human
ucccacugagaagugaaga

SEQ ID NO: 458691 - RNA, 22 nt, Human
ucccuccaguuagacaggagga

SEQ ID NO: 458692 - RNA, 21 nt, Human
ucccuccugagccauggagau

SEQ ID NO: 458693 - RNA, 23 nt, Human
ucgcaccacugcacuccagccug

SEQ ID NO: 458694 - RNA, 21 nt, Human
ucgcagguuuuuccguagccu

SEQ ID NO: 458695 - RNA, 18 nt, Human
ucggccuuccaaagugcu

SEQ ID NO: 458696 - RNA, 19 nt, Human
ucuacagcuaaaguaggau

SEQ ID NO: 458697 - RNA, 20 nt, Human
ucuacagcuaaaguaggauu

SEQ ID NO: 458698 - RNA, 25 nt, Human
ucucaaaaaacaaaaaacaaaaaaa

SEQ ID NO: 458699 - RNA, 20 nt, Human
ucucuacuaaaaauacaaaa

SEQ ID NO: 458700 - RNA, 25 nt, Human
ucucuuaccuucaccacuugcuaga

SEQ ID NO: 458701 - RNA, 19 nt, Human
ucucuugccuccuauacag

SEQ ID NO: 458702 - RNA, 18 nt, Human
ugaaaguagggucaugca

SEQ ID NO: 458703 - RNA, 18 nt, Human
ugaagaacaguaauugag

SEQ ID NO: 458704 - RNA, 20 nt, Human
ugaauaguagguaagaauaa

SEQ ID NO: 458705 - RNA, 22 nt, Human
ugacccuaagacagcccccaag

SEQ ID NO: 458706 - RNA, 22 nt, Human
ugagccgagaucgcaccacugc

SEQ ID NO: 458707 - RNA, 21 nt, Human
ugagcugacucuccuggcucc

SEQ ID NO: 458708 - RNA, 20 nt, Human
ugaggcagaagaauggcuuc

SEQ ID NO: 458709 - RNA, 24 nt, Human
ugaggcagaagaauggcuugaacc

SEQ ID NO: 458710 - RNA, 21 nt, Human
ugaugaagggccgaagcagug

SEQ ID NO: 458711 - RNA, 22 nt, Human
ugcauaucccauacaaaaugac

SEQ ID NO: 458712 - RNA, 23 nt, Human
ugccagaaaugcuuucacauacc

SEQ ID NO: 458713 - RNA, 24 nt, Human
ugcugggauuacagacgugagcca

SEQ ID NO: 458714 - RNA, 21 nt, Human
ugcuggggguaccugcagcug

SEQ ID NO: 458715 - RNA, 24 nt, Human
uggccaacauggugaaaccccguc

SEQ ID NO: 458716 - RNA, 24 nt, Human
uggccgagcgcgguggcucacacc

SEQ ID NO: 458717 - RNA, 24 nt, Human
uggcgugcgccgguagucucagcu

SEQ ID NO: 458718 - RNA, 24 nt, Human
uggcucacaccuguaaucucggca

SEQ ID NO: 458719 - RNA, 19 nt, Human
ugggaggccgaggcgggca

SEQ ID NO: 458720 - RNA, 20 nt, Human
ugggaggccgaggcgggcag

SEQ ID NO: 458721 - RNA, 24 nt, Human
ugggaggccgaggcgggcagauca

SEQ ID NO: 458722 - RNA, 18 nt, Human
ugggauuacagacgugag

SEQ ID NO: 458723 - RNA, 19 nt, Human
ugggauuacagacgugagc

SEQ ID NO: 458724 - RNA, 21 nt, Human
ugggauuacagacgugagcca

SEQ ID NO: 458725 - RNA, 22 nt, Human
ugggauuacagacgugagccac

SEQ ID NO: 458726 - RNA, 23 nt, Human
ugggauuacagacgugagccacc

SEQ ID NO: 458727 - RNA, 24 nt, Human
ugggauuacagacgugagccaccg

SEQ ID NO: 458728 - RNA, 19 nt, Human
ugucagguaagccucuucc

SEQ ID NO: 458729 - RNA, 19 nt, Human
ugucucagggcugcuccua

SEQ ID NO: 458730 - RNA, 22 nt, Human
uuaaugagcugacucuccuggc

SEQ ID NO: 458731 - RNA, 19 nt, Human
uuagcugggcgugguggcg

SEQ ID NO: 458732 - RNA, 20 nt, Human
uuagcugggcgugguggcgu

SEQ ID NO: 458733 - RNA, 22 nt, Human
uuagcugggcgugguggcgugc

SEQ ID NO: 458734 - RNA, 24 nt, Human
uucagaagugccagccuccucagg

SEQ ID NO: 458735 - RNA, 24 nt, Human
uucuggugcuucugcaaucucccu

SEQ ID NO: 458736 - RNA, 23 nt, Human
uugaaccgggaggcggagguugc

SEQ ID NO: 458737 - RNA, 20 nt, Human
uugcagugagccgagaucgc

SEQ ID NO: 458738 - RNA, 22 nt, Human
uugcagugagccgagaucgcac

SEQ ID NO: 458739 - RNA, 19 nt, Human
uuggaacugaugaagggcc

SEQ ID NO: 458740 - RNA, 25 nt, Human
uugggaggccgaggcgggcagauca

SEQ ID NO: 458741 - RNA, 23 nt, Human
uuuccguagccucggccuuccaa

SEQ ID NO: 458742 - RNA, 24 nt, Human
uuuugcaugcuucuacaucgcucc

SEQ ID NO: 458743 - RNA, 22 nt, Human
uuuuuuuuuuuuaaaugucuca

SEQ ID NO: 458744 - RNA, 23 nt, Human
uuuuuuuuuuuuuuuuuuaaaug

SEQ ID NO: 458745 - RNA, 24 nt, Human
aaacaggagcugaaagggccagaa

SEQ ID NO: 458746 - RNA, 20 nt, Human
agccuagagcucaggaaccg

SEQ ID NO: 458747 - RNA, 24 nt, Human
agggcacgaugggagcgggagaca

SEQ ID NO: 458748 - RNA, 18 nt, Human
agggguguguggcucagc

SEQ ID NO: 458749 - RNA, 22 nt, Human
cagcagcggccucccauagugc

SEQ ID NO: 458750 - RNA, 22 nt, Human
cagccuagagcucaggaaccag

SEQ ID NO: 458751 - RNA, 22 nt, Human
caggacagauccugaaacagga

SEQ ID NO: 458752 - RNA, 24 nt, Human
caucccaaugccagaccuuccucc

SEQ ID NO: 458753 - RNA, 24 nt, Human
ccuaccucuucucucuucccucca

SEQ ID NO: 458754 - RNA, 20 nt, Human
ccuuucuuccuaccucuucu

SEQ ID NO: 458755 - RNA, 23 nt, Human
cuaccucuucucucuucccucca

SEQ ID NO: 458756 - RNA, 22 nt, Human
cugaaacaggagcugaaagggc

SEQ ID NO: 458757 - RNA, 21 nt, Human
cugaaagggccagaacuggca

SEQ ID NO: 458758 - RNA, 18 nt, Human
cuuccuaccucuucucuc

SEQ ID NO: 458759 - RNA, 19 nt, Human
cuugcagaaaaguggggca

SEQ ID NO: 458760 - RNA, 21 nt, Human
gacuuuaagugcuccacgcag

SEQ ID NO: 458761 - RNA, 20 nt, Human
gagcucaggaaccaggacag

SEQ ID NO: 458762 - RNA, 20 nt, Human
gaggggcauccgguccugga

SEQ ID NO: 458763 - RNA, 18 nt, Human
gccuagagcucaggaacc

SEQ ID NO: 458764 - RNA, 19 nt, Human
guauguccccagggcggca

SEQ ID NO: 458765 - RNA, 21 nt, Human
uaccucuucucucuucccucc

SEQ ID NO: 458766 - RNA, 27 nt, Human
uaccucuucucucuucccuccaccaga

SEQ ID NO: 458767 - RNA, 18 nt, Human
uagcagccuagagcucag

SEQ ID NO: 458768 - RNA, 23 nt, Human
uagugcacaaugguggaaggagg

SEQ ID NO: 458769 - RNA, 20 nt, Human
uccugaaacaggagcugaaa

SEQ ID NO: 458770 - RNA, 18 nt, Human
ucucucuucccuccacca

SEQ ID NO: 458771 - RNA, 19 nt, Human
ucuuccuaccucuucucuc

SEQ ID NO: 458772 - RNA, 21 nt, Human
aaacaaaugcaaaaacuacuu

SEQ ID NO: 458773 - RNA, 18 nt, Human
aaacccuaauuccuaccc

SEQ ID NO: 458774 - RNA, 18 nt, Human
aaagcagggccgagcgga

SEQ ID NO: 458775 - RNA, 19 nt, Human
aacagcacugcuccaucag

SEQ ID NO: 458776 - RNA, 20 nt, Human
aaccaguacagcagugaaca

SEQ ID NO: 458777 - RNA, 24 nt, Human
aagaagaugcaucauucaauaaac

SEQ ID NO: 458778 - RNA, 22 nt, Human
acaaaauuaaccuaauuuacag

SEQ ID NO: 458779 - RNA, 23 nt, Human
acggccaggucgcaaaaagcagg

SEQ ID NO: 458780 - RNA, 19 nt, Human
agcggagcccgcuccccuc

SEQ ID NO: 458781 - RNA, 21 nt, Human
agcggagcccgcuccccucgg

SEQ ID NO: 458782 - RNA, 23 nt, Human
agcuauuaaagagcuaaauucaa

SEQ ID NO: 458783 - RNA, 21 nt, Human
auaaacaaaugcaaaaacuac

SEQ ID NO: 458784 - RNA, 24 nt, Human
augucccauauauacauauauaca

SEQ ID NO: 458785 - RNA, 20 nt, Human
caaaacagcacaauaugaug

SEQ ID NO: 458786 - RNA, 21 nt, Human
caagaaauuugcaaaccagua

SEQ ID NO: 458787 - RNA, 20 nt, Human
caggaaauguauuuaaccau

SEQ ID NO: 458788 - RNA, 23 nt, Human
caggucgcaaaaagcagggccga

SEQ ID NO: 458789 - RNA, 25 nt, Human
cagguuacauaaaaauaugggccaa

SEQ ID NO: 458790 - RNA, 21 nt, Human
cauacaaacuugaauaaacac

SEQ ID NO: 458791 - RNA, 23 nt, Human
ccagaaguguucugauaaaccaa

SEQ ID NO: 458792 - RNA, 23 nt, Human
ccauuuaugcauauaaauauuuc

SEQ ID NO: 458793 - RNA, 23 nt, Human
cccauagugagaguuuaaaaagc

SEQ ID NO: 458794 - RNA, 18 nt, Human
ccccggaggaagccuugg

SEQ ID NO: 458795 - RNA, 20 nt, Human
cccggcccaaucccccggcc

SEQ ID NO: 458796 - RNA, 27 nt, Human
cccucuuaaauccucuaguucuaagaa

SEQ ID NO: 458797 - RNA, 21 nt, Human
ccggcccaaucccccggccgc

SEQ ID NO: 458798 - RNA, 23 nt, Human
ccggcccaaucccccggccgcag

SEQ ID NO: 458799 - RNA, 20 nt, Human
ccucguccucuucgccccuc

SEQ ID NO: 458800 - RNA, 22 nt, Human
ccucguccucuucgccccucca

SEQ ID NO: 458801 - RNA, 21 nt, Human
cgcuugcaucuguacuugcug

SEQ ID NO: 458802 - RNA, 25 nt, Human
cggccaggucgcaaaaagcagggcc

SEQ ID NO: 458803 - RNA, 19 nt, Human
cuuuagaaaaucguggucu

SEQ ID NO: 458804 - RNA, 22 nt, Human
gccaaauuaaacacguaucuaa

SEQ ID NO: 458805 - RNA, 18 nt, Human
gccuuggcccccucgucc

SEQ ID NO: 458806 - RNA, 21 nt, Human
ggcauuuuucuucgaguuguu

SEQ ID NO: 458807 - RNA, 22 nt, Human
ggcgguggagaccccggcccaa

SEQ ID NO: 458808 - RNA, 24 nt, Human
ggucaaacaacuaccgaguucaaa

SEQ ID NO: 458809 - RNA, 21 nt, Human
guccccggaggaagccuuggc

SEQ ID NO: 458810 - RNA, 23 nt, Human
uaaaaagcagccccuguuuucua

SEQ ID NO: 458811 - RNA, 22 nt, Human
uaacaaacguguuauccaaaac

SEQ ID NO: 458812 - RNA, 25 nt, Human
uaaguucuugaucaacuuguuuuaa

SEQ ID NO: 458813 - RNA, 24 nt, Human
uaauuccuacccucuuaaauccuc

SEQ ID NO: 458814 - RNA, 22 nt, Human
uacacauuaaaaaauauugcuc

SEQ ID NO: 458815 - RNA, 20 nt, Human
uacauauauacaaacccuaa

SEQ ID NO: 458816 - RNA, 20 nt, Human
uauuaaagagcuaaauucaa

SEQ ID NO: 458817 - RNA, 21 nt, Human
uauugucaaacaugauuucau

SEQ ID NO: 458818 - RNA, 19 nt, Human
ucagucuuguuuggacuag

SEQ ID NO: 458819 - RNA, 22 nt, Human
uccccggaggaagccuuggccc

SEQ ID NO: 458820 - RNA, 23 nt, Human
uccccucggucggcgguggagac

SEQ ID NO: 458821 - RNA, 23 nt, Human
ucccuuguauaauacaaaaguug

SEQ ID NO: 458822 - RNA, 29 nt, Human
uccuacccucuuaaauccucuaguucuaa

SEQ ID NO: 458823 - RNA, 18 nt, Human
ugagaaaaaaaccuuggg

SEQ ID NO: 458824 - RNA, 19 nt, Human
ugcauauaaauauuucacc

SEQ ID NO: 458825 - RNA, 23 nt, Human
uggaaguauuuugguaaagugcc

SEQ ID NO: 458826 - RNA, 22 nt, Human
uguaacagccagaaguguucug

SEQ ID NO: 458827 - RNA, 20 nt, Human
uucaaugucaacuacaaacu

SEQ ID NO: 458828 - RNA, 23 nt, Human
uuccauggggacaaguucugcua

SEQ ID NO: 458829 - RNA, 26 nt, Human
uuccauggggacaaguucugcuaguu

SEQ ID NO: 458830 - RNA, 19 nt, Human
uucugcuaguucugccaaa

SEQ ID NO: 458831 - RNA, 21 nt, Human
uugaauaaacaccacaucuaa

SEQ ID NO: 458832 - RNA, 23 nt, Human
uuuaaccaucuguugccuuauga

SEQ ID NO: 458833 - RNA, 18 nt, Human
aaaggucugaagccaacg

SEQ ID NO: 458834 - RNA, 21 nt, Human
aaaggucugaagccaacgucc

SEQ ID NO: 458835 - RNA, 23 nt, Human
gguguaucacaaaggucugaagc

SEQ ID NO: 458836 - RNA, 22 nt, Human
ucccuggcaacacuuucuucua

SEQ ID NO: 458837 - RNA, 23 nt, Human
aaaagaaggcuagccagcgagaa

SEQ ID NO: 458838 - RNA, 22 nt, Human
aacagcugaaaaagcaaauuuc

SEQ ID NO: 458839 - RNA, 20 nt, Human
aaggaucauuggacaagaaa

SEQ ID NO: 458840 - RNA, 21 nt, Human
acccccuccccaccaaagugc

SEQ ID NO: 458841 - RNA, 18 nt, Human
accccgccgcuggccucg

SEQ ID NO: 458842 - RNA, 20 nt, Human
agcagcaguggcgggaagcc

SEQ ID NO: 458843 - RNA, 22 nt, Human
agcgagaaauuuugccccacaa

SEQ ID NO: 458844 - RNA, 20 nt, Human
aggcuagccagcgagaaauu

SEQ ID NO: 458845 - RNA, 19 nt, Human
caacggcagcgaccccgcc

SEQ ID NO: 458846 - RNA, 18 nt, Human
cacccccuccccaccaaa

SEQ ID NO: 458847 - RNA, 24 nt, Human
caccgaaacgaggauccacccccu

SEQ ID NO: 458848 - RNA, 22 nt, Human
cacgcaaggaucauuggacaag

SEQ ID NO: 458849 - RNA, 19 nt, Human
cagcagcaguggcgggaag

SEQ ID NO: 458850 - RNA, 22 nt, Human
cagcagcaguggcgggaagccu

SEQ ID NO: 458851 - RNA, 21 nt, Human
cagcugaaaaagcaaauuuca

SEQ ID NO: 458852 - RNA, 18 nt, Human
cauuggacaagaaaucag

SEQ ID NO: 458853 - RNA, 20 nt, Human
cauuggacaagaaaucaguu

SEQ ID NO: 458854 - RNA, 19 nt, Human
ccacccccuccccaccaaa

SEQ ID NO: 458855 - RNA, 19 nt, Human
ccacccccuccccaccaaa

SEQ ID NO: 458856 - RNA, 22 nt, Human
cccaccaaagugcgggagggaa

SEQ ID NO: 458857 - RNA, 19 nt, Human
ccccacaaauccgccagca

SEQ ID NO: 458858 - RNA, 19 nt, Human
ccgcggcgacaacuuccuc

SEQ ID NO: 458859 - RNA, 19 nt, Human
ccucaacggcagcgacccu

SEQ ID NO: 458860 - RNA, 21 nt, Human
ccucgugcgcagcuggucccc

SEQ ID NO: 458861 - RNA, 24 nt, Human
cgccagcagcaguggcgggaagcc

SEQ ID NO: 458862 - RNA, 22 nt, Human
cggcagcgaccccgccgcuggc

SEQ ID NO: 458863 - RNA, 19 nt, Human
cuggaauagagcugcccaa

SEQ ID NO: 458864 - RNA, 19 nt, Human
gcgggagggaaaagaaggc

SEQ ID NO: 458865 - RNA, 21 nt, Human
ggaucauuggacaagaaauca

SEQ ID NO: 458866 - RNA, 22 nt, Human
uaacuaacacuaaguuucacaa

SEQ ID NO: 458867 - RNA, 22 nt, Human
uaaguuucacaacgggcagcuu

SEQ ID NO: 458868 - RNA, 22 nt, Human
uagaaaaggucauuacaguuag

SEQ ID NO: 458869 - RNA, 22 nt, Human
uagguuagcacauaaaaaacca

SEQ ID NO: 458870 - RNA, 24 nt, Human
uagguuagcacauaaaaaaccaac

SEQ ID NO: 458871 - RNA, 19 nt, Human
uccccaccaaagugcggga

SEQ ID NO: 458872 - RNA, 20 nt, Human
ucccccuccaaggccagcaa

SEQ ID NO: 458873 - RNA, 19 nt, Human
ucgcagucacugccucggc

SEQ ID NO: 458874 - RNA, 24 nt, Human
ucguugaagcuggaucucggccac

SEQ ID NO: 458875 - RNA, 24 nt, Human
ugccucggcgcuccucccccucca

SEQ ID NO: 458876 - RNA, 22 nt, Human
uggaauggauaaaacauguugu

SEQ ID NO: 458877 - RNA, 18 nt, Human
aaaaaagacuacgaauau

SEQ ID NO: 458878 - RNA, 22 nt, Human
aaauagccagaaaaauaucaga

SEQ ID NO: 458879 - RNA, 19 nt, Human
aaauuggccacaccucuga

SEQ ID NO: 458880 - RNA, 19 nt, Human
aacaagaccuaagugucag

SEQ ID NO: 458881 - RNA, 26 nt, Human
aacaagaccuaagugucagauacaag

SEQ ID NO: 458882 - RNA, 25 nt, Human
aacacagccccuucuucaaaacucc

SEQ ID NO: 458883 - RNA, 20 nt, Human
aacagccuuccaggagaucg

SEQ ID NO: 458884 - RNA, 21 nt, Human
aacuauacaacuaaaaaaaac

SEQ ID NO: 458885 - RNA, 21 nt, Human
aacuccaggaaaugucaauau

SEQ ID NO: 458886 - RNA, 20 nt, Human
aagaaaaaggaccagcgaag

SEQ ID NO: 458887 - RNA, 23 nt, Human
acaaaaccaacuccaggaaaugu

SEQ ID NO: 458888 - RNA, 18 nt, Human
accaaccacacaguauca

SEQ ID NO: 458889 - RNA, 20 nt, Human
agaaaaaggaccagcgaagg

SEQ ID NO: 458890 - RNA, 18 nt, Human
agaccacaggugagacca

SEQ ID NO: 458891 - RNA, 21 nt, Human
agacuuuuuuucccuggacuu

SEQ ID NO: 458892 - RNA, 20 nt, Human
agcccccaagggccaauucu

SEQ ID NO: 458893 - RNA, 26 nt, Human
agccuacguggcccaaacacagcccc

SEQ ID NO: 458894 - RNA, 23 nt, Human
aggacaaaaccaacuccaggaaa

SEQ ID NO: 458895 - RNA, 19 nt, Human
aggaccagcgaaggaaccu

SEQ ID NO: 458896 - RNA, 24 nt, Human
aggaccagcgaaggaaccugagaa

SEQ ID NO: 458897 - RNA, 20 nt, Human
aggagcacagacacagaaca

SEQ ID NO: 458898 - RNA, 21 nt, Human
aggaggagcacagacacagaa

SEQ ID NO: 458899 - RNA, 20 nt, Human
aggcagagauaacaaacgug

SEQ ID NO: 458900 - RNA, 19 nt, Human
agguauguguguuuccaag

SEQ ID NO: 458901 - RNA, 21 nt, Human
agugaaggagugggaguggaa

SEQ ID NO: 458902 - RNA, 24 nt, Human
agugaugauugacaucgaaaggcc

SEQ ID NO: 458903 - RNA, 20 nt, Human
auagauggagcaaagucugg

SEQ ID NO: 458904 - RNA, 18 nt, Human
auccaagaguucucagca

SEQ ID NO: 458905 - RNA, 22 nt, Human
auggagcaaagucuggggguca

SEQ ID NO: 458906 - RNA, 20 nt, Human
caaccacacaguaucacaua

SEQ ID NO: 458907 - RNA, 21 nt, Human
caaugacaaagaagggaaaaa

SEQ ID NO: 458908 - RNA, 22 nt, Human
cacaccaaccacacaguaucac

SEQ ID NO: 458909 - RNA, 19 nt, Human
cacagccccuucuucaaaa

SEQ ID NO: 458910 - RNA, 20 nt, Human
cacauguaaccaaauaaagc

SEQ ID NO: 458911 - RNA, 21 nt, Human
cacauguaaccaaauaaagcc

SEQ ID NO: 458912 - RNA, 18 nt, Human
caccaaccacacaguauc

SEQ ID NO: 458913 - RNA, 31 nt, Human
caccagacacauucccuccucugcacccuuc

SEQ ID NO: 458914 - RNA, 20 nt, Human
cacccaggcacauguaaccu

SEQ ID NO: 458915 - RNA, 23 nt, Human
caccugcacagaugggugagcag

SEQ ID NO: 458916 - RNA, 19 nt, Human
cagaaaaagaaacucaaca

SEQ ID NO: 458917 - RNA, 19 nt, Human
cagggcaugacagaaaaag

SEQ ID NO: 458918 - RNA, 22 nt, Human
caggggaagggauccagaguac

SEQ ID NO: 458919 - RNA, 20 nt, Human
caguagauaacaggauaaca

SEQ ID NO: 458920 - RNA, 18 nt, Human
cauagaaacucaaaauac

SEQ ID NO: 458921 - RNA, 20 nt, Human
caugacagaaaaagaaacuc

SEQ ID NO: 458922 - RNA, 21 nt, Human
ccaaauaaagcccccaagggc

SEQ ID NO: 458923 - RNA, 20 nt, Human
ccagaguacauuccaaaggg

SEQ ID NO: 458924 - RNA, 23 nt, Human
ccaggaaaugucaauaugucagg

SEQ ID NO: 458925 - RNA, 20 nt, Human
cccagagacaccugcacaga

SEQ ID NO: 458926 - RNA, 23 nt, Human
cccaugauagagucuaagcuggu

SEQ ID NO: 458927 - RNA, 19 nt, Human
cccuccuccauauaguuua

SEQ ID NO: 458928 - RNA, 23 nt, Human
ccugugaugugggggcuugaaag

SEQ ID NO: 458929 - RNA, 23 nt, Human
cugcuacccucaacucagauguc

SEQ ID NO: 458930 - RNA, 22 nt, Human
cuucuucaaaacuccacaccaa

SEQ ID NO: 458931 - RNA, 22 nt, Human
gaaaaagaaacucaacaaggga

SEQ ID NO: 458932 - RNA, 21 nt, Human
gaaugaaucaaggacaaaacc

SEQ ID NO: 458933 - RNA, 19 nt, Human
gacuuuuuuucccuggacu

SEQ ID NO: 458934 - RNA, 19 nt, Human
gagcacagacacagaacac

SEQ ID NO: 458935 - RNA, 19 nt, Human
gagggacacagcaggucau

SEQ ID NO: 458936 - RNA, 21 nt, Human
gaguagagccuacguggccca

SEQ ID NO: 458937 - RNA, 18 nt, Human
gauaacaaugacaaagaa

SEQ ID NO: 458938 - RNA, 23 nt, Human
gauaacaaugacaaagaagggaa

SEQ ID NO: 458939 - RNA, 19 nt, Human
gcacacacacacaucacac

SEQ ID NO: 458940 - RNA, 18 nt, Human
gcagccccagagacaccu

SEQ ID NO: 458941 - RNA, 20 nt, Human
gccacaccucugaacagggu

SEQ ID NO: 458942 - RNA, 19 nt, Human
gcucugaggucaaugguag

SEQ ID NO: 458943 - RNA, 18 nt, Human
ggaaaucacaacagccuu

SEQ ID NO: 458944 - RNA, 23 nt, Human
ggaaggaggagcacagacacaga

SEQ ID NO: 458945 - RNA, 20 nt, Human
ggaagggauccagaguacau

SEQ ID NO: 458946 - RNA, 21 nt, Human
ggaagugggucaccaaaauca

SEQ ID NO: 458947 - RNA, 21 nt, Human
ggagaagcuaacauuuaggca

SEQ ID NO: 458948 - RNA, 19 nt, Human
ggggaaaugaccaggggcu

SEQ ID NO: 458949 - RNA, 22 nt, Human
gguaauaagggugauagaggga

SEQ ID NO: 458950 - RNA, 21 nt, Human
gucaaugguaguccuggguug

SEQ ID NO: 458951 - RNA, 24 nt, Human
uaaauguuucucuacauuuugcuu

SEQ ID NO: 458952 - RNA, 21 nt, Human
uaacaaugacaaagaagggaa

SEQ ID NO: 458953 - RNA, 26 nt, Human
uaaccaaauaaagcccccaagggcca

SEQ ID NO: 458954 - RNA, 25 nt, Human
uaagcugguaaagaccacccaggca

SEQ ID NO: 458955 - RNA, 27 nt, Human
uacugcagaccacaggugagaccagca

SEQ ID NO: 458956 - RNA, 20 nt, Human
uagagccuacguggcccaaa

SEQ ID NO: 458957 - RNA, 21 nt, Human
uagauggaaaucacaacagcc

SEQ ID NO: 458958 - RNA, 18 nt, Human
uaggcagagauaacaaac

SEQ ID NO: 458959 - RNA, 23 nt, Human
uauucaacacacauuuacugagc

SEQ ID NO: 458960 - RNA, 18 nt, Human
ucagccaauugugucuac

SEQ ID NO: 458961 - RNA, 24 nt, Human
ucagccaauugugucuacugcaga

SEQ ID NO: 458962 - RNA, 18 nt, Human
ucccucucuguguguucu

SEQ ID NO: 458963 - RNA, 26 nt, Human
ucugaacagggucuaacccaggucag

SEQ ID NO: 458964 - RNA, 23 nt, Human
ucuuguaaaaccuuccagaaagg

SEQ ID NO: 458965 - RNA, 25 nt, Human
ucuuucgacauaugcaccauucuga

SEQ ID NO: 458966 - RNA, 22 nt, Human
ugaacagggucuaacccaggug

SEQ ID NO: 458967 - RNA, 19 nt, Human
ugaagaaaggcagaugaua

SEQ ID NO: 458968 - RNA, 21 nt, Human
ugaaucaaggacaaaaccaac

SEQ ID NO: 458969 - RNA, 23 nt, Human
ugacagaaaaagaaacucaacaa

SEQ ID NO: 458970 - RNA, 20 nt, Human
ugagaagagcagaagccccc

SEQ ID NO: 458971 - RNA, 20 nt, Human
ugagaaggccagugggguga

SEQ ID NO: 458972 - RNA, 19 nt, Human
ugagaauggagcuucaugg

SEQ ID NO: 458973 - RNA, 20 nt, Human
ugagaauggagcuucauggg

SEQ ID NO: 458974 - RNA, 22 nt, Human
ugagagggaaggaggagcacag

SEQ ID NO: 458975 - RNA, 22 nt, Human
ugagcagccaccugagacucca

SEQ ID NO: 458976 - RNA, 18 nt, Human
ugcacacacacacaucac

SEQ ID NO: 458977 - RNA, 18 nt, Human
ugcaccugagaaggccag

SEQ ID NO: 458978 - RNA, 23 nt, Human
uggagcaaagucugggggucaaa

SEQ ID NO: 458979 - RNA, 23 nt, Human
uggcugggagugaugauugacau

SEQ ID NO: 458980 - RNA, 21 nt, Human
ugguaaagaccacccaggcac

SEQ ID NO: 458981 - RNA, 24 nt, Human
uggugagaaauuuggggucucagu

SEQ ID NO: 458982 - RNA, 21 nt, Human
uguaaccaaauaaagccccca

SEQ ID NO: 458983 - RNA, 22 nt, Human
uguacaagaauccagauucaaa

SEQ ID NO: 458984 - RNA, 21 nt, Human
uguuuccaagauucucucuca

SEQ ID NO: 458985 - RNA, 19 nt, Human
uuagugaaggagugggagu

SEQ ID NO: 458986 - RNA, 20 nt, Human
uucaaaacuccacaccaacc

SEQ ID NO: 458987 - RNA, 22 nt, Human
uugaaaauauuuuuuaaauccu

SEQ ID NO: 458988 - RNA, 19 nt, Human
uuucaugguucuuuugccu

SEQ ID NO: 458989 - RNA, 18 nt, Human
uuucuggugagaagagca

SEQ ID NO: 458990 - RNA, 18 nt, Human
ccaccccagccccaggca

SEQ ID NO: 458991 - RNA, 22 nt, Human
ccacccgcacagcccucgugcc

SEQ ID NO: 458992 - RNA, 20 nt, Human
ccagccccaggcaggcagaa

SEQ ID NO: 458993 - RNA, 19 nt, Human
cccaccgcgcgccggccgc

SEQ ID NO: 458994 - RNA, 20 nt, Human
ugacuucagcacgaccaccc

SEQ ID NO: 458995 - RNA, 21 nt, Human
uuuuuuuuuuuugcacagggu

SEQ ID NO: 458996 - RNA, 21 nt, Human
uuuuuuuuuuuuuugcacagg

SEQ ID NO: 458997 - RNA, 23 nt, Human
uuuuuuuuuuuuuuuuugcacag

SEQ ID NO: 458998 - RNA, 25 nt, Human
uuuuuuuuuuuuuuuuugcacaggg

SEQ ID NO: 458999 - RNA, 27 nt, Human
uuuuuuuuuuuuuuuuuuuuuuugggg

SEQ ID NO: 459000 - RNA, 25 nt, Human
auggggaagucccagucuucuuguu

SEQ ID NO: 459001 - RNA, 25 nt, Human
ccacugacuguuaacaagccaccug

SEQ ID NO: 459002 - RNA, 18 nt, Human
ccccauagauugcauaga

SEQ ID NO: 459003 - RNA, 21 nt, Human
cucaugguugcugaaauugcu

SEQ ID NO: 459004 - RNA, 19 nt, Human
gcaguauucuggcucuccu

SEQ ID NO: 459005 - RNA, 23 nt, Human
gggaagucccagucuucuuguuc

SEQ ID NO: 459006 - RNA, 23 nt, Human
ucagucuucccccauagauugca

SEQ ID NO: 459007 - RNA, 23 nt, Human
ucccagucuucuuguuccaucug

SEQ ID NO: 459008 - RNA, 21 nt, Human
ucuuucaaauucccacugacu

SEQ ID NO: 459009 - RNA, 23 nt, Human
ugacuguuaacaagccaccuggu

SEQ ID NO: 459010 - RNA, 20 nt, Human
uggggccagaaacucauggu

SEQ ID NO: 459011 - RNA, 23 nt, Human
aaaaaacaaaaacaaaacaaaaa

SEQ ID NO: 459012 - RNA, 24 nt, Human
aaaaaacaaaaacaaaacaaaaaa

SEQ ID NO: 459013 - RNA, 21 nt, Human
aaaaacaaaaagcagggagga

SEQ ID NO: 459014 - RNA, 20 nt, Human
aaaaagcagggaggacgagc

SEQ ID NO: 459015 - RNA, 22 nt, Human
aaaacaaaaaaacacaacaaaa

SEQ ID NO: 459016 - RNA, 23 nt, Human
aaaacaaaaaaacacaacaaaag

SEQ ID NO: 459017 - RNA, 21 nt, Human
aaaacaaaaacaaaacaaaaa

SEQ ID NO: 459018 - RNA, 28 nt, Human
aaaacaaaaacaaaacaaaaaaacacaa

SEQ ID NO: 459019 - RNA, 27 nt, Human
aaacaaaaacaaaacaaaaaaacacaa

SEQ ID NO: 459020 - RNA, 22 nt, Human
aaacaaaaagcagggaggacga

SEQ ID NO: 459021 - RNA, 23 nt, Human
aacaaaacaaaaaaacacaacaa

SEQ ID NO: 459022 - RNA, 21 nt, Human
aacagcuucaagaggguucgc

SEQ ID NO: 459023 - RNA, 22 nt, Human
aacgcaaaucuuccagaagaga

SEQ ID NO: 459024 - RNA, 24 nt, Human
aacgcagccucccucgcgccgccc

SEQ ID NO: 459025 - RNA, 19 nt, Human
aagcacagagggacccugg

SEQ ID NO: 459026 - RNA, 19 nt, Human
aaggcaaaaaacaaaaaca

SEQ ID NO: 459027 - RNA, 24 nt, Human
acaaaacaaaaaaacacaacaaaa

SEQ ID NO: 459028 - RNA, 18 nt, Human
acaaggcaaaaaacaaaa

SEQ ID NO: 459029 - RNA, 20 nt, Human
acaaggcaaaaaacaaaaac

SEQ ID NO: 459030 - RNA, 23 nt, Human
acaaggcaaaaaacaaaaacaaa

SEQ ID NO: 459031 - RNA, 25 nt, Human
acaaggcaaaaaacaaaaacaaaac

SEQ ID NO: 459032 - RNA, 26 nt, Human
acaaggcaaaaaacaaaaacaaaaca

SEQ ID NO: 459033 - RNA, 18 nt, Human
acgcagccucccucgcgc

SEQ ID NO: 459034 - RNA, 19 nt, Human
acugaggggacaaagagga

SEQ ID NO: 459035 - RNA, 19 nt, Human
agaaagcgcgcagagaggc

SEQ ID NO: 459036 - RNA, 21 nt, Human
agagaggcagcuucaggccag

SEQ ID NO: 459037 - RNA, 22 nt, Human
agagaggcagcuucaggccagg

SEQ ID NO: 459038 - RNA, 20 nt, Human
agcagggaggacgagccguc

SEQ ID NO: 459039 - RNA, 19 nt, Human
agcgaaaaagcacagaggg

SEQ ID NO: 459040 - RNA, 18 nt, Human
aggaacacaaaauuuauu

SEQ ID NO: 459041 - RNA, 26 nt, Human
aggcaaaaaacaaaaacaaaacaaaa

SEQ ID NO: 459042 - RNA, 19 nt, Human
aggcugccccggcucccgc

SEQ ID NO: 459043 - RNA, 22 nt, Human
auacuaaagcuuuugauuuuca

SEQ ID NO: 459044 - RNA, 22 nt, Human
caaaaaacaaaaacaaaacaaa

SEQ ID NO: 459045 - RNA, 26 nt, Human
caaaaacaaaacaaaaaaacacaaca

SEQ ID NO: 459046 - RNA, 19 nt, Human
caaaaagcagggaggacga

SEQ ID NO: 459047 - RNA, 26 nt, Human
caacaagcuacaguacaaccaggucu

SEQ ID NO: 459048 - RNA, 26 nt, Human
caaggcaaaaaacaaaaacaaaacaa

SEQ ID NO: 459049 - RNA, 19 nt, Human
cacagagggacccugggcg

SEQ ID NO: 459050 - RNA, 22 nt, Human
cagaggucagggaggugagcac

SEQ ID NO: 459051 - RNA, 20 nt, Human
cagccucccucgcgccgccc

SEQ ID NO: 459052 - RNA, 21 nt, Human
cagcgugggccaggcaggcag

SEQ ID NO: 459053 - RNA, 22 nt, Human
ccacaauacuuccccgguugcc

SEQ ID NO: 459054 - RNA, 25 nt, Human
ccagcagcgugggccaggcaggcag

SEQ ID NO: 459055 - RNA, 18 nt, Human
ccaggcaggcagugaucu

SEQ ID NO: 459056 - RNA, 18 nt, Human
ccccaaacaacaagcuac

SEQ ID NO: 459057 - RNA, 18 nt, Human
cccccaaacaacaagcua

SEQ ID NO: 459058 - RNA, 24 nt, Human
cccccgccccgccuagugggcccc

SEQ ID NO: 459059 - RNA, 27 nt, Human
ccccgccccgccuagugggccccgcgg

SEQ ID NO: 459060 - RNA, 21 nt, Human
ccccuagggagcggccggcgg

SEQ ID NO: 459061 - RNA, 19 nt, Human
cccgcgcuugcuugcugga

SEQ ID NO: 459062 - RNA, 19 nt, Human
cccucgcgccgcccgcggu

SEQ ID NO: 459063 - RNA, 19 nt, Human
cccucuccuuccccuuccc

SEQ ID NO: 459064 - RNA, 20 nt, Human
cccugggcgcuggcuccaga

SEQ ID NO: 459065 - RNA, 22 nt, Human
cccuuuccgcggugaauuuggg

SEQ ID NO: 459066 - RNA, 19 nt, Human
ccgcggugaauuugggcag

SEQ ID NO: 459067 - RNA, 24 nt, Human
ccggcucccgcugggucccaaccc

SEQ ID NO: 459068 - RNA, 23 nt, Human
ccggggccggaggugcccgaagc

SEQ ID NO: 459069 - RNA, 18 nt, Human
ccggguuucacauuucuc

SEQ ID NO: 459070 - RNA, 18 nt, Human
ccggucgcaccuccgccc

SEQ ID NO: 459071 - RNA, 24 nt, Human
ccgucccagcagcgugggccaggc

SEQ ID NO: 459072 - RNA, 24 nt, Human
cgacaaggcaaaaaacaaaaacaa

SEQ ID NO: 459073 - RNA, 19 nt, Human
cgaguacaggccguggagc

SEQ ID NO: 459074 - RNA, 19 nt, Human
cgccccgggcccuuuccgc

SEQ ID NO: 459075 - RNA, 22 nt, Human
cgcugccgacgcccggucgcac

SEQ ID NO: 459076 - RNA, 18 nt, Human
cgcuggcuccagaggcgg

SEQ ID NO: 459077 - RNA, 22 nt, Human
cgcugggucccaacccccgccc

SEQ ID NO: 459078 - RNA, 21 nt, Human
cggaaagagacgagcccagua

SEQ ID NO: 459079 - RNA, 22 nt, Human
cggcucccgcugggucccaacc

SEQ ID NO: 459080 - RNA, 20 nt, Human
cggcuccgggccacaagacc

SEQ ID NO: 459081 - RNA, 21 nt, Human
cggggacauuuguuuuugauu

SEQ ID NO: 459082 - RNA, 27 nt, Human
cgucgucggcugcgaccggggccggcg

SEQ ID NO: 459083 - RNA, 19 nt, Human
cuccaggcgcuggcgcggc

SEQ ID NO: 459084 - RNA, 19 nt, Human
cuccgccccgggcccuuuc

SEQ ID NO: 459085 - RNA, 18 nt, Human
cucgcgccgcccgcggug

SEQ ID NO: 459086 - RNA, 24 nt, Human
cucgcgccgcccgcgguguaaacc

SEQ ID NO: 459087 - RNA, 21 nt, Human
cucuccuuccccuuccccuag

SEQ ID NO: 459088 - RNA, 22 nt, Human
gaaaaacaaaaagcagggagga

SEQ ID NO: 459089 - RNA, 24 nt, Human
gaaacuuccccaauugguagacga

SEQ ID NO: 459090 - RNA, 22 nt, Human
gaaagagacgagcccaguagaa

SEQ ID NO: 459091 - RNA, 21 nt, Human
gaagaugaggaauacuaaagc

SEQ ID NO: 459092 - RNA, 20 nt, Human
gacaaggcaaaaaacaaaaa

SEQ ID NO: 459093 - RNA, 22 nt, Human
gacgcuggggcuccggaaagag

SEQ ID NO: 459094 - RNA, 18 nt, Human
gaggaaacgcagccuccc

SEQ ID NO: 459095 - RNA, 23 nt, Human
gaggaauacuaaagcuuuugauu

SEQ ID NO: 459096 - RNA, 24 nt, Human
gcaaaaaacaaaaacaaaacaaaa

SEQ ID NO: 459097 - RNA, 22 nt, Human
gcagagaggcagcuucaggcca

SEQ ID NO: 459098 - RNA, 29 nt, Human
gccugucgcugcucuccccucuccuuccc

SEQ ID NO: 459099 - RNA, 23 nt, Human
ggcaaaaaacaaaaacaaaacaa

SEQ ID NO: 459100 - RNA, 23 nt, Human
ggcagcuucaggccaggggagug

SEQ ID NO: 459101 - RNA, 19 nt, Human
ggccaggcaggcagugauc

SEQ ID NO: 459102 - RNA, 23 nt, Human
ggcucccgcugggucccaacccc

SEQ ID NO: 459103 - RNA, 20 nt, Human
ggcugcgaccggggccggcg

SEQ ID NO: 459104 - RNA, 20 nt, Human
gggacaaagaggagcgacag

SEQ ID NO: 459105 - RNA, 19 nt, Human
gggaggacgagccguccca

SEQ ID NO: 459106 - RNA, 19 nt, Human
uagcaaacuccaaggccac

SEQ ID NO: 459107 - RNA, 21 nt, Human
uagcaaacuccaaggccacaa

SEQ ID NO: 459108 - RNA, 21 nt, Human
ucaggccaggggagugcaagg

SEQ ID NO: 459109 - RNA, 18 nt, Human
uccaaggccacaauacuu

SEQ ID NO: 459110 - RNA, 22 nt, Human
uccaggacuugcaucgaaagau

SEQ ID NO: 459111 - RNA, 28 nt, Human
ucccaacccccgccccgccuagugggcc

SEQ ID NO: 459112 - RNA, 20 nt, Human
ucccgcugggucccaacccc

SEQ ID NO: 459113 - RNA, 20 nt, Human
uccucgcauccgucugcacc

SEQ ID NO: 459114 - RNA, 19 nt, Human
ucgcggagcaaacacacgu

SEQ ID NO: 459115 - RNA, 25 nt, Human
ucgcugcucuccccucuccuucccc

SEQ ID NO: 459116 - RNA, 21 nt, Human
ucucaaacuucuggagacugc

SEQ ID NO: 459117 - RNA, 23 nt, Human
ucucaaacuucuggagacugcgg

SEQ ID NO: 459118 - RNA, 19 nt, Human
ucucuagaaaauuuggucc

SEQ ID NO: 459119 - RNA, 19 nt, Human
ugaggucaggcuggcggcg

SEQ ID NO: 459120 - RNA, 22 nt, Human
ugccccggcucccgcugggucc

SEQ ID NO: 459121 - RNA, 20 nt, Human
uggcgcggcaaagaguuggg

SEQ ID NO: 459122 - RNA, 19 nt, Human
uggcggcggcgucgucggc

SEQ ID NO: 459123 - RNA, 25 nt, Human
uggcuccagaggcgggcccagaggg

SEQ ID NO: 459124 - RNA, 20 nt, Human
ugggcaggagacgcuggggc

SEQ ID NO: 459125 - RNA, 22 nt, Human
ugggcaggagacgcuggggcuc

SEQ ID NO: 459126 - RNA, 18 nt, Human
uggucccccaaacaacaa

SEQ ID NO: 459127 - RNA, 23 nt, Human
uuccccuagggagcggccggcgg

SEQ ID NO: 459128 - RNA, 24 nt, Human
uugcaucgaaagauccggggacau

SEQ ID NO: 459129 - RNA, 18 nt, Human
uuugauuuuuuucuucag

SEQ ID NO: 459130 - RNA, 20 nt, Human
uuuuuuuuuuuaaaagaagg

SEQ ID NO: 459131 - RNA, 22 nt, Human
uuuuuuuuuuuuaaauacucuc

SEQ ID NO: 459132 - RNA, 20 nt, Human
aaaacucuuucccuccacuc

SEQ ID NO: 459133 - RNA, 22 nt, Human
aaaagcaacugcuucaaaggac

SEQ ID NO: 459134 - RNA, 21 nt, Human
aaaaggccaucugaauaucac

SEQ ID NO: 459135 - RNA, 25 nt, Human
aaacaggaggugccaagaggcuggg

SEQ ID NO: 459136 - RNA, 23 nt, Human
aaacccacguacugaucacuuaa

SEQ ID NO: 459137 - RNA, 22 nt, Human
aacaggccacgugccacgagca

SEQ ID NO: 459138 - RNA, 23 nt, Human
aacccacuuccccaaccucccua

SEQ ID NO: 459139 - RNA, 22 nt, Human
aacucuugccccucucaacccc

SEQ ID NO: 459140 - RNA, 20 nt, Human
aagaggaagacaagcccgaa

SEQ ID NO: 459141 - RNA, 19 nt, Human
aagaggcugggcaggggca

SEQ ID NO: 459142 - RNA, 21 nt, Human
aagcagcugugguggcagggg

SEQ ID NO: 459143 - RNA, 20 nt, Human
aauaaaggggcaagggugaa

SEQ ID NO: 459144 - RNA, 22 nt, Human
accacaaccuugagacucuuaa

SEQ ID NO: 459145 - RNA, 19 nt, Human
accccaacccacuucccca

SEQ ID NO: 459146 - RNA, 22 nt, Human
acgugccacgagcacacagcaa

SEQ ID NO: 459147 - RNA, 18 nt, Human
acugcacugggauugggc

SEQ ID NO: 459148 - RNA, 23 nt, Human
agaaaggccaggccccagcuccc

SEQ ID NO: 459149 - RNA, 19 nt, Human
agaagaaagagaggauucu

SEQ ID NO: 459150 - RNA, 21 nt, Human
agagcuggcccagaaugaguu

SEQ ID NO: 459151 - RNA, 25 nt, Human
agaguccuuugacauuuuggacccu

SEQ ID NO: 459152 - RNA, 21 nt, Human
agcaaaaaaaaaaaaaaaaaa

SEQ ID NO: 459153 - RNA, 22 nt, Human
aggaaagugugcuuggcuuuca

SEQ ID NO: 459154 - RNA, 24 nt, Human
aggaacugugcauagcaaaaaaaa

SEQ ID NO: 459155 - RNA, 21 nt, Human
aggaaggguggacacugaggu

SEQ ID NO: 459156 - RNA, 18 nt, Human
aggagggguggagagaac

SEQ ID NO: 459157 - RNA, 22 nt, Human
aggcaggaaggguggacacuga

SEQ ID NO: 459158 - RNA, 25 nt, Human
aggggcuaucaggaugucgucucgg

SEQ ID NO: 459159 - RNA, 24 nt, Human
aggugccaagaggcugggcagggg

SEQ ID NO: 459160 - RNA, 22 nt, Human
agguggcugcugccuagguugg

SEQ ID NO: 459161 - RNA, 24 nt, Human
aguaaaagcaacugcuucaaagga

SEQ ID NO: 459162 - RNA, 18 nt, Human
agucccacccacccuuuc

SEQ ID NO: 459163 - RNA, 22 nt, Human
caaaaaaaaaaaaaaaaaaaaa

SEQ ID NO: 459164 - RNA, 24 nt, Human
caaaauaaauguuugcagagaggc

SEQ ID NO: 459165 - RNA, 24 nt, Human
caacaggccacgugccacgagcac

SEQ ID NO: 459166 - RNA, 22 nt, Human
caacccacuuccccaaccuccc

SEQ ID NO: 459167 - RNA, 18 nt, Human
cacuacaugcuacauacc

SEQ ID NO: 459168 - RNA, 20 nt, Human
cacugggauugggcagggag

SEQ ID NO: 459169 - RNA, 23 nt, Human
cacuuauucaggcaacccaccuu

SEQ ID NO: 459170 - RNA, 31 nt, Human
cagagaacacaggugacuuggauucaaacaa

SEQ ID NO: 459171 - RNA, 24 nt, Human
cagcaaacaugugaagaauguuug

SEQ ID NO: 459172 - RNA, 18 nt, Human
cagcagcaggacaaggua

SEQ ID NO: 459173 - RNA, 21 nt, Human
cagcaugcagaguccuuugac

SEQ ID NO: 459174 - RNA, 20 nt, Human
cagcccggggcugcuuccag

SEQ ID NO: 459175 - RNA, 25 nt, Human
cagcccggggcugcuucccccucug

SEQ ID NO: 459176 - RNA, 24 nt, Human
cagcugguaaguggcauagcuggc

SEQ ID NO: 459177 - RNA, 20 nt, Human
cagcuugggaugguggucag

SEQ ID NO: 459178 - RNA, 19 nt, Human
caggccccagcucccagag

SEQ ID NO: 459179 - RNA, 21 nt, Human
caggccccagcucccagaggg

SEQ ID NO: 459180 - RNA, 23 nt, Human
cagggaagauccaccucaccauu

SEQ ID NO: 459181 - RNA, 19 nt, Human
caguaauuacaggcuacag

SEQ ID NO: 459182 - RNA, 18 nt, Human
ccaaggaauuuuaucacc

SEQ ID NO: 459183 - RNA, 18 nt, Human
ccaccucaccauuaccua

SEQ ID NO: 459184 - RNA, 19 nt, Human
ccaccucccgggcuaaucu

SEQ ID NO: 459185 - RNA, 23 nt, Human
ccacucucuccacagaacucuug

SEQ ID NO: 459186 - RNA, 24 nt, Human
ccauuggucagagagggaagguug

SEQ ID NO: 459187 - RNA, 20 nt, Human
cccagaaugaguuuccugga

SEQ ID NO: 459188 - RNA, 19 nt, Human
ccccaacccacuuccccaa

SEQ ID NO: 459189 - RNA, 27 nt, Human
ccccaacccacuuccccaaccucccuu

SEQ ID NO: 459190 - RNA, 18 nt, Human
cccggggcugcuuccagg

SEQ ID NO: 459191 - RNA, 22 nt, Human
ccucccgggcuaaucucaccag

SEQ ID NO: 459192 - RNA, 18 nt, Human
cgacaccaucuucacaca

SEQ ID NO: 459193 - RNA, 18 nt, Human
cgagcacacagcaacgug

SEQ ID NO: 459194 - RNA, 23 nt, Human
cuagucccacccacccuuucuca

SEQ ID NO: 459195 - RNA, 22 nt, Human
cucaccauuaccuaacaucacc

SEQ ID NO: 459196 - RNA, 23 nt, Human
cuccacagaacucuugccccucu

SEQ ID NO: 459197 - RNA, 19 nt, Human
cuccuguuucgucuguacc

SEQ ID NO: 459198 - RNA, 21 nt, Human
cucugcaauauucuuuuagcc

SEQ ID NO: 459199 - RNA, 23 nt, Human
cugcgaaaggacccaacaggcca

SEQ ID NO: 459200 - RNA, 23 nt, Human
cugcugccuagguuggccuugaa

SEQ ID NO: 459201 - RNA, 22 nt, Human
cuggcccagaaugaguuuccug

SEQ ID NO: 459202 - RNA, 22 nt, Human
cuggucacuagccauaucaaaa

SEQ ID NO: 459203 - RNA, 20 nt, Human
cuucaaaggacugcgaaagg

SEQ ID NO: 459204 - RNA, 24 nt, Human
gaaacccuccacauucauuugcuu

SEQ ID NO: 459205 - RNA, 22 nt, Human
gaaaccuucugcauuaucacag

SEQ ID NO: 459206 - RNA, 20 nt, Human
gaagaggaagacaagcccga

SEQ ID NO: 459207 - RNA, 19 nt, Human
gacaugaggcaggaagggu

SEQ ID NO: 459208 - RNA, 18 nt, Human
gagcugcugccuugagac

SEQ ID NO: 459209 - RNA, 18 nt, Human
gcacgagcuccugggcug

SEQ ID NO: 459210 - RNA, 22 nt, Human
gcagcagcaggacaagguagcu

SEQ ID NO: 459211 - RNA, 19 nt, Human
gccaaggaauuuuaucacc

SEQ ID NO: 459212 - RNA, 18 nt, Human
gccuguugacacucagcc

SEQ ID NO: 459213 - RNA, 22 nt, Human
gccuuguuuccugagaaggugg

SEQ ID NO: 459214 - RNA, 18 nt, Human
ggagagaacccaggugcu

SEQ ID NO: 459215 - RNA, 23 nt, Human
ggcaggggcacacgaagggaggg

SEQ ID NO: 459216 - RNA, 19 nt, Human
ggccccagcucccagaggg

SEQ ID NO: 459217 - RNA, 19 nt, Human
ggccucgggccuugcuuca

SEQ ID NO: 459218 - RNA, 21 nt, Human
ggcuaucaggauguggggaca

SEQ ID NO: 459219 - RNA, 23 nt, Human
gggacaguaaaagcaaccgguac

SEQ ID NO: 459220 - RNA, 21 nt, Human
gggaguccagaggaggggugg

SEQ ID NO: 459221 - RNA, 18 nt, Human
gggcaaggacuguggcug

SEQ ID NO: 459222 - RNA, 20 nt, Human
gggcagagccuagaggcccc

SEQ ID NO: 459223 - RNA, 21 nt, Human
gggcagagccuagaggcccca

SEQ ID NO: 459224 - RNA, 21 nt, Human
gggcagcagcaggacaaggua

SEQ ID NO: 459225 - RNA, 23 nt, Human
gggcagccuccauccagacucug

SEQ ID NO: 459226 - RNA, 19 nt, Human
gggcucggggaguaaacag

SEQ ID NO: 459227 - RNA, 24 nt, Human
gggggcucggggaguaaacaggag

SEQ ID NO: 459228 - RNA, 21 nt, Human
gguggcaggggcagcagcagg

SEQ ID NO: 459229 - RNA, 19 nt, Human
guaaagcauagcaaaugca

SEQ ID NO: 459230 - RNA, 20 nt, Human
guauguauauauuuauauau

SEQ ID NO: 459231 - RNA, 18 nt, Human
gucacuagccauaucaaa

SEQ ID NO: 459232 - RNA, 19 nt, Human
gucccacccacccuuucuc

SEQ ID NO: 459233 - RNA, 19 nt, Human
gugaagggcagagccuaga

SEQ ID NO: 459234 - RNA, 18 nt, Human
gugccacgagcacacagc

SEQ ID NO: 459235 - RNA, 24 nt, Human
guuuggucagcugcauuccagagg

SEQ ID NO: 459236 - RNA, 22 nt, Human
uaaaacaggggacaguaaaagc

SEQ ID NO: 459237 - RNA, 20 nt, Human
uaaaaggaaaccuucugcau

SEQ ID NO: 459238 - RNA, 24 nt, Human
uaacagcaaacaugugaagaaugu

SEQ ID NO: 459239 - RNA, 23 nt, Human
uaaccuacaacacuguuucuugg

SEQ ID NO: 459240 - RNA, 21 nt, Human
uaagauuuaaaacaaaaauuc

SEQ ID NO: 459241 - RNA, 23 nt, Human
uaagcagcugugguggcaggggc

SEQ ID NO: 459242 - RNA, 24 nt, Human
uacaaauaaaaugcccacaggaga

SEQ ID NO: 459243 - RNA, 22 nt, Human
uacaguaucauagacucugcaa

SEQ ID NO: 459244 - RNA, 19 nt, Human
uacauaccaugucuaguga

SEQ ID NO: 459245 - RNA, 21 nt, Human
uaccaugucuagugaagcucu

SEQ ID NO: 459246 - RNA, 20 nt, Human
uaccccaacccacuucccca

SEQ ID NO: 459247 - RNA, 22 nt, Human
uaccccaacccacuuccccaac

SEQ ID NO: 459248 - RNA, 25 nt, Human
uaccccaacccacuuccccaaccuc

SEQ ID NO: 459249 - RNA, 24 nt, Human
uaccccaacccacuuccccaaggu

SEQ ID NO: 459250 - RNA, 21 nt, Human
uagcacacaaaauaaauguuu

SEQ ID NO: 459251 - RNA, 19 nt, Human
uagguucuuucacuuauuc

SEQ ID NO: 459252 - RNA, 20 nt, Human
uauauauuuauauauauaua

SEQ ID NO: 459253 - RNA, 20 nt, Human
uauccagcaacauaucucca

SEQ ID NO: 459254 - RNA, 23 nt, Human
uauggaaauuuuuaugaacaguu

SEQ ID NO: 459255 - RNA, 20 nt, Human
uauguauauauuuauauaua

SEQ ID NO: 459256 - RNA, 22 nt, Human
uauguauauauuuauauauaua

SEQ ID NO: 459257 - RNA, 22 nt, Human
uauguauauauuuauauauaua

SEQ ID NO: 459258 - RNA, 23 nt, Human
ucagaggagggcuuggagaggaa

SEQ ID NO: 459259 - RNA, 21 nt, Human
ucauucacauauacaacaauc

SEQ ID NO: 459260 - RNA, 24 nt, Human
uccaaggccuuguuuccugagaag

SEQ ID NO: 459261 - RNA, 26 nt, Human
uccaccucaccauuaccuaacaucac

SEQ ID NO: 459262 - RNA, 20 nt, Human
uccacucucuccacagaacu

SEQ ID NO: 459263 - RNA, 22 nt, Human
uccagaggagggguggagagaa

SEQ ID NO: 459264 - RNA, 25 nt, Human
uccauccagacucuguguggggacc

SEQ ID NO: 459265 - RNA, 19 nt, Human
ucccagcuugggauggugg

SEQ ID NO: 459266 - RNA, 21 nt, Human
uccccaaccucccuauuauuu

SEQ ID NO: 459267 - RNA, 25 nt, Human
ucuacagucaccacaaccuugagac

SEQ ID NO: 459268 - RNA, 19 nt, Human
ucucacagaggggcagcug

SEQ ID NO: 459269 - RNA, 23 nt, Human
ucugcaauauucuuuuagccaag

SEQ ID NO: 459270 - RNA, 18 nt, Human
ucugcuauaaacaucauu

SEQ ID NO: 459271 - RNA, 22 nt, Human
ugaaagcaugaagacaugacug

SEQ ID NO: 459272 - RNA, 24 nt, Human
ugaauaucacuuaaaaucagcuug

SEQ ID NO: 459273 - RNA, 21 nt, Human
ugacacucagcccuuucccag

SEQ ID NO: 459274 - RNA, 22 nt, Human
ugacauuuuggacccaacuugg

SEQ ID NO: 459275 - RNA, 23 nt, Human
ugacugcacugggauugggcagg

SEQ ID NO: 459276 - RNA, 20 nt, Human
ugagaaucugggggcucggg

SEQ ID NO: 459277 - RNA, 18 nt, Human
ugaguuccuagucccacc

SEQ ID NO: 459278 - RNA, 21 nt, Human
ugcccuuaaccuacaacacug

SEQ ID NO: 459279 - RNA, 22 nt, Human
ugcgaaaggacccaacaggcca

SEQ ID NO: 459280 - RNA, 28 nt, Human
ugcgaaaggacccaacaggccacgugcc

SEQ ID NO: 459281 - RNA, 18 nt, Human
uggauguggucauggacc

SEQ ID NO: 459282 - RNA, 20 nt, Human
uggcagaagaaagagaggau

SEQ ID NO: 459283 - RNA, 21 nt, Human
uggcagaagaaagagaggauu

SEQ ID NO: 459284 - RNA, 22 nt, Human
uggcagaagaaagagaggauuc

SEQ ID NO: 459285 - RNA, 23 nt, Human
uggcauagcuggcacugaacuca

SEQ ID NO: 459286 - RNA, 19 nt, Human
ugggaauuuguuuggucag

SEQ ID NO: 459287 - RNA, 20 nt, Human
ugggaugguggucagugcug

SEQ ID NO: 459288 - RNA, 18 nt, Human
ugggcagaaaggccaggc

SEQ ID NO: 459289 - RNA, 19 nt, Human
ugggcagaaaggccaggcc

SEQ ID NO: 459290 - RNA, 22 nt, Human
ugggcagaaaggccaggcccca

SEQ ID NO: 459291 - RNA, 20 nt, Human
ugggcagggaggaaugccuu

SEQ ID NO: 459292 - RNA, 20 nt, Human
uggggacagcagaggggaug

SEQ ID NO: 459293 - RNA, 20 nt, Human
ugucuuguuugaaacccucc

SEQ ID NO: 459294 - RNA, 20 nt, Human
uuaaaaucagcuugugcacu

SEQ ID NO: 459295 - RNA, 21 nt, Human
uuaaagcaaaucugagacauc

SEQ ID NO: 459296 - RNA, 22 nt, Human
uucaacaauuaucaacucacac

SEQ ID NO: 459297 - RNA, 21 nt, Human
uucaugguggagggaaaagga

SEQ ID NO: 459298 - RNA, 23 nt, Human
uuccuagucccacccacccuuuc

SEQ ID NO: 459299 - RNA, 18 nt, Human
uuccugagaagguggcug

SEQ ID NO: 459300 - RNA, 18 nt, Human
uuccuuagguucuuucac

SEQ ID NO: 459301 - RNA, 18 nt, Human
uugcaguaugcagaccug

SEQ ID NO: 459302 - RNA, 19 nt, Human
uuuguugagaaugggcaga

SEQ ID NO: 459303 - RNA, 18 nt, Human
aaaauuacugugaaaaac

SEQ ID NO: 459304 - RNA, 22 nt, Human
aaacaagagugagauuccagaa

SEQ ID NO: 459305 - RNA, 21 nt, Human
aagcauauauaauaacaucau

SEQ ID NO: 459306 - RNA, 22 nt, Human
aagucuuuugagaaggauggca

SEQ ID NO: 459307 - RNA, 19 nt, Human
accucagcuacugagcaug

SEQ ID NO: 459308 - RNA, 24 nt, Human
agaaaucugguuuaggccaggugc

SEQ ID NO: 459309 - RNA, 24 nt, Human
aggugcgguggcucacaccuguaa

SEQ ID NO: 459310 - RNA, 18 nt, Human
agugagauuccagaaaaa

SEQ ID NO: 459311 - RNA, 20 nt, Human
caaagagcuaggauuaaaua

SEQ ID NO: 459312 - RNA, 24 nt, Human
cacaccuguaaucccggccaaaug

SEQ ID NO: 459313 - RNA, 18 nt, Human
caccuguaaucccggcca

SEQ ID NO: 459314 - RNA, 25 nt, Human
cacucuggaacaacguuggaccaaa

SEQ ID NO: 459315 - RNA, 20 nt, Human
caggaggagcaaaagcgcgu

SEQ ID NO: 459316 - RNA, 22 nt, Human
ccuaccucagcuacugagcaug

SEQ ID NO: 459317 - RNA, 18 nt, Human
cguagacccaggucccuc

SEQ ID NO: 459318 - RNA, 19 nt, Human
cuaauccccaaagucgaga

SEQ ID NO: 459319 - RNA, 25 nt, Human
cuacugagcaugcgggaaacugcgc

SEQ ID NO: 459320 - RNA, 26 nt, Human
cuuauaaugaugccacaagaauaaac

SEQ ID NO: 459321 - RNA, 19 nt, Human
gaauaacaaagagcuagga

SEQ ID NO: 459322 - RNA, 18 nt, Human
gagcuuuggcacugucaa

SEQ ID NO: 459323 - RNA, 24 nt, Human
ggaacaacguuggaccaaagacac

SEQ ID NO: 459324 - RNA, 23 nt, Human
ggaccaaagacacuucaggagga

SEQ ID NO: 459325 - RNA, 19 nt, Human
ggcucacaccuguaauccc

SEQ ID NO: 459326 - RNA, 22 nt, Human
gguggcucacaccuguaauccc

SEQ ID NO: 459327 - RNA, 24 nt, Human
gguggcucacaccuguaaucccgg

SEQ ID NO: 459328 - RNA, 21 nt, Human
uaaaaagcuggugaauaacaa

SEQ ID NO: 459329 - RNA, 18 nt, Human
uaacaaagagcuaggauu

SEQ ID NO: 459330 - RNA, 27 nt, Human
uaauuuauuuaaaaaaaacuuuucuca

SEQ ID NO: 459331 - RNA, 18 nt, Human
uaccgagcuuuggcacug

SEQ ID NO: 459332 - RNA, 20 nt, Human
ucauuggaaggaauagaagc

SEQ ID NO: 459333 - RNA, 24 nt, Human
ucucucauuggaaggaauagaagc

SEQ ID NO: 459334 - RNA, 22 nt, Human
ucuuuugagaaggauggcaucc

SEQ ID NO: 459335 - RNA, 24 nt, Human
uggaacaacguuggaccaaagaca

SEQ ID NO: 459336 - RNA, 21 nt, Human
uggcucacaccuguaaucccg

SEQ ID NO: 459337 - RNA, 21 nt, Human
uguccaguaccgagcuuuggc

SEQ ID NO: 459338 - RNA, 21 nt, Human
uguguccaguaccgagcuuug

SEQ ID NO: 459339 - RNA, 20 nt, Human
uuaaaaaaaacuuuucucau

SEQ ID NO: 459340 - RNA, 24 nt, Human
uuaggccaggugcgguggcucaca

SEQ ID NO: 459341 - RNA, 22 nt, Human
aaaaauaagcagacaccacagc

SEQ ID NO: 459342 - RNA, 24 nt, Human
aaaaauuucucuuccaauuauaaa

SEQ ID NO: 459343 - RNA, 24 nt, Human
aaacaaaaggaagugaugucccag

SEQ ID NO: 459344 - RNA, 26 nt, Human
aaacaaaaggaagugaugucccagag

SEQ ID NO: 459345 - RNA, 19 nt, Human
aaacaguuccccgcaaaga

SEQ ID NO: 459346 - RNA, 23 nt, Human
aaaccaaauaauauuggaaauaa

SEQ ID NO: 459347 - RNA, 19 nt, Human
aaacgacaagaucucuagc

SEQ ID NO: 459348 - RNA, 21 nt, Human
aaacugaaguucuugagaaaa

SEQ ID NO: 459349 - RNA, 22 nt, Human
aaacuggagggcugaguuugga

SEQ ID NO: 459350 - RNA, 19 nt, Human
aacacggcgagaccccauc

SEQ ID NO: 459351 - RNA, 20 nt, Human
aacacggcgagaccccaucu

SEQ ID NO: 459352 - RNA, 21 nt, Human
aacacggcgagaccccaucuc

SEQ ID NO: 459353 - RNA, 24 nt, Human
aacacggcucuuagaaaccucauu

SEQ ID NO: 459354 - RNA, 22 nt, Human
aagaaaacaaaaggaagugaug

SEQ ID NO: 459355 - RNA, 21 nt, Human
aagaucuccccuuuuacaucc

SEQ ID NO: 459356 - RNA, 19 nt, Human
aagcugccaaguggccugg

SEQ ID NO: 459357 - RNA, 19 nt, Human
aaggagaaaaaaaaaauga

SEQ ID NO: 459358 - RNA, 20 nt, Human
aagugaucucucccuaaagc

SEQ ID NO: 459359 - RNA, 22 nt, Human
aauauacacacacacugaagug

SEQ ID NO: 459360 - RNA, 19 nt, Human
aaucauggucuucucauug

SEQ ID NO: 459361 - RNA, 20 nt, Human
aauguggaaacacacagaaa

SEQ ID NO: 459362 - RNA, 18 nt, Human
aauuccuugagguugcuc

SEQ ID NO: 459363 - RNA, 23 nt, Human
acagcacuagagaaagagggugc

SEQ ID NO: 459364 - RNA, 23 nt, Human
acagcacuagagaaagagggugc

SEQ ID NO: 459365 - RNA, 22 nt, Human
acucagaacccagaggcucucc

SEQ ID NO: 459366 - RNA, 18 nt, Human
acugaaguucuugagaaa

SEQ ID NO: 459367 - RNA, 21 nt, Human
acuguacugcaaauaaauaua

SEQ ID NO: 459368 - RNA, 23 nt, Human
acuugagugcaaagcuucaucca

SEQ ID NO: 459369 - RNA, 24 nt, Human
acuuuaaaaaaugccagauuuccg

SEQ ID NO: 459370 - RNA, 19 nt, Human
agaaagacaacaccagcag

SEQ ID NO: 459371 - RNA, 22 nt, Human
agaacaaaaaggaacuucaaua

SEQ ID NO: 459372 - RNA, 20 nt, Human
agaagacgcacucacccaca

SEQ ID NO: 459373 - RNA, 19 nt, Human
agagcagagcugaauucuu

SEQ ID NO: 459374 - RNA, 23 nt, Human
aggcagccgaagugcccucugga

SEQ ID NO: 459375 - RNA, 19 nt, Human
aggcggaggcgggcagggc

SEQ ID NO: 459376 - RNA, 21 nt, Human
aucacagaagauggauggaaa

SEQ ID NO: 459377 - RNA, 19 nt, Human
aucugugaagaucuccccu

SEQ ID NO: 459378 - RNA, 24 nt, Human
auggaaagcacaaauacaaaaaua

SEQ ID NO: 459379 - RNA, 21 nt, Human
augguuauaauucaugugugc

SEQ ID NO: 459380 - RNA, 21 nt, Human
caaaaauaagcagacaccaca

SEQ ID NO: 459381 - RNA, 23 nt, Human
caaauaaauauacacacacacug

SEQ ID NO: 459382 - RNA, 22 nt, Human
caacugaacagaacccacucag

SEQ ID NO: 459383 - RNA, 22 nt, Human
caacugcagauccuccuacccc

SEQ ID NO: 459384 - RNA, 18 nt, Human
caagagccgcugcaaccu

SEQ ID NO: 459385 - RNA, 24 nt, Human
caagagccgggccucgaaugagag

SEQ ID NO: 459386 - RNA, 20 nt, Human
caagaucucuagcccaucca

SEQ ID NO: 459387 - RNA, 23 nt, Human
caagucgugcuagaaaaccuuaa

SEQ ID NO: 459388 - RNA, 19 nt, Human
cacacauacaaguuagagc

SEQ ID NO: 459389 - RNA, 18 nt, Human
cacccacacgugcgcgua

SEQ ID NO: 459390 - RNA, 24 nt, Human
cacggcgagaccccaucucuaggg

SEQ ID NO: 459391 - RNA, 31 nt, Human
cacgugcgcguacacacacacacacgcgcgg

SEQ ID NO: 459392 - RNA, 22 nt, Human
cagaaagacggcugaacaacug

SEQ ID NO: 459393 - RNA, 22 nt, Human
cagaacccagaggcucuccaga

SEQ ID NO: 459394 - RNA, 19 nt, Human
cagagaaauggagccugua

SEQ ID NO: 459395 - RNA, 21 nt, Human
cagagcccucugcacaccuuc

SEQ ID NO: 459396 - RNA, 19 nt, Human
cagcagaaagacggcugaa

SEQ ID NO: 459397 - RNA, 23 nt, Human
cagcagagagagagccaggacug

SEQ ID NO: 459398 - RNA, 21 nt, Human
caggccagauuucccugcugg

SEQ ID NO: 459399 - RNA, 23 nt, Human
cauccuggcgcucagagcccucu

SEQ ID NO: 459400 - RNA, 22 nt, Human
caucgguaaaccaagcugccaa

SEQ ID NO: 459401 - RNA, 18 nt, Human
caucugaagaaacuggag

SEQ ID NO: 459402 - RNA, 24 nt, Human
caugagugaaacaguuccccgcaa

SEQ ID NO: 459403 - RNA, 24 nt, Human
ccaccgcccagaacggaaccuauu

SEQ ID NO: 459404 - RNA, 21 nt, Human
ccaccugggcuguugccaagg

SEQ ID NO: 459405 - RNA, 23 nt, Human
ccacucagaagacgcacucaccc

SEQ ID NO: 459406 - RNA, 24 nt, Human
ccagaacuaaaaauuaaaauccuc

SEQ ID NO: 459407 - RNA, 18 nt, Human
ccaggccuguggcaugac

SEQ ID NO: 459408 - RNA, 22 nt, Human
ccauccuggcgcucagagcccu

SEQ ID NO: 459409 - RNA, 22 nt, Human
cccacgagucuggauguccgca

SEQ ID NO: 459410 - RNA, 23 nt, Human
cccacucagaagacgcacucacc

SEQ ID NO: 459411 - RNA, 20 nt, Human
ccccaagcuccaggacgcuc

SEQ ID NO: 459412 - RNA, 23 nt, Human
cccgcaaagagauuuguaaaauc

SEQ ID NO: 459413 - RNA, 19 nt, Human
ccucuggagagaaaggccc

SEQ ID NO: 459414 - RNA, 25 nt, Human
cgcguacacacacacacacgcgcgc

SEQ ID NO: 459415 - RNA, 22 nt, Human
cgugcuagaaaaccuuaagaag

SEQ ID NO: 459416 - RNA, 18 nt, Human
cuaaagcauccuugugcu

SEQ ID NO: 459417 - RNA, 21 nt, Human
cuacaagagccgcugcaaccu

SEQ ID NO: 459418 - RNA, 19 nt, Human
cucaagcguucucuucaau

SEQ ID NO: 459419 - RNA, 21 nt, Human
cucacacauacaaguuagagc

SEQ ID NO: 459420 - RNA, 21 nt, Human
cuccgaaagaaaacaaaagga

SEQ ID NO: 459421 - RNA, 22 nt, Human
cuccgaaagaaaacaaaaggaa

SEQ ID NO: 459422 - RNA, 18 nt, Human
cugaagaaacuggagggc

SEQ ID NO: 459423 - RNA, 18 nt, Human
cugcaaauaaauauacac

SEQ ID NO: 459424 - RNA, 23 nt, Human
cugcacaccuucgaacgggcugu

SEQ ID NO: 459425 - RNA, 26 nt, Human
cugugaagaucuccccuuuuacaucc

SEQ ID NO: 459426 - RNA, 20 nt, Human
cuuagaaaccucauuccaaa

SEQ ID NO: 459427 - RNA, 24 nt, Human
gaacggaaccuauucugucagcaa

SEQ ID NO: 459428 - RNA, 19 nt, Human
gacagucugugcaacacgg

SEQ ID NO: 459429 - RNA, 26 nt, Human
gacgcacucacccacacgugcgcgua

SEQ ID NO: 459430 - RNA, 20 nt, Human
gaggaagcagaggcagccga

SEQ ID NO: 459431 - RNA, 18 nt, Human
gaggcaucugugaagauc

SEQ ID NO: 459432 - RNA, 20 nt, Human
gaguggcacagaagggaugg

SEQ ID NO: 459433 - RNA, 20 nt, Human
gauggcagaaagacaacacc

SEQ ID NO: 459434 - RNA, 20 nt, Human
gauggcauugaguggcacag

SEQ ID NO: 459435 - RNA, 22 nt, Human
gcaaagcuucauccagguccca

SEQ ID NO: 459436 - RNA, 24 nt, Human
gcacaaaaaaagguggaagaauuc

SEQ ID NO: 459437 - RNA, 20 nt, Human
gcaccaaggccggccagaga

SEQ ID NO: 459438 - RNA, 19 nt, Human
gccucgaaugagaggaagc

SEQ ID NO: 459439 - RNA, 24 nt, Human
gccugcccuucagguuuuucccau

SEQ ID NO: 459440 - RNA, 23 nt, Human
gcguacacacacacacacgcggg

SEQ ID NO: 459441 - RNA, 18 nt, Human
gcuccaggacgcucagag

SEQ ID NO: 459442 - RNA, 24 nt, Human
gcuccgaaagaaaacaaaaggaag

SEQ ID NO: 459443 - RNA, 25 nt, Human
gcucuuagaaaccucauuccaaauc

SEQ ID NO: 459444 - RNA, 28 nt, Human
gcugcaaccucagagaagggggaacgcc

SEQ ID NO: 459445 - RNA, 28 nt, Human
ggaaaaaccaugucuggauggcauugag

SEQ ID NO: 459446 - RNA, 20 nt, Human
ggagagaaaggccccuggag

SEQ ID NO: 459447 - RNA, 21 nt, Human
ggcagaguccugggguuuucc

SEQ ID NO: 459448 - RNA, 19 nt, Human
ggcgggcccagcacgugca

SEQ ID NO: 459449 - RNA, 22 nt, Human
gggaaaaaaagggaacgugaag

SEQ ID NO: 459450 - RNA, 18 nt, Human
gggaaaaaccaugucugg

SEQ ID NO: 459451 - RNA, 23 nt, Human
gggaauguggaaacacacagaaa

SEQ ID NO: 459452 - RNA, 25 nt, Human
ggguagacgggugcuugcacuuucu

SEQ ID NO: 459453 - RNA, 23 nt, Human
guacacacacacacacgcgcgca

SEQ ID NO: 459454 - RNA, 24 nt, Human
gugaaacaguuccccgcaaagaga

SEQ ID NO: 459455 - RNA, 24 nt, Human
guggggacugucccugcaaguggg

SEQ ID NO: 459456 - RNA, 24 nt, Human
uaacagcaaaaauuucucuuccaa

SEQ ID NO: 459457 - RNA, 19 nt, Human
uaacauaccuuacaggacu

SEQ ID NO: 459458 - RNA, 23 nt, Human
uaagcagacaccacagcacuaga

SEQ ID NO: 459459 - RNA, 22 nt, Human
uaccgagccaugggugggcccc

SEQ ID NO: 459460 - RNA, 22 nt, Human
uagccggccagaacuaaaaauu

SEQ ID NO: 459461 - RNA, 24 nt, Human
uauucacaugcauaggagugcaua

SEQ ID NO: 459462 - RNA, 19 nt, Human
ucacaccugugaagauagc

SEQ ID NO: 459463 - RNA, 20 nt, Human
ucagaaagaugaaggugcug

SEQ ID NO: 459464 - RNA, 19 nt, Human
uccaagaaacgacaagagg

SEQ ID NO: 459465 - RNA, 21 nt, Human
ucccagugccggcuauagaga

SEQ ID NO: 459466 - RNA, 19 nt, Human
uccccaagcuccaggacgc

SEQ ID NO: 459467 - RNA, 24 nt, Human
ucccuugacaauacuugagugcaa

SEQ ID NO: 459468 - RNA, 20 nt, Human
ucgaaagacugcgguucucu

SEQ ID NO: 459469 - RNA, 22 nt, Human
ucugcacaccuucgaacgggcu

SEQ ID NO: 459470 - RNA, 23 nt, Human
ucuggagagaaaggccccuggag

SEQ ID NO: 459471 - RNA, 23 nt, Human
ugaagaacacggcucuuagaaac

SEQ ID NO: 459472 - RNA, 20 nt, Human
ugaauacagacagucugugc

SEQ ID NO: 459473 - RNA, 24 nt, Human
ugaaugugguaugaucacaccugu

SEQ ID NO: 459474 - RNA, 18 nt, Human
ugacuuauuuuuuuccuu

SEQ ID NO: 459475 - RNA, 25 nt, Human
ugacuuccaagaaacgacaagaucu

SEQ ID NO: 459476 - RNA, 25 nt, Human
ugagaacaaaaaggaacuucaauac

SEQ ID NO: 459477 - RNA, 21 nt, Human
ugagggcuugaauuaccuaga

SEQ ID NO: 459478 - RNA, 22 nt, Human
ugaguggcacagaagggauggg

SEQ ID NO: 459479 - RNA, 20 nt, Human
ugaguuuggaguaaaggaga

SEQ ID NO: 459480 - RNA, 23 nt, Human
ugcaaagcuucauccagguccca

SEQ ID NO: 459481 - RNA, 21 nt, Human
ugcacuuucuggcuuuggugg

SEQ ID NO: 459482 - RNA, 22 nt, Human
ugcagaaagugguuuuguuuua

SEQ ID NO: 459483 - RNA, 28 nt, Human
ugccaaaaacugacuuauuuuuuuccuu

SEQ ID NO: 459484 - RNA, 21 nt, Human
ugccuagaguggcagaguccu

SEQ ID NO: 459485 - RNA, 18 nt, Human
ugcucaagcguucucuuc

SEQ ID NO: 459486 - RNA, 22 nt, Human
ugcucaggccagauuucccugc

SEQ ID NO: 459487 - RNA, 23 nt, Human
uggaagaauucucacuggggaaa

SEQ ID NO: 459488 - RNA, 24 nt, Human
uggaguaaaggagaaaaaaaaaau

SEQ ID NO: 459489 - RNA, 26 nt, Human
uggcacaaaaaaagguggaagaauuc

SEQ ID NO: 459490 - RNA, 21 nt, Human
uggcacagaagggaugggacu

SEQ ID NO: 459491 - RNA, 21 nt, Human
uggcagagaaauuaaucuaua

SEQ ID NO: 459492 - RNA, 22 nt, Human
uggcaugaccucuggcuugcug

SEQ ID NO: 459493 - RNA, 21 nt, Human
uggcauugaguggcacagaag

SEQ ID NO: 459494 - RNA, 21 nt, Human
ugucagcaagagccgggccuc

SEQ ID NO: 459495 - RNA, 23 nt, Human
ugucccugcaagugggaguucag

SEQ ID NO: 459496 - RNA, 22 nt, Human
ugugugccuagaguggcagagu

SEQ ID NO: 459497 - RNA, 20 nt, Human
uguuucagaagugaaugugg

SEQ ID NO: 459498 - RNA, 26 nt, Human
uuaaaagaaaucauggucuucucauu

SEQ ID NO: 459499 - RNA, 18 nt, Human
uuaccuagauuuuccaag

SEQ ID NO: 459500 - RNA, 20 nt, Human
uucccuagguguucucucca

SEQ ID NO: 459501 - RNA, 23 nt, Human
uucccuagguguucucuccacac

SEQ ID NO: 459502 - RNA, 18 nt, Human
uugaccacacgcagugga

SEQ ID NO: 459503 - RNA, 22 nt, Human
uuuguaaaauccugaugaugac

SEQ ID NO: 459504 - RNA, 23 nt, Human
aagcuggucucuuccgugacaca

SEQ ID NO: 459505 - RNA, 19 nt, Human
accccaucggaagcacaau

SEQ ID NO: 459506 - RNA, 18 nt, Human
acccuggaacuugagccc

SEQ ID NO: 459507 - RNA, 18 nt, Human
acccuggaacuugagccc

SEQ ID NO: 459508 - RNA, 21 nt, Human
accuuaaaacccuggaacuug

SEQ ID NO: 459509 - RNA, 20 nt, Human
agcacaauuucccauugucu

SEQ ID NO: 459510 - RNA, 18 nt, Human
aguccccaccccaucgga

SEQ ID NO: 459511 - RNA, 19 nt, Human
auccaggacuuccagcugc

SEQ ID NO: 459512 - RNA, 20 nt, Human
auccaggacuuccagcugcu

SEQ ID NO: 459513 - RNA, 20 nt, Human
cccaccccaucggaagcaca

SEQ ID NO: 459514 - RNA, 22 nt, Human
ccccucugcccucuggugccug

SEQ ID NO: 459515 - RNA, 22 nt, Human
ccuuaaaacccuggaacuugag

SEQ ID NO: 459516 - RNA, 18 nt, Human
ccuuuccuucucaguccc

SEQ ID NO: 459517 - RNA, 30 nt, Human
ccuuugcaaacagacuuucaggugggaacu

SEQ ID NO: 459518 - RNA, 23 nt, Human
cuccugggaguuccaagcaccuu

SEQ ID NO: 459519 - RNA, 21 nt, Human
cugucuguccuuuccuucuca

SEQ ID NO: 459520 - RNA, 21 nt, Human
cuuaaaacccuggaacuugag

SEQ ID NO: 459521 - RNA, 20 nt, Human
cuuuuccccuauuguugaau

SEQ ID NO: 459522 - RNA, 19 nt, Human
cuuuuugucuugcuugagg

SEQ ID NO: 459523 - RNA, 21 nt, Human
gaagguuugccaggcuccugg

SEQ ID NO: 459524 - RNA, 18 nt, Human
gcuuuuugucuugcuuga

SEQ ID NO: 459525 - RNA, 20 nt, Human
ggccccuuucuuuauucugu

SEQ ID NO: 459526 - RNA, 23 nt, Human
gggccccuuucuuuauucugugg

SEQ ID NO: 459527 - RNA, 23 nt, Human
gugcuuagcagcuuuuugucuug

SEQ ID NO: 459528 - RNA, 23 nt, Human
uaaaacccuggaacuugagcccc

SEQ ID NO: 459529 - RNA, 23 nt, Human
uaacagggccccuuucuuuauuc

SEQ ID NO: 459530 - RNA, 24 nt, Human
ucacagagacggagggagcagugc

SEQ ID NO: 459531 - RNA, 20 nt, Human
ucugucugucugucuguccu

SEQ ID NO: 459532 - RNA, 22 nt, Human
ugaagguuugccaggcuccugg

SEQ ID NO: 459533 - RNA, 22 nt, Human
ugggaacuauccaggacuucca

SEQ ID NO: 459534 - RNA, 25 nt, Human
uguacaacccccugucugucugucu

SEQ ID NO: 459535 - RNA, 22 nt, Human
uguccuuuccuucucagucccc

SEQ ID NO: 459536 - RNA, 24 nt, Human
ugucucugucuuuuccccuauugu

SEQ ID NO: 459537 - RNA, 24 nt, Human
ugucugucuguccuuuccuucuca

SEQ ID NO: 459538 - RNA, 19 nt, Human
uuccaagcaccuuaaaacc

SEQ ID NO: 459539 - RNA, 20 nt, Human
uucucaguccccaccccauc

SEQ ID NO: 459540 - RNA, 21 nt, Human
uugaauaacagggccccuuuc

SEQ ID NO: 459541 - RNA, 27 nt, Human
uuucccauugucucugucuuuuccccu

SEQ ID NO: 459542 - RNA, 22 nt, Human
uuuuccccuauuguugaauaac

SEQ ID NO: 459543 - RNA, 21 nt, Human
aggcuggaaggcgagccgaga

SEQ ID NO: 459544 - RNA, 22 nt, Human
cacccucacauuuagcugaagg

SEQ ID NO: 459545 - RNA, 21 nt, Human
cacucucacagugucagggag

SEQ ID NO: 459546 - RNA, 18 nt, Human
cagcagcagcagcuccuc

SEQ ID NO: 459547 - RNA, 19 nt, Human
cagcagcagcagcuccucg

SEQ ID NO: 459548 - RNA, 18 nt, Human
cauccaucucuaaggcca

SEQ ID NO: 459549 - RNA, 18 nt, Human
ccggcgcgggcccggcgg

SEQ ID NO: 459550 - RNA, 18 nt, Human
cgagccgagagcgagcgg

SEQ ID NO: 459551 - RNA, 19 nt, Human
gagccgagagcgagcggcc

SEQ ID NO: 459552 - RNA, 18 nt, Human
ugccgccgccucagcagc

SEQ ID NO: 459553 - RNA, 20 nt, Human
aaaaccuccccccuccccgg

SEQ ID NO: 459554 - RNA, 22 nt, Human
aaacaaguuacagaaagccccu

SEQ ID NO: 459555 - RNA, 24 nt, Human
aaacucacagcuaaccucuuucca

SEQ ID NO: 459556 - RNA, 21 nt, Human
aacccacccuacuuuccccaa

SEQ ID NO: 459557 - RNA, 24 nt, Human
aacuuuauucuccccucuuuccac

SEQ ID NO: 459558 - RNA, 24 nt, Human
aagaaaaagcuacauaucaaagaa

SEQ ID NO: 459559 - RNA, 21 nt, Human
aagcaaaugaauacacuuucu

SEQ ID NO: 459560 - RNA, 18 nt, Human
aagcaugcuuggacagau

SEQ ID NO: 459561 - RNA, 23 nt, Human
aagccccucauuguaaacaaaag

SEQ ID NO: 459562 - RNA, 22 nt, Human
aaucaaagcaaaacucacagcc

SEQ ID NO: 459563 - RNA, 21 nt, Human
accacaaaagcaugcuuggac

SEQ ID NO: 459564 - RNA, 18 nt, Human
acccacccuacuuucccc

SEQ ID NO: 459565 - RNA, 18 nt, Human
acccacccuacuuucccc

SEQ ID NO: 459566 - RNA, 22 nt, Human
accugcgggguuugaggugggc

SEQ ID NO: 459567 - RNA, 18 nt, Human
agaaaacuuggaaauaaa

SEQ ID NO: 459568 - RNA, 18 nt, Human
agcagcaguaacaggcag

SEQ ID NO: 459569 - RNA, 22 nt, Human
aggagcccuccugagcaccugc

SEQ ID NO: 459570 - RNA, 21 nt, Human
aggcaaaaguaaagguaauuc

SEQ ID NO: 459571 - RNA, 18 nt, Human
aggcacaccugcgggguu

SEQ ID NO: 459572 - RNA, 18 nt, Human
aggcacagaggcuaugcc

SEQ ID NO: 459573 - RNA, 21 nt, Human
aggcagagaggcagccugagg

SEQ ID NO: 459574 - RNA, 22 nt, Human
aggcagagaggcagccugagga

SEQ ID NO: 459575 - RNA, 27 nt, Human
agguguccaaaaccacacauccaggcc

SEQ ID NO: 459576 - RNA, 23 nt, Human
caaagacucgagaaaaccacaaa

SEQ ID NO: 459577 - RNA, 25 nt, Human
caccaggcacagaggcuaugcccac

SEQ ID NO: 459578 - RNA, 25 nt, Human
cagagaggcagccugaggagcccuc

SEQ ID NO: 459579 - RNA, 18 nt, Human
cagcaguaacaggcagag

SEQ ID NO: 459580 - RNA, 22 nt, Human
cagcauaacuuuauucuccccu

SEQ ID NO: 459581 - RNA, 24 nt, Human
cagcuaaccucuuuccaagguguc

SEQ ID NO: 459582 - RNA, 20 nt, Human
ccaaaaccacacauccaggc

SEQ ID NO: 459583 - RNA, 18 nt, Human
ccacacauccaggccuga

SEQ ID NO: 459584 - RNA, 20 nt, Human
ccaggcacagaggcuaugcc

SEQ ID NO: 459585 - RNA, 27 nt, Human
cccacaguugcaggacuuucccagcaa

SEQ ID NO: 459586 - RNA, 21 nt, Human
cccaccagacaggcaugcuca

SEQ ID NO: 459587 - RNA, 21 nt, Human
cccacucacagcgcccagacg

SEQ ID NO: 459588 - RNA, 19 nt, Human
ccccaacauaaugcuuuac

SEQ ID NO: 459589 - RNA, 26 nt, Human
ccccaggaccagggagggagcagcag

SEQ ID NO: 459590 - RNA, 21 nt, Human
cccucauuguaaacaaaagau

SEQ ID NO: 459591 - RNA, 19 nt, Human
ccgcugggaggcacaccug

SEQ ID NO: 459592 - RNA, 18 nt, Human
ccggcccagagcccacag

SEQ ID NO: 459593 - RNA, 31 nt, Human
ccuaccaccacacaccaguccccucucggaa

SEQ ID NO: 459594 - RNA, 27 nt, Human
ccucauuguaaacaaaagauuacaagu

SEQ ID NO: 459595 - RNA, 21 nt, Human
ccugcgggguuugaggugggc

SEQ ID NO: 459596 - RNA, 19 nt, Human
ccugcgucccuaccaccac

SEQ ID NO: 459597 - RNA, 18 nt, Human
cgacgggagcggggacac

SEQ ID NO: 459598 - RNA, 18 nt, Human
cgagaaaaccacaaaagc

SEQ ID NO: 459599 - RNA, 24 nt, Human
cgcccagacggagauggguuccua

SEQ ID NO: 459600 - RNA, 26 nt, Human
cucacagcgcccagacggagaugggu

SEQ ID NO: 459601 - RNA, 22 nt, Human
cucacagcuaaccucuuuccaa

SEQ ID NO: 459602 - RNA, 29 nt, Human
cuccugagcaccugcgucccuaccaccuu

SEQ ID NO: 459603 - RNA, 18 nt, Human
cucucggaccacaccaac

SEQ ID NO: 459604 - RNA, 20 nt, Human
cucuguguaaagagcaugau

SEQ ID NO: 459605 - RNA, 21 nt, Human
cugagcaccugcgucccuacc

SEQ ID NO: 459606 - RNA, 22 nt, Human
cugcggagaccacagcaacgcu

SEQ ID NO: 459607 - RNA, 23 nt, Human
gaacaauauacaaacauguacag

SEQ ID NO: 459608 - RNA, 24 nt, Human
gaacaauauacaaacauguacagc

SEQ ID NO: 459609 - RNA, 20 nt, Human
gacacacccaccggcgguca

SEQ ID NO: 459610 - RNA, 18 nt, Human
gagaaaaccacaaaagca

SEQ ID NO: 459611 - RNA, 25 nt, Human
gagaaaaccacaaaagcaugcuugg

SEQ ID NO: 459612 - RNA, 20 nt, Human
gagcagcaguaacaggcaga

SEQ ID NO: 459613 - RNA, 21 nt, Human
gagcagcaguaacaggcagag

SEQ ID NO: 459614 - RNA, 20 nt, Human
gcaggcggucccccaggaag

SEQ ID NO: 459615 - RNA, 18 nt, Human
ggaggcacaccugcgggg

SEQ ID NO: 459616 - RNA, 22 nt, Human
gggacgacgggagcggggacac

SEQ ID NO: 459617 - RNA, 21 nt, Human
gggagcagcaguaacaggcag

SEQ ID NO: 459618 - RNA, 19 nt, Human
ggggaaaaagaauuaaaga

SEQ ID NO: 459619 - RNA, 21 nt, Human
ggugaccaaagacucgagaaa

SEQ ID NO: 459620 - RNA, 24 nt, Human
uaaagcaaaugaauacacuuucua

SEQ ID NO: 459621 - RNA, 20 nt, Human
uaagaaaaagcuacauauca

SEQ ID NO: 459622 - RNA, 25 nt, Human
uacaaguuauaaaaucaaaguacac

SEQ ID NO: 459623 - RNA, 19 nt, Human
uacacagcauaacuuuauu

SEQ ID NO: 459624 - RNA, 19 nt, Human
uauacaaugcaaugcauuc

SEQ ID NO: 459625 - RNA, 23 nt, Human
uauauacaucacagguaccauac

SEQ ID NO: 459626 - RNA, 22 nt, Human
uauuaaacauucaaaagucuuu

SEQ ID NO: 459627 - RNA, 24 nt, Human
ucaaagcaaaacucacagcuaacc

SEQ ID NO: 459628 - RNA, 24 nt, Human
ucaaaguacacacaggccagaguc

SEQ ID NO: 459629 - RNA, 22 nt, Human
uccaaaguuucuauugcuacca

SEQ ID NO: 459630 - RNA, 21 nt, Human
uccacauacagggcuggaccc

SEQ ID NO: 459631 - RNA, 23 nt, Human
ugaccaaagacucgagaaaacca

SEQ ID NO: 459632 - RNA, 21 nt, Human
ugaggagcccuccugagcacc

SEQ ID NO: 459633 - RNA, 24 nt, Human
uggaaacccacccuacuuucccca

SEQ ID NO: 459634 - RNA, 25 nt, Human
uggaaauaaaaccuccccccucccc

SEQ ID NO: 459635 - RNA, 19 nt, Human
uggugaucugcaagugaug

SEQ ID NO: 459636 - RNA, 27 nt, Human
uguccaaaaccacacauuaccauaggg

SEQ ID NO: 459637 - RNA, 18 nt, Human
uuguaaacaaaagauuac

SEQ ID NO: 459638 - RNA, 21 nt, Human
uuuccaagguguccaaaacca

SEQ ID NO: 459639 - RNA, 26 nt, Human
uuuuuuuucuugacuuuauuuuuaau

SEQ ID NO: 459640 - RNA, 20 nt, Human
aaaaaaucaacguaaaaaaa

SEQ ID NO: 459641 - RNA, 18 nt, Human
aaaaagagcucccccuuc

SEQ ID NO: 459642 - RNA, 25 nt, Human
aaaaaucaacguaaaaaaagagcua

SEQ ID NO: 459643 - RNA, 22 nt, Human
aaaacgaagccgugcuggggga

SEQ ID NO: 459644 - RNA, 22 nt, Human
aaacagaguagaaaaaaaaaaa

SEQ ID NO: 459645 - RNA, 21 nt, Human
aacaaucucaaaacagggccc

SEQ ID NO: 459646 - RNA, 18 nt, Human
aacccgccacaucuccaa

SEQ ID NO: 459647 - RNA, 21 nt, Human
aagcagucucuuuggggccuc

SEQ ID NO: 459648 - RNA, 20 nt, Human
aauuagaacaaacaaucuca

SEQ ID NO: 459649 - RNA, 22 nt, Human
acaaagucuucccaagcuucca

SEQ ID NO: 459650 - RNA, 19 nt, Human
acccgccacaucuccaagc

SEQ ID NO: 459651 - RNA, 19 nt, Human
acccuccccccagccuuac

SEQ ID NO: 459652 - RNA, 18 nt, Human
acugcccgcugggaccag

SEQ ID NO: 459653 - RNA, 23 nt, Human
agagacccacagggaaguggcaa

SEQ ID NO: 459654 - RNA, 21 nt, Human
agcagcagcgaagaaucugga

SEQ ID NO: 459655 - RNA, 20 nt, Human
aggcagaagagugccgcaga

SEQ ID NO: 459656 - RNA, 24 nt, Human
aggccauuuccaagcggauggagg

SEQ ID NO: 459657 - RNA, 18 nt, Human
aggggaccaaauggggag

SEQ ID NO: 459658 - RNA, 20 nt, Human
agggguccgguccugcggag

SEQ ID NO: 459659 - RNA, 21 nt, Human
aggugcggaagccaucgccuc

SEQ ID NO: 459660 - RNA, 25 nt, Human
auccuaaagccuuccagggggccuc

SEQ ID NO: 459661 - RNA, 18 nt, Human
caaagucuucccaagcuu

SEQ ID NO: 459662 - RNA, 25 nt, Human
caaagucuucccaagcuuccaugca

SEQ ID NO: 459663 - RNA, 21 nt, Human
caacaaagacaguccagggga

SEQ ID NO: 459664 - RNA, 23 nt, Human
caacguaaaaaaagagcuccccc

SEQ ID NO: 459665 - RNA, 24 nt, Human
cacccccuccgcgcgcgcgcgcuc

SEQ ID NO: 459666 - RNA, 21 nt, Human
cagacggcggacagcaagaaa

SEQ ID NO: 459667 - RNA, 19 nt, Human
cagagccuccagcacucuc

SEQ ID NO: 459668 - RNA, 22 nt, Human
cagcacucucuccccgccuccc

SEQ ID NO: 459669 - RNA, 22 nt, Human
cagcagcacccagauuggcuga

SEQ ID NO: 459670 - RNA, 18 nt, Human
cagcagcagcgaagaauc

SEQ ID NO: 459671 - RNA, 18 nt, Human
cagggguguggccgcaag

SEQ ID NO: 459672 - RNA, 24 nt, Human
ccaacaaagucuucccaagcuucc

SEQ ID NO: 459673 - RNA, 23 nt, Human
ccagcacucucuccccgccuccc

SEQ ID NO: 459674 - RNA, 21 nt, Human
ccaggggcuucuagggggucu

SEQ ID NO: 459675 - RNA, 23 nt, Human
ccagggggccuccaaaguugccc

SEQ ID NO: 459676 - RNA, 22 nt, Human
ccauuggccaaagcagggaaac

SEQ ID NO: 459677 - RNA, 22 nt, Human
cccaccccccgccuuuccccca

SEQ ID NO: 459678 - RNA, 25 nt, Human
cccacccuccccccagccuuaccua

SEQ ID NO: 459679 - RNA, 19 nt, Human
cccagggccccaaauggag

SEQ ID NO: 459680 - RNA, 19 nt, Human
ccccaaauggagcggaagg

SEQ ID NO: 459681 - RNA, 23 nt, Human
ccccacccccuccgcgcgcgcgc

SEQ ID NO: 459682 - RNA, 25 nt, Human
ccccacugcagagccagcucuccua

SEQ ID NO: 459683 - RNA, 21 nt, Human
ccccagccccucccuuccgga

SEQ ID NO: 459684 - RNA, 18 nt, Human
ccccagggccccaaaugg

SEQ ID NO: 459685 - RNA, 19 nt, Human
cccccaccccccgccuuuc

SEQ ID NO: 459686 - RNA, 20 nt, Human
cccccaccccccgccuuucc

SEQ ID NO: 459687 - RNA, 25 nt, Human
cccccaccccccgccuuucccccag

SEQ ID NO: 459688 - RNA, 20 nt, Human
cccccagccuuaccuagcuu

SEQ ID NO: 459689 - RNA, 21 nt, Human
cccccagccuuaccuagcuua

SEQ ID NO: 459690 - RNA, 22 nt, Human
ccccccgccuuucccccagcca

SEQ ID NO: 459691 - RNA, 27 nt, Human
ccccuucuucccuccccauggaggcug

SEQ ID NO: 459692 - RNA, 20 nt, Human
cccgccacaucuccaagcca

SEQ ID NO: 459693 - RNA, 20 nt, Human
cccuuagaagugaauagggc

SEQ ID NO: 459694 - RNA, 20 nt, Human
ccgagccccgcgccagcccu

SEQ ID NO: 459695 - RNA, 20 nt, Human
ccgccuccaucuuugaaauc

SEQ ID NO: 459696 - RNA, 19 nt, Human
ccgcuucccccccaccccc

SEQ ID NO: 459697 - RNA, 22 nt, Human
ccuagaggggggcggggggggg

SEQ ID NO: 459698 - RNA, 22 nt, Human
ccuaugucccgaaacccagagc

SEQ ID NO: 459699 - RNA, 22 nt, Human
ccuccaaaguugcccucggcuu

SEQ ID NO: 459700 - RNA, 23 nt, Human
ccuccagcacucucuccccgccu

SEQ ID NO: 459701 - RNA, 22 nt, Human
ccuccaggcgacaaacccccug

SEQ ID NO: 459702 - RNA, 21 nt, Human
ccugcggagccuuccugcccc

SEQ ID NO: 459703 - RNA, 22 nt, Human
ccugggggucgcgccaaggggc

SEQ ID NO: 459704 - RNA, 22 nt, Human
cgaaauggcgccgccgagcccc

SEQ ID NO: 459705 - RNA, 21 nt, Human
cgccgagccccgcgccagccc

SEQ ID NO: 459706 - RNA, 21 nt, Human
cgcggccacgucagcagcacc

SEQ ID NO: 459707 - RNA, 24 nt, Human
cggcggccucagcugaggcgggcc

SEQ ID NO: 459708 - RNA, 19 nt, Human
cgggaggggucgcgugggc

SEQ ID NO: 459709 - RNA, 22 nt, Human
cuaaagccuuccagggggccuc

SEQ ID NO: 459710 - RNA, 20 nt, Human
cuagaggcugcuccacucca

SEQ ID NO: 459711 - RNA, 20 nt, Human
cuccacuccagcacgaaaug

SEQ ID NO: 459712 - RNA, 21 nt, Human
cuccagcacucucuccccgcc

SEQ ID NO: 459713 - RNA, 27 nt, Human
cuccccccagccuuaccuagcuuaaaa

SEQ ID NO: 459714 - RNA, 23 nt, Human
cucucuccccgccuccccuucca

SEQ ID NO: 459715 - RNA, 19 nt, Human
cucuugggccuccaggcga

SEQ ID NO: 459716 - RNA, 20 nt, Human
cugcagagccagcucucccc

SEQ ID NO: 459717 - RNA, 21 nt, Human
cugcaucccucccccacugca

SEQ ID NO: 459718 - RNA, 24 nt, Human
cugccaagcucgagcaggucgugc

SEQ ID NO: 459719 - RNA, 19 nt, Human
cuucaguaaaugucccugc

SEQ ID NO: 459720 - RNA, 20 nt, Human
cuuuauauauaggcggggag

SEQ ID NO: 459721 - RNA, 22 nt, Human
gaaauggcgccgccgagccccg

SEQ ID NO: 459722 - RNA, 23 nt, Human
gacaguccaggggaccaaauggg

SEQ ID NO: 459723 - RNA, 21 nt, Human
gagggcggaguagagggggug

SEQ ID NO: 459724 - RNA, 20 nt, Human
gccaauuggcugagcugugg

SEQ ID NO: 459725 - RNA, 22 nt, Human
gccccacccuccccccagccuu

SEQ ID NO: 459726 - RNA, 23 nt, Human
gccccagagccuccagcacucuc

SEQ ID NO: 459727 - RNA, 20 nt, Human
gcccgcuucccccccacccc

SEQ ID NO: 459728 - RNA, 25 nt, Human
gcccgcuucccccccaccccccgcc

SEQ ID NO: 459729 - RNA, 19 nt, Human
gcccucagccgcggaaagu

SEQ ID NO: 459730 - RNA, 25 nt, Human
gcccuuagaagugaauagggcagcu

SEQ ID NO: 459731 - RNA, 22 nt, Human
gccgcaagacgccuggcgggug

SEQ ID NO: 459732 - RNA, 20 nt, Human
gcggccacgucagcagcacc

SEQ ID NO: 459733 - RNA, 23 nt, Human
gcggggcccgaaaaaggggagcu

SEQ ID NO: 459734 - RNA, 23 nt, Human
gcguagcccccagccccucccuu

SEQ ID NO: 459735 - RNA, 23 nt, Human
gcucccccuucuucccuccccau

SEQ ID NO: 459736 - RNA, 18 nt, Human
ggagguggauuguaaugg

SEQ ID NO: 459737 - RNA, 24 nt, Human
ggccccacccuccccccagccuua

SEQ ID NO: 459738 - RNA, 18 nt, Human
ggcccgaaaaaggggagc

SEQ ID NO: 459739 - RNA, 18 nt, Human
gggaggccguuccucuug

SEQ ID NO: 459740 - RNA, 19 nt, Human
gggaggggucgcgugggcg

SEQ ID NO: 459741 - RNA, 23 nt, Human
gggccuccaggcgacaaaccccc

SEQ ID NO: 459742 - RNA, 21 nt, Human
gggcggggcccgaaaaagggg

SEQ ID NO: 459743 - RNA, 24 nt, Human
gggcugggaauucaauguuguuuu

SEQ ID NO: 459744 - RNA, 18 nt, Human
gggcugggggggugggga

SEQ ID NO: 459745 - RNA, 23 nt, Human
ggggagggggcguagcccccagc

SEQ ID NO: 459746 - RNA, 20 nt, Human
ggggcaggguggucuagggg

SEQ ID NO: 459747 - RNA, 21 nt, Human
ggggcccgaaaaaggggagcc

SEQ ID NO: 459748 - RNA, 20 nt, Human
gggggaaggggcaggugggg

SEQ ID NO: 459749 - RNA, 25 nt, Human
gggggaaggggcagguggggcaggg

SEQ ID NO: 459750 - RNA, 22 nt, Human
ggggggaggccguuccucuugg

SEQ ID NO: 459751 - RNA, 19 nt, Human
gggguggggagagcaucgg

SEQ ID NO: 459752 - RNA, 24 nt, Human
gggucgcgccaaggggccaagggg

SEQ ID NO: 459753 - RNA, 24 nt, Human
gguggauuguaauggcggccccgg

SEQ ID NO: 459754 - RNA, 22 nt, Human
guaaaaaaagagcucccccuuc

SEQ ID NO: 459755 - RNA, 20 nt, Human
guaaggcagcagcagcgaag

SEQ ID NO: 459756 - RNA, 25 nt, Human
uaaaaaaagagcucccccuucuucc

SEQ ID NO: 459757 - RNA, 21 nt, Human
uaaaugucccugcaucccucc

SEQ ID NO: 459758 - RNA, 19 nt, Human
uaacuccagaucagggcuu

SEQ ID NO: 459759 - RNA, 21 nt, Human
uaaggagggacugacucuuca

SEQ ID NO: 459760 - RNA, 22 nt, Human
uagaaucaacaaagacagucca

SEQ ID NO: 459761 - RNA, 18 nt, Human
uagcccccagccccuccc

SEQ ID NO: 459762 - RNA, 22 nt, Human
ucaacccccccccagaaaacga

SEQ ID NO: 459763 - RNA, 26 nt, Human
ucacgugcccgcuucccccccacccc

SEQ ID NO: 459764 - RNA, 22 nt, Human
uccacuccagcacgaaauggcg

SEQ ID NO: 459765 - RNA, 19 nt, Human
ucccacccuugcccugccc

SEQ ID NO: 459766 - RNA, 19 nt, Human
uccccagcuuccuaucccg

SEQ ID NO: 459767 - RNA, 22 nt, Human
uccccagcuuccuaucccgcag

SEQ ID NO: 459768 - RNA, 19 nt, Human
ucccccagccacgaggacc

SEQ ID NO: 459769 - RNA, 22 nt, Human
uccccccagccuuaccuagcuu

SEQ ID NO: 459770 - RNA, 18 nt, Human
ucccccccaccccccgcc

SEQ ID NO: 459771 - RNA, 23 nt, Human
ucccccccaccccccgccuuucc

SEQ ID NO: 459772 - RNA, 21 nt, Human
uccccgaucucagacaccguc

SEQ ID NO: 459773 - RNA, 20 nt, Human
uccccgccuccccuuccaac

SEQ ID NO: 459774 - RNA, 23 nt, Human
uccccgccuccccuuccaacaaa

SEQ ID NO: 459775 - RNA, 18 nt, Human
uccgcgcgcgcgcgcucg

SEQ ID NO: 459776 - RNA, 24 nt, Human
uccgcgcgcgcgcgcucgcucacg

SEQ ID NO: 459777 - RNA, 23 nt, Human
uccgcgggagcuuuuucuauugg

SEQ ID NO: 459778 - RNA, 25 nt, Human
ucgaaggggaaggaacaccucuccg

SEQ ID NO: 459779 - RNA, 20 nt, Human
ucguagcuccuccauuggcc

SEQ ID NO: 459780 - RNA, 19 nt, Human
ucuagaggcugcuccacuc

SEQ ID NO: 459781 - RNA, 26 nt, Human
ucuugggccuccaggcgacaaacccc

SEQ ID NO: 459782 - RNA, 26 nt, Human
ugagaugaagaagugucacagcaaag

SEQ ID NO: 459783 - RNA, 19 nt, Human
ugcccgcuucccccccacc

SEQ ID NO: 459784 - RNA, 22 nt, Human
ugcccucagccgcggaaagucc

SEQ ID NO: 459785 - RNA, 23 nt, Human
ugcugggggagggggcguagccc

SEQ ID NO: 459786 - RNA, 20 nt, Human
ugcuuguccauauccccagc

SEQ ID NO: 459787 - RNA, 19 nt, Human
uggaagaggugcggaagcc

SEQ ID NO: 459788 - RNA, 21 nt, Human
uggcggguggugguucucggc

SEQ ID NO: 459789 - RNA, 19 nt, Human
uggggagagcaucggggcc

SEQ ID NO: 459790 - RNA, 24 nt, Human
uggggggguggggagagcaucggg

SEQ ID NO: 459791 - RNA, 20 nt, Human
uguccaagagaucacucccc

SEQ ID NO: 459792 - RNA, 24 nt, Human
uguccaagagaucacuccccaaug

SEQ ID NO: 459793 - RNA, 26 nt, Human
uguccauauccccagcuuccuauccc

SEQ ID NO: 459794 - RNA, 20 nt, Human
ugucccugcaucccuccccc

SEQ ID NO: 459795 - RNA, 24 nt, Human
uguuuuguccaugucccuccuuca

SEQ ID NO: 459796 - RNA, 19 nt, Human
uuagaagugaauagggcag

SEQ ID NO: 459797 - RNA, 21 nt, Human
uuagaagugaauagggcagcc

SEQ ID NO: 459798 - RNA, 19 nt, Human
uuccaaggugucagucacc

SEQ ID NO: 459799 - RNA, 19 nt, Human
uucccuccccauggaggcu

SEQ ID NO: 459800 - RNA, 18 nt, Human
uuuuccccacccccuccg

SEQ ID NO: 459801 - RNA, 19 nt, Human
aagcaggcacaucuguccu

SEQ ID NO: 459802 - RNA, 20 nt, Human
acaaagcuaacagcuuucaa

SEQ ID NO: 459803 - RNA, 23 nt, Human
accacgagcggagaacgcacauc

SEQ ID NO: 459804 - RNA, 18 nt, Human
agcaggcacaucuguccu

SEQ ID NO: 459805 - RNA, 18 nt, Human
agccuggucuccacaagc

SEQ ID NO: 459806 - RNA, 21 nt, Human
aguuuuuuuuuuuuuuuuuua

SEQ ID NO: 459807 - RNA, 20 nt, Human
auucagugaugaagaagaga

SEQ ID NO: 459808 - RNA, 23 nt, Human
caaagggauuccacaagguucuu

SEQ ID NO: 459809 - RNA, 20 nt, Human
caagcaggcacaucuguccu

SEQ ID NO: 459810 - RNA, 24 nt, Human
caaggacaaugcguguugacaaag

SEQ ID NO: 459811 - RNA, 19 nt, Human
caaugcguguugacaaagc

SEQ ID NO: 459812 - RNA, 19 nt, Human
cacacaagauagaucucug

SEQ ID NO: 459813 - RNA, 18 nt, Human
caccccccaagggcucca

SEQ ID NO: 459814 - RNA, 25 nt, Human
caccccccaagggcuccacgcuccg

SEQ ID NO: 459815 - RNA, 19 nt, Human
cacccgaccaccccccaag

SEQ ID NO: 459816 - RNA, 22 nt, Human
cacccgaccaccccccaagggc

SEQ ID NO: 459817 - RNA, 18 nt, Human
cagccccuccagaaagag

SEQ ID NO: 459818 - RNA, 22 nt, Human
cagguugggccuaagcaaaggg

SEQ ID NO: 459819 - RNA, 24 nt, Human
cauaacacugaauuaagaagcaga

SEQ ID NO: 459820 - RNA, 20 nt, Human
ccacccgaccaccccccaag

SEQ ID NO: 459821 - RNA, 21 nt, Human
ccagccuggucuccacaagca

SEQ ID NO: 459822 - RNA, 23 nt, Human
ccagccuggucuccacaagcagg

SEQ ID NO: 459823 - RNA, 18 nt, Human
ccaggcgacaguuggccu

SEQ ID NO: 459824 - RNA, 18 nt, Human
cccagccuggucuccaca

SEQ ID NO: 459825 - RNA, 20 nt, Human
ccccaagggcuccacgcucc

SEQ ID NO: 459826 - RNA, 22 nt, Human
cccuccagaaagagguggccgc

SEQ ID NO: 459827 - RNA, 19 nt, Human
ccuccggcagcucacucac

SEQ ID NO: 459828 - RNA, 22 nt, Human
cgcacaucccacccgaccaccc

SEQ ID NO: 459829 - RNA, 24 nt, Human
cuaacagcuuucaaauacaguacc

SEQ ID NO: 459830 - RNA, 21 nt, Human
cuccacaagcaggcacaucug

SEQ ID NO: 459831 - RNA, 24 nt, Human
cugaauuaagaagcagaccugcac

SEQ ID NO: 459832 - RNA, 22 nt, Human
gaccaccccccaagggcuccac

SEQ ID NO: 459833 - RNA, 19 nt, Human
gagaaagcgcgacguccca

SEQ ID NO: 459834 - RNA, 18 nt, Human
gagcuccugacaucacca

SEQ ID NO: 459835 - RNA, 31 nt, Human
gaugccucgaguuuuuuuuuuuuuuuuuccc

SEQ ID NO: 459836 - RNA, 20 nt, Human
gcacaucccacccgaccacc

SEQ ID NO: 459837 - RNA, 20 nt, Human
gcccagccuggucuccacaa

SEQ ID NO: 459838 - RNA, 21 nt, Human
gcugcuucuacgcucccugag

SEQ ID NO: 459839 - RNA, 18 nt, Human
gcuuggagaggcccuggc

SEQ ID NO: 459840 - RNA, 21 nt, Human
gcuuggagaggcccuggcugc

SEQ ID NO: 459841 - RNA, 21 nt, Human
gucaucggguuagcauuugaa

SEQ ID NO: 459842 - RNA, 24 nt, Human
uaucauaacacugaauuaagaagc

SEQ ID NO: 459843 - RNA, 18 nt, Human
uauggaaaccugcaggcu

SEQ ID NO: 459844 - RNA, 20 nt, Human
ucacuuucugucacagcagc

SEQ ID NO: 459845 - RNA, 21 nt, Human
ucaguguauggaaaccugcag

SEQ ID NO: 459846 - RNA, 21 nt, Human
uccacgcuccgggcuggggcu

SEQ ID NO: 459847 - RNA, 23 nt, Human
uccacgcuccgggcuggggcugc

SEQ ID NO: 459848 - RNA, 22 nt, Human
ucccacccgaccaccccccaag

SEQ ID NO: 459849 - RNA, 21 nt, Human
uccucagccccuccagaaaga

SEQ ID NO: 459850 - RNA, 22 nt, Human
uccuuggaaaaaauucuuucuc

SEQ ID NO: 459851 - RNA, 18 nt, Human
ucugucacagcagcggcu

SEQ ID NO: 459852 - RNA, 18 nt, Human
ugaccuaugaaagcaaaa

SEQ ID NO: 459853 - RNA, 18 nt, Human
uggaaaccugcaggcugc

SEQ ID NO: 459854 - RNA, 19 nt, Human
uggaacagaaguaguaaua

SEQ ID NO: 459855 - RNA, 23 nt, Human
uggcugcuucuacgcucccugag

SEQ ID NO: 459856 - RNA, 20 nt, Human
ugucacagcagcggcuugga

SEQ ID NO: 459857 - RNA, 22 nt, Human
uguccuguucuguccgaagcca

SEQ ID NO: 459858 - RNA, 22 nt, Human
uuaggcccagccuggucuccac

SEQ ID NO: 459859 - RNA, 21 nt, Human
uugaaguugucaucuccaagu

SEQ ID NO: 459860 - RNA, 25 nt, Human
uuuuuuuuuuuuuuuuuaaucuuuu

SEQ ID NO: 459861 - RNA, 20 nt, Human
aaaaaaaacgaaacagaaac

SEQ ID NO: 459862 - RNA, 24 nt, Human
aaaaaaacgaaacagaaacacagg

SEQ ID NO: 459863 - RNA, 20 nt, Human
aaaauggacuuaagcuauag

SEQ ID NO: 459864 - RNA, 23 nt, Human
aaacacaggugggaaggaacuga

SEQ ID NO: 459865 - RNA, 18 nt, Human
aaacgaaacagaaacaca

SEQ ID NO: 459866 - RNA, 22 nt, Human
aaagacuccaaaaaggcucaga

SEQ ID NO: 459867 - RNA, 22 nt, Human
aacaauggagacgaaggaggaa

SEQ ID NO: 459868 - RNA, 23 nt, Human
aacaauggagacgaaggaggaaa

SEQ ID NO: 459869 - RNA, 23 nt, Human
aacagaaacacaggugggaagga

SEQ ID NO: 459870 - RNA, 21 nt, Human
aacgucacguucuuggggaca

SEQ ID NO: 459871 - RNA, 23 nt, Human
aacugacuuugguugguggccuc

SEQ ID NO: 459872 - RNA, 28 nt, Human
aagcagugccauugugucucccaguagg

SEQ ID NO: 459873 - RNA, 27 nt, Human
aagcagugccauugugucucccagugg

SEQ ID NO: 459874 - RNA, 18 nt, Human
aaggaaucuggaacugaa

SEQ ID NO: 459875 - RNA, 18 nt, Human
aagggccucugccccgca

SEQ ID NO: 459876 - RNA, 23 nt, Human
acagggcaccagugagaagcaug

SEQ ID NO: 459877 - RNA, 22 nt, Human
acgaaggaggaaagacuccaaa

SEQ ID NO: 459878 - RNA, 18 nt, Human
acggagcccauagaaacu

SEQ ID NO: 459879 - RNA, 23 nt, Human
agaaaaaaaaaaacgaaacagaa

SEQ ID NO: 459880 - RNA, 25 nt, Human
agaaaaagagggaugggacaaagag

SEQ ID NO: 459881 - RNA, 19 nt, Human
agaaccaggaaggcugggc

SEQ ID NO: 459882 - RNA, 19 nt, Human
agagagaaaacauacuugg

SEQ ID NO: 459883 - RNA, 18 nt, Human
agagggaugggacaaaga

SEQ ID NO: 459884 - RNA, 21 nt, Human
agagggaugggacaaagagag

SEQ ID NO: 459885 - RNA, 22 nt, Human
agaguagcaccacaugaaugca

SEQ ID NO: 459886 - RNA, 22 nt, Human
agcacaguggcaacacccacaa

SEQ ID NO: 459887 - RNA, 21 nt, Human
aggaaggcugggcaggacagc

SEQ ID NO: 459888 - RNA, 20 nt, Human
aggaaucuggaacugaagac

SEQ ID NO: 459889 - RNA, 18 nt, Human
aggaccccagagaaccag

SEQ ID NO: 459890 - RNA, 23 nt, Human
agggaaguaguuaggguccaaag

SEQ ID NO: 459891 - RNA, 19 nt, Human
agucagacuucuagcagua

SEQ ID NO: 459892 - RNA, 19 nt, Human
aucaaagucagaagccacc

SEQ ID NO: 459893 - RNA, 24 nt, Human
caagcacaguggcaacacccacaa

SEQ ID NO: 459894 - RNA, 25 nt, Human
cacaagcaaacacuuacagagagcg

SEQ ID NO: 459895 - RNA, 18 nt, Human
cacacagaguagcaccac

SEQ ID NO: 459896 - RNA, 21 nt, Human
cacaccauuucggagauaagc

SEQ ID NO: 459897 - RNA, 22 nt, Human
cacccagaggaccccagagaac

SEQ ID NO: 459898 - RNA, 24 nt, Human
cacccagaggaccccagagaaccc

SEQ ID NO: 459899 - RNA, 24 nt, Human
cacggcacuauucccuuuugcaca

SEQ ID NO: 459900 - RNA, 27 nt, Human
cacucaagcacaguggcaacacccacu

SEQ ID NO: 459901 - RNA, 18 nt, Human
cacuccccggccgagggc

SEQ ID NO: 459902 - RNA, 19 nt, Human
cacugagccuuccaggguc

SEQ ID NO: 459903 - RNA, 19 nt, Human
cacuugcucguaacaaggc

SEQ ID NO: 459904 - RNA, 26 nt, Human
cagcagcaccacacuuugcuguaccc

SEQ ID NO: 459905 - RNA, 20 nt, Human
cagcgagggggugggccggc

SEQ ID NO: 459906 - RNA, 20 nt, Human
caggcccugaggcauccccu

SEQ ID NO: 459907 - RNA, 19 nt, Human
ccaaaaaggcucagaguca

SEQ ID NO: 459908 - RNA, 21 nt, Human
ccacacuuugcuguacccauc

SEQ ID NO: 459909 - RNA, 18 nt, Human
ccacaugaaugcaugugu

SEQ ID NO: 459910 - RNA, 20 nt, Human
ccaccgccccuaacacuagu

SEQ ID NO: 459911 - RNA, 19 nt, Human
ccagaaaaucaaagucaga

SEQ ID NO: 459912 - RNA, 20 nt, Human
ccagcccacgcaggccugcc

SEQ ID NO: 459913 - RNA, 20 nt, Human
ccagcgagggggugggccgg

SEQ ID NO: 459914 - RNA, 22 nt, Human
ccaucaguggccugccuucucu

SEQ ID NO: 459915 - RNA, 19 nt, Human
cccacagcgcgguggcagc

SEQ ID NO: 459916 - RNA, 21 nt, Human
ccccagagaaccaggaaggcu

SEQ ID NO: 459917 - RNA, 20 nt, Human
ccccgggggacaggcccagg

SEQ ID NO: 459918 - RNA, 23 nt, Human
cccuccaggagaugccacccacc

SEQ ID NO: 459919 - RNA, 21 nt, Human
cccuggccuccugggagcggg

SEQ ID NO: 459920 - RNA, 22 nt, Human
ccuccagcccacgcaggccugc

SEQ ID NO: 459921 - RNA, 21 nt, Human
ccuccaggagaugccacccac

SEQ ID NO: 459922 - RNA, 18 nt, Human
ccugggcggcuggccagg

SEQ ID NO: 459923 - RNA, 18 nt, Human
cggaacaauggagacgaa

SEQ ID NO: 459924 - RNA, 21 nt, Human
cuagugaucccaucacauucu

SEQ ID NO: 459925 - RNA, 22 nt, Human
cuccaggagaugccacccaccc

SEQ ID NO: 459926 - RNA, 28 nt, Human
cucccacuccuuaucuaggacagcucua

SEQ ID NO: 459927 - RNA, 19 nt, Human
cucccggcgggcaggacau

SEQ ID NO: 459928 - RNA, 23 nt, Human
cucgcccgccuccagcccacgca

SEQ ID NO: 459929 - RNA, 22 nt, Human
cugaucccaccuccaccaccgc

SEQ ID NO: 459930 - RNA, 23 nt, Human
cugcccuggccuccugggagcgg

SEQ ID NO: 459931 - RNA, 18 nt, Human
gaacaauggagacgaagg

SEQ ID NO: 459932 - RNA, 23 nt, Human
gaaggaggaaagacuccaaaaag

SEQ ID NO: 459933 - RNA, 18 nt, Human
gacaugacuaauccaccc

SEQ ID NO: 459934 - RNA, 20 nt, Human
gacuaggcgugugcugcugg

SEQ ID NO: 459935 - RNA, 19 nt, Human
gaggaccccagagaaccag

SEQ ID NO: 459936 - RNA, 23 nt, Human
gaggcccagucauccuacacggg

SEQ ID NO: 459937 - RNA, 26 nt, Human
gaggcccagucauccuacacgggucu

SEQ ID NO: 459938 - RNA, 21 nt, Human
gaggccugggcggcuggccag

SEQ ID NO: 459939 - RNA, 21 nt, Human
gaguccugucccuuucacgga

SEQ ID NO: 459940 - RNA, 18 nt, Human
gaucccaccuccaccacc

SEQ ID NO: 459941 - RNA, 24 nt, Human
gcacacagaguagcaccacaugaa

SEQ ID NO: 459942 - RNA, 19 nt, Human
gcacuauucccuuuugcac

SEQ ID NO: 459943 - RNA, 22 nt, Human
gcagcugggugccauguggccc

SEQ ID NO: 459944 - RNA, 22 nt, Human
gcagucuuuacacagagaggcc

SEQ ID NO: 459945 - RNA, 19 nt, Human
gccacccacccagaggacc

SEQ ID NO: 459946 - RNA, 23 nt, Human
gcggcagcaacgauguccugugu

SEQ ID NO: 459947 - RNA, 20 nt, Human
gcuugugggggagggucggg

SEQ ID NO: 459948 - RNA, 23 nt, Human
ggacaucacgaacgucacguucu

SEQ ID NO: 459949 - RNA, 26 nt, Human
ggccaggcccugaggcauccccuggc

SEQ ID NO: 459950 - RNA, 28 nt, Human
ggcugggguguggggaaagacucccggg

SEQ ID NO: 459951 - RNA, 24 nt, Human
gggcaggacagccaggcagucuuu

SEQ ID NO: 459952 - RNA, 19 nt, Human
guggccucacuccccggcc

SEQ ID NO: 459953 - RNA, 21 nt, Human
uaaggcagacaggcucugcaa

SEQ ID NO: 459954 - RNA, 24 nt, Human
uaaggcagacaggcucugcaaucc

SEQ ID NO: 459955 - RNA, 24 nt, Human
uacccaucaguggccugccuucuc

SEQ ID NO: 459956 - RNA, 23 nt, Human
uagaggccuugccucuaaagcuc

SEQ ID NO: 459957 - RNA, 24 nt, Human
uagaggccuugccucuaaagcucc

SEQ ID NO: 459958 - RNA, 25 nt, Human
uauagaaaaaaaagaaaaaaaaaaa

SEQ ID NO: 459959 - RNA, 26 nt, Human
uauagaaaaaaaagaaaaaaaaaaac

SEQ ID NO: 459960 - RNA, 24 nt, Human
uauauagaaaaaaaagaaaaaaaa

SEQ ID NO: 459961 - RNA, 25 nt, Human
uaucuaggacagcucuagaggucag

SEQ ID NO: 459962 - RNA, 20 nt, Human
uauuaagaguccguguccaa

SEQ ID NO: 459963 - RNA, 19 nt, Human
uauucccuuuugcacaagc

SEQ ID NO: 459964 - RNA, 18 nt, Human
ucaaagucagaagccacc

SEQ ID NO: 459965 - RNA, 21 nt, Human
ucaauguuuugccagaaaauc

SEQ ID NO: 459966 - RNA, 19 nt, Human
ucagugccagcgagggggu

SEQ ID NO: 459967 - RNA, 19 nt, Human
uccaaagucccagaaaaag

SEQ ID NO: 459968 - RNA, 22 nt, Human
ucccaccuccaccaccgccccu

SEQ ID NO: 459969 - RNA, 25 nt, Human
ucccaccuccaccaccgccccuaac

SEQ ID NO: 459970 - RNA, 21 nt, Human
ucuagaggucagaguguucuu

SEQ ID NO: 459971 - RNA, 18 nt, Human
ucugcaauccucagcugc

SEQ ID NO: 459972 - RNA, 22 nt, Human
ucuuccgcacacugaacgagag

SEQ ID NO: 459973 - RNA, 23 nt, Human
ucuuccgcacacugaacgagagc

SEQ ID NO: 459974 - RNA, 23 nt, Human
ucuuuggcuuggccagcagcacc

SEQ ID NO: 459975 - RNA, 21 nt, Human
ugccacccacccagaggaccc

SEQ ID NO: 459976 - RNA, 19 nt, Human
ugccagaaaaucaaaguca

SEQ ID NO: 459977 - RNA, 18 nt, Human
ugccccgcauguggggau

SEQ ID NO: 459978 - RNA, 19 nt, Human
ugcccuggccuccugggag

SEQ ID NO: 459979 - RNA, 21 nt, Human
ugcucguaacaaggcgugugc

SEQ ID NO: 459980 - RNA, 19 nt, Human
uggacacacacaccuccac

SEQ ID NO: 459981 - RNA, 20 nt, Human
uggcaacacccacaaggggc

SEQ ID NO: 459982 - RNA, 21 nt, Human
uggccagcagcaccacacuuu

SEQ ID NO: 459983 - RNA, 21 nt, Human
uggcucgagcuuacagggcac

SEQ ID NO: 459984 - RNA, 19 nt, Human
ugggaaggaacugacuuug

SEQ ID NO: 459985 - RNA, 19 nt, Human
ugggacaaagagagaaaac

SEQ ID NO: 459986 - RNA, 25 nt, Human
ugggagcgggcggcgauggcugggg

SEQ ID NO: 459987 - RNA, 21 nt, Human
ugguugguggccucacucccc

SEQ ID NO: 459988 - RNA, 22 nt, Human
ugguugguggccucacuccccg

SEQ ID NO: 459989 - RNA, 20 nt, Human
uguccgacuggccguaaggc

SEQ ID NO: 459990 - RNA, 18 nt, Human
ugugagggguggugggug

SEQ ID NO: 459991 - RNA, 23 nt, Human
uuaaaaauaaaauagaauucaac

SEQ ID NO: 459992 - RNA, 20 nt, Human
uuccagggucuagaggccuu

SEQ ID NO: 459993 - RNA, 18 nt, Human
uugagaagacggagccca

SEQ ID NO: 459994 - RNA, 23 nt, Human
uugccucuaaagcucccacuccu

SEQ ID NO: 459995 - RNA, 23 nt, Human
uugcugggaaggaaucuggaacu

SEQ ID NO: 459996 - RNA, 23 nt, Human
uuggggucuggcuuugcacacag

SEQ ID NO: 459997 - RNA, 18 nt, Human
uugugggggagggucggg

SEQ ID NO: 459998 - RNA, 24 nt, Human
aagcauuucuaaguuaagaaugaa

SEQ ID NO: 459999 - RNA, 25 nt, Human
caaguccaaccucuggaacauccaa

SEQ ID NO: 460000 - RNA, 22 nt, Human
cuaauacaaguccaaccucugg

SEQ ID NO: 460001 - RNA, 22 nt, Human
uauaaucaaauaccaggcagcc

SEQ ID NO: 460002 - RNA, 22 nt, Human
uccaaccucuggaacauccaaa

SEQ ID NO: 460003 - RNA, 19 nt, Human
ucuaaguuaagaaugaaaa

SEQ ID NO: 460004 - RNA, 22 nt, Human
aagaaaaaaauuccaucuagaa

SEQ ID NO: 460005 - RNA, 21 nt, Human
agaacuucguuuugaaaauau

SEQ ID NO: 460006 - RNA, 21 nt, Human
cagugcaugggaauguguaua

SEQ ID NO: 460007 - RNA, 20 nt, Human
ccaucuagaaaguacuaugu

SEQ ID NO: 460008 - RNA, 18 nt, Human
ccguagucucuaguuucc

SEQ ID NO: 460009 - RNA, 23 nt, Human
cucgucucaaacaaaaugaaauc

SEQ ID NO: 460010 - RNA, 26 nt, Human
cugguguucaggugaaugacuuggua

SEQ ID NO: 460011 - RNA, 19 nt, Human
gccguagucucuaguuucc

SEQ ID NO: 460012 - RNA, 19 nt, Human
ggaaauguauuucauugag

SEQ ID NO: 460013 - RNA, 24 nt, Human
gggaauggagacauuuauuuccau

SEQ ID NO: 460014 - RNA, 22 nt, Human
guaaaauuuagaacuagagaaa

SEQ ID NO: 460015 - RNA, 23 nt, Human
uauaauauuuccauuggaaaagg

SEQ ID NO: 460016 - RNA, 18 nt, Human
uaugguacaauguuuaau

SEQ ID NO: 460017 - RNA, 20 nt, Human
ucaaaucagauuucagcaaa

SEQ ID NO: 460018 - RNA, 21 nt, Human
ucaaaucagauuucagcaaaa

SEQ ID NO: 460019 - RNA, 26 nt, Human
ucaggagaauauagguaauucucuuu

SEQ ID NO: 460020 - RNA, 22 nt, Human
ucaguaucaggagaauauaggu

SEQ ID NO: 460021 - RNA, 25 nt, Human
ucugcagguuaccaccacagccgua

SEQ ID NO: 460022 - RNA, 19 nt, Human
ugaaugacuugguaaucag

SEQ ID NO: 460023 - RNA, 24 nt, Human
ugauaagauaaugaaauuguaugg

SEQ ID NO: 460024 - RNA, 21 nt, Human
ugcagguuaccaccacagccg

SEQ ID NO: 460025 - RNA, 23 nt, Human
ugcagguuaccaccacagccgua

SEQ ID NO: 460026 - RNA, 21 nt, Human
uggaaaagggcuccucuagua

SEQ ID NO: 460027 - RNA, 19 nt, Human
uuccauuggaaaagggcuc

SEQ ID NO: 460028 - RNA, 21 nt, Human
uucccugugaauugguuucau

SEQ ID NO: 460029 - RNA, 28 nt, Human
uuucagcaaaacuuagguuuuuugggaa

SEQ ID NO: 460030 - RNA, 18 nt, Human
uuugggaauugguaaaau

SEQ ID NO: 460031 - RNA, 20 nt, Human
aacuaagaaauagaggcaag

SEQ ID NO: 460032 - RNA, 18 nt, Human
aagcccaaagugaucaaa

SEQ ID NO: 460033 - RNA, 18 nt, Human
aagugaagggcucuagga

SEQ ID NO: 460034 - RNA, 24 nt, Human
agaaauagaggcaagaaagaggga

SEQ ID NO: 460035 - RNA, 23 nt, Human
agagacaaaggcuuuggaagaaa

SEQ ID NO: 460036 - RNA, 22 nt, Human
agaggucucagagacaaaggcu

SEQ ID NO: 460037 - RNA, 24 nt, Human
aggaagcggcuguaugugcugaca

SEQ ID NO: 460038 - RNA, 22 nt, Human
aggcaagaaagagggaguaacc

SEQ ID NO: 460039 - RNA, 25 nt, Human
aggcaagaaagagggaguaacccga

SEQ ID NO: 460040 - RNA, 21 nt, Human
aggcagucuggcuggccaccu

SEQ ID NO: 460041 - RNA, 22 nt, Human
aggucucagagacaaaggcuuu

SEQ ID NO: 460042 - RNA, 23 nt, Human
caaaugcugccuccuggaacuga

SEQ ID NO: 460043 - RNA, 20 nt, Human
cagccagcucaaguuggauu

SEQ ID NO: 460044 - RNA, 22 nt, Human
cagcucaaguuggauuucagca

SEQ ID NO: 460045 - RNA, 24 nt, Human
cagggaccaccagccagcucaagu

SEQ ID NO: 460046 - RNA, 22 nt, Human
cccccgacagacgcaccgaccu

SEQ ID NO: 460047 - RNA, 20 nt, Human
ccccggaaaauuacugcacc

SEQ ID NO: 460048 - RNA, 19 nt, Human
cgcccccgacagacgcacu

SEQ ID NO: 460049 - RNA, 19 nt, Human
cgugcaaaagcugcugugu

SEQ ID NO: 460050 - RNA, 19 nt, Human
cgugggcauuccugaggcu

SEQ ID NO: 460051 - RNA, 23 nt, Human
cucucaagacugguguuuccuag

SEQ ID NO: 460052 - RNA, 20 nt, Human
cugaggcuuuacuuuccccg

SEQ ID NO: 460053 - RNA, 24 nt, Human
cuggaacugagggacaaagguuuu

SEQ ID NO: 460054 - RNA, 19 nt, Human
gaaaauuacugcaccauaa

SEQ ID NO: 460055 - RNA, 24 nt, Human
gcaagaaagagggaguaacccgaa

SEQ ID NO: 460056 - RNA, 18 nt, Human
gcgcgcgcgccgcgggca

SEQ ID NO: 460057 - RNA, 23 nt, Human
ggagaaacagcgaggggcauuua

SEQ ID NO: 460058 - RNA, 26 nt, Human
ggcuuuggaagaaaggcgugggcauu

SEQ ID NO: 460059 - RNA, 22 nt, Human
ggguacagguacccgagcgcgc

SEQ ID NO: 460060 - RNA, 21 nt, Human
uaacuugacuuguaaaucacc

SEQ ID NO: 460061 - RNA, 21 nt, Human
uacugcaccauaauuugugag

SEQ ID NO: 460062 - RNA, 18 nt, Human
uagaggcaagaaagaggg

SEQ ID NO: 460063 - RNA, 20 nt, Human
uaugugcugacacgcaugug

SEQ ID NO: 460064 - RNA, 24 nt, Human
ucagcagucggggcugccuggggc

SEQ ID NO: 460065 - RNA, 21 nt, Human
ucucagagacaaaggcuuugg

SEQ ID NO: 460066 - RNA, 19 nt, Human
ugccuggggcgugcaaaag

SEQ ID NO: 460067 - RNA, 21 nt, Human
uggccaccucucaagacuggu

SEQ ID NO: 460068 - RNA, 21 nt, Human
ugugagcaaaacgcugccgug

SEQ ID NO: 460069 - RNA, 18 nt, Human
uuccuagagcuuuccauu

SEQ ID NO: 460070 - RNA, 20 nt, Human
uuccuagagcuuuccauugg

SEQ ID NO: 460071 - RNA, 20 nt, Human
uuguaaaucaccacuggaac

SEQ ID NO: 460072 - RNA, 20 nt, Human
uuuuuuuuuuuuucagagga

SEQ ID NO: 460073 - RNA, 21 nt, Human
uuuuuuuuuuuuuuuucagag

SEQ ID NO: 460074 - RNA, 22 nt, Human
aaaagcagugcuuuauugaguu

SEQ ID NO: 460075 - RNA, 18 nt, Human
acugccucuccacgcucc

SEQ ID NO: 460076 - RNA, 22 nt, Human
agccucgggcgggagcagcagc

SEQ ID NO: 460077 - RNA, 18 nt, Human
agcuggguguaggaaagc

SEQ ID NO: 460078 - RNA, 25 nt, Human
caaaacaguccugaagcuuaaucaa

SEQ ID NO: 460079 - RNA, 21 nt, Human
ccgcgcccgccgcuccggccc

SEQ ID NO: 460080 - RNA, 19 nt, Human
ccggccgcgcccgccgcuc

SEQ ID NO: 460081 - RNA, 21 nt, Human
cgcuccggcccggcucggcuc

SEQ ID NO: 460082 - RNA, 24 nt, Human
cggucccaccucgcuuuacaaaac

SEQ ID NO: 460083 - RNA, 23 nt, Human
gaaaacauuauuucucaccuuuc

SEQ ID NO: 460084 - RNA, 23 nt, Human
ggguguaggaaagccgggccugg

SEQ ID NO: 460085 - RNA, 22 nt, Human
gguaugaaucucauuuauugga

SEQ ID NO: 460086 - RNA, 20 nt, Human
guacacaacauuuacauuag

SEQ ID NO: 460087 - RNA, 19 nt, Human
uacaaaacaguccugaagc

SEQ ID NO: 460088 - RNA, 22 nt, Human
ucggcucggucggccccggcgg

SEQ ID NO: 460089 - RNA, 21 nt, Human
ugucaugagccucgggcggga

SEQ ID NO: 460090 - RNA, 23 nt, Human
uuuuuuuuuuuuuuuuuuaaugg

SEQ ID NO: 460091 - RNA, 20 nt, Human
caaaauaaauauaaaguaac

SEQ ID NO: 460092 - RNA, 20 nt, Human
cauugaauacaaaauaaaua

SEQ ID NO: 460093 - RNA, 23 nt, Human
uaaaguaacugaaaaacaaauca

SEQ ID NO: 460094 - RNA, 21 nt, Human
uaacugaaaaacaaaucaggu

SEQ ID NO: 460095 - RNA, 20 nt, Human
uuuuucuuucuuguaaaugc

SEQ ID NO: 460096 - RNA, 19 nt, Human
aaacaguggggacaaaauu

SEQ ID NO: 460097 - RNA, 18 nt, Human
aacauuuuuaaacagugg

SEQ ID NO: 460098 - RNA, 20 nt, Human
aagugcuagugguuacaaau

SEQ ID NO: 460099 - RNA, 18 nt, Human
aaugacacccaggccaac

SEQ ID NO: 460100 - RNA, 22 nt, Human
aauuuuguucucuucaguuuuu

SEQ ID NO: 460101 - RNA, 23 nt, Human
acccaggccaaccccccggcagc

SEQ ID NO: 460102 - RNA, 21 nt, Human
cauuuuuaaacaguggggaca

SEQ ID NO: 460103 - RNA, 18 nt, Human
ccagcccgaaggcccgcc

SEQ ID NO: 460104 - RNA, 28 nt, Human
ccggcagccgacggcgagccagcccgaa

SEQ ID NO: 460105 - RNA, 24 nt, Human
cgacaccagaccccgagugguccc

SEQ ID NO: 460106 - RNA, 27 nt, Human
cuagugguuacaaauuuuguucucuuc

SEQ ID NO: 460107 - RNA, 20 nt, Human
cugcugccgcuucccagagc

SEQ ID NO: 460108 - RNA, 22 nt, Human
gaaauacacagguaacauuuuu

SEQ ID NO: 460109 - RNA, 23 nt, Human
gcugugccgacaccagaccccga

SEQ ID NO: 460110 - RNA, 18 nt, Human
uaauagaugauauacaua

SEQ ID NO: 460111 - RNA, 27 nt, Human
uaauagaugauauacauauuacugccg

SEQ ID NO: 460112 - RNA, 21 nt, Human
uaguaaaaauagcauucagug

SEQ ID NO: 460113 - RNA, 25 nt, Human
uauauacacugcauggaaauacaca

SEQ ID NO: 460114 - RNA, 31 nt, Human
ucagcagcagcuggcaaugcugucccuucuu

SEQ ID NO: 460115 - RNA, 23 nt, Human
ucaguuuuucauuaaguaaauuc

SEQ ID NO: 460116 - RNA, 19 nt, Human
ucccagagccaaugacacc

SEQ ID NO: 460117 - RNA, 25 nt, Human
ucuaauagaugauauacauauuacu

SEQ ID NO: 460118 - RNA, 21 nt, Human
ucugcugccgcuucccagagc

SEQ ID NO: 460119 - RNA, 21 nt, Human
ucugugacucagcagcagcug

SEQ ID NO: 460120 - RNA, 20 nt, Human
ucuuguggucauuaaagaca

SEQ ID NO: 460121 - RNA, 20 nt, Human
ugacacccaggccaaccccc

SEQ ID NO: 460122 - RNA, 21 nt, Human
ugacacccaggccaacccccc

SEQ ID NO: 460123 - RNA, 21 nt, Human
ugacucagcagcagcuggcaa

SEQ ID NO: 460124 - RNA, 19 nt, Human
ugauauacauauuacugca

SEQ ID NO: 460125 - RNA, 22 nt, Human
uggcaaugcugucccuucaaga

SEQ ID NO: 460126 - RNA, 20 nt, Human
uggucccugccucugcugcc

SEQ ID NO: 460127 - RNA, 18 nt, Human
ugguuuagaaacucucag

SEQ ID NO: 460128 - RNA, 22 nt, Human
aaaaaugagacucagagagaga

SEQ ID NO: 460129 - RNA, 20 nt, Human
aaaagaccaguguggugacg

SEQ ID NO: 460130 - RNA, 28 nt, Human
aaacaagaggggacccgccuugauccag

SEQ ID NO: 460131 - RNA, 23 nt, Human
aaacuccccuaugaaaaauuuaa

SEQ ID NO: 460132 - RNA, 22 nt, Human
aaagagcauuuuaaaaaaugag

SEQ ID NO: 460133 - RNA, 21 nt, Human
aaccaugcgauuggucaaaac

SEQ ID NO: 460134 - RNA, 21 nt, Human
aacuggcccugcgacuuuggu

SEQ ID NO: 460135 - RNA, 22 nt, Human
aagaaaaagaccagugugguga

SEQ ID NO: 460136 - RNA, 18 nt, Human
aagaaggaaggaggcaga

SEQ ID NO: 460137 - RNA, 18 nt, Human
aagaaggaaggaggcaga

SEQ ID NO: 460138 - RNA, 19 nt, Human
aagaaggaaggaggcagag

SEQ ID NO: 460139 - RNA, 19 nt, Human
aagaaggaaggaggcagag

SEQ ID NO: 460140 - RNA, 22 nt, Human
aagagaaagcaagacugggcaa

SEQ ID NO: 460141 - RNA, 23 nt, Human
aaggucacagaguccacagcuga

SEQ ID NO: 460142 - RNA, 25 nt, Human
aauaaagagagagacuaagaagaga

SEQ ID NO: 460143 - RNA, 18 nt, Human
acaaaauccaaaacccca

SEQ ID NO: 460144 - RNA, 22 nt, Human
acacccagccugauaggagccc

SEQ ID NO: 460145 - RNA, 20 nt, Human
acacugaagccucugaaagu

SEQ ID NO: 460146 - RNA, 23 nt, Human
acuguuuuguccaaaacuccccu

SEQ ID NO: 460147 - RNA, 18 nt, Human
agaaaaaguccaugagga

SEQ ID NO: 460148 - RNA, 24 nt, Human
agaaaaggaauaugggaaagagaa

SEQ ID NO: 460149 - RNA, 24 nt, Human
agaaaauaaguuucagacagucau

SEQ ID NO: 460150 - RNA, 18 nt, Human
agagaaagaaggaaggag

SEQ ID NO: 460151 - RNA, 21 nt, Human
agagcaucaugugcuucacag

SEQ ID NO: 460152 - RNA, 25 nt, Human
agagggcagacccagcugacgagca

SEQ ID NO: 460153 - RNA, 21 nt, Human
agaggguuugaaauaaaagua

SEQ ID NO: 460154 - RNA, 24 nt, Human
agcacagcuccacacaaaccaccc

SEQ ID NO: 460155 - RNA, 26 nt, Human
aggagagaagaaggagaaaaggggag

SEQ ID NO: 460156 - RNA, 18 nt, Human
aggcagggcagggcagag

SEQ ID NO: 460157 - RNA, 21 nt, Human
aggccgccgagcaggucggcg

SEQ ID NO: 460158 - RNA, 21 nt, Human
aggggguugaagagaaagaag

SEQ ID NO: 460159 - RNA, 18 nt, Human
aggugguggagagugaag

SEQ ID NO: 460160 - RNA, 23 nt, Human
agucaaguguguaaaaauggcag

SEQ ID NO: 460161 - RNA, 20 nt, Human
aguuguguugguuugucagu

SEQ ID NO: 460162 - RNA, 21 nt, Human
auacaaaauccaaaaccccau

SEQ ID NO: 460163 - RNA, 26 nt, Human
caagaaggagcccaggaccucuugcc

SEQ ID NO: 460164 - RNA, 23 nt, Human
cacacaaaccacccucgacaucc

SEQ ID NO: 460165 - RNA, 24 nt, Human
cacacaaaccacccucgacaucca

SEQ ID NO: 460166 - RNA, 20 nt, Human
cacacuugcagagcugggaa

SEQ ID NO: 460167 - RNA, 21 nt, Human
cacagcagacgcgacagagac

SEQ ID NO: 460168 - RNA, 20 nt, Human
cacccagccugauaggagcc

SEQ ID NO: 460169 - RNA, 25 nt, Human
cacuguguggccacacaauggagga

SEQ ID NO: 460170 - RNA, 27 nt, Human
cagcaaagaaaaaaacaagaggggacc

SEQ ID NO: 460171 - RNA, 18 nt, Human
cagcagacgcgacagaga

SEQ ID NO: 460172 - RNA, 28 nt, Human
cagccgccugcccggccccaccguucgg

SEQ ID NO: 460173 - RNA, 18 nt, Human
cagggcagagcgcaggcc

SEQ ID NO: 460174 - RNA, 22 nt, Human
caguuuuuuuuuccuuccauuu

SEQ ID NO: 460175 - RNA, 21 nt, Human
ccaggugguggagagugaagc

SEQ ID NO: 460176 - RNA, 21 nt, Human
cccagccugauaggagcccac

SEQ ID NO: 460177 - RNA, 19 nt, Human
ccccacagcuguuucuacu

SEQ ID NO: 460178 - RNA, 24 nt, Human
cccccugggacccuggcguaucca

SEQ ID NO: 460179 - RNA, 20 nt, Human
ccccugagggaccuugggug

SEQ ID NO: 460180 - RNA, 22 nt, Human
ccccugggacccuggcguaucc

SEQ ID NO: 460181 - RNA, 19 nt, Human
ccccugggcgcgggcgggc

SEQ ID NO: 460182 - RNA, 24 nt, Human
cccggcccgcgcuggggccccggc

SEQ ID NO: 460183 - RNA, 23 nt, Human
cccgugccacagcaggaucugag

SEQ ID NO: 460184 - RNA, 21 nt, Human
cccuuaguggggagaaagccc

SEQ ID NO: 460185 - RNA, 24 nt, Human
cccuuuuaaacucuggcucauguc

SEQ ID NO: 460186 - RNA, 18 nt, Human
ccgccgccgccgcucccg

SEQ ID NO: 460187 - RNA, 18 nt, Human
ccgccgccgccgcucccg

SEQ ID NO: 460188 - RNA, 23 nt, Human
ccggccccaccguucggggcccc

SEQ ID NO: 460189 - RNA, 21 nt, Human
ccggccgccgccgccgcuccc

SEQ ID NO: 460190 - RNA, 23 nt, Human
ccggccgccgccgccgcucccgg

SEQ ID NO: 460191 - RNA, 24 nt, Human
ccucaagaaggagcccaggaccuc

SEQ ID NO: 460192 - RNA, 19 nt, Human
ccuccguggccuccgccgu

SEQ ID NO: 460193 - RNA, 22 nt, Human
ccucugaaaguuguguugguuu

SEQ ID NO: 460194 - RNA, 23 nt, Human
ccugaggagccuggcagagacac

SEQ ID NO: 460195 - RNA, 22 nt, Human
ccugauaggagcccacccugaa

SEQ ID NO: 460196 - RNA, 21 nt, Human
cgacagagacacauaggcccc

SEQ ID NO: 460197 - RNA, 21 nt, Human
cgccgugcccccucccggccc

SEQ ID NO: 460198 - RNA, 22 nt, Human
cgcuggggccccggcccggccg

SEQ ID NO: 460199 - RNA, 25 nt, Human
cggccgccgccgccgcucccggggg

SEQ ID NO: 460200 - RNA, 20 nt, Human
cggggccccugggcgcgggc

SEQ ID NO: 460201 - RNA, 19 nt, Human
cgugccacagcaggaucug

SEQ ID NO: 460202 - RNA, 23 nt, Human
cgugcccccucccggcccgcgcu

SEQ ID NO: 460203 - RNA, 26 nt, Human
cuccacacaaaccacccucgacaucc

SEQ ID NO: 460204 - RNA, 21 nt, Human
cucugucugggccugaggagc

SEQ ID NO: 460205 - RNA, 21 nt, Human
cugaaaguuguguugguuugu

SEQ ID NO: 460206 - RNA, 20 nt, Human
cugagggaccuuggguggga

SEQ ID NO: 460207 - RNA, 20 nt, Human
cuucccuagccauaugcugu

SEQ ID NO: 460208 - RNA, 22 nt, Human
gaaaaagaaaaggaauauggga

SEQ ID NO: 460209 - RNA, 21 nt, Human
gacuguuuuguccaaaacucc

SEQ ID NO: 460210 - RNA, 19 nt, Human
gagacaccaccuggcauag

SEQ ID NO: 460211 - RNA, 23 nt, Human
gagcauuuuaaaaaaugagacuc

SEQ ID NO: 460212 - RNA, 19 nt, Human
gaggagccuggcagagaca

SEQ ID NO: 460213 - RNA, 26 nt, Human
gaguccacagcugaccaacuaccugg

SEQ ID NO: 460214 - RNA, 18 nt, Human
gccuaccaugagaggggg

SEQ ID NO: 460215 - RNA, 19 nt, Human
gcguauccacggcaucucu

SEQ ID NO: 460216 - RNA, 22 nt, Human
gcuguuucuacuucuaacuggu

SEQ ID NO: 460217 - RNA, 19 nt, Human
ggaagagggcagacccagc

SEQ ID NO: 460218 - RNA, 24 nt, Human
ggaccaccucguggcagcaaagaa

SEQ ID NO: 460219 - RNA, 24 nt, Human
ggagagaagaaggagaaaagggga

SEQ ID NO: 460220 - RNA, 19 nt, Human
ggcaagcggaugcaggccc

SEQ ID NO: 460221 - RNA, 23 nt, Human
gggaaugagacauuaaagaaaaa

SEQ ID NO: 460222 - RNA, 20 nt, Human
gggagagagugugagcuugg

SEQ ID NO: 460223 - RNA, 22 nt, Human
gggagaggggaagcacuggcuc

SEQ ID NO: 460224 - RNA, 19 nt, Human
gggaguagcagaggcuagg

SEQ ID NO: 460225 - RNA, 18 nt, Human
gggcaagcggaugcaggc

SEQ ID NO: 460226 - RNA, 23 nt, Human
gggcacacuugcagagcugggaa

SEQ ID NO: 460227 - RNA, 23 nt, Human
gggcagaagaggcuucucugugc

SEQ ID NO: 460228 - RNA, 18 nt, Human
ggggcacacuugcagagc

SEQ ID NO: 460229 - RNA, 23 nt, Human
gggugggaggugguguccugggg

SEQ ID NO: 460230 - RNA, 19 nt, Human
ggucacagaguccacagcu

SEQ ID NO: 460231 - RNA, 22 nt, Human
ggugggaggugguguccugggg

SEQ ID NO: 460232 - RNA, 20 nt, Human
gguguccugggggagggggu

SEQ ID NO: 460233 - RNA, 19 nt, Human
gguugugggcuggccucug

SEQ ID NO: 460234 - RNA, 19 nt, Human
guggcagcaaagaaaaaaa

SEQ ID NO: 460235 - RNA, 19 nt, Human
guggccuccgccgugcccc

SEQ ID NO: 460236 - RNA, 22 nt, Human
uaaaaagucaaguguguaaaaa

SEQ ID NO: 460237 - RNA, 20 nt, Human
uaagaaguuguggugguugg

SEQ ID NO: 460238 - RNA, 23 nt, Human
uagaaagcaaauaaagucacucu

SEQ ID NO: 460239 - RNA, 25 nt, Human
uagaaagcaaauaaagucacucucu

SEQ ID NO: 460240 - RNA, 18 nt, Human
uagaacaguauuuuacaa

SEQ ID NO: 460241 - RNA, 19 nt, Human
uagcagaggcuaggcaggg

SEQ ID NO: 460242 - RNA, 21 nt, Human
uaggauggagcgggccaggca

SEQ ID NO: 460243 - RNA, 24 nt, Human
uaugcuguauuguuuuuauuauua

SEQ ID NO: 460244 - RNA, 23 nt, Human
uauuauacaaaauccaaaacccc

SEQ ID NO: 460245 - RNA, 21 nt, Human
ucaaggggaaugagacauuaa

SEQ ID NO: 460246 - RNA, 19 nt, Human
ucacagcagacgcgacaga

SEQ ID NO: 460247 - RNA, 20 nt, Human
ucagugaaauauccccugag

SEQ ID NO: 460248 - RNA, 21 nt, Human
uccacacaaaccacccucgac

SEQ ID NO: 460249 - RNA, 23 nt, Human
uccagagaacagacacugaagcc

SEQ ID NO: 460250 - RNA, 18 nt, Human
uccauuuuugagaaggug

SEQ ID NO: 460251 - RNA, 19 nt, Human
ucccuagccauaugcugua

SEQ ID NO: 460252 - RNA, 24 nt, Human
uccguggccuccgccgugcccccu

SEQ ID NO: 460253 - RNA, 26 nt, Human
uccuaagcugggcccaagccccacag

SEQ ID NO: 460254 - RNA, 22 nt, Human
uccugggggagggggucauagg

SEQ ID NO: 460255 - RNA, 22 nt, Human
ucggcgcggcccgggaagcgga

SEQ ID NO: 460256 - RNA, 19 nt, Human
ucggggccccugggcgcgg

SEQ ID NO: 460257 - RNA, 21 nt, Human
ucggggccccugggcgcgggc

SEQ ID NO: 460258 - RNA, 24 nt, Human
ucuacaauaaauagagccgggguc

SEQ ID NO: 460259 - RNA, 23 nt, Human
ucuggcaggggcagaagaggcuu

SEQ ID NO: 460260 - RNA, 23 nt, Human
ugaaaaauaaagagagagacuaa

SEQ ID NO: 460261 - RNA, 21 nt, Human
ugaagagaaagaaggaaggag

SEQ ID NO: 460262 - RNA, 25 nt, Human
ugagaaggugaagguggggaggggg

SEQ ID NO: 460263 - RNA, 18 nt, Human
ugagagggggaagcugcc

SEQ ID NO: 460264 - RNA, 20 nt, Human
ugagagggggaagcugccgg

SEQ ID NO: 460265 - RNA, 24 nt, Human
ugaggagagaagaaggagaaaagg

SEQ ID NO: 460266 - RNA, 21 nt, Human
ugagggaccuugggugggagu

SEQ ID NO: 460267 - RNA, 26 nt, Human
ugcaacuggcccugcgacuuuggugc

SEQ ID NO: 460268 - RNA, 20 nt, Human
ugcagaaaaaguccaugagg

SEQ ID NO: 460269 - RNA, 18 nt, Human
ugcgauuggucaaaacug

SEQ ID NO: 460270 - RNA, 22 nt, Human
ugcgggauggaggcagggcaag

SEQ ID NO: 460271 - RNA, 18 nt, Human
uggcaggcgccaugccau

SEQ ID NO: 460272 - RNA, 20 nt, Human
uggcucaugucccaaaugua

SEQ ID NO: 460273 - RNA, 21 nt, Human
ugggaaguugugucaacagcu

SEQ ID NO: 460274 - RNA, 23 nt, Human
ugggaggugguguccugggggag

SEQ ID NO: 460275 - RNA, 21 nt, Human
ugggaucagugucggaaccuc

SEQ ID NO: 460276 - RNA, 19 nt, Human
uggggagaaagcccagucc

SEQ ID NO: 460277 - RNA, 19 nt, Human
uggggaggggguugaagag

SEQ ID NO: 460278 - RNA, 20 nt, Human
uuaaagaaaaagaccagugu

SEQ ID NO: 460279 - RNA, 20 nt, Human
uugaagagaaagaaggaagg

SEQ ID NO: 460280 - RNA, 22 nt, Human
uugcagagcugggaaguugugu

SEQ ID NO: 460281 - RNA, 18 nt, Human
uuggcacaagagaaaaag

SEQ ID NO: 460282 - RNA, 22 nt, Human
uugguucccuuuuaaacucugg

SEQ ID NO: 460283 - RNA, 25 nt, Human
uuucucagagagaaaauaaguuuca

SEQ ID NO: 460284 - RNA, 25 nt, Human
uuuuacaauuauauacaccaugucc

SEQ ID NO: 460285 - RNA, 19 nt, Human
aagcccuuggcacccccaa

SEQ ID NO: 460286 - RNA, 19 nt, Human
acucuaaggaaugauauga

SEQ ID NO: 460287 - RNA, 18 nt, Human
agagggcggggggcugcc

SEQ ID NO: 460288 - RNA, 21 nt, Human
agagggcggggggcugcccag

SEQ ID NO: 460289 - RNA, 21 nt, Human
agagggcggggggcugcccag

SEQ ID NO: 460290 - RNA, 25 nt, Human
agccccaggcaccagccuugggucc

SEQ ID NO: 460291 - RNA, 22 nt, Human
aggggcggggccggggcggggc

SEQ ID NO: 460292 - RNA, 18 nt, Human
agggggagggggcggagc

SEQ ID NO: 460293 - RNA, 20 nt, Human
agggggcgggguccgggugg

SEQ ID NO: 460294 - RNA, 19 nt, Human
cacccccaacgcccucugc

SEQ ID NO: 460295 - RNA, 25 nt, Human
cacccccaacgcccucugcugguuc

SEQ ID NO: 460296 - RNA, 20 nt, Human
ccccgcccugucagcccucc

SEQ ID NO: 460297 - RNA, 21 nt, Human
ccccgcccugucagcccuccc

SEQ ID NO: 460298 - RNA, 28 nt, Human
ccccuggacagucacuccucaccagccc

SEQ ID NO: 460299 - RNA, 26 nt, Human
cccgccugucccgccguccccucccu

SEQ ID NO: 460300 - RNA, 29 nt, Human
cccugucagcccucccgccggucccacuu

SEQ ID NO: 460301 - RNA, 23 nt, Human
ccgauccaccuccguccgcagcu

SEQ ID NO: 460302 - RNA, 24 nt, Human
ccucccuggaccgguggcgagggc

SEQ ID NO: 460303 - RNA, 23 nt, Human
ccugucccgccguccccucccug

SEQ ID NO: 460304 - RNA, 21 nt, Human
ccuuggguccgauccaccucc

SEQ ID NO: 460305 - RNA, 18 nt, Human
cgcagcugcuccuucggg

SEQ ID NO: 460306 - RNA, 21 nt, Human
cgggcggagagggcggggggc

SEQ ID NO: 460307 - RNA, 18 nt, Human
cggggccggggcggggcg

SEQ ID NO: 460308 - RNA, 22 nt, Human
cguagaggggguggggcgggca

SEQ ID NO: 460309 - RNA, 22 nt, Human
cucuccuuucuucucacucuuu

SEQ ID NO: 460310 - RNA, 18 nt, Human
cucugcugguuccccugg

SEQ ID NO: 460311 - RNA, 19 nt, Human
cugcaggcacagaacaacc

SEQ ID NO: 460312 - RNA, 20 nt, Human
cuuagccccaggcaccagcc

SEQ ID NO: 460313 - RNA, 22 nt, Human
cuuggcacccccaacgcccucu

SEQ ID NO: 460314 - RNA, 22 nt, Human
gaaguaaaucugggcuucccuu

SEQ ID NO: 460315 - RNA, 18 nt, Human
gaggggcguagagggggu

SEQ ID NO: 460316 - RNA, 21 nt, Human
gaggggguggggcgggcagga

SEQ ID NO: 460317 - RNA, 19 nt, Human
gccagggggagggggcgga

SEQ ID NO: 460318 - RNA, 22 nt, Human
gcccugucagcccucccgccgg

SEQ ID NO: 460319 - RNA, 18 nt, Human
gcuggucagugaaagcag

SEQ ID NO: 460320 - RNA, 27 nt, Human
gcuuuuccucuccuuucuucucacucc

SEQ ID NO: 460321 - RNA, 22 nt, Human
ggcaggaaaggggcggggccgg

SEQ ID NO: 460322 - RNA, 19 nt, Human
ggccagggggagggggcgg

SEQ ID NO: 460323 - RNA, 22 nt, Human
ggcccgggccgagguggcggcu

SEQ ID NO: 460324 - RNA, 19 nt, Human
ggcggagagggcggggggc

SEQ ID NO: 460325 - RNA, 19 nt, Human
ggcguagaggggguggggc

SEQ ID NO: 460326 - RNA, 19 nt, Human
gggaagggcugcucaagcg

SEQ ID NO: 460327 - RNA, 21 nt, Human
gggcaggaaaggggcggggcc

SEQ ID NO: 460328 - RNA, 21 nt, Human
gggccgagguggcggcugaac

SEQ ID NO: 460329 - RNA, 20 nt, Human
gggcggagagggcggggggc

SEQ ID NO: 460330 - RNA, 19 nt, Human
gggcggggccggggcgggg

SEQ ID NO: 460331 - RNA, 20 nt, Human
gggcggggccggggcggggc

SEQ ID NO: 460332 - RNA, 19 nt, Human
gggcggggcgggcccgggc

SEQ ID NO: 460333 - RNA, 19 nt, Human
gggggagggggcggagccc

SEQ ID NO: 460334 - RNA, 19 nt, Human
gggguggggcgggcaggaa

SEQ ID NO: 460335 - RNA, 25 nt, Human
gggguggggcgggcaggaaaggggc

SEQ ID NO: 460336 - RNA, 18 nt, Human
gucacuccucaccagccc

SEQ ID NO: 460337 - RNA, 20 nt, Human
gucagcccucccgccggucc

SEQ ID NO: 460338 - RNA, 25 nt, Human
guccggguggaggggcguagagggg

SEQ ID NO: 460339 - RNA, 22 nt, Human
uccaccuccguccgcagcugcu

SEQ ID NO: 460340 - RNA, 22 nt, Human
ucccuggaccgguggcgagggc

SEQ ID NO: 460341 - RNA, 23 nt, Human
ucccuugcggagaagcccuuggc

SEQ ID NO: 460342 - RNA, 25 nt, Human
uccggguggaggggcguagaggggg

SEQ ID NO: 460343 - RNA, 20 nt, Human
uccucuccuuucuucucacu

SEQ ID NO: 460344 - RNA, 22 nt, Human
uccuuuggucccuaaacucuaa

SEQ ID NO: 460345 - RNA, 20 nt, Human
ucuaugcugcaggcacagaa

SEQ ID NO: 460346 - RNA, 19 nt, Human
ucuccuuucuucucacucu

SEQ ID NO: 460347 - RNA, 28 nt, Human
ugccagccugcgcucuaugcugcaggca

SEQ ID NO: 460348 - RNA, 25 nt, Human
ugcggagaagcccuuggcaccccca

SEQ ID NO: 460349 - RNA, 19 nt, Human
uggcacccccaacgcccuc

SEQ ID NO: 460350 - RNA, 19 nt, Human
uggggcgggcaggaaaggg

SEQ ID NO: 460351 - RNA, 22 nt, Human
uggggcgggcaggaaaggggcg

SEQ ID NO: 460352 - RNA, 20 nt, Human
uguggcuggucagugaaagc

SEQ ID NO: 460353 - RNA, 22 nt, Human
uuagccccaggcaccagccuug

SEQ ID NO: 460354 - RNA, 20 nt, Human
uuccccuggacagucacucc

SEQ ID NO: 460355 - RNA, 21 nt, Human
uuuuuguuuguuuguuucuuu

SEQ ID NO: 460356 - RNA, 24 nt, Human
aaauauucauuuucucuaagaucc

SEQ ID NO: 460357 - RNA, 19 nt, Human
aacaaaaccagcucaacaa

SEQ ID NO: 460358 - RNA, 25 nt, Human
acuucggaggagcauuaacaaaaga

SEQ ID NO: 460359 - RNA, 25 nt, Human
agaaauaaugaaaaacaccgguacc

SEQ ID NO: 460360 - RNA, 19 nt, Human
auguuacuuuuacccccug

SEQ ID NO: 460361 - RNA, 22 nt, Human
auucauuuucucuaagauccag

SEQ ID NO: 460362 - RNA, 18 nt, Human
caaagaugaaauguggca

SEQ ID NO: 460363 - RNA, 21 nt, Human
cagcucaguaaaagauuaccc

SEQ ID NO: 460364 - RNA, 21 nt, Human
cccugaaaaacuucggaggag

SEQ ID NO: 460365 - RNA, 18 nt, Human
ccugcaauuuuaaacuac

SEQ ID NO: 460366 - RNA, 22 nt, Human
cugaaaaugcaacaaauucuca

SEQ ID NO: 460367 - RNA, 18 nt, Human
cuuggaaacaaaaaccgc

SEQ ID NO: 460368 - RNA, 20 nt, Human
gaaacaguucuguaguucuu

SEQ ID NO: 460369 - RNA, 21 nt, Human
gcuuuguuuuuguuguuuuau

SEQ ID NO: 460370 - RNA, 21 nt, Human
guguuuaaaggcuggugcaaa

SEQ ID NO: 460371 - RNA, 20 nt, Human
uaaaaccuaaaaauguuuua

SEQ ID NO: 460372 - RNA, 21 nt, Human
uaaaauaauacccuccacuga

SEQ ID NO: 460373 - RNA, 22 nt, Human
uaaacuacaagaucaaagcuaa

SEQ ID NO: 460374 - RNA, 18 nt, Human
uaagcugaacaaaaccag

SEQ ID NO: 460375 - RNA, 21 nt, Human
uaauacccuccacugauguua

SEQ ID NO: 460376 - RNA, 24 nt, Human
uaaucaucggggugacuccgggaa

SEQ ID NO: 460377 - RNA, 21 nt, Human
uaaugaaaaugacauaucugu

SEQ ID NO: 460378 - RNA, 19 nt, Human
uacaagcacucauguuagg

SEQ ID NO: 460379 - RNA, 21 nt, Human
ucaacaagguuaagaaaaaaa

SEQ ID NO: 460380 - RNA, 22 nt, Human
ucaauguuggcaaucugcuucu

SEQ ID NO: 460381 - RNA, 22 nt, Human
ucccugcaauuuuaaacuacaa

SEQ ID NO: 460382 - RNA, 23 nt, Human
ucucuaagauccagcucaguaaa

SEQ ID NO: 460383 - RNA, 23 nt, Human
ucugaaacaguucuguaguucuu

SEQ ID NO: 460384 - RNA, 20 nt, Human
ugaaaaacacaauugggaaa

SEQ ID NO: 460385 - RNA, 22 nt, Human
ugaaaagaaauaaugaaaaaca

SEQ ID NO: 460386 - RNA, 23 nt, Human
ugaaaagaaauaaugaaaaacac

SEQ ID NO: 460387 - RNA, 20 nt, Human
ugcaggacuagcccugcugu

SEQ ID NO: 460388 - RNA, 20 nt, Human
uuaagaaaaaaaugucacau

SEQ ID NO: 460389 - RNA, 22 nt, Human
aaaaaguagcaagcccccaaga

SEQ ID NO: 460390 - RNA, 23 nt, Human
aaaaaguagcaagcccccaagaa

SEQ ID NO: 460391 - RNA, 27 nt, Human
aagacaaaaaguagcaagcccccaaga

SEQ ID NO: 460392 - RNA, 23 nt, Human
aagcggggacaaggaggaaccag

SEQ ID NO: 460393 - RNA, 21 nt, Human
aaguagcaagcccccaagaaa

SEQ ID NO: 460394 - RNA, 23 nt, Human
acccacccugcccuuggacuccu

SEQ ID NO: 460395 - RNA, 21 nt, Human
agaaagccacacaauagaaga

SEQ ID NO: 460396 - RNA, 20 nt, Human
agaccgggauggggagaagg

SEQ ID NO: 460397 - RNA, 27 nt, Human
agaggaaggauuuggggguggaggggc

SEQ ID NO: 460398 - RNA, 19 nt, Human
agccccagacaagccccag

SEQ ID NO: 460399 - RNA, 19 nt, Human
aggaaggauuugggggugg

SEQ ID NO: 460400 - RNA, 24 nt, Human
aggaaggugacacaggacuggggu

SEQ ID NO: 460401 - RNA, 23 nt, Human
aggggacauagaaggaaaaagga

SEQ ID NO: 460402 - RNA, 18 nt, Human
auggagaugcccacaccc

SEQ ID NO: 460403 - RNA, 21 nt, Human
caaggcuggacccacccugcc

SEQ ID NO: 460404 - RNA, 18 nt, Human
cacccugucucucaaaag

SEQ ID NO: 460405 - RNA, 20 nt, Human
cacccugucucucaaaagcu

SEQ ID NO: 460406 - RNA, 19 nt, Human
cagcucaggccgggcacgg

SEQ ID NO: 460407 - RNA, 20 nt, Human
ccacacccugucucucaaaa

SEQ ID NO: 460408 - RNA, 24 nt, Human
ccacccugcccuuggacuccuggg

SEQ ID NO: 460409 - RNA, 25 nt, Human
ccacccugcccuuggacuccugggc

SEQ ID NO: 460410 - RNA, 18 nt, Human
ccagugcccgaucccgcc

SEQ ID NO: 460411 - RNA, 20 nt, Human
ccagugcccgaucccgcccu

SEQ ID NO: 460412 - RNA, 22 nt, Human
cccccaagaaagcggggacaag

SEQ ID NO: 460413 - RNA, 24 nt, Human
ccccucagccucagcgcccccccc

SEQ ID NO: 460414 - RNA, 22 nt, Human
cccgcccucuucccagcugggg

SEQ ID NO: 460415 - RNA, 18 nt, Human
cccucuucccagcugggg

SEQ ID NO: 460416 - RNA, 22 nt, Human
cccuuggacuccugggcucagg

SEQ ID NO: 460417 - RNA, 23 nt, Human
ccucagccucagcgccccccccg

SEQ ID NO: 460418 - RNA, 23 nt, Human
ccugcaguuggcagugauggggc

SEQ ID NO: 460419 - RNA, 19 nt, Human
ccuuggacuccugggcuca

SEQ ID NO: 460420 - RNA, 23 nt, Human
cgcagcucccccucagccucagc

SEQ ID NO: 460421 - RNA, 19 nt, Human
cucagccucagcgcccccc

SEQ ID NO: 460422 - RNA, 21 nt, Human
gaggagaggaaggauuugggg

SEQ ID NO: 460423 - RNA, 19 nt, Human
gccccagacaagccccagg

SEQ ID NO: 460424 - RNA, 20 nt, Human
gcggaacgcggggggcgcgg

SEQ ID NO: 460425 - RNA, 18 nt, Human
ggauuuggggguggaggg

SEQ ID NO: 460426 - RNA, 18 nt, Human
ggcaaggggugggacugg

SEQ ID NO: 460427 - RNA, 24 nt, Human
ggcccgaggggcccccugcaguug

SEQ ID NO: 460428 - RNA, 20 nt, Human
gggacugggaggagaggaag

SEQ ID NO: 460429 - RNA, 18 nt, Human
gggagaagggggaagccc

SEQ ID NO: 460430 - RNA, 22 nt, Human
gggauggggagaagggggaagc

SEQ ID NO: 460431 - RNA, 24 nt, Human
gggcaaggggugggacugggagga

SEQ ID NO: 460432 - RNA, 23 nt, Human
gggcggaacgcggggggcgcggg

SEQ ID NO: 460433 - RNA, 22 nt, Human
ggggagaagggggaagcccuag

SEQ ID NO: 460434 - RNA, 19 nt, Human
uagaagacaaaaaguagca

SEQ ID NO: 460435 - RNA, 24 nt, Human
uagcaagacgcagcucccccucag

SEQ ID NO: 460436 - RNA, 21 nt, Human
uagcaagcccccaagaaagcg

SEQ ID NO: 460437 - RNA, 23 nt, Human
ucaaaagcugggucucuggagac

SEQ ID NO: 460438 - RNA, 25 nt, Human
ucaaauacucagaaagccacacaau

SEQ ID NO: 460439 - RNA, 18 nt, Human
ucaggccgggcacggagg

SEQ ID NO: 460440 - RNA, 22 nt, Human
uccguggggcaaggggugggac

SEQ ID NO: 460441 - RNA, 19 nt, Human
ugcccuuggacuccugggc

SEQ ID NO: 460442 - RNA, 21 nt, Human
ugcccuuggacuccugggcuc

SEQ ID NO: 460443 - RNA, 24 nt, Human
ugcccuuggacuccugggcucagg

SEQ ID NO: 460444 - RNA, 24 nt, Human
uggagaugcccacacccugucucu

SEQ ID NO: 460445 - RNA, 19 nt, Human
uggaggggcucaaggcugg

SEQ ID NO: 460446 - RNA, 20 nt, Human
uggcagugauggggccagug

SEQ ID NO: 460447 - RNA, 24 nt, Human
uggcagugauggggccaguggagg

SEQ ID NO: 460448 - RNA, 22 nt, Human
uggggagaagggggaagcccua

SEQ ID NO: 460449 - RNA, 20 nt, Human
uuggcagugauggggccagu

SEQ ID NO: 460450 - RNA, 19 nt, Human
aaccagaaggaacugucua

SEQ ID NO: 460451 - RNA, 20 nt, Human
aaccagaaggaacugucuau

SEQ ID NO: 460452 - RNA, 21 nt, Human
acaggaaugcagggggaggcc

SEQ ID NO: 460453 - RNA, 23 nt, Human
accacagcccuccccuugagcca

SEQ ID NO: 460454 - RNA, 25 nt, Human
agaggccaaggcuggagcaguggga

SEQ ID NO: 460455 - RNA, 25 nt, Human
aggaaugcagggggaggccgguacc

SEQ ID NO: 460456 - RNA, 23 nt, Human
aggaggccacaugggccuggggu

SEQ ID NO: 460457 - RNA, 21 nt, Human
aguuugguguugcacuggggu

SEQ ID NO: 460458 - RNA, 19 nt, Human
cacaugguaggacccaucu

SEQ ID NO: 460459 - RNA, 19 nt, Human
cagcgugcuggggugacgg

SEQ ID NO: 460460 - RNA, 19 nt, Human
cauucuaggcucuuggcug

SEQ ID NO: 460461 - RNA, 19 nt, Human
cauucuaggcucuuggcug

SEQ ID NO: 460462 - RNA, 21 nt, Human
ccaagcaaggaggaggccaca

SEQ ID NO: 460463 - RNA, 21 nt, Human
cccugaaguuugguguugcac

SEQ ID NO: 460464 - RNA, 23 nt, Human
ccucuucacccagacaggaauug

SEQ ID NO: 460465 - RNA, 18 nt, Human
ccugggguagcccuggcc

SEQ ID NO: 460466 - RNA, 19 nt, Human
ccuggguuccacagaggcg

SEQ ID NO: 460467 - RNA, 20 nt, Human
cgaagagcacauucucugca

SEQ ID NO: 460468 - RNA, 23 nt, Human
cguaacacgucuccucuucaccc

SEQ ID NO: 460469 - RNA, 24 nt, Human
cucgcucaucaguguucuuccucc

SEQ ID NO: 460470 - RNA, 25 nt, Human
cucuuggcuguacaugacaagggcu

SEQ ID NO: 460471 - RNA, 27 nt, Human
cugggccuggggaacugggaccaaagu

SEQ ID NO: 460472 - RNA, 18 nt, Human
gaagagcacauucucugc

SEQ ID NO: 460473 - RNA, 24 nt, Human
gaagagcacauucucugcacacgu

SEQ ID NO: 460474 - RNA, 22 nt, Human
gauagcaggggcuguggaggga

SEQ ID NO: 460475 - RNA, 25 nt, Human
gcaccacagcccuccccuugagcca

SEQ ID NO: 460476 - RNA, 20 nt, Human
gccacgggaaggagcccuuu

SEQ ID NO: 460477 - RNA, 19 nt, Human
gcccuggccuugcccaccu

SEQ ID NO: 460478 - RNA, 23 nt, Human
ggagagggacaucaggagaggcc

SEQ ID NO: 460479 - RNA, 22 nt, Human
ggaggccacaugggccuggggu

SEQ ID NO: 460480 - RNA, 19 nt, Human
gggaacuggguugaagcag

SEQ ID NO: 460481 - RNA, 20 nt, Human
gggaggccaggcaauggcug

SEQ ID NO: 460482 - RNA, 19 nt, Human
gggaugaggagcugcugga

SEQ ID NO: 460483 - RNA, 21 nt, Human
gggaugaggagcugcuggaug

SEQ ID NO: 460484 - RNA, 18 nt, Human
gggcuguggagggaggga

SEQ ID NO: 460485 - RNA, 19 nt, Human
ggguagcccuggccuugcc

SEQ ID NO: 460486 - RNA, 19 nt, Human
uagcugagucuuauucugg

SEQ ID NO: 460487 - RNA, 21 nt, Human
uaggacccaucuaaccagaag

SEQ ID NO: 460488 - RNA, 21 nt, Human
ucauucuaggcucuuggcugu

SEQ ID NO: 460489 - RNA, 19 nt, Human
ucuaggcucuuggcuguac

SEQ ID NO: 460490 - RNA, 22 nt, Human
ugaagcagccacgggaaggagc

SEQ ID NO: 460491 - RNA, 21 nt, Human
ugacaagggcugguacagagc

SEQ ID NO: 460492 - RNA, 23 nt, Human
ugcagggggaggccaggcaaugg

SEQ ID NO: 460493 - RNA, 21 nt, Human
uggagggagggagagggacau

SEQ ID NO: 460494 - RNA, 24 nt, Human
uggagggagggagagggacaucag

SEQ ID NO: 460495 - RNA, 19 nt, Human
uggguuccacagaggcggc

SEQ ID NO: 460496 - RNA, 21 nt, Human
uguguccucgcuugugccccu

SEQ ID NO: 460497 - RNA, 21 nt, Human
uucuggucccuuagauguguc

SEQ ID NO: 460498 - RNA, 23 nt, Human
aaaucaugcaaagauuuaaauaa

SEQ ID NO: 460499 - RNA, 20 nt, Human
aaccacacaucccauagaua

SEQ ID NO: 460500 - RNA, 19 nt, Human
aaccagaaccacacauccc

SEQ ID NO: 460501 - RNA, 24 nt, Human
aacuauugaaagacccuaagucag

SEQ ID NO: 460502 - RNA, 18 nt, Human
aagauacuucaaaccacc

SEQ ID NO: 460503 - RNA, 18 nt, Human
aagcguauuuuucagcag

SEQ ID NO: 460504 - RNA, 20 nt, Human
agauaauuccauuuaacuga

SEQ ID NO: 460505 - RNA, 21 nt, Human
auucauaacacucaaacuacu

SEQ ID NO: 460506 - RNA, 18 nt, Human
auuuacacaaaauuccau

SEQ ID NO: 460507 - RNA, 21 nt, Human
caacacagcuguaacacugac

SEQ ID NO: 460508 - RNA, 22 nt, Human
caagagaccucagccaccaaua

SEQ ID NO: 460509 - RNA, 20 nt, Human
caccgucaucaucucaaucu

SEQ ID NO: 460510 - RNA, 19 nt, Human
cagagagacagguauagug

SEQ ID NO: 460511 - RNA, 20 nt, Human
cagcugcgcgguugcccagg

SEQ ID NO: 460512 - RNA, 23 nt, Human
caucaccgucaucaucucaaucu

SEQ ID NO: 460513 - RNA, 21 nt, Human
caugcaguuucaauuguucag

SEQ ID NO: 460514 - RNA, 21 nt, Human
ccgccgccaucgcccaggccg

SEQ ID NO: 460515 - RNA, 18 nt, Human
ccuauccccaacacagcu

SEQ ID NO: 460516 - RNA, 21 nt, Human
cgccgccaucgcccaggccgc

SEQ ID NO: 460517 - RNA, 18 nt, Human
gccaaucuaugaaauuau

SEQ ID NO: 460518 - RNA, 24 nt, Human
uaagaaaauggaaaaucuguuuuu

SEQ ID NO: 460519 - RNA, 20 nt, Human
uaaggcagaaguauuuucug

SEQ ID NO: 460520 - RNA, 19 nt, Human
uaaucaccuuccacaacga

SEQ ID NO: 460521 - RNA, 21 nt, Human
uacaagaugaaggugaaaaag

SEQ ID NO: 460522 - RNA, 24 nt, Human
uacuacuacaaaauauccuucucu

SEQ ID NO: 460523 - RNA, 23 nt, Human
uagcaauuucaagagaccucagc

SEQ ID NO: 460524 - RNA, 20 nt, Human
uaggucuccaacgucaagaa

SEQ ID NO: 460525 - RNA, 23 nt, Human
uauuacaaaugcuaacaacaaga

SEQ ID NO: 460526 - RNA, 18 nt, Human
ucacaauguugaagugag

SEQ ID NO: 460527 - RNA, 22 nt, Human
ucccaaacuauugaaagacccu

SEQ ID NO: 460528 - RNA, 23 nt, Human
ucgcccaggccgccuccggaggc

SEQ ID NO: 460529 - RNA, 23 nt, Human
ucuuuacaaugucagagcaguug

SEQ ID NO: 460530 - RNA, 18 nt, Human
ugaagugauggcuguuca

SEQ ID NO: 460531 - RNA, 23 nt, Human
ugcaugcaguuucaauuguucag

SEQ ID NO: 460532 - RNA, 20 nt, Human
uguaucuuacuuagaaaaaa

SEQ ID NO: 460533 - RNA, 18 nt, Human
uguugaagugauggcugu

SEQ ID NO: 460534 - RNA, 23 nt, Human
uuaguauuuuauucgguuucuug

SEQ ID NO: 460535 - RNA, 20 nt, Human
uucaagagaccucagccacc

SEQ ID NO: 460536 - RNA, 20 nt, Human
uucauuuuuuauaagagaau

SEQ ID NO: 460537 - RNA, 21 nt, Human
uucuuaauuuucugaaauuua

SEQ ID NO: 460538 - RNA, 25 nt, Human
uuuacaauauaaagugaaauauuac

SEQ ID NO: 460539 - RNA, 23 nt, Human
uuuacacaaaauuccauuuauag

SEQ ID NO: 460540 - RNA, 24 nt, Human
uuugcccaucucaccuaaccuuca

SEQ ID NO: 460541 - RNA, 18 nt, Human
uuuuauauauauauauau

SEQ ID NO: 460542 - RNA, 19 nt, Human
uuuuauggcugcaugcagu

SEQ ID NO: 460543 - RNA, 18 nt, Human
aaaggaacgcaaggucug

SEQ ID NO: 460544 - RNA, 18 nt, Human
accaggugggcuagggca

SEQ ID NO: 460545 - RNA, 23 nt, Human
acccggucggggccggcuggggc

SEQ ID NO: 460546 - RNA, 20 nt, Human
acgcggggugggugggggcg

SEQ ID NO: 460547 - RNA, 27 nt, Human
aggaacgcaaggucugggacccacggc

SEQ ID NO: 460548 - RNA, 24 nt, Human
aggcugggcuuggguggccucggg

SEQ ID NO: 460549 - RNA, 21 nt, Human
auccccgcggagggagggcgg

SEQ ID NO: 460550 - RNA, 20 nt, Human
cacagggcaaccccguccug

SEQ ID NO: 460551 - RNA, 18 nt, Human
cacagggucugaguccca

SEQ ID NO: 460552 - RNA, 20 nt, Human
caccugggccagggcuaggc

SEQ ID NO: 460553 - RNA, 21 nt, Human
cacuggccuggccaccucccc

SEQ ID NO: 460554 - RNA, 18 nt, Human
cacugggccuggcaccgc

SEQ ID NO: 460555 - RNA, 21 nt, Human
cagagaaaugggaaucgcaaa

SEQ ID NO: 460556 - RNA, 19 nt, Human
cagcaccuggggguggcuc

SEQ ID NO: 460557 - RNA, 24 nt, Human
cagcccugucccuaguccugaggg

SEQ ID NO: 460558 - RNA, 23 nt, Human
caggcgagcagugcuccuggacc

SEQ ID NO: 460559 - RNA, 25 nt, Human
caguauguacaggcgagcagugcuc

SEQ ID NO: 460560 - RNA, 20 nt, Human
cagugaagagacgcgaggga

SEQ ID NO: 460561 - RNA, 23 nt, Human
caucugggggcauggucugagga

SEQ ID NO: 460562 - RNA, 24 nt, Human
ccaccuccccggcugcccugaucc

SEQ ID NO: 460563 - RNA, 22 nt, Human
ccacuggccuggccaccucccc

SEQ ID NO: 460564 - RNA, 22 nt, Human
ccccacacugaauccugcgugc

SEQ ID NO: 460565 - RNA, 21 nt, Human
ccccagcagcagaugauggcc

SEQ ID NO: 460566 - RNA, 18 nt, Human
cccguccugaugcugaga

SEQ ID NO: 460567 - RNA, 19 nt, Human
cccuaguccugagggauug

SEQ ID NO: 460568 - RNA, 22 nt, Human
ccuggcaccgcguggugggggg

SEQ ID NO: 460569 - RNA, 20 nt, Human
cgcgagggacgcccgcggcg

SEQ ID NO: 460570 - RNA, 19 nt, Human
cugauccagcagccacacu

SEQ ID NO: 460571 - RNA, 23 nt, Human
cuggcccaggccggcacagcccu

SEQ ID NO: 460572 - RNA, 19 nt, Human
gagcugcggguccgugggc

SEQ ID NO: 460573 - RNA, 20 nt, Human
gcagacgacgugggcaggcg

SEQ ID NO: 460574 - RNA, 21 nt, Human
gcagugaagagacgcgaggga

SEQ ID NO: 460575 - RNA, 19 nt, Human
gcccaggccggcacagccc

SEQ ID NO: 460576 - RNA, 19 nt, Human
gcccugagcugcggguccg

SEQ ID NO: 460577 - RNA, 18 nt, Human
gcggcaggggagcucugg

SEQ ID NO: 460578 - RNA, 23 nt, Human
gcggcaggggagcucuggggcac

SEQ ID NO: 460579 - RNA, 21 nt, Human
gcguggccggaguggggaggg

SEQ ID NO: 460580 - RNA, 23 nt, Human
gcuccuagcagagaaaugggaau

SEQ ID NO: 460581 - RNA, 19 nt, Human
gcugcccugauccagcagc

SEQ ID NO: 460582 - RNA, 18 nt, Human
ggacaggaacaaaaggaa

SEQ ID NO: 460583 - RNA, 19 nt, Human
ggcguggccggagugggga

SEQ ID NO: 460584 - RNA, 23 nt, Human
ggcuuggguggccucgggcacgu

SEQ ID NO: 460585 - RNA, 25 nt, Human
gggaccccagcagcagaugauggcc

SEQ ID NO: 460586 - RNA, 21 nt, Human
gggcacagggucugaguccca

SEQ ID NO: 460587 - RNA, 18 nt, Human
ggggaggggcugugcccc

SEQ ID NO: 460588 - RNA, 21 nt, Human
gggugggggcguggccggagu

SEQ ID NO: 460589 - RNA, 25 nt, Human
gguggcucccacggcaccagguggg

SEQ ID NO: 460590 - RNA, 18 nt, Human
gugaacacagggcaaccc

SEQ ID NO: 460591 - RNA, 21 nt, Human
gugaacacagggcaaccccgu

SEQ ID NO: 460592 - RNA, 21 nt, Human
uaaaaaaaucaucugggggca

SEQ ID NO: 460593 - RNA, 20 nt, Human
uacaggcgagcagugcuccc

SEQ ID NO: 460594 - RNA, 18 nt, Human
ucagguggaugagaacgg

SEQ ID NO: 460595 - RNA, 21 nt, Human
uccacagggccuggccacugg

SEQ ID NO: 460596 - RNA, 18 nt, Human
uccccggcugcccugauc

SEQ ID NO: 460597 - RNA, 20 nt, Human
uccgugggcccuggcccagg

SEQ ID NO: 460598 - RNA, 24 nt, Human
ucugcggcaggggagcucuggggc

SEQ ID NO: 460599 - RNA, 21 nt, Human
ugagaaagguggcauggagug

SEQ ID NO: 460600 - RNA, 21 nt, Human
ugagaacggacacugcaaacc

SEQ ID NO: 460601 - RNA, 25 nt, Human
ugcccccagcaccuggggguggcuc

SEQ ID NO: 460602 - RNA, 30 nt, Human
ugcgcagaacucaagccggcauccaggcag

SEQ ID NO: 460603 - RNA, 24 nt, Human
ugcuccuggacccggucggggccg

SEQ ID NO: 460604 - RNA, 18 nt, Human
uggcccaggccggcacag

SEQ ID NO: 460605 - RNA, 24 nt, Human
uggccuggccaccuccccggcugc

SEQ ID NO: 460606 - RNA, 24 nt, Human
uggcuccuagcagagaaaugggaa

SEQ ID NO: 460607 - RNA, 23 nt, Human
uggggaggggcugugcccccagc

SEQ ID NO: 460608 - RNA, 18 nt, Human
ugggggcguggccggagu

SEQ ID NO: 460609 - RNA, 24 nt, Human
uuuuuuuuuuuauuuucuauuuuu

SEQ ID NO: 460610 - RNA, 24 nt, Human
uuuuuuuuuuuuuuuuuuuauuuu

SEQ ID NO: 460611 - RNA, 21 nt, Human
aaaaauaacuguuuccuagau

SEQ ID NO: 460612 - RNA, 21 nt, Human
aaacaaaugcccccaguuccu

SEQ ID NO: 460613 - RNA, 24 nt, Human
aaaccaaaucuuuuguagaagugu

SEQ ID NO: 460614 - RNA, 18 nt, Human
aaaccaacaaagcugaua

SEQ ID NO: 460615 - RNA, 18 nt, Human
aaagagauuagcccgggc

SEQ ID NO: 460616 - RNA, 20 nt, Human
aacaaagguaucucauuaca

SEQ ID NO: 460617 - RNA, 18 nt, Human
aacugaaaccaacaaagc

SEQ ID NO: 460618 - RNA, 23 nt, Human
aaggacaauaggguuuaaaaugu

SEQ ID NO: 460619 - RNA, 26 nt, Human
aaguggcccagaggcacagugaauac

SEQ ID NO: 460620 - RNA, 23 nt, Human
aauacaauuuucaaauuuuaccc

SEQ ID NO: 460621 - RNA, 21 nt, Human
aauguaaaaggaauaaaacga

SEQ ID NO: 460622 - RNA, 18 nt, Human
acacacacaccccaggac

SEQ ID NO: 460623 - RNA, 22 nt, Human
accaguaacagcuuuucaucau

SEQ ID NO: 460624 - RNA, 18 nt, Human
acgcacugcaccugaaga

SEQ ID NO: 460625 - RNA, 19 nt, Human
acucuggguggcggcgggg

SEQ ID NO: 460626 - RNA, 18 nt, Human
acugcaaagaugacaggc

SEQ ID NO: 460627 - RNA, 18 nt, Human
acugggucuguuaaauau

SEQ ID NO: 460628 - RNA, 22 nt, Human
agaugacaggcacagagcugua

SEQ ID NO: 460629 - RNA, 18 nt, Human
agcaggaggcggccaagg

SEQ ID NO: 460630 - RNA, 22 nt, Human
agcauauuagccuucauuccau

SEQ ID NO: 460631 - RNA, 22 nt, Human
aggcaacaagcccacaucuaca

SEQ ID NO: 460632 - RNA, 21 nt, Human
aggggaagaaguggcccagag

SEQ ID NO: 460633 - RNA, 25 nt, Human
agguaauggcaagagugauuaaaac

SEQ ID NO: 460634 - RNA, 20 nt, Human
agguagagaggagacagcuc

SEQ ID NO: 460635 - RNA, 18 nt, Human
agucauggccuaaacaaa

SEQ ID NO: 460636 - RNA, 24 nt, Human
auauuagguauaauaaaauguguc

SEQ ID NO: 460637 - RNA, 18 nt, Human
aucaauuuauuucuguuc

SEQ ID NO: 460638 - RNA, 21 nt, Human
augaacaacgacaaagacugc

SEQ ID NO: 460639 - RNA, 24 nt, Human
augaacuaguuuuauuugcauuua

SEQ ID NO: 460640 - RNA, 18 nt, Human
augcaacucuaaaaacca

SEQ ID NO: 460641 - RNA, 20 nt, Human
auggaggcagcuagcaaaca

SEQ ID NO: 460642 - RNA, 21 nt, Human
auuguacacugagguuuaucu

SEQ ID NO: 460643 - RNA, 19 nt, Human
auuuauguauuuuuuccuu

SEQ ID NO: 460644 - RNA, 18 nt, Human
caaaaguaaauaaagcaa

SEQ ID NO: 460645 - RNA, 23 nt, Human
caaaauccaagauuacaaaagua

SEQ ID NO: 460646 - RNA, 22 nt, Human
caaacacacuugcaugcgcaug

SEQ ID NO: 460647 - RNA, 23 nt, Human
caacaaauguaaaaggaauaaaa

SEQ ID NO: 460648 - RNA, 24 nt, Human
caacaagcccacaucuacagggga

SEQ ID NO: 460649 - RNA, 21 nt, Human
cacaguaugacuuauacaaau

SEQ ID NO: 460650 - RNA, 18 nt, Human
cacccaccucaacaaucu

SEQ ID NO: 460651 - RNA, 21 nt, Human
cacuaaaccaguacaagccag

SEQ ID NO: 460652 - RNA, 19 nt, Human
cacuggacacugccaggga

SEQ ID NO: 460653 - RNA, 21 nt, Human
cagaaaagcugcccagaaaca

SEQ ID NO: 460654 - RNA, 23 nt, Human
caggaggcggccaaggaccacac

SEQ ID NO: 460655 - RNA, 21 nt, Human
cagguagagaggagacagcuc

SEQ ID NO: 460656 - RNA, 21 nt, Human
caucaaauaacguccaaaagg

SEQ ID NO: 460657 - RNA, 22 nt, Human
ccaaacacaaccacugucuacu

SEQ ID NO: 460658 - RNA, 22 nt, Human
ccagaaacacauggauacuuca

SEQ ID NO: 460659 - RNA, 24 nt, Human
ccagggacacaggcacuaaaccag

SEQ ID NO: 460660 - RNA, 18 nt, Human
ccccaucaugauuccugu

SEQ ID NO: 460661 - RNA, 25 nt, Human
cccgggcuaagagguuaacugaaac

SEQ ID NO: 460662 - RNA, 24 nt, Human
ccuguaaucuccccaauaagaaau

SEQ ID NO: 460663 - RNA, 20 nt, Human
cggcugaaggcaacaagccc

SEQ ID NO: 460664 - RNA, 21 nt, Human
cuagaucaccugaaaaugcua

SEQ ID NO: 460665 - RNA, 21 nt, Human
cugaaaccaacaaagcugaua

SEQ ID NO: 460666 - RNA, 18 nt, Human
cuugcagagcaggagcag

SEQ ID NO: 460667 - RNA, 20 nt, Human
cuuguuaucaauuuauuucu

SEQ ID NO: 460668 - RNA, 21 nt, Human
cuuuguuagaacaaugguuuc

SEQ ID NO: 460669 - RNA, 21 nt, Human
gaaaagaaaucugcuuguaga

SEQ ID NO: 460670 - RNA, 22 nt, Human
gaacuaguuuuauuugcauuua

SEQ ID NO: 460671 - RNA, 18 nt, Human
gaaggcaacaagcccaca

SEQ ID NO: 460672 - RNA, 18 nt, Human
gaaguaucuguauugaaa

SEQ ID NO: 460673 - RNA, 25 nt, Human
gagagggugguggaacgcuugggaa

SEQ ID NO: 460674 - RNA, 22 nt, Human
gccuugcuggggccagcaggag

SEQ ID NO: 460675 - RNA, 20 nt, Human
gcuacacugcaaagaugaca

SEQ ID NO: 460676 - RNA, 21 nt, Human
ggaaagcacauaaucucccca

SEQ ID NO: 460677 - RNA, 20 nt, Human
ggacacaggcacuaaaccag

SEQ ID NO: 460678 - RNA, 19 nt, Human
ggcaaggugaccuuuucac

SEQ ID NO: 460679 - RNA, 22 nt, Human
ggcacagugaauacgucagggc

SEQ ID NO: 460680 - RNA, 21 nt, Human
ggccagcaggaggaccauuac

SEQ ID NO: 460681 - RNA, 20 nt, Human
ggcugaaggcaacaagccca

SEQ ID NO: 460682 - RNA, 20 nt, Human
gggacacaggcacuaaacca

SEQ ID NO: 460683 - RNA, 20 nt, Human
gugcgcaggcacacacacac

SEQ ID NO: 460684 - RNA, 19 nt, Human
guggagagaagaguuuggc

SEQ ID NO: 460685 - RNA, 19 nt, Human
guuaacugaaaccaacaaa

SEQ ID NO: 460686 - RNA, 27 nt, Human
uaaaaaaaugaacaaagguaucucauu

SEQ ID NO: 460687 - RNA, 19 nt, Human
uaaaaaccacaaagccuua

SEQ ID NO: 460688 - RNA, 22 nt, Human
uaaaacgagagccaaacacaac

SEQ ID NO: 460689 - RNA, 24 nt, Human
uaaacaaaugcccccaguuccuua

SEQ ID NO: 460690 - RNA, 19 nt, Human
uaaagcaagcauauuagcc

SEQ ID NO: 460691 - RNA, 20 nt, Human
uaaauaaugcuguaagcuac

SEQ ID NO: 460692 - RNA, 19 nt, Human
uaaaucccagaagcaacaa

SEQ ID NO: 460693 - RNA, 21 nt, Human
uaacuccuggcuccagacaag

SEQ ID NO: 460694 - RNA, 23 nt, Human
uaagagguuaacugaaaccaaca

SEQ ID NO: 460695 - RNA, 24 nt, Human
uaauccaguguucuccucccucag

SEQ ID NO: 460696 - RNA, 21 nt, Human
uacaaaauccaagauuacaaa

SEQ ID NO: 460697 - RNA, 22 nt, Human
uacaauaacauucaacaugagg

SEQ ID NO: 460698 - RNA, 19 nt, Human
uacaaucaaaguggaucag

SEQ ID NO: 460699 - RNA, 22 nt, Human
uacagugugucucucuuuagag

SEQ ID NO: 460700 - RNA, 20 nt, Human
uacauuguucuauacacagg

SEQ ID NO: 460701 - RNA, 19 nt, Human
uacuagccagguagagagg

SEQ ID NO: 460702 - RNA, 18 nt, Human
uagaauaaaguugccugc

SEQ ID NO: 460703 - RNA, 20 nt, Human
uaugccaucaauuaaauuau

SEQ ID NO: 460704 - RNA, 20 nt, Human
ucaggcaaguuggaaccaga

SEQ ID NO: 460705 - RNA, 20 nt, Human
ucagggcagucacucauggg

SEQ ID NO: 460706 - RNA, 21 nt, Human
ucauggccuaaacaaaugccc

SEQ ID NO: 460707 - RNA, 21 nt, Human
uccaauaauccaguguucucc

SEQ ID NO: 460708 - RNA, 22 nt, Human
uccugagcuggcaaacacacuu

SEQ ID NO: 460709 - RNA, 21 nt, Human
ucuacugacaauaaaaucuaa

SEQ ID NO: 460710 - RNA, 21 nt, Human
ucuaguuuuaaaagcuacaaa

SEQ ID NO: 460711 - RNA, 18 nt, Human
ucuccucccucagggaag

SEQ ID NO: 460712 - RNA, 21 nt, Human
ucugaaguguuuaauaccuaa

SEQ ID NO: 460713 - RNA, 21 nt, Human
ugaacacacuggacacugcca

SEQ ID NO: 460714 - RNA, 20 nt, Human
ugaaggcaacaagcccacaa

SEQ ID NO: 460715 - RNA, 19 nt, Human
ugaauagaaacuggcuuua

SEQ ID NO: 460716 - RNA, 20 nt, Human
ugacagugagcguuagugaa

SEQ ID NO: 460717 - RNA, 21 nt, Human
ugagagggugguggaacgcuu

SEQ ID NO: 460718 - RNA, 20 nt, Human
ugaugcacaagugacuacag

SEQ ID NO: 460719 - RNA, 25 nt, Human
ugcaccugaagacuaucacacccac

SEQ ID NO: 460720 - RNA, 20 nt, Human
ugcacuguuacauuaaaaau

SEQ ID NO: 460721 - RNA, 18 nt, Human
ugccagggacacaggcac

SEQ ID NO: 460722 - RNA, 21 nt, Human
uggagagaagaguuuggcuuu

SEQ ID NO: 460723 - RNA, 23 nt, Human
ugggaaagcacauaaucucccca

SEQ ID NO: 460724 - RNA, 22 nt, Human
ugggugcgcaggcacacacaca

SEQ ID NO: 460725 - RNA, 19 nt, Human
uguacacugagguuuaucu

SEQ ID NO: 460726 - RNA, 22 nt, Human
uguuuugggggguaagaggagu

SEQ ID NO: 460727 - RNA, 24 nt, Human
uuagaacaaugguuucuaguuuua

SEQ ID NO: 460728 - RNA, 24 nt, Human
uuagguauaauaaaaugugucacu

SEQ ID NO: 460729 - RNA, 21 nt, Human
uuggaaccagaugugcacuuu

SEQ ID NO: 460730 - RNA, 22 nt, Human
uuucacacgacuuucaccagca

SEQ ID NO: 460731 - RNA, 21 nt, Human
uuugcagaugagcuaagcauc

SEQ ID NO: 460732 - RNA, 20 nt, Human
uuuguuagaacaaugguuuc

SEQ ID NO: 460733 - RNA, 22 nt, Human
caacccccacuuuuaggaugau

SEQ ID NO: 460734 - RNA, 23 nt, Human
caccagaguccuuugagacuggg

SEQ ID NO: 460735 - RNA, 21 nt, Human
cagaguccacaugucugccug

SEQ ID NO: 460736 - RNA, 24 nt, Human
caguaccuccccagaguccacaug

SEQ ID NO: 460737 - RNA, 22 nt, Human
ccccagaguccacaugucugcc

SEQ ID NO: 460738 - RNA, 22 nt, Human
ccccaguaccuccccagagucc

SEQ ID NO: 460739 - RNA, 18 nt, Human
ccugguuccagggagggg

SEQ ID NO: 460740 - RNA, 25 nt, Human
cuccucaggcaucugagaauuccag

SEQ ID NO: 460741 - RNA, 19 nt, Human
gagaaagcagggacaacgg

SEQ ID NO: 460742 - RNA, 20 nt, Human
gcagagagaaagcagggaca

SEQ ID NO: 460743 - RNA, 26 nt, Human
gcccccaguaccuccccagaguccac

SEQ ID NO: 460744 - RNA, 21 nt, Human
gccugggggaucauccuugag

SEQ ID NO: 460745 - RNA, 18 nt, Human
ggcagagagaaagcaggg

SEQ ID NO: 460746 - RNA, 20 nt, Human
ggcccccaguaccuccccag

SEQ ID NO: 460747 - RNA, 21 nt, Human
uaccuccccagaguccacaug

SEQ ID NO: 460748 - RNA, 22 nt, Human
ucaggcaucugagaauuccagu

SEQ ID NO: 460749 - RNA, 19 nt, Human
uccaagguccgccuggugg

SEQ ID NO: 460750 - RNA, 18 nt, Human
uccagggaggggagaauc

SEQ ID NO: 460751 - RNA, 19 nt, Human
uccuuugagacugggagcu

SEQ ID NO: 460752 - RNA, 18 nt, Human
ugggaaagaaggaugggc

SEQ ID NO: 460753 - RNA, 21 nt, Human
ugggcagagagaaagcaggga

SEQ ID NO: 460754 - RNA, 19 nt, Human
ugguguaaugacucuggga

SEQ ID NO: 460755 - RNA, 23 nt, Human
aaacagaaacaagcgaagucaag

SEQ ID NO: 460756 - RNA, 27 nt, Human
aaacagaaacaagcgaagucaagucua

SEQ ID NO: 460757 - RNA, 19 nt, Human
accaccccucuucccuggg

SEQ ID NO: 460758 - RNA, 24 nt, Human
accugagauuaggcgcacacacgc

SEQ ID NO: 460759 - RNA, 19 nt, Human
cagaaacaagcgaagucaa

SEQ ID NO: 460760 - RNA, 18 nt, Human
ccaaacagaaacaagcga

SEQ ID NO: 460761 - RNA, 21 nt, Human
cccaaacagaaacaagcgaag

SEQ ID NO: 460762 - RNA, 21 nt, Human
cggguggaccaccugagauua

SEQ ID NO: 460763 - RNA, 18 nt, Human
cugcagguaauaguuaua

SEQ ID NO: 460764 - RNA, 21 nt, Human
gaccaccugagauuaggcgca

SEQ ID NO: 460765 - RNA, 21 nt, Human
ggagcaagggucauuagugcu

SEQ ID NO: 460766 - RNA, 22 nt, Human
uccacaccuucuuguaaauuca

SEQ ID NO: 460767 - RNA, 20 nt, Human
uggaccaccugagauuaggc

SEQ ID NO: 460768 - RNA, 19 nt, Human
uuagauaccuacacauccu

SEQ ID NO: 460769 - RNA, 24 nt, Human
aauugccacccaacaggaagaaac

SEQ ID NO: 460770 - RNA, 18 nt, Human
acaaaaagaagaggacac

SEQ ID NO: 460771 - RNA, 22 nt, Human
acaaagaacagcugugcaaaca

SEQ ID NO: 460772 - RNA, 22 nt, Human
accacaaccccaugcuaaccug

SEQ ID NO: 460773 - RNA, 18 nt, Human
acccugaggagaggcagc

SEQ ID NO: 460774 - RNA, 22 nt, Human
accucacuucccuccaucauaa

SEQ ID NO: 460775 - RNA, 19 nt, Human
agaacagcugugcaaacaa

SEQ ID NO: 460776 - RNA, 20 nt, Human
agaauacgauggaaauggaa

SEQ ID NO: 460777 - RNA, 22 nt, Human
agagagaugcuauaacaaaaag

SEQ ID NO: 460778 - RNA, 24 nt, Human
agagagaugcuauaacaaaaagaa

SEQ ID NO: 460779 - RNA, 22 nt, Human
aggaagaaacagacuggguaaa

SEQ ID NO: 460780 - RNA, 22 nt, Human
aggcuauggaggagagggguua

SEQ ID NO: 460781 - RNA, 18 nt, Human
aggggacccugaggagag

SEQ ID NO: 460782 - RNA, 21 nt, Human
aggugcaauccccacccucuc

SEQ ID NO: 460783 - RNA, 22 nt, Human
agguguaagccuggagucuauu

SEQ ID NO: 460784 - RNA, 22 nt, Human
agguguguguaagggguuuggg

SEQ ID NO: 460785 - RNA, 22 nt, Human
auaacaaaaagaagaggacaac

SEQ ID NO: 460786 - RNA, 24 nt, Human
caaaaagaagaggacaacuggaaa

SEQ ID NO: 460787 - RNA, 23 nt, Human
caacaggaagaaacagacugggu

SEQ ID NO: 460788 - RNA, 24 nt, Human
cacaaccccaugcuaaccugaccc

SEQ ID NO: 460789 - RNA, 22 nt, Human
cacagcucagacccauagaagu

SEQ ID NO: 460790 - RNA, 19 nt, Human
caccccuccaucccccaaa

SEQ ID NO: 460791 - RNA, 20 nt, Human
caccccuccaucccccaaau

SEQ ID NO: 460792 - RNA, 19 nt, Human
cagcauguaggaaagcugg

SEQ ID NO: 460793 - RNA, 21 nt, Human
caggaagaaacagacugggua

SEQ ID NO: 460794 - RNA, 21 nt, Human
caggagcuucagccuggguga

SEQ ID NO: 460795 - RNA, 23 nt, Human
caggugcaaucaguccagcugca

SEQ ID NO: 460796 - RNA, 21 nt, Human
caugugccuggauucaccuca

SEQ ID NO: 460797 - RNA, 20 nt, Human
ccacaaccccaugcuaaccu

SEQ ID NO: 460798 - RNA, 19 nt, Human
ccacccuucuggagcagca

SEQ ID NO: 460799 - RNA, 18 nt, Human
ccaggcaagggagaaaca

SEQ ID NO: 460800 - RNA, 19 nt, Human
ccccaugcuaaccugaccc

SEQ ID NO: 460801 - RNA, 20 nt, Human
ccuccaaguuccuuuauggg

SEQ ID NO: 460802 - RNA, 23 nt, Human
ccuccaucauaauauucccucca

SEQ ID NO: 460803 - RNA, 21 nt, Human
ccuuugaguuugcuccaagua

SEQ ID NO: 460804 - RNA, 19 nt, Human
cucccacccuucuggagca

SEQ ID NO: 460805 - RNA, 18 nt, Human
gacuggguaaagcuagca

SEQ ID NO: 460806 - RNA, 21 nt, Human
gagaauacgauggaaauggaa

SEQ ID NO: 460807 - RNA, 24 nt, Human
gaggugacauaagguugagauggu

SEQ ID NO: 460808 - RNA, 19 nt, Human
ggaagaaacagacugggua

SEQ ID NO: 460809 - RNA, 22 nt, Human
ggaaggugcaauccccacccuc

SEQ ID NO: 460810 - RNA, 23 nt, Human
ggagcagcaagauaacugaugug

SEQ ID NO: 460811 - RNA, 19 nt, Human
ggcuauggaggagaggggu

SEQ ID NO: 460812 - RNA, 21 nt, Human
gguaaagacgaugagcaacau

SEQ ID NO: 460813 - RNA, 21 nt, Human
gguacagaaacagauuuggaa

SEQ ID NO: 460814 - RNA, 23 nt, Human
gucaccccuccaucccccaaaua

SEQ ID NO: 460815 - RNA, 19 nt, Human
gugagucccucaggagcuu

SEQ ID NO: 460816 - RNA, 23 nt, Human
uaaagccuguuuuuccacauacc

SEQ ID NO: 460817 - RNA, 19 nt, Human
uaacaaaaagaagaggaca

SEQ ID NO: 460818 - RNA, 25 nt, Human
uacaaagaacagcugugcaaacaac

SEQ ID NO: 460819 - RNA, 21 nt, Human
uagcagcagcaauguaaccuu

SEQ ID NO: 460820 - RNA, 22 nt, Human
uagucuuaagggauuaggagaa

SEQ ID NO: 460821 - RNA, 26 nt, Human
uauuucaaccacaaccccaugcuaac

SEQ ID NO: 460822 - RNA, 19 nt, Human
ucaaaaauucucuccucua

SEQ ID NO: 460823 - RNA, 24 nt, Human
ucagacccauagaaguggggccag

SEQ ID NO: 460824 - RNA, 22 nt, Human
ucaggagcuucagccuggguga

SEQ ID NO: 460825 - RNA, 19 nt, Human
ucccucaggagcuucagcc

SEQ ID NO: 460826 - RNA, 20 nt, Human
ucccucaggagcuucagccu

SEQ ID NO: 460827 - RNA, 19 nt, Human
uccuggauaccaagauauu

SEQ ID NO: 460828 - RNA, 22 nt, Human
ugacccaaucucgaucccuaau

SEQ ID NO: 460829 - RNA, 24 nt, Human
ugagccagguguucaucaugugcc

SEQ ID NO: 460830 - RNA, 19 nt, Human
ugcaaucaguccagcugca

SEQ ID NO: 460831 - RNA, 21 nt, Human
uggaaacuggagaauacgaug

SEQ ID NO: 460832 - RNA, 24 nt, Human
uggaaggugcaauccccacccucu

SEQ ID NO: 460833 - RNA, 21 nt, Human
uggaagguguaagccuggagu

SEQ ID NO: 460834 - RNA, 23 nt, Human
ugggauuucagccugagauuguc

SEQ ID NO: 460835 - RNA, 24 nt, Human
aaagaggcagcuggaagauguucu

SEQ ID NO: 460836 - RNA, 22 nt, Human
aaaugccauaaauaccaacaaa

SEQ ID NO: 460837 - RNA, 19 nt, Human
aagaagggccucacaggca

SEQ ID NO: 460838 - RNA, 24 nt, Human
aagcaaaggaacuacuaaaaacac

SEQ ID NO: 460839 - RNA, 22 nt, Human
aauguuguaaauguauguaugu

SEQ ID NO: 460840 - RNA, 25 nt, Human
aauguuguaaauguauguauguaau

SEQ ID NO: 460841 - RNA, 22 nt, Human
acaggcacggaaaaggcugaac

SEQ ID NO: 460842 - RNA, 22 nt, Human
acuagacgcaaaccuucccaaa

SEQ ID NO: 460843 - RNA, 19 nt, Human
agagcaggcagggacagga

SEQ ID NO: 460844 - RNA, 22 nt, Human
agcucucugguuccacuuccuc

SEQ ID NO: 460845 - RNA, 18 nt, Human
aggcagggacaggaggcc

SEQ ID NO: 460846 - RNA, 21 nt, Human
aguggccacuuccaugaaggc

SEQ ID NO: 460847 - RNA, 22 nt, Human
augaagauggggcuguccucac

SEQ ID NO: 460848 - RNA, 21 nt, Human
caagauaucaugaaaccagga

SEQ ID NO: 460849 - RNA, 22 nt, Human
caaguccauaucuucuggugcc

SEQ ID NO: 460850 - RNA, 21 nt, Human
cacaccccaaccugaagaagg

SEQ ID NO: 460851 - RNA, 21 nt, Human
cacccagagcaggcagggaca

SEQ ID NO: 460852 - RNA, 25 nt, Human
caccccaaccugaagaagggccuca

SEQ ID NO: 460853 - RNA, 23 nt, Human
caccgugaccccauuggcuccug

SEQ ID NO: 460854 - RNA, 23 nt, Human
cacucaaucacguuuuccaccuc

SEQ ID NO: 460855 - RNA, 21 nt, Human
cacuucugucucuccagagag

SEQ ID NO: 460856 - RNA, 21 nt, Human
cacuuucuucuuggcugggag

SEQ ID NO: 460857 - RNA, 18 nt, Human
cagaagccauucugagga

SEQ ID NO: 460858 - RNA, 21 nt, Human
caggaagacgcccacccggca

SEQ ID NO: 460859 - RNA, 19 nt, Human
caggaccacaucaacugca

SEQ ID NO: 460860 - RNA, 21 nt, Human
caggaccucaaauuucagcca

SEQ ID NO: 460861 - RNA, 22 nt, Human
cauaaauaccaacaaauauuaa

SEQ ID NO: 460862 - RNA, 25 nt, Human
caucuccagcuucauaguccaggaa

SEQ ID NO: 460863 - RNA, 21 nt, Human
caucuucaucccagguccagg

SEQ ID NO: 460864 - RNA, 20 nt, Human
ccaaccugaagaagggccuc

SEQ ID NO: 460865 - RNA, 22 nt, Human
ccacaguccacucaaucacguu

SEQ ID NO: 460866 - RNA, 22 nt, Human
ccacuuccucuaucucugaucu

SEQ ID NO: 460867 - RNA, 22 nt, Human
ccagagcaggcagggacaggag

SEQ ID NO: 460868 - RNA, 19 nt, Human
ccagucgucccucuucucu

SEQ ID NO: 460869 - RNA, 21 nt, Human
ccagucgucccucuucucucc

SEQ ID NO: 460870 - RNA, 23 nt, Human
cccauaguuacaagcaaaggaac

SEQ ID NO: 460871 - RNA, 23 nt, Human
cccuguaggccucauuccaaguc

SEQ ID NO: 460872 - RNA, 21 nt, Human
ccucacaccccaaccugaaga

SEQ ID NO: 460873 - RNA, 26 nt, Human
ccucacaccccaaccugaagaagggc

SEQ ID NO: 460874 - RNA, 27 nt, Human
ccuccccuuuccucucaacacugucuc

SEQ ID NO: 460875 - RNA, 19 nt, Human
ccucucuccucuuacaucc

SEQ ID NO: 460876 - RNA, 22 nt, Human
cggaaaaggcugaacggggaca

SEQ ID NO: 460877 - RNA, 24 nt, Human
cucaaucacguuuuccaccuccac

SEQ ID NO: 460878 - RNA, 22 nt, Human
cucacacuucuccgguccucug

SEQ ID NO: 460879 - RNA, 18 nt, Human
cucccagguccccuuagc

SEQ ID NO: 460880 - RNA, 22 nt, Human
cugguccauuacuccuuggcuc

SEQ ID NO: 460881 - RNA, 19 nt, Human
cuucauucaucuucauccc

SEQ ID NO: 460882 - RNA, 24 nt, Human
cuucucacacuucuccgguccucu

SEQ ID NO: 460883 - RNA, 23 nt, Human
gaagcucucccggccuaggacac

SEQ ID NO: 460884 - RNA, 23 nt, Human
gaccuccccuuuccucucaacac

SEQ ID NO: 460885 - RNA, 22 nt, Human
gauucuauaggcucuggugggu

SEQ ID NO: 460886 - RNA, 19 nt, Human
ggaaaaggcugaacgggga

SEQ ID NO: 460887 - RNA, 20 nt, Human
ggaaauccuggggcugggug

SEQ ID NO: 460888 - RNA, 23 nt, Human
ggaauccuccaucauuuguaagg

SEQ ID NO: 460889 - RNA, 18 nt, Human
ggccuggggucucaggaa

SEQ ID NO: 460890 - RNA, 18 nt, Human
ggcuugucuacauggcug

SEQ ID NO: 460891 - RNA, 22 nt, Human
gggcugaggucuguagugggug

SEQ ID NO: 460892 - RNA, 22 nt, Human
ggggcacaggcacuacuagacg

SEQ ID NO: 460893 - RNA, 21 nt, Human
gguuccugauccccagagagg

SEQ ID NO: 460894 - RNA, 18 nt, Human
guccuguggauuccucuc

SEQ ID NO: 460895 - RNA, 20 nt, Human
gucucagguuuaggccuggg

SEQ ID NO: 460896 - RNA, 19 nt, Human
gugcgcucuggaaauccug

SEQ ID NO: 460897 - RNA, 20 nt, Human
gugguuccugauccccagag

SEQ ID NO: 460898 - RNA, 19 nt, Human
gugugaccagaggggagga

SEQ ID NO: 460899 - RNA, 19 nt, Human
guuauggugggacuuagcc

SEQ ID NO: 460900 - RNA, 18 nt, Human
guugucaggcacgcucuc

SEQ ID NO: 460901 - RNA, 21 nt, Human
uacagacccccacaguccacu

SEQ ID NO: 460902 - RNA, 21 nt, Human
uagaugugcgaucugucccuc

SEQ ID NO: 460903 - RNA, 21 nt, Human
uagccacccuuacaaccuugg

SEQ ID NO: 460904 - RNA, 22 nt, Human
uagccacccuuacaaccuuggu

SEQ ID NO: 460905 - RNA, 22 nt, Human
uaggccuggggucucaggaacc

SEQ ID NO: 460906 - RNA, 24 nt, Human
uauaaauuaauaaauguuguaaau

SEQ ID NO: 460907 - RNA, 20 nt, Human
uauauuaaccuauaauuggc

SEQ ID NO: 460908 - RNA, 21 nt, Human
uaucaggggaggacacggccc

SEQ ID NO: 460909 - RNA, 18 nt, Human
ucaaucacguuuuccacc

SEQ ID NO: 460910 - RNA, 20 nt, Human
ucaggcccucuucaggcacc

SEQ ID NO: 460911 - RNA, 20 nt, Human
ucaggcccucuucaggcacc

SEQ ID NO: 460912 - RNA, 21 nt, Human
uccaugaaggcucucugaucc

SEQ ID NO: 460913 - RNA, 18 nt, Human
uccauuacuccuuggcuc

SEQ ID NO: 460914 - RNA, 18 nt, Human
ucccaguaauguuucccu

SEQ ID NO: 460915 - RNA, 19 nt, Human
uccccuuuccucucaacac

SEQ ID NO: 460916 - RNA, 21 nt, Human
ucccugaagcgaagcucuccc

SEQ ID NO: 460917 - RNA, 22 nt, Human
ucucaaaugccauaaauaccaa

SEQ ID NO: 460918 - RNA, 19 nt, Human
ucucacacuuucuucuugg

SEQ ID NO: 460919 - RNA, 22 nt, Human
ucuccagagacagaagcaguuc

SEQ ID NO: 460920 - RNA, 22 nt, Human
ucucccagguccccuuagcugu

SEQ ID NO: 460921 - RNA, 21 nt, Human
ucucuggguugucaggcacgc

SEQ ID NO: 460922 - RNA, 18 nt, Human
ucugaggaaucagcagga

SEQ ID NO: 460923 - RNA, 18 nt, Human
ucugguucccucuccucu

SEQ ID NO: 460924 - RNA, 20 nt, Human
ucugucucuccagagacaga

SEQ ID NO: 460925 - RNA, 23 nt, Human
ugaaaccaggaaguuugaagcug

SEQ ID NO: 460926 - RNA, 27 nt, Human
ugaaagaggcagcuggaagauguucuc

SEQ ID NO: 460927 - RNA, 21 nt, Human
ugaagggauccccacguagug

SEQ ID NO: 460928 - RNA, 22 nt, Human
ugaagugucaggcccucuucag

SEQ ID NO: 460929 - RNA, 22 nt, Human
ugaggaggagaaaacuggggcu

SEQ ID NO: 460930 - RNA, 23 nt, Human
ugaucugcauaucugguucccuc

SEQ ID NO: 460931 - RNA, 23 nt, Human
ugccaacuggaauacugggcuua

SEQ ID NO: 460932 - RNA, 24 nt, Human
ugcccuuuaugcaucuccaagguc

SEQ ID NO: 460933 - RNA, 21 nt, Human
uggaaaugagccaucaucucc

SEQ ID NO: 460934 - RNA, 18 nt, Human
uggaauacugggcuuaau

SEQ ID NO: 460935 - RNA, 22 nt, Human
ugggagcuguguaacaacuagu

SEQ ID NO: 460936 - RNA, 19 nt, Human
uggugccaacuggaauacu

SEQ ID NO: 460937 - RNA, 20 nt, Human
uguagaaggagacaucucca

SEQ ID NO: 460938 - RNA, 23 nt, Human
uguagaugugcgaucugucccuc

SEQ ID NO: 460939 - RNA, 23 nt, Human
uuaacccaaauaaacaaaaacuc

SEQ ID NO: 460940 - RNA, 20 nt, Human
uuacaagcaaaggaacuacu

SEQ ID NO: 460941 - RNA, 21 nt, Human
uuaggccuggggucucaggaa

SEQ ID NO: 460942 - RNA, 23 nt, Human
uucaugcuauuuuaauauaaauu

SEQ ID NO: 460943 - RNA, 21 nt, Human
uucccaaaagaggagaaaaaa

SEQ ID NO: 460944 - RNA, 21 nt, Human
uucccuaugccuggaucccau

SEQ ID NO: 460945 - RNA, 22 nt, Human
uucugaggaaucagcaggaccu

SEQ ID NO: 460946 - RNA, 21 nt, Human
uugcuuuuucuuuucuccgcu

SEQ ID NO: 460947 - RNA, 18 nt, Human
uuggcuccugugagugca

SEQ ID NO: 460948 - RNA, 21 nt, Human
aaaggaacuacuaaagccaca

SEQ ID NO: 460949 - RNA, 21 nt, Human
aaaguuuuuuugagcuaacau

SEQ ID NO: 460950 - RNA, 25 nt, Human
aacacacucacagacacacccagaa

SEQ ID NO: 460951 - RNA, 21 nt, Human
aagucugaaagccucagaacc

SEQ ID NO: 460952 - RNA, 21 nt, Human
aaguucaaaggccggagagcc

SEQ ID NO: 460953 - RNA, 21 nt, Human
acaguagguucacugcccaac

SEQ ID NO: 460954 - RNA, 21 nt, Human
acauuaaucguuuuucaucuc

SEQ ID NO: 460955 - RNA, 21 nt, Human
accaggaccucaaaccucaac

SEQ ID NO: 460956 - RNA, 18 nt, Human
accagugucacacuuuuu

SEQ ID NO: 460957 - RNA, 21 nt, Human
agagaauuucccacugacuca

SEQ ID NO: 460958 - RNA, 22 nt, Human
agcucucugguuccacuuccuc

SEQ ID NO: 460959 - RNA, 18 nt, Human
aggaccucaaaccucaac

SEQ ID NO: 460960 - RNA, 22 nt, Human
aggcagauaugauaauacaaau

SEQ ID NO: 460961 - RNA, 23 nt, Human
aguccaaagccaaaggccugaga

SEQ ID NO: 460962 - RNA, 22 nt, Human
auugggcacccagccaacagaa

SEQ ID NO: 460963 - RNA, 24 nt, Human
caaguccugaaguucaaaggccgg

SEQ ID NO: 460964 - RNA, 24 nt, Human
cacacucacagacacacccagaaa

SEQ ID NO: 460965 - RNA, 21 nt, Human
cagaaggagagaauuucccac

SEQ ID NO: 460966 - RNA, 19 nt, Human
cagcuucucucacuuucuu

SEQ ID NO: 460967 - RNA, 20 nt, Human
caguccaaagccaaaggccu

SEQ ID NO: 460968 - RNA, 19 nt, Human
cauaaauauuaacccaaau

SEQ ID NO: 460969 - RNA, 19 nt, Human
caucugagccaaaccacau

SEQ ID NO: 460970 - RNA, 21 nt, Human
caucuucaucccagguccagg

SEQ ID NO: 460971 - RNA, 22 nt, Human
cauugaaccugaaugcugacgu

SEQ ID NO: 460972 - RNA, 23 nt, Human
ccaaaccacauccacaugagucc

SEQ ID NO: 460973 - RNA, 24 nt, Human
ccaaagccaaaggccugagaaccc

SEQ ID NO: 460974 - RNA, 27 nt, Human
ccaaauaaacaaaagcucuuuaaaguc

SEQ ID NO: 460975 - RNA, 19 nt, Human
ccacauccacaugagucca

SEQ ID NO: 460976 - RNA, 18 nt, Human
ccacaugaguccauguuc

SEQ ID NO: 460977 - RNA, 22 nt, Human
ccacuuccucuaucucugaucu

SEQ ID NO: 460978 - RNA, 25 nt, Human
ccagagagacaaaaucaauaugaua

SEQ ID NO: 460979 - RNA, 21 nt, Human
ccagggcaggcagagaccaga

SEQ ID NO: 460980 - RNA, 19 nt, Human
ccagucagguugacaucua

SEQ ID NO: 460981 - RNA, 22 nt, Human
ccagucagguugacaucuaaaa

SEQ ID NO: 460982 - RNA, 19 nt, Human
cccagaaauaauguuguac

SEQ ID NO: 460983 - RNA, 23 nt, Human
cccauaauuacaagcaaaggaac

SEQ ID NO: 460984 - RNA, 21 nt, Human
cccucucccuucugguggucc

SEQ ID NO: 460985 - RNA, 21 nt, Human
ccugguacaaguccugaaguu

SEQ ID NO: 460986 - RNA, 18 nt, Human
ccuggugaacccuguugg

SEQ ID NO: 460987 - RNA, 19 nt, Human
cuaaagccacagacuagug

SEQ ID NO: 460988 - RNA, 20 nt, Human
cucacagacacacccagaaa

SEQ ID NO: 460989 - RNA, 23 nt, Human
cucacuugccaaucucuucugga

SEQ ID NO: 460990 - RNA, 20 nt, Human
cucgguaucugggaccuguu

SEQ ID NO: 460991 - RNA, 22 nt, Human
cugauuuuaaacaguagguuca

SEQ ID NO: 460992 - RNA, 19 nt, Human
cugcccugcucgaccagga

SEQ ID NO: 460993 - RNA, 21 nt, Human
cuggcauauugggcuuaaugu

SEQ ID NO: 460994 - RNA, 22 nt, Human
cugguccaguacugcccugcuc

SEQ ID NO: 460995 - RNA, 23 nt, Human
cuggugccaacuggcauauuggg

SEQ ID NO: 460996 - RNA, 24 nt, Human
cuuauggugggacuuagccauccu

SEQ ID NO: 460997 - RNA, 19 nt, Human
cuucauucaucuucauccc

SEQ ID NO: 460998 - RNA, 20 nt, Human
cuuuccucugccuuuuuguu

SEQ ID NO: 460999 - RNA, 20 nt, Human
gagaaaacuggggcagaggg

SEQ ID NO: 461000 - RNA, 21 nt, Human
gagaagaauuugccuuuccuc

SEQ ID NO: 461001 - RNA, 28 nt, Human
gaggaggagaaaacuggggcagagggcu

SEQ ID NO: 461002 - RNA, 21 nt, Human
gagugggugugaaaaaggcag

SEQ ID NO: 461003 - RNA, 26 nt, Human
gauugcuuuuucacaaaacauccuau

SEQ ID NO: 461004 - RNA, 18 nt, Human
gcagaagaagaagagugu

SEQ ID NO: 461005 - RNA, 18 nt, Human
gcucaucuguaggcugga

SEQ ID NO: 461006 - RNA, 20 nt, Human
gcuguggaaauccugggguu

SEQ ID NO: 461007 - RNA, 20 nt, Human
ggaaauccugggguugggug

SEQ ID NO: 461008 - RNA, 24 nt, Human
gggcacccagccaacagaaggaga

SEQ ID NO: 461009 - RNA, 19 nt, Human
gggcgugucuuucauuagg

SEQ ID NO: 461010 - RNA, 20 nt, Human
gguugugcgguggcugcuga

SEQ ID NO: 461011 - RNA, 18 nt, Human
guccuguggauuccucuc

SEQ ID NO: 461012 - RNA, 21 nt, Human
gugugcuguggaaauccuggg

SEQ ID NO: 461013 - RNA, 24 nt, Human
guucacugcccaacagcuucucuc

SEQ ID NO: 461014 - RNA, 19 nt, Human
uaaaguccucaauaacuuc

SEQ ID NO: 461015 - RNA, 21 nt, Human
uaaccagugucacacuuuuug

SEQ ID NO: 461016 - RNA, 22 nt, Human
uaacuuccaggauccacuauuc

SEQ ID NO: 461017 - RNA, 19 nt, Human
uacaaaggcagauaugaua

SEQ ID NO: 461018 - RNA, 18 nt, Human
uagaucaggaaguuugaa

SEQ ID NO: 461019 - RNA, 22 nt, Human
uagccauccuuacaaccuuggu

SEQ ID NO: 461020 - RNA, 21 nt, Human
uagugaggaggagaaaacugg

SEQ ID NO: 461021 - RNA, 18 nt, Human
uauugcagggacaucuga

SEQ ID NO: 461022 - RNA, 22 nt, Human
uccaaagccaaaggccugagaa

SEQ ID NO: 461023 - RNA, 24 nt, Human
uccaaagccaaaggccugagaacc

SEQ ID NO: 461024 - RNA, 23 nt, Human
uccagaggagagaagaauuugcc

SEQ ID NO: 461025 - RNA, 19 nt, Human
uccucucuccucucucauc

SEQ ID NO: 461026 - RNA, 22 nt, Human
ucuacauuaaccuauaacugau

SEQ ID NO: 461027 - RNA, 19 nt, Human
ucuagguauuccuuaaucc

SEQ ID NO: 461028 - RNA, 21 nt, Human
ucuaugagcaggcauuuauua

SEQ ID NO: 461029 - RNA, 18 nt, Human
ucuccagagagacaaaau

SEQ ID NO: 461030 - RNA, 18 nt, Human
ucugguucccucucccuu

SEQ ID NO: 461031 - RNA, 20 nt, Human
ucuucuggaaacacacucac

SEQ ID NO: 461032 - RNA, 18 nt, Human
ugaaaaaggcagcuggaa

SEQ ID NO: 461033 - RNA, 23 nt, Human
ugaucugcauaucugguucccuc

SEQ ID NO: 461034 - RNA, 23 nt, Human
ugcccugcucgaccaggaccuca

SEQ ID NO: 461035 - RNA, 19 nt, Human
ugcuguggaaauccugggg

SEQ ID NO: 461036 - RNA, 19 nt, Human
uggaaaaaguuaaccagug

SEQ ID NO: 461037 - RNA, 21 nt, Human
uggaaaugagccaucaucucc

SEQ ID NO: 461038 - RNA, 21 nt, Human
uggagacccugggaugcuggu

SEQ ID NO: 461039 - RNA, 24 nt, Human
uggauuccucucuccucucucauc

SEQ ID NO: 461040 - RNA, 20 nt, Human
ugggguuggguggaaaugag

SEQ ID NO: 461041 - RNA, 20 nt, Human
uggugggacuuagccauccu

SEQ ID NO: 461042 - RNA, 18 nt, Human
ugucucagcuccagagga

SEQ ID NO: 461043 - RNA, 21 nt, Human
ugugcaguaaaguuuuuuuga

SEQ ID NO: 461044 - RNA, 20 nt, Human
ugugcuguggaaauccuggg

SEQ ID NO: 461045 - RNA, 23 nt, Human
ugugguuuugggauuccuagaga

SEQ ID NO: 461046 - RNA, 18 nt, Human
uguuguauugggcaccca

SEQ ID NO: 461047 - RNA, 23 nt, Human
uuaacccaaauaaacaaaagcuc

SEQ ID NO: 461048 - RNA, 23 nt, Human
uuaaugcuauuuuaacauaaauu

SEQ ID NO: 461049 - RNA, 20 nt, Human
uuacaagcaaaggaacuacu

SEQ ID NO: 461050 - RNA, 19 nt, Human
uuagaucaggaaguuugaa

SEQ ID NO: 461051 - RNA, 25 nt, Human
uuagaucaggaaguuugaagccacu

SEQ ID NO: 461052 - RNA, 18 nt, Human
uuagccauccuuacaacc

SEQ ID NO: 461053 - RNA, 22 nt, Human
uuaucugcauggcugugagucc

SEQ ID NO: 461054 - RNA, 18 nt, Human
uucaaaggccggagagcc

SEQ ID NO: 461055 - RNA, 20 nt, Human
uucacugcccaacagcuucu

SEQ ID NO: 461056 - RNA, 21 nt, Human
uucauuagggggguugugcgg

SEQ ID NO: 461057 - RNA, 21 nt, Human
uucccuaugccuggaucccau

SEQ ID NO: 461058 - RNA, 19 nt, Human
uuccuagagagaacucuga

SEQ ID NO: 461059 - RNA, 22 nt, Human
uuggccucauuccaaguccaca

SEQ ID NO: 461060 - RNA, 20 nt, Human
uuguuuuuuuuauuuggacc

SEQ ID NO: 461061 - RNA, 19 nt, Human
uuuaaaguccucaauaacu

SEQ ID NO: 461062 - RNA, 19 nt, Human
uuuuguuucaaugucaaau

SEQ ID NO: 461063 - RNA, 22 nt, Human
uuuuuuuuuuuuagaugccuca

SEQ ID NO: 461064 - RNA, 18 nt, Human
aaaaaaaaaaaaucccug

SEQ ID NO: 461065 - RNA, 18 nt, Human
aaaagaacggccauaggg

SEQ ID NO: 461066 - RNA, 25 nt, Human
aaauaucccuguaagccggucaccc

SEQ ID NO: 461067 - RNA, 26 nt, Human
aaaucaccucuuagcauuccccucug

SEQ ID NO: 461068 - RNA, 20 nt, Human
aacagaguaagacuccaucu

SEQ ID NO: 461069 - RNA, 22 nt, Human
aacaggggugucaacuccacaa

SEQ ID NO: 461070 - RNA, 20 nt, Human
aacauagugaacccucaucu

SEQ ID NO: 461071 - RNA, 22 nt, Human
aacuagucaugucuacuuugua

SEQ ID NO: 461072 - RNA, 23 nt, Human
aagaaacaggguggaaaagaacg

SEQ ID NO: 461073 - RNA, 21 nt, Human
aagcagagaaaaguuacuuca

SEQ ID NO: 461074 - RNA, 20 nt, Human
aaggaaaaacccacgcgucc

SEQ ID NO: 461075 - RNA, 23 nt, Human
aaucagcugggaaggagucaaca

SEQ ID NO: 461076 - RNA, 24 nt, Human
aauuguuugaacccaggaggugga

SEQ ID NO: 461077 - RNA, 24 nt, Human
acagaguaagacuccaucuuaaaa

SEQ ID NO: 461078 - RNA, 23 nt, Human
acauagugaacccucaucuguac

SEQ ID NO: 461079 - RNA, 21 nt, Human
accaaacucaaacaacuguca

SEQ ID NO: 461080 - RNA, 19 nt, Human
accucuuagcauuccccuc

SEQ ID NO: 461081 - RNA, 24 nt, Human
acuccacaaccaccuacagugauc

SEQ ID NO: 461082 - RNA, 23 nt, Human
acugcacuccagccuagcaacag

SEQ ID NO: 461083 - RNA, 23 nt, Human
acugcacuccagccuagcaacag

SEQ ID NO: 461084 - RNA, 22 nt, Human
agaauuguuugaacccaggagg

SEQ ID NO: 461085 - RNA, 20 nt, Human
agaccgagguggguggauca

SEQ ID NO: 461086 - RNA, 24 nt, Human
agcacuuugggagaccgagguggg

SEQ ID NO: 461087 - RNA, 23 nt, Human
agccuguaaucccagcacuuugg

SEQ ID NO: 461088 - RNA, 19 nt, Human
aggaaggcuggcucuggcu

SEQ ID NO: 461089 - RNA, 23 nt, Human
aggcaggagaauuguuugaaccc

SEQ ID NO: 461090 - RNA, 24 nt, Human
aggcaggagaauuguuugaaccca

SEQ ID NO: 461091 - RNA, 21 nt, Human
aggcugaggcaggagaauugu

SEQ ID NO: 461092 - RNA, 24 nt, Human
aggcugaggcaggagaauuguuug

SEQ ID NO: 461093 - RNA, 20 nt, Human
agguggagguugcagggagc

SEQ ID NO: 461094 - RNA, 24 nt, Human
agguggagguugcagggagcugag

SEQ ID NO: 461095 - RNA, 20 nt, Human
agguggggggcagacacuau

SEQ ID NO: 461096 - RNA, 24 nt, Human
agguggguggaucaugaggucaag

SEQ ID NO: 461097 - RNA, 20 nt, Human
aucgcaccacugcacuccag

SEQ ID NO: 461098 - RNA, 21 nt, Human
auucacuuuucugcaccccag

SEQ ID NO: 461099 - RNA, 21 nt, Human
auuuguuggguggaacacauc

SEQ ID NO: 461100 - RNA, 18 nt, Human
caaagcuaauccaaggcg

SEQ ID NO: 461101 - RNA, 22 nt, Human
caaagcucauaacacagcacuc

SEQ ID NO: 461102 - RNA, 20 nt, Human
caaccaccuacagugauccu

SEQ ID NO: 461103 - RNA, 21 nt, Human
caagacacucugcaaagcuaa

SEQ ID NO: 461104 - RNA, 24 nt, Human
caagccuguaaucccagcacuuug

SEQ ID NO: 461105 - RNA, 22 nt, Human
caauaauaaugaugauaaugag

SEQ ID NO: 461106 - RNA, 25 nt, Human
caccacugcacuccagccuagcaac

SEQ ID NO: 461107 - RNA, 22 nt, Human
cacuccagccuagcaacagagu

SEQ ID NO: 461108 - RNA, 18 nt, Human
cacugcacuccagccuag

SEQ ID NO: 461109 - RNA, 20 nt, Human
cacugcacuccagccuagca

SEQ ID NO: 461110 - RNA, 21 nt, Human
cacugcacuccagccuagcaa

SEQ ID NO: 461111 - RNA, 24 nt, Human
cacugcacuccagccuagcaacag

SEQ ID NO: 461112 - RNA, 21 nt, Human
cagcacuuugggagaccgagg

SEQ ID NO: 461113 - RNA, 24 nt, Human
cagcacuuugggagaccgaggugg

SEQ ID NO: 461114 - RNA, 23 nt, Human
caguacucgggaggcugaggcag

SEQ ID NO: 461115 - RNA, 20 nt, Human
ccaaacucaaacaacuguca

SEQ ID NO: 461116 - RNA, 21 nt, Human
ccaagacacucugcaaagcua

SEQ ID NO: 461117 - RNA, 22 nt, Human
ccaagacacucugcaaagcuaa

SEQ ID NO: 461118 - RNA, 19 nt, Human
ccacugcacuccagccuag

SEQ ID NO: 461119 - RNA, 19 nt, Human
ccacugcacuccagccuag

SEQ ID NO: 461120 - RNA, 20 nt, Human
ccacugcacuccagccuagc

SEQ ID NO: 461121 - RNA, 23 nt, Human
ccacugcacuccagccuagcaac

SEQ ID NO: 461122 - RNA, 21 nt, Human
cccaggagguggagguugcag

SEQ ID NO: 461123 - RNA, 21 nt, Human
ccuagcaacagaguaagacuc

SEQ ID NO: 461124 - RNA, 21 nt, Human
ccucuuagcauuccccucuga

SEQ ID NO: 461125 - RNA, 19 nt, Human
ccuggccaacauagugaac

SEQ ID NO: 461126 - RNA, 22 nt, Human
ccuggccaacauagugaacccu

SEQ ID NO: 461127 - RNA, 24 nt, Human
ccuggccaacauagugaacccuca

SEQ ID NO: 461128 - RNA, 22 nt, Human
ccuguaaucccagcacuuuggg

SEQ ID NO: 461129 - RNA, 24 nt, Human
cgagaccauccuggccaacauagu

SEQ ID NO: 461130 - RNA, 22 nt, Human
cgagguggguggaucaugaggu

SEQ ID NO: 461131 - RNA, 24 nt, Human
cgagguggguggaucaugagguca

SEQ ID NO: 461132 - RNA, 21 nt, Human
cgcaccacugcacuccagccu

SEQ ID NO: 461133 - RNA, 24 nt, Human
cucaagccuguaaucccagcacuu

SEQ ID NO: 461134 - RNA, 21 nt, Human
cucaaguauggugaccgaaga

SEQ ID NO: 461135 - RNA, 24 nt, Human
cugcaaagcuaauccaaggcgugc

SEQ ID NO: 461136 - RNA, 25 nt, Human
cuuaaaaaaaaaaaaaaaucccugu

SEQ ID NO: 461137 - RNA, 22 nt, Human
cuuaucacauuuguugggugga

SEQ ID NO: 461138 - RNA, 23 nt, Human
cuuuaugguugugauugguugcu

SEQ ID NO: 461139 - RNA, 27 nt, Human
cuuugagucccaacauugaaaaucacc

SEQ ID NO: 461140 - RNA, 18 nt, Human
gaaaaucucuaggguauu

SEQ ID NO: 461141 - RNA, 23 nt, Human
gagaucgcaccacugcacuccag

SEQ ID NO: 461142 - RNA, 22 nt, Human
gagcauuuuaaguucuccauua

SEQ ID NO: 461143 - RNA, 18 nt, Human
gagcugggcagggagaag

SEQ ID NO: 461144 - RNA, 23 nt, Human
gagguggguggaucaugagguca

SEQ ID NO: 461145 - RNA, 23 nt, Human
gagguugcagggagcugagaucg

SEQ ID NO: 461146 - RNA, 20 nt, Human
gcaccacugcacuccagccu

SEQ ID NO: 461147 - RNA, 23 nt, Human
gcacuccagccuagcaacagagu

SEQ ID NO: 461148 - RNA, 22 nt, Human
gcaggagaauuguuugaaccca

SEQ ID NO: 461149 - RNA, 19 nt, Human
gcugagaucgcaccacugc

SEQ ID NO: 461150 - RNA, 21 nt, Human
gcugggcagggagaagcagag

SEQ ID NO: 461151 - RNA, 22 nt, Human
gcugggcagggagaagcagaga

SEQ ID NO: 461152 - RNA, 24 nt, Human
ggaaaccuccacuucccuagagcu

SEQ ID NO: 461153 - RNA, 18 nt, Human
ggagguugcagggagcug

SEQ ID NO: 461154 - RNA, 24 nt, Human
ggagguugcagggagcugagaucg

SEQ ID NO: 461155 - RNA, 20 nt, Human
ggccucuagucucuuuccaa

SEQ ID NO: 461156 - RNA, 19 nt, Human
gggcagggagaagcagaga

SEQ ID NO: 461157 - RNA, 18 nt, Human
gggugucaacuccacaac

SEQ ID NO: 461158 - RNA, 19 nt, Human
gggugucaacuccacaacc

SEQ ID NO: 461159 - RNA, 24 nt, Human
gguggcgugcaccuauauucccag

SEQ ID NO: 461160 - RNA, 23 nt, Human
gguggcucaagccuguaauccca

SEQ ID NO: 461161 - RNA, 24 nt, Human
gguggcucaagccuguaaucccag

SEQ ID NO: 461162 - RNA, 22 nt, Human
gucaacuccacaaccaccuaca

SEQ ID NO: 461163 - RNA, 20 nt, Human
guggaacacaucuguucccc

SEQ ID NO: 461164 - RNA, 19 nt, Human
gugggucgaccugcaggca

SEQ ID NO: 461165 - RNA, 23 nt, Human
uacggugagguuauucucucaac

SEQ ID NO: 461166 - RNA, 22 nt, Human
uagaauuccaaauggaaaccuc

SEQ ID NO: 461167 - RNA, 23 nt, Human
uagaauuccaaauggaaaccucc

SEQ ID NO: 461168 - RNA, 22 nt, Human
uagcaacagaguaagacuccau

SEQ ID NO: 461169 - RNA, 23 nt, Human
uagcaggcagcaguugaaaggaa

SEQ ID NO: 461170 - RNA, 21 nt, Human
uagugaacccucaucuguacu

SEQ ID NO: 461171 - RNA, 19 nt, Human
uauggugaccgaagaagau

SEQ ID NO: 461172 - RNA, 23 nt, Human
ucaaccaagacacucugcaaagc

SEQ ID NO: 461173 - RNA, 24 nt, Human
ucaaccaagacacucugcaaagcu

SEQ ID NO: 461174 - RNA, 21 nt, Human
ucaauucacuuuucugcaccc

SEQ ID NO: 461175 - RNA, 24 nt, Human
ucaugaggucaagagaucgagacc

SEQ ID NO: 461176 - RNA, 18 nt, Human
ucaugcugcauaucagga

SEQ ID NO: 461177 - RNA, 23 nt, Human
uccaucuuaaaaaaaaaaaaaaa

SEQ ID NO: 461178 - RNA, 23 nt, Human
uccauucuuucuacuaugguuaa

SEQ ID NO: 461179 - RNA, 20 nt, Human
ucccaacauugaaaaucacc

SEQ ID NO: 461180 - RNA, 23 nt, Human
uccuucuggaagaaaggaaaaac

SEQ ID NO: 461181 - RNA, 23 nt, Human
ucgggaggcugaggcaggagaau

SEQ ID NO: 461182 - RNA, 22 nt, Human
ucucaaccaagacacucugcaa

SEQ ID NO: 461183 - RNA, 25 nt, Human
ucucaaccaagacacucugcaaagc

SEQ ID NO: 461184 - RNA, 19 nt, Human
ucugacaaucagcugggaa

SEQ ID NO: 461185 - RNA, 21 nt, Human
ucuggaagaaaggaaaaaccc

SEQ ID NO: 461186 - RNA, 21 nt, Human
ugaacaucucccaacugcaga

SEQ ID NO: 461187 - RNA, 23 nt, Human
ugacaaucagcugggaaggaguc

SEQ ID NO: 461188 - RNA, 24 nt, Human
ugaggcaggagaauuguuugaacc

SEQ ID NO: 461189 - RNA, 25 nt, Human
ugaggcaggagaauuguuugaaccc

SEQ ID NO: 461190 - RNA, 18 nt, Human
ugcccugccucaacuucc

SEQ ID NO: 461191 - RNA, 21 nt, Human
ugccucaacuuccauacuugc

SEQ ID NO: 461192 - RNA, 24 nt, Human
ugccucaacuuccauacuugcuaa

SEQ ID NO: 461193 - RNA, 20 nt, Human
ugcuaaaugagacuacccga

SEQ ID NO: 461194 - RNA, 22 nt, Human
ugcuguggagggggaggcccuc

SEQ ID NO: 461195 - RNA, 24 nt, Human
uggaaaagaacggccauagggccg

SEQ ID NO: 461196 - RNA, 20 nt, Human
uggaagguggggggcagaca

SEQ ID NO: 461197 - RNA, 18 nt, Human
uggauagaccccucuccu

SEQ ID NO: 461198 - RNA, 19 nt, Human
uggccucuagucucuuucc

SEQ ID NO: 461199 - RNA, 22 nt, Human
uggcucaagccuguaaucccag

SEQ ID NO: 461200 - RNA, 24 nt, Human
uggcucaagccuguaaucccagca

SEQ ID NO: 461201 - RNA, 21 nt, Human
ugggaaggagucaacaggggu

SEQ ID NO: 461202 - RNA, 19 nt, Human
ugggagaccgaggugggug

SEQ ID NO: 461203 - RNA, 24 nt, Human
ugggagaccgagguggguggauca

SEQ ID NO: 461204 - RNA, 24 nt, Human
ugggcagggagaagcagagaaaag

SEQ ID NO: 461205 - RNA, 21 nt, Human
ugggggaagaaacagggugga

SEQ ID NO: 461206 - RNA, 21 nt, Human
uggguggaacacaucuguucc

SEQ ID NO: 461207 - RNA, 23 nt, Human
uggguggaucaugaggucaagag

SEQ ID NO: 461208 - RNA, 19 nt, Human
ugguaccaaacucaaacaa

SEQ ID NO: 461209 - RNA, 19 nt, Human
uguagucaauucacuuuuc

SEQ ID NO: 461210 - RNA, 20 nt, Human
ugucauguggguacggugag

SEQ ID NO: 461211 - RNA, 19 nt, Human
uguugcgaggauuaaagga

SEQ ID NO: 461212 - RNA, 23 nt, Human
uuaguuauugcuguuuagauccc

SEQ ID NO: 461213 - RNA, 23 nt, Human
uuccccucugaaaaucacagccc

SEQ ID NO: 461214 - RNA, 24 nt, Human
uugaacccaggagguggagguugc

SEQ ID NO: 461215 - RNA, 20 nt, Human
uugcagggagcugagaucgc

SEQ ID NO: 461216 - RNA, 23 nt, Human
uugcccugccucaacuuccauac

SEQ ID NO: 461217 - RNA, 24 nt, Human
uugcuguuuagaucccagcugugu

SEQ ID NO: 461218 - RNA, 19 nt, Human
uuggguggaacacaucugu

SEQ ID NO: 461219 - RNA, 24 nt, Human
uuguuugaacccaggagguggagg

SEQ ID NO: 461220 - RNA, 22 nt, Human
uuuguugggugugguggcgugc

SEQ ID NO: 461221 - RNA, 22 nt, Human
uuuuuuuuuuuuuuuuuuucag

SEQ ID NO: 461222 - RNA, 19 nt, Human
aaagugcuaggauuacagg

SEQ ID NO: 461223 - RNA, 24 nt, Human
aaagugcuaggauuacaggcauga

SEQ ID NO: 461224 - RNA, 26 nt, Human
aagugcuaggauuacaggcaugagcu

SEQ ID NO: 461225 - RNA, 19 nt, Human
accuugugauccgcccucc

SEQ ID NO: 461226 - RNA, 18 nt, Human
acgggguuucaccguguu

SEQ ID NO: 461227 - RNA, 19 nt, Human
acgggguuucaccguguua

SEQ ID NO: 461228 - RNA, 20 nt, Human
acgggguuucaccguguuag

SEQ ID NO: 461229 - RNA, 24 nt, Human
acgggguuucaccguguuagccag

SEQ ID NO: 461230 - RNA, 21 nt, Human
acugcaagcucugccuuccgg

SEQ ID NO: 461231 - RNA, 19 nt, Human
agagacgggguuucaccgu

SEQ ID NO: 461232 - RNA, 25 nt, Human
aggcuggagugcaguggcgugaucu

SEQ ID NO: 461233 - RNA, 20 nt, Human
aguagagacgggguuucacc

SEQ ID NO: 461234 - RNA, 18 nt, Human
aguagcugggacuacagg

SEQ ID NO: 461235 - RNA, 19 nt, Human
agugcaguggcgugaucuc

SEQ ID NO: 461236 - RNA, 20 nt, Human
agugcaguggcgugaucucg

SEQ ID NO: 461237 - RNA, 23 nt, Human
agugcaguggcgugaucucggcu

SEQ ID NO: 461238 - RNA, 24 nt, Human
agugcaguggcgugaucucggcuc

SEQ ID NO: 461239 - RNA, 21 nt, Human
auucuccugccucagccuccc

SEQ ID NO: 461240 - RNA, 24 nt, Human
auuuuuuguauuuuuaguagagga

SEQ ID NO: 461241 - RNA, 24 nt, Human
caaagugcuaggauuacaggcaug

SEQ ID NO: 461242 - RNA, 18 nt, Human
caccguguuagccaggau

SEQ ID NO: 461243 - RNA, 23 nt, Human
caccguguuagccaggauggucu

SEQ ID NO: 461244 - RNA, 24 nt, Human
caccguguuagccaggauggucuu

SEQ ID NO: 461245 - RNA, 23 nt, Human
cacugcaagcucugccuuccggg

SEQ ID NO: 461246 - RNA, 19 nt, Human
caggugcccgucaccaugc

SEQ ID NO: 461247 - RNA, 21 nt, Human
caguauggaaaaccaucccuu

SEQ ID NO: 461248 - RNA, 22 nt, Human
caguauggaaaaccaucccuug

SEQ ID NO: 461249 - RNA, 23 nt, Human
caguauggaaaaccaucccuugg

SEQ ID NO: 461250 - RNA, 22 nt, Human
caugccauucuccugccucagc

SEQ ID NO: 461251 - RNA, 21 nt, Human
cauuagagcaucaggcugacu

SEQ ID NO: 461252 - RNA, 19 nt, Human
ccaaagugcuaggauuaca

SEQ ID NO: 461253 - RNA, 22 nt, Human
ccaaagugcuaggauuacaggc

SEQ ID NO: 461254 - RNA, 24 nt, Human
ccaaagugcuaggauuacaggcau

SEQ ID NO: 461255 - RNA, 19 nt, Human
cccaggcuggagugcagug

SEQ ID NO: 461256 - RNA, 22 nt, Human
cccaggcuggagugcaguggcg

SEQ ID NO: 461257 - RNA, 23 nt, Human
cccgaguagcugggacuacaggu

SEQ ID NO: 461258 - RNA, 24 nt, Human
cccgaguagcugggacuacaggug

SEQ ID NO: 461259 - RNA, 18 nt, Human
ccgcccuccucagccuuc

SEQ ID NO: 461260 - RNA, 22 nt, Human
ccggguucaugccauucuccug

SEQ ID NO: 461261 - RNA, 21 nt, Human
ccuuccggguucaugccauuc

SEQ ID NO: 461262 - RNA, 18 nt, Human
ccuugugauccgcccucc

SEQ ID NO: 461263 - RNA, 21 nt, Human
ccuugugauccgcccuccuca

SEQ ID NO: 461264 - RNA, 22 nt, Human
ccuugugauccgcccuccucag

SEQ ID NO: 461265 - RNA, 24 nt, Human
cgcucugucucccaggcuggagug

SEQ ID NO: 461266 - RNA, 24 nt, Human
cucacugcaagcucugccuuccgg

SEQ ID NO: 461267 - RNA, 24 nt, Human
cucagccucccgaguagcugggac

SEQ ID NO: 461268 - RNA, 22 nt, Human
cuccugaccuugugauccgccc

SEQ ID NO: 461269 - RNA, 24 nt, Human
cucgcucugucucccaggcuggag

SEQ ID NO: 461270 - RNA, 23 nt, Human
cugccucagccucccgaguagcu

SEQ ID NO: 461271 - RNA, 24 nt, Human
gaccuugugauccgcccuccucag

SEQ ID NO: 461272 - RNA, 24 nt, Human
gacuacaggugcccgucaccaugc

SEQ ID NO: 461273 - RNA, 20 nt, Human
gagaaucagagcccacagaa

SEQ ID NO: 461274 - RNA, 24 nt, Human
gagacgggguuucaccguguuagc

SEQ ID NO: 461275 - RNA, 21 nt, Human
gauuacaggcaugagcugcug

SEQ ID NO: 461276 - RNA, 24 nt, Human
gauuacaggcaugagcugcugugc

SEQ ID NO: 461277 - RNA, 20 nt, Human
gccucagccucccgaguagc

SEQ ID NO: 461278 - RNA, 25 nt, Human
gccuuccggguucaugccauucucc

SEQ ID NO: 461279 - RNA, 19 nt, Human
gcuggagugcaguggcgug

SEQ ID NO: 461280 - RNA, 22 nt, Human
ggauuacaggcaugagcugcug

SEQ ID NO: 461281 - RNA, 24 nt, Human
ggauuacaggcaugagcugcugug

SEQ ID NO: 461282 - RNA, 22 nt, Human
ggcuggagugcaguggcgugau

SEQ ID NO: 461283 - RNA, 23 nt, Human
gggguuucaccguguuagccagg

SEQ ID NO: 461284 - RNA, 22 nt, Human
ggguuucaccguguuagccagg

SEQ ID NO: 461285 - RNA, 19 nt, Human
ggucuugaucuccugaccu

SEQ ID NO: 461286 - RNA, 20 nt, Human
ggucuugaucuccugaccuu

SEQ ID NO: 461287 - RNA, 23 nt, Human
guagagacgggguuucaccgugu

SEQ ID NO: 461288 - RNA, 24 nt, Human
gugauccgcccuccucagccuucc

SEQ ID NO: 461289 - RNA, 21 nt, Human
gugaucucggcucacugcaag

SEQ ID NO: 461290 - RNA, 24 nt, Human
uaauuuuuuauuuuuuguauuuuu

SEQ ID NO: 461291 - RNA, 19 nt, Human
uaggauuacaggcaugagc

SEQ ID NO: 461292 - RNA, 19 nt, Human
uaggauuacaggcaugagc

SEQ ID NO: 461293 - RNA, 19 nt, Human
uaggauuacaggcaugagc

SEQ ID NO: 461294 - RNA, 20 nt, Human
uaggauuacaggcaugagcu

SEQ ID NO: 461295 - RNA, 22 nt, Human
uaggauuacaggcaugagcugc

SEQ ID NO: 461296 - RNA, 24 nt, Human
uaggauuacaggcaugagcugcug

SEQ ID NO: 461297 - RNA, 21 nt, Human
uaguagagacgggguuucacc

SEQ ID NO: 461298 - RNA, 24 nt, Human
uaguagagacgggguuucaccgug

SEQ ID NO: 461299 - RNA, 26 nt, Human
uaguagagacgggguuucaccguguu

SEQ ID NO: 461300 - RNA, 26 nt, Human
uaguagagacgggguuucaccguugg

SEQ ID NO: 461301 - RNA, 24 nt, Human
ucaccguguuagccaggauggucu

SEQ ID NO: 461302 - RNA, 18 nt, Human
ucacugcaagcucugccu

SEQ ID NO: 461303 - RNA, 24 nt, Human
ucacugcaagcucugccuuccggg

SEQ ID NO: 461304 - RNA, 23 nt, Human
ucagccucccgaguagcugggac

SEQ ID NO: 461305 - RNA, 18 nt, Human
ucaugccauucuccugcc

SEQ ID NO: 461306 - RNA, 24 nt, Human
uccaaagugcuaggauuacaggca

SEQ ID NO: 461307 - RNA, 21 nt, Human
uccauuagagcaucaggcuga

SEQ ID NO: 461308 - RNA, 21 nt, Human
uccauucuuucuauuauggcu

SEQ ID NO: 461309 - RNA, 22 nt, Human
ucccaggcuggagugcaguggc

SEQ ID NO: 461310 - RNA, 23 nt, Human
ucccgaguagcugggacuacagg

SEQ ID NO: 461311 - RNA, 24 nt, Human
ucccgaguagcugggacuacaggu

SEQ ID NO: 461312 - RNA, 21 nt, Human
uccgcccuccucagccuucca

SEQ ID NO: 461313 - RNA, 22 nt, Human
uccuugagugucuuuaccuuug

SEQ ID NO: 461314 - RNA, 19 nt, Human
ucgugagcuaaaugaguuc

SEQ ID NO: 461315 - RNA, 19 nt, Human
ucuccauucuuucuauuau

SEQ ID NO: 461316 - RNA, 24 nt, Human
ucucccaggcuggagugcaguggc

SEQ ID NO: 461317 - RNA, 24 nt, Human
ucuccugccucagccucccgagua

SEQ ID NO: 461318 - RNA, 21 nt, Human
ucucgcucugucucccaggcu

SEQ ID NO: 461319 - RNA, 22 nt, Human
ucucgcucugucucccaggcug

SEQ ID NO: 461320 - RNA, 23 nt, Human
ucucgcucugucucccaggcugg

SEQ ID NO: 461321 - RNA, 24 nt, Human
ucucgcucugucucccaggcugga

SEQ ID NO: 461322 - RNA, 25 nt, Human
ucugcagucuauuuuuccauacauc

SEQ ID NO: 461323 - RNA, 19 nt, Human
ucugucucccaggcuggag

SEQ ID NO: 461324 - RNA, 24 nt, Human
ucugucucccaggcuggagugcag

SEQ ID NO: 461325 - RNA, 22 nt, Human
ugagacagagucucgcucuguc

SEQ ID NO: 461326 - RNA, 26 nt, Human
ugagacagagucucgcucugucuccc

SEQ ID NO: 461327 - RNA, 22 nt, Human
ugauccgcccuccucagccuuc

SEQ ID NO: 461328 - RNA, 24 nt, Human
ugcccggcuaauuuuuuauuuuuu

SEQ ID NO: 461329 - RNA, 24 nt, Human
ugccucagccucccgaguagcugg

SEQ ID NO: 461330 - RNA, 19 nt, Human
ugccuuccggguucaugcc

SEQ ID NO: 461331 - RNA, 20 nt, Human
ugcuaggauuacaggcauga

SEQ ID NO: 461332 - RNA, 19 nt, Human
uggagugcaguggcgugau

SEQ ID NO: 461333 - RNA, 23 nt, Human
uggagugcaguggcgugaucucg

SEQ ID NO: 461334 - RNA, 24 nt, Human
uggagugcaguggcgugaucucgg

SEQ ID NO: 461335 - RNA, 20 nt, Human
uggcgugaucucggcucacu

SEQ ID NO: 461336 - RNA, 19 nt, Human
ugggacuacaggugcccgu

SEQ ID NO: 461337 - RNA, 22 nt, Human
ugggacuacaggugcccgucac

SEQ ID NO: 461338 - RNA, 24 nt, Human
ugggacuacaggugcccgucacca

SEQ ID NO: 461339 - RNA, 25 nt, Human
ugggacuacaggugcccgucaccau

SEQ ID NO: 461340 - RNA, 21 nt, Human
uguauuuuuaguagagacggg

SEQ ID NO: 461341 - RNA, 24 nt, Human
ugugauccgcccuccucagccuuc

SEQ ID NO: 461342 - RNA, 18 nt, Human
uuaguagagacgggguuu

SEQ ID NO: 461343 - RNA, 22 nt, Human
uuaguagagacgggguuucacc

SEQ ID NO: 461344 - RNA, 24 nt, Human
uuaguagagacgggguuucaccgu

SEQ ID NO: 461345 - RNA, 19 nt, Human
uucaugccauucuccugcc

SEQ ID NO: 461346 - RNA, 24 nt, Human
uuccggguucaugccauucuccug

SEQ ID NO: 461347 - RNA, 19 nt, Human
uuuaacaagguggagccuc

SEQ ID NO: 461348 - RNA, 19 nt, Human
uuucaccguguuagccagg

SEQ ID NO: 461349 - RNA, 20 nt, Human
uuucugcagucuauuuuucc

SEQ ID NO: 461350 - RNA, 23 nt, Human
uuuucaaucuucacucgaccacu

SEQ ID NO: 461351 - RNA, 24 nt, Human
uuuuuaguagagacgggguuucac

SEQ ID NO: 461352 - RNA, 22 nt, Human
uuuuuguauuuuuaguagagaa

SEQ ID NO: 461353 - RNA, 30 nt, Human
uuuuuuauuuuuuguauuuuuaguagagaa

SEQ ID NO: 461354 - RNA, 24 nt, Human
uuuuuuguauuuuuaguagagacg

SEQ ID NO: 461355 - RNA, 20 nt, Human
uuuuuuuucuugagacagag

SEQ ID NO: 461356 - RNA, 25 nt, Human
uuuuuuuuucuugagacagagucuc

SEQ ID NO: 461357 - RNA, 27 nt, Human
uuuuuuuuuuuuuuuuuuuucuugggg

SEQ ID NO: 461358 - RNA, 21 nt, Human
aaaaaaaaucaggcuggaaaa

SEQ ID NO: 461359 - RNA, 26 nt, Human
aaaccauuucuuaguauuccccucug

SEQ ID NO: 461360 - RNA, 18 nt, Human
aaccaagacacucugcag

SEQ ID NO: 461361 - RNA, 18 nt, Human
aacuccacaagcacuuaa

SEQ ID NO: 461362 - RNA, 24 nt, Human
acuccacaagcacuuaaaaugauc

SEQ ID NO: 461363 - RNA, 19 nt, Human
aggaaggcuggcucuggcu

SEQ ID NO: 461364 - RNA, 18 nt, Human
aucccagcucugcuguuc

SEQ ID NO: 461365 - RNA, 21 nt, Human
auucaccuuucugcaccccag

SEQ ID NO: 461366 - RNA, 21 nt, Human
caagacacucugcagagcuaa

SEQ ID NO: 461367 - RNA, 21 nt, Human
cacauuuguugggugggaaca

SEQ ID NO: 461368 - RNA, 19 nt, Human
caccuuucugcaccccagu

SEQ ID NO: 461369 - RNA, 18 nt, Human
caguauggaaaaccauuu

SEQ ID NO: 461370 - RNA, 22 nt, Human
caguauggaaaaccauuucuua

SEQ ID NO: 461371 - RNA, 24 nt, Human
caguauggaaaaccauuucuuagu

SEQ ID NO: 461372 - RNA, 22 nt, Human
ccaagacacucugcagagcuaa

SEQ ID NO: 461373 - RNA, 24 nt, Human
cugcagagcuaauccaaggagugc

SEQ ID NO: 461374 - RNA, 23 nt, Human
cuuaucacauuuguuggguggga

SEQ ID NO: 461375 - RNA, 25 nt, Human
cuuccauacuugcaaaauaugacua

SEQ ID NO: 461376 - RNA, 18 nt, Human
gagaaucucuaggguauu

SEQ ID NO: 461377 - RNA, 19 nt, Human
gagguuauucucucaacca

SEQ ID NO: 461378 - RNA, 23 nt, Human
gcuuauaacacagcacuaagaac

SEQ ID NO: 461379 - RNA, 18 nt, Human
ggaacauaucugugcccc

SEQ ID NO: 461380 - RNA, 20 nt, Human
ggccucuagucucuuuccaa

SEQ ID NO: 461381 - RNA, 19 nt, Human
gggaacauaucugugcccc

SEQ ID NO: 461382 - RNA, 21 nt, Human
gguuuaacauccaccaaugac

SEQ ID NO: 461383 - RNA, 18 nt, Human
uaacacauuuauugaaca

SEQ ID NO: 461384 - RNA, 21 nt, Human
uaauucaccuuucugcacccc

SEQ ID NO: 461385 - RNA, 24 nt, Human
uacaguggugagcaauaauaguga

SEQ ID NO: 461386 - RNA, 23 nt, Human
uagcaggcagcaguugaaaggaa

SEQ ID NO: 461387 - RNA, 20 nt, Human
uagggaugucaacuccacaa

SEQ ID NO: 461388 - RNA, 19 nt, Human
uauggguuuaacauccacc

SEQ ID NO: 461389 - RNA, 27 nt, Human
uauuaacacauuuauugaacaacuaga

SEQ ID NO: 461390 - RNA, 24 nt, Human
ucaaccaagacacucugcagagcu

SEQ ID NO: 461391 - RNA, 27 nt, Human
ucaccuuucugcaccccaguuuccuua

SEQ ID NO: 461392 - RNA, 22 nt, Human
uccacaagcacuuaaaaugauc

SEQ ID NO: 461393 - RNA, 21 nt, Human
ucccuguaauucuuuuagcuu

SEQ ID NO: 461394 - RNA, 22 nt, Human
uccuugagugucuuuaccuuug

SEQ ID NO: 461395 - RNA, 24 nt, Human
ucuacccugcagcuguccugggaa

SEQ ID NO: 461396 - RNA, 22 nt, Human
ucucaaccaagacacucugcag

SEQ ID NO: 461397 - RNA, 25 nt, Human
ucucaaccaagacacucugcagagc

SEQ ID NO: 461398 - RNA, 19 nt, Human
ucuccauucuuucuauuau

SEQ ID NO: 461399 - RNA, 24 nt, Human
ugaccaggaguggacagaccuauu

SEQ ID NO: 461400 - RNA, 20 nt, Human
ugaucucuacccugcagcug

SEQ ID NO: 461401 - RNA, 23 nt, Human
ugccucagcuuccauacuugcaa

SEQ ID NO: 461402 - RNA, 24 nt, Human
ugcuguuuagaucccagcucugcu

SEQ ID NO: 461403 - RNA, 19 nt, Human
uggccucuagucucuuucc

SEQ ID NO: 461404 - RNA, 24 nt, Human
ugggaaaaaaaaucaggcuggaaa

SEQ ID NO: 461405 - RNA, 23 nt, Human
ugggaacauaucugugccccaug

SEQ ID NO: 461406 - RNA, 21 nt, Human
uguugcccugccucagcuucc

SEQ ID NO: 461407 - RNA, 19 nt, Human
uguugugaggauuaaagga

SEQ ID NO: 461408 - RNA, 21 nt, Human
uuaauucaccuuucugcaccc

SEQ ID NO: 461409 - RNA, 19 nt, Human
uuagaucccagcucugcug

SEQ ID NO: 461410 - RNA, 23 nt, Human
uuaguuauugcuguuuagauccc

SEQ ID NO: 461411 - RNA, 22 nt, Human
uuccaagucacaugucauguug

SEQ ID NO: 461412 - RNA, 23 nt, Human
uuccccucugaaaaucacagccc

SEQ ID NO: 461413 - RNA, 23 nt, Human
uugcccugccucagcuuccauac

SEQ ID NO: 461414 - RNA, 20 nt, Human
acagaguucucaagucacca

SEQ ID NO: 461415 - RNA, 26 nt, Human
cacccucguccucaccauagugggga

SEQ ID NO: 461416 - RNA, 18 nt, Human
cagaguucucaagucacc

SEQ ID NO: 461417 - RNA, 19 nt, Human
cccaaaucaacacucucaa

SEQ ID NO: 461418 - RNA, 20 nt, Human
ccccacccucguccucacca

SEQ ID NO: 461419 - RNA, 24 nt, Human
ccucaccauaguggggagacuaaa

SEQ ID NO: 461420 - RNA, 26 nt, Human
cguccucaccauaguggggagacuaa

SEQ ID NO: 461421 - RNA, 20 nt, Human
cuagugauuauggcacuccu

SEQ ID NO: 461422 - RNA, 21 nt, Human
gaaacaguccucagaaaccag

SEQ ID NO: 461423 - RNA, 20 nt, Human
uaaaguggccagggauuugc

SEQ ID NO: 461424 - RNA, 23 nt, Human
uaaaguggccagggauuugccuu

SEQ ID NO: 461425 - RNA, 19 nt, Human
ucaaugccccacccucguc

SEQ ID NO: 461426 - RNA, 20 nt, Human
ucaaugccccacccucgucc

SEQ ID NO: 461427 - RNA, 25 nt, Human
uccucagaaaccaggcacagaguuc

SEQ ID NO: 461428 - RNA, 18 nt, Human
ucucaaugccccacccuc

SEQ ID NO: 461429 - RNA, 20 nt, Human
ugugcagugcguucugaguu

SEQ ID NO: 461430 - RNA, 24 nt, Human
aaaaagaucaaaauaggauaaaug

SEQ ID NO: 461431 - RNA, 19 nt, Human
acugaaaaggacauccagc

SEQ ID NO: 461432 - RNA, 18 nt, Human
acuugggcaguaucuuuc

SEQ ID NO: 461433 - RNA, 21 nt, Human
cugguuuuccucugcacucgg

SEQ ID NO: 461434 - RNA, 22 nt, Human
ggacauccagcucgcacaaacg

SEQ ID NO: 461435 - RNA, 22 nt, Human
gggcaguaucuuucccucuuaa

SEQ ID NO: 461436 - RNA, 19 nt, Human
uacugaaaaggacauccag

SEQ ID NO: 461437 - RNA, 21 nt, Human
uacugaaaaggacauccagcu

SEQ ID NO: 461438 - RNA, 21 nt, Human
uuccuuucagaagacuugaaa

SEQ ID NO: 461439 - RNA, 23 nt, Human
uuucugguuuuccucugcacucg

SEQ ID NO: 461440 - RNA, 28 nt, Human
uuuuuuuuuuuuuuuuuuuuuuuggggg

SEQ ID NO: 461441 - RNA, 22 nt, Human
aaaaagagaaaugaccaaagag

SEQ ID NO: 461442 - RNA, 24 nt, Human
acugcacucuggccugguugacag

SEQ ID NO: 461443 - RNA, 24 nt, Human
agauucuugguauauuuagcaucu

SEQ ID NO: 461444 - RNA, 21 nt, Human
aggcccaggaacuugaagcaa

SEQ ID NO: 461445 - RNA, 20 nt, Human
aggugggaggagcccgggag

SEQ ID NO: 461446 - RNA, 18 nt, Human
cacugcacucuggccugg

SEQ ID NO: 461447 - RNA, 23 nt, Human
cacugcacucuggccugguugac

SEQ ID NO: 461448 - RNA, 25 nt, Human
cacugcacucuggccugguugacag

SEQ ID NO: 461449 - RNA, 25 nt, Human
cacugcacucuggccugguugacag

SEQ ID NO: 461450 - RNA, 26 nt, Human
cagugagacccucgagacagaaguuc

SEQ ID NO: 461451 - RNA, 25 nt, Human
ccaaagagguuaacaaguauuuaga

SEQ ID NO: 461452 - RNA, 22 nt, Human
ccugaagucccagcuacucaag

SEQ ID NO: 461453 - RNA, 18 nt, Human
ccugauggugaggagcaa

SEQ ID NO: 461454 - RNA, 21 nt, Human
ccugcacgcugucagcaggcc

SEQ ID NO: 461455 - RNA, 21 nt, Human
cgagacagaaguucuucuuuc

SEQ ID NO: 461456 - RNA, 21 nt, Human
cugguugacagugagacccuc

SEQ ID NO: 461457 - RNA, 18 nt, Human
gaggagcaaagucaagga

SEQ ID NO: 461458 - RNA, 18 nt, Human
gaucuggcugucuuccuu

SEQ ID NO: 461459 - RNA, 23 nt, Human
ggaagaaggcaaguuugcccuga

SEQ ID NO: 461460 - RNA, 22 nt, Human
uaaaaagagaaaugaccaaaga

SEQ ID NO: 461461 - RNA, 21 nt, Human
uaaaaguuucuuuuggcacaa

SEQ ID NO: 461462 - RNA, 20 nt, Human
uauuuuacuauguugaugaa

SEQ ID NO: 461463 - RNA, 18 nt, Human
ucaaggauuacacugauu

SEQ ID NO: 461464 - RNA, 19 nt, Human
ucacugcacucuggccugg

SEQ ID NO: 461465 - RNA, 20 nt, Human
ucacugcacucuggccuggu

SEQ ID NO: 461466 - RNA, 24 nt, Human
ucacugcacucuggccugguugac

SEQ ID NO: 461467 - RNA, 26 nt, Human
ucacuggaucuggcugucuuccuuuc

SEQ ID NO: 461468 - RNA, 22 nt, Human
ucucucuuuccuuugcaguguu

SEQ ID NO: 461469 - RNA, 21 nt, Human
ugaagcugggcaguuguaguc

SEQ ID NO: 461470 - RNA, 21 nt, Human
ugaccaaagagguuaacaagu

SEQ ID NO: 461471 - RNA, 23 nt, Human
ugaccaaagagguuaacaaguau

SEQ ID NO: 461472 - RNA, 24 nt, Human
ugaucuucacugcacucuggccug

SEQ ID NO: 461473 - RNA, 21 nt, Human
ugcuguagcuguuuuaaaagu

SEQ ID NO: 461474 - RNA, 18 nt, Human
ugguauauuuagcaucuc

SEQ ID NO: 461475 - RNA, 22 nt, Human
uggugaggagcaaagucaagga

SEQ ID NO: 461476 - RNA, 21 nt, Human
uguauggauguuguugaaugu

SEQ ID NO: 461477 - RNA, 19 nt, Human
uguccuaccuaucuuugcu

SEQ ID NO: 461478 - RNA, 24 nt, Human
uguucuguuuauuuacuggagcuu

SEQ ID NO: 461479 - RNA, 18 nt, Human
uguuguugaauguugagg

SEQ ID NO: 461480 - RNA, 19 nt, Human
uuccccugugcccuguugc

SEQ ID NO: 461481 - RNA, 20 nt, Human
uuguugaauguugaggucug

SEQ ID NO: 461482 - RNA, 25 nt, Human
aaaacaaaacaaaacaaaaaguuaa

SEQ ID NO: 461483 - RNA, 19 nt, Human
aaacaaaacaaaacaaaaa

SEQ ID NO: 461484 - RNA, 22 nt, Human
aaacaaaacaaaacaaaacaaa

SEQ ID NO: 461485 - RNA, 22 nt, Human
aaacaaaacaaaacaaaacaaa

SEQ ID NO: 461486 - RNA, 22 nt, Human
aaaccagagaccaaacaauuga

SEQ ID NO: 461487 - RNA, 19 nt, Human
aaacggcaacuaggguaug

SEQ ID NO: 461488 - RNA, 26 nt, Human
aaccagagaccaaacaauugagcuuu

SEQ ID NO: 461489 - RNA, 26 nt, Human
aacgaagccaguccaguaugaccgag

SEQ ID NO: 461490 - RNA, 20 nt, Human
aagaaccaggacacaugaga

SEQ ID NO: 461491 - RNA, 21 nt, Human
aagccaguccaguaugaccga

SEQ ID NO: 461492 - RNA, 22 nt, Human
aaugaaaaggcagccauuaaaa

SEQ ID NO: 461493 - RNA, 27 nt, Human
aaugcaaaacaaaacaaaacaaaacaa

SEQ ID NO: 461494 - RNA, 22 nt, Human
aauggaucaauuguauaccaag

SEQ ID NO: 461495 - RNA, 24 nt, Human
aauggcaccuucaaaaggggcgau

SEQ ID NO: 461496 - RNA, 18 nt, Human
acaaaacaaaacaaaaag

SEQ ID NO: 461497 - RNA, 27 nt, Human
acaaaacaaaacaaaacaaaacaaaaa

SEQ ID NO: 461498 - RNA, 24 nt, Human
acaugacauuuuaucuacaacucc

SEQ ID NO: 461499 - RNA, 24 nt, Human
acccauuuguuuugccuggaaaga

SEQ ID NO: 461500 - RNA, 22 nt, Human
acguacucaagauucauguuaa

SEQ ID NO: 461501 - RNA, 23 nt, Human
acuaaaugcagaaguuucucaag

SEQ ID NO: 461502 - RNA, 22 nt, Human
agguagaagauaacugaaaaga

SEQ ID NO: 461503 - RNA, 21 nt, Human
augcaaaacaaaacaaaacaa

SEQ ID NO: 461504 - RNA, 20 nt, Human
caaaacaaaacaaaaaguua

SEQ ID NO: 461505 - RNA, 24 nt, Human
caaaacaaaacaaaacaaaaaguu

SEQ ID NO: 461506 - RNA, 21 nt, Human
caaaacaaaacaaaacaaaac

SEQ ID NO: 461507 - RNA, 24 nt, Human
caaaacaaaacaaaacaaaacaaa

SEQ ID NO: 461508 - RNA, 24 nt, Human
caaaacaaaacaaaacaaaacaaa

SEQ ID NO: 461509 - RNA, 31 nt, Human
caacaaucaguuauaauguucuuuuuaaggg

SEQ ID NO: 461510 - RNA, 25 nt, Human
caacuccuguuugcuuuacugaggg

SEQ ID NO: 461511 - RNA, 23 nt, Human
caagcaaugguccacguacucaa

SEQ ID NO: 461512 - RNA, 20 nt, Human
cacaaagucuucccauaaaa

SEQ ID NO: 461513 - RNA, 21 nt, Human
cagaucacuacguagaaaucu

SEQ ID NO: 461514 - RNA, 20 nt, Human
caggagguagaagauaacug

SEQ ID NO: 461515 - RNA, 18 nt, Human
cagggcuccgggcaugcc

SEQ ID NO: 461516 - RNA, 23 nt, Human
caguuaaaauaaaauuugccaug

SEQ ID NO: 461517 - RNA, 24 nt, Human
cauugcacuucauuuguuauagca

SEQ ID NO: 461518 - RNA, 19 nt, Human
ccaaaucauauccuuaaaa

SEQ ID NO: 461519 - RNA, 20 nt, Human
cccaaugacuacauacauag

SEQ ID NO: 461520 - RNA, 21 nt, Human
ccucugccacauuaugauuuc

SEQ ID NO: 461521 - RNA, 24 nt, Human
cggcaacugcggcggugucuccuc

SEQ ID NO: 461522 - RNA, 23 nt, Human
cucaaaaugaacuuuuaaaugac

SEQ ID NO: 461523 - RNA, 24 nt, Human
cucaacuuucuucuucccaccacc

SEQ ID NO: 461524 - RNA, 22 nt, Human
cucuaaggaugaaaaccagaga

SEQ ID NO: 461525 - RNA, 20 nt, Human
cugaaaagacuaaugcaaca

SEQ ID NO: 461526 - RNA, 21 nt, Human
cuucuucccaccaccucugcc

SEQ ID NO: 461527 - RNA, 24 nt, Human
cuuuuccaguuuaauuugcaaaca

SEQ ID NO: 461528 - RNA, 18 nt, Human
gaagauguaagaaccagg

SEQ ID NO: 461529 - RNA, 24 nt, Human
gaccuuuaacauuuucaacaauuu

SEQ ID NO: 461530 - RNA, 22 nt, Human
gaggaaagagccagaaaucccc

SEQ ID NO: 461531 - RNA, 19 nt, Human
gauguaagaaccaggacac

SEQ ID NO: 461532 - RNA, 21 nt, Human
ggauaucuggaguuaaaaaug

SEQ ID NO: 461533 - RNA, 26 nt, Human
uaaaauaaauggaucaauuguauacc

SEQ ID NO: 461534 - RNA, 25 nt, Human
uaaauggaucaauuguauaccaaga

SEQ ID NO: 461535 - RNA, 23 nt, Human
uaaggcgaagaggaaagagccag

SEQ ID NO: 461536 - RNA, 22 nt, Human
uacaggagguagaagauaacug

SEQ ID NO: 461537 - RNA, 21 nt, Human
uacaguagaaaauacaggagg

SEQ ID NO: 461538 - RNA, 19 nt, Human
uaccaagaaguauuuggcu

SEQ ID NO: 461539 - RNA, 21 nt, Human
uagcagcaagaaaagaugaaa

SEQ ID NO: 461540 - RNA, 18 nt, Human
uaggaagauguaagaacc

SEQ ID NO: 461541 - RNA, 20 nt, Human
uaggauaucuggaguuaaaa

SEQ ID NO: 461542 - RNA, 24 nt, Human
uauaccaagaaguauuuggcucau

SEQ ID NO: 461543 - RNA, 21 nt, Human
uauagcaaauacucuaagcca

SEQ ID NO: 461544 - RNA, 23 nt, Human
uaucaaaguuacucauuuuaaca

SEQ ID NO: 461545 - RNA, 23 nt, Human
uaucuggaguuaaaaaugcaaaa

SEQ ID NO: 461546 - RNA, 25 nt, Human
ucaguuauaauguucuuuuuaaggg

SEQ ID NO: 461547 - RNA, 21 nt, Human
ucauugaugagcagggcuccg

SEQ ID NO: 461548 - RNA, 20 nt, Human
uccacucagucucugguggc

SEQ ID NO: 461549 - RNA, 21 nt, Human
ucccaauuagaacaugcugac

SEQ ID NO: 461550 - RNA, 20 nt, Human
ucuauagcuccuguagcuac

SEQ ID NO: 461551 - RNA, 18 nt, Human
ugaaaagaauacccauuu

SEQ ID NO: 461552 - RNA, 22 nt, Human
ugaaaaggcagccauuaaaaua

SEQ ID NO: 461553 - RNA, 21 nt, Human
ugaaagcccuuauaucaugcu

SEQ ID NO: 461554 - RNA, 21 nt, Human
ugaauacauuuugccugugca

SEQ ID NO: 461555 - RNA, 24 nt, Human
ugacuacauacauagauggguagc

SEQ ID NO: 461556 - RNA, 23 nt, Human
ugagacucuggauacuuuuccag

SEQ ID NO: 461557 - RNA, 25 nt, Human
ugcaaaacaaaacaaaacaaaacaa

SEQ ID NO: 461558 - RNA, 26 nt, Human
ugcaagcaaugguccacguacucaag

SEQ ID NO: 461559 - RNA, 22 nt, Human
ugccauauuaucucacaaauca

SEQ ID NO: 461560 - RNA, 18 nt, Human
ugccuuuugagacucugg

SEQ ID NO: 461561 - RNA, 23 nt, Human
uggauacuuuuccaguuuaauuu

SEQ ID NO: 461562 - RNA, 18 nt, Human
uggcucauaagaauggca

SEQ ID NO: 461563 - RNA, 22 nt, Human
ugucauugcacuucauuuguua

SEQ ID NO: 461564 - RNA, 25 nt, Human
ugucauugcacuucauuuguuauag

SEQ ID NO: 461565 - RNA, 18 nt, Human
uguggcuacauuuucccc

SEQ ID NO: 461566 - RNA, 22 nt, Human
uuaacacaaagucuucccauaa

SEQ ID NO: 461567 - RNA, 19 nt, Human
uucaccccauucacaacaa

SEQ ID NO: 461568 - RNA, 26 nt, Human
uucacuuuuaacacaaagucuuccca

SEQ ID NO: 461569 - RNA, 20 nt, Human
uucccaccaccucugccaca

SEQ ID NO: 461570 - RNA, 24 nt, Human
uuucaagucuguucuccauggcuu

SEQ ID NO: 461571 - RNA, 25 nt, Human
uuugcaaacagaauuuuuauaacaa

SEQ ID NO: 461572 - RNA, 23 nt, Human
aaaaacaaaaccauuucucccuc

SEQ ID NO: 461573 - RNA, 22 nt, Human
aaacaaaacaaaaacaaaacca

SEQ ID NO: 461574 - RNA, 21 nt, Human
aaaguggccuguaauagacac

SEQ ID NO: 461575 - RNA, 23 nt, Human
acaaaaacaaaaccauuucuccc

SEQ ID NO: 461576 - RNA, 20 nt, Human
acaaaacaaaaacaaaacca

SEQ ID NO: 461577 - RNA, 19 nt, Human
acagacacauugacauaga

SEQ ID NO: 461578 - RNA, 24 nt, Human
acaguaccugaaaaauacagcuaa

SEQ ID NO: 461579 - RNA, 24 nt, Human
aggcugggggcugcggcgauucgu

SEQ ID NO: 461580 - RNA, 25 nt, Human
auagacaccaguggggcggucacca

SEQ ID NO: 461581 - RNA, 22 nt, Human
aucacauacaugagcagauaca

SEQ ID NO: 461582 - RNA, 18 nt, Human
auccuauuuuuuuuuucc

SEQ ID NO: 461583 - RNA, 21 nt, Human
auccuauuuuuuuuuuccuuu

SEQ ID NO: 461584 - RNA, 24 nt, Human
auggaggagugaaggacagacacc

SEQ ID NO: 461585 - RNA, 25 nt, Human
caaaaacaaaaccauuucucccucu

SEQ ID NO: 461586 - RNA, 27 nt, Human
caaaacaaaaacaaaaccauuucuccc

SEQ ID NO: 461587 - RNA, 22 nt, Human
caauggaggagugaaggacaga

SEQ ID NO: 461588 - RNA, 27 nt, Human
cacacaguaccugaaaaauacagcuaa

SEQ ID NO: 461589 - RNA, 18 nt, Human
caccaguggggcggucac

SEQ ID NO: 461590 - RNA, 21 nt, Human
cagauacacaacuaccaaagu

SEQ ID NO: 461591 - RNA, 22 nt, Human
cagaucuacuugacuccuuguu

SEQ ID NO: 461592 - RNA, 23 nt, Human
cagcagcagcagcagcagcagug

SEQ ID NO: 461593 - RNA, 23 nt, Human
cagcagcagcggcagcagcagca

SEQ ID NO: 461594 - RNA, 27 nt, Human
cagcagcaguggcggcagacaauggag

SEQ ID NO: 461595 - RNA, 24 nt, Human
cagcggcagcagcagcagcagcag

SEQ ID NO: 461596 - RNA, 22 nt, Human
caguaccugaaaaauacagcua

SEQ ID NO: 461597 - RNA, 24 nt, Human
ccauuuaaaaacaaaacaaaaaca

SEQ ID NO: 461598 - RNA, 25 nt, Human
ccugaaaaauacagcuaaaaaagga

SEQ ID NO: 461599 - RNA, 23 nt, Human
ccuguaauagacaccaguggggc

SEQ ID NO: 461600 - RNA, 21 nt, Human
cgaaaacagaagccaaguuuc

SEQ ID NO: 461601 - RNA, 23 nt, Human
cggcagcagcagcagcagcagca

SEQ ID NO: 461602 - RNA, 20 nt, Human
gaaaacagaagccaaguuuc

SEQ ID NO: 461603 - RNA, 19 nt, Human
gacaauggaggagugaagg

SEQ ID NO: 461604 - RNA, 19 nt, Human
gacaauggaggagugaagg

SEQ ID NO: 461605 - RNA, 18 nt, Human
gauacacaacuaccaaag

SEQ ID NO: 461606 - RNA, 21 nt, Human
gcagcagcaguggcggcagac

SEQ ID NO: 461607 - RNA, 24 nt, Human
uaaaaacaaaacaaaaacaaaacc

SEQ ID NO: 461608 - RNA, 25 nt, Human
uaaaaacaaaacaaaaacaaaacca

SEQ ID NO: 461609 - RNA, 23 nt, Human
uacacaacuaccaaaguggccug

SEQ ID NO: 461610 - RNA, 19 nt, Human
uccauuuaaaaacaaaaca

SEQ ID NO: 461611 - RNA, 21 nt, Human
uccuuugcgaaaacagaagcu

SEQ ID NO: 461612 - RNA, 25 nt, Human
ugaaggacagacacauugacauaga

SEQ ID NO: 461613 - RNA, 21 nt, Human
ugagcagauacacaacuacca

SEQ ID NO: 461614 - RNA, 23 nt, Human
ugagcagauacacaacuaccaaa

SEQ ID NO: 461615 - RNA, 25 nt, Human
uggccuguaauagacaccagugggg

SEQ ID NO: 461616 - RNA, 18 nt, Human
uggcggcagacaauggag

SEQ ID NO: 461617 - RNA, 18 nt, Human
uuucucccucugcacaag

SEQ ID NO: 461618 - RNA, 25 nt, Human
uuucucccucugcacaagggaagcc

SEQ ID NO: 461619 - RNA, 27 nt, Human
aaaaacaacaaaaaaaagccaggugug

SEQ ID NO: 461620 - RNA, 21 nt, Human
aaaaagccaggugugguggcg

SEQ ID NO: 461621 - RNA, 20 nt, Human
aaaagaaaaagaaaaugugg

SEQ ID NO: 461622 - RNA, 23 nt, Human
aaaagaaaaagaaaauguggagg

SEQ ID NO: 461623 - RNA, 21 nt, Human
aaacaacaaaaaaaagccagg

SEQ ID NO: 461624 - RNA, 21 nt, Human
aagaaaaagaaaauguggagg

SEQ ID NO: 461625 - RNA, 24 nt, Human
aagagagcuggggcaggccaccag

SEQ ID NO: 461626 - RNA, 24 nt, Human
aagaucacuugagcccaggaguuc

SEQ ID NO: 461627 - RNA, 18 nt, Human
aaggcuccuggauugaaa

SEQ ID NO: 461628 - RNA, 19 nt, Human
aaggugaggccuuugaaaa

SEQ ID NO: 461629 - RNA, 20 nt, Human
acaccacugcacuccagucu

SEQ ID NO: 461630 - RNA, 24 nt, Human
acacucuguccccaaacccucccg

SEQ ID NO: 461631 - RNA, 20 nt, Human
acagagcaagacccugucuc

SEQ ID NO: 461632 - RNA, 24 nt, Human
acagagcaagacccugucucaaaa

SEQ ID NO: 461633 - RNA, 19 nt, Human
accacugcacuccagucug

SEQ ID NO: 461634 - RNA, 18 nt, Human
acccugucucuaaaaaca

SEQ ID NO: 461635 - RNA, 20 nt, Human
accucccaaagagggacuga

SEQ ID NO: 461636 - RNA, 19 nt, Human
accuggguggaugugcugu

SEQ ID NO: 461637 - RNA, 23 nt, Human
accuguggucccagcuguucagg

SEQ ID NO: 461638 - RNA, 22 nt, Human
acucuguccccaaacccucccg

SEQ ID NO: 461639 - RNA, 24 nt, Human
acugcacuccagucugggugacag

SEQ ID NO: 461640 - RNA, 26 nt, Human
acugcacuccagucugggugacagag

SEQ ID NO: 461641 - RNA, 21 nt, Human
agaaaaagaaaauguggaggg

SEQ ID NO: 461642 - RNA, 18 nt, Human
agagcccugccuccugcu

SEQ ID NO: 461643 - RNA, 24 nt, Human
agaggacagaggaaggacacucug

SEQ ID NO: 461644 - RNA, 23 nt, Human
agccaggugugguggcgugcacc

SEQ ID NO: 461645 - RNA, 22 nt, Human
agccugagcaauauagugagac

SEQ ID NO: 461646 - RNA, 24 nt, Human
agccugagcaauauagugagaccc

SEQ ID NO: 461647 - RNA, 24 nt, Human
agcguuuugggaggcccacguggg

SEQ ID NO: 461648 - RNA, 23 nt, Human
aggaguucaagaccagccugagc

SEQ ID NO: 461649 - RNA, 23 nt, Human
aggcaggaggauugcuugaaccc

SEQ ID NO: 461650 - RNA, 24 nt, Human
aggcaggaggauugcuugaaccca

SEQ ID NO: 461651 - RNA, 19 nt, Human
aggccuuugaaaaacaaug

SEQ ID NO: 461652 - RNA, 21 nt, Human
aggcgcgguggcucacacuug

SEQ ID NO: 461653 - RNA, 24 nt, Human
aggcgcgguggcucacacuuguag

SEQ ID NO: 461654 - RNA, 21 nt, Human
aggcugaggcaggaggauugc

SEQ ID NO: 461655 - RNA, 24 nt, Human
aggcugaggcaggaggauugcuug

SEQ ID NO: 461656 - RNA, 24 nt, Human
aucacaccacugcacuccagucug

SEQ ID NO: 461657 - RNA, 24 nt, Human
aucacuugagcccaggaguucaag

SEQ ID NO: 461658 - RNA, 19 nt, Human
auugcuugaacccaggagg

SEQ ID NO: 461659 - RNA, 22 nt, Human
caaaaaaaagccagguguggug

SEQ ID NO: 461660 - RNA, 21 nt, Human
caagacccugucucaaaaaag

SEQ ID NO: 461661 - RNA, 22 nt, Human
caauauagugagacccugucuc

SEQ ID NO: 461662 - RNA, 21 nt, Human
cacaccacugcacuccagucu

SEQ ID NO: 461663 - RNA, 24 nt, Human
caccuguggucccagcuguucagg

SEQ ID NO: 461664 - RNA, 22 nt, Human
cacuccagucugggugacagag

SEQ ID NO: 461665 - RNA, 23 nt, Human
cacuccagucugggugacagagc

SEQ ID NO: 461666 - RNA, 19 nt, Human
cacugcacuccagucuggg

SEQ ID NO: 461667 - RNA, 21 nt, Human
cacugcacuccagucugggug

SEQ ID NO: 461668 - RNA, 22 nt, Human
cacugcacuccagucuggguga

SEQ ID NO: 461669 - RNA, 23 nt, Human
cacugcacuccagucugggugac

SEQ ID NO: 461670 - RNA, 24 nt, Human
cacugcacuccagucugggugaca

SEQ ID NO: 461671 - RNA, 25 nt, Human
cacugcacuccagucugggugacag

SEQ ID NO: 461672 - RNA, 18 nt, Human
cagaagagagcuggggca

SEQ ID NO: 461673 - RNA, 22 nt, Human
cagcguuuugggaggcccacgu

SEQ ID NO: 461674 - RNA, 24 nt, Human
cagcguuuugggaggcccacgugg

SEQ ID NO: 461675 - RNA, 24 nt, Human
cagcuguucaggaggcugaggcag

SEQ ID NO: 461676 - RNA, 20 nt, Human
ccacugcacuccagucuggg

SEQ ID NO: 461677 - RNA, 20 nt, Human
ccacugcacuccagucuggg

SEQ ID NO: 461678 - RNA, 20 nt, Human
ccacugcacuccagucuggg

SEQ ID NO: 461679 - RNA, 21 nt, Human
ccacugcacuccagucugggu

SEQ ID NO: 461680 - RNA, 21 nt, Human
ccacugcacuccagucugggu

SEQ ID NO: 461681 - RNA, 23 nt, Human
ccacugcacuccagucuggguga

SEQ ID NO: 461682 - RNA, 24 nt, Human
ccacugcacuccagucugggugac

SEQ ID NO: 461683 - RNA, 21 nt, Human
ccagagccgccucugcacucu

SEQ ID NO: 461684 - RNA, 22 nt, Human
ccaggagguugagggugcagug

SEQ ID NO: 461685 - RNA, 23 nt, Human
ccaggcccagggcuggcgaugug

SEQ ID NO: 461686 - RNA, 18 nt, Human
cccagacuggccuggagg

SEQ ID NO: 461687 - RNA, 18 nt, Human
cccguccagggugugagg

SEQ ID NO: 461688 - RNA, 21 nt, Human
ccuccaggccccagccccacc

SEQ ID NO: 461689 - RNA, 20 nt, Human
ccuggcugcagccgcuaucc

SEQ ID NO: 461690 - RNA, 23 nt, Human
ccugucucaaaaaagaaaaagaa

SEQ ID NO: 461691 - RNA, 23 nt, Human
ccugucucaaaaaagaaaaagaa

SEQ ID NO: 461692 - RNA, 25 nt, Human
cuaagacagacaguugaaggugagg

SEQ ID NO: 461693 - RNA, 23 nt, Human
cucacacuuguaguuccagcguu

SEQ ID NO: 461694 - RNA, 22 nt, Human
cucugcucgcuuccugcucaga

SEQ ID NO: 461695 - RNA, 21 nt, Human
cugggccuccaggccccagcc

SEQ ID NO: 461696 - RNA, 19 nt, Human
cugggugacagagcaagac

SEQ ID NO: 461697 - RNA, 23 nt, Human
cuuccugcucagaaagccagaag

SEQ ID NO: 461698 - RNA, 20 nt, Human
gaaaaagaaaauguggaggg

SEQ ID NO: 461699 - RNA, 19 nt, Human
gaaggaacuuagguagaga

SEQ ID NO: 461700 - RNA, 19 nt, Human
gaagugaaagcauagggag

SEQ ID NO: 461701 - RNA, 19 nt, Human
gacccugucucuaaaaaca

SEQ ID NO: 461702 - RNA, 24 nt, Human
gaggccuuugaaaaacaaugggaa

SEQ ID NO: 461703 - RNA, 24 nt, Human
gaucacuugagcccaggaguucaa

SEQ ID NO: 461704 - RNA, 24 nt, Human
gcacuccagucugggugacagagc

SEQ ID NO: 461705 - RNA, 22 nt, Human
gcaggaggauugcuugaaccca

SEQ ID NO: 461706 - RNA, 24 nt, Human
gccagguacagcauuggggacauc

SEQ ID NO: 461707 - RNA, 22 nt, Human
gcccaggaguucaagaccagcc

SEQ ID NO: 461708 - RNA, 24 nt, Human
gccccagagcccugccuccugcuc

SEQ ID NO: 461709 - RNA, 23 nt, Human
gcuaugaucacaccacugcacuu

SEQ ID NO: 461710 - RNA, 20 nt, Human
ggcccuagaacuuggaggug

SEQ ID NO: 461711 - RNA, 23 nt, Human
ggccggcccgcacaccguccuuc

SEQ ID NO: 461712 - RNA, 22 nt, Human
gguggcucacacuuguaguucc

SEQ ID NO: 461713 - RNA, 24 nt, Human
gguggcucacacuuguaguuccag

SEQ ID NO: 461714 - RNA, 19 nt, Human
gugcaccuguggucccagc

SEQ ID NO: 461715 - RNA, 21 nt, Human
guggagggcuugggccaggcg

SEQ ID NO: 461716 - RNA, 23 nt, Human
uaaaaacaacaaaaaaaagccag

SEQ ID NO: 461717 - RNA, 20 nt, Human
uagaacuuggaggugucagg

SEQ ID NO: 461718 - RNA, 24 nt, Human
uauagugagacccugucucuaaaa

SEQ ID NO: 461719 - RNA, 23 nt, Human
ucacaccacugcacuccagucug

SEQ ID NO: 461720 - RNA, 25 nt, Human
ucagccagguacagcauuggggaca

SEQ ID NO: 461721 - RNA, 18 nt, Human
uccagggugugagggcuc

SEQ ID NO: 461722 - RNA, 19 nt, Human
uccagggugugagggcucg

SEQ ID NO: 461723 - RNA, 23 nt, Human
uccagggugugagggcucgggac

SEQ ID NO: 461724 - RNA, 24 nt, Human
uccagucugggugacagagcaaga

SEQ ID NO: 461725 - RNA, 19 nt, Human
ucccguguccugacggccc

SEQ ID NO: 461726 - RNA, 20 nt, Human
uccugcucagaaagccagaa

SEQ ID NO: 461727 - RNA, 19 nt, Human
ucuaagacagacaguugaa

SEQ ID NO: 461728 - RNA, 26 nt, Human
ucuacgacaaggacagccauucuggc

SEQ ID NO: 461729 - RNA, 23 nt, Human
ucugggccuccaggccccagccc

SEQ ID NO: 461730 - RNA, 24 nt, Human
ugaaagcauagggaggccauagcc

SEQ ID NO: 461731 - RNA, 22 nt, Human
ugacagagcaagacccugucuc

SEQ ID NO: 461732 - RNA, 24 nt, Human
ugagcaauauagugagacccuguc

SEQ ID NO: 461733 - RNA, 23 nt, Human
ugagcccaggaguucaagaccag

SEQ ID NO: 461734 - RNA, 24 nt, Human
ugaggcaggaggauugcuugaacc

SEQ ID NO: 461735 - RNA, 25 nt, Human
ugaggcaggaggauugcuugaaccc

SEQ ID NO: 461736 - RNA, 23 nt, Human
ugagggugcagugagcuaugauc

SEQ ID NO: 461737 - RNA, 19 nt, Human
ugcccagacuggccuggag

SEQ ID NO: 461738 - RNA, 23 nt, Human
ugcccagacuggccuggaggggc

SEQ ID NO: 461739 - RNA, 23 nt, Human
ugccuccugcucuggaaugcagc

SEQ ID NO: 461740 - RNA, 24 nt, Human
uggcgugcaccuguggucccagcu

SEQ ID NO: 461741 - RNA, 20 nt, Human
uggcucacacuuguaguucc

SEQ ID NO: 461742 - RNA, 22 nt, Human
uggcucacacuuguaguuccag

SEQ ID NO: 461743 - RNA, 23 nt, Human
uggcucacacuuguaguuccagc

SEQ ID NO: 461744 - RNA, 18 nt, Human
ugggaaggaacuuaggua

SEQ ID NO: 461745 - RNA, 19 nt, Human
ugggccuccaggccccagc

SEQ ID NO: 461746 - RNA, 22 nt, Human
ugggccuccaggccccagcccc

SEQ ID NO: 461747 - RNA, 19 nt, Human
uggggacauccccaggccc

SEQ ID NO: 461748 - RNA, 25 nt, Human
uggggacauccccaggcccagggcu

SEQ ID NO: 461749 - RNA, 24 nt, Human
ugguggcgugcaccugugguccca

SEQ ID NO: 461750 - RNA, 19 nt, Human
ugucaggacacaacacaga

SEQ ID NO: 461751 - RNA, 25 nt, Human
ugucucuaaaaacaacaaaaaaaag

SEQ ID NO: 461752 - RNA, 23 nt, Human
ugugguggcgugcaccugugguc

SEQ ID NO: 461753 - RNA, 22 nt, Human
uugagcccaggaguucaagacc

SEQ ID NO: 461754 - RNA, 24 nt, Human
uugcuugaacccaggagguugagg

SEQ ID NO: 461755 - RNA, 24 nt, Human
uugggccaggcgcgguggcucaca

SEQ ID NO: 461756 - RNA, 18 nt, Human
uuuuuuuuuuuuuuuucg

SEQ ID NO: 461757 - RNA, 19 nt, Human
uuuuuuuuuuuuuuuuucg

SEQ ID NO: 461758 - RNA, 18 nt, Human
agcaggugggacacuucc

SEQ ID NO: 461759 - RNA, 19 nt, Human
cagcaacaguaaaaaaaag

SEQ ID NO: 461760 - RNA, 19 nt, Human
cagugaagccaucugguug

SEQ ID NO: 461761 - RNA, 18 nt, Human
cgccguccgccaccggaa

SEQ ID NO: 461762 - RNA, 25 nt, Human
gcaacaguaaaaaaaaguaauuuac

SEQ ID NO: 461763 - RNA, 24 nt, Human
gccaccggaagaacacgucgacag

SEQ ID NO: 461764 - RNA, 20 nt, Human
uccgccaccggaagaacacg

SEQ ID NO: 461765 - RNA, 23 nt, Human
uucagugaagccaucugguuguu

SEQ ID NO: 461766 - RNA, 24 nt, Human
uuucagugaagccaucugguuguu

SEQ ID NO: 461767 - RNA, 21 nt, Human
aagcccagcagcuucuguaaa

SEQ ID NO: 461768 - RNA, 19 nt, Human
aaggaaggagaggauggca

SEQ ID NO: 461769 - RNA, 23 nt, Human
aaggucccggaagaacuccgcaa

SEQ ID NO: 461770 - RNA, 22 nt, Human
acacugaggaugacuacccagu

SEQ ID NO: 461771 - RNA, 18 nt, Human
accacuuucuucuuguca

SEQ ID NO: 461772 - RNA, 19 nt, Human
accaugccgcugcagaaug

SEQ ID NO: 461773 - RNA, 21 nt, Human
acugauuuugucuugcuucug

SEQ ID NO: 461774 - RNA, 20 nt, Human
agaaggaaggagaggauggc

SEQ ID NO: 461775 - RNA, 22 nt, Human
agacaggaaggccaagagggac

SEQ ID NO: 461776 - RNA, 21 nt, Human
agaggacagugaugcacacac

SEQ ID NO: 461777 - RNA, 23 nt, Human
agcaggcagggcaggccugggug

SEQ ID NO: 461778 - RNA, 22 nt, Human
agcauguaguagcagaccucuu

SEQ ID NO: 461779 - RNA, 21 nt, Human
agccagcaggcagugauggga

SEQ ID NO: 461780 - RNA, 22 nt, Human
agccccaggccccucccugggc

SEQ ID NO: 461781 - RNA, 18 nt, Human
aggaaguagccagcaggc

SEQ ID NO: 461782 - RNA, 23 nt, Human
aggagaaagaggaagauggccgg

SEQ ID NO: 461783 - RNA, 18 nt, Human
aggagaggauggcagcag

SEQ ID NO: 461784 - RNA, 24 nt, Human
aggcaacacgagcaggaccgagcc

SEQ ID NO: 461785 - RNA, 19 nt, Human
aggcaccagaucugggggg

SEQ ID NO: 461786 - RNA, 18 nt, Human
aggcagagaaggggcggc

SEQ ID NO: 461787 - RNA, 19 nt, Human
aggcaggcagggcagguag

SEQ ID NO: 461788 - RNA, 22 nt, Human
aggcaggcagggcagguagggu

SEQ ID NO: 461789 - RNA, 19 nt, Human
aggcagggcaggccugggu

SEQ ID NO: 461790 - RNA, 18 nt, Human
aggcgcgaugggaacaga

SEQ ID NO: 461791 - RNA, 18 nt, Human
aggcguggugggggugac

SEQ ID NO: 461792 - RNA, 23 nt, Human
aggcugcagguggagccagaaug

SEQ ID NO: 461793 - RNA, 24 nt, Human
agggagcaggccucgugcggguua

SEQ ID NO: 461794 - RNA, 22 nt, Human
agggaggaaggccugcucccag

SEQ ID NO: 461795 - RNA, 19 nt, Human
agguggguaggagccaggu

SEQ ID NO: 461796 - RNA, 19 nt, Human
agguggguaggagccaggu

SEQ ID NO: 461797 - RNA, 21 nt, Human
aggugguaugcaggagaaaga

SEQ ID NO: 461798 - RNA, 21 nt, Human
aggugguaugcaggagaaaga

SEQ ID NO: 461799 - RNA, 24 nt, Human
aguacugagugagccagacgaugc

SEQ ID NO: 461800 - RNA, 25 nt, Human
agucagcgccucgguagguccucga

SEQ ID NO: 461801 - RNA, 20 nt, Human
agugcaugagggucuguggg

SEQ ID NO: 461802 - RNA, 21 nt, Human
aguuggcagaggccgcaggcg

SEQ ID NO: 461803 - RNA, 19 nt, Human
aucagguacaugggccacc

SEQ ID NO: 461804 - RNA, 23 nt, Human
augcacaugcauacgcgccaaca

SEQ ID NO: 461805 - RNA, 25 nt, Human
augcacaugcauacgcgccaacacu

SEQ ID NO: 461806 - RNA, 21 nt, Human
augccggccuggaccacagau

SEQ ID NO: 461807 - RNA, 22 nt, Human
caaaggccccaucaugcucccc

SEQ ID NO: 461808 - RNA, 22 nt, Human
caaggcccaccauaccccacuc

SEQ ID NO: 461809 - RNA, 27 nt, Human
cacacucaugcacaugcauacgcgcca

SEQ ID NO: 461810 - RNA, 27 nt, Human
cacacucaugcacaugcauacgcggug

SEQ ID NO: 461811 - RNA, 21 nt, Human
caccacgaucccgggcauggc

SEQ ID NO: 461812 - RNA, 24 nt, Human
caccacggacaggaucacaaacca

SEQ ID NO: 461813 - RNA, 20 nt, Human
caccacuuucuucuugucau

SEQ ID NO: 461814 - RNA, 19 nt, Human
caccugcuccugccugggc

SEQ ID NO: 461815 - RNA, 23 nt, Human
cacuccacacccuuccccaucuu

SEQ ID NO: 461816 - RNA, 19 nt, Human
cacugcaggccaccucggc

SEQ ID NO: 461817 - RNA, 25 nt, Human
cacugcccacagaccagcgccgccg

SEQ ID NO: 461818 - RNA, 21 nt, Human
cagaggacggcuacugaacac

SEQ ID NO: 461819 - RNA, 19 nt, Human
cagccaccuuggcucuggg

SEQ ID NO: 461820 - RNA, 20 nt, Human
cagccauccaggccaguccc

SEQ ID NO: 461821 - RNA, 19 nt, Human
caggacccacccuggcaga

SEQ ID NO: 461822 - RNA, 19 nt, Human
caggcagugaugggaggca

SEQ ID NO: 461823 - RNA, 21 nt, Human
cagggcagguagggugggcag

SEQ ID NO: 461824 - RNA, 20 nt, Human
cagggcauccuugggggaca

SEQ ID NO: 461825 - RNA, 22 nt, Human
cagggggccggccagcaggcac

SEQ ID NO: 461826 - RNA, 22 nt, Human
cagggugggcaggggcucccag

SEQ ID NO: 461827 - RNA, 23 nt, Human
cagggugggcaggggcucccagg

SEQ ID NO: 461828 - RNA, 18 nt, Human
cagguagccgcggccgug

SEQ ID NO: 461829 - RNA, 22 nt, Human
caguggacagaggucuccagcc

SEQ ID NO: 461830 - RNA, 20 nt, Human
cagugugguaugggguggag

SEQ ID NO: 461831 - RNA, 20 nt, Human
cauacgcgccaacacuagca

SEQ ID NO: 461832 - RNA, 23 nt, Human
cauccugagccaagcccagcagc

SEQ ID NO: 461833 - RNA, 21 nt, Human
caugcacacccucccaccccg

SEQ ID NO: 461834 - RNA, 18 nt, Human
caugcacaugcauacgcg

SEQ ID NO: 461835 - RNA, 18 nt, Human
cauggagggcagucaggc

SEQ ID NO: 461836 - RNA, 21 nt, Human
cauggccuguccuggagcagg

SEQ ID NO: 461837 - RNA, 24 nt, Human
cauuagaggucccaggacccaccc

SEQ ID NO: 461838 - RNA, 19 nt, Human
ccaaacccagcaggggagg

SEQ ID NO: 461839 - RNA, 22 nt, Human
ccaagccugccccagccccaag

SEQ ID NO: 461840 - RNA, 19 nt, Human
ccaaggcccaccauacccc

SEQ ID NO: 461841 - RNA, 25 nt, Human
ccacacccuuccccaucuuucccca

SEQ ID NO: 461842 - RNA, 21 nt, Human
ccacccguaggcagccagggc

SEQ ID NO: 461843 - RNA, 21 nt, Human
ccacccuccucuggccccucc

SEQ ID NO: 461844 - RNA, 18 nt, Human
ccagaacacauccugagc

SEQ ID NO: 461845 - RNA, 21 nt, Human
ccagaacacauccugagccaa

SEQ ID NO: 461846 - RNA, 20 nt, Human
ccagcaggcaccagaucugg

SEQ ID NO: 461847 - RNA, 23 nt, Human
ccagcaggcagggcaggccuggg

SEQ ID NO: 461848 - RNA, 18 nt, Human
ccagcucccucugucagg

SEQ ID NO: 461849 - RNA, 24 nt, Human
ccaggugguaugcaggagaaagag

SEQ ID NO: 461850 - RNA, 19 nt, Human
ccagugugguauggggugg

SEQ ID NO: 461851 - RNA, 23 nt, Human
ccauccaggccagucccagcugu

SEQ ID NO: 461852 - RNA, 19 nt, Human
cccaccacccuuugggugg

SEQ ID NO: 461853 - RNA, 21 nt, Human
cccacuccacacccuucccca

SEQ ID NO: 461854 - RNA, 22 nt, Human
cccaggccccugggaggacagg

SEQ ID NO: 461855 - RNA, 19 nt, Human
cccagguagccgcggccgu

SEQ ID NO: 461856 - RNA, 19 nt, Human
cccauggccuguccuggag

SEQ ID NO: 461857 - RNA, 22 nt, Human
ccccacuccacacccuucccca

SEQ ID NO: 461858 - RNA, 21 nt, Human
ccccagccccaagccugaaac

SEQ ID NO: 461859 - RNA, 21 nt, Human
cccccuggcggggaguaggca

SEQ ID NO: 461860 - RNA, 18 nt, Human
ccccggauacugaucacc

SEQ ID NO: 461861 - RNA, 19 nt, Human
ccccggauacugaucacca

SEQ ID NO: 461862 - RNA, 21 nt, Human
ccccuggcugccuugggcccu

SEQ ID NO: 461863 - RNA, 20 nt, Human
ccccugggaggacaggcccg

SEQ ID NO: 461864 - RNA, 19 nt, Human
cccuccaggccccuggcug

SEQ ID NO: 461865 - RNA, 21 nt, Human
cccugcucagaggacggcuac

SEQ ID NO: 461866 - RNA, 24 nt, Human
cccugggugcccaggauugagccc

SEQ ID NO: 461867 - RNA, 18 nt, Human
cccuuguggcccagccag

SEQ ID NO: 461868 - RNA, 21 nt, Human
ccgcuucuggggaaacuccgg

SEQ ID NO: 461869 - RNA, 20 nt, Human
ccuauggggaccucaggcua

SEQ ID NO: 461870 - RNA, 25 nt, Human
ccucaaaggccccaucaugcucccc

SEQ ID NO: 461871 - RNA, 24 nt, Human
ccucaccucagcaggcccccuggc

SEQ ID NO: 461872 - RNA, 21 nt, Human
ccucuugguggcucucagcuu

SEQ ID NO: 461873 - RNA, 22 nt, Human
ccugaccccacccuccucuggc

SEQ ID NO: 461874 - RNA, 24 nt, Human
ccugcucccaggagggugcccagg

SEQ ID NO: 461875 - RNA, 20 nt, Human
ccuggcugccuugggcccug

SEQ ID NO: 461876 - RNA, 27 nt, Human
ccugugccugaggcuaaaccggggucc

SEQ ID NO: 461877 - RNA, 22 nt, Human
ccuuguggcccagccaggugcc

SEQ ID NO: 461878 - RNA, 21 nt, Human
cgcaucauggcaggagguaua

SEQ ID NO: 461879 - RNA, 22 nt, Human
cgccggaacaccacgaucccgg

SEQ ID NO: 461880 - RNA, 25 nt, Human
cgccucgguacacaccaguuuucca

SEQ ID NO: 461881 - RNA, 18 nt, Human
cgcgaugggaacagaugg

SEQ ID NO: 461882 - RNA, 21 nt, Human
cggagcagcaccaggccagca

SEQ ID NO: 461883 - RNA, 25 nt, Human
cggugcacacucaugcacaugcaua

SEQ ID NO: 461884 - RNA, 22 nt, Human
cuaaagcugagcuugucccugc

SEQ ID NO: 461885 - RNA, 20 nt, Human
cuaacugcuucccaaaccca

SEQ ID NO: 461886 - RNA, 21 nt, Human
cucagcagcgaugccugugcc

SEQ ID NO: 461887 - RNA, 23 nt, Human
cucagugggccuggugcucaccu

SEQ ID NO: 461888 - RNA, 20 nt, Human
cuccccacuccacacccuuc

SEQ ID NO: 461889 - RNA, 24 nt, Human
cucucagcuugacaaaggugcggc

SEQ ID NO: 461890 - RNA, 24 nt, Human
cugaagcucuguaugccucagcag

SEQ ID NO: 461891 - RNA, 22 nt, Human
cugcagccuugggggugggggg

SEQ ID NO: 461892 - RNA, 22 nt, Human
cugccgcugccggagcagcacc

SEQ ID NO: 461893 - RNA, 20 nt, Human
cugcucagaggacggcuacu

SEQ ID NO: 461894 - RNA, 22 nt, Human
cugcucccaggagggugcccag

SEQ ID NO: 461895 - RNA, 20 nt, Human
cuggccccuccaggccccug

SEQ ID NO: 461896 - RNA, 21 nt, Human
cuggcugccuugggcccugcu

SEQ ID NO: 461897 - RNA, 25 nt, Human
cugggcccggcuggccacgcaacug

SEQ ID NO: 461898 - RNA, 28 nt, Human
cuugcaagcccagaacacauccugagcc

SEQ ID NO: 461899 - RNA, 22 nt, Human
cuuggccccaccuccuaccaac

SEQ ID NO: 461900 - RNA, 19 nt, Human
gaaagaggaagauggccgg

SEQ ID NO: 461901 - RNA, 24 nt, Human
gaagcucuguaugccucagcaggg

SEQ ID NO: 461902 - RNA, 22 nt, Human
gacaugcccacauuagaggucc

SEQ ID NO: 461903 - RNA, 27 nt, Human
gaccccacccuccucuggccccuccag

SEQ ID NO: 461904 - RNA, 23 nt, Human
gacgaugcccacgauggcguaga

SEQ ID NO: 461905 - RNA, 18 nt, Human
gagaggcacaaggcagag

SEQ ID NO: 461906 - RNA, 24 nt, Human
gagcaccacggacaggaucacaaa

SEQ ID NO: 461907 - RNA, 20 nt, Human
gagcagggggugccagaaug

SEQ ID NO: 461908 - RNA, 24 nt, Human
gagccgggggccagaauucaggcc

SEQ ID NO: 461909 - RNA, 21 nt, Human
gaggaaggccugcucccagga

SEQ ID NO: 461910 - RNA, 21 nt, Human
gaggaugacuacccaguugca

SEQ ID NO: 461911 - RNA, 20 nt, Human
gaggcagcuugcccauggcc

SEQ ID NO: 461912 - RNA, 22 nt, Human
gaucccagccaccuuggcucug

SEQ ID NO: 461913 - RNA, 18 nt, Human
gauggcacaaugucaagg

SEQ ID NO: 461914 - RNA, 19 nt, Human
gcagcaggcaggcagggca

SEQ ID NO: 461915 - RNA, 20 nt, Human
gcagcaggcaggcagggcag

SEQ ID NO: 461916 - RNA, 20 nt, Human
gccccagaggccccuuccuu

SEQ ID NO: 461917 - RNA, 23 nt, Human
gcccgcugccgcugccgggggag

SEQ ID NO: 461918 - RNA, 19 nt, Human
gccugaggcuaaacugccc

SEQ ID NO: 461919 - RNA, 19 nt, Human
gccuggaccacagaugaga

SEQ ID NO: 461920 - RNA, 21 nt, Human
gcggcccaggucucgcccaaa

SEQ ID NO: 461921 - RNA, 21 nt, Human
gcggggggcuugcaagcccag

SEQ ID NO: 461922 - RNA, 24 nt, Human
gcuaaacugccccugggggucugu

SEQ ID NO: 461923 - RNA, 20 nt, Human
gcugcccaggcuccucccca

SEQ ID NO: 461924 - RNA, 21 nt, Human
gcuucuguaaacauguacagc

SEQ ID NO: 461925 - RNA, 19 nt, Human
ggacacaggcaacacgagc

SEQ ID NO: 461926 - RNA, 18 nt, Human
ggcaggcaccaggugccc

SEQ ID NO: 461927 - RNA, 19 nt, Human
ggcccagcucccucuguca

SEQ ID NO: 461928 - RNA, 24 nt, Human
ggccgaagagcaccacggacagga

SEQ ID NO: 461929 - RNA, 19 nt, Human
ggcucagugggccuggugc

SEQ ID NO: 461930 - RNA, 20 nt, Human
ggcugguggcucugcagagg

SEQ ID NO: 461931 - RNA, 21 nt, Human
ggcugguggcucugcagaggc

SEQ ID NO: 461932 - RNA, 22 nt, Human
gggagcaggccucgugcggguu

SEQ ID NO: 461933 - RNA, 23 nt, Human
gggaggcagcuugcccauggccu

SEQ ID NO: 461934 - RNA, 20 nt, Human
gggcagcaggcaggcagggc

SEQ ID NO: 461935 - RNA, 22 nt, Human
gggcagcaggcaggcagggcag

SEQ ID NO: 461936 - RNA, 24 nt, Human
gggcagccccagaggccccuuccu

SEQ ID NO: 461937 - RNA, 25 nt, Human
gggugccagaaugcccccauggagg

SEQ ID NO: 461938 - RNA, 21 nt, Human
gggugggcagccccagaggcc

SEQ ID NO: 461939 - RNA, 21 nt, Human
ggucuguccuuaaagcugccc

SEQ ID NO: 461940 - RNA, 22 nt, Human
ggucuguccuuaaagcugcccg

SEQ ID NO: 461941 - RNA, 25 nt, Human
ggugccccuccacggggaggcgcuc

SEQ ID NO: 461942 - RNA, 24 nt, Human
gguguguugguuccagaucccagg

SEQ ID NO: 461943 - RNA, 18 nt, Human
guagaagguaagccagga

SEQ ID NO: 461944 - RNA, 19 nt, Human
guccgcagguuacgcugcc

SEQ ID NO: 461945 - RNA, 18 nt, Human
gugaauucuugaggucga

SEQ ID NO: 461946 - RNA, 20 nt, Human
gugcagcaggcccauccuuc

SEQ ID NO: 461947 - RNA, 19 nt, Human
gugcaugagggucuguggg

SEQ ID NO: 461948 - RNA, 20 nt, Human
gugcugggcugaagcucugg

SEQ ID NO: 461949 - RNA, 20 nt, Human
gugcugggcugaagcucugu

SEQ ID NO: 461950 - RNA, 27 nt, Human
gugggcgcagaaggaaggagaggaugg

SEQ ID NO: 461951 - RNA, 19 nt, Human
uaaaaggccagacaucaag

SEQ ID NO: 461952 - RNA, 24 nt, Human
uacacaccaguuuuccaaaacggg

SEQ ID NO: 461953 - RNA, 19 nt, Human
uaccagugaucaugagagg

SEQ ID NO: 461954 - RNA, 24 nt, Human
uacgcgccaacacuagcaugcaca

SEQ ID NO: 461955 - RNA, 20 nt, Human
uacugugggcgcagaaggaa

SEQ ID NO: 461956 - RNA, 21 nt, Human
uaggacgaggucaucacugcc

SEQ ID NO: 461957 - RNA, 21 nt, Human
uaggcaaagcacuugaggguc

SEQ ID NO: 461958 - RNA, 18 nt, Human
uaggcgauuucugaguag

SEQ ID NO: 461959 - RNA, 24 nt, Human
uagggugggcagccccagaggccc

SEQ ID NO: 461960 - RNA, 18 nt, Human
uaguacugagugagccag

SEQ ID NO: 461961 - RNA, 18 nt, Human
uauauuaauuugucucuc

SEQ ID NO: 461962 - RNA, 23 nt, Human
ucaaaggccccaucaugcucccc

SEQ ID NO: 461963 - RNA, 20 nt, Human
ucaaggucccggaagaacuc

SEQ ID NO: 461964 - RNA, 23 nt, Human
ucacagcagugcccaccacccuu

SEQ ID NO: 461965 - RNA, 22 nt, Human
ucccagccaccuuggcucuggg

SEQ ID NO: 461966 - RNA, 18 nt, Human
ucccagccccaggccccu

SEQ ID NO: 461967 - RNA, 22 nt, Human
ucccagccccaggccccucccu

SEQ ID NO: 461968 - RNA, 22 nt, Human
ucccagcuguguggggagccgg

SEQ ID NO: 461969 - RNA, 25 nt, Human
ucccaggacagccauccaggccagu

SEQ ID NO: 461970 - RNA, 21 nt, Human
ucccaggacccacccuggcag

SEQ ID NO: 461971 - RNA, 19 nt, Human
ucccaggagggugcccagg

SEQ ID NO: 461972 - RNA, 18 nt, Human
ucccugggcaguggacag

SEQ ID NO: 461973 - RNA, 19 nt, Human
ucccugggcaguggacaga

SEQ ID NO: 461974 - RNA, 20 nt, Human
ucuguaaacauguacagcac

SEQ ID NO: 461975 - RNA, 22 nt, Human
ucuguaugccucagcagggcca

SEQ ID NO: 461976 - RNA, 19 nt, Human
ucugugcugggcugaagcu

SEQ ID NO: 461977 - RNA, 22 nt, Human
ucuuccucgauggugacuccag

SEQ ID NO: 461978 - RNA, 20 nt, Human
ugaacacaugauugggcggg

SEQ ID NO: 461979 - RNA, 19 nt, Human
ugacaaaggugcggcccgu

SEQ ID NO: 461980 - RNA, 22 nt, Human
ugacuccaggggcgaaccgcgg

SEQ ID NO: 461981 - RNA, 22 nt, Human
ugaggaugacuacccaguugca

SEQ ID NO: 461982 - RNA, 26 nt, Human
ugaggggaggcccagcucccucuguc

SEQ ID NO: 461983 - RNA, 19 nt, Human
ugcagcaggcccauccuuc

SEQ ID NO: 461984 - RNA, 18 nt, Human
ugcaggagaaagaggaag

SEQ ID NO: 461985 - RNA, 22 nt, Human
ugcagucagcgccucgguacac

SEQ ID NO: 461986 - RNA, 23 nt, Human
ugcauacgcgccaacacuagcau

SEQ ID NO: 461987 - RNA, 18 nt, Human
ugcccccauggagggcag

SEQ ID NO: 461988 - RNA, 18 nt, Human
ugccggagcagcaccagg

SEQ ID NO: 461989 - RNA, 21 nt, Human
ugccuaggcguggugggggug

SEQ ID NO: 461990 - RNA, 18 nt, Human
ugcugggcugaagcucug

SEQ ID NO: 461991 - RNA, 19 nt, Human
uggaggagggagacgugca

SEQ ID NO: 461992 - RNA, 21 nt, Human
uggaggagggagacgugcagc

SEQ ID NO: 461993 - RNA, 25 nt, Human
uggcagaggaggaauuaaaaggcca

SEQ ID NO: 461994 - RNA, 18 nt, Human
uggcagaggccgcaggcg

SEQ ID NO: 461995 - RNA, 24 nt, Human
uggcaggcugggaggggcagcagg

SEQ ID NO: 461996 - RNA, 18 nt, Human
uggcauuacagccacagc

SEQ ID NO: 461997 - RNA, 23 nt, Human
uggccuguccuggagcagggggu

SEQ ID NO: 461998 - RNA, 22 nt, Human
uggcugcagccuuggggguggg

SEQ ID NO: 461999 - RNA, 22 nt, Human
ugggacaggaccaucuccugcu

SEQ ID NO: 462000 - RNA, 22 nt, Human
ugggcugccccugggugcccag

SEQ ID NO: 462001 - RNA, 20 nt, Human
uggggguccuaagcugaggu

SEQ ID NO: 462002 - RNA, 20 nt, Human
ugggggugggagggaggaag

SEQ ID NO: 462003 - RNA, 23 nt, Human
ugggggugggagggaggaaggcc

SEQ ID NO: 462004 - RNA, 23 nt, Human
uggguaggagccagguuaggggu

SEQ ID NO: 462005 - RNA, 19 nt, Human
ugggugcccaggauugagc

SEQ ID NO: 462006 - RNA, 19 nt, Human
ugguaugcaggagaaagag

SEQ ID NO: 462007 - RNA, 21 nt, Human
ugguguggcugcagccuuggg

SEQ ID NO: 462008 - RNA, 21 nt, Human
ugguuccagaucccagggccc

SEQ ID NO: 462009 - RNA, 22 nt, Human
uguaaacauguacagcacugca

SEQ ID NO: 462010 - RNA, 22 nt, Human
ugucaaggucccggaagaacuc

SEQ ID NO: 462011 - RNA, 19 nt, Human
ugucagggugggcaggggc

SEQ ID NO: 462012 - RNA, 18 nt, Human
uguccuggagcagggggu

SEQ ID NO: 462013 - RNA, 18 nt, Human
uguguggggagccggggg

SEQ ID NO: 462014 - RNA, 20 nt, Human
uguguggggagccgggggcc

SEQ ID NO: 462015 - RNA, 21 nt, Human
uguguggggagccgggggcca

SEQ ID NO: 462016 - RNA, 23 nt, Human
uuaggggugggcugccccugggu

SEQ ID NO: 462017 - RNA, 21 nt, Human
uucugugcugggcugaagcuc

SEQ ID NO: 462018 - RNA, 19 nt, Human
uucuugauguacucagcug

SEQ ID NO: 462019 - RNA, 21 nt, Human
uucuuggcaggcugggagggg

SEQ ID NO: 462020 - RNA, 19 nt, Human
uugguuccgcggcccaggu

SEQ ID NO: 462021 - RNA, 23 nt, Human
uuuggguggugaggauccuuggg

SEQ ID NO: 462022 - RNA, 23 nt, Human
aaaagcaaauuccuggaagaagc

SEQ ID NO: 462023 - RNA, 27 nt, Human
aaaagcaaauuccuggaagaagcagag

SEQ ID NO: 462024 - RNA, 28 nt, Human
aaaagcaaauuccuggaagaagcagaga

SEQ ID NO: 462025 - RNA, 22 nt, Human
aaagcaaauuccuggaagaagc

SEQ ID NO: 462026 - RNA, 27 nt, Human
aaagcaaauuccuggaagaagcagaga

SEQ ID NO: 462027 - RNA, 21 nt, Human
aagaaacucuaauucuaagac

SEQ ID NO: 462028 - RNA, 19 nt, Human
aagaagcagagaaauaggc

SEQ ID NO: 462029 - RNA, 21 nt, Human
acacauucucaccucuuugcc

SEQ ID NO: 462030 - RNA, 24 nt, Human
acagaaccuggcagccccuauacu

SEQ ID NO: 462031 - RNA, 21 nt, Human
acagccccccggcagccucag

SEQ ID NO: 462032 - RNA, 20 nt, Human
acauucucaccucuuugccc

SEQ ID NO: 462033 - RNA, 27 nt, Human
acuaauaaaagcaaauuccuggaagaa

SEQ ID NO: 462034 - RNA, 24 nt, Human
agcccacagccccccggcagccuc

SEQ ID NO: 462035 - RNA, 22 nt, Human
agccccccggcagccucagccu

SEQ ID NO: 462036 - RNA, 21 nt, Human
agcuauaggaaaagaagcaca

SEQ ID NO: 462037 - RNA, 22 nt, Human
aggcgccggcggcccgguagcc

SEQ ID NO: 462038 - RNA, 20 nt, Human
auggaaggacuugguccaca

SEQ ID NO: 462039 - RNA, 22 nt, Human
auggagacacagaaccuggcag

SEQ ID NO: 462040 - RNA, 21 nt, Human
caaaaaaggucuauaaguuaa

SEQ ID NO: 462041 - RNA, 23 nt, Human
caaaguaguaaaaaacaauggcc

SEQ ID NO: 462042 - RNA, 20 nt, Human
cacagcaagucacuacggca

SEQ ID NO: 462043 - RNA, 20 nt, Human
cacagcaagucacuacggca

SEQ ID NO: 462044 - RNA, 20 nt, Human
cacagccccccggcagccuc

SEQ ID NO: 462045 - RNA, 19 nt, Human
cacgugcagacaugcugca

SEQ ID NO: 462046 - RNA, 24 nt, Human
cagcugaaaggagguaaaggucag

SEQ ID NO: 462047 - RNA, 24 nt, Human
ccacagccccccggcagccucagc

SEQ ID NO: 462048 - RNA, 19 nt, Human
ccagacaagaucucuaagc

SEQ ID NO: 462049 - RNA, 26 nt, Human
cccacagccccccggcagccucagcc

SEQ ID NO: 462050 - RNA, 23 nt, Human
ccggcggcccgguagcccacagc

SEQ ID NO: 462051 - RNA, 23 nt, Human
ccucuuugcccuccuguuaaagg

SEQ ID NO: 462052 - RNA, 22 nt, Human
cuauaggaaaagaagcacauau

SEQ ID NO: 462053 - RNA, 21 nt, Human
cuugagaaaucaaugaaucaa

SEQ ID NO: 462054 - RNA, 21 nt, Human
cuugguccacagcaagucacu

SEQ ID NO: 462055 - RNA, 25 nt, Human
gacacagaaccuggcagccccuaua

SEQ ID NO: 462056 - RNA, 18 nt, Human
gaggcgccggcggcccgg

SEQ ID NO: 462057 - RNA, 23 nt, Human
gcaaauuccuggaagaagcagag

SEQ ID NO: 462058 - RNA, 22 nt, Human
ggauaaugucccugggcucuuu

SEQ ID NO: 462059 - RNA, 24 nt, Human
ggcagccucagccucgaggcuccu

SEQ ID NO: 462060 - RNA, 18 nt, Human
ggcccgguagcccacagc

SEQ ID NO: 462061 - RNA, 24 nt, Human
gguaaaggucagguuccuguuuau

SEQ ID NO: 462062 - RNA, 19 nt, Human
guccacagcaagucacuac

SEQ ID NO: 462063 - RNA, 27 nt, Human
guguaugcaugcacacgugcagacaug

SEQ ID NO: 462064 - RNA, 18 nt, Human
uaaaugaaagaguuagac

SEQ ID NO: 462065 - RNA, 19 nt, Human
uagacuguaauggauaaug

SEQ ID NO: 462066 - RNA, 21 nt, Human
uagcccacagccccccggcag

SEQ ID NO: 462067 - RNA, 20 nt, Human
uagguauccuggcaccuguu

SEQ ID NO: 462068 - RNA, 18 nt, Human
ugaaacagcugaaaggag

SEQ ID NO: 462069 - RNA, 20 nt, Human
ugaaacagcugaaaggaggu

SEQ ID NO: 462070 - RNA, 18 nt, Human
ugaaaggagguaaagguc

SEQ ID NO: 462071 - RNA, 19 nt, Human
ugagaaaucaaugaaucaa

SEQ ID NO: 462072 - RNA, 23 nt, Human
uggcagccccuauacuugacuaa

SEQ ID NO: 462073 - RNA, 21 nt, Human
uggcuuggaaaucaggucugc

SEQ ID NO: 462074 - RNA, 20 nt, Human
ugggaaggagccccuggagc

SEQ ID NO: 462075 - RNA, 22 nt, Human
uguaugcaugcacacgugcagu

SEQ ID NO: 462076 - RNA, 21 nt, Human
ugucaacccgguguguaugca

SEQ ID NO: 462077 - RNA, 19 nt, Human
uuaaaggcuugaauacaaa

SEQ ID NO: 462078 - RNA, 21 nt, Human
uuccuggaagaagcagagaaa

SEQ ID NO: 462079 - RNA, 18 nt, Human
uuucacauaauccauacu

SEQ ID NO: 462080 - RNA, 24 nt, Human
uuuuuuuuuuuuaacacauucuca

SEQ ID NO: 462081 - RNA, 24 nt, Human
aaaaaacaacaacaacaaaaaccc

SEQ ID NO: 462082 - RNA, 23 nt, Human
aaaaagccaguuauccaauaaug

SEQ ID NO: 462083 - RNA, 19 nt, Human
aaaacaaacaaacaaaaaa

SEQ ID NO: 462084 - RNA, 18 nt, Human
aaaacuauguggugaaaa

SEQ ID NO: 462085 - RNA, 22 nt, Human
aaacaaaaaacaacaacaacaa

SEQ ID NO: 462086 - RNA, 24 nt, Human
aaacaaacaaaaaacaacaacaac

SEQ ID NO: 462087 - RNA, 21 nt, Human
aaacaacaacaacaaaaaccc

SEQ ID NO: 462088 - RNA, 21 nt, Human
aaacccagcaaaacccaguca

SEQ ID NO: 462089 - RNA, 20 nt, Human
aaacucgaaaauagaaggua

SEQ ID NO: 462090 - RNA, 27 nt, Human
aacaaacaaacaaaaaacaacaacaac

SEQ ID NO: 462091 - RNA, 20 nt, Human
aacaacaaaaacccugaaaa

SEQ ID NO: 462092 - RNA, 22 nt, Human
aacaacaacaacaaaaacccug

SEQ ID NO: 462093 - RNA, 18 nt, Human
aacccagcaaaacccagu

SEQ ID NO: 462094 - RNA, 19 nt, Human
aagaggcacccacaacccc

SEQ ID NO: 462095 - RNA, 24 nt, Human
acaacaacaacaaaaacccugaaa

SEQ ID NO: 462096 - RNA, 25 nt, Human
accaaaacaaacaaacaaaaaacaa

SEQ ID NO: 462097 - RNA, 23 nt, Human
acccacaaccccagcccuaguuc

SEQ ID NO: 462098 - RNA, 23 nt, Human
acccagcaaaacccagucaguuc

SEQ ID NO: 462099 - RNA, 23 nt, Human
acccugaaaauuaucuugaaagu

SEQ ID NO: 462100 - RNA, 23 nt, Human
agaaaaucugcuuuuugugaaaa

SEQ ID NO: 462101 - RNA, 22 nt, Human
agacacagcagauacccagaua

SEQ ID NO: 462102 - RNA, 21 nt, Human
agcggucccacagcccggagc

SEQ ID NO: 462103 - RNA, 25 nt, Human
aggaagaaaaaagccaguuauccaa

SEQ ID NO: 462104 - RNA, 19 nt, Human
aggcacccacaaccccagc

SEQ ID NO: 462105 - RNA, 18 nt, Human
aggcagauuuauuuuuau

SEQ ID NO: 462106 - RNA, 23 nt, Human
auuuuuauuguuacauuccaaag

SEQ ID NO: 462107 - RNA, 19 nt, Human
caaaacaaacaaacaaaaa

SEQ ID NO: 462108 - RNA, 26 nt, Human
caaacaaaaaacaacaacaacaaaaa

SEQ ID NO: 462109 - RNA, 23 nt, Human
caaacaaacaaaaaacaacaaca

SEQ ID NO: 462110 - RNA, 23 nt, Human
caacaaaaacccugaaaauuauc

SEQ ID NO: 462111 - RNA, 20 nt, Human
caaccccagcccuaguucaa

SEQ ID NO: 462112 - RNA, 20 nt, Human
cacaaccccagcccuaguuc

SEQ ID NO: 462113 - RNA, 19 nt, Human
caccaaaacaaacaaacaa

SEQ ID NO: 462114 - RNA, 19 nt, Human
cacccacaaccccagcccu

SEQ ID NO: 462115 - RNA, 20 nt, Human
cagauaauacagucagugca

SEQ ID NO: 462116 - RNA, 20 nt, Human
caggcacaggcuugggaccc

SEQ ID NO: 462117 - RNA, 18 nt, Human
caggcuugggacccggcu

SEQ ID NO: 462118 - RNA, 23 nt, Human
cagucaguucuuuccaguugucu

SEQ ID NO: 462119 - RNA, 20 nt, Human
ccacaaccccagcccuaguu

SEQ ID NO: 462120 - RNA, 27 nt, Human
ccacaaccccagcccuaguucaaagcu

SEQ ID NO: 462121 - RNA, 21 nt, Human
ccagcggucccacagcccgga

SEQ ID NO: 462122 - RNA, 23 nt, Human
ccagcggucccacagcccggagc

SEQ ID NO: 462123 - RNA, 19 nt, Human
ccaggcaucccuccccucu

SEQ ID NO: 462124 - RNA, 21 nt, Human
cccacagcccggagcccccgc

SEQ ID NO: 462125 - RNA, 21 nt, Human
cccaccaaaacaaacaaacaa

SEQ ID NO: 462126 - RNA, 25 nt, Human
cccaccaaaacaaacaaacaaaaaa

SEQ ID NO: 462127 - RNA, 18 nt, Human
cccccgcgaccggcuccc

SEQ ID NO: 462128 - RNA, 20 nt, Human
cccuccccucucccaccaaa

SEQ ID NO: 462129 - RNA, 20 nt, Human
cucccggcucgggcucaggc

SEQ ID NO: 462130 - RNA, 25 nt, Human
gaggacagaggaagaaaaaagccag

SEQ ID NO: 462131 - RNA, 22 nt, Human
gcccggagcccccgcgaccggc

SEQ ID NO: 462132 - RNA, 19 nt, Human
ggcccagcggucccacagc

SEQ ID NO: 462133 - RNA, 25 nt, Human
guuaacaagaaaaaaaaaucaagca

SEQ ID NO: 462134 - RNA, 22 nt, Human
uaaaaugaaacccagcaaaacc

SEQ ID NO: 462135 - RNA, 28 nt, Human
uaaagguacuagaagaugaguaagacca

SEQ ID NO: 462136 - RNA, 21 nt, Human
uacaugaagaaaaucugcuuu

SEQ ID NO: 462137 - RNA, 20 nt, Human
uauguggugaaaaagagagu

SEQ ID NO: 462138 - RNA, 18 nt, Human
ucagaagaggcacccaca

SEQ ID NO: 462139 - RNA, 18 nt, Human
ucaguucuuuccaguuga

SEQ ID NO: 462140 - RNA, 21 nt, Human
uccagguaaaggacuucaaga

SEQ ID NO: 462141 - RNA, 26 nt, Human
ucccuccccucucccaccaaaacaaa

SEQ ID NO: 462142 - RNA, 18 nt, Human
ugacaaauguguauauau

SEQ ID NO: 462143 - RNA, 21 nt, Human
ugaguaagaccacacacacca

SEQ ID NO: 462144 - RNA, 24 nt, Human
ugaguaagaccacacacaccaaga

SEQ ID NO: 462145 - RNA, 24 nt, Human
ugcaaaagucaaaugaguaaguca

SEQ ID NO: 462146 - RNA, 18 nt, Human
uggagcucaaacagcugc

SEQ ID NO: 462147 - RNA, 20 nt, Human
uggagcucaaacagcugccu

SEQ ID NO: 462148 - RNA, 18 nt, Human
uggcugacuuugagcugu

SEQ ID NO: 462149 - RNA, 18 nt, Human
ugugcuuuuaaaaauguc

SEQ ID NO: 462150 - RNA, 19 nt, Human
ugugcuuuuaaaaaugucu

SEQ ID NO: 462151 - RNA, 19 nt, Human
uguggugaaaaagagagug

SEQ ID NO: 462152 - RNA, 18 nt, Human
uguuucuuucuagucacc

SEQ ID NO: 462153 - RNA, 24 nt, Human
uuacguuaacaagaaaaaaaaauc

SEQ ID NO: 462154 - RNA, 22 nt, Human
uuccagguaaaggacuucaaga

SEQ ID NO: 462155 - RNA, 24 nt, Human
aaacaaaaugucacucauguacaa

SEQ ID NO: 462156 - RNA, 18 nt, Human
aaacucccagccuccacc

SEQ ID NO: 462157 - RNA, 19 nt, Human
accuagauccucagggcuc

SEQ ID NO: 462158 - RNA, 22 nt, Human
agauacuggugguuauuugacu

SEQ ID NO: 462159 - RNA, 19 nt, Human
agccccaaacucccagccu

SEQ ID NO: 462160 - RNA, 20 nt, Human
agccccaaacucccagccuc

SEQ ID NO: 462161 - RNA, 23 nt, Human
caacaggugccuuccugcugcuu

SEQ ID NO: 462162 - RNA, 26 nt, Human
cacccacagccccaaacucccagccu

SEQ ID NO: 462163 - RNA, 24 nt, Human
cacucauguacaacuaggcuuuau

SEQ ID NO: 462164 - RNA, 18 nt, Human
cacucuguauaacucucc

SEQ ID NO: 462165 - RNA, 21 nt, Human
cacucuguauaacucuccucg

SEQ ID NO: 462166 - RNA, 20 nt, Human
cagaggauccacccacagcc

SEQ ID NO: 462167 - RNA, 26 nt, Human
cagaggauccacccacagccccaaac

SEQ ID NO: 462168 - RNA, 20 nt, Human
cagccccaaacucccagccu

SEQ ID NO: 462169 - RNA, 20 nt, Human
cagccuccaccucagccuca

SEQ ID NO: 462170 - RNA, 22 nt, Human
cagggcccuggcagggagcccc

SEQ ID NO: 462171 - RNA, 21 nt, Human
ccagccuccaccucagccuca

SEQ ID NO: 462172 - RNA, 23 nt, Human
cccaaacucccagccuccaccuc

SEQ ID NO: 462173 - RNA, 21 nt, Human
cccagccuccaccucagccuc

SEQ ID NO: 462174 - RNA, 25 nt, Human
cccagccuccaccucagccucaggc

SEQ ID NO: 462175 - RNA, 22 nt, Human
ccucacaacaggugccuuccug

SEQ ID NO: 462176 - RNA, 20 nt, Human
ccucagccucaggcuccuuc

SEQ ID NO: 462177 - RNA, 25 nt, Human
ccucaggcuccuucugacaguuggg

SEQ ID NO: 462178 - RNA, 19 nt, Human
ccuucagaggauccaccca

SEQ ID NO: 462179 - RNA, 21 nt, Human
cuaggcuuuaugggaaggugg

SEQ ID NO: 462180 - RNA, 23 nt, Human
cucagccucaggcuccuucugac

SEQ ID NO: 462181 - RNA, 20 nt, Human
cucccagccuccaccucagc

SEQ ID NO: 462182 - RNA, 23 nt, Human
cucccagccuccaccucagccuc

SEQ ID NO: 462183 - RNA, 26 nt, Human
cucuuccacggaagaggcaucuuaaa

SEQ ID NO: 462184 - RNA, 22 nt, Human
gaggugaaacaaaaugucacuc

SEQ ID NO: 462185 - RNA, 19 nt, Human
gcccuggcagggagcccca

SEQ ID NO: 462186 - RNA, 19 nt, Human
ggaagguggcagaguggcu

SEQ ID NO: 462187 - RNA, 19 nt, Human
uauuaagaggugaaacaaa

SEQ ID NO: 462188 - RNA, 22 nt, Human
ucaggcuccuucugacaguugg

SEQ ID NO: 462189 - RNA, 19 nt, Human
uccacccacagccccaaac

SEQ ID NO: 462190 - RNA, 19 nt, Human
ucccagccuccaccucagc

SEQ ID NO: 462191 - RNA, 20 nt, Human
ugggaagguggcagaguggc

SEQ ID NO: 462192 - RNA, 22 nt, Human
ugggaagguggcagaguggcug

SEQ ID NO: 462193 - RNA, 18 nt, Human
uuaccuagauccucaggg

SEQ ID NO: 462194 - RNA, 23 nt, Human
uuuaccauguuuauucuuuaccu

SEQ ID NO: 462195 - RNA, 22 nt, Human
aaaaaaaaaccaaccaaacaaa

SEQ ID NO: 462196 - RNA, 24 nt, Human
aaaaaagcacugaaagagacagac

SEQ ID NO: 462197 - RNA, 26 nt, Human
aaaaccaaccaaacaaacaaaaaagc

SEQ ID NO: 462198 - RNA, 21 nt, Human
aaaaggcacugaggccgggcg

SEQ ID NO: 462199 - RNA, 24 nt, Human
aacacuuugggaggccaagguggg

SEQ ID NO: 462200 - RNA, 23 nt, Human
aacagagugagacugucucaaaa

SEQ ID NO: 462201 - RNA, 20 nt, Human
aacaugguuaaaccccgucu

SEQ ID NO: 462202 - RNA, 21 nt, Human
aacaugguuaaaccccgucuc

SEQ ID NO: 462203 - RNA, 21 nt, Human
aaccaaacaaacaaaaaagca

SEQ ID NO: 462204 - RNA, 26 nt, Human
aaccaaacaaacaaaaaagcacugaa

SEQ ID NO: 462205 - RNA, 20 nt, Human
aagagggaccaggccuagcg

SEQ ID NO: 462206 - RNA, 21 nt, Human
aaggcugacccagucagcacu

SEQ ID NO: 462207 - RNA, 24 nt, Human
accaaacaaacaaaaaagcacuga

SEQ ID NO: 462208 - RNA, 24 nt, Human
accccgucucuacuaaaaauacaa

SEQ ID NO: 462209 - RNA, 24 nt, Human
acgccacugcacuccagccugggc

SEQ ID NO: 462210 - RNA, 24 nt, Human
acgccacugcacuccagccugggc

SEQ ID NO: 462211 - RNA, 24 nt, Human
acuccagccugggcaacagaguga

SEQ ID NO: 462212 - RNA, 24 nt, Human
acugcacuccagccugggcaacag

SEQ ID NO: 462213 - RNA, 24 nt, Human
acugcacuccagccugggcaacag

SEQ ID NO: 462214 - RNA, 23 nt, Human
agccgggcaugguggcgggugcc

SEQ ID NO: 462215 - RNA, 22 nt, Human
agccugggcaacagagugagac

SEQ ID NO: 462216 - RNA, 22 nt, Human
agcuauuaagagaaucauacag

SEQ ID NO: 462217 - RNA, 19 nt, Human
aggaagagggaccaggccu

SEQ ID NO: 462218 - RNA, 18 nt, Human
aggcaggagaauggugug

SEQ ID NO: 462219 - RNA, 24 nt, Human
aggcaggagaauggugugaacccg

SEQ ID NO: 462220 - RNA, 21 nt, Human
aggccaagguggguggaucac

SEQ ID NO: 462221 - RNA, 21 nt, Human
aggcggaacuugcagugagcc

SEQ ID NO: 462222 - RNA, 24 nt, Human
aggcggaacuugcagugagccgag

SEQ ID NO: 462223 - RNA, 19 nt, Human
aggcugaggcaggagaaug

SEQ ID NO: 462224 - RNA, 24 nt, Human
agguggguggaucacgaggucaag

SEQ ID NO: 462225 - RNA, 24 nt, Human
aucacgccacugcacuccagccug

SEQ ID NO: 462226 - RNA, 22 nt, Human
aucccaacacuuugggaggcca

SEQ ID NO: 462227 - RNA, 19 nt, Human
augugauggcagugauggu

SEQ ID NO: 462228 - RNA, 22 nt, Human
caaaaaagcacugaaagagaca

SEQ ID NO: 462229 - RNA, 20 nt, Human
caaacaaacaaaaaagcacu

SEQ ID NO: 462230 - RNA, 21 nt, Human
caaacaaacaaaaaagcacug

SEQ ID NO: 462231 - RNA, 24 nt, Human
caacacuuugggaggccaaggugg

SEQ ID NO: 462232 - RNA, 22 nt, Human
caacagagugagacugucucag

SEQ ID NO: 462233 - RNA, 24 nt, Human
caacaugguuaaaccccgucucua

SEQ ID NO: 462234 - RNA, 24 nt, Human
caagguggguggaucacgagguca

SEQ ID NO: 462235 - RNA, 24 nt, Human
cacgccuguaaucccaacacuuug

SEQ ID NO: 462236 - RNA, 20 nt, Human
cacuaaaaacaggauuaaug

SEQ ID NO: 462237 - RNA, 22 nt, Human
cacuccagccugggcaacagag

SEQ ID NO: 462238 - RNA, 22 nt, Human
cacuccagccugggcaacagag

SEQ ID NO: 462239 - RNA, 24 nt, Human
cacuccagccugggcaacagagug

SEQ ID NO: 462240 - RNA, 19 nt, Human
cacugcacuccagccuggg

SEQ ID NO: 462241 - RNA, 21 nt, Human
cacugcacuccagccugggca

SEQ ID NO: 462242 - RNA, 22 nt, Human
cacugcacuccagccugggcaa

SEQ ID NO: 462243 - RNA, 23 nt, Human
cacugcacuccagccugggcaac

SEQ ID NO: 462244 - RNA, 24 nt, Human
cacugcacuccagccugggcaaca

SEQ ID NO: 462245 - RNA, 18 nt, Human
cagcaucauuauauuacu

SEQ ID NO: 462246 - RNA, 24 nt, Human
cagcuacucgggaggcugaggcag

SEQ ID NO: 462247 - RNA, 22 nt, Human
caguaaaaccuguucagacagc

SEQ ID NO: 462248 - RNA, 22 nt, Human
caugguggcgggugccuguagu

SEQ ID NO: 462249 - RNA, 18 nt, Human
caugguuaaaccccgucu

SEQ ID NO: 462250 - RNA, 18 nt, Human
ccaaacaaacaaaaaagc

SEQ ID NO: 462251 - RNA, 24 nt, Human
ccaaacaaacaaaaaagcacugaa

SEQ ID NO: 462252 - RNA, 21 nt, Human
ccaaccaaacaaacaaaaaag

SEQ ID NO: 462253 - RNA, 20 nt, Human
ccacugcacuccagccuggg

SEQ ID NO: 462254 - RNA, 20 nt, Human
ccacugcacuccagccuggg

SEQ ID NO: 462255 - RNA, 21 nt, Human
ccacugcacuccagccugggc

SEQ ID NO: 462256 - RNA, 23 nt, Human
ccacugcacuccagccugggcaa

SEQ ID NO: 462257 - RNA, 24 nt, Human
ccacugcacuccagccugggcaac

SEQ ID NO: 462258 - RNA, 23 nt, Human
ccuggccaacaugguuaaacccc

SEQ ID NO: 462259 - RNA, 24 nt, Human
ccuggccaacaugguuaaaccccg

SEQ ID NO: 462260 - RNA, 21 nt, Human
ccuguagugccagcuacucgg

SEQ ID NO: 462261 - RNA, 24 nt, Human
cgagaccauccuggccaacauggu

SEQ ID NO: 462262 - RNA, 24 nt, Human
cgagaucacgccacugcacuccag

SEQ ID NO: 462263 - RNA, 24 nt, Human
cgccacugcacuccagccugggca

SEQ ID NO: 462264 - RNA, 23 nt, Human
cgccuguaaucccaacacuuugg

SEQ ID NO: 462265 - RNA, 24 nt, Human
cgccuguaaucccaacacuuuggg

SEQ ID NO: 462266 - RNA, 28 nt, Human
cgggcaugguggcgggugccuguagugc

SEQ ID NO: 462267 - RNA, 20 nt, Human
cgucaaggcgcaugcgcgca

SEQ ID NO: 462268 - RNA, 24 nt, Human
cuaaaaauacaaaaaaaauagccg

SEQ ID NO: 462269 - RNA, 22 nt, Human
cucacgccuguaaucccaacac

SEQ ID NO: 462270 - RNA, 24 nt, Human
cucacgccuguaaucccaacacuu

SEQ ID NO: 462271 - RNA, 19 nt, Human
cuugcagugagccgagauc

SEQ ID NO: 462272 - RNA, 18 nt, Human
gaaagagacagacuccag

SEQ ID NO: 462273 - RNA, 23 nt, Human
gaaagcaagcaguaaaaccuguu

SEQ ID NO: 462274 - RNA, 19 nt, Human
gacugucucaaaaaaaaac

SEQ ID NO: 462275 - RNA, 24 nt, Human
gcacuccagccugggcaacagagu

SEQ ID NO: 462276 - RNA, 24 nt, Human
gccaacaugguuaaaccccgucuc

SEQ ID NO: 462277 - RNA, 22 nt, Human
gccacugcacuccagccugggc

SEQ ID NO: 462278 - RNA, 24 nt, Human
gccacugcacuccagccugggcaa

SEQ ID NO: 462279 - RNA, 20 nt, Human
gccgagaucacgccacugca

SEQ ID NO: 462280 - RNA, 22 nt, Human
ggcacugaggccgggcgcggug

SEQ ID NO: 462281 - RNA, 23 nt, Human
ggcgcgguggcucacgccuguaa

SEQ ID NO: 462282 - RNA, 18 nt, Human
gguggaucacgaggucaa

SEQ ID NO: 462283 - RNA, 23 nt, Human
gguggcucacgccuguaauccca

SEQ ID NO: 462284 - RNA, 22 nt, Human
guuaaaaaaggcacugaggccg

SEQ ID NO: 462285 - RNA, 23 nt, Human
uaauguauagcuauuaagagaau

SEQ ID NO: 462286 - RNA, 18 nt, Human
uacaguggcuuuauucuu

SEQ ID NO: 462287 - RNA, 21 nt, Human
uagccgggcaugguggcgggu

SEQ ID NO: 462288 - RNA, 22 nt, Human
ucaaaaaaaaaccaaccaaaca

SEQ ID NO: 462289 - RNA, 24 nt, Human
ucacgaggucaagagaucgagacc

SEQ ID NO: 462290 - RNA, 23 nt, Human
ucacgccacugcacuccagccug

SEQ ID NO: 462291 - RNA, 23 nt, Human
uccagccugggcaacagagugag

SEQ ID NO: 462292 - RNA, 24 nt, Human
uccagccugggcaacagagugaga

SEQ ID NO: 462293 - RNA, 18 nt, Human
uccaguucccggaaggcu

SEQ ID NO: 462294 - RNA, 27 nt, Human
ucucaaaaaaaaaccaaccaaacaaac

SEQ ID NO: 462295 - RNA, 22 nt, Human
ucucuacuaaaaauacaaaaaa

SEQ ID NO: 462296 - RNA, 23 nt, Human
ugaaagagacagacuccaguucc

SEQ ID NO: 462297 - RNA, 22 nt, Human
ugagccgagaucacgccacugc

SEQ ID NO: 462298 - RNA, 23 nt, Human
ugaggcaggagaauggugugaac

SEQ ID NO: 462299 - RNA, 24 nt, Human
ugaggcaggagaauggugugaacc

SEQ ID NO: 462300 - RNA, 25 nt, Human
ugaggcaggagaauggugugaaccc

SEQ ID NO: 462301 - RNA, 24 nt, Human
ugaggccgggcgcgguggcucacg

SEQ ID NO: 462302 - RNA, 23 nt, Human
ugccuguagugccagcuacucgg

SEQ ID NO: 462303 - RNA, 24 nt, Human
ugccuguagugccagcuacucggg

SEQ ID NO: 462304 - RNA, 23 nt, Human
uggaaagcaagcaguaaaaccug

SEQ ID NO: 462305 - RNA, 19 nt, Human
uggcgggugccuguagugc

SEQ ID NO: 462306 - RNA, 21 nt, Human
uggcucacgccuguaauccca

SEQ ID NO: 462307 - RNA, 24 nt, Human
uggcucacgccuguaaucccaaca

SEQ ID NO: 462308 - RNA, 23 nt, Human
ugggaggccaagguggguggauc

SEQ ID NO: 462309 - RNA, 24 nt, Human
ugggaggccaagguggguggauca

SEQ ID NO: 462310 - RNA, 22 nt, Human
ugugauggcagugauggucaac

SEQ ID NO: 462311 - RNA, 24 nt, Human
uucaggcaaacaagcguggaggac

SEQ ID NO: 462312 - RNA, 18 nt, Human
uugcagugagccgagauc

SEQ ID NO: 462313 - RNA, 20 nt, Human
uugcagugagccgagaucac

SEQ ID NO: 462314 - RNA, 21 nt, Human
uugcagugagccgagaucacg

SEQ ID NO: 462315 - RNA, 22 nt, Human
uuuuuuucauuuccaaaucucu

SEQ ID NO: 462316 - RNA, 22 nt, Human
uuuuuuuuuuuuuuuuucauuu

SEQ ID NO: 462317 - RNA, 20 nt, Human
agauccugggugccaugggg

SEQ ID NO: 462318 - RNA, 20 nt, Human
ccaacugcagcccacgggcg

SEQ ID NO: 462319 - RNA, 21 nt, Human
ccggugcauggcagcggcugc

SEQ ID NO: 462320 - RNA, 22 nt, Human
cgagaccagauccugggugcca

SEQ ID NO: 462321 - RNA, 20 nt, Human
cguuccaacugcagcccacu

SEQ ID NO: 462322 - RNA, 20 nt, Human
cugcagcccacgggcgugag

SEQ ID NO: 462323 - RNA, 19 nt, Human
gaccggugcauggcagcgg

SEQ ID NO: 462324 - RNA, 18 nt, Human
ggcgugaggcuggaaagg

SEQ ID NO: 462325 - RNA, 25 nt, Human
uugaggaggccacacauguuuauua

SEQ ID NO: 462326 - RNA, 21 nt, Human
uuuuuuuuuuuugaggaggcc

SEQ ID NO: 462327 - RNA, 22 nt, Human
uuuuuuuuuuuuugaggaggcc

SEQ ID NO: 462328 - RNA, 19 nt, Human
uuuuuuuuuuuuuugagga

SEQ ID NO: 462329 - RNA, 18 nt, Human
uuuuuuuuuuuuuuuuug

SEQ ID NO: 462330 - RNA, 23 nt, Human
uuuuuuuuuuuuuuuuuuugagg

SEQ ID NO: 462331 - RNA, 23 nt, Human
aaaccacccuaagcagagaucac

SEQ ID NO: 462332 - RNA, 21 nt, Human
aacuccgugagcccacugacc

SEQ ID NO: 462333 - RNA, 25 nt, Human
aacuccgugagcccacugaccucca

SEQ ID NO: 462334 - RNA, 20 nt, Human
aagccacccacugagguugc

SEQ ID NO: 462335 - RNA, 26 nt, Human
aagugaccucugcacccaccgagggu

SEQ ID NO: 462336 - RNA, 21 nt, Human
acccaucucccuucuuugucu

SEQ ID NO: 462337 - RNA, 22 nt, Human
accccaauggcuuccaccuggc

SEQ ID NO: 462338 - RNA, 18 nt, Human
accucacugccccucccc

SEQ ID NO: 462339 - RNA, 21 nt, Human
accucugcccccgaggcuccc

SEQ ID NO: 462340 - RNA, 20 nt, Human
acuccgugagcccacugacc

SEQ ID NO: 462341 - RNA, 18 nt, Human
acuggggaaagaagaaua

SEQ ID NO: 462342 - RNA, 20 nt, Human
agacagacagaggggcggau

SEQ ID NO: 462343 - RNA, 24 nt, Human
agauaucagaacucaccucaaacc

SEQ ID NO: 462344 - RNA, 22 nt, Human
agaucacuccggcugacgcagg

SEQ ID NO: 462345 - RNA, 21 nt, Human
agcaggugcuuauuucuugca

SEQ ID NO: 462346 - RNA, 18 nt, Human
agcuccugccugggcccc

SEQ ID NO: 462347 - RNA, 18 nt, Human
aggacucucaaauaugcu

SEQ ID NO: 462348 - RNA, 21 nt, Human
agggcaacccaguccuccuuc

SEQ ID NO: 462349 - RNA, 21 nt, Human
aggggagacuggggaaagaag

SEQ ID NO: 462350 - RNA, 19 nt, Human
aggugcugcugauuccagu

SEQ ID NO: 462351 - RNA, 23 nt, Human
aggugcuuauuucuugcaguucu

SEQ ID NO: 462352 - RNA, 23 nt, Human
agguguccggggaugcuuugauu

SEQ ID NO: 462353 - RNA, 25 nt, Human
agugaucaguagucauaucuggaac

SEQ ID NO: 462354 - RNA, 22 nt, Human
aguguggggacagcccagcaga

SEQ ID NO: 462355 - RNA, 18 nt, Human
aucaguagucauaucugg

SEQ ID NO: 462356 - RNA, 21 nt, Human
augaaugaaugagugcuggga

SEQ ID NO: 462357 - RNA, 19 nt, Human
caacaagaagagugaaccc

SEQ ID NO: 462358 - RNA, 22 nt, Human
caccaagaacgaggccaugucu

SEQ ID NO: 462359 - RNA, 19 nt, Human
caccacccugcaucuucca

SEQ ID NO: 462360 - RNA, 23 nt, Human
caccacccugcaucuuccaaguc

SEQ ID NO: 462361 - RNA, 22 nt, Human
caccaggcaagggaggccaccc

SEQ ID NO: 462362 - RNA, 24 nt, Human
caccccacaucuaucaccucugcc

SEQ ID NO: 462363 - RNA, 20 nt, Human
caccgcaccuucccucccac

SEQ ID NO: 462364 - RNA, 20 nt, Human
caccucccaccugcacggcc

SEQ ID NO: 462365 - RNA, 18 nt, Human
caccuucccucccacccu

SEQ ID NO: 462366 - RNA, 19 nt, Human
caccuucccucccacccug

SEQ ID NO: 462367 - RNA, 20 nt, Human
cacggccuccagcauugccc

SEQ ID NO: 462368 - RNA, 22 nt, Human
cacugcuucccagagccagccc

SEQ ID NO: 462369 - RNA, 20 nt, Human
cagagccagcccagagcugu

SEQ ID NO: 462370 - RNA, 21 nt, Human
cagcauaguagcccccacccu

SEQ ID NO: 462371 - RNA, 21 nt, Human
cagcccaacaaggccugugcu

SEQ ID NO: 462372 - RNA, 19 nt, Human
cagcucccguggcaccgug

SEQ ID NO: 462373 - RNA, 24 nt, Human
caggucccugaggggagacugggg

SEQ ID NO: 462374 - RNA, 27 nt, Human
ccaccugcacggccuccagcauugccc

SEQ ID NO: 462375 - RNA, 21 nt, Human
ccagucuuggugagggcucuc

SEQ ID NO: 462376 - RNA, 23 nt, Human
cccaccgcaccuucccucccacc

SEQ ID NO: 462377 - RNA, 19 nt, Human
cccagagccagcccagagc

SEQ ID NO: 462378 - RNA, 21 nt, Human
ccccaccgcaccuucccuccc

SEQ ID NO: 462379 - RNA, 22 nt, Human
ccccaccgcaccuucccuccca

SEQ ID NO: 462380 - RNA, 18 nt, Human
ccccacugggcugugccc

SEQ ID NO: 462381 - RNA, 23 nt, Human
cccccgaggcuccccagguucac

SEQ ID NO: 462382 - RNA, 19 nt, Human
cccccugucuuccacacaa

SEQ ID NO: 462383 - RNA, 18 nt, Human
ccccuccccuuccugccu

SEQ ID NO: 462384 - RNA, 20 nt, Human
ccccuuccugccugcccuuc

SEQ ID NO: 462385 - RNA, 21 nt, Human
ccgggaccccccugucuucca

SEQ ID NO: 462386 - RNA, 23 nt, Human
ccucaagggcaacccaguccucc

SEQ ID NO: 462387 - RNA, 23 nt, Human
ccucacugccccuccccuuccug

SEQ ID NO: 462388 - RNA, 22 nt, Human
ccucagcccaacaaggccugug

SEQ ID NO: 462389 - RNA, 23 nt, Human
ccuccagcauugcccaaauucac

SEQ ID NO: 462390 - RNA, 19 nt, Human
ccuccauacgccccuccuc

SEQ ID NO: 462391 - RNA, 21 nt, Human
ccucugcccccgaggcucccc

SEQ ID NO: 462392 - RNA, 23 nt, Human
ccugcacggccuccagcauugcc

SEQ ID NO: 462393 - RNA, 18 nt, Human
ccugccugcccuucuucc

SEQ ID NO: 462394 - RNA, 22 nt, Human
ccugggccccggccucuugccc

SEQ ID NO: 462395 - RNA, 23 nt, Human
ccuucuuccggggcacccagcag

SEQ ID NO: 462396 - RNA, 18 nt, Human
ccuuucccagcauaguag

SEQ ID NO: 462397 - RNA, 24 nt, Human
cgagcucccaacugggacaccccu

SEQ ID NO: 462398 - RNA, 21 nt, Human
cggccuccagcauugcccaaa

SEQ ID NO: 462399 - RNA, 18 nt, Human
cuccaugggcuggacugu

SEQ ID NO: 462400 - RNA, 19 nt, Human
cucguguguugggaggcug

SEQ ID NO: 462401 - RNA, 22 nt, Human
cugaccagcucacucuuauuuu

SEQ ID NO: 462402 - RNA, 18 nt, Human
cugauggacagaaaaggg

SEQ ID NO: 462403 - RNA, 21 nt, Human
cugugcccugccuccuuaaag

SEQ ID NO: 462404 - RNA, 22 nt, Human
cuugcaguucuggaggcuggaa

SEQ ID NO: 462405 - RNA, 19 nt, Human
gaacaaaugugggggcucu

SEQ ID NO: 462406 - RNA, 18 nt, Human
gaacucacagcauguaca

SEQ ID NO: 462407 - RNA, 23 nt, Human
gacacaggggggcccugcagcca

SEQ ID NO: 462408 - RNA, 21 nt, Human
gaccagcaccgcugggguucu

SEQ ID NO: 462409 - RNA, 20 nt, Human
gagcccccaccgcaccuucc

SEQ ID NO: 462410 - RNA, 19 nt, Human
gaggcuggugaagccuggc

SEQ ID NO: 462411 - RNA, 22 nt, Human
gaucccccuuuccacuagccac

SEQ ID NO: 462412 - RNA, 19 nt, Human
gcaccaggcaagggaggcc

SEQ ID NO: 462413 - RNA, 22 nt, Human
gcagaccccaagccacccacug

SEQ ID NO: 462414 - RNA, 22 nt, Human
gcagugggggucaccacccugc

SEQ ID NO: 462415 - RNA, 18 nt, Human
gcauaguagcccccaccc

SEQ ID NO: 462416 - RNA, 19 nt, Human
gccaaccucacugccccuc

SEQ ID NO: 462417 - RNA, 19 nt, Human
gccacaccaagaacgaggc

SEQ ID NO: 462418 - RNA, 23 nt, Human
gccacaccaagaacgaggccaug

SEQ ID NO: 462419 - RNA, 26 nt, Human
gcccaacaaggccugugcuucugacc

SEQ ID NO: 462420 - RNA, 19 nt, Human
gccuucacucccaagucca

SEQ ID NO: 462421 - RNA, 20 nt, Human
gcggaugcagccuaccuccu

SEQ ID NO: 462422 - RNA, 19 nt, Human
ggacacaggggggcccugc

SEQ ID NO: 462423 - RNA, 19 nt, Human
ggacccucaggcugggcag

SEQ ID NO: 462424 - RNA, 19 nt, Human
ggcaacccaguccuccuuc

SEQ ID NO: 462425 - RNA, 18 nt, Human
ggcaccagggugaggugg

SEQ ID NO: 462426 - RNA, 21 nt, Human
ggccacccauugcuccagcuc

SEQ ID NO: 462427 - RNA, 19 nt, Human
ggccggggccucguggcca

SEQ ID NO: 462428 - RNA, 23 nt, Human
ggccucagaugucagcaaaugcc

SEQ ID NO: 462429 - RNA, 19 nt, Human
ggccuccagcauugcccaa

SEQ ID NO: 462430 - RNA, 19 nt, Human
gggagacuggggaaagaag

SEQ ID NO: 462431 - RNA, 22 nt, Human
gggaggcuggugaagccuggca

SEQ ID NO: 462432 - RNA, 19 nt, Human
gggccucguggccaccccc

SEQ ID NO: 462433 - RNA, 21 nt, Human
gggcuccaugggcuggacugu

SEQ ID NO: 462434 - RNA, 21 nt, Human
gggcugggcugggggcaccag

SEQ ID NO: 462435 - RNA, 18 nt, Human
gggggcccugcagccagg

SEQ ID NO: 462436 - RNA, 18 nt, Human
ggguccucagccuccgcc

SEQ ID NO: 462437 - RNA, 22 nt, Human
ggugaagccuggcauugggggg

SEQ ID NO: 462438 - RNA, 26 nt, Human
guccuucuuucuccgggaccccccuu

SEQ ID NO: 462439 - RNA, 18 nt, Human
gucuuccacacaagccaa

SEQ ID NO: 462440 - RNA, 26 nt, Human
gugaagccuggcauuggggggcacca

SEQ ID NO: 462441 - RNA, 19 nt, Human
gugugacacuguaauagug

SEQ ID NO: 462442 - RNA, 24 nt, Human
uaaaaaauaaaaucuuuauuaaaa

SEQ ID NO: 462443 - RNA, 24 nt, Human
uacaacaagaagagugaacccuca

SEQ ID NO: 462444 - RNA, 20 nt, Human
uacgucuguuuacucaccca

SEQ ID NO: 462445 - RNA, 24 nt, Human
uacucacccaucugaggcuaggga

SEQ ID NO: 462446 - RNA, 21 nt, Human
uagaguuagaguccaguaauc

SEQ ID NO: 462447 - RNA, 22 nt, Human
uagcccccacccucaggucagg

SEQ ID NO: 462448 - RNA, 22 nt, Human
ucacccagagagcaugggcugc

SEQ ID NO: 462449 - RNA, 23 nt, Human
ucacccagagagcaugggcugca

SEQ ID NO: 462450 - RNA, 25 nt, Human
ucaccccaauggcuuccaccuggcc

SEQ ID NO: 462451 - RNA, 21 nt, Human
ucacugccccuccccuuccug

SEQ ID NO: 462452 - RNA, 19 nt, Human
ucacuggggacacaggggg

SEQ ID NO: 462453 - RNA, 19 nt, Human
ucacuggggacacaggggg

SEQ ID NO: 462454 - RNA, 21 nt, Human
ucagaacucaccucaaaccac

SEQ ID NO: 462455 - RNA, 23 nt, Human
ucaggcaccaggcaagggaggcc

SEQ ID NO: 462456 - RNA, 20 nt, Human
ucaguggccacaccaagaac

SEQ ID NO: 462457 - RNA, 18 nt, Human
uccaaucacugccggugc

SEQ ID NO: 462458 - RNA, 21 nt, Human
uccagggcugcagguugcuuu

SEQ ID NO: 462459 - RNA, 20 nt, Human
uccaguaaucccccugaguc

SEQ ID NO: 462460 - RNA, 20 nt, Human
uccaugggcuggacuguucc

SEQ ID NO: 462461 - RNA, 23 nt, Human
ucccaaguccacagaggugucuc

SEQ ID NO: 462462 - RNA, 19 nt, Human
uccccaggaguggguguca

SEQ ID NO: 462463 - RNA, 19 nt, Human
ucccugaggggagacuggg

SEQ ID NO: 462464 - RNA, 22 nt, Human
uccgugagcccacugaccucca

SEQ ID NO: 462465 - RNA, 19 nt, Human
uccucagccuccgcccaag

SEQ ID NO: 462466 - RNA, 21 nt, Human
uccucagccuccgcccaaggc

SEQ ID NO: 462467 - RNA, 21 nt, Human
uccuccuucacucaggcacca

SEQ ID NO: 462468 - RNA, 22 nt, Human
uccuucacucaggcaccaggca

SEQ ID NO: 462469 - RNA, 19 nt, Human
ucucagccacaggccgggg

SEQ ID NO: 462470 - RNA, 23 nt, Human
ucucuguaaacaugaaacugcuc

SEQ ID NO: 462471 - RNA, 19 nt, Human
ucuguaaacaugaaacugc

SEQ ID NO: 462472 - RNA, 20 nt, Human
ucuguaaacaugaaacugcu

SEQ ID NO: 462473 - RNA, 21 nt, Human
ucuguaaacaugaaacugcuc

SEQ ID NO: 462474 - RNA, 25 nt, Human
ucuguaaacaugaaacugcucuaaa

SEQ ID NO: 462475 - RNA, 19 nt, Human
ucuugggcugggcuggggg

SEQ ID NO: 462476 - RNA, 20 nt, Human
ugaaacaccccacaucuauc

SEQ ID NO: 462477 - RNA, 24 nt, Human
ugaaacaccccacaucuaucaccu

SEQ ID NO: 462478 - RNA, 21 nt, Human
ugaaugaaugagugcugggag

SEQ ID NO: 462479 - RNA, 25 nt, Human
ugacuaggucaauauugguucauua

SEQ ID NO: 462480 - RNA, 25 nt, Human
ugagcgagcucccaacugggacacc

SEQ ID NO: 462481 - RNA, 21 nt, Human
ugaggcuagggaagugaccuc

SEQ ID NO: 462482 - RNA, 19 nt, Human
ugagggcucucuuccuggc

SEQ ID NO: 462483 - RNA, 22 nt, Human
ugaggggagacuggggaaagaa

SEQ ID NO: 462484 - RNA, 23 nt, Human
ugagugcugggagcugucucagg

SEQ ID NO: 462485 - RNA, 24 nt, Human
ugccagccucagcccaacaaggcc

SEQ ID NO: 462486 - RNA, 25 nt, Human
ugcccccgaggcuccccagguucac

SEQ ID NO: 462487 - RNA, 18 nt, Human
ugcccgaacucacagcau

SEQ ID NO: 462488 - RNA, 20 nt, Human
ugcccuggcccugaugcugg

SEQ ID NO: 462489 - RNA, 18 nt, Human
ugcccuggugucuugggc

SEQ ID NO: 462490 - RNA, 21 nt, Human
ugcccuggugucuugggcugg

SEQ ID NO: 462491 - RNA, 19 nt, Human
ugccuugaaacaccccaca

SEQ ID NO: 462492 - RNA, 18 nt, Human
uggcaagguccuuccuca

SEQ ID NO: 462493 - RNA, 20 nt, Human
uggcaagguccuuccucaaa

SEQ ID NO: 462494 - RNA, 20 nt, Human
uggcaagguccuuccucaag

SEQ ID NO: 462495 - RNA, 22 nt, Human
uggcaagguccuuccucaaggg

SEQ ID NO: 462496 - RNA, 20 nt, Human
uggcugcaggucccugaggg

SEQ ID NO: 462497 - RNA, 18 nt, Human
ugggaggcuggugaagcc

SEQ ID NO: 462498 - RNA, 19 nt, Human
ugggcugggggcaccaggg

SEQ ID NO: 462499 - RNA, 21 nt, Human
ugggcugugcccugccuccuu

SEQ ID NO: 462500 - RNA, 21 nt, Human
ugggggcagugugugugacuu

SEQ ID NO: 462501 - RNA, 19 nt, Human
uggggggagccaaccucac

SEQ ID NO: 462502 - RNA, 23 nt, Human
ugggguccucagccuccgcccaa

SEQ ID NO: 462503 - RNA, 22 nt, Human
uggugagggcucucuuccuggc

SEQ ID NO: 462504 - RNA, 22 nt, Human
ugguggggggagccaaccucac

SEQ ID NO: 462505 - RNA, 20 nt, Human
uguacaacaagaagagugaa

SEQ ID NO: 462506 - RNA, 20 nt, Human
ugucucacugccuugaaaca

SEQ ID NO: 462507 - RNA, 26 nt, Human
ugugacucacugcuucccagagccag

SEQ ID NO: 462508 - RNA, 21 nt, Human
ugugagggacccucaggcugg

SEQ ID NO: 462509 - RNA, 21 nt, Human
uguugacagacagacagaggg

SEQ ID NO: 462510 - RNA, 19 nt, Human
uguuuaguagacaugaggu

SEQ ID NO: 462511 - RNA, 20 nt, Human
uucacuguccuucuuucucc

SEQ ID NO: 462512 - RNA, 19 nt, Human
aaaaaaacaaacaaaaaca

SEQ ID NO: 462513 - RNA, 28 nt, Human
aaaaaaacaaacaaaaacaaaagccaag

SEQ ID NO: 462514 - RNA, 24 nt, Human
aaaaacugguuauaaaaagaacac

SEQ ID NO: 462515 - RNA, 24 nt, Human
aaaacaaaaugaugccccaaagaa

SEQ ID NO: 462516 - RNA, 22 nt, Human
aaaacaaacaaaaacaaaagcc

SEQ ID NO: 462517 - RNA, 20 nt, Human
aaaaucacuuuuguaaguua

SEQ ID NO: 462518 - RNA, 18 nt, Human
aaacaaaaugagggcaca

SEQ ID NO: 462519 - RNA, 24 nt, Human
aaacaaacaaaaacaaaagccaaa

SEQ ID NO: 462520 - RNA, 22 nt, Human
aaacaagcucuccucaaacuga

SEQ ID NO: 462521 - RNA, 23 nt, Human
aaacacaagccauauacacucca

SEQ ID NO: 462522 - RNA, 19 nt, Human
aaacauacgcaaaaauucu

SEQ ID NO: 462523 - RNA, 30 nt, Human
aaacgaaacaaaaaaacaaacaaaaacaaa

SEQ ID NO: 462524 - RNA, 24 nt, Human
aaaugaugccccaaagaaaagucc

SEQ ID NO: 462525 - RNA, 23 nt, Human
aacaaaaaaacaaacaaaaacaa

SEQ ID NO: 462526 - RNA, 25 nt, Human
aacaaaaaaacaaacaaaaacaaaa

SEQ ID NO: 462527 - RNA, 24 nt, Human
aacaaaaacaaaagccaaaaaaaa

SEQ ID NO: 462528 - RNA, 19 nt, Human
aacagaacauauggcuuua

SEQ ID NO: 462529 - RNA, 25 nt, Human
aacccuggccauggcuggggguagc

SEQ ID NO: 462530 - RNA, 24 nt, Human
aacuaccaaacgaaacaaaaaaac

SEQ ID NO: 462531 - RNA, 26 nt, Human
aacuaccaaacgaaacaaaaaaacaa

SEQ ID NO: 462532 - RNA, 22 nt, Human
aagacaaaacaaaaugaugccc

SEQ ID NO: 462533 - RNA, 19 nt, Human
aagcaaacaagacuugaac

SEQ ID NO: 462534 - RNA, 20 nt, Human
aagcaaacaagacuugaaca

SEQ ID NO: 462535 - RNA, 23 nt, Human
aagcaaacaagacuugaacagaa

SEQ ID NO: 462536 - RNA, 24 nt, Human
aauccccgagguccaacgccauuc

SEQ ID NO: 462537 - RNA, 20 nt, Human
acaaaacaaaaugaugcccc

SEQ ID NO: 462538 - RNA, 25 nt, Human
acaaaacaaaaugaugccccaaaga

SEQ ID NO: 462539 - RNA, 26 nt, Human
acaaaagccaaaaaaaaaaaaaaaaa

SEQ ID NO: 462540 - RNA, 21 nt, Human
acaaacaaaaacaaaagccaa

SEQ ID NO: 462541 - RNA, 22 nt, Human
acaagcucuccucaaacugaag

SEQ ID NO: 462542 - RNA, 24 nt, Human
accaaacgaaacaaaaaaacaaac

SEQ ID NO: 462543 - RNA, 20 nt, Human
acccgggaaaggggguuccu

SEQ ID NO: 462544 - RNA, 23 nt, Human
acgaaacaaaaaaacaaacaaaa

SEQ ID NO: 462545 - RNA, 24 nt, Human
acgaaacaaaaaaacaaacaaaaa

SEQ ID NO: 462546 - RNA, 25 nt, Human
acgaaacaaaaaaacaaacaaaaac

SEQ ID NO: 462547 - RNA, 24 nt, Human
agaaaacaauuaccaaucaaaaac

SEQ ID NO: 462548 - RNA, 19 nt, Human
agacguuugauucuuuuau

SEQ ID NO: 462549 - RNA, 18 nt, Human
agagcauauuaucuacca

SEQ ID NO: 462550 - RNA, 19 nt, Human
agauugcucugaaauguuc

SEQ ID NO: 462551 - RNA, 24 nt, Human
agccaaaaaaaaaaaaaaaaaucc

SEQ ID NO: 462552 - RNA, 25 nt, Human
agccaaaaaaaaaaaaaaaaauccc

SEQ ID NO: 462553 - RNA, 21 nt, Human
aggaggcgugcaaaggucaag

SEQ ID NO: 462554 - RNA, 19 nt, Human
aggcagaugaacuaccaaa

SEQ ID NO: 462555 - RNA, 22 nt, Human
agggacccacccuugccaccug

SEQ ID NO: 462556 - RNA, 21 nt, Human
auaugaaacaagcucuccuca

SEQ ID NO: 462557 - RNA, 21 nt, Human
auccugguaacaguuuuccuc

SEQ ID NO: 462558 - RNA, 23 nt, Human
augaacuaccaaacgaaacaaaa

SEQ ID NO: 462559 - RNA, 23 nt, Human
augaagcaagacacuguuaccuu

SEQ ID NO: 462560 - RNA, 25 nt, Human
caaaaaaaaaaaaaaaaaucccaaa

SEQ ID NO: 462561 - RNA, 22 nt, Human
caaaacaaaaugaugccccaaa

SEQ ID NO: 462562 - RNA, 31 nt, Human
caaaacacaagccauauacacuccaaauagg

SEQ ID NO: 462563 - RNA, 27 nt, Human
caaaacucaccaccaggcgagaccaga

SEQ ID NO: 462564 - RNA, 20 nt, Human
caaaauaacacuuagagggc

SEQ ID NO: 462565 - RNA, 19 nt, Human
caaaaugagggcacacuug

SEQ ID NO: 462566 - RNA, 20 nt, Human
caaagaaaagucccagaggc

SEQ ID NO: 462567 - RNA, 25 nt, Human
caagguacaguaaacaauuagcaug

SEQ ID NO: 462568 - RNA, 22 nt, Human
caauacaauauaaacauacgca

SEQ ID NO: 462569 - RNA, 24 nt, Human
caccaguggagccaaacccuggcc

SEQ ID NO: 462570 - RNA, 21 nt, Human
cacuauuugagcaagucacca

SEQ ID NO: 462571 - RNA, 22 nt, Human
cagaggaggcccaaggacaguc

SEQ ID NO: 462572 - RNA, 18 nt, Human
cagcuuggugggcuccag

SEQ ID NO: 462573 - RNA, 21 nt, Human
cagggcuuacugcugacucca

SEQ ID NO: 462574 - RNA, 23 nt, Human
cagugggauauggauaugaaaca

SEQ ID NO: 462575 - RNA, 20 nt, Human
cauauggcuuuacgauaaca

SEQ ID NO: 462576 - RNA, 22 nt, Human
ccaaacccuggccauggcuggc

SEQ ID NO: 462577 - RNA, 20 nt, Human
ccacggaggccacgugugcc

SEQ ID NO: 462578 - RNA, 22 nt, Human
ccagcugaccccuccagagccc

SEQ ID NO: 462579 - RNA, 18 nt, Human
ccagggcuuacugcugac

SEQ ID NO: 462580 - RNA, 22 nt, Human
cccacccuugccaccuguccca

SEQ ID NO: 462581 - RNA, 18 nt, Human
ccccaaagaaaaguccca

SEQ ID NO: 462582 - RNA, 20 nt, Human
cccgagguccaacgccauuc

SEQ ID NO: 462583 - RNA, 19 nt, Human
cccugcuacgaaagacaaa

SEQ ID NO: 462584 - RNA, 19 nt, Human
ccgccuaauacuuuggucc

SEQ ID NO: 462585 - RNA, 24 nt, Human
cgaaacaaaaaaacaaacaaaaac

SEQ ID NO: 462586 - RNA, 20 nt, Human
cgaaagacaaaacaaaauga

SEQ ID NO: 462587 - RNA, 26 nt, Human
cgagaccagagcauauuaucuaccag

SEQ ID NO: 462588 - RNA, 18 nt, Human
cuauuacagaaaugaaaa

SEQ ID NO: 462589 - RNA, 22 nt, Human
cuccaaauagucuaguguuuca

SEQ ID NO: 462590 - RNA, 18 nt, Human
cuccauauggccgaggaa

SEQ ID NO: 462591 - RNA, 21 nt, Human
cugcaguccucagucagcagc

SEQ ID NO: 462592 - RNA, 19 nt, Human
cugguccugaucccuugca

SEQ ID NO: 462593 - RNA, 20 nt, Human
cuuggcuuggccccuccaac

SEQ ID NO: 462594 - RNA, 23 nt, Human
cuuuggucacacuaauaauuguc

SEQ ID NO: 462595 - RNA, 21 nt, Human
gaugccccaaagaaaaguccc

SEQ ID NO: 462596 - RNA, 18 nt, Human
gccaaaaaaaaaaaaaaa

SEQ ID NO: 462597 - RNA, 19 nt, Human
gcuccuugcccauuacagg

SEQ ID NO: 462598 - RNA, 21 nt, Human
ggagugcuggaaucuccacac

SEQ ID NO: 462599 - RNA, 23 nt, Human
ggccauggcuggcaaaacucacc

SEQ ID NO: 462600 - RNA, 19 nt, Human
ggcugugauguauuuuugu

SEQ ID NO: 462601 - RNA, 22 nt, Human
ggucuuucaaaccaaguuuaaa

SEQ ID NO: 462602 - RNA, 20 nt, Human
ggugcugcuuccagaggagg

SEQ ID NO: 462603 - RNA, 20 nt, Human
gugcaauauuuuuacacuuc

SEQ ID NO: 462604 - RNA, 19 nt, Human
gugcuggaaucuccacacc

SEQ ID NO: 462605 - RNA, 18 nt, Human
uaaaaggcagaugaacua

SEQ ID NO: 462606 - RNA, 22 nt, Human
uaaaaggcagaugaacuaccaa

SEQ ID NO: 462607 - RNA, 18 nt, Human
uaaaaguagaaacaaaau

SEQ ID NO: 462608 - RNA, 23 nt, Human
uaaaaugaaaaaggaaaucagaa

SEQ ID NO: 462609 - RNA, 20 nt, Human
uaacccuuucaccagacgau

SEQ ID NO: 462610 - RNA, 25 nt, Human
uaaguuagaacaaccaaaauaacac

SEQ ID NO: 462611 - RNA, 28 nt, Human
uaaguuagaacaaccaaaauaacacuua

SEQ ID NO: 462612 - RNA, 22 nt, Human
uaccacagaggccacaguggga

SEQ ID NO: 462613 - RNA, 22 nt, Human
uaccacggaggccacgugugcc

SEQ ID NO: 462614 - RNA, 22 nt, Human
uacgauaacaucaauuuaucaa

SEQ ID NO: 462615 - RNA, 21 nt, Human
uagaacaauacaauauaaaca

SEQ ID NO: 462616 - RNA, 26 nt, Human
uagagggcauuuucauucuacaacuc

SEQ ID NO: 462617 - RNA, 22 nt, Human
uaugaccccuccauauggccga

SEQ ID NO: 462618 - RNA, 23 nt, Human
uaugcagauugcucugaaauguu

SEQ ID NO: 462619 - RNA, 19 nt, Human
ucacuauauauauacacaa

SEQ ID NO: 462620 - RNA, 26 nt, Human
ucaggcagcccugaggcaagcaggag

SEQ ID NO: 462621 - RNA, 19 nt, Human
uccaaauagucuaguguuu

SEQ ID NO: 462622 - RNA, 24 nt, Human
uccaacgccauucaagucaggcag

SEQ ID NO: 462623 - RNA, 21 nt, Human
uccauaccacagaggccacag

SEQ ID NO: 462624 - RNA, 24 nt, Human
uccauaugcaauguaauguuuagg

SEQ ID NO: 462625 - RNA, 21 nt, Human
uccuccccauugucauauccu

SEQ ID NO: 462626 - RNA, 22 nt, Human
uccucugggggugcugcuucca

SEQ ID NO: 462627 - RNA, 19 nt, Human
ucuaauuccauuagcagca

SEQ ID NO: 462628 - RNA, 24 nt, Human
ucuaccaguaauccccgaggucca

SEQ ID NO: 462629 - RNA, 20 nt, Human
ucucccagcagucaguggga

SEQ ID NO: 462630 - RNA, 22 nt, Human
ucuguacaaugucuuagaaucu

SEQ ID NO: 462631 - RNA, 21 nt, Human
ugaaacaagcucuccucaaac

SEQ ID NO: 462632 - RNA, 21 nt, Human
ugaaauguucauuggugaugc

SEQ ID NO: 462633 - RNA, 22 nt, Human
ugaaauguucauuggugaugcu

SEQ ID NO: 462634 - RNA, 19 nt, Human
ugaauggguuaaaaggcag

SEQ ID NO: 462635 - RNA, 23 nt, Human
ugagugaaaaccucacaagguac

SEQ ID NO: 462636 - RNA, 19 nt, Human
ugauguauuuuuguauuga

SEQ ID NO: 462637 - RNA, 22 nt, Human
ugcaaaggucaagggacccacc

SEQ ID NO: 462638 - RNA, 25 nt, Human
ugccccaaagaaaagucccagaggc

SEQ ID NO: 462639 - RNA, 19 nt, Human
ugggaugcuacuucuaaaa

SEQ ID NO: 462640 - RNA, 21 nt, Human
ugggaugcuacuucuaaaaaa

SEQ ID NO: 462641 - RNA, 21 nt, Human
uguaaaaugaacgcacucuaa

SEQ ID NO: 462642 - RNA, 24 nt, Human
ugugcaauauuuuuacacuucuga

SEQ ID NO: 462643 - RNA, 23 nt, Human
uguuucaaauacaauagaucugu

SEQ ID NO: 462644 - RNA, 22 nt, Human
uucaagucaggcagcccugagg

SEQ ID NO: 462645 - RNA, 24 nt, Human
uucacuuguaggaauaaucauuuc

SEQ ID NO: 462646 - RNA, 22 nt, Human
uuccagaggaggcccaaggaca

SEQ ID NO: 462647 - RNA, 24 nt, Human
uuccauuagcagcacgagcauuuu

SEQ ID NO: 462648 - RNA, 23 nt, Human
uucuucuuuguggcuccuugccc

SEQ ID NO: 462649 - RNA, 27 nt, Human
uuuucagaauauccuuuugguuuuaaa

SEQ ID NO: 462650 - RNA, 21 nt, Human
aggcucccagccagccagcuc

SEQ ID NO: 462651 - RNA, 18 nt, Human
aggcugcugcuaagggga

SEQ ID NO: 462652 - RNA, 19 nt, Human
agggaucagaggcugcugc

SEQ ID NO: 462653 - RNA, 24 nt, Human
cacagaaucauuuacaaaaauaaa

SEQ ID NO: 462654 - RNA, 19 nt, Human
cacccugagguggaacccc

SEQ ID NO: 462655 - RNA, 22 nt, Human
cacucccgggccaugccauccu

SEQ ID NO: 462656 - RNA, 21 nt, Human
cacugugucgcugggcgaagu

SEQ ID NO: 462657 - RNA, 22 nt, Human
cacuugguuuggucucaaaggc

SEQ ID NO: 462658 - RNA, 19 nt, Human
cagcaggcccccggcggcc

SEQ ID NO: 462659 - RNA, 22 nt, Human
cagcaggcccccggcggccugg

SEQ ID NO: 462660 - RNA, 24 nt, Human
cccagccuggaccaucuuccuccu

SEQ ID NO: 462661 - RNA, 21 nt, Human
cccccggcggccugguggccc

SEQ ID NO: 462662 - RNA, 19 nt, Human
cccgggccaugccauccuu

SEQ ID NO: 462663 - RNA, 23 nt, Human
ccucaggcugcuaaugguucccu

SEQ ID NO: 462664 - RNA, 24 nt, Human
ccucccgccaggcccccgcccccc

SEQ ID NO: 462665 - RNA, 19 nt, Human
cgccaggcccccgcccccc

SEQ ID NO: 462666 - RNA, 24 nt, Human
cucaggcugcuaaugguucccucc

SEQ ID NO: 462667 - RNA, 21 nt, Human
gccaagggaucagaggcugcu

SEQ ID NO: 462668 - RNA, 21 nt, Human
gcucccagccagccagcuccu

SEQ ID NO: 462669 - RNA, 21 nt, Human
ggagacgggguccugcccgcc

SEQ ID NO: 462670 - RNA, 18 nt, Human
gggagacgggguccugcc

SEQ ID NO: 462671 - RNA, 21 nt, Human
ggucucaaaggcaaaaggaaa

SEQ ID NO: 462672 - RNA, 22 nt, Human
guccccgaggcucccagccagc

SEQ ID NO: 462673 - RNA, 24 nt, Human
gugagcugggagcaaggcugggcg

SEQ ID NO: 462674 - RNA, 19 nt, Human
uaaugguucccuccugcuu

SEQ ID NO: 462675 - RNA, 21 nt, Human
uaggaaggagccugaggcccg

SEQ ID NO: 462676 - RNA, 22 nt, Human
ucccagccuggaccaucuuccu

SEQ ID NO: 462677 - RNA, 21 nt, Human
ucgcugggcgaagucuggcuu

SEQ ID NO: 462678 - RNA, 23 nt, Human
ucuggcauaucuccucaauugca

SEQ ID NO: 462679 - RNA, 22 nt, Human
ugagcugggagcaaggcugggc

SEQ ID NO: 462680 - RNA, 18 nt, Human
ugcuaaggggaugcuccc

SEQ ID NO: 462681 - RNA, 18 nt, Human
uggaagcacuugguuugg

SEQ ID NO: 462682 - RNA, 20 nt, Human
aaaacauuucucucaacuaa

SEQ ID NO: 462683 - RNA, 20 nt, Human
aaaaguacgugcacagacuc

SEQ ID NO: 462684 - RNA, 23 nt, Human
aaacagagugaucuaaaacuaac

SEQ ID NO: 462685 - RNA, 22 nt, Human
aaacagccuuccacaauaaagu

SEQ ID NO: 462686 - RNA, 24 nt, Human
aaaccaaaacaaaacuauggaaga

SEQ ID NO: 462687 - RNA, 21 nt, Human
aaaccucuagagcugauacug

SEQ ID NO: 462688 - RNA, 18 nt, Human
aaacuaaaacacaaaugu

SEQ ID NO: 462689 - RNA, 18 nt, Human
aaacuaaaacacaaaugu

SEQ ID NO: 462690 - RNA, 20 nt, Human
aaagagacuugaaguagcca

SEQ ID NO: 462691 - RNA, 21 nt, Human
aaccaugauauaaaacauuuc

SEQ ID NO: 462692 - RNA, 18 nt, Human
aagaaacuaaaacacaaa

SEQ ID NO: 462693 - RNA, 19 nt, Human
aagagacaugggcaauucc

SEQ ID NO: 462694 - RNA, 18 nt, Human
aauaaaucauagagaaaa

SEQ ID NO: 462695 - RNA, 20 nt, Human
aaucaacaccuuauuugaaa

SEQ ID NO: 462696 - RNA, 20 nt, Human
acaaaaaaaaaaaaugcaga

SEQ ID NO: 462697 - RNA, 20 nt, Human
acaaagcaaaauuaugucuu

SEQ ID NO: 462698 - RNA, 22 nt, Human
acauuucagacaauuuuuucuu

SEQ ID NO: 462699 - RNA, 19 nt, Human
accccagcuuaguuagccg

SEQ ID NO: 462700 - RNA, 21 nt, Human
acugcaguugauggaaggcag

SEQ ID NO: 462701 - RNA, 23 nt, Human
agaaacuaaaacacaaauguuuu

SEQ ID NO: 462702 - RNA, 18 nt, Human
agaaagaaggaaaagcua

SEQ ID NO: 462703 - RNA, 24 nt, Human
agaaagaaggaaaagcuaacaaaa

SEQ ID NO: 462704 - RNA, 21 nt, Human
agacgcuccaagguccggagc

SEQ ID NO: 462705 - RNA, 19 nt, Human
agacuugaaguagccaaug

SEQ ID NO: 462706 - RNA, 23 nt, Human
agcaaaccucuagagcugauacu

SEQ ID NO: 462707 - RNA, 22 nt, Human
agcucuucucuuucuuccuuuc

SEQ ID NO: 462708 - RNA, 24 nt, Human
aggaaaggaaauacuucuuaagga

SEQ ID NO: 462709 - RNA, 19 nt, Human
aggaggagauauaaaucgg

SEQ ID NO: 462710 - RNA, 24 nt, Human
aggcccuuugcucagaaucagagg

SEQ ID NO: 462711 - RNA, 21 nt, Human
agggagcugcccgagagggag

SEQ ID NO: 462712 - RNA, 18 nt, Human
aguggaauuaguugcuac

SEQ ID NO: 462713 - RNA, 18 nt, Human
auauguaugugugcauau

SEQ ID NO: 462714 - RNA, 19 nt, Human
aucuuagauuuuugguuug

SEQ ID NO: 462715 - RNA, 23 nt, Human
auuacaaacuauuucagccauga

SEQ ID NO: 462716 - RNA, 21 nt, Human
auuacacugcaguugauggaa

SEQ ID NO: 462717 - RNA, 24 nt, Human
caaaacaaaacuauggaagaaaua

SEQ ID NO: 462718 - RNA, 22 nt, Human
caaaccucuagagcugauacug

SEQ ID NO: 462719 - RNA, 23 nt, Human
caaagggacaaggaaaaccaacg

SEQ ID NO: 462720 - RNA, 22 nt, Human
caaaucccagagauggcuguga

SEQ ID NO: 462721 - RNA, 24 nt, Human
caaccuccauagcuuaugccuccu

SEQ ID NO: 462722 - RNA, 22 nt, Human
caacuggcucugccagggguaa

SEQ ID NO: 462723 - RNA, 21 nt, Human
caauagcaaaaacugguguca

SEQ ID NO: 462724 - RNA, 22 nt, Human
caauagcaaaaacuggugucag

SEQ ID NO: 462725 - RNA, 18 nt, Human
caauguaaagcagcauaa

SEQ ID NO: 462726 - RNA, 18 nt, Human
cacugcaacuggcucugc

SEQ ID NO: 462727 - RNA, 19 nt, Human
cagaauuccugagaauagu

SEQ ID NO: 462728 - RNA, 24 nt, Human
cagaugcuauaaaaauggaggagu

SEQ ID NO: 462729 - RNA, 21 nt, Human
caguagccagacucuagacgc

SEQ ID NO: 462730 - RNA, 22 nt, Human
ccacauaaaucaacaccuuauu

SEQ ID NO: 462731 - RNA, 18 nt, Human
ccccaucacuccugccuc

SEQ ID NO: 462732 - RNA, 23 nt, Human
ccccaucacuccugccucaucug

SEQ ID NO: 462733 - RNA, 20 nt, Human
cccccgcgcguccagugccg

SEQ ID NO: 462734 - RNA, 22 nt, Human
cccccgcgcguccagugccgca

SEQ ID NO: 462735 - RNA, 20 nt, Human
ccccuuagcggcuacucugg

SEQ ID NO: 462736 - RNA, 26 nt, Human
ccgaauaaacauauuacaauagcaaa

SEQ ID NO: 462737 - RNA, 20 nt, Human
ccgcaucccccgcgcgucca

SEQ ID NO: 462738 - RNA, 19 nt, Human
ccuggcuuccugcaauguc

SEQ ID NO: 462739 - RNA, 18 nt, Human
cgagagggaggcggagga

SEQ ID NO: 462740 - RNA, 20 nt, Human
cggcacuugagggaaguuca

SEQ ID NO: 462741 - RNA, 27 nt, Human
cuagcacuuuucacuugaguuuuccuc

SEQ ID NO: 462742 - RNA, 25 nt, Human
cucaacuaaaacagagugaucuaaa

SEQ ID NO: 462743 - RNA, 20 nt, Human
cugaaaaaacacuacccaau

SEQ ID NO: 462744 - RNA, 20 nt, Human
cugcaacuggcucugccagg

SEQ ID NO: 462745 - RNA, 19 nt, Human
cugcccgagagggaggcgg

SEQ ID NO: 462746 - RNA, 20 nt, Human
cuggucuuuuauauguuaga

SEQ ID NO: 462747 - RNA, 21 nt, Human
cuggucuuuuauauguuagaa

SEQ ID NO: 462748 - RNA, 19 nt, Human
cuucagcuuggaacaacuu

SEQ ID NO: 462749 - RNA, 22 nt, Human
cuugugcacauuuacauggaaa

SEQ ID NO: 462750 - RNA, 19 nt, Human
cuuucaaaaccucaccacc

SEQ ID NO: 462751 - RNA, 19 nt, Human
gaacucaaccauacuuucc

SEQ ID NO: 462752 - RNA, 25 nt, Human
gagaaagaaggaaaagcuaacaaaa

SEQ ID NO: 462753 - RNA, 19 nt, Human
gagcaaaccucuagagcug

SEQ ID NO: 462754 - RNA, 18 nt, Human
gagcugcauaaaccacaa

SEQ ID NO: 462755 - RNA, 21 nt, Human
gcacagacucagacaauuaca

SEQ ID NO: 462756 - RNA, 23 nt, Human
gcagagacguuucuguuuuucuu

SEQ ID NO: 462757 - RNA, 21 nt, Human
gccggugucguugucauggga

SEQ ID NO: 462758 - RNA, 19 nt, Human
gcgucccagccggcuuagg

SEQ ID NO: 462759 - RNA, 21 nt, Human
gcuccaagguccggagccuca

SEQ ID NO: 462760 - RNA, 18 nt, Human
ggagcaugagaaccucuc

SEQ ID NO: 462761 - RNA, 20 nt, Human
ggcagaaagccaccccagcu

SEQ ID NO: 462762 - RNA, 24 nt, Human
ggcccuuugcucagaaucagagga

SEQ ID NO: 462763 - RNA, 24 nt, Human
gggaacgcgggagggcggucuagc

SEQ ID NO: 462764 - RNA, 21 nt, Human
ggggagcaugagaaccucucu

SEQ ID NO: 462765 - RNA, 24 nt, Human
guauacauguaccuaacaaaaaaa

SEQ ID NO: 462766 - RNA, 25 nt, Human
guccggagccucagcgagcgcacug

SEQ ID NO: 462767 - RNA, 19 nt, Human
uaaaacagagugaucuaaa

SEQ ID NO: 462768 - RNA, 20 nt, Human
uaaaacagagugaucuaaaa

SEQ ID NO: 462769 - RNA, 19 nt, Human
uaaaccaaaacaaaacuau

SEQ ID NO: 462770 - RNA, 23 nt, Human
uaaauccccuguggcacagaucc

SEQ ID NO: 462771 - RNA, 24 nt, Human
uaagcagcauucauguaauacaga

SEQ ID NO: 462772 - RNA, 22 nt, Human
uaaggagggggggggagcauga

SEQ ID NO: 462773 - RNA, 18 nt, Human
uacaaauaaggagggggg

SEQ ID NO: 462774 - RNA, 26 nt, Human
uacaauagcaaaaacuggugucagag

SEQ ID NO: 462775 - RNA, 18 nt, Human
uacacugcaguugaugga

SEQ ID NO: 462776 - RNA, 22 nt, Human
uacccacgaugcucgauuuaau

SEQ ID NO: 462777 - RNA, 21 nt, Human
uacuuagucacaggggcugaa

SEQ ID NO: 462778 - RNA, 25 nt, Human
uagagaaauacuggcauauauaugu

SEQ ID NO: 462779 - RNA, 21 nt, Human
uauaaaaagaaacuuaagauc

SEQ ID NO: 462780 - RNA, 22 nt, Human
uauguaugugugcauaugugug

SEQ ID NO: 462781 - RNA, 18 nt, Human
ucaaaucccagagauggc

SEQ ID NO: 462782 - RNA, 20 nt, Human
ucagacaaauguugcuguuc

SEQ ID NO: 462783 - RNA, 24 nt, Human
ucagcucuucucuuucuuccuuuc

SEQ ID NO: 462784 - RNA, 18 nt, Human
ucaggcagguguauacau

SEQ ID NO: 462785 - RNA, 23 nt, Human
uccaagcauauaucucccugaga

SEQ ID NO: 462786 - RNA, 19 nt, Human
uccacaauaaaguauggau

SEQ ID NO: 462787 - RNA, 21 nt, Human
uccauuguguuugaucugguc

SEQ ID NO: 462788 - RNA, 24 nt, Human
ucuagcguccggcuccccuuagcg

SEQ ID NO: 462789 - RNA, 18 nt, Human
ucucucaacuaaaacaga

SEQ ID NO: 462790 - RNA, 24 nt, Human
ucucuggaaucugaauggaagagu

SEQ ID NO: 462791 - RNA, 22 nt, Human
ucugaacuuucuugagugcccc

SEQ ID NO: 462792 - RNA, 22 nt, Human
ucuggucuuuuauauguuagaa

SEQ ID NO: 462793 - RNA, 23 nt, Human
ucuucugccauucaggccuugaa

SEQ ID NO: 462794 - RNA, 22 nt, Human
ucuuucuuccuuuccaaccucc

SEQ ID NO: 462795 - RNA, 18 nt, Human
ugaaaaaacacuacccac

SEQ ID NO: 462796 - RNA, 21 nt, Human
ugaaaaaagaaacuaaaacac

SEQ ID NO: 462797 - RNA, 20 nt, Human
ugaaaaagcguaaguguugc

SEQ ID NO: 462798 - RNA, 22 nt, Human
ugaaaagacaaguuagaauaug

SEQ ID NO: 462799 - RNA, 28 nt, Human
ugaaaagacaaguuagaauaugaaaaua

SEQ ID NO: 462800 - RNA, 23 nt, Human
ugaaauagaaauuccacaacaaa

SEQ ID NO: 462801 - RNA, 18 nt, Human
ugaccacuaaaggugaug

SEQ ID NO: 462802 - RNA, 18 nt, Human
ugagaauagugugugcua

SEQ ID NO: 462803 - RNA, 18 nt, Human
ugaggggugggcguugag

SEQ ID NO: 462804 - RNA, 24 nt, Human
ugagugccccaucacuccugccuc

SEQ ID NO: 462805 - RNA, 24 nt, Human
ugcaauccgacaccugcuguagcc

SEQ ID NO: 462806 - RNA, 19 nt, Human
ugcaguggcagaugcagag

SEQ ID NO: 462807 - RNA, 18 nt, Human
ugccaucauuucuuccca

SEQ ID NO: 462808 - RNA, 21 nt, Human
ugcccgagagggaggcggagg

SEQ ID NO: 462809 - RNA, 19 nt, Human
ugccuccucugaacuuucu

SEQ ID NO: 462810 - RNA, 23 nt, Human
ugcuuugcuugauuggacaaaua

SEQ ID NO: 462811 - RNA, 24 nt, Human
uggaaaucugucuuucaaaaccuc

SEQ ID NO: 462812 - RNA, 19 nt, Human
uggaacaacuugucaaggc

SEQ ID NO: 462813 - RNA, 23 nt, Human
uggaacagacauacucauagaua

SEQ ID NO: 462814 - RNA, 19 nt, Human
uggagagaaagaaggaaaa

SEQ ID NO: 462815 - RNA, 19 nt, Human
ugggagcagaagacuuuac

SEQ ID NO: 462816 - RNA, 19 nt, Human
ugggagugggagcagaaga

SEQ ID NO: 462817 - RNA, 20 nt, Human
ugguagguaaacccugggac

SEQ ID NO: 462818 - RNA, 18 nt, Human
ugucaugggaacgcggga

SEQ ID NO: 462819 - RNA, 21 nt, Human
uguuaaaaauaaaccaaaaca

SEQ ID NO: 462820 - RNA, 24 nt, Human
uucauguaauacagaauuccugag

SEQ ID NO: 462821 - RNA, 19 nt, Human
uuccauuguguuugaucug

SEQ ID NO: 462822 - RNA, 24 nt, Human
uucuguggcccuaauuuggaaaag

SEQ ID NO: 462823 - RNA, 20 nt, Human
uugcuacgauugcuacaaau

SEQ ID NO: 462824 - RNA, 19 nt, Human
uugguuugaccacuaaagg

SEQ ID NO: 462825 - RNA, 24 nt, Human
uuucaaaaccucaccacccucuuu

SEQ ID NO: 462826 - RNA, 24 nt, Human
uuugccaagcuuugaggcugguua

SEQ ID NO: 462827 - RNA, 18 nt, Human
acaaggguuucccuggac

SEQ ID NO: 462828 - RNA, 23 nt, Human
aucaaaauacaaggguuucccug

SEQ ID NO: 462829 - RNA, 25 nt, Human
caagcagguuuuaaagugcacuauu

SEQ ID NO: 462830 - RNA, 21 nt, Human
ccuggacacuugguaaccaag

SEQ ID NO: 462831 - RNA, 23 nt, Human
uuuaaagugcacuauugugucca

SEQ ID NO: 462832 - RNA, 19 nt, Human
aaacagagccagcugcuaa

SEQ ID NO: 462833 - RNA, 24 nt, Human
aaacugguccuguccuggccccua

SEQ ID NO: 462834 - RNA, 24 nt, Human
aacaaagucaucauaagguaacca

SEQ ID NO: 462835 - RNA, 21 nt, Human
aacagagccagcugcuaacgg

SEQ ID NO: 462836 - RNA, 27 nt, Human
aacagcuuuaagggggagagccgacca

SEQ ID NO: 462837 - RNA, 24 nt, Human
aacaggcaaaccccagaaagucca

SEQ ID NO: 462838 - RNA, 21 nt, Human
aacugguccuguccuggcccc

SEQ ID NO: 462839 - RNA, 21 nt, Human
aacuucuucccuaacccaggg

SEQ ID NO: 462840 - RNA, 27 nt, Human
aagcaagcaggcccggggcugcuuccc

SEQ ID NO: 462841 - RNA, 20 nt, Human
aagcagcuuggauccccagc

SEQ ID NO: 462842 - RNA, 20 nt, Human
aagggggagagccgucugcc

SEQ ID NO: 462843 - RNA, 18 nt, Human
acagagccagcugcuaac

SEQ ID NO: 462844 - RNA, 23 nt, Human
accaccauaucuggaaagaggua

SEQ ID NO: 462845 - RNA, 21 nt, Human
acugguccuguccuggccccu

SEQ ID NO: 462846 - RNA, 21 nt, Human
agaacaugaacccccauugag

SEQ ID NO: 462847 - RNA, 19 nt, Human
agaaugaguggugggacag

SEQ ID NO: 462848 - RNA, 18 nt, Human
agagagaagaagggaggg

SEQ ID NO: 462849 - RNA, 22 nt, Human
agagguggcagcauaccacagg

SEQ ID NO: 462850 - RNA, 23 nt, Human
agccgggcagcuggcagcuucca

SEQ ID NO: 462851 - RNA, 23 nt, Human
agccucggaaugcaccaggcacc

SEQ ID NO: 462852 - RNA, 23 nt, Human
aggaacgcaggcagugaagcugc

SEQ ID NO: 462853 - RNA, 20 nt, Human
aggaagcaagcaggcccggg

SEQ ID NO: 462854 - RNA, 22 nt, Human
aggaagcaagcaggcccggggc

SEQ ID NO: 462855 - RNA, 27 nt, Human
aggaaggcccaagaagucucuggcucu

SEQ ID NO: 462856 - RNA, 19 nt, Human
aggauucccccagugggag

SEQ ID NO: 462857 - RNA, 21 nt, Human
aggcaaaccccagaaagucca

SEQ ID NO: 462858 - RNA, 18 nt, Human
aggcagggcuggccucgg

SEQ ID NO: 462859 - RNA, 23 nt, Human
aggcagggcuggccucggcugcc

SEQ ID NO: 462860 - RNA, 19 nt, Human
aggggaggcaagggagaau

SEQ ID NO: 462861 - RNA, 22 nt, Human
aucccugcuauuccugcauccc

SEQ ID NO: 462862 - RNA, 22 nt, Human
caaaggugggcagguccucucu

SEQ ID NO: 462863 - RNA, 24 nt, Human
caacuccugcacugaggaaccccu

SEQ ID NO: 462864 - RNA, 21 nt, Human
caagcagcuuggauccccagc

SEQ ID NO: 462865 - RNA, 22 nt, Human
caagcagcuuggauccccagcc

SEQ ID NO: 462866 - RNA, 22 nt, Human
cacaccccugcucuggcccacu

SEQ ID NO: 462867 - RNA, 18 nt, Human
cacgcaggcuucuaaggg

SEQ ID NO: 462868 - RNA, 19 nt, Human
cacuaccaagccauccccc

SEQ ID NO: 462869 - RNA, 24 nt, Human
cagcagguggcccacuuaccuucc

SEQ ID NO: 462870 - RNA, 23 nt, Human
cagcauaccacagggcaaggaca

SEQ ID NO: 462871 - RNA, 18 nt, Human
caggaacaaacgccaaag

SEQ ID NO: 462872 - RNA, 21 nt, Human
caggcaaaccccagaaagucc

SEQ ID NO: 462873 - RNA, 24 nt, Human
cagggcaaggacagcaauucccuu

SEQ ID NO: 462874 - RNA, 18 nt, Human
cagggcagggacagggcc

SEQ ID NO: 462875 - RNA, 18 nt, Human
caguggacggucacuuuc

SEQ ID NO: 462876 - RNA, 18 nt, Human
caguguuggggggugccu

SEQ ID NO: 462877 - RNA, 23 nt, Human
ccaacccaggcagggcuggccuc

SEQ ID NO: 462878 - RNA, 26 nt, Human
ccacuaccaagccaucccccagggaa

SEQ ID NO: 462879 - RNA, 18 nt, Human
ccagaaaguccacuacca

SEQ ID NO: 462880 - RNA, 22 nt, Human
ccaggaacgcaggcagugaagc

SEQ ID NO: 462881 - RNA, 20 nt, Human
cccagaaaguccacuaccaa

SEQ ID NO: 462882 - RNA, 19 nt, Human
ccccagaaaguccacuacc

SEQ ID NO: 462883 - RNA, 20 nt, Human
ccccauugaggaagcccagg

SEQ ID NO: 462884 - RNA, 19 nt, Human
ccccuaggggguggcaggc

SEQ ID NO: 462885 - RNA, 19 nt, Human
ccccuggucccuggugugg

SEQ ID NO: 462886 - RNA, 23 nt, Human
cccucaagcagcuuggaucccca

SEQ ID NO: 462887 - RNA, 20 nt, Human
cccugguguggugcugccuc

SEQ ID NO: 462888 - RNA, 18 nt, Human
ccuccaaccaccauaucu

SEQ ID NO: 462889 - RNA, 20 nt, Human
ccugcacugaggaaccccuc

SEQ ID NO: 462890 - RNA, 19 nt, Human
cgaccagcuggaacagcaa

SEQ ID NO: 462891 - RNA, 21 nt, Human
cuagcuccauccuuccauucc

SEQ ID NO: 462892 - RNA, 24 nt, Human
cucagggagaagaacugggaguuu

SEQ ID NO: 462893 - RNA, 20 nt, Human
cucuagggcuuaccuggccc

SEQ ID NO: 462894 - RNA, 22 nt, Human
cugcccaccagccaagaccagg

SEQ ID NO: 462895 - RNA, 22 nt, Human
cuggcguaacaggcaaacccca

SEQ ID NO: 462896 - RNA, 23 nt, Human
cuugggagccaagcccucccagg

SEQ ID NO: 462897 - RNA, 20 nt, Human
gaaggcccaagaagucucug

SEQ ID NO: 462898 - RNA, 19 nt, Human
gaaucguaaaauuccuaug

SEQ ID NO: 462899 - RNA, 19 nt, Human
gacacucacaccauugcca

SEQ ID NO: 462900 - RNA, 23 nt, Human
gagggggcugggagcaagcuauc

SEQ ID NO: 462901 - RNA, 24 nt, Human
gauccgagcccccugcugaucuca

SEQ ID NO: 462902 - RNA, 22 nt, Human
gcaagggagaaugggcucugaa

SEQ ID NO: 462903 - RNA, 19 nt, Human
gcagagcuggccugcagcg

SEQ ID NO: 462904 - RNA, 20 nt, Human
gccacaggcuuccccuuccc

SEQ ID NO: 462905 - RNA, 25 nt, Human
gcccugggacuucuugggagcccca

SEQ ID NO: 462906 - RNA, 19 nt, Human
gccucggcugcccugggac

SEQ ID NO: 462907 - RNA, 21 nt, Human
gccugcagcgggcuccagugu

SEQ ID NO: 462908 - RNA, 20 nt, Human
gcucagggagaagaacuggg

SEQ ID NO: 462909 - RNA, 23 nt, Human
gcuggccucggcugcccugggac

SEQ ID NO: 462910 - RNA, 26 nt, Human
gcuuucuagcuccauccuuccauucc

SEQ ID NO: 462911 - RNA, 19 nt, Human
ggaaaggccuccacuauag

SEQ ID NO: 462912 - RNA, 18 nt, Human
ggaacagcuuuaaggggg

SEQ ID NO: 462913 - RNA, 21 nt, Human
ggaaugcaccaggcaccacua

SEQ ID NO: 462914 - RNA, 25 nt, Human
ggagaacaaagucaucauaaggaag

SEQ ID NO: 462915 - RNA, 19 nt, Human
ggcagggcuggccucggcu

SEQ ID NO: 462916 - RNA, 19 nt, Human
ggccacacuuaaagcuuag

SEQ ID NO: 462917 - RNA, 20 nt, Human
ggccugugaagggcugaggg

SEQ ID NO: 462918 - RNA, 20 nt, Human
ggcugaggguggcuucacca

SEQ ID NO: 462919 - RNA, 21 nt, Human
gggauuccugcuccucugcuc

SEQ ID NO: 462920 - RNA, 21 nt, Human
gggcaguggacggucacuuuc

SEQ ID NO: 462921 - RNA, 18 nt, Human
ggggggugccugggcacc

SEQ ID NO: 462922 - RNA, 21 nt, Human
ggggugccugggcaccccugg

SEQ ID NO: 462923 - RNA, 20 nt, Human
gguggcccacuuaccuuccc

SEQ ID NO: 462924 - RNA, 24 nt, Human
ggugguugggagugggaugggugu

SEQ ID NO: 462925 - RNA, 21 nt, Human
gguguggugcugccucaggag

SEQ ID NO: 462926 - RNA, 18 nt, Human
gucaguuucuccaaccca

SEQ ID NO: 462927 - RNA, 18 nt, Human
gugaagggcugagggugg

SEQ ID NO: 462928 - RNA, 18 nt, Human
gugggaugggugucggag

SEQ ID NO: 462929 - RNA, 23 nt, Human
guggguccccucucugcaggccc

SEQ ID NO: 462930 - RNA, 21 nt, Human
guguaacaccauugcauccag

SEQ ID NO: 462931 - RNA, 22 nt, Human
uaaagcuuagaaguccgagucu

SEQ ID NO: 462932 - RNA, 23 nt, Human
uaaaugaauacuacacuccuucc

SEQ ID NO: 462933 - RNA, 18 nt, Human
uaacaggcaaaccccaga

SEQ ID NO: 462934 - RNA, 21 nt, Human
uaacaggcaaaccccagaaag

SEQ ID NO: 462935 - RNA, 25 nt, Human
uaaggcaacuuugguccaagguuga

SEQ ID NO: 462936 - RNA, 21 nt, Human
uacauggaguggggcucggca

SEQ ID NO: 462937 - RNA, 20 nt, Human
uagggcuuaccuggcccacu

SEQ ID NO: 462938 - RNA, 19 nt, Human
ucacaccccugcucuggcc

SEQ ID NO: 462939 - RNA, 21 nt, Human
uccaagaacaugaacccccau

SEQ ID NO: 462940 - RNA, 21 nt, Human
uccaagguugacccccucaag

SEQ ID NO: 462941 - RNA, 26 nt, Human
ucccccagugggagggagaacaaagu

SEQ ID NO: 462942 - RNA, 20 nt, Human
ucccugaagcccuuuuaccu

SEQ ID NO: 462943 - RNA, 21 nt, Human
uccugcaucccccugcucuuc

SEQ ID NO: 462944 - RNA, 18 nt, Human
uccuggauauuccugguu

SEQ ID NO: 462945 - RNA, 21 nt, Human
ucugcccaccagccaagacca

SEQ ID NO: 462946 - RNA, 23 nt, Human
ucuuagggcuggauccgagcccc

SEQ ID NO: 462947 - RNA, 18 nt, Human
ugaacaaaucagggccac

SEQ ID NO: 462948 - RNA, 24 nt, Human
ugaacccccauugaggaagcccag

SEQ ID NO: 462949 - RNA, 22 nt, Human
ugaagcccuuuuaccacaggcu

SEQ ID NO: 462950 - RNA, 27 nt, Human
ugaagcuagggggagauuagcccagug

SEQ ID NO: 462951 - RNA, 19 nt, Human
ugacaaauaccaagcucag

SEQ ID NO: 462952 - RNA, 21 nt, Human
ugaguagacuuaaggcacaaa

SEQ ID NO: 462953 - RNA, 22 nt, Human
ugcccugggacuucuugggagc

SEQ ID NO: 462954 - RNA, 22 nt, Human
uggaaacagagccagcugcuaa

SEQ ID NO: 462955 - RNA, 19 nt, Human
uggcacaugacaaauacca

SEQ ID NO: 462956 - RNA, 19 nt, Human
uggcacuuaagauacaacu

SEQ ID NO: 462957 - RNA, 18 nt, Human
uggcagcauaccacaggg

SEQ ID NO: 462958 - RNA, 20 nt, Human
ugggaaguagggggcgcucu

SEQ ID NO: 462959 - RNA, 22 nt, Human
ugggagugggaugggugucggg

SEQ ID NO: 462960 - RNA, 18 nt, Human
uggggagggggcugggag

SEQ ID NO: 462961 - RNA, 23 nt, Human
uggggcugugcuguguccagaug

SEQ ID NO: 462962 - RNA, 19 nt, Human
uggggggugccugggcacc

SEQ ID NO: 462963 - RNA, 21 nt, Human
uggugcugccucaggagggca

SEQ ID NO: 462964 - RNA, 22 nt, Human
uguccagaugggcuccaugggg

SEQ ID NO: 462965 - RNA, 19 nt, Human
ugucggaggcucccuggga

SEQ ID NO: 462966 - RNA, 22 nt, Human
uuaagggggagagccgucugcc

SEQ ID NO: 462967 - RNA, 18 nt, Human
uucccucugugccgugag

SEQ ID NO: 462968 - RNA, 22 nt, Human
uuucuagcuccauccuuccauu

SEQ ID NO: 462969 - RNA, 24 nt, Human
uuucuagcuccauccuuccauucc

SEQ ID NO: 462970 - RNA, 23 nt, Human
uuugguccaagguugacccccuc

SEQ ID NO: 462971 - RNA, 22 nt, Human
uuuuuuuuuuuuuugagaugga

SEQ ID NO: 462972 - RNA, 27 nt, Human
uuuuuuuuuuuuuuuuuuuuuuugggg

SEQ ID NO: 462973 - RNA, 24 nt, Human
aaagugcugagauuacaggcguga

SEQ ID NO: 462974 - RNA, 19 nt, Human
aacaauccuucugccucag

SEQ ID NO: 462975 - RNA, 26 nt, Human
aagugcugagauuacaggcgugagcc

SEQ ID NO: 462976 - RNA, 19 nt, Human
acccaggcuggagugcagu

SEQ ID NO: 462977 - RNA, 25 nt, Human
acucuguuacccaggcuggagugca

SEQ ID NO: 462978 - RNA, 19 nt, Human
acugauuuacauucccacc

SEQ ID NO: 462979 - RNA, 23 nt, Human
agauguaaccuaacaggugugag

SEQ ID NO: 462980 - RNA, 22 nt, Human
agauuacaggcgugagccacca

SEQ ID NO: 462981 - RNA, 24 nt, Human
agauuacaggcgugagccaccaug

SEQ ID NO: 462982 - RNA, 21 nt, Human
agcacuuuuucauauaccugu

SEQ ID NO: 462983 - RNA, 18 nt, Human
agccaccaugcccagccc

SEQ ID NO: 462984 - RNA, 21 nt, Human
agcugcaggaacacggagugg

SEQ ID NO: 462985 - RNA, 25 nt, Human
aggcuggagugcaguaaugcgaucu

SEQ ID NO: 462986 - RNA, 23 nt, Human
aguagcugggauuacaggcgcgu

SEQ ID NO: 462987 - RNA, 25 nt, Human
aguagcugggauuacaggcgcgugc

SEQ ID NO: 462988 - RNA, 24 nt, Human
agugcaguaaugcgaucucggcuc

SEQ ID NO: 462989 - RNA, 21 nt, Human
auccuucugccucagccuccc

SEQ ID NO: 462990 - RNA, 24 nt, Human
caaagugcugagauuacaggcgug

SEQ ID NO: 462991 - RNA, 23 nt, Human
caaccuccaccucccggguucaa

SEQ ID NO: 462992 - RNA, 24 nt, Human
caccucggccucccaaagugcuga

SEQ ID NO: 462993 - RNA, 23 nt, Human
cacucuguuacccaggcuggagu

SEQ ID NO: 462994 - RNA, 24 nt, Human
cacucuguuacccaggcuggagug

SEQ ID NO: 462995 - RNA, 21 nt, Human
cacugcaaccuccaccucccg

SEQ ID NO: 462996 - RNA, 23 nt, Human
cacugcaaccuccaccucccggg

SEQ ID NO: 462997 - RNA, 25 nt, Human
caugguguuagccaggauggucucc

SEQ ID NO: 462998 - RNA, 20 nt, Human
ccaaagugcugagauuacag

SEQ ID NO: 462999 - RNA, 22 nt, Human
ccaaagugcugagauuacaggc

SEQ ID NO: 463000 - RNA, 22 nt, Human
ccaaagugcugagauuacaggc

SEQ ID NO: 463001 - RNA, 24 nt, Human
ccaaagugcugagauuacaggcgu

SEQ ID NO: 463002 - RNA, 20 nt, Human
ccaccacaccuggcuaaugu

SEQ ID NO: 463003 - RNA, 27 nt, Human
ccaccucccggguucaaacaauccuuu

SEQ ID NO: 463004 - RNA, 27 nt, Human
ccaucaugguguuagccaggauggucu

SEQ ID NO: 463005 - RNA, 23 nt, Human
cccgaguagcugggauuacaggc

SEQ ID NO: 463006 - RNA, 24 nt, Human
cccgaguagcugggauuacaggcg

SEQ ID NO: 463007 - RNA, 21 nt, Human
cccggguucaaacaauccuuc

SEQ ID NO: 463008 - RNA, 22 nt, Human
ccgaguagcugggauuacaggc

SEQ ID NO: 463009 - RNA, 18 nt, Human
ccuaacaggugugaggug

SEQ ID NO: 463010 - RNA, 24 nt, Human
ccuucugccucagccucccgagua

SEQ ID NO: 463011 - RNA, 24 nt, Human
cucacucuguuacccaggcuggag

SEQ ID NO: 463012 - RNA, 24 nt, Human
cucacugcaaccuccaccucccgg

SEQ ID NO: 463013 - RNA, 24 nt, Human
cucagccucccgaguagcugggau

SEQ ID NO: 463014 - RNA, 21 nt, Human
cucccaaagugcugagauuac

SEQ ID NO: 463015 - RNA, 21 nt, Human
cucccggguucaaacaauccu

SEQ ID NO: 463016 - RNA, 18 nt, Human
cuccugaccuugugauuc

SEQ ID NO: 463017 - RNA, 26 nt, Human
cucuacacuguuuuccacaauagcug

SEQ ID NO: 463018 - RNA, 18 nt, Human
cugcaaccuccaccuccc

SEQ ID NO: 463019 - RNA, 23 nt, Human
cugcaaccuccaccucccggguu

SEQ ID NO: 463020 - RNA, 23 nt, Human
cugccucagccucccgaguagcu

SEQ ID NO: 463021 - RNA, 23 nt, Human
cuuguucauuuuugcuuuucuug

SEQ ID NO: 463022 - RNA, 23 nt, Human
cuuuucuugccugagcuuuuggu

SEQ ID NO: 463023 - RNA, 18 nt, Human
gaacacggaguggagaag

SEQ ID NO: 463024 - RNA, 22 nt, Human
gaccuugugauucucccaccuc

SEQ ID NO: 463025 - RNA, 22 nt, Human
gaccuugugauucucccaccuc

SEQ ID NO: 463026 - RNA, 24 nt, Human
gaccuugugauucucccaccucgg

SEQ ID NO: 463027 - RNA, 18 nt, Human
gauuacaggcgcgugcca

SEQ ID NO: 463028 - RNA, 18 nt, Human
gauuacaggcgugagcca

SEQ ID NO: 463029 - RNA, 24 nt, Human
gauuacaggcgugagccaccaugc

SEQ ID NO: 463030 - RNA, 22 nt, Human
gcaaccuccaccucccggguuc

SEQ ID NO: 463031 - RNA, 19 nt, Human
gcaggaacacggaguggag

SEQ ID NO: 463032 - RNA, 19 nt, Human
ggagaagacuaagucugug

SEQ ID NO: 463033 - RNA, 19 nt, Human
ggucucagucuccugaccu

SEQ ID NO: 463034 - RNA, 18 nt, Human
guagcugggauuacaggc

SEQ ID NO: 463035 - RNA, 19 nt, Human
guagucagacuguaggugc

SEQ ID NO: 463036 - RNA, 18 nt, Human
guaucucauuguggcuuu

SEQ ID NO: 463037 - RNA, 20 nt, Human
gugaguuccuuauauaguuu

SEQ ID NO: 463038 - RNA, 24 nt, Human
gugauucucccaccucggccuccc

SEQ ID NO: 463039 - RNA, 24 nt, Human
uaauguuucauauuuuuaguagag

SEQ ID NO: 463040 - RNA, 27 nt, Human
uacaaaaauucccuuuucuccagaccc

SEQ ID NO: 463041 - RNA, 23 nt, Human
uacacuguuuuccacaauagcug

SEQ ID NO: 463042 - RNA, 22 nt, Human
uacaggcgcgugccaccacacc

SEQ ID NO: 463043 - RNA, 24 nt, Human
uacaggcgugagccaccaugccca

SEQ ID NO: 463044 - RNA, 22 nt, Human
uacccaggcuggagugcaguaa

SEQ ID NO: 463045 - RNA, 23 nt, Human
uaguagagauggguguuagccca

SEQ ID NO: 463046 - RNA, 24 nt, Human
uaguagagauggguguuagcccau

SEQ ID NO: 463047 - RNA, 27 nt, Human
uaguagagauggguguuagcccaucau

SEQ ID NO: 463048 - RNA, 23 nt, Human
uauacaaaaauucccuuuucucc

SEQ ID NO: 463049 - RNA, 18 nt, Human
uauuuuuuuuuuuuuuga

SEQ ID NO: 463050 - RNA, 24 nt, Human
ucacucuguuacccaggcuggagu

SEQ ID NO: 463051 - RNA, 23 nt, Human
ucacugcaaccuccaccucccgg

SEQ ID NO: 463052 - RNA, 24 nt, Human
ucacugcaaccuccaccucccggg

SEQ ID NO: 463053 - RNA, 25 nt, Human
ucacugcaaccuccaccucccgggu

SEQ ID NO: 463054 - RNA, 27 nt, Human
ucacugcaaccuccaccucccggguuc

SEQ ID NO: 463055 - RNA, 20 nt, Human
ucagccucccgaguagcugg

SEQ ID NO: 463056 - RNA, 24 nt, Human
ucccaaagugcugagauuacaggc

SEQ ID NO: 463057 - RNA, 24 nt, Human
ucccgaguagcugggauuacaggc

SEQ ID NO: 463058 - RNA, 20 nt, Human
ucccggguucaaacaauccu

SEQ ID NO: 463059 - RNA, 24 nt, Human
ucccggguucaaacaauccuucug

SEQ ID NO: 463060 - RNA, 18 nt, Human
ucggccucccaaagugcu

SEQ ID NO: 463061 - RNA, 24 nt, Human
ucucacucuguuacccaggcugga

SEQ ID NO: 463062 - RNA, 26 nt, Human
ucucacucuguuacccaggcuggagu

SEQ ID NO: 463063 - RNA, 27 nt, Human
ucucacucuguuacccaggcuggagug

SEQ ID NO: 463064 - RNA, 20 nt, Human
ucucuuaucuuuuugacaaa

SEQ ID NO: 463065 - RNA, 24 nt, Human
ucuguuacccaggcuggagugcag

SEQ ID NO: 463066 - RNA, 22 nt, Human
ugacaauagcagauguaaccua

SEQ ID NO: 463067 - RNA, 22 nt, Human
ugagauggagucucacucuguu

SEQ ID NO: 463068 - RNA, 18 nt, Human
ugagauuacaggcgugag

SEQ ID NO: 463069 - RNA, 22 nt, Human
ugagauuacaggcgugagccac

SEQ ID NO: 463070 - RNA, 23 nt, Human
ugagauuacaggcgugagccacc

SEQ ID NO: 463071 - RNA, 24 nt, Human
ugagauuacaggcgugagccacca

SEQ ID NO: 463072 - RNA, 25 nt, Human
ugagauuacaggcgugagccaccau

SEQ ID NO: 463073 - RNA, 24 nt, Human
ugaggugguaucucauuguggcuu

SEQ ID NO: 463074 - RNA, 22 nt, Human
ugcaguaaugcgaucucggcuc

SEQ ID NO: 463075 - RNA, 25 nt, Human
ugcccagccccuuugaccauuuuua

SEQ ID NO: 463076 - RNA, 24 nt, Human
ugccucagccucccgaguagcugg

SEQ ID NO: 463077 - RNA, 24 nt, Human
ugcugagauuacaggcgugagcca

SEQ ID NO: 463078 - RNA, 23 nt, Human
uggagugcaguaaugcgaucucg

SEQ ID NO: 463079 - RNA, 24 nt, Human
uggagugcaguaaugcgaucucgg

SEQ ID NO: 463080 - RNA, 18 nt, Human
ugggauuacaggcgcgug

SEQ ID NO: 463081 - RNA, 21 nt, Human
ugggauuacaggcgcgugcca

SEQ ID NO: 463082 - RNA, 22 nt, Human
ugggauuacaggcgcgugccac

SEQ ID NO: 463083 - RNA, 24 nt, Human
ugggauuacaggcgcgugccacca

SEQ ID NO: 463084 - RNA, 21 nt, Human
uguaaccuaacaggugugagg

SEQ ID NO: 463085 - RNA, 20 nt, Human
uguuaggucaugucucuagc

SEQ ID NO: 463086 - RNA, 22 nt, Human
uguuucauauuuuuaguagaga

SEQ ID NO: 463087 - RNA, 24 nt, Human
uguuucauauuuuuaguagagaug

SEQ ID NO: 463088 - RNA, 24 nt, Human
uuacccaggcuggagugcaguaau

SEQ ID NO: 463089 - RNA, 18 nt, Human
uuaguagagauggguguu

SEQ ID NO: 463090 - RNA, 24 nt, Human
uucaaacaauccuucugccucagc

SEQ ID NO: 463091 - RNA, 23 nt, Human
uucucccaaucuacaguccaccu

SEQ ID NO: 463092 - RNA, 20 nt, Human
uuucauauuuuuaguagaga

SEQ ID NO: 463093 - RNA, 20 nt, Human
uuuccacaauagcuguacug

SEQ ID NO: 463094 - RNA, 24 nt, Human
uuuccacaauagcuguacugauuu

SEQ ID NO: 463095 - RNA, 22 nt, Human
uuuguuuucuuuaaguucugug

SEQ ID NO: 463096 - RNA, 20 nt, Human
uuuuuaguagagaugggugu

SEQ ID NO: 463097 - RNA, 23 nt, Human
uuuuuuuuuuugagauggagucu

SEQ ID NO: 463098 - RNA, 26 nt, Human
uuuuuuuuuuuugagauggagucuca

SEQ ID NO: 463099 - RNA, 22 nt, Human
uuuuuuuuuuuuuugagaugga

SEQ ID NO: 463100 - RNA, 23 nt, Human
aaaaaacaagcauggcacaaaua

SEQ ID NO: 463101 - RNA, 24 nt, Human
aaaaaccugggugaaaaaacaagc

SEQ ID NO: 463102 - RNA, 26 nt, Human
aaacuaaaaccaagcaaaaacuggaa

SEQ ID NO: 463103 - RNA, 19 nt, Human
aaaguuugggaucagugug

SEQ ID NO: 463104 - RNA, 23 nt, Human
aaauacuaccuguguacaguaug

SEQ ID NO: 463105 - RNA, 25 nt, Human
aacaauccuuucccacccauucccc

SEQ ID NO: 463106 - RNA, 18 nt, Human
aaccaagcaaaaacugga

SEQ ID NO: 463107 - RNA, 23 nt, Human
aaccagacaagcuuuggauucac

SEQ ID NO: 463108 - RNA, 24 nt, Human
aacugguuuggcuuccaauuuuua

SEQ ID NO: 463109 - RNA, 21 nt, Human
aagauugccacauucuacauu

SEQ ID NO: 463110 - RNA, 24 nt, Human
aagcaaaaacuggaacaaauagga

SEQ ID NO: 463111 - RNA, 24 nt, Human
aagcaaaaacuggaacaaccccgg

SEQ ID NO: 463112 - RNA, 24 nt, Human
aauagagaauggguaagaggcagg

SEQ ID NO: 463113 - RNA, 23 nt, Human
acaggaugaacaggaacuguauu

SEQ ID NO: 463114 - RNA, 22 nt, Human
acccauuccccaaagaccccaa

SEQ ID NO: 463115 - RNA, 24 nt, Human
accucacccuccccuuccgacaca

SEQ ID NO: 463116 - RNA, 18 nt, Human
acucugccuggggcuugg

SEQ ID NO: 463117 - RNA, 18 nt, Human
agaaaaaagacacauaga

SEQ ID NO: 463118 - RNA, 18 nt, Human
agaaaggaaauuggaaaa

SEQ ID NO: 463119 - RNA, 19 nt, Human
agaacuugaauccuuugga

SEQ ID NO: 463120 - RNA, 19 nt, Human
agaauaaccaccgagaaaa

SEQ ID NO: 463121 - RNA, 20 nt, Human
agagaaaaaagacacauaga

SEQ ID NO: 463122 - RNA, 23 nt, Human
agauggacuagguuguagagaag

SEQ ID NO: 463123 - RNA, 18 nt, Human
aggauggagagaaaaaag

SEQ ID NO: 463124 - RNA, 18 nt, Human
aggcagagagggccgggc

SEQ ID NO: 463125 - RNA, 19 nt, Human
aggcagagagggccgggcg

SEQ ID NO: 463126 - RNA, 19 nt, Human
agguagggcuggucuccuu

SEQ ID NO: 463127 - RNA, 23 nt, Human
aguucuuuguuccaguggcccag

SEQ ID NO: 463128 - RNA, 22 nt, Human
augggaugggugagccccagcc

SEQ ID NO: 463129 - RNA, 21 nt, Human
caaacaauccuuucccaccca

SEQ ID NO: 463130 - RNA, 23 nt, Human
caaaccucacccuccccuuccga

SEQ ID NO: 463131 - RNA, 25 nt, Human
caaacuaaaaccaagcaaaaacugg

SEQ ID NO: 463132 - RNA, 26 nt, Human
caaacuaaaaccaagcaaaaacugga

SEQ ID NO: 463133 - RNA, 24 nt, Human
caaagccccuacucaccaccagcu

SEQ ID NO: 463134 - RNA, 20 nt, Human
cacccuccccuuccgacaca

SEQ ID NO: 463135 - RNA, 22 nt, Human
cacccuccccuuccgacacaaa

SEQ ID NO: 463136 - RNA, 22 nt, Human
cacucccuccucccuagacucg

SEQ ID NO: 463137 - RNA, 23 nt, Human
cagagaacaccaaacaugucaaa

SEQ ID NO: 463138 - RNA, 24 nt, Human
cagccgaaagcugccugacagugc

SEQ ID NO: 463139 - RNA, 22 nt, Human
cagugggcaaaccucacccucc

SEQ ID NO: 463140 - RNA, 23 nt, Human
cauauuccugguuugaucccaaa

SEQ ID NO: 463141 - RNA, 21 nt, Human
cccaaaagcuaauguguuccu

SEQ ID NO: 463142 - RNA, 23 nt, Human
cccagaaagcuuaauguucagca

SEQ ID NO: 463143 - RNA, 18 nt, Human
cccagggcggcagggcgg

SEQ ID NO: 463144 - RNA, 19 nt, Human
ccccaaagccccuacucac

SEQ ID NO: 463145 - RNA, 25 nt, Human
ccccaaagccccuacucaccaccag

SEQ ID NO: 463146 - RNA, 19 nt, Human
ccccaacacaguuuuucac

SEQ ID NO: 463147 - RNA, 22 nt, Human
ccccagccaauccagcucuuuc

SEQ ID NO: 463148 - RNA, 24 nt, Human
ccccaguguggggaacaggucaga

SEQ ID NO: 463149 - RNA, 21 nt, Human
ccccgccgcagcugccuccuc

SEQ ID NO: 463150 - RNA, 24 nt, Human
ccccgccgcagcugccuccucccg

SEQ ID NO: 463151 - RNA, 23 nt, Human
ccccgcggcgacggccggggagc

SEQ ID NO: 463152 - RNA, 20 nt, Human
ccccgcugccgccgccgccc

SEQ ID NO: 463153 - RNA, 20 nt, Human
ccgcggcgacggccggggag

SEQ ID NO: 463154 - RNA, 23 nt, Human
ccgcugccgccgccgcccuagcc

SEQ ID NO: 463155 - RNA, 22 nt, Human
ccuacucaccaccagcuagcca

SEQ ID NO: 463156 - RNA, 18 nt, Human
ccuagauuaagccggagc

SEQ ID NO: 463157 - RNA, 22 nt, Human
ccuguguacaguaugugagaaa

SEQ ID NO: 463158 - RNA, 19 nt, Human
ccuuccacucccuccuccc

SEQ ID NO: 463159 - RNA, 21 nt, Human
cgacacaaacuuugaaaaaga

SEQ ID NO: 463160 - RNA, 23 nt, Human
cgaccaggugacuuuccaguuug

SEQ ID NO: 463161 - RNA, 22 nt, Human
cgacggccggggagcucccagg

SEQ ID NO: 463162 - RNA, 21 nt, Human
cgcccccgcugccgccgccgc

SEQ ID NO: 463163 - RNA, 20 nt, Human
cgccgcagcugccuccuccc

SEQ ID NO: 463164 - RNA, 21 nt, Human
cucaaacaauccuuucccacc

SEQ ID NO: 463165 - RNA, 19 nt, Human
cucacaaagagggaaaaac

SEQ ID NO: 463166 - RNA, 19 nt, Human
cucguuauaccauaucccc

SEQ ID NO: 463167 - RNA, 23 nt, Human
cugaagcuaucugcuucuaugau

SEQ ID NO: 463168 - RNA, 27 nt, Human
cugccgcccccgcugccgccgccgccc

SEQ ID NO: 463169 - RNA, 24 nt, Human
cuuuugugugugugugugguuaau

SEQ ID NO: 463170 - RNA, 22 nt, Human
gaaaaaacaagcauggcacaaa

SEQ ID NO: 463171 - RNA, 24 nt, Human
gaaaaagauucuuuucuccauaaa

SEQ ID NO: 463172 - RNA, 24 nt, Human
gaacugguuuggcuuccaauuuuu

SEQ ID NO: 463173 - RNA, 25 nt, Human
gagacccuuccacucccuccucccu

SEQ ID NO: 463174 - RNA, 21 nt, Human
gagcagcagcugcuucuacag

SEQ ID NO: 463175 - RNA, 25 nt, Human
gaucacuuugcuaaugaaaggaaau

SEQ ID NO: 463176 - RNA, 19 nt, Human
gccccaaagccccuacuca

SEQ ID NO: 463177 - RNA, 20 nt, Human
gccccaaagccccuacucac

SEQ ID NO: 463178 - RNA, 22 nt, Human
gccgcccccgcugccgccgccg

SEQ ID NO: 463179 - RNA, 25 nt, Human
gccgcccccgcugccgccgccgccc

SEQ ID NO: 463180 - RNA, 26 nt, Human
gccgcccccgcugccgccgccgcccu

SEQ ID NO: 463181 - RNA, 19 nt, Human
ggaaggagggaggagcgag

SEQ ID NO: 463182 - RNA, 21 nt, Human
ggaauaaauagagaaugggua

SEQ ID NO: 463183 - RNA, 19 nt, Human
ggagucuaguucaguucug

SEQ ID NO: 463184 - RNA, 18 nt, Human
ggcccagaaagcuuaaug

SEQ ID NO: 463185 - RNA, 19 nt, Human
ggcggcagggcggggaggg

SEQ ID NO: 463186 - RNA, 20 nt, Human
ggcggggagggagggcggug

SEQ ID NO: 463187 - RNA, 18 nt, Human
gggagggagggcgguggg

SEQ ID NO: 463188 - RNA, 20 nt, Human
gggaugggugagccccagcc

SEQ ID NO: 463189 - RNA, 21 nt, Human
gggcaaaccucacccuccccu

SEQ ID NO: 463190 - RNA, 24 nt, Human
gguguaaaggaugcuugagaagaa

SEQ ID NO: 463191 - RNA, 21 nt, Human
guugaaaacgaccaugagggu

SEQ ID NO: 463192 - RNA, 18 nt, Human
uaaaaaauacucaaacaa

SEQ ID NO: 463193 - RNA, 21 nt, Human
uaaaaaauacucaaacaaucc

SEQ ID NO: 463194 - RNA, 19 nt, Human
uaaaaguuugggaucagug

SEQ ID NO: 463195 - RNA, 23 nt, Human
uaaauauucucuuuaaauacagc

SEQ ID NO: 463196 - RNA, 21 nt, Human
uaaguaggaguagugucuccc

SEQ ID NO: 463197 - RNA, 20 nt, Human
uacaaaucuuuucaggcuca

SEQ ID NO: 463198 - RNA, 23 nt, Human
uagagaaggccuuucgcuugaca

SEQ ID NO: 463199 - RNA, 18 nt, Human
uagcaagcagccuguucc

SEQ ID NO: 463200 - RNA, 19 nt, Human
uaggccuagacugggacug

SEQ ID NO: 463201 - RNA, 23 nt, Human
uaucccaccagaaaaggcuuuau

SEQ ID NO: 463202 - RNA, 18 nt, Human
ucagagaaccagacaagc

SEQ ID NO: 463203 - RNA, 25 nt, Human
ucauauuccugguuugaucccaaaa

SEQ ID NO: 463204 - RNA, 24 nt, Human
uccaaacuaaaaccaagcaaaaaa

SEQ ID NO: 463205 - RNA, 23 nt, Human
uccacauaggccuccuaugggau

SEQ ID NO: 463206 - RNA, 19 nt, Human
uccagauagcaagcagccu

SEQ ID NO: 463207 - RNA, 18 nt, Human
uccauaaagccaaauucc

SEQ ID NO: 463208 - RNA, 22 nt, Human
ucccacccauuccccaaagacc

SEQ ID NO: 463209 - RNA, 21 nt, Human
uccccagaucaagguagggcu

SEQ ID NO: 463210 - RNA, 19 nt, Human
uccuggagauuuuguacag

SEQ ID NO: 463211 - RNA, 28 nt, Human
uccugugagauccuaguucuuuguuccc

SEQ ID NO: 463212 - RNA, 24 nt, Human
uccuuggggagcccaccaaguugg

SEQ ID NO: 463213 - RNA, 20 nt, Human
uccuugguacuguuucccuu

SEQ ID NO: 463214 - RNA, 21 nt, Human
ucuuugccccaagacuauccc

SEQ ID NO: 463215 - RNA, 19 nt, Human
ugaaaaaacaagcauggca

SEQ ID NO: 463216 - RNA, 22 nt, Human
ugaaaaaacaagcauggcacaa

SEQ ID NO: 463217 - RNA, 19 nt, Human
ugaaaacgaccaugagggu

SEQ ID NO: 463218 - RNA, 18 nt, Human
ugaaggaaggcagguuac

SEQ ID NO: 463219 - RNA, 18 nt, Human
ugccgcccccgcugccgc

SEQ ID NO: 463220 - RNA, 18 nt, Human
ugccuccuuuggccacag

SEQ ID NO: 463221 - RNA, 19 nt, Human
ugcucccuacugccuccau

SEQ ID NO: 463222 - RNA, 20 nt, Human
uggaacaaauaggaaaggca

SEQ ID NO: 463223 - RNA, 22 nt, Human
uggacuagguuguagagaaggc

SEQ ID NO: 463224 - RNA, 22 nt, Human
uggccccaaagccccuacucac

SEQ ID NO: 463225 - RNA, 21 nt, Human
ugggaaggagggaggagcgag

SEQ ID NO: 463226 - RNA, 22 nt, Human
ugggagagaaagggcuuugcca

SEQ ID NO: 463227 - RNA, 27 nt, Human
ugggagcagcagcugcuuccucccggg

SEQ ID NO: 463228 - RNA, 19 nt, Human
ugggaucagugugagucac

SEQ ID NO: 463229 - RNA, 22 nt, Human
ugggaucagugugagucacaac

SEQ ID NO: 463230 - RNA, 22 nt, Human
uggggcuugggagagaaagggc

SEQ ID NO: 463231 - RNA, 23 nt, Human
ugggugagccccagccgaaagcu

SEQ ID NO: 463232 - RNA, 18 nt, Human
uguacagaagcagagacc

SEQ ID NO: 463233 - RNA, 19 nt, Human
uguacagaagcagagaccc

SEQ ID NO: 463234 - RNA, 25 nt, Human
uuaaugcuaaauguuaauauuuagc

SEQ ID NO: 463235 - RNA, 18 nt, Human
uucauauuccugguuuga

SEQ ID NO: 463236 - RNA, 18 nt, Human
uuccagauagcaagcagc

SEQ ID NO: 463237 - RNA, 23 nt, Human
uucccacccauuccccaaagacc

SEQ ID NO: 463238 - RNA, 18 nt, Human
uuccuagauuaagccgga

SEQ ID NO: 463239 - RNA, 22 nt, Human
uuccugguuugaucccaaaagc

SEQ ID NO: 463240 - RNA, 23 nt, Human
uuggauucacauugaaaauacua

SEQ ID NO: 463241 - RNA, 21 nt, Human
uuuucagagaaccagacaagc

SEQ ID NO: 463242 - RNA, 18 nt, Human
aaagaaacuuaagcuuga

SEQ ID NO: 463243 - RNA, 19 nt, Human
aacaugcuuacgugcaugu

SEQ ID NO: 463244 - RNA, 18 nt, Human
aagaaacuuaagcuugaa

SEQ ID NO: 463245 - RNA, 20 nt, Human
aagaaacuuaagcuugaagu

SEQ ID NO: 463246 - RNA, 21 nt, Human
aaugaugguuaucugcauuua

SEQ ID NO: 463247 - RNA, 22 nt, Human
accccagugggguuccaauccc

SEQ ID NO: 463248 - RNA, 21 nt, Human
agaaaugauggugaaguacaa

SEQ ID NO: 463249 - RNA, 22 nt, Human
aguacaagagggugccccaggg

SEQ ID NO: 463250 - RNA, 18 nt, Human
cagccccacugcaaguga

SEQ ID NO: 463251 - RNA, 19 nt, Human
cagguuuggaccuuugcac

SEQ ID NO: 463252 - RNA, 19 nt, Human
ccccaucaagccaggcccc

SEQ ID NO: 463253 - RNA, 21 nt, Human
ccuccucugcugcaggcugaa

SEQ ID NO: 463254 - RNA, 18 nt, Human
ccugacugcauuucucuu

SEQ ID NO: 463255 - RNA, 19 nt, Human
cucugcugccgugcccucc

SEQ ID NO: 463256 - RNA, 19 nt, Human
cugagacuguggcagcccc

SEQ ID NO: 463257 - RNA, 20 nt, Human
cugcauuucucuuacagcug

SEQ ID NO: 463258 - RNA, 20 nt, Human
cugcccccucuucaagaccc

SEQ ID NO: 463259 - RNA, 21 nt, Human
cugcccccucuucaagacccc

SEQ ID NO: 463260 - RNA, 18 nt, Human
cugcugcaggcugaacug

SEQ ID NO: 463261 - RNA, 21 nt, Human
gaccuaaaagaaacuuaagcu

SEQ ID NO: 463262 - RNA, 19 nt, Human
gacucugggguggagagac

SEQ ID NO: 463263 - RNA, 20 nt, Human
gccccugcagacagacagcu

SEQ ID NO: 463264 - RNA, 23 nt, Human
ggagacaagcccagguuuggaaa

SEQ ID NO: 463265 - RNA, 25 nt, Human
ggugaaguacaagagggugccccag

SEQ ID NO: 463266 - RNA, 20 nt, Human
guaacuuaauuugcaucugc

SEQ ID NO: 463267 - RNA, 19 nt, Human
guaggggaugcugugcucc

SEQ ID NO: 463268 - RNA, 22 nt, Human
gugaaguacaagagggugcccc

SEQ ID NO: 463269 - RNA, 21 nt, Human
gugccugagacucuggggugg

SEQ ID NO: 463270 - RNA, 19 nt, Human
guggguguaggaacaugcu

SEQ ID NO: 463271 - RNA, 18 nt, Human
uaagguaggcuggucaug

SEQ ID NO: 463272 - RNA, 23 nt, Human
ucagaaaugauggugaaguacaa

SEQ ID NO: 463273 - RNA, 24 nt, Human
ucagaaaugauggugaaguacaag

SEQ ID NO: 463274 - RNA, 22 nt, Human
uccucugcugcaggcugaacug

SEQ ID NO: 463275 - RNA, 18 nt, Human
ugaaguacaagagggugc

SEQ ID NO: 463276 - RNA, 22 nt, Human
ugaaguuucugagauguagcau

SEQ ID NO: 463277 - RNA, 22 nt, Human
ugacgugaaguggagacaagcc

SEQ ID NO: 463278 - RNA, 22 nt, Human
ugacucaguuuucuuguaguga

SEQ ID NO: 463279 - RNA, 23 nt, Human
ugcaccuuacuaucagguccagc

SEQ ID NO: 463280 - RNA, 21 nt, Human
ugcagacagacagcacgccau

SEQ ID NO: 463281 - RNA, 19 nt, Human
ugccccaggguacauggga

SEQ ID NO: 463282 - RNA, 19 nt, Human
ugcugccgugcccuccucu

SEQ ID NO: 463283 - RNA, 19 nt, Human
ugcuuacgugcaugugcgu

SEQ ID NO: 463284 - RNA, 21 nt, Human
uggagagaccccagugggguu

SEQ ID NO: 463285 - RNA, 21 nt, Human
ugggguggagagaccccagug

SEQ ID NO: 463286 - RNA, 22 nt, Human
aaaaaagagaaauucauaaaga

SEQ ID NO: 463287 - RNA, 18 nt, Human
aaaaagucaaaugccucc

SEQ ID NO: 463288 - RNA, 23 nt, Human
aagaaaaaaagagaaauucauaa

SEQ ID NO: 463289 - RNA, 21 nt, Human
aaguguccaugugugauaaau

SEQ ID NO: 463290 - RNA, 20 nt, Human
aaguucucuuucugggcauc

SEQ ID NO: 463291 - RNA, 22 nt, Human
acagaacucgucuaguuccgaa

SEQ ID NO: 463292 - RNA, 20 nt, Human
acagagaagaaaaaaagaga

SEQ ID NO: 463293 - RNA, 26 nt, Human
agaaaaaaagagaaauucauaaagag

SEQ ID NO: 463294 - RNA, 22 nt, Human
agaagaaaaaaagagaaauuca

SEQ ID NO: 463295 - RNA, 18 nt, Human
agagaagaaaaaaagaga

SEQ ID NO: 463296 - RNA, 24 nt, Human
agauucccagcauagcacaaguuc

SEQ ID NO: 463297 - RNA, 20 nt, Human
caaaugccuccauguaaaua

SEQ ID NO: 463298 - RNA, 24 nt, Human
cugcaaguucucuuucugggcauc

SEQ ID NO: 463299 - RNA, 21 nt, Human
gucaaaugccuccauguaaau

SEQ ID NO: 463300 - RNA, 19 nt, Human
guggauugagcugcaaguu

SEQ ID NO: 463301 - RNA, 23 nt, Human
ucccagcauagcacaaguuccug

SEQ ID NO: 463302 - RNA, 21 nt, Human
ugacaggauuucuacagaacu

SEQ ID NO: 463303 - RNA, 23 nt, Human
uuacuaauauucacagguaacac

SEQ ID NO: 463304 - RNA, 19 nt, Human
aaaaacauacaguaucuua

SEQ ID NO: 463305 - RNA, 28 nt, Human
aaaaugccaacuguacuuggacaaaaua

SEQ ID NO: 463306 - RNA, 20 nt, Human
agagaaguaaauaaagccaa

SEQ ID NO: 463307 - RNA, 21 nt, Human
agggugguaaaauuauucugg

SEQ ID NO: 463308 - RNA, 23 nt, Human
auaaagccaauggcacucccuuc

SEQ ID NO: 463309 - RNA, 24 nt, Human
caauggcacucccuucagaggcuc

SEQ ID NO: 463310 - RNA, 23 nt, Human
ccauuaaaauaggcuaaaaugaa

SEQ ID NO: 463311 - RNA, 19 nt, Human
ccccgcgccgcgcugcccc

SEQ ID NO: 463312 - RNA, 21 nt, Human
cccgcgccgcgcugccccugc

SEQ ID NO: 463313 - RNA, 22 nt, Human
cccgcgccgcgcugccccugca

SEQ ID NO: 463314 - RNA, 24 nt, Human
cccugcacugcgggcuaccucccc

SEQ ID NO: 463315 - RNA, 22 nt, Human
ccgcgucccgucgguggccccg

SEQ ID NO: 463316 - RNA, 26 nt, Human
uaaauaaagccaauggcacucccuuc

SEQ ID NO: 463317 - RNA, 23 nt, Human
ucaggacuagcagaggagagaag

SEQ ID NO: 463318 - RNA, 18 nt, Human
uccagagaugacaucuag

SEQ ID NO: 463319 - RNA, 19 nt, Human
ugguuguccauuaaaguuu

SEQ ID NO: 463320 - RNA, 21 nt, Human
uuuacauaaacuuauaaggau

SEQ ID NO: 463321 - RNA, 24 nt, Human
augcaaccuuuacgaaggccuucc

SEQ ID NO: 463322 - RNA, 24 nt, Human
auuuuuuuuuuucccgcggguccc

SEQ ID NO: 463323 - RNA, 24 nt, Human
cauaucuguuucaaaaguaucaga

SEQ ID NO: 463324 - RNA, 22 nt, Human
cccgcggguccccaggagcgaa

SEQ ID NO: 463325 - RNA, 21 nt, Human
ccuuuacgaaggccuuccucc

SEQ ID NO: 463326 - RNA, 18 nt, Human
gaccaccgagauuuggaa

SEQ ID NO: 463327 - RNA, 22 nt, Human
ggauuuuuuuuuuucccgcggg

SEQ ID NO: 463328 - RNA, 20 nt, Human
ggcuagaugacugaagagca

SEQ ID NO: 463329 - RNA, 24 nt, Human
ggguguuggauuuuuuuuuuuccc

SEQ ID NO: 463330 - RNA, 23 nt, Human
ggugacaaaaucgagcggagaga

SEQ ID NO: 463331 - RNA, 24 nt, Human
guggcuagaugacugaagagcaaa

SEQ ID NO: 463332 - RNA, 21 nt, Human
uacgaaggccuuccuccuccc

SEQ ID NO: 463333 - RNA, 20 nt, Human
ugacugaagagcaaaccuuc

SEQ ID NO: 463334 - RNA, 21 nt, Human
ugacugaagagcaaaccuucc

SEQ ID NO: 463335 - RNA, 19 nt, Human
ugggaaggggcuagccgcg

SEQ ID NO: 463336 - RNA, 26 nt, Human
ugggaaggggcuagccgcggggccug

SEQ ID NO: 463337 - RNA, 21 nt, Human
ugugggaaggggcuagccgcg

SEQ ID NO: 463338 - RNA, 25 nt, Human
uuuacgaaggccuuccuccuccccc

SEQ ID NO: 463339 - RNA, 24 nt, Human
uuucccgcggguccccaggagcug

SEQ ID NO: 463340 - RNA, 18 nt, Human
uuuuuuuuuuuuggaguc

SEQ ID NO: 463341 - RNA, 18 nt, Human
uuuuuuuuuuuuuuuuug

SEQ ID NO: 463342 - RNA, 28 nt, Human
uuuuuuuuuuuuuuuuuuuuuuuggggg

SEQ ID NO: 463343 - RNA, 22 nt, Human
aacucuccccucccuaccccca

SEQ ID NO: 463344 - RNA, 25 nt, Human
acccccaccaaacccuggaaaauca

SEQ ID NO: 463345 - RNA, 24 nt, Human
ccaaacccuggaaaaucacagaca

SEQ ID NO: 463346 - RNA, 23 nt, Human
ccccucccuacccccaccaaacc

SEQ ID NO: 463347 - RNA, 24 nt, Human
ccuacccccaccaaacccuggaaa

SEQ ID NO: 463348 - RNA, 22 nt, Human
ccucccuacccccaccaaaccc

SEQ ID NO: 463349 - RNA, 22 nt, Human
uaacucuccccucccuaccccc

SEQ ID NO: 463350 - RNA, 22 nt, Human
uagcaucaauguccaggcauac

SEQ ID NO: 463351 - RNA, 25 nt, Human
aaaaacacccacccaacucuacaac

SEQ ID NO: 463352 - RNA, 20 nt, Human
aaaaagaaagaaaaccacuu

SEQ ID NO: 463353 - RNA, 18 nt, Human
aaagcaucauacuauucu

SEQ ID NO: 463354 - RNA, 24 nt, Human
aaagugcugggauuacagguguga

SEQ ID NO: 463355 - RNA, 20 nt, Human
aaauaaauguuacucaagua

SEQ ID NO: 463356 - RNA, 27 nt, Human
aacacagccugaggcaacaaaaugcuc

SEQ ID NO: 463357 - RNA, 19 nt, Human
aacauggugaaaccccauc

SEQ ID NO: 463358 - RNA, 20 nt, Human
aacauggugaaaccccaucu

SEQ ID NO: 463359 - RNA, 21 nt, Human
aacauggugaaaccccaucuc

SEQ ID NO: 463360 - RNA, 21 nt, Human
aacauggugaaaccccaucuc

SEQ ID NO: 463361 - RNA, 24 nt, Human
aagcagagguugcagugagccaag

SEQ ID NO: 463362 - RNA, 25 nt, Human
aagcagagguugcagugagccaaga

SEQ ID NO: 463363 - RNA, 18 nt, Human
aagugcugggauuacagg

SEQ ID NO: 463364 - RNA, 19 nt, Human
aagugcugggauuacaggu

SEQ ID NO: 463365 - RNA, 26 nt, Human
aagugcugggauuacaggugugagcc

SEQ ID NO: 463366 - RNA, 24 nt, Human
aaucgcuuaaaccugggaagcaga

SEQ ID NO: 463367 - RNA, 18 nt, Human
acaaagcaaaucaaaagc

SEQ ID NO: 463368 - RNA, 24 nt, Human
acaaggugagacucugucucaaaa

SEQ ID NO: 463369 - RNA, 21 nt, Human
acaggcgcccgccaccacacc

SEQ ID NO: 463370 - RNA, 24 nt, Human
accccaucucuacuaaaaauacaa

SEQ ID NO: 463371 - RNA, 19 nt, Human
accgacuccgccgccgugc

SEQ ID NO: 463372 - RNA, 21 nt, Human
acgccuauaauuccagcacuu

SEQ ID NO: 463373 - RNA, 19 nt, Human
acuacacuuacuaagugcc

SEQ ID NO: 463374 - RNA, 25 nt, Human
acucuguugccuaggcuggagugca

SEQ ID NO: 463375 - RNA, 18 nt, Human
acugcacucuagccuggg

SEQ ID NO: 463376 - RNA, 25 nt, Human
acugcacucuagccugggugacaag

SEQ ID NO: 463377 - RNA, 18 nt, Human
agaaaaccacuuucccug

SEQ ID NO: 463378 - RNA, 19 nt, Human
agaaccacuuucuggcugg

SEQ ID NO: 463379 - RNA, 21 nt, Human
agacucagggucaugaagagg

SEQ ID NO: 463380 - RNA, 18 nt, Human
agaggagaaaauaggaug

SEQ ID NO: 463381 - RNA, 23 nt, Human
agagguugcagugagccaagauc

SEQ ID NO: 463382 - RNA, 24 nt, Human
agagguugcagugagccaagaucg

SEQ ID NO: 463383 - RNA, 24 nt, Human
agcacuuugggaggcugagggagg

SEQ ID NO: 463384 - RNA, 18 nt, Human
agccuccagaguagcuag

SEQ ID NO: 463385 - RNA, 22 nt, Human
agccuggacaacauggugaaac

SEQ ID NO: 463386 - RNA, 24 nt, Human
agccuggacaacauggugaaaccc

SEQ ID NO: 463387 - RNA, 24 nt, Human
agccugggugacaaggugagacuc

SEQ ID NO: 463388 - RNA, 20 nt, Human
aggaguuugagaccagccug

SEQ ID NO: 463389 - RNA, 26 nt, Human
aggcaacaaaaugcucugacaauuac

SEQ ID NO: 463390 - RNA, 22 nt, Human
aggcaagagaaucgcuuaaacc

SEQ ID NO: 463391 - RNA, 24 nt, Human
aggcaagagaaucgcuuaaaccug

SEQ ID NO: 463392 - RNA, 25 nt, Human
aggcuggagugcaguggggcaaucu

SEQ ID NO: 463393 - RNA, 24 nt, Human
agggagguggaucaugaggucagg

SEQ ID NO: 463394 - RNA, 24 nt, Human
agguggaucaugaggucaggaguu

SEQ ID NO: 463395 - RNA, 20 nt, Human
agugcaguggggcaaucucg

SEQ ID NO: 463396 - RNA, 24 nt, Human
agugcaguggggcaaucucggcuc

SEQ ID NO: 463397 - RNA, 18 nt, Human
auaaauuucucucacuuu

SEQ ID NO: 463398 - RNA, 22 nt, Human
auaguaugguauauuccuuaau

SEQ ID NO: 463399 - RNA, 24 nt, Human
aucgugccacugcacucuagccug

SEQ ID NO: 463400 - RNA, 19 nt, Human
auuuuuuuuugagacagag

SEQ ID NO: 463401 - RNA, 21 nt, Human
caaaaacacccacccaacucu

SEQ ID NO: 463402 - RNA, 27 nt, Human
caaaagcaaugacauuacacaacaaaa

SEQ ID NO: 463403 - RNA, 22 nt, Human
caaagcaaaucaaaagcaauga

SEQ ID NO: 463404 - RNA, 24 nt, Human
caaagugcugggauuacaggugug

SEQ ID NO: 463405 - RNA, 18 nt, Human
caaaucaaaagcaaugac

SEQ ID NO: 463406 - RNA, 22 nt, Human
caaaucaaaagcaaugacauua

SEQ ID NO: 463407 - RNA, 22 nt, Human
caacauggugaaaccccaucuc

SEQ ID NO: 463408 - RNA, 24 nt, Human
caacauggugaaaccccaucucua

SEQ ID NO: 463409 - RNA, 24 nt, Human
caagaucgugccacugcacucuag

SEQ ID NO: 463410 - RNA, 22 nt, Human
caagccauucuccugccucagc

SEQ ID NO: 463411 - RNA, 19 nt, Human
cacagccugaggcaacaaa

SEQ ID NO: 463412 - RNA, 24 nt, Human
caccauguuagccacgauggucuc

SEQ ID NO: 463413 - RNA, 23 nt, Human
caccuguagucccaccuacucgg

SEQ ID NO: 463414 - RNA, 24 nt, Human
caccuguagucccaccuacucggg

SEQ ID NO: 463415 - RNA, 24 nt, Human
cacucuagccugggugacaaggug

SEQ ID NO: 463416 - RNA, 22 nt, Human
cacucuguugccuaggcuggag

SEQ ID NO: 463417 - RNA, 23 nt, Human
cacugcaagcgccgucucccggg

SEQ ID NO: 463418 - RNA, 19 nt, Human
cacugcacucuagccuggg

SEQ ID NO: 463419 - RNA, 19 nt, Human
cacugcacucuagccuggg

SEQ ID NO: 463420 - RNA, 22 nt, Human
cacugcacucuagccuggguga

SEQ ID NO: 463421 - RNA, 23 nt, Human
cacugcacucuagccugggugac

SEQ ID NO: 463422 - RNA, 24 nt, Human
cacugcacucuagccugggugaca

SEQ ID NO: 463423 - RNA, 25 nt, Human
cacugcacucuagccugggugacaa

SEQ ID NO: 463424 - RNA, 24 nt, Human
cagaaaacauacaaauaaaagucc

SEQ ID NO: 463425 - RNA, 18 nt, Human
cagagguagaauuuggga

SEQ ID NO: 463426 - RNA, 24 nt, Human
cagcacuuugggaggcugagggag

SEQ ID NO: 463427 - RNA, 25 nt, Human
cagcacuuugggaggcugagggagg

SEQ ID NO: 463428 - RNA, 18 nt, Human
cagcuccgucuccugccc

SEQ ID NO: 463429 - RNA, 21 nt, Human
cagcuccgucuccugcccccg

SEQ ID NO: 463430 - RNA, 19 nt, Human
cagggucaugaagaggauu

SEQ ID NO: 463431 - RNA, 19 nt, Human
caggguuucaccauguuag

SEQ ID NO: 463432 - RNA, 22 nt, Human
caggucacagggcguuaacuaa

SEQ ID NO: 463433 - RNA, 24 nt, Human
caugaggucaggaguuugagacca

SEQ ID NO: 463434 - RNA, 21 nt, Human
ccaaagugcugggauuacagg

SEQ ID NO: 463435 - RNA, 21 nt, Human
ccaaagugcugggauuacagg

SEQ ID NO: 463436 - RNA, 24 nt, Human
ccaaagugcugggauuacaggugu

SEQ ID NO: 463437 - RNA, 19 nt, Human
ccacccaacucuacaucuc

SEQ ID NO: 463438 - RNA, 20 nt, Human
ccacugcacucuagccuggg

SEQ ID NO: 463439 - RNA, 20 nt, Human
ccacugcacucuagccuggg

SEQ ID NO: 463440 - RNA, 21 nt, Human
ccacugcacucuagccugggu

SEQ ID NO: 463441 - RNA, 21 nt, Human
ccacugcacucuagccugggu

SEQ ID NO: 463442 - RNA, 23 nt, Human
ccacugcacucuagccuggguga

SEQ ID NO: 463443 - RNA, 24 nt, Human
ccacugcacucuagccugggugac

SEQ ID NO: 463444 - RNA, 21 nt, Human
ccccccgccgcucagcuccgu

SEQ ID NO: 463445 - RNA, 18 nt, Human
cccccgccgcucagcucc

SEQ ID NO: 463446 - RNA, 23 nt, Human
cccggguucaagccauucuccug

SEQ ID NO: 463447 - RNA, 20 nt, Human
cccugauacuuuaccaucca

SEQ ID NO: 463448 - RNA, 24 nt, Human
ccgccucagccucccaaagugcug

SEQ ID NO: 463449 - RNA, 19 nt, Human
ccgcucagcuccgucuccu

SEQ ID NO: 463450 - RNA, 23 nt, Human
ccgcucagcuccgucuccugccc

SEQ ID NO: 463451 - RNA, 23 nt, Human
ccugauacuuuaccauccaggaa

SEQ ID NO: 463452 - RNA, 24 nt, Human
ccuggacaacauggugaaacccca

SEQ ID NO: 463453 - RNA, 22 nt, Human
ccugggugacaaggugagacuc

SEQ ID NO: 463454 - RNA, 23 nt, Human
cgccuauaauuccagcacuuugg

SEQ ID NO: 463455 - RNA, 24 nt, Human
cgccuauaauuccagcacuuuggg

SEQ ID NO: 463456 - RNA, 21 nt, Human
cucaaaaaaaaaacgagaaaa

SEQ ID NO: 463457 - RNA, 24 nt, Human
cucacucuguugccuaggcuggag

SEQ ID NO: 463458 - RNA, 24 nt, Human
cucacugcaagcgccgucucccgg

SEQ ID NO: 463459 - RNA, 24 nt, Human
cuccugaccuugugauccucccgc

SEQ ID NO: 463460 - RNA, 20 nt, Human
cucugucucaaaaaaaaaac

SEQ ID NO: 463461 - RNA, 23 nt, Human
cugccucagccuccagaguagcu

SEQ ID NO: 463462 - RNA, 27 nt, Human
cuugugauccucccgccucagccuccc

SEQ ID NO: 463463 - RNA, 24 nt, Human
gacaaggugagacucugucucaaa

SEQ ID NO: 463464 - RNA, 24 nt, Human
gaccuugugauccucccgccucag

SEQ ID NO: 463465 - RNA, 23 nt, Human
gagcagcaaaacuacaauuugga

SEQ ID NO: 463466 - RNA, 25 nt, Human
gaguagcuagaacuacaggcgcccg

SEQ ID NO: 463467 - RNA, 22 nt, Human
gaucaugaggucaggaguuuga

SEQ ID NO: 463468 - RNA, 24 nt, Human
gaucaugaggucaggaguuugaga

SEQ ID NO: 463469 - RNA, 18 nt, Human
gauuacaggugugagcca

SEQ ID NO: 463470 - RNA, 22 nt, Human
gauuacaggugugagccaccgc

SEQ ID NO: 463471 - RNA, 22 nt, Human
gauuacaggugugagccaccgc

SEQ ID NO: 463472 - RNA, 20 nt, Human
gccaagaucgugccacugca

SEQ ID NO: 463473 - RNA, 24 nt, Human
gccacugcacucuagccuggguga

SEQ ID NO: 463474 - RNA, 23 nt, Human
gccucagccucccaaagugcugg

SEQ ID NO: 463475 - RNA, 19 nt, Human
gcuccgucuccugcccccg

SEQ ID NO: 463476 - RNA, 21 nt, Human
gcugggugugguggcuuacgc

SEQ ID NO: 463477 - RNA, 19 nt, Human
ggaaauguaugcauccuug

SEQ ID NO: 463478 - RNA, 20 nt, Human
ggaagcagagguugcaguga

SEQ ID NO: 463479 - RNA, 22 nt, Human
ggagguggaucaugaggucagg

SEQ ID NO: 463480 - RNA, 22 nt, Human
ggcaaaauuauccaacuguaga

SEQ ID NO: 463481 - RNA, 19 nt, Human
gggaggcugaggcaagaga

SEQ ID NO: 463482 - RNA, 24 nt, Human
gggcgugguggcgggcaccuguag

SEQ ID NO: 463483 - RNA, 20 nt, Human
ggucucgaucuccugaccuu

SEQ ID NO: 463484 - RNA, 24 nt, Human
gguggcuuacgccuauaauuccag

SEQ ID NO: 463485 - RNA, 23 nt, Human
ggugugguggcuuacgccuauaa

SEQ ID NO: 463486 - RNA, 25 nt, Human
gguuucaccauguuagccacgauga

SEQ ID NO: 463487 - RNA, 19 nt, Human
guaugguauauuccuuaau

SEQ ID NO: 463488 - RNA, 24 nt, Human
gugacaaggugagacucugucuca

SEQ ID NO: 463489 - RNA, 24 nt, Human
gugauccucccgccucagccuccc

SEQ ID NO: 463490 - RNA, 18 nt, Human
gugaugcugauguugccg

SEQ ID NO: 463491 - RNA, 23 nt, Human
guggaucaugaggucaggaguuu

SEQ ID NO: 463492 - RNA, 23 nt, Human
guggcuuacgccuauaauuccag

SEQ ID NO: 463493 - RNA, 23 nt, Human
guuccuuagacggcaucaacaag

SEQ ID NO: 463494 - RNA, 26 nt, Human
uaaauguaaagcaucauacuauucua

SEQ ID NO: 463495 - RNA, 23 nt, Human
uaacacagccugaggcaacaaaa

SEQ ID NO: 463496 - RNA, 21 nt, Human
uaagaaccaggcaaagacuca

SEQ ID NO: 463497 - RNA, 22 nt, Human
uacaggcgcccgccaccacacc

SEQ ID NO: 463498 - RNA, 22 nt, Human
uacaggugugagccaccgcgcc

SEQ ID NO: 463499 - RNA, 23 nt, Human
uacaggugugagccaccgcgccu

SEQ ID NO: 463500 - RNA, 24 nt, Human
uacgccuauaauuccagcacuuug

SEQ ID NO: 463501 - RNA, 27 nt, Human
uacuacauuacuaaucaaccacuacuu

SEQ ID NO: 463502 - RNA, 20 nt, Human
uagaaagccagacaaaaugc

SEQ ID NO: 463503 - RNA, 21 nt, Human
uagaacuacaggcgcccgcca

SEQ ID NO: 463504 - RNA, 24 nt, Human
uagaacuacaggcgcccgccacca

SEQ ID NO: 463505 - RNA, 19 nt, Human
uagaaucuuaugucaguau

SEQ ID NO: 463506 - RNA, 22 nt, Human
uagagccaggguuucaccaugu

SEQ ID NO: 463507 - RNA, 24 nt, Human
uaguagagccaggguuucaccaug

SEQ ID NO: 463508 - RNA, 19 nt, Human
uaucuaaagauguauagag

SEQ ID NO: 463509 - RNA, 24 nt, Human
uaucuccuuucacaaagcaaaucc

SEQ ID NO: 463510 - RNA, 19 nt, Human
uauuuauuuaaauaagaau

SEQ ID NO: 463511 - RNA, 25 nt, Human
ucaaaaauagcccaucauaaauccu

SEQ ID NO: 463512 - RNA, 25 nt, Human
ucaagccauucuccugccucagccu

SEQ ID NO: 463513 - RNA, 22 nt, Human
ucacaaagcaaaucaaaagcaa

SEQ ID NO: 463514 - RNA, 24 nt, Human
ucacucuguugccuaggcuggagu

SEQ ID NO: 463515 - RNA, 24 nt, Human
ucacugcaagcgccgucucccggg

SEQ ID NO: 463516 - RNA, 22 nt, Human
ucagccuccagaguagcuagaa

SEQ ID NO: 463517 - RNA, 24 nt, Human
ucaugaggucaggaguuugagacc

SEQ ID NO: 463518 - RNA, 23 nt, Human
ucccaaagugcugggauuacagg

SEQ ID NO: 463519 - RNA, 21 nt, Human
ucccggguucaagccauucuc

SEQ ID NO: 463520 - RNA, 24 nt, Human
ucccggguucaagccauucuccug

SEQ ID NO: 463521 - RNA, 20 nt, Human
ucccugauacuuuaccaucc

SEQ ID NO: 463522 - RNA, 27 nt, Human
uccucccgccucagccucccaaagugc

SEQ ID NO: 463523 - RNA, 19 nt, Human
uccugcccccgcccgaggu

SEQ ID NO: 463524 - RNA, 24 nt, Human
ucgggaggcugaggcaagagaauc

SEQ ID NO: 463525 - RNA, 18 nt, Human
ucucaaaaaaaaaacgag

SEQ ID NO: 463526 - RNA, 23 nt, Human
ucucacucuguugccuaggcugg

SEQ ID NO: 463527 - RNA, 24 nt, Human
ucucacucuguugccuaggcugga

SEQ ID NO: 463528 - RNA, 24 nt, Human
ucuccugccucagccuccagagua

SEQ ID NO: 463529 - RNA, 23 nt, Human
ucucuacuaaaaauacaaaaauu

SEQ ID NO: 463530 - RNA, 22 nt, Human
ucucucacuuuguuauauugua

SEQ ID NO: 463531 - RNA, 30 nt, Human
ucugaaauugagguaacacagccugaggcc

SEQ ID NO: 463532 - RNA, 18 nt, Human
ucuggcuggguguggugg

SEQ ID NO: 463533 - RNA, 24 nt, Human
ucuguugccuaggcuggagugcag

SEQ ID NO: 463534 - RNA, 19 nt, Human
ugaaaccccaucucuacua

SEQ ID NO: 463535 - RNA, 21 nt, Human
ugacaaaaacacccacccaac

SEQ ID NO: 463536 - RNA, 22 nt, Human
ugaccuugugauccucccgccu

SEQ ID NO: 463537 - RNA, 18 nt, Human
ugagacagagucucacuc

SEQ ID NO: 463538 - RNA, 22 nt, Human
ugagacagagucucacucuguu

SEQ ID NO: 463539 - RNA, 22 nt, Human
ugagccaagaucgugccacugc

SEQ ID NO: 463540 - RNA, 24 nt, Human
ugaggcaagagaaucgcuuaaacc

SEQ ID NO: 463541 - RNA, 24 nt, Human
ugagggagguggaucaugagguca

SEQ ID NO: 463542 - RNA, 21 nt, Human
ugagguaacacagccugaggc

SEQ ID NO: 463543 - RNA, 18 nt, Human
ugaggucaggaguuugag

SEQ ID NO: 463544 - RNA, 18 nt, Human
ugauagcaaacaguaguc

SEQ ID NO: 463545 - RNA, 19 nt, Human
ugauuuggugggucuggug

SEQ ID NO: 463546 - RNA, 20 nt, Human
ugauuuggugggucuggugu

SEQ ID NO: 463547 - RNA, 21 nt, Human
ugcauaauacauacauaguua

SEQ ID NO: 463548 - RNA, 18 nt, Human
ugccuagaccgaggcgac

SEQ ID NO: 463549 - RNA, 19 nt, Human
ugccuaggcuggagugcag

SEQ ID NO: 463550 - RNA, 20 nt, Human
ugccuaggcuggagugcagu

SEQ ID NO: 463551 - RNA, 21 nt, Human
ugccuaggcuggagugcagug

SEQ ID NO: 463552 - RNA, 22 nt, Human
ugccuaggcuggagugcagugg

SEQ ID NO: 463553 - RNA, 25 nt, Human
ugccuaggcuggagugcaguggggc

SEQ ID NO: 463554 - RNA, 24 nt, Human
ugccucagccuccagaguagcuag

SEQ ID NO: 463555 - RNA, 24 nt, Human
ugcugggauuacaggugugagcca

SEQ ID NO: 463556 - RNA, 22 nt, Human
uggacaacauggugaaacccca

SEQ ID NO: 463557 - RNA, 20 nt, Human
uggagugcaguggggcaauc

SEQ ID NO: 463558 - RNA, 23 nt, Human
uggagugcaguggggcaaucucg

SEQ ID NO: 463559 - RNA, 24 nt, Human
uggagugcaguggggcaaucucgg

SEQ ID NO: 463560 - RNA, 21 nt, Human
uggaucaugaggucaggaguu

SEQ ID NO: 463561 - RNA, 24 nt, Human
uggaucaugaggucaggaguuuga

SEQ ID NO: 463562 - RNA, 18 nt, Human
uggaucucuuucuaauuc

SEQ ID NO: 463563 - RNA, 21 nt, Human
uggcuuacgccuauaauucca

SEQ ID NO: 463564 - RNA, 22 nt, Human
uggcuuacgccuauaauuccag

SEQ ID NO: 463565 - RNA, 24 nt, Human
uggcuuacgccuauaauuccagca

SEQ ID NO: 463566 - RNA, 24 nt, Human
ugggaagcagagguugcagugagc

SEQ ID NO: 463567 - RNA, 24 nt, Human
ugggaggcugagggagguggauca

SEQ ID NO: 463568 - RNA, 18 nt, Human
ugggauuacaggugugag

SEQ ID NO: 463569 - RNA, 19 nt, Human
ugggauuacaggugugagc

SEQ ID NO: 463570 - RNA, 21 nt, Human
ugggauuacaggugugagcca

SEQ ID NO: 463571 - RNA, 22 nt, Human
ugggauuacaggugugagccac

SEQ ID NO: 463572 - RNA, 23 nt, Human
ugggauuacaggugugagccacc

SEQ ID NO: 463573 - RNA, 24 nt, Human
ugggauuacaggugugagccaccg

SEQ ID NO: 463574 - RNA, 24 nt, Human
ugguggcgggcaccuguaguccca

SEQ ID NO: 463575 - RNA, 24 nt, Human
ugguggcuuacgccuauaauucca

SEQ ID NO: 463576 - RNA, 24 nt, Human
ugugauccucccgccucagccucc

SEQ ID NO: 463577 - RNA, 21 nt, Human
uguugccggucugagaagcau

SEQ ID NO: 463578 - RNA, 20 nt, Human
uguugccuaggcuggagugc

SEQ ID NO: 463579 - RNA, 22 nt, Human
uuacgccuauaauuccagcacu

SEQ ID NO: 463580 - RNA, 24 nt, Human
uuaguagagccaggguuucaccau

SEQ ID NO: 463581 - RNA, 18 nt, Human
uucaagccauucuccugc

SEQ ID NO: 463582 - RNA, 21 nt, Human
uucaagccauucuccugccuc

SEQ ID NO: 463583 - RNA, 24 nt, Human
uuccagcacuuugggaggcugagg

SEQ ID NO: 463584 - RNA, 24 nt, Human
uuccugaacaauguacuguuucua

SEQ ID NO: 463585 - RNA, 22 nt, Human
uugcagugagccaagaucgugc

SEQ ID NO: 463586 - RNA, 23 nt, Human
uugccuaggcuggagugcagugg

SEQ ID NO: 463587 - RNA, 25 nt, Human
uugggaggcugagggagguggauca

SEQ ID NO: 463588 - RNA, 18 nt, Human
uuggugggucuggugugg

SEQ ID NO: 463589 - RNA, 20 nt, Human
uuucaccauguuagccacga

SEQ ID NO: 463590 - RNA, 23 nt, Human
uuucuaauucuaacacucauguu

SEQ ID NO: 463591 - RNA, 24 nt, Human
uuuuuaguagagccaggguuucac

SEQ ID NO: 463592 - RNA, 23 nt, Human
uuuuuuguauuuuuuuaguagag

SEQ ID NO: 463593 - RNA, 18 nt, Human
aaaacaugcacaaaccca

SEQ ID NO: 463594 - RNA, 18 nt, Human
aaacaugcacaaacccaa

SEQ ID NO: 463595 - RNA, 18 nt, Human
acccacccagcagaaaac

SEQ ID NO: 463596 - RNA, 23 nt, Human
caaacccaagguauauguggaag

SEQ ID NO: 463597 - RNA, 22 nt, Human
cagaaaacaugcacaaacccaa

SEQ ID NO: 463598 - RNA, 19 nt, Human
cagcagaaaacaugcacaa

SEQ ID NO: 463599 - RNA, 25 nt, Human
caugcacaaacccaagguauaugug

SEQ ID NO: 463600 - RNA, 22 nt, Human
ccagcagaaaacaugcacaaac

SEQ ID NO: 463601 - RNA, 23 nt, Human
ccagcagaaaacaugcacaaacc

SEQ ID NO: 463602 - RNA, 21 nt, Human
ccagccgcccggcagcgccug

SEQ ID NO: 463603 - RNA, 18 nt, Human
ccccggccccaaguuagc

SEQ ID NO: 463604 - RNA, 19 nt, Human
cccucugaacccacccagc

SEQ ID NO: 463605 - RNA, 25 nt, Human
ccucugaacccacccagcagaaaac

SEQ ID NO: 463606 - RNA, 21 nt, Human
cgcccggcagcgccuggaaac

SEQ ID NO: 463607 - RNA, 22 nt, Human
cggagcagccguagccacagcc

SEQ ID NO: 463608 - RNA, 19 nt, Human
cuggaguccccugccgcug

SEQ ID NO: 463609 - RNA, 18 nt, Human
gaacccacccagcagaaa

SEQ ID NO: 463610 - RNA, 18 nt, Human
uagcagcugggacgaugc

SEQ ID NO: 463611 - RNA, 25 nt, Human
ugcacaaacccaagguauaugugga

SEQ ID NO: 463612 - RNA, 18 nt, Human
ugcccucugaacccaccc

SEQ ID NO: 463613 - RNA, 22 nt, Human
uguacacauaaaagagaaauug

SEQ ID NO: 463614 - RNA, 24 nt, Human
uuauuuagcauauguacacauaaa

SEQ ID NO: 463615 - RNA, 21 nt, Human
aaaaaaaaaaaaaaaaagucu

SEQ ID NO: 463616 - RNA, 23 nt, Human
aaaacaacaaaauaaagugaaga

SEQ ID NO: 463617 - RNA, 21 nt, Human
aaaacagaaaaacaaaacaaa

SEQ ID NO: 463618 - RNA, 22 nt, Human
aaaacagaaaaacaaaacaaaa

SEQ ID NO: 463619 - RNA, 19 nt, Human
aaacaaaacaaaacaacaa

SEQ ID NO: 463620 - RNA, 25 nt, Human
aaacaaaacaaaacaacaaaauaaa

SEQ ID NO: 463621 - RNA, 27 nt, Human
aaacaaaacaacaaaauaaagugaaga

SEQ ID NO: 463622 - RNA, 24 nt, Human
aaacaaaacagaaaaacaaaacaa

SEQ ID NO: 463623 - RNA, 25 nt, Human
aaacaaaacagaaaaacaaaacaaa

SEQ ID NO: 463624 - RNA, 19 nt, Human
aaaggagguggcugcccag

SEQ ID NO: 463625 - RNA, 19 nt, Human
aacaaaauacaccccaucc

SEQ ID NO: 463626 - RNA, 21 nt, Human
aacaaaccaaaacauuuuccc

SEQ ID NO: 463627 - RNA, 21 nt, Human
aacacuggccuuggcaaaaaa

SEQ ID NO: 463628 - RNA, 18 nt, Human
aaccaaaacauuuucccc

SEQ ID NO: 463629 - RNA, 25 nt, Human
aaccaauacuauacugcuuaacaca

SEQ ID NO: 463630 - RNA, 19 nt, Human
aagaagaauuggggcucug

SEQ ID NO: 463631 - RNA, 19 nt, Human
aagcaaaaacaaaacaaca

SEQ ID NO: 463632 - RNA, 21 nt, Human
aagcaaaaacaaaacaacacg

SEQ ID NO: 463633 - RNA, 19 nt, Human
aagcagccgugcgcccgcu

SEQ ID NO: 463634 - RNA, 27 nt, Human
aagcauccgugcaucaauaaagcaaaa

SEQ ID NO: 463635 - RNA, 18 nt, Human
acaaaacaaaacaacaaa

SEQ ID NO: 463636 - RNA, 24 nt, Human
acaaaacaacaaaauaaagugaag

SEQ ID NO: 463637 - RNA, 23 nt, Human
acaaaacagaaaaacaaaacaaa

SEQ ID NO: 463638 - RNA, 24 nt, Human
acaaaacagaaaaacaaaacaaaa

SEQ ID NO: 463639 - RNA, 21 nt, Human
acaaaauacaccccauccccc

SEQ ID NO: 463640 - RNA, 22 nt, Human
acaccccaucccccccgacacc

SEQ ID NO: 463641 - RNA, 22 nt, Human
accagcacccacgcccaccucu

SEQ ID NO: 463642 - RNA, 20 nt, Human
accgccggcgcagcgccucg

SEQ ID NO: 463643 - RNA, 23 nt, Human
accuuuguuucaaaauauagaaa

SEQ ID NO: 463644 - RNA, 21 nt, Human
agacaagcggggcccccagga

SEQ ID NO: 463645 - RNA, 19 nt, Human
agaggucgaagacgacgcg

SEQ ID NO: 463646 - RNA, 20 nt, Human
agcggcggcggcggcggcgg

SEQ ID NO: 463647 - RNA, 23 nt, Human
agcggcggcggcggcggcggcgg

SEQ ID NO: 463648 - RNA, 18 nt, Human
aggagccccugggggagc

SEQ ID NO: 463649 - RNA, 20 nt, Human
aggcccccgcccgggcuguc

SEQ ID NO: 463650 - RNA, 22 nt, Human
agggagggucgaguuggguugg

SEQ ID NO: 463651 - RNA, 18 nt, Human
aggggagggagggucgag

SEQ ID NO: 463652 - RNA, 18 nt, Human
aggggguggggggaguac

SEQ ID NO: 463653 - RNA, 22 nt, Human
caaaaaaaaaaaaaaaaaaaaa

SEQ ID NO: 463654 - RNA, 22 nt, Human
caaaauacaccccauccccccc

SEQ ID NO: 463655 - RNA, 23 nt, Human
caaacaaaacagaaaaacaaaac

SEQ ID NO: 463656 - RNA, 20 nt, Human
caaaccaaaacauuuucccc

SEQ ID NO: 463657 - RNA, 22 nt, Human
caaaccaaaacauuuuccccuc

SEQ ID NO: 463658 - RNA, 23 nt, Human
caacaaaauacaccccauccccc

SEQ ID NO: 463659 - RNA, 25 nt, Human
caacaaaauacaccccauccccccc

SEQ ID NO: 463660 - RNA, 24 nt, Human
caacacuggccuuggcaaaaaaaa

SEQ ID NO: 463661 - RNA, 25 nt, Human
caacacuggccuuggcaaaaaaaaa

SEQ ID NO: 463662 - RNA, 21 nt, Human
caauaaagcaaaaacaaaaca

SEQ ID NO: 463663 - RNA, 20 nt, Human
cacaaaccagcuuauccuuc

SEQ ID NO: 463664 - RNA, 24 nt, Human
cacaaacuugcaacaaaauacacc

SEQ ID NO: 463665 - RNA, 19 nt, Human
cacagguagcaagauuguc

SEQ ID NO: 463666 - RNA, 19 nt, Human
caccagcacccacgcccac

SEQ ID NO: 463667 - RNA, 23 nt, Human
caccccaucccccccgacacccc

SEQ ID NO: 463668 - RNA, 23 nt, Human
caccccccggguugggcagcccc

SEQ ID NO: 463669 - RNA, 19 nt, Human
cacccccuuaccauuuugc

SEQ ID NO: 463670 - RNA, 23 nt, Human
cacgccgagacgccaccgacgcc

SEQ ID NO: 463671 - RNA, 18 nt, Human
cagcaacacuggccuugg

SEQ ID NO: 463672 - RNA, 23 nt, Human
cagcaacacuggccuuggcaaaa

SEQ ID NO: 463673 - RNA, 25 nt, Human
cagcaccgcaggcuugcuggaacca

SEQ ID NO: 463674 - RNA, 20 nt, Human
cagcccucucuucgccccca

SEQ ID NO: 463675 - RNA, 24 nt, Human
caucccccccgacacccccuuacc

SEQ ID NO: 463676 - RNA, 25 nt, Human
caucccccccgacacccccuuacca

SEQ ID NO: 463677 - RNA, 23 nt, Human
ccaccgccggcgcagcgccucgc

SEQ ID NO: 463678 - RNA, 23 nt, Human
ccaccuccuacugcgguugacuc

SEQ ID NO: 463679 - RNA, 23 nt, Human
ccagcacccacgcccaccucugc

SEQ ID NO: 463680 - RNA, 18 nt, Human
ccaggccagacggggccg

SEQ ID NO: 463681 - RNA, 23 nt, Human
ccccaucccccccgacacccccu

SEQ ID NO: 463682 - RNA, 25 nt, Human
cccccaggccguugggcagucgcgc

SEQ ID NO: 463683 - RNA, 21 nt, Human
ccccccggguugggcagcccc

SEQ ID NO: 463684 - RNA, 24 nt, Human
cccccgagacaagcggggccccca

SEQ ID NO: 463685 - RNA, 19 nt, Human
ccccggguugggcagcccc

SEQ ID NO: 463686 - RNA, 19 nt, Human
ccccguaaccagcccaccg

SEQ ID NO: 463687 - RNA, 21 nt, Human
ccccugggggagcaggcgucg

SEQ ID NO: 463688 - RNA, 24 nt, Human
cccggugguggccgccguugccuc

SEQ ID NO: 463689 - RNA, 19 nt, Human
cccucaggauuggagagga

SEQ ID NO: 463690 - RNA, 18 nt, Human
ccgcagcgcuggccgggc

SEQ ID NO: 463691 - RNA, 21 nt, Human
ccgcaggcuugcuggaaccau

SEQ ID NO: 463692 - RNA, 19 nt, Human
ccgcggcgccuucuccucc

SEQ ID NO: 463693 - RNA, 21 nt, Human
ccgugcguuccacgccgagac

SEQ ID NO: 463694 - RNA, 19 nt, Human
cgagacgccaccgacgccg

SEQ ID NO: 463695 - RNA, 21 nt, Human
cgagccgggccucuuaccacc

SEQ ID NO: 463696 - RNA, 27 nt, Human
cgagccgggccucuuaccaccagcacc

SEQ ID NO: 463697 - RNA, 21 nt, Human
cgcccccaccuccuacugcgg

SEQ ID NO: 463698 - RNA, 18 nt, Human
cgccgugggggcuccacc

SEQ ID NO: 463699 - RNA, 21 nt, Human
cggcccgaggggagggggcga

SEQ ID NO: 463700 - RNA, 22 nt, Human
cggcccgggggagcggccgucc

SEQ ID NO: 463701 - RNA, 24 nt, Human
cggcggcggcggcggcggcagcgc

SEQ ID NO: 463702 - RNA, 21 nt, Human
cggcugcccagggcgugggga

SEQ ID NO: 463703 - RNA, 21 nt, Human
cgggcugucuccgcggcgccu

SEQ ID NO: 463704 - RNA, 19 nt, Human
cggggcccccaggagcccc

SEQ ID NO: 463705 - RNA, 20 nt, Human
cguagcgcuccaggccagac

SEQ ID NO: 463706 - RNA, 20 nt, Human
cguggaagcucgaaaggggc

SEQ ID NO: 463707 - RNA, 24 nt, Human
cguggccgauacacccgggguacc

SEQ ID NO: 463708 - RNA, 22 nt, Human
cucagcucggccagggccucgg

SEQ ID NO: 463709 - RNA, 23 nt, Human
cucagcucggccagggccucggc

SEQ ID NO: 463710 - RNA, 18 nt, Human
cuccgccaccccccgggu

SEQ ID NO: 463711 - RNA, 20 nt, Human
cucugggggucccuccucug

SEQ ID NO: 463712 - RNA, 24 nt, Human
cugcgggggagggaggaggggggg

SEQ ID NO: 463713 - RNA, 19 nt, Human
cugcugcugcugcugcugc

SEQ ID NO: 463714 - RNA, 21 nt, Human
cugcugcuucccaggcucacc

SEQ ID NO: 463715 - RNA, 18 nt, Human
cugcuguugcuguugcug

SEQ ID NO: 463716 - RNA, 19 nt, Human
cuggucuagggcaaaggag

SEQ ID NO: 463717 - RNA, 23 nt, Human
cugucucuuccucuccccgggga

SEQ ID NO: 463718 - RNA, 19 nt, Human
cuucccaggcucaccggcg

SEQ ID NO: 463719 - RNA, 21 nt, Human
cuuggcaaaaaaaaaaaaaaa

SEQ ID NO: 463720 - RNA, 23 nt, Human
cuuuuucuuuuguguguguuuuu

SEQ ID NO: 463721 - RNA, 19 nt, Human
gaagaaguuacauaccuuu

SEQ ID NO: 463722 - RNA, 21 nt, Human
gaagcucccggcccgagggga

SEQ ID NO: 463723 - RNA, 18 nt, Human
gagcugcguccucucccc

SEQ ID NO: 463724 - RNA, 20 nt, Human
gaggagggggggcgagaaag

SEQ ID NO: 463725 - RNA, 23 nt, Human
gcagcggcggcggcggcggcggc

SEQ ID NO: 463726 - RNA, 26 nt, Human
gccccugggggagcaggcgucggggg

SEQ ID NO: 463727 - RNA, 21 nt, Human
gcccgaggggagggggcgagg

SEQ ID NO: 463728 - RNA, 23 nt, Human
gcccuggggaagguaggcccccg

SEQ ID NO: 463729 - RNA, 18 nt, Human
gccguagcgcuccaggcc

SEQ ID NO: 463730 - RNA, 22 nt, Human
gccguagcgcuccaggccagac

SEQ ID NO: 463731 - RNA, 21 nt, Human
gccucggcguugcgcugcuuc

SEQ ID NO: 463732 - RNA, 18 nt, Human
gcgccuucuuccuggugc

SEQ ID NO: 463733 - RNA, 24 nt, Human
gcggcggcggcggcggcggcagcg

SEQ ID NO: 463734 - RNA, 23 nt, Human
gcggcggcggcggcggcggcggc

SEQ ID NO: 463735 - RNA, 24 nt, Human
gcggcggcggcggcggcggcggca

SEQ ID NO: 463736 - RNA, 24 nt, Human
gcggcggcggcggcggcggcggcg

SEQ ID NO: 463737 - RNA, 23 nt, Human
gcucccggcccgaggggaggggg

SEQ ID NO: 463738 - RNA, 20 nt, Human
gcugcccagggcguggggag

SEQ ID NO: 463739 - RNA, 21 nt, Human
ggagcaggcgucgggggccca

SEQ ID NO: 463740 - RNA, 25 nt, Human
ggaggacuggccggcuggggaggga

SEQ ID NO: 463741 - RNA, 19 nt, Human
ggaggagggggggcgagaa

SEQ ID NO: 463742 - RNA, 18 nt, Human
ggcaaaaaaaaaaaaaaa

SEQ ID NO: 463743 - RNA, 18 nt, Human
ggccuccgccaccccccg

SEQ ID NO: 463744 - RNA, 23 nt, Human
ggcggcggcggcggcggcggcgg

SEQ ID NO: 463745 - RNA, 23 nt, Human
ggcggcggcggcggcggcggcgg

SEQ ID NO: 463746 - RNA, 23 nt, Human
ggcguggggagggggugggggga

SEQ ID NO: 463747 - RNA, 22 nt, Human
ggcuggaagcucccggcccgag

SEQ ID NO: 463748 - RNA, 21 nt, Human
gggagcaggcgucgggggccc

SEQ ID NO: 463749 - RNA, 26 nt, Human
gggagcaggcgucgggggcccacggc

SEQ ID NO: 463750 - RNA, 20 nt, Human
gggagggucgaguuggguug

SEQ ID NO: 463751 - RNA, 19 nt, Human
gggcaaaggagguggcugc

SEQ ID NO: 463752 - RNA, 20 nt, Human
gggcaggucgcacagguagc

SEQ ID NO: 463753 - RNA, 18 nt, Human
gggcccacggcugcccag

SEQ ID NO: 463754 - RNA, 19 nt, Human
gggcguggggagggggugg

SEQ ID NO: 463755 - RNA, 23 nt, Human
ggggaguaccgcagcgcuggccc

SEQ ID NO: 463756 - RNA, 26 nt, Human
gggugaggggagggagggucgaguug

SEQ ID NO: 463757 - RNA, 20 nt, Human
guccgacugcgggggaggga

SEQ ID NO: 463758 - RNA, 23 nt, Human
guggccgauacacccgggguacc

SEQ ID NO: 463759 - RNA, 20 nt, Human
guugcgcugcuucuccuuca

SEQ ID NO: 463760 - RNA, 22 nt, Human
guugcugcugcugcugcugcug

SEQ ID NO: 463761 - RNA, 23 nt, Human
guugcuguugcgcggcggcggcg

SEQ ID NO: 463762 - RNA, 19 nt, Human
uaaagcaaaaacaaaacaa

SEQ ID NO: 463763 - RNA, 20 nt, Human
uaaaggacaaacagagcaga

SEQ ID NO: 463764 - RNA, 20 nt, Human
uacaaaaauacacaccagca

SEQ ID NO: 463765 - RNA, 25 nt, Human
uacaaguuacuaagcuccaaggcac

SEQ ID NO: 463766 - RNA, 23 nt, Human
uagaaacaaaccaaaacauuuuc

SEQ ID NO: 463767 - RNA, 18 nt, Human
uagcauuucgcucuacug

SEQ ID NO: 463768 - RNA, 23 nt, Human
uagcauuuuuuuuuuuuuuuuuu

SEQ ID NO: 463769 - RNA, 22 nt, Human
ucaggcgccuucuuccuggugc

SEQ ID NO: 463770 - RNA, 24 nt, Human
uccaccgcagcggcggcggcggcg

SEQ ID NO: 463771 - RNA, 20 nt, Human
ucccccccgacacccccuua

SEQ ID NO: 463772 - RNA, 18 nt, Human
uccccggaguggcuggug

SEQ ID NO: 463773 - RNA, 19 nt, Human
uccuggucugugcucgaca

SEQ ID NO: 463774 - RNA, 22 nt, Human
ucgcgaggggagcucaggcgcc

SEQ ID NO: 463775 - RNA, 23 nt, Human
ucgcucagcucggccagggccuc

SEQ ID NO: 463776 - RNA, 19 nt, Human
ucuccaugucuagcauuuc

SEQ ID NO: 463777 - RNA, 18 nt, Human
ugaagaagaauuggggcu

SEQ ID NO: 463778 - RNA, 19 nt, Human
ugcaaacaaaacagaaaaa

SEQ ID NO: 463779 - RNA, 21 nt, Human
ugcaaacaaaacagaaaaaca

SEQ ID NO: 463780 - RNA, 24 nt, Human
ugcaaacaaaacagaaaaacaaga

SEQ ID NO: 463781 - RNA, 26 nt, Human
ugcaucaauaaagcaaaaacaaaaca

SEQ ID NO: 463782 - RNA, 18 nt, Human
ugcccuggggaagguagg

SEQ ID NO: 463783 - RNA, 20 nt, Human
ugcccuggggaagguaggcc

SEQ ID NO: 463784 - RNA, 21 nt, Human
ugcgguagcagguuggggggc

SEQ ID NO: 463785 - RNA, 24 nt, Human
ugcgguagcagguuggggggcacg

SEQ ID NO: 463786 - RNA, 21 nt, Human
ugcugcugcugcugcugcugc

SEQ ID NO: 463787 - RNA, 21 nt, Human
ugcugcugcugcugcugcugc

SEQ ID NO: 463788 - RNA, 21 nt, Human
ugcugcugcugcugcugcugc

SEQ ID NO: 463789 - RNA, 21 nt, Human
ugcugcugcugcugcugcugu

SEQ ID NO: 463790 - RNA, 21 nt, Human
ugcugcugcugcugcugcugu

SEQ ID NO: 463791 - RNA, 18 nt, Human
ugcugcugcugcugcugu

SEQ ID NO: 463792 - RNA, 18 nt, Human
ugcugcugcugcugcugu

SEQ ID NO: 463793 - RNA, 21 nt, Human
ugcugcugcugcuguugcugc

SEQ ID NO: 463794 - RNA, 21 nt, Human
ugcugcugcugcuguugcugu

SEQ ID NO: 463795 - RNA, 21 nt, Human
ugcugcugcuguugcugcugc

SEQ ID NO: 463796 - RNA, 21 nt, Human
ugcugcuguugcugcugcugc

SEQ ID NO: 463797 - RNA, 30 nt, Human
ugcuggcccacuccucggcgcgguugcgcc

SEQ ID NO: 463798 - RNA, 21 nt, Human
ugcuguugcugcugcugcugc

SEQ ID NO: 463799 - RNA, 18 nt, Human
ugcuguugcuguugcugu

SEQ ID NO: 463800 - RNA, 23 nt, Human
ugcuguugcuguugcuguugcgc

SEQ ID NO: 463801 - RNA, 20 nt, Human
uggcccagggcaugcggggc

SEQ ID NO: 463802 - RNA, 22 nt, Human
uggccuuggcaaaaaaaaaaaa

SEQ ID NO: 463803 - RNA, 23 nt, Human
ugggcagccccguaaccagccca

SEQ ID NO: 463804 - RNA, 20 nt, Human
uggggaggggguggggggag

SEQ ID NO: 463805 - RNA, 18 nt, Human
ugggggaggggcccucag

SEQ ID NO: 463806 - RNA, 24 nt, Human
ugggggaggggcccucaggauugg

SEQ ID NO: 463807 - RNA, 23 nt, Human
ugguugagcuguuguugcugcug

SEQ ID NO: 463808 - RNA, 22 nt, Human
uguauaaaggacaaacagagca

SEQ ID NO: 463809 - RNA, 19 nt, Human
uguggcugcugcuucccag

SEQ ID NO: 463810 - RNA, 21 nt, Human
uguugcugcugcugcugcugc

SEQ ID NO: 463811 - RNA, 21 nt, Human
uguugcugcugcugcugcugc

SEQ ID NO: 463812 - RNA, 24 nt, Human
uugagcuguuguugcugcugcugc

SEQ ID NO: 463813 - RNA, 20 nt, Human
uuggcaaaaaaaaaaaaaaa

SEQ ID NO: 463814 - RNA, 23 nt, Human
uugggggugaggggagggagggu

SEQ ID NO: 463815 - RNA, 30 nt, Human
uuugcaaacaaaacagaaaaacaaaacaaa

SEQ ID NO: 463816 - RNA, 19 nt, Human
uuuuucuuuuguguguguu

SEQ ID NO: 463817 - RNA, 23 nt, Human
uuuuuuuuuuuuuuuuuuuuagg

SEQ ID NO: 463818 - RNA, 22 nt, Human
aaacaaggacgcaccucccgug

SEQ ID NO: 463819 - RNA, 24 nt, Human
aacaauaccccagugcugcaccaa

SEQ ID NO: 463820 - RNA, 23 nt, Human
aacacaagaagccaacaauaccc

SEQ ID NO: 463821 - RNA, 25 nt, Human
aacacaagaagccaacaauacccca

SEQ ID NO: 463822 - RNA, 21 nt, Human
aagaagccaacaauaccccag

SEQ ID NO: 463823 - RNA, 20 nt, Human
accaaguuacuucccacugu

SEQ ID NO: 463824 - RNA, 19 nt, Human
agggcguggggauuuccag

SEQ ID NO: 463825 - RNA, 25 nt, Human
auuacaaaguuuccaacacaagaag

SEQ ID NO: 463826 - RNA, 20 nt, Human
caacaauaccccagugcugc

SEQ ID NO: 463827 - RNA, 24 nt, Human
caacaauaccccagugcugcacca

SEQ ID NO: 463828 - RNA, 23 nt, Human
cacaagacgauaaagggaaacag

SEQ ID NO: 463829 - RNA, 18 nt, Human
cacagcuuaaccacggcc

SEQ ID NO: 463830 - RNA, 18 nt, Human
caccaaguuacuucccac

SEQ ID NO: 463831 - RNA, 19 nt, Human
caggacccgaagcugagag

SEQ ID NO: 463832 - RNA, 23 nt, Human
ccaaggcacagucaauuaauaau

SEQ ID NO: 463833 - RNA, 22 nt, Human
ccgcagccgcaggacccgaagc

SEQ ID NO: 463834 - RNA, 24 nt, Human
ccucauagaaucuccagcaucagg

SEQ ID NO: 463835 - RNA, 22 nt, Human
ccucccguggcucuaugcaugg

SEQ ID NO: 463836 - RNA, 27 nt, Human
gaaccuacgaccgucugauacccuuga

SEQ ID NO: 463837 - RNA, 19 nt, Human
gaagccaacaauaccccag

SEQ ID NO: 463838 - RNA, 23 nt, Human
gcugcaccaaguuacuucccacu

SEQ ID NO: 463839 - RNA, 23 nt, Human
ggccaggagcaagaauucgaguu

SEQ ID NO: 463840 - RNA, 20 nt, Human
ggggauuuccaguuuuuccu

SEQ ID NO: 463841 - RNA, 23 nt, Human
guacacagcuuaaccacggccag

SEQ ID NO: 463842 - RNA, 21 nt, Human
uaagaaccuacgaccgucuga

SEQ ID NO: 463843 - RNA, 18 nt, Human
uacccuugaggagagcac

SEQ ID NO: 463844 - RNA, 28 nt, Human
ucgcucaguuuauaaaaacuugaggcca

SEQ ID NO: 463845 - RNA, 18 nt, Human
ugccacugaugaaucaaa

SEQ ID NO: 463846 - RNA, 23 nt, Human
uggaaaacaaggacgcaccuccc

SEQ ID NO: 463847 - RNA, 25 nt, Human
aaaaacaggagcuuuuuaaaagaaa

SEQ ID NO: 463848 - RNA, 28 nt, Human
aaaacaggaaauacuaaaauaaaaauau

SEQ ID NO: 463849 - RNA, 21 nt, Human
aaaaguaaagucuguucuauc

SEQ ID NO: 463850 - RNA, 21 nt, Human
aaacaaugucauuaugcucuu

SEQ ID NO: 463851 - RNA, 19 nt, Human
aacaaagggaauauuuuac

SEQ ID NO: 463852 - RNA, 23 nt, Human
accuaucagaaggguuaaaccag

SEQ ID NO: 463853 - RNA, 21 nt, Human
agcauaauuaggcuucaucaa

SEQ ID NO: 463854 - RNA, 23 nt, Human
agggaauauuuuacugcaaagaa

SEQ ID NO: 463855 - RNA, 24 nt, Human
caaacgccaagcuugagaggaagu

SEQ ID NO: 463856 - RNA, 21 nt, Human
caggaaauacuaaaauaaaaa

SEQ ID NO: 463857 - RNA, 23 nt, Human
ccaaacaaacgccaagcuugaga

SEQ ID NO: 463858 - RNA, 18 nt, Human
ccaccaaacaaacgccaa

SEQ ID NO: 463859 - RNA, 20 nt, Human
cccauaaauucuacuuucca

SEQ ID NO: 463860 - RNA, 20 nt, Human
ccccaccaaacaaacgccaa

SEQ ID NO: 463861 - RNA, 20 nt, Human
ccccagcauccacaacuacc

SEQ ID NO: 463862 - RNA, 19 nt, Human
cuccaggcaaagauuauuc

SEQ ID NO: 463863 - RNA, 20 nt, Human
cucugcuucuagaucaaugc

SEQ ID NO: 463864 - RNA, 24 nt, Human
cucugcuucuagaucaaugcuggg

SEQ ID NO: 463865 - RNA, 18 nt, Human
gaaauucuagaguguagu

SEQ ID NO: 463866 - RNA, 19 nt, Human
gaaucacaaguuggaacug

SEQ ID NO: 463867 - RNA, 26 nt, Human
gccauuauccaaauagcacaaccauu

SEQ ID NO: 463868 - RNA, 21 nt, Human
ggaauauuuuacugcaaagaa

SEQ ID NO: 463869 - RNA, 21 nt, Human
guaaccccaccaaacaaacgc

SEQ ID NO: 463870 - RNA, 21 nt, Human
guucucauccccagcauccac

SEQ ID NO: 463871 - RNA, 21 nt, Human
uaaaaauaucugacacugcca

SEQ ID NO: 463872 - RNA, 22 nt, Human
uaaaccaggucaaaacagucca

SEQ ID NO: 463873 - RNA, 26 nt, Human
uaaauucuacuuuccaaaaacaggag

SEQ ID NO: 463874 - RNA, 23 nt, Human
uaacacugagaugcaaucuaaca

SEQ ID NO: 463875 - RNA, 21 nt, Human
uaacauuaacaaagggaauau

SEQ ID NO: 463876 - RNA, 22 nt, Human
uacaaaugcugccuagugccau

SEQ ID NO: 463877 - RNA, 27 nt, Human
uaccuucuucccccuuccccgaccgga

SEQ ID NO: 463878 - RNA, 24 nt, Human
uacuaaaauaaaaauaucugacac

SEQ ID NO: 463879 - RNA, 21 nt, Human
uagcacaaccauuuuacgucu

SEQ ID NO: 463880 - RNA, 19 nt, Human
uagugucacuccaggcaaa

SEQ ID NO: 463881 - RNA, 20 nt, Human
ucauuuaagugaccuuaugu

SEQ ID NO: 463882 - RNA, 24 nt, Human
uccccagcauccacaacuaccuau

SEQ ID NO: 463883 - RNA, 18 nt, Human
ucccccuuccccgaccgg

SEQ ID NO: 463884 - RNA, 19 nt, Human
uccuuuuuguauccccccu

SEQ ID NO: 463885 - RNA, 25 nt, Human
ucuaagaugcaaauaaaccaaaaca

SEQ ID NO: 463886 - RNA, 24 nt, Human
ucuacuuuccaaaaacaggagcug

SEQ ID NO: 463887 - RNA, 19 nt, Human
ucucauccccagcauccac

SEQ ID NO: 463888 - RNA, 23 nt, Human
uggcaaugcaggaaagaugucuu

SEQ ID NO: 463889 - RNA, 23 nt, Human
uuaacacugagaugcaaucuaac

SEQ ID NO: 463890 - RNA, 23 nt, Human
uuaccuucuucccccuuccccga

SEQ ID NO: 463891 - RNA, 20 nt, Human
uuauguaaaaaauaaaauaa

SEQ ID NO: 463892 - RNA, 21 nt, Human
uucaaauguacauaaaagaaa

SEQ ID NO: 463893 - RNA, 23 nt, Human
uuuagcaguuccaaguauccaaa

SEQ ID NO: 463894 - RNA, 25 nt, Human
uuuuuuuuuuuuuuuuacuuuuuaa

SEQ ID NO: 463895 - RNA, 21 nt, Human
agacuacagguggccgcugca

SEQ ID NO: 463896 - RNA, 19 nt, Human
caagagccaggcugcgaga

SEQ ID NO: 463897 - RNA, 23 nt, Human
cacacaauguccuugaggcucua

SEQ ID NO: 463898 - RNA, 19 nt, Human
caccccuaacagcguccgc

SEQ ID NO: 463899 - RNA, 27 nt, Human
caggcacaacgcgcccaacaagcgcca

SEQ ID NO: 463900 - RNA, 21 nt, Human
ccagagccucucgaaccgccg

SEQ ID NO: 463901 - RNA, 20 nt, Human
ccccccgccaccccuaacag

SEQ ID NO: 463902 - RNA, 24 nt, Human
ccccgccaccccuaacagcguccg

SEQ ID NO: 463903 - RNA, 18 nt, Human
ccgccgccaaccccccgc

SEQ ID NO: 463904 - RNA, 24 nt, Human
cuuagacugccggcccagagccuc

SEQ ID NO: 463905 - RNA, 20 nt, Human
gcccaacaagcgccaugggg

SEQ ID NO: 463906 - RNA, 22 nt, Human
gcugcaggcacaacgcgcccaa

SEQ ID NO: 463907 - RNA, 21 nt, Human
ucucgaaccgccgccaacccc

SEQ ID NO: 463908 - RNA, 18 nt, Human
uugcuugagggugcggcu

SEQ ID NO: 463909 - RNA, 22 nt, Human
uuuuuuuuuuuuuuuuuuucag

SEQ ID NO: 463910 - RNA, 21 nt, Human
aaaggaaaacaaauucagacc

SEQ ID NO: 463911 - RNA, 25 nt, Human
aaaggaaaacaaauucagaccaaaa

SEQ ID NO: 463912 - RNA, 21 nt, Human
aaccacauuauucugagacag

SEQ ID NO: 463913 - RNA, 23 nt, Human
aaguaguaguuuuuuuuuuuucu

SEQ ID NO: 463914 - RNA, 22 nt, Human
aaugguuauuuugcagagaaga

SEQ ID NO: 463915 - RNA, 18 nt, Human
aauguuuacaaaauaagu

SEQ ID NO: 463916 - RNA, 21 nt, Human
acacuguaucagcuggagucc

SEQ ID NO: 463917 - RNA, 24 nt, Human
acauuauucugagacaguacauuu

SEQ ID NO: 463918 - RNA, 19 nt, Human
acugagauauuuucugguu

SEQ ID NO: 463919 - RNA, 24 nt, Human
acuuuaagaaucuaaccaaaggaa

SEQ ID NO: 463920 - RNA, 20 nt, Human
aguuuuuuuuuuuucuacuu

SEQ ID NO: 463921 - RNA, 23 nt, Human
aguuuuuuuuuuuucuacuuuaa

SEQ ID NO: 463922 - RNA, 26 nt, Human
augaagacugcugucaaaaucugucc

SEQ ID NO: 463923 - RNA, 20 nt, Human
auucauuuucuuacuuuuuu

SEQ ID NO: 463924 - RNA, 21 nt, Human
auuuccuguugugcucuagug

SEQ ID NO: 463925 - RNA, 23 nt, Human
auuugaguaagcucuuuaaaaau

SEQ ID NO: 463926 - RNA, 23 nt, Human
caaaaagggcugaaaaaagguug

SEQ ID NO: 463927 - RNA, 22 nt, Human
cacacuguaucagcuggagucc

SEQ ID NO: 463928 - RNA, 18 nt, Human
cacuguaucagcuggagu

SEQ ID NO: 463929 - RNA, 23 nt, Human
cacuuacgggagauuuccacuga

SEQ ID NO: 463930 - RNA, 21 nt, Human
cagagauaagccaauauuucc

SEQ ID NO: 463931 - RNA, 19 nt, Human
cauuucaaaucaaugguua

SEQ ID NO: 463932 - RNA, 24 nt, Human
ccccagaauuuauaauuucucaca

SEQ ID NO: 463933 - RNA, 19 nt, Human
cccuuugguuauauuuuaa

SEQ ID NO: 463934 - RNA, 25 nt, Human
cuaguguacaaaggggcaaaggaag

SEQ ID NO: 463935 - RNA, 24 nt, Human
cuccacauuucaaaucaaugguua

SEQ ID NO: 463936 - RNA, 26 nt, Human
cucuuuaaaaaugcuguuuuagaaag

SEQ ID NO: 463937 - RNA, 21 nt, Human
cugugcuuucuuuucucuugc

SEQ ID NO: 463938 - RNA, 21 nt, Human
gagaagaaaacggaggcacuu

SEQ ID NO: 463939 - RNA, 21 nt, Human
guucacacaaaaccuauauau

SEQ ID NO: 463940 - RNA, 19 nt, Human
guugcaauugcauuguauu

SEQ ID NO: 463941 - RNA, 20 nt, Human
uaagcaacuccuauagagac

SEQ ID NO: 463942 - RNA, 21 nt, Human
uagaaaacacucauauggaac

SEQ ID NO: 463943 - RNA, 24 nt, Human
uagaggaauugagaucucagcuca

SEQ ID NO: 463944 - RNA, 24 nt, Human
uaguaguuuuuuuuuuuucuacuu

SEQ ID NO: 463945 - RNA, 20 nt, Human
uccacugagcuccuacacca

SEQ ID NO: 463946 - RNA, 25 nt, Human
ugaagacugcugucaaaaucugucc

SEQ ID NO: 463947 - RNA, 19 nt, Human
ugagacaguacauuucauu

SEQ ID NO: 463948 - RNA, 18 nt, Human
ugagcuccuacaccagca

SEQ ID NO: 463949 - RNA, 21 nt, Human
ugaguaagcucuuuaaaaaug

SEQ ID NO: 463950 - RNA, 22 nt, Human
uuaaaauaucugaaucaaaauc

SEQ ID NO: 463951 - RNA, 23 nt, Human
uucacauuaaauaaaauuuucuu

SEQ ID NO: 463952 - RNA, 20 nt, Human
uugcuuagaagaggacugau

SEQ ID NO: 463953 - RNA, 26 nt, Human
uuguauguucacacaaaaccuauaua

SEQ ID NO: 463954 - RNA, 22 nt, Human
uuuaaaauaucugaaucaaaau

SEQ ID NO: 463955 - RNA, 21 nt, Human
uuugaaguaacucgcccaggg

SEQ ID NO: 463956 - RNA, 18 nt, Human
accaagaaucauaaaagu

SEQ ID NO: 463957 - RNA, 18 nt, Human
aggugacggugaggaugg

SEQ ID NO: 463958 - RNA, 21 nt, Human
auaaaaguaaaaaaagcugcu

SEQ ID NO: 463959 - RNA, 21 nt, Human
cggaauacuaagaaguugcug

SEQ ID NO: 463960 - RNA, 26 nt, Human
cuaagaaguugcugcuggucuacaga

SEQ ID NO: 463961 - RNA, 23 nt, Human
ggugaggauggucccaagaggcg

SEQ ID NO: 463962 - RNA, 19 nt, Human
uaccaagaaucauaaaagu

SEQ ID NO: 463963 - RNA, 21 nt, Human
uaccaagaaucauaaaaguaa

SEQ ID NO: 463964 - RNA, 23 nt, Human
ucuacagagcccugggaggugac

SEQ ID NO: 463965 - RNA, 24 nt, Human
ugcugcuggucuacagagcccugg

SEQ ID NO: 463966 - RNA, 20 nt, Human
aaaccagcaucagaggaagg

SEQ ID NO: 463967 - RNA, 23 nt, Human
aacuacugaccaagacugccacc

SEQ ID NO: 463968 - RNA, 24 nt, Human
aacuacugaccaagacugccaccu

SEQ ID NO: 463969 - RNA, 19 nt, Human
aagcagaccaacaacacac

SEQ ID NO: 463970 - RNA, 19 nt, Human
acacaccaagcagaccaaa

SEQ ID NO: 463971 - RNA, 18 nt, Human
acacaguuccuccccuuc

SEQ ID NO: 463972 - RNA, 19 nt, Human
acagggcgaggcugguguc

SEQ ID NO: 463973 - RNA, 22 nt, Human
accaugccccaccucuagcacc

SEQ ID NO: 463974 - RNA, 21 nt, Human
acccuuggccuuaaaucccaa

SEQ ID NO: 463975 - RNA, 21 nt, Human
accugagaguucugagggcca

SEQ ID NO: 463976 - RNA, 25 nt, Human
acuacaaacugagacugggccacga

SEQ ID NO: 463977 - RNA, 21 nt, Human
acuuccagccaccaugcccca

SEQ ID NO: 463978 - RNA, 21 nt, Human
acuuguggcugcuccuuccuc

SEQ ID NO: 463979 - RNA, 23 nt, Human
agagcagaggcccagggcggggg

SEQ ID NO: 463980 - RNA, 23 nt, Human
agccaccaggcagaggucauacc

SEQ ID NO: 463981 - RNA, 25 nt, Human
agccaggcaagagagcagaggccca

SEQ ID NO: 463982 - RNA, 21 nt, Human
aggcaagagagcagaggccca

SEQ ID NO: 463983 - RNA, 24 nt, Human
aggcaagagagcagaggcccaggg

SEQ ID NO: 463984 - RNA, 21 nt, Human
aggcagggcuccgggagcugu

SEQ ID NO: 463985 - RNA, 24 nt, Human
aggcagggcuccgggagcuguuuc

SEQ ID NO: 463986 - RNA, 25 nt, Human
agggagcaagggcugccaagccagg

SEQ ID NO: 463987 - RNA, 23 nt, Human
agggccagaggucgcccagaacc

SEQ ID NO: 463988 - RNA, 18 nt, Human
aggggaaggaaaggcagg

SEQ ID NO: 463989 - RNA, 20 nt, Human
agugaaagggccaaggggga

SEQ ID NO: 463990 - RNA, 25 nt, Human
caacacacaagcucauugccagccc

SEQ ID NO: 463991 - RNA, 22 nt, Human
caagagagcagaggcccagggc

SEQ ID NO: 463992 - RNA, 18 nt, Human
caagcgcacccacaaggg

SEQ ID NO: 463993 - RNA, 19 nt, Human
cacacaagcucauugccag

SEQ ID NO: 463994 - RNA, 24 nt, Human
cacacacaccaagcagaccaacaa

SEQ ID NO: 463995 - RNA, 20 nt, Human
cacacacccgaccaccccuc

SEQ ID NO: 463996 - RNA, 21 nt, Human
caccaagcagaccaacaacac

SEQ ID NO: 463997 - RNA, 23 nt, Human
caccaggcagaggucauacccac

SEQ ID NO: 463998 - RNA, 26 nt, Human
caccccagaggcgcaaaguacccaga

SEQ ID NO: 463999 - RNA, 22 nt, Human
caccccuccauuccucgguccc

SEQ ID NO: 464000 - RNA, 22 nt, Human
cacccgaccaccccuccauucc

SEQ ID NO: 464001 - RNA, 25 nt, Human
cagacaacuuacccauucucggccc

SEQ ID NO: 464002 - RNA, 18 nt, Human
cagaccaacaacacacaa

SEQ ID NO: 464003 - RNA, 19 nt, Human
cagagauggccagggccag

SEQ ID NO: 464004 - RNA, 18 nt, Human
cagaggaaggaaggugac

SEQ ID NO: 464005 - RNA, 23 nt, Human
caggaccccagcaggagaccccu

SEQ ID NO: 464006 - RNA, 25 nt, Human
caggcagaggucauacccacacgca

SEQ ID NO: 464007 - RNA, 18 nt, Human
caggcaguuggcauggca

SEQ ID NO: 464008 - RNA, 25 nt, Human
cagggcugggcccaggggccugggc

SEQ ID NO: 464009 - RNA, 24 nt, Human
cagguacaguguccucucuaccug

SEQ ID NO: 464010 - RNA, 25 nt, Human
cauucucggcccagcaggucagaaa

SEQ ID NO: 464011 - RNA, 21 nt, Human
ccacacacccgaccaccccuc

SEQ ID NO: 464012 - RNA, 23 nt, Human
ccacugccgagaccaacgugugc

SEQ ID NO: 464013 - RNA, 23 nt, Human
ccaggcaagagagcagaggccca

SEQ ID NO: 464014 - RNA, 18 nt, Human
ccaggcaguuggcauggc

SEQ ID NO: 464015 - RNA, 20 nt, Human
ccagggccagaggucgccca

SEQ ID NO: 464016 - RNA, 19 nt, Human
ccagggcugggcccagggg

SEQ ID NO: 464017 - RNA, 23 nt, Human
cccagaggcgcaaaguacccaga

SEQ ID NO: 464018 - RNA, 19 nt, Human
ccccagaggcgcaaaguac

SEQ ID NO: 464019 - RNA, 22 nt, Human
cccccugccacccacugacccu

SEQ ID NO: 464020 - RNA, 24 nt, Human
ccuccauuccucggucccgucgca

SEQ ID NO: 464021 - RNA, 19 nt, Human
ccucccagcuuaucuuccc

SEQ ID NO: 464022 - RNA, 21 nt, Human
ccucccguccugccaguagac

SEQ ID NO: 464023 - RNA, 23 nt, Human
ccugacuccagacaacuuaccca

SEQ ID NO: 464024 - RNA, 19 nt, Human
ccugcagccccacccucuu

SEQ ID NO: 464025 - RNA, 22 nt, Human
ccugucagcuggggugaggggc

SEQ ID NO: 464026 - RNA, 19 nt, Human
ccugugccacaggccuggg

SEQ ID NO: 464027 - RNA, 19 nt, Human
ccuuccacauccggcuucu

SEQ ID NO: 464028 - RNA, 24 nt, Human
cgccugugccacaggccuggggac

SEQ ID NO: 464029 - RNA, 19 nt, Human
cgcugcuucuccucaaauc

SEQ ID NO: 464030 - RNA, 18 nt, Human
cuccuuccggccccagca

SEQ ID NO: 464031 - RNA, 18 nt, Human
cucgggcacugggacagg

SEQ ID NO: 464032 - RNA, 21 nt, Human
cucuuucccucaaaaaagaag

SEQ ID NO: 464033 - RNA, 21 nt, Human
cugcagccccacccucuuucc

SEQ ID NO: 464034 - RNA, 23 nt, Human
cugucagcuggggugaggggccc

SEQ ID NO: 464035 - RNA, 21 nt, Human
cuuacagccacugccgagacc

SEQ ID NO: 464036 - RNA, 21 nt, Human
cuuccagccaccaugccccac

SEQ ID NO: 464037 - RNA, 19 nt, Human
gaaagggccaagggggagu

SEQ ID NO: 464038 - RNA, 21 nt, Human
gaaagggccaagggggaguga

SEQ ID NO: 464039 - RNA, 21 nt, Human
gacaguggcaggauacagugg

SEQ ID NO: 464040 - RNA, 23 nt, Human
gacccuguccuacgugggcccac

SEQ ID NO: 464041 - RNA, 23 nt, Human
gagcagaggcccagggcggggga

SEQ ID NO: 464042 - RNA, 20 nt, Human
gagcaggugugagcaggcac

SEQ ID NO: 464043 - RNA, 19 nt, Human
gaggacacagggcagacgg

SEQ ID NO: 464044 - RNA, 19 nt, Human
gccagggccagaggucgcc

SEQ ID NO: 464045 - RNA, 24 nt, Human
gccauccacacacccgaccacccc

SEQ ID NO: 464046 - RNA, 22 nt, Human
gcccucagcagggagcaagggc

SEQ ID NO: 464047 - RNA, 23 nt, Human
gcucauugccagcccccugccac

SEQ ID NO: 464048 - RNA, 19 nt, Human
gcucuguuagucuucugcc

SEQ ID NO: 464049 - RNA, 24 nt, Human
ggagcuguuucaggggaaggaaag

SEQ ID NO: 464050 - RNA, 23 nt, Human
ggccaagggggagugaaagggcc

SEQ ID NO: 464051 - RNA, 21 nt, Human
ggcgcaaaguacccagaaaca

SEQ ID NO: 464052 - RNA, 20 nt, Human
gggcgggggagugaaagggc

SEQ ID NO: 464053 - RNA, 18 nt, Human
gggcuucuauaccugaga

SEQ ID NO: 464054 - RNA, 23 nt, Human
gggggagugaaagggccaagggg

SEQ ID NO: 464055 - RNA, 19 nt, Human
gucacagcuggaaauccca

SEQ ID NO: 464056 - RNA, 21 nt, Human
gucagaaacgccugugccaca

SEQ ID NO: 464057 - RNA, 19 nt, Human
gucagcuggggugaggggc

SEQ ID NO: 464058 - RNA, 23 nt, Human
uacacccgacucugguuugguuu

SEQ ID NO: 464059 - RNA, 21 nt, Human
uagcaccccagaggcgcaaag

SEQ ID NO: 464060 - RNA, 19 nt, Human
ucaaaaaagaaggaagcca

SEQ ID NO: 464061 - RNA, 22 nt, Human
ucaaaaaagaaggaagccaggc

SEQ ID NO: 464062 - RNA, 19 nt, Human
ucaaagggacaaguuccuu

SEQ ID NO: 464063 - RNA, 21 nt, Human
ucagcuggggugaggggcccg

SEQ ID NO: 464064 - RNA, 22 nt, Human
ucccagggcuggucuacaccuc

SEQ ID NO: 464065 - RNA, 23 nt, Human
uccucggucccgucgcaggucug

SEQ ID NO: 464066 - RNA, 18 nt, Human
ucucccuaagcugucacu

SEQ ID NO: 464067 - RNA, 21 nt, Human
ucuucugccugucagccucag

SEQ ID NO: 464068 - RNA, 18 nt, Human
ugaaagggccaaggggga

SEQ ID NO: 464069 - RNA, 20 nt, Human
ugacaggaggccaugcagug

SEQ ID NO: 464070 - RNA, 20 nt, Human
ugacccuuggccuuaaaucc

SEQ ID NO: 464071 - RNA, 19 nt, Human
ugacucaaagggacaaguu

SEQ ID NO: 464072 - RNA, 21 nt, Human
ugagaaacuacaaacugagac

SEQ ID NO: 464073 - RNA, 24 nt, Human
ugagacccugaggacucagccucc

SEQ ID NO: 464074 - RNA, 24 nt, Human
ugagcaggcacagcaacagccugu

SEQ ID NO: 464075 - RNA, 19 nt, Human
ugaguuagugcagagaugg

SEQ ID NO: 464076 - RNA, 24 nt, Human
ugcaguggcagugcgagaccagga

SEQ ID NO: 464077 - RNA, 20 nt, Human
ugcccuggcccagucacagc

SEQ ID NO: 464078 - RNA, 19 nt, Human
ugcguggaugccauauaua

SEQ ID NO: 464079 - RNA, 25 nt, Human
uggaaaucccagggcuggucuacac

SEQ ID NO: 464080 - RNA, 20 nt, Human
uggaugccauauauagaugg

SEQ ID NO: 464081 - RNA, 21 nt, Human
uggauggacagggaacaggca

SEQ ID NO: 464082 - RNA, 20 nt, Human
uggcagugcgagaccaggaa

SEQ ID NO: 464083 - RNA, 21 nt, Human
uggcaucagcacugagggugu

SEQ ID NO: 464084 - RNA, 18 nt, Human
ugggauacaccagccacc

SEQ ID NO: 464085 - RNA, 18 nt, Human
uggggugaggggcccggc

SEQ ID NO: 464086 - RNA, 26 nt, Human
uggucuacacccgacucugguuuggu

SEQ ID NO: 464087 - RNA, 19 nt, Human
uuggcauggcaucagcacu

SEQ ID NO: 464088 - RNA, 22 nt, Human
uuggccuuaaaucccaacagaa

SEQ ID NO: 464089 - RNA, 22 nt, Human
uugugacccuguccuacguggg

SEQ ID NO: 464090 - RNA, 25 nt, Human
uuuuuuuuuuuuuuuuuaccuguaa

SEQ ID NO: 464091 - RNA, 19 nt, Human
aagaaacuaguucaugggg

SEQ ID NO: 464092 - RNA, 20 nt, Human
aagcccaaagcuucccuucu

SEQ ID NO: 464093 - RNA, 18 nt, Human
aagcuucccuucuuggcc

SEQ ID NO: 464094 - RNA, 20 nt, Human
acagacacagaugauccgca

SEQ ID NO: 464095 - RNA, 23 nt, Human
accagcugcaccccaggccccag

SEQ ID NO: 464096 - RNA, 21 nt, Human
accccaggccccagccggccc

SEQ ID NO: 464097 - RNA, 25 nt, Human
acuccagcuucuucuggggggccgc

SEQ ID NO: 464098 - RNA, 19 nt, Human
agcagcagaggccacagcg

SEQ ID NO: 464099 - RNA, 20 nt, Human
agcagcgugaggcuccagga

SEQ ID NO: 464100 - RNA, 22 nt, Human
agccaguggcccccuuggccuc

SEQ ID NO: 464101 - RNA, 22 nt, Human
agcucuccaggaccagcagucc

SEQ ID NO: 464102 - RNA, 19 nt, Human
aggcagcuguguuuaggcc

SEQ ID NO: 464103 - RNA, 23 nt, Human
aggccuccccggggcagcagcuc

SEQ ID NO: 464104 - RNA, 19 nt, Human
agggucagcgagacagccu

SEQ ID NO: 464105 - RNA, 18 nt, Human
aguggacaagcccccacc

SEQ ID NO: 464106 - RNA, 18 nt, Human
aucaggaccugagagaga

SEQ ID NO: 464107 - RNA, 18 nt, Human
auucagccccauucuguc

SEQ ID NO: 464108 - RNA, 18 nt, Human
caacuccccuucuagggg

SEQ ID NO: 464109 - RNA, 26 nt, Human
cacagccaaggugagcaaggggcagg

SEQ ID NO: 464110 - RNA, 22 nt, Human
cacagcccacagccaaggugag

SEQ ID NO: 464111 - RNA, 18 nt, Human
caccacgaaggacaggau

SEQ ID NO: 464112 - RNA, 20 nt, Human
cacccaccgaagcccaaagc

SEQ ID NO: 464113 - RNA, 22 nt, Human
caccccaggccccagccggccc

SEQ ID NO: 464114 - RNA, 21 nt, Human
cacuccgacaccagcugaggg

SEQ ID NO: 464115 - RNA, 21 nt, Human
cacugcuggccggcucauggc

SEQ ID NO: 464116 - RNA, 23 nt, Human
cagagcccgagacccugcagggg

SEQ ID NO: 464117 - RNA, 23 nt, Human
cagagcccgagacccugcccgag

SEQ ID NO: 464118 - RNA, 25 nt, Human
cagcagcagaggccacagcggggag

SEQ ID NO: 464119 - RNA, 20 nt, Human
cagcauacccugacaccagc

SEQ ID NO: 464120 - RNA, 24 nt, Human
cagcgagacagccugucuacggca

SEQ ID NO: 464121 - RNA, 21 nt, Human
cagcggggagaaaaaggguuc

SEQ ID NO: 464122 - RNA, 22 nt, Human
cagcugcaccccaggccccagc

SEQ ID NO: 464123 - RNA, 26 nt, Human
caggaccagcaguccgagcuccuggg

SEQ ID NO: 464124 - RNA, 18 nt, Human
cagggccugguuccuccu

SEQ ID NO: 464125 - RNA, 24 nt, Human
caguagaucccauggcuccaggug

SEQ ID NO: 464126 - RNA, 27 nt, Human
caucagcaaacagcauacccugacacc

SEQ ID NO: 464127 - RNA, 20 nt, Human
ccacaguggacaagccccca

SEQ ID NO: 464128 - RNA, 19 nt, Human
ccaccaugugcagagcagc

SEQ ID NO: 464129 - RNA, 21 nt, Human
ccaggccuccccggggcagca

SEQ ID NO: 464130 - RNA, 18 nt, Human
ccagggucagaugugagg

SEQ ID NO: 464131 - RNA, 19 nt, Human
ccccaggagcugccccagc

SEQ ID NO: 464132 - RNA, 20 nt, Human
ccccaggagcugccccagcc

SEQ ID NO: 464133 - RNA, 21 nt, Human
ccccaggccccagccggcccu

SEQ ID NO: 464134 - RNA, 20 nt, Human
ccccaggccccagccggccu

SEQ ID NO: 464135 - RNA, 19 nt, Human
cccccuuggccucaggguu

SEQ ID NO: 464136 - RNA, 21 nt, Human
cccgggcucggugcacgcucc

SEQ ID NO: 464137 - RNA, 20 nt, Human
cccugggaggcgaggccagg

SEQ ID NO: 464138 - RNA, 21 nt, Human
cccuucuuggccucucugagg

SEQ ID NO: 464139 - RNA, 24 nt, Human
ccugcacccaccgaagcccaaagc

SEQ ID NO: 464140 - RNA, 23 nt, Human
ccuggagcugauucagccccauu

SEQ ID NO: 464141 - RNA, 21 nt, Human
ccugggcucagagcccgagac

SEQ ID NO: 464142 - RNA, 19 nt, Human
ccugucuacggcauugugg

SEQ ID NO: 464143 - RNA, 20 nt, Human
cggaauguucacagcccaca

SEQ ID NO: 464144 - RNA, 22 nt, Human
cggggcagcagcuccacguagc

SEQ ID NO: 464145 - RNA, 27 nt, Human
cuaugcacuccagcuucuucugggggc

SEQ ID NO: 464146 - RNA, 20 nt, Human
cucagcaccacgaaggacag

SEQ ID NO: 464147 - RNA, 21 nt, Human
cucagcaccacgaaggacagg

SEQ ID NO: 464148 - RNA, 25 nt, Human
cuccagggccgcgcacuccgacacc

SEQ ID NO: 464149 - RNA, 23 nt, Human
cugacccagacaagaaacuaguu

SEQ ID NO: 464150 - RNA, 21 nt, Human
cugacccuugggcugcacgga

SEQ ID NO: 464151 - RNA, 20 nt, Human
cugcaccccaggccccagcc

SEQ ID NO: 464152 - RNA, 21 nt, Human
cugcucagggcagccucccgg

SEQ ID NO: 464153 - RNA, 20 nt, Human
cuuggccaggccuccccggg

SEQ ID NO: 464154 - RNA, 18 nt, Human
gacaggaugggcagcagg

SEQ ID NO: 464155 - RNA, 20 nt, Human
gagccagggacgagcuggaa

SEQ ID NO: 464156 - RNA, 20 nt, Human
gaggcagcuguguuuaggcc

SEQ ID NO: 464157 - RNA, 20 nt, Human
gaggcgaggccaggcccugc

SEQ ID NO: 464158 - RNA, 25 nt, Human
gaggcgaggccaggcccugcaggga

SEQ ID NO: 464159 - RNA, 21 nt, Human
gcccagggucccggaauguuc

SEQ ID NO: 464160 - RNA, 24 nt, Human
gcccccaccaugugcagagcagcg

SEQ ID NO: 464161 - RNA, 19 nt, Human
gcccccucuucccugaugc

SEQ ID NO: 464162 - RNA, 22 nt, Human
gcccccucuucccugaugcucc

SEQ ID NO: 464163 - RNA, 21 nt, Human
gccggccugggguguggccuc

SEQ ID NO: 464164 - RNA, 24 nt, Human
gcgguccuuggaggcagcuguguu

SEQ ID NO: 464165 - RNA, 21 nt, Human
gcuacacaggagagcagggcc

SEQ ID NO: 464166 - RNA, 22 nt, Human
gcugacccuugggcugcacgga

SEQ ID NO: 464167 - RNA, 22 nt, Human
ggaaaagacaucaggaccugag

SEQ ID NO: 464168 - RNA, 20 nt, Human
ggagaaaaaggguuccucaa

SEQ ID NO: 464169 - RNA, 20 nt, Human
ggagaaaaaggguuccucaa

SEQ ID NO: 464170 - RNA, 21 nt, Human
ggcagaggugccaaccccaag

SEQ ID NO: 464171 - RNA, 21 nt, Human
ggcagcagcuccacguagcuc

SEQ ID NO: 464172 - RNA, 27 nt, Human
ggcccccuuggccucaggguucugggg

SEQ ID NO: 464173 - RNA, 20 nt, Human
ggcuccaggaugguccucag

SEQ ID NO: 464174 - RNA, 25 nt, Human
gggaugccaauggcgguggggggug

SEQ ID NO: 464175 - RNA, 21 nt, Human
ggggucagaggggagagaaac

SEQ ID NO: 464176 - RNA, 22 nt, Human
ggguucugggggaggagcuugg

SEQ ID NO: 464177 - RNA, 20 nt, Human
guucugggggaggagcuugg

SEQ ID NO: 464178 - RNA, 21 nt, Human
uagauaagaugcccagggucc

SEQ ID NO: 464179 - RNA, 20 nt, Human
uagcucagggcacucugcag

SEQ ID NO: 464180 - RNA, 20 nt, Human
ucauggggcuacaacucccc

SEQ ID NO: 464181 - RNA, 25 nt, Human
uccgagcuccugggccgccgcgcag

SEQ ID NO: 464182 - RNA, 18 nt, Human
uccugggccgccgcgcag

SEQ ID NO: 464183 - RNA, 21 nt, Human
ucuccacugcuggccggcuca

SEQ ID NO: 464184 - RNA, 18 nt, Human
ugacaccagcugcacccc

SEQ ID NO: 464185 - RNA, 27 nt, Human
ugacagucaagagggcugacccuuggg

SEQ ID NO: 464186 - RNA, 19 nt, Human
ugacccagacaagaaacua

SEQ ID NO: 464187 - RNA, 20 nt, Human
ugcacuccagcuucuucugg

SEQ ID NO: 464188 - RNA, 21 nt, Human
ugcacuccagcuucuucuggg

SEQ ID NO: 464189 - RNA, 21 nt, Human
ugcacuccagcuucuucuggg

SEQ ID NO: 464190 - RNA, 21 nt, Human
ugcacuccagcuucuucuggg

SEQ ID NO: 464191 - RNA, 21 nt, Human
ugcacuccagcuucuucuggg

SEQ ID NO: 464192 - RNA, 18 nt, Human
ugcccaucagcaaacagc

SEQ ID NO: 464193 - RNA, 20 nt, Human
uggacugccgucuccacugc

SEQ ID NO: 464194 - RNA, 20 nt, Human
uggaucuccuccaccgcggu

SEQ ID NO: 464195 - RNA, 23 nt, Human
uggcccccucuucccugaugcuc

SEQ ID NO: 464196 - RNA, 20 nt, Human
uggcuccagguguaggagag

SEQ ID NO: 464197 - RNA, 18 nt, Human
ugggguguggccucuggg

SEQ ID NO: 464198 - RNA, 20 nt, Human
ugggugggggcagcauguga

SEQ ID NO: 464199 - RNA, 19 nt, Human
ugugcagagcagcgugagg

SEQ ID NO: 464200 - RNA, 23 nt, Human
uuggaggcagcuguguuuaggcc

SEQ ID NO: 464201 - RNA, 18 nt, Human
aaaaguaccauuacucca

SEQ ID NO: 464202 - RNA, 19 nt, Human
acguaaaauauauaucuua

SEQ ID NO: 464203 - RNA, 18 nt, Human
agaaaaaggcauaauaga

SEQ ID NO: 464204 - RNA, 19 nt, Human
agaaagaauaaaaguacca

SEQ ID NO: 464205 - RNA, 18 nt, Human
agucuguguuagaaaaag

SEQ ID NO: 464206 - RNA, 22 nt, Human
aucaccuuucaaugaaagagug

SEQ ID NO: 464207 - RNA, 21 nt, Human
cuaacacaagaccugugaggg

SEQ ID NO: 464208 - RNA, 21 nt, Human
cugugagggucauggcucugg

SEQ ID NO: 464209 - RNA, 20 nt, Human
guucucuuggguucuuucuc

SEQ ID NO: 464210 - RNA, 20 nt, Human
uaacuuuaguucucuugggu

SEQ ID NO: 464211 - RNA, 20 nt, Human
uaguccuuuucuucuuuuua

SEQ ID NO: 464212 - RNA, 24 nt, Human
uaguccuuuucuucuuuuuaguga

SEQ ID NO: 464213 - RNA, 21 nt, Human
uaucaagaaagaauaaaagua

SEQ ID NO: 464214 - RNA, 21 nt, Human
uaucaagaaagaauaaaagua

SEQ ID NO: 464215 - RNA, 24 nt, Human
ucaagaaagaauaaaaguaccauu

SEQ ID NO: 464216 - RNA, 22 nt, Human
uccuggguaggaauaccagccc

SEQ ID NO: 464217 - RNA, 25 nt, Human
uccuuuucuucuuuuuagugaccaa

SEQ ID NO: 464218 - RNA, 24 nt, Human
ucuuuauuugauuuucaucaccuu

SEQ ID NO: 464219 - RNA, 19 nt, Human
ugaaagacagugaagaaag

SEQ ID NO: 464220 - RNA, 20 nt, Human
ugaaagacagugaagaaagu

SEQ ID NO: 464221 - RNA, 22 nt, Human
ugagggucauggcucuggccca

SEQ ID NO: 464222 - RNA, 23 nt, Human
uggcaagacaugagucaagggaa

SEQ ID NO: 464223 - RNA, 22 nt, Human
uuaguucucuuggguucuuucu

SEQ ID NO: 464224 - RNA, 18 nt, Human
uugugcauguucucaaaa

SEQ ID NO: 464225 - RNA, 22 nt, Human
aaaccccacuuuucagauccca

SEQ ID NO: 464226 - RNA, 22 nt, Human
acauuguaauuucccaaggcug

SEQ ID NO: 464227 - RNA, 21 nt, Human
accccacuuuucagaucccag

SEQ ID NO: 464228 - RNA, 25 nt, Human
agagucaggggccuggaucggaucc

SEQ ID NO: 464229 - RNA, 18 nt, Human
aguugaguuggagaugau

SEQ ID NO: 464230 - RNA, 18 nt, Human
auagguggauuauuugua

SEQ ID NO: 464231 - RNA, 18 nt, Human
caggccaaaagaauguga

SEQ ID NO: 464232 - RNA, 24 nt, Human
ccagaucagugcugccucuacugg

SEQ ID NO: 464233 - RNA, 24 nt, Human
ccauggauggaaagccuaucucuc

SEQ ID NO: 464234 - RNA, 19 nt, Human
cccaguaucugcaggaauc

SEQ ID NO: 464235 - RNA, 22 nt, Human
cccauauccaggaauucagcca

SEQ ID NO: 464236 - RNA, 20 nt, Human
cccgaggauuccccauaucc

SEQ ID NO: 464237 - RNA, 23 nt, Human
ccuggggcucuucaacauuuucc

SEQ ID NO: 464238 - RNA, 22 nt, Human
cggcaacgccaccaaacacuag

SEQ ID NO: 464239 - RNA, 20 nt, Human
cugcguagaacccauguaga

SEQ ID NO: 464240 - RNA, 22 nt, Human
gagaguuccugagggcccaaag

SEQ ID NO: 464241 - RNA, 20 nt, Human
gcaacgccaccaaacacuag

SEQ ID NO: 464242 - RNA, 20 nt, Human
gcccaaaggaucauacugcg

SEQ ID NO: 464243 - RNA, 18 nt, Human
guagaacccauguagaua

SEQ ID NO: 464244 - RNA, 23 nt, Human
guccuuugccacuuguugugcug

SEQ ID NO: 464245 - RNA, 24 nt, Human
gugagaguuccugagggcccaaag

SEQ ID NO: 464246 - RNA, 21 nt, Human
gugcugccucuacuggauagg

SEQ ID NO: 464247 - RNA, 23 nt, Human
guuucaucccgaggauuccccau

SEQ ID NO: 464248 - RNA, 21 nt, Human
uacaaacgucucccagagcaa

SEQ ID NO: 464249 - RNA, 21 nt, Human
ucagcuuagagucaggggccu

SEQ ID NO: 464250 - RNA, 24 nt, Human
uccccuggugaccaccgaagauuc

SEQ ID NO: 464251 - RNA, 20 nt, Human
uccuuugccacuuguugugc

SEQ ID NO: 464252 - RNA, 24 nt, Human
ucucccagagcaaaaguaaauggc

SEQ ID NO: 464253 - RNA, 19 nt, Human
ugagaguuccugagggccc

SEQ ID NO: 464254 - RNA, 30 nt, Human
ugcaacggcaacgccaccaaacacuagagg

SEQ ID NO: 464255 - RNA, 22 nt, Human
ugcuagcuguguccuuugccac

SEQ ID NO: 464256 - RNA, 18 nt, Human
uguuccaggaguugccau

SEQ ID NO: 464257 - RNA, 28 nt, Human
uugaguuggagaugaucaccggacuucc

SEQ ID NO: 464258 - RNA, 18 nt, Human
uuuuuuuuuuuccgcuug

SEQ ID NO: 464259 - RNA, 20 nt, Human
aaaaaagccagacuagccaa

SEQ ID NO: 464260 - RNA, 18 nt, Human
aaaaagccagacuagcca

SEQ ID NO: 464261 - RNA, 19 nt, Human
aaaaagccagacuagccaa

SEQ ID NO: 464262 - RNA, 22 nt, Human
aaaaaucucccucaaagcaaag

SEQ ID NO: 464263 - RNA, 20 nt, Human
aaauggucaacagggaagga

SEQ ID NO: 464264 - RNA, 27 nt, Human
aacaaacccacacucugucugucucuu

SEQ ID NO: 464265 - RNA, 20 nt, Human
aacagggaaggacccacagc

SEQ ID NO: 464266 - RNA, 19 nt, Human
aacuacauacaaagacaua

SEQ ID NO: 464267 - RNA, 22 nt, Human
aagcaaaguaaaaaugguucua

SEQ ID NO: 464268 - RNA, 19 nt, Human
aaggacccacagcagauuc

SEQ ID NO: 464269 - RNA, 18 nt, Human
aagguagcuugcuaucuu

SEQ ID NO: 464270 - RNA, 18 nt, Human
aaggucccgaaguggaga

SEQ ID NO: 464271 - RNA, 22 nt, Human
acagggaaggacccacagcaga

SEQ ID NO: 464272 - RNA, 25 nt, Human
acauacaaagacauaaaaauaaaac

SEQ ID NO: 464273 - RNA, 27 nt, Human
accaaccaccacaccaguuaaucucaa

SEQ ID NO: 464274 - RNA, 21 nt, Human
agaaagaagcuuguuguccca

SEQ ID NO: 464275 - RNA, 21 nt, Human
agaggugugcuggccacucug

SEQ ID NO: 464276 - RNA, 23 nt, Human
aggaaaaaaguuuuaaugugaag

SEQ ID NO: 464277 - RNA, 21 nt, Human
aggaggggcggaugagaggug

SEQ ID NO: 464278 - RNA, 21 nt, Human
auacauacaccaaccaccaca

SEQ ID NO: 464279 - RNA, 22 nt, Human
auggagcaggaggggcggauga

SEQ ID NO: 464280 - RNA, 23 nt, Human
caaaauaaaugccuaagaaauuu

SEQ ID NO: 464281 - RNA, 24 nt, Human
caaccaccacaccaguuaaucuca

SEQ ID NO: 464282 - RNA, 18 nt, Human
caccaaccaccacaccaa

SEQ ID NO: 464283 - RNA, 22 nt, Human
caccacaccaguuaaucucaac

SEQ ID NO: 464284 - RNA, 26 nt, Human
cacugcacuuccaucagcccccgccg

SEQ ID NO: 464285 - RNA, 21 nt, Human
cagaggccuccgaacaaaccc

SEQ ID NO: 464286 - RNA, 21 nt, Human
cagcagagcccacugaaaguc

SEQ ID NO: 464287 - RNA, 18 nt, Human
cagcccccgcugccacuc

SEQ ID NO: 464288 - RNA, 19 nt, Human
ccacugcacuuccaucagc

SEQ ID NO: 464289 - RNA, 18 nt, Human
ccccgcugccacucucuc

SEQ ID NO: 464290 - RNA, 18 nt, Human
ccccuucuuccuuuccca

SEQ ID NO: 464291 - RNA, 21 nt, Human
ccccuucuuccuuucccaucc

SEQ ID NO: 464292 - RNA, 19 nt, Human
cccucuccagcccccacug

SEQ ID NO: 464293 - RNA, 21 nt, Human
cccugagucacuaggccacca

SEQ ID NO: 464294 - RNA, 23 nt, Human
ccucccauguaguaucuccuuag

SEQ ID NO: 464295 - RNA, 18 nt, Human
ccucuucuuuuccuaucc

SEQ ID NO: 464296 - RNA, 18 nt, Human
ccugacuccugggcugcc

SEQ ID NO: 464297 - RNA, 19 nt, Human
ccuuagggggagguaaagg

SEQ ID NO: 464298 - RNA, 21 nt, Human
ccuucccuuuuucuguguccc

SEQ ID NO: 464299 - RNA, 23 nt, Human
ccuuccuucucagcagagcccac

SEQ ID NO: 464300 - RNA, 21 nt, Human
cgacaaauggccuugcuccug

SEQ ID NO: 464301 - RNA, 18 nt, Human
cggccuuggaagguagcu

SEQ ID NO: 464302 - RNA, 20 nt, Human
cucugucugucucuucuuuc

SEQ ID NO: 464303 - RNA, 19 nt, Human
cugccacucucucgccggc

SEQ ID NO: 464304 - RNA, 19 nt, Human
cugccacucucucgccggc

SEQ ID NO: 464305 - RNA, 21 nt, Human
cugccacucucucgccggcuc

SEQ ID NO: 464306 - RNA, 22 nt, Human
cugccacucucucgccggcucc

SEQ ID NO: 464307 - RNA, 19 nt, Human
cuggcuucuggucuaguuc

SEQ ID NO: 464308 - RNA, 21 nt, Human
cuuagggggagguaaaggaag

SEQ ID NO: 464309 - RNA, 23 nt, Human
cuucuggucuaguucgacucauu

SEQ ID NO: 464310 - RNA, 33 nt, Human
cuuuaaaaaaaaaaaaagccagacuagccaaaa

SEQ ID NO: 464311 - RNA, 19 nt, Human
cuuuccacagggcucacug

SEQ ID NO: 464312 - RNA, 19 nt, Human
gaaguggagauuucccugg

SEQ ID NO: 464313 - RNA, 19 nt, Human
gaaucuguauuuccaugac

SEQ ID NO: 464314 - RNA, 18 nt, Human
gacaaauggccuugcucc

SEQ ID NO: 464315 - RNA, 21 nt, Human
gacagcagaggccuccgaaca

SEQ ID NO: 464316 - RNA, 20 nt, Human
gacaugcuccucucugggcu

SEQ ID NO: 464317 - RNA, 18 nt, Human
gagaugaagaagagagga

SEQ ID NO: 464318 - RNA, 24 nt, Human
gaguucuagcaguuugcugguguc

SEQ ID NO: 464319 - RNA, 21 nt, Human
gauaaugagaugaagaagaga

SEQ ID NO: 464320 - RNA, 19 nt, Human
gaugaagaagagaggaagg

SEQ ID NO: 464321 - RNA, 23 nt, Human
gcccccgcugccacucucucgcc

SEQ ID NO: 464322 - RNA, 18 nt, Human
gccuuaucuguguuugaa

SEQ ID NO: 464323 - RNA, 21 nt, Human
ggaauccauugacagcagagg

SEQ ID NO: 464324 - RNA, 21 nt, Human
ggacaggucauugcuaccccu

SEQ ID NO: 464325 - RNA, 24 nt, Human
uaaaaauaaaacauacauacacca

SEQ ID NO: 464326 - RNA, 22 nt, Human
uaaaggaagacaugcuccucuc

SEQ ID NO: 464327 - RNA, 24 nt, Human
uaaaucaaaaaucucccucaaagc

SEQ ID NO: 464328 - RNA, 19 nt, Human
ucacuaggccaccaaaaug

SEQ ID NO: 464329 - RNA, 24 nt, Human
uccaaaacucuuucauucacuuga

SEQ ID NO: 464330 - RNA, 18 nt, Human
uccugggcugccuuccuu

SEQ ID NO: 464331 - RNA, 19 nt, Human
uccuuagggggagguaaag

SEQ ID NO: 464332 - RNA, 22 nt, Human
ucuccagcccccacugcacuuc

SEQ ID NO: 464333 - RNA, 26 nt, Human
ucuccagcccccacugcacuuccauc

SEQ ID NO: 464334 - RNA, 19 nt, Human
ucucugggcuggcucggcc

SEQ ID NO: 464335 - RNA, 20 nt, Human
ucucugggcuggcucggccu

SEQ ID NO: 464336 - RNA, 24 nt, Human
ucuucaauuuugaucaucagugcu

SEQ ID NO: 464337 - RNA, 18 nt, Human
ugaccuugaggaguuggg

SEQ ID NO: 464338 - RNA, 21 nt, Human
ugacuccugggcugccuuccu

SEQ ID NO: 464339 - RNA, 21 nt, Human
ugagagcagacacugacaaug

SEQ ID NO: 464340 - RNA, 20 nt, Human
ugagaugaagaagagaggaa

SEQ ID NO: 464341 - RNA, 22 nt, Human
ugauauuaaucacaguuaugag

SEQ ID NO: 464342 - RNA, 18 nt, Human
uggagcaggaggggcgga

SEQ ID NO: 464343 - RNA, 22 nt, Human
uggccaaaacaaagaaucugua

SEQ ID NO: 464344 - RNA, 24 nt, Human
uggccaaaacaaagaaucuguauu

SEQ ID NO: 464345 - RNA, 23 nt, Human
ugggcugccuuccuucucagcag

SEQ ID NO: 464346 - RNA, 20 nt, Human
uggucaacagggaaggaccc

SEQ ID NO: 464347 - RNA, 20 nt, Human
uguaaacucugagagcagac

SEQ ID NO: 464348 - RNA, 22 nt, Human
uguagaacuacauacaaagaca

SEQ ID NO: 464349 - RNA, 23 nt, Human
uuccaucagcccccgcugccacu

SEQ ID NO: 464350 - RNA, 21 nt, Human
uuggagaagcuauguaagaag

SEQ ID NO: 464351 - RNA, 18 nt, Human
uuguccaucagaaagcac

SEQ ID NO: 464352 - RNA, 23 nt, Human
uuuaaaaaaaaaaaaagccagac

SEQ ID NO: 464353 - RNA, 24 nt, Human
uuucugugucccccucccauguag

SEQ ID NO: 464354 - RNA, 22 nt, Human
uuuucugugucccccucccaug

SEQ ID NO: 464355 - RNA, 22 nt, Human
aaacgggacagaaaggagagcu

SEQ ID NO: 464356 - RNA, 22 nt, Human
aaagagcccagucuucugagac

SEQ ID NO: 464357 - RNA, 19 nt, Human
aaaggagaggccggggacc

SEQ ID NO: 464358 - RNA, 19 nt, Human
aaccccugcccugucucca

SEQ ID NO: 464359 - RNA, 24 nt, Human
aacuagaaggggaagaagggugag

SEQ ID NO: 464360 - RNA, 20 nt, Human
aagaggugggggcccagggc

SEQ ID NO: 464361 - RNA, 19 nt, Human
aagcuugcaauuguccuug

SEQ ID NO: 464362 - RNA, 24 nt, Human
aaguucagagugagaaccccuaug

SEQ ID NO: 464363 - RNA, 19 nt, Human
acaguggaaauaaaugagc

SEQ ID NO: 464364 - RNA, 22 nt, Human
acaguggccucccugcaucucc

SEQ ID NO: 464365 - RNA, 19 nt, Human
acccauguucucuaagaca

SEQ ID NO: 464366 - RNA, 19 nt, Human
acggaaagaaaggccagug

SEQ ID NO: 464367 - RNA, 19 nt, Human
acgucacuggcaagaauug

SEQ ID NO: 464368 - RNA, 22 nt, Human
agagagcagaugaagcaggcau

SEQ ID NO: 464369 - RNA, 21 nt, Human
agagcugcgcacccauccucc

SEQ ID NO: 464370 - RNA, 22 nt, Human
agcaggcaugacccauguucuc

SEQ ID NO: 464371 - RNA, 25 nt, Human
agccaccugaccccacuaugaccuc

SEQ ID NO: 464372 - RNA, 19 nt, Human
agcugcgcacccauccucc

SEQ ID NO: 464373 - RNA, 21 nt, Human
aggaaaagcuugcaauugucc

SEQ ID NO: 464374 - RNA, 22 nt, Human
aggaagggugugugguaagucu

SEQ ID NO: 464375 - RNA, 20 nt, Human
aggagaaagggagcaggugg

SEQ ID NO: 464376 - RNA, 18 nt, Human
aggaguagcccucuccca

SEQ ID NO: 464377 - RNA, 24 nt, Human
aggccucagggagacuggggacac

SEQ ID NO: 464378 - RNA, 23 nt, Human
agggaagcuugucuuggcccagg

SEQ ID NO: 464379 - RNA, 19 nt, Human
agggaggauggucaaagcu

SEQ ID NO: 464380 - RNA, 23 nt, Human
aguggccucccugcaucuccagc

SEQ ID NO: 464381 - RNA, 20 nt, Human
auggguaguagagagggaaa

SEQ ID NO: 464382 - RNA, 22 nt, Human
auuguccuuggccucaccugga

SEQ ID NO: 464383 - RNA, 22 nt, Human
caaaaagccaaccccgcuuucc

SEQ ID NO: 464384 - RNA, 24 nt, Human
caacgaggaguagcccucucccag

SEQ ID NO: 464385 - RNA, 23 nt, Human
cacagcauggccguggcgugggu

SEQ ID NO: 464386 - RNA, 18 nt, Human
caccaaaaagccaacccc

SEQ ID NO: 464387 - RNA, 19 nt, Human
caccgaaaaccccgucuuc

SEQ ID NO: 464388 - RNA, 22 nt, Human
caccuucaccugagagguugau

SEQ ID NO: 464389 - RNA, 18 nt, Human
cacgggccugagaccaga

SEQ ID NO: 464390 - RNA, 19 nt, Human
cacuaugaccucugaccuu

SEQ ID NO: 464391 - RNA, 19 nt, Human
cagaagcaggggcuaaaag

SEQ ID NO: 464392 - RNA, 18 nt, Human
cagcacaggagccgaggg

SEQ ID NO: 464393 - RNA, 21 nt, Human
cagcacaggagccgagggugg

SEQ ID NO: 464394 - RNA, 23 nt, Human
cagcacaggagccgaggguggaa

SEQ ID NO: 464395 - RNA, 23 nt, Human
cagcacuggaaugccucaggcug

SEQ ID NO: 464396 - RNA, 22 nt, Human
cagcccaggagggucccagcag

SEQ ID NO: 464397 - RNA, 22 nt, Human
caggacccagggauguggacau

SEQ ID NO: 464398 - RNA, 24 nt, Human
caggagccgaggguggaaggcccu

SEQ ID NO: 464399 - RNA, 24 nt, Human
cagugugugucagccaccugaccc

SEQ ID NO: 464400 - RNA, 18 nt, Human
ccaaagagcccagucuuc

SEQ ID NO: 464401 - RNA, 20 nt, Human
ccaaccccgcuuuccuacac

SEQ ID NO: 464402 - RNA, 20 nt, Human
ccaccuucaccaaaaagcca

SEQ ID NO: 464403 - RNA, 23 nt, Human
ccacugagguaccagcuaaaggg

SEQ ID NO: 464404 - RNA, 22 nt, Human
ccagcuaaaggggcaaggaaag

SEQ ID NO: 464405 - RNA, 22 nt, Human
ccaggccucagggagacugggg

SEQ ID NO: 464406 - RNA, 18 nt, Human
ccagggauguggacaucc

SEQ ID NO: 464407 - RNA, 21 nt, Human
ccagugcugcaaacgggacag

SEQ ID NO: 464408 - RNA, 18 nt, Human
ccccaggcgagaaggccc

SEQ ID NO: 464409 - RNA, 18 nt, Human
cccccaaacuacuggccu

SEQ ID NO: 464410 - RNA, 24 nt, Human
ccccuacacgguaccccaucgcuu

SEQ ID NO: 464411 - RNA, 18 nt, Human
ccccugcccugucuccac

SEQ ID NO: 464412 - RNA, 22 nt, Human
cccugcaucuccagccucucac

SEQ ID NO: 464413 - RNA, 21 nt, Human
cccugcccugucuccacugga

SEQ ID NO: 464414 - RNA, 21 nt, Human
cccuggcuccaccgaaaaccc

SEQ ID NO: 464415 - RNA, 20 nt, Human
cccuguacuccaaagagccc

SEQ ID NO: 464416 - RNA, 21 nt, Human
ccucagccuuggaaugagacg

SEQ ID NO: 464417 - RNA, 18 nt, Human
ccucaggcugggcugucc

SEQ ID NO: 464418 - RNA, 22 nt, Human
ccucagggagggcagagcugcg

SEQ ID NO: 464419 - RNA, 19 nt, Human
ccucccugcuaaauccugg

SEQ ID NO: 464420 - RNA, 21 nt, Human
ccucuagacucaugacugucc

SEQ ID NO: 464421 - RNA, 20 nt, Human
ccuggaaaggauucuaccug

SEQ ID NO: 464422 - RNA, 24 nt, Human
ccuugagcuuggggugccuggucc

SEQ ID NO: 464423 - RNA, 24 nt, Human
ccuugagcuuggggugccuggucc

SEQ ID NO: 464424 - RNA, 24 nt, Human
cuaaguacuuugaccaccuucacc

SEQ ID NO: 464425 - RNA, 22 nt, Human
cucacaguaaagacggacagcc

SEQ ID NO: 464426 - RNA, 24 nt, Human
cuccaaagagcccagucuucugag

SEQ ID NO: 464427 - RNA, 24 nt, Human
cuccaccgaaaaccccgucuuccc

SEQ ID NO: 464428 - RNA, 19 nt, Human
cuccccuacacgguacccc

SEQ ID NO: 464429 - RNA, 21 nt, Human
cucugaccuuacgccccagcc

SEQ ID NO: 464430 - RNA, 25 nt, Human
cucuguggcugcauccucugccacc

SEQ ID NO: 464431 - RNA, 18 nt, Human
cugcauccucugccaccu

SEQ ID NO: 464432 - RNA, 21 nt, Human
cuggccgacagggagaaaagc

SEQ ID NO: 464433 - RNA, 24 nt, Human
cugguccugggcuugccuccguga

SEQ ID NO: 464434 - RNA, 21 nt, Human
cuugguaaggaagccucccca

SEQ ID NO: 464435 - RNA, 22 nt, Human
gaaacaaaaccagugcugcaaa

SEQ ID NO: 464436 - RNA, 18 nt, Human
gaaaguggcugcgucccc

SEQ ID NO: 464437 - RNA, 21 nt, Human
gaaauugguuuccuuggggau

SEQ ID NO: 464438 - RNA, 24 nt, Human
gaagcaggcaugacccauguucuc

SEQ ID NO: 464439 - RNA, 18 nt, Human
gaaugagacgggggaggg

SEQ ID NO: 464440 - RNA, 20 nt, Human
gagaagggaagcuugucuug

SEQ ID NO: 464441 - RNA, 18 nt, Human
gagauggggauuuccagg

SEQ ID NO: 464442 - RNA, 19 nt, Human
gagauggggauuuccaggg

SEQ ID NO: 464443 - RNA, 18 nt, Human
gccaccucccugcuaaau

SEQ ID NO: 464444 - RNA, 21 nt, Human
gccaccuucaccaaaaagcca

SEQ ID NO: 464445 - RNA, 22 nt, Human
gccaguuuccucucuguggucu

SEQ ID NO: 464446 - RNA, 20 nt, Human
gcccagggcagguaagcaug

SEQ ID NO: 464447 - RNA, 19 nt, Human
gccccagcacuggaaugcc

SEQ ID NO: 464448 - RNA, 26 nt, Human
gcugauaugcaaaaggcugugaucua

SEQ ID NO: 464449 - RNA, 19 nt, Human
gcuucuggcauaguccugg

SEQ ID NO: 464450 - RNA, 23 nt, Human
ggaaaggauucuaccuguuugga

SEQ ID NO: 464451 - RNA, 19 nt, Human
ggaagaggagcagcaggaa

SEQ ID NO: 464452 - RNA, 18 nt, Human
ggagaaaggcugagagca

SEQ ID NO: 464453 - RNA, 20 nt, Human
ggagaaagggagcaggugga

SEQ ID NO: 464454 - RNA, 20 nt, Human
ggagagaaucuuaaaggaga

SEQ ID NO: 464455 - RNA, 18 nt, Human
ggagaggggagcuaagga

SEQ ID NO: 464456 - RNA, 19 nt, Human
ggauguggacauccugagg

SEQ ID NO: 464457 - RNA, 22 nt, Human
ggcaagaauuguaaggacaagc

SEQ ID NO: 464458 - RNA, 22 nt, Human
ggcaggaagaggagcagcagga

SEQ ID NO: 464459 - RNA, 22 nt, Human
ggccagugaggagaaagggagc

SEQ ID NO: 464460 - RNA, 20 nt, Human
ggccucagggagggcagagc

SEQ ID NO: 464461 - RNA, 24 nt, Human
ggcgacggugccccagcacuggaa

SEQ ID NO: 464462 - RNA, 22 nt, Human
gggaagaagggugaggggcuau

SEQ ID NO: 464463 - RNA, 23 nt, Human
gggacacacacccugggcacuuc

SEQ ID NO: 464464 - RNA, 22 nt, Human
gggggagcugaggagagucagg

SEQ ID NO: 464465 - RNA, 20 nt, Human
gggggcccagggcugcuguu

SEQ ID NO: 464466 - RNA, 22 nt, Human
ggugaggggcuauucuggaggg

SEQ ID NO: 464467 - RNA, 19 nt, Human
gucuggguggauugguggc

SEQ ID NO: 464468 - RNA, 22 nt, Human
gugugccacggacgcaugcaca

SEQ ID NO: 464469 - RNA, 22 nt, Human
uaaagaacagagccgaaaugag

SEQ ID NO: 464470 - RNA, 23 nt, Human
uaagacaguggaaauaaaugagc

SEQ ID NO: 464471 - RNA, 23 nt, Human
uaauagccuggcaggcagcacgc

SEQ ID NO: 464472 - RNA, 21 nt, Human
uacccuguccuuugcaaucca

SEQ ID NO: 464473 - RNA, 21 nt, Human
uaggacaaggacaacugcugg

SEQ ID NO: 464474 - RNA, 22 nt, Human
uaggggacuccuacccccaaac

SEQ ID NO: 464475 - RNA, 19 nt, Human
uauguaauggguccaggau

SEQ ID NO: 464476 - RNA, 20 nt, Human
uauucaaacaugugaugagg

SEQ ID NO: 464477 - RNA, 21 nt, Human
uauucuggagggaggguaggc

SEQ ID NO: 464478 - RNA, 18 nt, Human
ucaaagcuguguaaagug

SEQ ID NO: 464479 - RNA, 20 nt, Human
ucaacugugugcucuguggc

SEQ ID NO: 464480 - RNA, 24 nt, Human
ucagccaccugaccccacuaugac

SEQ ID NO: 464481 - RNA, 19 nt, Human
ucaggaacgguuccacggg

SEQ ID NO: 464482 - RNA, 18 nt, Human
ucaggccaugggcucugg

SEQ ID NO: 464483 - RNA, 22 nt, Human
ucauuuccgccccauuuagaag

SEQ ID NO: 464484 - RNA, 25 nt, Human
uccaaagagcccagucuucugagac

SEQ ID NO: 464485 - RNA, 18 nt, Human
uccacgccuggaaguuuc

SEQ ID NO: 464486 - RNA, 25 nt, Human
uccccaggcgagaaggcccucccuc

SEQ ID NO: 464487 - RNA, 18 nt, Human
ucccugcaucuccagccu

SEQ ID NO: 464488 - RNA, 24 nt, Human
uccucuagacucaugacuguccac

SEQ ID NO: 464489 - RNA, 21 nt, Human
uccugacuuaaccaaagccuc

SEQ ID NO: 464490 - RNA, 18 nt, Human
uccuuacagggucugugg

SEQ ID NO: 464491 - RNA, 22 nt, Human
uccuuacagggucugugggaau

SEQ ID NO: 464492 - RNA, 18 nt, Human
uccuugggaggggcucug

SEQ ID NO: 464493 - RNA, 19 nt, Human
ucuaagacaguggaaauaa

SEQ ID NO: 464494 - RNA, 21 nt, Human
ucuaggacaaggacaacugac

SEQ ID NO: 464495 - RNA, 20 nt, Human
ucuuggugugaggcugcugc

SEQ ID NO: 464496 - RNA, 21 nt, Human
ugaaccccugcccugucucca

SEQ ID NO: 464497 - RNA, 20 nt, Human
ugaagaaaugaaggggauca

SEQ ID NO: 464498 - RNA, 26 nt, Human
ugaagaaaugaaggggaucagggagg

SEQ ID NO: 464499 - RNA, 19 nt, Human
ugaaggggaucagggaggu

SEQ ID NO: 464500 - RNA, 22 nt, Human
ugacccauguucucuaagacag

SEQ ID NO: 464501 - RNA, 21 nt, Human
ugaccucugaccuuacgcccc

SEQ ID NO: 464502 - RNA, 20 nt, Human
ugagaccagaugccccuuuc

SEQ ID NO: 464503 - RNA, 23 nt, Human
ugaggagaaagggagcaggugga

SEQ ID NO: 464504 - RNA, 22 nt, Human
ugagguaccagcuaaaggggca

SEQ ID NO: 464505 - RNA, 20 nt, Human
ugauaagggcaggaagagga

SEQ ID NO: 464506 - RNA, 22 nt, Human
ugauaugcaaaaggcugugauc

SEQ ID NO: 464507 - RNA, 20 nt, Human
ugcaaacgggacagaaagga

SEQ ID NO: 464508 - RNA, 22 nt, Human
ugcacagacaggcgggcaggag

SEQ ID NO: 464509 - RNA, 24 nt, Human
ugccccuggcuccaccgaaaaccc

SEQ ID NO: 464510 - RNA, 18 nt, Human
ugcccugucuccacugga

SEQ ID NO: 464511 - RNA, 21 nt, Human
ugcgcacccauccuccaggca

SEQ ID NO: 464512 - RNA, 23 nt, Human
ugcugcaaacgggacagaaagga

SEQ ID NO: 464513 - RNA, 19 nt, Human
uggaaggcccuggguggga

SEQ ID NO: 464514 - RNA, 20 nt, Human
uggagggaggguaggcgggc

SEQ ID NO: 464515 - RNA, 22 nt, Human
uggcaccccugcuaagugugca

SEQ ID NO: 464516 - RNA, 25 nt, Human
uggcauaguccugggccucagggag

SEQ ID NO: 464517 - RNA, 22 nt, Human
uggcccagggcagguaagcaug

SEQ ID NO: 464518 - RNA, 22 nt, Human
uggccgacagggagaaaagcca

SEQ ID NO: 464519 - RNA, 19 nt, Human
uggccguggcguggguugg

SEQ ID NO: 464520 - RNA, 20 nt, Human
uggcguggguuggaagagga

SEQ ID NO: 464521 - RNA, 21 nt, Human
uggcuccccuacacgguaccc

SEQ ID NO: 464522 - RNA, 19 nt, Human
ugggcucuggguauccccc

SEQ ID NO: 464523 - RNA, 19 nt, Human
ugggucucccucccgacca

SEQ ID NO: 464524 - RNA, 18 nt, Human
uguccuuggccucaccug

SEQ ID NO: 464525 - RNA, 21 nt, Human
ugugcacacaguaggcucaca

SEQ ID NO: 464526 - RNA, 22 nt, Human
uuaaagaacagagccgaaauga

SEQ ID NO: 464527 - RNA, 19 nt, Human
uuccuuacagggucugugg

SEQ ID NO: 464528 - RNA, 21 nt, Human
uuccuucuuggugugaggcug

SEQ ID NO: 464529 - RNA, 23 nt, Human
uucuggagggaggguaggcgggc

SEQ ID NO: 464530 - RNA, 25 nt, Human
aaaaaaaaaaaaaaagacaaaaagg

SEQ ID NO: 464531 - RNA, 20 nt, Human
aaaaaaaagacaaaaagaca

SEQ ID NO: 464532 - RNA, 18 nt, Human
aaaaaagacaaaaagaca

SEQ ID NO: 464533 - RNA, 23 nt, Human
aaaaagacaaaccaaccaaccag

SEQ ID NO: 464534 - RNA, 24 nt, Human
aaaaagacaaaccaaccaaccaga

SEQ ID NO: 464535 - RNA, 26 nt, Human
aaaaagacaaaccaaccaaccagagg

SEQ ID NO: 464536 - RNA, 18 nt, Human
aaaagaaaaaaggaacac

SEQ ID NO: 464537 - RNA, 23 nt, Human
aaaagacaaaaagacaaaccaac

SEQ ID NO: 464538 - RNA, 20 nt, Human
aaaagagacggaaagcaaaa

SEQ ID NO: 464539 - RNA, 21 nt, Human
aaacaacaacaaaaaccacaa

SEQ ID NO: 464540 - RNA, 22 nt, Human
aaacaccaagggcugugcccuc

SEQ ID NO: 464541 - RNA, 23 nt, Human
aaacagagaacacuuggccagga

SEQ ID NO: 464542 - RNA, 20 nt, Human
aaaccaaccaaccagauccc

SEQ ID NO: 464543 - RNA, 22 nt, Human
aacaaaaaccacaacacugcca

SEQ ID NO: 464544 - RNA, 20 nt, Human
aacucucaacucugaaacag

SEQ ID NO: 464545 - RNA, 23 nt, Human
aagaaaaagaaaagaaaaaagga

SEQ ID NO: 464546 - RNA, 21 nt, Human
aagcacacacuuccugaggcc

SEQ ID NO: 464547 - RNA, 20 nt, Human
aaggaaacccgaacacauca

SEQ ID NO: 464548 - RNA, 18 nt, Human
aaguguccacaaauccca

SEQ ID NO: 464549 - RNA, 21 nt, Human
acaaacaccaagggcugugcc

SEQ ID NO: 464550 - RNA, 24 nt, Human
acaaaucccacagagcaacacacc

SEQ ID NO: 464551 - RNA, 19 nt, Human
acaacaacaaaaaccacaa

SEQ ID NO: 464552 - RNA, 21 nt, Human
acaccuuggaacaccugcauc

SEQ ID NO: 464553 - RNA, 18 nt, Human
acagaacgugcgugcucc

SEQ ID NO: 464554 - RNA, 19 nt, Human
accaaccaaccagauccca

SEQ ID NO: 464555 - RNA, 25 nt, Human
acccagccugccuccccuugccccc

SEQ ID NO: 464556 - RNA, 19 nt, Human
acccuaggguucuagaaac

SEQ ID NO: 464557 - RNA, 19 nt, Human
accuuggaacaccugcauc

SEQ ID NO: 464558 - RNA, 21 nt, Human
acgcaggcccugccauggucu

SEQ ID NO: 464559 - RNA, 20 nt, Human
acugcauccuuuaauggcag

SEQ ID NO: 464560 - RNA, 20 nt, Human
acuuauuuuacaaacaccaa

SEQ ID NO: 464561 - RNA, 19 nt, Human
agaaaaagaaaagaaaaaa

SEQ ID NO: 464562 - RNA, 22 nt, Human
agaaaagaaaaaaggaacaccc

SEQ ID NO: 464563 - RNA, 24 nt, Human
agaaaagaaaaaaggaacacccag

SEQ ID NO: 464564 - RNA, 23 nt, Human
agacaaaaagacaaaccaaccaa

SEQ ID NO: 464565 - RNA, 20 nt, Human
agacaaaccaaccaaccaga

SEQ ID NO: 464566 - RNA, 20 nt, Human
agacaaaccaaccaaccaga

SEQ ID NO: 464567 - RNA, 24 nt, Human
agagcccacagagucugaggccag

SEQ ID NO: 464568 - RNA, 23 nt, Human
agcaaaagaaaaagaaaagaaga

SEQ ID NO: 464569 - RNA, 20 nt, Human
agcaggagccccugagcccg

SEQ ID NO: 464570 - RNA, 22 nt, Human
agccugccuccccuugccccca

SEQ ID NO: 464571 - RNA, 18 nt, Human
agcuggaggccaggugcc

SEQ ID NO: 464572 - RNA, 18 nt, Human
agcuguccggggcugggc

SEQ ID NO: 464573 - RNA, 18 nt, Human
aggaaaaacaacaacaaa

SEQ ID NO: 464574 - RNA, 20 nt, Human
aggagcguucaauaccuucc

SEQ ID NO: 464575 - RNA, 22 nt, Human
agggugaggagcguucaauacc

SEQ ID NO: 464576 - RNA, 21 nt, Human
agguggcucuucaggacucug

SEQ ID NO: 464577 - RNA, 19 nt, Human
augcagccacaagcacaca

SEQ ID NO: 464578 - RNA, 22 nt, Human
augcuuugcccagaaaacccac

SEQ ID NO: 464579 - RNA, 24 nt, Human
auuauauacauauuugcaccacca

SEQ ID NO: 464580 - RNA, 19 nt, Human
caaaaaccacaacacugcc

SEQ ID NO: 464581 - RNA, 23 nt, Human
caaaagaaaaagaaaagaaaaaa

SEQ ID NO: 464582 - RNA, 21 nt, Human
caaaccaaccaaccagauccc

SEQ ID NO: 464583 - RNA, 24 nt, Human
cacaaaucccacagagcaacacac

SEQ ID NO: 464584 - RNA, 19 nt, Human
caccccuugcgcccaucuc

SEQ ID NO: 464585 - RNA, 19 nt, Human
cacgcaggcccugccaugg

SEQ ID NO: 464586 - RNA, 20 nt, Human
cacugggccuccagcaaggc

SEQ ID NO: 464587 - RNA, 23 nt, Human
cagaaaacccacugggccuccag

SEQ ID NO: 464588 - RNA, 19 nt, Human
cagagaacacuuggccagg

SEQ ID NO: 464589 - RNA, 19 nt, Human
cagaggcuccccauccccu

SEQ ID NO: 464590 - RNA, 18 nt, Human
cagcccuguaggacaccc

SEQ ID NO: 464591 - RNA, 18 nt, Human
cagggagggcacgugugg

SEQ ID NO: 464592 - RNA, 20 nt, Human
ccaaccaaccagaucccagc

SEQ ID NO: 464593 - RNA, 21 nt, Human
ccaaccagaucccagcacuga

SEQ ID NO: 464594 - RNA, 18 nt, Human
ccacaaaucccacagagc

SEQ ID NO: 464595 - RNA, 23 nt, Human
ccagcaccccuugcgcccaucuc

SEQ ID NO: 464596 - RNA, 20 nt, Human
ccauaggugggccuccuccu

SEQ ID NO: 464597 - RNA, 18 nt, Human
ccauggucuugguuccgg

SEQ ID NO: 464598 - RNA, 22 nt, Human
cccagcacugaccccucagggc

SEQ ID NO: 464599 - RNA, 21 nt, Human
cccauagugccgcugggggcu

SEQ ID NO: 464600 - RNA, 19 nt, Human
ccccacuaccuuugggucc

SEQ ID NO: 464601 - RNA, 21 nt, Human
ccccagcaccccuugcgccca

SEQ ID NO: 464602 - RNA, 22 nt, Human
ccccaggguccccauuguuggg

SEQ ID NO: 464603 - RNA, 23 nt, Human
cccccacuaccuuuggguccagu

SEQ ID NO: 464604 - RNA, 23 nt, Human
cccccagcaccccuugcgcccau

SEQ ID NO: 464605 - RNA, 19 nt, Human
ccccugagcccgccacacu

SEQ ID NO: 464606 - RNA, 23 nt, Human
ccccugagcccgccacacugacc

SEQ ID NO: 464607 - RNA, 19 nt, Human
cccucagccagggugggag

SEQ ID NO: 464608 - RNA, 19 nt, Human
ccggggcugggcugcagug

SEQ ID NO: 464609 - RNA, 22 nt, Human
ccuaggggcugccuccuagagg

SEQ ID NO: 464610 - RNA, 18 nt, Human
ccugaggaggagggaagg

SEQ ID NO: 464611 - RNA, 21 nt, Human
ccugccuccuggcuccaaacu

SEQ ID NO: 464612 - RNA, 20 nt, Human
ccuggagcuguccggggcug

SEQ ID NO: 464613 - RNA, 23 nt, Human
ccuuuguccuggggaaaaggggc

SEQ ID NO: 464614 - RNA, 24 nt, Human
cgaacacaucaauaccucaugccc

SEQ ID NO: 464615 - RNA, 22 nt, Human
cguucaauaccuucccagacac

SEQ ID NO: 464616 - RNA, 18 nt, Human
cuccuaggggcugccucc

SEQ ID NO: 464617 - RNA, 23 nt, Human
cugaaacaguauuuacacuuuug

SEQ ID NO: 464618 - RNA, 19 nt, Human
cugcaggcuggggggcauc

SEQ ID NO: 464619 - RNA, 23 nt, Human
cugcaggcuggggggcauccgcu

SEQ ID NO: 464620 - RNA, 23 nt, Human
cuggugugggcaagcagggugug

SEQ ID NO: 464621 - RNA, 25 nt, Human
cuguaggacacccugccuccuggcu

SEQ ID NO: 464622 - RNA, 22 nt, Human
cuuccacgcaggcccugccaug

SEQ ID NO: 464623 - RNA, 18 nt, Human
cuucugcugcaggcuggg

SEQ ID NO: 464624 - RNA, 23 nt, Human
gaaaaaaggaacacccagccugc

SEQ ID NO: 464625 - RNA, 21 nt, Human
gacaggagcaggcaugcgcca

SEQ ID NO: 464626 - RNA, 18 nt, Human
gacggaaagcaaaagaaa

SEQ ID NO: 464627 - RNA, 19 nt, Human
gaggagggaaggggaaucc

SEQ ID NO: 464628 - RNA, 21 nt, Human
gaggcuucugcugcaggcugg

SEQ ID NO: 464629 - RNA, 23 nt, Human
gaggguggcagggagggcacgug

SEQ ID NO: 464630 - RNA, 19 nt, Human
gccaugcuuugcccagaaa

SEQ ID NO: 464631 - RNA, 23 nt, Human
gccuccccuugcccccaaguucc

SEQ ID NO: 464632 - RNA, 21 nt, Human
gcgcagccacugcacggaucc

SEQ ID NO: 464633 - RNA, 27 nt, Human
gcugcaggguucccacucaguccguuu

SEQ ID NO: 464634 - RNA, 19 nt, Human
ggagcuguccggggcuggg

SEQ ID NO: 464635 - RNA, 19 nt, Human
ggccaggagccaccccagg

SEQ ID NO: 464636 - RNA, 20 nt, Human
ggcugggcugcagugcaggc

SEQ ID NO: 464637 - RNA, 24 nt, Human
gggacaggagcaggcaugcgccag

SEQ ID NO: 464638 - RNA, 18 nt, Human
gggcacagggugaggagc

SEQ ID NO: 464639 - RNA, 19 nt, Human
guccaguucucacugugga

SEQ ID NO: 464640 - RNA, 22 nt, Human
guggcucuucaggacucugccc

SEQ ID NO: 464641 - RNA, 22 nt, Human
guguaaaaaaaaaaaaaaaaaa

SEQ ID NO: 464642 - RNA, 21 nt, Human
guucuuaggcugaauauucca

SEQ ID NO: 464643 - RNA, 25 nt, Human
uaaaagagacggaaagcaaaagaaa

SEQ ID NO: 464644 - RNA, 21 nt, Human
uaaguguccacaaaucccaca

SEQ ID NO: 464645 - RNA, 21 nt, Human
uagacggaggguggcagggag

SEQ ID NO: 464646 - RNA, 24 nt, Human
uagagaacaauuuuucuuuaaaag

SEQ ID NO: 464647 - RNA, 20 nt, Human
ucaaaaggagaggaaaaaca

SEQ ID NO: 464648 - RNA, 20 nt, Human
uccaagaggagggcuccagc

SEQ ID NO: 464649 - RNA, 19 nt, Human
uccacgcaggcccugccau

SEQ ID NO: 464650 - RNA, 21 nt, Human
ucccagacaccaacuguuccc

SEQ ID NO: 464651 - RNA, 22 nt, Human
ucccagacaccaacuguucccu

SEQ ID NO: 464652 - RNA, 25 nt, Human
ucccagacaccaacuguucccuuug

SEQ ID NO: 464653 - RNA, 22 nt, Human
uccccuggcugcaggguuccca

SEQ ID NO: 464654 - RNA, 25 nt, Human
uccgcuugcucuagacggagggugg

SEQ ID NO: 464655 - RNA, 23 nt, Human
uccuuaauaccuuuucacucuca

SEQ ID NO: 464656 - RNA, 23 nt, Human
ucucaaaaggagaggaaaaacaa

SEQ ID NO: 464657 - RNA, 24 nt, Human
ucuuaggcugaauauuccaagagg

SEQ ID NO: 464658 - RNA, 18 nt, Human
ucuucaggacucugcccc

SEQ ID NO: 464659 - RNA, 19 nt, Human
ugaaacaguauuuacacuu

SEQ ID NO: 464660 - RNA, 21 nt, Human
ugaaacaguauuuacacuuuu

SEQ ID NO: 464661 - RNA, 19 nt, Human
ugaccagaacuuaagaugg

SEQ ID NO: 464662 - RNA, 22 nt, Human
ugagcccgccacacugaccaga

SEQ ID NO: 464663 - RNA, 22 nt, Human
ugaggagcguucaauaccuucc

SEQ ID NO: 464664 - RNA, 20 nt, Human
ugauggcaaaugagaauuuc

SEQ ID NO: 464665 - RNA, 21 nt, Human
ugcuccuaggggcugccuccu

SEQ ID NO: 464666 - RNA, 18 nt, Human
uggaagacagauauggag

SEQ ID NO: 464667 - RNA, 19 nt, Human
uggaagacagauauggagu

SEQ ID NO: 464668 - RNA, 22 nt, Human
uggcagggagggcacguguggu

SEQ ID NO: 464669 - RNA, 22 nt, Human
uggcccagaggcaggauagcag

SEQ ID NO: 464670 - RNA, 18 nt, Human
uggcggcgcagccacugc

SEQ ID NO: 464671 - RNA, 19 nt, Human
uggggugggauaggagccu

SEQ ID NO: 464672 - RNA, 23 nt, Human
uggggugggauaggagccuuguu

SEQ ID NO: 464673 - RNA, 22 nt, Human
ugggguggggugggauaggagc

SEQ ID NO: 464674 - RNA, 25 nt, Human
uggugggccagggagacgggcagau

SEQ ID NO: 464675 - RNA, 18 nt, Human
uggugugggcaagcaggg

SEQ ID NO: 464676 - RNA, 23 nt, Human
uggugugggcaagcagggugugg

SEQ ID NO: 464677 - RNA, 19 nt, Human
ugugcagcccuguaggaca

SEQ ID NO: 464678 - RNA, 21 nt, Human
ugugggcaagcaggguguggc

SEQ ID NO: 464679 - RNA, 22 nt, Human
uguucaccccacccugaggagg

SEQ ID NO: 464680 - RNA, 23 nt, Human
uuacuggauuaagagaccacagg

SEQ ID NO: 464681 - RNA, 22 nt, Human
uucauuuuucucuuuuuggggu

SEQ ID NO: 464682 - RNA, 23 nt, Human
uuccaagaggagggcuccagcuu

SEQ ID NO: 464683 - RNA, 22 nt, Human
uugcccccaaguucccuacccu

SEQ ID NO: 464684 - RNA, 25 nt, Human
uuggccugcagccacauggugggcc

SEQ ID NO: 464685 - RNA, 22 nt, Human
uuguguaaaaaaaaaaaaaaaa

SEQ ID NO: 464686 - RNA, 24 nt, Human
uuuuacaaaagaaaauucucaaaa

SEQ ID NO: 464687 - RNA, 21 nt, Human
aaacaggcaacaaaaucucuu

SEQ ID NO: 464688 - RNA, 21 nt, Human
aaauuuucuuuucuuuaaggc

SEQ ID NO: 464689 - RNA, 20 nt, Human
aggauguuauaaaaucaaag

SEQ ID NO: 464690 - RNA, 24 nt, Human
caacaauauuucuuucuaaaauuu

SEQ ID NO: 464691 - RNA, 22 nt, Human
cacuuagaauuccucacuggga

SEQ ID NO: 464692 - RNA, 20 nt, Human
ccagucuuauuuuagcuucu

SEQ ID NO: 464693 - RNA, 23 nt, Human
ccucauauauauagacauauuua

SEQ ID NO: 464694 - RNA, 21 nt, Human
ccucuaccuggccaccauuua

SEQ ID NO: 464695 - RNA, 21 nt, Human
gaaaguguauuucuguaagaa

SEQ ID NO: 464696 - RNA, 24 nt, Human
ggaagaaauacuaccaauuauaaa

SEQ ID NO: 464697 - RNA, 20 nt, Human
gugcuagacauauuaccuuu

SEQ ID NO: 464698 - RNA, 25 nt, Human
uacugcaaauauaaacucaauucuu

SEQ ID NO: 464699 - RNA, 26 nt, Human
uacugcaaauauaaacucaauucuug

SEQ ID NO: 464700 - RNA, 21 nt, Human
ucacagcucauuuaaagcuuc

SEQ ID NO: 464701 - RNA, 25 nt, Human
uccucauauauauagacauauuuau

SEQ ID NO: 464702 - RNA, 23 nt, Human
ucuaguuccucuaccuggccacc

SEQ ID NO: 464703 - RNA, 18 nt, Human
ugaaagguuucuauaagg

SEQ ID NO: 464704 - RNA, 21 nt, Human
ugugugggugugguagggggg

SEQ ID NO: 464705 - RNA, 24 nt, Human
ugugugugggugugguaggggggu

SEQ ID NO: 464706 - RNA, 19 nt, Human
uucucagugacaauaacac

SEQ ID NO: 464707 - RNA, 26 nt, Human
uuuauagucauucaugugaaagguca

SEQ ID NO: 464708 - RNA, 24 nt, Human
uuuuuuuuuuuuuuuuuuaauuuu

SEQ ID NO: 464709 - RNA, 23 nt, Human
agaaagaccuaaaagggaagcug

SEQ ID NO: 464710 - RNA, 22 nt, Human
auaaaaauaguccugaaacccc

SEQ ID NO: 464711 - RNA, 19 nt, Human
caauagagagaugucagag

SEQ ID NO: 464712 - RNA, 22 nt, Human
ccacaagaugaggacaauucag

SEQ ID NO: 464713 - RNA, 19 nt, Human
ccaugcaggacaagccaaa

SEQ ID NO: 464714 - RNA, 20 nt, Human
ccaugcaggacaagccaaag

SEQ ID NO: 464715 - RNA, 19 nt, Human
cuccagcugucuucuucca

SEQ ID NO: 464716 - RNA, 18 nt, Human
cuugcagaaauuaucuca

SEQ ID NO: 464717 - RNA, 18 nt, Human
gaagcugcauaaugaaga

SEQ ID NO: 464718 - RNA, 24 nt, Human
ggccaugcaggacaagccaaacuc

SEQ ID NO: 464719 - RNA, 21 nt, Human
uaaaagggaagcugcauaaug

SEQ ID NO: 464720 - RNA, 18 nt, Human
ucaggauagaaagcuccu

SEQ ID NO: 464721 - RNA, 21 nt, Human
ucuccagcugucuucuuccag

SEQ ID NO: 464722 - RNA, 22 nt, Human
ucucuccagcugucuucuucca

SEQ ID NO: 464723 - RNA, 19 nt, Human
ugagagggucugcaccgca

SEQ ID NO: 464724 - RNA, 20 nt, Human
ugggaugaaacaaguggcug

SEQ ID NO: 464725 - RNA, 23 nt, Human
uuugaagucaaccuaaugcccag

SEQ ID NO: 464726 - RNA, 19 nt, Human
gcuaggugggacagggcga

SEQ ID NO: 464727 - RNA, 18 nt, Human
uaugagaaucauguauua

SEQ ID NO: 464728 - RNA, 18 nt, Human
uguauuaaacaaauuugu

SEQ ID NO: 464729 - RNA, 22 nt, Human
aaaaaacaaaacccagaaaaca

SEQ ID NO: 464730 - RNA, 26 nt, Human
aaaaaaccacaaaagaaaguuuacua

SEQ ID NO: 464731 - RNA, 22 nt, Human
aaaaaauaaccacacugaaagc

SEQ ID NO: 464732 - RNA, 30 nt, Human
aaaaaccacaaaagaaaguuuacuacacag

SEQ ID NO: 464733 - RNA, 19 nt, Human
aaaacaaaacccagaaaac

SEQ ID NO: 464734 - RNA, 21 nt, Human
aaaaccaaccaaagaaaaaau

SEQ ID NO: 464735 - RNA, 25 nt, Human
aaaacccagaaaacaaaacaaaaaa

SEQ ID NO: 464736 - RNA, 18 nt, Human
aaaagaaaguuuacuaca

SEQ ID NO: 464737 - RNA, 25 nt, Human
aaaagaaaguuuacuacacaaaacc

SEQ ID NO: 464738 - RNA, 18 nt, Human
aaaaggcuugggaagagg

SEQ ID NO: 464739 - RNA, 20 nt, Human
aaaauaaccacacugaaagc

SEQ ID NO: 464740 - RNA, 18 nt, Human
aaacaaaaaacaaaaccc

SEQ ID NO: 464741 - RNA, 24 nt, Human
aaacaaaaaacaaaacccagaaaa

SEQ ID NO: 464742 - RNA, 27 nt, Human
aaacaaaaaacaaaacccagaaaacaa

SEQ ID NO: 464743 - RNA, 23 nt, Human
aaacaaaacaaaaaaccacaaaa

SEQ ID NO: 464744 - RNA, 24 nt, Human
aaacaaaacaaaaaaccacaaaag

SEQ ID NO: 464745 - RNA, 18 nt, Human
aaacaccccacuugguuu

SEQ ID NO: 464746 - RNA, 22 nt, Human
aaacauacagacacacaaagga

SEQ ID NO: 464747 - RNA, 22 nt, Human
aaacauuccaaacaccaaauuc

SEQ ID NO: 464748 - RNA, 25 nt, Human
aaagaaaaaauaaccacacugaaag

SEQ ID NO: 464749 - RNA, 20 nt, Human
aaaugcuguccuucuguuuc

SEQ ID NO: 464750 - RNA, 27 nt, Human
aacaaaaaacaaaacccagaaaacaaa

SEQ ID NO: 464751 - RNA, 25 nt, Human
aacaaaacccaaacaccaugucaaa

SEQ ID NO: 464752 - RNA, 22 nt, Human
aacccaaacaccaugucaaacu

SEQ ID NO: 464753 - RNA, 21 nt, Human
aagagaagcacaaaagguuuc

SEQ ID NO: 464754 - RNA, 24 nt, Human
aagcaaucauuaauggauuccuau

SEQ ID NO: 464755 - RNA, 22 nt, Human
aaggccuugaugaagucagaaa

SEQ ID NO: 464756 - RNA, 19 nt, Human
acaaaacaaaaaaccacaa

SEQ ID NO: 464757 - RNA, 21 nt, Human
acaaaacaaaaaaccacaaaa

SEQ ID NO: 464758 - RNA, 21 nt, Human
acaaaacccagaaaacaaaac

SEQ ID NO: 464759 - RNA, 21 nt, Human
acaaaggagagaccucccaga

SEQ ID NO: 464760 - RNA, 20 nt, Human
acagacaaaaacaaaaaaca

SEQ ID NO: 464761 - RNA, 19 nt, Human
acagugaggaugauaaggc

SEQ ID NO: 464762 - RNA, 20 nt, Human
acauacagacacacaaagga

SEQ ID NO: 464763 - RNA, 22 nt, Human
acccaaacaccaugucaaacua

SEQ ID NO: 464764 - RNA, 18 nt, Human
acccaacaugccaugguu

SEQ ID NO: 464765 - RNA, 23 nt, Human
acccagaaaacaaaacaaaaaac

SEQ ID NO: 464766 - RNA, 22 nt, Human
accugguuagcuugucuagggc

SEQ ID NO: 464767 - RNA, 25 nt, Human
acuaacuccauacacucgcacacac

SEQ ID NO: 464768 - RNA, 23 nt, Human
acuccacagugaggaugauaagg

SEQ ID NO: 464769 - RNA, 21 nt, Human
agaaaaaauaaccacacugaa

SEQ ID NO: 464770 - RNA, 22 nt, Human
agaaaacaaaacaaaaaaccac

SEQ ID NO: 464771 - RNA, 19 nt, Human
agaaaacauuccaaacacc

SEQ ID NO: 464772 - RNA, 20 nt, Human
agaagggauggagauggggc

SEQ ID NO: 464773 - RNA, 25 nt, Human
agacaaaaacaaaaaacaaaaccca

SEQ ID NO: 464774 - RNA, 26 nt, Human
agacaaaaacaaaaaacaaaacccag

SEQ ID NO: 464775 - RNA, 28 nt, Human
agacaaaaacaaaaaacaaaacccagaa

SEQ ID NO: 464776 - RNA, 18 nt, Human
agagggccagcaacugug

SEQ ID NO: 464777 - RNA, 23 nt, Human
agauggggcaggagggugggaag

SEQ ID NO: 464778 - RNA, 18 nt, Human
agcauacggggcgggggg

SEQ ID NO: 464779 - RNA, 22 nt, Human
agcugcaggucuugcacagaca

SEQ ID NO: 464780 - RNA, 21 nt, Human
agcuuuuuggaauagcagccu

SEQ ID NO: 464781 - RNA, 18 nt, Human
aggaaaaaaggacugaga

SEQ ID NO: 464782 - RNA, 19 nt, Human
aggaaaaaggcuugggaag

SEQ ID NO: 464783 - RNA, 23 nt, Human
aggaaaaaggcuugggaagagga

SEQ ID NO: 464784 - RNA, 18 nt, Human
aggaaggccuaccagagc

SEQ ID NO: 464785 - RNA, 23 nt, Human
aggccuugaugaagucagaaaca

SEQ ID NO: 464786 - RNA, 24 nt, Human
aggccuugaugaagucagaaacac

SEQ ID NO: 464787 - RNA, 20 nt, Human
aggcugggagacugcagcug

SEQ ID NO: 464788 - RNA, 24 nt, Human
agggauggagauggggcaggaggg

SEQ ID NO: 464789 - RNA, 20 nt, Human
aggggccugggcccucugug

SEQ ID NO: 464790 - RNA, 21 nt, Human
aguucccauuggcuucuccca

SEQ ID NO: 464791 - RNA, 23 nt, Human
auccugucaccaccaaccucuca

SEQ ID NO: 464792 - RNA, 21 nt, Human
augcagaauggggcuuuagau

SEQ ID NO: 464793 - RNA, 23 nt, Human
auggggcuuuagauaggagcugg

SEQ ID NO: 464794 - RNA, 21 nt, Human
caaaaaaacaaaacccaaaca

SEQ ID NO: 464795 - RNA, 26 nt, Human
caaaaaaacaaaacccaaacaccaug

SEQ ID NO: 464796 - RNA, 21 nt, Human
caaaaacaaaaaacaaaaccc

SEQ ID NO: 464797 - RNA, 27 nt, Human
caaaacccagaaaacaaaacaaaaaac

SEQ ID NO: 464798 - RNA, 28 nt, Human
caaaagaaaguuuacuacacaaaaccag

SEQ ID NO: 464799 - RNA, 22 nt, Human
caagcucuuacucagguacaca

SEQ ID NO: 464800 - RNA, 20 nt, Human
cacaaaaaccaaccaaagaa

SEQ ID NO: 464801 - RNA, 24 nt, Human
cagacaaaaacaaaaaacaaaacc

SEQ ID NO: 464802 - RNA, 20 nt, Human
cagcaaugcuucauuggagg

SEQ ID NO: 464803 - RNA, 21 nt, Human
cagcagaugggcacgugugug

SEQ ID NO: 464804 - RNA, 28 nt, Human
cagccucuuaaacuguucuuccaauuuc

SEQ ID NO: 464805 - RNA, 20 nt, Human
cagcgagaaacagaaaagaa

SEQ ID NO: 464806 - RNA, 22 nt, Human
cagcugcaggucuugcacagac

SEQ ID NO: 464807 - RNA, 22 nt, Human
caguuccucucucucucccucc

SEQ ID NO: 464808 - RNA, 24 nt, Human
caucugccuucccuucucagcuuu

SEQ ID NO: 464809 - RNA, 23 nt, Human
ccaaccacucucucugaagagca

SEQ ID NO: 464810 - RNA, 19 nt, Human
ccaagagucagaaaacauu

SEQ ID NO: 464811 - RNA, 18 nt, Human
ccacacuaacuccauaca

SEQ ID NO: 464812 - RNA, 22 nt, Human
ccagaaaacaaaacaaaaaacc

SEQ ID NO: 464813 - RNA, 21 nt, Human
cccaagagucagaaaacauuc

SEQ ID NO: 464814 - RNA, 26 nt, Human
cccagaaaacaaaacaaaaaaccaca

SEQ ID NO: 464815 - RNA, 21 nt, Human
cccagcaccaccacccacacu

SEQ ID NO: 464816 - RNA, 19 nt, Human
cccgccccaagagucagaa

SEQ ID NO: 464817 - RNA, 23 nt, Human
ccuaccacuagcacagcaauuga

SEQ ID NO: 464818 - RNA, 20 nt, Human
ccucccagaaaauaaacccu

SEQ ID NO: 464819 - RNA, 19 nt, Human
ccugcaaacccaacaugcc

SEQ ID NO: 464820 - RNA, 27 nt, Human
ccugcuaguccagcccagcaccaccac

SEQ ID NO: 464821 - RNA, 19 nt, Human
ccuggccagaggaaggccu

SEQ ID NO: 464822 - RNA, 22 nt, Human
ccugucaccaccaaccucucag

SEQ ID NO: 464823 - RNA, 19 nt, Human
ccuuccucuucagacuguc

SEQ ID NO: 464824 - RNA, 18 nt, Human
ccuugcuacacacugacu

SEQ ID NO: 464825 - RNA, 24 nt, Human
ccuuucaaaaaaacaaaacccaaa

SEQ ID NO: 464826 - RNA, 23 nt, Human
cucaaacacacaaacuggguaaa

SEQ ID NO: 464827 - RNA, 23 nt, Human
cugaaaguggaggcugggagacu

SEQ ID NO: 464828 - RNA, 20 nt, Human
cugcuggagucuccuggcca

SEQ ID NO: 464829 - RNA, 18 nt, Human
cuguucuuccaauuucuc

SEQ ID NO: 464830 - RNA, 19 nt, Human
cuguuucuacacaagaaca

SEQ ID NO: 464831 - RNA, 18 nt, Human
cuugggaagaggagagaa

SEQ ID NO: 464832 - RNA, 22 nt, Human
cuuucaaaaaaacaaaacccaa

SEQ ID NO: 464833 - RNA, 22 nt, Human
cuuuuccaggaaaugacuaaca

SEQ ID NO: 464834 - RNA, 24 nt, Human
gaaaagagggcugccaccugcagg

SEQ ID NO: 464835 - RNA, 26 nt, Human
gacaaaaacaaaaaacaaaacccaga

SEQ ID NO: 464836 - RNA, 18 nt, Human
gacugugugggccagucc

SEQ ID NO: 464837 - RNA, 20 nt, Human
gagcuggguauuacugggag

SEQ ID NO: 464838 - RNA, 21 nt, Human
gaggcagcugggaaagggaac

SEQ ID NO: 464839 - RNA, 22 nt, Human
gccuucauucccagguugccac

SEQ ID NO: 464840 - RNA, 19 nt, Human
gcuugggaagaggagagaa

SEQ ID NO: 464841 - RNA, 21 nt, Human
ggaggcagcugggaaagggaa

SEQ ID NO: 464842 - RNA, 18 nt, Human
ggauggagauggggcagg

SEQ ID NO: 464843 - RNA, 21 nt, Human
ggauggagauggggcaggagg

SEQ ID NO: 464844 - RNA, 21 nt, Human
ggauggagauggggcaggagg

SEQ ID NO: 464845 - RNA, 21 nt, Human
ggcacaaaaaccaaccaaaga

SEQ ID NO: 464846 - RNA, 23 nt, Human
ggcacaaaaaccaaccaaagaaa

SEQ ID NO: 464847 - RNA, 26 nt, Human
ggcaggagggugggaaguagaauggg

SEQ ID NO: 464848 - RNA, 26 nt, Human
ggcuugggaagaggagagaaaggugg

SEQ ID NO: 464849 - RNA, 25 nt, Human
gggaaagggaacuucacagcaaugc

SEQ ID NO: 464850 - RNA, 23 nt, Human
gggagacugcagcugggcagggg

SEQ ID NO: 464851 - RNA, 21 nt, Human
gggcaggggccugggcccucu

SEQ ID NO: 464852 - RNA, 24 nt, Human
ggggacugugugggccaguccugc

SEQ ID NO: 464853 - RNA, 21 nt, Human
gggggggcuccaaccacucuc

SEQ ID NO: 464854 - RNA, 18 nt, Human
gugacaugaacuaacugc

SEQ ID NO: 464855 - RNA, 26 nt, Human
guggaauuuaauaaaggccuugauga

SEQ ID NO: 464856 - RNA, 21 nt, Human
uaacagaaaugcuguccuucu

SEQ ID NO: 464857 - RNA, 19 nt, Human
uaaggcgaggaaucccgcc

SEQ ID NO: 464858 - RNA, 24 nt, Human
uaauaaaggccuugaugaagucag

SEQ ID NO: 464859 - RNA, 20 nt, Human
uaaugacagugacaugaacu

SEQ ID NO: 464860 - RNA, 18 nt, Human
uacacaugaccguggaau

SEQ ID NO: 464861 - RNA, 18 nt, Human
uacacccucuugacagcg

SEQ ID NO: 464862 - RNA, 18 nt, Human
uaccacuagcacagcaau

SEQ ID NO: 464863 - RNA, 20 nt, Human
uaccagagccuucugacagg

SEQ ID NO: 464864 - RNA, 18 nt, Human
ucaccaccaaccucucac

SEQ ID NO: 464865 - RNA, 23 nt, Human
ucagaaaacauuccaaacaccaa

SEQ ID NO: 464866 - RNA, 21 nt, Human
ucagcagcugcaggucuugca

SEQ ID NO: 464867 - RNA, 22 nt, Human
uccacagugaggaugauaaggc

SEQ ID NO: 464868 - RNA, 18 nt, Human
uccauacacucgcacaca

SEQ ID NO: 464869 - RNA, 21 nt, Human
ucccagaaaauaaacccuacc

SEQ ID NO: 464870 - RNA, 18 nt, Human
uccccaaagaggaaaaaa

SEQ ID NO: 464871 - RNA, 25 nt, Human
ucccuccggaaggccccggggggac

SEQ ID NO: 464872 - RNA, 19 nt, Human
uccucgauuggggcucgag

SEQ ID NO: 464873 - RNA, 20 nt, Human
ucuacagcugucuuccagcu

SEQ ID NO: 464874 - RNA, 18 nt, Human
ucugccuucccuucucag

SEQ ID NO: 464875 - RNA, 24 nt, Human
ucuucagacugucuuuugggcccc

SEQ ID NO: 464876 - RNA, 19 nt, Human
ucuuuugggccccaacugc

SEQ ID NO: 464877 - RNA, 19 nt, Human
ugaagucagaaacacccca

SEQ ID NO: 464878 - RNA, 23 nt, Human
ugaauuucacucugaaaguggag

SEQ ID NO: 464879 - RNA, 20 nt, Human
ugagauaaacagcaguuccc

SEQ ID NO: 464880 - RNA, 22 nt, Human
ugagugagauaaacagcaguuc

SEQ ID NO: 464881 - RNA, 23 nt, Human
ugcacacauuaggaauaaaaaca

SEQ ID NO: 464882 - RNA, 25 nt, Human
ugcacagacaaaaacaaaaaacaaa

SEQ ID NO: 464883 - RNA, 28 nt, Human
ugcacagacaaaaacaaaaaacaaaacc

SEQ ID NO: 464884 - RNA, 21 nt, Human
ugcagugacaacuggggcucc

SEQ ID NO: 464885 - RNA, 27 nt, Human
ugcccagacugcagugaccggggguuc

SEQ ID NO: 464886 - RNA, 18 nt, Human
ugcuaguccagcccagca

SEQ ID NO: 464887 - RNA, 21 nt, Human
ugcucaucuuggcuauaagug

SEQ ID NO: 464888 - RNA, 23 nt, Human
ugcucuacagcugucuuccagcu

SEQ ID NO: 464889 - RNA, 24 nt, Human
ugcugugcgacuguaaaauguaca

SEQ ID NO: 464890 - RNA, 19 nt, Human
uggacacagggaaggggcu

SEQ ID NO: 464891 - RNA, 25 nt, Human
uggaggcugggagacugcagcuggg

SEQ ID NO: 464892 - RNA, 22 nt, Human
ugggaaagggaacuucacagca

SEQ ID NO: 464893 - RNA, 19 nt, Human
ugguggaauacuuacaccc

SEQ ID NO: 464894 - RNA, 22 nt, Human
uguaagcauacggggcgggggg

SEQ ID NO: 464895 - RNA, 19 nt, Human
uguacaggaaucaaaaacg

SEQ ID NO: 464896 - RNA, 26 nt, Human
uguguacacaaacauacagacacaca

SEQ ID NO: 464897 - RNA, 23 nt, Human
uguguguacacaaacauacagug

SEQ ID NO: 464898 - RNA, 22 nt, Human
uuauggagccuucauucccagg

SEQ ID NO: 464899 - RNA, 27 nt, Human
uuauuuuccuuucuuucgaccuucagg

SEQ ID NO: 464900 - RNA, 24 nt, Human
uucauauugccauuggguaggggg

SEQ ID NO: 464901 - RNA, 23 nt, Human
uuccacacuaacuccauacacuc

SEQ ID NO: 464902 - RNA, 21 nt, Human
uucuuggggagaugugauguu

SEQ ID NO: 464903 - RNA, 19 nt, Human
uucuuuuuguugcacugcg

SEQ ID NO: 464904 - RNA, 23 nt, Human
uugacagcgagaaacagaaaaga

SEQ ID NO: 464905 - RNA, 19 nt, Human
uugcagcugccugaaugca

SEQ ID NO: 464906 - RNA, 18 nt, Human
uuggaauagcagccucuu

SEQ ID NO: 464907 - RNA, 20 nt, Human
uuuauggagccuucauuccc

SEQ ID NO: 464908 - RNA, 18 nt, Human
uuucaguccucuuuccuc

SEQ ID NO: 464909 - RNA, 24 nt, Human
uuucuacacaagaacauuuucagu

SEQ ID NO: 464910 - RNA, 19 nt, Human
uuugcucuacagcugucuu

SEQ ID NO: 464911 - RNA, 22 nt, Human
uuuuucuuuuuguugcacugcg

SEQ ID NO: 464912 - RNA, 19 nt, Human
uuuuugcagauuaguggag

SEQ ID NO: 464913 - RNA, 21 nt, Human
aaaaaagccaaacauugaggg

SEQ ID NO: 464914 - RNA, 23 nt, Human
aaacaaaaaccagauacccaagg

SEQ ID NO: 464915 - RNA, 25 nt, Human
aaacaaaaaccagauacccaaggaa

SEQ ID NO: 464916 - RNA, 23 nt, Human
aaacaaaacaccacaaaaaucaa

SEQ ID NO: 464917 - RNA, 24 nt, Human
aaacaaaacagaaaacuggagcaa

SEQ ID NO: 464918 - RNA, 19 nt, Human
aaaguggggacccgccccu

SEQ ID NO: 464919 - RNA, 22 nt, Human
aaauaugaaaacaaaaaccaga

SEQ ID NO: 464920 - RNA, 25 nt, Human
aagaaugagaguucuuaaaucuguc

SEQ ID NO: 464921 - RNA, 21 nt, Human
aagcugccucuuguccuaaag

SEQ ID NO: 464922 - RNA, 18 nt, Human
aagucugcaacaucuguu

SEQ ID NO: 464923 - RNA, 23 nt, Human
aauacccaccccuacuggauaac

SEQ ID NO: 464924 - RNA, 23 nt, Human
aaucaaucugugaagaaagcaga

SEQ ID NO: 464925 - RNA, 18 nt, Human
acaaaaaccagauaccca

SEQ ID NO: 464926 - RNA, 25 nt, Human
acaaaacaccacaaaaaucaaccca

SEQ ID NO: 464927 - RNA, 20 nt, Human
acacagcagcaccagcacug

SEQ ID NO: 464928 - RNA, 24 nt, Human
acacaugcacacacucaaauauga

SEQ ID NO: 464929 - RNA, 20 nt, Human
acauggcaaacuggucaccu

SEQ ID NO: 464930 - RNA, 18 nt, Human
acccuuuauauauuacau

SEQ ID NO: 464931 - RNA, 21 nt, Human
accugcagccgcuggcgcucc

SEQ ID NO: 464932 - RNA, 18 nt, Human
acuccaacugccaugaug

SEQ ID NO: 464933 - RNA, 23 nt, Human
acuggccucggcggcugcgguuc

SEQ ID NO: 464934 - RNA, 23 nt, Human
agaaaacuggagcaaacagauga

SEQ ID NO: 464935 - RNA, 19 nt, Human
agaaaggguguccgccugg

SEQ ID NO: 464936 - RNA, 23 nt, Human
agaaauccagacaggguuuagcc

SEQ ID NO: 464937 - RNA, 22 nt, Human
agaacaaaacaaaacagaaaac

SEQ ID NO: 464938 - RNA, 26 nt, Human
agagagcgggugccaggccccccaag

SEQ ID NO: 464939 - RNA, 26 nt, Human
agaggcagagagcgggugccaggccc

SEQ ID NO: 464940 - RNA, 21 nt, Human
agcaccccagccaccucccac

SEQ ID NO: 464941 - RNA, 19 nt, Human
agcauccugacucgagugg

SEQ ID NO: 464942 - RNA, 31 nt, Human
aggaaaaaaaaaauucucuauuaaacaaaaa

SEQ ID NO: 464943 - RNA, 21 nt, Human
aggacaaauaaugaggucaag

SEQ ID NO: 464944 - RNA, 21 nt, Human
aggauaguugcuggccugaaa

SEQ ID NO: 464945 - RNA, 23 nt, Human
aggcaaauaguuuaucacuuccc

SEQ ID NO: 464946 - RNA, 18 nt, Human
aggggaacaggaaaaaaa

SEQ ID NO: 464947 - RNA, 21 nt, Human
aggggaacaggaaaaaaaaaa

SEQ ID NO: 464948 - RNA, 18 nt, Human
agugacucacagaacuca

SEQ ID NO: 464949 - RNA, 18 nt, Human
augaggcugccuugacua

SEQ ID NO: 464950 - RNA, 23 nt, Human
auguuguucaaccuuaauguggg

SEQ ID NO: 464951 - RNA, 23 nt, Human
caaaaaccagauacccaaggaaa

SEQ ID NO: 464952 - RNA, 22 nt, Human
caaaacaaaacagaaaacugga

SEQ ID NO: 464953 - RNA, 18 nt, Human
caaaacaccacaaaaauc

SEQ ID NO: 464954 - RNA, 19 nt, Human
caaaacagaaaacuggagc

SEQ ID NO: 464955 - RNA, 20 nt, Human
caaaacagaaaacuggagca

SEQ ID NO: 464956 - RNA, 26 nt, Human
caaauaccuacacaaacugucaaaua

SEQ ID NO: 464957 - RNA, 23 nt, Human
caacugccaugauggucacaggc

SEQ ID NO: 464958 - RNA, 24 nt, Human
cacaaaaaucaacccaaacuuccu

SEQ ID NO: 464959 - RNA, 21 nt, Human
cacacuagaucacuuugguua

SEQ ID NO: 464960 - RNA, 21 nt, Human
cacagccaguccucacccuuu

SEQ ID NO: 464961 - RNA, 18 nt, Human
caccacaaaaaucaaccc

SEQ ID NO: 464962 - RNA, 19 nt, Human
caccagcacugcugauguc

SEQ ID NO: 464963 - RNA, 18 nt, Human
cacccaccacucccccgg

SEQ ID NO: 464964 - RNA, 19 nt, Human
caccccagccaccucccac

SEQ ID NO: 464965 - RNA, 21 nt, Human
cacucugaaauagcacgcaag

SEQ ID NO: 464966 - RNA, 24 nt, Human
cagcaccccagccaccucccaccc

SEQ ID NO: 464967 - RNA, 18 nt, Human
cagcagcaccagcacugc

SEQ ID NO: 464968 - RNA, 18 nt, Human
cagccaccucccacccca

SEQ ID NO: 464969 - RNA, 22 nt, Human
caugacacugcaaaggucaaau

SEQ ID NO: 464970 - RNA, 21 nt, Human
ccaaaaguugcacacacaagu

SEQ ID NO: 464971 - RNA, 21 nt, Human
ccaauguguccacacccacca

SEQ ID NO: 464972 - RNA, 21 nt, Human
ccacacacagcagcaccagca

SEQ ID NO: 464973 - RNA, 19 nt, Human
ccauaauaaaaaagccaaa

SEQ ID NO: 464974 - RNA, 24 nt, Human
ccauccacaggccuccccacaaga

SEQ ID NO: 464975 - RNA, 18 nt, Human
cccacagugagucgggaa

SEQ ID NO: 464976 - RNA, 24 nt, Human
cccagccaccucccaccccauuaa

SEQ ID NO: 464977 - RNA, 19 nt, Human
cccaggcuaagggguggag

SEQ ID NO: 464978 - RNA, 26 nt, Human
cccauccacaggccuccccacaagag

SEQ ID NO: 464979 - RNA, 24 nt, Human
ccccagcaccccagccaccuccca

SEQ ID NO: 464980 - RNA, 23 nt, Human
cccccauccacaggccuccccac

SEQ ID NO: 464981 - RNA, 22 nt, Human
cccccgggugccguggaagucu

SEQ ID NO: 464982 - RNA, 22 nt, Human
ccgggacagggcaggaugcaca

SEQ ID NO: 464983 - RNA, 20 nt, Human
ccucccaccccauuaaaaaa

SEQ ID NO: 464984 - RNA, 23 nt, Human
ccucccaccccauuaaaaaaguc

SEQ ID NO: 464985 - RNA, 23 nt, Human
ccucggcggcugcgguucccagg

SEQ ID NO: 464986 - RNA, 18 nt, Human
ccugcgguggguucccag

SEQ ID NO: 464987 - RNA, 24 nt, Human
ccuguggacucugcucugaagggc

SEQ ID NO: 464988 - RNA, 23 nt, Human
cgaggcgggcggcggggaagucc

SEQ ID NO: 464989 - RNA, 24 nt, Human
cgcccggcugggcugccugagggc

SEQ ID NO: 464990 - RNA, 20 nt, Human
cgggccgaggcgggcggcgg

SEQ ID NO: 464991 - RNA, 21 nt, Human
cguacacuaagcuuguguaug

SEQ ID NO: 464992 - RNA, 19 nt, Human
cuaagaacaaaacaaaaca

SEQ ID NO: 464993 - RNA, 23 nt, Human
cucaaauaccuacacaaacuguc

SEQ ID NO: 464994 - RNA, 25 nt, Human
cuccccagaugcucuuucuguuuuu

SEQ ID NO: 464995 - RNA, 19 nt, Human
cucccgccgccgcugcacc

SEQ ID NO: 464996 - RNA, 21 nt, Human
cucguacacuaagcuugugua

SEQ ID NO: 464997 - RNA, 18 nt, Human
cucuauacugacgcccuc

SEQ ID NO: 464998 - RNA, 22 nt, Human
cucugaaauagcacgcaagaca

SEQ ID NO: 464999 - RNA, 21 nt, Human
cugagggcggcggcggcugcc

SEQ ID NO: 465000 - RNA, 21 nt, Human
cugaggucuguggccuucccu

SEQ ID NO: 465001 - RNA, 19 nt, Human
cugccuuauccuaaagaca

SEQ ID NO: 465002 - RNA, 18 nt, Human
cuguagcagcgcgcaaac

SEQ ID NO: 465003 - RNA, 24 nt, Human
gaacaaaacaaaacagaaaacugg

SEQ ID NO: 465004 - RNA, 23 nt, Human
gaacugaugugggccacacuccc

SEQ ID NO: 465005 - RNA, 19 nt, Human
gacuugugacagaauccuu

SEQ ID NO: 465006 - RNA, 25 nt, Human
gcaaaggucaaaugucaaaggucaa

SEQ ID NO: 465007 - RNA, 22 nt, Human
gcaaggauaguugcuggccuga

SEQ ID NO: 465008 - RNA, 19 nt, Human
gcagcguguccucugcaaa

SEQ ID NO: 465009 - RNA, 19 nt, Human
gccacacucccagggagcc

SEQ ID NO: 465010 - RNA, 18 nt, Human
gcccaggccccagugcgg

SEQ ID NO: 465011 - RNA, 21 nt, Human
gccuguggacucugcucugaa

SEQ ID NO: 465012 - RNA, 22 nt, Human
gcgcgcaaacccgggacaggga

SEQ ID NO: 465013 - RNA, 18 nt, Human
gcggcggcugccggggag

SEQ ID NO: 465014 - RNA, 23 nt, Human
gcuaaguuuuuuuuuaauuuuuc

SEQ ID NO: 465015 - RNA, 21 nt, Human
gcucugaagggcccuccccau

SEQ ID NO: 465016 - RNA, 23 nt, Human
ggagagauaggacaaauaaugag

SEQ ID NO: 465017 - RNA, 21 nt, Human
ggagcaaggggcugcgagggg

SEQ ID NO: 465018 - RNA, 22 nt, Human
ggccauaauaaaaaagccaaac

SEQ ID NO: 465019 - RNA, 19 nt, Human
ggccuagcuugcuggucag

SEQ ID NO: 465020 - RNA, 18 nt, Human
ggcggcggcggcugccgg

SEQ ID NO: 465021 - RNA, 21 nt, Human
gggaaggaaggccgaggcugg

SEQ ID NO: 465022 - RNA, 24 nt, Human
gguggagcggagagcgugaagcuc

SEQ ID NO: 465023 - RNA, 18 nt, Human
guagcagcgcgcaaaccc

SEQ ID NO: 465024 - RNA, 20 nt, Human
guccacacccaccacucccc

SEQ ID NO: 465025 - RNA, 18 nt, Human
guccuagucuaaaaugcu

SEQ ID NO: 465026 - RNA, 22 nt, Human
uaaaaaaaaagucacaucugcg

SEQ ID NO: 465027 - RNA, 19 nt, Human
uaaaaaagccaaacauuga

SEQ ID NO: 465028 - RNA, 28 nt, Human
uaaaacggacaaacuagaccaauaagug

SEQ ID NO: 465029 - RNA, 18 nt, Human
uaaaaugcuagaauuuaa

SEQ ID NO: 465030 - RNA, 28 nt, Human
uaaacaaaacaccacaaaaaucaaccca

SEQ ID NO: 465031 - RNA, 18 nt, Human
uaaaguggggacccgccc

SEQ ID NO: 465032 - RNA, 21 nt, Human
uaagaacaaaacaaaacagaa

SEQ ID NO: 465033 - RNA, 20 nt, Human
uaagugauuccuguccccca

SEQ ID NO: 465034 - RNA, 23 nt, Human
uacacuaagcuuguguauguagc

SEQ ID NO: 465035 - RNA, 18 nt, Human
uacacucguacacuaagc

SEQ ID NO: 465036 - RNA, 19 nt, Human
uagaacaguccuagucuaa

SEQ ID NO: 465037 - RNA, 21 nt, Human
uagagcauccugacucgagug

SEQ ID NO: 465038 - RNA, 27 nt, Human
uagaucccaagagaaauccagacaggg

SEQ ID NO: 465039 - RNA, 22 nt, Human
uaguucaaauccccccauccac

SEQ ID NO: 465040 - RNA, 22 nt, Human
ucaaauccccccauccacaggc

SEQ ID NO: 465041 - RNA, 24 nt, Human
ucaacccaaacuuccuucaacccc

SEQ ID NO: 465042 - RNA, 24 nt, Human
ucacaaagagcuccagaaggcaaa

SEQ ID NO: 465043 - RNA, 24 nt, Human
ucaguaucacaugggcagugaacu

SEQ ID NO: 465044 - RNA, 28 nt, Human
ucauuaaagucaugcacacaugcacaca

SEQ ID NO: 465045 - RNA, 24 nt, Human
uccaaaaaaccugucuuucagccg

SEQ ID NO: 465046 - RNA, 18 nt, Human
uccacacacagcagcacc

SEQ ID NO: 465047 - RNA, 19 nt, Human
uccacacacagcagcacca

SEQ ID NO: 465048 - RNA, 20 nt, Human
uccacacacagcagcaccag

SEQ ID NO: 465049 - RNA, 18 nt, Human
uccccccauccacaggcc

SEQ ID NO: 465050 - RNA, 23 nt, Human
uccucugcaaagugcagguguuc

SEQ ID NO: 465051 - RNA, 20 nt, Human
ucuagaccugagcagggaga

SEQ ID NO: 465052 - RNA, 19 nt, Human
ucucugccuuauccuaaag

SEQ ID NO: 465053 - RNA, 20 nt, Human
ucucuuagcagugacucaca

SEQ ID NO: 465054 - RNA, 24 nt, Human
ucugcaacaucuguuucucugccu

SEQ ID NO: 465055 - RNA, 24 nt, Human
ucugggggugggugggaaaggaag

SEQ ID NO: 465056 - RNA, 26 nt, Human
ucuguagcagcgcgcaaacccgggac

SEQ ID NO: 465057 - RNA, 18 nt, Human
ucuguuuuucugggggug

SEQ ID NO: 465058 - RNA, 19 nt, Human
ucuuaaaucugucagacca

SEQ ID NO: 465059 - RNA, 18 nt, Human
ugaaauagcacgcaagac

SEQ ID NO: 465060 - RNA, 18 nt, Human
ugaagaaagcagaaagga

SEQ ID NO: 465061 - RNA, 24 nt, Human
ugacagauuguggagugggaagaa

SEQ ID NO: 465062 - RNA, 21 nt, Human
ugacugugaccacuaagaaca

SEQ ID NO: 465063 - RNA, 24 nt, Human
ugagggcggcggcggcugccgggg

SEQ ID NO: 465064 - RNA, 24 nt, Human
ugaguagugaacugaagaauuagg

SEQ ID NO: 465065 - RNA, 18 nt, Human
ugcauggugcauggacag

SEQ ID NO: 465066 - RNA, 20 nt, Human
ugcggcucacaguguucacc

SEQ ID NO: 465067 - RNA, 20 nt, Human
uggagcggagagcgugaagc

SEQ ID NO: 465068 - RNA, 20 nt, Human
ugggaaucaguaucacauga

SEQ ID NO: 465069 - RNA, 24 nt, Human
ugggcagugaacugaagaauuagg

SEQ ID NO: 465070 - RNA, 19 nt, Human
ugggcugccugagggcggc

SEQ ID NO: 465071 - RNA, 19 nt, Human
ugggggugggugggaaagg

SEQ ID NO: 465072 - RNA, 21 nt, Human
ugggggugggugggaaaggaa

SEQ ID NO: 465073 - RNA, 22 nt, Human
ugggggugggugggaaaggaag

SEQ ID NO: 465074 - RNA, 18 nt, Human
ugguaugggaugccuggg

SEQ ID NO: 465075 - RNA, 24 nt, Human
ugguaugggaugccugggaggguu

SEQ ID NO: 465076 - RNA, 25 nt, Human
ugguaugggaugccugggaggguuu

SEQ ID NO: 465077 - RNA, 23 nt, Human
ugugaagaaagcagaaaggacuc

SEQ ID NO: 465078 - RNA, 22 nt, Human
ugugaccacuaagaacaaaaca

SEQ ID NO: 465079 - RNA, 21 nt, Human
uguggcaaucaguaucacaug

SEQ ID NO: 465080 - RNA, 23 nt, Human
uguggcaaucaguaucacauggg

SEQ ID NO: 465081 - RNA, 18 nt, Human
ugugggccacacucccag

SEQ ID NO: 465082 - RNA, 21 nt, Human
uguucucagagcuccugcagc

SEQ ID NO: 465083 - RNA, 19 nt, Human
uguugaacugaugugggcc

SEQ ID NO: 465084 - RNA, 19 nt, Human
uuccauggucaaaaauaug

SEQ ID NO: 465085 - RNA, 22 nt, Human
uucccaggcuaagggguggagc

SEQ ID NO: 465086 - RNA, 22 nt, Human
uuucugggggugggugggaaag

SEQ ID NO: 465087 - RNA, 19 nt, Human
uuucuuguucucagagcuc

SEQ ID NO: 465088 - RNA, 22 nt, Human
uuugagaaaggguguccgccug

SEQ ID NO: 465089 - RNA, 21 nt, Human
aaaaaagagaaauaacaguaa

SEQ ID NO: 465090 - RNA, 23 nt, Human
aaaaaagagaaauaacaguaaag

SEQ ID NO: 465091 - RNA, 21 nt, Human
aaacagaagugggugacaagg

SEQ ID NO: 465092 - RNA, 18 nt, Human
aaacauugagaaaagaca

SEQ ID NO: 465093 - RNA, 25 nt, Human
aacaaaaguggaauaacugggucua

SEQ ID NO: 465094 - RNA, 22 nt, Human
aaucuuuaccccaaacuuuaaa

SEQ ID NO: 465095 - RNA, 19 nt, Human
acauuaacaaaaguggaau

SEQ ID NO: 465096 - RNA, 20 nt, Human
accacauuuguaaacaaagu

SEQ ID NO: 465097 - RNA, 24 nt, Human
acuguaauuaaacugucucuagau

SEQ ID NO: 465098 - RNA, 25 nt, Human
agaagugggugacaagguacauaua

SEQ ID NO: 465099 - RNA, 20 nt, Human
agcaagaaacaaagagacaa

SEQ ID NO: 465100 - RNA, 20 nt, Human
agcugcaguggccaaaaggc

SEQ ID NO: 465101 - RNA, 20 nt, Human
agguaacaugucucuggucc

SEQ ID NO: 465102 - RNA, 24 nt, Human
auacagcaguguugacaaguuaug

SEQ ID NO: 465103 - RNA, 21 nt, Human
augugauaagaaugaaaagga

SEQ ID NO: 465104 - RNA, 20 nt, Human
caaaaaagagaaauaacagu

SEQ ID NO: 465105 - RNA, 23 nt, Human
caaaaggcacuggggagagcuga

SEQ ID NO: 465106 - RNA, 24 nt, Human
caacccuauuucugagauaaaaga

SEQ ID NO: 465107 - RNA, 18 nt, Human
caagcuaugauaugugau

SEQ ID NO: 465108 - RNA, 21 nt, Human
caguggcagcaagaaacaaag

SEQ ID NO: 465109 - RNA, 26 nt, Human
ccagggaugacaaacuauggcaccac

SEQ ID NO: 465110 - RNA, 23 nt, Human
ccaucugaauacauccuaggcau

SEQ ID NO: 465111 - RNA, 19 nt, Human
ccgcgcccggccagaagca

SEQ ID NO: 465112 - RNA, 24 nt, Human
ccuaaaauaguuacuuucuggccc

SEQ ID NO: 465113 - RNA, 23 nt, Human
ccuauauuuuuuaagaaggagaa

SEQ ID NO: 465114 - RNA, 21 nt, Human
ccucacuauguacgucaaccc

SEQ ID NO: 465115 - RNA, 20 nt, Human
ccuccuaucccacuauaacc

SEQ ID NO: 465116 - RNA, 20 nt, Human
cgcccggccagaagcagcgg

SEQ ID NO: 465117 - RNA, 20 nt, Human
cuggaacaaagccacgcccg

SEQ ID NO: 465118 - RNA, 26 nt, Human
cuguggguuccgcuuccccgaggcuc

SEQ ID NO: 465119 - RNA, 23 nt, Human
gaaaagacaaagucauccauuuu

SEQ ID NO: 465120 - RNA, 23 nt, Human
gagcuggcaguggcagcaagaaa

SEQ ID NO: 465121 - RNA, 18 nt, Human
gaugacaaaagcagcaca

SEQ ID NO: 465122 - RNA, 19 nt, Human
gcccggccagaagcagcgg

SEQ ID NO: 465123 - RNA, 19 nt, Human
ggcagucucaacaaugagc

SEQ ID NO: 465124 - RNA, 20 nt, Human
guaagagaaagaaauggcag

SEQ ID NO: 465125 - RNA, 22 nt, Human
gugcuucauacagcaguguuga

SEQ ID NO: 465126 - RNA, 20 nt, Human
uaaaacaagcaucaggaaac

SEQ ID NO: 465127 - RNA, 21 nt, Human
uaaaacaagcaucaggaaaca

SEQ ID NO: 465128 - RNA, 19 nt, Human
uaacaaaaguggaauaacu

SEQ ID NO: 465129 - RNA, 18 nt, Human
uaagagaaagaaauggca

SEQ ID NO: 465130 - RNA, 18 nt, Human
uaagguaauauuuucaug

SEQ ID NO: 465131 - RNA, 24 nt, Human
uacaaauaaaaacauugagaaaag

SEQ ID NO: 465132 - RNA, 26 nt, Human
uaccccaaacuuuaaagugguuuaua

SEQ ID NO: 465133 - RNA, 24 nt, Human
uacucuucagaaugaaaaccuuau

SEQ ID NO: 465134 - RNA, 24 nt, Human
uacuggaacaaagccacgcccgua

SEQ ID NO: 465135 - RNA, 21 nt, Human
uagguaacaugucucuggucc

SEQ ID NO: 465136 - RNA, 21 nt, Human
ucccacuauaaccaguuagua

SEQ ID NO: 465137 - RNA, 19 nt, Human
uccuagacccagggaugac

SEQ ID NO: 465138 - RNA, 21 nt, Human
ucuacgguagcugcaguggcc

SEQ ID NO: 465139 - RNA, 18 nt, Human
ucucuagauaacaaaguu

SEQ ID NO: 465140 - RNA, 18 nt, Human
ucucuggucccuguuacu

SEQ ID NO: 465141 - RNA, 21 nt, Human
ugaauaaaacaagcaucagga

SEQ ID NO: 465142 - RNA, 20 nt, Human
ugaguaagagaaagaaaugg

SEQ ID NO: 465143 - RNA, 27 nt, Human
ugauaagaaugaaaaggauagcccaga

SEQ ID NO: 465144 - RNA, 18 nt, Human
ugaugggucucaaaucca

SEQ ID NO: 465145 - RNA, 20 nt, Human
ugaugggucucaaauccaau

SEQ ID NO: 465146 - RNA, 22 nt, Human
uggaauaacugggucuaauuaa

SEQ ID NO: 465147 - RNA, 24 nt, Human
uggaugaacauauuuugaguuuug

SEQ ID NO: 465148 - RNA, 24 nt, Human
uggcaccacauuuguaaacaaagu

SEQ ID NO: 465149 - RNA, 21 nt, Human
uggcagucucaacaaugagcu

SEQ ID NO: 465150 - RNA, 20 nt, Human
uggggaaguuuuacucuuca

SEQ ID NO: 465151 - RNA, 26 nt, Human
uguaaacaaaguuuuacuggaacaaa

SEQ ID NO: 465152 - RNA, 21 nt, Human
uguauugucuauggcugcuuu

SEQ ID NO: 465153 - RNA, 22 nt, Human
uugagugugggaugacaaaagc

SEQ ID NO: 465154 - RNA, 20 nt, Human
aagaggaugcugggggcugc

SEQ ID NO: 465155 - RNA, 21 nt, Human
aauuuauugaaggcuuacaua

SEQ ID NO: 465156 - RNA, 23 nt, Human
acaagaauuuguuuuccuccucc

SEQ ID NO: 465157 - RNA, 19 nt, Human
accccacucgcucuagagc

SEQ ID NO: 465158 - RNA, 25 nt, Human
accccagagguaggagggaaaggga

SEQ ID NO: 465159 - RNA, 20 nt, Human
acugaaauuuauugaaggcu

SEQ ID NO: 465160 - RNA, 20 nt, Human
acuuugggggguauacagca

SEQ ID NO: 465161 - RNA, 18 nt, Human
agaagcucucccagaccg

SEQ ID NO: 465162 - RNA, 18 nt, Human
agaccagagcagcagagg

SEQ ID NO: 465163 - RNA, 22 nt, Human
agagaccccagagguaggaggg

SEQ ID NO: 465164 - RNA, 22 nt, Human
agcaagagaccccagagguagg

SEQ ID NO: 465165 - RNA, 23 nt, Human
agcacaggacagaagcucuccca

SEQ ID NO: 465166 - RNA, 25 nt, Human
agcagcagaggcaagcagcaagaga

SEQ ID NO: 465167 - RNA, 18 nt, Human
agcuggugccuguggcug

SEQ ID NO: 465168 - RNA, 21 nt, Human
agcuggugccuguggcuggau

SEQ ID NO: 465169 - RNA, 23 nt, Human
aggcaagcagcaagagaccccag

SEQ ID NO: 465170 - RNA, 25 nt, Human
aggcaagcagcaagagaccccagag

SEQ ID NO: 465171 - RNA, 19 nt, Human
agggaaagggacacuuugg

SEQ ID NO: 465172 - RNA, 27 nt, Human
agggguggggaggguaaaagcgggaag

SEQ ID NO: 465173 - RNA, 19 nt, Human
auacccaugcagcacagga

SEQ ID NO: 465174 - RNA, 20 nt, Human
auccggggccgccugguggg

SEQ ID NO: 465175 - RNA, 20 nt, Human
auuuauugaaggcuuacaua

SEQ ID NO: 465176 - RNA, 24 nt, Human
cacaggacagaagcucucccagac

SEQ ID NO: 465177 - RNA, 25 nt, Human
caccccacucgcucuagagcccacc

SEQ ID NO: 465178 - RNA, 20 nt, Human
cacccuguacuuaaacaccu

SEQ ID NO: 465179 - RNA, 20 nt, Human
cacucucauucugaggggga

SEQ ID NO: 465180 - RNA, 21 nt, Human
cacucucauucugagggggac

SEQ ID NO: 465181 - RNA, 22 nt, Human
cacuugggagcaucucagaggc

SEQ ID NO: 465182 - RNA, 20 nt, Human
cagaccagagcagcagaggc

SEQ ID NO: 465183 - RNA, 24 nt, Human
cagagcagcagaggcaagcagcaa

SEQ ID NO: 465184 - RNA, 22 nt, Human
cagagcugagaggccaccuaga

SEQ ID NO: 465185 - RNA, 23 nt, Human
cagaggcaagcagcaagagaccc

SEQ ID NO: 465186 - RNA, 19 nt, Human
cagaggcccccaaggcccc

SEQ ID NO: 465187 - RNA, 23 nt, Human
cagcacaggacagaagcucuccc

SEQ ID NO: 465188 - RNA, 18 nt, Human
cagcagguuucuuuuugu

SEQ ID NO: 465189 - RNA, 19 nt, Human
cagcagguuucuuuuugug

SEQ ID NO: 465190 - RNA, 22 nt, Human
cagcuggugccuguggcuggaa

SEQ ID NO: 465191 - RNA, 21 nt, Human
ccagaccagagcagcagaggc

SEQ ID NO: 465192 - RNA, 18 nt, Human
ccagagguaggagggaaa

SEQ ID NO: 465193 - RNA, 23 nt, Human
ccagcuggugccuguggcuggaa

SEQ ID NO: 465194 - RNA, 22 nt, Human
cccagaccagagcagcagaggc

SEQ ID NO: 465195 - RNA, 21 nt, Human
ccccaccacgcuccgcucccc

SEQ ID NO: 465196 - RNA, 22 nt, Human
ccccaccacgcuccgcuccccg

SEQ ID NO: 465197 - RNA, 24 nt, Human
ccccuccccaccacgcuccgcucc

SEQ ID NO: 465198 - RNA, 23 nt, Human
ccccuggcuggguccccuggggc

SEQ ID NO: 465199 - RNA, 20 nt, Human
cccguccuuucuccucucca

SEQ ID NO: 465200 - RNA, 20 nt, Human
cccuagggaagaggggcacc

SEQ ID NO: 465201 - RNA, 19 nt, Human
cccucccuggcacuuggga

SEQ ID NO: 465202 - RNA, 19 nt, Human
cccuggggcauggccgagg

SEQ ID NO: 465203 - RNA, 18 nt, Human
cccuugcaaaucagaaag

SEQ ID NO: 465204 - RNA, 22 nt, Human
ccgcugucuccugugucgccug

SEQ ID NO: 465205 - RNA, 18 nt, Human
ccggggccgccugguggg

SEQ ID NO: 465206 - RNA, 18 nt, Human
ccucgcucggcccucccu

SEQ ID NO: 465207 - RNA, 24 nt, Human
cgccgcugucuccugugucgccug

SEQ ID NO: 465208 - RNA, 20 nt, Human
cgggaaggauggaaauaagu

SEQ ID NO: 465209 - RNA, 23 nt, Human
cgucacccuguacuuaaacaccu

SEQ ID NO: 465210 - RNA, 21 nt, Human
cgucacggagggaccgcggag

SEQ ID NO: 465211 - RNA, 22 nt, Human
cugaaauuuauugaaggcuuac

SEQ ID NO: 465212 - RNA, 24 nt, Human
cugggggcugcuggucccaaccag

SEQ ID NO: 465213 - RNA, 25 nt, Human
cugucccgcuccccuccccaccacg

SEQ ID NO: 465214 - RNA, 22 nt, Human
cuuugggggguauacagcaggu

SEQ ID NO: 465215 - RNA, 21 nt, Human
gaagcucucccaguccagagc

SEQ ID NO: 465216 - RNA, 21 nt, Human
gagcaucucagaggcgcccaa

SEQ ID NO: 465217 - RNA, 21 nt, Human
gaggcaagcagcaagagaccc

SEQ ID NO: 465218 - RNA, 23 nt, Human
gcaagcagcaagagaccccagag

SEQ ID NO: 465219 - RNA, 25 nt, Human
gccccguccuuucuccucuccaccc

SEQ ID NO: 465220 - RNA, 18 nt, Human
gccgcggcgccgcugucu

SEQ ID NO: 465221 - RNA, 24 nt, Human
gcgacgaugaggacgcgggggcac

SEQ ID NO: 465222 - RNA, 22 nt, Human
gcugcuggucccaaccagcugg

SEQ ID NO: 465223 - RNA, 19 nt, Human
ggaaggauggaaauaaguc

SEQ ID NO: 465224 - RNA, 19 nt, Human
ggagcccagggacgggugg

SEQ ID NO: 465225 - RNA, 26 nt, Human
ggagcccagggagggguggggagggu

SEQ ID NO: 465226 - RNA, 20 nt, Human
ggagggguggggaggguaaa

SEQ ID NO: 465227 - RNA, 21 nt, Human
ggagggguggggaggguaaaa

SEQ ID NO: 465228 - RNA, 23 nt, Human
ggccccguccuuucuccucucca

SEQ ID NO: 465229 - RNA, 21 nt, Human
ggcggcggccuggagcccagg

SEQ ID NO: 465230 - RNA, 21 nt, Human
gggagggguggggaggguaaa

SEQ ID NO: 465231 - RNA, 24 nt, Human
gggcugcuggucccaaccagcugg

SEQ ID NO: 465232 - RNA, 26 nt, Human
gggggcugcuggucccaaccagcugg

SEQ ID NO: 465233 - RNA, 20 nt, Human
gggguggggaggguaaaagc

SEQ ID NO: 465234 - RNA, 20 nt, Human
ggucccaaccagcuggugcc

SEQ ID NO: 465235 - RNA, 23 nt, Human
ggucccaaccagcuggugccugu

SEQ ID NO: 465236 - RNA, 20 nt, Human
gucacggagggaccgcggag

SEQ ID NO: 465237 - RNA, 19 nt, Human
gucccgcuccccuccccac

SEQ ID NO: 465238 - RNA, 19 nt, Human
guccuuucuccucuccacc

SEQ ID NO: 465239 - RNA, 20 nt, Human
ucagaaagagccacucucau

SEQ ID NO: 465240 - RNA, 21 nt, Human
ucccccacagucuaaauaccc

SEQ ID NO: 465241 - RNA, 18 nt, Human
ucccgcuccccuccccac

SEQ ID NO: 465242 - RNA, 24 nt, Human
ucccuccccaccacgggcacugga

SEQ ID NO: 465243 - RNA, 18 nt, Human
uccugugucgccuguccc

SEQ ID NO: 465244 - RNA, 18 nt, Human
ucggugugcccucagggc

SEQ ID NO: 465245 - RNA, 21 nt, Human
ucucagaggcccccaaggccc

SEQ ID NO: 465246 - RNA, 22 nt, Human
ucucagaggcccccaaggcccc

SEQ ID NO: 465247 - RNA, 19 nt, Human
ugaggagggggcggcggcc

SEQ ID NO: 465248 - RNA, 21 nt, Human
ugcagcuagagguggcagagc

SEQ ID NO: 465249 - RNA, 22 nt, Human
ugcccggggcgacgaugaggac

SEQ ID NO: 465250 - RNA, 21 nt, Human
ugccugccuuaccaccccauu

SEQ ID NO: 465251 - RNA, 24 nt, Human
ugcugggggcugcuggucccaacc

SEQ ID NO: 465252 - RNA, 18 nt, Human
ugcuggucccaaccagcu

SEQ ID NO: 465253 - RNA, 24 nt, Human
uggaaauaagucuagagaagaggg

SEQ ID NO: 465254 - RNA, 19 nt, Human
uggcagagcugagaggcca

SEQ ID NO: 465255 - RNA, 25 nt, Human
uggggaggguaaaagcgggaaggau

SEQ ID NO: 465256 - RNA, 22 nt, Human
ugucccgcuccccuccccacca

SEQ ID NO: 465257 - RNA, 21 nt, Human
uguuuuccuccuccagugcua

SEQ ID NO: 465258 - RNA, 22 nt, Human
uuaagagcuuuacaaacauucu

SEQ ID NO: 465259 - RNA, 18 nt, Human
uugccugcgccucgcucg

SEQ ID NO: 465260 - RNA, 18 nt, Human
uuggacucuucgugccug

SEQ ID NO: 465261 - RNA, 19 nt, Human
aaacacaaagaaaauccac

SEQ ID NO: 465262 - RNA, 22 nt, Human
aagaacccaaaaccccgaagcc

SEQ ID NO: 465263 - RNA, 18 nt, Human
aagccgggcccgcgugca

SEQ ID NO: 465264 - RNA, 20 nt, Human
accccgaagccgggcccgcg

SEQ ID NO: 465265 - RNA, 23 nt, Human
agaacccaaaaccccgaagccgg

SEQ ID NO: 465266 - RNA, 23 nt, Human
aggcggcggcgcgcggccagcuc

SEQ ID NO: 465267 - RNA, 21 nt, Human
agucucauucggucagcuuca

SEQ ID NO: 465268 - RNA, 21 nt, Human
caaaaccccgaagccgggccc

SEQ ID NO: 465269 - RNA, 20 nt, Human
caccuugcugcugaguuggu

SEQ ID NO: 465270 - RNA, 23 nt, Human
cagggacauuuuuuuucuuuaaa

SEQ ID NO: 465271 - RNA, 23 nt, Human
cccaaaaccccgaagccgggccc

SEQ ID NO: 465272 - RNA, 19 nt, Human
cccacaguguguccggggc

SEQ ID NO: 465273 - RNA, 19 nt, Human
ccccccgccccuguccucc

SEQ ID NO: 465274 - RNA, 20 nt, Human
cccccgccccuguccuccuc

SEQ ID NO: 465275 - RNA, 22 nt, Human
cccccgccccuguccuccucgu

SEQ ID NO: 465276 - RNA, 23 nt, Human
ccccgccgcuuggaguaagaacc

SEQ ID NO: 465277 - RNA, 18 nt, Human
ccucccuccuccucuucu

SEQ ID NO: 465278 - RNA, 20 nt, Human
cgggggggcugaagguggca

SEQ ID NO: 465279 - RNA, 26 nt, Human
cuccaguaacugagcgcgggguaccc

SEQ ID NO: 465280 - RNA, 23 nt, Human
cucccuccuccucuucuuccucc

SEQ ID NO: 465281 - RNA, 23 nt, Human
cuccuccuccccacagugugucc

SEQ ID NO: 465282 - RNA, 19 nt, Human
cuccuccucuucuuccucc

SEQ ID NO: 465283 - RNA, 20 nt, Human
cugaagguggcaagccuccc

SEQ ID NO: 465284 - RNA, 23 nt, Human
cugcugaguuggucaagaugugu

SEQ ID NO: 465285 - RNA, 20 nt, Human
gaguaagaacccaaaacccc

SEQ ID NO: 465286 - RNA, 18 nt, Human
ggaggcggcggcgcgcgg

SEQ ID NO: 465287 - RNA, 23 nt, Human
ggcguucgcgggggggcugaagg

SEQ ID NO: 465288 - RNA, 20 nt, Human
ggcucccccuccuccccgcc

SEQ ID NO: 465289 - RNA, 19 nt, Human
gucuuuuuucuuccucccu

SEQ ID NO: 465290 - RNA, 20 nt, Human
gucuuuuuucuuccucccuu

SEQ ID NO: 465291 - RNA, 24 nt, Human
uaaacacaaagaaaauccaccuug

SEQ ID NO: 465292 - RNA, 23 nt, Human
uaagaacccaaaaccccgaagcc

SEQ ID NO: 465293 - RNA, 24 nt, Human
uaagaacccaaaaccccgaagccg

SEQ ID NO: 465294 - RNA, 23 nt, Human
uccccgccgcuuggaguaagaac

SEQ ID NO: 465295 - RNA, 19 nt, Human
uccucccuccuccucuucu

SEQ ID NO: 465296 - RNA, 18 nt, Human
uccuccucuucuuccucc

SEQ ID NO: 465297 - RNA, 20 nt, Human
ucgcgggggggcugaaggug

SEQ ID NO: 465298 - RNA, 22 nt, Human
ucuucuuccuccuccucccccc

SEQ ID NO: 465299 - RNA, 24 nt, Human
ucuuuuuucuuccucccuccuccu

SEQ ID NO: 465300 - RNA, 19 nt, Human
uggaguaagaacccaaaac

SEQ ID NO: 465301 - RNA, 20 nt, Human
uggaguaagaacccaaaacc

SEQ ID NO: 465302 - RNA, 21 nt, Human
uggcaagccucccgccccccg

SEQ ID NO: 465303 - RNA, 20 nt, Human
ugugaaagaagcagcggccg

SEQ ID NO: 465304 - RNA, 21 nt, Human
uuuuuucuuccucccuccucc

SEQ ID NO: 465305 - RNA, 18 nt, Human
aaaaaaaaaaaaaacaac

SEQ ID NO: 465306 - RNA, 23 nt, Human
aaaaaaaaaaaaaacaacuaaug

SEQ ID NO: 465307 - RNA, 23 nt, Human
aaaaaaaaaaaacaacuaaugcc

SEQ ID NO: 465308 - RNA, 26 nt, Human
aaacaaaaacaaaaaccaugauucaa

SEQ ID NO: 465309 - RNA, 21 nt, Human
aaacaaaaaccaugauucaac

SEQ ID NO: 465310 - RNA, 20 nt, Human
aaacaauaaaauccaacaac

SEQ ID NO: 465311 - RNA, 19 nt, Human
aaaccaaaaaaaaaagggg

SEQ ID NO: 465312 - RNA, 20 nt, Human
aacaaauucaggcaaguuua

SEQ ID NO: 465313 - RNA, 18 nt, Human
aagaagaaaaaagaaaaa

SEQ ID NO: 465314 - RNA, 20 nt, Human
aagcuggcuuuuccaaugug

SEQ ID NO: 465315 - RNA, 21 nt, Human
aaucaagucaucuugaucauu

SEQ ID NO: 465316 - RNA, 22 nt, Human
aaugaaaggcaacaccucccuc

SEQ ID NO: 465317 - RNA, 22 nt, Human
aauuaaaagccaauaagggucu

SEQ ID NO: 465318 - RNA, 22 nt, Human
aauucuuucacacuuaaaacuu

SEQ ID NO: 465319 - RNA, 21 nt, Human
acaaaauaucccauaccaaac

SEQ ID NO: 465320 - RNA, 25 nt, Human
acaacaaaccaaaaaaaaaaggggg

SEQ ID NO: 465321 - RNA, 18 nt, Human
acaacaacaacaaaccaa

SEQ ID NO: 465322 - RNA, 24 nt, Human
accguguuuuaggaaaaaguuuug

SEQ ID NO: 465323 - RNA, 20 nt, Human
accugggaucuaaacauacu

SEQ ID NO: 465324 - RNA, 25 nt, Human
acuaaaaaaaaaaaaaaacaacuaa

SEQ ID NO: 465325 - RNA, 21 nt, Human
acuacaacaacaacaaaccaa

SEQ ID NO: 465326 - RNA, 19 nt, Human
acucuuuuuggaagccuau

SEQ ID NO: 465327 - RNA, 20 nt, Human
acuuaugcugagcuuucuuc

SEQ ID NO: 465328 - RNA, 23 nt, Human
agaaaaagggagacguauaaugc

SEQ ID NO: 465329 - RNA, 21 nt, Human
agaaaguguacaauuuuucuu

SEQ ID NO: 465330 - RNA, 28 nt, Human
agacagaaaaauggaacaaaagggaccc

SEQ ID NO: 465331 - RNA, 21 nt, Human
agcauaaucagaaugccacaa

SEQ ID NO: 465332 - RNA, 20 nt, Human
agcuggcuuuuccaaugugu

SEQ ID NO: 465333 - RNA, 20 nt, Human
aggaagagaguggcaguaag

SEQ ID NO: 465334 - RNA, 20 nt, Human
aggcaacaccucccucuaau

SEQ ID NO: 465335 - RNA, 19 nt, Human
aggggggggggguggaagu

SEQ ID NO: 465336 - RNA, 19 nt, Human
agguauaauuaaaagccaa

SEQ ID NO: 465337 - RNA, 23 nt, Human
agguggccgacaccaggcagaac

SEQ ID NO: 465338 - RNA, 23 nt, Human
agguuccauuucagaguagucac

SEQ ID NO: 465339 - RNA, 25 nt, Human
auacuauucuuuuuccccuccccaa

SEQ ID NO: 465340 - RNA, 24 nt, Human
auauacaggauuauauacauuuug

SEQ ID NO: 465341 - RNA, 25 nt, Human
auggaacaaaauguauauagcuguu

SEQ ID NO: 465342 - RNA, 20 nt, Human
auuauacucuuuuuggaagc

SEQ ID NO: 465343 - RNA, 24 nt, Human
auugcaaauaagggcauaucauuu

SEQ ID NO: 465344 - RNA, 20 nt, Human
caaaaccaagaaaggcgagc

SEQ ID NO: 465345 - RNA, 21 nt, Human
caaaagagccucuaaccccca

SEQ ID NO: 465346 - RNA, 20 nt, Human
caaaauaucccauaccaaac

SEQ ID NO: 465347 - RNA, 23 nt, Human
caacagaaaaugugacagauucc

SEQ ID NO: 465348 - RNA, 20 nt, Human
caacauuuaacugagguaga

SEQ ID NO: 465349 - RNA, 20 nt, Human
caacuuuagaaaccuaaguu

SEQ ID NO: 465350 - RNA, 18 nt, Human
cacacuuaaaacuuuaug

SEQ ID NO: 465351 - RNA, 21 nt, Human
caccucccucuaauggccaaa

SEQ ID NO: 465352 - RNA, 23 nt, Human
caucugcucauuuucuccaagcc

SEQ ID NO: 465353 - RNA, 18 nt, Human
cauggcucuguaagacag

SEQ ID NO: 465354 - RNA, 21 nt, Human
cccaaaagagccucuaacccc

SEQ ID NO: 465355 - RNA, 21 nt, Human
cccauaccaaacauaucuagu

SEQ ID NO: 465356 - RNA, 27 nt, Human
ccccacuccacuacuaaaaggucggac

SEQ ID NO: 465357 - RNA, 26 nt, Human
ccccacuccacuacuaaaaggucggc

SEQ ID NO: 465358 - RNA, 20 nt, Human
ccccgccguccacacggagg

SEQ ID NO: 465359 - RNA, 22 nt, Human
ccccgccguccacacggaggug

SEQ ID NO: 465360 - RNA, 21 nt, Human
ccuacaaggauauaaugcuag

SEQ ID NO: 465361 - RNA, 19 nt, Human
cgacaccaggcagaacgcg

SEQ ID NO: 465362 - RNA, 18 nt, Human
cgagccuuguggcucaaa

SEQ ID NO: 465363 - RNA, 26 nt, Human
cgucaaugaaaggcaacaccucccuc

SEQ ID NO: 465364 - RNA, 25 nt, Human
cuaaaaaaaaaaaaaaacaacuaau

SEQ ID NO: 465365 - RNA, 22 nt, Human
cuaaaaaacaaaacacuaaaaa

SEQ ID NO: 465366 - RNA, 18 nt, Human
cuaaaaauauccauuuug

SEQ ID NO: 465367 - RNA, 19 nt, Human
cuaacccccaaaaccaaga

SEQ ID NO: 465368 - RNA, 23 nt, Human
cuacaacaacaacaaaccaaaaa

SEQ ID NO: 465369 - RNA, 20 nt, Human
cucaguaaucuuucccuggc

SEQ ID NO: 465370 - RNA, 22 nt, Human
cucccuuacuccauuuuucaga

SEQ ID NO: 465371 - RNA, 22 nt, Human
cugcuguuuuuaacagcuccaa

SEQ ID NO: 465372 - RNA, 24 nt, Human
cuguaagacagaaaaauggaacaa

SEQ ID NO: 465373 - RNA, 22 nt, Human
cuuaacaagugaacaauuugcu

SEQ ID NO: 465374 - RNA, 24 nt, Human
cuucccaaaagagccucuaacccc

SEQ ID NO: 465375 - RNA, 20 nt, Human
cuugccuaacaaaauauccc

SEQ ID NO: 465376 - RNA, 23 nt, Human
gagccucuaacccccaaaaccaa

SEQ ID NO: 465377 - RNA, 21 nt, Human
gagguggccgacaccaggcag

SEQ ID NO: 465378 - RNA, 19 nt, Human
gcagcuuugcaauuaaaau

SEQ ID NO: 465379 - RNA, 21 nt, Human
gccgacaccaggcagaacgcg

SEQ ID NO: 465380 - RNA, 22 nt, Human
ggccugagguguugcagggugg

SEQ ID NO: 465381 - RNA, 26 nt, Human
ggggaacuguggauuuccauuuuuga

SEQ ID NO: 465382 - RNA, 24 nt, Human
guaagacagaaaaauggaacaaaa

SEQ ID NO: 465383 - RNA, 21 nt, Human
uaaaaacaaaaacaaaaacca

SEQ ID NO: 465384 - RNA, 24 nt, Human
uaaaauccaacaacaguaguguua

SEQ ID NO: 465385 - RNA, 20 nt, Human
uaaaaugaauaaagccauga

SEQ ID NO: 465386 - RNA, 23 nt, Human
uaaacacaggucaccauacacua

SEQ ID NO: 465387 - RNA, 25 nt, Human
uaaccacuuaggucacuuagagugu

SEQ ID NO: 465388 - RNA, 19 nt, Human
uaagcaaucuccacaaugu

SEQ ID NO: 465389 - RNA, 23 nt, Human
uaaguaagcaaucuccacaaugu

SEQ ID NO: 465390 - RNA, 24 nt, Human
uaaguagguaaacagguuaaguuu

SEQ ID NO: 465391 - RNA, 24 nt, Human
uaaucaccucuaagagaaaugaac

SEQ ID NO: 465392 - RNA, 23 nt, Human
uacaacaacaacaaaccaaaaaa

SEQ ID NO: 465393 - RNA, 22 nt, Human
uacaauucuuucacacuuaaaa

SEQ ID NO: 465394 - RNA, 23 nt, Human
uacauaacugcaauacagcacug

SEQ ID NO: 465395 - RNA, 23 nt, Human
uacgauaacuacgccagucagaa

SEQ ID NO: 465396 - RNA, 22 nt, Human
uagaaggcuauccaaacuccua

SEQ ID NO: 465397 - RNA, 25 nt, Human
uauaugcagaaaaaaacuagcuauu

SEQ ID NO: 465398 - RNA, 20 nt, Human
uauccagagacaacagaaau

SEQ ID NO: 465399 - RNA, 23 nt, Human
uaugcagagaacucacugagaaa

SEQ ID NO: 465400 - RNA, 24 nt, Human
uauggaaggcccaaugggagguuc

SEQ ID NO: 465401 - RNA, 26 nt, Human
uauuaaccacacacaguuuaccuuuu

SEQ ID NO: 465402 - RNA, 22 nt, Human
ucagcuaaaauccuugauucca

SEQ ID NO: 465403 - RNA, 23 nt, Human
uccaaacuccuauuccccacucc

SEQ ID NO: 465404 - RNA, 23 nt, Human
uccaagccccaguccuauaaauc

SEQ ID NO: 465405 - RNA, 18 nt, Human
uccagagacaacagaaau

SEQ ID NO: 465406 - RNA, 22 nt, Human
ucccauaccaaacauaucuagu

SEQ ID NO: 465407 - RNA, 25 nt, Human
ugaacuggaaaugauuuauaaucua

SEQ ID NO: 465408 - RNA, 23 nt, Human
ugagcaaagacuguuuucaccau

SEQ ID NO: 465409 - RNA, 23 nt, Human
ugagcaaagacuguuuucaccau

SEQ ID NO: 465410 - RNA, 19 nt, Human
ugagguguugcaggguggu

SEQ ID NO: 465411 - RNA, 22 nt, Human
ugauuccagauuuguaaacauu

SEQ ID NO: 465412 - RNA, 22 nt, Human
ugcaauuaaaaugaacaaagca

SEQ ID NO: 465413 - RNA, 23 nt, Human
ugcagagagacuaaaaauaucca

SEQ ID NO: 465414 - RNA, 23 nt, Human
ugggauggaguaaggcugauggc

SEQ ID NO: 465415 - RNA, 18 nt, Human
uguggugaucacuucagc

SEQ ID NO: 465416 - RNA, 25 nt, Human
uuacuaaauucuaccccccucuaaa

SEQ ID NO: 465417 - RNA, 21 nt, Human
uuagugaaguuaaaaucagaa

SEQ ID NO: 465418 - RNA, 19 nt, Human
uuaugggaaaaguauugca

SEQ ID NO: 465419 - RNA, 24 nt, Human
uucauucacagaauguuuuuuuuu

SEQ ID NO: 465420 - RNA, 19 nt, Human
uucgggguucauagaaucc

SEQ ID NO: 465421 - RNA, 18 nt, Human
uugaaaauaccugaauua

SEQ ID NO: 465422 - RNA, 21 nt, Human
uuuauaaucuacccuacaagg

SEQ ID NO: 465423 - RNA, 18 nt, Human
uuucacacuuaaaacuuu

SEQ ID NO: 465424 - RNA, 21 nt, Human
uuuuuaaacacaggucaccau

SEQ ID NO: 465425 - RNA, 25 nt, Human
uuuuucauaaauuacaucauaagaa

SEQ ID NO: 465426 - RNA, 21 nt, Human
uuuuuuuuuaaacacagguca

SEQ ID NO: 465427 - RNA, 20 nt, Human
uuuuuuuuuuaaacacaggg

SEQ ID NO: 465428 - RNA, 18 nt, Human
aaaagucggggagggaaa

SEQ ID NO: 465429 - RNA, 26 nt, Human
aaacaauccuccugccucaaccaccc

SEQ ID NO: 465430 - RNA, 25 nt, Human
aaagagcuaguuuaaagucauggag

SEQ ID NO: 465431 - RNA, 23 nt, Human
aaagugcugggauuauaggugua

SEQ ID NO: 465432 - RNA, 21 nt, Human
aaaugccaggauaugagugag

SEQ ID NO: 465433 - RNA, 20 nt, Human
aacauggugaaaacccaucu

SEQ ID NO: 465434 - RNA, 21 nt, Human
aacauggugaaaacccaucuc

SEQ ID NO: 465435 - RNA, 25 nt, Human
aaccuuuugaaaucacuagcucuga

SEQ ID NO: 465436 - RNA, 24 nt, Human
aacgcuuuggcuuuuuucagagaa

SEQ ID NO: 465437 - RNA, 19 nt, Human
aaggcaaacccucaaaccc

SEQ ID NO: 465438 - RNA, 24 nt, Human
aaguagcuaggacugcaggcacac

SEQ ID NO: 465439 - RNA, 22 nt, Human
aagugcagaguauacucaaaac

SEQ ID NO: 465440 - RNA, 18 nt, Human
aagugcugggauuauagg

SEQ ID NO: 465441 - RNA, 18 nt, Human
aauacuugggacuggaga

SEQ ID NO: 465442 - RNA, 19 nt, Human
aaucauaguucacugcagc

SEQ ID NO: 465443 - RNA, 24 nt, Human
aaucuccugaacccaggaggcgga

SEQ ID NO: 465444 - RNA, 24 nt, Human
aaugaaccaggacuauuugaaugg

SEQ ID NO: 465445 - RNA, 18 nt, Human
acaccacugcacuccagc

SEQ ID NO: 465446 - RNA, 20 nt, Human
acaccacugcacuccagccu

SEQ ID NO: 465447 - RNA, 24 nt, Human
acagagcgagacuccaucucaaaa

SEQ ID NO: 465448 - RNA, 21 nt, Human
accacucaaaugacacauaca

SEQ ID NO: 465449 - RNA, 22 nt, Human
accacucaaaugacacauacaa

SEQ ID NO: 465450 - RNA, 24 nt, Human
acccaggaggcggagguugcagug

SEQ ID NO: 465451 - RNA, 25 nt, Human
acuccgucgcccaagcuggagugca

SEQ ID NO: 465452 - RNA, 24 nt, Human
acugcacuccagccuuggcgacag

SEQ ID NO: 465453 - RNA, 26 nt, Human
acugcacuccagccuuggcgacagag

SEQ ID NO: 465454 - RNA, 19 nt, Human
acugcacuccagccuuggg

SEQ ID NO: 465455 - RNA, 23 nt, Human
agaaagcagagacugggggagaa

SEQ ID NO: 465456 - RNA, 19 nt, Human
agaacaauucauguccaca

SEQ ID NO: 465457 - RNA, 24 nt, Human
agaauaaccucgcuccaaucugga

SEQ ID NO: 465458 - RNA, 22 nt, Human
agauguguuuugucuauuucca

SEQ ID NO: 465459 - RNA, 27 nt, Human
agcacuuaucuuuucuuuuuuuuauua

SEQ ID NO: 465460 - RNA, 24 nt, Human
agcacuuugggaagucgagguggg

SEQ ID NO: 465461 - RNA, 18 nt, Human
agcaggaugaguaacagg

SEQ ID NO: 465462 - RNA, 18 nt, Human
agcaggccccaaauagcc

SEQ ID NO: 465463 - RNA, 25 nt, Human
agccuggccaacauggugaaaaccc

SEQ ID NO: 465464 - RNA, 24 nt, Human
agccuuggcgacagagcgagacuc

SEQ ID NO: 465465 - RNA, 20 nt, Human
aggaugagaucuugcuaugu

SEQ ID NO: 465466 - RNA, 23 nt, Human
aggcaggaagccauuauucaagg

SEQ ID NO: 465467 - RNA, 19 nt, Human
aggccccaaauagccccag

SEQ ID NO: 465468 - RNA, 24 nt, Human
aggcggagguugcagugagccgag

SEQ ID NO: 465469 - RNA, 23 nt, Human
agugcagugguaaaaucauaguu

SEQ ID NO: 465470 - RNA, 23 nt, Human
aguucccacauuucccgagcagc

SEQ ID NO: 465471 - RNA, 21 nt, Human
auaaaauuuucuugccucauc

SEQ ID NO: 465472 - RNA, 24 nt, Human
auaguucacugcagccucaacuuc

SEQ ID NO: 465473 - RNA, 25 nt, Human
aucacaccacugcacuccagccuug

SEQ ID NO: 465474 - RNA, 19 nt, Human
augguauccccagugcuug

SEQ ID NO: 465475 - RNA, 18 nt, Human
auggugaaaacccaucuc

SEQ ID NO: 465476 - RNA, 21 nt, Human
auuuaugcuagaacaagcacu

SEQ ID NO: 465477 - RNA, 22 nt, Human
auuucaacacaccaugcuaaau

SEQ ID NO: 465478 - RNA, 28 nt, Human
caaacaauccuccugccucaaccaccca

SEQ ID NO: 465479 - RNA, 18 nt, Human
caaacuuccuucgagagg

SEQ ID NO: 465480 - RNA, 24 nt, Human
caaagugcugggauuauaggugua

SEQ ID NO: 465481 - RNA, 20 nt, Human
caaauagccccagcacagca

SEQ ID NO: 465482 - RNA, 22 nt, Human
caacacaccaugcuaaaugcca

SEQ ID NO: 465483 - RNA, 20 nt, Human
caaccccuaaguguaccccu

SEQ ID NO: 465484 - RNA, 27 nt, Human
caagugacccucucaccucagccuccc

SEQ ID NO: 465485 - RNA, 21 nt, Human
cacaccacugcacuccagccu

SEQ ID NO: 465486 - RNA, 20 nt, Human
cacauccagcccaaaaacuu

SEQ ID NO: 465487 - RNA, 25 nt, Human
caccccaaguaugccauugucuuug

SEQ ID NO: 465488 - RNA, 24 nt, Human
caccucagccucccaaagugcugg

SEQ ID NO: 465489 - RNA, 23 nt, Human
cacuccagccuuggcgacagagc

SEQ ID NO: 465490 - RNA, 24 nt, Human
cacuccagccuuggcgacagagcg

SEQ ID NO: 465491 - RNA, 22 nt, Human
cacuccgucgcccaagcuggag

SEQ ID NO: 465492 - RNA, 19 nt, Human
cacugcacuccagccuugg

SEQ ID NO: 465493 - RNA, 20 nt, Human
cacugcacuccagccuuggc

SEQ ID NO: 465494 - RNA, 22 nt, Human
cacugcacuccagccuuggcga

SEQ ID NO: 465495 - RNA, 23 nt, Human
cacugcacuccagccuuggcgac

SEQ ID NO: 465496 - RNA, 24 nt, Human
cacugcacuccagccuuggcgaca

SEQ ID NO: 465497 - RNA, 21 nt, Human
cagagaaagacuucagccaaa

SEQ ID NO: 465498 - RNA, 21 nt, Human
cagcacuuugggaagucgagg

SEQ ID NO: 465499 - RNA, 24 nt, Human
cagcacuuugggaagucgaggugg

SEQ ID NO: 465500 - RNA, 22 nt, Human
caucugccccuuggacuuugga

SEQ ID NO: 465501 - RNA, 22 nt, Human
cauguuuaugaccuagaaauuc

SEQ ID NO: 465502 - RNA, 21 nt, Human
ccaaagugcugggauuauagg

SEQ ID NO: 465503 - RNA, 24 nt, Human
ccaaagugcugggauuauaggugu

SEQ ID NO: 465504 - RNA, 20 nt, Human
ccacagaucacaccuuccac

SEQ ID NO: 465505 - RNA, 24 nt, Human
ccacccaaguagcuaggacugcag

SEQ ID NO: 465506 - RNA, 20 nt, Human
ccacugcacuccagccuugg

SEQ ID NO: 465507 - RNA, 20 nt, Human
ccacugcacuccagccuugg

SEQ ID NO: 465508 - RNA, 21 nt, Human
ccacugcacuccagccuuggc

SEQ ID NO: 465509 - RNA, 23 nt, Human
ccacugcacuccagccuuggcga

SEQ ID NO: 465510 - RNA, 24 nt, Human
ccacugcacuccagccuuggcgac

SEQ ID NO: 465511 - RNA, 20 nt, Human
ccagacagucccacagauca

SEQ ID NO: 465512 - RNA, 22 nt, Human
cccaaguagcuaggacugcagg

SEQ ID NO: 465513 - RNA, 24 nt, Human
cccaaguagcuaggacugcaggca

SEQ ID NO: 465514 - RNA, 24 nt, Human
cccaggccaauaaaauuuucuugc

SEQ ID NO: 465515 - RNA, 22 nt, Human
ccccaaauagccccagcacagc

SEQ ID NO: 465516 - RNA, 18 nt, Human
cccgcugcuagcuccugg

SEQ ID NO: 465517 - RNA, 23 nt, Human
ccgcgcccgcugcuagcuccugg

SEQ ID NO: 465518 - RNA, 19 nt, Human
ccucagcucccucucaccc

SEQ ID NO: 465519 - RNA, 23 nt, Human
ccuccauuuccgcuuagcuucuc

SEQ ID NO: 465520 - RNA, 24 nt, Human
ccuccugccucaaccacccaagua

SEQ ID NO: 465521 - RNA, 26 nt, Human
ccucucaccucagccucccaaagugc

SEQ ID NO: 465522 - RNA, 23 nt, Human
ccucuuuggcuuccugccuuacu

SEQ ID NO: 465523 - RNA, 22 nt, Human
ccugccaaauagugcccagucc

SEQ ID NO: 465524 - RNA, 19 nt, Human
ccuggccaacauggugaaa

SEQ ID NO: 465525 - RNA, 24 nt, Human
ccuggccaacauggugaaaaccca

SEQ ID NO: 465526 - RNA, 19 nt, Human
ccugugcugagcgcggaaa

SEQ ID NO: 465527 - RNA, 22 nt, Human
ccuucgagaggcgagagacagg

SEQ ID NO: 465528 - RNA, 22 nt, Human
ccuuggcgacagagcgagacuc

SEQ ID NO: 465529 - RNA, 20 nt, Human
cgagaggcgagagacaggag

SEQ ID NO: 465530 - RNA, 21 nt, Human
cgagaggcgagagacaggagg

SEQ ID NO: 465531 - RNA, 24 nt, Human
cgagaucacaccacugcacuccag

SEQ ID NO: 465532 - RNA, 20 nt, Human
cgccuucuggggcgccuccu

SEQ ID NO: 465533 - RNA, 21 nt, Human
cgcuguaaucccagcacuuug

SEQ ID NO: 465534 - RNA, 26 nt, Human
cucaaacaauccuccugccucaacca

SEQ ID NO: 465535 - RNA, 24 nt, Human
cucaagugacccucucaccucagc

SEQ ID NO: 465536 - RNA, 21 nt, Human
cucacgcuguaaucccagcac

SEQ ID NO: 465537 - RNA, 23 nt, Human
cucacgcuguaaucccagcacuu

SEQ ID NO: 465538 - RNA, 23 nt, Human
cuccugggcucaagugacccucu

SEQ ID NO: 465539 - RNA, 24 nt, Human
cugaacccaggaggcggagguugc

SEQ ID NO: 465540 - RNA, 20 nt, Human
cugggauuauagguguaagc

SEQ ID NO: 465541 - RNA, 21 nt, Human
cuguaaucccagcacuuuggg

SEQ ID NO: 465542 - RNA, 21 nt, Human
cuguaauuccagcuacuuggg

SEQ ID NO: 465543 - RNA, 20 nt, Human
cuuucagucuuacccaggcc

SEQ ID NO: 465544 - RNA, 31 nt, Human
cuuuugucuuuauucauuuauuuauuuauuu

SEQ ID NO: 465545 - RNA, 21 nt, Human
gaaaacccaucuccaccaaaa

SEQ ID NO: 465546 - RNA, 23 nt, Human
gaaagacuucagccaaauugucc

SEQ ID NO: 465547 - RNA, 23 nt, Human
gaaagcuuuuggacaaguuggaa

SEQ ID NO: 465548 - RNA, 24 nt, Human
gaacuccugggcucaagugacccu

SEQ ID NO: 465549 - RNA, 18 nt, Human
gaagacagaguauuuuaa

SEQ ID NO: 465550 - RNA, 19 nt, Human
gagaaaaaaaagcugucau

SEQ ID NO: 465551 - RNA, 20 nt, Human
gagacagggucucacuccgu

SEQ ID NO: 465552 - RNA, 23 nt, Human
gagaccagccuggccaacauggu

SEQ ID NO: 465553 - RNA, 18 nt, Human
gaggaaggaacaaaguug

SEQ ID NO: 465554 - RNA, 21 nt, Human
gaggcggagguugcagugagc

SEQ ID NO: 465555 - RNA, 19 nt, Human
gagggaaaccacgauguaa

SEQ ID NO: 465556 - RNA, 22 nt, Human
gagguugcagugagccgagauc

SEQ ID NO: 465557 - RNA, 24 nt, Human
gcacuccagccuuggcgacagagc

SEQ ID NO: 465558 - RNA, 24 nt, Human
gccaacauggugaaaacccaucuc

SEQ ID NO: 465559 - RNA, 22 nt, Human
gccagguccuaugcaccaggga

SEQ ID NO: 465560 - RNA, 20 nt, Human
gcccaagcuggagugcagug

SEQ ID NO: 465561 - RNA, 20 nt, Human
gccgagaucacaccacugca

SEQ ID NO: 465562 - RNA, 19 nt, Human
gccugugcugagcgcggaa

SEQ ID NO: 465563 - RNA, 20 nt, Human
gcucugaaauuaagagcaaa

SEQ ID NO: 465564 - RNA, 18 nt, Human
ggacaaaugccgaguccu

SEQ ID NO: 465565 - RNA, 20 nt, Human
ggagguugcagugagccgag

SEQ ID NO: 465566 - RNA, 22 nt, Human
ggagguugcagugagccgagau

SEQ ID NO: 465567 - RNA, 23 nt, Human
ggagguugcagugagccgagauc

SEQ ID NO: 465568 - RNA, 24 nt, Human
ggagguugcagugagccgagauca

SEQ ID NO: 465569 - RNA, 24 nt, Human
ggcaaacccucaaacccgucucuu

SEQ ID NO: 465570 - RNA, 18 nt, Human
ggcaugauugccucugug

SEQ ID NO: 465571 - RNA, 28 nt, Human
gggcagugcaucuggccaucgggccccc

SEQ ID NO: 465572 - RNA, 21 nt, Human
gggcucaagugacccucucac

SEQ ID NO: 465573 - RNA, 19 nt, Human
ggggugcaagaagcccugc

SEQ ID NO: 465574 - RNA, 23 nt, Human
gguagcucacgcuguaaucccag

SEQ ID NO: 465575 - RNA, 19 nt, Human
guccuucccuucuucacau

SEQ ID NO: 465576 - RNA, 19 nt, Human
guugcagugagccgagauc

SEQ ID NO: 465577 - RNA, 22 nt, Human
uaaaauaaaaagucggggaggg

SEQ ID NO: 465578 - RNA, 24 nt, Human
uaacuuagcuaagcccuuugcaca

SEQ ID NO: 465579 - RNA, 23 nt, Human
uaauaaaauauguaaggccagaa

SEQ ID NO: 465580 - RNA, 24 nt, Human
uacaagggaaaaaaugacaagccc

SEQ ID NO: 465581 - RNA, 23 nt, Human
uacauuugcauucucaaacaaaa

SEQ ID NO: 465582 - RNA, 18 nt, Human
uagaacaauucaugucca

SEQ ID NO: 465583 - RNA, 24 nt, Human
uagcaggaagcacaaaugaugacu

SEQ ID NO: 465584 - RNA, 22 nt, Human
uagcuaagcccuuugcacaguc

SEQ ID NO: 465585 - RNA, 21 nt, Human
uagcucacgcuguaaucccag

SEQ ID NO: 465586 - RNA, 23 nt, Human
uagcucacgcuguaaucccagca

SEQ ID NO: 465587 - RNA, 21 nt, Human
uaggacugcaggcacacacca

SEQ ID NO: 465588 - RNA, 24 nt, Human
uaguucacugcagccucaacuucc

SEQ ID NO: 465589 - RNA, 24 nt, Human
uaugccauugucuuuguaauucuu

SEQ ID NO: 465590 - RNA, 23 nt, Human
uauguuucccaggcuugucuaga

SEQ ID NO: 465591 - RNA, 23 nt, Human
ucaaccacccaaguagcuaggac

SEQ ID NO: 465592 - RNA, 23 nt, Human
ucacaccacugcacuccagccuu

SEQ ID NO: 465593 - RNA, 23 nt, Human
ucaccucagccucccaaagugcu

SEQ ID NO: 465594 - RNA, 24 nt, Human
ucacgcuguaaucccagcacuuug

SEQ ID NO: 465595 - RNA, 19 nt, Human
ucacugcagccucaacuuc

SEQ ID NO: 465596 - RNA, 19 nt, Human
ucauucauuuugugcccuu

SEQ ID NO: 465597 - RNA, 23 nt, Human
uccagccuuggcgacagagcgag

SEQ ID NO: 465598 - RNA, 24 nt, Human
uccagccuuggcgacagagcgaga

SEQ ID NO: 465599 - RNA, 22 nt, Human
uccaucuucaaauuaaacaauc

SEQ ID NO: 465600 - RNA, 23 nt, Human
ucccaaagugcugggauuauagg

SEQ ID NO: 465601 - RNA, 24 nt, Human
ucccagggagucgggcagccuuug

SEQ ID NO: 465602 - RNA, 19 nt, Human
ucccugcaauacuauuccc

SEQ ID NO: 465603 - RNA, 21 nt, Human
ucccugcaauacuauucccuc

SEQ ID NO: 465604 - RNA, 22 nt, Human
uccggugugaggucagccuggg

SEQ ID NO: 465605 - RNA, 21 nt, Human
uccucagcucccucucacccc

SEQ ID NO: 465606 - RNA, 21 nt, Human
uccugggcucaagugacccuc

SEQ ID NO: 465607 - RNA, 24 nt, Human
uccugggcucaagugacccucuca

SEQ ID NO: 465608 - RNA, 18 nt, Human
ucgcccaagcuggagugc

SEQ ID NO: 465609 - RNA, 21 nt, Human
ucuagaacuccugggcucaag

SEQ ID NO: 465610 - RNA, 24 nt, Human
ucucacuccgucgcccaagcugga

SEQ ID NO: 465611 - RNA, 26 nt, Human
ucucacuccgucgcccaagcuggagu

SEQ ID NO: 465612 - RNA, 27 nt, Human
ucucacuccgucgcccaagcuggagug

SEQ ID NO: 465613 - RNA, 18 nt, Human
ucucugcuuaaagcuaca

SEQ ID NO: 465614 - RNA, 21 nt, Human
ucucugugaaaggucaguagu

SEQ ID NO: 465615 - RNA, 24 nt, Human
ucugguuuuauuauucaaauuaag

SEQ ID NO: 465616 - RNA, 23 nt, Human
ucuuacccugguagucuccaaaa

SEQ ID NO: 465617 - RNA, 19 nt, Human
ucuugcuauguuucccagg

SEQ ID NO: 465618 - RNA, 22 nt, Human
ugaaaacccaucuccaccaaaa

SEQ ID NO: 465619 - RNA, 23 nt, Human
ugaaaacccaucuccaccaaaaa

SEQ ID NO: 465620 - RNA, 24 nt, Human
ugaaaacccaucuccaccaaaaau

SEQ ID NO: 465621 - RNA, 19 nt, Human
ugaaaagcaaaacaaacuc

SEQ ID NO: 465622 - RNA, 27 nt, Human
ugaaauuaagagcaaacuuccuucgag

SEQ ID NO: 465623 - RNA, 22 nt, Human
ugaagcaaaugcucuaaagaac

SEQ ID NO: 465624 - RNA, 21 nt, Human
ugacacauacaagucuguaug

SEQ ID NO: 465625 - RNA, 24 nt, Human
ugacagcaggccccaaauagcccc

SEQ ID NO: 465626 - RNA, 24 nt, Human
ugagaucuugcuauguuucccagg

SEQ ID NO: 465627 - RNA, 20 nt, Human
ugaucuaaacaaguucucaa

SEQ ID NO: 465628 - RNA, 24 nt, Human
ugccaaauagugcccaguccuccc

SEQ ID NO: 465629 - RNA, 23 nt, Human
ugccagguccuaugcaccaggga

SEQ ID NO: 465630 - RNA, 21 nt, Human
ugccgcauggcuguaauucca

SEQ ID NO: 465631 - RNA, 24 nt, Human
ugccucaaccacccaaguagcuag

SEQ ID NO: 465632 - RNA, 22 nt, Human
ugcuauguuucccaggcuuguc

SEQ ID NO: 465633 - RNA, 20 nt, Human
ugcuuucagucuuacccagg

SEQ ID NO: 465634 - RNA, 24 nt, Human
uggaauauaggcaccuggcagagu

SEQ ID NO: 465635 - RNA, 24 nt, Human
uggaaucuuacccugguagucucc

SEQ ID NO: 465636 - RNA, 21 nt, Human
uggagugcagugguaaaauca

SEQ ID NO: 465637 - RNA, 18 nt, Human
uggaguuuuugccaaaaa

SEQ ID NO: 465638 - RNA, 18 nt, Human
uggauaaaguuagggcac

SEQ ID NO: 465639 - RNA, 19 nt, Human
uggccaacauggugaaaac

SEQ ID NO: 465640 - RNA, 24 nt, Human
uggcuguaauuccagcuacuuggg

SEQ ID NO: 465641 - RNA, 24 nt, Human
ugggaagucgagguggguggaucg

SEQ ID NO: 465642 - RNA, 20 nt, Human
ugggagggcugaaaagggug

SEQ ID NO: 465643 - RNA, 18 nt, Human
ugggauuauagguguaag

SEQ ID NO: 465644 - RNA, 19 nt, Human
ugggauuauagguguaagc

SEQ ID NO: 465645 - RNA, 22 nt, Human
ugggauuauagguguaagcuac

SEQ ID NO: 465646 - RNA, 24 nt, Human
ugggauuauagguguaagcuacca

SEQ ID NO: 465647 - RNA, 26 nt, Human
ugggcaugauugccucugugggggcu

SEQ ID NO: 465648 - RNA, 18 nt, Human
ugggcucaagugacccuc

SEQ ID NO: 465649 - RNA, 22 nt, Human
ugggggagaaguggucuuuacu

SEQ ID NO: 465650 - RNA, 21 nt, Human
uguaauacuugggacuggaga

SEQ ID NO: 465651 - RNA, 19 nt, Human
ugucuuggggaauuguggu

SEQ ID NO: 465652 - RNA, 23 nt, Human
ugugaaaggucaguaguaaaaga

SEQ ID NO: 465653 - RNA, 21 nt, Human
ugugaggucagccugggcugg

SEQ ID NO: 465654 - RNA, 23 nt, Human
ugugcugagcgcggaaacugccc

SEQ ID NO: 465655 - RNA, 19 nt, Human
uuaaucuuuuggaagcaag

SEQ ID NO: 465656 - RNA, 24 nt, Human
uuagcuucucuugaaucuauuggg

SEQ ID NO: 465657 - RNA, 20 nt, Human
uuccagcuacuugggacgcu

SEQ ID NO: 465658 - RNA, 24 nt, Human
uuccagggggugcaagaagcccug

SEQ ID NO: 465659 - RNA, 24 nt, Human
uucccaggcuugucuagaacuccu

SEQ ID NO: 465660 - RNA, 23 nt, Human
uucucaaacaaaauuaaaaagcc

SEQ ID NO: 465661 - RNA, 20 nt, Human
uugaaucuauugggcaugau

SEQ ID NO: 465662 - RNA, 18 nt, Human
uugcagugagccgagauc

SEQ ID NO: 465663 - RNA, 19 nt, Human
uugcagugagccgagauca

SEQ ID NO: 465664 - RNA, 20 nt, Human
uugcagugagccgagaucac

SEQ ID NO: 465665 - RNA, 19 nt, Human
uuggggaggggccagguag

SEQ ID NO: 465666 - RNA, 21 nt, Human
uugucuagaacuccugggcuc

SEQ ID NO: 465667 - RNA, 22 nt, Human
uugucuauuuccauuaaaaugu

SEQ ID NO: 465668 - RNA, 21 nt, Human
uugugaaaccuuuugaaauca

SEQ ID NO: 465669 - RNA, 23 nt, Human
uuugccaaaaaccaugucucgag

SEQ ID NO: 465670 - RNA, 19 nt, Human
uuuuuuuuuuaaagaaagu

SEQ ID NO: 465671 - RNA, 23 nt, Human
uuuuuuuuuugagacagggucuc

SEQ ID NO: 465672 - RNA, 20 nt, Human
uuuuuuuuuuugagacaggg

SEQ ID NO: 465673 - RNA, 19 nt, Human
aaaaaaaacuuggaaagca

SEQ ID NO: 465674 - RNA, 24 nt, Human
aaaaaaacaacccccaaacccaaa

SEQ ID NO: 465675 - RNA, 21 nt, Human
aaaaaacaacccccaaaccca

SEQ ID NO: 465676 - RNA, 24 nt, Human
aaaaaacaacccccaaacccaaaa

SEQ ID NO: 465677 - RNA, 25 nt, Human
aaaaauaccaaaccaagcaacaaca

SEQ ID NO: 465678 - RNA, 21 nt, Human
aaacaaaaaaaaacuuggaaa

SEQ ID NO: 465679 - RNA, 25 nt, Human
aaacaaaaaaaaacuuggaaagcaa

SEQ ID NO: 465680 - RNA, 21 nt, Human
aaacagaaagccagaggcagc

SEQ ID NO: 465681 - RNA, 18 nt, Human
aaacaggaaaacauaaac

SEQ ID NO: 465682 - RNA, 20 nt, Human
aaaccaaaaauaccaaacca

SEQ ID NO: 465683 - RNA, 20 nt, Human
aaaccaagcaacaacaaaaa

SEQ ID NO: 465684 - RNA, 22 nt, Human
aaacuaccgccuaccaaauuuu

SEQ ID NO: 465685 - RNA, 22 nt, Human
aaacuagcuugcacuucaccua

SEQ ID NO: 465686 - RNA, 21 nt, Human
aaacuuggaaagcaaagcucc

SEQ ID NO: 465687 - RNA, 25 nt, Human
aacaaaaaaacaacccccaaaccca

SEQ ID NO: 465688 - RNA, 18 nt, Human
aacaacccccaaacccaa

SEQ ID NO: 465689 - RNA, 22 nt, Human
aacaacccccaaacccaaaaac

SEQ ID NO: 465690 - RNA, 23 nt, Human
aacccccaaacccaaaaacucuc

SEQ ID NO: 465691 - RNA, 21 nt, Human
aagaacagaaaaagaacuaca

SEQ ID NO: 465692 - RNA, 23 nt, Human
aagcaacaacaaaaaaacaaccc

SEQ ID NO: 465693 - RNA, 26 nt, Human
aauaccaaaccaagcaacaacaaaaa

SEQ ID NO: 465694 - RNA, 21 nt, Human
acaaaaaaacaacccccaaac

SEQ ID NO: 465695 - RNA, 22 nt, Human
acaaauacacacaaaaccaaaa

SEQ ID NO: 465696 - RNA, 26 nt, Human
acaacaaaaaaacaacccccaaaccc

SEQ ID NO: 465697 - RNA, 23 nt, Human
acaacccccaaacccaaaaacuc

SEQ ID NO: 465698 - RNA, 19 nt, Human
acacuacaaacaggaaaac

SEQ ID NO: 465699 - RNA, 25 nt, Human
acagacaaaagaugaagaaccagug

SEQ ID NO: 465700 - RNA, 20 nt, Human
accaagcaacaacaaaaaaa

SEQ ID NO: 465701 - RNA, 23 nt, Human
accaagcaacaacaaaaaaacaa

SEQ ID NO: 465702 - RNA, 27 nt, Human
accacccccuccacccccuucccccca

SEQ ID NO: 465703 - RNA, 22 nt, Human
acccccuccacccccuuccccc

SEQ ID NO: 465704 - RNA, 23 nt, Human
acccccuccacccccuucccccc

SEQ ID NO: 465705 - RNA, 23 nt, Human
acccccuccacccccuucccccc

SEQ ID NO: 465706 - RNA, 18 nt, Human
agaaguacuuuuuucuua

SEQ ID NO: 465707 - RNA, 21 nt, Human
agacaaaaacccaaacuuuau

SEQ ID NO: 465708 - RNA, 21 nt, Human
agacaaaagaugaagaaccag

SEQ ID NO: 465709 - RNA, 21 nt, Human
agcaaagcucccaaaccagcu

SEQ ID NO: 465710 - RNA, 18 nt, Human
agcacgaagagauuuucc

SEQ ID NO: 465711 - RNA, 18 nt, Human
agcggggcucacggcggg

SEQ ID NO: 465712 - RNA, 19 nt, Human
agcggggcucacggcgggg

SEQ ID NO: 465713 - RNA, 18 nt, Human
aggaaaacauaaacauca

SEQ ID NO: 465714 - RNA, 22 nt, Human
aggcacuuaagaucacccaacc

SEQ ID NO: 465715 - RNA, 21 nt, Human
agggauaaauauggaucaaau

SEQ ID NO: 465716 - RNA, 18 nt, Human
aguauuuccucuuuuggu

SEQ ID NO: 465717 - RNA, 20 nt, Human
auacaaauacacacaaaacc

SEQ ID NO: 465718 - RNA, 23 nt, Human
auacaaauacacacaaaaccaaa

SEQ ID NO: 465719 - RNA, 18 nt, Human
auguggagagaaguauga

SEQ ID NO: 465720 - RNA, 24 nt, Human
auuuuuacucuacugaauugaaag

SEQ ID NO: 465721 - RNA, 22 nt, Human
caaaaaaacaacccccaaaccc

SEQ ID NO: 465722 - RNA, 24 nt, Human
caaaaaaacaacccccaaacccaa

SEQ ID NO: 465723 - RNA, 23 nt, Human
caaaaauaaaguauuucuaucuc

SEQ ID NO: 465724 - RNA, 19 nt, Human
caaaaauaccaaaccaagc

SEQ ID NO: 465725 - RNA, 21 nt, Human
caaaccaagcaacaacaaaaa

SEQ ID NO: 465726 - RNA, 26 nt, Human
caaauccuguuaguagaaaacagaaa

SEQ ID NO: 465727 - RNA, 22 nt, Human
caaauccuugagacaaaaaccc

SEQ ID NO: 465728 - RNA, 19 nt, Human
caacaaaaaaacaaccccc

SEQ ID NO: 465729 - RNA, 23 nt, Human
caacaaaaaaacaacccccaaac

SEQ ID NO: 465730 - RNA, 27 nt, Human
caacaacaaaaaaacaacccccaaacc

SEQ ID NO: 465731 - RNA, 25 nt, Human
caagcaacaacaaaaaaacaacccc

SEQ ID NO: 465732 - RNA, 27 nt, Human
cacacaaaaccaaaaauaccaaaccaa

SEQ ID NO: 465733 - RNA, 22 nt, Human
cacuacaaacaggaaaacauaa

SEQ ID NO: 465734 - RNA, 20 nt, Human
cauaaaauuccaaacacuuu

SEQ ID NO: 465735 - RNA, 23 nt, Human
caugauaaacauuugcaaugucc

SEQ ID NO: 465736 - RNA, 23 nt, Human
ccaaaaauaccaaaccaagcaac

SEQ ID NO: 465737 - RNA, 22 nt, Human
ccaaaccaagcaacaacaaaaa

SEQ ID NO: 465738 - RNA, 24 nt, Human
ccaaaccaagcaacaacaaaaaaa

SEQ ID NO: 465739 - RNA, 22 nt, Human
ccaaauccuuucauccaaaauc

SEQ ID NO: 465740 - RNA, 24 nt, Human
ccaaauccuuucauccaaaaucuu

SEQ ID NO: 465741 - RNA, 21 nt, Human
ccaccacaaacugcgcagaag

SEQ ID NO: 465742 - RNA, 20 nt, Human
ccaucuauacagacaccuga

SEQ ID NO: 465743 - RNA, 23 nt, Human
cccccuccacccccuucccccca

SEQ ID NO: 465744 - RNA, 25 nt, Human
cccccuccacccccuuccccccacu

SEQ ID NO: 465745 - RNA, 26 nt, Human
cccccuccacccccuuccccccacuu

SEQ ID NO: 465746 - RNA, 24 nt, Human
cccccuuccccccacuuaaugguu

SEQ ID NO: 465747 - RNA, 22 nt, Human
cccuccacccccuuccccccac

SEQ ID NO: 465748 - RNA, 24 nt, Human
ccggagcggggcucacggcggggu

SEQ ID NO: 465749 - RNA, 21 nt, Human
ccgugccaagcccgcccgggg

SEQ ID NO: 465750 - RNA, 19 nt, Human
ccuccgugccaagcccgcc

SEQ ID NO: 465751 - RNA, 23 nt, Human
ccugaucagaguucuaaacuacc

SEQ ID NO: 465752 - RNA, 18 nt, Human
ccuugagacaaaaaccca

SEQ ID NO: 465753 - RNA, 25 nt, Human
cuaccgccuaccaaauuuuucuuug

SEQ ID NO: 465754 - RNA, 21 nt, Human
cuccacccccuuccccccacu

SEQ ID NO: 465755 - RNA, 20 nt, Human
cugaugcuacuuuacaacau

SEQ ID NO: 465756 - RNA, 26 nt, Human
cuuaagaucacccaaccuuuuuaauu

SEQ ID NO: 465757 - RNA, 19 nt, Human
cuuuauaccaaauccuuuc

SEQ ID NO: 465758 - RNA, 20 nt, Human
cuuugcauuaagcccaacuc

SEQ ID NO: 465759 - RNA, 21 nt, Human
gaaaaagaacuacaguuggua

SEQ ID NO: 465760 - RNA, 20 nt, Human
gaaaacagaaagccagaggc

SEQ ID NO: 465761 - RNA, 20 nt, Human
gaacugacgugaaugcccac

SEQ ID NO: 465762 - RNA, 19 nt, Human
gcccggggacccggagcgg

SEQ ID NO: 465763 - RNA, 18 nt, Human
gccuuaaaacaaaaaaaa

SEQ ID NO: 465764 - RNA, 21 nt, Human
ggagcggggcucacggcgggg

SEQ ID NO: 465765 - RNA, 21 nt, Human
guagaaaacagaaagccagag

SEQ ID NO: 465766 - RNA, 22 nt, Human
uaaaaaguuacaucccuuaaga

SEQ ID NO: 465767 - RNA, 24 nt, Human
uaaaacaaaaaaaaacuuggaaag

SEQ ID NO: 465768 - RNA, 22 nt, Human
uaagcccaacucaucacugauc

SEQ ID NO: 465769 - RNA, 18 nt, Human
uaaguuagaaacugcuca

SEQ ID NO: 465770 - RNA, 24 nt, Human
uaauuuauaaccaaaucucuccuc

SEQ ID NO: 465771 - RNA, 22 nt, Human
uacaaacaggaaaacauaaaca

SEQ ID NO: 465772 - RNA, 22 nt, Human
uacaacugaugcuacuuuacaa

SEQ ID NO: 465773 - RNA, 21 nt, Human
uacacacaaaaccaaaaauac

SEQ ID NO: 465774 - RNA, 20 nt, Human
uacagacaccugagaaccaa

SEQ ID NO: 465775 - RNA, 19 nt, Human
uaccacccccuccaccccc

SEQ ID NO: 465776 - RNA, 20 nt, Human
uaccacccccuccacccccu

SEQ ID NO: 465777 - RNA, 20 nt, Human
uagaaaacagaaagccagag

SEQ ID NO: 465778 - RNA, 24 nt, Human
uagaaaacagaaagccagaggcag

SEQ ID NO: 465779 - RNA, 23 nt, Human
uagcacgaagagauuuuccuuca

SEQ ID NO: 465780 - RNA, 19 nt, Human
uauaccaaauccuuucauc

SEQ ID NO: 465781 - RNA, 20 nt, Human
uauauuagauuaauggucuc

SEQ ID NO: 465782 - RNA, 26 nt, Human
uauuaccacccccuccacccccuucc

SEQ ID NO: 465783 - RNA, 25 nt, Human
ucaauguggagagaaguaugauuuc

SEQ ID NO: 465784 - RNA, 22 nt, Human
ucagaguucuaaacuaccgccu

SEQ ID NO: 465785 - RNA, 19 nt, Human
ucccaaauuacuacuauug

SEQ ID NO: 465786 - RNA, 21 nt, Human
ucuaaacuaccgccuaccaaa

SEQ ID NO: 465787 - RNA, 24 nt, Human
ugaaaaaucuaccuuuauauguga

SEQ ID NO: 465788 - RNA, 19 nt, Human
ugaaagaacagaaaaagaa

SEQ ID NO: 465789 - RNA, 24 nt, Human
ugaaagaacagaaaaagaacuaca

SEQ ID NO: 465790 - RNA, 19 nt, Human
ugaaauacauuaugaccug

SEQ ID NO: 465791 - RNA, 18 nt, Human
ugaaauguuuccauuaaa

SEQ ID NO: 465792 - RNA, 24 nt, Human
ugaagaaccagugaccaaauccug

SEQ ID NO: 465793 - RNA, 19 nt, Human
ugaaugaaaaugacacugu

SEQ ID NO: 465794 - RNA, 19 nt, Human
ugaaugcccacagggcugg

SEQ ID NO: 465795 - RNA, 18 nt, Human
ugacgugaaugcccacag

SEQ ID NO: 465796 - RNA, 18 nt, Human
ugagacaaaaacccaaac

SEQ ID NO: 465797 - RNA, 25 nt, Human
ugagacaaaaacccaaacuuuauac

SEQ ID NO: 465798 - RNA, 22 nt, Human
ugagacugauauucaauaauau

SEQ ID NO: 465799 - RNA, 21 nt, Human
ugagacuuggcuucauaugaa

SEQ ID NO: 465800 - RNA, 21 nt, Human
ugauauucaauaauauguauu

SEQ ID NO: 465801 - RNA, 19 nt, Human
ugccaagcccgcccgggga

SEQ ID NO: 465802 - RNA, 22 nt, Human
ugccaagcccgcccggggaccc

SEQ ID NO: 465803 - RNA, 21 nt, Human
ugccuuaaaacaaaaaaaaac

SEQ ID NO: 465804 - RNA, 23 nt, Human
uggaaagcaaagcucccaaacca

SEQ ID NO: 465805 - RNA, 22 nt, Human
uggcaagaauuacacagcagaa

SEQ ID NO: 465806 - RNA, 19 nt, Human
uguaguaccugaucagagu

SEQ ID NO: 465807 - RNA, 26 nt, Human
uguuaguagaaaacagaaagccagag

SEQ ID NO: 465808 - RNA, 22 nt, Human
uuacgagaauaagauugcucag

SEQ ID NO: 465809 - RNA, 22 nt, Human
uucaugcugauaagcauuuagc

SEQ ID NO: 465810 - RNA, 20 nt, Human
uucuaaacuaccgccuacca

SEQ ID NO: 465811 - RNA, 22 nt, Human
uuuaugaccacauuaauuggaa

SEQ ID NO: 465812 - RNA, 19 nt, Human
aaaaaacagcccacauuaa

SEQ ID NO: 465813 - RNA, 19 nt, Human
aaaagugacaagcccacag

SEQ ID NO: 465814 - RNA, 21 nt, Human
aaauauggugagcaugaucau

SEQ ID NO: 465815 - RNA, 19 nt, Human
acccugagggaggugaagg

SEQ ID NO: 465816 - RNA, 21 nt, Human
acuaaaaagucaacuaaacag

SEQ ID NO: 465817 - RNA, 22 nt, Human
agaagaguugagucuauggagu

SEQ ID NO: 465818 - RNA, 18 nt, Human
agaguugagucuauggag

SEQ ID NO: 465819 - RNA, 19 nt, Human
aggagaaacccagcagagg

SEQ ID NO: 465820 - RNA, 21 nt, Human
aggcauugugaacuccagaag

SEQ ID NO: 465821 - RNA, 23 nt, Human
aguaaacaaggacuuccaacuua

SEQ ID NO: 465822 - RNA, 22 nt, Human
agugacaagcccacagaaggaa

SEQ ID NO: 465823 - RNA, 24 nt, Human
cagaaggaaaggcuguauaaggaa

SEQ ID NO: 465824 - RNA, 23 nt, Human
caguuugaucauaaaaaacagcc

SEQ ID NO: 465825 - RNA, 27 nt, Human
ccaacuuauccuauaacuaaaaaguca

SEQ ID NO: 465826 - RNA, 18 nt, Human
cccugagggaggugaagg

SEQ ID NO: 465827 - RNA, 25 nt, Human
ccuaagaugacuaaaaauacggcuc

SEQ ID NO: 465828 - RNA, 23 nt, Human
cugaaaagugacaagcccacaga

SEQ ID NO: 465829 - RNA, 22 nt, Human
cugagggaggugaaggagggug

SEQ ID NO: 465830 - RNA, 18 nt, Human
cuguacccugggucuucc

SEQ ID NO: 465831 - RNA, 22 nt, Human
cuuucauuacccugagggaggu

SEQ ID NO: 465832 - RNA, 20 nt, Human
guacugaaaagugacaagcc

SEQ ID NO: 465833 - RNA, 20 nt, Human
gucaaauuucuacuuucauu

SEQ ID NO: 465834 - RNA, 21 nt, Human
uaaaaauacggcucuccuuuc

SEQ ID NO: 465835 - RNA, 27 nt, Human
uaaaauucucuuggguuuggcccaaaa

SEQ ID NO: 465836 - RNA, 20 nt, Human
uaagaugacuaaaaauacgg

SEQ ID NO: 465837 - RNA, 19 nt, Human
uaaggagaaacccagcaga

SEQ ID NO: 465838 - RNA, 20 nt, Human
ucaagaauagagguagggag

SEQ ID NO: 465839 - RNA, 21 nt, Human
ugacaagcccacagaaggaaa

SEQ ID NO: 465840 - RNA, 19 nt, Human
ugaucauaaaaaacagccc

SEQ ID NO: 465841 - RNA, 22 nt, Human
uggcagugucucuggucacaug

SEQ ID NO: 465842 - RNA, 28 nt, Human
uuaaaauucucuuggguuuggcccaaaa

SEQ ID NO: 465843 - RNA, 25 nt, Human
uuaggcuuuuuagagcuacaaugag

SEQ ID NO: 465844 - RNA, 20 nt, Human
uucauuacccugagggaggu

SEQ ID NO: 465845 - RNA, 23 nt, Human
uuuauuuugcuucacauuuaagg

SEQ ID NO: 465846 - RNA, 20 nt, Human
uuugaucauaaaaaacagcc

SEQ ID NO: 465847 - RNA, 23 nt, Human
aaagccuuuccuuggagauuuau

SEQ ID NO: 465848 - RNA, 27 nt, Human
aagcaggcuaaacaaggcagcuuggcu

SEQ ID NO: 465849 - RNA, 26 nt, Human
aagcauuaggauuauacgugugagcc

SEQ ID NO: 465850 - RNA, 18 nt, Human
aaggccagagacaaaagc

SEQ ID NO: 465851 - RNA, 23 nt, Human
accuggcaggcauguucuguggc

SEQ ID NO: 465852 - RNA, 22 nt, Human
agccccaggugaugcuccuacc

SEQ ID NO: 465853 - RNA, 19 nt, Human
auccaaguuauccaacuua

SEQ ID NO: 465854 - RNA, 22 nt, Human
augcauaacguuauuucuggaa

SEQ ID NO: 465855 - RNA, 23 nt, Human
caaaagccuuuccuuggagauuu

SEQ ID NO: 465856 - RNA, 22 nt, Human
caaagcauuaggauuauacgug

SEQ ID NO: 465857 - RNA, 24 nt, Human
caguagagacagaaucucauuaug

SEQ ID NO: 465858 - RNA, 24 nt, Human
cauuaugucauccaggcuggucuc

SEQ ID NO: 465859 - RNA, 20 nt, Human
ccaggcuggucuccaacucc

SEQ ID NO: 465860 - RNA, 24 nt, Human
cccagccccaggugaugcuccuac

SEQ ID NO: 465861 - RNA, 30 nt, Human
ccuacaauguaaagcaggcuaaacaaggcc

SEQ ID NO: 465862 - RNA, 22 nt, Human
ccucccagccccaggugaugcu

SEQ ID NO: 465863 - RNA, 27 nt, Human
gccagagacaaaagccuuuccuuggag

SEQ ID NO: 465864 - RNA, 24 nt, Human
gcuccuaccucagccucucaaagc

SEQ ID NO: 465865 - RNA, 21 nt, Human
gcuuugggauguuugagguuc

SEQ ID NO: 465866 - RNA, 24 nt, Human
ggauuauacgugugagccaucaug

SEQ ID NO: 465867 - RNA, 20 nt, Human
uaaagcaggcuaaacaaggc

SEQ ID NO: 465868 - RNA, 22 nt, Human
uaccucagccucucaaagcauu

SEQ ID NO: 465869 - RNA, 22 nt, Human
uagagacagaaucucauuaugu

SEQ ID NO: 465870 - RNA, 20 nt, Human
uagcuuugggauguuugaga

SEQ ID NO: 465871 - RNA, 22 nt, Human
uagcuuugggauguuugagguu

SEQ ID NO: 465872 - RNA, 21 nt, Human
uaggauuauacgugugagcca

SEQ ID NO: 465873 - RNA, 22 nt, Human
uaggauuauacgugugagccau

SEQ ID NO: 465874 - RNA, 24 nt, Human
uaggauuauacgugugagccauca

SEQ ID NO: 465875 - RNA, 21 nt, Human
uauccaacuuagcuuugggau

SEQ ID NO: 465876 - RNA, 23 nt, Human
uaucccaucauuuugaagcuuuu

SEQ ID NO: 465877 - RNA, 24 nt, Human
uaugucauccaggcuggucuccaa

SEQ ID NO: 465878 - RNA, 21 nt, Human
ucccagccccaggugaugcuc

SEQ ID NO: 465879 - RNA, 19 nt, Human
ucucauuaugucauccagg

SEQ ID NO: 465880 - RNA, 24 nt, Human
ucucauuaugucauccaggcuggu

SEQ ID NO: 465881 - RNA, 20 nt, Human
uggcccauucuucauccaag

SEQ ID NO: 465882 - RNA, 23 nt, Human
uggcguucuaguggcaagaauca

SEQ ID NO: 465883 - RNA, 19 nt, Human
ugugcacucguggcagaca

SEQ ID NO: 465884 - RNA, 21 nt, Human
uguggcccauucuucauccaa

SEQ ID NO: 465885 - RNA, 23 nt, Human
uuaaaaauagauaauaaugauuu

SEQ ID NO: 465886 - RNA, 18 nt, Human
uucucacuuugcuccucu

SEQ ID NO: 465887 - RNA, 20 nt, Human
uugaagcuuuuaaaaauaga

SEQ ID NO: 465888 - RNA, 21 nt, Human
aaaucagaagauggcucagag

SEQ ID NO: 465889 - RNA, 20 nt, Human
aaauggaaagauauuacaga

SEQ ID NO: 465890 - RNA, 20 nt, Human
gagucucaauuuccagaaau

SEQ ID NO: 465891 - RNA, 25 nt, Human
guucaaucaaauugaagaauugauc

SEQ ID NO: 465892 - RNA, 24 nt, Human
uaaauauacacacauuuauaaccu

SEQ ID NO: 465893 - RNA, 21 nt, Human
uagagcaaugaaaaaucagaa

SEQ ID NO: 465894 - RNA, 24 nt, Human
uauaaccugcauuuauuuucuaaa

SEQ ID NO: 465895 - RNA, 21 nt, Human
ucaccaaagucagugagaaga

SEQ ID NO: 465896 - RNA, 24 nt, Human
uuccagagacuaaaauuuaauacc

SEQ ID NO: 465897 - RNA, 20 nt, Human
uucuagguuucaaaaucacc

SEQ ID NO: 465898 - RNA, 18 nt, Human
uugaaaaggcugaacagu

SEQ ID NO: 465899 - RNA, 19 nt, Human
uugaaaaggcugaacaguu

SEQ ID NO: 465900 - RNA, 18 nt, Human
uuuccauuacagacuaga

SEQ ID NO: 465901 - RNA, 22 nt, Human
aaggcaaaacgaacaaaagcaa

SEQ ID NO: 465902 - RNA, 21 nt, Human
aaugguacggaaauauggagg

SEQ ID NO: 465903 - RNA, 20 nt, Human
acaaaagcaaaaucugaagc

SEQ ID NO: 465904 - RNA, 19 nt, Human
acacagauaaguaaaaucc

SEQ ID NO: 465905 - RNA, 19 nt, Human
agaaggcaaaacgaacaaa

SEQ ID NO: 465906 - RNA, 23 nt, Human
aguggagaugggguuucaucaug

SEQ ID NO: 465907 - RNA, 19 nt, Human
augggguuucaucauguug

SEQ ID NO: 465908 - RNA, 21 nt, Human
caaaagcaaaaucugaagcag

SEQ ID NO: 465909 - RNA, 21 nt, Human
cagaaaguucuuaagagaucu

SEQ ID NO: 465910 - RNA, 23 nt, Human
caguggagaugggguuucaucau

SEQ ID NO: 465911 - RNA, 24 nt, Human
caguggagaugggguuucaucaug

SEQ ID NO: 465912 - RNA, 25 nt, Human
caucauguugcccaggcuaguuuuc

SEQ ID NO: 465913 - RNA, 18 nt, Human
cauguugcccaggcuagu

SEQ ID NO: 465914 - RNA, 18 nt, Human
cauguugcccaggcuagu

SEQ ID NO: 465915 - RNA, 21 nt, Human
ccaguacaggcugggccaaau

SEQ ID NO: 465916 - RNA, 22 nt, Human
gaacaaaagcaaaaucugaagc

SEQ ID NO: 465917 - RNA, 19 nt, Human
gaaggaaaaguaauggcaa

SEQ ID NO: 465918 - RNA, 18 nt, Human
gagaugggguuucaucau

SEQ ID NO: 465919 - RNA, 22 nt, Human
gagaugggguuucaucauguug

SEQ ID NO: 465920 - RNA, 23 nt, Human
gagaugggguuucaucauguugc

SEQ ID NO: 465921 - RNA, 22 nt, Human
gaugggguuucaucauguugcc

SEQ ID NO: 465922 - RNA, 23 nt, Human
gauguuggagagagugggaagga

SEQ ID NO: 465923 - RNA, 20 nt, Human
gcaguggagaugggguuuca

SEQ ID NO: 465924 - RNA, 24 nt, Human
gcaguggagaugggguuucaucau

SEQ ID NO: 465925 - RNA, 24 nt, Human
ggacagaaggcaaaacgaacaaaa

SEQ ID NO: 465926 - RNA, 19 nt, Human
ggcaaaacgaacaaaagca

SEQ ID NO: 465927 - RNA, 21 nt, Human
ggcaaaacgaacaaaagcaaa

SEQ ID NO: 465928 - RNA, 22 nt, Human
gggguuucaucauguugcccag

SEQ ID NO: 465929 - RNA, 23 nt, Human
gggguuucaucauguugcccagg

SEQ ID NO: 465930 - RNA, 21 nt, Human
guggagaugggguuucaucau

SEQ ID NO: 465931 - RNA, 21 nt, Human
guuagaucaggcuuaaauuga

SEQ ID NO: 465932 - RNA, 19 nt, Human
guuccaaggacagaaggca

SEQ ID NO: 465933 - RNA, 21 nt, Human
uaaagugaaugugauguugga

SEQ ID NO: 465934 - RNA, 22 nt, Human
uaagaagcagaugucuauacaa

SEQ ID NO: 465935 - RNA, 19 nt, Human
uaaguaaaauccacgcugu

SEQ ID NO: 465936 - RNA, 23 nt, Human
uaccaggcacugugcuaagcucu

SEQ ID NO: 465937 - RNA, 22 nt, Human
uagaagaauaaauuagagaaua

SEQ ID NO: 465938 - RNA, 19 nt, Human
uauagaagaauaaauuaga

SEQ ID NO: 465939 - RNA, 23 nt, Human
uaucuuagcccaccgcuucucag

SEQ ID NO: 465940 - RNA, 20 nt, Human
uccaaggacagaaggcaaaa

SEQ ID NO: 465941 - RNA, 21 nt, Human
ugauguuggagagagugggaa

SEQ ID NO: 465942 - RNA, 24 nt, Human
ugggguuucaucauguugcccagg

SEQ ID NO: 465943 - RNA, 18 nt, Human
ugucacagaaacugaauu

SEQ ID NO: 465944 - RNA, 21 nt, Human
ugugauguuggagagaguggg

SEQ ID NO: 465945 - RNA, 21 nt, Human
uugaggauuaacuguucuguc

SEQ ID NO: 465946 - RNA, 19 nt, Human
uugucacuuccauuguucu

SEQ ID NO: 465947 - RNA, 25 nt, Human
uuuccaagcaguugcgcagaugauu

SEQ ID NO: 465948 - RNA, 23 nt, Human
aaaaagcugcucucuccagaggg

SEQ ID NO: 465949 - RNA, 19 nt, Human
aaagugcugggauuccagg

SEQ ID NO: 465950 - RNA, 24 nt, Human
aaagugcugggauuccaggcguga

SEQ ID NO: 465951 - RNA, 19 nt, Human
aagugcugggauuccaggc

SEQ ID NO: 465952 - RNA, 18 nt, Human
acgggguuucaccguguu

SEQ ID NO: 465953 - RNA, 19 nt, Human
acgggguuucaccguguua

SEQ ID NO: 465954 - RNA, 20 nt, Human
acgggguuucaccguguuag

SEQ ID NO: 465955 - RNA, 24 nt, Human
acgggguuucaccguguuagccag

SEQ ID NO: 465956 - RNA, 19 nt, Human
acucuguugcccaggcugg

SEQ ID NO: 465957 - RNA, 20 nt, Human
acucuguugcccaggcugga

SEQ ID NO: 465958 - RNA, 21 nt, Human
acucuguugcccaggcuggag

SEQ ID NO: 465959 - RNA, 25 nt, Human
acucuguugcccaggcuggagagca

SEQ ID NO: 465960 - RNA, 19 nt, Human
agagacgggguuucaccgu

SEQ ID NO: 465961 - RNA, 20 nt, Human
aguagagacgggguuucacc

SEQ ID NO: 465962 - RNA, 21 nt, Human
aguagagacgggguuucaccg

SEQ ID NO: 465963 - RNA, 18 nt, Human
aguagcugggacuacagg

SEQ ID NO: 465964 - RNA, 24 nt, Human
agugauucuccugccucagccucc

SEQ ID NO: 465965 - RNA, 20 nt, Human
auaaaaagcugcucucucca

SEQ ID NO: 465966 - RNA, 24 nt, Human
augaucugcccaccucggcuuccc

SEQ ID NO: 465967 - RNA, 24 nt, Human
caaagugcugggauuccaggcgug

SEQ ID NO: 465968 - RNA, 23 nt, Human
caaccuccaccucccggguucaa

SEQ ID NO: 465969 - RNA, 20 nt, Human
caagugauucuccugccuca

SEQ ID NO: 465970 - RNA, 22 nt, Human
caagugauucuccugccucagc

SEQ ID NO: 465971 - RNA, 19 nt, Human
caccgcgcccggcccacag

SEQ ID NO: 465972 - RNA, 18 nt, Human
caccguguuagccaggau

SEQ ID NO: 465973 - RNA, 24 nt, Human
caccguguuagccaggauggucuu

SEQ ID NO: 465974 - RNA, 24 nt, Human
caccucggcuucccaaagugcugg

SEQ ID NO: 465975 - RNA, 24 nt, Human
cagaguuuuacucuguugcccagg

SEQ ID NO: 465976 - RNA, 20 nt, Human
cagcaguccugaugguccag

SEQ ID NO: 465977 - RNA, 20 nt, Human
cagccuccugaguagcuggg

SEQ ID NO: 465978 - RNA, 21 nt, Human
caggcgugagccaccgcgccc

SEQ ID NO: 465979 - RNA, 21 nt, Human
cagugcccaucauguucccug

SEQ ID NO: 465980 - RNA, 21 nt, Human
cagugguccaaucucaacuca

SEQ ID NO: 465981 - RNA, 22 nt, Human
ccaaagugcugggauuccaggc

SEQ ID NO: 465982 - RNA, 24 nt, Human
ccaaagugcugggauuccaggcgu

SEQ ID NO: 465983 - RNA, 19 nt, Human
ccaccgcgcccggcccaca

SEQ ID NO: 465984 - RNA, 24 nt, Human
ccaccucccggguucaagugauuc

SEQ ID NO: 465985 - RNA, 20 nt, Human
cccagaagcuuccaggagac

SEQ ID NO: 465986 - RNA, 23 nt, Human
cccggguucaagugauucuccuc

SEQ ID NO: 465987 - RNA, 23 nt, Human
cccggguucaagugauucuccug

SEQ ID NO: 465988 - RNA, 24 nt, Human
ccucccggguucaagugauucucc

SEQ ID NO: 465989 - RNA, 23 nt, Human
ccugaguagcugggacuacaggc

SEQ ID NO: 465990 - RNA, 24 nt, Human
ccugaguagcugggacuacaggca

SEQ ID NO: 465991 - RNA, 24 nt, Human
ccugccucagccuccugaguagcu

SEQ ID NO: 465992 - RNA, 18 nt, Human
cggcaaccuccaccuccc

SEQ ID NO: 465993 - RNA, 24 nt, Human
cgggguuucaccguguuagccagg

SEQ ID NO: 465994 - RNA, 22 nt, Human
cucacggcaaccuccaccuccc

SEQ ID NO: 465995 - RNA, 24 nt, Human
cucacggcaaccuccaccucccgg

SEQ ID NO: 465996 - RNA, 24 nt, Human
cucagccuccugaguagcugggac

SEQ ID NO: 465997 - RNA, 20 nt, Human
cucccggguucaagugauuc

SEQ ID NO: 465998 - RNA, 20 nt, Human
cuccugaccuuaugaucugc

SEQ ID NO: 465999 - RNA, 22 nt, Human
cuccugccucagccuccugagu

SEQ ID NO: 466000 - RNA, 22 nt, Human
gaccuuaugaucugcccaccuc

SEQ ID NO: 466001 - RNA, 22 nt, Human
gaccuuaugaucugcccaccuc

SEQ ID NO: 466002 - RNA, 24 nt, Human
gaccuuaugaucugcccaccucgg

SEQ ID NO: 466003 - RNA, 24 nt, Human
gacuacaggcacaugccacuaugc

SEQ ID NO: 466004 - RNA, 24 nt, Human
gagacgggguuucaccguguuagc

SEQ ID NO: 466005 - RNA, 20 nt, Human
gaguagcugggacuacaggc

SEQ ID NO: 466006 - RNA, 25 nt, Human
gaguagcugggacuacaggcacaug

SEQ ID NO: 466007 - RNA, 18 nt, Human
gauuccaggcgugagcca

SEQ ID NO: 466008 - RNA, 21 nt, Human
gauuccaggcgugagccaccg

SEQ ID NO: 466009 - RNA, 22 nt, Human
gauuccaggcgugagccaccgc

SEQ ID NO: 466010 - RNA, 22 nt, Human
gcaaccuccaccucccggguuc

SEQ ID NO: 466011 - RNA, 20 nt, Human
gccucagccuccugaguagc

SEQ ID NO: 466012 - RNA, 23 nt, Human
ggcagcaguccugaugguccagu

SEQ ID NO: 466013 - RNA, 23 nt, Human
gggguuucaccguguuagccagg

SEQ ID NO: 466014 - RNA, 22 nt, Human
ggguucaagugauucuccugcc

SEQ ID NO: 466015 - RNA, 23 nt, Human
ggguucaagugauucuccugccu

SEQ ID NO: 466016 - RNA, 19 nt, Human
ggucuuaaucuccugaccu

SEQ ID NO: 466017 - RNA, 23 nt, Human
guagagacgggguuucaccgugu

SEQ ID NO: 466018 - RNA, 20 nt, Human
guccagugagacccagaagc

SEQ ID NO: 466019 - RNA, 24 nt, Human
gugauucuccugccucagccuccu

SEQ ID NO: 466020 - RNA, 24 nt, Human
guuuuacucuguugcccaggcugg

SEQ ID NO: 466021 - RNA, 24 nt, Human
uacaggcacaugccacuaugccca

SEQ ID NO: 466022 - RNA, 21 nt, Human
uaguagagacgggguuucacc

SEQ ID NO: 466023 - RNA, 24 nt, Human
uaguagagacgggguuucaccgug

SEQ ID NO: 466024 - RNA, 26 nt, Human
uaguagagacgggguuucaccguguu

SEQ ID NO: 466025 - RNA, 19 nt, Human
ucaagugauucuccugccu

SEQ ID NO: 466026 - RNA, 24 nt, Human
ucaccguguuagccaggauggucu

SEQ ID NO: 466027 - RNA, 24 nt, Human
ucacggcaaccuccaccucccggg

SEQ ID NO: 466028 - RNA, 23 nt, Human
ucagccuccugaguagcugggac

SEQ ID NO: 466029 - RNA, 21 nt, Human
ucagugcccaucauguucccu

SEQ ID NO: 466030 - RNA, 20 nt, Human
uccaggagaccuucaguccc

SEQ ID NO: 466031 - RNA, 19 nt, Human
uccaggcgugagccaccgc

SEQ ID NO: 466032 - RNA, 24 nt, Human
ucccaaagugcugggauuccaggc

SEQ ID NO: 466033 - RNA, 21 nt, Human
ucccggguucaagugauucuc

SEQ ID NO: 466034 - RNA, 24 nt, Human
ucccggguucaagugauucuccug

SEQ ID NO: 466035 - RNA, 24 nt, Human
uccugaguagcugggacuacaggc

SEQ ID NO: 466036 - RNA, 20 nt, Human
ugagacccagaagcuuccag

SEQ ID NO: 466037 - RNA, 23 nt, Human
ugaucugcccaccucggcuuccc

SEQ ID NO: 466038 - RNA, 24 nt, Human
ugaucugcccaccucggcuuccca

SEQ ID NO: 466039 - RNA, 20 nt, Human
ugauucuccugccucagccu

SEQ ID NO: 466040 - RNA, 24 nt, Human
ugccucagccuccugaguagcugg

SEQ ID NO: 466041 - RNA, 21 nt, Human
ugggacuacaggcacaugcca

SEQ ID NO: 466042 - RNA, 22 nt, Human
ugggacuacaggcacaugccac

SEQ ID NO: 466043 - RNA, 22 nt, Human
ugggacuacaggcacaugccac

SEQ ID NO: 466044 - RNA, 22 nt, Human
ugggacuacaggcacaugccac

SEQ ID NO: 466045 - RNA, 24 nt, Human
ugggacuacaggcacaugccacua

SEQ ID NO: 466046 - RNA, 26 nt, Human
ugggacuacaggcacaugccacuaug

SEQ ID NO: 466047 - RNA, 18 nt, Human
ugggauuccaggcgugag

SEQ ID NO: 466048 - RNA, 19 nt, Human
ugggauuccaggcgugagc

SEQ ID NO: 466049 - RNA, 23 nt, Human
ugggauuccaggcgugagccacc

SEQ ID NO: 466050 - RNA, 24 nt, Human
ugggauuccaggcgugagccaccg

SEQ ID NO: 466051 - RNA, 20 nt, Human
uuacucuguugcccaggcug

SEQ ID NO: 466052 - RNA, 21 nt, Human
uuacucuguugcccaggcugg

SEQ ID NO: 466053 - RNA, 22 nt, Human
uuacucuguugcccaggcugga

SEQ ID NO: 466054 - RNA, 18 nt, Human
uuaguagagacgggguuu

SEQ ID NO: 466055 - RNA, 22 nt, Human
uuaguagagacgggguuucacc

SEQ ID NO: 466056 - RNA, 24 nt, Human
uuaguagagacgggguuucaccgu

SEQ ID NO: 466057 - RNA, 21 nt, Human
uucaagugauucuccugccuc

SEQ ID NO: 466058 - RNA, 23 nt, Human
uucaagugauucuccugccucag

SEQ ID NO: 466059 - RNA, 24 nt, Human
uucaagugauucuccugccucagc

SEQ ID NO: 466060 - RNA, 18 nt, Human
uugcccaggcuggagagc

SEQ ID NO: 466061 - RNA, 19 nt, Human
uuucaccguguuagccagg

SEQ ID NO: 466062 - RNA, 22 nt, Human
uuuuacucuguugcccaggcug

SEQ ID NO: 466063 - RNA, 24 nt, Human
uuuuacucuguugcccaggcugga

SEQ ID NO: 466064 - RNA, 24 nt, Human
uuuuuaguagagacgggguuucac

SEQ ID NO: 466065 - RNA, 24 nt, Human
uuuuuucuauuuuuaguagagacg

SEQ ID NO: 466066 - RNA, 24 nt, Human
aaaaaaagaaaaaagguucccuga

SEQ ID NO: 466067 - RNA, 21 nt, Human
aaacacacuccugcccugcug

SEQ ID NO: 466068 - RNA, 19 nt, Human
aaacagccacucauguccu

SEQ ID NO: 466069 - RNA, 19 nt, Human
aaaggauuuggcugaaggc

SEQ ID NO: 466070 - RNA, 19 nt, Human
aaagugcuaggauuacagg

SEQ ID NO: 466071 - RNA, 24 nt, Human
aaagugcuaggauuacaggcauga

SEQ ID NO: 466072 - RNA, 23 nt, Human
aaauguccacugugcaccgagcc

SEQ ID NO: 466073 - RNA, 20 nt, Human
aacauagcaagacccugucu

SEQ ID NO: 466074 - RNA, 20 nt, Human
aagauugcuugggcccagga

SEQ ID NO: 466075 - RNA, 18 nt, Human
aagcuucgggaaaggauu

SEQ ID NO: 466076 - RNA, 24 nt, Human
accaacauagcaagacccugucuc

SEQ ID NO: 466077 - RNA, 18 nt, Human
accauguuggccaggcug

SEQ ID NO: 466078 - RNA, 20 nt, Human
acccagagaauuccccuuca

SEQ ID NO: 466079 - RNA, 19 nt, Human
accccaaagccacacagcg

SEQ ID NO: 466080 - RNA, 19 nt, Human
accccugaugcaagccccc

SEQ ID NO: 466081 - RNA, 22 nt, Human
acccuguggcacacagccccuc

SEQ ID NO: 466082 - RNA, 18 nt, Human
acgggguuucaccauguu

SEQ ID NO: 466083 - RNA, 23 nt, Human
acgggguuucaccauguuggcca

SEQ ID NO: 466084 - RNA, 24 nt, Human
acgggguuucaccauguuggccag

SEQ ID NO: 466085 - RNA, 25 nt, Human
acugcacuuacuggaaccagacauc

SEQ ID NO: 466086 - RNA, 23 nt, Human
agaacucagaggguuacaacccc

SEQ ID NO: 466087 - RNA, 20 nt, Human
agacauguugagagcucagu

SEQ ID NO: 466088 - RNA, 21 nt, Human
agaccaagccagacgacauca

SEQ ID NO: 466089 - RNA, 21 nt, Human
agaccagugaggcucaaacug

SEQ ID NO: 466090 - RNA, 22 nt, Human
agaccuccaugcagaggagggg

SEQ ID NO: 466091 - RNA, 21 nt, Human
agagaccuccaugcagaggag

SEQ ID NO: 466092 - RNA, 21 nt, Human
agagagagggacuggccaccc

SEQ ID NO: 466093 - RNA, 21 nt, Human
agagcacagccacaaauggaa

SEQ ID NO: 466094 - RNA, 22 nt, Human
agagcaggagagagcuauaaug

SEQ ID NO: 466095 - RNA, 20 nt, Human
agaggcccaggccccaggac

SEQ ID NO: 466096 - RNA, 25 nt, Human
agaggugggaagauugcuugggccc

SEQ ID NO: 466097 - RNA, 18 nt, Human
agcaagagagaagcagag

SEQ ID NO: 466098 - RNA, 24 nt, Human
agcacuuuaggaggcagagguggg

SEQ ID NO: 466099 - RNA, 18 nt, Human
agcagggugggcucaggg

SEQ ID NO: 466100 - RNA, 22 nt, Human
agcccaugaggaaucuucccac

SEQ ID NO: 466101 - RNA, 22 nt, Human
agcccguggccaccuugccugu

SEQ ID NO: 466102 - RNA, 18 nt, Human
agccuccugaauagcugg

SEQ ID NO: 466103 - RNA, 19 nt, Human
agcugggaggccuggccca

SEQ ID NO: 466104 - RNA, 22 nt, Human
aggacacaucaaacacacuccu

SEQ ID NO: 466105 - RNA, 21 nt, Human
aggaccugcccuaaccuuucu

SEQ ID NO: 466106 - RNA, 21 nt, Human
aggagaucuggccuccagucc

SEQ ID NO: 466107 - RNA, 21 nt, Human
aggagcaagagagaagcagag

SEQ ID NO: 466108 - RNA, 23 nt, Human
aggaguucaagacuagccugacc

SEQ ID NO: 466109 - RNA, 21 nt, Human
aggcagaggugggaagauugc

SEQ ID NO: 466110 - RNA, 23 nt, Human
aggcagaggugggaagauugcuu

SEQ ID NO: 466111 - RNA, 24 nt, Human
aggcagaggugggaagauugcuug

SEQ ID NO: 466112 - RNA, 19 nt, Human
aggcagggcuacggaagag

SEQ ID NO: 466113 - RNA, 21 nt, Human
aggcaugcaccaccacgccag

SEQ ID NO: 466114 - RNA, 18 nt, Human
agggggugugggggccau

SEQ ID NO: 466115 - RNA, 21 nt, Human
aguaggaggugaugaggaggg

SEQ ID NO: 466116 - RNA, 23 nt, Human
aucaguggcccucaugugcccaa

SEQ ID NO: 466117 - RNA, 19 nt, Human
augugggugggaaagucac

SEQ ID NO: 466118 - RNA, 24 nt, Human
auugcuugggcccaggaguucaag

SEQ ID NO: 466119 - RNA, 24 nt, Human
auuuuaguagagacgggguuucac

SEQ ID NO: 466120 - RNA, 20 nt, Human
caaauguccacugugcaccg

SEQ ID NO: 466121 - RNA, 24 nt, Human
caacaccacagcagaccgggacuc

SEQ ID NO: 466122 - RNA, 24 nt, Human
caacauagcaagacccugucucua

SEQ ID NO: 466123 - RNA, 27 nt, Human
caagucccggugacuuuaccuccccua

SEQ ID NO: 466124 - RNA, 20 nt, Human
caccacaucagcucccagua

SEQ ID NO: 466125 - RNA, 24 nt, Human
caccacgccaggcuaauuuuugua

SEQ ID NO: 466126 - RNA, 20 nt, Human
caccaggcucaucuccaaga

SEQ ID NO: 466127 - RNA, 21 nt, Human
caccauguuggccaggcuggu

SEQ ID NO: 466128 - RNA, 24 nt, Human
caccauguuggccaggcugguuuc

SEQ ID NO: 466129 - RNA, 31 nt, Human
caccauguuggccaggcugguuucaaacucc

SEQ ID NO: 466130 - RNA, 21 nt, Human
caccccaaagccacacagcgg

SEQ ID NO: 466131 - RNA, 18 nt, Human
caccccucuccuacucuc

SEQ ID NO: 466132 - RNA, 22 nt, Human
caccccucuccuacucucagcc

SEQ ID NO: 466133 - RNA, 21 nt, Human
cacugcaaccuccgccuccca

SEQ ID NO: 466134 - RNA, 20 nt, Human
cacugggggaaacacaaagg

SEQ ID NO: 466135 - RNA, 22 nt, Human
cacugggugugguguggaggac

SEQ ID NO: 466136 - RNA, 21 nt, Human
cacugucaccaccuuguuucu

SEQ ID NO: 466137 - RNA, 23 nt, Human
cacugugcaccgagcccugaggc

SEQ ID NO: 466138 - RNA, 20 nt, Human
cagaggcccaggccccagga

SEQ ID NO: 466139 - RNA, 18 nt, Human
cagcacuuuaggaggcag

SEQ ID NO: 466140 - RNA, 24 nt, Human
cagcacuuuaggaggcagaggugg

SEQ ID NO: 466141 - RNA, 20 nt, Human
cagccacccaccucacucua

SEQ ID NO: 466142 - RNA, 19 nt, Human
cagccccucugcagcgccc

SEQ ID NO: 466143 - RNA, 19 nt, Human
cagccccucugcagcgccc

SEQ ID NO: 466144 - RNA, 18 nt, Human
cagcccguggccaccuug

SEQ ID NO: 466145 - RNA, 24 nt, Human
caggacacaucaaacacacuccug

SEQ ID NO: 466146 - RNA, 25 nt, Human
cagggcgguucccaggacacaucaa

SEQ ID NO: 466147 - RNA, 24 nt, Human
cauagcaagacccugucucuaaaa

SEQ ID NO: 466148 - RNA, 27 nt, Human
cauagcaagacccugucucuaaaaaaa

SEQ ID NO: 466149 - RNA, 18 nt, Human
caucuuguuaaucccucc

SEQ ID NO: 466150 - RNA, 20 nt, Human
caugcaccaccacgccaggc

SEQ ID NO: 466151 - RNA, 23 nt, Human
cauguuggccaggcugguuucaa

SEQ ID NO: 466152 - RNA, 19 nt, Human
cauuucuaccacagaaaca

SEQ ID NO: 466153 - RNA, 19 nt, Human
ccaaagugcuaggauuaca

SEQ ID NO: 466154 - RNA, 24 nt, Human
ccaaagugcuaggauuacaggcau

SEQ ID NO: 466155 - RNA, 24 nt, Human
ccaaggggaggauaugaguagaag

SEQ ID NO: 466156 - RNA, 21 nt, Human
ccacaaauggaaagaccaagc

SEQ ID NO: 466157 - RNA, 19 nt, Human
ccaccugccccagacccag

SEQ ID NO: 466158 - RNA, 22 nt, Human
ccacuccuguccccugcaagcc

SEQ ID NO: 466159 - RNA, 22 nt, Human
ccacugucaccaccuuguuucu

SEQ ID NO: 466160 - RNA, 19 nt, Human
ccaggccucugccugugcu

SEQ ID NO: 466161 - RNA, 18 nt, Human
cccaaauguccacugugc

SEQ ID NO: 466162 - RNA, 20 nt, Human
cccaagcccugagcacgcca

SEQ ID NO: 466163 - RNA, 23 nt, Human
cccaccaggucucuccuucccca

SEQ ID NO: 466164 - RNA, 18 nt, Human
cccagagaauuccccuuc

SEQ ID NO: 466165 - RNA, 23 nt, Human
cccagccccaaccccucugcauc

SEQ ID NO: 466166 - RNA, 19 nt, Human
ccccaaauguccacugugc

SEQ ID NO: 466167 - RNA, 19 nt, Human
ccccaaccccucugcaucc

SEQ ID NO: 466168 - RNA, 22 nt, Human
ccccaaccccucugcauccucc

SEQ ID NO: 466169 - RNA, 23 nt, Human
ccccagccccaccugccccagac

SEQ ID NO: 466170 - RNA, 19 nt, Human
cccccgaccuccccuuaca

SEQ ID NO: 466171 - RNA, 26 nt, Human
cccccgaccuccccuuacaaagcccc

SEQ ID NO: 466172 - RNA, 19 nt, Human
cccccucuccccugcauuc

SEQ ID NO: 466173 - RNA, 24 nt, Human
cccccugcccuucugccacacaaa

SEQ ID NO: 466174 - RNA, 25 nt, Human
ccccucugcagcgcccuggcuucug

SEQ ID NO: 466175 - RNA, 19 nt, Human
ccccuuucccccuuggccc

SEQ ID NO: 466176 - RNA, 22 nt, Human
cccuaaguccuuccucuccaag

SEQ ID NO: 466177 - RNA, 22 nt, Human
cccuacacuccuuaaacucucc

SEQ ID NO: 466178 - RNA, 24 nt, Human
cccuccugcccacagacagcucac

SEQ ID NO: 466179 - RNA, 23 nt, Human
cccugagcacgccacugucacca

SEQ ID NO: 466180 - RNA, 21 nt, Human
cccugcucccacuccuguccc

SEQ ID NO: 466181 - RNA, 18 nt, Human
cccuguuccaggcuaccc

SEQ ID NO: 466182 - RNA, 24 nt, Human
ccgccucagccucccaaagugcua

SEQ ID NO: 466183 - RNA, 21 nt, Human
ccucagaggucucuccucaga

SEQ ID NO: 466184 - RNA, 21 nt, Human
ccuccaggaccugcccuaacc

SEQ ID NO: 466185 - RNA, 22 nt, Human
ccucccagguucaagcgauucu

SEQ ID NO: 466186 - RNA, 24 nt, Human
ccucccaucacucccugcauccag

SEQ ID NO: 466187 - RNA, 26 nt, Human
ccucccaucacucccugcauccagcc

SEQ ID NO: 466188 - RNA, 18 nt, Human
ccucuuggcuuggggugu

SEQ ID NO: 466189 - RNA, 24 nt, Human
ccugaauagcugggacugcaggca

SEQ ID NO: 466190 - RNA, 22 nt, Human
ccugaccaacauagcaagaccc

SEQ ID NO: 466191 - RNA, 24 nt, Human
ccugaccaacauagcaagacccug

SEQ ID NO: 466192 - RNA, 18 nt, Human
ccugcaggcaccuucugg

SEQ ID NO: 466193 - RNA, 21 nt, Human
ccugcccagcucccucugccc

SEQ ID NO: 466194 - RNA, 25 nt, Human
ccuggcccaccuucugguccccugg

SEQ ID NO: 466195 - RNA, 19 nt, Human
ccuuccuguccucuuuggu

SEQ ID NO: 466196 - RNA, 18 nt, Human
cgcccucuuggcuugggg

SEQ ID NO: 466197 - RNA, 24 nt, Human
cgccucagccucccaaagugcuag

SEQ ID NO: 466198 - RNA, 27 nt, Human
cgcucugucgcccaggcuaaggcugga

SEQ ID NO: 466199 - RNA, 18 nt, Human
cggacugccaccaucucc

SEQ ID NO: 466200 - RNA, 24 nt, Human
cgggguuucaccauguuggccagg

SEQ ID NO: 466201 - RNA, 20 nt, Human
cuaggcacauuucaugugcu

SEQ ID NO: 466202 - RNA, 27 nt, Human
cuaggcucagguggggccccaggagcc

SEQ ID NO: 466203 - RNA, 24 nt, Human
cucacugcaaccuccgccucccag

SEQ ID NO: 466204 - RNA, 22 nt, Human
cucagaggguuacaacccccau

SEQ ID NO: 466205 - RNA, 22 nt, Human
cucagaguagauaacaagaagu

SEQ ID NO: 466206 - RNA, 19 nt, Human
cuccauucugguguccucu

SEQ ID NO: 466207 - RNA, 18 nt, Human
cuccccuuacaaagcccc

SEQ ID NO: 466208 - RNA, 20 nt, Human
cucccucugcccuaacggcc

SEQ ID NO: 466209 - RNA, 24 nt, Human
cuccugaauagcugggacugcagg

SEQ ID NO: 466210 - RNA, 26 nt, Human
cuccugaccucaagcuauccgcccgc

SEQ ID NO: 466211 - RNA, 20 nt, Human
cucugccugugcugcuccuc

SEQ ID NO: 466212 - RNA, 19 nt, Human
cugaaaacaaucaguuucc

SEQ ID NO: 466213 - RNA, 23 nt, Human
cugcaaccuccgccucccagguu

SEQ ID NO: 466214 - RNA, 24 nt, Human
cugcaaccuccgccucccagguuc

SEQ ID NO: 466215 - RNA, 24 nt, Human
cugcagcgcccuggcuucugagcc

SEQ ID NO: 466216 - RNA, 23 nt, Human
cugcuguccugguacacauuguc

SEQ ID NO: 466217 - RNA, 24 nt, Human
cuuccccagccccaccugccccag

SEQ ID NO: 466218 - RNA, 19 nt, Human
cuugggcccaggaguucaa

SEQ ID NO: 466219 - RNA, 25 nt, Human
cuuguuucuggccaucucagccucu

SEQ ID NO: 466220 - RNA, 21 nt, Human
cuuugguaggcgggcaucugu

SEQ ID NO: 466221 - RNA, 21 nt, Human
gacaggcuucccccgaccucc

SEQ ID NO: 466222 - RNA, 24 nt, Human
gaccucaagcuauccgcccgccuc

SEQ ID NO: 466223 - RNA, 21 nt, Human
gacuccucaggaggacucuag

SEQ ID NO: 466224 - RNA, 23 nt, Human
gagaauuccccuucagcuugguc

SEQ ID NO: 466225 - RNA, 24 nt, Human
gagacgggguuucaccauguuggc

SEQ ID NO: 466226 - RNA, 20 nt, Human
gagagagagggacuggccac

SEQ ID NO: 466227 - RNA, 22 nt, Human
gagagcacagccacaaauggaa

SEQ ID NO: 466228 - RNA, 22 nt, Human
gagcaagagagaagcagaggcc

SEQ ID NO: 466229 - RNA, 19 nt, Human
gaggauugauuagcaaugu

SEQ ID NO: 466230 - RNA, 25 nt, Human
gaugucauaggagagagcacagcca

SEQ ID NO: 466231 - RNA, 18 nt, Human
gauuacaggcaugagcca

SEQ ID NO: 466232 - RNA, 22 nt, Human
gauuacaggcaugagccacugc

SEQ ID NO: 466233 - RNA, 22 nt, Human
gauuacaggcaugagccacugc

SEQ ID NO: 466234 - RNA, 22 nt, Human
gcaaccuccgccucccagguuc

SEQ ID NO: 466235 - RNA, 18 nt, Human
gcacuccagccacacgac

SEQ ID NO: 466236 - RNA, 21 nt, Human
gcacugggggaaacacaaagg

SEQ ID NO: 466237 - RNA, 23 nt, Human
gcagcacuccagccacacgacgg

SEQ ID NO: 466238 - RNA, 21 nt, Human
gccagcacugggggaaacaca

SEQ ID NO: 466239 - RNA, 23 nt, Human
gccaucucagccucuaggcugcc

SEQ ID NO: 466240 - RNA, 23 nt, Human
gcccacagacagcucacccucac

SEQ ID NO: 466241 - RNA, 22 nt, Human
gcccaggaguucaagacuagcc

SEQ ID NO: 466242 - RNA, 23 nt, Human
gccccgacuccucaggaggacuc

SEQ ID NO: 466243 - RNA, 20 nt, Human
gccccuuucccccuuggccc

SEQ ID NO: 466244 - RNA, 18 nt, Human
gcccuggcuucugagccu

SEQ ID NO: 466245 - RNA, 18 nt, Human
gcccuggcuucugagccu

SEQ ID NO: 466246 - RNA, 21 nt, Human
gcccuggcuucugagccuuug

SEQ ID NO: 466247 - RNA, 24 nt, Human
gcuauccgcccgccucagccuccc

SEQ ID NO: 466248 - RNA, 25 nt, Human
gcuuguauuuccugccuuagaacag

SEQ ID NO: 466249 - RNA, 21 nt, Human
ggacacaucaaacacacuccu

SEQ ID NO: 466250 - RNA, 24 nt, Human
ggacucugguugaaaccaagggga

SEQ ID NO: 466251 - RNA, 22 nt, Human
ggagguuuugcaaaagcuucgg

SEQ ID NO: 466252 - RNA, 22 nt, Human
ggauuacaggcaugagccacug

SEQ ID NO: 466253 - RNA, 24 nt, Human
ggcugguuucaaacuccugaccuc

SEQ ID NO: 466254 - RNA, 21 nt, Human
gggaagguaucuaaggucaca

SEQ ID NO: 466255 - RNA, 19 nt, Human
gggcaagccccgacuccuc

SEQ ID NO: 466256 - RNA, 20 nt, Human
gggcucagggcaagccccga

SEQ ID NO: 466257 - RNA, 18 nt, Human
ggggccaugggagcuggg

SEQ ID NO: 466258 - RNA, 23 nt, Human
gggguuucaccauguuggccagg

SEQ ID NO: 466259 - RNA, 21 nt, Human
ggucucgcucugucgcccagg

SEQ ID NO: 466260 - RNA, 20 nt, Human
gguugaaaccaaggggagga

SEQ ID NO: 466261 - RNA, 23 nt, Human
guagagacgggguuucaccaugu

SEQ ID NO: 466262 - RNA, 19 nt, Human
gugcuaggcucaggugggg

SEQ ID NO: 466263 - RNA, 19 nt, Human
guguuucuugucuccccac

SEQ ID NO: 466264 - RNA, 21 nt, Human
guugcagagagagagggacug

SEQ ID NO: 466265 - RNA, 22 nt, Human
uaaaacugaaaacaaucaguuu

SEQ ID NO: 466266 - RNA, 18 nt, Human
uaaggcccagaaucccag

SEQ ID NO: 466267 - RNA, 21 nt, Human
uaaguugguuuacuuaggccu

SEQ ID NO: 466268 - RNA, 25 nt, Human
uaauuuuuguauauuuuaguagaga

SEQ ID NO: 466269 - RNA, 19 nt, Human
uacaauuuccuugacaccu

SEQ ID NO: 466270 - RNA, 22 nt, Human
uagaaaucucuuugugacacau

SEQ ID NO: 466271 - RNA, 18 nt, Human
uagaacaggacccagcca

SEQ ID NO: 466272 - RNA, 22 nt, Human
uagagacgggguuucaccaugu

SEQ ID NO: 466273 - RNA, 22 nt, Human
uagcagcugugugcccccacca

SEQ ID NO: 466274 - RNA, 24 nt, Human
uaggaggcagaggugggaagauug

SEQ ID NO: 466275 - RNA, 22 nt, Human
uaggauuacaggcaugagccac

SEQ ID NO: 466276 - RNA, 22 nt, Human
uaggauuacaggcaugagccac

SEQ ID NO: 466277 - RNA, 23 nt, Human
uaggauuacaggcaugagccacu

SEQ ID NO: 466278 - RNA, 24 nt, Human
uaggauuacaggcaugagccacug

SEQ ID NO: 466279 - RNA, 24 nt, Human
uaggauuacaggcaugagccacug

SEQ ID NO: 466280 - RNA, 22 nt, Human
uaggccuuugucauuacaucug

SEQ ID NO: 466281 - RNA, 21 nt, Human
uaggugguuguaagacucuug

SEQ ID NO: 466282 - RNA, 24 nt, Human
uaguagagacgggguuucaccaug

SEQ ID NO: 466283 - RNA, 18 nt, Human
uauggcaauggccagagg

SEQ ID NO: 466284 - RNA, 19 nt, Human
uauggcaauggccagaggc

SEQ ID NO: 466285 - RNA, 18 nt, Human
uauugcccaucuguguuu

SEQ ID NO: 466286 - RNA, 19 nt, Human
uauugcccaucuguguuuc

SEQ ID NO: 466287 - RNA, 19 nt, Human
ucacaguccucgcuuagca

SEQ ID NO: 466288 - RNA, 19 nt, Human
ucacugcaaccuccgccuc

SEQ ID NO: 466289 - RNA, 24 nt, Human
ucacugcaaccuccgccucccagg

SEQ ID NO: 466290 - RNA, 25 nt, Human
ucacugcaaccuccgccucccaggu

SEQ ID NO: 466291 - RNA, 27 nt, Human
ucacugcaaccuccgccucccagguuc

SEQ ID NO: 466292 - RNA, 18 nt, Human
ucagaagccuuccugucc

SEQ ID NO: 466293 - RNA, 26 nt, Human
ucagcccaugaggaaucuucccaccc

SEQ ID NO: 466294 - RNA, 20 nt, Human
ucaguuauaugagccuuuug

SEQ ID NO: 466295 - RNA, 19 nt, Human
ucauaggagagagcacagc

SEQ ID NO: 466296 - RNA, 22 nt, Human
uccagccuaaucgucaugcccu

SEQ ID NO: 466297 - RNA, 24 nt, Human
ucccaaagugcuaggauuacaggc

SEQ ID NO: 466298 - RNA, 20 nt, Human
ucccagguucaagcgauucu

SEQ ID NO: 466299 - RNA, 20 nt, Human
ucccagguucaagcgauucu

SEQ ID NO: 466300 - RNA, 22 nt, Human
ucccccacugcuggauaaagcc

SEQ ID NO: 466301 - RNA, 21 nt, Human
ucccuaaguccuuccucucca

SEQ ID NO: 466302 - RNA, 22 nt, Human
ucccugcucccacuccuguccc

SEQ ID NO: 466303 - RNA, 21 nt, Human
uccgcccgccucagccuccca

SEQ ID NO: 466304 - RNA, 21 nt, Human
uccuaagucuuacaugacguu

SEQ ID NO: 466305 - RNA, 21 nt, Human
uccucagaagccuuccugucc

SEQ ID NO: 466306 - RNA, 24 nt, Human
uccugaauagcugggacugcaggc

SEQ ID NO: 466307 - RNA, 23 nt, Human
uccugaauccaaagccaacacuc

SEQ ID NO: 466308 - RNA, 20 nt, Human
uccugccuuagaacaggacc

SEQ ID NO: 466309 - RNA, 19 nt, Human
ucgcucagccagggucugc

SEQ ID NO: 466310 - RNA, 24 nt, Human
ucucccugcucccacuccuguccc

SEQ ID NO: 466311 - RNA, 18 nt, Human
ucuccuaucucccugcuc

SEQ ID NO: 466312 - RNA, 18 nt, Human
ucuccuuccccauauggu

SEQ ID NO: 466313 - RNA, 22 nt, Human
ucuccuugcugagcaggucggc

SEQ ID NO: 466314 - RNA, 18 nt, Human
ucucgcucugucgcccag

SEQ ID NO: 466315 - RNA, 19 nt, Human
ucucgcucugucgcccagg

SEQ ID NO: 466316 - RNA, 26 nt, Human
ucucgcucugucgcccaggcuaaggc

SEQ ID NO: 466317 - RNA, 27 nt, Human
ucucgcucugucgcccaggcuaaggcu

SEQ ID NO: 466318 - RNA, 18 nt, Human
ucugccauuuccuccccu

SEQ ID NO: 466319 - RNA, 24 nt, Human
ucugccucccuaaguccuuccucu

SEQ ID NO: 466320 - RNA, 22 nt, Human
ucuggccaucucagccucuagg

SEQ ID NO: 466321 - RNA, 19 nt, Human
ucuggccuccaguccuggu

SEQ ID NO: 466322 - RNA, 20 nt, Human
ucugucgcccaggcuaaggc

SEQ ID NO: 466323 - RNA, 24 nt, Human
ucuucuguggaaccaccccucucc

SEQ ID NO: 466324 - RNA, 20 nt, Human
ucuuguggucuuuaguuccu

SEQ ID NO: 466325 - RNA, 21 nt, Human
ugacguggagacaccaagucc

SEQ ID NO: 466326 - RNA, 19 nt, Human
ugacucuggcagggguccc

SEQ ID NO: 466327 - RNA, 18 nt, Human
ugagccuuugguccugcc

SEQ ID NO: 466328 - RNA, 24 nt, Human
ugaggagaguguugcagagagaga

SEQ ID NO: 466329 - RNA, 21 nt, Human
ugaggagggggugugggggcc

SEQ ID NO: 466330 - RNA, 19 nt, Human
ugaguagaagcagcccgug

SEQ ID NO: 466331 - RNA, 21 nt, Human
ugaguagaagcagcccguggc

SEQ ID NO: 466332 - RNA, 18 nt, Human
ugauaaauuucaucuuug

SEQ ID NO: 466333 - RNA, 23 nt, Human
ugcaaagaugcagcagaaacaaa

SEQ ID NO: 466334 - RNA, 19 nt, Human
ugcaagcccccugcccuuc

SEQ ID NO: 466335 - RNA, 21 nt, Human
ugcagagagagagggacuggc

SEQ ID NO: 466336 - RNA, 22 nt, Human
ugcccacagacagcucacccuc

SEQ ID NO: 466337 - RNA, 19 nt, Human
ugcccagcucccucugccc

SEQ ID NO: 466338 - RNA, 23 nt, Human
ugcccugcugugcccugcccagc

SEQ ID NO: 466339 - RNA, 22 nt, Human
ugccucagccuccugaauagcu

SEQ ID NO: 466340 - RNA, 27 nt, Human
ugccucagccuccugaauagcugggac

SEQ ID NO: 466341 - RNA, 21 nt, Human
ugccuggagcuuugcagggga

SEQ ID NO: 466342 - RNA, 18 nt, Human
ugccugugcugcuccucg

SEQ ID NO: 466343 - RNA, 18 nt, Human
uggacagagggagccaug

SEQ ID NO: 466344 - RNA, 24 nt, Human
uggagugcuauggcgcgaucucgg

SEQ ID NO: 466345 - RNA, 23 nt, Human
uggcaauggccagaggcccaggc

SEQ ID NO: 466346 - RNA, 18 nt, Human
uggcaggggucccccauc

SEQ ID NO: 466347 - RNA, 20 nt, Human
uggcaggggucccccaucug

SEQ ID NO: 466348 - RNA, 21 nt, Human
uggcaggggucccccaucugc

SEQ ID NO: 466349 - RNA, 26 nt, Human
uggcaucuuguuaaucccuccacuau

SEQ ID NO: 466350 - RNA, 24 nt, Human
uggccaggcugguuucaaacuccu

SEQ ID NO: 466351 - RNA, 22 nt, Human
uggcccagcaacugcugguggg

SEQ ID NO: 466352 - RNA, 23 nt, Human
uggcccccucuccccugcauucc

SEQ ID NO: 466353 - RNA, 24 nt, Human
uggccccuuucccccuuggccccc

SEQ ID NO: 466354 - RNA, 19 nt, Human
uggcugaaggcagcugaau

SEQ ID NO: 466355 - RNA, 21 nt, Human
ugggacugcaggcaugcacca

SEQ ID NO: 466356 - RNA, 24 nt, Human
ugggacugcaggcaugcaccacca

SEQ ID NO: 466357 - RNA, 22 nt, Human
uggggccccagaacucagaggg

SEQ ID NO: 466358 - RNA, 20 nt, Human
ugggggccaugggagcuggg

SEQ ID NO: 466359 - RNA, 22 nt, Human
ugggggccgcugcugacucugg

SEQ ID NO: 466360 - RNA, 21 nt, Human
ugguuagccccagccacccac

SEQ ID NO: 466361 - RNA, 22 nt, Human
ugugggggccaugggagcuggg

SEQ ID NO: 466362 - RNA, 24 nt, Human
ugugggggccaugggagcugggcc

SEQ ID NO: 466363 - RNA, 23 nt, Human
ugugguggccaaguucuggagau

SEQ ID NO: 466364 - RNA, 18 nt, Human
uuaguagagacgggguuu

SEQ ID NO: 466365 - RNA, 22 nt, Human
uuaguagagacgggguuucacc

SEQ ID NO: 466366 - RNA, 24 nt, Human
uuaguagagacgggguuucaccau

SEQ ID NO: 466367 - RNA, 19 nt, Human
uuauuucaauacuuaccau

SEQ ID NO: 466368 - RNA, 24 nt, Human
uucaagcgauucuuguugccucag

SEQ ID NO: 466369 - RNA, 19 nt, Human
uuccacuggcccuuguagg

SEQ ID NO: 466370 - RNA, 24 nt, Human
uuccagugcugcugggccucacag

SEQ ID NO: 466371 - RNA, 22 nt, Human
uuccccauaugguuagccccag

SEQ ID NO: 466372 - RNA, 24 nt, Human
uuccugcaaagaugcagcagaaac

SEQ ID NO: 466373 - RNA, 19 nt, Human
uuccuucuggaaaucuggu

SEQ ID NO: 466374 - RNA, 18 nt, Human
uucgagagucacuuucag

SEQ ID NO: 466375 - RNA, 24 nt, Human
uucugccacacaaacucuucaccc

SEQ ID NO: 466376 - RNA, 18 nt, Human
uucuggcucaucuucugc

SEQ ID NO: 466377 - RNA, 20 nt, Human
uugcagagagagagggacug

SEQ ID NO: 466378 - RNA, 23 nt, Human
uuggcccccucuccccugcauuc

SEQ ID NO: 466379 - RNA, 21 nt, Human
uugggcccaggaguucaagac

SEQ ID NO: 466380 - RNA, 22 nt, Human
uuuacaaauaacagauuagacg

SEQ ID NO: 466381 - RNA, 24 nt, Human
uuucaccauguuggccaggcuggu

SEQ ID NO: 466382 - RNA, 18 nt, Human
uuucuugucuccccacua

SEQ ID NO: 466383 - RNA, 22 nt, Human
uuuguccuuuuugggaguagga

SEQ ID NO: 466384 - RNA, 22 nt, Human
uuuuguauauuuuaguagagac

SEQ ID NO: 466385 - RNA, 21 nt, Human
uuuuuguauauuuuaguagag

SEQ ID NO: 466386 - RNA, 22 nt, Human
aagccggcugcuccagagcuag

SEQ ID NO: 466387 - RNA, 18 nt, Human
aaggagcuuccgaggcag

SEQ ID NO: 466388 - RNA, 20 nt, Human
aagggaggguucaggguccc

SEQ ID NO: 466389 - RNA, 22 nt, Human
aggaagccggcugcuccagagc

SEQ ID NO: 466390 - RNA, 21 nt, Human
aggcaagcaaggugaagggag

SEQ ID NO: 466391 - RNA, 18 nt, Human
aggcaggaggcaagcaag

SEQ ID NO: 466392 - RNA, 21 nt, Human
cagagggaguccagccucuac

SEQ ID NO: 466393 - RNA, 21 nt, Human
caggcuggugcccagagccac

SEQ ID NO: 466394 - RNA, 24 nt, Human
caucccugguaugcgaaaccugga

SEQ ID NO: 466395 - RNA, 21 nt, Human
ccagagccacuuccacaggaa

SEQ ID NO: 466396 - RNA, 25 nt, Human
cccacacccaaggagcuuccgaggc

SEQ ID NO: 466397 - RNA, 20 nt, Human
cccacaggcuggugcccaga

SEQ ID NO: 466398 - RNA, 22 nt, Human
cccacaggcuggugcccagagc

SEQ ID NO: 466399 - RNA, 18 nt, Human
cccaggcccgaccucgug

SEQ ID NO: 466400 - RNA, 19 nt, Human
cccgcaacccgagacccgc

SEQ ID NO: 466401 - RNA, 25 nt, Human
cccgcaacccgagacccgcuaccca

SEQ ID NO: 466402 - RNA, 23 nt, Human
ccgcuacccacuaccgucggacc

SEQ ID NO: 466403 - RNA, 22 nt, Human
ccugcaacccgcaacccgagac

SEQ ID NO: 466404 - RNA, 19 nt, Human
cgccgggaaggcaguugcc

SEQ ID NO: 466405 - RNA, 22 nt, Human
cgccgggaaggcaguugccugg

SEQ ID NO: 466406 - RNA, 23 nt, Human
cuggagguuuuccaggaagccgg

SEQ ID NO: 466407 - RNA, 21 nt, Human
gaaaccuggagguuuuccagg

SEQ ID NO: 466408 - RNA, 19 nt, Human
gagguuuuccaggaagccg

SEQ ID NO: 466409 - RNA, 22 nt, Human
gcuacccacuaccgucggaccc

SEQ ID NO: 466410 - RNA, 19 nt, Human
ggcccauggcugcugcaac

SEQ ID NO: 466411 - RNA, 24 nt, Human
gguucagggucccacaacagcagu

SEQ ID NO: 466412 - RNA, 20 nt, Human
guucagggucccacaacagc

SEQ ID NO: 466413 - RNA, 25 nt, Human
ucaccuucgcaggccaagccagggg

SEQ ID NO: 466414 - RNA, 23 nt, Human
uccaggaagccggcugcuccaga

SEQ ID NO: 466415 - RNA, 22 nt, Human
ugcggcuugcaaccugcaaccc

SEQ ID NO: 466416 - RNA, 19 nt, Human
uugccuggggccugcggcu

SEQ ID NO: 466417 - RNA, 20 nt, Human
uugccuggggccugcggcuu

SEQ ID NO: 466418 - RNA, 20 nt, Human
uuuuuuuuuuuuuuaccuuc

SEQ ID NO: 466419 - RNA, 21 nt, Human
aaaaaacaaaauagcuacaga

SEQ ID NO: 466420 - RNA, 23 nt, Human
aaaaaacaaaauagcuacagaua

SEQ ID NO: 466421 - RNA, 26 nt, Human
aaagcaaaaaacaaaauagcuacaga

SEQ ID NO: 466422 - RNA, 25 nt, Human
aacaauaaccaaagcaaaaaacaaa

SEQ ID NO: 466423 - RNA, 22 nt, Human
aaccguagcagaaaaguauucc

SEQ ID NO: 466424 - RNA, 25 nt, Human
aagcaaaaaacaaaauagcuacaga

SEQ ID NO: 466425 - RNA, 24 nt, Human
aagcuauggccauggcgcuuacgc

SEQ ID NO: 466426 - RNA, 23 nt, Human
aauacaaucccaaacauccaccu

SEQ ID NO: 466427 - RNA, 20 nt, Human
aauuacagauuugugggcca

SEQ ID NO: 466428 - RNA, 20 nt, Human
aauuacuacaaaaacaauac

SEQ ID NO: 466429 - RNA, 21 nt, Human
acaauaaccaaagcaaaaaac

SEQ ID NO: 466430 - RNA, 23 nt, Human
acaguaucauggcaggaggugag

SEQ ID NO: 466431 - RNA, 23 nt, Human
agcaaaaaacaaaauagcuacag

SEQ ID NO: 466432 - RNA, 20 nt, Human
auacaaucccaaacauccac

SEQ ID NO: 466433 - RNA, 24 nt, Human
auagcuaagaaaagggaaaaaaac

SEQ ID NO: 466434 - RNA, 24 nt, Human
caauaccaauaaaguuauagcaaa

SEQ ID NO: 466435 - RNA, 21 nt, Human
cagcagcucaagaugguugag

SEQ ID NO: 466436 - RNA, 21 nt, Human
caggaggugagaaggagcaau

SEQ ID NO: 466437 - RNA, 24 nt, Human
cauagcuaagaaaagggaaaaaaa

SEQ ID NO: 466438 - RNA, 23 nt, Human
cccgaguccuccagggccugggg

SEQ ID NO: 466439 - RNA, 20 nt, Human
ccuccagggccuggggggac

SEQ ID NO: 466440 - RNA, 24 nt, Human
cuggggggacuggguggaagcucg

SEQ ID NO: 466441 - RNA, 20 nt, Human
gaaaaaaacaauaaccaaag

SEQ ID NO: 466442 - RNA, 22 nt, Human
gaguggaauuuuagaugucuau

SEQ ID NO: 466443 - RNA, 22 nt, Human
ggccauggcgcuuacgcugccu

SEQ ID NO: 466444 - RNA, 21 nt, Human
gucacagcagcucaagauggu

SEQ ID NO: 466445 - RNA, 24 nt, Human
guuucauucucugauacacacaag

SEQ ID NO: 466446 - RNA, 19 nt, Human
uaaccaaagcaaaaaacaa

SEQ ID NO: 466447 - RNA, 18 nt, Human
uaagaaaagggaaaaaaa

SEQ ID NO: 466448 - RNA, 21 nt, Human
uaaucuccuugauuuugaaga

SEQ ID NO: 466449 - RNA, 24 nt, Human
uagcagaaaaguauuccaauccuc

SEQ ID NO: 466450 - RNA, 18 nt, Human
uagcccagggucaggaaa

SEQ ID NO: 466451 - RNA, 18 nt, Human
uagugauuucuuaaggcc

SEQ ID NO: 466452 - RNA, 24 nt, Human
uauggccauggcgcuuacgcugcc

SEQ ID NO: 466453 - RNA, 23 nt, Human
uauucaaauaaaauuuuaaugau

SEQ ID NO: 466454 - RNA, 19 nt, Human
uccagggccuggggggacu

SEQ ID NO: 466455 - RNA, 23 nt, Human
uccaggguuagggugauugagac

SEQ ID NO: 466456 - RNA, 19 nt, Human
uggggggacuggguggaag

SEQ ID NO: 466457 - RNA, 22 nt, Human
uucaccgggcccgaguccucca

SEQ ID NO: 466458 - RNA, 21 nt, Human
uuuuuuuuuuuuuuuuuucag

SEQ ID NO: 466459 - RNA, 18 nt, Human
aaaaagacagagacaucg

SEQ ID NO: 466460 - RNA, 21 nt, Human
aaaagaaaucaaauaacagaa

SEQ ID NO: 466461 - RNA, 23 nt, Human
aaaagaaaucaaauaacagaaaa

SEQ ID NO: 466462 - RNA, 19 nt, Human
aaacaaagauccaguuggc

SEQ ID NO: 466463 - RNA, 19 nt, Human
aaacaaagauccaguuggc

SEQ ID NO: 466464 - RNA, 18 nt, Human
aaagaacaacaacaaaaa

SEQ ID NO: 466465 - RNA, 22 nt, Human
aaagaacaacaacaaaaaaguu

SEQ ID NO: 466466 - RNA, 21 nt, Human
aacaaagcuaaaggaagaggu

SEQ ID NO: 466467 - RNA, 24 nt, Human
aacaucuuuauaaaaugucuacca

SEQ ID NO: 466468 - RNA, 19 nt, Human
aagagcaucaccaucuacc

SEQ ID NO: 466469 - RNA, 18 nt, Human
aauuucugaaugccuuuc

SEQ ID NO: 466470 - RNA, 18 nt, Human
acaaaaaaaaagacagag

SEQ ID NO: 466471 - RNA, 21 nt, Human
acaaaaaaaaagacagagaca

SEQ ID NO: 466472 - RNA, 25 nt, Human
agaaauaggaacaaagcuaaaggaa

SEQ ID NO: 466473 - RNA, 19 nt, Human
agacaaaaaaaaagacaga

SEQ ID NO: 466474 - RNA, 26 nt, Human
agacaggaaagaaauuuaaaucuucu

SEQ ID NO: 466475 - RNA, 21 nt, Human
agccaauacaaagcaaacauc

SEQ ID NO: 466476 - RNA, 21 nt, Human
agccugaauaagugaaaauaa

SEQ ID NO: 466477 - RNA, 22 nt, Human
aggcaaguuuaaaaacaguuau

SEQ ID NO: 466478 - RNA, 24 nt, Human
aguguucagauuuauuuggaaauu

SEQ ID NO: 466479 - RNA, 20 nt, Human
aguuaucacuacuaaaagug

SEQ ID NO: 466480 - RNA, 20 nt, Human
caaaaaaaaagacagagaca

SEQ ID NO: 466481 - RNA, 23 nt, Human
caaggggcuucuauaaaaucagg

SEQ ID NO: 466482 - RNA, 21 nt, Human
caaguguucagauuuauuugg

SEQ ID NO: 466483 - RNA, 22 nt, Human
caauaaauggucaauucucucc

SEQ ID NO: 466484 - RNA, 20 nt, Human
cacaacacacagaucacaua

SEQ ID NO: 466485 - RNA, 20 nt, Human
caccaucuaccuaacagaac

SEQ ID NO: 466486 - RNA, 22 nt, Human
cagaaaaaguuaucccuccucu

SEQ ID NO: 466487 - RNA, 25 nt, Human
cagaaaaaguuaucccuccucuucc

SEQ ID NO: 466488 - RNA, 22 nt, Human
caggcacagacccccucaaagc

SEQ ID NO: 466489 - RNA, 18 nt, Human
cauuacaaacaauaccca

SEQ ID NO: 466490 - RNA, 19 nt, Human
cauuacaaacaauacccaa

SEQ ID NO: 466491 - RNA, 21 nt, Human
cauuccuaucccaccuaagga

SEQ ID NO: 466492 - RNA, 23 nt, Human
ccaccuaaggaacugggcuucca

SEQ ID NO: 466493 - RNA, 24 nt, Human
ccaccuaaggaacugggcuuccaa

SEQ ID NO: 466494 - RNA, 21 nt, Human
cccucccccaaacccuucaaa

SEQ ID NO: 466495 - RNA, 25 nt, Human
cccucccccaaacccuucaaauacu

SEQ ID NO: 466496 - RNA, 23 nt, Human
ccuuucgcuuuuucuucucuuca

SEQ ID NO: 466497 - RNA, 24 nt, Human
cgcuuuuucuucucuucagcaaga

SEQ ID NO: 466498 - RNA, 20 nt, Human
cucacuguaucucugcucuc

SEQ ID NO: 466499 - RNA, 19 nt, Human
cucuucagcaagaauuucg

SEQ ID NO: 466500 - RNA, 23 nt, Human
cuucaggcacagacccccucaaa

SEQ ID NO: 466501 - RNA, 21 nt, Human
gaacagacuuaaaaauuccau

SEQ ID NO: 466502 - RNA, 24 nt, Human
gaccucuuuucaaggggcuucuau

SEQ ID NO: 466503 - RNA, 21 nt, Human
ggaauaauaaucucuuuagac

SEQ ID NO: 466504 - RNA, 19 nt, Human
gucaauucucucccuuuca

SEQ ID NO: 466505 - RNA, 24 nt, Human
uaaaacacgcuguuaaccuaaagc

SEQ ID NO: 466506 - RNA, 20 nt, Human
uaaacaaacaaagaaggcgu

SEQ ID NO: 466507 - RNA, 23 nt, Human
uaaacaaagauccaguuggcaag

SEQ ID NO: 466508 - RNA, 22 nt, Human
uaaagcagcaacuuaaacaaac

SEQ ID NO: 466509 - RNA, 26 nt, Human
uaaauaagucacauuacaaacaauac

SEQ ID NO: 466510 - RNA, 19 nt, Human
uaacaagagcaucaccauc

SEQ ID NO: 466511 - RNA, 21 nt, Human
uaacagaaaaaguuaucccuc

SEQ ID NO: 466512 - RNA, 20 nt, Human
uaacagaacagacuuaaaaa

SEQ ID NO: 466513 - RNA, 20 nt, Human
uaacuuaaacaucacaacaa

SEQ ID NO: 466514 - RNA, 20 nt, Human
uaagaaguaauccagccuga

SEQ ID NO: 466515 - RNA, 21 nt, Human
uaagaaguaauccagccugaa

SEQ ID NO: 466516 - RNA, 22 nt, Human
uaagcuaaagaaaaccuucaca

SEQ ID NO: 466517 - RNA, 19 nt, Human
uaauuucucacuguaucuc

SEQ ID NO: 466518 - RNA, 24 nt, Human
uacaaacaauacccaagaaaggua

SEQ ID NO: 466519 - RNA, 21 nt, Human
uacuaauaaaaacagugaaag

SEQ ID NO: 466520 - RNA, 20 nt, Human
uacuuuugucccaguaauua

SEQ ID NO: 466521 - RNA, 23 nt, Human
uauuuuuuaaagacaaaaaaaaa

SEQ ID NO: 466522 - RNA, 18 nt, Human
ucaaaaauuugucugcau

SEQ ID NO: 466523 - RNA, 20 nt, Human
ucaaauacuacagacuguuc

SEQ ID NO: 466524 - RNA, 20 nt, Human
ucacauauguauuaccucuu

SEQ ID NO: 466525 - RNA, 25 nt, Human
ucacauuacaaacaauacccaagaa

SEQ ID NO: 466526 - RNA, 18 nt, Human
ucauugaguuaguaacua

SEQ ID NO: 466527 - RNA, 18 nt, Human
uccacacuccugagcuuc

SEQ ID NO: 466528 - RNA, 20 nt, Human
ucccaccuaaggaacugggc

SEQ ID NO: 466529 - RNA, 19 nt, Human
ucccaguaauuaaucuugu

SEQ ID NO: 466530 - RNA, 29 nt, Human
ucccauuaauauuuucucccucccccaag

SEQ ID NO: 466531 - RNA, 24 nt, Human
uccugagcuucaggcacagacccc

SEQ ID NO: 466532 - RNA, 20 nt, Human
ucucccuuucaaaaagaaac

SEQ ID NO: 466533 - RNA, 20 nt, Human
ugaauagcuaauugugcaga

SEQ ID NO: 466534 - RNA, 25 nt, Human
ugaaugccuuucccauuaauauuuu

SEQ ID NO: 466535 - RNA, 18 nt, Human
uggcauuauaaauagaca

SEQ ID NO: 466536 - RNA, 18 nt, Human
uuaaacaaacaaagaagg

SEQ ID NO: 466537 - RNA, 25 nt, Human
uuaggcuuucauuccuaucccaccu

SEQ ID NO: 466538 - RNA, 25 nt, Human
uucaaaaaccuaacaaaguuauaaa

SEQ ID NO: 466539 - RNA, 21 nt, Human
uucaaagaacaacaacaaaaa

SEQ ID NO: 466540 - RNA, 18 nt, Human
uugaaaauucucuuccca

SEQ ID NO: 466541 - RNA, 20 nt, Human
uugcaaaaaaagauccugua

SEQ ID NO: 466542 - RNA, 22 nt, Human
uuguagccaauacaaagcaaac

SEQ ID NO: 466543 - RNA, 21 nt, Human
uuuagacuuaaccaauuagau

SEQ ID NO: 466544 - RNA, 21 nt, Human
uuucaaaaagaaacauguucc

SEQ ID NO: 466545 - RNA, 19 nt, Human
uuucugaaugccuuuccca

SEQ ID NO: 466546 - RNA, 21 nt, Human
uuuuuaggaucuuuagacugu

SEQ ID NO: 466547 - RNA, 20 nt, Human
aaaaaaaaauucuuuuaaaa

SEQ ID NO: 466548 - RNA, 22 nt, Human
aaaaaaaauucuuuuaaacuca

SEQ ID NO: 466549 - RNA, 22 nt, Human
aaaacuucccccguccccaugg

SEQ ID NO: 466550 - RNA, 19 nt, Human
aaacaaaaguaccuaauga

SEQ ID NO: 466551 - RNA, 19 nt, Human
aaacaccuguaaugcacuu

SEQ ID NO: 466552 - RNA, 18 nt, Human
aaacucaguucauccugc

SEQ ID NO: 466553 - RNA, 24 nt, Human
aaacuggcaagaguauuaacccug

SEQ ID NO: 466554 - RNA, 19 nt, Human
aaagaacuucagcucagag

SEQ ID NO: 466555 - RNA, 18 nt, Human
aacacagugcaucaucuc

SEQ ID NO: 466556 - RNA, 20 nt, Human
aaccauagcaucuauauuuc

SEQ ID NO: 466557 - RNA, 18 nt, Human
aagaagaaagaaagagca

SEQ ID NO: 466558 - RNA, 19 nt, Human
aagaagaaagaaagagcag

SEQ ID NO: 466559 - RNA, 18 nt, Human
aagaucccccaaacaaga

SEQ ID NO: 466560 - RNA, 23 nt, Human
aagcaccauuuuguuagaacuca

SEQ ID NO: 466561 - RNA, 18 nt, Human
aagcuaaagcuauuguuc

SEQ ID NO: 466562 - RNA, 20 nt, Human
aaugacaaagaagaaagaaa

SEQ ID NO: 466563 - RNA, 23 nt, Human
acaaaccauauagauuuaaacca

SEQ ID NO: 466564 - RNA, 19 nt, Human
acacauuuccucugucugu

SEQ ID NO: 466565 - RNA, 21 nt, Human
acagagcaagccuuugcaggg

SEQ ID NO: 466566 - RNA, 18 nt, Human
acaguggugguaaaaagc

SEQ ID NO: 466567 - RNA, 20 nt, Human
acccagccugccagggaagg

SEQ ID NO: 466568 - RNA, 26 nt, Human
acccuuucucugaggcuuuggggccu

SEQ ID NO: 466569 - RNA, 21 nt, Human
accgaaggcagagaccagaug

SEQ ID NO: 466570 - RNA, 23 nt, Human
accgcagcccacuuccccacauc

SEQ ID NO: 466571 - RNA, 25 nt, Human
acgaaauccccaccguggcacgcca

SEQ ID NO: 466572 - RNA, 25 nt, Human
acuagcucccuacuuggugugugcg

SEQ ID NO: 466573 - RNA, 18 nt, Human
agaaaaugcacaaaccau

SEQ ID NO: 466574 - RNA, 20 nt, Human
agaaagcuguguuuuccugu

SEQ ID NO: 466575 - RNA, 23 nt, Human
agaaaucuuguaauuccagaauu

SEQ ID NO: 466576 - RNA, 20 nt, Human
agacagagaacaaaaguucc

SEQ ID NO: 466577 - RNA, 19 nt, Human
agacaugaggccucccaga

SEQ ID NO: 466578 - RNA, 21 nt, Human
agagaagauauucaggggagc

SEQ ID NO: 466579 - RNA, 20 nt, Human
agauaagagcaacagcacaa

SEQ ID NO: 466580 - RNA, 19 nt, Human
agcaaaaauaaacaggaga

SEQ ID NO: 466581 - RNA, 24 nt, Human
agcagugauggcaccugaaauuca

SEQ ID NO: 466582 - RNA, 18 nt, Human
agcucggagcacuggcau

SEQ ID NO: 466583 - RNA, 24 nt, Human
agcucggagcacuggcauuccggg

SEQ ID NO: 466584 - RNA, 24 nt, Human
agcugcuagaaagcuguguuuucc

SEQ ID NO: 466585 - RNA, 21 nt, Human
agcugggccccaaggggagcu

SEQ ID NO: 466586 - RNA, 19 nt, Human
agcugggugugugagaugu

SEQ ID NO: 466587 - RNA, 22 nt, Human
agcuguugagcagggguggagu

SEQ ID NO: 466588 - RNA, 21 nt, Human
aggaauguguuccagugcccc

SEQ ID NO: 466589 - RNA, 21 nt, Human
aggacacaaaggcugagggcu

SEQ ID NO: 466590 - RNA, 19 nt, Human
aggauaggcacauaacaga

SEQ ID NO: 466591 - RNA, 19 nt, Human
aggaugaaguggaggcggg

SEQ ID NO: 466592 - RNA, 20 nt, Human
aggcgagaagcccagcggcg

SEQ ID NO: 466593 - RNA, 22 nt, Human
aggcggggccacaggcagggug

SEQ ID NO: 466594 - RNA, 22 nt, Human
aggggagcugaggggugagcug

SEQ ID NO: 466595 - RNA, 21 nt, Human
aguugagaaaaugcacaaacc

SEQ ID NO: 466596 - RNA, 23 nt, Human
auagauuuaaaccauggguuuug

SEQ ID NO: 466597 - RNA, 22 nt, Human
aucaacuguggacuaugaacug

SEQ ID NO: 466598 - RNA, 18 nt, Human
aucugugaacaaaucccu

SEQ ID NO: 466599 - RNA, 20 nt, Human
augcaguucauccccacauu

SEQ ID NO: 466600 - RNA, 24 nt, Human
auuugcauuuauuuaagugcugau

SEQ ID NO: 466601 - RNA, 22 nt, Human
caaagacagguuguccuugaau

SEQ ID NO: 466602 - RNA, 23 nt, Human
caaaguaacagcaaaaauaaaca

SEQ ID NO: 466603 - RNA, 20 nt, Human
caacugaaaacuggagacca

SEQ ID NO: 466604 - RNA, 24 nt, Human
caagagucucccagaauuauugac

SEQ ID NO: 466605 - RNA, 21 nt, Human
caagggcuugugaugaggaug

SEQ ID NO: 466606 - RNA, 19 nt, Human
caaggggagcugaggggug

SEQ ID NO: 466607 - RNA, 22 nt, Human
caaggggagcugaggggugagc

SEQ ID NO: 466608 - RNA, 24 nt, Human
caaggggagcugaggggugagcug

SEQ ID NO: 466609 - RNA, 25 nt, Human
cacacagcuuccacuucaggaacau

SEQ ID NO: 466610 - RNA, 25 nt, Human
cacauuacccaaacauaacgucgua

SEQ ID NO: 466611 - RNA, 20 nt, Human
caccuuguggcccuucaacc

SEQ ID NO: 466612 - RNA, 20 nt, Human
caccuuguggcccuucaacc

SEQ ID NO: 466613 - RNA, 18 nt, Human
cacuucaggaacaucaaa

SEQ ID NO: 466614 - RNA, 21 nt, Human
cagagaaggacacaaaggcug

SEQ ID NO: 466615 - RNA, 23 nt, Human
cagccugccagggaagguuuuga

SEQ ID NO: 466616 - RNA, 19 nt, Human
cagcucagaggaauagugg

SEQ ID NO: 466617 - RNA, 21 nt, Human
cagcucagaggaauagugggc

SEQ ID NO: 466618 - RNA, 19 nt, Human
cauccccacauuacccaaa

SEQ ID NO: 466619 - RNA, 19 nt, Human
cauguggcuggcccuuccu

SEQ ID NO: 466620 - RNA, 20 nt, Human
ccagaguuccaacugaaaac

SEQ ID NO: 466621 - RNA, 21 nt, Human
ccagcggcgacaggagcuucu

SEQ ID NO: 466622 - RNA, 25 nt, Human
ccagcggcgacaggagcuucuaucu

SEQ ID NO: 466623 - RNA, 22 nt, Human
ccccacauuacccaaacauaac

SEQ ID NO: 466624 - RNA, 19 nt, Human
ccccacugugccacgcccg

SEQ ID NO: 466625 - RNA, 18 nt, Human
cccuagccccguagauua

SEQ ID NO: 466626 - RNA, 19 nt, Human
cccucuuccuucccuccuu

SEQ ID NO: 466627 - RNA, 23 nt, Human
cccuggcuuguucugcugcugaa

SEQ ID NO: 466628 - RNA, 24 nt, Human
cccuuguggguuccacagaggggu

SEQ ID NO: 466629 - RNA, 19 nt, Human
ccguagucaaguguguggu

SEQ ID NO: 466630 - RNA, 20 nt, Human
ccuccugcauccuuucucaa

SEQ ID NO: 466631 - RNA, 21 nt, Human
ccucuuccuucccuccuuacc

SEQ ID NO: 466632 - RNA, 19 nt, Human
ccugagcugucugguuggg

SEQ ID NO: 466633 - RNA, 23 nt, Human
ccuguaaugcacuucaagcaacu

SEQ ID NO: 466634 - RNA, 19 nt, Human
cgaucucugagccuucccu

SEQ ID NO: 466635 - RNA, 18 nt, Human
cgcccuagccccguagau

SEQ ID NO: 466636 - RNA, 18 nt, Human
cggaauuggucacauugg

SEQ ID NO: 466637 - RNA, 28 nt, Human
cgugucucugugugugugugugugugug

SEQ ID NO: 466638 - RNA, 22 nt, Human
cuaaugaucaucuccauccauc

SEQ ID NO: 466639 - RNA, 20 nt, Human
cucaaaggacaacaaagcug

SEQ ID NO: 466640 - RNA, 24 nt, Human
cucaaaggacaacaaagcugcacc

SEQ ID NO: 466641 - RNA, 24 nt, Human
cucugcgggaggcgagaagcccag

SEQ ID NO: 466642 - RNA, 22 nt, Human
cugagccuucccuccucacagu

SEQ ID NO: 466643 - RNA, 19 nt, Human
cugcagggcuuccucuguc

SEQ ID NO: 466644 - RNA, 22 nt, Human
cugcguuggggcugugggaagc

SEQ ID NO: 466645 - RNA, 21 nt, Human
cugggccccaaggggagcuga

SEQ ID NO: 466646 - RNA, 23 nt, Human
cuugcaaggccgacagugaccgc

SEQ ID NO: 466647 - RNA, 27 nt, Human
gaaaagaacugcuugccaccuugcaga

SEQ ID NO: 466648 - RNA, 18 nt, Human
gaaaagacaaagcaacuu

SEQ ID NO: 466649 - RNA, 23 nt, Human
gaaaauaccugcauguuccaagg

SEQ ID NO: 466650 - RNA, 22 nt, Human
gaaguuuugccaaauggacacu

SEQ ID NO: 466651 - RNA, 22 nt, Human
gacacauuuccucugucuguuc

SEQ ID NO: 466652 - RNA, 21 nt, Human
gagaagcuaagaagagaaaua

SEQ ID NO: 466653 - RNA, 21 nt, Human
gagcacuggcauuccgggcag

SEQ ID NO: 466654 - RNA, 18 nt, Human
gagccuucccuccucaca

SEQ ID NO: 466655 - RNA, 20 nt, Human
gagcucggagcacuggcauu

SEQ ID NO: 466656 - RNA, 21 nt, Human
gaugaggauggaaaagacaaa

SEQ ID NO: 466657 - RNA, 22 nt, Human
gcacaaaaccuccaucuuuccu

SEQ ID NO: 466658 - RNA, 20 nt, Human
gcggggccacaggcagggug

SEQ ID NO: 466659 - RNA, 25 nt, Human
ggcaaaaccagaaacagcagggacu

SEQ ID NO: 466660 - RNA, 19 nt, Human
ggcaggaugaaguggaggc

SEQ ID NO: 466661 - RNA, 19 nt, Human
ggccgacagugaccgcagc

SEQ ID NO: 466662 - RNA, 20 nt, Human
gggaagauggcauguggcug

SEQ ID NO: 466663 - RNA, 21 nt, Human
gggaagccaaggacagaaaug

SEQ ID NO: 466664 - RNA, 22 nt, Human
gggccuuggagggagacacauu

SEQ ID NO: 466665 - RNA, 20 nt, Human
ggggagcugaggggugagcu

SEQ ID NO: 466666 - RNA, 23 nt, Human
gggugccccuuuggaauggggag

SEQ ID NO: 466667 - RNA, 19 nt, Human
gucucuguguggcccucug

SEQ ID NO: 466668 - RNA, 23 nt, Human
gugaugaggauggaaaagacaaa

SEQ ID NO: 466669 - RNA, 24 nt, Human
guggaggcggggccacaggcaggg

SEQ ID NO: 466670 - RNA, 21 nt, Human
uaaaaucucaggaugcugcau

SEQ ID NO: 466671 - RNA, 18 nt, Human
uaaggcaaaaccagaaac

SEQ ID NO: 466672 - RNA, 20 nt, Human
uaaggcaaaaccagaaacac

SEQ ID NO: 466673 - RNA, 22 nt, Human
uaaggcaaaaccagaaacaccc

SEQ ID NO: 466674 - RNA, 18 nt, Human
uaauucaagcuuaagcca

SEQ ID NO: 466675 - RNA, 24 nt, Human
uagaaagcuguguuuuccuguuuu

SEQ ID NO: 466676 - RNA, 19 nt, Human
uagaauccucugaauggcc

SEQ ID NO: 466677 - RNA, 23 nt, Human
uaugaaaauagugucuuugauua

SEQ ID NO: 466678 - RNA, 21 nt, Human
uauucaguuuuuuccaagagu

SEQ ID NO: 466679 - RNA, 19 nt, Human
ucaaaacacagugcaucau

SEQ ID NO: 466680 - RNA, 22 nt, Human
ucaaaugacaaagaagaaagaa

SEQ ID NO: 466681 - RNA, 23 nt, Human
ucaauccuaaucagcaugagcaa

SEQ ID NO: 466682 - RNA, 18 nt, Human
ucacgaaauccccaccgu

SEQ ID NO: 466683 - RNA, 20 nt, Human
ucauccuaggaagagaaaca

SEQ ID NO: 466684 - RNA, 21 nt, Human
uccacuuuuuugccugaucgc

SEQ ID NO: 466685 - RNA, 22 nt, Human
ucccagagauacucagguaacu

SEQ ID NO: 466686 - RNA, 19 nt, Human
uccccacauuacccaaaca

SEQ ID NO: 466687 - RNA, 22 nt, Human
ucccuacuuggugugugcgcca

SEQ ID NO: 466688 - RNA, 25 nt, Human
uccuccaccacuggcuaacagacag

SEQ ID NO: 466689 - RNA, 22 nt, Human
uccuuaagcaaacugccugacu

SEQ ID NO: 466690 - RNA, 20 nt, Human
uccuugaauuuguuuccuug

SEQ ID NO: 466691 - RNA, 24 nt, Human
ucugugugugugugugugugugug

SEQ ID NO: 466692 - RNA, 19 nt, Human
ucuuuacauugucugcuuu

SEQ ID NO: 466693 - RNA, 19 nt, Human
ugaaaagggagggggagua

SEQ ID NO: 466694 - RNA, 26 nt, Human
ugaacaggucaccugggcagaaacac

SEQ ID NO: 466695 - RNA, 20 nt, Human
ugaccgcagcccacuucccc

SEQ ID NO: 466696 - RNA, 26 nt, Human
ugacuucacaaacaccuguaaugcac

SEQ ID NO: 466697 - RNA, 18 nt, Human
ugacuuuuuaauuccacu

SEQ ID NO: 466698 - RNA, 25 nt, Human
ugagaaaaugcacaaaccauauaga

SEQ ID NO: 466699 - RNA, 18 nt, Human
ugagaugacuuuaaaaag

SEQ ID NO: 466700 - RNA, 28 nt, Human
ugaggauauaauuuaaauggcuuuuccc

SEQ ID NO: 466701 - RNA, 19 nt, Human
ugaggaugguggcugguga

SEQ ID NO: 466702 - RNA, 18 nt, Human
ugaggggagggagagagu

SEQ ID NO: 466703 - RNA, 25 nt, Human
ugaggggagggagagaguugguccu

SEQ ID NO: 466704 - RNA, 21 nt, Human
ugaggggugagcugcagccac

SEQ ID NO: 466705 - RNA, 18 nt, Human
ugauuuagacaauggaga

SEQ ID NO: 466706 - RNA, 19 nt, Human
ugcaaauaaacccaaggcu

SEQ ID NO: 466707 - RNA, 23 nt, Human
ugcagggcuuccucugucugagc

SEQ ID NO: 466708 - RNA, 19 nt, Human
ugcaucaugaugcuauggc

SEQ ID NO: 466709 - RNA, 23 nt, Human
uggaagugagcagagaagauauu

SEQ ID NO: 466710 - RNA, 21 nt, Human
uggcauguggcuggcccuucc

SEQ ID NO: 466711 - RNA, 20 nt, Human
uggccagacagauggcugcu

SEQ ID NO: 466712 - RNA, 18 nt, Human
uggcgagcugggugugug

SEQ ID NO: 466713 - RNA, 25 nt, Human
uggcuuguucugcugcugaacaggu

SEQ ID NO: 466714 - RNA, 19 nt, Human
ugggaguggugugcaagag

SEQ ID NO: 466715 - RNA, 21 nt, Human
ugggaguggugugcaagagaa

SEQ ID NO: 466716 - RNA, 19 nt, Human
ugggcaaaaucugcugaaa

SEQ ID NO: 466717 - RNA, 22 nt, Human
ugggccccaaggggagcugagg

SEQ ID NO: 466718 - RNA, 22 nt, Human
ugucuccuucaccccaaaugau

SEQ ID NO: 466719 - RNA, 18 nt, Human
ugugugugugugugugug

SEQ ID NO: 466720 - RNA, 18 nt, Human
ugugugugugugugugug

SEQ ID NO: 466721 - RNA, 18 nt, Human
ugugugugugugugugug

SEQ ID NO: 466722 - RNA, 18 nt, Human
ugugugugugugugugug

SEQ ID NO: 466723 - RNA, 18 nt, Human
ugugugugugugugugug

SEQ ID NO: 466724 - RNA, 18 nt, Human
ugugugugugugugugug

SEQ ID NO: 466725 - RNA, 18 nt, Human
ugugugugugugugugug

SEQ ID NO: 466726 - RNA, 18 nt, Human
ugugugugugugugugug

SEQ ID NO: 466727 - RNA, 21 nt, Human
ugugugugugugugugugugu

SEQ ID NO: 466728 - RNA, 21 nt, Human
ugugugugugugugugugugu

SEQ ID NO: 466729 - RNA, 21 nt, Human
ugugugugugugugugugugu

SEQ ID NO: 466730 - RNA, 21 nt, Human
ugugugugugugugugugugu

SEQ ID NO: 466731 - RNA, 21 nt, Human
ugugugugugugugugugugu

SEQ ID NO: 466732 - RNA, 21 nt, Human
ugugugugugugugugugugu

SEQ ID NO: 466733 - RNA, 21 nt, Human
ugugugugugugugugugugu

SEQ ID NO: 466734 - RNA, 22 nt, Human
ugugugugugugugugugugug

SEQ ID NO: 466735 - RNA, 22 nt, Human
ugugugugugugugugugugug

SEQ ID NO: 466736 - RNA, 22 nt, Human
ugugugugugugugugugugug

SEQ ID NO: 466737 - RNA, 22 nt, Human
ugugugugugugugugugugug

SEQ ID NO: 466738 - RNA, 22 nt, Human
ugugugugugugugugugugug

SEQ ID NO: 466739 - RNA, 22 nt, Human
ugugugugugugugugugugug

SEQ ID NO: 466740 - RNA, 24 nt, Human
uuaaacucaguucauccugcaaaa

SEQ ID NO: 466741 - RNA, 21 nt, Human
uuaucugugggaauuguccuc

SEQ ID NO: 466742 - RNA, 20 nt, Human
uucaaaacacagugcaucau

SEQ ID NO: 466743 - RNA, 22 nt, Human
uucacacaucaccuagagucuc

SEQ ID NO: 466744 - RNA, 21 nt, Human
uucauccuaggaagagaaaca

SEQ ID NO: 466745 - RNA, 22 nt, Human
uucauugucuugguguccaucu

SEQ ID NO: 466746 - RNA, 18 nt, Human
uuccaacugaaaacugga

SEQ ID NO: 466747 - RNA, 20 nt, Human
uuguccuugaauuuguuucc

SEQ ID NO: 466748 - RNA, 21 nt, Human
uuuagcaagacuugugcuggc

SEQ ID NO: 466749 - RNA, 21 nt, Human
uuugaccaaaaaaccagaucu

SEQ ID NO: 466750 - RNA, 20 nt, Human
uuugcuaagauuccagucca

SEQ ID NO: 466751 - RNA, 26 nt, Human
uuuuuugucaaaucucaucucuguuc

SEQ ID NO: 466752 - RNA, 22 nt, Human
aaaaagaaacaaauuuccaccu

SEQ ID NO: 466753 - RNA, 18 nt, Human
aaacaaauuuccaccucu

SEQ ID NO: 466754 - RNA, 24 nt, Human
aaaguccugggauuauaggcauga

SEQ ID NO: 466755 - RNA, 27 nt, Human
acaaacuuaaaaaaagaaacaaauuuc

SEQ ID NO: 466756 - RNA, 22 nt, Human
accucuucccugucuccuguua

SEQ ID NO: 466757 - RNA, 22 nt, Human
accuuggccccucccucuuucc

SEQ ID NO: 466758 - RNA, 24 nt, Human
acgauguuuugccauguuggucag

SEQ ID NO: 466759 - RNA, 25 nt, Human
acucuguugcccaggcuggagugca

SEQ ID NO: 466760 - RNA, 22 nt, Human
acugcaaccuccaccuccuggg

SEQ ID NO: 466761 - RNA, 19 nt, Human
acuugcagagccuuuugcu

SEQ ID NO: 466762 - RNA, 21 nt, Human
agaaccgcucacucgaccccc

SEQ ID NO: 466763 - RNA, 19 nt, Human
agacgauguuuugccaugu

SEQ ID NO: 466764 - RNA, 21 nt, Human
agagugugcacauaagcaaaa

SEQ ID NO: 466765 - RNA, 18 nt, Human
agcggcagcagccgggca

SEQ ID NO: 466766 - RNA, 18 nt, Human
agcgggccugcaaaagau

SEQ ID NO: 466767 - RNA, 21 nt, Human
aggcaugagcuaccacauccc

SEQ ID NO: 466768 - RNA, 25 nt, Human
aggcuggagugcaguggcaggaucu

SEQ ID NO: 466769 - RNA, 21 nt, Human
agggaggugagaaguuggaaa

SEQ ID NO: 466770 - RNA, 18 nt, Human
aguagcugggauuacagg

SEQ ID NO: 466771 - RNA, 23 nt, Human
agugcaguggcaggaucucagcu

SEQ ID NO: 466772 - RNA, 18 nt, Human
aucucauucauugagaag

SEQ ID NO: 466773 - RNA, 24 nt, Human
augauccguccaccucagcuuccc

SEQ ID NO: 466774 - RNA, 24 nt, Human
auucuguauuaucuuccagccuca

SEQ ID NO: 466775 - RNA, 24 nt, Human
caaaguccugggauuauaggcaug

SEQ ID NO: 466776 - RNA, 20 nt, Human
caaccuccaccuccuggguu

SEQ ID NO: 466777 - RNA, 23 nt, Human
caaccuccaccuccuggguucaa

SEQ ID NO: 466778 - RNA, 24 nt, Human
caccucagcuucccaaaguccugg

SEQ ID NO: 466779 - RNA, 24 nt, Human
cacucuguugcccaggcuggagug

SEQ ID NO: 466780 - RNA, 21 nt, Human
cacuugcagagccuuuugcug

SEQ ID NO: 466781 - RNA, 19 nt, Human
cagcggcagcagccgggca

SEQ ID NO: 466782 - RNA, 21 nt, Human
cagcuaacugcaaccuccacc

SEQ ID NO: 466783 - RNA, 24 nt, Human
cagcuucuuaagcccccagauccc

SEQ ID NO: 466784 - RNA, 21 nt, Human
caggcgcccaacaccacgccu

SEQ ID NO: 466785 - RNA, 25 nt, Human
caggggcguccggagcaaagaagcu

SEQ ID NO: 466786 - RNA, 27 nt, Human
caguagcugggauuacaggcgcccaac

SEQ ID NO: 466787 - RNA, 22 nt, Human
caucccgccagcaccuggcacu

SEQ ID NO: 466788 - RNA, 24 nt, Human
cauguuggucaggcuggucuugaa

SEQ ID NO: 466789 - RNA, 22 nt, Human
cauucuguauuaucuuccagcc

SEQ ID NO: 466790 - RNA, 18 nt, Human
ccaaaguccugggauuau

SEQ ID NO: 466791 - RNA, 24 nt, Human
ccaaaguccugggauuauaggcau

SEQ ID NO: 466792 - RNA, 19 nt, Human
ccaacaccacgccugucua

SEQ ID NO: 466793 - RNA, 24 nt, Human
ccaccuccuggguucaagcgauuc

SEQ ID NO: 466794 - RNA, 21 nt, Human
ccaguagcugggauuacaggc

SEQ ID NO: 466795 - RNA, 19 nt, Human
ccauguuggucaggcuggu

SEQ ID NO: 466796 - RNA, 21 nt, Human
ccauguuggucaggcuggucu

SEQ ID NO: 466797 - RNA, 21 nt, Human
ccauguuggucaggcuggucu

SEQ ID NO: 466798 - RNA, 18 nt, Human
cccaacaccacgccuguc

SEQ ID NO: 466799 - RNA, 22 nt, Human
cccaacaccacgccugucuaau

SEQ ID NO: 466800 - RNA, 23 nt, Human
cccaguagcugggauuacaggcg

SEQ ID NO: 466801 - RNA, 23 nt, Human
ccccagccuacaguugugggguc

SEQ ID NO: 466802 - RNA, 23 nt, Human
ccccaguagcugggauuacaggc

SEQ ID NO: 466803 - RNA, 25 nt, Human
cccccagccuacaguuguggggucu

SEQ ID NO: 466804 - RNA, 18 nt, Human
cccucgcggcugcccgcc

SEQ ID NO: 466805 - RNA, 22 nt, Human
ccgcgucccggcuuuccucagc

SEQ ID NO: 466806 - RNA, 19 nt, Human
ccggagcaaagaagcucuc

SEQ ID NO: 466807 - RNA, 30 nt, Human
ccuaaaaacacaaacuuaaaaaaagaaaca

SEQ ID NO: 466808 - RNA, 19 nt, Human
ccuccaccuccuggguuca

SEQ ID NO: 466809 - RNA, 24 nt, Human
ccuccuggguucaagcgauucucc

SEQ ID NO: 466810 - RNA, 24 nt, Human
ccugaccucaaaugauccguccac

SEQ ID NO: 466811 - RNA, 23 nt, Human
ccugggacauucuguauuaucuu

SEQ ID NO: 466812 - RNA, 24 nt, Human
cgauguuuugccauguuggucagg

SEQ ID NO: 466813 - RNA, 21 nt, Human
cgccucagccuccccaguagc

SEQ ID NO: 466814 - RNA, 24 nt, Human
cgccucagccuccccaguagcugg

SEQ ID NO: 466815 - RNA, 23 nt, Human
cggcggggcuccgcgucccggcu

SEQ ID NO: 466816 - RNA, 27 nt, Human
cgucggccccagccucgugccgguucc

SEQ ID NO: 466817 - RNA, 24 nt, Human
cucaaaugauccguccaccucagc

SEQ ID NO: 466818 - RNA, 24 nt, Human
cucacucuguugcccaggcuggag

SEQ ID NO: 466819 - RNA, 23 nt, Human
cucagccuccccaguagcuggga

SEQ ID NO: 466820 - RNA, 21 nt, Human
cucagcuucccaaaguccugg

SEQ ID NO: 466821 - RNA, 21 nt, Human
cuccuggguucaagcgauucu

SEQ ID NO: 466822 - RNA, 18 nt, Human
cugcaaccuccaccuccu

SEQ ID NO: 466823 - RNA, 24 nt, Human
cugcaaccuccaccuccuggguuc

SEQ ID NO: 466824 - RNA, 21 nt, Human
cugcuagaauguaagcugcau

SEQ ID NO: 466825 - RNA, 23 nt, Human
cuguauuaucuuccagccucacg

SEQ ID NO: 466826 - RNA, 19 nt, Human
cuguugcccaggcuggagu

SEQ ID NO: 466827 - RNA, 25 nt, Human
cuuccagccucacgccucaugccuc

SEQ ID NO: 466828 - RNA, 24 nt, Human
cuucuuaagcccccagaucccugc

SEQ ID NO: 466829 - RNA, 18 nt, Human
cuuugaucuacauggagg

SEQ ID NO: 466830 - RNA, 19 nt, Human
cuuugcacuugcagagccu

SEQ ID NO: 466831 - RNA, 19 nt, Human
cuuuugcuggagaccucuu

SEQ ID NO: 466832 - RNA, 22 nt, Human
gaaccgcucacucgacccccca

SEQ ID NO: 466833 - RNA, 22 nt, Human
gaacucagcucaaaaauggaaa

SEQ ID NO: 466834 - RNA, 24 nt, Human
gaccucaaaugauccguccaccuc

SEQ ID NO: 466835 - RNA, 19 nt, Human
gacuugacucaugcaauga

SEQ ID NO: 466836 - RNA, 26 nt, Human
gagcuaccacaucccgccagcaccug

SEQ ID NO: 466837 - RNA, 20 nt, Human
gaggaggugagccugaggcu

SEQ ID NO: 466838 - RNA, 19 nt, Human
gaugcacgugcauauccug

SEQ ID NO: 466839 - RNA, 23 nt, Human
gauguuuugccauguuggucagg

SEQ ID NO: 466840 - RNA, 19 nt, Human
gauuauaggcaugagcuac

SEQ ID NO: 466841 - RNA, 21 nt, Human
gauuauaggcaugagcuacca

SEQ ID NO: 466842 - RNA, 21 nt, Human
gauucucccgccucagccucc

SEQ ID NO: 466843 - RNA, 20 nt, Human
gcagcuucuuaagcccccag

SEQ ID NO: 466844 - RNA, 20 nt, Human
gccauguuggucaggcuggu

SEQ ID NO: 466845 - RNA, 19 nt, Human
gcccaggcuggagugcagu

SEQ ID NO: 466846 - RNA, 23 nt, Human
gccuacaguuguggggucuugcu

SEQ ID NO: 466847 - RNA, 20 nt, Human
gccugaggcuagaaccgcuc

SEQ ID NO: 466848 - RNA, 24 nt, Human
gcgauucucccgccucagccuccc

SEQ ID NO: 466849 - RNA, 23 nt, Human
gcggcagcagccgggcagagcgu

SEQ ID NO: 466850 - RNA, 18 nt, Human
gcuaccacaucccgccag

SEQ ID NO: 466851 - RNA, 24 nt, Human
gcucaagucuguggccgacuugac

SEQ ID NO: 466852 - RNA, 23 nt, Human
gcuggucuugaacuccugaccuc

SEQ ID NO: 466853 - RNA, 24 nt, Human
ggcuggucuugaacuccugaccuc

SEQ ID NO: 466854 - RNA, 19 nt, Human
ggucuugaacuccugaccu

SEQ ID NO: 466855 - RNA, 25 nt, Human
ggucuuugcacuugcagagccuuuu

SEQ ID NO: 466856 - RNA, 27 nt, Human
uaaaaacacaaacuuaaaaaaagaaac

SEQ ID NO: 466857 - RNA, 24 nt, Human
uaacugcaaccuccaccuccuggg

SEQ ID NO: 466858 - RNA, 27 nt, Human
uaacugcaaccuccaccuccuggguuc

SEQ ID NO: 466859 - RNA, 21 nt, Human
uaagcccaaguccagaagcuu

SEQ ID NO: 466860 - RNA, 21 nt, Human
uaauuuuuguauuuuuuuaga

SEQ ID NO: 466861 - RNA, 23 nt, Human
uaccuuggccccucccucuuucc

SEQ ID NO: 466862 - RNA, 19 nt, Human
ucaagcgauucucccgccu

SEQ ID NO: 466863 - RNA, 20 nt, Human
ucagccuccccaguagcugg

SEQ ID NO: 466864 - RNA, 23 nt, Human
ucagcggcagcagccgggcagag

SEQ ID NO: 466865 - RNA, 18 nt, Human
ucagcuucccaaaguccu

SEQ ID NO: 466866 - RNA, 19 nt, Human
ucagcuucccaaaguccug

SEQ ID NO: 466867 - RNA, 21 nt, Human
uccacugcugcaucuuucaga

SEQ ID NO: 466868 - RNA, 24 nt, Human
ucccaaaguccugggauuauaggc

SEQ ID NO: 466869 - RNA, 24 nt, Human
uccccaguagcugggauuacaggc

SEQ ID NO: 466870 - RNA, 21 nt, Human
uccguccaccucagcuuccca

SEQ ID NO: 466871 - RNA, 18 nt, Human
uccugaccucaaaugauc

SEQ ID NO: 466872 - RNA, 21 nt, Human
uccuggguucaagcgauucuc

SEQ ID NO: 466873 - RNA, 24 nt, Human
uccuggguucaagcgauucucccg

SEQ ID NO: 466874 - RNA, 23 nt, Human
ucucacucuguugcccaggcugg

SEQ ID NO: 466875 - RNA, 24 nt, Human
ucucacucuguugcccaggcugga

SEQ ID NO: 466876 - RNA, 26 nt, Human
ucucacucuguugcccaggcuggagu

SEQ ID NO: 466877 - RNA, 27 nt, Human
ucucacucuguugcccaggcuggagug

SEQ ID NO: 466878 - RNA, 23 nt, Human
ucucagcuaacugcaaccuccac

SEQ ID NO: 466879 - RNA, 25 nt, Human
ucucccgccucagccuccccaguag

SEQ ID NO: 466880 - RNA, 24 nt, Human
ucuguaagcccaaguccagaagcu

SEQ ID NO: 466881 - RNA, 18 nt, Human
ucuguugcccaggcugga

SEQ ID NO: 466882 - RNA, 24 nt, Human
ucuguugcccaggcuggagugcag

SEQ ID NO: 466883 - RNA, 19 nt, Human
ucuugaacuccugaccuca

SEQ ID NO: 466884 - RNA, 22 nt, Human
ugaauaaauagaugguuggaug

SEQ ID NO: 466885 - RNA, 19 nt, Human
ugaccucaaaugauccguc

SEQ ID NO: 466886 - RNA, 20 nt, Human
ugagaaguuggaaauagcuu

SEQ ID NO: 466887 - RNA, 21 nt, Human
ugagaaguuggaaauagcuug

SEQ ID NO: 466888 - RNA, 22 nt, Human
ugagaaguuggaaauagcuugu

SEQ ID NO: 466889 - RNA, 21 nt, Human
ugaguugucaacuuaaaaucu

SEQ ID NO: 466890 - RNA, 23 nt, Human
ugauccguccaccucagcuuccc

SEQ ID NO: 466891 - RNA, 22 nt, Human
ugcacauaagcaaaaauuauuc

SEQ ID NO: 466892 - RNA, 24 nt, Human
ugccauguuggucaggcuggucuu

SEQ ID NO: 466893 - RNA, 18 nt, Human
ugcccaggcuggagugca

SEQ ID NO: 466894 - RNA, 21 nt, Human
ugcccaggcuggagugcagug

SEQ ID NO: 466895 - RNA, 22 nt, Human
ugcccaggcuggagugcagugg

SEQ ID NO: 466896 - RNA, 24 nt, Human
ugcccaggcuggagugcaguggca

SEQ ID NO: 466897 - RNA, 20 nt, Human
ugccuggaggaccgccgugg

SEQ ID NO: 466898 - RNA, 21 nt, Human
uggaaauuuuccagguacuga

SEQ ID NO: 466899 - RNA, 23 nt, Human
uggagugcaguggcaggaucuca

SEQ ID NO: 466900 - RNA, 24 nt, Human
uggagugcaguggcaggaucucag

SEQ ID NO: 466901 - RNA, 20 nt, Human
uggcaacaccugugcuuggg

SEQ ID NO: 466902 - RNA, 24 nt, Human
uggcaacaccugugcuuggggugc

SEQ ID NO: 466903 - RNA, 24 nt, Human
uggcaggaucucagcuaacugcaa

SEQ ID NO: 466904 - RNA, 19 nt, Human
ugggauuacaggcgcccaa

SEQ ID NO: 466905 - RNA, 22 nt, Human
ugggauuacaggcgcccaacac

SEQ ID NO: 466906 - RNA, 24 nt, Human
ugggauuacaggcgcccaacacca

SEQ ID NO: 466907 - RNA, 18 nt, Human
ugggauuauaggcaugag

SEQ ID NO: 466908 - RNA, 19 nt, Human
ugggauuauaggcaugagc

SEQ ID NO: 466909 - RNA, 22 nt, Human
ugggauuauaggcaugagcuac

SEQ ID NO: 466910 - RNA, 23 nt, Human
ugggauuauaggcaugagcuacc

SEQ ID NO: 466911 - RNA, 24 nt, Human
ugggauuauaggcaugagcuacca

SEQ ID NO: 466912 - RNA, 24 nt, Human
uggucaggcuggucuugaacuccu

SEQ ID NO: 466913 - RNA, 22 nt, Human
ugucaaggucuuugcacuugcc

SEQ ID NO: 466914 - RNA, 20 nt, Human
ugucuuguccacugcugcau

SEQ ID NO: 466915 - RNA, 26 nt, Human
ugucuuguccacugcugcaucuuuca

SEQ ID NO: 466916 - RNA, 21 nt, Human
ugugcacauaagcaaaaauua

SEQ ID NO: 466917 - RNA, 23 nt, Human
uucaagcgauucucccgccucag

SEQ ID NO: 466918 - RNA, 24 nt, Human
uucaagcgauucucccgccucagc

SEQ ID NO: 466919 - RNA, 20 nt, Human
uucccugucuccuguuauuc

SEQ ID NO: 466920 - RNA, 20 nt, Human
uugcagagccuuuugcugga

SEQ ID NO: 466921 - RNA, 21 nt, Human
uugccauguuggucaggcugg

SEQ ID NO: 466922 - RNA, 24 nt, Human
uugccauguuggucaggcuggucu

SEQ ID NO: 466923 - RNA, 24 nt, Human
uugcccaggcuggagugcaguggc

SEQ ID NO: 466924 - RNA, 22 nt, Human
uugcuggagaccucuuuucgag

SEQ ID NO: 466925 - RNA, 21 nt, Human
uuuugagauagucucacucug

SEQ ID NO: 466926 - RNA, 19 nt, Human
uuuuuguauuuuuuuagac

SEQ ID NO: 466927 - RNA, 22 nt, Human
uuuuuuuuuuuuuuuuuuuggg

SEQ ID NO: 466928 - RNA, 26 nt, Human
uuuuuuuuuuuuuuuuuuugguuuuu

SEQ ID NO: 466929 - RNA, 19 nt, Human
aaccucaaccuccugaccc

SEQ ID NO: 466930 - RNA, 20 nt, Human
aaccuccugaccccacaucc

SEQ ID NO: 466931 - RNA, 18 nt, Human
acauuacuggucaagcac

SEQ ID NO: 466932 - RNA, 22 nt, Human
accacauuacuggucaagcacu

SEQ ID NO: 466933 - RNA, 21 nt, Human
accucaaccuccugaccccac

SEQ ID NO: 466934 - RNA, 24 nt, Human
accucaaccuccugaccccacauc

SEQ ID NO: 466935 - RNA, 19 nt, Human
cacauccgaaguugggggc

SEQ ID NO: 466936 - RNA, 19 nt, Human
cagcuacaagucuucccca

SEQ ID NO: 466937 - RNA, 23 nt, Human
ccccagcccugucauaucacuac

SEQ ID NO: 466938 - RNA, 18 nt, Human
ccuguucuugccccagcc

SEQ ID NO: 466939 - RNA, 24 nt, Human
cuaauaaggcagcuagugccccug

SEQ ID NO: 466940 - RNA, 23 nt, Human
cucaacuuuaauguuccucagau

SEQ ID NO: 466941 - RNA, 19 nt, Human
cuccaggagcguggucucc

SEQ ID NO: 466942 - RNA, 23 nt, Human
ggaacauacacaaaauuacaacc

SEQ ID NO: 466943 - RNA, 19 nt, Human
ggagggcacuaaauuagcu

SEQ ID NO: 466944 - RNA, 22 nt, Human
uaauagugaaccucaaccuccu

SEQ ID NO: 466945 - RNA, 20 nt, Human
uacauccgauucucucaaaa

SEQ ID NO: 466946 - RNA, 23 nt, Human
uagaaaaaaauauuuccaaccug

SEQ ID NO: 466947 - RNA, 19 nt, Human
ucagaguuuuaauguauuu

SEQ ID NO: 466948 - RNA, 24 nt, Human
ucuucugagccccugaauugucca

SEQ ID NO: 466949 - RNA, 18 nt, Human
ugagaagacuauuuugug

SEQ ID NO: 466950 - RNA, 20 nt, Human
ugagccccugaauuguccaa

SEQ ID NO: 466951 - RNA, 27 nt, Human
uugccacaguuuuaucuaaagccaggu

SEQ ID NO: 466952 - RNA, 21 nt, Human
cagcggacagggugcuggggc

SEQ ID NO: 466953 - RNA, 18 nt, Human
ccccuggcccucccgggc

SEQ ID NO: 466954 - RNA, 26 nt, Human
cccgcgcugcggcaggggcggcgggg

SEQ ID NO: 466955 - RNA, 24 nt, Human
ccgcccgcgcugcggcaggggcug

SEQ ID NO: 466956 - RNA, 21 nt, Human
ccgggcgccucgugccgaauu

SEQ ID NO: 466957 - RNA, 18 nt, Human
ccgggcugcgggcugcgg

SEQ ID NO: 466958 - RNA, 22 nt, Human
ccucccgggcucuucucuggcc

SEQ ID NO: 466959 - RNA, 23 nt, Human
ccuggcugggggcggcggucgag

SEQ ID NO: 466960 - RNA, 22 nt, Human
cgccccuggcccucccgggcuc

SEQ ID NO: 466961 - RNA, 21 nt, Human
cgcccggaggccguggcgcuc

SEQ ID NO: 466962 - RNA, 18 nt, Human
cgggggcuccggcugcuu

SEQ ID NO: 466963 - RNA, 18 nt, Human
cuccgggcugcgggcugc

SEQ ID NO: 466964 - RNA, 21 nt, Human
cugcgggcugcgggcugcagg

SEQ ID NO: 466965 - RNA, 21 nt, Human
gagcccgcgaucuggcuccgg

SEQ ID NO: 466966 - RNA, 24 nt, Human
gcccggaggccguggcgcucgcgc

SEQ ID NO: 466967 - RNA, 24 nt, Human
gcugggggcggcggucgagucggg

SEQ ID NO: 466968 - RNA, 19 nt, Human
ggcugcaggcugcaggcug

SEQ ID NO: 466969 - RNA, 19 nt, Human
ggcugcgggcugcaggcug

SEQ ID NO: 466970 - RNA, 18 nt, Human
ucccggcucugaggcggc

SEQ ID NO: 466971 - RNA, 21 nt, Human
ugccgggcugcgcgcugaccg

SEQ ID NO: 466972 - RNA, 23 nt, Human
ugccgggcugcgcgcugaccgcc

SEQ ID NO: 466973 - RNA, 18 nt, Human
ugcgggugccgggcugcg

SEQ ID NO: 466974 - RNA, 21 nt, Human
ugcgggugccgggcugcgcgc

SEQ ID NO: 466975 - RNA, 18 nt, Human
uggcagaguccaggcgcg

SEQ ID NO: 466976 - RNA, 18 nt, Human
uuuuuuuuuuuuuugccu

SEQ ID NO: 466977 - RNA, 20 nt, Human
uuuuuuuuuuuuuugccugg

SEQ ID NO: 466978 - RNA, 18 nt, Human
uuuuuuuuuuuuuuuuug

SEQ ID NO: 466979 - RNA, 21 nt, Human
uuuuuuuuuuuuuuuuugccu

SEQ ID NO: 466980 - RNA, 24 nt, Human
uuuuuuuuuuuuuuuuugccuggg

SEQ ID NO: 466981 - RNA, 18 nt, Human
aaaauagguccaagagag

SEQ ID NO: 466982 - RNA, 24 nt, Human
aaaugcccccacacuccugggucc

SEQ ID NO: 466983 - RNA, 24 nt, Human
aacagagcaagacucugucucaag

SEQ ID NO: 466984 - RNA, 23 nt, Human
aagaaucgcuugaacccgggagg

SEQ ID NO: 466985 - RNA, 21 nt, Human
aauauggugaaaccccaucuc

SEQ ID NO: 466986 - RNA, 24 nt, Human
aaucgcuugaacccgggaggcaga

SEQ ID NO: 466987 - RNA, 18 nt, Human
aauuagccaggcauggua

SEQ ID NO: 466988 - RNA, 21 nt, Human
acagaacccuugaccuggcca

SEQ ID NO: 466989 - RNA, 24 nt, Human
acagagcaagacucugucucaaga

SEQ ID NO: 466990 - RNA, 24 nt, Human
accacugcacucuagccugggcaa

SEQ ID NO: 466991 - RNA, 19 nt, Human
accagagaucaccccccgg

SEQ ID NO: 466992 - RNA, 24 nt, Human
accagcugcaccugaacacccaga

SEQ ID NO: 466993 - RNA, 19 nt, Human
acccagaacacaggccccc

SEQ ID NO: 466994 - RNA, 23 nt, Human
acccagaacacaggcccccauga

SEQ ID NO: 466995 - RNA, 24 nt, Human
accccaucucuacuaaaaauacaa

SEQ ID NO: 466996 - RNA, 20 nt, Human
acccccaggcccagcagagg

SEQ ID NO: 466997 - RNA, 22 nt, Human
accugccccugccaccgggacc

SEQ ID NO: 466998 - RNA, 24 nt, Human
acugcacucuagccugggcaacag

SEQ ID NO: 466999 - RNA, 24 nt, Human
acugcacucuagccugggcaacag

SEQ ID NO: 467000 - RNA, 25 nt, Human
agaagggcaggccaccuggguuugg

SEQ ID NO: 467001 - RNA, 22 nt, Human
agagaucaccccccggggcacc

SEQ ID NO: 467002 - RNA, 22 nt, Human
agagguugcagugaacugagau

SEQ ID NO: 467003 - RNA, 24 nt, Human
agagguugcagugaacugagauug

SEQ ID NO: 467004 - RNA, 22 nt, Human
agcaagagaagagggggaaggg

SEQ ID NO: 467005 - RNA, 21 nt, Human
agcaggcgccuguaaucccag

SEQ ID NO: 467006 - RNA, 21 nt, Human
agcauuuugagaggccgaggc

SEQ ID NO: 467007 - RNA, 26 nt, Human
agcauuuugagaggccgaggcgggug

SEQ ID NO: 467008 - RNA, 23 nt, Human
agccaggcaugguagcaggcgcc

SEQ ID NO: 467009 - RNA, 19 nt, Human
agccuggccaauaugguga

SEQ ID NO: 467010 - RNA, 22 nt, Human
agccuggccaauauggugaaac

SEQ ID NO: 467011 - RNA, 24 nt, Human
agccuggccaauauggugaaaccc

SEQ ID NO: 467012 - RNA, 24 nt, Human
agccugggcaacagagcaagacuc

SEQ ID NO: 467013 - RNA, 18 nt, Human
agcuccccagaccugcug

SEQ ID NO: 467014 - RNA, 23 nt, Human
aggagcagaaauaggcugggagg

SEQ ID NO: 467015 - RNA, 24 nt, Human
aggcacgguggcucacaccuguaa

SEQ ID NO: 467016 - RNA, 24 nt, Human
aggcagaagaaucgcuugaacccg

SEQ ID NO: 467017 - RNA, 20 nt, Human
aggcagagguugcagugaac

SEQ ID NO: 467018 - RNA, 24 nt, Human
aggcagagguugcagugaacugag

SEQ ID NO: 467019 - RNA, 21 nt, Human
aggcagcaccaggccggagga

SEQ ID NO: 467020 - RNA, 24 nt, Human
aggcaggggcaggaucaggcaggg

SEQ ID NO: 467021 - RNA, 24 nt, Human
aggcaugguagcaggcgccuguaa

SEQ ID NO: 467022 - RNA, 21 nt, Human
aggccgaggcgggugggucac

SEQ ID NO: 467023 - RNA, 24 nt, Human
aggcugaggcagaagaaucgcuug

SEQ ID NO: 467024 - RNA, 20 nt, Human
auauugagaaaguccuagaa

SEQ ID NO: 467025 - RNA, 23 nt, Human
aucccagccacuagggaggcuga

SEQ ID NO: 467026 - RNA, 20 nt, Human
auggugaaaccccaucucua

SEQ ID NO: 467027 - RNA, 21 nt, Human
auugagaaaguccuagaaccu

SEQ ID NO: 467028 - RNA, 24 nt, Human
auugcaccacugcacucuagccug

SEQ ID NO: 467029 - RNA, 26 nt, Human
caaaugcccccacacuccuggguccu

SEQ ID NO: 467030 - RNA, 24 nt, Human
caagaccagccuggccaauauggu

SEQ ID NO: 467031 - RNA, 21 nt, Human
caaggcccuggcagagcccug

SEQ ID NO: 467032 - RNA, 24 nt, Human
caauauggugaaaccccaucucua

SEQ ID NO: 467033 - RNA, 24 nt, Human
cacaccuguaaucccagcauuuug

SEQ ID NO: 467034 - RNA, 18 nt, Human
caccaaugggcggaggcc

SEQ ID NO: 467035 - RNA, 24 nt, Human
caccacugcacucuagccugggca

SEQ ID NO: 467036 - RNA, 21 nt, Human
caccaggccggaggagggcuc

SEQ ID NO: 467037 - RNA, 19 nt, Human
caccccccaaaugccccca

SEQ ID NO: 467038 - RNA, 23 nt, Human
caccugaagucaggaguucaaga

SEQ ID NO: 467039 - RNA, 23 nt, Human
caccuguaaucccagcauuuuga

SEQ ID NO: 467040 - RNA, 18 nt, Human
caccuugauaaagccugg

SEQ ID NO: 467041 - RNA, 18 nt, Human
caccuugauaaagccugg

SEQ ID NO: 467042 - RNA, 18 nt, Human
cacuagggaggcugaggc

SEQ ID NO: 467043 - RNA, 19 nt, Human
cacuagggaggcugaggca

SEQ ID NO: 467044 - RNA, 21 nt, Human
cacuagggaggcugaggcaga

SEQ ID NO: 467045 - RNA, 19 nt, Human
cacuccuggguccucuccu

SEQ ID NO: 467046 - RNA, 23 nt, Human
cacucuagccugggcaacagagc

SEQ ID NO: 467047 - RNA, 18 nt, Human
cacugcacucuagccugg

SEQ ID NO: 467048 - RNA, 19 nt, Human
cacugcacucuagccuggg

SEQ ID NO: 467049 - RNA, 21 nt, Human
cacugcacucuagccugggca

SEQ ID NO: 467050 - RNA, 23 nt, Human
cacugcacucuagccugggcaac

SEQ ID NO: 467051 - RNA, 24 nt, Human
cacugcacucuagccugggcaaca

SEQ ID NO: 467052 - RNA, 24 nt, Human
cagaacacaggcccccaugagccg

SEQ ID NO: 467053 - RNA, 23 nt, Human
cagacccccaggcccagcagagg

SEQ ID NO: 467054 - RNA, 22 nt, Human
cagagaucaccccccggggcac

SEQ ID NO: 467055 - RNA, 24 nt, Human
cagcauuuugagaggccgaggcgg

SEQ ID NO: 467056 - RNA, 26 nt, Human
cagccaagauagaagcagggucuccc

SEQ ID NO: 467057 - RNA, 18 nt, Human
cagcugcaccugaacacc

SEQ ID NO: 467058 - RNA, 23 nt, Human
caggcaggggcaggaucaggcag

SEQ ID NO: 467059 - RNA, 21 nt, Human
caucuggccauggagccacgg

SEQ ID NO: 467060 - RNA, 19 nt, Human
ccaaaugcccccacacucc

SEQ ID NO: 467061 - RNA, 24 nt, Human
ccaccuggguuuggaaggcuaggg

SEQ ID NO: 467062 - RNA, 20 nt, Human
ccacugcacucuagccuggg

SEQ ID NO: 467063 - RNA, 21 nt, Human
ccacugcacucuagccugggc

SEQ ID NO: 467064 - RNA, 23 nt, Human
ccacugcacucuagccugggcaa

SEQ ID NO: 467065 - RNA, 24 nt, Human
ccacugcacucuagccugggcaac

SEQ ID NO: 467066 - RNA, 22 nt, Human
ccagcaccugagcucuccagcc

SEQ ID NO: 467067 - RNA, 25 nt, Human
ccagcaccugagcucuccagccggg

SEQ ID NO: 467068 - RNA, 20 nt, Human
cccaaaugcccccacacucc

SEQ ID NO: 467069 - RNA, 20 nt, Human
cccagacccccaggcccagc

SEQ ID NO: 467070 - RNA, 23 nt, Human
cccagacccccaggcccagcaga

SEQ ID NO: 467071 - RNA, 21 nt, Human
cccaggaacaugugagaaaca

SEQ ID NO: 467072 - RNA, 22 nt, Human
cccaggaacaugugagaaacac

SEQ ID NO: 467073 - RNA, 18 nt, Human
ccccacacuccugggucc

SEQ ID NO: 467074 - RNA, 20 nt, Human
ccccaucagcaucacccagg

SEQ ID NO: 467075 - RNA, 25 nt, Human
cccccaaaugcccccacacuccugg

SEQ ID NO: 467076 - RNA, 21 nt, Human
cccccacacuccuggguccuc

SEQ ID NO: 467077 - RNA, 23 nt, Human
ccccccggggcaccucagccccc

SEQ ID NO: 467078 - RNA, 20 nt, Human
cccccggggcaccucagccc

SEQ ID NO: 467079 - RNA, 22 nt, Human
cccggggcaccucagccccaga

SEQ ID NO: 467080 - RNA, 23 nt, Human
cccugcaggggacgggaccagca

SEQ ID NO: 467081 - RNA, 19 nt, Human
cccugccaccgggaccccc

SEQ ID NO: 467082 - RNA, 18 nt, Human
ccgccugggcuggacugg

SEQ ID NO: 467083 - RNA, 22 nt, Human
ccggugagaggggcaugagggg

SEQ ID NO: 467084 - RNA, 22 nt, Human
ccucacccuucccgggacccag

SEQ ID NO: 467085 - RNA, 21 nt, Human
ccucuggggagaagggcaggc

SEQ ID NO: 467086 - RNA, 28 nt, Human
ccugaacacccagaacacaggcccccag

SEQ ID NO: 467087 - RNA, 23 nt, Human
ccugaagucaggaguucaagacc

SEQ ID NO: 467088 - RNA, 22 nt, Human
ccuggcacuuggucagacccug

SEQ ID NO: 467089 - RNA, 23 nt, Human
ccuggccaauauggugaaacccc

SEQ ID NO: 467090 - RNA, 24 nt, Human
ccuggccaauauggugaaacccca

SEQ ID NO: 467091 - RNA, 22 nt, Human
ccugggcaacagagcaagacuc

SEQ ID NO: 467092 - RNA, 19 nt, Human
ccuggggcuuccguggccc

SEQ ID NO: 467093 - RNA, 19 nt, Human
cgaggcgggugggucaccu

SEQ ID NO: 467094 - RNA, 18 nt, Human
cgccugggcuggacuggc

SEQ ID NO: 467095 - RNA, 23 nt, Human
cgccuguaaucccagccacuagg

SEQ ID NO: 467096 - RNA, 24 nt, Human
cgccuguaaucccagccacuaggg

SEQ ID NO: 467097 - RNA, 22 nt, Human
cggaaguucagaugacuuuggu

SEQ ID NO: 467098 - RNA, 22 nt, Human
cggcugugagcaccagagauca

SEQ ID NO: 467099 - RNA, 19 nt, Human
cgggagggcggcccagagg

SEQ ID NO: 467100 - RNA, 24 nt, Human
cgggugggucaccugaagucagga

SEQ ID NO: 467101 - RNA, 23 nt, Human
cuagaaccugguugcuccagugu

SEQ ID NO: 467102 - RNA, 24 nt, Human
cuauguacacaucucuccccgccu

SEQ ID NO: 467103 - RNA, 21 nt, Human
cucacaccuguaaucccagca

SEQ ID NO: 467104 - RNA, 21 nt, Human
cucacaccuguaaucccagca

SEQ ID NO: 467105 - RNA, 21 nt, Human
cugagucagaaucugcauuua

SEQ ID NO: 467106 - RNA, 21 nt, Human
cugcugagucagaaucugcau

SEQ ID NO: 467107 - RNA, 21 nt, Human
cugcuucacagcagugcaaac

SEQ ID NO: 467108 - RNA, 19 nt, Human
cuggcuccuuggcccaugu

SEQ ID NO: 467109 - RNA, 21 nt, Human
cugggaggaggcaggaagggg

SEQ ID NO: 467110 - RNA, 19 nt, Human
cugggucugcuuuaaaacc

SEQ ID NO: 467111 - RNA, 20 nt, Human
cuucgggggccacuucaccc

SEQ ID NO: 467112 - RNA, 23 nt, Human
cuucgggggccacuucacccccc

SEQ ID NO: 467113 - RNA, 24 nt, Human
cuuggcccaugucugcaauacuaa

SEQ ID NO: 467114 - RNA, 22 nt, Human
cuuguugcuggcccagaccccc

SEQ ID NO: 467115 - RNA, 19 nt, Human
gaacacccagaacacaggc

SEQ ID NO: 467116 - RNA, 19 nt, Human
gaaccugguugcuccagug

SEQ ID NO: 467117 - RNA, 20 nt, Human
gaagaaacggaaggccugag

SEQ ID NO: 467118 - RNA, 21 nt, Human
gaagggcaggccaccuggguu

SEQ ID NO: 467119 - RNA, 21 nt, Human
gagcugcccacccgggccuua

SEQ ID NO: 467120 - RNA, 25 nt, Human
gaggcgggugggucaccugaaguca

SEQ ID NO: 467121 - RNA, 24 nt, Human
gcacucuagccugggcaacagagc

SEQ ID NO: 467122 - RNA, 20 nt, Human
gcagcuggaggcccugggga

SEQ ID NO: 467123 - RNA, 21 nt, Human
gcaggccaccuggguuuggaa

SEQ ID NO: 467124 - RNA, 19 nt, Human
gcaguggugcaggccugag

SEQ ID NO: 467125 - RNA, 24 nt, Human
gccaauauggugaaaccccaucuc

SEQ ID NO: 467126 - RNA, 20 nt, Human
gccaccgggaccccguccca

SEQ ID NO: 467127 - RNA, 26 nt, Human
gcccuggcagagcccugggaggaggc

SEQ ID NO: 467128 - RNA, 22 nt, Human
gccugaggucccuccuuugcuc

SEQ ID NO: 467129 - RNA, 22 nt, Human
gcguggcggggucaggcagggg

SEQ ID NO: 467130 - RNA, 25 nt, Human
gcucuaaagccuggggcuuccgugg

SEQ ID NO: 467131 - RNA, 18 nt, Human
gcugcaguggugcaggcc

SEQ ID NO: 467132 - RNA, 18 nt, Human
ggacaccaggccacccca

SEQ ID NO: 467133 - RNA, 20 nt, Human
ggagacagcauucuuuaauc

SEQ ID NO: 467134 - RNA, 19 nt, Human
ggagcagaaauaggcuggg

SEQ ID NO: 467135 - RNA, 21 nt, Human
ggccaggcacgguggcucaca

SEQ ID NO: 467136 - RNA, 19 nt, Human
ggccucuggcuccuuggcc

SEQ ID NO: 467137 - RNA, 21 nt, Human
ggcucacaccuguaaucccag

SEQ ID NO: 467138 - RNA, 23 nt, Human
gggaaggagauaccugccccugc

SEQ ID NO: 467139 - RNA, 22 nt, Human
gggaggcugaggcagaagaauc

SEQ ID NO: 467140 - RNA, 23 nt, Human
gggcaccucagccccagagucug

SEQ ID NO: 467141 - RNA, 23 nt, Human
gggcacugggccggugagagggg

SEQ ID NO: 467142 - RNA, 20 nt, Human
gggcagagagcaccugggga

SEQ ID NO: 467143 - RNA, 20 nt, Human
ggggaccucccuggccuucc

SEQ ID NO: 467144 - RNA, 21 nt, Human
ggggcaugaggggcagagagc

SEQ ID NO: 467145 - RNA, 22 nt, Human
gggugguuuauagcacaggucu

SEQ ID NO: 467146 - RNA, 24 nt, Human
gguagcaggcgccuguaaucccag

SEQ ID NO: 467147 - RNA, 19 nt, Human
ggucaccugaagucaggag

SEQ ID NO: 467148 - RNA, 24 nt, Human
ggucaccugaagucaggaguucaa

SEQ ID NO: 467149 - RNA, 22 nt, Human
gguggaugaggaacgggaagga

SEQ ID NO: 467150 - RNA, 23 nt, Human
gguggcucacaccuguaauccca

SEQ ID NO: 467151 - RNA, 24 nt, Human
gguggcucacaccuguaaucccag

SEQ ID NO: 467152 - RNA, 19 nt, Human
guccucuccucacagaacc

SEQ ID NO: 467153 - RNA, 23 nt, Human
guggcucacaccuguaaucccag

SEQ ID NO: 467154 - RNA, 21 nt, Human
uaaaaauacaaaaauuagcca

SEQ ID NO: 467155 - RNA, 18 nt, Human
uaauggaggaccagcugc

SEQ ID NO: 467156 - RNA, 19 nt, Human
uagcacggggagcccugga

SEQ ID NO: 467157 - RNA, 22 nt, Human
uagcaggcgccuguaaucccag

SEQ ID NO: 467158 - RNA, 24 nt, Human
uagguuagcaagcuucuuaaaaua

SEQ ID NO: 467159 - RNA, 22 nt, Human
ucaccugaagucaggaguucaa

SEQ ID NO: 467160 - RNA, 23 nt, Human
ucaccugaagucaggaguucaag

SEQ ID NO: 467161 - RNA, 23 nt, Human
ucauagacugaccccaucagcau

SEQ ID NO: 467162 - RNA, 21 nt, Human
uccaaguuugagaagugcugg

SEQ ID NO: 467163 - RNA, 22 nt, Human
uccccggggaccucccuggccu

SEQ ID NO: 467164 - RNA, 22 nt, Human
uccccggggaccucccuggccu

SEQ ID NO: 467165 - RNA, 23 nt, Human
uccugcagguguuuguaaaggca

SEQ ID NO: 467166 - RNA, 20 nt, Human
uccugcuucacagcagugca

SEQ ID NO: 467167 - RNA, 18 nt, Human
ucgcuugaacccgggagg

SEQ ID NO: 467168 - RNA, 23 nt, Human
ucucuacuaaaaauacaaaaauu

SEQ ID NO: 467169 - RNA, 19 nt, Human
ugaaaccccaucucuacua

SEQ ID NO: 467170 - RNA, 18 nt, Human
ugaaugaauaaaugaacg

SEQ ID NO: 467171 - RNA, 19 nt, Human
ugagaggccgaggcgggug

SEQ ID NO: 467172 - RNA, 22 nt, Human
ugagaggccgaggcgggugggu

SEQ ID NO: 467173 - RNA, 24 nt, Human
ugagaggccgaggcggguggguca

SEQ ID NO: 467174 - RNA, 26 nt, Human
ugagaggccgaggcgggugggucacc

SEQ ID NO: 467175 - RNA, 24 nt, Human
ugagauugcaccacugcacucuag

SEQ ID NO: 467176 - RNA, 20 nt, Human
ugagcaagagaagaggggga

SEQ ID NO: 467177 - RNA, 23 nt, Human
ugagcaagagaagagggggaagg

SEQ ID NO: 467178 - RNA, 20 nt, Human
ugaggcagaagaaucgcuug

SEQ ID NO: 467179 - RNA, 24 nt, Human
ugaggcagaagaaucgcuugaacc

SEQ ID NO: 467180 - RNA, 25 nt, Human
ugaggcagaagaaucgcuugaaccc

SEQ ID NO: 467181 - RNA, 19 nt, Human
ugagggcaggggcagggcc

SEQ ID NO: 467182 - RNA, 19 nt, Human
ugaggggcagagagcaccu

SEQ ID NO: 467183 - RNA, 21 nt, Human
ugaggggcagagagcaccugg

SEQ ID NO: 467184 - RNA, 20 nt, Human
ugcaaacugagcccugcagg

SEQ ID NO: 467185 - RNA, 21 nt, Human
ugcaguggugcaggccugagc

SEQ ID NO: 467186 - RNA, 23 nt, Human
ugcucuagcuccccagaccugcu

SEQ ID NO: 467187 - RNA, 22 nt, Human
ugcuggcccagacccccaggcc

SEQ ID NO: 467188 - RNA, 22 nt, Human
uggaaggcuagggggacaccag

SEQ ID NO: 467189 - RNA, 23 nt, Human
uggccaaggcccccugggguuug

SEQ ID NO: 467190 - RNA, 24 nt, Human
uggccaauauggugaaaccccauc

SEQ ID NO: 467191 - RNA, 24 nt, Human
uggcccagacccccaggcccagcc

SEQ ID NO: 467192 - RNA, 24 nt, Human
uggccuuccugcuucacagcagug

SEQ ID NO: 467193 - RNA, 21 nt, Human
uggcucacaccuguaauccca

SEQ ID NO: 467194 - RNA, 24 nt, Human
uggcucacaccuguaaucccagca

SEQ ID NO: 467195 - RNA, 22 nt, Human
ugggagggaugauggcagccaa

SEQ ID NO: 467196 - RNA, 25 nt, Human
ugggcuggacuggccagucacugag

SEQ ID NO: 467197 - RNA, 24 nt, Human
ugggucaccugaagucaggaguuc

SEQ ID NO: 467198 - RNA, 24 nt, Human
ugguagcaggcgccuguaauccca

SEQ ID NO: 467199 - RNA, 24 nt, Human
uguugggagaauucuagaaugugg

SEQ ID NO: 467200 - RNA, 20 nt, Human
uuaaucaugcuggacggcag

SEQ ID NO: 467201 - RNA, 19 nt, Human
uugcagugaacugagauug

SEQ ID NO: 467202 - RNA, 20 nt, Human
uugcagugaacugagauugc

SEQ ID NO: 467203 - RNA, 22 nt, Human
uugcagugaacugagauugcac

SEQ ID NO: 467204 - RNA, 20 nt, Human
uuuuuuuuuuuuaagaggag

SEQ ID NO: 467205 - RNA, 20 nt, Human
uuuuuuuuuuuuuuuaagag

SEQ ID NO: 467206 - RNA, 21 nt, Human
uuuuuuuuuuuuuuuaagagg

SEQ ID NO: 467207 - RNA, 22 nt, Human
aaacacauacaccuuggcauga

SEQ ID NO: 467208 - RNA, 18 nt, Human
aaagacaggaaaagcaag

SEQ ID NO: 467209 - RNA, 22 nt, Human
aacuauuaaaaauuuaaagcag

SEQ ID NO: 467210 - RNA, 18 nt, Human
aagugugaaguggaaacc

SEQ ID NO: 467211 - RNA, 22 nt, Human
aauaaaagaaacauuuaaaaga

SEQ ID NO: 467212 - RNA, 23 nt, Human
aauaaaagaaacauuuaaaagau

SEQ ID NO: 467213 - RNA, 24 nt, Human
accaucccaccagauauuugaaaa

SEQ ID NO: 467214 - RNA, 18 nt, Human
acccccuuaaacacauac

SEQ ID NO: 467215 - RNA, 19 nt, Human
accucugcccggccgcccc

SEQ ID NO: 467216 - RNA, 19 nt, Human
agaaaugguagaucagaca

SEQ ID NO: 467217 - RNA, 24 nt, Human
aggcccaaugagcagagaggauuu

SEQ ID NO: 467218 - RNA, 19 nt, Human
augauuaguguuuuuccau

SEQ ID NO: 467219 - RNA, 25 nt, Human
caaaaaauaacuugaugaaaaauaa

SEQ ID NO: 467220 - RNA, 25 nt, Human
caaacuuucccccaaaacaugaggc

SEQ ID NO: 467221 - RNA, 24 nt, Human
caccuucuggaaccccagauucaa

SEQ ID NO: 467222 - RNA, 24 nt, Human
cagauucaaucagaguguuuacca

SEQ ID NO: 467223 - RNA, 24 nt, Human
caucuguuugcuaugcugcucauc

SEQ ID NO: 467224 - RNA, 22 nt, Human
cauguccugacucagaaggaga

SEQ ID NO: 467225 - RNA, 22 nt, Human
ccauauguucacuuuucccgga

SEQ ID NO: 467226 - RNA, 23 nt, Human
cccauauuuaugagaaagcuauu

SEQ ID NO: 467227 - RNA, 25 nt, Human
ccccagauucaaucagaguguuuac

SEQ ID NO: 467228 - RNA, 19 nt, Human
cccggccgccccucugucu

SEQ ID NO: 467229 - RNA, 24 nt, Human
ccucugggaagugaggagcaccuc

SEQ ID NO: 467230 - RNA, 21 nt, Human
cggaagagaauaauugaagaa

SEQ ID NO: 467231 - RNA, 18 nt, Human
cucucucccuccuucucc

SEQ ID NO: 467232 - RNA, 19 nt, Human
cucugcccggccgccccuc

SEQ ID NO: 467233 - RNA, 19 nt, Human
cugcccggccgccccucug

SEQ ID NO: 467234 - RNA, 20 nt, Human
cuggcuccugcacccucugg

SEQ ID NO: 467235 - RNA, 22 nt, Human
cuggcuccugcacccucuggga

SEQ ID NO: 467236 - RNA, 24 nt, Human
cuuacaggcucauuaaaggguugu

SEQ ID NO: 467237 - RNA, 25 nt, Human
cuucugggucucuguucucacuucg

SEQ ID NO: 467238 - RNA, 21 nt, Human
gaaguaaacauuuccucuucu

SEQ ID NO: 467239 - RNA, 23 nt, Human
gaucccauuccugcuuguuccac

SEQ ID NO: 467240 - RNA, 18 nt, Human
gcagauccaugagaagca

SEQ ID NO: 467241 - RNA, 21 nt, Human
gcccaaugagcagagaggauu

SEQ ID NO: 467242 - RNA, 20 nt, Human
gcguaaaagcuucucuggcc

SEQ ID NO: 467243 - RNA, 23 nt, Human
gcuggcuccugcacccucuggga

SEQ ID NO: 467244 - RNA, 21 nt, Human
ggauaaagggaauacuauuac

SEQ ID NO: 467245 - RNA, 22 nt, Human
ggcuguuaucuguaagcaggug

SEQ ID NO: 467246 - RNA, 18 nt, Human
uaaaagaaacauuuaaaa

SEQ ID NO: 467247 - RNA, 22 nt, Human
uaauccccauuaccaucccacc

SEQ ID NO: 467248 - RNA, 21 nt, Human
uaccucaaaccaccuuugcug

SEQ ID NO: 467249 - RNA, 22 nt, Human
uacuauauagccuuucgagaau

SEQ ID NO: 467250 - RNA, 24 nt, Human
uagcagacccugugugcuuuuagc

SEQ ID NO: 467251 - RNA, 21 nt, Human
uauacaaacaugaaggaauaa

SEQ ID NO: 467252 - RNA, 31 nt, Human
uaucaaacuuucccccaaaacaugaggcuuu

SEQ ID NO: 467253 - RNA, 23 nt, Human
ucaccccugccaggccuccucug

SEQ ID NO: 467254 - RNA, 21 nt, Human
ucauuucaaucuccauuuuua

SEQ ID NO: 467255 - RNA, 21 nt, Human
uccaucacacccccuuaaaca

SEQ ID NO: 467256 - RNA, 22 nt, Human
uccccaaguuugcauuuucgac

SEQ ID NO: 467257 - RNA, 22 nt, Human
ucucaggcuggcuuucaaagcu

SEQ ID NO: 467258 - RNA, 20 nt, Human
ucucccuccuucuccuguuc

SEQ ID NO: 467259 - RNA, 21 nt, Human
ucucuaggcuucaaaccaauu

SEQ ID NO: 467260 - RNA, 24 nt, Human
ucuggaaccccagauucaaucaga

SEQ ID NO: 467261 - RNA, 23 nt, Human
ucugggaaguggggagcaccuuu

SEQ ID NO: 467262 - RNA, 19 nt, Human
ucuguaagcaggugacuac

SEQ ID NO: 467263 - RNA, 23 nt, Human
ucuugcuuugguugucccaugaa

SEQ ID NO: 467264 - RNA, 26 nt, Human
ugaaagcaagauaggguugaaagaca

SEQ ID NO: 467265 - RNA, 18 nt, Human
ugaagaacaaggugcuga

SEQ ID NO: 467266 - RNA, 21 nt, Human
ugacacaagcaagagugggac

SEQ ID NO: 467267 - RNA, 19 nt, Human
ugacucagaaggagagcaa

SEQ ID NO: 467268 - RNA, 23 nt, Human
ugagaagcaaugucuuaccacaa

SEQ ID NO: 467269 - RNA, 19 nt, Human
ugauguuuccgcccucccc

SEQ ID NO: 467270 - RNA, 21 nt, Human
ugcaguucagugaagaacaag

SEQ ID NO: 467271 - RNA, 18 nt, Human
ugccauuuccuuucuggu

SEQ ID NO: 467272 - RNA, 22 nt, Human
ugcccggccgccccucugucug

SEQ ID NO: 467273 - RNA, 23 nt, Human
ugcguuugaagcuuggagcucau

SEQ ID NO: 467274 - RNA, 19 nt, Human
ugcuguugagaauaccaau

SEQ ID NO: 467275 - RNA, 21 nt, Human
ugcuuuagaaucugaguggga

SEQ ID NO: 467276 - RNA, 20 nt, Human
uggcaguauccagcucugaa

SEQ ID NO: 467277 - RNA, 18 nt, Human
uggcaugauuaguguuuu

SEQ ID NO: 467278 - RNA, 21 nt, Human
uggcaugauuaguguuuuucc

SEQ ID NO: 467279 - RNA, 21 nt, Human
uggcucucucccuccuucucc

SEQ ID NO: 467280 - RNA, 18 nt, Human
ugggaaaccaucacacua

SEQ ID NO: 467281 - RNA, 25 nt, Human
ugggaagugaagagugccucuggcc

SEQ ID NO: 467282 - RNA, 21 nt, Human
ugggaagugaggagcaccucu

SEQ ID NO: 467283 - RNA, 20 nt, Human
ugggaaguggggagcaccuu

SEQ ID NO: 467284 - RNA, 21 nt, Human
ugggaaguggggagcaccuuu

SEQ ID NO: 467285 - RNA, 18 nt, Human
ugguccauugauucuccu

SEQ ID NO: 467286 - RNA, 25 nt, Human
ugguucaugacugucugcaauaacu

SEQ ID NO: 467287 - RNA, 18 nt, Human
ugguuucaacuuuucugu

SEQ ID NO: 467288 - RNA, 18 nt, Human
ugugagacuuggaaggga

SEQ ID NO: 467289 - RNA, 23 nt, Human
uguuauguuuuucuuaaauaaca

SEQ ID NO: 467290 - RNA, 23 nt, Human
uuaaagcagaaauauguguuuau

SEQ ID NO: 467291 - RNA, 21 nt, Human
uuaccaucccaccagauauuu

SEQ ID NO: 467292 - RNA, 21 nt, Human
uuaggacaaauguuugucuug

SEQ ID NO: 467293 - RNA, 24 nt, Human
uucacagcauuuugcccuuauuuc

SEQ ID NO: 467294 - RNA, 20 nt, Human
uucguccccaucauuaccuc

SEQ ID NO: 467295 - RNA, 22 nt, Human
uugaagaauugcaguucaguga

SEQ ID NO: 467296 - RNA, 20 nt, Human
uuguaugugauguuuccgcc

SEQ ID NO: 467297 - RNA, 24 nt, Human
uuucccuaucccuucucugucaca

SEQ ID NO: 467298 - RNA, 18 nt, Human
uuuccgcccuccccaagu

SEQ ID NO: 467299 - RNA, 24 nt, Human
uuugaaauaaauaccuagcagauc

SEQ ID NO: 467300 - RNA, 21 nt, Human
aacccuguuccucucaguuca

SEQ ID NO: 467301 - RNA, 24 nt, Human
augaauggagcaacaccagugcca

SEQ ID NO: 467302 - RNA, 21 nt, Human
caccugcagcugugacaucac

SEQ ID NO: 467303 - RNA, 22 nt, Human
ccuguuccucucaguucagcca

SEQ ID NO: 467304 - RNA, 23 nt, Human
guucagccagcacucaggcuggg

SEQ ID NO: 467305 - RNA, 22 nt, Human
ugccaggcaccaacccuguucc

SEQ ID NO: 467306 - RNA, 21 nt, Human
uggagcaacaccagugccagg

SEQ ID NO: 467307 - RNA, 23 nt, Human
uggagcaacaccagugccaggca

SEQ ID NO: 467308 - RNA, 24 nt, Human
aagaacccaaacccaaacgaaacc

SEQ ID NO: 467309 - RNA, 18 nt, Human
aagcgaccccgccagggg

SEQ ID NO: 467310 - RNA, 22 nt, Human
acagauccacagcucucagcca

SEQ ID NO: 467311 - RNA, 19 nt, Human
accaagacagacacucgcc

SEQ ID NO: 467312 - RNA, 19 nt, Human
accugggcuggggcuggag

SEQ ID NO: 467313 - RNA, 18 nt, Human
acgaaaccccaaaaccac

SEQ ID NO: 467314 - RNA, 24 nt, Human
acgaaaccccaaaaccacacacac

SEQ ID NO: 467315 - RNA, 20 nt, Human
acguagucaacuacuuacac

SEQ ID NO: 467316 - RNA, 21 nt, Human
agacagacacucgccagggcc

SEQ ID NO: 467317 - RNA, 25 nt, Human
agaugucuucagcacaguucuaaaa

SEQ ID NO: 467318 - RNA, 22 nt, Human
augaagugcaaauucugcaaau

SEQ ID NO: 467319 - RNA, 20 nt, Human
caaaaccacacacacgguag

SEQ ID NO: 467320 - RNA, 21 nt, Human
caaacccaaacgaaaccccaa

SEQ ID NO: 467321 - RNA, 27 nt, Human
caagaacccaaacccaaacgaaacccc

SEQ ID NO: 467322 - RNA, 22 nt, Human
caccaagacagacacucgccag

SEQ ID NO: 467323 - RNA, 20 nt, Human
cacggaaccaacaguuucua

SEQ ID NO: 467324 - RNA, 22 nt, Human
cacggagcccacgcgucugcgc

SEQ ID NO: 467325 - RNA, 18 nt, Human
cacugucaccaucaaaau

SEQ ID NO: 467326 - RNA, 22 nt, Human
cagaugucuucagcacaguucu

SEQ ID NO: 467327 - RNA, 24 nt, Human
cagccgcuuuugugcgcgucuccc

SEQ ID NO: 467328 - RNA, 18 nt, Human
caggaaacagcugcaaac

SEQ ID NO: 467329 - RNA, 22 nt, Human
caggcucugagcagugccuucc

SEQ ID NO: 467330 - RNA, 21 nt, Human
cagugccuuccagcgagccuc

SEQ ID NO: 467331 - RNA, 24 nt, Human
cagugggcugccucugcagagucu

SEQ ID NO: 467332 - RNA, 20 nt, Human
ccaaaaccacacacacggua

SEQ ID NO: 467333 - RNA, 20 nt, Human
ccaaacgaaaccccaaaacc

SEQ ID NO: 467334 - RNA, 21 nt, Human
ccaccugggcuggggcuggag

SEQ ID NO: 467335 - RNA, 26 nt, Human
ccagggccucuuuucugcugucagcc

SEQ ID NO: 467336 - RNA, 23 nt, Human
ccauagcuucaguggagccucaa

SEQ ID NO: 467337 - RNA, 21 nt, Human
cccaaacgaaaccccaaaacc

SEQ ID NO: 467338 - RNA, 21 nt, Human
ccgcuuuugugcgcgucuccc

SEQ ID NO: 467339 - RNA, 24 nt, Human
ccggcccucuggcccaugcaucug

SEQ ID NO: 467340 - RNA, 19 nt, Human
ccggguguccagacauagg

SEQ ID NO: 467341 - RNA, 25 nt, Human
ccugggcuggggcuggagcuggggc

SEQ ID NO: 467342 - RNA, 21 nt, Human
cgaaaccccaaaaccacacac

SEQ ID NO: 467343 - RNA, 19 nt, Human
cggaaccaacaguuucuag

SEQ ID NO: 467344 - RNA, 25 nt, Human
cguagucaacuacuuacacggaacc

SEQ ID NO: 467345 - RNA, 21 nt, Human
cgucaagaacccaaacccaaa

SEQ ID NO: 467346 - RNA, 19 nt, Human
cugcagagucuggugggag

SEQ ID NO: 467347 - RNA, 19 nt, Human
cugcucucuccgaugggcc

SEQ ID NO: 467348 - RNA, 23 nt, Human
gaaacuacuuuuuucccccacaa

SEQ ID NO: 467349 - RNA, 21 nt, Human
gagagcagugcuccggggugg

SEQ ID NO: 467350 - RNA, 19 nt, Human
gagcagugcuccggggugg

SEQ ID NO: 467351 - RNA, 20 nt, Human
gagcagugcuccgggguggc

SEQ ID NO: 467352 - RNA, 19 nt, Human
gcacugucaccaucaaaau

SEQ ID NO: 467353 - RNA, 24 nt, Human
gccacggagcccacgcgucugcgc

SEQ ID NO: 467354 - RNA, 18 nt, Human
gcggaagguuccugcagg

SEQ ID NO: 467355 - RNA, 20 nt, Human
ggcacugucaccaucaaaau

SEQ ID NO: 467356 - RNA, 18 nt, Human
ggcagugggcugccucug

SEQ ID NO: 467357 - RNA, 23 nt, Human
ggccagggccucuuuucugcucc

SEQ ID NO: 467358 - RNA, 21 nt, Human
gggcggcccaccugggcuggg

SEQ ID NO: 467359 - RNA, 20 nt, Human
uaaaauagaugaauacauga

SEQ ID NO: 467360 - RNA, 19 nt, Human
uacagaugucuucagcaca

SEQ ID NO: 467361 - RNA, 25 nt, Human
uagcuucaguggagccucaggcaac

SEQ ID NO: 467362 - RNA, 19 nt, Human
ucaccaucaaaaugcacag

SEQ ID NO: 467363 - RNA, 22 nt, Human
ucagaaaaguaaugaagugcaa

SEQ ID NO: 467364 - RNA, 19 nt, Human
ucagggaugguagggaggc

SEQ ID NO: 467365 - RNA, 18 nt, Human
uccacaguuacccuggag

SEQ ID NO: 467366 - RNA, 25 nt, Human
ucucccuuaagauaaaacuuaaaaa

SEQ ID NO: 467367 - RNA, 20 nt, Human
ucugcaaauuaugccauagc

SEQ ID NO: 467368 - RNA, 20 nt, Human
ucugcagagucuggugggag

SEQ ID NO: 467369 - RNA, 22 nt, Human
ucuuugggcugguggugggcag

SEQ ID NO: 467370 - RNA, 28 nt, Human
ucuuugggcugguggugggcagugggcu

SEQ ID NO: 467371 - RNA, 18 nt, Human
ugagagaagcacugggca

SEQ ID NO: 467372 - RNA, 19 nt, Human
ugagagaagcacugggcac

SEQ ID NO: 467373 - RNA, 26 nt, Human
ugcacagauccacagcucucagccag

SEQ ID NO: 467374 - RNA, 18 nt, Human
ugccauagcuucagugga

SEQ ID NO: 467375 - RNA, 21 nt, Human
ugggagguugaggaagagacu

SEQ ID NO: 467376 - RNA, 19 nt, Human
uggggcuggagcuggggcc

SEQ ID NO: 467377 - RNA, 20 nt, Human
uuaagauaaaacuuaaaaau

SEQ ID NO: 467378 - RNA, 22 nt, Human
uucccccacaaaauagucuuac

SEQ ID NO: 467379 - RNA, 23 nt, Human
uucucaagguuucuucauaaaua

SEQ ID NO: 467380 - RNA, 21 nt, Human
uuucugcugucagcccuucag

SEQ ID NO: 467381 - RNA, 25 nt, Human
uuuuuuuuuuuuuuuuucagcuuuu

SEQ ID NO: 467382 - RNA, 21 nt, Human
uuuuuuuuuuuuuuuuuucag

SEQ ID NO: 467383 - RNA, 21 nt, Human
aaccagggggcaggugugccc

SEQ ID NO: 467384 - RNA, 18 nt, Human
aagcaagcaaagcaaaac

SEQ ID NO: 467385 - RNA, 19 nt, Human
aagggcccuccuggguucc

SEQ ID NO: 467386 - RNA, 19 nt, Human
acaagcaagcaaagcaaaa

SEQ ID NO: 467387 - RNA, 24 nt, Human
acacuggacuccacagaagcuggu

SEQ ID NO: 467388 - RNA, 23 nt, Human
accuucuccgagccaggucaccg

SEQ ID NO: 467389 - RNA, 23 nt, Human
agcccucggccucucccaccucc

SEQ ID NO: 467390 - RNA, 23 nt, Human
agcgcacgcccagccggccgccu

SEQ ID NO: 467391 - RNA, 20 nt, Human
agcuggggcauuggggggcc

SEQ ID NO: 467392 - RNA, 20 nt, Human
aggaaggggguggccccggg

SEQ ID NO: 467393 - RNA, 20 nt, Human
aggacccaagagggagcugg

SEQ ID NO: 467394 - RNA, 21 nt, Human
agggcagggguggguggggcu

SEQ ID NO: 467395 - RNA, 20 nt, Human
agggccaccuucuccgagcc

SEQ ID NO: 467396 - RNA, 23 nt, Human
augguggccacaggcggccucgg

SEQ ID NO: 467397 - RNA, 20 nt, Human
cacaggacccaagagggagc

SEQ ID NO: 467398 - RNA, 21 nt, Human
caccaggggagaggcccuagu

SEQ ID NO: 467399 - RNA, 21 nt, Human
cacgcccagccggccgccucc

SEQ ID NO: 467400 - RNA, 19 nt, Human
cacuggacuccacagaagc

SEQ ID NO: 467401 - RNA, 22 nt, Human
cagaggugccagccaauuccga

SEQ ID NO: 467402 - RNA, 24 nt, Human
cagcugccccucgcccgcuguccc

SEQ ID NO: 467403 - RNA, 23 nt, Human
caggacccaagagggagcugggg

SEQ ID NO: 467404 - RNA, 18 nt, Human
caggaugggggacaagca

SEQ ID NO: 467405 - RNA, 22 nt, Human
caggggucugaaagggcagggg

SEQ ID NO: 467406 - RNA, 21 nt, Human
cauguauacagggcaacccac

SEQ ID NO: 467407 - RNA, 19 nt, Human
ccacacccccagguccaag

SEQ ID NO: 467408 - RNA, 24 nt, Human
cccaccucccccacgucaucacug

SEQ ID NO: 467409 - RNA, 22 nt, Human
cccagccccggcuucggggagc

SEQ ID NO: 467410 - RNA, 23 nt, Human
cccagcccucgcccggcuccggc

SEQ ID NO: 467411 - RNA, 24 nt, Human
cccagcucccagcccucgcccggc

SEQ ID NO: 467412 - RNA, 19 nt, Human
ccccaggcccuggggcgga

SEQ ID NO: 467413 - RNA, 23 nt, Human
ccccaggcccuggggcggacuug

SEQ ID NO: 467414 - RNA, 19 nt, Human
ccccggacccggcccagcu

SEQ ID NO: 467415 - RNA, 20 nt, Human
ccccggacccggcccagcuc

SEQ ID NO: 467416 - RNA, 22 nt, Human
ccccgggccccagcaugguccc

SEQ ID NO: 467417 - RNA, 20 nt, Human
ccccucccuucugacucgcc

SEQ ID NO: 467418 - RNA, 23 nt, Human
ccccucgcccgcuguccccggac

SEQ ID NO: 467419 - RNA, 21 nt, Human
ccccugcaucccuggaggguc

SEQ ID NO: 467420 - RNA, 24 nt, Human
cccggacccggcccagcucccagc

SEQ ID NO: 467421 - RNA, 23 nt, Human
cccggcuccggcccagccccggc

SEQ ID NO: 467422 - RNA, 23 nt, Human
cccuaggccuccaugagugaccc

SEQ ID NO: 467423 - RNA, 24 nt, Human
cccuaggccuccaugagugacccu

SEQ ID NO: 467424 - RNA, 26 nt, Human
cccugagcggccuggcugcccggcuc

SEQ ID NO: 467425 - RNA, 18 nt, Human
cccugcagagccacugcc

SEQ ID NO: 467426 - RNA, 21 nt, Human
ccgacaugguggccacaggcg

SEQ ID NO: 467427 - RNA, 18 nt, Human
ccggccgccuccgacugc

SEQ ID NO: 467428 - RNA, 19 nt, Human
ccucgcccgcuguccccgg

SEQ ID NO: 467429 - RNA, 20 nt, Human
ccucgcccgcuguccccgga

SEQ ID NO: 467430 - RNA, 20 nt, Human
ccucggccucucccaccucc

SEQ ID NO: 467431 - RNA, 24 nt, Human
ccucggccucucccaccuccccca

SEQ ID NO: 467432 - RNA, 22 nt, Human
ccugcagagccacugccccaga

SEQ ID NO: 467433 - RNA, 19 nt, Human
ccugcuggugcaaaacucu

SEQ ID NO: 467434 - RNA, 20 nt, Human
ccugggagagccuugaaggc

SEQ ID NO: 467435 - RNA, 19 nt, Human
cgaggcuggggggccccgg

SEQ ID NO: 467436 - RNA, 23 nt, Human
cgcccagccggccgccuccgacu

SEQ ID NO: 467437 - RNA, 21 nt, Human
cgcccgcuguccccggacccg

SEQ ID NO: 467438 - RNA, 19 nt, Human
cgccgccgccucacaucug

SEQ ID NO: 467439 - RNA, 20 nt, Human
cgccuccgacugcgggacuc

SEQ ID NO: 467440 - RNA, 21 nt, Human
cggcagcugccccucgcccgc

SEQ ID NO: 467441 - RNA, 19 nt, Human
cggccucucccaccucccc

SEQ ID NO: 467442 - RNA, 19 nt, Human
cgggacucuucccuuccgc

SEQ ID NO: 467443 - RNA, 19 nt, Human
cucccagcccucgcccggc

SEQ ID NO: 467444 - RNA, 21 nt, Human
cucccagcccucgcccggcuc

SEQ ID NO: 467445 - RNA, 18 nt, Human
cucccccacgucaucacu

SEQ ID NO: 467446 - RNA, 20 nt, Human
cuccuggguucccugggucu

SEQ ID NO: 467447 - RNA, 22 nt, Human
cuccuggguucccugggucuuc

SEQ ID NO: 467448 - RNA, 21 nt, Human
cucgcuguuccccuaggccuc

SEQ ID NO: 467449 - RNA, 23 nt, Human
cucgcuguuccccuaggccucca

SEQ ID NO: 467450 - RNA, 22 nt, Human
cugaaagggcaggggugggugg

SEQ ID NO: 467451 - RNA, 21 nt, Human
cuggggccauggguccgaggg

SEQ ID NO: 467452 - RNA, 25 nt, Human
gaaggggguggccccgggccccagc

SEQ ID NO: 467453 - RNA, 22 nt, Human
gacaggaaggggguggccccgg

SEQ ID NO: 467454 - RNA, 20 nt, Human
gacgcaggcagucggucccc

SEQ ID NO: 467455 - RNA, 18 nt, Human
gagggaggcgaggcuggg

SEQ ID NO: 467456 - RNA, 19 nt, Human
gaggugccagccaauuccg

SEQ ID NO: 467457 - RNA, 21 nt, Human
gcaaagcaaaacacuggacuc

SEQ ID NO: 467458 - RNA, 22 nt, Human
gcaaagcaaaacacuggacucc

SEQ ID NO: 467459 - RNA, 24 nt, Human
gcaacccaccccuaggcaaagccc

SEQ ID NO: 467460 - RNA, 21 nt, Human
gccacugccccagaagggccc

SEQ ID NO: 467461 - RNA, 22 nt, Human
gccagcuguccccugcccugag

SEQ ID NO: 467462 - RNA, 24 nt, Human
gcccagggccaccuucuccgagcc

SEQ ID NO: 467463 - RNA, 18 nt, Human
gcccuuggcucccaacag

SEQ ID NO: 467464 - RNA, 20 nt, Human
gccucggggauggggcgcgg

SEQ ID NO: 467465 - RNA, 19 nt, Human
gcggccucggggauggggc

SEQ ID NO: 467466 - RNA, 22 nt, Human
gcuggugcaaaacucugccugg

SEQ ID NO: 467467 - RNA, 26 nt, Human
ggaaggggguggccccgggccccagc

SEQ ID NO: 467468 - RNA, 21 nt, Human
ggagcuggggcauuggggggc

SEQ ID NO: 467469 - RNA, 19 nt, Human
ggaggagggaggcgaggcu

SEQ ID NO: 467470 - RNA, 19 nt, Human
ggaggggucacuguccaca

SEQ ID NO: 467471 - RNA, 23 nt, Human
ggccauggguccgagggaaaggc

SEQ ID NO: 467472 - RNA, 22 nt, Human
ggcccuuggcucccaacagccc

SEQ ID NO: 467473 - RNA, 21 nt, Human
ggcgccagcuguccccugccc

SEQ ID NO: 467474 - RNA, 21 nt, Human
ggcgguuggccccuuggugcc

SEQ ID NO: 467475 - RNA, 21 nt, Human
ggcucaggacaggauggggga

SEQ ID NO: 467476 - RNA, 18 nt, Human
gggaacugaguaccaggg

SEQ ID NO: 467477 - RNA, 24 nt, Human
gggaaucgugagggaacugaguac

SEQ ID NO: 467478 - RNA, 20 nt, Human
gggagcuggggcauuggggg

SEQ ID NO: 467479 - RNA, 21 nt, Human
gggcagggguggguggggcuu

SEQ ID NO: 467480 - RNA, 23 nt, Human
gggcccuuggcucccaacagccc

SEQ ID NO: 467481 - RNA, 23 nt, Human
gggcggaugggcgggggcagggg

SEQ ID NO: 467482 - RNA, 22 nt, Human
gguaggaggagggaggcgaggc

SEQ ID NO: 467483 - RNA, 21 nt, Human
gguggccacaggcggccucgg

SEQ ID NO: 467484 - RNA, 23 nt, Human
uacaaauaaccagggggcaggug

SEQ ID NO: 467485 - RNA, 22 nt, Human
ucacugagcuguggcaaccaga

SEQ ID NO: 467486 - RNA, 24 nt, Human
uccaagugagggaugguaggagga

SEQ ID NO: 467487 - RNA, 19 nt, Human
uccacacccccagguccaa

SEQ ID NO: 467488 - RNA, 21 nt, Human
uccccggacccggcccagcuc

SEQ ID NO: 467489 - RNA, 24 nt, Human
uccccugcaucccuggagggucgc

SEQ ID NO: 467490 - RNA, 21 nt, Human
uccggcagcugccccucgccc

SEQ ID NO: 467491 - RNA, 22 nt, Human
uccugcuggugcaaaacucugc

SEQ ID NO: 467492 - RNA, 19 nt, Human
ugacaggaaggggguggcc

SEQ ID NO: 467493 - RNA, 21 nt, Human
ugacaggaaggggguggcccc

SEQ ID NO: 467494 - RNA, 22 nt, Human
ugacaggaaggggguggccccg

SEQ ID NO: 467495 - RNA, 23 nt, Human
ugacaggaaggggguggccccgg

SEQ ID NO: 467496 - RNA, 22 nt, Human
ugacagggcagagaauccugga

SEQ ID NO: 467497 - RNA, 23 nt, Human
ugacccugcagagccacugcccc

SEQ ID NO: 467498 - RNA, 19 nt, Human
ugagugacccugcagagcc

SEQ ID NO: 467499 - RNA, 19 nt, Human
ugccccucgcccgcugucc

SEQ ID NO: 467500 - RNA, 24 nt, Human
ugcccugagcggccuggcugcccg

SEQ ID NO: 467501 - RNA, 22 nt, Human
ugcugagcaaggggugguggaa

SEQ ID NO: 467502 - RNA, 18 nt, Human
uggauccccugcaucccu

SEQ ID NO: 467503 - RNA, 25 nt, Human
uggccccgggccccagcaugguccc

SEQ ID NO: 467504 - RNA, 18 nt, Human
ugggagagccuugaaggc

SEQ ID NO: 467505 - RNA, 18 nt, Human
ugggucuucaccagggga

SEQ ID NO: 467506 - RNA, 24 nt, Human
uggucccugccccaguguucaggg

SEQ ID NO: 467507 - RNA, 19 nt, Human
uguauacagggcaacccac

SEQ ID NO: 467508 - RNA, 21 nt, Human
uuccgaggagaauugggucca

SEQ ID NO: 467509 - RNA, 20 nt, Human
uucggggagcgagcgcacgc

SEQ ID NO: 467510 - RNA, 21 nt, Human
uuggcacaggacccaagaggg

SEQ ID NO: 467511 - RNA, 21 nt, Human
aaacagacucacacagauuga

SEQ ID NO: 467512 - RNA, 21 nt, Human
aaacauucccaagacaaucac

SEQ ID NO: 467513 - RNA, 19 nt, Human
aagcaagccucagauaccc

SEQ ID NO: 467514 - RNA, 19 nt, Human
aagccaagcaagccucaga

SEQ ID NO: 467515 - RNA, 18 nt, Human
aagggggagggagggagg

SEQ ID NO: 467516 - RNA, 23 nt, Human
acacaagccaagcaagccucaga

SEQ ID NO: 467517 - RNA, 21 nt, Human
acaggaagaaguccaaacaac

SEQ ID NO: 467518 - RNA, 18 nt, Human
acccuacaaauccgaaag

SEQ ID NO: 467519 - RNA, 18 nt, Human
acucgcagugccccgaau

SEQ ID NO: 467520 - RNA, 19 nt, Human
agaagggggagggagggag

SEQ ID NO: 467521 - RNA, 18 nt, Human
agaaugccagccagaagc

SEQ ID NO: 467522 - RNA, 19 nt, Human
agacccuccuccccuccuc

SEQ ID NO: 467523 - RNA, 21 nt, Human
agccaagcaagccucagauac

SEQ ID NO: 467524 - RNA, 24 nt, Human
agccagaagcaugaaucacuuuca

SEQ ID NO: 467525 - RNA, 19 nt, Human
aggaagaaguccaaacaac

SEQ ID NO: 467526 - RNA, 19 nt, Human
aggccggcugugcugcugc

SEQ ID NO: 467527 - RNA, 20 nt, Human
caaagcaccccauauucuuc

SEQ ID NO: 467528 - RNA, 24 nt, Human
caagacaaucacuaaacaugcaga

SEQ ID NO: 467529 - RNA, 21 nt, Human
caaucacuaaacaugcagaau

SEQ ID NO: 467530 - RNA, 24 nt, Human
caccccauauucuucugaaccuaa

SEQ ID NO: 467531 - RNA, 22 nt, Human
caccgacagcugcuggcagagc

SEQ ID NO: 467532 - RNA, 22 nt, Human
cacuaaacaugcagaaugccag

SEQ ID NO: 467533 - RNA, 28 nt, Human
cagcauggagagaauaauugccauuuca

SEQ ID NO: 467534 - RNA, 21 nt, Human
caggaagaaguccaaacaacu

SEQ ID NO: 467535 - RNA, 23 nt, Human
ccaggccuguuugauuguagcua

SEQ ID NO: 467536 - RNA, 19 nt, Human
ccaguugggggagcaggaa

SEQ ID NO: 467537 - RNA, 20 nt, Human
ccuggcacaggaagaagucc

SEQ ID NO: 467538 - RNA, 22 nt, Human
ccuggcacaggaagaaguccaa

SEQ ID NO: 467539 - RNA, 18 nt, Human
cggcaccgacagcugcug

SEQ ID NO: 467540 - RNA, 29 nt, Human
cgggggacagagaagggggagggagggag

SEQ ID NO: 467541 - RNA, 23 nt, Human
cucgcagugccccgaaugaggcc

SEQ ID NO: 467542 - RNA, 18 nt, Human
cugagacccuccuccccu

SEQ ID NO: 467543 - RNA, 20 nt, Human
gaaaaacagacucacacaga

SEQ ID NO: 467544 - RNA, 22 nt, Human
gaaugccagccagaagcaugaa

SEQ ID NO: 467545 - RNA, 18 nt, Human
gcugcagaggccgccaga

SEQ ID NO: 467546 - RNA, 20 nt, Human
gcuuuuguuguucuaccuga

SEQ ID NO: 467547 - RNA, 21 nt, Human
gggccggggugagcgagaggc

SEQ ID NO: 467548 - RNA, 18 nt, Human
gggggagggagggagcgc

SEQ ID NO: 467549 - RNA, 23 nt, Human
gggugagcgagaggcgggggaca

SEQ ID NO: 467550 - RNA, 22 nt, Human
uaaacaugcagaaugccagcca

SEQ ID NO: 467551 - RNA, 23 nt, Human
ucagauacccaggccuguuugau

SEQ ID NO: 467552 - RNA, 19 nt, Human
uccaagggagcaaagcacc

SEQ ID NO: 467553 - RNA, 19 nt, Human
uccgaaagagucucccccu

SEQ ID NO: 467554 - RNA, 22 nt, Human
ugaaaaacagacucacacagau

SEQ ID NO: 467555 - RNA, 22 nt, Human
ugagacccuccuccccuccucc

SEQ ID NO: 467556 - RNA, 19 nt, Human
ugaggccggcugugcugcu

SEQ ID NO: 467557 - RNA, 24 nt, Human
ugaggccggcugugcugcugcaga

SEQ ID NO: 467558 - RNA, 18 nt, Human
ugcagggagcaugagguu

SEQ ID NO: 467559 - RNA, 22 nt, Human
ugcuuuuguuguucuaccugau

SEQ ID NO: 467560 - RNA, 25 nt, Human
uggacacaagccaagcaagccucag

SEQ ID NO: 467561 - RNA, 24 nt, Human
uggcacaggaagaaguccaaacaa

SEQ ID NO: 467562 - RNA, 24 nt, Human
uggcacaggaagaaguccaaacag

SEQ ID NO: 467563 - RNA, 23 nt, Human
ugugugcauugacaacuguauag

SEQ ID NO: 467564 - RNA, 23 nt, Human
uucuucaggucccccgacuugga

SEQ ID NO: 467565 - RNA, 23 nt, Human
uugggggagcaggaauagggggu

SEQ ID NO: 467566 - RNA, 22 nt, Human
caacggggcugccuuuauucuc

SEQ ID NO: 467567 - RNA, 21 nt, Human
cccaggauugugcccccauga

SEQ ID NO: 467568 - RNA, 22 nt, Human
gaagcuccuccugcaggugccc

SEQ ID NO: 467569 - RNA, 23 nt, Human
gccccaggauugugcccccauga

SEQ ID NO: 467570 - RNA, 25 nt, Human
ugcaggugccccaggauugugcccc

SEQ ID NO: 467571 - RNA, 18 nt, Human
ugcgaagcuccuccugca

SEQ ID NO: 467572 - RNA, 23 nt, Human
aaacucccgaccucaggcaaucc

SEQ ID NO: 467573 - RNA, 23 nt, Human
aaagugaugggauuacagcauga

SEQ ID NO: 467574 - RNA, 19 nt, Human
aaagugcuaggauuacagg

SEQ ID NO: 467575 - RNA, 20 nt, Human
aaagugcuaggauuacaggg

SEQ ID NO: 467576 - RNA, 24 nt, Human
aaaguucugggaccacaggcauga

SEQ ID NO: 467577 - RNA, 24 nt, Human
aagugaucugcccgucucggccuc

SEQ ID NO: 467578 - RNA, 26 nt, Human
aagugcuaggauuacaggggugagcc

SEQ ID NO: 467579 - RNA, 18 nt, Human
acaggguuucaccauguu

SEQ ID NO: 467580 - RNA, 19 nt, Human
acaggguuucaccauguug

SEQ ID NO: 467581 - RNA, 24 nt, Human
acaggguuucaccauguugcccag

SEQ ID NO: 467582 - RNA, 23 nt, Human
accauguugcccagcuggucucg

SEQ ID NO: 467583 - RNA, 18 nt, Human
accauguuggccaggcug

SEQ ID NO: 467584 - RNA, 18 nt, Human
accguguuggccaggcug

SEQ ID NO: 467585 - RNA, 24 nt, Human
acgaggucucaccauguuggccag

SEQ ID NO: 467586 - RNA, 23 nt, Human
agacaggguuucaccauguugcc

SEQ ID NO: 467587 - RNA, 19 nt, Human
agagaugggguuucaccgu

SEQ ID NO: 467588 - RNA, 24 nt, Human
agcuggucucgaacuccugaccuc

SEQ ID NO: 467589 - RNA, 23 nt, Human
aggagugcaguagugugaucuca

SEQ ID NO: 467590 - RNA, 22 nt, Human
aggcaauccaccugcccuggcc

SEQ ID NO: 467591 - RNA, 24 nt, Human
aggcaauccaccugcccuggccuc

SEQ ID NO: 467592 - RNA, 23 nt, Human
aggcaugagccacugugcccggc

SEQ ID NO: 467593 - RNA, 23 nt, Human
aggguucaagugauucuccugcc

SEQ ID NO: 467594 - RNA, 22 nt, Human
aggucucaccauguuggccagg

SEQ ID NO: 467595 - RNA, 20 nt, Human
aguagagaugggguuucacc

SEQ ID NO: 467596 - RNA, 18 nt, Human
aguagcugggauuacaga

SEQ ID NO: 467597 - RNA, 18 nt, Human
aguagcugggauuacagg

SEQ ID NO: 467598 - RNA, 24 nt, Human
agugauucuccugccucagccucc

SEQ ID NO: 467599 - RNA, 21 nt, Human
agugcaguagugugaucucag

SEQ ID NO: 467600 - RNA, 24 nt, Human
agugcaguagugugaucucagcuc

SEQ ID NO: 467601 - RNA, 24 nt, Human
agugcaguggcuccaucucggcuc

SEQ ID NO: 467602 - RNA, 21 nt, Human
aucauuuccauuuagcucagg

SEQ ID NO: 467603 - RNA, 23 nt, Human
augggguuucaccguguuggcca

SEQ ID NO: 467604 - RNA, 24 nt, Human
augggguuucaccguguuggccag

SEQ ID NO: 467605 - RNA, 18 nt, Human
auucuccugccucagccu

SEQ ID NO: 467606 - RNA, 24 nt, Human
auuuuuguauuuuuaguagagaug

SEQ ID NO: 467607 - RNA, 24 nt, Human
caaagugcuaggauuacaggggug

SEQ ID NO: 467608 - RNA, 24 nt, Human
caaaguucugggaccacaggcaug

SEQ ID NO: 467609 - RNA, 22 nt, Human
caagccauucuucugccucagc

SEQ ID NO: 467610 - RNA, 23 nt, Human
caagggaacagugaauuuggccc

SEQ ID NO: 467611 - RNA, 20 nt, Human
caagugauucuccugccuca

SEQ ID NO: 467612 - RNA, 22 nt, Human
caagugauucuccugccucagc

SEQ ID NO: 467613 - RNA, 23 nt, Human
cacaggcaugagccacugugccc

SEQ ID NO: 467614 - RNA, 20 nt, Human
caccacaaccucugccucca

SEQ ID NO: 467615 - RNA, 20 nt, Human
caccacaaccucugccucca

SEQ ID NO: 467616 - RNA, 23 nt, Human
caccauguugcccagcuggucuc

SEQ ID NO: 467617 - RNA, 26 nt, Human
caccauguugcccagcuggucucgaa

SEQ ID NO: 467618 - RNA, 21 nt, Human
caccauguuggccaggcuggu

SEQ ID NO: 467619 - RNA, 24 nt, Human
caccauguuggccaggcuggucuc

SEQ ID NO: 467620 - RNA, 23 nt, Human
cacccgccucagccucccaaagu

SEQ ID NO: 467621 - RNA, 18 nt, Human
caccguguuggccaggcu

SEQ ID NO: 467622 - RNA, 19 nt, Human
caccguguuggccaggcug

SEQ ID NO: 467623 - RNA, 22 nt, Human
caccguguuggccaggcuguuc

SEQ ID NO: 467624 - RNA, 24 nt, Human
caccguguuggccaggcuguucuc

SEQ ID NO: 467625 - RNA, 19 nt, Human
caccucugccuccaggguu

SEQ ID NO: 467626 - RNA, 23 nt, Human
caccugcccuggccucccaaagu

SEQ ID NO: 467627 - RNA, 24 nt, Human
cacucugucaccugggcuggagug

SEQ ID NO: 467628 - RNA, 18 nt, Human
cagaggcccugagcugag

SEQ ID NO: 467629 - RNA, 21 nt, Human
caggcgcccgccacuacgccc

SEQ ID NO: 467630 - RNA, 21 nt, Human
caggguucaagccauucuucu

SEQ ID NO: 467631 - RNA, 18 nt, Human
caggguuucaccauguug

SEQ ID NO: 467632 - RNA, 20 nt, Human
cauguugcccagcuggucuc

SEQ ID NO: 467633 - RNA, 23 nt, Human
cauguugcccagcuggucucgaa

SEQ ID NO: 467634 - RNA, 23 nt, Human
cauguuggccaggcuggucucaa

SEQ ID NO: 467635 - RNA, 20 nt, Human
cauuuccauuuagcucagga

SEQ ID NO: 467636 - RNA, 19 nt, Human
ccaaagugaugggauuaca

SEQ ID NO: 467637 - RNA, 23 nt, Human
ccaaagugaugggauuacagcau

SEQ ID NO: 467638 - RNA, 19 nt, Human
ccaaagugcuaggauuaca

SEQ ID NO: 467639 - RNA, 24 nt, Human
ccaaaguucugggaccacaggcau

SEQ ID NO: 467640 - RNA, 24 nt, Human
ccacaaccucugccuccaggguuc

SEQ ID NO: 467641 - RNA, 19 nt, Human
ccaggguucaagccauucu

SEQ ID NO: 467642 - RNA, 20 nt, Human
ccaggguucaagugauucuc

SEQ ID NO: 467643 - RNA, 23 nt, Human
ccaggguucaagugauucuccug

SEQ ID NO: 467644 - RNA, 22 nt, Human
ccaugcccagcuaauuuuugua

SEQ ID NO: 467645 - RNA, 23 nt, Human
cccgaccucaggcaauccaccug

SEQ ID NO: 467646 - RNA, 19 nt, Human
cccgaguagcugggauuac

SEQ ID NO: 467647 - RNA, 23 nt, Human
cccgaguagcugggauuacaggc

SEQ ID NO: 467648 - RNA, 24 nt, Human
cccgaguagcugggauuacaggcg

SEQ ID NO: 467649 - RNA, 23 nt, Human
cccugagcugaggccacccuggc

SEQ ID NO: 467650 - RNA, 22 nt, Human
ccgaguagcugggauuacaggc

SEQ ID NO: 467651 - RNA, 24 nt, Human
ccgccucagccucccaaagugcua

SEQ ID NO: 467652 - RNA, 21 nt, Human
ccgcgccuggccuaauuucug

SEQ ID NO: 467653 - RNA, 21 nt, Human
ccuacaccuuuaucuccuuac

SEQ ID NO: 467654 - RNA, 21 nt, Human
ccuacauuugaaaaaauccau

SEQ ID NO: 467655 - RNA, 24 nt, Human
ccuccaggguucaagugauucucc

SEQ ID NO: 467656 - RNA, 19 nt, Human
ccugaccucaagugaucug

SEQ ID NO: 467657 - RNA, 22 nt, Human
ccugaccucaagugaucugccc

SEQ ID NO: 467658 - RNA, 21 nt, Human
ccugaccucgugauucacccg

SEQ ID NO: 467659 - RNA, 23 nt, Human
ccugccucagccucccgaguagc

SEQ ID NO: 467660 - RNA, 24 nt, Human
cgaggucucaccauguuggccagg

SEQ ID NO: 467661 - RNA, 24 nt, Human
cgccucagccucccaaagugcuag

SEQ ID NO: 467662 - RNA, 24 nt, Human
cgugauucacccgccucagccucc

SEQ ID NO: 467663 - RNA, 23 nt, Human
cuauccuacauuugaaaaaaucc

SEQ ID NO: 467664 - RNA, 24 nt, Human
cucacucugucaccugggcuggag

SEQ ID NO: 467665 - RNA, 24 nt, Human
cucagccucccgaguagcugggau

SEQ ID NO: 467666 - RNA, 24 nt, Human
cucagccucccgaguagcugggau

SEQ ID NO: 467667 - RNA, 19 nt, Human
cuccaggguucaagugauu

SEQ ID NO: 467668 - RNA, 26 nt, Human
cuccaucucggcucacuaccaccucu

SEQ ID NO: 467669 - RNA, 25 nt, Human
cuccugaccucaagugaucugcccg

SEQ ID NO: 467670 - RNA, 24 nt, Human
cuccugaccucgugauucacccgc

SEQ ID NO: 467671 - RNA, 23 nt, Human
cucugucaccugggcuggagugc

SEQ ID NO: 467672 - RNA, 23 nt, Human
cugccucagccucccgaguagcu

SEQ ID NO: 467673 - RNA, 20 nt, Human
cugccuccaggguucaagcc

SEQ ID NO: 467674 - RNA, 19 nt, Human
cugucaccugggcuggagu

SEQ ID NO: 467675 - RNA, 22 nt, Human
gaaaaaauccaucuaaccagaa

SEQ ID NO: 467676 - RNA, 22 nt, Human
gaauaauauaauuuugaccuuc

SEQ ID NO: 467677 - RNA, 21 nt, Human
gaccacaggcaugagccacug

SEQ ID NO: 467678 - RNA, 24 nt, Human
gaccucaagugaucugcccgucuc

SEQ ID NO: 467679 - RNA, 22 nt, Human
gaccucgugauucacccgccuc

SEQ ID NO: 467680 - RNA, 24 nt, Human
gaccucgugauucacccgccucag

SEQ ID NO: 467681 - RNA, 19 nt, Human
gaccuucuaaaacacacca

SEQ ID NO: 467682 - RNA, 18 nt, Human
gagaugggguuucaccgu

SEQ ID NO: 467683 - RNA, 24 nt, Human
gagaugggguuucaccguguuggc

SEQ ID NO: 467684 - RNA, 24 nt, Human
gagccacugugcccggccuacacc

SEQ ID NO: 467685 - RNA, 24 nt, Human
gaguagcugggauuacagacacac

SEQ ID NO: 467686 - RNA, 25 nt, Human
gaguagcugggauuacaggcgcccg

SEQ ID NO: 467687 - RNA, 22 nt, Human
gauuacagacacacgccgccau

SEQ ID NO: 467688 - RNA, 21 nt, Human
gauuacagcaugaaccacugc

SEQ ID NO: 467689 - RNA, 18 nt, Human
gauuacaggcgcccgcca

SEQ ID NO: 467690 - RNA, 18 nt, Human
gauuacaggggugagcca

SEQ ID NO: 467691 - RNA, 23 nt, Human
gcaggagugcaguagugugaucu

SEQ ID NO: 467692 - RNA, 22 nt, Human
gcccagcuaauuuuuguauuuu

SEQ ID NO: 467693 - RNA, 18 nt, Human
gcccugugaauaauauaa

SEQ ID NO: 467694 - RNA, 18 nt, Human
gcuggagugcaguggcuc

SEQ ID NO: 467695 - RNA, 23 nt, Human
gcuggucucaaucuccugaccuc

SEQ ID NO: 467696 - RNA, 20 nt, Human
ggaccacaggcaugagccac

SEQ ID NO: 467697 - RNA, 22 nt, Human
ggauuacaggggugagccaccg

SEQ ID NO: 467698 - RNA, 23 nt, Human
ggcaauccaccugcccuggccuc

SEQ ID NO: 467699 - RNA, 24 nt, Human
ggcuggucucaaucuccugaccuc

SEQ ID NO: 467700 - RNA, 22 nt, Human
gggguuucaccguguuggccag

SEQ ID NO: 467701 - RNA, 23 nt, Human
ggguucaagugauucuccugccu

SEQ ID NO: 467702 - RNA, 18 nt, Human
ggucucaccauguuggcc

SEQ ID NO: 467703 - RNA, 19 nt, Human
ggucucgaacuccugaccu

SEQ ID NO: 467704 - RNA, 23 nt, Human
ggugagcagagauggggaaggga

SEQ ID NO: 467705 - RNA, 24 nt, Human
gguuuuguauuuuuaguagagaca

SEQ ID NO: 467706 - RNA, 18 nt, Human
guagcugggauuacaggc

SEQ ID NO: 467707 - RNA, 24 nt, Human
gugauucacccgccucagccuccc

SEQ ID NO: 467708 - RNA, 24 nt, Human
gugauucuccugccucagccuccc

SEQ ID NO: 467709 - RNA, 24 nt, Human
uaauuucuguauuuuuaguaaaga

SEQ ID NO: 467710 - RNA, 24 nt, Human
uaauuuuuguauuuuuaguagaga

SEQ ID NO: 467711 - RNA, 24 nt, Human
uacagacacacgccgccaugccca

SEQ ID NO: 467712 - RNA, 22 nt, Human
uacaggggugagccaccgcgcc

SEQ ID NO: 467713 - RNA, 22 nt, Human
uacaggggugagccaccgcgcc

SEQ ID NO: 467714 - RNA, 23 nt, Human
uacaggggugagccaccgcgccu

SEQ ID NO: 467715 - RNA, 22 nt, Human
uagagacaggguuucaccaugu

SEQ ID NO: 467716 - RNA, 22 nt, Human
uaggauuacaggggugagccac

SEQ ID NO: 467717 - RNA, 23 nt, Human
uaggauuacaggggugagccacc

SEQ ID NO: 467718 - RNA, 24 nt, Human
uaggauuacaggggugagccaccg

SEQ ID NO: 467719 - RNA, 26 nt, Human
uaguaaagacgaggucucaccauguu

SEQ ID NO: 467720 - RNA, 24 nt, Human
uaguagagacaggguuucaccaug

SEQ ID NO: 467721 - RNA, 26 nt, Human
uaguagagacaggguuucaccauguu

SEQ ID NO: 467722 - RNA, 21 nt, Human
uaguagagaugggguuucacc

SEQ ID NO: 467723 - RNA, 24 nt, Human
uaguagagaugggguuucaccgug

SEQ ID NO: 467724 - RNA, 26 nt, Human
uaguagagaugggguuucaccguguu

SEQ ID NO: 467725 - RNA, 24 nt, Human
uagugugaucucagcucaccacaa

SEQ ID NO: 467726 - RNA, 25 nt, Human
ucaagccauucuucugccucagccu

SEQ ID NO: 467727 - RNA, 19 nt, Human
ucaagugauucuccugccu

SEQ ID NO: 467728 - RNA, 25 nt, Human
ucaccacaaccucugccuccagggu

SEQ ID NO: 467729 - RNA, 27 nt, Human
ucaccacaaccucugccuccaggguuc

SEQ ID NO: 467730 - RNA, 19 nt, Human
ucaccguguuggccaggcu

SEQ ID NO: 467731 - RNA, 24 nt, Human
ucaccugggcuggagugcaguggc

SEQ ID NO: 467732 - RNA, 20 nt, Human
ucagccucccgaguagcugg

SEQ ID NO: 467733 - RNA, 20 nt, Human
ucagccucccgaguagcugg

SEQ ID NO: 467734 - RNA, 24 nt, Human
uccaggguucaagccauucuucug

SEQ ID NO: 467735 - RNA, 24 nt, Human
uccaggguucaagugauucuccug

SEQ ID NO: 467736 - RNA, 22 nt, Human
ucccaaagugaugggauuacag

SEQ ID NO: 467737 - RNA, 23 nt, Human
ucccaaagugcuaggauuacagg

SEQ ID NO: 467738 - RNA, 18 nt, Human
ucccaaaguucugggacc

SEQ ID NO: 467739 - RNA, 24 nt, Human
ucccaaaguucugggaccacaggc

SEQ ID NO: 467740 - RNA, 18 nt, Human
ucccgaguagcugggauu

SEQ ID NO: 467741 - RNA, 24 nt, Human
ucccgaguagcugggauuacaggc

SEQ ID NO: 467742 - RNA, 23 nt, Human
ucuaaccagaagaacuuugagcc

SEQ ID NO: 467743 - RNA, 18 nt, Human
ucuauccuacauuugaaa

SEQ ID NO: 467744 - RNA, 24 nt, Human
ucucaccauguuggccaggcuggu

SEQ ID NO: 467745 - RNA, 23 nt, Human
ucucacucugucaccugggcugg

SEQ ID NO: 467746 - RNA, 24 nt, Human
ucucacucugucaccugggcugga

SEQ ID NO: 467747 - RNA, 24 nt, Human
ucuccugccucagccucccgagua

SEQ ID NO: 467748 - RNA, 19 nt, Human
ucucgaacuccugaccucg

SEQ ID NO: 467749 - RNA, 24 nt, Human
ucugccucagccucccgaguagcu

SEQ ID NO: 467750 - RNA, 24 nt, Human
ucugccuccaggguucaagugauu

SEQ ID NO: 467751 - RNA, 24 nt, Human
ucugucaccugggcuggagugcag

SEQ ID NO: 467752 - RNA, 19 nt, Human
ucuguggauguggggacua

SEQ ID NO: 467753 - RNA, 19 nt, Human
ucuuuauuuugagacagag

SEQ ID NO: 467754 - RNA, 18 nt, Human
ugaccucaagugaucugc

SEQ ID NO: 467755 - RNA, 24 nt, Human
ugaccucaagugaucugcccgucu

SEQ ID NO: 467756 - RNA, 18 nt, Human
ugagacagagucucacuc

SEQ ID NO: 467757 - RNA, 22 nt, Human
ugagacagagucucacucuguc

SEQ ID NO: 467758 - RNA, 22 nt, Human
ugagacagagucucagucgccc

SEQ ID NO: 467759 - RNA, 20 nt, Human
ugcaggagugcaguaguguu

SEQ ID NO: 467760 - RNA, 22 nt, Human
ugcaguagugugaucucagcuc

SEQ ID NO: 467761 - RNA, 22 nt, Human
ugcaguggcuccaucucggcuc

SEQ ID NO: 467762 - RNA, 24 nt, Human
ugccucagccucccgaguagcugg

SEQ ID NO: 467763 - RNA, 24 nt, Human
ugccucagccucccgaguagcugg

SEQ ID NO: 467764 - RNA, 20 nt, Human
uggaagacugggcaccuggu

SEQ ID NO: 467765 - RNA, 23 nt, Human
uggagugcaguggcuccaucucg

SEQ ID NO: 467766 - RNA, 24 nt, Human
uggagugcaguggcuccaucucgg

SEQ ID NO: 467767 - RNA, 24 nt, Human
uggccaggcuggucucaaucuccu

SEQ ID NO: 467768 - RNA, 21 nt, Human
uggccaggcuguucucaaacu

SEQ ID NO: 467769 - RNA, 21 nt, Human
ugggaccacaggcaugagcca

SEQ ID NO: 467770 - RNA, 22 nt, Human
ugggaccacaggcaugagccac

SEQ ID NO: 467771 - RNA, 23 nt, Human
ugggaccacaggcaugagccacu

SEQ ID NO: 467772 - RNA, 24 nt, Human
ugggaccacaggcaugagccacug

SEQ ID NO: 467773 - RNA, 26 nt, Human
ugggaccacaggcaugagccacugug

SEQ ID NO: 467774 - RNA, 21 nt, Human
ugggauuacagacacacgccg

SEQ ID NO: 467775 - RNA, 22 nt, Human
ugggauuacagacacacgccgc

SEQ ID NO: 467776 - RNA, 24 nt, Human
ugggauuacagacacacgccgcca

SEQ ID NO: 467777 - RNA, 25 nt, Human
ugggauuacagacacacgccgccau

SEQ ID NO: 467778 - RNA, 21 nt, Human
ugggauuacagcaugaaccac

SEQ ID NO: 467779 - RNA, 23 nt, Human
ugggauuacagcaugaaccacug

SEQ ID NO: 467780 - RNA, 25 nt, Human
ugggauuacagcaugaaccacugcg

SEQ ID NO: 467781 - RNA, 21 nt, Human
ugggauuacaggcgcccgcca

SEQ ID NO: 467782 - RNA, 22 nt, Human
ugggauuacaggcgcccgccac

SEQ ID NO: 467783 - RNA, 22 nt, Human
ugggauuacaggcgcccgccac

SEQ ID NO: 467784 - RNA, 24 nt, Human
ugggauuacaggcgcccgccacua

SEQ ID NO: 467785 - RNA, 21 nt, Human
ugggcaccuggugccaggccc

SEQ ID NO: 467786 - RNA, 18 nt, Human
uggggaagggaguugcuc

SEQ ID NO: 467787 - RNA, 24 nt, Human
ugggguuucaccguguuggccagg

SEQ ID NO: 467788 - RNA, 24 nt, Human
ugucacagaggcccugagcugagg

SEQ ID NO: 467789 - RNA, 19 nt, Human
uguucucaaacucccgacc

SEQ ID NO: 467790 - RNA, 22 nt, Human
uguuggccaggcuguucucaaa

SEQ ID NO: 467791 - RNA, 24 nt, Human
uuaguagagacaggguuucaccau

SEQ ID NO: 467792 - RNA, 18 nt, Human
uuaguagagaugggguuu

SEQ ID NO: 467793 - RNA, 22 nt, Human
uuaguagagaugggguuucacc

SEQ ID NO: 467794 - RNA, 24 nt, Human
uuaguagagaugggguuucaccgu

SEQ ID NO: 467795 - RNA, 18 nt, Human
uucaagccauucuucugc

SEQ ID NO: 467796 - RNA, 21 nt, Human
uucaagccauucuucugccuc

SEQ ID NO: 467797 - RNA, 21 nt, Human
uucaagugauucuccugccuc

SEQ ID NO: 467798 - RNA, 23 nt, Human
uucaagugauucuccugccucag

SEQ ID NO: 467799 - RNA, 24 nt, Human
uucaagugauucuccugccucagc

SEQ ID NO: 467800 - RNA, 21 nt, Human
uucacccgccucagccuccca

SEQ ID NO: 467801 - RNA, 24 nt, Human
uugcccagcuggucucgaacuccu

SEQ ID NO: 467802 - RNA, 23 nt, Human
uuguauuuuuaguagagaugggg

SEQ ID NO: 467803 - RNA, 18 nt, Human
uuucaccauguugcccag

SEQ ID NO: 467804 - RNA, 21 nt, Human
uuucaccguguuggccaggcu

SEQ ID NO: 467805 - RNA, 21 nt, Human
uuuucaguaagucaaacacua

SEQ ID NO: 467806 - RNA, 19 nt, Human
uuuuguauuuuuaguagag

SEQ ID NO: 467807 - RNA, 20 nt, Human
uuuuguauuuuuaguagaga

SEQ ID NO: 467808 - RNA, 24 nt, Human
uuuuuaguagagacaggguuucac

SEQ ID NO: 467809 - RNA, 24 nt, Human
uuuuuaguagagaugggguuucac

SEQ ID NO: 467810 - RNA, 20 nt, Human
uuuuuguauuuuuaguagag

SEQ ID NO: 467811 - RNA, 20 nt, Human
uuuuuuuuuuugagacagag

SEQ ID NO: 467812 - RNA, 26 nt, Human
uuuuuuuuuuuugagacagagucuca

SEQ ID NO: 467813 - RNA, 18 nt, Human
uuuuuuuuuuuuuuuuug

SEQ ID NO: 467814 - RNA, 26 nt, Human
aaaagaaacccuacaacccuaaaacc

SEQ ID NO: 467815 - RNA, 24 nt, Human
aaagugcugggauuacaggcguga

SEQ ID NO: 467816 - RNA, 18 nt, Human
aacccuaaaacccuaaaa

SEQ ID NO: 467817 - RNA, 22 nt, Human
aacccuacaacccuaaaacccu

SEQ ID NO: 467818 - RNA, 19 nt, Human
aacuccuucaacuacguga

SEQ ID NO: 467819 - RNA, 23 nt, Human
aagaaacccuacaacccuaaaac

SEQ ID NO: 467820 - RNA, 20 nt, Human
aagacaguaaaaccuuuugg

SEQ ID NO: 467821 - RNA, 24 nt, Human
aagccaaggaauugcuuuaaacac

SEQ ID NO: 467822 - RNA, 19 nt, Human
aagugcugggauuacaggc

SEQ ID NO: 467823 - RNA, 19 nt, Human
aagugcugggauuacaggc

SEQ ID NO: 467824 - RNA, 26 nt, Human
aagugcugggauuacaggcgugagcc

SEQ ID NO: 467825 - RNA, 23 nt, Human
aaguuugagauagaagauugucu

SEQ ID NO: 467826 - RNA, 23 nt, Human
accccgcaggacagaauuacuuc

SEQ ID NO: 467827 - RNA, 20 nt, Human
acccuaaaacccuaaaacca

SEQ ID NO: 467828 - RNA, 19 nt, Human
acccuacaacccuaaaacc

SEQ ID NO: 467829 - RNA, 21 nt, Human
acccuacaacccuaaaacccu

SEQ ID NO: 467830 - RNA, 22 nt, Human
acccuacaacccuaaaacccua

SEQ ID NO: 467831 - RNA, 22 nt, Human
acccuacaacccuaaaacccuu

SEQ ID NO: 467832 - RNA, 22 nt, Human
accgcaccuggccucuaugcuc

SEQ ID NO: 467833 - RNA, 23 nt, Human
acgcugcauauuaaacuguaggc

SEQ ID NO: 467834 - RNA, 18 nt, Human
acgggguuucaucauguu

SEQ ID NO: 467835 - RNA, 23 nt, Human
acgggguuucaucauguuggcca

SEQ ID NO: 467836 - RNA, 24 nt, Human
acgggguuucaucauguuggccag

SEQ ID NO: 467837 - RNA, 19 nt, Human
acuacaggcgugugccacc

SEQ ID NO: 467838 - RNA, 21 nt, Human
agaaaaaccaucuggaaucag

SEQ ID NO: 467839 - RNA, 22 nt, Human
agaguucuaccugaaagaccuu

SEQ ID NO: 467840 - RNA, 21 nt, Human
agcaaugcugccucagccucc

SEQ ID NO: 467841 - RNA, 20 nt, Human
agccaccgcaccuggccucu

SEQ ID NO: 467842 - RNA, 21 nt, Human
agccucucccuggcuuguauu

SEQ ID NO: 467843 - RNA, 22 nt, Human
agcugggacuacaggcgugugc

SEQ ID NO: 467844 - RNA, 22 nt, Human
aggaguggagugggguuggggc

SEQ ID NO: 467845 - RNA, 24 nt, Human
aggcgugugccaccacacccggcu

SEQ ID NO: 467846 - RNA, 25 nt, Human
aggcuggagugcaguggugugaucu

SEQ ID NO: 467847 - RNA, 23 nt, Human
aguagcugggacuacaggcgugu

SEQ ID NO: 467848 - RNA, 23 nt, Human
agugcaguggugugaucuuggcu

SEQ ID NO: 467849 - RNA, 24 nt, Human
agugcaguggugugaucuuggcuc

SEQ ID NO: 467850 - RNA, 18 nt, Human
agugcugggauuacaggc

SEQ ID NO: 467851 - RNA, 20 nt, Human
aguucccugauccuuugacc

SEQ ID NO: 467852 - RNA, 20 nt, Human
aguuuuucuuuuuuuuuuuu

SEQ ID NO: 467853 - RNA, 27 nt, Human
aucaguuuuucuuuuuuuuuuuuuuuu

SEQ ID NO: 467854 - RNA, 24 nt, Human
caaagugcugggauuacaggcgug

SEQ ID NO: 467855 - RNA, 20 nt, Human
caaccuccaccuccuggguu

SEQ ID NO: 467856 - RNA, 23 nt, Human
caaccuccaccuccuggguucaa

SEQ ID NO: 467857 - RNA, 19 nt, Human
caaggaacauuuguaggcu

SEQ ID NO: 467858 - RNA, 19 nt, Human
caagugacacgccugcccc

SEQ ID NO: 467859 - RNA, 19 nt, Human
caaugaaacauaccagaac

SEQ ID NO: 467860 - RNA, 24 nt, Human
cacagacccucgccaaagucuccc

SEQ ID NO: 467861 - RNA, 24 nt, Human
caccacacccggcuaauuuuugua

SEQ ID NO: 467862 - RNA, 22 nt, Human
cacgccugccucaaccucccaa

SEQ ID NO: 467863 - RNA, 21 nt, Human
cacugcaaccuccaccuccug

SEQ ID NO: 467864 - RNA, 23 nt, Human
cacugcaaccuccaccuccuggg

SEQ ID NO: 467865 - RNA, 26 nt, Human
cagacaguguaaacaucaguuaaaga

SEQ ID NO: 467866 - RNA, 25 nt, Human
cagcugacaacaaauaucagcggaa

SEQ ID NO: 467867 - RNA, 23 nt, Human
cagguggagaaauuguccuacaa

SEQ ID NO: 467868 - RNA, 25 nt, Human
caguagcugggacuacaggcgugug

SEQ ID NO: 467869 - RNA, 19 nt, Human
cauaggcauuacuagggac

SEQ ID NO: 467870 - RNA, 19 nt, Human
cauauuaaguuuugcuuca

SEQ ID NO: 467871 - RNA, 24 nt, Human
caucauguuggccaggcuggucuc

SEQ ID NO: 467872 - RNA, 27 nt, Human
caucauguuggccaggcuggucucgaa

SEQ ID NO: 467873 - RNA, 18 nt, Human
cauguuggccaggcuggu

SEQ ID NO: 467874 - RNA, 21 nt, Human
cauguuggccaggcuggucuc

SEQ ID NO: 467875 - RNA, 22 nt, Human
cauguuggccaggcuggucucg

SEQ ID NO: 467876 - RNA, 24 nt, Human
cauguuggccaggcuggucucgaa

SEQ ID NO: 467877 - RNA, 22 nt, Human
ccaaagugcugggauuacaggc

SEQ ID NO: 467878 - RNA, 22 nt, Human
ccaaagugcugggauuacaggc

SEQ ID NO: 467879 - RNA, 24 nt, Human
ccaaagugcugggauuacaggcgu

SEQ ID NO: 467880 - RNA, 20 nt, Human
ccaccacacccggcuaauuu

SEQ ID NO: 467881 - RNA, 22 nt, Human
ccaucuccgaugccuugcugac

SEQ ID NO: 467882 - RNA, 19 nt, Human
cccacaaggaacauuugua

SEQ ID NO: 467883 - RNA, 19 nt, Human
cccaggcuggagugcagug

SEQ ID NO: 467884 - RNA, 23 nt, Human
cccaguagcugggacuacaggcg

SEQ ID NO: 467885 - RNA, 19 nt, Human
cccuaccucuccaaaagaa

SEQ ID NO: 467886 - RNA, 24 nt, Human
cccucugucgcccaggcuggagug

SEQ ID NO: 467887 - RNA, 22 nt, Human
ccuaaaaccaauccaaaucaug

SEQ ID NO: 467888 - RNA, 25 nt, Human
ccuaaaacccuaaaaccaauccaaa

SEQ ID NO: 467889 - RNA, 19 nt, Human
ccuccaccuccuggguuca

SEQ ID NO: 467890 - RNA, 23 nt, Human
ccucuccaaaagaaacccuacaa

SEQ ID NO: 467891 - RNA, 25 nt, Human
ccucugucgcccaggcuggagugca

SEQ ID NO: 467892 - RNA, 21 nt, Human
ccuggccucaagugacacgcc

SEQ ID NO: 467893 - RNA, 22 nt, Human
ccuggccucaagugacacgccu

SEQ ID NO: 467894 - RNA, 23 nt, Human
ccuggccucaagugacacgccug

SEQ ID NO: 467895 - RNA, 23 nt, Human
cuaaaacccuaaaaccaauccaa

SEQ ID NO: 467896 - RNA, 20 nt, Human
cuaggcgcagcacccgcgcc

SEQ ID NO: 467897 - RNA, 24 nt, Human
cucacugcaaccuccaccuccugg

SEQ ID NO: 467898 - RNA, 26 nt, Human
cucacugcaaccuccaccuccugggu

SEQ ID NO: 467899 - RNA, 24 nt, Human
cucagccuccccaguagcugggac

SEQ ID NO: 467900 - RNA, 24 nt, Human
cuccaaaagaaacccuacaacccc

SEQ ID NO: 467901 - RNA, 24 nt, Human
cucccucugucgcccaggcuggag

SEQ ID NO: 467902 - RNA, 18 nt, Human
cugcaaccuccaccuccu

SEQ ID NO: 467903 - RNA, 24 nt, Human
cugcaaccuccaccuccuggguuc

SEQ ID NO: 467904 - RNA, 24 nt, Human
cugccucaaccucccaaagugcug

SEQ ID NO: 467905 - RNA, 24 nt, Human
cugcuccugacuacuauaaggacg

SEQ ID NO: 467906 - RNA, 23 nt, Human
gaaacccuacaacccuaaaaccc

SEQ ID NO: 467907 - RNA, 19 nt, Human
gaaagacagcuuuaagaca

SEQ ID NO: 467908 - RNA, 22 nt, Human
gacaagugcuaugaauauuccu

SEQ ID NO: 467909 - RNA, 22 nt, Human
gagaacauagcaauuagccccc

SEQ ID NO: 467910 - RNA, 18 nt, Human
gagacgggguuucaucau

SEQ ID NO: 467911 - RNA, 24 nt, Human
gagacgggguuucaucauguuggc

SEQ ID NO: 467912 - RNA, 18 nt, Human
gauuacaggcgugagcca

SEQ ID NO: 467913 - RNA, 22 nt, Human
gauuacaggcgugagccaccgc

SEQ ID NO: 467914 - RNA, 23 nt, Human
gauuacaggcgugagccaccgca

SEQ ID NO: 467915 - RNA, 20 nt, Human
gcccaggcuggagugcagug

SEQ ID NO: 467916 - RNA, 23 nt, Human
gcccaggcuggagugcaguggug

SEQ ID NO: 467917 - RNA, 24 nt, Human
gcccaggcuggagugcaguggugu

SEQ ID NO: 467918 - RNA, 24 nt, Human
gcugccucagccuccccaguagcu

SEQ ID NO: 467919 - RNA, 23 nt, Human
gcuggucucgaacuccuggccuc

SEQ ID NO: 467920 - RNA, 19 nt, Human
ggacuacaggcgugugcca

SEQ ID NO: 467921 - RNA, 19 nt, Human
ggagacuggcauagaaagu

SEQ ID NO: 467922 - RNA, 24 nt, Human
ggccucaagugacacgccugccuc

SEQ ID NO: 467923 - RNA, 22 nt, Human
ggcuggagugcaguggugugau

SEQ ID NO: 467924 - RNA, 24 nt, Human
ggcuggucucgaacuccuggccuc

SEQ ID NO: 467925 - RNA, 19 nt, Human
gggcuuaggagagagcaau

SEQ ID NO: 467926 - RNA, 26 nt, Human
gggcuuaggagagagcaauguggcuc

SEQ ID NO: 467927 - RNA, 18 nt, Human
gggguuggggcuuaggag

SEQ ID NO: 467928 - RNA, 23 nt, Human
gggguuucaucauguuggccagg

SEQ ID NO: 467929 - RNA, 22 nt, Human
ggguuucaucauguuggccagg

SEQ ID NO: 467930 - RNA, 22 nt, Human
gguuuauucaguucucugaugg

SEQ ID NO: 467931 - RNA, 23 nt, Human
guagagacgggguuucaucaugu

SEQ ID NO: 467932 - RNA, 18 nt, Human
guagcugggacuacaggc

SEQ ID NO: 467933 - RNA, 24 nt, Human
guaguagagacgggguuucaucau

SEQ ID NO: 467934 - RNA, 21 nt, Human
gugaaucuggguucccagagu

SEQ ID NO: 467935 - RNA, 24 nt, Human
gugacaagugcuaugaauauuccu

SEQ ID NO: 467936 - RNA, 19 nt, Human
guggagaaauuguccuaca

SEQ ID NO: 467937 - RNA, 27 nt, Human
guugccuucuauuugugacaagugcua

SEQ ID NO: 467938 - RNA, 20 nt, Human
uaaaacccuaaaaccaaucc

SEQ ID NO: 467939 - RNA, 22 nt, Human
uaaaacccuaaaaccaauccaa

SEQ ID NO: 467940 - RNA, 19 nt, Human
uaaacacaagaugaaaaua

SEQ ID NO: 467941 - RNA, 20 nt, Human
uaaacuguaggcagcugaca

SEQ ID NO: 467942 - RNA, 24 nt, Human
uaauuuuuguauuuguaguagaga

SEQ ID NO: 467943 - RNA, 22 nt, Human
uacaggcgugagccaccgcacc

SEQ ID NO: 467944 - RNA, 23 nt, Human
uacaggcgugagccaccgcaccu

SEQ ID NO: 467945 - RNA, 23 nt, Human
uacaggcgugugccaccacaccc

SEQ ID NO: 467946 - RNA, 22 nt, Human
uaccugaaagaccuugcaggug

SEQ ID NO: 467947 - RNA, 22 nt, Human
uagaagaaauagguuuucagug

SEQ ID NO: 467948 - RNA, 19 nt, Human
uagcuguggagaaguccuu

SEQ ID NO: 467949 - RNA, 18 nt, Human
uagguuucaccaucaguu

SEQ ID NO: 467950 - RNA, 23 nt, Human
uaguagagacgggguuucaucau

SEQ ID NO: 467951 - RNA, 24 nt, Human
uaguagagacgggguuucaucaug

SEQ ID NO: 467952 - RNA, 24 nt, Human
uaguucccugauccuuugaccucc

SEQ ID NO: 467953 - RNA, 23 nt, Human
ucaaaagccugauuuuugcuggc

SEQ ID NO: 467954 - RNA, 23 nt, Human
ucacugcaaccuccaccuccugg

SEQ ID NO: 467955 - RNA, 24 nt, Human
ucacugcaaccuccaccuccuggg

SEQ ID NO: 467956 - RNA, 25 nt, Human
ucacugcaaccuccaccuccugggu

SEQ ID NO: 467957 - RNA, 27 nt, Human
ucacugcaaccuccaccuccuggguuc

SEQ ID NO: 467958 - RNA, 22 nt, Human
ucagaaagacagcuuuaagaca

SEQ ID NO: 467959 - RNA, 20 nt, Human
ucagccuccccaguagcugg

SEQ ID NO: 467960 - RNA, 18 nt, Human
ucaguguguacgacugaa

SEQ ID NO: 467961 - RNA, 24 nt, Human
ucccaaagugcugggauuacaggc

SEQ ID NO: 467962 - RNA, 21 nt, Human
ucccagaguguggagcaagug

SEQ ID NO: 467963 - RNA, 22 nt, Human
uccccaguagcugggacuacag

SEQ ID NO: 467964 - RNA, 24 nt, Human
uccccaguagcugggacuacaggc

SEQ ID NO: 467965 - RNA, 20 nt, Human
ucccucugucgcccaggcug

SEQ ID NO: 467966 - RNA, 24 nt, Human
ucccucugucgcccaggcuggagu

SEQ ID NO: 467967 - RNA, 18 nt, Human
uccuggguucaagcaaug

SEQ ID NO: 467968 - RNA, 24 nt, Human
ucgcccaggcuggagugcaguggu

SEQ ID NO: 467969 - RNA, 21 nt, Human
ucuaccugaaagaccuugcag

SEQ ID NO: 467970 - RNA, 21 nt, Human
ucuccaaaagaaacccuacaa

SEQ ID NO: 467971 - RNA, 23 nt, Human
ucucccucugucgcccaggcugg

SEQ ID NO: 467972 - RNA, 24 nt, Human
ucucccucugucgcccaggcugga

SEQ ID NO: 467973 - RNA, 21 nt, Human
ucucgaacuccuggccucaag

SEQ ID NO: 467974 - RNA, 19 nt, Human
ucugcaaaaccaggauggc

SEQ ID NO: 467975 - RNA, 18 nt, Human
ucuguacaucuugcuggu

SEQ ID NO: 467976 - RNA, 24 nt, Human
ucugucgcccaggcuggagugcag

SEQ ID NO: 467977 - RNA, 24 nt, Human
ugaaguuugagauagaagauuguc

SEQ ID NO: 467978 - RNA, 25 nt, Human
ugacagggcagacuggugaaucugg

SEQ ID NO: 467979 - RNA, 21 nt, Human
ugacauggguagcuguggguc

SEQ ID NO: 467980 - RNA, 23 nt, Human
ugaggcaaaaaauuaaaauuguu

SEQ ID NO: 467981 - RNA, 22 nt, Human
ugcaguggugugaucuuggcuc

SEQ ID NO: 467982 - RNA, 19 nt, Human
ugcaucagagaauggccca

SEQ ID NO: 467983 - RNA, 24 nt, Human
ugccucaaccucccaaagugcugg

SEQ ID NO: 467984 - RNA, 21 nt, Human
ugccucagccuccccaguagc

SEQ ID NO: 467985 - RNA, 24 nt, Human
ugccucagccuccccaguagcugg

SEQ ID NO: 467986 - RNA, 24 nt, Human
ugcugggauuacaggcgugagcca

SEQ ID NO: 467987 - RNA, 21 nt, Human
uggaaucagccccaucauguc

SEQ ID NO: 467988 - RNA, 20 nt, Human
uggaccccuggccacaggag

SEQ ID NO: 467989 - RNA, 19 nt, Human
uggagugcaguggugugau

SEQ ID NO: 467990 - RNA, 23 nt, Human
uggagugcaguggugugaucuug

SEQ ID NO: 467991 - RNA, 24 nt, Human
uggagugcaguggugugaucuugg

SEQ ID NO: 467992 - RNA, 23 nt, Human
uggagugggguuggggcuuagga

SEQ ID NO: 467993 - RNA, 19 nt, Human
uggcagcuguuuugugaac

SEQ ID NO: 467994 - RNA, 24 nt, Human
uggccaggcuggucucgaacuccu

SEQ ID NO: 467995 - RNA, 23 nt, Human
uggcccagggggaacgugcauga

SEQ ID NO: 467996 - RNA, 24 nt, Human
uggccucaagugacacgccugccu

SEQ ID NO: 467997 - RNA, 21 nt, Human
uggccucuaugcucgaauuuc

SEQ ID NO: 467998 - RNA, 18 nt, Human
ugggacuacaggcgugug

SEQ ID NO: 467999 - RNA, 21 nt, Human
ugggacuacaggcgugugcca

SEQ ID NO: 468000 - RNA, 22 nt, Human
ugggacuacaggcgugugccac

SEQ ID NO: 468001 - RNA, 24 nt, Human
ugggacuacaggcgugugccacca

SEQ ID NO: 468002 - RNA, 18 nt, Human
ugggauuacaggcgugag

SEQ ID NO: 468003 - RNA, 19 nt, Human
ugggauuacaggcgugagc

SEQ ID NO: 468004 - RNA, 21 nt, Human
ugggauuacaggcgugagcca

SEQ ID NO: 468005 - RNA, 22 nt, Human
ugggauuacaggcgugagccac

SEQ ID NO: 468006 - RNA, 23 nt, Human
ugggauuacaggcgugagccacc

SEQ ID NO: 468007 - RNA, 24 nt, Human
ugggauuacaggcgugagccaccg

SEQ ID NO: 468008 - RNA, 26 nt, Human
uggguagcugugggucaaccaggaac

SEQ ID NO: 468009 - RNA, 23 nt, Human
uggugaaucuggguucccagagu

SEQ ID NO: 468010 - RNA, 23 nt, Human
uguaaacacaggcguucuguaca

SEQ ID NO: 468011 - RNA, 19 nt, Human
uguaauacaagccucuccc

SEQ ID NO: 468012 - RNA, 28 nt, Human
uuaagacaguaaaaccuuuuggcaaugg

SEQ ID NO: 468013 - RNA, 24 nt, Human
uuacuccuaacaaaguuugagauu

SEQ ID NO: 468014 - RNA, 23 nt, Human
uuauucugcuaguuccauaaaaa

SEQ ID NO: 468015 - RNA, 19 nt, Human
uucacaaaauuuaugaggc

SEQ ID NO: 468016 - RNA, 23 nt, Human
uuccuuuuuaagaagugauacaa

SEQ ID NO: 468017 - RNA, 23 nt, Human
uuucaucauguuggccaggcugu

SEQ ID NO: 468018 - RNA, 24 nt, Human
uuuguaguagagacgggguuucau

SEQ ID NO: 468019 - RNA, 20 nt, Human
uuuuuguauuuguaguagag

SEQ ID NO: 468020 - RNA, 23 nt, Human
uuuuuguauuuguaguagagacg

SEQ ID NO: 468021 - RNA, 23 nt, Human
uuuuuuuuuuuuuuuugcauagg

SEQ ID NO: 468022 - RNA, 18 nt, Human
uuuuuuuuuuuuuuuuug

SEQ ID NO: 468023 - RNA, 24 nt, Human
aaaaaaaaaaaaacacaaaaacca

SEQ ID NO: 468024 - RNA, 28 nt, Human
aaaaaaaaaaaacacaaaaaccacaggg

SEQ ID NO: 468025 - RNA, 25 nt, Human
aaaaaaaaaaacacaaaaaccacag

SEQ ID NO: 468026 - RNA, 26 nt, Human
aaaaaaaaaaacacaaaaaccacagg

SEQ ID NO: 468027 - RNA, 21 nt, Human
aaaaaaaacacaaaaaccaca

SEQ ID NO: 468028 - RNA, 20 nt, Human
aaaaaaacacaaaaaccaca

SEQ ID NO: 468029 - RNA, 26 nt, Human
aaaaaaacacaaaaaccacaggggua

SEQ ID NO: 468030 - RNA, 22 nt, Human
aaaaaacacauagcccccucac

SEQ ID NO: 468031 - RNA, 22 nt, Human
aaaaagaaaaaaaaaaaaacac

SEQ ID NO: 468032 - RNA, 26 nt, Human
aaaagaaaaaaaaaaaaacacaaaaa

SEQ ID NO: 468033 - RNA, 24 nt, Human
aaacaaaucaaacucaaugcccuc

SEQ ID NO: 468034 - RNA, 20 nt, Human
aaacacauagcccccucaca

SEQ ID NO: 468035 - RNA, 21 nt, Human
aaccacagggguaaggaaaaa

SEQ ID NO: 468036 - RNA, 20 nt, Human
aagcagaaucaugauucgug

SEQ ID NO: 468037 - RNA, 21 nt, Human
aagcagaaucaugauucgugc

SEQ ID NO: 468038 - RNA, 20 nt, Human
aaugucugccuaagcuaaca

SEQ ID NO: 468039 - RNA, 19 nt, Human
accaaagggaaaacaaauc

SEQ ID NO: 468040 - RNA, 18 nt, Human
accgaauccuucagcagc

SEQ ID NO: 468041 - RNA, 20 nt, Human
agcagccagaggcccccgaa

SEQ ID NO: 468042 - RNA, 18 nt, Human
agccagaggcccccgaac

SEQ ID NO: 468043 - RNA, 23 nt, Human
agccucuccugggcuggggagag

SEQ ID NO: 468044 - RNA, 18 nt, Human
aggaaaaacuuguaggug

SEQ ID NO: 468045 - RNA, 22 nt, Human
agggagaaaaagaguucucuac

SEQ ID NO: 468046 - RNA, 20 nt, Human
augagccaucuuugaauuag

SEQ ID NO: 468047 - RNA, 20 nt, Human
caacaaaacugcccagaaga

SEQ ID NO: 468048 - RNA, 19 nt, Human
caagucccacgacgcaggg

SEQ ID NO: 468049 - RNA, 20 nt, Human
cacuggaagagcaaaccgca

SEQ ID NO: 468050 - RNA, 22 nt, Human
cagccuaacagcacagcccucc

SEQ ID NO: 468051 - RNA, 22 nt, Human
caucccccaaaagccacacaac

SEQ ID NO: 468052 - RNA, 18 nt, Human
ccagaagagaugguucau

SEQ ID NO: 468053 - RNA, 24 nt, Human
ccagaccaaagggaaaacaaauca

SEQ ID NO: 468054 - RNA, 19 nt, Human
cccagaccaaagggaaaac

SEQ ID NO: 468055 - RNA, 20 nt, Human
ccccaaaagccacacaaccc

SEQ ID NO: 468056 - RNA, 23 nt, Human
cccccaaaagccacacaacccag

SEQ ID NO: 468057 - RNA, 21 nt, Human
cccccgaacacuggaagagca

SEQ ID NO: 468058 - RNA, 24 nt, Human
cccccucacacgcaucccccaaaa

SEQ ID NO: 468059 - RNA, 22 nt, Human
ccccucacacgcaucccccaaa

SEQ ID NO: 468060 - RNA, 25 nt, Human
ccccucacacgcaucccccaaaagc

SEQ ID NO: 468061 - RNA, 19 nt, Human
ccuauaaaaagaugccagg

SEQ ID NO: 468062 - RNA, 24 nt, Human
ccucacacgcaucccccaaaagcc

SEQ ID NO: 468063 - RNA, 21 nt, Human
cgcaaccuuccagauucuuca

SEQ ID NO: 468064 - RNA, 19 nt, Human
cgccggggcgcccgaguag

SEQ ID NO: 468065 - RNA, 18 nt, Human
cgugcggaaccugccucc

SEQ ID NO: 468066 - RNA, 22 nt, Human
cugcggcuccgcagccucuccu

SEQ ID NO: 468067 - RNA, 23 nt, Human
cugcggcuccgcagccucuccug

SEQ ID NO: 468068 - RNA, 18 nt, Human
cugggcuggggagaggug

SEQ ID NO: 468069 - RNA, 24 nt, Human
cuugcagucgcaggcugaucugag

SEQ ID NO: 468070 - RNA, 19 nt, Human
gaacacuggaagagcaaac

SEQ ID NO: 468071 - RNA, 25 nt, Human
gaauccuucagcagccagaggcccc

SEQ ID NO: 468072 - RNA, 18 nt, Human
ggaaaacaaaucaaacuc

SEQ ID NO: 468073 - RNA, 21 nt, Human
gguaaggaaaaacuuguaggu

SEQ ID NO: 468074 - RNA, 22 nt, Human
uaaaaaacacauagcccccuca

SEQ ID NO: 468075 - RNA, 21 nt, Human
uaaaaagaugccaggucaaaa

SEQ ID NO: 468076 - RNA, 19 nt, Human
uaagcuaacagaaagcaga

SEQ ID NO: 468077 - RNA, 22 nt, Human
uaagcuaacagaaagcagaauc

SEQ ID NO: 468078 - RNA, 22 nt, Human
uaaggaaaaacuuguaggugaa

SEQ ID NO: 468079 - RNA, 23 nt, Human
uauggaaaaagaaaaaaaaaaaa

SEQ ID NO: 468080 - RNA, 21 nt, Human
uccaccacgcaagcgcaggcu

SEQ ID NO: 468081 - RNA, 22 nt, Human
uccacugccuacaaaggccauu

SEQ ID NO: 468082 - RNA, 19 nt, Human
uccgcagccucuccugggc

SEQ ID NO: 468083 - RNA, 19 nt, Human
uccugggcuggggagaggu

SEQ ID NO: 468084 - RNA, 23 nt, Human
uccuugcaaguuuuccacugccu

SEQ ID NO: 468085 - RNA, 22 nt, Human
ucgugcggaaccugccucccgc

SEQ ID NO: 468086 - RNA, 18 nt, Human
ugaaaucaaagagaaacc

SEQ ID NO: 468087 - RNA, 19 nt, Human
ugccuaagcuaacagaaag

SEQ ID NO: 468088 - RNA, 25 nt, Human
uggaaaaagaaaaaaaaaaaaacac

SEQ ID NO: 468089 - RNA, 21 nt, Human
ugggcuggggagagguggcgg

SEQ ID NO: 468090 - RNA, 18 nt, Human
uucaacaaaacugcccag

SEQ ID NO: 468091 - RNA, 26 nt, Human
uuccuauggaaaaagaaaaaaaaaaa

SEQ ID NO: 468092 - RNA, 18 nt, Human
uuuuuuuuuuuuuuuuug

SEQ ID NO: 468093 - RNA, 25 nt, Human
aaaacccugagcccuuacuggaggg

SEQ ID NO: 468094 - RNA, 18 nt, Human
aaaauucagucucaccac

SEQ ID NO: 468095 - RNA, 25 nt, Human
aaaauucagucucaccacaagaagg

SEQ ID NO: 468096 - RNA, 20 nt, Human
aaacagacucucuaaccccc

SEQ ID NO: 468097 - RNA, 22 nt, Human
aaacagcaccaaacugcauuca

SEQ ID NO: 468098 - RNA, 18 nt, Human
aaagacacccagcuugaa

SEQ ID NO: 468099 - RNA, 19 nt, Human
aaagacacccagcuugaag

SEQ ID NO: 468100 - RNA, 21 nt, Human
aaagaggcccccugaaggccc

SEQ ID NO: 468101 - RNA, 20 nt, Human
aaagcaaaacccugagcccu

SEQ ID NO: 468102 - RNA, 18 nt, Human
aaagccacauggaucuag

SEQ ID NO: 468103 - RNA, 21 nt, Human
aaauugauacaaacuccucua

SEQ ID NO: 468104 - RNA, 23 nt, Human
aacacaaaacacccaaccagcuc

SEQ ID NO: 468105 - RNA, 20 nt, Human
aagcaacucagggcauccca

SEQ ID NO: 468106 - RNA, 24 nt, Human
aagcaacucagggcaucccaagag

SEQ ID NO: 468107 - RNA, 27 nt, Human
aagcagcuccacagaguaccgccccca

SEQ ID NO: 468108 - RNA, 19 nt, Human
aauacaguaugacaagggc

SEQ ID NO: 468109 - RNA, 21 nt, Human
aaugaaaagaggcccccugaa

SEQ ID NO: 468110 - RNA, 24 nt, Human
acacccaacagggaugcacucaac

SEQ ID NO: 468111 - RNA, 22 nt, Human
acacuagaaaaggacggcuaga

SEQ ID NO: 468112 - RNA, 23 nt, Human
acagcaccaaacugcauucauac

SEQ ID NO: 468113 - RNA, 20 nt, Human
acaggcaugccacaugaccc

SEQ ID NO: 468114 - RNA, 21 nt, Human
acauacuguaccuuuccaggc

SEQ ID NO: 468115 - RNA, 20 nt, Human
acaugacccaguugaggugg

SEQ ID NO: 468116 - RNA, 22 nt, Human
acuggaggagaaggggaggggg

SEQ ID NO: 468117 - RNA, 24 nt, Human
agaaaaggacggcuagaaagagga

SEQ ID NO: 468118 - RNA, 23 nt, Human
agaaggaaggggagacuaaaagc

SEQ ID NO: 468119 - RNA, 19 nt, Human
agacuccaggcuucagccu

SEQ ID NO: 468120 - RNA, 19 nt, Human
agaguaccgcccccaaggc

SEQ ID NO: 468121 - RNA, 19 nt, Human
agaguggcaagguacuaac

SEQ ID NO: 468122 - RNA, 18 nt, Human
agcaaggcugucaacuac

SEQ ID NO: 468123 - RNA, 19 nt, Human
agcagggugugaaauacaa

SEQ ID NO: 468124 - RNA, 21 nt, Human
aggaaagguacaaaaaaauau

SEQ ID NO: 468125 - RNA, 18 nt, Human
aggaguaggcaagaaggg

SEQ ID NO: 468126 - RNA, 21 nt, Human
aggcagggggcuggggagcag

SEQ ID NO: 468127 - RNA, 22 nt, Human
aggcagggggcuggggagcagg

SEQ ID NO: 468128 - RNA, 18 nt, Human
aggccuggggcuauaggg

SEQ ID NO: 468129 - RNA, 18 nt, Human
aggcuucagccugggagc

SEQ ID NO: 468130 - RNA, 24 nt, Human
agggaagugggggcagacuccagg

SEQ ID NO: 468131 - RNA, 23 nt, Human
agggaugcacucaacuuguuggu

SEQ ID NO: 468132 - RNA, 19 nt, Human
aggggagggggaucauagg

SEQ ID NO: 468133 - RNA, 18 nt, Human
agggucagggagggcagc

SEQ ID NO: 468134 - RNA, 21 nt, Human
aggugccgaagacccuaggcu

SEQ ID NO: 468135 - RNA, 19 nt, Human
aguagaagggggcuauggu

SEQ ID NO: 468136 - RNA, 23 nt, Human
auaggguacccauuucuccccag

SEQ ID NO: 468137 - RNA, 22 nt, Human
caaaacagacucucuaaccccc

SEQ ID NO: 468138 - RNA, 18 nt, Human
caacacaaaacacccaac

SEQ ID NO: 468139 - RNA, 22 nt, Human
caaccaagcaggugagagauug

SEQ ID NO: 468140 - RNA, 21 nt, Human
caagaggcuguugcugguguc

SEQ ID NO: 468141 - RNA, 23 nt, Human
cacaagaaggggaggcugguggc

SEQ ID NO: 468142 - RNA, 21 nt, Human
caccaaacugcauucauacac

SEQ ID NO: 468143 - RNA, 22 nt, Human
cacccaacagggaugcacucaa

SEQ ID NO: 468144 - RNA, 24 nt, Human
cacguacacagucaauacaguaug

SEQ ID NO: 468145 - RNA, 23 nt, Human
cagaaaacaucaaucaaaacaga

SEQ ID NO: 468146 - RNA, 24 nt, Human
cagcaaccuagaaagaaagagagg

SEQ ID NO: 468147 - RNA, 21 nt, Human
cagcagcccaggcugcacagg

SEQ ID NO: 468148 - RNA, 22 nt, Human
caggcauacucuaaaacagcac

SEQ ID NO: 468149 - RNA, 21 nt, Human
cccacauaccccccaugaggc

SEQ ID NO: 468150 - RNA, 22 nt, Human
ccccagggauucagguucccuc

SEQ ID NO: 468151 - RNA, 20 nt, Human
ccccugaaggcccugaaccu

SEQ ID NO: 468152 - RNA, 18 nt, Human
cccucugacaguuuuggc

SEQ ID NO: 468153 - RNA, 21 nt, Human
cccugcuggggcuagacuggc

SEQ ID NO: 468154 - RNA, 18 nt, Human
cggccaggaugguagggc

SEQ ID NO: 468155 - RNA, 19 nt, Human
cuauaacuuaaacucuucc

SEQ ID NO: 468156 - RNA, 19 nt, Human
cucaacacaaaacacccaa

SEQ ID NO: 468157 - RNA, 27 nt, Human
cucccucuaacucacgucucacagucc

SEQ ID NO: 468158 - RNA, 26 nt, Human
cucccuuggugcccugcuccucaccg

SEQ ID NO: 468159 - RNA, 18 nt, Human
cucuucccccaccagaag

SEQ ID NO: 468160 - RNA, 23 nt, Human
cucuucuacauacuguaccuuuc

SEQ ID NO: 468161 - RNA, 22 nt, Human
cugcucccugcagcuucucaac

SEQ ID NO: 468162 - RNA, 20 nt, Human
cuguaccuuuccaggccuaa

SEQ ID NO: 468163 - RNA, 18 nt, Human
gaagucuuaaaaguuccu

SEQ ID NO: 468164 - RNA, 20 nt, Human
gagacagugggaguccugga

SEQ ID NO: 468165 - RNA, 19 nt, Human
gagcaagcacagugcacac

SEQ ID NO: 468166 - RNA, 23 nt, Human
gagcaagcacagugcacacuccc

SEQ ID NO: 468167 - RNA, 18 nt, Human
gaggcugguggccccugc

SEQ ID NO: 468168 - RNA, 21 nt, Human
gcaaaggcuggaaagacaccc

SEQ ID NO: 468169 - RNA, 23 nt, Human
gcagaguuuucuccaagcuucag

SEQ ID NO: 468170 - RNA, 26 nt, Human
gccaaaugcccuauaacuuaaacucu

SEQ ID NO: 468171 - RNA, 23 nt, Human
gcccugaaccuggauaggaacaa

SEQ ID NO: 468172 - RNA, 21 nt, Human
gcugccucguucccuagauuc

SEQ ID NO: 468173 - RNA, 18 nt, Human
gcugguggccccugcccc

SEQ ID NO: 468174 - RNA, 22 nt, Human
ggaauagcauuacagucuaaca

SEQ ID NO: 468175 - RNA, 21 nt, Human
ggaggagaaggggagggggau

SEQ ID NO: 468176 - RNA, 18 nt, Human
ggcccuaguggacuggcg

SEQ ID NO: 468177 - RNA, 21 nt, Human
ggccuggaaaccuagaguucc

SEQ ID NO: 468178 - RNA, 21 nt, Human
gggaagcaacucagggcaucc

SEQ ID NO: 468179 - RNA, 22 nt, Human
gggaauaacuggaagucacugu

SEQ ID NO: 468180 - RNA, 23 nt, Human
gggugaggggaggaccuauguuc

SEQ ID NO: 468181 - RNA, 20 nt, Human
gugaacagacggccaggaug

SEQ ID NO: 468182 - RNA, 18 nt, Human
guggccugcaugucuccu

SEQ ID NO: 468183 - RNA, 19 nt, Human
gugguugucuccuugaguc

SEQ ID NO: 468184 - RNA, 21 nt, Human
gugugcccuuucccugccuag

SEQ ID NO: 468185 - RNA, 21 nt, Human
uaaaaaaaaauccugaagcau

SEQ ID NO: 468186 - RNA, 25 nt, Human
uaacaaucagaauucuguuacacac

SEQ ID NO: 468187 - RNA, 26 nt, Human
uacacacauacacaggcaugccacau

SEQ ID NO: 468188 - RNA, 27 nt, Human
uacacacauacacaggcaugccacaug

SEQ ID NO: 468189 - RNA, 19 nt, Human
uacacaggcaugccacaug

SEQ ID NO: 468190 - RNA, 21 nt, Human
uacccauuucuccccagcaac

SEQ ID NO: 468191 - RNA, 23 nt, Human
uagaguggcaagguacuaacuaa

SEQ ID NO: 468192 - RNA, 28 nt, Human
uaggguacccauuucuccccagcaaccu

SEQ ID NO: 468193 - RNA, 21 nt, Human
uauguucauagguaccaagaa

SEQ ID NO: 468194 - RNA, 19 nt, Human
ucaaaacagacucucuaac

SEQ ID NO: 468195 - RNA, 22 nt, Human
ucaaucaaaacagacucucuaa

SEQ ID NO: 468196 - RNA, 23 nt, Human
ucagccagucucaacacaaaaca

SEQ ID NO: 468197 - RNA, 23 nt, Human
ucagccuugggauggcuucaccc

SEQ ID NO: 468198 - RNA, 18 nt, Human
uccaggcagggggcuggg

SEQ ID NO: 468199 - RNA, 20 nt, Human
uccccacauaccccccauga

SEQ ID NO: 468200 - RNA, 18 nt, Human
uccguguugcaccuaaga

SEQ ID NO: 468201 - RNA, 19 nt, Human
uccuccagcaucacugcuc

SEQ ID NO: 468202 - RNA, 21 nt, Human
ucuagaauacaggagccucca

SEQ ID NO: 468203 - RNA, 20 nt, Human
ucuagcaccuugggcuugug

SEQ ID NO: 468204 - RNA, 20 nt, Human
ucucaccacaagaaggggag

SEQ ID NO: 468205 - RNA, 21 nt, Human
ucucaccacaagaaggggagg

SEQ ID NO: 468206 - RNA, 20 nt, Human
ucuccaagcuucagcuuggc

SEQ ID NO: 468207 - RNA, 26 nt, Human
ucucugagcaagcacagugcacacuc

SEQ ID NO: 468208 - RNA, 18 nt, Human
ucugcacgcugaccuagg

SEQ ID NO: 468209 - RNA, 24 nt, Human
ucuuccucuguccucaucccaagg

SEQ ID NO: 468210 - RNA, 21 nt, Human
ugaagcaugcucaaggugaaa

SEQ ID NO: 468211 - RNA, 25 nt, Human
ugacacgucacauggucaaagucuc

SEQ ID NO: 468212 - RNA, 22 nt, Human
ugagcacacacuagaaaaggaa

SEQ ID NO: 468213 - RNA, 24 nt, Human
ugagcugucagccuugggauggcu

SEQ ID NO: 468214 - RNA, 19 nt, Human
ugauguaacugggacucac

SEQ ID NO: 468215 - RNA, 24 nt, Human
ugcccugcucccugcagcuucuca

SEQ ID NO: 468216 - RNA, 25 nt, Human
ugccucguucccuagauucccucca

SEQ ID NO: 468217 - RNA, 20 nt, Human
ugcuggugucugagcccaaa

SEQ ID NO: 468218 - RNA, 23 nt, Human
uggaaagacacccagcuugaagg

SEQ ID NO: 468219 - RNA, 21 nt, Human
uggaggagaaggggaggggga

SEQ ID NO: 468220 - RNA, 20 nt, Human
uggagggagauucagcucuu

SEQ ID NO: 468221 - RNA, 23 nt, Human
uggagggagauucagcucuugga

SEQ ID NO: 468222 - RNA, 24 nt, Human
uggauuauagaaaagggaaguggg

SEQ ID NO: 468223 - RNA, 20 nt, Human
uggcagggcgagagggaaag

SEQ ID NO: 468224 - RNA, 25 nt, Human
uggcagugaggaguaggcaagaagg

SEQ ID NO: 468225 - RNA, 28 nt, Human
uggcagugaggaguaggcaagaaggguu

SEQ ID NO: 468226 - RNA, 22 nt, Human
uggccccugccccuucugucuc

SEQ ID NO: 468227 - RNA, 20 nt, Human
uggcugugaagugcccaagu

SEQ ID NO: 468228 - RNA, 19 nt, Human
ugggagaaaaugaaaagag

SEQ ID NO: 468229 - RNA, 19 nt, Human
ugggagaggagcaaggcug

SEQ ID NO: 468230 - RNA, 18 nt, Human
ugggagcaggguuuggcc

SEQ ID NO: 468231 - RNA, 21 nt, Human
ugggauggcuucaccccaugg

SEQ ID NO: 468232 - RNA, 19 nt, Human
uggggaccaggagugaggg

SEQ ID NO: 468233 - RNA, 24 nt, Human
uggggauaccccaucccuucccca

SEQ ID NO: 468234 - RNA, 24 nt, Human
uggggcuagacuggcaaaggcugg

SEQ ID NO: 468235 - RNA, 20 nt, Human
uggggguagaguggcaaggu

SEQ ID NO: 468236 - RNA, 26 nt, Human
ugguggccccugccccuucugucucc

SEQ ID NO: 468237 - RNA, 21 nt, Human
ugguguguccuccagcaucac

SEQ ID NO: 468238 - RNA, 19 nt, Human
ugugcccuuucccugccua

SEQ ID NO: 468239 - RNA, 23 nt, Human
uguuacacacauacacaggcaug

SEQ ID NO: 468240 - RNA, 21 nt, Human
uuaguguuaauuuggcuuauu

SEQ ID NO: 468241 - RNA, 19 nt, Human
uucagucucaccacaagaa

SEQ ID NO: 468242 - RNA, 22 nt, Human
uuccaggcagggggcuggggag

SEQ ID NO: 468243 - RNA, 26 nt, Human
uuccccacauaccccccaugaggccu

SEQ ID NO: 468244 - RNA, 18 nt, Human
uucccuagauucccucca

SEQ ID NO: 468245 - RNA, 22 nt, Human
uugaacucugguucccucaugu

SEQ ID NO: 468246 - RNA, 20 nt, Human
uugcccagcuucuacucggg

SEQ ID NO: 468247 - RNA, 22 nt, Human
uugucuccuugagucuguugac

SEQ ID NO: 468248 - RNA, 22 nt, Human
aaaaaaaaaaaaaaagggcguc

SEQ ID NO: 468249 - RNA, 19 nt, Human
aaaaaaaaaaaaaagggcg

SEQ ID NO: 468250 - RNA, 19 nt, Human
aaguuuuuauugcaagcac

SEQ ID NO: 468251 - RNA, 21 nt, Human
agcacagugagcagaaagaga

SEQ ID NO: 468252 - RNA, 19 nt, Human
auaaaauaacuccugcucg

SEQ ID NO: 468253 - RNA, 22 nt, Human
cacgcaaaauaaaauaacuccu

SEQ ID NO: 468254 - RNA, 21 nt, Human
cagaaagagaugucuucucac

SEQ ID NO: 468255 - RNA, 23 nt, Human
cagugagcagaaagagaugucuu

SEQ ID NO: 468256 - RNA, 23 nt, Human
cccucucuccucuacuuuggcua

SEQ ID NO: 468257 - RNA, 18 nt, Human
ccuguugccaucuuuuau

SEQ ID NO: 468258 - RNA, 25 nt, Human
cgcaagaucuaugcugcugugaaga

SEQ ID NO: 468259 - RNA, 21 nt, Human
cuucuaugcagccuacauguu

SEQ ID NO: 468260 - RNA, 25 nt, Human
cuucuggcugcuaacggguaccauc

SEQ ID NO: 468261 - RNA, 18 nt, Human
gaguggaccacggccaag

SEQ ID NO: 468262 - RNA, 21 nt, Human
gaguucauccccucucuccuc

SEQ ID NO: 468263 - RNA, 27 nt, Human
ggaguucauccccucucuccucuacuu

SEQ ID NO: 468264 - RNA, 22 nt, Human
ggucuuguccuucuggcugcua

SEQ ID NO: 468265 - RNA, 23 nt, Human
uaacuaaaucucuuugacaagcc

SEQ ID NO: 468266 - RNA, 23 nt, Human
uaccaucggcuucuaugcagccu

SEQ ID NO: 468267 - RNA, 18 nt, Human
ucacacaaaguggccaca

SEQ ID NO: 468268 - RNA, 19 nt, Human
uccgcucgcgaucuagaac

SEQ ID NO: 468269 - RNA, 24 nt, Human
uggaauguaacaaaaaaaaaaaaa

SEQ ID NO: 468270 - RNA, 18 nt, Human
uggaguggaccacggcca

SEQ ID NO: 468271 - RNA, 19 nt, Human
uuuuuuuuuuuuuugccaa

SEQ ID NO: 468272 - RNA, 21 nt, Human
uuuuuuuuuuuuuuuuuuugg

SEQ ID NO: 468273 - RNA, 19 nt, Human
aaaaaguguccuugugccc

SEQ ID NO: 468274 - RNA, 23 nt, Human
aaacaaaauguaccaacugguga

SEQ ID NO: 468275 - RNA, 25 nt, Human
aaaguguccuugugcccaaagucuc

SEQ ID NO: 468276 - RNA, 20 nt, Human
aagccagguccaggcuggga

SEQ ID NO: 468277 - RNA, 20 nt, Human
acuggccccagcccacauca

SEQ ID NO: 468278 - RNA, 18 nt, Human
aggcaggaagccaggucc

SEQ ID NO: 468279 - RNA, 18 nt, Human
agguaauuaucugggggu

SEQ ID NO: 468280 - RNA, 24 nt, Human
agguccuccugcuuggcguugccu

SEQ ID NO: 468281 - RNA, 22 nt, Human
caaaaacaaaauguaccaacug

SEQ ID NO: 468282 - RNA, 21 nt, Human
caagcaggucagagcacccgu

SEQ ID NO: 468283 - RNA, 19 nt, Human
cagacagacacagacuagc

SEQ ID NO: 468284 - RNA, 22 nt, Human
cagcccacaucaguguagugau

SEQ ID NO: 468285 - RNA, 21 nt, Human
cagcgccuugucaggggagcc

SEQ ID NO: 468286 - RNA, 23 nt, Human
ccaaaaaaaaaaaaaaaaaaaaa

SEQ ID NO: 468287 - RNA, 22 nt, Human
cccaacccuuccagagcugccc

SEQ ID NO: 468288 - RNA, 21 nt, Human
cccuguggcagcacugggauc

SEQ ID NO: 468289 - RNA, 22 nt, Human
ccucuuccaagcaggucagagc

SEQ ID NO: 468290 - RNA, 21 nt, Human
ccugccccuacuggccccagc

SEQ ID NO: 468291 - RNA, 22 nt, Human
ccuggcaccuguccugccccua

SEQ ID NO: 468292 - RNA, 18 nt, Human
ccugguggugucccugug

SEQ ID NO: 468293 - RNA, 20 nt, Human
ccuugugcccaaagucucag

SEQ ID NO: 468294 - RNA, 19 nt, Human
cugccccguuggccucuuc

SEQ ID NO: 468295 - RNA, 24 nt, Human
cuggccaagggcuagcggccacag

SEQ ID NO: 468296 - RNA, 21 nt, Human
cugggacagccuccuucccua

SEQ ID NO: 468297 - RNA, 21 nt, Human
cugguggugucccuguggcag

SEQ ID NO: 468298 - RNA, 23 nt, Human
cuguccugccccuacuggcccca

SEQ ID NO: 468299 - RNA, 19 nt, Human
gagcccccaacccuuccag

SEQ ID NO: 468300 - RNA, 18 nt, Human
gagguccuccugcuuggc

SEQ ID NO: 468301 - RNA, 18 nt, Human
gcugcagccccagcgccu

SEQ ID NO: 468302 - RNA, 28 nt, Human
gugagauuccaaaaaaaaaaaaaaaaaa

SEQ ID NO: 468303 - RNA, 21 nt, Human
gugaggcaggaagccaggucc

SEQ ID NO: 468304 - RNA, 24 nt, Human
uagaaacagcucuuuuggauccca

SEQ ID NO: 468305 - RNA, 21 nt, Human
ucaguguagugauauggaaug

SEQ ID NO: 468306 - RNA, 23 nt, Human
uccaaaaaaaaaaaaaaaaaaaa

SEQ ID NO: 468307 - RNA, 22 nt, Human
uccacgaaggugauucuaaaca

SEQ ID NO: 468308 - RNA, 19 nt, Human
uccaggcugggacagccuc

SEQ ID NO: 468309 - RNA, 20 nt, Human
uccugggcuggaagcgaggc

SEQ ID NO: 468310 - RNA, 18 nt, Human
uccuucugaucagacaga

SEQ ID NO: 468311 - RNA, 22 nt, Human
ugagauuccaaaaaaaaaaaaa

SEQ ID NO: 468312 - RNA, 19 nt, Human
ugagguccuccugcuuggc

SEQ ID NO: 468313 - RNA, 23 nt, Human
ugagguccuccugcuuggcguug

SEQ ID NO: 468314 - RNA, 23 nt, Human
ugcaccaggcaugcagaggaaca

SEQ ID NO: 468315 - RNA, 20 nt, Human
ugccccguuggccucuucca

SEQ ID NO: 468316 - RNA, 21 nt, Human
ugccugguggugucccugugg

SEQ ID NO: 468317 - RNA, 24 nt, Human
ugcuuggaguguggcuagaaacag

SEQ ID NO: 468318 - RNA, 23 nt, Human
uggccaagggcuagcggccacag

SEQ ID NO: 468319 - RNA, 18 nt, Human
uggccuggccaagggcua

SEQ ID NO: 468320 - RNA, 23 nt, Human
uggcuagaaacagcucuuuugga

SEQ ID NO: 468321 - RNA, 24 nt, Human
ugggacagccuccuucccuagggc

SEQ ID NO: 468322 - RNA, 22 nt, Human
ugggauucuaacaucagggucc

SEQ ID NO: 468323 - RNA, 18 nt, Human
ugggugagguccuccugc

SEQ ID NO: 468324 - RNA, 20 nt, Human
uguacaaacacaaaagaauc

SEQ ID NO: 468325 - RNA, 21 nt, Human
uguacaaacacaaaagaaucc

SEQ ID NO: 468326 - RNA, 23 nt, Human
uguacaaacacaaaagaauccau

SEQ ID NO: 468327 - RNA, 19 nt, Human
uuccagagcugccccguug

SEQ ID NO: 468328 - RNA, 21 nt, Human
acccauacucccagcugggac

SEQ ID NO: 468329 - RNA, 22 nt, Human
acccauacucccagcugggacc

SEQ ID NO: 468330 - RNA, 25 nt, Human
auagagcucacacccauacucccag

SEQ ID NO: 468331 - RNA, 22 nt, Human
cgcuggaguccucggcccgcuc

SEQ ID NO: 468332 - RNA, 23 nt, Human
gacccagccuucccugauggcug

SEQ ID NO: 468333 - RNA, 20 nt, Human
gagcucacacccauacuccc

SEQ ID NO: 468334 - RNA, 20 nt, Human
gaguccucggcccgcuccuc

SEQ ID NO: 468335 - RNA, 23 nt, Human
ucccugauggcugccauccaagu

SEQ ID NO: 468336 - RNA, 18 nt, Human
ucuuuuuuuuuuuuuuuu

SEQ ID NO: 468337 - RNA, 21 nt, Human
uuuuuuuuuuuuuuucacagg

SEQ ID NO: 468338 - RNA, 23 nt, Human
uuuuuuuuuuuuuuuuucacagg

SEQ ID NO: 468339 - RNA, 24 nt, Human
uuuuuuuuuuuuuuuuuucuuuuu

SEQ ID NO: 468340 - RNA, 24 nt, Human
uuuuuuuuuuuuuuuuuuucuuuu

SEQ ID NO: 468341 - RNA, 25 nt, Human
uuuuuuuuuuuuuuuuuuucuuuuu

SEQ ID NO: 468342 - RNA, 24 nt, Human
uuuuuuuuuuuuuuuuuuuucuuu

SEQ ID NO: 468343 - RNA, 26 nt, Human
uuuuuuuuuuuuuuuuuuuuuucuuu

SEQ ID NO: 468344 - RNA, 24 nt, Human
acaccaagccacaccaagcucagc

SEQ ID NO: 468345 - RNA, 23 nt, Human
acuucaccagcuuccaagggacc

SEQ ID NO: 468346 - RNA, 20 nt, Human
agcuuccaagggacccuccc

SEQ ID NO: 468347 - RNA, 19 nt, Human
aggauccuaggccaggccu

SEQ ID NO: 468348 - RNA, 22 nt, Human
aggccuucugccacaccaagcc

SEQ ID NO: 468349 - RNA, 18 nt, Human
augguggggagggaugaa

SEQ ID NO: 468350 - RNA, 22 nt, Human
augguggggagggaugaagaug

SEQ ID NO: 468351 - RNA, 24 nt, Human
auguauagccagguaggccacacc

SEQ ID NO: 468352 - RNA, 23 nt, Human
cagcaguacucacaggccuuuaa

SEQ ID NO: 468353 - RNA, 24 nt, Human
cagcaguacucacaggccuuuaau

SEQ ID NO: 468354 - RNA, 21 nt, Human
ccaagccacaccaagcucagc

SEQ ID NO: 468355 - RNA, 18 nt, Human
ccuaggccaggccuucug

SEQ ID NO: 468356 - RNA, 24 nt, Human
ccucucggauauauucugaagccu

SEQ ID NO: 468357 - RNA, 19 nt, Human
cgagggccucagugcagaa

SEQ ID NO: 468358 - RNA, 25 nt, Human
cucucggauauauucugaagccuaa

SEQ ID NO: 468359 - RNA, 22 nt, Human
gcuuccaagggacccuccccac

SEQ ID NO: 468360 - RNA, 22 nt, Human
ggagggaugaagauguauagcc

SEQ ID NO: 468361 - RNA, 21 nt, Human
ggauauauucugaagccuaaa

SEQ ID NO: 468362 - RNA, 27 nt, Human
uaagaacaggacuucaccagcuuccaa

SEQ ID NO: 468363 - RNA, 27 nt, Human
uaauaagaacaggacuucaccagcuuc

SEQ ID NO: 468364 - RNA, 21 nt, Human
ucacuuccccaggaugguggg

SEQ ID NO: 468365 - RNA, 20 nt, Human
uccaagggacccuccccacc

SEQ ID NO: 468366 - RNA, 22 nt, Human
ucugccacaccaagccacacca

SEQ ID NO: 468367 - RNA, 23 nt, Human
ugaguccaagagggaaggacugg

SEQ ID NO: 468368 - RNA, 21 nt, Human
uggccacaccaucacuucccu

SEQ ID NO: 468369 - RNA, 24 nt, Human
uuuuuuuuuuuuuuuuuuuauuuu

SEQ ID NO: 468370 - RNA, 18 nt, Human
aaaccugcagcaauaaac

SEQ ID NO: 468371 - RNA, 19 nt, Human
aaagugcugggauuacagg

SEQ ID NO: 468372 - RNA, 20 nt, Human
aaagugcugggauuacaggc

SEQ ID NO: 468373 - RNA, 23 nt, Human
aaagugcugggauuacaggcgua

SEQ ID NO: 468374 - RNA, 20 nt, Human
aacacaccauaaugauggga

SEQ ID NO: 468375 - RNA, 19 nt, Human
aacagagcaagauacagaa

SEQ ID NO: 468376 - RNA, 22 nt, Human
aacucugcacaaccccgggaaa

SEQ ID NO: 468377 - RNA, 19 nt, Human
aagugcugggauuacaggc

SEQ ID NO: 468378 - RNA, 19 nt, Human
aagugcugggauuacaggc

SEQ ID NO: 468379 - RNA, 26 nt, Human
aagugcugggauuacaggcguaagcc

SEQ ID NO: 468380 - RNA, 19 nt, Human
aauucucuuuagaaauuca

SEQ ID NO: 468381 - RNA, 24 nt, Human
aauuuuguauuuuuaguagagacg

SEQ ID NO: 468382 - RNA, 18 nt, Human
acagagcaagauacagaa

SEQ ID NO: 468383 - RNA, 26 nt, Human
acaugugcuuauaccacauguaugug

SEQ ID NO: 468384 - RNA, 18 nt, Human
acgggguuucuccauguu

SEQ ID NO: 468385 - RNA, 20 nt, Human
acgggguuucuccauguugg

SEQ ID NO: 468386 - RNA, 24 nt, Human
acgggguuucuccauguuggucag

SEQ ID NO: 468387 - RNA, 20 nt, Human
acuaaaaaucaaauacacaa

SEQ ID NO: 468388 - RNA, 20 nt, Human
agaggugguggcugugggac

SEQ ID NO: 468389 - RNA, 24 nt, Human
agcgauuuuccugccucagccucu

SEQ ID NO: 468390 - RNA, 20 nt, Human
aggcaugcaccacuacgccc

SEQ ID NO: 468391 - RNA, 19 nt, Human
aguaacugggauuacaggc

SEQ ID NO: 468392 - RNA, 20 nt, Human
aguaacugggauuacaggca

SEQ ID NO: 468393 - RNA, 21 nt, Human
aguaacugggauuacaggcau

SEQ ID NO: 468394 - RNA, 23 nt, Human
agugcgauggcgcgaucuuggcu

SEQ ID NO: 468395 - RNA, 24 nt, Human
agugcgauggcgcgaucuuggcuc

SEQ ID NO: 468396 - RNA, 18 nt, Human
agugcugggauuacaggc

SEQ ID NO: 468397 - RNA, 20 nt, Human
agugucugauuucauuucca

SEQ ID NO: 468398 - RNA, 18 nt, Human
auacagaacagugugugg

SEQ ID NO: 468399 - RNA, 25 nt, Human
caaaaaaccugcagcaauaaaccau

SEQ ID NO: 468400 - RNA, 24 nt, Human
caaagugcugggauuacaggcgua

SEQ ID NO: 468401 - RNA, 19 nt, Human
caagcaaacagagcaagau

SEQ ID NO: 468402 - RNA, 22 nt, Human
caagcgauuuuccugccucagc

SEQ ID NO: 468403 - RNA, 26 nt, Human
cacaaaaaaccugcagcaauaaacca

SEQ ID NO: 468404 - RNA, 22 nt, Human
cacaguauacugggagcugucc

SEQ ID NO: 468405 - RNA, 19 nt, Human
cacugaaccagcagucauu

SEQ ID NO: 468406 - RNA, 21 nt, Human
cacuguaaccucugccucccg

SEQ ID NO: 468407 - RNA, 23 nt, Human
cacuguaaccucugccucccggg

SEQ ID NO: 468408 - RNA, 18 nt, Human
cacugugccagccaugcu

SEQ ID NO: 468409 - RNA, 25 nt, Human
cagccucagccucccaaagugcugg

SEQ ID NO: 468410 - RNA, 21 nt, Human
caggagagacuauauuuggug

SEQ ID NO: 468411 - RNA, 24 nt, Human
caggugauacgccagccccugaag

SEQ ID NO: 468412 - RNA, 18 nt, Human
caucuggagugucugauu

SEQ ID NO: 468413 - RNA, 23 nt, Human
caugcaccacuacgcccgacuaa

SEQ ID NO: 468414 - RNA, 24 nt, Human
cauguuggucaggcuggucuugaa

SEQ ID NO: 468415 - RNA, 22 nt, Human
ccaaagugcugggauuacaggc

SEQ ID NO: 468416 - RNA, 22 nt, Human
ccaaagugcugggauuacaggc

SEQ ID NO: 468417 - RNA, 24 nt, Human
ccaaagugcugggauuacaggcgu

SEQ ID NO: 468418 - RNA, 22 nt, Human
ccagcagucauuuucucucucu

SEQ ID NO: 468419 - RNA, 19 nt, Human
ccauguuggucaggcuggu

SEQ ID NO: 468420 - RNA, 21 nt, Human
ccauguuggucaggcuggucu

SEQ ID NO: 468421 - RNA, 21 nt, Human
ccauguuggucaggcuggucu

SEQ ID NO: 468422 - RNA, 22 nt, Human
cccaggcuggagugcgauggcg

SEQ ID NO: 468423 - RNA, 21 nt, Human
ccccauaaccaauucucuuua

SEQ ID NO: 468424 - RNA, 18 nt, Human
ccccgggaaaggcaaguc

SEQ ID NO: 468425 - RNA, 23 nt, Human
cccggguucaagcgauuuuccug

SEQ ID NO: 468426 - RNA, 24 nt, Human
ccucaggugauacgccagccucag

SEQ ID NO: 468427 - RNA, 18 nt, Human
ccucuugccuccuccuuc

SEQ ID NO: 468428 - RNA, 25 nt, Human
cuaaucucaaauacacauuucagaa

SEQ ID NO: 468429 - RNA, 24 nt, Human
cuaauuuuguauuuuuaguagaga

SEQ ID NO: 468430 - RNA, 24 nt, Human
cucacuguaaccucugccucccgg

SEQ ID NO: 468431 - RNA, 24 nt, Human
cuccauguuggucaggcuggucuu

SEQ ID NO: 468432 - RNA, 19 nt, Human
cucgaguaacugggauuac

SEQ ID NO: 468433 - RNA, 24 nt, Human
cucgaguaacugggauuacaggca

SEQ ID NO: 468434 - RNA, 18 nt, Human
cucucucucucucucucg

SEQ ID NO: 468435 - RNA, 23 nt, Human
cucugcacaaccccgggaaaggc

SEQ ID NO: 468436 - RNA, 20 nt, Human
cucuuguugcccaggcugga

SEQ ID NO: 468437 - RNA, 21 nt, Human
cucuuguugcccaggcuggag

SEQ ID NO: 468438 - RNA, 22 nt, Human
cucuuguugcccaggcuggagu

SEQ ID NO: 468439 - RNA, 21 nt, Human
cugaggagagaggugguggcu

SEQ ID NO: 468440 - RNA, 23 nt, Human
cugccucagccucucgaguaacu

SEQ ID NO: 468441 - RNA, 18 nt, Human
cugggagcuguccauuua

SEQ ID NO: 468442 - RNA, 24 nt, Human
cuguaaccucugccucccggguuc

SEQ ID NO: 468443 - RNA, 24 nt, Human
cuuguugcccaggcuggagugcga

SEQ ID NO: 468444 - RNA, 24 nt, Human
cuuuuagcuuugaaccaugugcaa

SEQ ID NO: 468445 - RNA, 22 nt, Human
cuuuuccaggcugaggcacucg

SEQ ID NO: 468446 - RNA, 22 nt, Human
gaaacaccuuugucacaaugcc

SEQ ID NO: 468447 - RNA, 23 nt, Human
gagacgggguuucuccauguugg

SEQ ID NO: 468448 - RNA, 24 nt, Human
gagacgggguuucuccauguuggu

SEQ ID NO: 468449 - RNA, 22 nt, Human
gaguaacugggauuacaggcau

SEQ ID NO: 468450 - RNA, 24 nt, Human
gaguaacugggauuacaggcaugc

SEQ ID NO: 468451 - RNA, 18 nt, Human
gauuacaggcguaagcca

SEQ ID NO: 468452 - RNA, 21 nt, Human
gauuacaggcguaagccacug

SEQ ID NO: 468453 - RNA, 24 nt, Human
gauuacaggcguaagccacugugc

SEQ ID NO: 468454 - RNA, 20 nt, Human
gcacaaccccgggaaaggca

SEQ ID NO: 468455 - RNA, 22 nt, Human
gccuccuccuucgccgccgccc

SEQ ID NO: 468456 - RNA, 24 nt, Human
gcgauuuuccugccucagccucuc

SEQ ID NO: 468457 - RNA, 21 nt, Human
gcucacuguaaccucugccuc

SEQ ID NO: 468458 - RNA, 21 nt, Human
gcucuuguugcccaggcugga

SEQ ID NO: 468459 - RNA, 23 nt, Human
gcugaggagagaggugguggcug

SEQ ID NO: 468460 - RNA, 23 nt, Human
gcuggucuugaacucccaaccuc

SEQ ID NO: 468461 - RNA, 24 nt, Human
ggauuacaggcguaagccacugug

SEQ ID NO: 468462 - RNA, 24 nt, Human
ggcuggucuugaacucccaaccuc

SEQ ID NO: 468463 - RNA, 18 nt, Human
gggaauauugaugauuuc

SEQ ID NO: 468464 - RNA, 23 nt, Human
gggguuucuccauguuggucagg

SEQ ID NO: 468465 - RNA, 22 nt, Human
ggguuucuccauguuggucagg

SEQ ID NO: 468466 - RNA, 24 nt, Human
ggugauacgccagccucagccucc

SEQ ID NO: 468467 - RNA, 23 nt, Human
gguggcugugggacagaauggga

SEQ ID NO: 468468 - RNA, 20 nt, Human
guaacugggauuacaggcau

SEQ ID NO: 468469 - RNA, 23 nt, Human
guagagacgggguuucuccaugu

SEQ ID NO: 468470 - RNA, 24 nt, Human
gugauacgccagccucagccuccc

SEQ ID NO: 468471 - RNA, 23 nt, Human
gugcauaucuaacucugcacaaa

SEQ ID NO: 468472 - RNA, 21 nt, Human
gugguggcugugggacagaau

SEQ ID NO: 468473 - RNA, 22 nt, Human
uaaaaaaaaaaucuccugaguu

SEQ ID NO: 468474 - RNA, 29 nt, Human
uaaaaaaaaaaucuccugaguuccucucc

SEQ ID NO: 468475 - RNA, 22 nt, Human
uaaaaaucaaauacacaaaaaa

SEQ ID NO: 468476 - RNA, 23 nt, Human
uacaggcaugcaccacuacgccc

SEQ ID NO: 468477 - RNA, 21 nt, Human
uaguaauuaggagccacuuac

SEQ ID NO: 468478 - RNA, 24 nt, Human
uaguagagacgggguuucuccaug

SEQ ID NO: 468479 - RNA, 21 nt, Human
uauaccacauguaugugcaua

SEQ ID NO: 468480 - RNA, 21 nt, Human
uauauguugacaucuggagug

SEQ ID NO: 468481 - RNA, 22 nt, Human
uauugaugauuucaacauaaaa

SEQ ID NO: 468482 - RNA, 18 nt, Human
ucaaagaacacaccauaa

SEQ ID NO: 468483 - RNA, 21 nt, Human
ucaagcaaacagagcaagaua

SEQ ID NO: 468484 - RNA, 23 nt, Human
ucacuguaaccucugccucccgg

SEQ ID NO: 468485 - RNA, 24 nt, Human
ucacuguaaccucugccucccggg

SEQ ID NO: 468486 - RNA, 18 nt, Human
ucagccucccaaagugcu

SEQ ID NO: 468487 - RNA, 22 nt, Human
ucauugcuggcugaggagagag

SEQ ID NO: 468488 - RNA, 24 nt, Human
ucccaaagugcugggauuacaggc

SEQ ID NO: 468489 - RNA, 18 nt, Human
ucccggguucaagcgauu

SEQ ID NO: 468490 - RNA, 24 nt, Human
ucccggguucaagcgauuuuccug

SEQ ID NO: 468491 - RNA, 24 nt, Human
ucgaguaacugggauuacaggcau

SEQ ID NO: 468492 - RNA, 18 nt, Human
ucuaacucugcacaaccc

SEQ ID NO: 468493 - RNA, 19 nt, Human
ucuaaucucaaauacacau

SEQ ID NO: 468494 - RNA, 24 nt, Human
ucucgaguaacugggauuacaggc

SEQ ID NO: 468495 - RNA, 24 nt, Human
ucugagggacacacacugaaccag

SEQ ID NO: 468496 - RNA, 21 nt, Human
ucugucugcagucuuuagaga

SEQ ID NO: 468497 - RNA, 22 nt, Human
ucuuguugcccaggcuggagug

SEQ ID NO: 468498 - RNA, 28 nt, Human
ucuuuaguuuugauccaacaaauccauu

SEQ ID NO: 468499 - RNA, 22 nt, Human
ugaaaaauaaguuaaaaacuaa

SEQ ID NO: 468500 - RNA, 25 nt, Human
ugaaacaccuuugucacaaugccac

SEQ ID NO: 468501 - RNA, 18 nt, Human
ugcccaggcuggagugcg

SEQ ID NO: 468502 - RNA, 21 nt, Human
ugcccaggcuggagugcgaug

SEQ ID NO: 468503 - RNA, 24 nt, Human
ugccucagccucucgaguaacugg

SEQ ID NO: 468504 - RNA, 23 nt, Human
ugccuccuccuucgccgccgccc

SEQ ID NO: 468505 - RNA, 24 nt, Human
ugcugggauuacaggcguaagcca

SEQ ID NO: 468506 - RNA, 24 nt, Human
uggagugcgauggcgcgaucuugg

SEQ ID NO: 468507 - RNA, 23 nt, Human
uggcgcgaucuuggcucacugua

SEQ ID NO: 468508 - RNA, 24 nt, Human
uggcgcgaucuuggcucacuguaa

SEQ ID NO: 468509 - RNA, 21 nt, Human
ugggaauauugaugauuucaa

SEQ ID NO: 468510 - RNA, 21 nt, Human
ugggauuacaggcaugcacca

SEQ ID NO: 468511 - RNA, 24 nt, Human
ugggauuacaggcaugcaccacua

SEQ ID NO: 468512 - RNA, 24 nt, Human
ugggauuacaggcaugcaccacua

SEQ ID NO: 468513 - RNA, 22 nt, Human
ugggauuacaggcguaagccac

SEQ ID NO: 468514 - RNA, 22 nt, Human
ugggauuacaggcguaagccac

SEQ ID NO: 468515 - RNA, 22 nt, Human
ugggauuacaggcguaagccac

SEQ ID NO: 468516 - RNA, 24 nt, Human
ugggauuacaggcguaagccacug

SEQ ID NO: 468517 - RNA, 26 nt, Human
ugggauuacaggcguaagccacugug

SEQ ID NO: 468518 - RNA, 30 nt, Human
ugggauuacaggcguaagccacugugccaa

SEQ ID NO: 468519 - RNA, 23 nt, Human
uggucaggcuggucuugaacucc

SEQ ID NO: 468520 - RNA, 20 nt, Human
uguaucaagcaaacagagca

SEQ ID NO: 468521 - RNA, 22 nt, Human
uguguacuccucuguacaugug

SEQ ID NO: 468522 - RNA, 20 nt, Human
uguuuuaaaagaggggaaag

SEQ ID NO: 468523 - RNA, 25 nt, Human
uuagagacagcaauagcuuuaacuu

SEQ ID NO: 468524 - RNA, 18 nt, Human
uuaguagagacgggguuu

SEQ ID NO: 468525 - RNA, 24 nt, Human
uuaguagagacgggguuucuccau

SEQ ID NO: 468526 - RNA, 21 nt, Human
uucaagcgauuuuccugccuc

SEQ ID NO: 468527 - RNA, 23 nt, Human
uucaagcgauuuuccugccucag

SEQ ID NO: 468528 - RNA, 24 nt, Human
uucaagcgauuuuccugccucagc

SEQ ID NO: 468529 - RNA, 28 nt, Human
uuccaggcugaggcacucguaaugguau

SEQ ID NO: 468530 - RNA, 18 nt, Human
uucucucucucucucucu

SEQ ID NO: 468531 - RNA, 20 nt, Human
uugacaucuggagugucuga

SEQ ID NO: 468532 - RNA, 18 nt, Human
uugcccaggcuggagugc

SEQ ID NO: 468533 - RNA, 23 nt, Human
uugcucuuguugcccaggcugga

SEQ ID NO: 468534 - RNA, 23 nt, Human
uuguauuuuuaguagagacgggg

SEQ ID NO: 468535 - RNA, 21 nt, Human
uuucuccauguuggucaggcu

SEQ ID NO: 468536 - RNA, 24 nt, Human
uuugcucuuguugcccaggcugga

SEQ ID NO: 468537 - RNA, 18 nt, Human
uuuuagcuuugaaccaug

SEQ ID NO: 468538 - RNA, 24 nt, Human
uuuugcucuuguugcccaggcugg

SEQ ID NO: 468539 - RNA, 19 nt, Human
uuuuguauuuuuaguagag

SEQ ID NO: 468540 - RNA, 20 nt, Human
uuuuguauuuuuaguagaga

SEQ ID NO: 468541 - RNA, 22 nt, Human
uuuuuaguagagacgggguuuc

SEQ ID NO: 468542 - RNA, 19 nt, Human
aaagaaaagaaggaaaaga

SEQ ID NO: 468543 - RNA, 20 nt, Human
aaauucuccuugugccucuc

SEQ ID NO: 468544 - RNA, 23 nt, Human
aaccagaucaccaccccccaacc

SEQ ID NO: 468545 - RNA, 22 nt, Human
aagaaggaaaagaauuaaagaa

SEQ ID NO: 468546 - RNA, 18 nt, Human
aaggugcuuuccaaaccc

SEQ ID NO: 468547 - RNA, 27 nt, Human
aauccauggacccuuaaauucuccuuu

SEQ ID NO: 468548 - RNA, 26 nt, Human
accacaaacaaaaacaggauccaacc

SEQ ID NO: 468549 - RNA, 24 nt, Human
accaccccccaaccaaaaagcaaa

SEQ ID NO: 468550 - RNA, 19 nt, Human
accgacccgcacucccugc

SEQ ID NO: 468551 - RNA, 25 nt, Human
agaaaaucuaacauucaguaacuaa

SEQ ID NO: 468552 - RNA, 22 nt, Human
agaaccagaucaccacccccca

SEQ ID NO: 468553 - RNA, 21 nt, Human
agacugaauccauggacccuu

SEQ ID NO: 468554 - RNA, 22 nt, Human
agaucaccaccccccaaccaaa

SEQ ID NO: 468555 - RNA, 23 nt, Human
aggcagaaaaucuaacauucagu

SEQ ID NO: 468556 - RNA, 19 nt, Human
aggugcuuuccaaacccgg

SEQ ID NO: 468557 - RNA, 21 nt, Human
aucccagagccucagcagcca

SEQ ID NO: 468558 - RNA, 21 nt, Human
aucucgaagucuccauuccgg

SEQ ID NO: 468559 - RNA, 19 nt, Human
caaaaacaggauccaacca

SEQ ID NO: 468560 - RNA, 23 nt, Human
caaacaaaaacaggauccaacca

SEQ ID NO: 468561 - RNA, 28 nt, Human
caaccaaaaagcaaaacaaaauagauau

SEQ ID NO: 468562 - RNA, 21 nt, Human
cacacugaagguuuggccaaa

SEQ ID NO: 468563 - RNA, 25 nt, Human
cagcagccaaaauggcccuagcuga

SEQ ID NO: 468564 - RNA, 19 nt, Human
cauagcccggaggcucagg

SEQ ID NO: 468565 - RNA, 19 nt, Human
cauuucauccagccucauu

SEQ ID NO: 468566 - RNA, 19 nt, Human
ccagagccucagcagccaa

SEQ ID NO: 468567 - RNA, 21 nt, Human
ccauggaguaauuaaaguaac

SEQ ID NO: 468568 - RNA, 21 nt, Human
ccccaaccaaaaagcaaaaca

SEQ ID NO: 468569 - RNA, 20 nt, Human
cccccaaccaaaaagcaaaa

SEQ ID NO: 468570 - RNA, 24 nt, Human
ccccccaaccaaaaagcaaaacaa

SEQ ID NO: 468571 - RNA, 24 nt, Human
cccgggcuuuggugaccaggucuu

SEQ ID NO: 468572 - RNA, 20 nt, Human
ccggcuuuuccugcagcucu

SEQ ID NO: 468573 - RNA, 18 nt, Human
cuaggcagaaaaucuaac

SEQ ID NO: 468574 - RNA, 20 nt, Human
cuccuggaaaagugggauca

SEQ ID NO: 468575 - RNA, 21 nt, Human
cugcagcucuucccgggcuuu

SEQ ID NO: 468576 - RNA, 21 nt, Human
gaaaaacacaaacucccaguc

SEQ ID NO: 468577 - RNA, 26 nt, Human
gaaccgacccgcacucccugcccucg

SEQ ID NO: 468578 - RNA, 18 nt, Human
gaggccacagaagggcug

SEQ ID NO: 468579 - RNA, 25 nt, Human
gcaaaacaaaauagauauagccucu

SEQ ID NO: 468580 - RNA, 21 nt, Human
gccaaauuauuucauacaagu

SEQ ID NO: 468581 - RNA, 19 nt, Human
gcgcgggucaaucggcggc

SEQ ID NO: 468582 - RNA, 22 nt, Human
ggaaagacacauguaccacaaa

SEQ ID NO: 468583 - RNA, 18 nt, Human
gguccugauuguucuugc

SEQ ID NO: 468584 - RNA, 18 nt, Human
uaaagauggugacccugg

SEQ ID NO: 468585 - RNA, 27 nt, Human
uaacuaaaccaaaucccagagccucag

SEQ ID NO: 468586 - RNA, 24 nt, Human
uaagaaccagaucaccacccccca

SEQ ID NO: 468587 - RNA, 24 nt, Human
uaauaguugcagacugggauucca

SEQ ID NO: 468588 - RNA, 18 nt, Human
uacaaguaguucucacug

SEQ ID NO: 468589 - RNA, 25 nt, Human
uaccacaaacaaaaacaggauccaa

SEQ ID NO: 468590 - RNA, 22 nt, Human
uagcugacauuucauccagccu

SEQ ID NO: 468591 - RNA, 26 nt, Human
ucagguggugguggcagcucauuuuc

SEQ ID NO: 468592 - RNA, 24 nt, Human
ucauacaaguaguucucacuggcc

SEQ ID NO: 468593 - RNA, 24 nt, Human
uccaaacccggugacaacagcugg

SEQ ID NO: 468594 - RNA, 18 nt, Human
uccauggaguaauuaaag

SEQ ID NO: 468595 - RNA, 22 nt, Human
ucccagagccucagcagccaaa

SEQ ID NO: 468596 - RNA, 18 nt, Human
ucccagaggugcuuugaa

SEQ ID NO: 468597 - RNA, 20 nt, Human
ucccagaggugcuuugaagu

SEQ ID NO: 468598 - RNA, 21 nt, Human
ucccgggcuuuggugaccagg

SEQ ID NO: 468599 - RNA, 21 nt, Human
ucccugauucuauugagaacc

SEQ ID NO: 468600 - RNA, 18 nt, Human
uccuugugccucuccaaa

SEQ ID NO: 468601 - RNA, 22 nt, Human
ucuccaaagaaaagaaggaaaa

SEQ ID NO: 468602 - RNA, 19 nt, Human
ucuccuggaaaagugggau

SEQ ID NO: 468603 - RNA, 19 nt, Human
ucucuuggaacagaacggc

SEQ ID NO: 468604 - RNA, 24 nt, Human
ugaaaaacacaaacucccagucuc

SEQ ID NO: 468605 - RNA, 25 nt, Human
ugaaaaacacaaacucccagucuca

SEQ ID NO: 468606 - RNA, 19 nt, Human
ugaggccacagaagggcug

SEQ ID NO: 468607 - RNA, 22 nt, Human
ugcagcucuucccgggcuuugg

SEQ ID NO: 468608 - RNA, 19 nt, Human
uguuccuccauccugcagu

SEQ ID NO: 468609 - RNA, 21 nt, Human
uucuccuugugccucuccaaa

SEQ ID NO: 468610 - RNA, 22 nt, Human
uugaguaaaaucauuuccugcu

SEQ ID NO: 468611 - RNA, 21 nt, Human
uugcaaacuucaaccaguggg

SEQ ID NO: 468612 - RNA, 20 nt, Human
uugcuuccaagauguguaag

SEQ ID NO: 468613 - RNA, 23 nt, Human
uuggaaagacacauguaccacaa

SEQ ID NO: 468614 - RNA, 25 nt, Human
uuuuuuuuuuuuuuuuuuuaauugg

SEQ ID NO: 468615 - RNA, 20 nt, Human
acaguucuagaggcugggaa

SEQ ID NO: 468616 - RNA, 19 nt, Human
aggggcaggugccaaguga

SEQ ID NO: 468617 - RNA, 18 nt, Human
cacauugcagaagggcaa

SEQ ID NO: 468618 - RNA, 22 nt, Human
cacugguuucauucaugagggg

SEQ ID NO: 468619 - RNA, 19 nt, Human
ccaagaucaaggcaccagc

SEQ ID NO: 468620 - RNA, 20 nt, Human
ccccagagguagaaaggacc

SEQ ID NO: 468621 - RNA, 22 nt, Human
ccccagagguagaaaggaccuc

SEQ ID NO: 468622 - RNA, 22 nt, Human
cuggugaggaccaguuucucuu

SEQ ID NO: 468623 - RNA, 26 nt, Human
uaagggcacugguuucauucaugagg

SEQ ID NO: 468624 - RNA, 22 nt, Human
ucaaggcaccagcagauucagc

SEQ ID NO: 468625 - RNA, 22 nt, Human
ucuuacaguucuagaggcuggg

SEQ ID NO: 468626 - RNA, 20 nt, Human
ucuuacaguucuagaggcuu

SEQ ID NO: 468627 - RNA, 23 nt, Human
ucuuuggugggguuggguauugc

SEQ ID NO: 468628 - RNA, 19 nt, Human
ugagagugacccccagagg

SEQ ID NO: 468629 - RNA, 24 nt, Human
ugagagugacccccagagguagaa

SEQ ID NO: 468630 - RNA, 22 nt, Human
ugccaagugagagugaccccca

SEQ ID NO: 468631 - RNA, 19 nt, Human
ugggaaguccaagaucaag

SEQ ID NO: 468632 - RNA, 24 nt, Human
ugggaaguccaagaucaaggcacc

SEQ ID NO: 468633 - RNA, 23 nt, Human
ugugacucuucccucuuuuuggg

SEQ ID NO: 468634 - RNA, 21 nt, Human
uuccaagucucaggacccuca

SEQ ID NO: 468635 - RNA, 26 nt, Human
uucccucuuuuuggggaaaaggacuu

SEQ ID NO: 468636 - RNA, 21 nt, Human
uucucugacagugccuucuag

SEQ ID NO: 468637 - RNA, 25 nt, Human
uucuuccauauuccaagucucagga

SEQ ID NO: 468638 - RNA, 22 nt, Human
uuggguauugcuucuuccauau

SEQ ID NO: 468639 - RNA, 25 nt, Human
uuggguauugcuucuuccauauucc

SEQ ID NO: 468640 - RNA, 18 nt, Human
aaaguccuccucugaccg

SEQ ID NO: 468641 - RNA, 22 nt, Human
aacauucucuccucccaguuaa

SEQ ID NO: 468642 - RNA, 21 nt, Human
aacccuuggucccggcgcggg

SEQ ID NO: 468643 - RNA, 24 nt, Human
aaggugaccuuaaugaaacccuug

SEQ ID NO: 468644 - RNA, 22 nt, Human
accaggcugcccagcagcccca

SEQ ID NO: 468645 - RNA, 22 nt, Human
accuucucuggcccccaaguag

SEQ ID NO: 468646 - RNA, 25 nt, Human
agaccuugaagacuaucccggagcc

SEQ ID NO: 468647 - RNA, 19 nt, Human
agcauuggagggggcaggu

SEQ ID NO: 468648 - RNA, 21 nt, Human
agcgcccucugggggcuggua

SEQ ID NO: 468649 - RNA, 20 nt, Human
agcggcgggaagagcuccac

SEQ ID NO: 468650 - RNA, 21 nt, Human
agcuagccugcggccuagagc

SEQ ID NO: 468651 - RNA, 22 nt, Human
aggcggccgcggaaccaaaugc

SEQ ID NO: 468652 - RNA, 19 nt, Human
aggcugcccagcagcccca

SEQ ID NO: 468653 - RNA, 22 nt, Human
aggcugcccagcagccccaggc

SEQ ID NO: 468654 - RNA, 25 nt, Human
aggggcacccaggccgggccgaagg

SEQ ID NO: 468655 - RNA, 19 nt, Human
auggcccucuccgaaguga

SEQ ID NO: 468656 - RNA, 23 nt, Human
caacaccugcauggacacagcca

SEQ ID NO: 468657 - RNA, 22 nt, Human
caccagaaaguuccacgucagg

SEQ ID NO: 468658 - RNA, 20 nt, Human
caccccgcgcggcaggagcu

SEQ ID NO: 468659 - RNA, 21 nt, Human
cacccgcacauagggcuccac

SEQ ID NO: 468660 - RNA, 19 nt, Human
caccugcauggacacagcc

SEQ ID NO: 468661 - RNA, 23 nt, Human
caccugcauggacacagccagca

SEQ ID NO: 468662 - RNA, 24 nt, Human
caccugcauggacacagccagcag

SEQ ID NO: 468663 - RNA, 23 nt, Human
cacugcccgccgcuccagcuggg

SEQ ID NO: 468664 - RNA, 19 nt, Human
cagcagggaggggcggaag

SEQ ID NO: 468665 - RNA, 20 nt, Human
cagcagggaggggcggaagu

SEQ ID NO: 468666 - RNA, 19 nt, Human
cagcggcgggaagagcucc

SEQ ID NO: 468667 - RNA, 21 nt, Human
cagcugggccuccccaggcuc

SEQ ID NO: 468668 - RNA, 21 nt, Human
cauguccuccuccccaccuca

SEQ ID NO: 468669 - RNA, 23 nt, Human
ccaacaccugcauggacacagcc

SEQ ID NO: 468670 - RNA, 24 nt, Human
ccacccccggauccauguccuccu

SEQ ID NO: 468671 - RNA, 20 nt, Human
ccaggcaccccagcugugcu

SEQ ID NO: 468672 - RNA, 22 nt, Human
ccaggcaccccagcugugcucc

SEQ ID NO: 468673 - RNA, 20 nt, Human
ccaguuccuggaagcccaca

SEQ ID NO: 468674 - RNA, 23 nt, Human
ccaucuaagggcgaaggggcgag

SEQ ID NO: 468675 - RNA, 25 nt, Human
ccauucgggcgccgccgccucggcg

SEQ ID NO: 468676 - RNA, 19 nt, Human
cccaccucaucccggcuca

SEQ ID NO: 468677 - RNA, 19 nt, Human
ccccacggccacccccgga

SEQ ID NO: 468678 - RNA, 19 nt, Human
ccccugcugggccugggga

SEQ ID NO: 468679 - RNA, 25 nt, Human
ccccugcugggccuggggaggcucc

SEQ ID NO: 468680 - RNA, 21 nt, Human
cccgcagcugcaggcggaggc

SEQ ID NO: 468681 - RNA, 18 nt, Human
cccugugguacccucucc

SEQ ID NO: 468682 - RNA, 19 nt, Human
cccugugguacccucuccc

SEQ ID NO: 468683 - RNA, 25 nt, Human
cccugugguacccucucccagcccc

SEQ ID NO: 468684 - RNA, 22 nt, Human
ccgcgcccauggccucucggcg

SEQ ID NO: 468685 - RNA, 24 nt, Human
ccgcuccagcugggccuccccagg

SEQ ID NO: 468686 - RNA, 21 nt, Human
ccggauccauguccuccuccc

SEQ ID NO: 468687 - RNA, 25 nt, Human
ccucugccuggaacauucucuccuc

SEQ ID NO: 468688 - RNA, 23 nt, Human
ccugccccaggaaagacacccgc

SEQ ID NO: 468689 - RNA, 21 nt, Human
ccuggaacauucucuccuccc

SEQ ID NO: 468690 - RNA, 18 nt, Human
ccuggaugggugccccaa

SEQ ID NO: 468691 - RNA, 22 nt, Human
cgagcggggggggagaaacugg

SEQ ID NO: 468692 - RNA, 21 nt, Human
cgcccucacggacaaggugac

SEQ ID NO: 468693 - RNA, 24 nt, Human
cgccuucguugagaccuugaagac

SEQ ID NO: 468694 - RNA, 20 nt, Human
cgcgccccacggccaccccc

SEQ ID NO: 468695 - RNA, 21 nt, Human
cggaaccaaaugccuuggcca

SEQ ID NO: 468696 - RNA, 23 nt, Human
cggaaccaaaugccuuggccaac

SEQ ID NO: 468697 - RNA, 26 nt, Human
cggaaccaaaugccuuggccaacgcc
